United States Patent 7,795,419 (VIRAL AND VIRAL ASSOCIATED MIRNAS AND USES THEREOF) - sequence listing, part 2

SEQ ID NO: 28371 - RNA, 61 nt, Human
uuuaaaccaucuggcuggaucucguggccuucccccucagacuacccaugucuccacgaag

SEQ ID NO: 28372 - RNA, 61 nt, Human
gggguacagguggguucccucaucuggaguucccccucaauaaagcaaggucuggaccugc

SEQ ID NO: 28373 - RNA, 61 nt, Human
auuuuuaauuagauaauccacucauguauuucccccucacugcaguugucugcauuuuuag

SEQ ID NO: 28374 - RNA, 61 nt, Human
acuuucuuguagcaaucucguaagcagugaacccccucagaucaguagaauauaguaucug

SEQ ID NO: 28375 - RNA, 61 nt, Human
uucuguaccaugccuucagaaaccuucuuaucccccucaucucuggggcccccuguggauc

SEQ ID NO: 28376 - RNA, 61 nt, Human
caaaauggcaaacauuuagcuagauugaccacccccucaaaagacucaaauuacuagaauc

SEQ ID NO: 28377 - RNA, 61 nt, Human
cugccugugccuagaucagaggcccagagggcccccucaguugccugagcagcugguggcu

SEQ ID NO: 28378 - RNA, 61 nt, Human
ccgcuuacaauaguccucccucuguuccugacccccucacacacacuggaaagugagggug

SEQ ID NO: 28379 - RNA, 61 nt, Human
gucaggaaugaaggaugcuugcacacaugcacccccucacucucacacuugcacacauaca

SEQ ID NO: 28380 - RNA, 61 nt, Human
cccaccccuagccaccaguguccuccaagugcccccucaccucuccaggugcucauuguaa

SEQ ID NO: 28381 - RNA, 61 nt, Human
agccucaguccccagcagagccugugucucacccccucacaggacagagcuguaucugcau

SEQ ID NO: 28382 - RNA, 61 nt, Human
ccgucugugucagcccagcucugccucgcagcccccucagcaugggugcccccagaaguaa

SEQ ID NO: 28383 - RNA, 61 nt, Human
ugcuucaacuaccaaaauguuaucuccacuucccccucacccguagaggauccuggccaca

SEQ ID NO: 28384 - RNA, 61 nt, Human
gcugauuguaguacaccugcuagcucuguugcccccucaaaacugcacccagagcagggcc

SEQ ID NO: 28385 - RNA, 61 nt, Human
aaccucccaccccuucaauguggggacgagacccccucaucucagaguaaugggaagaacc

SEQ ID NO: 28386 - RNA, 61 nt, Human
cagcacagacuacgggaggggcuggcucccucccccucagacccucacuuccuguaccuag

SEQ ID NO: 28387 - RNA, 61 nt, Human
ucuuaaaucagcaguauuaugaaaaaaaauucccccucauuagaauguuuaagaaaucuuu

SEQ ID NO: 28388 - RNA, 61 nt, Human
agcagcccacaagauguagcacuauuagugucccccucagaggcuuaauguugccugugga

SEQ ID NO: 28389 - RNA, 61 nt, Human
ccagacccagccccgguggcugaagaggcugcccccucagcugucgaggagggggccgccg

SEQ ID NO: 28390 - RNA, 61 nt, Human
ggaggagagagggggagaccccuuugccuuccccccucagcaaggggcugcuucuggggcu

SEQ ID NO: 28391 - RNA, 61 nt, Human
cgcccagaggcaugcaggcugcugggcaccacccccucauccagggaacgagugugucuca

SEQ ID NO: 28392 - RNA, 61 nt, Human
cgaauggauuccauuaaacugcauuaagaaacccccucauggaucugcauaaccgcacaga

SEQ ID NO: 28393 - RNA, 61 nt, Human
agcucucaugguuuacaggaaggcucugguucccccucacaggaugagcaugcucaguugg

SEQ ID NO: 28394 - RNA, 61 nt, Human
aauaacuaucaauauccauuuccauucaucucccccucaaaucauagccuaacagaacacu

SEQ ID NO: 28395 - RNA, 61 nt, Human
acaggcugaggcaacauggaucagugugugucccccucaggaauguauccacaguggccuu

SEQ ID NO: 28396 - RNA, 61 nt, Human
auauuuuucuucuuuagucauggagaacucccccccucaucucuucccuauuaucuuuccc

SEQ ID NO: 28397 - RNA, 61 nt, Human
cccucuccuucuuucuccuucaagguucuuucccccucaguuuuguuguugucuuacucug

SEQ ID NO: 28398 - RNA, 61 nt, Human
agugauggacaaaacagguaaaaaaucgcugcccccucagagcugacauucugggguggga

SEQ ID NO: 28399 - RNA, 61 nt, Human
cacacccaagugccccucacaccucgugccucccccucacaggguggccaccugcaccagc

SEQ ID NO: 28400 - RNA, 61 nt, Human
ggccccucucugucccaccuugcacaaaggacccccucagaccaggcccuugucugugccc

SEQ ID NO: 28401 - RNA, 61 nt, Human
ucucacugaccugaccgcccaccaccuccuucccccucaucacaugacaaaggauaaugug

SEQ ID NO: 28402 - RNA, 61 nt, Human
gaaaguauguaaccagaauugguuagugugacccccucaaguagcaagugauggaaaauaa

SEQ ID NO: 28403 - RNA, 61 nt, Human
ggagucaguccuaggcuggaugggaggguggcccccucaagaggacucccagccuccacau

SEQ ID NO: 28404 - RNA, 61 nt, Human
uguaccuauuuacacccagaacuuuccagcucccccucaucaugccuccuccuuccuaccu

SEQ ID NO: 28405 - RNA, 61 nt, Human
caacccugguccccaccccuaaccuccugcucccccucaagccaacuaugcagcccacaag

SEQ ID NO: 28406 - RNA, 61 nt, Human
cucugccccucuucccuggccaggggcuucucccccucagcucucccucacaccucccuuc

SEQ ID NO: 28407 - RNA, 61 nt, Human
ugugucagugccuggggggaggggaggagcacccccucagccccccugaaccugaccaaaa

SEQ ID NO: 28408 - RNA, 61 nt, Human
uuuuuuuauuguugaaucauuuugugaaugucccccucaaaaaaagcuaauggaauauuug

SEQ ID NO: 28409 - RNA, 61 nt, Human
auuuauacagugccuugcucggcgcccaccacccccucaagccccagcagcccucaacagg

SEQ ID NO: 28410 - RNA, 61 nt, Human
aaagaaucaucaagaaagcuauuuauauaaacccccucagucauuuugaaauaaaauuaau

SEQ ID NO: 28411 - RNA, 61 nt, Human
guucuuuuuacucuaauguucuuuugguuuccccccucagaagaaucaugaauuugcaaca

SEQ ID NO: 28412 - RNA, 61 nt, Human
aacccuggguuuuuaagagcaaauucugucccccccucacucccccaagugacaagauacu

SEQ ID NO: 28413 - RNA, 61 nt, Human
cagcccaaguggggucaacuccuaagccccacccccucacacacaccgccuucccuguuuu

SEQ ID NO: 28414 - RNA, 61 nt, Human
gcucccaccccgccacaucccaacuucauuucccccucacuguagcccauuuccaccccac

SEQ ID NO: 28415 - RNA, 61 nt, Human
ccaaucccuuccuuugguccuuugguacgcacccccucagagcugagauggaagacauggc

SEQ ID NO: 28416 - RNA, 60 nt, Human
agcucguggggauggagugacagccucagucccccucagcacagacaaaagccagcagag

SEQ ID NO: 28417 - RNA, 61 nt, Human
aaauuauggccuaacuuccugagagaccgaacccccucaccugaaucccccucuaucaaac

SEQ ID NO: 28418 - RNA, 61 nt, Human
acaucucauuucuuccuuuugcuguugcuuccccccucacacacuugguuuuguucuaucc

SEQ ID NO: 28419 - RNA, 61 nt, Human
uaauauggauucugacucuuaagugcuuccgcccccucacuaccuccuuuaauacaaauuc

SEQ ID NO: 28420 - RNA, 61 nt, Human
ccuccccaccccacucccagccuuaucuauccccccucacuguccccuuuucuccacuccc

SEQ ID NO: 28421 - RNA, 61 nt, Human
cuuucagcaucggcucuucagcagauccaaacccccucagcaacuugcagaggaccugucc

SEQ ID NO: 28422 - RNA, 61 nt, Human
gagggccugaggguacauuucuccaccugugcccccucauguucacagaggauuucagcag

SEQ ID NO: 28423 - RNA, 61 nt, Human
ugugucuggguugcuuauuucccucaucuugcccccucaucucacugcccaguuucuuuuu

SEQ ID NO: 28424 - RNA, 61 nt, Human
ucccaaacugaccaggcugaugucaaccuaacccccucaggggcagggaacaggggagggc

SEQ ID NO: 28425 - RNA, 61 nt, Human
aggagaaaggaggggagaaagcgggcucucacccccucaggagugggcacgggagcccuuc

SEQ ID NO: 28426 - RNA, 61 nt, Human
uuauuguugaggggaagaccacaugguucuucccccucagccaucuuugagcaguaaauug

SEQ ID NO: 28427 - RNA, 61 nt, Human
cccacaaggcagcugacccugaaagcagccucccccucauggagagucagcagcuugggca

SEQ ID NO: 28428 - RNA, 61 nt, Human
cuuggggacgagggagaggacugauucagggcccccucagcugucuccucccucccucugg

SEQ ID NO: 28429 - RNA, 61 nt, Human
agacuggagcucccugaagauggggcugugucccccucagacuggggcugccugaggauga

SEQ ID NO: 28430 - RNA, 61 nt, Human
ugugcucuguuccuuaucaaaaacagcacaacccccucaaucugcccauuuaaaaauuggu

SEQ ID NO: 28431 - RNA, 61 nt, Human
aucacuccagggagcacccgcaggagcugggcccccucacgccugccuuccugggccagcu

SEQ ID NO: 28432 - RNA, 61 nt, Human
gcuagucagacaugagcagggcaggggagggcccccucaccaggaaugucaggcaaccauc

SEQ ID NO: 28433 - RNA, 61 nt, Human
uuucccuuuuccccagcugaugaggagccggcccccucaguucccacuugcuuggguuccu

SEQ ID NO: 28434 - RNA, 61 nt, Human
ugucccuucacuguuuagagcaugacacucucccccucaacagccuccugagaaggaaagg

SEQ ID NO: 28435 - RNA, 61 nt, Human
ucuagguaaguuuguuccugucaauugggaacccccucaaccacuuccauuccccaaauac

SEQ ID NO: 28436 - RNA, 61 nt, Human
ggccaaacgccggacccucagucgcuccaggcccccucacccucaaaguguagcgccccca

SEQ ID NO: 28437 - RNA, 61 nt, Human
uccuacugucuugucugugggacaguugccucccccucaucuccagugacucagccuacac

SEQ ID NO: 28438 - RNA, 61 nt, Human
aaagggaugcagauuauccuguuccucacgacccccucagcuaacaacaguucugaagggu

SEQ ID NO: 28439 - RNA, 61 nt, Human
ggcuccccaccccaccuuugauggccucuuccccccucacccuagggugucccgagaugac

SEQ ID NO: 28440 - RNA, 61 nt, Human
ugccuuagcccagguuccugggcuucugcugcccccucaggaccccagcuaaccucagaac

SEQ ID NO: 28441 - RNA, 61 nt, Human
agaaauagugcacuccaagaaacguggaucucccccucauccaacuccgaaagucugaauc

SEQ ID NO: 28442 - RNA, 61 nt, Human
ucucaauaaagccaaaaaucuuucucuuucucccccucaggccaccuccuguccucacucc

SEQ ID NO: 28443 - RNA, 61 nt, Human
cuccuacacuucucagcccauugcuuugccacccccucaugugccagggcaucccauucca

SEQ ID NO: 28444 - RNA, 61 nt, Human
uuauucucuggggagggccagcggcucgcaucccccucaucuccagcugcagcucggaugg

SEQ ID NO: 28445 - RNA, 61 nt, Human
cagcacagggaccccggaugaagacucuguccccccucaggcauucagcugcccacaaguu

SEQ ID NO: 28446 - RNA, 61 nt, Human
ggugcuuugucccagcuccugcacccacaggcccccucagggcuccuugccuuuccccccc

SEQ ID NO: 28447 - RNA, 61 nt, Human
acaaaacccaccagaaucuaagcaguuuucacccccucagaaaccacugucauuaguuuac

SEQ ID NO: 28448 - RNA, 61 nt, Human
gguguagggcccccagccccugagaccuaaucccccucaugcuagccuagucccuggagga

SEQ ID NO: 28449 - RNA, 61 nt, Human
augagcauuccuaguucuacacuucuuuuuucccccucauguguaaaaugaaaagaaaacu

SEQ ID NO: 28450 - RNA, 61 nt, Human
aagaguugucuuguccccucuugacccaucucccccucacugaaugccucaaugugaccag

SEQ ID NO: 28451 - RNA, 61 nt, Human
uugaucuucaggaugcacgguuucuguucugcccccucagggaugugggaaucucccagac

SEQ ID NO: 28452 - RNA, 61 nt, Human
uccgcgucccacuagcaggcggagccccccacccccucagcagggccggagaccuagguaa

SEQ ID NO: 28453 - RNA, 61 nt, Human
gcaguguuugagagggucugcuuuaccauuacccccucaauaucaugaucauccaaucuca

SEQ ID NO: 28454 - RNA, 61 nt, Human
cugcggagaacacccuugguggcuuaugggucccccucagcaagcccuacagagcugugga

SEQ ID NO: 28455 - RNA, 61 nt, Human
cacuuuucugucuuagaaaauugugggaauccccccucacucugccuauguugcacucucu

SEQ ID NO: 28456 - RNA, 61 nt, Human
ucagaaggguucauggcccuuuccccuccuccccccucagcugggccuggggaggagucga

SEQ ID NO: 28457 - RNA, 61 nt, Human
gugcccaacaucucccagccuccccaggugccccccucaccuugaugggugcguucccgca

SEQ ID NO: 28458 - RNA, 61 nt, Human
gguaacugggggaaggugauggggcgggggucccccucaaccgcagacuucaggcugcuuu

SEQ ID NO: 28459 - RNA, 61 nt, Human
agcgcucggagcccccccaggacacucugcacccccucaccccgguccuccucauuagggu

SEQ ID NO: 28460 - RNA, 61 nt, Human
gcacacugaugggaagcuucccucucccaggcccccucaggagaagguggaagagaaaggg

SEQ ID NO: 28461 - RNA, 61 nt, Human
ucaagacuauuuagugacucucucugcaugucccccucacccgccaacccuccguuucauu

SEQ ID NO: 28462 - RNA, 61 nt, Human
cagggcggccucccaggucccauaaggguagcccccucaucugcaggacagagggaagcca

SEQ ID NO: 28463 - RNA, 61 nt, Human
caguccccggcagugagcuauggacuuucuucccccucacaaggcugggggccuccugcuc

SEQ ID NO: 28464 - RNA, 61 nt, Human
aaaaguccugcgcugcggaggacaggaagcacccccucaauagccagcacccacagugagc

SEQ ID NO: 28465 - RNA, 61 nt, Human
gagcuggcagcugcugaugguguuucccaaccccccucacuucccaagacaacccccagcu

SEQ ID NO: 28466 - RNA, 61 nt, Human
gcccaagagccuuaccgggcauucccugaagcccccucauaggcagugauccuagaccaaa

SEQ ID NO: 28467 - RNA, 61 nt, Human
uugcuucaagauucaaacagagacucccagucccccucagcaucuucccugaaucacagcc

SEQ ID NO: 28468 - RNA, 61 nt, Human
cauucaagagggcacugccugcauucccuuccccccucaaaggcccggcccugcuauuauc

SEQ ID NO: 28469 - RNA, 61 nt, Human
ccuggggugggcuucucugagcaggacccagcccccucagcugccuccuggcugcugcugc

SEQ ID NO: 28470 - RNA, 61 nt, Human
uuaauuaagaauagcuacacucacaaaaauacccccucaugaaauaacuguucucuuggau

SEQ ID NO: 28471 - RNA, 61 nt, Human
auuuaaaauuguaauagaucuuaaccauuuucccccucacccuaacucucuuauucugccg

SEQ ID NO: 28472 - RNA, 61 nt, Human
gcaauuuuuagugggaaagaacagcucaucucccccucaugugaaagauuaaauuguaaag

SEQ ID NO: 28473 - RNA, 61 nt, Human
ccaaaguucugggaauuucuagcuuauucugcccccucauagcccuuggccuaucuaucuu

SEQ ID NO: 28474 - RNA, 61 nt, Human
gccaauguccuugucucuugucuuuggccagcccccucagcccagcccaccccacccgcug

SEQ ID NO: 28475 - RNA, 61 nt, Human
aucucugaccagcugggaaccugcuuggggucccccucaaaccugugucuggggugugggc

SEQ ID NO: 28476 - RNA, 61 nt, Human
ggaggcucugguugucugagcaccaugggggcccccucaccuugucccuccucagccagca

SEQ ID NO: 28477 - RNA, 61 nt, Human
ugggccaugcagcuaacccacccaccaaagacccccucacccuggccccuugggcuggacc

SEQ ID NO: 28478 - RNA, 61 nt, Human
cuaugcaagugccccuguggcuuguccccaacccccucagcaacaaagcucagcuggggaa

SEQ ID NO: 28479 - RNA, 61 nt, Human
ugugggaaauuaagauuacagaugcuuugggcccccucaaacaguacauugcuacaguuca

SEQ ID NO: 28480 - RNA, 61 nt, Human
agagcuuugugucgcuucucacuccucaaagcccccucaggagcacccaguccucagcugc

SEQ ID NO: 28481 - RNA, 61 nt, Human
gcggggccugggaugcccgcgccacccgcagcccccucacucggcggaaacccgcgagccg

SEQ ID NO: 28482 - RNA, 61 nt, Human
ggucccagaagucuucuguucucuggccucacccccucagucgccauagagcugggccugg

SEQ ID NO: 28483 - RNA, 61 nt, Human
ccccugugccugugucucuacacacuccacacccccucaaacucuguuuaucuguucucug

SEQ ID NO: 28484 - RNA, 61 nt, Human
gccguuuccaauucuaaaacagacucaaugucccccucacccccaccucaaggucaggaug

SEQ ID NO: 28485 - RNA, 61 nt, Human
ccugucccaaggagcugggaacuugguguugcccccucaauuuccagcaccagaaagagag

SEQ ID NO: 28486 - RNA, 61 nt, Human
ucugucaggucccaguugccuuucugacggccccccucagagggacggcgaugagcacuaa

SEQ ID NO: 28487 - RNA, 61 nt, Human
ggagagagccucuacaacaugcuggcaacuucccccucacugauucaaauguuaaucuccu

SEQ ID NO: 28488 - RNA, 61 nt, Human
aucuccgggcagccaccaccuccucggucugcccccucauuaaaauucacguucccacccu

SEQ ID NO: 28489 - RNA, 61 nt, Human
cuucccagccuuccucacaggcuucugccgccccccucaucuccacccucccccauaucug

SEQ ID NO: 28490 - RNA, 61 nt, Human
gccugggcucucccagccucccagcccucugcccccucagauggcuuuuuguuuuuguuuu

SEQ ID NO: 28491 - RNA, 61 nt, Human
gauuuagauucugagcccauaauggcaacagcccccucaccuaugggaagcugacuucccu

SEQ ID NO: 28492 - RNA, 61 nt, Human
gggauugccaugccccagucuucgcaccucgcccccucacccccuaacucacagcacaaac

SEQ ID NO: 28493 - RNA, 61 nt, Human
gaauuccugccccucuuuaccaccucuuccucccccucaaaggaaaaacauuucauccaag

SEQ ID NO: 28494 - RNA, 61 nt, Human
ucauugcacagcaaagccaugugcagggcgucccccucaacccugcccugaacaugcccca

SEQ ID NO: 28495 - RNA, 61 nt, Human
agucuccucacagcagagagacccaccggagcccccucaacuuugcagaugcccaccugga

SEQ ID NO: 28496 - RNA, 61 nt, Human
gguccaggggucugggcacuguacauaccugcccccucauccuuggguccuucauuauuau

SEQ ID NO: 28497 - RNA, 61 nt, Human
cccugugggagaugcaccccauucuugggcccccccucauucccuuuccgaaaaaggaaaa

SEQ ID NO: 28498 - RNA, 61 nt, Human
agggaacuccagagcugcccaccucccacugcccccucagcacacacacaguccccaggcg

SEQ ID NO: 28499 - RNA, 61 nt, Human
acucccucugucuuaugacuccccuccccaacccccucaucuaaagacaccuuccuuucca

SEQ ID NO: 28500 - RNA, 61 nt, Human
accccauaccacacuggggggucugagccaccccccucagccccguucggcucagaccgac

SEQ ID NO: 28501 - RNA, 60 nt, Human
gagucuccugcccucccugaacccaccuggcccccucagcucuguccuguuaggccaacu

SEQ ID NO: 28502 - RNA, 61 nt, Human
agccagucaccagagcgcccaccuggcacaccccccucaccccagcccugcgcaugggccu

SEQ ID NO: 28503 - RNA, 61 nt, Human
ugugcccaugggcacugcuggguggcccauccccccucaccaggggcaggcacagcacagg

SEQ ID NO: 28504 - RNA, 61 nt, Human
gccucaacaguagcccccgggcccccgucagcccccucaaguucuccccuuuugagggguu

SEQ ID NO: 28505 - RNA, 61 nt, Human
cccucgaccaccgccccucuccccauccguccccccucagggaccaagaaguccaagaggg

SEQ ID NO: 28506 - RNA, 58 nt, Human
gaaccuugcggcccagaugaggaaggaacccccucaccaccugcccggcccaggagcg

SEQ ID NO: 28507 - RNA, 61 nt, Human
aggccccagcucuccacccugaacuccccagcccccucagaguacuaggaccacagaagcc

SEQ ID NO: 28508 - RNA, 61 nt, Human
aacucugccuucuccguugucaauaaagccucccccucaugaccuaaacucugggcuuuuc

SEQ ID NO: 28509 - RNA, 61 nt, Human
gaauuguuccuuauuaccaaacucccaguaacccccucaaagaauaauugccccuugcuua

SEQ ID NO: 28510 - RNA, 61 nt, Human
ugugugaaucuuuuuccaccugccacugcuccccccucagcaucuccaaauauauuuaugc

SEQ ID NO: 28511 - RNA, 61 nt, Human
ccuccuuuccuugggucucuuggccuccagacccccucaauagacacugacuaaagucagg

SEQ ID NO: 28512 - RNA, 61 nt, Human
ugcccuccugguacuguugucuuccccucggcccccucacauguguauucagcagcccuau

SEQ ID NO: 28513 - RNA, 61 nt, Human
auuagaaucuguuugcaaauuguccaacccacccccucaacaugaggggcuuccauuuucu

SEQ ID NO: 28514 - RNA, 61 nt, Human
cgugccccuggcccaggggucucuuccccugcccccucaguuuuccacuuuugggguuuuu

SEQ ID NO: 28515 - RNA, 61 nt, Human
cccuuccuccugcaucuccccuucuuuccuucccccucaggagagagaaaacuuagugcuu

SEQ ID NO: 28516 - RNA, 61 nt, Human
cugcagaaccagcgugugauggggugcagaccccccucauggaguauggggcgcuggacac

SEQ ID NO: 28517 - RNA, 61 nt, Human
cuuauuuuccaagaguccuccauuuuuugcacccccucaccgccaacucuguuauucagua

SEQ ID NO: 28518 - RNA, 61 nt, Human
gaggaagaagaguguuuacaaaguccuguagcccccucaccuuucuguuuucacuuuugcc

SEQ ID NO: 28519 - RNA, 61 nt, Human
ggagcaugccauuggaaaacccacccccacccccccucaaaaaaacagaacaguaaaccaa

SEQ ID NO: 28520 - RNA, 61 nt, Human
uuccauuugguacaaaauuuuuacuccaacacccccucaacccuuuucucagggaccacac

SEQ ID NO: 28521 - RNA, 61 nt, Human
guggucccaagguucugggagaaacaggggacccccucaccuccugggcagugaccccuac

SEQ ID NO: 28522 - RNA, 61 nt, Human
cuuuucaugucccgauaagaagccaaugauccccccucaggacaaaucuacuccagccacg

SEQ ID NO: 28523 - RNA, 61 nt, Human
uaggggugguccgugugaggugucauccugucccccucauaauuacuaauagcuggaacug

SEQ ID NO: 28524 - RNA, 61 nt, Human
caagugaggggcccuuugcauagcucuccuucccccucacugaagcuggguagccuauugg

SEQ ID NO: 28525 - RNA, 61 nt, Human
gauccuuaaaucuccauucuguuugugguugcccccucaaccuccccuacacccuuccuau

SEQ ID NO: 28526 - RNA, 61 nt, Human
caugggggcuucugggaacccccguauucuucccccucacccaagggcagugggcaugaau

SEQ ID NO: 28527 - RNA, 61 nt, Human
gaaaccucccuaccaaaaagacagagacccgcccccucacacacaaacacacauguccugu

SEQ ID NO: 28528 - RNA, 61 nt, Human
aauaagauccuuaaaauaaacucuugggcaucccccucaccagcugacuggcuuuccggag

SEQ ID NO: 28529 - RNA, 61 nt, Human
agaaauuacuuaccugacauccacccccauucccccucauccugcugggguugaaaguucc

SEQ ID NO: 28530 - RNA, 61 nt, Human
guuggggcaaggcaaaacuaacuuagaguuucccccucaacaacauccaaguccaaacccu

SEQ ID NO: 28531 - RNA, 61 nt, Human
ugauuuuucauucugccacuccaucuucaaacccccucaccuuucccauccuacuccugcc

SEQ ID NO: 28532 - RNA, 61 nt, Human
cuccacagugaggagccagccagacaucucucccccucacccccuguggacaucacgguuc

SEQ ID NO: 28533 - RNA, 61 nt, Human
ggacuaaugcaugugguaugaguagguuuggcccccucacuaucucuagagugagaaucug

SEQ ID NO: 28534 - RNA, 61 nt, Human
ggccgcaggcugugcccccgagcugcccccacccccucacagggucccucagauuauaggu

SEQ ID NO: 28535 - RNA, 61 nt, Human
ccccuaaaucacuuugagccugggaaauaagcccccucaacuaccauuccuucuuuaaaca

SEQ ID NO: 28536 - RNA, 61 nt, Human
ucaucuuuugccuuacugauaauaccauaaucccccucaauucagaccuucugauugagug

SEQ ID NO: 28537 - RNA, 61 nt, Human
ggauccccaauccacgcccuucuaguccaaccccccucaaugagagaggcaggcagaucuc

SEQ ID NO: 28538 - RNA, 61 nt, Human
ccugccucuucuggccuggugucuccucaugcccccucagugaggaucuucauguaccugc

SEQ ID NO: 28539 - RNA, 61 nt, Human
ggucuugaacuccugggcucaagcaauucaucccccucagccucccaaagugcuaggauua

SEQ ID NO: 28540 - RNA, 61 nt, Human
cagggugccauucauugucuuucucuccuagcccccucaggaaagaaggacuauauuugua

SEQ ID NO: 28541 - RNA, 61 nt, Human
cccccagcaccucagaaugugcccucccucucccccucauaaccccaccuaacauaaggac

SEQ ID NO: 28542 - RNA, 61 nt, Human
aaaaagagucucccccuuaaauuuccugguacccccucaccuaugccugaaagcauuucac

SEQ ID NO: 28543 - RNA, 61 nt, Human
caacagcaacaaauccaccuccaccccaucucccccucauaucccugacccaaagcaaagg

SEQ ID NO: 28544 - RNA, 61 nt, Human
ucaaucgaagcaucugccucccaccccucggcccccucaagcccaccaucugcuucugagu

SEQ ID NO: 28545 - RNA, 61 nt, Human
cgucauuacuguccuccaugccuucagcagccccccucacagcuaagguacauaccacccc

SEQ ID NO: 28546 - RNA, 61 nt, Human
ugcagagggcucagcagagaacaguaugggacccccucaccaggccuggaacaccuccagc

SEQ ID NO: 28547 - RNA, 61 nt, Human
ugaggccugcccccugggcuggggccucagacccccucagccuugggaccgugcccacgag

SEQ ID NO: 28548 - RNA, 61 nt, Human
caguucuuggugacugucccaccgggagccucccccucagaugaucucuccacgguagcac

SEQ ID NO: 28549 - RNA, 61 nt, Human
cccuucagccuacugggccaggccggaccugcccccucagugucucucccucccgaguccc

SEQ ID NO: 28550 - RNA, 61 nt, Human
gaaaguccuccuucuaccaacuccaccuccacccccucauuccccuucucccaaaguacua

SEQ ID NO: 28551 - RNA, 61 nt, Human
uccacagccacuauuugcauugcugucccugcccccucaucacucccccugccaagacaaa

SEQ ID NO: 28552 - RNA, 61 nt, Human
uccagguguaauuauugcuuucauuccuuaccccccucaagcaaaugugaaaaguauacug

SEQ ID NO: 28553 - RNA, 61 nt, Human
ccagagcgcccucugaugagcccacugcccacccccucaagccaauccccuccuugggcac

SEQ ID NO: 28554 - RNA, 61 nt, Human
cccugguggagaaagcacugaccugucaugccccccucaaaccuccucuucugacgugccu

SEQ ID NO: 28555 - RNA, 61 nt, Human
caggagaccugccccucccccccgaccuccacccccucagacuccaucccccacccccagg

SEQ ID NO: 28556 - RNA, 61 nt, Human
acgcuguggaagcagccaaggcacuuccucacccccucagcgccacggaccucucugggga

SEQ ID NO: 28557 - RNA, 61 nt, Human
uuccaggggaauuaguccuccucucuucucucccccucagccuuucucucgccugccuucu

SEQ ID NO: 28558 - RNA, 61 nt, Human
ucacuacccagcagcaggcuggggaccuccucccccucaaaaaagguauuuuuuuauucua

SEQ ID NO: 28559 - RNA, 61 nt, Human
uuacaguuguaacaagccuacuucauauuggcccccucaguuagccuuuuugaggcaaugc

SEQ ID NO: 28560 - RNA, 61 nt, Human
gcuuugggccaaaagcaggcguugggggguccccccucaaguuuggagccguuuccguggu

SEQ ID NO: 28561 - RNA, 61 nt, Human
cuuucaucuucaggcagaagccucugcccaucccccucaagggcugcaggcccaguucuca

SEQ ID NO: 28562 - RNA, 61 nt, Human
uuacaggcaugagccaccacacccagcuccucccccucaaacuucugugcacaaagugcuc

SEQ ID NO: 28563 - RNA, 61 nt, Human
acagggacagaccagaggcccugcaaggacucccccucagaccuccaaagggcaacagaag

SEQ ID NO: 28564 - RNA, 61 nt, Human
ucucuacaaaugugccguuuuaagaauaaaacccccucaaaucucucccccgaggccuguu

SEQ ID NO: 28565 - RNA, 61 nt, Human
uuguauaucaaaagcuccaaccauguccucucccccucagccuguggguggcacgagcaag

SEQ ID NO: 28566 - RNA, 61 nt, Human
ucggguguggguucuacagccuugucccccucccccucaaccccaccauaugaauuguaca

SEQ ID NO: 28567 - RNA, 61 nt, Human
caugcagaggcuccuggaucugggaagcccgcccccucacaaaugcugagccguucuugcu

SEQ ID NO: 28568 - RNA, 61 nt, Human
cugguggcguguuaguuucugcccaguucuacccccucaugugcuucuucugaauacugaa

SEQ ID NO: 28569 - RNA, 61 nt, Human
cccgaggcuagcaccgugucugugucugucucccccucagaggagcucucucaaaaugggg

SEQ ID NO: 28570 - RNA, 61 nt, Human
caaacuaaggagugacuagguggguuggggacccccucaggauuguuucucggcaccagug

SEQ ID NO: 28571 - RNA, 61 nt, Human
aaaugagcauguaauaauacaagaacuguuucccccucaaaaccugaaccugaauuauuug

SEQ ID NO: 28572 - RNA, 61 nt, Human
cucgaggccucuucugaccucaagggucacacccccucaaagauccucucacccaugguag

SEQ ID NO: 28573 - RNA, 61 nt, Human
auaggguggccacacuagggcgggguccuuccccccucacagcuuuggccccuuucagaga

SEQ ID NO: 28574 - RNA, 61 nt, Human
acucgucuuuaggcaaaaccuacagcgcccccccccucaccccagaccuacagaaucagag

SEQ ID NO: 28575 - RNA, 61 nt, Human
gcgcugaguagggacucagggccaugccugccccccucaucucauucaaaccccacccuag

SEQ ID NO: 28576 - RNA, 61 nt, Human
auggacgaagacccccuccagagcaaggaggcccccucagcccugugguuacagccgcuga

SEQ ID NO: 28577 - RNA, 61 nt, Human
ggagccugccgcccccgccugggcaccgggacccccucaccauccagugggcccggagaaa

SEQ ID NO: 28578 - RNA, 61 nt, Human
ucuccucuccgcgcccuccgaccucucucggcccccucaccccagcuccgaccucucucag

SEQ ID NO: 28579 - RNA, 61 nt, Human
uugggaagcugggggaaggguggucugagcacccccucauuccccucgugugacucucuug

SEQ ID NO: 28580 - RNA, 61 nt, Human
uuuauuugacguuuuauuuugguuuuccccacccccucaaucugucggggagccccugccc

SEQ ID NO: 28581 - RNA, 61 nt, Human
guuuuuuuuugccacccuggacacauguuggcccccucaaagaauuucuguggggauuugu

SEQ ID NO: 28582 - RNA, 61 nt, Human
uacuucuggcuuguugcaagaggaguagaugcccccucacccacacaaaccccacucaguc

SEQ ID NO: 28583 - RNA, 61 nt, Human
uccucucugaccaugacccaggcauccuugucccccucacccacccagagcuaggggcggg

SEQ ID NO: 28584 - RNA, 61 nt, Human
ccugaacaucuaggcuggaaccugcacaccucccccucagcuccgucgugaaugggacaac

SEQ ID NO: 28585 - RNA, 61 nt, Human
auccaaauguuaccucuuaggggaaguuaugcccccucaacuauugucuuauuauaaugaa

SEQ ID NO: 28586 - RNA, 61 nt, Human
ugucucccucgggggcucuuccccuagaccucccccucacuuacauaaagcucccuugaag

SEQ ID NO: 28587 - RNA, 61 nt, Human
aaaugacuuuauugcuuaauuucugccuuuccccccucacacaugcacuuuugggccuuuu

SEQ ID NO: 28588 - RNA, 61 nt, Human
cugguuggcccaagcccugccugacugaccacccccucagagcacagaucagggaccucac

SEQ ID NO: 28589 - RNA, 61 nt, Human
guuuuuaucacaccugcuccccagauucccacccccucaauguuccucucacacgaaaccc

SEQ ID NO: 28590 - RNA, 61 nt, Human
ggcacugaggcacagaucgucaaggcagguacccccucaacccuucuuccacuggagcccc

SEQ ID NO: 28591 - RNA, 61 nt, Human
agcugggagggguuuucgaagcucagcccaccccccucauuuuggauauaggucagugagg

SEQ ID NO: 28592 - RNA, 61 nt, Human
uggcaaguacaguauccuuugggaaggccaucccccucaggacuguccuggcuccgaccuu

SEQ ID NO: 28593 - RNA, 61 nt, Human
ggcugucacuuuucugccagggguacugggucccccucagcacccuccacagcacaggccu

SEQ ID NO: 28594 - RNA, 61 nt, Human
gggugguaggagccacacagacucuucugagcccccucacucacuuccuucccccugugcc

SEQ ID NO: 28595 - RNA, 61 nt, Human
aaaauccugggcacuaugaaggaacccccugcccccucaccuuuuuggguagguaaaagac

SEQ ID NO: 28596 - RNA, 61 nt, Human
uuuuuuguucuuccuuccuuucuucccuccucccccucauccuucccuuucuccuucuuuu

SEQ ID NO: 28597 - RNA, 61 nt, Human
agggaaaauggggguccuugccucucguguacccccucaaggcugaccccuuagauggccc

SEQ ID NO: 28598 - RNA, 61 nt, Human
gaggauaaaaaggaaggagagaugaccccuacccccucaucccccaguuuugaaaaggucu

SEQ ID NO: 28599 - RNA, 61 nt, Human
ugucgcuuggcuaagugacucccagcccaagcccccucaagagucugggucgggggaggag

SEQ ID NO: 28600 - RNA, 61 nt, Human
aggcagggaagcccugagcacagguacgggccccccucagccccugccuccaucugccuga

SEQ ID NO: 28601 - RNA, 61 nt, Human
agggccugcagagggagauguggcccuuccucccccucauugaggacuuaauaaauuggau

SEQ ID NO: 28602 - RNA, 61 nt, Human
gggccaguccauuuuuggaggucacucuuuccccccucauccccucaccuccuucucuuua

SEQ ID NO: 28603 - RNA, 61 nt, Human
cucucuccacagugugagugcacgugugaagcccccucacucuuccgcuagggauaaagca

SEQ ID NO: 28604 - RNA, 61 nt, Human
aaaugcccauguccacagcuuguacacacugcccccucacuaucuuguuauccaguggcau

SEQ ID NO: 28605 - RNA, 58 nt, Human
ugaaaauccgccgggccugaagggcuggcccccucaggcaccuuuccuccccuggaca

SEQ ID NO: 28606 - RNA, 61 nt, Human
ggccagcauccuccugcugcaggaaguggaucccccucagccaccucaauucuucaaaaga

SEQ ID NO: 28607 - RNA, 61 nt, Human
auugggggagguacauuccugcaucuucucacccccucaaccaggaacuggggauuuggga

SEQ ID NO: 28608 - RNA, 61 nt, Human
ggcccugaggaaucccgggcgccggcaaggccccccucagcccgccagcugagggguccca

SEQ ID NO: 28609 - RNA, 61 nt, Human
ccauagcauguucauuaggggauuccuuccucccccucaucucacaggggaagggagagga

SEQ ID NO: 28610 - RNA, 61 nt, Human
ugccaaagacguguccgaccuacguuccuggcccccucauucagagacugcccuucucacg

SEQ ID NO: 28611 - RNA, 61 nt, Human
acccggaaacagacaagcaacccaaacugaacccccucaaaagccaaaaaaugggagacaa

SEQ ID NO: 28612 - RNA, 61 nt, Human
aagcaagucuauaaauaucggcugcagccaucccccucauuuuaaauguugcccuaauaau

SEQ ID NO: 28613 - RNA, 61 nt, Human
cgggccccagguugauccugugacugaggcucccccucauguagccuccccaggcccaggg

SEQ ID NO: 28614 - RNA, 61 nt, Human
accccaccagccccuuucaucccuccuuccucccccucaguuuuuguuggaaagauuaucu

SEQ ID NO: 28615 - RNA, 61 nt, Human
caccaggagcccaccaccucccucuaggaugcccccucaggggcuggccaggcccugcuca

SEQ ID NO: 28616 - RNA, 61 nt, Human
accuugugucccagcccugcccuucuucccacccccucaaucugcuagucccugaagccuu

SEQ ID NO: 28617 - RNA, 61 nt, Human
uagaggacagcggcugccugucccuucuucacccccucacccccauaauuugucuagaucu

SEQ ID NO: 28618 - RNA, 61 nt, Human
gggcuucuacaugcuauccuuaagagcuucucccccucacccauuccuagugcucuuggua

SEQ ID NO: 28619 - RNA, 61 nt, Human
uguucccucauuugcacugcucuguaagccucccccucaccuccauucauaacccagucuc

SEQ ID NO: 28620 - RNA, 61 nt, Human
aaucagcccuucucccaggccugugcacacacccccucagcacucccuaugcacuuuccug

SEQ ID NO: 28621 - RNA, 61 nt, Human
uuguccaccucgcaggagccgccccccgggccccccucagccccccacuucccguacccgu

SEQ ID NO: 28622 - RNA, 61 nt, Human
gagaugggcuucccaagggcugccggggcagcccccucacaguauugcucacccagugccc

SEQ ID NO: 28623 - RNA, 61 nt, Human
cggggcagcccccuccgcgcccccggccguccccccucaucgccccgcgcccacccccauc

SEQ ID NO: 28624 - RNA, 61 nt, Human
ggcaggggaguggggccugagcugagcacugcccccucacccccccaccaccccuucccau

SEQ ID NO: 28625 - RNA, 61 nt, Human
uggcaggguagggaaggaggaccccgggcaccccccucagggccugacucacguacuguag

SEQ ID NO: 28626 - RNA, 61 nt, Human
uucccaguugccccuuugccauauuccaagucccccucagacuucaugucucugcucauca

SEQ ID NO: 28627 - RNA, 61 nt, Human
acauggaagcaacuccgucugcugcagcugacccccucacacugaguucacagugcgcccu

SEQ ID NO: 28628 - RNA, 61 nt, Human
cucaguuuuggacaagugacaaaccauuuugcccccucacucuucuuuuuuaacuguuaaa

SEQ ID NO: 28629 - RNA, 61 nt, Human
cccagccuggcugagcccgagauucgcuccucccccucaugccaaccccacacaggucccg

SEQ ID NO: 28630 - RNA, 61 nt, Human
gaaggagcugggggcagccugcguggcugaccccccucaggacccucgcuggcccccacug

SEQ ID NO: 28631 - RNA, 61 nt, Human
uauguauuccugaacuggagccccagacccgcccccucacugccuugcuauaggagucacc

SEQ ID NO: 28632 - RNA, 61 nt, Human
gcacuggggagggggcuucaaggagggagugcccccucagacucccugcuucccuggaagc

SEQ ID NO: 28633 - RNA, 61 nt, Human
gaccccugagaagaugccaggacuuauaguacccccucaggacauggacaguauguggggg

SEQ ID NO: 28634 - RNA, 61 nt, Human
aguuauuacaccccgacccuccuccugucagcccccucaccugcagccuguugcccaauaa

SEQ ID NO: 28635 - RNA, 61 nt, Human
ggggugggguggggccgaguggcugcccugccccccucauuugcauggcuccucccccacu

SEQ ID NO: 28636 - RNA, 61 nt, Human
ccugugugaacgcaggcaaaagcagcccagucccccucacugcuugagcuaacacugccac

SEQ ID NO: 28637 - RNA, 61 nt, Human
cuaggugguccuguccaggcuccugcagcgccccccucacuuugacacuggacuaggaugc

SEQ ID NO: 28638 - RNA, 61 nt, Human
ucagguguccacugcgggucuucaaacguaccccccucaggugagaggggacugcuguaca

SEQ ID NO: 28639 - RNA, 61 nt, Human
ccccagccucaggacugcaggagccauccgccccccucagccccuuccuccccagggagca

SEQ ID NO: 28640 - RNA, 61 nt, Human
uccuccucugcggggcucuccggacccccuucccccucaccuccaggcagggacagaauaa

SEQ ID NO: 28641 - RNA, 61 nt, Human
cugggcgacugcggggagcuugcucuucccucccccucaucacaguggccuucucauggca

SEQ ID NO: 28642 - RNA, 61 nt, Human
uccuggcugcaaccugcacggaugcuggauucccccucaccccaccucugcauggccaccc

SEQ ID NO: 28643 - RNA, 61 nt, Human
ccgccccaggggcaccccgacauccaggccacccccucauggugcuacagacccugcccug

SEQ ID NO: 28644 - RNA, 61 nt, Human
uagggcaguaguuccguaaguggaagcccagcccccucaacaucugguaccagcacuccgc

SEQ ID NO: 28645 - RNA, 61 nt, Human
gauaaucagagggacagaaacaccagcugcucccccucauccccuucacccuccugccccc

SEQ ID NO: 28646 - RNA, 61 nt, Human
uagggccgccgccaccuccccugggaccccgcccccucauccugccuccaguucccggcca

SEQ ID NO: 28647 - RNA, 61 nt, Human
aguccccacugucaucuaccaagacuugcaccccccucauuaucuaccaugacugucucuc

SEQ ID NO: 28648 - RNA, 61 nt, Human
aagacaguggugguccgguggagggaagacccccccucaccccaggacccuaggagggggu

SEQ ID NO: 28649 - RNA, 61 nt, Human
ggugucccccaggucucagcccccaaggcugcccccucagcagaggcagcugguggcuuug

SEQ ID NO: 28650 - RNA, 61 nt, Human
ggcggccggcgaggccugagcccaggaaagccccccucacugucccugguaccgcugccaa

SEQ ID NO: 28651 - RNA, 61 nt, Human
ggaaaugcaguguguugcaguggccuuuucucccccucaccuucuaaggucagcucuagcu

SEQ ID NO: 28652 - RNA, 61 nt, Human
uuugcccacgucccgacaacuuguucccugacccccucagggauggccccaaacugucccu

SEQ ID NO: 28653 - RNA, 61 nt, Human
uggacacuaagacuccgccccugaggcuccgcccccucacgaggucaagcaagacacaguc

SEQ ID NO: 28654 - RNA, 61 nt, Human
agacuauaaaagccuuuggugggaagauaaacccccucagaagugaucauagaucaugaau

SEQ ID NO: 28655 - RNA, 61 nt, Human
cuggacccaggaguugaagccuccaucgacucccccucaacuuugagacuguagagucagg

SEQ ID NO: 28656 - RNA, 61 nt, Human
cgcagccugcccccuccuggacgugcccauccccccucagauccagacaugccccuccccc

SEQ ID NO: 28657 - RNA, 61 nt, Human
cugcaccuuccccacccccuccugggaagugcccccucaccucagggcacccgcaaccugg

SEQ ID NO: 28658 - RNA, 61 nt, Human
guuugcucacauucuuucagccuucugucaccccccucaacaccaaacuuucuuccuugug

SEQ ID NO: 28659 - RNA, 61 nt, Human
ggcagccugguaggggucgccagccuccaugcccccucaucuuccaguucuugcuuagugg

SEQ ID NO: 28660 - RNA, 61 nt, Human
ccaucucacagagaaucagacagggccacagcccccucaggcagccaggucaucugaguau

SEQ ID NO: 28661 - RNA, 61 nt, Human
ugcauuccagccugggugacagagugagacucccccucaaaaaaaaaaaaaaaaaaaaaaa

SEQ ID NO: 28662 - RNA, 61 nt, Human
ggagugugaagcaaggagcuuagauaagacacccccucaaacccauucccucuccaggaga

SEQ ID NO: 28663 - RNA, 61 nt, Human
cuccugcuccaaacuuugcccauccucuuugcccccucaggagugcugagggccaguguug

SEQ ID NO: 28664 - RNA, 61 nt, Human
cagguggacggcgauguuaauuacucuccagcccccucagaaggggcuggauugauggagg

SEQ ID NO: 28665 - RNA, 61 nt, Human
gccugaugauggugggugggugggaugaguacccccucaaacccugcccuccuuagaccug

SEQ ID NO: 28666 - RNA, 61 nt, Human
ucccccaaacauguuguacauuucaccauggcccccucaucauagcaauaacauucccacu

SEQ ID NO: 28667 - RNA, 61 nt, Human
cucugucucuaaaccucucucucucucccuucccccucaguacuuagucuacagaccuaug

SEQ ID NO: 28668 - RNA, 61 nt, Human
cacacaccccagcccugucccaggggccuggcccccucagccaucucagggugaggagcug

SEQ ID NO: 28669 - RNA, 61 nt, Human
augacacccugugcaccagcugcacuggcuucccccucagcaccaggguaccaggugagcc

SEQ ID NO: 28670 - RNA, 61 nt, Human
ugccugccuggauugcaccuuucugcccuuucccccucauuauuaaauguuucuuuuugcc

SEQ ID NO: 28671 - RNA, 61 nt, Human
uuugaguagcaguguuccucgucacccauuucccccucaggauuacaacaccugcuaucaa

SEQ ID NO: 28672 - RNA, 61 nt, Human
uaggauuauaggcaugagccacugugccuggcccccucaucugauagaaaauuagauuuug

SEQ ID NO: 28673 - RNA, 61 nt, Human
agcucucugggcacagagaccugcugucaaccccccucauuaaaauucaugugccugcuac

SEQ ID NO: 28674 - RNA, 61 nt, Human
gcaauucuguuuuucuccaaguacauuaugacccccucauccuucucuugaacuggagagg

SEQ ID NO: 28675 - RNA, 61 nt, Human
cacaucccagcagcccaagcuuaauagcccucccccucaaccucaccauugugaagcaccu

SEQ ID NO: 28676 - RNA, 61 nt, Human
ccagggaagcugggugggguggguguugagacccccucagaccagcacagagaccuguccu

SEQ ID NO: 28677 - RNA, 61 nt, Human
aauaacaacaccuggggguggucagugagggcccccucaaugauuuucuuguuuguucugu

SEQ ID NO: 28678 - RNA, 61 nt, Human
ugagaguccucucccuucuggccagcuccagcccccucacccuugcugggggcauaucucu

SEQ ID NO: 28679 - RNA, 61 nt, Human
gcuauuuauccugaugcuuucccucccccugcccccucaacaguccacguguucucauugu

SEQ ID NO: 28680 - RNA, 61 nt, Human
gcgggccuccaggugcagggcgggccagaagcccccucaucggcccgcagcuggcuggccc

SEQ ID NO: 28681 - RNA, 61 nt, Human
ccuuuuucuaggaaucauauguuguccaucccccccucaggcuugaaaguccucaaagaga

SEQ ID NO: 28682 - RNA, 61 nt, Human
acagggcugucuggacggggcucuuuugcuucccccucaaucuggggucuagaguugugca

SEQ ID NO: 28683 - RNA, 61 nt, Human
aaguuccccggagagucgggguccccuguggcccccucaggccuaugucugugaggaaggg

SEQ ID NO: 28684 - RNA, 61 nt, Human
ucucuacagaggcugcaggcuccgccgaguccccccucaguguuauuuuauuuaugacuua

SEQ ID NO: 28685 - RNA, 61 nt, Human
acauuggccuuuguuugccaaaauuauucaacccccucauacgacuucagcuccucacuug

SEQ ID NO: 28686 - RNA, 61 nt, Human
ggcauuuuacucagaagucauaaguuuuugccccccucauuuaccucguauuaccaagaaa

SEQ ID NO: 28687 - RNA, 61 nt, Human
uuguaaccucagugcuggggacugaggcgagcccccucaggucgcuggagugcaccagucu

SEQ ID NO: 28688 - RNA, 61 nt, Human
cugagucucgccucccugcuggucccugaagcccccucagaagcccugccugucacgucgg

SEQ ID NO: 28689 - RNA, 61 nt, Human
cuucuccaccggggccccucugcucacagagcccccucaccucccuggggaugaggggcca

SEQ ID NO: 28690 - RNA, 61 nt, Human
agugccucagggguccucagggucagggagccccccucacccucuuggcccguuacccuuu

SEQ ID NO: 28691 - RNA, 61 nt, Human
auuuaccagcacaucaaagcugcuucgcaagcccccucauuagcagggcuuaucuggggga

SEQ ID NO: 28692 - RNA, 61 nt, Human
cugcccugccucugaccagucuguuccggggcccccucagccaggugggaaugacggacac

SEQ ID NO: 28693 - RNA, 61 nt, Human
gaaauaacaccuucuccuauagcaggccuggcccccucagugucucccugucaauuucuac

SEQ ID NO: 28694 - RNA, 61 nt, Human
ggaggaguccacuaacaggaaacacuucucacccccucacacaggcccaggggagccccug

SEQ ID NO: 28695 - RNA, 61 nt, Human
uggagaauaauauugacacuugcuuuucugccccccucagggguguguggaaggcaguggg

SEQ ID NO: 28696 - RNA, 61 nt, Human
ccccuccaccucucucucgauuucucucucucccccucagcaucuucccgcugagaguggu

SEQ ID NO: 28697 - RNA, 61 nt, Human
aggcccuuccucucccccugucuguuuccuucccccucaaccuuaccccaccccucuguua

SEQ ID NO: 28698 - RNA, 61 nt, Human
cacaugcuauucccuggggcugcugugcgcucccccucaucuaggugacaaacuucccuga

SEQ ID NO: 28699 - RNA, 61 nt, Human
augcccugccccagcccuggcucuuuccuaacccccucaacggugggaggaacuggcagag

SEQ ID NO: 28700 - RNA, 61 nt, Human
cuccccgucuguaagauggcaaaaaugcugccccccucacagggugaccaugaggaccagu

SEQ ID NO: 28701 - RNA, 61 nt, Human
uuuucuccacugccauguguccuggucaagccccccucacucuguuuccuguucagcaugu

SEQ ID NO: 28702 - RNA, 61 nt, Human
cuuuucccauugccaugcguccuggucaagccccccucacucuguuuccuguucagcaugu

SEQ ID NO: 28703 - RNA, 61 nt, Human
cuuuucccauugccgugcauccuggucaagccccccucacucuguuuccuguucagcaugu

SEQ ID NO: 28704 - RNA, 61 nt, Human
aauggacccuuggagacucccauccucucuucccccucaccaagugcccaggagaccccug

SEQ ID NO: 28705 - RNA, 61 nt, Human
uggggguucucuagcucugaccucugggugacccccucaguuguugauugcucucacuccc

SEQ ID NO: 28706 - RNA, 61 nt, Human
guggccccccuccucacgccuucuucacugccccccucagagugcacaauacgaguuuguu

SEQ ID NO: 28707 - RNA, 61 nt, Human
ggguuuggaaacuugcaugaaaauauuuuagcccccucagauguuccugcagugcugaaau

SEQ ID NO: 28708 - RNA, 61 nt, Human
auuguggcugugccacgcuggaccacagggucccccucaagcaucucggggcccuauucuc

SEQ ID NO: 28709 - RNA, 61 nt, Human
gggugacuggcacagagcgggccguaggggacccccucacacaccaccgagauggacaggg

SEQ ID NO: 28710 - RNA, 61 nt, Human
aacugcuuuuccccauguguccuggucaagccccccucacucuguuuccuguucagcaugu

SEQ ID NO: 28711 - RNA, 61 nt, Human
uuuuccccauugccaugcguccuggucaagccccccucacucuguuuccuguucagcaugu

SEQ ID NO: 28712 - RNA, 61 nt, Human
uuuucuccauugccaugcgaccuggucaagccccccucacucuguuuccuguucagcaugu

SEQ ID NO: 28713 - RNA, 61 nt, Human
gcuuggaggaggguuguaaaagcauauuguacccccucauuuguuuaucugauuuuuuuau

SEQ ID NO: 28714 - RNA, 61 nt, Human
gccaucuguucaucacacacacccccuuccucccccucaucacccauaaucgugggccccu

SEQ ID NO: 28715 - RNA, 61 nt, Human
gagguccugucuggauggaggcuggaggcuccccccucaaccccucugcucagugccugug

SEQ ID NO: 28716 - RNA, 64 nt, Human
cccagugcugaggagaaaggaggggcaguggcuuccccggcagcagccccaugauggcugaauc

SEQ ID NO: 28717 - RNA, 64 nt, Human
ccucccugcaagaaggugugcaggagagaagaggccccggcauggggaucuggguucuagaggg

SEQ ID NO: 28718 - RNA, 64 nt, Human
gugaccuagucaccuggaaccagcuccugacagaccccggcaacuucuagaugaacccaaguga

SEQ ID NO: 28719 - RNA, 64 nt, Human
cugucugucagcaugcagagggauccaggaauccccccggcagcacggcccgcuuuccuucucc

SEQ ID NO: 28720 - RNA, 64 nt, Human
ccuucuggcaaagcugcugcuccgccgcuugguuccccggcaccagacaucgcccuggcccugc

SEQ ID NO: 28721 - RNA, 64 nt, Human
agcuggggggcuuccuccagaccaccggccucggccccggcaucccuguugggcgucagccuga

SEQ ID NO: 28722 - RNA, 64 nt, Human
ggaccagugccgucacaucgcugucucugauuguccccggcaccagcaggcccuuggggggcuc

SEQ ID NO: 28723 - RNA, 64 nt, Human
ccaacagcccuuaccaaagcugggagccccauugccccggcagcucuggccugugguuccagaa

SEQ ID NO: 28724 - RNA, 52 nt, Human
uccagcagccgccccgauaaugccccggcacugaagucgggacacaaucagc

SEQ ID NO: 28725 - RNA, 58 nt, Human
gccugccaaccagauggugaagugugauccccggcacggcaaguacauggccugcugc

SEQ ID NO: 28726 - RNA, 64 nt, Human
ccggcuucucuccucagagcgccugucacuccauccccggcagggagggaccgucagcucacaa

SEQ ID NO: 28727 - RNA, 56 nt, Human
ucaagcagccucugagauagcagcuaccccggcaccaucugcccagcuccaaggac

SEQ ID NO: 28728 - RNA, 64 nt, Human
gcccaaggcggccccucccgccccuucccacucaccccggcagacgccggggacagaggccugc

SEQ ID NO: 28729 - RNA, 64 nt, Human
gacccugggagguggcagacagaagcacccccugccccggcaagaaacucccaggcucaaucaa

SEQ ID NO: 28730 - RNA, 64 nt, Human
gcacugagaaagccagccccgccugcuuagucagccccggcagcagggcagccaugggaacuca

SEQ ID NO: 28731 - RNA, 64 nt, Human
uagcagcccacccugcugcuggugcacagccacuccccggcaugagacucagugcagauggaga

SEQ ID NO: 28732 - RNA, 64 nt, Human
gauuuauuugguguuucgggcguggccucuggagccccggcacguggugggccacgcugcuggc

SEQ ID NO: 28733 - RNA, 64 nt, Human
augauucuugagaggagguuguagggagaggaggccccggcagaggucuuccuucaugugguua

SEQ ID NO: 28734 - RNA, 64 nt, Human
ggacuccauagcuccuucccaggaccccucagcuccccggcacugcagucugcagaguucuccu

SEQ ID NO: 28735 - RNA, 64 nt, Human
ugacuggcaggcaggugaggggcacagcaccccuccccggcaucugccagcucagcacagaaga

SEQ ID NO: 28736 - RNA, 64 nt, Human
gccagugcagaccucacugucguguccaugccacccccggcauggcuccagguggccuggugac

SEQ ID NO: 28737 - RNA, 64 nt, Human
gcacgugaguuuguaugaguuuguaccggagugaccccggcagccacugcccaccuccccucua

SEQ ID NO: 28738 - RNA, 64 nt, Human
aacaauaagggugauuggggucccugucgcccacccccggcaauccuauuugcuuaccugucac

SEQ ID NO: 28739 - RNA, 64 nt, Human
gaugagagcuguguggccacccccccaaccuugcccccggcacaccaaaguguccacauuguac

SEQ ID NO: 28740 - RNA, 64 nt, Human
cacaagcuugccugaagaauggaucccaacuucuccccggcagcucugccucccuaagucugug

SEQ ID NO: 28741 - RNA, 64 nt, Human
uuaugccugugcaaagaagaggcucaaaugcuguccccggcagcuuuccugggggacuagagcu

SEQ ID NO: 28742 - RNA, 64 nt, Human
gcugggggaccaacagguugcuuacagcuuugcaccccggcaucagcacaggggucccugcccc

SEQ ID NO: 28743 - RNA, 64 nt, Human
cccagcaguagacggcuugggggagucggaggcuccccggcagacaccccacccccaucuuguu

SEQ ID NO: 28744 - RNA, 64 nt, Human
uggcagccagagucccucaggaccugcagccucgccccggcagaagucuuuuguccaggaggca

SEQ ID NO: 28745 - RNA, 64 nt, Human
cucagguagaguggggggccaaaaccucugcaguccccggcagugagcuauggacuuucuuccc

SEQ ID NO: 28746 - RNA, 64 nt, Human
gguggugcugccuccucugggguggcucaccgggccccggcaccgugccccuucagcccugucu

SEQ ID NO: 28747 - RNA, 64 nt, Human
ggaagcuggcuuugaaaccucagggcugucccagccccggcaagccacaggaaggaggggagag

SEQ ID NO: 28748 - RNA, 64 nt, Human
cauggaacgugagaccuguaagcugucccgcgggccccggcaccccgcccagcugugcacuuug

SEQ ID NO: 28749 - RNA, 64 nt, Human
cauuugggcucagggcagagcagguguuuaucugccccggcaucugccauggcaucaagaggga

SEQ ID NO: 28750 - RNA, 64 nt, Human
gccugcggcccagacguccagggagccggccccuccccggcagcaggccggggcggagcaggag

SEQ ID NO: 28751 - RNA, 64 nt, Human
gggcagaguccagcugagcacuuccugcaugcgcccccggcaccugacucugcccuuuauguau

SEQ ID NO: 28752 - RNA, 64 nt, Human
gcuccucuuccagacucaccagggggccucgaggccccggcaucucccuuggcccugggugugg

SEQ ID NO: 28753 - RNA, 64 nt, Human
ccgcgcccccgccgggccccgcgcgcuccuggguccccggcaccccggccccgcagcgcgacuc

SEQ ID NO: 28754 - RNA, 63 nt, Human
acugugccagcuggcagugagggcugcccagauccccggcacacacucccccaccugcuguuu

SEQ ID NO: 28755 - RNA, 64 nt, Human
cuucccaguggcugcuuccuggggacccagggcaccccggcaccuucaggcacgcuccucagcu

SEQ ID NO: 28756 - RNA, 64 nt, Human
gggcaggggccgcuuggcuguggggugugcgcugccccggcaccugcuugcccuccgcgcucau

SEQ ID NO: 28757 - RNA, 64 nt, Human
cagacuguccccagacucccccgagaccugccagccccggcauccuggaagucccgacuccccc

SEQ ID NO: 28758 - RNA, 64 nt, Human
gaaggcccuuccugcgggaggagcagcuguguguccccggcaccucacucccccaaaaugacac

SEQ ID NO: 28759 - RNA, 64 nt, Human
cccacccacacuccagaucgagaccccugccuccccccggcaaauguccucccgcugccuugca

SEQ ID NO: 28760 - RNA, 64 nt, Human
ugagaccaguucccuggaggccacccacccugugccccggcaggccuggggucugcaguccucu

SEQ ID NO: 28761 - RNA, 64 nt, Human
gcacagaggaagccaaggccuggagcugcaggucccccggcaucucucucugucccggcagccc

SEQ ID NO: 28762 - RNA, 64 nt, Human
ucuaaaacaguucauguguucacaaaaauugccuccccggcagagauuaugcaguaagauaauu

SEQ ID NO: 28763 - RNA, 64 nt, Human
cuuucccugugggauguugggcagucucuguuguccccggcagagcugggcaccgcucuguauc

SEQ ID NO: 28764 - RNA, 64 nt, Human
ccucucuggcuggacuguuaaaagcaacgagaggccccggcacaccuggaagcuggccgcgaau

SEQ ID NO: 28765 - RNA, 64 nt, Human
uggccgggccucucaagggcuucguuucugcucuccccggcaugccuggcuuguuugaccaaag

SEQ ID NO: 28766 - RNA, 64 nt, Human
gagggcagggaggcagaugggacaggguccccuuccccggcacccaugcgccgggcccagagcu

SEQ ID NO: 28767 - RNA, 64 nt, Human
ugcaaaaauuucuggcuucucuuaccccuauugcccccggcaauaaauuguuucuauaugccag

SEQ ID NO: 28768 - RNA, 63 nt, Human
uaaagagcagucgcaaaugaagcugccccacucccccggcacccugcagcuuuaguuuacuaa

SEQ ID NO: 28769 - RNA, 52 nt, Human
acaaggaguauuaugucugagcccccggcacugcgccccacugccagcugcc

SEQ ID NO: 28770 - RNA, 64 nt, Human
ccucugcuuuccgggcagcucucaccaccccaggccccggcaugaggccuuuccucaguccugu

SEQ ID NO: 28771 - RNA, 64 nt, Human
cccacauccuccauccugacugcagcaugggguuccccggcaggggugggaggcagcagggguc

SEQ ID NO: 28772 - RNA, 64 nt, Human
auaccugcauuguugagcuucucuacuggggacgccccggcauuauuuuauucccaagccagca

SEQ ID NO: 28773 - RNA, 64 nt, Human
cacucuguaucuccuguccuuaaaauccucuuguccccggcauucugacacacugggcugccgu

SEQ ID NO: 28774 - RNA, 64 nt, Human
gcaggaaggccuggguggaucggccuccucuucaccccggcaggcccugcaguguucgcuuggc

SEQ ID NO: 28775 - RNA, 64 nt, Human
cgacagggugggcuggggugcgcuccggaggaacccccggcacugaugggcuucugccccugcc

SEQ ID NO: 28776 - RNA, 64 nt, Human
cagccccucugcucuguacccuuuuuccuuuuguccccggcagcagggaagaagcuggaggccg

SEQ ID NO: 28777 - RNA, 64 nt, Human
ucuagccucauacccgugcccucacagagccaugccccggcaccucugcccugugucuuucaua

SEQ ID NO: 28778 - RNA, 64 nt, Human
gcccuugggugugggguaacugccuugcuucugcccccggcacuugccauguuccagugggggg

SEQ ID NO: 28779 - RNA, 64 nt, Human
cauagugaggaucccaucucuacgcccacccuccccccggcaaaaaaaaaaagcuggguauggu

SEQ ID NO: 28780 - RNA, 64 nt, Human
cugcuuugagcugucagccucaccugcccuggaaccccggcacccggcuugggcagagaacuga

SEQ ID NO: 28781 - RNA, 64 nt, Human
uguguucuuugcagaaugucuccuucagccugucccccggcaaggugacggcccugguggggcc

SEQ ID NO: 28782 - RNA, 64 nt, Human
gaagggcgcugggcaguguggccgccaacuuccaccccggcaagccccucuguccuaugcagaa

SEQ ID NO: 28783 - RNA, 64 nt, Human
ggcugcagagcacuaugaaaucaugguacguaguccccggcaccugucguuauuccuauauccu

SEQ ID NO: 28784 - RNA, 64 nt, Human
gccuccuucacccugaccgccucccucccuccugccccggcauugcaucuucccuagauagguc

SEQ ID NO: 28785 - RNA, 64 nt, Human
cccacuugucacugacacaaaggaagugcccccuccccggcacccucuggccgccuaggcucag

SEQ ID NO: 28786 - RNA, 64 nt, Human
cuccaagaugggaaacaugucgugugucugcacgccccggcaaacugccgccacucguucugcu

SEQ ID NO: 28787 - RNA, 64 nt, Human
uugaggcugcuuugguucaugaauccagguguucccccggcagucggcuucuucagucgcuccc

SEQ ID NO: 28788 - RNA, 64 nt, Human
gcuuacuuguaaagaaaacuaaauccuucuguguccccggcagccucagugcagcaacagaagc

SEQ ID NO: 28789 - RNA, 50 nt, Human
gcagggcaguccacuccuagccccggcauccugcucuagggccccucaug

SEQ ID NO: 28790 - RNA, 64 nt, Human
uuaccaacgaccucauguacauugcugaccugggccccggcauugcccccucugccccuggcac

SEQ ID NO: 28791 - RNA, 64 nt, Human
ggaugcuaaguagaaacugcaugagccaccagugccccggcacccuuuaacaccaccagauggg

SEQ ID NO: 28792 - RNA, 64 nt, Human
cagcgggccggccucgcccccacucccccuccuaccccggcaggggcuuccggggccuuuucac

SEQ ID NO: 28793 - RNA, 64 nt, Human
guccccacccacagaagcagaccuucagcucaggccccggcauugccaucagcagccucagcgu

SEQ ID NO: 28794 - RNA, 64 nt, Human
gcuggaggacgcagcguccagggccagcgagcucccccggcagcagguccccaagccaugucag

SEQ ID NO: 28795 - RNA, 64 nt, Human
gcgcagagaacuuaggagagaagcacggaggagcccccggcagagcacccgcccccgggcccca

SEQ ID NO: 28796 - RNA, 64 nt, Human
ucacuccaucagcacuagcaccucacuccaucggccccggcacccugcuccaucggcacuggcg

SEQ ID NO: 28797 - RNA, 64 nt, Human
aacugagcccauccugcggacaguuguggugcccccccggcagcucccggcacugcccccgacg

SEQ ID NO: 28798 - RNA, 64 nt, Human
acccuggcuccuugugccagagaacccagcccacccccggcagcagcccccagcucccaccucc

SEQ ID NO: 28799 - RNA, 57 nt, Human
gcaagaagcacggaaugugaacuggugccccggcagccugcuggacucccagacccc

SEQ ID NO: 28800 - RNA, 64 nt, Human
uacuggccgagcugcuggcgcacaggccucuucuccccggcacuuccgagauccaccagaucga

SEQ ID NO: 28801 - RNA, 64 nt, Human
cccugcugccagcuucaggugacccccccccaucccccggcaccucccuugggcacgugugcug

SEQ ID NO: 28802 - RNA, 64 nt, Human
cacuacuccuccccagagacauacagauugcccuccccggcaugaagaagucacaauucugacc

SEQ ID NO: 28803 - RNA, 64 nt, Human
cggcucauccucaagcuggaagauaccucucuggccccggcacaugucaccccugcacuccugc

SEQ ID NO: 28804 - RNA, 64 nt, Human
ggcggagcugugcucagcacaggccugggaccucccccggcaggcaccuguggggggugcagcu

SEQ ID NO: 28805 - RNA, 64 nt, Human
gccugccagcuucugccuucaacuucagcaccugccccggcaguggggagcgccggauuugcuc

SEQ ID NO: 28806 - RNA, 64 nt, Human
ggacaacaacgggcagaaaucgagagugugcucuccccggcaggccugagaaugagugggaauc

SEQ ID NO: 28807 - RNA, 64 nt, Human
aagcagaacuuccaaagagaguuaaaagcagcagccccggcaacucuggcuccaggcagaagga

SEQ ID NO: 28808 - RNA, 64 nt, Human
uguuccauuccccucuucuuccuucuaucuccuuccccggcaaaaaccaaacaaacuggcagac

SEQ ID NO: 28809 - RNA, 64 nt, Human
agcuuaucccaggccagaggcugcaugccacuguccccggcagcgccaaccccugcuuggcugu

SEQ ID NO: 28810 - RNA, 64 nt, Human
gcagacccggccucggucagcugggaggggcccgccccggcacaaagcacccaugggaauaaag

SEQ ID NO: 28811 - RNA, 64 nt, Human
uuuccugguccucccaacugggaggaaggggcccccccggcaggugagagaaggaacaucuccc

SEQ ID NO: 28812 - RNA, 64 nt, Human
auguggagcaaagugucagugagaucauuuacuuccccggcacgcccuaguuaagcagcugaca

SEQ ID NO: 28813 - RNA, 64 nt, Human
ggcgccuguucccccaggcucucagugccaccacccccggcaggccuucccugacccagccagg

SEQ ID NO: 28814 - RNA, 64 nt, Human
cggcggaaucucuccaggagaagcucggcguuacccccggcagcugguggaugcaucucagauc

SEQ ID NO: 28815 - RNA, 64 nt, Human
agacaggggcugccuguggagccugcccaccggcccccggcagugcaguccagcggggaggagg

SEQ ID NO: 28816 - RNA, 64 nt, Human
cgagaaucccuagcugccccagcccagucuuucuccccggcauucacaaacuuugcaagcgugg

SEQ ID NO: 28817 - RNA, 64 nt, Human
cagcugugggagugcggguggggguguggccgagccccggcaggaagccccgcccagacggugu

SEQ ID NO: 28818 - RNA, 64 nt, Human
cuggccugcgcucccgccgcccuggugccuuagcccccggcacaggauggggcaggcucuggca

SEQ ID NO: 28819 - RNA, 64 nt, Human
gcaggggguucugggacccacuccgacucccccuccccggcaucauuuccccucccgcuuccuc

SEQ ID NO: 28820 - RNA, 64 nt, Human
ucugucugucgcccuucucccggcccucacuaagccccggcacuucuaguggucucaccuggag

SEQ ID NO: 28821 - RNA, 64 nt, Human
ggcagcucccacaggccacagccgggcuccccacccccggcacccagcucucuacggcaggucc

SEQ ID NO: 28822 - RNA, 64 nt, Human
acggccgggccccuccccgacaagccucccagggccccggcaccccggucggcagccugccccu

SEQ ID NO: 28823 - RNA, 64 nt, Human
cccccaccaggacugggccuccccggcagcaagaccccggcacuccccgccaggcccagggugg

SEQ ID NO: 28824 - RNA, 64 nt, Human
ccagcccugagccucccccaccaggacugggccuccccggcagcaagaccccggcacuccccgc

SEQ ID NO: 28825 - RNA, 64 nt, Human
aucuggcccgcacguguccgaggggcccccggguccccggcaccauggcuacuaccggggcucc

SEQ ID NO: 28826 - RNA, 64 nt, Human
uuccauguauaguugguguacacucaaaaccuguccccggcagccagugcucucuguauagggc

SEQ ID NO: 28827 - RNA, 64 nt, Human
cuggcugaccauuuuguucccugagugucugaguccccggcaggcggccuucacucagggucag

SEQ ID NO: 28828 - RNA, 64 nt, Human
aagugcagcugaggucccgccccgccccgccccgccccggcaggcccggccccaccccgccccg

SEQ ID NO: 28829 - RNA, 64 nt, Human
accaggccaguccggcucuggggagcaggggccuccccggcaacagccccaggggccuugaggg

SEQ ID NO: 28830 - RNA, 64 nt, Human
aaaaucaaagggcuagaacucuccaaggucuugcccccggcauguagcaccaccugagccagaa

SEQ ID NO: 28831 - RNA, 64 nt, Human
cagggcccugcccccuaauguaaccccucucucaccccggcacaaccugggcuuccacagucug

SEQ ID NO: 28832 - RNA, 64 nt, Human
gcgagggaugcuucucccuacagcauguccacucccccggcauggccagguggggccccugggg

SEQ ID NO: 28833 - RNA, 64 nt, Human
agugcugagggguacagcccugggcccugaccagccccggcaccugccaugcugguucccggaa

SEQ ID NO: 28834 - RNA, 64 nt, Human
gcgcgcacacaccgccaagcagcucagcauucucccccggcacacuuagugacagugaugcucu

SEQ ID NO: 28835 - RNA, 64 nt, Human
ccagaugcccacugugcgcaucuccccaccgaggccccggcagcagucuuguucacagaccuua

SEQ ID NO: 28836 - RNA, 64 nt, Human
aggcucagaggacugaaucugggaccuguguuccccccggcaggcagggacaagauggcauggc

SEQ ID NO: 28837 - RNA, 64 nt, Human
ccugggugacagaguuagauuccacccucucccaccccggcaaaaaaaaaaaaaaaagaugcaa

SEQ ID NO: 28838 - RNA, 64 nt, Human
gggugaguguggagcuugccccuccggcucacagccccggcagccccuggcuccuuggucucuc

SEQ ID NO: 28839 - RNA, 64 nt, Human
ccugagacgggggguggcugcccuccccagaccaccccggcagccugagcagcuccaaagcacu

SEQ ID NO: 28840 - RNA, 64 nt, Human
cuccucucccugcaguaggcaccagcucuaccucccccggcaggcaauguccuggcuucucagc

SEQ ID NO: 28841 - RNA, 64 nt, Human
cuuucucaguccugcagcggcccuugggggugacccccggcaucuaccccacucaggaaaccuu

SEQ ID NO: 28842 - RNA, 64 nt, Human
gucagcagcaggggaggcagcuugcaugccugucccccggcacacuguguggagguggaaacag

SEQ ID NO: 28843 - RNA, 64 nt, Human
augccgacggcgccacguagccucccaucccuguccccggcacggauccggguaagguggcccg

SEQ ID NO: 28844 - RNA, 64 nt, Human
gguaucguggggcaggucacccuggccacgaugcccccggcacacccaggcccccuucauuagu

SEQ ID NO: 28845 - RNA, 64 nt, Human
uugaccuucagaacuucucuugguguggaaccauuacgcccaggguucacuccccucucaucgu

SEQ ID NO: 28846 - RNA, 64 nt, Human
cggugucgguucuguuucuccccuuggcugccuguacgcccacagccuucuggcugcgacauua

SEQ ID NO: 28847 - RNA, 64 nt, Human
guguagagggggagaggguagcaaggugcuucucuacgcccaugacuugggagcaggucuuggc

SEQ ID NO: 28848 - RNA, 64 nt, Human
aguaauuccuuuuuccuucccccuccuccacuccuacgcccacucccaugcuugggagaauggg

SEQ ID NO: 28849 - RNA, 64 nt, Human
cacgugcuacccccaugcuggaggugacaucucuuacgcccaacccuuccccacugcacacacc

SEQ ID NO: 28850 - RNA, 64 nt, Human
gcaggagccgcugcugagcugcgugccacaucgcuacgcccaggaggugagccggcucugccuc

SEQ ID NO: 28851 - RNA, 64 nt, Human
caauauucuuggagauugauaaccauagcauuaauacgcccauuauggucauuuaaauuggggu

SEQ ID NO: 28852 - RNA, 64 nt, Human
uguacuucccccagaucccacucagaacagcagguacgcccaggcuccugcugcccuagagguc

SEQ ID NO: 28853 - RNA, 64 nt, Human
cagaaaaaaaaucuucaugauguguauugagcgguacgcccaguugccaccaugacugagucuu

SEQ ID NO: 28854 - RNA, 64 nt, Human
gcaaauggaaugaugacuuugaaaaccacuggcuuacgcccaccauuuccgagguccuguccac

SEQ ID NO: 28855 - RNA, 64 nt, Human
ugaguuggagauuuuguaucuguuucuccuccuuuacgcccauuuuccuacccacagcagcaaa

SEQ ID NO: 28856 - RNA, 64 nt, Human
acggacuaagacccaguggugcucuuugagaguuuacgcccaugagugcagaagacugaacaga

SEQ ID NO: 28857 - RNA, 64 nt, Human
ccugccucuucccaggcuuccuggggaagaguuguacgcccaggcaacaagggcugagcugcgc

SEQ ID NO: 28858 - RNA, 64 nt, Human
uguggcgacucugcagagucacucacaccguucguacgcccaggacagcugguucgugguuuuu

SEQ ID NO: 28859 - RNA, 64 nt, Human
aggggcaggggcagggagagcccugcauuuccucuacgcccagguuccggaagguggugagaca

SEQ ID NO: 28860 - RNA, 64 nt, Human
cccagcuuuccucacuguuccuguggaggaugucuacgcccaggcgagcuccucgaccucugag

SEQ ID NO: 28861 - RNA, 64 nt, Human
aaccagaaccucccauucccaguaucgcuguuccuacgcccauuucacccucauuaccuucugc

SEQ ID NO: 28862 - RNA, 64 nt, Human
accggccugagcaacauagugaggaucccaucucuacgcccacccuccccccggcaaaaaaaaa

SEQ ID NO: 28863 - RNA, 64 nt, Human
cucccgaguagcuaggauuacaggcgcccgccacuacgcccagcuaauuugugguauuuuuagu

SEQ ID NO: 28864 - RNA, 64 nt, Human
cacacacgugugcauguuccugugcgcugauguuuacgcccaagcauuucugaacaaaugaaac

SEQ ID NO: 28865 - RNA, 64 nt, Human
accugcugagcccaccccaaguaugccugccaccuacgcccacaggcagggcacacugggcagc

SEQ ID NO: 28866 - RNA, 64 nt, Human
cagacagccggcuagccccacugcccguuccuuuuacgcccaaguuuugcuccuugagagcaga

SEQ ID NO: 28867 - RNA, 64 nt, Human
gaagugaaucccgcaggacagcugcacucagggauacgcccaacaccauggccugcaaccccag

SEQ ID NO: 28868 - RNA, 64 nt, Human
ggcguuuucacaugcacauauguguaugcauguauacgcccauacagacaugcacacacagacu

SEQ ID NO: 28869 - RNA, 64 nt, Human
ggcaguccgcggucucuggacaaucaacucaagguacgcccacugcaaggccucccucccaccg

SEQ ID NO: 28870 - RNA, 64 nt, Human
agaaagguguccaaguaccuguaucacagccgccuacgcccaccuaguggccagucccagagcc

SEQ ID NO: 28871 - RNA, 64 nt, Human
uccugguggcccacuguggcugcccgggcgacaguacgcccagggccuguguuccauagccauc

SEQ ID NO: 28872 - RNA, 64 nt, Human
ucaguguuaccugugugcuuggucuguuugacuuuacgcccaucucaggacacuuccguagacu

SEQ ID NO: 28873 - RNA, 64 nt, Human
gcccuacauugaguacacgccggccagcccggccuacgcccaguacccaccggccaccuaugac

SEQ ID NO: 28874 - RNA, 64 nt, Human
ugcccauggugccugucagcccgcagagcccaucuacgcccaacacagagcucacacaggucac

SEQ ID NO: 28875 - RNA, 64 nt, Human
augagucagcauauccuuguaguaugucacaguauacgcccaaauuguuuucaccauauugcau

SEQ ID NO: 28876 - RNA, 64 nt, Human
ugagagagugugcagagagcaaugauagcaaauaauguacgaauguuuuuugcauucaaaggac

SEQ ID NO: 28877 - RNA, 64 nt, Human
ccaaggcucccauagaggcgcugugucagugaagauguacgacuaccuguugggaaggacaaag

SEQ ID NO: 28878 - RNA, 64 nt, Human
uuuaaauuuuagaacuuguuuuggaugugauuauauguacgaaaaucguguaacacuaugcuca

SEQ ID NO: 28879 - RNA, 64 nt, Human
aauuaauuaaaguagaagagaaggguucuguuccauguacgauuaaugugccccuuuuggagau

SEQ ID NO: 28880 - RNA, 64 nt, Human
gugugcaauagagugaucacaucuuuguuucuucauguacgauagcuaucccuacagaagauaa

SEQ ID NO: 28881 - RNA, 64 nt, Human
ugcucugggccggggguagagcuagcauccgggcauguacgagggaagagggaggcaggccucu

SEQ ID NO: 28882 - RNA, 64 nt, Human
ucugugacuguagagugaggaauaucuauacaaaauguacgaaacuguaugauuaagcaacaca

SEQ ID NO: 28883 - RNA, 64 nt, Human
caucuuuuuaaucaacagucauuaauaaauguacauguacgauauucaaacuuuagaauuucag

SEQ ID NO: 28884 - RNA, 64 nt, Human
ccaaacuuuauugauucaccuccuaaaacaacagauguacgacuugcauaccugcuuuuuaugg

SEQ ID NO: 28885 - RNA, 64 nt, Human
guccucuacacacuugugauuccuauucgauauuauguacgauggagauugggaaacuuaaccg

SEQ ID NO: 28886 - RNA, 62 nt, Human
uauucccauuucuccucagauaacuucaagugauguacgaaaagguuuggaguucauuuuug

SEQ ID NO: 28887 - RNA, 64 nt, Human
auauauuaaauaggucaaucagacuaugacagcuauguacgaccauuuguauguguaucuaugu

SEQ ID NO: 28888 - RNA, 64 nt, Human
agggagggcuggggcgggggccgggcuuggaacgauguacgauacccucauagugaccauuaaa

SEQ ID NO: 28889 - RNA, 64 nt, Human
uuuauacuccaccuccuuucaaaaaagauuuaagauguacgacauuaccgaacaccuaaaauag

SEQ ID NO: 28890 - RNA, 64 nt, Human
gcacgguggugcccaagccaacccugugacugacauguacgauucacuccuuugagucuuugga

SEQ ID NO: 28891 - RNA, 64 nt, Human
gcaaauuuaacgaaaugaaauuguauguguaaaaauguacgauuuuucacugugcaacuguaaa

SEQ ID NO: 28892 - RNA, 64 nt, Human
cuagcccuuuggugauaaguacuuccucuaggaaauguacgauagguagaauugugguucccua

SEQ ID NO: 28893 - RNA, 64 nt, Human
gacauacgugacagcucacuuuucaguucauuauauguacgaggguagcagugugugggaugag

SEQ ID NO: 28894 - RNA, 64 nt, Human
aauugguguagucaugacuuuagcugauacucuuauguacgagaucugucucugcuguuuaacu

SEQ ID NO: 28895 - RNA, 64 nt, Human
ucccuucacaaguuuuuuuacuguuuuuagaugaauguacgaugagaaauucaacguuaauaau

SEQ ID NO: 28896 - RNA, 64 nt, Human
acacuguuguccuuaaaauuccccuuuuuucucuauguacgauaaaguaacaguaugucagaua

SEQ ID NO: 28897 - RNA, 64 nt, Human
ugccacucggagcaaccagacuuacagcauaaguauguacgaggaauuucaaaucaucagaugu

SEQ ID NO: 28898 - RNA, 64 nt, Human
ggaggccgggcugcgccugcugcacuuccuguucauguacgacccuaagaaaaggugcugaucu

SEQ ID NO: 28899 - RNA, 64 nt, Human
uccuuucuccuaagacgugaguuucucaugggggauguacgaguaaaaagguuaacuucuguuc

SEQ ID NO: 28900 - RNA, 64 nt, Human
uuuuauuaaauuaauugaaucuaguauaugcgggauguacgacauuuugugacugaagagacuu

SEQ ID NO: 28901 - RNA, 64 nt, Human
ugaaugcuuaccaaguccugggaauaugcuagugauguacgagcugcgcguccugcccucuggg

SEQ ID NO: 28902 - RNA, 64 nt, Human
guguacaggauauuccuuuagugguggaauuaaaauguacgaauacuugcuuuuucaaaaaaau

SEQ ID NO: 28903 - RNA, 64 nt, Human
auagaggccaaugaaagaugaauuugcauuguagauguacgaauuaaauauguucuucaaaauc

SEQ ID NO: 28904 - RNA, 64 nt, Human
gaagcagcugaaggagcagcaggagaugcagcagauguacgacaugaucaugcagcacaagcgg

SEQ ID NO: 28905 - RNA, 64 nt, Human
augagcagaggugagcgugagcgagcggguguguauguacgagugugcacgugugugcgugugc

SEQ ID NO: 28906 - RNA, 64 nt, Human
agucugagucauuuggaauuguggguaaauuauuauguacgauggaauccacggaugagaccuc

SEQ ID NO: 28907 - RNA, 64 nt, Human
uuuucuauaaaugccuucguguuuucugagcagaauguacgaggugugccaucccaaaaccagc

SEQ ID NO: 28908 - RNA, 64 nt, Human
uuucucucucagggcaccccagccccacacucacauguacgaaguucucaccccagcuccuuug

SEQ ID NO: 28909 - RNA, 64 nt, Human
gcagggguuuuucuucagagucuauuuuuucagcgacaaggacccaggucuuccugcugcugcc

SEQ ID NO: 28910 - RNA, 64 nt, Human
aucaccauucaccccaggggacagccucgaccgagacaaggaggcccuuaaaugacagccugca

SEQ ID NO: 28911 - RNA, 64 nt, Human
ggucuucccucauccuccguggcugccuccaugggacaaggaccgauuccaacacaggcuccuc

SEQ ID NO: 28912 - RNA, 64 nt, Human
auggggagcuggcagagcagguggcagucacugggacaaggagggacuugccucucuucucauu

SEQ ID NO: 28913 - RNA, 64 nt, Human
cugucugauccugggccuuucuuucaucccaaaugacaaggaauguggcucagagaaggguuuu

SEQ ID NO: 28914 - RNA, 64 nt, Human
gaguauaaaggaucuggagguuggggauaugacugacaaggaaaggcuguggccaccugaugac

SEQ ID NO: 28915 - RNA, 64 nt, Human
acuugaggcaguaauuacaguggaaugaguacuggacaaggagucaaaaaacuugauuucaggu

SEQ ID NO: 28916 - RNA, 64 nt, Human
uugggcaugugguauacugaagcaauacccguuagacaaggauauuuuacuucuuccagacacc

SEQ ID NO: 28917 - RNA, 64 nt, Human
aaggcugaauguaggauucuucaguauguggaaagacaaggauucaacguguggucauaugaua

SEQ ID NO: 28918 - RNA, 64 nt, Human
auacuaugaggagaaguuuuguggugccgcuggugacaaggaacucacagaaagguuucuuagc

SEQ ID NO: 28919 - RNA, 64 nt, Human
caguaagaagggcugcaaggaaggggaggauggggacaaggaaaggaucagauaccugcuccag

SEQ ID NO: 28920 - RNA, 64 nt, Human
uuacaaguagacaccccugggggggcgggcaguggacaaggauggcaaggggugggcauugggg

SEQ ID NO: 28921 - RNA, 64 nt, Human
uccacugccaaguagaagugacucaaaacccucugacaaggauauucccuuggcuaugguccug

SEQ ID NO: 28922 - RNA, 64 nt, Human
ccagcugaucccaaaagcuguuuucagguauaaggacaaggagaggagacaagugacgacagcc

SEQ ID NO: 28923 - RNA, 64 nt, Human
gccauccagcaguuccuuaaauaaggucaccaaggacaaggauaucaaauaacuacuguucaau

SEQ ID NO: 28924 - RNA, 64 nt, Human
uauaauggagacacagaagugugcauggcccaaggacaaggaccuccagccaggcuucauuuau

SEQ ID NO: 28925 - RNA, 51 nt, Human
aaguaauguucucagcuugaugacaaggaaccuguauagugauccagggau

SEQ ID NO: 28926 - RNA, 64 nt, Human
aggaaugugaaucuguuguuuuauaagaguuuaggacaaggacguggaacaguggacacugguu

SEQ ID NO: 28927 - RNA, 64 nt, Human
ccuuguagauuccucuggugcuggucuccaggcugacaaggauucaaaguugucucugaaacuc

SEQ ID NO: 28928 - RNA, 64 nt, Human
agaaaacaagagccacuuguagcugguuuaauuagacaaggauuuacuaccuggccccuggugg

SEQ ID NO: 28929 - RNA, 64 nt, Human
accccaaauagccugcucaguagagggucaugcagacaaggaagaaaacuuaggggcugcucug

SEQ ID NO: 28930 - RNA, 64 nt, Human
aacugacagcaaaaggaagggcgaacuuucuagugacaaggaaucucuuccaagacuuuguuuu

SEQ ID NO: 28931 - RNA, 64 nt, Human
cccaauuaagcgugaaauugaaaaacugaagcuggacaaggaccauuuagagaagguuuuacaa

SEQ ID NO: 28932 - RNA, 64 nt, Human
uucccaauucauuagguaugacuguggaaauacagacaaggaucuuaguugauauuuugggcuu

SEQ ID NO: 28933 - RNA, 64 nt, Human
aacucaggugccuagagaagccaggcagcuaaaggacaaggaaugcugggggcugugggaacag

SEQ ID NO: 28934 - RNA, 64 nt, Human
acuauuuucuccuuaaagcuccagccaaaaacuggacaaggauagagaggaggagggaagaaca

SEQ ID NO: 28935 - RNA, 64 nt, Human
uauuuauucacuuuuauuuagcaccagggaaggggacaaggacuaggguccuggggaaccugac

SEQ ID NO: 28936 - RNA, 64 nt, Human
augaaguucucauugcaugcaauuguguaggauugacaaggaacucagauaaaaauuuccaggg

SEQ ID NO: 28937 - RNA, 64 nt, Human
agggaaggagcagcaucugguaugcagccaccaggacaaggacugaaaauaaugucuacagucc

SEQ ID NO: 28938 - RNA, 64 nt, Human
acaacaaucucaauuccauuuuuuaugaacacuugacaaggacccuccaggagucccucugugg

SEQ ID NO: 28939 - RNA, 64 nt, Human
cagaauauuauuaaacaaucaucaggcuuuuagcgacaaggaacacacacauuuuucuuaaagg

SEQ ID NO: 28940 - RNA, 64 nt, Human
gcauugggcuccccagccggaacugguuaccaaggacaaggacacucugacauucggcuugauc

SEQ ID NO: 28941 - RNA, 64 nt, Human
uugaagucaccugacucagccccuuguguuuacagacaaggacauguaguccaagguugcaugg

SEQ ID NO: 28942 - RNA, 64 nt, Human
uaaagagaaaaaauauguguauaucauggaaaaagacaaggauauuuuaauaaaacauuacuua

SEQ ID NO: 28943 - RNA, 64 nt, Human
aacgaccacucaagagacugacuucgccauucaagacaaggaagagacacaugugugcacuccu

SEQ ID NO: 28944 - RNA, 64 nt, Human
ggugaauucaucuuacaaaauguuccaaguuuuggacaaggaaaaacauuacauuggauauuga

SEQ ID NO: 28945 - RNA, 64 nt, Human
acaauuggcuaaucaagauguaacaccaucauaagacaaggagaaucauauacaacuugauaug

SEQ ID NO: 28946 - RNA, 64 nt, Human
guuuguagucccucuguuucgcacagaguacuaugacaaggaaacaucagaauuacuaaucuag

SEQ ID NO: 28947 - RNA, 64 nt, Human
ugggugguaaugacuacggagcuaaaguuggggugacaaggaugggguaaaagaaaacugucuc

SEQ ID NO: 28948 - RNA, 64 nt, Human
auuacaucaaaaaggucagugacaauugauaaaugacaaggaaauauuuaauuagguaaaacua

SEQ ID NO: 28949 - RNA, 64 nt, Human
aagcccugaagugggcaggggaaauguacgcugggacaaggaccaucucugugcccccugccug

SEQ ID NO: 28950 - RNA, 64 nt, Human
ccggaugcaucaguguccaccaguuggaagcaaugacaaggauggcuggcugguguuuuucagc

SEQ ID NO: 28951 - RNA, 64 nt, Human
ggagcagaaguccugguaguuacaagcaaagggagacaaggaaacgggcacagcgaaauccugg

SEQ ID NO: 28952 - RNA, 64 nt, Human
uguccagggucaauuugaguguaaagaaaauguagacaaggaauugcccaauuuuaaauucuga

SEQ ID NO: 28953 - RNA, 64 nt, Human
cauccgccuggauugggagaccuauguuccagaagacaaggaagaccggcugguggagcugcug

SEQ ID NO: 28954 - RNA, 64 nt, Human
uaaaaacaguaaaaaugacucccauccauccucugacaaggaagaaggugaggccacauccgau

SEQ ID NO: 28955 - RNA, 64 nt, Human
uccauuucuguguccugcuggagguuuuaaccuagacaaggauuccgcuuauuccuugguaugg

SEQ ID NO: 28956 - RNA, 64 nt, Human
ugagauggagugagagagagagagagagagagaugacaaggagcacaagaagugguccaucucc

SEQ ID NO: 28957 - RNA, 64 nt, Human
auguccacaggccagggccugugcugcagucggggacaaggagcuuccgucuggcaaggccggg

SEQ ID NO: 28958 - RNA, 64 nt, Human
ucggguuuggggagggagcacucugggacugugagacaaggaagcagggccagcagugagacua

SEQ ID NO: 28959 - RNA, 64 nt, Human
gaggagcaagucacaucuuacauggauggcagcagacaaggagagagagcuugugcagggaaac

SEQ ID NO: 28960 - RNA, 64 nt, Human
ccccgaccugcgggccgcuguuuugguuugacaugacaaggaaaggacuuccugcugacccuga

SEQ ID NO: 28961 - RNA, 64 nt, Human
cccagagggcacgggcuuucccaccucucaaagagacaaggaagccaccuguaagcagaagcag

SEQ ID NO: 28962 - RNA, 64 nt, Human
ccucuacucugagucacuaucuucccugacagaagacaaggaccaggucuggccugaucccauu

SEQ ID NO: 28963 - RNA, 64 nt, Human
ugcagggaacucacaagcugugucagguaugcaggacaaggaaugucugcucuggggggcacag

SEQ ID NO: 28964 - RNA, 64 nt, Human
cucugcagacugcuaguguucugucuaaaaaccagacaaggaaauacccuucuuuuaugagcag

SEQ ID NO: 28965 - RNA, 64 nt, Human
gucuuuguucaacaagagcuggcagaguaguuaagacaaggaguucaaaaauuccaugaaucuu

SEQ ID NO: 28966 - RNA, 64 nt, Human
cucugcuauaauaugggaccauaaagaugaguaagacaaggauuuuugccuccaaggacuuguu

SEQ ID NO: 28967 - RNA, 64 nt, Human
cauuaggauuaggcagaaucucucagagcugcuggacaaggaggucuacuuauuuuguguggau

SEQ ID NO: 28968 - RNA, 64 nt, Human
uguuuguuuauauagaccuauccucuaaauaugugacaaggaucuagaaauucugagaggggaa

SEQ ID NO: 28969 - RNA, 64 nt, Human
uuaugugugucauucaugaaucucuauaaucaaggacaaggauaauucagucaugaaccuguuu

SEQ ID NO: 28970 - RNA, 64 nt, Human
uucuaaagcaccgacuggagaggaaggcaacagagacaaggagagaagccgagagacaugucug

SEQ ID NO: 28971 - RNA, 64 nt, Human
uagaacaauagagacuguaaaagaacaagcuacagacaaggaaauguuugcaaugcauggaacu

SEQ ID NO: 28972 - RNA, 64 nt, Human
cugacccugguaaauauauuucaaaacuucagaugacaaggauuagaacacucauuaaagaugc

SEQ ID NO: 28973 - RNA, 64 nt, Human
uuucuuugaaaguauuggaaaacuaaaauuaaaugacaaggacuuugaauuagaauuuugcugu

SEQ ID NO: 28974 - RNA, 64 nt, Human
ucuguagcuuuacaauuaauuuaaguacuaaaaagacaaggauuucuuuuaagaaauuuauagc

SEQ ID NO: 28975 - RNA, 64 nt, Human
uuuaaacucuguccauguucuguuagaacucagggacaaggauccaugaaaaagaccugugaug

SEQ ID NO: 28976 - RNA, 64 nt, Human
aagaugcuugccccgcuaguggcagaugugaacugacaaggagugaagcgcccacccagcggau

SEQ ID NO: 28977 - RNA, 64 nt, Human
cuucaugaaagugggaaucacugaacauguagaagacaaggaacauauuguuaacuccugauuc

SEQ ID NO: 28978 - RNA, 64 nt, Human
caaucccugguuagccucuacacaauaauagggagacaaggauuaggagccauaccucccagag

SEQ ID NO: 28979 - RNA, 64 nt, Human
cuuagaaggcccuggaagggaagugaggaggagggacaaggaagaugacuaguuacggagggug

SEQ ID NO: 28980 - RNA, 64 nt, Human
guccaaacuccccaaccgaguucuagaagcuccugacaaggaggcagcauccagccuugaccag

SEQ ID NO: 28981 - RNA, 64 nt, Human
uauguaaaggagugcagggaggggcaggaaaggagacaaggaggccaguauggacacugugucc

SEQ ID NO: 28982 - RNA, 64 nt, Human
guuuuauuuugcacguguagaguuuuugucaucagacaaggacuuugauccuguccccuuuggc

SEQ ID NO: 28983 - RNA, 64 nt, Human
cuuccugaguaaguggauauacaaccucagcaaugacaaggaagaaguguggaaacaguacuug

SEQ ID NO: 28984 - RNA, 64 nt, Human
aaaauucacaauaauguagauagaacaaauuacagacaaggaaagaaaaaacuugaaugaaaug

SEQ ID NO: 28985 - RNA, 64 nt, Human
caccuccguuagcgcacugugucagcgggcuauggacaaggaagaauaguggcagaugcagcca

SEQ ID NO: 28986 - RNA, 64 nt, Human
gcugacaauacaaugaaaaggcuuaaaaagcagagacaaggagugggcuucaugcauuauggau

SEQ ID NO: 28987 - RNA, 64 nt, Human
ucgaacccagagauuuuugagggaugaacggguagacaaggacugagauugccucugacuuccu

SEQ ID NO: 28988 - RNA, 64 nt, Human
gccugacaaugguaccuauuagggaugagauacagacaaggauagcuaucugggacauuauugg

SEQ ID NO: 28989 - RNA, 64 nt, Human
ggccgcucaguguccacuggcauuuugcuaaaccgacaaggaaggcugugugcuuagcucuccc

SEQ ID NO: 28990 - RNA, 64 nt, Human
cuuugguuuccgugucauccuuuuugguguguaggacaaggagccagggaauuggcacguuugg

SEQ ID NO: 28991 - RNA, 64 nt, Human
cuuagcccucagagccggcagcccccuacccucagacaaggaacucucuccucucuuuuuggag

SEQ ID NO: 28992 - RNA, 64 nt, Human
acuuccuuguuaacauauaaaguuauaaaugaaggacaaggaggagauggaaaauguguauuua

SEQ ID NO: 28993 - RNA, 64 nt, Human
accacuucaaaacugguagaauauuuauucauaugacaaggauaccugaguaaaacuauccuuu

SEQ ID NO: 28994 - RNA, 64 nt, Human
uucccaacucgguucucauggaggaguggguggagacaaggagggaguaagucguaggaguaca

SEQ ID NO: 28995 - RNA, 64 nt, Human
cuuugcgagcucugugacugucccacguccaggagacaaggaagguagggcaccugcugcacac

SEQ ID NO: 28996 - RNA, 64 nt, Human
aguagguacucuugagagcaauucaaaucaugcugacaaggauacugauagaaaaagugauuuc

SEQ ID NO: 28997 - RNA, 64 nt, Human
auauguuuucuagaugauuucugagacuugugaugacaaggaaccugaccuaaccccauuuuuc

SEQ ID NO: 28998 - RNA, 64 nt, Human
ggaagagguaauuuuucaccuugcuuuucaguuagacaaggaccaggauugcacugacauggcg

SEQ ID NO: 28999 - RNA, 64 nt, Human
auagugaacauuucuccuaagauuauaaaaauaagacaaggauaucugcugucaaugauuuuau

SEQ ID NO: 29000 - RNA, 64 nt, Human
acauugguccaaccaguccuuuuuugaaguaagggacaaggaguaaguauuuucuuuuuuaagu

SEQ ID NO: 29001 - RNA, 64 nt, Human
ggacgugguuuuagagucuaccuaauauguuaaggacaaggaaaccucugagucuaccuaauau

SEQ ID NO: 29002 - RNA, 64 nt, Human
caaggaaaccucugagucuaccuaauauguuaaggacaaggaaaccucuggacagugguauauu

SEQ ID NO: 29003 - RNA, 63 nt, Human
ggccgccaggggagcuguaagcagccggguggugacaaggagaaaagccuucuagggucacug

SEQ ID NO: 29004 - RNA, 64 nt, Human
aaccauauuggugcccuagaaaugugaggaauaugacaaggacuuuaaaugguugucacgcuug

SEQ ID NO: 29005 - RNA, 64 nt, Human
aagaccugccagaaugcuagucccgagagugucagacaaggaagaagucccugggccucuuccc

SEQ ID NO: 29006 - RNA, 64 nt, Human
uuuaggaucaagacuaggaauuaggagccagguugacaaggacuuuuucugagaguugggugag

SEQ ID NO: 29007 - RNA, 64 nt, Human
aucuuuuguggagacaggugcaaaucagaagauugacaaggaagaacuugagcuugcuaaauaa

SEQ ID NO: 29008 - RNA, 64 nt, Human
cgugcugugucucauggguuuccauagugauaaagacaaggaaacgcugcaggggccacaggca

SEQ ID NO: 29009 - RNA, 64 nt, Human
cagcugcguccacagugaccuggaucaggguggggacaaggacuggacccuccuucuccagaag

SEQ ID NO: 29010 - RNA, 64 nt, Human
uaccaggcaugcuagcuggcccguguaaucccaagacaaggaaaacauucguuuuccucauggg

SEQ ID NO: 29011 - RNA, 64 nt, Human
aaauuuugcauugugugagcuucuacagauuuuagacaaggaccguuuuuacuaaguaaaaggg

SEQ ID NO: 29012 - RNA, 64 nt, Human
agaaaagaaauuaucuaguuuaauuucuucuuuggacaaggaguccuagguauuauauuuugag

SEQ ID NO: 29013 - RNA, 64 nt, Human
uguacacuguaaauagccuuuaccaaacguguuugacaaggaccauaauuaacaucacuuagug

SEQ ID NO: 29014 - RNA, 64 nt, Human
caucccccagaucccacugcugccaaagagaugggacaaggaaccucucucuagccucaggggc

SEQ ID NO: 29015 - RNA, 64 nt, Human
gcaaaccuucuaccuccuaccuacuuuucucugggacaaggauaaaggaauaugauuuuccaga

SEQ ID NO: 29016 - RNA, 64 nt, Human
cucugaugguggcuacacaaacugacccucuugggacaaggacaaaagaugucauugacguagu

SEQ ID NO: 29017 - RNA, 64 nt, Human
uccugucuggggcaucuacuggagcaccucagaagacaaggaggaaaacacuggcucauguuuu

SEQ ID NO: 29018 - RNA, 64 nt, Human
gccguggagcugcugugugacugugucaggccuggacaaggaagacccuuagggaugacguccc

SEQ ID NO: 29019 - RNA, 64 nt, Human
cauggaauugaagagcacuagaaacaacuuccuggacaaggaauguaggaagugagugcugugu

SEQ ID NO: 29020 - RNA, 64 nt, Human
cagggccagccucugucucaggacauuccagaaggacaaggagaugucucucccucucccaaag

SEQ ID NO: 29021 - RNA, 64 nt, Human
aaaaaaaaaaaaaaaaaaaaaaacaaaaaaacuagacaaggagagaggcacuagaacuccagcu

SEQ ID NO: 29022 - RNA, 64 nt, Human
aucauugucuucucuggacugugaagucacugaggacaaggaaacuaaauuuaaugucuguauc

SEQ ID NO: 29023 - RNA, 64 nt, Human
aggaagccaaaguuuucaaacugcugcauacuuugacaaggaaaaucuauauuugucuuccgau

SEQ ID NO: 29024 - RNA, 64 nt, Human
cauccucaguuccucuugcuguuuaugaaucuaagacaaggaaguccuauagaagccaaaggga

SEQ ID NO: 29025 - RNA, 64 nt, Human
gagacuggaaauguugaucucuuagucuucuauagacaaggaggucagacuggagugaauguug

SEQ ID NO: 29026 - RNA, 64 nt, Human
auucuguuauuuuuggaaaguucaaauaugcagggacaaggagguugcugacuguacugacagg

SEQ ID NO: 29027 - RNA, 64 nt, Human
gcagaugugcauguuaaagagauaaagugaucgagacaaggacugacuggguauagaaggaaga

SEQ ID NO: 29028 - RNA, 64 nt, Human
gacacuguucucccuucgguggaagagcucaagggacaaggacacgcgccccccucccagaggc

SEQ ID NO: 29029 - RNA, 64 nt, Human
agagcuuuuaguuaaguaagaagcuauguaaacugacaaggaugcuaaaauaaaagucucugaa

SEQ ID NO: 29030 - RNA, 64 nt, Human
ucaggagcuucaaugaguauggccgacagacauggacaaggagcuguguucaccaucggacuca

SEQ ID NO: 29031 - RNA, 64 nt, Human
gacuuugccucguacaauuaauagugauauuuuggacaaggaguucuggugacaagcuauaccu

SEQ ID NO: 29032 - RNA, 64 nt, Human
cagagcaaacagaaaaagaagguugagggcaauggacaaggaaggaauaaagggagaagaggga

SEQ ID NO: 29033 - RNA, 64 nt, Human
acaggagagacauggaguggcgcuggacagucacgacaaggacuugccuccagcacuggacaca

SEQ ID NO: 29034 - RNA, 53 nt, Human
gaccaguuuaugacagcugaugagacaaggaaccugcagaauguggacaugaa

SEQ ID NO: 29035 - RNA, 64 nt, Human
acugcuugaggaggggcaccugccaccgccagaggacaaggaagugggggccgcuggcccaggg

SEQ ID NO: 29036 - RNA, 64 nt, Human
gcuuucuccucagacucugucccugguaaggagugacaaggaagcucacagcugggcgagugca

SEQ ID NO: 29037 - RNA, 64 nt, Human
cucagggagccagggaccccaaggggaguccuuggacaaggaggccugggcccugagauccucc

SEQ ID NO: 29038 - RNA, 64 nt, Human
gugcacacacuagagagaaauugugaacauuaaggacaaggagaauuggugucuuucuaaaaca

SEQ ID NO: 29039 - RNA, 64 nt, Human
uuggugggcugcacgugccugcgaagaugugguggacaaggaggcucucgggcugggccuugga

SEQ ID NO: 29040 - RNA, 64 nt, Human
guacaaaauuaugaauucauuuuuccuccaggccgacaaggaguuguagaaugaaaaugcccuc

SEQ ID NO: 29041 - RNA, 64 nt, Human
ggacuugacaaagcugaagaguuaucaguccuuugacaaggacagguggggcagggagcaagac

SEQ ID NO: 29042 - RNA, 64 nt, Human
ugcaguggaaagagcacugaacuaggaguuggaagacaaggaugugguccuggcucugccacug

SEQ ID NO: 29043 - RNA, 64 nt, Human
guguuaugcccauuggggacacagaggugaacaagacaaggaaugccaucagggaauucaccuu

SEQ ID NO: 29044 - RNA, 64 nt, Human
cauccccgagacgcaacugcaggcugaggaccgcgacaaggacgacauucuguucuacacccuc

SEQ ID NO: 29045 - RNA, 64 nt, Human
ccugagaaaucgagauuaucacuccacuuuuucagacaaggaaacugaggcucagggaagccaa

SEQ ID NO: 29046 - RNA, 64 nt, Human
gauauagaaggugguuucgaaggaggagacuccagacaaggaaaacagaaaucuuauguugcca

SEQ ID NO: 29047 - RNA, 64 nt, Human
ucccugaacuuaagauagccacaaucagaaaaaggacaaggacaugagacaguggugauggcca

SEQ ID NO: 29048 - RNA, 64 nt, Human
gaccguuccuaggaugggacagugggucaggcaggacaaggagaaagcagggcagaaugaugcc

SEQ ID NO: 29049 - RNA, 64 nt, Human
aaggagcagggcuuggagcucgggugguggagaugacaaggacacuguggggucugggucccca

SEQ ID NO: 29050 - RNA, 64 nt, Human
gcugguuuuuaaaaaauguuuucuggggaaaggggacaaggaaggaaaagaaagaagagaaggg

SEQ ID NO: 29051 - RNA, 64 nt, Human
gauccugaugggucucuaagguucccuccaagaagacaaggacaggagacuugggaaggaccaa

SEQ ID NO: 29052 - RNA, 64 nt, Human
gagggaggagaaagugaagaagcagcggucagcagacaaggagaagagcaaggguucccucaag

SEQ ID NO: 29053 - RNA, 64 nt, Human
acacaggcaagaggaauuuucccucggccuuacugacaaggacaccaaccuagggugcaaacag

SEQ ID NO: 29054 - RNA, 64 nt, Human
agcucacuuuauuuuuauugguuccugaagacgggacaaggaacaaauacauacguuaauauga

SEQ ID NO: 29055 - RNA, 64 nt, Human
gucucccucugcaggcugggggcagaggccugaggacaaggaagagcuuugccauccccugcau

SEQ ID NO: 29056 - RNA, 64 nt, Human
aauccagccuuccagcaagagauuguuuuucaaggacaaggacuuugauuuauuucugccccca

SEQ ID NO: 29057 - RNA, 64 nt, Human
aaggaccaauucagaacugaaaagcuaugcauaggacaaggaagauacauagaaugggguggaa

SEQ ID NO: 29058 - RNA, 64 nt, Human
uauaagcaccaauaucaacuucauguggauuuuugacaaggagggguaguuuguaauuucauuu

SEQ ID NO: 29059 - RNA, 64 nt, Human
ugagcgcucacagcuucauuuggcccagguugaagacaaggaaagcucugcuguggcugccucu

SEQ ID NO: 29060 - RNA, 64 nt, Human
ucccuuggaucagccaagcgaaacuuggagcuuugacaaggaacuuuccuaagaaaccgcugau

SEQ ID NO: 29061 - RNA, 64 nt, Human
gguacaaauaaacaggugccugaacuaguucacagacaaggaaacuucuauguaaaaaucacua

SEQ ID NO: 29062 - RNA, 64 nt, Human
gguuuuuuuuuuuuuuuuuuuuuuuuuggcaggggacaaggagcaugguggucuuggcuauuug

SEQ ID NO: 29063 - RNA, 64 nt, Human
ggcugaaggcuccucuggguuugaggguccaagggacaaggaggagaagccuagcaggauuuca

SEQ ID NO: 29064 - RNA, 64 nt, Human
ugcccaagggccagcucaguuuauccuucggagagacaaggauaugcaugauucuuaaccaggc

SEQ ID NO: 29065 - RNA, 64 nt, Human
uggcccuggaugucacacucccaccagggcugaagacaaggauguuccaaaaccccaccucccu

SEQ ID NO: 29066 - RNA, 64 nt, Human
caggaguggcugucucuggucucuuccuuuagcugacaaggacacuccugaggucuuuguucuc

SEQ ID NO: 29067 - RNA, 64 nt, Human
aaacccagaaaagacagaggugauggaauuaguagacaaggauauuaaaagagcuauuguaaau

SEQ ID NO: 29068 - RNA, 64 nt, Human
auuauucagcuggcugauaccacauagauagcuugacaaggagugcugucuguccuuaccacau

SEQ ID NO: 29069 - RNA, 64 nt, Human
aauuccucuuuauuuggugccacagucaccaaaugacaaggauuugccacuuucccaccaaauu

SEQ ID NO: 29070 - RNA, 64 nt, Human
augucuccccugcccccuggcauuagggcagcaugacaaggagaggaaauaaauggaaaggggg

SEQ ID NO: 29071 - RNA, 64 nt, Human
uaggagagcuucuuuucuaacuaccaucugaucagacaaggaaugaagcaaugacugugggcug

SEQ ID NO: 29072 - RNA, 64 nt, Human
ccuguccaccuggagacccggagacagaggccuggacaaggagugaacacgggaacugucacga

SEQ ID NO: 29073 - RNA, 64 nt, Human
gcugggagugaguagcucuguguuuagaguuggggacaaggaugacaccgaagguccaggaguc

SEQ ID NO: 29074 - RNA, 64 nt, Human
ggagaccaggauuuuauggcuccccucacugauggacaaggaggucugugccaaagaagaaucc

SEQ ID NO: 29075 - RNA, 64 nt, Human
acccaagaagucugauggccaccugagugcaggugacaaggaccugacagagcccaugcagggc

SEQ ID NO: 29076 - RNA, 64 nt, Human
gguuccaaugggaaaugacucuuuacuauuaaaagacaaggaaagcucugacuucguacuucuc

SEQ ID NO: 29077 - RNA, 64 nt, Human
ccacccaugagaacagcgugagcugguggaucaugacaaggaggaaaaauguccccccaggcau

SEQ ID NO: 29078 - RNA, 64 nt, Human
acccggcugcauacccgggcagggcucccacagagacaaggagggcacaggugucugcccccuc

SEQ ID NO: 29079 - RNA, 64 nt, Human
cagccaucaaggggcugguguugcuccugucccagacaaggaagccccucuuuacaucagccau

SEQ ID NO: 29080 - RNA, 64 nt, Human
guguggccaauggagggauugcuucuuggguugugacaaggaugggcuauagggcaagggcuga

SEQ ID NO: 29081 - RNA, 64 nt, Human
ugugcauucuuucacaggagcuuuucaugcauuugacaaggauggagaugguaucaucaagcuc

SEQ ID NO: 29082 - RNA, 64 nt, Human
cuauaacucaggcagccugggagucaggaacccagacaaggaaucccauuccagccucacccca

SEQ ID NO: 29083 - RNA, 64 nt, Human
aggacagcaaugcagagagggcauaggaucugaggacaaggaaauuccucagcauggcguauca

SEQ ID NO: 29084 - RNA, 64 nt, Human
gaaauagcuccuugggacacaaacaagaaauguggacaaggagggacauuugcauacuccuacu

SEQ ID NO: 29085 - RNA, 64 nt, Human
aaagaaucauuuaaaaguaaagugacuucuaagagacaaggaaguaggaacauuucugauauua

SEQ ID NO: 29086 - RNA, 64 nt, Human
ccgggagaaugaguacauaagcaggcuggcucaggacaaggaggagaugaagguagggcgugca

SEQ ID NO: 29087 - RNA, 64 nt, Human
ccuugccauuagcaugccucaugcaucaucagaugacaaggacaacccucaugacgaagcaaca

SEQ ID NO: 29088 - RNA, 64 nt, Human
gcccucaccucugugcccagccuggaaaccuacagacaaggaggaguuccaccaugagcucacc

SEQ ID NO: 29089 - RNA, 64 nt, Human
gcuuccaaaauuagcaucucauugagccagagaagacaaggagaucucccucugggcaucuggc

SEQ ID NO: 29090 - RNA, 64 nt, Human
aggggagagugaaggccugcaggagggcaggcgagacaaggaggguguccagggcuagggagug

SEQ ID NO: 29091 - RNA, 64 nt, Human
cagcccacuucugccauauucuguuggccagugugacaaggauugcuacuguccuacccacccu

SEQ ID NO: 29092 - RNA, 64 nt, Human
gagcguguuucuugagaggaauguccccgaguuggacaaggaggcuguuucugcacaucagcuc

SEQ ID NO: 29093 - RNA, 64 nt, Human
ugagagacagacagaugccccacgaggauggcuggacaaggacuuuuacuuuuuauuacauaaa

SEQ ID NO: 29094 - RNA, 64 nt, Human
cauggacuuuguuaguuucuccaagcaggacauggacaaggaugaucuaggaagacuuuggaaa

SEQ ID NO: 29095 - RNA, 64 nt, Human
cacccuggagaucccaaaccuagcccccuagugggacaaggaccugacccuccugcccgcauac

SEQ ID NO: 29096 - RNA, 64 nt, Human
uaaguuaccacagacucuguaguguguaaauguugacaaggaauuggaucacaaucauguagca

SEQ ID NO: 29097 - RNA, 64 nt, Human
cucagaggaguuuaacgcgaucuucacauuuuacgacaaggauagaagcggcuacauugacgag

SEQ ID NO: 29098 - RNA, 64 nt, Human
uuggguucuccugcagcuggguggucugcaguuugacaaggagcugaggucgcucauugccuac

SEQ ID NO: 29099 - RNA, 64 nt, Human
ugacaccgcaguucuguucagccaucagaagagagacaaggaauuaaaaauuucuuuuuaaucc

SEQ ID NO: 29100 - RNA, 64 nt, Human
cagacaguguguggaggggcaggagcgugaugcagacaaggacuuagucaugacugauuuuccu

SEQ ID NO: 29101 - RNA, 64 nt, Human
gugacacuggcugggcaccugccccacgaccaaugacaaggauuuccagcugaaugcuuuauuc

SEQ ID NO: 29102 - RNA, 64 nt, Human
aucaugaaggugugcaaaugauucuuacggcauggacaaggauuuuucaauuuauuuuuuaaac

SEQ ID NO: 29103 - RNA, 64 nt, Human
gcaccccauauuauuuccaaaaauaucuuggacagacaaggaccaaaaugccaaaaucucagcg

SEQ ID NO: 29104 - RNA, 64 nt, Human
cccaggaaacagcaugugguucagagaaaagagcgacaaggaaaaguuaggacuccugaggucc

SEQ ID NO: 29105 - RNA, 64 nt, Human
caccuucugccaccaccugcaccugccuacccacgacaaggagacagaggagcugguagccagc

SEQ ID NO: 29106 - RNA, 64 nt, Human
ucugucugcuucccucaccccuugcccaauaaaggacaaggacuucagaggaguacuuucauua

SEQ ID NO: 29107 - RNA, 64 nt, Human
uuucuucucaucaccagcucagcuaggccgggcagacaaggacagaagacucugggccacugua

SEQ ID NO: 29108 - RNA, 64 nt, Human
gggcagagacagaccacugacaaauacacagauagacaaggaauuucccaugguaaaaagggau

SEQ ID NO: 29109 - RNA, 64 nt, Human
uaaugcauuugagcauggccagacuauucccuaggacaaggaagcagagggaaaugggaggucu

SEQ ID NO: 29110 - RNA, 64 nt, Human
gagcauccaucuucugacauacaacugaggucaugacaaggaaaaaaaacaccacauuuaucua

SEQ ID NO: 29111 - RNA, 64 nt, Human
accuaugauaaauaaccaggaagcauugcuuuuggacaaggaaggacagaggguuuugauuuua

SEQ ID NO: 29112 - RNA, 64 nt, Human
aaagaucaagaucaaagauucuccccaucucacagacaaggaaacugaggccagagggaggaga

SEQ ID NO: 29113 - RNA, 64 nt, Human
gcgggccgcgguuccuccuuagggccuucuccccgacaaggaguccgacggggcggaugcugca

SEQ ID NO: 29114 - RNA, 64 nt, Human
uaccaagaaugaguuccugaaacccagggccagagacaaggacaacuuaggggaagacgggguu

SEQ ID NO: 29115 - RNA, 64 nt, Human
uuaggugauuuuacuuccagcugcagguagucuugacaaggaguguuuaaacagaaggcucaag

SEQ ID NO: 29116 - RNA, 64 nt, Human
ucccuccaaacagaccuugaggcccaagacccaggacaaggaacagcaagcucaggugggaugg

SEQ ID NO: 29117 - RNA, 64 nt, Human
acagagcccugggaaaaagaggggguggaagacagacaaggaagguggaauguucuguuuuggc

SEQ ID NO: 29118 - RNA, 64 nt, Human
ucacugcugagcuccucaccuggacagucuccuggacaaggaguuuccagcugcuggcuggagu

SEQ ID NO: 29119 - RNA, 64 nt, Human
gcaucagucugaaagccagggaguuggucugagugacaaggaauugguuucagaugaugaagaa

SEQ ID NO: 29120 - RNA, 64 nt, Human
caugcaccaguuccacacaccaucccauuuuacagacaaggacgcugaggccugcagcagcagu

SEQ ID NO: 29121 - RNA, 64 nt, Human
ccgugaugcauucugccuuccugucuacuaggaugacaaggaguaugugggcuuugcaacccuc

SEQ ID NO: 29122 - RNA, 64 nt, Human
ccucccugugcuggaauugacuuuccugagcauggacaaggaaaggugaagucuggggagcaga

SEQ ID NO: 29123 - RNA, 64 nt, Human
ucccuauaugcaccccuggaaccagcaagucccagacaaggagagcggaggaggaagucauggg

SEQ ID NO: 29124 - RNA, 64 nt, Human
cuguugccucccagugacccugcugggacaccaggacaaggaagacaguuucgccucucgaaag

SEQ ID NO: 29125 - RNA, 64 nt, Human
ggcugaauguuuuccccuuaagauugggaagaaggacaaggauguucacucggcacuacuucua

SEQ ID NO: 29126 - RNA, 64 nt, Human
uucuuuuauggaauucaugaagcaagugguaugugacaaggacuccacuuauaaauauaacugu

SEQ ID NO: 29127 - RNA, 56 nt, Human
auuuuggucaagaaggcuaagccaaagacaaggaagaugcuuaccauauguauucu

SEQ ID NO: 29128 - RNA, 64 nt, Human
uaggagagagacaggacagacccgcuuuucccgagacaaggaccccccaugucacggcagcuuc

SEQ ID NO: 29129 - RNA, 64 nt, Human
gcugcaccccaugcuccgggcccacacccugcaggacaaggagcuccagacaggacguccauaa

SEQ ID NO: 29130 - RNA, 64 nt, Human
ucugacgccaaaugggcuucccauggucacccuggacaaggaggcaaccaccccaccuccccgu

SEQ ID NO: 29131 - RNA, 64 nt, Human
acacuuuggaggggguccauguccaagagacccugacaaggaaggaguugagcccuggguaggc

SEQ ID NO: 29132 - RNA, 64 nt, Human
ggaugcagcccuaacugcaaaagucagagaggcugacaaggaccaaugcuucuuuaucuggugc

SEQ ID NO: 29133 - RNA, 64 nt, Human
ucuugucugagccaggccaccaaagccaugccacgacaaggacaagaugagcagcaaacaccag

SEQ ID NO: 29134 - RNA, 64 nt, Human
ugagcgggagcgcagagagcggagccgggagcgagacaaggagcgagaacggcgacgcucccgc

SEQ ID NO: 29135 - RNA, 64 nt, Human
cucccgggaccggcggaggcgcucacggagucgcgacaaggaggagcggaggcgcuccagggag

SEQ ID NO: 29136 - RNA, 64 nt, Human
ggaggagcggaggcgcuccagggagcggagcaaggacaaggaccgggaccggaagcggcgaagc

SEQ ID NO: 29137 - RNA, 64 nt, Human
aagucaaccagcaugcagggggccuuccucuaaagacaaggacuccacaugcuuuucuuuuucu

SEQ ID NO: 29138 - RNA, 64 nt, Human
ccuggagcagggacggagggggagaaugggaggagacaaggagcugaaggaguaguucccgaag

SEQ ID NO: 29139 - RNA, 64 nt, Human
cauccccaguaaaccuugggucauuauucauacugacaaggaaccgagucaauuuggugaauag

SEQ ID NO: 29140 - RNA, 64 nt, Human; identical to SEQ ID NO: 29139

SEQ ID NO: 29141 - RNA, 64 nt, Human
gcuuuuuguucaaggagauuuaugaaaagacucugacaaggacucuugaauacaaguuccugau

SEQ ID NO: 29142 - RNA, 64 nt, Human
cuuuuucuucaaggagauuuauggaaaagacucugacaaggacucuugaauacaaguuccugau

SEQ ID NO: 29143 - RNA, 64 nt, Human
acgucccuaaggcuguccugacccuccaugcugcgacaaggacagggaauggucggucacuaug

SEQ ID NO: 29144 - RNA, 64 nt, Human
caaggugguggcugugaggagggcagcaaaugcugacaaggaugaaaagcacauggaaaaaaau

SEQ ID NO: 29145 - RNA, 63 nt, Human
auuccuuauacucucucugaaggcaaagauggggacaaggacuaagagucagaauguugacac

SEQ ID NO: 29146 - RNA, 64 nt, Human
augcugcaggcagggcuguggcccagcugggucugacaaggacccagcugucacaucgugaaua

SEQ ID NO: 29147 - RNA, 64 nt, Human
guggggagaagcucaguggccguuugcugccacugacaaggauuucacaugcagaagagaaaag

SEQ ID NO: 29148 - RNA, 64 nt, Human
cgaagcucauaaaauucaacgugaggaagcaagugacaaggacgcccgaagcacaguggacggu

SEQ ID NO: 29149 - RNA, 64 nt, Human
auugaauagaaauucugcauguguggggagaauggacaaggacuuaggaaaaaguccucaucaa

SEQ ID NO: 29150 - RNA, 64 nt, Human
gucuggggccuuuaucaaaaaaagacucagccaagacaaggagguagagaggggacugggggac

SEQ ID NO: 29151 - RNA, 64 nt, Human
uauggauggggaugacuucccuaagaucccaugggacaaggauguggcaaggcuuggaugagau

SEQ ID NO: 29152 - RNA, 64 nt, Human
acaggagaccguugcuccagugcaugucugcugggacaaggauuccuggccucgaagcccuggg

SEQ ID NO: 29153 - RNA, 64 nt, Human
gccuuugggaccauuaguccauuuccauuuuacagacaaggaaaucaagacccagcuuggggga

SEQ ID NO: 29154 - RNA, 64 nt, Human
aaugagaacauuauucucuuuuuaguccuugugagacaaggaugaagucucaguugcugauacu

SEQ ID NO: 29155 - RNA, 64 nt, Human
auauuuucuaagaagaagaauagaucauaaaucugacaaggaaaaaguugcuuacccaaaaucu

SEQ ID NO: 29156 - RNA, 64 nt, Human
uguuacuggaacagagaccucagcccaagcucaggacaaggaggccucccugggagagggggcc

SEQ ID NO: 29157 - RNA, 64 nt, Human
uguaaagguauuaauguacuaguaagguguuaaugacaaggaauuaguacuauuccuguuguaa

SEQ ID NO: 29158 - RNA, 64 nt, Human
uuuggaaugaauccuaagaggcagggaucuuaaggacaaggaagagaagagagagagggaggga

SEQ ID NO: 29159 - RNA, 64 nt, Human
aaaacacggaugcugguauuuuaacagauggagagacaaggaaaggaaaggaaaggccuggcau

SEQ ID NO: 29160 - RNA, 64 nt, Human
gaacaguugucaucaccgggcauugauuggcagggacaaggagcugcuuggguguggaaaguug

SEQ ID NO: 29161 - RNA, 64 nt, Human
cccguggaaugaaauccgaaacaucucguacagugacaaggaguuuacuauuaaaccacuggau

SEQ ID NO: 29162 - RNA, 64 nt, Human
cuuugcccuucuccuccaauacauaaaggacacagacaaggaacuugcugaaaggccaaccauu

SEQ ID NO: 29163 - RNA, 64 nt, Human
aaagggggccauggacugcuguggcaaauagggagacaaggagacagacccugcaguccuacua

SEQ ID NO: 29164 - RNA, 64 nt, Human
ucugcucgucaucuguggcugcaggggucagacagacaaggauggggacugccagggcaccacu

SEQ ID NO: 29165 - RNA, 64 nt, Human
augccuggaggggccgugaacacagaacccucaagacaaggaugacagagcuggaggacacauc

SEQ ID NO: 29166 - RNA, 64 nt, Human
ccacggauauuuugauccaagagagaauuacucugacaaggagucccugucguucaugauagac

SEQ ID NO: 29167 - RNA, 64 nt, Human
aguggcagggagugcugagugccacaggaagucagacaaggaaggagaguguggggcaggugcc

SEQ ID NO: 29168 - RNA, 64 nt, Human
aucccucccccacuggagugauuucagugaaucagacaaggaaggauguguaggaucacuacug

SEQ ID NO: 29169 - RNA, 64 nt, Human
gcccagccaagcugcccucacuacagagaccuuggacaaggauccagccagucccucucugccc

SEQ ID NO: 29170 - RNA, 64 nt, Human
aauggaaucuagaggaauacguggggugggucuggacaaggagcggcaggaaucaccacccauc

SEQ ID NO: 29171 - RNA, 64 nt, Human
ggagcaggggcuggcgugggaggucugggggacagacaaggaugauggaccccucagaggcaag

SEQ ID NO: 29172 - RNA, 64 nt, Human
gccuguguccgcuuuugcagcucaaugcagccaugacaaggaaagaaaagacaaaggaaggcca

SEQ ID NO: 29173 - RNA, 64 nt, Human
gauuuuaaaauguucccuguaaaagucagcccaugacaaggaaauuuacaaaauacuagaguau

SEQ ID NO: 29174 - RNA, 64 nt, Human
uuccuuggggugcuuggacaaaucuauccgaugggacaaggagcaccggauucuuucucggguu

SEQ ID NO: 29175 - RNA, 64 nt, Human
guuuguuugugugugugugugcucauuuugaggggacaaggaucucuagcauucauaacauucu

SEQ ID NO: 29176 - RNA, 64 nt, Human
ccagccucccacugacuaggcauguuaggaauuagacaaggauggagagacugguuuuuuccag

SEQ ID NO: 29177 - RNA, 64 nt, Human
ccuccuaauuuacauccuaagaguggaaccaugugacaaggacuggagugccauuggcugugga

SEQ ID NO: 29178 - RNA, 64 nt, Human
guacaggaugaauuuaaauguguuuuuccugagagacaaggaagacuuggguauuucccaaaac

SEQ ID NO: 29179 - RNA, 64 nt, Human
cgauaaaagacagugaaagaaaauaacaauaaaagacaaggaaaaaauaacaaugaaaguugau

SEQ ID NO: 29180 - RNA, 64 nt, Human
ugauuucuguccuugcuuacauuuggaggacagggacaaggacugagcaaaaacaaaaugaaaa

SEQ ID NO: 29181 - RNA, 64 nt, Human
uggcauaagcaacauuuagaaguuccuuugcgcugacaaggauuccacuguuagagcccuuacc

SEQ ID NO: 29182 - RNA, 64 nt, Human
auuguuccauccucuacuucuggugcaguccugggacaaggacaagggaaagggaugggugaac

SEQ ID NO: 29183 - RNA, 64 nt, Human
cauguaaaauuccuuccagccagaaagaaagaaagacaaggaguaagggggauuuagaguuaug

SEQ ID NO: 29184 - RNA, 64 nt, Human
uacacagaaucuccugauaguaaagggggcuggagacaaggauaaguuauagagcaguuggagg

SEQ ID NO: 29185 - RNA, 64 nt, Human
gccccuggaacacacucaggcuucccugacucaggacaaggaccacgggaggcccaggugcgga

SEQ ID NO: 29186 - RNA, 64 nt, Human
gcccgagaccugcacagaugaaggagcagagguucugaccgagaggcugagccaggccgggguc

SEQ ID NO: 29187 - RNA, 64 nt, Human
aguggacagugauucaaguaaaccuccugaaacacugaccgacccuccuggggucugucaggaa

SEQ ID NO: 29188 - RNA, 64 nt, Human
uguuacuuguggagaaacuaaaaauguuguacaacugaccgaaagaaaacccuuggggauaagu

SEQ ID NO: 29189 - RNA, 64 nt, Human
guggaucgcaaguggagcuuuugcugauguguuccugaccgaccccgggucccaccugugcccc

SEQ ID NO: 29190 - RNA, 64 nt, Human
caacacuuuuugguuuuuuucauuuuguuuugcucugaccgauuccuuuauauuugcuccccua

SEQ ID NO: 29191 - RNA, 64 nt, Human
caugcuuuuguaccacuguuuuguaccugacucccugaccgauuuguauuuuuuauauacaacu

SEQ ID NO: 29192 - RNA, 64 nt, Human
gaggcauccuuuccucuagaagaccugagucuuccugaccgacuccaccaucacccaaucuguu

SEQ ID NO: 29193 - RNA, 64 nt, Human
cuccucucaggugcacccgcuagcugugcugcugcugaccgacggggacgugcacauccguggu

SEQ ID NO: 29194 - RNA, 64 nt, Human
cugauuccacagaguggggcucaggcaucugugacugaccgauugauuugauuuguuuuuguuu

SEQ ID NO: 29195 - RNA, 64 nt, Human
uccgcaguggagagcagagcgggcgguaaagcugcugaccgaucucccuccuccucaccccaag

SEQ ID NO: 29196 - RNA, 64 nt, Human
gccucuaagcuagcaccccguaagaagagccuaccugaccgacuuggggagggaacacagaggu

SEQ ID NO: 29197 - RNA, 64 nt, Human
ggccugugugcacccaacgugaugcuaugcaugucugaccgacgaucccucgaccagaaucaga

SEQ ID NO: 29198 - RNA, 64 nt, Human
gaaugggauaccuccagguuccaguaaaauucuucugaccgaaaccaauguggguguuagaaaa

SEQ ID NO: 29199 - RNA, 64 nt, Human
agccugguagggaagggacccgcguggcgcgacccugaccgaucccaccucaacagcucccuga

SEQ ID NO: 29200 - RNA, 64 nt, Human
ccagcgugaaaagaagaagagaguuccuccaauucugaccgagugcugaucauucccuagagac

SEQ ID NO: 29201 - RNA, 64 nt, Human
cagaaagggaacaguccauaacuuaccucugcuucugaccgaugguguuugggaauagguuacu

SEQ ID NO: 29202 - RNA, 64 nt, Human
ggccucccagccggugcgggagccccucacugcccugaccgacuccgcaguccccggggaggag

SEQ ID NO: 29203 - RNA, 64 nt, Human
acuuggggacauaauuucagugggaaauaugccacugaccgauuuuuuuuuuuuccucuuugca

SEQ ID NO: 29204 - RNA, 64 nt, Human
cucccuacgccagcugggcacaucuaccaguauccugaccgacccgggccgcaucccugagcaa

SEQ ID NO: 29205 - RNA, 64 nt, Human
ucccuuagcagucaggucauaacagggcacauuucugaccgaacccucucaaggcagaggagga

SEQ ID NO: 29206 - RNA, 64 nt, Human
ugaacuuuuaaaaauccccuucacacuuaauguacugaccgagacagaaguaccugaaaacagc

SEQ ID NO: 29207 - RNA, 64 nt, Human
auuuaucagcauucccaagggagcuugcacgguacugaccgagugcugagacuacugguauucc

SEQ ID NO: 29208 - RNA, 64 nt, Human
cagcccuggggcucagggcagccaccccgggccgcugaccgacugaccucuccucacggaggcc

SEQ ID NO: 29209 - RNA, 64 nt, Human
uccucugccugcuguccccuucccacccucaucccugaccgacuccacuuaacccccaaaccca

SEQ ID NO: 29210 - RNA, 64 nt, Human
augccagcggggcugggcaggccagccgggcauccugaccgaugggcacccucucccagggcag

SEQ ID NO: 29211 - RNA, 64 nt, Human
cagacugguugaguucagguagcugccccuggcucugaccgaaacagcgcuggguccaccccau

SEQ ID NO: 29212 - RNA, 64 nt, Human
ccugaccccuccucaccuauucucuuccucuauccugaccgauguaagcauugugaugaaacag

SEQ ID NO: 29213 - RNA, 64 nt, Human
uaacuaaauuacaggggacucagaggccgugcuccugaccgauccagacacuauuacuggcuuu

SEQ ID NO: 29214 - RNA, 64 nt, Human
caugacagcugcucaaagcagguuucugagauagcugaccgagcucugguaaaucucuuuguca

SEQ ID NO: 29215 - RNA, 64 nt, Human
agagccagaugccuaugcguuguuccauaagaagcugaccgagggugugcugaugcgggacccc

SEQ ID NO: 29216 - RNA, 64 nt, Human
acccaucccgcgggugaccggugccuguucuccccugaccgagccugugagcacaucgcccccu

SEQ ID NO: 29217 - RNA, 64 nt, Human
uaaauaccccaguguugagugcaucaauaacuuacugaccgaacauuucaguuauuuguuuaga

SEQ ID NO: 29218 - RNA, 64 nt, Human
gggaucaguguccggcuggccgacguggcauuugcugaccgaaugcucauagagguugaccccc

SEQ ID NO: 29219 - RNA, 64 nt, Human
cagugucagggucggaguggccuggcucuuagcacugaccgaccauugccauuucuggccucgc

SEQ ID NO: 29220 - RNA, 64 nt, Human
acuugaaaucuuugcagcaaugaguugggaaaaacugaccgaguaccugcuccaucaugcuuga

SEQ ID NO: 29221 - RNA, 64 nt, Human
caaauauuucucauugaguuucuuguuuuggugccugaccgaaccaacgacagccccaaucuuc

SEQ ID NO: 29222 - RNA, 64 nt, Human
caugugagcgcgggcagcgggcagggacugaagccugaccgaccuccagcagcacucggacguc

SEQ ID NO: 29223 - RNA, 64 nt, Human
gggcaggaagacaccuuucccuccuuguuccucgcugaccgaugacccuggaacuccacggugc

SEQ ID NO: 29224 - RNA, 64 nt, Human
aaggaaucaugugggccuguguuaaaucaaauagcugaccgacaguuaucccuuccucccuauu

SEQ ID NO: 29225 - RNA, 64 nt, Human
ugggccagcuacgugggagggaggaauuacacagcugaccgaauccggcuucggaugaggugag

SEQ ID NO: 29226 - RNA, 64 nt, Human
gucacauccacgcacucccaaaggccagaaguaucugaccgaccuacgccacuggaaacacacc

SEQ ID NO: 29227 - RNA, 64 nt, Human
agugaccacgggcggggcugugcgggcgcccggacugaccgaagggacggggcccgccccaggc

SEQ ID NO: 29228 - RNA, 64 nt, Human
auauucuguuggcaagaagcucagcacugcauuccugaccgaggucagaaccagaucaaucuca

SEQ ID NO: 29229 - RNA, 64 nt, Human
ucacuugucgggggcccaaguggggugcucuggucugaccgaugugucucccagaacuauucug

SEQ ID NO: 29230 - RNA, 64 nt, Human
gcaacaggucuuccacuggcucgaggcugcgaggcugaccgacaggggcgcccaauagaguuug

SEQ ID NO: 29231 - RNA, 64 nt, Human
gcccccgccccaguagguucaaggcaaagcagcucugaccgaauucuaggcaggggugggggca

SEQ ID NO: 29232 - RNA, 62 nt, Human
ugagcagcagcauggccugaggggcugcuggacugaccgaggggcugcccagcaagacugca

SEQ ID NO: 29233 - RNA, 64 nt, Human
uuuaaacacuguauagacggaagagccugcauuccugaccgaaccuucaguuggucucgguugu

SEQ ID NO: 29234 - RNA, 62 nt, Human
ugcacagaugaaggagcagagguucugaccgagaggcugagccaggccggggucugggcccu

SEQ ID NO: 29235 - RNA, 62 nt, Human
gugguggcacaucuguggucccagcuacuugagaggcugagccaggaggaucgcuugagccc

SEQ ID NO: 29236 - RNA, 62 nt, Human
gguggcacgugccuguagucccagcuacuugggaggcugaggcaggagaaucacuugacccc

SEQ ID NO: 29237 - RNA, 62 nt, Human
ggugccgcauaacuauaaucccagcuacuugggaggcugaggcaggagaaucgcuugaaccc

SEQ ID NO: 29238 - RNA, 62 nt, Human
gguggugggcuccuguagucccagcuacuugggaggcugaggcaggagaaucgcuugaaccu

SEQ ID NO: 29239 - RNA, 62 nt, Human
gguggcgggcgccuguagucccagcuacucgggaggcugaugcagaagaauggcgugaaccc

SEQ ID NO: 29240 - RNA, 62 nt, Human
ucacccaugaagacaggacagugcuucagccugaggcugagacugcgggaugguccuggggc

SEQ ID NO: 29241 - RNA, 62 nt, Human
aguggcucacgccuaugaucccagcacuuugggaggcugaggcggguggaucaccugagguu

SEQ ID NO: 29242 - RNA, 62 nt, Human
ggcuggcugcagugacgugcaccuguacucaggaggcugaggggaggaucacuggagcccag

SEQ ID NO: 29243 - RNA, 62 nt, Human
agccacuguagaucauuaaaguuccuccuugagaggcugagccguagccaggauuggggaga

SEQ ID NO: 29244 - RNA, 62 nt, Human
aguggcaugugccuguagucccagcuacucaggaggcugaggcaggagaaucacuugaaccc

SEQ ID NO: 29245 - RNA, 62 nt, Human
uccugcucgcccucagccgcggagccucugcggaggcugagccccgcgaccggagcgccgcu

SEQ ID NO: 29246 - RNA, 62 nt, Human
aguggcucacaccucuaaucccagcacuuugggaggcugagguagguggaucacccaagguc

SEQ ID NO: 29247 - RNA, 62 nt, Human
gguagcaggcgcuuguaaucccagcuacuugggaggcugaggcuggagaaucgcuugaaccc

SEQ ID NO: 29248 - RNA, 62 nt, Human
gguggugcaugccuguagucccaguuacucgggaggcugagacaggagaaucgcuugaaccc

SEQ ID NO: 29249 - RNA, 62 nt, Human
gguggcacacgccuauagucccagcuacucaggaggcugaggcaggagaaucacuugaaccc

SEQ ID NO: 29250 - RNA, 62 nt, Human
ucggcccugaacagagcagcugcugaugucuggaggcugauuuuccuguucucuguucucca

SEQ ID NO: 29251 - RNA, 62 nt, Human
agucacucacuccuguaaucccaacacuuugggaggcugaggcgggaggaucacuugagccc

SEQ ID NO: 29252 - RNA, 62 nt, Human
uagaggcaggaaaugggaaccgagcugaagcagaggcugaguuagggggcuagaggacagug

SEQ ID NO: 29253 - RNA, 62 nt, Human
gcuggcaugugccuguggucccagcuacucaggaggcugaggcaggaggaucacuugagcac

SEQ ID NO: 29254 - RNA, 62 nt, Human
gguggcacaugccuguaaucccagcuacuugggaggcugaguugggaggauugcugcaaucu

SEQ ID NO: 29255 - RNA, 62 nt, Human
gguggcucaugccuguaaucccagcauuuugagaggcugaggcggguggaucacuugagguc

SEQ ID NO: 29256 - RNA, 62 nt, Human
gguggcaggugcuuguaaucccagcuacuugggaggcugaggcaggagaaucacuugaacca

SEQ ID NO: 29257 - RNA, 60 nt, Human
gguagcucaugccuguaaucccagcacuuugggaggcugaggcaggcggaucaugagguc

SEQ ID NO: 29258 - RNA, 62 nt, Human
gguagugcacaccuguaguccuagcuacuugggaggcugaggcaggaggaucccuugagucc

SEQ ID NO: 29259 - RNA, 62 nt, Human
caauucauucaacuccuuauaaaaaugaugaggaggcugaaaaccaagaauuuugauuggga

SEQ ID NO: 29260 - RNA, 62 nt, Human
ggugacaggcaccuaugguuccagcuacucaggaggcugaggugggaggaucgcuugugccu

SEQ ID NO: 29261 - RNA, 62 nt, Human
aguggcacacgccuguagucccaguuacuugggaggcugaggcaggagaauugcuugaaccu

SEQ ID NO: 29262 - RNA, 62 nt, Human
gguggcaccugccuguaaucccagcuacuugggaggcugaggcaggagaaucgcuugaaccc

SEQ ID NO: 29263 - RNA, 62 nt, Human
cccucuccuucuuggugauucaaagguuaauagaggcugaggagauugcaggggaaacaccc

SEQ ID NO: 29264 - RNA, 62 nt, Human
gagcuagagggagcaggcccaagggcagagcagaggcugaggcacggggagccagccccacu

SEQ ID NO: 29265 - RNA, 62 nt, Human
gauggcacaugccuguaaucccagauacuugggaggcugaggcaggagaauugcuugaaccc

SEQ ID NO: 29266 - RNA, 62 nt, Human
ggugcugcacgccuguggucccagcuauucaggaggcugaggugggaggaucauuugagccc

SEQ ID NO: 29267 - RNA, 62 nt, Human
gguggcacacgccuguaaucucagcuacucaggaggcugaggcaggagaauugcuugaaccu

SEQ ID NO: 29268 - RNA, 62 nt, Human
gguggugcacaccuguggucccagcuacuugggaggcugaggugggaaaaucacuugaaccu

SEQ ID NO: 29269 - RNA, 62 nt, Human
aggaagacuagaggcuugcauaauaagcuaaagaggcugaaagaggccaaugccccacuggc

SEQ ID NO: 29270 - RNA, 62 nt, Human
cauggugcaugccuguaaucccagcugcuugggaggcugaggcaggagaaucacuugaacac

SEQ ID NO: 29271 - RNA, 62 nt, Human
gcuucuguugugagcgaaucagccaagagccugaggcugaagggaaaaguacacagaggaag

SEQ ID NO: 29272 - RNA, 62 nt, Human
gguggugcaugccugaaaucccagcuacuugggaggcugaggcaggagaauugcuugaaccc

SEQ ID NO: 29273 - RNA, 62 nt, Human
aguggcgggcgccuguagucccagcuacuugggaggcugaggcaggagaauggugugaaccc

SEQ ID NO: 29274 - RNA, 62 nt, Human
gauggcucacacguauaauccuaaugcuuugagaggcugagguaggagcaucaccuggggcu

SEQ ID NO: 29275 - RNA, 62 nt, Human
ugguggcaaucagcucuagucccaacuacuuggaggcugaagcaggaagaucacgugagccc

SEQ ID NO: 29276 - RNA, 62 nt, Human
cagguguuaacagaacugaaauccgacaaccagaggcugaaagaugaaaauggugcccucau

SEQ ID NO: 29277 - RNA, 62 nt, Human
gguggcaggcgccuguagucccagcuacucaggaggcugaggcaggagaauggcgugaaccc

SEQ ID NO: 29278 - RNA, 62 nt, Human
guccagagcuucagggcugggcagguccuggggaggcugagacugcagaggagccaccuggg

SEQ ID NO: 29279 - RNA, 62 nt, Human
uaguggcgcgcgccuauaaucccagcuacugggaggcugaggcgggagaaucgcuugagccg

SEQ ID NO: 29280 - RNA, 62 nt, Human
ggugguacaugccuguagucccagcuacuugggaggcugaggcaggagaauugcuugaaccc

SEQ ID NO: 29281 - RNA, 62 nt, Human
ugcuucaguggauucacugguuagauuaaaaagaggcugagaugagcagugaacuaagaggc

SEQ ID NO: 29282 - RNA, 62 nt, Human
gguggugugccccuguaaucccagcuacucaggaggcugaagcaggagaaucgcuugaaccc

SEQ ID NO: 29283 - RNA, 62 nt, Human
gccaucacaccccucugagcagaagcaaaucugaggcugaagaauuaaguuuuccccaagca

SEQ ID NO: 29284 - RNA, 62 nt, Human
ccagacuaaaucaaccacuccagcagagcagagaggcugaauagauuccacaaccugguuug

SEQ ID NO: 29285 - RNA, 62 nt, Human
ggcggcacaugccuguaaucccagcuacaugggaggcugaggugggagaauugcuugaaccc

SEQ ID NO: 29286 - RNA, 62 nt, Human
ggugguaugugccuguaaucccagcuacuugggaggcugaggcaggagacucgcuugaaccu

SEQ ID NO: 29287 - RNA, 62 nt, Human
aguggcucacgccuguaaucccagcacuuugggaggcugaggcggguggaucacaagcucag

SEQ ID NO: 29288 - RNA, 62 nt, Human
cacugcgggaucggacaaagccccgcuuuggagaggcugagcuggagccauuggccucccca

SEQ ID NO: 29289 - RNA, 62 nt, Human
gcucaugcacaccuguaauccuagcacuuugggaggcugaggcgggaggauugcuugagccu

SEQ ID NO: 29290 - RNA, 62 nt, Human
gggacgcgugaagggagaagggguccucccaugaggcugaggauggccugaaccuggagcag

SEQ ID NO: 29291 - RNA, 62 nt, Human
gguggcaggagccuguagucccagcuacucgggaggcugaggcaggagaauugcuugaaccg

SEQ ID NO: 29292 - RNA, 62 nt, Human
gguggcgggcgccuguaaucccagcuacuugggaggcugaggcaggagaauggcaugaaccu

SEQ ID NO: 29293 - RNA, 62 nt, Human
aaaauacaaaaauuagccuggcaugguggugggaggcugaagcaagagaaucacuugaaccc

SEQ ID NO: 29294 - RNA, 62 nt, Human
caccccaaagcuuuccugccccaggccugaaagaggcugaggccuggacuuuccugcaacuc

SEQ ID NO: 29295 - RNA, 62 nt, Human
cguggugggugccuguaaucccagcuauucaggaggcugaggcaggagaaucacuuggaccu

SEQ ID NO: 29296 - RNA, 62 nt, Human
gguggugggcaccuguagucccagcuacucgggaggcugaggcaggagaaaggcaugaaucc

SEQ ID NO: 29297 - RNA, 62 nt, Human
ggugguuuauggcuguaaucugcaaacucugggaggcugaggugggagaaucgcuuaacccc

SEQ ID NO: 29298 - RNA, 62 nt, Human
gguggcacaugccuguaaucucagcuacucaggaggcugaggcaagagaaucgcuugaaccu

SEQ ID NO: 29299 - RNA, 62 nt, Human
aguucaacagacaccugaagucuagcaugugggaggcugaggauggagcugggaacacaaag

SEQ ID NO: 29300 - RNA, 62 nt, Human
gguggugcaugccuguagucccagcuguuugggaggcugaggcaggaggaucuuugagccua

SEQ ID NO: 29301 - RNA, 62 nt, Human
aauggcaggcgccuauaaucccagcuacucaggaggcugaagcagaagaaucacuugaaccu

SEQ ID NO: 29302 - RNA, 62 nt, Human
gguggcacacgccuguagucccagcuacucaggaggcugaggcaggagaaucgcuugaaccu

SEQ ID NO: 29303 - RNA, 62 nt, Human
cccaggacccagucuuggccauucaguugagugaggcugaaggcuggguuugaaaaggcaaa

SEQ ID NO: 29304 - RNA, 62 nt, Human
aaggggagggggaagggaaugaaauggaaagggaggcugauucccuuccccugacuuaccac

SEQ ID NO: 29305 - RNA, 62 nt, Human
gugagaggcguccauuuccagcagacacaauggaggcugacagaggcaggagccuaccccug

SEQ ID NO: 29306 - RNA, 62 nt, Human
ccccagaggccuaccccccauauguccucagagaggcugaguguccccuccaggcagucaug

SEQ ID NO: 29307 - RNA, 62 nt, Human
guguugcuccuuccuaugugucuuuugaaucugaggcugacauuugcuuggaaggccagacc

SEQ ID NO: 29308 - RNA, 62 nt, Human
ggugaugcaugccuguggucccaguuacuugggaggcugacguggguggcucacuugagcac

SEQ ID NO: 29309 - RNA, 62 nt, Human
aguggcuugugccuguagucccagcuacuugggaggcugaggcaggaggguugcuugagacu

SEQ ID NO: 29310 - RNA, 62 nt, Human
gguggcgugugccuguagucccagcuacuugcgaggcugaggcaggagaauugcuugaaccu

SEQ ID NO: 29311 - RNA, 62 nt, Human
aguggcucacgccuguaaucccagcacuuugggaggcugaggcgggugaaaucaccugaggu

SEQ ID NO: 29312 - RNA, 62 nt, Human
gguggugcaugccuauaaucccagcuacucaggaggcugaggcagaauugcuugaaccuggg

SEQ ID NO: 29313 - RNA, 62 nt, Human
cuggauuuuaccccaugaggguaaaguugugugaggcugacacgucugugugaugcagugug

SEQ ID NO: 29314 - RNA, 62 nt, Human
ggguagggcuguuugcuggaauaaggagggcugaggcugaguuguuccccgccacuguugag

SEQ ID NO: 29315 - RNA, 62 nt, Human
gguggugggcaccuguaaucccagcuacucgggaggcugaggcaggagaaucgcuugaacuc

SEQ ID NO: 29316 - RNA, 62 nt, Human
uguggcuuguaccuguggucccaucugcuugggaggcugagguugcaggaucacuugagccc

SEQ ID NO: 29317 - RNA, 62 nt, Human
gguggccggcgccuguaaucccagcuacuagggaggcugagacacacgaaucccuugagccc

SEQ ID NO: 29318 - RNA, 62 nt, Human
uuccuuuuguauuccauuguggaagcuucuaggaggcugagaagcaggagauccaagcucca

SEQ ID NO: 29319 - RNA, 62 nt, Human
ggaggggcggcaggagggagguuugugagagcgaggcugagccuacagaugaacucuuucug

SEQ ID NO: 29320 - RNA, 62 nt, Human
gguggcacgcgccuguagucccagcuacacgggaggcugaggcaggagaauggcgugaaccc

SEQ ID NO: 29321 - RNA, 61 nt, Human
auuggcacacuccuauagucccaccuacucaagaggcugaggcaggaggaucacuagagua

SEQ ID NO: 29322 - RNA, 62 nt, Human
gguggcacucgccuguaaucucagcuacuugggaggcugaggcaggagaaucgcuugaaccc

SEQ ID NO: 29323 - RNA, 62 nt, Human
gguggcacacgccuguagucccagcuacuugggaggcugaggcaggagaauugcuugagccc

SEQ ID NO: 29324 - RNA, 62 nt, Human
gaugacuuguaacuguaaucccaguuauaggggaggcugaagcaggaggaucacuugaggcc

SEQ ID NO: 29325 - RNA, 62 nt, Human
agccggguguggugguggguaccgcuacuugggaggcugaggcaggagaaucgcuugaaccu

SEQ ID NO: 29326 - RNA, 62 nt, Human
gcaauugcucaugcauagucccagcuacccaggaggcugaggugggaggaucacuugagccc

SEQ ID NO: 29327 - RNA, 62 nt, Human
gguugcucacagcuguaauaacaacaccuucagaggcugaggugagaggaucaguugaggcc

SEQ ID NO: 29328 - RNA, 62 nt, Human
gguggcaugugccuauagucccagcuacucaggaggcugaggcaggagaauugcuugaaccu

SEQ ID NO: 29329 - RNA, 62 nt, Human
gguggcucacgccuguaaucccagcacuuugggaggcugaggugggcagaucacgaggucaa

SEQ ID NO: 29330 - RNA, 62 nt, Human
agcucacacagcaaaaacaauggacaggcccagaggcugaagcaaacagugucccuucuggc

SEQ ID NO: 29331 - RNA, 62 nt, Human
gguggcacacgccuguaaacccagcuacuugggaggcugaggcaggagaauugcuugagccc

SEQ ID NO: 29332 - RNA, 62 nt, Human
gaguaaaaguauagauacaaaaccuuguguaagaggcugacuuuuccaaauaaacauuuuuu

SEQ ID NO: 29333 - RNA, 62 nt, Human
agaauuauugucauuuuacacaugaggaaagugaggcugagagaauccaauuagcuuguacg

SEQ ID NO: 29334 - RNA, 62 nt, Human
caacagcaauccccugucaaaccucagaacuugaggcugaaacauugcuuccacccaccauc

SEQ ID NO: 29335 - RNA, 62 nt, Human
ucuuaccugagacuggaaggcugauuugcuuugaggcugauauguguguuucagagccucug

SEQ ID NO: 29336 - RNA, 62 nt, Human
auaaauuguaauaggaaacagucucuaaaugugaggcugaauacagcuucagucuggcucuc

SEQ ID NO: 29337 - RNA, 62 nt, Human
aguggcucaugccuguaaucccaacacuuugggaggcugaaguaggaggaucgucuugagcc

SEQ ID NO: 29338 - RNA, 62 nt, Human
gguggugcaugccuguaaucccagcuacuugggaggcugaggcacgagauuccuugaaccca

SEQ ID NO: 29339 - RNA, 62 nt, Human
gguggcguacgccuguagucccagcuacucaggaggcugaggcaggagaauugcuugaaccc

SEQ ID NO: 29340 - RNA, 62 nt, Human
gguggugggcgccuguaaucccagcuacucaggaggcugaggcaggagaaucgcuugaaccc

SEQ ID NO: 29341 - RNA, 62 nt, Human
ggcaggggaggagggagagcaggguugggggagaggcugaggagagugugacauguggggag

SEQ ID NO: 29342 - RNA, 62 nt, Human
ucugccucuucccggagaauccagcugggcuagaggcugagcaccuuuggaaacaacauuua

SEQ ID NO: 29343 - RNA, 62 nt, Human
ugccuccuacgaggcugggcugcaggguaugugaggcugagcaaaaggucugcaaaucuccc

SEQ ID NO: 29344 - RNA, 62 nt, Human
gguggcccuugccuguagucucagcacuuugggaggcugaggugggagggucgcuugaguuc

SEQ ID NO: 29345 - RNA, 62 nt, Human
gguagcaugcgccuauagucccagcugcucaggaggcugaggcaugagaaucgcuugaaccu

SEQ ID NO: 29346 - RNA, 62 nt, Human
gguggcacacaucuguagucccagcuacucuggaggcugagacaggagaaucgcuugaaccc

SEQ ID NO: 29347 - RNA, 62 nt, Human
cucaguuucucucucaggauaaagagugaauagaggcugaagggugaauuucuuauuauaca

SEQ ID NO: 29348 - RNA, 62 nt, Human
gcugggcgcaguggcucacgccuauaaucccagaggcugaggcaggcggaucaccugagguc

SEQ ID NO: 29349 - RNA, 62 nt, Human
ccacccucaugacugggaaggaagccugugaugaggcugagauaaagcacagggugguuuca

SEQ ID NO: 29350 - RNA, 62 nt, Human
gguagcuuacaccuauaaucccagcacuuugggaggcugaggugagagggucacuugagccc

SEQ ID NO: 29351 - RNA, 62 nt, Human
ugagccagacggucgguuggaacaugagacucgaggcugagcguggaucugaacaccacagc

SEQ ID NO: 29352 - RNA, 62 nt, Human
gguaguacaugccuguaaucccagcuacacuggaggcugagucaggagaaucacuugaacgu

SEQ ID NO: 29353 - RNA, 62 nt, Human
gcuggcacgcaccaguaaucccagcuacuugggaggcugaggcaggagaaucacuugaaccc

SEQ ID NO: 29354 - RNA, 62 nt, Human
gguggugcaugccuguaauccaagauacucaggaggcugaggcaggagaaucgcuugaaccu

SEQ ID NO: 29355 - RNA, 62 nt, Human
gguggcucacgccuguaaucucagcacuuugggaggcugaggcgggcggaucacaaggucca

SEQ ID NO: 29356 - RNA, 62 nt, Human
gguggcucacaccuguaaucccagcacuuugggaggcugaggcagguggaucgccugagguc

SEQ ID NO: 29357 - RNA, 62 nt, Human
gguggcgcgcaccuguaaucccagcuacuugggaggcugaggcaagagaauugcuugaaccc

SEQ ID NO: 29358 - RNA, 62 nt, Human
gguggcucacgccuguaaucccagcacuuugggaggcugaggcggguggaucacuugagguc

SEQ ID NO: 29359 - RNA, 62 nt, Human
gguggcaggcgccuguagucccagcuacuugggaggcugaggcaggagaauggugugaaccu

SEQ ID NO: 29360 - RNA, 62 nt, Human
gguugcucacgccuguaaucccagcacuuugggaggcugaggugggcggcucacgaggagau

SEQ ID NO: 29361 - RNA, 62 nt, Human
ccugucaugcgccugucaucccagcuacuugagaggcugaagcagaagaaucucuugagccc

SEQ ID NO: 29362 - RNA, 62 nt, Human
ggcggugcgcaacuguagucccagcuacucgggaggcugaggcaggagaaucucuugaaccu

SEQ ID NO: 29363 - RNA, 62 nt, Human
aauggcucaugccuguaaucccagcacuuugggaggcugagaugggaggaucacuugaagcc

SEQ ID NO: 29364 - RNA, 62 nt, Human
agaauugugaauagcaugauucauuucuagcagaggcugaguuuaggacagcagcuuccauu

SEQ ID NO: 29365 - RNA, 62 nt, Human
aguggcucacaccuguauucccaacacuuuuggaggcugagguuggaggauugcuugagccc

SEQ ID NO: 29366 - RNA, 62 nt, Human
guggcacgugccugggagucccagcgacuugggaggcugaggugggaggauuguuugagccu

SEQ ID NO: 29367 - RNA, 62 nt, Human
uaccaagcagauucugugagaaagcacugguugaggcugaacacuguugacacaucauuuuu

SEQ ID NO: 29368 - RNA, 62 nt, Human
guaugcauuagccuucccauuuugcaguugaggaggcugaguagccucagaaggguuuaggc

SEQ ID NO: 29369 - RNA, 62 nt, Human
gguggcucaugccuguaaucccagcacuuugggaggcugaggugggcauaucaccugagguc

SEQ ID NO: 29370 - RNA, 62 nt, Human
ggugguacaugccuguaaucccagcuacucaggaggcugagacaggagaaucacuugaaccu

SEQ ID NO: 29371 - RNA, 62 nt, Human
gguagcacgcaccuguagucccagcuacuugggaggcugaagcaggagaaucgcuugaaccu

SEQ ID NO: 29372 - RNA, 62 nt, Human
gguggcucacgccuguaaucccagcucuuugggaggcugaagcggguggaucaugaggucag

SEQ ID NO: 29373 - RNA, 62 nt, Human
ggugguacgugccuguacugucagcuacuugggaggcugaggcacaauaauuguuugaaccc

SEQ ID NO: 29374 - RNA, 62 nt, Human
gguaaugcgcgccuguggucccagcugcucgggaggcugaggugggaggaucacuugagccu

SEQ ID NO: 29375 - RNA, 62 nt, Human
uaaucccagcuacuguaaucucagcuacuugggaggcugaggcaggagaauugccucaaccg

SEQ ID NO: 29376 - RNA, 62 nt, Human
aggcuggguaugguggcucaccagcacuuugggaggcugaggcagguggaucucuugagguc

SEQ ID NO: 29377 - RNA, 62 nt, Human
gguggcgugugccaguaaucccagcuacuugggaggcugaggcgcgagaaucgcuugaaccc

SEQ ID NO: 29378 - RNA, 62 nt, Human
aguggcucacaccuguaaucccaggacuucgggaggcugaggcuggaggauugcuugaguuc

SEQ ID NO: 29379 - RNA, 62 nt, Human
aguggcucaugccuguaaucccagcacuuugggaggcugaggcgggcggaucaccugagguc

SEQ ID NO: 29380 - RNA, 62 nt, Human
gguggugcaugccuguaauuccagcuacucgggaggcugaggcaagagaaucgcuugaaucc

SEQ ID NO: 29381 - RNA, 62 nt, Human
guggcagaucccuuguagucccagcuacucgggaggcugaggcaggagaauagcuugaaccc

SEQ ID NO: 29382 - RNA, 62 nt, Human
gguggcucaugccuguaaucccagcacucugggaggcugaggugggcggaucacuugagcuc

SEQ ID NO: 29383 - RNA, 62 nt, Human
ugguggcacaugccuguaacccagcuacucgggaggcugaagcaggagaaucacuugaaccc

SEQ ID NO: 29384 - RNA, 62 nt, Human
gguggcucacgccuauaaucccagcacuuugggaggcugaaguggguggaucaccagagguc

SEQ ID NO: 29385 - RNA, 62 nt, Human
gguggcacacgccuguaaucccagcuacaccugaggcugaggcaggagaauugcuugaaccg

SEQ ID NO: 29386 - RNA, 62 nt, Human
ggugauucaugccugaaaucccacuacuuugggaggcugaggcuggagaauugcuugaggcu

SEQ ID NO: 29387 - RNA, 62 nt, Human
gguggugcgugccuguagucccagcuacuuaggaggcugaggcaugagaaucacuuaaaccu

SEQ ID NO: 29388 - RNA, 62 nt, Human
aguggcucaugccuguaaucccagcacuaugggaggcugaggcgggcagaucuccugagcuc

SEQ ID NO: 29389 - RNA, 62 nt, Human
gguggcauguggcuguagucccagcuacucgggaggcugaggcacgagaaucgcuugagccc

SEQ ID NO: 29390 - RNA, 62 nt, Human
ggugcugugcaucuauagucccugcuauuugagaggcugaggugggaggaucauuugagugc

SEQ ID NO: 29391 - RNA, 62 nt, Human
aguggcacaccccuguagucccagcuacuugggaggcugaggugggaggauugcuugaaccc

SEQ ID NO: 29392 - RNA, 62 nt, Human
gguggcacaugccuguaguuccagcuacucaggaggcugaggugggagaaucuccugagccu

SEQ ID NO: 29393 - RNA, 62 nt, Human
cccuucauuuggagauuauguucuuucggggagaggcugaggacuuaaaauauuccugcauu

SEQ ID NO: 29394 - RNA, 62 nt, Human
uaggaauaguuuggaccuugugccuccugugggaggcugaggacugcaagaggagagcuagc

SEQ ID NO: 29395 - RNA, 62 nt, Human
gguggcaggcgccuguggucccagcuacucgggaggcugaggcaggagaauagugugaaccc

SEQ ID NO: 29396 - RNA, 62 nt, Human
ggugucacaugccaguaaccccagcuacuagggaggcugaggcaggagaaucacuugaaccc

SEQ ID NO: 29397 - RNA, 62 nt, Human
ggguguggguaccuguauucccaguuacuugggaggcugaggugggaggaucuuuugaaccc

SEQ ID NO: 29398 - RNA, 62 nt, Human
cacccacuucccugcaggacaguauuccugccgaggcugacuuccuacuuggucuggccacu

SEQ ID NO: 29399 - RNA, 62 nt, Human
ggcggcgagcaccuguaaucccagcuacucgggaggcugagacaggagaaucucuugaaucc

SEQ ID NO: 29400 - RNA, 62 nt, Human
uaucaucaccucaaacgagauauaucccggaugaggcugacuuucugcuggggauggccacu

SEQ ID NO: 29401 - RNA, 62 nt, Human
agcagagacugcugugaguuucucccggcuccgaggcugaacggggacugugagcgaucccc

SEQ ID NO: 29402 - RNA, 62 nt, Human
gguggcaggcaccuguaaucccagcugcccaagaggcugaggcaugagaaucgcuugaaccu

SEQ ID NO: 29403 - RNA, 62 nt, Human
gagccagaggccacuagguauucuugcucccagaggcugaagucacccugggaaucacagug

SEQ ID NO: 29404 - RNA, 62 nt, Human
gguggugagugccuguaaucacagcuacuugggaggcugagaugggagaaucacuugaaccc

SEQ ID NO: 29405 - RNA, 62 nt, Human
gugugggggaaggggcugccggcuucuuucaggaggcugagguuuggaggcaaaaucaaccu

SEQ ID NO: 29406 - RNA, 62 nt, Human
auaaggauuuuggccaaaugggacuuagacuggaggcugaauuugagaaggauuucaaggaa

SEQ ID NO: 29407 - RNA, 62 nt, Human
uuaucuaugcgccuguagucccagcuacccaggaggcugaagcaggauaaucgcuugaaccc

SEQ ID NO: 29408 - RNA, 62 nt, Human
uggucguucuggcccgaggcccuuagaguauggaggcugagccaggccuuggguuuccccag

SEQ ID NO: 29409 - RNA, 62 nt, Human
gauggugggcgccuguaaucccagccacuccagaggcugaggcaggagaaucgcuugaaccu

SEQ ID NO: 29410 - RNA, 62 nt, Human
aggugagugcacagccugugacgcuacagggagaggcugaguaaaccgagauccagcguucu

SEQ ID NO: 29411 - RNA, 62 nt, Human
gguggcgcacaccuguaaucccagcuacuugggaggcugaggcaggagaauugcuugaaccu

SEQ ID NO: 29412 - RNA, 62 nt, Human
gguggcucaugccuguaaucccagcacuuggagaggcugagguugcgccacuacacuccagc

SEQ ID NO: 29413 - RNA, 62 nt, Human
gauggugguggccuguaaucccagcuacuugggaggcugagacaggagaaucgcuugaaccc

SEQ ID NO: 29414 - RNA, 62 nt, Human
aguaguauccgccuguagucccagcuacucaggaggcugagacaggaggauugcuuaagccc

SEQ ID NO: 29415 - RNA, 62 nt, Human
gguggcgcaugccuguaauccuagcuacucaggaggcugaggcagaagaaucacuucaaccc

SEQ ID NO: 29416 - RNA, 62 nt, Human
cuuuaagaccuuguauaccauauugaaaggaagaggcugacaauaagguuugacagagggga

SEQ ID NO: 29417 - RNA, 62 nt, Human
cccacaggagauucacagagagacgagcccaggaggcugacugagcucaaaggaacaggaug

SEQ ID NO: 29418 - RNA, 62 nt, Human
ugguggugggugccuguaauccaacuacccaggaggcugaggcaugagaaucgcuugggccc

SEQ ID NO: 29419 - RNA, 62 nt, Human
cguggcucacgccuguaaucccagcauuuugggaggcugaggugggcagaucacuugaggcc

SEQ ID NO: 29420 - RNA, 62 nt, Human
uacagggaugaggcagaccugacucucuuaaggaggcugagagcccaaacugcugucccaaa

SEQ ID NO: 29421 - RNA, 62 nt, Human
gggcagggugucaugcaugggugcagaggauggaggcugagaaagguagacagcuacccaug

SEQ ID NO: 29422 - RNA, 62 nt, Human
gugcuggggagccguggucccgaguucccugggaggcugacagggucaagccacccugccca

SEQ ID NO: 29423 - RNA, 62 nt, Human
gguagugcgugccuguaaucccagcuacuugggaggcugagguagaagaauuguuugaaccu

SEQ ID NO: 29424 - RNA, 62 nt, Human
ggugauucaugccugaaaucccacuacuuugggaggcugaggcuggagaaucgcuugaggcu

SEQ ID NO: 29425 - RNA, 62 nt, Human
agaauuaccccucccaaaaugucagaagugcugaggcugagaaacccugauguaaagaucag

SEQ ID NO: 29426 - RNA, 62 nt, Human
cauggcacacaccuguagucccagcuacuuaggaggcugagaugggaggauugaucgaucgc

SEQ ID NO: 29427 - RNA, 62 nt, Human
aguggcucacgccuguaaucucagcacuuugggaggcugaggcgggcagaucgcuugagguc

SEQ ID NO: 29428 - RNA, 62 nt, Human
gguggcgggugccuguaaucccagcuacucaggaggcugaggcaggagaaucgcuugaaucu

SEQ ID NO: 29429 - RNA, 62 nt, Human
ggagguacaugccuguaaucccagcuacucaggaggcugaggcagaagaauugcuugaaccc

SEQ ID NO: 29430 - RNA, 62 nt, Human
gguggcacgugccuguagucccagcuacuccggaggcugaggcaggagaauggcgugaaccc

SEQ ID NO: 29431 - RNA, 62 nt, Human
gguggcucacgcuuguaaucccagcacuuugggaggcugaggcaggcggaucacgaggucag

SEQ ID NO: 29432 - RNA, 62 nt, Human
gguggugcaugucugcaaacccagcuacucgggaggcugaagcaggagaaucacuugaaccu

SEQ ID NO: 29433 - RNA, 62 nt, Human
gguggcacacaccuguagucccagguacuugggaggcugaggcaggaggaucgcuugaaccc

SEQ ID NO: 29434 - RNA, 62 nt, Human
augcaccugcaggcaagguacccgaagaagcagaggcugagggcaggcaaagccugugugac

SEQ ID NO: 29435 - RNA, 62 nt, Human
gauggugggcaccucuaaucccagcuacuugggaggcugagggcaggagaauugcuugaauc

SEQ ID NO: 29436 - RNA, 62 nt, Human
gguggcucaugccuguaaucccagcacuuugggaggcugagacggguggauuaccugagguc

SEQ ID NO: 29437 - RNA, 62 nt, Human
gguggugugggccugcagucccagcuaccugggaggcugagucaggaaaaucucuugaacca

SEQ ID NO: 29438 - RNA, 62 nt, Human
uguggcucaugccuguaauccuagcacuuugggaggcugaggugggcagaucacuugaggcc

SEQ ID NO: 29439 - RNA, 62 nt, Human
gguggugcgugccuguagucccagcuacuugggaggcugaggcaggagaaucgcuugaaccu

SEQ ID NO: 29440 - RNA, 62 nt, Human
uguggcucacaccuguaaucccagcauuuugggaggcugaagugagagguuaauuugagggu

SEQ ID NO: 29441 - RNA, 62 nt, Human
gguggcgggcgccuguaaucccaacuacucaggaggcugaggcuagagaaucacuugaaccc

SEQ ID NO: 29442 - RNA, 62 nt, Human
gacaaacccagggcugaggccugccccaugaagaggcugagcccccugaaaccccugccccu

SEQ ID NO: 29443 - RNA, 60 nt, Human
gguggcacgugccuguuaucucagcuacuugggaggcugaggcaggagaaucacuugaac

SEQ ID NO: 29444 - RNA, 62 nt, Human
gguagcucaagccuauaaucccagcauguugagaggcugaggugggcagaucauuugaggcc

SEQ ID NO: 29445 - RNA, 62 nt, Human
ggugacucaugccuguaaucccagcacuuugggaggcugaggugggaggauugcuugagucc

SEQ ID NO: 29446 - RNA, 62 nt, Human
gguggcgcauaccuguaaucccagcuacuugggaggcugaggcaagagaaucgcuugaaccc

SEQ ID NO: 29447 - RNA, 62 nt, Human
cacagcauauccaggcugccacagguggggacgaggcugagagagucagcaggcagagccag

SEQ ID NO: 29448 - RNA, 62 nt, Human
gguggcucgugccuguaaucccagcacuuugggaggcugaggcggguggaucaugaggucag

SEQ ID NO: 29449 - RNA, 62 nt, Human
gguggcgcaugccuguaaucccagcuacuagagaggcugaggcaggagaaucacuugaaucc

SEQ ID NO: 29450 - RNA, 62 nt, Human
gggggcacacaccgguaaucccagcuacucaggaggcugagacaggagagucgcuugaaccu

SEQ ID NO: 29451 - RNA, 62 nt, Human
agggacuaugaaugggcaaaacugaauuauaagaggcugauaauuccagugguccauggaau

SEQ ID NO: 29452 - RNA, 62 nt, Human
auguuaccuggagaguguccagaggcugcucugaggcugagguguguucccccuugccuggu

SEQ ID NO: 29453 - RNA, 62 nt, Human
gguggcucacgccuguaaucccaacacuuugggaggcugaggcaggcagaucacgaggucag

SEQ ID NO: 29454 - RNA, 62 nt, Human
gguggcacacaccaguaaucccagcuacucaggaggcugaagcaggagauuugcuugaaccu

SEQ ID NO: 29455 - RNA, 62 nt, Human
aggggcgauugaggguucaccucugccuuggggaggcugauuucucacacacuggcuggccc

SEQ ID NO: 29456 - RNA, 62 nt, Human
ggugucgggcaccuguagucccagcuacucaggaggcugaggcaggagaagggugggaaccc

SEQ ID NO: 29457 - RNA, 62 nt, Human
ggugccucacaucuguaaucccaacacuuugggaggcugagauggguggauugcuugagccc

SEQ ID NO: 29458 - RNA, 62 nt, Human
gguggcacacaccuguaaucccagcuacucgggaggcugaggaaggagaauugcuugaaccu

SEQ ID NO: 29459 - RNA, 62 nt, Human
gguggcacacaccuguagucccagcuacuugggaggcugaggcaggagaaucacaaggauug

SEQ ID NO: 29460 - RNA, 62 nt, Human
gacggccagagcccauggucccagcuacucgagaggcugagguaagagcaucccuugagcca

SEQ ID NO: 29461 - RNA, 62 nt, Human
uuaaaucaagcuuucaaaaaaauauauuuuaggaggcugauuuaaugccagucuaaauccuu

SEQ ID NO: 29462 - RNA, 62 nt, Human
gguggugcacaucuguaguccuaccaacuugggaggcugaggcaggagaaucgcuugagccc

SEQ ID NO: 29463 - RNA, 62 nt, Human
aguggcucacgccuguaauccuagcacuuugggaggcugaggaggaaggaucacuugagccc

SEQ ID NO: 29464 - RNA, 62 nt, Human
gguggccuacaccuguagucccagcauuccgggaggcugaggugggaggaucacuugagccc

SEQ ID NO: 29465 - RNA, 62 nt, Human
gguggcacauaccuguaaucccagcuacucgggaggcugaaacaggagaaucgcuugaaccc

SEQ ID NO: 29466 - RNA, 62 nt, Human
gguggugugugccuguaauuccagcuacucgggaggcugaggcaggaagaaucacuugaacc

SEQ ID NO: 29467 - RNA, 62 nt, Human
gguggcucacgucuguaaucccagcacuuugggaggcugagacagguggaucacuugagguc

SEQ ID NO: 29468 - RNA, 62 nt, Human
uuuggcaccugccuguaaucucagcuacucaggaggcugaggcacaagaaucgcuugaaucc

SEQ ID NO: 29469 - RNA, 62 nt, Human
aagcauucuccuguuuuuacagauuguauccugaggcugagagaguuaagugaaugucuaag

SEQ ID NO: 29470 - RNA, 62 nt, Human
ggugacucacacuuguaaucccagcaauuugggaggcugagacaggaggauugccugaggcc

SEQ ID NO: 29471 - RNA, 62 nt, Human
guaaaggcauaauauaaaauguaucuccaugggaggcugaggcaggagaaucaguugaaccu

SEQ ID NO: 29472 - RNA, 62 nt, Human
accuguacauaccugcgguuccagcuacucaagaggcugaggcaggaggacugcuugagccc

SEQ ID NO: 29473 - RNA, 62 nt, Human
cuguaucaucugcuguggucccaguuacucaggaggcugaggcaggaggaucacuugagccc

SEQ ID NO: 29474 - RNA, 62 nt, Human
gguggcucaugccuguaaucccagcacuuugggaggcugaugugggcggauaguugagccca

SEQ ID NO: 29475 - RNA, 62 nt, Human
auuuuuguggucaacaaccaggaggagcuugagaggcugaacacccaaaacgccauugccuu

SEQ ID NO: 29476 - RNA, 62 nt, Human
gguggcgugcgccuguagucccagcuacuugggaggcugaggcaggagaaucgcuuaaaccu

SEQ ID NO: 29477 - RNA, 62 nt, Human
aaugggcuuuucuacuaaaagcauaaaauacugaggcugauuuagucagggcaaaaccauuu

SEQ ID NO: 29478 - RNA, 62 nt, Human
agcccacacuacgcccuaucacuucccacaaugaggcugaguguuuguuucuacugaucaau

SEQ ID NO: 29479 - RNA, 62 nt, Human
cguggugggcacccguaaucccagcuacucaggaggcugaggcaggagaauugcuugaaccc

SEQ ID NO: 29480 - RNA, 62 nt, Human
gguggcaugugccuguggucccagcuacucaggaggcugaggugggaaaaucacuugagccc

SEQ ID NO: 29481 - RNA, 62 nt, Human
gguggcucacaccuauaaucccagcacuaugggaggcugaggcaagcagguuguuugagccc

SEQ ID NO: 29482 - RNA, 62 nt, Human
gguggcaguugccuguaauccuagcuacucaggaggcugaggcaggagaaucgcuugaaccu

SEQ ID NO: 29483 - RNA, 62 nt, Human
agccucuggcugggcacaguggcucacuuugggaggcugaggcaggaaggcugcuggaaacu

SEQ ID NO: 29484 - RNA, 62 nt, Human
gguggcacacacuuguaauccuagcaucuugggaggcugaggcaugaaaaucgcuugagccc

SEQ ID NO: 29485 - RNA, 62 nt, Human
ugguggugcaugccuguaaucccagcuacucagaggcugaggcaggagaauugcuugaaccu

SEQ ID NO: 29486 - RNA, 62 nt, Human
ccagacgccagaaggucagccguugaucaauggaggcugagaccaugaugcuugggcuuagg

SEQ ID NO: 29487 - RNA, 62 nt, Human
gaagaccguuuaccuagaagaagcuaugucaagaggcugaauuauuuuuauuuuuaaacagg

SEQ ID NO: 29488 - RNA, 62 nt, Human
gcagaacucacugggggugggcaguuaagguggaggcugauucuaauugucugguugagggg

SEQ ID NO: 29489 - RNA, 62 nt, Human
cugugcccacccagacuugguuugggccaccagaggcugaaguguauuuccugugcauucca

SEQ ID NO: 29490 - RNA, 62 nt, Human
cccgcggacuuccuagugcccaaaugcccugugaggcugagagacccaggccccuguggcuu

SEQ ID NO: 29491 - RNA, 62 nt, Human
uuugaugcaagaauguauuaggacauaaaauagaggcugaccuuaaaagggccaggacagaa

SEQ ID NO: 29492 - RNA, 62 nt, Human
gauggcaggcaccuguaaucccagcuacucgggaggcugaggcaggagaauugcuugaacug

SEQ ID NO: 29493 - RNA, 62 nt, Human
uguggggcacaccuguugucccagcuacucuggaggcugaguccggaggaacguuugagccu

SEQ ID NO: 29494 - RNA, 62 nt, Human
uguauauacuauuuauagucucagcuacuagggaggcugaggcaagaggcuugagaccagga

SEQ ID NO: 29495 - RNA, 57 nt, Human
gcugcugccaccugaccugacagggaggaggcugagaacucaguuuugugaccauga

SEQ ID NO: 29496 - RNA, 62 nt, Human
uuuaaauauacuuuugaauaagcuacuauccugaggcugaggguuuugcugccacuuuuccu

SEQ ID NO: 29497 - RNA, 62 nt, Human
gguggcaugcacuuguagucccagcuacucaagaggcugaggcagaaggaucccuugagccc

SEQ ID NO: 29498 - RNA, 62 nt, Human
cucuggucagaggcagugaguacugggaacuggaggcugaccugugcuuagaaguccuuuaa

SEQ ID NO: 29499 - RNA, 62 nt, Human
ccaaacccauaggucugaaacugagacccagagaggcugaaugacaugcucacagucacaca

SEQ ID NO: 29500 - RNA, 62 nt, Human
gguggcacaugcuuguaguccuagcuacuugggaggcugaggcaggaggauugcuugagucu

SEQ ID NO: 29501 - RNA, 62 nt, Human
gguggcgcaugccuguaauccuagcuacucaggaggcugaggcaugagaaucgcuugaacuc

SEQ ID NO: 29502 - RNA, 62 nt, Human
gaguuuggguucuccccagccccuuggccucugaggcugaggguggcuuccucccauccucc

SEQ ID NO: 29503 - RNA, 62 nt, Human
gauggcacaugccuuuagucccagcuacucgggaggcugaggcaugagaaucauuugaaccc

SEQ ID NO: 29504 - RNA, 62 nt, Human
ggcacgcaucuaucagagucccagcuacucaggaggcugaggcaggagaaucgcuugaaccu

SEQ ID NO: 29505 - RNA, 62 nt, Human
gauggugggcgccuguaaucucagcuacuugggaggcugaagcaggagaacugccugaaccc

SEQ ID NO: 29506 - RNA, 62 nt, Human
guuggcacaugccuguagucccagcuacuugagaggcugaggcaagagaauuguuugaaccc

SEQ ID NO: 29507 - RNA, 62 nt, Human
gguggugggugccuguagucccagcuacucuggaggcugaggcaggagaauggcgugaaccc

SEQ ID NO: 29508 - RNA, 62 nt, Human
gguggcacauuccuguaaucccagcuacucgggaggcugaggcaggagauucgccugaaccc

SEQ ID NO: 29509 - RNA, 62 nt, Human
aguggcucacaccuguaaucccagcacuuugggaggcugaggcaggaggauuguuugaggcc

SEQ ID NO: 29510 - RNA, 62 nt, Human
gguggcaggcaccuguaaucccagcuacucgggaggcugaggcaggagaauugcuugaacca

SEQ ID NO: 29511 - RNA, 62 nt, Human
ccaugacauuggagcaccuuccucuccagccagaggcugaccugagggccacuguccucaga

SEQ ID NO: 29512 - RNA, 62 nt, Human
uacagcucacgccuguaaucucagcacuuugggaggcugagguggguggaucacaaggucag

SEQ ID NO: 29513 - RNA, 62 nt, Human
gcaugagcauuuucaggauaagcgacuucugugaggcugagagaggaagaaaacacggagcc

SEQ ID NO: 29514 - RNA, 62 nt, Human
gguggcucacacguguaaucccaacacuuugggaggcugaggaggaaggauagcuugaggcc

SEQ ID NO: 29515 - RNA, 62 nt, Human
gcgaagggaaccggguggaaaccaagcugggagaggcugaggauggcagggcuggaagggcc

SEQ ID NO: 29516 - RNA, 62 nt, Human
gguggcgugugccuguaaucccagcuacuugggaggcugaggcaggagaaccgcuuaaaccu

SEQ ID NO: 29517 - RNA, 62 nt, Human
ugcgaccuuaauuuaacuuuccagucuuagcugaggcugagaaagcuaaaguuugguuuuga

SEQ ID NO: 29518 - RNA, 62 nt, Human
gguggcgggcaccuguaaucccagccacuugggaggcugaggcaggagaauugcuugaaccc

SEQ ID NO: 29519 - RNA, 62 nt, Human
aguggcucacaccuacgaucacagcacuucgggaggcugaagcaagcagaucacuugagguc

SEQ ID NO: 29520 - RNA, 62 nt, Human
gaugacaggcaccuguaaucccagcuacucgggaggcugaggcaugagaauugcuugaaccc

SEQ ID NO: 29521 - RNA, 62 nt, Human
aaaauguagaaacuuaaacacaccuuccuguggaggcugagaugaaaacuagggcucauuuu

SEQ ID NO: 29522 - RNA, 62 nt, Human
guacaagaagaaccauucuuuaaaggugaguggaggcugauuugcagcugaagugggccagc

SEQ ID NO: 29523 - RNA, 62 nt, Human
aaguaauggagaagcuguagaacaauguggaagaggcugagguuguggaacacacugaauaa

SEQ ID NO: 29524 - RNA, 62 nt, Human
aguggcacgcgccuguaaucccagcuacucaagaggcugaggcacgagaaucacuugaaccc

SEQ ID NO: 29525 - RNA, 62 nt, Human
gguggggcgugccuguagucccauguacuugggaggcugaggcaggaaaauucuugaaccca

SEQ ID NO: 29526 - RNA, 62 nt, Human
gguggcaggcgccuguaaucccagcuacucaggaggcugaggcaggagaauugcuugaaccc

SEQ ID NO: 29527 - RNA, 62 nt, Human
gguggcguguacauguggucucagauacuugggaggcugaggugggaggguugaucacuuga

SEQ ID NO: 29528 - RNA, 62 nt, Human
uugggaggcugaggugggaggguugaucacuugaggcugagaggucaagguugcagugagcc

SEQ ID NO: 29529 - RNA, 62 nt, Human
gguugcauacgccuguguucccagcuacucaggaggcugaagcaggaggauagcuugagccc

SEQ ID NO: 29530 - RNA, 62 nt, Human
gguggcgugcaccuauagucccagcuauucaggaggcugaggugggaggauugcuugagccc

SEQ ID NO: 29531 - RNA, 62 nt, Human
aauggcaggcaccuauaaugccagcuacucgggaggcugaggcaggagaaucgcuugaaccc

SEQ ID NO: 29532 - RNA, 62 nt, Human
ugaugacauaucacaugucagccacugugauagaggcugaggaauccaagaaaauggccagu

SEQ ID NO: 29533 - RNA, 62 nt, Human
gguggcgcauaccuguaauuccagcuacucaggaggcugaggcaggagaauugcuugaaccc

SEQ ID NO: 29534 - RNA, 62 nt, Human
uuggaagacuuucaccucuguuucuugucuuugaggcugaugaauguguuucuaaguuauaa

SEQ ID NO: 29535 - RNA, 62 nt, Human
gguggcacaugcugguaaucucagcuauugaggaggcugaggcaggagaauugcuugaaccc

SEQ ID NO: 29536 - RNA, 62 nt, Human
gguggcuuacaucuguaaucccagcacuuugggaggcugaggggguggaucaccugaggucg

SEQ ID NO: 29537 - RNA, 62 nt, Human
gccacugaaacuugagccaucugugccucuaagaggcugagaauggaagaguuucagauaau

SEQ ID NO: 29538 - RNA, 62 nt, Human
cucuggacaccuuaugcucugaaaucaugagcgaggcugauucaauuggugauuuggguaga

SEQ ID NO: 29539 - RNA, 62 nt, Human
gacagaaggugucuaugugauaaugaguuucagaggcugaucucugccaaauaccuuaauug

SEQ ID NO: 29540 - RNA, 62 nt, Human
gguggcacaugccuguggucucagcuacuugggaggcugaggcaggagaaucauuugagccc

SEQ ID NO: 29541 - RNA, 62 nt, Human
gauggcggacgccuguagucccagcuacucgggaggcugagacagaagaacugcuugaaacc

SEQ ID NO: 29542 - RNA, 62 nt, Human
aguggcucacgucuguaaucccagcacuuugggaggcugaggcgggcagaucaugaggucag

SEQ ID NO: 29543 - RNA, 62 nt, Human
gguggcacgugccuguagucccagcuacaugggaggcugaggugggaggaucacuugagccc

SEQ ID NO: 29544 - RNA, 62 nt, Human
aguggcgggcgccuguagucccagcuacuugggaggcugaggcaggagaauggcgugaaccc

SEQ ID NO: 29545 - RNA, 62 nt, Human
aguggcucacgccuguaauaccagcacuuugggaggcugaggcaggcggaucacuugagguc

SEQ ID NO: 29546 - RNA, 62 nt, Human
gguggcucacgccuguaaucccagcacuuugggaggcugaggcggguggaucacgaggucag

SEQ ID NO: 29547 - RNA, 62 nt, Human
gguggcaggcaccuguagucccagcuacucgggaggcugaggcaggagacuggcgugaaccc

SEQ ID NO: 29548 - RNA, 62 nt, Human
ggugccucaugccuguaauccuagcacuuugggaggcugaggcaggcaaucacuugagguca

SEQ ID NO: 29549 - RNA, 62 nt, Human
uguggugcacguuuguaaucccaguuacucaggaggcugaggcacaagaauugaguaucacu

SEQ ID NO: 29550 - RNA, 62 nt, Human
gauggcgggugccuguaaucccagcuacucgggaggcugaggcaggagaaucgcuugaaccc

SEQ ID NO: 29551 - RNA, 62 nt, Human
gguggcgcacaccuguagucccagcuacuccggaggcugaggcaggagaaucucuugaaccu

SEQ ID NO: 29552 - RNA, 62 nt, Human
ggugguguguuccuguagucccagcuccccaggaggcugaggugggagguuggcuuuaaccc

SEQ ID NO: 29553 - RNA, 62 nt, Human
gguggcucaggccuguaaucccagcauuuugggaggcugaggcaaguggauaacuugagguc

SEQ ID NO: 29554 - RNA, 62 nt, Human
gguggcucacgccuguaaucccagcacuuugggaggcugagaagggcggaucacgaggucag

SEQ ID NO: 29555 - RNA, 62 nt, Human
gguucuccaugccuauaaucccggcuacucgggaggcugaggcaggagaaucaccugaaccc

SEQ ID NO: 29556 - RNA, 62 nt, Human
aguggcucauguguguaaucccagcacucugggaggcugagacagguagaucauuugagguc

SEQ ID NO: 29557 - RNA, 62 nt, Human
gguggcgcaugccuguagucccaacuacuagggaggcugaggcaggagaaucacuugaaccc

SEQ ID NO: 29558 - RNA, 62 nt, Human
auuuuuggacaugaaccagaaagcugaaagcugaggcugacacggacuguaggugcuuuuug

SEQ ID NO: 29559 - RNA, 62 nt, Human
gguggugcgcgcauguaaucccagcuacucgggaggcugaggcggaagaaucacuugaaccc

SEQ ID NO: 29560 - RNA, 62 nt, Human
aguggcacuugccuguagucucagcuacuuaggaggcugagguggcagaauagcuuaugccu

SEQ ID NO: 29561 - RNA, 62 nt, Human
ggugguggguggcuguaaucccagcuacucaggaggcugaggcagaagaaucugagccaaga

SEQ ID NO: 29562 - RNA, 62 nt, Human
aguggcucacaccuguaaucccagcacuuugggaggcugaggcaggcagaucaugaugucag

SEQ ID NO: 29563 - RNA, 62 nt, Human
agcuguggggguugaggguagaggguggaccagaggcugaggacugagccacccaaggaggu

SEQ ID NO: 29564 - RNA, 62 nt, Human
gguggcacacaucucuagucccaauuacucaggaggcugaggcgagagaaucgcuugagccu

SEQ ID NO: 29565 - RNA, 62 nt, Human
gguggcacaugcuuguaaucccagcuacucgggaggcugaggcaggagaaucgcuugaaccc

SEQ ID NO: 29566 - RNA, 62 nt, Human
gguggcgggcgccuguagucccagcuacucuggaggcugaggcaggagaauggcaugaaccc

SEQ ID NO: 29567 - RNA, 62 nt, Human
gguggcacgcgccuguagucccagcuacucaggaggcugaggcaggagaauuacuugaaccc

SEQ ID NO: 29568 - RNA, 62 nt, Human
gguggugcaugccuguaaucccagcuacuugggaggcugagacaggagaaucacuugaacua

SEQ ID NO: 29569 - RNA, 62 nt, Human
cuguccuauguccaggaagaagcccauuuguugaggcugaccuuccugaucauacacacaca

SEQ ID NO: 29570 - RNA, 62 nt, Human
gguugcgggcaccuguagucccagcuacucaggaggcugaggcgggagaauggcaugaaccc

SEQ ID NO: 29571 - RNA, 62 nt, Human
ugagcagcauuauaauuaauuuucaggguuuugaggcugaacauaauuucauuaucccucaa

SEQ ID NO: 29572 - RNA, 62 nt, Human
uuuuauuucuguuuuguaaugaccaaaggaaugaggcugacauagguauauauauauauuuu

SEQ ID NO: 29573 - RNA, 62 nt, Human
gguggugggcgccuguagucccagcuacucgggaggcugaggcaggagaauggcaugaaccc

SEQ ID NO: 29574 - RNA, 62 nt, Human
gggagaagccggcgcuccugcucccuccuggggaggcugacggguguggccacccgcuguca

SEQ ID NO: 29575 - RNA, 62 nt, Human
cguggugcgugccuguggucccaguuucuugggaggcugaggcgggaguaucauuugagcca

SEQ ID NO: 29576 - RNA, 62 nt, Human
gguagcacauaccuguaaucccagcuacucaggaggcugaggcaggagaauuugcuugaucc

SEQ ID NO: 29577 - RNA, 62 nt, Human
gguggugcaugccuguagucccagcuacucgggaggcugaggugggaggaucccgugagccu

SEQ ID NO: 29578 - RNA, 62 nt, Human
cucccauuuuucuaauuagaaaaaggcuuggugaggcugagaaaccagcccacaauuacaca

SEQ ID NO: 29579 - RNA, 62 nt, Human
gguggcacaugccuguaaugccagcuacucgggaggcugaggcaggagaauugcuugaaccc

SEQ ID NO: 29580 - RNA, 62 nt, Human
gguggugcaugccuguaaucccagcuacuagggaggcugaggcaggagaauugcuugaaccu

SEQ ID NO: 29581 - RNA, 62 nt, Human
gguggcaugugccuguagucuuagcuacuugagaggcugaggcaggagaaucgcuugaaccu

SEQ ID NO: 29582 - RNA, 62 nt, Human
uucugaugcuucaguguuauaaauucaacauagaggcugacaaccuaaauucaugguguaac

SEQ ID NO: 29583 - RNA, 62 nt, Human
gguggcgggcgccugcagucccagcuacucaggaggcugaggcaggagaauggcgugaaccu

SEQ ID NO: 29584 - RNA, 62 nt, Human; identical to SEQ ID NO: 29545

SEQ ID NO: 29585 - RNA, 62 nt, Human
gguggcucacaccuguaaucccagcacuuugggaggcugaggcgggcgaaucauuugaggug

SEQ ID NO: 29586 - RNA, 62 nt, Human
uguggcucacaccuguaaucccaacacuuugggaggcugaggugggcagaucaccugagguc

SEQ ID NO: 29587 - RNA, 62 nt, Human
uucacucacacagcucccgacugcuucuugcagaggcugagagucccccccccaccuuuuuu

SEQ ID NO: 29588 - RNA, 62 nt, Human
agacuuugcccugacggaguggcccggaagcagaggcugaccaggagcaggggccucccucc

SEQ ID NO: 29589 - RNA, 62 nt, Human
cuccccauuugcaccuagcuggaucaaguugggaggcugagcaaacucauauuccaguuagu

SEQ ID NO: 29590 - RNA, 62 nt, Human
ccacaccaggacuggacugggaugccgcuagugaggcugaggggugccagcgugggugggcu

SEQ ID NO: 29591 - RNA, 62 nt, Human
uaagauggacgccauaauccugaggccuccuagaggcugagggggcaacggugugauccagc

SEQ ID NO: 29592 - RNA, 62 nt, Human
gacugcagcaaggucagagguuuuagccuccugaggcugaccuugcuagucugcccacuccc

SEQ ID NO: 29593 - RNA, 62 nt, Human
ucuggggccauuaggcagccuaauuaaugcuggaggcugagccaaguacaggacacccccag

SEQ ID NO: 29594 - RNA, 62 nt, Human
ugcacgguguggccagagccucagcuggaugagaggcugagauggguggccagcuuguacac

SEQ ID NO: 29595 - RNA, 62 nt, Human
gguggugggcgccuguagucccagcagcuugggaggcugaggcuggagaauggugugaaccc

SEQ ID NO: 29596 - RNA, 62 nt, Human
uuguuugcucuugaaaaccucacugcaaggcugaggcugagcuucugauucaccaccccagg

SEQ ID NO: 29597 - RNA, 62 nt, Human
uuuguuuauuuauuuauuuauuuuugcauucugaggcugaacuaauaaaaacucuucuuugu

SEQ ID NO: 29598 - RNA, 62 nt, Human
gguguugggugccuguaaucccagcuacuggggaggcugaggcgggagaaucgcuugaaccc

SEQ ID NO: 29599 - RNA, 62 nt, Human
ggaagauugagcaacauaggaaaaggggaagagaggcugagugucaccaagguccaaacucc

SEQ ID NO: 29600 - RNA, 62 nt, Human
ucuauguggggggcggggaccggggaaagagggaggcugaaauguuuauucugcuucucccg

SEQ ID NO: 29601 - RNA, 62 nt, Human
ggguuuaaaaaaaaaaaaccagcccauccuuugaggcugauuuuucuuuuuuuuaaguucua

SEQ ID NO: 29602 - RNA, 62 nt, Human
gauggugggugccuguaaucccaguuacuugggaggcugaggcaggagaaucgcuugaaccu

SEQ ID NO: 29603 - RNA, 62 nt, Human
gguggcucacagcuauaaucucagcacuuugggaggcugaggugggagaauugccugagccc

SEQ ID NO: 29604 - RNA, 62 nt, Human
gguggcaggugccuguagucccagcuacucuggaggcugaggcaggagaauggcgugaaccc

SEQ ID NO: 29605 - RNA, 62 nt, Human
gguggcucacgccuguaaucccagaacuaugugaggcugaggcagguggaucacuugagguc

SEQ ID NO: 29606 - RNA, 62 nt, Human
ggugacgggcaccuguagucccagcuacucgggaggcugaggcaggagaauggcaugaaccc

SEQ ID NO: 29607 - RNA, 62 nt, Human
agagcucggcggugacgccgcugcacgagagcgaggcugaagaacuuugugacacaauaguc

SEQ ID NO: 29608 - RNA, 62 nt, Human
aguggugggcaccuauaauaccagcuacuccggaggcugaggcaggagaaucgcuugaaccc

SEQ ID NO: 29609 - RNA, 62 nt, Human
gagcuacucucaggcugcaaguaaguaugaaggaggcugaucccugagauccuugggaucuu

SEQ ID NO: 29610 - RNA, 62 nt, Human
auuggccagagguaggaauguggggagaaggagaggcugaaaagaaagcagaggagaaccca

SEQ ID NO: 29611 - RNA, 62 nt, Human
ggaaaugaauguugcugauagggauaaaucuugaggcugagggcgggugguacagaugugua

SEQ ID NO: 29612 - RNA, 62 nt, Human
gccucagacagacacagcaggaaggggccugagaggcugacagaggcaggaugggugcaagg

SEQ ID NO: 29613 - RNA, 62 nt, Human
agaacugcagugacccacuucaaagauauucagaggcugagcggugcagggagugcucaguu

SEQ ID NO: 29614 - RNA, 62 nt, Human
gguggcucaugccuguaaucccagcacuuugggaggcugagguagguggaaaaccugagguc

SEQ ID NO: 29615 - RNA, 62 nt, Human
gauggugugcaccuguaaucucagcuacucgggaggcugaggcaagagaaucgcuugaaccc

SEQ ID NO: 29616 - RNA, 62 nt, Human
cuuuccuccucuuccucacccucauccuuugggaggcugacuuggacccaaacugggcgacu

SEQ ID NO: 29617 - RNA, 62 nt, Human
augggagccaacauuuuauugaagaagccacagaggcugaaauucaauaaacacaaguuuua

SEQ ID NO: 29618 - RNA, 62 nt, Human
acguuccaggcaccugugaucccagcuacuuagaggcugaggcagaagaauugcuuuaaccu

SEQ ID NO: 29619 - RNA, 62 nt, Human
gguggcaugcaccuguagucccagcuauuugggaggcugaugcaggagaauagcuuaagccc

SEQ ID NO: 29620 - RNA, 62 nt, Human
gagguuuuugagcauaguacuugacuacucuagaggcugagacgggagcaucucuugagccu

SEQ ID NO: 29621 - RNA, 62 nt, Human
aguggcgggcaucuguagucccagcuacucaggaggcugaggcaggagaaucacuugaaccc

SEQ ID NO: 29622 - RNA, 62 nt, Human
gguggcacaugccuguaaucccagcacuuugggaggcugaggcaggugaaucaccugagguc

SEQ ID NO: 29623 - RNA, 62 nt, Human
uguggcgggcaccuguaaucccaccuacucgggaggcugaggcaggagaauugcuugaaucc

SEQ ID NO: 29624 - RNA, 62 nt, Human
gagccaggugccauggcuugagccuauaauccgaggcugaggugggaggaucacuugagccc

SEQ ID NO: 29625 - RNA, 62 nt, Human
cugggcaugcacuuguaauuccagcuacucaggaggcugaggcaagagaacugcuugaaucc

SEQ ID NO: 29626 - RNA, 62 nt, Human
guuggcauaugccuguaaucccagcuacucgagaggcugagacacgaaaauugcuugaaccu

SEQ ID NO: 29627 - RNA, 62 nt, Human
gguggcgggugccuguaaucccagcuacuugggaggcugaggcaagagaaucgcuugaaccc

SEQ ID NO: 29628 - RNA, 62 nt, Human
cugggcucuugggagcagaguccagugggugugaggcugacuugccgacggucggcagguaa

SEQ ID NO: 29629 - RNA, 62 nt, Human
gguggcacgugccuguaaucccagcuacuugggaggcugaggcgggagaaucgcuugaacca

SEQ ID NO: 29630 - RNA, 62 nt, Human
auugaagggaagagggaccagcacaugaggcugaggcugaggggcagucaccagcaccagga

SEQ ID NO: 29631 - RNA, 62 nt, Human
cuccuuauugaagggaagagggaccagcacaugaggcugaggcugaggggcagucaccagca

SEQ ID NO: 29632 - RNA, 62 nt, Human
gguggcaugcaccugucaucccagcuacucgggaggcugaggcaggagaaucgcuugaaccc

SEQ ID NO: 29633 - RNA, 62 nt, Human
ccguggcucacgccuguaauccaacacuuugagaggcugaggcgggcggaucaccugaguca

SEQ ID NO: 29634 - RNA, 62 nt, Human
guggggggucuggggcagaaagguaagagugggaggcugagcagaugcacacauccugagag

SEQ ID NO: 29635 - RNA, 62 nt, Human
gguggcucgcaccuguauucccagccacuggggaggcugaggccggaggagugcuugagccc

SEQ ID NO: 29636 - RNA, 62 nt, Human
gaggugggcaaguggcagcccagcugaagcaagaggcugauugacuggcugcucacucaggc

SEQ ID NO: 29637 - RNA, 62 nt, Human
ugaaaugcugagguccccacgugugaaugggugaggcugauguggaugucugugugugccag

SEQ ID NO: 29638 - RNA, 62 nt, Human
uauguccaggagagggcaauagagggaagacugaggcugaagaauugacggcucuggaccca

SEQ ID NO: 29639 - RNA, 62 nt, Human
aauggugugcaccugugauccuagcuacuugggaggcugaggugggagaauugcucaagccc

SEQ ID NO: 29640 - RNA, 62 nt, Human
gguggugggcacugguaaucccagguacucaagaggcugaggcaggagaaucgcuugaaccu

SEQ ID NO: 29641 - RNA, 62 nt, Human
gguggcacgugccuguaaucccagcuacucaggaggcugaggcaggagaauugcgugaaccc

SEQ ID NO: 29642 - RNA, 62 nt, Human
gagagguggaggcccugcuggaucgauacuucgaggcugauccuccagggcagguggcugcc

SEQ ID NO: 29643 - RNA, 62 nt, Human
gguggcucaugccuauaauccuggcauuuuaggaggcugagguuggagaaucgcuugaggcc

SEQ ID NO: 29644 - RNA, 62 nt, Human
gguggcacacgccuguagucccagcuacucgggaggcugaggcagaagaaucgcuugaaccu

SEQ ID NO: 29645 - RNA, 62 nt, Human
aguggcaggcaccuguaaucccagcuacucgggaggcugaggcaggagaaucgcuugaaccu

SEQ ID NO: 29646 - RNA, 62 nt, Human
ggugacgggcgccuguaaucccagauacucaggaggcugagguaggagaaucacuugaaccu

SEQ ID NO: 29647 - RNA, 62 nt, Human
uuuggaaugguaggaugcugugcggggagcucgaggcugaggcauaaucacugcuucgguuc

SEQ ID NO: 29648 - RNA, 62 nt, Human
ggugguaagugccuguaguccuagcuacuugggaggcugagaugggaggaugucuugagccc

SEQ ID NO: 29649 - RNA, 62 nt, Human
agugucucauaccuguauuugcagcacuuugggaggcugaagcagaucgcuggagcuuauga

SEQ ID NO: 29650 - RNA, 62 nt, Human
ggugguguaccccuguaaucccagcuacucgggaggcugagacaggagaaucacuugaaccc

SEQ ID NO: 29651 - RNA, 62 nt, Human
acgguggcaugccuauagucccagcuacuugagaggcugaggcaggaggauuguugagccca

SEQ ID NO: 29652 - RNA, 62 nt, Human
uaagguagcuuuggcagcagggcugauacuaugaggcugaaacaauccuugugaugaaguag

SEQ ID NO: 29653 - RNA, 62 nt, Human
uguagcauaugccuguggucccagcuacugaggaggcugaggugggaggauugcuugagccc

SEQ ID NO: 29654 - RNA, 62 nt, Human
gguagcucacccuuguaaucccagcacuuugggaggcugagguggguagauuacuugagccc

SEQ ID NO: 29655 - RNA, 62 nt, Human
ggugcccucugccuauagccccagcuacuugggaggcugaggugggaggaucgcuugagccc

SEQ ID NO: 29656 - RNA, 62 nt, Human
gguggcucacaccuguaaucaaaacacuuugggaggcugagucgggaggauagcgugagccc

SEQ ID NO: 29657 - RNA, 62 nt, Human
ggugccucaugccuguaauccuagcaccuugggaggcugaggcagguggaucaccuaagguc

SEQ ID NO: 29658 - RNA, 62 nt, Human
gguggcacaugccuguaaucccagcuacucaggaggcugaggcggagaauugcuugaacccg

SEQ ID NO: 29659 - RNA, 62 nt, Human
gguggcaggcaucuauaaucccagcuacuugggaggcugaggcaggagaauugcucaaaccc

SEQ ID NO: 29660 - RNA, 62 nt, Human
uuucguaaccauauccuuucccccgcuaacuggaggcugauuucuacauauuucuuccaugu

SEQ ID NO: 29661 - RNA, 62 nt, Human
uucugagcgugcgggcgccgggaggggaugcugaggcugauggagcugccuccagggcuagg

SEQ ID NO: 29662 - RNA, 62 nt, Human
aaggcugagacaggaaaauugcuugaacccaggaggcugagguugcagugagccaggauugc

SEQ ID NO: 29663 - RNA, 62 nt, Human
gguggcgugagccuguaguccuagcuacucaggaggcugaggcaggagaauagccugaaccu

SEQ ID NO: 29664 - RNA, 62 nt, Human
aaggcccugucucuggcuacucccuggaccacgaggcugauuccucucauuuccagcuucuc

SEQ ID NO: 29665 - RNA, 62 nt, Human
cugguggugcaugccuaguccuagcugaucuggaggcugacgugggaggauugcuugagccu

SEQ ID NO: 29666 - RNA, 62 nt, Human
gguggcaggccccuguaaucccagcuaauugggaggcugaagcaggagaauugcucaaaccu

SEQ ID NO: 29667 - RNA, 62 nt, Human
ggccuuuccucaaggcaugguagucuuuccuugaggcugauagcuagggcuugaccaggaag

SEQ ID NO: 29668 - RNA, 62 nt, Human
ucgagcacacaccuguaguaccagcuacucuggaggcugaggcaggaggaucacuugagccc

SEQ ID NO: 29669 - RNA, 62 nt, Human
gguggcucacaccuguaaucccagcaccuugggaggcugaggugggaggaucauuugaggcc

SEQ ID NO: 29670 - RNA, 62 nt, Human
guccaagcagauaggcucacacgagaaacagugaggcugaaagggggggcuauggaagagcg

SEQ ID NO: 29671 - RNA, 62 nt, Human
aguggcucuugucuguaaucccagcgcucugggaggcugaggcaggaggaucacuugagguc

SEQ ID NO: 29672 - RNA, 62 nt, Human
cgugggucacgccuguaaucccagcacuuugggaggcugaggcagguggaucaccucaaguc

SEQ ID NO: 29673 - RNA, 62 nt, Human
gguugcacacgccuguaaucccagcuacucaggaggcugagggaggagaaucccuugaaccc

SEQ ID NO: 29674 - RNA, 62 nt, Human
acgccagucaugggaggcagagcugggggagcgaggcugacaaugacuccuguuuucacgcu

SEQ ID NO: 29675 - RNA, 62 nt, Human
gguggugcacgucuguagucccagcuacucaggaggcugaggcagaagaaucgcuugaaccc

SEQ ID NO: 29676 - RNA, 62 nt, Human
gcaugcgccuguagucccagcuacucccuccagaggcugagaauugcuugaaccugggaagu

SEQ ID NO: 29677 - RNA, 62 nt, Human
ggcgcaugccuguuguagccccagcuacucaagaggcugaggcaggagaauugcuugaacgc

SEQ ID NO: 29678 - RNA, 62 nt, Human
aguggcuuaugccuguaauugcagcacuuuuagaggcugaggcaggagaauugguugaaccc

SEQ ID NO: 29679 - RNA, 62 nt, Human
uauggugcaugccuguaaucccagcuacucgggaggcugaggcaggagaauugcuugaacuc

SEQ ID NO: 29680 - RNA, 62 nt, Human
gguggcucacaccuguaaucccagcacuuugggaggcugaggcggauggaucacgaggucag

SEQ ID NO: 29681 - RNA, 62 nt, Human
gguggcacgcgccuguaaucccagcuacucaggaggcugaggcaggagaacugcuugaaccu

SEQ ID NO: 29682 - RNA, 62 nt, Human
gauggugggcaccuguaaucccagcuacuugggaggcugaggcaggagaaucacuugaaccc

SEQ ID NO: 29683 - RNA, 62 nt, Human
aguagcauaugccuuucaacguagcuacucaggaggcugaggugggaggaucccuugagccg

SEQ ID NO: 29684 - RNA, 62 nt, Human
gguggcucuugccuguaaucccagcacuuugggaggcugaggcgggcagaucaccugagauc

SEQ ID NO: 29685 - RNA, 62 nt, Human
uaguucuaaauuauuccuaucucaauagccaagaggcugaucaagcgucauuuauugaggaa

SEQ ID NO: 29686 - RNA, 62 nt, Human
agugguaugugccuguagucccagguacucaggaggcugaggcaggaggauugccugagccc

SEQ ID NO: 29687 - RNA, 62 nt, Human
ggcggugugcgccuguagucccagcuacucaggaggcugaggcaggagaauugcuugaaccc

SEQ ID NO: 29688 - RNA, 62 nt, Human
gguggcaugcaccuguagucccagcuaccugggaggcugaggcaggagaauugcuugaaccu

SEQ ID NO: 29689 - RNA, 62 nt, Human
gguggcgggcgccuguagucccagccacucgggaggcugagacaggagaaucgcuuaaaccu

SEQ ID NO: 29690 - RNA, 62 nt, Human
gguggcucaugccuguaauccuagcacuuugggaggcugagguggguggaucaccugagguc

SEQ ID NO: 29691 - RNA, 62 nt, Human
gguggcagaggccuguaaucccagcuccuugggaggcugaggcgggagaauugcuugaaccc

SEQ ID NO: 29692 - RNA, 62 nt, Human
cauggugcaugccuguaaucccagccacucaggaggcugaggcagggaggauccauugagcc

SEQ ID NO: 29693 - RNA, 62 nt, Human
ugcuaucucuguaguauuuucauuugagagaggaggcugaguuuccagagcuuugcuuucau

SEQ ID NO: 29694 - RNA, 62 nt, Human
gguggcgggggccuguaaucccagcuacucaggaggcugaggcagaagaauggcaugaaccc

SEQ ID NO: 29695 - RNA, 62 nt, Human
agguccuaaaacugaaggcaacuugguuaagggaggcugaauucuuggagcugaagggaaaa

SEQ ID NO: 29696 - RNA, 62 nt, Human
gguggcaggcaccuguaaucccagcuacucgggaggcugaggcaggagaaucgcuugaaccu

SEQ ID NO: 29697 - RNA, 55 nt, Human
acggccuguguccucacuagcgccugaggcugagguggugcucccugcggccgca

SEQ ID NO: 29698 - RNA, 62 nt, Human
gguggcgcaugccuauaaucccagguacucaggaggcugaggcaggagaaucacuugaaccu

SEQ ID NO: 29699 - RNA, 62 nt, Human
gguaccgugcaugugcagucccagcuacucaggaggcugaggcaggaggaucacagugaccu

SEQ ID NO: 29700 - RNA, 62 nt, Human
aucauucagagugagagagagaaagcacggcugaggcugagucaguugaccguugaggaaga

SEQ ID NO: 29701 - RNA, 62 nt, Human
gguggugggcaccuguaaucucagcuacuugggaggcugaggcacaagaaucacuugaacuu

SEQ ID NO: 29702 - RNA, 62 nt, Human
gguggugcacaccuguagucccagcuacucgggaggcugagacaggagauuugcuugaaccc

SEQ ID NO: 29703 - RNA, 62 nt, Human
gguggcucaugccuguaaucccagcacuuugggaggcugaggcgggcggaucaccugagguu

SEQ ID NO: 29704 - RNA, 62 nt, Human
ggugguacaugccuguaaucccagcuacucaggaggcugaggcaggagaaucacuugacccc

SEQ ID NO: 29705 - RNA, 62 nt, Human
gguggugcacacuuguagucccagcuacucaggaggcugaggugggagaauugcuugggccc

SEQ ID NO: 29706 - RNA, 62 nt, Human
ggaaccagugaccuuggcugcccaacuguguggaggcugagugauugacaaacacagguugg

SEQ ID NO: 29707 - RNA, 62 nt, Human
gacucucugcugaggucaacccucaguuccaagaggcugacuucaggguugccacagaagag

SEQ ID NO: 29708 - RNA, 62 nt, Human
gguggugcacaccuguaaucccagcuacucuggaggcugaggcaggagaaucacuugaaccc

SEQ ID NO: 29709 - RNA, 62 nt, Human
gguggcaggcgccuauaaucccagcuacuggggaggcugaggcaggagaaucacuugaaccc

SEQ ID NO: 29710 - RNA, 62 nt, Human
agugacgggugcccguaaucccagcuacucaggaggcugagacaggagaaucaccugaaccc

SEQ ID NO: 29711 - RNA, 62 nt, Human
aguggcucacgccuguaaucccagcacuuugagaggcugaggugguaggaucaccugagguc

SEQ ID NO: 29712 - RNA, 62 nt, Human
gguggcgggcgccuguagucccagcuacuugggaggcugaggcaggagaauggcgugaaccc

SEQ ID NO: 29713 - RNA, 62 nt, Human
auuccuacuugggcucuuuccuuuaaucuucggaggcugaguuugcccaacucagguaugcc

SEQ ID NO: 29714 - RNA, 62 nt, Human
guuuuuguuuaauauuuaaacuucuuguuguggaggcugaaaagaaaaaaaauaauagaaag

SEQ ID NO: 29715 - RNA, 62 nt, Human
ggugguguaugccuguaaucccagcuacuugggaggcugaggcaggagaaucgcuugauccc

SEQ ID NO: 29716 - RNA, 62 nt, Human
gguggugcaugccuguaagcccagcuauucgggaggcugagguaggagaaucacuugaaccc

SEQ ID NO: 29717 - RNA, 62 nt, Human
augguggacucgccuguaaucucacuacacaggaggcugaggcaggagaaucacuugaaccu

SEQ ID NO: 29718 - RNA, 62 nt, Human
aguggcucacgccuguaauccuagcaguuugggaggcugagccggguggaucgccugagguc

SEQ ID NO: 29719 - RNA, 62 nt, Human
caggagggcacguucgcgccgcgccgcggagggaggcugagagggccgggccgggcggcggg

SEQ ID NO: 29720 - RNA, 62 nt, Human
ggugccgcgugccuguaaucccagcuacuugggaggcugaggcauaagaauuguuugagccc

SEQ ID NO: 29721 - RNA, 62 nt, Human
ggugguguguaccuguagucacagguacuugggaggcugaggugggaggaucacuugagccc

SEQ ID NO: 29722 - RNA, 62 nt, Human
aauguuuguuuauucuguuacagcucaaaauggaggcugagaaucucuaccaccauucccuu

SEQ ID NO: 29723 - RNA, 62 nt, Human
gauggcgcaugccuguaaucccagcuacuugggaggcugaggcaggagaaucacuugaaccc

SEQ ID NO: 29724 - RNA, 62 nt, Human
gguggcucacaccuguaaucccagcccuuugggaggcugagguggguguaucacuugagguc

SEQ ID NO: 29725 - RNA, 62 nt, Human
uucuuugaaaugccucucucagacccaucuuggaggcugauuacuuacugcaccaaagcuau

SEQ ID NO: 29726 - RNA, 62 nt, Human
gguggcucacaccuguaaucccagcgcuuugggaggcugaggcagguggaucacuugagcuc

SEQ ID NO: 29727 - RNA, 62 nt, Human
uggagcgcacgccuguagucccagcuacucgggaggcugaggcaggagaauugcuugaaccc

SEQ ID NO: 29728 - RNA, 62 nt, Human
gcuuugggguuccuuuuauuagugcuuugccagaggcugaugucaagcaccacaccccaacc

SEQ ID NO: 29729 - RNA, 62 nt, Human
ugucccugucugucacagcacaguggggccacgaggcugacauucucuggccuugcacacag

SEQ ID NO: 29730 - RNA, 62 nt, Human
ggagaaucaggauuucuuaaauacucaacagagaggcugagcagagcaaauggggggcuuca

SEQ ID NO: 29731 - RNA, 62 nt, Human
aauaucggcguguggcuggagccuucccacuggaggcugaaaguggcuugugguauuauaau

SEQ ID NO: 29732 - RNA, 62 nt, Human
agugccucacgccugucaucccagcacuuugggaggcugaggcaggcggaucacuugaugcc

SEQ ID NO: 29733 - RNA, 62 nt, Human
ggugucaggcaccuguaaucccagcuacuugggaggcugaggcaggagaauugcuugaacuc

SEQ ID NO: 29734 - RNA, 62 nt, Human
gguggcacgugccuguggucccagcuacuugggaggcugaggugggagccugggaggucaag

SEQ ID NO: 29735 - RNA, 62 nt, Human
gguggcucacgccuguaaucccagcacuuugggaggcugaggcgggcagaucaccugagguc

SEQ ID NO: 29736 - RNA, 62 nt, Human
gguggcacaugccuuuagucccagcuacucuggaggcugaaguuggaggauggcuugagccc

SEQ ID NO: 29737 - RNA, 62 nt, Human
gguaucucaugccuauaaucccagcacuuugggaggcugaggcaguugagaccaggaguucg

SEQ ID NO: 29738 - RNA, 62 nt, Human
gguggcaggcaccuguaaucccagcuacuugggaggcugagucaggagaaucgcuugagccc

SEQ ID NO: 29739 - RNA, 62 nt, Human
guuggcacaugccuguagucccagcuacgugggaggcugaggcacgagaauugccugaaccc

SEQ ID NO: 29740 - RNA, 62 nt, Human
uggcaggcgccuguagaaucccagcuacucgggaggcugaggcaggagaauugcuugaaccu

SEQ ID NO: 29741 - RNA, 62 nt, Human
ggugcugggugccuguaaucccagcuacucgggaggcugaagcaggagaaucacuucaaccu

SEQ ID NO: 29742 - RNA, 62 nt, Human
auuagacagaacaccuaugcaaagaugaacccgaggcugagaaucagacugacaguuuacag

SEQ ID NO: 29743 - RNA, 62 nt, Human
gguggcacacaccuguagucccagcugcucgagaggcugaggcacgagaaucaguugaacug

SEQ ID NO: 29744 - RNA, 62 nt, Human
aggggcucacaccgguaaucccagcacuuugagaggcugaggcgggaagaucacuugaggcc

SEQ ID NO: 29745 - RNA, 62 nt, Human
ugguggcaggcgccuguaauccagcuacucgggaggcugaggcaggagaaucacuugaaccc

SEQ ID NO: 29746 - RNA, 62 nt, Human
gguggcgggcgccuguagucccagcuacuugggaggcugaggcaggagaauggcgggaaccu

SEQ ID NO: 29747 - RNA, 62 nt, Human
aguggcucaugccuguaaucccagcacuuugggaggcugaggcggguggaucacuugagguc

SEQ ID NO: 29748 - RNA, 62 nt, Human
gguggcagacagcuguaaucucagcugcucgggaggcugaggcacaagaaucgcuugagcca

SEQ ID NO: 29749 - RNA, 62 nt, Human
gguggcucacgccuguaaucccagcacuuugggaggcugaggcgggugaaucacuugauuga

SEQ ID NO: 29750 - RNA, 62 nt, Human
gguggcgcaaaccuguagucguagcuacuugggaggcugaggcaggggaaucacuugaaccc

SEQ ID NO: 29751 - RNA, 62 nt, Human
aguggcucacgccuguaaucccagcauuuugggaggcugagguaggcggaucacaaggucag

SEQ ID NO: 29752 - RNA, 62 nt, Human
gguggcaggcgccuguagucccagcuacucgggaggcugaggcagaagaauggcguaaaccc

SEQ ID NO: 29753 - RNA, 62 nt, Human
gguggcucacgccuguaauccuagcacuuugggaggcugaggcggguagaucacaaggucag

SEQ ID NO: 29754 - RNA, 62 nt, Human
acaaaaauuagcugggugugauggccacuugggaggcugagauaggagaaucgcuugaaccu

SEQ ID NO: 29755 - RNA, 62 nt, Human
cagagaggcggaggaggaagcuggcgcugggggaggcugagggugagggaacagccuggaug

SEQ ID NO: 29756 - RNA, 62 nt, Human
aguggcucaugccuguaaucccagcacuuugggaggcugaggcagguagaucaccugaaguu

SEQ ID NO: 29757 - RNA, 62 nt, Human
cuugaguagaaaagucggggaucggggcaagagaggcugaguacggaugggaaacuauugug

SEQ ID NO: 29758 - RNA, 62 nt, Human
gguggcacacacuuguagccccagcuacuagggaggcugaggagggaggaucucuugugccu

SEQ ID NO: 29759 - RNA, 62 nt, Human
gagcaugaagcaaagaauuccaggaaacccaagaggcugagaauucuuuugucuaccauaga

SEQ ID NO: 29760 - RNA, 62 nt, Human
ggugguggaagccuguagucccagcuacuccggaggcugaggcaggagaauggcgugaaccc

SEQ ID NO: 29761 - RNA, 62 nt, Human
caucccuuccgcacucucucccugacuuucaagaggcugacaauccaggccgcugcuuccca

SEQ ID NO: 29762 - RNA, 62 nt, Human
agauguaagugcuaguagaauauaagauaaaagaggcugagaauuaccauacaaggguauua

SEQ ID NO: 29763 - RNA, 62 nt, Human
cacggggaagcaacugccuuucaaggguaauugaggcugaaugaaugaucccgaaucuguaa

SEQ ID NO: 29764 - RNA, 62 nt, Human
gguggugggcaccuguagucccagcuacucaggaggcugaggcaggagaauggugugaaccu

SEQ ID NO: 29765 - RNA, 62 nt, Human
gguggcauauacuuguggucccagauacuugggaggcugagauaggaucacuugggcccagg

SEQ ID NO: 29766 - RNA, 62 nt, Human
cuguguaaccggcuuagggucuuugcagucaagaggcugaccccuucaguuaaagauauuua

SEQ ID NO: 29767 - RNA, 62 nt, Human
gguggugugcgccuguaaucccagcuacucgggaggcugaggcaggacgauuacuugagcuu

SEQ ID NO: 29768 - RNA, 62 nt, Human
gguggcgcauaccuguagucccagcuacuugggaggcugaggcaggagaaucacuugaacuc

SEQ ID NO: 29769 - RNA, 62 nt, Human
aguggcucacgccuguaaucccagcacuuugggaggcugaggugaguggauuacaaggucag

SEQ ID NO: 29770 - RNA, 62 nt, Human
gguggugcgugccuguagucucagcuacucaggaggcugaggcaggagaaucgccugaaccc

SEQ ID NO: 29771 - RNA, 62 nt, Human
gguggugcucaccuguaaucccagcuacccaggaggcugaggcaagagaaucacuugaaccc

SEQ ID NO: 29772 - RNA, 62 nt, Human
gguggcucaugccuguaaucccagcuacucaggaggcugaggcaggaggauugcuugaaccc

SEQ ID NO: 29773 - RNA, 62 nt, Human
ccaggcuugcaccuguaaucccaguuaccugggaggcugaggcaggagaaucucuugagccc

SEQ ID NO: 29774 - RNA, 62 nt, Human
aguggcucacaccuguaaucccagcacuuugggaggcugaggcggguggaucaccugagguc

SEQ ID NO: 29775 - RNA, 62 nt, Human
gauagcacgugccuguagucccagcuacucgggaggcugaggcuggagaguugcucaaaccc

SEQ ID NO: 29776 - RNA, 62 nt, Human
gguggcgcacgccuguggucccagcuacuugggaggcugaggcaugagaauugcuugaaccc

SEQ ID NO: 29777 - RNA, 62 nt, Human
ucaugucacaaacacaaucuauucuacaugaggaggcugagaaaggggaagagaaaaacaaa

SEQ ID NO: 29778 - RNA, 62 nt, Human
gguggugcaugccuguaaucccagcuacucgggaggcugaggcaggagaaucacuugaacuc

SEQ ID NO: 29779 - RNA, 62 nt, Human
gguggcacaucccuauagucccagcuacuugggaggcugagguggaaggauugcuugagcga

SEQ ID NO: 29780 - RNA, 62 nt, Human
gguggugcauaccuauaguccuggcuauuugggaggcugaggcaggaggauugcuuuagccc

SEQ ID NO: 29781 - RNA, 62 nt, Human
gguggugcaugccuguaaucccagcuacucgggaggcugaggcaggagaaucgcuugaaccc

SEQ ID NO: 29782 - RNA, 62 nt, Human
gguggcuucugccugugauuccggcuacuugggaggcugaggugggagggauugcuuaagcc

SEQ ID NO: 29783 - RNA, 62 nt, Human
uuucacacuauccagcuaagcaaagauuccuggaggcugacuuguaucuucagacucacaga

SEQ ID NO: 29784 - RNA, 62 nt, Human
guagauguucuuugcuccuugucagaguugaagaggcugacuuggcccacugcuaagcggca

SEQ ID NO: 29785 - RNA, 62 nt, Human
auucucccgaugacuauucaaaucagcaucuagaggcugaaugacaaugccaaacacuccac

SEQ ID NO: 29786 - RNA, 62 nt, Human
gguggugugcaccuguagucccagcuauuugggaggcugaggugggagaaucacuugaaccu

SEQ ID NO: 29787 - RNA, 62 nt, Human
cagcagaggccgagcgggagccucuggggagcgaggcugaaaccugaaccugcccauggaga

SEQ ID NO: 29788 - RNA, 62 nt, Human
guggugcacgccuguaauccccagauacucgggaggcugaagcaggagaauugcuugaaccc

SEQ ID NO: 29789 - RNA, 62 nt, Human
cacugcccuccuggguaccagcccucaguguggaggcugagcuggugccuggccccagucuu

SEQ ID NO: 29790 - RNA, 62 nt, Human
gcugggugugguggcgggucccagcuacucgggaggcugaggcaggagaauggcaugaacca

SEQ ID NO: 29791 - RNA, 62 nt, Human
gguggcgggcgccuguaguccuagcuacucgggaggcugaggcaggagaaucucuuucuuaa

SEQ ID NO: 29792 - RNA, 62 nt, Human
uugaacaggugauugaauauguuaggaacuuugaggcugaguugagcuucugagaugauuga

SEQ ID NO: 29793 - RNA, 62 nt, Human
aauggcaugcaucuguaaucccagcuauucaagaggcugaggcaugaggaucucuugaaccc

SEQ ID NO: 29794 - RNA, 62 nt, Human
gguggugcaugccuguaaucccagcuacuagggaggcugaggcaagagaguugcuugaaccc

SEQ ID NO: 29795 - RNA, 62 nt, Human
aguggcucaugccuguaaucccagcacucugggaggcugaggugggcggauugcuugagguc

SEQ ID NO: 29796 - RNA, 62 nt, Human
guacgugcgugccuguagucccagcuacucgggaggcugagaugggagaaucacuugaaccu

SEQ ID NO: 29797 - RNA, 62 nt, Human
uuaugccugucugacugucacucuggcacuaggaggcugaucuuguacuccauaugacccca

SEQ ID NO: 29798 - RNA, 62 nt, Human
gguggcgcacaccuauaaucucagcuacucaggaggcugaggcacgagaaucgcuugagccu

SEQ ID NO: 29799 - RNA, 62 nt, Human
gguggcaugugccuguauucccagcuacucaugaggcugaggcaggagaauggcgugaaccc

SEQ ID NO: 29800 - RNA, 62 nt, Human
gguggcacgugccuguaaucccagcuacucgggaggcugaggcaggagaaucgcuugaaccu

SEQ ID NO: 29801 - RNA, 62 nt, Human
guggcucacgccuguaaucccagcacuuuugggaggcugagguugggaguucaagaccagcc

SEQ ID NO: 29802 - RNA, 62 nt, Human
cugccccuagucaccuagcugugagggugccugaggcugaauggcuccaccccucccccagc

SEQ ID NO: 29803 - RNA, 62 nt, Human
accugccagggcccgaccuggggcugagugcagaggcugagcaggacguuaggcccgggccc

SEQ ID NO: 29804 - RNA, 62 nt, Human
ucggggagguucuccugccucuccucggccaggaggcugaggccugcacugcagaugauccu

SEQ ID NO: 29805 - RNA, 62 nt, Human
gguggcacaugccuguaaucccagcugcucaggaggcugaggcaggagaauugcuugaaccc

SEQ ID NO: 29806 - RNA, 62 nt, Human
gguagugcacaccuguaauuucaacuacuugggaggcugaggcaggagaauugcuugaaccc

SEQ ID NO: 29807 - RNA, 62 nt, Human
gguggcacacacccguaguuccagcuacuugggaggcugaggcagcauugcuugaacccggg

SEQ ID NO: 29808 - RNA, 62 nt, Human
gguggugggcaccugugaucccagcuuccugggaggcugaggcaagagaaucgcuugaaucu

SEQ ID NO: 29809 - RNA, 62 nt, Human
gguggcaugcgcuuguagucucagcuacuccggaggcugaggcaggagaauugcuugaaccu

SEQ ID NO: 29810 - RNA, 62 nt, Human
ugcggcuugcgccuguaaucucagcacuuugggaggcugagauggguggaucaccugagguu

SEQ ID NO: 29811 - RNA, 62 nt, Human
gguggugggugucuguaaucccagcuauucgggaggcugaggcaggagaaucgcuugaaccc

SEQ ID NO: 29812 - RNA, 62 nt, Human
gguggcacacaccuguagucccggcuacucgggaggcugaggcaggagaauugcuugaaccc

SEQ ID NO: 29813 - RNA, 62 nt, Human
gguggcucacaccugugaucccagcacuuugggaggcugagguaggaggaucacgugagguc

SEQ ID NO: 29814 - RNA, 62 nt, Human
gguggcacacgccuguagucccagcuacucaggaggcugaggcaggagaaucacuugaauuc

SEQ ID NO: 29815 - RNA, 62 nt, Human
gguggugggcaccuguagucccagcuacucgggaggcugaggcaggagaauggugugaaccu

SEQ ID NO: 29816 - RNA, 62 nt, Human
aguggcucccuccuguagucccagcuacuugggaggcugagaugggaggaccauuugagccu

SEQ ID NO: 29817 - RNA, 62 nt, Human
uucaugccuguaaucccagcacuucacuuugggaggcugaggcggguggaucacaaggucag

SEQ ID NO: 29818 - RNA, 62 nt, Human
gguggcaugcguguguagucgaagcuacucaggaggcugaggcagaagaaucacuugaaccu

SEQ ID NO: 29819 - RNA, 62 nt, Human
gguggcucaugccuguaaucccaguacuuugggaggcugaggugggcaaaucaccugagguc

SEQ ID NO: 29820 - RNA, 62 nt, Human
gguggcauaugccuguagucccaguuacuugggaggcugagacaggauugcuuaagcccagg

SEQ ID NO: 29821 - RNA, 62 nt, Human
aguggcucccaccuuuaaucccagcaccuggggaggcugaggugaguggaucacuagagguc

SEQ ID NO: 29822 - RNA, 62 nt, Human
gguggcacacacuuguaaucccagcuacucaggaggcugaggcaugagaaucgcuuaaaccc

SEQ ID NO: 29823 - RNA, 62 nt, Human
gguggcucacgccuguaaucccggcacuuugggaggcugaggcaggcggauugccugagauc

SEQ ID NO: 29824 - RNA, 62 nt, Human
gguggcgggcgccuguaaucccagcuacucaggaggcugaggcagcagaaucguuugaaccc

SEQ ID NO: 29825 - RNA, 62 nt, Human
gcugcuccugcugcuggcaacaaaggauucgggaggcugauguuucuucugaggggaauggg

SEQ ID NO: 29826 - RNA, 62 nt, Human
gguggcuggcaccuguagucccagcuacuugggaggcugaggcaggagaauggcgugaaccu

SEQ ID NO: 29827 - RNA, 62 nt, Human
aguuauacugggcagcaauaauaauugggcaugaggcugauuacucaauggugaggguaggu

SEQ ID NO: 29828 - RNA, 62 nt, Human
gguggcucaugccuguaaucccagcacuuugggaggcugaggcggguggauugcuugagccc

SEQ ID NO: 29829 - RNA, 62 nt, Human
gguggcacacuccuguaaucccagcuacuggggaggcugaggcacgagaaucacuugaaccc

SEQ ID NO: 29830 - RNA, 62 nt, Human
ucucuccugggcauguagucccagcuacucgggaggcugaggcaggagaaucgcuugaaccu

SEQ ID NO: 29831 - RNA, 62 nt, Human
agccgaaugagaucaaaaguuggggguggggggaggcugaacaaacucaggaccugguggcc

SEQ ID NO: 29832 - RNA, 62 nt, Human
aauuuccucuccacugcuggacaugagauggagaggcugagggacaggaucuauaggcagcu

SEQ ID NO: 29833 - RNA, 62 nt, Human
cuggcuagcgggccccccagccagggaucccagaggcugaggguuggggagaggaagccauc

SEQ ID NO: 29834 - RNA, 62 nt, Human
gguggcgcaugcguguaaucccagcuacuugggaggcugaggcaggagaauugcuugaaccu

SEQ ID NO: 29835 - RNA, 62 nt, Human
ccaggugcaguggcucacgcccagcacuuugggaggcugaggugggaggaucccuugaggcc

SEQ ID NO: 29836 - RNA, 62 nt, Human
uguggugggcgccuguaaucccagcuccucaggaggcugaggcaggagaauugcuugaaacc

SEQ ID NO: 29837 - RNA, 62 nt, Human
cgggcgugguggcuguagucgcagcuacucaggaggcugaggcgggagaauggcgugaaccc

SEQ ID NO: 29838 - RNA, 62 nt, Human
gguggugggcgccuguagucccagcuacucaggaggcugaggcaggagaaugcugugaaccc

SEQ ID NO: 29839 - RNA, 62 nt, Human
gguggcauacgccuguaguccuagccacucaggaggcugaggcaggaggauugcuugagccc

SEQ ID NO: 29840 - RNA, 62 nt, Human
gguggugcgugccuguaguuccagcuacuugggaggcugaggcaggagaaucgcuugaacca

SEQ ID NO: 29841 - RNA, 62 nt, Human
gguggcgugugccuguagucccagcugcuugggaggcugaggcaggagaaucgcuugaaccu

SEQ ID NO: 29842 - RNA, 62 nt, Human
cgcagcaugcgccuguagucccagcugcucaggaggcugaggcaggagaauugauugaaccc

SEQ ID NO: 29843 - RNA, 62 nt, Human
gguggugggugccuguaauuccagccacucgagaggcugaggcaggagaauugcuugaaccc

SEQ ID NO: 29844 - RNA, 62 nt, Human
uggggugcaugccuggaaucccagcuacuugagaggcugaggcacgagaauugcuugaaccc

SEQ ID NO: 29845 - RNA, 62 nt, Human
cauggcucacaucuguaaucccagcacuuuuggaggcugaggcggguggauugcuugaggcc

SEQ ID NO: 29846 - RNA, 62 nt, Human
ggcggugcacaccuguagucccagcugcucaggaggcugaggcaggaggaucucuugagccc

SEQ ID NO: 29847 - RNA, 62 nt, Human
gguggcaugcguguauaguccaagcuacucaggaggcugaggcagaagaaucacuugaaccu

SEQ ID NO: 29848 - RNA, 62 nt, Human
cccugcaggguaagcuguuguucccugaggcugaggcugaggcagagaaucuuccagaugau

SEQ ID NO: 29849 - RNA, 62 nt, Human
uguauacccugcaggguaagcuguuguucccugaggcugaggcugaggcagagaaucuucca

SEQ ID NO: 29850 - RNA, 62 nt, Human
agagacuuccugccuuuauucccucccagggagaggcugaaggaauggaauugaaagcacca

SEQ ID NO: 29851 - RNA, 62 nt, Human
aguggcucacaccuguaaucucagcacuuugggaggcugagguggaaggaucacuugaagcc

SEQ ID NO: 29852 - RNA, 62 nt, Human
gguggcucacaccuguaaucccagcacuuugggaggcugaggcggguggaucacgaggucag

SEQ ID NO: 29853 - RNA, 62 nt, Human
gguggcgagcgccuguagucccagcuacucgggaggcugaggcaggagaauggcaugaaccu

SEQ ID NO: 29854 - RNA, 62 nt, Human
acccucagagaacucugcauuuuaggguacuugaggcugacuuaacuaaaaguuuuaaagua

SEQ ID NO: 29855 - RNA, 62 nt, Human
agugguacaugccuguaaucccagcuacuugggaggcugaggugggaggaucacuugaacuc

SEQ ID NO: 29856 - RNA, 62 nt, Human
uguggaagaaugucuuauaaaaccugaauccugaggcugaugaauugugaaaauuccucaaa

SEQ ID NO: 29857 - RNA, 62 nt, Human
gagacaggcuggggauuccuuucccucacucugaggcugaccccucacuugacaacacacag

SEQ ID NO: 29858 - RNA, 62 nt, Human
ggugcaugccuguaaucccaucaucuacucaggaggcugaggcaggagaauugcuugaaccc

SEQ ID NO: 29859 - RNA, 62 nt, Human
gguggugcaugccuaugguuccagcuacucgggaggcugaagcgguagaaucacuugagcac

SEQ ID NO: 29860 - RNA, 62 nt, Human
ucaacaaaggaguguguucagaaaaggagagagaggcugagaucauucaggaguuuguuggg

SEQ ID NO: 29861 - RNA, 62 nt, Human
cauugugaggcaggucccaaaagggaaggcuggaggcugaggcuguuuucuuuucuuuguuc

SEQ ID NO: 29862 - RNA, 62 nt, Human
agaggcagugagggagguggacggugccagcugaggcugaggcaugcagcagcccccagcua

SEQ ID NO: 29863 - RNA, 62 nt, Human
gacggacuugcuugccucuccuacagcauggagaggcugaccccauggcucugccaccguug

SEQ ID NO: 29864 - RNA, 62 nt, Human
accuuucugaacauguacaccacccaaugcuagaggcugacuuggaaaccggugggugcaau

SEQ ID NO: 29865 - RNA, 62 nt, Human
ggggcccagcgcccagcaggacacccaugcaagaggcugagccccccaacauccaaggacag

SEQ ID NO: 29866 - RNA, 62 nt, Human
aagguuuuuugcuuuucuccugugcaccuggcgaggcugaaggcgagggguggaggaggccc

SEQ ID NO: 29867 - RNA, 62 nt, Human
gguggcgggcgccuguaaucccagcuacuugggaggcugaggcaggagaaucacuugaacgu

SEQ ID NO: 29868 - RNA, 62 nt, Human
gcucuggucucugggcauucauuucccucauagaggcugagaauaaaacaaggacuuauuca

SEQ ID NO: 29869 - RNA, 62 nt, Human
cacugugggaggccaagccaggcaaaucgcuugaggcugaggaguucaagaccagccuggcc

SEQ ID NO: 29870 - RNA, 62 nt, Human
guuggugucugccuguggucccagcuacucgggaggcugaggcacaagaaucacuugaaccc

SEQ ID NO: 29871 - RNA, 62 nt, Human
cauggggcaugccuguagucccaccuacuugggaggcugaagcaggagaauugcucgaaccu

SEQ ID NO: 29872 - RNA, 62 nt, Human
gauggcgggugccucuaaucccagcuacuggggaggcugaggugggagaaucgcuugaacuc

SEQ ID NO: 29873 - RNA, 62 nt, Human
gguuuuccacuccuucuagauauucccaaaaagaggcugagacaggagguuauuuucaauuu

SEQ ID NO: 29874 - RNA, 62 nt, Human
aacggguagucugacacggugauuauccuuuugaggcugaauccguuauuaacuuguuauuu

SEQ ID NO: 29875 - RNA, 62 nt, Human
gguggcgggcaccuguagucccagcuacuugggaggcugaggcaggagaauggugugaaccc

SEQ ID NO: 29876 - RNA, 62 nt, Human
agagcccugcugaguuccugcuuucugaccuggaggcugagcaggccggaguggauggaugc

SEQ ID NO: 29877 - RNA, 62 nt, Human
cgugugugguacguguguguguguguggcuaugaggcugauuccuguuuggauuuuuguccu

SEQ ID NO: 29878 - RNA, 62 nt, Human
gguggcagucaccuguagucccagcuacuugggaggcugaggcaggagaaucgcuucaaccu

SEQ ID NO: 29879 - RNA, 62 nt, Human
gguggugcgcaccuguaguuccagcuacuugggaggcugaggcagaagaaucacuugaaccc

SEQ ID NO: 29880 - RNA, 62 nt, Human
agagugaugggaaagugacaugagaaggccuggaggcugauucugauauagacucaauaaag

SEQ ID NO: 29881 - RNA, 62 nt, Human
gguggcucacgccuguaaucccagcaccuugggaggcugaggcgggcagaucaugaggucag

SEQ ID NO: 29882 - RNA, 62 nt, Human
aguggcacaggccuuuaauuccagcuacuugggaggcugaggcaggagaauuacuugaaccc

SEQ ID NO: 29883 - RNA, 62 nt, Human
auguggugcccccuuuccuugucugaguggcugaggcugauaccccugaccuaucugcaguc

SEQ ID NO: 29884 - RNA, 62 nt, Human
aggaagggcagcuggcuggcagacaaggugaagaggcugaugcggccccggcgggagggggg

SEQ ID NO: 29885 - RNA, 62 nt, Human
uggguucuguggaggagaggcgggguaauggggaggcugagggcaccucuucacugccccuc

SEQ ID NO: 29886 - RNA, 62 nt, Human
aguggcucaugcuuguaaucacagcacuuuaggaggcugaggcaggaggacuguuugagccc

SEQ ID NO: 29887 - RNA, 62 nt, Human
aggaaguguugaagggagguggcaagaguguggaggcugacgugugagggaggacaggcggg

SEQ ID NO: 29888 - RNA, 62 nt, Human
gguggcucacgccuguaaucccagcacuuugggaggcugaggaggucggaucaugaggucaa

SEQ ID NO: 29889 - RNA, 62 nt, Human
aguggcucgugccuguaaucucagcuauuugggaggcugaggcaggagaaucacuugaaccu

SEQ ID NO: 29890 - RNA, 62 nt, Human
ugguggcacgcaccucuacucccagcuacuaggaggcugaggcaggagaaucguuugaaccc

SEQ ID NO: 29891 - RNA, 62 nt, Human
ggugguaugugccuguggucccagcuacuggggaggcugaggugggaggaucguuugagccu

SEQ ID NO: 29892 - RNA, 62 nt, Human
gguggugggugccuguaaucccagcuacucgggaggcugaggcaggagaaucgcuugaaccc

SEQ ID NO: 29893 - RNA, 62 nt, Human
uguggcaugcaccuguagucucaccuacuccagaggcugaggugggaggauggcuugcgcuc

SEQ ID NO: 29894 - RNA, 62 nt, Human
gguggcucacgucuguaaucccagcacuuugggaggcugaggcaggcagaucaccugauauc

SEQ ID NO: 29895 - RNA, 62 nt, Human
agcauaagucuacugggugccuuuacaugccagaggcugaugcugcacuguugaugucaugu

SEQ ID NO: 29896 - RNA, 62 nt, Human
gguggcucaugccuguaauccuagcacuuugggaggcugagguaggcagaucacuugagguc

SEQ ID NO: 29897 - RNA, 62 nt, Human
aguggugcgcaccuguagucucagauacuugggaggcugaggguggagaaucgcuugaaccu

SEQ ID NO: 29898 - RNA, 62 nt, Human
ggugaugcacaccuguaaucccagcuacucgggaggcugaggcacaagaaucgcuugaacac

SEQ ID NO: 29899 - RNA, 62 nt, Human
gguggcucacgccuguaaucccagcacuuugggaggcugaggcggguggaucaagaggucag

SEQ ID NO: 29900 - RNA, 62 nt, Human
gguggcacgcgccuguagucccagcuacucgggaggcugaggcaggaagaaucgcuugaacc

SEQ ID NO: 29901 - RNA, 62 nt, Human
uggcaguuugaccgaaccuguucacaaggguagaggcugauuucuaacgaaacuuguagaau

SEQ ID NO: 29902 - RNA, 62 nt, Human
gguggcgggcgccuguaguuccagcuacucgggaggcugaggcaagagaauggcaugaaccc

SEQ ID NO: 29903 - RNA, 62 nt, Human
gccaguggccacaggaaccccgggccugaguggaggcugagucugaaauaaacucugucguc

SEQ ID NO: 29904 - RNA, 62 nt, Human
caugggcccugagcguccugccccgaauucacgaggcugaggcauccgggagcuggcguaau

SEQ ID NO: 29905 - RNA, 62 nt, Human
gcgccuguaguccuguagucccagcuacucgggaggcugaggcaggagaauggugugaaccc

SEQ ID NO: 29906 - RNA, 62 nt, Human
gguggcaggugccuguaaucucagcuacucgggaggcugaggcagaauugcuugaacccagg

SEQ ID NO: 29907 - RNA, 62 nt, Human
ugcugccccugccuaccuccugccuguccccagaggcugaggagaggggguacugugcccac

SEQ ID NO: 29908 - RNA, 62 nt, Human
gguggcacacaccuguaaucccagcuaccggggaggcugaggcaggagaaucgcuagaaccu

SEQ ID NO: 29909 - RNA, 62 nt, Human
ggggguguggguaaagacagggaugaaggauagaggcugagagaagaaggaagaaucagccc

SEQ ID NO: 29910 - RNA, 62 nt, Human
acccauuuuguugcaguuccugugagacaggagaggcugagccaagggaacugugaagggga

SEQ ID NO: 29911 - RNA, 62 nt, Human
cucuccagcccccgauguggacccggggaggggaggcugaggcguuuggccccggccuggcc

SEQ ID NO: 29912 - RNA, 62 nt, Human
gguggcacgcgccuguaaucccagcuacccaggaggcugaggcaggagaaucgcuugaaccg

SEQ ID NO: 29913 - RNA, 62 nt, Human
ggugguggguaccuguagucccagcuacuccggaggcugaggcaggagaauggcgugaaccc

SEQ ID NO: 29914 - RNA, 62 nt, Human
gguggcucacgccuguaaucccagcacuuugggaggcugaggcgggcagaucacgaagucag

SEQ ID NO: 29915 - RNA, 62 nt, Human
aguaaugcgaaccuauaguagcagcuacuccagaggcugaaaugggaggaucucuugagccc

SEQ ID NO: 29916 - RNA, 62 nt, Human
gguggcgggcgccuguaaucccagcuacuugggaggcugaggcaggagaauuacuugaaccu

SEQ ID NO: 29917 - RNA, 62 nt, Human
gguggcucacaucuguaauaccagcgcuuugggaggcugaggcaggaggauugcuugaggcc

SEQ ID NO: 29918 - RNA, 62 nt, Human
gaggcugaggcaggagaauugcuugaaccuaggaggcugagauugcagugagccgaaaucac

SEQ ID NO: 29919 - RNA, 62 nt, Human
gguggugggcaccuguagucccagcuacucgggaggcugaggcaggagaauugcuugaaccu

SEQ ID NO: 29920 - RNA, 62 nt, Human
aguggcucacgccuguaaucccagcacuuugggaggcugaggcagguggaucacaaugucag

SEQ ID NO: 29921 - RNA, 62 nt, Human
aguggcucaugccuguaaucccagcacuuugagaggcugaggcagggcagauugcaugagcc

SEQ ID NO: 29922 - RNA, 62 nt, Human
gggaaagcugacaucugcagggaacccacuuugaggcugaggccauggcaggacagcugcug

SEQ ID NO: 29923 - RNA, 62 nt, Human
acuaaaaggcaguauauuacagaaacucuguagaggcugaacuguugauguucagguggacu

SEQ ID NO: 29924 - RNA, 62 nt, Human
gguggcauuugccuguaaucccagcuacucgggaggcugaggcaggagaaucacuugaaccu

SEQ ID NO: 29925 - RNA, 62 nt, Human
gguggcacacaccuguagucccagcuacucaggaggcugaggcaggagaauugcuugaaccu

SEQ ID NO: 29926 - RNA, 62 nt, Human
agugacgcaugcccucaaucccagcuacucaagaggcugaggcaggagaaucacuugcacuc

SEQ ID NO: 29927 - RNA, 62 nt, Human
aguggcucacgccuguaaucccagcccuuugggaggcugaggcgggcagaucaccagagguc

SEQ ID NO: 29928 - RNA, 62 nt, Human
ucuaggguugcuggagccugagucagggcccagaggcugaguuuucucuuuguggggcuugg

SEQ ID NO: 29929 - RNA, 62 nt, Human
ccuagccaagaucauaugaagaguuuggcacggaggcugagaaugaccuggcauagaugguu

SEQ ID NO: 29930 - RNA, 62 nt, Human
gguggcgugugccuguaaucccagcuauuugggaggcugaggcaggagaaucgcuugagccc

SEQ ID NO: 29931 - RNA, 62 nt, Human
agcucaugcucucacuccuagaaggagggugugaggcugacaaccaggucauccaggagggc

SEQ ID NO: 29932 - RNA, 62 nt, Human
ucucuguugccaguuaaagguuccuuggagaugaggcugaauaauuaugaaccucaccuucu

SEQ ID NO: 29933 - RNA, 62 nt, Human
uaaggauaauccauuuggaagaagaaaagagugaggcugaaaguaaagccacaugacaagca

SEQ ID NO: 29934 - RNA, 62 nt, Human
uggcugcauccagaaagugagagcuaaauggagaggcugaacaaaggacgcauguggagcgc

SEQ ID NO: 29935 - RNA, 62 nt, Human
cugugccucccugaacagaaauggcaggggaggaggcugaugcuuuaaaugaagaggauggu

SEQ ID NO: 29936 - RNA, 62 nt, Human
uuauauaugagaguucauugaagaaguccagugaggcugaaguaaaggggcaagauagggca

SEQ ID NO: 29937 - RNA, 62 nt, Human
gguggcacgcgccuguaaucccagcuacucgggaggcugaggcagaaggauuguuugaaccc

SEQ ID NO: 29938 - RNA, 62 nt, Human
aaggcagcuuuauuaauuaauucucuuacccugaggcugagggcgaacaguagguagcaagg

SEQ ID NO: 29939 - RNA, 62 nt, Human
ggugguggacaccuguagucccagcuacuugggaggcugaggcaggagacuagcuggaacca

SEQ ID NO: 29940 - RNA, 62 nt, Human
gguggcaggcaccuguagucccagcuacuugggaggcugaggcaggagaaucaccugaaccu

SEQ ID NO: 29941 - RNA, 62 nt, Human
uguggcucaugccuguaaucccagcacuuugggaggcugaggcggguggaucacuaggucag

SEQ ID NO: 29942 - RNA, 62 nt, Human
gguggcgugugccuguaaucucagcuacucaggaggcugaggcaggagaaucgcuugaaccc

SEQ ID NO: 29943 - RNA, 62 nt, Human
aucucaaaguguggccaacucccauuuacuuagaggcugauuaucuaguuuuguaguuccuc

SEQ ID NO: 29944 - RNA, 62 nt, Human
ucccuccuaccucacccgcagggggaaggagggaggcugacaagccuugaauaaaacacaag

SEQ ID NO: 29945 - RNA, 62 nt, Human
gguggcucaugccuguaaucucagcacuuugggaggcugaggcagaaggauuaccugaggca

SEQ ID NO: 29946 - RNA, 62 nt, Human
gcucaugccuguaaucccagccagcacuuugggaggcugagaugggaagaucacuugagccc

SEQ ID NO: 29947 - RNA, 62 nt, Human
gguggugggcaccuguagucccagcuacucaggaggcugaggcaggagaauggcgugaaccc

SEQ ID NO: 29948 - RNA, 62 nt, Human
gguggcgcaugccuguaaucccagcuacucgggaggcugaggcaggagaaucacuugaaccc

SEQ ID NO: 29949 - RNA, 62 nt, Human
gguggugcgugccuguauucccagccacucaggaggcugaggcaggagaaucgcuggaaccu

SEQ ID NO: 29950 - RNA, 62 nt, Human
accugguucagcauguaauccgagcacuuugggaggcugaggcaggcggaucacuugagguc

SEQ ID NO: 29951 - RNA, 62 nt, Human
aaaauacaaaaauaagccaggcgugguggcgggaggcugaggcaaggagaaucacuugaaua

SEQ ID NO: 29952 - RNA, 62 nt, Human
gugauaucugucuacaguauuggcucuucugcgaggcugauacacaaggccucucuuccaca

SEQ ID NO: 29953 - RNA, 62 nt, Human
uucuaauuggggccaguguaaggucgaucccagaggcugaucugcaaaucaagcuacaugua

SEQ ID NO: 29954 - RNA, 62 nt, Human
gguggcaugcaccugcaaucccagcuacucgggaggcugaggcacaagaaucacuugaaccc

SEQ ID NO: 29955 - RNA, 62 nt, Human
gacauugugucaguuucagauccugaucuuaagaggcugacagcuucuacuugcugucccuu

SEQ ID NO: 29956 - RNA, 62 nt, Human
auggugcgggcaccuguaguccuagcuaucaagaggcugagacaggagaaacacuugaaccu

SEQ ID NO: 29957 - RNA, 62 nt, Human
gguggcgugcgccugcagucccagcuacuugggaggcugaguugggaggaucacuugagccu

SEQ ID NO: 29958 - RNA, 62 nt, Human
gguggcuccugccuauaaucccagcacuuugggaggcugaggcaggaggaucacuugagccc

SEQ ID NO: 29959 - RNA, 62 nt, Human
aauggcucaugccuguaaucccagcacuuugggaggcugagguggguggaucacuugagguc

SEQ ID NO: 29960 - RNA, 62 nt, Human
uauuccuucuucccucgguccacgaacaggaagaggcugaggccaugcugggcagggucugg

SEQ ID NO: 29961 - RNA, 62 nt, Human
ucccgcuuagcgacccgccgccgccgccaagcgaggcugaggacuccgaucgcgaugucuca

SEQ ID NO: 29962 - RNA, 62 nt, Human
accguguaaaugagcuccaggaggaagcccaggaggcugaugccugccaggaggagcuggca

SEQ ID NO: 29963 - RNA, 62 nt, Human
uucggcggcuggacacagaccuggcccguuuugaggcugaucucaaggagaaacagauugag

SEQ ID NO: 29964 - RNA, 62 nt, Human
cccgggcccucagccucucuuguacaggcugagaggcugagaaaucauccccugaauaacuu

SEQ ID NO: 29965 - RNA, 62 nt, Human
cugcuggccuagaccagcugcugaaagcuggugaggcugagccccuaccccaacccaagcuc

SEQ ID NO: 29966 - RNA, 62 nt, Human
aaugaugcacacuuauacccccagccacucaggaggcugaugcaagaggaucgcuugagccc

SEQ ID NO: 29967 - RNA, 62 nt, Human
ggugacacgugccuguagucccagcuacucgggaggcugaggcaggagaaucacuugaaccu

SEQ ID NO: 29968 - RNA, 62 nt, Human
gguagcaggcaccuguaaucccagcuacuugggaggcugaggcaggagaaucgcuugaaccc

SEQ ID NO: 29969 - RNA, 62 nt, Human
gguggcacgugccuguaaucccagcuacucgggaggcugaggcaggagaaucaauugaaccu

SEQ ID NO: 29970 - RNA, 62 nt, Human
ugguggcagggccuguaauuccagcuacucaggaggcugaagcaggagaaucguuuaaacac

SEQ ID NO: 29971 - RNA, 62 nt, Human
uuagccgggcgugguggcgggugccuguacaggaggcugaggcaggagaauggcgugaaccc

SEQ ID NO: 29972 - RNA, 62 nt, Human
uuuaagaaguaauacuuauuggcugaaaaacggaggcugagccauuguggcuaccauuuuac

SEQ ID NO: 29973 - RNA, 62 nt, Human
gguggcgcaagccuguaaucccagcuacucaggaggcugaggcagaagaauugaacccagga

SEQ ID NO: 29974 - RNA, 62 nt, Human
gguggcaugcgccuguaaucccagcuacucaggaggcugagacagaagaaucgcuugaaccu

SEQ ID NO: 29975 - RNA, 62 nt, Human
gguggcucacgucuguaaucccaggacuuugggaggcugaggcagguggaucaccugagguc

SEQ ID NO: 29976 - RNA, 62 nt, Human
cagcacuugaacugucugggguuugauggacagaggcugaggaauuuccuggcuuccccaga

SEQ ID NO: 29977 - RNA, 62 nt, Human
ggaggauagggcuggccuuugugaagccagcagaggcugagaaccucaggcuucccuagauc

SEQ ID NO: 29978 - RNA, 62 nt, Human
gauggcacgcaccugcagucccagcuacuugggaggcugaggcaggagaaucacucgaaccc

SEQ ID NO: 29979 - RNA, 62 nt, Human
uauuaauuucuugccuccaguguucuaucucugaggcugagcauuauaagaaaaugaccucu

SEQ ID NO: 29980 - RNA, 62 nt, Human
ugacuugggggugaccuuuugaccaccgagaggaggcugaauuucucaagccauuaggagag

SEQ ID NO: 29981 - RNA, 62 nt, Human
gaggugcgguggcuauaauccuagcacuuugggaggcugaagcaggaggaucacuugagccc

SEQ ID NO: 29982 - RNA, 62 nt, Human
aaaucaggugggugggaaucucuuggagaacugaggcugaggguagagggaguaugcccaag

SEQ ID NO: 29983 - RNA, 62 nt, Human
aguuaugcacgcuuguagucccaacuaccugggaggcugaggcgggagaaucaccugagccu

SEQ ID NO: 29984 - RNA, 62 nt, Human
gguggcucacgccuguaaucccagcacugugagaggcugaggcgggaugaucaccugagguc

SEQ ID NO: 29985 - RNA, 62 nt, Human
gguggcaggcaccuguaaucccagcuacuugggaggcugaggcaggagaaaucgccugaacc

SEQ ID NO: 29986 - RNA, 62 nt, Human
gguggcucaugccuguaaucccagcacuuugggaggcugaggcaggcggaucacuugagguc

SEQ ID NO: 29987 - RNA, 62 nt, Human
gguggugcaugccuguaaucccagcuacuggggaggcugaggcaggagaaucgcuugaaccu

SEQ ID NO: 29988 - RNA, 62 nt, Human
gguggcgggcaccuguaaucgcagccuuucaggaggcugagacaggagaaucgcuugaaccc

SEQ ID NO: 29989 - RNA, 62 nt, Human
gguggcgggcgccuguagucccagcuacucaggaggcugaggcaggagaauggcgugaaccu

SEQ ID NO: 29990 - RNA, 62 nt, Human
gguggugggugccuguagucccagcuacucaggaggcugaggcaggagaauggugugaaccc

SEQ ID NO: 29991 - RNA, 62 nt, Human
ugauggcucaugcuuguaaucugaacauuugggaggcugaggcaggaagaucgcuugagguc

SEQ ID NO: 29992 - RNA, 62 nt, Human
gguagcgcacgccuguaaucccaucuucuugggaggcugaggcaggagaaucgcuagaaacu

SEQ ID NO: 29993 - RNA, 62 nt, Human
gguggcgcacgccuguaguuccagcuacucaggaggcugaggcaggagaaucgcuugaaccc

SEQ ID NO: 29994 - RNA, 62 nt, Human
cguggcucacgccuguaaucccagcacuuugggaggcugaggcggguggaucaccugagguc

SEQ ID NO: 29995 - RNA, 62 nt, Human
cagacccuaauaaagagaacaggguaagaugugaggcugaguguguuuaaguacgugagaga

SEQ ID NO: 29996 - RNA, 62 nt, Human
gacggcacaugccuguaaucccagcacuuugggaggcugaggugggaggacugcuugagccc

SEQ ID NO: 29997 - RNA, 62 nt, Human
gccugaccuuccugaggccaugugcgguuucugaggcugacaugucaguaacugacuggggu

SEQ ID NO: 29998 - RNA, 62 nt, Human
ugguggugcaugccuguaauccagcuacuugggaggcugaggcaggaaaauggcuugaaccc

SEQ ID NO: 29999 - RNA, 62 nt, Human
aggacagggcucuaugugcggccaggacagcagaggcugaggggccgggguguggcugagug

SEQ ID NO: 30000 - RNA, 62 nt, Human
gauggcucacgccuguaaucccagcacuuugggaggcugaggcgggcagaucacuugaggcc

SEQ ID NO: 30001 - RNA, 62 nt, Human
caguggugaggccuguaaucccagcuacucaggaggcugaggcaggagaaucgcuugcaccc

SEQ ID NO: 30002 - RNA, 62 nt, Human
aguggcggguaccuauaaucccagcuacucgggaggcugaggcacgagaaucacuugaagcc

SEQ ID NO: 30003 - RNA, 62 nt, Human
aaaaaucuuuuuuuuuuuuuuuggucaagcuugaggcugaauaaagccuuugaugcacaaaa

SEQ ID NO: 30004 - RNA, 62 nt, Human
gguggcacgugccuguaaucccagcuacucaggaggcugaggcaggagaaucgcuugaaccc

SEQ ID NO: 30005 - RNA, 62 nt, Human
cagagccagaagccagagggccagggauaugagaggcugacaaacaucaggggacaucuggg

SEQ ID NO: 30006 - RNA, 62 nt, Human
gaauauucccagcccagugaugauuugguucugaggcugaugugagaaagcugauguaaaaa

SEQ ID NO: 30007 - RNA, 62 nt, Human
uaauaacuagucugacaucagaaaauaaaauugaggcugauuuuuaaaaauuucuaguagau

SEQ ID NO: 30008 - RNA, 62 nt, Human
gguggcaugugccuguagucccagcuacuugggaggcugaggcaggagaaucgcuugagccc

SEQ ID NO: 30009 - RNA, 62 nt, Human
gguggcucacaccuauaauccuagcacuuggggaggcugaggcagacggauuaccugagguc

SEQ ID NO: 30010 - RNA, 62 nt, Human
aguggcgugcaccuguaaucccagcuacucuggaggcugaggcaggagaaucaccugaaccu

SEQ ID NO: 30011 - RNA, 62 nt, Human
aaaugggagguguucuccuuuauauuguguuagaggcugaggauauagaaauauguaacuca

SEQ ID NO: 30012 - RNA, 62 nt, Human
aguggugggcaccuguaguccuagcuacucgagaggcugaggcaggagaauggcgugaaccc

SEQ ID NO: 30013 - RNA, 62 nt, Human
cacacguaggacgcaugaaggucacucguggugaggcugacaugcucacacauuacaacagu

SEQ ID NO: 30014 - RNA, 62 nt, Human
uuaauauugcacacccaaaccagucuaucagggaggcugaagcaagggcgcagugugauauu

SEQ ID NO: 30015 - RNA, 62 nt, Human
gguggcaugcgccuguaaucccagcuacccaggaggcugaggcaggagaauugcugaaaccc

SEQ ID NO: 30016 - RNA, 62 nt, Human
uguggcacacaacuguggucccagcuacaggggaggcugagacgcaaggaucacuugagccc

SEQ ID NO: 30017 - RNA, 62 nt, Human
ggaggcucgugcauguaauccuagcacuuugggaggcugagaugggaggaucacuugaggcc

SEQ ID NO: 30018 - RNA, 62 nt, Human
ccacauuuuacaggcaaggaaacaggcuccaagaggcugaggacuuugcccaggaugacaua

SEQ ID NO: 30019 - RNA, 62 nt, Human
ugugguggcaagugccuuuaaucccaccucaggaggcugaggcaggagaaucgcuugaaccu

SEQ ID NO: 30020 - RNA, 62 nt, Human
aacggcggaugccuguaaucccagcuacuugggaggcugaggcaggagaaucgcuugaaccu

SEQ ID NO: 30021 - RNA, 62 nt, Human
ggugguguucaccuuuaaucccagcuacuugggaggcugaggugggaggauaacuugagcac

SEQ ID NO: 30022 - RNA, 62 nt, Human
cugacauugaugccugggggaccuuuugccucgaggcugagcuggaaaaucuugaaaauauu

SEQ ID NO: 30023 - RNA, 62 nt, Human
uggcucacgcuuauguagucccaguuacucgggaggcugaggcacgagaaucacuugaaccu

SEQ ID NO: 30024 - RNA, 62 nt, Human
gguggcacaugccuguaaucccagcuacucaggaggcugaggcaggagauucgcuugaacuc

SEQ ID NO: 30025 - RNA, 62 nt, Human
cuuggggcuguuccugguucagccucugcugggaggcugaagcugacacucuggugagcuga

SEQ ID NO: 30026 - RNA, 62 nt, Human
aagcuccuucucccacacugcaccuacuccuugaggcugaacuggucacagacaaacuggga

SEQ ID NO: 30027 - RNA, 62 nt, Human
gguggcucacgccuguaaucccagcacuuugggaggcugaggcgggcagaucacaagaucag

SEQ ID NO: 30028 - RNA, 62 nt, Human
gguggggugcgcuuguaaucccagcuacucaggaggcugaggcaggagaaucgcuuaaacuc

SEQ ID NO: 30029 - RNA, 62 nt, Human
gguggcgggugccuguaaucucagcuacuugagaggcugaggcaggagaaucgcuugaacuu

SEQ ID NO: 30030 - RNA, 62 nt, Human
ggugacgcaugccuguaguccuagcuacucaggaggcugaggugggaggaucaccuaaggcc

SEQ ID NO: 30031 - RNA, 62 nt, Human
gguggugugugccuauagucccaacuacuagggaggcugaggugggaggaucacuugagccu

SEQ ID NO: 30032 - RNA, 62 nt, Human
ggugguaugcaccugcagucccagcaacaugggaggcugaacaggagaaucgcuugaacccg

SEQ ID NO: 30033 - RNA, 62 nt, Human
cccgccacccacuguggcagcuugaauuucuugaggcugagacaaacuaggauccaguagcc

SEQ ID NO: 30034 - RNA, 62 nt, Human
gguggcacacgccuguaaucccagcuacucaggaggcugaggcuggagaaucauuugaaccu

SEQ ID NO: 30035 - RNA, 62 nt, Human
gaauacuguuaucuaugugacggggcagucgugaggcugagaugagaaugcggauuaaaaug

SEQ ID NO: 30036 - RNA, 62 nt, Human
gugcuuuagacccuguuuguuuucuucugcaugaggcugauuuccaguuugucaucaaccuc

SEQ ID NO: 30037 - RNA, 62 nt, Human
cguaguuucuacacguggcaggccaagaaugggaggcugacucaaaacuagauagaaaaaua

SEQ ID NO: 30038 - RNA, 62 nt, Human
gggagaauucauuucuggccuuuucauuuuuagaggcugaccguaauucuugacuucaggcu

SEQ ID NO: 30039 - RNA, 62 nt, Human
gguggugcacaccuguaaucccagcuacucuggaggcugaggcaaaagaaucgcuugaaccc

SEQ ID NO: 30040 - RNA, 62 nt, Human
gauggugugugccucuagucccagcuacuugggaggcugaggucagaggauggcuugagccc

SEQ ID NO: 30041 - RNA, 62 nt, Human
aguggcucacgccuguaaucccagcacuuugggaggcugaggugggcagaucacaaggucag

SEQ ID NO: 30042 - RNA, 62 nt, Human
gguggcgggcgcccauagucccagcuacucgggaggcugagacaggagacuugcuugaaccc

SEQ ID NO: 30043 - RNA, 62 nt, Human
agguggaggcauccagugauuucuacccuguggaggcugaggggucgggggaagaaaacaga

SEQ ID NO: 30044 - RNA, 62 nt, Human
cacgcagagcaggagaagaaggcugcagcgcugaggcugaaggagaaagaggccgcugcugc

SEQ ID NO: 30045 - RNA, 62 nt, Human
uaugaauggaaucauacagaauguaaucuuacgaggcugaucuuuuuucauucagcauaauu

SEQ ID NO: 30046 - RNA, 62 nt, Human
gguggcucacaccuguaauccuagcacuuugggaggcugaggcagguggcucacuugagguc

SEQ ID NO: 30047 - RNA, 62 nt, Human
cuugggggaagccugcccaugucgggcugugggaggcugaucggugcaugugagaguggcuu

SEQ ID NO: 30048 - RNA, 62 nt, Human
ugcauaggggugggaauuaaucaaaaaccucagaggcugaaauuccuaauaccuuuccuuua

SEQ ID NO: 30049 - RNA, 62 nt, Human
aguggugggugccuguaaucccagcuacuugggaggcugagacaggagaaucacuugaaccc

SEQ ID NO: 30050 - RNA, 62 nt, Human
gaaggccagauguguagcuucggguaucagaggaggcugaccuggcccccaucccaaguuac

SEQ ID NO: 30051 - RNA, 62 nt, Human
gguggcaugugccuguaaucccagcuacucaggaggcugagacaggagaauugcuugaaccu

SEQ ID NO: 30052 - RNA, 62 nt, Human
gguggugggcgccuauaaucccagcuauucuggaggcugaggcaggaaucgcuugaaauugg

SEQ ID NO: 30053 - RNA, 62 nt, Human
ggugucgggcgacuguagucccagcuacucgcgaggcugaggcaggagaauggcgugaaucc

SEQ ID NO: 30054 - RNA, 62 nt, Human
gggggcgugcgccuguagucccagcuacuugggaggcugaggcaggagaauugcuugaaccc

SEQ ID NO: 30055 - RNA, 62 nt, Human
gauggcucacaccuguaaucccagugcuuugggaggcugaggugggaagauucuuugagccc

SEQ ID NO: 30056 - RNA, 62 nt, Human
aucugagaugaggccucguccuccuggaagcugaggcugagaaggguggagcuuggcccugg

SEQ ID NO: 30057 - RNA, 62 nt, Human
aguggcucaugccuguaaucccagcacuuugggaggcugaagugggaggacugcuugggccc

SEQ ID NO: 30058 - RNA, 62 nt, Human
aaaauucagccucccaggucccuccccucggagaggcugauucacugggucugggaaggagc

SEQ ID NO: 30059 - RNA, 62 nt, Human
gguggcgcgcgccuguaaucccaguuacuuaggaggcugaggcaggagaaucacaucaaccu

SEQ ID NO: 30060 - RNA, 62 nt, Human
gguagugcacgccuguaaucccagcuacucaggaggcugaggcacgagacuugcuugaaccc

SEQ ID NO: 30061 - RNA, 62 nt, Human
aaugggggccuuugucaaacacuguugaaggagaggcugaugugucugugauggugagaauu

SEQ ID NO: 30062 - RNA, 62 nt, Human
gcccuccccuccccucugccuguccggaacgggaggcugaaauggaaaagcugccuuggccc

SEQ ID NO: 30063 - RNA, 62 nt, Human
ggugguaugugccuguagucucagcuacucaggaggcugagacaggagaaucacuugaaccc

SEQ ID NO: 30064 - RNA, 62 nt, Human
cguggugggcgccuguaaucccagcugcucaggaggcugaggcaggagaaucgcuugaaccc

SEQ ID NO: 30065 - RNA, 62 nt, Human
gguggcucacgccuguaaucccagcacuuugggaggcugaggcaggcagaucaccugaggcu

SEQ ID NO: 30066 - RNA, 62 nt, Human
guggcgggcgccuguagucccagcuacucggagaggcugaggcaggagaauggcgugaaccc

SEQ ID NO: 30067 - RNA, 54 nt, Human
cuagcaagcuggcuggcugauuaagaggcugaacugcaugaaucugcuaaaucu

SEQ ID NO: 30068 - RNA, 62 nt, Human
ggcccuccgagguggagcagcagcuacaagcagaggcugaacaccugcggaaggagcuggag

SEQ ID NO: 30069 - RNA, 62 nt, Human
ggcccuccgagguggaacagcagcuacaagcagaggcugaacaccugcggaaggagcuggag

SEQ ID NO: 30070 - RNA, 62 nt, Human
ugcugcucagcacagcccuggauugcagccccgaggcugagaccagacaaagcccgggaggc

SEQ ID NO: 30071 - RNA, 62 nt, Human
gguggcaugcucccguagucccagcuacucgggaggcugaggcaggagaaucacuugagccu

SEQ ID NO: 30072 - RNA, 62 nt, Human
gguggcaagcgccuguagucccagcuacucuggaggcugaggcaggagaauggcgugaaccc

SEQ ID NO: 30073 - RNA, 62 nt, Human
gguggugcacaccuguagucccagcuacuggggaggcugaggcaggagaaugguguaaaacc

SEQ ID NO: 30074 - RNA, 62 nt, Human
gguggcaggugccuguagucccagguacucgggaggcugagacaggagaaucgcuugaaccu

SEQ ID NO: 30075 - RNA, 62 nt, Human
gguggcucaugccuguaaucccagcacuuugggaggcugagggagguagaucaccugagguc

SEQ ID NO: 30076 - RNA, 62 nt, Human
cccagccaagagcccaugaauggaggcugcaggaggcugaguccggcugccaugcacgucuc

SEQ ID NO: 30077 - RNA, 62 nt, Human
ccuugggcaagagcugucuguccucccugcaggaggcugaguguaaagaguaucauucauug

SEQ ID NO: 30078 - RNA, 62 nt, Human
gguggugcaugccuguagucccagcuacucgggaggcugagugaggcaggaggaucacuuga

SEQ ID NO: 30079 - RNA, 62 nt, Human
gguggcgggcgccuguagucccagcuacucuggaggcugaggcaggagaaucaauugaaccc

SEQ ID NO: 30080 - RNA, 62 nt, Human
ggaggggcaugccuguggucucagcuauucaggaggcugaggcaggagaaucacuugagacc

SEQ ID NO: 30081 - RNA, 62 nt, Human
cugagcucaaagccaagcagaggccggcaguggaggcugagcagggacucuccaggcuucuc

SEQ ID NO: 30082 - RNA, 62 nt, Human
gucaaggaagugagaugccaauuuggggucuugaggcugaccaguuggggugcuugggugau

SEQ ID NO: 30083 - RNA, 62 nt, Human
gguggcacaugccuguaauaucagcuacucaggaggcugaggcaggagaauugcuugaaccc

SEQ ID NO: 30084 - RNA, 62 nt, Human
gguggugcaugccuguaguuccagcuacuugggaggcugagacaggcgaauugcuugaaccu

SEQ ID NO: 30085 - RNA, 51 nt, Human
cuggaccccaggccagcuaaugaggcugacuggauguccagagcuggccag

SEQ ID NO: 30086 - RNA, 62 nt, Human
gguggcgcacaccuguagucccagcuacucuggaggcugaggcaggggaaucgcuuaaaccc

SEQ ID NO: 30087 - RNA, 62 nt, Human
gauggcucacaccuguaaucccagcacuuugggaggcugaggcgggaagaucacuugaguuc

SEQ ID NO: 30088 - RNA, 62 nt, Human
gguggcacgcgccuguaaucccagcuacuuaggaggcugaggcaggagaaucgcuugaaccc

SEQ ID NO: 30089 - RNA, 62 nt, Human
gugaaggauccucccugagacuggcaagggaggaggcugagcagaaggagucaucauggagg

SEQ ID NO: 30090 - RNA, 62 nt, Human
aguagcucacaccugaaaucuuagcacuucgggaggcugaggcagguggaucacuugagguu

SEQ ID NO: 30091 - RNA, 62 nt, Human
gauggugcaugccuuuaaacccagcuacugaggaggcugaggcaugagaauugcuugaacca

SEQ ID NO: 30092 - RNA, 62 nt, Human
caugguggcacccgccuguaguccagcuacuugaggcugagaugggaggaugagggaggucg

SEQ ID NO: 30093 - RNA, 62 nt, Human
ccuccuggacuccugcacacgcuccuuccucugaggcugaaauucagaauauuagugaccuc

SEQ ID NO: 30094 - RNA, 62 nt, Human
ugggguggugagaugaugauuagaucaggggugaggcugagagacucuggguuuagggcuag

SEQ ID NO: 30095 - RNA, 62 nt, Human
guggacgggggaaggguuguggcggguguucugaggcugagaggacaccuauaugcguauuu

SEQ ID NO: 30096 - RNA, 62 nt, Human
gguggugcaugccuguaaucccagcuacucgggaggcugaggcaggaaaaucacuugaaccc

SEQ ID NO: 30097 - RNA, 62 nt, Human
gguggugcccaccugugaucccagcuacucaggaggcugaggcaggagaauuacuugaaccu

SEQ ID NO: 30098 - RNA, 62 nt, Human
ggugacacauggcugugguccuaguuacuugggaggcugaggcaggagaauggcuugaacug

SEQ ID NO: 30099 - RNA, 62 nt, Human
ucugccugccucccuagcaggcgccagcgguggaggcugagucgcaggacacaugccggcca

SEQ ID NO: 30100 - RNA, 62 nt, Human
gaagaaacgauagaugugcagguugugcggaagaggcugaguggaaaauggugugagcccca

SEQ ID NO: 30101 - RNA, 62 nt, Human
gguggcucaugccuauaaucccagcacguugggaggcugaggcgggcggaucgguugagcuc

SEQ ID NO: 30102 - RNA, 62 nt, Human
gguggcgcacgccuguagucccagcuacucgggaggcugagguaggaggaucgcuugagccu

SEQ ID NO: 30103 - RNA, 62 nt, Human
ggcggcucacaccuguaaccccagcacuuugggaggcugagguggguggaucacuugagguc

SEQ ID NO: 30104 - RNA, 62 nt, Human
gguggcgggcgccuguaaucccagcuacuugggaggcugaggcaggagaaucgcuugaaucu

SEQ ID NO: 30105 - RNA, 62 nt, Human
uguggcaggcacuuuuaaucccagcuacucgggaggcugaggcaggagaauugcuugaaccu

SEQ ID NO: 30106 - RNA, 62 nt, Human
cucugaauguggaggcgccagaagcuacugaggaggcugaagguagugagggcaagugggcu

SEQ ID NO: 30107 - RNA, 62 nt, Human
gguggugggcaccugucgucccagcuacuagggaggcugaggcaggagaauggugugaaccc

SEQ ID NO: 30108 - RNA, 62 nt, Human
auguaaaacgguuuucuuguggggagguuacagaggcugacuucagaguggacuuguguuuu

SEQ ID NO: 30109 - RNA, 62 nt, Human
uaccccgagacuaccaggagagcccugggcuggaggcugagcugcaucccugcuccccacau

SEQ ID NO: 30110 - RNA, 62 nt, Human
aguggcaggaaccuguaaucccagcuacaggggaggcugaggcaggagaaucgcuugaaccc

SEQ ID NO: 30111 - RNA, 62 nt, Human
gcgucuccccaccccagggcuccccccgugcugaggcugagcccucuuggcccugaggccug

SEQ ID NO: 30112 - RNA, 62 nt, Human
ucucgcuucuguggcacaggggcacacggucagaggcugaaaaggggcacugcacgagcacc

SEQ ID NO: 30113 - RNA, 62 nt, Human
ggugguggacaccuguaaucccagcuacuagggaggcugaggcaggagaauugcuugaaccu

SEQ ID NO: 30114 - RNA, 62 nt, Human
ggugguacacaccuguggucccagcuacuagggaggcugagccaggaagaacgcuccagccc

SEQ ID NO: 30115 - RNA, 62 nt, Human
gguggcgggcgccuguagucccagcuacucgggaggcugaggcaggagaauggcgugaaccc

SEQ ID NO: 30116 - RNA, 62 nt, Human
aguggcucaugccuguaaucccagcauuuugggaggcugaggcagguggaucaccugagguc

SEQ ID NO: 30117 - RNA, 62 nt, Human
gucucggccuucuuugugcuucucugagcuaugaggcugagaagaucuucaaguggauuuuu

SEQ ID NO: 30118 - RNA, 62 nt, Human
aguggcucacgccuauaaucccagcauuuugggaggcugagugggaugaccgcuugagccca

SEQ ID NO: 30119 - RNA, 62 nt, Human
gguggcgcacgccuguagucccagcugcuugggaggcugaggugggagaaucacuugagccc

SEQ ID NO: 30120 - RNA, 62 nt, Human
aguggcucacaccuguaaucccagcauuuugggaggcugagugagaggaucacuugagcuca

SEQ ID NO: 30121 - RNA, 62 nt, Human
cgguaggucaugucuguaaucccagcaauuuggaggcugaggugggaggaucauuugagccc

SEQ ID NO: 30122 - RNA, 62 nt, Human
gucuuggccuucuuugugcuucucugagcuaugaggcugagaagaucuucaaguggauuuuu

SEQ ID NO: 30123 - RNA, 62 nt, Human
gguggcaaacgccuguaaucccaacuacuugggaggcugaggcaggagaaucucuugaaccc

SEQ ID NO: 30124 - RNA, 62 nt, Human
gguggcucacgcauguaaucccagcacucugggaggcugaggcgggcagaucaccugaggcc

SEQ ID NO: 30125 - RNA, 62 nt, Human
aguggugugcaccuguagucccagcucuucaggaggcugagaaaagagaauuguuugaaccu

SEQ ID NO: 30126 - RNA, 62 nt, Human
cuacuuaggaggcugaggggcaaggauugcuugaggcugagagauugagccugcagugagcu

SEQ ID NO: 30127 - RNA, 62 nt, Human
aauuagcuggacguguagucccagcuacuuaggaggcugaggggcaaggauugcuugaggcu

SEQ ID NO: 30128 - RNA, 62 nt, Human
gguggaaugugccuguaaucccaccuacucgagaggcugaggcagcagaauugcuugaaccc

SEQ ID NO: 30129 - RNA, 62 nt, Human
gguggugcaugcauguaguuccagcuacucaggaggcugaggcuagaggauccuugagccca

SEQ ID NO: 30130 - RNA, 62 nt, Human
gguggcucacgcuuguaaucgcagcacuuugggaggcugaggcaggaggaucacuugagccc

SEQ ID NO: 30131 - RNA, 62 nt, Human
guccggaucuugucuccuaguccugaggagcggaggcugagaacucagugcugguuuguaaa

SEQ ID NO: 30132 - RNA, 62 nt, Human
gagagggcgaaggcaggaaggggagugagaaagaggcugaaauuaagagggcgagaaagcag

SEQ ID NO: 30133 - RNA, 62 nt, Human
gcagcuugcacaguugcuuuacagacuuccaagaggcugauucuggcuucaagauggagccu

SEQ ID NO: 30134 - RNA, 62 nt, Human
ugccuccagaaucacagcccuucuccccaagggaggcugaggaggcuucuccaccaguggca

SEQ ID NO: 30135 - RNA, 62 nt, Human
gguggcacacuccuguaaucccagcuacuuaggaggcugaggugggagaaucacuuggacuc

SEQ ID NO: 30136 - RNA, 62 nt, Human
gguggcucaugccuguaaucccagcauuuugagaggcugaggcggguggaucaccugagguc

SEQ ID NO: 30137 - RNA, 62 nt, Human
gguggcgcacaccuguaauccuagcuacucgggaggcugaggcaggagaauugcuugaaccc

SEQ ID NO: 30138 - RNA, 62 nt, Human
gguggugcaugccuguagucccagcuacuugggaggcugaggcaggagaauuuuuugagccc

SEQ ID NO: 30139 - RNA, 62 nt, Human
gguguguggauggcacaggaucaauaaugccugaggcugauugacgacaucuacauuucagu

SEQ ID NO: 30140 - RNA, 62 nt, Human
uggccucuuggcuauuucuguguccaguuuuggaggcugaguucugguucaugcagacaaag

SEQ ID NO: 30141 - RNA, 62 nt, Human
ugaacccagcugugccccucccccaggggcgugaggcugaucagcgaagacgggaggaaaga

SEQ ID NO: 30142 - RNA, 62 nt, Human
gucaccagcagcucuugggaaggacuugcugggaggcugagagaggcuuugggcacagccug

SEQ ID NO: 30143 - RNA, 62 nt, Human
ccgacccucccaugcgggugcacacgaagggugaggcugacacagccacugcggaguccagg

SEQ ID NO: 30144 - RNA, 62 nt, Human
aguggcgugcgccuguagucccagcuacucgggaggcugaggcaggaggaucgcuugagccc

SEQ ID NO: 30145 - RNA, 62 nt, Human
aggugauagaagacaagggggagaccgagccggaggcugaggaaaggaagagggcacggagu

SEQ ID NO: 30146 - RNA, 62 nt, Human
gguggcucaugucuguaaucccagcacuuugggaggcugaggcgggugguucaccugagguc

SEQ ID NO: 30147 - RNA, 62 nt, Human
ggugguacaugccuguaaucccagcuacuagggaggcugaggcaggagaaucacucgaaccc

SEQ ID NO: 30148 - RNA, 62 nt, Human
ggucgcucaggccaguaaucccagugacuuaggaggcugaggugggaggauuacuugaaacc

SEQ ID NO: 30149 - RNA, 62 nt, Human
gacggcucaugccuguaaucccagcacuuugggaggcugaggcagguggaucacuggagguc

SEQ ID NO: 30150 - RNA, 62 nt, Human
aucccagcuggccuguaaucccagcuacuugggaggcugaggcagaacugcuugaacccagg

SEQ ID NO: 30151 - RNA, 62 nt, Human
cucuagggaacuuggagaggugugccuaaggugaggcugagcugaaggaaugugggcccagg

SEQ ID NO: 30152 - RNA, 53 nt, Human
ucgaaauccccaaggaguagagugaggcugacuuccuuagaaagagggggaag

SEQ ID NO: 30153 - RNA, 62 nt, Human
gguggcaugagccuguguucccagcugcuuaggaggcugaagcaggaggauugauugagccu

SEQ ID NO: 30154 - RNA, 62 nt, Human
gguggugcacaccuguaguccuagcuacuugggaggcugaggcaggagaauugcuugaaccc

SEQ ID NO: 30155 - RNA, 62 nt, Human
aguggcucacgccuguaaucccagcacuuugggaggcugaggcgggcggaucacgaggucag

SEQ ID NO: 30156 - RNA, 62 nt, Human
gguggcacgcgccuguagucccagcugcucaggaggcugaggcaggagaauggcguaaaccc

SEQ ID NO: 30157 - RNA, 62 nt, Human
cccugcuccccuggccaaagaaagcuguccuugaggcugagcccucagcccuggccuggugg

SEQ ID NO: 30158 - RNA, 62 nt, Human
aagaguccccgccugcccaggccuuuggcacagaggcugaguggacagucaggagagaggcg

SEQ ID NO: 30159 - RNA, 62 nt, Human
augcccuuugcccuccucccucgccuccaguggaggcugagcugacccugggcugcuggagg

SEQ ID NO: 30160 - RNA, 62 nt, Human
guggcacaugccuguaaucccagcuacccggggaggcugaggcaggagaauugcuugaacuc

SEQ ID NO: 30161 - RNA, 62 nt, Human
gguggcaggcaccuguagucccagcuacucgggaggcugaggcaggagaauggcgugaaccc

SEQ ID NO: 30162 - RNA, 62 nt, Human
aguggcucacgccuguaaucucagcacauugggaggcugaggugggcggaucaccugagguc

SEQ ID NO: 30163 - RNA, 62 nt, Human
gguagugcaugccuguaaucccagcuacucaggaggcugaggccggagaaucgcuugagccc

SEQ ID NO: 30164 - RNA, 62 nt, Human
gguggcucacgccuauaaucccagcacuuugggaggcugagguggguggaccacuugaggcc

SEQ ID NO: 30165 - RNA, 62 nt, Human
gguggugcgugccuguaaucccagcuacucaggaggcugaggcaggagaaucacuugaaccc

SEQ ID NO: 30166 - RNA, 62 nt, Human
ccauuuuccucugugccaaagacagacagacagaggcugagagaggcuguuccugaaucaaa

SEQ ID NO: 30167 - RNA, 62 nt, Human
cucagccccuugucgugugcugagcauggcaugaggcugaaguggcaacccuggggucuuug

SEQ ID NO: 30168 - RNA, 62 nt, Human
ucccccaagguagugaaguaauuggaaugaaggaggcugaaaguauugucuaaagugagccc

SEQ ID NO: 30169 - RNA, 62 nt, Human
gguggcucaugccuguaaucccagcacuuugggaggcugagacaggcggaucaucugaaguc

SEQ ID NO: 30170 - RNA, 62 nt, Human
cguggugcaugccuguaaucccagccacucaggaggcugaggcggggaggauccauugagcc

SEQ ID NO: 30171 - RNA, 62 nt, Human
ggcagcucaugccuguaaucccaacacuuugggaggcugaggcaggcggaucacgaggucag

SEQ ID NO: 30172 - RNA, 62 nt, Human
accuguaguccccuguagucccagcuacucgggaggcugaggcaggagaaucguuugaaccu

SEQ ID NO: 30173 - RNA, 62 nt, Human
cauagcacuggaagccagagaaaauguuggaagaggcugagacauucuucaccuccuuggcg

SEQ ID NO: 30174 - RNA, 62 nt, Human
ggaacuucuaccaggacgacgauuucagcuaggaggcugaggcaggagaaucacuggaaccu

SEQ ID NO: 30175 - RNA, 62 nt, Human
gguggcaggcgccuguaaucccagcuacuggggaggcugaggcaggagaauggcaugaaccc

SEQ ID NO: 30176 - RNA, 62 nt, Human
gguggcucacaccuguaaucccagcauuuugggaggcugagguggccagaucccaaggucag

SEQ ID NO: 30177 - RNA, 62 nt, Human
gguggcggguaccuguaguccuagcuacuugggaggcugaggcaggagaauggcgugaaccu

SEQ ID NO: 30178 - RNA, 62 nt, Human
ggugucacgugccuguaauccuagcugcucgggaggcugaggcaggagaaucacuugaacuu

SEQ ID NO: 30179 - RNA, 62 nt, Human
gguggcacacgccuguaaucccagcuacucaggaggcugaggcaggagaaucgccugaaccu

SEQ ID NO: 30180 - RNA, 62 nt, Human
gccuucccccucccaggccuggcuuauuccaagaggcugagccaauggggagaaagauggag

SEQ ID NO: 30181 - RNA, 62 nt, Human
aggugugcacaccuguaaucccagcuaccugggaggcugagguaugaggauugcuugagccu

SEQ ID NO: 30182 - RNA, 62 nt, Human
cuggcagcuccucaggggaacaggggcuaccagaggcugauuucuccccucuccugggccag

SEQ ID NO: 30183 - RNA, 62 nt, Human
ccagaggggaaccgccgggugacaccugcguggaggcugagcugagaaagggccuccgcuua

SEQ ID NO: 30184 - RNA, 62 nt, Human
gguggugcacgccuguaaucccagcuacucgggaggcugaggcaggagaauugcuucaaccu

SEQ ID NO: 30185 - RNA, 62 nt, Human
gguggugcacgccucuaaucccagcuacucgggaggcugaggcaggagaaucacuugaaccc

SEQ ID NO: 30186 - RNA, 62 nt, Human
gguggugggcaccuguaaucccagcuacuugggaggcugaggcaggagaaucucuugaaccc

SEQ ID NO: 30187 - RNA, 62 nt, Human
ccaagaaccaauuaccaaaggaaagaucaucagaggcugaaaucuagaacuucaucccgggc

SEQ ID NO: 30188 - RNA, 62 nt, Human
gguggcagaccccuguaaucccagcuacucaagaggcugagguaggagaaucacuugaacuu

SEQ ID NO: 30189 - RNA, 62 nt, Human
agggacaguuacaaaccaggucaccauccucagaggcugagcccuguacccaccccagcaca

SEQ ID NO: 30190 - RNA, 62 nt, Human
gguggcgcaugccuguaaucccagcuacucaggaggcugaggcaggaaaaucacuugaacuc

SEQ ID NO: 30191 - RNA, 62 nt, Human
gguggcgggcgccuauaaucccagcuacuugggaggcugaggcaggagaauugauugaaccu

SEQ ID NO: 30192 - RNA, 62 nt, Human
gaagacagacccacagcccugcccuugucucugaggcugaagacccccugacucccaugcug

SEQ ID NO: 30193 - RNA, 62 nt, Human
gcagaguaaacacaccugccugaugcuaucaagaggcugaagaaaggcacaaaaugugcuau

SEQ ID NO: 30194 - RNA, 62 nt, Human
ggcggugugcgccuguagacccggcuacucaggaggcugaggcaggagaauugcuugaaccc

SEQ ID NO: 30195 - RNA, 62 nt, Human
cugcccagaccggggcccagcagagcucucaggaggcugagaaaccuccagggcagacagaa

SEQ ID NO: 30196 - RNA, 62 nt, Human
augugaguugcccagaguggaagcuccuaguagaggcugaaggccacaggggaggccucagc

SEQ ID NO: 30197 - RNA, 62 nt, Human
gguagcgggcgccuguagucccagcuacucgggaggcugaggcaggagaauggcgugaaccc

SEQ ID NO: 30198 - RNA, 62 nt, Human
gauggugugcaccuguagucccagcuacucaggaggcugaggcaggagaauugcuugaaccc

SEQ ID NO: 30199 - RNA, 62 nt, Human
gguggggugcaccuguagucccagcuacuagggaggcugagccaggaggaucacuugagccc

SEQ ID NO: 30200 - RNA, 62 nt, Human
gauggcucgugccuguacucccagcacuuugggaggcugaggugggaggguugcuugagccc

SEQ ID NO: 30201 - RNA, 62 nt, Human
aguggcucacgccuguaaucccagcacuuugggaggcugaggcaggcggaucaccugaaguc

SEQ ID NO: 30202 - RNA, 62 nt, Human
augggggucugccuguaaugccagcuacuccagaggcugaggcaagagaaucacuugaaccc

SEQ ID NO: 30203 - RNA, 62 nt, Human
gguggcucaugccuguaaucccagcacuuugggaggcugaggugggcagaucaccugagguc

SEQ ID NO: 30204 - RNA, 62 nt, Human
acgguuaugauuucagcccugggccugcaggagaggcugagaccagcccacccagccagugg

SEQ ID NO: 30205 - RNA, 62 nt, Human
gguggcaggcgccugaaaucccagcuacucaagaggcugaggcaggagaaucgcuugaaccu

SEQ ID NO: 30206 - RNA, 62 nt, Human
gguggugggcgccuguagucccagcuacucgggaggcugaggcaggagaaucgcuugaaccu

SEQ ID NO: 30207 - RNA, 62 nt, Human
gguggcacgugccuguggucucagcuacuugggaggcugaggcgggaggaucgccagagccc

SEQ ID NO: 30208 - RNA, 62 nt, Human
gguugcgcaugccuguaaucccagcuacuuuggaggcugagguggggagaauugcuugaacc

SEQ ID NO: 30209 - RNA, 62 nt, Human
ccugcccugguggagcuuguggucugaugggugaggcugacccaagcccaccccauugccaa

SEQ ID NO: 30210 - RNA, 62 nt, Human
gguggcacacgccugaagucccagcuacucaggaggcugaggcaagagaaucacuugaaccc

SEQ ID NO: 30211 - RNA, 62 nt, Human
gguggcgggugccuguagucccagcuacucgggaggcugaggcaggagaaugacgugaaccc

SEQ ID NO: 30212 - RNA, 62 nt, Human
gguggugggcgccuguagucccagcuacuugggaggcugaggcaggagaauggugugaaccc

SEQ ID NO: 30213 - RNA, 62 nt, Human
cccaugagcugagggagagggagaggggacccgaggcugaggcauaaguggcaggauuucgg

SEQ ID NO: 30214 - RNA, 62 nt, Human
ggggcgcccuccugaccacccacuacauggcagaggcugaggcggugugugaccgaguggcc

SEQ ID NO: 30215 - RNA, 62 nt, Human
gguggcucauaccuguuauaccagcacuuugggaggcugaagugggaggaucgcuugagccu

SEQ ID NO: 30216 - RNA, 62 nt, Human
agauauuugcuuccuaagaauaguucucauuggaggcugaggucgaagcagccucccaccag

SEQ ID NO: 30217 - RNA, 62 nt, Human
gguggugugcgccuguaaucccagcuacuggggaggcugaggcagaagaaucgcuugaaccc

SEQ ID NO: 30218 - RNA, 62 nt, Human
ggacguaaaucccuaaucuuuaagcccgacuugaggcugagagcagcuggaaguuuggguuu

SEQ ID NO: 30219 - RNA, 62 nt, Human
ccagccccagcugccaucagauucaagcccaggaggcugaaaacgagggcccaggaccagaa

SEQ ID NO: 30220 - RNA, 62 nt, Human
cuucacuucaagggcccuccccagcuacucgggaggcugaggcaggagaaucgcuugaacuc

SEQ ID NO: 30221 - RNA, 62 nt, Human
gguugcaggcgccuguagucccagcuacuugggaggcugaggcaggagaauggccugaaccc

SEQ ID NO: 30222 - RNA, 62 nt, Human
gggcucuggaccugggugccccccugccaggcgaggcugacuccgcgugagaugguugguua

SEQ ID NO: 30223 - RNA, 62 nt, Human
ggaaagccacauacucagccuggauggguggagaggcugagggacucacuggagggcaccaa

SEQ ID NO: 30224 - RNA, 62 nt, Human
gguggcucacgccuguaaucccagcacuuugggaggcugaggcaggugguucacuggagguu

SEQ ID NO: 30225 - RNA, 62 nt, Human
gguggugcacaccugugaucccagcuacuugggaggcugaggugggagaauugcuugaaccu

SEQ ID NO: 30226 - RNA, 62 nt, Human
acccugguagggaaaugguguugcugaaaggggaggcugagccagugcgagacugaacuugu

SEQ ID NO: 30227 - RNA, 62 nt, Human
gaucacuugaggccauuugguacacaucucuggaggcugagucgguucaugaggucucuuau

SEQ ID NO: 30228 - RNA, 62 nt, Human
gguggcacuucucuguaaucucagcuucucaggaggcugagacaggagaaucgcuugaaccc

SEQ ID NO: 30229 - RNA, 62 nt, Human
ggcgccgcaugccuguagucccagcuacucgggaggcugaggcaggggaauugcuugaaccc

SEQ ID NO: 30230 - RNA, 62 nt, Human
gguggcuuacgcuuguaaucccagcacuuugggaggcugaagcaggcggaucacaaggucag

SEQ ID NO: 30231 - RNA, 62 nt, Human
guuggcgggcaucuguaauaccagcuacuugggaggcugaggcagaagaaucacuugaaccc

SEQ ID NO: 30232 - RNA, 62 nt, Human
gguggcgggcaccuguagucccagcuacuugggaggcugaggcaggagaauggcgugaaccc

SEQ ID NO: 30233 - RNA, 62 nt, Human
gguggugggugccuguaguuccagcuacuugggaggcugaggugggaaaaugacuugagccc

SEQ ID NO: 30234 - RNA, 62 nt, Human
ccucacaacucacccucacuucacugaaugaggaggcugagcagcugcaguguuucuguccg

SEQ ID NO: 30235 - RNA, 62 nt, Human
aagcaugguagcaagugccuauaauaccagcugaggcugaggcaggagaaucccuugagccc

SEQ ID NO: 30236 - RNA, 62 nt, Human
aguggcucacaccuguaaucccagcacuuugggaggcugaggcggguggaucacuugagguc

SEQ ID NO: 30237 - RNA, 62 nt, Human
gguggcgaaugacuguaaucccagcuacucaggaggcugaggcaggagaaucgcuugaaucc

SEQ ID NO: 30238 - RNA, 62 nt, Human
guuggcacacaccuguaaucccagcuacucaggaggcugaggcaggagaauuacuuuaaccu

SEQ ID NO: 30239 - RNA, 62 nt, Human
gguagcccacgccucuaaucccagcacuuugggaggcugaggcggggagaucacaaggucag

SEQ ID NO: 30240 - RNA, 62 nt, Human
gauggcgagugucuguaaucccagcuacucaggaggcugaggcgggagaaucacuugaaccu

SEQ ID NO: 30241 - RNA, 62 nt, Human
gguggcgggcaccuguagucccagcuacacgggaggcugaggcaggagaauggcaugaaccu

SEQ ID NO: 30242 - RNA, 62 nt, Human
agccccugccccacgcuaauaaaauguguugcgaggcugacgcugguguguaugcgagcgcc

SEQ ID NO: 30243 - RNA, 62 nt, Human
gguggcaggcgccuguaaucccagcuacucaggaggcugaggcaggagaauaacuugaaccc

SEQ ID NO: 30244 - RNA, 62 nt, Human
ggaggugggugcuuguaguuccagcuacucaggaggcugaggugggaggaugacuugaacgc

SEQ ID NO: 30245 - RNA, 62 nt, Human
gaggcugaggugggaggaugacuugaacgcaggaggcugaggcugcagugaguugugauugc

SEQ ID NO: 30246 - RNA, 62 nt, Human
gucugaggacgcagggaggguggagguguccugaggcugauggacagugaccgccacuggcc

SEQ ID NO: 30247 - RNA, 62 nt, Human
gguggugggcgccuguagucccaacuacucaggaggcugaggcaggagaauggugugaaccc

SEQ ID NO: 30248 - RNA, 62 nt, Human
ggcagugguugggagacgcccagauggagggggaggcugaccaagggccccgcagggcgggc

SEQ ID NO: 30249 - RNA, 62 nt, Human
gguggcaggugccuguaaucccagcuacuugggaggcugaggcaugagaaucacuuaaaccu

SEQ ID NO: 30250 - RNA, 62 nt, Human
aguggcucaugccuguaaucccagcacucugggaggcugagguggguggaucaccugagguc

SEQ ID NO: 30251 - RNA, 62 nt, Human
gguggugcaugccuguaaucccagcuacucgggaggcugaggcaggagaacugcuugaaccc

SEQ ID NO: 30252 - RNA, 62 nt, Human
gguggcccgcaccuguggucccagcuacccgggaggcugaguugggaggauccuuugagccc

SEQ ID NO: 30253 - RNA, 62 nt, Human
gguggcgggcaccuguagucccagcuacucgggaggcugaggcaggagaauggugugaaccc

SEQ ID NO: 30254 - RNA, 62 nt, Human
ucagcagcccauggccucuggccaggcauggcgaggcugaggugggaggaugguuugagcuc

SEQ ID NO: 30255 - RNA, 62 nt, Human
ggugccucacgccuguaaucccagcacuuugggaggcugagcuggaucacuugaguucagga

SEQ ID NO: 30256 - RNA, 62 nt, Human
gguggcacgugccugugaucccagcuacuugggaggcugaggcaggaggaucgccugagccc

SEQ ID NO: 30257 - RNA, 62 nt, Human
gguggcaugcuccuguaauccuagcuauucaggaggcugacauaggagaauugcuugaauau

SEQ ID NO: 30258 - RNA, 62 nt, Human
gguggcaugcuccuguaauccuagcuauucaggaggcugacgcaggagacuugcuugaauau

SEQ ID NO: 30259 - RNA, 62 nt, Human
gguggcucacaccuguaaucccagcacuuugggaggcugaggcaggaggaucacuugagguc

SEQ ID NO: 30260 - RNA, 62 nt, Human
cucuugauggaugaagacacugaggacucagagaggcugagucacuuaccugaggacaccca

SEQ ID NO: 30261 - RNA, 62 nt, Human
gauggcacacaccuguaguccgagccacuugggaggcugaggugggaggaucgguugagccc

SEQ ID NO: 30262 - RNA, 62 nt, Human
gguggcucaugccucuaaucccagcacuuugggaggcugaggcugggggaucaccugagguc

SEQ ID NO: 30263 - RNA, 62 nt, Human
gguggcaugcaccuguaaucccagcuacuugggaggcugaggcaggagaauucuuugaaccc

SEQ ID NO: 30264 - RNA, 62 nt, Human
gguggugcgggccuguaaucccagcuacucgggaggcugaugcgggagaaucacuugaaacc

SEQ ID NO: 30265 - RNA, 62 nt, Human
ggugacgccugccuguagucccagcuacucgggaggcugaggcaggaggaucgcuugaaccc

SEQ ID NO: 30266 - RNA, 62 nt, Human
gguggugcacgccuuuaaucccagcuacucgggaggcugaggcaggagaaucacaugaaucc

SEQ ID NO: 30267 - RNA, 62 nt, Human
uguacuggggaggugcccacccagcuacuggggaggcugagucaggagaaucgcuugaaccu

SEQ ID NO: 30268 - RNA, 62 nt, Human
ucccuggagacucacugcaaguuccugcccaggaggcugagggcaccccauccucagugccc

SEQ ID NO: 30269 - RNA, 62 nt, Human
gguggcggccgccuguaaucccagcuacuugggaggcugaggcgugagaaucucuugaaccc

SEQ ID NO: 30270 - RNA, 62 nt, Human
cuucuauguccccucucugcggggggggcgcugaggcugagggggagcugcgucuugcuagg

SEQ ID NO: 30271 - RNA, 62 nt, Human
gguggcgcaugccuguagucccagcuaacugggaggcugaggcaggaggaucacuugagccc

SEQ ID NO: 30272 - RNA, 62 nt, Human
gguggcucacaccuguaaucccagcacuuugggaggcugagacgggugaauuacaugagguu

SEQ ID NO: 30273 - RNA, 62 nt, Human
aguggugcaugccuguaaucccagcuacucgggaggcugaggcaggagaauugcuugaaccc

SEQ ID NO: 30274 - RNA, 62 nt, Human
uggcuuaugcaaaauggcucccagcauuuugggaggcugagguggguggaucacaaggucaa

SEQ ID NO: 30275 - RNA, 62 nt, Human
uguaccuguuuccucauuccuuggcugagggagaggcugagaacugggcagacaccccugga

SEQ ID NO: 30276 - RNA, 62 nt, Human
aacuaaacccaggcaacaggcgaggcaggacagaggcugaguggaaagguggucuggagccc

SEQ ID NO: 30277 - RNA, 62 nt, Human
augcacagcucagggaagcugguggaugccuagaggcugaaggacagggaacucuccauuau

SEQ ID NO: 30278 - RNA, 62 nt, Human
aaauggaugcagcccuaacugcaaaagucagagaggcugacaaggaccaaugcuucuuuauc

SEQ ID NO: 30279 - RNA, 62 nt, Human
gguggcgugcgccuguagucccagcuacucgggaggcugaagcagaagaaucgcuugaaccc

SEQ ID NO: 30280 - RNA, 62 nt, Human
uuggggcaccaugagaagguuggcgugcccuggaggcugacacagaggcuggcacugagccu

SEQ ID NO: 30281 - RNA, 62 nt, Human
aguggcacaugccuguaaucccagcuacuugggaggcugauagaagaagauaacuugagguc

SEQ ID NO: 30282 - RNA, 62 nt, Human
gguggugcaugccugugauccuggcuacuucagaggcugagguggaaggaucacuugaggcc

SEQ ID NO: 30283 - RNA, 62 nt, Human
gguggcgcaugccuauaaucccagcuacuugggaggcugagguaggagaauugcuugaaccu

SEQ ID NO: 30284 - RNA, 62 nt, Human
gguggcacacaccuguagucccagcuacucgggaggcugaggcaggagaaucguuugaaccu

SEQ ID NO: 30285 - RNA, 62 nt, Human
ugguggugcgugcccagguucccagguacucggaggcugagaggugggaggaugccuugagc

SEQ ID NO: 30286 - RNA, 62 nt, Human
aguggcucacgccuguaaucccagcacuuugggaggcugagguggguggaucaccugagguc

SEQ ID NO: 30287 - RNA, 62 nt, Human
uguggggggugccuguaaucccagcuacucaggaggcugaggcaggaaaauugcaugaaccu

SEQ ID NO: 30288 - RNA, 62 nt, Human
gguggcgcgcaccuguagucccaguuacucgggaggcugaggcaggagaaucgcuugaaccc

SEQ ID NO: 30289 - RNA, 62 nt, Human
guggcgggcgccugugguggccagcuacucaggaggcugaggcaggagaauggcgugaaccc

SEQ ID NO: 30290 - RNA, 62 nt, Human
gguggcacaugccuguaauccgagugcuuugggaggcugaggcaggaggaucacucgagcuc

SEQ ID NO: 30291 - RNA, 62 nt, Human
gguggugcacaccaguauucccagcuacucuggaggcugaggcggaggcaggauugcuugau

SEQ ID NO: 30292 - RNA, 53 nt, Human
cacccaugagacuguacugaggagaggcugaggcuagggcuggggacagauau

SEQ ID NO: 30293 - RNA, 62 nt, Human
gguggcacacacuuguaguccgagcuacucgggaggcugaggcagaagaaucgcuugaaccc

SEQ ID NO: 30294 - RNA, 62 nt, Human
uguggcgggugccuguagucccagcuacucaggaggcugagguaggaugauggcuugagccc

SEQ ID NO: 30295 - RNA, 62 nt, Human
gguagugggugccuguaaucccagcuacuugggaggcugaggugggagaauugcucgaacuu

SEQ ID NO: 30296 - RNA, 62 nt, Human
aaauaucuucagaggaagacugccgccauacugaggcugagcacagauuugucuuuuucauu

SEQ ID NO: 30297 - RNA, 62 nt, Human
gguggugcacaccuguaaucccagcuacucgggaggcugaggcaagagaaucacuugaaccc

SEQ ID NO: 30298 - RNA, 62 nt, Human
agucauggaguuggguauucccagcuaccagggaggcugaggugggaggauugcuugaugcc

SEQ ID NO: 30299 - RNA, 62 nt, Human
gaucacagccccuccaggcaagggagaagucagaggcugauucuuguagaauuaacagcccu

SEQ ID NO: 30300 - RNA, 62 nt, Human
gaggguucacgaccccuccagcaaaggagucugaggcugauuccaguagaauuagcagcccu

SEQ ID NO: 30301 - RNA, 62 nt, Human
ugguggcagugccuguaaucccagcuauuugggaggcugaggcaggagaaucgcuugaacca

SEQ ID NO: 30302 - RNA, 62 nt, Human
gccuguggucccagcuccucagagguugaguagaggcugaggugagcggagcacuugagcca

SEQ ID NO: 30303 - RNA, 62 nt, Human
gguggugggcuccuguaaucccagcugcucgggaggcugaggcaggagaaucacuugaaucu

SEQ ID NO: 30304 - RNA, 62 nt, Human
ucgggcgcaggccaggcccccuuggugaagcagaggcugaaggaaaggggucugggucuugu

SEQ ID NO: 30305 - RNA, 62 nt, Human
gguggcacccaucuguaguccuaacugcucaggaggcugaggugggaggauugcuugagucc

SEQ ID NO: 30306 - RNA, 62 nt, Human
gguggcgugcauuuguaaucccagcuacacaggaggcugaggcaggagaauugcuugaaccu

SEQ ID NO: 30307 - RNA, 62 nt, Human
cuauagccugauuuaugucacugccaauuucugaggcugaagccauuucacauuucaccccu

SEQ ID NO: 30308 - RNA, 62 nt, Human
ggcagcaugcgccuauagucccagccacuugggaggcugaggcaggagaaucgcuugaaccc

SEQ ID NO: 30309 - RNA, 62 nt, Human
gguggcgcauaccuguaguccuagcuacucaggaggcugaggugggaggaucacuugagcuu

SEQ ID NO: 30310 - RNA, 62 nt, Human
gguggcgggcuccuguagucccagcuacucaggaggcugaggcaggagaauggcgcgaacau

SEQ ID NO: 30311 - RNA, 62 nt, Human
cacaggcagagagggccacauaucgugugccagaggcugagagacugagagggaugacaggc

SEQ ID NO: 30312 - RNA, 62 nt, Human
ugguggcucagccuacaaucccaacacuuugggaggcugaggaaggggcaucacuugaacca

SEQ ID NO: 30313 - RNA, 62 nt, Human
ggccuccuacaugucucccguuggggaggcaagaggcugaggggcuuccgagccccugagag

SEQ ID NO: 30314 - RNA, 62 nt, Human
uuuuuugguuccuuuucagagaacuguaaaccgaggcugacgugcuccacugacugugccga

SEQ ID NO: 30315 - RNA, 62 nt, Human
gguggugggcaccuguagucccagcaacucgggaggcugaggcaggagaauggcgugaacuu

SEQ ID NO: 30316 - RNA, 62 nt, Human
gguggcgcgugccuauaaucccagcuacucgggaggcugaggcaggagaaucgcuugaaccc

SEQ ID NO: 30317 - RNA, 62 nt, Human
gguggcucacgucuguaaucccagcacuuugggaggcugaggcgggcggaucaccugagguu

SEQ ID NO: 30318 - RNA, 62 nt, Human
gcaugguagcaggugucuguuaucccaguuaggaggcugaggcaagagaaucucuugaaccu

SEQ ID NO: 30319 - RNA, 62 nt, Human
gguggcucacaccuguaaucccagcacuuugggaggcugaggcgggcggaacaccugagguc

SEQ ID NO: 30320 - RNA, 62 nt, Human
uguggcucacgccuguaaucccagcacuuugggaggcugagguaggaggauugauugaggcc

SEQ ID NO: 30321 - RNA, 62 nt, Human
ugguggugccugccuguaauccagcuacucaggaggcugaggcaggauaauuuugcuuaaac

SEQ ID NO: 30322 - RNA, 62 nt, Human
uguggugggcaccuguaaucccagcuacuugggaggcugaggcaagugaaucacuugaaccc

SEQ ID NO: 30323 - RNA, 62 nt, Human
auuacuuaauuccuguaaucccagcauuuugagaggcugagguggguggaucacuugagguc

SEQ ID NO: 30324 - RNA, 62 nt, Human
caggaugagggaauggcaugcgcaaaggcccugaggcugaaaugugcccauguguucuaaga

SEQ ID NO: 30325 - RNA, 62 nt, Human
ggaagucgucccauuuuauggauguggaaacugaggcugacuuaaacuucccgugacuugga

SEQ ID NO: 30326 - RNA, 62 nt, Human
gguggugcgcgccuguagucccagcuacuugggaggcugagcccuggaggucgaggcuacag

SEQ ID NO: 30327 - RNA, 62 nt, Human
cugcauagacaccccauaaccccaggcuuuaggaggcugagguggggggacugcuuaagccc

SEQ ID NO: 30328 - RNA, 62 nt, Human
gauggcacaugccuguaaucccagcuacucaggaggcugaggcaggauaaucacuugaaucc

SEQ ID NO: 30329 - RNA, 62 nt, Human
ggugguaugccccuguagucccagcuacuugggaggcugaggugggaagaucucuugagccc

SEQ ID NO: 30330 - RNA, 62 nt, Human
gguggugcgcaccuguagucccagcuacucuggaggcugaggcaggggaauggcucgaacac

SEQ ID NO: 30331 - RNA, 62 nt, Human
gguggcacgcgucugugguccuagcuccucgggaggcugaggcaggagaaucgcuugaacuc

SEQ ID NO: 30332 - RNA, 62 nt, Human
aguggcucacaucuguaaccccagcacuuugggaggcugagaugggcagaucacuugagguc

SEQ ID NO: 30333 - RNA, 62 nt, Human
aguggcucacgccuauaaucccagcacuuugggaggcugagguggucagaucaccuaagguc

SEQ ID NO: 30334 - RNA, 62 nt, Human
gguggcaccugccuguaaucccagcuacuugggaggcugaggcaggagaaucacuugagccc

SEQ ID NO: 30335 - RNA, 62 nt, Human
gguggcucaugccuguaaucucagcacuuugggaggcugagguggguggaucacuggaguuu

SEQ ID NO: 30336 - RNA, 62 nt, Human
gguggcgggugccuguaaucccagcuacuggggaggcugaggcaggagaaucacuugaauuc

SEQ ID NO: 30337 - RNA, 62 nt, Human
aguggcccaugccuauaaucccagcacuuugggaggcugaggcagguggaucaccugagguu

SEQ ID NO: 30338 - RNA, 62 nt, Human
agacaaaggggaucgcuugagcccaggaguuggaggcugaagagagcuaugacugcaucacu

SEQ ID NO: 30339 - RNA, 62 nt, Human
aguggcuuaugccuguaaucccgguacuuugggaggcugaggugggaggacugcuuaagcuc

SEQ ID NO: 30340 - RNA, 62 nt, Human
uggauguacaggcagugcucaauaaaugcuucgaggcugaugaggcugcuggcucagggugc

SEQ ID NO: 30341 - RNA, 62 nt, Human
gguggcucacgccuguaaugccagcacuuugggaggcugaggugggcagaucaugaggucaa

SEQ ID NO: 30342 - RNA, 62 nt, Human
gguggcgggcgccuguagucccagcuaugcgagaggcugaggcaggagaauggcgugaaccc

SEQ ID NO: 30343 - RNA, 62 nt, Human
aguggcgcaugccuguagucccagcuacuugggaggcugaugcaugagaauugcuugaaccc

SEQ ID NO: 30344 - RNA, 62 nt, Human
ggugacucacgccuauaaucccagcacuuugggaggcugaggcggguggaucaccugagguc

SEQ ID NO: 30345 - RNA, 62 nt, Human
cacaccuguaaucccuaaucccagcacuuugggaggcugaggcagggggaucacgaggucaa

SEQ ID NO: 30346 - RNA, 62 nt, Human
aguaguacacaccuguaguccaagcuacuugggaggcugaagugggaggaucauuugugccc

SEQ ID NO: 30347 - RNA, 62 nt, Human
gguggugugcaccuguaauuccagcuacucgggaggcugaggcaggagaauugcuugagccc

SEQ ID NO: 30348 - RNA, 62 nt, Human
aguggcucaugccuguaaucccagcacuuugggaggcugaggcaggcggaucaccugagguc

SEQ ID NO: 30349 - RNA, 62 nt, Human
gcgggcgaggcggccacaggcgagggugggcugaggcugaaguugcccacacugggggccag

SEQ ID NO: 30350 - RNA, 62 nt, Human
ccaucucacuccccaaggcucgggugggggcugaggcugaggccaaaggggcuggggaggca

SEQ ID NO: 30351 - RNA, 62 nt, Human
uuggacucucggggccaaagguggcuaaggcagaggcugagggggcugggcgagcuaccaag

SEQ ID NO: 30352 - RNA, 62 nt, Human
ccgccgcuccuccccccaggaaagccaagguggaggcugagguggcugcaggagcucguuuc

SEQ ID NO: 30353 - RNA, 62 nt, Human
ggugacgcaugccuguaaucccagcuacucgggaggcugaggcagagaauugcuugaauccg

SEQ ID NO: 30354 - RNA, 62 nt, Human
gguggugugugccuguagucccagcuacuggugaggcugaggcuggaggaucacuggaguuc

SEQ ID NO: 30355 - RNA, 62 nt, Human
gguggcucaugccuguaaucccaacacuuugggaggcugaggccggaggauugcuugagccc

SEQ ID NO: 30356 - RNA, 62 nt, Human
aguaaagucuagcaggauagaaggagguuucugaggcugacagaaacaagcauuccugccuu

SEQ ID NO: 30357 - RNA, 62 nt, Human
gguggugggugccuguaauccuagcuacuugggaggcugaggcaggagaauugcuugaacuu

SEQ ID NO: 30358 - RNA, 62 nt, Human
gguggggugcgcuuguaaucccagcuacucgggaggcugaggcaggagaauugcuugaaccc

SEQ ID NO: 30359 - RNA, 62 nt, Human
gguggcgcgcgccuguaaucccagcuacucaggaggcugaggcagaugaauugcuugaaucc

SEQ ID NO: 30360 - RNA, 62 nt, Human
gguggcucacgccuguaaucccagcacuuugggaggcugaggcaggucgaucacgaggucag

SEQ ID NO: 30361 - RNA, 62 nt, Human
aauaacagaaacacucccagggacucuggggagaggcugaggacaaauaccugcugucacuc

SEQ ID NO: 30362 - RNA, 62 nt, Human
gguggugcacgccuauagucccagcuacucgggaggcugagguaggagaaucguuugaacuc

SEQ ID NO: 30363 - RNA, 62 nt, Human
gguggcgggcaccuguagucccagcuacucgggaggcugaggcaggagaauggcaugaaccu

SEQ ID NO: 30364 - RNA, 62 nt, Human
ggacgccugugaucucaaucucagcuacucgggaggcugaggcaggagaaucacuugaaccc

SEQ ID NO: 30365 - RNA, 62 nt, Human
gguggcucacgccuguaaucucaacacuuugggaggcugaaguggguggaucacaagucagg

SEQ ID NO: 30366 - RNA, 62 nt, Human
gggcucaguucuggacuguggguuuguggggggaggcugacuccugguccuaggcuggaagg

SEQ ID NO: 30367 - RNA, 62 nt, Human
caacuccaucuggaauaggagcugaauaaaaugaggcugagaccuacugggcugcauucuca

SEQ ID NO: 30368 - RNA, 62 nt, Human
gguggugugcaccuuuaguuccagcuacuugagaggcugaggcacaagagucgcuuaaaccu

SEQ ID NO: 30369 - RNA, 62 nt, Human
gguggcaggugccuguaguccuagcugcuugggaggcugaggcaggagaauggugugaaucc

SEQ ID NO: 30370 - RNA, 62 nt, Human
gguugugggcgccuguagucccagcuacucaggaggcugaggcaggagaauggcaugaaccg

SEQ ID NO: 30371 - RNA, 62 nt, Human
uguggcucaggccuguaaucccauaauuuucagaggcugagacaguugggucacgugggccc

SEQ ID NO: 30372 - RNA, 62 nt, Human
aguggugcaugccuguagucucagcuacuugggaggcugaggcaggagaauugcuugaaucc

SEQ ID NO: 30373 - RNA, 62 nt, Human
gguggcaggugccuguaaucccagcuacuugggaggcugaggcaggagagugcuugaaccca

SEQ ID NO: 30374 - RNA, 62 nt, Human
gguggcucacaccuguaaucccagcacuuugggaggcugaggcagguggaucaccugagguc

SEQ ID NO: 30375 - RNA, 62 nt, Human
gguggcgugcgccuguaaucccagcuauauaggaggcugaggcaggagaaucacuugaaccc

SEQ ID NO: 30376 - RNA, 62 nt, Human
gguggugcacgccuguaaucccagcuacucgggaggcugaggcaggagaaucacuugaaccu

SEQ ID NO: 30377 - RNA, 62 nt, Human
gguggcgggcaccuguagucccagcuacucaggaggcugaggcaggagaaucgcuugaaccc

SEQ ID NO: 30378 - RNA, 62 nt, Human
gguggcgugugccuauggucccagcuacucaggaggcugaggcaggagaauugcuucaaucc

SEQ ID NO: 30379 - RNA, 62 nt, Human
aguugugggcaccuguaaucccagcuacccgggaggcugaggcaggagaauugcuugaaccu

SEQ ID NO: 30380 - RNA, 62 nt, Human
uggcucaaaugccuguaaucccaguacuuugggaggcugaggugggcgcaucaccugagguc

SEQ ID NO: 30381 - RNA, 62 nt, Human
gguagcaggugccuguagucccagcuacucgggaggcugaggcaggagaauggcgugaaccu

SEQ ID NO: 30382 - RNA, 62 nt, Human
aguggugggugccuguagucccagcugcuugggaggcugaggcaggagaauucguuaaaccu

SEQ ID NO: 30383 - RNA, 62 nt, Human
uuuggcucaggccuguaaucccagcacuuugggaggcugagguggguggcuuacaaggucag

SEQ ID NO: 30384 - RNA, 62 nt, Human
cggcccccuccccccacauugccacauaccuggaggcugacguugccaaaccagccagggaa

SEQ ID NO: 30385 - RNA, 62 nt, Human
auggcaagagagaaagaaagagaaaguacucagaggcugacacugacauuucacuuccucgc

SEQ ID NO: 30386 - RNA, 62 nt, Human
caguagcucacacuguaaucacagugacucaggaggcugaggugagaggauuccuugaggcc

SEQ ID NO: 30387 - RNA, 62 nt, Human
gguggcacaugccuauagucucagcuacuugugaggcugaggcaggaggauucuuugagccc

SEQ ID NO: 30388 - RNA, 62 nt, Human
gguggugcaugccuguagucccagcuacucaggaggcugagguaggagaaucauugaaccug

SEQ ID NO: 30389 - RNA, 62 nt, Human
acugcgcccuuaacugcauccagccuggggcugaggcugaggcacuggcgaggagagggcgc

SEQ ID NO: 30390 - RNA, 62 nt, Human
gguggcacaugccuguauucccagcugcuugggaggcugaggcaggagaauggcuugaaccu

SEQ ID NO: 30391 - RNA, 62 nt, Human
gguggugcaugccucuaguccuagcuacucgggaggcugaggcacgagaaucacuugaaccu

SEQ ID NO: 30392 - RNA, 62 nt, Human
uuaacaccuaguugguucaccuggaaaacagagaggcugaccguggggcucaccaugcggau

SEQ ID NO: 30393 - RNA, 62 nt, Human
guaaugcucuuccacccugcucgugcugcccagaggcugaucugcaaaccugggcaguauuc

SEQ ID NO: 30394 - RNA, 62 nt, Human
aacucuauuuaaaauucagguauuguacucgggaggcugaggugggaggaucccaggaguuc

SEQ ID NO: 30395 - RNA, 62 nt, Human
gguggcggacgccuguaaucucagcuacuugggaggcugaagcaggagaggugcuggaaccu

SEQ ID NO: 30396 - RNA, 62 nt, Human
uguauucuagaguagggguggaggcggcccaggaggcugaagacaggugcacagaugcuucc

SEQ ID NO: 30397 - RNA, 62 nt, Human
aauggcucacaccuauaaucccaguauuuugggaggcugaggugggagaaucacuugagucc

SEQ ID NO: 30398 - RNA, 62 nt, Human
gguggugcgugcaucuagucccaacuauuugggaggcugaggcaggaggaucgcuugagccc

SEQ ID NO: 30399 - RNA, 62 nt, Human
gguggugcacaccuguaaucccagcuugucaggaggcugaagugggaggaucaccugagccc

SEQ ID NO: 30400 - RNA, 62 nt, Human
ggugggacacgccuguaaucccagcuacucaagaggcugaggcaggagaauagcuugaaccc

SEQ ID NO: 30401 - RNA, 62 nt, Human
gguggcggucaccuguagucccagcuacucgggaggcugaagcaggagaauggcgugaaccu

SEQ ID NO: 30402 - RNA, 62 nt, Human
gagggccuggaggggccuggggcccgggaccggaggcugacgaggcuggacuuccucgagug

SEQ ID NO: 30403 - RNA, 62 nt, Human
gguggugugugccuguaaugccagcuacucaggaggcugaggcaugagaaucgcuugaaccg

SEQ ID NO: 30404 - RNA, 62 nt, Human
ggugguguguaccuguaggccuagcugcucaggaggcugaagcaggaggaucacuugagccu

SEQ ID NO: 30405 - RNA, 62 nt, Human
uaaauggcaggggguggggauuaucuuggggagaggcugaaaagcacaaaagauagucuucc

SEQ ID NO: 30406 - RNA, 62 nt, Human
aguggugcaugccuguaaucccaguuacucgagaggcugaggcaggaaaaucgcuugaaccc

SEQ ID NO: 30407 - RNA, 62 nt, Human
aguggcuuacgccuguaaucccagcacuuugggaggcugaggcuggcguaucaccugagguu

SEQ ID NO: 30408 - RNA, 62 nt, Human
gguggugcacaccuguaguccuagcuucuugggaggcugaggcaggauugcuugagcccagg

SEQ ID NO: 30409 - RNA, 62 nt, Human
gguggcucaugccuguaaucccagcacugugggaggcugaggugguuguauugcuugaggcc

SEQ ID NO: 30410 - RNA, 62 nt, Human
uucccuacccugcccuagacccaaaagugguggaggcugagaagaagccccacugcccucgc

SEQ ID NO: 30411 - RNA, 62 nt, Human
agcuucuagcucuggggucuggcuaccgcuaggaggcugagcaagccaggaagggaaggagu

SEQ ID NO: 30412 - RNA, 62 nt, Human
uguggcucacuccuguaaucucagaacuuugggaggcugaggcagguggaucacuugagcuc

SEQ ID NO: 30413 - RNA, 62 nt, Human
gguggcgcaugccuguaaucccagcuacuugggaggcugaggcagaauugcuugaacccagg

SEQ ID NO: 30414 - RNA, 62 nt, Human
gagggacucuggcgucccggcaggcgagaggcgaggcugagcgaaagaaggaaggacagacg

SEQ ID NO: 30415 - RNA, 62 nt, Human
gcacccccagccuggguccccuccucccaauagaggcugagccggagccagggcaguaugag

SEQ ID NO: 30416 - RNA, 62 nt, Human
ccaguaaaguacuugauguaguccugugccuugaggcugagugauugacaucuuuuuggcac

SEQ ID NO: 30417 - RNA, 62 nt, Human
ggacccucugagucccccuggaggacucccuugaggcugaacccucucaaagggcugucacc

SEQ ID NO: 30418 - RNA, 62 nt, Human
ggaacuaagaagcaggacagaggcaacguggagaggcugaaaacagugcagagacguuugac

SEQ ID NO: 30419 - RNA, 62 nt, Human
ggcggugcgugccuguaaucccagcuauucaggaggcugaggcaccagaauugcuugaaccc

SEQ ID NO: 30420 - RNA, 62 nt, Human
uguggcgggcaccuggagucccagcuacuccggaggcugagggaggagaauggugugaaccc

SEQ ID NO: 30421 - RNA, 62 nt, Human
uuuuggggggccucgucucaagcccccccuuggaggcugaaaucaccccaggcacugugagg

SEQ ID NO: 30422 - RNA, 62 nt, Human
gggggugggcgccuguagucccagcuacgugggaggcugaggcagcagacuggugugaaccc

SEQ ID NO: 30423 - RNA, 62 nt, Human
gguggcucaugccuguaaucccagcacuuugggaggcugaggcagguggaucacgaggucag

SEQ ID NO: 30424 - RNA, 62 nt, Human
gguggcgggcgccuguaaucccagcuacuugggaggcugaggcaggagaaucgcuugacucc

SEQ ID NO: 30425 - RNA, 62 nt, Human
cccuguggcuucugaaaaucucagggacagaugaggcugagccccuaguccccucugugugc

SEQ ID NO: 30426 - RNA, 62 nt, Human
cuugucgcacggaugcagaaaacuuaauggaggaggcugaggucagaaugggaagaguuuuu

SEQ ID NO: 30427 - RNA, 62 nt, Human
uccuaacuuuaaauuuuucagugugagcauacgaggcugaugacugcccugugcuggccaaa

SEQ ID NO: 30428 - RNA, 62 nt, Human
gguggcucauaccuguaaccccagcacuuugggaggcugagguaggaggauugugggaagcc

SEQ ID NO: 30429 - RNA, 62 nt, Human
gauggugugcaccuauagucccagcuacucgggaggcugaagcagaaggaucacuugagucu

SEQ ID NO: 30430 - RNA, 62 nt, Human
ggguggcaugugccuuuaaucccagcuacagggaggcugaggcaggagaaucacuugaaccu

SEQ ID NO: 30431 - RNA, 62 nt, Human
gguggcucacaccuguaaucccagcacuuugggaggcugaggcaggcagaucaugaggucaa

SEQ ID NO: 30432 - RNA, 62 nt, Human
gguggcgcgcgccuguugucuuagcuacucaggaggcugaggcaggagaaucgcuugaaaac

SEQ ID NO: 30433 - RNA, 62 nt, Human
gauggcucaugccuguaaucccagcuacucgggaggcugaggcaggagaauggcuagaaccc

SEQ ID NO: 30434 - RNA, 62 nt, Human
gcuuugauucuugguucuuugagcucguuucagaggcugaguccccacaucagcuuuaguuc

SEQ ID NO: 30435 - RNA, 62 nt, Human
agggaggccaggccucgcuugcaccgcgggacgaggcugaccgggcuguucuguagacucag

SEQ ID NO: 30436 - RNA, 62 nt, Human
gguggcacaugccuguaaucccagcuacucgggaggcugaggcaggagaauugcuugaaccu

SEQ ID NO: 30437 - RNA, 62 nt, Human
ugagcgccaggauggaacacggccacaucaaagaggcugaggcuggcacaggacaugcggua

SEQ ID NO: 30438 - RNA, 62 nt, Human
acaaaccagcugccucacuucuguuucacagggaggcugauggaaaaaggaagcaagcugga

SEQ ID NO: 30439 - RNA, 62 nt, Human
gguggugggcgccuguagucccagcuacuugggaggcugaggcaggagaaugguaugaacca

SEQ ID NO: 30440 - RNA, 62 nt, Human
ugaauaccgaauuggaaaaacagauuucuaaugaggcugauagugaagaaaugaaaaugucu

SEQ ID NO: 30441 - RNA, 62 nt, Human
ggaauuuuguuuuuagccaggucaguauugaugaggcugaucauuuggcucuuuuuuuccuu

SEQ ID NO: 30442 - RNA, 62 nt, Human
aaguuuuacugcucuuugccaugugguaaaaagaggcugagacauauuuaagaauuccaaga

SEQ ID NO: 30443 - RNA, 62 nt, Human
agugcuguguguaucuaguuccagcuacuugagaggcugaggcaggaggauugcuugagucc

SEQ ID NO: 30444 - RNA, 62 nt, Human
acaccugacuugggugaaguugugcaauauuggaggcugacuguagggcugggcagcuggga

SEQ ID NO: 30445 - RNA, 62 nt, Human
gguggugcacgccuguagucucagcuacucaggaggcugaggcaggagaaucgcuugaaccc

SEQ ID NO: 30446 - RNA, 62 nt, Human
cauggcucaugccuguaaucccagcacuuuaagaggcugaggcaggaggaucacuugagcuc

SEQ ID NO: 30447 - RNA, 62 nt, Human
ggugacacaugccuguaguccuagcuacuugggaggcugaggcaggagaauugcuugaaucu

SEQ ID NO: 30448 - RNA, 62 nt, Human
ggcggcaugucccuguggucccagcuacucaggaggcugaggugggaggaucauuugagccu

SEQ ID NO: 30449 - RNA, 62 nt, Human
uugcaacaggucuuccacuggcucgaggcugcgaggcugaccgacaggggcgcccaauagag

SEQ ID NO: 30450 - RNA, 62 nt, Human
gaacaagggaggagagagcaggagcuggggcagaggcugagccgggaggcccuugaggugag

SEQ ID NO: 30451 - RNA, 62 nt, Human
aagaggguggagccgccgcccgaagcgccgaggaggcugagccacucagcaucuccuggucc

SEQ ID NO: 30452 - RNA, 62 nt, Human
aguggcucacaccuguaaucccagcacuuugggaggcugagguggguggaugacaaggucag

SEQ ID NO: 30453 - RNA, 62 nt, Human
ggugguucaugccuguaauaccagcguuuugggaggcugagaugggaggauugcuugagccc

SEQ ID NO: 30454 - RNA, 62 nt, Human
agugguucaugccuguaaucccagcacuuugggaggcugaggaggguggaucacuugaggcc

SEQ ID NO: 30455 - RNA, 62 nt, Human
ugguggcacacaccuguaaucccagcuacucggaggcugaggcacaagaauugcuugaaccu

SEQ ID NO: 30456 - RNA, 62 nt, Human
caggucucaguccuggcaccaugcacaugucugaggcugagcaagggcugagaggagaggcu

SEQ ID NO: 30457 - RNA, 62 nt, Human
agcgccucgcucgagagaagcagaugagggaggaggcugaacgcacgagggaugaguuggag

SEQ ID NO: 30458 - RNA, 62 nt, Human
aggaggcaaaacuucuggcccagaaggccgcagaggcugagcaggaaaugcagcgcaucaag

SEQ ID NO: 30459 - RNA, 62 nt, Human
agcugagccaguccccucacagauggauaaaugaggcugauguuuggagggagaggcacacg

SEQ ID NO: 30460 - RNA, 62 nt, Human
cucuagcaccgcuggaugaaaggagaaggcuagaggcugagggaggaaagagcaguuaacaa

SEQ ID NO: 30461 - RNA, 62 nt, Human
gugggcgggcgccuguaaucccagcuacuugggaggcugaggcagaagaaucauuugaaccc

SEQ ID NO: 30462 - RNA, 62 nt, Human
gguggcucaugccuguagucccagcuacuugggaggcugaggcaggaggaucacuuaagccc

SEQ ID NO: 30463 - RNA, 62 nt, Human
gguggcgggcgccuguagucccagcuacucuggaggcugaggcaggagaguagcgugaaccc

SEQ ID NO: 30464 - RNA, 62 nt, Human
gguggcaggcgccuauaaucccagcuacucgggaggcugaggcaggagaauaacuuaaaccc

SEQ ID NO: 30465 - RNA, 62 nt, Human
gaugauacaugccuguaauccuggcuacuugggaggcugaggcaugagaauugcuugaaccu

SEQ ID NO: 30466 - RNA, 62 nt, Human
gguggcggaugccuguagucccagcuacucaggaggcugaggcaggagaauggcgugaaccc

SEQ ID NO: 30467 - RNA, 62 nt, Human
uuugugugugugguucaagugugcacugggaggaggcugaggccugugaagccaaacaauau

SEQ ID NO: 30468 - RNA, 62 nt, Human
gccugguggggacaagauggaggauguccacagaggcugaccugugggggaaaagaagugcu

SEQ ID NO: 30469 - RNA, 62 nt, Human
uucuaccagugugcuuggguuugccaugaugcgaggcugaguugcuguagcgucuugauucu

SEQ ID NO: 30470 - RNA, 62 nt, Human
caguggcuuacacuuguaacccuagaacuugggaggcugaggugggcggauuacuugagccc

SEQ ID NO: 30471 - RNA, 62 nt, Human
gguagugcaugccuguagucccagcuacuugggaggcugaagugggaggauggccugagcuc

SEQ ID NO: 30472 - RNA, 62 nt, Human
acacggggccaugucuggacgagcaggggagagaggcugaacuggccagaaguggccccucc

SEQ ID NO: 30473 - RNA, 62 nt, Human
gguggcacaugacuguaaucccagcuacucaggaggcugaggcaggaggaucacuugaaccu

SEQ ID NO: 30474 - RNA, 62 nt, Human
gguggcacaugccaguaauuccaucuacucgggaggcugaggcaggagaaucgucuaagccc

SEQ ID NO: 30475 - RNA, 62 nt, Human
gagccaucccagagccuggggaggccaggguagaggcugacggcgcaagaccagcuuuagcc

SEQ ID NO: 30476 - RNA, 62 nt, Human
guggcuucagucaauugucuugagacugugaagaggcugaaagacaccuucccggguggaag

SEQ ID NO: 30477 - RNA, 62 nt, Human
gguggcgcaugccuuuaaucccagcuacucgggaggcugaggcacgagaaucacuugaaccc

SEQ ID NO: 30478 - RNA, 62 nt, Human
gaagagguggcggggaccagcugggcagaugagaggcugagccucaucccuaacccccuuuc

SEQ ID NO: 30479 - RNA, 62 nt, Human
gguggcgugcaccuguaaucccagcuacucaggaggcugaggcaggagaaucgcuuguaccc

SEQ ID NO: 30480 - RNA, 62 nt, Human
gguggcucacgccuauaaucccagcaguuugggaggcugaguugggcagaucaccugagauc

SEQ ID NO: 30481 - RNA, 62 nt, Human
ccagagaggcuccaggggcuagacucccucaggaggcugaauugaaaaagggcagggggcac

SEQ ID NO: 30482 - RNA, 62 nt, Human
ugguggcaguggaggaggcugaggaggcugaagaggcugacaggucggggggcuuucugucu

SEQ ID NO: 30483 - RNA, 62 nt, Human
caggccuggugguggcaguggaggaggcugaggaggcugaagaggcugacaggucggggggc

SEQ ID NO: 30484 - RNA, 62 nt, Human
ugcccaccucaggccuggugguggcaguggaggaggcugaggaggcugaagaggcugacagg

SEQ ID NO: 30485 - RNA, 62 nt, Human
aguggcaugugcuuguaaucccagcuacucuggaggcugaggcaggagaauugcuugaaccc

SEQ ID NO: 30486 - RNA, 62 nt, Human
gguggcucacgccuguaaucccagcacuuugggaggcugagacaggcagaucacuugagguc

SEQ ID NO: 30487 - RNA, 62 nt, Human
ggugguacgugccuguaggccuagcuacuuaggaggcugaggugggaggauugcuugagccc

SEQ ID NO: 30488 - RNA, 62 nt, Human
gguggugcaugccugugguccuggcuacuugggaggcugaggauggaggaucauuugagccc

SEQ ID NO: 30489 - RNA, 62 nt, Human
aguggcucacgccuguaaucccagcacuuugggaggcugagauggguggaucaccugagauc

SEQ ID NO: 30490 - RNA, 62 nt, Human
gguggcgugcaccuguaaucccagcuacucaggaggcugagacaggacacuugcuugaaccc

SEQ ID NO: 30491 - RNA, 62 nt, Human
cgaagccugggccuguauucccagagcuuugggaggcugaggcgagaggaucacuugagcac

SEQ ID NO: 30492 - RNA, 62 nt, Human
gaggaauaguuuggaccuugugccuccugugggaggcugaggacugcaagaggagagcuagc

SEQ ID NO: 30493 - RNA, 62 nt, Human
caaagauucgucaacuuucuuagcucaagagagaggcugagaaaugcagagaagaauaagac

SEQ ID NO: 30494 - RNA, 62 nt, Human
ucucugaaccagagaaaugaaagucaguuuaagaggcugauagaucuuggcccuguuaaggc

SEQ ID NO: 30495 - RNA, 62 nt, Human
gguggcacacaccuguggucccagcuacucgggaggcugaggugggaggaucgcuggagccu

SEQ ID NO: 30496 - RNA, 62 nt, Human
ggugguguacgccuguaaucccagugacuugggaggcugaggcaggagaaucgcuugaaccc

SEQ ID NO: 30497 - RNA, 62 nt, Human
gguagcaggugccuguaaucacagcuacucgggaggcugaggcagagaauugcuugaaccca

SEQ ID NO: 30498 - RNA, 62 nt, Human
aagccaggcacaguguuacgcgucugccucaggaggcugaggcagaagaauagcuugagccc

SEQ ID NO: 30499 - RNA, 62 nt, Human
ugcuaucaaucgcaguagucuuuccccugugugaggcugaagccucagauuccuucuaaaca

SEQ ID NO: 30500 - RNA, 62 nt, Human
uucauuuguguaaauacgaugcugaauuuuaugaggcugaguuaagagugggcacugacggg

SEQ ID NO: 30501 - RNA, 62 nt, Human
auuguuggccauguggcaucauugagcagcaggaggcugaaggaggggagaacaaaauuguc

SEQ ID NO: 30502 - RNA, 62 nt, Human
uugaaaagacgguguuaugcuuggguguuagugaggcugauaugucaugucaaucgauaaac

SEQ ID NO: 30503 - RNA, 62 nt, Human
gguagugcaugccuguaaucccagcuacuugggaggcugaggcaggagaaucgcuugaaccc

SEQ ID NO: 30504 - RNA, 62 nt, Human
aguggcucacgccuguaaucccagcacuuugggaggcugaggcagguggaucacgaggucag

SEQ ID NO: 30505 - RNA, 62 nt, Human
gguggcgggcgccuguagucccagcuacucgggaggcugaggcaggagaauggugugaaccc

SEQ ID NO: 30506 - RNA, 62 nt, Human
acacaugcggaccaagaggggcuugugggcuagaggcugaccagcagcguuuauuuagcaag

SEQ ID NO: 30507 - RNA, 62 nt, Human
gaggcugaggugggaagaucauuugagcccaggaggcugaggcugcaaugagcuauaauuau

SEQ ID NO: 30508 - RNA, 62 nt, Human
gguggugugcaccuguggucccagcuacuccagaggcugaggugggaagaucauuugagccc

SEQ ID NO: 30509 - RNA, 62 nt, Human
gguggcgggcaccuguaauccuggcuacucgggaggcugaggcaggagaaucgcuugaaccc

SEQ ID NO: 30510 - RNA, 62 nt, Human
gguggcacgugaguguagucucagcuacucaggaggcugagaugagaggaucacuugagccu

SEQ ID NO: 30511 - RNA, 62 nt, Human
aguggcuuguuccuauagucccagcacuuugggaggcugagguggguggauugcuugagccc

SEQ ID NO: 30512 - RNA, 62 nt, Human
gguggcgugcaccuguaauccuagcuacucaggaggcugaggcaggagaaucgcuugaaccu

SEQ ID NO: 30513 - RNA, 62 nt, Human
gcaugguggugugcaccuguagucccaguuaggaggcugaggugaguggauugcuugagucc

SEQ ID NO: 30514 - RNA, 62 nt, Human
aguggcgcgugccuguaauuccaucuacucgggaggcugaggcaggagaaucgcuugauccu

SEQ ID NO: 30515 - RNA, 62 nt, Human
gguggcucaugccuguaacccuagcacuuugggaggcugaggcgggcagaucacuugagguu

SEQ ID NO: 30516 - RNA, 62 nt, Human
caaguuuacccucagaguuaugcuuuuccaaagaggcugaugucuuuguuuuuguuuuuuuu

SEQ ID NO: 30517 - RNA, 62 nt, Human
gguggcaggagccuguaaucccagcuacacaggaggcugaggcacgagaaucacuugaacuc

SEQ ID NO: 30518 - RNA, 62 nt, Human
gguggcucaugccuauaauccuagcuacuugggaggcugaggcacgagacuugcuuaauacc

SEQ ID NO: 30519 - RNA, 62 nt, Human
agcgacagaccccugacaagagcaggucucuggaggcugaguugcauggggccuaguaacac

SEQ ID NO: 30520 - RNA, 62 nt, Human
gcccaugcugggucaaugaacagcaucaaagggaggcugaagagauuucaaagaauugucag

SEQ ID NO: 30521 - RNA, 62 nt, Human
gguggugggcgccuguaaucccaguuacucgggaggcugaggcaggagaaucacuugaaccc

SEQ ID NO: 30522 - RNA, 62 nt, Human
gguggcccacaccuguggucccagcuacucaggaggcugaggugggaggaucauuugagccc

SEQ ID NO: 30523 - RNA, 62 nt, Human
gguagcgcacgccuguggucccagcugcuggggaggcugaaguaggaggaucauuuaugcuu

SEQ ID NO: 30524 - RNA, 62 nt, Human
ccaagggaggcacgcgcgcugccgggcggacagaggcugaggcucacaccccacacccgggc

SEQ ID NO: 30525 - RNA, 62 nt, Human
ccaggcagcaauaaggaaauaguucucuggcugaggcugaggacgugaaccgcgggcuuugg

SEQ ID NO: 30526 - RNA, 62 nt, Human
gguggagcaugccuguagucucagcuacucaggaggcugagaugagaggaucacuugagccu

SEQ ID NO: 30527 - RNA, 62 nt, Human
uccauauauacuuucacagaacaaagaguaaagaggcugagugugacuuuauaaagauacuc

SEQ ID NO: 30528 - RNA, 62 nt, Human
ggcggcggacgcccaucaucccagcuacuugggaggcugaggcaggagaauugcuugaaccc

SEQ ID NO: 30529 - RNA, 62 nt, Human
cccucccuuucugugcacuggggacgcugauggaggcugaagcugcuguucggaggcccucu

SEQ ID NO: 30530 - RNA, 62 nt, Human
gguggcacccgccuguaaucccagcuacucgggaggcugaggcggaagauucgcuugagccc

SEQ ID NO: 30531 - RNA, 62 nt, Human
cugauggcaugugccuguaaucccagcuucuggaggcugaggccagagaaucgcuugaaccu

SEQ ID NO: 30532 - RNA, 64 nt, Human
uuuuuauuaaaguaagguucucauuuagcagacaucgcaacaaguaccuucugugaaguuucac

SEQ ID NO: 30533 - RNA, 64 nt, Human
guugcuuucaagcuacaauuguagaguuggguagucgcaacagaaucucuguggcccacaaggc

SEQ ID NO: 30534 - RNA, 64 nt, Human
aaucaugccuuuucuuuaaaagacacaauaggacucgcaacagcauugacucaacaccuaggac

SEQ ID NO: 30535 - RNA, 55 nt, Human
ucaugucaacaaaacucuaaccucaucgcaacaaacgcaacaguggcuuucaaag

SEQ ID NO: 30536 - RNA, 64 nt, Human
aaucauugcuaaguaagaaguuaaguuguugcuaucgcaacaauccuggcagacaauugaguaa

SEQ ID NO: 30537 - RNA, 64 nt, Human
ugcugagcucuggggcagaaggaucaggugaccuucgcaacaaaguuugcccccaccucacaua

SEQ ID NO: 30538 - RNA, 64 nt, Human
uuaugagcuuugguggaugucacuccuuuaauccucgcaacacccugucggguagucucauuua

SEQ ID NO: 30539 - RNA, 64 nt, Human
ccaggccugcgagaagacccagcuggaguucaugucgcaacagugcgccaggaccgacggccag

SEQ ID NO: 30540 - RNA, 64 nt, Human
gcagggcuuuggccaagcccuugucuucacaaauucgcaacacaacaaucagauggcaccaggg

SEQ ID NO: 30541 - RNA, 64 nt, Human
gcgggggcgggcagggagguauuuauuuauuuauucgcaacagccagcgcuaaaagagggggag

SEQ ID NO: 30542 - RNA, 64 nt, Human
uaacuugaacucuuaugcaaaaauccuaaucgugucgcaacacgggaccaguuacugugucuau

SEQ ID NO: 30543 - RNA, 64 nt, Human
ucaggguuaagccuguaauuauguaaccuauuuaucgcaacaugaauuuuuaugauuucuugug

SEQ ID NO: 30544 - RNA, 64 nt, Human
ucacauacuauuacauccacaccugcauacacacucgcaacaugucuacacacguccacacaca

SEQ ID NO: 30545 - RNA, 64 nt, Human
aucuaaacuacguuauuaaauagaaauaguuuacucgcaacaacuuaauuucuaaggguccaag

SEQ ID NO: 30546 - RNA, 64 nt, Human
ugguuaagguuugugauaaagaguuuuaacacacucgcaacaaugagaauuguucacauggccc

SEQ ID NO: 30547 - RNA, 64 nt, Human
ugcugcugaucuggucgugcacucuuuggaugauucgcaacagaagaaaauaugccaugaucag

SEQ ID NO: 30548 - RNA, 64 nt, Human
auuugauuuuuuuuuuuuuuccagagacggggucucgcaacauugcccagacuuccuuuguguu

SEQ ID NO: 30549 - RNA, 64 nt, Human
guauagacaucauucuggguaguucuagaggauaucgcaacaagugcguuugaagguucagcac

SEQ ID NO: 30550 - RNA, 64 nt, Human
aggcaccugcaaagaacaggaagugauggcugucucgcaacagagccugggcugcuccuccugc

SEQ ID NO: 30551 - RNA, 64 nt, Human
uauacacugucucuacugaauucuucuaauuccuucgcaacagaagucuaaauccugcuuagcc

SEQ ID NO: 30552 - RNA, 64 nt, Human
aaaggcuuugccaguccuuaagguacaaugagugaugcugcaacuugcaaauguaccagcauuu

SEQ ID NO: 30553 - RNA, 64 nt, Human
cugguggguaaccagugccuucccuguaacgguaaugcugcagaacugcaaccuuuuguaccuu

SEQ ID NO: 30554 - RNA, 64 nt, Human
ccagaagcugauggacagugcggucuauguggagaugcugcagauccugcugccgcacuucagc

SEQ ID NO: 30555 - RNA, 64 nt, Human
uacuacuacuguucaguuuuuuaaaaguuuugaaaugcugcacuuacauuuaaaaaaacaacaa

SEQ ID NO: 30556 - RNA, 64 nt, Human
ucuccacuugaccuuauuaagguuuuauugggauaugcugcaguguuugaaaugaacaugcauc

SEQ ID NO: 30557 - RNA, 64 nt, Human
ggggcagaaggacucagcgccccuggacccccaaaugcugcaugaacacauuuucaggggagcc

SEQ ID NO: 30558 - RNA, 64 nt, Human
gugcuuacacacuguaccuuuuccuuucauacugaugcugcaguucagggcuggaguuguuaag

SEQ ID NO: 30559 - RNA, 64 nt, Human
ccuggacuaaauuccccuuggggaagacgaagggaugcugcaguuccaaaagagaaggacucuu

SEQ ID NO: 30560 - RNA, 64 nt, Human
ccuggccuaaauuccccuuggggaggacagggagaugcugcaguuccaaaagagaagguuucuu

SEQ ID NO: 30561 - RNA, 64 nt, Human
gugaacaggaagagcacagaaucucuguggggcgaugcugcagcggcugaaaccacgucaaguc

SEQ ID NO: 30562 - RNA, 64 nt, Human
aagugagacaacauaauuauaacuuuguuuuaugaugcugcaucauuuguacuguuuaggucga

SEQ ID NO: 30563 - RNA, 64 nt, Human
guguguccuguagguuguguuugccacgccaggaaugcugcacgcugggcagucccugcagauc

SEQ ID NO: 30564 - RNA, 64 nt, Human
cucgccagaguccccagccggcucgccagccaugaugcugcagccgggcccgcagcucuacgac

SEQ ID NO: 30565 - RNA, 64 nt, Human
acccaggccuauguugauccauccagcuugccagaugcugcagagucacaagccucgaggugcc

SEQ ID NO: 30566 - RNA, 64 nt, Human
guccacguuuaauacuuuguuuuggaaaauuuaaaugcugcagauuuguguagaguucuaauac

SEQ ID NO: 30567 - RNA, 64 nt, Human
agggaaacccucgguugugauuucauucacguggaugcugcaagcagagagacugccaccugga

SEQ ID NO: 30568 - RNA, 64 nt, Human
cugcuguugccugacaugcugauucucauuuauuaugcugcaucaacacauuagagguacagga

SEQ ID NO: 30569 - RNA, 64 nt, Human
ggagccaucucuagcgggcccuucauuccucuccaugcugcaaucacuguccugggcuuauggu

SEQ ID NO: 30570 - RNA, 64 nt, Human
agggcccagaaauaggaaaggcuaggauuggauaaugcugcaaaugcuuuuuuugugugagaaa

SEQ ID NO: 30571 - RNA, 64 nt, Human
acuuucuggaacccgagacuuggccauaaagauaaugcugcauuuuucugucagaaucacauau

SEQ ID NO: 30572 - RNA, 64 nt, Human
cgggaaggggggacacuuugcacguuguacacauaugcugcaggaaggggguggggggcccaau

SEQ ID NO: 30573 - RNA, 64 nt, Human
cuuggccacaggccccaaguuuccucuggcagacaugcugcacgucuguacccuucucagauca

SEQ ID NO: 30574 - RNA, 64 nt, Human
aauugcaccaaaagaaugagugccuugaccccuaaugcugcauauguuacaauucucucacuua

SEQ ID NO: 30575 - RNA, 64 nt, Human
uuuaauuuaagcaaagacuaaaaucaaccauuugaugcugcaggggccuuucaggaucugggag

SEQ ID NO: 30576 - RNA, 64 nt, Human
agaagagaaccuucugugacuccuaaaauguuccaugcugcauuuuuguuucauuuuuuauuuu

SEQ ID NO: 30577 - RNA, 64 nt, Human
gggcuacagcauccuggacaacaacgcggccaccaugcugcagguguuugaccuccgaaggauc

SEQ ID NO: 30578 - RNA, 64 nt, Human
ccaauuguggguguagcaaugaaagcaauaugauaugcugcagugugaagcuccuucugggguu

SEQ ID NO: 30579 - RNA, 64 nt, Human
ugcccugagagcccacugcaguuggacuuugccgaugcugcaagaaggggugcagagaagacuc

SEQ ID NO: 30580 - RNA, 64 nt, Human
ucuauuauuugaauucaacuggacacucuguaaaaugcugcacugcagcaaaaacaaaaccacc

SEQ ID NO: 30581 - RNA, 64 nt, Human
ggggccugugcccccagaggccuacaggggcaccaugcugcacugcccgcugaacuucacuggc

SEQ ID NO: 30582 - RNA, 64 nt, Human
gagaagaggucaugccugggaggaagggaucgucaugcugcaucgaauccucucuccgccgugu

SEQ ID NO: 30583 - RNA, 64 nt, Human
gagacccugccacaugcuggcccuuugagugagaaugcugcaucuuucuacauaucuucaugag

SEQ ID NO: 30584 - RNA, 64 nt, Human
uaaaagugacauguuaaggggcuaugaaguaaauaugcugcaguuaauuaugcuaaguuaaaau

SEQ ID NO: 30585 - RNA, 64 nt, Human
ggaccuugacaguaucuaaugacuccuccugaaaaugcugcaguauaaaagagcaaagagcuuu

SEQ ID NO: 30586 - RNA, 64 nt, Human
cuagcaagccauggagacagguagcauuuguaagaugcugcacaggagcagcauuauccccaaa

SEQ ID NO: 30587 - RNA, 64 nt, Human
uugccaacaugauuccuaaagggagaugugacugaugcugcaagaaccaucuuuucuaugaaaa

SEQ ID NO: 30588 - RNA, 64 nt, Human
ugauuuuguuuguaauguauuuugauagcaaaucaugcugcaucuauaucuuuuucuuguuuga

SEQ ID NO: 30589 - RNA, 64 nt, Human
ggcacugucacuacggugauuguaugaaguuugaaugcugcaaguuaugaaauauuuggcccgc

SEQ ID NO: 30590 - RNA, 64 nt, Human
cuaauauuaaguuauugcagauaccacauucauuaugcugcaguacuguacauauuuuucuuag

SEQ ID NO: 30591 - RNA, 64 nt, Human
ugagcaguaugccucuucuuuuagaauuaaaugaaugcugcacagguccagauguguguugaug

SEQ ID NO: 30592 - RNA, 64 nt, Human
gggaaauuuauuuuuuuuaauguccuguuccuuaaugcugcaaauuaucaguauuuauaaagua

SEQ ID NO: 30593 - RNA, 64 nt, Human
cucugcugaccuggguguggcggagggagaggcgaugcugcaaaguguuuucugugucccacug

SEQ ID NO: 30594 - RNA, 64 nt, Human
ccucugcgccuccugccacugaggcccugggcagaugcugcagcccgcccccuucucauggugc

SEQ ID NO: 30595 - RNA, 64 nt, Human
uaaaagucucucaaauuaggccagauucuaaaacaugcugcagcaagaggaccccgcucucuuc

SEQ ID NO: 30596 - RNA, 64 nt, Human
cggacugaaaaaaagaacaaacauuagcuauuuuaugcugcaagaaccaggacacacaauucgc

SEQ ID NO: 30597 - RNA, 64 nt, Human
ccuauaccagcuuuuuguuuguuuauguuacagaaugcugcaauucagggcucuucaaacuugu

SEQ ID NO: 30598 - RNA, 64 nt, Human
gcaaauaaaaggaauugucugacccuagaggcagaugcugcacugcacuacuccaaugucuucc

SEQ ID NO: 30599 - RNA, 64 nt, Human
ggucugcauaaaugcuguauacauaccagauuugaugcugcauauaggguauggaauugcacau

SEQ ID NO: 30600 - RNA, 64 nt, Human
cugagagaaaaagagagagagagagaaaaagaccaugcugcauacauucuguaauacauaucau

SEQ ID NO: 30601 - RNA, 64 nt, Human
uuucuauaacuggaggaccuggcaaaccugccgcaugcugcacacaucuaccuacguacacaua

SEQ ID NO: 30602 - RNA, 64 nt, Human
ugucaguuugaccgagcugguuuugcuuauggucaugcugcaauuuguuagaauaauagggauc

SEQ ID NO: 30603 - RNA, 64 nt, Human
uaaaagugacauguuaaggggcuaugaaguaaauaugcugcaguuaauugugcuaaguuaaaau

SEQ ID NO: 30604 - RNA, 64 nt, Human
auuuguuuuucuuccugcaauguggugugcagagaugcugcauauccuuuuuaugggauugcgu

SEQ ID NO: 30605 - RNA, 64 nt, Human
uuagcccuggccccauccuuccuauuucuguaguaugcugcagcuuuaaucagaaaguccaugg

SEQ ID NO: 30606 - RNA, 64 nt, Human
uccaugaacuuagauuuuauugguuucacucaaaaugcugcagucauuugaccugaacuugugg

SEQ ID NO: 30607 - RNA, 64 nt, Human
acucuccaggcuuugucauuucaaggcugcugaaaugcugcauuucaggggccaccauggagca

SEQ ID NO: 30608 - RNA, 64 nt, Human
ugcaguugaaugguuggagauugcuggcgaugugaugcugcacugaaaaaacuggucacacaaa

SEQ ID NO: 30609 - RNA, 64 nt, Human
cccagaguccucugguuccuuacacauuaagcaaaugcugcacagauggauuuguuuggaccuc

SEQ ID NO: 30610 - RNA, 64 nt, Human
ggggacccgugucugugggagcgggcacagguccaugcugcaggccacuacggcugcucggcag

SEQ ID NO: 30611 - RNA, 64 nt, Human
aaaaagacuuugcucugcccuuuuauauuccuuuaugcugcaaguggugacauguucagauuuc

SEQ ID NO: 30612 - RNA, 64 nt, Human
uacuuccuaaaaagcaacaaaaaaguuuuugugaaugcugcaagauuguugcauuguguauacu

SEQ ID NO: 30613 - RNA, 64 nt, Human
agggaauagggaucucaugcuugcaaacuacacaaugcugcaggugcuucccaggggccacagg

SEQ ID NO: 30614 - RNA, 64 nt, Human
ggcuccaguaaaggguuuuggcugcauuuggggaaugcugcauuuuguucgugccuguaagauu

SEQ ID NO: 30615 - RNA, 64 nt, Human
gcugagaaagguugcauugcugccccuuauacacaugcugcagcuugauguuaaagaauuuuua

SEQ ID NO: 30616 - RNA, 64 nt, Human
cccaacaggugugacugcucugacaaccuguggcaugcugcagggucaggcuccugauaggagg

SEQ ID NO: 30617 - RNA, 64 nt, Human
guugggccggaguuugugcagcccaugccuagcgaugcugcaccucccaugauguccuggcuuu

SEQ ID NO: 30618 - RNA, 64 nt, Human
gaaguaaucgaacaaauugaaaaucugaagaccgaugcugcaagcagaccauaugcagaugugc

SEQ ID NO: 30619 - RNA, 64 nt, Human
gagugcauaauggugauacuuguuuauaauucuuaugcugcaggaacccuagagacaaaaugag

SEQ ID NO: 30620 - RNA, 64 nt, Human
gugcucacuuuaggaucagcaguguugaccauuuaugcugcauagcuguauuauagccuuauua

SEQ ID NO: 30621 - RNA, 64 nt, Human
cgccaccuuggccuucaaugacagggaucuagcaaugcugcaucaucagccuuccaauaccagg

SEQ ID NO: 30622 - RNA, 64 nt, Human
auguggcugcaaggucucccggcugccauacugcaugcugcaggcucugccuuucaugacccca

SEQ ID NO: 30623 - RNA, 64 nt, Human
uuucugcagguggcaggugagcaagcccaggagaaugcugcaaucuugggggugguuuuauuua

SEQ ID NO: 30624 - RNA, 64 nt, Human
agcuccacuggagagaaguggaauccuauauagaaugcugcacuaauugacaacacagccuaua

SEQ ID NO: 30625 - RNA, 64 nt, Human
aagaaaugcauaugucacuagaauggauaaaauaaugcugcaaacuuaauguucuuaugcaaaa

SEQ ID NO: 30626 - RNA, 64 nt, Human
cugcuaucaagccaaauaccugguuuuccuuaucaugcugcacccagagcaacucuugagaaag

SEQ ID NO: 30627 - RNA, 64 nt, Human
aaggguucuguaguguuaucaaagcaaaaagaaaaugcugcauaaaaauaccaaacuucagcaa

SEQ ID NO: 30628 - RNA, 64 nt, Human
uuauagcgugugugcaaacucuugaggguugauuaugcugcaauuuagcauguuggaacgucua

SEQ ID NO: 30629 - RNA, 64 nt, Human
cucgacaauacccguuggcaaggagucugccuccaugcugcaguguucgaguggauuguaggug

SEQ ID NO: 30630 - RNA, 64 nt, Human
gaggacaaagcagcagaggucguaaagaauacaaaugcugcagagguaugaguugcuuuguauu

SEQ ID NO: 30631 - RNA, 64 nt, Human
cauuauuuuucauucacugaaguaaaagcaccugaugcugcaucacaacugcaauguuuguuuu

SEQ ID NO: 30632 - RNA, 64 nt, Human
gcauuuaauaaauuaucuuuuuuuggagggguggaugcugcauuucauuggaaaugucauuuuu

SEQ ID NO: 30633 - RNA, 64 nt, Human
cucugauuauaguucugaguucuuugauuuacucaugcugcaugacaaaauguuuacuaauaac

SEQ ID NO: 30634 - RNA, 64 nt, Human
auagucuagucaccaaaggaccauucucuugccaaugcugcauuccuuuugcacuuuuggauuc

SEQ ID NO: 30635 - RNA, 64 nt, Human
aagaaaauguagcuucugaauauuggccaccucuaugcugcauauacuucuugggauauaguau

SEQ ID NO: 30636 - RNA, 64 nt, Human
uaacuuuaaaaauaaaugaaauuauuuaaggguuaugcugcacuaguauuccuuagaggaaaca

SEQ ID NO: 30637 - RNA, 64 nt, Human
uaugucaaauugugcaaaauauugguauuaaagaaugcugcaacuuuuuuaugucucuuagagg

SEQ ID NO: 30638 - RNA, 64 nt, Human
aaaaaaacuacuguauguaacggaauugcagaauaugcugcacauguauuuuauuuaguuaucc

SEQ ID NO: 30639 - RNA, 64 nt, Human
cauuccguuuuggucuuuuucaaaaaggucccaaaugcugcacucuacacaugaaggcccucuc

SEQ ID NO: 30640 - RNA, 64 nt, Human
agagaaauuaaaaaucacagaguauuuauuaccaaugcugcagguacauuaaugaacucgagau

SEQ ID NO: 30641 - RNA, 50 nt, Human
caauuccuggaaaaugguagaugcugcacaaaguuaccuucuguuucauc

SEQ ID NO: 30642 - RNA, 64 nt, Human
uuuuucuuaggugcagcucgauucuaaucuuuucaugcugcacacgauuccuuuaauguagcau

SEQ ID NO: 30643 - RNA, 64 nt, Human
cucccaccaaaacaaacuuuucaaugaucaaaaaaugcugcagauuuuuugaguucccaauacg

SEQ ID NO: 30644 - RNA, 64 nt, Human
guguuuguuucugacauuuuaacuugaaagcgauaugcugcaagauaauguauuuaacaauauu

SEQ ID NO: 30645 - RNA, 64 nt, Human
aacaagaaguuaguucuauuuagcagguuaaaaaaugcugcauuagaauuaaagcaaguuauuu

SEQ ID NO: 30646 - RNA, 64 nt, Human
uucagucucugugcauacucagcuuuguagaaccaugcugcaaagccauauaccgaugggguua

SEQ ID NO: 30647 - RNA, 64 nt, Human
aaaaggccagaacaauugucugaaauuaguaacaaugcugcaucuagauuggagugcugcacaa

SEQ ID NO: 30648 - RNA, 64 nt, Human
aaaaaugcuugaagagccugagaguaaaaagauuaugcugcaaagcuaugauauaaacugcucu

SEQ ID NO: 30649 - RNA, 64 nt, Human
gauuguuauggugagaguauuuacaccucagcaaaugcugcaaaauccuguuuucccccagaga

SEQ ID NO: 30650 - RNA, 64 nt, Human
uagucaaauuauguauugguggggcuggguaccaaugcugcaggucaacagcuaugcugguagg

SEQ ID NO: 30651 - RNA, 64 nt, Human
uuuuguucauucucuagacaaaauccaucagggaaugcugcaggaaacgauugccaacuauacg

SEQ ID NO: 30652 - RNA, 64 nt, Human
agccauggggugucgggggcuccugugcaggcucaugcugcaggcggccgagggcacagggggu

SEQ ID NO: 30653 - RNA, 64 nt, Human
ucucccuuuuuuaaacaaaaagcaaaaaaguaaaaugcugcacugcccagcagcccgguuaggg

SEQ ID NO: 30654 - RNA, 64 nt, Human
ucuagauaaaaggagagaaagcaaaacauuuuguaugcugcaugaaagcguuaucucuuccuua

SEQ ID NO: 30655 - RNA, 64 nt, Human
uaugcaugauaaugauaugaauaguuucgaaucaaugcugcaaagcuuuauuucacauuuuuuc

SEQ ID NO: 30656 - RNA, 64 nt, Human
guauaaaauaagaguaaaugcccuacauggugugaugcugcauuauauauaaaacugugugcau

SEQ ID NO: 30657 - RNA, 64 nt, Human
guacuguauuucccucucauuuugaccuacucucaugcugcagaggguacuuuaagacauacuc

SEQ ID NO: 30658 - RNA, 64 nt, Human
aauacacaacagccccuucugcccccgcacagaaaugcugcagaguauauaaaacuugagacau

SEQ ID NO: 30659 - RNA, 64 nt, Human
ggaauugccuaacauguggacuuuuacaauaaaaaugcugcauucuaauccaugguggcaucuc

SEQ ID NO: 30660 - RNA, 64 nt, Human
aacagaagagaaaauauuuuuauauuuaaggauuaugcugcacuguacuacaaaauuguaguac

SEQ ID NO: 30661 - RNA, 64 nt, Human
cgaguaacuccaaguacaaggccgaccacaauggaugcugcaaaaacguugacuggggcaaagg

SEQ ID NO: 30662 - RNA, 64 nt, Human
aagaaagcaaaugcuguuuuacuucaaaugauggaugcugcaaucauaugauauuugcuaagcu

SEQ ID NO: 30663 - RNA, 64 nt, Human
gacauguauacaaauucuuccuuaagugaaaguuaugcugcaucgaauuguaacugaaaguaua

SEQ ID NO: 30664 - RNA, 64 nt, Human
aaugagggcagguuccagggccugaaauguagguaugcugcaaggcuuuuacauugaauuugac

SEQ ID NO: 30665 - RNA, 64 nt, Human
guuccuacacaacccuguugaaaaucuacaauauaugcugcauuuaaugaaacauguauauguc

SEQ ID NO: 30666 - RNA, 64 nt, Human
uuuggacuuguuuuugcucagcaugaaguuuuauaugcugcauuuuacuaauuccauauuuaac

SEQ ID NO: 30667 - RNA, 64 nt, Human
uuccuacaugcugccucuccucaggguccccugaaugcugcaucauuguguucagugcagcugg

SEQ ID NO: 30668 - RNA, 64 nt, Human
agagaaaauaacaucacuuauuuauuguuguuggaugcugcaaaguguuaguagguaugaggug

SEQ ID NO: 30669 - RNA, 64 nt, Human
ucuggagaccagggagccuuugguucuggccagaaugcugcaggacuugagaagaccucaccua

SEQ ID NO: 30670 - RNA, 64 nt, Human
aaaagauggucaucgggaagagaaaaagaaaaaaaugcugcaguuguucucucaagcuagggca

SEQ ID NO: 30671 - RNA, 64 nt, Human
ccagucccagggaagguggggcccugccccuaggaugcugcagcagagugagcaagggggccca

SEQ ID NO: 30672 - RNA, 64 nt, Human
cggccuccuccuguagcuccugccugcacccacgaugcugcacgggcccgcccugguggggcuc

SEQ ID NO: 30673 - RNA, 64 nt, Human
cugcugugaaacacaggccaucagggaaaacgaaaugcugcacuauuaaauuagagguuuuuga

SEQ ID NO: 30674 - RNA, 64 nt, Human
cuagguugguucaaaccuuuuuacucuuaaaacaaugcugcaguuaacacccuuguacauauau

SEQ ID NO: 30675 - RNA, 64 nt, Human
aaaucuagauggugggucccacagaugugagaacaugcugcaagagccugccagccacagcaau

SEQ ID NO: 30676 - RNA, 64 nt, Human
cucaugaguuccaauguugugugaagacaggcagaugcugcacagugaauugcagaugauauua

SEQ ID NO: 30677 - RNA, 64 nt, Human
augaauuacgaagcaccuuaguaagcaccuucuaaugcugcauuuuuuuuguuguuguuaaaaa

SEQ ID NO: 30678 - RNA, 64 nt, Human
ucauccaugucugacccaagagcucuuaacugcuaugcugcacugccucauucagagauagaug

SEQ ID NO: 30679 - RNA, 64 nt, Human
gaauauuugcaucuaaaaauguuuacucguugccaugcugcaguccgcacaagcugugaggcag

SEQ ID NO: 30680 - RNA, 64 nt, Human
acuauuaaggauuugucccaggccaauggugaacaugcugcauuuuauguuuggauugugcugu

SEQ ID NO: 30681 - RNA, 64 nt, Human
ugaguucccagcaaugacucaggcaucagagaugaugcugcaguggaaaaccugacucugugug

SEQ ID NO: 30682 - RNA, 64 nt, Human
gauaagcaccagugaagaaguucuaacuuuuagcaugcugcacagaaacugguauaacaugccu

SEQ ID NO: 30683 - RNA, 64 nt, Human
uuagaauauaguaaauaaaaggugauguaaaugaaugcugcacaaacgguguucaugauacuuu

SEQ ID NO: 30684 - RNA, 64 nt, Human
ggggauacagugagaccuugucuuuaaaaaaaaaaugcugcaaaaccaaaaauaaauagccaua

SEQ ID NO: 30685 - RNA, 64 nt, Human
gacuaaugugaucuaaagugcagcagaguggcugaugcugcaaguuaugucuaaggcuaggaac

SEQ ID NO: 30686 - RNA, 64 nt, Human
gcauuuuaaauguaguuugaauauuuuccacaagaugcugcaaugugaguuaucacuucauuua

SEQ ID NO: 30687 - RNA, 64 nt, Human
acaugcauacaaaggacacacagggauuuugaaaaugcugcacaucccuuaauagucaucuaca

SEQ ID NO: 30688 - RNA, 64 nt, Human
uguguagcaccauugaucacaauguaacauuuccaugcugcauuaagggugucucucucuaauc

SEQ ID NO: 30689 - RNA, 64 nt, Human
uguuaaguaaaauaagccaggcuuagaaagacaaaugcugcauaaucucacuguggaaucuuaa

SEQ ID NO: 30690 - RNA, 64 nt, Human
gguagauuauugccugccccuuauacauaggaauaugcugcauaauugcgcauaacuuccaucu

SEQ ID NO: 30691 - RNA, 64 nt, Human
cgcacagaaggacuucuucugggaggcccuggacaugcugcagagggcugaaggaggcgggggu

SEQ ID NO: 30692 - RNA, 64 nt, Human
uuugauauccuggauauuuauuauauuuuauguaaugcugcauuucuauuugaauguuaagugg

SEQ ID NO: 30693 - RNA, 64 nt, Human
uuuaaacagagcuagaaugugaugucugaagauaaugcugcauuucuggguuucuuguguggau

SEQ ID NO: 30694 - RNA, 64 nt, Human
guguccacuauguauucuucaaaacauuuggcacaugcugcacuaaccuagucuaucuuuucua

SEQ ID NO: 30695 - RNA, 64 nt, Human
agcaaguggaacagcagcaaguuuuucagugcauaugcugcacaagaacaaaauauaaaucugu

SEQ ID NO: 30696 - RNA, 64 nt, Human
auaauuugccauugcuauacuguaccagugucaaaugcugcagccugccaagcugugauuuugu

SEQ ID NO: 30697 - RNA, 64 nt, Human
gacacaccuggcacccgucaucggccagcgguggaugcugcauaauccaccuggguacuucagc

SEQ ID NO: 30698 - RNA, 64 nt, Human
uucaaagcccccuccuccaugagaggggacugaaaugcugcagcugaggcuggucuucagggca

SEQ ID NO: 30699 - RNA, 64 nt, Human
caugucagggugucagauccuuaaacgugugugaaugcugcaucaucuauguguaacaucaaag

SEQ ID NO: 30700 - RNA, 64 nt, Human
ccuuugaggggaaggaggagccccucuuucucccaugcugcacuuacuccuuuugcuaauaaaa

SEQ ID NO: 30701 - RNA, 64 nt, Human
gugcucuguucuguggcauagaacuuccuuugauaugcugcauagcuaguucuaggcauaggua

SEQ ID NO: 30702 - RNA, 64 nt, Human
gcagcaggaggcccagcuccgcaggcagguguggaugcugcaauucccaaugcagagaagcgga

SEQ ID NO: 30703 - RNA, 63 nt, Human
uaccgguagaauucacacccucuaucauaaacauaugcugcagaaaaaaaaugucuugugguc

SEQ ID NO: 30704 - RNA, 64 nt, Human
augcacgugaagccuucccggagccagcgagcauaugcugcaugaggaccuuucuaucuuacau

SEQ ID NO: 30705 - RNA, 64 nt, Human
uagaugauuaacugaccuacuauacuccucaaggaugcugcauuuggaccuaauaugaaucgac

SEQ ID NO: 30706 - RNA, 64 nt, Human
caaagauuuuuaguuaaaaaucauguagucuaauaugcugcaguuauuuuuuuauauuuuucaa

SEQ ID NO: 30707 - RNA, 64 nt, Human
acuugaugcguuuugcacuacucuuuccauuuauaugcugcaaacaacuacagucuuugaaaua

SEQ ID NO: 30708 - RNA, 64 nt, Human
gaaaggcacagucuaaaucgaaacccuaaacucaaugcugcaaguaugaauuuaauucauauau

SEQ ID NO: 30709 - RNA, 64 nt, Human
gccucccacugccugacuuccugccacacgguuaaugcugcagcaacaccgacugcuucaucuu

SEQ ID NO: 30710 - RNA, 64 nt, Human
aguuaugccuuauucauaucacaguuagaucaccaugcugcaacaugguuuauauucaugcugc

SEQ ID NO: 30711 - RNA, 64 nt, Human
ugucccucugggccaaugcuuauacccagugaggaugcugcagugaggcuguaaaguggccccc

SEQ ID NO: 30712 - RNA, 64 nt, Human
gaggaguuuggggucuccacacgaugccuagagaaugcugcagucugcacauuagacgcuuuuu

SEQ ID NO: 30713 - RNA, 64 nt, Human
uaucaugaaaaguuuuuagauuacacgaucgcauaugcugcauuucacguuuuauuggacauuu

SEQ ID NO: 30714 - RNA, 64 nt, Human
agauuccuaccuuuguucugcuacccacugccagaugcugcaagcgagguccaagcacaucuug

SEQ ID NO: 30715 - RNA, 64 nt, Human
aucgaagacugcacaacuccuagaaggcagcacuaugcugcaaacccagacggccacucuucuc

SEQ ID NO: 30716 - RNA, 64 nt, Human
uagguguggcuuuguacaugcagaagaaugcuauaugcugcacauuuugccuuuaaagucuuac

SEQ ID NO: 30717 - RNA, 58 nt, Human
caauucagacugaaauuuaggcccauaaaugcugcagaauaauuaccacuguacaacc

SEQ ID NO: 30718 - RNA, 64 nt, Human
auuuuuuaacuauagcuuuauuaguaauuccaaaaugcugcaauguagcugauuuccucacuca

SEQ ID NO: 30719 - RNA, 64 nt, Human
uuuuugccuuucaauguaaucaauuggauuaacaaugcugcaauauaauuuagcuauaaucgua

SEQ ID NO: 30720 - RNA, 64 nt, Human
gaaaauuacuuaauuucauacuagaaauggauggaugcugcaaguugaaauggacuguccauug

SEQ ID NO: 30721 - RNA, 64 nt, Human
uaaaaauuuauuuuuuuuggaaauaguugcacaaaugcugcaauuuagcuuuaagguucuauag

SEQ ID NO: 30722 - RNA, 64 nt, Human
ccuaaccuugaaguuuggaaacagguggucuucuaugcugcagagaaacuaugcauuaggucuc

SEQ ID NO: 30723 - RNA, 64 nt, Human
uuguaccauggacuucagaccgccuugcagccguaugcugcacaagcguguacacccccugggc

SEQ ID NO: 30724 - RNA, 64 nt, Human
ucucacacagaucuauggcuaugacgagcuccagaugcugcagucacggcugccaguggugagu

SEQ ID NO: 30725 - RNA, 64 nt, Human
gugcugguggauccacucccauggauccacucacaugcugcaggcaugcaguagacucacccac

SEQ ID NO: 30726 - RNA, 64 nt, Human
agcauguaccaagaauguguguguaguuuuaauuaugcugcaauguauaaucugguguguuauu

SEQ ID NO: 30727 - RNA, 64 nt, Human
caggaacuuuucaccugagccuuucuucugagaaaugcugcagucagaagggugugcugguaaa

SEQ ID NO: 30728 - RNA, 64 nt, Human
uuuaaaacucuggcuggacagaguuuuaagcacuaugcugcaggaauccugagaaaaaggggaa

SEQ ID NO: 30729 - RNA, 64 nt, Human
gggauauugaaaauuagaaauugcauguuaguucaugcugcacuaccauauuguucuuuugggg

SEQ ID NO: 30730 - RNA, 64 nt, Human
aguccccaucuguagcacaggcaaugccagugccaugcugcagccucagaaaccaggccucuca

SEQ ID NO: 30731 - RNA, 64 nt, Human
auaaaccugccaagagucaacaggucacuugaucaugcugcaguggguaguucuaaggauggaa

SEQ ID NO: 30732 - RNA, 64 nt, Human
ccuugugggacgucucuuucuauucaauaaacagaugcugcagccucauggcccucaccucuuu

SEQ ID NO: 30733 - RNA, 64 nt, Human
acauauaauuucucaagaaauuuccagaugucucaugcugcauagggcaggagccugaaaagcu

SEQ ID NO: 30734 - RNA, 64 nt, Human
gucucccuccagguuccaagcccugcgucugacgaugcugcagcgccuggagcagcugguggag

SEQ ID NO: 30735 - RNA, 64 nt, Human
aguuaaguucuccuuuugacacuuuauugccuagaugcugcaauguuuuuauguuuccuuuaug

SEQ ID NO: 30736 - RNA, 64 nt, Human
auucuuagcucuuaauuguucauuuugagcugaaaugcugcauuuuaauuuuaaccaaaacaug

SEQ ID NO: 30737 - RNA, 64 nt, Human
guuagcugguuucuaguugguuaucuaguuaccaaugcugcaguccugcagucaccuauacauu

SEQ ID NO: 30738 - RNA, 64 nt, Human
agaagauuaugaaggauuucuauggaggacauaaaugcugcaucuuucauaaucuccauuauca

SEQ ID NO: 30739 - RNA, 64 nt, Human
uucuuuuuucucauuaaauauaaaauauuuuguaaugcugcacagaaauuuucaauuugagauu

SEQ ID NO: 30740 - RNA, 64 nt, Human
uugcuauaacguguguacugaccuuauguggaaaaugcugcaacccuguuuacugccuauguaa

SEQ ID NO: 30741 - RNA, 64 nt, Human
ucgagcagcagaagaauggugugccuacccuuuaaugcugcaguuuaagagaacuuguauugug

SEQ ID NO: 30742 - RNA, 64 nt, Human
auacaaaguaugacaaaauuaucuucauaagaacaugcugcauacuugccuaguagcaaaacaa

SEQ ID NO: 30743 - RNA, 64 nt, Human
aucuucaccagcuucagaaaucugaccuuugccgaugcugcaauaaaguguuguaauuuagauu

SEQ ID NO: 30744 - RNA, 64 nt, Human
gacugucauugccacuaaauuauugagcuagaagaugcugcagggaaaauuguuuugaagcugg

SEQ ID NO: 30745 - RNA, 64 nt, Human
uucggcuguggugcaggugaauggcacgcccguaaugcugcagaccacgugugcugugcacagc

SEQ ID NO: 30746 - RNA, 64 nt, Human
ugaggcaguaagaucacuugagcccaggaggccgaugcugcagugaacugugauuguuccacua

SEQ ID NO: 30747 - RNA, 64 nt, Human
cagcacccaccuuucuuuagccagcugaucagagaugcugcaaagagaaccuuucggaucacuc

SEQ ID NO: 30748 - RNA, 64 nt, Human
auuuugguuagaucuuuuaguauuauguaaauuuaugcugcaauagcuuuugcugcuauuaaaa

SEQ ID NO: 30749 - RNA, 64 nt, Human
cuguugaccuuaagauccauucucauugcugauaaugcugcagcccugcugguuugggcuugcc

SEQ ID NO: 30750 - RNA, 64 nt, Human
ugugguuugcugaccuauuucuaaacuguugaauaugcugcaccauugcugaaaugaaagauga

SEQ ID NO: 30751 - RNA, 64 nt, Human
ccgucucaugcagaagagggaaugagcuuccauuaugcugcagagcuggcagcaauggaugaaa

SEQ ID NO: 30752 - RNA, 64 nt, Human
cuuccagaugguuuguguuuugagguacaaaaaaaugcugcagaucuagaaaugcauauauuua

SEQ ID NO: 30753 - RNA, 64 nt, Human
gaauuauuuauuuucgccaaagcacauguaauaaaugcugcagcccagccucugcccacuuugu

SEQ ID NO: 30754 - RNA, 64 nt, Human
gcugagugacugcaugaugagauacaacuucugaaugcugcacauucuuccaaaaugauccuua

SEQ ID NO: 30755 - RNA, 64 nt, Human
agguagcuauugauauaauuaguuuuaauaaaacaugcugcaaccaugguauacaacaaaaaua

SEQ ID NO: 30756 - RNA, 64 nt, Human
uuauagacuuuauauuuuuccuuuugauaaagggaugcugcauaguagaguugguguaauuaaa

SEQ ID NO: 30757 - RNA, 64 nt, Human
ggcucuucugucggugucccucccacccccauguaugcugcacuggguucucuccuucuucuuc

SEQ ID NO: 30758 - RNA, 64 nt, Human
ccaggcuccagggucccugguuuucugugacaucaugcugcaggacccuguuucucucuuugcu

SEQ ID NO: 30759 - RNA, 64 nt, Human
aaccuuucugaagcuccaugaggacauguauagaaugcugcaccuucagccagcucugcucuga

SEQ ID NO: 30760 - RNA, 64 nt, Human
aucuuccuuaaagcacaaagagagggacuaacugaugcugcaucuagaaaacaccuuuaaguug

SEQ ID NO: 30761 - RNA, 64 nt, Human
aagucuacugggugccuuuacaugccagaggcugaugcugcacuguugaugucaugugaggaaa

SEQ ID NO: 30762 - RNA, 64 nt, Human
ggauaguauaaauaaaaagaaauacagucuagacaugcugcaaggaaagaagauucuaaagucc

SEQ ID NO: 30763 - RNA, 64 nt, Human
caaggccaggacggggcugaggcccugcguggagaugcugcaccagcggaaggcugagacccgc

SEQ ID NO: 30764 - RNA, 64 nt, Human
cucauuuguuuacauguuguuuauggcgacugccaugcugcaagagcagaauugaguaguugug

SEQ ID NO: 30765 - RNA, 64 nt, Human
ggugggcacauaagauuccgaucagaccccaaccaugcugcauguguaaagaaggauugaaaau

SEQ ID NO: 30766 - RNA, 64 nt, Human
caguuucuaagagggacugaggccucuucucagcaugcugcaaaccuguggucucugauacuaa

SEQ ID NO: 30767 - RNA, 64 nt, Human
acaauagaaacacuuagacuuacuugaaaauccaaugcugcaccacuuguaaugaaggcaacac

SEQ ID NO: 30768 - RNA, 64 nt, Human
cuaacauugaagaaauuuugacaauuccgauuugaugcugcaauuacuugcuguuuuuauugau

SEQ ID NO: 30769 - RNA, 64 nt, Human
augcuuaagaauggugcuucucagcucugcuuaaaugcugcaguuuuaaugcaguugucaacaa

SEQ ID NO: 30770 - RNA, 64 nt, Human
uaauucauaauaacuguagaaauggcccuaaagcaugcugcauaauuaauaauuuauauuuuca

SEQ ID NO: 30771 - RNA, 64 nt, Human
cucuucaugagaggccuccuuuucuucaccuuuuaugcugcacuccuccccuaguuuacacauc

SEQ ID NO: 30772 - RNA, 64 nt, Human
uuuguacaaauuucacauuuauuuuacagcaaucaugcugcauuuguguuaguguucuuuauaa

SEQ ID NO: 30773 - RNA, 64 nt, Human
gauccaggauuuguaauuucuugaucuaaacuuuaugcugcauaaaucacuuaucggaaaugca

SEQ ID NO: 30774 - RNA, 64 nt, Human
uccgcugcccacagcccaagccagcccacagcggaugcugcaaaaaucaauaaagucuccccuc

SEQ ID NO: 30775 - RNA, 64 nt, Human
gaauguuaauggucaaugcuagcacaauauuccuaugcugcaauacauuaaaauaacuaagcaa

SEQ ID NO: 30776 - RNA, 64 nt, Human
ccugguugaagguaacguguuccuagaaaagaaaaugcugcauaggaaaacugagaugccuuuu

SEQ ID NO: 30777 - RNA, 64 nt, Human
gaauugucaaccugcauauccuaaaaaugucaaaaugcugcaucugguuaaaugucgggguagg

SEQ ID NO: 30778 - RNA, 64 nt, Human
ccccaaacugcuguggggacauuuuauaaucuauaugcugcacccacuuaaucuacuguggugu

SEQ ID NO: 30779 - RNA, 64 nt, Human
auuuuuuuuuuuuuaaagauaaaagcauggucagaugcugcaaggauuuuacauaaaugccaua

SEQ ID NO: 30780 - RNA, 64 nt, Human
uuuucaaggaugccgucaagacgggguugacacaaugcugcacgugucuggucacacuuagaaa

SEQ ID NO: 30781 - RNA, 64 nt, Human
gcugcaucggaaucuuguccaugcacuguugcgaaugcugcagggcugacugugcagcucucug

SEQ ID NO: 30782 - RNA, 64 nt, Human
gaccgcacagcuccgagguuuggccucuaucguuaugcugcagaucaguuugagcccaaggcau

SEQ ID NO: 30783 - RNA, 64 nt, Human
aucuggaauuugaaaucagaucuguuuagggcuaaugcugcauuuuucuacaacaucaugccuc

SEQ ID NO: 30784 - RNA, 64 nt, Human
guaccaggagauuuucuuaccuucauuugcuuuuaugcugcagaaguaaaggaaucucacguug

SEQ ID NO: 30785 - RNA, 64 nt, Human
aucaaaggguauguuucacuucuugacaauauaaaugcugcagcaaagaugagaggugaaguaa

SEQ ID NO: 30786 - RNA, 64 nt, Human
auuuugauugucacacugggucggguaggaagguaugcugcagacauuugguggguagaggcca

SEQ ID NO: 30787 - RNA, 64 nt, Human
ugugaucaugagugcacaaugaagaagacccuagaugcugcauuuuuuagcucugaagauuccu

SEQ ID NO: 30788 - RNA, 64 nt, Human
aaaugugccuguuggaugagaguaaaaaaauuauaugcugcauaaaugcugaugcaaaaggauu

SEQ ID NO: 30789 - RNA, 54 nt, Human
gagccaaugaaaauguguaaucccaugcugcaugucuucacacauauacagguc

SEQ ID NO: 30790 - RNA, 64 nt, Human
uuuguuaaggaacucuuuuggaauaaagagcaggaugcugcaaaguuaugagucugucccucaa

SEQ ID NO: 30791 - RNA, 64 nt, Human
cacgaaauucccauugacguccugcaggaacugcaugcugcagguguccugcccuuccgcccac

SEQ ID NO: 30792 - RNA, 64 nt, Human
caccauccaggacauucagaagaguucacugcagaugcugcagguaguccucaaaaauggguuc

SEQ ID NO: 30793 - RNA, 64 nt, Human
uuuuuuauuaauaaucggugcugccgggucaugcaugcugcaacucucaacauuucccuuauuu

SEQ ID NO: 30794 - RNA, 64 nt, Human
aaaaauaaauaaauagaaggaaauaaauguaaaaaugcugcaaauuaaaaaccucaaagaaggg

SEQ ID NO: 30795 - RNA, 64 nt, Human
uaaagggauggaugcaaccuagcuuaacaguauaaugcugcaaauuuuccuccauuaucagcca

SEQ ID NO: 30796 - RNA, 64 nt, Human
cuuaugugcagcacucaaucccacuggaagccuaaugcugcagucagaagcaaugccuggcugg

SEQ ID NO: 30797 - RNA, 64 nt, Human
aacuaaaagggugaaucugcuaaauccuuuugaaaugcugcagauuugauaaauauuuauuuua

SEQ ID NO: 30798 - RNA, 64 nt, Human
accuguucuccaucugaacuagacaauggaaauaaugcugcaugcuggccauggcccauucuuc

SEQ ID NO: 30799 - RNA, 64 nt, Human
aagacuagacugucuuauauuaugagauacuugaaugcugcauguaaagccuuuaaagcaaaau

SEQ ID NO: 30800 - RNA, 64 nt, Human
agaauuucccucuuacauaaaccaaugcuugaaaaugcugcaaaugacccucuaaugaucccug

SEQ ID NO: 30801 - RNA, 64 nt, Human
caaaccagugccauccagucuuuaugcaaaugaaaugcugcaaagggaagcagauucuguauau

SEQ ID NO: 30802 - RNA, 64 nt, Human
ccagcacaugauucugaacuugaugcuucguggaaugcugcauuuauauguaagugacauuuga

SEQ ID NO: 30803 - RNA, 64 nt, Human
acaaaauaaaccuuagacauaucacaccuaaaauaugcugcagauuuuauaauugauugguuac

SEQ ID NO: 30804 - RNA, 64 nt, Human
uuacugcuucuagacuguuggcaagaguagcaagaugcugcagcacauugacuauagaaugaga

SEQ ID NO: 30805 - RNA, 64 nt, Human
uuccuuaaagagcccugggguccuguccugcaggaugcugcauaggaaugggcagagauguccu

SEQ ID NO: 30806 - RNA, 64 nt, Human
augaugcgcaacccugcugacuguuucaguuaauaugcugcacaccacacacuuguuuagugaa

SEQ ID NO: 30807 - RNA, 64 nt, Human
cccgguguguggcccagcuuguucaggcccugggaugcugcaucuccaggcaacuaugcacuuu

SEQ ID NO: 30808 - RNA, 64 nt, Human
cccaucuuccacaucuuuaaagcucaugugaaaaaugcugcauuuuuaauaaacugauacauuu

SEQ ID NO: 30809 - RNA, 64 nt, Human
ggacgcucgacuuccaagggucuucucacccguaaugcugcauuacauguaggacuguguuuac

SEQ ID NO: 30810 - RNA, 64 nt, Human
ucuucuuucuuucuuuuuauguuguuugcuguaaaugcugcacauccagauugcauaucaggac

SEQ ID NO: 30811 - RNA, 64 nt, Human
aaaugauggcuauauucauuacuuaccucaaagcaugcugcaagaaaauuaguuaguuacuugu

SEQ ID NO: 30812 - RNA, 64 nt, Human
auuguccaauuuaaacaucaaagucuccaggcuuaugcugcaaagagaauguacggauugauca

SEQ ID NO: 30813 - RNA, 62 nt, Human
uuuuuuuuuuacagaccuaacuaccauaaugaaugcugcauauuaagagaaaccacaagaag

SEQ ID NO: 30814 - RNA, 64 nt, Human
gggguucuguuugaaaaaaaugaggggaucuuagaugcugcagcagaacagucuccagguguuu

SEQ ID NO: 30815 - RNA, 64 nt, Human
auccccacccccagcgacuuccguccuaccuggcaugcugcagcccucugccggcugugguguc

SEQ ID NO: 30816 - RNA, 64 nt, Human
aaaggagacgcugcucccacggaggggagcaggaaugcugcacuguuuacacccugacugugcu

SEQ ID NO: 30817 - RNA, 64 nt, Human
cuggccccucccagcgcugcccucugccguccagaugcugcaguguggccagauuuaccuucca

SEQ ID NO: 30818 - RNA, 64 nt, Human
aggacagucagcauuucuagacuuccacaaaauuaugcugcauuuggcuggagcccgguguuca

SEQ ID NO: 30819 - RNA, 64 nt, Human
cccgggacccaggaccagcaacccgcgaccaaucaugcugcagcccaggggcgucugcugugcc

SEQ ID NO: 30820 - RNA, 64 nt, Human
uauagcucuagcuguuugacuaucuguaaugaaaaugcugcacuucaacugguauuucauuaga

SEQ ID NO: 30821 - RNA, 64 nt, Human
cggcgacagcgcggcucugugaguggcugugaggaugcugcacguccucagcagaguuugcaag

SEQ ID NO: 30822 - RNA, 64 nt, Human
auccccccugcugcccagugcaaaccacuucuccaugcugcaaaggagaagcacagcuccugcc

SEQ ID NO: 30823 - RNA, 64 nt, Human
auggacuuggcggggggacaagacaaagcucccgaugcugcauggggcgcugccagaucucacg

SEQ ID NO: 30824 - RNA, 64 nt, Human
ccucauccucucuaaccuccuuuuucuuuuuuuaaugcugcagccuccacacuccacccacagg

SEQ ID NO: 30825 - RNA, 64 nt, Human
ggcggcugucccugugcauccuuugauuacucucaugcugcauuuacuguuuacauuuguuuua

SEQ ID NO: 30826 - RNA, 64 nt, Human
cuucccuguccuugcccuuuccccccauguuguaaugcugcacuuccuguuuuauaaugaaccc

SEQ ID NO: 30827 - RNA, 64 nt, Human
gcuucuuuuuaaucuuuuguuggggauuaguuucaugcugcacauaaugggguugcacuggucu

SEQ ID NO: 30828 - RNA, 64 nt, Human
agagcaugccugugggagucauggacaugaagggaugcugcaauguaggaaggagagcucuuug

SEQ ID NO: 30829 - RNA, 64 nt, Human
cauccugcuuuaaaacacuccuguuguugguauuaugcugcagaguugugugcuacauaagcua

SEQ ID NO: 30830 - RNA, 64 nt, Human
gggcacuguccccauuuucccacacacagcucauaugcugcauucgugcagggggugggggugc

SEQ ID NO: 30831 - RNA, 64 nt, Human
guaagggaagcccucccgguucccacaggcuaugaugcugcauggcagaggcagguauaacaca

SEQ ID NO: 30832 - RNA, 64 nt, Human
cacacuugacagugguuggcuuugaugaacccucaugcugcaccuucagagccaguccucuagu

SEQ ID NO: 30833 - RNA, 64 nt, Human
guccucuccuaucacccccaaacacucacuuugaaugcugcaugaaucucguggggggucccug

SEQ ID NO: 30834 - RNA, 64 nt, Human
gcaggugccaaaguaauguccacuuuucccuuucaugcugcauauuaacugguuaauuauacug

SEQ ID NO: 30835 - RNA, 64 nt, Human
agagugaagccaauggcgagagaucagguccgaaaugcugcauugcugcaguuuccaccacucu

SEQ ID NO: 30836 - RNA, 64 nt, Human
aacccuccauugccucgccucuauuccagaaucaaugcugcagaauguguuagcugcagauagg

SEQ ID NO: 30837 - RNA, 64 nt, Human
ccuccccuucacuggggacugggguuuucgccccaugcugcaucguguuguauugggauggggc

SEQ ID NO: 30838 - RNA, 64 nt, Human
ggccuucuccccgacaaggaguccgacggggcggaugcugcauccucugccucccuggucgcug

SEQ ID NO: 30839 - RNA, 64 nt, Human
gaggcugguuaggaagcaagaguccugaucuuucaugcugcacaauaugagcaugcaaaaagcu

SEQ ID NO: 30840 - RNA, 64 nt, Human
cugccccagccuguguagcucuuccugcauguggaugcugcaugucuggucuggggcuuggaug

SEQ ID NO: 30841 - RNA, 64 nt, Human
ucucuguaagcauauaaaccacaggcgaaagaggaugcugcauugcgaggacccagaaauucau

SEQ ID NO: 30842 - RNA, 64 nt, Human
ccugggacaucuguaucucuuggcuuuguaauaaaugcugcauacuuucuggagccuguaguuc

SEQ ID NO: 30843 - RNA, 64 nt, Human
uuucuggguggcuuuuuggguccacccagccaggaugcugcaggccaagcugggugugguauuu

SEQ ID NO: 30844 - RNA, 64 nt, Human
aaaacacccaccucuuuuagagaauuauccuuugaugcugcagaaucuacucuuacaaugccuu

SEQ ID NO: 30845 - RNA, 64 nt, Human
agcaggacaucggugcuuugcuguccaucuucccaugcugcaauuucuuccugagauuucuaua

SEQ ID NO: 30846 - RNA, 64 nt, Human
aaacaagccuauuuccuccagccaguuucacugaaugcugcaccacaugcuacaccaguucagc

SEQ ID NO: 30847 - RNA, 64 nt, Human
augucccccuucggcccacucugggggccuggaaaugcugcaguggggagcaggccccaggcug

SEQ ID NO: 30848 - RNA, 64 nt, Human
aacacaaguaaugccuauccauuacuagcaugcuaugcugcaugcuuuacugccauugcuguau

SEQ ID NO: 30849 - RNA, 64 nt, Human
uagcaauuuauugcauuuugaaauaaucauuaacaugcugcaauucaggagcugguuagaacau

SEQ ID NO: 30850 - RNA, 64 nt, Human
cucacaaucuagcugaggagacaagacacauccaaugcugcaaaaauggugaauaaccugauuc

SEQ ID NO: 30851 - RNA, 64 nt, Human
ucuggggcagcacccuauaaaucaacaccuuaauaugcugcaacaaaauguagaauauucagac

SEQ ID NO: 30852 - RNA, 64 nt, Human
agacacagaaacaaacagaaugagcuaguaagcgaugcugcaacuuguuaucuuaacaagaauu

SEQ ID NO: 30853 - RNA, 64 nt, Human
aaaaagagagagcuuccuaggccugggcucuuaaaugcugcauuauaacugagucuaugaggaa

SEQ ID NO: 30854 - RNA, 50 nt, Human
auccaaaguuuauggacuaaaugcugcaggucagcagaaauuugcacuaa

SEQ ID NO: 30855 - RNA, 64 nt, Human
uggggccguggcugaagccggcuccccaaccaaaaugcugcaccaaagcucgggcgccgcgggc

SEQ ID NO: 30856 - RNA, 64 nt, Human
cauccccccaucccuugcaggcugggggcugggcaugcugcaucuuaaccuuuuguauuuauuc

SEQ ID NO: 30857 - RNA, 64 nt, Human
cucccaggccccucugcccaggggugccuuggggaugcugcacugggcagcuacccaccugggg

SEQ ID NO: 30858 - RNA, 64 nt, Human
ccugaaucugccuggauggaacugaggaccaaucaugcugcaaggaacacuuccacgccccgug

SEQ ID NO: 30859 - RNA, 64 nt, Human
ccgauccaggccuccuguggcuguuggguuccagaugcugcagcuccaugugacuuccaagcag

SEQ ID NO: 30860 - RNA, 64 nt, Human
gacaccgugcccgccccaagagcaagcaccggccaugcugcagaggcaagaccucaauucuugg

SEQ ID NO: 30861 - RNA, 64 nt, Human
uaucaauauggugcugguucaaaccagagaauucaugcugcagggaaacucaaucaauguuauu

SEQ ID NO: 30862 - RNA, 64 nt, Human
aaaugcgaugugaucuguaccaggucacccagcuaugcugcaaaguggguuggccaaggcccuu

SEQ ID NO: 30863 - RNA, 64 nt, Human
uaccccaguggucgugggacugucagagcagagaaugcugcaggguuucuaacagaaguuugac

SEQ ID NO: 30864 - RNA, 64 nt, Human
auucuguccauguguucucuggucuucucucacaaugcugcaucccugucccauuuuuaggguc

SEQ ID NO: 30865 - RNA, 64 nt, Human
cugucccauuuuuagggucccugucuaucacuggaugcugcagcuucuguucauuacuguuagu

SEQ ID NO: 30866 - RNA, 64 nt, Human
aucuuccaguucugccagaauuggccuuucccagaugcugcaaacuuccaguugaaccccuuuu

SEQ ID NO: 30867 - RNA, 64 nt, Human
uggaggacagacacaggagaaauaaaaaaagaugaugcugcaggaauccuucuuaaaaauauua

SEQ ID NO: 30868 - RNA, 52 nt, Human
uagguaagcaacguguaugaagaugcugcauuggcccacagaaggcaaaagg

SEQ ID NO: 30869 - RNA, 64 nt, Human
ggcugcccggcagacgacagagaugcugaaggugaugcugcagcagggcgaggccaugcgcugc

SEQ ID NO: 30870 - RNA, 64 nt, Human
gccccacagcccugcucauuccucacgcccuucaaugcugcaggauggacuggccccugaccca

SEQ ID NO: 30871 - RNA, 64 nt, Human
uuaaucauaaagaagcaagaauggucaaaaucgaaugcugcauuuuuauaaacaaaauuacaga

SEQ ID NO: 30872 - RNA, 64 nt, Human
aaggugcucuaagucaugaguguuuuggucucaaaugcugcaguuuuaauaaucugugacuccu

SEQ ID NO: 30873 - RNA, 64 nt, Human
ugcuuagaguuggaagugcagcaggcaggugaucaugcugcaaguucuuucuggaccucuggca

SEQ ID NO: 30874 - RNA, 64 nt, Human
agggucucuucggagacccaggauuuagggucacaugcugcaggcagggcuguggcccagcugg

SEQ ID NO: 30875 - RNA, 64 nt, Human
aguuaauuauggguuuaugagucuguaauguuauaugcugcaaacauuuacuauguaaacguga

SEQ ID NO: 30876 - RNA, 64 nt, Human
gcucaugggaugugcugggccugccuuuggcgccaugcugcagacuccagugggccugguuucu

SEQ ID NO: 30877 - RNA, 64 nt, Human
gggcugguguuugggguuggguuugggguucaggaugcugcagucugugcaauaauaaacccgc

SEQ ID NO: 30878 - RNA, 64 nt, Human
aggccuaagugccagguucccuggcguuggugacaugcugcagccuggaacucugauauccagu

SEQ ID NO: 30879 - RNA, 64 nt, Human
gcagaggcuggggcauuggcaagaucacagguugaugcugcacagccccauugacacaaacccu

SEQ ID NO: 30880 - RNA, 64 nt, Human
uuuuuuguacuuagugaauuuguaugcaacagagaugcugcagcugaugccuuuaaaagguauu

SEQ ID NO: 30881 - RNA, 64 nt, Human
auuuugguuuugcaaaaagacccacuaucaaggaaugcugcaugugcuauuaaaaauuguucca

SEQ ID NO: 30882 - RNA, 64 nt, Human
gcugaaaaugcacaaaguuaugaaaguuaaagguaugcugcaaauaacuagccauuauucuaug

SEQ ID NO: 30883 - RNA, 64 nt, Human
cagaagagaaucaaggccguguccccuuguucuaaugcugcacaccaguuacuguucauggcac

SEQ ID NO: 30884 - RNA, 64 nt, Human
uugucuccgcccgcagcugaggcgcaugcaggagaugcugcagaggaugaagcagcagaugcag

SEQ ID NO: 30885 - RNA, 64 nt, Human
gcccuguucuguuauccaauccgaaacacggaacaugcugcaauucaggagucuggcucucuuc

SEQ ID NO: 30886 - RNA, 64 nt, Human
ugaggagagcagccagaggaaaaccagccccagaaugcugcaacuucucuucucucuggacuuc

SEQ ID NO: 30887 - RNA, 64 nt, Human
ggccucauggucugucuccucuagccuccugcucaugcugcacgggccuccccuccacccugga

SEQ ID NO: 30888 - RNA, 64 nt, Human
auggcaagcaugggggcgggguggguggggagggaugcugcauuucucagcugggcaguaauca

SEQ ID NO: 30889 - RNA, 64 nt, Human
uuuuuuuuuuuaauuuaauuuaauuuuaaaauaaaugcugcauugguaaagcuggcaguugaaa

SEQ ID NO: 30890 - RNA, 64 nt, Human
gccgaauuuacuuguauuccuaacuguuuuguauaugcugcauugagacuuacggcaagaaggc

SEQ ID NO: 30891 - RNA, 64 nt, Human
cagccaggguuuguuuugcgcucuccugucacaaaugcugcacuauugguucuuaaguuuuuua

SEQ ID NO: 30892 - RNA, 64 nt, Human
ucuuacacuguggugaagggauguuuuuuuuguaaugcugcaguagaguuggaguacuuaguuc

SEQ ID NO: 30893 - RNA, 64 nt, Human
agggaacaagcccugggauuggacaaaagggcccaugcugcagccacugacugggggcagagcu

SEQ ID NO: 30894 - RNA, 64 nt, Human
guaagacuuucugaaaacacuugaugauguggaaaugcugcaggauuaaauaacuugaagagcc

SEQ ID NO: 30895 - RNA, 64 nt, Human
acguauacauaggcaucauuucacaaggucaguaaugcugcaggaaaagcaaaauugcaaucua

SEQ ID NO: 30896 - RNA, 64 nt, Human
accucuucuaaaacauaacugucacuuaccugaaaugcugcauccuaaaauuccaaaauuauau

SEQ ID NO: 30897 - RNA, 64 nt, Human
guggcagcgcauuaguuuuggcgcaagcgagccuaugcugcagggucacuuuuggcuggucaga

SEQ ID NO: 30898 - RNA, 64 nt, Human
auuugaaacuuucugucuuaagaugcuucuugacaugcugcauaacuacauaaacagcagaggu

SEQ ID NO: 30899 - RNA, 64 nt, Human
cugaccuggagggaccagcuaaggaagcccugacaugcugcagucggaaguuuccuuuuccgug

SEQ ID NO: 30900 - RNA, 64 nt, Human
aaaaagcuacagcugagaaauaaaauaaaaugucaugcugcagaauauguuauacccuuauuuu

SEQ ID NO: 30901 - RNA, 64 nt, Human
auuaauaauagggaauaaguuugcaacuaaucucaugcugcaaacuuguguuaauucuguuuaa

SEQ ID NO: 30902 - RNA, 64 nt, Human
gcacaaauuaagagagcugauuagacauaggcaaaugcugcaaacuuccaauauguucauaucg

SEQ ID NO: 30903 - RNA, 64 nt, Human
cuccaagggaauagcuugagaaacccaaaguacuaugcugcagucgggggagagguggauugca

SEQ ID NO: 30904 - RNA, 64 nt, Human
ugccgggccagcuccuuaacccaaugacccagugaugcugcaaggcuggaacgggguccaggag

SEQ ID NO: 30905 - RNA, 64 nt, Human
uuacuguuuuacaguuaacucugcuguuugcugcaugcugcaugagacccaggguccugguaag

SEQ ID NO: 30906 - RNA, 62 nt, Human
gagggcggccagggacagacgcuugcgccgagaccgcagagggaagcgucagcgggcgcugc

SEQ ID NO: 30907 - RNA, 62 nt, Human
cugaggaccuccccugaggagggaccguugggaccgcagauucugcagcuggugugggguuc

SEQ ID NO: 30908 - RNA, 62 nt, Human
ugaagaagcauaagcaagacaaaaacagagagaccgcagaaggaggaagauacugugguacu

SEQ ID NO: 30909 - RNA, 62 nt, Human
ggacucaccccaagcaagggaaaauugacuggaccgcagaucauuaccuugaaccacacaga

SEQ ID NO: 30910 - RNA, 62 nt, Human
cacaaaggcagucacugccucgaggggugcagaccgcagaauuuucacagcaggggcucuug

SEQ ID NO: 30911 - RNA, 62 nt, Human
aagacaaagcccacaauuagcuguccuuuaacaccgcagaacccccucccagaagaagagcg

SEQ ID NO: 30912 - RNA, 62 nt, Human
gccacuuugagagacuguucccaggaggcccaaccgcagaccuggcaaguggacagugcagu

SEQ ID NO: 30913 - RNA, 62 nt, Human
ugccaccccagugagauguccccugacccuccaccgcagaaggaaggcagggaggaggcaga

SEQ ID NO: 30914 - RNA, 62 nt, Human
uuacccaucuuuuugaaaacaguguagcgaacaccgcagauuuaaaagaaaaacuagaggga

SEQ ID NO: 30915 - RNA, 62 nt, Human
gcuuacaguggaugccacuucuaggccucuggaccgcagaugcccuccucccuccugcacac

SEQ ID NO: 30916 - RNA, 62 nt, Human
cugucgggggcggggcgguagguccgaaagaaaccgcagacacuacgaugcacuccucaagc

SEQ ID NO: 30917 - RNA, 62 nt, Human
auaugcguguccauccuuaccaaaggauugugaccgcagaccgagguuaguuuaguucugca

SEQ ID NO: 30918 - RNA, 62 nt, Human
acaagccagugcaugcauuaauacuuaguuagaccgcagagagcuggcauucacucaaaugc

SEQ ID NO: 30919 - RNA, 62 nt, Human
uugacccucugucuggucuuccucuagaagguaccgcagaaauugaugugugcucccugccc

SEQ ID NO: 30920 - RNA, 62 nt, Human
gggggaaggugauggggcgggggucccccucaaccgcagacuucaggcugcuuuguccucau

SEQ ID NO: 30921 - RNA, 62 nt, Human
caugccgucucacccacaguaucacacguggaaccgcagacagggcccagaagcuuuagagg

SEQ ID NO: 30922 - RNA, 62 nt, Human
uccagccgggccccucauguauccacuggccgaccgcagagugucccuaccuccucuccaga

SEQ ID NO: 30923 - RNA, 62 nt, Human
gaauuucaguucaucagauguucaccauggccaccgcagaacaccgaaguaauuccagcaua

SEQ ID NO: 30924 - RNA, 62 nt, Human
cuugagcucacgcugcaggauaguacaguuuuaccgcagagggaaucuggaacaguggaauc

SEQ ID NO: 30925 - RNA, 62 nt, Human
cccaaaugaacugccacagcagggacagcuggaccgcagaguuuauuuuuguauuucuacug

SEQ ID NO: 30926 - RNA, 62 nt, Human
ugcuucucuacagacuucuccagacccaccacaccgcagaagcgggacgagacccuacagga

SEQ ID NO: 30927 - RNA, 62 nt, Human
cauggcccagcccaacugcaugucuaucucaaaccgcagaaaggcuuuaauacuggaaaaaa

SEQ ID NO: 30928 - RNA, 62 nt, Human
ccguuugucucagugucccugcaacaagcagcaccgcagacuguaauaaaaggugggguuuu

SEQ ID NO: 30929 - RNA, 62 nt, Human
cucucuucuuguuaaauuagcuaaaucauguaaccgcagauaggaagggcucgccuggggaa

SEQ ID NO: 30930 - RNA, 62 nt, Human
acuuuggggagccacgcuuuugaugugacaguaccgcagagugauucccccacugaggaugu

SEQ ID NO: 30931 - RNA, 56 nt, Human
acaugacuucucacagcuagcaggugaccgcagaaugaccugcugggugcagcagc

SEQ ID NO: 30932 - RNA, 62 nt, Human
acuggaugcacccaggccggcccgagccucccaccgcagacaguguggaacagagugagccu

SEQ ID NO: 30933 - RNA, 62 nt, Human
uaggugcugccuggcccuccccacaaugccagaccgcagagaggcucauccuguagggcacc

SEQ ID NO: 30934 - RNA, 62 nt, Human
uaucguuaagcaaauguacaauaugcucaggcaccgcagagagcugggcacgggcccaugug

SEQ ID NO: 30935 - RNA, 60 nt, Human
ccaagggugccaagcugugaugagagggccaccgcagagcccaggaggcagcaucuccag

SEQ ID NO: 30936 - RNA, 62 nt, Human
ggaggcuugcugaacauggauaucuacauuauaccgcagaguauuugaagucacacuguaac

SEQ ID NO: 30937 - RNA, 62 nt, Human
aguguaaaaaugucccaaguguagccccucccaccgcagagccuguuucuaacguaccugcc

SEQ ID NO: 30938 - RNA, 62 nt, Human
agacggcagagaaagagcaugcauugcucuuaaccgcagaauggcaauaacccccaaaaggu

SEQ ID NO: 30939 - RNA, 62 nt, Human
uacuaagguagagccauagcgccgccugugggaccgcagagcaugcugcguagcucgcgcgu

SEQ ID NO: 30940 - RNA, 62 nt, Human
gugacagccggcccagcguggcgccaccacacaccgcagagcuguccaggcacagcuccguc

SEQ ID NO: 30941 - RNA, 62 nt, Human
ccagauaaccucagggaaccagcacuucccaaaccgcagacuacaucuuuagaggaagcaca

SEQ ID NO: 30942 - RNA, 62 nt, Human
ccuccaagaccuucuccuucaccuuuguccccaccgcagacaggaccagggauuuccaugau

SEQ ID NO: 30943 - RNA, 62 nt, Human
accucuugcuucuaaagaauguauuauaaaacaccgcagauuuuuuuuuuuccuuaaaaaac

SEQ ID NO: 30944 - RNA, 62 nt, Human
aaccugcaggggguuuggaaguggacuuggucaccgcagaagcgugugcgccguugggggaa

SEQ ID NO: 30945 - RNA, 62 nt, Human
aacauugaguacacauggauacaaagaagggaaccgcagacacuggggccuaccugaggucg

SEQ ID NO: 30946 - RNA, 62 nt, Human
gggacagguuucucccuggauacucuuggcccaccgcagaucuguagccagucagaggagga

SEQ ID NO: 30947 - RNA, 62 nt, Human
ggagcuaaaggaagggcaggcccacaggggccaccgcagagccgagucggggcggcaucgug

SEQ ID NO: 30948 - RNA, 62 nt, Human
uccggccagccccgccccugccgaucuacuggaccgcagaccaccuucugcccccgugggcc

SEQ ID NO: 30949 - RNA, 62 nt, Human
gcucucagccagcacuaagggcugaggucaauaccgcagaccuuggggaggaagcugagcau

SEQ ID NO: 30950 - RNA, 62 nt, Human
ucccugcucugagacacaccccuguggcgagcaccgcagaaacgggaagccacuacuuaaga

SEQ ID NO: 30951 - RNA, 62 nt, Human
uggggaacuggcgccaucgccgggacuccagaaccgcagaagccuccccagcucaccccugg

SEQ ID NO: 30952 - RNA, 62 nt, Human
gagacacagcggaccccggccgggcagcggagaccgcagaggcgggcaggguggggcaggcg

SEQ ID NO: 30953 - RNA, 62 nt, Human
gucaugcuguuuugugugcucucuugcuaaagaccgcagagaccauaccuguugucaaagag

SEQ ID NO: 30954 - RNA, 62 nt, Human
cuccgaggacccuuuguguaucuccuccagcuaccgcagagcccacaaacccaggcaucuau

SEQ ID NO: 30955 - RNA, 62 nt, Human
cccugggugggucaggacaaaggccucucaucaccgcagaaagcgggggcuugcagggaaag

SEQ ID NO: 30956 - RNA, 62 nt, Human
guauccuuuauaauaaacugguaaacauuguaaccgcagauucagcccaaucugguucaacu

SEQ ID NO: 30957 - RNA, 62 nt, Human
gccuuagucagcucagacaaccauaagagaauaccgcagaccaaauggcuuagaaauuaauu

SEQ ID NO: 30958 - RNA, 62 nt, Human
aaucagagguuauauaaaaauacugcaaauagaccgcagacauaaauaucuaccaaaugcua

SEQ ID NO: 30959 - RNA, 62 nt, Human
cucagggucugaggaggcugugacgcccuaugaccgcagagaucuagacagucguaacaguc

SEQ ID NO: 30960 - RNA, 62 nt, Human
gcacaggcgccuaggcagaaacuuggagacucaccgcagaggccacgugaacccacggccac

SEQ ID NO: 30961 - RNA, 62 nt, Human
uuuguguccccuaagggguaaaacagccguuuaccgcagauccucucauugugcuuuucuag

SEQ ID NO: 30962 - RNA, 62 nt, Human
ccccagcaguccaaggugugaugugggaagacaccgcagagcucacucaccgggacucgccc

SEQ ID NO: 30963 - RNA, 62 nt, Human
cacacaagugcccaggcaaggugcuuggcagaaccgcagagugggaagagaguaccggcauc

SEQ ID NO: 30964 - RNA, 62 nt, Human
ggcuugaaaucggccaaggugggagcauuuacaccgcagaaaugacaccgcacgccagcgcc

SEQ ID NO: 30965 - RNA, 60 nt, Human
aaaaauauagauaagaaaagguggggcuauacuagcaacaaaaaaagaaugcuguuccug

SEQ ID NO: 30966 - RNA, 60 nt, Human
cagccccuugccccuccucuaagggguuuuacuagcaagcauccuggcugcuggggcuac

SEQ ID NO: 30967 - RNA, 60 nt, Human
acugauauauuucuguacagaguaagaacaacuagcaagguucuuucacuuggaauuacu

SEQ ID NO: 30968 - RNA, 60 nt, Human
uuaaggcaaagauugaaaacaugcuuaaccacuagcaaucaagccacaggccuuauuuca

SEQ ID NO: 30969 - RNA, 60 nt, Human
aaaagugauuuuagcccuaggcccgaaaugacuagcaaauaucauuuucuguaugaauug

SEQ ID NO: 30970 - RNA, 60 nt, Human
uuuguuugggauaaagacucuauccauuguacuagcaaaucuaugggggguaauuuuauc

SEQ ID NO: 30971 - RNA, 60 nt, Human
aaacaaaaugauccaaugaaaacugguuuaacuagcaaaagccuuggcaccuguuggaga

SEQ ID NO: 30972 - RNA, 60 nt, Human
uuucagaaagagccuggcaaggcccuguugacuagcaauggccuuagcugucccacacaa

SEQ ID NO: 30973 - RNA, 60 nt, Human
acgaauuuaaauguuuaaguuauauucaucacuagcaaggaugauaaacacuugugcacu

SEQ ID NO: 30974 - RNA, 60 nt, Human
cucuuccuaauguccuucaaguuuucaugaacuagcaaccccaccuuccaccaugguucu

SEQ ID NO: 30975 - RNA, 60 nt, Human
agcccucuugcaaguguggugagaggcucuacuagcaaagacaugggcaccggaguaggu

SEQ ID NO: 30976 - RNA, 60 nt, Human
gaguuugguagaaauagccuugucaagagaacuagcaagccccugacauuuuuuucuaag

SEQ ID NO: 30977 - RNA, 60 nt, Human
uagccaucuuuucccuuuuuuggagaguagacuagcaaaacucccuuuuuucucuugccu

SEQ ID NO: 30978 - RNA, 60 nt, Human
gaaauggauggaauaaggagggggaacacaacuagcaagaacaaaacauuggguuggcaa

SEQ ID NO: 30979 - RNA, 60 nt, Human
cuuccuauuaagacuuacuugcauugcuggacuagcaaaggaaaauugcacuauugcaca

SEQ ID NO: 30980 - RNA, 60 nt, Human
uuuauaaugcaugaaaacaauuuuaaaauaacuagcaauuaaucacagcauaucaggaaa

SEQ ID NO: 30981 - RNA, 60 nt, Human
auucccaacucauaaauugcuuuccuaacaacuagcaaaagcuauuguucauaauggcau

SEQ ID NO: 30982 - RNA, 60 nt, Human
ugacacaaaagcaaguuugauuuuugcagcacuagcaauggacuuuguuguuuuucuuuu

SEQ ID NO: 30983 - RNA, 60 nt, Human
uauacagucuaaauuuauuauuuaaauuuuacuagcaaaagucuuaggugaacaaucaac

SEQ ID NO: 30984 - RNA, 60 nt, Human
acaauuggaggagaaacaaauauauuucuuacuagcaaaauagaaaauugaauuauuuuu

SEQ ID NO: 30985 - RNA, 60 nt, Human
gagaaacaaacuauuagucugccaguuucuacuagcaaaucaaggaaagagucuacagaa

SEQ ID NO: 30986 - RNA, 60 nt, Human
uuggauuuuuuuuuuuuuuuuuuuuugaguacuagcaaugcacagggaccguguucuuag

SEQ ID NO: 30987 - RNA, 60 nt, Human
gaguacgguauauuuaugguaauuuuauccacuagcaaaucuugauuuaguuugauagug

SEQ ID NO: 30988 - RNA, 60 nt, Human
ugugauuuuuuuuuuacauuuuuucagaugacuagcaauuuugauaguuuauaagauaau

SEQ ID NO: 30989 - RNA, 60 nt, Human
ccuucuaaauuccaaagacuccaacgcagcacuagcaagcagguucgggacagcccugga

SEQ ID NO: 30990 - RNA, 60 nt, Human
aauauacaaaaaugaauuguauuucuuuauacuagcaacaaacaauaugaaaacgaaguu

SEQ ID NO: 30991 - RNA, 60 nt, Human
caagacagcagaagcagacaccuccagugaacuagcaaagaaaagcaaagaaguauucag

SEQ ID NO: 30992 - RNA, 60 nt, Human
ugacauacaagcuucaggguaaaacugucuacuagcaagauuaccucccucaauucuacc

SEQ ID NO: 30993 - RNA, 60 nt, Human
augucaccuagggaacagacauuauagcuuacuagcaaaugaauauucaugccuuguuuu

SEQ ID NO: 30994 - RNA, 60 nt, Human
ccugcugaggccucucagaaaacugagcauacuagcaagacagcucuucuugaaaaaaaa

SEQ ID NO: 30995 - RNA, 60 nt, Human
gacuuaauucaguugcuggugugaacuauaacuagcaaauaauucuauaaacugaauuau

SEQ ID NO: 30996 - RNA, 60 nt, Human
uccacucaauguguagaugguagagcugggacuagcaacauugcugcagcccauuguugg

SEQ ID NO: 30997 - RNA, 60 nt, Human
agaaaagucauaucuccucacauuuuacuaacuagcaauguucauacuuaauaaaaacau

SEQ ID NO: 30998 - RNA, 60 nt, Human
ugcuacuuuaguguuuagcaguguaccaagacuagcaagaguuugcuucaggauuuuguu

SEQ ID NO: 30999 - RNA, 60 nt, Human
ggaauuaaaacuguucagaaugauuuuccaacuagcaaauauaaguaugccugguuaaga

SEQ ID NO: 31000 - RNA, 60 nt, Human
agaggcagcgugaaagcagaugagcuguggacuagcaauauaggguuuuguuugguuggu

SEQ ID NO: 31001 - RNA, 60 nt, Human
cuaacauggaguuaacuggaauagcaguacacuagcaaguaucugugaauccuuagcacu

SEQ ID NO: 31002 - RNA, 60 nt, Human
ggcccauaauacuuguuuuucuuacaugugacuagcaacuuucuccacuuaaagacuaaa

SEQ ID NO: 31003 - RNA, 60 nt, Human
ugaauuaugcaacuguuugcuauuuaguaaacuagcaaaugaugcauguauuuuguuuuu

SEQ ID NO: 31004 - RNA, 60 nt, Human
ucaccuuacucuguauuuauauuacccauaacuagcaagaaguucuuguucuagauuuuu

SEQ ID NO: 31005 - RNA, 60 nt, Human
ugguuuagaaaacauucagccauccuagaaacuagcaauauuuauuuuugccucuuucgu

SEQ ID NO: 31006 - RNA, 60 nt, Human
gacuuucuucaucacugcaacauuucucugacuagcaaugugacgauguaacaaaugaga

SEQ ID NO: 31007 - RNA, 60 nt, Human
uugguguaauuugaagauugccccaucuagacuagcaaucucuucauuauucucugcuau

SEQ ID NO: 31008 - RNA, 60 nt, Human
uacauuaaaagcuuuagauugaaauuuaugacuagcaaacaaaaauagaauauauaaacg

SEQ ID NO: 31009 - RNA, 60 nt, Human
uaaaaaaccuuaaaguugugcuguuccuaaacuagcaaauugcucaugcugaaauuucug

SEQ ID NO: 31010 - RNA, 60 nt, Human
uauuauuacuuggaccuuggucguuuuuauacuagcaaaaugucuuguuuuaauuugugu

SEQ ID NO: 31011 - RNA, 60 nt, Human
uuaacauucaaaacgcagcuccccaaucacacuagcaacauuucaagugcuugagagcca

SEQ ID NO: 31012 - RNA, 60 nt, Human
acacuuuaaauauccuuaauuuuggcaaccacuagcaaaaaaacuugucagaauaauuua

SEQ ID NO: 31013 - RNA, 60 nt, Human
ugacucaaacaauuguaauuuuugaaauaaacuagcaaaaccagaagcagcuagaaauau

SEQ ID NO: 31014 - RNA, 60 nt, Human
uccuuguagaacaucagagaaggcacauugacuagcaaacagcacuuuaggaaaagucac

SEQ ID NO: 31015 - RNA, 60 nt, Human
ucaaguaucuucaguuuugugaauaacaaaacuagcaauauuuuaauuaucuaucuagag

SEQ ID NO: 31016 - RNA, 60 nt, Human
aaacuaaagagcuucugcacagaaaaagaaacuagcaacacaguaaacagacagccugua

SEQ ID NO: 31017 - RNA, 60 nt, Human
agaaaaucccuaagacagaucuugccguggacuagcaauaccugcaagugcugccaaugg

SEQ ID NO: 31018 - RNA, 60 nt, Human
guaacuaagggugcugugcccaacccugcgacuagcaaggcucgcagcaagagcacagcc

SEQ ID NO: 31019 - RNA, 60 nt, Human
aauuuucuauuuuucuugaggugauucucaacuagcaauuggaacuccuaggcucuauua

SEQ ID NO: 31020 - RNA, 60 nt, Human
aaaacuagaggacugaaaaaacaaauuuuaacuagcaaaugcugugaauuacucuuccuc

SEQ ID NO: 31021 - RNA, 60 nt, Human
aaaugaauauauuaauucuagaggggcaaaacuagcaaugcuuaugcaagugacggugcu

SEQ ID NO: 31022 - RNA, 60 nt, Human
uaaauaaaacccaaucauaguaagugauuaacuagcaaaaaguaaagcuauuuauagcaa

SEQ ID NO: 31023 - RNA, 60 nt, Human
aagauugcacacugcacuccagccugggugacuagcaaaacuccaucucaaaaaaaaaaa

SEQ ID NO: 31024 - RNA, 60 nt, Human
gauuugcgguugcuuagaauaaaacuugcuacuagcaaaagaaaaaaaaaaaguucauac

SEQ ID NO: 31025 - RNA, 60 nt, Human
gugcuuuuaacauauuugagaauaaaaaggacuagcaaauaaaacucauuuugcauuuaa

SEQ ID NO: 31026 - RNA, 60 nt, Human
ugagcuaaaaauauaauuuuuuaaaaauugacuagcaaaaucuauggccacacugagaag

SEQ ID NO: 31027 - RNA, 60 nt, Human
acuauuuagagaaccguuguuaauuuuaaaacuagcaaucuauaaagugcaccaggucaa

SEQ ID NO: 31028 - RNA, 60 nt, Human
uuuuacugugacugcacgugguggaaagggacuagcaagcuuaccccauucaugagggcu

SEQ ID NO: 31029 - RNA, 60 nt, Human
ugaauuggcuaaaagacaugcauuuuuaaaacuagcaacucuuauuucuuuccuuuaaaa

SEQ ID NO: 31030 - RNA, 60 nt, Human
agaauugguuuggcugaaucacaacaaauaacuagcaaagcuucagugcuuuugcaaacu

SEQ ID NO: 31031 - RNA, 60 nt, Human
cugaguuuauagcuuaaaggccuaaggagcacuagcaacauuuggcuauauugguuugcu

SEQ ID NO: 31032 - RNA, 60 nt, Human
uauaaaaaguguguauugcuguguaauauuacuagcaaauuuuguagauuuuuuuccauu

SEQ ID NO: 31033 - RNA, 60 nt, Human
cuucugaaaaaaaaaaagagugaagauaguacuagcaaguauacuuauuuuuuaaaacag

SEQ ID NO: 31034 - RNA, 60 nt, Human
cacaugcacuguggcuuaaauaccauaccuacuagcaauggagguucagucaggcucucu

SEQ ID NO: 31035 - RNA, 60 nt, Human
cacccauucauucauuuauucauucacagcacuagcaagugcugccuaugcugagaacaa

SEQ ID NO: 31036 - RNA, 60 nt, Human
auuauaagcauugcagucagaugauauagcacuagcaaagcauucaucccuuuccauaua

SEQ ID NO: 31037 - RNA, 60 nt, Human
ccuagagcacugacuguuaacacaaacgucacuagcaaaguagcaacagcuuuaagucua

SEQ ID NO: 31038 - RNA, 60 nt, Human
ucugacaguaucuccacuuuacuuaagaaaacuagcaaauauaugaaaagacccuuagua

SEQ ID NO: 31039 - RNA, 60 nt, Human
uccagucacuguaugaagugucuccccaacacuagcaaaucuagguccuacuaaauacaa

SEQ ID NO: 31040 - RNA, 60 nt, Human
guugcucaggcuggucucaaacuccugagcacuagcaauccacccaccucuguuuccaaa

SEQ ID NO: 31041 - RNA, 60 nt, Human
cguucuauguaccagguauuuuauuacugaacuagcaacuagccuuuuccaccuuuaaaa

SEQ ID NO: 31042 - RNA, 60 nt, Human
uauccuauuuuaccccuucgugugaaauuuacuagcaaaauuaagcuuucaucaaaguuc

SEQ ID NO: 31043 - RNA, 60 nt, Human
gaguaggcacucuuuaauccauuaccuggcacuagcaacauuagaauuuuaaaauaaaau

SEQ ID NO: 31044 - RNA, 60 nt, Human
aguuuuaaauucugagcuccugagauacugacuagcaaccauggaaugaaugugugacca

SEQ ID NO: 31045 - RNA, 60 nt, Human
aguaaauggggaaucccagcuuucuuuucuacuagcaaaugacccuaccauuuauuucug

SEQ ID NO: 31046 - RNA, 60 nt, Human
cugauuuaaauaauuuguaaaauccugcuaacuagcaaauucacauugagauuuucuauu

SEQ ID NO: 31047 - RNA, 60 nt, Human
agcauauuuugaacuuguaccuuuuuuuauacuagcaacacuacaaaggagaaguuacuc

SEQ ID NO: 31048 - RNA, 60 nt, Human
ugaacuuaauaggaaagcuagcucuugguaacuagcaaugaucaggcauuguuugccucu

SEQ ID NO: 31049 - RNA, 60 nt, Human
uuuuguugaaauucugcaugccuuuaaaucacuagcaaagcaaauauuauaaaguuauau

SEQ ID NO: 31050 - RNA, 60 nt, Human
gcaauggaagacauuuauuuggacaguaauacuagcaaaguugguagauauuugauucuu

SEQ ID NO: 31051 - RNA, 60 nt, Human
ugaagggaacaaucaggacuauuccuagacacuagcaaaaucuagaaaauaaauaacaag

SEQ ID NO: 31052 - RNA, 60 nt, Human
guuuuaugcagugaaucucaguuugaacaaacuagcaacaauuaagugacccccgucaac

SEQ ID NO: 31053 - RNA, 60 nt, Human
gaggcuagaugauugauuaccaagugccggacuagcaagugcuggagucgggacuaaccc

SEQ ID NO: 31054 - RNA, 60 nt, Human
uuucuuuagagcuguauaacuauaguuugaacuagcaaggaaguuauuguuuugacaacc

SEQ ID NO: 31055 - RNA, 60 nt, Human
guuucauuaguaauaguugaggaauaauauacuagcaaagaauggccuaauguuugucau

SEQ ID NO: 31056 - RNA, 60 nt, Human
cauagcccuuccaauucuggguccauuugcacuagcaaauuaaaauaugcuuugauucau

SEQ ID NO: 31057 - RNA, 60 nt, Human
aaccucuagauguguaauuacauggaaaauacuagcaaugugaaugcuuuuguaguaacc

SEQ ID NO: 31058 - RNA, 60 nt, Human
ccauuuagcaaaacgucuuuagucuaugcaacuagcaaaaaucugcauaaugcaacaaca

SEQ ID NO: 31059 - RNA, 60 nt, Human
cuaacucuggaucugucuuaaggugucuccacuagcaaucugagugauggaaucuuaguc

SEQ ID NO: 31060 - RNA, 60 nt, Human
cugcaacacagucaagaauuauacaauccuacuagcaauauauaaggacccaaaaugucu

SEQ ID NO: 31061 - RNA, 60 nt, Human
auagaggugugcauguauaacauggaagcuacuagcaaacugcucccagauguccuuucu

SEQ ID NO: 31062 - RNA, 60 nt, Human
ugccaguauucccagaguuuugguuuuugaacuagcaaugccugugaaaaagaaacugaa

SEQ ID NO: 31063 - RNA, 60 nt, Human
guagaaaaagaaaaaagugaaaaggaaacaacuagcaaaaagaauagccauaagaaaacc

SEQ ID NO: 31064 - RNA, 60 nt, Human
ugauuauuugcauguuauguuuaauaagcuacuagcaaaauaaaacauagcaaauggcau

SEQ ID NO: 31065 - RNA, 60 nt, Human
auugagagcaucgucuuugagaagugaaagacuagcaagaauaaaauaaauuaaguccag

SEQ ID NO: 31066 - RNA, 60 nt, Human
gcuucuuucuagcagugcagggugaaacuaacuagcaaagacaaaaauucaggcaguuug

SEQ ID NO: 31067 - RNA, 60 nt, Human
cagaacaugcuguguuccauacagccuuggacuagcaauuuaugcuucuugggaggccag

SEQ ID NO: 31068 - RNA, 60 nt, Human
caccuuuugcacauggauuccguaccuugcacuagcaaugucuaccuucaguaacgucgu

SEQ ID NO: 31069 - RNA, 60 nt, Human
ucauuuagccuuugauuuucacugauauuaacuagcaaacugcuuuaagucagcucaaag

SEQ ID NO: 31070 - RNA, 60 nt, Human
ucccuccccuccacugcauaaucauguauaacuagcaacauuuaugguuauagguugauu

SEQ ID NO: 31071 - RNA, 60 nt, Human
uugcaaaauggugugcuuuuggggagauacacuagcaauuuuuuuaaaaacuggaacagu

SEQ ID NO: 31072 - RNA, 60 nt, Human
gugucacuauuuauuuuaugcccugaucagacuagcaacuuagauaagugaaaguuuuuc

SEQ ID NO: 31073 - RNA, 60 nt, Human
gucuuguuuaauauuuguuccucuagguaaacuagcaaaaggaugauuuaacauuaccaa

SEQ ID NO: 31074 - RNA, 60 nt, Human
aucuggaggcagagucugccauucugccagacuagcaauuugggggcuuacucaugcuag

SEQ ID NO: 31075 - RNA, 60 nt, Human
ucuccccaaugucuacauuguguuauuuauacuagcaaaaaaauagacacaacuaaaugu

SEQ ID NO: 31076 - RNA, 60 nt, Human
ugauuucuucagcagggucaaaagacaguuacuagcaauggggaaugcuugucacugugg

SEQ ID NO: 31077 - RNA, 60 nt, Human
auuugggagaaacaaggaagggugcacuuaacuagcaaccuaagcaugauuuuucagcuu

SEQ ID NO: 31078 - RNA, 60 nt, Human
gcugaccuggccucuccaaugucuccucgaacuagcaaaagccgcauguccaugaagcug

SEQ ID NO: 31079 - RNA, 60 nt, Human
uuauauuaagaauaucuuagucaucucaaaacuagcaaaauuuaaauuuuggcauguuuu

SEQ ID NO: 31080 - RNA, 60 nt, Human
caacauuacccaacuauagaagagaggcuaacuagcaacaauaauagaugauuucagcca

SEQ ID NO: 31081 - RNA, 60 nt, Human
aagcuuguuggaaauaauguacccauguagacuagcaaaauaguauguagaugugaucuc

SEQ ID NO: 31082 - RNA, 60 nt, Human
uuugggcaauagcauugugaguggcuuccaacuagcaacccucucuggccccauguguga

SEQ ID NO: 31083 - RNA, 60 nt, Human
cccagugauucacugccaucccaggccuuaacuagcaaaacuacggagcgugccaaguga

SEQ ID NO: 31084 - RNA, 60 nt, Human
auauuagaaagauucuucccacagggaagaacuagcaagugucccaauuuuuuccaaacg

SEQ ID NO: 31085 - RNA, 60 nt, Human
gugcauugucugugacaugcaacuuacaaaacuagcaauuguaacaauaaaucacagcca

SEQ ID NO: 31086 - RNA, 60 nt, Human
aaacaucuaccuuuuuucauaggaguagacacuagcaagcuggacaaacuaucacaaaag

SEQ ID NO: 31087 - RNA, 60 nt, Human
uggcaauaggaugagguuucuucaggguaaacuagcaaugccugagccugaaccuuaaug

SEQ ID NO: 31088 - RNA, 60 nt, Human
gcaaacuuucaaaggugguuauuauaacauacuagcaauggaccuuacuacuguaaggaa

SEQ ID NO: 31089 - RNA, 60 nt, Human
uaaaacgugaacucuguaauucuauguguuacuagcaaccggaaaagcccacuguguuuu

SEQ ID NO: 31090 - RNA, 60 nt, Human
ggacuagaccuguacuaauauaugguagucacuagcaaccuguugagcacuugaaauuga

SEQ ID NO: 31091 - RNA, 60 nt, Human
acguuucuggaacugucugaauauucuagaacuagcaaaacaucuuuuccugauggcugg

SEQ ID NO: 31092 - RNA, 60 nt, Human
aggccuaaauaauuaaaaacgguccuaaaaacuagcaaaccagauaagaaaagauguuaa

SEQ ID NO: 31093 - RNA, 60 nt, Human
ggaaacagcauuugccuucugagagaagagacuagcaaaaagcugcagagaggauucggc

SEQ ID NO: 31094 - RNA, 60 nt, Human
aauaaacugaauuucauauguucuaaaaugacuagcaaugguuuaaaaaggaagaagagu

SEQ ID NO: 31095 - RNA, 60 nt, Human
uuucauucauaucccugcugaaauauugguacuagcaacuuaaaguuggcaagucucauc

SEQ ID NO: 31096 - RNA, 60 nt, Human
ggggaggagggaaaagcuucagacuuuuaaacuagcaaaacaguuauuucucugcauuca

SEQ ID NO: 31097 - RNA, 60 nt, Human
uaacauuagaugucaugaggaaacuacugaacuagcaauugguuguuuaacacuucugua

SEQ ID NO: 31098 - RNA, 60 nt, Human
ccaguuguaauguauaagcaugcacuucauacuagcaaucacagcacaggaggacagcau

SEQ ID NO: 31099 - RNA, 60 nt, Human
gauggauaaauugacaacucuguaggauuuacuagcaagcuaauggaaacaugauuuucg

SEQ ID NO: 31100 - RNA, 60 nt, Human
aaugcuucaggguuuucuuuguugagaacaacuagcaacaaaggcaacccaugugugacc

SEQ ID NO: 31101 - RNA, 60 nt, Human
aagaacaaugguaacuaaaagcugcauauaacuagcaauaacuacauugaacggugugca

SEQ ID NO: 31102 - RNA, 60 nt, Human
acaaaauauaaaucacagauuuccaaaaguacuagcaauaaguugaaugauaauagcuca

SEQ ID NO: 31103 - RNA, 60 nt, Human
uguauggguuucuucagcccuuuuucugccacuagcaaccagaauagcacuuuaccuuuu

SEQ ID NO: 31104 - RNA, 60 nt, Human
cuaaacagcaguuaaguugucucuaaaugaacuagcaaaaaaaaaaaauguaguuuuugu

SEQ ID NO: 31105 - RNA, 60 nt, Human
agggaaauggauuacuguaaugaacugaucacuagcaauaguguguaucccgaugugugu

SEQ ID NO: 31106 - RNA, 64 nt, Human
uagaaucugcagaaauuaggaggcaccgagcccagcgcagcagccucggacccggauugcguuu

SEQ ID NO: 31107 - RNA, 64 nt, Human
aaucucagggauagccagcagcagcuccaggucugcgcagcaggaauuacuuuuuguuguuuuu

SEQ ID NO: 31108 - RNA, 64 nt, Human
cagcuguuccccucgggaacaugagguggugguggcgcagcagacugcgaucaauucugcaugg

SEQ ID NO: 31109 - RNA, 64 nt, Human
cauguaugugcagacucuuggaugcuuuaugccugcgcagcaggagcccuguccucacguuccc

SEQ ID NO: 31110 - RNA, 64 nt, Human
ccacacagaacuucugagaggggcuguuagcauugcgcagcaucuucaguucuccaguaaauga

SEQ ID NO: 31111 - RNA, 64 nt, Human
cuagccccaggguuagagugggcagggcagagccgcgcagcaccugggagcgguaccuuucccu

SEQ ID NO: 31112 - RNA, 64 nt, Human
cguuucagcccucauuuaauucaauuuguaaguagcgcagcagccucugugggggaggauaggc

SEQ ID NO: 31113 - RNA, 64 nt, Human
uacagagcuuucaagaacacacaaugcaaagugagcgcagcauagcuguuaacaaacauacaac

SEQ ID NO: 31114 - RNA, 64 nt, Human
uggucuaggggaauccugccugccccauggaguugcgcagcacaacccuggcuccaauugccag

SEQ ID NO: 31115 - RNA, 64 nt, Human
ugccgggacacugcugccagaccugcccccaggagcgcagcaguucggagcggcagccgagcgg

SEQ ID NO: 31116 - RNA, 64 nt, Human
acccagcccuacacuuugguuugucauggugucagcgcagcagccuacaacuaaguuccuaaac

SEQ ID NO: 31117 - RNA, 64 nt, Human
ggcgcuaggaaaugacccgagaaccccguuggaagcgcagcagcgggagcuaggggcgggggcg

SEQ ID NO: 31118 - RNA, 64 nt, Human
gggccgcgcuccuccccuccuagaguucguggaggcgcagcagagggccgucccucuuccggau

SEQ ID NO: 31119 - RNA, 64 nt, Human
cccucuaaacucccuuacagcucucagccuaagagcgcagcacugaacagccucaucauuccac

SEQ ID NO: 31120 - RNA, 64 nt, Human
cuucccacugcuuagagcgagagcagagcaaacugcgcagcaggcaccuccagaaagguaaugg

SEQ ID NO: 31121 - RNA, 64 nt, Human
ggcgaugacaagucugaacccacgaaaauacccagcgcagcaucuacacauucaaaagauaagc

SEQ ID NO: 31122 - RNA, 64 nt, Human
aucuccacgcuagugugaacgccucugucccgaggcgcagcaauaauaaggcagcuguugaaug

SEQ ID NO: 31123 - RNA, 64 nt, Human
ucccugaauccgugugcacacugcguauguguacgcgcagcaugcuauacugaacucaacaaga

SEQ ID NO: 31124 - RNA, 64 nt, Human
gcagccucuuggagcagagugccccguggcaggagcgcagcaccaugucccugccccccgggcu

SEQ ID NO: 31125 - RNA, 64 nt, Human
cgacgcgcucaacuucuucugugagcagcugcgggcgcagcagcggaguucgcuccaggagaag

SEQ ID NO: 31126 - RNA, 64 nt, Human
gcagggcagcuuuccccaccuggugacaggcugugcgcagcagccccaggaccucacccugagc

SEQ ID NO: 31127 - RNA, 64 nt, Human
aacuccauauauguuagucuuccuuuaucuuacagcgcagcauuuauuuuaugauauaaugaaa

SEQ ID NO: 31128 - RNA, 64 nt, Human
ucagguugauacugccuggauggucaccucuggugcgcagcaagugcaaagccagugggggacu

SEQ ID NO: 31129 - RNA, 64 nt, Human
gugcuuucugugaaagccuuaagaagauaaaugagcgcagcagagauggagaaauagacuuugc

SEQ ID NO: 31130 - RNA, 64 nt, Human
auagccacguggccagcagcuaccacacuggucagcgcagcaccugaggaaaugcacugugugg

SEQ ID NO: 31131 - RNA, 64 nt, Human
aaggauaaaaaaaaaaaaaaacaacuaauaccgggcgcagcaucuuuccagguguggcucugcg

SEQ ID NO: 31132 - RNA, 64 nt, Human
ccuuagcacauccagucccagcguggcccuuggcgcgcagcagcaggcgaacucccagaaggug

SEQ ID NO: 31133 - RNA, 64 nt, Human
cacacacacaaaauaaagacacacaaggacgucugcgcagcaagaaaagaaucucaguugccaa

SEQ ID NO: 31134 - RNA, 64 nt, Human
ucugaucagagccgacaccagacgugauuagcaggcgcagcaaauucaauuuguuaaaugaaau

SEQ ID NO: 31135 - RNA, 64 nt, Human
cagguaaccccagauucaugcacuguagggugcugcgcagcaucccuagucucuacccaguaga

SEQ ID NO: 31136 - RNA, 64 nt, Human
uccaauggugccaaacccuucaucuccccaagaagcgcagcauaccccugggaccccucggcca

SEQ ID NO: 31137 - RNA, 64 nt, Human
cggggccucucucccucucccuguccccaccccagcgcagcagcccuccccgcagcuagcagcg

SEQ ID NO: 31138 - RNA, 64 nt, Human
gggcccaggcagcucggacaccaggcugagcccggcgcagcaccugggcaguguccccacccca

SEQ ID NO: 31139 - RNA, 64 nt, Human
uaaaugagauaacugggggcaaagguugggauaggcgcagcagcuauaagacaagcuccuacgc

SEQ ID NO: 31140 - RNA, 64 nt, Human
uccgccaagcugggggcaucggcaaggccaagcugcgcagcaugaaggagcgaaagcuggagaa

SEQ ID NO: 31141 - RNA, 64 nt, Human
cccaccuggccucugcacuccccugcuggguguggcgcagcauauucaggaagcucagggccug

SEQ ID NO: 31142 - RNA, 64 nt, Human
aacugcccaucgggacgcccggccagccgcucgggcgcagcacaagggacaggggaccaagguc

SEQ ID NO: 31143 - RNA, 64 nt, Human
agcggauccgccaggcugagacccuggagcaagugcgcagcaucauggaugaggcgccacucac

SEQ ID NO: 31144 - RNA, 64 nt, Human
cccagugagaccggaggaugaucccccaaggacugcgcagcaucagcucuuggugggccucugc

SEQ ID NO: 31145 - RNA, 64 nt, Human
cucucuguguccucugcaguggggguuguggggggcgcagcauccacgccuugcugcccuucuu

SEQ ID NO: 31146 - RNA, 64 nt, Human
ugaagaauggaaguuuggaucugcuccucgucaggcgcagcaucucugaagcuuggaaagcugu

SEQ ID NO: 31147 - RNA, 64 nt, Human
ugccaacacaaguaggauugacuuaaacucuuaagcgcagcauauugcuguacacauuuacaga

SEQ ID NO: 31148 - RNA, 64 nt, Human
ugaacagacagacagacgcacacacacaacagaugcgcagcaacuccccgcccagggaccccuc

SEQ ID NO: 31149 - RNA, 64 nt, Human
gccagcucucccagccccucagcuucgcagccuggcgcagcauccucugaggccccggggccug

SEQ ID NO: 31150 - RNA, 64 nt, Human
cuuccacccuacagcuggccucggaccccgcccugcgcagcaagcugguccgccuguccuccga

SEQ ID NO: 31151 - RNA, 64 nt, Human
gagaccaggucccaagggagcaagaccucgcgaagcgcagcagccccggcccuucccccguuuu

SEQ ID NO: 31152 - RNA, 64 nt, Human
acguggccuuuucccacagugcuuccuucucacugcgcagcaaaguucguccccuguggcaaga

SEQ ID NO: 31153 - RNA, 64 nt, Human
gcuucuuagaagaggagugagaggaaggcggggggcgcagcaacgcaucguguggcccuccccu

SEQ ID NO: 31154 - RNA, 50 nt, Human
augucgccuacaacaugugagcgcagcacaccggcccaggugccggagau

SEQ ID NO: 31155 - RNA, 64 nt, Human
accaggggccucaugaaucucuccguugcccuccgcgcagcaggaggcugccuguguguuuccu

SEQ ID NO: 31156 - RNA, 64 nt, Human
agccauuccuauuaccuccccaggaggcaagugggcgcagcaccagggaaauguaucuccacag

SEQ ID NO: 31157 - RNA, 64 nt, Human
ccuggucggccacaccagugucccaaagaggagagcgcagcagagccaggggucuguucuguag

SEQ ID NO: 31158 - RNA, 64 nt, Human
uggccguuugcugcgucuagggguguucuauguagcgcagcaguucgcagcgauugcgcagugc

SEQ ID NO: 31159 - RNA, 64 nt, Human
uuuucuccucaccuaaacccaucuccuacuuugggcgcagcacacauauuuucuugucaacuuu

SEQ ID NO: 31160 - RNA, 64 nt, Human
uccuggcacuaccaaaggacacuuauccacgagagcgcagcauccgaccagguugucacugaga

SEQ ID NO: 31161 - RNA, 64 nt, Human
uccgugucucuuaucaguggcguuucucacgucugcgucucagaucuaacgugguuucacauca

SEQ ID NO: 31162 - RNA, 64 nt, Human
gcagcacuggugugaaugaaagagagacccagccgcgucucacacagguggaauugcacuucuu

SEQ ID NO: 31163 - RNA, 64 nt, Human
ucuuuaaaagaaaguuagguuauaagaaacagaggcgucucacauuuuuacuugguguaauuaa

SEQ ID NO: 31164 - RNA, 64 nt, Human
gccgcaggccccacccucaagcauuccucaggaagcgucucacucugggagccuuggcccugcu

SEQ ID NO: 31165 - RNA, 64 nt, Human
ccagugcacuccaggcgggugacagagcaagacugcgucucaagaaaaaaaaaaaaaaaaagaa

SEQ ID NO: 31166 - RNA, 64 nt, Human
gguaucggccgucacucagcucuccugugccccugcgucucacccuaggcgggcugggcggggc

SEQ ID NO: 31167 - RNA, 64 nt, Human
gagauggucucaagucagagggaagcagagacgcgcgucucaagccugcccuuccuagacggcc

SEQ ID NO: 31168 - RNA, 64 nt, Human
gcguccuuguuugcugaggggugggagccacccagcgucucagggaccugucccuccgucacgu

SEQ ID NO: 31169 - RNA, 64 nt, Human
ggaagguggggccacgcugcaggcaggucucacugcgucucaugaggccgcugccgcugcugca

SEQ ID NO: 31170 - RNA, 64 nt, Human
ucauggguugugacuggaagcugaccuuagucuugcgucucauccuuuaugauguugagaaauc

SEQ ID NO: 31171 - RNA, 64 nt, Human
aaaggcucagaccgaccgauggcaagaucugcaagcgucucaaagcccaggcagaaaaggacuu

SEQ ID NO: 31172 - RNA, 64 nt, Human
uuaaaucuguaaucaccggcuauuucuaaagucagcgucucaccuuccugcccacugcccucgu

SEQ ID NO: 31173 - RNA, 64 nt, Human
agccuggcuguaguagcgagugaucuggcggggggcgucucagcacccuccccagggggugcau

SEQ ID NO: 31174 - RNA, 64 nt, Human
acaagaauguggugguggcugacuucgggcuggcgcgucucaugguggacgagaagacucagcc

SEQ ID NO: 31175 - RNA, 64 nt, Human
ucaccucccuucuguuaucgcugacagcuuucuugcgucucauuugucgccgagccccgagcgc

SEQ ID NO: 31176 - RNA, 64 nt, Human
guccaagguggaacagaccucuuugccuuucccagcgucucauacccccgguagugcagcugug

SEQ ID NO: 31177 - RNA, 64 nt, Human
cguuaguucaucguuugccuagcaugucccuguggcgucucaaaaaaaaguuucaucgucccgu

SEQ ID NO: 31178 - RNA, 64 nt, Human
ccgacuguggggggcgggcugggaggugggagccgcgucucaggcccggccguuaucaaggccc

SEQ ID NO: 31179 - RNA, 64 nt, Human
ccuggauaauguuuccaggguguugggaaggccugcgucucaggucacaguuguggguguggcc

SEQ ID NO: 31180 - RNA, 64 nt, Human
aagggggcccccuuucccugcccgcuggggagcggcgucucagugaaaucggcuuucuccucag

SEQ ID NO: 31181 - RNA, 64 nt, Human
aguggauccgaauguucucaacuccugaacugcagcgucucaucucuggcgacaaugcugagau

SEQ ID NO: 31182 - RNA, 64 nt, Human
ucuggcgagggcagaccccaggggaaagcaaagggcgucucagggaacccccacauucucucac

SEQ ID NO: 31183 - RNA, 64 nt, Human
gacacugggaguggcugguauguuggggcccugugcgucucaguguagggaucagacgaaagug

SEQ ID NO: 31184 - RNA, 64 nt, Human
cagaagccccaggaagggguauuuccaacacuuggcgucucaaugaggauaaaagggagggacu

SEQ ID NO: 31185 - RNA, 64 nt, Human
ccacguuccacucgcccugccuguuguucaguuugcgucucagugcugacucacgggcaugcuu

SEQ ID NO: 31186 - RNA, 64 nt, Human
gucuauggagccccgccuugugagccaggaagcagcgucucaucaggacagaagguaggaugaa

SEQ ID NO: 31187 - RNA, 64 nt, Human
accccccgccacacacacacacaaacgugcacacgcgucucauuugaccccuuugcuuccagag

SEQ ID NO: 31188 - RNA, 64 nt, Human
uguuuguuuuuuuuguuguuguuguuuuugaggcgcgucucacccuguugcccaggcuggagug

SEQ ID NO: 31189 - RNA, 64 nt, Human
gcagagugagucacggcccagacugggcaccuucgcgucucagccucagggagccccacagccc

SEQ ID NO: 31190 - RNA, 64 nt, Human
uggugacguuacguuaucccaggugagguggaaagcgucucaccuggaaccugauauaacucag

SEQ ID NO: 31191 - RNA, 64 nt, Human
ccuggaagcagagcaaaaugcucuugucccugucgcgucucauuuuguccaugucccccgugca

SEQ ID NO: 31192 - RNA, 64 nt, Human
caugaaguggaaaaaggagagcaaacugcucagcgcgucucagcucagugccgaggaggaggaa

SEQ ID NO: 31193 - RNA, 64 nt, Human
uguuccuuaaaaagaagauggaauucucuguagagcgucucaauccacuuuuaaccauggauga

SEQ ID NO: 31194 - RNA, 64 nt, Human
cuggagugguggggccauggcaagagacaccguggcgucucaugugaacuuuccugggcacugu

SEQ ID NO: 31195 - RNA, 64 nt, Human
uauucuuuuuuuuuuuuuuuuuuuuuugagacaagcgucucacucugucgcccaggcuggagua

SEQ ID NO: 31196 - RNA, 64 nt, Human
agccaggauuuuuuuauuuuuauuuuuugagauagcgucucacucugucacccaggcuggagug

SEQ ID NO: 31197 - RNA, 64 nt, Human
ggaacaauuuccaaaacuguccagggcggggguugcgucucaaucucccuggggcacuuucauc

SEQ ID NO: 31198 - RNA, 64 nt, Human
gcccagugaacugacccuucaggcugagugugaagcgucucagaggcauuucagaaccugagcu

SEQ ID NO: 31199 - RNA, 64 nt, Human
ccaguguucccgauuuacuaaaauagguaaccaggcgucucacagucgccguccugucaagagc

SEQ ID NO: 31200 - RNA, 64 nt, Human
cggggccgugugaacggugaugaauguugaaaaugcgucucagagagguauucacaugaacuuu

SEQ ID NO: 31201 - RNA, 64 nt, Human
cauuggccgaguuauggagcgcuccgaccagacagcgucucauuggccaaagaugggaggguuc

SEQ ID NO: 31202 - RNA, 64 nt, Human
cuauuggccgggcaccgcgcggcuagcggagguugcgucucauuggcucagguccugcagccgc

SEQ ID NO: 31203 - RNA, 64 nt, Human
aguguguccccuguccccaccugaguggggaggagcgucucaagugaacagugggagccugccc

SEQ ID NO: 31204 - RNA, 64 nt, Human
aagugguacuaacuuuccuucauucaacccaccugcgucucauacucaccucaccccacugugg

SEQ ID NO: 31205 - RNA, 64 nt, Human
gccugugguggaggguggucaguuguagcccugugcgucucaaggcugccuugugaggccauuc

SEQ ID NO: 31206 - RNA, 64 nt, Human
gaagccccgcugcugagaugggcgcucccgacacagcgcagacccaccaggaggaaagaggccc

SEQ ID NO: 31207 - RNA, 64 nt, Human
gugaauggugagggugggagucaggagacaagacagcgcagagagggcugguuagccggaaaag

SEQ ID NO: 31208 - RNA, 64 nt, Human
uugcucccacauggucaggucucacccugcuugaagcgcagaaggcacagccuuacugaccagc

SEQ ID NO: 31209 - RNA, 64 nt, Human
gucccuggcugaagggaauuaacagauaguaucaagcgcagaaggaaugugccaguauggcucc

SEQ ID NO: 31210 - RNA, 64 nt, Human
ccuacuaacccuuuaacauacaguuuaggguccuagcgcagaguccuuguuuaaaggucauuga

SEQ ID NO: 31211 - RNA, 64 nt, Human
ucaaggucacacaauuggauagugacauagcuagagcgcagaguuccugauuccaagucaccug

SEQ ID NO: 31212 - RNA, 64 nt, Human
cucaggauggggaauagccaagaauggcagccucagcgcagaggcaaggucagaaagagacggc

SEQ ID NO: 31213 - RNA, 64 nt, Human
ccuccaccuggaccagggagggccuccaugugcaagcgcagaggaagagacccucccauguacg

SEQ ID NO: 31214 - RNA, 64 nt, Human
ucuccagcucucuuggcagggccuuuauuuaaagagcgcagagauuccuaugucucccuagugc

SEQ ID NO: 31215 - RNA, 64 nt, Human
guuguugagucuguuuuguaaaguccccagagaaagcgcagaugcuagcacaugcccuaauguc

SEQ ID NO: 31216 - RNA, 64 nt, Human
caacaaugccccgagugguggcagccaggagagcagcgcagaacagcccagaaaaggcggugcu

SEQ ID NO: 31217 - RNA, 64 nt, Human
aaagacaccagccacucagaguucuauacuguaaagcgcagauaacauuuguguguuauaccuu

SEQ ID NO: 31218 - RNA, 64 nt, Human
ucagagcugugagcggggggcgccguccaggccgagcgcagacuguuuaggacucagcagaccc

SEQ ID NO: 31219 - RNA, 64 nt, Human
gaagucaauaauuuccagugagcgggaggcuucaagcgcagacccugggucccuagaccucgcc

SEQ ID NO: 31220 - RNA, 64 nt, Human
ucccaccuccagggaggacgcuucgucuucggccagcgcagaccugguguuuguuuguugggcu

SEQ ID NO: 31221 - RNA, 64 nt, Human
agggcccggggcggaggugcgaccgggcgucggcagcgcagaccucuuggccuucucucacagg

SEQ ID NO: 31222 - RNA, 64 nt, Human
guaugccaucauggaagggguggcauugggauggagcgcagauauccaggcaagcauacuaaaa

SEQ ID NO: 31223 - RNA, 64 nt, Human
auagcuuuucccuguccugacaccaggcaagaaaagcgcagagaaaucggugucugacgauuuu

SEQ ID NO: 31224 - RNA, 64 nt, Human
gggcauucaggcaagugcaagugguucaggggccagcgcagagcagagugcugaguaaagaugu

SEQ ID NO: 31225 - RNA, 64 nt, Human
cauuaacuggaucauugcuuccccagggcaggagagcgcagagcuagggaaagugaaagguaau

SEQ ID NO: 31226 - RNA, 64 nt, Human
ucagcagggacagcacagacccucuggcuggggcagcgcagacccucuagcuggggcagaacaa

SEQ ID NO: 31227 - RNA, 64 nt, Human
ugugcucuggugacccgaggaggucgugcagcacagcgcagaagccccugcccacgggauccgg

SEQ ID NO: 31228 - RNA, 64 nt, Human
ccgcccaccacggcugugggaacuuccaggccucagcgcagagcccugcuuggggccagcacgg

SEQ ID NO: 31229 - RNA, 64 nt, Human
cggcgccagagcugggcucuucaacacggcauuuagcgcagaaagucgugguucaggcaguaug

SEQ ID NO: 31230 - RNA, 64 nt, Human
cuguuuuguccuuugagaaagaaauaauuguuugagcgcagaguaaaauaaggcuccuucaugu

SEQ ID NO: 31231 - RNA, 64 nt, Human
cacgcuggaagcccacccaagccggcggggcccuagcgcagaaauucagaacccccuguccuga

SEQ ID NO: 31232 - RNA, 64 nt, Human
acucgagagggggaggggguaaggagcgcaccaaagcgcagagcuugcugcccgccgcacgcac

SEQ ID NO: 31233 - RNA, 64 nt, Human
uaagagguauuggauuuucacagaggaagaacacagcgcagaaugaagggccaggcuuacugag

SEQ ID NO: 31234 - RNA, 61 nt, Human
gagaggcaguggcacacugaugggcgagcugagcgcagagcugcgaaggggaacuguuugc

SEQ ID NO: 31235 - RNA, 64 nt, Human
ccagcuucccugaugucugcagccauggcuuugcagcgcagacagagcuucucugggaugcugg

SEQ ID NO: 31236 - RNA, 64 nt, Human
gaccccagccuuccuggaacagggagucugcaggagcgcagacaggcacagcccuggagcaggc

SEQ ID NO: 31237 - RNA, 64 nt, Human
cagcucagucagcccucggggacgagaaaccacaagcgcagagacgcugaggcccaggcaggug

SEQ ID NO: 31238 - RNA, 64 nt, Human
guacauagaggaaaccugggcuagccccacccagagcgcagaggagggggcaccgacagcgcug

SEQ ID NO: 31239 - RNA, 64 nt, Human
augacaaccugugaugucucacaguagagcacuuagcgcagaaucagguccccacggcuguugc

SEQ ID NO: 31240 - RNA, 64 nt, Human
acaguucuggaugcugggaaguccaaguucaaggagcgcagauucaaugucuggugagggccca

SEQ ID NO: 31241 - RNA, 64 nt, Human
cccuccucucccgcaggucugaaguuggccccccagcgcagaguagcugcuuccuggacgugcg

SEQ ID NO: 31242 - RNA, 64 nt, Human
uccuugcgcucaccuugccagaaagucugguggcagcgcagagcccaaucauuccaaccaaagc

SEQ ID NO: 31243 - RNA, 64 nt, Human
ggccugggugggggccggaaugagaccacaugagagcgcagagagguggguggucaggcccuga

SEQ ID NO: 31244 - RNA, 64 nt, Human
aaagcauuauuacugauacuugcacacagucaaaagcgcagacuggauggauggucuuuuauaa

SEQ ID NO: 31245 - RNA, 64 nt, Human
ccccaccuuuccgauagucuguuagaauuuuauuagcgcagauuccugggccaugccggguacc

SEQ ID NO: 31246 - RNA, 64 nt, Human
ucagccgugggcccgggcgcggggaggccggcgcagcgcagagcgggcucgaagaaaauaauuc

SEQ ID NO: 31247 - RNA, 64 nt, Human
aaaugcugcuuccauaucagcugcugcuagcgccagcgcagacucucagggagucaccacagcu

SEQ ID NO: 31248 - RNA, 64 nt, Human
agccgcagccuuugggagggagaagagaaggaagagcgcagagccggcaaagugagaugcacgc

SEQ ID NO: 31249 - RNA, 64 nt, Human
caugagaguacuagccuccuccacuccuccccacagcgcagaggaaacaggccagcccagugac

SEQ ID NO: 31250 - RNA, 64 nt, Human
accccaucccucuggugugagccguggcagccgcagcgcagacuggcggagaaggagaggaacg

SEQ ID NO: 31251 - RNA, 64 nt, Human
aacacuccaccgcgaucugccugcgggggaucucagcgcagagaaguugagaggacccaugaag

SEQ ID NO: 31252 - RNA, 64 nt, Human
gucgagaaucgucagcuguaaguaggagcuacacagcgcagagaaaauggaaccacccauccgu

SEQ ID NO: 31253 - RNA, 64 nt, Human
ccacacgcccgcggugaucccagccagggccccgagcgcagaggcggagcugugcucagcacag

SEQ ID NO: 31254 - RNA, 64 nt, Human
gugcugcugcgcgcgcuucgccugugcgggagccagcgcagagcuuggcugcgccggggguucc

SEQ ID NO: 31255 - RNA, 64 nt, Human
ccagacucccucauuuuaccaucaaggaaucucaagcgcagagagggagagaauucuccacaaa

SEQ ID NO: 31256 - RNA, 64 nt, Human
acagaguguucuggcaaagaggaaaucccacagcagcgcagaggaccugggccuggaggggcag

SEQ ID NO: 31257 - RNA, 64 nt, Human
ucaggaaagaggucggggcuggacagauggggagagcgcagauagauuuaagagaguccuguga

SEQ ID NO: 31258 - RNA, 64 nt, Human
uggggacguggggcagccaccccugcccagcgagagcgcagacaccgugugaggggacagcagc

SEQ ID NO: 31259 - RNA, 64 nt, Human
ccgcacagggaccgggaccgggaccgugagcgggagcgcagagagcggagccgggagcgagaca

SEQ ID NO: 31260 - RNA, 64 nt, Human
auaccagcguguaacacggaacuuccaaaugcugagcgcagauccaaaguugucuucuguccac

SEQ ID NO: 31261 - RNA, 64 nt, Human
gcacuuuaggagccccagacaggaggaucacuuaagcgcagaagaucaagaccagccugggaaa

SEQ ID NO: 31262 - RNA, 51 nt, Human
gccuggagccugaccgcugagagcgcagacacccuucuucacacccgggac

SEQ ID NO: 31263 - RNA, 64 nt, Human
ggguuuucuuggcuccccuguucaaaguggccacagcgcagaccgaagcaaaauucuuguauac

SEQ ID NO: 31264 - RNA, 64 nt, Human
guugccacccacgugcccagcugucccacgcugcagcgcagacggccacgcccacacccggccu

SEQ ID NO: 31265 - RNA, 64 nt, Human
aaauggaauucuguauuuauuauuauuuaaguguagcgcagaugugugugcuugggcguguuuc

SEQ ID NO: 31266 - RNA, 64 nt, Human
uaguacuuucuuccugaugccaguucuucugggaagcgcagaauuucagauauauuuuaguaac

SEQ ID NO: 31267 - RNA, 64 nt, Human
guuggggcuggcaggccacuggcaugugcugaguagcgcagagcuacccagugagaggccuugu

SEQ ID NO: 31268 - RNA, 64 nt, Human
guuuuaacucuuggugacaguagaugcucucuggagcgcagacgaggcacaugugucuucauag

SEQ ID NO: 31269 - RNA, 64 nt, Human
cuggggccgucugccuacacgcuccagaagggccagcgcagagcugggauggccacugagagcc

SEQ ID NO: 31270 - RNA, 64 nt, Human
gggaccugaguuugggugggguggcaguuggcacagcgcagaugcgguagagaugggaggaaac

SEQ ID NO: 31271 - RNA, 64 nt, Human
aagcacaacgggucauuuuccuuuguauguuccuagcgcagaacuguuucuaaaacaacuugaa

SEQ ID NO: 31272 - RNA, 64 nt, Human
auaaauaggaugagguugaagaaaaguauauuggagcgcagauaaauauaaauuguggacugcu

SEQ ID NO: 31273 - RNA, 64 nt, Human
aggaggccucuggggaagggguucccucccuccugaagaugaacacacaauacacggaagagcg

SEQ ID NO: 31274 - RNA, 64 nt, Human
ucugacucugugcccugucccugagcucgugggagaagaugacccguggaacacuugccuggcc

SEQ ID NO: 31275 - RNA, 64 nt, Human
aguuuuccuuuuuuucauuuugauuuuugaaagugaagaugaugcccuaauuccugguaaggau

SEQ ID NO: 31276 - RNA, 64 nt, Human
agauggagauaaggauuccagauggcacuugagugaagaugagaauagauccuauguggagauu

SEQ ID NO: 31277 - RNA, 64 nt, Human
aagguccuaguuagguuccuauauaaagcauuuggaagaugaccuuguugcccuugaaacuuga

SEQ ID NO: 31278 - RNA, 64 nt, Human
uucgcuucuacacaagaauuuuauauguauuuaugaagaugauucuguacccuaguauaucuuu

SEQ ID NO: 31279 - RNA, 64 nt, Human
uauauuuggguuaugaugucaaacgauccuaagcgaagaugauuucaguucaucaaaucaucau

SEQ ID NO: 31280 - RNA, 56 nt, Human
ucuccaagucaacaauuuaaaaaugggaagaugaagauugggggugaaucacauug

SEQ ID NO: 31281 - RNA, 64 nt, Human
ggaaguaacuuauuaaaggcuaugacuuaaauuugaagaugaaguacaguguucuagguuugcu

SEQ ID NO: 31282 - RNA, 64 nt, Human
uaugaguuauuauaaaaauugguuaauuguauaggaagaugacaguauuuuuuucaaguuauca

SEQ ID NO: 31283 - RNA, 64 nt, Human
agcaaauaggcuauguugaguacguaggcugugggaagaugaagaugguuuggagguguaaaac

SEQ ID NO: 31284 - RNA, 64 nt, Human
ugggggaccuggcagauggggugaguuggguaaggaagaugaugcuuaguuccugauagaugcu

SEQ ID NO: 31285 - RNA, 64 nt, Human
uaucauguggagaagagccaauuuaacaaacuaggaagaugaaaagggaaauuguggccaaaac

SEQ ID NO: 31286 - RNA, 64 nt, Human
uucagagauuuagggguggaggaagagcuuuggggaagaugagguaaggaaagaugacucguga

SEQ ID NO: 31287 - RNA, 64 nt, Human
uuuuccuuuucccagacucagacgaugcccugcugaagaugaccaucagccagcaagaguuugg

SEQ ID NO: 31288 - RNA, 64 nt, Human
acauggggcauagaaacugaggaguagcugagaggaagaugaagagaagcugagaagaagcuga

SEQ ID NO: 31289 - RNA, 64 nt, Human
uaacucacccuuccaccauaugaggacguggcaagaagaugacauguaugagaaccaaaaaaca

SEQ ID NO: 31290 - RNA, 64 nt, Human
ugaagauuuuucuaguauauuaauaauugacuaggaagaugaacuuuuuuucagaucuuugggc

SEQ ID NO: 31291 - RNA, 64 nt, Human
ugauuauccuggaacauuuugaauauuggggaaggaagaugauacuucuuucucaagaaaagaa

SEQ ID NO: 31292 - RNA, 64 nt, Human
gggauguaugaacggccaaauucccaugugagaggaagaugaccugauccaccuagccuuuucu

SEQ ID NO: 31293 - RNA, 64 nt, Human
guguauuguccgggcucagaaugggaggacuccagaagaugagagaaaccucuuuauccaacag

SEQ ID NO: 31294 - RNA, 64 nt, Human
aacaguguguaaaaugacugaagugaugaugcccgaagaugaaauagaugccaaauuagaugga

SEQ ID NO: 31295 - RNA, 64 nt, Human
ugcuaaaugguuguagggugagaagugcaagaaugaagaugaagccccacugcucggucagucu

SEQ ID NO: 31296 - RNA, 64 nt, Human
gucugccuccguguguccucugaaauaagcagaugaagaugaaagggcaacuuuguuuucuucu

SEQ ID NO: 31297 - RNA, 64 nt, Human
gcucugccugucuggugccuggaggugugggagggaagaugaguuauuuaacugguaagcgauu

SEQ ID NO: 31298 - RNA, 64 nt, Human
cucaaggcuuauauuaagcaaacacuugaagugagaagaugauccacaacuugagaagacauuu

SEQ ID NO: 31299 - RNA, 64 nt, Human
gucacucagaaauccuucaaacaugauuaauuaugaagaugaaacacuagagucauauaagaaa

SEQ ID NO: 31300 - RNA, 64 nt, Human
aaauauauuugaaaugaaaaucuccaacacauuagaagaugaugauguuagaugcccaucgugu

SEQ ID NO: 31301 - RNA, 64 nt, Human
ggggaucauaacaccuaccucauggaguuguggugaagaugaaaugaagucaugucuuuaaagu

SEQ ID NO: 31302 - RNA, 64 nt, Human
cuuucccccagccgcacgggucccaggccccagagaagaugagucuauggcaucagguucuuaa

SEQ ID NO: 31303 - RNA, 64 nt, Human
uugauaggaaacaacaaaagcagguugagauggggaagaugacagaacaacaguguuaaauggc

SEQ ID NO: 31304 - RNA, 64 nt, Human
uuguaaagugugaaucgcccuucccuuuuguacagaagaugaacuguauuuugcauuuugucua

SEQ ID NO: 31305 - RNA, 64 nt, Human
agccucgaggugccuucuucagggccugguugaagaagaugaucaguggacagucugcucuaga

SEQ ID NO: 31306 - RNA, 64 nt, Human
agaggucaccuuccagcagugaaaugaacaaauagaagaugagaaguacaggcaagugguuugu

SEQ ID NO: 31307 - RNA, 59 nt, Human
uuuuuuguagcuccaauugauugguaacagaagaugaagacaacagcauaacuaaauua

SEQ ID NO: 31308 - RNA, 64 nt, Human
gcugacuccuacuuuauaggcugagucaaugagggaagaugacuggcguuuccucugucuaaau

SEQ ID NO: 31309 - RNA, 64 nt, Human
aagggugugaagaaggaauaguuuuauaaucucggaagaugauaccaagagcagaggcaacaaa

SEQ ID NO: 31310 - RNA, 64 nt, Human
cagauuccccuuguggaaaaaaaaauucugcugugaagaugaaaauaaaaauggagagaaaaca

SEQ ID NO: 31311 - RNA, 64 nt, Human
aguacuccugcagggcuggaggaacagguucuuagaagaugauucaccuuggaggaagcugggg

SEQ ID NO: 31312 - RNA, 64 nt, Human
aaaaggcuuaguucugaaaaccgauauguuguuggaagaugagcagccagaucacugccuaauc

SEQ ID NO: 31313 - RNA, 64 nt, Human
guccuuaccccaggcucaggaacugccagggagggaagaugagguggggagucuguacugagau

SEQ ID NO: 31314 - RNA, 64 nt, Human
ccuauccccugccucccccucucagaagaggguggaagaugaaaugaaagcuaugggacucuug

SEQ ID NO: 31315 - RNA, 64 nt, Human
guagaugugagcuguugaguucccucuugcuggggaagaugagcuuccauguauccugugcuca

SEQ ID NO: 31316 - RNA, 64 nt, Human
agggagggcugccuaccauggucuggggcuugaggaagaugaguuuguugauuuaaauaaagaa

SEQ ID NO: 31317 - RNA, 64 nt, Human
cgaaacaacugaugggggaagauaccuggggugagaagaugagaaagaaaugaugcugagggac

SEQ ID NO: 31318 - RNA, 64 nt, Human
caccauugaacuguaccaugugcuacaggggccagaagaugaacagacugaccuugaugagcug

SEQ ID NO: 31319 - RNA, 64 nt, Human
gacacuaauauuauuacccauauacaugauuucagaagaugacauaagauuccucuuaaagagg

SEQ ID NO: 31320 - RNA, 64 nt, Human
aauaaggaaugauauaagguuuuuuuuucucacagaagaugaagcacacaggaaccuaaugggc

SEQ ID NO: 31321 - RNA, 64 nt, Human
guguggaaauguaugauccaacuagaaaugaauggaagaugaugggaaauaugacuucaccaag

SEQ ID NO: 31322 - RNA, 64 nt, Human
uuuuguuuuccccacauucuauagccauaaaccugaagaugaguaaaacuggugggucuuuaau

SEQ ID NO: 31323 - RNA, 64 nt, Human
cagcauaaaagagugaacaaauguugggaugagagaagaugacaucaaugugggaguucaguau

SEQ ID NO: 31324 - RNA, 64 nt, Human
aacacccuuaggaccucaggccaucuucuccuaugaagaugaaaauagggguuaaguuuuccau

SEQ ID NO: 31325 - RNA, 64 nt, Human
aaaaauuugcaagcaucaagugucaaucaaaacugaagaugaaacacuaaugaauguugaauuc

SEQ ID NO: 31326 - RNA, 64 nt, Human
uguuguuacaaagucuggagucuaggguugggcagaagaugacauuuaauuuggaaauuucuuu

SEQ ID NO: 31327 - RNA, 64 nt, Human
aaaaaauuuuccucaacaacuaaaauauaauacugaagaugaacaaaaacaaaaccaaauagga

SEQ ID NO: 31328 - RNA, 64 nt, Human
cgaugugaagaugaaugaauguaacuccuggugugaagaugaauguaaacccuggcgacaguug

SEQ ID NO: 31329 - RNA, 64 nt, Human
ucucgguaaccacggcagagagcagcgccgaugugaagaugaaugaauguaacuccugguguga

SEQ ID NO: 31330 - RNA, 64 nt, Human
aucuggcagagucagcugcugacccucuccccaagaagaugaaagauucaguggugagacauuu

SEQ ID NO: 31331 - RNA, 64 nt, Human
ucaaaugccaugcagcacuuaaacuugugauaaggaagaugaagggucuucagagaagaaccuc

SEQ ID NO: 31332 - RNA, 64 nt, Human
uuuggaggagaaccaaaacgacaaguuccaagaagaagaugaagcuccgccuccgccgcuuagu

SEQ ID NO: 31333 - RNA, 64 nt, Human
caguggauucgccucaagguugaggccgccauuggaagaugaaaaauugcacucccuuggugua

SEQ ID NO: 31334 - RNA, 64 nt, Human
uuuuuagagucuuacauauuugugcaccaaacuugaagaugaaccagaaaacagacuuaaacaa

SEQ ID NO: 31335 - RNA, 64 nt, Human
gguucaguaguggggaauucugugacagcugauugaagaugaugaugaagaaccucugcauucu

SEQ ID NO: 31336 - RNA, 64 nt, Human
uggcuaagacuugcuggacugacaccuauggcuggaagaugacuuguuuugcuccaugucuccu

SEQ ID NO: 31337 - RNA, 64 nt, Human
auaauuaacuuugucaaaauccugcucacaauuugaagaugaaacuugucauuagguuggcggg

SEQ ID NO: 31338 - RNA, 64 nt, Human
ggcuucaauuccauuauguuuuaauguugucucugaagaugacuugugauuuuuuuuucuuuuu

SEQ ID NO: 31339 - RNA, 64 nt, Human
uuaauuuaccuguauuuccuaauuuuucuacaaugaagaugaauuccuuguauaaaaauaagaa

SEQ ID NO: 31340 - RNA, 64 nt, Human
ucuuuguugcagccaaaucaaaguacuugauggggaagaugaauauuacaaaucucugucacca

SEQ ID NO: 31341 - RNA, 57 nt, Human
uauuauaggaugaacuuugauaauguugaagaugaagaaaaaguuuaaaagaaauuc

SEQ ID NO: 31342 - RNA, 64 nt, Human
ggucagaaacacagauuguauucuaugagucccagaagaugaaaaaaauuuuauacguugauaa

SEQ ID NO: 31343 - RNA, 64 nt, Human
caugaggaacuuuuuuauuuagaaggauaauuuugaagaugaaaauguauucaucuuaauuguu

SEQ ID NO: 31344 - RNA, 64 nt, Human
guuuuuauuugguuagagacagguuucccuguaggaagaugauggcucauuuacacucagcugc

SEQ ID NO: 31345 - RNA, 64 nt, Human
uuuggaugaaaagauuucaggcaaagacuugcaggaagaugaugauaacggcgaugugaaucgu

SEQ ID NO: 31346 - RNA, 64 nt, Human
gguguuuggauuugcugggcguggaguggggacggaagaugagcgcgggaaaggcacuccaacc

SEQ ID NO: 31347 - RNA, 64 nt, Human
ucgcgcaccuucaggucgcgcaccuucgcugaaggaagaugacgcagagcuuuaucugaaauca

SEQ ID NO: 31348 - RNA, 64 nt, Human
ugauguagagcgacuggaaagauucuucgacucagaagaugaagacuuugaaauccugucccuu

SEQ ID NO: 31349 - RNA, 64 nt, Human
uccguuucucugggaauuggugauuuuuuacugugaagaugaaauuacccuaauagcaugaaga

SEQ ID NO: 31350 - RNA, 64 nt, Human
caagaaaaauauuugacauugugacuugacuguggaagaugaugguugcauguuucuaguuugu

SEQ ID NO: 31351 - RNA, 64 nt, Human
gcuuaacauuuuugcaagaaaaauaggaagauaugaagaugauguuuugguuuguuuaugaaau

SEQ ID NO: 31352 - RNA, 64 nt, Human
uauuggcauguuuagaugucagguuuagucuucugaagaugaaguucagccauuuuguaucaaa

SEQ ID NO: 31353 - RNA, 64 nt, Human
augccaaaaaaugagagauacaaaugagcuagaggaagaugaggggggaugcgaguaccuccaa

SEQ ID NO: 31354 - RNA, 64 nt, Human
ucauuccauucuauuguuuacacaacgauuacucgaagaugacugcaaagguaaaaggaaaaua

SEQ ID NO: 31355 - RNA, 64 nt, Human
aacccugucauaaugacugugcaauacaugugcagaagaugagguauuuuaaaauuuacuuccu

SEQ ID NO: 31356 - RNA, 64 nt, Human
ucuauucuuuaugccuugcccuagccagauggaagaagaugaagaaggaaaccaggugaacuca

SEQ ID NO: 31357 - RNA, 64 nt, Human
uuuuaaaaauaguucucuugauugauuucauacagaagaugacugugauccaugacaucuaaua

SEQ ID NO: 31358 - RNA, 64 nt, Human
uacccaagggugccucacucaucugcgccaccaggaagaugaacugugagggcuccuauaaggg

SEQ ID NO: 31359 - RNA, 64 nt, Human
ccuuuuucagaguuuauuucucaugugcacugcugaagaugaauaucccuaauccuucauaaag

SEQ ID NO: 31360 - RNA, 64 nt, Human
cucuuggguccuucuagggcacugggaagagccugaagaugaggaaaaguuuggaggagcagcu

SEQ ID NO: 31361 - RNA, 64 nt, Human
caguauuauuuuuuaaauaagaaaaacauuccuagaagaugauaauugugaaaaccuccuuugg

SEQ ID NO: 31362 - RNA, 64 nt, Human
aucuuuuagucuuuuauugucuuagauacuauaagaagaugaacaugacaauuuucuagaaccu

SEQ ID NO: 31363 - RNA, 64 nt, Human
ucugaaucaaggugauugugauuauagugacaaugaagaugaugcuauuaauacugcauaaaaa

SEQ ID NO: 31364 - RNA, 64 nt, Human
cuaggagcacagcaccaaauguggucucuuaagggaagaugaggguagaagauguuaagauccc

SEQ ID NO: 31365 - RNA, 63 nt, Human
ucaacuugacucaagauugacucuacagacucagaagaugaugcuaacaguguuaguuuuauu

SEQ ID NO: 31366 - RNA, 64 nt, Human
gagggaagaagaagaagggaugaugugugguagagaagaugaggguuaacuuuagccuuuccca

SEQ ID NO: 31367 - RNA, 64 nt, Human
caguucucuggaugcccagacaccucucuucagggaagaugagucugacugguuugccccaggg

SEQ ID NO: 31368 - RNA, 64 nt, Human
uugcuguaccugcuuggugguuagaaggaggcuagaagaugaauucaggcacuuucuuccaaua

SEQ ID NO: 31369 - RNA, 64 nt, Human
ggauuacaacauagcaaauacuguuugacuuucagaagaugauugguuuauuucccuuuaaaau

SEQ ID NO: 31370 - RNA, 64 nt, Human
ggaagcccuggguauggccauuaccaucugauuagaagaugaacagguauuuugaaucugaucu

SEQ ID NO: 31371 - RNA, 64 nt, Human
ggcuucagugggguggagaguggccuccaugauggaagaugauaggggacucagccaucagaca

SEQ ID NO: 31372 - RNA, 64 nt, Human
caggaggcagcagggucuggucauaauccagugugaagaugaggugaggaaggaagggguugcu

SEQ ID NO: 31373 - RNA, 64 nt, Human
agugcucagcccaucaacuuccugagugucuaaagaagaugaggaaggugugcaggaagaaaac

SEQ ID NO: 31374 - RNA, 64 nt, Human
uuucccugcaaaaggacacagaaggcagucuuaagaagaugaauggaugagagaagggagagaa

SEQ ID NO: 31375 - RNA, 64 nt, Human
cagucuuuuccaugaacuucuccccugguagaaagaagaugaaugagcaaaaccaaauauucca

SEQ ID NO: 31376 - RNA, 64 nt, Human
agauauuuaaaagacaaacaccuuauuugucggggaagaugaaaccgucccugaguugcaccau

SEQ ID NO: 31377 - RNA, 64 nt, Human
ucuguauguaacaaaaagacauucauaauguuaggaagaugauaaaaauucgcucuuuuaaagu

SEQ ID NO: 31378 - RNA, 64 nt, Human
gacaggaagucuuuagacugcccacauucaugaagaagaugauguguggcuggaucaguaggag

SEQ ID NO: 31379 - RNA, 58 nt, Human
uacaaggaagaaguuuaugauucaaguggaagaugacuuuuaaaauaauauuuuuuaa

SEQ ID NO: 31380 - RNA, 64 nt, Human
auccugggccaaggccagaacuuuagugcuaggggaagaugaaaugugcaguuuugaaauguug

SEQ ID NO: 31381 - RNA, 64 nt, Human
cuaauuuuaccugaugcuaugagagaaucauauugaagaugaaaugucuaauauauaauguaua

SEQ ID NO: 31382 - RNA, 64 nt, Human
aaaauacggcuuuuccaaugaugaaauauaaucagaagaugaaaaauaguucuaaacuaucaau

SEQ ID NO: 31383 - RNA, 64 nt, Human
acuggcaugaacacgucuuugaaguuguggcugagaagaugagaggaauauuuaaauaacauca

SEQ ID NO: 31384 - RNA, 64 nt, Human
ccaaggugucgaggaggaucagauccagauaagagaagaugauuccuucuaguccuguaaaauu

SEQ ID NO: 31385 - RNA, 64 nt, Human
auacauacaguguauauaaacaaaauugcacccugaagaugacagaguuuugucacagcuugug

SEQ ID NO: 31386 - RNA, 64 nt, Human
auuugggaccuaugucuacuuuucaaggcaaagugaagaugacaguccuugcucucagggagcc

SEQ ID NO: 31387 - RNA, 64 nt, Human
aaaagaaaagagaaaaaaaagacuagccagccaggaagaugaauccuagcuucuuccauuggaa

SEQ ID NO: 31388 - RNA, 64 nt, Human
aggcaugacagcuaacagggacgggcuuucuuuggaagaugaugaaauuguggaaugaugguug

SEQ ID NO: 31389 - RNA, 64 nt, Human
gaauauacuagaaaccaaugaauuaaaaacuuuggaagaugaauuuuauggucugugaauuaua

SEQ ID NO: 31390 - RNA, 64 nt, Human
gaacaagcuggugaauaaccuuggcaguggaagggaagaugaugccauuguccuggaugaugcc

SEQ ID NO: 31391 - RNA, 64 nt, Human
caaaaggaccggcucauuuggucacuagucuauagaagaugacacagaaauuggaaccaacaaa

SEQ ID NO: 31392 - RNA, 64 nt, Human
gcaucaaauauuugugcaagaauuuggaaaaauagaagaugaaucauugauugaauaguuauaa

SEQ ID NO: 31393 - RNA, 64 nt, Human
aaucagucauuuguuaaagaaaaguauauucaaugaagaugaaauuuaaauaaaaaaggacaga

SEQ ID NO: 31394 - RNA, 64 nt, Human
cuauucagaguuucaucuggggaugaaagcuauggaagaugauguacaaauguuauugauggag

SEQ ID NO: 31395 - RNA, 64 nt, Human
ucaaaugugcugucaaaacaaguuuuucugucaagaagaugaucagaccuuggaucagaugaac

SEQ ID NO: 31396 - RNA, 64 nt, Human
aguauugaaauguggaugcugccuuguuuuauaagaagaugaucaagguuugugugcccauuac

SEQ ID NO: 31397 - RNA, 64 nt, Human
cuaacauggguauuuuugaacauauuuuugccaggaagaugaaaaucacauaguaugauaaaca

SEQ ID NO: 31398 - RNA, 64 nt, Human
guaaaacuugcgugucuuuuaaaaauaauaaaaggaagaugaguauuuaugaagaauaugugcu

SEQ ID NO: 31399 - RNA, 64 nt, Human
uuuugucauacuaagugucuccuguaauuuucaggaagaugauuuguucuuuccagaagaggag

SEQ ID NO: 31400 - RNA, 64 nt, Human
aaagaugaacaaagguuaauuuaaacuuaccuaagaagaugagaaucaaacaaaacagauaugc

SEQ ID NO: 31401 - RNA, 64 nt, Human
uauucugagaagguugguuaaaagauggcagaaagaagaugaaaauaaauaagccugguuucaa

SEQ ID NO: 31402 - RNA, 64 nt, Human
gacaaauuacgaccacuggaagccagcacccaaggaagaugaccggagguaggcugcuacgugc

SEQ ID NO: 31403 - RNA, 64 nt, Human
aagaggaaugaaugcaccuauuuggcuuuaaguugaagaugaauuauuucucaugcucauuuuc

SEQ ID NO: 31404 - RNA, 64 nt, Human
guagaagaggaaaaagcaacaacagcaacaacacgaagaugauaccaaaacaaggaccacaaaa

SEQ ID NO: 31405 - RNA, 64 nt, Human
aaucugauacaauauguuaaagaauuaagaaccugaagaugaagauuuagagcauauuuaccug

SEQ ID NO: 31406 - RNA, 64 nt, Human
ugcgagagagggagacacccggaggagcaggugggaagaugaagccggccagagccccucugcc

SEQ ID NO: 31407 - RNA, 64 nt, Human
guuucauggucuuaaaaagauacuuuaugugguugaagaugaaaucauuccuaaauuaaccuuu

SEQ ID NO: 31408 - RNA, 64 nt, Human
cuugucaagggcucuguuuacaucuauacauuuugaagaugaaauuuuuagccuuaaaguuuau

SEQ ID NO: 31409 - RNA, 64 nt, Human
guuuuacuuaauauucccuaaaaacuugaggaaggaagaugauagaacaugagauacucuuugu

SEQ ID NO: 31410 - RNA, 64 nt, Human
uaucuauuuuuauuuaaccuuucuuauauuaucugaagaugaauauguauguggcuguauuuug

SEQ ID NO: 31411 - RNA, 64 nt, Human
uuuuguuuuguuuguguccauaagagaaaugguagaagaugaaucaguaugaagacacugucaa

SEQ ID NO: 31412 - RNA, 64 nt, Human
ucuagccauuucggaagacaccgaggaagaggaggaagaugaagaccaggacuacagcuuuccu

SEQ ID NO: 31413 - RNA, 64 nt, Human
gacaucguaucgguuccuguucagaugacauggggaagaugaugguucagccacugguacuacg

SEQ ID NO: 31414 - RNA, 64 nt, Human
aacuuuaucuuuuaauuaugugcucuuaauauuugaagaugagaguuaauaccugagauguuuu

SEQ ID NO: 31415 - RNA, 64 nt, Human
acaucaagauaaagagcggagguggauggggauggaagaugaugcuccuauccucccugccuga

SEQ ID NO: 31416 - RNA, 64 nt, Human
guuuugcagacuuaaaaguguaaauuuagaauuagaagaugaagcuauaguaguaagaaucuca

SEQ ID NO: 31417 - RNA, 64 nt, Human
aggcccuggaagggaagugaggaggagggacaaggaagaugacuaguuacggagggugaggguu

SEQ ID NO: 31418 - RNA, 64 nt, Human
aguggagagccucaagauaaaacucugucauucagaagaugauuuuacucagcuuauccaaaau

SEQ ID NO: 31419 - RNA, 64 nt, Human
cauaugcagaggacggagcaggcucagcccccuggaagaugagcucaaggggaggacaggccuu

SEQ ID NO: 31420 - RNA, 64 nt, Human
uccaguuuuuuguaaauuuaauuuuauauuuuuugaagaugauagcaauaugcuaaaaaaugcu

SEQ ID NO: 31421 - RNA, 64 nt, Human
ugagucacaaguccucuagugcucuuguugguuugaagaugaaccgacuuuuuaguuugggucc

SEQ ID NO: 31422 - RNA, 64 nt, Human
cuauggucuuaaaaacaagaaggcacacauuugagaagaugagauuaagguuaggagaaaaccu

SEQ ID NO: 31423 - RNA, 64 nt, Human
ugugaauucagauuuuaaaaagucuucacucucugaagaugaucauuugcccuuaaggacaaaa

SEQ ID NO: 31424 - RNA, 64 nt, Human
aggggaacuacuucuuuaaacacauggagggaaagaagaugaugccacuggcaccagaggguua

SEQ ID NO: 31425 - RNA, 64 nt, Human
uuucuugugguguaaagcuggcccugccuccugggaagaugagguucugagaccaguguaucag

SEQ ID NO: 31426 - RNA, 64 nt, Human
uggguucugacuucuuccuccccuugcuuccagggaagaugaagagagagagauuuggaagggg

SEQ ID NO: 31427 - RNA, 64 nt, Human
gccgaaaggcuuaaauaguuuaaguaggugaugggaagaugagauuaccucauuuagggcucag

SEQ ID NO: 31428 - RNA, 64 nt, Human
uucuuuucugccugagaaagagaaccagacgcaggaagaugaaaggcugcccuuuguucuucga

SEQ ID NO: 31429 - RNA, 64 nt, Human
cugggaccuccuuccaggagaucaugcacgcccugaagaugaccuggcacgugcacugcuuuac

SEQ ID NO: 31430 - RNA, 64 nt, Human
gcccgcgcgcggacuuugcacuuugaauccagaggaagaugaauuuuuaaaaucuccaucaaac

SEQ ID NO: 31431 - RNA, 64 nt, Human
cagcuucaccuucuuaacaaggugcagcucaguggaagaugaugacaaccagaagacaugagcu

SEQ ID NO: 31432 - RNA, 64 nt, Human
ccacagcacacacccacaggccuggaccugggaugaagaugaaugaagaacauggacucaugug

SEQ ID NO: 31433 - RNA, 64 nt, Human
ccagagcgcacauccacaggccuggaccugggaugaagaugaaugaagaacauggaugcacgug

SEQ ID NO: 31434 - RNA, 64 nt, Human
aaaacccaccuauggaauaggugccuaucccugugaagaugaaccucuggcccuuccaggaugg

SEQ ID NO: 31435 - RNA, 64 nt, Human
uguuaaaucugagacauccugacucucgagcugggaagaugaaagaaacucuauuauauauuug

SEQ ID NO: 31436 - RNA, 64 nt, Human
guuuggaaggacaccaagacccccguuggugacugaagaugacacugagcuuuaauggcugaag

SEQ ID NO: 31437 - RNA, 64 nt, Human
agcauuugauuuucuguguccuuaaguacuuccugaagaugaagcaaaauuuuaaucuggcaau

SEQ ID NO: 31438 - RNA, 64 nt, Human
augggauacguauagaauggacucacuuguccuagaagaugaauguguagugucagcaaaugca

SEQ ID NO: 31439 - RNA, 62 nt, Human
uuuuauaggcagaaccuuagagaagaagaguggaagaugacggagaugcauuuugaagcacc

SEQ ID NO: 31440 - RNA, 64 nt, Human
cauguugcgauugaauucuaaccucuuugacuccgaagaugaaugaaguguauaacugucucua

SEQ ID NO: 31441 - RNA, 64 nt, Human
auuuguguuuuuacauuuuaugguuaauuuaauggaagaugaaagggcauugcaaaguuguuca

SEQ ID NO: 31442 - RNA, 64 nt, Human
ccgccccaucuucaaggcucagcgacugaggcuggaagaugauauggauuggaacacaaaaaau

SEQ ID NO: 31443 - RNA, 64 nt, Human
uucugcaccaugaaauuaaaaucaucucauuccugaagaugaauguaggaccagacauuuuagc

SEQ ID NO: 31444 - RNA, 64 nt, Human
cauggcucacaaauuucuaucccaaaucuuuucugaagaugaagaguuuaguuuuaaaacugca

SEQ ID NO: 31445 - RNA, 64 nt, Human
ccguggauauucuucaucagaagcuuuaaucaaagaagaugagcagaagacaaucacuggcucc

SEQ ID NO: 31446 - RNA, 64 nt, Human
guccaucaucaaaacaccaaagacucaagacacagaagaugaugagggagcucaguggaauugu

SEQ ID NO: 31447 - RNA, 64 nt, Human
ucagauuccagugugacaugaggaauuagauuuugaagaugagcauauauuacuaucuuuaagc

SEQ ID NO: 31448 - RNA, 63 nt, Human
cauuacagcuaauuucuugagauagaggacagagaagaugacucguucccauagauuugaaga

SEQ ID NO: 31449 - RNA, 64 nt, Human
cuauucugccccagcuggagcauugcagcuccaggaagaugaauacauggcuugguguguggga

SEQ ID NO: 31450 - RNA, 64 nt, Human
ggaggcugagcagaugcacacauccugagagagggaagaugauuccuuggagagacuugcucuu

SEQ ID NO: 31451 - RNA, 52 nt, Human
cagggcugagagacacgugaaggaagaugaugggaggaaaagcccaggagaa

SEQ ID NO: 31452 - RNA, 64 nt, Human
ggccaaguccuuuaucaaaaagcugcuuuuuggagaagaugaugcauaaagcugugauacuaag

SEQ ID NO: 31453 - RNA, 64 nt, Human
uaaugaagucugcauagugacacucaucaagacugaagaugaagcagguuacgugcuccauugg

SEQ ID NO: 31454 - RNA, 64 nt, Human
acccauaacuuucauuuguuuuuauaucgacaaugaagaugaucauauuucauuuugcagaugu

SEQ ID NO: 31455 - RNA, 64 nt, Human
auugcuauaauaaaaccuuauuuaugucuuauuugaagaugaauagucuuaaaagauaaagaca

SEQ ID NO: 31456 - RNA, 64 nt, Human
acauguggguacuucuccaccuagggaagccacugaagaugaguuugaccuguggugaccugac

SEQ ID NO: 31457 - RNA, 64 nt, Human
uuuguccuuacagucccacucuggagcacugucugaagaugaggaaucaucuguguacggauaa

SEQ ID NO: 31458 - RNA, 64 nt, Human
ugaacaaucagaugcccaacucuguugccuuguggaagaugaguaaaugcagugcuucuuaaag

SEQ ID NO: 31459 - RNA, 64 nt, Human
caaccuccuaugugcaugucuaaauagucacaaugaagaugaaaauaaggaugauggggacggg

SEQ ID NO: 31460 - RNA, 64 nt, Human
cacuucuggucucugucccucugccuccccggaagaagaugaggaaucugaggauuaucagaac

SEQ ID NO: 31461 - RNA, 64 nt, Human
acuucaaauuguuuugugaauaaaacucagaaaugaagaugagcuuaauuaaccuaguauacug

SEQ ID NO: 31462 - RNA, 64 nt, Human
uccacaguugccaaacguugcaggaccgcacggagaagaugaaggagaucguaggguggaugcc

SEQ ID NO: 31463 - RNA, 64 nt, Human
accagcauauccugagucauuugaccaagacacagaagaugaugaaugggaaaaaaaacauaga

SEQ ID NO: 31464 - RNA, 64 nt, Human
aaaccuucuuguaggaaaagagagcucucuacaugaagaugacuuguuuuauauuucagauuuu

SEQ ID NO: 31465 - RNA, 64 nt, Human
caggauggcccuucccacuggaggucacauucaggaagaugaaagaggagguuuggggucugcc

SEQ ID NO: 31466 - RNA, 64 nt, Human
uaugguagugacuguucaucauaugacauuuacugaagaugaacuggguccaugaugaagugug

SEQ ID NO: 31467 - RNA, 64 nt, Human
aaaaggcaaacacaaggaaagaucagaugaaacagaagaugauaguaaaagugauccuaaguaa

SEQ ID NO: 31468 - RNA, 64 nt, Human
gcgaggagagugaugccgguaaagaaaaguugccgaagaugagacugcccacgcgcucagacau

SEQ ID NO: 31469 - RNA, 64 nt, Human
aagccuggguuggguggagcagaaccaucuuggagaagaugacaguucccuguccucccggaga

SEQ ID NO: 31470 - RNA, 64 nt, Human
uuuuuuuguuugaacuuucuggagcuguuuuauagaagaugaugguuuguugucggugaguguu

SEQ ID NO: 31471 - RNA, 64 nt, Human
gucucugguucagggaaaggggacagcccagcuugaagaugagggauggugaauggcugugacc

SEQ ID NO: 31472 - RNA, 64 nt, Human
aaucaaauuguccuauugugacucuucuaaaaaugaagaugaagagcuauuuaaugacacaccu

SEQ ID NO: 31473 - RNA, 64 nt, Human
aaauaaaggaaagcaaaugauuugggucucaacugaagaugaagcucaacucaggaagagauuu

SEQ ID NO: 31474 - RNA, 64 nt, Human
uccuucucacuuagaauccgaagggaauuaaaaagaagaugaauggucuggcaauauucuguaa

SEQ ID NO: 31475 - RNA, 64 nt, Human
ggggcaguaucuucugauggugugcaugugaggagaagaugagguuaggacugagaagugcaga

SEQ ID NO: 31476 - RNA, 64 nt, Human
uauggaagccagugccuguguacucacugaaauugaagaugaggaaaguagcuguacacucacu

SEQ ID NO: 31477 - RNA, 64 nt, Human
gcuaguggcaucaguuucccagaaucagacuuuugaagaugaaugacuuuggagaagcaaauua

SEQ ID NO: 31478 - RNA, 64 nt, Human
cuauguguagccaucuuugccuuuugcugcaauagaagaugagcaaaggauuaaacagaggccc

SEQ ID NO: 31479 - RNA, 64 nt, Human
ggagaaauagaaaagaagaaauuuauaaugaaaagaagaugaauuucauuauguaaacgcucag

SEQ ID NO: 31480 - RNA, 64 nt, Human
ugcacacgcccugccugguccgccauguuccaaagaagaugauuuaaugguagaacggauaccu

SEQ ID NO: 31481 - RNA, 64 nt, Human
auuuaaaauuucaauuauccauucuuauaagaaggaagaugauuguaaagaaauaucuccgaag

SEQ ID NO: 31482 - RNA, 64 nt, Human
aagaaucuuuuuguauggaauauuacuucuaucagaagaugaucaagauguuucaguccagugc

SEQ ID NO: 31483 - RNA, 64 nt, Human
uaauugagccaaauuugggucagaacacaaauuugaagaugacuuuucaguauaugauggguau

SEQ ID NO: 31484 - RNA, 64 nt, Human
gcuaguaguggaauacuggaaaagcuucauuucugaagaugaauuuuauuuuuaaaaaauacau

SEQ ID NO: 31485 - RNA, 64 nt, Human
cagguacuuggacuuuuuguagaaggagagagaagaagaugaaguuugccaggagggcccauau

SEQ ID NO: 31486 - RNA, 64 nt, Human
ucucuagacaucaguuuccacaucugaaaaauaagaagaugagaguacacgguuguuaugaaca

SEQ ID NO: 31487 - RNA, 64 nt, Human
aggagacaaggcagaagcaacuucuggccgacgagaagaugaagcagcucacagaggagacgga

SEQ ID NO: 31488 - RNA, 64 nt, Human
aagaauaucacaggcuaauagcgugguugggggugaagaugauagcaguuauuaaaucaggaau

SEQ ID NO: 31489 - RNA, 64 nt, Human
uuuuacccccuuguuauaaaacugugcagagcaagaagaugauacuuauuuuugaauuuguauu

SEQ ID NO: 31490 - RNA, 64 nt, Human
aauucuauaagcaauagcugauuaaugggcccuggaagaugaagauuauaacuguuuauuuacc

SEQ ID NO: 31491 - RNA, 64 nt, Human
ggaguucauuugaacucuugaaccuuaguuuagugaagaugaacugucuguucuuagguagaaa

SEQ ID NO: 31492 - RNA, 64 nt, Human
uuuacuuuguacacguuugaaaccaacuacuguagaagaugaggaaucuauuguaauuuuuugc

SEQ ID NO: 31493 - RNA, 64 nt, Human
uagaagagaucaaagagugguugcuucuuacuuugaagaugaaauuauaccaaguuagguuuuu

SEQ ID NO: 31494 - RNA, 64 nt, Human
uuagggcauuugagaaaugcauauuguauuacuagaagaugaauacaaacaauggaaacugaau

SEQ ID NO: 31495 - RNA, 64 nt, Human
ugagcauuggauacagcaguagacauuuuaacaagaagaugaauggcguccguggguugcuaac

SEQ ID NO: 31496 - RNA, 64 nt, Human
uaagauacacugcacuuuguuuagaaaaaaaacugaagaugaaauauauauuguaaagaaggga

SEQ ID NO: 31497 - RNA, 64 nt, Human
guucugauggagaaaacagcaccccaaggacucagaagaugauuuuaacaguucagaacagaug

SEQ ID NO: 31498 - RNA, 64 nt, Human
cugcaggccacagagcagcuuggguuggaagagagaagaugaagggacauccuuggggcugugc

SEQ ID NO: 31499 - RNA, 64 nt, Human
auaguacacaaaagaucuauuucagacacauuuugaagaugaaucuucaacuuuaauaccagcu

SEQ ID NO: 31500 - RNA, 64 nt, Human
uucuccagaggcucgagagcaggccauuucccaagaagaugaagaauggugacuguguuuuuau

SEQ ID NO: 31501 - RNA, 64 nt, Human
aaaacuagaagcccccaaaccagcagaucuuacugaagaugauguuccagcagcagcgacuuag

SEQ ID NO: 31502 - RNA, 64 nt, Human
cagguuuuuaaaacgugaaguaauguuugaacuggaagaugagcucaccaggcaaagcuaagga

SEQ ID NO: 31503 - RNA, 64 nt, Human
uuuuguuuccuuuuuuuuaaccaucugauacuaagaagaugaauuugcacagauuucucugcau

SEQ ID NO: 31504 - RNA, 64 nt, Human
agcuccuuccaccagaaggcacugccugcaggaagaagaugaucugauggccgugggugucugg

SEQ ID NO: 31505 - RNA, 64 nt, Human
auugcuuucauuguucagagaacccaggagacaugaagaugaccagacugggcaaauuaugugu

SEQ ID NO: 31506 - RNA, 64 nt, Human
cggugaggaucggagggcgcuaugucguggcugggaagaugagcaucuccccuaacaccaccua

SEQ ID NO: 31507 - RNA, 64 nt, Human
ggucaggacagggccugauuugagccuccucucugaagaugauuuggccgagcggaaggugugg

SEQ ID NO: 31508 - RNA, 64 nt, Human
gcccacaccuugugauuuuugaaaccaaagcccagaagaugauguuuacuucucucucccuggc

SEQ ID NO: 31509 - RNA, 64 nt, Human
guggaauauagcaauuaccuaugacggauuagaggaagaugaugaggucuuugaaguaauucug

SEQ ID NO: 31510 - RNA, 64 nt, Human
aaacugugaaauguacuaaauaaaauguacaucugaagaugauuauugugaaauuuuaguaugc

SEQ ID NO: 31511 - RNA, 64 nt, Human
gaaucagagaauucacauaggaaagaaaccagaugaagaugaaugcaggaagaauuguguccaa

SEQ ID NO: 31512 - RNA, 64 nt, Human
aauugugacaggcagaggguguuccugacagagggaagaugaauacacuugaccccaacauuuc

SEQ ID NO: 31513 - RNA, 64 nt, Human
uuaccaaagugauauguauuccaaaaaagucauagaagaugaagcacuauaauauuguucccau

SEQ ID NO: 31514 - RNA, 64 nt, Human
gugguaccuccuuagcgagcacaguggcuccguggaagaugacaucugauaggucucaggcuac

SEQ ID NO: 31515 - RNA, 64 nt, Human
gacaugggccagcagccacagcauauuguaaacugaagaugaccagcucgugggaccaucuaga

SEQ ID NO: 31516 - RNA, 64 nt, Human
gccugucuuccgcuagaacaacgucuacaaaugugaagaugaugacuucuggcacgcggucaug

SEQ ID NO: 31517 - RNA, 64 nt, Human
auuauccauuuuuuccuucaguuaguuuaauggugaagaugauuaacaggggaaaugcuugaag

SEQ ID NO: 31518 - RNA, 64 nt, Human
uuggauuagaaaugauuuauguuagccauguguugaagaugaaauuggcaucaguguagacggu

SEQ ID NO: 31519 - RNA, 64 nt, Human
cccuaacuuagggcuugggcaggggaaagagaaagaagaugagagauuauacuucaugagucuu

SEQ ID NO: 31520 - RNA, 64 nt, Human
aguauaagagucuguaccuugcuggaauauucaagaagaugaaagaauaauauauuggguacaa

SEQ ID NO: 31521 - RNA, 64 nt, Human
accuccccgucuuccucugggugccaaaugaugggaagaugagcuucaucugaccauuucuucu

SEQ ID NO: 31522 - RNA, 64 nt, Human
gaggacacaaggacauuggugcuucagagccuuugaagaugagaagagagugcaggagggcugg

SEQ ID NO: 31523 - RNA, 64 nt, Human
agugguauuugcagacuagaauucuagugcugcugaagaugaaucaaugggaaauacuacuccu

SEQ ID NO: 31524 - RNA, 64 nt, Human
ccauugugaccagcagcaggcuuuuuucccccaagaagaugaucaaaacaaaggaugaucucaa

SEQ ID NO: 31525 - RNA, 64 nt, Human
cuugugauggcggggcagggagccuguucguagggaagaugaggaggcaagggcugccucucac

SEQ ID NO: 31526 - RNA, 64 nt, Human
uauaccugauuuccaacaccagcuacaaagaguugaagaugauaccuaugggucgcguuaacac

SEQ ID NO: 31527 - RNA, 64 nt, Human
ugaucucucugugaaaaugcuaaaagauuuucuugaagaugacacugacgugaaccaguaucuu

SEQ ID NO: 31528 - RNA, 64 nt, Human
gaagaauugacauguaucccaccauaaaaugguagaagaugaguuuucaaugaguagucauagu

SEQ ID NO: 31529 - RNA, 64 nt, Human
acaccuuaaaauucauuuaauacuuauuuaaaaagaagaugagagauucaaaaauaucagaaaa

SEQ ID NO: 31530 - RNA, 64 nt, Human
guucucauaaugcuuuuuaaauaagaaaaauucagaagaugaauuucuuccaauauuugaauaa

SEQ ID NO: 31531 - RNA, 64 nt, Human
cacaagcagcuugauuccaccaaucagagaaguugaagaugaauguugacucccaggagaccag

SEQ ID NO: 31532 - RNA, 64 nt, Human
ccacagggcuauuuuguuugcuucaugugucccagaagaugacugagggugaguuggcuuaccu

SEQ ID NO: 31533 - RNA, 64 nt, Human
auaaccuuuaagaaugugggugguauuggagaaagaagaugaauuauagcuccggagaaucaag

SEQ ID NO: 31534 - RNA, 64 nt, Human
aaaccuuagccugcugcugcugcugcccucagaggaagaugaggaaggaaaaaaacugggugga

SEQ ID NO: 31535 - RNA, 64 nt, Human
uaaauagugaaaaccuccuguuuagacuuugguggaagaugaaucaaggaagcagggcccuguc

SEQ ID NO: 31536 - RNA, 64 nt, Human
caccgcauuccaccugcaucccccacaucacccugaagaugacuuccugagccagcccccagcc

SEQ ID NO: 31537 - RNA, 64 nt, Human
gauaacugacaaacuaaauuauuucccuagaaaggaagaugaaaggaguggagugugguuuggc

SEQ ID NO: 31538 - RNA, 64 nt, Human
ugccccuccccgcuguccucuuggccccaggggagaagaugaggccaucagagauggccaggag

SEQ ID NO: 31539 - RNA, 64 nt, Human
agccaguagccuugguaauaugaagggugggccagaagaugauuucacuugcaaaaacugcuuc

SEQ ID NO: 31540 - RNA, 64 nt, Human
ugaaacugucggaauauaugggucuugaaauucagaagaugauagucacucuucccauauuuau

SEQ ID NO: 31541 - RNA, 64 nt, Human
agccccugcucucccaaaguugcacuuucacugggaagaugagauuugcacauacaaaaggcua

SEQ ID NO: 31542 - RNA, 64 nt, Human
uccaugcuuugagucaccaaugaagcgggugagggaagaugagagggggaggugagagcuucug

SEQ ID NO: 31543 - RNA, 64 nt, Human
cuuuuuauuuacccuuguauguuauccucagagggaagaugauaauauauaaauaauauaauga

SEQ ID NO: 31544 - RNA, 64 nt, Human
gugucuuuuguccuuuuauuuguacagauaaucagaagaugauacugaauagauauaaauuaca

SEQ ID NO: 31545 - RNA, 64 nt, Human
uauuuaucacccaauugccucugacacugacuaagaagaugaagaaaagcuuuucaacagccuu

SEQ ID NO: 31546 - RNA, 64 nt, Human
uaaaaauuauuccaccaaaaaauucuaaaacaaugaagaugacucuuuacugcucugccugaag

SEQ ID NO: 31547 - RNA, 64 nt, Human
uguacuuuaagaaaaauuuaagugacaaauguuagaagaugauggauugaaaaauauaaguaau

SEQ ID NO: 31548 - RNA, 64 nt, Human
caugccucuuguauguugaugccacuucuuggaagaagaugagggcaaugaguuagggcuccuu

SEQ ID NO: 31549 - RNA, 64 nt, Human
aaaagccccccaggauguagaaaugaaggaccuugaagaugagagcuaaaccucuuccacuaga

SEQ ID NO: 31550 - RNA, 64 nt, Human
gcagaggagcugguggauaacagagaaugccagggaagaugagugcugggucaggguacuugga

SEQ ID NO: 31551 - RNA, 64 nt, Human
cauggcaggacagcugcuguggggugcagaggcagaagaugaaggacaaaaggaagggaaaacu

SEQ ID NO: 31552 - RNA, 64 nt, Human
augguuaauuuuuccugcauguucugugacugaagaagaugagccuugcagauaucugcaugug

SEQ ID NO: 31553 - RNA, 64 nt, Human
ccuuggaaggcacugccuugggcuuccauggcaggaagaugagaagaaaucuucagggugauuu

SEQ ID NO: 31554 - RNA, 64 nt, Human
ucugcaagacacugcuuccaaggcuacaguuggggaagaugaagagauucuagaaucugugccc

SEQ ID NO: 31555 - RNA, 64 nt, Human
acaagagaggggaaagaugcuuuauggaauguaagaagaugaaggugacugggauucagcgaga

SEQ ID NO: 31556 - RNA, 64 nt, Human
uuacuccaagaagucguuuccuguggccaauaaugaagaugacgcacucggaagcuugugggcu

SEQ ID NO: 31557 - RNA, 64 nt, Human
acgaugaccaggcggcuugggagaaugagcugcagaagaugacccgggggcaggugagccucuc

SEQ ID NO: 31558 - RNA, 64 nt, Human
ccacacuucacguggacugagguagacccugcaugaagaugaaauuauagggaggacgcuccuu

SEQ ID NO: 31559 - RNA, 64 nt, Human
cacauccuuugacccuggucugagcugacugcuggaagaugaucuuucugcacugagacugugg

SEQ ID NO: 31560 - RNA, 64 nt, Human
auuggaaaauccccuucccccaucuagaucgaaggaagaugagggagcagcuuggauucuucuc

SEQ ID NO: 31561 - RNA, 64 nt, Human
guccaccuuuugcuaauuuaaaaucaucaggcuggaagaugaagccaugauagcuacagagaaa

SEQ ID NO: 31562 - RNA, 64 nt, Human
gcacuuaguagcugugaaggaaggugcagagucagaagaugaagaagaggaggaugugaaacuc

SEQ ID NO: 31563 - RNA, 64 nt, Human
aaaacuugcugcugcugcugaugaugaugaugaugaagaugaugaugaugaugaugacgaggaa

SEQ ID NO: 31564 - RNA, 64 nt, Human
auaaucuuccuugucuuuuucaggaagugaauaagaagaugacaguguuucaaaugccuugaaa

SEQ ID NO: 31565 - RNA, 64 nt, Human
ugagguuagagagauuggccagcaaaaacugugggaagaugaacuuugucauuaugauuucauu

SEQ ID NO: 31566 - RNA, 64 nt, Human
cuuaacuuuuuaaaggcuuuguccuauacauuuagaagaugagucaguugaauuaguacuggac

SEQ ID NO: 31567 - RNA, 64 nt, Human
aaauaaccaauaguugccaaucuaaaauggcagagaagaugaaauuugauaaacugaauuuuuu

SEQ ID NO: 31568 - RNA, 64 nt, Human
auagcuaaugaauuaggcaggggagcuauuuuuugaagaugaugaacuaaauguugaagacaag

SEQ ID NO: 31569 - RNA, 64 nt, Human
ucuacuucuugaacaguggucuauucugcuacaugaagaugaauacaaacaaaauuuuuguaua

SEQ ID NO: 31570 - RNA, 64 nt, Human
agcagaagaaagaauguguuaccaaugugagagugaagaugaaccacaagcagauggaaguggu

SEQ ID NO: 31571 - RNA, 64 nt, Human
caugggaaggcugaauugagugacuccccagaaugaagaugagaaggugaauauaaucaaugcc

SEQ ID NO: 31572 - RNA, 64 nt, Human
uuugauuucagaaucaggagucagcucugacaaugaagaugaugaugaugaagaagaugggaau

SEQ ID NO: 31573 - RNA, 64 nt, Human
uggauccaggcuucugccaaaaaaaaaaagagaagaagaugacgaugaugaccagucguacuau

SEQ ID NO: 31574 - RNA, 64 nt, Human
cccugugccguuauuaccuagcaacccuugcaaugaagaugagcagauccacaggaaaacuuga

SEQ ID NO: 31575 - RNA, 64 nt, Human
caguaaucaagguucaaugacaggaagugaauaagaagaugacagugauucaaaugauucaaau

SEQ ID NO: 31576 - RNA, 64 nt, Human
agucaucuaggauucaaugacaggaagugaauaagaagaugagagugauucaaaugauucaaau

SEQ ID NO: 31577 - RNA, 64 nt, Human
aaacgaugaagaagcccaacuggaguguugcuuugaagaugacgccuucuuauauuuucauagc

SEQ ID NO: 31578 - RNA, 64 nt, Human
gccagcugcugcagacaaaagaucacauuucugggaagaugagaacuuguuuccagaccagcau

SEQ ID NO: 31579 - RNA, 64 nt, Human
uuuguauacagagaaccggaugaauauaagcaaugaagaugaacauuuauugaucuucuacaua

SEQ ID NO: 31580 - RNA, 64 nt, Human
uuuuugugguuguaaauagacuuacuugcacuuugaagaugaguuacuccuugucaucuuacaa

SEQ ID NO: 31581 - RNA, 64 nt, Human
gccucauaucccccuuauugaugacacugaugccgaagaugaugcuccuacaaaacguaacucc

SEQ ID NO: 31582 - RNA, 64 nt, Human
aaugaauaugaaacacuacaaauuuauucuuggugaagaugauaccugaagcugucaccucuug

SEQ ID NO: 31583 - RNA, 64 nt, Human
aaggaaaauucucaaggccuuuugaagagcauaagaagaugaagauuguaaacuuguauaaaau

SEQ ID NO: 31584 - RNA, 64 nt, Human
accaagcacccuccuccccaguucacaaaaggaagaagaugaagauucugucucccuguucccc

SEQ ID NO: 31585 - RNA, 64 nt, Human
uuuacacuggagacagacacagagacacuguucagaagaugaacuaaacucagcaguggucugg

SEQ ID NO: 31586 - RNA, 64 nt, Human
ucaguggacuaccuaaaacaggggacagcuuuuggaagaugacaucugcaaugcuuuucaucuu

SEQ ID NO: 31587 - RNA, 64 nt, Human
ccaaagaaacaauuuucuucuuccuuauuucacugaagaugaaaaaaagcuaauccaggguacc

SEQ ID NO: 31588 - RNA, 64 nt, Human
guugcacuccugaaauucuauuaacauuuccgcagaagaugaguagggagaugcugccuucccu

SEQ ID NO: 31589 - RNA, 64 nt, Human
cauucuaauagauaaacuaguaccaucauguaaggaagaugaagccauguugcauccacauguu

SEQ ID NO: 31590 - RNA, 64 nt, Human
gguuuauuucuacuguaaucucucaauauucauagaagaugaagaaauaagucugacaacacua

SEQ ID NO: 31591 - RNA, 64 nt, Human
uuaguuauccauugggggguguauuuacugugaugaagaugagacagaugccaucagagcuuug

SEQ ID NO: 31592 - RNA, 64 nt, Human
ccuaauggcuauuaguguucaugguuaguguguugaagaugagccagguacauaacgcggcaca

SEQ ID NO: 31593 - RNA, 64 nt, Human
uuuucauucacuugaaagcuuaagugggaaaaaggaagaugauugucaggggaaaaacuuacaa

SEQ ID NO: 31594 - RNA, 64 nt, Human
aaaaaaagaauuaaaaaaaaaaaaaagaaaaacagaagaugaccuugauggaaaaaaaauauuu

SEQ ID NO: 31595 - RNA, 64 nt, Human
ccagcggcuccuaaaccgccuuacagcugaguuagaagaugaggagaggcagcagggauuuccc

SEQ ID NO: 31596 - RNA, 64 nt, Human
guaaaaacgagaaaaacaaaaugaaagaggggaagaagaugagagaccugcaaauccagcgcca

SEQ ID NO: 31597 - RNA, 64 nt, Human
gagcagaacacuuacauggaaaauccuaaacauggaagaugauuuaaaaaugauucacccugga

SEQ ID NO: 31598 - RNA, 53 nt, Human
agcaguucagaaggaauuagauggaagaugauguugaacagcuguuaacgucc

SEQ ID NO: 31599 - RNA, 64 nt, Human
aagugcagggcaccaguaaacaccauguauuauugaagaugaaucuguuuguauguauccuugu

SEQ ID NO: 31600 - RNA, 64 nt, Human
ugcuugaagugcuaauaauguuaaagacacuuaagaagaugaaauaauauucaaauuucauuuu

SEQ ID NO: 31601 - RNA, 64 nt, Human
uauugcauguccagcuggauucuggccugccaaagaagaugaugauuaaaaacauagauauugc

SEQ ID NO: 31602 - RNA, 64 nt, Human
auagacuuugugaaucugaacugcucuacuuugagaagaugaccgguuuggaguaaucagaaug

SEQ ID NO: 31603 - RNA, 64 nt, Human
auuccuuauacaugacagacacuuggcuacaugggaagaugauguuaauaauaaaaugauuuuu

SEQ ID NO: 31604 - RNA, 64 nt, Human
ccucgugggucugguagauuauccugaugaugaugaagaugaugaugaggaugaagauaaggaa

SEQ ID NO: 31605 - RNA, 64 nt, Human
agaagaugaagaagagaugugguuuaacacagaugaagaugacauggaagauggagaagcugua

SEQ ID NO: 31606 - RNA, 64 nt, Human
gaaucacagauaucgaagagaugccagaacacuagaagaugaagaagagaugugguuuaacaca

SEQ ID NO: 31607 - RNA, 64 nt, Human
uggcuuuaauuacaaacaugaggaaugauucacugaagaugaaaagauaggacggaugugauau

SEQ ID NO: 31608 - RNA, 64 nt, Human
uuuguauccacuuuuuagacuuaauagaaacauugaagaugaacauaaucuaccaacgaaagac

SEQ ID NO: 31609 - RNA, 64 nt, Human
guagauucuucgacugaggaaucuaccaguugucgaagaugauccguuagugauguucucuggg

SEQ ID NO: 31610 - RNA, 64 nt, Human
cugauuuuccaaauuauuugugaagcuguuuuuagaagaugagagacuaaggauucuucucuuu

SEQ ID NO: 31611 - RNA, 64 nt, Human
cgacugacucaaaaaguuaaauguugccacugcugaagaugauuaugagcaucgcaaacuuugu

SEQ ID NO: 31612 - RNA, 64 nt, Human
aaucccaggaacuccuaaaccuuccccugugacagaagaugagguuggcagcugaucagaccuc

SEQ ID NO: 31613 - RNA, 64 nt, Human
aaaguaggaaaaaaugaacaguaauaauuaugaugaagaugauaguagugcuaugggaugugug

SEQ ID NO: 31614 - RNA, 64 nt, Human
ccacagcacaaugagcaaaagacaaaccucgugggaagaugacacuggggcagcccuuccuauu

SEQ ID NO: 31615 - RNA, 64 nt, Human
uucauuuuugcuuuacuuugcauuugauugcugugaagaugaaagcauuagacuuuuauccccu

SEQ ID NO: 31616 - RNA, 64 nt, Human
uaaaaaugauuagauugcuaugccucaacucauagaagaugaacccuucaagaaaacgugaagu

SEQ ID NO: 31617 - RNA, 64 nt, Human
cucaggaguaagggaagagguccucuggcccccugaagaugagaaucaccccucucagugcacc

SEQ ID NO: 31618 - RNA, 64 nt, Human
ucccugcuuagugcaguuuccauuggaauggguggaagaugauaaagcucucuuuuuuaucuac

SEQ ID NO: 31619 - RNA, 64 nt, Human
ccuccuccaucucugagcccgugucacagauccagaagaugaaagaaggaagugagcauccuuu

SEQ ID NO: 31620 - RNA, 64 nt, Human
ucguguguugcaucgaugcguuuguggucaccacgaagaugaggaccaacuugaaaagauuccu

SEQ ID NO: 31621 - RNA, 64 nt, Human
uguacaggucacagauccccuuucccaacacuuugaagaugaaucuggagucugcuuacuugga

SEQ ID NO: 31622 - RNA, 64 nt, Human
uguuuuuucuagacguuucuugaacaaaaguucugaagaugaugcggccucagagagcuuccuc

SEQ ID NO: 31623 - RNA, 64 nt, Human
gcugagaccucuucuccaucccccuuauucaguggaagaugacgggggaucugaggcugugucu

SEQ ID NO: 31624 - RNA, 64 nt, Human
ccuagcgccuucccacuccuuaagcaagcacaaagaagaugaggcagagaauugucagagcuga

SEQ ID NO: 31625 - RNA, 55 nt, Human
cggacaccuucagauuguaagcuuugaagaugaacaauacaaacaaaugaauuua

SEQ ID NO: 31626 - RNA, 62 nt, Human
aauaaaauaaaaguugguccugugagaggauaaugaagaugacgaccucgcucaccuucccu

SEQ ID NO: 31627 - RNA, 64 nt, Human
augucuaccagccaccucucaccgcugccauugagaagaugaaaaccacccaccucaaggaaca

SEQ ID NO: 31628 - RNA, 64 nt, Human
auccagguucagggacuaaauacacuuggcagcugaagaugaauuggaauggucacguuuuuua

SEQ ID NO: 31629 - RNA, 64 nt, Human
auuuggaccuuuaaacagcuuguuuucccauggagaagaugacaaugccaaucauaggcauuuu

SEQ ID NO: 31630 - RNA, 64 nt, Human
aggcacagccagggagaggggaggagugggcagugaagaugaagccccaugcucaguccccucc

SEQ ID NO: 31631 - RNA, 64 nt, Human
ccagggaggcacacuguguuuuacugauugauuugaagaugauagagagccuagggggaugagu

SEQ ID NO: 31632 - RNA, 64 nt, Human
cugggcauggaccagccuucagauggcagaaguggaagaugagccuacuugugagcgaugugac

SEQ ID NO: 31633 - RNA, 64 nt, Human
cccugggcagggcagggcagccugucacccgugugaagaugaaggggcucuucaucugccugcg

SEQ ID NO: 31634 - RNA, 64 nt, Human
ugucccacucuuggauuagcagggguggguccaggaagaugauauuugcgucuuuugcccaccc

SEQ ID NO: 31635 - RNA, 64 nt, Human
cuggacagccagggcagggcuuuggggggcacuagaagaugagggugucggcugugaggcgggu

SEQ ID NO: 31636 - RNA, 64 nt, Human
guucuugccugcccaucuucuccgcuuuugggaugaagaugauagccagggcuguuguuuuggg

SEQ ID NO: 31637 - RNA, 64 nt, Human
cagcuccuugcuuugauuucauccuugauaaaaugaagaugaaacuuacacuacuucuccaagc

SEQ ID NO: 31638 - RNA, 64 nt, Human
ccccgggaucuguuugguagcaggagaaaugaaggaagaugaaaaagcaggcagggaagggggu

SEQ ID NO: 31639 - RNA, 64 nt, Human
acuucuucugaggacagacaggaauggccuugaugaagaugacaggcauggccggggucagcuc

SEQ ID NO: 31640 - RNA, 64 nt, Human
ucaagggaaaggcacuaaaugguuuuuuccucuggaagaugagauuguaggugauauuuauuuu

SEQ ID NO: 31641 - RNA, 64 nt, Human
gaaugugaggagcacgcgugagcuuauguaccgugaagaugaucagaggauaucuuauuuuaag

SEQ ID NO: 31642 - RNA, 64 nt, Human
caaaugaugauugaauucaaaaucaacccuucuagaagaugaaauuuaguacacuuuacaucug

SEQ ID NO: 31643 - RNA, 64 nt, Human
uuaaaaauauuccucuauaguaaauuauuuauuggaagaugacuuuuuuaaagcugccguuugc

SEQ ID NO: 31644 - RNA, 64 nt, Human
aagugaaggcaaaaggggaagguuauuugaucuggaagaugaguguucugaugugguggcuuuu

SEQ ID NO: 31645 - RNA, 64 nt, Human
agaugcuaagccaaauccagaagaacccauagaugaagaugaagauauucaaacagaaagaaua

SEQ ID NO: 31646 - RNA, 64 nt, Human
uagggauaugcucuggggcuuucaugggaaugaugaagaugauaaugagaaaaauguuaucauu

SEQ ID NO: 31647 - RNA, 64 nt, Human
ucugggcagaagcuuaucuuuuuugagaguguccgaagaugaaggcauggcgaugcccguccuc

SEQ ID NO: 31648 - RNA, 64 nt, Human
cugugugauaaaacacagaauuuacauauacacugaagaugaguuuuuaaucucuuacuuuaaa

SEQ ID NO: 31649 - RNA, 64 nt, Human
caggagucuguucugagguggcaauagcacaugggaagaugaacuuucccuguuuguuuacccg

SEQ ID NO: 31650 - RNA, 64 nt, Human
aguaagccuugcuaaucucuuuuauuuuguaacugaagaugagacccaaagaaagggaaagcug

SEQ ID NO: 31651 - RNA, 64 nt, Human
aaauggaacuuauuacauaccaauggcuuugcaagaagaugacauuucagaaaaucaaacaaau

SEQ ID NO: 31652 - RNA, 64 nt, Human
gugaauuguucugaguguugauggcaacagcuuggaagaugauugcaugcauccucauaaucau

SEQ ID NO: 31653 - RNA, 64 nt, Human
gcguauuauuauucgcccauuccgagagaaaguugaagaugacugaagaacuaaaaauacauaa

SEQ ID NO: 31654 - RNA, 64 nt, Human
guuucucuccaccgugacacaauccucaaacauggaagaugaaaggggaggggaugucaggccc

SEQ ID NO: 31655 - RNA, 64 nt, Human
aaagaaacuacauauggcaaagguggggaggggggaagaugaugcauucugaucauuauaaaga

SEQ ID NO: 31656 - RNA, 64 nt, Human
uguucacuaagaguguuuaucuugccagacauaagaagaugaaugguagagcaaccugaaggau

SEQ ID NO: 31657 - RNA, 64 nt, Human
ucugcauugagaggaaagguagcauaggauagaugaagaugaagagcauaccaggccccacccu

SEQ ID NO: 31658 - RNA, 64 nt, Human
agggaggcuaaaggcggccagguuugcagugcgggaagaugagcaggccagugggaggaggggc

SEQ ID NO: 31659 - RNA, 64 nt, Human
cccaagaccugggggacgacagacaucacgggaggaagaugagaugacuuuugcauccagggag

SEQ ID NO: 31660 - RNA, 64 nt, Human
accagcaucaaagaccaaagguagauaaauucacgaagaugaggagaaaccagugcaaaaagcc

SEQ ID NO: 31661 - RNA, 64 nt, Human
uuccaccuuuugccuauugaaauaaugcugcuaugaagaugaguguacaagugucuauucaaga

SEQ ID NO: 31662 - RNA, 64 nt, Human
ugugagauggcucuguggcugguaucccgacuuggaagaugaggaaacugaggcacacggccug

SEQ ID NO: 31663 - RNA, 64 nt, Human
gaacugcuugaugaaauguaucuccuuguaccuggaagaugaagcccaaacacccacaccucug

SEQ ID NO: 31664 - RNA, 64 nt, Human
gcaccccggucugcccugugcccuguggacaguggaagaugaggucaucugccacuuucaggac

SEQ ID NO: 31665 - RNA, 64 nt, Human
caucucccggagccucugcugucacucgcuuguugaagaugaauucuugaauucugccugccca

SEQ ID NO: 31666 - RNA, 64 nt, Human
ucuccaagucugugacgcugacuuuccagcacgugaagaugacccccaguaccaaaaaggucuu

SEQ ID NO: 31667 - RNA, 64 nt, Human
ccucggcagcagcgggaggcagaggaaggcggcagaagaugaagagcuuucccauccaggggug

SEQ ID NO: 31668 - RNA, 64 nt, Human
cacccucacuccaugaccugugagaucacaaagugaagaugaacccuuucugugcaggagcaga

SEQ ID NO: 31669 - RNA, 64 nt, Human
gcugaagauuauacuuucaauucagagcgaguuugaagaugacacuuugaggcaucgugucuau

SEQ ID NO: 31670 - RNA, 64 nt, Human
uucagaccacccugcugaggcuggccccaucucagaagaugagcaggagcuccacuacgcuguc

SEQ ID NO: 31671 - RNA, 64 nt, Human
gccucagucugcucauccguaaaguggggauagugaagaugacaccccuccccaccaccucuca

SEQ ID NO: 31672 - RNA, 64 nt, Human
uaaauguuuaauaucugacugaaauuaaacgagcgaagaugagcaccaccucccgugucugcag

SEQ ID NO: 31673 - RNA, 64 nt, Human
ucccagugcucacagauggcuggcccaugugcuggaagaugacacaguugccuucucuccgagg

SEQ ID NO: 31674 - RNA, 64 nt, Human
cauuccgucaggacgugaucugaaaacauguagagaagaugaguugaggacagcuuuucuaagg

SEQ ID NO: 31675 - RNA, 64 nt, Human
ugcagcaggagcagaggaaggcagacacccacaagaagaugacugaguucuagagaccccacaa

SEQ ID NO: 31676 - RNA, 64 nt, Human
cuguacauauuugagacuaguuuuuauuccuugugaagaugauauacuauuuuuguuaagcgug

SEQ ID NO: 31677 - RNA, 64 nt, Human
aaagcuauuuucauuuuagaaaaauggguuguuugaagaugaaagucuuuuaucuuuuuucaca

SEQ ID NO: 31678 - RNA, 64 nt, Human
uugaauggguaaaaacaaaacaaaacuuuuuuuagaagaugaauuugcugucauguuuugugga

SEQ ID NO: 31679 - RNA, 64 nt, Human
ucuccagcuuucuuuagcuugcccauggugaugugaagaugagaagaaauagcaaggcccaacc

SEQ ID NO: 31680 - RNA, 64 nt, Human
uuuaaagaaauguaaacagaucgcacagaguaaagaagaugaugauguaauagugaauaaaccu

SEQ ID NO: 31681 - RNA, 64 nt, Human
cuucauggagggacuccuuuucaauaagaauuaggaagaugagaaaguaauuugagauuuuacu

SEQ ID NO: 31682 - RNA, 63 nt, Human
gggagucaccucgacacugagggcccucggugugaagaugaaccuuccaccgucuucacugca

SEQ ID NO: 31683 - RNA, 64 nt, Human
cagaaaaucuggaaacaguugcagguguugggaggaagaugaaaucgagcugucuuuuaacuuu

SEQ ID NO: 31684 - RNA, 64 nt, Human
uuaaccagucugaaguuucauuuaugauacaaaagaagaugaaaauggaaguggcaauauaagg

SEQ ID NO: 31685 - RNA, 64 nt, Human
gauugacugaggaauguaugucuaaauuccuggagaagaugauauggauuggaaacugaaauuc

SEQ ID NO: 31686 - RNA, 64 nt, Human
uuugaaacauaguucaugguuuuaucaaagaacugaagaugagaauacuggucaucuaacuuug

SEQ ID NO: 31687 - RNA, 64 nt, Human
guuugauggacagcugucagcuuucucaaacugugaagaugacccaaaguuuccaacuccuuua

SEQ ID NO: 31688 - RNA, 64 nt, Human
uucuuggcucuugggggggacuagauccuguggagaagaugacuuaaacuuugcuuuuuguuuu

SEQ ID NO: 31689 - RNA, 64 nt, Human
ccuuugacuuugccacauggcaaggcacccagcagaagaugaggaugacgggugaugcuagaug

SEQ ID NO: 31690 - RNA, 64 nt, Human
agcagcuguuugcccagagcuggagccucagcuugaagaugaugcucaagguacucuucaugga

SEQ ID NO: 31691 - RNA, 64 nt, Human
gggggcgcccugcuccccucagaucagucaggaggaagaugacuaaggggagggauccucuggg

SEQ ID NO: 31692 - RNA, 64 nt, Human
guucuccucuguugcccuuccuaaaaaaugagcugaagaugacaguauuuuucuuuacaugcuu

SEQ ID NO: 31693 - RNA, 64 nt, Human
guuggaaauauagcacuucauggagucuuguuuugaagaugacaguuuucuguaacuacagcuu

SEQ ID NO: 31694 - RNA, 64 nt, Human
ugaauucauugucucagugaaggaagaaccuguagaagaugaccucguuccggagcuggguauc

SEQ ID NO: 31695 - RNA, 64 nt, Human
guucccagagaaugcggcugagaaugagaacgcugaagaugauccaguccacugaggauggguc

SEQ ID NO: 31696 - RNA, 64 nt, Human
gaguuuguuucuuugauuucuuugccaauggcaagaagaugagaugcccucagcacugaggauu

SEQ ID NO: 31697 - RNA, 64 nt, Human
gcucaaccccaaguccuuuaugcuuugucacagugaagaugagaccucugacguccaagccuug

SEQ ID NO: 31698 - RNA, 64 nt, Human
ugaaagguguugcuguuugaauugaugagaaauggaagaugagaacucccuaagaguucucaua

SEQ ID NO: 31699 - RNA, 64 nt, Human
ugggagaaacacagcccugacagcucguccgugggaagaugaggcaguccagguugugaggagc

SEQ ID NO: 31700 - RNA, 64 nt, Human
ggcccuggaugaggaauccuacuccuaugaccccgaagaugaggccagccucagccucuauggc

SEQ ID NO: 31701 - RNA, 57 nt, Human
gcaauuuuuuucaggauuaaaagaucagaagaugagaggggaaugaauacuucagau

SEQ ID NO: 31702 - RNA, 64 nt, Human
agaaacuaaagcccucacugucauuauucuuuaagaagaugaaauuacucuggauguuugguau

SEQ ID NO: 31703 - RNA, 64 nt, Human
gcuggugauuuaugaagagaucagagacccugaggaagaugaugaguaacuccguaagugaacc

SEQ ID NO: 31704 - RNA, 64 nt, Human
gcuggugauuuaugaagagaucagcgacccugaggaagaugacgaguaacuccguaagagaacc

SEQ ID NO: 31705 - RNA, 64 nt, Human
aauaucugucuucucccuaaaaugucagccuacugaagaugaaccaucucuuucaugucuaccc

SEQ ID NO: 31706 - RNA, 64 nt, Human
aaugcuauuaacuuaaauagccauugaggaguuagaagaugaauuguucaugaagucgguguua

SEQ ID NO: 31707 - RNA, 64 nt, Human
cuguuacuuauguagaaacugaggcccagagagggaagaugaccugccccaaguggugagcaag

SEQ ID NO: 31708 - RNA, 64 nt, Human
uagcugguuccugcuagaaaugggaaaugccuaagaagaugacuucccaacugcaagucacaaa

SEQ ID NO: 31709 - RNA, 64 nt, Human
uaauguuaaaauugcacugguguuagauauuaacgaagaugauuggaaaaaagucugaaagaua

SEQ ID NO: 31710 - RNA, 64 nt, Human
acacauuuuaaaacguuuucucuuccuugugauugaagaugaaaggaguaagaaauuaaggcau

SEQ ID NO: 31711 - RNA, 51 nt, Human
ugcuuggcauggcauccuaaggaagaugaccucauguucauuguuccuggu

SEQ ID NO: 31712 - RNA, 64 nt, Human
guaagauuugugguguuccuaggccaaacuggaugaagaugaaauuaaauguguggcuuuuuuc

SEQ ID NO: 31713 - RNA, 64 nt, Human
cuuagaaauucccucucuccaaucaucuaaaauugaagaugacugaaucuauuuuaagaucuaa

SEQ ID NO: 31714 - RNA, 64 nt, Human
aacggugguucagcuuguagagccaugacucugugaagaugaauguugucucuuaacuuggaca

SEQ ID NO: 31715 - RNA, 64 nt, Human
cuuuguccucauccccagcacuggccucccuguggaagaugaacauaucccagccaccugugua

SEQ ID NO: 31716 - RNA, 64 nt, Human
gauaucuucuguuuucccauugcaguugauuugagaagaugaagguuuaaauauuguugaaagu

SEQ ID NO: 31717 - RNA, 64 nt, Human
aaggaacuuugcauguguaauuacuuaaggauaugaagaugagauugugcuggauuauuaagca

SEQ ID NO: 31718 - RNA, 64 nt, Human
gucacacuucuguccaccuggccuccucucgccuggccgccagccccagccccagccccagccc

SEQ ID NO: 31719 - RNA, 64 nt, Human
ccggccccuccccgcucccuuccacucugcacgaggccgccacaccggcgcuggcucccugccc

SEQ ID NO: 31720 - RNA, 64 nt, Human
gccuugugaguggccugcugccucaccucccgcaggccgccacacuuauugcaggucagugauc

SEQ ID NO: 31721 - RNA, 64 nt, Human
ccccaaaugcuggcugcccccagccaagcauuggggccgccauccugccuggcacuggcugaug

SEQ ID NO: 31722 - RNA, 64 nt, Human
cugaggccccaguagggguggggagggagggagaggccgccacccccgccggugucugcuguuc

SEQ ID NO: 31723 - RNA, 64 nt, Human
gcugacauuuccccuccuuccugccaaggcuggaggccgccagguguuugcucucuccuugugg

SEQ ID NO: 31724 - RNA, 64 nt, Human
acccuguuguggacagcucucagaagcgcuaccgggccgccagugccuucuucaccuacguguc

SEQ ID NO: 31725 - RNA, 64 nt, Human
cuucagucccacgaggagcugacacguccucucuggccgccauccggcucgcacaggggccucc

SEQ ID NO: 31726 - RNA, 64 nt, Human
agcggcuggagaaagaugcaguccucaggaagggggccgccacccuccccuaugcugguagaug

SEQ ID NO: 31727 - RNA, 61 nt, Human
cagugugcacagcaguauagccacccggccuggccgccaccaccgccaccgagagccccgc

SEQ ID NO: 31728 - RNA, 64 nt, Human
ugggguaugggagagaagagaaugcacaaacagaggccgccauuuuggauucuuauggacaaug

SEQ ID NO: 31729 - RNA, 64 nt, Human
cugagccuugggaccccugagcuugcagagaugaggccgccauguccucugccuagccgcagag

SEQ ID NO: 31730 - RNA, 64 nt, Human
cccgcuccuguuagccccauggggcugccgggcuggccgccaguuucuguugcugccaaaguaa

SEQ ID NO: 31731 - RNA, 64 nt, Human
gcaucuuucgccaguggauucgccucaagguugaggccgccauuggaagaugaaaaauugcacu

SEQ ID NO: 31732 - RNA, 64 nt, Human
cuggagucauggccccacagggcuugaagcccggggccgccauugacagagggacaagcaaugg

SEQ ID NO: 31733 - RNA, 64 nt, Human
gccucccgaagugccaagagugcagccucugcccggccgccaccccgucugggaagugaggagc

SEQ ID NO: 31734 - RNA, 64 nt, Human
ugcccagucuggaaagugaggagcgucucugcccggccgccaucccaucuaggaagugaggagc

SEQ ID NO: 31735 - RNA, 64 nt, Human
gcgcccccagcccagcccacuccccgcauggggaggccgccaccaccaacaccucaucauccuu

SEQ ID NO: 31736 - RNA, 64 nt, Human
gcugccaugucucagaugaggagggagagaaggaggccgccagacucgagaggugggaggaacu

SEQ ID NO: 31737 - RNA, 64 nt, Human
gggcggggacaugguaaccugguccacggagggcggccgccacccucgcguagcuuuccugugg

SEQ ID NO: 31738 - RNA, 64 nt, Human
ggcuacauggucaaaaagcuccuuggggcaugaaggccgccagcucccgccagccgcuccccag

SEQ ID NO: 31739 - RNA, 64 nt, Human
ugaggcucuugaaacaggacguccgcucgggggcggccgccaggggccgcgcggcucugcuccu

SEQ ID NO: 31740 - RNA, 64 nt, Human
caccugugagcgcagccgaggcgcaggccgagugggccgccaggaccaagcgagguggaccccg

SEQ ID NO: 31741 - RNA, 64 nt, Human
cccuagagcccggccugggccaaugauggagggcggccgccagcccagggccugcccauccaga

SEQ ID NO: 31742 - RNA, 64 nt, Human
ggguuguauguauguguguccuacccaaaccuguggccgccacuuuugaauucucagauugccc

SEQ ID NO: 31743 - RNA, 64 nt, Human
guuuggaaucacugugaggucuccagaaggaccuggccgccagccccuucaucaccaucuccau

SEQ ID NO: 31744 - RNA, 64 nt, Human
cugugcugucaggaagagggggugcugguuugagggccgccacugcaguucugcuaggucugcu

SEQ ID NO: 31745 - RNA, 64 nt, Human
auccaggcggccaagcacaaacugggggagaggaggccgccagcccggaggcugcagcccagaa

SEQ ID NO: 31746 - RNA, 64 nt, Human
uugcccagauuuguguauuguacuuauugccacuggccgccacuuugacuuauuuucucuaaua

SEQ ID NO: 31747 - RNA, 64 nt, Human
cucucuauaccagcaugccgacacuggcugguguggccgccacagagaguguuaccaccagcac

SEQ ID NO: 31748 - RNA, 64 nt, Human
ucaugcugugccacuccagagacuucugccaccuggccgccacacugaaaacuguccugcucag

SEQ ID NO: 31749 - RNA, 64 nt, Human
accaagacagcaagcuacgcaauugcagccacccggccgccaaggcaggcuugggcugggccag

SEQ ID NO: 31750 - RNA, 64 nt, Human
gcgaaaguuguaacaaguggggguggggggugcgggccgccaccacugcuccuugacucugccg

SEQ ID NO: 31751 - RNA, 64 nt, Human
ccccuuccccaggcccaccaucaccaccgccucuggccgccacccccaucuuccaccugugccc

SEQ ID NO: 31752 - RNA, 64 nt, Human
cacuuauuguccaggugaggcccaagagcccuguggccgccaccugaggugggcuggggcugcu

SEQ ID NO: 31753 - RNA, 64 nt, Human
acagacacggaggccccgccugcuggccagcuguggccgccauaggggagcuggugaggaguga

SEQ ID NO: 31754 - RNA, 62 nt, Human
gcugucccugccucaaguagcaggccggcccgggccgccaccgcccaucccagaccauggag

SEQ ID NO: 31755 - RNA, 64 nt, Human
ugcccacacccccacuucucuagccguuugcagaggccgccacccagcaggggccugaaaagga

SEQ ID NO: 31756 - RNA, 64 nt, Human
cuaggggcccucgggggagaccgcaggcuccucuggccgccagcgcccacuuucgggacaccag

SEQ ID NO: 31757 - RNA, 64 nt, Human
ugcaggggucaaggcugggcccugcaguggggcgggccgccagccccagcaguuuacagacgca

SEQ ID NO: 31758 - RNA, 54 nt, Human
ccuggcaccccuggcugugacuguggccgccacggccacccggaaugugaaggg

SEQ ID NO: 31759 - RNA, 64 nt, Human
uccuaguggagggaguaauccuaacacccaggcuggccgccagcuggcaccugccucuauccca

SEQ ID NO: 31760 - RNA, 64 nt, Human
cagccgcugagcgcccgcacccgccgcaccccgaggccgccaauuguccgccccgccagcgcug

SEQ ID NO: 31761 - RNA, 64 nt, Human
ugcagugugcacagcgaggagcagacccaggcagggccgccagggugacacaggccacccuucc

SEQ ID NO: 31762 - RNA, 64 nt, Human
agaaugggagggagaacggggccccaggagacccggccgccaccccacccgcuacccuugggug

SEQ ID NO: 31763 - RNA, 64 nt, Human
ucaucucaggcgggcuggccggggcccucgccgcggccgccacgaccccccuggacgucuguaa

SEQ ID NO: 31764 - RNA, 64 nt, Human
ugcacgccacauggguguggucugcaucucaguuggccgccaucaguguaaauagagcuuaaag

SEQ ID NO: 31765 - RNA, 64 nt, Human
agggcagccucgcggucuugggcacuggugggucggccgccauagccccaguaggacaaacggg

SEQ ID NO: 31766 - RNA, 64 nt, Human
gaggaccagggccugccacuaagcccgccccgcuggccgccagcugcccguccccagagccacu

SEQ ID NO: 31767 - RNA, 64 nt, Human
ugucagagagcggugagaccuggagcgaggugugggccgccauccccaugucagauccccaggu

SEQ ID NO: 31768 - RNA, 64 nt, Human
cccuuucuguuuccaguccaguuacggacuucccggccgccacugggcccugccggucaccagg

SEQ ID NO: 31769 - RNA, 64 nt, Human
guggccaucuaugguagggcuggaagcugaggcuggccgccagcugugggcugggguggggugg

SEQ ID NO: 31770 - RNA, 64 nt, Human
cuggcuggcuggcuguaaagcacugaagccccccggccgccaaccccugaaagcagaaccuggc

SEQ ID NO: 31771 - RNA, 64 nt, Human
guagcgggcggggccacugcggucgccggggcggggccgccaagggccggguaggacgggcaga

SEQ ID NO: 31772 - RNA, 64 nt, Human
ucgugcagugggaugagcuacuuugccagcuagaggccgccacgcaagugaagccagcagagga

SEQ ID NO: 31773 - RNA, 64 nt, Human
ucuccaggugcaauugaagccucucagcagcggaggccgccauguggagagagcaggcaggccc

SEQ ID NO: 31774 - RNA, 64 nt, Human
ugcugcuguggccuccagcuuggcugguuuugcaggccgccagcaggaaggcgaaggugguagu

SEQ ID NO: 31775 - RNA, 64 nt, Human
cagagaagcucucgggcuaggaagaucucugcagggccgccagggagaccuggacacaggccug

SEQ ID NO: 31776 - RNA, 64 nt, Human
auggacacgucuagauagaggccuccguccccauggccgccaccgcucuggaccacaggcgggg

SEQ ID NO: 31777 - RNA, 64 nt, Human
ugacccccugggccaggugagguuggggccugugggccgccaguccauacggugcugucacugc

SEQ ID NO: 31778 - RNA, 64 nt, Human
cgcuccagcugaucucguuccgccgguuccccuuggccgccaguuccguucuccucacgggccg

SEQ ID NO: 31779 - RNA, 64 nt, Human
ggcuuccagggccguaggugccuuucugcacacaggccgccaggacucguggugucuccaggcu

SEQ ID NO: 31780 - RNA, 64 nt, Human
gagacagagggagcagcugaggccucucuccacuggccgccagccucccuagcacaaggggacc

SEQ ID NO: 31781 - RNA, 64 nt, Human
ucaggugaccuuacucaggagcagauaucuccuuggccgccauggagccucauccauccacacg

SEQ ID NO: 31782 - RNA, 64 nt, Human
ucgaagcaauaaacccaggcuggccggccgggccggccgccaccagcggccuccgccgccccgg

SEQ ID NO: 31783 - RNA, 64 nt, Human
cgcaagggcaaauacacccugaccccacgcauguggccgccagccccaggagcccagccucuug

SEQ ID NO: 31784 - RNA, 64 nt, Human
gcacgagugcguguaccuggugcgggacucacccggccgccagacugccugggccugcccagau

SEQ ID NO: 31785 - RNA, 64 nt, Human
ccucacccaacucccuuugccucuccccaaaccgggccgccaggaucccuccccgcggcggcga

SEQ ID NO: 31786 - RNA, 64 nt, Human
aagcuggagcagcggauugcucuggagcagccaaggccgccagcguguggagcagagcucuccc

SEQ ID NO: 31787 - RNA, 64 nt, Human
cagucugguaggagagagugcugcagagccacguggccgccacgcagugugcuuagggccugag

SEQ ID NO: 31788 - RNA, 64 nt, Human
ucccaggaguacuaagagggcccgcgccgcggccggccgccaggccuccccaugccaccacaaa

SEQ ID NO: 31789 - RNA, 51 nt, Human
cacgggguaccaaggccugagggccgccagcggccucuacggccccgacgg

SEQ ID NO: 31790 - RNA, 64 nt, Human
acagacucuucuccugcagugcacuugcccccguggccgccaucauccccccgccccccgacgu

SEQ ID NO: 31791 - RNA, 64 nt, Human
caccaucguuuuuauaaaggggggucuuuuuggaggccgccaucugauugcaacaccucgaguu

SEQ ID NO: 31792 - RNA, 64 nt, Human
cagccugugccugugauuguccagguguggccuaggccgccaccuucugcugccccggaguccc

SEQ ID NO: 31793 - RNA, 64 nt, Human
uccuugggcagaaugaauucgaugcguauucuguggccgccaucugcgcaggguggugguauuc

SEQ ID NO: 31794 - RNA, 64 nt, Human
ggggcccccaggcuccaugccuucuugggaggguggccgccaacgccuuuccuguguuauggca

SEQ ID NO: 31795 - RNA, 64 nt, Human
ccuuccaauguccaaaacugcuaacccucgacguggccgccaaguuagucgcuccuugcuaacc

SEQ ID NO: 31796 - RNA, 64 nt, Human
uaaaaagggagccgcgaagggcgcugggcaguguggccgccaacuuccaccccggcaagccccu

SEQ ID NO: 31797 - RNA, 64 nt, Human
uggacuuguguaaacagcagcagucacguuccucggccgccacaaccaacaccaaagcaggaaa

SEQ ID NO: 31798 - RNA, 64 nt, Human
augucuuccugggcaucggccuggccugguccguggccgccaucuacugggcucugcagggaca

SEQ ID NO: 31799 - RNA, 64 nt, Human
cuccuguccaaaguagggaugcggauccugcuggggccgccacggccuggcuggugggaaggcc

SEQ ID NO: 31800 - RNA, 64 nt, Human
gccugaaggauggcagacgccuggugucaggaggggccgccaccaaggagcagcagcuggggca

SEQ ID NO: 31801 - RNA, 64 nt, Human
ggggcacugguuuacacuuugccgggaccaucagggccgccaagcaggucaggggcugggggcu

SEQ ID NO: 31802 - RNA, 64 nt, Human
ggagcagcaccuccuaacuggccugaccugcaguggccgccagggaggucugggcccagcgggg

SEQ ID NO: 31803 - RNA, 64 nt, Human
ggacccccgggcggccgggcaggggaaggggccuggccgccaccugcucacucuccaguccuuc

SEQ ID NO: 31804 - RNA, 64 nt, Human
gagcaugcagggaacccucgugcagcugagcuggggccgccaaagaccggggcugccaaagggg

SEQ ID NO: 31805 - RNA, 64 nt, Human
ccugaaccccacaguccgccuggccaggccuccuggccgccacgcagaauaccucgaaccaggc

SEQ ID NO: 31806 - RNA, 64 nt, Human
caagcaggcuucugagagcccguggccgcacacuggccgccacggaaaagcagucuucugcacg

SEQ ID NO: 31807 - RNA, 64 nt, Human
cuucgcugccaggacaccugccccagcgcggcuuggccgccauccgggacgcuuccagaccacc

SEQ ID NO: 31808 - RNA, 64 nt, Human
gucacgucuugcucugagaguucaaguccugccaggccgccagcccagagccuccucacccuau

SEQ ID NO: 31809 - RNA, 64 nt, Human
ggcaaaagacaggcccugcuuggccguggucacuggccgccaagaucagggcuacagaugucug

SEQ ID NO: 31810 - RNA, 64 nt, Human
ccgggccuccuggccuggaauccucagccucucuggccgccaguagccugaggcuacggcuccu

SEQ ID NO: 31811 - RNA, 64 nt, Human
ggaggcuccucuggccuggcugggcugggucuggggccgccacaggccccucacggggcggcag

SEQ ID NO: 31812 - RNA, 64 nt, Human
aagccagccagguugaacuguagcgaggcccccaggccgccaggaauggaccaugcagaucacu

SEQ ID NO: 31813 - RNA, 64 nt, Human
cagggcuggccucggccucgagucucgggacagaggccgccaguggagaucauggcuuugggua

SEQ ID NO: 31814 - RNA, 64 nt, Human
cgcucccccgacgcauguggcuccagcccggccuggccgccagggagcgccacuggcuucccgc

SEQ ID NO: 31815 - RNA, 64 nt, Human
gagccuccgggccugaauacgggccagccgccgaggccgccagagcagggccgccuggucccac

SEQ ID NO: 31816 - RNA, 64 nt, Human
cuccucaggccgggggagccacugccccguccaaggccgccagcugugaugcauccucccggcc

SEQ ID NO: 31817 - RNA, 64 nt, Human
gccucccaaagugccgagauugcagccucugcccggccgccaccccgucuggaaagugaggagc

SEQ ID NO: 31818 - RNA, 64 nt, Human
caccccgucuggaaagugaggagcgccucugcccggccgccaucccaucuaggaagugaggagc

SEQ ID NO: 31819 - RNA, 64 nt, Human
gcugugggccuggcagggcuggcaggaugccgugggccgccagaucugcaccaccuucgagcac

SEQ ID NO: 31820 - RNA, 64 nt, Human
acaguucccaccuccuggcaccucccuccccuggggccgccaccccuucugggcucgugauggu

SEQ ID NO: 31821 - RNA, 64 nt, Human
aacagguuccuccuuugggcccagcggccggcgaggccgccagacauacacacguuaccagacg

SEQ ID NO: 31822 - RNA, 64 nt, Human
uucuuuucuuuccucaaucuaugcaagcggcucuggccgccaucaucuccugggaugccagagg

SEQ ID NO: 31823 - RNA, 64 nt, Human
uauugugacaucgagcuggaugugugggguucuuggccgccaucuguacuguagcacuggccuc

SEQ ID NO: 31824 - RNA, 64 nt, Human
ggagagagagagggagcggaggcuaaggacuggaggccgccaggcaggcguggccgagggaaga

SEQ ID NO: 31825 - RNA, 64 nt, Human
cgcaucaggaaggcuagaguuacccagagcaucaggccgccacaagugccugcuuuuaggagac

SEQ ID NO: 31826 - RNA, 64 nt, Human
cauccagaccaaagccaugccauugcgcugccccggccgccaguccgcccagaagccauagacg

SEQ ID NO: 31827 - RNA, 64 nt, Human
uuccugccgguuccgcccgcccucccggagagguggccgccaugcuucugugccgaccacgccc

SEQ ID NO: 31828 - RNA, 64 nt, Human
cgggccagcccaccagccaauggaccccuccucaggccgccagugucgcccugccccuuuuuaa

SEQ ID NO: 31829 - RNA, 64 nt, Human
gcuuucuuuccgucugucucaacagcugagauggggccgccaaggagugccuuccuuuugcucc

SEQ ID NO: 31830 - RNA, 64 nt, Human
ccaggcacgcggcccauggggcugggccccugcuggccgccacucuccgggcucuccuuucaaa

SEQ ID NO: 31831 - RNA, 64 nt, Human
ccgccaccagaccccuaaaucuuggccaucguguggccgccaccuccgggaagccuuguacagu

SEQ ID NO: 31832 - RNA, 64 nt, Human
caguggaaccaguacuaucagaaccagggccaguggccgccauacuacgggaacuacgacuacg

SEQ ID NO: 31833 - RNA, 64 nt, Human
guacgugcauccccaguccccgccggggcgggcgggccgccagagcagcuuuuuacaauccaga

SEQ ID NO: 31834 - RNA, 64 nt, Human
ccggugcugcuccgccaguuggugcccgcccuggggccgccagugcgcgcggagcugcugggcg

SEQ ID NO: 31835 - RNA, 64 nt, Human
aggucuucguaugaugcccaccuggcccugcccuggccgccacgcuggcugggguguagggccg

SEQ ID NO: 31836 - RNA, 64 nt, Human
uggcacuaccugagccgggagacccaggacuggcggccgccaugcccgcaguagguucuagggg

SEQ ID NO: 31837 - RNA, 64 nt, Human
cggugcugcccagcucaagccagaagcugacuuuggccgccauggggacaucaggcaaggucug

SEQ ID NO: 31838 - RNA, 64 nt, Human
aaaacaaccugaaagaggcgauugaaaccauuguggccgccaugagcaaccuggugccccccgu

SEQ ID NO: 31839 - RNA, 64 nt, Human
acagaggggccgggcugccagccacccgcccguuggccgccacuaccuccuccgcugcgcuuuu

SEQ ID NO: 31840 - RNA, 64 nt, Human
acccacccuuuuacacggcagagaggaaggacgcggccgccauggaccccaugggagagugagu

SEQ ID NO: 31841 - RNA, 64 nt, Human
agcaaaaauaaccacugucucauucaugggaaaaggccgccaaacaaauuuguuacuggaacca

SEQ ID NO: 31842 - RNA, 64 nt, Human
cgugugagggagguggcacgggccagggcgcgggggccgccagccgcacuucugaggagaccag

SEQ ID NO: 31843 - RNA, 64 nt, Human
ccgccugcagaccucucccuuggccggcucccugggccgccaucugcguguacuucagggccug

SEQ ID NO: 31844 - RNA, 56 nt, Human
accucagugacauugacugacggcccggccgccagcgcgggucuuguccauagugu

SEQ ID NO: 31845 - RNA, 64 nt, Human
ccuuuguuugcuuuuguggcaucaugaaacgccuggccgccaacuuccacccugacggccgcgc

SEQ ID NO: 31846 - RNA, 64 nt, Human
agcaagacugcugccaccagccaccugcuugugaggccgccacuuggcaugaagccuccacagc

SEQ ID NO: 31847 - RNA, 64 nt, Human
cccugcuuccccuucuuucuuuccucuuuccccaggccgccacugcccuugccccuuucaucuc

SEQ ID NO: 31848 - RNA, 64 nt, Human
gggggcuggaggacacccucaguuugcuccacauggccgccacccccugcaccagcccacaucc

SEQ ID NO: 31849 - RNA, 64 nt, Human
cagugggucagcaggcacggcuggcagccuucucugcccugagggucgaaggucgagcaggccg

SEQ ID NO: 31850 - RNA, 64 nt, Human
cagggacaggcaagacaacuggcaagcuugcagcugcccugauggugcaggugcagggagguga

SEQ ID NO: 31851 - RNA, 64 nt, Human
ccccggccucucgagggcuggaucagcagccgccugcccugaggcugccccggugaauguuauu

SEQ ID NO: 31852 - RNA, 64 nt, Human
ugggguaaagacaccuggaucagacuccaagggcugcccugagucugggacuucugccuccaug

SEQ ID NO: 31853 - RNA, 64 nt, Human
ggggccucugaagggauuccucacugugggcagcugcccugagcuucaggcagcaguguuuauc

SEQ ID NO: 31854 - RNA, 64 nt, Human
gaagaaaccaaaugagcuccacccucacuuugccugcccugauaugaucacuuguugagucacu

SEQ ID NO: 31855 - RNA, 64 nt, Human
gagacacaguuugcaccauuagccuuaccugcccugcccugauugugagacccaaauguguagg

SEQ ID NO: 31856 - RNA, 64 nt, Human
uucccuuuaucuuuuuucauucuucccgguccucugcccugaucuguguaacucuuaucuuggg

SEQ ID NO: 31857 - RNA, 64 nt, Human
gggaugggcuggguaagaccuggcccuccccugcugcccugaagaccaccccagucuaccucgg

SEQ ID NO: 31858 - RNA, 64 nt, Human
cuaagccaugaaaccagagacaaaaucucuauacugcccugaguuggggggaauucucagugcc

SEQ ID NO: 31859 - RNA, 64 nt, Human
ccuuagagacucauagugagcacaaggaaaguuuugcccugagauucaugguuauggcugggua

SEQ ID NO: 31860 - RNA, 64 nt, Human
auuuuaaaucucacuucacuuagccgacauuccaugcccugaccaauccuacugcuuuuccuaa

SEQ ID NO: 31861 - RNA, 64 nt, Human
gggggaggaagaguaaacacagugcuggcucggcugcccugagggugcucaaucaagcacaggu

SEQ ID NO: 31862 - RNA, 64 nt, Human
accugguuuuguuuuccugcagcuguugacuuguugcccugaaguacaauaaaaaaaauucauu

SEQ ID NO: 31863 - RNA, 64 nt, Human
gcgcccuuggggcuaugaaugggaggcucagcagugcccugaggaugggcuuccuuguccugug

SEQ ID NO: 31864 - RNA, 64 nt, Human
uccaggcacccuucuuuccucuuccccuugcccuugcccugaccucccagcccuauggaugugg

SEQ ID NO: 31865 - RNA, 64 nt, Human
cagaggggugaggcccuggggaggcagggguuggugcccugacuccugugaggggaaucucagu

SEQ ID NO: 31866 - RNA, 64 nt, Human
guauugaguaaaguauacuuuuugcaguagaucaugcccugaccuccaauaaaaaccucuuuaa

SEQ ID NO: 31867 - RNA, 64 nt, Human
uggagggaucuagcuggccuaugucuacacucagugcccugagaagccuggaagacuuucuggc

SEQ ID NO: 31868 - RNA, 64 nt, Human
acuuuugaguguuuaauaaagccggaagugguguugcccugaaccagcagauuuucaccugggu

SEQ ID NO: 31869 - RNA, 64 nt, Human
cagccacgaggugguagcucugagcccuccuucuugcccugagcuuuccggggaggagccuugg

SEQ ID NO: 31870 - RNA, 64 nt, Human
ugggggauccccgccuagggcagugcugcauggcugcccugauuccaagugcucuuaucgccuc

SEQ ID NO: 31871 - RNA, 64 nt, Human
aggugccgugucaagcccaggcagacgagaccucugcccugaagaccaacaccagcccgugggc

SEQ ID NO: 31872 - RNA, 64 nt, Human
cuggucuucuggucuccuuggagaaagguucuguugcccugauuuaugaacucuauaauagagu

SEQ ID NO: 31873 - RNA, 64 nt, Human
ggagccucccacuuucaccagagcagccucacugugcccugauucacacacuguggcuuuccac

SEQ ID NO: 31874 - RNA, 64 nt, Human
cacuaacagccuccaagcccccuggcacuucuguugcccugagagugucccaggggauucagag

SEQ ID NO: 31875 - RNA, 64 nt, Human
ucccuuuugccugaugaagacugagggucagauuugcccugagcugcacuggacaaaaugccuc

SEQ ID NO: 31876 - RNA, 64 nt, Human
uggagggccuggauuucuuuuugggcuggaaugcugcccugaggguggggcuggcucuuacuca

SEQ ID NO: 31877 - RNA, 64 nt, Human
gacccccauuuuaaccuucagcaugggagaugcaugcccugaagagcaggauccagaaggaaga

SEQ ID NO: 31878 - RNA, 64 nt, Human
auguagagaguucuaaugaggaaucauuuucaugugcccugacauguacacaugcgaaaacauu

SEQ ID NO: 31879 - RNA, 64 nt, Human
uacuuuaucuuuucuuaauaauccugcaaaucucugcccugaauccgaaaucugaaaauguacu

SEQ ID NO: 31880 - RNA, 64 nt, Human
uggccagggcaacaauaauuggaguucauacugaugcccugaggcacugaaaaaaaaaaaaauc

SEQ ID NO: 31881 - RNA, 64 nt, Human
ccaaauuuauugaaccaacaaaaauaauuacuucugcccugagauaagcagauuaaguuuguuc

SEQ ID NO: 31882 - RNA, 64 nt, Human
ugaagagaugucuaguccucagaaacuucuuuccugcccugauuggggcucuugcuguuccguu

SEQ ID NO: 31883 - RNA, 64 nt, Human
ugcaauaccgucuggcugggggcugucccugcccugcccugagcugaguccuuucccugggagc

SEQ ID NO: 31884 - RNA, 64 nt, Human
cucuccugccaacuuacagggguggggcucgaguugcccugaagaucauuaagaauguggagaa

SEQ ID NO: 31885 - RNA, 64 nt, Human
ugauacguagguuccccaccaaaagcaggcuuucugcccugagggacaucuucccacuccccug

SEQ ID NO: 31886 - RNA, 64 nt, Human
uaaguccaggaugaacuaggagaaagcaauuuguugcccugaugauaacugaugauuuucaccc

SEQ ID NO: 31887 - RNA, 64 nt, Human
acugccucagucuucauccaaacaccuuucccuuugcccugagaccucagaaucuucccuuuaa

SEQ ID NO: 31888 - RNA, 64 nt, Human
ggucucuucccgaugccaguggcugggcugggccugcccugaauugagagagaagaaggggaga

SEQ ID NO: 31889 - RNA, 64 nt, Human
ccaccccccaagugaaacgguuugagagacgcagugcccugaccuggacaagcugugcacgucu

SEQ ID NO: 31890 - RNA, 64 nt, Human
acuacuucuguagcaggggccuccuaagccaggcugcccugaugcuaggaagccagcucugggg

SEQ ID NO: 31891 - RNA, 64 nt, Human
gaaggaggcggggagggcuccuuucuaccuccagugcccugagccuccaguccgucucccccug

SEQ ID NO: 31892 - RNA, 64 nt, Human
ggagacauuggauguggagcuccugcuggaugcgugcccugaccccugcaccagcccuucccug

SEQ ID NO: 31893 - RNA, 64 nt, Human
cuuuuccucuugucuucccuacuuuauuaggacuugcccugaauaccauuuucuaccccuugcc

SEQ ID NO: 31894 - RNA, 64 nt, Human
gggucugguauaaaaacacuccuggaaacgccuuugcccugauccaaauguuagcacuugcuag

SEQ ID NO: 31895 - RNA, 64 nt, Human
augccccaucucgacucccauccccaucuaucugugcccugagcauggcucugcccccaggucg

SEQ ID NO: 31896 - RNA, 64 nt, Human
gaugucccugaaacuucaccaggaccaguucacuugcccugacgaguaugaagacccagcaguc

SEQ ID NO: 31897 - RNA, 64 nt, Human
ucuuugucugccuguuucuaaggaaaugcaugugugcccugagccgugaugauccucccauccg

SEQ ID NO: 31898 - RNA, 64 nt, Human
caaggcccccugccccagcacugaaucccagcgcugcccugaggcccccagccacucccuccag

SEQ ID NO: 31899 - RNA, 64 nt, Human
aaggaagagcccuggaggugguugggggcaaaugugcccugaguccuuggggugguucugcuua

SEQ ID NO: 31900 - RNA, 64 nt, Human
agugcaugauccccauguugcaauauggagucucugcccugagaucuuccccaucucaguuuuc

SEQ ID NO: 31901 - RNA, 64 nt, Human
gauuuucaaggccuuaacaaaguuaaaggaccacugcccugagguuacugcacugaggccaagu

SEQ ID NO: 31902 - RNA, 64 nt, Human
acugggaccucuggucggugcaaaguggcaagucugcccugaaccuguaagcaucaaauaagca

SEQ ID NO: 31903 - RNA, 64 nt, Human
uguaacaaaaagaaguggguuuuaguucuuucugugcccugauauuuuguauauuaaugaauua

SEQ ID NO: 31904 - RNA, 64 nt, Human
ccugggcucuggaccccgggcacacgagggacggugcccugagcccguuagguuuucuuuucuu

SEQ ID NO: 31905 - RNA, 64 nt, Human
cuugaauuucaagcucagaggaaacuuugucucaugcccugacaugaaguggcaaacacggaag

SEQ ID NO: 31906 - RNA, 64 nt, Human
uaguaugaggacauuuguuugaauuauagaaauuugcccugagcugaacuggguuguguuaaca

SEQ ID NO: 31907 - RNA, 64 nt, Human
ucuguacuccuguugucuuuuucccugcuccuggugcccugaagagaccagcaagggggcagac

SEQ ID NO: 31908 - RNA, 64 nt, Human
agauuccaagagaagcacgguuuucucuuucccuugcccugacuguuggaguaaaaaaccucuu

SEQ ID NO: 31909 - RNA, 64 nt, Human
gggccaggacucaguuccugcucucauccuccccugcccugaugucagcugcuuugcacaaagg

SEQ ID NO: 31910 - RNA, 64 nt, Human
gugggcagagugaagucccgcauuagcauuuaggugcccugagcuguuucugccaauagauuag

SEQ ID NO: 31911 - RNA, 64 nt, Human
aguccccuggauugccccaguccugugaccauguugcccugaagaagaccaucuucaugacugc

SEQ ID NO: 31912 - RNA, 64 nt, Human
uggguugaaaaguguucccgcccuaaggccuuggugcccugaaccucugaugccuaccggguuc

SEQ ID NO: 31913 - RNA, 64 nt, Human
uuguggaucccugcuguucccuaaucccacccccugcccugagacagugaauguaguccgugaa

SEQ ID NO: 31914 - RNA, 64 nt, Human
ggccgaggcucagccccagacucucagcaucugcugcccugaucacagagacgggaccgagcca

SEQ ID NO: 31915 - RNA, 64 nt, Human
agagagcacuuacccgaccccaaggugccagagaugcccugaggauggugguuaaggaaacagg

SEQ ID NO: 31916 - RNA, 64 nt, Human
ccaagucccuaggcugcacacacaugucaggggcugcccugacauggccuggagacauuuuccc

SEQ ID NO: 31917 - RNA, 64 nt, Human
uuuuuaucgccauagccccuuggagugccccagcugcccugaggucaaucaaggaaaauuucuu

SEQ ID NO: 31918 - RNA, 64 nt, Human
ccgcuggugcccaccagcuggcucugcagcacauugcccugaggggccugccacucuccugagg

SEQ ID NO: 31919 - RNA, 64 nt, Human
cuuggcucguauacuaggcuuaggguccccugcaugcccugaaccccuggguggguggcacagc

SEQ ID NO: 31920 - RNA, 64 nt, Human
acgugauucuuaacaucauuuccacagaccccucugcccugacccucugcauuggaugcaggaa

SEQ ID NO: 31921 - RNA, 64 nt, Human
agcccagccaggacugacccuccuuccuccagccugcccugacccaccuggcaaagcagggcac

SEQ ID NO: 31922 - RNA, 64 nt, Human
ucccagcaaaagagcucuggcccgcaucucgcugugcccugaagggggaugaagggcgaugccu

SEQ ID NO: 31923 - RNA, 64 nt, Human
cgcugaccuuccauggaggccguguguuggagagugcccugaugcagauggaggugaugggagu

SEQ ID NO: 31924 - RNA, 64 nt, Human
uuguguccugaccagcuccaaaaauauacuucacugcccugaaaaacagacacagggagaguug

SEQ ID NO: 31925 - RNA, 64 nt, Human
cccgcugcgggaccaagccgggaaugagcuugugugcccugauaccccugaggguggcugccuc

SEQ ID NO: 31926 - RNA, 64 nt, Human
gcucuugcugucuucagcagcaucucaggguagcugcccugaccucggagcagucugucgcccc

SEQ ID NO: 31927 - RNA, 64 nt, Human
gcccugggcuucagccuuugugcaguacucucgaugcccugaacacacaccuucccuuugccca

SEQ ID NO: 31928 - RNA, 64 nt, Human
uaggugcaagaucagagcaugugccuacaccuugugcccugaugccgagguggagaccauuggg

SEQ ID NO: 31929 - RNA, 64 nt, Human
cuuuguugaaagaaaguauggcaucuuguaccacugcccugacugucacaacuccuaaccuugc

SEQ ID NO: 31930 - RNA, 64 nt, Human
agacaaggugccuguuauauauuuacucagucuuugcccugaauggucucagcuugagaccauu

SEQ ID NO: 31931 - RNA, 64 nt, Human
uagacauuggugggaccaaggauguuuugcaggaugcccugauccuaagaagggggccuggggg

SEQ ID NO: 31932 - RNA, 64 nt, Human
ccucaaagcaugccuuacccagcugggaagucucugcccugaucugguacuccuuguaguaagc

SEQ ID NO: 31933 - RNA, 64 nt, Human
ccguaguccugcaaaguguccuuuguggggcugaugcccugaucccaguccagacgggugcugc

SEQ ID NO: 31934 - RNA, 64 nt, Human
cccggugcaggcucccgaccagugcugcccuguuugcccugagaaacaagaugucagagacuug

SEQ ID NO: 31935 - RNA, 64 nt, Human
uuuuuuuuuuuaaaaaaaaaaacguauaaaauaaugcccugaaagaauaauagggauuauaccu

SEQ ID NO: 31936 - RNA, 64 nt, Human
caaaccuguggccgccacuuuugaauucucagauugcccugaauuuugccacuuuuaaauaaug

SEQ ID NO: 31937 - RNA, 64 nt, Human
ugggcacugcacuucagcguggcccaccugcccaugcccugaggccaguuggcgagggguggcu

SEQ ID NO: 31938 - RNA, 64 nt, Human
cugagcuguuuggcuucaguugacaguuucugauugcccugagcaccaggucucaucuugcauc

SEQ ID NO: 31939 - RNA, 64 nt, Human
aaaaagccuuugcugcauucggaggacugccccgugcccugaggugacuuccuaacuauguggu

SEQ ID NO: 31940 - RNA, 64 nt, Human
gagcauuuuguuuugcacaggaagaugcugcugcugcccugacugggaugagggugagggguga

SEQ ID NO: 31941 - RNA, 64 nt, Human
ggagcagccuggagacccaccccaccugcagggcugcccugagcgccuggauuucugguucuga

SEQ ID NO: 31942 - RNA, 64 nt, Human
ccacacucucccaggcccuaaacuugggcggccuugcccugagagcugguccuccagcgaggcc

SEQ ID NO: 31943 - RNA, 64 nt, Human
cugcccucauuacugggccuuagugggccagggcugcccugagaagcugcuccaggccugcagc

SEQ ID NO: 31944 - RNA, 64 nt, Human
gguuggugucaggggcgagccaaccccaccucuaugcccugagcccugguaguccagagacccc

SEQ ID NO: 31945 - RNA, 64 nt, Human
gaaugggaggaaccaggccacauuccuuccaucgugcccugaggccugacacggcagaucagcc

SEQ ID NO: 31946 - RNA, 64 nt, Human
uggccaaaaaaaaaaaccggcuuccccgagcagcugcccugaaaguagggguggcggcggcggc

SEQ ID NO: 31947 - RNA, 64 nt, Human
agcugcagggacuggcgagucugcuuucuucuacugcccugagccugaacgcuucugcuuaauc

SEQ ID NO: 31948 - RNA, 64 nt, Human
ugugaggaugaggacgugucuaucacagucaguaugcccugaaugaaugggugucacccuccuc

SEQ ID NO: 31949 - RNA, 64 nt, Human
uagccucauucugugcaaccaagugcauauaagaugcccugaaaagaguaacaaaguaugcuuu

SEQ ID NO: 31950 - RNA, 64 nt, Human
auuuauaguguuauuuguuucaccuucaagccuuugcccugagguguuacaaucuugucuugcg

SEQ ID NO: 31951 - RNA, 64 nt, Human
aagggcgauuaacacuuuugacaguauuuuguuuugcccugauuugggggauuguuuuguuuug

SEQ ID NO: 31952 - RNA, 64 nt, Human
cgucucugcccugcccacccagagccccucuuugugcccugauggucccugucucaccccugaa

SEQ ID NO: 31953 - RNA, 64 nt, Human
uuuuagccaguguaccugggcacagacucggggcugcccugaagcugaugaaggcuugaaggac

SEQ ID NO: 31954 - RNA, 64 nt, Human
aauuaaagacaauguuaacaaauuuucuauuaaaugcccugagugauaaaaccaguuggcaaua

SEQ ID NO: 31955 - RNA, 64 nt, Human
uggucuucauggacgagaugaaugaggauucugcugcccugagggaguucauuggaaaccugcg

SEQ ID NO: 31956 - RNA, 64 nt, Human
ugaaauauuuuucauaaauuaggcguaaauucuaugcccugaacaaauguaaagcuauuuaugu

SEQ ID NO: 31957 - RNA, 64 nt, Human
uauguguguagacaaauauuuggagggguauuuuugcccugaguccaagaggguccuuuaguac

SEQ ID NO: 31958 - RNA, 55 nt, Human
acagccuaagggaaccauaagaaguugcccugaucauucagacauuuugguaggu

SEQ ID NO: 31959 - RNA, 64 nt, Human
guccugaauugcuguaacaagcacacuauuuauaugcccugaccaccauaggaugcuagucuuu

SEQ ID NO: 31960 - RNA, 64 nt, Human
cagauguagcuuaucuguuuuuuucuuaaauuguugcccugaaaaaauuucuugcauaugaauu

SEQ ID NO: 31961 - RNA, 64 nt, Human
gccaggacuuguccccuggcagcugggcugagucugcccugagggggcgccuuuuucuaauuug

SEQ ID NO: 31962 - RNA, 64 nt, Human
cauuugacuagaaaaugugauccauaguauuuagugcccugauacuauaagcucagcaaguaac

SEQ ID NO: 31963 - RNA, 64 nt, Human
gucaucgaaucccaguggaggggacccuuuuacuugcccugaacauacacaugcugggccauug

SEQ ID NO: 31964 - RNA, 64 nt, Human
ugggaacaggauccugugaaagcugaugcccaugugcccugagagcugccucucaaucccuguc

SEQ ID NO: 31965 - RNA, 64 nt, Human
gcaaauccuccuuuuacccguugaauguuuugaaugcccugacucuaccagcgcccauaaauga

SEQ ID NO: 31966 - RNA, 64 nt, Human
cugggugcaguagugagcaggacggguaccaugcugcccugaagggggccacagccugggugga

SEQ ID NO: 31967 - RNA, 64 nt, Human
cccacucucccucacauggugcuaggcugggagcugcccugagagcugggaugcccaccaaggc

SEQ ID NO: 31968 - RNA, 64 nt, Human
agguagaccuccaaacuagaaaugcuggcugauuugcccugauccaugcuuccauuucccuguc

SEQ ID NO: 31969 - RNA, 64 nt, Human
accugcagcugaggcuuggaaacguuucuuguguugcccugaaaaaucuuugagaccucaggga

SEQ ID NO: 31970 - RNA, 64 nt, Human
ucucaaaaagaaguauugcaugucuaaaagcuagugcccugaguacucaugaauucgauuccaa

SEQ ID NO: 31971 - RNA, 64 nt, Human
cgagcacccugugaaagucucccuugaguucaggugcccugaacucaguacagccucaucuucu

SEQ ID NO: 31972 - RNA, 64 nt, Human
agagcgagcugacagcagcaacacugucagaaggugcccugagacggccggcucagccuucccu

SEQ ID NO: 31973 - RNA, 64 nt, Human
cugcaggcagagccccucagugcucugagaaaccugcccugaacucaccgccuccccugccugg

SEQ ID NO: 31974 - RNA, 64 nt, Human
gaggaagccaagguggccaaggcccucgguccccugcccugauagggcuuaccugugggugggg

SEQ ID NO: 31975 - RNA, 64 nt, Human
ccccccacucuccuuuagggagcugagguucuucugcccugagcccugcagcagcggcagucac

SEQ ID NO: 31976 - RNA, 64 nt, Human
uuggccugacccugugggagucagaagccauggcugcccugaaguggggacggaauagacucac

SEQ ID NO: 31977 - RNA, 64 nt, Human
auugagcaaucaucuccugcccaaguuuccuccuugcccugaggaccagugaaagacagaucau

SEQ ID NO: 31978 - RNA, 64 nt, Human
aagcuggaaucaugggugguaauccccacuuugcugcccugagcgggaccugugccauuuaaac

SEQ ID NO: 31979 - RNA, 64 nt, Human
aggacuccuugauaagcuugcuaaacuuucagagugcccugagacacuuccagccaucccuccu

SEQ ID NO: 31980 - RNA, 64 nt, Human
agcuauacaacccugacuucagaguuugcaaccuugcccugagugaaucauguuaaagcugucu

SEQ ID NO: 31981 - RNA, 64 nt, Human
ucauugucccuuacugccagacccagccagacuuugcccugacggaguggcccggaagcagagg

SEQ ID NO: 31982 - RNA, 64 nt, Human
acccacccccguuccccugaggugcucuggccuaugcccugagcaaggggggucuugacauccc

SEQ ID NO: 31983 - RNA, 64 nt, Human
agcuuccuccugguguccuggccgcuggcgugucugcccugagaugcucgcucuccugcugggc

SEQ ID NO: 31984 - RNA, 64 nt, Human
cuacgacacagcccaaauguguaaauggcacuguugcccugacagugcauggaaaggacguugg

SEQ ID NO: 31985 - RNA, 64 nt, Human
aauccuuucuuguccuauacccagcugggguugcugcccugaacgaacugcguguggggccggc

SEQ ID NO: 31986 - RNA, 64 nt, Human
gcugggcagguccugaccaaccugcaucaggggaugcccugagcuccacaggucuucaugggca

SEQ ID NO: 31987 - RNA, 64 nt, Human
aaccucucucuugccuuaccucagagagggacuaugcccugaccccuccuuucugaaaaucagu

SEQ ID NO: 31988 - RNA, 64 nt, Human
gugaggucaggagcccagcucuccagggggcuucugcccugacugggaagggugccuggcuccc

SEQ ID NO: 31989 - RNA, 64 nt, Human
uuugggcuaguggguuucugacagcccaugggaaugcccugaaacuacuguaucugauguuugu

SEQ ID NO: 31990 - RNA, 64 nt, Human
uaggcaauuucaauauaauguagaaguaguagugugcccugaaaaauguacacguuuuuucuua

SEQ ID NO: 31991 - RNA, 64 nt, Human
auugaacuuauaauuuaugugcaaguguuuucagugcccugaaucaaacuauaaauguggggag

SEQ ID NO: 31992 - RNA, 64 nt, Human
acaggccccccagccaagaaagcuaucucugaguugcccugauuugaagggaaaagggaugaug

SEQ ID NO: 31993 - RNA, 64 nt, Human
gacuugcaguuacuuaaaauuuuuuaauaaacugugcccugaaaccuaaacugacaguggacug

SEQ ID NO: 31994 - RNA, 64 nt, Human
uucuucaucucuaaguaauuauaucugucauuauugcccugaucacaaacaaaagccugaaugu

SEQ ID NO: 31995 - RNA, 64 nt, Human
ccccugcacugagcccccuuagaucuacugccccugcccugacuuucgccauugggaagaccug

SEQ ID NO: 31996 - RNA, 64 nt, Human
aaaacagccuacaaucugugaccaccacaagaugugcccugauggcagcugaaguuugauucag

SEQ ID NO: 31997 - RNA, 64 nt, Human
cuucccucagcucacccuucagccuguuccuucuugcccugaccccagcccgugcagcugcucu

SEQ ID NO: 31998 - RNA, 64 nt, Human
uuuuaagggcuuuaaguuauuuauguauuuaauaugcccugagauaacuuugggguauaagauu

SEQ ID NO: 31999 - RNA, 64 nt, Human
agugcaucaguaugucugaauuggggaaguaaaaugcccugacugaauucucuugagacuagau

SEQ ID NO: 32000 - RNA, 64 nt, Human
guuugauuuauauaguuuuauauugaauuuuuuuugcccugauuguuuagggugauaggucuua

SEQ ID NO: 32001 - RNA, 64 nt, Human
uuuuggaaaucuacugaccuuaauaccccaagcuugcccugaauacuuugauuggaauuggaau

SEQ ID NO: 32002 - RNA, 64 nt, Human
uggauaugguuuuugccaauccacagagccauccugcccugacagcuagcaagaggccaagacc

SEQ ID NO: 32003 - RNA, 64 nt, Human
auaauauuguaaaaugcuuuucaaguguggguuuugcccugauuguugcaaauacaauuuccac

SEQ ID NO: 32004 - RNA, 64 nt, Human
ucccccucaacagccuccugagaaggaaaggaucugcccugaccacuccccuggcacuguuacu

SEQ ID NO: 32005 - RNA, 64 nt, Human
ugcacucccaauccugcugucuucuccuucccugugcccugaacaaggaccucacugcccgccu

SEQ ID NO: 32006 - RNA, 64 nt, Human
gacagguguccuuugcugggccucuggauggcccugcccugacuggggcugcuccucccuccug

SEQ ID NO: 32007 - RNA, 64 nt, Human
acacacucuuucauugcugaauucuaaauaaugaugcccugaauuaguucuaugagaaguacug

SEQ ID NO: 32008 - RNA, 64 nt, Human
gagguaucuuacuuuccucugaggaugauguacuugcccugaccaugcauuuuaccaucacaca

SEQ ID NO: 32009 - RNA, 64 nt, Human
uaggucacucuucuccuuuguacuauuuuguuucugcccugaugucccuugggucuccauccua

SEQ ID NO: 32010 - RNA, 64 nt, Human
cagagcacugagaggccacaaucguucagcccugugcccugaacaccacugcccccuucacugu

SEQ ID NO: 32011 - RNA, 64 nt, Human
ucaaaacauaggacaguacaucucuaguagaauaugcccugagaaugaaaagaauguaacagug

SEQ ID NO: 32012 - RNA, 64 nt, Human
ccacggccucccagccggugcgggagccccucacugcccugaccgacuccgcaguccccgggga

SEQ ID NO: 32013 - RNA, 64 nt, Human
cugcugaccacaagcucugugcuggggguaccugugcccugaaguccuggccccugugucauag

SEQ ID NO: 32014 - RNA, 64 nt, Human
ugagggacagggacacgugccaccugcucaucucugcccugaggucaccccguggucccuccac

SEQ ID NO: 32015 - RNA, 64 nt, Human
cuuuccuacuuguaaucucauugauucccugcucugcccugacaggagggguagggaaaaucag

SEQ ID NO: 32016 - RNA, 64 nt, Human
gagaacuaaggaaacaccuguacauaguguccgcugcccugacucccgcuuagcacacccuuag

SEQ ID NO: 32017 - RNA, 64 nt, Human
gggauccggccaggccccucuguccagaaggagcugcccugaggaccaucuuagcggcccuguc

SEQ ID NO: 32018 - RNA, 64 nt, Human
gacugauguuacaucacaguguuugcaaugguguugcccugaguggaucuccaaggaccagguu

SEQ ID NO: 32019 - RNA, 64 nt, Human
cugugccuguaguguuggcccagagugugguuacugcccugagggccaugaaagccacagagga

SEQ ID NO: 32020 - RNA, 64 nt, Human
ccucccauuuccaaccccucccuagcaucccaggugcccugacccaggacccaacauggucuag

SEQ ID NO: 32021 - RNA, 64 nt, Human
ccaucugcccagcuugccugccuccugcacccacugcccugaccuuccugcuucccacgcugcc

SEQ ID NO: 32022 - RNA, 64 nt, Human
cccguugagccacgcugucuggugggugauucucugcccugagccaccacccuggacuggccca

SEQ ID NO: 32023 - RNA, 64 nt, Human
gggacuggucacugccucaggacccccaagccuaugcccugagccauggcugcugacugacucc

SEQ ID NO: 32024 - RNA, 64 nt, Human
ugacccaggcccaagagacccugaagagccugggugcccugaagaagugacucugggagggccc

SEQ ID NO: 32025 - RNA, 64 nt, Human
uagacgggcgcuucguguggagggugaacuuggaugcccugacccagcaccuagacaagaucuu

SEQ ID NO: 32026 - RNA, 64 nt, Human
acagcugcaucuguuacuuaaguuuguaagacagugcccugagaccucuagagaaaagauguuu

SEQ ID NO: 32027 - RNA, 64 nt, Human
agagucacucaugacuuucuuggugguggguauaugcccugacaacuucuguaagccccccuuc

SEQ ID NO: 32028 - RNA, 64 nt, Human
ucacacagggcguucacucagaccaucugugcucugcccugaguucaguugagaaaauccuauu

SEQ ID NO: 32029 - RNA, 64 nt, Human
uaaaauuuugcuaccaaagaaugcauguucugugugcccugaaaauguuaccaguguuaauaaa

SEQ ID NO: 32030 - RNA, 64 nt, Human
aagcccagaggaagugguagagcagcaccgugccugcccugaggcaguggagucaguagcgcug

SEQ ID NO: 32031 - RNA, 64 nt, Human
ccuccggcagggaggucaccccuccacuucagcuugcccugaccuccgcucgcaaaccccgagc

SEQ ID NO: 32032 - RNA, 64 nt, Human
uagugcauuuauugagaugaucucuaaagagcuaugcccugaccuaccccugauucuaugacau

SEQ ID NO: 32033 - RNA, 64 nt, Human
cacuauggccugggugagaggccagcacugcugcugcccugaggggaaacgccugggccgugua

SEQ ID NO: 32034 - RNA, 64 nt, Human
acagggggagaagugagaaguguuaugacauuagugcccugauugggcagcacccacggcuaca

SEQ ID NO: 32035 - RNA, 64 nt, Human
agauguaagaaagugauaagccauggccaugagcugcccugagcuuuggucguuggggaggugg

SEQ ID NO: 32036 - RNA, 64 nt, Human
guguccuggcagaaggucuggguuugcagaugggugcccugaauggaacuacuuuaacuaaucc

SEQ ID NO: 32037 - RNA, 64 nt, Human
ccuccugcagccugaccccuaggcagcucgagcaugcccugagcucucugaaaguugucacccu

SEQ ID NO: 32038 - RNA, 64 nt, Human
cccuccugcagccugaccccaggcagcucgagcaugcccugagcucucugaaaguugucacccu

SEQ ID NO: 32039 - RNA, 64 nt, Human
cuugaagagggagugacuaaggugaccuccaaccugcccugagccagcugcccugcaggugcca

SEQ ID NO: 32040 - RNA, 64 nt, Human
gaggacagugaaugaacauggcauuacuuuuaauugcccugaaaagcaaauacuuccuaacggc

SEQ ID NO: 32041 - RNA, 64 nt, Human
gacuuuuaggccauucuugauggaaccagaucccugcccugacuguccagcuauccugaaagug

SEQ ID NO: 32042 - RNA, 64 nt, Human
uuguacauuuuuuguaugaggaagugauguagcuugcccugauuuuuuuuuuuuuuuuuugguc

SEQ ID NO: 32043 - RNA, 64 nt, Human
uucacacucuugucaacucuccaggccucucucuugcccugaguuaucagccugugugguguua

SEQ ID NO: 32044 - RNA, 64 nt, Human
caugccaacaauagcuccaggugccucagccccgugcccugacccggggaccacagggacaccc

SEQ ID NO: 32045 - RNA, 64 nt, Human
gaucccgagggaaguccuccagucuaagucacagugcccugacaggugagaagcaaacucccgc

SEQ ID NO: 32046 - RNA, 64 nt, Human
agcucccagcaggacaccgccugcagaaaggaccugcccugauaaugucccuuccccagauucu

SEQ ID NO: 32047 - RNA, 64 nt, Human
uaccaccacccuuuguggcagcaccgggcuggacugcccugaucccugggacgugagacuuagc

SEQ ID NO: 32048 - RNA, 64 nt, Human
ggcccagagugaaccguccuuucacacaucugggugcccugaaagggcccuuccccucccccac

SEQ ID NO: 32049 - RNA, 64 nt, Human
ugcugguuuuucuuuuugauccaaaugugugaucugcccugauaaauaacaaguuauaguacca

SEQ ID NO: 32050 - RNA, 64 nt, Human
cccuuuggaagaaaggaaagcuguuuccuccuggugcccugagcgggcaggagguggaccaccc

SEQ ID NO: 32051 - RNA, 64 nt, Human
cuuuuccaaagugccuuaaaagaaaucagacaaaugcccugagugguaacuucuguguuauuuu

SEQ ID NO: 32052 - RNA, 64 nt, Human
uggccgagugagguguagcagaaaaaggcugugcugcccugaagaauggcgccaccagcucugc

SEQ ID NO: 32053 - RNA, 64 nt, Human
ucauggggaggguagcaccaggcauagccacuuuugcccugagggacuccuguguacuucacau

SEQ ID NO: 32054 - RNA, 64 nt, Human
uuucaucucucaucucucuuucuucucucccuucugcccugacguagccaugguugggugggug

SEQ ID NO: 32055 - RNA, 64 nt, Human
acuuacugcccagagccucguaguuuucuuccccugcccugaugguuggguguuuuuccuuuaa

SEQ ID NO: 32056 - RNA, 64 nt, Human
acaggggacucacccucuuucauaucccuugcccugcccugaaauggacaaucacuuuuuggga

SEQ ID NO: 32057 - RNA, 64 nt, Human
cagaggugggaggccggcauccaggucuuggcucugcccugagaccuuggacaaacccuucccc

SEQ ID NO: 32058 - RNA, 64 nt, Human
guuguguuguaagaugacuaauuuuaaaagaaccugcccugaaaaguucuuagaaacgcaguga

SEQ ID NO: 32059 - RNA, 64 nt, Human
agcguuccugugcagagccccauccacugguucuugcccugagccacauaugucugugccaugg

SEQ ID NO: 32060 - RNA, 64 nt, Human
ccgucgcugacuuggccuggaacgaggaaucuggugcccugaaaggcccagccggacugccggg

SEQ ID NO: 32061 - RNA, 64 nt, Human
uucagcauguuuaaggaaaauagcccacaaugucugcccugaucaauauguauccaugggacuu

SEQ ID NO: 32062 - RNA, 64 nt, Human
ucgcugaccccgagcgcagguuuugcuagcagauugcccugacaucuuguucauuucagauaaa

SEQ ID NO: 32063 - RNA, 64 nt, Human
aaaucuguuaauauaaugauaaugagaacaccuuugcccugaagucaguucucacaguauagaa

SEQ ID NO: 32064 - RNA, 64 nt, Human
aauucuacuuagcuauauuauuauaagcuacauuugcccugaauuugaacacucaacaucacua

SEQ ID NO: 32065 - RNA, 64 nt, Human
cacugguguccugggaauuucugguuggauuuggugcccugaacuuuuuuauuaagaaaucaga

SEQ ID NO: 32066 - RNA, 64 nt, Human
cauuaugacucagaguacuuuauaauaaaucagaugcccugaggcucuguugaggaaguagaau

SEQ ID NO: 32067 - RNA, 64 nt, Human
gccaagagugagggcagaugucuccagccaggacugcccugagccgcaaaaugucaaagcugga

SEQ ID NO: 32068 - RNA, 64 nt, Human
uaaauccagacaauggauauauuaagguucuccuugcccugaagcuucaggaugaaggacagga

SEQ ID NO: 32069 - RNA, 64 nt, Human
acucgggaccugaugucggcagcugugccucuacugcccugaggacuuaccagagggagcccua

SEQ ID NO: 32070 - RNA, 64 nt, Human
uuuuaaaagcccccaaggaaggaggcugggacugugcccugacaugauucuuggugauggaaua

SEQ ID NO: 32071 - RNA, 64 nt, Human
auguggacuauuuugaaauuauaaccauuuuugaugcccugaaucuugaggugacuuauuuugc

SEQ ID NO: 32072 - RNA, 64 nt, Human
gacguccugcggggccaccccccggcugagacuuugcccugaacuuguccggguagggagggcc

SEQ ID NO: 32073 - RNA, 64 nt, Human
gacaggcccagauugagguggugccuucugccucugcccugaucgucacaacccucaggaacca

SEQ ID NO: 32074 - RNA, 64 nt, Human
ccuucuguacaaaaugaaaaguuuggaaauuguuugcccugauaccuugaaaaagaagccagaa

SEQ ID NO: 32075 - RNA, 64 nt, Human
ugaggccuuguuuuuagugcugagagccaguugcugcccugagaagagaagacaaccuccaucu

SEQ ID NO: 32076 - RNA, 64 nt, Human
gcacuggugggccugggcuucugagguggccuccugcccugaucagggacccuccccgcuuucc

SEQ ID NO: 32077 - RNA, 64 nt, Human
ugggcuccuggaccccccuuucacaggcagccagugcccugagccagggucuccagaaagcccc

SEQ ID NO: 32078 - RNA, 64 nt, Human
caggcuuuguuuuccaucagcacguugggggcccugcccugaauggucaauuuuucacauauau

SEQ ID NO: 32079 - RNA, 64 nt, Human
gccaguguaacgugggaaccauugagauuguauuugcccugaguauuaaagcuagcuuagcaaa

SEQ ID NO: 32080 - RNA, 64 nt, Human
ugcauucagccugcugugcagcagugccauugacugcccugauguucagagagaaacgcacaca

SEQ ID NO: 32081 - RNA, 64 nt, Human
ggcacauagcugugaucacagcagacagggucgcugcccugauggcgcuuacauuccagugggu

SEQ ID NO: 32082 - RNA, 64 nt, Human
ugggcuggccccacccucacccccacccccagggugcccugaggccccaggcagcugcugccuc

SEQ ID NO: 32083 - RNA, 64 nt, Human
agcaaagccaugugcagggcgucccccucaacccugcccugaacaugccccagggcacugaggg

SEQ ID NO: 32084 - RNA, 64 nt, Human
ccuggcucucugcggcuggugggaaaacacacccugcccugaggggcuguccaggccuucuccc

SEQ ID NO: 32085 - RNA, 64 nt, Human
ucuccagggcagaagucgcggugggcucagugggugcccugagcggggucucucagacugacgu

SEQ ID NO: 32086 - RNA, 64 nt, Human
ggaauggcuccuaaucaggguuuguucccaccauugcccugagcugcuaggaugcgcucugucc

SEQ ID NO: 32087 - RNA, 64 nt, Human
ccagauggguucuaaugcagcugcuggggccugaugcccugaguuguuugugauucaauaaaga

SEQ ID NO: 32088 - RNA, 64 nt, Human
gauuuuauuucagugaacugcuggaacucacacaugcccugauauguaaaugaugauuuauguu

SEQ ID NO: 32089 - RNA, 64 nt, Human
ggaggcagagcgggagggagucucaggaggaggcugcccugaggggcuggggaggggguaccuc

SEQ ID NO: 32090 - RNA, 64 nt, Human
gaaggcagcuuccacagcucacuccucuucucccugcccugaucagauuccccaccuuacccgg

SEQ ID NO: 32091 - RNA, 64 nt, Human
cagcuuucaguuccugacuccccaacuuggucucugcccugaagcagggcacugaacucugggc

SEQ ID NO: 32092 - RNA, 64 nt, Human
cuuuucacgucccuucugccucugccccguuggaugcccugacugggggcaggggaagagacag

SEQ ID NO: 32093 - RNA, 64 nt, Human
gggcuccccaucuccuucuggcccaucugccugcugcccugagccccgguucugucaggguccc

SEQ ID NO: 32094 - RNA, 64 nt, Human
ugggggaaaggcagggcccacccgggccagcccgugcccugaggggcucuugacacccacguag

SEQ ID NO: 32095 - RNA, 64 nt, Human
agggaggccagcagguggacagggggccucagccugcccugaagucccgccagucagugguuac

SEQ ID NO: 32096 - RNA, 64 nt, Human
agcacggcuggagacccacgaccuggccugccguugcccugagcugcagccucggccccaggau

SEQ ID NO: 32097 - RNA, 64 nt, Human
cauccugugggaccugggccauagucauucugccugcccugaaagucccagaucaagccugccu

SEQ ID NO: 32098 - RNA, 64 nt, Human
guucuuuguagucauuccaagugguacacgucugugcccugaaggaacacuggccuccauucug

SEQ ID NO: 32099 - RNA, 64 nt, Human
caacccacagcuaaaguaaauucaaugacacuacugcccugauuacuccuuaggauguggucaa

SEQ ID NO: 32100 - RNA, 64 nt, Human
aggaccaaagcauguggcauuuggauggccagagugcccugaagcaccacuaccaaccuugccu

SEQ ID NO: 32101 - RNA, 64 nt, Human
agcugaggaauccuuuuaagauuauuagaaaacaugcccugaagagaguuguucuuagguuaca

SEQ ID NO: 32102 - RNA, 64 nt, Human
cucaucugccuccaugucucuggggcuuugcuguugcccugaaaccuagcugggcuggucuugc

SEQ ID NO: 32103 - RNA, 64 nt, Human
cucucuguugagccaggaaucccaagugagggguugcccugaggucugacucuuggggcaagcc

SEQ ID NO: 32104 - RNA, 64 nt, Human
acugcgaagcugcucuggggucugcacccaccccugcccugacuuguguugccugacaagagac

SEQ ID NO: 32105 - RNA, 64 nt, Human
guggcucguccuuaacguuucugaaccaccuuggugcccugagcaggaagaugugccacuuccu

SEQ ID NO: 32106 - RNA, 64 nt, Human
gacccuuuccuaucaggagagauggcuuguccccugcccugaagcuggcaguucagucccuuau

SEQ ID NO: 32107 - RNA, 64 nt, Human
aauuaagucuacuuaauuuaucaagucauguucaugcccugauuuuauauacuuguaucuauca

SEQ ID NO: 32108 - RNA, 64 nt, Human
ugagaaagugaaaccuuauugggaaaaauuggacugcccugaauuuagcaccaauugcauuaac

SEQ ID NO: 32109 - RNA, 64 nt, Human
ggcugaggcacggagaagaaaaggaaucagcaacugcccugaugggccaugagaugcuggggag

SEQ ID NO: 32110 - RNA, 64 nt, Human
gauugacugagaugcuccggagcugccugcucuaugcccugagaccccacugcugucauuguca

SEQ ID NO: 32111 - RNA, 64 nt, Human
uucuugcugggggcauugcuaucucuaggauguuugcccugaaguccugauagucucuuugggg

SEQ ID NO: 32112 - RNA, 64 nt, Human
aggcugcugaaaaccaucuggccuggccuggcccugcccugaggaaggaggggaagcugcagcu

SEQ ID NO: 32113 - RNA, 64 nt, Human
agaagcccaagauuccuggagucuuuuuuuccucugcccugaucaacuggggcccaggaaaagc

SEQ ID NO: 32114 - RNA, 64 nt, Human
aagacccccccaaacugucugacucuguguuuccugcccugaggagagaggggucagauugcag

SEQ ID NO: 32115 - RNA, 64 nt, Human
agcagacagucacccuacuuuucagcagcaaaacugcccugaugacgcagcacgaagggccugg

SEQ ID NO: 32116 - RNA, 64 nt, Human
cccaaaggcacugacauuucuaguuugcccccucugcccugaaccccacagcaugccugucuca

SEQ ID NO: 32117 - RNA, 64 nt, Human
aucagcaguggagaacugugggagcugguggcucugcccugacagagagccauggagcagagga

SEQ ID NO: 32118 - RNA, 64 nt, Human
ugagucaauaguccaggguggggccuggccucccugcccugauuggggacucaggaggugaggc

SEQ ID NO: 32119 - RNA, 64 nt, Human
aaaaaguaacccauuaucacucugaguuucgucgugcccugagacaugaugggaaucucauucc

SEQ ID NO: 32120 - RNA, 64 nt, Human
gcccuacccggccagcagucgcugggccucucccugcccugacacuugaugugaccuaugugcu

SEQ ID NO: 32121 - RNA, 64 nt, Human
cugccggagggagcccugagccuggcagguccccugcccugaggcugugagcagcuaguggugg

SEQ ID NO: 32122 - RNA, 64 nt, Human
ggccggaggaaccgagguguugccagugcuaagcugcccugaggguuuccuucggggaccagcc

SEQ ID NO: 32123 - RNA, 64 nt, Human
agccuguucccacucagcagugagaguuccucuuugcccugaggcucagucucucucguauuuu

SEQ ID NO: 32124 - RNA, 64 nt, Human
ucuuucuagacuggauuaugcucacaugcucccuugcccugacauuuuuguaaauucugugccc

SEQ ID NO: 32125 - RNA, 64 nt, Human
uugggacuggucugggccccuggggcuugucgccugcccugaguccggagcccuuugccuccuu

SEQ ID NO: 32126 - RNA, 64 nt, Human
aaccucucccucucuccucaguccaccacuccacugcccugacuacaggcauugaucccugucc

SEQ ID NO: 32127 - RNA, 64 nt, Human
cuccuuccuguuuuuaucuaauaaaaugcuaaccugcccugaguuuccauuacugugggugggg

SEQ ID NO: 32128 - RNA, 64 nt, Human
uaguuugacuuuuuauaauugaaccuccuggcuaugcccugagaucagcgcuauuuuguaaacc

SEQ ID NO: 32129 - RNA, 64 nt, Human
aggguggcuggugacaggccugggccucugcaacugcccugacaggaccgagaggccuugcccc

SEQ ID NO: 32130 - RNA, 64 nt, Human
uuuuuuuuuuuuuugagacggggucuggcuguguugcccugacuggaguucaguggugcaaaca

SEQ ID NO: 32131 - RNA, 64 nt, Human
uagaggaaugucuacguauuucauucccuguuccugcccugaaacaauuucaaucacugacaaa

SEQ ID NO: 32132 - RNA, 64 nt, Human
caagcagagaagguaggaacccuccauagcucucugcccugaugugugggggaacuaggaagaa

SEQ ID NO: 32133 - RNA, 64 nt, Human
ugccaagccugucccacuggggcuccagggccucugcccugaacaucugggcuucuguucaaaa

SEQ ID NO: 32134 - RNA, 64 nt, Human
ucugagccggguggaaggucucccaccccagggcugcccugacagucucucuuggcucucuaga

SEQ ID NO: 32135 - RNA, 64 nt, Human
aggggucuggacaugugguuacuaguacagguuuugcccugauuaaaaaaucucccaaagcccc

SEQ ID NO: 32136 - RNA, 64 nt, Human
gacuauacuggaaacagacuucugcugcugaaugugcccugaugugaccagguugcacuuggaa

SEQ ID NO: 32137 - RNA, 64 nt, Human
uuuuuuaaugaaaaugaaggucagagagaauaauugcccugaccacauuugccuuucaguagga

SEQ ID NO: 32138 - RNA, 64 nt, Human
acuaggguaagcauucuuaacauguauuuccacuugcccugaguaaaucuguggugagagaagc

SEQ ID NO: 32139 - RNA, 64 nt, Human
aaacagaggacucuacgaaaugacaagcugccccugcccugaauuagggggaaacauuccaggc

SEQ ID NO: 32140 - RNA, 64 nt, Human
ccugccccauucccagggcacuccuuaccccugcugcccugagccaacgccuucacggaccucc

SEQ ID NO: 32141 - RNA, 64 nt, Human
gaggguugcagaauuugcucuuuuugggauggguugcccugaauaacauuacggaccagguaaa

SEQ ID NO: 32142 - RNA, 64 nt, Human
uugccaacguuaaaccuuauuuaaaagccaaacgugcccugagcccucuccuccaagagguccc

SEQ ID NO: 32143 - RNA, 64 nt, Human
uuuaggcagccuacucuuggaaacuggaggaaacugcccugagaauuauuagaaugcuaauaau

SEQ ID NO: 32144 - RNA, 64 nt, Human
ggagaauuauauaaagguuuucuuagaacaauuuugcccugauuacugaagcgucaaauaaagc

SEQ ID NO: 32145 - RNA, 64 nt, Human
gaagaaaguugaccuugugucacuauuuauuuuaugcccugaucagacuagcaacuuagauaag

SEQ ID NO: 32146 - RNA, 64 nt, Human
gaggggccagccgcaggcguccccagggccacccugcccugagguccuuguguggccgcccugg

SEQ ID NO: 32147 - RNA, 64 nt, Human
cccugcuccagagcguggaccgaggaggucuuugugcccugagcagggaccggauaacaccaga

SEQ ID NO: 32148 - RNA, 64 nt, Human
ugcagaaccugcugcuaacaccaaggugugaacaugcccugaugccuaaccaaagaugaguuaa

SEQ ID NO: 32149 - RNA, 64 nt, Human
cacuagauaucacucucaacuugucauucugccaugcccugaagaaaaccaacauugaaucuuu

SEQ ID NO: 32150 - RNA, 64 nt, Human
aggaggcaaguggaggauggacugggcccgcagaugcccugaccucugcccccagguagcagga

SEQ ID NO: 32151 - RNA, 64 nt, Human
uuuaauaaaauguuauuaugucaaccagugaggcugcccugaacaaaaaaaacaaaaagaaaaa

SEQ ID NO: 32152 - RNA, 64 nt, Human
ucuuuugaggaagaaauuauucacuccagaugcaugcccugagccagaccucacugcugcacuu

SEQ ID NO: 32153 - RNA, 64 nt, Human
uugcuuaaaagcaauaugcuauuugcuuauuccgugcccugacauagauaauuuuugaauucug

SEQ ID NO: 32154 - RNA, 64 nt, Human
ugcgggagaagagcggcccuaugcaugguguagaugcccugauaaagaacaucuguccugugaa

SEQ ID NO: 32155 - RNA, 64 nt, Human
uguucuuuccuagccaccuuucuggccucccacuugcccugaaaggccaagaucaagauguccc

SEQ ID NO: 32156 - RNA, 64 nt, Human
acaggagacuugcuugaacccgggagguggagguugcccugagcugauuaucaugcuguugcac

SEQ ID NO: 32157 - RNA, 64 nt, Human
gcucugcccccucagugcuugaugaagccaccagugcccugacagaggaaguggagagcgagcu

SEQ ID NO: 32158 - RNA, 64 nt, Human
augggucucauuugagucucgcgggcugugcagaugcccugacagagucgguuuccuuuggcgg

SEQ ID NO: 32159 - RNA, 64 nt, Human
guaauauggaaaaccuaccaguggggugugguugugcccugagcacguguguaaaggacugggg

SEQ ID NO: 32160 - RNA, 64 nt, Human
cugccuuaagauuuagguuuuuuaaauguauuuuugcccugaauuaaguguuaauuugauggaa

SEQ ID NO: 32161 - RNA, 64 nt, Human
ccaccugccacuaccuuggguguccuuacagcucugcccugaccccagccccugccccuggaca

SEQ ID NO: 32162 - RNA, 64 nt, Human
uguggaugagggguccaugcaggcaucuccaggaugcccugacacugugcuuuaggacuggcug

SEQ ID NO: 32163 - RNA, 64 nt, Human
gugagugugaccgguuguacccuggaguagugucugcccugagcugccagugcuggguaucccc

SEQ ID NO: 32164 - RNA, 64 nt, Human
aauauguuuguaacucaggugacugauuugggggugcccugagccacccuuagaaucacagagc

SEQ ID NO: 32165 - RNA, 64 nt, Human
ccuccugccccaggcuuccaggccccaucaggccugcccugaguuggccuuguccacuccuuga

SEQ ID NO: 32166 - RNA, 64 nt, Human
agaccaucuuuagcagccucagcacugccaggccugcccugaaacuccagauccuggcuaagag

SEQ ID NO: 32167 - RNA, 64 nt, Human
cugaucugaaugccuuuuauuuauuuuucccaauugcccugagcaguacaaugaugaacacacg

SEQ ID NO: 32168 - RNA, 64 nt, Human
cccugauauucuugaugucaccagugauacccacugcccugaccccugggcaggccccucucug

SEQ ID NO: 32169 - RNA, 64 nt, Human
uuugauuuuuuuuuuuuaaagaagaaaaaaaaacugcccugaauuaaauggcuguuuuaacagu

SEQ ID NO: 32170 - RNA, 64 nt, Human
ccucauaaaaguguucagguacagcagcugaggcugcccugaggaaucaaggggccauuaccaa

SEQ ID NO: 32171 - RNA, 64 nt, Human
ucccaagccaccauuugagagggagggguguuggugcccugacagggacugggcagggugucca

SEQ ID NO: 32172 - RNA, 64 nt, Human
uggcaggagacccaguggauggggccagcuggccugcccugauccucugcuuccuccucacaac

SEQ ID NO: 32173 - RNA, 64 nt, Human
uauccgucuucuacuucauggaagauuguuuuggugcccugacccucugaagugcccaguuccu

SEQ ID NO: 32174 - RNA, 64 nt, Human
cgaaccacccaaaacacgcacacccugccccuggugcccugagacagacacacagccucacgcc

SEQ ID NO: 32175 - RNA, 64 nt, Human
cccccagcacugccagggacugcccugucugcugugcccugaccacaggcugcuucauggcguu

SEQ ID NO: 32176 - RNA, 64 nt, Human
ucccagcgucccgagcccagcacugucucuucagugcccugauuucucacccagagguuucacc

SEQ ID NO: 32177 - RNA, 64 nt, Human
cugcuucuccaccucccccaaacccugcuucugcugcccugaugcgucuacccagacucagaga

SEQ ID NO: 32178 - RNA, 64 nt, Human
cuccucaaguaauggaacgauuucaaaggcaggcugcccugaccaaaaauaucugccaugaaua

SEQ ID NO: 32179 - RNA, 64 nt, Human
ugggaacauccuccacugacuuccucccacugucugcccugaacccacugcugcccccagaaaa

SEQ ID NO: 32180 - RNA, 64 nt, Human
gccccucugcugcugugcuggguggggaagcggcugcccugagccccaggucuugugggaggcu

SEQ ID NO: 32181 - RNA, 64 nt, Human
gccugcugcuuaaaggcaccauggggaccuggguugcccugagacccaagccauuguuagcagc

SEQ ID NO: 32182 - RNA, 64 nt, Human
acaaugcaaaauuuguaguuaaauuugaccucagugcccugacuacaauuggaaaugccaaaaa

SEQ ID NO: 32183 - RNA, 64 nt, Human
gccaacuuuucuuguaugccuugggaaagccaguugcccugaacccagcagacaccauggaaug

SEQ ID NO: 32184 - RNA, 64 nt, Human
ccugcugucugcugucagccccuccuggugcuggugcccugaugcugugccuugucacccauug

SEQ ID NO: 32185 - RNA, 64 nt, Human
gcagacugagcuggaggaagaugucagaaauguuugcccugaaaucaguuacggacaaaauguu

SEQ ID NO: 32186 - RNA, 64 nt, Human
gagcaguccuaugucucagugccccuuaaauuucugcccugagcccuccacgucagugccaucg

SEQ ID NO: 32187 - RNA, 64 nt, Human
gagaggagggcuacugccucacaucacugcagagugcccugagcuacguggagcugcugccccg

SEQ ID NO: 32188 - RNA, 64 nt, Human
ucugccccaggagcgugcaccgagcccgggaggcugcccugagcaggagcauggagcucuacag

SEQ ID NO: 32189 - RNA, 64 nt, Human
cccaguccugcucucaccccugcugccacacacaugcccugagcagccaggucccacuaggugc

SEQ ID NO: 32190 - RNA, 64 nt, Human
gaguggccuccccugccggugccgguacccuccaugcccugagccgcuacagccgcuacacgag

SEQ ID NO: 32191 - RNA, 64 nt, Human
uccgacauaccgaggaccaacuggucuacauggaugcccugaacaugcaauucuuucuuccaaa

SEQ ID NO: 32192 - RNA, 64 nt, Human
auggacauaggaggugcugugucccaugcccucuugcccugacagugucccaugggcccccuuc

SEQ ID NO: 32193 - RNA, 64 nt, Human
gaggcugcuaaacccuaucccccagccuccccccugcccugaagaucuuccauuugcuuccacu

SEQ ID NO: 32194 - RNA, 64 nt, Human
agugggugagcaucuugugcagggacauggugagugcccugaugccccagcuagcaggagcuac

SEQ ID NO: 32195 - RNA, 64 nt, Human
ggggucucugcagccaacugagacuaucuugcugugcccugagccuuccuaggguuuagaagaa

SEQ ID NO: 32196 - RNA, 64 nt, Human
uuuuagacuucacugcggaguucuguacacccuuugcccugaugaauuugaauggguuugauuu

SEQ ID NO: 32197 - RNA, 64 nt, Human
uggcagcuccagaagguguugccaggggcccagaugcccugacacugcuugaauacacugagac

SEQ ID NO: 32198 - RNA, 64 nt, Human
aagcuggcggcagaguccagcccagcauaugacuugcccugaauggaagcugcugaaacgggug

SEQ ID NO: 32199 - RNA, 64 nt, Human
auguuggguagcuggccucuguggggauuguaagugcccugaggcgcucuguacuagaaacugc

SEQ ID NO: 32200 - RNA, 64 nt, Human
uggacgacacggucggggcaucuggccuggccagugcccugaucccagagagcccgaggaggug

SEQ ID NO: 32201 - RNA, 64 nt, Human
auggagaaauugccuuuucucguuagccuccucuugcccugauuucauccucccuaucccugca

SEQ ID NO: 32202 - RNA, 64 nt, Human
caaguucagcuaagagacacccagguccccagcuugcccugagcagcccuucagggcuucuggu

SEQ ID NO: 32203 - RNA, 64 nt, Human
ccagagccaagagccucucaguagagggaggggcugcccugaguggaguauuaaagacacuuaa

SEQ ID NO: 32204 - RNA, 64 nt, Human
ggaucaagacagaagacggcgagggcaucgucauugcccugagcguggacacgccaccggcagc

SEQ ID NO: 32205 - RNA, 64 nt, Human
gacacgcgcguuuucuccugccgaacgcaggggcugcccugacuuugcucugccgccccccggg

SEQ ID NO: 32206 - RNA, 64 nt, Human
uggcaucuuggcucuugccugaggccagucacccugcccugaauucuauccuacuccaccuuca

SEQ ID NO: 32207 - RNA, 64 nt, Human
gcacaguguuuucauaaagauaauaggauccucuugcccugaagucuuuuuuucuuuuuacgcu

SEQ ID NO: 32208 - RNA, 64 nt, Human
guggcccucaggcccacagguuuaaggcugaggcugcccugacccuuccacagucauuucuucu

SEQ ID NO: 32209 - RNA, 64 nt, Human
cccacccccugcccagagcaacagccuaaaggccugcccugaugcucuccuccuaccagaguga

SEQ ID NO: 32210 - RNA, 64 nt, Human
agaacaugucuaaagagugagcuucugccucuccugcccugaaaaggaggaaugauuggggcca

SEQ ID NO: 32211 - RNA, 64 nt, Human
cuauuccuacagcgggacacccugaccccacggcugcccugaccccaggaggcuccaguucugg

SEQ ID NO: 32212 - RNA, 64 nt, Human
uucccaucaggacucagaccccaggccgagaucuugcccugaauguacccugccucugcuuucu

SEQ ID NO: 32213 - RNA, 64 nt, Human
ggggaguugaaagggugggugccugaagauguugugcccugagucauugacucaaaagaaaaga

SEQ ID NO: 32214 - RNA, 64 nt, Human
uuguacuggggaagauuuuauuucuuggguggggugcccugaguggguugauccucugggacuu

SEQ ID NO: 32215 - RNA, 64 nt, Human
gccggaagcagccuuccugcucggugcacgaugcugcccugaaacacaggcucagccguuccca

SEQ ID NO: 32216 - RNA, 64 nt, Human
gccugggguggacccaggaccccuggggccugggugcccugaguggugguaaaguggagcaauc

SEQ ID NO: 32217 - RNA, 63 nt, Human
guggcugucugauaagcugauggcauggagcccugcccugagugucugucccucuucagccaa

SEQ ID NO: 32218 - RNA, 64 nt, Human
gagacgaggagggcucuggucccgucacucuccaugcccugacaacagugcuuguagcuuugau

SEQ ID NO: 32219 - RNA, 64 nt, Human
gacgcugugaucuccaccuugaagccaggcaggcugcccugagacgaggagggcucuggucccg

SEQ ID NO: 32220 - RNA, 64 nt, Human
ccuggugagauguuucccacuuaugccgugguccugcccugagccccuuuccccaccacaaccc

SEQ ID NO: 32221 - RNA, 64 nt, Human
gggagcuguccguucaggaccaugagccauccucugcccugacuagcgaggggcagagcacacc

SEQ ID NO: 32222 - RNA, 64 nt, Human
auacugcgggcugagcaggagcagugguggcgccugcccugaggcugcccugcgauggccuggg

SEQ ID NO: 32223 - RNA, 64 nt, Human
guuaucaaccgugacugcaagagcguucgugcagugcccugagccacggccgucucugauucuc

SEQ ID NO: 32224 - RNA, 64 nt, Human
acuuuuaagugucuuagcacuuccucgaugugccugcccugagggagugaguucacauuugaga

SEQ ID NO: 32225 - RNA, 64 nt, Human
ccuguggcucaucggcuucccucuuaaccuuuagugcccugaagacugcugccgcugucaccgu

SEQ ID NO: 32226 - RNA, 64 nt, Human
ucacgucucccuaaaaaugcguaagaccaagcugugcccugaccacccugggccccugucguca

SEQ ID NO: 32227 - RNA, 64 nt, Human
gggccgucaccugcuuggcccuggcccagcucccugcccugaguccugagccagugccuggugu

SEQ ID NO: 32228 - RNA, 64 nt, Human
aggccagcguccagcuggcggugcucccgggaugugcccugacaugguuaauuuauaacacccc

SEQ ID NO: 32229 - RNA, 64 nt, Human
cugugacccccgcggcccacacacuggacugaccugcccugagcggggaugcaguguugcacug

SEQ ID NO: 32230 - RNA, 64 nt, Human
gcgcuucuucucuccauccuuggaccuucacaaaugcccugagacgguucucuguucgauuuuu

SEQ ID NO: 32231 - RNA, 64 nt, Human
ggcggccugcugcuuuuuccuucucuuccuccccugcccugagcugcaugguucccccacccug

SEQ ID NO: 32232 - RNA, 64 nt, Human
gucacauuuccccagccccaccuuccccuccugaugcccugaaagcuuccggaauugacuguga

SEQ ID NO: 32233 - RNA, 64 nt, Human
acucgcccaccagggugaugccacuuuugccuccugcccugaaaauuggacuuaagaugccaug

SEQ ID NO: 32234 - RNA, 64 nt, Human
acugccaacugcagggggccccucgggccucacuugcccugagcccaggaguccaagggcaggg

SEQ ID NO: 32235 - RNA, 64 nt, Human
cucuccuugcuacccagaaauccaucuaaauaccugcccugacaugcacaccucccccugcccc

SEQ ID NO: 32236 - RNA, 64 nt, Human
uuccagguuccugagcccuacugugucucaggugugcccugaaaccccagggcuugugugcaca

SEQ ID NO: 32237 - RNA, 64 nt, Human
guccccggaucugccgggaaggcuucugaggggcugcccugagagcauucaguucacaugucac

SEQ ID NO: 32238 - RNA, 64 nt, Human
cauucugugaccugucugaggcccacccugcagcugcccugaggaggcccacagguccccuucu

SEQ ID NO: 32239 - RNA, 64 nt, Human
aaaggggaaauggcuuuagaguagacaacagagaugcccugagggguuguguagguuguucacu

SEQ ID NO: 32240 - RNA, 64 nt, Human
gccagucaugaaucucagacagccugccaccuauugcccugauuuguguuauaauaaaggccuu

SEQ ID NO: 32241 - RNA, 64 nt, Human
uccuccuccccugcagccugguuagguggauaccugcccugacaugugaggcaagcuaaggccu

SEQ ID NO: 32242 - RNA, 64 nt, Human
ccgggccucggagccugccucggccgcggggcauugcccugaguggacagucgucuucgaccug

SEQ ID NO: 32243 - RNA, 64 nt, Human
gcagaugcuguuuagcaccugccaaggagccauaugcccugaaguucagcauuaggcagguauc

SEQ ID NO: 32244 - RNA, 64 nt, Human
gccaaggacuguccucucacccacuccuggauucugcccugaccuccauccuggacacugccuu

SEQ ID NO: 32245 - RNA, 64 nt, Human
uaggagcuaucacuauauuuugcagaauggaaacugcccugacucaugaaucacaaauaaaagc

SEQ ID NO: 32246 - RNA, 64 nt, Human
ccaugggcaggcggguggggggaugggaagggggugcccugaaaccaaacuggaagcccccucu

SEQ ID NO: 32247 - RNA, 64 nt, Human
ucacccccgaggauggccucgggguuucccccugugcccugacagccgcuccugguaucagagc

SEQ ID NO: 32248 - RNA, 64 nt, Human
ccagccucaaugguucccgcccuggaccuccagcugcccugacuccccucuggacacuaagacu

SEQ ID NO: 32249 - RNA, 64 nt, Human
aguuugagagcugagccuuccugccuacugccccugcccugaggagggcccugaggaauaaagc

SEQ ID NO: 32250 - RNA, 64 nt, Human
cgguggaggugcggcagcugcugcucaggugccaugcccugaagaggcaggguacacauggggc

SEQ ID NO: 32251 - RNA, 64 nt, Human
ccuccugcuggccccagcaaggcccaugagugacugcccugacguauucacugugccucugggc

SEQ ID NO: 32252 - RNA, 64 nt, Human
uuuauugaguggggcaagugcugggcuguggucgugcccugacagcaucuuccccaggcagcgg

SEQ ID NO: 32253 - RNA, 64 nt, Human
ccuggagucugcaucaugggucuugcuugccugcugcccugauggccugagcaucccccagauc

SEQ ID NO: 32254 - RNA, 64 nt, Human
auuauccuucucuuucugcacaaggaaaaauuaaugcccugagaauugucauaauuuucccaag

SEQ ID NO: 32255 - RNA, 64 nt, Human
uuugggcucagacaccagcaacagccucuugggaugcccugaguugcuucccauuuccucuuuc

SEQ ID NO: 32256 - RNA, 64 nt, Human
uuuaacccucuucuuucucagucuaugagaaacuugcccugaggggcaccugggcuaggggcuu

SEQ ID NO: 32257 - RNA, 64 nt, Human
agugcagcaggcagcuuuucuuuggggugggacuugcccugagcuuggagcugccaccuggagg

SEQ ID NO: 32258 - RNA, 64 nt, Human
uggaccuagagagaggcacagauguucugggggcugcccugagcccuggaaggguggggguggg

SEQ ID NO: 32259 - RNA, 64 nt, Human
uuccugauguuccacuccacuuuguauagacaucugcccugacugaauguguucugucacucag

SEQ ID NO: 32260 - RNA, 64 nt, Human
aaucccuauuugagaaacacugccccauccuccaugcccugaacccugaguagacagccccaag

SEQ ID NO: 32261 - RNA, 64 nt, Human
auccagagccuggcuguggggaaagugaccacucugcccugaccccgaucaguuaaggagcugu

SEQ ID NO: 32262 - RNA, 64 nt, Human
ccugggccuuccuggaagccugcaguugggggccugcccugagucugcuggggagugggcauuc

SEQ ID NO: 32263 - RNA, 64 nt, Human
cucuuaauaucugcugcaacuuggagaaccucccugcccugaaaugugaaccaagcacacuuug

SEQ ID NO: 32264 - RNA, 64 nt, Human
cucgcuugccaggagugcguucuuuguugaaaaaugcccugaagcgaaaagaugcagguuuaua

SEQ ID NO: 32265 - RNA, 64 nt, Human
cccuuggugcgagggaagcaauugaaaaggaacuugcccugagcacuccuggugcaggucucca

SEQ ID NO: 32266 - RNA, 64 nt, Human
cuguuugcaggggacacggucacaggagcucuucugcccugaacgcucccaaccugccucccgc

SEQ ID NO: 32267 - RNA, 64 nt, Human
ccaucauucccgguuucugccccugucugcccccugcccugagaguugcccgugcccuggacuu

SEQ ID NO: 32268 - RNA, 64 nt, Human
gguagcagcaggacagacagugaaucacagagucugcccugagcagaggcugcugucccuggga

SEQ ID NO: 32269 - RNA, 64 nt, Human
uggucaaaauguuuaugcagucaaggccaaagccugcccugagcccagacacaccugggucccc

SEQ ID NO: 32270 - RNA, 64 nt, Human
uguguugggaccaaaaccuggguguccucacugcugcccugaguccagccaugguuuucagggg

SEQ ID NO: 32271 - RNA, 64 nt, Human
auucauuuuuagccaaguacuucauagcaaucuuugcccugaauuuaggcagucacuuugagau

SEQ ID NO: 32272 - RNA, 64 nt, Human
accagaccuucuuucucagccagguuucccaggaugcccugaggagaaccaucuucccucuggg

SEQ ID NO: 32273 - RNA, 64 nt, Human
gguguggggcugccagguuggacgcagcugcugcugcccugacuuuggcauaugccagccuguu

SEQ ID NO: 32274 - RNA, 64 nt, Human
guggcuggcagcacgccugccuugcucugccccaugcccugaacaggcaugagagcuccacguc

SEQ ID NO: 32275 - RNA, 64 nt, Human
gguuagggcuguuccugaaaggcagagagccucuugcccugagccucacagcuacucuucucag

SEQ ID NO: 32276 - RNA, 64 nt, Human
cagcccagcaccauccaaagggugggagcacaucugcccugaaagaaaacgccacuggccaugu

SEQ ID NO: 32277 - RNA, 64 nt, Human
aaggagcaaaguuacaggccaguuuuuacuuguuugcccugagggaaaaauccuuuuaaaaaaa

SEQ ID NO: 32278 - RNA, 64 nt, Human
caaaauggagucugauggggagaagaaguacccaugcccugaaugugggagcuucuuccgcucu

SEQ ID NO: 32279 - RNA, 64 nt, Human
agaagcacugacugccccuggucuuccaccucucugcccugaacacccaaucucggccccucuc

SEQ ID NO: 32280 - RNA, 64 nt, Human
ccaauaucaguccucgcggcucuccagggcucccugcccugaccucuucccuggguuuucugcc

SEQ ID NO: 32281 - RNA, 64 nt, Human
gcugacaggucggggggcuuucugucuggcucacugcccugaugacccacccgccccauccagg

SEQ ID NO: 32282 - RNA, 64 nt, Human
gagcuucuugguaccucuugccaccccuucucacugcccugacccaaccccacuggaccuugau

SEQ ID NO: 32283 - RNA, 64 nt, Human
gggcccccuguccucagcacauuccaggcagcugugcccugacccacagggacccguggggaug

SEQ ID NO: 32284 - RNA, 64 nt, Human
caagugacuucugcaagccugcggcuggucccaaugcccugaaucaccucucucauggaagaac

SEQ ID NO: 32285 - RNA, 64 nt, Human
gagccuugcccaccagccaaucaauguucgucucugcccugaugcugccucaggaucccccauu

SEQ ID NO: 32286 - RNA, 64 nt, Human
agugcaaaaagcugaguauggugagagaagccugugcccugauccaaguuuacucaacccucuc

SEQ ID NO: 32287 - RNA, 64 nt, Human
uuugaccuucucuuucacccacaugccuaagaccugcccugacaaucagaguagggacuacaag

SEQ ID NO: 32288 - RNA, 64 nt, Human
uggcagggaugagugcggugggugagaaucccggugcccugagaggcuauacgugacaaaugac

SEQ ID NO: 32289 - RNA, 64 nt, Human
cccuagucccaggguggggguggggcaccccagcugcccugacagauggguccccuuuuucucu

SEQ ID NO: 32290 - RNA, 64 nt, Human
gucccaagaaacagggaagagccuaggggagaggugcccugacggcacuuuggugccagcauug

SEQ ID NO: 32291 - RNA, 64 nt, Human
cuaugcugugguucuuaugagacuuguaugaagaugcccugauuuguacagauugaccacggga

SEQ ID NO: 32292 - RNA, 64 nt, Human
cagggucauguugcaucuuggagccacaugcugcugcccugaucucagugggaaauccacccag

SEQ ID NO: 32293 - RNA, 64 nt, Human
ccaaaccuucauuugggccuuccuuccucaugucugcccugagcgcgggguggaagugcucccu

SEQ ID NO: 32294 - RNA, 64 nt, Human
aacuuacccacuguaaucaccuaaauaaaguguuuauaaacaugauuguggcaccugugcuccu

SEQ ID NO: 32295 - RNA, 64 nt, Human
aagguucuauccuguuccgagcaacuuuucuaauuauaaacaucacagaacauccuggaucaaa

SEQ ID NO: 32296 - RNA, 64 nt, Human
auguggucucuucugugucaaauguuaaaugaaauauaaacauuuuuuaguuuuuaaaauauuc

SEQ ID NO: 32297 - RNA, 64 nt, Human
gguuucaaauagugauguuagacuuaaccuaauuuauaaacaagagauuaauaucuccaugcau

SEQ ID NO: 32298 - RNA, 64 nt, Human
aggguaugggguggggagagaggguggaggguuuuauaaacaaacuuaacagcaauauugaaag

SEQ ID NO: 32299 - RNA, 64 nt, Human
aaguguguagaugcuuuuuucuuuguuguuuaaauauaaacagaaguguaccuuuuauaauaaa

SEQ ID NO: 32300 - RNA, 64 nt, Human
guaauaguccccacuauacgaauuuuaugguuuguauaaacacuaacauuuuccccuucuguag

SEQ ID NO: 32301 - RNA, 64 nt, Human
aaugauggauaaggggguacacagaccaagucccuauaaacaaggaccuuccaguccaggggaa

SEQ ID NO: 32302 - RNA, 64 nt, Human
cuuuguaaacuacauuugacauggauuaaaccaguauaaacaguugcugccuguguguuaugug

SEQ ID NO: 32303 - RNA, 64 nt, Human
gggcaugagggaacacuucuuaugagaaaacauuuauaaacaaaagaaacauuuauaaacuaaa

SEQ ID NO: 32304 - RNA, 64 nt, Human
gggaaaaaaggugaucuaagaguuguaccaccuauauaaacauccuuugaagaagaaacuaaga

SEQ ID NO: 32305 - RNA, 64 nt, Human
auucaacguguggucauaugauaaauaagugauuuauaaacaagagugauauuuugcuagggcu

SEQ ID NO: 32306 - RNA, 64 nt, Human
cauugucuccuucccaucuuaguaccauuguaguuauaaacaucugcauuuuuuagaagcauuu

SEQ ID NO: 32307 - RNA, 64 nt, Human
gaggggggaaaaauggaaccagggccugacauuuuauaaacaaacaaaaugcuaugguagcauu

SEQ ID NO: 32308 - RNA, 64 nt, Human
ccugugcugagcaacagcuguuauugucaugguuuauaaacaauaaacugugaugccaggcaca

SEQ ID NO: 32309 - RNA, 64 nt, Human
cugcguuuuguuauuugaaacacacacacuuauauauaaacacauguaauuuuacuauuuuauu

SEQ ID NO: 32310 - RNA, 64 nt, Human
acucagggagcuuauagaagugaagauuccugaauauaaacauaguaauaauucaaccuacuga

SEQ ID NO: 32311 - RNA, 64 nt, Human
aaaguaaauuuaguccuauaauuuucagcuuaauuauaaacaaaggaacaaauaaguggaaggg

SEQ ID NO: 32312 - RNA, 64 nt, Human
gcaauuuccagaaauggaauuugccugcaaauaguauaaacaacacuaaauuuacugugccagg

SEQ ID NO: 32313 - RNA, 64 nt, Human
gggauuuuuuaccaaagcagcauaauauguguuauauaaacauaauaauacucagauauccaaa

SEQ ID NO: 32314 - RNA, 64 nt, Human
cucacuuaugagaugccugaagccaggccauggcuauaaacaauuacauggcucuaaaaaguuu

SEQ ID NO: 32315 - RNA, 64 nt, Human
cuuuguugauacugcuuauuuagagaaggguucauauaaacacucacucugugucuucaacagc

SEQ ID NO: 32316 - RNA, 64 nt, Human
guacagaacuuugucuacagcacaaauuaaguuauauaaacacagugacugguauuuaaugcug

SEQ ID NO: 32317 - RNA, 64 nt, Human
uacugaugggcauuuguugccauuauuuuacuguuauaaacaaugcuucagugaaugcucuugu

SEQ ID NO: 32318 - RNA, 64 nt, Human
uucaauuaaacucaaauauuaaauaucuauaacuuauaaacaccaacuuucaauguaauaaaug

SEQ ID NO: 32319 - RNA, 64 nt, Human
gccaacugugagaaucaauggccuaaaugcuuuuuauaaacauuuuuauaagugucaagauaau

SEQ ID NO: 32320 - RNA, 64 nt, Human
gaauuuaagugaacauuugccucaagauguuaacuauaaacacacugcauacaauuuucuucug

SEQ ID NO: 32321 - RNA, 64 nt, Human
aaaaacaaacuuaauuuugauugaacuaauaauuuauaaacaugggaaacaagucagaaguagu

SEQ ID NO: 32322 - RNA, 64 nt, Human
ucacccguuguauucaccccacacccagggcuaguauaaacaugacccugggcuucuguaccac

SEQ ID NO: 32323 - RNA, 64 nt, Human
uccccacacacaaagccuuuauucuauauaauuuuauaaacacaaauucaugauuaucuguuuu

SEQ ID NO: 32324 - RNA, 64 nt, Human
ugcacaaucaguguugcucaaacugcuuuauacuuauaaacagccaucuuaaauaagcaacgua

SEQ ID NO: 32325 - RNA, 64 nt, Human
ccaauuauuuuauguaauccucauaauaaccugguauaaacaugaaggguauggcuuuauuuuu

SEQ ID NO: 32326 - RNA, 64 nt, Human
cuucuaauccucaccauuccucagguauaaguucuauaaacaggcuuggaaucuggguaauuaa

SEQ ID NO: 32327 - RNA, 64 nt, Human
uuccuuuuauaaaacauucuacccucaccuccaauauaaacacauuaaaagaguacaauaaaaa

SEQ ID NO: 32328 - RNA, 64 nt, Human
cucaaauacuacgcauauacgguaagagauuaaauauaaacacagcaaguuccaccccaguccu

SEQ ID NO: 32329 - RNA, 64 nt, Human
caagugugaucgaaagcuguuaaugugcucucuguauaaacaauuugcuccaaauauuuuguuu

SEQ ID NO: 32330 - RNA, 64 nt, Human
uuuuuguauguauacuuaugcauacauguaaguauauaaacauuuagaaguguaccuaucuaac

SEQ ID NO: 32331 - RNA, 64 nt, Human
cagaugauuuguaacuucucugugccaaaccuuuuauaaacauaaauuuuugagauauguauuu

SEQ ID NO: 32332 - RNA, 64 nt, Human
cugacaucaagaugggagcccagcccacgggcuuuauaaacacccaagaaccguuucagaucuu

SEQ ID NO: 32333 - RNA, 64 nt, Human
agggacuaugcuccuuggcucaccccuucucccuuauaaacaaugagcaguucuugaugaaccu

SEQ ID NO: 32334 - RNA, 64 nt, Human
uuaagcagaaguucuaccaccuuauuagaacugcuauaaacaaaagcaucugaaauaauugugc

SEQ ID NO: 32335 - RNA, 64 nt, Human
aauuccacuccuuugguuaauacugaagauaaaauauaaacaaaugucaacucuguuauaauua

SEQ ID NO: 32336 - RNA, 64 nt, Human
uauuguacuuuugguuaugcaaacacuuugauaauauaaacaguuauguccccuauaaaucugg

SEQ ID NO: 32337 - RNA, 64 nt, Human
uucuuguuuaaguguuuacacaguuugguucaauuauaaacauuuggccuuuuacuauguuauu

SEQ ID NO: 32338 - RNA, 64 nt, Human
auugaagguucuuaucagaugggauacuggggacuauaaacaauggaaauaaagccacuguauu

SEQ ID NO: 32339 - RNA, 64 nt, Human
uuuauauuuauaaauuuauaacuucauacaaauuuauaaacauuucuuuauaaauuguaauuua

SEQ ID NO: 32340 - RNA, 64 nt, Human
caaaaaaaaaaaaaaaaaaaccaguuagcugcuauauaaacacuauaccaagcacuaggcuuag

SEQ ID NO: 32341 - RNA, 64 nt, Human
guauuguuauuaaaugucuuuuuaaaaagagaaauauaaacauauauuuuuacuauuaaaauau

SEQ ID NO: 32342 - RNA, 64 nt, Human
agaugguaugcagcauacaaaaauauauuaaaaauauaaacaauguucaggagaguaaaaauuc

SEQ ID NO: 32343 - RNA, 64 nt, Human
agucaccuuuuacaugacucaggugaaaaaacaguauaaacauuaauuuacuuuguguucaaaa

SEQ ID NO: 32344 - RNA, 64 nt, Human
cugguuuaccucuauaguuuauuuauuuuuaaauuauaaacacuuuucagcugcuaguaucaga

SEQ ID NO: 32345 - RNA, 64 nt, Human
cagguggacccccuaaguuagauuacuagacagauauaaacagauccccugcugaacagauaca

SEQ ID NO: 32346 - RNA, 64 nt, Human
caguuuuguauuauacuuuuuaaaucuugaacuuuauaaacauuuucugaaaucauugauuauu

SEQ ID NO: 32347 - RNA, 64 nt, Human
uuaacagaacuugcauuauuuuguuuuuaauaaauauaaacaugaaauuuuuguaugugagaau

SEQ ID NO: 32348 - RNA, 64 nt, Human
auuuugaaggaggauauucacugaagcucauaguuauaaacaaggaaaucacuguuaagaaugg

SEQ ID NO: 32349 - RNA, 64 nt, Human
auaaagauuaccaaguaagacucaaaauugcaaauauaaacaaaagaaaaauccaacugaaaau

SEQ ID NO: 32350 - RNA, 64 nt, Human
gggacugacagcauggucaggguguauuguagcuuauaaacaugaaaucuuauaagguuucagu

SEQ ID NO: 32351 - RNA, 64 nt, Human
uuggauuuuuuuaaucacucauaugguagaauuuuauaaacacauacaugauaccauccaaauu

SEQ ID NO: 32352 - RNA, 64 nt, Human
aauuucaaaguugucauuaauuuaguaagccuaauauaaacaaauauuuguauuauuuuuguua

SEQ ID NO: 32353 - RNA, 64 nt, Human
auccagugucuccaaaauuguuuccuuguacugauauaaacacuuccaaauaaaaauauguaaa

SEQ ID NO: 32354 - RNA, 64 nt, Human
aaccuagagaagauaauuguugaaauuuugcaaauauaaacaucuccuauagcuucuguguuau

SEQ ID NO: 32355 - RNA, 64 nt, Human
uaugcuuaagcaaucuauaaaucauuuucaauguuauaaacacuaauugguuuccucuagggug

SEQ ID NO: 32356 - RNA, 64 nt, Human
acaaugaacaguucacuuuauucccuggguuuucuauaaacaguuuuaaggauaugauuugguu

SEQ ID NO: 32357 - RNA, 64 nt, Human
cucucuuccuaacagggcacauauucuuccauaauauaaacacuuuucugccccaucucccaua

SEQ ID NO: 32358 - RNA, 64 nt, Human
uugaauccuuuuauaaaccaguaucacuuuguaauauaaacaccuauuuguacuuaauuuugua

SEQ ID NO: 32359 - RNA, 64 nt, Human
acguauguuuuuguguauuuguuaaugguuugaauauaaacacuauauggcagugucuuuccac

SEQ ID NO: 32360 - RNA, 64 nt, Human
ucccacacccauuauaaaagagguuucuauuguauauaaacaaacaauaaaugauuauuagcag

SEQ ID NO: 32361 - RNA, 64 nt, Human
uaaacuucaaguagaaauguacucaagcccuauuuauaaacaaauacuuuuccugccuccacca

SEQ ID NO: 32362 - RNA, 64 nt, Human
acugcuguagaaaaguauuaauagcuucauuucauauaaacauaaguaacucccaaacacuuau

SEQ ID NO: 32363 - RNA, 64 nt, Human
cuuuaagaagugaccauuauacuguguauauauauauaaacacacacacauauauauauauaua

SEQ ID NO: 32364 - RNA, 64 nt, Human
gcuuaaggcacuguuuuagaagcuuacuuaguuuuauaaacacugcucauuuuuggauguuugu

SEQ ID NO: 32365 - RNA, 64 nt, Human
aagugcuuuguauuuuguugaagucaguauuuuguauaaacauuuauguugacccacuuauguu

SEQ ID NO: 32366 - RNA, 64 nt, Human
aggggaggggggauuuauuucugaaagaaaaauauauaaacagaucuucuacauuuauauuuuu

SEQ ID NO: 32367 - RNA, 64 nt, Human
uuucaaccaguuaccauaaagaaguuaguguauauauaaacacaaauaauuagugacagauuca

SEQ ID NO: 32368 - RNA, 64 nt, Human
cuaguuaaucaucauuuuuccuuuaguuuaauuuuauaaacaaaacugauuauaccaguauaaa

SEQ ID NO: 32369 - RNA, 64 nt, Human
aauguagccauugcuuuaaaauguaccguguaaauauaaacacauccuaucagaucgcuggcuu

SEQ ID NO: 32370 - RNA, 64 nt, Human
acagcagugaaugggacucaaauguugugcuuccuauaaacagcuccgcucuuucagggaagga

SEQ ID NO: 32371 - RNA, 64 nt, Human
guuauauaccauauagaacuuacugucagucaacuauaaacaggcccaauuaaaaacuguucca

SEQ ID NO: 32372 - RNA, 64 nt, Human
acuauuguccauuaacaugauaugcuaaacauucuauaaacauucuuguauuuaugugagacuu

SEQ ID NO: 32373 - RNA, 64 nt, Human
caauauuauuucugugccuagagucuuucuccauuauaaacauguuuuaacauuauuucuuuuc

SEQ ID NO: 32374 - RNA, 64 nt, Human
gcuggaagcuaaauuuacacuuaaaguuggaguguauaaacauuuuaauauauguuaauguugc

SEQ ID NO: 32375 - RNA, 64 nt, Human
cgacagagugaguuugucaaaaguaucucauacuuauaaacaguaugagauaggaggauuaaaa

SEQ ID NO: 32376 - RNA, 64 nt, Human
ugcuuauuuuauuuuuuauguuguaaaaugcuaguauaaacaaacaaauuaauguuguucuaaa

SEQ ID NO: 32377 - RNA, 64 nt, Human
ggcuguagauuccaaguaucuuaaaagaaggaacuauaaacauugcacugaaaacuugcuuuaa

SEQ ID NO: 32378 - RNA, 64 nt, Human
uauaaaauucucuguuggaauuugccuacuuaccuauaaacagcucacuacacuuaaaggaaau

SEQ ID NO: 32379 - RNA, 64 nt, Human
guaaauauaaauuuugucccuuccauuucuacuguauaaacaaauuagcaaucauuuuauauaa

SEQ ID NO: 32380 - RNA, 64 nt, Human
uacccuuauugccccaagagaccuagcuaaggucuauaaacaugaagggaaaauuagcuuuuag

SEQ ID NO: 32381 - RNA, 64 nt, Human
gauaugggacaaaauuuaaaaauucaguaacauuuauaaacagaauugaaugaaaagaguuaca

SEQ ID NO: 32382 - RNA, 64 nt, Human
gcuuuucuuacucuuuucuguuaguagauuuauuuauaaacaccacaagaagaucucuugggau

SEQ ID NO: 32383 - RNA, 64 nt, Human
gucaccuuuguuccucagcuaaaaguaauuuuguuauaaacacaaagugacuuuaaacagguaa

SEQ ID NO: 32384 - RNA, 64 nt, Human
acauugaucuagaucugccuuuauccacucgaauuauaaacagcucggcuuguccuugucccau

SEQ ID NO: 32385 - RNA, 64 nt, Human
ccaucauuauauucuuucguguuuuuucuuuuauuauaaacaaggggauuauucuuuaguucuc

SEQ ID NO: 32386 - RNA, 64 nt, Human
guauauaugugguaaggaaaugccgauucuucauuauaaacaaguuuuaaaauuguucuuucuu

SEQ ID NO: 32387 - RNA, 64 nt, Human
caaauuccuguuuccaacuucaaauaguuuuuucuauaaacacaaaaucaguguuuauucacca

SEQ ID NO: 32388 - RNA, 64 nt, Human
guauaacaaugccaguuuucccaagguuaauugauauaaacaagaaugauguuccuacagcaua

SEQ ID NO: 32389 - RNA, 64 nt, Human
acuggacagugacauaaaaggcaauggaauuuucuauaaacauuuucucauguaaacaugcugc

SEQ ID NO: 32390 - RNA, 64 nt, Human
agucauaaaguugacuuucagcacaaaagauacuuauaaacaaauaaaaaauuuuuauuuuucu

SEQ ID NO: 32391 - RNA, 64 nt, Human
uugauuacacaugugagauuugcugcuguugcaguauaaacacuagguauaauaggauuugaaa

SEQ ID NO: 32392 - RNA, 64 nt, Human
ccccucuaggaaaugcacggcuugauaccccagauauaaacauuguuuugaagcaggauauggc

SEQ ID NO: 32393 - RNA, 64 nt, Human
ggaagagcugcccgcauacugagagacagcuucuuauaaacaaggagaguuuuugugugugcga

SEQ ID NO: 32394 - RNA, 64 nt, Human
agaacaguugacaguggucaucuggaacuguucauauaaacaguggcuucaagcuaaguuucuu

SEQ ID NO: 32395 - RNA, 64 nt, Human
auugaaaacaaaccuuuauauccaaugaaaauaguauaaacagaaugauuuuuauaccaccuug

SEQ ID NO: 32396 - RNA, 64 nt, Human
cuuaaguauuuggcuguuuuuauuuuuuaaaagguauaaacaccaaaaaaaaaauuaacauugu

SEQ ID NO: 32397 - RNA, 64 nt, Human
auuuaaaauuagaaauuuguuuuucuguugaguauauaaacaaaaauuggucccaauucuaaca

SEQ ID NO: 32398 - RNA, 64 nt, Human
aaaaagaaaaggagaauuuaggaaauaaauaugcuauaaacaagguacaguacagugagaguua

SEQ ID NO: 32399 - RNA, 64 nt, Human
uuuaucaccaguaacauugauaccuauuuugggguauaaacaugguguuuuucagaaauaaaaa

SEQ ID NO: 32400 - RNA, 64 nt, Human
aagaggagauguagaaaaauguguacaauguuauuauaaacagacaaaucacgucuuaccacau

SEQ ID NO: 32401 - RNA, 64 nt, Human
cugaagaauugaaaaguuuuuguuuggagacguuuauaaacagaaauggaaagcagaguuuuca

SEQ ID NO: 32402 - RNA, 64 nt, Human
acuaaauuaaaacucuugguggucacauauuguauauaaacaaaacaauaugcuuuguugaagg

SEQ ID NO: 32403 - RNA, 64 nt, Human
uaucggcuggaaccagcaguucagagaucugccuuauaaacauuuaaaaccgguuugugguaca

SEQ ID NO: 32404 - RNA, 64 nt, Human
aaaauauuuauuuugauaugaugcuuaaauauuauauaaacauuuggaaaaguaacaaauagag

SEQ ID NO: 32405 - RNA, 64 nt, Human
auuucagucuaaucugcccuucugugggccauaauauaaacauaaauguguguaaugauaaaaa

SEQ ID NO: 32406 - RNA, 64 nt, Human
cuaggcuuagcuuccaaauuaugcuuuauagcuguauaaacaucgugauuauauucaucuacuu

SEQ ID NO: 32407 - RNA, 64 nt, Human
aaggcaaucuuaaaguucauuauguaaaacuaauuauaaacaggacccaauuuauauucauaga

SEQ ID NO: 32408 - RNA, 64 nt, Human
ccaacaauuuaagugccugauacaaaguccaaaguauaaacaugcuccuuuccucucuugcugc

SEQ ID NO: 32409 - RNA, 64 nt, Human
guaacuguaguguagucaggugcucaauggagaauauaaacauauacagaaaaauauauauuuu

SEQ ID NO: 32410 - RNA, 64 nt, Human
uuguauguauuuaaaugaucauccgacucagaaauauaaacacuuuuaaugaaagggaggaacg

SEQ ID NO: 32411 - RNA, 64 nt, Human
aaaacggcuauauuugaagagagaauacauuuuauauaaacaggaaaauacauuugacacuuua

SEQ ID NO: 32412 - RNA, 64 nt, Human
uuuuauuguauuuuauuugguugagggauuuuuuuauaaacaguuuuacuugugucauauuuua

SEQ ID NO: 32413 - RNA, 64 nt, Human
aguuuuguuuauuucuuuuaaguuuuguuugugguauaaacaauaccacauagaauguuucuug

SEQ ID NO: 32414 - RNA, 64 nt, Human
cugugugccacaggccaguguuguuggugaaauauauaaacauuuauuuaaagagaaaaguuac

SEQ ID NO: 32415 - RNA, 64 nt, Human
agaugguugaaaagaugguuguaagcuauuauaguauaaacacauuuuugcuauuaaaaaugcu

SEQ ID NO: 32416 - RNA, 64 nt, Human
cccaguaaacauauacaaaguaagcuuaaaacacuauaaacaugagauaagggaaaaugaaucc

SEQ ID NO: 32417 - RNA, 64 nt, Human
guucuccauauagcaauacuucagugagauuaaguauaaacaguuuuuggcaaaaaacaacaca

SEQ ID NO: 32418 - RNA, 64 nt, Human
gaaaguguaaaauagaauguuacuuuggaaugacuauaaacauuaaaagaagacuggaagcaua

SEQ ID NO: 32419 - RNA, 64 nt, Human
agagcaaacuaagcuuuauuagugcugcaacuaauauaaacaaauguuuauauuuguugcuucu

SEQ ID NO: 32420 - RNA, 64 nt, Human
gccaaaucuaaaagaaauauauacauacaguguauauaaacaaaauugcacccugaagaugaca

SEQ ID NO: 32421 - RNA, 64 nt, Human
gguugguacuaaacauuuauaauuacuguguaauuauaaacaaaaauacauaaagcuuugaaua

SEQ ID NO: 32422 - RNA, 64 nt, Human
ucagggacagcaauucacagccugccucugguucuauaaacaagucauucuaccucuuugugcc

SEQ ID NO: 32423 - RNA, 64 nt, Human
cuggaaauucaaaacucaaacuacuaucuuuagauauaaacacuaguaauuaaaaugugccuuu

SEQ ID NO: 32424 - RNA, 64 nt, Human
gugcauuguuugugcucaauuucagacacucauuuauaaacaaauucaaccaagggauauuuac

SEQ ID NO: 32425 - RNA, 64 nt, Human
acuuuucagguguuggagccucuaaaauaugagauauaaacagaaacuaauacaaguuguucuc

SEQ ID NO: 32426 - RNA, 64 nt, Human
uauauauguauauauauauacauauauauauauauauaaacaugaaauauauauauauggcucc

SEQ ID NO: 32427 - RNA, 64 nt, Human
aucaguucaaauaaguuuuaauugucaaaugaaguauaaacacaugaacuuucuagaaauauuu

SEQ ID NO: 32428 - RNA, 64 nt, Human
cccccaucaaaaucccaccugaaccaucuaauccuauaaacauaaagggguaaaauuggaacuc

SEQ ID NO: 32429 - RNA, 64 nt, Human
aacccuuucuaggcuuuaacauuguaaauaauccuauaaacaguuugauuuuuuaagaugauuu

SEQ ID NO: 32430 - RNA, 64 nt, Human
uugaacuuauuuuaauucuuauaauuugcaccuauauaaacaaagcuccuacuguauucuucuc

SEQ ID NO: 32431 - RNA, 64 nt, Human
gaauagaauggcaugaagauuuuaaucaauuacuuauaaacaaagucuuagagacuuccuuuua

SEQ ID NO: 32432 - RNA, 64 nt, Human
acuucuucucauacuauuuaagagaacaagcaaauauaaacagcaacuuguguuccuaacagga

SEQ ID NO: 32433 - RNA, 64 nt, Human
uuuggcagaacuccuaagaauuuaugggagccuauauaaacauaucuugcuuuuaaaaaguucu

SEQ ID NO: 32434 - RNA, 64 nt, Human
guggccuaauuuacaagcacgauggagagagccuuauaaacagauaaugcuuuuacuaagcacu

SEQ ID NO: 32435 - RNA, 64 nt, Human
cauuuuaacauauauauauucacaaauauauucauauaaacaguauacauuuugaaucagucau

SEQ ID NO: 32436 - RNA, 64 nt, Human
cagaaaaucuuuuacuaguguguguguguauauauauaaacaauuguaaauuucuuuuagccca

SEQ ID NO: 32437 - RNA, 64 nt, Human
aaacgggcgugcucucucagacacacaacucugcuauaaacagcagaaacucuggacacaaacu

SEQ ID NO: 32438 - RNA, 64 nt, Human
gaagguuguauuaccuuccacuuccauguugucuuauaaacaaaugaauuguauuuuuuguuga

SEQ ID NO: 32439 - RNA, 64 nt, Human
gaaagcgagggugacaaaaacaacaaaacaccguuauaaacacaucaaagguucauucugacug

SEQ ID NO: 32440 - RNA, 64 nt, Human
auauauaauuuaaaggaaaaauaggugccuccuuuauaaacaguaauagcuacguuugggaagg

SEQ ID NO: 32441 - RNA, 64 nt, Human
ugugcuuacauacuuaaaaggauaucauuaaguauauaaacaaucauuacuucuguauuuuuaa

SEQ ID NO: 32442 - RNA, 64 nt, Human
ucaucggaaaagauccaaagugcaaggauuugauuauaaacauaauuuccuagacugaaaguuu

SEQ ID NO: 32443 - RNA, 64 nt, Human
uaauuacuuucaauuuccuccaggcaugacuagguauaaacauauauuuacaugauuaauccac

SEQ ID NO: 32444 - RNA, 64 nt, Human
uuaaauuaaacauuggcaaaaggaaauggaauaguauaaacacugaucaauagaguaaaauauc

SEQ ID NO: 32445 - RNA, 64 nt, Human
gaaaaugcagaaugucuuuuuaaauguuuuuaaauauaaacaaauauucuuuacuaaaauaaaa

SEQ ID NO: 32446 - RNA, 64 nt, Human
acuuguucuuuagccaaaagcugauuacauaugauauaaacagagaaauaccuuuagaggugac

SEQ ID NO: 32447 - RNA, 64 nt, Human
auauuuuagaaaauauuccuuuuguaauacugaauauaaacauagagcuagaaucauauuauca

SEQ ID NO: 32448 - RNA, 64 nt, Human
agacauagaacccuuauaaagaauuauuaaccuuuauaaacauuuaaagucuugugagcaccug

SEQ ID NO: 32449 - RNA, 64 nt, Human
auuauaaacuaguccauccaagaaccaaaguuuguauaaacagguugcuauaagcuuggugaaa

SEQ ID NO: 32450 - RNA, 64 nt, Human
aucaaguauaagguuacugauugauugguccuuuuauaaacauugguauauuuccauucaugcc

SEQ ID NO: 32451 - RNA, 64 nt, Human
aucuuuguuaagguccugaaaguaacucauaaucuauaaacaaugaaauauugcuguauagcuc

SEQ ID NO: 32452 - RNA, 64 nt, Human
aaaaaguagaagauaaguuuguuaaaguauuuuuuauaaacagcuuaauauaaaacauuauaga

SEQ ID NO: 32453 - RNA, 64 nt, Human
uagcaaucuuaguguauagacauuuugcaagucauauaaacaaguauugauuuauauauuuugu

SEQ ID NO: 32454 - RNA, 64 nt, Human
aaaauuggaaagcaaaguaauaaaacuuaguuuauauaaacagguugaaugauauauuuaucaa

SEQ ID NO: 32455 - RNA, 64 nt, Human
caggucucagagauaccuuaacuauuccuuuuuuuauaaacauauuaaaggauguggcuuuauu

SEQ ID NO: 32456 - RNA, 64 nt, Human
gaacaugucuuacauggguugcuguauuuagaauuauaaacauuuuucauuauuggaaagugua

SEQ ID NO: 32457 - RNA, 64 nt, Human
gugucuaccuuccuccucaacucccagccaucuguauaaacacaauccuuuguucucccaaauc

SEQ ID NO: 32458 - RNA, 64 nt, Human
aacugaagaagauuauaaaauuauuuauuguuauuauaaacaaaauuaacccuuugaauacuga

SEQ ID NO: 32459 - RNA, 64 nt, Human
auaugugaucuuaaauuuauaaggacuauccaucuauaaacaucugguaccugcaugugacuug

SEQ ID NO: 32460 - RNA, 64 nt, Human
uuuuucaaguuucugucuuccuaacuuuucuacguauaaacacucuugaauagacuuccacuuu

SEQ ID NO: 32461 - RNA, 64 nt, Human
aauuacuggauuuaccugucccugaaacugguguuauaaacaugaccuaucuuaagugauuuuc

SEQ ID NO: 32462 - RNA, 64 nt, Human
aggcacccucucacucaauuuccacucagaacccuauaaacaccagugggaagggcaacccacu

SEQ ID NO: 32463 - RNA, 64 nt, Human
ccauuaaaaaaauuguuuuuuuaauuuucuauauuauaaacauaaaauaaguaaugagcacuuu

SEQ ID NO: 32464 - RNA, 64 nt, Human
uaauugcauaagaauuuuaauuucuuuuaauugauauaaacaguaguugauuauucuuuuuauc

SEQ ID NO: 32465 - RNA, 64 nt, Human
uggcuggaucacagcucuuggcaauuacauuauuuauaaacacacacacuagcauguuuuucag

SEQ ID NO: 32466 - RNA, 64 nt, Human
cuuuuuccccccaaauauggucuagaugaguuauuauaaacauuguuuuuauuuuuuugagaca

SEQ ID NO: 32467 - RNA, 64 nt, Human
uuagaucuuaucacauuuaagucauugcuaauuuuauaaacaaaaacaaugguuuuacuuugca

SEQ ID NO: 32468 - RNA, 64 nt, Human
cuuguguuugcuuaaacaaagugacuguuuggcuuauaaacacauugaaugcgcuuuauugccc

SEQ ID NO: 32469 - RNA, 64 nt, Human
uccacuuuaggaaucaaauuaugucaauaaauguuauaaacacagccuucauuucaacuuauau

SEQ ID NO: 32470 - RNA, 64 nt, Human
uaaaauuuaguuuacucauuuuucacaaauuguauauaaacaugcacuucacuacauugguaau

SEQ ID NO: 32471 - RNA, 64 nt, Human
ugugaaaauauuuaauuugcuccuuuuaauucuguauaaacaaaucagagguuccugagguucc

SEQ ID NO: 32472 - RNA, 64 nt, Human
uuuaaggcauaauaaggguuaacauucuaggcaguauaaacacaccccauaaugcaaguaauag

SEQ ID NO: 32473 - RNA, 64 nt, Human
aauguaccgaugauacuguuucuugcacugaauauauaaacacuccacaguguuuauauuggga

SEQ ID NO: 32474 - RNA, 64 nt, Human
cucccucacuacaggaucuucauguuguuaauaauauaaacaaaccuuugaaauuagcauugca

SEQ ID NO: 32475 - RNA, 64 nt, Human
auguagcaaagucugccaucugugucugcuguauuauaaacagauaagcagccuacaagauaac

SEQ ID NO: 32476 - RNA, 64 nt, Human
aagucuaagucuagugaagguacccugacccccauauaaacaacccuugaggccgguguggugg

SEQ ID NO: 32477 - RNA, 64 nt, Human
aacucuuaaaaucaauaucuccuacauuaguagauauaaacauaauucaaauauuuaaauauuu

SEQ ID NO: 32478 - RNA, 64 nt, Human
uauacauuuuuauuaaaaaaauguaaugcuuauguauaaacauguauguaauaugcuuucuaug

SEQ ID NO: 32479 - RNA, 64 nt, Human
uuucagcugagacauaagggcugucagucuaucauauaaacaucuuuaacuauagccuagagaa

SEQ ID NO: 32480 - RNA, 64 nt, Human
ccaacacaguaauugccuuacaugacuugaaagauauaaacagaucuucuaucaguagcaguau

SEQ ID NO: 32481 - RNA, 64 nt, Human
caggaaucagagagaccugcuaaaaccagacagauauaaacaccaaagacggaagccaaauagg

SEQ ID NO: 32482 - RNA, 64 nt, Human
uguuacuguccuucauucuuggcucccuacuaucuauaaacagcugcugugaagaagaaaaguu

SEQ ID NO: 32483 - RNA, 64 nt, Human
ucugccuccaagguugaaaaggagacuaagacuguauaaacaucuucauugucaguucucaaaa

SEQ ID NO: 32484 - RNA, 64 nt, Human
ucuaucaguucauugccuggucaggucucuggccuauaaacaugcaaaaaaacuaauucauguu

SEQ ID NO: 32485 - RNA, 64 nt, Human
auuaguuuuuuucacaucauuauaucuggcuuccuauaaacaacagccuuaauucagucaagac

SEQ ID NO: 32486 - RNA, 64 nt, Human
gaaaagggaagagggguagauccuccaauguaaauauaaacaugccauaguuaacaaaugauaa

SEQ ID NO: 32487 - RNA, 64 nt, Human
gaaacauguauaugucaaaucagaagagaagaacuauaaacauauauuguguaaagaaaaaguu

SEQ ID NO: 32488 - RNA, 64 nt, Human
cccgccacccagcccccuuguaaacucuagucacuauaaacacacccguacgccuauccauguc

SEQ ID NO: 32489 - RNA, 64 nt, Human
guuuguguuuuaauuuaauauguuuauaagcauguauaaacauuuagcauauuuuuaucauagg

SEQ ID NO: 32490 - RNA, 64 nt, Human
uuaccuguguaugcuacaguacagacauuaauucuauaaacauguucauaggucuucccccucg

SEQ ID NO: 32491 - RNA, 64 nt, Human
auuaaaauuuuuagaucaaaaaggcaaaugauuuuauaaacaauggacaauauauacuuucuua

SEQ ID NO: 32492 - RNA, 64 nt, Human
aaagguguuugcacuucauguuacuuuuugaguuuauaaacauaaaaacagaauuuacuucugu

SEQ ID NO: 32493 - RNA, 64 nt, Human
auaaaauuguuaaucugucugauuuugucugaauuauaaacacuuugagguaccaaacauaacc

SEQ ID NO: 32494 - RNA, 64 nt, Human
ugaagaauuacaaaucagaagaaaaagcaagcauuauaaacaaaacuaauaacuguuuuacugc

SEQ ID NO: 32495 - RNA, 64 nt, Human
uuuauagcuccuguuauaauagcaaguuuaaugguauaaacacaggauaccauccucucuugca

SEQ ID NO: 32496 - RNA, 64 nt, Human
aagcaguaaucuuuaacuguagcauuccucuaauuauaaacagugaaaaaucaaaaucagucca

SEQ ID NO: 32497 - RNA, 63 nt, Human
agaguguucuuuauucaauaaaguuuuaauuuaguauaaacauagcuucuauauuccguguga

SEQ ID NO: 32498 - RNA, 64 nt, Human
ugaauuaaaguuuugucccccccccccuuuuuuuuauaaacaagugaauacauuuuauaauuuc

SEQ ID NO: 32499 - RNA, 64 nt, Human
cugcugcuuuuaaaaaauggucacuuucauaaacuauaaacaucuauaucauaacucugaccuu

SEQ ID NO: 32500 - RNA, 64 nt, Human
uguauauaaaagaaugaaauugaaaaauaaaauauauaaacauaaauaaauuagguaguguauu

SEQ ID NO: 32501 - RNA, 64 nt, Human
ccaaaauacaugaguauuaugggauugcuaccuguauaaacaauggcacugugaaaauacuguu

SEQ ID NO: 32502 - RNA, 64 nt, Human
cccccaaugaggacaccuuuuauauauaaauauguauaaacauagaauacaguuguuuccaaaa

SEQ ID NO: 32503 - RNA, 64 nt, Human
uugaaauaguuauaugugugucauuggacuggauuauaaacagcugucuuggacuuucccucuc

SEQ ID NO: 32504 - RNA, 64 nt, Human
guaucaaacuucagguugaaacuguuugaagcauuauaaacauucauuucacaacuagauugua

SEQ ID NO: 32505 - RNA, 64 nt, Human
cauuuuucuuuauaauaaaauauuugagccacuguauaaacaugagggugcacaugucaaguac

SEQ ID NO: 32506 - RNA, 64 nt, Human
uugaauaguaauuucuugagaaccucagguguucuauaaacaguccuuuccuguaugucuucua

SEQ ID NO: 32507 - RNA, 64 nt, Human
ggccagaauugacucuuugggccuaaauagcagcuauaaacaucuucaguaacuugccaggcuc

SEQ ID NO: 32508 - RNA, 64 nt, Human
aauuuaauaaacucgaaguuuagguuuaugaguauauaaacaaaugaggcacuucaucugaaga

SEQ ID NO: 32509 - RNA, 64 nt, Human
auggugcaaaaaugaguuuucaccugguauccauuauaaacaaucaggaagagguaauuuuuca

SEQ ID NO: 32510 - RNA, 64 nt, Human
uuauugaggaaagaaaacaagggcuggagcaguuuauaaacaaggucgcuggucauccucuggc

SEQ ID NO: 32511 - RNA, 64 nt, Human
ggauacugcaaagaacaugguuuauuuuaaaauuuauaaacaagucacuuaaaugccaguuguc

SEQ ID NO: 32512 - RNA, 64 nt, Human
uuuuuguaaccuacguucacuuaugaucuggauuuauaaacauuacuugguauaacguuuuuca

SEQ ID NO: 32513 - RNA, 64 nt, Human
agggcuugacuauuaaauguuugccuuugauguuuauaaacauuacaacuauguuguuuuaaga

SEQ ID NO: 32514 - RNA, 64 nt, Human
ccccccacccccgggucaugaaaaucacagaacuuauaaacacauugaacccuagaucucaggc

SEQ ID NO: 32515 - RNA, 64 nt, Human
cucuacaaugacacacaaaucccauuaaauaaauuauaaacaagggucaauucaaauuugaagu

SEQ ID NO: 32516 - RNA, 64 nt, Human
ucucugaauuauuaaaguucuuuaugaccucauuuauaaacacuaaauucugucaccuccuguc

SEQ ID NO: 32517 - RNA, 64 nt, Human
cagacuuaagaauuuuauggcauggcccaauugauauaaacauuuagaaggaaaugaaaagcua

SEQ ID NO: 32518 - RNA, 64 nt, Human
uaugcuaggaaaaguuauaaaaugccaaaauauuuauaaacauuuacuuuguccauaaaaaauu

SEQ ID NO: 32519 - RNA, 64 nt, Human
gaucaagaauucuaccaucccuugggucuuuguguauaaacaauguuaaauaaagguagacuca

SEQ ID NO: 32520 - RNA, 64 nt, Human
auuagacaguuuuuuuaguccaugggauuguaaauauaaacauuaacuuuccuauaagaauauu

SEQ ID NO: 32521 - RNA, 64 nt, Human
aacucauuuaagcuguuuuuauuuuaauaugcccuauaaacauuuuuauauuuuuugaaauugg

SEQ ID NO: 32522 - RNA, 64 nt, Human
cccucuacaucaucuuaccuagcccacccaaccuuauaaacaugauaauugacuacuuuccuga

SEQ ID NO: 32523 - RNA, 64 nt, Human
cuuuggauuuaguguuucaucagcuguuuuuaguuauaaacauuuuguuaaaauagauauuggu

SEQ ID NO: 32524 - RNA, 64 nt, Human
gaguuauaauaaaacaguguuuuaaaaucuagccuauaaacaaaaacuaguuugaggcacccaa

SEQ ID NO: 32525 - RNA, 64 nt, Human
gcauguucugugaaucugccauuccuaaaaauuuuauaaacacuugauacuuuucacugauaau

SEQ ID NO: 32526 - RNA, 64 nt, Human
ucaauauauuucccaccaaguaccuauauauguauauaaacaaacacauuaucuauauauaacg

SEQ ID NO: 32527 - RNA, 64 nt, Human
auugaagcugauuuuucugcaaaagaugaauuucuauaaacaaucccauuuuuauauuuuauua

SEQ ID NO: 32528 - RNA, 50 nt, Human
cagagcaugcgcacuuaugauauaaacagaggaccagcuccauucucagg

SEQ ID NO: 32529 - RNA, 64 nt, Human
uaauuccucauuguucuuaaaagacuguugauacuauaaacaucagugaaucauuauauuuuaa

SEQ ID NO: 32530 - RNA, 64 nt, Human
aaccuuuucaccuccaacuggauguugacguauauauaaacagaacucccuucaaaagccaaaa

SEQ ID NO: 32531 - RNA, 64 nt, Human
cagauauuguaccauguaccuaauccaaauaucauauaaacauuuuauuuauaguuaauaaucu

SEQ ID NO: 32532 - RNA, 64 nt, Human
uagguuuuaggguuuuguaaaucuucauaguaauuauaaacauuuguaaaauuuguaaaauacu

SEQ ID NO: 32533 - RNA, 64 nt, Human
auaacacuguuauuuaaaacaguuuucugcagucuauaaacauuucucaacauuuuuuuaaaag

SEQ ID NO: 32534 - RNA, 64 nt, Human
uaauaaaugaugaaauucaguccaacaugcuuauuauaaacauagcaauucuugcucuaucaaa

SEQ ID NO: 32535 - RNA, 64 nt, Human
gggacccuggaguauuuggaagcaacguguuaauuauaaacagcaggguuugagcacaaucugu

SEQ ID NO: 32536 - RNA, 64 nt, Human
caugcugacugaaauaauaagacaucuacaaauuuauaaacaaaaagugauugucauuauccug

SEQ ID NO: 32537 - RNA, 64 nt, Human
uguaccugcuuaguuaauuggcucagaauuuuaauauaaacaucacacuuuaauuuggagcaua

SEQ ID NO: 32538 - RNA, 64 nt, Human
uauaauuaugaagcgauugcuugagaaaauaacauauaaacauagaauagaauagacugaccaa

SEQ ID NO: 32539 - RNA, 64 nt, Human
cauacuacuagggaguaacuguagagugagaaauuauaaacauuauuuagggauuaccauggug

SEQ ID NO: 32540 - RNA, 64 nt, Human
cucccuucuagcagauucuuauuuuguuugaauuuauaaacaaggcugguggcugucuacccac

SEQ ID NO: 32541 - RNA, 64 nt, Human
ggaaacuaaaaagaaucaaauugaauuaaagcuauauaaacacaguuaacccuuguaaaugagu

SEQ ID NO: 32542 - RNA, 64 nt, Human
gagaaccccuaguguccugccacaaccugccuuguauaaacauguacauuuuuucauaacauuu

SEQ ID NO: 32543 - RNA, 64 nt, Human
aaaucagaaaaagccccugccuagcucacauuucuauaaacagaggcccccaugaugaggaggu

SEQ ID NO: 32544 - RNA, 64 nt, Human
auauacaguuuacaauacauguauaacuuguagcuauaaacauuuugugccauuaaagcucuca

SEQ ID NO: 32545 - RNA, 64 nt, Human
ucccauggauuuuuuuuuccuuuggccuggguuuuauaaacaacuugaacaucauaucauauag

SEQ ID NO: 32546 - RNA, 64 nt, Human
caaaaggcccuauuacuuuuaaccacuggcuucauauaaacacuugccauuuuuuucugcauag

SEQ ID NO: 32547 - RNA, 64 nt, Human
gauauuuauuagauagcccugaauucacucuaauuauaaacagggaguguaaacugcccccaga

SEQ ID NO: 32548 - RNA, 64 nt, Human
aacacugggaugagacuagaacuucacuuuaugauauaaacacaauacgauuauucaauguggu

SEQ ID NO: 32549 - RNA, 64 nt, Human
gcugcuguaaugaaauacuaugaacuuggcagcuuauaaacaacagaaauuuauuucucgcugu

SEQ ID NO: 32550 - RNA, 64 nt, Human
gugagagacuuuauuaaaaauacauauauaucuauauaaacauauaugauaguggcucuaguuu

SEQ ID NO: 32551 - RNA, 64 nt, Human
cuguaaauguguacuaaaaaaaucagaguuuauuuauaaacaaaauaguuuauuuaaagagaag

SEQ ID NO: 32552 - RNA, 64 nt, Human
uauuauucacuacuucuuuucuuaguuugaaaauuauaaacaaauuuuaagcuuuauucaaaga

SEQ ID NO: 32553 - RNA, 64 nt, Human
uaaauucauauauguauauuuuggaaucaguucuuauaaacagcucgauucaguuuuagcuaaa

SEQ ID NO: 32554 - RNA, 64 nt, Human
gcugccauaacaaaauaccaucaacugggaggcuuauaaacaacagaaauuuauguuuuacagu

SEQ ID NO: 32555 - RNA, 64 nt, Human
cacaguggauggacggacaagacaggcagagaucuauaaacagacaggcucuaugcuauggccu

SEQ ID NO: 32556 - RNA, 64 nt, Human
cacucacacgccccgacugcacccgguguccaucuauaaacaugucagggcacgugugcauaca

SEQ ID NO: 32557 - RNA, 64 nt, Human
caagaugcacucgcugugauuuuaagacaagcuguauaaacagaacuccacugcaagagggggg

SEQ ID NO: 32558 - RNA, 64 nt, Human
ucuuaagucacugucccuugucucucuuugaaguuauaaacaacaaacuuaaagcuuagcuuau

SEQ ID NO: 32559 - RNA, 64 nt, Human
uguaugaaacugagauguugucuauagcuaugucuauaaacaaccugaagacuugugaaaucaa

SEQ ID NO: 32560 - RNA, 64 nt, Human
cacaugaacuucaugugggcuuaauuuucugugcuauaaacaaaaguguuuauuuuuuauuaac

SEQ ID NO: 32561 - RNA, 64 nt, Human
gaaaauuuguucagguauaaaugagcaguuaagauauaaacaauuuaugcaugcugugacuuag

SEQ ID NO: 32562 - RNA, 64 nt, Human
gguucucaaagcaagguuuccaucuuaagauuuuuauaaacacaaagccuuugcaaaauuggau

SEQ ID NO: 32563 - RNA, 64 nt, Human
gcaaacgcuucaguuguuagcauuuucaaugugauauaaacagcuucuccaauacagcaaaccu

SEQ ID NO: 32564 - RNA, 64 nt, Human
aaucuguguauugugauuuuuacauacuaaugaauauaaacaggugauuuuaaaauauuacugu

SEQ ID NO: 32565 - RNA, 64 nt, Human
ccugugcucuaaacagugggaguaccaaagaaauuauaaacaagauaaaugcuguggcuccuuc

SEQ ID NO: 32566 - RNA, 64 nt, Human
agccaauuaacacaaccaaauacaacugggccaauauaaacauguuugaauugucaaauauaaa

SEQ ID NO: 32567 - RNA, 64 nt, Human
cacucuguaauauaaugauuaaauugcucccuuuuauaaacauugcuaauguggucugaguuuu

SEQ ID NO: 32568 - RNA, 64 nt, Human
uuuuuucuuugaaaaacaagcuccuuuuacagaauauaaacaacaguagugccugugguuuagc

SEQ ID NO: 32569 - RNA, 64 nt, Human
cagagguguucacaguguagacagggaaaaaauguauaaacaaauguguaaaaagagaaaucag

SEQ ID NO: 32570 - RNA, 64 nt, Human
aaaccuaaaggaagugguucuguugcaaauggacuauaaacagggacauuauauucuuacacua

SEQ ID NO: 32571 - RNA, 64 nt, Human
aaacuagugauacucagugacauagacuuugucuuauaaacauuuuuucauuuuuuauuuugaa

SEQ ID NO: 32572 - RNA, 64 nt, Human
gaaacucccauguauggaaucccacuguaugauuuauaaacagacaauaugugagugccuuuug

SEQ ID NO: 32573 - RNA, 64 nt, Human
gaugcugcguggaggaacaugcaauuuuauucaauauaaacauuugcuauuuucugcuuagaaa

SEQ ID NO: 32574 - RNA, 64 nt, Human
uaugagauaauuuguugcauaguguccuuauuuguauaaacauuuguaugcacguuauauugua

SEQ ID NO: 32575 - RNA, 64 nt, Human
ugauauuuguacacaaauuuucuuuucucaguuuuauaaacacagaauauaacaauucacuuua

SEQ ID NO: 32576 - RNA, 64 nt, Human
uaaaugaaaauaaauugcuaguuuauauuuuagauauaaacaucauauuuuuuauuaauaccua

SEQ ID NO: 32577 - RNA, 64 nt, Human
ucgcaugaaguguuuguuuuuacaguuuagcauauauaaacaaacaugauaggauuccuuaaga

SEQ ID NO: 32578 - RNA, 64 nt, Human
gaauucucaucuucgaaccuagagaaauaggugcuauaaacagggaauuaagcaaaaugcugga

SEQ ID NO: 32579 - RNA, 64 nt, Human
uuauuucauuuugacucuuggaauucugugcuguuauaaacaaacccaauaugaugcauuuuaa

SEQ ID NO: 32580 - RNA, 64 nt, Human
ugagcauaguggggaaagaaaaggaaauggcuuuuauaaacaucuuuuacuuuguuuugauuca

SEQ ID NO: 32581 - RNA, 64 nt, Human
auuuaaccuuuucuugaugagucauggucaugauuauaaacaucagccccuuuuauaccuuggu

SEQ ID NO: 32582 - RNA, 64 nt, Human
uugcauuucaaaggagaggaucagacuaucugaauauaaacacaaucugauguuaauuuauucu

SEQ ID NO: 32583 - RNA, 64 nt, Human
agcuuauuuccuuucagucuuuuuucaauauuuuuauaaacauugaguacuuacugaauuuagu

SEQ ID NO: 32584 - RNA, 64 nt, Human
accuuguagcuagcaauaaggugacuuacaguuguauaaacaggaagccaggcuuuugaacugu

SEQ ID NO: 32585 - RNA, 64 nt, Human
ccgucacuauuauuuugccuuuucuggacugucauauaaacagaaucuuauaguacguucccuc

SEQ ID NO: 32586 - RNA, 64 nt, Human
uaaacuauuuuuuauagcugaaguucuucacuacuauaaacaugucuucuguacuauaaaaucc

SEQ ID NO: 32587 - RNA, 64 nt, Human
caccugcagcuuuaauauuuaugaucagggauuuuauaaacaugcgggccugguuucacaucgg

SEQ ID NO: 32588 - RNA, 64 nt, Human
cguaggaugaaaagauucuucuguguuuauaaaauauaaacaaagauucaugauuuauaaaugc

SEQ ID NO: 32589 - RNA, 64 nt, Human
guggggucagcacuguacuccguugcuguuuuuuuauaaacacacucuuggaaguggcugggga

SEQ ID NO: 32590 - RNA, 64 nt, Human
caaaauguaaagcacuuuaauuuauagcuaugguuauaaacagguuuuagauguuucaaaugac

SEQ ID NO: 32591 - RNA, 64 nt, Human
uaugugugcauguuuagcagauauuuguauaaaauauaaacacucuguugucauauaggcuaua

SEQ ID NO: 32592 - RNA, 64 nt, Human
uauuuuaaauuuuuaauacaauauuuuauuuuaauauaaacaucugucaguuauagacaaagau

SEQ ID NO: 32593 - RNA, 64 nt, Human
ccauuucacuggcuucccaaaugugugcccagcuuauaaacagaagugacugauguucccuccg

SEQ ID NO: 32594 - RNA, 64 nt, Human
uuuccccccuuuagaaauguuggauauuaagugauauaaacacuucuuuuaacuccgaaaaucu

SEQ ID NO: 32595 - RNA, 64 nt, Human
cauuccagguuaaacuggguugucuguacuaaauuauaaacagaguuaacuugaaccuuuuaua

SEQ ID NO: 32596 - RNA, 64 nt, Human
auuccacaggucaucagaugccugcuugauaauauauaaacaauaaaaacaacuuucacuucuu

SEQ ID NO: 32597 - RNA, 64 nt, Human
aaaacuaacaggauaauugggcaaauaaauuacauauaaacacacacaaucuauauauguauau

SEQ ID NO: 32598 - RNA, 64 nt, Human
ggcaaaaaugaaucuauuguuuugcaauauagguuauaaacaggcaaaaugcaauaaaauauau

SEQ ID NO: 32599 - RNA, 64 nt, Human
cuauggccauuagguaccuagcagaugugcacaauauaaacaaaaagauaucuggccuaccuua

SEQ ID NO: 32600 - RNA, 64 nt, Human
uuauauauuauuuguauuuugacauuguaccuuguauaaacaaaauaaaacaucuauuuucaau

SEQ ID NO: 32601 - RNA, 64 nt, Human
uagaucuauuucccuuaucacuucaauuaaagacuauaaacaacaaaaaucucauugugucuac

SEQ ID NO: 32602 - RNA, 64 nt, Human
ccaacagcccuguaagccagcuuucuucuauauuuauaaacacgauaaaugcaugagaagaucu

SEQ ID NO: 32603 - RNA, 64 nt, Human
uauauauguggaauauucuuuuuaaaaacaauuuuauaaacaaaucaaggagcacuagagcuuu

SEQ ID NO: 32604 - RNA, 64 nt, Human
aagguucuuuguggauuuauauagaguugagcuauauaaacauuaacuuuagauuugggauuua

SEQ ID NO: 32605 - RNA, 64 nt, Human
auaguuuguggauucuaaaauauauauauauuuauauaaacaccauauaagucaaauauguauu

SEQ ID NO: 32606 - RNA, 64 nt, Human
ugaccuccaugacugcacaguaauuucgucuguuuauaaacauuguauaguuggaaucauauug

SEQ ID NO: 32607 - RNA, 64 nt, Human
auguugccuuucuucgaaggcgccugaagcacuuuauaaacacaaauccucacaauaccucugu

SEQ ID NO: 32608 - RNA, 64 nt, Human
ucgccuuauuuuucuuggacccaaacugucaggguauaaacacuauuuguuucuuuuuuaaaac

SEQ ID NO: 32609 - RNA, 64 nt, Human
auguuauuuuuaagaaaauggaaaauaaaaacuuuauaaacaccaucugcuggcaauacucuga

SEQ ID NO: 32610 - RNA, 64 nt, Human
gaagccuggagcuggagaacgaaagaaucuucacuauaaacagagacccauucauuuauuucca

SEQ ID NO: 32611 - RNA, 64 nt, Human
gacuaaaaugaugucaacagucuauauucaggcuuauaaacauuucuugguuuccaacagaagu

SEQ ID NO: 32612 - RNA, 64 nt, Human
ucuagcauucacccuugggcugcagauaguaauauauaaacacacacaaugauugcaagacuau

SEQ ID NO: 32613 - RNA, 64 nt, Human
aaaaacaaaaacaaaaacaaaacaaaacauaaaauauaaacaaucaaaauccaaacaaacaaac

SEQ ID NO: 32614 - RNA, 64 nt, Human
uggccagaaaacugguguugaaggcuuuugcucauauaaacaagugccauugaguuucaaauga

SEQ ID NO: 32615 - RNA, 64 nt, Human
uguagaaauauuuagcuucaggaauacugcucguuauaaacacuacuaaaaaaacaguuuauau

SEQ ID NO: 32616 - RNA, 64 nt, Human
cauggugcaaaaacucuuauggccaaauucaaacuauaaacaugaugucaacuuccuuguaaaa

SEQ ID NO: 32617 - RNA, 64 nt, Human
uaaaauuuuacauuuucucaguucauaauuaguuuauaaacaccuagaauaauacuggcauuaa

SEQ ID NO: 32618 - RNA, 64 nt, Human
cuuggggagggccuguguacccccauucucugauuauaaacagauaaacccaaauguggaucau

SEQ ID NO: 32619 - RNA, 64 nt, Human
auaucuauaaaaauuauaaaaggauuuuugaaaguauaaacaaauugucagugaaauaaaugag

SEQ ID NO: 32620 - RNA, 64 nt, Human
ucaccacaaaugguaagggaugcccaccuacuuuuauaaacaccacugcaacuuaacaaguuua

SEQ ID NO: 32621 - RNA, 64 nt, Human
agcucugccugagguaaaguaaacuucagccucuuauaaacaagagugauagagagcugcaggc

SEQ ID NO: 32622 - RNA, 64 nt, Human
uagggguuaggauuuaacaugaauuuuggggacauauaaacauuaagucuguaguagcagcagc

SEQ ID NO: 32623 - RNA, 64 nt, Human
guauaagcaugcuuucuuugaguuuuaaauuauguauaaacauaaguugcauuuagaaaucaag

SEQ ID NO: 32624 - RNA, 64 nt, Human
uauacgcuaaaagauuaaguaaaaugcccaaggguauaaacaaaagcaacaugaaaguggaagc

SEQ ID NO: 32625 - RNA, 64 nt, Human
auaauugcaguuucacaagguuuacuuuuuaaaguauaaacaaauuauguauuuacuuacuaau

SEQ ID NO: 32626 - RNA, 64 nt, Human
gucaaaauccugcaugugcuauucaggacacacuuauaaacacaaaugcacugugagauaugug

SEQ ID NO: 32627 - RNA, 64 nt, Human
uaaacuccccagcguauccuaugguaacugaugauauaaacaagcuuucuuuaaaaaggaaaaa

SEQ ID NO: 32628 - RNA, 64 nt, Human
uguauguauguguauauauauauauauauauauauauaaacaaguuuguugacaccuacuaugu

SEQ ID NO: 32629 - RNA, 64 nt, Human
gcauaaggauuuuuucccaggaaaagauagacuuuauaaacagugggagcccaugaacaaacau

SEQ ID NO: 32630 - RNA, 64 nt, Human
auacuaacugggucuuucagauagcaaagcaaucuauaaacacuggaaacgcuggguucagaaa

SEQ ID NO: 32631 - RNA, 64 nt, Human
auaguuuaaaacaauauucucuuuuugaaaauaguauaaacaggccaugcauauaauguacagu

SEQ ID NO: 32632 - RNA, 64 nt, Human
aauuuagaacuagauuuugguuagaaguaaggauuauaaacaaccuagacaguacccuuggccu

SEQ ID NO: 32633 - RNA, 64 nt, Human
ccaaccuuagaaaagacaauaaaugcacaaaagauauaaacaggaacagcaaauauuuauauuu

SEQ ID NO: 32634 - RNA, 64 nt, Human
cacaguuugcuauuugcuuuagagacagggacuguauaaacaagccuaacauuggugcaaagau

SEQ ID NO: 32635 - RNA, 64 nt, Human
agaguguaaauuuuuucaagugcucauuagguuuuauaaacaagaagcuacauuuuugcccuua

SEQ ID NO: 32636 - RNA, 64 nt, Human
cauaugcacaggggaaggaaauaacauugcacuuuauaaacacuguauuguaaguggaaaaugc

SEQ ID NO: 32637 - RNA, 64 nt, Human
uagcuguaauguuucacagagugugcugcuauuuuauaaacauuuuuauaauauauuauuuuac

SEQ ID NO: 32638 - RNA, 61 nt, Human
gaaaagcucuaagacacuaauauauguaucuuauaaacaaacaauucaacucagaaguuua

SEQ ID NO: 32639 - RNA, 64 nt, Human
uuuggguaagguguaugcuuuuaacuuugaaauguauaaacacccagcggaaacguauaccuuu

SEQ ID NO: 32640 - RNA, 64 nt, Human
auucccaauaaaccccacguuguggcaggugcuuuauaaacacucuuauuuaaucuccacaccu

SEQ ID NO: 32641 - RNA, 64 nt, Human
uaauuagacuaauuauuuuauccccaucccaggguauaaacaggaauuguuuugauaguggugg

SEQ ID NO: 32642 - RNA, 64 nt, Human
ucaaaugagauucagcaauucacaagugcauuaauauaaacagaacugguggcacuuaaaauga

SEQ ID NO: 32643 - RNA, 64 nt, Human
uuauugagaaacuuaugaugguggcauugccuuuuauaaacauggagugaaagccauuugacuc

SEQ ID NO: 32644 - RNA, 64 nt, Human
gagccucaguuuccucaucugucaaauggggguuuauaaacaccuaccucgcaggguuguugug

SEQ ID NO: 32645 - RNA, 64 nt, Human
auucuacaugcacaaaaucauacauguuaauaaauauaaacaaauuggaggcuuauuuaaacca

SEQ ID NO: 32646 - RNA, 64 nt, Human
auaccauaauguauauuuauguagaaucaaauuauauaaacaguaccaauaucauuauagaaaa

SEQ ID NO: 32647 - RNA, 64 nt, Human
uuggauauuuugacuauuuacaucuuuucacaguuauaaacagcacuucacugaaucccaugua

SEQ ID NO: 32648 - RNA, 64 nt, Human
aaagaacuuggcaagagaauuugcuuaauguaaauauaaacagucacaauuaguauagacccau

SEQ ID NO: 32649 - RNA, 64 nt, Human
uuuauaaacuaaaugaagauaagauauuauuuuguauaaacauucaucugagaacaaucaaagc

SEQ ID NO: 32650 - RNA, 64 nt, Human
cccucacaccaccagccccagggagcuucccugcuauaaacacagacccccuugucuuugccuc

SEQ ID NO: 32651 - RNA, 64 nt, Human
agcaaaucuacuuuaaacuggauggguuaauuuauauaaacauuuucauuuuaaguuggcauuu

SEQ ID NO: 32652 - RNA, 64 nt, Human
uuuuugauuaaaaagaauuuuuuuuuuccuuuuuuauaaacagacccuaauaaagagaacaggg

SEQ ID NO: 32653 - RNA, 64 nt, Human
ggaauguuuaauaaaggcuuugauuuaaucuugauauaaacagauuuuuaaaaaucuccaccca

SEQ ID NO: 32654 - RNA, 64 nt, Human
gggcacgguuuuuauacauacguacauauauauauauaaacacacacauagauauauaugaaua

SEQ ID NO: 32655 - RNA, 64 nt, Human
cuucccugaugcgauuuuaccuuuguugaauuuguauaaacaauuguacaaaaaaaaccacucu

SEQ ID NO: 32656 - RNA, 64 nt, Human
uaucugucuccaauuuauaucaagaauaaggaaauauaaacagaggaagcagcuuguuucuaaa

SEQ ID NO: 32657 - RNA, 64 nt, Human
ucaaaugagagcuacucuguuacauuucuuaacauauaaacaucguuuuuuacuucuucuggua

SEQ ID NO: 32658 - RNA, 64 nt, Human
gccugagcuuagaagguuauagaaaaaggguauuuauaaacauaaaugaccuuuuacuugcauu

SEQ ID NO: 32659 - RNA, 64 nt, Human
gugguauucuaaucccguagcauagcaccuuuuguauaaacaaugugauauugcuucugcacau

SEQ ID NO: 32660 - RNA, 64 nt, Human
uuuuuagcagagacagggaggaaguuuuuauuuuuauaaacaaaaucugauguucagaggcccc

SEQ ID NO: 32661 - RNA, 64 nt, Human
auuucuuagcagaaacauuaguauuuuagguuucuauaaacacuauaagugauaguuuccccca

SEQ ID NO: 32662 - RNA, 64 nt, Human
aaauuuugucagcuaguuuacuauguuccuugaauauaaacagguuauaauacuacccuguuca

SEQ ID NO: 32663 - RNA, 64 nt, Human
guaaacauuucuguauaaaguuaccugacacacauauaaacacaaggaacauuccauaucauua

SEQ ID NO: 32664 - RNA, 64 nt, Human
gaggaaauaaguacagauacugacaggaagcuuuuauaaacaauuuauuggaguguuuuuguuu

SEQ ID NO: 32665 - RNA, 64 nt, Human
ucauucauaaacagguguauaaggaacaaugucuuauaaacagcaugggggcaaucugagaaua

SEQ ID NO: 32666 - RNA, 64 nt, Human
cuuucuguuacaccucuauuauauuaguuuugaauauaaacaucuuuuucagaccaaaaaaaac

SEQ ID NO: 32667 - RNA, 64 nt, Human
auuacugcugggggugcaugcuacaauacuucuauauaaacacuuguagaaguacacuguucac

SEQ ID NO: 32668 - RNA, 64 nt, Human
caaaacgaaaaccuuuaagagaauguagaguuuauauaaacacaaaguaugcauugaagaucug

SEQ ID NO: 32669 - RNA, 64 nt, Human
cucuccauucagcauguguguggguguggauguuuauaaacaagacuaagucugacuucauaag

SEQ ID NO: 32670 - RNA, 64 nt, Human
uuuccaaaagguuaaaacuuguaaaaaaaauauauauaaacaauugaguuuacuaaugguaaac

SEQ ID NO: 32671 - RNA, 64 nt, Human
aaagcccuuugauugcuguaugaauuccacacuauauaaacaauaagcugauauuuuaaauaga

SEQ ID NO: 32672 - RNA, 64 nt, Human
caccaaauacaugauaaauguaucaaucacuauuuauaaacagagcuuucaaacacuccucaga

SEQ ID NO: 32673 - RNA, 64 nt, Human
uuuuuucugcuguaauuguucuggguagauggaguauaaacauuugaauggaaaaaaauuaacc

SEQ ID NO: 32674 - RNA, 64 nt, Human
uuauuuuauaugagagcuauagcaaaauaaucuguauaaacaaggaauguguuagcuuaaacug

SEQ ID NO: 32675 - RNA, 64 nt, Human
cuucuuauucaaacuguuggucauauguacaguauauaaacauaaaacacacaaggaagguauu

SEQ ID NO: 32676 - RNA, 64 nt, Human
ggccaugauauuacugugcacuacuguagacuuuuauaaacacuauauacuuaggcuacauaaa

SEQ ID NO: 32677 - RNA, 64 nt, Human
uaguuuaaaaacuuguacuggauggaacccauuuuauaaacagucuuauuuggagucauguaua

SEQ ID NO: 32678 - RNA, 64 nt, Human
uuagacucaugugauccaagcuguauauaccauauauaaacauuuuacaugaaucauuuaguuu

SEQ ID NO: 32679 - RNA, 64 nt, Human
gacagcauauaaauguaauaaguaucacacuguauauaaacauaucaauguuuguccuguauaa

SEQ ID NO: 32680 - RNA, 64 nt, Human
ucuuaccugauaaguuccaucguaucaaacuuucuauaaacaaaauacaguauaaucagaaagu

SEQ ID NO: 32681 - RNA, 64 nt, Human
auggagauguauacagucuuuacuauauuagguuuauaaacaguuuuaagaauuucauccuuuu

SEQ ID NO: 32682 - RNA, 64 nt, Human
aaaaguuaaguugguaaaguauuuacugacugcuuauaaacauuuaaagacaaagacauuucaa

SEQ ID NO: 32683 - RNA, 64 nt, Human
guauaacuauuucaauuugauuaauccacuauuauauaaacaauagugggaguuuuauauaugu

SEQ ID NO: 32684 - RNA, 64 nt, Human
uugauacuccuguugauguuaaauuacuauauaauauaaacaguauguguuuuuauauaucauu

SEQ ID NO: 32685 - RNA, 64 nt, Human
caggccacucaugucagugaccagauuuguggcuuauaaacauuagcaguuuauuuauguuuua

SEQ ID NO: 32686 - RNA, 64 nt, Human
ucauagguaaaaaaaaaaaucucucuugggagcauauaaacaaaaaacauagaagcaauaaagc

SEQ ID NO: 32687 - RNA, 64 nt, Human
gacacauaacugugguacaguguauuggaaauuuuauaaacaaaagugaaagugccaacaaauu

SEQ ID NO: 32688 - RNA, 64 nt, Human
gaguuuuacuuucgguuguauuuucuuuguauauuauaaacauuuauuuaacuuguugccguuu

SEQ ID NO: 32689 - RNA, 64 nt, Human
aauauaaaauaccauuguuaaagaaugguacuuuuauaaacauuaguguauuuauuuccuaugu

SEQ ID NO: 32690 - RNA, 64 nt, Human
aauacugcuguuauauagcaagacauaaacagauuauaaacaucagagccauuugcuucucagu

SEQ ID NO: 32691 - RNA, 64 nt, Human
ugcacugcuaagagugguuuguguaaaacuauuuuauaaacaaacuacagagccuaaaugugca

SEQ ID NO: 32692 - RNA, 64 nt, Human
gguuggcuugaguaccuuuuuaaaucuagcccaguauaaacauuagccugcuuaauauuuagac

SEQ ID NO: 32693 - RNA, 64 nt, Human
cucauuuucuuuuuuagcaaaaaauacuugacuauauaaacaagacuagaaauuuauccuaaac

SEQ ID NO: 32694 - RNA, 64 nt, Human
gggagccauucugccaauuuaaaugcgacugugguauaaacaguaaaaugauuuaaaaguaagu

SEQ ID NO: 32695 - RNA, 64 nt, Human
gaugaauucaggcacuggggguggggggguuauuuauaaacacaaggugguugguuuaagccaa

SEQ ID NO: 32696 - RNA, 64 nt, Human
auaagagaaaguguggauauaaaugaccauuguuuauaaacaguuaugaaaaaugcugugacuu

SEQ ID NO: 32697 - RNA, 64 nt, Human
gacagucacucuuuuuuuucuuaaaugauauacauauaaacaguuauuuuuauccuauuauaau

SEQ ID NO: 32698 - RNA, 64 nt, Human
aaugaugauaauccuaauuauauaaaaauauauauauaaacacacauauauauagugauuucua

SEQ ID NO: 32699 - RNA, 64 nt, Human
uuuuucagcuauuuucuuaaaaguauauuuuuucuauaaacauccuuugcugcuacauuagaac

SEQ ID NO: 32700 - RNA, 64 nt, Human
uucagccuccaaugaauaagacaucuuccaagcauauaaacaauugcuuugguuuccuuuugaa

SEQ ID NO: 32701 - RNA, 64 nt, Human
gggaaaacagcuauuauaucagcuuuucugaugguauaaacaggagacaggucaguagucacaa

SEQ ID NO: 32702 - RNA, 64 nt, Human
aauauguucugucaacacaaaccugccuuugguguauaaacagggcauuacagaaugguacacc

SEQ ID NO: 32703 - RNA, 64 nt, Human
agcaacauuucuucaauuagcagucuagacauuuuauaaacagaaaucuuggaccaauugauaa

SEQ ID NO: 32704 - RNA, 64 nt, Human
ugguuauuagacaauuccauuucuuucugguuauuauaaacagaaaaucuuuccucuucucauu

SEQ ID NO: 32705 - RNA, 64 nt, Human
uuugucuuuaguguaacaagaucacuggauuaaauauaaacauucagguuaauuaucuagauuu

SEQ ID NO: 32706 - RNA, 64 nt, Human
gcaguguacauuuccacaaaucuaagaauugcccuauaaacauagcaggauuuugagagcuuga

SEQ ID NO: 32707 - RNA, 64 nt, Human
uccuccuuucauuucccacuacgcacaaagaguuuauaaacacuguucucagaagagucacagu

SEQ ID NO: 32708 - RNA, 64 nt, Human
cuucuccagcccuggucugaauuucuuaagguuuuauaaacaaaugcugcuauuuauuagcugc

SEQ ID NO: 32709 - RNA, 64 nt, Human
cacuggagugagggaguagauaaaacagcugcaauauaaacaguccucuggaauaaugguuugu

SEQ ID NO: 32710 - RNA, 64 nt, Human
ugcaacaaaguuaggaaguuuguuguuuguuuauuauaaacaaaaagcaugugaaagugcacuu

SEQ ID NO: 32711 - RNA, 64 nt, Human
uuaauguuguguuauuuugcuccagauuuucaucuauaaacaaaggagcauuuguuuugauuuu

SEQ ID NO: 32712 - RNA, 64 nt, Human
cauaagucuuaauguuauuguuaugauuauacuuuauaaacaaccuuuuccagaugcuacaggg

SEQ ID NO: 32713 - RNA, 64 nt, Human
acuacauagauguuauaagaacauaaaccaacauuauaaacaauggccacauuuaguuacucua

SEQ ID NO: 32714 - RNA, 64 nt, Human
uugacucguugaaauuguuuuccauaaagaacaguauaaacauauuauucacauguaaucacca

SEQ ID NO: 32715 - RNA, 64 nt, Human
auaacugucuuaguacaccauaaacuggguggauuauaaacaacagaaacuucucaguuuugga

SEQ ID NO: 32716 - RNA, 64 nt, Human
uauuuuauucuauauuauuacaaaaacggaaauguauaaacaugucaaaaagaacuguugaugc

SEQ ID NO: 32717 - RNA, 64 nt, Human
aaauggaauuuuguguaaauucacaaaaaugugauauaaacaggaucuaagacuggauucccug

SEQ ID NO: 32718 - RNA, 64 nt, Human
guccugucccccacacccgugucaugugucuguuuauaaacauguccccuucccuuuccuuccc

SEQ ID NO: 32719 - RNA, 64 nt, Human
aacaaguccaguaauuuuuuauaaaucuucagauuauaaacagccccuaaaaacuuuacaacgu

SEQ ID NO: 32720 - RNA, 64 nt, Human
cacaccauuagggguaugcaagaugucccuguuuuauaaacauaaucacaacaguaauaaaccu

SEQ ID NO: 32721 - RNA, 64 nt, Human
auuagggagaaaauucaauuguaaauugaaucaguauaaacaaaguuacuagguaacuucauau

SEQ ID NO: 32722 - RNA, 64 nt, Human
ccugcuccgaagacaaaccaaccuccguuucuuuuauaaacagucggcuuuuucuuaauaagcc

SEQ ID NO: 32723 - RNA, 64 nt, Human
cugauaauaauuuacaaacuacuauaaacaaauuuauaaacauuacuaauuucugaugaaaaua

SEQ ID NO: 32724 - RNA, 64 nt, Human
acauuacuauuucugauaauaauuuacaaacuacuauaaacaaauuuauaaacauuacuaauuu

SEQ ID NO: 32725 - RNA, 64 nt, Human
uuuugacuuuuuuuaugguauaaaaacaauaauuuauaaacauaaaagcucauuguguuuuuua

SEQ ID NO: 32726 - RNA, 64 nt, Human
acaauuguauuucuagaacuccagacuaggagacuauaaacaguagucuauuggaacaccauua

SEQ ID NO: 32727 - RNA, 64 nt, Human
cgaaacaaauaaaaaauacuguaauaaaaguacuuauaaacauacuaauccucuuucaggaccc

SEQ ID NO: 32728 - RNA, 64 nt, Human
auuaggcauuuuauguuagucacagucuugaauguauaaacagcacuaagacucucaggucagg

SEQ ID NO: 32729 - RNA, 64 nt, Human
augcaaguuugguuugaaugccauaauaaaaugauauaaacagugcuucugacaauaucuguau

SEQ ID NO: 32730 - RNA, 64 nt, Human
acagagaagcaaagaauggaguucaaccuuacacuauaaacaucuaauagauauguaugaaaau

SEQ ID NO: 32731 - RNA, 64 nt, Human
cccccccaccccaccaccccagggauaaauuggauauaaacacuaaauacuaaucaguugaacu

SEQ ID NO: 32732 - RNA, 64 nt, Human
gcacuucccauuuguguuucagaaaggaguagaauauaaacacauaauugcuuauguaugccua

SEQ ID NO: 32733 - RNA, 64 nt, Human
augaugagguuuucuuaacuuaaaagaacauguauauaaacaugcuugcauuauauuuguaaau

SEQ ID NO: 32734 - RNA, 64 nt, Human
agaaugugagaaaccugaucuggaagaggagcuauauaaacacuaucugacuaucuuugucuuu

SEQ ID NO: 32735 - RNA, 64 nt, Human
aauucaacauucuuuacuauagguaaugaaugauuauaaacaagaugcaucuuagauaguauua

SEQ ID NO: 32736 - RNA, 64 nt, Human
gaaggaaacugucucgcauaggagccuauauaaauauaaacauauauacgugcacucuacagaa

SEQ ID NO: 32737 - RNA, 64 nt, Human
ugcaugcuauagacaguuggaacauguagacuuguauaaacacugcacacuuaaccuauacuaa

SEQ ID NO: 32738 - RNA, 64 nt, Human
uaugcuuagauuagggguuuugcaaccugaggucuauaaacaaagucuuccuggaaguaauugu

SEQ ID NO: 32739 - RNA, 64 nt, Human
cauguccacucugcagaacugugauuucagaccauauaaacaaauggaaggauggagccacuuc

SEQ ID NO: 32740 - RNA, 64 nt, Human
uucuuuccagacuucuguaggccuaauuuucccuuauaaacauagaugcaggcguacauucuau

SEQ ID NO: 32741 - RNA, 64 nt, Human
aaugcccagccgcucguggguuggugcaaagaaguauaaacauauaucacuaaggaaaaagaaa

SEQ ID NO: 32742 - RNA, 64 nt, Human
acagacaaacaucaccguaaaugacucacaacauuauaaacaguugugagaaaauauuucacau

SEQ ID NO: 32743 - RNA, 64 nt, Human
uugcauggacaugggccagguuuuucaaaaggaauauaaacaggaucucaaacuugauuaaaug

SEQ ID NO: 32744 - RNA, 64 nt, Human
uuuuuuauuuuguuaccaacccauauucuuagaauauaaacaggacuuguuuuuuucaguaagg

SEQ ID NO: 32745 - RNA, 64 nt, Human
gauuaauuaaauaaacaugcaauuuaugaaaacauauaaacaauuauuuaucacuuuuaugacc

SEQ ID NO: 32746 - RNA, 64 nt, Human
cucuuuggucaaaugcacauuuacagagagacacuauaaacaaguacacaaauuuuucaauuuu

SEQ ID NO: 32747 - RNA, 64 nt, Human
gcuuuuuuaguguagaccuaaaauuauuuuugccuauaaacagugaacuuaauauguuucugug

SEQ ID NO: 32748 - RNA, 64 nt, Human
aagucugauguuaauuuuuguuucaggagugagauauaaacauuuugcuuuuuuucaguuuuga

SEQ ID NO: 32749 - RNA, 64 nt, Human
ugaaguucaauuuaaaggguccacugcagucccuuauaaacaauuguugaaccuaaccauuaua

SEQ ID NO: 32750 - RNA, 64 nt, Human
uauaagcaucauuauuuauguauugugcaauguguauaaacaagaaaaauaaagaaaagaugca

SEQ ID NO: 32751 - RNA, 64 nt, Human
uuucccaguuaaagauuauugugacuucacuguauauaaacauauuuuuauacuuuauugaaag

SEQ ID NO: 32752 - RNA, 64 nt, Human
ucaguuuuuuucacacaucagaaaaaacugacuguauaaacacuuaucacugaccuuuuucuau

SEQ ID NO: 32753 - RNA, 64 nt, Human
aagcugcaggcuguuuaagaaaaaauaacacacauauaaacaucacacacacagacagacacac

SEQ ID NO: 32754 - RNA, 64 nt, Human
gaagaacuaaaaauacauaaaugaauuaaguaauuauaaacauaaauuuccuguagcuccaaca

SEQ ID NO: 32755 - RNA, 64 nt, Human
cagcagauguaguuucagacuuggaguaaaacuguauaaacaaaagaaucuuccauauuuauac

SEQ ID NO: 32756 - RNA, 64 nt, Human
ggccccuugcuaauuaacuuccauuuuguaaaaauauaaacacauggggcuaugacuuucccuc

SEQ ID NO: 32757 - RNA, 64 nt, Human
ucaacauacgcaaaucaauaaauguaauccagcauauaaacagaaccaaagacagaaaccacau

SEQ ID NO: 32758 - RNA, 64 nt, Human
auggguauugguuaaaggggacuucagcuuuuuauauaaacauccacuucucuuucaaaagacu

SEQ ID NO: 32759 - RNA, 64 nt, Human
cuucagcagacaaaaacuuccucugucaagguguuauaaacauuuaaaaucacauuuuccauuu

SEQ ID NO: 32760 - RNA, 62 nt, Human
ccccaauuuugucaaauauuaaaaauuuugccauuauaaacacuuaccuugauggccccuuu

SEQ ID NO: 32761 - RNA, 64 nt, Human
uucuuuuguuugucugauuuaugguuuuuuuaaguauaaacaaaaguuuuuuauuagcauucug

SEQ ID NO: 32762 - RNA, 64 nt, Human
aggaguggcucaagaguccagugugggaugaaaauauaaacagaggaagacaacauaugucacu

SEQ ID NO: 32763 - RNA, 64 nt, Human
ccccacagaaauacgaaaaacccucaaagauuacuauaaacaccuguaugcacacaaacuagaa

SEQ ID NO: 32764 - RNA, 64 nt, Human
uggagcccugagcauuguaauaugcggcccagccuauaaacagccuccgugcuuagcagauggu

SEQ ID NO: 32765 - RNA, 64 nt, Human
gcugcuguaacaaaagaccuuagacuggguaauuuauaaacaauagaaauuugucacucauggu

SEQ ID NO: 32766 - RNA, 64 nt, Human
gauuggaauuacauaugacaaaguaucaguguacuauaaacagguuuuuaguuaucccugcauu

SEQ ID NO: 32767 - RNA, 64 nt, Human
uccuuuuguauuaauuucuaguguauguuugugauauaaacauuuaauaaauauccuguuuugu

SEQ ID NO: 32768 - RNA, 64 nt, Human
gcucauuaauuuuuuuagucuuuuuuucuuuuaauauaaacauuuguguauagcuguucccuaa

SEQ ID NO: 32769 - RNA, 64 nt, Human
uucuacugcuaggcaauugaaguauaaacuauuuuauaaacacugucuucuuucgucuucacac

SEQ ID NO: 32770 - RNA, 64 nt, Human
uguguauaaaauauauauuugccuuaaauggaaauauaaacaaaauuuaccaacuacaguuuuu

SEQ ID NO: 32771 - RNA, 64 nt, Human
auuaagugccuucacacagcacugguuuaauguuuauaaacaaaauagagaaacuuuccuuaua

SEQ ID NO: 32772 - RNA, 64 nt, Human
agggucugggaucuguuuucuggaagugugcagguauaaacacacccucugugcuugugacaaa

SEQ ID NO: 32773 - RNA, 64 nt, Human
ucuuguacauuugacaacacauugaggaaaacccuauaaacauaaucaagaggggacauuuuuc

SEQ ID NO: 32774 - RNA, 64 nt, Human
ggcagccuguaucuggugucugagugaggcaugguauaaacaccuggucauuucaauccaacau

SEQ ID NO: 32775 - RNA, 64 nt, Human
aagcaagaauggucaaaaucgaaugcugcauuuuuauaaacaaaauuacagacugucugaaauu

SEQ ID NO: 32776 - RNA, 64 nt, Human
aaccauuguucuaacaaagcaggcaacuuuauucuauaaacacaacuuuauuaagcagaauaca

SEQ ID NO: 32777 - RNA, 64 nt, Human
cauugcaucaccucuguaauuuuucagcucucuguauaaacauuaaaugucuuauauagcagca

SEQ ID NO: 32778 - RNA, 64 nt, Human
gagcugucuugucaucuuuuagaguaaacuauucuauaaacauaugcaaacagcccuaaauaaa

SEQ ID NO: 32779 - RNA, 64 nt, Human
gcaccaaacguguaugucauuuuuauuuccauuuuauaaacauguaaauaauagugauaacuug

SEQ ID NO: 32780 - RNA, 64 nt, Human
uaguacagggaagucugacacagccucuccagccuauaaacagccggggggcuguggcacaggu

SEQ ID NO: 32781 - RNA, 64 nt, Human
cuauauuucaaaggaauugagacauacucccaucuauaaacauguuugguuuucuuacgauaca

SEQ ID NO: 32782 - RNA, 64 nt, Human
uugccuauaccauccugauuuuugaaaagugaauuauaaacacaaaauuguuaguguuuaugau

SEQ ID NO: 32783 - RNA, 64 nt, Human
guauaagcacauguacagaggaguacacauagcauauaaacaugucuguagcacauauauauuc

SEQ ID NO: 32784 - RNA, 64 nt, Human
uuucccuagucaaugcucugaaaaugugucacauuauaaacaauacagaaggagagauagauga

SEQ ID NO: 32785 - RNA, 64 nt, Human
cuagucagugcucugaagaugugucacauuauauuauaaacaauacggaaggggagauagguga

SEQ ID NO: 32786 - RNA, 64 nt, Human
caccccuucucgugccuuuucucuccuugagcuuuauaaacagauuuguaccugagccccagug

SEQ ID NO: 32787 - RNA, 64 nt, Human
acaagcauuuucucuguagagcagccacacguuguauaaacauaaacuguaugugcaguuauuu

SEQ ID NO: 32788 - RNA, 64 nt, Human
ucauauagcuguauacauauucaguugaucauuuuauaaacauaugaaggcauaaagauauaca

SEQ ID NO: 32789 - RNA, 64 nt, Human
uuuguaaagcacuugguuuaaauuucucucuaccuauaaacaguuuagcauuaaggguuucuau

SEQ ID NO: 32790 - RNA, 64 nt, Human
gggauguauuuaucacuuggacaucuguuuauaauauaaacagacaugugacugggaacaucuu

SEQ ID NO: 32791 - RNA, 64 nt, Human
cugacacugcaggguccugaguaaauguguucuguauaaacaaaugcagcuggaaucgcucaag

SEQ ID NO: 32792 - RNA, 64 nt, Human
agguugauaaccauaugcacuuaacauuauauucuauaaacauuaaguagugccaguuaugaga

SEQ ID NO: 32793 - RNA, 64 nt, Human
gauucuugaaguugaaggaauauacugaaauguuuauaaacauaacuuuuacuacaguagcauc

SEQ ID NO: 32794 - RNA, 64 nt, Human
cauuucccaguacuucccuuuacagucugcagccuauaaacaguggugucucaaagcaaaggaa

SEQ ID NO: 32795 - RNA, 64 nt, Human
acacagccagaccacuguggugacagacuuucuuuauaaacauuuggaaguuuucucccccauc

SEQ ID NO: 32796 - RNA, 64 nt, Human
ggccuagggcauuacuguauacuacuguaggcuuuauaaacacagcacacuuaggguacacaaa

SEQ ID NO: 32797 - RNA, 64 nt, Human
aauaaauguauagacccuuauguacagaccuguguauaaacaacuuuuguauauacauauagga

SEQ ID NO: 32798 - RNA, 64 nt, Human
uauauugaccugcaguguaaaaagcacauuuaauuauaaacaauauauucaaaaugggcaaauu

SEQ ID NO: 32799 - RNA, 64 nt, Human
cauuuuaaagaaacccccacccugccgcccgcauuauaaacacaggagaauaaucaauagaaua

SEQ ID NO: 32800 - RNA, 64 nt, Human
uuuaaaucuugcuuuucagaaauuaccgaauguguauaaacaaauaaagaaaaauaauuuagcu

SEQ ID NO: 32801 - RNA, 64 nt, Human
caccgucuccaugaaugagaaguuugacuugguguauaaacagaagaugggaaagugugaccuc

SEQ ID NO: 32802 - RNA, 64 nt, Human
gcugcuauaauaaagcaccauagacuugguggcuuauaaacaacagaaauuuauuccucacagu

SEQ ID NO: 32803 - RNA, 64 nt, Human
ucuuucucuugugcauuuaauaaaggaugguaucuauaaacaaugcaaaagaugcucugauguc

SEQ ID NO: 32804 - RNA, 64 nt, Human
cuuugcaguuuuggacaauuacaaguaaagcugcuauaaacauuuguaugcaacauuuuguguu

SEQ ID NO: 32805 - RNA, 64 nt, Human
gaugaacacauaagucuuggaaauuaaauaaauuuauaaacauaaagauaauuuaaugcuguga

SEQ ID NO: 32806 - RNA, 64 nt, Human
uaacagaaaggcuuuuuauaaacuuuuaaagaaauauaaacacaaauauagagauuuuuuaacc

SEQ ID NO: 32807 - RNA, 64 nt, Human
auguaauguucuccucaaacauuuauguuaacucuauaaacaaauaucguuaaguuaaacaagu

SEQ ID NO: 32808 - RNA, 64 nt, Human
uauuuucaaaauggaaaucacuguuuauauugauuauaaacauaagacaugcucauuguaaaaa

SEQ ID NO: 32809 - RNA, 64 nt, Human
augucuaaaaguuuccagugauuuauuaccacauuauaaacaucauguauaggcagucugcauc

SEQ ID NO: 32810 - RNA, 64 nt, Human
gucucauuuuagugacuccuaaggcuaguccuuuuauaaacaacuuuuucugacauagcauuua

SEQ ID NO: 32811 - RNA, 64 nt, Human
uucauggccagcacucuugaugagggucuuggucuauaaacaggcauagauagcuagaacauaa

SEQ ID NO: 32812 - RNA, 64 nt, Human
uacacuuuacauucuugcucugcucaucuacacauauaaacacaguaagauagguucugcuuuc

SEQ ID NO: 32813 - RNA, 64 nt, Human
aauauauaccguggggguaguuuuacccuauaucuauaaacacuguuuguuccagaaucuguau

SEQ ID NO: 32814 - RNA, 64 nt, Human
auuugacacacauacucaaaaaaauguaacugacuauaaacacuuuaaccuaaucaucuguauc

SEQ ID NO: 32815 - RNA, 64 nt, Human
guguuuuaggauucuguccauuuucuuuuaaaguuauaaacacguacuugugcgaauuauuuuu

SEQ ID NO: 32816 - RNA, 64 nt, Human
gagaagcuggauuuaaucaucccugcccuacauauauaaacauaagguaaccuacugaauuuua

SEQ ID NO: 32817 - RNA, 64 nt, Human
augucauguagagguuaauuuaaucaaaaugagcuauaaacauggagcaaucacuguauaauuu

SEQ ID NO: 32818 - RNA, 64 nt, Human
aucuguugcauguacuuuaaaguuuauuauaaaauauaaacagauauauaaagauguugacucu

SEQ ID NO: 32819 - RNA, 64 nt, Human
ucugauguugaugcaugucuuugggaaacacauuuauaaacauggauaccugauaauagauauu

SEQ ID NO: 32820 - RNA, 64 nt, Human
guacuauuugcuagauucaugccucaaaaguuauuauaaacagaccuuuauuaaacacaucuug

SEQ ID NO: 32821 - RNA, 64 nt, Human
gucuuacugggauuuuuaugcauagaaacucacauauaaacaugaaauaaacagugccaguauu

SEQ ID NO: 32822 - RNA, 64 nt, Human
gaaaaugcuuuuccccgcccaaucuucucucaaauauaaacacaucacacaggguguugggggu

SEQ ID NO: 32823 - RNA, 64 nt, Human
gucauauacauguaagcuacaauuuugagugcuuuauaaacacuuaagauauauauauaaauuu

SEQ ID NO: 32824 - RNA, 64 nt, Human
aaaacccuucuugguggauuagacagguuaaauauauaaacaaacaaacaaaaauugcucaaaa

SEQ ID NO: 32825 - RNA, 64 nt, Human
auucuguuuaauauacaaauuuggauagcuuaauuauaaacauauuuuuauaucaaauauacag

SEQ ID NO: 32826 - RNA, 64 nt, Human
uuugaauccuuacaugaaauguucugggaguuguuauaaacacaccccaaggaagcaauauuua

SEQ ID NO: 32827 - RNA, 64 nt, Human
cugaaguugugguuguuagguucacacccuguuuuauaaacaacaucaaaauggcagaaccauu

SEQ ID NO: 32828 - RNA, 64 nt, Human
aaguuggagaagucuugcaguuaucuuagcauuguauaaacagccuuaaguauagccuaagaag

SEQ ID NO: 32829 - RNA, 64 nt, Human
gucauauugggaaagauggcaaagcuuuugagaauauaaacacaccuguuuuguuuuucuuaag

SEQ ID NO: 32830 - RNA, 64 nt, Human
aguuaauagagauaaauauuuuuaucaaaaauuuuauaaacacagccuuucuuuagcauugauu

SEQ ID NO: 32831 - RNA, 64 nt, Human
uaugaaugaugaaguuuucucaccuucaaagucuuauaaacauguugacucuuguuccugcuga

SEQ ID NO: 32832 - RNA, 64 nt, Human
uguauauggugguaauaagggaaaaaucaaguauuauaaacaagaaugaagguuuuuguaaaga

SEQ ID NO: 32833 - RNA, 64 nt, Human
auauuaauuuaaaaagcagcaugaacccucuacuuauaaacaaggguuugguguuuuuaaagug

SEQ ID NO: 32834 - RNA, 64 nt, Human
ggaaucaaauauuuuuuccaggggugagaauaaguauaaacauaaagcaacuaaaaugaaacau

SEQ ID NO: 32835 - RNA, 64 nt, Human
aaugaauaugccaucuaugcagaacaggcagaaauauaaacacauuaaaagacaaauauguaga

SEQ ID NO: 32836 - RNA, 64 nt, Human
ugcccgccucggccucccaacgugcccccaguuuuauaaacagcagauagcaacuugucgucac

SEQ ID NO: 32837 - RNA, 64 nt, Human
cugagugugacuuuauaaagauacucauaaaaaauauaaacaacaaaaccuuggaaguaguuuc

SEQ ID NO: 32838 - RNA, 64 nt, Human
uuuucauuauuuuucuacuuugugucauguccuguauaaacaggaauauuuagaggguguuucc

SEQ ID NO: 32839 - RNA, 63 nt, Human
aggauugcagcaacacgcucggcugcccaaacccaaggcgaagaccuugccagaguucaucaa

SEQ ID NO: 32840 - RNA, 63 nt, Human
ggccccaccccugcucgccccuaucgcuccagccaaggcgaagaagcacgaacgaaugucgag

SEQ ID NO: 32841 - RNA, 63 nt, Human
auucuuguuagcuuugcuuuucuccccauaucccaaggcgaagcgcugagauucuuccaucua

SEQ ID NO: 32842 - RNA, 63 nt, Human
ccauuuggggaugaagucuacuuugacagcuagcaaggcgacaugcaacuguuguugaaugau

SEQ ID NO: 32843 - RNA, 63 nt, Human
accugcuucacaaguuacaguucguccugacuacaaggcgaguggauaauuccaacacaagac

SEQ ID NO: 32844 - RNA, 63 nt, Human
acuuuacaaacaaauaaacauuguuuguacucacaaggcgauaauagcuugauuuauuugguu

SEQ ID NO: 32845 - RNA, 63 nt, Human
agccaagagagauuagagagagaaaauguagaucaaggcgagcugccuacaaauuacucuguc

SEQ ID NO: 32846 - RNA, 63 nt, Human
uacuguguaccucauggaugcuuuggcaaugcccaaggcgauauaagcaaaaucagaaguaua

SEQ ID NO: 32847 - RNA, 63 nt, Human
uguccagugugcaagcaaaaaguuguuccuucucaaggcgauucagacucugacacagacagu

SEQ ID NO: 32848 - RNA, 63 nt, Human
ugcugguccuguugaucccagucucugccagaccaaggcgaguuuccccacuaauaaagugcc

SEQ ID NO: 32849 - RNA, 63 nt, Human
cagggggagggggucaggugucgaaccagcaggcaaggcgaggugcccgcucagcucagcaag

SEQ ID NO: 32850 - RNA, 63 nt, Human
gcucacaccuguaaucccagcacuuugggaggccaaggcgagcggaucaugaggucagaagau

SEQ ID NO: 32851 - RNA, 63 nt, Human
cuuggcauuuucggaggaaacuuguaggacacccaaggcgacuaagagacagccuccuuggca

SEQ ID NO: 32852 - RNA, 63 nt, Human
ugccccucagggucacaggggugggggcucucacaaggcgacuugaagaggacgcaggcuucc

SEQ ID NO: 32853 - RNA, 63 nt, Human
ugagggcagcuaaacccauagaaggaguuggaccaaggcgaauuacgaguccuggucccagca

SEQ ID NO: 32854 - RNA, 63 nt, Human
agaggcccgugccaugagaccgccuggggugagcaaggcgaccugggcugcugcccgaagguu

SEQ ID NO: 32855 - RNA, 63 nt, Human
cccgcucccacccccaccuuguugacagggagccaaggcgaggcggcugucugcgaccacagc

SEQ ID NO: 32856 - RNA, 63 nt, Human
gccccucgccccugccuggcacugcucaccgcccaaggcgacgccggcuggaccaggcacugc

SEQ ID NO: 32857 - RNA, 63 nt, Human
agggucaggcccugccagaggcuggagggugcccaaggcgaggccggugaggcccagcucuac

SEQ ID NO: 32858 - RNA, 63 nt, Human
agacaguguggaacagagugagccugagcugcccaaggcgaugcccuuugugcuguaugacug

SEQ ID NO: 32859 - RNA, 63 nt, Human
gucuucuggggaccccagaggugucugugcugacaaggcgacuucagauuccauacugagauc

SEQ ID NO: 32860 - RNA, 63 nt, Human
caggccuggcaggggcccacuggugcccagcaccaaggcgagcuccgggcucagaccaacucc

SEQ ID NO: 32861 - RNA, 63 nt, Human
ugcaaaccacuggcucguuuccgugcccaaauccaaggcgaaguuuucuagaggguucuuggg

SEQ ID NO: 32862 - RNA, 63 nt, Human
cugaggucgggaguuggagacccgccuggcuaacaaggcgaaauccugucuguacuaaaaaua

SEQ ID NO: 32863 - RNA, 63 nt, Human
ggcuggccuuccacuuggcuacacagggauguacaaggcgaucccaucuugauaagaccacca

SEQ ID NO: 32864 - RNA, 63 nt, Human
uugaggucaggaguucaagaccagccuggccaacaaggcgaaacccugucucuacuaaaaaua

SEQ ID NO: 32865 - RNA, 63 nt, Human
uuccccuucccaaccccgaggggcuugcagggacaaggcgaccgacugcgcugagcugcuuau

SEQ ID NO: 32866 - RNA, 63 nt, Human
aaaauccauaacugauuuccaagcugguguguucaaggcgaggacgguguguggguggccccu

SEQ ID NO: 32867 - RNA, 63 nt, Human
acaaggagaccuggacacaacagacacacaucacaaggcgaacacaaauggacacacauaccu

SEQ ID NO: 32868 - RNA, 63 nt, Human
ggcugaguggacagucaggagagaggcgagaggcaaggcgaagccugugucccuguuucaguu

SEQ ID NO: 32869 - RNA, 63 nt, Human
cugccagaacuugacuagcauuucugaauaucccaaggcgaggucauguaacuuccuugggaa

SEQ ID NO: 32870 - RNA, 63 nt, Human
uccuuguuuucuagcuuuggaucauuuuuguaccaaggcgagcaagccuuuuugaaaaauaac

SEQ ID NO: 32871 - RNA, 63 nt, Human
ugggaagugaccauuuggaugucugggcccugccaaggcgacagggagggucagagggaggcc

SEQ ID NO: 32872 - RNA, 63 nt, Human
accucaacagacugccccgggcucugggugggccaaggcgaaggcuucccaucaccacaggaa

SEQ ID NO: 32873 - RNA, 63 nt, Human
cgagaucgugccacuguacuccagccugggcaacaaggcgagacuccaucucaauaauaauaa

SEQ ID NO: 32874 - RNA, 63 nt, Human
ccgggaccccagcccucaggauuccugaugcuccaaggcgacugaugggcgcuggaugaagug

SEQ ID NO: 32875 - RNA, 63 nt, Human
gaggauugcacccgcccguccuaagccuccccacaaggcgaggggaguuaccccuaaaacaaa

SEQ ID NO: 32876 - RNA, 63 nt, Human
aggacgggagcugccuagcuacaguuuucuugccaaggcgagguguuuugugaaucugugcug

SEQ ID NO: 32877 - RNA, 63 nt, Human
ucaacuuacucucuugaguucuuacauacacuucaaggcgagcagaucaaagaaaaauccccc

SEQ ID NO: 32878 - RNA, 63 nt, Human
uucagcucaggaguucgagaucauucuggccaacaaggcgaaacccugucucuaccaaaaaua

SEQ ID NO: 32879 - RNA, 63 nt, Human
accuuuucuccuguguaucuuugaaguggcagacaaggcgaagcaucagacugguauuaaugu

SEQ ID NO: 32880 - RNA, 63 nt, Human
auccagggcugccaggagauucagagcucaaaacaaggcgagcuugaguucugcacuccagau

SEQ ID NO: 32881 - RNA, 64 nt, Human
gacuucgccugggugggauguaccgcaggugcaucgcgucgagguggggcacggccgccggcaa

SEQ ID NO: 32882 - RNA, 64 nt, Human
aaaagucauuuagaaaacuucaguuuucggccagcgcgucgagggaggggccagcgacacaugg

SEQ ID NO: 32883 - RNA, 64 nt, Human
aggaccccgagcggcgcugccggagcccagagcgcgcgucgaaccgucggcccgagggcgcaga

SEQ ID NO: 32884 - RNA, 64 nt, Human; identical to SEQ ID NO: 8469

SEQ ID NO: 32885 - RNA, 64 nt, Human; identical to SEQ ID NO: 8470

SEQ ID NO: 32886 - RNA, 64 nt, Human; identical to SEQ ID NO: 8471

SEQ ID NO: 32887 - RNA, 64 nt, Human; identical to SEQ ID NO: 8472

SEQ ID NO: 32888 - RNA, 64 nt, Human; identical to SEQ ID NO: 8473

SEQ ID NO: 32889 - RNA, 64 nt, Human; identical to SEQ ID NO: 8474

SEQ ID NO: 32890 - RNA, 64 nt, Human; identical to SEQ ID NO: 8475

SEQ ID NO: 32891 - RNA, 64 nt, Human; identical to SEQ ID NO: 8476

SEQ ID NO: 32892 - RNA, 64 nt, Human; identical to SEQ ID NO: 8477

SEQ ID NO: 32893 - RNA, 64 nt, Human; identical to SEQ ID NO: 8478

SEQ ID NO: 32894 - RNA, 64 nt, Human; identical to SEQ ID NO: 8479

SEQ ID NO: 32895 - RNA, 64 nt, Human; identical to SEQ ID NO: 8480

SEQ ID NO: 32896 - RNA, 64 nt, Human; identical to SEQ ID NO: 8481

SEQ ID NO: 32897 - RNA, 64 nt, Human; identical to SEQ ID NO: 8482

SEQ ID NO: 32898 - RNA, 64 nt, Human; identical to SEQ ID NO: 8483

SEQ ID NO: 32899 - RNA, 50 nt, Human; identical to SEQ ID NO: 8484

SEQ ID NO: 32900 - RNA, 64 nt, Human; identical to SEQ ID NO: 8485

SEQ ID NO: 32901 - RNA, 64 nt, Human; identical to SEQ ID NO: 8486

SEQ ID NO: 32902 - RNA, 64 nt, Human; identical to SEQ ID NO: 8487

SEQ ID NO: 32903 - RNA, 64 nt, Human; identical to SEQ ID NO: 8488

SEQ ID NO: 32904 - RNA, 64 nt, Human; identical to SEQ ID NO: 8489

SEQ ID NO: 32905 - RNA, 64 nt, Human; identical to SEQ ID NO: 8490

SEQ ID NO: 32906 - RNA, 64 nt, Human; identical to SEQ ID NO: 8491

SEQ ID NO: 32907 - RNA, 51 nt, Human; identical to SEQ ID NO: 8492

SEQ ID NO: 32908 - RNA, 64 nt, Human; identical to SEQ ID NO: 8493

SEQ ID NO: 32909 - RNA, 64 nt, Human; identical to SEQ ID NO: 8494

SEQ ID NO: 32910 - RNA, 64 nt, Human; identical to SEQ ID NO: 8495

SEQ ID NO: 32911 - RNA, 64 nt, Human; identical to SEQ ID NO: 8496

SEQ ID NO: 32912 - RNA, 64 nt, Human; identical to SEQ ID NO: 8497

SEQ ID NO: 32913 - RNA, 64 nt, Human; identical to SEQ ID NO: 8498

SEQ ID NO: 32914 - RNA, 64 nt, Human; identical to SEQ ID NO: 8499

SEQ ID NO: 32915 - RNA, 64 nt, Human; identical to SEQ ID NO: 8500

SEQ ID NO: 32916 - RNA, 64 nt, Human; identical to SEQ ID NO: 8501

SEQ ID NO: 32917 - RNA, 63 nt, Human; identical to SEQ ID NO: 8502

SEQ ID NO: 32918 - RNA, 64 nt, Human; identical to SEQ ID NO: 8503

SEQ ID NO: 32919 - RNA, 64 nt, Human; identical to SEQ ID NO: 8504

SEQ ID NO: 32920 - RNA, 64 nt, Human; identical to SEQ ID NO: 8505

SEQ ID NO: 32921 - RNA, 64 nt, Human; identical to SEQ ID NO: 8506

SEQ ID NO: 32922 - RNA, 64 nt, Human; identical to SEQ ID NO: 8507

SEQ ID NO: 32923 - RNA, 64 nt, Human; identical to SEQ ID NO: 8508

SEQ ID NO: 32924 - RNA, 64 nt, Human; identical to SEQ ID NO: 8509

SEQ ID NO: 32925 - RNA, 64 nt, Human; identical to SEQ ID NO: 8510

SEQ ID NO: 32926 - RNA, 64 nt, Human; identical to SEQ ID NO: 8511

SEQ ID NO: 32927 - RNA, 64 nt, Human; identical to SEQ ID NO: 8512

SEQ ID NO: 32928 - RNA, 64 nt, Human; identical to SEQ ID NO: 8513

SEQ ID NO: 32929 - RNA, 64 nt, Human; identical to SEQ ID NO: 8514

SEQ ID NO: 32930 - RNA, 64 nt, Human; identical to SEQ ID NO: 8515

SEQ ID NO: 32931 - RNA, 64 nt, Human; identical to SEQ ID NO: 8516

SEQ ID NO: 32932 - RNA, 64 nt, Human; identical to SEQ ID NO: 8517

SEQ ID NO: 32933 - RNA, 64 nt, Human; identical to SEQ ID NO: 8518

SEQ ID NO: 32934 - RNA, 64 nt, Human; identical to SEQ ID NO: 8519

SEQ ID NO: 32935 - RNA, 64 nt, Human; identical to SEQ ID NO: 8520

SEQ ID NO: 32936 - RNA, 64 nt, Human; identical to SEQ ID NO: 8521

SEQ ID NO: 32937 - RNA, 64 nt, Human; identical to SEQ ID NO: 8522

SEQ ID NO: 32938 - RNA, 64 nt, Human; identical to SEQ ID NO: 8523

SEQ ID NO: 32939 - RNA, 64 nt, Human; identical to SEQ ID NO: 8524

SEQ ID NO: 32940 - RNA, 64 nt, Human; identical to SEQ ID NO: 8525

SEQ ID NO: 32941 - RNA, 64 nt, Human; identical to SEQ ID NO: 8526

SEQ ID NO: 32942 - RNA, 64 nt, Human; identical to SEQ ID NO: 8527

SEQ ID NO: 32943 - RNA, 64 nt, Human; identical to SEQ ID NO: 8528

SEQ ID NO: 32944 - RNA, 64 nt, Human; identical to SEQ ID NO: 8529

SEQ ID NO: 32945 - RNA, 64 nt, Human; identical to SEQ ID NO: 8530

SEQ ID NO: 32946 - RNA, 64 nt, Human; identical to SEQ ID NO: 8531

SEQ ID NO: 32947 - RNA, 64 nt, Human; identical to SEQ ID NO: 8532

SEQ ID NO: 32948 - RNA, 64 nt, Human; identical to SEQ ID NO: 8533

SEQ ID NO: 32949 - RNA, 64 nt, Human; identical to SEQ ID NO: 8534

SEQ ID NO: 32950 - RNA, 64 nt, Human; identical to SEQ ID NO: 8535

SEQ ID NO: 32951 - RNA, 64 nt, Human; identical to SEQ ID NO: 8536

SEQ ID NO: 32952 - RNA, 64 nt, Human; identical to SEQ ID NO: 8537

SEQ ID NO: 32953 - RNA, 64 nt, Human; identical to SEQ ID NO: 8538

SEQ ID NO: 32954 - RNA, 64 nt, Human; identical to SEQ ID NO: 8539

SEQ ID NO: 32955 - RNA, 64 nt, Human; identical to SEQ ID NO: 8540

SEQ ID NO: 32956 - RNA, 64 nt, Human; identical to SEQ ID NO: 8541

SEQ ID NO: 32957 - RNA, 64 nt, Human; identical to SEQ ID NO: 8542

SEQ ID NO: 32958 - RNA, 64 nt, Human; identical to SEQ ID NO: 8543

SEQ ID NO: 32959 - RNA, 64 nt, Human; identical to SEQ ID NO: 8544

SEQ ID NO: 32960 - RNA, 64 nt, Human; identical to SEQ ID NO: 8545

SEQ ID NO: 32961 - RNA, 64 nt, Human; identical to SEQ ID NO: 8546

SEQ ID NO: 32962 - RNA, 64 nt, Human; identical to SEQ ID NO: 8547

SEQ ID NO: 32963 - RNA, 54 nt, Human; identical to SEQ ID NO: 8548

SEQ ID NO: 32964 - RNA, 64 nt, Human; identical to SEQ ID NO: 8549

SEQ ID NO: 32965 - RNA, 64 nt, Human; identical to SEQ ID NO: 8550

SEQ ID NO: 32966 - RNA, 64 nt, Human; identical to SEQ ID NO: 8551

SEQ ID NO: 32967 - RNA, 64 nt, Human; identical to SEQ ID NO: 8552

SEQ ID NO: 32968 - RNA, 64 nt, Human; identical to SEQ ID NO: 8553

SEQ ID NO: 32969 - RNA, 64 nt, Human; identical to SEQ ID NO: 8554

SEQ ID NO: 32970 - RNA, 64 nt, Human; identical to SEQ ID NO: 8555

SEQ ID NO: 32971 - RNA, 64 nt, Human; identical to SEQ ID NO: 8556

SEQ ID NO: 32972 - RNA, 64 nt, Human; identical to SEQ ID NO: 8557

SEQ ID NO: 32973 - RNA, 64 nt, Human; identical to SEQ ID NO: 8558

SEQ ID NO: 32974 - RNA, 64 nt, Human; identical to SEQ ID NO: 8559

SEQ ID NO: 32975 - RNA, 64 nt, Human; identical to SEQ ID NO: 8560

SEQ ID NO: 32976 - RNA, 64 nt, Human; identical to SEQ ID NO: 8561

SEQ ID NO: 32977 - RNA, 64 nt, Human; identical to SEQ ID NO: 8562

SEQ ID NO: 32978 - RNA, 64 nt, Human; identical to SEQ ID NO: 8563

SEQ ID NO: 32979 - RNA, 64 nt, Human; identical to SEQ ID NO: 8564

SEQ ID NO: 32980 - RNA, 64 nt, Human; identical to SEQ ID NO: 8565

SEQ ID NO: 32981 - RNA, 64 nt, Human; identical to SEQ ID NO: 8566

SEQ ID NO: 32982 - RNA, 64 nt, Human; identical to SEQ ID NO: 8567

SEQ ID NO: 32983 - RNA, 64 nt, Human; identical to SEQ ID NO: 8568

SEQ ID NO: 32984 - RNA, 64 nt, Human; identical to SEQ ID NO: 8569

SEQ ID NO: 32985 - RNA, 64 nt, Human; identical to SEQ ID NO: 8570

SEQ ID NO: 32986 - RNA, 64 nt, Human; identical to SEQ ID NO: 8571

SEQ ID NO: 32987 - RNA, 64 nt, Human; identical to SEQ ID NO: 8572

SEQ ID NO: 32988 - RNA, 64 nt, Human; identical to SEQ ID NO: 8573

SEQ ID NO: 32989 - RNA, 64 nt, Human; identical to SEQ ID NO: 8574

SEQ ID NO: 32990 - RNA, 64 nt, Human; identical to SEQ ID NO: 8575

SEQ ID NO: 32991 - RNA, 64 nt, Human; identical to SEQ ID NO: 8576

SEQ ID NO: 32992 - RNA, 64 nt, Human; identical to SEQ ID NO: 8577

SEQ ID NO: 32993 - RNA, 64 nt, Human; identical to SEQ ID NO: 8578

SEQ ID NO: 32994 - RNA, 64 nt, Human; identical to SEQ ID NO: 8579

SEQ ID NO: 32995 - RNA, 64 nt, Human; identical to SEQ ID NO: 8580

SEQ ID NO: 32996 - RNA, 64 nt, Human
gcuggguguacagguggguuugggagagaggagcaugcgcgagagagucuccgagugugugcga

SEQ ID NO: 32997 - RNA, 64 nt, Human
ugagcacugcuuugaggcccaagcacuaguagagaugcgcgauacaggucuaguuucgguaacu

SEQ ID NO: 32998 - RNA, 64 nt, Human
ucgcucugccugccugcucagaagagguggcuuuggcccagaggcucaggccgggacugagaug

SEQ ID NO: 32999 - RNA, 64 nt, Human
cuuucagagccucuuguauuuggaaggcuggaagggcccagacuuuggaauagugucuugguuu

SEQ ID NO: 33000 - RNA, 64 nt, Human
gagagaaggggcuucucagacuuauuugcagaagggcccagaacucaguaugaaggcauuggca

SEQ ID NO: 33001 - RNA, 64 nt, Human
accugagcuugcuugaagggacccagagucuuugggcccagaucuuuaaaccuuugugucgugu

SEQ ID NO: 33002 - RNA, 64 nt, Human
cuaguuaguggaaauuuggauaagggaacuguagggcccagauucuggagguuuuaugucauug

SEQ ID NO: 33003 - RNA, 64 nt, Human
aaaauuugccuccugguaacccuguaauggauggggcccagaaaugaaauauuugagaaaaaca

SEQ ID NO: 33004 - RNA, 64 nt, Human
cagagaacucagcuguauguugcccucugaccuuggcccagaccuucagaggcucagucuguug

SEQ ID NO: 33005 - RNA, 64 nt, Human
cuguggccuuggagcucugugucaaggccuuugaggcccagaacccagaccccaaagcgccugu

SEQ ID NO: 33006 - RNA, 64 nt, Human
uccgcccuccucacugaggcaacaugaagcccgaggcccagaugggggcugaacagguagggca

SEQ ID NO: 33007 - RNA, 64 nt, Human
aggacugguggaaaaucucccaugcgacccucggggcccagagccaucugggucugauguucug

SEQ ID NO: 33008 - RNA, 64 nt, Human
ggacccgaagcccaggcugaagaguuuaacuuugggcccagaaacucaaccaucaauggaaaca

SEQ ID NO: 33009 - RNA, 64 nt, Human
auacaauguaaaugacaaaacauaauuccugagaggcccagaacaaacuggagucuagccugga

SEQ ID NO: 33010 - RNA, 64 nt, Human
uccaagaagugagaauuuccgaaaaagaucugccggcccagagcacucccucuugcccuaaucc

SEQ ID NO: 33011 - RNA, 64 nt, Human
guaucaucuucucauuuugcagaagagaaacugaggcccagaggcggagggcagucugcucaag

SEQ ID NO: 33012 - RNA, 64 nt, Human
ggccuuuggugaccacugagaaggacacuucacgggcccagagcuccugguacugcccuuccuu

SEQ ID NO: 33013 - RNA, 64 nt, Human
aagucccuucagacuggcccuuaagccaaacucaggcccagaauugcaguucagaauggcaguc

SEQ ID NO: 33014 - RNA, 55 nt, Human
uuaggugcccuuucugguaacuggaggcccagaugugcccaucacguuuuuucug

SEQ ID NO: 33015 - RNA, 64 nt, Human
accaggacuuggggucaggaacaguggcugggugggcccagaacugcccccacugucccccuac

SEQ ID NO: 33016 - RNA, 64 nt, Human
ggcucagccuccugauucauggguccccuaguuaggcccagauaaaaauccaguuggcugaggg

SEQ ID NO: 33017 - RNA, 64 nt, Human
uaccacccccaccccggcccgggauacugcccccggcccagauccuggccgucucaucccauac

SEQ ID NO: 33018 - RNA, 64 nt, Human
aaaaaugcuguaucuaaaugaaucuguguaauugggcccagauguggguuugcucaguauuagu

SEQ ID NO: 33019 - RNA, 64 nt, Human
gcaaccuacuuguuuuacagauggggcaaaaggaggcccagagcugaucucucauccgcucugg

SEQ ID NO: 33020 - RNA, 64 nt, Human
ucaguugcucgcuucugggugugcucccuucgaaggcccagauaagacagggaacacuugugag

SEQ ID NO: 33021 - RNA, 64 nt, Human
ccgacugagcagagccagacagacauuccugaggggcccagaaauggggccgguuggagggcag

SEQ ID NO: 33022 - RNA, 64 nt, Human
gucaacugacaaagagaagagaagacaagucuguggcccagacaggaugccaagucugggggca

SEQ ID NO: 33023 - RNA, 64 nt, Human
gcugcuggauggugaccccuggggaaugccccauggcccagaaugaugcugcuaguuuucuacu

SEQ ID NO: 33024 - RNA, 64 nt, Human
caauuauacgaauauguucuuuggguucugcuguggcccagacaguguuaacuuuuuuuuuauu

SEQ ID NO: 33025 - RNA, 56 nt, Human
gauccaucaaggggccuugagcaucaggcccagacagagccuggcaggcauccugg

SEQ ID NO: 33026 - RNA, 64 nt, Human
cacauuaugaagcagaaauuaaaaauagccaagaggcccagaaaucuaaagaucuuuguucuau

SEQ ID NO: 33027 - RNA, 64 nt, Human
ucauaacagucuuacugcaggcaagugggauaaaggcccagacuccaugguggaaguuaaaggg

SEQ ID NO: 33028 - RNA, 64 nt, Human
cacaccccagcucacacagcaaaaacaauggacaggcccagaggcugaagcaaacagugucccu

SEQ ID NO: 33029 - RNA, 64 nt, Human
acugacucugaacugggugaacucuguggagggaggcccagaaugggugcuuucaccaagaauu

SEQ ID NO: 33030 - RNA, 64 nt, Human
ugacacuuccacacacucccuguaguccagguagggcccagaaauaggaaaggcuaggauugga

SEQ ID NO: 33031 - RNA, 61 nt, Human
aagaaagccacaaagaguagcugaguuacugggcccagaggcugggccccuggacauguac

SEQ ID NO: 33032 - RNA, 64 nt, Human
ucuucugcgaucaguuaacccauuuuaccuaggaggcccagagaugugagggcuccuuccucag

SEQ ID NO: 33033 - RNA, 64 nt, Human
ucccuccgcaucccgucagcuggaaaaggccuguggcccagaggcuucuccaaagggaggguga

SEQ ID NO: 33034 - RNA, 64 nt, Human
uugucacagccugacauggccagguucucacacuggcccagagaaaagagccucagcaagagag

SEQ ID NO: 33035 - RNA, 64 nt, Human
uugccagagaagaugugacaggccaaucagacagggcccagagcaucucuuugcugcuacuguu

SEQ ID NO: 33036 - RNA, 64 nt, Human
uggauaccaauauucuauuuugcagauagaauuuggcccagagagguuaacuaauauauccaug

SEQ ID NO: 33037 - RNA, 64 nt, Human
uugccugucaccccagucaccuaagcaaucacugggcccagaggagaggagacagacacacacu

SEQ ID NO: 33038 - RNA, 64 nt, Human
cuacccucacagcuccuggggccuuccuggcucuggcccagaaagugauucauuuguaaauuau

SEQ ID NO: 33039 - RNA, 64 nt, Human
cucugccacccaggcaggcccugccuucagcccuggcccagagcuggaacacucucugagaugc

SEQ ID NO: 33040 - RNA, 64 nt, Human
auucucccugggcccaaaugacuuugucucccugggcccagauucuuugucucucuucaaccuu

SEQ ID NO: 33041 - RNA, 64 nt, Human
agccaaucauguuaacucuuccuuaucagccuguggcccagagacacaaugggguccuucugua

SEQ ID NO: 33042 - RNA, 64 nt, Human
cuaguaccaacacagggaaaacggaugggaccugggcccagacagucccccuugaccccagggc

SEQ ID NO: 33043 - RNA, 64 nt, Human
agcuuggcucacaaaaagagcuuucuggguuguaggcccagacuagacuugcagcaugcaugcu

SEQ ID NO: 33044 - RNA, 64 nt, Human
caacccugccugcauacaugggcuccugucauggggcccagagucccuugcagauauagaaaua

SEQ ID NO: 33045 - RNA, 64 nt, Human
cauuccuccagacguccaccucagugcacgagcuggcccagaggcucucgggcagccggcucuc

SEQ ID NO: 33046 - RNA, 64 nt, Human
gauugaaaaguguccucuggcugaguggccacuaggcccagacccagcccagccugagccccaa

SEQ ID NO: 33047 - RNA, 64 nt, Human
gcuugcagcaccauucggaguaaggaugacagcaggcccagaaggugucuuacucagaaaaaaa

SEQ ID NO: 33048 - RNA, 64 nt, Human
uccugcgccccgcccacacccucggggggucacaggcccagaaggguagcugggcggggcucga

SEQ ID NO: 33049 - RNA, 64 nt, Human
uuguguccauuccccaaauuaaccucuccgcccaggcccagaggaggggcugccugggcuagag

SEQ ID NO: 33050 - RNA, 64 nt, Human
ggggagaaaccugguaacauaaaagcaguucaguggcccagagguuauuuuuuuccuauugcuc

SEQ ID NO: 33051 - RNA, 64 nt, Human
uguaggugguaucauucucuuucucacucaguguggcccagaguugcucagaauuggagcagag

SEQ ID NO: 33052 - RNA, 64 nt, Human
aggguagagacaccccucccuugccccuuuccugggcccagaaguuggggggagggagggaaag

SEQ ID NO: 33053 - RNA, 64 nt, Human
auagacauaacugagcugaaguaauuccauaaagggcccagacagccuccuccaccauucccuu

SEQ ID NO: 33054 - RNA, 64 nt, Human
aagucagggucaacucccaggccucagaugcaggggcccagaacaccugcucucaccugagccc

SEQ ID NO: 33055 - RNA, 64 nt, Human
gaacaccugcucucaccugaaccccaggugaaggggcccagaacaccugcucucaccugagccc

SEQ ID NO: 33056 - RNA, 64 nt, Human
agcccuggcuggggcugcuuugagcaaugacgcuggcccagagcagcuucccacaugaccccag

SEQ ID NO: 33057 - RNA, 64 nt, Human
aagaaaauaucauaaaaaugagugauaaauacaaggcccagaugugguugcauaagguuuuuau

SEQ ID NO: 33058 - RNA, 64 nt, Human
cugcccucuaggugcacagacaauucagguccauggcccagaugguacuugcugucuucugcaa

SEQ ID NO: 33059 - RNA, 59 nt, Human
ggacaggaggcccaugcugaguugcccaaggcccagaucagcugcccagaaggcaccag

SEQ ID NO: 33060 - RNA, 64 nt, Human
aggguccucuuuuccuggcagcugcuguggguggggcccagacaccagccuagccuggcucugc

SEQ ID NO: 33061 - RNA, 64 nt, Human
cccggacccauccacucacuccugagagggcuccggcccagaaugggaaccucagagaagagcu

SEQ ID NO: 33062 - RNA, 64 nt, Human
aggaauagcugugauggaaggacuagagcgaaagggcccagagauaucaaggaagcuuuucauu

SEQ ID NO: 33063 - RNA, 64 nt, Human
gcucccugaggaccaccuccuacacuauugaccaggcccagaaggaaccagccaugaggugcuc

SEQ ID NO: 33064 - RNA, 64 nt, Human
gucugugggcuacugaguggguccuuaggauacuggcccagauuuugccacuggguauggcaga

SEQ ID NO: 33065 - RNA, 64 nt, Human
ccaccauugggcacugccaugcagagacguggcuggcccagaauggccuguugccauagcaacu

SEQ ID NO: 33066 - RNA, 64 nt, Human
cagaggggccaggacuucugccagccaagggaaaggcccagagcccugugcgggggaauguggc

SEQ ID NO: 33067 - RNA, 64 nt, Human
ucacauuccacugcugggagaagaaacaggccgaggcccagaguggccugcccccgggagccaa

SEQ ID NO: 33068 - RNA, 64 nt, Human
aucugcaggauggucuucacagguucucaaagcuggcccagaugcugauacacagcacacaggg

SEQ ID NO: 33069 - RNA, 64 nt, Human
ggaauugcugcucuuuaccaaagaaugguugauaggcccagaagcccaucuuaguuaggggaag

SEQ ID NO: 33070 - RNA, 64 nt, Human
uauagacugcaaacaagugcuuguugccccacacggcccagauucacuugaagcagaaguuagc

SEQ ID NO: 33071 - RNA, 64 nt, Human
caccguugccacugagcccacaucccaagagacaggcccagagccuaaaggcaaggacagugcc

SEQ ID NO: 33072 - RNA, 64 nt, Human
agugcugggauuacaggugugggccacugcaccuggcccagaugauauaauuuaacuguguuuu

SEQ ID NO: 33073 - RNA, 64 nt, Human
cauccaugccaucccugccugugccuagaucagaggcccagagggcccccucaguugccugagc

SEQ ID NO: 33074 - RNA, 64 nt, Human
cucuuggacuuuuggaugccuggccuuaggcuguggcccagaagcuggaaguuugggaaaggcc

SEQ ID NO: 33075 - RNA, 64 nt, Human
agagggggugaugaccccuccccaagccccucagggcccagaccuuccugcucuccagcagggg

SEQ ID NO: 33076 - RNA, 63 nt, Human
cuuuccguagcuccguauaagauuccgugguugggcccagagccugucgagggugccaguuag

SEQ ID NO: 33077 - RNA, 64 nt, Human
cccgcccccaggaagggggaaauggggcauuuggggcccagaccuacacuuggagcccaggucc

SEQ ID NO: 33078 - RNA, 64 nt, Human
ucucucucgaggccacugaaguuuggagucaaaaggcccagagucugagucccagcccugagca

SEQ ID NO: 33079 - RNA, 64 nt, Human
auggcugugucagcccagccccuucccuucuccaggcccagagaacucuuccacaaacaagaug

SEQ ID NO: 33080 - RNA, 64 nt, Human
gggcugugacaaggcccaugaugacauuucaugaggcccagaugugggcaggcagcccgggcug

SEQ ID NO: 33081 - RNA, 64 nt, Human
cagcuccuguggaaguuuccaguucccaguauguggcccagagugaugguguaguacaccaaga

SEQ ID NO: 33082 - RNA, 64 nt, Human
aaaggugggguguggggcccuggauggcagcucuggcccagacaugaauaccucguguuccucc

SEQ ID NO: 33083 - RNA, 50 nt, Human
cagguacugcccaggacugaggcccagauaaugagcugagauucagcauc

SEQ ID NO: 33084 - RNA, 64 nt, Human
uguccuagcaggccucagggccucugguggcucuggcccagacaguauuugcaguucuugugcu

SEQ ID NO: 33085 - RNA, 64 nt, Human
gagacaggcaggaccuugucucaccugugggcugggcccagaccuccacucgcuugccugcccu

SEQ ID NO: 33086 - RNA, 64 nt, Human
ccaccacagccucauuuuacagacagcccccugaggcccagagacaugcagcucucuguccaca

SEQ ID NO: 33087 - RNA, 64 nt, Human
gccuguggaggacaggccagagaggaggccagcaggcccagaguccccaggggaggaggaccag

SEQ ID NO: 33088 - RNA, 64 nt, Human
uaugaucccuaggccugggccugggccugccuauggcccagagcuacccugggagugucagugc

SEQ ID NO: 33089 - RNA, 64 nt, Human
ugcucagcugggucuccuguccuagagggaagguggcccagagucuuugguggagcggaaucug

SEQ ID NO: 33090 - RNA, 64 nt, Human
ugcaagucagugagacgaaguauagagaacagguggcccagauccaggggacccaacuucuggc

SEQ ID NO: 33091 - RNA, 64 nt, Human
ugacugcuccauagguuuugacuggugaaacaggggcccagaugacaaccucuccuucgcucca

SEQ ID NO: 33092 - RNA, 64 nt, Human
ccuggagccggcucaaguggcuaaagcauccuggggcccagagccaggugauaggucccucugg

SEQ ID NO: 33093 - RNA, 64 nt, Human
caggccaggucccuggaccagccuccuguuugcaggcccagaggagccaagucauuaaaaugga

SEQ ID NO: 33094 - RNA, 64 nt, Human
uuaaaaguuuaggguuuucucuugguuguagaguggcccagaauugcauucugaaugaauaaag

SEQ ID NO: 33095 - RNA, 64 nt, Human
auaggaagagcaaaugaaauaaacucuuuaggcuggcccagaaugccuucauugugaggaaggg

SEQ ID NO: 33096 - RNA, 64 nt, Human
acagcaucuugccaucuauauguuaguagcaguuggcccagaaaggacaaaaaaaaaaauuaag

SEQ ID NO: 33097 - RNA, 64 nt, Human
uucccucuucgccccuucggcuuggcuccuacaaggcccagaaaaccagcagguccuccagcau

SEQ ID NO: 33098 - RNA, 64 nt, Human
auccagagcuuugucguauuuggcacacagcagaggcccagauauuagaaaggcucuauuccaa

SEQ ID NO: 33099 - RNA, 64 nt, Human
ugaugggggaaaaaaaguaaucuuuaaacuggcuggcccagaguuuacauucuaauuugcauug

SEQ ID NO: 33100 - RNA, 64 nt, Human
agugcuaggauuacaggcaugagccacagcacccggcccagaauaagaauacugucuuggaaau

SEQ ID NO: 33101 - RNA, 64 nt, Human
gguuacaguuucuacuguucucugcaaguaaauaggcccagaaagguauaagagacucuuugaa

SEQ ID NO: 33102 - RNA, 64 nt, Human
acugggguuuguuagguucuuucucuaauguagaggcccagaucccaucacaaaguuuuucauu

SEQ ID NO: 33103 - RNA, 64 nt, Human
ugaggcagcaccauuugacagguuaggaugcuggggcccagagagguuaagugucuugcccgag

SEQ ID NO: 33104 - RNA, 64 nt, Human
augcagaccuggcuguggagagcagcuaauguguggcccagagagccugucuguguggagcacg

SEQ ID NO: 33105 - RNA, 64 nt, Human
acacagugcucgaccuugauagcauggggccccuggcccagaguugcugugccguguccaaggg

SEQ ID NO: 33106 - RNA, 56 nt, Human
acaaugccacccgccucuaggcugugggcccagacuacagccuggaauggggaagg

SEQ ID NO: 33107 - RNA, 64 nt, Human
ugccugugauacccaucagcccacugccccggccggcccagauaggucugccucugccuuccag

SEQ ID NO: 33108 - RNA, 64 nt, Human
ggcagggcccagcccugcuuccuggaguggauguggcccagagaaggaggcugggggaucacca

SEQ ID NO: 33109 - RNA, 64 nt, Human
caaaacuuggcagcugugccagaaaccaaagccaggcccagauguagggggagggcacgagagc

SEQ ID NO: 33110 - RNA, 64 nt, Human
aaccuguuucuccuugguuaaaauuauacuugaaggcccagaacacucauggcacauuuguuua

SEQ ID NO: 33111 - RNA, 52 nt, Human
ugugggugggugagguaugaagggcccagagcagagcccugggccaaggaac

SEQ ID NO: 33112 - RNA, 64 nt, Human
cuacauuccuuaggauuucucucccuaucaagcuggcccagauacaaguaccaaacaguagucu

SEQ ID NO: 33113 - RNA, 64 nt, Human
ccagcuaggaagaaagaauggcacucuugggcuuggcccagaauuagaguuauuagagcaagag

SEQ ID NO: 33114 - RNA, 57 nt, Human
gcugcaccugcaucuucugaaucaccuggcccagaagccaggccagcagcccgagac

SEQ ID NO: 33115 - RNA, 64 nt, Human
cccaggcccaggggcaggcucuuggccugccccaggcccagagggcuucccaguaaggcccagu

SEQ ID NO: 33116 - RNA, 64 nt, Human
ggaggcuucggggcucucccgccugccuucucggggcccagacgcaaggcaccgauugggccaa

SEQ ID NO: 33117 - RNA, 64 nt, Human
ggcacaaccaucccccaugucgcuacagaacaugggcccagagcaccuugaaggagacccuuga

SEQ ID NO: 33118 - RNA, 64 nt, Human
ugcugccgcuggggacaagccgccaagacccaggggcccagagcuucuuccuuugggugaguau

SEQ ID NO: 33119 - RNA, 64 nt, Human
gcaacaaugaaauuaauggauaccgucugcccuuggcccagaauuguuauagcaaaaauuuuag

SEQ ID NO: 33120 - RNA, 64 nt, Human
gcuaugccagguggugucucugccaggcuccucaggcccagacagaggccagcccacaaccuau

SEQ ID NO: 33121 - RNA, 64 nt, Human
aguauaggcuguggacaauaacugaugaauauagggcccagauggaccaaguggggccggggag

SEQ ID NO: 33122 - RNA, 64 nt, Human
aacuuugagcacaggaggaaaugcaaccagucagggcccagaaucaugcaaaucucagggguau

SEQ ID NO: 33123 - RNA, 64 nt, Human
cucagcuuggcugggaagugcuccucaccuguguggcccagauggcuccaacaagcaaaaggaa

SEQ ID NO: 33124 - RNA, 64 nt, Human
gaaaggaaauggcccuacuguagacagcuuauggggcccagaaaggcacugggcuuuaaagagc

SEQ ID NO: 33125 - RNA, 64 nt, Human
cgccgauuccgggagcuugggagcccugcgucagggcccagagccucgcacuugcugugugcga

SEQ ID NO: 33126 - RNA, 64 nt, Human
aagugacuguaggggggaccgucuagaaacaccaggcccagacacacggucccucaggucagga

SEQ ID NO: 33127 - RNA, 64 nt, Human
ccucaggauggcuuuuugucugagggccucauuaggcccagacugcugcugcugguaccagucu

SEQ ID NO: 33128 - RNA, 64 nt, Human
agaggaaggagucccagccucugggcagaccagaggcccagagggagagaguagcagaaggcuu

SEQ ID NO: 33129 - RNA, 64 nt, Human
ggguuaccagcuugauccacuguugcucuuagaaggcccagaaagucuuugggcauugccaaga

SEQ ID NO: 33130 - RNA, 64 nt, Human
caguguucuccuugggggcaggaaccuggggaggggcccagagcaaagggcaucagggagaaag

SEQ ID NO: 33131 - RNA, 64 nt, Human
gguuaucugcucuuggccaucugguggugguggcggcccagagucugaagaaauggcacaggga

SEQ ID NO: 33132 - RNA, 64 nt, Human
agugcugggauuacaggagugagccaccgcucccggcccagaacuuuuaauaaauauaaauaca

SEQ ID NO: 33133 - RNA, 64 nt, Human
ccauccuaaucugggagagaaggugacacagcugggcccagacccuggagagacagcucugcag

SEQ ID NO: 33134 - RNA, 64 nt, Human
gacuguauugcagggugaagagugggcucccgugggcccagagcugcacgccgguccacagaca

SEQ ID NO: 33135 - RNA, 64 nt, Human
ggugacucaggcagguaaucccagaacuuugggaggcccagacagaaggaucgcuugaggucag

SEQ ID NO: 33136 - RNA, 64 nt, Human
accucacccccaaacuccacgggugccccuagcuggcccagagccggcagugugagcccaaguc

SEQ ID NO: 33137 - RNA, 64 nt, Human
cugccauagauacccuaagcccagggccccuugaggcccagacucagccugcccacuggugccg

SEQ ID NO: 33138 - RNA, 64 nt, Human
uaguuucaucugcuucccugggaacuuacuaaggggcccagagcacuguuggaagucugguuag

SEQ ID NO: 33139 - RNA, 64 nt, Human
ccguggaccgcuuccccugccuucucucugccguggcccagagccggcccagcugcacacacac

SEQ ID NO: 33140 - RNA, 64 nt, Human
aacaguguugugacugucucaugggaagagcuggggcccagagggaccuugagucagaaauguu

SEQ ID NO: 33141 - RNA, 64 nt, Human
uaacgcacaggacacgugugcaauucauaggaacggcccagaucgcccucaugagugccaccug

SEQ ID NO: 33142 - RNA, 64 nt, Human
cugagaucuaaggaugucacagggccaacuugagggcccagagcaggaagcauucagagagcag

SEQ ID NO: 33143 - RNA, 64 nt, Human
uuauuaaaaucaagaauccugugccuguaguguuggcccagagugugguuacugcccugagggc

SEQ ID NO: 33144 - RNA, 64 nt, Human
uagaguuuguauagguaacuagguaacuuauuguggcccagauaaggcuuuaggaugccucagu

SEQ ID NO: 33145 - RNA, 64 nt, Human
cugcagugcaagcugcugcuccagagcguaccguggcccagacugauccucgaggccuccugcc

SEQ ID NO: 33146 - RNA, 64 nt, Human
ugcccacuauggcccugggagagccagaccccaaggcccagacaggcucagguuuccuuccuuc

SEQ ID NO: 33147 - RNA, 64 nt, Human
gcccaucccagccucucuggccagggccuuacugggcccagagcagagaaggaccuguccaaca

SEQ ID NO: 33148 - RNA, 58 nt, Human
ucgucuaugacuguaacugaaguggccgggcccagacaugccccuuccaaaacuggaa

SEQ ID NO: 33149 - RNA, 64 nt, Human
gccccugacucaaaaaagugguuuugaccagagaggcccagauggaggcuguucauucccugca

SEQ ID NO: 33150 - RNA, 64 nt, Human
agaugagccaccaucuccauuucucuuuaggggaggcccagaguuacugacacucaggcuuucu

SEQ ID NO: 33151 - RNA, 64 nt, Human
gaggcccagcuuuucccuugugguggccucuccaggcccagaacuuccucaagucggccucccc

SEQ ID NO: 33152 - RNA, 64 nt, Human
gccaccacccugagauuaugcggcucuucccucgggcccagaugcagacggugccgaacgcugg

SEQ ID NO: 33153 - RNA, 64 nt, Human
gugaauggucucugucaagcgggccgucucccuuggcccagagacggagugugggagugauucc

SEQ ID NO: 33154 - RNA, 64 nt, Human
agcaagaaggauugaggcugggccuuccccugccggcccagaggggcuucuguccuguguguug

SEQ ID NO: 33155 - RNA, 64 nt, Human
uagcaugacaggcuguucagccgggaggguggugggcccagaccacugucuccacccaccuuga

SEQ ID NO: 33156 - RNA, 64 nt, Human
uaaucacaguuuaguuuuuuucuuaaccucgucaggcccagaguucacuucuuuguuucucugu

SEQ ID NO: 33157 - RNA, 64 nt, Human
acucuaccuguacagagcagcgucccuuugguuuggcccagaggggcgaacaauugcaagggag

SEQ ID NO: 33158 - RNA, 64 nt, Human
ccugcagcucagcgcagcccagggcuccaagugaggcccagaagcccaugggcagggcuggggg

SEQ ID NO: 33159 - RNA, 64 nt, Human
ucacccacaguaucacacguggaaccgcagacagggcccagaagcuuuagagguaugaggcugc

SEQ ID NO: 33160 - RNA, 64 nt, Human
cauugcaggaccuugggcacaucugcugguggguggcccagagccucugcuggaaggggcagca

SEQ ID NO: 33161 - RNA, 64 nt, Human
ucaccuuacagcuggggaaacugaggccuggaauggcccagagucaccaaggcaaaguuggggc

SEQ ID NO: 33162 - RNA, 64 nt, Human
gaaagcaggagccccucuggugcuccuagaggguggcccagaggagcugugccagggcguggag

SEQ ID NO: 33163 - RNA, 64 nt, Human
ccagggggccgcaggggucucuccacccugcaggggcccagacugccugcaggucaggcacagg

SEQ ID NO: 33164 - RNA, 64 nt, Human
cuuccuauucaaggagaugaugaccuggguccagggcccagaccuggacuccaaggccggccug

SEQ ID NO: 33165 - RNA, 64 nt, Human
ccuucuccauaucuccauggcccugucccaggccggcccagaugugucccccccaggccuuguc

SEQ ID NO: 33166 - RNA, 64 nt, Human
uggagauaggaggcccagguggcagguagcaggaggcccagaucacccauccuccccugggguc

SEQ ID NO: 33167 - RNA, 64 nt, Human
caccccuucccaagccuucuagcgcagggccugcggcccagacguccagggagccggccccucc

SEQ ID NO: 33168 - RNA, 64 nt, Human
cucugaggugcaaagaaugcacuuuucccuauggggcccagaguuugccuuuucugccaggcag

SEQ ID NO: 33169 - RNA, 64 nt, Human
gggugaagacaagcaagucccccuggaggcggguggcccagaaagccaucuacaggguucccua

SEQ ID NO: 33170 - RNA, 64 nt, Human
uuuggcuucucacucuccaaguaacccugaauuaggcccagaauggcugaggcuuggagcaucu

SEQ ID NO: 33171 - RNA, 64 nt, Human
ucaggacacuuggcuuuggggggaaggaaacugaggcccagagaggggcaaccacuggccaagg

SEQ ID NO: 33172 - RNA, 64 nt, Human
uggcuaagagccuggccuccagccccagcaguguggcccagagcaggggccgacugccaaagua

SEQ ID NO: 33173 - RNA, 64 nt, Human
ggccccaccugaaggguggaugugcuggagggguggcccagagccauacugcguccacccugag

SEQ ID NO: 33174 - RNA, 64 nt, Human
cacuuugggcuuaguauuucucaggaagagcuauggcccagaaacaacaggggaaacuagaguu

SEQ ID NO: 33175 - RNA, 64 nt, Human
cagguccugggcagcccacaguagugcuagcugaggcccagaggaacgggaggaaagggaggca

SEQ ID NO: 33176 - RNA, 64 nt, Human
cuugcaagcaacaucugcucuguuccucagguggggcccagagcccuuccccgagacugcugau

SEQ ID NO: 33177 - RNA, 64 nt, Human
aaugaggaugaagucacuauccuagaggcugcuuggcccagaagagccaggcacagagcugcag

SEQ ID NO: 33178 - RNA, 64 nt, Human
ccagcucgcccucuucuaccucccagcgagaccuggcccagaaagggugccgcagcaaggagug

SEQ ID NO: 33179 - RNA, 64 nt, Human
gaaccucggucaguguuucccugucugggggcagggcccagagcgagcacgcgucuggcggcug

SEQ ID NO: 33180 - RNA, 64 nt, Human
gcugcccuuuggguaggugcugggcuccugggagggcccagaugauggggugaggcaugucuuu

SEQ ID NO: 33181 - RNA, 64 nt, Human
ggcccugcuucucugcuccccugggugaugggugggcccagaagguggcagucccacaccuugu

SEQ ID NO: 33182 - RNA, 64 nt, Human
uccuaggaugugcuuguucuggaaggaugacaugggcccagacugaacaagucagcuugaugau

SEQ ID NO: 33183 - RNA, 64 nt, Human
auagccccagacugggcccaggcaggucugcaagggcccagagugaaccguccuuucacacauc

SEQ ID NO: 33184 - RNA, 64 nt, Human
aggcuuaucuccagagggaggugcccuggacuggggcccagauguucagggacccugccuacac

SEQ ID NO: 33185 - RNA, 64 nt, Human
cgcugcaccacgggguugcucuguucuccuguccggcccagacucuucuguguggcgccgccga

SEQ ID NO: 33186 - RNA, 64 nt, Human
cucaagaguccgccugcuuggagcuggacccagcggcccagagucuagccagcuuggcuccaau

SEQ ID NO: 33187 - RNA, 64 nt, Human
cacuaaagaagccucuucuauuuaaugcagacccggcccagagacugugcgugccacuaccaaa

SEQ ID NO: 33188 - RNA, 64 nt, Human
acugucagcaacuggcacaggccuuugugagucuggcccagaucagcaauaaaagaggagucau

SEQ ID NO: 33189 - RNA, 64 nt, Human
aagguagccuggaugagcugaguggagccaggcuggcccagagcugagaugggagugcgguaca

SEQ ID NO: 33190 - RNA, 64 nt, Human
ccuucagggcugcaagaguuauugccuagcacagggcccagacagggcuggacuagacacgaug

SEQ ID NO: 33191 - RNA, 64 nt, Human
cacgcccauguauguccccugcguguucauccugggcccagaucccccugccccagcaagacuc

SEQ ID NO: 33192 - RNA, 64 nt, Human
cugccuuccuugggggucugagaugaggccuuauggcccagaggggaacuugauucaaaaauuu

SEQ ID NO: 33193 - RNA, 64 nt, Human
ucugaccuucagcccucccuacagccggggguguggcccagagaagcuuccagcacagcccucu

SEQ ID NO: 33194 - RNA, 64 nt, Human
uugaaacaccccauccccucacguucucaccccaggcccagaaguagguugcaacugccuuugg

SEQ ID NO: 33195 - RNA, 64 nt, Human
gccugccaggccaggagugggcuggagcugcugaggcccagaaggcccgcauaguuccucacca

SEQ ID NO: 33196 - RNA, 60 nt, Human
ggggcuccugccucuucugacuucacugggggcccagaggcagauggguggguggguggg

SEQ ID NO: 33197 - RNA, 64 nt, Human
aaauuccagggaccacugggugagagaggaauaaggcccagagcgaggaaaggauuuuaccaaa

SEQ ID NO: 33198 - RNA, 64 nt, Human
uuagagaaaagauaauuuauccucauucaacacaggcccagaaaauugugucccagaaggaugu

SEQ ID NO: 33199 - RNA, 64 nt, Human
cauggggugggcaggccuggggugaaaugagaaaggcccagaacgugcaggucugcggagggga

SEQ ID NO: 33200 - RNA, 64 nt, Human
gcucagcagcccuggacccgcgugcguuacgucaggcccagaugcagggcggcuuuuccaaggc

SEQ ID NO: 33201 - RNA, 64 nt, Human
agggggacacaguggugcucugcugaguugugagggcccagaucacagaucccaugugagaaag

SEQ ID NO: 33202 - RNA, 64 nt, Human
agccuuagaaaauccauguacucuguuguuagagggcccagaguuccuucuccacccccgcucu

SEQ ID NO: 33203 - RNA, 64 nt, Human
aaaacaugaccguggggccaggauguuucuggcaggcccagaagugcuggccguucuuccccag

SEQ ID NO: 33204 - RNA, 64 nt, Human
guccccucuccagcaagccuccaccagcaagcucggcccagagcuucccuuccggcuggcucug

SEQ ID NO: 33205 - RNA, 64 nt, Human
gguugccuugaauguggacucuggaagagccaggggcccagaaugccgggggaggcuucugagu

SEQ ID NO: 33206 - RNA, 64 nt, Human
gacaaggcuggcaaacccucccagaaacaucucuggcccagaaagccucucucucccucccucu

SEQ ID NO: 33207 - RNA, 64 nt, Human
acugggucuucaaugacaggcuuggacuagcuguggcccagacaucggcccugcccagaauugc

SEQ ID NO: 33208 - RNA, 64 nt, Human
aaagcaccauuugcuguccagcugccugucguuuggcccagaccacccucagaaaaaaaccagc

SEQ ID NO: 33209 - RNA, 64 nt, Human
ggaugauagugaaacugaccagccacagcagacaggcccagauugagguggugccuucugccuc

SEQ ID NO: 33210 - RNA, 64 nt, Human
cgauagguggcaaaaccuuaagauuguguacuggggcccagaauuuuuauuucuaggaauguau

SEQ ID NO: 33211 - RNA, 64 nt, Human
gacacagagcacagcucaugggcaacaucacuggggcccagagagagcuguccgccagugcauc

SEQ ID NO: 33212 - RNA, 64 nt, Human
uugguauuucagcagcagugugcaauuuuugcuuggcccagagcuucauucuccuggcuuuuag

SEQ ID NO: 33213 - RNA, 64 nt, Human
gcaguggaaacaccagauagaagaucuuaggagaggcccagaaaugcaucaccuugucaugaca

SEQ ID NO: 33214 - RNA, 64 nt, Human
cccucuagcaucacuccugagcugcgggagagguggcccagagaacagcagagucaguuacacc

SEQ ID NO: 33215 - RNA, 64 nt, Human
uacauguggcccaacacaauucuucuuccaacguggcccagagaagccaaaagauuggauacgc

SEQ ID NO: 33216 - RNA, 64 nt, Human
ugccuuccccagcuugcccauuucccugccccaaggcccagagcuccccccagacuggagagca

SEQ ID NO: 33217 - RNA, 64 nt, Human
gcccuagggcugggguucucaagccccuggcccuggcccagagauuuggauucccuuggcggcc

SEQ ID NO: 33218 - RNA, 64 nt, Human
agcauccuuggucaucauugucuccuucccaccuggcccagagaugcuuaaauccaaguuguuu

SEQ ID NO: 33219 - RNA, 64 nt, Human
gcacaugcgagugccguguggcccugggacccugggcccagaaaggacgaugaacuaccugcag

SEQ ID NO: 33220 - RNA, 64 nt, Human
augccggcagcauuuuggauuuugugcaaucaugggcccagaauaggcaagguuuuauuuucuu

SEQ ID NO: 33221 - RNA, 64 nt, Human
ucaggugcugguacugacccacuaaucugccauaggcccagaaauaucuucagaaguacgugag

SEQ ID NO: 33222 - RNA, 64 nt, Human
ccuggcccucucugaaggaggccaccuccuaaaaggcccagagagaagagccccacucucagag

SEQ ID NO: 33223 - RNA, 64 nt, Human
cacugugacugggaccugaaugaccugcagucagggcccagaguugggacucuauacuacccug

SEQ ID NO: 33224 - RNA, 64 nt, Human
cuuguuuucccagagauuuccugggucugccagaggcccagacaggcucacucaagcucuuuaa

SEQ ID NO: 33225 - RNA, 64 nt, Human
gcuuuccccaucuguuggaccaaauaaucucaaaggcccagagaggacagugaccauccacaga

SEQ ID NO: 33226 - RNA, 64 nt, Human
gggcaaaucugagagugggaaggccaaaggccgaggcccagauuuaguauucacuagcagcgcc

SEQ ID NO: 33227 - RNA, 64 nt, Human
uuucuuacauaguugauggcucgauaucugugguggcccagauuguuuuguuuuguuucgcuuu

SEQ ID NO: 33228 - RNA, 64 nt, Human
ggcgcuuugauugccugaguuucugacacuucagggcccagagguccugcgaggggcagaacug

SEQ ID NO: 33229 - RNA, 64 nt, Human
ggccagggaggcgcagggacauggggcaagccagggcccagagcccuugacuguacagagacuc

SEQ ID NO: 33230 - RNA, 64 nt, Human
uugcaggguccccuuccccggcacccaugcgccgggcccagagcucccucugccugcgggauga

SEQ ID NO: 33231 - RNA, 64 nt, Human
aggcaggaggaaagcaaagaccuccauuuccagaggcccagaggcugcccucugagguccccac

SEQ ID NO: 33232 - RNA, 64 nt, Human
gcugucagucccucuaucccuucuccuguccaggggcccagagagaaacacaccuaccccuggc

SEQ ID NO: 33233 - RNA, 64 nt, Human
gcucuguucuucccccuccuuaggccccagccugggcccagacccauccucccagccagguuuc

SEQ ID NO: 33234 - RNA, 64 nt, Human
accucaaccauggcaagaaccagagguccaaagaggcccagacccagguccuugugcucagucc

SEQ ID NO: 33235 - RNA, 64 nt, Human
acccagguccuugugcucaguccugcgcaaaccaggcccagacccugcaagcauuuguugaugc

SEQ ID NO: 33236 - RNA, 64 nt, Human
ggaguccagccuaaucaagucaaauggagaaacaggcccagagaggaagguggcuuaccaagau

SEQ ID NO: 33237 - RNA, 64 nt, Human
gcucaccaaaaacuauuucuucagccccuucucuggcccagacccugugggcauggagauggac

SEQ ID NO: 33238 - RNA, 64 nt, Human
cacaguuccugcaccucagcagccagggaagcagggcccagaggagacccaucaacucaucugg

SEQ ID NO: 33239 - RNA, 64 nt, Human
uaagcacauccccuaggggagggggugagugaggggcccagagcccucuuuguggcuuccccac

SEQ ID NO: 33240 - RNA, 64 nt, Human
cccucuucccaucaauauccuaaaugugggggagggcccagagaauggcacccaagagccugcg

SEQ ID NO: 33241 - RNA, 64 nt, Human
ucuggugggcuccucagcucccaccccaggcuggggcccagauugugaggucugugugcaugug

SEQ ID NO: 33242 - RNA, 64 nt, Human
cugcccaggccuaggccccacagacuuuuaggcuggcccagauauuccccaguggaugggcaga

SEQ ID NO: 33243 - RNA, 64 nt, Human
cucaggagaagcucuacaaggaauaucugcagauggcccagaauggaagcuuccagugaggggg

SEQ ID NO: 33244 - RNA, 64 nt, Human
ugcccacauugcuauggugggaagagggccuggaggcccagaaguugcugcccugucuaucuuc

SEQ ID NO: 33245 - RNA, 64 nt, Human
gugagaagagaacauuuuguuuguggggcuaaugggcccagaggaggguaagacucugcugucu

SEQ ID NO: 33246 - RNA, 64 nt, Human
agguugugagcuggaaaagaaaguucuagacuguggcccagaauagggcuggggcagcucccag

SEQ ID NO: 33247 - RNA, 64 nt, Human
ucgcccggcccggacacagggaggacgcucccggggcccagaggcaggacuguggcgggccggg

SEQ ID NO: 33248 - RNA, 64 nt, Human
gcugguuucagcaggcgacuuucuuccaaugcugggcccagacuucuugccugggugcuggccu

SEQ ID NO: 33249 - RNA, 64 nt, Human
acuggaucuguucaaacagcaaacgcccacagauggcccagagguggugguagucagggugugu

SEQ ID NO: 33250 - RNA, 64 nt, Human
aggcuuaacauuaaguauuccuuggcccagcagcggcccagauugcggugugagauggugcccc

SEQ ID NO: 33251 - RNA, 64 nt, Human
cagcgccgccgcugacgccgccgacgccgcccucggcccagaccucggugaucacugagggauu

SEQ ID NO: 33252 - RNA, 64 nt, Human
cagagcucuggaggcugggaaguccauaguggagggcccagagcccagugaggacccuucugca

SEQ ID NO: 33253 - RNA, 64 nt, Human
gaggagguaacgaggagggcggacuccaggccccggcccagagauuuggacuuggcuggcuugc

SEQ ID NO: 33254 - RNA, 64 nt, Human
cugaggaggugcauggccugagcauuguuugucuggcccagaggagagagcuuggguucccaua

SEQ ID NO: 33255 - RNA, 64 nt, Human
ccccggcauuauuuuauucccaagccagcagaccggcccagacagccaggcuguggcuggucca

SEQ ID NO: 33256 - RNA, 64 nt, Human
ucucuccaccccauuuuacagaggagaacaccaaggcccagaggaaguuaagggagagucaaug

SEQ ID NO: 33257 - RNA, 64 nt, Human
ggugccuucccuguacccgcagcagccacaagugggcccagacuauugcagccucccauaaaca

SEQ ID NO: 33258 - RNA, 64 nt, Human
uguaucucugaggaagaggagcgaggacaacguuggcccagaugggggcugaaucauucaacug

SEQ ID NO: 33259 - RNA, 64 nt, Human
gcaaauccuccuuacagaucugaguggaugaucaggcccagagcaacccugagaccccagguac

SEQ ID NO: 33260 - RNA, 64 nt, Human
ucuggggcucuaggguugcuggagccugagucagggcccagaggcugaguuuucucuuuguggg

SEQ ID NO: 33261 - RNA, 64 nt, Human
agcagauuucuaugguacccuguguuaguaaaggggcccagaaaucugggauguacuguuugcu

SEQ ID NO: 33262 - RNA, 64 nt, Human
acgggcacuggccagcugcucucuccaagcagguggcccagaucccacccacguggacuuucuc

SEQ ID NO: 33263 - RNA, 64 nt, Human
ccucuaacucacaguggguuuugugaggcucuguggcccagagcagaccugcauaucugagcaa

SEQ ID NO: 33264 - RNA, 64 nt, Human
uuuugaauaaugguuuugguuaccugggaaggcaggcccagaacccauuuccuugacuugcagu

SEQ ID NO: 33265 - RNA, 64 nt, Human
gugaucacagcucacugcagccucaaccucugaaggcccagaugaucuuccugccucagcuccc

SEQ ID NO: 33266 - RNA, 64 nt, Human
cagcauaaggauguuuugcaacuuuccagaaucuggcccagaaauuagggcucaauuuccugau

SEQ ID NO: 33267 - RNA, 64 nt, Human
aguggacgacccagccuccccauaccgggccucuggcccagaccuaagcccugcccacaaagac

SEQ ID NO: 33268 - RNA, 64 nt, Human
ccugaaggcucuaagccuggaacacccugggguuggcccagaaggaggcacaucagucccaaaa

SEQ ID NO: 33269 - RNA, 64 nt, Human
uguugggcaggugguggggcugggccauggagcuggcccagaggccccucagcccuuuguaaag

SEQ ID NO: 33270 - RNA, 64 nt, Human
ggcguuuaggacugggcgucuccaagcccaccauggcccagauggacgugcaaagcccuuggaa

SEQ ID NO: 33271 - RNA, 64 nt, Human
uuguccucacuaacccggagcgauuccagacgguggcccagauggugagagucuggaggaauga

SEQ ID NO: 33272 - RNA, 64 nt, Human
gaaccuuugggacacucugccauggcuggcgugaggcccagaggaccacgcagaggcaauggua

SEQ ID NO: 33273 - RNA, 64 nt, Human
cucgcugucucccucugugcagccacagccagagggcccagaauggccccacucuguucccaag

SEQ ID NO: 33274 - RNA, 64 nt, Human
ucacaacaguucuuguuagaaucaugggauguguggcccagagguaagaauagaauuucuuucc

SEQ ID NO: 33275 - RNA, 64 nt, Human
cuccagcuccuucucuuuucucagggacaaaugaggcccagagagaauacgaccuguguaaggu

SEQ ID NO: 33276 - RNA, 64 nt, Human
accuuccacucaccugugugcagacccucagcuaggcccagaugguggggacagacggcagaga

SEQ ID NO: 33277 - RNA, 64 nt, Human
auuauuaaagauugcuugguagugaaaagggaagggcccagaaucugacuggcugauucugucu

SEQ ID NO: 33278 - RNA, 53 nt, Human
agauggaggccacagacugagcuggcccagagggguggaacugcugaugggau

SEQ ID NO: 33279 - RNA, 64 nt, Human
gacagaugccacacaaggauagaugcuggcccagggcccagagcccagcuccaaggggaaucag

SEQ ID NO: 33280 - RNA, 64 nt, Human
gacuggaaggguucccuuguccuagacauugaggggcccagauaagaccaaaaccaagcauaag

SEQ ID NO: 33281 - RNA, 64 nt, Human
uuuguaaauguauaaacucaccucugguaacaguggcccagacgcugcuuugugcuaaaagcau

SEQ ID NO: 33282 - RNA, 64 nt, Human
cucauagaucauaguccaauccccuagacccaaaggcccagacacgcaggguucucuauuucuc

SEQ ID NO: 33283 - RNA, 64 nt, Human
cugucuuuacccuuuagaaacuggcauguguuagggcccagauuucaccagauacacaauccuc

SEQ ID NO: 33284 - RNA, 64 nt, Human
ugaugucacucaugguggacgcguucugcucacgggcccagagcccugugaaaugcaucaaggu

SEQ ID NO: 33285 - RNA, 64 nt, Human
ggcuaauugaaguauuuuaugacuccucauuccuggcccagaggguugucuuugaaacccuguu

SEQ ID NO: 33286 - RNA, 64 nt, Human
cgcccacgugcucagccacccucuggcucagcggggcccagacccaccucggcacggacacccc

SEQ ID NO: 33287 - RNA, 64 nt, Human
ggccccacaggcuccccaggaggcucgugucuuuggcccagagccagccuuaguuugucccugc

SEQ ID NO: 33288 - RNA, 64 nt, Human
ccuacacagaaacacccgugacccacuaugagauggcccagaugugggacccgguaccaugcuc

SEQ ID NO: 33289 - RNA, 64 nt, Human
uuacaggaaaauuauugacagcaaugguuucccgggcccagaaacucuggaaagauuuugucca

SEQ ID NO: 33290 - RNA, 64 nt, Human
ccauaucccuuugcagucaguucaucccuacccuggcccagaugaucacugaucuugucauuau

SEQ ID NO: 33291 - RNA, 64 nt, Human
gguggcucacaccuguaaucccagcacuuugggaggcccagacuggcggaucaccugaggucag

SEQ ID NO: 33292 - RNA, 64 nt, Human
ucccaaaguucccucaaaacugaugugggcacuuggcccagaaguuguuugcuaaugaucaguc

SEQ ID NO: 33293 - RNA, 64 nt, Human
ccgcagaugaccuagcugcggugugagagagcauggcccagacaagcagcuggguuggcuucug

SEQ ID NO: 33294 - RNA, 64 nt, Human
aaccaagacuggaagguccccucuaccccucccaggcccagagcuagcugacuguguaugagcc

SEQ ID NO: 33295 - RNA, 64 nt, Human
auucuaaucugacuuugccacugugcccagcucuggcccagaggguagagugccuccuguggaa

SEQ ID NO: 33296 - RNA, 64 nt, Human
guuggggcagcuuacuccagcccuggcccaaggaggcccagaaguuggaaagagauggaaugug

SEQ ID NO: 33297 - RNA, 64 nt, Human
acacucuuugguggugacugaggcaucauuagaaggcccagacgauuuccacuauucacagcau

SEQ ID NO: 33298 - RNA, 64 nt, Human
augagcuagggaaggcugaggaggacaggagaagggcccagacacucccuccagugaguguccu

SEQ ID NO: 33299 - RNA, 64 nt, Human
gcccuguggugcugggagaugcucucugaggcaaggcccagaccuggccucugccauccucccu

SEQ ID NO: 33300 - RNA, 64 nt, Human
gagccccagcaggggccacucuauugaauggcauggcccagacccucggagggccaggcaacag

SEQ ID NO: 33301 - RNA, 64 nt, Human
ccgccuguccucagccagcacugcagggaucccaggcccagacucuggaggccuucacugaucc

SEQ ID NO: 33302 - RNA, 64 nt, Human
ggagacugugaggaucccaggauucaguauuccuggcccagagggcccuugcuggcuacugggu

SEQ ID NO: 33303 - RNA, 64 nt, Human
cccuaaacuuuugguggccuggggcaugucuugaggcccagacuguuaaccaggcucugcuggc

SEQ ID NO: 33304 - RNA, 64 nt, Human
ucacuaaucccaaaggucccaaggaacaaguccaggcccagaguacugugaggggugauuuuga

SEQ ID NO: 33305 - RNA, 64 nt, Human
cucuuccaccagaagcuguucgugcagcuggggaggcccagaagcagggaugccaucuguugug

SEQ ID NO: 33306 - RNA, 64 nt, Human
ccuuuucuccccaccaccccuccugccccacuuuggcccagaaaccaaaugugaacuuccuguc

SEQ ID NO: 33307 - RNA, 64 nt, Human
ccuggacagcuaccaggaucucacugggucucagggcccagagcuuuggccagagcagagaaca

SEQ ID NO: 33308 - RNA, 64 nt, Human
ucuaaacaagaaauugcagcauauucuucucuuuggcccagagguggguuaaacuguaagggac

SEQ ID NO: 33309 - RNA, 64 nt, Human
gccacgcagccaggacaccgggcagggccgcccgggcccagaggagcugggagccgggccgcag

SEQ ID NO: 33310 - RNA, 64 nt, Human
aguuaugaaaagauaacuucaugaagacuuaacuggcccagaagcugauuuucaugaaaaucug

SEQ ID NO: 33311 - RNA, 64 nt, Human
uccuuguacaacccagacccaucuuguauuuuguggcccagaaaacugaacgauuauuuuguuc

SEQ ID NO: 33312 - RNA, 64 nt, Human
cgcggcaccaggagauggaggaugucaucaggcuggcccagaaggaggaggagaugaagguagg

SEQ ID NO: 33313 - RNA, 64 nt, Human
ucgagaagacuaaggcagaugggcuuccaggacuggcccagaccagccagggcuccuuguagaa

SEQ ID NO: 33314 - RNA, 64 nt, Human
agcagugcccccagcacuguccccaccuugcuagggcccagaaccaagcgucccccagccccga

SEQ ID NO: 33315 - RNA, 64 nt, Human
aagcacaggugggcuucccaguggcugcugcccaggcccagaccuucuaggacgccacccagca

SEQ ID NO: 33316 - RNA, 64 nt, Human
caacagaugauauugagugucggguggggaaggaggcccagacucugcuucggccaugauuugu

SEQ ID NO: 33317 - RNA, 64 nt, Human
acuguucacucugugucuuuugaagugccuugaaggcccagaugaaauuuuaaagggagggggu

SEQ ID NO: 33318 - RNA, 64 nt, Human
agccucugggauauguggauucggagaaagcugaggcccagaggggacacucgacccagucuaa

SEQ ID NO: 33319 - RNA, 64 nt, Human
aaugaggguacugucaccugccuuaauguagguaggcccagagucuuacauuuaagaucuuaca

SEQ ID NO: 33320 - RNA, 64 nt, Human
ugcacugccagcgccugucuuacccgguggccuuggcccagaaggagccagaggcagcagccuc

SEQ ID NO: 33321 - RNA, 64 nt, Human
uuaggagcgccuggaagcagaaccaguagcuacaggcccagagauggacuggagagugaggagg

SEQ ID NO: 33322 - RNA, 64 nt, Human
gagcuccucucaucaaagccuuuacaaggugcugggcccagaggcuuugccuugacagaguggc

SEQ ID NO: 33323 - RNA, 64 nt, Human
agagcuugacccaagaacuacuccacauucggauggcccagacugacuccauccccugacuuuc

SEQ ID NO: 33324 - RNA, 64 nt, Human
uucuagcucuuuuaacaccccuuuucccccugcuggcccagagggagacccaggacugaacucu

SEQ ID NO: 33325 - RNA, 61 nt, Human
auggccaguacugggugugaggccuggccugggcccagaugcugaucgggccagggacagg

SEQ ID NO: 33326 - RNA, 64 nt, Human
gcugucucccugcaggcuccacagacuguccuggggcccagaggagcuggugcugaccuagcua

SEQ ID NO: 33327 - RNA, 64 nt, Human
cccgccucauuucagcccagggugcucauccaggggcccagaacagucccaccugugcugcugu

SEQ ID NO: 33328 - RNA, 64 nt, Human
uggcagggccguccaucagcgcugaccuuccgggggcccagagcuucccagcccugagucaagc

SEQ ID NO: 33329 - RNA, 64 nt, Human
gcgggccugccccaacccccagcauucccgggugggcccagaccccaucaccaagacuggccac

SEQ ID NO: 33330 - RNA, 64 nt, Human
ugugucuccuucccauuugggacacccaggugagggcccagacaucuggauguggucagaccuc

SEQ ID NO: 33331 - RNA, 64 nt, Human
gugccaggcaagacaagccccucagcaggagagaggcccagaggcuccagcuggccaccgugcc

SEQ ID NO: 33332 - RNA, 64 nt, Human
cggaugaccgcuuccacgagaugcacguggcucuggcccagaaggaccaggagaucgccuuccu

SEQ ID NO: 33333 - RNA, 64 nt, Human
ccuccccaggccacccaacuugggcaccucccugggcccagaacugccuuccauucaaugggga

SEQ ID NO: 33334 - RNA, 64 nt, Human
uugaggaaugaugaugcacauucugcugugaggaggcccagaaaaggccaaccagggcccaacc

SEQ ID NO: 33335 - RNA, 64 nt, Human
cagcugcacagucggugccugggaggcacguagaggcccagagagucccuggggguucugcucu

SEQ ID NO: 33336 - RNA, 64 nt, Human
uuccagaaggaaggagaaaacucuugucaagaauggcccagaggaaugccucgcacaaaagguc

SEQ ID NO: 33337 - RNA, 64 nt, Human
cuggucccacucaguccauagcagagaaugaaagggcccagagaggguggugaccucugccuga

SEQ ID NO: 33338 - RNA, 64 nt, Human
agguguccuccaugcccucaggcagcagagaacuggcccagagcccuuggaguguugguggaga

SEQ ID NO: 33339 - RNA, 64 nt, Human
acaggggaguuccugcauuuccugccagggcagaggcccagaggagcgacccccugcuuccacu

SEQ ID NO: 33340 - RNA, 64 nt, Human
cagcaggcauaaggcaccaguuacccugcauguuggcccagaccucaggugcuagggaaggcgg

SEQ ID NO: 33341 - RNA, 64 nt, Human
guucagcccagugacgguggggcuggggccuggaggcccagauacagcacauccacccaggucc

SEQ ID NO: 33342 - RNA, 64 nt, Human
cggcgccuggguggcuugccgcccacacuucaggggcccagacuuacacccugacugucccacc

SEQ ID NO: 33343 - RNA, 64 nt, Human
cucacccagagguuucacccuccuucaucucacgggcccagagcccugucucacucaccccacc

SEQ ID NO: 33344 - RNA, 64 nt, Human
ggagcgagaagccaaggccagguucuggguguagggcccagagaagcagaacagcccagagccc

SEQ ID NO: 33345 - RNA, 64 nt, Human
ccugccaauggacuaacuugucuuuggacccugaggcccagagggccugcaagggagugaguug

SEQ ID NO: 33346 - RNA, 64 nt, Human
uccccuugucugaacuggagccaugggcacaaagggcccagauuaaagucuuuauccucagucu

SEQ ID NO: 33347 - RNA, 64 nt, Human
uuccauccacucaccuuaccccauagcaucuugcggcccagaaaccagagccauuugucucaga

SEQ ID NO: 33348 - RNA, 64 nt, Human
gggcucaggcugggugcucugccaugggcugaguggcccagauauucuucuguccaucuuuggc

SEQ ID NO: 33349 - RNA, 64 nt, Human
ggcucaggacccaguccaggccuucuacgggcuaggcccagagacuuggguugcuggucccccu

SEQ ID NO: 33350 - RNA, 64 nt, Human
ucaucaaugcaauaagauugcgccugagauacaaggcccagaagccugaucuuugggcaucaga

SEQ ID NO: 33351 - RNA, 64 nt, Human
gccagugguccaaaaaggcugcucucuuccaccuggcccagacccuguggggcagcggagcuuc

SEQ ID NO: 33352 - RNA, 64 nt, Human
gggaucuggcauccuccuaaggaccggggcgcguggcccagauaagaauagguguuccuuugug

SEQ ID NO: 33353 - RNA, 64 nt, Human
uugaguugugguggacgcuggccugggaugagagggcccagaagaccuucguauccccucucag

SEQ ID NO: 33354 - RNA, 64 nt, Human
cuaccacauucuggugcuguccucacucgccccuggcccagaggcuccugaagaugcugggcgg

SEQ ID NO: 33355 - RNA, 64 nt, Human
ggcggcuccaguguggggugaggcagugagguuaggcccagagagcuggaguuggcucagauga

SEQ ID NO: 33356 - RNA, 64 nt, Human
gugggauugagggggcugggucccccaggacacgggcccagaagagccccacgggcuuccugca

SEQ ID NO: 33357 - RNA, 64 nt, Human
gcacuccccggccugcauccggcuuggguacacaggcccagaggacuggggugacucacgggcc

SEQ ID NO: 33358 - RNA, 64 nt, Human
cguggagacaguauuucuuucugucugucccuuuggcccagacccagccugaccaacgaugagc

SEQ ID NO: 33359 - RNA, 64 nt, Human
ucccccacuggauucccuacaaggagaggccuugggcccagaugagccaguacagacuccagac

SEQ ID NO: 33360 - RNA, 64 nt, Human
uggacugcagugcaggagaugacagagugaggagggcccagagcagaauucuggccccagaacu

SEQ ID NO: 33361 - RNA, 64 nt, Human
cauucugaauaccaaaaacagggcuucacagccaggcccagaagaggucuggugauaauggcug

SEQ ID NO: 33362 - RNA, 64 nt, Human
agcgagcccacuguaucugggcccaaggccagagggcccagagagaagccugagcaccguguua

SEQ ID NO: 33363 - RNA, 64 nt, Human
ggauacuguggccccgcugccaggacaucuguugggcccagaccccuaugccuuguuccgagca

SEQ ID NO: 33364 - RNA, 64 nt, Human
gccuucauaagcacacacguccauucccuacuaaggcccagaccuccugguaucugccccgggc

SEQ ID NO: 33365 - RNA, 64 nt, Human
ggaaggcaggagccuuccuuucuccugccccaagggcccagacccugggcaaacagagcuacug

SEQ ID NO: 33366 - RNA, 64 nt, Human
aagcagacacauagaucaauggaacagaauagagggcccagaaauaaagcuacacaccuacaac

SEQ ID NO: 33367 - RNA, 64 nt, Human
agauuguaauuggagggggcgcgggaagacuuugggcccagaaccaucuuucuauuguuugugu

SEQ ID NO: 33368 - RNA, 64 nt, Human
caggcaggggugggagagccagcucucucuacccggcccagagaccccuuccuuuccucugcag

SEQ ID NO: 33369 - RNA, 64 nt, Human
aacagcgucuccaucuaaaucccaggggaacacaggcccagaugacaucccuuugaccacaucg

SEQ ID NO: 33370 - RNA, 51 nt, Human
agcuccuccaguccaacugauggcccagaugcagcaggaggccagaggaca

SEQ ID NO: 33371 - RNA, 64 nt, Human
ggcagaaccagagagaugggacaugguagacuguggcccagaccccagagcagagaaacuuguu

SEQ ID NO: 33372 - RNA, 64 nt, Human
gggagcaaugucacccugccuccagcuagcuaugggcccagaguuucucccugagucgcuguug

SEQ ID NO: 33373 - RNA, 64 nt, Human
cccccauacacaccuaggcuugaaaugcccuacaggcccagaacuuucucacaucugaaaugga

SEQ ID NO: 33374 - RNA, 64 nt, Human
guggagucugagucugaguccugucucugccugcggcccagaaguuucccucaaaugcgcgugu

SEQ ID NO: 33375 - RNA, 64 nt, Human
cugaacucgcuucucugugacugauguuaggcugggcccagaggcacagccggggccugccuag

SEQ ID NO: 33376 - RNA, 64 nt, Human
ccuuguuuuccgcuaauuccagggcagauuccagggcccagagcuggacagacaucacaggaua

SEQ ID NO: 33377 - RNA, 64 nt, Human
gagaaaugggggccuugaugcucacccugguucaggcccagagguccaagcuauacugugcagg

SEQ ID NO: 33378 - RNA, 64 nt, Human
cugcaagugugugugugugugaaagagagaggggggcccagaggccgccuuuugaaauguuugc

SEQ ID NO: 33379 - RNA, 64 nt, Human
augagagacuugcaccuuaacucugggaccugcuggcccagaguggagcuagggcuagguguca

SEQ ID NO: 33380 - RNA, 64 nt, Human
ucucuuccuggcagcuccagaagguguugccaggggcccagaugcccugacacugcuugaauac

SEQ ID NO: 33381 - RNA, 64 nt, Human
auccuccccuucccugcaaacaugggguuggcugggcccagaagguugugaugaagaaaagugg

SEQ ID NO: 33382 - RNA, 64 nt, Human
uuggucagccccacuccagcacggggugaacggaggcccagaguacuagggaaggaggaaggga

SEQ ID NO: 33383 - RNA, 64 nt, Human
uacagggcugggggggcccuuggcugcgggagaaggcccagagcccuggaggagccaccacccc

SEQ ID NO: 33384 - RNA, 64 nt, Human
aaagugauggacaggaaggggcagagugagucacggcccagacugggcaccuucgcgucucagc

SEQ ID NO: 33385 - RNA, 64 nt, Human
ggguccugagggccgggaagccgaagaguccacaggcccagaggaagcagaagcccccgagucc

SEQ ID NO: 33386 - RNA, 64 nt, Human
aggggaaauggggaaagcagaacugaagccacuuggcccagaaagcugcggauuggggugauaa

SEQ ID NO: 33387 - RNA, 64 nt, Human
agacucccaaaggagcccaggcucaggcaggccuggcccagagucacgcuggcaaccacgaguu

SEQ ID NO: 33388 - RNA, 64 nt, Human
uggcaugugaggccagggugggcaccaaagaccaggcccagagccaggggacagguuggggcug

SEQ ID NO: 33389 - RNA, 64 nt, Human
ccacagugggcuaucuaggcccucccucaccugaggcccagaguggacacagcuguuaauuucc

SEQ ID NO: 33390 - RNA, 64 nt, Human
gucucgcucccuacucuccuccccuuauucccgaggcccagaaaagaaaacaaaaacaaaaacc

SEQ ID NO: 33391 - RNA, 64 nt, Human
ggacagccuagcugggggcucccccauauucccaggcccagaagacagacccacagcccugccc

SEQ ID NO: 33392 - RNA, 64 nt, Human
ugccccucuaggucugggcagccaugaccugcagggcccagagacacuguccuuccccucaucc

SEQ ID NO: 33393 - RNA, 64 nt, Human
ccccucacuauccuaccccacccgcuccuugaagggcccagauucuaccacacagcagcaguua

SEQ ID NO: 33394 - RNA, 64 nt, Human
uagaauuuggagggaauuugaagaaaggaacugaggcccagaaagaggcagugauuugccaaag

SEQ ID NO: 33395 - RNA, 64 nt, Human
acccucuacccuccguggccauggcaacguccagggcccagaacccugaggagugagcggccga

SEQ ID NO: 33396 - RNA, 64 nt, Human
aaggcucguccauuccuccuguguuuuaguauuuggcccagagguuuccuaaaugguugccuug

SEQ ID NO: 33397 - RNA, 64 nt, Human
uuucaacuucuugaacuuggacaugaaggaugugggcccagaaucauguggccagcccaccccc

SEQ ID NO: 33398 - RNA, 64 nt, Human
cuuggagccugggccagcucaaggugggcacgggggcccagacaguacucuccaguucuggggc

SEQ ID NO: 33399 - RNA, 64 nt, Human
gcucccagccccuaccuugagacccucuucucugggcccagagagaggcguccuggugaggaca

SEQ ID NO: 33400 - RNA, 64 nt, Human
gaaaagaagauccuaucaugaauaaaagcuguauggcccagagaggagcucaugugucuaaagu

SEQ ID NO: 33401 - RNA, 64 nt, Human
cacugucucugcugagcagggaaggcucagacugggcccagagcccccguucuucugcguuaac

SEQ ID NO: 33402 - RNA, 64 nt, Human
gccauccccagggagguggcccaggaaggugccuggcccagaauaaggaacuggcauacugcaa

SEQ ID NO: 33403 - RNA, 64 nt, Human
cggccggcgggggcucuccuagugcccagagacaggcccagagguuuacaaguuuucuaagcuu

SEQ ID NO: 33404 - RNA, 64 nt, Human
aagaacggaaggcagaggacagaggcuggacgugggcccagaggcccacagggacgcccaccug

SEQ ID NO: 33405 - RNA, 64 nt, Human
gccuuucaccggguugcugguuucuuuucuguggggcccagacuucuguaaagcacacagaugu

SEQ ID NO: 33406 - RNA, 64 nt, Human
guuuuguguugcgucuuuccuugaauauuuuauuggcccagaguuagccuuucucaauuauguu

SEQ ID NO: 33407 - RNA, 64 nt, Human
cuagccucaacugacagcugaggaaaggcaauuaggcccagagaggcagagacacucgcuuaag

SEQ ID NO: 33408 - RNA, 64 nt, Human
ccccccgccacgaagguugagaacaaagccagggggcccagaggagcaauagcccugggccaca

SEQ ID NO: 33409 - RNA, 51 nt, Human
gugagaaaguugccaacuagaggcccagagggaggccaucucagucugucc

SEQ ID NO: 33410 - RNA, 64 nt, Human
ccgacgcuagcccgcggcgccgcgacgucugcacggcccagacccaggauuccaaacuugugaa

SEQ ID NO: 33411 - RNA, 64 nt, Human
accgcgcccacagccgcccugaggcuguaggcauggcccagaccugcgugauuuguacaaugua

SEQ ID NO: 33412 - RNA, 64 nt, Human
ugacagugacccucggcccccuuuugaguccucgggcccagaaucguaucccaaagcccuccca

SEQ ID NO: 33413 - RNA, 64 nt, Human
ucaaacauggaagaugaaaggggaggggaugucaggcccagagaagcaaguggcuuucaacaca

SEQ ID NO: 33414 - RNA, 64 nt, Human
gagagccccuggcccuggccccugcacaccaguaggcccagaauaaccgccacccuugccaucc

SEQ ID NO: 33415 - RNA, 64 nt, Human
cccauccucagugcccaaugcuguggccccaccaggcccagagccugguuggccauucucaugc

SEQ ID NO: 33416 - RNA, 64 nt, Human
gacccgggccaggaggcccggggcgcugagcucaggcccagaacuggcugauuucagggauacc

SEQ ID NO: 33417 - RNA, 64 nt, Human
uugguggcgaugucccagacaaucccaccaggacggcccagacaucccuacuggcuucgcuggu

SEQ ID NO: 33418 - RNA, 64 nt, Human
cgcacccuagccaggccccagggagccuccgcugggcccagacagcagcguuugguuuuaucca

SEQ ID NO: 33419 - RNA, 64 nt, Human
ucagccgacaguuuugaugagcagggaagucugaggcccagaggacggggggcccagcgguaag

SEQ ID NO: 33420 - RNA, 54 nt, Human
uccaaaaggauguucuauaaaaauggcccagaguauuuucaacaaagcgugcuu

SEQ ID NO: 33421 - RNA, 64 nt, Human
auggcugcaggguggaccagcugccuggcauucaggcccagaugccugcagggcuggggcucuc

SEQ ID NO: 33422 - RNA, 64 nt, Human
ccuaccagcaggaggagccagaggccagagucccggcccagaguggugaguagagugcccaguc

SEQ ID NO: 33423 - RNA, 64 nt, Human
ccguaaucaaucaaguugcugcagccuaugcacuggcccagaauaaaaaacguggugauucugc

SEQ ID NO: 33424 - RNA, 64 nt, Human
ccugcucucccucagugaguccucaaccacccugggcccagaaacagaggccugccgaggggag

SEQ ID NO: 33425 - RNA, 64 nt, Human
uaagaccuacuggggccagguaagaacaguaauuggcccagacagguaggugugauaaacagag

SEQ ID NO: 33426 - RNA, 64 nt, Human
uaaggugagagggaugcaggcauggguuggggguggcccagagaaacuuaugacagcuguacac

SEQ ID NO: 33427 - RNA, 64 nt, Human
cggggauuugggagugauguaucugggugguuguggcccagagucucucaugagguugcaguua

SEQ ID NO: 33428 - RNA, 64 nt, Human
gcgguuugcaguguccguucucauccaccugaugggcccagauaaaggcccccgcuguccagcc

SEQ ID NO: 33429 - RNA, 64 nt, Human
cggcugcccccgaaggcgcugcccaccccgcugaggcccagagcucgggagaugcccgccucgc

SEQ ID NO: 33430 - RNA, 64 nt, Human
ugccccucuccacucuugagcauggauacagccaggcccagagcaagacccugaagacccccaa

SEQ ID NO: 33431 - RNA, 64 nt, Human
gggcuuauuccucggaguagaaggguguacagggggcccagacuccacagugacuugccacauu

SEQ ID NO: 33432 - RNA, 64 nt, Human
gguaaagcucucagcucgaauucucaccuucaugggcccagaagauuauguacugagagaaucc

SEQ ID NO: 33433 - RNA, 64 nt, Human
cccaccucccaucucuccuuccaggcccaucccuggcccagagcaggagggagggagggacgau

SEQ ID NO: 33434 - RNA, 64 nt, Human
auuccuccuugggugcagccucagaguggccugaggcccagagggucuggucuggugagcuccu

SEQ ID NO: 33435 - RNA, 54 nt, Human
aguacgcucccagcgccugaggcuggcccagagcugucaggaccaugaagccag

SEQ ID NO: 33436 - RNA, 64 nt, Human
ucucugaccacccuggcaccuuaaauaaggaagaggcccagauugugaagacggacccauauau

SEQ ID NO: 33437 - RNA, 64 nt, Human
gccccuccuuccaggucuugaugggagggaggagggcccagaagcuggacaacuuaagccacuc

SEQ ID NO: 33438 - RNA, 64 nt, Human
ggaugccuggaucucuguaagggccagaagugagggcccagaggucugggucccccagggggca

SEQ ID NO: 33439 - RNA, 64 nt, Human
cuccccucgacucaagcccuuguccucauuauccggcccagaccaaagauucccucaucccugg

SEQ ID NO: 33440 - RNA, 64 nt, Human
ccugccucaccuucaucaggggguggccaggaggggcccagacugugaauccugugcucugccc

SEQ ID NO: 33441 - RNA, 64 nt, Human
acagaacggagccaucccccaagacccuguccaaggcccagauguuagccaaggacuuguccca

SEQ ID NO: 33442 - RNA, 64 nt, Human
aguccaccccaggggcuggaaaccuggaguucagggcccagacuuugggguccgggagcugaug

SEQ ID NO: 33443 - RNA, 64 nt, Human
ucugaugaguuaggccauggaccugacccaguuuggcccagaggacucugcuggugaccugaaa

SEQ ID NO: 33444 - RNA, 64 nt, Human
uugcggggucucgggcgugagugcgcugucugcuggcccagacuuuuucgggccgccggugcgg

SEQ ID NO: 33445 - RNA, 64 nt, Human
cucacacuucacaacaauuuccucaacacuugagggcccagaaagucugaucucuccagaauga

SEQ ID NO: 33446 - RNA, 64 nt, Human
ucuugccuaacucugugguuuuuggaccccauggggcccagacagagcacaggagcaugggcug

SEQ ID NO: 33447 - RNA, 64 nt, Human
agguguauucccguuuuacagauaaggaaacugaggcccagagagcugaaguacugcacccagc

SEQ ID NO: 33448 - RNA, 64 nt, Human
gaauuaaacuaaaauacaaguaaagcuagacaaaggcccagaaaucauacuguaaggaaauguu

SEQ ID NO: 33449 - RNA, 64 nt, Human
agugggcccugcccaacuucaggcagaacagggaggcccagagauuacagauccccuccuguaa

SEQ ID NO: 33450 - RNA, 64 nt, Human
uugccaaggcucugaccucacagaagaugcccagggcccagaagccaucagaauuaucagugga

SEQ ID NO: 33451 - RNA, 64 nt, Human
auccuggaaagguggcagagccuccacugagccaggcccagagcuccuugcagugccuucuucc

SEQ ID NO: 33452 - RNA, 64 nt, Human
uaaaauggugauaaaaaccgacagguuguucaaaggcccagaucagcuaaagcauguauauaag

SEQ ID NO: 33453 - RNA, 64 nt, Human
gcuggauccauguaaugggguccagcgcuggcugggcccagacagacugugguggccugcgcag

SEQ ID NO: 33454 - RNA, 64 nt, Human
guucacugcugucuguaguacuuaggaugguguuggcccagaguugguguuugauuaaaguauc

SEQ ID NO: 33455 - RNA, 64 nt, Human
ggcuuucugggucucagcccucucugcgguugagggcccagaggacagagagauggacaugcgu

SEQ ID NO: 33456 - RNA, 64 nt, Human
gcagcguuagugaucccacuagcugugacagccaggcccagaaaaugccuggcgugagagccag

SEQ ID NO: 33457 - RNA, 59 nt, Human
agcccggggagaaccucuaggcacaggcgggcccagaccggcuucucggcuuggauccu

SEQ ID NO: 33458 - RNA, 64 nt, Human
gcucugggccgggccuggggcuccgaaauuccaaggcccagacuugcgggggguggggggguau

SEQ ID NO: 33459 - RNA, 64 nt, Human
ucugaggugagucccaggauguuucguccaccagggcccagauucugggaggugcuggggacuc

SEQ ID NO: 33460 - RNA, 64 nt, Human
aacaucaauuagggaaccaaaguugcacuaucugggcccagauugucugguuggcaagagcaaa

SEQ ID NO: 33461 - RNA, 64 nt, Human
gccucugcagccacaauucugaccuaaguggcagggcccagaaauccugaaaaccucccgcugc

SEQ ID NO: 33462 - RNA, 64 nt, Human
gcccaaaaaggacaaaaaugggcuggccuggaauggcccagaccccagccuccccuccucccuc

SEQ ID NO: 33463 - RNA, 64 nt, Human
ugcuuguggcugugcaggcugaggucuggagccaggcccagagcuggcuucaggguggggccuu

SEQ ID NO: 33464 - RNA, 64 nt, Human
agcagggcacuguggguggcucacccuagauuguggcccagaucucaggagucucugccuucag

SEQ ID NO: 33465 - RNA, 64 nt, Human
agggccccauccugggcagaggggccuggggcugggcccagaguccagccguccagcugcuccu

SEQ ID NO: 33466 - RNA, 64 nt, Human
ugcagcccaugcccaccugcccaucacaggguugggcccagaucuggucccuugcagcuaguuu

SEQ ID NO: 33467 - RNA, 64 nt, Human
ggggcugucugcgccuuccacgccccccaggacgggcccagaggcugggggagccccgcggcgg

SEQ ID NO: 33468 - RNA, 64 nt, Human
aagcuguagcccaucugagagguugggaaacugaggcccagaaacaggaagugacucacacaag

SEQ ID NO: 33469 - RNA, 64 nt, Human
gcagcuuugcaaggauccggagccagcucccaggggcccagagccccccacuugaagaggagcu

SEQ ID NO: 33470 - RNA, 61 nt, Human
agcuggccaaccagaagugagggccacggacggcccagacccgggcuggggcgcggcacca

SEQ ID NO: 33471 - RNA, 64 nt, Human
ggcacaggcugccccaccccuccaugauuccaagggcccagaggggcggggccaggauggcgug

SEQ ID NO: 33472 - RNA, 64 nt, Human
cgaagggaacuggcuggcuguccguccagugagcggcccagaccccaccucugcgccauuguca

SEQ ID NO: 33473 - RNA, 64 nt, Human
ggguccagugggcacugggcggggugguguguucggcccagaggccccuggccugagcaggugc

SEQ ID NO: 33474 - RNA, 64 nt, Human
cuucacacaccccucccuguggaucgccugccugggcccagagcaggggaacuggaguuuguga

SEQ ID NO: 33475 - RNA, 64 nt, Human
uggagcagagguuggccucccuggaggagcagguggcccagacagcccaagcccugcacuggau

SEQ ID NO: 33476 - RNA, 64 nt, Human
gcagugugagguaguccuggauccccgccaggguggcccagacgccagcccuucccuguguggc

SEQ ID NO: 33477 - RNA, 64 nt, Human
uuuaguugaagcacucaggaaauauacuaaugcaggcccagacaccccagaagggcaagcucuc

SEQ ID NO: 33478 - RNA, 64 nt, Human
acagccccagugacggucuggucuugcaggcagaggcccagagccccugccagugcucgcccau

SEQ ID NO: 33479 - RNA, 64 nt, Human
cugggcggacaggaccgucccucgcagggucccaggcccagaagaggccccacgccucuagagc

SEQ ID NO: 33480 - RNA, 64 nt, Human
cgcugcccaaucucucagacccaccccaccugcaggcccagaccacgugggacagaacuccugc

SEQ ID NO: 33481 - RNA, 64 nt, Human
ccaaggaggggcacgugcaccugauucuccuuggggcccagaggaagcugaugucauggcugga

SEQ ID NO: 33482 - RNA, 64 nt, Human
acagagauggaagccaggacaagggagcccaccgggcccagauagguacagagagcagaggcuc

SEQ ID NO: 33483 - RNA, 64 nt, Human
cucccuagacucuccuaggguucaggagcugcugggcccagaggugacauuugacuuuuuucca

SEQ ID NO: 33484 - RNA, 64 nt, Human
ggucugaggagacagcugaccuguuggcugaaaaggcccagaucaccgaggaggaggcaaaacu

SEQ ID NO: 33485 - RNA, 64 nt, Human
aggcccagaucaccgaggaggaggcaaaacuucuggcccagaaggccgcagaggcugagcagga

SEQ ID NO: 33486 - RNA, 64 nt, Human
aagcccuguggcuccacaggugcugcuucucacuggcccagacucugagcuccaccggcccagu

SEQ ID NO: 33487 - RNA, 64 nt, Human
ugguucugugcaugccugggugugguuaaggcguggcccagaaggcuucccuggugcucucagu

SEQ ID NO: 33488 - RNA, 64 nt, Human
cacccucugcuugggcuucugagcugguggcccuggcccagaggucuggcggaggcccaggcag

SEQ ID NO: 33489 - RNA, 64 nt, Human
uagcucuauauaaguaggggcagcuuagcccugaggcccagagaccugcuguccuuuuucuccu

SEQ ID NO: 33490 - RNA, 64 nt, Human
cccaggcagcgcugccugggggcuggggaggggaggcccagaggagggcuggccaugugagcac

SEQ ID NO: 33491 - RNA, 64 nt, Human
aagcauuuucauuucuaauggcccaugggagccaggcccagaaagcaggaauggcuugccuaag

SEQ ID NO: 33492 - RNA, 64 nt, Human
ggaccagauuuuguuuggagccucagcaugccggggcccagaugauggagcauaacggguccca

SEQ ID NO: 33493 - RNA, 64 nt, Human
ucuguccuauggccccaccccaccauucccucuaggcccagaccaucaucauggcccuggccau

SEQ ID NO: 33494 - RNA, 64 nt, Human
ucugcuccuaguggcacuggcuucguccucccagggcccagaguguuccccaugcuccaccugg

SEQ ID NO: 33495 - RNA, 64 nt, Human
gugggggaggucaacagggacugaguggggcagaggcccagaagugccagccuggggagccguu

SEQ ID NO: 33496 - RNA, 64 nt, Human
gucaaagccagaacugagaggggaccccagacugggcccagaggcuggccagaguucaggaacg

SEQ ID NO: 33497 - RNA, 64 nt, Human
gagcccaaggggccacugcccuugaaguggagugggcccagaguguggcgguccccaugguggc

SEQ ID NO: 33498 - RNA, 64 nt, Human
cuguggcuguggcugaagcuggcggaucgcuugaggcccagagucuaagacugcagugagcucu

SEQ ID NO: 33499 - RNA, 64 nt, Human
gaccagaacucaggccuugcagaaacagccuaugggcccagacugguacuuccuggcugaauau

SEQ ID NO: 33500 - RNA, 64 nt, Human
aauuuguuacacaguaauagguuaauaauacacuggcccagauuaggaagguucugccauccau

SEQ ID NO: 33501 - RNA, 64 nt, Human
cacgccacacacugggcguucccggcacgggagaggcccagaguuuccuucacccugggaacag

SEQ ID NO: 33502 - RNA, 64 nt, Human
cuacauuccacccuguuacuuauguagaaacugaggcccagagagggaagaugaccugccccaa

SEQ ID NO: 33503 - RNA, 64 nt, Human
agugcugggauuacaggugugagccaccgugcccggcccagauagguugaucuuaauguaacaa

SEQ ID NO: 33504 - RNA, 64 nt, Human
auugauauccucuucuuaaaaaugaguaaauggaggcccagagaaauguaauuugccugagauc

SEQ ID NO: 33505 - RNA, 64 nt, Human
uaucccccuacuccuacccucaucucauccuuaaggcccagagguagcuuggacaagcccuccu

SEQ ID NO: 33506 - RNA, 64 nt, Human
gaugcauuucugagcuuuccugggcugagcugaaggcccagaaucccgcuagaauauauccuga

SEQ ID NO: 33507 - RNA, 64 nt, Human
ccagaccgugaacaccugcuuccucccucgggcaggcccagagagccagagguggguaggaggu

SEQ ID NO: 33508 - RNA, 64 nt, Human
cccccaacucccuuccaggguucgccucaucugaggcccagauaauggugagaggccaggagac

SEQ ID NO: 33509 - RNA, 64 nt, Human
gauauaaccuacuuacuccguaaggggaaaugaaggcccagagaagggaagggacuugaccgag

SEQ ID NO: 33510 - RNA, 64 nt, Human
ucuucugucaccucugcuggcacaccaguggcaaggcccagaauggcgaccucucuuuagcuca

SEQ ID NO: 33511 - RNA, 64 nt, Human
aaaugcaaaaacugaacuucgggggucguucugugccuuccagcaucuuguacagcaaauccug

SEQ ID NO: 33512 - RNA, 64 nt, Human
uuuaaaccuuuggguaaucagauuuccaacuuaugccuuccagaaaaaaacacuacugccuaac

SEQ ID NO: 33513 - RNA, 64 nt, Human
cuguccaggauacaguggggcugagcacccccaggccuuccacuccucuacccucugggcacca

SEQ ID NO: 33514 - RNA, 64 nt, Human
gacuagggcgggcagaugcgcucgagccccacgggccuuccaccucccucagcuuccugcaugg

SEQ ID NO: 33515 - RNA, 64 nt, Human
uuucuaauccuaaaguaaagagaugcaauugggggccuuccauguagaaaguggggucaggagg

SEQ ID NO: 33516 - RNA, 64 nt, Human
ccccaaaacccuagcucuuuacccuuccauuuuagccuuccacccagcuuccacaaaagauuug

SEQ ID NO: 33517 - RNA, 64 nt, Human
uccuuuucaauagacugcccuggcucuuuccuaggccuuccacuaccuccuuucuuucucccac

SEQ ID NO: 33518 - RNA, 64 nt, Human
aacgggggcagcgcccaggaucacccagagcugggccuuccaccauuuccuccgcgccugagga

SEQ ID NO: 33519 - RNA, 64 nt, Human
ccgggucccaaguccagcccuggaucucccaauggccuuccaauccuuaaacugccaaucgccc

SEQ ID NO: 33520 - RNA, 64 nt, Human
aauuucaaugcugaaacugaacucuauuacuaaugccuuccaaucagaguuccugauggggaug

SEQ ID NO: 33521 - RNA, 64 nt, Human
uguuauucuggggaaauaaaucuagcaaagccucgccuuccaugccgagcguccucuuggcucu

SEQ ID NO: 33522 - RNA, 50 nt, Human
gcuucgccaagcuggacugagccuuccaggccccucaugcagaccugggg

SEQ ID NO: 33523 - RNA, 64 nt, Human
cuccuacuugugacuagagggugguggagguaaggccuuccagagcccauggcuucaggagagg

SEQ ID NO: 33524 - RNA, 64 nt, Human
uguguggaauggagaaaaaaacgccugcccugcugccuuccauguucauaggcccagcccaaga

SEQ ID NO: 33525 - RNA, 64 nt, Human
caacuuaaaccagcaucacuuuugucuucaauuugccuuccagugauuuuaguuuacaaccugc

SEQ ID NO: 33526 - RNA, 64 nt, Human
auuagauugcacacuauaauuuuacauaagaucugccuuccacacuucccugcuggaaggcauu

SEQ ID NO: 33527 - RNA, 64 nt, Human
ggccugcucagaggaguaggagcugaaagauggugccuuccacccucuugggcugugugcccau

SEQ ID NO: 33528 - RNA, 64 nt, Human
ccaugggcccagccccugcccugggaaccaggcagccuuccagaccucaggggcugaggcagac

SEQ ID NO: 33529 - RNA, 64 nt, Human
agacucaaggaguuugacuugguggccaauaccugccuuccaaagagauccuaccuuugcagau

SEQ ID NO: 33530 - RNA, 64 nt, Human
cuccccacacagggccuuuccugucccuuguggggccuuccaacccuguccuuuccacuggugg

SEQ ID NO: 33531 - RNA, 64 nt, Human
cauuugcugcccccaccccucuuuuccaguccuugccuuccaaccaaaagaaauggauguuuug

SEQ ID NO: 33532 - RNA, 64 nt, Human
uggcguuuccagaaggcaucuggugcuuugcucagccuuccaugcugugcagcacuucuguccu

SEQ ID NO: 33533 - RNA, 64 nt, Human
ggauuuugauggugugggaauauccuaagugguagccuuccaaguagcagugaguugacauuca

SEQ ID NO: 33534 - RNA, 64 nt, Human
gacuauugggcuuaagcgauccucccccaccucagccuuccaaguaacugggacuacaggugug

SEQ ID NO: 33535 - RNA, 64 nt, Human
gaaccugggauguccugaugcucaauggguagaugccuuccaggcugcagucagugcagaugau

SEQ ID NO: 33536 - RNA, 64 nt, Human
caaacuccugaccucaagugauccaccuaccuaggccuuccagagugcugggauuauaggcgug

SEQ ID NO: 33537 - RNA, 64 nt, Human
cuggcuggccucucaccaggaguuuaggcugaaugccuuccacgugauggaggaaaaggccaac

SEQ ID NO: 33538 - RNA, 64 nt, Human
uuaggccaggaaucuucugcuccauguggcuuaagccuuccagcugagugaagcuaggcaaaug

SEQ ID NO: 33539 - RNA, 64 nt, Human
gcuagcugccuuaccccuccuuggcacauaguaggccuuccauaaauguuggauggauggauaa

SEQ ID NO: 33540 - RNA, 64 nt, Human
uuuaaaaaggaaaaaaaaaauguuuuacuauguggccuuccaaaauagguaguguuugccuaug

SEQ ID NO: 33541 - RNA, 64 nt, Human
ucucauucucacucuugccgcccugugaagaggugccuuccaccgugauuguuaaguuuccuga

SEQ ID NO: 33542 - RNA, 64 nt, Human
cuuuaaaagcaaguaucucuccauaaauauuauggccuuccauuuucuucauacauuuuuuagg

SEQ ID NO: 33543 - RNA, 64 nt, Human
uggugacaaacagaugguugcucagggacaaggugccuuccaauggaaaugcgaaguaguugcu

SEQ ID NO: 33544 - RNA, 64 nt, Human
augcuucuucaaagagauuuucuucucuagucuagccuuccacauucuuagauuaauauggcca

SEQ ID NO: 33545 - RNA, 64 nt, Human
uuggucacuaccaccucuucccugagaagggcgggccuuccauguucucucacccgcuucaacu

SEQ ID NO: 33546 - RNA, 64 nt, Human
cguuccacagcuccacuugcaucuucucaccaaagccuuccauggaugcacagggagcuucuuu

SEQ ID NO: 33547 - RNA, 64 nt, Human
ccugcccuaccccauccaccaagugcgccacauggccuuccagcugugccaggcugucaagugu

SEQ ID NO: 33548 - RNA, 64 nt, Human
cacauuuuucuacccuucuucugagauguccucugccuuccagguauuugugauuuugucacag

SEQ ID NO: 33549 - RNA, 64 nt, Human
gggcggguccccacuuuaggacaagaggcagcuugccuuccaccagacgccagccucggccuuc

SEQ ID NO: 33550 - RNA, 64 nt, Human
gaugcgaucugucucuccuggcuccacucuugccgccuuccagcucugagucuugggaauguug

SEQ ID NO: 33551 - RNA, 64 nt, Human
ggcugccacuggggcaccgaacuaagccagcucagccuuccaagcugcuuagccuuugucaacc

SEQ ID NO: 33552 - RNA, 64 nt, Human
ccuuucucccuccacaggaaacagauuuuucagggccuuccaugccugccacuuuguccgucuc

SEQ ID NO: 33553 - RNA, 64 nt, Human
ucucuccccagucucuagggcugccugacuggaggccuuccaaggggguuucagucuggacuua

SEQ ID NO: 33554 - RNA, 64 nt, Human
ugcagugacacaaucucggcucacugaaaccucugccuuccagguucaagcuauucucaugccu

SEQ ID NO: 33555 - RNA, 64 nt, Human
cuugucugggaauugugugucugguaacuggaaggccuuccacuguggcaaauggaggcuuuuc

SEQ ID NO: 33556 - RNA, 64 nt, Human
ucuuucaccuacugagaugauugaccgagguuuggccuuccauuuuuacugagauuuggcgaga

SEQ ID NO: 33557 - RNA, 64 nt, Human
cuccagccacauucucauagcagguaggacuucagccuuccagacacugcccuuagaaucugga

SEQ ID NO: 33558 - RNA, 64 nt, Human
uaaaagagaacccuuguucccuuccuaagaaacugccuuccacaauuaaagaauacucauagaa

SEQ ID NO: 33559 - RNA, 64 nt, Human
gcacuucugagacggcaaagccaaccacuuagaagccuuccacaucuuugucaccugccuggcu

SEQ ID NO: 33560 - RNA, 64 nt, Human
gggaagcaacggacauaaucuguucccagccauggccuuccagcuugugucccugauucaggga

SEQ ID NO: 33561 - RNA, 64 nt, Human
ggagaggcugugguggcugucucugucccucacugccuuccaggagcaauuugcacauguaaca

SEQ ID NO: 33562 - RNA, 64 nt, Human
uguccccacuaaaacaaaacaaaaaacuuuuaaugccuuccacauuaauuagauuuucuugcag

SEQ ID NO: 33563 - RNA, 64 nt, Human
uggaaugugaacuuugggcaaguuaagugggacagccuuccauguucauuugucuaccucuuaa

SEQ ID NO: 33564 - RNA, 64 nt, Human
uccuguauuuucuacuguaauaauguaauuuaaggccuuccacaaugaacaguucacuuuauuc

SEQ ID NO: 33565 - RNA, 64 nt, Human
ucuugaacugaccucaagcgauccaccugccuuggccuuccagagugcugggauuacaggugug

SEQ ID NO: 33566 - RNA, 64 nt, Human
cccugcuggcugggggcagcucccaggauauccugccuuccaacuguuucugaagccccuccuc

SEQ ID NO: 33567 - RNA, 64 nt, Human
ccuggaaacaguccacuugggcgcaaaacccagugccuuccaaaugagcugcaguccccaggcc

SEQ ID NO: 33568 - RNA, 64 nt, Human
auaugugaccuaucaagacauucauagcauucaggccuuccaugaacagaucgucauugcaguu

SEQ ID NO: 33569 - RNA, 64 nt, Human
uauuucuacuaccaccguaugucaacuggguaaagccuuccagagcucucuaaauaccugaaag

SEQ ID NO: 33570 - RNA, 64 nt, Human
gugagaggccucacauauacgccucccuagaagugccuuccaagucaguccuuuggaaaccagc

SEQ ID NO: 33571 - RNA, 64 nt, Human
uccacucccuuaguacacuggagugccgagcccugccuuccacccagcguccauccagccccug

SEQ ID NO: 33572 - RNA, 64 nt, Human
ggcaucuuaggguaggggaagugugcugaggugggccuuccaugggcauggccguugccucucu

SEQ ID NO: 33573 - RNA, 64 nt, Human
caucucccccccacccacaaagagcacggagccagccuuccacuuuucccaguggggccugcug

SEQ ID NO: 33574 - RNA, 64 nt, Human
cugggaacccuguggucugcacuacaugugaauggccuuccacuucagucuuaggcagauuuga

SEQ ID NO: 33575 - RNA, 64 nt, Human
uuaccuauccuugaggucauccauauucuuacaggccuuccagucaauaauggaagagcucacu

SEQ ID NO: 33576 - RNA, 64 nt, Human
uccagaaaagaaagcuuggaaacuuacccaguuugccuuccauuugggacaugacugaugugcu

SEQ ID NO: 33577 - RNA, 64 nt, Human
cccauuauuugcccuauccaaaauauauucaagggccuuccaaguuguagaagaacaaugaucu

SEQ ID NO: 33578 - RNA, 64 nt, Human
cuuuuaaacuugauuuugcagacucuggcaauaagccuuccaaaauucugugccuuuucuauua

SEQ ID NO: 33579 - RNA, 64 nt, Human
ugcuuuuacuaaaccaguacuucguuaugaaaaugccuuccacgcaaauaagaaaccaagggau

SEQ ID NO: 33580 - RNA, 64 nt, Human
uuuccuacaucggaauccaagcuaauuucuaauggccuuccauaauaauucugcuuuagaugug

SEQ ID NO: 33581 - RNA, 64 nt, Human
gucacaaguacagacacuucacuuagccuagggggccuuccaggguucuuguggcuguugucag

SEQ ID NO: 33582 - RNA, 64 nt, Human
gcacccggugccagccccgcucugggcaccaccugccuuccagccccuccaggacccggucccc

SEQ ID NO: 33583 - RNA, 64 nt, Human
aggaaggaccaaggagaugaagcaaacacauuaagccuuccacacucaccucuaaaacaguccu

SEQ ID NO: 33584 - RNA, 64 nt, Human
caccgccucucugugggccagcuguucacagaaggccuuccaucugaugcuccccaucgccugc

SEQ ID NO: 33585 - RNA, 64 nt, Human
ucaaugacagggaucuagcaaugcugcaucaucagccuuccaauaccagguuuaaggguauuuu

SEQ ID NO: 33586 - RNA, 64 nt, Human
caauucccaauguuccaggugagggcuuugaaaggccuuccaaacagcuccgucgccccuagca

SEQ ID NO: 33587 - RNA, 64 nt, Human
gacuaagcugguuccuugugucaaagcaccucaugccuuccauuaaagagaggccguguccacc

SEQ ID NO: 33588 - RNA, 64 nt, Human
gcuuucuucugguuguacagauccauuguggucugccuuccaggcucauuaauagucuaacuac

SEQ ID NO: 33589 - RNA, 64 nt, Human
cucgaucuccugaccucgugauccgcccgccucagccuuccaaaguguugggauuauaggcgug

SEQ ID NO: 33590 - RNA, 64 nt, Human
acgauggggccgucccgggagccaggugggagcugccuuccacugccaucgggucuccucuccu

SEQ ID NO: 33591 - RNA, 64 nt, Human
ucuuacggagcuucuccucagaagugguaccaucgccuuccaaagucagcacucuacacucuug

SEQ ID NO: 33592 - RNA, 64 nt, Human
gucacuuuacauccucagguauuguaaccacugggccuuccaacuuugcuggcaagcucuggua

SEQ ID NO: 33593 - RNA, 64 nt, Human
cucuuucuccuauuucuuacccuguccuccaccugccuuccauuuugaagugggauguuaauga

SEQ ID NO: 33594 - RNA, 64 nt, Human
gcaucaagguaaauauauuuuugccaaaguucuggccuuccaaaacucacccccuuauuuaaau

SEQ ID NO: 33595 - RNA, 64 nt, Human
caaacuccuggacucaagcaauccucccaccuuggccuuccaaaucacugggauuauaggcaug

SEQ ID NO: 33596 - RNA, 64 nt, Human
auaucuagcauucuuuccagacagcauccuccccgccuuccaccuugguagaugcaaggucuau

SEQ ID NO: 33597 - RNA, 64 nt, Human
caaaaacagacucccacugucuccagaagucguggccuuccagaacagucugccccucaaggaa

SEQ ID NO: 33598 - RNA, 64 nt, Human
gaccuccccaggcucaggugaucuucccaccucagccuuccaaguagcugggacuacagaugca

SEQ ID NO: 33599 - RNA, 64 nt, Human
ugucuucuuugccuagguugccaaaaagauguuugccuuccaccuugaugcauccuguuuugug

SEQ ID NO: 33600 - RNA, 64 nt, Human
cugggcaagggaggauuuucccggccgcagcacagccuuccauucaugugcacgugagucuggu

SEQ ID NO: 33601 - RNA, 64 nt, Human
aagcacugagauuaaccuaucaacgcccugagaagccuuccagccugcggugcugucugcuggg

SEQ ID NO: 33602 - RNA, 64 nt, Human
guccuucaaggcaugauggguggcuauccgccaggccuuccaccuuugcagggcccaguugaug

SEQ ID NO: 33603 - RNA, 64 nt, Human
cucuaacuauuggaacgccagaaagucagagaaagccuuccauuauucucagcaagucucagcu

SEQ ID NO: 33604 - RNA, 64 nt, Human
cugauagccuucaggggaggaccugcccagguaugccuuccagugaugcccaccagagaauaca

SEQ ID NO: 33605 - RNA, 64 nt, Human
guucauguuacucaugacuccuuucucuaaaacugccuuccacaauucacuagaccagaagugg

SEQ ID NO: 33606 - RNA, 64 nt, Human
cagggcuuagggagggagggaggacauggacagggccuuccacccuggcuccuucacagggaug

SEQ ID NO: 33607 - RNA, 64 nt, Human
gagaaaggguaauuuccuuugcuucaaauucaaggccuuccaacgcccccauccccuuuacuau

SEQ ID NO: 33608 - RNA, 64 nt, Human
cuuaugaggaauuggaccuaauaaauuuuagugugccuuccaaaccugagaauauaugcuuuug

SEQ ID NO: 33609 - RNA, 64 nt, Human
ggacaggccuccuuggcaagaggaaugaccagcugccuuccaacuucaccccuguuuucuacuc

SEQ ID NO: 33610 - RNA, 64 nt, Human
guuuuuuuaauagaauauaauuaucggaagcagugccuuccauaauuaugacaguuauacuguc

SEQ ID NO: 33611 - RNA, 64 nt, Human
gagugucugcaguccugguggggcugagccugaggccuuccagaaagcaggagcagcugugcug

SEQ ID NO: 33612 - RNA, 64 nt, Human
gucacuuccaaguucuccggauauucacaaaacugccuuccauggagguccccuccucuccuag

SEQ ID NO: 33613 - RNA, 64 nt, Human
uuaagaaguaggaaaacaaaaaccucucuccucagccuuccaccuccaagagaggaggaaaaac

SEQ ID NO: 33614 - RNA, 64 nt, Human
aaccauuagcuuauacuuggacucaucauuuguugccuuccaaaaugcugaggauaauguaugu

SEQ ID NO: 33615 - RNA, 64 nt, Human
ugaacuccugggcucaagcauuucuccuaccucggccuuccaagggcuaggauuacaggcauga

SEQ ID NO: 33616 - RNA, 64 nt, Human
cagcauuauucuagcagcauccauucuuguuuaagccuuccacuguuagagauuugagguuaca

SEQ ID NO: 33617 - RNA, 64 nt, Human
aaaggcuuccauuaauauaauagcuuugcuugcagccuuccaaucuauguugguuuaccuguag

SEQ ID NO: 33618 - RNA, 64 nt, Human
uguaugugcaacagcaaugaaauuaacuccagaagccuuccaccugcgucacccaggccgggag

SEQ ID NO: 33619 - RNA, 64 nt, Human
acuaaagccugcaagcgccacaauucuaagugccgccuuccauuuuuuuucaguauguuuucac

SEQ ID NO: 33620 - RNA, 64 nt, Human
aauuccugcccugggugggaggauagauggcguggccuuccaaacauacaaacauaaugauuug

SEQ ID NO: 33621 - RNA, 64 nt, Human
aaucaagguucacaauaggaaguugucuuuuuuugccuuccauucugugagauuugacagaugg

SEQ ID NO: 33622 - RNA, 64 nt, Human
ggaagcccuuccuuauguuacauguggaaagccugccuuccaagacauguggaaguaauugauc

SEQ ID NO: 33623 - RNA, 64 nt, Human
cacugccccggccggcccagauaggucugccucugccuuccagcucccacagccuggucccuga

SEQ ID NO: 33624 - RNA, 64 nt, Human
gauuuugaggguuagcaagacaaagcaaauaaaugccuuccaccucaccgcaaaccuucugcua

SEQ ID NO: 33625 - RNA, 64 nt, Human
aauucugaaucuucugggacaggguuguaacucagccuuccaaagggaagagugcagggggacg

SEQ ID NO: 33626 - RNA, 64 nt, Human
ucgccauuguucaccccucgcccugcccuccuuugccuuccacccccaccauccagguggagac

SEQ ID NO: 33627 - RNA, 64 nt, Human
uuggguacuuauacuaaauuaugguaguuauucugccuuccaguuugcuugauauauuuguuga

SEQ ID NO: 33628 - RNA, 64 nt, Human
cugcccuggagcacacuggggaagcaggcugcgggccuuccaaaaguaaaaaauggugauaugc

SEQ ID NO: 33629 - RNA, 64 nt, Human
uugccucacggguucaagggauucucgugccucagccuuccaaguagcugggauuacaggugug

SEQ ID NO: 33630 - RNA, 64 nt, Human
ucuaauagcucuaaacucauuaaaaaaacuccaagccuuccaccaaaacagugccccaccugua

SEQ ID NO: 33631 - RNA, 64 nt, Human
cuuucucucucaacaccacaguucucaacccugagccuuccagagagagcuauugaugauacaa

SEQ ID NO: 33632 - RNA, 64 nt, Human
auuaauuugaugauugucacguacaacuuucuuugccuuccaaguagaggugauccuaacaauu

SEQ ID NO: 33633 - RNA, 64 nt, Human
cauacuuuccaguugaaaaaaaucaaaauuuuuugccuuccauuuuucuggguaauguccuuua

SEQ ID NO: 33634 - RNA, 64 nt, Human
gucuuccauuugcuucuuauccccuuaaaagaaugccuuccacuucccaacagcccccaucaag

SEQ ID NO: 33635 - RNA, 64 nt, Human
ccagaaaguggcagaggauuacgucaguguggcugccuuccaggugaugacaggugugugcuuc

SEQ ID NO: 33636 - RNA, 64 nt, Human
guguucccagcaaccagcuccauccuggcugcuugccuuccauuuccguguagauggagaucac

SEQ ID NO: 33637 - RNA, 64 nt, Human
caaacuucuggacucaagugauccucccgccucggccuuccaaagugcugggauaucaggcacu

SEQ ID NO: 33638 - RNA, 64 nt, Human
agggaaaaggggcagcauguggggaaugccccccgccuuccacaaauccuuuugcugacccagg

SEQ ID NO: 33639 - RNA, 64 nt, Human
uaggauaauuaugaaaagcaguucuggauggugugccuuccagauccucucuggggcuguguuu

SEQ ID NO: 33640 - RNA, 64 nt, Human
acagagacuugaguuaggaagcccucagucacuugccuuccacgguggccagcccugcugccau

SEQ ID NO: 33641 - RNA, 64 nt, Human
gaaguauuugaaugcauuuaggcuuaauuucuucgccuuccacauguuaacaguagagcucuau

SEQ ID NO: 33642 - RNA, 64 nt, Human
uccguggaugggaagacacauguuaaguuuuguggccuuccagcacuuacuauuuucagcuuuu

SEQ ID NO: 33643 - RNA, 64 nt, Human
auugccccaacuagacugugagcuccuccucugagccuuccaaguccccccuccaccuucgcca

SEQ ID NO: 33644 - RNA, 64 nt, Human
ccuuucuauagggaggauaccagcaggcccuuaagccuuccaggacacuaaggucgugggagcg

SEQ ID NO: 33645 - RNA, 64 nt, Human
agccgcuggucuucuccuaggacuaaguccaggugccuuccacaaucucauggucuuucagguc

SEQ ID NO: 33646 - RNA, 64 nt, Human
gaugauuuagcuuuugcugugugugugugugugugccuuccaaaucaugccauaauuguaaugu

SEQ ID NO: 33647 - RNA, 64 nt, Human
aaagagggaccacugugcucauggacccaucgcugccuuccaaggaccauuucccagagcuacu

SEQ ID NO: 33648 - RNA, 64 nt, Human
gcuuuggugaugauuacuguauugacaucaucaugccuuccaaauuguggguggcucugugggc

SEQ ID NO: 33649 - RNA, 64 nt, Human
ccccuguaaaugcuaucgcagccugaguccugccgccuuccaguuccuuggugucccgugcacc

SEQ ID NO: 33650 - RNA, 64 nt, Human
cgugagcaggcaggcaggagguccuguuagcccugccuuccaggaagguuggggugggaguuuu

SEQ ID NO: 33651 - RNA, 64 nt, Human
acacacacacaaaucagcaucauaagggaauguagccuuccaacagagaugaugcuguucguau

SEQ ID NO: 33652 - RNA, 64 nt, Human
cggcuaagcuugguggagcauuuucccauugagagccuuccaugggaacucaauguucccauug

SEQ ID NO: 33653 - RNA, 64 nt, Human
uugggccuucauaaacacucaccuggcuggcuuugccuuccaggaggaagcuggcugaagcaag

SEQ ID NO: 33654 - RNA, 64 nt, Human
ccaacucccggguucacgccauucuccugccucagccuuccaaguagcugggacuacaggugcc

SEQ ID NO: 33655 - RNA, 64 nt, Human
ugcaauggcgugaucgcugcucaccgcaaccuccgccuuccagguucaagcgauucuccugacu

SEQ ID NO: 33656 - RNA, 64 nt, Human
cugaguacaguggugcaaucucacugcaaccuccgccuuccaguugcaagugauucuccugccu

SEQ ID NO: 33657 - RNA, 64 nt, Human
ccccuagccauccuuucuuucaagggugaaccaggccuuccacccugaccuugcaucuccagac

SEQ ID NO: 33658 - RNA, 64 nt, Human
aaauaagucaauuaaguacacuuuauugaaaauugccuuccauuaacacacaagaaagaaagca

SEQ ID NO: 33659 - RNA, 64 nt, Human
gcccuacagagcuguggaggauugcuaucuggaggccuuccagcugcugucuucuggacaggcu

SEQ ID NO: 33660 - RNA, 64 nt, Human
ugaauacauuuugcacaaaguaagccucaccuuugccuuccaacugccagaacauggauuccac

SEQ ID NO: 33661 - RNA, 64 nt, Human
gcugccaucaauucccaccuggacaacugcaaaagccuuccagcuguuccugcuuccacucuug

SEQ ID NO: 33662 - RNA, 64 nt, Human
uaaaugaaccauaauuuuuuucacuaagcuguuugccuuccaaaguguuuacaccuuaagccuu

SEQ ID NO: 33663 - RNA, 64 nt, Human
gacuuuguuuccugcccucucuuuccuauuuccugccuuccagccccaccccucugucccuaga

SEQ ID NO: 33664 - RNA, 64 nt, Human
gggggcagaguuugucccucugucaucagaggcagccuuccaggcacagcucuggucaccucug

SEQ ID NO: 33665 - RNA, 64 nt, Human
gacuguaucaacauugauuuacuccacuuuuuaugccuuccauugugaugacgucaaacacagu

SEQ ID NO: 33666 - RNA, 64 nt, Human
aagcacaugauggugaaaaaccuaggauuuggcagccuuccagaaugguauggaaucugaggga

SEQ ID NO: 33667 - RNA, 64 nt, Human
cauacuccugggcucaagcaauccuccugccucagccuuccaacuagcugggacuacaggugcg

SEQ ID NO: 33668 - RNA, 64 nt, Human
aacaccacagaacaagcagcaccccacagugggugccuuccagaaauauaguccaagcuuucuc

SEQ ID NO: 33669 - RNA, 53 nt, Human
gagaaggaggggaaaauuaaccggccuuccaacuuuugucugccucauucuaa

SEQ ID NO: 33670 - RNA, 64 nt, Human
auuucucaagugagugaguuccccucuacuuuuagccuuccacccaaacuggaagccucuaggu

SEQ ID NO: 33671 - RNA, 64 nt, Human
ugggaccccgcaguugggaggaggaaguaguccagccuuccagguggcgugagaggcaaugacu

SEQ ID NO: 33672 - RNA, 64 nt, Human
acgucuugcuacccucuuuugaagauguucucuagccuuccaccagcagcgaggaauuaacccu

SEQ ID NO: 33673 - RNA, 64 nt, Human
cugaggggagagaagcacaccaggggcgcccucugccuuccauaccccacgcuuauaaaacaua

SEQ ID NO: 33674 - RNA, 64 nt, Human
ccaauacuauuuacaaaauuauucaaauucucacgccuuccaacucaaaauuagcaaucuaaag

SEQ ID NO: 33675 - RNA, 64 nt, Human
gcgucagccuccagccucuguuccccuaguaagugccuuccaugucggccucuaaccccaggcc

SEQ ID NO: 33676 - RNA, 64 nt, Human
ccuggggcugcaaguuucuggaggcccccaggaggccuuccagacaucugcguuccuucuggac

SEQ ID NO: 33677 - RNA, 64 nt, Human
agaccaggauccaaauuguggggaaucaguuucagccuuccaugugcugccggaacucgggccu

SEQ ID NO: 33678 - RNA, 64 nt, Human
ccaugcugacagaagccuguccuuguaaggcccagccuuccaggggaacacucagacauguuca

SEQ ID NO: 33679 - RNA, 64 nt, Human
agggguguugucuggaagggcagguucagaugcagccuuccagauuuagaggcacugggaggac

SEQ ID NO: 33680 - RNA, 64 nt, Human
ugccccuucguugucaugagugccagcagcugcugccuuccauuccucagcugaaagaacaucu

SEQ ID NO: 33681 - RNA, 64 nt, Human
cacuggucuucccuacuacacaggcaugcccagugccuuccaguauggccccaccauguuugug

SEQ ID NO: 33682 - RNA, 64 nt, Human
uguacuuggggugaccccagcagccaauuauccggccuuccauaggggguucagucccaaagac

SEQ ID NO: 33683 - RNA, 64 nt, Human
cuggcugagggcuucccuuggcuuccagaaggcagccuuccauccagacaagccagugagcucu

SEQ ID NO: 33684 - RNA, 64 nt, Human
acagccaucuaggcuaguguagagaugagcgcuagccuuccaagcaugaagucggggaccaaau

SEQ ID NO: 33685 - RNA, 64 nt, Human
ggcagcaucuccuuagucccagcucaggcucucugccuuccagaggccgcuucuccagugacua

SEQ ID NO: 33686 - RNA, 64 nt, Human
agucagacagaucccugccuuggugggcaguucugccuuccaaggaagaaggggaagaaaagga

SEQ ID NO: 33687 - RNA, 64 nt, Human
uacuuagggggaaacuuaggcuggagacagggaggccuuccacucugccccauuagcuuagaaa

SEQ ID NO: 33688 - RNA, 64 nt, Human
uaucaccuccugcucggugcuguggcucaacaaugccuuccaggauguggagucagagaacguc

SEQ ID NO: 33689 - RNA, 64 nt, Human
cccacuaaccagacuggaaaacccagaaagaugggccuuccaugaaugcuucauuccagaggga

SEQ ID NO: 33690 - RNA, 64 nt, Human
cuguggucccuggaggcaaaaggcagcucacggggccuuccauuuccagccaggccucaucugg

SEQ ID NO: 33691 - RNA, 64 nt, Human
acuugguucuacuaccaugaucuuuauaaacuaugccuuccagacaauugauaaugcugcuaua

SEQ ID NO: 33692 - RNA, 64 nt, Human
cccgccuggagcacuaggcccccacccugcugcugccuuccagugcugucauuuucuucagggg

SEQ ID NO: 33693 - RNA, 64 nt, Human
ccccucacccccaguacugcagaucucacaguuugccuuccagaagccagccuaucucuagccc

SEQ ID NO: 33694 - RNA, 64 nt, Human
guuuugauguugaaauccuggccuugggagagaugccuuccaggcagacacagcugucugguuc

SEQ ID NO: 33695 - RNA, 64 nt, Human
gauaauuuugcuauuuuccaugcauuaaaaaucagccuuccaucuguaaagggcgguaauggug

SEQ ID NO: 33696 - RNA, 64 nt, Human
ugcaauggugcgaucuaggcucaccacaaccucugccuuccagguucaagugauuagagacagu

SEQ ID NO: 33697 - RNA, 64 nt, Human
caagaacagauaaggaagggauuggcaucggcuggccuuccagcaccuucucucuccaacacuu

SEQ ID NO: 33698 - RNA, 64 nt, Human
ucuuuaacugauuuugcuaaaaaucucccugugagccuuccacucaacucuuaauaugcuugca

SEQ ID NO: 33699 - RNA, 64 nt, Human
gucaccccccuucacuccagcccgccugccuucagccuuccaugagcuucaccugcuuccaacu

SEQ ID NO: 33700 - RNA, 64 nt, Human
uucuuacaaacucgucucucggccuuucucuccugccuuccacagccucucguuucuccuccau

SEQ ID NO: 33701 - RNA, 64 nt, Human
cugugcucuuaccuaaggaaucuaaauuguccuagccuuccauugcuaugcacugaaugaggac

SEQ ID NO: 33702 - RNA, 64 nt, Human
gaaacagaaaaauauguaccaagaaucuugguuugccuuccagaaaacaaaacugcauuucacu

SEQ ID NO: 33703 - RNA, 64 nt, Human
agaggccaggggucucuacugcccaugccgggcggccuuccagucauugcacagcaaagccaug

SEQ ID NO: 33704 - RNA, 64 nt, Human
ccagucucagggagauauaugcuuggagaacucugccuuccaucaacugcaguguaaugggaaa

SEQ ID NO: 33705 - RNA, 64 nt, Human
gguggggcugauggagcaaggguccagacuaggagccuuccaccccagcugugucuggcgcccc

SEQ ID NO: 33706 - RNA, 64 nt, Human
cucgaacuccugaccucgugauccaccugccucggccuuccaaagugcugggauuacaaguuug

SEQ ID NO: 33707 - RNA, 64 nt, Human
ggaagcuguggugggcagagccccaaaacaagcagccuuccaacuagagacucgggggugucug

SEQ ID NO: 33708 - RNA, 64 nt, Human
ccagggcagugccgugguggccaaccggacccaggccuuccaggagcaggagcaggggcagggg

SEQ ID NO: 33709 - RNA, 64 nt, Human
uacgucugggcccccacuuucaccaguuucugcggccuuccaccgggccugaaccacagcggag

SEQ ID NO: 33710 - RNA, 64 nt, Human
aaaauuggaagaaugcaaaauggaucagaaucaugccuuccaauaaaggccuuuacacauguuu

SEQ ID NO: 33711 - RNA, 64 nt, Human
ccaguugagacaccuaguguauggcucaugcccagccuuccaccugggauucuccagccuccac

SEQ ID NO: 33712 - RNA, 64 nt, Human
gcacucucugccccaggacucauggcucugcugugccuuccauccugggcucccuucucuccug

SEQ ID NO: 33713 - RNA, 64 nt, Human
ugauuaccccgggagacugaacugcaggguucaagccuuccagggauuugccucaccuuggggc

SEQ ID NO: 33714 - RNA, 64 nt, Human
cacaggcaccccugcaggaggcgcugccaggagagccuuccaucucggggcucuuugagguucc

SEQ ID NO: 33715 - RNA, 64 nt, Human
ccaccaggaacccagacaccaccuccaacucugagccuuccagagcuucagccucucuucgucg

SEQ ID NO: 33716 - RNA, 64 nt, Human
uuuuccugcuguacugaaccugcugauaaaagcugccuuccaggcucuuggacacugccuuggg

SEQ ID NO: 33717 - RNA, 64 nt, Human
cucaaucucuugaccuugugauccaccugccuuggccuuccaaaguguuggaauuacaggcgug

SEQ ID NO: 33718 - RNA, 55 nt, Human
caccaauuccuaaauuguaggguaugccuuccaguauuucauaaugaucugcauc

SEQ ID NO: 33719 - RNA, 64 nt, Human
guacuguugucauuguucucagguaggugauucugccuuccaagaguauauguuucuuuaauca

SEQ ID NO: 33720 - RNA, 64 nt, Human
aacugcuauggagagaaagcuaacauggucccaugccuuccaggcagcccugcugaaggaucua

SEQ ID NO: 33721 - RNA, 64 nt, Human
cucacaggagccuccuccucagacccuguucuuggccuuccauccucuccccacggcugauggu

SEQ ID NO: 33722 - RNA, 64 nt, Human
acugacuaaaacaagcaagcagagaaaagcaucagccuuccagaguuacugucugcuuaaggca

SEQ ID NO: 33723 - RNA, 64 nt, Human
accaggaaucagaggcagcuguuaccagguuucggccuuccaguugaucccuccacuguccagg

SEQ ID NO: 33724 - RNA, 55 nt, Human
cugcccaagcagucuacugaauccagccuuccagcaagagauuguuuuucaagga

SEQ ID NO: 33725 - RNA, 64 nt, Human
ccagggucuuagguacaaaauccuacuuuucagagccuuccagcucuggaaccucaaacauccu

SEQ ID NO: 33726 - RNA, 64 nt, Human
cuguacuguugcgugugcaagcggccccacuagagccuuccagccuucugguguguucuaagag

SEQ ID NO: 33727 - RNA, 64 nt, Human
uugccugggucugucugaggaaggagggggucccgccuuccaccucaacacaucccuucaguga

SEQ ID NO: 33728 - RNA, 64 nt, Human
gccagcagcccugcacuccacgcuggccaagaaggccuuccacgcagaaugacaagacugcaaa

SEQ ID NO: 33729 - RNA, 64 nt, Human
ucuuccccagcaagccacccgaggggacugccuggccuuccagaugcgagcuggguugcuuccc

SEQ ID NO: 33730 - RNA, 64 nt, Human
auuacgacccgucagagccgacggaggaggaggagccuuccaaacagagaggugaguggggagc

SEQ ID NO: 33731 - RNA, 64 nt, Human
ucacagcaaagaagaauccugugaauguccaaaagccuuccagaagucaagucucuuaagcuau

SEQ ID NO: 33732 - RNA, 64 nt, Human
ccagaagcuccgccggcgaccagacuccugccacgccuuccauccagaggugcggguugaggcg

SEQ ID NO: 33733 - RNA, 64 nt, Human
cugcgggcagcucuaaggaccguccugcgagaucgccuuccaaccccacuuuuuucuggaaagg

SEQ ID NO: 33734 - RNA, 64 nt, Human
acagagucuagcaaagaaggggauuuuggaaggugccuuccaaaaaucuccugaauccgggcuc

SEQ ID NO: 33735 - RNA, 64 nt, Human
aggagaaggugaggcaugggccaaucccauuccugccuuccagugccccaccacccuucugauc

SEQ ID NO: 33736 - RNA, 64 nt, Human
agcuucaagagcuaagaaccugcugcaagucacugccuuccaagugcagcaacccagcccaugg

SEQ ID NO: 33737 - RNA, 64 nt, Human
uacagaggggccaggggaucccucucucccuagugccuuccacccuuuacuccccagagcagcu

SEQ ID NO: 33738 - RNA, 64 nt, Human
uuccugcggcauguaugacuucucuggccaguuugccuuccacgugggccugccagccaaguca

SEQ ID NO: 33739 - RNA, 64 nt, Human
caguagcuggggagagggcagggaggcuuccugggccuuccagccuccuuccccaccuccuucc

SEQ ID NO: 33740 - RNA, 64 nt, Human
caaacuccugaccucaggugauccaccugccuuggccuuccagagugcugggauuacaggcgug

SEQ ID NO: 33741 - RNA, 64 nt, Human
gcacuuccuacccccacgagggcacagcccccacgccuuccagaagacacaaacucaccucccu

SEQ ID NO: 33742 - RNA, 64 nt, Human
guaauccauuaagggcaguaccucuaacaaggacgccuuccagcuucagcgauguuacuuacgu

SEQ ID NO: 33743 - RNA, 64 nt, Human
cauuugggaaagaaggcaaaguccccccaguuaugccuuccaagaggaacuucagacacaaaag

SEQ ID NO: 33744 - RNA, 64 nt, Human
ugggugaggugcagaugaccaggagugugugaaugccuuccaggagguggcuuuguuccgugcc

SEQ ID NO: 33745 - RNA, 64 nt, Human
gggcugcugcgcguuaccuugcugcaagcggggcgccuuccaccuggcugggggucugcgccac

SEQ ID NO: 33746 - RNA, 64 nt, Human
ugaaaucagagauaccagcuccucuuuuaaaacagccuuccagucauuggcacgcauuuucucu

SEQ ID NO: 33747 - RNA, 64 nt, Human
cagggggucuuuuuuuuaauacauauccaauaaugccuuccaucugaauguaaaauaaguaccc

SEQ ID NO: 33748 - RNA, 64 nt, Human
aucagaaaaccaaagggugcuaggaggugugggugccuuccauacuguuugcccauuuucauuc

SEQ ID NO: 33749 - RNA, 64 nt, Human
gggccccuggucaagugcuggcucugcuguccuugccuuccauuuccccucugcacccagaaca

SEQ ID NO: 33750 - RNA, 64 nt, Human
ugcaauggcgcaaucucgguucacugcaaccucugccuuccagguuccagcaauucuccuaccu

SEQ ID NO: 33751 - RNA, 64 nt, Human
aauugcuuuagauuuccaaagagggaaugauguugccuuccacuuuaacccacgcuucaaugag

SEQ ID NO: 33752 - RNA, 64 nt, Human
uggcuguucuaaggggcuguaaggugggcucugggccuuccagcuaggcucucaagcacagcag

SEQ ID NO: 33753 - RNA, 64 nt, Human
accuugcuccaagucccuccacccaugaugcugugccuuccagaaaccuguccucugcagcucg

SEQ ID NO: 33754 - RNA, 64 nt, Human
uccagccucugccuuucauuaaauguaaccuuuugccuuccaaauuaaagaacuccaugccacu

SEQ ID NO: 33755 - RNA, 64 nt, Human
ugagaagccaagaaagaucauuuuuagcaaguaugccuuccauccuuggcagaggcuucccagc

SEQ ID NO: 33756 - RNA, 64 nt, Human
ucgaucauauuuccccuuggacacuugguuagacgccuuccaggucaggaugcacauuucugga

SEQ ID NO: 33757 - RNA, 64 nt, Human
auacuuaccuggcccuccucccuagggagcaagugccuuccacuuacuucccauccaggucuca

SEQ ID NO: 33758 - RNA, 64 nt, Human
ugcaguggcgugaucuuggcucacugcauccuccgccuuccagguuuaagcuauucuccugccu

SEQ ID NO: 33759 - RNA, 64 nt, Human
gccgcaggcagggagugagcugggggugccugcagccuuccacuccugccccgccucaccccac

SEQ ID NO: 33760 - RNA, 64 nt, Human
agcguugugauuuccuugcuguugguuuuacacugccuuccacauugcaacagcaaguugauuu

SEQ ID NO: 33761 - RNA, 64 nt, Human
gcuacagcccuggcagcccauggcaacucaaagugccuuccaaaccaaacugccccucaugagg

SEQ ID NO: 33762 - RNA, 64 nt, Human
cauaggcccagugagaugcauucuugguuggcuggccuuccacuuggcuacacagggauguaca

SEQ ID NO: 33763 - RNA, 64 nt, Human
guggauuagacucccaguuccaccaaaccuaugagccuuccacuguggaugggggccgugaucc

SEQ ID NO: 33764 - RNA, 64 nt, Human
gucccuugcaaagucuccgcaggugcugugaagagccuuccaugguagagauuucucuuaagag

SEQ ID NO: 33765 - RNA, 64 nt, Human
ugaacuccugaccucaggugauccgccugccuuggccuuccagagugcugggauuacagcauga

SEQ ID NO: 33766 - RNA, 64 nt, Human
aauuuaagaguggggacgugaaacuguauucugugccuuccaucaugauuuccacaugaaagca

SEQ ID NO: 33767 - RNA, 64 nt, Human
ugccauuaguggaaaaaaagaggacagugaaccugccuuccaccugccagagggaccucagggu

SEQ ID NO: 33768 - RNA, 64 nt, Human
ccggaccgccaagaagcucuauggcagcaccuuugccuuccaugggucccacauugagaacugg

SEQ ID NO: 33769 - RNA, 64 nt, Human
ugcgcgcgcguguacguguggccccacauccgccgccuuccacgcuaggauguaagaggucgcc

SEQ ID NO: 33770 - RNA, 64 nt, Human
uccuggccgucaugacagcugcuuggagacccgugccuuccagauggcugggagaugccucugu

SEQ ID NO: 33771 - RNA, 64 nt, Human
gagcccccggcagagcacccgcccccgggccccagccuuccaccugugcuagcagccuggggcc

SEQ ID NO: 33772 - RNA, 64 nt, Human
cacccaacuugggcaccucccugggcccagaacugccuuccauucaauggggaacccuucuauc

SEQ ID NO: 33773 - RNA, 64 nt, Human
uucauuggcacuuugcugcugccuccugagcacugccuuccaugaacagggacagaccagaggc

SEQ ID NO: 33774 - RNA, 64 nt, Human
cuuccugacucaaaggcacuaacagugcucaugugccuuccagacgguucaaggcagaggccac

SEQ ID NO: 33775 - RNA, 64 nt, Human
ggaccuccuagccucaagcaauccacccaccucagccuuccaaguagcugggacuacaggugug

SEQ ID NO: 33776 - RNA, 64 nt, Human
cuuguucuuggccaaagaccaaauuccuuggcaugccuuccagcacccugcaaaaugagacccu

SEQ ID NO: 33777 - RNA, 64 nt, Human
ugggagguggggacagaaaucuguguuuuaagaagccuuccagguaauucugcugcacacucaa

SEQ ID NO: 33778 - RNA, 64 nt, Human
augcacuuuguucuggcucuuccaggcugggagagccuuccaggggugggacacccugugaugg

SEQ ID NO: 33779 - RNA, 64 nt, Human
ccgcccccacccugagcgccuggguccaggggaggccuuccagggacgaagaagagccacagug

SEQ ID NO: 33780 - RNA, 64 nt, Human
gcuuccccagcagcuuucccagagaggcagaggggccuuccacagcccggguucuccugcugcc

SEQ ID NO: 33781 - RNA, 64 nt, Human
cuucccaagugagucucucugggccuuaggaagagccuuccacccaggggcagccccaggccaa

SEQ ID NO: 33782 - RNA, 64 nt, Human
gacccccaggcagccccuuggacuggucccgggugccuuccaagcacagucuccaugcucccag

SEQ ID NO: 33783 - RNA, 64 nt, Human
gcugagcacccagccaggagaccugcagcccugcgccuuccagaagcaggucccaaauaaagcc

SEQ ID NO: 33784 - RNA, 64 nt, Human
ucuccucgucaggggagacuuuuaggaggccgcagccuuccaucaccggaucaguuuuuccucu

SEQ ID NO: 33785 - RNA, 64 nt, Human
ugcagguccuucccucuucucggcacugcccccggccuuccaugagaagccgacuccccacacc

SEQ ID NO: 33786 - RNA, 64 nt, Human
cguuugcuccuggccccuuagugucuggaauguggccuuccacgguugccccacuuugucuuuc

SEQ ID NO: 33787 - RNA, 64 nt, Human
guuuggcucguaacaguuucagcuuucuuguuaugccuuccaucacagcccaggcucaccccaa

SEQ ID NO: 33788 - RNA, 64 nt, Human
auauuuuaaggcaaauaaucacuucaccucuggugccuuccaugcgucgcauaagcacucuugu

SEQ ID NO: 33789 - RNA, 64 nt, Human
gagagccccucauccuuccucugggaccagaugugccuuccacaguugaaacuugagaagcaga

SEQ ID NO: 33790 - RNA, 64 nt, Human
aucaguauguguauggcguacauugguucagucagccuuccacugaauacacgauugagucugg

SEQ ID NO: 33791 - RNA, 64 nt, Human
ggggcccugggucuaugcacagcuggagcucugagccuuccacagcccgugugacugcuagagg

SEQ ID NO: 33792 - RNA, 64 nt, Human
ccaucugucccuggugagaagcaaggcuagcucugccuuccacaugcuucucaggaugccaaga

SEQ ID NO: 33793 - RNA, 64 nt, Human
cagucugaaagggaggcucucuuaagagcuaugugccuuccaaccagagggagacccaguagaa

SEQ ID NO: 33794 - RNA, 64 nt, Human
cgcuagucuggcuguuaagaggagaaagugcacugccuuccagcccaggaggaggacagcauuu

SEQ ID NO: 33795 - RNA, 64 nt, Human
cuuuugcuacucaaaacagcaaugcuuggcggcagccuuccaugaggcagaaggggucgucguu

SEQ ID NO: 33796 - RNA, 64 nt, Human
gggcugucuuuacagccccaacccucagacccucgccuuccaaggcaggccccucagccuggcc

SEQ ID NO: 33797 - RNA, 64 nt, Human
cuccucccugcuccucaugggaagaugucucagagccuuccaugaccuccccuccccagcccaa

SEQ ID NO: 33798 - RNA, 64 nt, Human
cccagaccccuucagccaccagccccuggccugugccuuccaacccauuagccauuucuuguug

SEQ ID NO: 33799 - RNA, 64 nt, Human
cuucugggaaauggcuugaagccaagucagcuuugccuuccacgcugucuccagacccccaccc

SEQ ID NO: 33800 - RNA, 64 nt, Human
uacugggucccccucagcacccuccacagcacaggccuuccaaguggaugucccguugccuuau

SEQ ID NO: 33801 - RNA, 64 nt, Human
ugcuagagcugacagcuuuguucgcgugggcagagccuuccacagugaaugugucuggaccuca

SEQ ID NO: 33802 - RNA, 62 nt, Human
gccuggacaucaaguggugaagucaggccagggccuuccagcugcucuuggggccagagcca

SEQ ID NO: 33803 - RNA, 64 nt, Human
auggcaggaaccuaguacaggucucccacccagggccuuccacccucggcuccugugcugggag

SEQ ID NO: 33804 - RNA, 64 nt, Human
uuucuuucucugcaaacaaguugccaucugguuugccuuccagcacuaaaguaauggaacuuug

SEQ ID NO: 33805 - RNA, 64 nt, Human
gggggagaagcaggggacuccgcagcgggccccugccuuccacaugcccccaccauuuuucuuu

SEQ ID NO: 33806 - RNA, 64 nt, Human
cagucugaaagggaggcucucuuaagagcuaugugccuuccacccagagggagacccaguagaa

SEQ ID NO: 33807 - RNA, 64 nt, Human
cacugagaggagggagcauuaugggaaagucccugccuuccacaccucucucuagucccugugg

SEQ ID NO: 33808 - RNA, 64 nt, Human
ugaacuccugaccucagguguuccacccaccucagccuuccaaagugcuaggauuacaggugug

SEQ ID NO: 33809 - RNA, 64 nt, Human
acacaagccauucuaaauacuuagccaguuuccagccuuccagaugaucuuugcccucuggguc

SEQ ID NO: 33810 - RNA, 64 nt, Human
caaacucgugugcccaagcaauccaccugccucagccuuccaaaagugcugggauuacaggcgu

SEQ ID NO: 33811 - RNA, 64 nt, Human
cuggauaaucuggucaauguaaugaauggauacugccuuccagauccuuucuuuagcagcaagg

SEQ ID NO: 33812 - RNA, 64 nt, Human
aagcacagaucccagacuuugccagaggcaaacagccuuccaauugccccuccacccccagcug

SEQ ID NO: 33813 - RNA, 64 nt, Human
cauccuggcucgcuggauuuguggguguuuucaggccuuccauuccccauagaggcaaggccca

SEQ ID NO: 33814 - RNA, 64 nt, Human
aauaccagugaacuuaaagaauuugucaauccuagccuuccaagagaagaaaaagaagagaaac

SEQ ID NO: 33815 - RNA, 64 nt, Human
gugagccauaauaugaugggcagcagguggcgcugccuuccacccauggugauggaugguuugg

SEQ ID NO: 33816 - RNA, 64 nt, Human
uaaacuggguaccucacugcacagcuucuagguagccuuccaacuuaaucuaacuugagccuca

SEQ ID NO: 33817 - RNA, 64 nt, Human
ccccaccacgucugugcccugcacuguccccacagccuuccacacccugugcauaggcagcccu

SEQ ID NO: 33818 - RNA, 64 nt, Human
cagggacuucaccaaagucacccucgcgggcugggccuuccacgcaucccccccaccccccaug

SEQ ID NO: 33819 - RNA, 64 nt, Human
guucugacccagccaguccuggugacuggccucugccuuccaccggagagacuacugaccuucu

SEQ ID NO: 33820 - RNA, 64 nt, Human
cagucugaaagggaggcucucuuaagagcugugugccuuccacccagagccuugugggagaccc

SEQ ID NO: 33821 - RNA, 64 nt, Human
caguggacuuuuucacuucuauacuuuguaugcggccuuccacacuuccagagaaugucagugu

SEQ ID NO: 33822 - RNA, 64 nt, Human
ugauuugaaauacaauaaaugaaggcaaugcauggccuuccaauaaaaaauauuugaagacuga

SEQ ID NO: 33823 - RNA, 64 nt, Human
agcuuccuccagaggaggggacuuguaggaaucugccuuccagcccagacccccaguguauuuu

SEQ ID NO: 33824 - RNA, 64 nt, Human
uuacuguccugggaaaaucauuuuuauagagauggccuuccaagugguuuuaaaauuuacugaa

SEQ ID NO: 33825 - RNA, 64 nt, Human
cucugggaucucugguaccgucacucuugcuugugccuuccacaccuucucggugcagaucccu

SEQ ID NO: 33826 - RNA, 64 nt, Human
ucccgcaagcugccagucggcucuuuuucgcaaagccuuccagaaguuuucugugcuuaugaaa

SEQ ID NO: 33827 - RNA, 64 nt, Human
caguuagucauuuggucaaaccaaugacaaaaccgccuuccacaaaaguugaaauaagaaacaa

SEQ ID NO: 33828 - RNA, 64 nt, Human
cgaggaagaccacccggcauucucugcccacuuugccuuccaggaaaugggcuuuucaggaagu

SEQ ID NO: 33829 - RNA, 64 nt, Human
cgaacuccugaccucaggugauccacccgccucggccuuccaaagugcugggauuacaggcgug

SEQ ID NO: 33830 - RNA, 64 nt, Human
gauacaguuuugaguaaaaagacauuuuuuaaaagccuuccaguuuuguggauuaaaccuuuuu

SEQ ID NO: 33831 - RNA, 64 nt, Human
ccacagcucacuuaccucucuguguucagauguggccuuccauuuauaugugaucuuuguuuua

SEQ ID NO: 33832 - RNA, 64 nt, Human
uggccccgcccgagccccugcccacgcccuuggagccuuccaccggcacucaugacggccugcc

SEQ ID NO: 33833 - RNA, 64 nt, Human
gggccaggguuaugcaggaagguggugcggcauugccuuccacauauguaagucucugggcggc

SEQ ID NO: 33834 - RNA, 64 nt, Human
acucuggcgcacucuaguggacaggagaaggaacgccuuccaggaaccuguggacuaggggugc

SEQ ID NO: 33835 - RNA, 64 nt, Human
aauccacuagcuaagacgucgagugccaagaccagccuuccagccgagguuuggacaaagucuc

SEQ ID NO: 33836 - RNA, 64 nt, Human
agcacacgguacuguagcccccaguuccucccuagccuuccaucccucuguccaccccaggggg

SEQ ID NO: 33837 - RNA, 64 nt, Human
gaauauguggcuaucaccuugagcacugacaguggccuuccaggcuaguugccuuccaaacgca

SEQ ID NO: 33838 - RNA, 64 nt, Human
ccuugagcacugacaguggccuuccaggcuaguugccuuccaaacgcagguagccgaccugcag

SEQ ID NO: 33839 - RNA, 64 nt, Human
ccagacacugaacgcaggccucaaaacugcugcggccuuccaacuccugguaucugcaucggcg

SEQ ID NO: 33840 - RNA, 64 nt, Human
ugcuauggugcaauuuuuguucacugcaaccucugccuuccaagaucaagagauucuccagucu

SEQ ID NO: 33841 - RNA, 64 nt, Human
gaccuuuuauuuucuguuuguccccaccuccccagccuuccaccuccuguucuuccuaccuucu

SEQ ID NO: 33842 - RNA, 64 nt, Human
uggccucaccaucggcugagcccuccuggcccccgccuuccacgcccuuccgauuccaccucca

SEQ ID NO: 33843 - RNA, 64 nt, Human
ucuguaguuccuuuaaguucaggauguaagcgaagccuuccauuaaguaaaggugagugucguu

SEQ ID NO: 33844 - RNA, 64 nt, Human
ggucccuuuugaagaaugaaugaaaccuuccuaagccuuccagcaauuuccccccaacuccgau

SEQ ID NO: 33845 - RNA, 64 nt, Human
caggccuccucuuccucaaaggccccuccccccagccuuccaagcccaucccgacucccggggc

SEQ ID NO: 33846 - RNA, 64 nt, Human
cuuuacucuuugugacuucgaaaucuuuucaugugccuuccauacaggccauucacuguggucc

SEQ ID NO: 33847 - RNA, 64 nt, Human
ucugcgcuguuguuggggaagggaccccaguccugccuuccaccccccaaccaggccugagacu

SEQ ID NO: 33848 - RNA, 64 nt, Human
gcaggaaagcaggauuugagagaacauacaccuugccuuccagauaugugguuuuugugauuca

SEQ ID NO: 33849 - RNA, 64 nt, Human
cucccaccagccacugcuuccuccugggcccucggccuuccaccccucgucuucccucccucgg

SEQ ID NO: 33850 - RNA, 64 nt, Human
ggucucuccuuccuccucccuagcucagggaugggccuuccagccggagcaccccgauccccau

SEQ ID NO: 33851 - RNA, 64 nt, Human
gcugacugccagaucccugcauuucaagcacuacgccuuccacccccaggcacuggaucccaga

SEQ ID NO: 33852 - RNA, 64 nt, Human
cccucaaccccccggcuucagggaccccagaagugccuuccaagcuucccccaagauccacauc

SEQ ID NO: 33853 - RNA, 64 nt, Human
guaaccucuggguucaagcaauucuucugccucagccuuccaaguagcugggauuacaagugcc

SEQ ID NO: 33854 - RNA, 64 nt, Human
cccauccagagcauggagcccgaccccagccagcgccuuccacuccaucauuucauuucacacc

SEQ ID NO: 33855 - RNA, 64 nt, Human
ugcaguggugcaaugugggcucacugcaaccucugccuuccagguucaagcaauuauccugccu

SEQ ID NO: 33856 - RNA, 64 nt, Human
uuuuauauuagagaaagaauauguugauuuaaaagccuuccaacaccauuuaaacaugguuuau

SEQ ID NO: 33857 - RNA, 64 nt, Human
cagcacuacccuucuugcaagacagccugacugugccuuccagggccugggaccauuggcuggg

SEQ ID NO: 33858 - RNA, 64 nt, Human
caagggaucugggugggcauuuuuaacuuuggaggccuuccaucugucgguaggccaucugcau

SEQ ID NO: 33859 - RNA, 64 nt, Human
gauggccagaaugaaugugauaguucagaccaaugccuuccacugcuccuuuaugacugcacuu

SEQ ID NO: 33860 - RNA, 64 nt, Human
cuugaucuccugaccucaugauccacccgccucggccuuccaaagugcugggauuacaggcaug

SEQ ID NO: 33861 - RNA, 64 nt, Human
caggccuccucuuccucuaaagacccuccccgcagccuuccaaguccaucccgacuccuggagc

SEQ ID NO: 33862 - RNA, 64 nt, Human
caggacuccucuuccucaaaggccccuccccccagccuuccaaguccaucccgucucccggggc

SEQ ID NO: 33863 - RNA, 64 nt, Human
gucgcucgacugcgacgcagguguaccucccccugccuuccaaccccuuuccacgagcuauauu

SEQ ID NO: 33864 - RNA, 64 nt, Human
cauucucaccaugugaaauaccgacacccgcuuugccuuccaccaugauuuuaaccuuccugag

SEQ ID NO: 33865 - RNA, 64 nt, Human
aaaagucaaucugggaacugcgucagacaaaccugccuuccauuuuauuccuaaacaagauagu

SEQ ID NO: 33866 - RNA, 64 nt, Human
uucuccugccucugaacugagccaaaccuucagugccuuccagaagggagaaaggcagaagccu

SEQ ID NO: 33867 - RNA, 64 nt, Human
gaggcaggggcagaaacccaagggggcucccccagccuuccaaggugaggccaucucaucugca

SEQ ID NO: 33868 - RNA, 64 nt, Human
gggagugagggcguggggaggaaccaugcaaaucgccuuccaugguuuuuaaaugcaguaaaua

SEQ ID NO: 33869 - RNA, 64 nt, Human
ucaugggugaguucccugggcagcccccaggaaggccuuccagaucuggcuccagggucaccac

SEQ ID NO: 33870 - RNA, 50 nt, Human
aguuugucaucaaggucuaagccuuccaggaaggggcuggccucugcuga

SEQ ID NO: 33871 - RNA, 64 nt, Human
caaacuccugggcucaagugauccacccaccuuggccuuccaaaguggugggauuaugggcagg

SEQ ID NO: 33872 - RNA, 64 nt, Human
acugcugaaaaagcugagcaccuggucacccuuggccuuccauugcuuuggccuucaguaaaaa

SEQ ID NO: 33873 - RNA, 64 nt, Human
gggagguggugcuucccuacccccuagaaaugcugccuuccaacuaccacucucccagauguga

SEQ ID NO: 33874 - RNA, 64 nt, Human
cacagacgcucuccagguucucaagaguuauccugccuuccagauuccugccuaucccaacucc

SEQ ID NO: 33875 - RNA, 64 nt, Human
cacuuccgacuggcucccuucgggggcugucugcgccuuccacgccccccaggacgggcccaga

SEQ ID NO: 33876 - RNA, 64 nt, Human
ggcuccaaggacaagcauggcgguggccccuucugccuuccaggagaggucuugcuuuugaaac

SEQ ID NO: 33877 - RNA, 64 nt, Human
aacaucaccccagagcccagccuuauccagcagcgccuuccagccuucccuggcuagcccaaau

SEQ ID NO: 33878 - RNA, 64 nt, Human
ugaauugcagcccccuccaguuugcuuuccuuuggccuuccagaccccaggaaguuggccuucc

SEQ ID NO: 33879 - RNA, 64 nt, Human
auugggccacgaggaacaaacagcagaugcccuugccuuccaguccaagaaacugcuucuugaa

SEQ ID NO: 33880 - RNA, 64 nt, Human
acccagccccagcgagucuggagaccaggacucugccuuccaggcguagggccagggcucuggc

SEQ ID NO: 33881 - RNA, 64 nt, Human
gcaccucucacccacccagagauggagcugcucugccuuccagcggggcacccggagggcugcc

SEQ ID NO: 33882 - RNA, 64 nt, Human
cacucuuguggcucuauccuccuccugcccuuccgccuuccacuccucccuugcacccauccug

SEQ ID NO: 33883 - RNA, 64 nt, Human
ugaacuccuaaccucaagcaauccucccaccucggccuuccaaagugcugggauaauaggcaug

SEQ ID NO: 33884 - RNA, 64 nt, Human
ugcggucuccugaccuuggccagugaaccugccagccuuccaggacaggcggccggagagcugc

SEQ ID NO: 33885 - RNA, 64 nt, Human
cuuugauguggguccccuguugauuauaugugcggccuuccagcugcccaccaucacagcuaca

SEQ ID NO: 33886 - RNA, 64 nt, Human
aauagggauggggagcccucuggggaugagcaaggccuuccaggacaggcucgguucugguccc

SEQ ID NO: 33887 - RNA, 64 nt, Human
uccucuggcuucagcuucucagcagcaagcaccagccuuccacaacaacacuauauuuuuaugc

SEQ ID NO: 33888 - RNA, 64 nt, Human
ugcagcagccaagcgcaugagagguguuuccuuggccuuccagaaggcccacuguggagccagc

SEQ ID NO: 33889 - RNA, 64 nt, Human
cggcccuguagcccuggcccggucccaguccggugccuuccacccugcccuggccuaccacagc

SEQ ID NO: 33890 - RNA, 64 nt, Human
gcagcugggcugggaaucuuccccuuuguucaaggccuuccaguaaggcccagcuguccccuug

SEQ ID NO: 33891 - RNA, 64 nt, Human
cauggguaaccaucagaggaaaaagccaugcucagccuuccaguugaguggguaacgacugagu

SEQ ID NO: 33892 - RNA, 64 nt, Human
caaggcugucggggucaagcuggaaaggccagcagccuuccaguggcuucucccaacacucuug

SEQ ID NO: 33893 - RNA, 64 nt, Human
uucuuccagggugggguggccugguguuccccuagccuuccaaacccagguggccugcccuucu

SEQ ID NO: 33894 - RNA, 64 nt, Human
ggcugguccugaaggccugucucccacuaaccccgccuuccagcacuuucugucauuccaggcu

SEQ ID NO: 33895 - RNA, 64 nt, Human
ccaagccuuguuccugugcugcaucacccacucagccuuccaaagggaacaggaacaaauuucc

SEQ ID NO: 33896 - RNA, 64 nt, Human
cucccuucccaccuacugcacuuucccccuucccgccuuccaaaaccugcuuccuucaguuugu

SEQ ID NO: 33897 - RNA, 64 nt, Human
cuccccagaguaggggagaagguugggguguagggccuuccacguggaacagacagccccugug

SEQ ID NO: 33898 - RNA, 64 nt, Human
cguugcagguuccugauuuggacagagguguggggccuuccaggccguuacauaccuccugcca

SEQ ID NO: 33899 - RNA, 64 nt, Human
cugagggggaccaggcagcccucagcagccacaggccuuccaggagcuguuaucacuaccaguu

SEQ ID NO: 33900 - RNA, 64 nt, Human
aacccccaggauggcggaagcucaccaggccguggccuuccaguucacggugaccccagacggg

SEQ ID NO: 33901 - RNA, 64 nt, Human
aaauauaugcagaacauuuuaaagaaaaugcccggccuuccagaaauauuuuucaaaggacuag

SEQ ID NO: 33902 - RNA, 64 nt, Human
cacucagaaccucucuggaauuugugccugaugugccuuccacuggauuuugggguucccagca

SEQ ID NO: 33903 - RNA, 64 nt, Human
uuucacuugcaguuuccuguucuccucauugccugccuuccauucauauuacacuuauuuuucu

SEQ ID NO: 33904 - RNA, 58 nt, Human
acgauaucccauaccuuuaaugccuuuggccuuccauucugauuucucugaugagaau

SEQ ID NO: 33905 - RNA, 64 nt, Human
cuagguccacacagugaugccaugggggacccuugccuuccacacuugcaggugucacguuuug

SEQ ID NO: 33906 - RNA, 64 nt, Human
auggggguuuucuugugccuugcuugcuuucauagccuuccauuuuauuggcauggcugccuug

SEQ ID NO: 33907 - RNA, 64 nt, Human
acucagggugcuccagcgcuggggaguggugagggccuuccagagauccucguacucuuucucc

SEQ ID NO: 33908 - RNA, 64 nt, Human
cuuuccaagaagucaaacugccuguguccucaucgccuuccaccuuuaggaaaugcuaucuuug

SEQ ID NO: 33909 - RNA, 58 nt, Human
acgauaucccauaccuuuaaugccuuuggccuuccauucugacuucucugaugagauu

SEQ ID NO: 33910 - RNA, 64 nt, Human
cucuucccaucgucuuguguacacugcuccuguggccuuccacagcagaaaccagggcaaaagg

SEQ ID NO: 33911 - RNA, 64 nt, Human
cuuauuccagggccuuuucccacuaaguaguauugccuuccauuaggcuccugagaguuauuuc

SEQ ID NO: 33912 - RNA, 64 nt, Human
augcaguacuaaaauuaaugcagauuucucuuuagccuuccaacauuucuuguugauagugaug

SEQ ID NO: 33913 - RNA, 64 nt, Human
uuuauuuuugcaaaugugcuuucuaauagccauugccuuccauguuguuuaccuaaucagcaua

SEQ ID NO: 33914 - RNA, 64 nt, Human
ugaagucuccuggcauauguuaccgaaucaaauagccuuccagaggcuaagaaauuucuguuag

SEQ ID NO: 33915 - RNA, 64 nt, Human
gagugugggugguccugcuugugucauggucauggccuuccagcccccuccaguuuuccccaaa

SEQ ID NO: 33916 - RNA, 64 nt, Human
caggggugagugcauugaagaaguagguuuuggagccuuccaggaauuccuuguugacaacagg

SEQ ID NO: 33917 - RNA, 64 nt, Human
gcaguuaaaucaucuguuagccccuaacucuacugccuuccacauauugguuccuugauacauu

SEQ ID NO: 33918 - RNA, 63 nt, Human
gcagucuucaugcugcccugcugcugcuggaaggauggggaucuuucaccuuuagggaucuca

SEQ ID NO: 33919 - RNA, 52 nt, Human
ugugguugagugaggagugaaggauggggaggaggccucuggggaagggguu

SEQ ID NO: 33920 - RNA, 63 nt, Human
ucuccauuccccgagaagccgggggcagggugggauggggaagaccaggagcagagucgagcc

SEQ ID NO: 33921 - RNA, 63 nt, Human
cugagggaauccuguacaggaugucccaggguagauggggagcaggauugggaccugcucuga

SEQ ID NO: 33922 - RNA, 63 nt, Human
agugaucagucgccucaguaaagcagaucuguggauggggagccuacgggugguaagaagugg

SEQ ID NO: 33923 - RNA, 63 nt, Human
gcuaugguuccuuccucaggaggccuccaaucugauggggaagacauggccccucccccuggg

SEQ ID NO: 33924 - RNA, 63 nt, Human
gggugggauugggugggaaugggguggaagggugauggggagcuaaugaacuagggagaaaaa

SEQ ID NO: 33925 - RNA, 63 nt, Human
cuaccagggcuuccagaccuguggaacgaagaggauggggaaaaggcagagggcacugagugu

SEQ ID NO: 33926 - RNA, 63 nt, Human
accucucccaccaucccagacugugggcagggggauggggagggagugggccuggaucuggga

SEQ ID NO: 33927 - RNA, 63 nt, Human
ggcugccuggacuggucuggcagguugggccuggauggggaggcucuagcaucucucauaggu

SEQ ID NO: 33928 - RNA, 63 nt, Human
uuggggaauggggugggggugggagaggagguagauggggaagaaauaccccagacccaacaa

SEQ ID NO: 33929 - RNA, 63 nt, Human
gacuguucauuuuuuuccugccccacugcuugggauggggaguugcaacuucaguguggaauu

SEQ ID NO: 33930 - RNA, 63 nt, Human
ccucucucagcccuccauggccuggcacgaggggauggggaugcuuccgccuuuccggggcug

SEQ ID NO: 33931 - RNA, 63 nt, Human
aguacuuucgguucugaaaucauauuacuaacagauggggaagauuaucaaauaagcuuaugc

SEQ ID NO: 33932 - RNA, 63 nt, Human
ggacuuuugacuucaggccagucauuuccucccgauggggaaagggugagauuuacaucccca

SEQ ID NO: 33933 - RNA, 63 nt, Human
uagaacuggcaugguucaaagaggggcuaggcugauggggaagggggcugagcagcucccagg

SEQ ID NO: 33934 - RNA, 63 nt, Human
auuguaauuauccuggauucagaauaauacugugauggggagccagauccgcagugguggaga

SEQ ID NO: 33935 - RNA, 63 nt, Human
cugaagaaugguauccagucaucagccaggaaagauggggauucacuuacaugccucauguca

SEQ ID NO: 33936 - RNA, 63 nt, Human
ugcauggaucugggucaaguagaagguacuggggauggggacauuccugcccauaaaggauuu

SEQ ID NO: 33937 - RNA, 63 nt, Human
cagggcaguaagaagggcugcaaggaaggggaggauggggacaaggaaaggaucagauaccug

SEQ ID NO: 33938 - RNA, 63 nt, Human
cucuauuacuaaugccuuccaaucagaguuccugauggggaugccugugggauggcccacacc

SEQ ID NO: 33939 - RNA, 63 nt, Human
cuuuccuguggacucuggugauucauagagccggauggggagagucaacaggaaaaaaggagg

SEQ ID NO: 33940 - RNA, 63 nt, Human
cucuuauaguggaaggauggucagcauuaggcugauggggacugagaaggauaggaagggaua

SEQ ID NO: 33941 - RNA, 63 nt, Human
ugcugguggcugcugaggccuugguggacagaggauggggaaaggggucaggaggaaaaagcu

SEQ ID NO: 33942 - RNA, 63 nt, Human
gguaaccgcuagagggugcgcaccuggaugcuggauggggacggcugcgggcaucugcagggu

SEQ ID NO: 33943 - RNA, 63 nt, Human
ugaccccauuggaagaagaaccaggcauggaaagauggggagcucuggagguguuguggggau

SEQ ID NO: 33944 - RNA, 63 nt, Human
gacugugcugggaacauguaccacugagccugagauggggaugagggcagagagaggggagcc

SEQ ID NO: 33945 - RNA, 63 nt, Human
agggcucgggagccaugucaugugagugggugggauggggacauuugaacauguuuaaugggu

SEQ ID NO: 33946 - RNA, 63 nt, Human
uucacugcuccugugagagguugguggugacaggauggggaaccgaccucuucagccagugga

SEQ ID NO: 33947 - RNA, 63 nt, Human
agagacugauuuaggagcauugugucccuucgagauggggauccacacacugugaaugugaug

SEQ ID NO: 33948 - RNA, 63 nt, Human
aaauggaucccugagcucugagccaagggugaggauggggaaacucuaagcucccaccuaaua

SEQ ID NO: 33949 - RNA, 63 nt, Human
cccaaaauggugcuuuggauuugaaaagggucugauggggagaaggagaacguaucauccuag

SEQ ID NO: 33950 - RNA, 63 nt, Human
ggacacugaggcucuuguuugacaugguguguggauggggacuugccccaagacugagcaggu

SEQ ID NO: 33951 - RNA, 63 nt, Human
ggugacacccacccuaggcuuccuccuggaugugauggggauugccagagaggcucuuagcau

SEQ ID NO: 33952 - RNA, 63 nt, Human
cugugggagacagcccaccuugaaggggaaggagauggggaaggccccuugcagcugaaaguc

SEQ ID NO: 33953 - RNA, 63 nt, Human
gcugggcugcuccugaaugaggcggagcuccaggauggggaggggcucugcguuggcuucucc

SEQ ID NO: 33954 - RNA, 63 nt, Human
gcaggguuccugugguuucccuggucccucugagauggggacagacugaagacagaggucguu

SEQ ID NO: 33955 - RNA, 63 nt, Human
ccccggacccugccccuccaaguuggggacggagauggggagcaggucaggcccucccuaggc

SEQ ID NO: 33956 - RNA, 63 nt, Human
uauaauuuaaagaugugaugguggggaggggaggauggggaagcuuuuuauauaugcauacau

SEQ ID NO: 33957 - RNA, 63 nt, Human
ucagaacagcugaaacauuccgaagagggaauggauggggagaauggucaauacacauaagac

SEQ ID NO: 33958 - RNA, 63 nt, Human
uacacaugacagacaaguaacccccucaugggggauggggaccuaccuggcuccucagccagc

SEQ ID NO: 33959 - RNA, 63 nt, Human
uguggaaauaggggcacacacagaugauucauggauggggacauggaaaugagaauagguuaa

SEQ ID NO: 33960 - RNA, 63 nt, Human
ucugccccccaacuuuuuucuuuuuaaaaauaagauggggaguguucauaaaauuauagaugu

SEQ ID NO: 33961 - RNA, 63 nt, Human
guaucuugauaggaaacaacaaaagcagguugagauggggaagaugacagaacaacaguguua

SEQ ID NO: 33962 - RNA, 63 nt, Human
uagugcuuuguccuggacuccacucagccucaggauggggaauagccaagaauggcagccuca

SEQ ID NO: 33963 - RNA, 63 nt, Human
auuaucagagaaagggaccauugggugcauagagauggggaggaggccacugggcugaauuuu

SEQ ID NO: 33964 - RNA, 63 nt, Human
guucuagagcaagguugcggaaaucgggguggagauggggagcagugacuccuccaaauauuc

SEQ ID NO: 33965 - RNA, 63 nt, Human
auuuugaauucuaguuuucauaaucuauuagaagauggggauauaaaagaaguauaaggcaau

SEQ ID NO: 33966 - RNA, 63 nt, Human
acucucugcccuuggacccauuuauuauucacagauggggagaaccuaucugcauggaccucu

SEQ ID NO: 33967 - RNA, 63 nt, Human
aagagcaaaggacccacaggcuacagagaagaggauggggacagagugugggauggagaggac

SEQ ID NO: 33968 - RNA, 63 nt, Human
uucguagaauuccuuuugaaugaauugaguggggauggggacacagucuccaaguguguaugu

SEQ ID NO: 33969 - RNA, 63 nt, Human
cucccucccucccuggacuucucaucuucacaagauggggaucauggggguuucuuaccccac

SEQ ID NO: 33970 - RNA, 63 nt, Human
gcccuguucuccugucccuccaucccagacauugauggggacauuucuuccccagugucagcu

SEQ ID NO: 33971 - RNA, 63 nt, Human
auuugguuuaagcaggaauccuagaagcaaauggauggggauaagaauaggucauuuucuauu

SEQ ID NO: 33972 - RNA, 63 nt, Human
cuucaacugucuccuaccucugcucuuggaggagauggggacagggcuggagucaaaacacuu

SEQ ID NO: 33973 - RNA, 63 nt, Human
caggaugauuuccuggggcacagugggugaggagauggggacaggugaauggaggaguuaggg

SEQ ID NO: 33974 - RNA, 63 nt, Human
ucugaaucaccaauuaaaaaccuuuuugggagggauggggaaaacuacaaacguuugacaaac

SEQ ID NO: 33975 - RNA, 63 nt, Human
cuccuugaaucugagacuggcugcccauucugagauggggaugaagguaagaugccgcaucac

SEQ ID NO: 33976 - RNA, 63 nt, Human
cacccugcuugagccaaagacaaggugaugagagauggggagaggccauuggcucccagaggg

SEQ ID NO: 33977 - RNA, 63 nt, Human
ccacauaggauuucucuuaauucagcuugaauugauggggagggagguaagaguagggucaga

SEQ ID NO: 33978 - RNA, 63 nt, Human
gucacacugggagucucagauggaaggacaagugauggggaucaggccccagagcuugcuguc

SEQ ID NO: 33979 - RNA, 63 nt, Human
augccaguguaguggaaaaguaguacauggggagauggggaguuuuuuugaaaaccagaauua

SEQ ID NO: 33980 - RNA, 63 nt, Human
acugaccacguagcaugggggcaagaggcgugggauggggauuggggugagauggaugggagc

SEQ ID NO: 33981 - RNA, 63 nt, Human
guagagauauuugggguggggacagugaguuuggauggggaaaugggugggagggugguguug

SEQ ID NO: 33982 - RNA, 63 nt, Human
caaauuucugauugcccuaaauguagagagacugauggggaaaguaugauggguuugauuuuu

SEQ ID NO: 33983 - RNA, 63 nt, Human
ugacugggccgaugcuuaggaauauuuaugagggauggggagggagacaauuggaaugggggc

SEQ ID NO: 33984 - RNA, 63 nt, Human
ugccaaauuccaugucccuguauaauucuacaggauggggacacuaaugaagauacgguugcu

SEQ ID NO: 33985 - RNA, 63 nt, Human
ucgcauuggcgcaauauuuaugggagugggagggauggggaaaauaaacuuaacucuacaaaa

SEQ ID NO: 33986 - RNA, 63 nt, Human
ugaugcuuguucgcucagcuucuccauuuaugagauggggagaauagucacagccuccucaaa

SEQ ID NO: 33987 - RNA, 63 nt, Human
uuuaaccaauggaugagggggguggccacaggagauggggagaggagucugaacuaaaccccu

SEQ ID NO: 33988 - RNA, 63 nt, Human
aagggaggggagcagccuaguuggucuuggagagauggggaaggcuuucagcugauuugcaga

SEQ ID NO: 33989 - RNA, 63 nt, Human
cuauuuugcuuuuguauuuuaguuaaaauaaucgauggggauguguagcccccccgugugagg

SEQ ID NO: 33990 - RNA, 63 nt, Human
uucagaaauccuacuucagaaguguaauaaauggauggggaaaucguuugauggggaaaaguc

SEQ ID NO: 33991 - RNA, 63 nt, Human
cagaaguguaauaaauggauggggaaaucguuugauggggaaaagucucuuguaaguaaaagu

SEQ ID NO: 33992 - RNA, 63 nt, Human
uguuuucuuuguugcagccaaaucaaaguacuugauggggaagaugaauauuacaaaucucug

SEQ ID NO: 33993 - RNA, 63 nt, Human
uccugcccgagggcagcccccucccuagagcgggauggggaugggagggggggcgggauucuc

SEQ ID NO: 33994 - RNA, 63 nt, Human
uuccaauucugugaagaaagucaucgguagcuugauggggauggcauugaaucuauaaauuac

SEQ ID NO: 33995 - RNA, 63 nt, Human
gauggguauuuguagggccggagggaugguagugauggggagaaggugaggaagggucacccu

SEQ ID NO: 33996 - RNA, 63 nt, Human
ggaggggcccgaggagccagguugcauuuauuggauggggagcuccaaggggcauuagugguu

SEQ ID NO: 33997 - RNA, 63 nt, Human
uaguagcccaggucggcuugucacucgcugugagauggggagauuuugucuuuugauuuaucc

SEQ ID NO: 33998 - RNA, 63 nt, Human
cgcacucuccagcagaaugucugcuugugucuagauggggaaggagcagguucaucggguacu

SEQ ID NO: 33999 - RNA, 63 nt, Human
auggcgcaggacccuuguccugguggcacaagggauggggacgcgagggggaggggaggcgag

SEQ ID NO: 34000 - RNA, 63 nt, Human
agacugguggcggugggaggguuugcugggacugauggggacaccggccagcuugucuggugu

SEQ ID NO: 34001 - RNA, 63 nt, Human
aguuacuuuguaauuuauuguggcaugagauaagauggggaaaauuuuguuuuaagugguaug

SEQ ID NO: 34002 - RNA, 63 nt, Human
uugggggggaugugcccuacagaagacauagaagauggggaaaugccaaugggcaaagagcua

SEQ ID NO: 34003 - RNA, 63 nt, Human
uacucugucuccaaaggcaacgugaaaagaaaugauggggaggaaaaaaccccauagauugaa

SEQ ID NO: 34004 - RNA, 63 nt, Human
cucucagcuucauagaacggguaacuagugcaggauggggaaauguucacagacaucaucugu

SEQ ID NO: 34005 - RNA, 63 nt, Human
cuucaaaacaauuaauuugcauaguuaauuugggauggggaagcaaaugacucuaaaauaaaa

SEQ ID NO: 34006 - RNA, 63 nt, Human
uuauauauaaaauauauauguggaguuuugugggauggggaagagauuuuaguuguuauuuaa

SEQ ID NO: 34007 - RNA, 63 nt, Human
aagggggagcuccuuccgcugcggcuccagauagauggggaugccgggcuccaggccgaccag

SEQ ID NO: 34008 - RNA, 63 nt, Human
ucuucacccucaguuuccucacuugaggagugggauggggagaacagagaguagcuguguuug

SEQ ID NO: 34009 - RNA, 63 nt, Human
uuuuuuuguggaggggggacggagaggaacaaggauggggagguaggaaugagguauagaaaa

SEQ ID NO: 34010 - RNA, 63 nt, Human
aguuuagaccuucucuucauaaucuugcucugagauggggaacagaacacacaaguaugaagu

SEQ ID NO: 34011 - RNA, 63 nt, Human
uuguguaaucacuaagucuuuguagauaaagcagauggggaguuacggaguuguuccuuuacu

SEQ ID NO: 34012 - RNA, 63 nt, Human
aaggucucauuauauauugggugcuaaauguuugauggggaaagccugcauauauuaucguac

SEQ ID NO: 34013 - RNA, 63 nt, Human
uagggguauggugcgccgcaugacaugggaggcgauggggacgauggacagagacagagcgug

SEQ ID NO: 34014 - RNA, 63 nt, Human
gcuccccgaggcacccuccucucccugcacacagauggggaaaccgagggcugguagggauga

SEQ ID NO: 34015 - RNA, 63 nt, Human
ggccaggcccugagagucuggucugcgccuugggauggggagucccaaagcgggacgccgcag

SEQ ID NO: 34016 - RNA, 63 nt, Human
uguggcuucauuauacugagccaugugucagaggauggggagacaggcaggaccuugucucac

SEQ ID NO: 34017 - RNA, 63 nt, Human
uuuuuuuuuuuuuuuuuuuuugcuuccaguugggauggggaaggccuuuguguguguauuggg

SEQ ID NO: 34018 - RNA, 63 nt, Human
uucuucaggggucuuuuguuuugaaauacucaggauggggagagguuuauuuaagaacgaauu

SEQ ID NO: 34019 - RNA, 63 nt, Human
gggaagcuggaccaccuggaguugauccucugugauggggaggcggggggggggggggguguu

SEQ ID NO: 34020 - RNA, 63 nt, Human
uuucuuuucucucugucuuuaggaguagggugggauggggagggaggcugggcaucagggauc

SEQ ID NO: 34021 - RNA, 63 nt, Human
gaaaacuugccacuagauggcagugccuguauagauggggaaaaaauugccaccauucuuggu

SEQ ID NO: 34022 - RNA, 63 nt, Human
caaugcaguuugcugcaugccuggaaacugcaagauggggagggagggggcgggucuugcucg

SEQ ID NO: 34023 - RNA, 56 nt, Human
ccggagcagugucugucugacggcaggauggggagcuggagagcccccccgacccu

SEQ ID NO: 34024 - RNA, 63 nt, Human
aaagugcuguuggagcauggaggagcuggaggagauggggauggacugacagcuaagagggcg

SEQ ID NO: 34025 - RNA, 63 nt, Human
aaauucucaaaaaaaaaccccacgaaauuuaaagauggggaaaaaaagaugguauaaaaaugg

SEQ ID NO: 34026 - RNA, 63 nt, Human
uucuagcauuuagaucuacacucucgaguuaaagauggggaaacugagggcagagagguuaac

SEQ ID NO: 34027 - RNA, 63 nt, Human
caaacuggcaccuguaccugccagcaggagcaugauggggacuuccaugcuggaauugcuccc

SEQ ID NO: 34028 - RNA, 63 nt, Human
guugggggaaagcgcacuugagacagagguaaugauggggacgaagugagaacagagacccag

SEQ ID NO: 34029 - RNA, 63 nt, Human
auuuacuuaagaguuucuguuacuuuuuguucagauggggauuugcuaaagguucugggaagc

SEQ ID NO: 34030 - RNA, 63 nt, Human
gcauggagauguucguauguaugaggaguuagggauggggagucaaguucuagaaaguuuugu

SEQ ID NO: 34031 - RNA, 63 nt, Human
uuguugaaugaaugaauggugucaugggugaaugauggggaguaaauuuaggaaggggaagug

SEQ ID NO: 34032 - RNA, 63 nt, Human
ucagagaagcgugaaguuugcacuaugguggaggauggggaaagaguucuaaagugucuccag

SEQ ID NO: 34033 - RNA, 63 nt, Human
auucagacggugaagacugacuucugggacgaggauggggaaagaggcagcaugucuuuguua

SEQ ID NO: 34034 - RNA, 63 nt, Human
uguggcugccuucagagcgccaccuccagaucagauggggacacacaaccccuggauauguuu

SEQ ID NO: 34035 - RNA, 63 nt, Human
gaagcaagaguaggguuguggaaagaccaagcugauggggagggacuuguuuacgggaauuuu

SEQ ID NO: 34036 - RNA, 63 nt, Human
ugauaacauuaaauacucaauaaaucaccaugagauggggacucaaacuucugguaaaaauac

SEQ ID NO: 34037 - RNA, 63 nt, Human
ugggagcuaaaugaugagaacacauggacacaugauggggaacaacacacacuggggccuguu

SEQ ID NO: 34038 - RNA, 63 nt, Human
uuuuuuuuuuuuuuuuuuugagcugcggggcaugauggggauugcugcauaucagcaguugga

SEQ ID NO: 34039 - RNA, 63 nt, Human
aaagcuuuucucacugaguuguuuuuauguauugauggggacuuuuccaccucauuagacuaa

SEQ ID NO: 34040 - RNA, 63 nt, Human
aauuuucauuauaaugaguuccagugacucaaugauggggaaaaaaaucucugcucauuaaua

SEQ ID NO: 34041 - RNA, 63 nt, Human
gugccuguccccuaccuuuauguuauguuuacugauggggauacaagaugugacacacccuuc

SEQ ID NO: 34042 - RNA, 63 nt, Human
auuuucuauaaaaaucuggaagcaaagaauggggauggggagagcuacgugguaguauguuuu

SEQ ID NO: 34043 - RNA, 63 nt, Human
aauaauuagaacccacauaucuuuuuuuguguggauggggaaaauguuuuaaaauccaguuau

SEQ ID NO: 34044 - RNA, 63 nt, Human
caaugaguaauuuuucuacuuugaagauacacagauggggacaaaaacccuguuuuggaauuc

SEQ ID NO: 34045 - RNA, 63 nt, Human
ccuccuccccaaauacauaaagcaaauaagcaggauggggaacagcuugaccuucauccaccc

SEQ ID NO: 34046 - RNA, 63 nt, Human
aaaagaggcuggaucuuguggaagacugucuuggauggggaaguacuaccuggagauuucaaa

SEQ ID NO: 34047 - RNA, 63 nt, Human
cuuggugugacaucaagauaaagagcggagguggauggggauggaagaugaugcuccuauccu

SEQ ID NO: 34048 - RNA, 63 nt, Human
uccugaaggaggugggagcugagggcccuggaggauggggaagguuugcagagagaggaagaa

SEQ ID NO: 34049 - RNA, 63 nt, Human
uguagagcucucccugccucucucucugggggcgauggggaaggucaggaguccagcccauuc

SEQ ID NO: 34050 - RNA, 63 nt, Human
augcuaagauuuaaaggagccccagauaaacaugauggggaaaagcacugaacuaagaguccc

SEQ ID NO: 34051 - RNA, 63 nt, Human
ggggccugugucugugucugugccugugucugugauggggagccgccucgcaccccuguuguc

SEQ ID NO: 34052 - RNA, 63 nt, Human
auacuagaauggguuugagcuuggggugggguggauggggaagacuuacucugaauguucguu

SEQ ID NO: 34053 - RNA, 63 nt, Human
cgaggccccucaacagagaagccuccaccugaggauggggaggaccuggcaggcagcuuccac

SEQ ID NO: 34054 - RNA, 63 nt, Human
gggauauggaaugaagacuuaagagcaggagaagauggggagggggugggagugggaaauaaa

SEQ ID NO: 34055 - RNA, 63 nt, Human
cuagcaaaugaggcacuguucucaaccaaaggagauggggaucugguuuagggcaaucccuuu

SEQ ID NO: 34056 - RNA, 63 nt, Human
aguuaccgccaguaucgcaggucccaguguucagauggggagcgaucaguucucucggaagug

SEQ ID NO: 34057 - RNA, 63 nt, Human
gggagagccaacaagacuuacugcaucuugggggauggggaaaucacucacuuuauuuuggaa

SEQ ID NO: 34058 - RNA, 63 nt, Human
gaaauuuugagacuuguuucggugugucugugugauggggaugaggcugggguugggaucuga

SEQ ID NO: 34059 - RNA, 63 nt, Human
uuuggguuagugaguuagcaagcucuuugugcagauggggauguagguaaaucuuuuuaaaag

SEQ ID NO: 34060 - RNA, 63 nt, Human
cugggcgaaucuccuccaaggaagucccaggaggauggggaccaggaaggcuguggaccccca

SEQ ID NO: 34061 - RNA, 63 nt, Human
agcucuggaaacuuguggguggggcccagggaggauggggagggaguggcccaggccugcccc

SEQ ID NO: 34062 - RNA, 63 nt, Human
gaggguugucuagcauguccaguaugagugguggauggggaauguaauugaucgauccugauc

SEQ ID NO: 34063 - RNA, 63 nt, Human
aauucgguggacccagcuuucuucuguaccccagauggggaaauuugaaucacauguuaaacc

SEQ ID NO: 34064 - RNA, 63 nt, Human
ugaggauaugaguagccccaacccaaaccuggagauggggagaaaccuacagaauacuagcca

SEQ ID NO: 34065 - RNA, 63 nt, Human
ucaggaugaggcagaaggaaggguaagggaaaggauggggaccacaaggaagagccaggugcu

SEQ ID NO: 34066 - RNA, 63 nt, Human
uuguaggaauccuuugagaaugugauuccuuuugauggggagaaagggcaaauuauuuuaaua

SEQ ID NO: 34067 - RNA, 63 nt, Human
ugugcgcucucccugagugccuguguagcuggggauggggauuccuaggggcagaugaaggac

SEQ ID NO: 34068 - RNA, 63 nt, Human
cuacuuacccaggugggucccggcucugugggugauggggaggggcauugcugacuguguaua

SEQ ID NO: 34069 - RNA, 63 nt, Human
gcgaacagcagagcaggcaagggaaacuggggagauggggauggaggaggaaggcugauaucc

SEQ ID NO: 34070 - RNA, 63 nt, Human
cucugcccaggcacugcuaggcucugucuggaagauggggaccagcagccccacaccagggcc

SEQ ID NO: 34071 - RNA, 63 nt, Human
agauaugaaguccuggagcacuguccuggcagugauggggaaagcuuuuucugaagcugccuu

SEQ ID NO: 34072 - RNA, 63 nt, Human
uaaauuaaaagcccuaccuaaaacugagguggggauggggagaggcuuugccuccaccauucc

SEQ ID NO: 34073 - RNA, 63 nt, Human
caaggauuuggauuuauucagguaauuugaugggauggggaaauauaauauugugugaugcau

SEQ ID NO: 34074 - RNA, 63 nt, Human
cacuguggguuuauauacuaauucuauaccccagauggggaaugggggagauggucccugggc

SEQ ID NO: 34075 - RNA, 63 nt, Human
aaaauucucaagaugcagguucuuggggaaugggauggggacagcauuugauuuacacugauu

SEQ ID NO: 34076 - RNA, 63 nt, Human
cccgcagagucuccggugcagacgcgcugcggggauggggagcggcgugccaaucugcggguc

SEQ ID NO: 34077 - RNA, 63 nt, Human
caugacccaaauuguaagcauagggaccucagggauggggaagaaacccgaguacgagggugc

SEQ ID NO: 34078 - RNA, 63 nt, Human
gagguggggcagggaugguguuucggguggcgggauggggagcagcuugguccaugugccuuc

SEQ ID NO: 34079 - RNA, 63 nt, Human
gggccagagaauggcuuaugggggcccagguuggauggggaaaggcuaauggggucagacccc

SEQ ID NO: 34080 - RNA, 63 nt, Human
ggugggcacuaguauaucuaaauuaacaaugcugauggggaguaggggguaaucuacucuaaa

SEQ ID NO: 34081 - RNA, 63 nt, Human
aaugacaacauagacugugcucuaaguuuaaaagauggggaagcuuauauaaaagugacccuu

SEQ ID NO: 34082 - RNA, 63 nt, Human
caaugaagaaggucucauuaucuccaugauaaagauggggaaacuaaggucagaaggguuaac

SEQ ID NO: 34083 - RNA, 63 nt, Human
aagaagucauuuuucuuucuugucccauucugggauggggaauuuguccuuacagucccacuc

SEQ ID NO: 34084 - RNA, 63 nt, Human
ccucuccagccagggagucuggucucaaggccggauggggaggaagauguuuuguaaucuuuu

SEQ ID NO: 34085 - RNA, 63 nt, Human
cuuuuuucagcaccaguagguacuaagucuccagauggggaaauaacuaaaauguguuuuucu

SEQ ID NO: 34086 - RNA, 63 nt, Human
uugaauuuuuuauagguuaaaugucauuuuagagauggggagagggauuauacugcaggcagc

SEQ ID NO: 34087 - RNA, 63 nt, Human
cuaaauagucacaaugaagaugaaaauaaggaugauggggacgggguccaggagggccacugg

SEQ ID NO: 34088 - RNA, 63 nt, Human
uggccuugggcuugcugcuucauuacucaccuggauggggacgagggaugagaaggguguggg

SEQ ID NO: 34089 - RNA, 63 nt, Human
gagggagcguggagcugcggugcccuggccggcgauggggaggagccggcuccggcagugaga

SEQ ID NO: 34090 - RNA, 63 nt, Human
auaggggcugcucccucaaaaagggaggggacagauggggagcuuuucuuaccuauucaagga

SEQ ID NO: 34091 - RNA, 63 nt, Human
uuauuuaugaagacagcaaaagacugauuucaugauggggaaaacaauuagccaaaguuuaau

SEQ ID NO: 34092 - RNA, 63 nt, Human
uuuggaccgcuguguuucaaucugcaaaauggggauggggaagguucaaucagcagaugaccc

SEQ ID NO: 34093 - RNA, 63 nt, Human
gccgagaagauaaaccaagcuuuacacgagcaggauggggaugggaaaacuaaaggggccccc

SEQ ID NO: 34094 - RNA, 63 nt, Human
gugauuaauuuaaaauguuauuaagggccuugagauggggagauuauccugaauuacuuugga

SEQ ID NO: 34095 - RNA, 63 nt, Human
cuguaaugugaaagcaaauauuucuucguguuggauggggacuguggguagauaggggaacaa

SEQ ID NO: 34096 - RNA, 63 nt, Human
cugccuucccaacucagccacaagcucugugaggauggggacucagucuuugcaucccucaga

SEQ ID NO: 34097 - RNA, 63 nt, Human
uuuuaaauggagaucauaauuuuauguucacuugauggggaaugacuagaauggggcaauaac

SEQ ID NO: 34098 - RNA, 63 nt, Human
gagcuccagaccaaccaccccaagugccguuuggauggggaagggaaagacuggggagggaga

SEQ ID NO: 34099 - RNA, 63 nt, Human
agggccaagccugugacucaacuccaggggcaagauggggagugagcugauggcuccgagacu

SEQ ID NO: 34100 - RNA, 63 nt, Human
uaaucucuuccacugaugcauccuccaaggguagauggggagggucugugugaaggggccggc

SEQ ID NO: 34101 - RNA, 63 nt, Human
ugcuggggggaugcuuagcucagagcaguggcugauggggacacugagauaagaucggagggg

SEQ ID NO: 34102 - RNA, 63 nt, Human
ucagaacauuuugagucaccuugggagauucaggauggggagagcaaauuugaacaaaagguu

SEQ ID NO: 34103 - RNA, 63 nt, Human
cugccuauauuauaauggaucaugcgauaucaggauggggaauguaugacaugguuuaaaaag

SEQ ID NO: 34104 - RNA, 63 nt, Human
ugacuccccucugccucugagggcuucaguauugauggggagggaggccuaaguaccacucau

SEQ ID NO: 34105 - RNA, 63 nt, Human
gacccuggcuuggaaagugaacuugcagccuuggauggggaagggccagaugcugggugggug

SEQ ID NO: 34106 - RNA, 63 nt, Human
ugauuuaggguucucucaagauuaauaaaggaagauggggaaauuugacucauuaaugagcuc

SEQ ID NO: 34107 - RNA, 63 nt, Human
ucauuccagcaggaggcacuuaggggagacucggauggggacauggagaacaacccaagcucc

SEQ ID NO: 34108 - RNA, 63 nt, Human
uuacaguagaacucaucuaaaaauggauuuggggauggggaaacaugcacaaaaucuuuucau

SEQ ID NO: 34109 - RNA, 63 nt, Human
agcaccuggggaucuggacccugcgggugaagggauggggagggacgucccuggagucucuuc

SEQ ID NO: 34110 - RNA, 63 nt, Human
agagccaaguguuacauugagcuuggggugggagauggggaacaggcagugaggaaggagaca

SEQ ID NO: 34111 - RNA, 63 nt, Human
ccaucaggagggaagauggugggccucagggaggauggggaucaagggacaggccaggagcca

SEQ ID NO: 34112 - RNA, 63 nt, Human
uccaauauggagcaucucaagcuucuccugggggauggggauugggaugggcagaaucuguuu

SEQ ID NO: 34113 - RNA, 63 nt, Human
uagcaaagggaggcccaaauucucaagguuguugauggggaacuugccacuaagagaaggcag

SEQ ID NO: 34114 - RNA, 63 nt, Human
uccauaugaggaaaaaugcucagcuccaggaaagauggggaguccaaguggauuaaugauguc

SEQ ID NO: 34115 - RNA, 63 nt, Human
caauucaaucaaggcuguucuauuuaaaucagagauggggaccaggcucagaguucuaccuau

SEQ ID NO: 34116 - RNA, 63 nt, Human
ccccacuccaggaaggcagcccaaucccuaggugauggggaaccccucucacgguugaaaauu

SEQ ID NO: 34117 - RNA, 63 nt, Human
cagggcccauaaccagugggcagcuuuaggagggauggggaucuguuucagaucuaggcauaa

SEQ ID NO: 34118 - RNA, 63 nt, Human
gaugauguuuccaucuccaaccccuucaugccagauggggaaacugaggcucagagaggauac

SEQ ID NO: 34119 - RNA, 63 nt, Human
ucccucggcugagaauaaaacccauuucuggaugauggggaaugucuccucugcugguugugu

SEQ ID NO: 34120 - RNA, 63 nt, Human
acauuaguaaaugucuuuguaagucaguguugagauggggauaaaaugacuacuuagcauccu

SEQ ID NO: 34121 - RNA, 63 nt, Human
gaaugaccugcucuggcucagggaucccugguggauggggaaaagcacuuuccuggugaugga

SEQ ID NO: 34122 - RNA, 63 nt, Human
acaaaagugccuugacguggagggugggcaccagauggggaccagccuugccaacugcugcug

SEQ ID NO: 34123 - RNA, 63 nt, Human
aagcucagccugagaauauugugaaaugcagaggauggggaaaagggaagaguaccgacuuga

SEQ ID NO: 34124 - RNA, 63 nt, Human
ugcuuuuauagcugcuuggauucucugagaaaugauggggagugagugaucacugguauuaac

SEQ ID NO: 34125 - RNA, 63 nt, Human
ccgcacaguguccagacgaauuggcccccagaagauggggaguucuguccugcccuucugugu

SEQ ID NO: 34126 - RNA, 63 nt, Human
ucuucaagguuuggaaacugcaaauguccccuugauggggaauccgugugugugugugugugu

SEQ ID NO: 34127 - RNA, 63 nt, Human
ggguggccccauccuaccaggcccugaggucaggauggggagcugcugccuuuggggacccac

SEQ ID NO: 34128 - RNA, 63 nt, Human
gaggagcugaccacggagcuggggguugccauggauggggacccaaagaccugcagccaccag

SEQ ID NO: 34129 - RNA, 63 nt, Human
gggguguagggaagaggcgggaggagucauggggauggggagcggcagggggagagaggggcc

SEQ ID NO: 34130 - RNA, 63 nt, Human
gcagugcuuagagcacaggccccucuguugggggauggggaggagagcagucugcccuuggga

SEQ ID NO: 34131 - RNA, 63 nt, Human
agaugacuacuugggccaucggggggugggagggauggggagucgguuagucauugauagaac

SEQ ID NO: 34132 - RNA, 63 nt, Human
aggcaggugcagggaggccuggggcagccuccugauggggauguuuggccucugcuuccuccc

SEQ ID NO: 34133 - RNA, 63 nt, Human
ccaaggcagagccaaucuugcaaacuggccauggauggggaagugcccgguagccagcaugag

SEQ ID NO: 34134 - RNA, 63 nt, Human
ggaauguuaaggugaaccccaccccuucuuacagauggggacccagagccugcucuugggaac

SEQ ID NO: 34135 - RNA, 63 nt, Human
aagcuuucagagucuucacuggcaguagggggagauggggagaggaaugaucucugcccagcc

SEQ ID NO: 34136 - RNA, 63 nt, Human
aucauaaguggucuuuucaaauguccaucaauugauggggaaggcuggcacccaccaagaagu

SEQ ID NO: 34137 - RNA, 63 nt, Human
gccuuaaguguguuaguaggauggagaaacugugauggggacugggaaccuggauuugucuga

SEQ ID NO: 34138 - RNA, 63 nt, Human
aggccaagucagagcugcuguugcugccacuuggauggggaccugaaaaagagaauguugaua

SEQ ID NO: 34139 - RNA, 63 nt, Human
cacugucuuuuguagcucuggacuggagggguagauggggagucaauuacccaucacauaaau

SEQ ID NO: 34140 - RNA, 63 nt, Human
ucugauuggggugaugagaaaguucuggagguggauggggaggaugguugcacaacaguguga

SEQ ID NO: 34141 - RNA, 63 nt, Human
uaaauggcaagagacuagcuggcucucugcucugauggggaggagguuguuguuugggcuguu

SEQ ID NO: 34142 - RNA, 63 nt, Human
ggagcugggacugguuugaacacagggugugcagauggggaggggguacuggccuugggccuc

SEQ ID NO: 34143 - RNA, 63 nt, Human
ucaguauaaaagcaccggcaucccuacuugggugauggggauuaauuuuauagcauuccauuu

SEQ ID NO: 34144 - RNA, 63 nt, Human
gaccaaaucccucacucaaccugcugagguguggauggggaaacagaggcaaaacugaggcac

SEQ ID NO: 34145 - RNA, 63 nt, Human
ucuuccagagcugccucugccuuuauccugggagauggggaggaagccccaucucugcuguuc

SEQ ID NO: 34146 - RNA, 63 nt, Human
ugaaaggaagaugccccgacuucuuuggccagugauggggaaucagugagugcuccaugaugg

SEQ ID NO: 34147 - RNA, 63 nt, Human
guaagcccaaauuguggaauugccaguaaccuggauggggaaaagcauuucccauagcacucc

SEQ ID NO: 34148 - RNA, 63 nt, Human
ccggccugauggccaggccucagggaccaaggagauggggagggcgcuuuuguacguuaauua

SEQ ID NO: 34149 - RNA, 63 nt, Human
ccucagaauguguggacaggucagcuuagaagagauggggagauucaggaucccccugugcca

SEQ ID NO: 34150 - RNA, 63 nt, Human
ugagcuccaaggacucaggcagagggacucagggauggggacugccaggggcaguuggcaaaa

SEQ ID NO: 34151 - RNA, 63 nt, Human
aaacugacgauucuuaaucaagauuuuuuuccugauggggaagggacuuuuauuuucuuuuag

SEQ ID NO: 34152 - RNA, 63 nt, Human
ccagagccaagguggcugggaucuggccccacagauggggaaagauggggaaggguguggagu

SEQ ID NO: 34153 - RNA, 63 nt, Human
gguggcugggaucuggccccacagauggggaaagauggggaaggguguggaguggggaggagc

SEQ ID NO: 34154 - RNA, 63 nt, Human
uuuauuuuugugcgcgauauuuaaggucgucuggauggggaagcaaccugcagcugaggucgc

SEQ ID NO: 34155 - RNA, 63 nt, Human
gaccccuuuucagcuucugcugggcuggggccugauggggagggucucggugguaccaggucu

SEQ ID NO: 34156 - RNA, 63 nt, Human
gcaaagaaucaaguccacccuucucaugugacagauggggaaacugaggccuugagaaggaaa

SEQ ID NO: 34157 - RNA, 63 nt, Human
uacucugaggacaacaaaccgaaggccuuaaacgauggggauggaugaucccgccucuguagg

SEQ ID NO: 34158 - RNA, 63 nt, Human
gcuggguccaggggaugggagguugugggcauugauggggaaggaggcuggcuuguccccucc

SEQ ID NO: 34159 - RNA, 63 nt, Human
cuccaaagaaagcacauaacuguggccugaagggauggggaguagcaacauaaaaagaagugg

SEQ ID NO: 34160 - RNA, 51 nt, Human
cccucagcacugaccacugaugauggggacccugggccagcgccugcccac

SEQ ID NO: 34161 - RNA, 63 nt, Human
ggccacagcagggcugagggaacucugcuaugugauggggacuuccugggacaagcaaggaaa

SEQ ID NO: 34162 - RNA, 63 nt, Human
ccuggaacaguccugcagaggcuacaauccccggauggggacccuucccacccucugcaagcu

SEQ ID NO: 34163 - RNA, 63 nt, Human
uuguuuuguuuuuuaguucccacagggaguagagauggggaaagaauuccuacaauauauauu

SEQ ID NO: 34164 - RNA, 63 nt, Human
ccuuguuuuagaggaagguacugcccauugggagauggggacauugggaccucagcaaugaag

SEQ ID NO: 34165 - RNA, 63 nt, Human
uuuuuaaaaauuuugccucccuuugugaaaggggauggggaggggaagaguaaacagauaaca

SEQ ID NO: 34166 - RNA, 63 nt, Human
cuguucugugugugccgccgggcgacgugcauugauggggaagcugcuggaggagcaggggug

SEQ ID NO: 34167 - RNA, 63 nt, Human
gcacugucucaguucugcuugaauaccuccaucgauggggaacucacuuccuuuggaaaaauu

SEQ ID NO: 34168 - RNA, 63 nt, Human
aauuggacuugagauggggagcagacaggggaggauggggaaugugggacacggugugguggg

SEQ ID NO: 34169 - RNA, 63 nt, Human
cugccagggcucuggccuuggaauuggacuugagauggggagcagacaggggaggauggggaa

SEQ ID NO: 34170 - RNA, 63 nt, Human
ugagacuauggaauccaaccuccccauugcacagauggggaaacugaggcuuaggaagagaau

SEQ ID NO: 34171 - RNA, 63 nt, Human
cuuccucccaaacaaugacuuccugccauguuugauggggacagcuaccacuguccucugccc

SEQ ID NO: 34172 - RNA, 63 nt, Human
aauagauaaucucuguucuucuaacugaucuaggauggggacgcacccaggucugcugaacuu

SEQ ID NO: 34173 - RNA, 63 nt, Human
gcuacuaaaaucagugaccuugaacauaucuuagauggggagccucgggaaaagguagaggag

SEQ ID NO: 34174 - RNA, 63 nt, Human
aacucaagaaggaauugaaauaaggagggacaugauggggaaggaguacaaaacaaucucuca

SEQ ID NO: 34175 - RNA, 63 nt, Human
ggggccccgcugccggaccugcagcccuggacagauggggaacacugugccucccugaacaga

SEQ ID NO: 34176 - RNA, 63 nt, Human
cgauguggugugcagagguggggagguggcgaggauggggacagaaagcgcacagaaucuugg

SEQ ID NO: 34177 - RNA, 63 nt, Human
gcagagccaaaccuuuaguguuggugguaggaggauggggagaggaaaaaagagcuggcaaag

SEQ ID NO: 34178 - RNA, 63 nt, Human
gacucauagcugccgcuuguuagguuaggguuagauggggagagacagggcacagaggaccug

SEQ ID NO: 34179 - RNA, 63 nt, Human
cugagccccgcaggccgcugaaccaaaggccuagauggggaggacuaggagagcgagggggcc

SEQ ID NO: 34180 - RNA, 63 nt, Human
gaaguuacccaccacauuaaaacaaaagucugagauggggaguuucagauaaccgaauguaaa

SEQ ID NO: 34181 - RNA, 63 nt, Human
uucuauaaaaaccucaccuccaucaagcgcuaugauggggacaucacugaccugggccugacg

SEQ ID NO: 34182 - RNA, 63 nt, Human
ggguccuagaagaagggauauccuugaauaccagauggggacguuugacuuggugggaggugu

SEQ ID NO: 34183 - RNA, 63 nt, Human
ucccugucggagagugaggggccccgccagcccgauggggaugaggaggagagcacagcccuc

SEQ ID NO: 34184 - RNA, 63 nt, Human
gagagagaaagagaacaauauuugggagagaaggauggggaagcauugcaaggaaauugugcu

SEQ ID NO: 34185 - RNA, 63 nt, Human
agacaggugcuacguaagcacacugucuuucuggauggggacuuguauuuuaaauaacuuauc

SEQ ID NO: 34186 - RNA, 63 nt, Human
uuggcuuucucuuggaggugggucgcagcaccagauggggagcuuuaugacaugacaggcggg

SEQ ID NO: 34187 - RNA, 63 nt, Human
ucuggacacuugcucaugcccugccaagcagcagauggggagggugcccuccuauccccaccu

SEQ ID NO: 34188 - RNA, 63 nt, Human
ggcaauauuugaagaaagaauuuaacaggcacugauggggagaaagcuagcuguagguaaugu

SEQ ID NO: 34189 - RNA, 63 nt, Human
ccaugccuguuaccaggugcugcuucuucagaugauggggagcacuuuucagggugaaauuca

SEQ ID NO: 34190 - RNA, 63 nt, Human
ccacagcucugggcuuccucggagaccccuggggauggggaucuucagggaaggaacucuggc

SEQ ID NO: 34191 - RNA, 63 nt, Human
agauuggccuucauuucucgauguucuuuccaugauggggauggagguguucagugccaccgu

SEQ ID NO: 34192 - RNA, 63 nt, Human
gcaagggaaggcuuuaagcaguuacuagaaagagauggggauuuggccccuggcuccuccagc

SEQ ID NO: 34193 - RNA, 63 nt, Human
uugucugugacggcguguuguuccccacucugggauggggaagaggcccgucgggaguucugc

SEQ ID NO: 34194 - RNA, 63 nt, Human
aggaaaacaccaaacacacuauggaacucugcugauggggacccaagcgcccacgugcucagc

SEQ ID NO: 34195 - RNA, 63 nt, Human
ucacccaugugaauaagaagccaggaaaggaaagauggggaagcccagaucaccaggcuucua

SEQ ID NO: 34196 - RNA, 63 nt, Human
uuuaagcuagguaggcuuucagccagcagacaugauggggagagccuucuaauaagagggaag

SEQ ID NO: 34197 - RNA, 63 nt, Human
gggguggggagaagccacuaccauuuuuuaggugauggggaugccacugaguugcaacggcua

SEQ ID NO: 34198 - RNA, 63 nt, Human
uuuaauauagcucucuuauggugguggccuggugauggggaccgucuuucuuuuacugacaca

SEQ ID NO: 34199 - RNA, 63 nt, Human
ugaugguuaccagaggcugggaggcauugaagggauggggagggaagugagguugauuaaugg

SEQ ID NO: 34200 - RNA, 63 nt, Human
gaugaaaucaucccuguggggagugcagggccagauggggacuccauggagacagccgaccgg

SEQ ID NO: 34201 - RNA, 63 nt, Human
uguggggaauguuuggaggaaucacuggcauuugauggggaauaacauaagccugggcucuga

SEQ ID NO: 34202 - RNA, 63 nt, Human
gggaguugaauacugcauggcgaguguaaugaugauggggaggguccuuguguccucaccccu

SEQ ID NO: 34203 - RNA, 63 nt, Human
ugcaaaggggaaaaaaaggcagggauugggggggauggggaaguggcccaauaaauucauuuc

SEQ ID NO: 34204 - RNA, 63 nt, Human
uguccuuccugacaggaagcauagggcacugcagauggggaagcaugucaccuuggcagugac

SEQ ID NO: 34205 - RNA, 63 nt, Human
uuuccugucccugguaggggaagugaugucguggauggggaggggugggcaggguaguuuccc

SEQ ID NO: 34206 - RNA, 63 nt, Human
gagcuagguuaggcaaggaggugguuggccagagauggggaacagccaggugccccaguccuc

SEQ ID NO: 34207 - RNA, 63 nt, Human
cuacacuucuagcuuuauaaacagauuaaccaagauggggagaggggagggccucagggcucc

SEQ ID NO: 34208 - RNA, 63 nt, Human
guuucuauguucuuuuuuaagcaccaaaaagaagauggggaagaaaagaaggaaaauuuucug

SEQ ID NO: 34209 - RNA, 63 nt, Human
uuuguuauuuucaaauacccauccaacaagagagauggggagguuuuuaguuauauaugcuau

SEQ ID NO: 34210 - RNA, 63 nt, Human
uuccagccaaccaagugauucuucuucauucuugauggggagaaguacauacaaaguuuguuc

SEQ ID NO: 34211 - RNA, 63 nt, Human
uccuuuaaauuuuguucccaugaguuuuguggggauggggauucugguuuuauuagcuuugug

SEQ ID NO: 34212 - RNA, 63 nt, Human
aacacacagacuuucugugacgcagacagaggggauggggauagaggaaagggaugguaaguu

SEQ ID NO: 34213 - RNA, 63 nt, Human
acacacacacacgaaggagagagagagaaaacugauggggaaaacaagcugugucuucuuaac

SEQ ID NO: 34214 - RNA, 63 nt, Human
guacugcaaguaagacucaacagaccuaauuuggauggggagaaaaacucucaucccugaccc

SEQ ID NO: 34215 - RNA, 63 nt, Human
gcaggacccugucacuacuauaccugggccucugauggggaauucuggucuucuaaaaagaug

SEQ ID NO: 34216 - RNA, 63 nt, Human
gauucaagagccaaguacucagcccuggcaggggauggggacaugaugcccagagccaccccu

SEQ ID NO: 34217 - RNA, 63 nt, Human
cuauuagaagcccagacuggaagugagaggcaugauggggagagaccagacugaaucuacggg

SEQ ID NO: 34218 - RNA, 63 nt, Human
ccgggucugugccaagggacugaagaaguguaagauggggagaacuguaugucauggaguccu

SEQ ID NO: 34219 - RNA, 63 nt, Human
aagagaauccccaccaacuucugugccuccucagauggggauuuaucuggaucucugugguuc

SEQ ID NO: 34220 - RNA, 63 nt, Human
agaccuugccccuugugagcuggauagacuugggauggggagggagggaguuuugucugucuc

SEQ ID NO: 34221 - RNA, 63 nt, Human
caaaucuaaucugauuuacaguucaaggaagcugauggggagcugggccuuaccccugaugua

SEQ ID NO: 34222 - RNA, 63 nt, Human
gugaggauucauggaugaaugaaagcuagaccugauggggaggcauuaugacuaaauaggccc

SEQ ID NO: 34223 - RNA, 63 nt, Human
gaaaauaucuagcccaaagccuucauuuuaacagauggggaaagugagcccccaagaugggaa

SEQ ID NO: 34224 - RNA, 63 nt, Human
auguuguaaauggcauugacagcugcucuuuaggauggggaguauuauggaaauccacaauaa

SEQ ID NO: 34225 - RNA, 50 nt, Human
auuauuuaacaggacacuaagauggggaaacguccucgugagaugagagc

SEQ ID NO: 34226 - RNA, 63 nt, Human
cuaccccagugagcacuucuuuuugagggacuugauggggaggugggguaggcagaagggacg

SEQ ID NO: 34227 - RNA, 63 nt, Human
cccaggcucuaagcucugcggggauuggagagggauggggagggaagggaaggcagcuccaag

SEQ ID NO: 34228 - RNA, 63 nt, Human
aagauccaccuccccacugccuuuucucacucagauggggacaccgagguccagaggaaaaga

SEQ ID NO: 34229 - RNA, 63 nt, Human
acuccuggccaauuuuuaaaauuuuuuuguagagauggggaucuccuuauguuguccaggcca

SEQ ID NO: 34230 - RNA, 63 nt, Human
gugaugccucuugccucagggaaacguuucuuugauggggaguuugagauuucuuuuccuugu

SEQ ID NO: 34231 - RNA, 63 nt, Human
agggccccugacggaggcuuugcuggcuguggugauggggauugaguugggggcaaggguccc

SEQ ID NO: 34232 - RNA, 63 nt, Human
acgcucuacccugcagcuuggagaacuccgcuggauggggagucucaugcaagacuucacugc

SEQ ID NO: 34233 - RNA, 63 nt, Human
ugcuuuuccuucccaggugcagccugugauucugauggggacugguaaaucugugccucugcc

SEQ ID NO: 34234 - RNA, 63 nt, Human
ggggucccacccuggugcccuggcugugagauagauggggagucuuucugggggcggaggggg

SEQ ID NO: 34235 - RNA, 63 nt, Human
guccaggucccggcuccugugcuggaaagcguugauggggagcgucggcgcugaccacacgcg

SEQ ID NO: 34236 - RNA, 63 nt, Human
ucuguguagcuggggagaggaugaggcugcagagauggggaccagaagccccccaccccagcu

SEQ ID NO: 34237 - RNA, 63 nt, Human
cggccaggcagaugaccucguacucaggagcccgauggggaacaguguuggguguaccaccca

SEQ ID NO: 34238 - RNA, 63 nt, Human
cugucaugacccagugugcuuaagaaccugccugauggggagugucggcugugaaaucugcaa

SEQ ID NO: 34239 - RNA, 63 nt, Human
uuugugacagauuguauuggcauaggcaugauagauggggauugguacguuuugaaucagcau

SEQ ID NO: 34240 - RNA, 63 nt, Human
gauugacuuggagguggacaauggaccugcgcagauggggacuguggugccaucuuugcuuca

SEQ ID NO: 34241 - RNA, 63 nt, Human
aggaaagcgccuccaacccuagcaaaagugcaagauggggagugagaggcugggaauggaggg

SEQ ID NO: 34242 - RNA, 63 nt, Human
guaaaguuuuguuguuguuguuguuuuguuuuggauggggaagguaguuuuaauuuggcaagu

SEQ ID NO: 34243 - RNA, 63 nt, Human
agaagacuuagaauagaaacuuuuaguauuaccgauggggaaaaaaaaacuacuguuaacacu

SEQ ID NO: 34244 - RNA, 63 nt, Human
gcccuaagcugcaccagcgcuuugccaagaugggauggggaggggguaugagaacuggcagag

SEQ ID NO: 34245 - RNA, 63 nt, Human
gagauauccugacccucugcuuccuagccugaugauggggaacccagagccacccgcuaugag

SEQ ID NO: 34246 - RNA, 63 nt, Human
ucgccugccugugucucuccccaaaccccuuuagauggggagggaagaggaggagaggggagg

SEQ ID NO: 34247 - RNA, 63 nt, Human
aaaaacguggagugcuaggggcagccuggaaaagauggggaaccugcuagugaacuaggaggg

SEQ ID NO: 34248 - RNA, 63 nt, Human
aucuccucugucuuaauccacgcucaggcuaaagauggggauaauguggaaauggcaguuguc

SEQ ID NO: 34249 - RNA, 63 nt, Human
auauuaaccgcuuaaggcauugaagccauaugggauggggaaugcauuucuucaguguuucuc

SEQ ID NO: 34250 - RNA, 63 nt, Human
ugcuaaucccacuaauucaggaauuugaguagagauggggaacaagaacccagaugcuguccc

SEQ ID NO: 34251 - RNA, 63 nt, Human
agccccagccuccucaaccucuuggggccccgugauggggaggagagggcaggugcggggagg

SEQ ID NO: 34252 - RNA, 63 nt, Human
gagugggauccacuucuugguuccugggauggcgauggggacucugccgcuguguagggacca

SEQ ID NO: 34253 - RNA, 63 nt, Human
ccagggcugcaaaacuggaagcacagccucggggauggggagggaaagacggugcuauaucca

SEQ ID NO: 34254 - RNA, 63 nt, Human
agagcaaggagaccauggcuacucuuugaaauggauggggaaaauuagcuuaaaaauuuaauc

SEQ ID NO: 34255 - RNA, 63 nt, Human
cuguccuuuccaguggccuggcuccgcuguguggauggggagaucggggccagaggcagaacc

SEQ ID NO: 34256 - RNA, 63 nt, Human
cgacauugccuugguuuguuacaugacuaucgugauggggaaacuggcuggaaauaguaauca

SEQ ID NO: 34257 - RNA, 63 nt, Human
uguggccaagggcuccagggccagggugugagggauggggagcagcugggcacugggccggca

SEQ ID NO: 34258 - RNA, 63 nt, Human
aucacugcugucccuccugaggucuggauuggggauggggacaaagaaauagcaagagaugag

SEQ ID NO: 34259 - RNA, 63 nt, Human
gguuucugcuuaggagguggggacuugggcugggauggggacggcauaccccucccaggccuc

SEQ ID NO: 34260 - RNA, 63 nt, Human
ggggagagagaauuuauccagaggccugcugcagauggggaagagcuggaaaccaagaaguuu

SEQ ID NO: 34261 - RNA, 63 nt, Human
ugccuccacagacagcugagugcccuguccucagauggggagggacagggucggccuguaccc

SEQ ID NO: 34262 - RNA, 63 nt, Human
ccugugacuguugcugacuccaggggugggagggauggggagacuccccucuugcugugugua

SEQ ID NO: 34263 - RNA, 63 nt, Human
gaaagcuucggcccuccucugcugucacucaaugauggggagcccuaccccagaaguguaucc

SEQ ID NO: 34264 - RNA, 63 nt, Human
uggccugcacugguguuuuguuguggggaggaggauggggaguaggacauaccagcuuagauu

SEQ ID NO: 34265 - RNA, 63 nt, Human
uggccuucauaccaugagaacauuucuguuuuggauggggauguuacccuugcguucaaccaa

SEQ ID NO: 34266 - RNA, 63 nt, Human
ugcccuggugcccaccccugucgagccccuaaggauggggaggugggggggcaggagcuucug

SEQ ID NO: 34267 - RNA, 63 nt, Human
ccugccuucuugaagcaguuccaccaccaauaugauggggaagggcaggaacuuauggcaggg

SEQ ID NO: 34268 - RNA, 63 nt, Human
ggaaggugauggcucuuccagaggauucccucagauggggaggcagcaguaugagcucugagc

SEQ ID NO: 34269 - RNA, 63 nt, Human
auuuagucagaggccccacccccaggaagcauggauggggaugaaggcacaggcgucuccaac

SEQ ID NO: 34270 - RNA, 63 nt, Human
uucucuugaaaaguucagggaccguccaggggagauggggaggagauauggagugagucaccu

SEQ ID NO: 34271 - RNA, 63 nt, Human
ccuggccugccuucuucuugugucuuugguggggauggggaggccuauuccugcuggccccuu

SEQ ID NO: 34272 - RNA, 63 nt, Human
ggccaccucgccccucccucugggaccucuccggauggggaguccuuggccagggucucugac

SEQ ID NO: 34273 - RNA, 63 nt, Human
acuccacucccagucuuagagcuguuaggacccgauggggaggcagcccccgcaguggacaac

SEQ ID NO: 34274 - RNA, 63 nt, Human
agugaugaacuguuagguucugaugacucacaugauggggagucugaaucaaaugccaaagua

SEQ ID NO: 34275 - RNA, 51 nt, Human
cccaaugggcaggacccugaggauggggacuccacagccucuccaaguuca

SEQ ID NO: 34276 - RNA, 63 nt, Human
gugcuuguguguuuguuuuagauccuccugggggauggggauggggccaggcucaguguacua

SEQ ID NO: 34277 - RNA, 63 nt, Human
gcuauuacugguguauuauuugggggagggagggauggggaggggagaaagggagauggguag

SEQ ID NO: 34278 - RNA, 63 nt, Human
ccugugaugggaaagggcgaacgaggauuaggggauggggaggaagagagagacuguggagcu

SEQ ID NO: 34279 - RNA, 63 nt, Human
ugauauuuuucuuuuuuuuuuuuuuuuuuuguggauggggacuugugaauuuuucuaaaggug

SEQ ID NO: 34280 - RNA, 63 nt, Human
uggcaaugagugagcccaugggaaacagguggagauggggaagccgucucuucugcaugguuu

SEQ ID NO: 34281 - RNA, 63 nt, Human
gcucccaauguuuaugauaauaaaggcaccgcugauggggaccuccacucugucugugucuga

SEQ ID NO: 34282 - RNA, 63 nt, Human
ugguauguuuugauugacaucaaguggagacgggauggggaaaaauacugauucugugaaaau

SEQ ID NO: 34283 - RNA, 63 nt, Human
gccuggaguuagauaucuucuuuugcccggauugauggggaggagggauuaaaagagucagga

SEQ ID NO: 34284 - RNA, 63 nt, Human
ggauuguucugucuuugugagugaacauacaaugauggggauaacugguccucauaccaugca

SEQ ID NO: 34285 - RNA, 63 nt, Human
uggcugggcucaggaggcuccuuguaggcauaugauggggagggggugccccuacccaccucc

SEQ ID NO: 34286 - RNA, 63 nt, Human
gugacuucagguaccagcuuaaagagcacuagggauggggaacgaaugccaaaucagacucca

SEQ ID NO: 34287 - RNA, 63 nt, Human
ucccuuuauugauucaucgaggagaacuugguagauggggagaaaacacaguugguuuuuuuu

SEQ ID NO: 34288 - RNA, 63 nt, Human
aauaaugcaggcguggguaaggggccccccugggauggggagaagggcuucgaagauaaacug

SEQ ID NO: 34289 - RNA, 63 nt, Human
gcaaacuuguguuuauccaaaccugauccccaugauggggacuuuucuagagcaccccaaaug

SEQ ID NO: 34290 - RNA, 63 nt, Human
guagacccugaagccccuccuccuucccccacagauggggacaggaggugauggggugcucag

SEQ ID NO: 34291 - RNA, 63 nt, Human
cugauuuuagccagccacuggcccagcugaaaugauggggaaaggaguccuuaguccuuucag

SEQ ID NO: 34292 - RNA, 63 nt, Human
cggcugugugugcacgcgugugcaggagcggcagauggggagacaacgugcucuuuguuuugu

SEQ ID NO: 34293 - RNA, 63 nt, Human
auugagaguaauacacuauugaaaguuaucuuggauggggagaaaaaaaaauagugguuuucc

SEQ ID NO: 34294 - RNA, 63 nt, Human
ccccaccauguggcugggaggacuugggagggggauggggacauugggaaccugucaagaagu

SEQ ID NO: 34295 - RNA, 61 nt, Human
ucaccggccgaucggccugaugcccuggggugauggggacccccucgcugucuccacagga

SEQ ID NO: 34296 - RNA, 63 nt, Human
agcuaccucuugggggagcgugguggcagcgaugauggggagacgccuggaagcucacagaac

SEQ ID NO: 34297 - RNA, 63 nt, Human
cagagcugcuggcgcugaggucagagcgggucugauggggagcuccgucucaccggccacccg

SEQ ID NO: 34298 - RNA, 63 nt, Human
cuucugaggggcuucccaggccugcauuucacagauggggagcucagcccucgaaggccgcag

SEQ ID NO: 34299 - RNA, 63 nt, Human
gccccggguggggggcagaggcgcccagccuuggauggggaccccagccccuggccuguaccu

SEQ ID NO: 34300 - RNA, 63 nt, Human
gauucaagauggcagguaggcccuuugaggagagauggggacagggcaguggguguugggagu

SEQ ID NO: 34301 - RNA, 63 nt, Human
acucaccaaaucgcucaugguuuuuaaaacucugauggggagggugucggggacaccggggca

SEQ ID NO: 34302 - RNA, 63 nt, Human
uucccguagcccugcgcccccuuucuguggcuggauggggagacaggucagggccccccaccc

SEQ ID NO: 34303 - RNA, 63 nt, Human
cggcgaauggcccuucuugccuugauccacagggauggggaagggaggaaugucauuaauguu

SEQ ID NO: 34304 - RNA, 63 nt, Human
ugauggagcgucccugaagcccccagcccuggggauggggaaggacauggagccugagccaga

SEQ ID NO: 34305 - RNA, 63 nt, Human
ugauggagaguccccaaggcccccagcccuggggauggggaaggacaugaagccugagccaga

SEQ ID NO: 34306 - RNA, 63 nt, Human
agaugagucaggccuaaggcuucucugggcugugauggggaugugcagggacagugggauccc

SEQ ID NO: 34307 - RNA, 63 nt, Human
ucagaagaucaggaaagaggucggggcuggacagauggggagagcgcagauagauuuaagaga

SEQ ID NO: 34308 - RNA, 63 nt, Human
gugcuugacccuggcaggggaccccauggaaaagauggggaagagcaaaauacauggagacga

SEQ ID NO: 34309 - RNA, 63 nt, Human
gcagaaggggguuuuaggggccugggcuggggggauggggagggcacaucgugacuguguuuu

SEQ ID NO: 34310 - RNA, 63 nt, Human
ccuggaagacaccaugacacacagugaggccuggauggggaaagaguccugcuguugauccuc

SEQ ID NO: 34311 - RNA, 63 nt, Human
cgcacccacacagacacagagggaagggguugggauggggacagggugcacagcagggcgggg

SEQ ID NO: 34312 - RNA, 63 nt, Human
uucacaccagauaaagaauguauauauaaagcagauggggaaagacuucacacagaaaucuac

SEQ ID NO: 34313 - RNA, 63 nt, Human
gguggcccccuuguccugcagaugggaaaacaggauggggagcuggcaagaggagcugcuugu

SEQ ID NO: 34314 - RNA, 63 nt, Human
ucacccggagcagacgagggcagggcugggaaggauggggagggacauagaggauucgguucc

SEQ ID NO: 34315 - RNA, 63 nt, Human
cuggacacucccuauggagauccggggagcuaggauggggaaccugccacagccagaacugag

SEQ ID NO: 34316 - RNA, 63 nt, Human
cccauuacaccagaagaccaugggugaagucuagauggggaggagaagugaggccagggacag

SEQ ID NO: 34317 - RNA, 63 nt, Human
ggagggugcugggaacggcaaggcggucugggggauggggaggggcaaaggugagagaucacc

SEQ ID NO: 34318 - RNA, 63 nt, Human
gugcccuuugcuugauauagacugcuaaggugagauggggaauaucagagucagcugcugcuu

SEQ ID NO: 34319 - RNA, 63 nt, Human
agacugcagcucuaagaaagucucagccaaacagauggggaggcccaaagcaaggcuugcccc

SEQ ID NO: 34320 - RNA, 63 nt, Human
ccaccccagccauggaagagcagcuggaggguggauggggaggccagagggagcaaugagggg

SEQ ID NO: 34321 - RNA, 57 nt, Human
auuccuuauacucucucugaaggcaaagauggggacaaggacuaagagucagaaugu

SEQ ID NO: 34322 - RNA, 63 nt, Human
gucuaguauaauuacagucaugcauugcuuaacgauggggauacauucuuagaaaugugucac

SEQ ID NO: 34323 - RNA, 63 nt, Human
gccaucuuccugcaacuuuaccucuuucccucagauggggagccaugacuggguugcaccuca

SEQ ID NO: 34324 - RNA, 63 nt, Human
ugccagcccugcggaaccagagccucaggcugggauggggaggccucccugcuuccaccugca

SEQ ID NO: 34325 - RNA, 63 nt, Human
uaaauuaaaagcccuaccuaaaacugagguggggauggggagagccuuugccuccaccauucc

SEQ ID NO: 34326 - RNA, 63 nt, Human
ugcgugggaguauguuauuucucuggggucugugauggggaaggguggaugucccuuccccac

SEQ ID NO: 34327 - RNA, 63 nt, Human
ccggcuuccuuaggggacagacuguuggguggugauggggauuguuaggauggagcccaggcc

SEQ ID NO: 34328 - RNA, 63 nt, Human
ucuuugauuugcacuagcacuacgauaguguuagauggggaaauacugcaacauguccaguug

SEQ ID NO: 34329 - RNA, 63 nt, Human
agauggagguggccuuugagccaggcccugaaggauggggagguuuuggacagagggaggaga

SEQ ID NO: 34330 - RNA, 63 nt, Human
gccagugcacacaggaagaaauugaggcuuauggauggggaugacuucccuaagaucccaugg

SEQ ID NO: 34331 - RNA, 58 nt, Human
aauauuuaagcuccuuuuagcucaaugggauggggaaccugccggaguccagaggcug

SEQ ID NO: 34332 - RNA, 63 nt, Human
uuuggaaaucaaccuuuuuuauuugggggggaggauggggaaaagagcugagaguuuaugcug

SEQ ID NO: 34333 - RNA, 63 nt, Human
uaguuuguuugagagauuucccaggacauacaagauggggagugagaugaguaauucagggaa

SEQ ID NO: 34334 - RNA, 63 nt, Human
uggcagcauuuuaucgcaacuuugagcaucucagauggggaaggcaccuucuuccucgccucu

SEQ ID NO: 34335 - RNA, 63 nt, Human
gucgcuccuuagcaccaggcaccguggguccuggauggggaacugcaagcagccucucagcug

SEQ ID NO: 34336 - RNA, 63 nt, Human
uugccauguucuguggguguuuggcagguuaccgauggggaagauucuugucacagaaucagc

SEQ ID NO: 34337 - RNA, 63 nt, Human
agaugugaaucugggggccaggcuggaggcagggauggggacaggguggguggcuuagacucu

SEQ ID NO: 34338 - RNA, 63 nt, Human
auagcuuuagccacauggaagugugaacauccugauggggaaaauaccacaaagucuaauuua

SEQ ID NO: 34339 - RNA, 63 nt, Human
cauuucacccacuuggccuccuugaggaauagggauggggagcccucuggggaugagcaaggc

SEQ ID NO: 34340 - RNA, 63 nt, Human
gagcccccaggcccucccgcaucucagguuggggauggggacauggagaggaaggggccgccu

SEQ ID NO: 34341 - RNA, 63 nt, Human
accccucugggauggcuaugggagaggaggagugauggggaccgccaccuuuucugcaggaaa

SEQ ID NO: 34342 - RNA, 63 nt, Human
gugggugggaagacuagugaaacccaguucacggauggggaaacaggccugaggucacauuuc

SEQ ID NO: 34343 - RNA, 63 nt, Human
aggugacauggaauggagaaaaccaagauuccagauggggauaguaacuagaaggugcuucag

SEQ ID NO: 34344 - RNA, 63 nt, Human
gucaucuguggcugcaggggucagacagacaaggauggggacugccagggcaccacuucauca

SEQ ID NO: 34345 - RNA, 63 nt, Human
aggguaaggaagagagagugggaggcagagugugauggggaggagggacaggaagacccuuuu

SEQ ID NO: 34346 - RNA, 63 nt, Human
cucccucuccccacccucagaaggauccccaccgauggggaccugugcuggccugugcucaac

SEQ ID NO: 34347 - RNA, 63 nt, Human
ggcaccuucccccagcugcgcuagcgggaaagagauggggauggagucccaaggcaagcgccc

SEQ ID NO: 34348 - RNA, 63 nt, Human
gacauggcaguccccaaaaacaaaauggagucugauggggagaagaaguacccaugcccugaa

SEQ ID NO: 34349 - RNA, 63 nt, Human
acucccuacucuccagaauccaggggcuauagcgauggggacugcggaauuacgagggcuggc

SEQ ID NO: 34350 - RNA, 63 nt, Human
ccacaguggcuucacagacccacaagagaagcugauggggaguaaacccuggaguccgaggcc

SEQ ID NO: 34351 - RNA, 63 nt, Human
gcucugggaguugggguaccacccccagggcaggauggggacaggaucaccugcccgggacac

SEQ ID NO: 34352 - RNA, 63 nt, Human
ggguggagucaccaaaaccagugcugggacaaagauggggaaggugugugaacuuuuuaaaau

SEQ ID NO: 34353 - RNA, 63 nt, Human
ugacaauguggggggaggggggaggggugggaugauggggaaaggguggggggaauuaaaagg

SEQ ID NO: 34354 - RNA, 63 nt, Human
ggugcccacgagggcagaggccggugcuaaggggauggggaagaagggacaagauucccagag

SEQ ID NO: 34355 - RNA, 63 nt, Human
ccaggcccugaggaaaugcucagccucaguggagauggggagguuagagagauggaggcguga

SEQ ID NO: 34356 - RNA, 63 nt, Human
ucugccccugcagagcugaggcagccugggguugauggggaccacgcggugccugcagguccu

SEQ ID NO: 34357 - RNA, 63 nt, Human
ccuggagcugcgugagagugaaaccaagaagcggauggggaagggagagcuggccuuggucag

SEQ ID NO: 34358 - RNA, 63 nt, Human
cucuuguuccugaaauguguuuccuuuucaggagauggggaauaauuuccuucaggcagcuga

SEQ ID NO: 34359 - RNA, 63 nt, Human
uuucuuauuugugagcaguucaggcuaucuccugauggggaugaggccaaggcuuucuuaucu

SEQ ID NO: 34360 - RNA, 63 nt, Human
gugcuuuggugguuuuaauauuauugugccagggauggggaaaugggggggguugugugggaa

SEQ ID NO: 34361 - RNA, 62 nt, Human
uugcagcccaggcaaauaucacuuggccauucagauggggagcagagaagcugccuugcaga

SEQ ID NO: 34362 - RNA, 63 nt, Human
cucccuuuuacccuccauggucguuaaaggagagauggggagcaucauucuguuauacuucug

SEQ ID NO: 34363 - RNA, 63 nt, Human
acugcauccagcacauggggugccugggccucagauggggaccccaaagaagcagaagcugaa

SEQ ID NO: 34364 - RNA, 63 nt, Human
ugggggucucuggggaacacagccagacauccugauggggaggcagagccaggaagcuaagcc

SEQ ID NO: 34365 - RNA, 63 nt, Human
gcuugggccucucggggcuggggccucccaggggauggggacccagagugcaguggccgccca

SEQ ID NO: 34366 - RNA, 63 nt, Human
ugcuugucucagcuucagguucuucaccucuaagauggggaugaugaaaacaguaccugucau

SEQ ID NO: 34367 - RNA, 63 nt, Human
aggcugcugggaggcaagagccgcaccaugcaggauggggaggagggcgagagucacaggguu

SEQ ID NO: 34368 - RNA, 63 nt, Human
accagcuuuucacuaauauuuuguaccuaaggugauggggaacuccauucagauaauaaaauu

SEQ ID NO: 34369 - RNA, 63 nt, Human
cagguuuccugguaaggucacucgaagauaagggauggggaugggggcugacugacaaaaaau

SEQ ID NO: 34370 - RNA, 63 nt, Human
uuucagccccucccuggaauagugaguugggaggauggggagacagcuaaccaacugcauuac

SEQ ID NO: 34371 - RNA, 63 nt, Human
uuggucaucugauuuuauauugccuuauccaaagauggggaaaguaaguccugaccagguguu

SEQ ID NO: 34372 - RNA, 63 nt, Human
ggagugaccugcucagagucauugcagagccgggauggggaccaggucucccaucuccuacuu

SEQ ID NO: 34373 - RNA, 63 nt, Human
cucccuccccaaaagacaagagaaauuuggccagauggggaaggucacuggaaauugaggcca

SEQ ID NO: 34374 - RNA, 63 nt, Human
uuugcuugccugggacuguugccuuguaccgaugauggggagggcugaaaguuuugcuguagc

SEQ ID NO: 34375 - RNA, 63 nt, Human
caaguaaaguaugaaacauucuuauuucaguuagauggggaacauuuugcuagcccauuagaa

SEQ ID NO: 34376 - RNA, 64 nt, Human; identical to SEQ ID NO: 33511

SEQ ID NO: 34377 - RNA, 64 nt, Human; identical to SEQ ID NO: 33512

SEQ ID NO: 34378 - RNA, 64 nt, Human; identical to SEQ ID NO: 33513

SEQ ID NO: 34379 - RNA, 64 nt, Human; identical to SEQ ID NO: 33514

SEQ ID NO: 34380 - RNA, 64 nt, Human; identical to SEQ ID NO: 33515

SEQ ID NO: 34381 - RNA, 64 nt, Human; identical to SEQ ID NO: 33516

SEQ ID NO: 34382 - RNA, 64 nt, Human; identical to SEQ ID NO: 33517

SEQ ID NO: 34383 - RNA, 64 nt, Human; identical to SEQ ID NO: 33518

SEQ ID NO: 34384 - RNA, 64 nt, Human; identical to SEQ ID NO: 33519

SEQ ID NO: 34385 - RNA, 64 nt, Human; identical to SEQ ID NO: 33520

SEQ ID NO: 34386 - RNA, 64 nt, Human; identical to SEQ ID NO: 33521

SEQ ID NO: 34387 - RNA, 50 nt, Human; identical to SEQ ID NO: 33522

SEQ ID NO: 34388 - RNA, 64 nt, Human; identical to SEQ ID NO: 33523

SEQ ID NO: 34389 - RNA, 64 nt, Human; identical to SEQ ID NO: 33524

SEQ ID NO: 34390 - RNA, 64 nt, Human; identical to SEQ ID NO: 33525

SEQ ID NO: 34391 - RNA, 64 nt, Human; identical to SEQ ID NO: 33526

SEQ ID NO: 34392 - RNA, 64 nt, Human; identical to SEQ ID NO: 33527

SEQ ID NO: 34393 - RNA, 64 nt, Human; identical to SEQ ID NO: 33528

SEQ ID NO: 34394 - RNA, 64 nt, Human; identical to SEQ ID NO: 33529

SEQ ID NO: 34395 - RNA, 64 nt, Human; identical to SEQ ID NO: 33530

SEQ ID NO: 34396 - RNA, 64 nt, Human; identical to SEQ ID NO: 33531

SEQ ID NO: 34397 - RNA, 64 nt, Human; identical to SEQ ID NO: 33532

SEQ ID NO: 34398 - RNA, 64 nt, Human; identical to SEQ ID NO: 33533

SEQ ID NO: 34399 - RNA, 64 nt, Human; identical to SEQ ID NO: 33534

SEQ ID NO: 34400 - RNA, 64 nt, Human; identical to SEQ ID NO: 33535

SEQ ID NO: 34401 - RNA, 64 nt, Human; identical to SEQ ID NO: 33536

SEQ ID NO: 34402 - RNA, 64 nt, Human; identical to SEQ ID NO: 33537

SEQ ID NO: 34403 - RNA, 64 nt, Human; identical to SEQ ID NO: 33538

SEQ ID NO: 34404 - RNA, 64 nt, Human; identical to SEQ ID NO: 33539

SEQ ID NO: 34405 - RNA, 64 nt, Human; identical to SEQ ID NO: 33540

SEQ ID NO: 34406 - RNA, 64 nt, Human; identical to SEQ ID NO: 33541

SEQ ID NO: 34407 - RNA, 64 nt, Human; identical to SEQ ID NO: 33542

SEQ ID NO: 34408 - RNA, 64 nt, Human; identical to SEQ ID NO: 33543

SEQ ID NO: 34409 - RNA, 64 nt, Human; identical to SEQ ID NO: 33544

SEQ ID NO: 34410 - RNA, 64 nt, Human; identical to SEQ ID NO: 33545

SEQ ID NO: 34411 - RNA, 64 nt, Human; identical to SEQ ID NO: 33546

SEQ ID NO: 34412 - RNA, 64 nt, Human; identical to SEQ ID NO: 33547

SEQ ID NO: 34413 - RNA, 64 nt, Human; identical to SEQ ID NO: 33548

SEQ ID NO: 34414 - RNA, 64 nt, Human; identical to SEQ ID NO: 33549

SEQ ID NO: 34415 - RNA, 64 nt, Human; identical to SEQ ID NO: 33550

SEQ ID NO: 34416 - RNA, 64 nt, Human; identical to SEQ ID NO: 33551

SEQ ID NO: 34417 - RNA, 64 nt, Human; identical to SEQ ID NO: 33552

SEQ ID NO: 34418 - RNA, 64 nt, Human; identical to SEQ ID NO: 33553

SEQ ID NO: 34419 - RNA, 64 nt, Human; identical to SEQ ID NO: 33554

SEQ ID NO: 34420 - RNA, 64 nt, Human; identical to SEQ ID NO: 33555

SEQ ID NO: 34421 - RNA, 64 nt, Human; identical to SEQ ID NO: 33556

SEQ ID NO: 34422 - RNA, 64 nt, Human; identical to SEQ ID NO: 33557

SEQ ID NO: 34423 - RNA, 64 nt, Human; identical to SEQ ID NO: 33558

SEQ ID NO: 34424 - RNA, 64 nt, Human; identical to SEQ ID NO: 33559

SEQ ID NO: 34425 - RNA, 64 nt, Human; identical to SEQ ID NO: 33560

SEQ ID NO: 34426 - RNA, 64 nt, Human; identical to SEQ ID NO: 33561

SEQ ID NO: 34427 - RNA, 64 nt, Human; identical to SEQ ID NO: 33562

SEQ ID NO: 34428 - RNA, 64 nt, Human; identical to SEQ ID NO: 33563

SEQ ID NO: 34429 - RNA, 64 nt, Human; identical to SEQ ID NO: 33564

SEQ ID NO: 34430 - RNA, 64 nt, Human; identical to SEQ ID NO: 33565

SEQ ID NO: 34431 - RNA, 64 nt, Human; identical to SEQ ID NO: 33566

SEQ ID NO: 34432 - RNA, 64 nt, Human; identical to SEQ ID NO: 33567

SEQ ID NO: 34433 - RNA, 64 nt, Human; identical to SEQ ID NO: 33568

SEQ ID NO: 34434 - RNA, 64 nt, Human; identical to SEQ ID NO: 33569

SEQ ID NO: 34435 - RNA, 64 nt, Human; identical to SEQ ID NO: 33570

SEQ ID NO: 34436 - RNA, 64 nt, Human; identical to SEQ ID NO: 33571

SEQ ID NO: 34437 - RNA, 64 nt, Human; identical to SEQ ID NO: 33572

SEQ ID NO: 34438 - RNA, 64 nt, Human; identical to SEQ ID NO: 33573

SEQ ID NO: 34439 - RNA, 64 nt, Human; identical to SEQ ID NO: 33574

SEQ ID NO: 34440 - RNA, 64 nt, Human; identical to SEQ ID NO: 33575

SEQ ID NO: 34441 - RNA, 64 nt, Human; identical to SEQ ID NO: 33576

SEQ ID NO: 34442 - RNA, 64 nt, Human; identical to SEQ ID NO: 33577

SEQ ID NO: 34443 - RNA, 64 nt, Human; identical to SEQ ID NO: 33578

SEQ ID NO: 34444 - RNA, 64 nt, Human; identical to SEQ ID NO: 33579

SEQ ID NO: 34445 - RNA, 64 nt, Human; identical to SEQ ID NO: 33580

SEQ ID NO: 34446 - RNA, 64 nt, Human; identical to SEQ ID NO: 33581

SEQ ID NO: 34447 - RNA, 64 nt, Human; identical to SEQ ID NO: 33582

SEQ ID NO: 34448 - RNA, 64 nt, Human; identical to SEQ ID NO: 33583

SEQ ID NO: 34449 - RNA, 64 nt, Human; identical to SEQ ID NO: 33584

SEQ ID NO: 34450 - RNA, 64 nt, Human; identical to SEQ ID NO: 33585

SEQ ID NO: 34451 - RNA, 64 nt, Human; identical to SEQ ID NO: 33586

SEQ ID NO: 34452 - RNA, 64 nt, Human; identical to SEQ ID NO: 33587

SEQ ID NO: 34453 - RNA, 64 nt, Human; identical to SEQ ID NO: 33588

SEQ ID NO: 34454 - RNA, 64 nt, Human; identical to SEQ ID NO: 33589

SEQ ID NO: 34455 - RNA, 64 nt, Human; identical to SEQ ID NO: 33590

SEQ ID NO: 34456 - RNA, 64 nt, Human; identical to SEQ ID NO: 33591

SEQ ID NO: 34457 - RNA, 64 nt, Human; identical to SEQ ID NO: 33592

SEQ ID NO: 34458 - RNA, 64 nt, Human; identical to SEQ ID NO: 33593

SEQ ID NO: 34459 - RNA, 64 nt, Human; identical to SEQ ID NO: 33594

SEQ ID NO: 34460 - RNA, 64 nt, Human; identical to SEQ ID NO: 33595

SEQ ID NO: 34461 - RNA, 64 nt, Human; identical to SEQ ID NO: 33596

SEQ ID NO: 34462 - RNA, 64 nt, Human; identical to SEQ ID NO: 33597

SEQ ID NO: 34463 - RNA, 64 nt, Human; identical to SEQ ID NO: 33598

SEQ ID NO: 34464 - RNA, 64 nt, Human; identical to SEQ ID NO: 33599

SEQ ID NO: 34465 - RNA, 64 nt, Human; identical to SEQ ID NO: 33600

SEQ ID NO: 34466 - RNA, 64 nt, Human; identical to SEQ ID NO: 33601

SEQ ID NO: 34467 - RNA, 64 nt, Human; identical to SEQ ID NO: 33602

SEQ ID NO: 34468 - RNA, 64 nt, Human; identical to SEQ ID NO: 33603

SEQ ID NO: 34469 - RNA, 64 nt, Human; identical to SEQ ID NO: 33604

SEQ ID NO: 34470 - RNA, 64 nt, Human; identical to SEQ ID NO: 33605

SEQ ID NO: 34471 - RNA, 64 nt, Human; identical to SEQ ID NO: 33606

SEQ ID NO: 34472 - RNA, 64 nt, Human; identical to SEQ ID NO: 33607

SEQ ID NO: 34473 - RNA, 64 nt, Human; identical to SEQ ID NO: 33608

SEQ ID NO: 34474 - RNA, 64 nt, Human; identical to SEQ ID NO: 33609

SEQ ID NO: 34475 - RNA, 64 nt, Human; identical to SEQ ID NO: 33610

SEQ ID NO: 34476 - RNA, 64 nt, Human; identical to SEQ ID NO: 33611

SEQ ID NO: 34477 - RNA, 64 nt, Human; identical to SEQ ID NO: 33612

SEQ ID NO: 34478 - RNA, 64 nt, Human; identical to SEQ ID NO: 33613

SEQ ID NO: 34479 - RNA, 64 nt, Human; identical to SEQ ID NO: 33614

SEQ ID NO: 34480 - RNA, 64 nt, Human; identical to SEQ ID NO: 33615

SEQ ID NO: 34481 - RNA, 64 nt, Human; identical to SEQ ID NO: 33616

SEQ ID NO: 34482 - RNA, 64 nt, Human; identical to SEQ ID NO: 33617

SEQ ID NO: 34483 - RNA, 64 nt, Human; identical to SEQ ID NO: 33618

SEQ ID NO: 34484 - RNA, 64 nt, Human; identical to SEQ ID NO: 33619

SEQ ID NO: 34485 - RNA, 64 nt, Human; identical to SEQ ID NO: 33620

SEQ ID NO: 34486 - RNA, 64 nt, Human; identical to SEQ ID NO: 33621

SEQ ID NO: 34487 - RNA, 64 nt, Human; identical to SEQ ID NO: 33622

SEQ ID NO: 34488 - RNA, 64 nt, Human; identical to SEQ ID NO: 33623

SEQ ID NO: 34489 - RNA, 64 nt, Human; identical to SEQ ID NO: 33624

SEQ ID NO: 34490 - RNA, 64 nt, Human; identical to SEQ ID NO: 33625

SEQ ID NO: 34491 - RNA, 64 nt, Human; identical to SEQ ID NO: 33626

SEQ ID NO: 34492 - RNA, 64 nt, Human; identical to SEQ ID NO: 33627

SEQ ID NO: 34493 - RNA, 64 nt, Human; identical to SEQ ID NO: 33628

SEQ ID NO: 34494 - RNA, 64 nt, Human; identical to SEQ ID NO: 33629

SEQ ID NO: 34495 - RNA, 64 nt, Human; identical to SEQ ID NO: 33630

SEQ ID NO: 34496 - RNA, 64 nt, Human; identical to SEQ ID NO: 33631

SEQ ID NO: 34497 - RNA, 64 nt, Human; identical to SEQ ID NO: 33632

SEQ ID NO: 34498 - RNA, 64 nt, Human; identical to SEQ ID NO: 33633

SEQ ID NO: 34499 - RNA, 64 nt, Human; identical to SEQ ID NO: 33634

SEQ ID NO: 34500 - RNA, 64 nt, Human; identical to SEQ ID NO: 33635

SEQ ID NO: 34501 - RNA, 64 nt, Human; identical to SEQ ID NO: 33636

SEQ ID NO: 34502 - RNA, 64 nt, Human; identical to SEQ ID NO: 33637

SEQ ID NO: 34503 - RNA, 64 nt, Human; identical to SEQ ID NO: 33638

SEQ ID NO: 34504 - RNA, 64 nt, Human; identical to SEQ ID NO: 33639

SEQ ID NO: 34505 - RNA, 64 nt, Human; identical to SEQ ID NO: 33640

SEQ ID NO: 34506 - RNA, 64 nt, Human; identical to SEQ ID NO: 33641

SEQ ID NO: 34507 - RNA, 64 nt, Human; identical to SEQ ID NO: 33642

SEQ ID NO: 34508 - RNA, 64 nt, Human; identical to SEQ ID NO: 33643

SEQ ID NO: 34509 - RNA, 64 nt, Human; identical to SEQ ID NO: 33644

SEQ ID NO: 34510 - RNA, 64 nt, Human; identical to SEQ ID NO: 33645

SEQ ID NO: 34511 - RNA, 64 nt, Human; identical to SEQ ID NO: 33646

SEQ ID NO: 34512 - RNA, 64 nt, Human; identical to SEQ ID NO: 33647

SEQ ID NO: 34513 - RNA, 64 nt, Human; identical to SEQ ID NO: 33648

SEQ ID NO: 34514 - RNA, 64 nt, Human; identical to SEQ ID NO: 33649

SEQ ID NO: 34515 - RNA, 64 nt, Human; identical to SEQ ID NO: 33650

SEQ ID NO: 34516 - RNA, 64 nt, Human; identical to SEQ ID NO: 33651

SEQ ID NO: 34517 - RNA, 64 nt, Human; identical to SEQ ID NO: 33652

SEQ ID NO: 34518 - RNA, 64 nt, Human; identical to SEQ ID NO: 33653

SEQ ID NO: 34519 - RNA, 64 nt, Human; identical to SEQ ID NO: 33654

SEQ ID NO: 34520 - RNA, 64 nt, Human; identical to SEQ ID NO: 33655

SEQ ID NO: 34521 - RNA, 64 nt, Human; identical to SEQ ID NO: 33656

SEQ ID NO: 34522 - RNA, 64 nt, Human; identical to SEQ ID NO: 33657

SEQ ID NO: 34523 - RNA, 64 nt, Human; identical to SEQ ID NO: 33658

SEQ ID NO: 34524 - RNA, 64 nt, Human; identical to SEQ ID NO: 33659

SEQ ID NO: 34525 - RNA, 64 nt, Human; identical to SEQ ID NO: 33660

SEQ ID NO: 34526 - RNA, 64 nt, Human; identical to SEQ ID NO: 33661

SEQ ID NO: 34527 - RNA, 64 nt, Human; identical to SEQ ID NO: 33662

SEQ ID NO: 34528 - RNA, 64 nt, Human; identical to SEQ ID NO: 33663

SEQ ID NO: 34529 - RNA, 64 nt, Human; identical to SEQ ID NO: 33664

SEQ ID NO: 34530 - RNA, 64 nt, Human; identical to SEQ ID NO: 33665

SEQ ID NO: 34531 - RNA, 64 nt, Human; identical to SEQ ID NO: 33666

SEQ ID NO: 34532 - RNA, 64 nt, Human; identical to SEQ ID NO: 33667

SEQ ID NO: 34533 - RNA, 64 nt, Human; identical to SEQ ID NO: 33668

SEQ ID NO: 34534 - RNA, 53 nt, Human; identical to SEQ ID NO: 33669

SEQ ID NO: 34535 - RNA, 64 nt, Human; identical to SEQ ID NO: 33670

SEQ ID NO: 34536 - RNA, 64 nt, Human; identical to SEQ ID NO: 33671

SEQ ID NO: 34537 - RNA, 64 nt, Human; identical to SEQ ID NO: 33672

SEQ ID NO: 34538 - RNA, 64 nt, Human; identical to SEQ ID NO: 33673

SEQ ID NO: 34539 - RNA, 64 nt, Human; identical to SEQ ID NO: 33674

SEQ ID NO: 34540 - RNA, 64 nt, Human; identical to SEQ ID NO: 33675

SEQ ID NO: 34541 - RNA, 64 nt, Human; identical to SEQ ID NO: 33676

SEQ ID NO: 34542 - RNA, 64 nt, Human; identical to SEQ ID NO: 33677

SEQ ID NO: 34543 - RNA, 64 nt, Human; identical to SEQ ID NO: 33678

SEQ ID NO: 34544 - RNA, 64 nt, Human; identical to SEQ ID NO: 33679

SEQ ID NO: 34545 - RNA, 64 nt, Human; identical to SEQ ID NO: 33680

SEQ ID NO: 34546 - RNA, 64 nt, Human; identical to SEQ ID NO: 33681

SEQ ID NO: 34547 - RNA, 64 nt, Human; identical to SEQ ID NO: 33682

SEQ ID NO: 34548 - RNA, 64 nt, Human; identical to SEQ ID NO: 33683

SEQ ID NO: 34549 - RNA, 64 nt, Human; identical to SEQ ID NO: 33684

SEQ ID NO: 34550 - RNA, 64 nt, Human; identical to SEQ ID NO: 33685

SEQ ID NO: 34551 - RNA, 64 nt, Human; identical to SEQ ID NO: 33686

SEQ ID NO: 34552 - RNA, 64 nt, Human; identical to SEQ ID NO: 33687

SEQ ID NO: 34553 - RNA, 64 nt, Human; identical to SEQ ID NO: 33688

SEQ ID NO: 34554 - RNA, 64 nt, Human; identical to SEQ ID NO: 33689

SEQ ID NO: 34555 - RNA, 64 nt, Human; identical to SEQ ID NO: 33690

SEQ ID NO: 34556 - RNA, 64 nt, Human; identical to SEQ ID NO: 33691

SEQ ID NO: 34557 - RNA, 64 nt, Human; identical to SEQ ID NO: 33692

SEQ ID NO: 34558 - RNA, 64 nt, Human; identical to SEQ ID NO: 33693

SEQ ID NO: 34559 - RNA, 64 nt, Human; identical to SEQ ID NO: 33694

SEQ ID NO: 34560 - RNA, 64 nt, Human; identical to SEQ ID NO: 33695

SEQ ID NO: 34561 - RNA, 64 nt, Human; identical to SEQ ID NO: 33696

SEQ ID NO: 34562 - RNA, 64 nt, Human; identical to SEQ ID NO: 33697

SEQ ID NO: 34563 - RNA, 64 nt, Human; identical to SEQ ID NO: 33698

SEQ ID NO: 34564 - RNA, 64 nt, Human; identical to SEQ ID NO: 33699

SEQ ID NO: 34565 - RNA, 64 nt, Human; identical to SEQ ID NO: 33700

SEQ ID NO: 34566 - RNA, 64 nt, Human; identical to SEQ ID NO: 33701

SEQ ID NO: 34567 - RNA, 64 nt, Human; identical to SEQ ID NO: 33702

SEQ ID NO: 34568 - RNA, 64 nt, Human; identical to SEQ ID NO: 33703

SEQ ID NO: 34569 - RNA, 64 nt, Human; identical to SEQ ID NO: 33704

SEQ ID NO: 34570 - RNA, 64 nt, Human; identical to SEQ ID NO: 33705

SEQ ID NO: 34571 - RNA, 64 nt, Human; identical to SEQ ID NO: 33706

SEQ ID NO: 34572 - RNA, 64 nt, Human; identical to SEQ ID NO: 33707

SEQ ID NO: 34573 - RNA, 64 nt, Human; identical to SEQ ID NO: 33708

SEQ ID NO: 34574 - RNA, 64 nt, Human; identical to SEQ ID NO: 33709

SEQ ID NO: 34575 - RNA, 64 nt, Human; identical to SEQ ID NO: 33710

SEQ ID NO: 34576 - RNA, 64 nt, Human; identical to SEQ ID NO: 33711

SEQ ID NO: 34577 - RNA, 64 nt, Human; identical to SEQ ID NO: 33712

SEQ ID NO: 34578 - RNA, 64 nt, Human; identical to SEQ ID NO: 33713

SEQ ID NO: 34579 - RNA, 64 nt, Human; identical to SEQ ID NO: 33714

SEQ ID NO: 34580 - RNA, 64 nt, Human; identical to SEQ ID NO: 33715

SEQ ID NO: 34581 - RNA, 64 nt, Human; identical to SEQ ID NO: 33716

SEQ ID NO: 34582 - RNA, 64 nt, Human; identical to SEQ ID NO: 33717

SEQ ID NO: 34583 - RNA, 55 nt, Human; identical to SEQ ID NO: 33718

SEQ ID NO: 34584 - RNA, 64 nt, Human; identical to SEQ ID NO: 33719

SEQ ID NO: 34585 - RNA, 64 nt, Human; identical to SEQ ID NO: 33720

SEQ ID NO: 34586 - RNA, 64 nt, Human; identical to SEQ ID NO: 33721

SEQ ID NO: 34587 - RNA, 64 nt, Human; identical to SEQ ID NO: 33722

SEQ ID NO: 34588 - RNA, 64 nt, Human; identical to SEQ ID NO: 33723

SEQ ID NO: 34589 - RNA, 55 nt, Human; identical to SEQ ID NO: 33724

SEQ ID NO: 34590 - RNA, 64 nt, Human; identical to SEQ ID NO: 33725

SEQ ID NO: 34591 - RNA, 64 nt, Human; identical to SEQ ID NO: 33726

SEQ ID NO: 34592 - RNA, 64 nt, Human; identical to SEQ ID NO: 33727

SEQ ID NO: 34593 - RNA, 64 nt, Human; identical to SEQ ID NO: 33728

SEQ ID NO: 34594 - RNA, 64 nt, Human; identical to SEQ ID NO: 33729

SEQ ID NO: 34595 - RNA, 64 nt, Human; identical to SEQ ID NO: 33730

SEQ ID NO: 34596 - RNA, 64 nt, Human; identical to SEQ ID NO: 33731

SEQ ID NO: 34597 - RNA, 64 nt, Human; identical to SEQ ID NO: 33732

SEQ ID NO: 34598 - RNA, 64 nt, Human; identical to SEQ ID NO: 33733

SEQ ID NO: 34599 - RNA, 64 nt, Human; identical to SEQ ID NO: 33734

SEQ ID NO: 34600 - RNA, 64 nt, Human; identical to SEQ ID NO: 33735

SEQ ID NO: 34601 - RNA, 64 nt, Human; identical to SEQ ID NO: 33736

SEQ ID NO: 34602 - RNA, 64 nt, Human; identical to SEQ ID NO: 33737

SEQ ID NO: 34603 - RNA, 64 nt, Human; identical to SEQ ID NO: 33738

SEQ ID NO: 34604 - RNA, 64 nt, Human; identical to SEQ ID NO: 33739

SEQ ID NO: 34605 - RNA, 64 nt, Human; identical to SEQ ID NO: 33740

SEQ ID NO: 34606 - RNA, 64 nt, Human; identical to SEQ ID NO: 33741

SEQ ID NO: 34607 - RNA, 64 nt, Human; identical to SEQ ID NO: 33742

SEQ ID NO: 34608 - RNA, 64 nt, Human; identical to SEQ ID NO: 33743

SEQ ID NO: 34609 - RNA, 64 nt, Human; identical to SEQ ID NO: 33744

SEQ ID NO: 34610 - RNA, 64 nt, Human; identical to SEQ ID NO: 33745

SEQ ID NO: 34611 - RNA, 64 nt, Human; identical to SEQ ID NO: 33746

SEQ ID NO: 34612 - RNA, 64 nt, Human; identical to SEQ ID NO: 33747

SEQ ID NO: 34613 - RNA, 64 nt, Human; identical to SEQ ID NO: 33748

SEQ ID NO: 34614 - RNA, 64 nt, Human; identical to SEQ ID NO: 33749

SEQ ID NO: 34615 - RNA, 64 nt, Human; identical to SEQ ID NO: 33750

SEQ ID NO: 34616 - RNA, 64 nt, Human; identical to SEQ ID NO: 33751

SEQ ID NO: 34617 - RNA, 64 nt, Human; identical to SEQ ID NO: 33752

SEQ ID NO: 34618 - RNA, 64 nt, Human; identical to SEQ ID NO: 33753

SEQ ID NO: 34619 - RNA, 64 nt, Human; identical to SEQ ID NO: 33754

SEQ ID NO: 34620 - RNA, 64 nt, Human; identical to SEQ ID NO: 33755

SEQ ID NO: 34621 - RNA, 64 nt, Human; identical to SEQ ID NO: 33756

SEQ ID NO: 34622 - RNA, 64 nt, Human; identical to SEQ ID NO: 33757

SEQ ID NO: 34623 - RNA, 64 nt, Human; identical to SEQ ID NO: 33758

SEQ ID NO: 34624 - RNA, 64 nt, Human; identical to SEQ ID NO: 33759

SEQ ID NO: 34625 - RNA, 64 nt, Human; identical to SEQ ID NO: 33760

SEQ ID NO: 34626 - RNA, 64 nt, Human; identical to SEQ ID NO: 33761

SEQ ID NO: 34627 - RNA, 64 nt, Human; identical to SEQ ID NO: 33762

SEQ ID NO: 34628 - RNA, 64 nt, Human; identical to SEQ ID NO: 33763

SEQ ID NO: 34629 - RNA, 64 nt, Human; identical to SEQ ID NO: 33764

SEQ ID NO: 34630 - RNA, 64 nt, Human; identical to SEQ ID NO: 33765

SEQ ID NO: 34631 - RNA, 64 nt, Human; identical to SEQ ID NO: 33766

SEQ ID NO: 34632 - RNA, 64 nt, Human; identical to SEQ ID NO: 33767

SEQ ID NO: 34633 - RNA, 64 nt, Human; identical to SEQ ID NO: 33768

SEQ ID NO: 34634 - RNA, 64 nt, Human; identical to SEQ ID NO: 33769

SEQ ID NO: 34635 - RNA, 64 nt, Human; identical to SEQ ID NO: 33770

SEQ ID NO: 34636 - RNA, 64 nt, Human; identical to SEQ ID NO: 33771

SEQ ID NO: 34637 - RNA, 64 nt, Human; identical to SEQ ID NO: 33772

SEQ ID NO: 34638 - RNA, 64 nt, Human; identical to SEQ ID NO: 33773

SEQ ID NO: 34639 - RNA, 64 nt, Human; identical to SEQ ID NO: 33774

SEQ ID NO: 34640 - RNA, 64 nt, Human; identical to SEQ ID NO: 33775

SEQ ID NO: 34641 - RNA, 64 nt, Human; identical to SEQ ID NO: 33776

SEQ ID NO: 34642 - RNA, 64 nt, Human; identical to SEQ ID NO: 33777

SEQ ID NO: 34643 - RNA, 64 nt, Human; identical to SEQ ID NO: 33778

SEQ ID NO: 34644 - RNA, 64 nt, Human; identical to SEQ ID NO: 33779

SEQ ID NO: 34645 - RNA, 64 nt, Human; identical to SEQ ID NO: 33780

SEQ ID NO: 34646 - RNA, 64 nt, Human; identical to SEQ ID NO: 33781

SEQ ID NO: 34647 - RNA, 64 nt, Human; identical to SEQ ID NO: 33782

SEQ ID NO: 34648 - RNA, 64 nt, Human; identical to SEQ ID NO: 33783

SEQ ID NO: 34649 - RNA, 64 nt, Human; identical to SEQ ID NO: 33784

SEQ ID NO: 34650 - RNA, 64 nt, Human; identical to SEQ ID NO: 33785

SEQ ID NO: 34651 - RNA, 64 nt, Human; identical to SEQ ID NO: 33786

SEQ ID NO: 34652 - RNA, 64 nt, Human; identical to SEQ ID NO: 33787

SEQ ID NO: 34653 - RNA, 64 nt, Human; identical to SEQ ID NO: 33788

SEQ ID NO: 34654 - RNA, 64 nt, Human; identical to SEQ ID NO: 33789

SEQ ID NO: 34655 - RNA, 64 nt, Human; identical to SEQ ID NO: 33790

SEQ ID NO: 34656 - RNA, 64 nt, Human; identical to SEQ ID NO: 33791

SEQ ID NO: 34657 - RNA, 64 nt, Human; identical to SEQ ID NO: 33792

SEQ ID NO: 34658 - RNA, 64 nt, Human; identical to SEQ ID NO: 33793

SEQ ID NO: 34659 - RNA, 64 nt, Human; identical to SEQ ID NO: 33794

SEQ ID NO: 34660 - RNA, 64 nt, Human; identical to SEQ ID NO: 33795

SEQ ID NO: 34661 - RNA, 64 nt, Human; identical to SEQ ID NO: 33796

SEQ ID NO: 34662 - RNA, 64 nt, Human; identical to SEQ ID NO: 33797

SEQ ID NO: 34663 - RNA, 64 nt, Human; identical to SEQ ID NO: 33798

SEQ ID NO: 34664 - RNA, 64 nt, Human; identical to SEQ ID NO: 33799

SEQ ID NO: 34665 - RNA, 64 nt, Human; identical to SEQ ID NO: 33800

SEQ ID NO: 34666 - RNA, 64 nt, Human; identical to SEQ ID NO: 33801

SEQ ID NO: 34667 - RNA, 62 nt, Human; identical to SEQ ID NO: 33802

SEQ ID NO: 34668 - RNA, 64 nt, Human; identical to SEQ ID NO: 33803

SEQ ID NO: 34669 - RNA, 64 nt, Human; identical to SEQ ID NO: 33804

SEQ ID NO: 34670 - RNA, 64 nt, Human; identical to SEQ ID NO: 33805

SEQ ID NO: 34671 - RNA, 64 nt, Human; identical to SEQ ID NO: 33806

SEQ ID NO: 34672 - RNA, 64 nt, Human; identical to SEQ ID NO: 33807

SEQ ID NO: 34673 - RNA, 64 nt, Human; identical to SEQ ID NO: 33808

SEQ ID NO: 34674 - RNA, 64 nt, Human; identical to SEQ ID NO: 33809

SEQ ID NO: 34675 - RNA, 64 nt, Human; identical to SEQ ID NO: 33810

SEQ ID NO: 34676 - RNA, 64 nt, Human; identical to SEQ ID NO: 33811

SEQ ID NO: 34677 - RNA, 64 nt, Human; identical to SEQ ID NO: 33812

SEQ ID NO: 34678 - RNA, 64 nt, Human; identical to SEQ ID NO: 33813

SEQ ID NO: 34679 - RNA, 64 nt, Human; identical to SEQ ID NO: 33814

SEQ ID NO: 34680 - RNA, 64 nt, Human; identical to SEQ ID NO: 33815

SEQ ID NO: 34681 - RNA, 64 nt, Human; identical to SEQ ID NO: 33816

SEQ ID NO: 34682 - RNA, 64 nt, Human; identical to SEQ ID NO: 33817

SEQ ID NO: 34683 - RNA, 64 nt, Human; identical to SEQ ID NO: 33818

SEQ ID NO: 34684 - RNA, 64 nt, Human; identical to SEQ ID NO: 33819

SEQ ID NO: 34685 - RNA, 64 nt, Human; identical to SEQ ID NO: 33820

SEQ ID NO: 34686 - RNA, 64 nt, Human; identical to SEQ ID NO: 33821

SEQ ID NO: 34687 - RNA, 64 nt, Human; identical to SEQ ID NO: 33822

SEQ ID NO: 34688 - RNA, 64 nt, Human; identical to SEQ ID NO: 33823

SEQ ID NO: 34689 - RNA, 64 nt, Human; identical to SEQ ID NO: 33824

SEQ ID NO: 34690 - RNA, 64 nt, Human; identical to SEQ ID NO: 33825

SEQ ID NO: 34691 - RNA, 64 nt, Human; identical to SEQ ID NO: 33826

SEQ ID NO: 34692 - RNA, 64 nt, Human; identical to SEQ ID NO: 33827

SEQ ID NO: 34693 - RNA, 64 nt, Human; identical to SEQ ID NO: 33828

SEQ ID NO: 34694 - RNA, 64 nt, Human; identical to SEQ ID NO: 33829

SEQ ID NO: 34695 - RNA, 64 nt, Human; identical to SEQ ID NO: 33830

SEQ ID NO: 34696 - RNA, 64 nt, Human; identical to SEQ ID NO: 33831

SEQ ID NO: 34697 - RNA, 64 nt, Human; identical to SEQ ID NO: 33832

SEQ ID NO: 34698 - RNA, 64 nt, Human; identical to SEQ ID NO: 33833

SEQ ID NO: 34699 - RNA, 64 nt, Human; identical to SEQ ID NO: 33834

SEQ ID NO: 34700 - RNA, 64 nt, Human; identical to SEQ ID NO: 33835

SEQ ID NO: 34701 - RNA, 64 nt, Human; identical to SEQ ID NO: 33836

SEQ ID NO: 34702 - RNA, 64 nt, Human; identical to SEQ ID NO: 33837

SEQ ID NO: 34703 - RNA, 64 nt, Human; identical to SEQ ID NO: 33838

SEQ ID NO: 34704 - RNA, 64 nt, Human; identical to SEQ ID NO: 33839

SEQ ID NO: 34705 - RNA, 64 nt, Human; identical to SEQ ID NO: 33840

SEQ ID NO: 34706 - RNA, 64 nt, Human; identical to SEQ ID NO: 33841

SEQ ID NO: 34707 - RNA, 64 nt, Human; identical to SEQ ID NO: 33842

SEQ ID NO: 34708 - RNA, 64 nt, Human; identical to SEQ ID NO: 33843

SEQ ID NO: 34709 - RNA, 64 nt, Human; identical to SEQ ID NO: 33844

SEQ ID NO: 34710 - RNA, 64 nt, Human; identical to SEQ ID NO: 33845

SEQ ID NO: 34711 - RNA, 64 nt, Human; identical to SEQ ID NO: 33846

SEQ ID NO: 34712 - RNA, 64 nt, Human; identical to SEQ ID NO: 33847

SEQ ID NO: 34713 - RNA, 64 nt, Human; identical to SEQ ID NO: 33848

SEQ ID NO: 34714 - RNA, 64 nt, Human; identical to SEQ ID NO: 33849

SEQ ID NO: 34715 - RNA, 64 nt, Human; identical to SEQ ID NO: 33850

SEQ ID NO: 34716 - RNA, 64 nt, Human; identical to SEQ ID NO: 33851

SEQ ID NO: 34717 - RNA, 64 nt, Human; identical to SEQ ID NO: 33852

SEQ ID NO: 34718 - RNA, 64 nt, Human; identical to SEQ ID NO: 33853

SEQ ID NO: 34719 - RNA, 64 nt, Human; identical to SEQ ID NO: 33854

SEQ ID NO: 34720 - RNA, 64 nt, Human; identical to SEQ ID NO: 33855

SEQ ID NO: 34721 - RNA, 64 nt, Human; identical to SEQ ID NO: 33856

SEQ ID NO: 34722 - RNA, 64 nt, Human; identical to SEQ ID NO: 33857

SEQ ID NO: 34723 - RNA, 64 nt, Human; identical to SEQ ID NO: 33858

SEQ ID NO: 34724 - RNA, 64 nt, Human; identical to SEQ ID NO: 33859

SEQ ID NO: 34725 - RNA, 64 nt, Human; identical to SEQ ID NO: 33860

SEQ ID NO: 34726 - RNA, 64 nt, Human; identical to SEQ ID NO: 33861

SEQ ID NO: 34727 - RNA, 64 nt, Human; identical to SEQ ID NO: 33862

SEQ ID NO: 34728 - RNA, 64 nt, Human; identical to SEQ ID NO: 33863

SEQ ID NO: 34729 - RNA, 64 nt, Human; identical to SEQ ID NO: 33864

SEQ ID NO: 34730 - RNA, 64 nt, Human; identical to SEQ ID NO: 33865

SEQ ID NO: 34731 - RNA, 64 nt, Human; identical to SEQ ID NO: 33866

SEQ ID NO: 34732 - RNA, 64 nt, Human; identical to SEQ ID NO: 33867

SEQ ID NO: 34733 - RNA, 64 nt, Human; identical to SEQ ID NO: 33868

SEQ ID NO: 34734 - RNA, 64 nt, Human; identical to SEQ ID NO: 33869

SEQ ID NO: 34735 - RNA, 50 nt, Human; identical to SEQ ID NO: 33870

SEQ ID NO: 34736 - RNA, 64 nt, Human; identical to SEQ ID NO: 33871

SEQ ID NO: 34737 - RNA, 64 nt, Human; identical to SEQ ID NO: 33872

SEQ ID NO: 34738 - RNA, 64 nt, Human; identical to SEQ ID NO: 33873

SEQ ID NO: 34739 - RNA, 64 nt, Human; identical to SEQ ID NO: 33874

SEQ ID NO: 34740 - RNA, 64 nt, Human; identical to SEQ ID NO: 33875

SEQ ID NO: 34741 - RNA, 64 nt, Human; identical to SEQ ID NO: 33876

SEQ ID NO: 34742 - RNA, 64 nt, Human; identical to SEQ ID NO: 33877

SEQ ID NO: 34743 - RNA, 64 nt, Human; identical to SEQ ID NO: 33878

SEQ ID NO: 34744 - RNA, 64 nt, Human; identical to SEQ ID NO: 33879

SEQ ID NO: 34745 - RNA, 64 nt, Human; identical to SEQ ID NO: 33880

SEQ ID NO: 34746 - RNA, 64 nt, Human; identical to SEQ ID NO: 33881

SEQ ID NO: 34747 - RNA, 64 nt, Human; identical to SEQ ID NO: 33882

SEQ ID NO: 34748 - RNA, 64 nt, Human; identical to SEQ ID NO: 33883

SEQ ID NO: 34749 - RNA, 64 nt, Human; identical to SEQ ID NO: 33884

SEQ ID NO: 34750 - RNA, 64 nt, Human; identical to SEQ ID NO: 33885

SEQ ID NO: 34751 - RNA, 64 nt, Human; identical to SEQ ID NO: 33886

SEQ ID NO: 34752 - RNA, 64 nt, Human; identical to SEQ ID NO: 33887

SEQ ID NO: 34753 - RNA, 64 nt, Human; identical to SEQ ID NO: 33888

SEQ ID NO: 34754 - RNA, 64 nt, Human; identical to SEQ ID NO: 33889

SEQ ID NO: 34755 - RNA, 64 nt, Human; identical to SEQ ID NO: 33890

SEQ ID NO: 34756 - RNA, 64 nt, Human; identical to SEQ ID NO: 33891

SEQ ID NO: 34757 - RNA, 64 nt, Human; identical to SEQ ID NO: 33892

SEQ ID NO: 34758 - RNA, 64 nt, Human; identical to SEQ ID NO: 33893

SEQ ID NO: 34759 - RNA, 64 nt, Human; identical to SEQ ID NO: 33894

SEQ ID NO: 34760 - RNA, 64 nt, Human; identical to SEQ ID NO: 33895

SEQ ID NO: 34761 - RNA, 64 nt, Human; identical to SEQ ID NO: 33896

SEQ ID NO: 34762 - RNA, 64 nt, Human; identical to SEQ ID NO: 33897

SEQ ID NO: 34763 - RNA, 64 nt, Human; identical to SEQ ID NO: 33898

SEQ ID NO: 34764 - RNA, 64 nt, Human; identical to SEQ ID NO: 33899

SEQ ID NO: 34765 - RNA, 64 nt, Human; identical to SEQ ID NO: 33900

SEQ ID NO: 34766 - RNA, 64 nt, Human; identical to SEQ ID NO: 33901

SEQ ID NO: 34767 - RNA, 64 nt, Human; identical to SEQ ID NO: 33902

SEQ ID NO: 34768 - RNA, 64 nt, Human; identical to SEQ ID NO: 33903

SEQ ID NO: 34769 - RNA, 58 nt, Human; identical to SEQ ID NO: 33904

SEQ ID NO: 34770 - RNA, 64 nt, Human; identical to SEQ ID NO: 33905

SEQ ID NO: 34771 - RNA, 64 nt, Human; identical to SEQ ID NO: 33906

SEQ ID NO: 34772 - RNA, 64 nt, Human; identical to SEQ ID NO: 33907

SEQ ID NO: 34773 - RNA, 64 nt, Human; identical to SEQ ID NO: 33908

SEQ ID NO: 34774 - RNA, 58 nt, Human; identical to SEQ ID NO: 33909

SEQ ID NO: 34775 - RNA, 64 nt, Human; identical to SEQ ID NO: 33910

SEQ ID NO: 34776 - RNA, 64 nt, Human; identical to SEQ ID NO: 33911

SEQ ID NO: 34777 - RNA, 64 nt, Human; identical to SEQ ID NO: 33912

SEQ ID NO: 34778 - RNA, 64 nt, Human; identical to SEQ ID NO: 33913

SEQ ID NO: 34779 - RNA, 64 nt, Human; identical to SEQ ID NO: 33914

SEQ ID NO: 34780 - RNA, 64 nt, Human; identical to SEQ ID NO: 33915

SEQ ID NO: 34781 - RNA, 64 nt, Human; identical to SEQ ID NO: 33916

SEQ ID NO: 34782 - RNA, 64 nt, Human; identical to SEQ ID NO: 33917

SEQ ID NO: 34783 - RNA, 63 nt, Human; identical to SEQ ID NO: 33918

SEQ ID NO: 34784 - RNA, 52 nt, Human; identical to SEQ ID NO: 33919

SEQ ID NO: 34785 - RNA, 63 nt, Human; identical to SEQ ID NO: 33920

SEQ ID NO: 34786 - RNA, 63 nt, Human; identical to SEQ ID NO: 33921

SEQ ID NO: 34787 - RNA, 63 nt, Human; identical to SEQ ID NO: 33922

SEQ ID NO: 34788 - RNA, 63 nt, Human; identical to SEQ ID NO: 33923

SEQ ID NO: 34789 - RNA, 63 nt, Human; identical to SEQ ID NO: 33924

SEQ ID NO: 34790 - RNA, 63 nt, Human; identical to SEQ ID NO: 33925

SEQ ID NO: 34791 - RNA, 63 nt, Human; identical to SEQ ID NO: 33926

SEQ ID NO: 34792 - RNA, 63 nt, Human; identical to SEQ ID NO: 33927

SEQ ID NO: 34793 - RNA, 63 nt, Human; identical to SEQ ID NO: 33928

SEQ ID NO: 34794 - RNA, 63 nt, Human; identical to SEQ ID NO: 33929

SEQ ID NO: 34795 - RNA, 63 nt, Human; identical to SEQ ID NO: 33930

SEQ ID NO: 34796 - RNA, 63 nt, Human; identical to SEQ ID NO: 33931

SEQ ID NO: 34797 - RNA, 63 nt, Human; identical to SEQ ID NO: 33932

SEQ ID NO: 34798 - RNA, 63 nt, Human; identical to SEQ ID NO: 33933

SEQ ID NO: 34799 - RNA, 63 nt, Human; identical to SEQ ID NO: 33934

SEQ ID NO: 34800 - RNA, 63 nt, Human; identical to SEQ ID NO: 33935

SEQ ID NO: 34801 - RNA, 63 nt, Human; identical to SEQ ID NO: 33936

SEQ ID NO: 34802 - RNA, 63 nt, Human; identical to SEQ ID NO: 33937

SEQ ID NO: 34803 - RNA, 63 nt, Human; identical to SEQ ID NO: 33938

SEQ ID NO: 34804 - RNA, 63 nt, Human; identical to SEQ ID NO: 33939

SEQ ID NO: 34805 - RNA, 63 nt, Human; identical to SEQ ID NO: 33940

SEQ ID NO: 34806 - RNA, 63 nt, Human; identical to SEQ ID NO: 33941

SEQ ID NO: 34807 - RNA, 63 nt, Human; identical to SEQ ID NO: 33942

SEQ ID NO: 34808 - RNA, 63 nt, Human; identical to SEQ ID NO: 33943

SEQ ID NO: 34809 - RNA, 63 nt, Human; identical to SEQ ID NO: 33944

SEQ ID NO: 34810 - RNA, 63 nt, Human; identical to SEQ ID NO: 33945

SEQ ID NO: 34811 - RNA, 63 nt, Human; identical to SEQ ID NO: 33946

SEQ ID NO: 34812 - RNA, 63 nt, Human; identical to SEQ ID NO: 33947

SEQ ID NO: 34813 - RNA, 63 nt, Human; identical to SEQ ID NO: 33948

SEQ ID NO: 34814 - RNA, 63 nt, Human; identical to SEQ ID NO: 33949

SEQ ID NO: 34815 - RNA, 63 nt, Human; identical to SEQ ID NO: 33950

SEQ ID NO: 34816 - RNA, 63 nt, Human; identical to SEQ ID NO: 33951

SEQ ID NO: 34817 - RNA, 63 nt, Human; identical to SEQ ID NO: 33952

SEQ ID NO: 34818 - RNA, 63 nt, Human; identical to SEQ ID NO: 33953

SEQ ID NO: 34819 - RNA, 63 nt, Human; identical to SEQ ID NO: 33954

SEQ ID NO: 34820 - RNA, 63 nt, Human; identical to SEQ ID NO: 33955

SEQ ID NO: 34821 - RNA, 63 nt, Human; identical to SEQ ID NO: 33956

SEQ ID NO: 34822 - RNA, 63 nt, Human; identical to SEQ ID NO: 33957

SEQ ID NO: 34823 - RNA, 63 nt, Human; identical to SEQ ID NO: 33958

SEQ ID NO: 34824 - RNA, 63 nt, Human; identical to SEQ ID NO: 33959

SEQ ID NO: 34825 - RNA, 63 nt, Human; identical to SEQ ID NO: 33960

SEQ ID NO: 34826 - RNA, 63 nt, Human; identical to SEQ ID NO: 33961

SEQ ID NO: 34827 - RNA, 63 nt, Human; identical to SEQ ID NO: 33962

SEQ ID NO: 34828 - RNA, 63 nt, Human; identical to SEQ ID NO: 33963

SEQ ID NO: 34829 - RNA, 63 nt, Human; identical to SEQ ID NO: 33964

SEQ ID NO: 34830 - RNA, 63 nt, Human; identical to SEQ ID NO: 33965

SEQ ID NO: 34831 - RNA, 63 nt, Human; identical to SEQ ID NO: 33966

SEQ ID NO: 34832 - RNA, 63 nt, Human; identical to SEQ ID NO: 33967

SEQ ID NO: 34833 - RNA, 63 nt, Human; identical to SEQ ID NO: 33968

SEQ ID NO: 34834 - RNA, 63 nt, Human; identical to SEQ ID NO: 33969

SEQ ID NO: 34835 - RNA, 63 nt, Human; identical to SEQ ID NO: 33970

SEQ ID NO: 34836 - RNA, 63 nt, Human; identical to SEQ ID NO: 33971

SEQ ID NO: 34837 - RNA, 63 nt, Human; identical to SEQ ID NO: 33972

SEQ ID NO: 34838 - RNA, 63 nt, Human; identical to SEQ ID NO: 33973

SEQ ID NO: 34839 - RNA, 63 nt, Human; identical to SEQ ID NO: 33974

SEQ ID NO: 34840 - RNA, 63 nt, Human; identical to SEQ ID NO: 33975

SEQ ID NO: 34841 - RNA, 63 nt, Human; identical to SEQ ID NO: 33976

SEQ ID NO: 34842 - RNA, 63 nt, Human; identical to SEQ ID NO: 33977

SEQ ID NO: 34843 - RNA, 63 nt, Human; identical to SEQ ID NO: 33978

SEQ ID NO: 34844 - RNA, 63 nt, Human; identical to SEQ ID NO: 33979

SEQ ID NO: 34845 - RNA, 63 nt, Human; identical to SEQ ID NO: 33980

SEQ ID NO: 34846 - RNA, 63 nt, Human; identical to SEQ ID NO: 33981

SEQ ID NO: 34847 - RNA, 63 nt, Human; identical to SEQ ID NO: 33982

SEQ ID NO: 34848 - RNA, 63 nt, Human; identical to SEQ ID NO: 33983

SEQ ID NO: 34849 - RNA, 63 nt, Human; identical to SEQ ID NO: 33984

SEQ ID NO: 34850 - RNA, 63 nt, Human; identical to SEQ ID NO: 33985

SEQ ID NO: 34851 - RNA, 63 nt, Human; identical to SEQ ID NO: 33986

SEQ ID NO: 34852 - RNA, 63 nt, Human; identical to SEQ ID NO: 33987

SEQ ID NO: 34853 - RNA, 63 nt, Human; identical to SEQ ID NO: 33988

SEQ ID NO: 34854 - RNA, 63 nt, Human; identical to SEQ ID NO: 33989

SEQ ID NO: 34855 - RNA, 63 nt, Human; identical to SEQ ID NO: 33990

SEQ ID NO: 34856 - RNA, 63 nt, Human; identical to SEQ ID NO: 33991

SEQ ID NO: 34857 - RNA, 63 nt, Human; identical to SEQ ID NO: 33992

SEQ ID NO: 34858 - RNA, 63 nt, Human; identical to SEQ ID NO: 33993

SEQ ID NO: 34859 - RNA, 63 nt, Human; identical to SEQ ID NO: 33994

SEQ ID NO: 34860 - RNA, 63 nt, Human; identical to SEQ ID NO: 33995

SEQ ID NO: 34861 - RNA, 63 nt, Human; identical to SEQ ID NO: 33996

SEQ ID NO: 34862 - RNA, 63 nt, Human; identical to SEQ ID NO: 33997

SEQ ID NO: 34863 - RNA, 63 nt, Human; identical to SEQ ID NO: 33998

SEQ ID NO: 34864 - RNA, 63 nt, Human; identical to SEQ ID NO: 33999

SEQ ID NO: 34865 - RNA, 63 nt, Human; identical to SEQ ID NO: 34000

SEQ ID NO: 34866 - RNA, 63 nt, Human; identical to SEQ ID NO: 34001

SEQ ID NO: 34867 - RNA, 63 nt, Human; identical to SEQ ID NO: 34002

SEQ ID NO: 34868 - RNA, 63 nt, Human; identical to SEQ ID NO: 34003

SEQ ID NO: 34869 - RNA, 63 nt, Human; identical to SEQ ID NO: 34004

SEQ ID NO: 34870 - RNA, 63 nt, Human; identical to SEQ ID NO: 34005

SEQ ID NO: 34871 - RNA, 63 nt, Human; identical to SEQ ID NO: 34006

SEQ ID NO: 34872 - RNA, 63 nt, Human; identical to SEQ ID NO: 34007

SEQ ID NO: 34873 - RNA, 63 nt, Human; identical to SEQ ID NO: 34008

SEQ ID NO: 34874 - RNA, 63 nt, Human; identical to SEQ ID NO: 34009

SEQ ID NO: 34875 - RNA, 63 nt, Human; identical to SEQ ID NO: 34010

SEQ ID NO: 34876 - RNA, 63 nt, Human; identical to SEQ ID NO: 34011

SEQ ID NO: 34877 - RNA, 63 nt, Human; identical to SEQ ID NO: 34012

SEQ ID NO: 34878 - RNA, 63 nt, Human; identical to SEQ ID NO: 34013

SEQ ID NO: 34879 - RNA, 63 nt, Human; identical to SEQ ID NO: 34014

SEQ ID NO: 34880 - RNA, 63 nt, Human; identical to SEQ ID NO: 34015

SEQ ID NO: 34881 - RNA, 63 nt, Human; identical to SEQ ID NO: 34016

SEQ ID NO: 34882 - RNA, 63 nt, Human; identical to SEQ ID NO: 34017

SEQ ID NO: 34883 - RNA, 63 nt, Human; identical to SEQ ID NO: 34018

SEQ ID NO: 34884 - RNA, 63 nt, Human; identical to SEQ ID NO: 34019

SEQ ID NO: 34885 - RNA, 63 nt, Human; identical to SEQ ID NO: 34020

SEQ ID NO: 34886 - RNA, 63 nt, Human; identical to SEQ ID NO: 34021

SEQ ID NO: 34887 - RNA, 63 nt, Human; identical to SEQ ID NO: 34022

SEQ ID NO: 34888 - RNA, 56 nt, Human; identical to SEQ ID NO: 34023

SEQ ID NO: 34889 - RNA, 63 nt, Human; identical to SEQ ID NO: 34024

SEQ ID NO: 34890 - RNA, 63 nt, Human; identical to SEQ ID NO: 34025

SEQ ID NO: 34891 - RNA, 63 nt, Human; identical to SEQ ID NO: 34026

SEQ ID NO: 34892 - RNA, 63 nt, Human; identical to SEQ ID NO: 34027

SEQ ID NO: 34893 - RNA, 63 nt, Human; identical to SEQ ID NO: 34028

SEQ ID NO: 34894 - RNA, 63 nt, Human; identical to SEQ ID NO: 34029

SEQ ID NO: 34895 - RNA, 63 nt, Human; identical to SEQ ID NO: 34030

SEQ ID NO: 34896 - RNA, 63 nt, Human; identical to SEQ ID NO: 34031

SEQ ID NO: 34897 - RNA, 63 nt, Human; identical to SEQ ID NO: 34032

SEQ ID NO: 34898 - RNA, 63 nt, Human; identical to SEQ ID NO: 34033

SEQ ID NO: 34899 - RNA, 63 nt, Human; identical to SEQ ID NO: 34034

SEQ ID NO: 34900 - RNA, 63 nt, Human; identical to SEQ ID NO: 34035

SEQ ID NO: 34901 - RNA, 63 nt, Human; identical to SEQ ID NO: 34036

SEQ ID NO: 34902 - RNA, 63 nt, Human; identical to SEQ ID NO: 34037

SEQ ID NO: 34903 - RNA, 63 nt, Human; identical to SEQ ID NO: 34038

SEQ ID NO: 34904 - RNA, 63 nt, Human; identical to SEQ ID NO: 34039

SEQ ID NO: 34905 - RNA, 63 nt, Human; identical to SEQ ID NO: 34040

SEQ ID NO: 34906 - RNA, 63 nt, Human; identical to SEQ ID NO: 34041

SEQ ID NO: 34907 - RNA, 63 nt, Human; identical to SEQ ID NO: 34042

SEQ ID NO: 34908 - RNA, 63 nt, Human; identical to SEQ ID NO: 34043

SEQ ID NO: 34909 - RNA, 63 nt, Human; identical to SEQ ID NO: 34044

SEQ ID NO: 34910 - RNA, 63 nt, Human; identical to SEQ ID NO: 34045

SEQ ID NO: 34911 - RNA, 63 nt, Human; identical to SEQ ID NO: 34046

SEQ ID NO: 34912 - RNA, 63 nt, Human; identical to SEQ ID NO: 34047

SEQ ID NO: 34913 - RNA, 63 nt, Human; identical to SEQ ID NO: 34048

SEQ ID NO: 34914 - RNA, 63 nt, Human; identical to SEQ ID NO: 34049

SEQ ID NO: 34915 - RNA, 63 nt, Human; identical to SEQ ID NO: 34050

SEQ ID NO: 34916 - RNA, 63 nt, Human; identical to SEQ ID NO: 34051

SEQ ID NO: 34917 - RNA, 63 nt, Human; identical to SEQ ID NO: 34052

SEQ ID NO: 34918 - RNA, 63 nt, Human; identical to SEQ ID NO: 34053

SEQ ID NO: 34919 - RNA, 63 nt, Human; identical to SEQ ID NO: 34054

SEQ ID NO: 34920 - RNA, 63 nt, Human; identical to SEQ ID NO: 34055

SEQ ID NO: 34921 - RNA, 63 nt, Human; identical to SEQ ID NO: 34056

SEQ ID NO: 34922 - RNA, 63 nt, Human; identical to SEQ ID NO: 34057

SEQ ID NO: 34923 - RNA, 63 nt, Human; identical to SEQ ID NO: 34058

SEQ ID NO: 34924 - RNA, 63 nt, Human; identical to SEQ ID NO: 34059

SEQ ID NO: 34925 - RNA, 63 nt, Human; identical to SEQ ID NO: 34060

SEQ ID NO: 34926 - RNA, 63 nt, Human; identical to SEQ ID NO: 34061

SEQ ID NO: 34927 - RNA, 63 nt, Human; identical to SEQ ID NO: 34062

SEQ ID NO: 34928 - RNA, 63 nt, Human; identical to SEQ ID NO: 34063

SEQ ID NO: 34929 - RNA, 63 nt, Human; identical to SEQ ID NO: 34064

SEQ ID NO: 34930 - RNA, 63 nt, Human; identical to SEQ ID NO: 34065

SEQ ID NO: 34931 - RNA, 63 nt, Human; identical to SEQ ID NO: 34066

SEQ ID NO: 34932 - RNA, 63 nt, Human; identical to SEQ ID NO: 34067

SEQ ID NO: 34933 - RNA, 63 nt, Human; identical to SEQ ID NO: 34068

SEQ ID NO: 34934 - RNA, 63 nt, Human; identical to SEQ ID NO: 34069

SEQ ID NO: 34935 - RNA, 63 nt, Human; identical to SEQ ID NO: 34070

SEQ ID NO: 34936 - RNA, 63 nt, Human; identical to SEQ ID NO: 34071

SEQ ID NO: 34937 - RNA, 63 nt, Human; identical to SEQ ID NO: 34072

SEQ ID NO: 34938 - RNA, 63 nt, Human; identical to SEQ ID NO: 34073

SEQ ID NO: 34939 - RNA, 63 nt, Human; identical to SEQ ID NO: 34074

SEQ ID NO: 34940 - RNA, 63 nt, Human; identical to SEQ ID NO: 34075

SEQ ID NO: 34941 - RNA, 63 nt, Human; identical to SEQ ID NO: 34076

SEQ ID NO: 34942 - RNA, 63 nt, Human; identical to SEQ ID NO: 34077

SEQ ID NO: 34943 - RNA, 63 nt, Human; identical to SEQ ID NO: 34078

SEQ ID NO: 34944 - RNA, 63 nt, Human; identical to SEQ ID NO: 34079

SEQ ID NO: 34945 - RNA, 63 nt, Human; identical to SEQ ID NO: 34080

SEQ ID NO: 34946 - RNA, 63 nt, Human; identical to SEQ ID NO: 34081

SEQ ID NO: 34947 - RNA, 63 nt, Human; identical to SEQ ID NO: 34082

SEQ ID NO: 34948 - RNA, 63 nt, Human; identical to SEQ ID NO: 34083

SEQ ID NO: 34949 - RNA, 63 nt, Human; identical to SEQ ID NO: 34084

SEQ ID NO: 34950 - RNA, 63 nt, Human; identical to SEQ ID NO: 34085

SEQ ID NO: 34951 - RNA, 63 nt, Human; identical to SEQ ID NO: 34086

SEQ ID NO: 34952 - RNA, 63 nt, Human; identical to SEQ ID NO: 34087

SEQ ID NO: 34953 - RNA, 63 nt, Human; identical to SEQ ID NO: 34088

SEQ ID NO: 34954 - RNA, 63 nt, Human; identical to SEQ ID NO: 34089

SEQ ID NO: 34955 - RNA, 63 nt, Human; identical to SEQ ID NO: 34090

SEQ ID NO: 34956 - RNA, 63 nt, Human; identical to SEQ ID NO: 34091

SEQ ID NO: 34957 - RNA, 63 nt, Human; identical to SEQ ID NO: 34092

SEQ ID NO: 34958 - RNA, 63 nt, Human; identical to SEQ ID NO: 34093

SEQ ID NO: 34959 - RNA, 63 nt, Human; identical to SEQ ID NO: 34094

SEQ ID NO: 34960 - RNA, 63 nt, Human; identical to SEQ ID NO: 34095

SEQ ID NO: 34961 - RNA, 63 nt, Human; identical to SEQ ID NO: 34096

SEQ ID NO: 34962 - RNA, 63 nt, Human; identical to SEQ ID NO: 34097

SEQ ID NO: 34963 - RNA, 63 nt, Human; identical to SEQ ID NO: 34098

SEQ ID NO: 34964 - RNA, 63 nt, Human; identical to SEQ ID NO: 34099

SEQ ID NO: 34965 - RNA, 63 nt, Human; identical to SEQ ID NO: 34100

SEQ ID NO: 34966 - RNA, 63 nt, Human; identical to SEQ ID NO: 34101

SEQ ID NO: 34967 - RNA, 63 nt, Human; identical to SEQ ID NO: 34102

SEQ ID NO: 34968 - RNA, 63 nt, Human; identical to SEQ ID NO: 34103

SEQ ID NO: 34969 - RNA, 63 nt, Human; identical to SEQ ID NO: 34104

SEQ ID NO: 34970 - RNA, 63 nt, Human; identical to SEQ ID NO: 34105

SEQ ID NO: 34971 - RNA, 63 nt, Human; identical to SEQ ID NO: 34106

SEQ ID NO: 34972 - RNA, 63 nt, Human; identical to SEQ ID NO: 34107

SEQ ID NO: 34973 - RNA, 63 nt, Human; identical to SEQ ID NO: 34108

SEQ ID NO: 34974 - RNA, 63 nt, Human; identical to SEQ ID NO: 34109

SEQ ID NO: 34975 - RNA, 63 nt, Human; identical to SEQ ID NO: 34110

SEQ ID NO: 34976 - RNA, 63 nt, Human; identical to SEQ ID NO: 34111

SEQ ID NO: 34977 - RNA, 63 nt, Human; identical to SEQ ID NO: 34112

SEQ ID NO: 34978 - RNA, 63 nt, Human; identical to SEQ ID NO: 34113

SEQ ID NO: 34979 - RNA, 63 nt, Human; identical to SEQ ID NO: 34114

SEQ ID NO: 34980 - RNA, 63 nt, Human; identical to SEQ ID NO: 34115

SEQ ID NO: 34981 - RNA, 63 nt, Human; identical to SEQ ID NO: 34116

SEQ ID NO: 34982 - RNA, 63 nt, Human; identical to SEQ ID NO: 34117

SEQ ID NO: 34983 - RNA, 63 nt, Human; identical to SEQ ID NO: 34118

SEQ ID NO: 34984 - RNA, 63 nt, Human; identical to SEQ ID NO: 34119

SEQ ID NO: 34985 - RNA, 63 nt, Human; identical to SEQ ID NO: 34120

SEQ ID NO: 34986 - RNA, 63 nt, Human; identical to SEQ ID NO: 34121

SEQ ID NO: 34987 - RNA, 63 nt, Human; identical to SEQ ID NO: 34122

SEQ ID NO: 34988 - RNA, 63 nt, Human; identical to SEQ ID NO: 34123

SEQ ID NO: 34989 - RNA, 63 nt, Human; identical to SEQ ID NO: 34124

SEQ ID NO: 34990 - RNA, 63 nt, Human; identical to SEQ ID NO: 34125

SEQ ID NO: 34991 - RNA, 63 nt, Human; identical to SEQ ID NO: 34126

SEQ ID NO: 34992 - RNA, 63 nt, Human; identical to SEQ ID NO: 34127

SEQ ID NO: 34993 - RNA, 63 nt, Human; identical to SEQ ID NO: 34128

SEQ ID NO: 34994 - RNA, 63 nt, Human; identical to SEQ ID NO: 34129

SEQ ID NO: 34995 - RNA, 63 nt, Human; identical to SEQ ID NO: 34130

SEQ ID NO: 34996 - RNA, 63 nt, Human; identical to SEQ ID NO: 34131

SEQ ID NO: 34997 - RNA, 63 nt, Human; identical to SEQ ID NO: 34132

SEQ ID NO: 34998 - RNA, 63 nt, Human; identical to SEQ ID NO: 34133

SEQ ID NO: 34999 - RNA, 63 nt, Human; identical to SEQ ID NO: 34134

SEQ ID NO: 35000 - RNA, 63 nt, Human; identical to SEQ ID NO: 34135

SEQ ID NO: 35001 - RNA, 63 nt, Human; identical to SEQ ID NO: 34136

SEQ ID NO: 35002 - RNA, 63 nt, Human; identical to SEQ ID NO: 34137

SEQ ID NO: 35003 - RNA, 63 nt, Human; identical to SEQ ID NO: 34138

SEQ ID NO: 35004 - RNA, 63 nt, Human; identical to SEQ ID NO: 34139

SEQ ID NO: 35005 - RNA, 63 nt, Human; identical to SEQ ID NO: 34140

SEQ ID NO: 35006 - RNA, 63 nt, Human; identical to SEQ ID NO: 34141

SEQ ID NO: 35007 - RNA, 63 nt, Human; identical to SEQ ID NO: 34142

SEQ ID NO: 35008 - RNA, 63 nt, Human; identical to SEQ ID NO: 34143

SEQ ID NO: 35009 - RNA, 63 nt, Human; identical to SEQ ID NO: 34144

SEQ ID NO: 35010 - RNA, 63 nt, Human; identical to SEQ ID NO: 34145

SEQ ID NO: 35011 - RNA, 63 nt, Human; identical to SEQ ID NO: 34146

SEQ ID NO: 35012 - RNA, 63 nt, Human; identical to SEQ ID NO: 34147

SEQ ID NO: 35013 - RNA, 63 nt, Human; identical to SEQ ID NO: 34148

SEQ ID NO: 35014 - RNA, 63 nt, Human; identical to SEQ ID NO: 34149

SEQ ID NO: 35015 - RNA, 63 nt, Human; identical to SEQ ID NO: 34150

SEQ ID NO: 35016 - RNA, 63 nt, Human; identical to SEQ ID NO: 34151

SEQ ID NO: 35017 - RNA, 63 nt, Human; identical to SEQ ID NO: 34152

SEQ ID NO: 35018 - RNA, 63 nt, Human; identical to SEQ ID NO: 34153

SEQ ID NO: 35019 - RNA, 63 nt, Human; identical to SEQ ID NO: 34154

SEQ ID NO: 35020 - RNA, 63 nt, Human; identical to SEQ ID NO: 34155

SEQ ID NO: 35021 - RNA, 63 nt, Human; identical to SEQ ID NO: 34156

SEQ ID NO: 35022 - RNA, 63 nt, Human; identical to SEQ ID NO: 34157

SEQ ID NO: 35023 - RNA, 63 nt, Human; identical to SEQ ID NO: 34158

SEQ ID NO: 35024 - RNA, 63 nt, Human; identical to SEQ ID NO: 34159

SEQ ID NO: 35025 - RNA, 51 nt, Human; identical to SEQ ID NO: 34160

SEQ ID NO: 35026 - RNA, 63 nt, Human; identical to SEQ ID NO: 34161

SEQ ID NO: 35027 - RNA, 63 nt, Human; identical to SEQ ID NO: 34162

SEQ ID NO: 35028 - RNA, 63 nt, Human; identical to SEQ ID NO: 34163

SEQ ID NO: 35029 - RNA, 63 nt, Human; identical to SEQ ID NO: 34164

SEQ ID NO: 35030 - RNA, 63 nt, Human; identical to SEQ ID NO: 34165

SEQ ID NO: 35031 - RNA, 63 nt, Human; identical to SEQ ID NO: 34166

SEQ ID NO: 35032 - RNA, 63 nt, Human; identical to SEQ ID NO: 34167

SEQ ID NO: 35033 - RNA, 63 nt, Human; identical to SEQ ID NO: 34168

SEQ ID NO: 35034 - RNA, 63 nt, Human; identical to SEQ ID NO: 34169

SEQ ID NO: 35035 - RNA, 63 nt, Human; identical to SEQ ID NO: 34170

SEQ ID NO: 35036 - RNA, 63 nt, Human; identical to SEQ ID NO: 34171

SEQ ID NO: 35037 - RNA, 63 nt, Human; identical to SEQ ID NO: 34172

SEQ ID NO: 35038 - RNA, 63 nt, Human; identical to SEQ ID NO: 34173

SEQ ID NO: 35039 - RNA, 63 nt, Human; identical to SEQ ID NO: 34174

SEQ ID NO: 35040 - RNA, 63 nt, Human; identical to SEQ ID NO: 34175

SEQ ID NO: 35041 - RNA, 63 nt, Human; identical to SEQ ID NO: 34176

SEQ ID NO: 35042 - RNA, 63 nt, Human; identical to SEQ ID NO: 34177

SEQ ID NO: 35043 - RNA, 63 nt, Human; identical to SEQ ID NO: 34178

SEQ ID NO: 35044 - RNA, 63 nt, Human; identical to SEQ ID NO: 34179

SEQ ID NO: 35045 - RNA, 63 nt, Human; identical to SEQ ID NO: 34180

SEQ ID NO: 35046 - RNA, 63 nt, Human; identical to SEQ ID NO: 34181

SEQ ID NO: 35047 - RNA, 63 nt, Human; identical to SEQ ID NO: 34182

SEQ ID NO: 35048 - RNA, 63 nt, Human; identical to SEQ ID NO: 34183

SEQ ID NO: 35049 - RNA, 63 nt, Human; identical to SEQ ID NO: 34184

SEQ ID NO: 35050 - RNA, 63 nt, Human; identical to SEQ ID NO: 34185

SEQ ID NO: 35051 - RNA, 63 nt, Human; identical to SEQ ID NO: 34186

SEQ ID NO: 35052 - RNA, 63 nt, Human; identical to SEQ ID NO: 34187

SEQ ID NO: 35053 - RNA, 63 nt, Human; identical to SEQ ID NO: 34188

SEQ ID NO: 35054 - RNA, 63 nt, Human; identical to SEQ ID NO: 34189

SEQ ID NO: 35055 - RNA, 63 nt, Human; identical to SEQ ID NO: 34190

SEQ ID NO: 35056 - RNA, 63 nt, Human; identical to SEQ ID NO: 34191

SEQ ID NO: 35057 - RNA, 63 nt, Human; identical to SEQ ID NO: 34192

SEQ ID NO: 35058 - RNA, 63 nt, Human; identical to SEQ ID NO: 34193

SEQ ID NO: 35059 - RNA, 63 nt, Human; identical to SEQ ID NO: 34194

SEQ ID NO: 35060 - RNA, 63 nt, Human; identical to SEQ ID NO: 34195

SEQ ID NO: 35061 - RNA, 63 nt, Human; identical to SEQ ID NO: 34196

SEQ ID NO: 35062 - RNA, 63 nt, Human; identical to SEQ ID NO: 34197

SEQ ID NO: 35063 - RNA, 63 nt, Human; identical to SEQ ID NO: 34198

SEQ ID NO: 35064 - RNA, 63 nt, Human; identical to SEQ ID NO: 34199

SEQ ID NO: 35065 - RNA, 63 nt, Human; identical to SEQ ID NO: 34200

SEQ ID NO: 35066 - RNA, 63 nt, Human; identical to SEQ ID NO: 34201

SEQ ID NO: 35067 - RNA, 63 nt, Human; identical to SEQ ID NO: 34202

SEQ ID NO: 35068 - RNA, 63 nt, Human; identical to SEQ ID NO: 34203

SEQ ID NO: 35069 - RNA, 63 nt, Human; identical to SEQ ID NO: 34204

SEQ ID NO: 35070 - RNA, 63 nt, Human; identical to SEQ ID NO: 34205

SEQ ID NO: 35071 - RNA, 63 nt, Human; identical to SEQ ID NO: 34206

SEQ ID NO: 35072 - RNA, 63 nt, Human; identical to SEQ ID NO: 34207

SEQ ID NO: 35073 - RNA, 63 nt, Human; identical to SEQ ID NO: 34208

SEQ ID NO: 35074 - RNA, 63 nt, Human; identical to SEQ ID NO: 34209

SEQ ID NO: 35075 - RNA, 63 nt, Human; identical to SEQ ID NO: 34210

SEQ ID NO: 35076 - RNA, 63 nt, Human; identical to SEQ ID NO: 34211

SEQ ID NO: 35077 - RNA, 63 nt, Human; identical to SEQ ID NO: 34212

SEQ ID NO: 35078 - RNA, 63 nt, Human; identical to SEQ ID NO: 34213

SEQ ID NO: 35079 - RNA, 63 nt, Human; identical to SEQ ID NO: 34214

SEQ ID NO: 35080 - RNA, 63 nt, Human; identical to SEQ ID NO: 34215

SEQ ID NO: 35081 - RNA, 63 nt, Human; identical to SEQ ID NO: 34216

SEQ ID NO: 35082 - RNA, 63 nt, Human; identical to SEQ ID NO: 34217

SEQ ID NO: 35083 - RNA, 63 nt, Human; identical to SEQ ID NO: 34218

SEQ ID NO: 35084 - RNA, 63 nt, Human; identical to SEQ ID NO: 34219

SEQ ID NO: 35085 - RNA, 63 nt, Human; identical to SEQ ID NO: 34220

SEQ ID NO: 35086 - RNA, 63 nt, Human; identical to SEQ ID NO: 34221

SEQ ID NO: 35087 - RNA, 63 nt, Human; identical to SEQ ID NO: 34222

SEQ ID NO: 35088 - RNA, 63 nt, Human; identical to SEQ ID NO: 34223

SEQ ID NO: 35089 - RNA, 63 nt, Human; identical to SEQ ID NO: 34224

SEQ ID NO: 35090 - RNA, 50 nt, Human; identical to SEQ ID NO: 34225

SEQ ID NO: 35091 - RNA, 63 nt, Human; identical to SEQ ID NO: 34226

SEQ ID NO: 35092 - RNA, 63 nt, Human; identical to SEQ ID NO: 34227

SEQ ID NO: 35093 - RNA, 63 nt, Human; identical to SEQ ID NO: 34228

SEQ ID NO: 35094 - RNA, 63 nt, Human; identical to SEQ ID NO: 34229

SEQ ID NO: 35095 - RNA, 63 nt, Human; identical to SEQ ID NO: 34230

SEQ ID NO: 35096 - RNA, 63 nt, Human; identical to SEQ ID NO: 34231

SEQ ID NO: 35097 - RNA, 63 nt, Human; identical to SEQ ID NO: 34232

SEQ ID NO: 35098 - RNA, 63 nt, Human; identical to SEQ ID NO: 34233

SEQ ID NO: 35099 - RNA, 63 nt, Human; identical to SEQ ID NO: 34234

SEQ ID NO: 35100 - RNA, 63 nt, Human; identical to SEQ ID NO: 34235

SEQ ID NO: 35101 - RNA, 63 nt, Human; identical to SEQ ID NO: 34236

SEQ ID NO: 35102 - RNA, 63 nt, Human; identical to SEQ ID NO: 34237

SEQ ID NO: 35103 - RNA, 63 nt, Human; identical to SEQ ID NO: 34238

SEQ ID NO: 35104 - RNA, 63 nt, Human; identical to SEQ ID NO: 34239

SEQ ID NO: 35105 - RNA, 63 nt, Human; identical to SEQ ID NO: 34240

SEQ ID NO: 35106 - RNA, 63 nt, Human; identical to SEQ ID NO: 34241

SEQ ID NO: 35107 - RNA, 63 nt, Human; identical to SEQ ID NO: 34242

SEQ ID NO: 35108 - RNA, 63 nt, Human; identical to SEQ ID NO: 34243

SEQ ID NO: 35109 - RNA, 63 nt, Human; identical to SEQ ID NO: 34244

SEQ ID NO: 35110 - RNA, 63 nt, Human; identical to SEQ ID NO: 34245

SEQ ID NO: 35111 - RNA, 63 nt, Human; identical to SEQ ID NO: 34246

SEQ ID NO: 35112 - RNA, 63 nt, Human; identical to SEQ ID NO: 34247

SEQ ID NO: 35113 - RNA, 63 nt, Human; identical to SEQ ID NO: 34248

SEQ ID NO: 35114 - RNA, 63 nt, Human; identical to SEQ ID NO: 34249

SEQ ID NO: 35115 - RNA, 63 nt, Human; identical to SEQ ID NO: 34250

SEQ ID NO: 35116 - RNA, 63 nt, Human; identical to SEQ ID NO: 34251

SEQ ID NO: 35117 - RNA, 63 nt, Human; identical to SEQ ID NO: 34252

SEQ ID NO: 35118 - RNA, 63 nt, Human; identical to SEQ ID NO: 34253

SEQ ID NO: 35119 - RNA, 63 nt, Human; identical to SEQ ID NO: 34254

SEQ ID NO: 35120 - RNA, 63 nt, Human; identical to SEQ ID NO: 34255

SEQ ID NO: 35121 - RNA, 63 nt, Human; identical to SEQ ID NO: 34256

SEQ ID NO: 35122 - RNA, 63 nt, Human; identical to SEQ ID NO: 34257

SEQ ID NO: 35123 - RNA, 63 nt, Human; identical to SEQ ID NO: 34258

SEQ ID NO: 35124 - RNA, 63 nt, Human; identical to SEQ ID NO: 34259

SEQ ID NO: 35125 - RNA, 63 nt, Human; identical to SEQ ID NO: 34260

SEQ ID NO: 35126 - RNA, 63 nt, Human; identical to SEQ ID NO: 34261

SEQ ID NO: 35127 - RNA, 63 nt, Human; identical to SEQ ID NO: 34262

SEQ ID NO: 35128 - RNA, 63 nt, Human; identical to SEQ ID NO: 34263

SEQ ID NO: 35129 - RNA, 63 nt, Human; identical to SEQ ID NO: 34264

SEQ ID NO: 35130 - RNA, 63 nt, Human; identical to SEQ ID NO: 34265

SEQ ID NO: 35131 - RNA, 63 nt, Human; identical to SEQ ID NO: 34266

SEQ ID NO: 35132 - RNA, 63 nt, Human; identical to SEQ ID NO: 34267

SEQ ID NO: 35133 - RNA, 63 nt, Human; identical to SEQ ID NO: 34268

SEQ ID NO: 35134 - RNA, 63 nt, Human; identical to SEQ ID NO: 34269

SEQ ID NO: 35135 - RNA, 63 nt, Human; identical to SEQ ID NO: 34270

SEQ ID NO: 35136 - RNA, 63 nt, Human; identical to SEQ ID NO: 34271

SEQ ID NO: 35137 - RNA, 63 nt, Human; identical to SEQ ID NO: 34272

SEQ ID NO: 35138 - RNA, 63 nt, Human; identical to SEQ ID NO: 34273

SEQ ID NO: 35139 - RNA, 63 nt, Human; identical to SEQ ID NO: 34274

SEQ ID NO: 35140 - RNA, 51 nt, Human; identical to SEQ ID NO: 34275

SEQ ID NO: 35141 - RNA, 63 nt, Human; identical to SEQ ID NO: 34276

SEQ ID NO: 35142 - RNA, 63 nt, Human; identical to SEQ ID NO: 34277

SEQ ID NO: 35143 - RNA, 63 nt, Human; identical to SEQ ID NO: 34278

SEQ ID NO: 35144 - RNA, 63 nt, Human; identical to SEQ ID NO: 34279

SEQ ID NO: 35145 - RNA, 63 nt, Human; identical to SEQ ID NO: 34280

SEQ ID NO: 35146 - RNA, 63 nt, Human; identical to SEQ ID NO: 34281

SEQ ID NO: 35147 - RNA, 63 nt, Human; identical to SEQ ID NO: 34282

SEQ ID NO: 35148 - RNA, 63 nt, Human; identical to SEQ ID NO: 34283

SEQ ID NO: 35149 - RNA, 63 nt, Human; identical to SEQ ID NO: 34284

SEQ ID NO: 35150 - RNA, 63 nt, Human; identical to SEQ ID NO: 34285

SEQ ID NO: 35151 - RNA, 63 nt, Human; identical to SEQ ID NO: 34286

SEQ ID NO: 35152 - RNA, 63 nt, Human; identical to SEQ ID NO: 34287

SEQ ID NO: 35153 - RNA, 63 nt, Human; identical to SEQ ID NO: 34288

SEQ ID NO: 35154 - RNA, 63 nt, Human; identical to SEQ ID NO: 34289

SEQ ID NO: 35155 - RNA, 63 nt, Human; identical to SEQ ID NO: 34290

SEQ ID NO: 35156 - RNA, 63 nt, Human; identical to SEQ ID NO: 34291

SEQ ID NO: 35157 - RNA, 63 nt, Human; identical to SEQ ID NO: 34292

SEQ ID NO: 35158 - RNA, 63 nt, Human; identical to SEQ ID NO: 34293

SEQ ID NO: 35159 - RNA, 63 nt, Human; identical to SEQ ID NO: 34294

SEQ ID NO: 35160 - RNA, 61 nt, Human; identical to SEQ ID NO: 34295

SEQ ID NO: 35161 - RNA, 63 nt, Human; identical to SEQ ID NO: 34296

SEQ ID NO: 35162 - RNA, 63 nt, Human; identical to SEQ ID NO: 34297

SEQ ID NO: 35163 - RNA, 63 nt, Human; identical to SEQ ID NO: 34298

SEQ ID NO: 35164 - RNA, 63 nt, Human; identical to SEQ ID NO: 34299

SEQ ID NO: 35165 - RNA, 63 nt, Human; identical to SEQ ID NO: 34300

SEQ ID NO: 35166 - RNA, 63 nt, Human; identical to SEQ ID NO: 34301

SEQ ID NO: 35167 - RNA, 63 nt, Human; identical to SEQ ID NO: 34302

SEQ ID NO: 35168 - RNA, 63 nt, Human; identical to SEQ ID NO: 34303

SEQ ID NO: 35169 - RNA, 63 nt, Human; identical to SEQ ID NO: 34304

SEQ ID NO: 35170 - RNA, 63 nt, Human; identical to SEQ ID NO: 34305

SEQ ID NO: 35171 - RNA, 63 nt, Human; identical to SEQ ID NO: 34306

SEQ ID NO: 35172 - RNA, 63 nt, Human; identical to SEQ ID NO: 34307

SEQ ID NO: 35173 - RNA, 63 nt, Human; identical to SEQ ID NO: 34308

SEQ ID NO: 35174 - RNA, 63 nt, Human; identical to SEQ ID NO: 34309

SEQ ID NO: 35175 - RNA, 63 nt, Human; identical to SEQ ID NO: 34310

SEQ ID NO: 35176 - RNA, 63 nt, Human; identical to SEQ ID NO: 34311

SEQ ID NO: 35177 - RNA, 63 nt, Human; identical to SEQ ID NO: 34312

SEQ ID NO: 35178 - RNA, 63 nt, Human; identical to SEQ ID NO: 34313

SEQ ID NO: 35179 - RNA, 63 nt, Human; identical to SEQ ID NO: 34314

SEQ ID NO: 35180 - RNA, 63 nt, Human; identical to SEQ ID NO: 34315

SEQ ID NO: 35181 - RNA, 63 nt, Human; identical to SEQ ID NO: 34316

SEQ ID NO: 35182 - RNA, 63 nt, Human; identical to SEQ ID NO: 34317

SEQ ID NO: 35183 - RNA, 63 nt, Human; identical to SEQ ID NO: 34318

SEQ ID NO: 35184 - RNA, 63 nt, Human; identical to SEQ ID NO: 34319

SEQ ID NO: 35185 - RNA, 63 nt, Human; identical to SEQ ID NO: 34320

SEQ ID NO: 35186 - RNA, 57 nt, Human; identical to SEQ ID NO: 34321

SEQ ID NO: 35187 - RNA, 63 nt, Human; identical to SEQ ID NO: 34322

SEQ ID NO: 35188 - RNA, 63 nt, Human; identical to SEQ ID NO: 34323

SEQ ID NO: 35189 - RNA, 63 nt, Human; identical to SEQ ID NO: 34324

SEQ ID NO: 35190 - RNA, 63 nt, Human; identical to SEQ ID NO: 34325

SEQ ID NO: 35191 - RNA, 63 nt, Human; identical to SEQ ID NO: 34326

SEQ ID NO: 35192 - RNA, 63 nt, Human; identical to SEQ ID NO: 34327

SEQ ID NO: 35193 - RNA, 63 nt, Human; identical to SEQ ID NO: 34328

SEQ ID NO: 35194 - RNA, 63 nt, Human; identical to SEQ ID NO: 34329

SEQ ID NO: 35195 - RNA, 63 nt, Human; identical to SEQ ID NO: 34330

SEQ ID NO: 35196 - RNA, 58 nt, Human; identical to SEQ ID NO: 34331

SEQ ID NO: 35197 - RNA, 63 nt, Human; identical to SEQ ID NO: 34332

SEQ ID NO: 35198 - RNA, 63 nt, Human; identical to SEQ ID NO: 34333

SEQ ID NO: 35199 - RNA, 63 nt, Human; identical to SEQ ID NO: 34334

SEQ ID NO: 35200 - RNA, 63 nt, Human; identical to SEQ ID NO: 34335

SEQ ID NO: 35201 - RNA, 63 nt, Human; identical to SEQ ID NO: 34336

SEQ ID NO: 35202 - RNA, 63 nt, Human; identical to SEQ ID NO: 34337

SEQ ID NO: 35203 - RNA, 63 nt, Human; identical to SEQ ID NO: 34338

SEQ ID NO: 35204 - RNA, 63 nt, Human; identical to SEQ ID NO: 34339

SEQ ID NO: 35205 - RNA, 63 nt, Human; identical to SEQ ID NO: 34340

SEQ ID NO: 35206 - RNA, 63 nt, Human; identical to SEQ ID NO: 34341

SEQ ID NO: 35207 - RNA, 63 nt, Human; identical to SEQ ID NO: 34342

SEQ ID NO: 35208 - RNA, 63 nt, Human; identical to SEQ ID NO: 34343

SEQ ID NO: 35209 - RNA, 63 nt, Human; identical to SEQ ID NO: 34344

SEQ ID NO: 35210 - RNA, 63 nt, Human; identical to SEQ ID NO: 34345

SEQ ID NO: 35211 - RNA, 63 nt, Human; identical to SEQ ID NO: 34346

SEQ ID NO: 35212 - RNA, 63 nt, Human; identical to SEQ ID NO: 34347

SEQ ID NO: 35213 - RNA, 63 nt, Human; identical to SEQ ID NO: 34348

SEQ ID NO: 35214 - RNA, 63 nt, Human; identical to SEQ ID NO: 34349

SEQ ID NO: 35215 - RNA, 63 nt, Human; identical to SEQ ID NO: 34350

SEQ ID NO: 35216 - RNA, 63 nt, Human; identical to SEQ ID NO: 34351

SEQ ID NO: 35217 - RNA, 63 nt, Human; identical to SEQ ID NO: 34352

SEQ ID NO: 35218 - RNA, 63 nt, Human; identical to SEQ ID NO: 34353

SEQ ID NO: 35219 - RNA, 63 nt, Human; identical to SEQ ID NO: 34354

SEQ ID NO: 35220 - RNA, 63 nt, Human; identical to SEQ ID NO: 34355

SEQ ID NO: 35221 - RNA, 63 nt, Human; identical to SEQ ID NO: 34356

SEQ ID NO: 35222 - RNA, 63 nt, Human; identical to SEQ ID NO: 34357

SEQ ID NO: 35223 - RNA, 63 nt, Human; identical to SEQ ID NO: 34358

SEQ ID NO: 35224 - RNA, 63 nt, Human; identical to SEQ ID NO: 34359

SEQ ID NO: 35225 - RNA, 63 nt, Human; identical to SEQ ID NO: 34360

SEQ ID NO: 35226 - RNA, 62 nt, Human; identical to SEQ ID NO: 34361

SEQ ID NO: 35227 - RNA, 63 nt, Human; identical to SEQ ID NO: 34362

SEQ ID NO: 35228 - RNA, 63 nt, Human; identical to SEQ ID NO: 34363

SEQ ID NO: 35229 - RNA, 63 nt, Human; identical to SEQ ID NO: 34364

SEQ ID NO: 35230 - RNA, 63 nt, Human; identical to SEQ ID NO: 34365

SEQ ID NO: 35231 - RNA, 63 nt, Human; identical to SEQ ID NO: 34366

SEQ ID NO: 35232 - RNA, 63 nt, Human; identical to SEQ ID NO: 34367

SEQ ID NO: 35233 - RNA, 63 nt, Human; identical to SEQ ID NO: 34368

SEQ ID NO: 35234 - RNA, 63 nt, Human; identical to SEQ ID NO: 34369

SEQ ID NO: 35235 - RNA, 63 nt, Human; identical to SEQ ID NO: 34370

SEQ ID NO: 35236 - RNA, 63 nt, Human; identical to SEQ ID NO: 34371

SEQ ID NO: 35237 - RNA, 63 nt, Human; identical to SEQ ID NO: 34372

SEQ ID NO: 35238 - RNA, 63 nt, Human; identical to SEQ ID NO: 34373

SEQ ID NO: 35239 - RNA, 63 nt, Human; identical to SEQ ID NO: 34374

SEQ ID NO: 35240 - RNA, 63 nt, Human; identical to SEQ ID NO: 34375

SEQ ID NO: 35241 - RNA, 64 nt, Human
cuagugacccggaggccacaugagucccagugggaggcgcgagccaugauguggaguggggcag

SEQ ID NO: 35242 - RNA, 64 nt, Human
acaucuuguauaacuuagggagcgaagaaaauguaggcgcgaaagugaaaagugaggcagcuag

SEQ ID NO: 35243 - RNA, 64 nt, Human
cgugugccaguaaucccagcuacuugggaggcugaggcgcgagaaucgcuugaacccuggagau

SEQ ID NO: 35244 - RNA, 64 nt, Human
ccgcccaccuuggccucccaagugcugggauuacaggcgcgagccacggcgcccagccuugaaa

SEQ ID NO: 35245 - RNA, 64 nt, Human
uucuuuuaaaauuaauuuugguugguguugggggaggcgcgagugcgugugagaagaaccgacc

SEQ ID NO: 35246 - RNA, 64 nt, Human
uacagauuggguuuaccgaaguauaaucuauaggaggcgcgauggcaaguugauaaaaugugac

SEQ ID NO: 35247 - RNA, 64 nt, Human
uccgcuggaggcccggugugguuccgccucggcgaggcgcgagacaggcgcugcugcucacgug

SEQ ID NO: 35248 - RNA, 64 nt, Human
cacccgccuuggccucccaaagugcugggauuacaggcgcgagccaccgcgcccagccuacacc

SEQ ID NO: 35249 - RNA, 64 nt, Human
ugcgaggccaaguugcccacccugcggagcuaggaggcgcgagcagagaacguguguguuagga

SEQ ID NO: 35250 - RNA, 64 nt, Human
cacccgccucggccucccaaaauccugggauuacaggcgcgagccaccacacccggcuggaagu

SEQ ID NO: 35251 - RNA, 64 nt, Human
auagaucgcguuagccaguuuuaccagcgcagcuaggcgcgauggcugucgccuguaaugccag

SEQ ID NO: 35252 - RNA, 64 nt, Human
ugagcacagccuggagccugugcccagggccgacaggcgcgacacccagcaaggccaccucucc

SEQ ID NO: 35253 - RNA, 64 nt, Human
ggcuacgggacgaggguggcgggugaccaagugcaggcgcgacgggucagggaccgggccgggc

SEQ ID NO: 35254 - RNA, 64 nt, Human
uuuauguuaagaagauugggccaggugggauuacaggcgcgagccaccgcgcccggccccuaag

SEQ ID NO: 35255 - RNA, 64 nt, Human
cuguccuuggaggggacaagguugacugcuuaggaggcgcgacgcacagggcugccaggccugg

SEQ ID NO: 35256 - RNA, 64 nt, Human
ugggagacuccgcccugccggguccccaccagggaggcgcgaccccuugugggucuuugucugg

SEQ ID NO: 35257 - RNA, 64 nt, Human
cgcaccgaacccaggcggucggagcccggcggggaggcgcgagguccuucugggggcuccuccg

SEQ ID NO: 35258 - RNA, 64 nt, Human
uguuacccaugcuggagugcaguggcacaaucuuggcucagagcaaccucugccucccaggcuc

SEQ ID NO: 35259 - RNA, 64 nt, Human
uacauggcugugggcaacuauaagccaaauauuuggcucagaacagguguccaugggacaaaaa

SEQ ID NO: 35260 - RNA, 64 nt, Human
gggccuuucuuucaucccaaaugacaaggaauguggcucagagaaggguuuuucuuuuuugacc

SEQ ID NO: 35261 - RNA, 64 nt, Human
agaagugacuugagcauuucucugucugauuugaggcucagaccccucccugcccuucagagcu

SEQ ID NO: 35262 - RNA, 64 nt, Human
uuucugcucucuaugcuugagaccgggagguuuaggcucagauaagugagcucugggccaugag

SEQ ID NO: 35263 - RNA, 64 nt, Human
aacugagcgauuaaccugugaacuuccuucuccuggcucagaagcuuccccacugagcaccuug

SEQ ID NO: 35264 - RNA, 64 nt, Human
ugucuggcuguuuugucaacucucauccacugguggcucagagccauaagguggguugauuaca

SEQ ID NO: 35265 - RNA, 64 nt, Human
uauuuaggaauagaucugacuuuaauaaaaacauggcucagaaucuacaggucaaauuaauuug

SEQ ID NO: 35266 - RNA, 64 nt, Human
ggcggagggugggagcaggugugccagggcucagggcucagacuugggagggccuaggcagaag

SEQ ID NO: 35267 - RNA, 64 nt, Human
gacacccucacgaagggucgcaagucacucuuguggcucagauugcucuuaggaccuggaggga

SEQ ID NO: 35268 - RNA, 64 nt, Human
aguccuuuuuggcaucuaaccuccuguggauaagggcucagaauagcaccauugcugguuugua

SEQ ID NO: 35269 - RNA, 64 nt, Human
cuucaagagacuugcauaaaagcagagguuugggggcucagaugggacaagaagccgccucugg

SEQ ID NO: 35270 - RNA, 64 nt, Human
gcucuguagauaaugcauaagaagcaccaagucaggcucagaugcaacuaaaacacaucuuuga

SEQ ID NO: 35271 - RNA, 64 nt, Human
uuuuccccacguguaucugaacauuaagcagauuggcucagacacaaugaaaaggauaauccaa

SEQ ID NO: 35272 - RNA, 64 nt, Human
gcauccauggggcuuauaugagacaugaagcauuggcucagaaguagagggagaagaggaaccc

SEQ ID NO: 35273 - RNA, 64 nt, Human
cuaaacccuauccuaagcuccaguuccauggcaaggcucagacuuuuaaugccaucuuaaucug

SEQ ID NO: 35274 - RNA, 64 nt, Human
ccuagccuucgggcaccuccagggccagagagcaggcucagagcagcuaguguggagcucagca

SEQ ID NO: 35275 - RNA, 64 nt, Human
gaugcucaggguaaggagcaccaaagcugaggcuggcucagagaucuccagagaagcugcagcc

SEQ ID NO: 35276 - RNA, 64 nt, Human
cggagaagcuggaaagugugaaugcugaacugaaggcucagauugaggagcucaagaacgagaa

SEQ ID NO: 35277 - RNA, 64 nt, Human
ugcucaaccuucaucggcccacguguauuguccgggcucagaaugggaggacuccagaagauga

SEQ ID NO: 35278 - RNA, 64 nt, Human
ccacacugccaggggagccucacugugaagucuaggcucagacaggcaucaacaaaccuauuca

SEQ ID NO: 35279 - RNA, 64 nt, Human
uuucauuacgugaauggaacuuaccuaaccacagggcucagacuuacuagauaaaaccagaaau

SEQ ID NO: 35280 - RNA, 64 nt, Human
uuuucaguggucaaaauacucuguuuagagcaagggcucagaaaacagaaauacugucauggag

SEQ ID NO: 35281 - RNA, 64 nt, Human
ucagggugaggauggugagggagggcuggugaggggcucagaggaauacuuggaacaacagcag

SEQ ID NO: 35282 - RNA, 64 nt, Human
gccugcccgcccacccugggagucccaguggugaggcucagagaacugcuaaggggaaagaaca

SEQ ID NO: 35283 - RNA, 64 nt, Human
cagcugccucugagccaauccugggaccauaauaggcucagagugagucagcuguuugaaccca

SEQ ID NO: 35284 - RNA, 64 nt, Human
uccugcccuuugaauacccucacuuuccaggccuggcucagaaucuaaccuauuuauugacugu

SEQ ID NO: 35285 - RNA, 64 nt, Human
uaugggaggaucaggaccaggugggaacaaaggaggcucagagaagaaagacgugucccuucug

SEQ ID NO: 35286 - RNA, 64 nt, Human
gaugcagagguuggaggagagagguggagacuguggcucagacccaggugugcgggcauagcug

SEQ ID NO: 35287 - RNA, 64 nt, Human
guagcaagaaaugggaagcagggggaggggcaggggcucagaacaauauucuagaccaacuuug

SEQ ID NO: 35288 - RNA, 64 nt, Human
auccccugagagcugaugauuauugaggacagaaggcucagaaacaguuugugacagaaaaugc

SEQ ID NO: 35289 - RNA, 64 nt, Human
uuccuuccugcaaagcccaauccaagacuggcauggcucagagguugugagaaaggcauggacu

SEQ ID NO: 35290 - RNA, 64 nt, Human
ugauacugauugccacauuaagguugaacagcauggcucagagucuagagaaagugaucaccaa

SEQ ID NO: 35291 - RNA, 64 nt, Human
ugauacugauucccacauuaagguugaacaacauggcucagagucuuguucaagagaaagugau

SEQ ID NO: 35292 - RNA, 64 nt, Human
uuuggagaauagcacccauaucugugugcccuagggcucagaggggccucaucuuccccagccc

SEQ ID NO: 35293 - RNA, 64 nt, Human
gguggggggcucucaagugccugauccugcccugggcucagagccagcccagagggaagcaacu

SEQ ID NO: 35294 - RNA, 64 nt, Human
gaaugggucuacaccugcaugggcugagucccugggcucagaccuagcagcguggggugagucc

SEQ ID NO: 35295 - RNA, 64 nt, Human
gccugcacuacgaugagggauggagguagcugcaggcucagaagagacugagcuugcacagauc

SEQ ID NO: 35296 - RNA, 64 nt, Human
agcaaggggcagauagcucagcaaggaaagaaugggcucagaaaaaggagggcuggcuggagga

SEQ ID NO: 35297 - RNA, 64 nt, Human
uuugcaugccauucuccaucagaucugggaugauggcucagaacauguacacagacuaagagua

SEQ ID NO: 35298 - RNA, 64 nt, Human
cugagcucucaaggagaugcugccaucacugggaggcucagaggacccuuccugcccaccuucg

SEQ ID NO: 35299 - RNA, 64 nt, Human
ccagagguaucacaaacacuguuacucaucuacuggcucagacuguacuacuuuuuuuuuuuuu

SEQ ID NO: 35300 - RNA, 64 nt, Human
ccagaccucaugcccuggacacugcugcugaguuggcucagacucugcacuggcacugagccuu

SEQ ID NO: 35301 - RNA, 64 nt, Human
ugcagccuugaacacacacaaaaauauucuuaagggcucagauuuagcaaacacggaagaauuu

SEQ ID NO: 35302 - RNA, 64 nt, Human
gagagcuccuuuacagggacuuuaugugguuuagggcucagagcuccaaaacucugggcucagc

SEQ ID NO: 35303 - RNA, 64 nt, Human
gccuggcagcugccugcauuucaggaaaagaggaggcucagaccauccagcccccgcccauauc

SEQ ID NO: 35304 - RNA, 64 nt, Human
gcgaugcccuuggugcuuuagugcaagaagccuaggcucagaagcacagcagcgccaucuuucc

SEQ ID NO: 35305 - RNA, 64 nt, Human
acugacuuugcccuuuuuucccguugauagucauggcucagaggugcuuguaaaugucuuggga

SEQ ID NO: 35306 - RNA, 64 nt, Human
cccaccucgaggcucuucuuccugccacccuuugggcucagaggaggguggcuuuuuucgaggu

SEQ ID NO: 35307 - RNA, 64 nt, Human
ccagggccucccuguucacggugacacaggucagggcucagagugacccucagcugucaccugc

SEQ ID NO: 35308 - RNA, 64 nt, Human
aggaauaccacagacacccuaccgauagaacaguggcucagaucuuacuugcuccugcuuacga

SEQ ID NO: 35309 - RNA, 64 nt, Human
aggggcacgucugggcagaaaaccuguuuuguuuggcucagacauauaguuuuuuuuuuuuuua

SEQ ID NO: 35310 - RNA, 64 nt, Human
gaacuguuaucggauauaggguuugcaagggaagggcucagagcaagggaaauugagaaaaggg

SEQ ID NO: 35311 - RNA, 64 nt, Human
aaacugaagaaucaauauacaggguaauagcuuuggcucagagcuccaauaaugugcuucagau

SEQ ID NO: 35312 - RNA, 64 nt, Human
caagaaggccagaaaugggccgugagcucucacaggcucagacuaaaucagaggucaaggcuuc

SEQ ID NO: 35313 - RNA, 64 nt, Human
gccccauccccacccuccuuggggggcucagcuuggcucagaucugaugcuucaagaggcugua

SEQ ID NO: 35314 - RNA, 64 nt, Human
uggggagaacuuguuuuauagaugaggaaaccaaggcucagaggggcaaagucaccugcauggu

SEQ ID NO: 35315 - RNA, 64 nt, Human
aucauguuaucuucauaacaugcauuuugcauauggcucagagcagagccggaucucccaagga

SEQ ID NO: 35316 - RNA, 64 nt, Human
uuggaaacaaauggaaagccugucgggacuucugggcucagaaccagcuggcucacgcacucca

SEQ ID NO: 35317 - RNA, 64 nt, Human
cacgggacucuagccucauccccaggacccccuuggcucagaguguggugcuagaaacuggccc

SEQ ID NO: 35318 - RNA, 64 nt, Human
uuccuguaguuaguccguccccugguuccccuguggcucagaggccgcgucccuggcuuguaca

SEQ ID NO: 35319 - RNA, 64 nt, Human
gcagaggcucucccggcaggagcuggggucucagggcucagaugagucuguugcauuugaaugg

SEQ ID NO: 35320 - RNA, 64 nt, Human
cucuucguuaguugucagaauaugccuucgucaaggcucagagguaacaagacagaaaauucau

SEQ ID NO: 35321 - RNA, 64 nt, Human
ugacaaaauccugcagauagguuuaagaccuaguggcucagagcaguagcuacugggaaguuaa

SEQ ID NO: 35322 - RNA, 64 nt, Human
uguccacccaccuaugugccaacuguuguaacuaggcucagagaugugcacccaugggcucuga

SEQ ID NO: 35323 - RNA, 64 nt, Human
agugagacacagcaggacccuuccccaaauacuaggcucagagcaaccuccagccuucuccagc

SEQ ID NO: 35324 - RNA, 64 nt, Human
gagaaccaucgagccuguggaaguucuuucucauggcucagaaucuuagguaggugcuuaacuc

SEQ ID NO: 35325 - RNA, 64 nt, Human
gccuugaaaaccuggacagcccagcagccacuaaggcucagauuguuaaagcucucaaggcaau

SEQ ID NO: 35326 - RNA, 64 nt, Human
caguacagacugaaguaaacccaaacuuggcuggggcucagauacuaguaguggaguggugggg

SEQ ID NO: 35327 - RNA, 64 nt, Human
aagaaggcccaccuuugugucacucaccuccccaggcucagaguccccaaggcccugggguucc

SEQ ID NO: 35328 - RNA, 64 nt, Human
ccugcacuaugaagugcugcuggcugggcuugguggcucagaacaaggcacugucacugcccac

SEQ ID NO: 35329 - RNA, 64 nt, Human
gccagggccucggcggcugcugaagggauucuauggcucagaggcccaggguguggugaaggac

SEQ ID NO: 35330 - RNA, 64 nt, Human
auuauaccugucuguucuuaaagauuucaugguuggcucagacagaacaaucaucuguuugacu

SEQ ID NO: 35331 - RNA, 64 nt, Human
augagcaucaugggucauuacgggggcuugagcuggcucagagggaggcagggagcuuuuggac

SEQ ID NO: 35332 - RNA, 64 nt, Human
auaugagaauucuuuaggccaagaaacuguccuuggcucagagguguugggaauuaaagcagag

SEQ ID NO: 35333 - RNA, 64 nt, Human
ggaaguuguuugagcaagagguggcucaacgggaggcucagaaacaacagcaacagaugcagaa

SEQ ID NO: 35334 - RNA, 64 nt, Human
ugagacugaaaccccuggguuguggagggaaauuggcucagagauggacaaccuggcaacugug

SEQ ID NO: 35335 - RNA, 64 nt, Human
uuccuggguaccaguggggccaggagguggcucuggcucagagccgucaguguggcugaauaaa

SEQ ID NO: 35336 - RNA, 64 nt, Human
guggggaacugagggcaaggggauauagugauggggcucagauggacugggaggagggggaggg

SEQ ID NO: 35337 - RNA, 64 nt, Human
cuaaaacucuccaggggcagguaaagcccugcugggcucagaagcacuauagaauuugcuguac

SEQ ID NO: 35338 - RNA, 64 nt, Human
aauugggcucuaggucucugucccuggcgcuugaggcucagaagagccucuguccagccccuca

SEQ ID NO: 35339 - RNA, 64 nt, Human
cacuccaacucccuuaaaauaccuagaccuaaacggcucagacaggcagauuugagguuucccc

SEQ ID NO: 35340 - RNA, 64 nt, Human
ccuuggagaucccguaaucccacuacccuucuuuggcucagagaggauaauuugccuaaugaua

SEQ ID NO: 35341 - RNA, 64 nt, Human
caggaacccuuuccaaaagcccagagaugcccugggcucagaucuguaauucucccaggagcug

SEQ ID NO: 35342 - RNA, 64 nt, Human
cagcuccccagggcagacucacgugccccucugaggcucagaaaaugcccagcccuuccucaaa

SEQ ID NO: 35343 - RNA, 64 nt, Human
acccuccucccccuagugagagauaaggaccucaggcucagagagguuaugugguuuucucaaa

SEQ ID NO: 35344 - RNA, 64 nt, Human
ggaugugggaagcagcauuguccucugggcauguggcucagagguaucacagugacaaaagagc

SEQ ID NO: 35345 - RNA, 64 nt, Human
gccccucgcagccaacucagccaguguugggacuggcucagagcccaugggggcuggagggggg

SEQ ID NO: 35346 - RNA, 64 nt, Human
gauucuguauaacaaggugaugucuguuucccagggcucagaccuaauccaguuauaauaaaau

SEQ ID NO: 35347 - RNA, 64 nt, Human
caauuucuccccauuuuauagaugaggaaacugaggcucagaucagaugagaacucacuuaaau

SEQ ID NO: 35348 - RNA, 64 nt, Human
aggucugugucacgggccauggccacucauauuuggcucagaauaaaucucuucaaauauuuua

SEQ ID NO: 35349 - RNA, 64 nt, Human
guuguuguuacuucccuccaagaggcuggaaaagggcucagagcugcugagcaggaaccggagg

SEQ ID NO: 35350 - RNA, 64 nt, Human
caacaggcccuugguagagcuggugccagaugugggcucagauccugggcaugaugggccgagc

SEQ ID NO: 35351 - RNA, 64 nt, Human
uuuacgacgugaucuaaaccaguccuuagcaaggggcucagaacaccccgcucuggcaguaggu

SEQ ID NO: 35352 - RNA, 64 nt, Human
gagagcugcugagggaccuuggagagcucaggauggcucagacgaggacacucgcuugccgggc

SEQ ID NO: 35353 - RNA, 64 nt, Human
ugggaagaucagugaucuugggucauugaucccuggcucagaggauagcgguuuccaucauaaa

SEQ ID NO: 35354 - RNA, 64 nt, Human
acagugaauccagcaacucaguggauccaagcugggcucagaggucggaaggaggguagagcac

SEQ ID NO: 35355 - RNA, 64 nt, Human
ggaccaagaaaaaucaacaaacaaaucaaagccaggcucagagcucugaaauuaaaaagcacug

SEQ ID NO: 35356 - RNA, 64 nt, Human
gggggaggaaugaacaaaauggcgcuguuucuuuggcucagacuccuagaaugcuugacaagac

SEQ ID NO: 35357 - RNA, 64 nt, Human
accagcucuacgagagugagacugggaacuugauggcucagagagcaucuuuuccucccauuuu

SEQ ID NO: 35358 - RNA, 64 nt, Human
uagaaguuagauucaaaauggaaaaccuauucauggcucagauuuuucauuguggguuaaaaau

SEQ ID NO: 35359 - RNA, 64 nt, Human
guaggggagggccagugcccagacagggucauggggcucagaccagcccacuguagagaaucac

SEQ ID NO: 35360 - RNA, 64 nt, Human
uugaucuuggcucacugcagccucaauguccccaggcucagauuguccuuccaccuuagccucu

SEQ ID NO: 35361 - RNA, 64 nt, Human
ugguuucaggccaaaucuagaauuuagugauacuggcucagaagaauuuaaguucuauucagcc

SEQ ID NO: 35362 - RNA, 64 nt, Human
cuuuguuguuugcauuuuaaggaacugggagugaggcucagagaaguugagggaccugucccag

SEQ ID NO: 35363 - RNA, 64 nt, Human
uucugaagucucaggcuuagaaguuaccaaagugggcucagaaacugucaucuccugguuccaa

SEQ ID NO: 35364 - RNA, 64 nt, Human
ggccauccagccgugccccagccuggaccccuggggcucagauagaggugcugagccccugugu

SEQ ID NO: 35365 - RNA, 64 nt, Human
uggaaguaauugauccaccugccagagaaacacaggcucagaggaugccugggaacagggagga

SEQ ID NO: 35366 - RNA, 64 nt, Human
ccucccccagaauaaaaccauguuuucuaccagaggcucagaauacgcugagccugugaccaga

SEQ ID NO: 35367 - RNA, 64 nt, Human
agaaugguggagagaaaagagaaugcugaaaaguggcucagaugcagaguguucuguggagaaa

SEQ ID NO: 35368 - RNA, 64 nt, Human
uaacacuucguaagcaacgaguucaccuaaguaaggcucagauccuaguuuuaaaaaccauuuc

SEQ ID NO: 35369 - RNA, 64 nt, Human
uacaugguguugggggaagaaaaccuacgcuucaggcucagagaaaccuggauucaaauccugc

SEQ ID NO: 35370 - RNA, 64 nt, Human
uugaauuucccagauauuuauguuugaacauaauggcucagaauacauauuugaacaucauagu

SEQ ID NO: 35371 - RNA, 64 nt, Human
gcucauaaauagcaacagugucucaugauuuaauggcucagaaauaguuauucauuaguuuuua

SEQ ID NO: 35372 - RNA, 64 nt, Human
acuuucugaacuccacaaaaccuccuuugugacuggcucagaacugaccccagccaccacuuca

SEQ ID NO: 35373 - RNA, 64 nt, Human
gggagaggaaggggccuuaugggaauagugaaaaggcucagaccgaccgauggcaagaucugca

SEQ ID NO: 35374 - RNA, 64 nt, Human
uugcucuguugccuaggcuggucuugaacuccugggcucagaugauccuccuguccucagccuc

SEQ ID NO: 35375 - RNA, 64 nt, Human
gaacggaaaucaugauuucccuuguagaaagugaggcucagauuaaauuuuagaauauuuucua

SEQ ID NO: 35376 - RNA, 64 nt, Human
gaaugaagaacauggacucauguggaugugguuuggcucagaugucccugcaauaaacaagggg

SEQ ID NO: 35377 - RNA, 64 nt, Human
gguauccugggggacccaauguaggagcugccuuggcucagacauguuuuccgugaaaacggag

SEQ ID NO: 35378 - RNA, 64 nt, Human
ccucaauucagguaccaacgaacccucugcccuuggcucagaaugguuauagcagaaauacaaa

SEQ ID NO: 35379 - RNA, 58 nt, Human
uccugaggcccuacaaauaguaacccuaggcucagagacccaauuuuuuaagccccca

SEQ ID NO: 35380 - RNA, 64 nt, Human
caugggaugcuccaggaggucugggguaccagugggcucagaugaagcucuugugcucauguau

SEQ ID NO: 35381 - RNA, 64 nt, Human
ucauuuuuuaaaaugcucuuuuagaacgggaaacggcucagauccugcuguggcacggggccua

SEQ ID NO: 35382 - RNA, 64 nt, Human
guagcuuggccaucagcuccuucccccaaaaccaggcucagagcucuccucuaucagcaauucu

SEQ ID NO: 35383 - RNA, 64 nt, Human
cucuggacggacaguggggacauuguggguuuggggcucagagucgagggacgggguguagccu

SEQ ID NO: 35384 - RNA, 64 nt, Human
acuaauccagugaaggaggcugugucaaaagaagggcucagaagcccucuuuucagaggcaaug

SEQ ID NO: 35385 - RNA, 64 nt, Human
gaccuuccucuuucaucuuacagaggcuuagugaggcucagaugagauuauaucuguaaaaucc

SEQ ID NO: 35386 - RNA, 64 nt, Human
aagcugugacauuuuuaauuuacaaccuuucuggggcucagacauaaaguuaccuauccaaggu

SEQ ID NO: 35387 - RNA, 64 nt, Human
agcucuucacagcugaacucagucuauggguuggggcucagauaacucugugcauuuaagcuac

SEQ ID NO: 35388 - RNA, 64 nt, Human
uuccugauuguuuacagucauuggaauaaggcauggcucagaucggccacagggcgguaccuug

SEQ ID NO: 35389 - RNA, 64 nt, Human
ugagagcaggaacuucaagcugugauucuaucucggcucagacuuuugguuggaaaaagaucuu

SEQ ID NO: 35390 - RNA, 64 nt, Human
ugggagcaaaugggucacaaauagcucagcugugggcucagaaacugcuagguaaaagaauucc

SEQ ID NO: 35391 - RNA, 64 nt, Human
ccuagucucugcaccuccuuaggcccugccucugggcucagaccccaaccuagucaaggggauu

SEQ ID NO: 35392 - RNA, 64 nt, Human
ugagcccagcaggagaggaugguaggguugccagggcucagaagugcaagcugauuacucaccc

SEQ ID NO: 35393 - RNA, 57 nt, Human
caaaaguggagucuguuugauagcgucggcucagagcccugguaccuuggacccaag

SEQ ID NO: 35394 - RNA, 64 nt, Human
uuuaaaaaucaaagugauuuugaaaaucucuaauggcucagaaaauaaaaacauccaguuugug

SEQ ID NO: 35395 - RNA, 64 nt, Human
ucccgaggaaucugccucccacccacugacucagggcucagacucagccucuauuguccagagc

SEQ ID NO: 35396 - RNA, 64 nt, Human
cugcucaccccacagacacugguggggagaccauggcucagaggaaggguggagcaacccuccu

SEQ ID NO: 35397 - RNA, 64 nt, Human
cgucuauuguugacuuccucacgaugcuggcucaggcucagagccucucaucaccgccugugaa

SEQ ID NO: 35398 - RNA, 64 nt, Human
auuccucuuacuggggccuggggcucuagcccaaggcucagaggagccaauaaaccuguaaaug

SEQ ID NO: 35399 - RNA, 64 nt, Human
cacaguccaggagcauuugaaggcacaaugcaggggcucagauuggcacagaauucuuuuguga

SEQ ID NO: 35400 - RNA, 64 nt, Human
uuuuguucucgcaaaaacguaucuccuaauuugaggcucagaugaaaugcaucagguccuuugg

SEQ ID NO: 35401 - RNA, 64 nt, Human
gcuguuuuaaauggaaggcccuucuauuccugagggcucagagcugaccaugcaugaauguaug

SEQ ID NO: 35402 - RNA, 64 nt, Human
ucuguuaucuuugacauguaacauccuuuuuagaggcucagaacaccuccuuggcugcuaucuc

SEQ ID NO: 35403 - RNA, 64 nt, Human
gugucuccagaaaggggacaucgggggggaggggggcucagaaaggagaagggcugugaucucc

SEQ ID NO: 35404 - RNA, 64 nt, Human
guauuagaagacuuguauuuuuugaaacucuuguggcucagagauaacccuuggagaugugacu

SEQ ID NO: 35405 - RNA, 64 nt, Human
ugugggggugccuuccucagccucuggcccucuuggcucagauucaaucaaauguugcuucccu

SEQ ID NO: 35406 - RNA, 64 nt, Human
gaugaaggaagauguggaaaaaauccuuagccagggcucagagaugaagcagugaaagagacag

SEQ ID NO: 35407 - RNA, 64 nt, Human
gaacaagcugugugucaucacagauuguacugugggcucagaaaccgugagagagcccccaccg

SEQ ID NO: 35408 - RNA, 64 nt, Human
accuggcugggcugcccucccaacccccgccucuggcucagagcacccucccucccggccccca

SEQ ID NO: 35409 - RNA, 64 nt, Human
augcugcuuucugcuuaguauuuuuuugauucaaggcucagaaggaauggugcguggcuucccu

SEQ ID NO: 35410 - RNA, 64 nt, Human
gcuccucgcuugaaugauucagggucagggagguggcucagaguccaccucucauugcugauca

SEQ ID NO: 35411 - RNA, 64 nt, Human
uaguauuuagagauguguaccugcuuaguuaauuggcucagaauuuuaauauaaacaucacacu

SEQ ID NO: 35412 - RNA, 64 nt, Human
ucucuggaaugcgguaauaagagcuggcaaguaaggcucagagagaagcaaccaacuggaguua

SEQ ID NO: 35413 - RNA, 64 nt, Human
cacuguugauuccacuucugucgaggagcuucggggcucagagaggugaugacgugcccaaggu

SEQ ID NO: 35414 - RNA, 64 nt, Human
aggaggggcagagccaggaggcaguggggcugugggcucagagcucaggagucgccuuaccuga

SEQ ID NO: 35415 - RNA, 64 nt, Human
ugggcuauggacacagggugacggugacaaagauggcucagagggggacugcugcugccuggcc

SEQ ID NO: 35416 - RNA, 64 nt, Human
caagauuuuguauacacuuugcuccuugcccuagggcucagaguggugguuucugacuacauuu

SEQ ID NO: 35417 - RNA, 64 nt, Human
auuuuaaguaugugaagaaaaucuacuuguaaaaggcucagaucuuaauuaaaagguaauugua

SEQ ID NO: 35418 - RNA, 64 nt, Human
cagcuggcuggggccaccgugcggggugccaacgggcucagagcuggaguugccgccgccgccc

SEQ ID NO: 35419 - RNA, 64 nt, Human
ugcugggccuucugugcaggacgcucagccucagggcucagaaggugccaguccggucccaggu

SEQ ID NO: 35420 - RNA, 64 nt, Human
aauagcuuggauucaaucaugugacuuuuaaauuggcucagaaagcaauuuuguaauuucagag

SEQ ID NO: 35421 - RNA, 64 nt, Human
aagauuuucuucuuauuuaaugugguuuauuuugggcucagaaauaauugcucuguugaaaaua

SEQ ID NO: 35422 - RNA, 64 nt, Human
aggacacggacccugugugguauuuuggcauuuuggcucagaguccaauguaccauguugccca

SEQ ID NO: 35423 - RNA, 64 nt, Human
ggaaauucaugguuggcuacgaaaugcuugcucaggcucagagggaccucaccccugagcaggu

SEQ ID NO: 35424 - RNA, 64 nt, Human
aaggcuguucuauuuaaaucagagauggggaccaggcucagaguucuaccuaucuaacccccaa

SEQ ID NO: 35425 - RNA, 64 nt, Human
ucuccaaccccuucaugccagauggggaaacugaggcucagagaggauacugcucuauguggca

SEQ ID NO: 35426 - RNA, 64 nt, Human
aaguguggagaugucaagcuaguucacacucugaggcucagaauauguaggacaugcacaauug

SEQ ID NO: 35427 - RNA, 64 nt, Human
gagaucaugaacccauuuaacagacgaggagacaggcucagagaggcaccgucccuugccuaac

SEQ ID NO: 35428 - RNA, 64 nt, Human
uagcccaacucccuguuucaugaaagagaaaagaggcucagaaaaguuuagagagcagcucagu

SEQ ID NO: 35429 - RNA, 64 nt, Human
aagaggccuguggcagcgccgcuggacccuaggaggcucagaggcaguggugugggagcccugu

SEQ ID NO: 35430 - RNA, 64 nt, Human
auucuagcuuuuuuccuccuuucucuguauauugggcucagagaguacacugugucucuaugug

SEQ ID NO: 35431 - RNA, 64 nt, Human
uuacuggggugggguggcgagaugggcuugagggggcucagagcauaaggcuucagggcccaag

SEQ ID NO: 35432 - RNA, 64 nt, Human
ucacugcccccgcacucccacagggcucaggcugggcucagaggccacugagaugccagcuccu

SEQ ID NO: 35433 - RNA, 64 nt, Human
aaucggggcugcuggaacugggacagcugccuguggcucagagccuucuucaaaagcuucaaaa

SEQ ID NO: 35434 - RNA, 64 nt, Human
ugaagucugaccagcacaaggaaggaggcuggcuggcucagaggggcccaccuugcguggaaug

SEQ ID NO: 35435 - RNA, 64 nt, Human
auuaauuggcugagaaaacccuggaguggagggaggcucagagauacugauauggaugugggag

SEQ ID NO: 35436 - RNA, 64 nt, Human
uuacuaaaccccaauucauagaauaggaaacuguggcucagaggucaucuaccuaaagacacau

SEQ ID NO: 35437 - RNA, 64 nt, Human
gucauggggaugaaaggaucucugagaccacagaggcucagacucacuguuaagaauagaaaac

SEQ ID NO: 35438 - RNA, 51 nt, Human
gggugaagggaaucuacugagggcucagaccacaugccccaucccaugcug

SEQ ID NO: 35439 - RNA, 64 nt, Human
ugucucacaggcaaaauuugauuuggcuaaaauaggcucagauguauuugugugcccgugugug

SEQ ID NO: 35440 - RNA, 64 nt, Human
guauuuaaggaauaguuugaagcuaauaccaucaggcucagaguuuacaugcauuuuuacuuag

SEQ ID NO: 35441 - RNA, 64 nt, Human
uguugaugaguucugcggcccagcauauagaaauggcucagaacguuccaggccuuggugagac

SEQ ID NO: 35442 - RNA, 64 nt, Human
ugcuggcaacuuguccucccugccuuagagaugaggcucagacaaacgaccuuagcacccauag

SEQ ID NO: 35443 - RNA, 64 nt, Human
auguuaacuuucuaacacauuucaugcauagcuuggcucagaaggugccauuggcagacaggca

SEQ ID NO: 35444 - RNA, 64 nt, Human
gugauccaccgccuaggccucccaaaaccauuagggcucagaggaagguaucccaaugaauauc

SEQ ID NO: 35445 - RNA, 64 nt, Human
uugguuuaagcaguugcuaaguuuuguaauuuuaggcucagaggaccauaggagguuuuaagau

SEQ ID NO: 35446 - RNA, 64 nt, Human
caucauuguuaauuugaggacugggcugucuuggggcucagaagauaaagaacuauuugagcag

SEQ ID NO: 35447 - RNA, 64 nt, Human
augacugugugugucccugaaacaaaauugcucuggcucagagcuccuuuggccacucauauua

SEQ ID NO: 35448 - RNA, 64 nt, Human
gaguugcugggagccugagcaccuuucguuuuucggcucagagaaagccaagugcaacuugcuu

SEQ ID NO: 35449 - RNA, 64 nt, Human
acaugugcacagugcuaggacgggaggcagagccggcucagagcagguccaccagcccaccuau

SEQ ID NO: 35450 - RNA, 64 nt, Human
aggugaguugacuaucaacccaaggcaaaggggaggcucagaaggaggugguguggggaccccu

SEQ ID NO: 35451 - RNA, 64 nt, Human
uggccucggcccugguucccucccuccugcucugggcucagauacugugacaucccagaagccc

SEQ ID NO: 35452 - RNA, 64 nt, Human
uccucuccaggaugggccucuaaagcugaggccuggcucagagccuguuugcccucugucuuaa

SEQ ID NO: 35453 - RNA, 64 nt, Human
ugaggcacucgccggacucugcccgagccuucuaggcucagaucccagagggaugcaggagccc

SEQ ID NO: 35454 - RNA, 64 nt, Human
aaaccccauuuuucccaggguaaucaugaaagaaggcucagagaaagagggaaacaaaagccug

SEQ ID NO: 35455 - RNA, 64 nt, Human
ccccaucccuaccacuguggccccaagaggggcgggcucagagcuuugucacuugccacauggu

SEQ ID NO: 35456 - RNA, 64 nt, Human
ggggcaaggagcauagagauguuuuccaggaaggggcucagaagcugcacuaggccccgagucc

SEQ ID NO: 35457 - RNA, 64 nt, Human
acgucuccgugcagcccccagagagaggcccaugggcucagaccaggcuuuguuguccugcucu

SEQ ID NO: 35458 - RNA, 64 nt, Human
uggggggucugagccaccccccucagccccguucggcucagaccgacccccacuccauccccag

SEQ ID NO: 35459 - RNA, 64 nt, Human
auaugaagaguaauuaacuuuacccaaggcguuuggcucagagggcuacagacuauggccagaa

SEQ ID NO: 35460 - RNA, 64 nt, Human
aggagcugcggaggcuucagagcgagcacgacagggcucagaugcugcuggcagaguugucucg

SEQ ID NO: 35461 - RNA, 64 nt, Human
ggcuggggggcagggggcaugcacccaugcaaaaggcucagaaacucccccuccggcaagcccu

SEQ ID NO: 35462 - RNA, 64 nt, Human
ggcccacuggugcccagcaccaaggcgagcuccgggcucagaccaacuccaaggucagcuggcc

SEQ ID NO: 35463 - RNA, 64 nt, Human
cuccccuccccagccuuuuccagaaaccauacugggcucagaucagagcuccgaagcggucaaa

SEQ ID NO: 35464 - RNA, 64 nt, Human
auuagaaucuguuuggugaguugaaagguaaguuggcucagaguugcacaguagggcauuaaau

SEQ ID NO: 35465 - RNA, 64 nt, Human
gucauuguucuccucguccaucagggaucucagaggcucagagacugcaagcugcuugcccaag

SEQ ID NO: 35466 - RNA, 64 nt, Human
uugguugugcagggacugguagcuuggaugacauggcucagagucccagcauccacuugaaacc

SEQ ID NO: 35467 - RNA, 64 nt, Human
agacgggguaaguuauaauaaacagaaauguauuggcucagagcucuggaggcugggaagucca

SEQ ID NO: 35468 - RNA, 64 nt, Human
aggugagaauaccuaccucacggaacuguugggaggcucagaugagaugcuauaugugaaaaca

SEQ ID NO: 35469 - RNA, 64 nt, Human
uguauagcauucacauuccacaggugaggaaacaggcucagaggaauaaguggcaugccaagau

SEQ ID NO: 35470 - RNA, 64 nt, Human
uuuacaguccaggcagcaaaaucucaaggccuggggcucagaguaguaaggggugggaaguggg

SEQ ID NO: 35471 - RNA, 64 nt, Human
gauguuagagaggccuggggagagcagccgauggggcucagacuacauauggcaggccgaucag

SEQ ID NO: 35472 - RNA, 64 nt, Human
cauucuucucuacccagaaccugucaugggcuggggcucagauuuuccuggcuuugggagcaga

SEQ ID NO: 35473 - RNA, 64 nt, Human
aaggcagacguucaguacaaacauuuaugcgguaggcucagaugucguaauuugcacuuaggua

SEQ ID NO: 35474 - RNA, 64 nt, Human
uagggcccggggaagcagagcccuaagggauuaaggcucagacaccucugagagcaggugggca

SEQ ID NO: 35475 - RNA, 64 nt, Human
cuccagacucuggggagacgggcgcuagauuuggggcucagaaggcccugcucucucccaucca

SEQ ID NO: 35476 - RNA, 64 nt, Human
aaaaucugguccuccccccucccaguguagcuguggcucagaguuuuuucuuuuuguugucacu

SEQ ID NO: 35477 - RNA, 64 nt, Human
uuaaucugcugacagagcuacaccuuucauaacaggcucagaucacucagcucccugugaccuu

SEQ ID NO: 35478 - RNA, 64 nt, Human
auagggggcuggcuccucccagaaccugucuggaggcucagaaacgggggcagugacaguggag

SEQ ID NO: 35479 - RNA, 64 nt, Human
aggcgcgggagccaggggccuccaccccaaccccggcucagagacugggcggcccggcgggggc

SEQ ID NO: 35480 - RNA, 64 nt, Human
uuugcacuucaaaugacaacuuaaccaaguauagggcucagaaauuauauuuuuaaaugucuga

SEQ ID NO: 35481 - RNA, 64 nt, Human
acccccacuuucaacugaaucaagugaggaagagggcucagagccugacucugagggguuccgc

SEQ ID NO: 35482 - RNA, 64 nt, Human
ugugggggaaggauagcugcagauugacaggcgaggcucagaaacuccuggcuuagauugaagu

SEQ ID NO: 35483 - RNA, 64 nt, Human
guuuauauguccgggaucuggaucagauucugggggcucagaaacgucgguugcauugagcuac

SEQ ID NO: 35484 - RNA, 64 nt, Human
gccugauuccaaacagguguggagaauauugaauggcucagaagccgcgucccuuacuuaacac

SEQ ID NO: 35485 - RNA, 55 nt, Human
gcaagcagagggcggccuaggcuggggcucagagggccggagggacugaacgcuc

SEQ ID NO: 35486 - RNA, 64 nt, Human
gaguaauugucagacgugggauagauaacugagaggcucagaaucuuuaccaaggauauuuuuu

SEQ ID NO: 35487 - RNA, 64 nt, Human
auauauauucccauuuuauaaaacuacaaacugaggcucagagaaggugugaccucuuguugcu

SEQ ID NO: 35488 - RNA, 64 nt, Human
agcucuccuuuccaaaggcagagcuuacugucauggcucagauguucacucgcaucuucacccc

SEQ ID NO: 35489 - RNA, 64 nt, Human
ucuggauaccauuauauguucccccuguuucagaggcucagauuguaauauguaaaugguaugu

SEQ ID NO: 35490 - RNA, 64 nt, Human
uuuauaaauuuuagaaucaauuucucuuuaagguggcucagauuuuucaacucuugugcacaua

SEQ ID NO: 35491 - RNA, 64 nt, Human
aagaggagaaacucauugaaauccuggaacagcuggcucagacauuuaaauaggccaacccaga

SEQ ID NO: 35492 - RNA, 64 nt, Human
uucucaguggaggaggcuggggaaggcaugagggggcucagaggcuccuugacugggaccagga

SEQ ID NO: 35493 - RNA, 64 nt, Human
guuaaggauguccccagggucacacagugagcggggcucagagcuugagugucuuugugcuuug

SEQ ID NO: 35494 - RNA, 64 nt, Human
ugggcggagaucugcuccuucggugggggccucuggcucagauuuggggccaaggaggccucug

SEQ ID NO: 35495 - RNA, 64 nt, Human
gcuggggcagcugccucccaggggugggacucugggcucagagagaggcccuugagcugcagcu

SEQ ID NO: 35496 - RNA, 64 nt, Human
agggcuucuccccacagaaggcggagagagcuggggcucagacaugggugugcaccuuaauaaa

SEQ ID NO: 35497 - RNA, 64 nt, Human
augcuuuuucccugcccaacccuguggccuucagggcucagagcagcaaaggccugaagaguga

SEQ ID NO: 35498 - RNA, 64 nt, Human
ugcaaaacaggcaugcuaguaagcagucagucguggcucagaacuuaaccccauagcucagagg

SEQ ID NO: 35499 - RNA, 64 nt, Human
uuauagccaucacaaaauuuugcccaaaguguauggcucagaagagaugaucaauaacuaaaau

SEQ ID NO: 35500 - RNA, 64 nt, Human
ggggaagguguguaucuguccauguguggauguuggcucagagcuauagcuucucugugggggg

SEQ ID NO: 35501 - RNA, 64 nt, Human
ccuucucauuaauucuuuguaacagcaaauccuaggcucagaggcacagugcuuuguauuugau

SEQ ID NO: 35502 - RNA, 64 nt, Human
gugaaugucaacaauaaaaagcaagacuaugaaaggcucagauuucuugcaguuuaaaauggug

SEQ ID NO: 35503 - RNA, 64 nt, Human
cucacugcuccaggacucagaccucgaccccagaggcucagaugaaagaccgacccgggugugu

SEQ ID NO: 35504 - RNA, 64 nt, Human
cuucaguuagucucuaugacaauaagaaaacuaaggcucagagaaaaagccaaaacuaguacuu

SEQ ID NO: 35505 - RNA, 64 nt, Human
acccagugcccaguugugccacauucccacucaaggcucagaacuuggcucgcauugguagcug

SEQ ID NO: 35506 - RNA, 64 nt, Human
gcaguagcuguucuguuuggaucugguaggacagggcucagagggcuaggcacggagggaaggu

SEQ ID NO: 35507 - RNA, 64 nt, Human
guuuuauaauauguaauuuuucaugaaaagaaagggcucagaaaaauuaggaugugauuuuggu

SEQ ID NO: 35508 - RNA, 64 nt, Human
gguggugucaccgcagcuuauaccaagacaccauggcucagacaugggaucaggacacaccuuu

SEQ ID NO: 35509 - RNA, 64 nt, Human
auguuugagacagggaagggggcugugauccagaggcucagaauaaaaagaugcccucccuucu

SEQ ID NO: 35510 - RNA, 64 nt, Human
ucuauaccuuccacuaugaacacagauaaacugaggcucagauaaguccaaaugaaaugaaauc

SEQ ID NO: 35511 - RNA, 64 nt, Human
caggcugggagcuggauaccugcccuggcagcauggcucagacugcaugacagguacggcgugc

SEQ ID NO: 35512 - RNA, 64 nt, Human
gcuccaucuuaaccuccaaagccacagaacuaggggcucagagccagagcuggcagccgccagc

SEQ ID NO: 35513 - RNA, 64 nt, Human
ccucuccagccucaggaugcucuuguuuauucugggcucagacccuccucuuguacgucucauc

SEQ ID NO: 35514 - RNA, 64 nt, Human
ugaucauuuccuggccaccaucacaauacuaaggggcucagaugugucuugugcccaccucuuc

SEQ ID NO: 35515 - RNA, 64 nt, Human
auauuucugagcugcuaccacaugacagacacaaggcucagaugaagaggugaauugaacacgu

SEQ ID NO: 35516 - RNA, 64 nt, Human
ccccgugguugaauuggaagaggccauagccccaggcucagaggcccagggcgcugggucuggu

SEQ ID NO: 35517 - RNA, 64 nt, Human
aagccucuagcauagagcacugcagacaggcccuggcucagaaucagagcccagaaaguggcug

SEQ ID NO: 35518 - RNA, 64 nt, Human
aaaugcuggcaaauccaggcugguguucugucugggcucagacauccacauaacccugucaccc

SEQ ID NO: 35519 - RNA, 64 nt, Human
uaaaaaucaaaguacccaaaacugagucccuuugggcucagaaaugucugugguauugggucag

SEQ ID NO: 35520 - RNA, 64 nt, Human
uauggggcugagcccuccugagggccgguucuaaggcucagacugggcacuggggccucagccu

SEQ ID NO: 35521 - RNA, 64 nt, Human
gaggcagugagguuaggcccagagagcuggaguuggcucagaugaaaaccucugucaacaaaga

SEQ ID NO: 35522 - RNA, 64 nt, Human
gccucgagccauagagccugaaaucaucuuuguuggcucagaaaauaccuuagcuucacucagc

SEQ ID NO: 35523 - RNA, 64 nt, Human
uggcccagccaacugccccgggugccucagagcaggcucagacucugggucccucggagcugcc

SEQ ID NO: 35524 - RNA, 64 nt, Human
ggcaggauugcucgguggugagaagguuagguccggcucagacugaauaagaagagauaaaauu

SEQ ID NO: 35525 - RNA, 64 nt, Human
gccgggagccugacccucaucuuucuuccaaacaggcucagaggguguccugcaccggggccug

SEQ ID NO: 35526 - RNA, 64 nt, Human
auccgggucccggaucguggauccggccgccuagggcucagacuugcggccccggguugggagg

SEQ ID NO: 35527 - RNA, 64 nt, Human
auuaucauccccauuuuacagauaaugacacugaggcucagaaagguugaggauaagcccacuu

SEQ ID NO: 35528 - RNA, 64 nt, Human
cucugcauggcacauggucaaggaaacuguccuuggcucagacagaccugggguggugggcauc

SEQ ID NO: 35529 - RNA, 64 nt, Human
gcccccuucccuuuccgcacuguccgcuuugugaggcucagaggaaggacagucugcaagcccg

SEQ ID NO: 35530 - RNA, 64 nt, Human
gucauuauuuccuucuucuacaucagguaguggaggcucagacaaguuauuuagccauucaccu

SEQ ID NO: 35531 - RNA, 64 nt, Human
ugacuggcuuugagaaggaagggaagauggaacaggcucagaucucaugggauagcacguggag

SEQ ID NO: 35532 - RNA, 64 nt, Human
uuacagaggacaguauuuguggggagggauuuggggcucagagugggguagguugggagaaugu

SEQ ID NO: 35533 - RNA, 64 nt, Human
ugggagagaaacuagaacagaagaugugcaauagggcucagagcagccccaggaagugggccau

SEQ ID NO: 35534 - RNA, 64 nt, Human
aaaggggcugcaguuugggagcuccugaagaaauggcucagauauugagucagagaaauaaaaa

SEQ ID NO: 35535 - RNA, 64 nt, Human
agccagcgucggucugugccccuuccgccacuggggcucagagccggggugggguggcugcagc

SEQ ID NO: 35536 - RNA, 64 nt, Human
caugacccucuguccccaggccuggcuccccgagggcucagaagagcagcuucggugugcagau

SEQ ID NO: 35537 - RNA, 64 nt, Human
gccagggauugacccaagcgcgaugcagcaggcaggcucagaagacgaugcggggcugugugcc

SEQ ID NO: 35538 - RNA, 64 nt, Human
agaugcagagauggucaugggcagcuggaggguaggcucagaaaugaagggaaccccucagugg

SEQ ID NO: 35539 - RNA, 64 nt, Human
uuuugguuucuguucccuuucugacugcccaaggggcucagaaccccagcaaucccuuccuuuc

SEQ ID NO: 35540 - RNA, 64 nt, Human
uaccccccacuauacauuuuuaauaaggauucauggcucagagggauuuucugaugguuuugcu

SEQ ID NO: 35541 - RNA, 64 nt, Human
ugcccucaguggcuggauugcagccacccaugguggcucagaauaucuggauuggagaggcaua

SEQ ID NO: 35542 - RNA, 64 nt, Human
ugauguguccccauugguuaggugaggagggugaggcucagagagcuaaggacacuuguuuggg

SEQ ID NO: 35543 - RNA, 64 nt, Human
ucuguaacuuaugaugucuuuucccugagaugggggcucagagggggaaggccuguggccugca

SEQ ID NO: 35544 - RNA, 64 nt, Human
ucuggaaucucguauuugggggcuuggggaagggggcucagagccgucccuaucuauucaguua

SEQ ID NO: 35545 - RNA, 64 nt, Human
ggcccccagaucacugucucugcugagcagggaaggcucagacugggcccagagcccccguucu

SEQ ID NO: 35546 - RNA, 64 nt, Human
acugcauggccuuggagagagacucugggcucuuggcucagauguguucaucaaauacuccuuu

SEQ ID NO: 35547 - RNA, 64 nt, Human
agucuuaagggucacuggccucuccccaggaaguggcucagaccccucagccccagcccagaca

SEQ ID NO: 35548 - RNA, 64 nt, Human
cagagaacuccccuacagcccagagauguggcagggcucagagaagcagccagagcuccuggag

SEQ ID NO: 35549 - RNA, 64 nt, Human
gugggaaucuugagacucuuuggccauuucccauggcucagacuaagcuccaagcccuucagga

SEQ ID NO: 35550 - RNA, 64 nt, Human
cacaguccuuacuucucuaccugccucaagaaggggcucagagcagagacuugugaauuccuua

SEQ ID NO: 35551 - RNA, 64 nt, Human
ucaaaggaccggcucauggcguuggucacuggcaggcucagagacauucugcugugggcgcagg

SEQ ID NO: 35552 - RNA, 64 nt, Human
aauucacaaaucagguagccccugaaccauaauaggcucagaggcuucagcccagcugcauagu

SEQ ID NO: 35553 - RNA, 64 nt, Human
auuuuuuuuuuccucuucagaacuugucaggcauggcucagagcuugaagauuaggagaaacac

SEQ ID NO: 35554 - RNA, 64 nt, Human
cuggaggcuuuggcauaggcugcaaaccaauuugggcucagagggaauaucagugauccauacu

SEQ ID NO: 35555 - RNA, 64 nt, Human
uucccaaagggcgagaaccacauuggacggucccggcucagaccgucuguacucagagcgacgg

SEQ ID NO: 35556 - RNA, 64 nt, Human
acacgccaacgcuguuccggguuggaacagcagaggcucagaaacuggcucugaaauaggcaga

SEQ ID NO: 35557 - RNA, 64 nt, Human
gugacugcuuccauuuugcagaugaggaaacuaaggcucagagaggccacgccacccuugagcc

SEQ ID NO: 35558 - RNA, 64 nt, Human
ggacgccgcgcucugggucccagaggggccggguggcucagacgacccaccacucccccacccu

SEQ ID NO: 35559 - RNA, 64 nt, Human
cagagcagaagccacuaggccacugcgcgucugaggcucagacccugcugugguuggcuugggg

SEQ ID NO: 35560 - RNA, 64 nt, Human
uguuacuuucccauuuuacacacagugaaacugaggcucagauauaaaggaaagguacuggcuu

SEQ ID NO: 35561 - RNA, 64 nt, Human
accugcacuagaaauugcauugacauugugagcuggcucagaagacaaaccaauuaagauguag

SEQ ID NO: 35562 - RNA, 64 nt, Human
cacacacacacucacugcggagaaccuugugccuggcucagagccagucuuuuuggugagggua

SEQ ID NO: 35563 - RNA, 64 nt, Human
aaccugccagggagacagagcucacaauaaaaauggcucagaugccacuucaaagaaccaguga

SEQ ID NO: 35564 - RNA, 64 nt, Human
accacucgucaacugcugauucuacugggcugugggcucagaccucauuucaggcaccagauug

SEQ ID NO: 35565 - RNA, 64 nt, Human
gccugagcaagugcagggcggagcuaccagcccaggcucagauguuggggugugaaagccucaa

SEQ ID NO: 35566 - RNA, 64 nt, Human
caccagggagccauuugagugcugagcgacaagaggcucagagggcaugaccccaugggacugg

SEQ ID NO: 35567 - RNA, 64 nt, Human
ccugguaacaggugucuggacuguggcuuuggcuggcucagaagguccccacuggcgugugugg

SEQ ID NO: 35568 - RNA, 64 nt, Human
cuccaucacauccucaggucucgggaccauggggggcucagaggggagacacaccuacugcuuc

SEQ ID NO: 35569 - RNA, 64 nt, Human
cuuaacaggaugggaucgaggguccccaugggguggcucagagauaggacccugguuuuaaauc

SEQ ID NO: 35570 - RNA, 64 nt, Human
caagggguggccguccugagggggaagugagaagggcucagagaggacaaaauaaagugugugu

SEQ ID NO: 35571 - RNA, 64 nt, Human
gaugaagaugggcuggaaggagggcgaggggcugggcucagagggccagggcaucaagaaccca

SEQ ID NO: 35572 - RNA, 64 nt, Human
gacacaggucacugccaagcaucagggccacucgggcucagaggucacucagggucaauacuca

SEQ ID NO: 35573 - RNA, 64 nt, Human
ccaauccccuggguaccaggcuucugccacccccggcucagaucuuugcaaaucaguacgacag

SEQ ID NO: 35574 - RNA, 64 nt, Human
caacucaucucugaacuuagaaucucauccuuagggcucagagagucccagcccuaagggugug

SEQ ID NO: 35575 - RNA, 64 nt, Human
ccggcuuuggggaggcagguaccccagggcagcaggcucagaguacagucccuucagcagaggg

SEQ ID NO: 35576 - RNA, 64 nt, Human
uauucaccaucccccugcuguaccggcagcaccaggcucagaucgaccaauaugugggguuggu

SEQ ID NO: 35577 - RNA, 64 nt, Human
gucauaggcaggauugagugacgguugggaagggggcucagaagcccccuccccagcccggaac

SEQ ID NO: 35578 - RNA, 64 nt, Human
ccguagccucauuucuuacagacggggaaacugaggcucagagcagcagguguuacccaagguc

SEQ ID NO: 35579 - RNA, 64 nt, Human
gugugauggugcacuccagggcaucacauccuggggcucagaccccugugggagguccgacaaa

SEQ ID NO: 35580 - RNA, 64 nt, Human
uauaaguuagggacugauugugcagguuuugcaaggcucagagagcaaaaguggauguugcaga

SEQ ID NO: 35581 - RNA, 64 nt, Human
aaagaugcauggacuucaugacagcucuuuugguggcucagaagccauuuuuuauagaaucaug

SEQ ID NO: 35582 - RNA, 64 nt, Human
acugcaaggaguaucaggaggaccuggcccugcgggcucagaacgauguggcugcccggcagac

SEQ ID NO: 35583 - RNA, 64 nt, Human
cagccauggccugaagugcagaucacugacccagggcucagagcagaggccagaaccacugggc

SEQ ID NO: 35584 - RNA, 64 nt, Human
cagccuccccuucuuguggugagacugaauuuugggcucagacaccagcaacagccucuuggga

SEQ ID NO: 35585 - RNA, 64 nt, Human
caggcgcuccagggcaggccugggacagagucaaggcucagagaauaaagguagcuaaucucau

SEQ ID NO: 35586 - RNA, 64 nt, Human
aggucagugcagccccuaccccugcucaggagugggcucagagucuagcaaaugcuaaggcccc

SEQ ID NO: 35587 - RNA, 64 nt, Human
ggggaacgggucugaugucccugugcuggcugagggcucagagcugcccgcacuccguagcuca

SEQ ID NO: 35588 - RNA, 64 nt, Human
uggaugucccuuccccacaauaggcuuagugcuuggcucagacaccuagacucuaaaacuauca

SEQ ID NO: 35589 - RNA, 64 nt, Human
ccauaguguguaugaaaagcuuguugacucuagcggcucagagaggacuuugcuggguuucuuu

SEQ ID NO: 35590 - RNA, 64 nt, Human
gaugcugauuucaagcugcccacagaacuggugcggcucagagcucggcgaguuugcugggagc

SEQ ID NO: 35591 - RNA, 64 nt, Human
gcucuggacagaguucuuauaaauguauaaauuaggcucagaaaccacugcauucugaccugcu

SEQ ID NO: 35592 - RNA, 64 nt, Human
ggagucaagucaggaugcucucaaggaccccucgggcucagagcccuaaagugggcccugguga

SEQ ID NO: 35593 - RNA, 64 nt, Human
uuauaaacuaauauaaaaugugcucuaccccauuggcucagagcuagggcaaacagcagauauu

SEQ ID NO: 35594 - RNA, 64 nt, Human
uccccagcccccacccaugccagcgcagcgccagggcucagauggggccugggcuguugugucu

SEQ ID NO: 35595 - RNA, 64 nt, Human
gugccagagaaaccacccccacuccaugagaagaggcucagacagcaggcuccggggccacgca

SEQ ID NO: 35596 - RNA, 64 nt, Human
aaagcacauuuugaaugaguauggaaccuccaugggcucagaaaaaagaugcuaauauauuuau

SEQ ID NO: 35597 - RNA, 64 nt, Human
cuggugcagcccuggcaguaacuggcuuguaagaggcucagacaccaagcugggccugcagagg

SEQ ID NO: 35598 - RNA, 64 nt, Human
gcagagcucaggagggugggugggagcugcagugggcucagaguccagcaaugaggcccccugg

SEQ ID NO: 35599 - RNA, 64 nt, Human
ggacuauuugcaaggugacagggacuggagccauggcucagaggugauucgggcagccagggac

SEQ ID NO: 35600 - RNA, 64 nt, Human
ucaguugugagccuucuagggccccaggcugggaggcucagaggacugaaucugggaccugugu

SEQ ID NO: 35601 - RNA, 64 nt, Human
ucccccugcagacugccauucuccuugcagacuuggcucagaagucaccuccucagugcaguua

SEQ ID NO: 35602 - RNA, 64 nt, Human
ccagcacgugcaugguucacagaaaaggauccugggcucagaaucucgagaaccgccugcuccu

SEQ ID NO: 35603 - RNA, 64 nt, Human
gccaggauacagaucuuaaauuugucaggacaagggcucagaggacuggacgugcucagacauc

SEQ ID NO: 35604 - RNA, 64 nt, Human
ggaccuccuagcugccccaucaggucaucuccagggcucagaggggugagaccauuucccaagg

SEQ ID NO: 35605 - RNA, 64 nt, Human
acucccucguuaaucacaggaucccacgaauuuaggcucagaagcaucgcuccucuccagcccu

SEQ ID NO: 35606 - RNA, 64 nt, Human
gccaagcucggaggcuuggccagcacugcuggauggcucagagcaagcugggcuccccgucugu

SEQ ID NO: 35607 - RNA, 64 nt, Human
gagacacgggaaaggggucgggacaggagcacguggcucagacaccgacgccgggaggccgcag

SEQ ID NO: 35608 - RNA, 64 nt, Human
ugaaaguauuugcugauucuuugaagauugggaaggcucagaagggcagaguugaagaaggcau

SEQ ID NO: 35609 - RNA, 64 nt, Human
cucuucccccucaccaagugcccaggagaccccuggcucagaccagcccaaggccuugcccagu

SEQ ID NO: 35610 - RNA, 64 nt, Human
gcugauaauaugacaaacaucauuguuuagaugaggcucagagagguagcacucucagaguguu

SEQ ID NO: 35611 - RNA, 64 nt, Human
uuuuuuuuuuacaaucauucagauugugaauucaggcucagaauuuacccagucaucagauacu

SEQ ID NO: 35612 - RNA, 64 nt, Human
aacugugagcaguuuauguaacuggaaugaaaagggcucagaggaauggcagggauggcaagag

SEQ ID NO: 35613 - RNA, 55 nt, Human
acaaagugacugaccugugagcucuggcucagacagcagcaagccggauccacca

SEQ ID NO: 35614 - RNA, 64 nt, Human
uguaaugaaaucucaccagaagugucccgaaaucggcucagauagggcucaaaacaagagauuc

SEQ ID NO: 35615 - RNA, 64 nt, Human
ccugcccuuguuuggagcuaagggaagggcaaaaggcucagauaugauucucuaucucuugugc

SEQ ID NO: 35616 - RNA, 64 nt, Human
uuauugcagugucugcuucauccguggaacuugaggcucagaugcccccugcucuguaacccug

SEQ ID NO: 35617 - RNA, 64 nt, Human
acauuuucaggggagccugugcccccaggcgggggucgggcagccccagccccucuccuuuucc

SEQ ID NO: 35618 - RNA, 64 nt, Human
aucugcuuuaugcuggacccaguaagaugaggaagucgggcaguacacaggaagaggagccagg

SEQ ID NO: 35619 - RNA, 64 nt, Human
cauucucaucgggggugcgcacaccaucguuacugucgggcaguaacugccgcuugccuugccg

SEQ ID NO: 35620 - RNA, 64 nt, Human
cccuccaguguccacauccaguucaccccagagggucgggcagguugacauauuuauuuuuguc

SEQ ID NO: 35621 - RNA, 64 nt, Human
uaaauuuaaaugcuaaaaacaauuguaucauguagucgggcagccuauugauacugucagggga

SEQ ID NO: 35622 - RNA, 64 nt, Human
ucacuuugucucuccuacccccacugccccgagugucgggcagcgauguacauauggagguggg

SEQ ID NO: 35623 - RNA, 64 nt, Human
ggaaauaaaauugggaugagcccuaauggaggaagucgggcaaauugaaaguauaaaugaaugg

SEQ ID NO: 35624 - RNA, 64 nt, Human
gacaacauucuuuauauugccaaccucggagauagucgggcaaucuugugucguuauaaugagg

SEQ ID NO: 35625 - RNA, 64 nt, Human
cuacuaaaaauacaaaaaauuagccggguguggugucgggcaccuguagucccagcuacucagg

SEQ ID NO: 35626 - RNA, 64 nt, Human
cuguuuguuacaaaguucugucuugucauggggagucgggcauauucuuggcagcacuccacuc

SEQ ID NO: 35627 - RNA, 64 nt, Human
aauuuaccuguuguuggaaacuggagaaaugauugucgggcaaccguuuauuuuuuauuguauu

SEQ ID NO: 35628 - RNA, 64 nt, Human
ugaagccaaauucuagcccaagucugguagagcagucgggcagcuaguuuucgggggaggauga

SEQ ID NO: 35629 - RNA, 64 nt, Human
cuucuuccagggggccccuggcagcagcuggggugucgggcagaaugugacuuguggccuuacc

SEQ ID NO: 35630 - RNA, 64 nt, Human
gcuuggugucagggagaggcuguagaguggcugugucgggcaucagauggagcacacagguggc

SEQ ID NO: 35631 - RNA, 64 nt, Human
cuuggguagcgcacucuucauggugacacucgaggucgggcagcacaaguguaaugaauaccuu

SEQ ID NO: 35632 - RNA, 64 nt, Human
ccgcccgcaucccagcugugggccugccggucaggucgggcaccuacuacaaaccguagugggg

SEQ ID NO: 35633 - RNA, 64 nt, Human
gacuucuacuuuagguucacauaccugccugcuagucgggcaacaugaaguaggacaguucugu

SEQ ID NO: 35634 - RNA, 64 nt, Human
uugugaauauuagauugcugaauuaaggaucauagucgggcauacuuaucuauauccauaaccu

SEQ ID NO: 35635 - RNA, 64 nt, Human
acuucagcaagcaguagguuuuacuaagcagauggucgggcacugcagggcaccaggcaggauc

SEQ ID NO: 35636 - RNA, 64 nt, Human
cucgggucgggauagugugagugccuagcacagugucgggcacgcagaagggccccuuaaaagu

SEQ ID NO: 35637 - RNA, 64 nt, Human
agcucgguggcaccuggaauuuacuguauucauugucgggcacuguccacuguggccuuucuua

SEQ ID NO: 35638 - RNA, 64 nt, Human
aggagcggggcugauccuggucgggcggaccugagucgggcagccgcucucccggaacuggaag

SEQ ID NO: 35639 - RNA, 64 nt, Human
gccggcuuccuccuuccagaugcccgagcaccgugucgggcaggucagcgcgguccugacuccg

SEQ ID NO: 35640 - RNA, 64 nt, Human
uauggcuuugucccuaugacucagaggaggguuugucgggcaaauucagguggaugaaguaugu

SEQ ID NO: 35641 - RNA, 64 nt, Human
gcccccgggaggacgggacccugagccugugugugucgggcagcugcaggguaggcgugugugg

SEQ ID NO: 35642 - RNA, 64 nt, Human
gaagaugccacagagccgggcuccccuaggcugcgucgggcaugcuuggaagcuggccugccag

SEQ ID NO: 35643 - RNA, 64 nt, Human
ccucagucugccacccuugccccuugccuccuuggucgggcaccauaccuccuccccuccaccc

SEQ ID NO: 35644 - RNA, 64 nt, Human
gccuagcuccugccacauggagcccccucugccggucgggcagccagcagagggggaguagcca

SEQ ID NO: 35645 - RNA, 64 nt, Human
gugaccgagagcgccacggaagccuggggaugacgucgggcagcuuuauucuuugcuuggcuuu

SEQ ID NO: 35646 - RNA, 64 nt, Human
guccuguccccgcagcccuggcagggggcaugcggucgggcaggggcuggagggaggcgggggc

SEQ ID NO: 35647 - RNA, 64 nt, Human
ucuacuucacuguaauguugcuuuucuuauuuuagucgggcaaaccucuuguugaucauagucu

SEQ ID NO: 35648 - RNA, 64 nt, Human
agcccccucaccuaugggaagcugacuucccucagucgggcacuucucaugggggcugaacaug

SEQ ID NO: 35649 - RNA, 64 nt, Human
cagaugcucuugggguucauaggggcagguccuagucgggcagggccccugacccucccggccu

SEQ ID NO: 35650 - RNA, 64 nt, Human
aaccauccagugacaaaccauccaguggagguuugucgggcaccagccagcguagcagggucgg

SEQ ID NO: 35651 - RNA, 64 nt, Human
accugggcuuggaacacagugacucccuggaguagucgggcagcccagauggcacugaucacug

SEQ ID NO: 35652 - RNA, 64 nt, Human
ccuuagcuccccucccaggccucugugggcccuugucgggcacagaugggaucacaguaaauua

SEQ ID NO: 35653 - RNA, 64 nt, Human
uccugugcugcgaugggggaucagcagggcaguugucgggcaguccugaguggguguugcacag

SEQ ID NO: 35654 - RNA, 64 nt, Human
agugaguuucuuugcagugagcagugcaguggaagucgggcacagagguagcagacagauguga

SEQ ID NO: 35655 - RNA, 64 nt, Human
gacauacauauuaucucauuuuacacaaagggaagucgggcaugguggcucaugccuguaaucu

SEQ ID NO: 35656 - RNA, 64 nt, Human
ugcaugcaaacaagaaacgugucacacuugugacgucgggcauucauauaggaagaacgcggug

SEQ ID NO: 35657 - RNA, 64 nt, Human
gcuugccaggacuccugagcagguaggcucuagagucgggcaguccaauaacuuuuuugcaaua

SEQ ID NO: 35658 - RNA, 64 nt, Human
ggguaguguccuucaaguggguggcgaagagccagucgggcauaugucaugaagguuucuccga

SEQ ID NO: 35659 - RNA, 64 nt, Human
gaggaggaagaaaaugaagaaggagugauugaaugucgggcaaggcacuggcugagcugcugug

SEQ ID NO: 35660 - RNA, 64 nt, Human
aucccuuucucugaauggagagauugagagggaugucgggcaguucccauuagauuuaguggcc

SEQ ID NO: 35661 - RNA, 64 nt, Human
ccgaggcccacaggugcugcccuugcugcugcuggucgggcacccaagugcgugaggggcuuca

SEQ ID NO: 35662 - RNA, 64 nt, Human
gcugcccaucccagucccucgccgucccucccaggucgggcaguggaggcugcugugaaaacuc

SEQ ID NO: 35663 - RNA, 64 nt, Human
cuuuaucauccuauucauccuggagaggaaaagugucgggcaaagggggaucuggggggagcuc

SEQ ID NO: 35664 - RNA, 64 nt, Human
gccacauagggccagugguagggguucccucuaugucgggcagugcugagggcugggaugcucu

SEQ ID NO: 35665 - RNA, 64 nt, Human
cauagagcagcgcggcacaguggccucaccucccgucgggcacuggcgggagcaaggucggggg

SEQ ID NO: 35666 - RNA, 64 nt, Human
agcgccagugguaggguagaagaaaacagcuguggucgggcacgguggcucacgccuauaaucc

SEQ ID NO: 35667 - RNA, 64 nt, Human
ucuguuugcuuuaaauaacucuuuacaaauaagggucgggcacgguggcucacgccuguaaucc

SEQ ID NO: 35668 - RNA, 64 nt, Human
cuaccaagggacaccugccugcaaaggcuguugugucgggcaguguggaagucaggaccuugcu

SEQ ID NO: 35669 - RNA, 64 nt, Human
ccuagggaacccauuuccggggaacgccgugacugucgggcagccuggagcuuccugcagccuc

SEQ ID NO: 35670 - RNA, 64 nt, Human
ggcucccgccuguccggcagggcccagggccagcgucgggcacagggcagcucccacuggucuc

SEQ ID NO: 35671 - RNA, 64 nt, Human
uguggguccgggggguggggggguggggagaagggucgggcagggggugcaggggaggaaacuc

SEQ ID NO: 35672 - RNA, 64 nt, Human
uaagugugcccacccguguucuccuccaaaugcugucgggcaagauagcuccuucaugcuuuuc

SEQ ID NO: 35673 - RNA, 64 nt, Human
caucucuacaaaacaucaaaaaaaaaaaaaauuagucgggcaugguggugcacaccuguaaucc

SEQ ID NO: 35674 - RNA, 64 nt, Human
gaggaacuggaaggugcuuuaggucugguucagggucgggcauucuuuguuguuugcacaucuu

SEQ ID NO: 35675 - RNA, 64 nt, Human
gcauuucgaaccuuccaguccagaggaagggacugucgggcacccccuuccccgcccccacccc

SEQ ID NO: 35676 - RNA, 64 nt, Human
ggcccccagccugguccacuaaaugcagccuguggucgggcagacagcauugggguccauuagg

SEQ ID NO: 35677 - RNA, 64 nt, Human
agcuccgcuucugucaguauuugcaaccaagguggucgggcaaaguauugccaggagauacuga

SEQ ID NO: 35678 - RNA, 64 nt, Human
gucaccccaagucuuccagcugguggaucugggcccagcaaagacuguucuccucccgagggaa

SEQ ID NO: 35679 - RNA, 64 nt, Human
uuuugcccccguggggcucccggcauccugaaagccagcaaagccuccagcaucuuuuccaucc

SEQ ID NO: 35680 - RNA, 64 nt, Human
accccaacucugcccuucucccauccaagagaaaccagcaaaaugauaaagaagcuaaccugcc

SEQ ID NO: 35681 - RNA, 64 nt, Human
aaguagcugggaugacaggcgcacaccaccacgcccagcaaauuuuuuguauuuuuaguagaaa

SEQ ID NO: 35682 - RNA, 64 nt, Human
gagauaggaaugaguucuuaucuaguguugcaggccagcaaauacagaggugguuuaaucaaac

SEQ ID NO: 35683 - RNA, 64 nt, Human
accuuaacuaugacuaagaaauuaaagaagaaaaccagcaaacuaaaacuucugggcagcaaaa

SEQ ID NO: 35684 - RNA, 64 nt, Human
cugucuguuuaacagacaguccauaucugugaggccagcaaauauuuucuuaaacucaugggga

SEQ ID NO: 35685 - RNA, 64 nt, Human
gccugaaaacuguuuucacuggguuccaccagucccagcaaaauccucuuuguauuuauuuugc

SEQ ID NO: 35686 - RNA, 64 nt, Human
uuccuucugauucugccugaauagcugagagguuccagcaaaagcuugaagucuugccuggaga

SEQ ID NO: 35687 - RNA, 64 nt, Human
caagagagaacaaaggucagagauguugaagauuccagcaaauuucuccucuuauuucuaccaa

SEQ ID NO: 35688 - RNA, 64 nt, Human
cuuagagauugcauuuuuauuaaagcauuuccuaccagcaaagcaaauguugggaaaguauuua

SEQ ID NO: 35689 - RNA, 64 nt, Human
auuagggaguuauuugguaagcaaaucaauauaaccagcaaagauaccugcuucuucuauauga

SEQ ID NO: 35690 - RNA, 64 nt, Human
guuaugaucuugcuuccaacucccaccuguauguccagcaaacucuugcauguggccacuagga

SEQ ID NO: 35691 - RNA, 64 nt, Human
agaguucaccguaggcaucuuuaauaaacuaacuccagcaaaauguggguacguuacuaacaca

SEQ ID NO: 35692 - RNA, 64 nt, Human
ccuucccuuucccuguccccccgccccacgccugccagcaaagccucgcuaaccccauuacaac

SEQ ID NO: 35693 - RNA, 64 nt, Human
aagauggaacucgaaaucccaaugaaaaaccuacccagcaaagaagcauagcuuuuagcucuaa

SEQ ID NO: 35694 - RNA, 64 nt, Human
uggcuccuuggcucccagcagccgcugaccauagccagcaaaagaccuggcagguccugaauca

SEQ ID NO: 35695 - RNA, 64 nt, Human
ccuugcacugagguccuggaggccuugaugaggcccagcaaacaggcauucucacagcuggguu

SEQ ID NO: 35696 - RNA, 64 nt, Human
aaaaaaaaaguuugguguuuuuaaccaugcuguuccagcaaagaugauaccuuaaacucccacu

SEQ ID NO: 35697 - RNA, 64 nt, Human
uuuguuuuuaguauuuaguguagauguacacauuccagcaaauguauuugcaauuaugugguug

SEQ ID NO: 35698 - RNA, 64 nt, Human
auuuccagucuucuaccccugcaguuauccuaguccagcaaagucauuucuuucaaaagagaca

SEQ ID NO: 35699 - RNA, 64 nt, Human
uaugcuuuaggucucaauuuuggaauuucaaacaccagcaaaaaauuggaaaucgagauagguu

SEQ ID NO: 35700 - RNA, 64 nt, Human
aggaauuuguuuaaauaacauuaugggauugcaaccagcaaaacauaaacugagaaaaaguucu

SEQ ID NO: 35701 - RNA, 64 nt, Human
agccuuuuggguaugauuagagugaaaauggcagccagcaaacuugauagugcuuuugguccua

SEQ ID NO: 35702 - RNA, 64 nt, Human
ugucugaaaacugcaaagugaacuuaacugagauccagcaaacagguucuguuuaagaaaaaua

SEQ ID NO: 35703 - RNA, 64 nt, Human
guccagaggggucuggagcuuuguuuccuguucaccagcaaaaaaugucucucccauuuuucug

SEQ ID NO: 35704 - RNA, 64 nt, Human
caugguuuuugaagauagcuaguuuuauccaucuccagcaaagaaucaucaauaguuuauauug

SEQ ID NO: 35705 - RNA, 64 nt, Human
auggacgugucaaugacuugaaaaaaagucacauccagcaaaugcagggucacaugaaauaugg

SEQ ID NO: 35706 - RNA, 64 nt, Human
guauauuuuugugauguguaccauacugugugcuccagcaaauguccauuuguguaaauguauu

SEQ ID NO: 35707 - RNA, 64 nt, Human
ugugacauuuugguugagcagaauguacguuagaccagcaaaauguuccuaaugguucuaacuu

SEQ ID NO: 35708 - RNA, 64 nt, Human
ggcuggugaaguucucacauaggcugauuuaaauccagcaaaggucuauagaaaaaggcuugcg

SEQ ID NO: 35709 - RNA, 64 nt, Human
cagccccacucauccucucggauguucugcaggcccagcaaacucaucauguccaaagugaaac

SEQ ID NO: 35710 - RNA, 64 nt, Human
auucaaggcccgugauacagggaugaggucagcaccagcaaacucuggacugguggaagaauuc

SEQ ID NO: 35711 - RNA, 64 nt, Human
gcauccugccacccacacagcagccuccaggauaccagcaaauggaugcggugacaaauggcag

SEQ ID NO: 35712 - RNA, 64 nt, Human
cugaauuagcagaaauaacgauaucuaaagcuuaccagcaaaagaacccucagcagaauagcaa

SEQ ID NO: 35713 - RNA, 64 nt, Human
uaggauggggcagagacuuguugcaucuuuguccccagcaaaggcuacauguuaccuccuucaa

SEQ ID NO: 35714 - RNA, 64 nt, Human
guacacaucuccagcuauucagacagauggacccccagcaaaucaggaccuaucuaggcagacc

SEQ ID NO: 35715 - RNA, 64 nt, Human
auggcauuauagcuuuugaagaaaggccagugauccagcaaagggggaaaaauaugcauuucac

SEQ ID NO: 35716 - RNA, 64 nt, Human
aaguagcugggauuauaggcaugugccaccaugcccagcaaauuuuguauuuuuuuuugguaga

SEQ ID NO: 35717 - RNA, 64 nt, Human
uuuaaggcuugaaaaugccuccuguagucccaaaccagcaaagaacugguuaaaugugccagca

SEQ ID NO: 35718 - RNA, 64 nt, Human
ccaagggaaggauaaaucaaggcucaaggcuuccccagcaaagauuagggaaagagacuugacc

SEQ ID NO: 35719 - RNA, 64 nt, Human
ccuguguuguuacaggcugugcagugcaacaauuccagcaaaaauacccuauccccgcacuuag

SEQ ID NO: 35720 - RNA, 64 nt, Human
accuucaugaccuuaucaacuuuacacccauaucccagcaaaugccacucauccccacucuuca

SEQ ID NO: 35721 - RNA, 64 nt, Human
agagagggguguuucuguggguacuccucuuaccccagcaaauaaaaggaauugucugacccua

SEQ ID NO: 35722 - RNA, 64 nt, Human
auaaaguggccguaugggaauuuaguucauucauccagcaaacauugaguaccaauuauuugcu

SEQ ID NO: 35723 - RNA, 64 nt, Human
gauucugggaaaaugaaagaaaagagauaugaugccagcaaagggauggaaagucuagaggaca

SEQ ID NO: 35724 - RNA, 64 nt, Human
ucucuuaguucuucucuaacauaguacuuucuuuccagcaaaagcaaaauguguuuucagauuu

SEQ ID NO: 35725 - RNA, 64 nt, Human
cacauccuguguuucuagggaaaugaaagaaaggccagcaaauucgcugcaaccuguugauagc

SEQ ID NO: 35726 - RNA, 64 nt, Human
auuuuggauuuugaaucaagcaauauggaagcaaccagcaaauuaacuaauuuaaguacauuuu

SEQ ID NO: 35727 - RNA, 55 nt, Human
augaccagauggagucuuaacacuuccagcaaacucaaucucagcgugugaccaa

SEQ ID NO: 35728 - RNA, 64 nt, Human
cuucuugacuacguaguuggagcuauuucuucccccagcaaagccagagagcuuuguccccggc

SEQ ID NO: 35729 - RNA, 64 nt, Human
accgggcuggagggugaccuuggcugugugcgucccagcaaaagagcucuggcccgcaucucgc

SEQ ID NO: 35730 - RNA, 64 nt, Human
gauguacugguuaauuuugcauggcuucuuaaggccagcaaaaugcuggcaguuuucuuuaucu

SEQ ID NO: 35731 - RNA, 64 nt, Human
aauauuuaucuccaaagucgaaugagaaagaacuccagcaaauccaauggcuacaaacuaaaaa

SEQ ID NO: 35732 - RNA, 64 nt, Human
caacauggagaucugcacuccugauaggaguuccccagcaaaaguagaggagacuuccccucua

SEQ ID NO: 35733 - RNA, 64 nt, Human
acucaccauagagacccaugucagcaaacggugaccagcaaauccucuucccuuauucuaaagc

SEQ ID NO: 35734 - RNA, 64 nt, Human
auuucaaaaacuuucuauuccuuucuuaaaccuaccagcaaacuaggauugugauagcaaugaa

SEQ ID NO: 35735 - RNA, 64 nt, Human
gacacauugcccagaauguuuuguaaaaugaagaccagcaaauguaggcugaucuccuucacag

SEQ ID NO: 35736 - RNA, 64 nt, Human
caacaaaaaacaaccauuugaaaaauuuuugucaccagcaaaacuuuucacuaauuagugauau

SEQ ID NO: 35737 - RNA, 64 nt, Human
aagaauuuguccauuugcauucggaaaagaaugaccagcaaaagguuuacuaauaccucucccu

SEQ ID NO: 35738 - RNA, 64 nt, Human
ucccacccucggucauaucauugagaucaccguaccagcaaaucugcaaaccaagcacuuuguu

SEQ ID NO: 35739 - RNA, 64 nt, Human
auaguuagcuuuauugaagucuucuuaucuaaacccagcaaaacagauucaaagcgaacagucc

SEQ ID NO: 35740 - RNA, 64 nt, Human
cuuguaaugaucgaauacccacucugauguuuugccagcaaagggauaucuaauauuucagaag

SEQ ID NO: 35741 - RNA, 64 nt, Human
cugaugagaaauagggaauacucccaguccaggcccagcaaaaccaaaaugcuaagcaaugaau

SEQ ID NO: 35742 - RNA, 64 nt, Human
ugucccagugaaacaggcuaaauaaauuuuggcaccagcaaauuuguuacuuuguuuuuuuaau

SEQ ID NO: 35743 - RNA, 64 nt, Human
aacuauugaaacaccuuaaucugugguuacuaauccagcaaauucaaggaaccaggcuaugacu

SEQ ID NO: 35744 - RNA, 64 nt, Human
ugcacgaccccugaaucugcugagaggcaccaguccagcaaauaaagcagucaugauuuacuua

SEQ ID NO: 35745 - RNA, 64 nt, Human
caaggcaaggauuugccaaaaauguucugggggcccagcaaaugcaggagccgaccuggggcug

SEQ ID NO: 35746 - RNA, 64 nt, Human
aaaauggcuuaagauguuuuucagauccugaauuccagcaaaagagcuauugccaaccaguuug

SEQ ID NO: 35747 - RNA, 64 nt, Human
uauuuuuaaguaguaugacuaaaauaaagaugaaccagcaaaaggucaguuugcacauuuguaa

SEQ ID NO: 35748 - RNA, 64 nt, Human
ugguauuuguucugugcauuuuuagcaacuucuaccagcaaauaaaguauucucaguaaaacga

SEQ ID NO: 35749 - RNA, 64 nt, Human
auucacgugugaaguuguucauuuuauauugugcccagcaaagaaacuuucacccaguucaggu

SEQ ID NO: 35750 - RNA, 64 nt, Human
cuguguuaacuauucuuuggaauucuccuucuguccagcaaauacucuaaugaugguuaaacau

SEQ ID NO: 35751 - RNA, 64 nt, Human
cauuaaucaaugaaagugccuucgcagacuuuugccagcaaauguuaucauuauuuuuuuauac

SEQ ID NO: 35752 - RNA, 64 nt, Human
ccucacagcgcagcaagugaggcucccacaggcaccagcaaaacaacggaugaauguagcccuu

SEQ ID NO: 35753 - RNA, 64 nt, Human
aucugucuuuucacccacggagggcacagaaccaccagcaaagccggcggcuggacuggcgccc

SEQ ID NO: 35754 - RNA, 64 nt, Human
uugauuggauugacuuuuuugcauuaaauuuuucccagcaaaauaaaucauauggcgagucagg

SEQ ID NO: 35755 - RNA, 64 nt, Human
acuugaucuauguuaugaaauaaguagcaaauugccagcaaaaugucuuguaccuuuucuaaag

SEQ ID NO: 35756 - RNA, 64 nt, Human
gaccagaauuaucuuuguacuaaaagagaaguuuccagcaaaacccucaucagcauuacaagga

SEQ ID NO: 35757 - RNA, 64 nt, Human
gaagaagaaacagcagaaagcagucucagguaaaccagcaaauuuggcucgauaauaucgcugg

SEQ ID NO: 35758 - RNA, 64 nt, Human
ucuauauuggucauugccuugccaaacaggagcuccagcaaaagcgcaggaagagagacuggcc

SEQ ID NO: 35759 - RNA, 64 nt, Human
aaucaucucugucacauuagacuauccaucaugaccagcaaauacucauuuuaggaaaaaaaaa

SEQ ID NO: 35760 - RNA, 64 nt, Human
gacccuuaguaacaaacacaauuuauauaaugacccagcaaaacacaucacaucuuacugucga

SEQ ID NO: 35761 - RNA, 64 nt, Human
augaagauggagcagaaugagcagaugcagaucaccagcaaagugcacugaugugugagcucuu

SEQ ID NO: 35762 - RNA, 64 nt, Human
acuucucuacuccauuauuucucuacuuuuccuuccagcaaaccugaaacgugagggagaugga

SEQ ID NO: 35763 - RNA, 64 nt, Human
gaggcugaccuuccugaucauacacacacacagcccagcaaaagccucuccugaaccaaacaaa

SEQ ID NO: 35764 - RNA, 64 nt, Human
aaagagcagagaucucucugggcccuagacauuuccagcaaaaccuggaacuuucaugccaaac

SEQ ID NO: 35765 - RNA, 64 nt, Human
ugaaggaguacacaaaccagagaaugacaugaauccagcaaauaggauccaacacaggcaauau

SEQ ID NO: 35766 - RNA, 64 nt, Human
ugcccuuuuuagggaagcuguuggagaaaauacuccagcaaaaugaaggaguacacaaaccaga

SEQ ID NO: 35767 - RNA, 64 nt, Human
caccaccacccccccuuauuuuuuuuauccuaaaccagcaaacgcaggaccuguaccaauuuua

SEQ ID NO: 35768 - RNA, 64 nt, Human
aagaauggagugaagaaaggcaguauggcaggcaccagcaaagaguugagggcuguugcucuua

SEQ ID NO: 35769 - RNA, 64 nt, Human
uccugaacacuguguauuuauuuuauuuagacuaccagcaaagauuaaagcaugaaauguaaaa

SEQ ID NO: 35770 - RNA, 64 nt, Human
augcucuuaaaaagggaguaacaccuauaacaugccagcaaaagaggugacuguaucaaguagu

SEQ ID NO: 35771 - RNA, 64 nt, Human
uuccacaaccgcccacugagcagcaaggcugcagccagcaaagaggugcggaggcaagcaagcu

SEQ ID NO: 35772 - RNA, 64 nt, Human
gaauuuguuucuaguuuggugaugccuaacuuuuccagcaaagaugauggaaaauaguuauaua

SEQ ID NO: 35773 - RNA, 64 nt, Human
aauagagcaacacaaaggccucgaaaagaggucuccagcaaaaggcucugcaagugcaaagacc

SEQ ID NO: 35774 - RNA, 64 nt, Human
guuugcuguauacaaacaggugcuaacacuguucccagcaaaguuuucagauuguaaagguagg

SEQ ID NO: 35775 - RNA, 64 nt, Human
guuuauuaauguauauaaacuuauaaauauuucuccagcaaauuugaggaagcaugauauauuu

SEQ ID NO: 35776 - RNA, 64 nt, Human
guaugagguguuugcugcucugccacguagagagccagcaaagggaucaugaccaacucaacau

SEQ ID NO: 35777 - RNA, 64 nt, Human
uaauccaggcuucagcaacacuccucuuucccagccagcaaaggcugugaauuugaauucuuug

SEQ ID NO: 35778 - RNA, 64 nt, Human
gcuuaggcagacaucgaaccucucugggauguuuccagcaaaagugagcuuuucuaaucgucuc

SEQ ID NO: 35779 - RNA, 64 nt, Human
aacuccugcacaaguuuuaacugaacaagaaaucccagcaaaaggcauuuuuuuuucuacuucu

SEQ ID NO: 35780 - RNA, 64 nt, Human
gcucacagcugugcucugagugccuagcggaguuccagcaaacaaaauggacucaagagagauu

SEQ ID NO: 35781 - RNA, 64 nt, Human
ccauagauuugaagaucugauuuauaccauuauaccagcaaagagaauguauuuccuuuucuaa

SEQ ID NO: 35782 - RNA, 64 nt, Human
gaaggaaaacacccuuuccaaagcaaauuccccuccagcaaauaaagcaugaaauauacagaaa

SEQ ID NO: 35783 - RNA, 64 nt, Human
gggaaaggauucaguggaggcuggcagggucccuccagcaaagcucccgcggaaaacugcuccu

SEQ ID NO: 35784 - RNA, 64 nt, Human
uucauaaucccaaucuaauuaugagcuaaaacauccagcaaacucaaguugaaggacauucuac

SEQ ID NO: 35785 - RNA, 64 nt, Human
cucuaaauuuauucagaucguuaacauggguaacccagcaaauauuucccagcagugacaaucu

SEQ ID NO: 35786 - RNA, 64 nt, Human
gucaucuaaaggccaccaggaacacaccuguagcccagcaaaguugaggccaucgacuggcuca

SEQ ID NO: 35787 - RNA, 56 nt, Human
gcagaacuggaccaggaugaaaaggaccagcaaaauacaucucgccugguacagga

SEQ ID NO: 35788 - RNA, 64 nt, Human
caggagagcaaggcacuugcaguagugaucuaugccagcaaaacaucauuuugagacaaacauu

SEQ ID NO: 35789 - RNA, 64 nt, Human
cucuaagauaagaggccaggccagucaguuuggcccagcaaacauguggguacuucuccaccua

SEQ ID NO: 35790 - RNA, 64 nt, Human
uuagauuucuaucucuuguaagucacucuuuuaaccagcaaaggacuuucaucuuagauuaucc

SEQ ID NO: 35791 - RNA, 64 nt, Human
uuaauuacuagcuuucuauuaccauuauauguaaccagcaaauauauuuuuccuuagcccuucu

SEQ ID NO: 35792 - RNA, 64 nt, Human
ucugcccuguggaguauggccgugaguccccgccccagcaaagacuuccaugcggagcucuggu

SEQ ID NO: 35793 - RNA, 64 nt, Human
ugauaauccuggacaugggugaacaugaggagaaccagcaaaaucugugguguuugacaucacu

SEQ ID NO: 35794 - RNA, 64 nt, Human
ccuaagcuuagaguucuuuuauauaccucuacggccagcaaaaugcucaggucugcucuuggua

SEQ ID NO: 35795 - RNA, 64 nt, Human
acaggauccuauucucaccaggaaggggguccacccagcaaagagugggcugcaucugggauuc

SEQ ID NO: 35796 - RNA, 64 nt, Human
auaaaggaaaauuacggaaggaaaauaggcaacaccagcaaauuauauguggacagguucuaaa

SEQ ID NO: 35797 - RNA, 64 nt, Human
ugcaagcgacaggaaaggcccucugcuuuucuucccagcaaagguuggccuuacgaaauccuuu

SEQ ID NO: 35798 - RNA, 64 nt, Human
acaguuugaaagggacugaggcucacccaggucuccagcaaacggaggacugaacuggggagag

SEQ ID NO: 35799 - RNA, 64 nt, Human
cuucuuauuuaagacuucccaccuuacuaaauuaccagcaaaacaaaccacucuccuguuugag

SEQ ID NO: 35800 - RNA, 64 nt, Human
acucaguggugccccugcaguugggugggguacgccagcaaaggaucaguuuggcugccuuauc

SEQ ID NO: 35801 - RNA, 64 nt, Human
gagugaagguguuugaaaugcaggagaggauaucccagcaaauugggaucacaugcuuuugucu

SEQ ID NO: 35802 - RNA, 64 nt, Human
ccuauuuuaaaucucagagugauccugcugacugccagcaaagguuuguaauuaagaagggacu

SEQ ID NO: 35803 - RNA, 64 nt, Human
uuuuuuaauuuuaaaaugcaacccugcccccuccccagcaaagucacagcuccauuucaguaaa

SEQ ID NO: 35804 - RNA, 64 nt, Human
cauuuuauggcuccucccucccauguccucagacccagcaaaagcguagaggcagaauuagagg

SEQ ID NO: 35805 - RNA, 64 nt, Human
acauuuuacgaagcaauuuuaaucuuaaacacauccagcaaauggugucccugcugaaacuuuu

SEQ ID NO: 35806 - RNA, 64 nt, Human
auucaaucgcccaacuacccagacgauuaccggcccagcaaagucugcaucuggcggauccagg

SEQ ID NO: 35807 - RNA, 64 nt, Human
uugagaagucuacauugcuuacauuuuaauugagccagcaaagaaggcuuaaugauuuauugaa

SEQ ID NO: 35808 - RNA, 64 nt, Human
guccaugcggccucacugggggccaucagccucaccagcaaagcagagaugagagcgugggaac

SEQ ID NO: 35809 - RNA, 64 nt, Human
gauuuucacguauuaggcacuuuaguugaaucuuccagcaaaagcugucuacuuucucuuuuau

SEQ ID NO: 35810 - RNA, 64 nt, Human
ucaguagaugcuauuauucauaagaacugugauuccagcaaacuaggguaauuggugccuuuuu

SEQ ID NO: 35811 - RNA, 64 nt, Human
aagcaaaugcuaaggggaacauacauguaaaaagccagcaaacuaucuucaaacucuuccgucc

SEQ ID NO: 35812 - RNA, 64 nt, Human
ccuucugggcuaacuccaagguccagcagaguguccagcaaaaguaggcguuagagcauucaac

SEQ ID NO: 35813 - RNA, 64 nt, Human
guuuuaagaccucaguaaccauuucagccucuuuccagcaaacccuucuccauaguauuucagu

SEQ ID NO: 35814 - RNA, 64 nt, Human
auuuaaaaaccucaguaaucguuuuagcuucuuuccagcaaacucuucuccacaguagcccagu

SEQ ID NO: 35815 - RNA, 64 nt, Human
aaaaagaaacaaaugaaaaaaauuuuagaacaguccagcaaauugcuagucagggugaauugug

SEQ ID NO: 35816 - RNA, 64 nt, Human
uugaacuacaugugacuacuuaaguuucagguuaccagcaaaagccggguuucauuaucauaau

SEQ ID NO: 35817 - RNA, 64 nt, Human
gauacugaauguauacguauugugccugagcucaccagcaaacagaagcaucaagcccaggggu

SEQ ID NO: 35818 - RNA, 64 nt, Human
ugccacuuagacauaauccauuccacucauuauuccagcaaacacuuacugacaaaucgggucc

SEQ ID NO: 35819 - RNA, 64 nt, Human
acauauaucauuauuauauaaaucaugaugcuagccagcaaagaugugaaaauaucugcucaaa

SEQ ID NO: 35820 - RNA, 64 nt, Human
acaacaaugcuaaaauugagcagauugauaacugccagcaaaccauagauuuaagauaaaugaa

SEQ ID NO: 35821 - RNA, 64 nt, Human
gagucauggaauugucaaaguaagccuucccucaccagcaaauugucuccugaucugaaugaau

SEQ ID NO: 35822 - RNA, 64 nt, Human
ucauauuucauauucauauuucaaaccacaauauccagcaaaaugucuccugagcacccagaac

SEQ ID NO: 35823 - RNA, 64 nt, Human
aaacaauguuaaggauugucuuaaaguuccuuagccagcaaaacaaaacaaaacaaaacaaaca

SEQ ID NO: 35824 - RNA, 64 nt, Human
aucucuuuuuaacaucaugugcgucucuugggauccagcaaaaguguuaagccacaaugcccuu

SEQ ID NO: 35825 - RNA, 64 nt, Human
uguugggauuacaggcaugagccacugcgccuggccagcaaaugcuuuuugugcagaauacacu

SEQ ID NO: 35826 - RNA, 64 nt, Human
ucaaaugcacacaggccuaguugaaguuuaaaccccagcaaaacauuccucccuguaaauggaa

SEQ ID NO: 35827 - RNA, 64 nt, Human
ggcccuaggaggcccucugaggagagcuagagucccagcaaagggugcagcugacccuagcacu

SEQ ID NO: 35828 - RNA, 64 nt, Human
gguuggugggacagccaggccagaugaccugauuccagcaaaaauaaaacucagauuugggcaa

SEQ ID NO: 35829 - RNA, 64 nt, Human
uauagaaucuuacagcaucuuugacaaacaucucccagcaaaagugccgguuagucagguuugu

SEQ ID NO: 35830 - RNA, 64 nt, Human
uaaauaacucgaucuguacccagcuggguagcagccagcaaaggccaucagacaaccagaagca

SEQ ID NO: 35831 - RNA, 64 nt, Human
gggaccacccgagcuaaucauggaaugucuguucccagcaaacacgauaaagaaagauugugca

SEQ ID NO: 35832 - RNA, 64 nt, Human
acucugcuguccaggcacugcuuggcuuacuaucccagcaaagacugcaguuuuguggacuuuu

SEQ ID NO: 35833 - RNA, 64 nt, Human
accaggggaacugguuaugaauaugugaaugcaaccagcaaauuuauccuugaaggugugaugg

SEQ ID NO: 35834 - RNA, 64 nt, Human
gcagauacccauaaccuauguugagccuugcuuaccagcaaagaauauuuuuaauguggauauc

SEQ ID NO: 35835 - RNA, 64 nt, Human
cuugcugaagacagcuuuuucugagacacagcugccagcaaaccugagggaaagagagaagauu

SEQ ID NO: 35836 - RNA, 64 nt, Human
ggggaaaagaggaaauaauacaguaaucguuaauccagcaaaaagaaaugaaaagggaaaacca

SEQ ID NO: 35837 - RNA, 64 nt, Human
ggcaccuggcagcauauuuucugugacaauguguccagcaaaucauucuucaacuacauuuuag

SEQ ID NO: 35838 - RNA, 64 nt, Human
cauggcauacuuuucauguuuuaauuuuuuucuuccagcaaaauaaacacugaggcccuaaaaa

SEQ ID NO: 35839 - RNA, 64 nt, Human
auuccagucugggcugaugucccagccucccauaccagcaaaaugcccccugcuucccuaaggg

SEQ ID NO: 35840 - RNA, 64 nt, Human
cacuguuaguugaagaaaaagcaguucccaggugccagcaaagaccaucuuucauaacugucac

SEQ ID NO: 35841 - RNA, 64 nt, Human
cucauauaaacaagugccauugaguuucaaaugaccagcaaauauauuuagaacccuuccuguu

SEQ ID NO: 35842 - RNA, 64 nt, Human
accauaaugcagagugggcccccuacuccauuucccagcaaaaggcuccagcuggagggauggg

SEQ ID NO: 35843 - RNA, 54 nt, Human
agagaugcacucuccagugacuccccagcaaacacaaggugcagcaggguccca

SEQ ID NO: 35844 - RNA, 64 nt, Human
agugugugggguauggggcagcagaggcagccagccagcaaagaggggccacugagcaccaggg

SEQ ID NO: 35845 - RNA, 64 nt, Human
cacccccaccuuggaaggagauaaggagggggccccagcaaaagccacuggacacacagcucug

SEQ ID NO: 35846 - RNA, 64 nt, Human
guggcuuuuacuuuuuaaauggcauauuaacaagccagcaaagugugucagaccauggcguggu

SEQ ID NO: 35847 - RNA, 64 nt, Human
aucagggcuuaauuagaacaggcuguauuuccucccagcaaacaguuguggccacacuaaaaac

SEQ ID NO: 35848 - RNA, 64 nt, Human
cauaguugagcccugauugccacagacccagcacccagcaaaucccucucuaccucccaaggug

SEQ ID NO: 35849 - RNA, 64 nt, Human
cuauuggucuggcucuaacaguuuguuuguucauccagcaaauguuuaugagugaugaccaugu

SEQ ID NO: 35850 - RNA, 64 nt, Human
gcauuauguucuuaacuccuuaauguggaauuuuccagcaaaauguuuaacucaggugugauuu

SEQ ID NO: 35851 - RNA, 64 nt, Human
ugaggaccucgugucccaaaagacuuugccuaucccagcaaaacacacacacacacacacacac

SEQ ID NO: 35852 - RNA, 64 nt, Human
ggacuccagggguggcugggagacugggcagccaccagcaaacagacccuguggccccugcccg

SEQ ID NO: 35853 - RNA, 64 nt, Human
gaagacaagucucaccaacccagggagucaaggaccagcaaaccaaaguggauaauggacuuuu

SEQ ID NO: 35854 - RNA, 64 nt, Human
aaagacaagugcucaagcagcaaaauccuuacuuccagcaaaauccaaacugcugucucuuaaa

SEQ ID NO: 35855 - RNA, 64 nt, Human
cugucgggccccccgacgccgccccauuucccuuccagcaaacucaacucggcaauccaagcac

SEQ ID NO: 35856 - RNA, 64 nt, Human
ugcugucuugucuccugggacgagaaggacucauccagcaaaguugccugggauucaaaauaaa

SEQ ID NO: 35857 - RNA, 64 nt, Human
ucucaguuauuuuccucccuugcccuugcaaucuccagcaaaaggugggaucuaggaagaaaga

SEQ ID NO: 35858 - RNA, 64 nt, Human
ucuggccaagauuugccagaggcaacaucaaaaaccagcaaauuuuaauuuugucccacagcgu

SEQ ID NO: 35859 - RNA, 64 nt, Human
accaaauuaccuaggcugagguuagagagauuggccagcaaaaacugugggaagaugaacuuug

SEQ ID NO: 35860 - RNA, 64 nt, Human
uauaguauagcagugcaggaacaaacagcacuugccagcaaagucuguguguacuguuaagugu

SEQ ID NO: 35861 - RNA, 64 nt, Human
uugcaccagguaauaggggaaaauugugugaccuccagcaaacacaugaaugguuauuuccugg

SEQ ID NO: 35862 - RNA, 64 nt, Human
ggccuccccgcagucccugccuagccccucugccccagcaaaugcccagcccaggcaaauugua

SEQ ID NO: 35863 - RNA, 64 nt, Human
cgaccaaugucuguaaagugcuuugaggaucuccccagcaaagcaccuucagaauguaucgaca

SEQ ID NO: 35864 - RNA, 64 nt, Human
auaugguuauauauaugggaugguuugguuggucccagcaaaguauaugaaaauuaaaguucug

SEQ ID NO: 35865 - RNA, 64 nt, Human
uauauuauacgguaaauauaguaucgucugcauuccagcaaaaauaucaacucguaaggcacua

SEQ ID NO: 35866 - RNA, 64 nt, Human
aguuucaaguaccuauucaaaauuuuauuaaaaaccagcaaauuaauuuuaaucucuagccaua

SEQ ID NO: 35867 - RNA, 64 nt, Human
agacaccaggcuucaggcauggccaugagcaagaccagcaaauaacagcuuuuugccuugcagc

SEQ ID NO: 35868 - RNA, 64 nt, Human
caaaguucaaguucaaagcuguucaaguuuccuaccagcaaauagcccuaacuugccucuagag

SEQ ID NO: 35869 - RNA, 64 nt, Human
aaacagauugagucaagugacuaugacagcucuuccagcaaaggcaaaaagagugaggaggggg

SEQ ID NO: 35870 - RNA, 64 nt, Human
gggaaaauagaaaauaacauuauuaaguguaaaaccagcaaaguacuuuuuuaauuaaacaaag

SEQ ID NO: 35871 - RNA, 64 nt, Human
ccaucagaaauuggcagucacuucccagauuguaccagcaaauacacaaggaauucuuuuuguu

SEQ ID NO: 35872 - RNA, 64 nt, Human
uguucugaaugcucuaagugcuugcacaccucacccagcaaaacaaaagcuguguggcucccca

SEQ ID NO: 35873 - RNA, 64 nt, Human
ggagcuuuagcuucucugccaagcccucaauaagccagcaaaccaggacucugccccuucuguu

SEQ ID NO: 35874 - RNA, 64 nt, Human
uaucucucucaguugguuuuugauagaacagaggccagcaaacuuucuuuguaaaaggcugguu

SEQ ID NO: 35875 - RNA, 64 nt, Human
gggagugagcuagucaaaugugaaaaaugcucucccagcaaagcugagacaaaauuggagaagc

SEQ ID NO: 35876 - RNA, 64 nt, Human
uugaacagggccuugaagggugugcaggaguucgccagcaaagccaggcaggccaagacuugag

SEQ ID NO: 35877 - RNA, 64 nt, Human
aauguuguacgugaagauucuaggaggggagggaccagcaaaucugagagaaccguccuggggc

SEQ ID NO: 35878 - RNA, 64 nt, Human
gaaauccaauuuagauuauuuuuagaguauuuuuccagcaaauucaauuuauucugaaauuuaa

SEQ ID NO: 35879 - RNA, 64 nt, Human
uaaaauagggcuugaauuucucauucuguauagaccagcaaacuucccugugcaaggcaaguuu

SEQ ID NO: 35880 - RNA, 64 nt, Human
gaucucuagcccagcuacagcagaauacauuuuaccagcaaaccuaaggaugacaaacacuauc

SEQ ID NO: 35881 - RNA, 64 nt, Human
gagucuuucuguaggguagaaagaagccuccuacccagcaaaccaguagacccaaaaguugaaa

SEQ ID NO: 35882 - RNA, 64 nt, Human
uauuauuaauaaugaaguagaaguuacuuaauugccagcaaauaaauacgugucaaaaaagaau

SEQ ID NO: 35883 - RNA, 64 nt, Human
ucaguagucauuguguuaacuauaaagucaagugccagcaaagaacuuuaaaacuguaaagcug

SEQ ID NO: 35884 - RNA, 64 nt, Human
caggaacccuggcugguccuggaagugacaaaaaccagcaaauucaauucuuugcaggcugagu

SEQ ID NO: 35885 - RNA, 64 nt, Human
gaucacuuauuaaaaauccuuauuuucuccaagcccagcaaacguugacuucugggcaaaccug

SEQ ID NO: 35886 - RNA, 64 nt, Human
ucgucacaucaaugcaaaagguccugauuuuguuccagcaaaacacagugcaauguucucagag

SEQ ID NO: 35887 - RNA, 64 nt, Human
ugucagggaggcauuaaaaauuuggaaauguaugccagcaaaaugugagcucuguauuuuuugg

SEQ ID NO: 35888 - RNA, 64 nt, Human
cugggaccaggaagccgcagcugucccaucauccccagcaaauccuagaaguggagucuggaua

SEQ ID NO: 35889 - RNA, 64 nt, Human
aauuguuuuauagugcauacaaaucagcgaucagccagcaaauauuuuucuuugagcuugugaa

SEQ ID NO: 35890 - RNA, 64 nt, Human
ggagggguucgagccccugguucuguaucuucagccagcaaacgaaaccauaucgcaaaccaga

SEQ ID NO: 35891 - RNA, 64 nt, Human
ugcuacagcuugaccuaccaguauuccggaguaaccagcaaaugcaaaguugaccuuguuccug

SEQ ID NO: 35892 - RNA, 64 nt, Human
uugccacaucuugaucugcucagcccuggaggugccagcaaagccccaugcuggagccugugua

SEQ ID NO: 35893 - RNA, 64 nt, Human
ucuaaagaccaaacuucacucugggcacacucugccagcaaagaggacucgcuuguaaauacca

SEQ ID NO: 35894 - RNA, 64 nt, Human
ugccuuacuuuuuaauauguauuuauaaaguauuccagcaaaagaggauguagccucugggaaa

SEQ ID NO: 35895 - RNA, 64 nt, Human
guggcauuuggcaccucugucccagauacguuugccagcaaagcugcugcccuccaggauguau

SEQ ID NO: 35896 - RNA, 64 nt, Human
ccacaaagaagccaaaggucagucccucugcuccccagcaaacggugccucccaggcauucuca

SEQ ID NO: 35897 - RNA, 63 nt, Human
cagugauguaaaccucacuuuauuaaaaaauuauccagcaaacaaaaugggaaugugguguua

SEQ ID NO: 35898 - RNA, 64 nt, Human
ggguucauucauucauuccauaagaaacuuaauaccagcaaaugcauuaaaucccuugccaguu

SEQ ID NO: 35899 - RNA, 64 nt, Human
ucgagcccugggcgggggucagucaagccgugguccagcaaacuccucugcagauggcuggagu

SEQ ID NO: 35900 - RNA, 64 nt, Human
gaaagggaggguggagggugaggccaaaucagguccagcaaaagucaguagggacauugcagaa

SEQ ID NO: 35901 - RNA, 64 nt, Human
aaaccacaccagggaggaaaaaugacauucagaaccagcaaacacugaauuucucuuguuguuu

SEQ ID NO: 35902 - RNA, 64 nt, Human
agaaagugagagaggcaaucaugccaagaacaagccagcaaagcucuuucaccagauguagacu

SEQ ID NO: 35903 - RNA, 64 nt, Human
ugacugacacuaagucuagcacacagcacuugggccagcaaauccuggaaggcagacaaaaaua

SEQ ID NO: 35904 - RNA, 64 nt, Human
uccuguuugaagaaaaaggacaaauaaaacauggccagcaaauacagcuccuguuucacucuug

SEQ ID NO: 35905 - RNA, 64 nt, Human
gucaugcaggacaccuaggagcacccaggcuugcccagcaaacccugcgugccauucuucuacc

SEQ ID NO: 35906 - RNA, 64 nt, Human
uuauuauuuuucaagauaaggagaaagaaaguacccagcaaaugggcauuuuacaagaaguacg

SEQ ID NO: 35907 - RNA, 64 nt, Human
cugcugcccaggcccagaccuucuaggacgccacccagcaaaagguuguuccuaaaauaagggc

SEQ ID NO: 35908 - RNA, 64 nt, Human
gguagacugcuccugcagaguuuggaagaagucaccagcaaagccggccuaaccaagaaaaguc

SEQ ID NO: 35909 - RNA, 64 nt, Human
gaagugugccuguuuauuauguagauacagacauccagcaaaaacaggagaaucacaugcuuua

SEQ ID NO: 35910 - RNA, 64 nt, Human
gucagcccucccaaccucccuuccagggggcuuaccagcaaagccauauucggcuaggaauuug

SEQ ID NO: 35911 - RNA, 64 nt, Human
ggggguuggccauuuaugcugacaugccauccuuccagcaaacguacgggaaugugcuuucaau

SEQ ID NO: 35912 - RNA, 64 nt, Human
aguuuuggagguugggagguccaaggucaaggcaccagcaaauuuggugucuggugaggguccu

SEQ ID NO: 35913 - RNA, 64 nt, Human
cugggaggccagacggcacgaggucuccaaggccccagcaaagccauggcuucuaccccuaguu

SEQ ID NO: 35914 - RNA, 64 nt, Human
aguacagucuugacaauaguagcaaacuacuaacccagcaaaucuaagcccaaggaagaagggc

SEQ ID NO: 35915 - RNA, 64 nt, Human
cugcagcauggaucagcaaggcucuuucguucuuccagcaaaggcuuccaagguacaacucaaa

SEQ ID NO: 35916 - RNA, 64 nt, Human
ggcucuaaaguuccuauaguccugagacccccugccagcaaagagugacagucaccuccaugcc

SEQ ID NO: 35917 - RNA, 64 nt, Human
gagguggcuuucugaggccuggaaggcaggccaaccagcaaaauccugauaacaagacucugug

SEQ ID NO: 35918 - RNA, 64 nt, Human
aaguuauagcuacauaugggagagacucagugagccagcaaaggccauagaaacaacaauuuau

SEQ ID NO: 35919 - RNA, 64 nt, Human
ggcuguucgggacugagagcgccaagggucuuugccagcaaaggagguucugccuguaauugag

SEQ ID NO: 35920 - RNA, 64 nt, Human
gcaacugugucucccugugcuauauuuaauuccaccagcaaagcuggcgaggcagggcccagcc

SEQ ID NO: 35921 - RNA, 64 nt, Human
aucagcagccaggggcgagcacuaguggacaaagccagcaaaugcggcguuccugugagcagau

SEQ ID NO: 35922 - RNA, 64 nt, Human
gcuuuuccagcccacaaagggggacgaucacggcccagcaaaagcgaugcugagaggggaaaca

SEQ ID NO: 35923 - RNA, 64 nt, Human
agccccucgacucgucccguggccgccuguuuuuccagcaaaccacgcuaacuagcugaccaca

SEQ ID NO: 35924 - RNA, 64 nt, Human
agccuuugguucaguaaacgacccagggugguucccagcaaagcugcuuccucucugcuccuac

SEQ ID NO: 35925 - RNA, 64 nt, Human
ccgguggccaucuuuuccuacuaccuagagaaagccagcaaagaaugaaggcaacaaaggaaac

SEQ ID NO: 35926 - RNA, 64 nt, Human
cuauuuugauaaguauuagagguuaaccuuaaauccagcaaaacauuaaaacagaaacuuuuca

SEQ ID NO: 35927 - RNA, 64 nt, Human
ucuucaucaagaaaaaguggaaccagcugucccuccagcaaaaacagcagcccuaauagcagcc

SEQ ID NO: 35928 - RNA, 64 nt, Human
aauaagccgucaaguaguaagaagaacuuggaugccagcaaagagaauggggcugggcagaucu

SEQ ID NO: 35929 - RNA, 64 nt, Human
ugcacagcagcucggugcccaagaacuggccaagccagcaaagcgggagcccugaaaaauuagg

SEQ ID NO: 35930 - RNA, 64 nt, Human
ggacagucugcaagcccgccuaggagguccauccccagcaaauguuuuggagguccccccagag

SEQ ID NO: 35931 - RNA, 64 nt, Human
agaagggcuucaaagauauaggguguggcuccuaccagcaaacagcugaaagaggaggaccccu

SEQ ID NO: 35932 - RNA, 64 nt, Human
acaccccucugcccagcucaccacaucuucaucaccagcaaacgccaggacuuggcucccccau

SEQ ID NO: 35933 - RNA, 64 nt, Human
cgcacagguauguggaccgagugacugaauuccuccagcaaaagcugaagcagucccagcugcu

SEQ ID NO: 35934 - RNA, 64 nt, Human
ugucucuucguacucgguuauuaaauggccuagcccagcaaaugaucagccuugcaaauaauca

SEQ ID NO: 35935 - RNA, 64 nt, Human
gacaaauuagcaugcaagcuuggucaaacuuuuuccagcaaaauggaagcaaagacaaaagaaa

SEQ ID NO: 35936 - RNA, 64 nt, Human
uagcggaugaccaccaggcucucaucugggacauccagcaaaugccccgagccauugaggaccc

SEQ ID NO: 35937 - RNA, 64 nt, Human
ucuuggaaacagacggcggcaccuuuccucuaauccagcaaagugauucccugcacaccagaga

SEQ ID NO: 35938 - RNA, 64 nt, Human
ugccagggagcacugccagcuugccaguuucugcccagcaaaagcacguaugcuucaggggccu

SEQ ID NO: 35939 - RNA, 64 nt, Human
augacaggcuggcagcuauguucagagaauuuacccagcaaaauguaaguucuugauugggugg

SEQ ID NO: 35940 - RNA, 64 nt, Human
aagaaaaucauaggccaagauagggaggggcauuccagcaaaccccguguuaaugcuacugugg

SEQ ID NO: 35941 - RNA, 64 nt, Human
acuggugcuauagaaauugagaugcccccccaggccagcaaauguuccuuuuuguucaaagucu

SEQ ID NO: 35942 - RNA, 64 nt, Human
auccauuucguguuuuuuccugucaaacauuaauccagcaaauauaugagguauuuaccaauuu

SEQ ID NO: 35943 - RNA, 64 nt, Human
uauagccaucauguuucuaagagacuuggagacaccagcaaacugcuagaacucaaacucuuca

SEQ ID NO: 35944 - RNA, 64 nt, Human
accuccugaguuuauuuuuccagagauuccagggccagcaaagccggcguucagaaggagggag

SEQ ID NO: 35945 - RNA, 64 nt, Human
ugucucuaauuuggccucuguggcaagaccacgcccagcaaaaguggucggcugcagugccagg

SEQ ID NO: 35946 - RNA, 55 nt, Human
uucagauggacaccaguuaaacagaccagcaaauccgcgugcggaacaggaccca

SEQ ID NO: 35947 - RNA, 64 nt, Human
aggugccugguuugcagcaggcucuccgcucuuuccagcaaagcugcucagagaggguguccag

SEQ ID NO: 35948 - RNA, 64 nt, Human
gcugcccguuccugccaguuccucacugcggggaccagcaaaggccuucucacuggguugguca

SEQ ID NO: 35949 - RNA, 64 nt, Human
gcaaucaaugauagguuuauaaucuuagauuauuccagcaaaguguggauugcauuguuaggaa

SEQ ID NO: 35950 - RNA, 64 nt, Human
cugcaaggagcaagcaacgguggcccuguccaccccagcaaauaagaagcauaucuguagcuua

SEQ ID NO: 35951 - RNA, 64 nt, Human
gcugcagguugcagucagggcuugaaguaggagcccagcaaagaaccaccugcuggacaguccu

SEQ ID NO: 35952 - RNA, 64 nt, Human
caggccaggucgggagcacagccgcuccccaaacccagcaaaccggcagagagccgguuuccca

SEQ ID NO: 35953 - RNA, 64 nt, Human
agguagcuaguacuauaggugugcaccaccacgcccagcaaauuuuuaaauuuauuauagagug

SEQ ID NO: 35954 - RNA, 64 nt, Human
ggagugaccacaaagccugaaaacacuuugccacccagcaaagaacuggcacaauugguuuggg

SEQ ID NO: 35955 - RNA, 64 nt, Human
ucacaaguggguacccccaggaccagaagcucccccagcaaagcccccagagcccaggcucggc

SEQ ID NO: 35956 - RNA, 64 nt, Human
augguuuauucuuucuaacuccauauaagcuuuuccagcaaagauuguaauaacacauuuaugu

SEQ ID NO: 35957 - RNA, 64 nt, Human
uguuuuuuuaaaaaaagaaguggagguguuuacaccagcaaaauacucauuuuuuaaguguaau

SEQ ID NO: 35958 - RNA, 64 nt, Human
ccugccugacccccaggcuucucucuccuuucucccagcaaacugcaguggcagaaaggagguu

SEQ ID NO: 35959 - RNA, 64 nt, Human
uuucugcagcagaaagacccucauugucaguuucccagcaaaagucccagggcagacucucauu

SEQ ID NO: 35960 - RNA, 64 nt, Human
gaggcucgggcuuguuugaggguucacgaccccuccagcaaaggagucugaggcugauuccagu

SEQ ID NO: 35961 - RNA, 64 nt, Human
ugauacccaggcagauauggucuggaguggaccuccagcaaacuccagcagaccugcagccgag

SEQ ID NO: 35962 - RNA, 64 nt, Human
cccggaguaggggggcucgggaccaugaggaugaccagcaaaauucaagaacaaaacugcucca

SEQ ID NO: 35963 - RNA, 64 nt, Human
ugcuguggaaaccuggcuuauucuucuaaagccaccagcaaauugugccuaagcgaaauauuuu

SEQ ID NO: 35964 - RNA, 64 nt, Human
uuuaauugaugaugacagaggacacagguuuuugccagcaaaaaggaaaaccaaggcuuggugg

SEQ ID NO: 35965 - RNA, 64 nt, Human
gcagggaauacaggggagaggguuguccuuccccccagcaaaugcaauaaugcccucaccccuc

SEQ ID NO: 35966 - RNA, 64 nt, Human
cuuuuugugccaugaguuagccaugguccuggacccagcaaaaagaaugauuaugauggucaga

SEQ ID NO: 35967 - RNA, 64 nt, Human
aaaacuggggucccagcaacccuggcccccaaccccagcaaaucucuaacaccuccuagaggcc

SEQ ID NO: 35968 - RNA, 64 nt, Human
ggcuggggucccccccacugccagcugcaaggaaccagcaaagacauuuaccagagucugggau

SEQ ID NO: 35969 - RNA, 64 nt, Human
gagaccgagggucccagaggaccaaugcuacaagccagcaaaugcugccacaucucugccugau

SEQ ID NO: 35970 - RNA, 64 nt, Human
cugggcaguagagucagucuccaucucaaagaaaccagcaaacaaaaaauauuaaaaaaaaaca

SEQ ID NO: 35971 - RNA, 64 nt, Human
cucaguauugagacacugucaagauuaaguuauaccagcaaaagugcaguagugucacuuuuuu

SEQ ID NO: 35972 - RNA, 64 nt, Human
agauggauuugacacacucaccauuuaaucauuuccagcaaaauauauguuuggcugaaauuau

SEQ ID NO: 35973 - RNA, 64 nt, Human
cgccugccggugaagagcugcagaugccgagaagccagcaaacacagggcccacuggaaaaaaa

SEQ ID NO: 35974 - RNA, 64 nt, Human
gacgcucauucuucuuccuauuguucccugacauccagcaaauugugaauuugaaaaaugaugg

SEQ ID NO: 35975 - RNA, 64 nt, Human
uaauaagucauuauuauauuuuucagcccuucauccagcaaaucagaaggacucaguacaaacu

SEQ ID NO: 35976 - RNA, 64 nt, Human
aaaauggcuuguugccaauauggccacaacauugccagcaaauacugccuuggcaucacucagc

SEQ ID NO: 35977 - RNA, 64 nt, Human
ccaaacacgcuccauguauauauucuucugauggccagcaaaugaaauucugccuagaaauuaa

SEQ ID NO: 35978 - RNA, 64 nt, Human
uucccagcaggaagagcauuauauucucuuuguaccagcaaauuaauuuaacucaacucacaug

SEQ ID NO: 35979 - RNA, 64 nt, Human
guguaaucgcauuucugcuugguagaggccgagcccagcaaagguggcuccuucugaaugugug

SEQ ID NO: 35980 - RNA, 64 nt, Human
cauucccacccagcgcgcagucuccaccucggccccagcaaagcgcuaagcagccggagagaca

SEQ ID NO: 35981 - RNA, 64 nt, Human
gcuguugugugaucaaacaugucucuguguaguuccagcaaaucaagcugagcuuugaaaaagu

SEQ ID NO: 35982 - RNA, 64 nt, Human
acacacggugcagcaucagggaccuucccaggccccagcaaauucaagucggucugcagaccuc

SEQ ID NO: 35983 - RNA, 64 nt, Human
cugccagggagaugggacccuugugccaccugggccagcaaagaggagggguccagagaacagc

SEQ ID NO: 35984 - RNA, 64 nt, Human
accugaaggagaacuaccuccagaaccgacaguuccagcaaaagcagcggcccgagcagaagau

SEQ ID NO: 35985 - RNA, 64 nt, Human
uugccaaccauauuggaucugcuugcuguccaaaccagcaaacuuuccugggcaaaucacaauc

SEQ ID NO: 35986 - RNA, 64 nt, Human
cauuuuccuaggguuaacaccucaccaaguucuuccagcaaaaugcuuauuagaguuuuugucu

SEQ ID NO: 35987 - RNA, 64 nt, Human
ccugugugcaugucagggcucggccgggaagaagccagcaaagucccccgugucccuugcugag

SEQ ID NO: 35988 - RNA, 64 nt, Human
ugaugucauggcuggacaaagucacggaguaaagccagcaaagccacccucuuccuguguaguc

SEQ ID NO: 35989 - RNA, 64 nt, Human
gagcugacggugucccuggagcagugaggggacaccagcaaaaaccuucagcucucagaggaga

SEQ ID NO: 35990 - RNA, 64 nt, Human
accguucaccaccaucuccagcugcucacagacgccagcaaagcaguaugcucccgaucaagua

SEQ ID NO: 35991 - RNA, 64 nt, Human
accguucaccaccaucuccagcugcucacagacaccagcaaagcaaugugcuccugaucaagua

SEQ ID NO: 35992 - RNA, 64 nt, Human
gcuguucaccaccaucuccagcugaucacagacaccagcaaagcaaugcacuccugaccaagua

SEQ ID NO: 35993 - RNA, 64 nt, Human
cugcgugucccacagacgcuuguuccagggggcuccagcaaaccccuucguggucucucaaagg

SEQ ID NO: 35994 - RNA, 64 nt, Human
aacugcacccaggaggugacugggaaggagaaaaccagcaaaggaagcucugccuuuuauaauu

SEQ ID NO: 35995 - RNA, 64 nt, Human
ugagacagcagggcccaggggaguggaccagcccccagcaaauuaucaccaucugugccuuugc

SEQ ID NO: 35996 - RNA, 64 nt, Human
aucgaugguccugcuugccagagaguuccucuacccagcaaaaaugagugucucagaagugugc

SEQ ID NO: 35997 - RNA, 64 nt, Human
uucugccaggcaggcccuuccucccuuggcccaaccagcaaagcgccccucagucuucaagggc

SEQ ID NO: 35998 - RNA, 64 nt, Human
auucuaggcccgugauacagggaugaggucagcaccagcaaacucuggacugguggaagaauuc

SEQ ID NO: 35999 - RNA, 64 nt, Human
uuaggugugcauucggcugcaaauaacagaaaacccagcaaacacugaagggcuggauaagaac

SEQ ID NO: 36000 - RNA, 64 nt, Human
uaagucacuaaguuuugggcagcaugauaacaacccagcaaaaagcuaacugauacauugauua

SEQ ID NO: 36001 - RNA, 64 nt, Human
aaguugucuuuguagaaaaugaagagccuuucuuccagcaaaaaucccugcuguaugcaauagc

SEQ ID NO: 36002 - RNA, 64 nt, Human
ucuaagcagugagaaucuuuucuaugccucuauuccagcaaaaaguagaaguaucaaauaaaaa

SEQ ID NO: 36003 - RNA, 64 nt, Human
ccugcacaggcauccuucccuuuauagauugauuccagcaaaggcggaauaaaacaaauuuccu

SEQ ID NO: 36004 - RNA, 64 nt, Human
augaacuugucaugaacaaauucaaauguuuaugccagcaaauuuuuguacuguugcauaguua

SEQ ID NO: 36005 - RNA, 64 nt, Human
aaaucacuacacucuuagagaaucccucuguucuccagcaaacaugggauguaaagccucacag

SEQ ID NO: 36006 - RNA, 64 nt, Human
gcccaauacacacagcuccauuaugcaauccauuccagcaaauuccccgugucuguggucacca

SEQ ID NO: 36007 - RNA, 64 nt, Human
augcaauuguagguucaaccugucccuuucccugccagcaaaccccaccacccuaagagaaauu

SEQ ID NO: 36008 - RNA, 64 nt, Human
aauguggcccugguuucuuuucccacaugaaccuccagcaaauagcaaguccaggaaaaacucu

SEQ ID NO: 36009 - RNA, 64 nt, Human
aauggaccccgcaacccuguccucugcugggcccccagcaaacucuagcaauagcagcugcugc

SEQ ID NO: 36010 - RNA, 64 nt, Human
gcagucaauguauuaagcaaagcaaaccugccagccagcaaauucaaauaaaaaauaaagcauu

SEQ ID NO: 36011 - RNA, 64 nt, Human
uauccccuaaaggccacuuccuaucugauuuuucccagcaaaugaggcaggcaauucuaagauc

SEQ ID NO: 36012 - RNA, 64 nt, Human
gguuaaucugcuauaucaaacuccuucccugaaaccagcaaacaccgggaaacauuuuggcuca

SEQ ID NO: 36013 - RNA, 64 nt, Human
ucucuguguaccaccucugcugucucagaugcccccagcaaauaaacacucuucucguugguca

SEQ ID NO: 36014 - RNA, 64 nt, Human
auccuggcucacugcaaccuccaccucccggguuccagcaaauucuccugccucagccucccaa

SEQ ID NO: 36015 - RNA, 64 nt, Human
cuuccucgacaacgugcgagaacccugacgucccccagcaaaggaagacguugcaagcaggcaa

SEQ ID NO: 36016 - RNA, 64 nt, Human
auuccuacacugguggaagcaauuaaggaacaagauggaagagaaguggacugggaguauuuuu

SEQ ID NO: 36017 - RNA, 64 nt, Human
uuaaucucugcaguucaucucauuucaaauguuuauggaagaagcacuucauugaaaguagugc

SEQ ID NO: 36018 - RNA, 64 nt, Human
cggcgggcacagcuggcuggggcuguuccggggcauggaagauucccagucacccacucacuca

SEQ ID NO: 36019 - RNA, 64 nt, Human
gcugguuagccggaaaaggccucgggcuuggcaaauggaagaacuugagugagaguucagucug

SEQ ID NO: 36020 - RNA, 64 nt, Human
ccuaaggucugccagccaggcuccuggcugggcaauggaagaugguguggcccuguuagucucc

SEQ ID NO: 36021 - RNA, 64 nt, Human
gaccugcuucugucacagcacugaucacacugagauggaagacuccagggggcaaggaccaagg

SEQ ID NO: 36022 - RNA, 59 nt, Human
aguccaaagaagcauauugacccugcccaauggaagaaccaggaagauguggucauuca

SEQ ID NO: 36023 - RNA, 64 nt, Human
ggggccgauucugaucaagacacauggcuugaaaauggaagacacaaaacugagagaucauucu

SEQ ID NO: 36024 - RNA, 64 nt, Human
uuuuucuugaaauggauauguacaaauaaaauaaauggaagacaggauaacucuuuuucuauuu

SEQ ID NO: 36025 - RNA, 64 nt, Human
guaugaucucagccucaguucucuugucuguaaaauggaagaacuggauuaggcaguuuguaag

SEQ ID NO: 36026 - RNA, 64 nt, Human
uucuccgaauuuguacuugcucugguaaaaugaaauggaagacaggaaucuuuuaguaaaauag

SEQ ID NO: 36027 - RNA, 64 nt, Human
uuuuucguauauaauuauuuccaucauauucuuuauggaagaugcaauuaauuuuaacuuuuuu

SEQ ID NO: 36028 - RNA, 64 nt, Human
agacaucacuuggauuucuuaaucuuaaaugcuuauggaagaugugaaguugaggugcugcauu

SEQ ID NO: 36029 - RNA, 64 nt, Human
guuguggcuuauguggaguuuacaugggccucugauggaagaaagcuaaucuguuuaguauuug

SEQ ID NO: 36030 - RNA, 64 nt, Human
caccuaaagaggcuaugcuacagucucuagcuaaauggaagacacauucauccuucucccucug

SEQ ID NO: 36031 - RNA, 64 nt, Human
ucuaacuggagggacugugauccuuccaccuuggauggaagaggcuuaccugacagccagccug

SEQ ID NO: 36032 - RNA, 64 nt, Human
cuggggacaccugagaguaguauaguagugcaaaauggaagacugauuuuugacucuauuauaa

SEQ ID NO: 36033 - RNA, 64 nt, Human
uaggucaugcaagugagaaagacaucugaggaaaauggaagaccuaaggcagacaggaaggaag

SEQ ID NO: 36034 - RNA, 64 nt, Human
auuagagugagagagagaauaaggagccuuucuuauggaagaaaugggagaagagagacagggu

SEQ ID NO: 36035 - RNA, 64 nt, Human
ucugaccuuguaccucucuuugaugguaaccauaauggaagagauucuggcuagugucuaucag

SEQ ID NO: 36036 - RNA, 64 nt, Human
uacccuuuuuacugaaaguaagugacuuaaaaggauggaagaaaaacuacaugguuggaguguu

SEQ ID NO: 36037 - RNA, 64 nt, Human
uuucugauuuuccuauaaguaaaagaucuccuaaauggaagaugcacagaguagauuuacaaug

SEQ ID NO: 36038 - RNA, 64 nt, Human
gcuguuauugcuggaaucagaggagauaacauauauggaagauaaagugaauaaaaguacuuug

SEQ ID NO: 36039 - RNA, 64 nt, Human
aaacaaagggugaaugaagaagaacaaucaugaaauggaagaaggaggaagagcaugaaggauc

SEQ ID NO: 36040 - RNA, 64 nt, Human
ucauguguuuaaauuauuuuaucacaaacuuaacauggaagauauuccuuuuuaacuuuguggu

SEQ ID NO: 36041 - RNA, 64 nt, Human
ggaaucccacacuucacaccaccggcugaauuucauggaagagguucugauaauuuuuuuaacu

SEQ ID NO: 36042 - RNA, 64 nt, Human
uuuuguguuuuguuaagcaugucccuuggcccaaauggaagaggaaauguuuaauuaaugcuuu

SEQ ID NO: 36043 - RNA, 64 nt, Human
aucugaggccacuugcaacauugugacaaagaagauggaagauagcagccuacugggcugugag

SEQ ID NO: 36044 - RNA, 64 nt, Human
acaaagguuacuaauuguaugauaguguuuuuauauggaagaauguacagcuuauggacaaaug

SEQ ID NO: 36045 - RNA, 64 nt, Human
cauuuugucuauuugcuguugauuguaccaagggauggaagaaguaaauauagcucagguagca

SEQ ID NO: 36046 - RNA, 64 nt, Human
ugcccaaaagaacacaaaagccuuuuuccauuguauggaagauaguuuuuaagacauuugaaac

SEQ ID NO: 36047 - RNA, 64 nt, Human
ugacagugauucaucacuggugaugauaaaaaugauggaagaagaguugaaagucacuuuuuuc

SEQ ID NO: 36048 - RNA, 64 nt, Human
gaacacguuugucuugauaaaaguuggaugacguauggaagauucgaaccugcagcacugaugu

SEQ ID NO: 36049 - RNA, 64 nt, Human
agaaaugaguccugauagacugaaaauugagcaaauggaagaagauacaguauuguuuagauca

SEQ ID NO: 36050 - RNA, 64 nt, Human
aacucacaagagaacucaucauaaguacuugcugauggaagaaugaccuaguugcuccucucaa

SEQ ID NO: 36051 - RNA, 64 nt, Human
uuacaauuagcaucgugauccaagcagaugccacauggaagaggaaucgccauuuacucagaaa

SEQ ID NO: 36052 - RNA, 64 nt, Human
cucgagucagggccccagccacccaacagacaagauggaagaaggaccuugcagaggacgaaga

SEQ ID NO: 36053 - RNA, 64 nt, Human
acaaacacacacaccucuccuucauucacguccuauggaagagaccauaaaggcuucaaaacua

SEQ ID NO: 36054 - RNA, 64 nt, Human
ucagcauguaucuguagaaauaacuuuuuaguuaauggaagaauucaccaauuuuaaaguuuug

SEQ ID NO: 36055 - RNA, 64 nt, Human
aguuucugccgcagcccugcagagggcacagaaaauggaagacagcucuuauauugccauuucu

SEQ ID NO: 36056 - RNA, 64 nt, Human
ggaugucugcuuaguuggcagggguucaguccaaauggaagaauauugggaaauaaaccuccac

SEQ ID NO: 36057 - RNA, 64 nt, Human
gacaggauuaccuaggcuugccugaacuuugggcauggaagaaagacuggaaacuaguuggaaa

SEQ ID NO: 36058 - RNA, 51 nt, Human
acuuuccagcaaacagaugacauggaagagaacaucauuuacuaguccucu

SEQ ID NO: 36059 - RNA, 64 nt, Human
cauuuaucccauuuauuucuucuuagugggcauuauggaagaauauauuaaaauguguaauaua

SEQ ID NO: 36060 - RNA, 64 nt, Human
uuuuuuuuuacaguuuaguguaucugguuucuacauggaagacuaaacucaugcuuauugcuaa

SEQ ID NO: 36061 - RNA, 64 nt, Human
ggcuugaaaugcuaugucugcaugauaauuuaaaauggaagauuuaaacuuugcacuccaaaag

SEQ ID NO: 36062 - RNA, 64 nt, Human
ggagagguaaugcaccccugaaggauaugaggggauggaagagagggcuggcugcccaagggaa

SEQ ID NO: 36063 - RNA, 64 nt, Human
aaaaguuagaagaaaugaguaccaacaggaaggaauggaagagaggagaggggcuaagacauug

SEQ ID NO: 36064 - RNA, 64 nt, Human
uuaguuaauaauacaguaggccuuuuguuuauuaauggaagaguacuccccacaccuaagacca

SEQ ID NO: 36065 - RNA, 64 nt, Human
uugacucaugauagacaaaguauaugccugcuggauggaagaaucucuugggcgagcaccauuu

SEQ ID NO: 36066 - RNA, 64 nt, Human
ugugguauucuggugaugggguuuagcaacuuugauggaagaaaauauuaggcuauaaaugucc

SEQ ID NO: 36067 - RNA, 64 nt, Human
augaucuuuaaacgcuauauuucagaaauauuaaauggaagaaaucaauaucauggagagcuaa

SEQ ID NO: 36068 - RNA, 64 nt, Human
ggaaccagggaagcagagagcagagcaugcagugauggaagaagcaggaaaagcaagaagaaaa

SEQ ID NO: 36069 - RNA, 64 nt, Human
aauccgggagguauucuggcuucccuaagaaacaauggaagagaaggagcuuggaugaggaaac

SEQ ID NO: 36070 - RNA, 54 nt, Human
acuaugaagaugcuauguaagguuauggaagauucugcucuuugaaaaccaucc

SEQ ID NO: 36071 - RNA, 64 nt, Human
uugggaaauuccaacuccuauaccuuaccagagcauggaagagcccagaucugaauguaaaacg

SEQ ID NO: 36072 - RNA, 64 nt, Human
cccaugagagcaguucuguggagauauaaaaagaauggaagaaggaaugccuuauagugauauu

SEQ ID NO: 36073 - RNA, 64 nt, Human
augcuagcugcaagugacaucucuuugaugucauauggaagaguuaaaacagguggagaaauuc

SEQ ID NO: 36074 - RNA, 64 nt, Human
cagauaugauauguaaacauaauucuuguauauuauggaagauuuuaaauucacaauagaaacu

SEQ ID NO: 36075 - RNA, 64 nt, Human
aacggauggugaccuauaaccauuaauguugaaaauggaagagacuugcuuccaaaagauuaaa

SEQ ID NO: 36076 - RNA, 64 nt, Human
guuguguggaaauguaugauccaacuagaaaugaauggaagaugaugggaaauaugacuucacc

SEQ ID NO: 36077 - RNA, 64 nt, Human
ggauaguaccugcaggaacaauauuccuguagccauggaagagggccaaggcucagucacuccu

SEQ ID NO: 36078 - RNA, 64 nt, Human
gggugaauuuuauguuuaaaugaagaagugaauuauggaagaagaguauacgaccuucccuucc

SEQ ID NO: 36079 - RNA, 64 nt, Human
gcugccaaagaagggucacaaaguguucuuccucauggaagaagugccucgggguugcagggcu

SEQ ID NO: 36080 - RNA, 64 nt, Human
aauaggucugcuccucacagcuuugggaaucugaauggaagaagaaaagagagaaguuaacaac

SEQ ID NO: 36081 - RNA, 64 nt, Human
gggaagagaagcugaugcagccggugcuccacccauggaagaaaggcuggcuguccuugggccc

SEQ ID NO: 36082 - RNA, 64 nt, Human
cauucugcuacagauggucccaaaaggagucaacauggaagagcugaguaaguagacugaauuu

SEQ ID NO: 36083 - RNA, 64 nt, Human
ccguuugcugcuuuuuucuggccuuuacaacagaauggaagagaaucauuuaagaguuccugua

SEQ ID NO: 36084 - RNA, 64 nt, Human
ccuccauguguggguccuuuguuuuauuagaaccauggaagaagguuccugggccaucaguaug

SEQ ID NO: 36085 - RNA, 64 nt, Human
aaggggacacccuggaaggucaacaucucauuuuauggaagagcgacucucuggagcuacuccu

SEQ ID NO: 36086 - RNA, 64 nt, Human
cggccauggauuugcccuugauucuauuuugcuaauggaagauagaaaggagagaagguuuuuu

SEQ ID NO: 36087 - RNA, 64 nt, Human
uguucccuuccugucuauccauugaguuuaugaaauggaagaguuaacugcaugcacuaguguu

SEQ ID NO: 36088 - RNA, 64 nt, Human
ccaguauauauagucuguucauauguaaaauucaauggaagagagguggaacagugcuguuauu

SEQ ID NO: 36089 - RNA, 64 nt, Human
gcagguguuaauuggaucccuuuccuucacugaaauggaagaguuuauaagcuuacguuaguau

SEQ ID NO: 36090 - RNA, 64 nt, Human
cgugaaagcucuccuaauacuuacuuaaauagccauggaagaaaauuaugcuugucccuucuga

SEQ ID NO: 36091 - RNA, 64 nt, Human
ucuuccuauccaggugaggcagagacacaaagauauggaagaacauuggacagauuuacaucga

SEQ ID NO: 36092 - RNA, 64 nt, Human
auugccaaucuuugaacucauucaacuccaggacauggaagaggccucucucugcccuuugacu

SEQ ID NO: 36093 - RNA, 64 nt, Human
uuccauauuuucuuuucagugaaaaauuuuuuaaauggaagacuguucuaaaaucacuuuuuuc

SEQ ID NO: 36094 - RNA, 64 nt, Human
uuucucagaaucuauucaguacccuauggaguacauggaagaaguauauuuuuggaaccaguaa

SEQ ID NO: 36095 - RNA, 64 nt, Human
agcaggggaaagaaaggcaacucgcaaagaugagauggaagaaggcacgugagcagaggaggca

SEQ ID NO: 36096 - RNA, 64 nt, Human
guucaugucuucucaaaauaugaaauauugauaaauggaagagcauacggugacaagucuccuu

SEQ ID NO: 36097 - RNA, 64 nt, Human
aagaaggaggcaggaagggagagucagagagagaauggaagauaccaugcuucuaauuuugaag

SEQ ID NO: 36098 - RNA, 64 nt, Human
uguaguucagauauuuaucacaaucauccucauuauggaagaccuuuuaaagcauuguuuuaga

SEQ ID NO: 36099 - RNA, 64 nt, Human
uuggugggcaauguaauacuuaauuaaaauaaugauggaagagcuaucuggagauuaugaguaa

SEQ ID NO: 36100 - RNA, 64 nt, Human
ugcucacuuacacuagagaaauaaacaacuuucaauggaagagaauuuuagugcuuuuuuuuuc

SEQ ID NO: 36101 - RNA, 64 nt, Human
ugaauuauguagaaggagacaaaugcugauugggauggaagaccaaccaagagaucaagcuauc

SEQ ID NO: 36102 - RNA, 64 nt, Human
caucuguugaaacuaggaaaauacccaaacuuaaauggaagaauucugaaagagaggauagaau

SEQ ID NO: 36103 - RNA, 64 nt, Human
gaagaauuccgagccagcccauuucuagaaugucauggaagaggaacgugcaacuacuauucaa

SEQ ID NO: 36104 - RNA, 64 nt, Human
cuuuguaagaguagggucgccaugaugcagccauauggaagacuaggauaugggucacacuuau

SEQ ID NO: 36105 - RNA, 64 nt, Human
gaagcuacaggaggaacuuucugacuuaucagcaauggaagaugcuuuggaugaguuaauuaag

SEQ ID NO: 36106 - RNA, 64 nt, Human
aacuaaaaugaacaugcuauucugucagcugaauauggaagagaucuuuuuuuacuagagaucu

SEQ ID NO: 36107 - RNA, 64 nt, Human
ugucaagaugggauuuggaagacaagugaaugcaauggaagauuuugaucaaaaauguaauuug

SEQ ID NO: 36108 - RNA, 64 nt, Human
guuaguuugcuuuaagcagguaacuuuuuuuguaauggaagaaaugcacuacaaaguuaagaca

SEQ ID NO: 36109 - RNA, 64 nt, Human
cagaugcuugcggcaaaaggaaagcuguguuuauauggaagaaaguaaggugcuuggaguuuac

SEQ ID NO: 36110 - RNA, 64 nt, Human
uuugacccucugaaaauuauuauacuucaccuaaauggaagacugcuguguuuguggaaauuuu

SEQ ID NO: 36111 - RNA, 64 nt, Human
ucuuuuccauacacugugugcuauuuguguuaacauggaagaggauucauuguuuuuauuuuua

SEQ ID NO: 36112 - RNA, 64 nt, Human
uagcaccauuaugaucaccaguauuguggcuggaauggaagaagaucaccuugguguuccuugu

SEQ ID NO: 36113 - RNA, 64 nt, Human
uggaaaaggagcagagagcuguccaucuggauugauggaagaaaagagaaccucauccaugccu

SEQ ID NO: 36114 - RNA, 64 nt, Human
cugagcuuucuucauggaaccucuugaaugauggauggaagagcuauaagaggugguaggcaua

SEQ ID NO: 36115 - RNA, 64 nt, Human
gucauccauauucuuacaggccuuccagucaauaauggaagagcucacucuauacaaaaccaau

SEQ ID NO: 36116 - RNA, 64 nt, Human
uauuucuuuuccugauguacagggguuaaguccuauggaagaaacagcagaauuauucaaaauu

SEQ ID NO: 36117 - RNA, 64 nt, Human
agaagacuaaccagcuuagucagaagaugguuccauggaagaaaaaggccaaggaguuugaaga

SEQ ID NO: 36118 - RNA, 64 nt, Human
ucggcauguagaccaagugaugagaagugaauacauggaagaguuuuuaagugugacuugaaaa

SEQ ID NO: 36119 - RNA, 64 nt, Human
gaaaaaagucaggaaaauauaucaaaucagaaacauggaagaagaagggaaccgauuugaguug

SEQ ID NO: 36120 - RNA, 64 nt, Human
accugugguccccacccuuuuugggaccaguuucauggaagacaauuuuuccguggauggggga

SEQ ID NO: 36121 - RNA, 64 nt, Human
uauacgucuauucuuuaugccuugcccuagccagauggaagaagaugaagaaggaaaccaggug

SEQ ID NO: 36122 - RNA, 64 nt, Human
agauucugauuugccacugauauucagaauuaugauggaagacaggaaaguucagaguuuucug

SEQ ID NO: 36123 - RNA, 64 nt, Human
cugaacaucugugugugucccccuaugcuccaguauggaagaaugggguggagggucgccacac

SEQ ID NO: 36124 - RNA, 64 nt, Human
agccauugaagacucugauauguuacaggagacaauggaagaauacaugaacaagccuacauuu

SEQ ID NO: 36125 - RNA, 64 nt, Human
gucucaaauaauauuuuuuuccuauuuuauacucauggaagagauaagcuaaagaggggacaau

SEQ ID NO: 36126 - RNA, 64 nt, Human
cuuaaggugguauaccuuccaaauccugguucagauggaagaaauagcaggagagaggacccau

SEQ ID NO: 36127 - RNA, 64 nt, Human
aguggagauuccuccuuaugauguaugcuagguuauggaagauguaaaauauucaacuuuuucc

SEQ ID NO: 36128 - RNA, 64 nt, Human
ccugccacagguuccuggaaagacucuccaggaaauggaagauacugauuuuuuuuuuuaaauc

SEQ ID NO: 36129 - RNA, 64 nt, Human
caggagugagccaccaugcccggcuggcaguugcauggaagagaacaccucuuuauggcuuacc

SEQ ID NO: 36130 - RNA, 64 nt, Human
agccaccgcgcccagcccuggagugauacuuuuuauggaagacaaaagccccccaaaucugugu

SEQ ID NO: 36131 - RNA, 64 nt, Human
ccuuuuuuaaaaucagcaugaugugccugugagcauggaagaguccucucagaagaauguuggc

SEQ ID NO: 36132 - RNA, 64 nt, Human
acaaaaaucaaauaaugcauaucagaaucuuuauauggaagaaauccuuuauugccuuuccuuu

SEQ ID NO: 36133 - RNA, 64 nt, Human
auguggccacugagcggcuccaucugaagguuugauggaagaagggcucuugaaacagaguuaa

SEQ ID NO: 36134 - RNA, 64 nt, Human
uuuugcuuccuaaagauuugaauuuuuuguucccauggaagaaguaaagaagaggucacuagau

SEQ ID NO: 36135 - RNA, 64 nt, Human
uagguaguauaaggcuuucucaaucagugcaaaaauggaagauauauaaagcaacaaguugucu

SEQ ID NO: 36136 - RNA, 64 nt, Human
guuacgggcgcuuuaaccaucagcugccucucgaauggaagaacagugguaauggauuaacauc

SEQ ID NO: 36137 - RNA, 64 nt, Human
gaauuugcaaagaguggaguggacaaagcucuguauggaagacugaacaacuguaaauagauga

SEQ ID NO: 36138 - RNA, 64 nt, Human
gguggcuucagugggguggagaguggccuccaugauggaagaugauaggggacucagccaucag

SEQ ID NO: 36139 - RNA, 64 nt, Human
ucucaguggagccuggcuuagggaacagggagcgauggaagaaugccaacauuagcguuggucu

SEQ ID NO: 36140 - RNA, 64 nt, Human
gaaacaaaccuagcauuuuuaaaaaauaagauuaauggaagacuuuaagguauuuuaaaauucg

SEQ ID NO: 36141 - RNA, 64 nt, Human
guaaaaaaaagauuguuuuguaacacauaaaaaaauggaagaaacugauaccacaccuaaggac

SEQ ID NO: 36142 - RNA, 64 nt, Human
cagugcaaccacacaccucaccagaauugugcaaauggaagacaaaauguuuucuucaucugug

SEQ ID NO: 36143 - RNA, 64 nt, Human
aaauuugaaggcauuuuugagcauuuccaauuauauggaagaguuacuucuacggaauaguuuu

SEQ ID NO: 36144 - RNA, 64 nt, Human
uuucuucaugaucagacauaaacuuagcaucuuaauggaagaaaaaugaggggaacuucaauua

SEQ ID NO: 36145 - RNA, 64 nt, Human
gggaauggaggauagcaugggauguauggagaggauggaagauuuucauguaaaauaaaauuaa

SEQ ID NO: 36146 - RNA, 64 nt, Human
guuuaaaaaacaaacaucgaaaggcuuaugccaaauggaagauagaauauaaaauaaaacguua

SEQ ID NO: 36147 - RNA, 64 nt, Human
ugugcaacucuuguauugcuccauuuucuugucaauggaagaaacccuuccacguguaugcaag

SEQ ID NO: 36148 - RNA, 64 nt, Human
gagagcuugcuaugugaacucacuccuuaagaaaauggaagagaaaaagagagugcuaguuaaa

SEQ ID NO: 36149 - RNA, 64 nt, Human
caagcugaugaagggaagccuuugccaauggcccauggaagacacuugguuugagaaacccugc

SEQ ID NO: 36150 - RNA, 64 nt, Human
aaaauuaaugguuuuucuccugaaauguuugugcauggaagaacugcccugcuuuuuuacccug

SEQ ID NO: 36151 - RNA, 64 nt, Human
cggcauuucaguaagagccucaggccuagucucaauggaagaagaauuuccgauccucaaguau

SEQ ID NO: 36152 - RNA, 64 nt, Human
uagaagccacucaguaggauagaagaaaagaaagauggaagaaggauccugggcuugaugacca

SEQ ID NO: 36153 - RNA, 64 nt, Human
cuuuuuaggucagguggagaaacacuaucgggaaauggaagagaaaucagcacugauuauccag

SEQ ID NO: 36154 - RNA, 64 nt, Human
guuuuaaugagaggaggcagagagagggaggcagauggaagaagaaaaacaguuaaauaagaca

SEQ ID NO: 36155 - RNA, 64 nt, Human
ugaaucagaugcuuugaguuuaaacccaccauguauggaagagcaagaaaagagaaaauauuaa

SEQ ID NO: 36156 - RNA, 64 nt, Human
auacacaagaaaugucauauuuuugaguuuuguaauggaagaaccaggcacagaaacagacaga

SEQ ID NO: 36157 - RNA, 64 nt, Human
uuuauuguagaguuuugcugguuuuguaaaauggauggaagaacuuuguauuuauacugugauu

SEQ ID NO: 36158 - RNA, 64 nt, Human
auaugguauauauacauauauauauauaacauauauggaagaggaaaaggcugguacaacggag

SEQ ID NO: 36159 - RNA, 64 nt, Human
acacacucagugacauuucuaucacaaucauuuuauggaagaugugugauaaucuguuuuuacu

SEQ ID NO: 36160 - RNA, 64 nt, Human
auuuguauuuggaucaaugagguuuuuaaaaaaaauggaagagaaaaccacuaaccuugauuuu

SEQ ID NO: 36161 - RNA, 64 nt, Human
auaguguaaaaauucccugagcuaagcuaaaaccauggaagaaacaugcuacuuuaguguuuag

SEQ ID NO: 36162 - RNA, 64 nt, Human
uaagcagaagaaccaaaauuucaaggguaggaagauggaagaaauagggaaagagcccuuuuau

SEQ ID NO: 36163 - RNA, 64 nt, Human
auaugccagaaccuguacuaaaugccuaauuuguauggaagagugcauauuuaaucucuuuucu

SEQ ID NO: 36164 - RNA, 64 nt, Human
gugugugugugugugugugugucuuuaguaggaaauggaagaacacuguuuuauuuuuuaaagu

SEQ ID NO: 36165 - RNA, 64 nt, Human
ccacucuuaggucugcucacucuuagaacacacaauggaagaggaaggguuuuuguuuucacuc

SEQ ID NO: 36166 - RNA, 64 nt, Human
gaccuauucagaguuucaucuggggaugaaagcuauggaagaugauguacaaauguuauugaug

SEQ ID NO: 36167 - RNA, 64 nt, Human
gagacaaugcucaguauucauucauacacagacgauggaagaagccacuucuucccugggcggu

SEQ ID NO: 36168 - RNA, 64 nt, Human
aagaguucuggauucaaaugucaguucauaauauauggaagauaauuuuauguguuauaguagg

SEQ ID NO: 36169 - RNA, 64 nt, Human
cgacgacaaggguccaggagaacugagacgcaggauggaagacagagaagaccccccggagcuc

SEQ ID NO: 36170 - RNA, 64 nt, Human
acccucacacauuauaggggcaucagagaauggcauggaagagacagucuacagagagcuuuaa

SEQ ID NO: 36171 - RNA, 64 nt, Human
cauaaaacugggaagaaagagaagacaguuggagauggaagaugguuuuguauauauuuuggaa

SEQ ID NO: 36172 - RNA, 64 nt, Human
cgugggaucagaaucuuccaacuuuagaggugcaauggaagacacuacgcuacuugguugagcc

SEQ ID NO: 36173 - RNA, 64 nt, Human
aaguagggguauuuucuacuguugcuuaauuaugauggaagauaacauugucauuccuagauga

SEQ ID NO: 36174 - RNA, 64 nt, Human
aggcuguguuuauucuuuuccugugccccucauaauggaagaaaguaaacugcuuaucccgagc

SEQ ID NO: 36175 - RNA, 64 nt, Human
gagauuuguuaacacacauuuucugagagcagguauggaagacagccauguguagugauggaua

SEQ ID NO: 36176 - RNA, 64 nt, Human
aaauaagugugaccacuuaaagcugcucguuagcauggaagacuucuccauucuaucuuuguaa

SEQ ID NO: 36177 - RNA, 56 nt, Human
gagaaaucgaauuggaguaauagaaaauggaagaugguguuguuaauaaaggcauu

SEQ ID NO: 36178 - RNA, 64 nt, Human
cagcacauccaucagcaccccaguggaggaguucauggaagaguucccucuuuguuucugcuuc

SEQ ID NO: 36179 - RNA, 64 nt, Human
uaaaggagaugccgacagcuagugacagaugaagauggaagaacauaccuuugacaaauaacua

SEQ ID NO: 36180 - RNA, 64 nt, Human
auacaaaguggacacuguggggagauacagagaaauggaagauacggauccugccuggaguagg

SEQ ID NO: 36181 - RNA, 64 nt, Human
agaagaaaugaauuuacuuuguuugcauuaaguuauggaagaguuguaauauauacuuuaagaa

SEQ ID NO: 36182 - RNA, 64 nt, Human
cacguaaacugagcaaaacugcagcuggcugacaauggaagauccaggugccaauccacagccc

SEQ ID NO: 36183 - RNA, 64 nt, Human
cucuugguuucagccgugguccuaguggcuacuuauggaagaauaggaauaguuccacaacauc

SEQ ID NO: 36184 - RNA, 64 nt, Human
cuuucuguuucccauaucucaccucuaggauaugauggaagaagugcuugaaagagaauuuuag

SEQ ID NO: 36185 - RNA, 64 nt, Human
cuagucaauaacucugauuuugauauuuucacagauggaagaaguuuuaacuaugccguguagu

SEQ ID NO: 36186 - RNA, 64 nt, Human
aacuugagccaucugugccucuaagaggcugagaauggaagaguuucagauaauaaagagugaa

SEQ ID NO: 36187 - RNA, 64 nt, Human
ggggaucaucacaucaguccaaggauauaaaaaaauggaagauuaaaaacucaaauuguggagu

SEQ ID NO: 36188 - RNA, 64 nt, Human
guuuaaauucuguucacucaacaaugccagaugaauggaagagggaacacacugagaugacuua

SEQ ID NO: 36189 - RNA, 64 nt, Human
aaaaauuagaggugauuuucagauuucuuguucuauggaagaggaagcugagcucagggagaua

SEQ ID NO: 36190 - RNA, 64 nt, Human
aaaaaaaucuuucagauaagagguguucuccagaauggaagaacgacuuggcauguaagaaaua

SEQ ID NO: 36191 - RNA, 64 nt, Human
cguccucuuuuuccaucauaauucuaaucuaacaauggaagauuugcccauuuacacuuuugag

SEQ ID NO: 36192 - RNA, 64 nt, Human
ggacccuggguggggccuccaggugcagcuguggauggaagacagggauuggccugugcuucag

SEQ ID NO: 36193 - RNA, 64 nt, Human
gguacuauucauucacucuuccugcguagaagauauggaagaacgagguuuauauuuucaugug

SEQ ID NO: 36194 - RNA, 64 nt, Human
gugacaucaagauaaagagcggagguggauggggauggaagaugaugcuccuauccucccugcc

SEQ ID NO: 36195 - RNA, 64 nt, Human
uauacuaaagcccuuuucccaugcauggauggaaauggaagauuuuuuuuuaacuuguucuaga

SEQ ID NO: 36196 - RNA, 64 nt, Human
cauauuggagagaagugauaugaaugcaguuuguauggaagaccuuugagacugaguagaugaa

SEQ ID NO: 36197 - RNA, 64 nt, Human
ggugcucacggugggcggugggcaagaagccagcauggaagaaagaagggagaaaacuuuggug

SEQ ID NO: 36198 - RNA, 64 nt, Human
ugcaagaaugaauacugacuucagaacucaaacaauggaagaacuugcauuuuuauggaacuca

SEQ ID NO: 36199 - RNA, 64 nt, Human
cauugaaaaauuuaucaagaauuuaaaggauuucauggaagaaccaaguuuuucuaugauauua

SEQ ID NO: 36200 - RNA, 64 nt, Human
gaucugaaugaggauaacccuaaaaucaugaggaauggaagaauggaccuugaaacuaccuagg

SEQ ID NO: 36201 - RNA, 64 nt, Human
cuguaauauagucuugucaccuuagagcuuguuuauggaagauucaagaaaacuauaaaauacu

SEQ ID NO: 36202 - RNA, 64 nt, Human
ggacaggucugccaaucuaucuaaaagccacaauauggaagaaguauucaauuuauauaauaaa

SEQ ID NO: 36203 - RNA, 64 nt, Human
cacaccuguauucccaucuagucaggaagcugagauggaagaauuaauugagcccacgaguuca

SEQ ID NO: 36204 - RNA, 64 nt, Human
aauaggcuuuuccauaaguggccuuuaagaaaacauggaagacaauucauguuugacaaaugcu

SEQ ID NO: 36205 - RNA, 64 nt, Human
auuuuagagaagaaaugggucuaaagauagccugauggaagaaaaaccucagacaucuacaaac

SEQ ID NO: 36206 - RNA, 64 nt, Human
aagcuaucuuaaaaugcauauauauacuucuugcauggaagagcaaaacaaauucaaguuguca

SEQ ID NO: 36207 - RNA, 64 nt, Human
acuuccagcccucugaaagauuggagucaagcagauggaagaaugcaguggugauaguugucau

SEQ ID NO: 36208 - RNA, 64 nt, Human
uugguccuuugguacgcacccccucagagcugagauggaagacauggcuaguucuuuucagccu

SEQ ID NO: 36209 - RNA, 64 nt, Human
guuguauauuguguugaugacguacguuauuuccauggaagauagccgcuguggcagcugucac

SEQ ID NO: 36210 - RNA, 64 nt, Human
uccuccucuucaggacaugcuccauuuauuuuccauggaagacacagggucagagaucugucag

SEQ ID NO: 36211 - RNA, 64 nt, Human
cuacuuccuaauuuauucuuauuugacagaggguauggaagacuugcaauuugaaaacugggga

SEQ ID NO: 36212 - RNA, 64 nt, Human
uauugccaacuuaaucagauaaacagauuauguaauggaagaaaaaugcggaugccuacaguua

SEQ ID NO: 36213 - RNA, 64 nt, Human
gcaggcagagcuuaccaagucucuccgaacucaaauggaagaaauaccuuaugaauguaagaau

SEQ ID NO: 36214 - RNA, 64 nt, Human
aguugcacagcuaugaaggcuguacacugcacgaauggaagaggcaccugucccagaaaaagca

SEQ ID NO: 36215 - RNA, 64 nt, Human
aaaaauauuaaauaaaaaauaaauauugggcaagauggaagacugaaagaccaguuucuggugu

SEQ ID NO: 36216 - RNA, 64 nt, Human
ggagaagauuccuaaaauuugagagacaaaauaaauggaagacaugagaaccuuccagagucca

SEQ ID NO: 36217 - RNA, 64 nt, Human
cccugucuucauccuguuauccccugguguacacauggaagaggaccaggacauaccaccuggg

SEQ ID NO: 36218 - RNA, 64 nt, Human
caacuacuguuuuucagaaggaagaaagaaucaaauggaagaagaaucaaguccaugcccaagc

SEQ ID NO: 36219 - RNA, 64 nt, Human
ccucccucacccccuccuucauaugaaaggugccauggaagaggcuacagggccaaacgcugag

SEQ ID NO: 36220 - RNA, 64 nt, Human
ggcuccacaagcgugucuggcauucccacccaccauggaagacuggauacgcaccuggaaacaa

SEQ ID NO: 36221 - RNA, 64 nt, Human
acaauggauaaauuuuaagugugugcuaaggcacauggaagaccgauuuuauuugcacaaggua

SEQ ID NO: 36222 - RNA, 64 nt, Human
cagauucugucuucauugcaaaaaguuauucucaauggaagaauggcaucugaucucauaauua

SEQ ID NO: 36223 - RNA, 64 nt, Human
aguauuuguguuuuuacauuuuaugguuaauuuaauggaagaugaaagggcauugcaaaguugu

SEQ ID NO: 36224 - RNA, 64 nt, Human
caguaaaucucccaggccuucagauuucuacauaauggaagaauauguuuuuaacccugagauc

SEQ ID NO: 36225 - RNA, 64 nt, Human
aauucagaauuuuucuuuuuaauauauuucuuccauggaagaguugucaucacuaaaacuucag

SEQ ID NO: 36226 - RNA, 64 nt, Human
augacaauuaggcuuuugucauuguugccaucauauggaagauaauguuuacauccuuuuaaac

SEQ ID NO: 36227 - RNA, 64 nt, Human
uggggcuaagggaagugcugaaauagagcaaaggauggaagauaauauagacuaccacccacug

SEQ ID NO: 36228 - RNA, 64 nt, Human
aaggaaaugaauaacagcuugucagagacuuccuauggaagaaagaauuuuuuagauacuauca

SEQ ID NO: 36229 - RNA, 64 nt, Human
gccauugcucccuugucaagugucucacaaggacauggaagaauguguuauguucaucuuguaa

SEQ ID NO: 36230 - RNA, 64 nt, Human
agaguuuaugcugacugcuuacuagguguuugucauggaagagaagcauggguucagcagugcc

SEQ ID NO: 36231 - RNA, 64 nt, Human
uuggcagauaaacuguccccagacccugccacacauggaagagacagcucaggccaaauacagg

SEQ ID NO: 36232 - RNA, 64 nt, Human
cauaaacauccgacaguuugaauuuauaguguugauggaagaaaucauuuuuaauguguacugu

SEQ ID NO: 36233 - RNA, 64 nt, Human
auugagacuacuguagugacaucugagaaaugggauggaagagugaccauguuuuauuuucuug

SEQ ID NO: 36234 - RNA, 64 nt, Human
cccuggcaccucuagggaccaacugggacucauuauggaagaauggggugagaggagacaugag

SEQ ID NO: 36235 - RNA, 64 nt, Human
uauuuaaaacucaccucccaaucaccccaaacaaauggaagagaagagaaaggacauggcguau

SEQ ID NO: 36236 - RNA, 64 nt, Human
cccucaucagcugagggcagggaauggaacuuuaauggaagaaccacuuuuaucuauucuuuuu

SEQ ID NO: 36237 - RNA, 64 nt, Human
uccugcuaacccacaaaccuguuuggaaauaaacauggaagaauaucuggcaggcuuacuuuua

SEQ ID NO: 36238 - RNA, 64 nt, Human
acaggguugcaaagguuaugauuauuucaacacaauggaagagcacaguuaaggccaacuaacg

SEQ ID NO: 36239 - RNA, 64 nt, Human
uauuuuuugagaugauuuaaauguaaaccaaaagauggaagacaaaaagacaaacacacccaca

SEQ ID NO: 36240 - RNA, 64 nt, Human
uggacuauagcuguucuaauggauuauaaucagaauggaagagagaaagcauauugacuuuuuu

SEQ ID NO: 36241 - RNA, 64 nt, Human
aguguauuuuauucaguaguuugaggaucuugccauggaagauacuagcccagccuagcagaaa

SEQ ID NO: 36242 - RNA, 64 nt, Human
ccauucuucuuguguacuugugacucuuagcagcauggaagagaaguguaaccaugcaaauaca

SEQ ID NO: 36243 - RNA, 64 nt, Human
ggagucggagggaggaagugaggaagggucaaggauggaagaguucuuucacuuacccuuuuua

SEQ ID NO: 36244 - RNA, 64 nt, Human
aaguaucuuccuccaggcuuguaauacccuucacauggaagauuaaugagggaaaucuuuauau

SEQ ID NO: 36245 - RNA, 64 nt, Human
ugaagccaaaauacuaucuuuuaagaugucccacauggaagacgcuauuccaggaucuuuaaau

SEQ ID NO: 36246 - RNA, 64 nt, Human
agaaauaugaaugucgaggggcuuggaauucuaaauggaagauuuuagaaggaacuuugcucuc

SEQ ID NO: 36247 - RNA, 64 nt, Human
aguuugacaaugaaagaaaggaaugggaaagucaauggaagauuaugcagaagaaaauagaaga

SEQ ID NO: 36248 - RNA, 64 nt, Human
uuccgaaaaaggcauuaagggcuagagaugucaaauggaagagacuuaggaucaagacauuuuu

SEQ ID NO: 36249 - RNA, 64 nt, Human
cuuuguguaugcauguuugaauuaaaagaaaguaauggaagaauugaucgaugaauuaagugag

SEQ ID NO: 36250 - RNA, 64 nt, Human
gagcggcugucacacccaugagcaaguuuccuugauggaagaugcuguuucuccggcagaacca

SEQ ID NO: 36251 - RNA, 64 nt, Human
caccccaaccccccaaaauuaguuuguguuacuuauggaagauaguuuucuccuuuuacuucac

SEQ ID NO: 36252 - RNA, 64 nt, Human
auagauuucaguuuuuagaaggguuucugucaucauggaagagguggucugggacuagguacuu

SEQ ID NO: 36253 - RNA, 64 nt, Human
uuaggccacauaaaauugcuguuuaauguagucgauggaagacuuuaaacuaugcuucuagcuu

SEQ ID NO: 36254 - RNA, 64 nt, Human
cacacgagaaacagugaggcugaaagggggggcuauggaagagcgguagggaguccacggagaa

SEQ ID NO: 36255 - RNA, 64 nt, Human
aaacuuuggccugaacaguuuuuucuuuuucuuaauggaagaagauauuuaauaucuuaaaaau

SEQ ID NO: 36256 - RNA, 64 nt, Human
auagaccguauuaccaaugauaauaguauuuugaauggaagauaugagggggaaaaaaacuuau

SEQ ID NO: 36257 - RNA, 64 nt, Human
gaagucauguuguuucugcacuuuauaauaaagcauggaagaaauuaucuuaguaggcaauugu

SEQ ID NO: 36258 - RNA, 64 nt, Human
auggaaagaaggaaaaaaggaggauagaaaaaggauggaagaaagaagcauugaaaacaaagac

SEQ ID NO: 36259 - RNA, 64 nt, Human
gcuggaguaggggacaaugggaauccuagaggggauggaagacgcggggagugagcuggguggg

SEQ ID NO: 36260 - RNA, 64 nt, Human
ccugagaagugaguaaaaguccgcagagguggggauggaagaucucuccuuagauagaaccugu

SEQ ID NO: 36261 - RNA, 64 nt, Human
ggucuucuggauuuggaggcaaucagcggacagcauggaagaugugugcucuggcucggauaag

SEQ ID NO: 36262 - RNA, 64 nt, Human
uuagggucagaaguaccucacagugguuguggacauggaagaguuuugucaacacaacacuuug

SEQ ID NO: 36263 - RNA, 64 nt, Human
cgccucccucugcaucggccaaauuggggagggcauggaagauccagcggaaaguugaaaauaa

SEQ ID NO: 36264 - RNA, 64 nt, Human
agcccccgguucccuugugggggcuuuggcagcuauggaagaaccaaaauaacgugaagaacau

SEQ ID NO: 36265 - RNA, 64 nt, Human
uacuuuugcaguggaaaacugaauggcugacaagauggaagaguaaccauuucagcauuguaug

SEQ ID NO: 36266 - RNA, 64 nt, Human
cgaagccuccagugaccuggaccuggagcaacucauggaagauguugggagagagcuggggcag

SEQ ID NO: 36267 - RNA, 64 nt, Human
caguaacuggucauggucaugcaucuaaaagugcauggaagaucauuuauuacuuuuuccuuuu

SEQ ID NO: 36268 - RNA, 64 nt, Human
uacguagugugacacuucugacuucacugaaauuauggaagaaagacacccagaggaggccucu

SEQ ID NO: 36269 - RNA, 64 nt, Human
uacgcauagcucaccuuucuaaacccaguuaagcauggaagagagguaguagguaggugcagug

SEQ ID NO: 36270 - RNA, 64 nt, Human
cacgcgugguuuguguuggugguauguuccacaaauggaagagaucauugcauuuugcuuuggu

SEQ ID NO: 36271 - RNA, 64 nt, Human
auguaugcacacaaaacauuuaacuaugguauuuauggaagacagguaacaacauuaaaucuag

SEQ ID NO: 36272 - RNA, 64 nt, Human
aauuagucugaauuaacguauuuacauauugcauauggaagauaaguucauuuaucuuccuuuc

SEQ ID NO: 36273 - RNA, 64 nt, Human
cuguuucauuucaagguaucaaugcuguagauggauggaagaggcuucccacaggaaggugcca

SEQ ID NO: 36274 - RNA, 64 nt, Human
uuccuaaaaauauaguuuuauauuaauugugcuuauggaagaaacaaugucagccaaguccauu

SEQ ID NO: 36275 - RNA, 64 nt, Human
uacccccacccaggaaaaccugcauugugcuagcauggaagaaucaugggcuuuggaauuaaac

SEQ ID NO: 36276 - RNA, 64 nt, Human
agaugaguugaauuugugauaccauggguaaggcauggaagaacucuugaauguguuggccauu

SEQ ID NO: 36277 - RNA, 64 nt, Human
aaaauuaacugggcaugguggcugagguggaagaauggaagaaucacuugagcccaggaguuug

SEQ ID NO: 36278 - RNA, 64 nt, Human
ccuuugauuuuauacuugaaaaacuggcaaaggaauggaagaauauuuuagucaugaguuguuu

SEQ ID NO: 36279 - RNA, 64 nt, Human
auaauaaagagcaauuuguaacugaguggcacuaauggaagaaagugcugcucaaaggaaguau

SEQ ID NO: 36280 - RNA, 64 nt, Human
uuuuugguaaaguuucaaagaagaagaaacagagauggaagaguaaagauauuuuuaaaauggc

SEQ ID NO: 36281 - RNA, 64 nt, Human
augaaauuaagaggucagcagaauauacucagugauggaagacacuugggaaagucuuuuuaau

SEQ ID NO: 36282 - RNA, 64 nt, Human
uugcuucugagaagcaaaacucuuuaaauacauuauggaagauaaugaagauacuucauucucu

SEQ ID NO: 36283 - RNA, 64 nt, Human
uacugauguacacuugaagugcgauagugacauuauggaagagucaaaccacaaccauucuuuc

SEQ ID NO: 36284 - RNA, 64 nt, Human
ggguugaccagggaaggaggcagcuaggcuguagauggaagaugguccugggauucgaacaccg

SEQ ID NO: 36285 - RNA, 64 nt, Human
cguaauucuuacauugugauugcaauggauacucauggaagaaaguggguaguggccgauuuga

SEQ ID NO: 36286 - RNA, 59 nt, Human
ccuuggagccgcccuccugaagcuugaaaauggaagaauuuaguuuuguugguugaauu

SEQ ID NO: 36287 - RNA, 64 nt, Human
gaauuguuuauaucuacugucaaguuguuuugacauggaagauuuucaaguaacauuggcagag

SEQ ID NO: 36288 - RNA, 64 nt, Human
auuaaaaagugagauaaauggucaaugagaaagaauggaagaugguaaacaaucacuuuuuaaa

SEQ ID NO: 36289 - RNA, 64 nt, Human
uauaccucacuagccaugcuuuauguggguuaucauggaagaaaaggauuuuggaaacucaagg

SEQ ID NO: 36290 - RNA, 64 nt, Human
ccccuggggaaggucccgaggaugcugucaggagauggaagagucauguggggugggaaccugg

SEQ ID NO: 36291 - RNA, 64 nt, Human
ccccuggagaaggucccgaggaugcugucaggagauggaagagucauguggggugggaaccugg

SEQ ID NO: 36292 - RNA, 64 nt, Human
uuggcccagcaaggcaaagaacugaaguuccaggauggaagaaccuguguucuccucauaauag

SEQ ID NO: 36293 - RNA, 64 nt, Human
agauaggcaagaaggacagcaguaaaugaagaccauggaagaaaagaaggaaugccaaagaucg

SEQ ID NO: 36294 - RNA, 64 nt, Human
cuaccuugcccccaaguucugauuuuuaauuucuauggaagauuuuuuggauugucggauuucc

SEQ ID NO: 36295 - RNA, 64 nt, Human
aaaacugcuguuuuaaagugguuuauuauguuccauggaagaaacuggucuuauugaaugcauu

SEQ ID NO: 36296 - RNA, 64 nt, Human
ggguaacuggaggcggggccagggccucagcgcuauggaagaguguccacugaggcugcacaug

SEQ ID NO: 36297 - RNA, 64 nt, Human
gauaaggacuugagauguguagaaacguuggguuauggaagacuaguuucuuccauaacccuga

SEQ ID NO: 36298 - RNA, 64 nt, Human
aaaaggaaaaaaacaguuugaacacaaaggcucuauggaagaaaugccucuauguaggugaagu

SEQ ID NO: 36299 - RNA, 64 nt, Human
aaacucuauccacuggagauaguauuuggaaugaauggaagaauauggguuaaggcaaaaacca

SEQ ID NO: 36300 - RNA, 64 nt, Human
gagaugaucaaguuuuaauuuggguauagguuaaauggaagaagaaacagaacuucauggccaa

SEQ ID NO: 36301 - RNA, 64 nt, Human
caagagauaccacucagguaacuuuuuucaggacauggaagaucuguuucaaggagauuuacug

SEQ ID NO: 36302 - RNA, 64 nt, Human
uaccguugaguauauauaaagaaugagucucuguauggaagaacaaaugugugcauucaccccc

SEQ ID NO: 36303 - RNA, 64 nt, Human
auccagcucuugguagccacaccugcaauguaaaauggaagaaaaugcaaagaaaccaaaugug

SEQ ID NO: 36304 - RNA, 64 nt, Human
ccuuccugcagauggcuucucaaacucgggcaucauggaagagcgccuccuagacgcaguggug

SEQ ID NO: 36305 - RNA, 64 nt, Human
gagagagugaagugaaugcaagauaaaaagugggauggaagaauuaaauccagaguuccaggca

SEQ ID NO: 36306 - RNA, 64 nt, Human
augugacaucaugugacaaaguucauguaauuagauggaagaaaccucacugauuaauuuuaag

SEQ ID NO: 36307 - RNA, 64 nt, Human
agccuacaguaagacacuucuaucagcaguguuaauggaagaaauuccuaccaaugggcaauca

SEQ ID NO: 36308 - RNA, 64 nt, Human
uucaccuuaaaugugaaaauaaauccuauuuucuauggaagacugguaccugguuucuggaaga

SEQ ID NO: 36309 - RNA, 64 nt, Human
ucucugcccagccccuuccuuuccaaaccaugcaauggaagagcccagaugggugaagauugau

SEQ ID NO: 36310 - RNA, 64 nt, Human
cuuugggguugguuccuagaggcagagguugaagauggaagagggagcucuggagugcuaacuu

SEQ ID NO: 36311 - RNA, 64 nt, Human
gccaccuaagcccugcguacauucacaugcacacauggaagaauguuuaucggcugggcugcag

SEQ ID NO: 36312 - RNA, 64 nt, Human
aacgaugaugauauucagacgaagcauugauguuauggaagaaagaaagaaacaaacaaaauau

SEQ ID NO: 36313 - RNA, 64 nt, Human
uacucucaaugaaacugcagaagccaccaugaacauggaagaccaccuagcagaucggugagua

SEQ ID NO: 36314 - RNA, 64 nt, Human
agugauuuguuugucuugaacuguuugaaaagcuauggaagagguuacagugacaugcccucga

SEQ ID NO: 36315 - RNA, 64 nt, Human
agccuugaagauacacgaggaugaaguagaggauauggaagaaaauuaagugugauccaguuug

SEQ ID NO: 36316 - RNA, 64 nt, Human
uuucaggugaacaauggauaacaaaaagcaaguuauggaagauugugaagaggauggaaaaacu

SEQ ID NO: 36317 - RNA, 64 nt, Human
ucauauuuuggauuaugaaucauccaguaauaaaauggaagauggagucagcuauugaaguggu

SEQ ID NO: 36318 - RNA, 64 nt, Human
uucccccaugaaaccauucuucagacaucagucaauggaagaaauggcuaugaacagaaacuac

SEQ ID NO: 36319 - RNA, 64 nt, Human
ccaaauacaugcauagaaaagggucuuccuauuaauggaagaagguaauuuuuaggauguguau

SEQ ID NO: 36320 - RNA, 64 nt, Human
guugggugcucacagaacccuuuuccugacucucauggaagaugguggaaggaaaauagacugu

SEQ ID NO: 36321 - RNA, 64 nt, Human
uuaaagcuaacugggucuuagcauccuccuguguauggaagagacaggugaccgcuccagguug

SEQ ID NO: 36322 - RNA, 58 nt, Human
ugcucucagcgcaguuuuaguccugaggauggaagaccaggcucgugugucuuguguu

SEQ ID NO: 36323 - RNA, 64 nt, Human
cauuucauaaaggggcuacuuugaaggaguuaagauggaagacuuccuucuugacaaauugugu

SEQ ID NO: 36324 - RNA, 64 nt, Human
auauagugaauuucuaauucuaauguucagugcaauggaagacauuuauuuggacaguaauacu

SEQ ID NO: 36325 - RNA, 64 nt, Human
cuaucuuuccagugaaaacugaaagugcauuauuauggaagaauguauuugcagguaguaauag

SEQ ID NO: 36326 - RNA, 64 nt, Human
uccuuaaauuauugggcagggaauauacuuauuuauggaagauuacugcucuaauuugagugaa

SEQ ID NO: 36327 - RNA, 64 nt, Human
ugaguucccacucagacccacucagccaaaucucauggaagaccaaggagggcagcacuguuuu

SEQ ID NO: 36328 - RNA, 64 nt, Human
gaccuggccaucaaaugacacaaacaacuaaacgauggaagagagagcgagcccggguccucua

SEQ ID NO: 36329 - RNA, 64 nt, Human
accugagggugguggggaggagaagguuguaggcauggaagagagccaggcagccccgaaagaa

SEQ ID NO: 36330 - RNA, 64 nt, Human
aggagagagaggcuggccuacacaggugcccgucauggaagaggcggccaugcuguggccagcc

SEQ ID NO: 36331 - RNA, 64 nt, Human
gccucaggaaaagggaugagagaaaggaggugguauggaagacucagcaggaacaagguaggcu

SEQ ID NO: 36332 - RNA, 64 nt, Human
agucccuaauggaaauggugaucaacaaaagguuauggaagaaugguuuaugaacuucccauag

SEQ ID NO: 36333 - RNA, 64 nt, Human
ucaacauguaugaacuuaaaauauggagaauguuauggaagaaauaguuuauaaguuuguuaag

SEQ ID NO: 36334 - RNA, 64 nt, Human
auuggaugggacagaagaagaggaugaggaugagauggaagaggaggaggaggaggagcuggag

SEQ ID NO: 36335 - RNA, 64 nt, Human
auuucuucugaaaaaaauguuacaauuauacuagauggaagacuugcaucaguugcuuaaacuu

SEQ ID NO: 36336 - RNA, 64 nt, Human
uucagaacaccaagacuugaaggugccuugcucaauggaagaggccaggacagagcugacaaaa

SEQ ID NO: 36337 - RNA, 64 nt, Human
ccuagaaagccuggucauuuuacuguccucacacauggaagacacuuguguuggcugugccucu

SEQ ID NO: 36338 - RNA, 64 nt, Human
acauuucuggcugaucccaaucagauucccgcuaauggaagaaguuuagaaucuuucaggugga

SEQ ID NO: 36339 - RNA, 64 nt, Human
agacauggaagguuagguuugucaacacaaagacauggaagauuagagguuugucaacacaaag

SEQ ID NO: 36340 - RNA, 64 nt, Human
cccaaccccuggccucaauuucccuuucuauaaaauggaagauguccagagguccaugguuugu

SEQ ID NO: 36341 - RNA, 64 nt, Human
cacugguagcuaacguguccgaaaccaguuaagaauggaagaaaacggugcauccacgcacaca

SEQ ID NO: 36342 - RNA, 64 nt, Human
guguuccaggagcucuuugguuuggcuucuuuugauggaagaauccugcuucacagacugagug

SEQ ID NO: 36343 - RNA, 54 nt, Human
uccagauacaguuuauguaacuugauggaagaaaauggaauuacuccaaaaaga

SEQ ID NO: 36344 - RNA, 64 nt, Human
agaugacagacaugucugaaugaaguaaaaaucaauggaagacagucgggaucuuuugcuucau

SEQ ID NO: 36345 - RNA, 64 nt, Human
uuguaccaugguugugcacaugcuucagaauccuauggaagagaauauuccuacuugcaguaca

SEQ ID NO: 36346 - RNA, 64 nt, Human
uagaacgugcaaugcauuuauaugaaacugguguauggaagacauaggugcucucuugaaaucu

SEQ ID NO: 36347 - RNA, 64 nt, Human
uuuuggguauauuuucaagauacauguuguauuuauggaagaaagaguuguccugauguuuuuc

SEQ ID NO: 36348 - RNA, 64 nt, Human
uuuacuuuucaauuggugugcacugaaugcauguauggaagaauagcgugaauaaugcaaucuc

SEQ ID NO: 36349 - RNA, 64 nt, Human
ccuugucuccuaccuaagugugugucgccacccgauggaagauucgauggacauggacaugagc

SEQ ID NO: 36350 - RNA, 64 nt, Human
uaauagagaauucacuccucccaaaagcaccuucauggaagauuccucauuaacaggcaguccu

SEQ ID NO: 36351 - RNA, 64 nt, Human
ugagucagugauugaagccaauauucugauucccauggaagauggaugggcaagaguguacuuc

SEQ ID NO: 36352 - RNA, 64 nt, Human
agguaauauaacugauaauauacugaaacauauaauggaagaugcagaugauaaaacuaauuuu

SEQ ID NO: 36353 - RNA, 64 nt, Human
auuucaaccuuaaucuuggaucccuuuaccucauauggaagaacuugagggacauuaguauacu

SEQ ID NO: 36354 - RNA, 64 nt, Human
ccccgggaugcaagguagcauggguccaagagacauggaagagagagccaugaagcauuaaaau

SEQ ID NO: 36355 - RNA, 64 nt, Human
aggcuuugggaauaguucauagggaagggacaacauggaagaaacagcgauuuaaauuguauug

SEQ ID NO: 36356 - RNA, 64 nt, Human
ucuaaggagcaaugcagaaaaaaaggugaaauaaauggaagagauagccauggacucuggaucu

SEQ ID NO: 36357 - RNA, 64 nt, Human
ugcuguuuuaacuuguaaauauauauguauacauauggaagauauuauuauuaucuagauuacu

SEQ ID NO: 36358 - RNA, 64 nt, Human
gcauauauauauauguauaaaaaauaauaaaauaauggaagaugaugguguucucuaguaagcc

SEQ ID NO: 36359 - RNA, 64 nt, Human
uaucucauggaugugauaguggaaggaauuguggauggaagacaagcagaaaagcugaagacaa

SEQ ID NO: 36360 - RNA, 64 nt, Human
uacacuagcauaauauuuguggcauauccguguaauggaagauuaugcaggcauuaaaauaugu

SEQ ID NO: 36361 - RNA, 64 nt, Human
ucugcuuacuuaagucucuucucugacauacucaauggaagaauauuuagauuuauuuaaaguu

SEQ ID NO: 36362 - RNA, 55 nt, Human
cacuccagcccacuuccuaggaacaauggaagaagaaaggacugaaccaggguau

SEQ ID NO: 36363 - RNA, 64 nt, Human
ucuaguguaaugaaauaaaaugugaucuaguguaauggaagaccuuugagaaccuggguguauu

SEQ ID NO: 36364 - RNA, 64 nt, Human
cagacugaaauguuugugucuucaacuuauuagaauggaagauaaugcagauauuucuguggga

SEQ ID NO: 36365 - RNA, 64 nt, Human
acaacauugggcccauuuucuuuccuucacaccgauggaagagaccauuaggacauauauuuag

SEQ ID NO: 36366 - RNA, 64 nt, Human
ucuuccccagguugaggagagaaguggaagccccauggaagacagugcucccagcugagguagg

SEQ ID NO: 36367 - RNA, 64 nt, Human
uuguccuguuagaauuuccaucauggaaggugguauggaagaagguauggaaauacuuuguauu

SEQ ID NO: 36368 - RNA, 64 nt, Human
gauaaugaaaagaaugauucagucuugacggugaauggaagacacuuaccuaacaaguacugcu

SEQ ID NO: 36369 - RNA, 64 nt, Human
cuaggaauuuuagcaguccugguuucuuuuucucauggaagaaaugaacaucugccagcugugu

SEQ ID NO: 36370 - RNA, 64 nt, Human
uugucucagugcugaggaaccucaucagagaagcauggaagaugccaaaggauuuuuggaaggu

SEQ ID NO: 36371 - RNA, 64 nt, Human
agccuggcacccaccccucccaucuccaccccacauggaagacuugucuucaacuuggccacug

SEQ ID NO: 36372 - RNA, 64 nt, Human
gaauuuuuaaauguucacucuggcuuaccuguuaauggaagaauuugcauaauaucuacuuaga

SEQ ID NO: 36373 - RNA, 64 nt, Human
uuugucuucccuucuacccuacaucuuaaacuuuauggaagaaccucuauuuugcaucauauca

SEQ ID NO: 36374 - RNA, 64 nt, Human
ugaacauuuucaugaauccaggggacuugaaaauauggaagacccacauaguuagaagaauaua

SEQ ID NO: 36375 - RNA, 64 nt, Human
aacaagaauuuuauugacuaauaagggaauauguauggaagaaggaagagaaagccuuugucua

SEQ ID NO: 36376 - RNA, 64 nt, Human
cacuauacaguauauugucaugugaaaguguggaauggaagaaaugucgauccuguuguaacug

SEQ ID NO: 36377 - RNA, 64 nt, Human
uuccaacacuguucauguaacaguaacuccauagauggaagagcauuggcaggaaaaagcucua

SEQ ID NO: 36378 - RNA, 64 nt, Human
ugugagaacgggagaggcaguuccuaccuugggaauggaagauuuucucugcaguuugcugagg

SEQ ID NO: 36379 - RNA, 64 nt, Human
cucauguaaaacuaauguaucaaaauuagcauauauggaagaaaaaucacuauucaaaaauagu

SEQ ID NO: 36380 - RNA, 64 nt, Human
guuugggacagaaagaaauggaaugucuucagucauggaagagccuccauuucaucucaugucc

SEQ ID NO: 36381 - RNA, 64 nt, Human
gaccucuuuugaagguagaguuuuagaaggcuggauggaagauucugagccuggaauuaggacc

SEQ ID NO: 36382 - RNA, 64 nt, Human
aaaguuaagggauuugcugaagacuguaaaguuaauggaagaauugagacaaaaauccagugua

SEQ ID NO: 36383 - RNA, 64 nt, Human
aauauuaaugugauccgacccuaacauuuucucuauggaagacguauguugcauaaagcaaggc

SEQ ID NO: 36384 - RNA, 64 nt, Human
ugacaaugauguucuaccuacuuguuacaugcucauggaagaccgugcaguauugaaaguauuu

SEQ ID NO: 36385 - RNA, 64 nt, Human
uuuucagaggauuugacacgauaagccucaucugauggaagagaggaauaaauaauucaccuau

SEQ ID NO: 36386 - RNA, 57 nt, Human
auccugaggcugagaaauaaagcucagauggaagagauaaacgaccaaacucaguuc

SEQ ID NO: 36387 - RNA, 64 nt, Human
auggagcagaacacuuacauggaaaauccuaaacauggaagaugauuuaaaaaugauucacccu

SEQ ID NO: 36388 - RNA, 50 nt, Human
agcaguucagaaggaauuagauggaagaugauguugaacagcuguuaacg

SEQ ID NO: 36389 - RNA, 64 nt, Human
agggccgccgugagcgggauucagcaaugguggaauggaagacagaacuggaagagaaagaagg

SEQ ID NO: 36390 - RNA, 64 nt, Human
aagaaaaaagcaaauuuaaaugcacuggauagauauggaagaacuguucucauacuugcuguau

SEQ ID NO: 36391 - RNA, 64 nt, Human
agugauguuggccaacauucaauuugaacagagcauggaagaccuuucaguucaucgggaaaga

SEQ ID NO: 36392 - RNA, 64 nt, Human
cauucugauagcauuucauuaauuuugauuucaaauggaagauaaauaauaucccaaaugaauu

SEQ ID NO: 36393 - RNA, 64 nt, Human
uaugaaggcaaauuuccacucgcauuauuuaaugauggaagauucugggggagaguuguggauu

SEQ ID NO: 36394 - RNA, 64 nt, Human
uuguuccuggggaauucacuucucuuccucccucauggaagaugcaaguaaaaggaaaugcaag

SEQ ID NO: 36395 - RNA, 64 nt, Human
uucuuugaucuucucuuccaccucucuggcucucauggaagaauccuuuacacaugaaaacaau

SEQ ID NO: 36396 - RNA, 64 nt, Human
agaagagaugugguuuaacacagaugaagaugacauggaagauggagaagcuguagugucucca

SEQ ID NO: 36397 - RNA, 64 nt, Human
cugaugucaugaucuaaaugagggguagugggggauggaagagaguaccaggugguccaccguu

SEQ ID NO: 36398 - RNA, 64 nt, Human
uggggaccagaaucuccuuucggaaugaauguucauggaagaggcuccucugagggcaagagac

SEQ ID NO: 36399 - RNA, 64 nt, Human
uuucgguuccacgcucuucuaauugggagauaauauggaagaagggccagagcaguuacagccc

SEQ ID NO: 36400 - RNA, 64 nt, Human
ugcaagauuucucaaagauuagguauauauuuaaauggaagagaaaauauuuuuaugggagaaa

SEQ ID NO: 36401 - RNA, 64 nt, Human
uaaaauuugauguuauuucuggaagcuggaugauauggaagaguucaugugccuggacacacag

SEQ ID NO: 36402 - RNA, 64 nt, Human
agcauggcaucuuguccuugcuuuuagaacacccauggaagaaaacacagaguagauauugcug

SEQ ID NO: 36403 - RNA, 64 nt, Human
ugguaaaauggggggaaauguuucuccauguggaauggaagacagcauggcccacaacgugggc

SEQ ID NO: 36404 - RNA, 64 nt, Human
ggaaaacaucaagguuaaaacacaaaugacagauauggaagaaaauauuugcagcacauaaaaa

SEQ ID NO: 36405 - RNA, 64 nt, Human
cucaagccccaacaggccccugucauuccacuucauggaagagacggagccuucugaaaugaga

SEQ ID NO: 36406 - RNA, 64 nt, Human
auguuuauacacacaggagucagugcccauguguauggaagacaaauacacauacauauauaca

SEQ ID NO: 36407 - RNA, 64 nt, Human
gaguagguauauacuuaguggaaugguuuauuuuauggaagagaauucauuggaggugagauug

SEQ ID NO: 36408 - RNA, 64 nt, Human
agggaagguaaauggcauaaauauggucgcacuaauggaagacaaauggcaaaucuugaaauag

SEQ ID NO: 36409 - RNA, 64 nt, Human
agaccaucaagaagaggaagauaugagaaaauucauggaagaaguaaggaaaaggagagagcua

SEQ ID NO: 36410 - RNA, 64 nt, Human
cauugagcaauauuuuuuaauguguaccugucuuauggaagaaauaugcagguauauaagacca

SEQ ID NO: 36411 - RNA, 64 nt, Human
aaauguuuuucuuguguuuuaagaauuaggagacauggaagaggaagaacaaaguccccucugu

SEQ ID NO: 36412 - RNA, 64 nt, Human
aaccaaauaauaauaguuauccgucuucuacuucauggaagauuguuuuggugcccugacccuc

SEQ ID NO: 36413 - RNA, 64 nt, Human
guuucccugugcuagcugagaugcaaaacaaaucauggaagauugcauaccugugugguauuuu

SEQ ID NO: 36414 - RNA, 64 nt, Human
cccuuggccuuccuaugauuauaugagauucuuuauggaagaacaugaauauaaguuuugucuu

SEQ ID NO: 36415 - RNA, 64 nt, Human
aauguaaagagauucaagccuuguaaauaaugacauggaagacccugugcugcacuuaaaauau

SEQ ID NO: 36416 - RNA, 64 nt, Human
aacagaguaaauacuuaagaggccaaauagaugaauggaagaauuuuaggaacugugagagggg

SEQ ID NO: 36417 - RNA, 64 nt, Human
ggguaaagugcaauggguaagggagggaaggggaauggaagagaaaagacagggugggagggag

SEQ ID NO: 36418 - RNA, 64 nt, Human
aggcaagcuggacaggagagguggauauuuguugauggaagaauucaaguuuauaaucaauucc

SEQ ID NO: 36419 - RNA, 64 nt, Human
ugugacauagaccugcauauuugucagugccaugauggaagaagcugagcaugucuuaccaaaa

SEQ ID NO: 36420 - RNA, 64 nt, Human
acaaauggggagcucuagagugggagaaagaaugauggaagaagaguccagaacaggccagaaa

SEQ ID NO: 36421 - RNA, 64 nt, Human
uuuugaaagaugaguaggaguuugcuaagaauagauggaagacagcaggauaaacauuccagag

SEQ ID NO: 36422 - RNA, 64 nt, Human
uuaacaggacuucuguuuacaauggaaaucugaaauggaagaaacaucuuuaaccuuguguguc

SEQ ID NO: 36423 - RNA, 64 nt, Human
cgcgugcgaccagaggugggaggccccugguggcauggaagagggagggucagugccaagucuc

SEQ ID NO: 36424 - RNA, 64 nt, Human
aggcccugggccugucccugcggggaaaucuuuuauggaagaagggcuggacccacuuuaccug

SEQ ID NO: 36425 - RNA, 64 nt, Human
aggcuguaggacucgcagucaggggcagcugaccauggaagauugagagcccaagguuuaaacu

SEQ ID NO: 36426 - RNA, 64 nt, Human
caagaaaaaggucagcuccaccgaaggggcugccauggaagagcccaagaggagaucagcgcaa

SEQ ID NO: 36427 - RNA, 64 nt, Human
gugugugugugguuagaugcacauggagacagguauggaagaauauacaccaggcuguuaauau

SEQ ID NO: 36428 - RNA, 64 nt, Human
uucuccagacuccagugauucugcacugggcauuauggaagacuugugauagaucagagaagag

SEQ ID NO: 36429 - RNA, 64 nt, Human
agcccacgcucugagucucagcgccgacgagaccauggaagagccaucuguccuucucaggaca

SEQ ID NO: 36430 - RNA, 64 nt, Human
cacauaaauucccuaggaaguaaauucauuuacaauggaagaccaaaaauuuuuccuagaccug

SEQ ID NO: 36431 - RNA, 64 nt, Human
cuguuuguuuuaggaauccuggucucaggaccucauggaagaagagggggagagaguuacaggu

SEQ ID NO: 36432 - RNA, 64 nt, Human
ugaaguuaaccacagucgggaaacaagcauagaaauggaagaaagugaacuugaugcucaguau

SEQ ID NO: 36433 - RNA, 64 nt, Human
uauaaaaugauuuuuguaggucaucugcaaguucauggaagagcugggccuagaauguggguug

SEQ ID NO: 36434 - RNA, 64 nt, Human
ucuguuaaaaguuuaaagauuuuugcuauauauuauggaagaaaaauguaaucguaaauauuaa

SEQ ID NO: 36435 - RNA, 64 nt, Human
ccugcugcaaagcuuugauuuggcaaaggagaccauggaagaaucaugguggauccagaaguua

SEQ ID NO: 36436 - RNA, 64 nt, Human
gaaauggcauuucuccuaauuaauuuuccacuuaauggaagauuaucaauuguccuauuuuaug

SEQ ID NO: 36437 - RNA, 64 nt, Human
aaugcaugugaauuuuaguacauauugaaguuauauggaagaagauagccauaaucuguaagaa

SEQ ID NO: 36438 - RNA, 64 nt, Human
agcaaccuccagcuugaggccucggcaucuugagauggaagagcagccuuguguuuagaccugg

SEQ ID NO: 36439 - RNA, 64 nt, Human
uggcccucagcagugggcauuguaagcaugaacuauggaagaggcgccgguucaccaauucaac

SEQ ID NO: 36440 - RNA, 64 nt, Human
caagauguaaaacggcaguaauuuaugaccacguauggaagaaauucuucaaauagcuaccuua

SEQ ID NO: 36441 - RNA, 64 nt, Human
cuaauaugcguaaguauuaucgguaaguuacaagauggaagaagaauaacaguagggcacaguc

SEQ ID NO: 36442 - RNA, 64 nt, Human
gcagugcaucgcugaagcuuuuggagacuuuuggauggaagauaagauagggaagauuaaguuc

SEQ ID NO: 36443 - RNA, 64 nt, Human
accaggcauucgauaacacacuaaggggguaggaauggaagaugguaucuuuuauaugcuaaac

SEQ ID NO: 36444 - RNA, 64 nt, Human
cuugccgaucaccaggcauaaccuaauuuuauccauggaagaaacacagaaaggcaucuaaguu

SEQ ID NO: 36445 - RNA, 64 nt, Human
auuauaaaaccacuuuguuuauuuuaaagcaagaauggaagacccuugaaaauaaagaaguaau

SEQ ID NO: 36446 - RNA, 64 nt, Human
agaaaucaagucaguuuuuuuaaaagaaugaucuauggaagaaaacccaauaguacuuauaaua

SEQ ID NO: 36447 - RNA, 64 nt, Human
gaugucuguguaccucugucccuagguguaggaaauggaagaaaaagauucagccaagugggga

SEQ ID NO: 36448 - RNA, 64 nt, Human
ccaaauaguugaagaaaccaggugccuucucaugauggaagacagauucugcuuuaaauuaaaa

SEQ ID NO: 36449 - RNA, 64 nt, Human
cauguccugaggcgacgugagcauaacaaaggacauggaagaagauuccagaugccagaaaacc

SEQ ID NO: 36450 - RNA, 64 nt, Human
ugaguuucucuccaccgugacacaauccucaaacauggaagaugaaaggggaggggaugucagg

SEQ ID NO: 36451 - RNA, 64 nt, Human
gugguuuacguaacuuuaaacuguaacagccuuaauggaagaccaaaugguuuuuuauaugugu

SEQ ID NO: 36452 - RNA, 64 nt, Human
cacugcuuaacgaaauaaaagaggaugcaaagaaauggaagagcauuccaugcucauggguagg

SEQ ID NO: 36453 - RNA, 64 nt, Human
gcggaggcgugcguuugcuuuuacagauaucugaauggaagaguguuucuuccacaacagaagu

SEQ ID NO: 36454 - RNA, 60 nt, Human
gucuccagacucacgugugacaucuuuccaauggaagaguccugggaucuccaacuugcc

SEQ ID NO: 36455 - RNA, 64 nt, Human
aauaagcaggacagaggauuugcucuggacagagauggaagagccgggaacagagaaguguggg

SEQ ID NO: 36456 - RNA, 64 nt, Human
cccaucuccucgguauaaaucauguuuauaaguuauggaagaaccgggacauuuuacagaaaaa

SEQ ID NO: 36457 - RNA, 64 nt, Human
gaucaggguguuaaccgcauaugaaacaacccauauggaagacauacuuaggggucaaaccugu

SEQ ID NO: 36458 - RNA, 64 nt, Human
uggaguaaaauugucaaucauacauugaauugcuauggaagacuuguuuuuaugaugugcaugg

SEQ ID NO: 36459 - RNA, 64 nt, Human
agcgacuugguaaccugaacugaugccauguagaauggaagaauugaccagcugagccccuggc

SEQ ID NO: 36460 - RNA, 64 nt, Human
agagccaacucccaguuuagagaaaauucaaggaauggaagaguaaauuacaugacacaaaaag

SEQ ID NO: 36461 - RNA, 64 nt, Human
uuaugaaggaccccacuugcaccccaccccagccauggaagagcagcuggaggguggaugggga

SEQ ID NO: 36462 - RNA, 64 nt, Human
acacagaugugggcuuugauuuccaaguaauauaauggaagagaaaucucauacucccccacag

SEQ ID NO: 36463 - RNA, 64 nt, Human
cuucagaaguuugcuucuuaugguauaauaaaguauggaagaauauugaguauauguuuacucu

SEQ ID NO: 36464 - RNA, 64 nt, Human
gauuccaaucccuccuccuuuuuuaaguuauuugauggaagacucaccuaauuugugaccugag

SEQ ID NO: 36465 - RNA, 64 nt, Human
aauuuguuagaucaaacacuuaaaacuuuuuguuauggaagaauucaaauauaaauaaaaaauu

SEQ ID NO: 36466 - RNA, 64 nt, Human
cuaguucuauagggcuuggcuauuuaauauuuuuauggaagaaguguuuaguucuggaaaaggu

SEQ ID NO: 36467 - RNA, 64 nt, Human
gguuauggcuuuuguagcagagcccauacagccuauggaagaacuagaaucucacucacaguaa

SEQ ID NO: 36468 - RNA, 64 nt, Human
ccagcugguggcccugugccugggcccugggcugauggaagaugguccgugcccaggcccuugg

SEQ ID NO: 36469 - RNA, 64 nt, Human
cccucuuuguuuagaugaggaaacugagguucagauggaagauaugauuugccuauuguaauac

SEQ ID NO: 36470 - RNA, 64 nt, Human
ggcccugacaaguuuuuccacaggaauauguaucauggaagaauagagguuauucuguaaugga

SEQ ID NO: 36471 - RNA, 64 nt, Human
uaaaacauggcggguaccgaaaggagggcaauucauggaagaaauuuccucuguucauuccguu

SEQ ID NO: 36472 - RNA, 64 nt, Human
acgugcggucauaccuuucuucguugugguggggauggaagagcagagggagcauggcccaggg

SEQ ID NO: 36473 - RNA, 64 nt, Human
auuuuauugucuguuuuuggugacucugacauuaauggaagagaauauuuuccauuagauuuaa

SEQ ID NO: 36474 - RNA, 64 nt, Human
ccagcugaggaaggagcacacgccucaucaaugcauggaagaacgugcaaugcaucagaauaaa

SEQ ID NO: 36475 - RNA, 64 nt, Human
uggcuaucucugucccaucacccugagccucaagauggaagacauugucugcuugaacucuggg

SEQ ID NO: 36476 - RNA, 64 nt, Human
ggcaccugccccugaggguccugagacuuggaauauggaagaagcaauacccaaccccaccaaa

SEQ ID NO: 36477 - RNA, 64 nt, Human
augcugcagcugaugccuuuaaaagguauucaucauggaagagcugaggccugugcuugguguu

SEQ ID NO: 36478 - RNA, 64 nt, Human
cgaagaacuggccagggccuacgaacacgccaagauggaagagcaacugaggcacgccaaguuc

SEQ ID NO: 36479 - RNA, 64 nt, Human
acaaggccaacucucugaucagggugagggagagauggaagaauuaacagaucuaaaguuggcc

SEQ ID NO: 36480 - RNA, 64 nt, Human
cagcagaggcacgcauccccuuggagagacugucauggaagaggguggagccgccgcccgaagc

SEQ ID NO: 36481 - RNA, 64 nt, Human
uuucccuugguugucuuaauuuuuuuuuuuuuugauggaagaccaaggguugccaggcccacug

SEQ ID NO: 36482 - RNA, 64 nt, Human
ggagagaagcagagggagagagaaggugacacggauggaagagugggaaggagcuggccuggcu

SEQ ID NO: 36483 - RNA, 64 nt, Human
ggcaggcugcagcuucagccacagaauggggacuauggaagacagcaggagcucauuuccucug

SEQ ID NO: 36484 - RNA, 64 nt, Human
uggaaccagggagcugugggaagccacagcagaaauggaagaaaaacaggucucagcccagggu

SEQ ID NO: 36485 - RNA, 64 nt, Human
cuggaaaguguuuagauucuugauaaagauggaaauggaagagaaagaaaauuauauauguaua

SEQ ID NO: 36486 - RNA, 64 nt, Human
gaugguugacauuuuucccuauuuuccucacuuuauggaagaguuaaaacauuucuaaaccaga

SEQ ID NO: 36487 - RNA, 64 nt, Human
ccaaguccugagugacucaagaugcuucacuuacauggaagaaacuucuaaaacucuaccgagu

SEQ ID NO: 36488 - RNA, 64 nt, Human
gaucucugcugucucuuggaucccaucugccuagauggaagaggauccuauccgaagcuaggau

SEQ ID NO: 36489 - RNA, 64 nt, Human
auaauuaacuuggcuaguugauuguuugaagucuauggaagaaauaguuuuaugcaaaauuuua

SEQ ID NO: 36490 - RNA, 64 nt, Human
uucuuugaauuauuggcagggaauauacuuauguauggaagauuacugcucugagugaaauaaa

SEQ ID NO: 36491 - RNA, 64 nt, Human
cauugugcagugcuuggguuuggagcuuauuugaauggaagaggucaguuuguuccuggcucuc

SEQ ID NO: 36492 - RNA, 64 nt, Human
uugugaaagguguugcuguuugaauugaugagaaauggaagaugagaacucccuaagaguucuc

SEQ ID NO: 36493 - RNA, 64 nt, Human
gguaggagaaggcaucugagucuccuaacccaagauggaagagccagagggcucuggagugagc

SEQ ID NO: 36494 - RNA, 64 nt, Human
gcggcuggucccaaugcccugaaucaccucucucauggaagaaccaauuaacaccaaugaauca

SEQ ID NO: 36495 - RNA, 64 nt, Human
acuucuuuuuacucuaaucauuuuuaaaauacuaauggaagaacuuucuagcacuuuaccacua

SEQ ID NO: 36496 - RNA, 64 nt, Human
accuggauagaagccagggguaaccaugaacuugauggaagaaaauguuacaucuuuauuuuca

SEQ ID NO: 36497 - RNA, 64 nt, Human
gcagugggccgggaucguacuacugcacuccagcauggaagacagcgagacuccgucuccaaaa

SEQ ID NO: 36498 - RNA, 64 nt, Human
aaugaagcaagugauugauuggaaaacauacugaauggaagaaauauuuagauuaaaaaugagg

SEQ ID NO: 36499 - RNA, 64 nt, Human
aguaagacugaaauaaaacucugcugcaggaaagauggaagaaaagacagucaaaugggguggg

SEQ ID NO: 36500 - RNA, 64 nt, Human
cagguuuuucucagcuucaggcagaggagacaacauggaagaagauucccaccagcuaauucuu

SEQ ID NO: 36501 - RNA, 64 nt, Human
uuucauuuaccucugccccaguuguuucuacuacauggaagaccucauuuugaagggaaauuuc

SEQ ID NO: 36502 - RNA, 64 nt, Human
ugauaggucaggggcuagguguugaacuuaguuaauggaagacugagagcagaacagguuuguc

SEQ ID NO: 36503 - RNA, 64 nt, Human
uuuaccaagccguuggucuccuaagggccuccugauggaagaacaguggggugguucaaaguua

SEQ ID NO: 36504 - RNA, 64 nt, Human
cuuuccauccugguacauggaugcuuugaaagauauggaagacagagcccaggccauaauugac

SEQ ID NO: 36505 - RNA, 64 nt, Human
auaggagaaaggguucaugcacacacgugugagaauggaagagcccccuccagaccacucuaca

SEQ ID NO: 36506 - RNA, 64 nt, Human
uuuauucgugcauauuugcucaugucacaggaauauggaagagauuguguauucauuuuuuaca

SEQ ID NO: 36507 - RNA, 64 nt, Human
ugagaagaaccuuacuuccauaauuugggaaggaauggaagauggacaccaccggacaccacca

SEQ ID NO: 36508 - RNA, 64 nt, Human
cagaggacuagaggccaagacuuguuucagaaagauggaagagaguucuuuggaaacccguaga

SEQ ID NO: 36509 - RNA, 64 nt, Human
uaugauauguacaacugagugguacagauaugacauggaagaucugggggaggaaguucaagga

SEQ ID NO: 36510 - RNA, 57 nt, Human
cagcugaagcugagaaguagccuaucuauggaagagacuuuuguuuguguuuaauua

SEQ ID NO: 36511 - RNA, 64 nt, Human
gcuagguuuccauuuagaucuucauaucuguugcauggaagaaaguuggguucuuggcauagag

SEQ ID NO: 36512 - RNA, 64 nt, Human
ggaagacauggauuagcuggaagaucuguauuugauggaagaccuugaaauuauuggaagacau

SEQ ID NO: 36513 - RNA, 64 nt, Human
uuagccagaauaaagaaaccaaaucaugaaaauuauggaagacuauucugccaccugugcccca

SEQ ID NO: 36514 - RNA, 64 nt, Human
uaagauuuucauuuguaggaauaugugaugucaaauggaagacucagaaguuuuguguggccua

SEQ ID NO: 36515 - RNA, 64 nt, Human
aguccuggccgggccaaggccugggaaacugugaaagucagaaaggccagcggggagaggcugg

SEQ ID NO: 36516 - RNA, 64 nt, Human
cccacgacaugucucccuuucuuagaauauauuaaagucagagucucugaggaaggaaugugau

SEQ ID NO: 36517 - RNA, 64 nt, Human
guuuauauugcagggaguguauuuucugaauucuaagucagaacaagcagucugauacaggauc

SEQ ID NO: 36518 - RNA, 64 nt, Human
aaaugccaacuuguccuuuuguaccauggugugaaagucagaugcccagagggcccaggcaggc

SEQ ID NO: 36519 - RNA, 64 nt, Human
aacagagugagacccugucucuuaaagaaaaaaaaagucagacugcugggacuggccagguuuc

SEQ ID NO: 36520 - RNA, 64 nt, Human
gcugcaauaggcuacuuuggcaagcccuccguaaaagucagaggagagaucaguacagagcuaa

SEQ ID NO: 36521 - RNA, 64 nt, Human
auggugaaaaauaucacccucaaucuagugauccaagucagaaaacugggaguuaucgcuacuc

SEQ ID NO: 36522 - RNA, 64 nt, Human
ugaccuaaauugcuagacagucgugccauucacaaagucagaaaauacagcaggaagagacagc

SEQ ID NO: 36523 - RNA, 64 nt, Human
guauuagggaacuuuuaauugacaugagaugcuaaagucagacauuggaauuggaagaacuaua

SEQ ID NO: 36524 - RNA, 64 nt, Human
uuccccuacucucuucucaucuucguauaugacgaagucagaaaacucaucaucaggcgacgcc

SEQ ID NO: 36525 - RNA, 64 nt, Human
agcuccucuggcaauaaaagucagugaaugguggaagucagagaccaacccuggggauugggug

SEQ ID NO: 36526 - RNA, 64 nt, Human
ccacuccggcggacaucacagugacaagauuaacaagucagagucugugguguaugcggauauc

SEQ ID NO: 36527 - RNA, 64 nt, Human
ggauugggaggggggcgggaaaacauggagaauuaagucagauaaugcuggcagccaaaggggc

SEQ ID NO: 36528 - RNA, 64 nt, Human
uuuagguuuuguccucuuugcuuccccaaggcuaaagucagaucuagaguucugccacaggucu

SEQ ID NO: 36529 - RNA, 64 nt, Human
auguauaccccuuacuguaauuuguuccucuuagaagucagaucaucugauuuauagaggauua

SEQ ID NO: 36530 - RNA, 64 nt, Human
gccugcaaaccuucaacucccaucuuuccccaagaagucagagaugcuguuacuugaaugauuu

SEQ ID NO: 36531 - RNA, 64 nt, Human
gguuucuguaguacugacugguucaucacaaggcaagucagaaaccaguauccuucuagcucuc

SEQ ID NO: 36532 - RNA, 64 nt, Human
uaauuuagcauucugauaaaagaaacuuuagagcaagucagaauagagagguguuuuuccuuug

SEQ ID NO: 36533 - RNA, 64 nt, Human
cacugggcugccauuuagccaugugccaucucugaagucagagguguuugacucccauuccuug

SEQ ID NO: 36534 - RNA, 64 nt, Human
ugcugaugaggccucuucccaauuuaaacaacucaagucagaaaucaguucacucccuggaaga

SEQ ID NO: 36535 - RNA, 64 nt, Human
aaauuuuuacaagagauucuguuugggggaacuuaagucagauccagaaccuuggcugcaaggg

SEQ ID NO: 36536 - RNA, 64 nt, Human
ugaaaaaagaaauaauucaaaccuuggaauuaaaaagucagaaaaauaugggauuuucuuucug

SEQ ID NO: 36537 - RNA, 64 nt, Human
gagcuugacucugagagggaaagugacggaaaccaagucagaugagaugacugccauguacacu

SEQ ID NO: 36538 - RNA, 59 nt, Human
accagcucauggagaucugaguucugagcaagucagacuccuuccuuuuggccuccaaa

SEQ ID NO: 36539 - RNA, 64 nt, Human
auauguucauauagaugaaacuaauuuuuggcuuaagucagaacaacuggccaaaauugaaguc

SEQ ID NO: 36540 - RNA, 64 nt, Human
uugcaaaacccacggaaagccucauuuguguggaaagucagaggaaaaaugauccaguggacac

SEQ ID NO: 36541 - RNA, 64 nt, Human
gacaggagaaauuauauuuaacuaaguaaaaguuaagucagaauuacuugggugaugugauuca

SEQ ID NO: 36542 - RNA, 64 nt, Human
uugauugaacuaauaauuuauaaacaugggaaacaagucagaaguagugacauuauuccuagaa

SEQ ID NO: 36543 - RNA, 64 nt, Human
auccucaggcuuugaggagaauacacaggauuugaagucagaagaccuagguuugaguucuggc

SEQ ID NO: 36544 - RNA, 64 nt, Human
uuaacuaauauauccaugaucacacagcuaauaaaagucagagcucaggucuguuuuguuuguu

SEQ ID NO: 36545 - RNA, 64 nt, Human
ggugggagaaggucacagagccucaggaauuuccaagucagaguccccuuugaaccaaguaucu

SEQ ID NO: 36546 - RNA, 64 nt, Human
uuuuggagccagcugagaggucuauuuaaaaaaaaagucagagacagauaccuccaacccugcc

SEQ ID NO: 36547 - RNA, 64 nt, Human
ucaggagugauuuuugcauuugguggaaaaccucaagucagacucaguggcagaacaugcagca

SEQ ID NO: 36548 - RNA, 64 nt, Human
gugccuacagugucgugggccugcucgcuagcagaagucagaaaaggcgauaggcuuggcuuua

SEQ ID NO: 36549 - RNA, 64 nt, Human
aaaaaugaacaugaauggaguggcauuuuguuccaagucagaggugggcaccuauaauaaauga

SEQ ID NO: 36550 - RNA, 64 nt, Human
aaguggacaugcaaaccaaaauuggggauuggagaagucagacucacuagacuuuugguucgag

SEQ ID NO: 36551 - RNA, 64 nt, Human
auagugaucccauguuuguuaauugccaucauggaagucagagaauuaaccaauuaagugacgg

SEQ ID NO: 36552 - RNA, 64 nt, Human
guucuggauuuaaguacucuauagaaaauuugugaagucagaccagaauuuucuuugucccaug

SEQ ID NO: 36553 - RNA, 64 nt, Human
cccccaccccuuaggccccguggugacauuucccaagucagacagaugucagcuucccagccau

SEQ ID NO: 36554 - RNA, 64 nt, Human
ccgugaaguacgugagacuagaagacgcccaaacaagucagauaauaguaacuacaaugguugc

SEQ ID NO: 36555 - RNA, 64 nt, Human
caacauuuuagagucuugcuucccaaaccagaaaaagucagacucauuguugauuuaaaacuuu

SEQ ID NO: 36556 - RNA, 54 nt, Human
gaucagcagaucgauucugauuucaagucagagacuuuuuaucuugccuuugga

SEQ ID NO: 36557 - RNA, 64 nt, Human
uuugaaaagaaauaacugaacauauuuuuuaggcaagucagaaagagaacauggucacccaaaa

SEQ ID NO: 36558 - RNA, 64 nt, Human
guccauuugcuuauuggaggcaaagcuacaauagaagucagagcaucaccagaauggucuuuaa

SEQ ID NO: 36559 - RNA, 64 nt, Human
aguguugccacagaguuacauuaccaauguguagaagucagaaacuagacuucuaguuugguuc

SEQ ID NO: 36560 - RNA, 64 nt, Human
gugaguuaaugaaaacugauucaaccaaauggcgaagucagagacuaucgggggccauggagac

SEQ ID NO: 36561 - RNA, 64 nt, Human
uuuaagugaugagaacauuuaacuuuggugacuaaagucagaauaucuucucacuucacuuaag

SEQ ID NO: 36562 - RNA, 64 nt, Human
cauccuugcugagugggggagacauuuucccugaaagucagaagucaccauagagccugcaaau

SEQ ID NO: 36563 - RNA, 64 nt, Human
uauucaaaccucauuguuauuuggccuaaguaaaaagucagauuucauuuccauuuaccugagu

SEQ ID NO: 36564 - RNA, 64 nt, Human
guaacaucuguagguuuugguuuccaccuauuuaaagucagauuuauagacucgaggagacaga

SEQ ID NO: 36565 - RNA, 64 nt, Human
uuaguucuuagugaucaguggucaguaaucuucaaagucagaaucuaucaccuugguaaauuau

SEQ ID NO: 36566 - RNA, 64 nt, Human
uauuuuauauccagaaagucuucucuauguagagaagucagagagacuagaugcuuucacuagg

SEQ ID NO: 36567 - RNA, 64 nt, Human
uggcauacuaugcaguuuuuauguuuuccauaguaagucagaaaaugccuccuauuucuggcau

SEQ ID NO: 36568 - RNA, 64 nt, Human
agguucaggcuugaagucccugauuucgccaucaaagucagauccaggggggacgaugcuauuc

SEQ ID NO: 36569 - RNA, 64 nt, Human
ggcaccacguguaaggugaugugcacauaucaagaagucagagaaaacacuuuccuggauaaaa

SEQ ID NO: 36570 - RNA, 64 nt, Human
aacagucauguuuuuuaaaaucuuccuuuauaucaagucagagaguauacuucuauaaauuuca

SEQ ID NO: 36571 - RNA, 64 nt, Human
accggagagagaauguauuugcugacaaccauuaaagucagaaguuuuacuccagguuauugca

SEQ ID NO: 36572 - RNA, 64 nt, Human
uuuugaaaguuaacauuaaugccugcuuuuuggaaagucagaaucagaagauagucuuggaagc

SEQ ID NO: 36573 - RNA, 64 nt, Human
uuuucuuuuccugucgccaaggcucgacugagagaagucagaacagagaaggggaaaaaaaacc

SEQ ID NO: 36574 - RNA, 64 nt, Human
uucuuaguucuggagagucuuggcuucugggaggaagucagagggauuaucucaggaucagagc

SEQ ID NO: 36575 - RNA, 64 nt, Human
auuucagguuugacuuguucuuuucagaaggcuaaagucagaggaaugggggcugggccacucc

SEQ ID NO: 36576 - RNA, 64 nt, Human
cccuaguugaauguuauuuucuucuuguuccauuaagucagaauacaaaucagcacagauauuc

SEQ ID NO: 36577 - RNA, 64 nt, Human
aaucugagcacaacuacauacauccaggaaucugaagucagauaguaaggaugugguaccaauc

SEQ ID NO: 36578 - RNA, 64 nt, Human
guuuuaucaccuguucauuugaagaaaaauaauaaagucagaaguucaagugcuauuguguugu

SEQ ID NO: 36579 - RNA, 64 nt, Human
uucuucaaucaagccagauaaauuuuugagacaaaagucagacaguuuuuaauuuuucuugcuu

SEQ ID NO: 36580 - RNA, 64 nt, Human
auuuugguaguugaaauauaagaguggagaagaaaagucagaugguuuguggcaggugccaccg

SEQ ID NO: 36581 - RNA, 64 nt, Human
aaaaucugcuacucagauccacugcauacagaauaagucagaggaaaagcaaaauauaggucug

SEQ ID NO: 36582 - RNA, 64 nt, Human
auggccauuagauguuacaaacuccuugccucuaaagucagaucaugaagggauagguguucau

SEQ ID NO: 36583 - RNA, 64 nt, Human
ugagaauuuuuuccccgauauucuccuucugucaaagucagaacaaauucagggaauuuauuuu

SEQ ID NO: 36584 - RNA, 64 nt, Human
aaugucaaaaauauuuaggaauuuaauaaccuuuaagucagaaacuaaaacaaauacugaaaua

SEQ ID NO: 36585 - RNA, 64 nt, Human
uucaaagguuacuuguuuuuuuuuuuuuuuuuuaaagucagaauguuaacagcugugauauauc

SEQ ID NO: 36586 - RNA, 64 nt, Human
ugaacuuugaggaggaagcagaaucuuugcaagaaagucagaccuguuucuuguaacuggguuc

SEQ ID NO: 36587 - RNA, 64 nt, Human
agacucuggaaguauacuuuuugcauauguaaggaagucagacuuuuuuuuuucacuugacaua

SEQ ID NO: 36588 - RNA, 64 nt, Human
gggauguaaaauggacaguacuaggguagaggggaagucagauuagaggaaagaaagagcauca

SEQ ID NO: 36589 - RNA, 64 nt, Human
auaugcuucggaaacugugcauaguucuaauuguaagucagauuguauauucaaauuguaauua

SEQ ID NO: 36590 - RNA, 64 nt, Human
aaaacugcuauaugagccuuggaaacaugaagcuaagucagaaaaaaaaucagauacaaaaagu

SEQ ID NO: 36591 - RNA, 64 nt, Human
ucaguggaccacuggugacugggcucaugccuccaagucagaguuucccuggugccccagagac

SEQ ID NO: 36592 - RNA, 64 nt, Human
ucugaauuaucguaauuaagcucuccaacucguuaagucagaauauaauaugaaguuccccaag

SEQ ID NO: 36593 - RNA, 64 nt, Human
cucuucagccaugccuuugcugcagcugaaauggaagucagaagugagugaccuguuuucccag

SEQ ID NO: 36594 - RNA, 64 nt, Human
gugccccacacuaacgugugugucuuacauugccaagucagaugguacggacuuccuuuaggau

SEQ ID NO: 36595 - RNA, 64 nt, Human
ugacaugcuaaauuuuauuuuuaaacgguucuucaagucagauuaaaguaauaauagcaaauua

SEQ ID NO: 36596 - RNA, 64 nt, Human
caacaguaucuacugcccucgaggcagcccucccaagucagacaccuccuucggagccacagag

SEQ ID NO: 36597 - RNA, 64 nt, Human
agaguaaacccugugucuugugucuguaguucaaaagucagaaaugauucuaauuuaaacaaaa

SEQ ID NO: 36598 - RNA, 64 nt, Human
agugagccccgugugcacaccacccucccgcugcaagucagauugcugggaggacuggaccguu

SEQ ID NO: 36599 - RNA, 64 nt, Human
aauaaagggaaaaacccaaguucauucccacccaaagucagaaucccucauuggccuuaaggua

SEQ ID NO: 36600 - RNA, 64 nt, Human
uuuuagaagacucuaccagacuguguauucauugaagucagaugugguaacuguuaaauugcug

SEQ ID NO: 36601 - RNA, 64 nt, Human
agugaucuccagaugucacuugguuuauuccugcaagucagaugcaucaucucacucacagggg

SEQ ID NO: 36602 - RNA, 64 nt, Human
ugguuuuuuaaaaaagaaaguguauuuggaaauaaagucagauggaaaauucauuuuuuaaauu

SEQ ID NO: 36603 - RNA, 64 nt, Human
gcuccccuucuccucuaacuauuggaacgccagaaagucagagaaagccuuccauuauucucag

SEQ ID NO: 36604 - RNA, 64 nt, Human
cagggaaugggagaagaugggagcuaagaauguaaagucagaaacuugcacuguuuuaaauguu

SEQ ID NO: 36605 - RNA, 64 nt, Human
uccaucuuccuucagacaucaccacguuucucuaaagucagaaaacauuccguuuuggucuuuu

SEQ ID NO: 36606 - RNA, 64 nt, Human
ccaucuuucaagggucacaagcucacucucugacaagucagaauagggacacugcuucuauccc

SEQ ID NO: 36607 - RNA, 64 nt, Human
caacuguguuucauuugcuguaaucaguuuuuaaaagucagauggaaagagcaacugaaguccu

SEQ ID NO: 36608 - RNA, 64 nt, Human
cuuuaccuaguaugccuuuuuuuaguugcuucucaagucagaaaacuuuucaggaagguuuccc

SEQ ID NO: 36609 - RNA, 64 nt, Human
augcauuugucaauugcacugaauuuaaaucugaaagucagaggugauuauugauaguacuuuu

SEQ ID NO: 36610 - RNA, 64 nt, Human
aaaacgauccugggaaggagccccuaacuagggcaagucagaaauagccaggcucgcagcagcg

SEQ ID NO: 36611 - RNA, 64 nt, Human
aaaaguacaguugagauaguuaagauauaaccacaagucagaguacauugguuguauuuuguaa

SEQ ID NO: 36612 - RNA, 64 nt, Human
cauagagaacaaaguaaaaguaguguuguccaggaagucagaauuuuuaacuguacugaauagg

SEQ ID NO: 36613 - RNA, 64 nt, Human
ccaagccuguagcucuugguauacucacuguugcaagucagaagcuugauuucaucauugaugu

SEQ ID NO: 36614 - RNA, 64 nt, Human
ugggagaauugguauacugguaugacuacgucuuaagucagauuuuuauuuaugagucuuugag

SEQ ID NO: 36615 - RNA, 64 nt, Human
auauaauuuauuggcauuuuugcugaauagguuuaagucagauaauagauuuuaaaaaagcaaa

SEQ ID NO: 36616 - RNA, 64 nt, Human
aguuucuucuccagacuguucuuugguugucacuaagucagaggucuggucccucauguuuagg

SEQ ID NO: 36617 - RNA, 64 nt, Human
uuucuuacuaaauccuauuaaaauaugcaaaaauaagucagauuuuaaggcaaauaaagugaca

SEQ ID NO: 36618 - RNA, 64 nt, Human
gagaagcugcuguuggugcaagggagauggucucaagucagagggaagcagagacgcgcgucuc

SEQ ID NO: 36619 - RNA, 64 nt, Human
uggccuuuuaucaauaugucauaacagcauucugaagucagacauuguuaaauugagcuauuaa

SEQ ID NO: 36620 - RNA, 64 nt, Human
uggacucagaaguaugccaugugaugcuaccuuaaagucagaauaaccugcauuauagcuggaa

SEQ ID NO: 36621 - RNA, 64 nt, Human
uuggaaauuaggagaaggaauuucagguggguuuaagucagagcuaguuccccaacagaaagau

SEQ ID NO: 36622 - RNA, 64 nt, Human
aagauugcaccacuguacuccagccugggugacaaagucagacuccaucuccaaaaaaaaaaga

SEQ ID NO: 36623 - RNA, 64 nt, Human
ggauagaagucuauauucuagccucauuugcaugaagucagauagccagaagaaauuccauugc

SEQ ID NO: 36624 - RNA, 64 nt, Human
guauuuucuuuguauguuaaucauaguuauaguaaagucagacucauuaacuuuucuuccuagu

SEQ ID NO: 36625 - RNA, 64 nt, Human
ucaacgguccaaacgcccaaccuucagaaagaggaagucagauagaaauagucccugagagcac

SEQ ID NO: 36626 - RNA, 64 nt, Human
ggagaucauucccuaaagguauguggguugucugaagucagaaacauauuuacaaaguccuucu

SEQ ID NO: 36627 - RNA, 64 nt, Human
gaaaagaccaggaauccagauuucuggcuuuuaaaagucagaggcucucacuacacuggguccg

SEQ ID NO: 36628 - RNA, 64 nt, Human
ccuaaaagaaauggggaaaaaagaaaacaacagcaagucagaaaaaaaaaacaagagagagaaa

SEQ ID NO: 36629 - RNA, 64 nt, Human
cugcugacaaccaugcagaggaauuuuuccacuuaagucagagccuuccuccccaucuggaauu

SEQ ID NO: 36630 - RNA, 64 nt, Human
ggaaaguccuaggcaauggaguccagauuuuaguaagucagaccccaugugugagaaggaaagc

SEQ ID NO: 36631 - RNA, 64 nt, Human
aaaaugagaacacugagauuugauaggcauguagaagucagaguaagcaagagggcuugaguuc

SEQ ID NO: 36632 - RNA, 64 nt, Human
gaauaugaagcauaucuacccauggcggaaaaugaagucagaaagauuuguagugacauuaggc

SEQ ID NO: 36633 - RNA, 64 nt, Human
uggaggcuggaacagcuggcucuuuuagacucacaagucagacguucgauuccccucugccaau

SEQ ID NO: 36634 - RNA, 64 nt, Human
uucguggugucaguuuaauuagugucaaacuggcaagucagaguuuuacaaccuacuaguaauc

SEQ ID NO: 36635 - RNA, 64 nt, Human
uggaaugguaugaaagcuucagcaaaauaaauaaaagucagaaucuuugcuggucccuuuaaug

SEQ ID NO: 36636 - RNA, 64 nt, Human
uuaaggucaaacacaagaggcuucccuaguuuacaagucagagucacuuguaguccauuuaaau

SEQ ID NO: 36637 - RNA, 64 nt, Human
agacgccacuuggauacugauuugaacaauguagaagucagauucugaauuccaaaguuauuuc

SEQ ID NO: 36638 - RNA, 64 nt, Human
gagcuggcaguagggcacugaguacccuaggaagaagucagagcaauggauacaaaugaccuug

SEQ ID NO: 36639 - RNA, 64 nt, Human
aaacccugaagcuuaugcuucacagcugggcuguaagucagacuugaacccagcugauaugcaa

SEQ ID NO: 36640 - RNA, 64 nt, Human
uuagagaguucauuagagaguauuuauuccuaauaagucagauaaaugucaguuucauuuuuag

SEQ ID NO: 36641 - RNA, 64 nt, Human
cugaccuucgggugaccaggugcuugugaccuacaagucagaguccucucucacagucggccac

SEQ ID NO: 36642 - RNA, 64 nt, Human
uuauuuuuuaauguuuaaaaaguuucuaauauuaaagucagaauauuaauacaauuaauauuaa

SEQ ID NO: 36643 - RNA, 64 nt, Human
acugacaggcagccuggacauagagagggagaagaagucagagagggugacaagauagagagcu

SEQ ID NO: 36644 - RNA, 64 nt, Human
cauuuuuuucuguuuguuucaaucucuaaucuuuaagucagaaccuaauuguacaguggcucug

SEQ ID NO: 36645 - RNA, 64 nt, Human
caagggucuucaggugaugaguagggguacccacaagucagaaggucugcguucuccuaguuug

SEQ ID NO: 36646 - RNA, 64 nt, Human
ugggaguguggauucuagcaaaagagcuggaaaaaagucagacucuccacagacccccuauggg

SEQ ID NO: 36647 - RNA, 64 nt, Human
uuccaguucuucgacuguuguuaucuguuugagaaagucagauucuugcaucccuggcugggau

SEQ ID NO: 36648 - RNA, 64 nt, Human
gcugaugggcgaggaggcccuggcggggggcgacaagucagacccgaaccuuaauaaccccgcg

SEQ ID NO: 36649 - RNA, 64 nt, Human
cagagcuuucuuuuuccuagaaauccagagagcaaagucagagccuggcaccugcagauaggau

SEQ ID NO: 36650 - RNA, 64 nt, Human
uaccagccuucacaggauaagaggacugggaauaaagucagauguaaugugacccuagaaaacu

SEQ ID NO: 36651 - RNA, 64 nt, Human
caucaguguuugaccuguuuagggcagaggcaauaagucagaagucuugaaguugaaauaguua

SEQ ID NO: 36652 - RNA, 64 nt, Human
aacugcaaugaguuaccaucucuuaccagucacaaagucagagaugguggugaggcugcagagc

SEQ ID NO: 36653 - RNA, 64 nt, Human
agcagucaucaauuauaauuaacuuucaaagggcaagucagaaguuguuuauaaauuacaaaau

SEQ ID NO: 36654 - RNA, 64 nt, Human
acuagauuaugagggguuaucuccuguuauuaaaaagucagaaaacacuauacaguaguccucc

SEQ ID NO: 36655 - RNA, 64 nt, Human
gauacuggauuguacuuugugcugggguuaucugaagucagaucugccuaaggacuucuuuaau

SEQ ID NO: 36656 - RNA, 64 nt, Human
cguccccauggccauuggaucaugagacacucugaagucagaaggcuggggcagaucacuucaa

SEQ ID NO: 36657 - RNA, 64 nt, Human
cagaaguagcugcauagaaagggcacuggauuugaagucagaagaccuggguucuugaaccagc

SEQ ID NO: 36658 - RNA, 64 nt, Human
ugaaguguugcaagggaaccuccuagcacugugaaagucagaaucgccucagcauuuccaugac

SEQ ID NO: 36659 - RNA, 64 nt, Human
auuugggcugaauguauguaaauagguuucuaaaaagucagauguuugagcaguggccuacaaa

SEQ ID NO: 36660 - RNA, 64 nt, Human
ccagccaucaagagacugagucaaguuguuccuuaagucagaacagcagacucagcucugacau

SEQ ID NO: 36661 - RNA, 64 nt, Human
uggcugaaauauaucagcccauguuagacagaagaagucagagaagugaagagagaugugugga

SEQ ID NO: 36662 - RNA, 64 nt, Human
accaaaugaccgcacugugaugugaauggcaccgaagucagaugaguaucccuguaggucaccu

SEQ ID NO: 36663 - RNA, 64 nt, Human
guggaaggcccuugguguuacacgauggaucccaaagucagaugggaguacugcaaccugacac

SEQ ID NO: 36664 - RNA, 64 nt, Human
acccgguccuacauucgugauuuuguuuucucccaagucagaaaaauguugaggguauuagaca

SEQ ID NO: 36665 - RNA, 64 nt, Human
aaaggucaaucuucagggcuuccuguuugaagucaagucagagguaaaccggucaguuacagaa

SEQ ID NO: 36666 - RNA, 64 nt, Human
gugcauucuuuuuucaacgcuauccuuagagugaaagucagaaaaaaauacuagaaacuaacuc

SEQ ID NO: 36667 - RNA, 64 nt, Human
cguagagaauuguuuuuagcagaguuugugaccaaagucagaguggaucauggugguuuggcag

SEQ ID NO: 36668 - RNA, 64 nt, Human
cauagaagagcacagcuggccccggcguuucaugaagucagaaggccuggcagccauuuccugg

SEQ ID NO: 36669 - RNA, 64 nt, Human
aaagugagauagauguacugaggagauaauugaaaagucagacucuguacuguggggcuuuaau

SEQ ID NO: 36670 - RNA, 64 nt, Human
uguaauuuuccuacuucuuugauaaaagaaaaauaagucagauuguuaacuccaagauugaaaa

SEQ ID NO: 36671 - RNA, 64 nt, Human
uuccugcuuuuuucacaaugugaguaguuuugaaaagucagaucuggccauuugucuuuccuag

SEQ ID NO: 36672 - RNA, 64 nt, Human
auccuucugaugaaggaugagagagcucauuuagaagucagagcaaacuagggucucaguauug

SEQ ID NO: 36673 - RNA, 64 nt, Human
ugggaugguggcuccuguugucuugcgcucugggaagucagaugucauuucaggccugcagucu

SEQ ID NO: 36674 - RNA, 64 nt, Human
uagagcaacuuuucuuggaacugucccagcuaccaagucagacaccaagguuuaugccaccagg

SEQ ID NO: 36675 - RNA, 64 nt, Human
uuuaaaaauuguauccuagggaacaguuugccauaagucagaauuuugcaguuuagcucauaga

SEQ ID NO: 36676 - RNA, 64 nt, Human
gcacuuugggaggcuggggcaggcggaucaccugaagucagaguucaagaccagccuggccaac

SEQ ID NO: 36677 - RNA, 64 nt, Human
uuggucaacacuaacaugauuuggggaaaggagcaagucagaauagaaauuaguacuccccucc

SEQ ID NO: 36678 - RNA, 64 nt, Human
acucuugcuccucuacaauucauucugcacgcagaagucagaaucaaaaucaaaguucaucaug

SEQ ID NO: 36679 - RNA, 64 nt, Human
uucccacauuuugcuuuuuuuuuuuucuaugcaaaagucagaugcuucuauccauugcuuucug

SEQ ID NO: 36680 - RNA, 64 nt, Human
uuccuguuauaauuucuuuuagcagacaaguuauaagucagauuuaauuagcaucagaguugau

SEQ ID NO: 36681 - RNA, 64 nt, Human
uacucauuuauaauaugggaauaaaaauuugugcaagucagagaagggugccuuaaaaauguug

SEQ ID NO: 36682 - RNA, 64 nt, Human
aaugaugggagaaguuuggggcaggguauccaagaagucagacuguggucaaguaggugguccc

SEQ ID NO: 36683 - RNA, 64 nt, Human
aggggggacugcaugguugcauuuucaucacugaaagucagaggccaaggaaaucauuucuacu

SEQ ID NO: 36684 - RNA, 64 nt, Human
aacuugagaaggcugggaggauuguguauuuugcaagucagauggcugcauuuuugagcauuaa

SEQ ID NO: 36685 - RNA, 64 nt, Human
uuaauugccuauuacuucucucaaagagaaccugaagucagaacacaugagcagggugagaggu

SEQ ID NO: 36686 - RNA, 64 nt, Human
guuaaaauuuggucacugaugccuauaaucguggaagucagagggauuccccuuuuucaucuca

SEQ ID NO: 36687 - RNA, 64 nt, Human
uuccuugggaauggccuuaaaaauaaauguaauaaagucagaguggugguaugaaaacauuccu

SEQ ID NO: 36688 - RNA, 64 nt, Human
uaccacuaauuuuguuuuaaacugugagccguccaagucagaagaagacagcaaaaaaagcaac

SEQ ID NO: 36689 - RNA, 64 nt, Human
guaacauaguccagagaacugacaugcaggucaaaagucagauacgcaaccuccuuaucugcua

SEQ ID NO: 36690 - RNA, 64 nt, Human
cucauucagacuggugauaucgugauguaccuaaaagucagaaaccacauuuucuccucagaag

SEQ ID NO: 36691 - RNA, 64 nt, Human
ggcaccagcuucuuucucgguggcagaaauuuugaagucagagagaaacgguccuuuguuggcu

SEQ ID NO: 36692 - RNA, 64 nt, Human
acucugccauguccuaagugugauucucuucaggaagucagaccuucccugguuuaccuuuuuu

SEQ ID NO: 36693 - RNA, 64 nt, Human
guguaggaagccauacacugaggcggaagaucgcaagucagaguggcuggcaggcacaaccucc

SEQ ID NO: 36694 - RNA, 64 nt, Human
accuccuggacuccuguaaacccccauucuuuccaagucagauagucuucugcugcugguaccu

SEQ ID NO: 36695 - RNA, 64 nt, Human
ccugggcucuuggccaagcggccuuggauggaugaagucagagagguggggugagggugagcuu

SEQ ID NO: 36696 - RNA, 64 nt, Human
ccuaccugagcaacaagaaucuaaacuuuauuccaagucagaaacuguuucugcagagccacuc

SEQ ID NO: 36697 - RNA, 64 nt, Human
uuaaggcauucaacugagaaaacuuuauuugucaaagucagaaaacauuuucaucuuauugaga

SEQ ID NO: 36698 - RNA, 64 nt, Human
auaaaaugagaauucauauauacguucaucuuucaagucagagcaaugaguugggaaaagaggu

SEQ ID NO: 36699 - RNA, 64 nt, Human
auucugugacuugucccaggaccagaauguaccuaagucagauccauagacgcauguugguagg

SEQ ID NO: 36700 - RNA, 64 nt, Human
cacagcacuagcaagugcugccuaugcugagaacaagucagaucugaucccugcccucauggac

SEQ ID NO: 36701 - RNA, 64 nt, Human
uggggccuuaauuccuugcauagucucucuugucaagucagaacagccagguagagcccuuguc

SEQ ID NO: 36702 - RNA, 64 nt, Human
acuuguauuacagauguuacaguuccauguuaggaagucagaaaagacuuguguuugucuuugu

SEQ ID NO: 36703 - RNA, 64 nt, Human
ggaguaauuacaggagggaguuguaggagcuuugaagucagagagggagguagaggccuuuuua

SEQ ID NO: 36704 - RNA, 64 nt, Human
uauuccugcaaaccaucccauuucuacugauuguaagucagaauuucuuuuaucccuuucaaau

SEQ ID NO: 36705 - RNA, 64 nt, Human
uccaaauccacaccagcaccuuguuacagacaagaagucagaggaaagggcggggucccugcag

SEQ ID NO: 36706 - RNA, 64 nt, Human
cuagacuuuuaaaagauuuugugugguuuggugcaagucagaauaaauucuggcuaguugaauc

SEQ ID NO: 36707 - RNA, 64 nt, Human
uguaaauguaagaguggcaggccucugucugugaaagucagaacacagggcucgagccucugga

SEQ ID NO: 36708 - RNA, 64 nt, Human
cugcgcuucuccaacugacaacuggccggucugcaagucagaggauggccagugucugucccgg

SEQ ID NO: 36709 - RNA, 64 nt, Human
ccuccuucucuagguuacaugaggcaggaauaagaagucagacagagacagcaagacaguuaac

SEQ ID NO: 36710 - RNA, 64 nt, Human
ugcccacgccucccagaccccagaacggagcuucaagucagacagaucccugccuuggugggca

SEQ ID NO: 36711 - RNA, 64 nt, Human
cagagggcauuguguauccguaauaauguccuugaagucagagacuggaaauguugaucucuua

SEQ ID NO: 36712 - RNA, 64 nt, Human
cccacccccacccccgcagugugcagauuaaagcaagucagaucauccuuuucuguccuggugg

SEQ ID NO: 36713 - RNA, 64 nt, Human
ccaggggggcaagagcaacaacgucauaauggagaagucagacuuuggucaagaaaguccuucc

SEQ ID NO: 36714 - RNA, 64 nt, Human
ucuuaaauuauuauauguuuggacaauuagcaacaagucagauaguuagaaucgaaguuuuuca

SEQ ID NO: 36715 - RNA, 64 nt, Human
uaauaaaguaguauguaaaaagaaacugcauuuuaagucagacaguaaauguuuuuuuuaauuu

SEQ ID NO: 36716 - RNA, 64 nt, Human
gcucugcagccucucuccuggagugagggggcugaagucagaccaaaggaagaacucagaaaug

SEQ ID NO: 36717 - RNA, 64 nt, Human
cuggcuguccugcgggccacaagcucuucaggccaagucagagcugcuguugcugccacuugga

SEQ ID NO: 36718 - RNA, 64 nt, Human
agcuaaaacagcuacauacaaccuaguacacuugaagucagacagacauuucaguugcuuaccu

SEQ ID NO: 36719 - RNA, 64 nt, Human
gcccgagacaauacaccuccgagcugaauaugaaaagucagaaaugcuacugcuuuuuccaaga

SEQ ID NO: 36720 - RNA, 64 nt, Human
cucuguuuugaagccugcaauguggaaaagugagaagucagagggaacaggacaggugcagccg

SEQ ID NO: 36721 - RNA, 64 nt, Human
gugugaaaaguauacacaaagggcucugaagcucaagucagaggagugggaggucugaucauug

SEQ ID NO: 36722 - RNA, 64 nt, Human
agugguuccgaagacaggcagggacaguggcucaaagucagaucagucuggggucagggaucag

SEQ ID NO: 36723 - RNA, 64 nt, Human
auugcuguuuuuauucaagaauaaacaagacuugaagucagaaaguauucaagaucuauuuuac

SEQ ID NO: 36724 - RNA, 64 nt, Human
gauuguuaauccccaccagcuagacuuugaacuuaagucagacuuaaagauuugagaaauuauu

SEQ ID NO: 36725 - RNA, 64 nt, Human
uuuuucuauguauuuaauauuuuguguacaguaaaagucagaacucauuuaaagaacuuuaagg

SEQ ID NO: 36726 - RNA, 64 nt, Human
uuuguuaggaaggaucuggaauaaucuugaagggaagucagaguuuucucccugccuauuaaca

SEQ ID NO: 36727 - RNA, 64 nt, Human
ucucaaaaaaaaaaaaaaaaaaaaaaaagauaaaaagucagaaaucugaaaaguggaggaagag

SEQ ID NO: 36728 - RNA, 64 nt, Human
uuaaacaugguaagacugagguucugcaggauuaaagucagauuaaggguacagaaagcacacc

SEQ ID NO: 36729 - RNA, 64 nt, Human
augauuuucuaccaaaaguaaaaaggguuguauuaagucagaggaagaugccucuccauuuucc

SEQ ID NO: 36730 - RNA, 64 nt, Human
aagcaaaaagauaguugaaaauaguuaagauccaaagucagaauaggccaaaaaaaaaaaaaaa

SEQ ID NO: 36731 - RNA, 64 nt, Human
ucaccaaucauuuuaacuaaauacucagacuuagaagucagaugcuucaugucacagcauuuag

SEQ ID NO: 36732 - RNA, 64 nt, Human
uuccuuccugcccugcccaccuggggaucccccaaagucagacacagagcaagaguccccuugg

SEQ ID NO: 36733 - RNA, 64 nt, Human
auaaagcagaauauucuccuaccucacgucauuaaagucagaagauuauagaccuucucaaacu

SEQ ID NO: 36734 - RNA, 64 nt, Human
agccacggaaaccauguucuugcuuaagccauuaaagucagagaugaauucuggagugcagcug

SEQ ID NO: 36735 - RNA, 64 nt, Human
cugagaauguacauuugaucugccccagccacggaagucagaguaggaugcacaguacaaagga

SEQ ID NO: 36736 - RNA, 64 nt, Human
uuuagaagugucuuuccagagaagcauaaugagaaagucagacugagguaauaagaccagaauu

SEQ ID NO: 36737 - RNA, 64 nt, Human
gaggagcagaccuaggcagacaccuugagacuaaaagucagagcugaagggagucgcuggggcc

SEQ ID NO: 36738 - RNA, 64 nt, Human
gaaucuguaguuuugauccaaaaucuaaaacuuaaagucagaaaauaauuaaaauuuuucuugu

SEQ ID NO: 36739 - RNA, 64 nt, Human
cuugccagcccaagauaaauacuuuaauuguuaaaagucagaagagacagaauauguaggaaau

SEQ ID NO: 36740 - RNA, 64 nt, Human
gccgaagcugcuuacaguagcugggacaagcugaaagucagacuaagaaauaaagagagggccu

SEQ ID NO: 36741 - RNA, 64 nt, Human
ggaaaggaaaguuccaaagaggugguuucugaggaagucagagcgcccagggccagagcaguca

SEQ ID NO: 36742 - RNA, 64 nt, Human
gugcagagcaaaaucacucaggaucucauggccaaagucagagcgaugcuugcagcuuccaaaa

SEQ ID NO: 36743 - RNA, 64 nt, Human
caagugaauuggccccggucucacauuuucagugaagucagacucagaacuagguccuggguuu

SEQ ID NO: 36744 - RNA, 64 nt, Human
auuuucuguuuuuucucuagagagguacaguuguaagucagaguuaauauaauagggccuguga

SEQ ID NO: 36745 - RNA, 64 nt, Human
uggaucagaggaaaaauccagugugacagagugcaagucagaagaccuggcuuuucaucccagc

SEQ ID NO: 36746 - RNA, 64 nt, Human
gguagagauagacacguuuuuagauggugcauucaagucagaguuggaagggucauacaggacc

SEQ ID NO: 36747 - RNA, 64 nt, Human
uuucaccugcugaugcugcccuggguccagacucaagucagauacaacccugauuuuugaccuu

SEQ ID NO: 36748 - RNA, 64 nt, Human
uucauggccucuucuugaaaucaagacuuuuuaaaagucagacaugaacuugcaugucaugaag

SEQ ID NO: 36749 - RNA, 64 nt, Human
aauaucuuuuuucccccacugcgagguuguuuuaaagucagauuuguauaaggaaagccaaauu

SEQ ID NO: 36750 - RNA, 64 nt, Human
aaaaauuauguuaguguguuuucaguaugcuaaaaagucagagugauacaaaagugauauuuaa

SEQ ID NO: 36751 - RNA, 64 nt, Human
cuacuuuguuauuguaccuaaguaaauuuucuuuaagucagaagcccauuaaaauaguuacaag

SEQ ID NO: 36752 - RNA, 64 nt, Human
uggagcuuccggagcaguuucugggggcucuuccaagucagaagaauggaggaagguggacaag

SEQ ID NO: 36753 - RNA, 64 nt, Human
ugauguguaugucuaagccucauguaccgauuugaagucagacuuaaaaauguauuuacagauu

SEQ ID NO: 36754 - RNA, 64 nt, Human
uagaagaauauauuuauaaagauuccuugcugcuaagucagaucagauuugcuaacaggaagca

SEQ ID NO: 36755 - RNA, 64 nt, Human
gcauguguguuuauuguuccuaagaauuuggcacaagucagagauaauugccuauacuaagaau

SEQ ID NO: 36756 - RNA, 64 nt, Human
aauuuuauuuucggcguugcaaugcggggaggagaagucagauuauguacauaguuuucuaaaa

SEQ ID NO: 36757 - RNA, 64 nt, Human
uguuauugguuccugaauaaaacauuaaccuuuuaagucagaaggaaccucgguacuucuuaag

SEQ ID NO: 36758 - RNA, 64 nt, Human
guauuugaaacagagaacgugucccagggcccaaaagucagaagggccccaccagccaggaaag

SEQ ID NO: 36759 - RNA, 64 nt, Human
gaguaguaccaucugacuccuacacuuucauuacaagucagauuuuucuuaaacuagcaggcaa

SEQ ID NO: 36760 - RNA, 64 nt, Human
caaucuuauguuagcaggacaacccaugaaaaacaagucagagagugaaggcuuuuuccccuaa

SEQ ID NO: 36761 - RNA, 64 nt, Human
cauuguauauuuguauuuuaugaccaaguagaccaagucagaaagaucucucucgagcguacca

SEQ ID NO: 36762 - RNA, 64 nt, Human
uccucgcagugucgccgccaccccagcguaguccaagucagacuauuucacaaagucagagcga

SEQ ID NO: 36763 - RNA, 64 nt, Human
caccccagcguaguccaagucagacuauuucacaaagucagagcgauaggaaagcacccugccc

SEQ ID NO: 36764 - RNA, 64 nt, Human
ucuuauuuaaaaagaaagcuaaaagcauacuucuaagucagagccucuauuuugguguaagacu

SEQ ID NO: 36765 - RNA, 64 nt, Human
cagaguugcugucuucucugagacacacaaaucuaagucagaccauugcuccacgcccucccac

SEQ ID NO: 36766 - RNA, 64 nt, Human
gagcaggaggagcuuuuuaugcuuauguugaaucaagucagauacaaaaagcaauugucccucu

SEQ ID NO: 36767 - RNA, 64 nt, Human
uuucuugggggacucacucacuggugccaguucuaagucagagacaaaauuccacugucuguuc

SEQ ID NO: 36768 - RNA, 64 nt, Human
uuuuuuuuuuuuuuucccuaaaugguauggccaaaagucagaguuaaaauauauauaguuagau

SEQ ID NO: 36769 - RNA, 64 nt, Human
ugcaggcaggcccuguggccugcugggcugagggaagucagagccccagggcgccacgaagcag

SEQ ID NO: 36770 - RNA, 64 nt, Human
uuuccuagcuuagagcauuuguaucuauauuuuaaagucagaguucauguuaccuguuuuaauc

SEQ ID NO: 36771 - RNA, 64 nt, Human
agaaagaauggagcaaguugugccuauuuccuccaagucagauaagguuucuaaaauaaauaaa

SEQ ID NO: 36772 - RNA, 64 nt, Human
agccugccucccaguagaggcccuucaccuggagaagucagaaaucugacccaauuccaccccc

SEQ ID NO: 36773 - RNA, 64 nt, Human
uuucugggcccuacugcuccccucugcugcagguaagucagagcagcuuuaccacagcuucagg

SEQ ID NO: 36774 - RNA, 64 nt, Human
uagcuuagagcauuuauaucuacaauacauuuuaaagucagaguucauguuaccuguuuuaauc

SEQ ID NO: 36775 - RNA, 64 nt, Human
ucuaaagagucagacgccacaggcauucccauuaaagucagaaacuagccaagggcaagcuauu

SEQ ID NO: 36776 - RNA, 64 nt, Human
ccaucugcucccacggcagcaccaucaacucaacaagucagaagccaaguggaucaucuguguc

SEQ ID NO: 36777 - RNA, 64 nt, Human; identical to SEQ ID NO: 36770

SEQ ID NO: 36778 - RNA, 64 nt, Human
uagcuuagagcauuuguaucuacaauacauuuuaaagucagaguucguguucccuguuuuaauc

SEQ ID NO: 36779 - RNA, 64 nt, Human
gaagcuaggaaugagcaacacaaauuuuacucugaagucagaagagcucauauauaauaauucu

SEQ ID NO: 36780 - RNA, 64 nt, Human
uauguauauaugggacauuuuaucuucuggcccaaagucagaacuuuauaaaaaucuugaguuu

SEQ ID NO: 36781 - RNA, 64 nt, Human
ccaucauauuuuuucgguguugaaacaacauugaaagucagaauuggauuuguuuuuaauucuu

SEQ ID NO: 36782 - RNA, 64 nt, Human
uccacagcacacguucuguaggagaugcgccuugaagucagagaagugucccguggacaacguc

SEQ ID NO: 36783 - RNA, 64 nt, Human
aacguucucucagcccagagcagcaaacacaugaaagucagaagucucuaauauaucauuuguc

SEQ ID NO: 36784 - RNA, 64 nt, Human
ugcaaaucacugaaaacccaacucaaagugacuuaagucagaaagaaauuuuaugaauucaggu

SEQ ID NO: 36785 - RNA, 64 nt, Human
ccaucuggccugugugcccaucuuuuucuggagaaagucagauucacagcaugacagagauuug

SEQ ID NO: 36786 - RNA, 64 nt, Human
ugccacaaaauaagggcuauagagagauuuuuacaagucagauuuuuuguuccccaaaucuuuu

SEQ ID NO: 36787 - RNA, 64 nt, Human
uauugcuuccuugcgcaacuucucaaaacgaugaaagucagaaggcugucaaacucaaauaucu

SEQ ID NO: 36788 - RNA, 64 nt, Human
ccagauucugcauuugcgauguuacuagcagcagaagucagauuguagagguccuggcggcuga

SEQ ID NO: 36789 - RNA, 64 nt, Human
cagaauauguaauuauuugauaaccaaggaagucaagucagauggcuaaguaguaacuuuccaa

SEQ ID NO: 36790 - RNA, 64 nt, Human
acgucugcagagagugugggagggcuuuagccggaagucagaccuccucagucaccagaggaca

SEQ ID NO: 36791 - RNA, 64 nt, Human
caaauauggagagugugggcaagguuucagugauaagucagauguuauuacacaccaaaggaca

SEQ ID NO: 36792 - RNA, 64 nt, Human
uagguaggaguggccuaaauugucuaauguaauaaagucagacaaaaugcacacuuuauaguuu

SEQ ID NO: 36793 - RNA, 64 nt, Human
cgaagcauguuccccccgacgccccccuuggcacaagucagaugaagcacguucugccggggag

SEQ ID NO: 36794 - RNA, 64 nt, Human
cuagaugcauaauaacuggagugccugcugguggaagucagaaugcuccuggaggcugcagagg

SEQ ID NO: 36795 - RNA, 64 nt, Human
ugaagggaauugauggcaagaggauccccugagcaagucagaaguuacucucaucagucguuca

SEQ ID NO: 36796 - RNA, 64 nt, Human
gaagugugugugacgcccauugagcuguuacccgaagucagauuaaaaaucagggaguguuuuc

SEQ ID NO: 36797 - RNA, 64 nt, Human
acuaaaggcuaaggcuccaagagcuugggaucagaagucagaaguuuggaauguggugggucaa

SEQ ID NO: 36798 - RNA, 64 nt, Human
uucaaguugcagucagaagaucuuucuuaauagaaagucagaugacuaccguguugguugugac

SEQ ID NO: 36799 - RNA, 64 nt, Human
acuuuuuaaaauuuaaaauuaauuuuugaaaucaaagucagacacacccaugguaaaaaaaaaa

SEQ ID NO: 36800 - RNA, 64 nt, Human
uagguaggaguggccuaaauuaucuaauguaauaaagucagacaaaaugcauacuuuauaguuc

SEQ ID NO: 36801 - RNA, 64 nt, Human
gccccucaugacugagggcagaagaaauugcuagaagucagaacaggauggcugggucuccccc

SEQ ID NO: 36802 - RNA, 64 nt, Human
accugaggcaucgaaugggcuaaaggucagccagaagucagagggcucucagccuucauccagc

SEQ ID NO: 36803 - RNA, 64 nt, Human
ccuuuaguuggugcggaugccccguggccaggucaagucagagcaccuggacagguguccuccc

SEQ ID NO: 36804 - RNA, 64 nt, Human
gcacuuugggaggcugaggcaggcggaucaccugaagucagaaguuugagaccagccuggccaa

SEQ ID NO: 36805 - RNA, 64 nt, Human
uagguaggacuggccuaaauugucuaauguaauaaagucagacaaaaugcauacuuuauaguuu

SEQ ID NO: 36806 - RNA, 64 nt, Human
uauuaaugacaaaauuagagucuggaagugacagaagucagaucuacagccacccagaggaaag

SEQ ID NO: 36807 - RNA, 64 nt, Human
auuaacuucaauguaaucaugccuccuauuacugaagucagauuggaaccacuaaagauccaaa

SEQ ID NO: 36808 - RNA, 64 nt, Human
gugauaugaaaacuuuuguuaugugaagauauuuaagucagaaaauuguuaaauaauauuacuu

SEQ ID NO: 36809 - RNA, 64 nt, Human
uauuuauaaaucauuuccuuucuuuuuuuccccaaagucagaauugcucaaagaaaauuauuua

SEQ ID NO: 36810 - RNA, 64 nt, Human
uuuuuuuuuuuuuuaauaauuugguauuuauugaaagucagauggauucuuuugcuuucugagg

SEQ ID NO: 36811 - RNA, 64 nt, Human
ucaaauugguggggagugaauaaauacaauuuaaaagucagaaaucaguuuggcaaaguguacu

SEQ ID NO: 36812 - RNA, 64 nt, Human
caggacugcucacgggucaggagggcaacgccugaagucagaccucccuauaggucaacaggga

SEQ ID NO: 36813 - RNA, 64 nt, Human
ucucuccaucaccaaauccuuacuccaaauccagaagucagagccaacucccaucuugguucug

SEQ ID NO: 36814 - RNA, 64 nt, Human
acaacaugggaaggucgcagcguacuaagugaagaagucagaggacagaggaauuucucuuucu

SEQ ID NO: 36815 - RNA, 64 nt, Human
acaguauuuaaaauggaugcagcccuaacugcaaaagucagagaggcugacaaggaccaaugcu

SEQ ID NO: 36816 - RNA, 64 nt, Human
auauccaguaaaauagauuaaacuuccauuuauaaagucagaaccuaucucugaaaauuaaugu

SEQ ID NO: 36817 - RNA, 64 nt, Human
caggaaggcgcucagccuuggcuggaguagaauuaagucagagccaacagguggggagagacag

SEQ ID NO: 36818 - RNA, 64 nt, Human
gauugagggaucacagccccuccaggcaagggagaagucagaggcugauucuuguagaauuaac

SEQ ID NO: 36819 - RNA, 64 nt, Human
uuugccauaggcuuucuggggcuuucucuuuuuaaagucagacuguugaagguuucuucuauuc

SEQ ID NO: 36820 - RNA, 64 nt, Human
cuucucaauaaucaaugaaguagcugagaaaacuaagucagaaagugcauuaaacugaaucaca

SEQ ID NO: 36821 - RNA, 64 nt, Human
aauucacaaugaguuaacugauaaaacaaaacagaagucagacaauguuuuaaauugaaugauc

SEQ ID NO: 36822 - RNA, 64 nt, Human
aacaaaugccuuucauauauacgagaaccaaaugaagucagaauuugccauuauugcacaucac

SEQ ID NO: 36823 - RNA, 64 nt, Human
gcacuuuggaaggcugagguggguggaucaccugaagucagaaguuugagaccagccuggcaaa

SEQ ID NO: 36824 - RNA, 64 nt, Human
uucagccacgaagggauggaugugcaucugcccuaagucagauugaagccuccuccuaggcucc

SEQ ID NO: 36825 - RNA, 64 nt, Human
aagagcaagacccacucuguuccagaagcccuauaagucagaguuggacaacucaauguaaauu

SEQ ID NO: 36826 - RNA, 64 nt, Human
ccaggcccgauccuaccaccucgccuugacccugaagucagagcaggccagccaagcaggaagc

SEQ ID NO: 36827 - RNA, 64 nt, Human
guuuccaccauuuccuuuuaguggagaagagaggaagucagaggguagggaccuuugccugccc

SEQ ID NO: 36828 - RNA, 64 nt, Human
uuuauuugcuucuaaaaugcaaagaugaauacuaaagucagaagcaguguuucauuuugaacac

SEQ ID NO: 36829 - RNA, 64 nt, Human
aaacugggcggcagccagaguucccugaagugggaagucagagcuccaugcacacagugucuuc

SEQ ID NO: 36830 - RNA, 64 nt, Human
uauucucugcaauuuguuuaaagaauaaaguccaaagucagaucuggucuaguuaaccuagaag

SEQ ID NO: 36831 - RNA, 64 nt, Human
cccaccugcugaaucuucucuucacuugcugagaaagucagaggaggggauccaguagcccuuu

SEQ ID NO: 36832 - RNA, 64 nt, Human
uagaagaggaaaaaaauggcaauuuuugagugccaagucagaaaguguguauuaccuuguaaag

SEQ ID NO: 36833 - RNA, 64 nt, Human
cacaaggaagcaacuuuauucuauauagcuuuaaaagucagaacuagaauuguucauucuuuca

SEQ ID NO: 36834 - RNA, 64 nt, Human
ugguggaguggcagggagugcugagugccacaggaagucagacaaggaaggagaguguggggca

SEQ ID NO: 36835 - RNA, 64 nt, Human
ccaugucuauagaguaacacacuggaccgaggaaaagucagauuucauuuucuacccuggaugu

SEQ ID NO: 36836 - RNA, 64 nt, Human
cugaccucugagaacuggaaacgaguuuguacagaagucagaacuuuggguugggaaugagauc

SEQ ID NO: 36837 - RNA, 64 nt, Human
guugguuuucugagcagggggcugaacugugaacaagucagacaaauaaagcaagggucugcac

SEQ ID NO: 36838 - RNA, 64 nt, Human
ccuagcaucuugggaggcccaggcaggaggguugaagucagaauuucacgacaguccggguaac

SEQ ID NO: 36839 - RNA, 64 nt, Human
uauugccaggaaaagcuauucauuaugcguugugaagucagaaaguaaaaaaggguagauagaa

SEQ ID NO: 36840 - RNA, 64 nt, Human
agcauauauguuauuaauauuugauaugauuuuaaagucagaauaguacagauugcugaguauu

SEQ ID NO: 36841 - RNA, 64 nt, Human
guucaugacaauggcagauguaaaguuauucuugaagucagauugaggcugggagacagccgua

SEQ ID NO: 36842 - RNA, 64 nt, Human
uuguaaggggaagaauaacauuugauaaauauuaaagucagaauaauucuccuauuugucguua

SEQ ID NO: 36843 - RNA, 64 nt, Human
aaaaaugaacuuauuccccacucagggccagagaaagucagaacaaagaaaauguccccgaaac

SEQ ID NO: 36844 - RNA, 64 nt, Human
acagcugccccuauuuacugacuugggagaaguaaagucagaaagaacgaacagcugugggggg

SEQ ID NO: 36845 - RNA, 64 nt, Human
uacaagcuauuuaaguuuauauuccaucacaaccaagucagacuuguauuauaagucaaggaug

SEQ ID NO: 36846 - RNA, 64 nt, Human
gauauuauuacuugaauguucucagggaggcagcaagucagaaggccuagguucuaguccuagc

SEQ ID NO: 36847 - RNA, 64 nt, Human
aagaggcaacagauagaguguccuugguaauaagaagucagagauuuacaauaugacuuuaaca

SEQ ID NO: 36848 - RNA, 64 nt, Human
uuauguuauuagcuacgauuucaaggucacuuugaagucagacuucacaguuuucuacaggugu

SEQ ID NO: 36849 - RNA, 64 nt, Human
ucggauaucuucucaccuauguucccuggcuaagaagucagagguagccaauguuuccuuaaau

SEQ ID NO: 36850 - RNA, 64 nt, Human
cccaaacuucugucgaggagcaaggcuugccagcaagucagaaggauuugaaccgagcagccaa

SEQ ID NO: 36851 - RNA, 64 nt, Human
aauucuuaagcaagaaacuuuuuuugaugaaaacaagucagaucuacacagucacacaauuauu

SEQ ID NO: 36852 - RNA, 64 nt, Human
cggcccuggugacccggcgggaccugcgggcgcgcggcccgacgaccagagggcgagccugcuc

SEQ ID NO: 36853 - RNA, 64 nt, Human
uccauuuuuuaaaaagguuucucugacggccccacggcccgagccgcggugagcgucguguugc

SEQ ID NO: 36854 - RNA, 64 nt, Human
aauccucggggccugagcccaguggccuccuggccggcccgacacggccuucgucugguuccuc

SEQ ID NO: 36855 - RNA, 64 nt, Human
uuacuacccaagcccccugaacaaacacagcuuccggcccgaggccucaccuggacaacggugc

SEQ ID NO: 36856 - RNA, 64 nt, Human
ccgaccuaggcggucuuguggcccggagccggcccggcccgaaaaccauagaccugguuguacu

SEQ ID NO: 36857 - RNA, 64 nt, Human
agaacuaaccuuuaccuaccaaagccacguuccacggcccgaggcuuaaacaggaccaaugaga

SEQ ID NO: 36858 - RNA, 64 nt, Human
agugccauaagugggccugugaggucacaccgcccggcccgagguaucgcaugugcgggggagg

SEQ ID NO: 36859 - RNA, 64 nt, Human
ugcaugcccuccguggcugggcugccaccccacccggcccgaaucugucuugaccugcaggaau

SEQ ID NO: 36860 - RNA, 64 nt, Human
cagggcaggggcaggggcagggacaguggccaggcggcccgaggacuuacggucggcacuucuc

SEQ ID NO: 36861 - RNA, 64 nt, Human
uguaggaacccagccugaggggaagccacaggaucggcccgagacccaggccaugcccacuggg

SEQ ID NO: 36862 - RNA, 64 nt, Human
ggccggcguccgaggccgggcggugagaagggugcggcccgaggugcucccaggugcuacucag

SEQ ID NO: 36863 - RNA, 64 nt, Human
cacucggcuaucaggccacagcagcccccuggugcggcccgagaccgggcagaguggaccucac

SEQ ID NO: 36864 - RNA, 64 nt, Human
aagugcugggauuacaggcguuagccacugcgcccggcccgagaaaauacaguuuuaaaaagag

SEQ ID NO: 36865 - RNA, 64 nt, Human
aagggaacgugguacucacuggaugcacccaggccggcccgagccucccaccgcagacagugug

SEQ ID NO: 36866 - RNA, 64 nt, Human
gccuccccaggcggugccccugagccccccgcagcggcccgagcuggcggaagccccacggcgg

SEQ ID NO: 36867 - RNA, 64 nt, Human
cacccgcgggccuccgcugcccgacgcuucuguucggcccgaccuccaccccggcucccaauaa

SEQ ID NO: 36868 - RNA, 64 nt, Human
aguagcugggacuacaggcacacgccaccucgcccggcccgaucuuucuaaaauacaguucuga

SEQ ID NO: 36869 - RNA, 64 nt, Human
cugucugcccaaaugggcucugaccgugcucugucggcccgagacauuuggaaguccuggggga

SEQ ID NO: 36870 - RNA, 64 nt, Human
cagccgccuucagugcuguauuuagugcagugcccggcccgacccgcgggggugccacagccuu

SEQ ID NO: 36871 - RNA, 52 nt, Human
uccacagauggaggagaugagacggcccgaaguucucucugacccccaccuc

SEQ ID NO: 36872 - RNA, 63 nt, Human
ucacgcggccggccaagugaggcccggagaccccggcccgaggcgcccaggccugagccccau

SEQ ID NO: 36873 - RNA, 64 nt, Human
gcgcugccggagcccagagcgcgcgucgaaccgucggcccgagggcgcagaccugaggcgaggc

SEQ ID NO: 36874 - RNA, 64 nt, Human
ggggccccaccgcccccuuggucagcgcaggccacggcccgagggggcgcccgcaguggacagg

SEQ ID NO: 36875 - RNA, 64 nt, Human
cuuggaguggggaauggugggaguaggggucauccggcccgaggccugcccuggcacacgcguu

SEQ ID NO: 36876 - RNA, 64 nt, Human
accgugaggguugggacccaccgaggcgcagaggcggcccgaaugcagcccugguucaggcccg

SEQ ID NO: 36877 - RNA, 64 nt, Human
ccaucucuuguccguucccacccaccccccuccucggcccgagccuuuucccggugggugucag

SEQ ID NO: 36878 - RNA, 64 nt, Human
cuaccuccagaaccgacaguuccagcaaaagcagcggcccgagcagaagaucgaggacaucagc

SEQ ID NO: 36879 - RNA, 64 nt, Human
gggucgugaccgcuuacaccccuucuccacagcccggcccgaccuggagggcccccggggcacu

SEQ ID NO: 36880 - RNA, 64 nt, Human
uggcaacaggacagaguucacaggaggccagugggcgggccaugagggacagggucuuuuuuca

SEQ ID NO: 36881 - RNA, 64 nt, Human
agaauuguauauaagcuucaguaaaguucaaaaagcgggccaggugugguggcucaugccugua

SEQ ID NO: 36882 - RNA, 54 nt, Human
agaggcaggcccagcaguagggcugcgggccacgcccaggccggcuccgcggga

SEQ ID NO: 36883 - RNA, 56 nt, Human
ucacccugacggagaucuaaaggccugcgggccacagcuccccaggaguucagugc

SEQ ID NO: 36884 - RNA, 64 nt, Human
uuggggaggacacagcuucagcacagccucuccugcgggccagcccgcugcgaacccuccacca

SEQ ID NO: 36885 - RNA, 64 nt, Human
uuaagaaaguuuaaaaauuuguguuggacuucaugcgggccacagguuggacaagcuugcccua

SEQ ID NO: 36886 - RNA, 64 nt, Human
gcguuucugcagucuuuguaaaggccccacgagagcgggccaggccgugugccucaggcccuuc

SEQ ID NO: 36887 - RNA, 58 nt, Human
uaaacgaggacauggagugacuaucggggcgggccaaccccgagaaugaagauuggaa

SEQ ID NO: 36888 - RNA, 64 nt, Human
gcucuccuugaggaaggggaagcaggauacccuggcgggccacccugccagccagcagcuggcc

SEQ ID NO: 36889 - RNA, 64 nt, Human
ggacuccaaagccgcggggacaccgggaagugcagcgggccaggcaggcugggugggagggagg

SEQ ID NO: 36890 - RNA, 64 nt, Human
ucugcaggguuauucccugcaccucgaggccgcugcgggccaaucuggagugaaacacggggac

SEQ ID NO: 36891 - RNA, 64 nt, Human
gcagaauucagaauauuaaaaaguucauacauuugcgggccauuguaccuuuuuuuuuuuuuuu

SEQ ID NO: 36892 - RNA, 64 nt, Human
gcccgggcuagaauuuagcagacagcuguuccacgcgggccagggcggcaugaagaagucccgc

SEQ ID NO: 36893 - RNA, 64 nt, Human
ccgaaguggacugaagcuacaguuuuuagcuggugcgggccacaggcagggucagauugagaag

SEQ ID NO: 36894 - RNA, 64 nt, Human
aacuaaguuaaaugaacauuuaaaaguuucccuagcgggccauuccuuagcaaaauguuggaau

SEQ ID NO: 36895 - RNA, 64 nt, Human
gagcagagggaggagaagaaggggugcucaggcugcgggccacaguccagcagcgccagaagca

SEQ ID NO: 36896 - RNA, 64 nt, Human
caggcggcugcggcagcucugguaacgccgugcggcgggccagcugggcugcccgguucccagc

SEQ ID NO: 36897 - RNA, 64 nt, Human
cugccgcagacgggcacagacacgcucgcgggcagcgggccaggcccgcaccccggccucaggg

SEQ ID NO: 36898 - RNA, 64 nt, Human
uagacaugcuaccacugguacuuccuuucucccugcgggccaggcacugcccuuuucaggaagc

SEQ ID NO: 36899 - RNA, 64 nt, Human
cgcgugguucugccacuuagggagugugccuugggcgggccauuucacauuccugacccucacu

SEQ ID NO: 36900 - RNA, 64 nt, Human
uggcauuaccuccguguuucucccuuucgagccggcgggccacagacgucggaagaaacucccg

SEQ ID NO: 36901 - RNA, 64 nt, Human
ugcugaccucagugcaaggcuggugaacccugcagcgggccagcuauggugggaagccuggcau

SEQ ID NO: 36902 - RNA, 64 nt, Human
ccaggcuuuccuugaccccacuucuggcuguccugcgggccacaagcucuucaggccaagucag

SEQ ID NO: 36903 - RNA, 64 nt, Human
ccagggggcccccugcggccugggccccccugcccacggccagcuuccugcugaugaacaugcu

SEQ ID NO: 36904 - RNA, 64 nt, Human
ccgcccuccccauccccuacucccacugcucagcgcgggccauugcaagggugccacacaaugu

SEQ ID NO: 36905 - RNA, 64 nt, Human
cuuuaacaggcugccaggagcgggggcggcgggggcgggccagcuggacgggcugccggccgcu

SEQ ID NO: 36906 - RNA, 58 nt, Human
acgcuguccggcgaaacuagcaaccagggcgggccaguugggcaauggagcugcugga

SEQ ID NO: 36907 - RNA, 64 nt, Human
acauuuggacaaugagaggcugcuccugcggccugcgggccaccuccucuuccuuggcuccugc

SEQ ID NO: 36908 - RNA, 64 nt, Human
gagcccgggagguaauugggggugaggaagaugugcgggccagggaauguguuccacagagagg

SEQ ID NO: 36909 - RNA, 57 nt, Human
ccaaaccccgcacgccaugagcccgccgcgggccauacgcuggacgagucggaccga

SEQ ID NO: 36910 - RNA, 64 nt, Human
uuugccuuuaggcaggaagucaggagccagcagggcgggccaggagaaagaaggcuuaacauua

SEQ ID NO: 36911 - RNA, 64 nt, Human
ugugcuaauuuauuccacgguagcucucacaccagcgggccaguuauuaaaagcuguuuaauuu

SEQ ID NO: 36912 - RNA, 64 nt, Human
agaugaaugcugaaggaaccaacaguccaccucagcgggccagcagcccagggaaccccugccc

SEQ ID NO: 36913 - RNA, 64 nt, Human
uccuggaaaaaccugggcagugggaggcucagcugcgggccauugauuugagccuuugagggag

SEQ ID NO: 36914 - RNA, 64 nt, Human
agugaggaauaguugagccccaaguccugaagaggcgggccagccaggcgggcucaaggaaagg

SEQ ID NO: 36915 - RNA, 64 nt, Human
gagcuguggccaaggucaagccuguguugccagugcgggccaagcuggcccagccuggagcugg

SEQ ID NO: 36916 - RNA, 64 nt, Human
gucugaaggcugucgucgguuacagcgggaaugggcgggccaacauggucuggaggccggacac

SEQ ID NO: 36917 - RNA, 64 nt, Human
gggcgggcaggaaccggggcugcgcgcagcgcuugcgggccagagugaguuccgggugggcgug

SEQ ID NO: 36918 - RNA, 64 nt, Human
uauugauguaaaauuaucggcuagggaagcagcagcgggccaggugugguggcuuaccccugua

SEQ ID NO: 36919 - RNA, 64 nt, Human
ccgggacugucugauugaggacagugacgacgaggcgggccagagcugagcgugaggacgugcu

SEQ ID NO: 36920 - RNA, 64 nt, Human
gccaucucaccuccugcugggcagggggcaugaugcgggccagugcuccagccacagaaaagaa

SEQ ID NO: 36921 - RNA, 64 nt, Human
guguccagucuccuccaaucaauggccuucgggggcgggccagcggccgcucaauccccacucc

SEQ ID NO: 36922 - RNA, 64 nt, Human
cucgggagcugcacacaccuggguggacacaaggcacggccacgucaugucucuaaacugcggu

SEQ ID NO: 36923 - RNA, 64 nt, Human
ggggcccgggcgugacugugcccccucccacccugcgggccaggguccugucgccaccacuucc

SEQ ID NO: 36924 - RNA, 64 nt, Human
cucuggguucugcucugagauggucagagaagaugcgggccaggagacuuacucaggugggacu

SEQ ID NO: 36925 - RNA, 64 nt, Human
ucugcucggccgucuucacucgcccccggguuuggcgggccaaggacugccgaccgaggcugga

SEQ ID NO: 36926 - RNA, 64 nt, Human
accaaagccccagggggugcagaagacucaccacgcgggccagccucucucuuuugcccugcuc

SEQ ID NO: 36927 - RNA, 64 nt, Human
cccgggcaccugagggcuucucccucuggacacugcgggccagguguacauagagcagcgcggc

SEQ ID NO: 36928 - RNA, 64 nt, Human
uagaugccucuuaggacuggugccuggcacagccgcgggccaggaggcugccacacggaagcaa

SEQ ID NO: 36929 - RNA, 64 nt, Human
cacccccauccuaccccggcgccgggcgcggggagcgggccaccgguccugccgcucuccuggg

SEQ ID NO: 36930 - RNA, 64 nt, Human
acccuucuugucuuccuucccggcagcgcccgcagcgggccauuuacacgucgaggcuggcacc

SEQ ID NO: 36931 - RNA, 64 nt, Human
agugagauccugucucuaaauaaauaaauaaaaugcgggccaggcacaguggcucacaccugua

SEQ ID NO: 36932 - RNA, 64 nt, Human
gucucucagaacucagcgucccaagacgcucugggcgggccaacuguagcuuguucucaugugg

SEQ ID NO: 36933 - RNA, 59 nt, Human
gggaacgagccaacaugugaccggcgagcgcgggccaccccacccuguucauuuccaua

SEQ ID NO: 36934 - RNA, 64 nt, Human
gagcgagacaccaguagccaggugaagggccacagcgggccaggccccgacccuguugugaccc

SEQ ID NO: 36935 - RNA, 64 nt, Human
ggaagagcucacugccagcugcggccugggcaccgcgggccauguguguuugcaugaggaacuc

SEQ ID NO: 36936 - RNA, 64 nt, Human
cccggagggcggcugggagcugagcguggcgcaagcgggccagggcgcgggcgcggaccccggg

SEQ ID NO: 36937 - RNA, 64 nt, Human
ggcugguuuucuaugaacgauuccggccugggaugcgggccaggcugcaggcggcauaguuggg

SEQ ID NO: 36938 - RNA, 64 nt, Human
ugcagcagauguacgacaugaucaugcagcacaagcgggccaugcaggacaugcagcugcugug

SEQ ID NO: 36939 - RNA, 64 nt, Human
gagagcuucccuccuuucccaucuggggagugccgcgggccacagugggcagguggcaccgggg

SEQ ID NO: 36940 - RNA, 64 nt, Human
agcauacagagcaggccacgcucaggcccggcaugcgggccaccaaguucuggaaaccacgugg

SEQ ID NO: 36941 - RNA, 64 nt, Human
aguuugugauguaaggcacugucaggaauggggggcgggccagggugggaagagaagaaauagc

SEQ ID NO: 36942 - RNA, 64 nt, Human
uaguguuucuguauaauaaagugucugccggcucgcgggccaggauccucucggugggaugggc

SEQ ID NO: 36943 - RNA, 64 nt, Human
ugggcaccacagacaggaggccccucaggcccgugcgggccacugucugcugccgccugccggg

SEQ ID NO: 36944 - RNA, 64 nt, Human
agcugaaguuuuaggagacagcuuaggguuuggugcgggccacggggaggggaccgggaagcgc

SEQ ID NO: 36945 - RNA, 64 nt, Human
aacuccaggugcagggcgggccuccaggugcagggcgggccagaagcccccucaucggcccgca

SEQ ID NO: 36946 - RNA, 64 nt, Human
cagcccaagcccugcacuggaucgugaggacgcugcgggccagcggcuucagcucggaggcgga

SEQ ID NO: 36947 - RNA, 64 nt, Human
cccagcugguggccgugcuggucuacaccgccgagcgggccaaguucgccaccgggguagagcg

SEQ ID NO: 36948 - RNA, 64 nt, Human
cuccuggacgagcucucucgggcccaggccuggagcgggccaagcagaggagcccucgggucag

SEQ ID NO: 36949 - RNA, 64 nt, Human
ggauggauuguaguucauuugacccuccccauccgcgggccauccggcuuguguccagcuuuua

SEQ ID NO: 36950 - RNA, 64 nt, Human
cggucgugcccggggaggccggguuccccucgcugcgggccaggcuuggcuccugauucccucu

SEQ ID NO: 36951 - RNA, 64 nt, Human
gagggugccccugggaacacagugccccaguggugcgggccaggucuggcgccaggggcaggca

SEQ ID NO: 36952 - RNA, 64 nt, Human
gccccaaguuccccaggcccagugggguggccgggcgggccacgcgggaccgacuuuccauuga

SEQ ID NO: 36953 - RNA, 64 nt, Human
ugucccuuugcaaugaggaggagaucugggcugggcgggccagcuggggaagcauuugacuauc

SEQ ID NO: 36954 - RNA, 64 nt, Human
ugcuguguuuuccaguguccugugacuguccugugcgggccauagggcagggcccugucccagc

SEQ ID NO: 36955 - RNA, 64 nt, Human; identical to SEQ ID NO: 36852

SEQ ID NO: 36956 - RNA, 64 nt, Human; identical to SEQ ID NO: 36853

SEQ ID NO: 36957 - RNA, 64 nt, Human; identical to SEQ ID NO: 36854

SEQ ID NO: 36958 - RNA, 64 nt, Human; identical to SEQ ID NO: 36855

SEQ ID NO: 36959 - RNA, 64 nt, Human; identical to SEQ ID NO: 36856

SEQ ID NO: 36960 - RNA, 64 nt, Human; identical to SEQ ID NO: 36857

SEQ ID NO: 36961 - RNA, 64 nt, Human; identical to SEQ ID NO: 36858

SEQ ID NO: 36962 - RNA, 64 nt, Human; identical to SEQ ID NO: 36859

SEQ ID NO: 36963 - RNA, 64 nt, Human; identical to SEQ ID NO: 36860

SEQ ID NO: 36964 - RNA, 64 nt, Human; identical to SEQ ID NO: 36861

SEQ ID NO: 36965 - RNA, 64 nt, Human; identical to SEQ ID NO: 36862

SEQ ID NO: 36966 - RNA, 64 nt, Human; identical to SEQ ID NO: 36863

SEQ ID NO: 36967 - RNA, 64 nt, Human; identical to SEQ ID NO: 36864

SEQ ID NO: 36968 - RNA, 64 nt, Human; identical to SEQ ID NO: 36865

SEQ ID NO: 36969 - RNA, 64 nt, Human; identical to SEQ ID NO: 36866

SEQ ID NO: 36970 - RNA, 64 nt, Human; identical to SEQ ID NO: 36867

SEQ ID NO: 36971 - RNA, 64 nt, Human; identical to SEQ ID NO: 36868

SEQ ID NO: 36972 - RNA, 64 nt, Human; identical to SEQ ID NO: 36869

SEQ ID NO: 36973 - RNA, 64 nt, Human; identical to SEQ ID NO: 36870

SEQ ID NO: 36974 - RNA, 52 nt, Human; identical to SEQ ID NO: 36871

SEQ ID NO: 36975 - RNA, 63 nt, Human; identical to SEQ ID NO: 36872

SEQ ID NO: 36976 - RNA, 64 nt, Human; identical to SEQ ID NO: 36873

SEQ ID NO: 36977 - RNA, 64 nt, Human; identical to SEQ ID NO: 36874

SEQ ID NO: 36978 - RNA, 64 nt, Human; identical to SEQ ID NO: 36875

SEQ ID NO: 36979 - RNA, 64 nt, Human; identical to SEQ ID NO: 36876

SEQ ID NO: 36980 - RNA, 64 nt, Human; identical to SEQ ID NO: 36877

SEQ ID NO: 36981 - RNA, 64 nt, Human; identical to SEQ ID NO: 36878

SEQ ID NO: 36982 - RNA, 64 nt, Human; identical to SEQ ID NO: 36879

SEQ ID NO: 36983 - RNA, 64 nt, Human
uccuggaugugcaacugguuugcacugcacaccccacggccauguaacucuccuguccacauau

SEQ ID NO: 36984 - RNA, 64 nt, Human; identical to SEQ ID NO: 36880

SEQ ID NO: 36985 - RNA, 64 nt, Human; identical to SEQ ID NO: 36881

SEQ ID NO: 36986 - RNA, 54 nt, Human; identical to SEQ ID NO: 36882

SEQ ID NO: 36987 - RNA, 56 nt, Human; identical to SEQ ID NO: 36883

SEQ ID NO: 36988 - RNA, 64 nt, Human; identical to SEQ ID NO: 36884

SEQ ID NO: 36989 - RNA, 64 nt, Human; identical to SEQ ID NO: 36885

SEQ ID NO: 36990 - RNA, 64 nt, Human; identical to SEQ ID NO: 36886

SEQ ID NO: 36991 - RNA, 58 nt, Human; identical to SEQ ID NO: 36887

SEQ ID NO: 36992 - RNA, 64 nt, Human; identical to SEQ ID NO: 36888

SEQ ID NO: 36993 - RNA, 64 nt, Human; identical to SEQ ID NO: 36889

SEQ ID NO: 36994 - RNA, 64 nt, Human; identical to SEQ ID NO: 36890

SEQ ID NO: 36995 - RNA, 64 nt, Human; identical to SEQ ID NO: 36891

SEQ ID NO: 36996 - RNA, 64 nt, Human; identical to SEQ ID NO: 36892

SEQ ID NO: 36997 - RNA, 64 nt, Human; identical to SEQ ID NO: 36893

SEQ ID NO: 36998 - RNA, 64 nt, Human; identical to SEQ ID NO: 36894

SEQ ID NO: 36999 - RNA, 64 nt, Human; identical to SEQ ID NO: 36895

SEQ ID NO: 37000 - RNA, 64 nt, Human; identical to SEQ ID NO: 36896

SEQ ID NO: 37001 - RNA, 64 nt, Human; identical to SEQ ID NO: 36897

SEQ ID NO: 37002 - RNA, 64 nt, Human; identical to SEQ ID NO: 36898

SEQ ID NO: 37003 - RNA, 64 nt, Human; identical to SEQ ID NO: 36899

SEQ ID NO: 37004 - RNA, 64 nt, Human; identical to SEQ ID NO: 36900

SEQ ID NO: 37005 - RNA, 64 nt, Human; identical to SEQ ID NO: 36901

SEQ ID NO: 37006 - RNA, 64 nt, Human; identical to SEQ ID NO: 36902

SEQ ID NO: 37007 - RNA, 64 nt, Human; identical to SEQ ID NO: 36904

SEQ ID NO: 37008 - RNA, 64 nt, Human; identical to SEQ ID NO: 36905

SEQ ID NO: 37009 - RNA, 58 nt, Human; identical to SEQ ID NO: 36906

SEQ ID NO: 37010 - RNA, 64 nt, Human
accuguugaucuaaggggccgcgauggucagggccacggccaagggccacgggaacuuggagag

SEQ ID NO: 37011 - RNA, 64 nt, Human; identical to SEQ ID NO: 36907

SEQ ID NO: 37012 - RNA, 64 nt, Human; identical to SEQ ID NO: 36908

SEQ ID NO: 37013 - RNA, 57 nt, Human; identical to SEQ ID NO: 36909

SEQ ID NO: 37014 - RNA, 64 nt, Human; identical to SEQ ID NO: 36910

SEQ ID NO: 37015 - RNA, 64 nt, Human; identical to SEQ ID NO: 36911

SEQ ID NO: 37016 - RNA, 64 nt, Human; identical to SEQ ID NO: 36912

SEQ ID NO: 37017 - RNA, 64 nt, Human; identical to SEQ ID NO: 36913

SEQ ID NO: 37018 - RNA, 64 nt, Human; identical to SEQ ID NO: 36914

SEQ ID NO: 37019 - RNA, 64 nt, Human; identical to SEQ ID NO: 36915

SEQ ID NO: 37020 - RNA, 64 nt, Human; identical to SEQ ID NO: 36916

SEQ ID NO: 37021 - RNA, 64 nt, Human; identical to SEQ ID NO: 36917

SEQ ID NO: 37022 - RNA, 64 nt, Human; identical to SEQ ID NO: 36918

SEQ ID NO: 37023 - RNA, 64 nt, Human; identical to SEQ ID NO: 36919

SEQ ID NO: 37024 - RNA, 64 nt, Human; identical to SEQ ID NO: 36920

SEQ ID NO: 37025 - RNA, 64 nt, Human; identical to SEQ ID NO: 36921

SEQ ID NO: 37026 - RNA, 64 nt, Human; identical to SEQ ID NO: 36923

SEQ ID NO: 37027 - RNA, 64 nt, Human; identical to SEQ ID NO: 36924

SEQ ID NO: 37028 - RNA, 64 nt, Human; identical to SEQ ID NO: 36925

SEQ ID NO: 37029 - RNA, 64 nt, Human
auccccucgagacccucuggugccaggcuugcuucacggccaucuuguguugucacugcagagu

SEQ ID NO: 37030 - RNA, 64 nt, Human; identical to SEQ ID NO: 36926

SEQ ID NO: 37031 - RNA, 64 nt, Human; identical to SEQ ID NO: 36927

SEQ ID NO: 37032 - RNA, 64 nt, Human; identical to SEQ ID NO: 36928

SEQ ID NO: 37033 - RNA, 64 nt, Human; identical to SEQ ID NO: 36929

SEQ ID NO: 37034 - RNA, 64 nt, Human; identical to SEQ ID NO: 36930

SEQ ID NO: 37035 - RNA, 64 nt, Human; identical to SEQ ID NO: 36931

SEQ ID NO: 37036 - RNA, 64 nt, Human; identical to SEQ ID NO: 36932

SEQ ID NO: 37037 - RNA, 59 nt, Human; identical to SEQ ID NO: 36933

SEQ ID NO: 37038 - RNA, 64 nt, Human; identical to SEQ ID NO: 36934

SEQ ID NO: 37039 - RNA, 64 nt, Human; identical to SEQ ID NO: 36935

SEQ ID NO: 37040 - RNA, 64 nt, Human; identical to SEQ ID NO: 36936

SEQ ID NO: 37041 - RNA, 64 nt, Human; identical to SEQ ID NO: 36937

SEQ ID NO: 37042 - RNA, 64 nt, Human; identical to SEQ ID NO: 36938

SEQ ID NO: 37043 - RNA, 64 nt, Human; identical to SEQ ID NO: 36939

SEQ ID NO: 37044 - RNA, 64 nt, Human; identical to SEQ ID NO: 36940

SEQ ID NO: 37045 - RNA, 64 nt, Human; identical to SEQ ID NO: 36941

SEQ ID NO: 37046 - RNA, 64 nt, Human; identical to SEQ ID NO: 36942

SEQ ID NO: 37047 - RNA, 64 nt, Human; identical to SEQ ID NO: 36943

SEQ ID NO: 37048 - RNA, 64 nt, Human; identical to SEQ ID NO: 36944

SEQ ID NO: 37049 - RNA, 64 nt, Human; identical to SEQ ID NO: 36945

SEQ ID NO: 37050 - RNA, 64 nt, Human; identical to SEQ ID NO: 36946

SEQ ID NO: 37051 - RNA, 64 nt, Human; identical to SEQ ID NO: 36947

SEQ ID NO: 37052 - RNA, 64 nt, Human; identical to SEQ ID NO: 36948

SEQ ID NO: 37053 - RNA, 64 nt, Human; identical to SEQ ID NO: 36949

SEQ ID NO: 37054 - RNA, 64 nt, Human; identical to SEQ ID NO: 36950

SEQ ID NO: 37055 - RNA, 64 nt, Human; identical to SEQ ID NO: 36951

SEQ ID NO: 37056 - RNA, 64 nt, Human; identical to SEQ ID NO: 36952

SEQ ID NO: 37057 - RNA, 64 nt, Human; identical to SEQ ID NO: 36953

SEQ ID NO: 37058 - RNA, 64 nt, Human; identical to SEQ ID NO: 36954

SEQ ID NO: 37059 - RNA, 64 nt, Human
gaaaaugacagcuucacagccccuugaggagugaccaagccacaaaguaaauccuaaagccaca

SEQ ID NO: 37060 - RNA, 64 nt, Human
ugaaaugauuaaguauaagaccagauucauggagccaagccacuacauucuguggaaggagauc

SEQ ID NO: 37061 - RNA, 64 nt, Human
uuaagggaucccagccugccccuccacuucucucccaagccaggucccggcauggguggguuau

SEQ ID NO: 37062 - RNA, 64 nt, Human
aauuuuauuuuaauuugagaaauaaagauuuccuccaagccacaugaggacucuggcacccacc

SEQ ID NO: 37063 - RNA, 64 nt, Human
acccuucccaccccagcccuugcuggucccuaggccaagccaccaagugaaaccuuccaggaua

SEQ ID NO: 37064 - RNA, 64 nt, Human
gugaaguggucuugauugauuuugauuuucacugccaagccaaucaugugaaggacagaagcuu

SEQ ID NO: 37065 - RNA, 64 nt, Human
ccaggucccaagcgauaacacugucuaagcacccccaagccacuauccacuuugaauccugcuc

SEQ ID NO: 37066 - RNA, 64 nt, Human
caaauucauuugguguacuaacaucaaaauguauccaagccauuuaaaaaauauuuauauauac

SEQ ID NO: 37067 - RNA, 64 nt, Human
agggacaggaaggcugggggagggaguuuacaacccaagccauuccacccccuccccugcuggg

SEQ ID NO: 37068 - RNA, 64 nt, Human
agucucuuucgggggcagaggcuuucucugggugccaagccauauauauuagggaauaguagau

SEQ ID NO: 37069 - RNA, 64 nt, Human
ucaguggucugugccaaccaaacgauagccccauccaagccagcugagaaccuaggaaggagua

SEQ ID NO: 37070 - RNA, 64 nt, Human
uggaguucagaggcccaaaacuucucccccaaagccaagccauuuaaugaccucaguuugcgua

SEQ ID NO: 37071 - RNA, 64 nt, Human
ugucuguagaccuuguaaucagcacauugucaccccaagccauagucucucucuuauuuguauc

SEQ ID NO: 37072 - RNA, 64 nt, Human
gagucugcccuaugaccugccuuuggcauguuacccaagccauggagagagccccuucuccauc

SEQ ID NO: 37073 - RNA, 64 nt, Human
ccacuggccccacgucacacaguuacagugaagcccaagccaggccugguugagggugauaaac

SEQ ID NO: 37074 - RNA, 64 nt, Human
caucccgaugaaccugcaucauuccccgacacugccaagccaacccuggaaaaggaguucgcug

SEQ ID NO: 37075 - RNA, 64 nt, Human
ggcaaccuucccucucuccuuggugaagaacaucccaagccagaaagaaguuaacuacaguguu

SEQ ID NO: 37076 - RNA, 64 nt, Human
caacucauugaaggucuuauuuauauaauuuuuuccaagccaaggagaccauuggccauccagg

SEQ ID NO: 37077 - RNA, 64 nt, Human
acugguguguaaaaggcaggccuuacauuagaagccaagccaauccuuuuucuuuuuuuuggag

SEQ ID NO: 37078 - RNA, 64 nt, Human
acgcagaagcacugagcaagagagcccuuucuugccaagccagugcucuuuugguauauggcau

SEQ ID NO: 37079 - RNA, 64 nt, Human
ugggggucugccaagcugugaggaccaguagccaccaagccacccacaagcccccucccaauga

SEQ ID NO: 37080 - RNA, 64 nt, Human
aguuucauacuucagccccucuguaggaaugagaccaagccacagcugucuuuugaauuacgua

SEQ ID NO: 37081 - RNA, 64 nt, Human
gucuuggcugcccaagacucuuguugccuuucuuccaagccauggccaugcccuuuuucucaaa

SEQ ID NO: 37082 - RNA, 64 nt, Human
ggccuuaacuuaguccauagcguccucaccuuccccaagccacacauccuccucccaucccuug

SEQ ID NO: 37083 - RNA, 64 nt, Human
guggcucuucucugcugauggaaacagaagggcgccaagccaugccuaaaaagaucucgccaau

SEQ ID NO: 37084 - RNA, 64 nt, Human
caguugcugggugcugggcccuggcaggaaugggccaagccaagcaggggagacuagagagcac

SEQ ID NO: 37085 - RNA, 64 nt, Human
cuggcaggaacucagggcccuggagcugcuggggccaagccaaggccuccccuaccucaaaccc

SEQ ID NO: 37086 - RNA, 64 nt, Human
gcacgcugcuggcagagaugguuugagaacacauccaagccaguccccccagcccagcuucccc

SEQ ID NO: 37087 - RNA, 64 nt, Human
gucaccaugcaagggugacaucgacaaccacguaccaagccaccgcagcugcugccacucugcu

SEQ ID NO: 37088 - RNA, 64 nt, Human
uauuuguugaaaugaaugauaagagcauugguccccaagccagagagccagaagccaucaccca

SEQ ID NO: 37089 - RNA, 64 nt, Human
gccuccaccugccugucugauccaagagcugagacacggccacccagcaccagucacuccucug

SEQ ID NO: 37090 - RNA, 58 nt, Human
ccccuuggggacccugguaaccccagccccaagccaggaggacgacugugucuuuggg

SEQ ID NO: 37091 - RNA, 64 nt, Human
uagcaaaagccuuggcaccuguuggagacuaugaccaagccaauaaaaagggcauuuaaaucag

SEQ ID NO: 37092 - RNA, 64 nt, Human
ucuucccuggagccuacagagcaggcaggcuaggccaagccaggcucaacuucugggcucccag

SEQ ID NO: 37093 - RNA, 64 nt, Human
gccuagcaauacagcaucuuuuccuuucacuaguccaagccaaaaauuuuaagaugauuuguca

SEQ ID NO: 37094 - RNA, 64 nt, Human
uaguggcauaaaaaaguagcaucagggucuuuucccaagccagugagcaagagcauuauuucau

SEQ ID NO: 37095 - RNA, 64 nt, Human
agaggggagauuuaaaggaccagggacaugggaaccaagccauagggaucagagggccuugucc

SEQ ID NO: 37096 - RNA, 64 nt, Human
gaucuguuucccuguguccugugaauggaaggacccaagccaauauguuccuuugaaaagaguc

SEQ ID NO: 37097 - RNA, 64 nt, Human
uggccacaggcagguccagucacugcaaaagugaccaagccagcaggucacccuuaacuucaga

SEQ ID NO: 37098 - RNA, 64 nt, Human
cuaaacagauauuuuuguuucucaucuuaacuauccaagccaccuauuuuauuuguucuuucau

SEQ ID NO: 37099 - RNA, 64 nt, Human
auacaguuacacuuuuugcugcuuuuauuuucuuccaagccaaucaaucagccaguuccuagca

SEQ ID NO: 37100 - RNA, 64 nt, Human
augugugugugugcguguguguauaguuuuagcuccaagccaagcaaguuuguguuuggauaga

SEQ ID NO: 37101 - RNA, 64 nt, Human
ucucuagcuuuccacaaauccuaaaauuccugucccaagccacccaaauucucagaucuuuucu

SEQ ID NO: 37102 - RNA, 64 nt, Human
ugucgucgagggcuccuccaccaccggccggcucccaagccagcguugcgcagaugcacggcca

SEQ ID NO: 37103 - RNA, 64 nt, Human
aauuccuaagaacuuucuaucaaaagcauuggauccaagccauauauugaaauacaagcgugau

SEQ ID NO: 37104 - RNA, 64 nt, Human
cagcauggacagucacucuugcacuauuccuucuccaagccagaaaccacauuuaauuucauaa

SEQ ID NO: 37105 - RNA, 62 nt, Human
acaugaccuugggcacaugaagaucauguccuccaagccaugaaagugucuacgcuuuuguu

SEQ ID NO: 37106 - RNA, 64 nt, Human
gaccaugcucaucugcugguccgugggacggugcccaagccagaggcuggguucauuuguguaa

SEQ ID NO: 37107 - RNA, 64 nt, Human
gagggcagagccauggguucugugcuggagggugcacggccaagaucuccagacugcugguucc

SEQ ID NO: 37108 - RNA, 64 nt, Human
gaggugggccagucuguggaucagagaugcaccaccaagccaagggaaccuguguccgguauuc

SEQ ID NO: 37109 - RNA, 64 nt, Human
gacugacuggccugggccugggguggggacguccccaagccaaauuacuccagggccucugcuc

SEQ ID NO: 37110 - RNA, 64 nt, Human
uacuuuugcauccaguuuuuauaguuuuccacaaccaagccacccuucacagauaaaauaugau

SEQ ID NO: 37111 - RNA, 64 nt, Human
cuuguaggaauguaaaucuguauuaaaaggggguccaagccaggcccccaggucuucucauugu

SEQ ID NO: 37112 - RNA, 64 nt, Human
uggaagacagggccccggcuggacacacguggaaccaagccagggaugggcuggccauuguguc

SEQ ID NO: 37113 - RNA, 64 nt, Human
caggaaacccgcuuccccuuccugacagcuccugccaagccaaaugugcuuccugcagcucacg

SEQ ID NO: 37114 - RNA, 64 nt, Human
cccucggggccugagaagaucugaguccucaaucccaagccaccugcacaccuggaagccaaug

SEQ ID NO: 37115 - RNA, 64 nt, Human
cagcucuguguagguaaccagauggcucuuuuucccaagccaccaucuuccagcugaccagacu

SEQ ID NO: 37116 - RNA, 64 nt, Human
cccugcaucuugggcuccaucggccgaaacuuucccaagccagggugugcggagcuucccugua

SEQ ID NO: 37117 - RNA, 64 nt, Human
cccaaggugcccgagugaucugaggauuuauaauccaagccacaccacccugguuguucucugg

SEQ ID NO: 37118 - RNA, 64 nt, Human
ggaacugaggccccccagauguugccuccgguguccaagccacagcggucuggcuguugggaag

SEQ ID NO: 37119 - RNA, 64 nt, Human
aaaaugugcagcuugacucugcugaggaaaagguccaagccaagaggacuggcaggcggggccu

SEQ ID NO: 37120 - RNA, 64 nt, Human
agggaaaagggcccuaugugucaggccucugagcccaagccaagcaucgcauccccugugauuu

SEQ ID NO: 37121 - RNA, 64 nt, Human
gaacuaagagugagucacucccaugagaacagcaccaagccauucaugggggaaucugccccca

SEQ ID NO: 37122 - RNA, 64 nt, Human
caaaaagacuguggccugcccagcucucguauccccaagccacaccaucuggcuaaauggacau

SEQ ID NO: 37123 - RNA, 64 nt, Human
uuuauuagccagugaaacacuugcuugccaacugccaagccauacuuauuaaguucgaacaugu

SEQ ID NO: 37124 - RNA, 64 nt, Human
gggcagagcagcauucugagagacgcacaggagaccaagccagaccaauaaacagaacacuuuu

SEQ ID NO: 37125 - RNA, 64 nt, Human
uagguucugagacacuugaagaagcuuguggcucccaagccacaaguagucauucuuagccuug

SEQ ID NO: 37126 - RNA, 64 nt, Human
acguuugauaugaucaugccagauuggagaagauccaagccaggaagaugggcuugaagcaaac

SEQ ID NO: 37127 - RNA, 56 nt, Human
gccugcauccuacagagugagcuuggccaagccagcugcaaaccuggccagaggag

SEQ ID NO: 37128 - RNA, 64 nt, Human
ugaaggcuaauggcagaguuagcaccccacucucccaagccaccccugcaagcagcacagcagg

SEQ ID NO: 37129 - RNA, 64 nt, Human
gaaucacagagucauugacccuaucauuauuucaccaagccaauaccagccgccauccuucucc

SEQ ID NO: 37130 - RNA, 64 nt, Human
uaacauguaugcuuuucagaauacaguugucuagccaagccaucaagugucugaaauucaauau

SEQ ID NO: 37131 - RNA, 64 nt, Human
auguccugggauucugcuggaucucaaagaugugccaagccaaggaaaaagauacaagagcaga

SEQ ID NO: 37132 - RNA, 64 nt, Human
gguccuguaaaagauacugaggaaugucuuucagccaagccaagaggaugguuucaauaaaccu

SEQ ID NO: 37133 - RNA, 64 nt, Human
ucauugccaaugucaagaaaaagagcuaaauuuaccaagccauguuguuuuuuacuaaauacca

SEQ ID NO: 37134 - RNA, 64 nt, Human
cugccggucgaccaaucugccugccacacauugaccaagccagacccgguucacccagcucgag

SEQ ID NO: 37135 - RNA, 64 nt, Human
accccuuuucacuuuuguuauauagguuuaauccccaagccaaggauaguacuuaguauuucac

SEQ ID NO: 37136 - RNA, 64 nt, Human
ucagaguucuuccacuguauguuugaagagaugaccaagccagaauauggaauguucauguauc

SEQ ID NO: 37137 - RNA, 64 nt, Human
agcaggacuuuguguacaguuaaaggagagauggccaagccagggacaaauugucuauuagaaa

SEQ ID NO: 37138 - RNA, 64 nt, Human
uuuguagcccaguggcaucagcagucacagagcaccaagccaaaaaaaguacggcccucagcca

SEQ ID NO: 37139 - RNA, 64 nt, Human
gucuauccaagaggcuuuguuuaggacgugggucccaagccaagccuuaaguguggaauucgga

SEQ ID NO: 37140 - RNA, 64 nt, Human
acuucuaguauuggaucugaaaauaaagugucauccaagccauaaaaaaaaaagaaaagaaaaa

SEQ ID NO: 37141 - RNA, 64 nt, Human
auucaucacacagcauacgcuacacauggaacacccaagccaugacugaacacguucucagugc

SEQ ID NO: 37142 - RNA, 64 nt, Human
cgggcaagggccgugcccgcccaccucugcugcccacggccacccacccuucuccccugccccg

SEQ ID NO: 37143 - RNA, 64 nt, Human
caugugcccugagagcugccucucaaucccugucccaagccacagcuauggcauuaaugucacc

SEQ ID NO: 37144 - RNA, 64 nt, Human
augcccauuauccaaaugcagaaccucugcaucuccaagccaguuaugcugaauuugucaaacu

SEQ ID NO: 37145 - RNA, 64 nt, Human
uauggaaagguccuguggggagcccauccucucgccaagccaucacaggcucugcauacacaug

SEQ ID NO: 37146 - RNA, 52 nt, Human
ggcuuccaucugacagcuaaagccaagccacagagggggccucuugaccgac

SEQ ID NO: 37147 - RNA, 64 nt, Human
aguagauugauucacccuacccacaggacauucaccaagccacugauaccauuuuauauuucau

SEQ ID NO: 37148 - RNA, 64 nt, Human
aaagucguacuguucacacacacaguuugagacuccaagccaagagugccacaucccuauccug

SEQ ID NO: 37149 - RNA, 64 nt, Human
cagagcagacuuugccagugccccucaggucaaaccaagccaagagcacccuguccccauucca

SEQ ID NO: 37150 - RNA, 64 nt, Human
gcucugugacccugcuccugucaccccaauuucuccaagccagagguagcuuucucagagcccc

SEQ ID NO: 37151 - RNA, 64 nt, Human
ugccagaaucuguauguaucaauacaggguuuuuccaagccaggaaacgcccuccuuggcuacu

SEQ ID NO: 37152 - RNA, 64 nt, Human
cuguccgugggcagcccaguccccacagucacggccaagccacgcagaacgaacaugacuccag

SEQ ID NO: 37153 - RNA, 64 nt, Human
uugacauauuuauguauggugcaccuacugugugccaagccauguuagagauacagugggagca

SEQ ID NO: 37154 - RNA, 64 nt, Human
acacaugauaccucaauugacaaucuuccucccaccaagccagacacguuguaaaugcugcuuc

SEQ ID NO: 37155 - RNA, 64 nt, Human
aaagagcuaaagcaugucaguggcaugaugcuugccaagccagaucuaggcaucuaggauaauu

SEQ ID NO: 37156 - RNA, 64 nt, Human
ggugcgcgguugggcagacaccugggaggagucuccaagccaugugcacagcacacacgugcag

SEQ ID NO: 37157 - RNA, 64 nt, Human
acaagcuauuuuaaagauaauggcauuauuauuuccaagccauagcuugggcugaaggacaaau

SEQ ID NO: 37158 - RNA, 64 nt, Human
aacacacacagcuccuuucacuccugccugacugccaagccaccugcaucccccgccccagauc

SEQ ID NO: 37159 - RNA, 64 nt, Human
ccaaauugucagccuucuuaccuggccaagguguccaagccagaaaggaaaaaagguuauggag

SEQ ID NO: 37160 - RNA, 64 nt, Human
cccgaggccuucucugaaggacauugcggacagccacggccaggccagagggagugacagaggc

SEQ ID NO: 37161 - RNA, 64 nt, Human
uaucaauccugcccccagccauggugaggaagccccaagccauggugacacacagcagcacugc

SEQ ID NO: 37162 - RNA, 64 nt, Human
aggcugggacagccccguccccaccauccuccucccaagccaauuaaaugaucacagcacgcgu

SEQ ID NO: 37163 - RNA, 64 nt, Human
auguauauauauuuauaaccacuuaaauugugagccaagccauguaaaagaucuacuuuuucua

SEQ ID NO: 37164 - RNA, 64 nt, Human
cuauaugcuaccaagaacuuuaggauccaauuuuccaagccaccgugaagccucuuauggcuac

SEQ ID NO: 37165 - RNA, 64 nt, Human
uugauuucccuaguaaccuugcagauauguuuaaccaagccauagcccaugccuuuugagggcu

SEQ ID NO: 37166 - RNA, 64 nt, Human
uaagcgugagguaucuucuuuguguguguguuuuccaagccaacacacucuacagauucuuuau

SEQ ID NO: 37167 - RNA, 64 nt, Human
cagacacaaagaugaagugugccagcugguucccccaagccagcucaugcugcugaccacugac

SEQ ID NO: 37168 - RNA, 64 nt, Human
agcacagccuauaucuuuguucucucauguugauccaagccagagacaucaguaacaaauagca

SEQ ID NO: 37169 - RNA, 64 nt, Human
uucaguuuuaugcauucucuccugccccaaagugccaagccauuugugaaggcucugccagaca

SEQ ID NO: 37170 - RNA, 64 nt, Human
acagucuuccauagauuuuuaaggaagaaagggcccaagccaggagaucgcuugguuuucuucc

SEQ ID NO: 37171 - RNA, 64 nt, Human
cagagaaaguuucaugcuguugcgugugguggcuccaagccaagcaccuggcaugcaggucagc

SEQ ID NO: 37172 - RNA, 64 nt, Human
uucuaccugaacugaaaggacugugugaccucccccaagccaaccacuuucaccugggaugacu

SEQ ID NO: 37173 - RNA, 64 nt, Human
cuauucuaacaugcugucaacuaugugauucuuuccaagccaauaaacauuuccaguaauuucu

SEQ ID NO: 37174 - RNA, 64 nt, Human
ccaccauccacagucaauggcugugcuuucccuuccaagccagggcuuccaaagaccccacugc

SEQ ID NO: 37175 - RNA, 64 nt, Human
uggaggcagucggccugcagugccagacucugagccaagccacuggggccaugcguaugacugg

SEQ ID NO: 37176 - RNA, 64 nt, Human
cuucccccauccccacagcaaaacacggccugucccaagccagugaggagcuaaagacacccag

SEQ ID NO: 37177 - RNA, 64 nt, Human
cgcaaaaccuccucgcuuugcaugcaugaacgugccaagccagcauaggggagcuagaagccac

SEQ ID NO: 37178 - RNA, 64 nt, Human
ucucgugugcauggacgugccugagggguccgggcacggccauacgcaggaccccugugcccgg

SEQ ID NO: 37179 - RNA, 64 nt, Human
gcaugaaccagauggugccagggaguacgugacaccaagccaccuguguggcaagacgugcagu

SEQ ID NO: 37180 - RNA, 64 nt, Human
gcgugccugccacuaggcaucugcauccccgagcccaagccaggagggauuucccuuaggcaac

SEQ ID NO: 37181 - RNA, 64 nt, Human
gcccuaaaaauccagacucuuucgauacccaggaccaagccacagcagguccuccaucccaaca

SEQ ID NO: 37182 - RNA, 64 nt, Human
caccuuuaaaaaaaauacauuuuaaaaaaacauuccaagccaauuggaagacaucauuggguuc

SEQ ID NO: 37183 - RNA, 64 nt, Human
cuuguauagaugauuuuuggcuuggacauaaaagccaagccacccauuugcuuuuaauccaaag

SEQ ID NO: 37184 - RNA, 64 nt, Human
aaguuuaaugucaaaugcaaaguuuuuauucauuccaagccaccacuguaaggaauaaagcuua

SEQ ID NO: 37185 - RNA, 64 nt, Human
gcacauggaccggccugagcgaugugcacuccacccaagccaggcucccagggggccugauuuc

SEQ ID NO: 37186 - RNA, 64 nt, Human
ucugagaugauucucuacccucauccacaucuagccaagccagugaccuugcucugguggcacu

SEQ ID NO: 37187 - RNA, 64 nt, Human
ucugagagucguucacaucaaauucuuaucuuuuccaagccaguaaguuggcuucuccauuccu

SEQ ID NO: 37188 - RNA, 64 nt, Human
caguuguuugugauugccuucccuugucccaguaccaagccaagcccaaaggcuguccugaaaa

SEQ ID NO: 37189 - RNA, 64 nt, Human
guuccaggguuccugcaccuggaauccaguguguccaagccaguauuaaauuaucucaacacau

SEQ ID NO: 37190 - RNA, 64 nt, Human
gagggaguccuuugccaacugaugaccaacaguuccaagccagauagucucgugaacagugaca

SEQ ID NO: 37191 - RNA, 64 nt, Human
gcacgaaccagauggugccagggaguacgugacaccaagccaacuguguggcagaacgugcagu

SEQ ID NO: 37192 - RNA, 64 nt, Human
gucaaguggagggcauuuggaaggagcagugaagccaagccaggaaacaccaagauggcgagcc

SEQ ID NO: 37193 - RNA, 64 nt, Human
caagucagagaagggugccuuaaaaauguuguggccaagccacaugagaucaaagacacacuuu

SEQ ID NO: 37194 - RNA, 64 nt, Human
uaagaaaagggaauuuuaacuuuucuaccuugagccaagccaaugaagggaaaauuaauuaacu

SEQ ID NO: 37195 - RNA, 64 nt, Human
cuggaaaugcagaauaugaauugauuaguucucuccaagccauugcuuaaaauauaacauguuu

SEQ ID NO: 37196 - RNA, 64 nt, Human
cuuacaggcccucccuguuaauaaacagcucuaacacggccaggcugggcucugggauucugac

SEQ ID NO: 37197 - RNA, 64 nt, Human
cuauguugcccaggcuggucucgaacuucgggccccaagccauccucccaccuuggcuuuccaa

SEQ ID NO: 37198 - RNA, 64 nt, Human
ugguggcggucaccauuccuggaaagggacugucccaagccacuuaccuucccgaggagucugc

SEQ ID NO: 37199 - RNA, 64 nt, Human
caccucgagagagaagggcccggagggugucuccccaagccaggcacaccugcacaaacccaga

SEQ ID NO: 37200 - RNA, 64 nt, Human
aaggcagagaggucccuaguggguauauuugcugccaagccacuugccaaagaagaggaaccac

SEQ ID NO: 37201 - RNA, 51 nt, Human
uaguagcccucuugcacugagccaagccagggcaauaggaacacagggugg

SEQ ID NO: 37202 - RNA, 64 nt, Human
gaccagcgugugcgcagggccuggucuuccucccccaagccaggccccuguccccaccccacca

SEQ ID NO: 37203 - RNA, 64 nt, Human
cauaacccccagacucagagcccgagagcccuucccaagccauuggcuuggcugcagaguagac

SEQ ID NO: 37204 - RNA, 64 nt, Human
agguugacuuucugaauuguggagaggcacuuuuccaagccaaucuuauuugucacuuuuuguu

SEQ ID NO: 37205 - RNA, 64 nt, Human
uuuuauuuaaauuaauauacguagauaccagaggccaagccacagagaggauaauaguucuucc

SEQ ID NO: 37206 - RNA, 64 nt, Human
ggggcccaagacccuggcaggucaggggcccuggccaagccagaucuggagcugcugcucccug

SEQ ID NO: 37207 - RNA, 64 nt, Human
gacaguccucuaagcccuauuuagggaagcuuuuccaagccacaaucuuaacuaccuacccaaa

SEQ ID NO: 37208 - RNA, 64 nt, Human
auaggggaugagaaauuaucaguuucuucugcucccaagccaacuucccuucccuuaguucuug

SEQ ID NO: 37209 - RNA, 64 nt, Human
ggagguuggggccagcucauaaaaagccugaaugccaagccaaggaguggaugccuccagucau

SEQ ID NO: 37210 - RNA, 64 nt, Human
agcccugauggaagccauaggaacuccagaguugccaagccauagcugagaagccuggugguuu

SEQ ID NO: 37211 - RNA, 64 nt, Human
aggaaccagcacucuccauccuuucagaaagucuccaagccaaguucaggcucacugaccuggc

SEQ ID NO: 37212 - RNA, 64 nt, Human
auaaaaauauuaacuaggaaaaaacaguauagcaccaagccaguauuugguaucucucucuaga

SEQ ID NO: 37213 - RNA, 64 nt, Human
uacagauauuuacagaaaguagggaggaaggggaccaagccagagagggacagguauauguaca

SEQ ID NO: 37214 - RNA, 64 nt, Human
ccugcccugagccccuuuccccaccacaacccaccacggccaggcagagaagggcaacucccaa

SEQ ID NO: 37215 - RNA, 64 nt, Human
cucugacacagagagcugcccugccuaggagcacccaagccaggcagggggucuggcagcacgg

SEQ ID NO: 37216 - RNA, 64 nt, Human
uucucuccauacuccuaagggacuuugcagacacccaagccacugggaccccugcuaacacaug

SEQ ID NO: 37217 - RNA, 64 nt, Human
gcugcaaagcuuucuuugacccucuggccaccucccaagccagaaguuaucuucccccuccaug

SEQ ID NO: 37218 - RNA, 64 nt, Human
gcauccacuucuuucagcagacugaucaggaccuccaagccacugagcaauguauaaccccaaa

SEQ ID NO: 37219 - RNA, 64 nt, Human
ccaugccguugcgaggccuccgggaugucccaucccaagccaucacacuccacaaaaacauuua

SEQ ID NO: 37220 - RNA, 64 nt, Human
caggccgcgcccuuuccccgacgcccacccaaccccaagccagcccggccgcuccaccagcauc

SEQ ID NO: 37221 - RNA, 64 nt, Human
accaagguggccgagcugcuggcccagggccacaccaagccacccgagcgcagugccacaggcg

SEQ ID NO: 37222 - RNA, 64 nt, Human
uauuuuuaaaucacauuaauuuuaccaagugaaaccaagccauacuguuuuugagccaauuaag

SEQ ID NO: 37223 - RNA, 64 nt, Human
gucagucugcgugaaagcccuuuguggggaguuuccaagccagugucguuuuugcacugguuuc

SEQ ID NO: 37224 - RNA, 64 nt, Human
gaagcaaacaggagcggcaacuucuaacuuugcuccaagccacucucuuuuuaaacagcaacaa

SEQ ID NO: 37225 - RNA, 64 nt, Human
gccucucucucccucccucucucaugaggcacagccaagccaagcgcucauguugagccagugg

SEQ ID NO: 37226 - RNA, 64 nt, Human
gagggggauucggcccagcucgucccggccuccaccaagccagccccgaagcccgccagccacc

SEQ ID NO: 37227 - RNA, 64 nt, Human
ugucugagcccagccucccagaacaaaugcucuuccaagccagccuaucugucccaggcugggc

SEQ ID NO: 37228 - RNA, 64 nt, Human
ggcccagggcuugucauugggcugccagugucugccaagccagcauugagcuaauccuguggga

SEQ ID NO: 37229 - RNA, 64 nt, Human
gaccucaggguagguucucgggacugaaggaaggccaagccauuacgggagcacagcaugugcu

SEQ ID NO: 37230 - RNA, 64 nt, Human
uggucucgccuucccuucuuccugcagguucccgccaagccaugugacagagugcucacacuca

SEQ ID NO: 37231 - RNA, 64 nt, Human
uugaaauuucauccagagucugcaguccaggucaccaagccagcggcacccgucggcaacccug

SEQ ID NO: 37232 - RNA, 64 nt, Human
gaagccauucucacugcauccucccugcaguagccacggccaggcccuuaggaggagcagugac

SEQ ID NO: 37233 - RNA, 64 nt, Human
uuugaaacuucuuagcugucacuuuggaaucaccccaagccaauucucuuaacucuguaaugca

SEQ ID NO: 37234 - RNA, 64 nt, Human
gagauguucuggaaaccaggcucgccggagcuggccaagccaccgacuugcuucucaaauucac

SEQ ID NO: 37235 - RNA, 64 nt, Human
ccuucugagaauacuggaauagggaauuaggacaccaagccaauucagcugugaaccuuauucu

SEQ ID NO: 37236 - RNA, 64 nt, Human
cagagggcccaguggugccccagcacgguggugcccaagccaacccugugacugacauguacga

SEQ ID NO: 37237 - RNA, 64 nt, Human
gcuggagaaggugaaagucgcuuugggacggaagccaagccauuauggcagaugaaccugcugg

SEQ ID NO: 37238 - RNA, 64 nt, Human
cugcagaaugggugaccucaaagaugcccccuguccaagccaucccacagcuggaagguagggg

SEQ ID NO: 37239 - RNA, 64 nt, Human
cauaaaggaaaacaucacuuccugaauuacugacccaagccaaacagaaacaauaacccucgag

SEQ ID NO: 37240 - RNA, 64 nt, Human
ucgccgcccaaagggaggugccaaggccaggaacccaagccaccccggcuccccucgccugccc

SEQ ID NO: 37241 - RNA, 64 nt, Human
caugccugggaauccugcugccagagaaccauucccaagccauggcaugcuccuugaagaaucu

SEQ ID NO: 37242 - RNA, 64 nt, Human
uggcucacgccuguaaucccagcacugugggaggccaagccaggcaaaucgcuugaggcugagg

SEQ ID NO: 37243 - RNA, 64 nt, Human
ucuccugugaaaccugaaucuacaaguuuuccugccaagccacucaggugcauugcagggacca

SEQ ID NO: 37244 - RNA, 64 nt, Human
cauuuuagacaaugaagcugcuuaguaaucucugccaagccaucucuuaauauuaaagcagaca

SEQ ID NO: 37245 - RNA, 64 nt, Human
ggcucgggauggacucccugggccccacccauugccaagccaggaaggcagcuuucgcuuguuc

SEQ ID NO: 37246 - RNA, 64 nt, Human
ccauuggccugggccaguucuccacuccuaggggccaagccaccccuagccuuggugggggaaa

SEQ ID NO: 37247 - RNA, 64 nt, Human
cucugacuuugggacauuucauccacagaaauuuccaagccaaugguuucuuuuggguuuuggu

SEQ ID NO: 37248 - RNA, 64 nt, Human
auggggaggacaguucuuuuggagguuggaggggccaagccaaggacaggagcaagugugcccu

SEQ ID NO: 37249 - RNA, 64 nt, Human
auggaguagcaucccccuggggcacuugcugaggccaagccacucacauccucacuuugcugcc

SEQ ID NO: 37250 - RNA, 64 nt, Human
acugcaggugucuacccccaagucuucccuccucccaagccagggguggcacagggcacuagau

SEQ ID NO: 37251 - RNA, 64 nt, Human
ugcuugggaacacuggguauucucaugagcucauccaagccaagguuggaccccuccccaagag

SEQ ID NO: 37252 - RNA, 64 nt, Human
agaaauucagugcagcagggggacacagaccugcccaagccaccccacugccguucccucucug

SEQ ID NO: 37253 - RNA, 64 nt, Human
uucuucuugguaaaugaugcuaugcuuuuuccaaccaagccagaaaccugugucaucuuuucac

SEQ ID NO: 37254 - RNA, 64 nt, Human
gcuguggcuccucugcccccacagauccuauccuccaagccagcccaccucugccuucaucaua

SEQ ID NO: 37255 - RNA, 64 nt, Human
gugacugaagggaccaagaacgcagaccugauuuccaagccaagacucccaugcugccucauuu

SEQ ID NO: 37256 - RNA, 64 nt, Human
cagauggaggguacccuauuuacaacugagucagccaagccacugaugggaauauacagauuua

SEQ ID NO: 37257 - RNA, 64 nt, Human
gccucugagagcaucaggccuagaggccugacugccaagccauggguagccuggguguaaaacc

SEQ ID NO: 37258 - RNA, 64 nt, Human
caggcgggcagagaagggcucagggcaccagcaaccaagccagcccccggcgggaucgauaccc

SEQ ID NO: 37259 - RNA, 64 nt, Human
agggccagauguuauucccuuucuuaaagauacuccaagccacaugccacuaaccacaagcaag

SEQ ID NO: 37260 - RNA, 64 nt, Human
ucugcaccucugaccacaccuuggcaagucuuucccaagccauucuuugucugagcagcuugau

SEQ ID NO: 37261 - RNA, 64 nt, Human
ucucuacuggggacgccccggcauuauuuuauucccaagccagcagaccggcccagacagccag

SEQ ID NO: 37262 - RNA, 63 nt, Human
ugaagacagaggcagagauuggagugacgcaucuccaagccaaggaauuccaaggacuguaag

SEQ ID NO: 37263 - RNA, 64 nt, Human
cgaauagaguuuaauuacucauugcgucggaaagccaagccauuucugucuccagaguuguucu

SEQ ID NO: 37264 - RNA, 64 nt, Human
aaauaccagacugcagguuggaccccagagauucccaagccaaaaaccuuagcucccucccgca

SEQ ID NO: 37265 - RNA, 64 nt, Human
cuuugguuuggccuccauccucaucucucuugggccaagccagcugccuaggucccccaagcau

SEQ ID NO: 37266 - RNA, 64 nt, Human
augugccaaguucaugguuacuggacuucuuauuccaagccauggcaccaaaggagaaggggca

SEQ ID NO: 37267 - RNA, 56 nt, Human
ccucccagggccuggucugagccccacacggccaucugcccaguccuugacucguc

SEQ ID NO: 37268 - RNA, 64 nt, Human
caagcccccacagcuacuccaacccaaacaacaaccaagccaguuuaaugguaggaauuuguau

SEQ ID NO: 37269 - RNA, 64 nt, Human
cacagagggcaggaacuugcacaaaaucacacagccaagccagucaaggauggaugcagaucca

SEQ ID NO: 37270 - RNA, 64 nt, Human
caaugagccccauccaucuucccuacccuuccugccaagccagggacuaagcagcccagaagcc

SEQ ID NO: 37271 - RNA, 64 nt, Human
guagccucugggaucugccaacacacguccacucccaagccacuagcccacuccccaguuggcc

SEQ ID NO: 37272 - RNA, 64 nt, Human
uggcuucuugagcuaagggggacacccuuggccuccaagccagccuugaacccaccucccuguc

SEQ ID NO: 37273 - RNA, 64 nt, Human
uaaucugguacuuuacaguuuugcaccaacucugccaagccacuggaucuuacauuaaacauca

SEQ ID NO: 37274 - RNA, 64 nt, Human
cuuacuaaaagucagugggacuggguuucuguagccaagccagacuugacuguuucuguagagc

SEQ ID NO: 37275 - RNA, 64 nt, Human
ccccaacccuggggggaauguagggaagagguggccaagccaaccgugggguuagcucuaauua

SEQ ID NO: 37276 - RNA, 64 nt, Human
gguuagcuuggggaccugaacuguccuggaggccccaagccauguuccccaguucaguguugca

SEQ ID NO: 37277 - RNA, 64 nt, Human
gggaagaggcaucagccaucuugcuugagaaccaccaagccaaaagcaaaagcuuuuaucuaug

SEQ ID NO: 37278 - RNA, 64 nt, Human
uucagugcuacauuuuguggcuuuuuaauggaaaccaagccaauguuauagacguuuggacuga

SEQ ID NO: 37279 - RNA, 64 nt, Human
ucacuucccaucaccucucacagccaccuggaacccaagccagcugagcucugaggggcucugc

SEQ ID NO: 37280 - RNA, 64 nt, Human
gaggcagggaaauccuauucacaucacuguugcaccaagccacugcaagagaaacccccacccg

SEQ ID NO: 37281 - RNA, 64 nt, Human
ugaggaccugacgcugagagagaaccaucauaccccaagccaggcacuagauuuuggagggggc

SEQ ID NO: 37282 - RNA, 64 nt, Human
caggccuccacugccagccuaugguuguucgccaccaagccaggagugcugcaccgcccagugg

SEQ ID NO: 37283 - RNA, 64 nt, Human
ccauguuuuauccuuuucuggagaguagucuagaccaagccaauugcagaaccacauucuuugg

SEQ ID NO: 37284 - RNA, 64 nt, Human
aauggccccuuacuuuggacagcaaccccugagcccaagccaguuuuggccuucacagccuggc

SEQ ID NO: 37285 - RNA, 64 nt, Human
gccugaaauaggguuggcgcauacccacccccgccacggccacaagcccuggcauccccugcaa

SEQ ID NO: 37286 - RNA, 64 nt, Human
cugcaaggccaacuccguguccgcugcccacagcccaagccagcccacagcggaugcugcaaaa

SEQ ID NO: 37287 - RNA, 64 nt, Human
aucaugauauucuaacuguggucaaaccagguacccaagccaccucccugcccaacgccuuucc

SEQ ID NO: 37288 - RNA, 64 nt, Human
acaauuugcauaaaggucagcuagcauccugcugccaagccacugcauagcauuugugauaaga

SEQ ID NO: 37289 - RNA, 64 nt, Human
cuuaucuacucccaauuauguuguugauacaucuccaagccaucugucaucagaucaaaaagca

SEQ ID NO: 37290 - RNA, 64 nt, Human
uugcugcuguuuggguuguuggucuguguaacauccaagccagaguuuuuaaagccuucuggau

SEQ ID NO: 37291 - RNA, 64 nt, Human
gggugcucaugccuuaccuaagagaagaggcuggccaagccacaguucugacgcugacaauaaa

SEQ ID NO: 37292 - RNA, 63 nt, Human
cagugguguuugugaaauaguccuuccuguucuccaagccagugaagaguuaucugcugggaa

SEQ ID NO: 37293 - RNA, 64 nt, Human
uuacccagaugguggaggaugugaagggauugcaccaagccacauucacucucucuguggccuu

SEQ ID NO: 37294 - RNA, 64 nt, Human
gagacccugagacagugugaggggguggggacugccaagccacccuaagaccuugggaggaaaa

SEQ ID NO: 37295 - RNA, 64 nt, Human
gcagcauuggaaggcuggggccgggcaggccaggccaagccaagcagggggccacagggugggc

SEQ ID NO: 37296 - RNA, 64 nt, Human
cuaaggaccaaggagaagaacagccucuccacccccaagccaggcgguugaggaacauauugag

SEQ ID NO: 37297 - RNA, 64 nt, Human
aacuuuuaaguuagcauuuguuagcaguuauuauccaagccagaguaggauuuguuaccaguug

SEQ ID NO: 37298 - RNA, 64 nt, Human
ccccacaagcugucccugcagggccaucugacugccaagccagauucucuugaauaaaguauuc

SEQ ID NO: 37299 - RNA, 64 nt, Human
agcggcccuggcgcguggcuccugcauagcuagcccaagccaauaaagggcugugaugaguggc

SEQ ID NO: 37300 - RNA, 64 nt, Human
augccacaucucaguuaucuaaacuagauuagauccaagccaaguuuucucaacagagagcaaa

SEQ ID NO: 37301 - RNA, 64 nt, Human
gaccgcaugaaugcucacacaaggggaaagggcgccaagccaaggagccggcgucauccgacgu

SEQ ID NO: 37302 - RNA, 64 nt, Human
ccccaccagcagccauggcuggcuggggcuuuagccaagccaccuacugccaggaauuggagcc

SEQ ID NO: 37303 - RNA, 64 nt, Human
uccaaaagcccugaguuucaaguauccuuguugacacggccaugaccacuuuccccgugggcca

SEQ ID NO: 37304 - RNA, 64 nt, Human
aggcauuagaugucuaaugugaguauaauuucauccaagccaucucagaaagucuaaaagguug

SEQ ID NO: 37305 - RNA, 64 nt, Human
gucagguucuggaguuggcccugagcucuauccaccaagccagcaccccaccaucccuuugcag

SEQ ID NO: 37306 - RNA, 64 nt, Human
auuaagacauggacccccaaugcauucauauuugccaagccauccccaccacccagccaugaug

SEQ ID NO: 37307 - RNA, 64 nt, Human
gauugugaaguggucugaauucuggaaucacaaaccaagccaugcuggugggccauuaaugguu

SEQ ID NO: 37308 - RNA, 64 nt, Human
uuacuuuuaccuguuuugagggggauggggccggccaagccauucagagagaacauggguccag

SEQ ID NO: 37309 - RNA, 64 nt, Human
uaccuuauuugaacaaguuuuccuuuauugaguaccaagccauguaaugguaacuuggacuuua

SEQ ID NO: 37310 - RNA, 64 nt, Human
gcauuuuguaauccaaauauugauauucuuuacaccaagccaucaggcuccuuuuaucaaauag

SEQ ID NO: 37311 - RNA, 64 nt, Human
ugucagugaccauccuaaugccucucgcucacucccaagccaccauuugagagggagggguguu

SEQ ID NO: 37312 - RNA, 64 nt, Human
gcuuuaucuccccaggagcagcaucucugagcacccaagccaggugggugguggcucuuaagga

SEQ ID NO: 37313 - RNA, 64 nt, Human
guuugagccaccaacuucagugccuuucuguaccccaagccagcacaagauuggaccaauccuu

SEQ ID NO: 37314 - RNA, 64 nt, Human
uccagggccagcgagcucccccggcagcagguccccaagccaugucaggcaucuccaccacggc

SEQ ID NO: 37315 - RNA, 64 nt, Human
cccaguugcuuauccagaugugacagagcucgacccaagccaggcugcacacuccuggacuggg

SEQ ID NO: 37316 - RNA, 64 nt, Human
cuggcucaagaauuagggccccaacuacacacccccaagccacagggaagcauguacuguacuu

SEQ ID NO: 37317 - RNA, 64 nt, Human
uugcuaauaauuuauacuggaaucuggcauuuuuccaagccaagagaagaucgaauggcuuuuu

SEQ ID NO: 37318 - RNA, 64 nt, Human
ccaacacuuacccuguguuuaaaaagaucuuguaccaagccaacggcguuccuggcucuccugc

SEQ ID NO: 37319 - RNA, 64 nt, Human
ccaccugggaguccgaagcuuagccuggagguggccaagccagucccuacucuugggcugcggc

SEQ ID NO: 37320 - RNA, 64 nt, Human
aaaggcaccauggggaccuggguugcccugagacccaagccauuguuagcagcuagccagccac

SEQ ID NO: 37321 - RNA, 64 nt, Human
aguaguuacucugcucaugagacagaucugggcuccaagccaggaaaggugaacagaaaccaca

SEQ ID NO: 37322 - RNA, 64 nt, Human
uggcucacgccuguaaucccagcacuuugggaggccaagccagauggaucaugaagccaggagu

SEQ ID NO: 37323 - RNA, 64 nt, Human
ccagggcaaggcuaagaggcacugagcccucaacccaagccaggcugaccucaucugcuuugcu

SEQ ID NO: 37324 - RNA, 64 nt, Human
ugccaaaaaaugguuuucuauucucaaaagugacccaagccaauaaauagcauuaguagcuucu

SEQ ID NO: 37325 - RNA, 64 nt, Human
guggaguucacaguucgacuaacccugugaacacccaagccaggaguucuaugagaagccaaau

SEQ ID NO: 37326 - RNA, 64 nt, Human
gauggcucuggccucgguccucccccaacccugcccaagccagacagacagcaccugcagacgc

SEQ ID NO: 37327 - RNA, 64 nt, Human
caugggcaggguugaggacugccccccaccccgcccaagccaaugcagacacugaccucaagac

SEQ ID NO: 37328 - RNA, 64 nt, Human
cuggaacaucggaagaggaguucuuugcuauguuccaagccaucuacugagggaggcagaaagg

SEQ ID NO: 37329 - RNA, 64 nt, Human
uccuuagaaaaggagaggauggggguagagucucccaagccaaaauuuugacauuugagugcuu

SEQ ID NO: 37330 - RNA, 64 nt, Human
acagcugcacagcagcucggugcccaagaacuggccaagccagcaaagcgggagcccugaaaaa

SEQ ID NO: 37331 - RNA, 64 nt, Human
ccccucccaucccccacgcagcuccaccccagucccaagccaccagcugucugcuccugguggg

SEQ ID NO: 37332 - RNA, 64 nt, Human
uucaggaaccuggaccaaagcugacgaggcugggccaagccagggauggggccacagccagaac

SEQ ID NO: 37333 - RNA, 64 nt, Human
uuuuuaguauguggcguaucaugcaagugcuaugccaagccaugucuaaauggcuuuaauuaua

SEQ ID NO: 37334 - RNA, 64 nt, Human
uuccuagaggguaaauaugacuccuuucucuaucccaagccaaccaagagcacauucuuaaagg

SEQ ID NO: 37335 - RNA, 64 nt, Human
agcugaugucugcacugaguggguuucaugagccccaagccaaaaccagcuccagucacagcug

SEQ ID NO: 37336 - RNA, 64 nt, Human
ugcuauguuuucaaaccuuuuugagccauaggauccaagccauaaaauucuuuaugcauguuga

SEQ ID NO: 37337 - RNA, 64 nt, Human
ccaguaucugaacugcuuggggggugggaaagaaccaagccaugcucugucuacuggcaauggg

SEQ ID NO: 37338 - RNA, 64 nt, Human
gagcagacgcccggguuccauggacccuccuccccacggccaugccucugcucuugggcgccca

SEQ ID NO: 37339 - RNA, 64 nt, Human
gucgccacccuuugguuauuucagcccccaucacccaagccacaagcugaccccuucgugguua

SEQ ID NO: 37340 - RNA, 64 nt, Human
uccccauauuccuggacuucggagauggccucucccaagccaggucaaggagguuugggggagg

SEQ ID NO: 37341 - RNA, 64 nt, Human
uaaauuuacaaagauccacggugggcuccagcugccaagccacccaagggagucugggcccuag

SEQ ID NO: 37342 - RNA, 64 nt, Human
cccacagggggucgaugcuggagguuccggggccccaagccaguguggggucucccacagcugu

SEQ ID NO: 37343 - RNA, 64 nt, Human
ucucuugaaaaauggcauugccuucauggguccuccaagccaggccaugugggcuuuaggggau

SEQ ID NO: 37344 - RNA, 64 nt, Human
accucagugcccacagccaagguagggucacuaaccaagccagaaacguaacugugugcagaau

SEQ ID NO: 37345 - RNA, 64 nt, Human
gauccuuugauuuuggcccucugauguauugugcccaagccaggagcugcuugggcagucccag

SEQ ID NO: 37346 - RNA, 64 nt, Human
gaaccccucccuccaucguuuucuucacuguccuccaagccagcgggaauggcagcugccacgc

SEQ ID NO: 37347 - RNA, 64 nt, Human
cuucauauuuuuuuuauaagcauagaaauaaaaaccaagccaauauuugugacuuugcucugcu

SEQ ID NO: 37348 - RNA, 64 nt, Human
aaggguuuuguccugaauuguaguguuggcaagcccaagccacucgugcuaacugcuuuuuguc

SEQ ID NO: 37349 - RNA, 64 nt, Human
ccaguaacgaaguuauaaauaucagcuuguucauccaagccacuggcugagguguuaggaagag

SEQ ID NO: 37350 - RNA, 64 nt, Human
gagacccgggagggccuuccucugaaaggccaagccaagccaugcuuggcagggugaggggcca

SEQ ID NO: 37351 - RNA, 64 nt, Human
acucagagacccgggagggccuuccucugaaaggccaagccaagccaugcuuggcagggugagg

SEQ ID NO: 37352 - RNA, 64 nt, Human
aauauuuguacacauucuuugagcacccagguacccaagccaauaaggaaaguuaauuccuugc

SEQ ID NO: 37353 - RNA, 64 nt, Human
cgcuuccacugcacaggcccaggaaggagaaaggccaagccaaagugggccccacccugccccc

SEQ ID NO: 37354 - RNA, 64 nt, Human
gccccaccgaggcgucggccgcccgaagagccucccaagccagcgcggcugucacgggcagcgg

SEQ ID NO: 37355 - RNA, 64 nt, Human
uggguggagaggcugagggacucacuggagggcaccaagccagcccacagccagggaagugggg

SEQ ID NO: 37356 - RNA, 64 nt, Human
gcucugagcccugggcacccaccuccacccccgccacggccacccuccuucccgccgcccgacc

SEQ ID NO: 37357 - RNA, 64 nt, Human
cuugaaguaaaccucagugccugagacuuuucuaccaagccacacagcugcagcaacugcagau

SEQ ID NO: 37358 - RNA, 64 nt, Human
acccuccccaccacauaaacacauggacacacacccaagccacaagaaaucccaagagagcaga

SEQ ID NO: 37359 - RNA, 64 nt, Human
aaccauucauauuacagcucuuacuuaaauuugaccaagccaggauauaucuguuaggccacau

SEQ ID NO: 37360 - RNA, 64 nt, Human
uaaaugugacacuugugagaaggcauuugccaaaccaagccagcuggagcgccacagccgcaua

SEQ ID NO: 37361 - RNA, 64 nt, Human
aaauaaaccaaaccagccacuugcacuauggcuuccaagccaauguuauugacucaauaagugc

SEQ ID NO: 37362 - RNA, 64 nt, Human
gaaagugaucucaagagguccagggacuuaacagccaagccacaccacccgacagguucuucug

SEQ ID NO: 37363 - RNA, 64 nt, Human
gcaauacggcagacagaugcaagaccauuuuucuccaagccaugggggacuguuuggaaggaaa

SEQ ID NO: 37364 - RNA, 64 nt, Human
cccaccuagugcuuccacuucuaugcaaaugccuccaagccauucacuuccccaaucuugucgu

SEQ ID NO: 37365 - RNA, 64 nt, Human
cgugugccacgugagugccaaaguccccugccccccaagccagccagacccagacauuagaaga

SEQ ID NO: 37366 - RNA, 64 nt, Human
cacagcugacccccggccugcagaacaucuguccccaagccagcuccacugcccaggcccccaa

SEQ ID NO: 37367 - RNA, 64 nt, Human
ggcugccccagcaggcacccaccucccugccaggccaagccagguguccucuugcagcuuggcc

SEQ ID NO: 37368 - RNA, 64 nt, Human
caaacccaacccagggccauccccaaacccauccccaagccaaacucaacaccauccccuuccc

SEQ ID NO: 37369 - RNA, 64 nt, Human
gagaagccugaggaauuuacaaaaugaugcagcuccaagccauuguauggcccaugugggagac

SEQ ID NO: 37370 - RNA, 64 nt, Human
gccaccucuuuugugugagcacaaaagccacgucccaagccaccuggcccgauuccacagaugu

SEQ ID NO: 37371 - RNA, 64 nt, Human
ugagggcccugcccuggaagacuggagggaggccccaagccacggggcaucccccucucccagg

SEQ ID NO: 37372 - RNA, 64 nt, Human
ccuuaaccccccagugccuuggcgagggcagguuccaagccacagacgccugccccgaguggac

SEQ ID NO: 37373 - RNA, 64 nt, Human
ucugaggaaggcucaacuggggcuggagccacuuccaagccagugcccucacguggcugucggu

SEQ ID NO: 37374 - RNA, 64 nt, Human
ugcagcagcacacccugcaggcggaguuuucagaggaugcaauuuuggaucccgaauuuugaug

SEQ ID NO: 37375 - RNA, 64 nt, Human
ucucccuguuccucuccccgccaccccagggccuccaagccaccucuggaaauacuuggcucug

SEQ ID NO: 37376 - RNA, 64 nt, Human
gacccgcggcucaguggcccgcuagccacgucagccaagccacuuuagguccauuuuuuaauuu

SEQ ID NO: 37377 - RNA, 64 nt, Human
gcggggcagggccuaacaaggaaaccugggcccuccaagccagguugaggucugguaacagaau

SEQ ID NO: 37378 - RNA, 64 nt, Human
cccugcaaaagggaacagaagaggccaaguccccccaagccacggcccgggguucaaggcuaga

SEQ ID NO: 37379 - RNA, 64 nt, Human
cagccauccgcuggcuuggccagcagaaccagccccaagccagcaccuuugguaaauaaagcag

SEQ ID NO: 37380 - RNA, 64 nt, Human
ccccaaguccccaggggauggcccucccccucuaccaagccacuccaagagccagccccuuucu

SEQ ID NO: 37381 - RNA, 64 nt, Human
ccucccaaguagccaggauuacaggcacgcgccaccaagccaggcuaauuuuuguauuuuuagu

SEQ ID NO: 37382 - RNA, 64 nt, Human
gcugaaaggaagacgcgauuagugguuaagacuuccaagccagaagacagaggguucgaauccc

SEQ ID NO: 37383 - RNA, 64 nt, Human
gccccugaccccagacucccgagaccggccaaagccaagccagccccacccuuaagcuuccucu

SEQ ID NO: 37384 - RNA, 64 nt, Human
uguccagugcccugcgcacuccaugccgucucuuccaagccaccuugcccgcagcccaggcucc

SEQ ID NO: 37385 - RNA, 64 nt, Human
gccaagaaacccuggaccuggggccaaguauuucccaagccaagcauccacuugucugugucug

SEQ ID NO: 37386 - RNA, 64 nt, Human
cucugugaagagauccuggcauuucugguccaacccaagccagagaaccauuaagaaggggccu

SEQ ID NO: 37387 - RNA, 64 nt, Human
agccuggauuccagcagugaaugcuagacagaaaccaagccauuaaugagauguuauuacuguu

SEQ ID NO: 37388 - RNA, 64 nt, Human
guggacaaaccuaggucccccuccuagccucuguccaagccaucuccuucaauaucccccccuu

SEQ ID NO: 37389 - RNA, 64 nt, Human
uuuuuuuuuuuuuuuccccuuuuugucccuuuccccaagccaccaauuggauggaugaauguuu

SEQ ID NO: 37390 - RNA, 64 nt, Human
cggcccaggcugcuuuccgugucuucaguucuguccaagccaucagcuccuugggacugaugaa

SEQ ID NO: 37391 - RNA, 64 nt, Human
ugguuuaagucuuugcagucaaguacugaugcauccaagccaggcccaugccuggugucucccu

SEQ ID NO: 37392 - RNA, 64 nt, Human
caguccuuugauuucccacugaagauaccccaaaggaugcaagugccuacaguauuaucaggag

SEQ ID NO: 37393 - RNA, 64 nt, Human
auguucuugagcagcugaauuggcugccaagaguccaagccaucuggcccaacauacgcacugg

SEQ ID NO: 37394 - RNA, 64 nt, Human
ggaaacauuuagacacaaaccuccccagcuccggccaagccaucauuugcuaccuggagcugga

SEQ ID NO: 37395 - RNA, 64 nt, Human
aaaaaauuuacaaacacugcaagacaaauaaaauccaagccauccauuugugaccacagucaua

SEQ ID NO: 37396 - RNA, 64 nt, Human
cucauuucuuagaaaccaccugcuucccagagugccaagccacaaguaccaggcuucgugggca

SEQ ID NO: 37397 - RNA, 64 nt, Human
ugcaagcaacucagaaagcuuuauaaaccugccuccaagccauucaugaagcaggcaugagcca

SEQ ID NO: 37398 - RNA, 64 nt, Human
gggagcuguggacgggagucaccaggugguggggccaagccagggacucaugacuuuugccccu

SEQ ID NO: 37399 - RNA, 64 nt, Human
gagagccaugacagguccaucagcaugaaguuggccaagccauagggcacagcaccuccuugua

SEQ ID NO: 37400 - RNA, 64 nt, Human
gauccagguguuggaagggcagcggguaagguucccaagccagccccaacacccuucccacuug

SEQ ID NO: 37401 - RNA, 64 nt, Human
cagugagaaaagucugcaggaacugcugccugagccaagccagagaaccgaagacccggccggc

SEQ ID NO: 37402 - RNA, 64 nt, Human
gcacuuucuuguuuacuguuugaagggacgaguaccaagccacaagaacacuucuuuuggccac

SEQ ID NO: 37403 - RNA, 64 nt, Human
ggagcccugcacguagggccugaggucaucaccuccaagccagaagacgugcacccauguuaac

SEQ ID NO: 37404 - RNA, 64 nt, Human
gaauaaagggcgcccgcggucccccagcaccugcccaagccacaccccuagcuucccucccuau

SEQ ID NO: 37405 - RNA, 64 nt, Human
acugugguuuuuuauguggccaccugagggcgccccaagccaguucaucucggaguccaggccu

SEQ ID NO: 37406 - RNA, 64 nt, Human
ucagaggaagcaggccgagagacuugcaccuuggccaagccacacaaucaguggggcagccaga

SEQ ID NO: 37407 - RNA, 64 nt, Human
uggugaauauuuauuuauaaaugcuuauuuuuuuccaagccaaguuagaauagagcacuuuuag

SEQ ID NO: 37408 - RNA, 64 nt, Human
gguguguguacauacggggucucucuccacgccgccaagccagccgggcggccgacccgugggg

SEQ ID NO: 37409 - RNA, 64 nt, Human
gggcuaggggaggacucagaggccaucugcagggccaagccacaggaagggcugagcuggaggu

SEQ ID NO: 37410 - RNA, 64 nt, Human
gcaggaucccaggggaagggucucucucugcaucccaagccauccagcccuucucccuguaccc

SEQ ID NO: 37411 - RNA, 56 nt, Human
cuguucccgccguccucugaggagcuccaagccaacaaggcuacacuggugugucu

SEQ ID NO: 37412 - RNA, 64 nt, Human
gcuaccuaccccuguacaaguuaugcgaaggaaaccaagccaucugcauguuuauuuccucugc

SEQ ID NO: 37413 - RNA, 64 nt, Human
cgggcauccaguggcagcuccccaaaccaggccuccaagccaggugccacccucgccucacagc

SEQ ID NO: 37414 - RNA, 64 nt, Human
ucuuccaaccuccaaacuggcuguaaccccaaauccaagccauuaacuacaccugacaguagca

SEQ ID NO: 37415 - RNA, 64 nt, Human
ggccugaggcucaucugauaccugcaccuucuccccaagccagcguggacccuggugucuaugg

SEQ ID NO: 37416 - RNA, 64 nt, Human
guguauuugguuugcuguccuuuuuuaaaggauuccaagccaugugaaacuucccuucuggaug

SEQ ID NO: 37417 - RNA, 57 nt, Human
cagcccgccuugugccuuaggccccgcccaagccaccagggagccaaucucagcccu

SEQ ID NO: 37418 - RNA, 64 nt, Human
aggcaccguugacgaacugcagcgaucuuacuggccaagccagagcgccuccucucagauuccu

SEQ ID NO: 37419 - RNA, 64 nt, Human
aaggcagccccuccccaggcuuugugagccuggcccaagccaguacaagagggccuggggcacg

SEQ ID NO: 37420 - RNA, 64 nt, Human
agggaaagaucguaaggaugagagaggagaccauccaagccagaaauuauuuaauaaaucagag

SEQ ID NO: 37421 - RNA, 64 nt, Human
augauggagugaaugcccugcccugcuuccccacccaagccagucuacauugcccaaacagcaa

SEQ ID NO: 37422 - RNA, 64 nt, Human
gaaaugcaaguacaucagaacauaucugcaauacccaagccacagggaagaacuugcaaaacaa

SEQ ID NO: 37423 - RNA, 64 nt, Human
uaaguagauaucguagaaauaguguuguuaccugccaagccauccuguauacaccaaugauuuu

SEQ ID NO: 37424 - RNA, 64 nt, Human
uccuacacagaaaaauacuuuuagacuuauauugccaagccaaaguuaccauauuuugguguuu

SEQ ID NO: 37425 - RNA, 64 nt, Human
guucccucuauaaauuaugauuuacaaaagacacccaagccagaggaacucaaugaaauaagcu

SEQ ID NO: 37426 - RNA, 64 nt, Human
uugagcaaggcaagaagugggauucaggaaugggccaagccaggguuccagacaggguggggcu

SEQ ID NO: 37427 - RNA, 64 nt, Human
cgcaaauaagaaaccaagggauaaaacuguucauggaugcaacucaaauucagaugauccucaa

SEQ ID NO: 37428 - RNA, 64 nt, Human
ggcacagccaacccccccagugcaaaccccaaggccaagccaagccggaucagcaccguggucu

SEQ ID NO: 37429 - RNA, 64 nt, Human
ugcuugcucauggcaugaaugcuauguggacagcccaagccauacccagaaucaccuuaauucc

SEQ ID NO: 37430 - RNA, 64 nt, Human
cucuggaggcugaguugcauggggccuaguaacaccaagccagugagccucuaaugcuacugcg

SEQ ID NO: 37431 - RNA, 63 nt, Human
agagcuugaucacguuauuucuuccuuuuauuaagaaggaagccaauuguccaagucaggaga

SEQ ID NO: 37432 - RNA, 63 nt, Human
gagguuggaaacauugguaaacucuguugauugagaaggaaaaaaaaagucccauugaacugu

SEQ ID NO: 37433 - RNA, 63 nt, Human
ucccugggacuguuucagacuuggaaaggucacagaaggaaaauaauauaauaaagugacaac

SEQ ID NO: 37434 - RNA, 63 nt, Human
ucccugggacuguuucagacuuggaaaggucacagaaggaaaauaauauuauauaaagugaca

SEQ ID NO: 37435 - RNA, 63 nt, Human
uggcuugccuggugggggaaggggaggaggggaagaaggaaagggaagagucuuccaaggcca

SEQ ID NO: 37436 - RNA, 63 nt, Human
ccccacccggggcucacucagccuggcagaggaagaaggaaggcagacaucuccgcagccacu

SEQ ID NO: 37437 - RNA, 63 nt, Human
agaacguuccucuuuuuauagugguggcuggcaagaaggaagcaguucuccacguucucaccu

SEQ ID NO: 37438 - RNA, 58 nt, Human
uuuugaaauaaacugaacaggugaaugaagaaggaagaggauuccaggcugagagcac

SEQ ID NO: 37439 - RNA, 63 nt, Human
aaccauaugacuucauaguugugaucucaaaaaagaaggaauuucuccuuuguuucuugcagu

SEQ ID NO: 37440 - RNA, 63 nt, Human
gaugacuuugcagauggaaagaggugaaaaugaagaaggaagcuguguugaaacagaaaaaua

SEQ ID NO: 37441 - RNA, 63 nt, Human
caaaacuugaaaguauuuccagggauuaggauuagaaggaauauuagaggaaacuugaaaucu

SEQ ID NO: 37442 - RNA, 63 nt, Human
ugagugugcaugaaccaaaggaaauaacauugaagaaggaaaacaauauguagaaaguauuuu

SEQ ID NO: 37443 - RNA, 63 nt, Human
acagaaagguuucuuagcuggugaagaauauagagaaggaaccaaagccuguugagucauuga

SEQ ID NO: 37444 - RNA, 63 nt, Human
ucaucaucaggcgacgcccuggcggcuggguggagaaggaaaccuacuauuagccccccgucc

SEQ ID NO: 37445 - RNA, 63 nt, Human
uuuuuauacaaauauccuuaguacaaaaacaaaagaaggaaaacuguaggggggaguaaugug

SEQ ID NO: 37446 - RNA, 63 nt, Human
uggcugccugucuuugcugccauguuuuuuacaagaaggaaagaauucuugcuauuuuuuuuu

SEQ ID NO: 37447 - RNA, 63 nt, Human
uggagaggguguccggucccugucccagugccgagaaggaagccucccacgacugcccggcag

SEQ ID NO: 37448 - RNA, 63 nt, Human
acugagagagugaagaaccauaaaacgcuaugcagaaggaacauuauggagagaaaggguacu

SEQ ID NO: 37449 - RNA, 63 nt, Human
aucagcauccaaaagcaggaacccaucuaaaccagaaggaagcccucucagaucaccccagcc

SEQ ID NO: 37450 - RNA, 63 nt, Human
uccuguaucuuucugacuguccuguccuuggccagaaggaagggagaauacuguguuugggac

SEQ ID NO: 37451 - RNA, 63 nt, Human
aacuuuaaugggaggggagggcuggcugcuggaagaaggaagaagccagacugguuagacagu

SEQ ID NO: 37452 - RNA, 63 nt, Human
uuguaucugaauccacaagaagaucugaaucuaagaaggaauuaccuuugacaauauuuuucg

SEQ ID NO: 37453 - RNA, 63 nt, Human
agcugcugacgggcuuugucuguggaaggagacagaaggaaauugacccacucuccuaucucc

SEQ ID NO: 37454 - RNA, 63 nt, Human
auagaagcacauggagugcaauaggacauugugagaaggaauuuuucagggauucaucuacua

SEQ ID NO: 37455 - RNA, 63 nt, Human
agcugcagagaggaaaggucucccauguaccagagaaggaaaagucugaucccgaaacagcuu

SEQ ID NO: 37456 - RNA, 63 nt, Human
gcagacagggacuuuccucugccggcugcguggagaaggaagcggcuaaaagguuugggccgg

SEQ ID NO: 37457 - RNA, 63 nt, Human
ggcugaagggaauuaacagauaguaucaagcgcagaaggaaugugccaguauggcucccuggg

SEQ ID NO: 37458 - RNA, 63 nt, Human
auaauggaaaguuaccuuacugaaaaaaaaaaaagaaggaaaaauaagaugggcccaaagguc

SEQ ID NO: 37459 - RNA, 63 nt, Human
uuuaccuuuuggacaguaauuucuaucacaguuagaaggaaaugauagucaaauacacguuua

SEQ ID NO: 37460 - RNA, 63 nt, Human
ugcucucaguauaagauuuuacuuuauuaaugcagaaggaauauggauauauuucuuuaaguc

SEQ ID NO: 37461 - RNA, 63 nt, Human
augaggaggcccccgagcuggcuguucuaacuuagaaggaagagaagacuggaugggccugcu

SEQ ID NO: 37462 - RNA, 63 nt, Human
gccuaccccaccuggcaggugucccacagcaacagaaggaauaguaguccccacucuuuccau

SEQ ID NO: 37463 - RNA, 63 nt, Human
gacccaggcugaguccauacugccccugaucccagaaggaaugcugaccccucgucguaugaa

SEQ ID NO: 37464 - RNA, 63 nt, Human
ccucccucuauggggauggcuauuuuauuuuugagaaggaaaaaaaaagucauguauauauac

SEQ ID NO: 37465 - RNA, 63 nt, Human
uguucguauuuagaaugggaucacgaggaaaagagaaggaaagugauuuuuuuccacaagauc

SEQ ID NO: 37466 - RNA, 63 nt, Human
agaugagagaaaccucuuuauccaacagauaaaagaaggaacauugcagagcuaagcagucgu

SEQ ID NO: 37467 - RNA, 63 nt, Human
auauggaaagaccguaucuucauuuucgugaguagaaggaaagauaagaaugaggcagcagau

SEQ ID NO: 37468 - RNA, 63 nt, Human
ggccucuccggauguugaaacaaccacaggucaagaaggaaugugaaucuguuguuuuauaag

SEQ ID NO: 37469 - RNA, 63 nt, Human
uugaguaauaggaaauuaggaggaucuagggacagaaggaaagugaaaaaugugaaaauacaa

SEQ ID NO: 37470 - RNA, 63 nt, Human
uucagggcugucucaggccuuccuuagaaucagagaaggaagcguccuguuuggagagagcca

SEQ ID NO: 37471 - RNA, 63 nt, Human
aaauaaggaaacuggggccauuacaauguaccgagaaggaaggaagaaggccgaccugcagga

SEQ ID NO: 37472 - RNA, 63 nt, Human
caauaguaaucaaaacauacauaacauugaaacagaaggaaaugcuguggaccacagaacucc

SEQ ID NO: 37473 - RNA, 63 nt, Human
uucuaugguaaugaagaacucuuuggcuuagucagaaggaauuaacgaaccucgguaggaaug

SEQ ID NO: 37474 - RNA, 63 nt, Human
ccauugugauuauaucuguaucaggucagcagaagaaggaacugagcaguugaacucugaguu

SEQ ID NO: 37475 - RNA, 63 nt, Human
gucacagccuggcacaggcuacagggguggggcagaaggaaaggggacaagauagaacccagg

SEQ ID NO: 37476 - RNA, 63 nt, Human
gucccuggacaaccuccugcuccauccacuacaagaaggaaggauguccccagcccaggaggu

SEQ ID NO: 37477 - RNA, 63 nt, Human
gaccagccucucugggggaccagaaguagugagagaaggaaggggauaggcagcuuugacagg

SEQ ID NO: 37478 - RNA, 63 nt, Human
gcugcaagggagucugggaaaugucauuucccuagaaggaaguuaggguggguggagcaagcc

SEQ ID NO: 37479 - RNA, 63 nt, Human
auggugagggauacccaucccauaugccugggcagaaggaagacuucaucccucuggggcugu

SEQ ID NO: 37480 - RNA, 63 nt, Human
ugcuccggagggaggcagaggggagacugugguagaaggaagacagaacucacacaugcuccc

SEQ ID NO: 37481 - RNA, 63 nt, Human
ucuagagguagaaauuugccuugcugcagagagagaaggaauggcgugggaugggggaaagaa

SEQ ID NO: 37482 - RNA, 63 nt, Human
ggcucuguccuccucgacccuagugggggaucaagaaggaaacuccguugcaaaaggguauuu

SEQ ID NO: 37483 - RNA, 63 nt, Human
agugauagccaaacuccuuggucaccugcuccaagaaggaagcaguagcugagcaccugcccu

SEQ ID NO: 37484 - RNA, 63 nt, Human
caugggagaugcaugcccugaagagcaggauccagaaggaagauuuguggccagauugccuuc

SEQ ID NO: 37485 - RNA, 63 nt, Human
ugaucauuuugcaucugugcauagcguuucugcagaaggaacaguagucucaaaucuuuccuc

SEQ ID NO: 37486 - RNA, 63 nt, Human
aacugcccagccucagcugaaaacccgaaucugagaaggaauugcgucauguaagggaagcug

SEQ ID NO: 37487 - RNA, 63 nt, Human
ggagcaugcagcgaauucagaaagaggucuuucagaaggaaaccgaaacugacuugcucaccu

SEQ ID NO: 37488 - RNA, 63 nt, Human
cuccauauccuggguaagaauguaaauaagaggagaaggaagagucuaauaguaauuauggau

SEQ ID NO: 37489 - RNA, 63 nt, Human
aaagaaacacaucgcaucuacauuuguaacaugagaaggaaaacaauuuuuuuuuuuuuuuuu

SEQ ID NO: 37490 - RNA, 63 nt, Human
cugaccugcagauuugucaaagccagugacuagagaaggaagggagaaaggcuggcuguuggc

SEQ ID NO: 37491 - RNA, 63 nt, Human
gccugguaggggaaggaaaauaaaagggugugaagaaggaauaguuuuauaaucucggaagau

SEQ ID NO: 37492 - RNA, 63 nt, Human
gucuuuggccauaagaaguaaagauuugaagacagaaggaagaaacucaggaguaagcuucua

SEQ ID NO: 37493 - RNA, 63 nt, Human
uuaucucagucuauuuggaagagagggaggaagagaaggaaguaacccaaaguacuacucauu

SEQ ID NO: 37494 - RNA, 63 nt, Human
uauagagaucucagcccuaaaccuaggauggauagaaggaaacauauguucuccccuacauua

SEQ ID NO: 37495 - RNA, 63 nt, Human
caagcuguagccucuuuccucguuucuagucucagaaggaaggagagggaagccauucuccuc

SEQ ID NO: 37496 - RNA, 63 nt, Human
ucuuuguggacucugccugcauggcuuaguaguagaaggaaauuuuuuuuugguuuuguuuuu

SEQ ID NO: 37497 - RNA, 63 nt, Human
cuggccugcccgccagcccugcucuuguuguggagaaggaagcagaugugaucacaucacccc

SEQ ID NO: 37498 - RNA, 63 nt, Human
ggaaguaagauguauagaguuggggaaucauggagaaggaaagccuauagucgagugccugcu

SEQ ID NO: 37499 - RNA, 63 nt, Human
ugcugccucuccccaccccuuaaagcaguugguagaaggaaugguauuuguauggggggaggg

SEQ ID NO: 37500 - RNA, 63 nt, Human
gcagagguaagaggaagaggcagcagcaucccaagaaggaaagagcuggagucagcacugucc

SEQ ID NO: 37501 - RNA, 63 nt, Human
cagaaaaagcaagaagaagaaaaggcgacaucaagaaggaaaggucucagaugaaagagaggg

SEQ ID NO: 37502 - RNA, 63 nt, Human
aguuuauaugagaauaauucuugcaauaaaugaagaaggaauaaaagaaauaggaagccacaa

SEQ ID NO: 37503 - RNA, 63 nt, Human
ugauguuauaaaaaacucauaaggcaagagcugagaaggaagcgcugaucuucuauuuaauuc

SEQ ID NO: 37504 - RNA, 63 nt, Human
uagaagaccuugcaagaagcagagucauucuccagaaggaacuugggagaugauggugcagau

SEQ ID NO: 37505 - RNA, 63 nt, Human
agagcaguucuguggagauauaaaaagaauggaagaaggaaugccuuauagugauauugugac

SEQ ID NO: 37506 - RNA, 63 nt, Human
aacugaguaugaagaaaaacacuuuacuacugcagaaggaagaaagaauauaauaugaccauc

SEQ ID NO: 37507 - RNA, 63 nt, Human
auggggguuagcacuggcucucguucucaccggagaaggaaguguucuagugugguuuaggaa

SEQ ID NO: 37508 - RNA, 63 nt, Human
auuuuucugaaaguggcugauguaagaacaggcagaaggaaaacccuuuuugucaauaacucu

SEQ ID NO: 37509 - RNA, 63 nt, Human
ucuggucaagccccauuuggucuacagcccaugagaaggaaugaggcugguucugcacucuca

SEQ ID NO: 37510 - RNA, 63 nt, Human
uuacaaacaaguuugaggaccauguagccuuuaagaaggaauuaagaguacacugauaauugc

SEQ ID NO: 37511 - RNA, 63 nt, Human
caucauuucuauucugaaaugacucacugucguagaaggaaguuuauuauauaaccaagguuu

SEQ ID NO: 37512 - RNA, 63 nt, Human
agaggcccauggagcagucucuuccauggaguaagaaggaagggagcauguacgcuuggucca

SEQ ID NO: 37513 - RNA, 63 nt, Human
cacuccccgacauauccggaccuccccaaguccagaaggaaggaauggagcugagcaacugac

SEQ ID NO: 37514 - RNA, 63 nt, Human
cauccuuugacaccugguuguauguguaggcuaagaaggaaggacccuccugucagugugcaa

SEQ ID NO: 37515 - RNA, 63 nt, Human
gagacuuggguggugggaagaaggaaggugggaagaaggaauuagacacucugccugccacuc

SEQ ID NO: 37516 - RNA, 63 nt, Human
uuuaauaaguaaagugagacuuggguggugggaagaaggaaggugggaagaaggaauuagaca

SEQ ID NO: 37517 - RNA, 63 nt, Human
cuggcgcaaauuuagagacuccagugccuucugagaaggaagaucaaguuuacaucgagcaaa

SEQ ID NO: 37518 - RNA, 63 nt, Human
gcacuucuguuuuugaguuuguuuuagcuaaaaagaaggaauacacacaggaauaaugacccc

SEQ ID NO: 37519 - RNA, 63 nt, Human
ggcgguggucuguuacagggugugcaggggcagagaaggaagggaccaggggacugggccagu

SEQ ID NO: 37520 - RNA, 63 nt, Human
uguucgggggugggaaguggcgaccgugaccugagaaggaaagaaagauccucugcugacccc

SEQ ID NO: 37521 - RNA, 63 nt, Human
agaugcugcucccgccugauuggggccucacccagaaggaacccggucccaggccgcauggcc

SEQ ID NO: 37522 - RNA, 63 nt, Human
aggugauuugucuggguucuuccuuuugguuccagaaggaacugucagucaucagcaucugcg

SEQ ID NO: 37523 - RNA, 63 nt, Human
aaagaggcagaucccaguucaaaagcagccaugagaaggaaggauucaccaccuccaggaaaa

SEQ ID NO: 37524 - RNA, 63 nt, Human
cacagugaacacacucguguacauaucaagagaagaaggaaaggcacagguggagaacaguaa

SEQ ID NO: 37525 - RNA, 63 nt, Human
aggcauggagacagcgaacuagaagaaagggcaagaaggaaauagccaccgucuacagauggc

SEQ ID NO: 37526 - RNA, 63 nt, Human
acucaaacugggcaaacaaucggaacgucaugcagaaggaauggccugacuccugcagugcag

SEQ ID NO: 37527 - RNA, 63 nt, Human
auaaagugcaauugcacaaauacaagccaagcuagaaggaagcaccuaugaaagcaacaacuu

SEQ ID NO: 37528 - RNA, 63 nt, Human
ggcucaauccuggaguucugucuggucacuaucagaaggaacacuuugagggaaacccuggug

SEQ ID NO: 37529 - RNA, 63 nt, Human
caauaugccuugagaugccuugaaccaugcuugagaaggaaggacaaacacauuauuaucuug

SEQ ID NO: 37530 - RNA, 63 nt, Human
auuggaacccacguuugcacaaaacauuuuugcagaaggaaagucaacacuucuugcuggcug

SEQ ID NO: 37531 - RNA, 63 nt, Human
auaguaugaguaaugcuuaagggaguuuaauagagaaggaaagcuuuggcaguguuuugagaa

SEQ ID NO: 37532 - RNA, 63 nt, Human
uccaucaacuuuguauuuuacuugcaauuuggaagaaggaaagucacaugaugaaacuccuuu

SEQ ID NO: 37533 - RNA, 63 nt, Human
caucacauuuaaaccaaugugaauucaaaaaagagaaggaaacuuuuuaaauucaauuuagag

SEQ ID NO: 37534 - RNA, 63 nt, Human
uugggaugugaaauuuauuuucuaaaauugaggagaaggaaguuauauauuugcagaauguuu

SEQ ID NO: 37535 - RNA, 63 nt, Human
ugcccucccucagcugacuccagagauggagguagaaggaauugccuuucuuuuuuaaacagc

SEQ ID NO: 37536 - RNA, 63 nt, Human
aaugggaaugauugagcuaaaacccacucuaugagaaggaagauuacugaaaagcaugugaca

SEQ ID NO: 37537 - RNA, 63 nt, Human
ccaucccguccggaaaagaaggacccagagggaagaaggaacaguggaggcgggacgcccucc

SEQ ID NO: 37538 - RNA, 63 nt, Human
uuucgggaggaacucuguugcuucgccuggacaagaaggaaaaugcugauuuccuccuugggu

SEQ ID NO: 37539 - RNA, 63 nt, Human
gggcugcauucagcuuaccagcuaccuagcaagagaaggaauuauuugacaugccuaaagcuu

SEQ ID NO: 37540 - RNA, 63 nt, Human
uuagaaagagacugcguugagacaugaaggaucagaaggaauuuccuauuuucuuuuuguuau

SEQ ID NO: 37541 - RNA, 63 nt, Human
agaauacagaaacauugucugaaagggcucuaaagaaggaacuaccaaaaccugacuugaaau

SEQ ID NO: 37542 - RNA, 63 nt, Human
uagaaagaggucuuuuaauuuuuuuuuaaugugagaaggaagggaggaguaggaaucuugaga

SEQ ID NO: 37543 - RNA, 63 nt, Human
caaggaauuaaguuagggaauggcacagcccaaagaaggaaaaggcagggagcgagggagaag

SEQ ID NO: 37544 - RNA, 63 nt, Human
aaauaaauuaggcccaauccaagaaauugagugagaaggaaacacuuguuuuauucacagagg

SEQ ID NO: 37545 - RNA, 63 nt, Human
ccagacaucuggacacugggcauagauuucucaagaaggaagacuccccugccuccccagggc

SEQ ID NO: 37546 - RNA, 63 nt, Human
acuauaaacucacuggcugaaggaggaaauuuuagaaggaagcuacuaaaagaucuaauuuga

SEQ ID NO: 37547 - RNA, 63 nt, Human
uaaaauguacuuguuaaacagguaauuuuaaagagaaggaacaauuguuuuuaguaaguuuuc

SEQ ID NO: 37548 - RNA, 63 nt, Human
acaccuaacccauggauguggaaccuacggccgagaaggaauguugcaugagucggaucccag

SEQ ID NO: 37549 - RNA, 63 nt, Human
guuuaauguuucacuagggagaggaaauaaagcagaaggaacgugugaagcucugugucucag

SEQ ID NO: 37550 - RNA, 63 nt, Human
uuuaauuaccuugugcagucaaagagcgcuuccagaaggaaucucuuaaaacauaaugagagg

SEQ ID NO: 37551 - RNA, 63 nt, Human
gggaugguaagagaaaagagagaaacacugaaaagaaggaaagaugguuaaacauuuucccac

SEQ ID NO: 37552 - RNA, 63 nt, Human
uuuguauccaaauguagugcaggugaaaagcccagaaggaaaauuucagaagaccaguacugg

SEQ ID NO: 37553 - RNA, 63 nt, Human
uucccuggggguggccagccugguagggggcagagaaggaaaagcugaggggggucccuguga

SEQ ID NO: 37554 - RNA, 63 nt, Human
ugaagugaccccagcuccaggcaggaaaccccgagaaggaauggugcuuggcaggaaccaugg

SEQ ID NO: 37555 - RNA, 63 nt, Human
acgaccuggccuggauugacaacauccucccagagaaggaaaaaaaggagacagacaagaaga

SEQ ID NO: 37556 - RNA, 63 nt, Human
uauuuuguuuuuuugucauuggugguaggacuaagaaggaaacagauauuuuaaauacucaca

SEQ ID NO: 37557 - RNA, 63 nt, Human
agaacagggcauugauggaucacaugagaugguagaaggaacaucaucacauaccccucucac

SEQ ID NO: 37558 - RNA, 63 nt, Human
agaacuaaaauggauauauuuuuauaaugcagaagaaggaaagucccccugugugguaacugu

SEQ ID NO: 37559 - RNA, 63 nt, Human
ggugaagcugggaaaguaaaggcagcacguuacagaaggaagaaaggaagccaguaacugagg

SEQ ID NO: 37560 - RNA, 63 nt, Human
ugucuuuaaggaguuugcacuccaguagaagacagaaggaacguauguuuacaaaccacuuca

SEQ ID NO: 37561 - RNA, 63 nt, Human
ugaaaacugacuguugacauuuucauagugucaagaaggaagauuugacguuguugucauugu

SEQ ID NO: 37562 - RNA, 63 nt, Human
auucaaccuucauuacagacaaaguuuucucccagaaggaauggauugauagauuuugauuaa

SEQ ID NO: 37563 - RNA, 63 nt, Human
ugcuucgaggcuguagauuccaaguaucuuaaaagaaggaacuauaaacauugcacugaaaac

SEQ ID NO: 37564 - RNA, 63 nt, Human
uaugccuugcccuagccagauggaagaagaugaagaaggaaaccaggugaacucagcaaggca

SEQ ID NO: 37565 - RNA, 63 nt, Human
cacuaaacauguuuuuaccugcucucucuauagagaaggaaauaaaauauaaauauaagauua

SEQ ID NO: 37566 - RNA, 63 nt, Human
gcaaggaaauuuguucaguucguauacuucguaagaaggaaugcgaguaaggauuggcuugaa

SEQ ID NO: 37567 - RNA, 63 nt, Human
ucccuccccuaagaagauggauguccucaaaagagaaggaacaaaccuccuugggaauccaca

SEQ ID NO: 37568 - RNA, 63 nt, Human
cugaaaaccaucgaugaaggaauaucucuucucagaaggaaagaauaaccaacacccugaggu

SEQ ID NO: 37569 - RNA, 63 nt, Human
ucagagguagggacaaaaccacaucagguuuucagaaggaaaaaacauuuaaaaacccaccau

SEQ ID NO: 37570 - RNA, 63 nt, Human
gcaagagacuugugcuuucuaaauucaaagacuagaaggaaaauggauaaaaaucacaagugc

SEQ ID NO: 37571 - RNA, 63 nt, Human
uccuuugugugccuuuccuaugucaaauuagccagaaggaagaagagacguuaagaauggcag

SEQ ID NO: 37572 - RNA, 63 nt, Human
gcaaaagcugaccucguugcauggaauuaaaagagaaggaaaaacacaaggaugaagucuuuc

SEQ ID NO: 37573 - RNA, 63 nt, Human
uuuuucugaagccucuaacaaaugaucuaguucagaaggaagcaaaaucccuuaaucuaugug

SEQ ID NO: 37574 - RNA, 63 nt, Human
uacgaaucugguccuauacucagcccagguacgagaaggaacucaaccacacacagcagcugc

SEQ ID NO: 37575 - RNA, 63 nt, Human
auauuuuugaaugguugcacguuaaaaauuaaaagaaggaaugggggcagaaugccauauuuu

SEQ ID NO: 37576 - RNA, 63 nt, Human
cugucaugucaccguucugaacucccagaucugagaaggaacuaguguuggugguauguaaca

SEQ ID NO: 37577 - RNA, 63 nt, Human
ucccugaccgauuuguauuuuuuauauacaacuagaaggaagucacaagauugccuucuacag

SEQ ID NO: 37578 - RNA, 61 nt, Human
augcuguggaugaacgaugaaugucaaugucagaaggaaaagagaauuuuggccaucaaaa

SEQ ID NO: 37579 - RNA, 63 nt, Human
auguuguguucauuuguugagccauaucucagaagaaggaaagggagcuacagaaaggagguu

SEQ ID NO: 37580 - RNA, 63 nt, Human
gccauauugugaaaaacuuuaguggacaagggcagaaggaagagggaagaccuguuaggaagc

SEQ ID NO: 37581 - RNA, 63 nt, Human
ggauuugcugagaguuugaauguggaguguaagagaaggaagaguuaaugaugacauuaaggu

SEQ ID NO: 37582 - RNA, 63 nt, Human
gaaugcacuugguuuauuguugggggugcucucagaaggaaccugugaaagccuuuaucaguc

SEQ ID NO: 37583 - RNA, 63 nt, Human
cagguucauuuuaagauuuacuuggaagagcaaagaaggaaaaauuauauuuuuaaagaaaga

SEQ ID NO: 37584 - RNA, 63 nt, Human
ugaggaccaccuccuacacuauugaccaggcccagaaggaaccagccaugaggugcuccaugc

SEQ ID NO: 37585 - RNA, 63 nt, Human
gugaugaaccuuuuuaugugcagcugguaugauagaaggaaauugggaaaacuuguaugcuag

SEQ ID NO: 37586 - RNA, 63 nt, Human
cucaccagcuacucuggccauauaucccacaccagaaggaacaaguguggcuguguccaucuc

SEQ ID NO: 37587 - RNA, 63 nt, Human
auuuaaaaaaauauuuuugcauaggaaaaauugagaaggaaguaaaccaaaauguuaacagug

SEQ ID NO: 37588 - RNA, 63 nt, Human
cagaauggcugcaaauuuaauugcauuaaggcaagaaggaagcucuaaugugugcuuuguauc

SEQ ID NO: 37589 - RNA, 63 nt, Human
uggccugggagagcuggggaagcuucuuaaaugagaaggaauuugaguuggaucaucuauugc

SEQ ID NO: 37590 - RNA, 63 nt, Human
ugaugcuagagaggaaaaaggacuuggagagagagaaggaauggcugguccagaggcuuuugu

SEQ ID NO: 37591 - RNA, 63 nt, Human
gcugccccuggcuuccuuuaaggaggcugcuccagaaggaaccuggguggggagggcgaaggg

SEQ ID NO: 37592 - RNA, 63 nt, Human
aauaguuguauuuauuugaaggcagugaggaccagaaggaaguuuugugcuuuggcagacucc

SEQ ID NO: 37593 - RNA, 63 nt, Human
gcauuguuucguuuuuaacuggaacauuuagaaagaaggaaaugaaugugcauuuuauuaauu

SEQ ID NO: 37594 - RNA, 63 nt, Human
accaaaacaugggaugaagcuaaaucaaugcuuagaaggaaauuuauagcuucaaauacuuau

SEQ ID NO: 37595 - RNA, 63 nt, Human
auaauugauaauaacaguccaaagaaagcagaaagaaggaaagccuagaacagaaauaaauga

SEQ ID NO: 37596 - RNA, 63 nt, Human
auuaauuauuccugauaacaucucaagaaaaggagaaggaaaguguuucuggagaauguucuu

SEQ ID NO: 37597 - RNA, 63 nt, Human
cucugugaaauagccucaccccuacauguggauagaaggaaaugaaaaaauaauugcuuugac

SEQ ID NO: 37598 - RNA, 63 nt, Human
gacacuugaauuuuugucaccuuuuuccucauuagaaggaaaguagaaagccuuacuuuagga

SEQ ID NO: 37599 - RNA, 63 nt, Human
aaccaaaccucggugccaucgcagaguauaaaaagaaggaagaauuguauuugcaacggguag

SEQ ID NO: 37600 - RNA, 63 nt, Human
aaugcugcuuuuaaaauuuuuguuuauaaauugagaaggaauuuucucucuauaaguuucugu

SEQ ID NO: 37601 - RNA, 63 nt, Human
uuacaauaaaauaauucacaguaguuucaauauagaaggaauuagcuauuaaagguauuugaa

SEQ ID NO: 37602 - RNA, 63 nt, Human
caaggaaauaugaaggcacuuccuuuuuuucuaagaaggaaguugcuagaugauuccuucauc

SEQ ID NO: 37603 - RNA, 63 nt, Human
ucuguaaauaaaaggguuccaaccuuuuaaaaaagaaggaaaaaacuuuuuggugcuccagug

SEQ ID NO: 37604 - RNA, 63 nt, Human
uugaucaauucagcaucugagggcugcaaguacagaaggaaucuauucucagcagggcauagg

SEQ ID NO: 37605 - RNA, 63 nt, Human
augacuuuuauaugaaccccuucuuuaggguccagaaggaauuguggacugaaucacuagccu

SEQ ID NO: 37606 - RNA, 63 nt, Human
caucuguuugacuucuuugguuccucaugcagcagaaggaagacagaaagauagaaauugauu

SEQ ID NO: 37607 - RNA, 63 nt, Human
guugccuucuuuucuaucccuuugggcccugggagaaggaagccauuugcagugcuggugugu

SEQ ID NO: 37608 - RNA, 63 nt, Human
acuuauucuaaguggccaauuauuuggaaauaaagaaggaaauaaagauggcuucacauggaa

SEQ ID NO: 37609 - RNA, 63 nt, Human
acccaugaaugguuagccuuucuuuucuauuguagaaggaaauaaauaggaguaaaaagacca

SEQ ID NO: 37610 - RNA, 63 nt, Human
cuaaccagaaauccuaaagaagaggaauuauacagaaggaacagcaggagguuuuccuggaca

SEQ ID NO: 37611 - RNA, 63 nt, Human
aacaaagucaaguccauaaagcaauaaucccucagaaggaaaguccuuacuuuucacauauua

SEQ ID NO: 37612 - RNA, 63 nt, Human
ccuggcuagacugaauuacacuagaaaucagccagaaggaagcguccuugggaucccagauca

SEQ ID NO: 37613 - RNA, 63 nt, Human
aaaaaaaacaaaaacaagcagcuuuugugacuaagaaggaaaauaugcauauaguggcauauu

SEQ ID NO: 37614 - RNA, 63 nt, Human
auuccaaauacuucuuuuuuccccuggaguccgagaaggaaaauggaauucugguucauacug

SEQ ID NO: 37615 - RNA, 63 nt, Human
uuuugcacugacagugggaggggauaagguggcagaaggaaccugagcaggacccccaccuga

SEQ ID NO: 37616 - RNA, 63 nt, Human
aaccagacaaggaaauacccuucuuuuaugagcagaaggaaacaaaaaaaaaaaaagaagacc

SEQ ID NO: 37617 - RNA, 63 nt, Human
ccaaaggaaggaagugguugagggccaggaaagagaaggaaugucaugccaggguguuacucc

SEQ ID NO: 37618 - RNA, 63 nt, Human
agucuaccccaaagucugccaaaggcagugcaaagaaggaaggcuccaaacggaaaaucaaca

SEQ ID NO: 37619 - RNA, 63 nt, Human
agaagcagacaaccggacaugcgcauucauagcagaaggaaaccaucaagaaguggaaggcug

SEQ ID NO: 37620 - RNA, 63 nt, Human
ugcgagggacggugugugacaugucaugccuggagaaggaacaaggcuauuugaaaacagaag

SEQ ID NO: 37621 - RNA, 63 nt, Human
gauaaaaauaggacacaauauuaaaggagcuacagaaggaagggagucccaucucaaaaaaaa

SEQ ID NO: 37622 - RNA, 63 nt, Human
acuucagcucugcuguugggcugguguguggacagaaggaauggaaagccaaauuaauuuagu

SEQ ID NO: 37623 - RNA, 63 nt, Human
gguaucggcuauacuagggaaccauuuuguagaagaaggaacgaugacaggucgcaugaagau

SEQ ID NO: 37624 - RNA, 53 nt, Human
cuuucagaaaaguucuuuaaagaagaaggaagggucuucuuuugcuucuccuc

SEQ ID NO: 37625 - RNA, 63 nt, Human
aucucauuugcagaaagcagauuaaagaccaucagaaggaaauuauuuagguuguaaugcaca

SEQ ID NO: 37626 - RNA, 52 nt, Human
auguugcuggagauaaauaggcagaaggaagaagaggaccucaaauuacaau

SEQ ID NO: 37627 - RNA, 63 nt, Human
cucuccaaggaccggaugaagaaguacauggcaagaaggaaauggcagguaaugagaggguca

SEQ ID NO: 37628 - RNA, 63 nt, Human
agaaggggcagagaguaaaaaacaugaccugguagaaggaagagaggcaaaggaaacugggug

SEQ ID NO: 37629 - RNA, 63 nt, Human
gccagaaaucuauguuuucuuagaacauguggaagaaggaaaaagacaaaaaaggaaaucugg

SEQ ID NO: 37630 - RNA, 63 nt, Human
auguuggguuuccagagagagucaugcuggaggagaaggaaguaggccagaaguccagggcug

SEQ ID NO: 37631 - RNA, 63 nt, Human
gaggggacgggacagacgaaggcaaccauuuuuagaaggaaaaaggauuaggcaaaaauaauu

SEQ ID NO: 37632 - RNA, 63 nt, Human
cccacacccugcagaguggcaggggugaaaggaagaaggaaguggcugaguuauuaauagcca

SEQ ID NO: 37633 - RNA, 63 nt, Human
cugugacugagggggcagaggcaguggcucuuuagaaggaaaaggugcuauguaaaucuaagg

SEQ ID NO: 37634 - RNA, 63 nt, Human
cuuugccagcauccuaaaucuggaguuuuacaaagaaggaaacuguaucuuuagguuaaucaa

SEQ ID NO: 37635 - RNA, 63 nt, Human
uacuaaggauacaggcuggaaaguaagggaagcagaaggaaggcuuugaaaaguuguuuuauc

SEQ ID NO: 37636 - RNA, 63 nt, Human
auuaaaaaaaacaaaaagaacaaaaaaaucugcagaaggaaaaauguguaauuuuguucuagu

SEQ ID NO: 37637 - RNA, 63 nt, Human
aaucagccugguuuuggggaugcuaugaaagagagaaggaaaaucaugccgcucaguuccugg

SEQ ID NO: 37638 - RNA, 63 nt, Human
uguccuccagaggggucacguguaggagugagaagaaggaagaucuugagagcugcugaggga

SEQ ID NO: 37639 - RNA, 63 nt, Human
aaaaaauacuuuaaaaauccacacuuuuuguuaagaaggaaacauuuagcauuuauauauuug

SEQ ID NO: 37640 - RNA, 63 nt, Human
uuaacugagagggacagaagacgcuggaaggagagaaggaagcgggaagugugcuucucaggg

SEQ ID NO: 37641 - RNA, 63 nt, Human
ugccaaauccaacuguaauuaguaccagaacuuagaaggaaagucacaaagcaugccuuuuac

SEQ ID NO: 37642 - RNA, 53 nt, Human
cccuuccuagcgaaaaguaaacaagaaggaaaagucacgauaaaccugguaag

SEQ ID NO: 37643 - RNA, 63 nt, Human
guuuucuggagaucccuggacccaguaagaauaagaaggaaggguugguuuuuuuccauuuuc

SEQ ID NO: 37644 - RNA, 63 nt, Human
aaugaugucaaauuagucacauuaagcuauaguagaaggaauuggacacuucuccagauauuu

SEQ ID NO: 37645 - RNA, 63 nt, Human
ccuuuucuuuguccucaaccauacuuagaggaaagaaggaauggucuuccaugaacugauuau

SEQ ID NO: 37646 - RNA, 63 nt, Human
uuuuacuaaccuuuuauaucuugccuucaagugagaaggaacaaacaacucucagugguuacu

SEQ ID NO: 37647 - RNA, 63 nt, Human
guauaacuggauccagagagggaaggacugacaagaaggaauuauucagaaaaacacugacag

SEQ ID NO: 37648 - RNA, 63 nt, Human
acgucaucucaguagccacgcuaguccauucccagaaggaaauuuuuuuuuuuaacaaugacu

SEQ ID NO: 37649 - RNA, 63 nt, Human
gugaauuuuugaaagucaacaguucaggagaagagaaggaauuugaagagaaaaaggaaaauu

SEQ ID NO: 37650 - RNA, 63 nt, Human
gccugucugacauccagguugugcuauuaaccaagaaggaaacagauacuuggaggcuuagau

SEQ ID NO: 37651 - RNA, 63 nt, Human
uaauauacauauaaauacauucauguuugugagagaaggaaagaguaaguaauuugaauuggc

SEQ ID NO: 37652 - RNA, 63 nt, Human
gcgggaccagauuaugacuagaguuuuuaugccagaaggaaucauuggugaacuuuccaaggu

SEQ ID NO: 37653 - RNA, 63 nt, Human
aauggaggaguuguuuggggagggaaaggagagagaaggaaaggagugagguauuucccgucu

SEQ ID NO: 37654 - RNA, 63 nt, Human
auuaaauaaaaugcugcugcuuugacaguaaagagaaggaaguauucugauuagcuguaucug

SEQ ID NO: 37655 - RNA, 63 nt, Human
agagaucaggaagagaaggagcagagcugauggagaaggaaggcuccaucuccagugggaacu

SEQ ID NO: 37656 - RNA, 63 nt, Human
accccagugagauguccccugacccuccaccgcagaaggaaggcagggaggaggcagagaaga

SEQ ID NO: 37657 - RNA, 63 nt, Human
guuuucuggaggucucugaacccagggaagacaagaaggaaagauuuuguuguuguuuguuua

SEQ ID NO: 37658 - RNA, 52 nt, Human
acaguggcaaauccaacugaccagaaggaaggaggaagcuuauugguggcug

SEQ ID NO: 37659 - RNA, 63 nt, Human
acauaaaccuuaacaagacuacaaguauauuccagaaggaaaucauuuuaguuaugaacuaaa

SEQ ID NO: 37660 - RNA, 63 nt, Human
cuccaccuccuugcaggcuuguugccuguugaaagaaggaaaaagacacggcgcuggcaagug

SEQ ID NO: 37661 - RNA, 63 nt, Human
ggaaugagaacaugcaaaaucaggaaaggcuguagaaggaaauauaccuuaacaggcugauuu

SEQ ID NO: 37662 - RNA, 63 nt, Human
ggucuugcccuugaauaacuaagucauacaaauagaaggaaaaacaauggugaauuuuggaga

SEQ ID NO: 37663 - RNA, 63 nt, Human
augcacuucacaggcaagacugcagcaggagccagaaggaaaacagauacaacugcccaugua

SEQ ID NO: 37664 - RNA, 63 nt, Human
uuacuaugaaauuuuaaauacacauuuaugccuagaaggaacggacuuuuuuuuucuauuuua

SEQ ID NO: 37665 - RNA, 63 nt, Human
ccucauguauuauuuauuucgaccuuuuaggggagaaggaacucccccauucuuucaagagau

SEQ ID NO: 37666 - RNA, 63 nt, Human
aauaucuuuauaaagaaaucuuuggaaauuaggagaaggaauuucagguggguuuaagucaga

SEQ ID NO: 37667 - RNA, 63 nt, Human
auugacgcacaucugcccuaagcgaaaucugucagaaggaaucaacaaggcuccuugccuccc

SEQ ID NO: 37668 - RNA, 63 nt, Human
ugaaagaguuauuuguguaaguagaguauccggagaaggaaaagaacuuacgaccuuucuuua

SEQ ID NO: 37669 - RNA, 63 nt, Human
uuggggcaacagauugaaaagaccuacagacuaagaaggaaaagaagaagagaugacaaacca

SEQ ID NO: 37670 - RNA, 63 nt, Human
gugcuuacccuuugaacagcagagugaccacguagaaggaaggaaaagggcaaaaucgcuuca

SEQ ID NO: 37671 - RNA, 63 nt, Human
cccucaaagcuuccauuccacauccggaggagaagaaggaaaugaauuucucuacagaugucc

SEQ ID NO: 37672 - RNA, 63 nt, Human
aaacuucaaauaaaaccaauucauuauuuguccagaaggaagcuuggcugagcuggccuuuua

SEQ ID NO: 37673 - RNA, 63 nt, Human
aagcauuuuucuaauuccugccuuuggucacaaagaaggaaaagcagagcugugaaugaguua

SEQ ID NO: 37674 - RNA, 63 nt, Human
aagaguaaguggaaccugggaugcaggaacaaaagaaggaaauguugggcaaacauuuuugug

SEQ ID NO: 37675 - RNA, 63 nt, Human
cagaagagcuucuuacugauuucaccuaaaaugagaaggaaguccuguuuucaagaaugacau

SEQ ID NO: 37676 - RNA, 63 nt, Human
ucuaaucauuguaugugcuucacuacgggggggagaaggaaacguuagcaucauguuucccau

SEQ ID NO: 37677 - RNA, 63 nt, Human
auagaauuaucaagcuuuuaaaaacuagagcacagaaggaauaaggucaugaaauuuaaaagg

SEQ ID NO: 37678 - RNA, 63 nt, Human
cagggggcgcgcuuaaauuuccagacagagaccagaaggaagguuuagaaagaaaagaacacu

SEQ ID NO: 37679 - RNA, 63 nt, Human
aucuuagucuuaccuugagggaacagucauaugagaaggaacuuugucacaucuaagcugugg

SEQ ID NO: 37680 - RNA, 63 nt, Human
agaauaaaauuguaaaauuguauagagauaugcagaaggaagggcauccuucugccuuuuuua

SEQ ID NO: 37681 - RNA, 63 nt, Human
cuaguuuuaccagguuacaggaggguucaagacagaaggaaaacuaacagagggggagccagg

SEQ ID NO: 37682 - RNA, 63 nt, Human
gguaucuaaucagauuccuaaucauagcccguaagaaggaauguuacuuuaauauuggacuuu

SEQ ID NO: 37683 - RNA, 63 nt, Human
uguucccaccaugcccuucugccaucuucugggagaaggaaaccaaaggaucuaaaacugggg

SEQ ID NO: 37684 - RNA, 63 nt, Human
uaauuuuuuuuccaguguauugcucauauuaucagaaggaaaaguuauuuaaguaugucaguu

SEQ ID NO: 37685 - RNA, 63 nt, Human
gggggagagggagggaaggaaggugcggcugcaagaaggaaggcacgggacaggcaugugaca

SEQ ID NO: 37686 - RNA, 63 nt, Human
gaaauuccuuucuuuagcaccaguggaguuuucagaaggaacaacaccagggaaugccaaaaa

SEQ ID NO: 37687 - RNA, 63 nt, Human
guccagauuuuaguaagucagaccccaugugugagaaggaaagcuggaaucaugggugguaau

SEQ ID NO: 37688 - RNA, 63 nt, Human
uggccaugacagugugauucccccagaggaagcagaaggaaguuaaagguugucuuuggucau

SEQ ID NO: 37689 - RNA, 63 nt, Human
gaugucuggagugauugugguucuuggaaaagcagaaggaaaaacuaaaaaguguaucuugua

SEQ ID NO: 37690 - RNA, 63 nt, Human
cucuuaaugaugcucuugaugaaagaaaaagacagaaggaaggaaggaaggaaggaaggaagg

SEQ ID NO: 37691 - RNA, 63 nt, Human
aaguguacuugccacugagcaguaugucaggaaagaaggaauauuaucuagguuuagcuuuga

SEQ ID NO: 37692 - RNA, 63 nt, Human
agaagaaaaaugugaaagacugggugcuagacaagaaggaagcagguaaagggauaguugcuu

SEQ ID NO: 37693 - RNA, 63 nt, Human
cuuauuuuguuguuguuguuguuguuguauuuuagaaggaauucagcucugauguuuuuaaag

SEQ ID NO: 37694 - RNA, 63 nt, Human
gaaccuagcgcaauuguaaagugaaauucaaggagaaggaaugaggaguuagggaagcagcau

SEQ ID NO: 37695 - RNA, 63 nt, Human
gccaaccucugagaggugaaaagcuauguaaauagaaggaauggccaguucaaaagaauagua

SEQ ID NO: 37696 - RNA, 63 nt, Human
cuauuacuaaaaauauauauagacaaaauuaaaagaaggaaugauaagaauaaauuuaauuua

SEQ ID NO: 37697 - RNA, 63 nt, Human
aucucauaguaucuagauugaucaagaucugacagaaggaaugcacaaaggauucuauauucu

SEQ ID NO: 37698 - RNA, 63 nt, Human
cccaagcucugaagaagucaaggguggagccagagaaggaaggcagucccagaugagccucua

SEQ ID NO: 37699 - RNA, 63 nt, Human
gucuggagaagguauuagcaaagcaaaaggcugagaaggaacagggaacauuggagcugacug

SEQ ID NO: 37700 - RNA, 63 nt, Human
ugaaaaaaaaaaagaagaagaagaaggagagcaagaaggaaagauuugugaacuggaagaaag

SEQ ID NO: 37701 - RNA, 63 nt, Human
aacaucacauacagcuucagcugccuggaggccagaaggaaagggcagugcaggggaggccug

SEQ ID NO: 37702 - RNA, 63 nt, Human
gggauaccauaaaaagaggaugauuucagaaggagaaggaaaaagaaaguaaugccacacauu

SEQ ID NO: 37703 - RNA, 63 nt, Human
uguuuugaagccaaaaugguacaccgauauuuaagaaggaaagcgaauccaaacgguugugau

SEQ ID NO: 37704 - RNA, 63 nt, Human
aguccuacagaguaauauaugugaugcaguguaagaaggaaaauacucaucucuaacauuaug

SEQ ID NO: 37705 - RNA, 63 nt, Human
ucacuccuacuaccaauggccacugugagccacagaaggaagacauguacgugcuguucuacu

SEQ ID NO: 37706 - RNA, 63 nt, Human
cuggaaaauuuccauuuuugagcugaguuccaaagaaggaaauagagcaacacaaaggccucg

SEQ ID NO: 37707 - RNA, 63 nt, Human
agaccaugcuccgcgucgguggggcuggccuugagaaggaacuggacccagcucuaccccgau

SEQ ID NO: 37708 - RNA, 63 nt, Human
aagcuaaaaagcuaaaguaccagucaucuagagagaaggaaauuaauguuucuuaauaauccu

SEQ ID NO: 37709 - RNA, 63 nt, Human
gugauucagggauuccuaugaauagaaaugcugagaaggaacgcauuuuauugcagaagcuaa

SEQ ID NO: 37710 - RNA, 63 nt, Human
gugauagcaccguuuguucugugagcuggaaacagaaggaaaaaacauacccuuggguaccca

SEQ ID NO: 37711 - RNA, 63 nt, Human
cugucuaggaaaauaagaauuagguuucuuugaagaaggaaucuuuuauaacaccuuaacagu

SEQ ID NO: 37712 - RNA, 63 nt, Human
aaguuuggaaaaaaaugacaaaacaacgagggaagaaggaaccagaccuuagugccacauauu

SEQ ID NO: 37713 - RNA, 63 nt, Human
uugauauauaccuucuguaaauaacuuuuuuugagaaggaaauaaaaucagcuggaacugaac

SEQ ID NO: 37714 - RNA, 63 nt, Human
gaguguacuagccacauucccaaggucccaaggagaaggaagagcugaaauucaucuccuagu

SEQ ID NO: 37715 - RNA, 63 nt, Human
agaaacuucggggcugcagccucaggaugaggcagaaggaaggguaagggaaaggauggggac

SEQ ID NO: 37716 - RNA, 63 nt, Human
agucuucccugaucaagucaccggagcuuucaaagaaggaauucuaggcaucccaggggacca

SEQ ID NO: 37717 - RNA, 63 nt, Human
cuucaagcuuagcuuccucaacuacuguuuuucagaaggaagaaagaaucaaauggaagaaga

SEQ ID NO: 37718 - RNA, 63 nt, Human
ggacaggguggacccccugagucaacuggagcaagaaggaaggaggcagacugauggcgauuc

SEQ ID NO: 37719 - RNA, 63 nt, Human
uccagugauuagcuaaauuugacauagaaaguaagaaggaaugucuacuuuguauuguggucc

SEQ ID NO: 37720 - RNA, 63 nt, Human
gcuuuucugugcuguugguucccaaaacuagaaagaaggaagcagggagcggugccccaagca

SEQ ID NO: 37721 - RNA, 63 nt, Human
gagaaacacaggaaaugaaaaauuuuuaaaaaaagaaggaaaaauguuuuaaauacaaaagga

SEQ ID NO: 37722 - RNA, 63 nt, Human
auaugagaucugaauuaccuuucccucuuuccaagaaggaagguuugacugaguaccaauuug

SEQ ID NO: 37723 - RNA, 63 nt, Human
guacacguuauguuaaaggugaaaugugcauacagaaggaagagaguuggccaggugugguga

SEQ ID NO: 37724 - RNA, 63 nt, Human
gguaacgagacuuucacuauauuuugcuuugacagaaggaaagaggaagaguuucuauuaaaa

SEQ ID NO: 37725 - RNA, 63 nt, Human
auaugucugccaaguuguuagaaucuuugaaucagaaggaaaaaaagcagcgcugguugacaa

SEQ ID NO: 37726 - RNA, 63 nt, Human
ccaaccugagauuuguaguccaggauuacaaccagaaggaaaguaugacagauuucuacuuaa

SEQ ID NO: 37727 - RNA, 63 nt, Human
cagcaaaugguuuccccucaccucuggaauuaaagaaggaacuccaaaguuacugaaaucuca

SEQ ID NO: 37728 - RNA, 63 nt, Human
caccagacaggaaacgaauauggacguaauugcagaaggaacuucaaggagaugaaugaaugc

SEQ ID NO: 37729 - RNA, 63 nt, Human
aggcagguuuacaacacuacaagucuugaguuaagaaggaaagaggaaaaaagaaaaaacacc

SEQ ID NO: 37730 - RNA, 63 nt, Human
ucuuugauacacuuuugcuugccuccccaggaaagaaggaauugcauccaagguauacauaca

SEQ ID NO: 37731 - RNA, 63 nt, Human
gacaaccagaauccaauaaguccaacuucagccagaaggaaaaaaguuuuccauuuuuauuac

SEQ ID NO: 37732 - RNA, 63 nt, Human
gcuguuuucuguucuuguuuauccagcguaggaagaaggaaaagaaaaucuuugcuccucugc

SEQ ID NO: 37733 - RNA, 56 nt, Human
aucuggaagauguugcauagacacgaagaaggaaguauucuaauuaacaaggacag

SEQ ID NO: 37734 - RNA, 63 nt, Human
caugccugugggagccaggccucgcuugcaugaagaaggaacgaugccuuuuucaaugguguc

SEQ ID NO: 37735 - RNA, 63 nt, Human
uucucaucuuuaagguaaggaggaaguagagauagaaggaaauacgugauuuggugaaggcca

SEQ ID NO: 37736 - RNA, 63 nt, Human
cacuuacuauuuucagcuuuuuaaagcaugcuuagaaggaaaagcuuaccaaaaauauauuuu

SEQ ID NO: 37737 - RNA, 63 nt, Human
cuugugaagcugcagauauagaugguguuacugagaaggaaacuaaggacuuggcuccaaaac

SEQ ID NO: 37738 - RNA, 63 nt, Human
ccaagauuugguggguccacacggucuucacaaagaaggaagaaaagaaggaguggaggaagg

SEQ ID NO: 37739 - RNA, 63 nt, Human
gaugggggcgggggugguggugaagagaguuggagaaggaauggacgaauucuugagcaaaag

SEQ ID NO: 37740 - RNA, 63 nt, Human
gagcaugacacucucccccucaacagccuccugagaaggaaaggaucugcccugaccacuccc

SEQ ID NO: 37741 - RNA, 63 nt, Human
uuuugcaagaaugugugguaagccuggguaaagagaaggaacugcgguguugggagagucuuu

SEQ ID NO: 37742 - RNA, 63 nt, Human
guguucguacccuuauuuuuuuuuaagauuccuagaaggaaucuuugguuaauucagauugag

SEQ ID NO: 37743 - RNA, 63 nt, Human
aaggcuaccuaggaaauacuucagugaauucuaagaaggaaggaaggaagaaaggaaggaaag

SEQ ID NO: 37744 - RNA, 63 nt, Human
ugguuaaugauaacaaugcaucguaaaaccuucagaaggaaaggagaauguuuuguggaccac

SEQ ID NO: 37745 - RNA, 63 nt, Human
auauuuuaugauugccaucaaagaagaagaaaaagaaggaacagacaaagguuugaaaaugau

SEQ ID NO: 37746 - RNA, 63 nt, Human
agaaacuuguuaaaugaaaggacucuuuacccuagaaggaagaggugaaggaucuggcuuguu

SEQ ID NO: 37747 - RNA, 63 nt, Human
gcuguugagaaaacgaagucuuuuucauuuugcagaaggaaaugauggaauuuuucuguacuu

SEQ ID NO: 37748 - RNA, 63 nt, Human
uagacaagguuuugaaaaggauaaucauggguuagaaggaaguguuugaaagucacuuugaaa

SEQ ID NO: 37749 - RNA, 63 nt, Human
ucgaggggcuuggaauucuaaauggaagauuuuagaaggaacuuugcucucuacugucacuau

SEQ ID NO: 37750 - RNA, 63 nt, Human
cgaguaauaugccugcuauuugaaguguaauugagaaggaaaauuuuagcgugcucacugacc

SEQ ID NO: 37751 - RNA, 63 nt, Human
ugauaaagacagccuuuaaucccccuccuccccagaaggaaccucaaaagguagaugagguac

SEQ ID NO: 37752 - RNA, 63 nt, Human
acuaagcuaguuuaacacuugagcaaaugcuuaagaaggaauuaaaaaaaaaaagcuuugcca

SEQ ID NO: 37753 - RNA, 63 nt, Human
aauuauaacaauaacucauaaaguucuaaauucagaaggaaugucuguucuuuaucaagugua

SEQ ID NO: 37754 - RNA, 63 nt, Human
auacaggguugaaaaaauauuaauauguuugucagaaggaaaaauaaugcauuuaucuucccc

SEQ ID NO: 37755 - RNA, 63 nt, Human
gcuguaaagcaccaacccggaaguggcaggcacagaaggaagggcuggauugggccccuuugg

SEQ ID NO: 37756 - RNA, 63 nt, Human
uaugauacauacacauacacacacacgagagacagaaggaaagagaggaagagagaagcaaac

SEQ ID NO: 37757 - RNA, 63 nt, Human
accuacuagguacccaguggcagucucagguuaagaaggaaaugcagccucaguaacuuccuu

SEQ ID NO: 37758 - RNA, 63 nt, Human
ccauguaucugagaauaucuaacuagaaggaugagaaggaaauaaaauguuauaaucagauaa

SEQ ID NO: 37759 - RNA, 63 nt, Human
ugagcuagcuagcgcaccgccgaguuaaagaggagaaggaaaacaugcugcucuggugcacgc

SEQ ID NO: 37760 - RNA, 63 nt, Human
uuuuauggcauggcccaauugauauaaacauuuagaaggaaaugaaaagcuaaaauaggaagu

SEQ ID NO: 37761 - RNA, 63 nt, Human
ugauaaugcuuucacaacauuugcagauguuuuagaaggaaaaaaguuccuuccuaaaauaau

SEQ ID NO: 37762 - RNA, 63 nt, Human
cgauuucaugcacagcccugcaguaaggagcccagaaggaacauguguuuccuguuaaaacuc

SEQ ID NO: 37763 - RNA, 63 nt, Human
gaaucgaauaacagcuuuuguacaucaacaucaagaaggaauacgccugagagagaucagagu

SEQ ID NO: 37764 - RNA, 63 nt, Human
cuuuuguuguuguuguucucauguguccuuaagagaaggaaaugccacaguuacaagguaaac

SEQ ID NO: 37765 - RNA, 63 nt, Human
aagaaggagaugaauagaagaaagaaaauggaaagaaggaaaaaaggaggauagaaaaaggau

SEQ ID NO: 37766 - RNA, 63 nt, Human
cucuaaaagcaacagcauguaaacuagaaugaaagaaggaaauuauguacguaugccuaauau

SEQ ID NO: 37767 - RNA, 63 nt, Human
auugcagcacuuucugaggcuuucacuguagggagaaggaaaccccaaggguagaauagccau

SEQ ID NO: 37768 - RNA, 63 nt, Human
gggauccaggaaccagugggauuggaugggagaagaaggaaggggguggcccgucacccccgc

SEQ ID NO: 37769 - RNA, 63 nt, Human
uucaaaagaacucagaauccuccaggaucuagaagaaggaagaaaguguguaaauaaucauuu

SEQ ID NO: 37770 - RNA, 63 nt, Human
aaggauggagaaaaacagacugugggaaggaucagaaggaauccgccgaggcagggaugggug

SEQ ID NO: 37771 - RNA, 63 nt, Human
cuuccaaauucuguaacacauuguaauuggagaagaaggaaacucugcaaggcuaaacuguca

SEQ ID NO: 37772 - RNA, 63 nt, Human
gaaaauaguucccuuugccaacagaaacaugccagaaggaaucuucucaucuuuuaucuaacu

SEQ ID NO: 37773 - RNA, 63 nt, Human
uuuuaaaaugugaucgaaaauauaaugcuucuaagaaggaacaguaguggaaugaaugucuaa

SEQ ID NO: 37774 - RNA, 55 nt, Human
cgggggcugugcaguuuuaaugaccagaaggaaaggaaacccucgccggugggga

SEQ ID NO: 37775 - RNA, 63 nt, Human
gagagccugugaggaccgagaggagaaaugagaagaaggaacaaaaauauuauuucuauguaa

SEQ ID NO: 37776 - RNA, 63 nt, Human
augaaacuccauguagcaaccaggacgaaguugagaaggaaaacgccaaaugcuuugguuauu

SEQ ID NO: 37777 - RNA, 63 nt, Human
cauuccucugcagacugcuagagagagauggcaagaaggaagacacagaauucuuucugacag

SEQ ID NO: 37778 - RNA, 63 nt, Human
cuuucugcuuaguauuuuuuugauucaaggcucagaaggaauggugcguggcuucccuguccc

SEQ ID NO: 37779 - RNA, 63 nt, Human
uucccuagucuguguggcaaauuaaacaauauaagaaggaaaaauuugaaguauuagacuucu

SEQ ID NO: 37780 - RNA, 63 nt, Human
gggaaggcaugcagaugggauuuguuagaagacagaaggaaagacagccauaaauucuggcuu

SEQ ID NO: 37781 - RNA, 63 nt, Human
uugcagugaaggcaucaacuuauguaaaaacucagaaggaaggcuccucugauaaaaacacag

SEQ ID NO: 37782 - RNA, 63 nt, Human
gcuugagucaaaauguguuuccccuuugaaaggagaaggaauuggagcagcuuuuccuggagg

SEQ ID NO: 37783 - RNA, 63 nt, Human
agcagaguucaugaaaacugcaaugcugggaaaagaaggaaacaugaaaauaaaaauaagaca

SEQ ID NO: 37784 - RNA, 63 nt, Human
gauguauuugucacuugcuguuaagguagaacaagaaggaacacauauuauacacauaaugau

SEQ ID NO: 37785 - RNA, 63 nt, Human
aagaagaagaaggcugauaucacacagcuuugcagaaggaaggaagaccuugaucgacauugu

SEQ ID NO: 37786 - RNA, 63 nt, Human
guguguuaacauugcaaugaaaaaaugaaaaaaagaaggaaaaaagaauaagaaugaaaacug

SEQ ID NO: 37787 - RNA, 63 nt, Human
caauacaucauuuaauuuuuuaaguuauccugaagaaggaaagguccuuaauuauuauagucu

SEQ ID NO: 37788 - RNA, 63 nt, Human
acaaaaaccuuaauguaauuuacuuauaaugccagaaggaaaacacuauuuucauacccuacu

SEQ ID NO: 37789 - RNA, 63 nt, Human
gguucuguuaaaggagugugggauuaacagacuagaaggaagacuaaggaccugaccacccau

SEQ ID NO: 37790 - RNA, 63 nt, Human
gauuaaaaccuggauccacagacugugcgccucagaaggaauaaucgguaaauuaagaauugc

SEQ ID NO: 37791 - RNA, 63 nt, Human
uuuuuuauaaucuuuacaugcugguuuaaauucagaaggaaauagaucaaggaaauauauaua

SEQ ID NO: 37792 - RNA, 63 nt, Human
uuggauguucaaaugagaaacaaaacugugaagagaaggaacuggcguauacaagaugacuuc

SEQ ID NO: 37793 - RNA, 63 nt, Human
agagaggcaugggacagguuccccacaagccuuagaaggaagcauggcccugacuucagaauu

SEQ ID NO: 37794 - RNA, 63 nt, Human
augguaaccaaaggaagcagcugggacagguggagaaggaaguaggaaugagugcacggcgac

SEQ ID NO: 37795 - RNA, 63 nt, Human
augaauuuaaaauuucaauuauccauucuuauaagaaggaagaugauuguaaagaaauaucuc

SEQ ID NO: 37796 - RNA, 63 nt, Human
cacuaauauuuucauagaaauuaggcuggagaaagaaggaagaaaugguuuucuuaaauaccu

SEQ ID NO: 37797 - RNA, 63 nt, Human
auuaaauaugguuaguuccagagugcaaauuacagaaggaagcuacuuguuuaaaauuccaua

SEQ ID NO: 37798 - RNA, 63 nt, Human
agcugguaugaaaucagugggaagcagaacaacagaaggaacuuuaaaagcaacaagcaauua

SEQ ID NO: 37799 - RNA, 63 nt, Human
uccagauccacaucauuguagagucugaggguuagaaggaagucauugugucuaacauaacaa

SEQ ID NO: 37800 - RNA, 63 nt, Human
uuuuauauagaaacacuuucucacuuacaggggagaaggaaaugcagggcacaugaucuggcc

SEQ ID NO: 37801 - RNA, 63 nt, Human
agugcacuuuuucaguuaguccuaacuuuuaaaagaaggaaaaccaagagacauaucuggugu

SEQ ID NO: 37802 - RNA, 63 nt, Human
gggagaagccuggggaggagggggaggaagacaagaaggaagaggaggaggagaaggaagacg

SEQ ID NO: 37803 - RNA, 63 nt, Human
agggggaggaagacaagaaggaagaggaggaggagaaggaagacgaggagcuggacugggccu

SEQ ID NO: 37804 - RNA, 63 nt, Human
agagaaauauauucauaauuuacuuuaugaccuagaaggaaacugucguguguccuauacauu

SEQ ID NO: 37805 - RNA, 63 nt, Human
cuggaauagguguugcguaucaaauacagaugaagaaggaaaagagaaaccagagauggaugg

SEQ ID NO: 37806 - RNA, 63 nt, Human
cauuuuaacaaacaaugcaaacaucuucagugcagaaggaagagugguuucaacuguuuggag

SEQ ID NO: 37807 - RNA, 63 nt, Human
uuacuucuccuguggucaguaaguugcccagagagaaggaacaaaggucuggaguuuacagaa

SEQ ID NO: 37808 - RNA, 62 nt, Human
cugggcagaagaagauuuaaauccauugggccagaaggaaugaccauuacuaacaugacuua

SEQ ID NO: 37809 - RNA, 63 nt, Human
ccucugguuaauucucaucagcgucugcagaaaagaaggaaagagggcacccuuuucaguugg

SEQ ID NO: 37810 - RNA, 63 nt, Human
cacucucuaggggauuagcuugugcgugucaaaagaaggaacagcucguucugcuuccugcug

SEQ ID NO: 37811 - RNA, 63 nt, Human
uaguuuugacauuuuaugauagauuugcucucuagaaggaaacgucuuuauuuaggagggcaa

SEQ ID NO: 37812 - RNA, 63 nt, Human
cauaguugcacauacuguuuauugcuuauguguagaaggaaugaaacuaguuuccagaguugu

SEQ ID NO: 37813 - RNA, 63 nt, Human
gacacagucuaacaaauuccaaauucucacagaagaaggaaauugaauuuccaugaguuacac

SEQ ID NO: 37814 - RNA, 63 nt, Human
auaauuuugauaaaauuaacacaaaaucagucaagaaggaaacauguauauuagugaaguguu

SEQ ID NO: 37815 - RNA, 63 nt, Human
uguucaacaugugccuucaaaugugacccacugagaaggaaacaacaucacuguaacaacaac

SEQ ID NO: 37816 - RNA, 63 nt, Human
agacuuuuuaucauuaggaaacaaaaagaauuuagaaggaaugaaagcagcccguaaggugaa

SEQ ID NO: 37817 - RNA, 63 nt, Human
uuaccuuguauaucaucuucgaccacaucagaaagaaggaaucauauuccuuuaugaaugugu

SEQ ID NO: 37818 - RNA, 63 nt, Human
cauguaauagggagaguugaacaugaauauuagagaaggaauccaguuacuuuuuuaaauuac

SEQ ID NO: 37819 - RNA, 63 nt, Human
augaaaguucuugcuauaaugguauggaaaacaagaaggaaaugaaaauauuuuuaugccuac

SEQ ID NO: 37820 - RNA, 63 nt, Human
gcuuuuuauuaaacugcaggaaauuaauucugaagaaggaaaagaaacugacaugguaauuug

SEQ ID NO: 37821 - RNA, 63 nt, Human
uaaaucaauguuacauucuuauaucacuucuugagaaggaaguuccgauuugaaauuguauca

SEQ ID NO: 37822 - RNA, 63 nt, Human
gucuuggguugaguacccaaaugcuaccacuggagaaggaaugagagauaaagaaagagacag

SEQ ID NO: 37823 - RNA, 63 nt, Human
aagucugcccuucuuuuuaggaaacccuaaaggagaaggaagcagaauauaacccucuggaga

SEQ ID NO: 37824 - RNA, 63 nt, Human
aaggacagcaguaaaugaagaccauggaagaaaagaaggaaugccaaagaucgaggaaaucua

SEQ ID NO: 37825 - RNA, 63 nt, Human
ggaggaaaccgcuauaauguaaaaucagauuucagaaggaaaaugcagcaaggacugacugua

SEQ ID NO: 37826 - RNA, 63 nt, Human
gaauauaacaaccuuuaaaaaagcaaaauaauaagaaggaaaaauuccaggagggaaaaugaa

SEQ ID NO: 37827 - RNA, 63 nt, Human
ggaacacuuggaggauuugcuaaaaugagccucagaaggaaaauugguuuucuaaccugugac

SEQ ID NO: 37828 - RNA, 63 nt, Human
guuacaucaauaaaauagcaugcugggaaccugagaaggaagguuucuuuaguacugccacag

SEQ ID NO: 37829 - RNA, 63 nt, Human
agaacaguacagauuguucucaagagggccaucagaaggaagccaaagaguucacagccucag

SEQ ID NO: 37830 - RNA, 63 nt, Human
aucuauaaauacacucaccuaaauugaaagcuaagaaggaaauguaaauauaauauauauuua

SEQ ID NO: 37831 - RNA, 63 nt, Human
acagcgcuaacuaaccugugagaggggcccgagagaaggaacagcuguggaacaggcuuuuua

SEQ ID NO: 37832 - RNA, 63 nt, Human
agccuccugccccugcuuucugcccagggagggagaaggaagagggggagcugguuuuucugg

SEQ ID NO: 37833 - RNA, 63 nt, Human
agcuuggcauugggagcccuucaagaagguaccagaaggaacccuccaguccugcucucuggc

SEQ ID NO: 37834 - RNA, 63 nt, Human
gaccacggaacucaccgucugggggaggaggagagaaggaagggguggggggccuggaaacuu

SEQ ID NO: 37835 - RNA, 63 nt, Human
agcacugagcugccaucugggcuauucugggguagaaggaaggcugggaguggugggaauuuu

SEQ ID NO: 37836 - RNA, 63 nt, Human
uuucuuuucuucuugcauuuugugaacuuaaagagaaggaauauuuguguaggugaaucucgu

SEQ ID NO: 37837 - RNA, 63 nt, Human
uucaucccuuuccauauaacaggagggaggggaagaaggaaguuuccaugugcaggcaauacg

SEQ ID NO: 37838 - RNA, 63 nt, Human
accaucccagaagaggagugggagccagcucagagaaggaacugaacccaggagauccaucca

SEQ ID NO: 37839 - RNA, 63 nt, Human
ugaauuauuaccuaaccuggggaaccgaggaccagaaggaaggaccaggcuuccagcuccucu

SEQ ID NO: 37840 - RNA, 63 nt, Human
caaaacucccacucucaggugcaagaguuauguagaaggaaagggagcugaaauaggaacaga

SEQ ID NO: 37841 - RNA, 63 nt, Human
cacacuugcugggcagggagggggaagagagggagaaggaaggguuagagaugaauguguauc

SEQ ID NO: 37842 - RNA, 63 nt, Human
augugcuggaauggcauggacuugcugaucaacagaaggaaauggucugaagucugaccagca

SEQ ID NO: 37843 - RNA, 63 nt, Human
gcauuuuucuuuauugcaaagagagucuauuauagaaggaaagaaguggaggccugcugugug

SEQ ID NO: 37844 - RNA, 63 nt, Human
uugugggguaguaaaauucaugucaaaaaggaaagaaggaauggaggaggucaguuaguucau

SEQ ID NO: 37845 - RNA, 63 nt, Human
uaggcuccccagcuuucuccaggcuggggugggagaaggaagcaggacagagcugcaagugcc

SEQ ID NO: 37846 - RNA, 63 nt, Human
cgggggcugcgagcaccagcaacuuugauuuauagaaggaaaauggaaacccccaucugagua

SEQ ID NO: 37847 - RNA, 63 nt, Human
guaacagaaaggucaauggacuugacccaacugagaaggaaaaacuucuguauggaggaaaag

SEQ ID NO: 37848 - RNA, 63 nt, Human
cgggcgaggacgugaagccucccgaacacgcacagaaggaaggagccagcucccagcccacuc

SEQ ID NO: 37849 - RNA, 63 nt, Human
cugaaggcaaagaagaccuuucuagaaccugguagaaggaagcugugcagcaugcuccucguc

SEQ ID NO: 37850 - RNA, 63 nt, Human
aguuguucccccagggggcucugccccaccuggagaaggaagcugccugguguggagugacuc

SEQ ID NO: 37851 - RNA, 63 nt, Human
aauuucuaccaaauaguagagcauaccacuugaagaaggaaagaaccgaagagcaaacaaaag

SEQ ID NO: 37852 - RNA, 63 nt, Human
uguacauaaggagggaacaugguacagaaggcuagaaggaauuauaggucuuauuccccuuuc

SEQ ID NO: 37853 - RNA, 63 nt, Human
auucuaaagcagaguccuucccuucccccagugagaaggaaaaugggauaagucugggacacu

SEQ ID NO: 37854 - RNA, 63 nt, Human
cggugauccuuaaaugaacugcaggcugagaaaagaaggaaaaaggucacagccuccauggcu

SEQ ID NO: 37855 - RNA, 63 nt, Human
gaaaaucaaguuccauccucagacaagagguaaagaaggaaaauucagccaguugauuuuguu

SEQ ID NO: 37856 - RNA, 63 nt, Human
cucgaaagaaagaaagaaaaaaaggaaggaaggagaaggaaggaaggagaagaaaagguaccu

SEQ ID NO: 37857 - RNA, 60 nt, Human
aaaagacaaaugaagccuaaucguuuuucuagaaggaaaauaaauucuaauugauaauga

SEQ ID NO: 37858 - RNA, 63 nt, Human
ccaauauccauucauguuaaaaccucucaacacagaaggaauacaggagaacuuacucaaguu

SEQ ID NO: 37859 - RNA, 63 nt, Human
uuuuuaaaaucucaaaugacaugcagugugaguagaaggaagucaacaauauguggggagagc

SEQ ID NO: 37860 - RNA, 63 nt, Human
ugagccuggcuggcacagaaaccucuacuaaaaagaaggaaaaugaucugagucccaggagcu

SEQ ID NO: 37861 - RNA, 63 nt, Human
auugccaucuuaccugucucuucuccaugagggagaaggaagcagcuagcuaugucccuagcu

SEQ ID NO: 37862 - RNA, 63 nt, Human
ggugaccacgccugugcucaguuuggcagcuauagaaggaaaugcugucccauaaaaugccau

SEQ ID NO: 37863 - RNA, 63 nt, Human
aaguugagauguuucagcuugaagaaccaaaacagaaggaauauguacaaagaauaaauuuuc

SEQ ID NO: 37864 - RNA, 63 nt, Human
cacauugucuugauccagaccagcucugugaucagaaggaaauuggguccaguguaggagaga

SEQ ID NO: 37865 - RNA, 63 nt, Human
auaaagugaucgagacaaggacugacuggguauagaaggaagacagacuccugucuucacucc

SEQ ID NO: 37866 - RNA, 63 nt, Human
gucuucaaucgaucaauaauucugcucuggaagagaaggaacagggagcagagagacccaacu

SEQ ID NO: 37867 - RNA, 63 nt, Human
agaucucucuccccugcgagcccuuuuuauuugagaaggaaaaagagaaaagagaaucguuua

SEQ ID NO: 37868 - RNA, 63 nt, Human
gccucgggcuggguugcuuggucauagagccauagaaggaagcugucagcccggagugccugc

SEQ ID NO: 37869 - RNA, 63 nt, Human
ccaggagaggcagcccaucuuggcccuggaugaagaaggaaacccacagaggcccagggcuug

SEQ ID NO: 37870 - RNA, 63 nt, Human
cacagagucugaccucuggaccacucuaacuggagaaggaacuuuauguucccucuccugcug

SEQ ID NO: 37871 - RNA, 63 nt, Human
acaacauggagcaaaagagacagggagagguggagaaggaaaaaacccuacaaaacaaaaaca

SEQ ID NO: 37872 - RNA, 63 nt, Human
ggaaucagcuaguuuucaaucuuauuagggugcagaaggaaaacuaauaagaaaaccuccuaa

SEQ ID NO: 37873 - RNA, 63 nt, Human
uuccagcucuuuacauccuaacuuuggagguauagaaggaaggaugugguccaacgggaagga

SEQ ID NO: 37874 - RNA, 63 nt, Human
cucaggccagagaaagagccaugugagaagauuagaaggaacaguggugcugacacaggaccu

SEQ ID NO: 37875 - RNA, 63 nt, Human
guacauucaauguuuaugcaaggaaggaaagaaagaaggaagugaagagggagaagggaugga

SEQ ID NO: 37876 - RNA, 63 nt, Human
uuccuuugacaauuagacacacagguaccaggaagaaggaaugaccucugggcugaaaacagc

SEQ ID NO: 37877 - RNA, 63 nt, Human
cagagacauucauuuaguugauauaauccuaccagaaggaaagcacuaagaaacacucguuug

SEQ ID NO: 37878 - RNA, 63 nt, Human
ccaauauccauucaugauaaaaccucucaacacagaaggaauacaggagaacuuacucaauuu

SEQ ID NO: 37879 - RNA, 63 nt, Human
ugcuguguugcaguauugauguaaaauuuguuaagaaggaaguacccacagaucacugccauc

SEQ ID NO: 37880 - RNA, 63 nt, Human
gaagcacuuuagugguaguauuagcuguuuuuaagaaggaauagcaaguuuaauuauauacaa

SEQ ID NO: 37881 - RNA, 63 nt, Human
caaagcugaggaauuuucuuuuuucaacugaauagaaggaacuuugauuagugacuauugcua

SEQ ID NO: 37882 - RNA, 63 nt, Human
cuuugccucaaaacaaauuuuaaaaagaaagaaagaaggaaagaggguauguuuuucacaauu

SEQ ID NO: 37883 - RNA, 63 nt, Human
agagaccacucagagaggguccaagggugauggagaaggaagcauggccugggagcuuggaag

SEQ ID NO: 37884 - RNA, 63 nt, Human
ucccuuggguuuggacccauggucccaggugagagaaggaagugaggccauagaugcagggag

SEQ ID NO: 37885 - RNA, 63 nt, Human
augaaauaaacaaggcaaaauagagguggaaacagaaggaagucauuugcugagucugcagaa

SEQ ID NO: 37886 - RNA, 63 nt, Human
gucuccuggaaugcucccaccucaaguggaguuagaaggaagguagaggggcucucccccagg

SEQ ID NO: 37887 - RNA, 63 nt, Human
uuaguauauuuaaaaacuguucaaaagcaaaagagaaggaacaggaaugaaaggaaaccuucc

SEQ ID NO: 37888 - RNA, 63 nt, Human
uauaaauauauuuauuaaguagcgcugcggcuaagaaggaagagugaggggucuguccauggg

SEQ ID NO: 37889 - RNA, 63 nt, Human
uucaaggcugguggcugggacccuccaggggugagaaggaagggagaagguggcauaacuuuu

SEQ ID NO: 37890 - RNA, 63 nt, Human
uuuuucauaaaaauuaaaugcuuuaagaaauggagaaggaaaaauagcuuuuaucaauuuuuu

SEQ ID NO: 37891 - RNA, 63 nt, Human
uguauugauaauuggacaaagagagagaaagaaagaaggaaggaaggaaaaacuuguuacuga

SEQ ID NO: 37892 - RNA, 63 nt, Human
cagcuauggucuucuacacacuguaaggguaguagaaggaaagagaacuaaggaauguuauua

SEQ ID NO: 37893 - RNA, 63 nt, Human
uaaucacaacauccugacuccgucauuuaauaaagaaggaacaucaggcaugcuaccaggccu

SEQ ID NO: 37894 - RNA, 63 nt, Human
ucucuuggccuuacugaagaugggggaaggguaagaaggaaggguguaggccaaggcucaccc

SEQ ID NO: 37895 - RNA, 63 nt, Human
gcccuggcagcugagaaauuguuuucuauauguagaaggaaaaccugagcauuugcaggcauc

SEQ ID NO: 37896 - RNA, 63 nt, Human
ugaaagagaaagacugauuaccuccuguguggaagaaggaaacaccgagucucuguauaaucu

SEQ ID NO: 37897 - RNA, 63 nt, Human
uggaauuacaaagcagaauuaaaauuauauuguagaaggaaacaccaagaaaagaauuuccag

SEQ ID NO: 37898 - RNA, 63 nt, Human
ccgaccaaaauuuugacaacgaugauguucaccagaaggaaaaaaaaaaaucaguuuuaugca

SEQ ID NO: 37899 - RNA, 63 nt, Human
cuacuuauagacccaaucagaauacggugguugagaaggaaccaguguuuacaaguaauauca

SEQ ID NO: 37900 - RNA, 63 nt, Human
aaaagcaagcuaagaaaaaauucuguuuauaaaagaaggaaaagauaguuuauguuuuuagcc

SEQ ID NO: 37901 - RNA, 63 nt, Human
augggaaccauuucauucuaacagaauaaaccgagaaggaaaccagagcugggacugcugccg

SEQ ID NO: 37902 - RNA, 63 nt, Human
gaguaguuggaaaguuggaaccguguccagcacagaaggaaucugugcagaugagcagucaca

SEQ ID NO: 37903 - RNA, 63 nt, Human
uugcuaaaccauuacaauguuaggucuuuuuuaagaaggaaaaagucaguauuucaaguucuu

SEQ ID NO: 37904 - RNA, 63 nt, Human
cauccuuuucuauuucccuagaaccuuaaugguagaaggaauugcaaagaaucaaguccaccc

SEQ ID NO: 37905 - RNA, 63 nt, Human
ucucaugugacagauggggaaacugaggccuugagaaggaaaaaggcuaaucuaaguuccugc

SEQ ID NO: 37906 - RNA, 63 nt, Human
cuccagaauuccacuucuaguuauuuauucaagagaaggaaaaacaaugaucacagcaauacu

SEQ ID NO: 37907 - RNA, 63 nt, Human
cccagaaaaccagucuguguuuacagacagaagagaaggaagccauagugucacuuccacaca

SEQ ID NO: 37908 - RNA, 63 nt, Human
acugaacaaggucucagggguauugcuaagccaagaaggaacuuucccacacuacugaaugga

SEQ ID NO: 37909 - RNA, 63 nt, Human
uguaaaagcccagaucacugugggcuggagaggagaaggaaagggucugcgccagcccugucc

SEQ ID NO: 37910 - RNA, 63 nt, Human
uguuuccuggguuugcucuuugacaauaaauggagaaggaaggucacccaacuccauugggcc

SEQ ID NO: 37911 - RNA, 63 nt, Human
auaauaaauugguaggaaaaaaaaguaccuccuagaaggaagccuuccccaccauuuccaggu

SEQ ID NO: 37912 - RNA, 63 nt, Human
gauuauugcccaguuauucuuaaguaaggacaaagaaggaaauaucaucguauuucuuuuuuu

SEQ ID NO: 37913 - RNA, 63 nt, Human
ccuugcuucaagaauaaaccacaccagugaacaagaaggaaaggccuuuuggagugugucuuu

SEQ ID NO: 37914 - RNA, 63 nt, Human
ugcuuauuaaaacaaaugauguauggggagaggagaaggaagggcaaggaaggaauugacaga

SEQ ID NO: 37915 - RNA, 63 nt, Human
ucgcagaguaggccuuugcccgggggcagacuuagaaggaaggggagagacaaagggggacug

SEQ ID NO: 37916 - RNA, 63 nt, Human
uaauuuuugucuguuaaucauucauacguuucuagaaggaacccagccagccggcggaaugca

SEQ ID NO: 37917 - RNA, 63 nt, Human
ugauaauggauccuuaacagaugaacuauccacagaaggaagagggauccgucucuuaaguaa

SEQ ID NO: 37918 - RNA, 63 nt, Human
ggcuuugauaaugcucacacaucuuggaguuucagaaggaaauuauucugcaucacaaauacu

SEQ ID NO: 37919 - RNA, 63 nt, Human
uaucauuuuagauuuauacuuggguacucaaggagaaggaaugcauacugucauuugcaggcu

SEQ ID NO: 37920 - RNA, 63 nt, Human
uaauaaauuuggaugucaacugagaaaggagugagaaggaagaaacaaugcgcaaaggaaagc

SEQ ID NO: 37921 - RNA, 63 nt, Human
caguuauuugguggugggaaguagcugaagcaaagaaggaaaaguaauaccuuuaaccucacu

SEQ ID NO: 37922 - RNA, 63 nt, Human
ucuuucacaguaccaucugaauaccucuuugaaagaaggaagacuuuacguaguguagauuug

SEQ ID NO: 37923 - RNA, 63 nt, Human
cauuguaagugguggggcugggagaggaggaacagaaggaaagccauagcgcucucuugcccc

SEQ ID NO: 37924 - RNA, 63 nt, Human
uaaagacagggaugaaggauagaggcugagagaagaaggaagaaucagcccagcagguauggg

SEQ ID NO: 37925 - RNA, 63 nt, Human
gugugaaugugagagagacacagcccuccuuucagaaggaaaggggccugaggugccagcugu

SEQ ID NO: 37926 - RNA, 63 nt, Human
gcagccucaguucagaagagcuugcagcuuuccagaaggaacgagccaucuuccuggcugcuc

SEQ ID NO: 37927 - RNA, 63 nt, Human
aggaggagggcagggcuuggguccaguggaggaagaaggaaggagaggcuuggaaagccuugu

SEQ ID NO: 37928 - RNA, 63 nt, Human
gcugaaaacuuuugccaugaagcaggacucuaaagaaggaaugagugcaauuucuaagacuuu

SEQ ID NO: 37929 - RNA, 63 nt, Human
acauuccaucuuacauuagugauuccaucaaagagaaggaaaguaagccuuuuugucaccuca

SEQ ID NO: 37930 - RNA, 63 nt, Human
acggucugcaaccaaacucuaauucaaccugccagaaggaauguuagaggaagucuuugucag

SEQ ID NO: 37931 - RNA, 63 nt, Human
agaugugaaccugaggaugcaucuuguuucauaagaaggaaggcaggugaauaugugguuucu

SEQ ID NO: 37932 - RNA, 63 nt, Human
aucugugaggugauaggcaaggaugaaagacaaagaaggaaaagaguaucaaaggcagaaagg

SEQ ID NO: 37933 - RNA, 63 nt, Human
cuccccacccaccaaaugccucugccuugauggagaaggaaaaggcuggcaagguggguucca

SEQ ID NO: 37934 - RNA, 63 nt, Human
uuuuuuuaacuggugaagagaaaaaggcugaaaagaaggaauauaccuuuuuuguuccacuug

SEQ ID NO: 37935 - RNA, 63 nt, Human
cagauuucgcccauuauucaggcugcacaacacagaaggaaacuugauuucaauaagacccaa

SEQ ID NO: 37936 - RNA, 63 nt, Human
ucuccauuacugcaagagaauggaagucuuaauagaaggaagcaggagugauuaguucggguu

SEQ ID NO: 37937 - RNA, 63 nt, Human
ggaggagggguggcuuuuauggacuuccaugagagaaggaaagaaauauuucagguaagcuuc

SEQ ID NO: 37938 - RNA, 63 nt, Human
uuuuugaaagagcaagaggaaagaaaaaagaaaagaaggaaagaagaauaaagaagagaaacg

SEQ ID NO: 37939 - RNA, 63 nt, Human
auggcaugauuagauugcaaagcaaugaacucaagaaggaauugaaauaaggagggacaugau

SEQ ID NO: 37940 - RNA, 63 nt, Human
uuaggcuuuucugccugcuccugcuuaaacacaagaaggaauccuggauuuugcccucuccuu

SEQ ID NO: 37941 - RNA, 63 nt, Human
cuguagcaaaugacugaauacaugugaacaaacagaaggaaguucacucuggagugucuuugg

SEQ ID NO: 37942 - RNA, 63 nt, Human
uaaguguaagaaauaccauuucaggaaugaaaaagaaggaauacuacuuucuaagaaagaaga

SEQ ID NO: 37943 - RNA, 63 nt, Human
uauuccuuaacuauguauuuuuauuucagugagagaaggaaaguuguaaacuagcccauaguc

SEQ ID NO: 37944 - RNA, 63 nt, Human
ggacaggggcaggggcaggggcggagccccugaagaaggaaucccagccggguucgggagccg

SEQ ID NO: 37945 - RNA, 63 nt, Human
cugagcccuggccgccuccuggcuggaaccaugagaaggaagcucaguacuucccacaguguc

SEQ ID NO: 37946 - RNA, 63 nt, Human
cuggaaccugguugggcaguaggggagggagguagaaggaaaagugugagauuucuaccuuuu

SEQ ID NO: 37947 - RNA, 63 nt, Human
aucucaucucaggaaguggugguggggguagucagaaggaaaaauaacuggacaucuuugugu

SEQ ID NO: 37948 - RNA, 63 nt, Human
uugugcaagaacccaacuuuuacucaggagcugagaaggaagaagccucaaaccacccauuuc

SEQ ID NO: 37949 - RNA, 63 nt, Human
guguuaauuuuaguagaaucaggcacugcucgcagaaggaacacagauuguagagauuaacau

SEQ ID NO: 37950 - RNA, 63 nt, Human
uagggcuuuauuuguuugagccuuuucagugaaagaaggaacauuuccuauggugcugucuca

SEQ ID NO: 37951 - RNA, 63 nt, Human
guaacaaaauauuuuauuauauaaaaccagguuagaaggaaugcaggauauuuuuaacacaac

SEQ ID NO: 37952 - RNA, 63 nt, Human
auuccaaucuaaguauaaagguacaagguagugagaaggaaauacuacaguucggagaacugc

SEQ ID NO: 37953 - RNA, 63 nt, Human
gacccauguaauacuuuuauccauguuuaaaaaagaaggaauuuggacaaaggcaaaccgucu

SEQ ID NO: 37954 - RNA, 63 nt, Human
aagaaacauugaaggaaauugggauguuuggccagaaggaauguaaacaguaguaguagcugc

SEQ ID NO: 37955 - RNA, 63 nt, Human
uuaaugccacuggguuuuagucaggccacagugagaaggaacagcccuaacaggccuccagcc

SEQ ID NO: 37956 - RNA, 63 nt, Human
ccuccagauggcagguuugcaauccaagcaggaagaaggaaaagauacccaaaggucaagaac

SEQ ID NO: 37957 - RNA, 63 nt, Human
uagggcaacaaugaaggaggacccagccaagcuagaaggaauuuuguggaugggagacagcag

SEQ ID NO: 37958 - RNA, 63 nt, Human
ccucaacacaucccuucagugacucagagucucagaaggaaacccugacuccuggggccauuu

SEQ ID NO: 37959 - RNA, 63 nt, Human
gugcuucuggaugugagucucuuauuuaucugcagaaggaacuuuggggugcagccaggaccc

SEQ ID NO: 37960 - RNA, 63 nt, Human
cauucuugaccaagucuuaaaugcuagaaucugagaaggaauuauuaaauaggugaguuguug

SEQ ID NO: 37961 - RNA, 63 nt, Human
cccugcccuuucucagcugccuccccugcccucagaaggaaaggagagggcucacuuaucacu

SEQ ID NO: 37962 - RNA, 63 nt, Human
uuuuuaagcguaauuuugccaaauaauaaaaacagaaggaaauugagauuagagggagguguu

SEQ ID NO: 37963 - RNA, 63 nt, Human
uuuaagaacagaaggcacaacucaaauguguaaagaaggaagagcaagaacauggccacaccc

SEQ ID NO: 37964 - RNA, 63 nt, Human
gacucuuuaaaaagaucuaugucuugaaaauagagaaggaacacaggucuggccagggacgug

SEQ ID NO: 37965 - RNA, 63 nt, Human
uuuugguggauucucuguccuauacauuuacuuagaaggaauggaguuauuugucucuauaaa

SEQ ID NO: 37966 - RNA, 63 nt, Human
cauaacuuguuugguuucacagguucacaguuaagaaggaauuuugccucugaauaaauagaa

SEQ ID NO: 37967 - RNA, 63 nt, Human
gcuggcccccuucuguuuuauguuugguuuuugagaaggaaugaagugggaaccaaauuaggu

SEQ ID NO: 37968 - RNA, 63 nt, Human
aggagaagaagcugagcuauuggaacaggaaauagaaggaacucuaguuucuguuugaaguga

SEQ ID NO: 37969 - RNA, 63 nt, Human
cuucuugcugaacauauuuuauucucuuuucagagaaggaaaauaaaaaggauucuaaaaguu

SEQ ID NO: 37970 - RNA, 63 nt, Human
cuccucauaggaggaugauucagcaucagaagaagaaggaacccauagcuuggugucauuaac

SEQ ID NO: 37971 - RNA, 63 nt, Human
uucaaggcuuuuggggguccaggccuggggucaagaaggaaaaugugugugagcaugugugug

SEQ ID NO: 37972 - RNA, 63 nt, Human
ccuggcuuguaacuccaccaacccaucagaaggagaaggaaggagacucaccucugccucaau

SEQ ID NO: 37973 - RNA, 63 nt, Human
aaucggaagugcaggagcuggucagagccaaugagaaggaaaccucaucuuugcauagcccau

SEQ ID NO: 37974 - RNA, 63 nt, Human
gaauugggaauauagucagugggacagugagugagaaggaauggagcaagacacagaugaauu

SEQ ID NO: 37975 - RNA, 63 nt, Human
uguuacacacuauuuuggaauuagagaacauacagaaggaauuuaggggcuuaaacauuacga

SEQ ID NO: 37976 - RNA, 63 nt, Human
agauaggugggaggacuaacuuccagggugccaagaaggaagaaaagccccagguucucuuuu

SEQ ID NO: 37977 - RNA, 63 nt, Human
acauggguuucagcaaugccacauuccagucagagaaggaaacaggggaucggaauuaugcca

SEQ ID NO: 37978 - RNA, 63 nt, Human
gugaaauggacaccucugcugugaauguuuuagagaaggaaauucaaaaaauguuguaacuga

SEQ ID NO: 37979 - RNA, 63 nt, Human
auuuaugcuccagugcuugccauaauuugucugagaaggaaucuguuaaauaaaagcuuuuau

SEQ ID NO: 37980 - RNA, 63 nt, Human
uuguguugugaacguuuggugacugcuguugaaagaaggaaaagggugugugagaaagccuac

SEQ ID NO: 37981 - RNA, 63 nt, Human
cuuugugaugugaugcuuagcaguuuggcccgaagaaggaaaauauccaguaccaugcuguuu

SEQ ID NO: 37982 - RNA, 63 nt, Human
ugagagucuguaugauucuggaacagagacaucagaaggaaagacuggugaaaagauguaucu

SEQ ID NO: 37983 - RNA, 63 nt, Human
ggugcacuuuaugaaacuggcacuugacugaacagaaggaaacagcuguaccucuaagcuccu

SEQ ID NO: 37984 - RNA, 63 nt, Human
cccagagcuugaaaggccgcgguuggcacuucgagaaggaaguggagaguaaagacagcgccu

SEQ ID NO: 37985 - RNA, 63 nt, Human
auugggcuuuggcaaaucguguauuuuguguauagaaggaauuuaaggagagguauuacuuau

SEQ ID NO: 37986 - RNA, 63 nt, Human
cuccuccaucucucaccuuuuccuguggagaagagaaggaaaagcacacgcaugcgccucagc

SEQ ID NO: 37987 - RNA, 63 nt, Human
ccuggcagccaagaaaagcccuuucuacaugcuagaaggaaauacauccaaaaaguuagcauu

SEQ ID NO: 37988 - RNA, 63 nt, Human
auuaaggugucuuaaauuuggcgcauagaggagagaaggaaaccugaggaguaguguuccucc

SEQ ID NO: 37989 - RNA, 63 nt, Human
uauucaagagacucuuccauuuuugcaagcuguagaaggaaaugucugaaugucuauaaguua

SEQ ID NO: 37990 - RNA, 63 nt, Human
aauuuuauugacuaauaagggaauauguauggaagaaggaagagaaagccuuugucuagcauu

SEQ ID NO: 37991 - RNA, 63 nt, Human
caggauuuuucaaggaaccuuuuucaaugaaagagaaggaaguuaaaaccuauagguuauuuu

SEQ ID NO: 37992 - RNA, 63 nt, Human
ugguuccugaauaaaacauuaaccuuuuaagucagaaggaaccucgguacuucuuaagguuug

SEQ ID NO: 37993 - RNA, 63 nt, Human
gaccuagaaauuuuucauucccauaucuaccuaagaaggaagcaguaaauccauaauuuaccu

SEQ ID NO: 37994 - RNA, 63 nt, Human
gaucaaugaauaugugauuugcuccagaucguuagaaggaaaaguaagauuucagucaucaaa

SEQ ID NO: 37995 - RNA, 63 nt, Human
aaauuggcauuuaguaaccuuaauucuuuuuauagaaggaaugacuuaaaguauuguccccuc

SEQ ID NO: 37996 - RNA, 63 nt, Human
uuauuaauggggagggacgaguagaugguaaaaagaaggaaaaggagguaaaaggugaaagga

SEQ ID NO: 37997 - RNA, 63 nt, Human
ccuggcaccaguauaacuauaaagcacuagcugagaaggaacugauacuuacauuucauggac

SEQ ID NO: 37998 - RNA, 63 nt, Human
uccugagaacagcuuuagucauggaauacugggagaaggaauaacuuucacaaaauaaacuua

SEQ ID NO: 37999 - RNA, 63 nt, Human
agaagggcaauauuuuaucauauguucuaaaagagaaggaagagaaaauacuacuuucucaaa

SEQ ID NO: 38000 - RNA, 63 nt, Human
gacacaugaugaacucuagcacugguguauaugagaaggaaggcgaaagcaugacaggaaacc

SEQ ID NO: 38001 - RNA, 63 nt, Human
uuaagacggaaguaaauuaugauguccagggggagaaggaagauaggacguauuuauaauagg

SEQ ID NO: 38002 - RNA, 63 nt, Human
ccaugcaaagccgcagccuuugggagggagaagagaaggaagagcgcagagccggcaaaguga

SEQ ID NO: 38003 - RNA, 63 nt, Human
guauuaggaggagagagaggaaaaaaagaggaaagaaggaaaaaaaaaagaauuaaaaaaaaa

SEQ ID NO: 38004 - RNA, 63 nt, Human
cgggccacuggggaaucugaggggugaugggagagaaggaaccuggaguggaaggagcagagu

SEQ ID NO: 38005 - RNA, 63 nt, Human
ugggccacuggggaaucugaggggugaugggagagaaggaaccuggaguggaaggagcagagu

SEQ ID NO: 38006 - RNA, 63 nt, Human
ucuuuucuaauccuuguuagacuacugauuuaaagaaggaaaaaaaaaagccaacucuguaga

SEQ ID NO: 38007 - RNA, 63 nt, Human
ugggcugggaggagguggaggaggaggaagaggagaaggaaaagugacgaagagagaggagga

SEQ ID NO: 38008 - RNA, 63 nt, Human
gagcaagaccuuguuucucaaaaauaaauaaauagaaggaaauaaauguaaaaaugcugcaaa

SEQ ID NO: 38009 - RNA, 63 nt, Human
uucgagucgaguguaagggcccuucacaaaagcagaaggaacacuggcccaaacccccagcac

SEQ ID NO: 38010 - RNA, 63 nt, Human
aaugguggaauggaagacagaacuggaagagaaagaaggaaaagaugagcucucgucuggcag

SEQ ID NO: 38011 - RNA, 60 nt, Human
aaaagccaucuauguacugaacccgggacuagaaggaaaauaaaugaucuauauguugug

SEQ ID NO: 38012 - RNA, 63 nt, Human
uuuuuaagcaccaaaaagaagauggggaagaaaagaaggaaaauuuucugauauaaauauguu

SEQ ID NO: 38013 - RNA, 63 nt, Human
ccaucaugaaugcagauauucuagcauauugucagaaggaaggauggugcaaauuagcuuuuu

SEQ ID NO: 38014 - RNA, 63 nt, Human
ucagacucaucugaucaaaguuccgagaggcauagaaggaaaaacgaagggccuuagaggggc

SEQ ID NO: 38015 - RNA, 63 nt, Human
gcuuuaaagaaauagcuccgauaaggacuuuuuagaaggaaauacuugguaaaacuuaauaaa

SEQ ID NO: 38016 - RNA, 63 nt, Human
uaugggagaagggcaaagacuucaugggaagagagaaggaaggcccuggguagaaacgcuugg

SEQ ID NO: 38017 - RNA, 63 nt, Human
uuggggaacugagcucagaggcaggugcuucagagaaggaaacaaaaugagggguggcaggga

SEQ ID NO: 38018 - RNA, 63 nt, Human
cugagaauguauguaaaaguucugugacaguacagaaggaaaacaacuuuuuauguauagcuu

SEQ ID NO: 38019 - RNA, 63 nt, Human
ccccagaggcccuggaggucuccaggggccugcagaaggaaagaagggggcccugcuaccugu

SEQ ID NO: 38020 - RNA, 63 nt, Human
guguggcaaugggauuugggcuacccuaaagggagaaggaagggcagagaauggcugggucag

SEQ ID NO: 38021 - RNA, 63 nt, Human
aacgcuaauucagcauguguucauucugcauugagaaggaacugauacaucugaugcaugcuu

SEQ ID NO: 38022 - RNA, 63 nt, Human
aguguaauccacgguagcagccacacuuccuuuagaaggaacuguuauaauuuauuuaaaagu

SEQ ID NO: 38023 - RNA, 63 nt, Human
aacucucugugaacguuuuuccagguggcuggaagaaggaagaaaaccugauauagccaaugc

SEQ ID NO: 38024 - RNA, 63 nt, Human
gauuguggcaggucucaaucuugggaguuuuuaagaaggaaugugccagaggccgauucccaa

SEQ ID NO: 38025 - RNA, 63 nt, Human
auuuauauuuuaccaauauaugccuguuacaagagaaggaaauaugaguuauuuaaguuuaac

SEQ ID NO: 38026 - RNA, 63 nt, Human
ggcauuucuugaccuuuacccacuuacgcaaggagaaggaaaucauaaugaugucaugugauc

SEQ ID NO: 38027 - RNA, 63 nt, Human
uacacugugggagagaaccugucaaaaugucgaagaaggaaggcgaagaaucaaguaaucucu

SEQ ID NO: 38028 - RNA, 63 nt, Human
ggcauguuuuguuacagguuguagaguauuugcagaaggaaaccauuucugguuauuuggcua

SEQ ID NO: 38029 - RNA, 63 nt, Human
guuuuaccccaucccuugugcauauuuccagggagaaggaaagcauauacacuuuuuucuuuc

SEQ ID NO: 38030 - RNA, 63 nt, Human
aagauuuggaagcauugccaaagacagccaugaagaaggaagcuguagagguguuuuuuguug

SEQ ID NO: 38031 - RNA, 63 nt, Human
agauaggcagauguggguauggggcccagugugagaaggaagacagagaaguucuugaaagcu

SEQ ID NO: 38032 - RNA, 63 nt, Human
ugccuuaacaauguggcuguccuuuuccacugaagaaggaaagacguuuugaucuagaaauag

SEQ ID NO: 38033 - RNA, 63 nt, Human
auuauugcccacuguucucauagcuaaaaguuaagaaggaaggaaggaaagcaggagaaagga

SEQ ID NO: 38034 - RNA, 63 nt, Human
caccaagcucaaagcguggacaggugugccgacagaaggaaccagcguguauaugaggguauc

SEQ ID NO: 38035 - RNA, 63 nt, Human
agcugauaccacgggcuuucguuaucuugacauagaaggaagcaaugccacggcuccaggguu

SEQ ID NO: 38036 - RNA, 63 nt, Human
gggacccagaguuagcaguggggauggagcaguagaaggaaucacuguuucuccuaggagucu

SEQ ID NO: 38037 - RNA, 63 nt, Human
aaaacuugacuaugaucuggaacagauaaugcaagaaggaacacauaaguaaguugcuuuggu

SEQ ID NO: 38038 - RNA, 63 nt, Human
agcaaguagauuaggaaucaaugucuuuguacaagaaggaaaaauagagcaaaaauccaaggg

SEQ ID NO: 38039 - RNA, 63 nt, Human
agcaccucguauagauaugaucagacaaaaugcagaaggaaaaaaaaacauauugaaugaagc

SEQ ID NO: 38040 - RNA, 63 nt, Human
ucucuuuauuugagacucagaauuccuucuagaagaaggaagugcuuuuuguuauaggauccc

SEQ ID NO: 38041 - RNA, 63 nt, Human
gcuagucuagauaaaaaaagagauaaagacuacagaaggaaagagaucuugccuuuugaaaag

SEQ ID NO: 38042 - RNA, 63 nt, Human
gaacccuguggagaugagucagugccaugacugagaaggaaccgaccccuaguugagagcacc

SEQ ID NO: 38043 - RNA, 63 nt, Human
augccaacauuaauacucaggaccccaagauacagaaggaaaucaugcgugugaucggaacuc

SEQ ID NO: 38044 - RNA, 63 nt, Human
cagccagagccaaaugcaaucgguacgaaucuuagaaggaaggagggggagcccagguaugag

SEQ ID NO: 38045 - RNA, 63 nt, Human
ucgcgccugacccaggcugcuaagagggcaaggagaaggaaguacccuggggagggaagggac

SEQ ID NO: 38046 - RNA, 63 nt, Human
ugauaaaccugcuccaaggcaguggaaauaaaaagaaggaaaaaaaagacucuaucuucucau

SEQ ID NO: 38047 - RNA, 63 nt, Human
uguaaaaauaaauuggacuuugcaaaagcuuuuagaaggaaaagaaagaggauuaaagagaau

SEQ ID NO: 38048 - RNA, 63 nt, Human
ucuggacuuccaccuccagugccagaaacuuccagaaggaaggagaaaacucuugucaagaau

SEQ ID NO: 38049 - RNA, 63 nt, Human
acauuuccucguucugcucugaccucuuagcuuagaaggaagauucagaagugaggggcuaag

SEQ ID NO: 38050 - RNA, 63 nt, Human
cuucucuuuccccuuccagauccagaagaugaaagaaggaagugagcauccuuuugcucuguc

SEQ ID NO: 38051 - RNA, 63 nt, Human
aacuccuauuucccuaccaaccaaggagccuccagaaggaaaggaggaagaaauguuuucuua

SEQ ID NO: 38052 - RNA, 63 nt, Human
agagaagaaagggccugggagguggugggagggagaaggaagggaagaaaggggaggaagaau

SEQ ID NO: 38053 - RNA, 63 nt, Human
uguauguaaagacauuuuggaauuuccuggaugagaaggaagucugggcugggcaugguggcu

SEQ ID NO: 38054 - RNA, 63 nt, Human
ccuagaaccugcagguggugggggcggcuaccaagaaggaacagaggucucuggggaggaguc

SEQ ID NO: 38055 - RNA, 63 nt, Human
ugccaugucaccaccugaacauuccccaaacagagaaggaacccagcaucucagggccacugc

SEQ ID NO: 38056 - RNA, 63 nt, Human
gugcuguuuguuauccuuucucuguggcagugaagaaggaagaaaugagagucuagacucaag

SEQ ID NO: 38057 - RNA, 63 nt, Human
ucccucugcugucuggccgucugccagggagccagaaggaagggccuugcagccacagagaca

SEQ ID NO: 38058 - RNA, 63 nt, Human
uuuccuuugagcuagugacuugaaaagaaagagagaaggaaaagagaccauauuaaguccaug

SEQ ID NO: 38059 - RNA, 63 nt, Human
agccucccucccuccagcaagcccucccugcccagaaggaauggguccagguguggauuccca

SEQ ID NO: 38060 - RNA, 63 nt, Human
uguaacccagccaccaccaaaaagcaaacagaaagaaggaaggaugguuaagccauuggauaa

SEQ ID NO: 38061 - RNA, 63 nt, Human
gcauggguuggauuuuccaaaaucauaauuugcagaaggaaggccagcauuuacgaugcaaua

SEQ ID NO: 38062 - RNA, 63 nt, Human
ucuguugggauuucaagggaguguagagaagacagaaggaaagcugagagcuggcccgacaug

SEQ ID NO: 38063 - RNA, 63 nt, Human
guuugacaaguccugcuuggccugaugggugggagaaggaaccugagccuggcugagauggcu

SEQ ID NO: 38064 - RNA, 63 nt, Human
gauggaguuugcaagguuuccuugcccauuaucagaaggaaaaagagcagaauuuucuucucg

SEQ ID NO: 38065 - RNA, 63 nt, Human
ccccgucuccccucaaagaugagaaacauguucagaaggaaacggugucucucggcuguggcu

SEQ ID NO: 38066 - RNA, 63 nt, Human
cucuguaguuuauggcagaagggaauugcucagagaaggaaaagacugaaucuaccugcccua

SEQ ID NO: 38067 - RNA, 63 nt, Human
ucgacaggguuccaggaccuggaacacuuuaacagaaggaaaugccgaagcagcuugcacagu

SEQ ID NO: 38068 - RNA, 63 nt, Human
ccuccacuccucucaacugccucagcgauuucaagaaggaaauaaagggauaaagaaauucau

SEQ ID NO: 38069 - RNA, 63 nt, Human
auuuucccacaaaggggugggaagccaggagugagaaggaauucagggagagcaaaggagcca

SEQ ID NO: 38070 - RNA, 63 nt, Human
cucuuucuccccauggccccacugcagaauuaaagaaggaagaagggaaggcggaggagucua

SEQ ID NO: 38071 - RNA, 63 nt, Human
aagaaggaagaagggaaggcggaggagucuauaagaaggaaucaugauuucuauuuagcagau

SEQ ID NO: 38072 - RNA, 63 nt, Human
cacagucccugcccagcugugucuucuguuggaagaaggaaccugccuuagcucaguuuccag

SEQ ID NO: 38073 - RNA, 63 nt, Human
uuacuuguuaaugcuagucacagccaggaggucagaaggaauuuucuacuucuggauccaaau

SEQ ID NO: 38074 - RNA, 63 nt, Human
uuucuugcuuucuucagcacaucuuauaguaugagaaggaagguuugggcauguugggaaggg

SEQ ID NO: 38075 - RNA, 63 nt, Human
uaguguucucaucucaaagcaaacuaucauuccagaaggaaaagugugucagggcaagcagac

SEQ ID NO: 38076 - RNA, 63 nt, Human
agaugucaccaggauaagaccacagggaagcaaagaaggaagagagcuccacuuacaaagaac

SEQ ID NO: 38077 - RNA, 63 nt, Human
ccccuucugaaucagcugggaugacuggcuuugagaaggaagggaagauggaacaggcucaga

SEQ ID NO: 38078 - RNA, 63 nt, Human
guggcagaaagucucauuucaggaaggagggauagaaggaaggaaggaaggaacccccccccc

SEQ ID NO: 38079 - RNA, 63 nt, Human
ugaagaaaagugggccagugugggaaugcggcaagaaggaauugacuucgacugugaccugug

SEQ ID NO: 38080 - RNA, 63 nt, Human
caaaaccucaugccuacugucugccacugcuggagaaggaaucaugguuucuagaagugccuc

SEQ ID NO: 38081 - RNA, 63 nt, Human
aguaaaggacugagagaggagggagguggcuggagaaggaaaaggaacauugcucgaugcucc

SEQ ID NO: 38082 - RNA, 63 nt, Human
gcagguuggcaacauuguacaagucacccagccagaaggaaugcacaguacuguuucaaauca

SEQ ID NO: 38083 - RNA, 63 nt, Human
agucaucagauaugcuuacuaaaucuucagcauagaaggaaguguguuugccuaaaacaaucu

SEQ ID NO: 38084 - RNA, 63 nt, Human
auacuguggguaaugaaaagggaggaaaaaaaaagaaggaaaaggaauuauagacccccaggg

SEQ ID NO: 38085 - RNA, 63 nt, Human
agagcuggagcuuggagacauuaccccuucaucagaaggaauuuucggauguuuucuugggaa

SEQ ID NO: 38086 - RNA, 63 nt, Human
uauuagauguaagauguaagacuugcaaaggacagaaggaaucuucuguaaccacauagcugu

SEQ ID NO: 38087 - RNA, 63 nt, Human
uucuccacuggagcggaagggcugugugucaaaagaaggaagccaggcugugaagggccgugu

SEQ ID NO: 38088 - RNA, 63 nt, Human
gaggagcugagggagggagccauggaaggugccagaaggaagguuggcgggggcacguguggg

SEQ ID NO: 38089 - RNA, 63 nt, Human
cugagaaaccccugagcagguaacccagggaagagaaggaagccaggccuggagguccacggc

SEQ ID NO: 38090 - RNA, 63 nt, Human
agagacagcaacucccucccguaacucaggcugagaaggaaccagccagcucuuaccuccucc

SEQ ID NO: 38091 - RNA, 63 nt, Human
cuacaggggcaagggccgcuucguauuccuggaagaaggaaggcauaggcuucgguuuucccc

SEQ ID NO: 38092 - RNA, 63 nt, Human
cccugaccauuagcauggucuaggauccuuucuagaaggaagaucugaggcucuggugcucag

SEQ ID NO: 38093 - RNA, 63 nt, Human
gauauaaccuauuuagauuuaaugugaaauuuaagaaggaaacuugacuucuuaaccuuaauu

SEQ ID NO: 38094 - RNA, 63 nt, Human
gaggggaagagaggcagagagggaaagaggcagagaaggaaagagacaggcagagaaggagag

SEQ ID NO: 38095 - RNA, 63 nt, Human
gccgcauuccccccaauguggagaagucuaucaagaaggaaauggcucaguaugcuagcaaca

SEQ ID NO: 38096 - RNA, 63 nt, Human
gcaucacaauuggcaauaaaaccuguguguuugagaaggaaaaugacccaucggugaugcgcu

SEQ ID NO: 38097 - RNA, 63 nt, Human
gacccuggccuccacuuugcccuuuggguacaaagaaggaauagaagauuccguggccuuggg

SEQ ID NO: 38098 - RNA, 63 nt, Human
uuuguuccacgacuucuucuguagcuuuacaccagaaggaaggaaugggcuacagcagguagu

SEQ ID NO: 38099 - RNA, 63 nt, Human
agccugggugacagagugagacuccaucucaacagaaggaaaaaaaaggaaaauaggagaagg

SEQ ID NO: 38100 - RNA, 63 nt, Human
cgcaaagcacagacuagugcuuaaaaaaaaaaaagaaggaaaaauugaaaaaaauaaaaaaaa

SEQ ID NO: 38101 - RNA, 63 nt, Human
uuuuccacaagcuuuucacaaagaaggugagagagaaggaaaccuugggaggaggacauuacu

SEQ ID NO: 38102 - RNA, 63 nt, Human
cuuucuuaaaaaaaagaaaaagaaaaagcaagaagaaggaagaaagaaaaagacagaaagaga

SEQ ID NO: 38103 - RNA, 63 nt, Human
aacugggaggaaggggcccccccggcaggugagagaaggaacaucucccgccgcuguaacuug

SEQ ID NO: 38104 - RNA, 63 nt, Human
aacacacaaaacaaaaacagaacaaaagaagagagaaggaaauuuuaucaauuaaaaaugcug

SEQ ID NO: 38105 - RNA, 63 nt, Human
accaacccagcuccacccagcaguguccuggggagaaggaaggcugagccucuccccagccuu

SEQ ID NO: 38106 - RNA, 63 nt, Human
guagcuccccuggcuggcuccuaggggaagagcagaaggaaggaugccacuugggaaugaauu

SEQ ID NO: 38107 - RNA, 63 nt, Human
uuauucaguugguggcagugguugguuuaaaguagaaggaaauaagaucgccuuaauaccaga

SEQ ID NO: 38108 - RNA, 63 nt, Human
aggcacacgugagacuuucagugggcucugcugagaaggaaggcagcccaggagucagguaug

SEQ ID NO: 38109 - RNA, 63 nt, Human
uguauuuuguccaaguucacaguagaguaggguagaaggaaagcaugucucugcuuccauggc

SEQ ID NO: 38110 - RNA, 63 nt, Human
augacccugauggcuucugaaacaggaaaagagagaaggaagacagaggccugugcccacugc

SEQ ID NO: 38111 - RNA, 63 nt, Human
aacagaacaggcuuuuagaagauaaaagcgacaagaaggaaucuggugaauuuuagucauccc

SEQ ID NO: 38112 - RNA, 63 nt, Human
ccagaauggcauguuuuauaauuaacugaauaaagaaggaagcauuauuauauauuauugugg

SEQ ID NO: 38113 - RNA, 63 nt, Human
auaacaugaauugauggucaauuucccuucagcagaaggaaaaggugauuuagaucaguagcu

SEQ ID NO: 38114 - RNA, 63 nt, Human
ucagcccagcugcauaguugaagauuuauggacagaaggaaagugauguauggaaaauggaag

SEQ ID NO: 38115 - RNA, 63 nt, Human
agcuuguuguaaagauauuuucuuuuuguuauuagaaggaaauacaaagagaaaaauuucuuu

SEQ ID NO: 38116 - RNA, 63 nt, Human
ucucagauuuguagugcauagguguguguuucaagaaggaaaaaaaaagacuucuguucaaag

SEQ ID NO: 38117 - RNA, 63 nt, Human
accacucaguuaaggaagauccugaagcaguucagaaggaauaagcauuccuucuuucacagg

SEQ ID NO: 38118 - RNA, 63 nt, Human
gguagauuaaguuaaauaagcaaaaggaaacccagaaggaagagggcagaaucuuuaauuacc

SEQ ID NO: 38119 - RNA, 63 nt, Human
cuaggccaagcccucugugugccaucuccaaugagaaggaauccugcccucaccucacccuuu

SEQ ID NO: 38120 - RNA, 63 nt, Human
acauuaauaugugcaaagauuggcucuccaacaagaaggaaagcagggaggaagggagaccac

SEQ ID NO: 38121 - RNA, 63 nt, Human
acagaacgucgcugauggagaaagggcucccgcagaaggaacggccuguaccgugcgcuccgg

SEQ ID NO: 38122 - RNA, 63 nt, Human
agaagucacagcuuucuuaggcuuuaaaggaaaagaaggaaggacuuaaauagcuuuucuucc

SEQ ID NO: 38123 - RNA, 63 nt, Human
cccagguucaauccugcguuagcucuuuugaugagaaggaaauaaaccaaaccagccacuugc

SEQ ID NO: 38124 - RNA, 63 nt, Human
guguuuuuuuuccucaggaccugucacuuuggcagaaggaaaucugccuaauuuuucuugaaa

SEQ ID NO: 38125 - RNA, 63 nt, Human
ugaaugucuguuauauaacugggucggcuaucaagaaggaagguuauauuucuuaucacauuu

SEQ ID NO: 38126 - RNA, 63 nt, Human
aagcaggguuugaggguuggguggauggagcucagaaggaaaccccagccccaccacggauga

SEQ ID NO: 38127 - RNA, 63 nt, Human
aggacgcagcccccaagaccagcggacagcgccagaaggaaucgucgaaacagccugccagca

SEQ ID NO: 38128 - RNA, 63 nt, Human
gggcguggacucuggcgcacucuaguggacaggagaaggaacgccuuccaggaaccuguggac

SEQ ID NO: 38129 - RNA, 63 nt, Human
gcagugacuggucucauccaggacucucaugugagaaggaacaccuugcucuggucaggaaau

SEQ ID NO: 38130 - RNA, 63 nt, Human
uuaauugcuuucauagacauguaaagacacaccagaaggaaacccuaugaauguaagcaaugu

SEQ ID NO: 38131 - RNA, 63 nt, Human
gcacaaaugaaggaaauccuguguaaagcauugagaaggaaagaagccuggagcagccucucc

SEQ ID NO: 38132 - RNA, 63 nt, Human
guauaaacaaaaguuuuuuauuagcauucugaaagaaggaaaguaaaauguacaaguuuaaua

SEQ ID NO: 38133 - RNA, 63 nt, Human
auucuuccuugaagugcccgagcauguagggcaagaaggaaggcugaagcgcugucccuagga

SEQ ID NO: 38134 - RNA, 63 nt, Human
cuggauuggauucgguaaaaagaggggguugcuagaaggaaaaacaggugugaccugauccug

SEQ ID NO: 38135 - RNA, 63 nt, Human
cucauggaagagaugaacgccaugcuggcccggagaaggaaagccacgcaaguuggggagaaa

SEQ ID NO: 38136 - RNA, 63 nt, Human
cccauuaauuuuaggagcuucuggaagaggugaagaaggaauugcagaaagugaaagaggaaa

SEQ ID NO: 38137 - RNA, 63 nt, Human
aaagccaggaagagugacaaggcagguggggacagaaggaagaagccaggagccucccugaga

SEQ ID NO: 38138 - RNA, 63 nt, Human
ccagcagaccugcagccgaggggccucacuguuagaaggaaaacuaacaggaauauaaucaac

SEQ ID NO: 38139 - RNA, 63 nt, Human
ucaaaaucggcuucagugauugugggaggggcaagaaggaaaagaaacagcagcagguuugau

SEQ ID NO: 38140 - RNA, 63 nt, Human
aaagauuaugauaaacucagaaaauaaacacagagaaggaaucucauuuuucagucuuacaga

SEQ ID NO: 38141 - RNA, 63 nt, Human
gaaagaucaugauaaacucagaagaacaaacauagaaggaaugucauuuuuaaucuuuuuaaa

SEQ ID NO: 38142 - RNA, 63 nt, Human
auguuggcgaacugacaaacucugucugccgccagaaggaaugcugggggcagucauguccca

SEQ ID NO: 38143 - RNA, 63 nt, Human
auucaccuguggauuugugcgagaugcagccucagaaggaacaaggcccccagagggagguca

SEQ ID NO: 38144 - RNA, 63 nt, Human
gacucaagcgggggcucccggggucaguguucaagaaggaaagcaguuguugaagcuacagaa

SEQ ID NO: 38145 - RNA, 63 nt, Human
cggcgacagccuucccugagaggacuuaaaagcagaaggaaaccgagaugcuucccgcagccg

SEQ ID NO: 38146 - RNA, 63 nt, Human
ggggcugauuucccaccuagagagguugauggcagaaggaaaauggggaggcacugggguugu

SEQ ID NO: 38147 - RNA, 63 nt, Human
acaccgucuccacuuguggagagccacaggaagagaaggaagaccagcgcaugcccaguggga

SEQ ID NO: 38148 - RNA, 63 nt, Human
cagcaagauccugucuaaaaauaaaaagaaaagagaaggaaaggaaagagacggggcucugag

SEQ ID NO: 38149 - RNA, 63 nt, Human
uguccauguucuuggaaauacuuguguauguacagaaggaagggagggauuauuuuucuacaa

SEQ ID NO: 38150 - RNA, 63 nt, Human
gguuuuucuuuuuugaagaagucuaauaaaucuagaaggaauuagaggauuagaaaaaucacc

SEQ ID NO: 38151 - RNA, 63 nt, Human
cugauaccuuugugaaguugcccaccaaaacacagaaggaaaaaaacaugaauuucauugaac

SEQ ID NO: 38152 - RNA, 63 nt, Human
ugccaggaugggggcgucugcagaacuagauuaagaaggaagagucuguggauggaaauagga

SEQ ID NO: 38153 - RNA, 63 nt, Human
agaacuacaacaccgaaggaaaugaaagaagcaagaaggaaagcaccagaagugauuuggaag

SEQ ID NO: 38154 - RNA, 63 nt, Human
agaugauuauuuuugcuugaaucuuuuucuaagagaaggaaaagagcuggcauugugggaauu

SEQ ID NO: 38155 - RNA, 63 nt, Human
aguaagaggcgcugggcucggagccuguuuccaagaaggaauugguugucaucuggcaguguu

SEQ ID NO: 38156 - RNA, 63 nt, Human
aggaaaggcaguccuggacagaagacugucagcagaaggaaaguacuggacuacccgugggua

SEQ ID NO: 38157 - RNA, 63 nt, Human
auugaagacuccuuugagaaaagucuguuuugaagaaggaaaaagaaauacuguuugagagaa

SEQ ID NO: 38158 - RNA, 63 nt, Human
uucaggcucuucaaaagauguagaaaaagagauagaaggaaccaccuaugcuuaaaauacugu

SEQ ID NO: 38159 - RNA, 63 nt, Human
guaacaaaauucaaucaaaaaggcagcuaggucagaaggaaacauaccacucucaugguucau

SEQ ID NO: 38160 - RNA, 63 nt, Human
auguacuguuuuauggaauaaagucacuugaucagaaggaauugaaacaauagaucauuuugu

SEQ ID NO: 38161 - RNA, 63 nt, Human
acacugauagaccaagagguggccaggguucccagaaggaaggaacucaccuugaacuuagcu

SEQ ID NO: 38162 - RNA, 63 nt, Human
cuccuuuuggggacacccaaaacacugcuugugagaaggaagauggaagguaaguucugucgu

SEQ ID NO: 38163 - RNA, 63 nt, Human
agaagccguccaucaguccaaauggggguucugagaaggaaaguacccaacauuggcuucgga

SEQ ID NO: 38164 - RNA, 63 nt, Human
uccuccccaacuccccaaacacuguggaaggggagaaggaagugauccacagcauucaggcca

SEQ ID NO: 38165 - RNA, 63 nt, Human
cacugugcacagguuugagaggacaaguucaucagaaggaaggcaguccuuagaagucacaua

SEQ ID NO: 38166 - RNA, 63 nt, Human
ugaacauguuugugggccuuuugacugaguggcagaaggaaacugcucaggaagagaaacagg

SEQ ID NO: 38167 - RNA, 63 nt, Human
uuucuuuguucucagacuaauggaugguuccagagaaggaaaugaaaggugcuggguggggcc

SEQ ID NO: 38168 - RNA, 63 nt, Human
ugacuucuuccuccuccuccuucccugacucacagaaggaaugcaaucacccagcaaguccua

SEQ ID NO: 38169 - RNA, 63 nt, Human
gcucuugagccucugggaaugggaggggccaagagaaggaaaacccugucuuuagcacccuuu

SEQ ID NO: 38170 - RNA, 63 nt, Human
cucaggggaggcaggaagaaaggaaggaaggaaagaaggaagggaggacccaaucuauaggag

SEQ ID NO: 38171 - RNA, 52 nt, Human
aggaggaggagaggaagugaggagaaggaaggggaggacagacguucacacu

SEQ ID NO: 38172 - RNA, 63 nt, Human
cgucccggcaggcgagaggcgaggcugagcgaaagaaggaaggacagacggaccugucuguca

SEQ ID NO: 38173 - RNA, 63 nt, Human
ucuaaauccucuuauucuuuugguuugucacaaagaaggaacuaagaagcaggacagaggcaa

SEQ ID NO: 38174 - RNA, 63 nt, Human
accuugcacuucacacuucuugagucucguuucagaaggaaaaucauuugggauuccuacugc

SEQ ID NO: 38175 - RNA, 63 nt, Human
gcugcugcuucccaagauccucagcagggauuaagaaggaacccggugugcacagcagauccc

SEQ ID NO: 38176 - RNA, 63 nt, Human
gacacgguauccccucuggccagaguaugucagagaaggaagaguagggcuuuuuuguuuugu

SEQ ID NO: 38177 - RNA, 63 nt, Human
guggcaaguaaguuauagaagagaaaugcugcuagaaggaauuaagcguuguaguaaaugcgu

SEQ ID NO: 38178 - RNA, 63 nt, Human
ccacaugcaucuugaugcgaucgcacuuucugaagaaggaaggaucccaaaugccccuccagu

SEQ ID NO: 38179 - RNA, 56 nt, Human
ggcaggggccccaaagcuaggcucugagaaggaaacacacucggcugggcacagug

SEQ ID NO: 38180 - RNA, 63 nt, Human
auguaauuccuucacauuugggcagcauggacgagaaggaagaauuugcaaguuuggccuuua

SEQ ID NO: 38181 - RNA, 63 nt, Human
gguuuuuuaaaggauauuuaacuuuuauggacuagaaggaaucacgagggcuacugcacaaua

SEQ ID NO: 38182 - RNA, 63 nt, Human
accccagaagcagguggucugccccaggcauaaagaaggaaaauuggccaucuuucccaccuc

SEQ ID NO: 38183 - RNA, 63 nt, Human
guguguaguuuguggcaguuuuggccaaggagcagaaggaagacuacuugccuguucucagug

SEQ ID NO: 38184 - RNA, 63 nt, Human
uugagacugucucuuauccuaguauuugggaagagaaggaauaaauuugucaaaacuagguga

SEQ ID NO: 38185 - RNA, 63 nt, Human
ucugagaacuugauacugaaucguuuaugugggagaaggaaggaguaacauaaaacauguuuu

SEQ ID NO: 38186 - RNA, 63 nt, Human
acuuguuccccugcauccuggcaugucccuucaagaaggaaaaggugacaucaguugugacca

SEQ ID NO: 38187 - RNA, 63 nt, Human
cuauguaucgggaaccaugaucuauuuaugaggagaaggaaagccgauucuuuggaaguucag

SEQ ID NO: 38188 - RNA, 63 nt, Human
cccuggccugaauccagccuccgcuguggccauagaaggaauggagaacagggcugggcaugg

SEQ ID NO: 38189 - RNA, 63 nt, Human
ggcaagcagcuagacuggugaauugggggaaauagaaggaacuaguaacugagacuccuccag

SEQ ID NO: 38190 - RNA, 63 nt, Human
agagaaaccaacaagagaucucgaacccugucuagaaggaauguauuuguugcuaaauuucgu

SEQ ID NO: 38191 - RNA, 63 nt, Human
uauuuuuguaccauggggugggccccgggccugagaaggaagaagcacccucuccccggccuc

SEQ ID NO: 38192 - RNA, 63 nt, Human
gccugagugggcaaggaagcagguggaucccccagaaggaaccgcagcucgcgaggcaccucu

SEQ ID NO: 38193 - RNA, 63 nt, Human
ugagucccuugcucugacagagauggaucugcuagaaggaaccuggagagcaggacccauggc

SEQ ID NO: 38194 - RNA, 63 nt, Human
ggcaguauccuguuugaggaaagcaagaaucagagaaggaacauaccccuuacaaaugaaaaa

SEQ ID NO: 38195 - RNA, 63 nt, Human
aaauccccugagcacuaccugggucucauuccaagaaggaagagggucaggagaccuggggag

SEQ ID NO: 38196 - RNA, 63 nt, Human
guaucgguauuugauuuuuagugggcagaugggagaaggaaagguuauuuauucuauagaaga

SEQ ID NO: 38197 - RNA, 63 nt, Human
uuagcccaagacacucccagaggaaaacacugcagaaggaacugguuugcagacuguggaagg

SEQ ID NO: 38198 - RNA, 63 nt, Human
cacauguuagauaaauuuuugcaaguagaggaaagaaggaaauaaaacaucacauuuuggugu

SEQ ID NO: 38199 - RNA, 63 nt, Human
gucacuuagucuaacgcugacagaaaugaaugcagaaggaagauuuucaguccugaacgugaa

SEQ ID NO: 38200 - RNA, 63 nt, Human
ucagcguuggauaaaaugauugaugaggcaggcagaaggaauguagguuucaggugugucauu

SEQ ID NO: 38201 - RNA, 63 nt, Human
gguaucgcaaccaugagccuuaacauugccaucagaaggaaggaaucaggcaggugaaggcaa

SEQ ID NO: 38202 - RNA, 63 nt, Human
uccucaaaaucaguuuuuauauuccccaaaagaagaaggaaaccaaggaguagcuauauauuu

SEQ ID NO: 38203 - RNA, 63 nt, Human
uugccugcuugaggggcaccacuacuccagcccagaaggaaaggggggcagcucaguggcccc

SEQ ID NO: 38204 - RNA, 63 nt, Human
ggcuuugcuuuucaaaccagagaaaggaaagccagaaggaaaagaguaaugguauuuucuaga

SEQ ID NO: 38205 - RNA, 63 nt, Human
agagcuggccuuggucagcuuagggaugaauggagaaggaaucauucaugggccucggcuagg

SEQ ID NO: 38206 - RNA, 63 nt, Human
gccuaugcugcagggucacuuuuggcuggucagagaaggaauaaugauaucaccuucuucccc

SEQ ID NO: 38207 - RNA, 63 nt, Human
agacaugcucauuguaaaaaauguacacaaggcagaaggaaguaaaauuuccacaguucagaa

SEQ ID NO: 38208 - RNA, 63 nt, Human
aaacaaaguggaaggaaagaugcucagguacagagaaggaaugucuuugguccucuugccauc

SEQ ID NO: 38209 - RNA, 63 nt, Human
ugacaacccugugguuuccaaggagcugagaauagaaggaaacuagcuuacaugagaacagac

SEQ ID NO: 38210 - RNA, 63 nt, Human
gauguggagauguaaacacauguaggguuggugagaaggaaagaugagaacaaaagcaacauu

SEQ ID NO: 38211 - RNA, 55 nt, Human
auaugaagacauauaaaugagccucagaaggaaugcacuugggcuaaauauggau

SEQ ID NO: 38212 - RNA, 63 nt, Human
uugcuuuuauuuuaaccaucuuuuacuauuuuuagaaggaaacuagcuuuaguaguggguugc

SEQ ID NO: 38213 - RNA, 63 nt, Human
aaaagguuacacugugcaccgacauguggagcuagaaggaaaagcuuuuaagucucauguuug

SEQ ID NO: 38214 - RNA, 63 nt, Human
auuuugcccagcacauggagcuguaauccagagagaaggaaacguagaaauuuauuauuaaaa

SEQ ID NO: 38215 - RNA, 63 nt, Human
ccgcucagcaacauagaagagggaaggaaagagagaaggaaagagagagagaaagaaagucuc

SEQ ID NO: 38216 - RNA, 63 nt, Human
ggggugagaauaaugagauaucugaaaccagguagaaggaagccuagauuguaagauuuuaaa

SEQ ID NO: 38217 - RNA, 63 nt, Human
uuucuuuugcgugcagucuuugauucguacaauagaaggaacacguagaauguauauuuguac

SEQ ID NO: 38218 - RNA, 63 nt, Human
ccagccugggugacagagugagacucugucucaagaaggaaaaaaaaaaaaaagaauguacuc

SEQ ID NO: 38219 - RNA, 63 nt, Human
agggacggguaggaauuagccaguugaggaaguagaaggaauuuccagauauuggaaacagua

SEQ ID NO: 38220 - RNA, 63 nt, Human
uuuuuuuuguauaaaaauuuaaauugaauuaaaagaaggaaaaaaaaagcccaaacuuaaccu

SEQ ID NO: 38221 - RNA, 63 nt, Human
acaacagucaccucacaaaccugaauggucugaagaaggaaggccugagccccuuugccuguc

SEQ ID NO: 38222 - RNA, 63 nt, Human
aaggaaggagggaagaaaagaaagcaaaggaacagaaggaaggaaagaaagaugggaggaagu

SEQ ID NO: 38223 - RNA, 63 nt, Human
aggcggagaggggagaagaaggaagggaagggcagaaggaaggagggaagaaaagaaagcaaa

SEQ ID NO: 38224 - RNA, 63 nt, Human
ggcuuuuccuuugggggaggcggagaggggagaagaaggaagggaagggcagaaggaaggagg

SEQ ID NO: 38225 - RNA, 63 nt, Human
cugaccuuaguaaaguccuugacuaacugaacuagaaggaagguuuagccuucuaauuaguuc

SEQ ID NO: 38226 - RNA, 63 nt, Human
cucccccucuucuuucccauuuuaaaaaagaaaagaaggaaaaagaaaaaaggggcaaggagc

SEQ ID NO: 38227 - RNA, 63 nt, Human
guucagaaagaggaaugaagauguuguaugacaagaaggaaaguuacugagaacaaaaaccca

SEQ ID NO: 38228 - RNA, 63 nt, Human
cugagucaccuccuccacucacuccagcccaacagaaggaaggaggagggcgcccauucgucu

SEQ ID NO: 38229 - RNA, 63 nt, Human
aaagaagaccuguuuauacauugaaggaagaaaagaaggaagcaguugccuuccggagggggc

SEQ ID NO: 38230 - RNA, 63 nt, Human
aaaaaagguuacacugugcaccgacguggagcuagaaggaaaagcaugaagucucauguuugc

SEQ ID NO: 38231 - RNA, 63 nt, Human
cuuuuacacagcacaugaagcaguaauccagaaagaaggaaaugcagaauuuuauuaucaaag

SEQ ID NO: 38232 - RNA, 63 nt, Human
ucauuuucaggaaaguuuguaguauuacaaggcagaaggaaacacaguagcaaugguugcucu

SEQ ID NO: 38233 - RNA, 63 nt, Human
aaaagcuuccaugauucuauuuauauguacaugagaaggaacuuccagguguuacuguaauuc

SEQ ID NO: 38234 - RNA, 64 nt, Human
augcccgucucugucccaggcgggauggggcacagugcaggacacagccauguacaccaagaag

SEQ ID NO: 38235 - RNA, 64 nt, Human
auuugugguggacugcucagauaagcuugggcgugugcaggaguuugacaguggccugcugcac

SEQ ID NO: 38236 - RNA, 64 nt, Human
ccuuccggccugaaagcccucccugcaagaaggugugcaggagagaagaggccccggcaugggg

SEQ ID NO: 38237 - RNA, 64 nt, Human
gggauuuaaacuaagauaauauaugcacagugaugugcaggaacaacuuccuagauugcaagug

SEQ ID NO: 38238 - RNA, 64 nt, Human
cugguucuguguagauagagauggugucaaggaggugcaggauggagaugggagauuucaugga

SEQ ID NO: 38239 - RNA, 64 nt, Human
uuuguuuuguuuuuuccuucugaguuugcuguuggugcaggaauaagggaaaggcccaagguau

SEQ ID NO: 38240 - RNA, 64 nt, Human
ccaagugucauccggaggaggagguggcccguaugugcaggaccucagggugccagcccucacc

SEQ ID NO: 38241 - RNA, 64 nt, Human
aguccugcaggcuuccuaccaguggucuccaggggugcaggaguaacuggggcugggccagccu

SEQ ID NO: 38242 - RNA, 64 nt, Human
ggcgcgcgcacaggagccugacuccgcugggagagugcaggagcacgugcuguuuuuuauuugg

SEQ ID NO: 38243 - RNA, 64 nt, Human
gcccgcgguguacaauacccauauaagguacauugugcaggaggggaauugcuggcugcuuuua

SEQ ID NO: 38244 - RNA, 64 nt, Human
gaugacuggggagcuuggcagaaguucacggccagugcaggaauccagguaguggaggaugauc

SEQ ID NO: 38245 - RNA, 64 nt, Human
gggccgggcccugcuccccuggcagcagaagugggugcaggaagguggcagugaccagcgcccu

SEQ ID NO: 38246 - RNA, 64 nt, Human
ucggccacucagaugagggcuguggugcgagccagugcaggagagcugcgcuugggauugugcc

SEQ ID NO: 38247 - RNA, 64 nt, Human
ugcuccaucagaccucuuccauuuugcacagggagugcaggaggugaauguucacuuucuguuc

SEQ ID NO: 38248 - RNA, 64 nt, Human
cauggaggguacaauugccagcucccccgugucugugcaggauugucuggguugaaugacacuc

SEQ ID NO: 38249 - RNA, 64 nt, Human
ggggcuagaccucccaggcuaagccucagauucagugcaggacacaagcucaugcccccgucuu

SEQ ID NO: 38250 - RNA, 64 nt, Human
cuugcagauaaguuuauuauaauucuccagaaaugugcaggaugugcauuagcaaauugcacug

SEQ ID NO: 38251 - RNA, 64 nt, Human
acccucuucagccaggccucugugaccugcuagggugcaggaggcuuccagaagcaguuguugu

SEQ ID NO: 38252 - RNA, 64 nt, Human
ucacacucucaucucuuuccuuggcuggaaacaagugcaggaagcuccccucccaauuucuuau

SEQ ID NO: 38253 - RNA, 64 nt, Human
auucaugucacauauugaaauagcaaauagaaaugugcaggagcggagggacagcgacaccugg

SEQ ID NO: 38254 - RNA, 64 nt, Human
ucaugcuugagcuucccuguuugcacgcaugcgugugcaggacuggcugugugcuuggacucgg

SEQ ID NO: 38255 - RNA, 64 nt, Human
uggccagcaccaggagaggagucaggccgcgacugugcaggagaugacuuucccagcuuugcug

SEQ ID NO: 38256 - RNA, 64 nt, Human
aaaacaauuggcaaacuuuguauuaauguguuaagugcaggagacauugguauucugggcaccu

SEQ ID NO: 38257 - RNA, 64 nt, Human
ugccccuccccucauugagggucacugcucaagagugcaggaguggacucuccacugauggguc

SEQ ID NO: 38258 - RNA, 64 nt, Human
guucucacugaagacauggacuuuauauguucaagugcaggaauuggaaaguuggacuuguuuu

SEQ ID NO: 38259 - RNA, 64 nt, Human
uagcacuuaaucuguaaauugaauaauuuaucaagugcaggaauguguuaaucuaauggguuuu

SEQ ID NO: 38260 - RNA, 64 nt, Human
uugccugcuguccaggagcccgggagggaggggugugcaggagccgcagggccgugugggacga

SEQ ID NO: 38261 - RNA, 64 nt, Human
cuuugguuuuccuuuuuuguucugguggaagcaugugcaggagacauaucauccaaacauaaac

SEQ ID NO: 38262 - RNA, 64 nt, Human
caauuggcugccugcaaagccagcuggaggugaagugcaggaaaggaaaggucaccccauucua

SEQ ID NO: 38263 - RNA, 64 nt, Human
ggagcaaacuaggaaugaauuggguagcuagacugugcaggaauuguuggaaccuggagggaac

SEQ ID NO: 38264 - RNA, 64 nt, Human
cuauuugagaggcugaggugggaggaucauuugagugcaggaguucaaggacagccuggguaau

SEQ ID NO: 38265 - RNA, 64 nt, Human
ggagaaaaucugggcacauggggcccccugggcagugcaggacaacaucagcucacuggcagga

SEQ ID NO: 38266 - RNA, 64 nt, Human
aaugccagucaccacccugaacgcacaaucuccagugcaggaucuaaugacuguacauauuauu

SEQ ID NO: 38267 - RNA, 64 nt, Human
cucugucugggaaugagggaguuaaccaaguuuggugcaggagcaggggcagggggccacugua

SEQ ID NO: 38268 - RNA, 64 nt, Human
aacugagauccgaggagcuccugggaagcccugggugcaggacacuggucgagagccaaagguc

SEQ ID NO: 38269 - RNA, 64 nt, Human
accugaguuccgaggagcaccugggaagcucugggugcaggauagcaguccagaguccauggcc

SEQ ID NO: 38270 - RNA, 64 nt, Human
ccuguuaaggacgaggccuccccagcccugcccggugcaggagguggcucaguuauugaaccuu

SEQ ID NO: 38271 - RNA, 64 nt, Human
aaugcacuacaaaguuaagacagauuuuugcuaagugcaggaggcccuuuauuauugcugcaga

SEQ ID NO: 38272 - RNA, 64 nt, Human
cucagggacuugagguugcauuuuugagcauggggugcaggagccuuucuggauuuggaugugg

SEQ ID NO: 38273 - RNA, 64 nt, Human
aaguggcagcucagccaccacucagugcuucucugugcaggagccaguccugauuaauaugugg

SEQ ID NO: 38274 - RNA, 64 nt, Human
uuugagcccuaaaacaacagccuuuauguuuucagugcaggauuucuuggaauuucuugcuugu

SEQ ID NO: 38275 - RNA, 64 nt, Human
ggaaaaucucucagcuucauagaacggguaacuagugcaggauggggaaauguucacagacauc

SEQ ID NO: 38276 - RNA, 64 nt, Human
gcccugggguagugucagagcgggagugaggcuggugcaggagcaguucugcuauuuccaauca

SEQ ID NO: 38277 - RNA, 64 nt, Human
gccccguggagugcuggagaaaugcacuagcagagugcaggaucuguucugaaaggcagacgug

SEQ ID NO: 38278 - RNA, 64 nt, Human
cuuugccaguggaaggaguuccugcuaaggggaggugcaggaggacuaauuuauuauugugcaa

SEQ ID NO: 38279 - RNA, 64 nt, Human
uugccaaagcaaauauuucaaaaucaacugacuagugcaggaggcuguugauuggcucuugacu

SEQ ID NO: 38280 - RNA, 64 nt, Human
gggaggaggugguggccguggguuccugaugucggugcaggagcugaaggugaguggagugcug

SEQ ID NO: 38281 - RNA, 64 nt, Human
caacucaagugacuaggugggcccagcuggcuucgugcaggagggcacggugggugagccauuc

SEQ ID NO: 38282 - RNA, 64 nt, Human
uucagauaggaguuuagucuugacgaaaguguccgugcaggaauuggacuccgaggaggguuac

SEQ ID NO: 38283 - RNA, 64 nt, Human
agaauuaacuguauuuccugucaccuauucacuagugcaggaaauauacuugcuccaaauaagu

SEQ ID NO: 38284 - RNA, 64 nt, Human
gaucuuuuuuuuugucguagauuugucuguaaaagugcaggaacaguuauucuaugagaacacu

SEQ ID NO: 38285 - RNA, 64 nt, Human
cuguaaugaaucaaaguuuaauggauuuagggcugugcaggaugugccuuguuaacaauauguu

SEQ ID NO: 38286 - RNA, 64 nt, Human
aacuuccugagugucuaaagaagaugaggaaggugugcaggaagaaaacucccuugggagaacg

SEQ ID NO: 38287 - RNA, 64 nt, Human
ggguaauauaaguaaucuagugaugauuuaaacugugcaggaggauguggguagguuauaugca

SEQ ID NO: 38288 - RNA, 64 nt, Human
agaaaauacaugcccaugaccaaauauucaaauugugcaggacaguaaauaaugaaaaccaaau

SEQ ID NO: 38289 - RNA, 64 nt, Human
guccuccaauuccagcauucacagcugaugagcagugcaggagcagggcgagaggaacagagcc

SEQ ID NO: 38290 - RNA, 64 nt, Human
gcagccuguguugcucucuaccuggcagcagacugugcaggagccccaaccuguccuccaauuc

SEQ ID NO: 38291 - RNA, 64 nt, Human
guaagaauuagguggaauuuuuuccuucaaccaagugcaggaaagcccugugugucuugguuua

SEQ ID NO: 38292 - RNA, 64 nt, Human
uuuaugccugccauacccgcuaaugcuccucgaggugcaggagcagguugcugagccaguggcu

SEQ ID NO: 38293 - RNA, 64 nt, Human
cggccgggcagaggugcuccucacuucccagagggugcaggagccagcucugacuaguaaauuu

SEQ ID NO: 38294 - RNA, 64 nt, Human
ggucuucccaggaagagggccugagguucuccuagugcaggaacguugaauauuggcaaugauu

SEQ ID NO: 38295 - RNA, 64 nt, Human
ucuucaauccuuuucauacuacuuaaugauuuuggugcaggaaccugagauuuucugauuuaua

SEQ ID NO: 38296 - RNA, 64 nt, Human
ucaucagcccuccaucuaaugugauugcuaagaugugcaggauaggacagcuuagaaugagugc

SEQ ID NO: 38297 - RNA, 64 nt, Human
gaaaauauugcaaacacauuaaaacaguuguauggugcaggaaaagaagauuggaaaaagacca

SEQ ID NO: 38298 - RNA, 64 nt, Human
agcauugcagaaagguggucagaugaccaguguagugcaggaaacagcccugucucaacuaaug

SEQ ID NO: 38299 - RNA, 64 nt, Human
aaaagaaaaagaaaaaaaucccuuguucucaguggugcaggauguuggcuuggggcaacagauu

SEQ ID NO: 38300 - RNA, 64 nt, Human
ugaauaacuaugccagcaaccuuguaagcuaucugugcaggauauuugcacuauuuccacaugg

SEQ ID NO: 38301 - RNA, 64 nt, Human
caguuuccuuccugugucgaugucgauguugucugugcaggagaugcaguuuuuguguagagaa

SEQ ID NO: 38302 - RNA, 64 nt, Human
uaccacucaaggaaggaagucaccaguggccuuagugcaggaaacucagcccugguggcccugc

SEQ ID NO: 38303 - RNA, 64 nt, Human
uuaauucagaaaucaaaucugcaggccaaacaaggugcaggacccagcuuuggccccaugcccc

SEQ ID NO: 38304 - RNA, 64 nt, Human
gaagugcucugccucauucccuguucguaggaaggugcaggagaggaggugggcaagcuuaugg

SEQ ID NO: 38305 - RNA, 64 nt, Human
ggggaaacucauuuuccccugcagcucccccaaggugcaggagggcaggauccagcagcacugg

SEQ ID NO: 38306 - RNA, 64 nt, Human
gguauucucuucaccugaggcuuuccguccgccagugcaggaacccggugcucgcugggcuuuu

SEQ ID NO: 38307 - RNA, 64 nt, Human
aagacgcccccgcacggggaggguugggaagggggugcaggaagcucaaccccucugggcacca

SEQ ID NO: 38308 - RNA, 64 nt, Human
uuuuuauaacucuggauuaccgaugcugagaugugugcaggaauacuuccaaauaaauuuuuaa

SEQ ID NO: 38309 - RNA, 64 nt, Human
uuugaacagcauuguacauaacuuggggguaugugugcaggauuacccaagaauaacuuaagua

SEQ ID NO: 38310 - RNA, 64 nt, Human
ucaacaacaguuaccucauugaguguguccaguagugcaggaaaugaugucuuaucuaaugauu

SEQ ID NO: 38311 - RNA, 64 nt, Human
uauuguauauuuuuuucuuaauguuuaaggaaaugugcaggauacuacaugcuuuuuguaucac

SEQ ID NO: 38312 - RNA, 64 nt, Human
auuuagcccuggggcauggagcugaacaguacuugugcaggauuguuguggcuacuagagaaca

SEQ ID NO: 38313 - RNA, 64 nt, Human
uuguuuaggaucaggccccucuccugggccugcugugcaggagcacaggaacuaucugcuggcg

SEQ ID NO: 38314 - RNA, 64 nt, Human
caaaaguauuaaugaguauuuccuuucuccauaagugcaggacuguuacucacuacuaaacucu

SEQ ID NO: 38315 - RNA, 64 nt, Human
agauccaggucuggagcuggagagaacaggcccugugcaggaccagaaguaauuauacuaaagu

SEQ ID NO: 38316 - RNA, 64 nt, Human
cuguuuugaggcaaaggggaguaguucuugguaggugcaggaauaguagugucauuuggaauac

SEQ ID NO: 38317 - RNA, 64 nt, Human
gccuuaaggaauaagaggaaaauuauguuaugaagugcaggaacagcacagacccagacgaggg

SEQ ID NO: 38318 - RNA, 64 nt, Human
aagucauacuuugcguuaggugugcugguuggaugugcaggaacuucagcaagcaguagguuuu

SEQ ID NO: 38319 - RNA, 64 nt, Human
acacaugggaggaaaaccuuauauacugagcauugugcaggacugauagcucuucuuuauugac

SEQ ID NO: 38320 - RNA, 64 nt, Human
cagagcucccaagccggaguucacagucaucacugugcaggacccagguuccucccagaccuga

SEQ ID NO: 38321 - RNA, 64 nt, Human
aggggcuugcggccgugucucugaccugugugaugugcaggagggucucauugacucagcgccu

SEQ ID NO: 38322 - RNA, 64 nt, Human
ccugccuaaagcuugggcugugccugcaaagcuugugcaggaccugggggccaggucgaccuuc

SEQ ID NO: 38323 - RNA, 64 nt, Human
uuuugauccuccuggcacuccagaccugggugaugugcaggagagcacacugauagaaauccuu

SEQ ID NO: 38324 - RNA, 64 nt, Human
aguuucagggaaaguugguggcugauuuaaaguugugcaggaaacaucuucuguguaugaagca

SEQ ID NO: 38325 - RNA, 64 nt, Human
gaaaaucaaccagcaggaaaguacagaugcagccgugcaggagccgagccaguaagucacaggu

SEQ ID NO: 38326 - RNA, 64 nt, Human
cagauacuuggcugacggugaaccgcauggaacagugcaggacggaauauagaggagcacuauu

SEQ ID NO: 38327 - RNA, 64 nt, Human
ucaugacugaugcacaaauuuuaaugauuaaaaagugcaggagcccuaaaugucagugcagcag

SEQ ID NO: 38328 - RNA, 64 nt, Human
ggccaagaagggucacccuugaggacaaaccucugugcaggaccuuggccagaguggggagggu

SEQ ID NO: 38329 - RNA, 64 nt, Human
auccucuuguuauuagugugucuuguucugcacagugcaggagacuuuauuccuuuggaaaauu

SEQ ID NO: 38330 - RNA, 64 nt, Human
ggguuagauuucauuggcagagagauuagccacugugcaggaguagggaggaaaaggaguucug

SEQ ID NO: 38331 - RNA, 64 nt, Human
cugacccccgaaccacccaaccacauccauaggggugcaggacccuaaguagacuggguagaaa

SEQ ID NO: 38332 - RNA, 64 nt, Human
ccucccauuagccagggcggagacugucugagcugugcaggaggaggguugcuaguagguucug

SEQ ID NO: 38333 - RNA, 64 nt, Human
ugucaucugccacuuucgggaggguggauccacugugcaggaguggccggggaagcuggcagca

SEQ ID NO: 38334 - RNA, 64 nt, Human
cuauuaauaaguuagcaaggaaaguguaugucacgugcaggaacagugaggcagggacaggggu

SEQ ID NO: 38335 - RNA, 64 nt, Human
gaggaugugugcuagagugugggacccuggccaagugcaggaaugggccaugccgucucaccca

SEQ ID NO: 38336 - RNA, 64 nt, Human
ggccgccccuggccaccuuguccuggcucgcagggugcaggagcgccucguucucuggguggcc

SEQ ID NO: 38337 - RNA, 64 nt, Human
gcucuauggauuuaaaugcaaacuucauuuaccagugcaggaagucucauaaaacucagaugua

SEQ ID NO: 38338 - RNA, 64 nt, Human
ccauggcccuggaccugccauccucccacuugcagugcaggaucccacugcugccaaagagaug

SEQ ID NO: 38339 - RNA, 64 nt, Human
cugccuccuggucuuugccuuugcugggccuucugugcaggacgcucagccucagggcucagaa

SEQ ID NO: 38340 - RNA, 64 nt, Human
cugccuccuagucuuugccuuugcugggccuucugugcaggagacuuggucucaaagcucagag

SEQ ID NO: 38341 - RNA, 64 nt, Human
aaaaaaagaguuucuggcugaugggugacucagagugcaggacugccuggccguggggcagagg

SEQ ID NO: 38342 - RNA, 64 nt, Human
gagaaugagcagcuuugacuuugacaggcgguuugugcaggaaagcacagugccguguuguuua

SEQ ID NO: 38343 - RNA, 64 nt, Human
caugcguguguauaagcccaccugaguggggcucgugcaggagaacugaggcaugaaacucugg

SEQ ID NO: 38344 - RNA, 64 nt, Human
gcagcuccaaccgacgugcucauagugaucagcugugcaggagccaugaggcaccaaccucucc

SEQ ID NO: 38345 - RNA, 64 nt, Human
ugcccgggguggggugcacucgccauuuccucacgugcaggacagcucuugauuuggguggaaa

SEQ ID NO: 38346 - RNA, 64 nt, Human
acauccuacugacacuguccuauggagaguuacagugcaggaaaccugaacccagcucucaggu

SEQ ID NO: 38347 - RNA, 64 nt, Human
gaucccucuaggucacugagaaaugccacagaaugugcaggaagccugggaggcuucugugagg

SEQ ID NO: 38348 - RNA, 64 nt, Human
acccccgcucucucucucuuggccugagaucucugugcaggaaccaagauggggcugaagccuc

SEQ ID NO: 38349 - RNA, 64 nt, Human
uuggugcuucagagccuuugaagaugagaagagagugcaggagggcugggggccauggaggaaa

SEQ ID NO: 38350 - RNA, 64 nt, Human
ccccucccccagccaugccagcuggccuuuguaagugcaggaaaccgaguagaaaaugugaccc

SEQ ID NO: 38351 - RNA, 64 nt, Human
ucagagacuggugggaggaagccuggggaguggggugcaggaaaagccagagaagccgguggag

SEQ ID NO: 38352 - RNA, 64 nt, Human
gcaccagcagggaugccacaggagugcccacagggugcaggacuccacugaugagagauccagc

SEQ ID NO: 38353 - RNA, 64 nt, Human
ugcuggacagacuugaaggugucaugcccggugugugcaggaggaaacuaacaguucaguaaac

SEQ ID NO: 38354 - RNA, 64 nt, Human
guccagaaaaaagguguguucuucauaagcuucagugcaggauuuuucaaagacgagcuguugu

SEQ ID NO: 38355 - RNA, 64 nt, Human
gggggaguccguggcgaugggcgcugggguggaggugcaggagccccaggaccugcuuuucaaa

SEQ ID NO: 38356 - RNA, 64 nt, Human
auggucuccugucuaaguuggaaauauuaugcaugugcaggacuauucgaguauuuuauaaaca

SEQ ID NO: 38357 - RNA, 64 nt, Human
uacuucaugccuuucucagcaggaaaacgaauuugugcaggagaaggacuugcccgcauggagc

SEQ ID NO: 38358 - RNA, 64 nt, Human
uccucccuugcccacggucuuggagccccacugggugcaggagcugcuggcugucccuguggac

SEQ ID NO: 38359 - RNA, 64 nt, Human
cagcugacaacccaacuggacaaugaucugucuggugcaggagaaggcaaaaguuucuacaagu

SEQ ID NO: 38360 - RNA, 64 nt, Human
uuauuucuuaaaagccuuuuuugccuguuguaaugugcaggacccuucuccuuucaugggagag

SEQ ID NO: 38361 - RNA, 64 nt, Human
ucuuucauaucuuugccuaaauucauuugcuacagugcaggaaccaaaacuuguucaucucaug

SEQ ID NO: 38362 - RNA, 64 nt, Human
cgaugccacacaaagguuguucagggagaagggggugcaggaggcagagggugccccgcaggga

SEQ ID NO: 38363 - RNA, 63 nt, Human
uguccaaggaugauauguagcucccaccccagagugcaggaucauagggacagcgggggccag

SEQ ID NO: 38364 - RNA, 64 nt, Human
aguuccaugaacaccauaccuuugcuacuacuaugugcaggaacccuuggucacaugugacaug

SEQ ID NO: 38365 - RNA, 64 nt, Human
ucugaccuuuuuucccaaagggacuuaagcgauugugcaggaguaggagacaaaauguacacuc

SEQ ID NO: 38366 - RNA, 64 nt, Human
accuggccucacgcuggguaagcuuaagguagaggugcaggauuagcaagcccaccuggcuacc

SEQ ID NO: 38367 - RNA, 64 nt, Human
caaagcaaguuuuuucuggucugagacuuacugugugcaggaagucucgugagaauauacuuag

SEQ ID NO: 38368 - RNA, 64 nt, Human
auuacuauuuucuuccuucccagcucuucaggcagugcaggacaacccagcuaugcccacaugc

SEQ ID NO: 38369 - RNA, 64 nt, Human
aaaguggccuguuggguggaggguggaagguccugugcaggacagggaggccaccaaaggggcu

SEQ ID NO: 38370 - RNA, 64 nt, Human
gacucggggagcagggaggggggaagagacgugugugcaggaaacggggacguggggaggggac

SEQ ID NO: 38371 - RNA, 64 nt, Human
guauuuccuaucaagggugaaagugaugaugguggugcaggagggugacaauaaaauccuagug

SEQ ID NO: 38372 - RNA, 64 nt, Human
cacaaaggagaugguguggcuuagcaaggaaacagugcaggaaauguagguuaccaacuaagca

SEQ ID NO: 38373 - RNA, 64 nt, Human
ggauggcauuguccugcagucguauaguauagcagugcaggaacaaacagcacuugccagcaaa

SEQ ID NO: 38374 - RNA, 64 nt, Human
ccauuuccucccgccagucuccauugaaucaauggugcaggacagaaagccagucagacuaauu

SEQ ID NO: 38375 - RNA, 64 nt, Human
ugauuaaagcggggcucccugcccgugaggcccggugcaggaccgauguacaaaacagcagcaa

SEQ ID NO: 38376 - RNA, 64 nt, Human
uccacauugauuaaagcugcuguauagauuuagggugcaggacuuaauaauaguauaguuauug

SEQ ID NO: 38377 - RNA, 64 nt, Human
cacucaggguuccccagcagcuccuguguguugugugcaggaucuguuugcccacucggcccag

SEQ ID NO: 38378 - RNA, 64 nt, Human
auuguuugauacauuuuuauuugauaaacauucagugcaggaaacugugauuugcuauauguuu

SEQ ID NO: 38379 - RNA, 64 nt, Human
gcuuagcccaggugcuucguaacugcaaucggaagugcaggagcuggucagagccaaugagaag

SEQ ID NO: 38380 - RNA, 64 nt, Human
cucaacuggcuagcaaaugcccagccuucagagugugcaggaauguuuucaaaucccucaucag

SEQ ID NO: 38381 - RNA, 64 nt, Human
uacagcuauugauguaacuauagcugcaauuuuugugcaggacugagaaacacagugcauuauu

SEQ ID NO: 38382 - RNA, 64 nt, Human
aagacagagacauuugaacagggccuugaagggugugcaggaguucgccagcaaagccaggcag

SEQ ID NO: 38383 - RNA, 64 nt, Human
gcuuuuuuuuuuuuuuuuuaacaauggugugcaugugcaggaaaugacaaauuuguaugucaga

SEQ ID NO: 38384 - RNA, 64 nt, Human
uccaggcugccccugggacaugguggugaugugggugcaggagccagugucuguugucgggacu

SEQ ID NO: 38385 - RNA, 64 nt, Human
ugcuugaaacguuugccccaugggaaacguaugugugcaggagccucccugcacggcccaaggg

SEQ ID NO: 38386 - RNA, 64 nt, Human
ccugguugaaaugcuuaacuagagucaauuagaugugcaggaguaaguaguauaagaagaauca

SEQ ID NO: 38387 - RNA, 64 nt, Human
cauggggaggcacucgcuguuaucaaauagcgaugugcaggaagaaaagccccucuucauuccg

SEQ ID NO: 38388 - RNA, 64 nt, Human
ucacaggcgugccuugcugccccccugcagcacugugcaggacguggaccagcuggagcugcug

SEQ ID NO: 38389 - RNA, 64 nt, Human
uguggaggagugugugaggaccaggcgaaggaaggugcaggagcuccagucucuaggcuuuggg

SEQ ID NO: 38390 - RNA, 64 nt, Human
cacugcugcaaaagagacaagucugcauuuauuugugcaggaaaccagccauuuaauuguucua

SEQ ID NO: 38391 - RNA, 64 nt, Human
augaaauagccugcagcuauuaagaagcacgugugugcaggaagcggaggcgcaggaccucacc

SEQ ID NO: 38392 - RNA, 64 nt, Human
ugcaacgugcacgagggcgugugucaguggcugugugcaggagugugagugagcaagagcaaga

SEQ ID NO: 38393 - RNA, 64 nt, Human
agcagcccaggccgggccgcaagcuguuuccagagugcaggagccaagugcucggggacccuuu

SEQ ID NO: 38394 - RNA, 64 nt, Human
cacauagaucccgugcaggagccacauggguccugugcaggaccccuagcaguggugggcugag

SEQ ID NO: 38395 - RNA, 64 nt, Human
cgaagaucgagcucagguucgccacauagaucccgugcaggagccacauggguccugugcagga

SEQ ID NO: 38396 - RNA, 64 nt, Human
ccugacuuuauucccaggccccacaccgaggcaggugcaggauucgccauggugcagccuccgg

SEQ ID NO: 38397 - RNA, 64 nt, Human
acagaagaggaaaguggccugcucuggcaggugugugcaggauagaguguguuucauuuguucu

SEQ ID NO: 38398 - RNA, 64 nt, Human
ucuuuguucacuugaggcuuuccccagcuggugugugcaggacaguucaugguaauguugcccu

SEQ ID NO: 38399 - RNA, 64 nt, Human
gggcauguagaguauaugaggaggcaguauggcugugcaggagccuucauuucagcuucaauua

SEQ ID NO: 38400 - RNA, 64 nt, Human
uuguuuugugggucauagggagcacauuucaccugugcaggaaaagaguuuucugccgucuuuu

SEQ ID NO: 38401 - RNA, 64 nt, Human
cucuggccucccccaucaguuugcaggagcaggggugcaggauccuguucugagcugggucaaa

SEQ ID NO: 38402 - RNA, 64 nt, Human
acagaagaggaaaguggccugcucuggcagguaugugcaggauacaguguguuucaucuguucc

SEQ ID NO: 38403 - RNA, 64 nt, Human
cuagucuguucuucccggacaucuucugguagccgugcaggagagggcuggguggggcagaggc

SEQ ID NO: 38404 - RNA, 64 nt, Human
guccuagucccaguuguauucucacagguguuaugugcaggacacaauccaaaucauaaaccug

SEQ ID NO: 38405 - RNA, 64 nt, Human
agccucccggagcucugagcacgccccacgcauggugcaggagggacuggacagaucugaggaa

SEQ ID NO: 38406 - RNA, 64 nt, Human
cuagggaauaauguauauuaucuucaagaagugugugcaggaaugauugguucuuagaaaucuc

SEQ ID NO: 38407 - RNA, 64 nt, Human
uuguuagaagaaaguauauucuuucuagaauuuggugcaggaauauguguucauauccaggcaa

SEQ ID NO: 38408 - RNA, 64 nt, Human
ugugcacaucuugcugguggaggcauggcccacugugcaggaccccacccucgggggcuuucgg

SEQ ID NO: 38409 - RNA, 64 nt, Human
guaucccggaaaucuaucuggacccuggacugcagugcaggagaugacagagugaggagggccc

SEQ ID NO: 38410 - RNA, 64 nt, Human
caugcugaggcugcaguggugucguggguguuacgugcaggaacguggagacccugacgugggc

SEQ ID NO: 38411 - RNA, 64 nt, Human
cagccaagagcugaguauauaaaggagagggaaugugcaggaacagaggcgucuuccuggguuu

SEQ ID NO: 38412 - RNA, 64 nt, Human
ucuucugaaucucaugccuuuggcaccuugguaggugcaggaggagcucagugcaaaaaucacu

SEQ ID NO: 38413 - RNA, 64 nt, Human
acccugguucaggcccagagguccaagcuauacugugcaggacauggccaggccugguggacac

SEQ ID NO: 38414 - RNA, 64 nt, Human
cugucguaauuucuggagaacuccagguuugugugugcaggauguuggcacaaaaauaccugug

SEQ ID NO: 38415 - RNA, 64 nt, Human
ugggaccagccugugaccucucagucagacuggggugcaggaccuguccaccucaaugaaggag

SEQ ID NO: 38416 - RNA, 64 nt, Human
caccaagacccaccaaaaccaucucuggggcuuggugcaggacucugaauuucuaacaaugccc

SEQ ID NO: 38417 - RNA, 64 nt, Human
gacagccugggggggccgcucucccccugcagccgugcaggacucuagcucaugaguggaaagu

SEQ ID NO: 38418 - RNA, 64 nt, Human
cgugcccugggaagguguccacagugagcccugugugcaggacuguccacacgguucacaccuu

SEQ ID NO: 38419 - RNA, 64 nt, Human
accugccccccgcgccagcccagccccagccugagugcaggagcugcaggacccgcgggggcuu

SEQ ID NO: 38420 - RNA, 64 nt, Human
agguaccuuuccacugccuccucccugcucuccugugcaggaaugucucugagcuguucacguu

SEQ ID NO: 38421 - RNA, 64 nt, Human
cacacgugagcaucgugcauguggccccucugcagugcaggagucacugauugaugggugugcc

SEQ ID NO: 38422 - RNA, 64 nt, Human
acaaauagaccgucuggugucacagagcccgcgugugcaggagccugcuccuccgagauacgug

SEQ ID NO: 38423 - RNA, 64 nt, Human
ugaugacugaacugcacaaagugaggggaacagggugcaggagagggaucucuaguuuuugugg

SEQ ID NO: 38424 - RNA, 64 nt, Human
aaucuccuauugcuugucagccugugugcguguggugcaggaaauaaaggaucuauacccuccu

SEQ ID NO: 38425 - RNA, 50 nt, Human
ggacagccagccagcgcugagugcaggaaggaccccaggucuucccugga

SEQ ID NO: 38426 - RNA, 64 nt, Human
gauauuucucugucuguugauuuuaauucuaaaugugcaggaugcugccagaaacuccaaugua

SEQ ID NO: 38427 - RNA, 64 nt, Human
ugcauggccgggagcgcauccacggcugccccgugugcaggaaggccuucaagcgcgccacgca

SEQ ID NO: 38428 - RNA, 64 nt, Human
ggagcugagccggacccuccaccuggaggagguggugcaggaggccgccggcgaguggcaggcc

SEQ ID NO: 38429 - RNA, 64 nt, Human
gugagugugagugugcggcugugugugcacgcgugugcaggagcggcagauggggagacaacgu

SEQ ID NO: 38430 - RNA, 64 nt, Human
aaaacucaggcugccauagguucugcgaugagaggugcaggaggcaggagccuggcccaggggg

SEQ ID NO: 38431 - RNA, 64 nt, Human
gccagcgagcccuacagagugaggacacugaagugugcaggagcgaagguuaacaguaggggag

SEQ ID NO: 38432 - RNA, 64 nt, Human
uggcaccaguugucugaggucacauugcaagugagugcaggagugagauuaucgaaaauuauaa

SEQ ID NO: 38433 - RNA, 64 nt, Human
cucuguggcugguaggacucacccaugauauggggugcaggaacucugggggcccugaaggauu

SEQ ID NO: 38434 - RNA, 64 nt, Human
gcuggggucaucaggguacuuucaagaagggcucgugcaggacaucaaacagccuccgggccug

SEQ ID NO: 38435 - RNA, 64 nt, Human
guaucuuuacuauguugggucuuguaguucaugagugcaggaguaggccucuuaauuuauaaua

SEQ ID NO: 38436 - RNA, 64 nt, Human
cccuccugcccucagcuuggguuugggggccucagugcaggacaucuggccugaacaucgacug

SEQ ID NO: 38437 - RNA, 64 nt, Human
ucagagcaucgcugggccugcgccagagugaggggugcaggaagacaaagacgcgugcucacuu

SEQ ID NO: 38438 - RNA, 64 nt, Human
auugaagccuccuccuaggcuccaggaggagcaugugcaggaaggguuggccugagccagagcc

SEQ ID NO: 38439 - RNA, 64 nt, Human
ggucaucucccacugccugggggagucagauggggugcaggaaucuggcucuucagccaucuca

SEQ ID NO: 38440 - RNA, 64 nt, Human
augugcauccgugaaugcucccuugaauguggcugugcaggauucaggguuugcagaaauucuc

SEQ ID NO: 38441 - RNA, 64 nt, Human
cugugagaucacaaagugaagaugaacccuuucugugcaggagcagagccaggugggcccugga

SEQ ID NO: 38442 - RNA, 64 nt, Human
gcugagaauaucaaggggaagaagcaugggucaggugcaggaagaugucugggugucuguagaa

SEQ ID NO: 38443 - RNA, 64 nt, Human
auucaaaagacugccccucgagauuuuggaauucgugcaggaagccaugaaaggaaagaucagu

SEQ ID NO: 38444 - RNA, 64 nt, Human
cgacgaucuuccuggcuccaacacugcugcuccagugcaggagacuuuacauggaugccaaccg

SEQ ID NO: 38445 - RNA, 64 nt, Human
cacccaggaggauggcaaagagagucgcaucucagugcaggagagacagugaggcugcacccac

SEQ ID NO: 38446 - RNA, 64 nt, Human
ucuaaaugcuggucuaggagcugucuccaggauggugcaggauggcuuugcggaaaggagaugg

SEQ ID NO: 38447 - RNA, 64 nt, Human
uuuucaaucccacugcagugagaaggcaaccaaagugcaggacaucaaaaacaaccugaaagag

SEQ ID NO: 38448 - RNA, 64 nt, Human
agucacagaaaaugaccaacugauggggccuggagugcaggaggggcagcuccucugcauggcu

SEQ ID NO: 38449 - RNA, 64 nt, Human
gaugaaacagaucacugugcuguccuuccuaggggugcaggaaguggacagggcggaggguuug

SEQ ID NO: 38450 - RNA, 64 nt, Human
gccucaugucuccugugggcuuuuuaccaccacugugcaggagaacagacagaggaaauguguc

SEQ ID NO: 38451 - RNA, 64 nt, Human
ucggcuucucuucgcagccaucaggacuagguuugugcaggaaggugaugcccacuggaacucu

SEQ ID NO: 38452 - RNA, 64 nt, Human
aauauuuuauuuuauuuuacguuccgggauacaugugcaggaccugcagguuuguuacauaggu

SEQ ID NO: 38453 - RNA, 64 nt, Human
gauuuauguauuaggccacuuacuugguuggcaagugcaggaacucaguuaaaaugcaguugaa

SEQ ID NO: 38454 - RNA, 64 nt, Human
acuccaccagcaacuccacccgaccccagcaguggugcaggacagcugccagcacccaccuggc

SEQ ID NO: 38455 - RNA, 64 nt, Human
ggagcuguggugcagagaacuuuucccgcaacaggugcaggacugccagggaucggagugcggg

SEQ ID NO: 38456 - RNA, 64 nt, Human
caugacucugagucacgugcugcuguauugcaacgugcaggaccauuuuaaaccugugugcuaa

SEQ ID NO: 38457 - RNA, 64 nt, Human
ccacgcgcuucccugggguuuacugaggugaugggugcaggaaagguucacaaauguggagugu

SEQ ID NO: 38458 - RNA, 64 nt, Human
ucuugugcguacucauucauucuaaggggagucggugcaggaugccgcuucugcuuuggggcca

SEQ ID NO: 38459 - RNA, 64 nt, Human
gugguauccaguuaacucaaaaccaacacacagagugcaggaaaagacaauuagaaacuauuuu

SEQ ID NO: 38460 - RNA, 64 nt, Human
cuuucuccucccugacagcuacaccuuccagcaggugcaggagcacacggaccagauuuggaag

SEQ ID NO: 38461 - RNA, 64 nt, Human
gggucuggauuuccaagaaagcggagaccucgaggugcaggacugucggggcgagguggccgag

SEQ ID NO: 38462 - RNA, 64 nt, Human
uuuaaaagcaaaggcugaagagcagagagcccacgugcaggaguucuuugcuuccuccagagac

SEQ ID NO: 38463 - RNA, 64 nt, Human
caggucgcuggagugcaccagucuuggggaagaggugcaggagaagcuguguuuuuuaucucca

SEQ ID NO: 38464 - RNA, 64 nt, Human
gacccaguuacuugaggguagggaggcgggcccagugcaggaggcugcaucccuggccugcugg

SEQ ID NO: 38465 - RNA, 64 nt, Human
augcagcgcugacuucuuaggucagggcggaggugugcaggagcccaguuacgaacucaccccu

SEQ ID NO: 38466 - RNA, 64 nt, Human
cuuguuuuccuucgcuuagcaccuaggaagucgugugcaggagccagcagggcgccaaguggcc

SEQ ID NO: 38467 - RNA, 64 nt, Human
aaaauccgucaguauucacuggaccucaggcccugugcaggagugcgauccgggcugggccgcu

SEQ ID NO: 38468 - RNA, 64 nt, Human
ugccugugaacucugaagucacuaguccagcugggugcaggaggacuucaaguguguggacgaa

SEQ ID NO: 38469 - RNA, 64 nt, Human
uguguguguguguguguguguguguguguguguggugcaggagugccacccccagggcccuguc

SEQ ID NO: 38470 - RNA, 64 nt, Human
ugaggcaggauaaguauuuuuacauauuuuaagggugcaggaggacagcagcuaacaaggccag

SEQ ID NO: 38471 - RNA, 64 nt, Human
cccccccagugggcaggagcccaugcagacacuggugcaggacagcccacccuccuacagcuag

SEQ ID NO: 38472 - RNA, 64 nt, Human
acgaauauauuggggggaggaauagaggggaggugugcaggaaccagcaaugagaaggccagga

SEQ ID NO: 38473 - RNA, 64 nt, Human
agacauagacgggugcagaagcggggagcuccaggugcaggagggcaccggccggggcccacgc

SEQ ID NO: 38474 - RNA, 64 nt, Human
aaaaaggugcagaaggcaaucuuaaaacagaaaggugcaggagguaccuuaacucaccccucag

SEQ ID NO: 38475 - RNA, 64 nt, Human
auuaaguaguaauguggggaaacccacugugucagugcaggaagcccuagacaaauguuuucaa

SEQ ID NO: 38476 - RNA, 64 nt, Human
ggaagggcagacugcaaacuggggggcugcguacgugcaggaggcgcgguggggcugcguggag

SEQ ID NO: 38477 - RNA, 64 nt, Human
uuuaugucauuuucagauccuuccaaacucucuagugcaggaaaaggcugcagcuaauuuguga

SEQ ID NO: 38478 - RNA, 64 nt, Human
ccccguuggugagaggugcuaucccugagucucagugcaggaccaguggaugaaaggcaaggua

SEQ ID NO: 38479 - RNA, 64 nt, Human
ugcucagaggcccggacucuccuaugugacuuuagugcaggaagaacuucugucaaucauggac

SEQ ID NO: 38480 - RNA, 64 nt, Human
gagggcugccacaggcagaggaaaugaagcacuggugcaggagauuucagagugagagugcuca

SEQ ID NO: 38481 - RNA, 64 nt, Human
gggcaaauaaaauguuguugucuuauugacaguugugcaggagguagccuggugguuuucaacc

SEQ ID NO: 38482 - RNA, 64 nt, Human
uggggagcccaggaagcugcucacccaagauuuggugcaggaaaacuaccuggaguaccggcag

SEQ ID NO: 38483 - RNA, 64 nt, Human
cguuagaaaauuccucccagucaggggucguccagugcaggacgggggacccaagggucucaag

SEQ ID NO: 38484 - RNA, 64 nt, Human
cugcagugucaggggaaugaccaaguacauccuggugcaggaugccuuguucuuucucacagua

SEQ ID NO: 38485 - RNA, 64 nt, Human
gugagugugggguggggaagucccuucccaacggaggucccagccuauggcccugggcccaggu

SEQ ID NO: 38486 - RNA, 64 nt, Human
ggccccucagcagggaagggauccccggggaggcaggucccaggagcagacccugcccccagcc

SEQ ID NO: 38487 - RNA, 64 nt, Human
uaagugugcaugauuguauauggaacaaauacuaaggucccagggugggagggcuagggaaagg

SEQ ID NO: 38488 - RNA, 64 nt, Human
ucagauggcuugucaguaucugcucugaggaaccaggucccaccuccccacaaggcaaaucuag

SEQ ID NO: 38489 - RNA, 64 nt, Human
cacagaauaauugauagggcagcuguuugagaacaggucccauuuucacauuagggcuuuaaau

SEQ ID NO: 38490 - RNA, 64 nt, Human
uagaagccaagccaauccuuuuucuuuuuuuuggaggucccaccgagauagauaggaacuugga

SEQ ID NO: 38491 - RNA, 64 nt, Human
guguaauccuacaccuuuugcuaacaccccuacuaggucccagagggccagaaacaccugacuu

SEQ ID NO: 38492 - RNA, 64 nt, Human
uugccacgugucacaacuuuuccagucucugagaaggucccagccuuucucaaauauucugauu

SEQ ID NO: 38493 - RNA, 64 nt, Human
gaccauguucacuuuauaaucaaaacaaaaauaaaggucccauuuuuacaaaaggagaauucuu

SEQ ID NO: 38494 - RNA, 64 nt, Human
gggggcaucaaccccccgacugugcugcucgcgaaggucccacagcccugagaugggccggccc

SEQ ID NO: 38495 - RNA, 64 nt, Human
guggucaccgagaggguugaggacgcagcacccgaggucccagccuuugcaggagccucccugg

SEQ ID NO: 38496 - RNA, 64 nt, Human
gaagcagcuuucugguucuugugauuguauccugaggucccagaacccuauucucccacgagga

SEQ ID NO: 38497 - RNA, 64 nt, Human
uuccaaucuuauugcaacaacucugugaauugcaaggucccagaaucugccuucucacauacuc

SEQ ID NO: 38498 - RNA, 64 nt, Human
ccucauccucuauccguaaguguccuuccaugcaaggucccacucuaggugauagacagggacc

SEQ ID NO: 38499 - RNA, 64 nt, Human
ugucuggccauuugguaugauuucugugugugaaaggucccaaaaucaaaaugguacauccaua

SEQ ID NO: 38500 - RNA, 64 nt, Human
guuaauaugcuuauagugguaagaaauggacuugaggucccaggagauuucauuuuauucaccc

SEQ ID NO: 38501 - RNA, 64 nt, Human
uaaauucagcaucuccccuuccacccucacccccaggucccagccucccacucagcagagugcc

SEQ ID NO: 38502 - RNA, 64 nt, Human
uagagacagaaaguugacugagccugaaagggccaggucccagugcugggccccuggggaggag

SEQ ID NO: 38503 - RNA, 64 nt, Human
acacauuagacucagggaguuuugucugaagaccaggucccacugcccccuggcugaagagucu

SEQ ID NO: 38504 - RNA, 64 nt, Human
uguggggugggagggccuacggauggguccguagaggucccaccucccucauuccuccuuggcc

SEQ ID NO: 38505 - RNA, 64 nt, Human
cagcauuuccagagaccacaugugagcuucuuuuaggucccagugaugggaccagaagcaucua

SEQ ID NO: 38506 - RNA, 64 nt, Human
gcaucuggcucccuuugguuugggggucugccugaggucccaccccacuaaagggcuccccagg

SEQ ID NO: 38507 - RNA, 64 nt, Human
gcaaaugaggugaggagaugggguaacugccuuuaggucccaacccugugccugucccucugcc

SEQ ID NO: 38508 - RNA, 64 nt, Human
aauuguuccuauuggggaugaggguggcaugaggaggucccacuugcaacuucuuucuguugag

SEQ ID NO: 38509 - RNA, 64 nt, Human
ucuguuuauaaucaagaacauaucagaaauauauaggucccagguaauacucccaaacauccca

SEQ ID NO: 38510 - RNA, 64 nt, Human
ugcucagcaaaauuguugaguaccuguucugggcaggucccacgcuauaugcacaaaguuaaga

SEQ ID NO: 38511 - RNA, 64 nt, Human
gaaauucuugaauugccagagagccguauccuccaggucccacuccuguucauugccccuuagg

SEQ ID NO: 38512 - RNA, 64 nt, Human
uguaccccacaucuugaaguaaauugaucccaccaggucccacguuuguuaucucugccuaaau

SEQ ID NO: 38513 - RNA, 64 nt, Human
aagcccaaagccugcugggugucccccauggccaaggucccagccgagagccccacgcucccgc

SEQ ID NO: 38514 - RNA, 64 nt, Human
cuuucccauggucacaggaugcacugucagcaucaggucccagagggccaccguguccauuaca

SEQ ID NO: 38515 - RNA, 64 nt, Human
gaugugaggguguuaccuuggggugaaguggagaaggucccaggugaauuggcucucauggaaa

SEQ ID NO: 38516 - RNA, 64 nt, Human
caccucagaucaaugcagucagaaccugggaaguaggucccagacaucaggaccuuuuuaaagc

SEQ ID NO: 38517 - RNA, 64 nt, Human
guggaugucuucagccucugggugcuggccagugaggucccaaaugacccagggcuuaagggag

SEQ ID NO: 38518 - RNA, 64 nt, Human
gagggccggcggcucugagcaggggcaggcgcagaggucccagccccaggccuggccucgccug

SEQ ID NO: 38519 - RNA, 64 nt, Human
accgaguuccaccccaucggcuuccauaucuuccaggucccagaggguggaaggagccaggacg

SEQ ID NO: 38520 - RNA, 64 nt, Human
acauccugcuaugacucccgggccuggguuauccaggucccauugagugguuuuccucuuggca

SEQ ID NO: 38521 - RNA, 64 nt, Human
gugaaaaggcuuggcuauggcccugugugacuccaggucccaggaaccuugccuucgucaucug

SEQ ID NO: 38522 - RNA, 64 nt, Human
caggggagagucacuaguuguacccuacuccauuaggucccaaaugggggccccauuucaccug

SEQ ID NO: 38523 - RNA, 64 nt, Human
aaagucacuuccacauuuuggguauuucuucagcaggucccaaucuacugguaccaauuuacug

SEQ ID NO: 38524 - RNA, 64 nt, Human
ccauacuagaccagucagcuugccuggaagagggaggucccacuaugccuuugggagacaccua

SEQ ID NO: 38525 - RNA, 64 nt, Human
aguauuccuaugccagagcagugccaacucuuggaggucccagagugcagccaaugccuuugug

SEQ ID NO: 38526 - RNA, 64 nt, Human
uggagagugagcuacagagccgagcaauauuuauggaugcaacacgcauggucaacccucaggg

SEQ ID NO: 38527 - RNA, 64 nt, Human
caggcaguuaacugagaauuggagaggacaggcuaggucccaggcacagcgagggcccugggcu

SEQ ID NO: 38528 - RNA, 64 nt, Human
gggggaaggggcggucucagaaaugcagguucccaggucccacccuggacuucugaaggggugu

SEQ ID NO: 38529 - RNA, 64 nt, Human
uaggaaugcugauucagagugcaccucuuugacuaggucccaggauccccuugucccuggagua

SEQ ID NO: 38530 - RNA, 64 nt, Human
uguaaaaagcauaucgcuaaguaaaucauccuggaggucccaaguagcucuaugccugcaauca

SEQ ID NO: 38531 - RNA, 64 nt, Human
ucugguggccccuucuaugcccagcugugcugggaggucccagggcccuagaagaucacagcag

SEQ ID NO: 38532 - RNA, 64 nt, Human
caugccucaagaaagccauaaaccugguaggaacaggucccaagcgguugagccuggcagagua

SEQ ID NO: 38533 - RNA, 64 nt, Human
agaaccauugucaaagcaguggcaagggacggagaggucccaacaggagucaggaagagguuug

SEQ ID NO: 38534 - RNA, 53 nt, Human
uugaauacccugggaacugagugaggucccaggcuggaggcgcuacgcagaca

SEQ ID NO: 38535 - RNA, 64 nt, Human
ccacggggcucacucuggcccccuauugucuccaaggucccauuuucccccuguguuuucacgc

SEQ ID NO: 38536 - RNA, 64 nt, Human
ucacagcuuacugcagccuugaccucccaggcucaggucccaucugagccucccgaguagcugg

SEQ ID NO: 38537 - RNA, 64 nt, Human
gguucuuccaugggugaacagagcaucugacaaaaggucccaguuuggccaggggugagggaga

SEQ ID NO: 38538 - RNA, 64 nt, Human
uucuugccucaccauuccccuaggcaggcccugcaggucccacacucucccaggcccuaaacuu

SEQ ID NO: 38539 - RNA, 64 nt, Human
cuaaguuacauaaaaagugugaaagaacacugugaggucccagcaacgccagacuauauuaagg

SEQ ID NO: 38540 - RNA, 64 nt, Human
gucagaaaacauuccguuuuggucuuuuucaaaaaggucccaaaugcugcacucuacacaugaa

SEQ ID NO: 38541 - RNA, 64 nt, Human
guguccgcagaagcaaggggcugaaaagaucugaaggucccaccuccauuugcaauugaccucu

SEQ ID NO: 38542 - RNA, 64 nt, Human
uuaaugguuagacacuuuaugcaaaaaaagagaaaggucccaggugauuuuccacaaagaaugu

SEQ ID NO: 38543 - RNA, 64 nt, Human
uauacugauguuuguguuacucaaaaaaacuacuggaugcaaacuguuauguaaaucugagauu

SEQ ID NO: 38544 - RNA, 64 nt, Human
guaaaauccccaaauccauuaaaagugacuucagaggucccagauagggaccaacauuuguuua

SEQ ID NO: 38545 - RNA, 64 nt, Human
gguggagauggggucaggaacaucuggcagagggaggucccagucugugucuccaucaggcuua

SEQ ID NO: 38546 - RNA, 64 nt, Human
ucuccuaggucuucugaaugucuugaaacaucccaggucccaggucuggugcgguuucccgaga

SEQ ID NO: 38547 - RNA, 64 nt, Human
gauucuuccugggaggauggaaacagugcagcccaggucccaugggggcagcuccaucccagag

SEQ ID NO: 38548 - RNA, 64 nt, Human
ggcagaaaacuggcagugcaccucucaucagcccaggucccagugccauuggcuucaagaaaaa

SEQ ID NO: 38549 - RNA, 64 nt, Human
ccccccgccguccugccuuccccaccccacccuuaggucccagguaguugcucugaagaguuuc

SEQ ID NO: 38550 - RNA, 64 nt, Human
aacucauguucauccugcaacagaagcauucucuaggucccaguuuccaguugauugcauaucc

SEQ ID NO: 38551 - RNA, 64 nt, Human
cgagacccauuggauggauuggggugaacaguucaggucccaugcuuggagcauuggguaucug

SEQ ID NO: 38552 - RNA, 64 nt, Human
uuguccuuacuuagaggagacagagaggccaaucaggucccagagcuugaaugcuaacaagccc

SEQ ID NO: 38553 - RNA, 64 nt, Human
ugaaggggauagggcgaggcugugccugugccccaggucccagcccuggcccuucccagacugu

SEQ ID NO: 38554 - RNA, 64 nt, Human
uucucauucgccacgaaguuaccgccaguaucgcaggucccaguguucagauggggagcgauca

SEQ ID NO: 38555 - RNA, 64 nt, Human
ugcugcccaaucuccaucugucaacaggggcgugaggucccaggaaguggccaaaagcuagaca

SEQ ID NO: 38556 - RNA, 64 nt, Human
acuccgaggagcaccaccaggccucgggccccagaggucccacuccucagccuacacgcagagg

SEQ ID NO: 38557 - RNA, 64 nt, Human
ucacaaaauauuuaugauguauuuacucugcaccaggucccaugccaagcacuggggacacagu

SEQ ID NO: 38558 - RNA, 64 nt, Human
gggccccucggcuaccccccgucuccugccgggcaggucccagguuggaggcccuaggcgcggu

SEQ ID NO: 38559 - RNA, 64 nt, Human
caaguaaccuaaaagacuguguuaucagaggaagaggucccaaauuuggaguaaagaugggaga

SEQ ID NO: 38560 - RNA, 64 nt, Human
aaucccccgacucccuccccagaucuguccugggggaugcaaauaaagccugcucucccaaggu

SEQ ID NO: 38561 - RNA, 64 nt, Human
gcaucuggccuggaguguacuagccacauucccaaggucccaaggagaaggaagagcugaaauu

SEQ ID NO: 38562 - RNA, 64 nt, Human
agcaggcuccgagcuuuccuggcauaggucaaucaggucccaggaugaauaauccaggcuucag

SEQ ID NO: 38563 - RNA, 64 nt, Human
guuuuugagagggcgccagauuugaaacagugagaggucccacaucuggugcugaaacucagag

SEQ ID NO: 38564 - RNA, 64 nt, Human
ggauggaauaaacuugugguuguccuuuaacuggaggucccagcacauguguuuucaagaggcc

SEQ ID NO: 38565 - RNA, 64 nt, Human
uacauuugacauuacugaggucauucugaguuuuaggucccaccccauuggcccgucaccucca

SEQ ID NO: 38566 - RNA, 64 nt, Human
ccacuggccucccugagcauguccauugacagugaggucccaccccucaucucuccuugccaaa

SEQ ID NO: 38567 - RNA, 64 nt, Human
ccuccaaugaaccaaacgccucccgcccaccuccaggucccaguccucuguucccuuugccugg

SEQ ID NO: 38568 - RNA, 64 nt, Human
gggccaaugagucaauugaauucaugggccaaacaggucccauccucuucaugacagcugugag

SEQ ID NO: 38569 - RNA, 64 nt, Human
ugccucuuggugccccgacccccaggguucgucuaggucccagagacccucugccuggaggcgg

SEQ ID NO: 38570 - RNA, 64 nt, Human
uucaaaaaguaccauguauaggaaugaaacauugaggucccacuuuauucugucuuuaguacau

SEQ ID NO: 38571 - RNA, 64 nt, Human
gggagucccgaagcccuucugagaucaggaaaucaggucccaagguuaggagacgcccugaaaa

SEQ ID NO: 38572 - RNA, 64 nt, Human
agaaaacaacauuagaaaauggcgcaaaaucguuaggucccaggagagaaugugggggcgcaaa

SEQ ID NO: 38573 - RNA, 64 nt, Human
agagagcuccugguggggcccucgggguggucucaggucccauuugcagucugcaacagugacg

SEQ ID NO: 38574 - RNA, 64 nt, Human
ugcccagccuggggcaaaccuagccggaaggccgaggucccauuguuggcgcugaggugucugg

SEQ ID NO: 38575 - RNA, 64 nt, Human
cccguagccguggcuuuucauucugcacagucccaggucccagcuccccucuuaugguuucugu

SEQ ID NO: 38576 - RNA, 64 nt, Human
cucccacagcuugugcccuccacaguguggacucaggucccauagacaucaggcuggagucuuc

SEQ ID NO: 38577 - RNA, 64 nt, Human
acaguguaacaguacucucaugcaauuuuuuucaggaugcaaaggcaauuauucuuuguaagcg

SEQ ID NO: 38578 - RNA, 64 nt, Human
auccucccuagcauaaauuucccaaacaguccacaggucccaugcccacuuugcgucugcacug

SEQ ID NO: 38579 - RNA, 64 nt, Human
gggugacauccgucccacaucagggcggccucccaggucccauaaggguagcccccucaucugc

SEQ ID NO: 38580 - RNA, 64 nt, Human
caccguacuaauuuuuguauuuuuuguagagacgaggucccaccauguugcccaggcugguguc

SEQ ID NO: 38581 - RNA, 64 nt, Human
cuuacuaaaaaaaaauuuuauacuuuccuugcuaaggucccauauauugauuuguacagaucca

SEQ ID NO: 38582 - RNA, 64 nt, Human
auaaaauaguugugauuauauuuuuguuuuauauaggucccaaauuauaauugucaaauauaua

SEQ ID NO: 38583 - RNA, 50 nt, Human
aggccuccccucacuucugaaggucccauccccugcugcccuccgcaggc

SEQ ID NO: 38584 - RNA, 64 nt, Human
ucuugacauaauugguauauggaucugauaacugaggucccaucuucccuacucauuccuaugg

SEQ ID NO: 38585 - RNA, 64 nt, Human
ccuuagcacccagcaugugaccccacuccugaucaggucccagcaucuucccuucuuguucugu

SEQ ID NO: 38586 - RNA, 64 nt, Human
gucccagcaucuucccuucuuguucuguuccuuaaggucccagcaccuuaccccaggacuuggu

SEQ ID NO: 38587 - RNA, 64 nt, Human
uaaauacagacgcuccucaacuuaugauguggguaggucccaguaaacccauuauaauuugaaa

SEQ ID NO: 38588 - RNA, 64 nt, Human
ggaggaucgucuuuaccugaggauuucuagccagaggucccagaugccugggcugagaacccag

SEQ ID NO: 38589 - RNA, 64 nt, Human
uugcuucagaagaguugucauucccucggcuuccaggucccaacccaggguuggguugagugag

SEQ ID NO: 38590 - RNA, 64 nt, Human
uucuuagaauaucuaagaaucuuuguuagauauuaggucccaucaauucuuagaauaucuaaac

SEQ ID NO: 38591 - RNA, 64 nt, Human
auauucuuaaugacauuucacugaugcuucuaucaggucccaucaauucuuagaauaucuaaga

SEQ ID NO: 38592 - RNA, 64 nt, Human
auagucuugaugacauuucacugaugcuucugucaggucccacuaauuauuagaauauaagaaa

SEQ ID NO: 38593 - RNA, 64 nt, Human
aacgaggaaggacacagacccaaaagccagacccaggucccagcgcgcuucugggcucuaaccu

SEQ ID NO: 38594 - RNA, 64 nt, Human
cuucuaucaguagcaguauuguuacuucuuuccaggaugcaaggucuauuaucccaacagaaga

SEQ ID NO: 38595 - RNA, 64 nt, Human
ucuuuucugaucagcaccuuggccgugauucccaaggucccagccaaagcaaagggccaguugu

SEQ ID NO: 38596 - RNA, 64 nt, Human
ggcugagagugaaggcugccaaugucagcuuuggaggucccagaagucuucuguucucuggccu

SEQ ID NO: 38597 - RNA, 64 nt, Human
uugugggguuguggagguugugggggcgguggggaggucccagaggugggaggccggcauccag

SEQ ID NO: 38598 - RNA, 64 nt, Human
gcugcccagaggaccccacgccucucagaggcagaggucccaugacagccuuugacccacaacg

SEQ ID NO: 38599 - RNA, 64 nt, Human
cgcugcuauggaggcugccuccuagucucccaccaggucccaggcuguggaaagccccagccca

SEQ ID NO: 38600 - RNA, 64 nt, Human
ccacucuagacuggcaagggccuccacaguguggaggucccauuuuauuauuuuuuuuuuucga

SEQ ID NO: 38601 - RNA, 64 nt, Human
cuauagaagccaaagggacagggacggaaaggacaggucccaagggauggggcugucuuuacuu

SEQ ID NO: 38602 - RNA, 64 nt, Human
ggugcuucuggcuguggcacgcacuggaucacccaggucccagcagacauggccgcccaaaguc

SEQ ID NO: 38603 - RNA, 64 nt, Human
caugccccaucccaugcuguccauccauucucacaggucccaaauggcccugggucccaggacc

SEQ ID NO: 38604 - RNA, 64 nt, Human
auucaggaauuucaaguaugugcccgggucugucaggucccaguugccuuucugacggcccccc

SEQ ID NO: 38605 - RNA, 64 nt, Human
gggaggaaaaggaaauggaucuaaauggaauuccaggucccacgcuggauauuuucacaccuua

SEQ ID NO: 38606 - RNA, 64 nt, Human
cugaccaaagccagggcugugugugccuguguguaggucccacggccucugccuccccagggag

SEQ ID NO: 38607 - RNA, 64 nt, Human
guguuacgaauggugggccaaggggcugucugcuaggucccaguaggacaggcagagcuccagg

SEQ ID NO: 38608 - RNA, 64 nt, Human
agcucuauguauuuucuacugcaccugagcaggcaggucccagauuucuuaaggcuuuguuuga

SEQ ID NO: 38609 - RNA, 64 nt, Human
ugugaaacaguuuacauaugucaacuguaacaguaggucccaaaugggcccauuccccuaauag

SEQ ID NO: 38610 - RNA, 64 nt, Human
ccaugaggcaaugucaggaacagaaggaugaaugaggucccaggcagagaaucauacuuagcaa

SEQ ID NO: 38611 - RNA, 64 nt, Human
gauagaacauuuaaaugugggaaguggcuuccccaggucccauccccuguuuagggauagaguu

SEQ ID NO: 38612 - RNA, 64 nt, Human
uugaucaauggggaagccugggugaggaugggccaggucccaauucccaaagcuccuggaagag

SEQ ID NO: 38613 - RNA, 58 nt, Human
cuggggcagggcaccagugaacaggcacaggucccaggaccaaggagagguggaacau

SEQ ID NO: 38614 - RNA, 64 nt, Human
agugauucaucuagaugacucuaaggucucuuucaggucccaggggacgugaucuaaguuagga

SEQ ID NO: 38615 - RNA, 64 nt, Human
cuauuaaguaaauuauuaccacagggagccagugaggucccaguagucuaaaacaguucaugug

SEQ ID NO: 38616 - RNA, 64 nt, Human
ucaucuuacagauugggaucccagccuucucaccaggucccaacuccaucuccaaggccaaggg

SEQ ID NO: 38617 - RNA, 64 nt, Human
agaagugccuggaagagagggugcauugugaggcaggucccaaaagggaaggcuggaggcugag

SEQ ID NO: 38618 - RNA, 64 nt, Human
guggcugacacaugggguaugccgggcacugggcaggucccagagccggggaaccagcucaccu

SEQ ID NO: 38619 - RNA, 64 nt, Human
ggaaugucugauacccucugcaucaagcguaagaaggucccaaaucauaaccauuuuaagaaca

SEQ ID NO: 38620 - RNA, 64 nt, Human
cccuccaggcuucuucccuucuucaggcuggcccaggucccaggccuggucaacucggucacag

SEQ ID NO: 38621 - RNA, 64 nt, Human
cugugcggguuugacucagucccuuccccucacuaggucccaguuucuccauuuguaaaacaag

SEQ ID NO: 38622 - RNA, 64 nt, Human
ccuggucagccaccagcuggggcaacgaggguggaggucccacugagccucucgccugcccccg

SEQ ID NO: 38623 - RNA, 64 nt, Human
uguuauggggaggggaggggguucuuccagccucaggucccagcugucucacguuguuuauucu

SEQ ID NO: 38624 - RNA, 64 nt, Human
uuuacgagcagcugugagugaggggacaaggggcaggucccaggagccacacacucccuuccuc

SEQ ID NO: 38625 - RNA, 64 nt, Human
auggagauggacagaccugggccuggcucuugagaggucccagucagccauggagagcugggga

SEQ ID NO: 38626 - RNA, 64 nt, Human
gcucaagggccagagaucucaagugucaaccuugaggucccagcuccauccccuaguugcagac

SEQ ID NO: 38627 - RNA, 64 nt, Human
guuguggaaggaaaaugugaaugaaaguagugcuggaugcaauuacuccugaaccccaccuagg

SEQ ID NO: 38628 - RNA, 64 nt, Human
ggaaccauccaguaaaggucuuucagaaccacuaaggucccagcccucacuaggaugucaggag

SEQ ID NO: 38629 - RNA, 64 nt, Human
gcuccuuuaauguaggauugagagcugggcaaacaggucccacuggggacugugacucuuggag

SEQ ID NO: 38630 - RNA, 64 nt, Human
ccucuuggggggaucggcaaacaggcuaccccugaggucccaugugccaugagugugcacacau

SEQ ID NO: 38631 - RNA, 64 nt, Human
guggcuuuuuugccuucuccaaagacgcacugccaggucccaagcuucagacugcugugcuuag

SEQ ID NO: 38632 - RNA, 64 nt, Human
ggagcugagguuucacccuuaacccaaggagcacaggucccaccuccagcccgggagccuagga

SEQ ID NO: 38633 - RNA, 64 nt, Human
augccaucagagcagaccucagccagggccacagaggucccaaccgucucugcccucuucugcu

SEQ ID NO: 38634 - RNA, 59 nt, Human
ucuuuaagaagaacaaguaguugggggcaaggucccaggccaacucccucccuccguuc

SEQ ID NO: 38635 - RNA, 64 nt, Human
ggagugcucugccuggagucugcagaccucagagaggucccagcaccggcuguggccuuucagg

SEQ ID NO: 38636 - RNA, 64 nt, Human
cagaccaacugcuaugguggaaaaugcagcuuccaggucccacuacccugacauuuccguggaa

SEQ ID NO: 38637 - RNA, 64 nt, Human
gucuguggaaugggagguuggauuagcugcgcugaggucccauccacagcuggugcucagcugc

SEQ ID NO: 38638 - RNA, 64 nt, Human
uguuuguuuaaaacauuucuccaucacucauuccaggucccagagcaaacucucucugcucucg

SEQ ID NO: 38639 - RNA, 64 nt, Human
uccgacauguacugcuaguaccuguaagcauuuuaggucccagaauggaaaaaaaaaucagcua

SEQ ID NO: 38640 - RNA, 64 nt, Human
caggccacuccaaucacccuacaagaugccaaggaggucccaggaaguccagcuccuuaaacug

SEQ ID NO: 38641 - RNA, 64 nt, Human
cccggguggcgcuggaaguuaucaguggcuagugaggucccagcucccugauccuaugcucuau

SEQ ID NO: 38642 - RNA, 64 nt, Human
uccugccacccaucugcccugcucccacaugcucaggucccagggcacagaaaaagggcagacu

SEQ ID NO: 38643 - RNA, 64 nt, Human
ucucaaaagauuguuuuauauguaguacuaacuaaggucccauaauaaaaagauaguaucuuuu

SEQ ID NO: 38644 - RNA, 64 nt, Human
ggguaccgucuucucccuauucccucucucucccaggucccagccccuuuuccccagucccaga

SEQ ID NO: 38645 - RNA, 64 nt, Human
aaauauaacaauacuaaauaucacacugcgauggaggucccaaauauguggucuaucaccacug

SEQ ID NO: 38646 - RNA, 64 nt, Human
guggaccucugagcauccacgcaggauggcucucaggucccagucacagacgucgcuuccuggg

SEQ ID NO: 38647 - RNA, 64 nt, Human
cagcgcaacugcgaggacaugauccagauguuccaggucccauccaugggggggcggaagcggg

SEQ ID NO: 38648 - RNA, 64 nt, Human
ggcucuaggggcuaggggggaguggggagccaagaggucccauauuccugagugcagggguagu

SEQ ID NO: 38649 - RNA, 64 nt, Human
uccuauccggaggcacagcacaugagcccuggacaggucccaaaguuccaagcaguccuuuccg

SEQ ID NO: 38650 - RNA, 64 nt, Human
acuacagcacagauuucaccucugucuugaauaaaggucccacuuugaagucacuggcuguaau

SEQ ID NO: 38651 - RNA, 64 nt, Human
acacggaacagggucacccaggaggguggaugccaggucccacucaggcauaccuuaggaggug

SEQ ID NO: 38652 - RNA, 64 nt, Human
cucugauugacacagucaccuucccuguuuccuuaggucccauguggacuaacgacuucucauu

SEQ ID NO: 38653 - RNA, 64 nt, Human
gguacagaggcaagagcagagccugagaagcgucaggucccacuucugccaugcagcuacuaug

SEQ ID NO: 38654 - RNA, 50 nt, Human
uggcaaagauagcagccugaaggucccacccccaccccuacagaaaaaau

SEQ ID NO: 38655 - RNA, 64 nt, Human
guugucugauagaaugccccugaaugggaacucuaggucccaaggccugaaggguugagaacag

SEQ ID NO: 38656 - RNA, 64 nt, Human
aaaguggaugagguuggaaagaguugccauaaugaggucccacguggcuucuucgauaggagcc

SEQ ID NO: 38657 - RNA, 64 nt, Human
ccugucaaucacucugucccauugucuacugggaaggucccaggucuucaccaguuuuacaaug

SEQ ID NO: 38658 - RNA, 64 nt, Human
ugacucagaacagggcgggggggggggcggugucaggucccagcgagccacaggaacggcccug

SEQ ID NO: 38659 - RNA, 64 nt, Human
gagugaccacggccccaagcccagggcuggaggcaggucccaggacgcgccgcucccucaugcu

SEQ ID NO: 38660 - RNA, 64 nt, Human
aaacacaagaaaaucauguccuuuucagcaacauggaugcaacuagaggcuauuauccuaagca

SEQ ID NO: 38661 - RNA, 64 nt, Human
gagugaccgcggccccgagccuggggcuggacgcaggucccaggacgugcugcucccuugugug

SEQ ID NO: 38662 - RNA, 64 nt, Human
gagugaccgcggccccgagccuggggcuggacgcaggucccaggacaugcugcucccuugugug

SEQ ID NO: 38663 - RNA, 64 nt, Human
cagcaugaaaguagaaacgaagaagcagauggagaggucccauuaccugcaaagaaagggcacu

SEQ ID NO: 38664 - RNA, 64 nt, Human
caucucucucuaaagcucagccacggcugcggcaaggucccagcggucgcugggagacagaagg

SEQ ID NO: 38665 - RNA, 64 nt, Human
uggcacccugcuggcugccucacugcuuacagacaggucccaccaaacccaaacaccugccuag

SEQ ID NO: 38666 - RNA, 64 nt, Human
agggauuccagggugucaggaaggcaggggugccaggucccaccuagugaaguaauaaaccgug

SEQ ID NO: 38667 - RNA, 64 nt, Human
gucuccugauuaguacucuuuucacuaaucccaaaggucccaaggaacaaguccaggcccagag

SEQ ID NO: 38668 - RNA, 64 nt, Human
acacugaccggggcacagugcaaggacaauugcaaggucccaucuccaaggugcgucauaugca

SEQ ID NO: 38669 - RNA, 64 nt, Human
aagugaaaaaaaaaaaaaaagauauaagaacucaaggucccauacucuguauucgggauccauc

SEQ ID NO: 38670 - RNA, 64 nt, Human
aacuuaaugcuggaucccaugggaucgaugucugaggucccaccuaaagucccuaaccgggagg

SEQ ID NO: 38671 - RNA, 64 nt, Human
cuggcagguaucugugcauucauagaacuuauaaaggucccaggaucacuuuuaagggauuuuu

SEQ ID NO: 38672 - RNA, 64 nt, Human
cuucccgccuuuccucagagugcuucccaaacugaggucccauggcacacuguccugggaggcg

SEQ ID NO: 38673 - RNA, 64 nt, Human
uuguccaucagcaagagagagcagcuggaacagcaggucccagagaacuacuucuaugugccag

SEQ ID NO: 38674 - RNA, 64 nt, Human
cagucaagcagaaaaacaggcacaggcucaguguaggucccaagagagggugccuggacucagc

SEQ ID NO: 38675 - RNA, 64 nt, Human
cauuggccaucuccgccugccuaaggcucugagcaggucccagagcugcuguuccuccacugcu

SEQ ID NO: 38676 - RNA, 64 nt, Human
ugugguaguugucugauuuuguuuaccacacgccaggucccagggaagucuugcacagacucuu

SEQ ID NO: 38677 - RNA, 64 nt, Human
auacuucgacugugacauacaaguccauuaucugggaugcaaccacucaacaacuauccuauuc

SEQ ID NO: 38678 - RNA, 64 nt, Human
agagggagggagggggagggaggagggagcaggcaggucccaaaugcaaaagccagagaaaggc

SEQ ID NO: 38679 - RNA, 64 nt, Human
ggccugcagggcagcccaagucaugacucagaccaggucccacacugagcugcccacacucgag

SEQ ID NO: 38680 - RNA, 64 nt, Human
ugguuccgucagaccaugaggagccaagaccagcaggucccacagccgacagugcccagagcau

SEQ ID NO: 38681 - RNA, 64 nt, Human
cucggcuuaugggaggccgcccuggagggcccggaggucccaaggucccugggaggacugggcc

SEQ ID NO: 38682 - RNA, 64 nt, Human
uucuugaagcagcuccugcaaaagggaugcaaagaggucccagggaccugccccgaggaaggcc

SEQ ID NO: 38683 - RNA, 64 nt, Human
gaggaugggaccagguuggaccacguggcaucagaggucccauccagauccaacuauaggucca

SEQ ID NO: 38684 - RNA, 64 nt, Human
gagggauguuacugggcugugguccuguacccagaggucccagggaucggcuccuggccccucg

SEQ ID NO: 38685 - RNA, 64 nt, Human
cuagauguagccucuguuccuccuggacauaggaaggucccaagcuuaguaucccacguggccu

SEQ ID NO: 38686 - RNA, 64 nt, Human
ccaggagaccugcagcccugcgccuuccagaagcaggucccaaauaaagccagugcccaccugc

SEQ ID NO: 38687 - RNA, 64 nt, Human
gcagagccacagcugugcaugcucagcccugccgaggucccaggccaggcuuuguugcuuccgu

SEQ ID NO: 38688 - RNA, 64 nt, Human
gggugggguggcccaggcagcagaagguucccugaggucccagagccuguuccguuggcccugg

SEQ ID NO: 38689 - RNA, 64 nt, Human
uccgggaccccagcuugggagcugugggucugccaggucccaccuccucugucccccaugccac

SEQ ID NO: 38690 - RNA, 64 nt, Human
cuccguccugauaagacguccaccccccagggccaggucccagcuauguagacccccgccccca

SEQ ID NO: 38691 - RNA, 64 nt, Human
ugcugugccacacagcuccccacccccugcuaggaggucccagucucacgccuuccucaugugu

SEQ ID NO: 38692 - RNA, 64 nt, Human
uaaggugugaaccuaccugccuuggagagggcccaggucccaaaucucuucaaauucuucacau

SEQ ID NO: 38693 - RNA, 64 nt, Human
uuguggacuuuuccucagggauacauuggccugcaggucccaguucacauguaguccccugcuc

SEQ ID NO: 38694 - RNA, 64 nt, Human
ccuugcccuggcuacagaacauggaagccccuagggaugcaaguggacuugggcagaggagguc

SEQ ID NO: 38695 - RNA, 64 nt, Human
ugagaauuuugggcaaccuccuucgacgugggggaggucccauuuccacuucaucacuguugga

SEQ ID NO: 38696 - RNA, 64 nt, Human
ccugaggccucuccgcaccaccucagcgggcaggaggucccaccauguggacagacauagccca

SEQ ID NO: 38697 - RNA, 64 nt, Human
caccccugcugccacacacaugcccugagcagccaggucccacuaggugcucuacccugaggga

SEQ ID NO: 38698 - RNA, 64 nt, Human
acagccccuggcagaucccagaccccuugguggcaggucccagagccuaggugguaggagcuug

SEQ ID NO: 38699 - RNA, 64 nt, Human
cccaaggaccacgaucaagggguccgggggaccgaggucccagaucagugaggggagaagguug

SEQ ID NO: 38700 - RNA, 64 nt, Human
ugccucccugacccugcagagaugcgguggcuaaaggucccaaggcaaggggugccugggaacc

SEQ ID NO: 38701 - RNA, 64 nt, Human
ccuguguuuaaguggauggccccucuauccauccaggucccaugccaagaaccagugauucuag

SEQ ID NO: 38702 - RNA, 64 nt, Human
cguccccacccacgggggagacggagagauauaaaggucccagcggcaccaacaucaucauugg

SEQ ID NO: 38703 - RNA, 64 nt, Human
ggcucccuguccuagucuugaucuguucugggccaggucccagcuugagcugccucugagauuu

SEQ ID NO: 38704 - RNA, 64 nt, Human
uucaguggacagcuuucaagcagugcuuguugugaggucccaucucggccaagaacuuaccuuc

SEQ ID NO: 38705 - RNA, 64 nt, Human
acacuuaucccagacacaacaccauguggucuggaggucccagcccccacccuaaaaagguuau

SEQ ID NO: 38706 - RNA, 64 nt, Human
gcaugaagguggggccagugcuggggguuucuguaggucccacucccacagaggagagaggcuc

SEQ ID NO: 38707 - RNA, 64 nt, Human
agaaacgcggccagaagacaagcagggaagugaaaggucccaggcacacacccugcccauugca

SEQ ID NO: 38708 - RNA, 64 nt, Human
aauuaacacacugacccaaaggugcuuguguugcaggucccaucuccuuugaugagguuaacaa

SEQ ID NO: 38709 - RNA, 64 nt, Human
caaaaauugccaagugccuaugcaaaccagcuuuaggucccaauucggggccugcuggaguucc

SEQ ID NO: 38710 - RNA, 64 nt, Human
agcaggcagaacucuccuuggauaauuccccaagaggucccaaggauugggagcaugggagggg

SEQ ID NO: 38711 - RNA, 64 nt, Human
agguccuaaauucauagaguggauauuaggauuaggaugcaaaaauaaaugcuuaaccaacacu

SEQ ID NO: 38712 - RNA, 64 nt, Human
cggaugcccauuccugccugguccaguggggaacaggucccacgccaggccagcaggcgggcuc

SEQ ID NO: 38713 - RNA, 64 nt, Human
ggugcccuguuggugcuccuguuuccaauagcuuaggucccauggugggggaggaaccucaggg

SEQ ID NO: 38714 - RNA, 64 nt, Human
acaaugauggggauaacugguccucauaccaugcaggucccauuucugaucaccccacuggcag

SEQ ID NO: 38715 - RNA, 64 nt, Human
cagucaggcgccucguggucagagcagagccaccaggucccacugccccgagcccugcacagcc

SEQ ID NO: 38716 - RNA, 64 nt, Human
aggcaggggcuucggugccgcgugggcaguacgcaggucccaccgacacucaccugggagcacg

SEQ ID NO: 38717 - RNA, 64 nt, Human
cugagcggcugcagccugcuuugggacgauggucaggucccauguugucccugcugccucccuc

SEQ ID NO: 38718 - RNA, 64 nt, Human
aaugcugggaacauugaaguuuauuuggauaucaaggucccagaacaaggaagucacuuuucag

SEQ ID NO: 38719 - RNA, 64 nt, Human
ucuacagugaagauugauggaccagccucuuuccaggucccaggacuuugcaagagauggagac

SEQ ID NO: 38720 - RNA, 64 nt, Human
gacccgaaaauccagcgugcaccccgccggaggaaggucccauggccugcugggcuuggcucgg

SEQ ID NO: 38721 - RNA, 64 nt, Human
ggcuggggccaggguggggggcagucacugugggaggucccagcuccagccccccucugguuug

SEQ ID NO: 38722 - RNA, 64 nt, Human
uuuugaggaauucuuauuuguguuagagcagaggaggucccagauaccaaguggcgccucccag

SEQ ID NO: 38723 - RNA, 64 nt, Human
aggaggcugguucacguccccuaccacggaagcgaggucccagaaggccagcggugguuccagg

SEQ ID NO: 38724 - RNA, 64 nt, Human
aucaucacuucgguuccugauuggucccgggccaaggucccagaccaagcugaaucacgcuuuc

SEQ ID NO: 38725 - RNA, 64 nt, Human
uggccaaugacuguggagaggacugugagagagaaggucccagcgggggccagugaagcucagg

SEQ ID NO: 38726 - RNA, 64 nt, Human
gcccuucccuccccaucuccccuacuucccuggaaggucccauucuuucucaccggcugggcuc

SEQ ID NO: 38727 - RNA, 64 nt, Human
gcaagcuaaggccuggagggucagaugggagaccaggucccaagggagcaagaccucgcgaagc

SEQ ID NO: 38728 - RNA, 64 nt, Human
ggcucugaguguaaacuacaugguagguugugaaggaugcaaauaucgaaucaaucauuuuuua

SEQ ID NO: 38729 - RNA, 64 nt, Human
cauaugcccauagcaucccacaggcccaggcaggaggucccaccccagacccugccccagacgc

SEQ ID NO: 38730 - RNA, 64 nt, Human
uccguugcagugacaucauccagggagacacacaaggucccagugccauugccuuuaucucaua

SEQ ID NO: 38731 - RNA, 64 nt, Human
ccugcagacaccggugaggugggaugauuucaggaggucccagcccgggacugcccgccccucu

SEQ ID NO: 38732 - RNA, 64 nt, Human
cuagaccugccaggagcacuuggccugcaggggcaggucccagccgcuaaaaugggcaagggag

SEQ ID NO: 38733 - RNA, 64 nt, Human
agguagccaaggucagcccugaggccagggugaaaggucccagacuucgaaugcccaccuuugg

SEQ ID NO: 38734 - RNA, 64 nt, Human
uccuaucccccacuccaaaccaggacgaccugcaaggucccagccagcaggacaccgugggcac

SEQ ID NO: 38735 - RNA, 64 nt, Human
ucuccagcuuccauccuccaguuaucuagccaggaggucccaagaguuaguuuuagggaaaaag

SEQ ID NO: 38736 - RNA, 64 nt, Human
cccccaaccccuccuuccccagacccagagguccaggucccagccccuccucccucagacccag

SEQ ID NO: 38737 - RNA, 64 nt, Human
ccccggcaacagccccaggggccuugagggucugaggucccagcccuguugccaagugaccuug

SEQ ID NO: 38738 - RNA, 64 nt, Human
gcugggcccaggcaacccaccccuccaccucuggaggucccaccaggcuauuaaaggggaaugu

SEQ ID NO: 38739 - RNA, 60 nt, Human
cucuucagaccgacaugugaaagccuccagaggucccagcccuucuccagcaucacagau

SEQ ID NO: 38740 - RNA, 64 nt, Human
cugggacagcggagagacggcuucucuuuaaucuaggucccauugugucuugagggaggacuuu

SEQ ID NO: 38741 - RNA, 64 nt, Human
ggggcgauggugccuggucucugaguaagaugccaggucccaggaacucaggcuucaggugaga

SEQ ID NO: 38742 - RNA, 64 nt, Human
agcugggcugagagcccuuucucccauccauuggaggucccaggagugucacccauggagaggc

SEQ ID NO: 38743 - RNA, 57 nt, Human
ggaaggugggagccacaugagacccacaggucccacugucaaaggcugaaaaugugc

SEQ ID NO: 38744 - RNA, 64 nt, Human
gcacugcucguuacugucugccuucaguggucugaggucccaguaugaacugccgugaagucaa

SEQ ID NO: 38745 - RNA, 64 nt, Human
auaauuuuaauggcuauauuauauuccauuuaauggaugcaacucaguuuauuuaaccauuccc

SEQ ID NO: 38746 - RNA, 64 nt, Human
ccgggccuccucgaggccccuaagccacccccagaggucccaucugaagcuggaguacccuggg

SEQ ID NO: 38747 - RNA, 64 nt, Human
acagaguacccucuucaagccccggucaugauggaggucccagccacagggaaccaugagcuca

SEQ ID NO: 38748 - RNA, 64 nt, Human
cccuccucuguccaccgagacucuggacuugcucaggucccagacuggggaagggaggugucua

SEQ ID NO: 38749 - RNA, 64 nt, Human
ugggggacugggagucagagcccuggcuggguucaggucccacgucuggccaggcacugccuuc

SEQ ID NO: 38750 - RNA, 64 nt, Human
uucaaccuuguuggugcugagagagagaaccgagaggucccaguacaagggcagggcagggcag

SEQ ID NO: 38751 - RNA, 64 nt, Human
agcugagguccugggaggggaaagugcuugccugaggucccacuguguuagugggugggcagga

SEQ ID NO: 38752 - RNA, 64 nt, Human
ccacauucuggcuccaccgggagggacagucuggaggucccagacaugcugcccacccccugcu

SEQ ID NO: 38753 - RNA, 64 nt, Human
agaacagcgagagcaaccuggaaaaucggucuucaggucccacguuuccucccccuuuuuucuu

SEQ ID NO: 38754 - RNA, 64 nt, Human
ucacauguucuuucuuuuccugagugaaaagcaaaggucccacggugugugcuguggugcaccg

SEQ ID NO: 38755 - RNA, 64 nt, Human
gcuuugagccuccagacucgaggcuggucacugcaggucccagguggaauuuggacaacuggcc

SEQ ID NO: 38756 - RNA, 64 nt, Human
ugcugccucccagcagagggccccaggaucuccaaggucccagcuauggcuuuggacaacgugg

SEQ ID NO: 38757 - RNA, 64 nt, Human
cugauggacacgccccccagugccagccaggcucaggucccaccugaaagcugauagucgcguc

SEQ ID NO: 38758 - RNA, 64 nt, Human
guucauaucuggagccugaugucuuaacgaauaaaggucccaugcuccacccgaggacaguucu

SEQ ID NO: 38759 - RNA, 64 nt, Human
ggguugggcccugcuuuccaccaagucacucagaaggucccaaucacacaugauuggccucauu

SEQ ID NO: 38760 - RNA, 64 nt, Human
cgccaggccagcccccaaugguccccuuacggacaggucccagagauggacagaggcacccagg

SEQ ID NO: 38761 - RNA, 64 nt, Human
uggggccccaaacucauuaauucacugaagacacaggucccacagggagcggaugaugaagcag

SEQ ID NO: 38762 - RNA, 64 nt, Human
uuucacccaaaugaagugugaacgugauguuuucggaugcaaacucagcucagggauucauuuu

SEQ ID NO: 38763 - RNA, 64 nt, Human
cugugugugaugaaucucgccagaaaggcuccugaggucccagguuggcacuucucccugcagc

SEQ ID NO: 38764 - RNA, 50 nt, Human
uguucuccaccgaagucuaaaggucccaguccaucuccuggaggcggaca

SEQ ID NO: 38765 - RNA, 64 nt, Human
uucauuaaaaugcuggaaaacuguaaagacuuccaggucccauccaaggagauuuugcuucuga

SEQ ID NO: 38766 - RNA, 64 nt, Human
gaguuguaacagagcagugccagagcaugggcccaggucccaggggagagguuggggcuggcag

SEQ ID NO: 38767 - RNA, 64 nt, Human
gccuuuagaguuacaagccccuggaaaagggagcaggucccauacaaucagccuuucuccucuu

SEQ ID NO: 38768 - RNA, 64 nt, Human
cuccccaaagugccugagcgccgccucugugcccaggucccauuucucugcagcacuggccccu

SEQ ID NO: 38769 - RNA, 64 nt, Human
gcuggccccacugugucacagagcugccuggcacaggucccagccccucugcagagacacaaua

SEQ ID NO: 38770 - RNA, 64 nt, Human
acuggcccccuuuugaaccucauuggacccaaccaggucccaagcuccauuggagaugaccagu

SEQ ID NO: 38771 - RNA, 64 nt, Human
gagcccugauccggggguccagggaauggagcucaggucccaggccagccccgaagucgccacg

SEQ ID NO: 38772 - RNA, 64 nt, Human
uaaaagcugcauaugccuacaaagcucugaauucaggucccaguugcugucacaaaggagugag

SEQ ID NO: 38773 - RNA, 64 nt, Human
uggccacgcucccccucgguucaaaaccuugcacaggucccacugcccucagccccacuucuca

SEQ ID NO: 38774 - RNA, 64 nt, Human
gaggaacgggucggguccgugucggagaagugacaggucccagagccaaagccggcccucaagc

SEQ ID NO: 38775 - RNA, 64 nt, Human
gccauaggccgcagcccuggcccccuguggauugaggucccaagugguccagcugugggguuug

SEQ ID NO: 38776 - RNA, 64 nt, Human
uuuggccauauucuauuuguuagaaguaaaccacaggucccaccagcuccaugggagugaccac

SEQ ID NO: 38777 - RNA, 64 nt, Human
ugaauggagaaggaaucauucaugggccucggcuaggucccagacugauuacaugagacugggg

SEQ ID NO: 38778 - RNA, 64 nt, Human
cccacuucucuccagaugaagggaagacauucauaggucccaaaucugcccauucagaugucac

SEQ ID NO: 38779 - RNA, 64 nt, Human
gccucuggaaccugaggcggcugcuugaaccuuuggaugcaaaugucgaugcuuaagaaaaccg

SEQ ID NO: 38780 - RNA, 64 nt, Human
ugcauucauccuccuucuccaagaccuauggagaaggucccaggccccaggaacacagggcuuc

SEQ ID NO: 38781 - RNA, 64 nt, Human
uccguccuggcacagaagaggagucaaguaauggaggucccagcccuggggguuuaagcucugc

SEQ ID NO: 38782 - RNA, 64 nt, Human
ucagauuacuaaaaggacuugggaaaaagcaaaaaggucccauuguacuggacugaggauuaga

SEQ ID NO: 38783 - RNA, 64 nt, Human
gagcaagguagugaucacaccaguacaagaucucaggucccaggcuccuaugcaaguuuuuuuu

SEQ ID NO: 38784 - RNA, 64 nt, Human
gccuacaucuucucucuuccccaucuugcauuggaggucccagaaaacaauuagcuucuggcaa

SEQ ID NO: 38785 - RNA, 52 nt, Human
ucagcuuucugaugaguuaaaaaggucccagagauauauagacacuggagua

SEQ ID NO: 38786 - RNA, 64 nt, Human
aaugaaggcccagagaagggaagggacuugaccgaggucccacuucuguuucgaggcagaagcc

SEQ ID NO: 38787 - RNA, 64 nt, Human
ggagcccuuuuuauuuuugguacugagagucucaaggucccauagcuacaugguacagggcugu

SEQ ID NO: 38788 - RNA, 64 nt, Human
uuucccgcuaagccuggccugggcaaauggagcgaggucccacuuugcgucuccuuguaggcag

SEQ ID NO: 38789 - RNA, 64 nt, Human
cuauucugcuucugugagucccugauagagaaggaggucccaucaggccccuggaacacacuca

SEQ ID NO: 38790 - RNA, 64 nt, Human
gagcaagaggcccugggucucuccaagcagcugcagaccccagcucgaauuuugcacauggcgg

SEQ ID NO: 38791 - RNA, 64 nt, Human
gaggccuccucgcaccugcccuccgcugcuccucagaccccagcccccagcgagccgacguccc

SEQ ID NO: 38792 - RNA, 64 nt, Human
ucagugagguucuuggguuuugugccuuuggggcagaccccaggcaaggaugucugagaccacu

SEQ ID NO: 38793 - RNA, 64 nt, Human
gacagagacaggccccugaacgauaagcaccaagagaccccaaggcuccagauggaacacugag

SEQ ID NO: 38794 - RNA, 64 nt, Human
agaccccgaagccucaaggccggggcuggagcggagaccccagggccucucaggagacagugag

SEQ ID NO: 38795 - RNA, 64 nt, Human
cagccuggagaagcccuaggggggcgacccgcggagaccccagcagaggucgcagcccagcucc

SEQ ID NO: 38796 - RNA, 64 nt, Human
aagauccuagaggacgaaccccacaguaaggaugagaccccacuguguacccuucuggacuggc

SEQ ID NO: 38797 - RNA, 64 nt, Human
ccaagaguucaagaucagccugggcaguauagcaagaccccaucuccauuuuuuuuuuaaugau

SEQ ID NO: 38798 - RNA, 64 nt, Human
uaauuaugcacacagaaaaucuguggagccuaucagaccccaagugucuugaaauguuuguaga

SEQ ID NO: 38799 - RNA, 64 nt, Human
agcucugugucaaggccuuugaggcccagaacccagaccccaaagcgccuguggugcugcugag

SEQ ID NO: 38800 - RNA, 64 nt, Human
auacagucaccaagaauguuuugaguuuuuugaaagaccccaauuuaagccuugcuuauuuuua

SEQ ID NO: 38801 - RNA, 64 nt, Human
gccacugcacuugagccucuugggaaacauaacaagaccccaucuguaaauuaaaaaaaaaaaa

SEQ ID NO: 38802 - RNA, 64 nt, Human
ccagaggaaaaguacuaggauucuuaagauggcgagaccccaagagggaucucauagcacugcu

SEQ ID NO: 38803 - RNA, 64 nt, Human
ccaguaguucaagaccagccugggcaacauaguaagaccccaucucuaugaagaauaaaaaaau

SEQ ID NO: 38804 - RNA, 64 nt, Human
aaccugcgagugccaucagccucccucacaugggagaccccaacccagcugacaauguggagcc

SEQ ID NO: 38805 - RNA, 64 nt, Human
cugcagucccagcacagugggacaaaaagaauuuagaccccaaaaguguccucggcauggaucu

SEQ ID NO: 38806 - RNA, 64 nt, Human
agccagugauccagccccaccaaggggccuccagagaccccaggaacaauaagugucuccuccc

SEQ ID NO: 38807 - RNA, 64 nt, Human
agaagacuuaccuuaguucaaggggaggggacaaagaccccacagcccaacagcaggacuguag

SEQ ID NO: 38808 - RNA, 64 nt, Human
ucuggaguuugagaccagccugagcaacauggugagaccccaucucuacaaaaaaaauauaaaa

SEQ ID NO: 38809 - RNA, 64 nt, Human
ugugccacugcacuccacccugggcaacagagcaagaccccaucucaaaaauaaauaaauauau

SEQ ID NO: 38810 - RNA, 64 nt, Human
acaaaaacagaaagcacaagacgaacucaguagcagaccccagacucuccccuugccagacgug

SEQ ID NO: 38811 - RNA, 64 nt, Human
cccagcccuccugggccagcccagagggcccuucagaccccagcugucugcgcgucugacucuu

SEQ ID NO: 38812 - RNA, 64 nt, Human
agcacgggcucuucccgccggguccucccuccccagaccccagagggagaggcccaccccgccc

SEQ ID NO: 38813 - RNA, 64 nt, Human
caucuuggaaaggggaggagcuucucccagugugagaccccaaagacucuggaggucaucuggc

SEQ ID NO: 38814 - RNA, 64 nt, Human
gguuuuuauucuugcugcaguugguuaccaaggaagaccccaaagcacuggcuguugccuugaa

SEQ ID NO: 38815 - RNA, 64 nt, Human
caucucagcccagguucuagcccccacgcaccccagaccccagguggaccauccucccaaacua

SEQ ID NO: 38816 - RNA, 64 nt, Human
ugucuguccguccagguggccgaccucacugcacagaccccacuccagccccuccaccccuucu

SEQ ID NO: 38817 - RNA, 64 nt, Human
acaguucaggugagaaacuguuugauuauagaaaagaccccagacucagagggaaggcucucug

SEQ ID NO: 38818 - RNA, 64 nt, Human
ccagaaguuugaguccagcccaggcaacacagcaagaccccaucucuauaaaaagaaaaaauaa

SEQ ID NO: 38819 - RNA, 64 nt, Human
guucauuaaggacuccaccccucagagcucacucagaccccaaggacagaggugacuggggcuu

SEQ ID NO: 38820 - RNA, 64 nt, Human
uugaagcccagccacaaguguuggagcugcagagagaccccaaagguaguagauugugccagau

SEQ ID NO: 38821 - RNA, 64 nt, Human
gcuaaaacucagcugcagccuggacaguagagcgagaccccaucuuaaaaauaaagaaggcugg

SEQ ID NO: 38822 - RNA, 64 nt, Human
ugcguaggagcaagaagggacagggaauuucaagagaccccaaauagccugcucaguagagggu

SEQ ID NO: 38823 - RNA, 64 nt, Human
aaagucaggccugcugcaggacaggaucccccagagaccccauuugccucucaacacucagacc

SEQ ID NO: 38824 - RNA, 64 nt, Human
caggacccaaggcaggcuguuccuuggggcggucagaccccagucaggagcaaugacugacugg

SEQ ID NO: 38825 - RNA, 64 nt, Human
gccccucagaagcaggaaacccucaaacccagccagaccccaggccggggcauugccagggagg

SEQ ID NO: 38826 - RNA, 64 nt, Human
aaaaggcaaaucuuuucaccucuggcuauuccugagaccccaggaagucaggaaaagccuuuca

SEQ ID NO: 38827 - RNA, 64 nt, Human
agagcccuuccuguucccagaugccuugguccaaagaccccaccccucugcugguccugccaac

SEQ ID NO: 38828 - RNA, 64 nt, Human
aucuucucccuccucccaaccuacacccucaaguagaccccagugucucuuguucuccucugag

SEQ ID NO: 38829 - RNA, 64 nt, Human
aaggcaaagucaaauggggaccagaauaaaucuuagaccccacaguccuucccauuuccagccc

SEQ ID NO: 38830 - RNA, 64 nt, Human
cucccugcuugccuccacucccuucugacuuuccagaccccagguccagucugcagauccuacc

SEQ ID NO: 38831 - RNA, 64 nt, Human
auggugaaaccaaacaaauacaaaauccuucuccagaccccagaacuagaaaccccgggccauc

SEQ ID NO: 38832 - RNA, 64 nt, Human
ucaagggaauuggucccagguacaacagagagcaagaccccaaacagggcguggcugccacgau

SEQ ID NO: 38833 - RNA, 64 nt, Human
uucuuuccuguagccuagcauggagaaucugaccagaccccauuuugagaaggucagccuacac

SEQ ID NO: 38834 - RNA, 64 nt, Human
agaaacucacauaacuagcccagguaacacagcaagaccccaucucuacaaaaauauuaaaaau

SEQ ID NO: 38835 - RNA, 64 nt, Human
uucuccuuuuccccugcuggcuggugacugucagagaccccaucacugaguuuugugugaugag

SEQ ID NO: 38836 - RNA, 64 nt, Human
agccagugacccagccccaccaaugggccuccagagaccccaggaacaauaaaaugucuucucc

SEQ ID NO: 38837 - RNA, 64 nt, Human
uaaaugcacuuucuuccuccccucuuucuccauaagaccccaggcagaggugggugccuccccu

SEQ ID NO: 38838 - RNA, 64 nt, Human
gcgacaagggugaacugggagaggacuuacucagagaccccaacaggugauacugcacaaagcc

SEQ ID NO: 38839 - RNA, 64 nt, Human
ugugaccucugccugaaaaagcagguauuuucucagaccccagagcaguauuaaugaugcagag

SEQ ID NO: 38840 - RNA, 64 nt, Human
aauugaguuugagacuagccugggcaacauagugagaccccaucucuauuuaaaaaaugaacaa

SEQ ID NO: 38841 - RNA, 64 nt, Human
cagaugccucuucugugccuuaagcagagucaggagaccccaaggcaugugagcaucugcccag

SEQ ID NO: 38842 - RNA, 64 nt, Human
ggguguccagggagaaggcucugucccugccgccagaccccagugguugccacugaagaccuca

SEQ ID NO: 38843 - RNA, 55 nt, Human
gcgcaggugcggggcagugaacuucagaccccaaaggagucagagcaugcggggc

SEQ ID NO: 38844 - RNA, 64 nt, Human
gucgacucaagaggcugccaggaagcagagaugcagaccccaaggagacugggcuggggcuggu

SEQ ID NO: 38845 - RNA, 64 nt, Human
auggggaucaggccccagagcuugcuguccccugagaccccauccuggggagaggggaggacuc

SEQ ID NO: 38846 - RNA, 64 nt, Human
ucaggaguuugagaccagccugggcaauaucgugagaccccaucucuacaaaaauacaaauuaa

SEQ ID NO: 38847 - RNA, 64 nt, Human
ggcagguucgugcccugcugcggccagccugacuagaccccacccugagguccugcauuucuca

SEQ ID NO: 38848 - RNA, 64 nt, Human
ccaggaauuugagaccagccuaggugacauagugagaccccaucucuacaaaaaauaaaaaauu

SEQ ID NO: 38849 - RNA, 64 nt, Human
gauccuggaggauuuccuacccccguccucuucgagaccccagucgugauguggaggaagagcc

SEQ ID NO: 38850 - RNA, 64 nt, Human
guggggaggggagagcucagcccccgacucacucagaccccaaggcccacuguccagcugcaga

SEQ ID NO: 38851 - RNA, 64 nt, Human
ucccaagauuagccuguuauccuguuaucuacugagaccccaaauuucucaccaauguuuuggg

SEQ ID NO: 38852 - RNA, 64 nt, Human
cagauccccugcugaacagauacacagaguucucagaccccacccccacccucaggugggcugg

SEQ ID NO: 38853 - RNA, 64 nt, Human
gauggacccccagcaaaucaggaccuaucuaggcagaccccagccagacccccgccagacagac

SEQ ID NO: 38854 - RNA, 64 nt, Human
uucaggcugcugcaggaggccaggcccaggccagagaccccaggcagccugagcucuuggaugu

SEQ ID NO: 38855 - RNA, 64 nt, Human
ugaauacacacauauauauuacaagggauaauuuagaccccauacaaguuuauaaagagucauu

SEQ ID NO: 38856 - RNA, 64 nt, Human
ugccagugugacccuugaagacagugccccucagagaccccaagaccuuagggauugacaccug

SEQ ID NO: 38857 - RNA, 64 nt, Human
cuaccacugaugcgagggaaaggccaguggcuggagaccccaugugcaguucuuggauacucug

SEQ ID NO: 38858 - RNA, 64 nt, Human
cccgcugcacacagacggccuagggguggcgcucagaccccacccuacgcucaucucuggaagg

SEQ ID NO: 38859 - RNA, 64 nt, Human
cuugcuggcuucuguugcgccacugagacggcagagaccccaggaucccagagcuucccaggau

SEQ ID NO: 38860 - RNA, 64 nt, Human
aacuggaccaccagagaauggacaccauccaggaagaccccagcacagacucacauauggacga

SEQ ID NO: 38861 - RNA, 64 nt, Human
cuaagacccagggacccagcgacuaugcccacccagaccccagagcguucccauaacccugaca

SEQ ID NO: 38862 - RNA, 64 nt, Human
cugaggggccucagggcuugugggggguaggcugagaccccaccaccaaagguuaagugagguc

SEQ ID NO: 38863 - RNA, 64 nt, Human
ugagcagcugccggacgccugggucaggaauccaagaccccaccucuuaaggacugguuccuca

SEQ ID NO: 38864 - RNA, 64 nt, Human
acccugggugccgccagacccuucucuucuacaaagaccccagcaggagugggagggucugcaa

SEQ ID NO: 38865 - RNA, 64 nt, Human
cugccagccucgcugggcagggcuggccguagccagaccccaagcuggcccacugguccccucu

SEQ ID NO: 38866 - RNA, 64 nt, Human
cccagcacaaguggggcaaagccagcaugcaagcagaccccaccaccacagcccaccuccgucc

SEQ ID NO: 38867 - RNA, 64 nt, Human
gcuuguacauaugugauugcugugggcacaccccagaccccaugucauagcugccgucccgacg

SEQ ID NO: 38868 - RNA, 64 nt, Human
aggcugucccacgugaugcugacaugagccucagagaccccaaucccaugccugggggagagac

SEQ ID NO: 38869 - RNA, 64 nt, Human
agacucgcggaaggccccguccccagcagaguccagaccccacaacuucaggagcucuuucccg

SEQ ID NO: 38870 - RNA, 64 nt, Human
uccgugaggcagggacaagucuuucuccucuuugagaccccagugccugcacaucaugagccuu

SEQ ID NO: 38871 - RNA, 64 nt, Human
gcuucuuggaagagccuagaagauuccuggauggagaccccauugguucagccucaagucuggc

SEQ ID NO: 38872 - RNA, 64 nt, Human
ggcagguggggaagcaguuuggcccagcccaaggagaccccaccuugagccuuauuuccuaaug

SEQ ID NO: 38873 - RNA, 64 nt, Human
ccgaggcccagaguggccugcccccgggagccaaagaccccaguggccacacugggauagggug

SEQ ID NO: 38874 - RNA, 64 nt, Human
cgaggaggugccuggagugcccacccugggagacagaccccaccuccuuggguagugagcagug

SEQ ID NO: 38875 - RNA, 64 nt, Human
ccaggaguucaagaccagccugggcaacacagcgagaccccaucucuuaaaaaauaacagacuu

SEQ ID NO: 38876 - RNA, 64 nt, Human
cucaguggggcuucucuucccuccaugagccuggagaccccaggggaggauccauuugggauga

SEQ ID NO: 38877 - RNA, 64 nt, Human
aagggggccugggggugcgugcagccugucggggagaccccacucugacagugggcacacggca

SEQ ID NO: 38878 - RNA, 64 nt, Human
uacgacacugcacuccagccuaggcgacagagcaagaccccauucucuuacaaagucucuauua

SEQ ID NO: 38879 - RNA, 64 nt, Human
acggguguaaacacugaugguauaucaguaucugagaccccaaacucuccaaauacugauggug

SEQ ID NO: 38880 - RNA, 64 nt, Human
cgcccgccaaaccuggugguccugggcggccccgagaccccaacacaugcuucuucgaggggca

SEQ ID NO: 38881 - RNA, 64 nt, Human
gcccgcguccuacgcaggcucugccacagggguuagaccccagguccgacgcuugaccuuccug

SEQ ID NO: 38882 - RNA, 64 nt, Human
uccuuuuuauuuguagcagcauaauuauuuccaaagaccccaguauuugcugcuauuuuuaaaa

SEQ ID NO: 38883 - RNA, 64 nt, Human
aucucucaccuguucucaccccucugcagccccaagaccccacuggccaccccucccucugguc

SEQ ID NO: 38884 - RNA, 64 nt, Human
cguuaguuccucuucccgagauggggccgccgagagaccccagcgccuuugaaaagcaagguuu

SEQ ID NO: 38885 - RNA, 64 nt, Human
gaaugggucagggacuccaggccaaguccaacagagaccccaaacccaccacacaccagcagcc

SEQ ID NO: 38886 - RNA, 64 nt, Human
agcucuuugagacgagacuccaaguaguaaucccagaccccaccuugcucaucccaaccuguuc

SEQ ID NO: 38887 - RNA, 64 nt, Human
cuggagcuuaguuccaaugcauuuggcuccagaaagaccccagugccuuuugacaauggccagg

SEQ ID NO: 38888 - RNA, 64 nt, Human
ccccaccucuaugcccugagcccugguaguccagagaccccaacucugcccuggcuucucuggu

SEQ ID NO: 38889 - RNA, 64 nt, Human
ucaguaggcuucuggaauagaaacagugguuugaagaccccacugccaccuuuauggacuggcc

SEQ ID NO: 38890 - RNA, 64 nt, Human
uccccaauuaccauggcaaccuuugccagagcacagaccccagagucuugugguucucuaacuc

SEQ ID NO: 38891 - RNA, 64 nt, Human
auagccacugcacuccagccugggcaauauagcaagaccccauccuuuaaaaaauuuuagaacu

SEQ ID NO: 38892 - RNA, 64 nt, Human
uaaacuauuggugaggagcucgagugguuuguauagaccccagauuuuuguuuacuuuaaugua

SEQ ID NO: 38893 - RNA, 64 nt, Human
acgugaauaggcugcuuuuugcuuucuucuuuccagaccccacaguagagcacuuuucacuuau

SEQ ID NO: 38894 - RNA, 64 nt, Human
acaccaggccugacucaggcagguucugccccccagaccccacacacggccgccccacgugcug

SEQ ID NO: 38895 - RNA, 64 nt, Human
caugcacguggaggaggagcuggcuuucagccccagaccccacgcuagcacuuuccacgcugcu

SEQ ID NO: 38896 - RNA, 64 nt, Human
agugggagaggcugcagcaaggcuuugccucugcagaccccaucuuaguggcacggugcuuggg

SEQ ID NO: 38897 - RNA, 64 nt, Human
gugugaggggcuuaaugaccaccacagggagcucagaccccaacccuggaucccaggagaaagg

SEQ ID NO: 38898 - RNA, 64 nt, Human
cucugcacccucuggaacccuggcccaauuccucagaccccagaguggccugggacccaagcug

SEQ ID NO: 38899 - RNA, 64 nt, Human
uccuggaugcuuucaauguuuuuaaugcuaacauagaccccaaaauuagauauaaagaauuggg

SEQ ID NO: 38900 - RNA, 64 nt, Human
uggcugugauuaauuauugaaagugggguguugaagaccccaacuacuauuguagaguggucua

SEQ ID NO: 38901 - RNA, 64 nt, Human
aacuaaagccuuuuuaagaaaugccagcugcuguagaccccaugagaaaagaugucuuaaucau

SEQ ID NO: 38902 - RNA, 64 nt, Human
gagugcaccuccaucuccaagcacugcugcuggaagaccccauucccucuuuaucuaucaacuc

SEQ ID NO: 38903 - RNA, 64 nt, Human
acaaaacugcagugccggucagguauccccccaaagaccccagaaguaacccuaggcucaaugg

SEQ ID NO: 38904 - RNA, 64 nt, Human
uucuaagugggccuuuaaaaaccccagcugccagagaccccaacacuaagcccuaaaucugcug

SEQ ID NO: 38905 - RNA, 64 nt, Human
cacaccacugcacuccagccugggcaacagagcaagaccccauccuccaccccccccaaaaaau

SEQ ID NO: 38906 - RNA, 64 nt, Human
auccucugauauacaauuagagauauuuuuauauagaccccaagcauucugugcauaaaaguua

SEQ ID NO: 38907 - RNA, 64 nt, Human
cacugggccugauacuuagcugacauggauuugcagaccccagggugggcagaugucuccagug

SEQ ID NO: 38908 - RNA, 64 nt, Human
cugugaauuagcuggaguaggagucugggaguggagaccccaggaaacagcaugaggugagggu

SEQ ID NO: 38909 - RNA, 64 nt, Human
uucccagcaaaugaaccuacggguggcuuuuccuagaccccaaagaggugaauugcauuuaaau

SEQ ID NO: 38910 - RNA, 64 nt, Human
gguccuagccuggccagugaugcugcuggcguccagaccccagacucacuccaagcacucuugu

SEQ ID NO: 38911 - RNA, 64 nt, Human
ccacuggcucaagguguagagggagcagagacgaagaccccaggaagucauccugcaaugggag

SEQ ID NO: 38912 - RNA, 64 nt, Human
guccuaggcaauggaguccagauuuuaguaagucagaccccaugugugagaaggaaagcuggaa

SEQ ID NO: 38913 - RNA, 64 nt, Human
ucaagagaucgagaucacccuggcccacauggugagaccccaacucuacuaaaaauacaaaaau

SEQ ID NO: 38914 - RNA, 64 nt, Human
ugagacauucuugcuauaacuaagugcuucuccaagaccccaacugaguccccagcaccugcua

SEQ ID NO: 38915 - RNA, 64 nt, Human
cucacuuguaaagugacuaccuuaauguguauagagaccccagucuacuauuauuugggaaaau

SEQ ID NO: 38916 - RNA, 64 nt, Human
uuguaccacugcauuccugcugagcaacagagugagaccccaucucaaaaaagaaaaaaaaagg

SEQ ID NO: 38917 - RNA, 64 nt, Human
uagaggucaguggugaugccucuugcugcuccccagaccccaucucuccugaagaccugccacg

SEQ ID NO: 38918 - RNA, 64 nt, Human
ggaaggcacagggagaagggauaacccuacacccagaccccaggcuggacaugcugacuguccu

SEQ ID NO: 38919 - RNA, 64 nt, Human
aaauaugaacacuuuauaauuguauguucuuuuuagaccccauaaauccuguauacaucaaaga

SEQ ID NO: 38920 - RNA, 64 nt, Human
gacugaacagacaucagcacaucagacgucuuuuagaccccaagacaauuuuucuguuucaguu

SEQ ID NO: 38921 - RNA, 64 nt, Human
gggaacaagcuucuggacuugggcuuacagagcaagaccccacaacuguaggcugggggugggg

SEQ ID NO: 38922 - RNA, 64 nt, Human
uaaccuggggauugggcaguguggaagaacguguagaccccagaaugaaacaugggguuggagu

SEQ ID NO: 38923 - RNA, 64 nt, Human
gggaucaggaaccacacaauccccaggguuccugagaccccaggccuaaaccugagacuuccuc

SEQ ID NO: 38924 - RNA, 64 nt, Human
ugcuucucccaacagcccacuguuaggagguaguagaccccagccucaaggcucugaccuucuu

SEQ ID NO: 38925 - RNA, 64 nt, Human
uuaauagcagcaguccucccccuaccccgccccgagaccccaccccgagaccccaccccggacc

SEQ ID NO: 38926 - RNA, 64 nt, Human
uccucccccuaccccgccccgagaccccaccccgagaccccaccccggaccaguuacauucguu

SEQ ID NO: 38927 - RNA, 64 nt, Human
gcaaacaaaggaaggagcuggguggccuugagggagaccccagccccgaggaggaugagggcau

SEQ ID NO: 38928 - RNA, 64 nt, Human
cugggaguuugaguccagcaugggcaacauaacaagaccccaucccuuauuaaaagaaaaaaaa

SEQ ID NO: 38929 - RNA, 64 nt, Human
uuugauuucuucccucucccuggugucucccccaagaccccaaauaaagcaauacacuguuaac

SEQ ID NO: 38930 - RNA, 64 nt, Human
gucccuguauccucuggauguaaaaagcaaggagagaccccaacugucuccauggagaagaacu

SEQ ID NO: 38931 - RNA, 64 nt, Human
auagacaccaggcuuauuggggcgugcacagccaagaccccaagaagugacuccuuguaaaaug

SEQ ID NO: 38932 - RNA, 64 nt, Human
ucucugcaccuccuuaggcccugccucugggcucagaccccaaccuagucaaggggauucuccu

SEQ ID NO: 38933 - RNA, 64 nt, Human
ccaagagguggaaaccaucuugggcuacauagagagaccccaucucuacaaagaaagauuuaaa

SEQ ID NO: 38934 - RNA, 64 nt, Human
aaagccaagcccaggcaugagcucuggcaaagcaagaccccagauucuccauuuuugccugugg

SEQ ID NO: 38935 - RNA, 64 nt, Human
gacugggcaugaagaagggagcacagcagcuacuagaccccauuagcaccucauuagcccacaa

SEQ ID NO: 38936 - RNA, 64 nt, Human
ggcccagguuggauggggaaaggcuaauggggucagaccccaccccgucuaccccuccagucag

SEQ ID NO: 38937 - RNA, 64 nt, Human
ggaaaugugaccagugguuucugcucggagcugcagaccccagggcucuugguggaggcagggg

SEQ ID NO: 38938 - RNA, 64 nt, Human
cuuuauaaauuuucuuaaagauuaagaaaauuuaagaccccauugaguuacuguaaugcaauuc

SEQ ID NO: 38939 - RNA, 64 nt, Human
cagaugccgauacaggcccuugguguuuuaccacagaccccagcgucaggugggaguacugcaa

SEQ ID NO: 38940 - RNA, 64 nt, Human
ggcugugcuuucccuuccaagccagggcuuccaaagaccccacugccccggagcugaagccgac

SEQ ID NO: 38941 - RNA, 64 nt, Human
gagcccugcaccccccagguccugggacuccugcagaccccacuccauucccgcuccuggaaca

SEQ ID NO: 38942 - RNA, 64 nt, Human
aacuuuggggacuucugagaucagcguccuaccaagaccccagcccaacucaagcuacagcagc

SEQ ID NO: 38943 - RNA, 64 nt, Human
uuuuuaaaugcccuugaaucuagcuuugccuuggagaccccagugggugcugcuccugccguuu

SEQ ID NO: 38944 - RNA, 64 nt, Human
ugcaccacugcacuccagccugggugauagagcaagaccccaacucaaaaaaaaaaaaaaggau

SEQ ID NO: 38945 - RNA, 64 nt, Human
cgaggcugacaaugacuccuguuuucacgcugagagaccccacuccccugcugagaucgcgcca

SEQ ID NO: 38946 - RNA, 64 nt, Human
ccaggaguuugagaccagccugggcaacauagcgagaccccaucucuacaaaagauuaaaaauu

SEQ ID NO: 38947 - RNA, 64 nt, Human
ucugcagugagcuaugaucgcaccacugcauuccagaccccaucucgaaaaaaaaaaaaaaaaa

SEQ ID NO: 38948 - RNA, 64 nt, Human
uccugcuggggcggccagcacccucuccacgugcagaccccaugcgucccggagccuggugugu

SEQ ID NO: 38949 - RNA, 64 nt, Human
aggagccagugcccacuauggcccugggagagccagaccccaaggcccagacaggcucagguuu

SEQ ID NO: 38950 - RNA, 64 nt, Human
ggauggggguggugggaagaauuggccacguuggagaccccaugccaccccaccauggugagug

SEQ ID NO: 38951 - RNA, 64 nt, Human
ccgcaaggacuacgucuaagggacagacgcagggagaccccaccaccaccaccaccaccaacac

SEQ ID NO: 38952 - RNA, 64 nt, Human
agcaguucucagggugcugaccucucucucccacagaccccagacacccauuguccauagccuu

SEQ ID NO: 38953 - RNA, 64 nt, Human
ucucauuaccccuacacaucucuccacggagcccagaccccagcacagauauccacacacccca

SEQ ID NO: 38954 - RNA, 64 nt, Human
gugucccugaggacagcacagaggcgggacucagagaccccauuccucuucacgcagcccuuac

SEQ ID NO: 38955 - RNA, 64 nt, Human
gaaagaggugaguaacuugcccauuucuccacagagaccccauuuaaauaacacaaaauugacc

SEQ ID NO: 38956 - RNA, 64 nt, Human
gggugcagaugagccuuagguuccagccgccugcagaccccaccccagcaggcucacucagcaa

SEQ ID NO: 38957 - RNA, 64 nt, Human
ccgcuuuggagacgagauggcucuuguucagucaagaccccagacucuggccacaaaaaugcca

SEQ ID NO: 38958 - RNA, 64 nt, Human
gccuccaggaccgcugcgggugguaaccaguggaagaccccagcccccagggagaggaacccgu

SEQ ID NO: 38959 - RNA, 58 nt, Human
ccacugccauuguccugugagcugccaaagaccccacggggugcccgcaugucccugu

SEQ ID NO: 38960 - RNA, 64 nt, Human
cauguggagcgagagggaggcagguggacgcugcagaccccagguucagugcggccccucggcu

SEQ ID NO: 38961 - RNA, 64 nt, Human
ugaaugucuuguuccugugcauugguggcaucacagaccccagcuggggcgcgaugucaaaggu

SEQ ID NO: 38962 - RNA, 64 nt, Human
aagaucaaagaguuagaccaaugcuugaauaaguagaccccaagcauccuuuucuaaaaaguga

SEQ ID NO: 38963 - RNA, 64 nt, Human
uggaggagcuugggugacagccaggugagcacccagaccccagacccucaugugcugugugccu

SEQ ID NO: 38964 - RNA, 64 nt, Human
gaagcggagaccauuuccaggccuuauugagaccagaccccaagucccccacccccauccugcu

SEQ ID NO: 38965 - RNA, 64 nt, Human
ucuuaauucaaaccagaugccuguacuaguuuuuagaccccaagucaaccuuucugagccacag

SEQ ID NO: 38966 - RNA, 64 nt, Human
ggaaaaagucaaccucccaguuuaaaggaugggaagaccccaaucaccagguuauuggaucugu

SEQ ID NO: 38967 - RNA, 64 nt, Human
ucauuccccgccgggagcaacaucucucuucucgagaccccagccccuccgcugucuacccaug

SEQ ID NO: 38968 - RNA, 64 nt, Human
agggcucuccccuugugauucuguccccuccccaagaccccaccucauaucaucuuauggguua

SEQ ID NO: 38969 - RNA, 64 nt, Human
cagaaacuggaggacaugauccaggagcuucaggagaccccaucgcagacgucaguggucucug

SEQ ID NO: 38970 - RNA, 64 nt, Human
ccagaaguucgagaccagccugggcaauguagugagaccccaucacuacuaaaaauacauaaau

SEQ ID NO: 38971 - RNA, 64 nt, Human
cuggaugauuuugcagguccaaugcaaacaucacagaccccacccaugcauaggagagacucua

SEQ ID NO: 38972 - RNA, 64 nt, Human
cugcuuagagugaacaugucuauggacuuuaaaaagaccccacgcaauuugacuuuguggcaau

SEQ ID NO: 38973 - RNA, 64 nt, Human
aaccaacaggcaaaacgugggugcaaaagugaugagaccccacacuuuacacucguggugacaa

SEQ ID NO: 38974 - RNA, 64 nt, Human
gcauggaaugcugaugacuuggagcaggccccacagaccccacagaggaugaagccaccccaca

SEQ ID NO: 38975 - RNA, 64 nt, Human
caagucuuuuaaccuggguguuagcauuuuaaagagaccccacaggaguucuggccugugacua

SEQ ID NO: 38976 - RNA, 64 nt, Human
ucaggaguuugaaaccagucuggacaacauagggagaccccaucucuaccggaggaaaaaaaaa

SEQ ID NO: 38977 - RNA, 64 nt, Human
ccccguuuuaaggacauuaaaagcuaucaggccaagaccccagcuucauuaugcagcugagguc

SEQ ID NO: 38978 - RNA, 64 nt, Human
uuauucucuuggcugguucucucauugaauuaucagaccccaagaggagauauuggaacaggcu

SEQ ID NO: 38979 - RNA, 64 nt, Human
ugggacuggcccugcuccuguacugcuauccgccagaccccaagggccugccagggacccggcg

SEQ ID NO: 38980 - RNA, 64 nt, Human
gcucccuccgcucccuccugucaccuaccagggcagaccccacuaagccguugagucucuuccu

SEQ ID NO: 38981 - RNA, 64 nt, Human
ucauucugcagcaccgccucuuggggcaguggucagaccccacacgcccucucugggcccacca

SEQ ID NO: 38982 - RNA, 64 nt, Human
ccuuguggcccccagcuucuguuucaagcugggcagaccccaggaucccuucccucccuaagga

SEQ ID NO: 38983 - RNA, 64 nt, Human
uguuuucuauucuuuauuuuuccugcaacccaccagaccccaggccucaccggaggcccgguga

SEQ ID NO: 38984 - RNA, 64 nt, Human
agcagauguuacagucuuagggauccgggaugggagaccccacuuuagaaagggucgucacucc

SEQ ID NO: 38985 - RNA, 64 nt, Human
gcucaggaguucuagaccaaucugggcaacagagagaccccaucucuuuuaaauaaaaaguuaa

SEQ ID NO: 38986 - RNA, 64 nt, Human
gggccauagcccagugagcagccuggagcccuggagaccccaccagccucaccagcgcuugaag

SEQ ID NO: 38987 - RNA, 64 nt, Human
cagggcccgggguucggggauagaagccccgccgagaccccacagggaccucagucaccuuuga

SEQ ID NO: 38988 - RNA, 64 nt, Human
cuucuggaccuggaaagccuggggaaggacugacagaccccaggaccagcccuggggcucaggg

SEQ ID NO: 38989 - RNA, 64 nt, Human
accaaggcagcuuuccuuacccugacacagccccagaccccacaaagccuucuggaccuggaaa

SEQ ID NO: 38990 - RNA, 64 nt, Human
cugcuggcggccucuuccugggagccaugaccucagaccccacccacacuccagaucgagaccc

SEQ ID NO: 38991 - RNA, 64 nt, Human
gggccuggggcccucacuccugcccacgccucccagaccccagaacggagcuucaagucagaca

SEQ ID NO: 38992 - RNA, 64 nt, Human
ugccggcaguagcccccacgcuggccccagccucagaccccacccagcaccuucccagacacgc

SEQ ID NO: 38993 - RNA, 64 nt, Human
cccagggucgccagagccgcgagccacuccagcgagaccccaccuugcauggugccccuuccug

SEQ ID NO: 38994 - RNA, 64 nt, Human
aaaccuucagagaguggaugggagcgaaguaaggagaccccaccugagcagauacaugguauug

SEQ ID NO: 38995 - RNA, 64 nt, Human
cgugccacuguacucuagccuggaagacagagugagaccccaucucaggaaaaaagaaaaaaaa

SEQ ID NO: 38996 - RNA, 64 nt, Human
gcuggucacagagucuccugggcacagguuauacagaccccagccccauucccaucuacugaaa

SEQ ID NO: 38997 - RNA, 64 nt, Human
uccucuuaucuuccuuuugugguuuuuaauuugaagaccccagagaauuccauuacauaaugau

SEQ ID NO: 38998 - RNA, 64 nt, Human
cuguggugugaccugaguuggugacacaggccacagaccccagagcuuggcuuuugaaacacaa

SEQ ID NO: 38999 - RNA, 62 nt, Human
gagaagaggagccucgguagguggucgcucucagaccccacuguccaccggggcgcagaccc

SEQ ID NO: 39000 - RNA, 64 nt, Human
gcuugcuuuccccuugggugcuggccucaaugucagaccccacgcgcugccccuuccuggccug

SEQ ID NO: 39001 - RNA, 64 nt, Human
cugccucugccuggcagcucugugggaaaguggaagaccccaugaugacaucauggggagccag

SEQ ID NO: 39002 - RNA, 64 nt, Human
uccucaucuguggagcaagccaacucagugccccagaccccaccugaucugcaucuuuguuugc

SEQ ID NO: 39003 - RNA, 64 nt, Human
ugaggcagagacaacuucuaagaauuuggcugccagaccccaggccuggcugcugcugugugga

SEQ ID NO: 39004 - RNA, 64 nt, Human
ucuccaauuccuaguauguaacuagagguucaagagaccccaaauuccugccauuuuccccauu

SEQ ID NO: 39005 - RNA, 64 nt, Human
uguguacggcuugagguuucagcauccaggcugcagaccccacgcagugucucauacaguggaa

SEQ ID NO: 39006 - RNA, 64 nt, Human
uggauuacaugccaucugggacaggccaugugggagaccccaguugugccuuugcuacagaucu

SEQ ID NO: 39007 - RNA, 64 nt, Human
cuuguucuucaggagaugauucuguuuuuucuccagaccccaugccuuacgaaccaugccuucc

SEQ ID NO: 39008 - RNA, 64 nt, Human
ccccucacagagcuccucuauccgaggccauuggagaccccaguuucucaagaauucagcucug

SEQ ID NO: 39009 - RNA, 64 nt, Human
ugacggccugcucaguggagccaggagcuaacucagaccccaaagcaagcagggggccaguggc

SEQ ID NO: 39010 - RNA, 64 nt, Human
gaacccagcagaggugugacgggaggcuggggagagaccccagcaccuugagcacacaggagcc

SEQ ID NO: 39011 - RNA, 64 nt, Human
auuccaaauccugucuuuuccccacuauuccauuagaccccacaaauguuaguugugugugugu

SEQ ID NO: 39012 - RNA, 64 nt, Human
ccuggacucagggcaggugccguggguucuccagagaccccagcaacuggcccaggaugcaggc

SEQ ID NO: 39013 - RNA, 64 nt, Human
cauaggccccaccuccacgucccggcugggccccagaccccagcuuccugcccuccaccgggag

SEQ ID NO: 39014 - RNA, 64 nt, Human
uucacugccccucucccucaagccuaagacacuaagaccccagacccaaagccaaguccaccag

SEQ ID NO: 39015 - RNA, 64 nt, Human
ccuuauacuuggagucacaggggccaaaggccugagaccccacccugcccccaaacuggcuaag

SEQ ID NO: 39016 - RNA, 64 nt, Human
agacagucucccagagcugagggcuugccucuggagaccccagccccagagggcuuuguggagg

SEQ ID NO: 39017 - RNA, 64 nt, Human
gucuccaccauagacucaguggccuggccuccccagaccccagagccaagaacacuaagcacuc

SEQ ID NO: 39018 - RNA, 64 nt, Human
ccaggagugcaagaccugccugggcaauauacugagaccccauucuccacaaaaaggaaaaaua

SEQ ID NO: 39019 - RNA, 64 nt, Human
guggccacaugggcaucaggggcuggccccacagagaccccacagggcagugagcucugucuuc

SEQ ID NO: 39020 - RNA, 64 nt, Human
aggggagaugugcucccagagccucucugcuguaagaccccagcuuuuccuggaagaugggacu

SEQ ID NO: 39021 - RNA, 64 nt, Human
ccaggaguuugagaccagccugggcaauguagcaagaccccaucucuauauaaaauauaaaaau

SEQ ID NO: 39022 - RNA, 64 nt, Human
aacccucuuuauugaacauuagccagcccagcccagaccccagggcugccuaaggacacagaga

SEQ ID NO: 39023 - RNA, 64 nt, Human
caccaaccaaccacacccggugggggcacagcacagaccccagagccaggaaccucucagccga

SEQ ID NO: 39024 - RNA, 64 nt, Human
caccaaccagccacacccggugggggcacagcacagaccccagaggcaggaaccucucagccga

SEQ ID NO: 39025 - RNA, 64 nt, Human
caccaaccagccacacccagugggggcacagcacagaccccagagccaggaaccucucagccga

SEQ ID NO: 39026 - RNA, 64 nt, Human
caccaaccagccacucccgguggggacacagcacagaccccaaagccaggaaccucucagccga

SEQ ID NO: 39027 - RNA, 64 nt, Human
ccagaaauucaagacccgccugggcaucauaaugagaccccaucucuacaacaaaauuuaauaa

SEQ ID NO: 39028 - RNA, 64 nt, Human
ugauccagagcacagaucuguuucgugcauuggaagaccccacccaagcuuggcagccgagcuc

SEQ ID NO: 39029 - RNA, 64 nt, Human
cagcucugggggacuccuuccuugaacccuaauaagaccccacuggagucucucucucuccauc

SEQ ID NO: 39030 - RNA, 64 nt, Human
cuccaccccggcucccggacgccagcugggcgucagaccccaccggggcaaccuugcagaggac

SEQ ID NO: 39031 - RNA, 64 nt, Human
gagagcaucuccuggcaggggucucuucccaaccagaccccacccaggcacauuagcgaccagg

SEQ ID NO: 39032 - RNA, 61 nt, Human
ccccggaugaggccaucugagccuccagaccagaccccaaaccagcccuugagucugucac

SEQ ID NO: 39033 - RNA, 64 nt, Human
ucuuguucaaaaaucaggaaaagaaaagauuugaagaccccaagucuugucaauaacuugcugu

SEQ ID NO: 39034 - RNA, 64 nt, Human
caaggccauauccaccugugcccuggggcuugggagaccccauagggccgggacucuuggguca

SEQ ID NO: 39035 - RNA, 64 nt, Human
ucugugucugauagugauguuggugaaaguucguagaccccaggaguagagaaaagcaacugga

SEQ ID NO: 39036 - RNA, 64 nt, Human
ugagaugcuccggagcugccugcucuaugcccugagaccccacugcugucauugucacaggaug

SEQ ID NO: 39037 - RNA, 64 nt, Human
aucugaguggaugaucaggcccagagcaacccugagaccccagguacccacagcauuggcuguu

SEQ ID NO: 39038 - RNA, 64 nt, Human
accucuaggcccucugcuggugcuguggaggccaagaccccauuaagccuaaaggugauggguc

SEQ ID NO: 39039 - RNA, 64 nt, Human
gaaaaggauuaggugggcacauaagauuccgaucagaccccaaccaugcugcauguguaaagaa

SEQ ID NO: 39040 - RNA, 64 nt, Human
acagcacuccucggcaggcauggcuggugccugaagaccccagaugugagggcaccaccaagaa

SEQ ID NO: 39041 - RNA, 64 nt, Human
ggauucugucacaaugaaagaaaacuguuuauauagaccccauuggaaaagcaaaacgcucuca

SEQ ID NO: 39042 - RNA, 64 nt, Human
uauuucauccucagcaaauuucauccuggcucacagaccccacaaaaaagaucccaguacagau

SEQ ID NO: 39043 - RNA, 64 nt, Human
aaauuuggcucugagucgaggcaaccugcacacaagaccccaccaaggaaugugcaaggacuga

SEQ ID NO: 39044 - RNA, 64 nt, Human
ucccaggcaaagacacccuuagcucaccuuuaauagaccccauaacccacuaugccuuccuguc

SEQ ID NO: 39045 - RNA, 64 nt, Human
uaaccagcgccaaaaaguagauucaucaaacuagagaccccagcuccccuucucgccaucuucu

SEQ ID NO: 39046 - RNA, 64 nt, Human
agacaucaugaucccuccaguuagcucuaauuacagaccccaccaguacagcuugacagcuccc

SEQ ID NO: 39047 - RNA, 64 nt, Human
uacuugcccccaggcuggaagagaagagacagaaagaccccaugacccccccauguggaucccc

SEQ ID NO: 39048 - RNA, 64 nt, Human
uggccauuauuccaaaaggucauuguuucucacuagaccccagggcaccagaugaauuuccaag

SEQ ID NO: 39049 - RNA, 64 nt, Human
gcugcuggcugggugggccagggagcccgccagcagaccccacacagcauguccgccccagggc

SEQ ID NO: 39050 - RNA, 64 nt, Human
agauucccaacaguaaccuccuccuccuggugacagaccccaccugugacugcagcaucuuccc

SEQ ID NO: 39051 - RNA, 64 nt, Human
uuccuugucugccuccugcugcuucuguaacugcagaccccaggcccaauggcaagcccucggc

SEQ ID NO: 39052 - RNA, 64 nt, Human
uacuaaagcacugguucucaaacuuuuuggucucagaccccacucuuagaaauugaggaucuca

SEQ ID NO: 39053 - RNA, 64 nt, Human
ccagcccaaccugcccacguucucuauuguuuugagaccccauugcuuucaggcugccccuucu

SEQ ID NO: 39054 - RNA, 64 nt, Human
aguucauacuagucccuucccaauccaucaguaaagaccccaucugccuuguccaugccguuuc

SEQ ID NO: 39055 - RNA, 64 nt, Human
ccaggaguuugagaccgacaugggcaacaugacaagaccccaucucuacaaaaaaauuaaaaaa

SEQ ID NO: 39056 - RNA, 64 nt, Human
cacaagaugauauaauuggaguauuuuaaacacuagaccccaggagcuuggcugaacuggaaag

SEQ ID NO: 39057 - RNA, 64 nt, Human
aucuggcagggugggauggaggagaagaauuuucagaccccagcggcugagucaugaucucccu

SEQ ID NO: 39058 - RNA, 64 nt, Human
cagcuggcucaggaagccaagaaacuggaugccaagaccccaucccagcggaacaaguggcaac

SEQ ID NO: 39059 - RNA, 64 nt, Human
gccccauucucucacuuccccaucuugucuuccuagaccccacagaguuaaaacuugggauucc

SEQ ID NO: 39060 - RNA, 64 nt, Human
acaaacucaccucccucuccccaacgaggcauggagaccccagcucaacacgcccccucuccau

SEQ ID NO: 39061 - RNA, 64 nt, Human
gguccagccacacuucccugggaaaccuaaguccagaccccaugagcucucagccagcucuuuu

SEQ ID NO: 39062 - RNA, 51 nt, Human
acucucugcaaucuacgugaaagaccccacaccccuccuugcuggaaugug

SEQ ID NO: 39063 - RNA, 64 nt, Human
gucaaggcacaaucaguuuucaggaagugcuucaagaccccaggugaaaugaaaaugcuaagua

SEQ ID NO: 39064 - RNA, 64 nt, Human
uccacgggcucuccugggccaccccugagugcccagaccccauuccacagcucugggcuuccuc

SEQ ID NO: 39065 - RNA, 64 nt, Human
ccucccuuagcucacucugccaucuguuuuggcaagaccccaccuccacgggcucuccugggcc

SEQ ID NO: 39066 - RNA, 64 nt, Human
cccucuuugaaagggcuuuacagugggggcaccaagaccccaaagggcccaggccaggagacug

SEQ ID NO: 39067 - RNA, 64 nt, Human
augagugggcaccaggggacgcucuggcgagggcagaccccaggggaaagcaaagggcgucuca

SEQ ID NO: 39068 - RNA, 64 nt, Human
cacaguuugguccagaggagggaggaggaagggaagaccccaguggugggacccuggaccaggc

SEQ ID NO: 39069 - RNA, 64 nt, Human
ucuuaauuuucuuucacuuaaguuaguuccacugagaccccaggcuguuagggguuauuggugu

SEQ ID NO: 39070 - RNA, 64 nt, Human
aagcgauaccucucgcucccaugcccaucacuacagaccccaagucaagaugaauaucauagcc

SEQ ID NO: 39071 - RNA, 64 nt, Human
ugagguaagaauuugagaccagccugggcaaaauagaccccaugucuacaaaaaaacucaaaac

SEQ ID NO: 39072 - RNA, 64 nt, Human
ccagaaggugcggucuagggaccagugaauaagaagaccccacuucaacuuccccucgaagacg

SEQ ID NO: 39073 - RNA, 64 nt, Human
auuccauuuccugucccucugugguucugacuggagaccccagugugggggaggucuuaccauu

SEQ ID NO: 39074 - RNA, 64 nt, Human
uccucacuccccagccuccucuggauagggaugaagaccccacugggguuggaagugcagaggc

SEQ ID NO: 39075 - RNA, 64 nt, Human
aagaaaugaaaggugacaaaaggcagaaggagggagaccccaaaaagagguaaauuugguaucu

SEQ ID NO: 39076 - RNA, 64 nt, Human
cacucugccuguggacgcugcaccugccacuuaaagaccccaaagacucuguugggaacuguug

SEQ ID NO: 39077 - RNA, 62 nt, Human
agagccacacuuucaaguaaaccaggugguggagaccccauccuuggcugcuugcagggcca

SEQ ID NO: 39078 - RNA, 64 nt, Human
gggggcuucaaguacagauugggcacacuccaccagaccccagcaaggucagcugccccacgcc

SEQ ID NO: 39079 - RNA, 64 nt, Human
gucugccuaggacccagugccgcaggccuggaucagaccccaggaucagaccuuggggucuucu

SEQ ID NO: 39080 - RNA, 64 nt, Human
aacaaugggcccacgaccaagacccuggguguucagaccccaaggccagggccuuucccgcugc

SEQ ID NO: 39081 - RNA, 64 nt, Human
aacguggaugaaaaccacagggauuccggacgccagaccccauuuuauacuucacuuuucucua

SEQ ID NO: 39082 - RNA, 64 nt, Human
aaaaaaauuugccaagagccugagugacagagcaagaccccaucucaaaaaaaaaaacaaacaa

SEQ ID NO: 39083 - RNA, 64 nt, Human
cccacauaccaucacuuggcaauuuuuuagaauaagaccccauuauuaucuauugcuauaaacc

SEQ ID NO: 39084 - RNA, 64 nt, Human
gucuuuuuuaaaaauagagauuucacaucugcccagaccccacucaaaacgauuuggucagguu

SEQ ID NO: 39085 - RNA, 64 nt, Human
cccugccuucagguucucucuggagaaagguuagagaccccaggacaaucaacaugugcaccgu

SEQ ID NO: 39086 - RNA, 64 nt, Human
ggcagccugugccuuugucagcucuucuuucaaaagaccccaccgacagaccgcauuccacccc

SEQ ID NO: 39087 - RNA, 64 nt, Human
ccugccccaacccccagcauucccgggugggcccagaccccaucaccaagacuggccacccgcu

SEQ ID NO: 39088 - RNA, 64 nt, Human
uucuagaaccugggcugugcugcuuuugagccucagaccccaggucagcaucucgguucugcgc

SEQ ID NO: 39089 - RNA, 64 nt, Human
cacagcagguacccacuggcccccuccucaguggagaccccaaggagcugcagcugaacugcag

SEQ ID NO: 39090 - RNA, 64 nt, Human
cuugugcugugcagcccgguuccuaacagaccacagaccccacaccaggucuaucucauuuggu

SEQ ID NO: 39091 - RNA, 64 nt, Human
cucuagguucuuggaauuccuuugugcucaucagagaccccagccuggggaacacgcugcccgc

SEQ ID NO: 39092 - RNA, 64 nt, Human
cccagagcccugucucacucaccccaccugucuuagaccccaguucccagccugacaagcuuuc

SEQ ID NO: 39093 - RNA, 64 nt, Human
gacugcaucuagaaucgcucaaacaccuguuugcagaccccaugcaccagcuggaggggccgua

SEQ ID NO: 39094 - RNA, 64 nt, Human
gugaacuggugccccggcagccugcuggacucccagaccccauccagccaggggaccgcaggcc

SEQ ID NO: 39095 - RNA, 64 nt, Human
ugggcccacuggccguccugcauuucugguuuccagaccccaaugccucccauucggauggauc

SEQ ID NO: 39096 - RNA, 64 nt, Human
cugacccucucugcaaaacucuccccuguccucuagaccccacccuggguguaugugagugugc

SEQ ID NO: 39097 - RNA, 64 nt, Human
ccuaggccccugguacucagucacggcagccaggagaccccaggugaguuucugagcgcauacg

SEQ ID NO: 39098 - RNA, 64 nt, Human
gacccucacaguucacauucagcucagcagagcaagaccccagagaugcuuagagacaggacac

SEQ ID NO: 39099 - RNA, 64 nt, Human
ucacugugggucccauucggcuguuucccccaccagaccccagggaagccggggcccacuccga

SEQ ID NO: 39100 - RNA, 64 nt, Human
guguccaugugugacagcagaaccacaugccccaagaccccagggcuucccccaaaauucugag

SEQ ID NO: 39101 - RNA, 64 nt, Human
aggauuacuugaggccagacugggcaauauagcaagaccccaucucuaaaaaauuaggcauggu

SEQ ID NO: 39102 - RNA, 64 nt, Human
ccgccugccacaccacuccugccuggugcucggcagaccccacugugcccuggccuugggucug

SEQ ID NO: 39103 - RNA, 64 nt, Human
agagcaguugaggcccgggcagggcccccacaccagaccccaacauagcuuccccacccaggca

SEQ ID NO: 39104 - RNA, 64 nt, Human
gacuugcguguagaaaacccggccccugaggaaaagaccccacugguucucugaugaccuggga

SEQ ID NO: 39105 - RNA, 64 nt, Human
gcccuggccccuucccgacccccacccgccauucagaccccauuaagaagguuggcuuggccag

SEQ ID NO: 39106 - RNA, 64 nt, Human
gacacacuuuggaaagugggacccuccagccuggagaccccauggacugaugccuccacugcug

SEQ ID NO: 39107 - RNA, 64 nt, Human
acaaauggauacagccuugacccucccagugaggagaccccaauucagcaauaagucucacccu

SEQ ID NO: 39108 - RNA, 64 nt, Human
uucacuguacucugugggcaaggauggguccagaagaccccacuucaggcacuaagaggggcug

SEQ ID NO: 39109 - RNA, 62 nt, Human
acugcaaacucacugugugagccucguaccccagaccccaagcccauaaaugggaagggaga

SEQ ID NO: 39110 - RNA, 64 nt, Human
accugagccaccaccgagccauggcaggaucgggagaccccaacucccccugaacaauccuuuu

SEQ ID NO: 39111 - RNA, 64 nt, Human
aaccagagagaugggacaugguagacuguggcccagaccccagagcagagaaacuuguucccau

SEQ ID NO: 39112 - RNA, 64 nt, Human
gauaucucauccuagcuaagcucuauaaugcccaagaccccaaacaguacuuuuacuuuguuug

SEQ ID NO: 39113 - RNA, 64 nt, Human
ccaggaguucgagaagagccugggcaacauagugagaccccaucucuacaaagaaaaaaaaauu

SEQ ID NO: 39114 - RNA, 64 nt, Human
ccuccaaggacucuaaaagggggcuauucccuggagaccccagaguaggguugccaguccugca

SEQ ID NO: 39115 - RNA, 64 nt, Human
ugcccagugucggacccugccuuccucccacuccagaccccaccuugucuucccucccuggcgu

SEQ ID NO: 39116 - RNA, 64 nt, Human
accuccuccccuaaagcagcgcggggggcaaauaagaccccaccccucccugcagcuucacagg

SEQ ID NO: 39117 - RNA, 64 nt, Human
gcuauccuuguuuaugccucacuauuggcagaaaagaccccauuuaaaacccagagaacacugg

SEQ ID NO: 39118 - RNA, 64 nt, Human
auaggcagggggcccugccccaccccauccagccagaccccacgcugaccaugcgucaggggcc

SEQ ID NO: 39119 - RNA, 64 nt, Human
uuuguggagcuuucuaauuuacaaaaugcuuuguagaccccauugucuuuaaaccauacaacau

SEQ ID NO: 39120 - RNA, 64 nt, Human
cacaaugcagcugcucugggccucgggagaggagagaccccaguccccugggcugcccuucccg

SEQ ID NO: 39121 - RNA, 64 nt, Human
ccgugggccaaucuacuugaaguuacucggacaaagaccccaaaguggggcaacaacuccagag

SEQ ID NO: 39122 - RNA, 64 nt, Human
ugggaaagcaacagcuaucagagagagaagggccagaccccauagccucuuagauuccuggcag

SEQ ID NO: 39123 - RNA, 64 nt, Human
aacccuguacagaaucgagugcuguagccuggccagaccccagagcccuugugccaucuuucuu

SEQ ID NO: 39124 - RNA, 64 nt, Human
uauauuugaaaaggaaaaaacaaaaaacaaacccagaccccaccugaauugggcuuuuuaacuu

SEQ ID NO: 39125 - RNA, 64 nt, Human
uuucaagcagugaaaggaauucccaucaggacucagaccccaggccgagaucuugcccugaaug

SEQ ID NO: 39126 - RNA, 64 nt, Human
gcagcucgagagagauucagagauggaacacaccagaccccagaucacaaagccaaccaugccc

SEQ ID NO: 39127 - RNA, 64 nt, Human; identical to SEQ ID NO: 39126

SEQ ID NO: 39128 - RNA, 64 nt, Human; identical to SEQ ID NO: 39126

SEQ ID NO: 39129 - RNA, 64 nt, Human
cccaaagacaaacugcaugaaaaggguacagcuuagaccccaaugggaaggcccacccucucuu

SEQ ID NO: 39130 - RNA, 64 nt, Human
ccacagauucuuucccaugggggcucucuuccccagaccccagauccaaggucccucacccugc

SEQ ID NO: 39131 - RNA, 64 nt, Human
agccauaaaauaaguaucuguuacgaguaacugaagaccccauucuccaagcaucagauccauu

SEQ ID NO: 39132 - RNA, 64 nt, Human
aacuagaaacaguuaaagugucuaauaaugcugaagaccccaaagaucucauguuaaguggaga

SEQ ID NO: 39133 - RNA, 64 nt, Human
auguacuuuugcuguuuuacacagagaaacagguagaccccacagaggagaaggaggggauuca

SEQ ID NO: 39134 - RNA, 64 nt, Human
guuucucuacugagccuggggucucuagccagggagaccccaucuuauucaccauguccaagau

SEQ ID NO: 39135 - RNA, 64 nt, Human
guuccuaagaaugugaugggccacaaggaaagagagaccccagucaagcuccuaguaugcccug

SEQ ID NO: 39136 - RNA, 64 nt, Human
gggugguggggugugagaagccugcaauaccccaagaccccagagggcaguccuuaggaagcac

SEQ ID NO: 39137 - RNA, 64 nt, Human
cugucuugcuccuggaugaaccaucuacgggcauagaccccacagggcagcagcaaauguggug

SEQ ID NO: 39138 - RNA, 64 nt, Human
ccaagggugaaucuccugcucugugaaugcuaucagaccccaaaggccaaccuugggcuggguc

SEQ ID NO: 39139 - RNA, 64 nt, Human
ccagccagaggaagugucagcacuuuaaaauucuagaccccaaaaaacuacaaaaucagaaaaa

SEQ ID NO: 39140 - RNA, 64 nt, Human
ucaggagaucgagaccauccuggcgaacauggugagaccccaucucuacuaaaaauacaaaaaa

SEQ ID NO: 39141 - RNA, 64 nt, Human
uaaggaauuauagaccucuaguagcugaaaugcaagaccccaagaggaaguucagaucuuaaua

SEQ ID NO: 39142 - RNA, 64 nt, Human
ugccccacugcacuccagccugggcgacagaacgagaccccaucucaaaaaaaauaaguucugg

SEQ ID NO: 39143 - RNA, 64 nt, Human
gccccccgagcaguguccccagccuagcccugugagaccccauggggacacgggugccuaugua

SEQ ID NO: 39144 - RNA, 64 nt, Human
auuuugggucuucacagagaaucuuucccuugcuagaccccagaauuuuaaaugcauccgucuu

SEQ ID NO: 39145 - RNA, 64 nt, Human
ggcaggacuugaguggcuucggacagggcuucucagaccccagccagcagccuccuuccuacgg

SEQ ID NO: 39146 - RNA, 64 nt, Human
gcagcuacccaccuggggaugggacgugaggccaagaccccagcagagaugccagaauggggga

SEQ ID NO: 39147 - RNA, 64 nt, Human
ccaggagcucgaaaccaguccgggccacacagcaagaccccaucucuaaaaaauuaauauaaau

SEQ ID NO: 39148 - RNA, 64 nt, Human
gcaggaguuugggaccagccugggcuauauagcaagaccccaucacuacaaauuuuuuacaaau

SEQ ID NO: 39149 - RNA, 64 nt, Human
ucaggaguucgagaucagccuggguaacauagcgagaccccaccucugccaaaaaaaaaaaaaa

SEQ ID NO: 39150 - RNA, 64 nt, Human
ggguggcagguauaagacuucugggggcaccccaagaccccagacacccaaguggcaucuuggg

SEQ ID NO: 39151 - RNA, 64 nt, Human
uaugccacugcuuuccagccugggcaacauaguaagaccccaucucuuaaaaaaugaauuuggc

SEQ ID NO: 39152 - RNA, 64 nt, Human
gggagaauaggcagccccacacuuugaagaauacagaccccaguaucuagucguggauauaauu

SEQ ID NO: 39153 - RNA, 64 nt, Human
ucaggaguucaagaccagccugggaaacauagcaagaccccaucucuuaaaaaaaaagaaauau

SEQ ID NO: 39154 - RNA, 64 nt, Human
gcccagagucccccagcggcucgcaugucagcccagaccccaggguccuuggccuaggagagga

SEQ ID NO: 39155 - RNA, 64 nt, Human
guaagaucuauguuccagccugcgcaacauagugagaccccaacucuacaaaaaauaaaaaauu

SEQ ID NO: 39156 - RNA, 64 nt, Human
gaccucacccccagugacuuccgauugaggccaaagaccccaagcugcccgccagcucugacug

SEQ ID NO: 39157 - RNA, 64 nt, Human
acaacuuguaccaaguuucccuucucccaguccaagaccccaaaucaccacaaaggacccaauc

SEQ ID NO: 39158 - RNA, 64 nt, Human
cucucuccgcaguuccuucccuggcugccggaggagaccccacuaacccagccugccugggcuc

SEQ ID NO: 39159 - RNA, 64 nt, Human
cacucuggccauccacuagcccagggggggacgcagaccccacacuccauggagucuggaaugc

SEQ ID NO: 39160 - RNA, 64 nt, Human
ccacucuggccauccacuaauccaggggggacccagaccccacaagccauggagacucaggacc

SEQ ID NO: 39161 - RNA, 64 nt, Human
ugcugccuucccuccugcggggugggggugggacagaccccagugggggccagggccacacuca

SEQ ID NO: 39162 - RNA, 64 nt, Human
cuguccacagggccuuggguucccugagcuguccagaccccaccaucucccggaccccagggag

SEQ ID NO: 39163 - RNA, 64 nt, Human
uucauaguuggauucugagcuuaggaucaucuggagaccccauggagggacuuggaaaggggaa

SEQ ID NO: 39164 - RNA, 64 nt, Human
ccuuuugacccguguguaacuuccucugguaguuagaccccaggcagcuccgaauuugugaacc

SEQ ID NO: 39165 - RNA, 64 nt, Human
ccucacccacaccgugugccuuacuccugucuagagaccccaccucugugaacuuauuuuucuu

SEQ ID NO: 39166 - RNA, 64 nt, Human
cgugacuuggagcucucaccucgagacaccucccagaccccacauccccucagaacgcugcgcc

SEQ ID NO: 39167 - RNA, 64 nt, Human
ccaggaguuggagaccagacuggggaacauggcaagaccccaucucuacaaaaaaauuaaaaaa

SEQ ID NO: 39168 - RNA, 64 nt, Human
agagcagcgagccgcggagccggggagugcccacagaccccagcccccgcgcccccgcccuccg

SEQ ID NO: 39169 - RNA, 64 nt, Human
ccaggaguucaagaccaaccuggacaacauagcaagaccccaucucuuaaaaaaaaaggaaaga

SEQ ID NO: 39170 - RNA, 64 nt, Human
caugauccauggacaaggccaucccggccgugggagaccccagucccgaagucuugccugcagg

SEQ ID NO: 39171 - RNA, 64 nt, Human
auaugcaagcacugagcuccucuuuuguccucugagaccccaucuccauucucacccaguuccu

SEQ ID NO: 39172 - RNA, 64 nt, Human
acggauguccuaggcccccuccccaacucuaaccagaccccaucccccuaagucccuuugucuu

SEQ ID NO: 39173 - RNA, 64 nt, Human
uuuauuuucccaauaauuuugugugagcuacagaagaccccauaccaaauaaacaaaaaaaucu

SEQ ID NO: 39174 - RNA, 64 nt, Human
cuccccugugcccucaaguccuacagccccuagaagaccccaaugccguaacuccuaggacccc

SEQ ID NO: 39175 - RNA, 64 nt, Human
auuaacagauacucccauaauaacccccaaauacagaccccaugucacccagaaagagauuccc

SEQ ID NO: 39176 - RNA, 64 nt, Human
auagcuugggcuguuccuucucugauacgggaagagaccccaaucagauuuuucaaauuaaagc

SEQ ID NO: 39177 - RNA, 64 nt, Human
uuguauucgaugagguuuccauguauuuacuuacagaccccauaauguaaaggcucuaauaaua

SEQ ID NO: 39178 - RNA, 64 nt, Human
agggaaggggaacacagauuucuuuggggguccuagaccccaugccagccauuguaagaguucc

SEQ ID NO: 39179 - RNA, 64 nt, Human
ugggaggggggagccccagaaaugcgguugcugaagaccccagucaccacauccuucugccugg

SEQ ID NO: 39180 - RNA, 64 nt, Human
gucagcucugaucacauccccugucuacucauccagaccccaugccuguaggcuuaucagggag

SEQ ID NO: 39181 - RNA, 64 nt, Human
ccaggaguucaagaccagccugggcaacauggugagaccccaucucuacaaaaaauacaaaaau

SEQ ID NO: 39182 - RNA, 64 nt, Human
gcacugccagcuucgcuccacucagcccccuugcagaccccacccccugccugcucucuuuccc

SEQ ID NO: 39183 - RNA, 64 nt, Human
gcucuuugacccccgcagcccacgucccgcuuucagaccccaggcccauuguaagccuagguca

SEQ ID NO: 39184 - RNA, 64 nt, Human
ccacucuggccauccacuagcccgggggguacgcagaccccacacucagcagaaggagacucag

SEQ ID NO: 39185 - RNA, 64 nt, Human
ccaggaguucaagaccagccugggcaacauagugagaccccaucucuacuuaaaauaaagaaga

SEQ ID NO: 39186 - RNA, 64 nt, Human
ggcacccuccauuugggauggaaggaaucuguggagaccccauccuccucccugcacacugugg

SEQ ID NO: 39187 - RNA, 64 nt, Human
ccaggaguuccagaucaaccugggcaacaugaugagaccccaucucuacaaacaauuuuuuaaa

SEQ ID NO: 39188 - RNA, 64 nt, Human
gcugaaaaccgcagugccuucagcuaccauugcaagaccccagauugcaagggauggugcuucu

SEQ ID NO: 39189 - RNA, 64 nt, Human
ccaggguucgagaccaaccuugggcaacauagcaagaccccauuucuuaaaaaaaaaaaaaaaa

SEQ ID NO: 39190 - RNA, 64 nt, Human
aggaggggagucaccuuggggcuggaggccucucagaccccauccugacagcagguugaguauu

SEQ ID NO: 39191 - RNA, 64 nt, Human
ggggagaggugggcucugcuuuucagaggaacucagaccccagcccucagcuggcugcccauag

SEQ ID NO: 39192 - RNA, 64 nt, Human
uaaccgguaccucugaauggggcuggauaaccggagaccccaugggaggucccugaagaucaga

SEQ ID NO: 39193 - RNA, 64 nt, Human
aaaaggacaaaaaugggcuggccuggaauggcccagaccccagccuccccuccucccucccauc

SEQ ID NO: 39194 - RNA, 64 nt, Human
ggcagacacccacaagaagaugacugaguucuagagaccccacaagcacuauggacgaagcgug

SEQ ID NO: 39195 - RNA, 64 nt, Human
cauuuuuauuuauuaauuuuauacuauuucaacuagaccccacaccagggcacccuaagagggg

SEQ ID NO: 39196 - RNA, 64 nt, Human
ggccaggagccagccacuggcuggacagggaagaagaccccaggagccaagcccaccccuucuu

SEQ ID NO: 39197 - RNA, 64 nt, Human
ccaguguccccuccccuccaucucucuuccccauagaccccauaaccccagaccaaagagguuc

SEQ ID NO: 39198 - RNA, 64 nt, Human
cuaaugauucgacagaggcuggaggagauagccgagaccccagcaacaaucugagccaugagaa

SEQ ID NO: 39199 - RNA, 64 nt, Human
ccagguguuugaggccagccagggcaacacagcaagaccccaucucuacaaaauauuaaaacau

SEQ ID NO: 39200 - RNA, 64 nt, Human
aacgucuugucugugaucuuuguucuugaccucuagaccccaagaugugaacagugcacguguu

SEQ ID NO: 39201 - RNA, 64 nt, Human
ugcccaagaagcccaccuucuggucccaaccugcagaccccacagcagucaguuggucaggccc

SEQ ID NO: 39202 - RNA, 64 nt, Human
ccugguuccuuccuaugcccagguaccacccuucagaccccaguucuaggggagaagagcccug

SEQ ID NO: 39203 - RNA, 64 nt, Human
gcuagugagcaaaauaugccccuucuugggccccagaccccagggcagggugggcagccuaugg

SEQ ID NO: 39204 - RNA, 64 nt, Human
caccuccugggcugggcagagugacagugcuagaagaccccagagagagggcaagggcuuuggg

SEQ ID NO: 39205 - RNA, 64 nt, Human
aguuagcuucccuucuggaccaauagacgaggggagaccccauggauccucuggcugggaagcc

SEQ ID NO: 39206 - RNA, 64 nt, Human
gcugcagacugagugcugcccuuguagcuuccccagaccccaacucacugcaguucaucugaac

SEQ ID NO: 39207 - RNA, 64 nt, Human
gaccccucaugaaugaaaccagugcccuuauaagagaccccaaagagcugccuugcccuucugc

SEQ ID NO: 39208 - RNA, 64 nt, Human
uuccccaaaaagagggaagagucacaaaaaguccagaccccagggacgguacuuucccucucua

SEQ ID NO: 39209 - RNA, 64 nt, Human
cagcccccuccaguuugcuuuccuuuggccuuccagaccccaggaaguuggccuucccuuccua

SEQ ID NO: 39210 - RNA, 64 nt, Human
ccuccugcugagugguccacauucugcugcccccagaccccauccagccagggguggggauggg

SEQ ID NO: 39211 - RNA, 64 nt, Human
ggaacuggcuggcuguccguccagugagcggcccagaccccaccucugcgccauugucaccagg

SEQ ID NO: 39212 - RNA, 64 nt, Human
gaaaauguccuagcugcugcugaggcuugaacccagaccccagcacugugaugggaguccacgg

SEQ ID NO: 39213 - RNA, 64 nt, Human
uguaucacugcacuccagccuagaugacagaacgagaccccaucucuaaugaauaaauaaauau

SEQ ID NO: 39214 - RNA, 64 nt, Human
gaguucaagaucaaccaaccuggguaacauggccagaccccaucucuauuuauauauauauaua

SEQ ID NO: 39215 - RNA, 64 nt, Human
uguauuuguauucccuucccccuacaagauuaugagaccccagagggggaaggucugggucaaa

SEQ ID NO: 39216 - RNA, 64 nt, Human
uugccugcucccgcgggucacccagcgagugcugagaccccauuuucugucgaggcgggccgag

SEQ ID NO: 39217 - RNA, 64 nt, Human
ccuccucccccaucugcacccccaucauagguagagaccccacccucccaucgguccuacaugg

SEQ ID NO: 39218 - RNA, 64 nt, Human
guaggaccaggccauccuuggcuccagagcucgaagaccccaagacagcccucugcucucagcg

SEQ ID NO: 39219 - RNA, 64 nt, Human
acagucaaauggggagggguauucuucaugcaggagaccccaggcccuggaggcugcaacauac

SEQ ID NO: 39220 - RNA, 64 nt, Human
uaccugggcauuuaacccccuacucugucaucucagaccccaggcaggaggcccaguguuccaa

SEQ ID NO: 39221 - RNA, 64 nt, Human
uuccuggaugugauggaccagcucagcuguccccagaccccaucccuucuccuuuuccuuugug

SEQ ID NO: 39222 - RNA, 64 nt, Human
caugccacugcacuccagucugggugucagaaugagaccccaucucaaaaaaaaaaaaaaaaaa

SEQ ID NO: 39223 - RNA, 64 nt, Human
ugugccacuguacuccagacuggacaacagagugagaccccaucucuaaauaauaaucauuauu

SEQ ID NO: 39224 - RNA, 50 nt, Human
ucagccggaagagaaaaugaagaccccagagacauuuauuggggaguagg

SEQ ID NO: 39225 - RNA, 64 nt, Human
ucugugauaaaaagaccccucccgcuggguuuucagaccccauguuguuggucaaugaaauaaa

SEQ ID NO: 39226 - RNA, 64 nt, Human
gauggagccuuuauuccacgucgcguggucuccaagaccccaccuaccucccugaugcugaaug

SEQ ID NO: 39227 - RNA, 64 nt, Human
cccacagaaagcugcuccuggaugccccugcagaagaccccaauuaccugccccucccugagga

SEQ ID NO: 39228 - RNA, 64 nt, Human
ccaagcaccugcuggcugcuggaagcauaccccaagaccccaagccuugacuccagcugcgccc

SEQ ID NO: 39229 - RNA, 64 nt, Human
cacccauagacggugcggggggccuggcugggccagaccccaggaaggugggguagacuggggg

SEQ ID NO: 39230 - RNA, 50 nt, Human
gacccuccccaacacagugaagaccccagccaccucuaccugugcacucc

SEQ ID NO: 39231 - RNA, 64 nt, Human
gagcagcccuaagguagaggccucauggcccaggagaccccaccucuggcagagccacauuacc

SEQ ID NO: 39232 - RNA, 64 nt, Human
cuuucccagcuccagccuggagggaaggggacaaagaccccaggaggccaaagggcugcaguca

SEQ ID NO: 39233 - RNA, 64 nt, Human
cuucacaucaugguggggaccgagauagagagggagaccccauuccaagcucccucuuccuccg

SEQ ID NO: 39234 - RNA, 64 nt, Human
gagaggagaggcugcugucacugguaccggaugcagaccccacccugucugcaggccaccccca

SEQ ID NO: 39235 - RNA, 64 nt, Human
cgggaccccagcgcugcgccgcguccgaacgucgagaccccaccgagggcgggagggggacucu

SEQ ID NO: 39236 - RNA, 64 nt, Human
cgagcuccagcuccguucccaaggauacucgugaagaccccaucuguguucauggccuggaaag

SEQ ID NO: 39237 - RNA, 64 nt, Human
ggcauuagaguagaaauaucuuuggaaaugugaaagaccccauagugaaauauuugggaucaga

SEQ ID NO: 39238 - RNA, 64 nt, Human
gguaucuauaaacccuuuucaggggagagaccggagaccccaucuuagauacugucaacucacu

SEQ ID NO: 39239 - RNA, 64 nt, Human
gaucuccauucuuugccaugagggccaacacaugagaccccaccucccucccugccugccagcc

SEQ ID NO: 39240 - RNA, 64 nt, Human
ggcgagagggaagcccuugcugccugccauucccagaccccagcccuuugugcucacccugguu

SEQ ID NO: 39241 - RNA, 64 nt, Human
cuuccacagcaguaagccgaaaggaugaagaguuagaccccauggacccuagcucauacucaga

SEQ ID NO: 39242 - RNA, 64 nt, Human
uccauaggguuggugcugaaauguuagguugugcagaccccaaccucccugacuuccuucagua

SEQ ID NO: 39243 - RNA, 64 nt, Human
aacuuugguucauaaauauggcucuugaacccauagaccccaguugaagauggaauuuucagga

SEQ ID NO: 39244 - RNA, 64 nt, Human
gaugagaccaguguuccucacacuggagggugauagaccccaaggggaacugaagaguggagcu

SEQ ID NO: 39245 - RNA, 64 nt, Human
aguccccaugauucccuccucgucagucucucaaagaccccaugguccauccccugaggguggu

SEQ ID NO: 39246 - RNA, 64 nt, Human
ggagcugucugcggagccagcgccugcccgagagagaccccaccgccaccgugugccuuucccg

SEQ ID NO: 39247 - RNA, 64 nt, Human
uuguaacugugaaacuauggcuuaauacuguuaaagaccccaaggcuccacucuguagccaggu

SEQ ID NO: 39248 - RNA, 64 nt, Human
cuaggaguucgagaccgaccugggcagcauagcgagaccccaucucuauauaaaaaaaaagaug

SEQ ID NO: 39249 - RNA, 64 nt, Human
auggagaccuaugaaggggaugugcuggggguccagaccccauauuccucagacucaacaauuc

SEQ ID NO: 39250 - RNA, 64 nt, Human
cgggcugcagagccgggccacaccucagugccaaagaccccaugggagugggagggaugacaag

SEQ ID NO: 39251 - RNA, 64 nt, Human
ucucaaaucuugaacccuggaccaaagcuuuuccagaccccacccuaccuuccaacccagguca

SEQ ID NO: 39252 - RNA, 64 nt, Human
agaaaaggccaguauaaaaauguaguagacuuaaagaccccacucgaccaugagacuuucucuu

SEQ ID NO: 39253 - RNA, 64 nt, Human
agaaucacauuucuuuacagguuaaagacaaacaagaccccaggguuuuuaucuagaaaguuau

SEQ ID NO: 39254 - RNA, 64 nt, Human
auuguccugugccuccuaauaucauuuguacugaagaccccaucuggggacuugagacuuuggu

SEQ ID NO: 39255 - RNA, 64 nt, Human
cugggaguuugagacuggccugggcagcauagcgagaccccaucucuauauaaaaaaaaagaug

SEQ ID NO: 39256 - RNA, 64 nt, Human
augaccccacucagcuccaggcaguguucugccgagaccccaagaacucggggugucagagggc

SEQ ID NO: 39257 - RNA, 64 nt, Human
cuuugauguucagaaacccacuuuguucucagccacgcaaaacucccugaccccgaugugauuu

SEQ ID NO: 39258 - RNA, 64 nt, Human
gaaucaaagccagcacauuguaaccugugcuuguacgcaaaagaauuagauuucuuuguuuuug

SEQ ID NO: 39259 - RNA, 64 nt, Human
cagcccgaaugccugucaguuucauggaggggaaacgcaaaaccugcaguuccugaguaccuuc

SEQ ID NO: 39260 - RNA, 64 nt, Human
uauagaucgucagggaauagcccaaauguuuuaaacgcaaaaaaaaagacaaaaaaaaaccaaa

SEQ ID NO: 39261 - RNA, 64 nt, Human
gcuaggaauauuggaagcagcauaguguugauguacgcaaaacaagacagcuuggucagcuaca

SEQ ID NO: 39262 - RNA, 64 nt, Human
ccacugagcugucgugccagcaccauuccuggucacgcaaaacagaacccaguuagcagcaggg

SEQ ID NO: 39263 - RNA, 64 nt, Human
cagucccccaaagucuuaacucuuuucagcauuaacgcaaaaauccacaguccaaagucucauc

SEQ ID NO: 39264 - RNA, 64 nt, Human
gaaccuguggggugguauuuugcauugcaaggagacgcaaaauuuuauuuuaaaacuguccucc

SEQ ID NO: 39265 - RNA, 64 nt, Human
gcugcaaaagagaacaccaaucccauccacacucacgcaaaaaccgcgaugccgacaagaaaac

SEQ ID NO: 39266 - RNA, 64 nt, Human
cagaugucucauauaauaaggugaugucggaaacacgcaaaacaaaacgaaaaaagauuucuca

SEQ ID NO: 39267 - RNA, 64 nt, Human
agagcaugguuuguauaccacaagcccucuuagcacgcaaaagccaaaaucuaaagaucaacca

SEQ ID NO: 39268 - RNA, 64 nt, Human
uucugcccacuuuaccuacggagacaugauaaacacgcaaaaaaaaccuagaaauuaagcaaaa

SEQ ID NO: 39269 - RNA, 64 nt, Human
cugauuaaagaaguuucuuauuuaaacaucucagacgcaaaaauuacauuaaauuuuuguauau

SEQ ID NO: 39270 - RNA, 64 nt, Human
uugauauuuggaauuaauuacguuuguuuaagucacgcaaaagauuuucagaaaauguucggau

SEQ ID NO: 39271 - RNA, 64 nt, Human
caugggauuuuacuagaauuaaacaacaaacaaaacgcaaaacccaguauaugcuauucaauga

SEQ ID NO: 39272 - RNA, 64 nt, Human
caggcccaaggcagcgggggcccacaccccucacacgcaaaacuggcuucuucuggucacuggu

SEQ ID NO: 39273 - RNA, 64 nt, Human
ucaaggaaacacaaucaggauuuuaugugugaaaacgcaaaagugauggcucggcgguccgagc

SEQ ID NO: 39274 - RNA, 64 nt, Human
cccccagcuucacucagcacuggagcuggcagagacgcaaaacccagucugcccuugggauucc

SEQ ID NO: 39275 - RNA, 64 nt, Human
aacagcagaguugauuaagaaaaaugaagaaaaaacgcaaaaagagaacacauguagaaggugg

SEQ ID NO: 39276 - RNA, 64 nt, Human
ccugagaacuugauaaugcauauuugcaggccccacgcaaaaccugcugaaucagaagcucuga

SEQ ID NO: 39277 - RNA, 64 nt, Human
uuggccucuuguagucuuggcuaaggaaauucuaacgcaaaaauagcucuugcuuugacuuagg

SEQ ID NO: 39278 - RNA, 64 nt, Human
ucugccuaccaagacacuacuugcacuggaucuuacgcaaaaaagaaccagaacacacagugug

SEQ ID NO: 39279 - RNA, 64 nt, Human
uuucuacuguaaaaugcaauuugaaaaaaauaaaacgcaaaaaaagaaacuguaaaggaaacca

SEQ ID NO: 39280 - RNA, 64 nt, Human
gagggauagaaaacaagcgcaggagagccugcgaacgcaaaagugaaugagggcuuuuuguggc

SEQ ID NO: 39281 - RNA, 64 nt, Human
augaauucucaacaaaaugugcuagccacuggggacgcaaaacaaguaagaucccuguugcaag

SEQ ID NO: 39282 - RNA, 64 nt, Human
uugauuccuguuugauuuauacuucucuguugcuacgcaaaaccgaucaaagaaaagugaacuu

SEQ ID NO: 39283 - RNA, 64 nt, Human
cucuuaauaguugugaaaaaauaaaucuauucuaacgcaaaaccacuaacugaaguucagauaa

SEQ ID NO: 39284 - RNA, 62 nt, Human
augagaaaacauacauguaaaguaugugccugacgcaaaacuaauaaucauuauuggagagg

SEQ ID NO: 39285 - RNA, 64 nt, Human
accacuugacaccagaaaccccccagcugugauaacgcaaaaugucucuagacaucaccaaaug

SEQ ID NO: 39286 - RNA, 64 nt, Human
ccuggcugccucaggcuucucuuacgaagaggaaacgcaaaaaaagaaaaggaaaaaccccgug

SEQ ID NO: 39287 - RNA, 64 nt, Human
agguucuuugagggacugccucugccacacucugacgcaaaaccacuuuccuuuucuauuccuu

SEQ ID NO: 39288 - RNA, 64 nt, Human
ggaaggcccagucccuccucugcucuccucaaagacgcaaaacauuuuccaacaagagcuguca

SEQ ID NO: 39289 - RNA, 64 nt, Human
agggagccggcguucaaggcuaugacagucugcuacgcaaaacauuuuuucaaguaaaaauagu

SEQ ID NO: 39290 - RNA, 64 nt, Human
ugcacuccagccugggcgcaagaccaagacuuaaacgcaaaaaaaaaaaaaaaaaaaaaaaaaa

SEQ ID NO: 39291 - RNA, 64 nt, Human
cgugaacugggaugcaaguugcuaaccgaugugaacgcaaaaugccuuguucauuauuccugac

SEQ ID NO: 39292 - RNA, 64 nt, Human
uuuacauucuaaacaaguccacucucuguggcuaacgcaaaacaaaugaaaucuuuauuguuuu

SEQ ID NO: 39293 - RNA, 64 nt, Human
uucccccccuuuuagagcauccggaagugauaacacgcaaaaucacaaaguagcauaaaucagu

SEQ ID NO: 39294 - RNA, 64 nt, Human
cauaucgcaaaccagagcugcuggaaaccagcacacgcaaaagaugacgcccagcacagcagca

SEQ ID NO: 39295 - RNA, 64 nt, Human
acaaagcucacaucugggagauuaacuuuuuuuaacgcaaaaauauucugcacauuacccauau

SEQ ID NO: 39296 - RNA, 64 nt, Human
uguguauagcauguguauuaaugucuaacuacauacgcaaaaacuuccuuuacagagguucgga

SEQ ID NO: 39297 - RNA, 64 nt, Human
auaguauaagggaacucaagggaaaaggaaacacacgcaaaaacuauuuuaagacuuucugaac

SEQ ID NO: 39298 - RNA, 64 nt, Human
caccuucggagaggacacuucaaacugcggacacacgcaaaagcgacucccagcuccguuugau

SEQ ID NO: 39299 - RNA, 64 nt, Human
ggcccugagcugcccuugcguucaguuggaagccacgcaaaaugaacugaaccaggagugagcu

SEQ ID NO: 39300 - RNA, 64 nt, Human
cagagugagaaggccacugguucugugccgcagcacgcaaaauuuagaauucuacagacuagcu

SEQ ID NO: 39301 - RNA, 64 nt, Human
ccaaugacagaugcaagcccaacacccuuuugguacgcaaaaccugcucucaauaaauuccccc

SEQ ID NO: 39302 - RNA, 64 nt, Human
cuaggcuaggauaacuuuagagcacugacauaaaacgcaaaaacaggaaucaugccguuugcaa

SEQ ID NO: 39303 - RNA, 64 nt, Human
acacacugacaccucccgaaguggaccacaagaaacgcaaaauccgggaggagauugagcauuu

SEQ ID NO: 39304 - RNA, 64 nt, Human
ucaagagcaauucuaauauaauuuacauauguucacgcaaaauaugcuuaggcugucaaauuag

SEQ ID NO: 39305 - RNA, 64 nt, Human
ccugucugacuguagcuuugugaaauaucuuaaaacgcaaaaaccaauuguguccugaaaauug

SEQ ID NO: 39306 - RNA, 64 nt, Human
gacaggaagccacccugcgugggggacugcaggcacgcaaaauaaaauaacuccugcucguuug

SEQ ID NO: 39307 - RNA, 64 nt, Human
guguaauugguuugaaaaacagugaaauggguaaacgcaaaacuuuuguacuuuauuacgagua

SEQ ID NO: 39308 - RNA, 64 nt, Human
gacucccggggccauuugaaaggaaacaauccuuacgcaaaaucuuacacccugguauaacaga

SEQ ID NO: 39309 - RNA, 64 nt, Human
gcuauaaagguaauuguaaaaauaaauacaguggacgcaaaauaauguugugaguuuuuauaaa

SEQ ID NO: 39310 - RNA, 64 nt, Human
agcugugacccucaauucauauuuaugaaucucuacgcaaaaaauaacuacagaaaaauuacuu

SEQ ID NO: 39311 - RNA, 64 nt, Human
uuuuuuuuuuuuuuugcuguguuacaggauucagacgcaaaagacuugcauaagagacggacgc

SEQ ID NO: 39312 - RNA, 64 nt, Human
ggggggacaccacugagcauauccagacccacuucgagagcaagacagagcugcugccuucccg

SEQ ID NO: 39313 - RNA, 64 nt, Human
acaucucggggcaguuggaccuaucuccauaccccgagagcauuugccugccuguccuggacgg

SEQ ID NO: 39314 - RNA, 64 nt, Human
cucuaguaugaagcaagaguaaagacuaagguuucgagagcauuccuacucacauaagugaaga

SEQ ID NO: 39315 - RNA, 63 nt, Human
aacccuuggugugggucugaggucuugacucaacgagagcacuugaaaaugaaaugacugucu

SEQ ID NO: 39316 - RNA, 64 nt, Human
cugagauggcaccacugcacuccggccuaggcaacgagagcaaaacuccaauacaaacaaacaa

SEQ ID NO: 39317 - RNA, 64 nt, Human
uuuuagguggugaucuuaaaugggugagauggaacgagagcacacauuaaagagagaguaaauu

SEQ ID NO: 39318 - RNA, 64 nt, Human
ucugccuccaagccccagaugguucuggaggcugcgagagcagcuggcacugucagcccccagc

SEQ ID NO: 39319 - RNA, 64 nt, Human
agcagcagguugcaggacaaaugcuucaguccgccgagagcaguaccguguggccaagaggugg

SEQ ID NO: 39320 - RNA, 64 nt, Human
ucuucuuucuuccucauccuacucaaaaacuucccgagagcaguggugguuuugaggguuuuga

SEQ ID NO: 39321 - RNA, 64 nt, Human
accuaucgcugcuggcagcacuuuuugagcaagccgagagcacccauuuuggcuggggguucag

SEQ ID NO: 39322 - RNA, 64 nt, Human
ucccuaccucaccaggcuacuggcagcagcaucccgagagcacaucaucuccacagccugguaa

SEQ ID NO: 39323 - RNA, 64 nt, Human
gccgaggcagguggaucacuugaggucaggaguucgagagcagccuggccaauaugaugaaacc

SEQ ID NO: 39324 - RNA, 64 nt, Human
uccacccagccaagcccacaucacaucuccuggccgagagcagccacugccacucagucugaca

SEQ ID NO: 39325 - RNA, 64 nt, Human
aaagacagugcggaugcaagagcaccuggccaagcgagagcagcuggguaagcgccaccagggu

SEQ ID NO: 39326 - RNA, 64 nt, Human
guagagacaggucuucaugugugagaaaguauagcgagagcagaucaucuuuagauuauucuuc

SEQ ID NO: 39327 - RNA, 64 nt, Human
ccacuucagauguuuauuuggaugugguuggggacgagagcagacaccaaggaaagggaguugg

SEQ ID NO: 39328 - RNA, 64 nt, Human
gacggcagacugagcagaauuccuuuuuugagcacgagagcauuacuagaaccauugucaaagc

SEQ ID NO: 39329 - RNA, 64 nt, Human
aagucacuuuuuauuuuuccucagucuucaaugacgagagcaauauuaagaagacauugcuauc

SEQ ID NO: 39330 - RNA, 64 nt, Human
uccuggacugauggccacccgcccacagccaggccgagagcagacaccagcagcccugucacgc

SEQ ID NO: 39331 - RNA, 64 nt, Human
cugggagucacacaguguuggagguuaaggcauacgagagcagaggucucccaaacgcccuuuc

SEQ ID NO: 39332 - RNA, 64 nt, Human
uguggggggggacacgucuucccacugcuuagagcgagagcagagcaaacugcgcagcaggcac

SEQ ID NO: 39333 - RNA, 64 nt, Human
caucuucuucuuggauugacggaugacggcucaccgagagcauaucuaaaaaacacucugcaaa

SEQ ID NO: 39334 - RNA, 64 nt, Human
cuccucggagccgaccccuggguagcaaggcagccgagagcaucucccuggaggggcccacggu

SEQ ID NO: 39335 - RNA, 64 nt, Human
aggagaugcagggccaccugaagcgggccuccaacgagagcacccgccagaggcugcagcagca

SEQ ID NO: 39336 - RNA, 64 nt, Human
cauccgcaucuggagcaccaaggacuuccugcagcgagagcaccgcagcaugagagccaacgug

SEQ ID NO: 39337 - RNA, 64 nt, Human
aggccccggcgcccgcacccacccggcccggccccgagagcaggcucgaccgccgccccaugga

SEQ ID NO: 39338 - RNA, 64 nt, Human
gacacggacguuguugcacaaagcacuuaaagaacgagagcaucuuguucauugccuuuuucac

SEQ ID NO: 39339 - RNA, 64 nt, Human
gggcugagcuguuagaggggcuucuccagaggcucgagagcaggccauuucccaagaagaugaa

SEQ ID NO: 39340 - RNA, 64 nt, Human
ggggucuccuggaccuugacagagcagcuaacuccgagagcagugggcagguggccgccccuga

SEQ ID NO: 39341 - RNA, 64 nt, Human
cuucaugggcuaggagccgccgagcccgggcucccgagagcaaccucgugaccucagcaugcca

SEQ ID NO: 39342 - RNA, 64 nt, Human
auggccaggaagggcccuggccucuaaacuggcucgagagcaucuuggccccggccaccuuccc

SEQ ID NO: 39343 - RNA, 64 nt, Human
gcugaggcaggaggauccccugaggucaggaguucgagagcagccuggccaacauggcaaaacc

SEQ ID NO: 39344 - RNA, 64 nt, Human
gccgaggggggcagaucacuugagcccaggaguucgagagcagccugggcaacaugacgaaacc

SEQ ID NO: 39345 - RNA, 64 nt, Human
cccucauccuccugguucaggaccucuaccccagcgagagcacagcagaggacgacauucaggu

SEQ ID NO: 39346 - RNA, 64 nt, Human
agccguugccaauggaugccuuuaggaguggugccgagagcagugugguccacucuggccuggg

SEQ ID NO: 39347 - RNA, 64 nt, Human
aauggcagaaaaccaaaaacuaaauuuaugguaucgagagcaccaccuucucuuuuugcccaua

SEQ ID NO: 39348 - RNA, 64 nt, Human
cuuuucuccuaguuucucuccacccuggaacauucgagagcaaaucaaaaccucuauccagaca

SEQ ID NO: 39349 - RNA, 64 nt, Human
uguggacgugggucugggggucucacccgcccagcgagagcagaaccaauccagucaggauguc

SEQ ID NO: 39350 - RNA, 64 nt, Human
aacguccccagcuuuggcauccucaaguaucccccgagagcagaauaggguaaggauuguucau

SEQ ID NO: 39351 - RNA, 64 nt, Human
cagagguugcaaugaagcggagguugcagugagccgagagcaugccgcugcacuccagccuggg

SEQ ID NO: 39352 - RNA, 64 nt, Human
guguguauguguguagcgggagaugugggcggagcgagagcaaaaggacugcggccugaugcau

SEQ ID NO: 39353 - RNA, 64 nt, Human
gaaaaagacuuuuuguacauuuggaaaagacaagcgagagcacacuauucucauugccaacguu

SEQ ID NO: 39354 - RNA, 64 nt, Human
agauucuuccauaauuaacauaagugguuccuaacgagagcaauuuuuccacccaaaagucauu

SEQ ID NO: 39355 - RNA, 64 nt, Human
ccaagaccaugccauuacacucaagcuugggcaacgagagcaaaacucugucucaaaaaaaaaa

SEQ ID NO: 39356 - RNA, 64 nt, Human
caccuucuggcaaauucaagaggcaugaguggaccgagagcacauccagcauuugcaucaccuc

SEQ ID NO: 39357 - RNA, 64 nt, Human
gcaucuucuaaaucaugaaauuaaagucugaggacgagagcacgccugggagcgaaagcuggcc

SEQ ID NO: 39358 - RNA, 64 nt, Human
ccggggcuucacacucuuccagacccacgaaaaccgagagcaccuggugaugauggagaagauc

SEQ ID NO: 39359 - RNA, 64 nt, Human
ggaguaggggggguguggguguguaaccagagaccgagagcaugaguggggugugccucgugug

SEQ ID NO: 39360 - RNA, 64 nt, Human
cugugcccgccacacgcacgcacacacucuuacacgagagcacacucgaucccccuaggccagc

SEQ ID NO: 39361 - RNA, 64 nt, Human
ggacgcagccacgccaggaggaggacacggccgccgagagcaaggcacaaccucgaguucuugg

SEQ ID NO: 39362 - RNA, 64 nt, Human
cagcucuggagucuuguuccugacuccagaggaacgagagcauuccaggaaagagagauucccu

SEQ ID NO: 39363 - RNA, 64 nt, Human
ggucuggaguucgagaccagccuggccaacauagcgagagcagcuccgguggcgggaggagugg

SEQ ID NO: 39364 - RNA, 64 nt, Human
cccuucuguauccugucccuccuccacgccgacccgagagcagcugagcugcgcuggcucuggg

SEQ ID NO: 39365 - RNA, 64 nt, Human
cuucccccaggacccucagcucagcggcucucuccgagagcaccacccuccccgacacacaggu

SEQ ID NO: 39366 - RNA, 64 nt, Human
aacccaguucuagguacugucugggccugggaggcgagagcagugcccaggggacuucugggcu

SEQ ID NO: 39367 - RNA, 64 nt, Human
acugaccuuuguuucacuugccucugcucgacuccgagagcaggaaacccggccguggccuggc

SEQ ID NO: 39368 - RNA, 64 nt, Human
gcgucugagauccgcgugaaaaguccucugcccacgagagcagggaguuggggccacgcagaaa

SEQ ID NO: 39369 - RNA, 64 nt, Human
uaaucuuucagggccuaaauuuaggagagugucccgagagcaguucauacaaagggcuuucucu

SEQ ID NO: 39370 - RNA, 64 nt, Human
auccccgagguccccagcgaggacacacacuccacgagagcagccccuccacucugcccaggag

SEQ ID NO: 39371 - RNA, 64 nt, Human
aaaaagcgagcgagagagagagcgagagagagagcgagagcagaagaaauuccuaaaagucgau

SEQ ID NO: 39372 - RNA, 64 nt, Human
auucgacacaaaagagggucccugcucuguugcccgagagcagucugcauccugggaccagaau

SEQ ID NO: 39373 - RNA, 64 nt, Human
ggacuguuccagcacgggccagauggccagcugucgagagcagcccugcccagauugcgguggg

SEQ ID NO: 39374 - RNA, 64 nt, Human
gccuggugucacaugcccacagcagccucggugacgagagcacggagcccaagagguggggugu

SEQ ID NO: 39375 - RNA, 64 nt, Human
cacuguauguaguucauggcuacuguacugacagcgagagcauguccaucuguuggacagcacu

SEQ ID NO: 39376 - RNA, 64 nt, Human
acaaaucacgagaagagagaaggggacagaacagcgagagcaaccuggaaaaucggucuucagg

SEQ ID NO: 39377 - RNA, 64 nt, Human
gccgaggcagguggaucgcuugagcucaggaguucgagagcagccugggcaacauggugaaagc

SEQ ID NO: 39378 - RNA, 64 nt, Human
guuugaaucuuugcuguuuuaugguugugaagaacgagagcaagaaaaagaugauguagauguu

SEQ ID NO: 39379 - RNA, 64 nt, Human
aagcugccacucggaacagcgaguccucugccgucgagagcagggagggguaggguggacaggc

SEQ ID NO: 39380 - RNA, 53 nt, Human
ggggacagcugccccgguagccucgagagcaccccuugccggugaaggaugcg

SEQ ID NO: 39381 - RNA, 64 nt, Human
cguuuccaucugcaaggaugcacgguacccuccccgagagcaggccuguccccuacccaacugg

SEQ ID NO: 39382 - RNA, 64 nt, Human
cgaguguguagacggccaaguacuccccuaucuccgagagcagcgacuaaguucaggcccagcc

SEQ ID NO: 39383 - RNA, 64 nt, Human
cgaguguguagacggccagcuacuccccuaucuccgagagcagcgacuaaguucaggcccagcc

SEQ ID NO: 39384 - RNA, 64 nt, Human
gacacccacggaccagggaggccaagcagccgagcgagagcagcaggucacgcagaaaaaacug

SEQ ID NO: 39385 - RNA, 54 nt, Human
uagaagaccguacucaguaacaggccggaaaauugugcucuagaagaauaaaac

SEQ ID NO: 39386 - RNA, 64 nt, Human
caggagacaagacagcgcagagagggcugguuagccggaaaaggccucgggcuuggcaaaugga

SEQ ID NO: 39387 - RNA, 64 nt, Human
gcccuucuccccgggucugcccuguggggggcuuccggaaaagggaacccugcgguacccccag

SEQ ID NO: 39388 - RNA, 64 nt, Human
uguuuuuguuuuaacuuucuuguggcaagcuauaccggaaaagcggcaugucaaaaauacuuua

SEQ ID NO: 39389 - RNA, 64 nt, Human
auggcuuugacuaaauuacccccauccuccuugcccggaaaagggagagcuagagccacucacu

SEQ ID NO: 39390 - RNA, 64 nt, Human
gauccaugagcuauacagcugcaugcuuugacugccggaaaaauuaaucuugcuucuucaucag

SEQ ID NO: 39391 - RNA, 64 nt, Human
aguggaaagacaucaguacaacuggacuuggcuuccggaaaaagauugcuuuugaacuuuggcu

SEQ ID NO: 39392 - RNA, 64 nt, Human
aggucccucccgccuccagguccauccaucccguccggaaaagaaggacccagagggaagaagg

SEQ ID NO: 39393 - RNA, 64 nt, Human
uccucagagcauugcgugugugucuugcuguagcccggaaaagguuuuguguaaagauucuggg

SEQ ID NO: 39394 - RNA, 64 nt, Human
ugacguugaugagugaagaugucggcucaggaugccggaaaaugaccuguaguuaccagugcaa

SEQ ID NO: 39395 - RNA, 64 nt, Human
gagugccucuguuuuccagaagauuucacaauccccggaaaacugguauggcuauucuugaagg

SEQ ID NO: 39396 - RNA, 64 nt, Human
cgggauuccauuuguguaaaaacuagggugguaaccggaaaaaaauauugucaguauuucaagc

SEQ ID NO: 39397 - RNA, 64 nt, Human
ugugaugggauaugaaaugguccauagaaaaaaaccggaaaaauacgccaagguuagguucauu

SEQ ID NO: 39398 - RNA, 64 nt, Human
auuacggugccacgcagucauggaucuggguaguccggaaaacaaaaggagggaagacagccug

SEQ ID NO: 39399 - RNA, 64 nt, Human
caggggccaaggcgccagaugcagacccaggacuccggaaaagccguccgcgcuccgcucugag

SEQ ID NO: 39400 - RNA, 64 nt, Human
agcaguucuguggaagagacuggaauaauuauggccggaaaacaaguacccguuuuaaguaaga

SEQ ID NO: 39401 - RNA, 54 nt, Human
gaagauacaaagucuuauagacauccggaaaaaagauuuuuaccugugcugguc

SEQ ID NO: 39402 - RNA, 64 nt, Human
ugcugccugagaggaaccagagcagacgcacaggccggaaaaggcgcaucuaacgcguaucuag

SEQ ID NO: 39403 - RNA, 63 nt, Human
aucauguaagauggcaacuguauuaaagaaaaauccggaaaacaaauguuugauuuuuguuuu

SEQ ID NO: 39404 - RNA, 64 nt, Human
gagguuguuucccucuucagccacggcuacaauaccggaaaaugcuaguuuuuauuuauuuuuu

SEQ ID NO: 39405 - RNA, 64 nt, Human
gaagagcugaggcugccugggaggcccggggcgaccggaaaagggcucucucaaguucugaaaa

SEQ ID NO: 39406 - RNA, 64 nt, Human
aggcuagaguggacaaaugagggccagggaggaaccggaaaaugggagacaggauuuucuaaaa

SEQ ID NO: 39407 - RNA, 64 nt, Human
caucaagucccucuggggacguccccgucggaaaccggaaaaagcaguuccaguuaauugugug

SEQ ID NO: 39408 - RNA, 64 nt, Human
ggcagacauguggacucuggggagguacugggggccggaaaauagcgggaauucuugcaacgug

SEQ ID NO: 39409 - RNA, 64 nt, Human
gccgugcgcacuguguuccgugcccuggggacccccggaaaagcagcccagucagaugugggaa

SEQ ID NO: 39410 - RNA, 64 nt, Human
gagcuuucuaaguccccacauuuaccccgagucaccggaaaaaucugauuuuucccccgaaagc

SEQ ID NO: 39411 - RNA, 64 nt, Human
aaaaccaaacuggacuugucuuccuuggccuauuccggaaaagaugcuugaugcccagccccgu

SEQ ID NO: 39412 - RNA, 64 nt, Human
ccaccggcuccaauugccagcaaccucugcuuguccggaaaacgacaacacgaaauggaaaagg

SEQ ID NO: 39413 - RNA, 64 nt, Human
cugucccgccucccugucagucaggcgaauucaaccggaaaagggacguggaaaggccacugug

SEQ ID NO: 39414 - RNA, 64 nt, Human
cuuuccuuucccagaaaaacugaggaaacuggccccggaaaagcaugucuuugggguugguucc

SEQ ID NO: 39415 - RNA, 64 nt, Human
ggcgacuucaguaagcuacagcuaagcccaucggccggaaaagaaagacaauaauuuuguuuuu

SEQ ID NO: 39416 - RNA, 64 nt, Human
gggaaagggaggaagauauggcacuucuccaaccccggaaaacauugcuuuugaaaacugcuga

SEQ ID NO: 39417 - RNA, 64 nt, Human
cugagagccacaggugccuggaggagcugugcugccggaaaaagccgggggccugcaucaccac

SEQ ID NO: 39418 - RNA, 64 nt, Human
aggauucuuugacuacauaccucuguccuagaagccggaaaaggaguaaaaacacauuggggag

SEQ ID NO: 39419 - RNA, 64 nt, Human
acugagggacaucgggggcaaguuugcaguggggccggaaaauaugguggccacccuaccauga

SEQ ID NO: 39420 - RNA, 64 nt, Human
ucggcucgcccucucccccggaggccgcgcccucccggaaaagccggguccuccagaccccgag

SEQ ID NO: 39421 - RNA, 64 nt, Human
caguggacccagugcugagaaaagcccccacaucccggaaaacccacuuuccuuucacgaccca

SEQ ID NO: 39422 - RNA, 64 nt, Human
cuggcagccauuucuccauggaguugcuaaguggccggaaaacaagccugagggaggaggcagg

SEQ ID NO: 39423 - RNA, 64 nt, Human
cacccgaauuucuguccguucccaaagaucggccccggaaaaagucugccccagaaacucucac

SEQ ID NO: 39424 - RNA, 64 nt, Human
cgccuaaccugguuucuagcuuugcccucacuccccggaaaaacugacacugacacaggggccc

SEQ ID NO: 39425 - RNA, 64 nt, Human
uagauuaccucacugggaauagcauugugcguguccggaaaagggcuccauuugguuccagccc

SEQ ID NO: 39426 - RNA, 64 nt, Human
uggggggacaggagggggcccuggggccugggccccggaaaaaucuaucugcccucccccacac

SEQ ID NO: 39427 - RNA, 64 nt, Human
agauccuguugaagaaagagcuuaccccuuucccccggaaaacuugcaauccuguaguucccau

SEQ ID NO: 39428 - RNA, 64 nt, Human
acgugaacucuguaauucuauguguuacuagcaaccggaaaagcccacuguguuuuuaaaccac

SEQ ID NO: 39429 - RNA, 64 nt, Human
uucuuauuuucuuauuuuagagcgcuuaaaaaauccggaaaaaugggguuuaaaagaacugucu

SEQ ID NO: 39430 - RNA, 64 nt, Human
auccgagucgcggucuccggggugccugggagggccgaaccacuggugagggcguggggagcag

SEQ ID NO: 39431 - RNA, 64 nt, Human
cuagaagucggagcagaggaugguacagcagaggccgaaccagaagccggagcaguuccuaccg

SEQ ID NO: 39432 - RNA, 64 nt, Human
auagcucccuggaggcugggccaggaggcagccuccgaaccaugccccauauaacgcuugggug

SEQ ID NO: 39433 - RNA, 64 nt, Human
gaaaggaaagcacaaucagagaagaaaacagcccccgaaccagcaggaguggccuggcacaugg

SEQ ID NO: 39434 - RNA, 64 nt, Human
ugaagggauauacuuuccuguuuuucccugacccccgaaccacccaaccacauccauaggggug

SEQ ID NO: 39435 - RNA, 64 nt, Human
gggccuccucugccuccccuguaaaaugggaccuccgaaccaacccugccccucagaaaugccc

SEQ ID NO: 39436 - RNA, 64 nt, Human
uacucugauguauagaccauucucccuucaccagccgaaccaaugucaaaauuaauaaagaaau

SEQ ID NO: 39437 - RNA, 64 nt, Human
aauuaaaaacgccaccuugggcucgagcagcgacccgaaccagccccgugccagcccggucccc

SEQ ID NO: 39438 - RNA, 64 nt, Human
acagugcugugugccccggucaccuagcaagcugccgaaccaaaagaauuugcaccccgcugcg

SEQ ID NO: 39439 - RNA, 64 nt, Human
auggucauguugcaguuuuuuccuugaaggacaaccgaaccauagccucuaaaguucaagugca

SEQ ID NO: 39440 - RNA, 64 nt, Human
caccccagugguggcccuguggcagccuauggccccgaaccaaggacugccgcgccuccuggcc

SEQ ID NO: 39441 - RNA, 64 nt, Human
uuuuccccuuuuugcaaaaaaccacuggccaaauccgaaccauugcccuuguuucccccacguu

SEQ ID NO: 39442 - RNA, 64 nt, Human
gcaaaauuugccuuagcaauuaucuuugaacaucccgaaccagauuuuuaaaucccauuuuugu

SEQ ID NO: 39443 - RNA, 64 nt, Human
agaccuggugucaccaguuuuuccuagcaucaguccgaaccaugcgcccgcccugccccaacug

SEQ ID NO: 39444 - RNA, 64 nt, Human
gugucuuucuugagggagaaaucgguaacaguugccgaaccaggccgccucacagccaggaaau

SEQ ID NO: 39445 - RNA, 64 nt, Human
gcuggaggcugugcuuugacauuguaagacauuuccgaaccaaaggcugcuggguuugcauguu

SEQ ID NO: 39446 - RNA, 64 nt, Human
gcuccugcuuuuuccccacagcccguguucccagccgaaccagcacucucccggaagccugggg

SEQ ID NO: 39447 - RNA, 64 nt, Human
uauuucucauugaguuucuuguuuuggugccugaccgaaccaacgacagccccaaucuucccgu

SEQ ID NO: 39448 - RNA, 64 nt, Human
uccacaggcuucugagcagcgagccugcuaguggccgaaccagaaccaauuauuuucauccuug

SEQ ID NO: 39449 - RNA, 64 nt, Human
ggcccccacccgucaccacgccccaacacuccccccgaaccagagccgugcacuugugccuggu

SEQ ID NO: 39450 - RNA, 64 nt, Human
uuagaucccgggauggcauuccugagaaagcaacccgaaccagcuguccuucugacagcucggu

SEQ ID NO: 39451 - RNA, 64 nt, Human
gagacuagaauucaggguccucacucccaggccaccgaaccaugcagccccuucuuugggggaa

SEQ ID NO: 39452 - RNA, 64 nt, Human
gccccugacuucgaccccuagcuuaugucacagcccgaaccagaucgacuggucugguagcagc

SEQ ID NO: 39453 - RNA, 64 nt, Human
gaaacuucucuucuguuuucuuuggcuguaucagccgaaccaggagaggccugggcugcgacua

SEQ ID NO: 39454 - RNA, 51 nt, Human
ccccacuccucaaguucuaagccgaaccaaauccuuugccuugaaagaaca

SEQ ID NO: 39455 - RNA, 64 nt, Human
caggggcugugcuccgggccaaugcagaggccucccgaaccaagcagcaggauugaagcuucgg

SEQ ID NO: 39456 - RNA, 64 nt, Human
gagugggccaacacuauccagccacucugaccagccgaaccaggaacucaaucaaaaugcgcca

SEQ ID NO: 39457 - RNA, 64 nt, Human
gacuccucggccuggcuccuacccaccgcccuugccgaaccaggagcugcucacuaccuccuca

SEQ ID NO: 39458 - RNA, 64 nt, Human
uugcacacgcagucugcagagccgccgccgccgcccgaaccagcccggaucugagggcccuguc

SEQ ID NO: 39459 - RNA, 64 nt, Human
cguucauuuaaacguauauuuagaacugcacuuuguccacaaccuucccuucucuuucuauucc

SEQ ID NO: 39460 - RNA, 64 nt, Human
gaagaacauggaugggaugcuggugguggaagcgguccacaaccucaaggcugucuucaagggg

SEQ ID NO: 39461 - RNA, 64 nt, Human
gucaauauaaaaauugguaaacuagaaguaacuuguccacaacccucaguuaugauacuuaugu

SEQ ID NO: 39462 - RNA, 64 nt, Human
guuccccgcugacccuugguuagggguccucuuaguccacaagguccggaugucacucauguac

SEQ ID NO: 39463 - RNA, 64 nt, Human
cugagaguuaggacaggucaggaagucccccaggguccacaaaggugccugaggcucugguaag

SEQ ID NO: 39464 - RNA, 64 nt, Human
guacaacuauuaagagauuuugaacauuaaguuaguccacaaauauucagugggcaucuacuag

SEQ ID NO: 39465 - RNA, 64 nt, Human
uucaaauacauaaagauaaauuuauuuucacacaguccacaagggguauaucuuguaguuuuca

SEQ ID NO: 39466 - RNA, 64 nt, Human
uccuuugagcagugcucucaagagcuccgugccuguccacaaugaccuagagugcauccugcuc

SEQ ID NO: 39467 - RNA, 64 nt, Human
gccucagucucccucccuuggggccuaugcagagguccacaacacacagauuugagcucagccc

SEQ ID NO: 39468 - RNA, 64 nt, Human
ucaaacaaugguuugaaacaacuacuggaauauuguccacaauaagcuggaaguuuguuguagu

SEQ ID NO: 39469 - RNA, 64 nt, Human
uacagcacaauauuuauuuuaaagugaauaaaauguccacaagcaguguugucauguagucaau

SEQ ID NO: 39470 - RNA, 64 nt, Human
cuggagcagcucucgagaacuaccuguugguauuguccacaagcucucccgagcgccccaucuu

SEQ ID NO: 39471 - RNA, 57 nt, Human
cuuugcuccaaaaaaaauaguguuauuguccacaagauuguuuugguguuucucaag

SEQ ID NO: 39472 - RNA, 64 nt, Human
cauuucaaaugcccaaagcaacaguuugucuccaguccacaaucuuucaaaaaugccauuuaug

SEQ ID NO: 39473 - RNA, 64 nt, Human
uugaacaauuccccagaugaugcugaugcuccugguccacaaugugagaaccacuaaguuggag

SEQ ID NO: 39474 - RNA, 64 nt, Human
ugaugagguuacaugcugcuugccuccaccagauguccacaacaauaugaaguacagcagaagc

SEQ ID NO: 39475 - RNA, 64 nt, Human
gcugugcucaccuucauggggcuguuuccagcucguccacaagcucaucgauuuucuuuaguag

SEQ ID NO: 39476 - RNA, 64 nt, Human
auaacaaagaagaagcaauggucgugccaaagagguccacaaccaggugugcacuguucacugc

SEQ ID NO: 39477 - RNA, 64 nt, Human
aaaauuuuuauauaccaaugagcuuuuugguagcguccacaauguuuaaaauauuucauaggcg

SEQ ID NO: 39478 - RNA, 64 nt, Human
caugcccauaccccuggccaaggaagaucccuuuguccacaaguaaaaggaaaugcuccuccag

SEQ ID NO: 39479 - RNA, 64 nt, Human
accauauaaagaauucuuuugaggauggaauucuguccacaaaauaauuuugugagcccagaua

SEQ ID NO: 39480 - RNA, 64 nt, Human
ccuaccacuucugucuugggcugaaguugcccacguccacaaaaucuguacucccagcgggggu

SEQ ID NO: 39481 - RNA, 64 nt, Human
aaauucacaucaaagucaaacccacaaccaagucguccacaaauacuucacugccugaugauaa

SEQ ID NO: 39482 - RNA, 64 nt, Human
aaauuuaaaugagauaaugcaguugcaacuguguguccacaaguauggacaucaaaucuguggg

SEQ ID NO: 39483 - RNA, 64 nt, Human
aguuaauuuggaaugauaauuccagagauaaaguguccacaacaguuagggaaaugaugcuaga

SEQ ID NO: 39484 - RNA, 64 nt, Human
augccagugcccagaagcagugagauuagucuguguccacaagcagaggcccccucgaugggag

SEQ ID NO: 39485 - RNA, 64 nt, Human
uaggagaguggaugauagaugcaaaauaauaccuguccacaacaaacucuuaaugcuguguuug

SEQ ID NO: 39486 - RNA, 64 nt, Human
uacuguuuggauguagcauagucuugagucuagcguccacaaagaauuauucaaaugauauuua

SEQ ID NO: 39487 - RNA, 64 nt, Human
uaggauagauugugggacccaggcaggaacagguguccacaagaacucaggauggcaucaguua

SEQ ID NO: 39488 - RNA, 64 nt, Human
acuagcuaacuccaagagaucguuagcagcaucaguccacaaacacuuaguggcccacaauaua

SEQ ID NO: 39489 - RNA, 64 nt, Human
uccacucuaauggauaguguacauucuucuuaaaguccacaacagcagauuuucuugcaguaaa

SEQ ID NO: 39490 - RNA, 64 nt, Human
ucaucugugaagugguggugucaggugagaaggcguccacaaaagaggggagaaaaggcgacga

SEQ ID NO: 39491 - RNA, 64 nt, Human
cagcccccugaggcccagagacaugcagcucucuguccacaaccaugccacuugcaugggagcc

SEQ ID NO: 39492 - RNA, 64 nt, Human
acaaaugugaagaauauggcaaagccugugaaugguccacaaaccugaaugagcagaagaaaau

SEQ ID NO: 39493 - RNA, 64 nt, Human
uuaauauauaauacuuuaaauuuuaaaaauucuuguccacaaggaaauuugucuggguuauugg

SEQ ID NO: 39494 - RNA, 64 nt, Human
cguguaaaccaaagcccuaaaauuccacugcguuguccacaagacagaagcugaagugcaucca

SEQ ID NO: 39495 - RNA, 64 nt, Human
agaaugagguugacuaaugcauauuaugaauugaguccacaaaggaacacaaaacucuuuguaa

SEQ ID NO: 39496 - RNA, 64 nt, Human
uuugcaggaaggcagacgagacaguguuuaaaaaguccacaagaaugaucaaguaagauuuguu

SEQ ID NO: 39497 - RNA, 64 nt, Human
uaucuuuaccaacaucuugaauauauauucuaguguccacaagauuuagcaaaaagauaaagcu

SEQ ID NO: 39498 - RNA, 64 nt, Human
uacuguagcuacggaaccagauucuggugaauuuguccacaaucagccauuggccugucugggg

SEQ ID NO: 39499 - RNA, 64 nt, Human
uugugaccaguaccaaucuugaguuucuuuuucuguccacaaguaaauuaauaucugcucugaa

SEQ ID NO: 39500 - RNA, 64 nt, Human
agauaaaguuugagugaguucauugggauaaaugguccacaaucuuaaacagaauacugugagc

SEQ ID NO: 39501 - RNA, 64 nt, Human
cacgcacagaggugaacagaaacugaaacauuuuguccacaacuucacgggacguggccagacu

SEQ ID NO: 39502 - RNA, 64 nt, Human
uuuuuucccagcccaaauucuccucucuaaaaguguccacaagaagggguguuuauucuuccaa

SEQ ID NO: 39503 - RNA, 64 nt, Human
ucaucuguugggaaccugugauauaccuccauuuguccacaagaugguguuuaaaacaauuugu

SEQ ID NO: 39504 - RNA, 64 nt, Human
uuaauauaagcuuuuaagcaguuaucuaacuaguguccacaacccuguaaccauacuuccacau

SEQ ID NO: 39505 - RNA, 64 nt, Human
cagguuaaugacuccagagaguaagaucagauucguccacaaagagaugggcauaauaccaagc

SEQ ID NO: 39506 - RNA, 64 nt, Human
augucauuuuaaaaucugaaggaaagaauuugaaguccacaaaaaguguuugagguucuuuggu

SEQ ID NO: 39507 - RNA, 64 nt, Human
aaaaaauagagaugagacuuuuugugucaacucuguccacaagagugaguuaucuaguaugauu

SEQ ID NO: 39508 - RNA, 64 nt, Human
acuguacuuggagaaaucguguuuuaaagcaguaguccacaaaguauucugcucaugugccccc

SEQ ID NO: 39509 - RNA, 64 nt, Human
aaagaaaauugauaagaaaacuuugagggcccaaguccacaauuuggugagaccacuaaauuuu

SEQ ID NO: 39510 - RNA, 64 nt, Human
auauuuggaagcaaaugauauuuccucuugcaguguccacaaaucugaauauuaggggcaugaa

SEQ ID NO: 39511 - RNA, 64 nt, Human
gauuuggcaggaaauaaggcgauuaacccuauguguccacaagccucaagccuuguuucagguc

SEQ ID NO: 39512 - RNA, 64 nt, Human
cccacauuauagauaaagcugcuuaaacuuaaaaguccacaaagcuacgccgaccagaaaaaaa

SEQ ID NO: 39513 - RNA, 64 nt, Human
guugugacugcucaacauccccaucaagguuugaguccacaaaaguggaccucccuaucaugcu

SEQ ID NO: 39514 - RNA, 64 nt, Human
cuggucuugaccaaaauagaaaaaaaaaaaaaaaguccacaaauuuaaucacuuguagggaacc

SEQ ID NO: 39515 - RNA, 64 nt, Human
gagccccguggagcgcggccugcacgggaguuguguccacaaaggcaaaguaaagggguggaau

SEQ ID NO: 39516 - RNA, 64 nt, Human
ugcuugcacauugccugucccagagccccuguggguccacaagccccuguccucuuccuucaua

SEQ ID NO: 39517 - RNA, 64 nt, Human
cugcugcugguccucaguaccagcgcccggggguguccacaaccacuugggacagaagaaggug

SEQ ID NO: 39518 - RNA, 64 nt, Human
uggagaaggaacuuuauguucccucuccugcuguguccacaaccuuagaaaucuguagcuagau

SEQ ID NO: 39519 - RNA, 64 nt, Human
gcauucacaacuuguuuuugguuuuuaaaacccaguccacaaaauaaccaauccuggacaugaa

SEQ ID NO: 39520 - RNA, 64 nt, Human
ccagagaaaccuggccuggguugucucaaauccuguccacaaggcaacuccagaagaaagaagc

SEQ ID NO: 39521 - RNA, 64 nt, Human
acauccacuucccccgcagcucgugugggcgcucguccacaaacacuccguggcugagaggcag

SEQ ID NO: 39522 - RNA, 64 nt, Human
uuaaugugggaauugauacacaagaagguacuuaguccacaagaucaggauguacaagauaacc

SEQ ID NO: 39523 - RNA, 64 nt, Human
gccagggagcugggagcgagcaagcugaggccacguccacaaggagcuuuucaugccccugugc

SEQ ID NO: 39524 - RNA, 64 nt, Human
uagcagcauccuugggggaagggaaaggugcaugguccacaauguaugguuuggucccauggga

SEQ ID NO: 39525 - RNA, 64 nt, Human
ucccaaauguauucuacuuguucuaaaacaaucuguccacaaauauaaaacuauaaguaauaaa

SEQ ID NO: 39526 - RNA, 64 nt, Human
gcugcugcuggcucuccuuggccucgccguccuuguccacaagcacuauggcccccggcucaag

SEQ ID NO: 39527 - RNA, 64 nt, Human
cuacugacugcacaucuuaaauauaucuuuaucaguccacaaguccuuccaauuauauuuccca

SEQ ID NO: 39528 - RNA, 64 nt, Human
gcccaccugggcccuaggcauacucuccaggauuguccacaaauguccucagagggucccuagg

SEQ ID NO: 39529 - RNA, 64 nt, Human
uugucuccugguacccaaagaaauacugaguuguguccacaacauggcugggucuucagacccc

SEQ ID NO: 39530 - RNA, 64 nt, Human
auaaaaaaccuucaagucuacuuacccuucuccuguccacaauaaaguugagaaaacaccaagc

SEQ ID NO: 39531 - RNA, 64 nt, Human
aaccaaagacauuuaagcauaguaagaaucugauguccacaagaacaggaacuggguuaauaau

SEQ ID NO: 39532 - RNA, 64 nt, Human
uguuugggcuggcaagcaaauccgacacgacgagguccacaaacuguuucugcaucccagggcu

SEQ ID NO: 39533 - RNA, 64 nt, Human
uuauaucagucacuugccacucccccacccuccuguccacaacuccuuuccacuuuaggccaau

SEQ ID NO: 39534 - RNA, 64 nt, Human
ucuguaggcuucugggaggucccuuuucagggguguccacaaagucaaagcuauuuucauaaua

SEQ ID NO: 39535 - RNA, 64 nt, Human
uuugaaacuucuguccucuuuggaugagaucaguguccacaaguggccgacauggaacaugcug

SEQ ID NO: 39536 - RNA, 64 nt, Human
aaccauaucugcuuuauccuaggugaggguagcaguccacaauggaauagaagaaaaucccauu

SEQ ID NO: 39537 - RNA, 64 nt, Human
auuauggccuauugaacaaaaugugaaacugggaguccacaaagacauaaauggaaagaugaag

SEQ ID NO: 39538 - RNA, 64 nt, Human
uuuaguuuacaguauauggauucuaugaaaaaauguccacaacacaguaauuggucacuuguua

SEQ ID NO: 39539 - RNA, 64 nt, Human
gugagaguugaauaguugcaucagagaguauaugguccacaagccuaacuuauucacucucugg

SEQ ID NO: 39540 - RNA, 64 nt, Human
uggaaagucgcggugaaugcgugcaugucucaauguccacaaaggauucuggcuacccuuuggu

SEQ ID NO: 39541 - RNA, 64 nt, Human
ccuaacaucaugcauucacaaggucaaaguucugguccacaaacccuucccuauagaaguucaa

SEQ ID NO: 39542 - RNA, 64 nt, Human
ugaauuaaauacaguugucuugaggguaugauaaguccacaaaaaauuggaaagcaucuuaccc

SEQ ID NO: 39543 - RNA, 64 nt, Human
aauggucuuaauggugcucacuuuagcagacagcguccacaaugugaauccuacaguuuccagg

SEQ ID NO: 39544 - RNA, 64 nt, Human
aaaucucaccuuuggggcugcguuucaucaccucguccacaauagucaauccuaauuguggucc

SEQ ID NO: 39545 - RNA, 64 nt, Human
gcuuucaagcgcuuggcagaaucuuguacuucguguccacaaugguacugaauuugcaucugca

SEQ ID NO: 39546 - RNA, 64 nt, Human
guggguguuguugcccuggguggccuguggcuccguccacaagucaugcugaguuuugcagccu

SEQ ID NO: 39547 - RNA, 64 nt, Human
gugucuagaggcagguagggggucccuccaagugguccacaagcuucuguccugcccccaagga

SEQ ID NO: 39548 - RNA, 64 nt, Human
aaagaacagaaguuguuuggaccuuagagccauuguccacaaucacggaugguucucaagaguu

SEQ ID NO: 39549 - RNA, 64 nt, Human
ccagagggaugacuuccaguuccgucuguccuuuguccacaaggaauuucccuggacgcuaauu

SEQ ID NO: 39550 - RNA, 64 nt, Human
ccgagcagccuggacuuuacaguuaugugaaacuguccacaaaaagucauggcaauaauggugu

SEQ ID NO: 39551 - RNA, 64 nt, Human
auggugggcaccaucucucugaugacaguucuguguccacaacccagaccccuccacacaaacc

SEQ ID NO: 39552 - RNA, 64 nt, Human
gucguuuuuuuggcaauucuuccacgugggacuuguccacaagaaugaaaguagugguuuuuaa

SEQ ID NO: 39553 - RNA, 64 nt, Human
gaucucugcccacggaaaggauuuaauccaaaugguccacaagaggaaugugcuuaauuccuac

SEQ ID NO: 39554 - RNA, 64 nt, Human
uaaccauuuuuuuuaaguuugacuacauagucaaguccacaagccaucaagcacuccuaccuua

SEQ ID NO: 39555 - RNA, 64 nt, Human
uaaucuuaacuaauuacauuugcaaggaucuuauguccacaaaagucacagucugaggugcugg

SEQ ID NO: 39556 - RNA, 64 nt, Human
accuaaacuauuccugcagaacugccugguuggcguccacaagcaauaccucucguuccagcag

SEQ ID NO: 39557 - RNA, 64 nt, Human
ccugagauaaugguuuccaaacuguaucguagccguccacaaagauguaauccaaaucuauuuu

SEQ ID NO: 39558 - RNA, 64 nt, Human
agucccaggugggacucuucuggggacacuugggguccacaaucccagguccauacucuagguu

SEQ ID NO: 39559 - RNA, 64 nt, Human
ugcaggcuggaaacaugcaggagcugucccugaaguccacaaguggaauuucuucuucaucaug

SEQ ID NO: 39560 - RNA, 64 nt, Human
ccagggacucucagcaaacacgggacuguguucaguccacaaaggaaaagcguuuuugaagcuc

SEQ ID NO: 39561 - RNA, 64 nt, Human
caagccugcauuuuuuugaguuccuacaucauuuguccacaaagauggcuucagagaggugguc

SEQ ID NO: 39562 - RNA, 64 nt, Human
caggcuagacagaaacaugucuugacuguuaguuguccacaaaucuucaguauuuucuccacuu

SEQ ID NO: 39563 - RNA, 64 nt, Human
aaauuuuccagauacuugcuuuaaagcuacuuuuguccacaaaugaaauacugucacaguagac

SEQ ID NO: 39564 - RNA, 64 nt, Human
cugcccgaggcgccagcucaguuucaccguccacguccacaaggggcuuuucccaccuucaccu

SEQ ID NO: 39565 - RNA, 64 nt, Human
cuguugggaccagccacucaccaaggcugaguagguccacaaauaauggggacuuucuaccaga

SEQ ID NO: 39566 - RNA, 64 nt, Human
uuguagucuuuaaauucuuggucccugaggccaaguccacaacuugccuucuagucacuugccu

SEQ ID NO: 39567 - RNA, 64 nt, Human
cagugcucccugggucauaccaggaucugccucuguccacaaagaugagggaaaaugaugacug

SEQ ID NO: 39568 - RNA, 64 nt, Human
gcugggaaaccucacccuugcaccguccucagcaguccacaaagcauuuucauuucuaauggcc

SEQ ID NO: 39569 - RNA, 64 nt, Human
cuggcugcaaaggagguucauauuccccagauguguccacaaaccuguccaggaguugugucuu

SEQ ID NO: 39570 - RNA, 64 nt, Human
cccuguccacacacucccuguccacacacucccuguccacaacugcagccgggcccucugccua

SEQ ID NO: 39571 - RNA, 64 nt, Human
cuccauucacucccaggugagaauucaggcaaacguccacaaaggucacaggcagcguacauac

SEQ ID NO: 39572 - RNA, 64 nt, Human
auaccacaacagcagcaggggccugaaaugugauguccacaagagcuaauacccuacagauggg

SEQ ID NO: 39573 - RNA, 64 nt, Human
uuaggggaagugagauuuaaaaaaccauucacagguccacaauauucauacuauguguuugcag

SEQ ID NO: 39574 - RNA, 64 nt, Human
ccuggcgccuggcggucaccuggugccuacuguccgacaggaugccuugauccucgugcgaccc

SEQ ID NO: 39575 - RNA, 64 nt, Human
cagcggguuacauccacacugcugaucacaccaacgacaggagcugauaagcaagaaagcguca

SEQ ID NO: 39576 - RNA, 64 nt, Human
acggaugcccacagggccugggcaguugcuguggcgacaggaagagcuaaucuucagagagcuc

SEQ ID NO: 39577 - RNA, 64 nt, Human
aaauaacggugcuugugucacuagcauagaauagcgacaggaauagaugugguccuuaggagac

SEQ ID NO: 39578 - RNA, 64 nt, Human
aggaggccugcagauccagccuuccugucaacagcgacaggaaaucucuagguuggugagugcu

SEQ ID NO: 39579 - RNA, 64 nt, Human
uaguugucacuuuauuuuggaccugcugugaucucgacaggaaacgugccacagagcaguagug

SEQ ID NO: 39580 - RNA, 64 nt, Human
gaaggugaggucugggaugcugcgugcggcgcgacgacaggagguaugaccuggguggggucag

SEQ ID NO: 39581 - RNA, 64 nt, Human
ccauuguuguuuacuuuaguucuggaacugaaaccgacaggaagaaacuuuggaauaaggaaga

SEQ ID NO: 39582 - RNA, 64 nt, Human
uuuccuugcucucacccacggauaaaaccagaagcgacaggaggccagcuccugggguuccugg

SEQ ID NO: 39583 - RNA, 64 nt, Human
caagauaaaaccagagcaggaaagaugaugcaagcgacaggaaaggcccucugcuuuucuuccc

SEQ ID NO: 39584 - RNA, 64 nt, Human
gaggaacucuccuguggccugcucaucacccuuccgacaggagcacugcaugucagagcacuuu

SEQ ID NO: 39585 - RNA, 64 nt, Human
gucuguccacguggagagaaguugcccuccaggccgacaggaggccaugcccaccgccccugga

SEQ ID NO: 39586 - RNA, 64 nt, Human
ugucccauggcuacauccugugggugggggcccucgacaggacagcaggacgguuuguuuucag

SEQ ID NO: 39587 - RNA, 64 nt, Human
uaccgucacuagcccagccaggcuucagucuguccgacaggaagcugcuggguggggguggggg

SEQ ID NO: 39588 - RNA, 64 nt, Human
cuuuaauguugcccacauuaagcacuguggaucacgacaggaaaaagguuggagcagugcuuuu

SEQ ID NO: 39589 - RNA, 64 nt, Human
uugcuaggauggaauugcaauuugcaagcuucuucgacaggaaacuacaaguuccacacuuuaa

SEQ ID NO: 39590 - RNA, 64 nt, Human
uugugucccugaaguucccuguugcaugagccugcgacaggaccucacccccaccaccaggcuu

SEQ ID NO: 39591 - RNA, 64 nt, Human
cccaccaaucuggugaggauaaugguggcuccagcgacaggaggccaacccuggagaccaagaa

SEQ ID NO: 39592 - RNA, 64 nt, Human
agcuaguugggcgccccccacccucccccggacucgacaggagccuggaccuccggcuucauuu

SEQ ID NO: 39593 - RNA, 64 nt, Human
aggcugcuggacacgucggacagcgaaguauccccgacaggacgggcuugggcuuccauuugug

SEQ ID NO: 39594 - RNA, 64 nt, Human
cccagcaccagagcacaaugagaaacggcagcgccgacaggagcggcggcagaugaagcgguua

SEQ ID NO: 39595 - RNA, 64 nt, Human
caggcagcucccugaccauuuggacacauugccacgacaggagccuccaaguaugugggagggg

SEQ ID NO: 39596 - RNA, 64 nt, Human
ugggcuccugggcugaacauggaccacgcaguugcgacaggaggccaggggaaaaaccccugcu

SEQ ID NO: 39597 - RNA, 64 nt, Human
ucagccugcuuugagccucagugagaaguccuuccgacaggagcugacucaugucaggauggca

SEQ ID NO: 39598 - RNA, 64 nt, Human
cucagaaguugcugccaccaacucuuuaagaaggcgacaggaucaguccuucucucggguucug

SEQ ID NO: 39599 - RNA, 64 nt, Human
gaggccaccuccaagccgcgggugcccccuagggcgacaggagccagcgggacgccgcacgcgg

SEQ ID NO: 39600 - RNA, 64 nt, Human
auaaaggaaagguacuggcuugaagucacaaccacgacaggaguaaggauuuggaauaaggauu

SEQ ID NO: 39601 - RNA, 64 nt, Human
ccaagggcugaauccaguggagcugggccaaguacgacaggaguccagauaaagguguaggggc

SEQ ID NO: 39602 - RNA, 64 nt, Human
ccgaacacacgcugugagccaccaagaccuggggcgacaggagaaccgguccucucucugacgg

SEQ ID NO: 39603 - RNA, 64 nt, Human
ucuuacaggugguugucugggguggguggaguggcgacaggauagagcugaaggacuaugcaaa

SEQ ID NO: 39604 - RNA, 64 nt, Human
acaacacucuagaacuggagagagguccagauugcgacaggagccacaccagagugugcaggcu

SEQ ID NO: 39605 - RNA, 64 nt, Human
uagaggacugucacucuagcaucuuugaggacugcgacaggaccgggacagcaggccccuugac

SEQ ID NO: 39606 - RNA, 64 nt, Human
aagcugacccugugaucucugcccugucuucgggcgacaggagccagaaaaucagggacauggc

SEQ ID NO: 39607 - RNA, 64 nt, Human
cuuugaggugucucaaucugaucugagugagaggcgacaggaguauuuuuuuuuuuuuacagcu

SEQ ID NO: 39608 - RNA, 64 nt, Human
gggggaagaacuaggggcuccauuguucuucaggcgacaggagaccguugcuccagugcauguc

SEQ ID NO: 39609 - RNA, 51 nt, Human
aggaccacgagcggaaguagccgacaggagggcgaggccccugggacggac

SEQ ID NO: 39610 - RNA, 64 nt, Human
agaaccggcgcugggcaacacgggccugcaaacucgacaggacccugcccgaggggcccucgcg

SEQ ID NO: 39611 - RNA, 59 nt, Human
ucuccaacuccuaccccauugcauggguuguugcggacauccaauaaagauuuuuuuag

SEQ ID NO: 39612 - RNA, 59 nt, Human
ugugugugugauuuuuuuuuuaaauuuauguugcggaaagguaaccacaaaguuaugau

SEQ ID NO: 39613 - RNA, 59 nt, Human
uguuauuuuaugaagaguucuagagcaagguugcggaaaucgggguggagauggggagc

SEQ ID NO: 39614 - RNA, 59 nt, Human
caucuucuguaacagaagucaguacuccuguugcggagaaaggagucauacuugugaag

SEQ ID NO: 39615 - RNA, 59 nt, Human
uuucugaugaucauugcuggcaugaagcuguugcggacaucauucugcaacccgguuua

SEQ ID NO: 39616 - RNA, 59 nt, Human
uuaguugaucaagaauuuuggggguggggguugcggagaaaucaaguuuaaaauuccuu

SEQ ID NO: 39617 - RNA, 59 nt, Human
acggguggaagcacugaccguauccagaaguugcggaaagaguauuaucaggcucggag

SEQ ID NO: 39618 - RNA, 59 nt, Human
ucaucuguccgacaaguucacucgccucgguugcggaccuaggaccauuucucugcagg

SEQ ID NO: 39619 - RNA, 58 nt, Human
uucgcaagaagcuggauuaggacccaggguugcggagagacgcggccccucccgcgug

SEQ ID NO: 39620 - RNA, 59 nt, Human
gaauuguacguaaauauaaaggaucuacuguugcggaaaauuaagaagcuaaauacugc

SEQ ID NO: 39621 - RNA, 59 nt, Human
auguuccaagugcuacucucacucagccuguugcggaucuucauggccucaggagacuu

SEQ ID NO: 39622 - RNA, 59 nt, Human
uccggaucuucaucauggaaguuucauuuguugcggaauauggaagcaccucccaaugg

SEQ ID NO: 39623 - RNA, 59 nt, Human
uguuaucugugaaacuccaaaacagggguguugcggagaagggagaguucaaggcaaac

SEQ ID NO: 39624 - RNA, 59 nt, Human
uuuuguuccuccguaguccaaagggcagaguugcggaaggccgucggggcuuggugagc

SEQ ID NO: 39625 - RNA, 59 nt, Human
cgaaggggaggugguguacauaggaacgcguugcggaguccgccccgucccccgagggg

SEQ ID NO: 39626 - RNA, 59 nt, Human
agggagauuuucuggaagggccacaggagguugcggagcuuggauguugcccuuaguuc

SEQ ID NO: 39627 - RNA, 59 nt, Human
caaagcaagacuggacacaugccgagggcguugcggauagugccucaccauugcccacc

SEQ ID NO: 39628 - RNA, 59 nt, Human
ccugacugcucagaacuugcugcugucuuguugcggauggauggaagguuggauggaug

SEQ ID NO: 39629 - RNA, 59 nt, Human
gaugugaggaacacaaguucauuucuguuguugcggagacacugcagacuccacugugc

SEQ ID NO: 39630 - RNA, 59 nt, Human
uaaaaucugagggaucauugccagagauuguugcggagggaaauguuaucaacgguuuc

SEQ ID NO: 39631 - RNA, 64 nt, Human
gggcuugcugcagaaaccuggccuacggaagauacgacaccacugggaggguuguguaggugcc

SEQ ID NO: 39632 - RNA, 64 nt, Human
accacgcuuccuaacugcugcuucucagggaauccgacaccagccaaccauuuuaagccucuaa

SEQ ID NO: 39633 - RNA, 64 nt, Human
ugaccaccuuaaaaacuuucacagugguuccgcucgacaccauuguuuuauuauauuauaucag

SEQ ID NO: 39634 - RNA, 64 nt, Human
gcugaggcgggcagaucuccugagcucaggaguucgacaccaucuugggcaacauggugaaacc

SEQ ID NO: 39635 - RNA, 64 nt, Human
gaguaagugggaucacagggaaggauguuggcagcgacaccaucccauacaggcucuuaccucu

SEQ ID NO: 39636 - RNA, 64 nt, Human
auggacaaccuggcaacugugagucccugcuucccgacaccagccucauggaauaugcaacaac

SEQ ID NO: 39637 - RNA, 64 nt, Human
uccgagccucgguuuccuuaucuguaaagcaaagcgacaccagcaagccugugagcauugugua

SEQ ID NO: 39638 - RNA, 64 nt, Human
ccaaacccuuagcagcccagcauuucccgaaggccgacaccacuccugccagcccggcucggcc

SEQ ID NO: 39639 - RNA, 64 nt, Human
uugaaggaaccuggucagucuccgguucagcuuccgacaccagaguggaacccaguaagcacca

SEQ ID NO: 39640 - RNA, 64 nt, Human
ggaucagcaaugcucuguugccaucgugcugggacgacaccagcucuauugccaccgaugagua

SEQ ID NO: 39641 - RNA, 64 nt, Human
ucaguuuguccacacaagacagcagagccaucugcgacaccaccaacaggcguucucagccucc

SEQ ID NO: 39642 - RNA, 64 nt, Human
uugaccgugaggagcugcuauccgcaaccagcgccgacaccaugcccccucuuccuggugacac

SEQ ID NO: 39643 - RNA, 64 nt, Human
gacaagaauuugauguaacgcaaauggaaaaacucgacaccacauuucaggcuuuacccaacau

SEQ ID NO: 39644 - RNA, 64 nt, Human
cuccuggggcgcuuccaggcauucugcccugccccgacaccagaacccuggugcuggugggcca

SEQ ID NO: 39645 - RNA, 64 nt, Human
guuccugagggcucuccuuguuccuccggguguucgacaccagacguggggauuucaacagggg

SEQ ID NO: 39646 - RNA, 64 nt, Human
gaacccaggaaguggcaguugcagugagccgagacgacaccacugcacuccagccugggugaca

SEQ ID NO: 39647 - RNA, 64 nt, Human
uacauaacaaaacagcccccaaacagcccagugccgacaccauuguuccuuucacacuuuccuu

SEQ ID NO: 39648 - RNA, 64 nt, Human
guuuuagcugcagccuuggaaggaggcaccgacacgacaccaggcaggagugagccucaggccc

SEQ ID NO: 39649 - RNA, 64 nt, Human
uaugggggaaggggagguugagaaaggaaguucucgacaccagaaaugcaucggaggaccacaa

SEQ ID NO: 39650 - RNA, 64 nt, Human
cuuugaggugggcaauggcuugagcccaggaguucgacaccagccuggccaacacagugaaaug

SEQ ID NO: 39651 - RNA, 64 nt, Human
uucagaaggccucaucuccacuugccaggagccccgacaccacccuuggagacacggcuuguuc

SEQ ID NO: 39652 - RNA, 64 nt, Human
ccuuucucccccuaaacuuuggccggccgccgggcgacaccacgaguuauuucccagcuauuuc

SEQ ID NO: 39653 - RNA, 64 nt, Human
agguggugaucaucgacgaggcgcacaaccugaucgacaccaucacgggcaugcacagcgugga

SEQ ID NO: 39654 - RNA, 64 nt, Human
uggccucacugaucuacaacuucguccuguuccccgacaccaagacccuggcgcagcggcuggc

SEQ ID NO: 39655 - RNA, 64 nt, Human
aggaucuccccagcaaagcaccuucagaauguaucgacaccagcuggguuagggucaagggugc

SEQ ID NO: 39656 - RNA, 64 nt, Human
gcugcagccuccucuuucugucucugaucagagccgacaccagacgugauuagcaggcgcagca

SEQ ID NO: 39657 - RNA, 64 nt, Human
caugccugcccagaaaugaagcccggcccacacccgacaccagcccugcugcuuccuaacuuau

SEQ ID NO: 39658 - RNA, 64 nt, Human
acauguucccugggacagauccaggucugcagaucgacaccagugggcccaggaccugggggug

SEQ ID NO: 39659 - RNA, 64 nt, Human
gggccccacccugccauaugaaggaccccacccccgacaccacaaggcauuauuauucuauuaa

SEQ ID NO: 39660 - RNA, 64 nt, Human
cucccaccugccccaauaagaucugcucugucugcgacaccaagauccagcuggggacuccccu

SEQ ID NO: 39661 - RNA, 64 nt, Human
cacgaugacgccucuggaccucggugaugccuuccgacaccacugggaaccaagggcccucacu

SEQ ID NO: 39662 - RNA, 64 nt, Human
ggcagaaggagaggcccggugcagcugagguucccgacaccagaagcuguugggagaaagcaau

SEQ ID NO: 39663 - RNA, 64 nt, Human
gcaaaauuacacagcuggucccugugaugugucucgacaccaauacacaacccccuucccacca

SEQ ID NO: 39664 - RNA, 64 nt, Human
uuuuguccaacggacaagaaaaaagcaaagucaacgacaccauuaucuugucaagaucagaugg

SEQ ID NO: 39665 - RNA, 64 nt, Human
caccaaaagucacuuuuccaacuuaugugaugggcgacaccaagaagaccagugccccaccuuu

SEQ ID NO: 39666 - RNA, 64 nt, Human
gaccugccucacccaccaaugcagccggggcuggcgacaccagccaggugcuggucuugggcca

SEQ ID NO: 39667 - RNA, 64 nt, Human
cuuucuuccuuucucucuuugccuuuaguuugcccgacaccagcagaaaaguggaccuuggggg

SEQ ID NO: 39668 - RNA, 64 nt, Human
gagcuuguggcuugaauguuaaaggugugaccaccgacaccacucaugucaauggcugaaaguu

SEQ ID NO: 39669 - RNA, 64 nt, Human
ugggaaagcuuuuauucagaugucaaaccucauucgacaccagagaauucauacgggugagaaa

SEQ ID NO: 39670 - RNA, 64 nt, Human
uaaccugacugaguccugggcagaugauaacccccgacaccauggccuggcugcccacuccuca

SEQ ID NO: 39671 - RNA, 64 nt, Human
cuaugcaaccuaaagccaugguuccccccaggcccgacaccacuggccccggaugccucugccc

SEQ ID NO: 39672 - RNA, 64 nt, Human
ugucccgggaagcagcccagccuguggcugcccccgacaccaggaggagggccaggagaguucc

SEQ ID NO: 39673 - RNA, 64 nt, Human
gacaugugagccacucagaacucaccaaaauguucgacaccauaacaacagcuacucaaacugu

SEQ ID NO: 39674 - RNA, 64 nt, Human
cugcaggcccucgaggccccggagggcugggguccgacaccaagggcgggccgcgcggccuugc

SEQ ID NO: 39675 - RNA, 64 nt, Human
gaugugguuuuucggguuccccagcagcaucucccgacaccaacugugccgcuggcucccugcc

SEQ ID NO: 39676 - RNA, 64 nt, Human
aggcugaggcagguggaucacgaggucaggagaucgacaccauccuggcuaacacggugaaacc

SEQ ID NO: 39677 - RNA, 64 nt, Human
gaaggggcagaccaacgaaaccagaugagaccaacgacaccaugcgagacacgcuugcagacac

SEQ ID NO: 39678 - RNA, 64 nt, Human
uuuaaagauuugauauacauggaguguuucuucucgacaccaaaauuuucauguguuccaacag

SEQ ID NO: 39679 - RNA, 64 nt, Human
guguaauuuuguucuaguuuucaguuuguauauacccguacaacguguccucacggugccuuuu

SEQ ID NO: 39680 - RNA, 64 nt, Human
gugcggggccuggacuugccuaggauuucccgaccccguacaaaccaaguugcccucuccgagc

SEQ ID NO: 39681 - RNA, 64 nt, Human
cccccagggacccuugccccaggacaccgccuaccccguacagaccccuucacuccggggugcu

SEQ ID NO: 39682 - RNA, 64 nt, Human
uugccuauguagagaacacgcuucacccccacuccccguacagugcgcacaggcuuuaucgaga

SEQ ID NO: 39683 - RNA, 64 nt, Human
uucuuuaucuugugcacaugauacaaaauauguucccguacaauauggggcugucacuucuugc

SEQ ID NO: 39684 - RNA, 64 nt, Human
ccaagagcguccugcggucucgcuggcacagcgccccguacacuaggggguccuacagcuacgu

SEQ ID NO: 39685 - RNA, 64 nt, Human
caccacaggcacccuggauggcccggccccggggcccguacacaggcggggccagcacaguagu

SEQ ID NO: 39686 - RNA, 64 nt, Human
cuccucccccacucucaauaccuagagagugaaacccguacaaugagauaaagacuaaaaagag

SEQ ID NO: 39687 - RNA, 64 nt, Human
ucaggaaagcccgcugccccaccccucgggcccacccguacagaggcugguggucgccgggaua

SEQ ID NO: 39688 - RNA, 64 nt, Human
caaaaaaacagagguuuuaacacauaaguaaaaacccguacauauuugauguguaaugcagguu

SEQ ID NO: 39689 - RNA, 64 nt, Human
ggaccacggcaaaaggaaccacccagacccaccacccguacacccucagcagacccugaagacu

SEQ ID NO: 39690 - RNA, 64 nt, Human
caggacaguucaugguaauguugcccucugaggccccguacaccagaagggaggcccuggaaaa

SEQ ID NO: 39691 - RNA, 64 nt, Human
cuccuagacugacuaggauucugcaggaacaugacccguacacaccacgcgucacccaacgacc

SEQ ID NO: 39692 - RNA, 64 nt, Human
agccuuuccugcagccuggagguguccaaggauucccguacagugacugugucucaccgcccac

SEQ ID NO: 39693 - RNA, 64 nt, Human
ugagguuucaaaaauaaaaauugaguccacucuccccguacacacacacucgggcacuucagga

SEQ ID NO: 39694 - RNA, 64 nt, Human
ccugaagggaauuugaggaccgccgccagggcaccccguacauacacacagcugcuuuugugga

SEQ ID NO: 39695 - RNA, 64 nt, Human
ccuccccgcugaccgcuccuccagccccgccucccccguacaggcagagcgcccgcccaccucu

SEQ ID NO: 39696 - RNA, 64 nt, Human
cagcccagccgcccagccacaugugucugccugacccguacacaccagggguuccgggguuggg

SEQ ID NO: 39697 - RNA, 64 nt, Human
aucgauguagccgaaugaagggcgcugguggccucccguacaaacuuggacaacacggagcagg

SEQ ID NO: 39698 - RNA, 64 nt, Human
ccacguuucaggcaggcaccuagcaauuccaucacccguacaggcaauuccgucuucuuaaucu

SEQ ID NO: 39699 - RNA, 64 nt, Human
gccucauccagagaaggagcugcagaugagggagcccguacacucccugccaccacuagguugu

SEQ ID NO: 39700 - RNA, 64 nt, Human
uucuguaugucucuugugguauuggaacaauaaacccguacaaccugcaguuguggucucaguc

SEQ ID NO: 39701 - RNA, 64 nt, Human
guggauuugagguuaggcagaugaugcuguccaucccguacaccagugggaagagggugagggc

SEQ ID NO: 39702 - RNA, 64 nt, Human
uguggccaagccccacccuuuccuggucaugguacccguacagcguugauggccacagcucgaa

SEQ ID NO: 39703 - RNA, 64 nt, Human
ggggaccaagcagccuuucccguccccuccucgacccguacaguugagagccaggggcuggugu

SEQ ID NO: 39704 - RNA, 64 nt, Human
acugauuucccuuuagaggggaguuaugugacuccccguacaagggcaacccuguuucuuuggu

SEQ ID NO: 39705 - RNA, 64 nt, Human
uaauuuugucaacauauuucagcaguucuacuuucccguacauuuuuuagaaagcauaauuccu

SEQ ID NO: 39706 - RNA, 64 nt, Human
gucugccugagcaacucuauuucaggugccccacaccggcaaguaccagccagcaacaccaacc

SEQ ID NO: 39707 - RNA, 64 nt, Human
cuaggaaaggaaagugccauaucaggguaccgguaccggcaagcucacaucucagccaggggcc

SEQ ID NO: 39708 - RNA, 64 nt, Human
guuauuacgcuacaugacaacguuucgacauuucaccggcaacaccaagaggguuuuuaguggc

SEQ ID NO: 39709 - RNA, 64 nt, Human
caagcccagcccuccagagccagcccuccuggguaccggcaacuacagcagccgggugaagcuc

SEQ ID NO: 39710 - RNA, 64 nt, Human
cuuuuccauaaaguguaauuuuaauggcugcaaaaccggcaaccuguaacugcccuuuuaaaug

SEQ ID NO: 39711 - RNA, 64 nt, Human
guccuauugaucagugacacugccagaggcccauaccggcaagaggaagaggacgucauuuugu

SEQ ID NO: 39712 - RNA, 64 nt, Human
uuuaauuuuuuuggacucaagaucuaugcuuuaaaccggcaagguuauagauacagccucuagc

SEQ ID NO: 39713 - RNA, 64 nt, Human
uuguguuguucccugcuguccuccguauuacgugaccggcaaauaaaucucauagcaguuaaua

SEQ ID NO: 39714 - RNA, 64 nt, Human
ugggucuguggcauuuuccaagggcccacguagcaccggcaaccgccaaguggcccaggcucug

SEQ ID NO: 39715 - RNA, 64 nt, Human
gugucgaaaucaaaccaccaggcauccggcccuuaccggcaagcagcgggcuaacgggaggcug

SEQ ID NO: 39716 - RNA, 64 nt, Human
ggaaagaggaggagggugcagccaaacuuaaggcaccggcaaguguugucagcacuggaggaga

SEQ ID NO: 39717 - RNA, 64 nt, Human
guuuuccuaagugauuguaugaauuuaugcuccuaccggcaauguguggcaguccuagaugcuc

SEQ ID NO: 39718 - RNA, 64 nt, Human
agcauccugccgccuccucucugccugcccacucaccggcaagguugucccucugcccagggcu

SEQ ID NO: 39719 - RNA, 64 nt, Human
ggugagcagagugggaggccggagacugcccuugaccggcaaaugcccugcaacgguggcuccu

SEQ ID NO: 39720 - RNA, 64 nt, Human
ccggcgccccguccccuucugcaugucugaggccaccggcaaccgccgccccacuccagauuug

SEQ ID NO: 39721 - RNA, 64 nt, Human
augaagagaaugccgauacucagacugcagcuggaccggcaagcuggcuguguacaggaaaauu

SEQ ID NO: 39722 - RNA, 64 nt, Human
cuguuuugaauuuuuuuaauuaauagaaagaccaaccggcaaacuuucagaugaaugcuuacug

SEQ ID NO: 39723 - RNA, 64 nt, Human
ucucaagaaagauuauucauucuaucucagaguuaccggcaagcauauaaaaugcuacuuggau

SEQ ID NO: 39724 - RNA, 64 nt, Human
uugugcacguaguagggucaggccacggcagccuaccggcaauuuccggccaacaguuaaauga

SEQ ID NO: 39725 - RNA, 64 nt, Human
ucccuuuuaggugaagccccuuuuucuugcuaaaaccggcaauucuccgguuagaaauguuacu

SEQ ID NO: 39726 - RNA, 64 nt, Human
gggccugagugcccauccaagggcucucaaggacaccggcaaggccuccaggcccugagcccca

SEQ ID NO: 39727 - RNA, 64 nt, Human
aaaucgcucuagcucagaaguugcagagcagccugggcaacauggugaaacccgucucuaccaa

SEQ ID NO: 39728 - RNA, 64 nt, Human
guugcagugagauugcaccauugcauuccagccugggcaacaagagggaaacuccgucucaaaa

SEQ ID NO: 39729 - RNA, 64 nt, Human
cgugaguugagauuggaccacugcucuccagccugggcaacagaguaaaacucugucccaaaaa

SEQ ID NO: 39730 - RNA, 64 nt, Human
accagguuguagaaguugacaggcagugccaugggggcaacagccaaaauagggggguaaugau

SEQ ID NO: 39731 - RNA, 64 nt, Human
aaccugacccccaucugaccacagggcagggguggggcaacaugcgggcugccaaugggacaug

SEQ ID NO: 39732 - RNA, 64 nt, Human
cccgcccuccuggccagcagaguggggcacuggggggcaacagcaacaguuuucuugucuucau

SEQ ID NO: 39733 - RNA, 64 nt, Human
acugagcugagauugugccacugcacuccagccugggcaacaagagcaaaacucugucuggaaa

SEQ ID NO: 39734 - RNA, 64 nt, Human
aaauuuuucuguauauagaaaggaaaacuagccugggcaacaugaugaaaccccaucuccacug

SEQ ID NO: 39735 - RNA, 64 nt, Human
ucccaaaaccucuguacacaaggguggcugucuggggcaacaaguaaugccuugaaggccagga

SEQ ID NO: 39736 - RNA, 64 nt, Human
gccuuuccuuggcccgggccuguggugggaagacgggcaacaaguauaccccaccagggccuga

SEQ ID NO: 39737 - RNA, 64 nt, Human
ggauggcuugaagccaguaguucaagaccagccugggcaacauaguaagaccccaucucuauga

SEQ ID NO: 39738 - RNA, 64 nt, Human
gaauugcuugaguccaggaguuugagaugcgccugggcaacauagaaaccugugucuacaaaaa

SEQ ID NO: 39739 - RNA, 64 nt, Human
agugagcugagaucgcaccauuacacuccagccugggcaacagagccagacucugucucaaaaa

SEQ ID NO: 39740 - RNA, 64 nt, Human
ccccuuuccacaggcagcgucuccacagggagaggggcaacaggaggcugggaaauggugggga

SEQ ID NO: 39741 - RNA, 64 nt, Human
guaagccgagaccaugcuuauugcccuccagucugggcaacaaaaaugaaacuccgucucaaaa

SEQ ID NO: 39742 - RNA, 64 nt, Human
ugguagauuaaaucaugagaaugauuagaaagacgggcaacacagcggguuacauccacacugc

SEQ ID NO: 39743 - RNA, 64 nt, Human
uuauugccugagcucaggaguucgaaaccacccugggcaacauggugaaacccccgucucuacu

SEQ ID NO: 39744 - RNA, 64 nt, Human
ggcccagcaaggucagguuaucugcuuucauucagggcaacaaaugauacaaauggugccaggg

SEQ ID NO: 39745 - RNA, 64 nt, Human
agugacccaagauugugccacugcacuccacccugggcaacagagcaagaccccaucucaaaaa

SEQ ID NO: 39746 - RNA, 64 nt, Human
acgugcaccaaacugccucaauccuagguaacgagggcaacagggagcaccugucuggauuguu

SEQ ID NO: 39747 - RNA, 64 nt, Human
gaggcaagaugcauucaauuugaaagauauuuaugggcaacaaaguaaggucaggauuagacuu

SEQ ID NO: 39748 - RNA, 64 nt, Human
agugagcugagauugcgccacugcacuccagccugggcaacagagcgagacuccgucucaaaaa

SEQ ID NO: 39749 - RNA, 64 nt, Human
agugagcccagaucgcgacacugcacuccagccugggcaacagagugacacucugucucaaaaa

SEQ ID NO: 39750 - RNA, 64 nt, Human
agugagcugagaucacgccauugcacuccagccugggcaacaguguuaagacucugucucaaau

SEQ ID NO: 39751 - RNA, 64 nt, Human
agugagccaaaaucacgccacugcacuccagccugggcaacagagugagacuccgucucaaaaa

SEQ ID NO: 39752 - RNA, 64 nt, Human
gaacugcuugagcccaggaguucagaaucagccugggcaacauagcaauacuccgucucauaaa

SEQ ID NO: 39753 - RNA, 64 nt, Human
gcaucacuugagaccaggaguuugggaccaggcugggcaacacagggagacccccucucuacaa

SEQ ID NO: 39754 - RNA, 64 nt, Human
cggauuuuucuggaauuugaaucagauuucauuugggcaacaacagcagggcaggguuucuaaa

SEQ ID NO: 39755 - RNA, 64 nt, Human
aguaagcuacgaucaugccacugcacuccacucugggcaacagaaugagauccugucucuuaaa

SEQ ID NO: 39756 - RNA, 64 nt, Human
cuuccuuuuaaguaagguccaauucucgagcuuggggcaacauuguucaccuuuguagcacuca

SEQ ID NO: 39757 - RNA, 64 nt, Human
aggcagacugagcucaggagcuugagaccagccugggcaacauggcaaaaacccaccucuacaa

SEQ ID NO: 39758 - RNA, 64 nt, Human
ggaucacuugaggccaggaguuugagaccagccugggcaacauagugagaucccaucucaaaaa

SEQ ID NO: 39759 - RNA, 64 nt, Human
ggaucaguugaggccaggaguuuaagaccagccugggcaacauagugagaccccugucucccaa

SEQ ID NO: 39760 - RNA, 64 nt, Human
aaauaaagaaaagcaucuucuccuaguugugugugggcaacagaaacaaguuaaggaaacaaaa

SEQ ID NO: 39761 - RNA, 64 nt, Human
acucuccaguuaucaguacucccacaauuggccagggcaacaauaauuggaguucauacugaug

SEQ ID NO: 39762 - RNA, 64 nt, Human
agugagccaagaucaugccacaucacuccaaccugggcaacagaacaagaacccaucucaaaca

SEQ ID NO: 39763 - RNA, 64 nt, Human
ggauugccugagcucaggaguucaagaucagucugggcaacacgaugaaacuccgucucuacua

SEQ ID NO: 39764 - RNA, 64 nt, Human
uuuuuuaccuuggauuuaaagucaccuuagguuggggcaacagauucucacucauguuuaagau

SEQ ID NO: 39765 - RNA, 64 nt, Human
ugguguaugugccacgggauuugagugguugcgugggcaacacugucaggguuuggcgugugug

SEQ ID NO: 39766 - RNA, 64 nt, Human
agugaacuaugauuuuaccacugcacuccagcuugggcaacaaaaugagacccugucucaaaaa

SEQ ID NO: 39767 - RNA, 64 nt, Human
guaagccaagaucacaccacuggcacuccagccugggcaacagagugagacccugucucaaaca

SEQ ID NO: 39768 - RNA, 64 nt, Human
uaagcauuuuuuaaauugaguuugagacuagccugggcaacauagugagaccccaucucuauuu

SEQ ID NO: 39769 - RNA, 64 nt, Human
gaacaacuacauuuucucauauacagguagcuaggggcaacacaguuccauucuagagggaaac

SEQ ID NO: 39770 - RNA, 64 nt, Human
ggugagccgagaucacgccacugcacuccagccugggcaacagagcgagacucuaucucaaaaa

SEQ ID NO: 39771 - RNA, 64 nt, Human
auaugaaaguuauuuguaggggaagaguccugaggggcaacacacaagaaccagguccccucag

SEQ ID NO: 39772 - RNA, 64 nt, Human
agugagcugagaucacaccauugcgcuucagccugggcaacaagagugaaacuccaucuccaaa

SEQ ID NO: 39773 - RNA, 64 nt, Human
ggugagcugagaucgugccacugcacuccagccugggcaacaagagcaaaaaucccucucaaaa

SEQ ID NO: 39774 - RNA, 64 nt, Human
agguugcagugagccgagaucaugccacugcacugggcaacagagcaaaacucgaucucaaaaa

SEQ ID NO: 39775 - RNA, 64 nt, Human
gagggagaggcagcagggaacgugggucaggguggggcaacaguggcaucaggugcggggccuc

SEQ ID NO: 39776 - RNA, 64 nt, Human
guuauuaaaaaauuacaaaggccuagaccagccugggcaacauggugaaaccccaucucuacaa

SEQ ID NO: 39777 - RNA, 64 nt, Human
agugaaucaugaucaugccacuguacuccagccugggcaacagagaccaucuuaaaaaaaaaaa

SEQ ID NO: 39778 - RNA, 64 nt, Human
ggaucacuuagguccaggaguucgagacuagccugggcaacauagugagacaccggaucuacaa

SEQ ID NO: 39779 - RNA, 64 nt, Human
agugagccgugauugcaccacugcacuccagccugggcaacagagcaagacccugucuuggaga

SEQ ID NO: 39780 - RNA, 64 nt, Human
ggaucacuugagcucaggaauucaaggucagccugggcaacauggcuaaacucugucucuauua

SEQ ID NO: 39781 - RNA, 64 nt, Human
gggagugcagaaguugggcagaaagggaggaggagggcaacagggaaugaagcugguugagugu

SEQ ID NO: 39782 - RNA, 64 nt, Human
acaggucucucucuuuacguuguaccauucuguugggcaacaauugucccaacaaccacacuua

SEQ ID NO: 39783 - RNA, 64 nt, Human
agaucuccugagcucaggaguucgacaccaucuugggcaacauggugaaacccugucuacuaaa

SEQ ID NO: 39784 - RNA, 64 nt, Human
agauugcuugaacccaggaauucaaguccaaucugggcaacauggggaaaccccagcucuacaa

SEQ ID NO: 39785 - RNA, 64 nt, Human
ggacugcuugagcucaggaguucgagaccagccugggcaacaaagugagacuccaucucuauau

SEQ ID NO: 39786 - RNA, 64 nt, Human
ggugagccaagaugacacaacugcacuccagcuugggcaacagggcgagaccuuguuuaaaaaa

SEQ ID NO: 39787 - RNA, 64 nt, Human
agugagcugggauuacaccauugcauuccagccugggcaacagagcaagacugucucaaaaaac

SEQ ID NO: 39788 - RNA, 64 nt, Human
agugcugaggcuggaagaaaaacgcacaccagacgggcaacaaacagucuggguccccagcucg

SEQ ID NO: 39789 - RNA, 64 nt, Human
ggauugcuuaagcccaggagcucaagucccaccugggcaacauaguaagaucuugucucuuaaa

SEQ ID NO: 39790 - RNA, 64 nt, Human
agguugccugccaccaccagcuggaccugagcuugggcaacagcauuagguaugcccuuuacuu

SEQ ID NO: 39791 - RNA, 64 nt, Human
agcaaaucauguguuuaaacaaaucccauauguugggcaacaguucaaauaagcacggagaagu

SEQ ID NO: 39792 - RNA, 64 nt, Human
uugcagugagccgagaucgagccacugcacuccugggcaacagagcaagacuucgucucaaaau

SEQ ID NO: 39793 - RNA, 64 nt, Human
ggcucucuugagaauaggaguucaagaccagccugggcaacauagcaagauccugucucuccaa

SEQ ID NO: 39794 - RNA, 64 nt, Human
guucaaaucacaggugguuaguggcuacuguacugggcaacauacauuauagaacauuuucauu

SEQ ID NO: 39795 - RNA, 64 nt, Human
ggaucauuugagcucaggaguuccagaccagccugggcaacauagcaaaaucucaucucuacaa

SEQ ID NO: 39796 - RNA, 64 nt, Human
ugugagccaugaucaugccacugcacuccagccugggcaacagagugagacccugucuccaaag

SEQ ID NO: 39797 - RNA, 64 nt, Human
uuaaagagcaccuuuguauuuuuauuaucagauggggcaacauauuguaugaagcauauguagc

SEQ ID NO: 39798 - RNA, 64 nt, Human
agugagucgagauugcaccacuacacuccagccugggcaacagagagcgacucucucaaaaaaa

SEQ ID NO: 39799 - RNA, 64 nt, Human
ggugagccaacaucacaccauugcacuccagccugggcaacaagaguaaaacucugucucaaaa

SEQ ID NO: 39800 - RNA, 64 nt, Human
ugaccccccgagguggucuuuuguuuuaaacagggggcaacagcuggaucuccaaguacauaug

SEQ ID NO: 39801 - RNA, 64 nt, Human
guuuugcuugaggccagagguucaagaccagccugggcaacacagugacaccugacucuacuaa

SEQ ID NO: 39802 - RNA, 64 nt, Human
gauauuaauuuuuuccucggcuguaaaaugcuaugggcaacacaaucaugcaauuauaauuuga

SEQ ID NO: 39803 - RNA, 59 nt, Human
ugcugcggaaggaggucuaaagccagguggggcaacagcgguggcagggcagggggugg

SEQ ID NO: 39804 - RNA, 64 nt, Human
cgugagccaagaucacgccacugcacuccagccugggcaacagagcaagacucugucucaaaaa

SEQ ID NO: 39805 - RNA, 64 nt, Human
ggauugcuugaguccaggaguuugagaccagccugggcaacauggcgagacccuguuucuacaa

SEQ ID NO: 39806 - RNA, 64 nt, Human
agugagccaggaucgcgccauugcacuccagccugggcaacaagagcgaaacucuugucugaaa

SEQ ID NO: 39807 - RNA, 64 nt, Human
agugagccaagauugcgccguuguacuccagccugggcaacagagcaagacccaucucaaaaaa

SEQ ID NO: 39808 - RNA, 64 nt, Human
ggauugcuugagcccaggaguucaagaccagccugggcaacacagcgagaccccaucucuuaaa

SEQ ID NO: 39809 - RNA, 64 nt, Human
gcagggcugguguggggugcagccuuugcucagagggcaacauguuccaagcaaaaucuccccg

SEQ ID NO: 39810 - RNA, 64 nt, Human
agaucacuugagcucaggaggucaagaucagccugggcaacauggugaaaccuggucucuacau

SEQ ID NO: 39811 - RNA, 64 nt, Human
gaaauuaaaaaaaaauuuuaacugauaaaacuuagggcaacauuaauuaauguauauucuuacc

SEQ ID NO: 39812 - RNA, 64 nt, Human
gugaucacuugagcccaggaguaaagaccagccugggcaacauagugagacuccgucucuacaa

SEQ ID NO: 39813 - RNA, 64 nt, Human
ggaucacuugagcccagaaguucgagacuagccugggcaacauggagaagcccugucucuacaa

SEQ ID NO: 39814 - RNA, 64 nt, Human
ggagauggaguuggcagugagccaagauuagccugggcaacagugagugagacucggucucaaa

SEQ ID NO: 39815 - RNA, 64 nt, Human
ggauugccugaggccaggaguuugacaccagccugggcaacauagugagaccuugucucuacaa

SEQ ID NO: 39816 - RNA, 64 nt, Human
agugagcugagacugcaccauugcauuccagccugggcaacaagagugaaacugcaucucaaaa

SEQ ID NO: 39817 - RNA, 64 nt, Human
gggucgcuugaagcugagaguucaagaccaaccugggcaacauagugagacccccaucucuaca

SEQ ID NO: 39818 - RNA, 64 nt, Human
cggauaguugagcccaggaguucgagaccagccugggcaacauggcaagaccuugucucuacaa

SEQ ID NO: 39819 - RNA, 64 nt, Human
cugggaagauggcugggaagccaggccaaagugggggcaacagcuugcuucucuuucucuucuc

SEQ ID NO: 39820 - RNA, 64 nt, Human
aguaagcugagaucccaccauugcacuccagccugggcaacagagugagacuccaucucaaaaa

SEQ ID NO: 39821 - RNA, 64 nt, Human
aggcugcuggaaacugagaguucaagaccagccugggcaacauagugagacccugucucuacaa

SEQ ID NO: 39822 - RNA, 64 nt, Human
gaguuaugcccagccaagucuucaguauauccaggggcaacagauuuucacagcucauccacaa

SEQ ID NO: 39823 - RNA, 64 nt, Human
agugagcugugauugcaccacuguacuccagcuugggcaacagagcaagauccugucucaaaag

SEQ ID NO: 39824 - RNA, 64 nt, Human
gguuaggguuguuuucuuaauucuuuuccugguagggcaacaagaaccauuuccaaucuagagg

SEQ ID NO: 39825 - RNA, 64 nt, Human
ugccuccuugaggccaggaguucaggaccagccugggcaacauagcgagacccccauugcuaca

SEQ ID NO: 39826 - RNA, 64 nt, Human
uaugagcugagauugugccaguucauuccacccugggcaacagggugagacucugucucaaaaa

SEQ ID NO: 39827 - RNA, 64 nt, Human
ggauuguuugaggccagaaauuugagaccagccugggcaacauagcaaaacccugucucuacaa

SEQ ID NO: 39828 - RNA, 64 nt, Human
ggauagcuugaggccaggaguuugagacuagacugggcaacauagcaagaccccgucucuacaa

SEQ ID NO: 39829 - RNA, 64 nt, Human
gacauggcgagcacagugcaggcccggggcccacgggcaacauggaacccugggaacugcccuc

SEQ ID NO: 39830 - RNA, 64 nt, Human
aaguuaaaauuagauaugagaauguuuugcguaggggcaacacagucugcugcuauauaguggg

SEQ ID NO: 39831 - RNA, 64 nt, Human
aguucgcuugggcccaagaguucgagaccagccugggcaacauggugaaacccuaucuccguga

SEQ ID NO: 39832 - RNA, 64 nt, Human
gccgaggucaugccacugcacuccagccuggccugggcaacagagcaagacccugucucaaaau

SEQ ID NO: 39833 - RNA, 64 nt, Human
agugaguggaaauugcgccacugcacuccagccugggcaacaaagugagacuccaucucaaaaa

SEQ ID NO: 39834 - RNA, 64 nt, Human
agugagccaagaucgcaccacugcacuccagccugggcaacaaagagcgaaacucugucucaaa

SEQ ID NO: 39835 - RNA, 64 nt, Human
ggauagcuugaggccaggaguuccagaccagccugggcaacauagugagauccugucucuacaa

SEQ ID NO: 39836 - RNA, 64 nt, Human
ccuuauuuuuuuuuucuuuauguuuucuuucauugggcaacagcuaagagggcccagcaaggua

SEQ ID NO: 39837 - RNA, 64 nt, Human
agaguugccaagauauuuauacccucagcacucggggcaacacaguggaaaguggggaggccau

SEQ ID NO: 39838 - RNA, 64 nt, Human
aggggaauugcuugaguucagaaguuugagaucugggcaacauauugagacucugucucuaaaa

SEQ ID NO: 39839 - RNA, 64 nt, Human
gauuugugauugcgccaccacugcacuccagccugggcaacagagugagacccugucucaaaaa

SEQ ID NO: 39840 - RNA, 64 nt, Human
agugagcugagaucaugccauggcagucuagccugggcaacagagcgagacucuguuucaaaaa

SEQ ID NO: 39841 - RNA, 64 nt, Human
ucccuuguucucaguggugcaggauguuggcuuggggcaacagauugaaaagaccuacagacua

SEQ ID NO: 39842 - RNA, 64 nt, Human
agugagcuuugaucacaccacugcacuccagccugggcaacagagcaagaccccauccuccacc

SEQ ID NO: 39843 - RNA, 64 nt, Human
cgaacccuugaggccaggaguuccagacuaacuugggcaacacagggcgacccccaucucuaca

SEQ ID NO: 39844 - RNA, 64 nt, Human
ggaucacuuaagcccaggagucugagaccagccugggcaacauagcaagacccccaucucugca

SEQ ID NO: 39845 - RNA, 64 nt, Human
aggaaucuggccuuuauuuuuccucauuucucaugggcaacagaggccaaagaaacgaagcaag

SEQ ID NO: 39846 - RNA, 64 nt, Human
uaaguuuucucuuuuugggauuuuccgcagaucagggcaacacagaaugacuaccuucccagcc

SEQ ID NO: 39847 - RNA, 64 nt, Human
ggauugcuugaguucaggaguucaagaccagccugggcaacauagcaaaaccuuaucucuacaa

SEQ ID NO: 39848 - RNA, 64 nt, Human
agaucccuugugcccaggaguucaagaccagccugggcaacauggcgaaaccccauuucuacua

SEQ ID NO: 39849 - RNA, 64 nt, Human
agugagccgagaucgcgccacugugcuccagccugggcaacagagcaagacuccaucucaaaaa

SEQ ID NO: 39850 - RNA, 64 nt, Human
aaugagccgagaucacgucacugcacuccagcuugggcaacagagcaagacuccaucucaaaaa

SEQ ID NO: 39851 - RNA, 64 nt, Human
gcaucacuugauccugggaguucgagaccagccugggcaacauggugaaacccugucgguacaa

SEQ ID NO: 39852 - RNA, 64 nt, Human
ggaucacuugaggccaggacuuugagaccagccagggcaacauaauaagacuuuucucuacuuu

SEQ ID NO: 39853 - RNA, 64 nt, Human
uccugcaugaacagaguugaugaaaguggggugugggcaacaaguggcuuuccuugccuacuuu

SEQ ID NO: 39854 - RNA, 64 nt, Human
gggcaugacugcacguucacucucagugggaucugggcaacauggaguucauuguccuguugcu

SEQ ID NO: 39855 - RNA, 64 nt, Human
aucaugccugugaauaaccacugcacuccagccagggcaacauaacaagacucuaucuaaaaaa

SEQ ID NO: 39856 - RNA, 64 nt, Human
ggaucaccugagcucaggaguuugagaccagccugggcaacauggggaaacuccaucucuacaa

SEQ ID NO: 39857 - RNA, 64 nt, Human
gaauugcuugagcccaggaguucgagaccagccggggcaacauggcaaaacccugucucuacua

SEQ ID NO: 39858 - RNA, 64 nt, Human
agugagccaagauggcgccacugcauuccagccugggcaacagagcaagacccugucugucuca

SEQ ID NO: 39859 - RNA, 64 nt, Human
aggcuaaggcaggcagaucacuugagaccagcuugggcaacauggcaaagccccaucucuacaa

SEQ ID NO: 39860 - RNA, 64 nt, Human
uuuacauacucauuaguaagugggagguccacuggggcaacagacacugccacaauuucagugu

SEQ ID NO: 39861 - RNA, 64 nt, Human
cucagauagaaaggagccaugcauauuaaaugaggggcaacaaacauuucaaacgauuagauaa

SEQ ID NO: 39862 - RNA, 64 nt, Human
cugugcuuugcaccggggagaaaauggugauggagggcaacaaggacuccgaggagcaccacca

SEQ ID NO: 39863 - RNA, 64 nt, Human
aguuagcugagauccugccacugcacuccagccugggcaacagagugagacuaucucaaaaaaa

SEQ ID NO: 39864 - RNA, 64 nt, Human
agugagcuguaauugcaucacugcacuccaaccugggcaacagaguaagaccuugucuuaaaaa

SEQ ID NO: 39865 - RNA, 64 nt, Human
gacugcgugagccuuagaaaauaaaauguauaaagggcaacacaugagcugucaaacaguguua

SEQ ID NO: 39866 - RNA, 64 nt, Human
cagggugcuuugguagccaucagagaggaaccaagggcaacaucuuuucuucccaggcguucuu

SEQ ID NO: 39867 - RNA, 64 nt, Human
guagucucauuuagcaaguauggaaguugaggcagggcaacauuaagcaacuuacauaacucau

SEQ ID NO: 39868 - RNA, 64 nt, Human
guagucauauuuugcaaguauggaagcugaggcagggcaacaugaaguaacuuacauaacucau

SEQ ID NO: 39869 - RNA, 64 nt, Human
cuacuagggaccuggggaagcaaaaacgaaagcugggcaacaugccugcuuuagaauguuuucc

SEQ ID NO: 39870 - RNA, 64 nt, Human
agugcagaaccacagacggcuucggcugugccuagggcaacagccaaccuaggagccagcgggc

SEQ ID NO: 39871 - RNA, 64 nt, Human
agugcaccaagacugcgccauugcacuccagcccgggcaacaagagcgaaaccccaucucgaaa

SEQ ID NO: 39872 - RNA, 64 nt, Human
auugagcugagaucaugcuagugcgcuccagccugggcaacagagcgagacuucaucucagaaa

SEQ ID NO: 39873 - RNA, 64 nt, Human
agugagcugagaucgcgccaccgcacuccagccugggcaacagagcgagacuccaucucaaaca

SEQ ID NO: 39874 - RNA, 64 nt, Human
caggaauuugagucugggaguuugaguccagcaugggcaacauaacaagaccccaucccuuauu

SEQ ID NO: 39875 - RNA, 64 nt, Human
agaucaccugagcucaggaguccaagaccagccugggcaacauggcaaaacaccgucucuacaa

SEQ ID NO: 39876 - RNA, 64 nt, Human
uuuuuggugaaaugcaaccuuuucuauaaaaugugggcaacauuuuaaaguuuuuuuaaaaucc

SEQ ID NO: 39877 - RNA, 64 nt, Human
ggaucauuugagcccaggaguuugagaccagcuggggcaacauauggagacuccgucucuacag

SEQ ID NO: 39878 - RNA, 64 nt, Human
aagaugcugagaugccaccacugcacuccagccugggcaacagagcgagaaccugucucaaaaa

SEQ ID NO: 39879 - RNA, 64 nt, Human
aaugagccgagaucgcgcuacugcacuccagccugggcaacagagagagaccuugucucaaaaa

SEQ ID NO: 39880 - RNA, 64 nt, Human
cucuucugcaguuauacuaaaaaugaaaaugauagggcaacaauuuuuuaacuuuuauuuuaag

SEQ ID NO: 39881 - RNA, 64 nt, Human
aaugagcuaugauuucaccacugcauucuagccugggcaacagagugagauccugacucaaaua

SEQ ID NO: 39882 - RNA, 64 nt, Human
ggauugcuugaggccgaggguucaagacuagccugggcaacauagcgagacugcaucucuacaa

SEQ ID NO: 39883 - RNA, 64 nt, Human
uucuacuuuagguucacauaccugccugcuagucgggcaacaugaaguaggacaguucuguuga

SEQ ID NO: 39884 - RNA, 64 nt, Human
agugagcacagaucacaccacugcacuccagccugggcaacagagugagacccuauuucaaaaa

SEQ ID NO: 39885 - RNA, 64 nt, Human
ggauugcuuaagcccaggaguucaagaccagccugggcaacauggcuaaaccccaucucuacaa

SEQ ID NO: 39886 - RNA, 64 nt, Human
uuaugaaaaagauuauuugugcauuuuauugacugggcaacacugcaggacagucaaggugaua

SEQ ID NO: 39887 - RNA, 64 nt, Human
agugagccaaggucacgucacugcacucuagccugggcaacagaguaagacaaaaaaauauaua

SEQ ID NO: 39888 - RNA, 64 nt, Human
agauuacuugagcccaggaauucaagaccagccugggcaacauggugaaacccuguuucuauaa

SEQ ID NO: 39889 - RNA, 64 nt, Human
ggugagcugagauugcacuauugcacuccagccugggcaacaggaguaaaacucccccccaccc

SEQ ID NO: 39890 - RNA, 64 nt, Human
auuuaacacugguugacaguauaauuuucccaaagggcaacaaaacauacagauagcaaauuua

SEQ ID NO: 39891 - RNA, 64 nt, Human
agugagccaggauugcgccaccacacuccagccugggcaacagagacucugucucaaaaaaaaa

SEQ ID NO: 39892 - RNA, 64 nt, Human
agugagccgagguugcaccacugcacucccuccugggcaacagaacaagacuccaucucaaaaa

SEQ ID NO: 39893 - RNA, 64 nt, Human
gcugcagagagugauggugcuuguuagggaucaagggcaacauaguacuucuccuucacccaua

SEQ ID NO: 39894 - RNA, 64 nt, Human
aagaccaccugaggguaggagucaagaucagccugggcaacauagugagacgcugucucuacaa

SEQ ID NO: 39895 - RNA, 64 nt, Human
aucgugccuguggcuagccacugugcuccagccugggcaacaccaucguaaaaauaaauaaaua

SEQ ID NO: 39896 - RNA, 64 nt, Human
ggaucauuugaggccaggaguuugagaccugccugggcaacauaaugaaacuuccuuuccaggg

SEQ ID NO: 39897 - RNA, 64 nt, Human
ggauugcuugaagcuaggaguuugagaccagccugggcaacaggguaagguccugucucuacaa

SEQ ID NO: 39898 - RNA, 64 nt, Human
ggauugcuugaggccaggaguuugagaccagccugggcaacauagcgagaccccaucucuacaa

SEQ ID NO: 39899 - RNA, 64 nt, Human
ggauugcuugagcccaggaguucaagaccagccugggcaacauaccaagacccccgucucuuua

SEQ ID NO: 39900 - RNA, 64 nt, Human
agugagcugagauagcgccauugcacuccagccugggcaacaagagcaaaacucugucucaaaa

SEQ ID NO: 39901 - RNA, 64 nt, Human
cagggacacuuuuuaaaaacacucuuaucagccugggcaacacagugagacuccaucucuuaaa

SEQ ID NO: 39902 - RNA, 64 nt, Human
agauugccugagcucaggaguucgagaccagccagggcaacauggugaaaccccaucucuacua

SEQ ID NO: 39903 - RNA, 64 nt, Human
uugugccacugaacuccaaccugcacuccagccugggcaacagagcgagacuccaucucuaaau

SEQ ID NO: 39904 - RNA, 64 nt, Human
ggauugcuugaagucaggaguucaagaccaaccugggcaacauagcaacaccccccaugucuac

SEQ ID NO: 39905 - RNA, 64 nt, Human
aagcaguagagcaucuaugauuaggaaaugugaggggcaacagaugugaaugaaugaaaguuga

SEQ ID NO: 39906 - RNA, 64 nt, Human
ggaucacuuggagccaggaguuugagaccagccugggcaacaaagugagacccccaucucuaca

SEQ ID NO: 39907 - RNA, 64 nt, Human
uugguaacuauuccucuucaaguauuugcagauggggcaacaugauauuuggguagcugauguc

SEQ ID NO: 39908 - RNA, 64 nt, Human
ggugagcugagaucgcgccauugcacuccagccugggcaacaagagcaaaacuccgucucaaaa

SEQ ID NO: 39909 - RNA, 64 nt, Human
agagugagccgugaucaccagugcacucuagccugggcaacagagaaagacccugucucaaaaa

SEQ ID NO: 39910 - RNA, 64 nt, Human
ggaucgcuugaggccaggaguucgagaccacccugggcaacagagcgagaucccaucacuacaa

SEQ ID NO: 39911 - RNA, 64 nt, Human
uuuuuguuucaaaaaaguuuaagaaaauggaaaugggcaacagugagugaagacauauuuuagc

SEQ ID NO: 39912 - RNA, 64 nt, Human
ggaucgcuugaggccaggaauuuuagaccagccggggcaacauagugaaaccccaucucuacaa

SEQ ID NO: 39913 - RNA, 64 nt, Human
agugagcugagaucacgccauuguacuccagccugggcaacaagagcaaaacuccgucucaaaa

SEQ ID NO: 39914 - RNA, 64 nt, Human
cuugugguuucacacuaaagaguuuccuuguuaugggcaacaugcaugaccuaaugucuugcaa

SEQ ID NO: 39915 - RNA, 64 nt, Human
gaaucuauacauuauaagggacuuaacaacuaaagggcaacauauagacuuuagauccuaauuu

SEQ ID NO: 39916 - RNA, 64 nt, Human
agugagcugagaucaugccacugcacuccagccugggcaacagagcgagacuccaucucaaaaa

SEQ ID NO: 39917 - RNA, 64 nt, Human
agugagcugagauaaucccacugcauuccagccugggcaacagcgugagacuucaucucaaaaa

SEQ ID NO: 39918 - RNA, 64 nt, Human
ggaucguuugagcccaggaguugaagaccagccugggcaacacagugagacuucauuucuacaa

SEQ ID NO: 39919 - RNA, 64 nt, Human
acugagccgagaucgcgccacuauacuccagccugggcaacagacauccugucucaaauaaauu

SEQ ID NO: 39920 - RNA, 64 nt, Human
agugagccaagauugcgccacuguacuccagcuugggcaacagagcaagacuccaucucaaaaa

SEQ ID NO: 39921 - RNA, 64 nt, Human
gaucaccuugaggccaggaguuuaaggccagccugggcaacauagcaaaaccuagucccuaaaa

SEQ ID NO: 39922 - RNA, 64 nt, Human
gggucacuugaacccaggaguuugacaucaaccugggcaacauggugaccucccgucucucucg

SEQ ID NO: 39923 - RNA, 64 nt, Human
aauucaagaauggaaucagcaguuuuaaggauuugggcaacauucugcagucuuugcaauaguu

SEQ ID NO: 39924 - RNA, 64 nt, Human
ggauugcccgcgcucaggaggucaagaccagccugggcaacacggugaaaccccaucucuauua

SEQ ID NO: 39925 - RNA, 64 nt, Human
agugagccaagaucgcaccacugcacuccagccugggcaacagagugagacuccgucucaaaaa

SEQ ID NO: 39926 - RNA, 64 nt, Human
uuuauuuuuuauuuuuugagacggaguccagccugggcaacagaguaacucuccuucucaaaua

SEQ ID NO: 39927 - RNA, 64 nt, Human
aaaaucuguuauucaagguaaauuauuucuacaagggcaacagguaugguccuccgauauuuac

SEQ ID NO: 39928 - RNA, 64 nt, Human
ccaccugugucugaaugcaacagggguguugcgggggcaacaugagagccccucacccccaacu

SEQ ID NO: 39929 - RNA, 64 nt, Human
uguccaguuuggcccauggcggggcccauucacggggcaacacugggcuucugggcacagcggg

SEQ ID NO: 39930 - RNA, 64 nt, Human
cugcggaggcccugacccugccagcuggcuccgagggcaacacaggggccuggccucuagaggg

SEQ ID NO: 39931 - RNA, 64 nt, Human
agugagccgagaucgcaccauugcacuccugccugggcaacaagagugaaacuccaucuccaaa

SEQ ID NO: 39932 - RNA, 64 nt, Human
agauuauuugagcucaggaguuugagaccauccugggcaacauggcgaaacccuaucucuacaa

SEQ ID NO: 39933 - RNA, 64 nt, Human
agugagccaagaucaugccacugcacuccagacugggcaacagagggagacuccgucucaaaaa

SEQ ID NO: 39934 - RNA, 64 nt, Human
guacuaguauaacagcuuggguuuguuagaauuugggcaacauuuugauuauaaugacaacuuc

SEQ ID NO: 39935 - RNA, 64 nt, Human
aaugagcugagauugcaucacugcacuccagcaugggcaacaaagcaagacuccgucacagaaa

SEQ ID NO: 39936 - RNA, 64 nt, Human
agugagccgagaugguaccucugcacugcagccugggcaacagaaugagacugugucuucaaaa

SEQ ID NO: 39937 - RNA, 64 nt, Human
ugcagcgaggccuugucucucauccaucgucggagggcaacaucucagcaccuggugccgaagg

SEQ ID NO: 39938 - RNA, 64 nt, Human
aaaaguaaaaacucucuuaguaauaaucaucauagggcaacaggauauaguauguaacugcagu

SEQ ID NO: 39939 - RNA, 64 nt, Human
ccaggagguggauugcgccacugcacuccagccugggcaacagagugagacucccucucaaaaa

SEQ ID NO: 39940 - RNA, 64 nt, Human
gaaggguauccauguguaggaucacagcgcugccgggcaacagaaguuaccaacagcaguaaac

SEQ ID NO: 39941 - RNA, 64 nt, Human
ggaucacucaaguccaggaguucgagaccagccugggcaacauggugaaauccugucucuacca

SEQ ID NO: 39942 - RNA, 64 nt, Human
ccauuguagcagggagcuagcguauuagccuugugggcaacaugaugcaugggaaaugaaagau

SEQ ID NO: 39943 - RNA, 64 nt, Human
ucauuuagauuuguuuugcauuccuuagaauggagggcaacauuccacagcugcccuggcugug

SEQ ID NO: 39944 - RNA, 64 nt, Human
agugggcugugaucacaccacugcacuccagccugggcaacagagugagacccugucucugaaa

SEQ ID NO: 39945 - RNA, 64 nt, Human
ggaucacuugagcccaggaguucaagaccagccugggcaacauagugagacuccugucucuaca

SEQ ID NO: 39946 - RNA, 64 nt, Human
ugucuguaguugcuuugcggcaucuccauuucacgggcaacacucacugccugcagcugagauu

SEQ ID NO: 39947 - RNA, 64 nt, Human
gggcaaugcagugcagcaugggaaaggaauaagggggcaacaaggugcacagaccucagagaug

SEQ ID NO: 39948 - RNA, 64 nt, Human
agugagacgagcuugugccacugcacuccagccugggcaacagaguaagacucagucucaaaaa

SEQ ID NO: 39949 - RNA, 64 nt, Human
accagugagcacugguuaguacugguccccuucugggcaacauggcccuaccagacacugcugc

SEQ ID NO: 39950 - RNA, 64 nt, Human
gagccaucaucauggcaucauugcauuccagccugggcaacagagcaagaccucgucucaaaaa

SEQ ID NO: 39951 - RNA, 64 nt, Human
uucuaggaaaguuaaaagaauaaaucagaacccagggcaacaaugccauuucauguaaacauuu

SEQ ID NO: 39952 - RNA, 64 nt, Human
aguuauguuucuucauaggaaaacuauauuuagugggcaacaacuauuuuuaugaugggauggg

SEQ ID NO: 39953 - RNA, 64 nt, Human
gguuugcuugagcccaggaguuccagaccagccugggcaacauggcgaaaccccaucucuacua

SEQ ID NO: 39954 - RNA, 64 nt, Human
agaucgcuugagcucaggaguucaagacgagccugggcaacauggcaaaugccgucucugcaaa

SEQ ID NO: 39955 - RNA, 64 nt, Human
aacucugguuuccgaugggacaggaaagucauacgggcaacaguaugcggaaaguacguuuuuu

SEQ ID NO: 39956 - RNA, 64 nt, Human
gaaucacuugagcucaggaguucuagaccaaucugggcaacagagagaccccaucucuuuuaaa

SEQ ID NO: 39957 - RNA, 64 nt, Human
ggauugcuugagcucaugaguucaagaccagccugggcaacauagcgagacuccaucucuauaa

SEQ ID NO: 39958 - RNA, 64 nt, Human
agugagccgagaucaugacacugcacuccagccugggcaacagagcgagaccaucucuuaaaaa

SEQ ID NO: 39959 - RNA, 64 nt, Human
agugagcugagaucuugccacugcacaccagccugggcaacacagcaagacucugucucaaaaa

SEQ ID NO: 39960 - RNA, 64 nt, Human
agugagccaagaucacggcacugcgcugcagccugggcaacacagugagacccugucaaaaaaa

SEQ ID NO: 39961 - RNA, 64 nt, Human
ggguugcuugagcucaggaguuugagaccagccugggcaacauggcacaauugucucuacaaaa

SEQ ID NO: 39962 - RNA, 64 nt, Human
auugugcaugugaauagccacugcacuccagccugggcaacauagcaagacuccaucucuaagu

SEQ ID NO: 39963 - RNA, 64 nt, Human
ggauugcuugagcccaagaguuggagaccagccugggcaacauggugagaccaauugacuguag

SEQ ID NO: 39964 - RNA, 64 nt, Human
agugagccaagauugcgccccugcacuccagccugggcaacagagcaagacuccaucucaaaaa

SEQ ID NO: 39965 - RNA, 64 nt, Human
agugagccaaagguacaccacuacacuccagccugggcaacagagcaagacucggucucaaaaa

SEQ ID NO: 39966 - RNA, 64 nt, Human
gcagugagucgagauggugccauugcucucguuugggcaacaagagugaaacucuugucucaaa

SEQ ID NO: 39967 - RNA, 64 nt, Human
ggugagccaagaucgcgccauuguacuccagccugggcaacaagagcaagauucugccucaaaa

SEQ ID NO: 39968 - RNA, 64 nt, Human
ggaucaccugaaaucaggaguuccagaccagccugggcaacauggugaaaccccgucucuacua

SEQ ID NO: 39969 - RNA, 64 nt, Human
agugagccgaauaugcgccacugcacuccagccugggcaacagagcaagacuccgucuccaaaa

SEQ ID NO: 39970 - RNA, 64 nt, Human
agucagucaugauggcaccacugcacuccagccugggcaacagagcaagauccugucuuuaagg

SEQ ID NO: 39971 - RNA, 64 nt, Human
agugagcugagauugugucauugcacuccagccugggcaacaagagcaaaacucugucucaaaa

SEQ ID NO: 39972 - RNA, 64 nt, Human
agauugccugagcucaggaguuugagaccagccugggcaacacggugaaaccccgucucuacua

SEQ ID NO: 39973 - RNA, 64 nt, Human
agugagcugagaucaugccacugcacuccagccugggcaacagagcaagacucugccucaaaaa

SEQ ID NO: 39974 - RNA, 64 nt, Human
gcuuuuuguaaagcauagauaaauugaauaaucagggcaacagcauuaagcacaucugugaauu

SEQ ID NO: 39975 - RNA, 64 nt, Human
ggacagagagaggagaggaggaagauugagcugggggcaacagccaagcucaccugggcagguc

SEQ ID NO: 39976 - RNA, 64 nt, Human
uguggugcagcugcagacacagagcacagcucaugggcaacaucacuggggcccagagagagcu

SEQ ID NO: 39977 - RNA, 64 nt, Human
agugagccaagaucgugccacuacacuccagccugggcaacaaagcaagaccuugucucaaaaa

SEQ ID NO: 39978 - RNA, 64 nt, Human
agaucacuugagcccaggaguucgagagcagccugggcaacaugacgaaaccccgucucuacag

SEQ ID NO: 39979 - RNA, 64 nt, Human
ggaucacuugaacucaggaguuugagagcagccagggcaacacagcgagacccugucucaaaaa

SEQ ID NO: 39980 - RNA, 64 nt, Human
agaucacuugagcccaggaguuuaagaccagccugggcaacauagcaagacccugucucuaaag

SEQ ID NO: 39981 - RNA, 64 nt, Human
agugagccaggauugugccauugcacuccagccugggcaacaagaacaaaacuccaucucaaaa

SEQ ID NO: 39982 - RNA, 64 nt, Human
agcgagcugagaucaugccguuguacuccagcuugggcaacagagugagacuccaucucaaaac

SEQ ID NO: 39983 - RNA, 64 nt, Human
ggugagccaugauuacuccacugcacuccagccugggcaacagagccaggcccuguaucaaaaa

SEQ ID NO: 39984 - RNA, 64 nt, Human
ugggaugugguagagggacugaagguaccuuugggggcaacagcacccuaguuucauucucaac

SEQ ID NO: 39985 - RNA, 64 nt, Human
ggaaugcuugagcccaagaguuuuagaccagccugggcaacacaguaagacccuguuucuacaa

SEQ ID NO: 39986 - RNA, 64 nt, Human
agauugcuugagcccaggaguuagagaccagccugggcaacaugaugugaaaacccaucucuac

SEQ ID NO: 39987 - RNA, 64 nt, Human
aggaggggcacuuaagcagccuggaggaagaugugggcaacaguggaggaccaagagaacagac

SEQ ID NO: 39988 - RNA, 64 nt, Human
agugagucaagaucucaccacugcacuccagccugggcaacagagggagacucugucucaaaaa

SEQ ID NO: 39989 - RNA, 64 nt, Human
agugagccgagaccgcgccacugcacuccagccugggcaacagagcaaaacuccaacucaaaaa

SEQ ID NO: 39990 - RNA, 64 nt, Human
uacuugugaugagagauaaccuugcccuaguugugggcaacacaugcagaauaauccuguuuua

SEQ ID NO: 39991 - RNA, 64 nt, Human
agugauccacgaucguaccacuacacuccagccugggcaacagagcaagacccugucucaaagc

SEQ ID NO: 39992 - RNA, 64 nt, Human
guggagccaagauugcgccacugcacuccagccugggcaacagagcgggacuccaucucaaaaa

SEQ ID NO: 39993 - RNA, 64 nt, Human
cagauauugucagaguucugcucuagacaguguagggcaacaauacaugcugcuaauucaaagc

SEQ ID NO: 39994 - RNA, 64 nt, Human
ggaucacuugaggccaggaguucaagaccagccugggcaacauagugagaaugcaucucuacaa

SEQ ID NO: 39995 - RNA, 64 nt, Human
ucuugagcccaggaguuggaguccaguccagccagggcaacacagccagacgcccuuguuuuuu

SEQ ID NO: 39996 - RNA, 64 nt, Human
agugagccgaaaucacgccacuacacuccagccugggcaacagagggagacuccaucucaaaaa

SEQ ID NO: 39997 - RNA, 64 nt, Human
agauugcaugagcccaggaguucgagaccaacuugggcaacauggugaaacacugucucuacau

SEQ ID NO: 39998 - RNA, 64 nt, Human
ggugagccgagauugcaccauugcgcucuagccugggcaacaacagcaaaacuccaucucaaaa

SEQ ID NO: 39999 - RNA, 64 nt, Human
agugagccgagaccgugccacugcacuccagccugggcaacacagcgagacuccgucucgagga

SEQ ID NO: 40000 - RNA, 64 nt, Human
ugggaaacucuggcuuaggaaaacaugaacacaggggcaacagaggcaaacuguuguucgaguu

SEQ ID NO: 40001 - RNA, 64 nt, Human
ugaagaacaugugagguugaaagagcaccagccagggcaacauagcgugacccugucucuacaa

SEQ ID NO: 40002 - RNA, 64 nt, Human
agugagccgagaucacgccacugcacuccagccugggcaacaagagugaaacuccgucucaaaa

SEQ ID NO: 40003 - RNA, 64 nt, Human
gauucucaaaugagaaaaagggcuccggcuauaugggcaacaaagagggaagauacagguugcc

SEQ ID NO: 40004 - RNA, 64 nt, Human
agugagccgagaucguaccauugcacuccagccugggcaacaagagcgaaacuccauuucaaaa

SEQ ID NO: 40005 - RNA, 64 nt, Human
agugagccaagauugcaccacuguacuccagccugggcaacagagggagacuccaucuagacuc

SEQ ID NO: 40006 - RNA, 64 nt, Human
uccuuucuggccauugucauccauuucccaguuagggcaacaaugaaggaggacccagccaagc

SEQ ID NO: 40007 - RNA, 60 nt, Human
gccccauaccccagcgcugaaggguggguugggcaacagccugagaguggacucaguguu

SEQ ID NO: 40008 - RNA, 64 nt, Human
gaggaucacuugaguccagguucaagacuagccugggcaacauggcaagacccugucccuauaa

SEQ ID NO: 40009 - RNA, 64 nt, Human
agugaacugagaucacgacacugcacuccagccugggcaacaguaaaaccuggucuccaaaaaa

SEQ ID NO: 40010 - RNA, 64 nt, Human
ggauggcuugaacacagguguucaaggccagccugggcaacauaacaagauccugucucucaaa

SEQ ID NO: 40011 - RNA, 64 nt, Human
guaucgcuugagcccaggaguuugagaccgacaugggcaacaugacaagaccccaucucuacaa

SEQ ID NO: 40012 - RNA, 64 nt, Human
aguaagcugagaucgcgccacugcccuccagccugggcaacagagcaagacuccaucucaaaaa

SEQ ID NO: 40013 - RNA, 64 nt, Human
aagcaggcagauauuuugagcccaggaccagccugggcaacauggugaaagcucaucucuauga

SEQ ID NO: 40014 - RNA, 64 nt, Human
cuaagaaagaagauaauuuuuaaagaaugggagugggcaacagugaaaaauauugcagauaagu

SEQ ID NO: 40015 - RNA, 64 nt, Human
agcaugggaagagggugagcugagggcuggaggagggcaacagccacugggugagcuguucacg

SEQ ID NO: 40016 - RNA, 64 nt, Human
agugagccuugauugugucacugcacuccagccugggcaacagguaagacucugucucaaaaaa

SEQ ID NO: 40017 - RNA, 64 nt, Human
agugagccgagauugcaccccugcacuccaggcugggcaacaguacgagacucuguuccaaaaa

SEQ ID NO: 40018 - RNA, 64 nt, Human
ggaucacuugagcccaggaguucaagaccagcuugggcaacauagggagacccugucucugcaa

SEQ ID NO: 40019 - RNA, 64 nt, Human
aaaccguggggcucucuggggucugggggaauacgggcaacagcagucaggagggguacccccc

SEQ ID NO: 40020 - RNA, 64 nt, Human
ugaucaccugaggucaggaguucaagaucagccugggcaacauggcgaaaccccgucucuacaa

SEQ ID NO: 40021 - RNA, 64 nt, Human
cuugcaaagugaauccuuuugccaaggacagguggggcaacauuccccuggaugaugcugugca

SEQ ID NO: 40022 - RNA, 64 nt, Human
agugagccgagauagugccauuguacuccagcuugggcaacagaguaagacucugucucaaaaa

SEQ ID NO: 40023 - RNA, 64 nt, Human
ugaagcccauguauggcauggauuguggaagacugggcaacauauuuaagauuuccagcuccuu

SEQ ID NO: 40024 - RNA, 64 nt, Human
uguugaaacuguuauucacaaagacuccguguuugggcaacaucaagacuguaaguguagaauu

SEQ ID NO: 40025 - RNA, 64 nt, Human
caguagccgagaucgcgccacugcauuccagccugggcaacaaaagcgaaacucugucucaaaa

SEQ ID NO: 40026 - RNA, 64 nt, Human
agugagcugagaucgcaccauugcacuccagccugggcaacaagagcgaaacucugucucaaaa

SEQ ID NO: 40027 - RNA, 64 nt, Human
ggacugcuugagcccaggaguucaagaucagccugggcaacagagugagauaagacccaaucuu

SEQ ID NO: 40028 - RNA, 64 nt, Human
agugagcugagauugcgccacugcacuccagccugggcaacaagagcaaaacuccgucucaaaa

SEQ ID NO: 40029 - RNA, 64 nt, Human
ccagcuauucaggaauauugcuugaguccagcuugggcaacauagcgagacccuaucuaaaaua

SEQ ID NO: 40030 - RNA, 64 nt, Human
agugagccgagaucacaccacugcacuccagccugggcaacaagagcaaaacuccgucucaaaa

SEQ ID NO: 40031 - RNA, 64 nt, Human
ggagugcuugaggccaggaguucaagaccagccugggcaacauagggagacccccaucuuuaca

SEQ ID NO: 40032 - RNA, 64 nt, Human
agugagccgagaucaugccacugcacuccagccugggcaacagagcaagacuccaucucgaaaa

SEQ ID NO: 40033 - RNA, 64 nt, Human
agugagccaagaucgcgccacugcacuccagucugggcaacagagugagacccugucucaauaa

SEQ ID NO: 40034 - RNA, 64 nt, Human
uuccuagagccagcccuauauaacaugcccacaagggcaacaguuaucacaguucauacacacc

SEQ ID NO: 40035 - RNA, 64 nt, Human
accccacugggccagcccugcagcccaaaacccagggcaacaagcccguuagccccagggauca

SEQ ID NO: 40036 - RNA, 64 nt, Human
ggauugcuucagcccaggaguuugagaccagccugggcaacauagcaaaaccccaucucuacaa

SEQ ID NO: 40037 - RNA, 64 nt, Human
gugagccaaguucacaccacugccauuuccuccugggcaacagagugagacccuaucacaaaaa

SEQ ID NO: 40038 - RNA, 64 nt, Human
agugagccgagaucgcgccacugcacuccagccugggcaacagagugagacucugucucaaaaa

SEQ ID NO: 40039 - RNA, 64 nt, Human
ggaucgcuugagcccaggaguuugagaccagccugggcaacauggcaaaaccccaucucuacaa

SEQ ID NO: 40040 - RNA, 64 nt, Human
ggauugcuugaggccaggaguuugagaccagccugggcaacauagggagacccagucucuacaa

SEQ ID NO: 40041 - RNA, 64 nt, Human
agugagccgagaucgugccacugcacuccagccugggcaacagagugagacuucgucucaaaaa

SEQ ID NO: 40042 - RNA, 64 nt, Human
uaacaccugauguguacaucccauguaacagaaagggcaacaauaaaauagcaauccuaaagca

SEQ ID NO: 40043 - RNA, 64 nt, Human
agugaucuaagaucaugccacugcacuccagccugggcaacagagugagacccuguuucuaaaa

SEQ ID NO: 40044 - RNA, 64 nt, Human
ggcagugaacgaguguggggaaggauuggugcuggggcaacaggaaggggccuggggccguuug

SEQ ID NO: 40045 - RNA, 64 nt, Human
ggaccgcuugaguccacgaguuuaagaccagccugggcaacauggugaagccccaucucuacaa

SEQ ID NO: 40046 - RNA, 64 nt, Human
cuugguuuuucuuggcuacagaaaaacuguugcagggcaacacuaguuugauauuugauuuacu

SEQ ID NO: 40047 - RNA, 64 nt, Human
auuucaggguuaaaguauauuucaguuuucuuuagggcaacauauauuugaauuuaaaagcacu

SEQ ID NO: 40048 - RNA, 64 nt, Human
ggcaguggggccaggaacacguggccugagagcugggcaacagcagugauggcgaugcccucca

SEQ ID NO: 40049 - RNA, 64 nt, Human
agugggagauugcuugaguccaggagaccagccugggcaacauagcaaaaccucaucucuauuu

SEQ ID NO: 40050 - RNA, 64 nt, Human
agugagccaagauugcgccauugcacuccagccugggcaacaagagagaaacucugucucaaaa

SEQ ID NO: 40051 - RNA, 64 nt, Human
ggcucagcacggugaggccugacauccuggggaagggcaacagggagaccuacaggauguuggc

SEQ ID NO: 40052 - RNA, 64 nt, Human
gauaaggauuucugguuccuagugauccgggauugggcaacagugcagaacugccagucaugcc

SEQ ID NO: 40053 - RNA, 64 nt, Human
agugagccaagauugcaccacugugcucccaccugggcaacagugagacccugucucaaaaaaa

SEQ ID NO: 40054 - RNA, 64 nt, Human
agaucacugaagcucaggaguucaagaccagccugggcaacauggcgaaacuccauuucuauaa

SEQ ID NO: 40055 - RNA, 64 nt, Human
agaucacuugagcccaggaguuugaggccagccugggcaacauggugaaacccggugucuacca

SEQ ID NO: 40056 - RNA, 64 nt, Human
uuuccuccgcagggaaugccagauagaaaguugcgggcaacacuuuucucagacccaccauguc

SEQ ID NO: 40057 - RNA, 64 nt, Human
agugagcugagauugugccauugcauuccagcccgggcaacaagagcgaaauuccgucucaaaa

SEQ ID NO: 40058 - RNA, 64 nt, Human
ggugagccgagaucgcgccacugcacuccagccugggcaacaagagugaaacuccgucucaaaa

SEQ ID NO: 40059 - RNA, 64 nt, Human
ggacugcuugggcccaagaauucaggaccagucugggcaacagagccagacacugucucuauaa

SEQ ID NO: 40060 - RNA, 64 nt, Human
ggugagcugagaucacgccauugcacuccagccugggcaacaagagcaaaacucagucucaaau

SEQ ID NO: 40061 - RNA, 64 nt, Human
augaacugaaggggugaagacuugauuuuggagagggcaacaaaacaagggugugugugcauag

SEQ ID NO: 40062 - RNA, 64 nt, Human
cauucgguauaaggcagcuuucaauuugcuuagagggcaacauuggaagguuagaguucaucag

SEQ ID NO: 40063 - RNA, 64 nt, Human
agauagcuugaguccaggaguuugagaccagccugggcaacauagugauaccccaucucuuaaa

SEQ ID NO: 40064 - RNA, 64 nt, Human
gcccuaaacguacaacaucauaguaauuugucaugggcaacaugaccagagagaagauuuuugu

SEQ ID NO: 40065 - RNA, 64 nt, Human
uucucccucuuucuucccaugaccccaaagccaagggcaacagaucaguaaagaacguggucag

SEQ ID NO: 40066 - RNA, 64 nt, Human
aaguaccaaacauaacccagaguauguggaauaugggcaacauauauauagccuucuguauuua

SEQ ID NO: 40067 - RNA, 64 nt, Human
gaugccuugcagacaucauucaguuucuaauauugggcaacaauuauuauuaaaugaauuauuu

SEQ ID NO: 40068 - RNA, 64 nt, Human
gaauugcuugaacucaggaguuggagaccagccugggcaacauggcaaaacgcagucuguacaa

SEQ ID NO: 40069 - RNA, 64 nt, Human
agugagccgagaucgcaccacugcacuccagccugggcaacagagugagacucugucuaaaaag

SEQ ID NO: 40070 - RNA, 64 nt, Human
uuacagugagcugagauugcgccacuguacuccugggcaacagcgagacuccgucucaaaaaaa

SEQ ID NO: 40071 - RNA, 64 nt, Human
aggcccugcaaggacucccccucagaccuccaaagggcaacagaagaguauuaauaaacgugaa

SEQ ID NO: 40072 - RNA, 64 nt, Human
gcggagccaagaugaugccauugcacuccagccugggcaacaagagagaagguccuucucaaaa

SEQ ID NO: 40073 - RNA, 64 nt, Human
ggaucgcugcagcccaggaguucgagacuagccugggcaacauagcgagaccucgucucuacaa

SEQ ID NO: 40074 - RNA, 64 nt, Human
ggauugcuugagcccaggaguuugagaccagccugggcaacacagcgagaccuugucucuuaaa

SEQ ID NO: 40075 - RNA, 64 nt, Human
aaugaaccgagauagugccauugcacuccggccugggcaacagaggaagacugccucaaacaaa

SEQ ID NO: 40076 - RNA, 64 nt, Human
agugagccaagauugcgccauugcacuccagccugggcaacacagcgagacuccgucucaagga

SEQ ID NO: 40077 - RNA, 64 nt, Human
caugcuggguucugcacagcuggccucccgcguugggcaacauugcuggcuggaagggaggagc

SEQ ID NO: 40078 - RNA, 64 nt, Human
ggaucacuuaagcucaggaguucaaggccagccugggcaacauggcaaaaccccauuucuacaa

SEQ ID NO: 40079 - RNA, 64 nt, Human
ggauugcuugagcccaggaguuugagaccagccagggcaacagagugauacccugucucuacaa

SEQ ID NO: 40080 - RNA, 64 nt, Human
ggugagccaagaucgcaccauugcacuccagccugggcaacaagagugaaacucugucucaaaa

SEQ ID NO: 40081 - RNA, 64 nt, Human
ggcuugaggccagagguuugagaccgaccagccagggcaacacagugagaccccuucucaaaaa

SEQ ID NO: 40082 - RNA, 64 nt, Human
agugagcugagauugugccacuguacuccagccugggcaacaagagcgagacuccguuuccaaa

SEQ ID NO: 40083 - RNA, 64 nt, Human
agaucgcuugaggccaagaguucaagaccagccugggcaacauagcgagaccccuaucuguauu

SEQ ID NO: 40084 - RNA, 64 nt, Human
gucaccuggaacagacucaaagaacagguucuuugggcaacagacaaagaagaaucaaguucug

SEQ ID NO: 40085 - RNA, 64 nt, Human
aaugagcuauaauugcaucauugcacuccagccugggcaacagagacccugucucaaccaccac

SEQ ID NO: 40086 - RNA, 64 nt, Human
agugagccgagauugugccacugcacuccagccugggcaacagagcuagacucugugucaaaaa

SEQ ID NO: 40087 - RNA, 64 nt, Human
agugaguugagauugugccauugcacuccagccugggcaacagagcaagacucugucucaggaa

SEQ ID NO: 40088 - RNA, 64 nt, Human
ggaucauuugagcccaggaguucgagaccaaccugggcaacauagugagauucuguuaaaaaaa

SEQ ID NO: 40089 - RNA, 64 nt, Human
ggaucacuggaggccaagaguuggagagcagacugggcaacauagcgagaccucaucucaaaca

SEQ ID NO: 40090 - RNA, 64 nt, Human
gcagagccgggacuaucccuuaucccuguggguugggcaacacuauuuaguccugaaaccgaau

SEQ ID NO: 40091 - RNA, 64 nt, Human
ccauugcucaccaggccucacugggcccacagcugggcaacaagaaaaauguuugaauuggacc

SEQ ID NO: 40092 - RNA, 64 nt, Human
cuugaaaaguauuccaaggaauauuaugaaaauagggcaacauggacuguuuaagaucuccaug

SEQ ID NO: 40093 - RNA, 64 nt, Human
gagccaagcaauuuggagccaaguugaagggacagggcaacaaaauacaguaguaguuucuuuu

SEQ ID NO: 40094 - RNA, 64 nt, Human
uugggggccugggcaggggcccgcuuggcgggccgggcaacacgucaacauucuuuucuguucu

SEQ ID NO: 40095 - RNA, 64 nt, Human
aguagaucccagcaucugggccauggagagguuggggcaacagguuauugauuaaccugacuuu

SEQ ID NO: 40096 - RNA, 64 nt, Human
agugagucaagaucacgccauugcacuccagccugggcaacaagagcgaaacuccaucucaaaa

SEQ ID NO: 40097 - RNA, 64 nt, Human
ggauuacuugaaacccacaguuugagaccagccugggcaacauagugagacccugucucuaaaa

SEQ ID NO: 40098 - RNA, 64 nt, Human
gggguggggggugcuucugugcccacgggucccugggcaacagucccuaggcuaagacaggggu

SEQ ID NO: 40099 - RNA, 64 nt, Human
agcaggcugugauugcaccacugcacuucagcuugggcaacagagcaagacccugucuccgaaa

SEQ ID NO: 40100 - RNA, 64 nt, Human
aggaggauugagaccaggaguucgagaagagccugggcaacauagugagaccccaucucuacaa

SEQ ID NO: 40101 - RNA, 64 nt, Human
ggaucacuugagcucaggaguccuaaaccagccugggcaacauagugauaccuugucucuacca

SEQ ID NO: 40102 - RNA, 64 nt, Human
agcgagcugagaucacgccacugugcuccagccugggcaacaaagugagacucugucucaaaaa

SEQ ID NO: 40103 - RNA, 64 nt, Human
caccuggggucucucucccuaccucccuccucaggggcaacaacaggagaaugggguuccugcu

SEQ ID NO: 40104 - RNA, 64 nt, Human
auuuggaaacuguuuuccucuguuuuggucucuugggcaacauuuuuggcccaaguuugggcaa

SEQ ID NO: 40105 - RNA, 64 nt, Human
uuggucucuugggcaacauuuuuggcccaaguuugggcaacauuuggcccaaguuugggcauuu

SEQ ID NO: 40106 - RNA, 64 nt, Human
aguaagccaagaucaugccauugcacuccagccugggcaacacagggagacuccaucucaaaaa

SEQ ID NO: 40107 - RNA, 64 nt, Human
agugagcugagauugugccacugcacuccagccugggcaacaaagcaagacucugucucaaaaa

SEQ ID NO: 40108 - RNA, 64 nt, Human
agugagccaagaucaugucacugcauuccagccugggcaacagaggaagacuccgucucaaaaa

SEQ ID NO: 40109 - RNA, 64 nt, Human
agugagccaagaguacaccacugcacuccagccugggcaacagagcgagacuccgucuuaaaaa

SEQ ID NO: 40110 - RNA, 64 nt, Human
ggucuguuccauccccacggaugguguugcugcugggcaacaguguuggcuucuuuuaaguacc

SEQ ID NO: 40111 - RNA, 64 nt, Human
uacuugaaguuacucggacaaagaccccaaaguggggcaacaacuccagagaggcugugggaau

SEQ ID NO: 40112 - RNA, 64 nt, Human
ucaaggaaaauagcuuccagaauguggugguucugggcaacaaaugagauuguggcgacgugga

SEQ ID NO: 40113 - RNA, 64 nt, Human
ggauugccugagcucaggaguucgagaccagccagggcaacauggugaaacccugucucuacua

SEQ ID NO: 40114 - RNA, 64 nt, Human
uguccuuaguccuccagggggagcugggguugcagggcaacaguacagucgcgcuuacgaccug

SEQ ID NO: 40115 - RNA, 64 nt, Human
agugugguucuaaaguuccugcugucaucaacuugggcaacaaaugacccacuggaaaggcaaa

SEQ ID NO: 40116 - RNA, 64 nt, Human
ggguugcuugagcccagggguuugagaccagcuugggcaacaacaacaaaaaugccaggugugg

SEQ ID NO: 40117 - RNA, 64 nt, Human
agugagccgagauugcaccauugcaccccagccugggcaacagagcgagacuccgucucaaaaa

SEQ ID NO: 40118 - RNA, 64 nt, Human
ccuuuguacaguauucugagaaacgcaaauaaaagggcaacauguuucuguuucccugugucug

SEQ ID NO: 40119 - RNA, 64 nt, Human
acugcucacccacuuccaccgugggguugggggugggcaacagaggaggggagcaaguagggaa

SEQ ID NO: 40120 - RNA, 64 nt, Human
agugagccgagauugcgccacugcgcuccagccugggcaacagagcgagacuccaucucaaaaa

SEQ ID NO: 40121 - RNA, 64 nt, Human
cagugagccaagaucacgccacuacauuccagcugggcaacacagcaagacucugucucaaaaa

SEQ ID NO: 40122 - RNA, 64 nt, Human
ggaucgcuugagccugggaguucaagaccagccugggcaacauggcaagacccugucucuacua

SEQ ID NO: 40123 - RNA, 64 nt, Human
caggggacgguagaaaccuaaggaaaaugcuuuugggcaacaugagaggaaccuuuucauauua

SEQ ID NO: 40124 - RNA, 64 nt, Human
cucccuggacuucuccuggguugugcuuuuuugggggcaacauaccuuggacaaagcugagcug

SEQ ID NO: 40125 - RNA, 64 nt, Human
ggaucacuugaggucaggaguucaagaccagccugggcaacauggcgaaacccugucucuacua

SEQ ID NO: 40126 - RNA, 64 nt, Human
agugagcuaugauuccaccauugcacuccagucugggcaacagagcaagacccugucuauuuaa

SEQ ID NO: 40127 - RNA, 64 nt, Human
ccagguuccagucugggcucuucacugacaaagugggcaacacuagaaacuucccuuugucucu

SEQ ID NO: 40128 - RNA, 64 nt, Human
agugagccaagaucaugccacugcacuccagccugggcaacagagugagacuccgucucaaaaa

SEQ ID NO: 40129 - RNA, 64 nt, Human
aaagcagcccaaguagguuauuuguacagucagagggcaacaggaagaugcaggccuucaaggg

SEQ ID NO: 40130 - RNA, 64 nt, Human
gcagugagccgagauugccacugcacuccagccugggcaacaagagcgaaacuccgucucaaaa

SEQ ID NO: 40131 - RNA, 64 nt, Human
aacgcacuucgcggaccucagcccugcagcuggagggcaacaggcugccgggccccgcuggcca

SEQ ID NO: 40132 - RNA, 64 nt, Human
cagguugaugaugagaucccagugagaagauggggggcaacacugaccauuuggugcugagcgc

SEQ ID NO: 40133 - RNA, 64 nt, Human
cuuuuuuuucauuauaucuaauuauuuugcaguugggcaacagagaaccaucccuauuuuguau

SEQ ID NO: 40134 - RNA, 64 nt, Human
agugaguugugauugcaccacugcccuccagccugggcaacagagugaaaccuugucucucucu

SEQ ID NO: 40135 - RNA, 64 nt, Human
agugauccaagaucaugccacugcacuccagccugggcaacaagagcaaaacuccgucucaaaa

SEQ ID NO: 40136 - RNA, 64 nt, Human
agucagcucagauugcaccacugcacuccagccugggcaacagagcgagacccugucuccaaaa

SEQ ID NO: 40137 - RNA, 64 nt, Human
gcaggagggccuacaaacgggcccagcaagagcugggcaacagcuggcuugugaaaugagacac

SEQ ID NO: 40138 - RNA, 64 nt, Human
ccagagggcucaggaugccccaggaaggaaagaagggcaacagacuacacgauuggacgugugu

SEQ ID NO: 40139 - RNA, 64 nt, Human
acugcgcgggccugagacugcuggauacaauguugggcaacaacucagccagccugauggcagc

SEQ ID NO: 40140 - RNA, 64 nt, Human
cgugagcuaugauuaugccacugcuuuccagccugggcaacauaguaagaccccaucucuuaaa

SEQ ID NO: 40141 - RNA, 64 nt, Human
agugagccaugaucgagccacugcacuccagccugggcaacagaugaagacccuauuucagaaa

SEQ ID NO: 40142 - RNA, 64 nt, Human
agugagccgagguugcaccauuguacuccagccugggcaacaagagugaaacucugucuuaaaa

SEQ ID NO: 40143 - RNA, 64 nt, Human
cagugagccgaggucacaccauucacuccagccugggcaacaagagcgaaacuccguuucaaaa

SEQ ID NO: 40144 - RNA, 64 nt, Human
agugagccaagauugugccauugcacucuagccugggcaacaggagcaaaacuccgucucaaaa

SEQ ID NO: 40145 - RNA, 64 nt, Human
cuccuuucccaagugguguugugaggggcaaugagggcaacaggagauguggggacguguuagg

SEQ ID NO: 40146 - RNA, 64 nt, Human
agugagccgagauugcgccacugcacuccagccugggcaacagagugaaacucugucucaaaaa

SEQ ID NO: 40147 - RNA, 64 nt, Human
ggauugcuugaagccaggaguuugggaccagccugggcaacauagggggaucccaucucuacac

SEQ ID NO: 40148 - RNA, 64 nt, Human
agugagcuaugauuguaccacugcacuccagccugggcaacagagcaagaccuugucucaaaaa

SEQ ID NO: 40149 - RNA, 64 nt, Human
agugagcugagaucgcgccauugcacuccagccugggcaacaagaguggcacuccaucucagaa

SEQ ID NO: 40150 - RNA, 64 nt, Human
ggacugcuugaguccagaaguuuaagaccagccugggcaacacggggagacccugucucuacaa

SEQ ID NO: 40151 - RNA, 64 nt, Human
caaugagcaagauugugccacugcacuccagccugggcaacagagcaagacucugucucaaaaa

SEQ ID NO: 40152 - RNA, 64 nt, Human
agugaaccuagaucacgccacugcauuccagccugggcaacagagcgagacuccaucuuaaaaa

SEQ ID NO: 40153 - RNA, 64 nt, Human
gcacuguggaaagacaggaguucgaaaccagccugggcaacauagugagacccugccucauggc

SEQ ID NO: 40154 - RNA, 64 nt, Human
agugagcugagaucgcaccacugcacucuagcuugggcaacagagcaagacucugucucuuaaa

SEQ ID NO: 40155 - RNA, 64 nt, Human
ggaucacuuaaggccaggaguucgagaccagccugggcaacagcaagaccucaucucuacaaaa

SEQ ID NO: 40156 - RNA, 64 nt, Human
agugagcuguguucacaccacugcacuccagucugggcaacagugcaagacccugucacuuaaa

SEQ ID NO: 40157 - RNA, 64 nt, Human
acugaccuaugguagugcuacugcacuccagccagggcaacagagugagacccugucuccaaaa

SEQ ID NO: 40158 - RNA, 64 nt, Human
ugauggcuugagcccaggaguucgagaccagccugggcaacacagcgagaucucuuggggguaa

SEQ ID NO: 40159 - RNA, 64 nt, Human
agugagccgagaucgugccacuguacuccagccugggcaacaaggcgagacuccaucucaauaa

SEQ ID NO: 40160 - RNA, 64 nt, Human
cgagggggccaacucacagaaggggacugacagugggcaacacucacaucccacuggcugcugu

SEQ ID NO: 40161 - RNA, 64 nt, Human
ggaucguuugaggccaggaggucaauaccagccugggcaacauaguaagacccugucucuauua

SEQ ID NO: 40162 - RNA, 64 nt, Human
agugagcugagaucucaccacugcacuccagccugggcaacagagcgagacucugucucaacaa

SEQ ID NO: 40163 - RNA, 64 nt, Human
ggauugccugagcucaggaguucaagaccagccugggcaacauggugaaaucccaugucuacua

SEQ ID NO: 40164 - RNA, 64 nt, Human
gguucauuggaggccaggaguuagagaucagccugggcaacauagccagaccuccucucuacaa

SEQ ID NO: 40165 - RNA, 64 nt, Human
agugagcugagaucacacuacugcacuccagccugggcaacagagcaagacugucucaaaaaaa

SEQ ID NO: 40166 - RNA, 64 nt, Human
ggcaucacuugaaccaggaguucaguacuaaccugggcaacaaagaggccccugucucugauaa

SEQ ID NO: 40167 - RNA, 64 nt, Human
cgcuccccaacuucucgcccagcuggccgaggcggggcaacacuaaggugcucuuagaaacacu

SEQ ID NO: 40168 - RNA, 64 nt, Human
ggugagccaagaucgcaccauugcacuccagccugggcaacaagagcgaaacucugucucaaaa

SEQ ID NO: 40169 - RNA, 64 nt, Human
ggaaggcuugaggccaggaguucaagaccagccagggcaacauggugagaccucaucucuacaa

SEQ ID NO: 40170 - RNA, 64 nt, Human
agagagcuaugauugcaccacugcacuccagccugggcaacaaagcaagacccugucucuugaa

SEQ ID NO: 40171 - RNA, 64 nt, Human
cuugagcuugagccuagacguuaaagaccagccugggcaacacagcaagacccaucucuacaag

SEQ ID NO: 40172 - RNA, 64 nt, Human
ggacugcuuaagcccaggaguucaagaccagccugggcaacauagugagacucuguuauaaaaa

SEQ ID NO: 40173 - RNA, 64 nt, Human
ggauggcucaagcccaggaguuugagaccagugugggcaacagagugagaaccaucucuaccca

SEQ ID NO: 40174 - RNA, 64 nt, Human
uucccuugaucucaucaguucugagcgggucauggggcaacacgguuagcggggagagcacggg

SEQ ID NO: 40175 - RNA, 64 nt, Human
agagagcuaugacugcaucacugcacuccagccugggcaacacagcaagauccugucuaaaaau

SEQ ID NO: 40176 - RNA, 64 nt, Human
ggacugcuuaagcucaggaguuugagaccagccugggcaacauagcaagacccccaccaucucu

SEQ ID NO: 40177 - RNA, 64 nt, Human
agugagccgagaucacgccauugcacuccagccugggcaacaagagcaaaacucuaucucaaag

SEQ ID NO: 40178 - RNA, 64 nt, Human
ggaucacuggagcucgggaguucaagaccagccugggcaacauagugaaaccgucuccacaaau

SEQ ID NO: 40179 - RNA, 64 nt, Human
agugaaccaagaucaugccacugcacuccagccugggcaacacagcgagacuccgucucaaaaa

SEQ ID NO: 40180 - RNA, 64 nt, Human
ggugagccgagauugagccauugcacuccagccugggcaacaacagcaaaacuccaucucaaaa

SEQ ID NO: 40181 - RNA, 64 nt, Human
agaucucuugagcucaggaguucaagaucagccugggcaacacagugagaccucaucuccacua

SEQ ID NO: 40182 - RNA, 64 nt, Human
ggauugcuugagcccaggaguucaagaccagccugggcaacauagugagaccugcccccuaucu

SEQ ID NO: 40183 - RNA, 64 nt, Human
ggugagccaagauggcaccauugcacccuagccugggcaacagagcaagacaccgucuuaaaac

SEQ ID NO: 40184 - RNA, 64 nt, Human
auugagccaugauugcaccacugcacuccagccugggcaacagagggagcccccgucucaacaa

SEQ ID NO: 40185 - RNA, 64 nt, Human
ggauugauugaggccaggaguucaagaccagccugggcaacauggugagaccccaucucuacaa

SEQ ID NO: 40186 - RNA, 64 nt, Human
agugagccgagaucgucccacugcacuccagccugggcaacagagugagacucuguuucuaaau

SEQ ID NO: 40187 - RNA, 64 nt, Human
agagaacugaguucaacuccaucuaugccagccugggcaacagagcgagacuccaacucagaaa

SEQ ID NO: 40188 - RNA, 64 nt, Human
agaucacuugagcccgcaaguuugagaccacccugggcaacauagcgagacuaccucuacaaaa

SEQ ID NO: 40189 - RNA, 64 nt, Human
ggugagccaagaucaugccacugcacuccagccugggcaacaagaacaaaacuccaucuaaaga

SEQ ID NO: 40190 - RNA, 64 nt, Human
cagugagcgagaucaugccauugcacuccagccugggcaacaggagugaaacuccaucuccaaa

SEQ ID NO: 40191 - RNA, 64 nt, Human
ggaucgcuugagcccaggaguucaagaccagccugggcaacauagugagaccccaucucuacuu

SEQ ID NO: 40192 - RNA, 64 nt, Human
agugagccaauauugcaccauugcacuccugccugggcaacaagagcaaaauuucaucucaaaa

SEQ ID NO: 40193 - RNA, 64 nt, Human
ggauugcuugaggccaggaguuccagaucaaccugggcaacaugaugagaccccaucucuacaa

SEQ ID NO: 40194 - RNA, 64 nt, Human
ggauuccuugaggccaggguucgagaccaaccuugggcaacauagcaagaccccauuucuuaaa

SEQ ID NO: 40195 - RNA, 64 nt, Human
agugagcugagaucgucccacugcacuccagcccgggcaacagaguaagacccugccucaagaa

SEQ ID NO: 40196 - RNA, 64 nt, Human
agugagccgagauggugccacugcauuccagccugggcaacagagcgagacuccaucucaaaaa

SEQ ID NO: 40197 - RNA, 64 nt, Human
uuuguuguuguggugguuuuuuaacacaaagccugggcaacagagcaaaacucugucucaaaaa

SEQ ID NO: 40198 - RNA, 64 nt, Human
ggaucccuuuagcccaggaguuaaagaccagccugggcaacauagggagacccugucuuuuuuu

SEQ ID NO: 40199 - RNA, 64 nt, Human
aggugggaggaucccaggaguucaaauccugccugggcaacauagcaagacccugucucuuaaa

SEQ ID NO: 40200 - RNA, 64 nt, Human
gugguugcaccugugaauaacugcacuccagccugggcaacauagcgagaccucaucuccaaaa

SEQ ID NO: 40201 - RNA, 64 nt, Human
agugagcuauuacagugccacugcaauccagccugggcaacagagcgaggucccguuucuuaaa

SEQ ID NO: 40202 - RNA, 64 nt, Human
gguauagcacauugcuucugcgcugguggcaauagggcaacaaagccauaggccagagggcggg

SEQ ID NO: 40203 - RNA, 64 nt, Human
gcucuacccucacccuucuggccaggaucccgcagggcaacagccccaucugcuuggcugaccc

SEQ ID NO: 40204 - RNA, 64 nt, Human
ggaucaccagaggccagcagguccacaccagccugggcaacacagcaagacaccgcaucuacag

SEQ ID NO: 40205 - RNA, 64 nt, Human
agugagccaagaucgcgccaucgcacuccagccugggcaacaagagcaaaacuccaucucaaaa

SEQ ID NO: 40206 - RNA, 64 nt, Human
guauugcuugaggccagguguuugaggccagccagggcaacacagcaagaccccaucucuacaa

SEQ ID NO: 40207 - RNA, 64 nt, Human
ccaguagccacauguggcuaguggcugcugugacgggcaacacagauauggaacacuuguaucc

SEQ ID NO: 40208 - RNA, 64 nt, Human
ggaucacuugagcucaggagcuugagaccagccugggcaacauggugaaacccaguuucuacaa

SEQ ID NO: 40209 - RNA, 64 nt, Human
ggugagccaagguugcgccacugcacuccagccugggcaacaagaguaaaacuccaucucaaaa

SEQ ID NO: 40210 - RNA, 64 nt, Human
ccauucucucguggcuuuccaucucagccucggagggcaacauugacaguccuccuggcuucag

SEQ ID NO: 40211 - RNA, 64 nt, Human
ggaucgcuugagcucaggaguucgagagcagccugggcaacauggugaaagcccgucucuaccg

SEQ ID NO: 40212 - RNA, 64 nt, Human
cgugagucgagaucgcaccauugcauuccagccugggcaacaagagcgaaacuccgucucaaaa

SEQ ID NO: 40213 - RNA, 64 nt, Human
cuugcaccugugaauagccacugcacuccaucuugggcaacacagugagacccccaucuauaaa

SEQ ID NO: 40214 - RNA, 64 nt, Human
agaaagucucuaaaauaucacagauuuaccuagagggcaacauuuagauacaggaaaauuuuac

SEQ ID NO: 40215 - RNA, 64 nt, Human
gagccuuggucaugccacuacuguguucuagucugggcaacagagugagaccuucucucaaaaa

SEQ ID NO: 40216 - RNA, 64 nt, Human
gcacacuuuguagaggagggauuugcaguuacuugggcaacaagguaaccacugaucauuacag

SEQ ID NO: 40217 - RNA, 64 nt, Human
agugagcugagaucacgccacugcacuccagccugggcaacagagugagacucugucucaaaaa

SEQ ID NO: 40218 - RNA, 64 nt, Human
agugagcugaagucccgccacugcacuccagccugggcaacagagcgagacucagucucaaaaa

SEQ ID NO: 40219 - RNA, 64 nt, Human
agaaccggugcguccugaggagagaaccggcgcugggcaacacgggccugcaaacucgacagga

SEQ ID NO: 40220 - RNA, 64 nt, Human
agugagcagagaucacgcaacugcacuccagcuugggcaacagagugagacuuaaucuugaaaa

SEQ ID NO: 40221 - RNA, 64 nt, Human
agugagccgagaucgugcuacugcauuccaaccugggcaacaagagugaaacucugucucaaaa

SEQ ID NO: 40222 - RNA, 64 nt, Human
agugagcugagaucgcaccacugcacuccagccugggcaacauagcaaaauccugucucaaaaa

SEQ ID NO: 40223 - RNA, 64 nt, Human
ggugagcugagauugcaccauuucauuccagccugggcaacaugagugaaagucugacucaaaa

SEQ ID NO: 40224 - RNA, 64 nt, Human
agugagcugagauugcgccauugcacuccagccugggcaacaagagcaaaauucugccucaaaa

SEQ ID NO: 40225 - RNA, 64 nt, Human
gccucccaaagugggaaaugggucauuuucaaaggggcaacagugauaccaucccugcacuccu

SEQ ID NO: 40226 - RNA, 64 nt, Human
agugagcugagaucgugccacugcacuccagccugggcaacagagccagacuccgucucuaaac

SEQ ID NO: 40227 - RNA, 64 nt, Human
agaucaccugagaucaggaguucgggaccagccugggcaacauggugaaacccugucucuacua

SEQ ID NO: 40228 - RNA, 64 nt, Human
agugagccgagaucacgccauugcacuccagccugggcaacagagcaagacuccaucucaaaaa

SEQ ID NO: 40229 - RNA, 64 nt, Human
cccgucuccaggccccagcuguugaaacuuugaagggcaacaaacaaccauccacacugccgga

SEQ ID NO: 40230 - RNA, 64 nt, Human
cucuagucacagugaaucuuuaacuguguccugagggcaacaggguuugcugcacuucuuuuag

SEQ ID NO: 40231 - RNA, 64 nt, Human
agugagcuaagaucgcgccacuguacuccagccugggcaacagcgagacuccaucucaaaaaaa

SEQ ID NO: 40232 - RNA, 64 nt, Human
agaggaguuggcuguaucaccccugguuauuuuagggcaacaacccaguuggggagucuuauga

SEQ ID NO: 40233 - RNA, 64 nt, Human
agugagccgagaucucgccacugcacuccagccugggcaacagagcaagacucugucucaaaaa

SEQ ID NO: 40234 - RNA, 64 nt, Human
ggagugcuugagguuaggcguuccagaccagccugggcaacauagugagacucuugucucuaca

SEQ ID NO: 40235 - RNA, 64 nt, Human
agauggcuugagaccaggaguucaagaccagccugggcaacauagugagacgcccccccccccc

SEQ ID NO: 40236 - RNA, 64 nt, Human
guauuuggagaucaugggcugauuccauguucuugggcaacaguccagaagcaucaggggcucc

SEQ ID NO: 40237 - RNA, 64 nt, Human
agugagccaagaucuugccauugcacuccagccugggcaacaagagugaaauucugucucaaaa

SEQ ID NO: 40238 - RNA, 64 nt, Human
aaugagccgagaucacaccacugcacuccagccugggcaacagugaaacuccaucucaaaaaau

SEQ ID NO: 40239 - RNA, 64 nt, Human
gcuuuggggauggggugggcugggguggauggaugggcaacagugacuuugauuacccuugcug

SEQ ID NO: 40240 - RNA, 64 nt, Human
caucccuggugcaaguguucauccagccgugccagggcaacagcccacccccuaguacaacuga

SEQ ID NO: 40241 - RNA, 64 nt, Human
ggaucgcuggagcccaguaggucaagaccagccagggcaacaugaugagacccugucucugcca

SEQ ID NO: 40242 - RNA, 64 nt, Human
ggauugcuuaaggccaggaguuugagaccagcuugggcaacauagugaaacccugucuguaugg

SEQ ID NO: 40243 - RNA, 64 nt, Human
gccuguccgcugcagccgcacccuaccuugucuaagaaaccaugugugucuggaacacgcugcu

SEQ ID NO: 40244 - RNA, 64 nt, Human
caggacgucaaaaacucaccauggaccccaaggcagaaaccaagaacugucugcaggcaaauaa

SEQ ID NO: 40245 - RNA, 64 nt, Human
acggcaaggggcaauggagugaguuucccaacuaagaaaccacuauuauauauuuuuucccuuc

SEQ ID NO: 40246 - RNA, 64 nt, Human
aaaguggaauuaauugcaguagggauaaaguagaagaaaccacaaauuaucuugugccugaaau

SEQ ID NO: 40247 - RNA, 64 nt, Human
acugugacccucgcuccuuccauuucuguccauuagaaaccagccuuuucagcaucucacccau

SEQ ID NO: 40248 - RNA, 64 nt, Human
ccucagccucugcaacugcaagaaaggggacccaagaaaccaaagucugccgcccaccucgcuc

SEQ ID NO: 40249 - RNA, 64 nt, Human
guuacucaguauacaugaaauuuuuugcaggaaaagaaaccagaaauacagaauaauucauaga

SEQ ID NO: 40250 - RNA, 64 nt, Human
agacuuugucuaagccucauuauacugaaguugaagaaaccaaaugagcuccacccucacuuug

SEQ ID NO: 40251 - RNA, 64 nt, Human
gaccucaguuccuggaggggggaaagggugaaagagaaaccacguauuuuguuauuauuuugga

SEQ ID NO: 40252 - RNA, 64 nt, Human
auuauuuuggauuauuuuuuaucgaagagaucauagaaaccagagccuucuccccaggccugcc

SEQ ID NO: 40253 - RNA, 64 nt, Human
aaccuaccccaacucugcccuucucccauccaagagaaaccagcaaaaugauaaagaagcuaac

SEQ ID NO: 40254 - RNA, 64 nt, Human
agaguauaaagaguguagggggugguugagaguaagaaaccaggagccuugugccuugagacuc

SEQ ID NO: 40255 - RNA, 64 nt, Human
uaaaaauuuauuaaauauaaauauccccagggacagaaaccaaggccccgagcucagggcagcu

SEQ ID NO: 40256 - RNA, 64 nt, Human
ucaguuuuuaaccacuuuuagguuuuccccuuacagaaaccacagaaauauucccuuagaauaa

SEQ ID NO: 40257 - RNA, 64 nt, Human
gaagucaauugaguaaggacaccuccagccauacagaaaccaacacugugugggggccaagguc

SEQ ID NO: 40258 - RNA, 64 nt, Human
cgggagagcgaugcuuggauuuuuguuuccuauuagaaaccaacaguuuuguucuaauuucauu

SEQ ID NO: 40259 - RNA, 64 nt, Human
uuucaucagguaucuuucuguggcauuugagaacagaaaccaagaaacaugguaauuacuaaau

SEQ ID NO: 40260 - RNA, 64 nt, Human
aucccuuuucuauaaaaaauaaguuaaugugucaagaaaccaacucuauuaaggugggguuuaa

SEQ ID NO: 40261 - RNA, 64 nt, Human
uaugcuggccagaaagggaaaugaggaggagaguagaaaccacagcucuuaguaguaauggcau

SEQ ID NO: 40262 - RNA, 64 nt, Human
gguuuucgcacuucuuggcugguccagggacugcagaaaccaaagcugcuauuguugaggaaua

SEQ ID NO: 40263 - RNA, 64 nt, Human
uuuugucccuacauagcaauuuucuguggcacugagaaaccauguaugaccacaauaaaaaucc

SEQ ID NO: 40264 - RNA, 64 nt, Human
ccagcuccuguuagcucgugguccucaaggacucagaaaccaggcucgaggccuaucccagcaa

SEQ ID NO: 40265 - RNA, 64 nt, Human
ccugccccagcuguucuccagggcuuggggaaacagaaaccacucacauagggauuccuggaug

SEQ ID NO: 40266 - RNA, 64 nt, Human
uuggaaaguccccgucccccagaaccucaagucuagaaaccaguauggaagggagggguccuga

SEQ ID NO: 40267 - RNA, 64 nt, Human
gucaaaugauugccaucagaaagagacaacuugaagaaaccaacaaugacuaugaaacagcuga

SEQ ID NO: 40268 - RNA, 64 nt, Human
agcuccccagaugauuccuguguacauuaaaucuagaaaccauuaguuugagaucucucaaaaa

SEQ ID NO: 40269 - RNA, 64 nt, Human
ggcacugccauaguucugccucuuugcuggggaaagaaaccaggaacguggaggguuauuacug

SEQ ID NO: 40270 - RNA, 64 nt, Human
guuucaccuuuguauaagauauagccaagacugaagaaaccaaauauauguguuuacuguagca

SEQ ID NO: 40271 - RNA, 64 nt, Human
uauauauauuauuuuuuuuuaagaaaggaggaaaagaaaccaaaaguuuuuuuuaagaaaaaaa

SEQ ID NO: 40272 - RNA, 64 nt, Human
ggucaagcccauagacacacacucucugcugguaagaaaccauagcccagaacugagccaauaa

SEQ ID NO: 40273 - RNA, 64 nt, Human
ucaaagcagggcugguuuuccaacccagccucugagaaaccauuucuuugcuauccucugccuu

SEQ ID NO: 40274 - RNA, 64 nt, Human
caguuaaucguuucuuaauaaagaagcagaauuuagaaaccacaggauaguguacccacagaug

SEQ ID NO: 40275 - RNA, 64 nt, Human
aagucccaguccaaacucugauuuacaucacuuuagaaaccacacucacacuuuugcagagugu

SEQ ID NO: 40276 - RNA, 64 nt, Human
cuguaguacugacugguucaucacaaggcaagucagaaaccaguauccuucuagcucuccaguc

SEQ ID NO: 40277 - RNA, 64 nt, Human
aucccccaggacuugaugaccacacggggcagagagaaaccaaccaaggccagcaccuccgucg

SEQ ID NO: 40278 - RNA, 64 nt, Human
gagggagcaggaagagaugcugauaguuugaucuagaaaccagcagcuacuggcucaaauucag

SEQ ID NO: 40279 - RNA, 64 nt, Human
gggacauuagucguuauauuugacuugaaaagaaagaaaccaagugcgcuuugcaauauuuauu

SEQ ID NO: 40280 - RNA, 64 nt, Human
guccuuagaagucccauucucccuuccaguuaugagaaaccaaugccuucuagauucaggugac

SEQ ID NO: 40281 - RNA, 64 nt, Human
guuuacaauuaggcuauuuuuuaauauaggauuuagaaaccaaggguauguguuuuaaaauuac

SEQ ID NO: 40282 - RNA, 64 nt, Human
caggcgaguggggcccaggacugguuccagugagagaaaccaaccacaggcacccaagcacuac

SEQ ID NO: 40283 - RNA, 64 nt, Human
uucucacuauacucuaaaacaacuagacuugaaaagaaaccauuugagauuugaaucuaauggu

SEQ ID NO: 40284 - RNA, 64 nt, Human
augcggucagagugcagaaacccggucagcgugcagaaaccagcugucugcugaugaacggccc

SEQ ID NO: 40285 - RNA, 64 nt, Human
ccagaguaggccucugugaggcuucaguggccucagaaaccagaggguccagauagggggccug

SEQ ID NO: 40286 - RNA, 64 nt, Human
ccagggccucacagggaggcauucauggagcuggagaaaccagggauccugaccgcagggccca

SEQ ID NO: 40287 - RNA, 64 nt, Human
uagaaucucuuuauguucuccagaggaagguggaagaaaccaugggcaggaguaggaauugagu

SEQ ID NO: 40288 - RNA, 64 nt, Human
uuuaugauguaaggaauuaucaauuacaacagugagaaaccauauuuccuucuauccgaugagu

SEQ ID NO: 40289 - RNA, 64 nt, Human
cuguggaugaagaagccuaagccccucuggugucagaaaccagggaaaacccuugucuuuucuu

SEQ ID NO: 40290 - RNA, 64 nt, Human
ucaaaacuuaccuaucaaggaaagugaugacugcagaaaccagugagauacccaccugcuuguu

SEQ ID NO: 40291 - RNA, 64 nt, Human
acccugcagcuccuuuacaguucaauccaaugauagaaaccaucccuucccuuucucccuuggc

SEQ ID NO: 40292 - RNA, 64 nt, Human
uguccccucacagggaggggagcaggggagggaaagaaaccaggcaucuggucaaaccagcaga

SEQ ID NO: 40293 - RNA, 64 nt, Human
aaggcuaaccuuucuaagcucccuaacuugggccagaaaccaaagcugagcuuuuaacuuucuc

SEQ ID NO: 40294 - RNA, 64 nt, Human
cauagaaguggcuucccagaggaagaggccucucagaaaccauguucuauuuaaguucugaguc

SEQ ID NO: 40295 - RNA, 64 nt, Human
cccuacugacaaguucuuugguauuucaaaagggagaaaccacuauaaaagacaagaggaaggg

SEQ ID NO: 40296 - RNA, 64 nt, Human
uggguagagccaccagguacgacgaccagguaccagaaaccaccaggcacacggggcagaaagc

SEQ ID NO: 40297 - RNA, 64 nt, Human
gggcuuccuaacugcuacaaauacucuuaggaagagaaaccagggagccccuuugaugauuaau

SEQ ID NO: 40298 - RNA, 64 nt, Human
uuuggguugcccuccaacacauuacuuccauuucagaaaccauaucugauuuaauauaaacugc

SEQ ID NO: 40299 - RNA, 64 nt, Human
ucauuucccacacugucuuagagaacuugucaccagaaaccacauguauuugcauguuuuuugu

SEQ ID NO: 40300 - RNA, 64 nt, Human
aggcucucugucagcuuucauguacauaugguauagaaaccauggaguuaggcacuuccuggau

SEQ ID NO: 40301 - RNA, 64 nt, Human
aagcauuuauuaguucccugauuagacuggaagaagaaaccacuauuucaugaaaagcauggaa

SEQ ID NO: 40302 - RNA, 64 nt, Human
cgccgaagaaaaggugaagaaaggaauucuguaaagaaaccaucagauuuguuaaggacauacu

SEQ ID NO: 40303 - RNA, 64 nt, Human
acuguacuacuuuuuuuuuuuuuuuuccugaaaaagaaaccagaaaaaaauguacucuuacuga

SEQ ID NO: 40304 - RNA, 64 nt, Human
auacucguuacaucuguauugaacuuucggcccuagaaaccaguggaguuauuucaccacaaau

SEQ ID NO: 40305 - RNA, 64 nt, Human
uaaacaaaugcuuguugauagccuuuuucuaucaagaaaccaaggagcuaauuauuaauaacaa

SEQ ID NO: 40306 - RNA, 64 nt, Human
ucuggugaaaaauacuuuacaguggucggucacaagaaaccagcugaacaauuucagucauuug

SEQ ID NO: 40307 - RNA, 64 nt, Human
caaugagcuuucugaacagcugguguagcuacagagaaaccagcuuccuucagagagcagugcu

SEQ ID NO: 40308 - RNA, 64 nt, Human
uccucugaaggccgggacccagucauacauccuuagaaaccaaaguaugguuuuuguuuucucu

SEQ ID NO: 40309 - RNA, 64 nt, Human
ccagccugggcaacagagcaagacccugucuuggagaaaccagaauuuuggaagagcaaauggg

SEQ ID NO: 40310 - RNA, 64 nt, Human
aaggauggagaaaaaucugggacagugucuucucagaaaccaccagccuugacgguaaugaaac

SEQ ID NO: 40311 - RNA, 64 nt, Human
aaggauggagaaauaucuaggaaagugucuucucagaaaccaccaaccuugaagguaaugaaac

SEQ ID NO: 40312 - RNA, 64 nt, Human
uucucagaaaccaccaaccuugaagugucuucugagaaaccaccaggcuugaagguaaugaaac

SEQ ID NO: 40313 - RNA, 64 nt, Human
aaggauggagaaauaucuaggaaagugucuucucagaaaccaccagccuugaagguaaugaaac

SEQ ID NO: 40314 - RNA, 64 nt, Human
aaggauggagaaaaaucuaggacagugucuucugagaaaccaccaggcuugaagguaaugaaac

SEQ ID NO: 40315 - RNA, 64 nt, Human
ggaagaaaaauagguguauaaaauguuuuccaugagaaaccaagaaacuuacacugguuugaca

SEQ ID NO: 40316 - RNA, 64 nt, Human
cauugagaggugauuuaguuuauauguuuuuggaagaaaccauuaauguuuaauuuaaucuuaa

SEQ ID NO: 40317 - RNA, 64 nt, Human
agccuuaaggcugaugcaguuuacuuacaaguuuagaaaccagaaugcuuuguuuuuaccagau

SEQ ID NO: 40318 - RNA, 64 nt, Human
gacagucacucuugcacuauuccuucuccaagccagaaaccacauuuaauuucauaaauaaauu

SEQ ID NO: 40319 - RNA, 64 nt, Human
uacucuuucucaccugaugcucuuaaaagaucuuagaaaccaaccauacagacgagccgaugcg

SEQ ID NO: 40320 - RNA, 52 nt, Human
ucagggaaaguaaaaaguaaaaagaaaccaagaauuuuccauuuugugauca

SEQ ID NO: 40321 - RNA, 64 nt, Human
gucauaucaucccugcaaaaauuaauacacaaauagaaaccauuuucaaaagcaauucagaaag

SEQ ID NO: 40322 - RNA, 64 nt, Human
gcuuaaagcugaucaagaaaguuaacaacaacauagaaaccacacgauuguuccacugucugga

SEQ ID NO: 40323 - RNA, 64 nt, Human
gaugccucuacuaucauuaccucuauugggacccagaaaccaauaccccaaaauauggugcaug

SEQ ID NO: 40324 - RNA, 64 nt, Human
gccacgcuuguuccccauguaccucuagagaagcagaaaccaaagucccccugugcccugggag

SEQ ID NO: 40325 - RNA, 64 nt, Human
ccguuguguagauauuugacuucacugacagaaaagaaaccagggaguuuguagagacugugca

SEQ ID NO: 40326 - RNA, 64 nt, Human
gcucugagggcuguuuuuuuuuuuugauguuaacagaaaccaaucuuagcaccuuuucaagggg

SEQ ID NO: 40327 - RNA, 64 nt, Human
augaacagaucgucauugcaguuaaagcuccagcagaaaccagauuggauguuccagcucccag

SEQ ID NO: 40328 - RNA, 64 nt, Human
auaucuaguugauauuucucauucaguuggauccagaaaccaguaucucuaaaaacaaccucuc

SEQ ID NO: 40329 - RNA, 64 nt, Human
uagcuagcaaucuaugcaaacaccuuucccauaaagaaaccaaaccccauaguacagugccuug

SEQ ID NO: 40330 - RNA, 64 nt, Human
uggacacuuaagagacggggcaaauguggauccaagaaaccagggccaugaccggguccacugu

SEQ ID NO: 40331 - RNA, 64 nt, Human
guugcacuacaucaaaucuuuuuuugacacuuguagaaaccaguacacuuuuagauuagacagu

SEQ ID NO: 40332 - RNA, 64 nt, Human
cuuaaagaggagagcaggaagaaagguugguuucagaaaccaagagggucggcaguggacgcgu

SEQ ID NO: 40333 - RNA, 64 nt, Human
gaccucugacaacugugaagccacccugggcuacagaaaccacagucuucccagcaauuauuac

SEQ ID NO: 40334 - RNA, 64 nt, Human
ucucuuaccaaacaugggagaauccauacuagugagaaaccacgugaauguaaugaauguggga

SEQ ID NO: 40335 - RNA, 64 nt, Human
cuuuugagucugacauucuaauaaaauaauuuguagaaaccauuugucuuuguagugauuccaa

SEQ ID NO: 40336 - RNA, 57 nt, Human
uuaaaaaagccaccaacugaucaucugagaaaccaacacauuuuuuccugugaauuu

SEQ ID NO: 40337 - RNA, 64 nt, Human
ccugauugcuuguauuuuaagacauucauuaaaaagaaaccaggaaacacuuuugaaauaacag

SEQ ID NO: 40338 - RNA, 64 nt, Human
cucaccucuccuacucacuuaaagcccgccugacagaaaccacggccacauuugguucuaagaa

SEQ ID NO: 40339 - RNA, 64 nt, Human
ucuuccauguaaauacaaguugguacaaaucaauagaaaccauuuuaccuacauaggcaaagua

SEQ ID NO: 40340 - RNA, 64 nt, Human
ucaguauuaaucuccaaacaucacugcugcucggagaaaccacauccccaggcauaacaccacc

SEQ ID NO: 40341 - RNA, 64 nt, Human
uuugaccaguuccuuuuagagauucuuucagagaagaaaccagaucugaccuguuuauuguugg

SEQ ID NO: 40342 - RNA, 64 nt, Human
aguaugagauaggaggauuaaaauauuauuuuaaagaaaccacuguuucccccuaaaaugucau

SEQ ID NO: 40343 - RNA, 64 nt, Human
guacuucguuaugaaaaugccuuccacgcaaauaagaaaccaagggauaaaacuguucauggau

SEQ ID NO: 40344 - RNA, 64 nt, Human
aaaaugugaacguuuucuaacugccucguaggguagaaaccaauauuuuucaggaugcuguauu

SEQ ID NO: 40345 - RNA, 64 nt, Human
uauguuauucauguauuacugggagaugcuaccaagaaaccaacccaaagaaaauucugaaaaa

SEQ ID NO: 40346 - RNA, 64 nt, Human
gcuucagauaaacuugcaagauaagacaacuuuaagaaaccaguguuaauaacaauauuaacag

SEQ ID NO: 40347 - RNA, 64 nt, Human
uaaaaagagaugaucaguugguuguuuacuugcuagaaaccauuguuuuauugcaaacgaagga

SEQ ID NO: 40348 - RNA, 64 nt, Human
auuaucaucuuaaugacaaagggaauaaugaacuagaaaccagcaagugaaaguguuuauuucc

SEQ ID NO: 40349 - RNA, 62 nt, Human
ggcagauaaacaaacccugaagaguauacaaaagaaaccaugcaaagcaacgacuacuuugc

SEQ ID NO: 40350 - RNA, 64 nt, Human
uuuguuauuaaguaauaucugaaaugaauuagaaagaaaccauaagccuuaacaauacuccaau

SEQ ID NO: 40351 - RNA, 64 nt, Human
aggacaccuggcuucuugaaaaguucgcucugccagaaaccaccuagggaccacguuagcugcc

SEQ ID NO: 40352 - RNA, 64 nt, Human
guuucagaagcugcagcuggucuguuuccaggucagaaaccauuguucagaagaccucccugug

SEQ ID NO: 40353 - RNA, 64 nt, Human
ucacacugaaaaugccucaacuuuuuaaaguguaagaaaccaccaugaguggugucuagauuuc

SEQ ID NO: 40354 - RNA, 64 nt, Human
uaaauggugcuuuguuccugcugguuccaagcucagaaaccaagacuagcuuuguaggagagaa

SEQ ID NO: 40355 - RNA, 64 nt, Human
cuuucaauugaagugacuaaucgagauguaauauagaaaccagucuccauguguagauuaagcu

SEQ ID NO: 40356 - RNA, 64 nt, Human
uguuuuuuauuuguuaucuacacacucgaaaaagagaaaccagcugcgguacugucccauuuuu

SEQ ID NO: 40357 - RNA, 64 nt, Human
uaauguuucuuaaaaguuuuugagaaaaaaaggaagaaaccaacucauucagaaggcucggauu

SEQ ID NO: 40358 - RNA, 64 nt, Human
aagauuccugauguugcacccauuguaagugaucagaaaccaucuguaucaaagucuggacgga

SEQ ID NO: 40359 - RNA, 64 nt, Human
ccugcccaauucuuggcacaggcauuauguuugaagaaaccaggauaagguacacugcuuuugu

SEQ ID NO: 40360 - RNA, 64 nt, Human
ccuuuuauuuauagaaugcaugucuuuuguguuaagaaaccaaagagaaauaaagagaacacuc

SEQ ID NO: 40361 - RNA, 64 nt, Human
ugauggcucacugggcucuuggaggggaaugugaagaaaccaaggagucacuuuuucaucuaga

SEQ ID NO: 40362 - RNA, 64 nt, Human
ggcgcccacucugcuucgauucuccuccuguggaagaaaccauuuugagcaugacuuuucuuga

SEQ ID NO: 40363 - RNA, 64 nt, Human
ucacuucccccaguauaaaucaggaauguuugugagaaaccauugggaacuauacucuuuuuau

SEQ ID NO: 40364 - RNA, 64 nt, Human
ugaccuaucccacagcaaucggaguucuugaagaagaaaccagaacaaauaaaauagaaacaau

SEQ ID NO: 40365 - RNA, 64 nt, Human
cuaguuuaaaaacacuuuuuuucaaggaaaccgaagaaaccaucauccacuuuucucucuguau

SEQ ID NO: 40366 - RNA, 64 nt, Human
aaacauucucaacuccucuugaaucuaucccccaagaaaccaucuuaucccuguaauaaaucag

SEQ ID NO: 40367 - RNA, 64 nt, Human
uuucuuuuguuugcauuuucugcaaaaaggaaaaagaaaccacaaauuggggaaaaaaaaagaa

SEQ ID NO: 40368 - RNA, 64 nt, Human
ugcaaauauuccauuguaaacaaaucaaaggaaaagaaaccaagaacugaauuacugucugccc

SEQ ID NO: 40369 - RNA, 64 nt, Human
aacagauacccugauuuuucaucuuacgugaccaagaaaccacguuaggggaaaugaaaaaagc

SEQ ID NO: 40370 - RNA, 64 nt, Human
cugcagauggauguuuccaugaagaaaucucugaagaaaccaaaagagcugaaacugaaaaaag

SEQ ID NO: 40371 - RNA, 64 nt, Human
ggcagcugguugcucauaggguccuucucuagggagaaaccauuguuaauucaaauaagcugau

SEQ ID NO: 40372 - RNA, 64 nt, Human
cuucagucuggacuucuuuuugccagagaacuccagaaaccagucaggcucucagucagccuug

SEQ ID NO: 40373 - RNA, 64 nt, Human
ugggagacaacaacuguccuccuuggaacacccaagaaaccaugcaaagcaguggacaacacag

SEQ ID NO: 40374 - RNA, 64 nt, Human
uagccaggguaagggguaaaaggauaguaagcauagaaaccacuagaaagugggcuuaauggag

SEQ ID NO: 40375 - RNA, 64 nt, Human
cuuuuuuuuagccuuauuaauauuuuucccuauuagaaaccacaauuacucccucuauuaaccc

SEQ ID NO: 40376 - RNA, 64 nt, Human
uuguaguaaauaaguucaaggggaacuugggaccagaaaccacuguuauguacaaaaaaauggc

SEQ ID NO: 40377 - RNA, 64 nt, Human
auuauguucuguuaaugggaauuuaacauauuuaagaaaccaauauuuaaaauguuggucuagg

SEQ ID NO: 40378 - RNA, 64 nt, Human
ccguucauggagcuggucauuucuugaaaugagaagaaaccaaccuggaagaugucuuuuucag

SEQ ID NO: 40379 - RNA, 64 nt, Human
cagaacucuuggcuaaagggcuaguguggccuucagaaaccauucaauuauuuucucccuacac

SEQ ID NO: 40380 - RNA, 64 nt, Human
uaggaagaauggcuugugcuuaaggacaaagucuagaaaccacuaucauaguugcuaaaaaaaa

SEQ ID NO: 40381 - RNA, 64 nt, Human
acuaugcacugagaugccuuggccauggcacaagagaaaccagccaggaaaaaccagacagacu

SEQ ID NO: 40382 - RNA, 64 nt, Human
uuguccuucagauaauucauguggagauuuuuggagaaaccaugacggauaguuuaggaugacu

SEQ ID NO: 40383 - RNA, 64 nt, Human
uuuuuaaauugcaaauguaauuuuugccaauuagagaaaccaaccggugucaguaaaauucugu

SEQ ID NO: 40384 - RNA, 64 nt, Human
uucuuacugcuuaugaacuuucaauuuaguagucagaaaccauggauuuauuuuacugcacaau

SEQ ID NO: 40385 - RNA, 62 nt, Human
uuuguuuagcccaaaaguaaucgcucuggaguagaaaccaaaugugaauagccacaucuuac

SEQ ID NO: 40386 - RNA, 64 nt, Human
agaagcuuuacuuuuccacuuuuuuuuaaaaaaaagaaaccaacaauuuaaauuauauugaugu

SEQ ID NO: 40387 - RNA, 64 nt, Human
aggagggcaagaguacaccaauuuguuaaaagcaagaaaccacagugucucuucacuagucauu

SEQ ID NO: 40388 - RNA, 64 nt, Human
gaaagcugacaucuguaaaaggccuucaaggaagagaaaccaggcccugcgucaggcaguguga

SEQ ID NO: 40389 - RNA, 64 nt, Human
cauauggggacuauagugcaaccuauuuggguaaagaaaccauuugcuaaaauggagaaaguaa

SEQ ID NO: 40390 - RNA, 64 nt, Human
cagcacauugcugauuuacacuggaucuugccuuagaaaccauugucugccugccuaaccagcu

SEQ ID NO: 40391 - RNA, 64 nt, Human
auguuuguuaaaaaaacaaacacauguuuugaagagaaaccagaucugaacauguauuuguuga

SEQ ID NO: 40392 - RNA, 64 nt, Human
cugccucuuuccuguuguuguuaaugaaaaugucagaaaccaguuaugugaaugaucucucuga

SEQ ID NO: 40393 - RNA, 64 nt, Human
cccuucugagcguuucugacagcucccagcugggagaaaccaacaugacgaaaagacaaagaau

SEQ ID NO: 40394 - RNA, 64 nt, Human
uggaaugaugguugcacaacuuugugaauauacuagaaaccaaugaauuaaaaacuuuggaaga

SEQ ID NO: 40395 - RNA, 64 nt, Human
uguuuacuacaaaagcaugccaaaccuaggcuccagaaaccacguccaucagcugcauacuuac

SEQ ID NO: 40396 - RNA, 64 nt, Human
gaagaaaaaacugaagguacuuuacucccuauagagaaaccauugccaucauuguagcaagugc

SEQ ID NO: 40397 - RNA, 64 nt, Human
auugcugacauuuuaaaaaaauacaaaauacaaaagaaaccauuagaaauuaauaacuguggcu

SEQ ID NO: 40398 - RNA, 64 nt, Human
aacuuugguuuaccuccauggaaaauaaagauuuagaaaccagguggaaaacauucacuauuaa

SEQ ID NO: 40399 - RNA, 64 nt, Human
uuucgcuuuggauaauauuccucuuggccuugugagaaaccauucuuuccccucaggaguuucu

SEQ ID NO: 40400 - RNA, 64 nt, Human
gaggccaagugaggggcugcccaguucucacaccagaaaccacacauucacucaauaugcagcu

SEQ ID NO: 40401 - RNA, 64 nt, Human
gcaguaauagauaugugauuuuacaucauuuuuaagaaaccaaggggaaguaauaaguugaaaa

SEQ ID NO: 40402 - RNA, 64 nt, Human
cucucauaacguaaugauuauaugacaauccugaagaaaccacagguuccauagaacuaauauc

SEQ ID NO: 40403 - RNA, 64 nt, Human
auucuaguucacuaaugaccagaacuugucaaugagaaaccacuuguuaagaaaaaguccagug

SEQ ID NO: 40404 - RNA, 64 nt, Human
ugaaaucuuaaaaaaauuuaggaaauucaacuuaagaaaccauuauuuacuuggaugaugguga

SEQ ID NO: 40405 - RNA, 64 nt, Human
guugguugacaaaauuggcuguuggcaucaguauagaaaccaacuggcagcuuucccugacaag

SEQ ID NO: 40406 - RNA, 64 nt, Human
aaaaguaaaaauaaaaacaaaaaaguuggaaggcagaaaccauuaaaaaacaaaaagccaacaa

SEQ ID NO: 40407 - RNA, 64 nt, Human
ccuaaggcacaaggaugccaaaaaaacaaaggugagaaaccacaacacaggucuaaacucagca

SEQ ID NO: 40408 - RNA, 64 nt, Human
ccuuagaaagaugagaaagugaaccaaaaaggcuagaaaccagaggaaaaccuggacaaccucu

SEQ ID NO: 40409 - RNA, 64 nt, Human
gagaaagcugcacccuacaggcaaccagcacugcagaaaccacuccaggcaaaguagugaagga

SEQ ID NO: 40410 - RNA, 64 nt, Human
gcuucugguaccaugauccucaacuuagagaggaagaaaccaagacagagagcuuaacucacuu

SEQ ID NO: 40411 - RNA, 64 nt, Human
auaagcauggugguaucuuaaaauggugguuugcagaaaccaugguagccaacagaaccuccug

SEQ ID NO: 40412 - RNA, 64 nt, Human
uuacuuauuugcuagcaaaauucccccuugucacagaaaccagggacucuucaggauuugagau

SEQ ID NO: 40413 - RNA, 64 nt, Human
acuggauugauuguggacuuuuauacuauauugcagaaaccaauaucuguuucuuggugguuau

SEQ ID NO: 40414 - RNA, 64 nt, Human
gaaacaaguauccuuguugaguaccaagugcuacagaaaccauaagauaaaaauacuuucuacc

SEQ ID NO: 40415 - RNA, 64 nt, Human
auugucuucguaaaaguuagaucugacuucagacagaaaccaauaccagcuuccuuuuccuuua

SEQ ID NO: 40416 - RNA, 64 nt, Human
agcugugccggcgcuacgggacccgagccgucccagaaaccaaagggcaggcacggcagcaaac

SEQ ID NO: 40417 - RNA, 64 nt, Human
aaaaacuggcuagugaaaggaaaguaccucugaaagaaaccauuuuagcaaauuaugguuauau

SEQ ID NO: 40418 - RNA, 64 nt, Human
aauacaaccagcauagaaagacccaaaacuauacagaaaccaaaaccagaaugccauguggugg

SEQ ID NO: 40419 - RNA, 64 nt, Human
caccucaggcucaggauucugaaccauugagaucagaaaccagauacuuagccuucuacuguag

SEQ ID NO: 40420 - RNA, 64 nt, Human
cauacuguacuacuugcuuuuacaauguguuagcagaaaccaguggguuauaauguagaaugau

SEQ ID NO: 40421 - RNA, 64 nt, Human
uuaacauauuuuguacaauauuaaaaaaaugcacagaaaccauugggggggauucagaggugca

SEQ ID NO: 40422 - RNA, 64 nt, Human
agaggaggacuugaaugaggaaaccaacacuuugagaaaccaaaguccuuuuucccaaagguuc

SEQ ID NO: 40423 - RNA, 64 nt, Human
uuuuuaaaagacugcugcauccuuaggaaggaucagaaaccaugcugcccguaagagucacaac

SEQ ID NO: 40424 - RNA, 64 nt, Human
gguggcaguugggccuggugaggguuaggacuucagaaaccagagcacaagccccacagagggg

SEQ ID NO: 40425 - RNA, 64 nt, Human
ugggugggaggcaccaaaacuuggcagcugugccagaaaccaaagccaggcccagauguagggg

SEQ ID NO: 40426 - RNA, 64 nt, Human
auuuuucuaauuagaaaaaggcuuggugaggcugagaaaccagcccacaauuacacaaagacaa

SEQ ID NO: 40427 - RNA, 64 nt, Human
auuaaaguuccuaagacccagugacaguacugggagaaaccaaggcugaagagucagguugaag

SEQ ID NO: 40428 - RNA, 64 nt, Human
ucagaagacucacuuuucuuucuuucuuggauagagaaaccauuuucugacacuagguuuacaa

SEQ ID NO: 40429 - RNA, 64 nt, Human
caguuuuacuacauucugguguuuggccuauaugagaaaccaucuucucacagauuaagggcua

SEQ ID NO: 40430 - RNA, 64 nt, Human
cuaauguaauaauagaaaaauacucauaauagggagaaaccaagagaaguuuuguuuuuguuuu

SEQ ID NO: 40431 - RNA, 64 nt, Human
cuaaaaauuguuagaaauuggugggaaaauagguagaaaccaaggaagcagacacaacaugcau

SEQ ID NO: 40432 - RNA, 64 nt, Human
aguucauugcaugcugaagcgacauuguuggucaagaaaccaguuucuggcauagcgcuauuug

SEQ ID NO: 40433 - RNA, 64 nt, Human
auuguacugcuguguuauaugcuauguacaugucagaaaccauuagcauugcaugcagguuuca

SEQ ID NO: 40434 - RNA, 64 nt, Human
agaguuggaguagcacaauugccuguuuuagggcagaaaccaugggcuauguuaauguccuaau

SEQ ID NO: 40435 - RNA, 64 nt, Human
aaagcuaaagaagacuaugauaccauacccaucuagaaaccaagaacuaguuugaaaucguuua

SEQ ID NO: 40436 - RNA, 64 nt, Human
uuguacaugcauucauacaggcagcgauggucucagaaaccaaacaguuugcucuaggggaaga

SEQ ID NO: 40437 - RNA, 64 nt, Human
agagcaggccucagacaccuuuuaauugcuuaggagaaaccauugucucugacugcagguuuga

SEQ ID NO: 40438 - RNA, 64 nt, Human
uaacucuugaagucacacccuccgaaagaugaguagaaaccagcaccagcacagcccagaucuu

SEQ ID NO: 40439 - RNA, 64 nt, Human
uuuuuagaaaaauauaucaaauuauauaauuuccagaaaccauaaauaauggauauaaaacuua

SEQ ID NO: 40440 - RNA, 64 nt, Human
gcucuuccucaaggcaaccugaggccagacaccaagaaaccaagcguaucugcucuaaaaugac

SEQ ID NO: 40441 - RNA, 64 nt, Human
ggugauuauuauuaacucuagauaagcagguacuagaaaccaaaacucagaaaauguuuacugu

SEQ ID NO: 40442 - RNA, 64 nt, Human
uaaaauacguccaguucuuacccaguuaacaugaagaaaccacugucucuagaagaaagcuugu

SEQ ID NO: 40443 - RNA, 64 nt, Human
auagucaucucauccuacucaauuuuucaaaggcagaaaccaacccuggagcaauugagaggac

SEQ ID NO: 40444 - RNA, 64 nt, Human
acauuuuauauggcugaucaauuuucauacauugagaaaccaagucaaucaagcaggaaucauu

SEQ ID NO: 40445 - RNA, 64 nt, Human
caucuauuuaugcaguguucaaaaguacugaauuagaaaccaggaaguuuuaguuccuucuacu

SEQ ID NO: 40446 - RNA, 64 nt, Human
uuacuagucaaauccgucagugaucccgagucccagaaaccaaaggcucuuuucagagccaccc

SEQ ID NO: 40447 - RNA, 64 nt, Human
uaccauuccuaguuucuuuguacuugaaauuuuaagaaaccagaaacaaguaaaucugguugua

SEQ ID NO: 40448 - RNA, 64 nt, Human
auugaugaucacauucugcccuuuacuacaggacagaaaccacuuaguuuuuaauaaguggcuc

SEQ ID NO: 40449 - RNA, 64 nt, Human
guuuauuuuguuauguuggauaaauacuguuaaaagaaaccagucaguaacuauauuguuaauc

SEQ ID NO: 40450 - RNA, 64 nt, Human
ccacguuacugccuuuuuuaaaaauauauuugacagaaaccaggugccuucagaggcucucuga

SEQ ID NO: 40451 - RNA, 64 nt, Human
ucauuuaguaauguaccuugaguuaaaaagccugagaaaccaaacacagcuaaugcuauggggu

SEQ ID NO: 40452 - RNA, 64 nt, Human
augguuuaaucagucuaauuguuuugacuguuauagaaaccaaauauuuuacuguuucuuuuaa

SEQ ID NO: 40453 - RNA, 64 nt, Human
ugcacacauuuaacgacagaagguugccagguaaagaaaccauggcauaaagcugggaggccaa

SEQ ID NO: 40454 - RNA, 64 nt, Human
cuuuggggcagagacuuggcaucuucgcaguuuaagaaaccacguuuccuauccaauccgaagg

SEQ ID NO: 40455 - RNA, 64 nt, Human
ccugaccuacccauaacucccugcuaggcuaaguagaaaccagguuauuucucccugcuuaugg

SEQ ID NO: 40456 - RNA, 64 nt, Human
uuugggaauuaaacaggucacacgugacagaugaagaaaccaagggggcugcugaggagaccug

SEQ ID NO: 40457 - RNA, 64 nt, Human
aacauucauaaauggugggggcccuuacugugguagaaaccauugucacugcaaggcagcccug

SEQ ID NO: 40458 - RNA, 64 nt, Human
cucaguguaaacagccaaacaagcuuaaccaauuagaaaccaccaucuaaccucuaacuagguc

SEQ ID NO: 40459 - RNA, 64 nt, Human
gaucaucacaaauccuuuaaaacaauuaccuaaaagaaaccaaaaauccugccuucuuuguggg

SEQ ID NO: 40460 - RNA, 64 nt, Human
ucagggcgaaaagaaaaaaauaauacuauuaauaagaaaccaacaaacaagaaccucucuuucu

SEQ ID NO: 40461 - RNA, 64 nt, Human
uuauuacuggccguaaggcagaguuaauccauacagaaaccaguguguccaugugcucugcaca

SEQ ID NO: 40462 - RNA, 64 nt, Human
uucaaauucugggaaaccaguuccaaacauuugcagaaaccauuaagcaguuacauauuuaggu

SEQ ID NO: 40463 - RNA, 64 nt, Human
uuuggaauacuggucaucuuucugacaucacaguagaaaccaaaccuuggauuuagauucaaaa

SEQ ID NO: 40464 - RNA, 64 nt, Human
agaaaaccucaagggcuuucccacguugacaccaagaaaccacugggcauaaugcuuccccacg

SEQ ID NO: 40465 - RNA, 64 nt, Human
caauaaaauuguaauauaauaaauuuggcugacaagaaaccaaagugauucuuaauuaguauac

SEQ ID NO: 40466 - RNA, 64 nt, Human
aacucuuuacaagcuaagaagagagggccucagaagaaaccaacccugccaacaccuugaucuu

SEQ ID NO: 40467 - RNA, 64 nt, Human
uggauugggguuuaagguagggggaguaaaaacaagaaaccauccacucuguauauuauauaag

SEQ ID NO: 40468 - RNA, 64 nt, Human
guaaauacuguauccuaauauccagucaggauacagaaaccauaccauuaacuugaacagggau

SEQ ID NO: 40469 - RNA, 64 nt, Human
aaguaguaauguucagaaacugauuauuuggaucagaaaccauugaaacugcuucaagaauugu

SEQ ID NO: 40470 - RNA, 64 nt, Human
gcuccaccacugugcacuuagccaugauggcaacagaaaccaagagacacaauuacgcagguau

SEQ ID NO: 40471 - RNA, 64 nt, Human
augggguccuucuaggaguccuuggagaaaaguaagaaaccaggaguguuuccaguuccacccu

SEQ ID NO: 40472 - RNA, 64 nt, Human
uucuuuuugaaucucucaaacggcaacauuccucagaaaccaaagcuuuauuucaaaucucuuc

SEQ ID NO: 40473 - RNA, 64 nt, Human
aacccaccagaaucuaagcaguuuucacccccucagaaaccacugucauuaguuuacaaaguua

SEQ ID NO: 40474 - RNA, 64 nt, Human
gaugaguguuuugaaaaauguuuaguguucaaauagaaaccauucgugucccuucacucucuga

SEQ ID NO: 40475 - RNA, 64 nt, Human
aguccuuaucaaagagagauguggaaagagcuaaagaaaccacccuuuguucccaacuccacuu

SEQ ID NO: 40476 - RNA, 64 nt, Human
uugugaaugucuuucauuuaacuaaaauuauauuagaaaccagauugauaaauaaaaaauucaa

SEQ ID NO: 40477 - RNA, 64 nt, Human
aggagaaacucuuggccuaucaagugcuccugagagaaaccaugcaauuuaacacuucaguuaa

SEQ ID NO: 40478 - RNA, 64 nt, Human
agccacccacugcccaacccaacggcaaagacacagaaaccagguccccuugcagacggcucuc

SEQ ID NO: 40479 - RNA, 64 nt, Human
augcuuugcugagaaguuaggucugugguagaccagaaaccacaaauugacuuuuuuucuuaga

SEQ ID NO: 40480 - RNA, 64 nt, Human
ggcauggaggagggaggcgugggaugggaauagcagaaaccaaccaugucuucagugauugaaa

SEQ ID NO: 40481 - RNA, 64 nt, Human
ccuuuauugagauaaguuuuccugucaagaaagcagaaaccaucucauuucuaacagcuguguu

SEQ ID NO: 40482 - RNA, 62 nt, Human
ucaaauaaaccucauguacuuguguuuauaaagaagaaaccacucugguggcuguuugugcu

SEQ ID NO: 40483 - RNA, 64 nt, Human
auuuuccccauuuuucucuuucuuguagaaggagagaaaccaugcucucuagcaacauugagca

SEQ ID NO: 40484 - RNA, 64 nt, Human
aggguugauaaaaguucuugaucaaaaaguucaaagaaaccagaauuuuagacagcaagcuaaa

SEQ ID NO: 40485 - RNA, 64 nt, Human
cuauuuggaauaaccgauucccacaguuuugguaagaaaccagccccaguaaucaguaagucag

SEQ ID NO: 40486 - RNA, 64 nt, Human
aauauucucauuauuaacuuccucuauuucacacagaaaccaaggacaacaagauacaaauacc

SEQ ID NO: 40487 - RNA, 64 nt, Human
aguaaagaaaaaagaaaaaaaaggaagacuaaacagaaaccagaacugaaacauucaccuggua

SEQ ID NO: 40488 - RNA, 64 nt, Human
cugcguucccaucgucagacaacuuuggaguauuagaaaccacuguauauauguggaaagccag

SEQ ID NO: 40489 - RNA, 64 nt, Human
uaaacugugguuuccccaagcugcacaggaggccagaaaccacaaguaugaugacuaggaagcc

SEQ ID NO: 40490 - RNA, 64 nt, Human
auuuauaaaaucuuaaguuuuggaagucuaaaggagaaaccauuccaguaugcauauuuuuuuc

SEQ ID NO: 40491 - RNA, 64 nt, Human
cugcacgcacugcguagagccuggaagggaagugagaaaccagccgaccggcccugccccucuu

SEQ ID NO: 40492 - RNA, 64 nt, Human
aacacugcguuccagucaccccggucuugccagaagaaaccagcaccucuuucccguggcuccu

SEQ ID NO: 40493 - RNA, 64 nt, Human
auuugggagagaguuuaaaaauacauuaggagagagaaaccauuaaaaguuucacugucagaua

SEQ ID NO: 40494 - RNA, 64 nt, Human
cagaagacuuauuuuugugagcaguuugccauucagaaaccauugagcaaaauaagucuauaga

SEQ ID NO: 40495 - RNA, 62 nt, Human
ccccagcuggagaagaaugaaaagaacucccaagaaaccaggcaggcagaagcuccugaaug

SEQ ID NO: 40496 - RNA, 64 nt, Human
guuguugccaacaggguccuuuuaggcagaacccagaaaccagucaaaucuguagagaagcagu

SEQ ID NO: 40497 - RNA, 64 nt, Human
aagcagugaguguaaaauuguuguagcuugaauaagaaaccacuuuuguaguuuuaaccagacu

SEQ ID NO: 40498 - RNA, 64 nt, Human
uacauaguucaauuuuuaugucucuuuuguuaacagaaaccacuuuuaaaggauaguaauuauu

SEQ ID NO: 40499 - RNA, 61 nt, Human
acagacucugcugucgcugagcuuccuagauagaaaccaaagcagugcaagauucaguuca

SEQ ID NO: 40500 - RNA, 64 nt, Human
uguugcguaucaaauacagaugaagaaggaaaagagaaaccagagauggauggcagaucuggga

SEQ ID NO: 40501 - RNA, 64 nt, Human
cugaucucuacuaccacaaggaaaauaguuuaggagaaaccagcuuuuacuguuuuugaaaaau

SEQ ID NO: 40502 - RNA, 64 nt, Human
cacgcauuggcauccaaggccacggacuaugagaagaaaccaaacguguuuaaacuuaaaacug

SEQ ID NO: 40503 - RNA, 64 nt, Human
ucagacuggugauaucgugauguaccuaaaagucagaaaccacauuuucuccucagaaguaggg

SEQ ID NO: 40504 - RNA, 64 nt, Human
acauuaaguaaaauaaaauggaccagaaaagaaaagaaaccauaaauaucgugucauauuuucc

SEQ ID NO: 40505 - RNA, 64 nt, Human
uauaagguauuuaaaaucuauuuaugcuuuauagagaaaccagacauuaaaacuucaugcacua

SEQ ID NO: 40506 - RNA, 64 nt, Human
uuucauuccuuuuuuaaaaaauaauauaagcuacagaaaccagguaagcccuuuauuuccuuaa

SEQ ID NO: 40507 - RNA, 64 nt, Human
acagugaguuggucaaaugcuccugacaguguggagaaaccaacaggcaaaacgugggugcaaa

SEQ ID NO: 40508 - RNA, 64 nt, Human
aauuaguccaaauggaaccccuugaaggauaaugagaaaccacaaggccugccucugacugggg

SEQ ID NO: 40509 - RNA, 64 nt, Human
auuuccucucuguuuuuaacuauucuggagaccaagaaaccacuaggaauugaaggaauauuug

SEQ ID NO: 40510 - RNA, 64 nt, Human
acuuaagaucccacaccucacaaaccuacagcccagaaaccagaagccccuauagaggccccag

SEQ ID NO: 40511 - RNA, 64 nt, Human
auuccaccuauaauucugucuugcugguguggauagaaaccaggcaggacaguagaucccuaug

SEQ ID NO: 40512 - RNA, 64 nt, Human
ucuugggugggcccugaacaaagccaaaaauuguagaaaccagucuagaaaaaguccugcucau

SEQ ID NO: 40513 - RNA, 64 nt, Human
uuguccacagauguacuggccauuacaugaaacaagaaaccaagcaucuuugcuguuguuaauu

SEQ ID NO: 40514 - RNA, 64 nt, Human
uuuauucaauauaaacauuugcuauuuucugcuuagaaaccacacccugaagacgugcugucua

SEQ ID NO: 40515 - RNA, 64 nt, Human
aacccaggaagcgucuuuggugcuugggagaccaagaaaccaagaaauuaacaacugaaagcau

SEQ ID NO: 40516 - RNA, 64 nt, Human
gccacucugcccucuggaccugucuuucaucgggagaaaccacucagagauggaucccauuccc

SEQ ID NO: 40517 - RNA, 64 nt, Human
gccaucaaaacacauacacccagaaagaaacaacagaaaccaaaacucacaaggcgcaugauua

SEQ ID NO: 40518 - RNA, 64 nt, Human
gugggcacuaagcuaugggagagaccauagcugcagaaaccaacccugcccuaggcauaaaaug

SEQ ID NO: 40519 - RNA, 64 nt, Human
gcccccaugccccugcccaacaugcuggggguccagaaaccaccucggggugacugagcggaag

SEQ ID NO: 40520 - RNA, 64 nt, Human
uaggacguguaccucuguguguucauggagcuggagaaaccaaaacugggucucucuccacccg

SEQ ID NO: 40521 - RNA, 64 nt, Human
cacccaaacacuagaugugugugugcacacacacagaaaccacgagguaguuuaaaucaccauu

SEQ ID NO: 40522 - RNA, 64 nt, Human
acccucacugugaaucagagaauucacauaggaaagaaaccagaugaagaugaaugcaggaaga

SEQ ID NO: 40523 - RNA, 64 nt, Human
ccuaccauauacuuuuguauuuaauagauuacuuagaaaccacaaaaauaggaauccuuacccc

SEQ ID NO: 40524 - RNA, 64 nt, Human
ccacaccugcaauguaaaauggaagaaaaugcaaagaaaccaaaugugccgagugaauaaagga

SEQ ID NO: 40525 - RNA, 64 nt, Human
gggggugcuauuuaggggaacaaggggauucaggagaaaccaggcagcaggggaugaaauacau

SEQ ID NO: 40526 - RNA, 64 nt, Human
uggaagccaucccuuuuuuuacauuucauacaacagaaaccagaaaagcaauacuguuuccauu

SEQ ID NO: 40527 - RNA, 64 nt, Human
caaauuuaguucucuaaaacuugaaaaaaaaaaaagaaaccaguucugugaaaacgguaccuca

SEQ ID NO: 40528 - RNA, 64 nt, Human
ccuuccggagcagcucagucagcccucggggacgagaaaccacaagcgcagagacgcugaggcc

SEQ ID NO: 40529 - RNA, 64 nt, Human
agcacaggcaaugccagugccaugcugcagccucagaaaccaggccucucacuccagcagcagg

SEQ ID NO: 40530 - RNA, 64 nt, Human
aaccugggggucaggggaaggcaugggggggaccagaaaccagaagaacaaucaagacugcaau

SEQ ID NO: 40531 - RNA, 64 nt, Human
gcuguacccaaaucaagaaagacaaaauaacaauagaaaccauucacacacuccguucaugcau

SEQ ID NO: 40532 - RNA, 64 nt, Human
gcaagggcagugcguggaaaggccggggaggugcagaaaccagagcccagggcaauggugucug

SEQ ID NO: 40533 - RNA, 64 nt, Human
cacacccaccagugcagccugaaguaacucccacagaaaccaucaucgucuuuguacaucguau

SEQ ID NO: 40534 - RNA, 64 nt, Human
uuuauaugcauuaauuuaagagcaucuacuuagaagaaaccaaauagucuaucgcccucauauc

SEQ ID NO: 40535 - RNA, 64 nt, Human
ccauacuuuauauauguacauacauucauacuguagaaaccagcucauguguaccucauauccc

SEQ ID NO: 40536 - RNA, 64 nt, Human
guaaagaaugagaauggauucuguacaauacacuagaaaccaacauaauguauuucuuuaaaac

SEQ ID NO: 40537 - RNA, 64 nt, Human
guuaccacuuauaagcacaaaagaaacauguauaagaaaccagauuuaaguguuuuaaauaaaa

SEQ ID NO: 40538 - RNA, 64 nt, Human
ucaccagaacacaaugcuaccgccccaaaguaaaagaaaccacuucuggucaaucaacacuacc

SEQ ID NO: 40539 - RNA, 64 nt, Human
ugauauguauccaucaggauccagucuggaaaacagaaaccauucuagguguuucaacagaggg

SEQ ID NO: 40540 - RNA, 64 nt, Human
ucguacuccccaaugguggauuuauuacuauuaaagaaaccagggaaaauauuaauuuuaauau

SEQ ID NO: 40541 - RNA, 64 nt, Human
augaagagaaaagccaugcccaccccagccccagagaaaccaauaagaauccucuauuauuuuc

SEQ ID NO: 40542 - RNA, 64 nt, Human
acccguucgcccccaugugacuuuuaucuguagcagaaaccaagucuacuucacuaaugacgau

SEQ ID NO: 40543 - RNA, 64 nt, Human
caacuucaggcuaaagggaggggauguugggaggagaaaccaucacaagauucccucggugcca

SEQ ID NO: 40544 - RNA, 64 nt, Human
acuguggugccaaauugcuggugucucucuuuggagaaaccaaccagauacaucugcuggagag

SEQ ID NO: 40545 - RNA, 64 nt, Human
uugaaugucaaaccaaacuuaacauucuuguaauagaaaccagcaggguguguacacuuuugug

SEQ ID NO: 40546 - RNA, 64 nt, Human
uggccugaagaggaagagaaaaaaaacaaaaaacagaaaccaaucgguaaucugauccaccacu

SEQ ID NO: 40547 - RNA, 64 nt, Human
agcugugauacagggugaaauaaagucuugucuuagaaaccaggacccuaaaccccacacuaug

SEQ ID NO: 40548 - RNA, 64 nt, Human
uguggaacuaggaggaggaauauuccaucuuggcagaaaccacagcauugguuuuuuucuacuu

SEQ ID NO: 40549 - RNA, 64 nt, Human
gcggaggcuccgcaucgccucucuccuaggauacagaaaccauggcaacgaaaguagaauguaa

SEQ ID NO: 40550 - RNA, 64 nt, Human
gccaagcugacuguaaauuucacagucucucugaagaaaccauugugcuucugagacccuagcc

SEQ ID NO: 40551 - RNA, 64 nt, Human
uauuuuaguuuuauuuuugaaaccaagcaucuauagaaaccaagaaagucagcauguaagcguc

SEQ ID NO: 40552 - RNA, 64 nt, Human
agggccagaaagucauuccuuccaucuuccuugcagaaaccacgagaacaaagccaguucccug

SEQ ID NO: 40553 - RNA, 64 nt, Human
uguguaaagauaauaugaagaaccagcuuccaaaagaaaccagcauauggcacuauaaacuauu

SEQ ID NO: 40554 - RNA, 64 nt, Human
uuauauauaacuaugcuaauuguucauaaucaacagaaaccaagauagagcuacaaacucagcu

SEQ ID NO: 40555 - RNA, 64 nt, Human
gggugcauggacucguaaagcugcuagggccccuagaaaccaccuggguucagccucucccaca

SEQ ID NO: 40556 - RNA, 64 nt, Human
caaacuuaaucuucaucuuuaaaaaaaagaaaaaagaaaccaaaaugagaaucaacacuucaua

SEQ ID NO: 40557 - RNA, 64 nt, Human
aaaacuguccccauuuggaaugcccauuccuucuagaaaccaguuggacagugcuccucugccc

SEQ ID NO: 40558 - RNA, 64 nt, Human
acagacuauggccagaacucaucuguugauugcuagaaaccacuuuucuuucuuguguugucuu

SEQ ID NO: 40559 - RNA, 64 nt, Human
agaccuuuggcucacagaacugcaggguauggugagaaaccaacuacggauugcugcaaaccac

SEQ ID NO: 40560 - RNA, 64 nt, Human
guccuacuacgcccuccccuccccagccuuuuccagaaaccauacugggcucagaucagagcuc

SEQ ID NO: 40561 - RNA, 64 nt, Human
cuaacguccuacuccucacacugcucuacugcucagaaaccaccaagacuguugaugccuuagc

SEQ ID NO: 40562 - RNA, 64 nt, Human
auuuaaauggaaaccaggggaguuuuaaagcccgagaaaccacacauaaucuuuuguugagaug

SEQ ID NO: 40563 - RNA, 64 nt, Human
cccccagaucaugcuuuaauucuuucuuuucuguagaaaccaacaguuuccauuuaugucaaug

SEQ ID NO: 40564 - RNA, 64 nt, Human
uguauuagucuaggcugaucuuuuagggcacaauagaaaccauggggcguggagcaugaguugu

SEQ ID NO: 40565 - RNA, 64 nt, Human
uccgucuucacccauccccaagccuacuagagcaagaaaccaguuguaauauaaaaugcacugc

SEQ ID NO: 40566 - RNA, 64 nt, Human
ugcuagcugugcagaacccaauugcccuuugcacagaaaccaaccccugacccagcgguaccgg

SEQ ID NO: 40567 - RNA, 64 nt, Human
cccauggugauagccugaaagagcuuuccucacuagaaaccaaaugguguaaauauuuuauuug

SEQ ID NO: 40568 - RNA, 53 nt, Human
caugugaugaacacccauaguuaagaaaccauggagcaagaaagcuuguggaa

SEQ ID NO: 40569 - RNA, 64 nt, Human
auguuauuauuauuaaauuuauguuuugcaacuuagaaaccagcuacaguauggcccacuuaau

SEQ ID NO: 40570 - RNA, 64 nt, Human
uauggagcucuggacuccuaaauuccccugaagaagaaaccaauguacuguggucucuugggac

SEQ ID NO: 40571 - RNA, 64 nt, Human
cuuacaacgccccuggcccccagguugagcaauaagaaaccagaaccuugcggcccaguggccc

SEQ ID NO: 40572 - RNA, 64 nt, Human
acguuuguagguucuuacuggaccagaggagucaagaaaccaagaugguuugggguauggggug

SEQ ID NO: 40573 - RNA, 64 nt, Human
acaaaguucaaaaguagaaauaccaaaauagagcagaaaccaagcuaagaguguguuucugugu

SEQ ID NO: 40574 - RNA, 64 nt, Human
aauaggggccugaggagagaggggaaggguacagagaaaccaucuacauuccauggaauguuuu

SEQ ID NO: 40575 - RNA, 64 nt, Human
auuauuuguguuaucuuuauuucucuucauuguuagaaaccaaagucuucucugcuggcugggg

SEQ ID NO: 40576 - RNA, 64 nt, Human
cugccuccauuauccauucccaagaugccugaucagaaaccaaccaugaaugaaccccuggcuc

SEQ ID NO: 40577 - RNA, 64 nt, Human
cauaugugugcauugccacucucccaaguuuuucagaaaccagcagagcugucaacucuucuca

SEQ ID NO: 40578 - RNA, 64 nt, Human
cugcuuggcucaaacuguagucuuuccgggcacaagaaaccagaguccugcccagccugcccau

SEQ ID NO: 40579 - RNA, 64 nt, Human
cuacagcaaacgggugucuuucgacucugcuuguagaaaccauuugcacauauucuguacgagc

SEQ ID NO: 40580 - RNA, 64 nt, Human
uccuggguucccuaggcccuagugagggcagaagagaaaccauccucucccuucuuacaccgug

SEQ ID NO: 40581 - RNA, 64 nt, Human
caccaccuuucauguuuuugauugcccuacaaagagaaaccaaaugagcugauuacugacuaua

SEQ ID NO: 40582 - RNA, 64 nt, Human
uuuggacuaauguuacuguccaaguucuuucucaagaaaccacaucugguucagaagaguguca

SEQ ID NO: 40583 - RNA, 64 nt, Human
cacuuggccucacuaccagaagaaggguggagucagaaaccaaagugaccuccagagcuguccu

SEQ ID NO: 40584 - RNA, 64 nt, Human
agagcaaauauuguucuucccauuuuacagauucagaaaccaaggcuaagggacuggucuaaag

SEQ ID NO: 40585 - RNA, 64 nt, Human
cccauuccuccaacccauucucucccuaaucccuagaaaccaccaaucugcuguguauuucauc

SEQ ID NO: 40586 - RNA, 64 nt, Human
ugacuauccugaacaggguggaggggugugggaaagaaaccagccauauugguuuugguuucug

SEQ ID NO: 40587 - RNA, 64 nt, Human
uauugcacauuagagaauugguccuggaagggaaagaaaccacagauuuuauuucaguacacaa

SEQ ID NO: 40588 - RNA, 64 nt, Human
uuuaguaguguuugguauguuuuaugugucugguagaaaccauauuuugguuaacagcaagaaa

SEQ ID NO: 40589 - RNA, 64 nt, Human
acccagaacaggacuccacacagcguuugccaccagaaaccacaagcaaaaucuggaucuuggg

SEQ ID NO: 40590 - RNA, 64 nt, Human
gugugugugugugugcacaauaaauaggaaauguagaaaccaagcaagaaggcuuaguagcuca

SEQ ID NO: 40591 - RNA, 64 nt, Human
ccgagcuugucagcuuuuuugaaaacacaucaguagaaaccaagauuuuaaaaugaagugucaa

SEQ ID NO: 40592 - RNA, 64 nt, Human
uuaaauuauuuuaaaaaaauaaauacugucugugagaaaccagcugguuuagaaaaguuuagua

SEQ ID NO: 40593 - RNA, 64 nt, Human
aaagaguuuuauguuguauuuagaauuucaaccuagaaaccacacaguacuuaaauucuccugg

SEQ ID NO: 40594 - RNA, 64 nt, Human
uuucuggugggauauuaaggcccuggugucuuacagaaaccaucacguaugucgcagcagcauu

SEQ ID NO: 40595 - RNA, 64 nt, Human
cgggcauaaccuuggauaccacucucucagccacagaaaccacguuugaauacugacugcucac

SEQ ID NO: 40596 - RNA, 64 nt, Human
gcucuucacccaggucuccucuuccucucccugaagaaaccaucaugagagagauacucuggug

SEQ ID NO: 40597 - RNA, 64 nt, Human
uuuugcuucccucccaucagucugguugacaggaagaaaccacaccaucaacaccaacaaguuu

SEQ ID NO: 40598 - RNA, 64 nt, Human
aaugaaaguugaccauaguuauuuccaaauaaaaagaaaccaacucuuaccaggucuuggacug

SEQ ID NO: 40599 - RNA, 64 nt, Human
uccagcucuaguucagcuauaauuccuuuuauagagaaaccaaccugauacacacuuucaugau

SEQ ID NO: 40600 - RNA, 64 nt, Human
cucaaugauacugaaagcuuugcaccucuuugguagaaaccaggucuauuuagaaaauggcuuu

SEQ ID NO: 40601 - RNA, 64 nt, Human
aggcaagacacagucaccaaugauaucucgccaaagaaaccacgcccacaccaaugccaacaca

SEQ ID NO: 40602 - RNA, 64 nt, Human
aucagaauugcgucugugggaacaggaauaaaggagaaaccacuauugacugggaagacacaca

SEQ ID NO: 40603 - RNA, 64 nt, Human
aauguucugauuacaucacugauugguaaugguuagaaaccauuaaccuaaaacuuacuauuua

SEQ ID NO: 40604 - RNA, 64 nt, Human
uuaaugucuuaaguaagugcuuaauuuggaauagagaaaccaguauauuuuaaaaaagaaaaau

SEQ ID NO: 40605 - RNA, 64 nt, Human
ucuuuugauacaacauuuaaaacaaguagcuucaagaaaccacugguguuuugaggauaguauu

SEQ ID NO: 40606 - RNA, 64 nt, Human
cucaccuaggauuggcuauucugagggauugcauagaaaccaagcuccacuugcuguccuuggg

SEQ ID NO: 40607 - RNA, 64 nt, Human
gcccucaauaugcagugguugaauaaaugaaugaagaaaccacuaucaauuucugccuuguuaa

SEQ ID NO: 40608 - RNA, 64 nt, Human
augugcccauuuaagauauuugcauauacuugauagaaaccauaaaguuguagcaguuaagucc

SEQ ID NO: 40609 - RNA, 64 nt, Human
caacuauuguacaaauuaaaaauaaccauaagggagaaaccagaagaauuccucugaccacuua

SEQ ID NO: 40610 - RNA, 64 nt, Human
agcuaaaaauacagagggugacguagaaacacgcagaaaccauucuaaagaaaguagugaucuu

SEQ ID NO: 40611 - RNA, 64 nt, Human
aggaaaauacaaaaacagcugauuuguuuuaguaagaaaccacgucuugaugcuucagaguugg

SEQ ID NO: 40612 - RNA, 64 nt, Human
ccgggaggcaccccacccuccccaccagugcaacagaaaccaccugcguccacacccucacugc

SEQ ID NO: 40613 - RNA, 64 nt, Human
ccaggggaaaaguuaacaaguuaucuuucguagcagaaaccauuuugcugccacaaaauuuuca

SEQ ID NO: 40614 - RNA, 64 nt, Human
agugguuacccagacuuacagaauuauguccuccagaaaccagcaagaacacuuggaaugaacg

SEQ ID NO: 40615 - RNA, 64 nt, Human
ucauaaugaauuacagucaugacaggcacauguaagaaaccaaaauuugcuaaauauguacaug

SEQ ID NO: 40616 - RNA, 64 nt, Human
gccacccuaggucaucagagcuaaaggggcucccagaaaccacugggcagcaucugccuucucu

SEQ ID NO: 40617 - RNA, 64 nt, Human
uaaaggagaaguggggcagcugcaggacauguagagaaaccaaacugggaaaucuuacaaggag

SEQ ID NO: 40618 - RNA, 64 nt, Human
gaaagaugaaccaacuuaguaacuguuuaaacaaagaaaccacauuuuuaaaauuaccuugugg

SEQ ID NO: 40619 - RNA, 64 nt, Human
uugaacacccaaacuacgucaucuguuccaaugaagaaaccaaaccaccaucuuuuauaaauug

SEQ ID NO: 40620 - RNA, 64 nt, Human
acugccuacugugacuucaugcccuuuugggauaagaaaccacaaaacgcauggaacaacuauc

SEQ ID NO: 40621 - RNA, 64 nt, Human
aauuaagaccaccuagauugcgagagcugaauuuagaaaccagacaacgucaugcagcccagaa

SEQ ID NO: 40622 - RNA, 64 nt, Human
ucuccccaccaccccuccugccccacuuuggcccagaaaccaaaugugaacuuccugucuccca

SEQ ID NO: 40623 - RNA, 64 nt, Human
uggcaauuuaacgagccacuuccaugaucuccaaagaaaccaaaauacaaacacaauauuuaau

SEQ ID NO: 40624 - RNA, 64 nt, Human
ugauucucaagccagagacaaucuagcacuuuaaagaaaccaugaacacuauauguauguacuu

SEQ ID NO: 40625 - RNA, 64 nt, Human
uucauugccucacaggcccugagccucccgaaggagaaaccauugucuucccaggcuugccccu

SEQ ID NO: 40626 - RNA, 64 nt, Human
uaucaggaagccauuuuuuauuucaggaaauguaagaaaccauuauuucagguuaugaaaguau

SEQ ID NO: 40627 - RNA, 64 nt, Human
gaaacuauagagcgucauuuauacguaguuuggcagaaaccacuuacggcugaugaugcgcaac

SEQ ID NO: 40628 - RNA, 64 nt, Human
aaacucccaaagcgcaugauugcugggaaacaguagaaaccagacuugccuugaaaguguuuaa

SEQ ID NO: 40629 - RNA, 64 nt, Human
caaacaucaguguccuucuagcuuuagccgagaaagaaaccagucccagggaaugaaugguggu

SEQ ID NO: 40630 - RNA, 64 nt, Human
cauuuucauagauccuugguuuagucugugaaaaagaaaccaucucucuggauaggcugucaca

SEQ ID NO: 40631 - RNA, 64 nt, Human
aagaaacacccuaaucuagauaaaggucuguuucagaaaccaacagugauggcauucuaaagag

SEQ ID NO: 40632 - RNA, 64 nt, Human
acacuuaacuuccccuacccugccccuccccaaaagaaaccaugacaaaccuagcuuuuaaaaa

SEQ ID NO: 40633 - RNA, 64 nt, Human
agaaaacggcacaccaaucaauaaagaacugagcagaaaccaacagugugcuuuuaauaaagga

SEQ ID NO: 40634 - RNA, 64 nt, Human
caucacugcuccuuauaauaaaccuaauaaagcaagaaaccaagccuaucugggucucuuauuu

SEQ ID NO: 40635 - RNA, 64 nt, Human
guugacucuggcauuuaguggcuuugugaaggaaagaaaccauuaaaugaccugacaaaaacug

SEQ ID NO: 40636 - RNA, 64 nt, Human
uauaaacuauuuaaaucaaaauauucuuacauauagaaaccaaguaagaauaaaugagagauau

SEQ ID NO: 40637 - RNA, 64 nt, Human
gauuuauaaaugcacuguaauauguacacaacuuagaaaccaaauuacaaguauucaguuccaa

SEQ ID NO: 40638 - RNA, 64 nt, Human
uuuuaaauaaaacuucuuuuggauagaaaucauuagaaaccaagcauacugcacucuaauauuu

SEQ ID NO: 40639 - RNA, 64 nt, Human
auuugaagaaaaaaaagcguuauuuauaguccaaagaaaccaaagacuuagcucaccugcauuc

SEQ ID NO: 40640 - RNA, 64 nt, Human
cugagcuguagcauuugggcuggccugccuuaucagaaaccaagcuuaugaagaucuucuccca

SEQ ID NO: 40641 - RNA, 64 nt, Human
gaccuaacuaccauaaugaaugcugcauauuaagagaaaccacaagaagguuauauguuugguu

SEQ ID NO: 40642 - RNA, 64 nt, Human
cauuagcaaauuaaaucaucuucaaucuuaaauuagaaaccagaaugaucuucaggauaaaaag

SEQ ID NO: 40643 - RNA, 64 nt, Human
uuugcggauguucccuggagaggucgcuuugugaagaaaccaucagcaggcugugagcaucgcc

SEQ ID NO: 40644 - RNA, 64 nt, Human
ccaucaacgcacaccugcuaucguggaacagccuagaaaccaagggacuccaccaccaagucac

SEQ ID NO: 40645 - RNA, 64 nt, Human
ccgccagcugauuggaugucuaggaaugacugaaagaaaccaaaacagccuguccacugcugcu

SEQ ID NO: 40646 - RNA, 64 nt, Human
cuuccgccccuggcagggacuucuggguuaugggagaaaccagagaugggaaugaggaaaauau

SEQ ID NO: 40647 - RNA, 64 nt, Human
agcaacggcuauuaaaugucacaauccuuuaauuagaaaccauuuauuggccggacgcgguggc

SEQ ID NO: 40648 - RNA, 64 nt, Human
agcgagacuccgucucaaaaaaaaaaaaaaaaaaagaaaccauuuauuuuaaaaaugauuagau

SEQ ID NO: 40649 - RNA, 64 nt, Human
cugcaucaauaccaaacauggggguuugguaaugagaaaccaggacaggccaucugcagugacc

SEQ ID NO: 40650 - RNA, 64 nt, Human
ccuugcccuggggccgguucuuacccagguccagagaaaccaacgcgggaugucagacuucacc

SEQ ID NO: 40651 - RNA, 64 nt, Human
aucuauaaaacaaacauaguaucugucaaucucuagaaaccacaagaugauggagaggucauaa

SEQ ID NO: 40652 - RNA, 64 nt, Human
guggccgucugcaagccgaggagggggccucaggagaaaccaacccugcaaucaccuugaucuu

SEQ ID NO: 40653 - RNA, 64 nt, Human
uccacucaccuuaccccauagcaucuugcggcccagaaaccagagccauuugucucagacccua

SEQ ID NO: 40654 - RNA, 64 nt, Human
gggggucuucuguuucacuaacaggaacaaagacagaaaccaugacagggcugccccgccaggc

SEQ ID NO: 40655 - RNA, 64 nt, Human
uugugacagucacugcauuugccugcuucuuuccagaaaccaaacuaggagaugaaacugguuc

SEQ ID NO: 40656 - RNA, 64 nt, Human
caugucuguuaccaaaauauuguguaacacagacagaaaccaccuguuuuugucuuuccuuguu

SEQ ID NO: 40657 - RNA, 64 nt, Human
gacagaucugggcuccaagccaggaaaggugaacagaaaccacaaguguccagcccucggugcu

SEQ ID NO: 40658 - RNA, 64 nt, Human
gaaaucacugagaaaugucuuuaguucagugagaagaaaccagaacacuuguuccuaguguugu

SEQ ID NO: 40659 - RNA, 64 nt, Human
ugcacagcucugagagaauggaugcuuucuguugagaaaccaguaccuuguggaggcagguucu

SEQ ID NO: 40660 - RNA, 64 nt, Human
uaaauuguauauuuugaaaaauaaaacacugaaaagaaaccaacaaaaaugaguuguucaucag

SEQ ID NO: 40661 - RNA, 64 nt, Human
cccugggacauucuucaauuccacaucuguuucuagaaaccagcccuuuuuccccccacuuuug

SEQ ID NO: 40662 - RNA, 64 nt, Human
gggugaagggucaccacagacacuuagaacgguaagaaaccaugagcacucacaauucuguaga

SEQ ID NO: 40663 - RNA, 64 nt, Human
ccucaccuacuuucagcuucaaccccaggcccucagaaaccagagccaugagaccuaccauacc

SEQ ID NO: 40664 - RNA, 64 nt, Human
ucacuagcacagagguuccuuaauuuggggccuuagaaaccauugugggccuugggguccauga

SEQ ID NO: 40665 - RNA, 64 nt, Human
acauccaggcaagaacuaauucaaaaggcagaucagaaaccacaggagucaaaauuauugcucc

SEQ ID NO: 40666 - RNA, 64 nt, Human
gugaauaagagugaagcaaaauuacaccuuuaugagaaaccauaaaauuguuuuuauuuuucag

SEQ ID NO: 40667 - RNA, 64 nt, Human
uaauuagugcaaauacaagcugcguuucuuuaauagaaaccaaaggcaucuggagcccgagagg

SEQ ID NO: 40668 - RNA, 64 nt, Human
uucugguuccuucugccgcccuuccugagaccuuagaaaccagaagagccauacagucagugga

SEQ ID NO: 40669 - RNA, 64 nt, Human
guccccuccagaccuggcuggccccugcagccacagaaaccacgauggcaaaaaaucucauugg

SEQ ID NO: 40670 - RNA, 64 nt, Human
cgcaggcugagcaagucuguaaacugauucugggagaaaccaagcugcuggccauagggugucc

SEQ ID NO: 40671 - RNA, 64 nt, Human
gaagacgaaaaucagugagacauaagccaacaagagaaaccaucucugaccacccccuccuccc

SEQ ID NO: 40672 - RNA, 52 nt, Human
uggcagcgucugaagaguaaggagaaaccaccgaugccgagaggcuaguggu

SEQ ID NO: 40673 - RNA, 64 nt, Human
gaacuugcucuugcucaugcggagcuuggcuaagagaaaccagaucagaaugcaagcuguaggu

SEQ ID NO: 40674 - RNA, 64 nt, Human
gggucugacaucccugccaggaagcagguuggacagaaaccacuugcuaaaagcgucucuaugg

SEQ ID NO: 40675 - RNA, 64 nt, Human
ggugaauuagaaaggcauauccagacccuauuaaagaaaccacaggguuugauucugguuacca

SEQ ID NO: 40676 - RNA, 64 nt, Human
ucuggcugccucugagucugaaucucccaaagagagaaaccaauuucuaagaggacuggauugc

SEQ ID NO: 40677 - RNA, 64 nt, Human
ccgacgguagaguucuuucaucuaugguugaaucagaaaccaagaaacacuacuauuaaacugc

SEQ ID NO: 40678 - RNA, 64 nt, Human
ggcucgucugugucccugccacucugaguuauccagaaaccaccaccuacaaaugaggggacuc

SEQ ID NO: 40679 - RNA, 64 nt, Human
ucuuagcaagauauuuuaucucuguacauaaaguagaaaccaaaagcuagggaaacagauacuc

SEQ ID NO: 40680 - RNA, 62 nt, Human
gugccuucccccguggaauaaacgguguguccugagaaaccacacacaggcucguggcaucu

SEQ ID NO: 40681 - RNA, 64 nt, Human
gagauaaagaccuuuuccaugcacccucauacacagaaaccaauuuucuuuuuuauacucaauc

SEQ ID NO: 40682 - RNA, 64 nt, Human
uccucucacugccugccagaaaacaaaaacaccaagaaaccaagucaacuuuucaccuccugag

SEQ ID NO: 40683 - RNA, 64 nt, Human
aaaggaauggauuccccugccuggagccuccaaaagaaaccagcccugcccacgccuugacuug

SEQ ID NO: 40684 - RNA, 64 nt, Human
guauaguccuagcugacgccaauaauaaaaaacaagaaaccaagugggcugguauucucucuau

SEQ ID NO: 40685 - RNA, 64 nt, Human
cugauuccuuccaacgugcacuucagcuggagaaagaaaccaagaagggaagcggccgcugggc

SEQ ID NO: 40686 - RNA, 64 nt, Human
ggagaauuggaacauguguggccccaagcucaacagaaaccaguuguucccaaucugccguuac

SEQ ID NO: 40687 - RNA, 64 nt, Human
augucuuucuuuuucugccagaaaaucuauuuuaagaaaccagaauagucaacaguguucaaaa

SEQ ID NO: 40688 - RNA, 64 nt, Human
uggauggacucuucaaaacuuaccaaauaguugaagaaaccaggugccuucucaugauggaaga

SEQ ID NO: 40689 - RNA, 64 nt, Human
cagccgggcaggguggaaggagcuugccucuuugagaaaccaaggagucccagugaucuguuac

SEQ ID NO: 40690 - RNA, 64 nt, Human
ugcccucuccucacaggucuguugcagggacuccagaaaccauucugggagccguggauggggg

SEQ ID NO: 40691 - RNA, 64 nt, Human
caccuucgaaaacaugguaggacucacacuggauagaaaccaaagcaggugaaucaccugaggu

SEQ ID NO: 40692 - RNA, 64 nt, Human
uccacagagccccacgccuggcauggcauuccacagaaaccauaaagguuggcugaguccagcu

SEQ ID NO: 40693 - RNA, 64 nt, Human
aaauguaauccagcauauaaacagaaccaaagacagaaaccacaugauuaucucaauagaugca

SEQ ID NO: 40694 - RNA, 64 nt, Human
ccucaacuccuaguaaacauaauuaaugauggagagaaaccauacaacugugaagaauguggca

SEQ ID NO: 40695 - RNA, 64 nt, Human
aaucuucuugagcaugaaaaaauucauacuggagagaaaccauucaaauguaaugaauguggua

SEQ ID NO: 40696 - RNA, 64 nt, Human
ugaagcccacccuuucccccaacucugguccaggagaaaccagaaaaggcugguuagggugugg

SEQ ID NO: 40697 - RNA, 64 nt, Human
aaaauggaaaaacccuuccaguaauuaaaaaggaagaaaccacagaaagaaaacuacagaccuc

SEQ ID NO: 40698 - RNA, 64 nt, Human
gugccugcgggccuuggggggccccgugugagccagaaaccagggcuucccuacccccagcuga

SEQ ID NO: 40699 - RNA, 64 nt, Human
aggacuguagcaagggcuaugggaguucugaagcagaaaccaugggcuaaaaccaacauacauc

SEQ ID NO: 40700 - RNA, 64 nt, Human
ccuuggagcacugagcaccauuuggaagcuugagagaaaccaaaauuaaagagagaaagagaga

SEQ ID NO: 40701 - RNA, 64 nt, Human
aaggucccugauaaaguuaguagcugcccucaucagaaaccaggcccaggcaguggggacacau

SEQ ID NO: 40702 - RNA, 64 nt, Human
aagaccaaagguagauaaauucacgaagaugaggagaaaccagugcaaaaagccugaaaauucc

SEQ ID NO: 40703 - RNA, 64 nt, Human
uuaaacaaaggaagaggaaauauagggaagagaaagaaaccacagcuucuuuuagacuugucug

SEQ ID NO: 40704 - RNA, 64 nt, Human
gaaguugaaccucauucuuccuuguuucucugguagaaaccaucuacccucuaccaccuugcac

SEQ ID NO: 40705 - RNA, 64 nt, Human
ccugaaacucccaggacuuguccuugauccuuccagaaaccaccagguccggcacuuggagccc

SEQ ID NO: 40706 - RNA, 64 nt, Human
gagaucccuuuucuuaaaaaaggcucaacccaaaagaaaccauuucuuaaaaaauuuuacauag

SEQ ID NO: 40707 - RNA, 64 nt, Human
ggcccagcauucagggaggagucguaagaucuuaagaaaccaauccuugccucaagcaaaagca

SEQ ID NO: 40708 - RNA, 64 nt, Human
aucccuggagcuggccuccuuccagcccagugccagaaaccagcacuccaugaagauaaacucu

SEQ ID NO: 40709 - RNA, 64 nt, Human
aggcuuacuacauauaagacaacucauacuggagagaaaccaugcaugugugaagaauguggga

SEQ ID NO: 40710 - RNA, 64 nt, Human
uuuuauuauccuguccccagagggugguuuauccagaaaccaagaaaaaaaaucaaucagaaua

SEQ ID NO: 40711 - RNA, 64 nt, Human
accaacaaaagagaaaaccaaaaauaaucacaacagaaaccagcugccccaaaggaaccagagg

SEQ ID NO: 40712 - RNA, 64 nt, Human
agcuaugucagccaauccgauugccuuaggugaaagaaaccaccgaaaucccucaggucccuug

SEQ ID NO: 40713 - RNA, 64 nt, Human
ggugcagaacccugcaggcagccccaggcuuugcagaaaccacacacacuguugcuggaucuug

SEQ ID NO: 40714 - RNA, 64 nt, Human
ucagccugggcaguagagucagucuccaucucaaagaaaccagcaaacaaaaaauauuaaaaaa

SEQ ID NO: 40715 - RNA, 64 nt, Human
aaccuugaaacacauaagaaaaugcaugcugaagagaaaccacacagauguaagguuuaugaca

SEQ ID NO: 40716 - RNA, 64 nt, Human
aaccuuaaaacacauaagaaaauucacauugaagagaaaccauacagagguaagguuugugaca

SEQ ID NO: 40717 - RNA, 64 nt, Human
aauccugugagucaucaaagaauuuauaucagagagaaaccauacaaguauaauaaauguggca

SEQ ID NO: 40718 - RNA, 64 nt, Human
aaaggcaggaaggauccugccuugauuuuacuucagaaaccaaaucagucuucuauaaucuggg

SEQ ID NO: 40719 - RNA, 64 nt, Human
aaguaccacaccagucagagucaagucaggaaauagaaaccacacuagguauuucaaacagagg

SEQ ID NO: 40720 - RNA, 64 nt, Human
uuuuguaaucuuggauuuuguagcuuuuaaaacuagaaaccauuguucuaacaaagcaggcaac

SEQ ID NO: 40721 - RNA, 64 nt, Human
aauuaaaacuuaacagcaucaaauuauugggaccagaaaccaaguaauguauaauguggcuuuu

SEQ ID NO: 40722 - RNA, 64 nt, Human
ccugaagccuggauuccagcagugaaugcuagacagaaaccaagccauuaaugagauguuauua

SEQ ID NO: 40723 - RNA, 64 nt, Human
ggaaagggucuuggugucacugccgcucaugcauagaaaccaccaaaagccccaauaaagcauc

SEQ ID NO: 40724 - RNA, 64 nt, Human
aguugaggggcuuccggcucccuucuacagccucagaaaccagacucguucuucugggaacccu

SEQ ID NO: 40725 - RNA, 64 nt, Human
auacaaacagggcagaaccacagaagaacguuuuagaaaccaagagaugugcagaaagaaaugu

SEQ ID NO: 40726 - RNA, 64 nt, Human
aauugaaauaagcucuuugcaggcguccaauccuagaaaccaauggucuccagaacucucacac

SEQ ID NO: 40727 - RNA, 64 nt, Human
uguuaaugaucagaguaacaaagugugaaaaauaagaaaccaucauugauguuaauuaacacau

SEQ ID NO: 40728 - RNA, 64 nt, Human
uuccucgaguggccacugugagccucgucacagcagaaaccaacuuuucuaacgacugaguucg

SEQ ID NO: 40729 - RNA, 64 nt, Human
cggggaggggucccaccacucaaagugccucuaaagaaaccagcuuuuugcacuaaagccaaac

SEQ ID NO: 40730 - RNA, 64 nt, Human
auuuucuuuugauaaaagagucgaugccugaaagagaaaccauuuccuugauuguguaaggaac

SEQ ID NO: 40731 - RNA, 64 nt, Human
agaagcucucuuaagaaaagggaauucucuuuaaagaaaccaccaccaacaacaaaacaaccaa

SEQ ID NO: 40732 - RNA, 64 nt, Human
cuauuuaucaaaacugacuacuggaccggagcccagaaaccaugggucaaguuacacgugaauu

SEQ ID NO: 40733 - RNA, 64 nt, Human
guuuuacuggcaguucuauaguaguccagacuuuagaaaccaaacacaacaaaauggcuuguug

SEQ ID NO: 40734 - RNA, 64 nt, Human
aauuguucauguuguuuggaugguaucgaaaaccagaaaccacuuuuaauaauguguuuaagau

SEQ ID NO: 40735 - RNA, 64 nt, Human
agagaacacauaaaugauuuuggcauaccauuagagaaaccauuuguaaaacucaaaugaccac

SEQ ID NO: 40736 - RNA, 64 nt, Human
ggcggcccaggcugaagccaucuccgggugucugagaaaccacccagugccucaccuccagauc

SEQ ID NO: 40737 - RNA, 64 nt, Human
aagaccuguccaccuguagcuccgcucauuucuuagaaaccaccugcuucccagagugccaagc

SEQ ID NO: 40738 - RNA, 64 nt, Human
aucccccuuauuuagaaauguuccugggggaugaagaaaccauaauuacuugagacuggcagca

SEQ ID NO: 40739 - RNA, 64 nt, Human
ugggacgcuguacagagaccagcucagucgucagagaaaccaugaggugguguccugcacggaa

SEQ ID NO: 40740 - RNA, 64 nt, Human
uuucucaucccuuuauugcuuuuuagcaaacauaagaaaccaugagucauuuugucauuuagag

SEQ ID NO: 40741 - RNA, 64 nt, Human
cauauccuaaaagcuucuucaugaaauuauuagcagaaaccauguuuguaaccaaagcacauuu

SEQ ID NO: 40742 - RNA, 64 nt, Human
uacugugaccuaagaacaaaacuguaacugcauuagaaaccaugaaaaaauuagauauuguuuu

SEQ ID NO: 40743 - RNA, 64 nt, Human
ggacagaguucuuauaaauguauaaauuaggcucagaaaccacugcauucugaccugcuguaca

SEQ ID NO: 40744 - RNA, 64 nt, Human
acagugggaggugugauuuacccauuacacaaugagaaaccagaggagccgaugaguuacuuaa

SEQ ID NO: 40745 - RNA, 64 nt, Human
cggugauguugucauaaccucagaguggagaggcagaaaccaugugcagaggcugggagaugcu

SEQ ID NO: 40746 - RNA, 64 nt, Human
ggcugggcggcuccaguccauagacguuccccccagaaaccagggcuucucucuccugagccug

SEQ ID NO: 40747 - RNA, 64 nt, Human
acagaggccacacuuucugggaaauuuuaaaggaagaaaccauuuuuaaugagaugaaaauauu

SEQ ID NO: 40748 - RNA, 64 nt, Human
gauuucuguucuaaugccauagaucaaaggccucagaaaccauuguguguuuccucuuugaagc

SEQ ID NO: 40749 - RNA, 64 nt, Human
agggguccucccucuuaacccauguaggugccagagaaaccacccccacuccaugagaagaggc

SEQ ID NO: 40750 - RNA, 64 nt, Human
ggacucagcaggaacaccaaaucccggaccaggcagaaaccacccaagacugaggggcucgugc

SEQ ID NO: 40751 - RNA, 64 nt, Human
cagucugcuguccugaaacccagaagugauggagagaaaccaacaagagaucucgaacccuguc

SEQ ID NO: 40752 - RNA, 64 nt, Human
cgcugguaccugcuggcccauggcccggguguagagaaaccaagcggcagccaccaccaguguu

SEQ ID NO: 40753 - RNA, 64 nt, Human
auguucuuuuggccuuuuguuccuaccuaaaugaagaaaccaugccuggaggggccgugaacac

SEQ ID NO: 40754 - RNA, 64 nt, Human
uaaaacaggcugcagucuggcacuuuuagaagacagaaaccacacucacaguccaaagcaguag

SEQ ID NO: 40755 - RNA, 64 nt, Human
cacucggccacuagugggguccugaggccaagaaagaaaccagacccuguaugacaaguggggu

SEQ ID NO: 40756 - RNA, 64 nt, Human
aaauaagugaucagcacagcugcuuccaaauaggagaaaccauaaaauaggaugaaaaucaagu

SEQ ID NO: 40757 - RNA, 64 nt, Human
ggcucuuucuaccaauguuugcuccugguuggaaagaaaccaaagauuuaagacgggcugcucu

SEQ ID NO: 40758 - RNA, 64 nt, Human
agggaucugcaacaacccugaagacaacaaggaaagaaaccaugaaagucugucuguacugcag

SEQ ID NO: 40759 - RNA, 64 nt, Human
ggggagacaugccuggacccacagacugcgugagagaaaccagcuggugauuuaugaagagauc

SEQ ID NO: 40760 - RNA, 64 nt, Human
cuauaaagugccucggacaguccgcaguuguagcagaaaccaacaagaaccacuccuucauguu

SEQ ID NO: 40761 - RNA, 64 nt, Human
uuacgcaaccgcgcugcaggggugaggaguggggagaaaccagaaugcuucugaaacucccacc

SEQ ID NO: 40762 - RNA, 64 nt, Human
uaucugacucucagucugucccauaaauuaauucagaaaccaucuucaggggaagcagauauca

SEQ ID NO: 40763 - RNA, 64 nt, Human
auguuaaugcuggaaagaaaaaaagaagaaagaaagaaaccaucccuguccuucaguuuauaau

SEQ ID NO: 40764 - RNA, 64 nt, Human
cugcauagaaggaggagagggaaaauguuuuguaagaaaccaaucaagauaaaggacagugaag

SEQ ID NO: 40765 - RNA, 64 nt, Human
uauauuaagucaacguacaguuugcuugaguuauagaaaccagccugucaucaaaugauucuag

SEQ ID NO: 40766 - RNA, 64 nt, Human
uucucccauagcauuauuuuccccucaagacaacagaaaccauucagagcagaggggacugucu

SEQ ID NO: 40767 - RNA, 64 nt, Human
caaaaucuucaggcaaaaagcaaguugcaaaauuagaaaccauuggcuaaaaauguguuuuguu

SEQ ID NO: 40768 - RNA, 64 nt, Human
ugacaagugugggcuccugaaaggaauguuccagagaaaccagcuaaaucaugacaccuucaau

SEQ ID NO: 40769 - RNA, 64 nt, Human
aaagcguuccguagcucgcucuaugaaggccuggagaaaccagaauccaagaccuccauucaca

SEQ ID NO: 40770 - RNA, 64 nt, Human
cacaaguagagaacauguugcuauaauguuccccagaaaccauuuauuaauugguaugaacaug

SEQ ID NO: 40771 - RNA, 64 nt, Human
aagcuaauuaagggcgaugauuauuauuacaagaagaaaccaagacauuacaccaugguuuuua

SEQ ID NO: 40772 - RNA, 64 nt, Human
aucugagacuaagggcugguuuuuaauccucauaagaaaccagccuugaagaauuaacaauucu

SEQ ID NO: 40773 - RNA, 64 nt, Human
ucagaggagggugaggaagacuaauuaaacauggagaaaccaaauuggacaaauccucaccacc

SEQ ID NO: 40774 - RNA, 64 nt, Human
uccacuguacccagucucaaaggccagguugcuaagaaaccaggaguaaaagagucaagugacc

SEQ ID NO: 40775 - RNA, 64 nt, Human
ucguucucuaaaccagucuccaggaagaagagaaagaaaccacacuggcuagugaagaagcagg

SEQ ID NO: 40776 - RNA, 64 nt, Human
ucuuguguacacugcuccuguggccuuccacagcagaaaccagggcaaaaggguccaaacacau

SEQ ID NO: 40777 - RNA, 64 nt, Human
cauuucaacauagagucacauaaaugucccccugagaaaccaaucccacuucuuucuaggagau

SEQ ID NO: 40778 - RNA, 64 nt, Human
ggguuggggguagagguuuugggaugucuuaguuagaaaccagauuaauagaagaguaggccug

SEQ ID NO: 40779 - RNA, 64 nt, Human
caucauccacuuuaucccagaaacuagaacugugagaaaccagguuuagaagacagucacagaa

SEQ ID NO: 40780 - RNA, 64 nt, Human
ugcagauguuguuuucagguuaauggacacgcaaagaaaccacagcacauacuucuuuucuuuc

SEQ ID NO: 40781 - RNA, 60 nt, Human
aggacaguggggaggauuagucacacauggagaaaccaaauuggacaaaucaucaccacu

SEQ ID NO: 40782 - RNA, 60 nt, Human
aggaggguggggaggacuagucaaacauggagaaaccaaauuggacaaauccucacuacc

SEQ ID NO: 40783 - RNA, 64 nt, Human
ugacaagugugggcuccugaaaggaauguuccagagaaaccagcuaaaucauggcaccuucaau

SEQ ID NO: 40784 - RNA, 64 nt, Human
gaacugaggaaggugcuuagauggugagggcucuagaaaccaagccccaugagcagcaguggaa

SEQ ID NO: 40785 - RNA, 64 nt, Human
ucuuccccaugugacuugcaaagagucucaggcaagaaaccagggcuucaaacugcuaguuccc

SEQ ID NO: 40786 - RNA, 64 nt, Human
cugaaacuuugggaauuugcuuuagccagaauaaagaaaccaaaucaugaaaauuauggaagac

SEQ ID NO: 40787 - RNA, 64 nt, Human
ugcauuucacgagccacagguggggcucauccaggccgcccagcagcugcugugugaugagcag

SEQ ID NO: 40788 - RNA, 64 nt, Human
ggguauuuucugccuaagugcuacgugauccucugccgcccagaccucaacagcacagagcacu

SEQ ID NO: 40789 - RNA, 58 nt, Human
aacagaacagcgaucacuaaaccguuccgccgcccacccucugcuagacacagccaag

SEQ ID NO: 40790 - RNA, 64 nt, Human
auugccugaaccaagaggccaggagcccccaugggccgcccaguaccaugcacacuccuguccc

SEQ ID NO: 40791 - RNA, 64 nt, Human
ggauuuuggugagcuuagcuucuguauuccuacugccgcccagaaaaggggcagggcucugcag

SEQ ID NO: 40792 - RNA, 64 nt, Human
acugcaagaaaggggacccaagaaaccaaagucugccgcccaccucgcuccccucuggaaucuu

SEQ ID NO: 40793 - RNA, 64 nt, Human
uggaggagcagccgugacugcccguggcucugcugccgcccacucccugccuugugaguggccu

SEQ ID NO: 40794 - RNA, 64 nt, Human
cagagugguccucagcccauuucagacugcagaugccgcccacucccaccccacuccuaggcug

SEQ ID NO: 40795 - RNA, 64 nt, Human
gcagaccuaaggcaucucuacucccuccagaggagccgcccagauuccugcaguggagaggagg

SEQ ID NO: 40796 - RNA, 64 nt, Human
agccaccacucacucuccuuauuacacaagcacagccgcccagugugcacaucaugugcagaca

SEQ ID NO: 40797 - RNA, 64 nt, Human
aucuccccaggccuccagccucucccggcugccugccgcccaaagagaaaucacaggggcgggg

SEQ ID NO: 40798 - RNA, 64 nt, Human
uucagcauccuuucuucgcccgccuucgggcugagccgcccaacaaguugugggacuccagucg

SEQ ID NO: 40799 - RNA, 64 nt, Human
ccuucagauacugugggacucaugcuggagaggagccgcccacuuccaggaccugugaauaagg

SEQ ID NO: 40800 - RNA, 64 nt, Human
aguccgugcaggcacacucagcgcuaagccaaaggccgcccaugcugagcucaucuggccccau

SEQ ID NO: 40801 - RNA, 64 nt, Human
cggguggcggcgguaagcggggaggaaacauggcgccgcccaaaugcgcccggaggccguuagg

SEQ ID NO: 40802 - RNA, 64 nt, Human
gcgaaggcccuuagacaaccauggcugcuguacugccgcccaggguggguggccagugaggacu

SEQ ID NO: 40803 - RNA, 64 nt, Human
acgcccggggcgcgccggcucagggaggcucggggccgcccaugcagacuuuuggccuggcgcg

SEQ ID NO: 40804 - RNA, 64 nt, Human
cgauucccugggcuccaggcucccccgcgcgggcgccgcccaccgccauacuaaacgaucgagg

SEQ ID NO: 40805 - RNA, 64 nt, Human
aaccucugacccucuccuagcccuucccauacaggccgcccaacacucccccuacguugcgcug

SEQ ID NO: 40806 - RNA, 64 nt, Human
aucccaucuaggaagugaggagcuucucugccuggccgcccaucgucugagauguggggagcac

SEQ ID NO: 40807 - RNA, 64 nt, Human
agggacgcugccggguagacucuccacucccccugccgcccacacugcagcagccacauccaua

SEQ ID NO: 40808 - RNA, 64 nt, Human
cacccagcgugcaacagccacgggaagccuuucugccgcccaggcccacaggucucgagacgca

SEQ ID NO: 40809 - RNA, 64 nt, Human
auccccucccucauccucgucuguccugucaccugccgcccagccccucuccugccagacagcc

SEQ ID NO: 40810 - RNA, 64 nt, Human
ugguugcuguuugguucugcaggcugguggggaggccgcccaucgugguggggcaucuguccag

SEQ ID NO: 40811 - RNA, 64 nt, Human
ugcccacaggccuggagccagcuagcgaccuugugccgcccagcuguccauggcccgugcagag

SEQ ID NO: 40812 - RNA, 64 nt, Human
gacccaugaaaugcccugccuccccauucgcauggccgcccaagaggcuggcucccagcauguc

SEQ ID NO: 40813 - RNA, 64 nt, Human
auacaagagcagaauaguacuuaaaauccaaacugccgcccagaugggcuuguucuucaugccu

SEQ ID NO: 40814 - RNA, 64 nt, Human
gaacgugucauuugcucgacccuggcccacccuugccgcccagcuguugugcugggcacagucu

SEQ ID NO: 40815 - RNA, 64 nt, Human
agcucugggaugcagcagccgcucgcauggaagugccgcccagaggcaugcaggcugcugggca

SEQ ID NO: 40816 - RNA, 64 nt, Human
cuguaaggggcucugggacgcccagacccugcccgccgcccaccugguggugacaagcuccagc

SEQ ID NO: 40817 - RNA, 64 nt, Human
cccagcuuccacauccggagcccuggucagcauagccgcccacggucuguucucagauuccuaa

SEQ ID NO: 40818 - RNA, 64 nt, Human
gauaugugugaauguguggcaucauuucacuucagccgcccaauuccaucucuccucugcagcc

SEQ ID NO: 40819 - RNA, 64 nt, Human
aaacagacggcagacacaccugucccccagugaugccgcccaagcugcccauggggcuuccuac

SEQ ID NO: 40820 - RNA, 64 nt, Human
cuacgggcaccuggaguugauucggcugcagcuggccgcccaguuugagaauugguguaagaca

SEQ ID NO: 40821 - RNA, 64 nt, Human
ggacugagcucgggcacgcagggccugagaucuggccgcccauuccgcgagccagggccgggcg

SEQ ID NO: 40822 - RNA, 64 nt, Human
gcgguggcgccagcccuaggcuacccuugccaaggccgcccaccugcaucagccucuggccaga

SEQ ID NO: 40823 - RNA, 62 nt, Human
agcuugcauuucugaaccaaaggcccuuuucagggccgcccaacuaaacaaaagaagagcug

SEQ ID NO: 40824 - RNA, 62 nt, Human
aucucgacuucccaaaucaaaggcccuuuucagggccgcccacaguuuuccgcaaaagagcu

SEQ ID NO: 40825 - RNA, 64 nt, Human
aguagaagugcugggagcagcagcuggggaagcugccgcccacgggcucugccccuuccagcug

SEQ ID NO: 40826 - RNA, 62 nt, Human
uuucgucaguuuucuuccaauggcccuuuucagggccgcccacucccucucagaaagagcug

SEQ ID NO: 40827 - RNA, 62 nt, Human
uuauuuucauuuucaaccaaaggcccuuuucagggccgcccacuuuuuucauaaaagagcag

SEQ ID NO: 40828 - RNA, 64 nt, Human
ccccugccggccacaagggagcagcguccgcgccgccgcccaccggcccucccgccagcuccuc

SEQ ID NO: 40829 - RNA, 64 nt, Human
uuuuuuuuuuuuuuuugagagagagucuuacucugccgcccaaacuggagugcaguggcacaau

SEQ ID NO: 40830 - RNA, 64 nt, Human
aauguugcuucccucuccugucuuucccacuggagccgcccaagcuuguagguggguggugugc

SEQ ID NO: 40831 - RNA, 64 nt, Human
cugcucugggaagucggcuccaugcucaccagcagccgcccaggcccgcagccucacccggcuc

SEQ ID NO: 40832 - RNA, 64 nt, Human
gucuggcucccgagcucagacacagcccccaggagccgcccaccacggcugugggaacuuccag

SEQ ID NO: 40833 - RNA, 64 nt, Human
gugugcaguggacugugggucucccauaugcggugccgcccaaagguggcuuugccucaagcaa

SEQ ID NO: 40834 - RNA, 64 nt, Human
aagacagccaugcugcuggcacuacagagggugagccgcccaugucuggggccuccucccauuc

SEQ ID NO: 40835 - RNA, 64 nt, Human
aagcuggugagacaaccucugauccugaggaccggccgcccaccaaggguugggcccccggggc

SEQ ID NO: 40836 - RNA, 64 nt, Human
ucugcagggguguccuuguccacucgcaccccucgccgcccaccagggccaugcucugugacuu

SEQ ID NO: 40837 - RNA, 64 nt, Human
acugucuccuagaggccccggaggagcugggccagccgcccacccccacccccagugcagggcu

SEQ ID NO: 40838 - RNA, 56 nt, Human
accaguaccuggagaccuagggugcagccgcccagggccggcggggcccuuuucac

SEQ ID NO: 40839 - RNA, 64 nt, Human
uuuccagcagcaaucggcucucagaagaaguuuagccgcccacuucugccugccacuacaacaa

SEQ ID NO: 40840 - RNA, 64 nt, Human
uccagguggcgugagaggcaaugacucguuaccugccgcccaucaccuuggaggccuucccugg

SEQ ID NO: 40841 - RNA, 64 nt, Human
uccugguucaaacgggugccuggucagaaggccagccgcccacuucccguuuccucuuuaacug

SEQ ID NO: 40842 - RNA, 64 nt, Human
ugaggagccagcggccaccugcggggagaccaccgccgcccagacuacugacggcaggggcugc

SEQ ID NO: 40843 - RNA, 64 nt, Human
ggagucacccugagggccccgggcaguugcccuggccgcccagugacgcccaccggcucccucc

SEQ ID NO: 40844 - RNA, 64 nt, Human
ugcgauuugguuucguuuuucuuuuguauuauccgccgcccaguuccuuuuuugucuuucucuc

SEQ ID NO: 40845 - RNA, 64 nt, Human
gcacagccacgggggacugacgccagguuccccagccgcccacaacgacuuuauuuucuuaccc

SEQ ID NO: 40846 - RNA, 64 nt, Human
uugggggucagaccacccccuagaggagccacgugccgcccagccaccuucaaugccugccacc

SEQ ID NO: 40847 - RNA, 64 nt, Human
cacgcacuggaucacccaggucccagcagacauggccgcccaaagucagcaagccuccuuugug

SEQ ID NO: 40848 - RNA, 64 nt, Human
cgaagacccggccaggaccuuggugagauggggugccgcccaccuccugcggauacucuuggag

SEQ ID NO: 40849 - RNA, 64 nt, Human
ggacgucagacuuggcucagcucggggagccuuagccgcccaugcacuggggacgcuccgcugc

SEQ ID NO: 40850 - RNA, 64 nt, Human
ugacgcucagcucccgcccgacggcagcgccgccgccgcccagaaucccagcccagaaucccga

SEQ ID NO: 40851 - RNA, 64 nt, Human
uggcaagaagcugcgcugaaggcccgggcucccggccgcccagggucgccgccgccccucgcac

SEQ ID NO: 40852 - RNA, 64 nt, Human
aagaauacuagaaugguagcacuacccggccggagccgcccaccgucuugggucgcccuacccu

SEQ ID NO: 40853 - RNA, 64 nt, Human
agauccauggggcaguccaggcaucucccuaccagccgcccacauuggcuucgcugcagcgcuu

SEQ ID NO: 40854 - RNA, 64 nt, Human
gccugggcucuuccagccucagugugccucucuggccgcccacuggaugagcggugagacgaac

SEQ ID NO: 40855 - RNA, 64 nt, Human
gccuugagcuccgcuuuuugcugagaucacagcagccgcccacagacaguucacuuuuauuucu

SEQ ID NO: 40856 - RNA, 64 nt, Human
ggcuccuguaccaaccgcccagccacgcuccaucgccgcccaaagggaggugccaaggccagga

SEQ ID NO: 40857 - RNA, 52 nt, Human
aggaaaaacgggguuacuaguagccgcccauagccugcaaccuuugcacucc

SEQ ID NO: 40858 - RNA, 50 nt, Human
cagacaccuacugcgcguaggccgcccaccgcccgcuucucugccaaaag

SEQ ID NO: 40859 - RNA, 60 nt, Human
cgauauaccaggugcucugaggggaugguggccgcccacccgcccgagggauggugcccc

SEQ ID NO: 40860 - RNA, 53 nt, Human
accaggagacggcuguguagcgggccgcccacgggcagcaggagggacaaugc

SEQ ID NO: 40861 - RNA, 64 nt, Human
cccagggaaagagccccaugccgcccccuaaggagccgcccagaccuagggcuggacucaggag

SEQ ID NO: 40862 - RNA, 64 nt, Human
gggaugaggccaaggcugccuucaauuagaagcagccgcccacagagacaggcacugugugccu

SEQ ID NO: 40863 - RNA, 64 nt, Human
caaguauaacgucaggcccaaguguggacacacugccgcccaucccaucaggucaugaggaagg

SEQ ID NO: 40864 - RNA, 64 nt, Human
caacuccccucaccaggagaggcaccugcuuggugccgcccagggaaggggcucaggccugacg

SEQ ID NO: 40865 - RNA, 64 nt, Human
gaguuuuucuaacauggaaaaagauucucagccugccgcccagcaugcagguggccucgcuuug

SEQ ID NO: 40866 - RNA, 64 nt, Human
cuuauuuauugucggucugcccaugggacugggagccgcccacuuuuguccucaauaaaguuuc

SEQ ID NO: 40867 - RNA, 64 nt, Human
ucacugaagccuugacgcugugggcacugccucagccgcccaaguaucugggaccacaggcgug

SEQ ID NO: 40868 - RNA, 64 nt, Human
caagauugaaggaugugcagggcuuccucucagagccgcccaaacugccguugauguguggagg

SEQ ID NO: 40869 - RNA, 64 nt, Human
cugugccccgcgggagcuccaggccgccccuccugccgcccagcuucgugacuccacggcccca

SEQ ID NO: 40870 - RNA, 64 nt, Human
cuagccucuguagcuggugguggcagcguggggugccgcccagcgugcuggguccuggcagugc

SEQ ID NO: 40871 - RNA, 64 nt, Human
cugggcagaggccagaguagaauggaggaugauugccgcccaggggacgagcucagcccugcgc

SEQ ID NO: 40872 - RNA, 64 nt, Human
cagggccaagccuguaucucuucacucugcagaggccgcccaggugcugggaauggcacggagc

SEQ ID NO: 40873 - RNA, 64 nt, Human
gccccccugcuuggcucugcugggagagugcucagccgcccaguccugccugcaagcccagggc

SEQ ID NO: 40874 - RNA, 64 nt, Human
gcugaaggagaaagaggccgcugcugccgccgccgccgcccaccagcaggcccugcgggaggag

SEQ ID NO: 40875 - RNA, 64 nt, Human
gcguuccaugcugucuggggagagcagcacacuggccgcccagcacugcugcuaugacgaggac

SEQ ID NO: 40876 - RNA, 64 nt, Human
ggccaccgcaugaggagauggagggcgggacugggccgcccagccccuugacuccagccucgac

SEQ ID NO: 40877 - RNA, 64 nt, Human
aggaugccaguacuguggugugugagucucagcagccgcccacacgcuccuaacucugcugcau

SEQ ID NO: 40878 - RNA, 64 nt, Human
gacccagcaggaggaagcccaggagcuggguccugccgcccaggagcugggcccugccacccag

SEQ ID NO: 40879 - RNA, 64 nt, Human
cccaagggcagccauggugcucuguacugcucgggccgcccaggucacagagccugagcuucgu

SEQ ID NO: 40880 - RNA, 64 nt, Human
gaggcugcacaggccagggcucgggcaugugguggccgcccaccaggggccuucacgucugccc

SEQ ID NO: 40881 - RNA, 63 nt, Human
gugcagaugaccccguguagcucggggcuuggugccgcccacggcuuuggcccuggggucugg

SEQ ID NO: 40882 - RNA, 64 nt, Human
agcccuggagcucaacaagcggaaggcuguagaagccgcccagcuggccgaggaccugaaggug

SEQ ID NO: 40883 - RNA, 64 nt, Human
uccuccgucucuugccucggcgccuggguggcuugccgcccacacuucaggggcccagacuuac

SEQ ID NO: 40884 - RNA, 64 nt, Human
ggccacaggccacugcaaacccugcugccugccggccgcccagacaccacagacgccaccuggc

SEQ ID NO: 40885 - RNA, 64 nt, Human
ucuccaagcccccaaauagcuccaggcgcccucggccgcccaucaugguuaauucuguccaaca

SEQ ID NO: 40886 - RNA, 64 nt, Human
gcagcugugagagaggagcagguccucagcccaugccgcccacuaggccucagaccacagggga

SEQ ID NO: 40887 - RNA, 64 nt, Human
gggccagcuuggcagggauccccaggaggccugggccgcccagaggcuccucucaggcugggcc

SEQ ID NO: 40888 - RNA, 64 nt, Human
ucccuacacgauccgcaacccaugcccuggaccagccgcccagaucaugccgccgcagcugguu

SEQ ID NO: 40889 - RNA, 64 nt, Human
cauaugugcuucacauugugaggggagugcacaagccgcccaugcaaagaguagggucagccau

SEQ ID NO: 40890 - RNA, 64 nt, Human
cagcuugcuguggggcagugcagggaguccugcggccgcccaggugucaggagagguccccgcc

SEQ ID NO: 40891 - RNA, 64 nt, Human
ccuguugcuaggagauagcuggggaaggcccaaggccgcccagggcagagagaggagacgaaga

SEQ ID NO: 40892 - RNA, 64 nt, Human
auaccccaagacucccaugagggagaugccaugagccgcccaaggccuuccccuggcacuggca

SEQ ID NO: 40893 - RNA, 64 nt, Human
cuccagcguuugccuggucuggaaguccuggccggccgcccacaucgggcucaccuuaaagguc

SEQ ID NO: 40894 - RNA, 64 nt, Human
aucccaucuaggaagugaggagcgucucugcccggccgcccaucgucugagauguggggagcgc

SEQ ID NO: 40895 - RNA, 64 nt, Human
ucaucaaccaccuuccccaagcuuagugacagcagccgcccauccuaccuggauggagaagaga

SEQ ID NO: 40896 - RNA, 64 nt, Human
ggccagcugggucuccggggacccugggcccugggccgcccauuccuggcccucccgcugcauc

SEQ ID NO: 40897 - RNA, 64 nt, Human
ggagacgccccuccaacuggcgggugugaaggaagccgcccagggguccgggcuguccuuggcc

SEQ ID NO: 40898 - RNA, 64 nt, Human
cuccgggugacaccagccccgucuccagccuugagccgcccaugcugaugcgaccucggcugac

SEQ ID NO: 40899 - RNA, 64 nt, Human
ggcuacagcaacagcagcugggcaagccagauaggccgcccaugcucucagccuuucucccucc

SEQ ID NO: 40900 - RNA, 64 nt, Human
uguacucagccucaggagagcuugcugcacccaggccgcccaggucuucacagcacaacugccu

SEQ ID NO: 40901 - RNA, 64 nt, Human
aaucucacggaccugaccucagaggugcaccagugccgcccagguagauaagagcugcagcauu

SEQ ID NO: 40902 - RNA, 64 nt, Human
caccuuugggcugcccuggcccccacucucccgggccgcccaccacaggcucuuaauggggccg

SEQ ID NO: 40903 - RNA, 64 nt, Human
auaggcugcuggaguccuggaaccaccugggucggccgcccaaaucuuuccuggcgaaggggag

SEQ ID NO: 40904 - RNA, 64 nt, Human
aagggaaaugucaggggcggggagggugacaguggccgcccaaggcccacgagcuuguucuuug

SEQ ID NO: 40905 - RNA, 64 nt, Human
ugcugccgccccaacugcugccagaccaugugcugccgcccaaccugcucuagugcuucuugcu

SEQ ID NO: 40906 - RNA, 64 nt, Human
acuugggggucccagaaggccccggccugaggaggccgcccaccugcgggacccuccuccucgc

SEQ ID NO: 40907 - RNA, 64 nt, Human
gugggacauuagggcccccggccucgggagaggugccgcccagcuucccaugccagcccggagc

SEQ ID NO: 40908 - RNA, 64 nt, Human
auggacugccccgguucuguguugugugccgagugccgcccaguguucugugaccacccgugua

SEQ ID NO: 40909 - RNA, 64 nt, Human
acaggcaggacccaguuuccagagagcaggcggggccgcccagugggucaggcacagggagccc

SEQ ID NO: 40910 - RNA, 64 nt, Human
gcggcggggacucggagggugccgugcgggcgaggccgcccaaauuuggcaauaaauaaagcuu

SEQ ID NO: 40911 - RNA, 64 nt, Human
uguggggcccuccccugccaacuccccuucccuggccgcccacucaacccacaccucuuucacg

SEQ ID NO: 40912 - RNA, 64 nt, Human
cggcagugacgcccgccaccaccacgcagccgccgccgcccacgccggccucugcugcccccuu

SEQ ID NO: 40913 - RNA, 64 nt, Human
gcacggccccgggccugagcccuggcacccgcuggccgcccacccgcgcccgccacucggggcc

SEQ ID NO: 40914 - RNA, 64 nt, Human
gacacuguaaauagaacccccuccaccaccccccgccgcccagcauccuaccuggacugcggug

SEQ ID NO: 40915 - RNA, 64 nt, Human
gucuaagaacccgugccgagaggguuccuggacggccgcccagguccuccgugcaggcccguga

SEQ ID NO: 40916 - RNA, 64 nt, Human
cacccucaugugagcccggaacgcccgccugcccgccgcccacccccacugacccccgcugccu

SEQ ID NO: 40917 - RNA, 64 nt, Human
gcuggucaguggcggcuguccccuccccagcccagccgcccagccacaugugucugccugaccc

SEQ ID NO: 40918 - RNA, 64 nt, Human
caggccccacggccgagccucuggccggagaucggccgcccacggggggccacagcagcggccg

SEQ ID NO: 40919 - RNA, 64 nt, Human
agucgagcagagccgguaaccaccacgugccagagccgcccacccggagccgcccgcaugcagc

SEQ ID NO: 40920 - RNA, 64 nt, Human
ggguuccccucugcugcuugugcgcaugcgugcggccgcccagcaagcugugccuuuugcgccu

SEQ ID NO: 40921 - RNA, 64 nt, Human
ccgcccgcguagacgcgcuggacgccgccuccucgccgcccaaugcggcagccugcccgucggc

SEQ ID NO: 40922 - RNA, 64 nt, Human
ccugacccucuugcacucucccugccccccggacgccgcccagcuugcuuguguauaaguugua

SEQ ID NO: 40923 - RNA, 64 nt, Human
guugggggguggggggcggaggagggugaggggugccgcccaugggccacaaaucucuacaagu

SEQ ID NO: 40924 - RNA, 64 nt, Human
gaccgaggggguggggacugagccgcccgccucugccgcccaccaccaucucaggaaaggcugu

SEQ ID NO: 40925 - RNA, 64 nt, Human
caggucacagcuaggacuccauccugacgccacagccgcccauggaccagcccccgagagccac

SEQ ID NO: 40926 - RNA, 64 nt, Human
cccaggugccggggaagaggggccaggccugggggccgcccagcuccucggaauguguuugacu

SEQ ID NO: 40927 - RNA, 64 nt, Human
cgaacuccuggccucaagugauccacccaccucagccgcccaaaguguugggauuacaggcaug

SEQ ID NO: 40928 - RNA, 64 nt, Human
gaagacaggccaaucccuucccucccagaagcuggccgcccagcaggagggacugaggccagac

SEQ ID NO: 40929 - RNA, 64 nt, Human
acagcucaacacagaaggagcagccccagccacagccgcccagccccggggucucagaugcuca

SEQ ID NO: 40930 - RNA, 64 nt, Human
acagcucagcacagaaggagcagccccagccacagccgcccagccccggggucucagaugcuca

SEQ ID NO: 40931 - RNA, 64 nt, Human
uuuuuucugucaggaaaacaauguuggccugugggccgcccacaacauauccuucccucacuac

SEQ ID NO: 40932 - RNA, 64 nt, Human
guguuuaccguucaucaccacucgggggcaccgggccgcccacccacucccaaaauccgucagu

SEQ ID NO: 40933 - RNA, 64 nt, Human
gcguagccaggccuggaggccccccaggcaggaggccgcccaaaggcggggccggcgucucgca

SEQ ID NO: 40934 - RNA, 64 nt, Human
gggaggaagcucagaucucuagagcugucuugucgccgcccaggauugaccuguguguaagucc

SEQ ID NO: 40935 - RNA, 64 nt, Human
aaagucccugaaggcccucaggcaguauauaggggccgcccaccuucagcugcccugggauggg

SEQ ID NO: 40936 - RNA, 64 nt, Human
caagaggaagagaugagggucgcaggggcccccggccgcccaccgcccgccccgucucaccuuc

SEQ ID NO: 40937 - RNA, 64 nt, Human
ucucucagucauuccccuggggcucaagcgcugggccgcccacuccugccucccucaucugugu

SEQ ID NO: 40938 - RNA, 64 nt, Human
cgugcucaugaagcgcuccaucacggcaccgcuggccgcccacaucuccuuggugaacaaggcc

SEQ ID NO: 40939 - RNA, 64 nt, Human
agcgguacccggacaguuacgaguccauguccgagccgcccauugcucaucuuuugcgccccgu

SEQ ID NO: 40940 - RNA, 64 nt, Human
ggccucccaggggauggggacccagagugcaguggccgcccacauccauggccuaggagcuacu

SEQ ID NO: 40941 - RNA, 64 nt, Human
agccaaggcucccguuccgugggaugccauaaaagccgcccagugggacccacagucacacaga

SEQ ID NO: 40942 - RNA, 64 nt, Human
ccagcaucgcacucuggcagcaccgccucuucccgccgcccagcccaccccauggccggcuuuc

SEQ ID NO: 40943 - RNA, 64 nt, Human
cagagagaggagcgcgcuuccuuuccuccccgcugccgcccacccuggggagagacuuuugcgg

SEQ ID NO: 40944 - RNA, 64 nt, Human
aacuugguucuuaacuaccaugauugcuuuugagggcccggaauuauaaauauauauuauauuu

SEQ ID NO: 40945 - RNA, 64 nt, Human
uccuacacaccaaugaugagccucaugccagugaggcccggagcgcuugggaggggucccagug

SEQ ID NO: 40946 - RNA, 64 nt, Human
uccacagcugcagcugauccauaggacuaccgcaggcccggacucaccaacuugccacauguuc

SEQ ID NO: 40947 - RNA, 64 nt, Human
aaggggcugagugaguucaacuacauguucugggggcccggagauagaugacuuugcagaugga

SEQ ID NO: 40948 - RNA, 64 nt, Human
ugaaggucagcaagauaagcagggccagucucagggcccggagacgaacacggggacaauuguc

SEQ ID NO: 40949 - RNA, 64 nt, Human
ucgcuguccacggaacauggcagaggggcaccccggcccggaaagacgccagagccagcagggg

SEQ ID NO: 40950 - RNA, 64 nt, Human
cuaccacccgugcguuauccagcccgcccggccuggcccggacgcugccaucucucuuucuggg

SEQ ID NO: 40951 - RNA, 64 nt, Human
cugugucugggauaaccucggcuguuuacaguguggcccggagcgucuuggcugccgcccugcu

SEQ ID NO: 40952 - RNA, 64 nt, Human
ugagcgacgcccguccgaucggcguggagcgccgggcccggagcgguggagcgcgcggcugccu

SEQ ID NO: 40953 - RNA, 64 nt, Human
agcuaggccgccccugcccgcccggccccgccgcggcccggacccccagccagccccucacagc

SEQ ID NO: 40954 - RNA, 64 nt, Human
uucacugccuccugcccacagacccaggccugccggcccggacccgucccagccuccccucccc

SEQ ID NO: 40955 - RNA, 64 nt, Human
gaaacgugguccucagugaggcugcugccuggcuggcccggaguccucccuaggagaggggcuc

SEQ ID NO: 40956 - RNA, 64 nt, Human
gaacaccugcucucaccugaaccccaggugaaggggcccggaacaccugcucucaccugagccc

SEQ ID NO: 40957 - RNA, 64 nt, Human
gaacaccugcucucaccugagccccaggugaaggggcccggaacaccugcucucaccugagccc

SEQ ID NO: 40958 - RNA, 64 nt, Human; identical to SEQ ID NO: 40957

SEQ ID NO: 40959 - RNA, 64 nt, Human
gaacaccugcucucaccugagccccuggugaaggggcccggaacacuugcucucaccugagccc

SEQ ID NO: 40960 - RNA, 64 nt, Human
gaacacuugcucucaccugagccccaggugaaggggcccggaacaccugcucucaccugagccc

SEQ ID NO: 40961 - RNA, 64 nt, Human
gaacaccugcucucaccugagcccccggugaaggggcccggaacacuugcucucaccugagccc

SEQ ID NO: 40962 - RNA, 64 nt, Human
gaacacuugcucucaccugagccccaggugaaggggcccggaacaccuccucucaccugagccc

SEQ ID NO: 40963 - RNA, 64 nt, Human
gaacaccuccucucaccugagccccaggugaaggggcccggaacaccuccugucaccugagccc

SEQ ID NO: 40964 - RNA, 64 nt, Human
gaggcccggaaggaaggccaugaccaccacugagggcccggagcaggguggggaggugcagugg

SEQ ID NO: 40965 - RNA, 57 nt, Human
ugagagucacgacagugugagagcagaggcccggaaggaaggccaugaccaccacug

SEQ ID NO: 40966 - RNA, 64 nt, Human
uguauccucauuuguaaucuaguugucaauaaauggcccggacaugucuugcuaacaggauaug

SEQ ID NO: 40967 - RNA, 64 nt, Human
gggcccugggcuccguuuccuucacauuccagcuggcccggaucccucuguggcacagggcccu

SEQ ID NO: 40968 - RNA, 64 nt, Human
uugaguagacacaccagcuccuguugggauggauggcccggauuuuauggcaucuggaacaugg

SEQ ID NO: 40969 - RNA, 64 nt, Human
gccaggaccaagcgagguggaccccgaaacggacggcccggagcccgcaccagccccgcgccua

SEQ ID NO: 40970 - RNA, 60 nt, Human
cccacgcuacggccauguaacccccagcccggcccggaccugaggcguggucugaaagcc

SEQ ID NO: 40971 - RNA, 64 nt, Human
aaaaccaaaaacagacaugggguggguagcugggggcccggacacuugggacccugaccccuuu

SEQ ID NO: 40972 - RNA, 64 nt, Human
uaccugguuccaacuccagacaaccacuaugccaggcccggagccucugaggcaucggccaguc

SEQ ID NO: 40973 - RNA, 64 nt, Human
gaaacccggcagcggccgaccuaggcggucuuguggcccggagccggcccggcccgaaaaccau

SEQ ID NO: 40974 - RNA, 64 nt, Human
gacagcuccgcgcucggggcugggcagaaggggcggcccggacgggggagcuuucccagagacc

SEQ ID NO: 40975 - RNA, 64 nt, Human
ggaggagcucuccagccucggcgccugggcagagggcccggaaacccucggaccagagugugug

SEQ ID NO: 40976 - RNA, 64 nt, Human
agcauaaagguuuuggggaaggaggccguaggccggcccggaggaagcaauuccacuugguuug

SEQ ID NO: 40977 - RNA, 64 nt, Human
agagagcuauugaugauacaagaggaaucaccagggcccggaucuaagaugcccuuagaagacc

SEQ ID NO: 40978 - RNA, 64 nt, Human
uuaaaacuaaaaaggaccagagaauucuuagauuggcccggaaaggccaauaaagaguuagaau

SEQ ID NO: 40979 - RNA, 64 nt, Human
ugccagacccagccagacuuugcccugacggaguggcccggaagcagaggcugaccaggagcag

SEQ ID NO: 40980 - RNA, 64 nt, Human
cggaggaggcaggcggcccccacacugugccugaggcccggaaccguucgcacccggccugccc

SEQ ID NO: 40981 - RNA, 64 nt, Human
gcgucgggcuugggccggccugggguccgccgcuggcccggaggcccuaggagcuggugcugcc

SEQ ID NO: 40982 - RNA, 64 nt, Human
gcaagucgagagggcuguuggacagcugcuugugggcccggaguaaucaggcagccuucauagg

SEQ ID NO: 40983 - RNA, 64 nt, Human
ucuaacugacuucugcuuuccacggcgugugcugggcccggaucuccaggcccuggggagggag

SEQ ID NO: 40984 - RNA, 53 nt, Human
caggcccugaggccauguagccaggcccggaaugggccucucuggacaagagc

SEQ ID NO: 40985 - RNA, 64 nt, Human
uaugagugcguggugcgagugcgugaauauugggggcccggacgcccaggaccccauggcagug

SEQ ID NO: 40986 - RNA, 64 nt, Human
ugagaugauuguggauuauuacagugaagugccuggcccggagcccccagugaugaagcaggaa

SEQ ID NO: 40987 - RNA, 64 nt, Human
ggccucaccaggcccacgaggagcagcagcgcucggcccggagcagcaggaaggccccucugug

SEQ ID NO: 40988 - RNA, 64 nt, Human
cggaacccggacuuguacucggggccgugggcucggcccggacccggcauucggacuuggacuc

SEQ ID NO: 40989 - RNA, 64 nt, Human
uggcauccggacuuggacucggggccaugggcuuggcccggacccggaacccggacuuguacuc

SEQ ID NO: 40990 - RNA, 64 nt, Human
cccucccaguaguagccaguagggccgugggcucggcccggaccuggcauccggacuuggacuc

SEQ ID NO: 40991 - RNA, 64 nt, Human
aauguugcccuggucgccgccgcgguggggcgcgggcccggaggaggcgcccgagggaccaggc

SEQ ID NO: 40992 - RNA, 64 nt, Human
aguucugggauuacgggcgugagccacuucacccggcccggagcgguguauuuugauugcuggu

SEQ ID NO: 40993 - RNA, 64 nt, Human
guguggaggcagcagcggcaccucgagagagaagggcccggagggugucuccccaagccaggca

SEQ ID NO: 40994 - RNA, 64 nt, Human
gagacucagcaacgacccauaccucagacccgacggcccggagcggagcgcgcccugcccuggc

SEQ ID NO: 40995 - RNA, 64 nt, Human
cggcugcagguagcggugccuuucccgccgccuuggcccggaaccaaggugggccaagguccgc

SEQ ID NO: 40996 - RNA, 64 nt, Human
uaaccaucauccauaugggccguguggugaugcuggcccggaaggcagaaagaggcagcauggg

SEQ ID NO: 40997 - RNA, 64 nt, Human
ccagcccucccucccacacugccccagcagggcuggcccggagacugggcagcuaagugggcgc

SEQ ID NO: 40998 - RNA, 64 nt, Human
cacagcaagcagcaggaccgcugcccaguccucaggcccggaggggcaggccuagcuucuccca

SEQ ID NO: 40999 - RNA, 64 nt, Human
agcugcugcuucacggcgucuccacugugcgauuggcccggagccccgaagacucggagggagc

SEQ ID NO: 41000 - RNA, 64 nt, Human
ugccccccgaagggccaaaugccaaguccacugaggcccggaccccggacugcgucuccccagc

SEQ ID NO: 41001 - RNA, 64 nt, Human
gggaggagggcgcacgggcugagcggauaggggcggcccggagccagccaggcaguuuuauuga

SEQ ID NO: 41002 - RNA, 64 nt, Human
cugggaggggagagccuggccagggcugguguugggcccggagcagcaucuuccggugcuaucc

SEQ ID NO: 41003 - RNA, 64 nt, Human
cugaugcauggaggauggugugagcuuuucagcaggcccggaaagguacgcaggugacgccuua

SEQ ID NO: 41004 - RNA, 64 nt, Human
ucugaaaccuggucuuacuguccauguguguuugggcccggauggucaggguggggagcaggga

SEQ ID NO: 41005 - RNA, 64 nt, Human
acuuguaggcggccaaggccgccugugcugacgaggcccggagcugcuccugcugcuggcaaca

SEQ ID NO: 41006 - RNA, 64 nt, Human
uuugagaaugauuucuauauggaauuucuuuucaggcccggaaugggaaaaucuauuccaaaga

SEQ ID NO: 41007 - RNA, 64 nt, Human
gccaugcugaaagggaggcuggcaguggucauuuggcccggaucuaacauggcaccucgucucc

SEQ ID NO: 41008 - RNA, 64 nt, Human
cugggccaggggcuuugaggagaggguaaacauaggcccggagauggggcugacaccucgagug

SEQ ID NO: 41009 - RNA, 54 nt, Human
cuuuggaguccacucugugacaggggcccggagcccagcgcccuccucuucucc

SEQ ID NO: 41010 - RNA, 64 nt, Human
ccugggcccugagauccuccacggucagcgccggggcccggagauggagcugggacgagugugu

SEQ ID NO: 41011 - RNA, 64 nt, Human
ccuccccgcuggccauagcauuaagcccucgcccggcccggacacagggaggacgcucccgggg

SEQ ID NO: 41012 - RNA, 64 nt, Human
gagcggggcaggacuuccaggaggaccccaacccggcccggagagggaggaggaggccuccagg

SEQ ID NO: 41013 - RNA, 64 nt, Human
uuccuucggggaccagcccacagcacaccaagguggcccggaagaaccagaagugcagccccuc

SEQ ID NO: 41014 - RNA, 64 nt, Human
gagcacaguuugagaucaugcugaaggccaagcaggcccggaacucccaguuugacuuucugcg

SEQ ID NO: 41015 - RNA, 64 nt, Human
gugacagaguagaagcuggagugccucaccacacggcccggaaacagcgggaaguaacuggaaa

SEQ ID NO: 41016 - RNA, 64 nt, Human
uggcaaaauacuggugaugcucccuagagcaggaggcccggaagugcugacgcagccaucagcc

SEQ ID NO: 41017 - RNA, 64 nt, Human
uccgcggcgauggcgcugcgcuaaugacgucauaggcccggacucgcgugagugcgcgugcguu

SEQ ID NO: 41018 - RNA, 64 nt, Human
cagauuugagggacgaggucaaggagauaugauaggcccggaaguugcugugccccaucagcag

SEQ ID NO: 41019 - RNA, 64 nt, Human
gcucugcuguccccuuggcagguccuggccagauggcccggaugcugcuuccgguagggaggca

SEQ ID NO: 41020 - RNA, 64 nt, Human
cuguuuuccagagagaguggcaguagccccauggggcccggagcugcuguggccuccacuggca

SEQ ID NO: 41021 - RNA, 64 nt, Human
ggaggcagcccugguucuaggaugcugaggcccuggcccggacucuggccucccagauccccag

SEQ ID NO: 41022 - RNA, 64 nt, Human
cucuccacgccccaccuguguccccaucucggccggcccggagcucgcccacgcggacccccgc

SEQ ID NO: 41023 - RNA, 64 nt, Human
gcaguuccugccagugcagaucuggagaggagcuggcccggaaggcgugguugugaaagcgccc

SEQ ID NO: 41024 - RNA, 64 nt, Human
ggcaucucugggaaaggaccuggggcuggugaggggcccggaggagccuuugcccgcgugucag

SEQ ID NO: 41025 - RNA, 64 nt, Human
gauggaaaacaagcuucuggugggugcauuuucuggcccggaguugccugcauccacgcuacug

SEQ ID NO: 41026 - RNA, 64 nt, Human
ucacacaucacauucccaugguggccucaagaaaggcccggaagcgccaggcuggagauaacag

SEQ ID NO: 41027 - RNA, 64 nt, Human
cucguugcucggcuuaugggaggccgcccuggagggcccggaggucccaaggucccugggagga

SEQ ID NO: 41028 - RNA, 64 nt, Human
ggccgugggccgcauccaccugggaccccaggguggcccggagucagugggugagguguuccgc

SEQ ID NO: 41029 - RNA, 64 nt, Human
auuugcccacguacccaggucuggguggggcccaggcccggaugcagaggccugcagggccucu

SEQ ID NO: 41030 - RNA, 64 nt, Human
cccucacgugcuuggccucaaugcaggccugcugggcccggacguggcugucguccucaucacc

SEQ ID NO: 41031 - RNA, 64 nt, Human
gccguaaauaggcucaucuaccucuaccucugggggcccggacggcugcugcggaaaggaaacc

SEQ ID NO: 41032 - RNA, 64 nt, Human
gguuggggguaagacuaggcuggggcauucugggggcccggaggucuccguugcuucuugguug

SEQ ID NO: 41033 - RNA, 64 nt, Human
cgccugggcaccgggacccccucaccauccagugggcccggagaaaccugaugaacaguuuggg

SEQ ID NO: 41034 - RNA, 64 nt, Human
ccggaagugacuugcuccagacaagaggugaccaggcccggacagaaauggccugggaaguagc

SEQ ID NO: 41035 - RNA, 64 nt, Human
ggcagauguggggauguuuugacauuuacaggagggcccggagaaacugagguauggccaugcc

SEQ ID NO: 41036 - RNA, 64 nt, Human
gauuggcugggaggccgcgggagggaggccaggaggcccggaccaguugggaggagugagcagg

SEQ ID NO: 41037 - RNA, 64 nt, Human
agccgccgcgucccggcgcuuuccaggagccccaggcccggaggaggcgaagcccgcagagcaa

SEQ ID NO: 41038 - RNA, 64 nt, Human
agcgugcccgggaacugacgccccgcggaggccuggcccggagcccggccacacuccgaguccu

SEQ ID NO: 41039 - RNA, 64 nt, Human
ccaaaccuccagccucccugucuccagcugccugggcccggaagggcuuugguuccuucucugg

SEQ ID NO: 41040 - RNA, 64 nt, Human
auagccagcucccccuccuucaccuaguggucaaggcccggagcuggaaagccggguuggggug

SEQ ID NO: 41041 - RNA, 64 nt, Human
gcagcaaugucaccuuguagccuaugcgcucaauggcccggaggggcagcaaccccccgcacac

SEQ ID NO: 41042 - RNA, 64 nt, Human
agggacaaaggagauuggaugacugggaagcgcuggcccggaacagccccugcaacuguggggc

SEQ ID NO: 41043 - RNA, 57 nt, Human
gcuccagugccgaccgcugagccuccuggcccggaccccuuacacccugcauuccag

SEQ ID NO: 41044 - RNA, 50 nt, Human
ucacgcggccggccaagugaggcccggagaccccggcccgaggcgcccag

SEQ ID NO: 41045 - RNA, 64 nt, Human
ggcccagccucggcugccagaggugccuuugcuaggcccggagccguuggcccgggccggccuu

SEQ ID NO: 41046 - RNA, 64 nt, Human
acucaagaguuagagcagguggcugcaggccuugggcccggagggaaggccacugccggccacu

SEQ ID NO: 41047 - RNA, 64 nt, Human
ccguggagagaagccgccgcccgggcugcugagaggcccggagagggacucuguccccggggag

SEQ ID NO: 41048 - RNA, 64 nt, Human
ccuuucccuugcaggccucuggagccucgugccuggcccggacaucuggucccucagaguggca

SEQ ID NO: 41049 - RNA, 60 nt, Human
gggacucauggaagagaugaacgccaugcuggcccggagaaggaaagccacgcaaguugg

SEQ ID NO: 41050 - RNA, 64 nt, Human
aggauaauuucauauuucauggaaauaaacucagggcccggagcgguggcucacaccuguaauc

SEQ ID NO: 41051 - RNA, 64 nt, Human
ggcgcagaggcggcccgaaugcagcccugguucaggcccggaggaggguuugcggguaguugca

SEQ ID NO: 41052 - RNA, 64 nt, Human
caggccccacggggccccuucaggggcugaacgcggcccggaccgggaacggaggcggccagcg

SEQ ID NO: 41053 - RNA, 64 nt, Human
gcucgcccaggauggagaggcgggucccaggcccggcccggagcgagucccccagggccugucg

SEQ ID NO: 41054 - RNA, 64 nt, Human
gauuaggucucuguugacuggcugugugaccuuaggcccggagcugccccucucugggccucag

SEQ ID NO: 41055 - RNA, 64 nt, Human
ggacuccugggucccugggaaagaggguacuaggggcccggauccaggauucugggaggcuuca

SEQ ID NO: 41056 - RNA, 64 nt, Human
agugcugggauuaccggcgugagccaccaugccuggcccggauaauuuuuuuuaauuuuuguag

SEQ ID NO: 41057 - RNA, 64 nt, Human
ugcgcuccuccggcgcugcucccuggcucccggcggcccggaggcccgcggggugggaaggccg

SEQ ID NO: 41058 - RNA, 64 nt, Human
ccaccuuccugaaccuuccccugccacuccaggcggcccggagagaggagccucuucgauuugu

SEQ ID NO: 41059 - RNA, 64 nt, Human
cugcccaugacccucucguggggacccccggcccggcccggaacuuuucuccccaacccccaaa

SEQ ID NO: 41060 - RNA, 64 nt, Human
agucguggccgguccuggcccccgcccuugccccggcccggacucccugucccacgucccuagu

SEQ ID NO: 41061 - RNA, 64 nt, Human
uacucacuaagauauaaaacagcucuuuuuccaaggcccggaguacuggggauugauguuucaa

SEQ ID NO: 41062 - RNA, 64 nt, Human
gagcccagcugucgguccccagcccugcccggcgggcccggagccagagccgcgaggagcaggc

SEQ ID NO: 41063 - RNA, 64 nt, Human
gccuccgccccugagcugucccgugucagucccuggcccggagccaggcucucugugcuacuua

SEQ ID NO: 41064 - RNA, 64 nt, Human
agguccugaggccugggguugggguggagggugcggcccggaguuguccaucuguccaucccaa

SEQ ID NO: 41065 - RNA, 64 nt, Human
gcaugcuccgacacagcagggaagcuccuccuguggcccggacacccauagacggugcgggggg

SEQ ID NO: 41066 - RNA, 55 nt, Human
aggucuucaccugcaagugaggccaggcccggaggcggccgcgggcacccuggaa

SEQ ID NO: 41067 - RNA, 64 nt, Human
guguauugacuggucccccaugggcugcuggaaaggcccggagaugcaucuguggccuggggcc

SEQ ID NO: 41068 - RNA, 64 nt, Human
gccgcagaccccggacgugucaggcauccccgcaggcccggagcgauggcagccuugaugaccc

SEQ ID NO: 41069 - RNA, 64 nt, Human
gggaucacccccgccgacggccccgggccccgacggcccggaaguuccgcguguccgggggcac

SEQ ID NO: 41070 - RNA, 64 nt, Human
ugcacacuuccagaggcagugggaacugcucagaggcccggacucuccuaugugacuuuagugc

SEQ ID NO: 41071 - RNA, 64 nt, Human
uuugaguggguuuccuuuccuccccuauucccggggcccggacgacuucugcuugggaacugcc

SEQ ID NO: 41072 - RNA, 64 nt, Human
gaccugcuccccugucucuucuccgugaccuuucucuagccagggagaagggagagcaggagua

SEQ ID NO: 41073 - RNA, 64 nt, Human
ccugauuaauggaggcuuagcuuucuggauggcaucuagccagaggcuggagacaggugcgccc

SEQ ID NO: 41074 - RNA, 64 nt, Human
ugucuaaauauuuuuuauaaauagugaagauacgucuagccagaccuaauguucaaaaauaaau

SEQ ID NO: 41075 - RNA, 64 nt, Human
gcagguucauaaauuuccuuggucauuucugcccucuagccacaucccucuguuccucacugug

SEQ ID NO: 41076 - RNA, 64 nt, Human
uagacacaguaagaaccuaguaaauauuacuguuucuagccaucagggagauuguggaacuccu

SEQ ID NO: 41077 - RNA, 64 nt, Human
uuuuugauccaucuauuucucucacuccuggcuuucuagccacauucugcaccuccuuccugcu

SEQ ID NO: 41078 - RNA, 64 nt, Human
ccaucacucuccauacucuuucuugugauucuccucuagccauauauaugggccccaucucugu

SEQ ID NO: 41079 - RNA, 64 nt, Human
caggaggagcuucggaggaccaucgccccacuggucuagccaucaugacaccucuggagguguc

SEQ ID NO: 41080 - RNA, 64 nt, Human
agucggccccacaugggaaccuaguacucucugcucuagccaggagucugugcucuuuuggugg

SEQ ID NO: 41081 - RNA, 64 nt, Human
acaggugcuauuauucagaaaaaaacuggucagcucuagccaacagugagguuucuuuucuucu

SEQ ID NO: 41082 - RNA, 64 nt, Human
ugggggaguggccacagaaaauucuucuccacuuucuagccagaggagagaggacccccugaau

SEQ ID NO: 41083 - RNA, 64 nt, Human
acaaucacuacaagucagcuccagcuuucugccaucuagccagccccucuuccccaaugcucca

SEQ ID NO: 41084 - RNA, 64 nt, Human
ugaggcaagcaauucuaagaucuuccacaaaacaucuagccaacuaaaauggagagaugaauca

SEQ ID NO: 41085 - RNA, 64 nt, Human
uuuuuguuucccagacccaugacaacagagagcaucuagccaugauggaaaggaucuugggucc

SEQ ID NO: 41086 - RNA, 64 nt, Human
uagggcugucgaauagaggaggagagagaaauggucuagccaggguuacaagggcacaaucaug

SEQ ID NO: 41087 - RNA, 64 nt, Human
auuuuacagucaucuuauuaccugccagggcucaucuagccauggcaauguuugccuugaaugg

SEQ ID NO: 41088 - RNA, 64 nt, Human
gggacaaacagcuguagcauccccuuagcaucuuucuagccaaugagcccccuccccaggagga

SEQ ID NO: 41089 - RNA, 64 nt, Human
agggagcauuccaguaucaugcaggguccugugaucuagccaggagcagccauuaaccuaguga

SEQ ID NO: 41090 - RNA, 64 nt, Human
aucucgcugcaucccccgagaguacaccgguugcucuagccaccugcggcccgcccaucugcgc

SEQ ID NO: 41091 - RNA, 64 nt, Human
uuuuucuucagaaucacaagugacuaaauugccuucuagccauuuuuucuuguaaaaaaagugu

SEQ ID NO: 41092 - RNA, 64 nt, Human
guuaaucuuccagacuguauuuuguuuuuuccuuucuagccacaugacuguggcauugcacaaa

SEQ ID NO: 41093 - RNA, 64 nt, Human
aguuuccccucaugaucuggccucugcccccuucucuagccacagccucuaguacacuuuagca

SEQ ID NO: 41094 - RNA, 64 nt, Human
cugguaccacaguccucacgauggugcagugauuucuagccaggcgucaagaugcgcugcuuuc

SEQ ID NO: 41095 - RNA, 64 nt, Human
uucgucauaucaggaugaccucgagagcugaggcucuagccaccuaaaaccacgugcccaaacc

SEQ ID NO: 41096 - RNA, 64 nt, Human
uuugcuuaaugcuucugcuaaguguuagccaaaaucuagccauuuauauuuaguuguguaaacc

SEQ ID NO: 41097 - RNA, 64 nt, Human
uauuuuuaaauguucuaacauaagaccuguucucucuagccauugauuuaccaggcuuucugaa

SEQ ID NO: 41098 - RNA, 64 nt, Human
uaagggacgaaacugcgaacuccuuaaagcucuaucuagccaaaccgcuuacgaccuuguauau

SEQ ID NO: 41099 - RNA, 64 nt, Human
guguguggggugcaguuuuuaaaaaucagagcgcucuagccacuacuugguagaaaguagcauu

SEQ ID NO: 41100 - RNA, 64 nt, Human
acacuccaggaccucucccggaucugucuccuccucuagccagcaguauggacagcuggacccc

SEQ ID NO: 41101 - RNA, 64 nt, Human
ugauuaauauuuaaugagggaagguaggggagaaucuagccauuuuauaaugccagaaaucuau

SEQ ID NO: 41102 - RNA, 64 nt, Human
gaauuggcuugaauguucuguggcaauccacaggucuagccaaauauugaaauaggaguuuagg

SEQ ID NO: 41103 - RNA, 64 nt, Human
acaauaauucacugaucacauccauuuuaucuguucuagccaggcauuccaaacaauuucuuau

SEQ ID NO: 41104 - RNA, 64 nt, Human
agcucuagaauuguucccaacccaguccauggcuucuagccaccacuacagggcuguuucaugu

SEQ ID NO: 41105 - RNA, 64 nt, Human
ggcucacuuaaauacauguuuguauauacuguauucuagccagaauaauuuuagaucugaucag

SEQ ID NO: 41106 - RNA, 64 nt, Human
cuggguaguuuuugaaguuuuuuuguagagguggucuagccauguugccuaggcucccgaacuc

SEQ ID NO: 41107 - RNA, 64 nt, Human
ucugaccacagugcccaguccugccccacagggaucuagccacccuucaguggccccaaggcca

SEQ ID NO: 41108 - RNA, 64 nt, Human
uauucaauccuguccuggguagggcgaaaguuaaucuagccaugugauuuuucagaaaaguaag

SEQ ID NO: 41109 - RNA, 64 nt, Human
aacuguucaguggccugugaacugucuuccuuguucuagccaggcuguucaagacugcucucca

SEQ ID NO: 41110 - RNA, 64 nt, Human
ucuuaccagugugaccacacuguuacgaugcaauucuagccaaaaaaaaaaaaaaaaaaaaaaa

SEQ ID NO: 41111 - RNA, 64 nt, Human
uguuacuuuuuuaaaaugaauuuuuuuaaaacaaucuagccaucaucaaggugcuauaagaguu

SEQ ID NO: 41112 - RNA, 64 nt, Human
uucuuccaaguuccuagaggccuuaauuauucauucuagccacuaggugcauagaauuugagau

SEQ ID NO: 41113 - RNA, 64 nt, Human
gcuuauaacauguaugcuuuucagaauacaguugucuagccaagccaucaagugucugaaauuc

SEQ ID NO: 41114 - RNA, 64 nt, Human
ccacagugaacccuuggauuaccugguggcuuuuucuagccagauuugcauuaauccuuacuga

SEQ ID NO: 41115 - RNA, 64 nt, Human
gacauuuccuucuuugucuuagcuguauacagauucuagccaaacuauucuauggccauuacua

SEQ ID NO: 41116 - RNA, 64 nt, Human
ggguuuuauaaguugauuaaacaucaaaucagaaucuagccaagcaggaauuauauugaaauaa

SEQ ID NO: 41117 - RNA, 64 nt, Human
uuuuccucuggagagacagaucugaauguucaguucuagccaagguagauuuuacuuucaacuu

SEQ ID NO: 41118 - RNA, 64 nt, Human
gcccugugugucuugguuuaguuaugguuucauuucuagccauacaauugaugaauuguguaca

SEQ ID NO: 41119 - RNA, 64 nt, Human
caugaagacgugccuucugccaugauugugaaguucuagccacguggaacugugaguccauuaa

SEQ ID NO: 41120 - RNA, 64 nt, Human
aacaaaagggauaccauguagaauugugcaauagucuagccagcuagccuuaacaucuaagaaa

SEQ ID NO: 41121 - RNA, 64 nt, Human
uuccuauucacugcacuuuuuuauuguuuuuauuucuagccauaccucagauaauauguuuagu

SEQ ID NO: 41122 - RNA, 64 nt, Human
uaagaccaguguaacagaaagagaauguagccauucuagccaccguuaaaagauacacagugag

SEQ ID NO: 41123 - RNA, 64 nt, Human
cuggucuuccucacuggugauugauaagcuccuuucuagccaguuugugguacuuccuucauuu

SEQ ID NO: 41124 - RNA, 64 nt, Human
agaaaauuaauagagcguuauuccacagaaggccucuagccagagaucuugaguguagugcaag

SEQ ID NO: 41125 - RNA, 64 nt, Human
ugucaaauggcuuugaagaagugaugccaccaucucuagccauaauaaagaaacagaaucaccu

SEQ ID NO: 41126 - RNA, 64 nt, Human
gcuaauaaacacauggcccuuucccagauuauucucuagccaagccccaccuuuguuacguuga

SEQ ID NO: 41127 - RNA, 64 nt, Human
uucccugcuucaaaauaagagcaguauccuuagcucuagccaagcauuuuucuaauuccugccu

SEQ ID NO: 41128 - RNA, 64 nt, Human
cguauuuaaacaacagcuccccuguauucccccaucuagccauuucggaagacaccgaggaaga

SEQ ID NO: 41129 - RNA, 64 nt, Human
agugaauaguagcaaauuguuuuugcuuugaaaaucuagccauccuacauccuuuggauuucuu

SEQ ID NO: 41130 - RNA, 64 nt, Human
uaaacuaggccaaccugaaagccauggcugaugcucuagccaucagguucuuucaaaugcaucu

SEQ ID NO: 41131 - RNA, 64 nt, Human
gaucagcccuuuuucccauccugcccuaugguucucuagccaccugugcaugcauguguauuuc

SEQ ID NO: 41132 - RNA, 64 nt, Human
guagugauuaauugagaagguagauagaagaaugucuagccaauagguuaaaauuucaaguguc

SEQ ID NO: 41133 - RNA, 64 nt, Human
ugauuuaauggaguugucagcaugaucaucaucuucuagccaggggcauaguugccaaggccau

SEQ ID NO: 41134 - RNA, 64 nt, Human
uugucuaagugcuaacacuguuucagugaaaauaucuagccauaagauuaaaaaaauauauuau

SEQ ID NO: 41135 - RNA, 64 nt, Human
uuuacauuuuuuuauacaaccaaccaguuucuuuucuagccaaucaucucugaagaguugcugu

SEQ ID NO: 41136 - RNA, 64 nt, Human
ggaaauggcuguuuuugcuaauuuuuagcuaauaucuagccaggagagcaagcacauaggacag

SEQ ID NO: 41137 - RNA, 64 nt, Human
gcugguccuguggaugggauccucuccacccuccucuagccaucccuuggggaaggguggggag

SEQ ID NO: 41138 - RNA, 64 nt, Human
ucucugcccagaugguagguugauauuucuggacucuagccaagaaaaagcuaauucuggggau

SEQ ID NO: 41139 - RNA, 64 nt, Human
gcugcuaucucaaccagaugcccaggacaggugcucuagccauuaggaccacaaauggacaugu

SEQ ID NO: 41140 - RNA, 64 nt, Human
uaauguaauauuuuaauagcaaagauaucaugacucuagccacagccuaaccaaggauuaucaa

SEQ ID NO: 41141 - RNA, 64 nt, Human
uguuaaauucgguguauggauuuuaagaaaggaaucuagccaaugagguccaagaaguucucac

SEQ ID NO: 41142 - RNA, 64 nt, Human
uuuuaauggguauuuaauuuuagggagagauuuuucuagccauugaaaauaucuuguuuuuccc

SEQ ID NO: 41143 - RNA, 64 nt, Human
acaaagaacuccacuguggggaugaagcgcuucuucuagccacugcuaucgcuauuuaagaacc

SEQ ID NO: 41144 - RNA, 64 nt, Human
ggauuaacuguucaacuggaaaauuuuuaguuuuucuagccaggugugguggcacacacuugua

SEQ ID NO: 41145 - RNA, 64 nt, Human
gagguuuuagaaauuagcaaguagugcauacccuucuagccacaagugcccaguccaggcaagu

SEQ ID NO: 41146 - RNA, 64 nt, Human
aucccugaguucuguacuguucuguuuuguuuagucuagccacaguucuucacaaaggaaaaaa

SEQ ID NO: 41147 - RNA, 64 nt, Human
agccuuagaaucuguagaggagccuggagucggaucuagccauggcuggcagagguuucuaggg

SEQ ID NO: 41148 - RNA, 64 nt, Human
gaacaucugagaugauucucuacccucauccacaucuagccaagccagugaccuugcucuggug

SEQ ID NO: 41149 - RNA, 64 nt, Human
gggcaauacccuagcauauugggauuaagagcuuucuagccagaaucuggaccuauaccauggg

SEQ ID NO: 41150 - RNA, 64 nt, Human
guuuuuuguggguuuucuuuguuguuguuguuguucuagccaugugacagaggcucuuucuaaa

SEQ ID NO: 41151 - RNA, 64 nt, Human
uucagaaaguccuuagugcaaaccaccauuggaaucuagccagaaaugucugucagauaguuag

SEQ ID NO: 41152 - RNA, 64 nt, Human
gcugagucuagguggagaaaaauaucaacagaacucuagccaaaggcaagccccagaacucaga

SEQ ID NO: 41153 - RNA, 64 nt, Human
gagcacaucacaccagcaccagcucccugucucuucuagccacuuaauggagacacaauggaga

SEQ ID NO: 41154 - RNA, 64 nt, Human
ucaguaggguuccagccacugcuuuuuuguuguuucuagccacuguuuuuuuuuucuuguuucc

SEQ ID NO: 41155 - RNA, 64 nt, Human
aauucccagaguuuacucauucuuguuauuaaacucuagccaguugacaucuucgcaauuucaa

SEQ ID NO: 41156 - RNA, 64 nt, Human
aaauguaagauucugagcucucucucuguuuuguucuagccaugaauuugccugagaaacuugu

SEQ ID NO: 41157 - RNA, 64 nt, Human
cauuuuccuuugggauaauuuauuuccuguggcaucuagccagaagaaauugaggauguuuccu

SEQ ID NO: 41158 - RNA, 64 nt, Human
gccaguuaacuuagagaaaaucuauuuccuuaccucuagccagucacuuccuuuuuccgcaguu

SEQ ID NO: 41159 - RNA, 64 nt, Human
uuucauuuaacaauggauuagaaaaauauuuuggucuagccacuaaacauaaugacugaaaaaa

SEQ ID NO: 41160 - RNA, 64 nt, Human
gugucauugccgauuuuggcuauaacagugucuuucuagccauaauaaaauaaaacaaaaucuu

SEQ ID NO: 41161 - RNA, 64 nt, Human
acaagaauuaaaaucaugugcuguauuuuuaaaaucuagccaaauuaaauaguacaugagaaau

SEQ ID NO: 41162 - RNA, 64 nt, Human
acucaggaaggaggaucgucuuuaccugaggauuucuagccagaggucccagaugccugggcug

SEQ ID NO: 41163 - RNA, 64 nt, Human
auauacagugugcagucccagagccuccuaaaauucuagccauuugucacacaaccacagcaag

SEQ ID NO: 41164 - RNA, 64 nt, Human
ccgccugcuuggagcuggacccagcggcccagagucuagccagcuuggcuccaauaggagcuca

SEQ ID NO: 41165 - RNA, 64 nt, Human
uaacuccauugaucccguaucuuaacgguucacgucuagccaaauaacuguuuuggaauaaaaa

SEQ ID NO: 41166 - RNA, 64 nt, Human
uaucugguguuuuuacuucugccugcguuugcucucuagccaauaaaccguccuugugugcgag

SEQ ID NO: 41167 - RNA, 64 nt, Human
caugucuuucagaauccauguacauauaggcuguucuagccacagugguagauuuaugauucac

SEQ ID NO: 41168 - RNA, 64 nt, Human
aguuaagagauggcauucaaaaacccuaaauuauucuagccaauuugucauaggcauaggcaag

SEQ ID NO: 41169 - RNA, 64 nt, Human
auuuagaugcaaaauccuaaaauugaaaaaaacaucuagccauauccauaaacuauaucaucac

SEQ ID NO: 41170 - RNA, 64 nt, Human
gaggccacacagcagguugguagcaaagaucuugucuagccagggcagcccuuaucagcuugug

SEQ ID NO: 41171 - RNA, 64 nt, Human
aggaagcugaaggagaaaaguacauugaagaagcucuagccaacauguccucacagaccuaugu

SEQ ID NO: 41172 - RNA, 64 nt, Human
gggacccaccccagugaggaaguagauugcugccucuagccagagaccugaacuggggaauuug

SEQ ID NO: 41173 - RNA, 64 nt, Human
uuaaauucugaaaaacugcuuacaauucauguuuucuagccacuccacaaaccacuaaaauuuu

SEQ ID NO: 41174 - RNA, 64 nt, Human
gccucugccguccucaguuuccuuucaugaggcuucuagccaaagaugauaaagggggaaaugg

SEQ ID NO: 41175 - RNA, 64 nt, Human
uuuggaaaaugguauucaaauucuggaauggaaaucuagccaccaaaacggguuaaucaaaaga

SEQ ID NO: 41176 - RNA, 64 nt, Human
ugguccccagccuggagcagagcauuggggagugucuagccaugacgagaagauucccucugca

SEQ ID NO: 41177 - RNA, 64 nt, Human
aauuagccacuuuaaacugcggucaaaagauuuuucuagccaucagaugcaauuacgaugucuc

SEQ ID NO: 41178 - RNA, 64 nt, Human
ccugcucgugcacuccaagcugcuggcauucuacucuagccacagugccagcucccugcgcccg

SEQ ID NO: 41179 - RNA, 64 nt, Human
agccuauuugcacccacaucugcuaauguccauaucuagccaucuauuacaccagcugcugagg

SEQ ID NO: 41180 - RNA, 64 nt, Human
aauugauuaaagugcugcauuuugaugaauuuuuucuagccauuuuuaaagagaaaacuaggaa

SEQ ID NO: 41181 - RNA, 64 nt, Human
uguagucacccugacauccucacaagaaaacaaaucuagccauugcccaaacuuuaaauuugau

SEQ ID NO: 41182 - RNA, 64 nt, Human
acgaaccuagugggacauuuuuagacuuugaugcucuagccauuuuggauuguguaaguugcag

SEQ ID NO: 41183 - RNA, 64 nt, Human
aguauauauauacauauauuuuuuuuguuagaguucuagccauuuuauuucuccgcaggguccu

SEQ ID NO: 41184 - RNA, 64 nt, Human
uaaagccucugacucaaacuccucccuuuuaucuucuagccacaguucuaagacccaaaguggg

SEQ ID NO: 41185 - RNA, 64 nt, Human
cagccaccaccuggauggaucugcuccaugcagaucuagccaggccucccgcaugcugccugcc

SEQ ID NO: 41186 - RNA, 64 nt, Human
cccgccuccaacgggucacacagagaaaccugagucuagccaugaggggcuuaugcucccaacu

SEQ ID NO: 41187 - RNA, 64 nt, Human
acauauucagaguuuuccauuggcagugccaguuucuagccaauagacuugucugaucauaaca

SEQ ID NO: 41188 - RNA, 64 nt, Human
ggguccagucuccccacaccccagcagggugucuucuagccauaaggccaagggaguggcagaa

SEQ ID NO: 41189 - RNA, 64 nt, Human
uaaauaaggggaaauaguaucuuuaaaguuaaugucuagccaagaguuuaguaaacgaagaauu

SEQ ID NO: 41190 - RNA, 64 nt, Human
aauugucaaguaaagcaccucaauucauugacuuucuagccaucuuccuuugauuagcuaacaa

SEQ ID NO: 41191 - RNA, 64 nt, Human
gcagccugaccaaaagugagaugggaagggcuuaucuagccaaagagcucuuuuuuagcucucu

SEQ ID NO: 41192 - RNA, 64 nt, Human
uaaaggaauccauuaccauguccuauaaaugaccucuagccauuuuaugauuauguucucugua

SEQ ID NO: 41193 - RNA, 64 nt, Human
gaaagcuguuuuagauuuuuuuuuuuuuuccuuuucuagccaucuaaauugacucuuccaauau

SEQ ID NO: 41194 - RNA, 64 nt, Human
gcgagauggagcaggcccaucugccucugcccuuucuagccaagguuauagcugcccuggacug

SEQ ID NO: 41195 - RNA, 64 nt, Human
caggcaggaacaauccucagaggggaagugcccaucuagccauugacucaugaccugggucaaa

SEQ ID NO: 41196 - RNA, 64 nt, Human
gguucugagacacuugggggaauuguggggauauucuagccaccaguucucuucuuccuuugcu

SEQ ID NO: 41197 - RNA, 64 nt, Human
aauuuuauuaaaaaccagcaaauuaauuuuaaucucuagccauaaaaacauaaguaauaguaag

SEQ ID NO: 41198 - RNA, 64 nt, Human
auauauucccaaaacaaguacaucugcgaucaacucuagccaaauuugccccugugugcuacau

SEQ ID NO: 41199 - RNA, 64 nt, Human
auuggccccacuguaacuuuugggggcuucccggucuagccacacccucggauggaaagacuug

SEQ ID NO: 41200 - RNA, 64 nt, Human
auucuuuuuugcaggaagguuugcucuucagucaucuagccacuaaauguuaauuaucugauac

SEQ ID NO: 41201 - RNA, 64 nt, Human
ggcaccaaauaaauccaucuagcugguaguuuuaucuagccaaauaauuuaaccuagcucccag

SEQ ID NO: 41202 - RNA, 64 nt, Human
guuggcaucuuuuuaauaccaggaacccagcggcucuagccacugagcggcuaaaugaaauaaa

SEQ ID NO: 41203 - RNA, 64 nt, Human
uuuguccuuuuuuucccucucuccaccccuguccucuagccacagcauuuuucuuuuugucuuu

SEQ ID NO: 41204 - RNA, 64 nt, Human
gauucccccaugcacauugccuuaucucuccccaucuagccaggaaucuauuguguuuuucuuc

SEQ ID NO: 41205 - RNA, 64 nt, Human
uuauaauuauuaguggcaacagagucagugcuaaucuagccaaauuacauauguauaauauauu

SEQ ID NO: 41206 - RNA, 64 nt, Human
gaacucuggggaaaggagaaccggcuaggugggcucuagccacacaaagggaagcaggccugcc

SEQ ID NO: 41207 - RNA, 64 nt, Human
cuggggcggaaucugugcugucuagguuugugcuucuagccaugcccauucccgcccccaccau

SEQ ID NO: 41208 - RNA, 64 nt, Human
guuaaaagcagcuaaccaggucuuuagaauaugcucuagccaagucuaacuuuauuuagacgcu

SEQ ID NO: 41209 - RNA, 64 nt, Human
aauuaguauuuuuauguaugguuaaaccuuggcgucuagccauauuuuaugucauaauacaaug

SEQ ID NO: 41210 - RNA, 64 nt, Human
agauagauggcuuaauaaaauagcauuaggucuaucuagccaccaccaccuuucaacuuuuuau

SEQ ID NO: 41211 - RNA, 64 nt, Human
auccuucagaugcuggcuagaauccccuuugacuucuagccauaagcuggccacauuggacauc

SEQ ID NO: 41212 - RNA, 64 nt, Human
uacaauguuuuugcaacauaugagagaagauaguucuagccaugcaauuuuguuuacuagaauu

SEQ ID NO: 41213 - RNA, 64 nt, Human
gccccucagugacuuccuugggugauccugacuuucuagccauuaauaaagagaacugcuccua

SEQ ID NO: 41214 - RNA, 64 nt, Human
ugggagcucaggguguuuauguccaccugucuggucuagccaaacaguuuuuuucugggaauca

SEQ ID NO: 41215 - RNA, 64 nt, Human
ugguuauccugauuugcaaagugaucaaaagcauucuagccaugugcaaccaaacaccaccaaa

SEQ ID NO: 41216 - RNA, 64 nt, Human
ggacauuauggcagcuuuagaaggcugucuuguuucuagccaagggagagccagcgcagguuuu

SEQ ID NO: 41217 - RNA, 64 nt, Human
guaucauaguaauccuguuuccacuuuguuauacucuagccaagauugacuguauuagaugaaa

SEQ ID NO: 41218 - RNA, 64 nt, Human
accuuauguuagagucauuucugauguuccagcuucuagccauguagugcucucagucuucaua

SEQ ID NO: 41219 - RNA, 64 nt, Human
cuccauuucuauaaaaaauacaaaaaaaaaaaaaucuagccaggcgugguggugcgugccugua

SEQ ID NO: 41220 - RNA, 64 nt, Human
ccaagguuguaacagaagauucaaaacaucccauucuagccacacacaaauaaauaucugcggc

SEQ ID NO: 41221 - RNA, 64 nt, Human
cuuuucauguagaacucagcaguugacauccaaaucuagccagagcccuucacugccaugauag

SEQ ID NO: 41222 - RNA, 64 nt, Human
augccucaucugcaggguccugugccucugaaguucuagccaugagguuuccagguaggacagc

SEQ ID NO: 41223 - RNA, 64 nt, Human
gggaaaaaacuuuggaaaguguguuaccuauauuucuagccaacuaacucacagaaaaacuguu

SEQ ID NO: 41224 - RNA, 64 nt, Human
agcaugccuuauuuagccucuccuguaagggugaucuagccagguacauuuuaaacaaugcuuc

SEQ ID NO: 41225 - RNA, 64 nt, Human
uguauaguaauauuaagcaauuucuaguuauuauucuagccaguaauggacuucagaaucuuuu

SEQ ID NO: 41226 - RNA, 64 nt, Human
uuaaaaaauuuguuucugugacaauguuuguaaaucuagccaauagagucauuuacagaagaaa

SEQ ID NO: 41227 - RNA, 64 nt, Human
guggacuaaauuguguaucugggaguucucacuuucuagccaggccugaugaguuaaguuacau

SEQ ID NO: 41228 - RNA, 64 nt, Human
acuuauaccccacccagcucaguuuugucacuuuucuagccaaaggaagaccaguaggaaagca

SEQ ID NO: 41229 - RNA, 64 nt, Human
cagcauguaugagcuuucuucugcuguggagagaucuagccagucccugacuuugcaacagacc

SEQ ID NO: 41230 - RNA, 64 nt, Human
uuugccccgccugugcacaccucacauuccagacucuagccaucucggcaggaucuccuggcuc

SEQ ID NO: 41231 - RNA, 64 nt, Human
gggcagagggugagucacagcccucuccgucugcucuagccaggggcgacguguccccagguuu

SEQ ID NO: 41232 - RNA, 63 nt, Human
aagagcacuuacugccucgcaaauaauaaaaauuucuagccagucaugcuuugcuccugugug

SEQ ID NO: 41233 - RNA, 64 nt, Human
guucuuuauguccguuaauuugauaauuaugaaaucuagccagcgauuucaaaauuuuaaucuc

SEQ ID NO: 41234 - RNA, 64 nt, Human
uaauuacauucacuacuucuaccacuuguguaucucuagccaaugugcuugcaaguguacagau

SEQ ID NO: 41235 - RNA, 64 nt, Human
cucacucagucucugggcaaucaucaucuuugccucuagccaccguagauaaggugugaaggga

SEQ ID NO: 41236 - RNA, 64 nt, Human
uagaccccguguccccggccucagcaccccugucucuagccacuuuggucccgugcagcuucug

SEQ ID NO: 41237 - RNA, 64 nt, Human
uaucauggucucagucauaaucauuagggggaacucuagccaaaugguuuaacuucugccugug

SEQ ID NO: 41238 - RNA, 64 nt, Human
cuauguccuugaccuugguccauuugguuuucugucuagccagguccagguagcccacuugcau

SEQ ID NO: 41239 - RNA, 64 nt, Human
cauguauguguguuucucuacugagccuggggucucuagccagggagaccccaucuuauucacc

SEQ ID NO: 41240 - RNA, 64 nt, Human
caauugugugcuucucuuguuucugugauugcuuucuagccaaagcgaagcuuguacagguuga

SEQ ID NO: 41241 - RNA, 64 nt, Human
cggcacuacuucuauucagcauuguacuugaaguucuagccacagcaguuagguuaggaauuca

SEQ ID NO: 41242 - RNA, 64 nt, Human
guaaugugaccuuuucacugugcaaagggagauuucuagccaggcauugacuauuacaauuuca

SEQ ID NO: 41243 - RNA, 64 nt, Human
ggucuggucugugggccucugaggagaaaacaggucuagccaagacagggacaaaauggggaag

SEQ ID NO: 41244 - RNA, 64 nt, Human
auucccuauuuaauaaauggugcugggaaaacugucuagccauaaguagaaagcugaaacugga

SEQ ID NO: 41245 - RNA, 64 nt, Human
guguugggaguuuggggccgggauggaaguuguuucuagccacugaaagaagauauuucaagau

SEQ ID NO: 41246 - RNA, 64 nt, Human
ugcaggagggcauggccccagguagggggacuguucuagccagcuguggacacauaggaaugcu

SEQ ID NO: 41247 - RNA, 64 nt, Human
cuucuuuugaaaugugaacguccuuccuugacugucuagccacucccucccagaaaaacuggcu

SEQ ID NO: 41248 - RNA, 64 nt, Human
agugugcacugaaacuguguauuaccaagcucacucuagccaacuaaauaaaaaucucuggcag

SEQ ID NO: 41249 - RNA, 64 nt, Human
aguccucaacccggggcucauuucaaacuuauuuucuagccacuccucccagcucuucugugcu

SEQ ID NO: 41250 - RNA, 64 nt, Human
guuccuuuaacuuucgcucuuguucuugccguuuucuagccaccucuuccuuuuccuucuuuau

SEQ ID NO: 41251 - RNA, 64 nt, Human
ugaaaguaaagacaguagucauuguggagaaacaucuagccagauuggagauacuguugugaac

SEQ ID NO: 41252 - RNA, 64 nt, Human
ccuugcaguuaagagugugcccaugugauugaguucuagccaauggagugugagcaaaagugau

SEQ ID NO: 41253 - RNA, 59 nt, Human
gcgaggagacagaugacugaggcccacccucuagccacuuuccccaagcagguagauag

SEQ ID NO: 41254 - RNA, 64 nt, Human
gcuccuucagucuccagcuuccauccuccaguuaucuagccaggaggucccaagaguuaguuuu

SEQ ID NO: 41255 - RNA, 64 nt, Human
ccaaugccuuccacugcuccuuuaugacugcacuucuagccaguagcucugcacaaguuagcuc

SEQ ID NO: 41256 - RNA, 64 nt, Human
uggcaacucagacuucauuaaacaucaguguguuucuagccaauuggaacauaaacauggugcu

SEQ ID NO: 41257 - RNA, 64 nt, Human
auuauauuucuauccuauauuucaugggcuuaccucuagccaauuguuuuuaacugccauguaa

SEQ ID NO: 41258 - RNA, 64 nt, Human
gcuuuggacaggugcacacucucugccucuuaccucuagccaggaggaugccucagucuguuca

SEQ ID NO: 41259 - RNA, 64 nt, Human
gguuccuggauacugacuaacuuggguggguggaucuagccaggagaaagacaguaacaugugu

SEQ ID NO: 41260 - RNA, 64 nt, Human
cgcucugcucucaccugguucgcuuacagauuucucuagccauuaauuugccucucuguguuua

SEQ ID NO: 41261 - RNA, 64 nt, Human
aauggaccagccagggaaacucucgaccuugaucucuagccagugcuuaggcccaauaucugac

SEQ ID NO: 41262 - RNA, 64 nt, Human
uuccaaaacaaaaaccugagcacaguuuugaaguucuagccacucgagcucaugcaugugaaac

SEQ ID NO: 41263 - RNA, 64 nt, Human
gaaagggcuggcuucuguuuaccugcucacuggcucuagccagcccagggaccacaucaaugug

SEQ ID NO: 41264 - RNA, 64 nt, Human
uuagcccccugguaauagcuguaaacuuccaauuucuagccauacgcucagcucauccaugccu

SEQ ID NO: 41265 - RNA, 64 nt, Human
cugaagccaugugggacaguugggcuuuguucauucuagccacggggaugaaagggaucuuuug

SEQ ID NO: 41266 - RNA, 64 nt, Human
aaagguuuguuucccagauuuguaaugguccugcucuagccauuugcaguuuuguuuuagauga

SEQ ID NO: 41267 - RNA, 64 nt, Human
ggaauggagucuccugucccaaucauuuucaaaaucuagccaggcaaauuucuguuauauuuca

SEQ ID NO: 41268 - RNA, 64 nt, Human
ccugagagucuagaggccuuuaguuauaaaggaaucuagccagugaacauaauucuuauuacua

SEQ ID NO: 41269 - RNA, 64 nt, Human
ugaggcaggcaauucuaagaucuuccacaaaacaucuagccaucuaaaauggagagaugaauca

SEQ ID NO: 41270 - RNA, 64 nt, Human
cuuucucaaugaaugaacaaauuagucuguagaaucuagccaccuguuuagccuagucaugugc

SEQ ID NO: 41271 - RNA, 64 nt, Human
ugcuucugaaggccgcuucucguuggguaccguggggggugaacccuagccccagcuuugggag

SEQ ID NO: 41272 - RNA, 64 nt, Human
ccaucaguguguguuggggggaugcuuggcagcugggggugaggagacaacaaaccucgggaac

SEQ ID NO: 41273 - RNA, 64 nt, Human
ggggcgguaggggcugcagggacaaacaucguuggggggugagugugaaaggugcugauggccc

SEQ ID NO: 41274 - RNA, 64 nt, Human
aagucaacaauuuaaaaaugggaagaugaagauugggggugaaucacauuguucaaugucauca

SEQ ID NO: 41275 - RNA, 64 nt, Human
gaagggagucggaaagcugagucucuauggacgggggggugaucuugcuuucaguguucccuca

SEQ ID NO: 41276 - RNA, 64 nt, Human
cacacacccacacugcugcccuggcgggggccaugggggugaugaaugacccuccaacagcccc

SEQ ID NO: 41277 - RNA, 64 nt, Human
gugcugcuuuguguguauguguggcaaauaauuugggggugauuugcaaugaaauuuugggacc

SEQ ID NO: 41278 - RNA, 64 nt, Human
ugaggcugggagccugagccccuucagcuuugaggggggugauacuccaggcuguuuggggugg

SEQ ID NO: 41279 - RNA, 64 nt, Human
gaagauaggacacuuucuacccucugucaguccugggggugacugggaaccagagagguugagc

SEQ ID NO: 41280 - RNA, 64 nt, Human
agccaaggcgaagaagcacgaacgaaugucgagagggggugaagacauuucucaacuucucggc

SEQ ID NO: 41281 - RNA, 64 nt, Human
agaauugcaguucagaauggcaguccuggaggcagggggugaggggcaggucuaguguuccugc

SEQ ID NO: 41282 - RNA, 64 nt, Human
cuugcucccuauucacuuuacacugugaaagguggggggugagucccacuugagcgcuuccugu

SEQ ID NO: 41283 - RNA, 64 nt, Human
cugagccccuccaucugccuauagcaauaggcacgggggugaggacccucacacucucauuuga

SEQ ID NO: 41284 - RNA, 64 nt, Human
uuaagauuguggaauggguguaagacaauugguagggggugaaaguggguuugauuaaauggau

SEQ ID NO: 41285 - RNA, 64 nt, Human
uuauaaggcuuacagcuaggaaagcucuaguucugggggugaaagaaaaauauuaguuuaccug

SEQ ID NO: 41286 - RNA, 64 nt, Human
augcaguccucuaguguuucauguacauucuguggggggugaacaccuugguucugguuaaaca

SEQ ID NO: 41287 - RNA, 64 nt, Human
gggguuuuguuagguuuggaagcagcugucccuagggggugaaguccccccccuuuuuuuuuuu

SEQ ID NO: 41288 - RNA, 64 nt, Human
cucugcccugccucccuuucugggagggcggggugggggugacugaauuugggccucuuguaca

SEQ ID NO: 41289 - RNA, 64 nt, Human
ggaauaaagguugggguggccauaaugguuuguugggggugagggaaaaaacccacagggacca

SEQ ID NO: 41290 - RNA, 64 nt, Human
cuaggcugggcuuggccaccauuaaacacggggugggggugagggccccugcaauucacggugc

SEQ ID NO: 41291 - RNA, 64 nt, Human
gccaccccgugguguaacaaguggaggaggaggagggggugagaacaccuuuccuccagcccug

SEQ ID NO: 41292 - RNA, 64 nt, Human
uuccccccacugcgguguucggccugaagguggugggggugaggggggguuuggccauuagcau

SEQ ID NO: 41293 - RNA, 64 nt, Human
ggcucaucuagccauggcaauguuugccuugaaugggggugaaagccuuucuuuguuggaucaa

SEQ ID NO: 41294 - RNA, 64 nt, Human
ggggacaggcagggaaaagggguuggggccucuugggggugauuucuuuuguuaacaaagcauu

SEQ ID NO: 41295 - RNA, 64 nt, Human
aaggugcuagugggucccuaagagggcccauguugggggugaagucaugagguccugaaggcuu

SEQ ID NO: 41296 - RNA, 64 nt, Human
ccuauggugaccaucuaggagaggggagggcagagggggugaggguacuauucuggauugagaa

SEQ ID NO: 41297 - RNA, 64 nt, Human
aaacuuagguuagugacaaaauuggccagagagugggggugaugaugaccaagaauuacaagua

SEQ ID NO: 41298 - RNA, 64 nt, Human
cagcuuucuuucccaggggugaaggauggcgcucgggggugacuccuaagcucagcguggaagc

SEQ ID NO: 41299 - RNA, 64 nt, Human
guuuuuaacuuguuccucugucuacuguguguuugggggugacaucuaaauuccauuucuucuu

SEQ ID NO: 41300 - RNA, 64 nt, Human
cugcccaggauggccuccucuugacaggcggacagggggugagggggccagggggcaucuccaa

SEQ ID NO: 41301 - RNA, 64 nt, Human
aaacuacauaaggugguugugcuacuguauaauugggggugauaauaccaggaauuuuaauaag

SEQ ID NO: 41302 - RNA, 64 nt, Human
agagaaagagguggucuuaaggggaugcuuccaggggggugaguucaugccucuccuguauuuu

SEQ ID NO: 41303 - RNA, 64 nt, Human
uuguggugagacgucauagucuucaugagaacgugggggugaauuucaugaaggggaacuauag

SEQ ID NO: 41304 - RNA, 64 nt, Human
ucguugugcuccccucccccagagcgggugggcggggggugaauaugguuggccugcaucaggu

SEQ ID NO: 41305 - RNA, 64 nt, Human
gccuugcuccagaaggccuggccgccuucucccugggggugauucaaggauuuggucucggacc

SEQ ID NO: 41306 - RNA, 64 nt, Human
ucaguaacacacccucccugcuccaagugcaccaggaugcaaaugcacagaauucaccaggggc

SEQ ID NO: 41307 - RNA, 64 nt, Human
uguuuuuuguuuuuuaacagaauuauauaugucugggggugaaaaaacccuugcauuccaaagg

SEQ ID NO: 41308 - RNA, 64 nt, Human
gccaucucgcccuugcugggggcacgggaguggggggggugacaugggcccuaggcagacugca

SEQ ID NO: 41309 - RNA, 64 nt, Human
uggcagcuuggggcacccugaauuagcaaaaauggggggugaugaggugcugaagaaggauacu

SEQ ID NO: 41310 - RNA, 64 nt, Human
uauggagagcuuguuacagugguguaccaagguugggggugagccuacccuuucgaggaggagu

SEQ ID NO: 41311 - RNA, 64 nt, Human
uuuggccuuagguauuccugucugggaaaauggagggggugauauuagugguucccuguacuau

SEQ ID NO: 41312 - RNA, 64 nt, Human
gcaauggacagcaggaggcagguuccuggagcuggggggugaccugagaggcagagggugacgg

SEQ ID NO: 41313 - RNA, 64 nt, Human
gucagaugauauaauuuuuuuuuuuuuuuuuugugggggugaagucuugcucugccacccaggc

SEQ ID NO: 41314 - RNA, 64 nt, Human
ccaaaccucuucauauugaagauggauuaggagagggggugaugaccccuccccaagccccuca

SEQ ID NO: 41315 - RNA, 64 nt, Human
aggcuuucucuagaccaacuggaucagaagcucugggggugaggcccaguauucuguguuuuaa

SEQ ID NO: 41316 - RNA, 64 nt, Human
caaugaccccuuaaucugcagcagcucacaggcugggggugaggagucccuggcuucucuuagc

SEQ ID NO: 41317 - RNA, 64 nt, Human
gcucugguuuucuaugcagaugauucauuggauugggggugaguguuuuguuuuucugggggca

SEQ ID NO: 41318 - RNA, 64 nt, Human
agcugaaugucaaacagugccaaaugcuggggcagggggugaagaacccucugucccaccccua

SEQ ID NO: 41319 - RNA, 64 nt, Human
ugcuuccgccaucucacuuaccauggcuagagaugggggugagacuggggaaggacaaaagcag

SEQ ID NO: 41320 - RNA, 64 nt, Human
agaauuguugggaucucauagauggaaugggaaugggggugauauagauaaacuuacuagauau

SEQ ID NO: 41321 - RNA, 64 nt, Human
uuguuagccugagaccaggcuuugcagaggggcggggggugaggcuuagcccagaaggagaacu

SEQ ID NO: 41322 - RNA, 64 nt, Human
uucugggggcugguuggcauuugcuggccuggcagggggugaaggcaggaguugggggcagguc

SEQ ID NO: 41323 - RNA, 64 nt, Human
cuuggccuucuuuuuuggggauggugggagugaagggggugaaucuuaaaagcuuaucaacaaa

SEQ ID NO: 41324 - RNA, 64 nt, Human
uggaguuuuguuuuguugcuccaauuuuuaacuugggggugaaagauuuaagaacucagccuca

SEQ ID NO: 41325 - RNA, 64 nt, Human
uuccguacauuagugguugccuaaggcuagaauugggggugaugaauggggaguacaggauuca

SEQ ID NO: 41326 - RNA, 64 nt, Human
gaacgccagagcccuggcuggugaugugcuggcugggggugaaucccaaugagggucccucuca

SEQ ID NO: 41327 - RNA, 64 nt, Human
gaacgccagagcccuggauggugaugcgcuggcugggggugaaucccaaugagggucccucuca

SEQ ID NO: 41328 - RNA, 64 nt, Human
gaacgccagagcccuggcuggugacaugcuggcugggggugaauccgaaugacagugcagacgu

SEQ ID NO: 41329 - RNA, 64 nt, Human
ccucccugcacgucugugucuucauuucuaaaaugggggugaugcuuucauauugaccucaccc

SEQ ID NO: 41330 - RNA, 64 nt, Human
auagccucaggcuagugaguuugccaaaaccaaagggggugaauacuuccccaagauucuuccu

SEQ ID NO: 41331 - RNA, 64 nt, Human
uaauuuacuuaauggguacaauguacauuauucagggggugaugguuacagcccagacuuuacc

SEQ ID NO: 41332 - RNA, 64 nt, Human
aagggaaaggugagaugaacacugcccccaaggagggggugaaauaugaucuaacuuaugcaag

SEQ ID NO: 41333 - RNA, 64 nt, Human
cgaguccccaaggcugggggccgagccugggaaugggggugaguggagggcuccgacucagggc

SEQ ID NO: 41334 - RNA, 64 nt, Human
uuaagcccugcauuucuccaacugacaagugggugggggugauggcacauucaguguggcuaug

SEQ ID NO: 41335 - RNA, 64 nt, Human
gcuugugugagagugucggugugugugcaugugugggggugagucugcaugugcaccugucaug

SEQ ID NO: 41336 - RNA, 64 nt, Human
ggggugacaccaggagagagggacagguucuguugggggugacaccaggacacaggaauagguu

SEQ ID NO: 41337 - RNA, 64 nt, Human
ggggugacaagaggagacagggacagguucugucgggggugacaccaggagagagggacagguu

SEQ ID NO: 41338 - RNA, 64 nt, Human
ugggugacaccaggagagagggacagguucuguugggggugacaagaggagacagggacagguu

SEQ ID NO: 41339 - RNA, 64 nt, Human
ggggugacaccaggacacagggacagguucugucgggggugacaccaggacacagggacagguu

SEQ ID NO: 41340 - RNA, 64 nt, Human
uggggggcauuuauaauguaugaaaguuaaggaagggggugaggauguggguugggacagguag

SEQ ID NO: 41341 - RNA, 64 nt, Human
cccguagcaaacuaauacuagauaauaaggaaaugggggugaaauauuuuuuuauuguugaauc

SEQ ID NO: 41342 - RNA, 64 nt, Human
gucuuuuuuuuuuuuuuuggagucugcuuucugugggggugaggccgggcugucucgugguggc

SEQ ID NO: 41343 - RNA, 64 nt, Human
agaccaugguguuucucuauguuucucuaaguuggggggugagcgugugugacagucuacugga

SEQ ID NO: 41344 - RNA, 64 nt, Human
cacccgugugugcaaugccuuuuucugggggguggggggugagggaaaaccugguagugaaugu

SEQ ID NO: 41345 - RNA, 64 nt, Human
uguauuacacuuacacauacaaacacauauaagagggggugaaaaccguagccuuugcauucuc

SEQ ID NO: 41346 - RNA, 64 nt, Human
gauugggcacaacuaaggcuuuccugagcaggaagggggugaagaccaaucccuuccuuugguc

SEQ ID NO: 41347 - RNA, 64 nt, Human
ggacuggacuuggcuuauuucuuccugucucguagggggugaguugaguguggcugggagagug

SEQ ID NO: 41348 - RNA, 64 nt, Human
gugggcuacucccugcucagcgcuccccugggaagggggugaggagaugaaaaugaaacuauga

SEQ ID NO: 41349 - RNA, 64 nt, Human
uacuugagccuuuuucucggugggggguggggaggggggugagaagacaagaugaagaaaagcc

SEQ ID NO: 41350 - RNA, 64 nt, Human
cugucacacacuggaccccacuggcugagaaucugggggugaggaggacaagaaggagaggaaa

SEQ ID NO: 41351 - RNA, 64 nt, Human
cacaggaggcaaaacauaacuguaaguuuagaaugggggugagaggcugucaucuggagggaga

SEQ ID NO: 41352 - RNA, 64 nt, Human
cuaaauggggccaugaagaaggcuggaagggacagggggugauggcagccuaccuggugucccc

SEQ ID NO: 41353 - RNA, 64 nt, Human
agcucaagcagcgaccgcccccuccucuagcugugggggugagggucccaugugguggcacagg

SEQ ID NO: 41354 - RNA, 64 nt, Human
guaaaguucuguacauaguucccaagcuucugcagggggugauuuuugcucuuguccugagaaa

SEQ ID NO: 41355 - RNA, 64 nt, Human
acaugcugagcauucauuuugcguccucuggguuggaugcaaugugagaggauggcaugccaga

SEQ ID NO: 41356 - RNA, 64 nt, Human
gcccaaguugcagugagcaggguggggucugggagggggugagaggcaggaaugggggucagaa

SEQ ID NO: 41357 - RNA, 64 nt, Human
cauagucacaaguuuuguuauuuuguuuuuuuuugggggugaugguguaauuguuaaccucauu

SEQ ID NO: 41358 - RNA, 64 nt, Human
cagcccagguaguuggugugucucaauaugaauagggggugaguagcuucauagaaagaauggg

SEQ ID NO: 41359 - RNA, 64 nt, Human
auucagcaauugcuguucugugugugccugcccugggggugaugucagagguuguaagggaaga

SEQ ID NO: 41360 - RNA, 64 nt, Human
cugacaagucagcugacucaaccucacagagucagggggugacaaagccagacuggggcucagg

SEQ ID NO: 41361 - RNA, 64 nt, Human
ugaccgucuguccuucaggagaggacaccagggugggggugaaggagacacuacugcccccacc

SEQ ID NO: 41362 - RNA, 64 nt, Human
ugccacauucugaccaugagacgcggcuugcagugggggugaacgcacauaaaaagggaccacu

SEQ ID NO: 41363 - RNA, 60 nt, Human
cuuacuuucccucgggaugaaggugaacaugggggugagacugaagccugaggaauuaaa

SEQ ID NO: 41364 - RNA, 64 nt, Human
uucuuaagccuauggaaccggcuuugcuguucuggggggugaaaauagacuaacuacuggagaa

SEQ ID NO: 41365 - RNA, 64 nt, Human
gccaaagcaggucagaagagggagaggaggggcugggggugaggggccaggccauggccaaggg

SEQ ID NO: 41366 - RNA, 64 nt, Human
ggccucuggggugcacauggggugggaaugcuccgggggugacacaggccacgguggcuccagc

SEQ ID NO: 41367 - RNA, 64 nt, Human
acgcacagaaucagacacuacaaacaccugccuugggggugaagugaaggcccagccuccccac

SEQ ID NO: 41368 - RNA, 64 nt, Human
cuccaggccuaacuuggagcaugucacuggccaugggggugaggggacagacucugcucucacu

SEQ ID NO: 41369 - RNA, 64 nt, Human
uuuguauuucaagccauuuucaaauaacuaucuugggggugagaggagaaggagggagggaaaa

SEQ ID NO: 41370 - RNA, 64 nt, Human
ccugggcugcgcccacuugucuuccuggauauuugggggugacucgccaugcuuggcacccucu

SEQ ID NO: 41371 - RNA, 64 nt, Human
uugacugcauuaacuuaacuuacggggugggggcgggggugaggguaggugcuuuuuucuuaug

SEQ ID NO: 41372 - RNA, 64 nt, Human
ucaacauguuucaagacgcuguguuagacacuagggaugcaaagaugaaugagauaaggccuca

SEQ ID NO: 41373 - RNA, 64 nt, Human
gccggacguccuacucaggcugucggggcuuggugggggugacuuuuggcagcccgagacccag

SEQ ID NO: 41374 - RNA, 64 nt, Human
cauggugggcuugugguggcugcuccaugagggugggggugauacuacuagaucacuuguccuc

SEQ ID NO: 41375 - RNA, 64 nt, Human
cuccaguagcugccuccauucucuuuuaaaaaaagggggugauucugaggcacugaagugccuc

SEQ ID NO: 41376 - RNA, 64 nt, Human
aaagggcuucuuugcagucuacgaagccaucugcgggggugaugugaaaaaggacuauggccac

SEQ ID NO: 41377 - RNA, 64 nt, Human
gcagcugccuuauucugaaucccaaaaauuacuugggggugauugucacagaggagggacagaa

SEQ ID NO: 41378 - RNA, 64 nt, Human
guaauuuauuuugucugccacuugaacaguuugggggggugagguuucauuuaaaauuuguuca

SEQ ID NO: 41379 - RNA, 64 nt, Human
cuuuggcuuaaaauguucagcagaauugggcagugggggugacuuuucuuauauuaauaauauu

SEQ ID NO: 41380 - RNA, 64 nt, Human
gcaguucuuacuugcauucccacugccuuucauggggggugacuggguagaggccaggagaaag

SEQ ID NO: 41381 - RNA, 64 nt, Human
uucagacuguugugucuguggaguuuuaggaguggggggugaccuuucuggucuuugcacuucc

SEQ ID NO: 41382 - RNA, 64 nt, Human
uaggggaagaauaucacaggcuaauagcgugguugggggugaagaugauagcaguuauuaaauc

SEQ ID NO: 41383 - RNA, 64 nt, Human
ggcugcccuguagggaaccccagcucuggggcuugggggugagggucagcccuggacagaccuc

SEQ ID NO: 41384 - RNA, 64 nt, Human
ccgaaccucaucuccgaguugggucucugaagacgggggugaggugagguagggagcgcccucc

SEQ ID NO: 41385 - RNA, 64 nt, Human
gacuugagcacgagacacuuuucaucuggagcaggggggugagcuccucagcagccuccguaac

SEQ ID NO: 41386 - RNA, 64 nt, Human
gcuugggcagggucuguuuggacugcagaagcaagggggugauguagcccauccuucccuuugg

SEQ ID NO: 41387 - RNA, 64 nt, Human
acgccagaaggccgggugcccaggagcugaaggugggggugacacugggaggugggagggccag

SEQ ID NO: 41388 - RNA, 64 nt, Human
auuauuuucuaaauuggguuaagucuaagaaggugggggugagcaggggguuuaucugugugua

SEQ ID NO: 41389 - RNA, 56 nt, Human
ucgauauugaugccauuuaaagggauggaugcaaccuagcuuaacaguauaaugcu

SEQ ID NO: 41390 - RNA, 64 nt, Human
uguuuguaucugcgcccagaauucucagugacgugggggugaggguggguggcgauugccuuag

SEQ ID NO: 41391 - RNA, 64 nt, Human
cugagaaagcagagaaguggcgugggagccagcugggggugaagagcauuugggccagucccgu

SEQ ID NO: 41392 - RNA, 64 nt, Human
cgacuugaauauuccuggacuuacaaaaugccaagggggugacuggaaguuguggauaucaggg

SEQ ID NO: 41393 - RNA, 64 nt, Human
auucucuuuuuacagaccaugaaauggaggcucagggggugaagggacugaucaagaucauuca

SEQ ID NO: 41394 - RNA, 64 nt, Human
acuccaggguccugaggccucccaggagggccuugggggugaugaccccuucccugagguggcu

SEQ ID NO: 41395 - RNA, 64 nt, Human
uuucuucguucccugcccacugggcauggcagcugggggugagaggcuggugguugccucccgu

SEQ ID NO: 41396 - RNA, 64 nt, Human
acuuuguguauauguguguguguguguguugggggggggugagugugugcgcgcgugugcauuu

SEQ ID NO: 41397 - RNA, 64 nt, Human
guguaggucucgcuguggguuugcuggggaccaagggggugaugaaaaggggaggggcggagcu

SEQ ID NO: 41398 - RNA, 64 nt, Human
cuucacccuagaagaggagggagggauucugggugggggugacucuucacugauucuuguauau

SEQ ID NO: 41399 - RNA, 64 nt, Human
ccuuaaucccaagggaaaagguuauggaacuggagggggugagcuuucuggguagaaggagacu

SEQ ID NO: 41400 - RNA, 64 nt, Human
gggcuagguucagcuuucucgcgcccucccccaugggggugagacccucgcagaccuaagcccu

SEQ ID NO: 41401 - RNA, 64 nt, Human
cuccaaaggccccaccuccuaauacugucaccuugggggugagaauuccaaugugaauuugcag

SEQ ID NO: 41402 - RNA, 64 nt, Human
cccuggcugaaacccaaucuuucaaaacaugaaagggggugauggagaaaaccuuagcuugguu

SEQ ID NO: 41403 - RNA, 64 nt, Human
ggccgugggcguccagggcgcuaggaagccgggugggggugaggguagcccuugagcccugucc

SEQ ID NO: 41404 - RNA, 64 nt, Human
cacuuauuuaugcagugaccuggucaccuggggugggggugauuugaggaaaugacaugaggaa

SEQ ID NO: 41405 - RNA, 64 nt, Human
aggaaaugcacuguguggagcccgggagguaauugggggugaggaagaugugcgggccagggaa

SEQ ID NO: 41406 - RNA, 64 nt, Human
ccugcguuaaggucccuggagagguggcgucagugggggugaggaagggcaucuuccugacucc

SEQ ID NO: 41407 - RNA, 64 nt, Human
gcuacaauuccuaaucauuuuagacacuuuaggagggggugaaguuguaugauaaagcagauau

SEQ ID NO: 41408 - RNA, 64 nt, Human
aaugaggauugguagggcaauccuaccaauugaugggggugaggagacuguugggcccuuauuc

SEQ ID NO: 41409 - RNA, 64 nt, Human
cggcguuagcacuuuaagcacauccccuaggggagggggugagugaggggcccagagcccucuu

SEQ ID NO: 41410 - RNA, 64 nt, Human
cacuggaacuggagaaugcacuuuauucugggcggggggugagugggggaagacccaacccucc

SEQ ID NO: 41411 - RNA, 64 nt, Human
aaagaauuuaauguuuuugguuguauuuuuuugggggggugagggugggcaaaaacaugggggu

SEQ ID NO: 41412 - RNA, 64 nt, Human
caacagcaagaaauaaaucagagagcaaggcaucgggggugaaucuugucuaacauucccgagg

SEQ ID NO: 41413 - RNA, 64 nt, Human
gguagucgaagagcucugguggcagcguugagaagggggugaguggugccaguugccagggcaa

SEQ ID NO: 41414 - RNA, 50 nt, Human
ugagucagaucagcuccuaagggggugacgccugcccuccccagagcacu

SEQ ID NO: 41415 - RNA, 64 nt, Human
uuuucuuuugggccccgguugggagcaggcuccugggggugagggucugucugagucuguuuuu

SEQ ID NO: 41416 - RNA, 64 nt, Human
ucaccaccggucauucuaacccucacccaggaaugggggugacucgcacaagaccucauggaaa

SEQ ID NO: 41417 - RNA, 64 nt, Human
ggguggggaauaugggagggagugugguguggaugggggugaugcagggacugaggggaacccu

SEQ ID NO: 41418 - RNA, 64 nt, Human
aaaaguacucuuucaggagggacuagaaagagaagggggugauauguuacacaaauuaaagaag

SEQ ID NO: 41419 - RNA, 64 nt, Human
cagacucagccuuucucugcagccauccugcagugggggugagcgggcacaggcugagaacugc

SEQ ID NO: 41420 - RNA, 64 nt, Human
uggaaucaagccccagugcugccugcuugguggcgggggugauguauguggagaaggguugggg

SEQ ID NO: 41421 - RNA, 64 nt, Human
agacuuguggguaacugaucacagaccucagcaugggggugaccagggugacucuucaaucccu

SEQ ID NO: 41422 - RNA, 64 nt, Human
uggggcccagaggagcuggugcugaccuagcuagggaugcaagagugagcaagcagcaccccca

SEQ ID NO: 41423 - RNA, 64 nt, Human
acucucgcugugggacagggaccgggccuggaaagggggugaagggaagugucugaugcacggc

SEQ ID NO: 41424 - RNA, 64 nt, Human
ucagauuuagugcaaguaaaauguuagagggugcgggggugaggacugaccacagauucccugg

SEQ ID NO: 41425 - RNA, 64 nt, Human
gcaccugggcccuggggccuguacugccugcuuggggggugaugagggcagcagccagcccugc

SEQ ID NO: 41426 - RNA, 64 nt, Human
uagugggugggccaugaaacuagagaugggauuugggggugaauuugucaauaucuggauuuua

SEQ ID NO: 41427 - RNA, 64 nt, Human
ugggucgcgugaugcgcaugucacggagggugacgggggugaacuugguucccauuugcuccuu

SEQ ID NO: 41428 - RNA, 64 nt, Human
aguugccagcuugagugaugugcuugggugacuugggggugaccuuuugaccaccgagaggagg

SEQ ID NO: 41429 - RNA, 64 nt, Human
cagcccagagacauacuugaagggccagagccaggggggugaggagcuggggaucccucccccc

SEQ ID NO: 41430 - RNA, 64 nt, Human
guuggagaagaaucuguagcuuguugaaaaagcugggggugaaagggaacaaggaaggugaugu

SEQ ID NO: 41431 - RNA, 64 nt, Human
ccuggcugagccucuguuuuucucucuaggaaaugggggugauaauugugccuaccucagauag

SEQ ID NO: 41432 - RNA, 64 nt, Human
ccccaacugcgacugugaccuagagacuucacccgggggugaagggguaaacccgacugaaacu

SEQ ID NO: 41433 - RNA, 64 nt, Human
gaggugaugugcccaccccucucuaagaccccucgggggugaggggcuccccccuccccuguuu

SEQ ID NO: 41434 - RNA, 64 nt, Human
uaugaagggugcugccgcccgugccaucuggcccgggggugacuuuuugaacuguuuauuauau

SEQ ID NO: 41435 - RNA, 64 nt, Human
ucuuuuuucuccaaucaccagcaucuguuuuucagggggugauuuuacuuuugugaauuccuua

SEQ ID NO: 41436 - RNA, 64 nt, Human
cacguugucccugagauuuaaccccuccacugcugggggugagcuguacucuucugacugcccc

SEQ ID NO: 41437 - RNA, 64 nt, Human
ggaaauaauaauuacuccuccuuaaagcaaaugggggggugagaagucauuaccaaauuuaaag

SEQ ID NO: 41438 - RNA, 64 nt, Human
uggggccggugggagaggcccgggucagagcccugggggugagccugaaggccacagagaaaga

SEQ ID NO: 41439 - RNA, 64 nt, Human
gccggguuucuucuugaagcagcuccugcaaaagggaugcaaagaggucccagggaccugcccc

SEQ ID NO: 41440 - RNA, 64 nt, Human
ugggugcagccgggugcauggcagcccuucuggcgggggugagcgcacgaccaaagucacugga

SEQ ID NO: 41441 - RNA, 64 nt, Human
uucccuuuccugagucccaucccugcgugauuuugggggugaagaguggguugugaggugggcc

SEQ ID NO: 41442 - RNA, 64 nt, Human
gcucaagccaccaaucuaugaagaccucaggccagggggugaggaauuagugcuggauuugaag

SEQ ID NO: 41443 - RNA, 64 nt, Human
ugcauguauuugugugacagggaacucugcagcagggggugacugacacaccaaacaagauguu

SEQ ID NO: 41444 - RNA, 64 nt, Human
cuccucuccgcauccagggccacuuucccucagugggggugagccuggcggcaggcccgaaggu

SEQ ID NO: 41445 - RNA, 64 nt, Human
ugacgcgagcuggccggccgcggcugugcagcgugggggugaaggugaaggcuggggcuccucg

SEQ ID NO: 41446 - RNA, 64 nt, Human
uguccugcuucuucaggugagugcaggccaaggcgggggugagauggcugagcuuccagcgccu

SEQ ID NO: 41447 - RNA, 64 nt, Human
acagaguucagcaauuuugauuaaauuaagacuugggggugaaacuuuccaguuuacugaacuc

SEQ ID NO: 41448 - RNA, 64 nt, Human
aauuccuccccuccuggagcucagugucaggaaagggggugauaaaugacaaucaaaucgacau

SEQ ID NO: 41449 - RNA, 64 nt, Human
uccuccuuccaugucuugagcacuggcucacccagggggugaaaaauucccgccccuguuugca

SEQ ID NO: 41450 - RNA, 55 nt, Human
gggccucccagcagagcugagaggagggggugaccagcuuggagucucugguggg

SEQ ID NO: 41451 - RNA, 64 nt, Human
gaacgaugauaaugaguugggggguggacugcucgggggugauccugccagauucccagaggau

SEQ ID NO: 41452 - RNA, 64 nt, Human
ccaggacaagcugcucagaccuacuuccuugggagggggugacggaaccagcacuguguggaga

SEQ ID NO: 41453 - RNA, 64 nt, Human
uuuugacaggggggaggcgggagggauaguaggugggggugaucugcuugcuucuuuuaccaca

SEQ ID NO: 41454 - RNA, 64 nt, Human
cccauuuucaacuugauccacugaggagagggaagggggugacuuucccuucuucaguaggaaa

SEQ ID NO: 41455 - RNA, 64 nt, Human
uggcuuccugugccuagacuggaccuaauuauaugggggugacuuuaguuuuucuucagcuuag

SEQ ID NO: 41456 - RNA, 64 nt, Human
gauuuaggcaguaucauuuccauuuuauaaguagggaugcaaaauccgugucacuaaacuagug

SEQ ID NO: 41457 - RNA, 64 nt, Human
ucauguguaguccagguuugagaggaacuggaaggggggugaggguggggagguggggcagggc

SEQ ID NO: 41458 - RNA, 64 nt, Human
gucagagauggagaaggcugagugcagcaagguggggggugacugggacccagccuuugggccu

SEQ ID NO: 41459 - RNA, 64 nt, Human
ugacuccauucaucagauccaguuuaugaggguugggggugagcaagggcugucugcagaaacc

SEQ ID NO: 41460 - RNA, 64 nt, Human
cuuccuuccuucugcggccagagccgaggcgggcgggggugagaacaucaaucgucagcgacag

SEQ ID NO: 41461 - RNA, 64 nt, Human
gcccccaauggugcagcugcagcagucaccacuagggggugauggagaggaagggggccacccc

SEQ ID NO: 41462 - RNA, 64 nt, Human
ugaaugaagccuucugaccugggcuggcacugcugggggugaggacacauugccccaugagaca

SEQ ID NO: 41463 - RNA, 64 nt, Human
guuggacaccauaagccacagccucacaggaagugggggugaggagccugcggugcuccccaga

SEQ ID NO: 41464 - RNA, 64 nt, Human
uugccugguccucuguccccacagugaccugacugggggugagggagaaggaggagagagccca

SEQ ID NO: 41465 - RNA, 64 nt, Human
cuaacaccucccacccuuggaaaccaugucuucugggggugagaugaccauucugggucuaaga

SEQ ID NO: 41466 - RNA, 64 nt, Human
gcacauccuucuuggcuuccuggcgcccccuaucgggggugagcgaagcccccacuacuaaaug

SEQ ID NO: 41467 - RNA, 64 nt, Human
cagcacccccuggggggccaucgggaguguggcugggggugaagggggcucuguggcaauaugg

SEQ ID NO: 41468 - RNA, 64 nt, Human
ucuguguccugguguugaguuucugcaaauuucugggggugauuucugugacucugggcccaca

SEQ ID NO: 41469 - RNA, 64 nt, Human
cgcgcgcacgugcacauguguguagguagauggagggggugauuauuuuggguggucagggaag

SEQ ID NO: 41470 - RNA, 64 nt, Human
cccgacccgcgggggugccacagccuuuugggaugggggugagcgugcaauggaggcugggggu

SEQ ID NO: 41471 - RNA, 64 nt, Human
ccaggccagggaaggagcacccucuaguggaggcgggggugaauucuuaggucgagcugaugca

SEQ ID NO: 41472 - RNA, 64 nt, Human
gauauguaaauuaaaugaagauacaguggagaaugggggugaccacaaaagaggcucccccuaa

SEQ ID NO: 41473 - RNA, 64 nt, Human
gguggagaggagcuggguugaagcggacugcugcggaugcaacucccagcuugcccaccgcggg

SEQ ID NO: 41474 - RNA, 64 nt, Human
uccagcucagccccaggggacacagaugcacuuugggggugagggcagguaaugacuccaucgc

SEQ ID NO: 41475 - RNA, 64 nt, Human
gcccccaggcuuuuuugcugugagggagccaccagggggugauuuaaauagguuuauuucuuca

SEQ ID NO: 41476 - RNA, 64 nt, Human
agguuuuggaguagaaccagggguguguaugaaggggggugacaaggucccccuggggagggga

SEQ ID NO: 41477 - RNA, 64 nt, Human
aaggaaugggcuacagcagguaguggaggaagaggggggugagcagguguauuaaaauagcuua

SEQ ID NO: 41478 - RNA, 64 nt, Human
aucgcgccuacugugcgugugcgauagcgugugugggggugagaguuuguuuucuggaauggua

SEQ ID NO: 41479 - RNA, 64 nt, Human
cugaugcccaucugcugaccccgcucugaaagccgggggugaguguggcucagccaucccggcu

SEQ ID NO: 41480 - RNA, 64 nt, Human
ccauuaaaaacggagugcgucaugcaaggggguagggggugacgcugaagagaaagaguugagu

SEQ ID NO: 41481 - RNA, 64 nt, Human
ucgugaaauugugcuuguguuucgugauuucuuugggggugauugucucgcuuguuuucaguug

SEQ ID NO: 41482 - RNA, 64 nt, Human
accugagaccaagggggugucuugugggcagugagggggugaggagaggcuggcaugagguuca

SEQ ID NO: 41483 - RNA, 64 nt, Human
acacccucucaugcuaccagcaccauaauccagugggggugacugggugcacaccugcccaggu

SEQ ID NO: 41484 - RNA, 64 nt, Human
guccaaagagagucagagcuaagcauacaggcuugggggugagcccugcugugagaguucaggc

SEQ ID NO: 41485 - RNA, 64 nt, Human
agaagcagcugauuuccugccagggcuuauauuagggggugauucuuaaaggacauuaggauug

SEQ ID NO: 41486 - RNA, 64 nt, Human
ccacacgagcaauacugugcuggagagugagaaugggggugagcaggcgaacagagcucucucu

SEQ ID NO: 41487 - RNA, 64 nt, Human
uuuaaaaaauaaggucugugugaaacacacaugugggggugaggcuggauuaaagugaaauuuu

SEQ ID NO: 41488 - RNA, 64 nt, Human
cugccccuggguggcugggaggagaggcccucucgggggugaccugggcgucagccguggaacc

SEQ ID NO: 41489 - RNA, 64 nt, Human
gcuggccagauggggccaggagggacagagcaaggggggugaaggccguggugggaggguccca

SEQ ID NO: 41490 - RNA, 64 nt, Human
cuuauccaccaugaucaagugggcuucaucccugggaugcaaggcugguucaacauacgcaaau

SEQ ID NO: 41491 - RNA, 64 nt, Human
gcuaugcuuuucuauaacuuuuaaauaaaccuuggggggugauggagucauuccugccuguuac

SEQ ID NO: 41492 - RNA, 64 nt, Human
cucaucccauaggagguuugugagaacucacgccgggggugaaaauguacgucuguagcaugga

SEQ ID NO: 41493 - RNA, 64 nt, Human
agagccuguccccuccccccuucuccaggagccagggggugacuggagagacagacccaccccc

SEQ ID NO: 41494 - RNA, 64 nt, Human
ccccacccuugggcuaaaagcccccaggcgggcagggggugaccccuggagcuaguugcguguc

SEQ ID NO: 41495 - RNA, 64 nt, Human
augcuggaccaggguaccagauuuuuucaacaaagggggugaaguguccuacuaaaaagaauaa

SEQ ID NO: 41496 - RNA, 64 nt, Human
auuggugaacacagcgggggugggugguagcgcugggggugauuuuaggcagcaagaauuggag

SEQ ID NO: 41497 - RNA, 64 nt, Human
cuucuuccuccccucaacagugaguuagacucaagggggugacagaaccgagaagggggugaca

SEQ ID NO: 41498 - RNA, 64 nt, Human
ugaguuagacucaagggggugacagaaccgagaagggggugacaguccuccauccacguggccu

SEQ ID NO: 41499 - RNA, 64 nt, Human
agcuauuuaaggggaggggaugucucaccgggcugggggugagauauccccccaccccagggac

SEQ ID NO: 41500 - RNA, 64 nt, Human
gccaugccaggugguuuggggaccaagauguugggggggugaaucaggauccuaauggugcugc

SEQ ID NO: 41501 - RNA, 64 nt, Human
gaguguuuccaggacccccucggggcccugagccgggggugagggucaccuguugucgggaggg

SEQ ID NO: 41502 - RNA, 64 nt, Human
guugguugaguugccuagaaccccugccagggcugggggugagaaggggagucauuacucccca

SEQ ID NO: 41503 - RNA, 64 nt, Human
ggagaccuagagaucuggcuguggggcgggcauggggggugaagggccacugggacccucagcc

SEQ ID NO: 41504 - RNA, 64 nt, Human
agccaccuucuuggaaagggaaugcaaaggcuuugggggugauggaaaagaccuuuuacaaaug

SEQ ID NO: 41505 - RNA, 64 nt, Human
ugggaugagcccucucaggaauccuguggggaaggggggugauuauagggaaggacgcaggcau

SEQ ID NO: 41506 - RNA, 64 nt, Human
ggggggacgcgggagggugcaugucuugggaaaagggggugacagacaacuuuugagagggcag

SEQ ID NO: 41507 - RNA, 64 nt, Human
guccuguugcaggaagccccuccuguuagcagcgggaugcaagaugcugucucggggcucuccu

SEQ ID NO: 41508 - RNA, 64 nt, Human
cugccaacgccuccuguccccaccuaagccuggugggggugaggggcuccgggucacugcugua

SEQ ID NO: 41509 - RNA, 64 nt, Human
acaacacacacacuggaaugaaaugugcaaacaugggggugacaccacagagagaaccugugaa

SEQ ID NO: 41510 - RNA, 64 nt, Human
cucugcuuggacagcaggccuggcacugggaggugggggugagccccucacagccuugccccuc

SEQ ID NO: 41511 - RNA, 64 nt, Human
uuuaacucaugaggagggaaaagagugccuaagcgggggugaaagaggacguguuacccacugc

SEQ ID NO: 41512 - RNA, 64 nt, Human
cuugaagaaugaagacauuucugcucucagcuccgggggugaggugugccuggccucugccucc

SEQ ID NO: 41513 - RNA, 64 nt, Human
agaaugggggggcagcuugcugacccucaacugggggggugagggagcaucaggagguccaggc

SEQ ID NO: 41514 - RNA, 64 nt, Human
uugauuucaauaaaucuguccacuccccuuuugugggggugaacguuuuaacagccaagggugc

SEQ ID NO: 41515 - RNA, 64 nt, Human
ggaaaaguauaagcccccucccuaauggccgcuggggggugagggcgguguguuguaugucuuu

SEQ ID NO: 41516 - RNA, 64 nt, Human
agcuguuuucuucuauuccauggcuaacuggcgagggggugauuagagggaggagaaugagccu

SEQ ID NO: 41517 - RNA, 64 nt, Human
cucagccaggccccuggggccuccggacaaacuugggggugaggggaagcagggccucuuggga

SEQ ID NO: 41518 - RNA, 64 nt, Human
caugcuccucaccugucuaggucuccucaggguggggggugagagugccuucucuauugggcac

SEQ ID NO: 41519 - RNA, 64 nt, Human
augugcaugcagccuacacccacacguguguaccgggggugaaugugugugagcaugugugugu

SEQ ID NO: 41520 - RNA, 64 nt, Human
aacuaucuauacaccuaccuccagugugcacuuagggggugagcgcgggugucgaggucugugu

SEQ ID NO: 41521 - RNA, 64 nt, Human
gagaucaagugaucggacugaacaggaauccucggggggugaacagccauuccuucgugaccug

SEQ ID NO: 41522 - RNA, 64 nt, Human
aggggcuccccaugagggaggggcgacgggggaggggggugauggugccugggagccugcgugu

SEQ ID NO: 41523 - RNA, 64 nt, Human
ugucccugcagacaugagagacagcaggucucaugggggugacaagcuuuuuuuuuuuuucuua

SEQ ID NO: 41524 - RNA, 64 nt, Human
ggagugacacccccagaccucuggaggagacaauggaugcaaacagcccacacaggaaagacaa

SEQ ID NO: 41525 - RNA, 64 nt, Human
ucuucaauacaaaaagccaacaaaccaagacuaagggggugaccaugcaauuccauuuuguguc

SEQ ID NO: 41526 - RNA, 64 nt, Human
caggcgccucaacucugcugaggguccagaaggagggggugaccuccggccaggugccuccuga

SEQ ID NO: 41527 - RNA, 64 nt, Human
gcuugucuguccgucacaggcagugaggaugagagggggugaugggcgcaaggccccagggguc

SEQ ID NO: 41528 - RNA, 64 nt, Human
gggaggcgacgggggggcaggcgggagcaggcacgggggugaugcugccacagggggcugguga

SEQ ID NO: 41529 - RNA, 64 nt, Human
aguucagggacccaaguggugagcggcgucuuuugggggugagggagcuuggguagaugaggcu

SEQ ID NO: 41530 - RNA, 64 nt, Human
caguugcaccuuucucaccuacuuugggaccuuugggggugaguuccccuuuguccucucgugg

SEQ ID NO: 41531 - RNA, 64 nt, Human
aguucugugagcccuggcagcaaaaaacaccuuggggggugaagcugucaaugccaccaguugg

SEQ ID NO: 41532 - RNA, 64 nt, Human
gcagccccggaaggaaccagggauuaggcuguaggggggugagaaggagagaagggaccacccc

SEQ ID NO: 41533 - RNA, 64 nt, Human
aucccccagcccgacuagacccaccucaccugaagggggugagacccuuguuggcagccagaca

SEQ ID NO: 41534 - RNA, 64 nt, Human
uacucacuucccuccacccucaacaggauguggugggggugaaacuugaagaauuuuuguuucc

SEQ ID NO: 41535 - RNA, 64 nt, Human
gggcuuuggagugagggcagugcgguggaggugagggggugagccuggaccugugggcgagucc

SEQ ID NO: 41536 - RNA, 64 nt, Human
gugcucaugcagacucuggggcugaggugccccggggggugaucucuggugcucacagccgagg

SEQ ID NO: 41537 - RNA, 64 nt, Human
gugaggagaggacccaggagugugggggcauuuggggggugaaguggcccccgaagaauggaac

SEQ ID NO: 41538 - RNA, 64 nt, Human
auuuaugguuuuuuuuuuuuaauuuuuucuuuuugggggugaaauuggcagaugccugagguca

SEQ ID NO: 41539 - RNA, 64 nt, Human
ccccccagacuuucucaguccugcagcggcccuugggggugacccccggcaucuaccccacuca

SEQ ID NO: 41540 - RNA, 64 nt, Human
cugccagcagcccuuugcuaucugcgcgcaggaugggggugacugcccagacauucccgcuaga

SEQ ID NO: 41541 - RNA, 64 nt, Human
gaucuuuaagcacugaugauuuucuuauauaugaggaugcaaagcauucaagaguuucagccug

SEQ ID NO: 41542 - RNA, 64 nt, Human
gagcugaguuggggguguggcucugcccuggaaagggggugaccucuugccucgaggggcccag

SEQ ID NO: 41543 - RNA, 64 nt, Human
uugcuccaacugaauugcuaucauuuggcuggaugggggugaaguaugucuucaaaauauauug

SEQ ID NO: 41544 - RNA, 64 nt, Human
agcuagggccacgcggccccacauugcacuucuggggggugaccgacuucguacacggguuuaa

SEQ ID NO: 41545 - RNA, 64 nt, Human
gcuauucccugguguuuuuuucccccacuggggagggggugagguggaauggggugggggaaca

SEQ ID NO: 41546 - RNA, 64 nt, Human
aagaagagcucuuuguuccugggggaggggggcagggggugaauuuuacuuucaucucaaguua

SEQ ID NO: 41547 - RNA, 64 nt, Human
acacacacagagacacacacacauacuacuuuaagggggugaggaucauuaauucagauaauuu

SEQ ID NO: 41548 - RNA, 64 nt, Human
ugccuggacuaauaacuauucucacaguaaaagagggggugagaauaaugagauaucugaaacc

SEQ ID NO: 41549 - RNA, 64 nt, Human
gugccugaugccugccucagcucggcgccugccagggggugacuggcacagagcgggccguagg

SEQ ID NO: 41550 - RNA, 64 nt, Human
acacauuugccaagaaaggaucucuggggcuuccgggggugagauucaaguaggacaauaacaa

SEQ ID NO: 41551 - RNA, 64 nt, Human
cacccccagccccagcccaguccuccuaggagcaggacccgaugaagcgggcggcgguggggcu

SEQ ID NO: 41552 - RNA, 64 nt, Human
aaaugugaagggugggguuuuaugugugggaaagggacccgaagcccaggcugaagaguuuaac

SEQ ID NO: 41553 - RNA, 64 nt, Human
gaauuacucauuuaaaaauuuuaacuucuauaugggacccgaauuagacacugcugaauccugu

SEQ ID NO: 41554 - RNA, 64 nt, Human
uaccacagcauccccuagagagagugaggugcagggacccgagggccagguuagcacagcgcug

SEQ ID NO: 41555 - RNA, 64 nt, Human
cugcaggcucugggucagguucugcuccuuuaugggacccgacauuuuucagcucuuugcuauu

SEQ ID NO: 41556 - RNA, 56 nt, Human
cgucagugcugugcuccuaagccaugggacccgaggacugccccccggcgccugcc

SEQ ID NO: 41557 - RNA, 64 nt, Human
ccggcuuggcaaucucagcugugccggcgcuacgggacccgagccgucccagaaaccaaagggc

SEQ ID NO: 41558 - RNA, 64 nt, Human
auccccaccccggugcuccagggaaggaggacacggacccgacgugggagguccucaggcagca

SEQ ID NO: 41559 - RNA, 64 nt, Human
ugcacuguacugcacacgucccuagagccuaccgggacccgacgcuuuucagggcauuucuccc

SEQ ID NO: 41560 - RNA, 64 nt, Human
uccuugagaacuuggcccugugcuuuagacccaaggacccgauucuugggcuaggaaagagaga

SEQ ID NO: 41561 - RNA, 64 nt, Human
uaaaggcuuguucuaaguggacaaggcucucacaggacccgaugcagguaggcugaugugcuuc

SEQ ID NO: 41562 - RNA, 64 nt, Human
gguacagcaucccaggagcccggccugaggggcuggacccgagccggcugugaacaucccucag

SEQ ID NO: 41563 - RNA, 64 nt, Human
ucagagugaauugaauauuguaagucagccacugggacccgaggauuucugggaccccgcaguu

SEQ ID NO: 41564 - RNA, 64 nt, Human
gucccgcccggcugagacgcucgccccgacgcauggacccgagaggcgacgacacgagugaaua

SEQ ID NO: 41565 - RNA, 64 nt, Human
agacuggaguggaccuggaacuuagagacgggagggacccgagccuggcuuuugaccuaagaac

SEQ ID NO: 41566 - RNA, 64 nt, Human
ugcuccagcaacacagccugggccccagcucgcgggacccgaccccccgugggcucccguguuu

SEQ ID NO: 41567 - RNA, 64 nt, Human
cucuuuggcgcugacuuggaauucuaagagccuuggacccgaguguguggcuaggguugcccug

SEQ ID NO: 41568 - RNA, 64 nt, Human
aagucgcgagccagguuuaaccguugcgucaccgggacccgagcccccgcgaugcccugggggc

SEQ ID NO: 41569 - RNA, 64 nt, Human
aacucccucccauccuacucucacagaagggccuggaugcaagguuacccuugagcugugugcc

SEQ ID NO: 41570 - RNA, 64 nt, Human
gaucucaccagauuuuguaucuauugcucagcuaggacccgaguccaauagucaauuuauucua

SEQ ID NO: 41571 - RNA, 64 nt, Human
acucaacguuugcugugcuuaaagaauugcuucaggacccgagcguuuuuauguaugcuguucc

SEQ ID NO: 41572 - RNA, 64 nt, Human
ugugaugacuggcagcuaaggaggaccucggaguggacccgagccaggaauaacgaaugaccca

SEQ ID NO: 41573 - RNA, 64 nt, Human
uggggccucggauaccugcugcccagagcagcccggacccgaaaccuuucaggccccgcuugca

SEQ ID NO: 41574 - RNA, 64 nt, Human
gacagaaucaagaaaauugagaugagauuugaaaggacccgaaaaugcagggguuggcuuucug

SEQ ID NO: 41575 - RNA, 64 nt, Human
caugagagaacagcacucaagcuucuggccgcauggacccgauggcucgcauucuguguagugu

SEQ ID NO: 41576 - RNA, 64 nt, Human
ugagcagcagggagugcauuugcuggggugucggggacccgaagccugagcaugcggcucaccc

SEQ ID NO: 41577 - RNA, 64 nt, Human
ccccaaaauucugagugagcugcagggugugcugggacccgaguaggagcuaggacuagccagg

SEQ ID NO: 41578 - RNA, 64 nt, Human
ugaaaagcugaauccagaucauuccucagaaugaggacccgaggacaguggcagacagacgcgu

SEQ ID NO: 41579 - RNA, 64 nt, Human
cuuguuggugcuguaggcacccgccagggagcagggacccgacuugcagacgcauugcccggua

SEQ ID NO: 41580 - RNA, 64 nt, Human
acucagcuugagacacuccagccaaggguccuccggacccgauccugcagcucuuucuggaccu

SEQ ID NO: 41581 - RNA, 64 nt, Human
cugaucugauccuuagggggugcccuggccccacggacccgacucagcuugagacacuccagcc

SEQ ID NO: 41582 - RNA, 64 nt, Human
uccaggaacuccacucccagucuuagagcuguuaggacccgauggggaggcagcccccgcagug

SEQ ID NO: 41583 - RNA, 64 nt, Human
cacugcuucccaugagcugagggagagggagaggggacccgaggcugaggcauaaguggcagga

SEQ ID NO: 41584 - RNA, 64 nt, Human
guuugcauauacauaaugagauauuuugggaauaggacccgagccuaaacacaaaauucauuga

SEQ ID NO: 41585 - RNA, 64 nt, Human
uggcagugauuugaacaccggcagugcuggggcaggacccgagccagcgguggggagagauaua

SEQ ID NO: 41586 - RNA, 64 nt, Human
gaaagacuggcaagaaaagaguuaaggcaaaaaaggaugcaacaauucucccgggacucugcau

SEQ ID NO: 41587 - RNA, 64 nt, Human
acuggagcuggcaaggacgugggccuccagaguuggacccgaccccaauggaugaagacccccu

SEQ ID NO: 41588 - RNA, 64 nt, Human
guccucuuucccaccuucauagcaggaaucacccggacccgacuggcugggcuucgugcuagcg

SEQ ID NO: 41589 - RNA, 64 nt, Human
gacccuggggagagagggcaucugcaauaggaggggacccgagccuguccuggcugcuggccca

SEQ ID NO: 41590 - RNA, 64 nt, Human
agccagggugugccaggagaagggcaugaagcgaggacccgagggcagccucucggugccaaga

SEQ ID NO: 41591 - RNA, 64 nt, Human
cuggugggggcccccagcagggacacugacgucaggacccgagccuccagccugagccuagcuc

SEQ ID NO: 41592 - RNA, 64 nt, Human
cccugagccccacuucugccuucaccucugccugggacccgagcugggcuccugggccuugguc

SEQ ID NO: 41593 - RNA, 64 nt, Human
accuacugaggaggauccuccagggccgcuccccggacccgacaggcgcggguggaugcagguu

SEQ ID NO: 41594 - RNA, 64 nt, Human
gcacccccccuccccaccaacuucucugccccagggacccgaggccaccccagccuggugugga

SEQ ID NO: 41595 - RNA, 64 nt, Human
gccuacgcggggauggccgucaguucuggccacaggacccgagucugggcuugggucccccugc

SEQ ID NO: 41596 - RNA, 64 nt, Human
ccucuccaagcgccuggcuuuggaaugcuccaggcgcgccgacgccugugccaccccuuccuca

SEQ ID NO: 41597 - RNA, 64 nt, Human
cucccggcccaaccccaccgacccagaccaagaccgcgccgagccgccgggacucagcgccuuc

SEQ ID NO: 41598 - RNA, 64 nt, Human
cgagccacaagcugcacugugaaccugggcacuccgcgccgaugccaccggccugugggucucu

SEQ ID NO: 41599 - RNA, 64 nt, Human
ggucucuuggccucaaucugaaaacugcugccgccgcgccgaggagacucgcaugccgccacca

SEQ ID NO: 41600 - RNA, 64 nt, Human
gggcaauggccacguggccaaggcccugcaggaacgcgccgaggucucccucacccuccaggug

SEQ ID NO: 41601 - RNA, 64 nt, Human
ggggguuucgcgcugcuccugaccgcggugaggccgcgccgaccaucucugcacugaagggccc

SEQ ID NO: 41602 - RNA, 59 nt, Human
cgcuggaguuaaaccagugagccgaggcccgcgccgaggaccuggccaggccagccacu

SEQ ID NO: 41603 - RNA, 64 nt, Human
ccccgggagggcgcgucuguccacgccuaccggacgcgccgaggucgcgcugccuguguucucc

SEQ ID NO: 41604 - RNA, 64 nt, Human
uguggccucgccggggagagcgggcgggggagcucgcgccgaggacuggaccaucuguacagac

SEQ ID NO: 41605 - RNA, 64 nt, Human
ccaauccccgccguccuuccagcccacgaccugccgcgccgaggagcggcaucugucccguuuc

SEQ ID NO: 41606 - RNA, 64 nt, Human
gaauuucaugaaggggaacuauaguuauuucuaccgacacaaauauuauaauuagcaauuugaa

SEQ ID NO: 41607 - RNA, 64 nt, Human
uguguguaagggacaugggggcaaacugagguagcgacacaaaguuaaacaaacaaacaaaaaa

SEQ ID NO: 41608 - RNA, 64 nt, Human
gcuaaacaaccugacaaacuguggccaggggaaccgacacaacccucaagcauuucuauguauu

SEQ ID NO: 41609 - RNA, 64 nt, Human
ugcuuauauaauuuuugggacccagaagaaacaacgacacaaucuuagaaucacuccugaguau

SEQ ID NO: 41610 - RNA, 64 nt, Human
aauucaagaagaagcaguauuaacaucaauugaucgacacaaaguaauuuuuaauuuaauucau

SEQ ID NO: 41611 - RNA, 64 nt, Human
cugacacccagauuccauuaaaaauucugcuaaucgacacaacacauauauuugcucaugauuu

SEQ ID NO: 41612 - RNA, 64 nt, Human
acaaacuauagggugcuggggacugcuugaaaagcgacacaaacgggcgugcucucucagacac

SEQ ID NO: 41613 - RNA, 64 nt, Human
agaagcaguguuuuuuuuuuaggaaaggauuaugcgacacaauaaaauaagauauucugucugu

SEQ ID NO: 41614 - RNA, 64 nt, Human
ggaaacuauaugggaugaacacuuuuaaacuuuccgacacaacuuccauuacuaacuuucuaac

SEQ ID NO: 41615 - RNA, 64 nt, Human
ugaguuuuuuaguuucacaguuuuacagauccaacgacacaaucuuuuaaucuuuggucacuca

SEQ ID NO: 41616 - RNA, 64 nt, Human
ugaaggaagagagugcauggcaccugguguguaacgacacaaucagcacaacuggagagaggca

SEQ ID NO: 41617 - RNA, 64 nt, Human
cuaccuaaccuuucugagccuccuauaccucauccgacacaaauggggaugauaccuaccucca

SEQ ID NO: 41618 - RNA, 64 nt, Human
acggcuaugaucaugacaaccacgguccccaccacgacacaaucacguucacaaccacaaccac

SEQ ID NO: 41619 - RNA, 64 nt, Human
aaagggagcaacuuuuccuccaauccuggaaauucgacacaauuagauuugaacugcuggaaau

SEQ ID NO: 41620 - RNA, 64 nt, Human
ucuuaauucugaccaauaaaaaaauaagucaggaggaugcaauuguugaaagcuuugaaauaaa

SEQ ID NO: 41621 - RNA, 64 nt, Human
gugcucacugaaagggcugucaaccccagaaggccgacacaaaaaaaaugguaugugaagaugc

SEQ ID NO: 41622 - RNA, 64 nt, Human
caacccuuggcccaggacggcuuugaauauggcccgacacaaauucguaaacuuuuuaaaaaac

SEQ ID NO: 41623 - RNA, 64 nt, Human
gagggaguucuucuuuugugagagacacuguaaacgacacaagagaacaagaauaaaacaauaa

SEQ ID NO: 41624 - RNA, 64 nt, Human
agucacccaccuaugugccagagucaggccuggccgacacaaggaucuaugcuuuuucuguggu

SEQ ID NO: 41625 - RNA, 64 nt, Human
cuuaagguaggagagaauuuaacguguacuucaucgacacaacccaucuacaaaugugcccaga

SEQ ID NO: 41626 - RNA, 64 nt, Human
guggagacccggaaccagcagcccccuccacuggcgacacaacugcaccuucccucauuucagu

SEQ ID NO: 41627 - RNA, 64 nt, Human
gcugaaagcaagauguguuccuuauugugaagagcgacacaacugccugcugccuuuccacagc

SEQ ID NO: 41628 - RNA, 64 nt, Human
gcugcgucaucagcuaggagccccgccgcgcuggcgacacaaccuaaggaggaccuuuuuguua

SEQ ID NO: 41629 - RNA, 64 nt, Human
ggaaaagccaaaaccgaggcccauugcccggauucgacacaaaagagggucccugcucuguugc

SEQ ID NO: 41630 - RNA, 64 nt, Human
uuugcggaggaugcagggauaugcucacagcgcccgacacaacccccucccgccgcccccaacc

SEQ ID NO: 41631 - RNA, 64 nt, Human
uggucccuacucaacaaaauaugaugauggcucccgacacaagcgccagggccagggcuuagca

SEQ ID NO: 41632 - RNA, 64 nt, Human
gagcucucauugggccacugcagucgagccugggcgacacaaagagaccacccugucugauaga

SEQ ID NO: 41633 - RNA, 63 nt, Human
ccuggacuugucaagugaauucuuugcauguucaaaacggaaaccauugauuagaacuacauu

SEQ ID NO: 41634 - RNA, 63 nt, Human
ccaggaggggcccccaccugauggaccuccagaaaaacggaucacagccacuauggaugacau

SEQ ID NO: 41635 - RNA, 63 nt, Human
acaaacuuguaucgguucuuaauuaaauuauccaaaacggaggcauuuaaacacuuggauuua

SEQ ID NO: 41636 - RNA, 63 nt, Human
aacucacagauggauaccaacacggucagaagaaaaacggacagaacgguucuuguauauuua

SEQ ID NO: 41637 - RNA, 63 nt, Human
auuaauuuagagaagacaaucaaugucugugagaaaacggacuuucuuuuggauuuucuuuuu

SEQ ID NO: 41638 - RNA, 63 nt, Human
acagugccuauacugccucuacaguuaauaggaaaaacggaagaaguuacccuuaagcuagga

SEQ ID NO: 41639 - RNA, 63 nt, Human
agaggggaagagggugcuaguaccaacacagggaaaacggaugggaccugggcccagacaguc

SEQ ID NO: 41640 - RNA, 63 nt, Human
ugaggcacauuuuacaagaacauaacuccuauuaaaacggaguaacaacuaugcaaagguuuc

SEQ ID NO: 41641 - RNA, 63 nt, Human
auaaaauuuaaaaaaacagacucccauuucuuaaaaacggauaaguuugaaaggaaacugcua

SEQ ID NO: 41642 - RNA, 63 nt, Human
uccucucaauaugguuuuaagauugaaaguaagaaaacggauuuaggaugaaaacucuagaac

SEQ ID NO: 41643 - RNA, 63 nt, Human
uuaguucuguaaugucaagaauuuaagaauuaaaaaacggauugguuaaaaaaugcuucauau

SEQ ID NO: 41644 - RNA, 63 nt, Human
cccccugacccccgcuccauuguuuaugauggaaaaacggacauuuggcuaggugucucucac

SEQ ID NO: 41645 - RNA, 63 nt, Human
ggagaaccuugaagaacauuuuuccuuuucaggaaaacggagguuacagagaaaaguauaugu

SEQ ID NO: 41646 - RNA, 63 nt, Human
auucauuuggaaaguggguaaaaggggcuucaaaaaacggauagaacaggauuuucuaggagu

SEQ ID NO: 41647 - RNA, 63 nt, Human
agagugaaaacuguugugaaugagccugaucauaaaacggaccaggccauucauuauuccuca

SEQ ID NO: 41648 - RNA, 63 nt, Human
cccugccccccgccccucuccaaacaccggcagaaaacggagagugcuuggguggugggugcu

SEQ ID NO: 41649 - RNA, 63 nt, Human
uuuuaaaaauaguucuuuuguaaugugguguucaaaacggaauugaaaacuggcaccccaucu

SEQ ID NO: 41650 - RNA, 63 nt, Human
aaagagcgaaccaaagcgaugcuucgaauuuuuaaaacggaaucucugcacccaaaugcagga

SEQ ID NO: 41651 - RNA, 63 nt, Human
uauauacuuaauagauugaguucuguaagggcaaaaacggauugaaaugaacauagcguuuug

SEQ ID NO: 41652 - RNA, 63 nt, Human
auaaugggcagacagaaaaauguaaaaccacacaaaacggacugcugauaauauuuuaaaaua

SEQ ID NO: 41653 - RNA, 63 nt, Human
aggagcauguuacagauaauauagaguuauaauaaaacggacuaugacucuuuucauuggauu

SEQ ID NO: 41654 - RNA, 62 nt, Human
uguaugucaaaagaaaauaaaauucaaauauuuaaaacggacugucuccucuucacaaaagu

SEQ ID NO: 41655 - RNA, 63 nt, Human
augacuacauaguaaguacagaacaguaaaguuaaaacggaugucuccauugaucugccaaau

SEQ ID NO: 41656 - RNA, 63 nt, Human
uauauguucacugucccccuaauauuagggaguaaaacggauaccaaguugauuuaguguuuu

SEQ ID NO: 41657 - RNA, 63 nt, Human
cccccauuuuuuuaaugaaaaaaaaaaacaaaaaaaacggauccaagaagaaaagagaauuua

SEQ ID NO: 41658 - RNA, 63 nt, Human
aggagcugccuuggcucagacauguuuuccgugaaaacggagcugaacaauaggcuguuccca

SEQ ID NO: 41659 - RNA, 63 nt, Human
ugaauugaacauguaaaauuccaguaaaauguaaaaacggaauaugcaucgcucuuaaccuug

SEQ ID NO: 41660 - RNA, 63 nt, Human
guuuuaaucucuuaauauugagaaucagguugcaaaacggaugaguuauuaucuauggaaaug

SEQ ID NO: 41661 - RNA, 63 nt, Human
cuauugcacuucagccaaauguuuauuucacacaaaacggauguaacauuucaugugaucgug

SEQ ID NO: 41662 - RNA, 63 nt, Human
uugccucauaaagaagaaaggaccaagaaaaccaaaacggaagaggagaaacucaauacaaag

SEQ ID NO: 41663 - RNA, 63 nt, Human
aacacagauguaucgucagacaugagaauaauaaaaacggaguugaucaagaaauuaucuuuc

SEQ ID NO: 41664 - RNA, 63 nt, Human
auaaugcaagauaaaaaucacaccugagggcugaaaacggagagggaaugggagacuugauau

SEQ ID NO: 41665 - RNA, 63 nt, Human
agcaggacucuuucucugggaaaccauccuuccaaaacggaaucuauguagacaaugggacgu

SEQ ID NO: 41666 - RNA, 63 nt, Human
uggaagaauuggcaaaauaucuggaccauuaagaaaacggauuuuguaacuagcuuuaaacua

SEQ ID NO: 41667 - RNA, 63 nt, Human
ugcuuccuagaaguuacugaaugcaccauggucaaaacggauuagggcauuugagaaaugcau

SEQ ID NO: 41668 - RNA, 63 nt, Human
uaugauaagaaagucugucacagugcuauuuggaaaacggaaaauuuacaagcaaccuagagg

SEQ ID NO: 41669 - RNA, 63 nt, Human
cgugaaggacuuagccgacugcgcugcuuuuucaaaacggauccgggcaaugcuucguuuucu

SEQ ID NO: 41670 - RNA, 63 nt, Human
agaggauggggaaaagggaagaguaccgacuugaaaacggagagcugucuuggcugagggcag

SEQ ID NO: 41671 - RNA, 63 nt, Human
aguuuuaacgaguaauuggauaaacccugagggaaaacggagguagauucagcaccuaacaau

SEQ ID NO: 41672 - RNA, 63 nt, Human
cuuuuuauauucauguacauucaccuggggaaaaaaacggagggacuuugcuacuuguaaaaa

SEQ ID NO: 41673 - RNA, 63 nt, Human
gagucuuagagcuuuaccuaaauaugagcccagaaaacggaggauggggguggggcgccuucc

SEQ ID NO: 41674 - RNA, 63 nt, Human
caccaaaauaaugcuuuugaaaaaaagaaaaaaaaaacggauauauugagaaucaaaguagaa

SEQ ID NO: 41675 - RNA, 63 nt, Human
gcuggauaugaagaacuauugacuucuugggaaaaaacggagaaauauuaauuggaaaguuga

SEQ ID NO: 41676 - RNA, 63 nt, Human
guuuuugauugguaauuguuuucuguauuguuuaaaacggaucaaaaauguaagucuauuggu

SEQ ID NO: 41677 - RNA, 63 nt, Human
auuugcccucaccaugguuuauaaaacuuugggaaaacggaauauucagaaauagguuuccgc

SEQ ID NO: 41678 - RNA, 63 nt, Human
gcaaacuacuuuaagcaaauauuuguaaaauuaaaaacggaggaccgcucaccaaauguuuga

SEQ ID NO: 41679 - RNA, 63 nt, Human
caucucagcauucuccaucacuuccccuccagaaaaacggauggaaggaagcccucugugaca

SEQ ID NO: 41680 - RNA, 63 nt, Human
uggaacaccauguuuuuagcauguuuuuaaauaaaaacggauaaagugucaaaagcacagcag

SEQ ID NO: 41681 - RNA, 63 nt, Human
gaucuuuuagaagugagagaaaaagguccuacgaaaacggaauaauaaaaagcauuuggugcc

SEQ ID NO: 41682 - RNA, 63 nt, Human
aggagauaggaguugguuaagaugauagauagaaaaacggaaggguucagcugcugcucccaa

SEQ ID NO: 41683 - RNA, 63 nt, Human
uccacaguuaccagcacgcugucucagaaaacgaaaacggaggaaaaaaaccccaaaccccaa

SEQ ID NO: 41684 - RNA, 63 nt, Human
auauaaauuuaagaaguaauacuuauuggcugaaaaacggaggcugagccauuguggcuacca

SEQ ID NO: 41685 - RNA, 63 nt, Human
gagucggugcucaguguuugcaaaacagagcugaaaacggacuuugggaggccgaggcaggca

SEQ ID NO: 41686 - RNA, 63 nt, Human
accuuggauaaauuauuucaaucuuuauuuuguaaaacggagauaacggccuauaggauuguu

SEQ ID NO: 41687 - RNA, 63 nt, Human
aauaacugaaguauaacagaagauauauuuuuuaaaacggaaagccuuuguacaguuccuggg

SEQ ID NO: 41688 - RNA, 63 nt, Human
guugaggaagcuaacagucuuagaucuacuuuuaaaacggauggccuucuuaagaauaaagca

SEQ ID NO: 41689 - RNA, 63 nt, Human
gggaugagaugugugugaaaguauguacaagagaaaacggaagagagaggaaaugaggugggg

SEQ ID NO: 41690 - RNA, 63 nt, Human
cauuuugaucaaacugaucuucauuuuuguaauaaaacggaagacucauccaguaauuguuua

SEQ ID NO: 41691 - RNA, 63 nt, Human
uauagucaaaaauguucugcuuaaguguuaaauaaaacggaaacacuuauucgugcuugguaa

SEQ ID NO: 41692 - RNA, 63 nt, Human
uuaccaauuuaugaauucuuguaagcggaauguaaaacggaaauacugaaagacuuuugccua

SEQ ID NO: 41693 - RNA, 63 nt, Human
ccugccaguucuuuacauuuuuccaaggaaaggaaaacggaagcaggguucuugccugguagc

SEQ ID NO: 41694 - RNA, 63 nt, Human
gaggauugaaaaaaagggcacucugauagggcaaaaacggaacaugggaggggacaaauaagg

SEQ ID NO: 41695 - RNA, 63 nt, Human; identical to SEQ ID NO: 41692

SEQ ID NO: 41696 - RNA, 63 nt, Human
gauauaaagcauauuuuauucuauauuauuacaaaaacggaaauguauaaacaugucaaaaag

SEQ ID NO: 41697 - RNA, 63 nt, Human
gagguaauucgggcaaagaguagaauuuaagacaaaacggaagcugggaagcuucccuugagg

SEQ ID NO: 41698 - RNA, 63 nt, Human
guauacgguguccucagcacauacaccugugggaaaacggaccgcucuuggcuccugacuccc

SEQ ID NO: 41699 - RNA, 63 nt, Human
gguacauggugagaguucaggcuccagagacucaaaacggaaugguuuuccuuggcauuuugu

SEQ ID NO: 41700 - RNA, 63 nt, Human
ccauaaauuaacugcagcuugccugcuucagcaaaaacggagauucaggccagcagcuggaua

SEQ ID NO: 41701 - RNA, 63 nt, Human
auguccuuaguccuggguuuuugaaaaagugcuaaaacggacaaguagaauaaauguugcugu

SEQ ID NO: 41702 - RNA, 63 nt, Human
ugguguaaauggaaguuucagagaggacaaaauaaaacggaauuccauuuuucucucacugua

SEQ ID NO: 41703 - RNA, 63 nt, Human
gguaggguuccccaaccaaagacggcuccauuaaaaacggagugcgucaugcaaggggguagg

SEQ ID NO: 41704 - RNA, 63 nt, Human
aguuccaugggcagauuucccuuccugaaggccaaaacggagaacugcucucuuuaauuauuu

SEQ ID NO: 41705 - RNA, 53 nt, Human
aaggcaucgaguucauuuaacucaaaacggaaacacugagcaaggccaucagg

SEQ ID NO: 41706 - RNA, 63 nt, Human
cugcguccagcgagcgucacagcacaaccugcaaaaacggagcugggcugcagcuggggcugg

SEQ ID NO: 41707 - RNA, 63 nt, Human
uuuccaaggccccucccuguuuccccagcaauuaaaacggacucaucucuggccccauggccu

SEQ ID NO: 41708 - RNA, 63 nt, Human
cuucuggguauccagagagcacugcacuuccccaaaacggaaggggccccugggcaguggguu

SEQ ID NO: 41709 - RNA, 63 nt, Human
uccuauuccagggaauaagccaaauuaacacuaaaaacggaucaaagcucccacgccagucca

SEQ ID NO: 41710 - RNA, 63 nt, Human
cucaguccuucugggacagcuucccugccucagaaaacggaaucucugucugugaccuucucc

SEQ ID NO: 41711 - RNA, 63 nt, Human
gaaagacuuuuuguuuuccuuucccaaagaaauaaaacggaaaaagccucuugagugguauuc

SEQ ID NO: 41712 - RNA, 63 nt, Human
caccacuaacccucccccagaagcucacaaaggaaaacggagagagcgagcgagagagauuuc

SEQ ID NO: 41713 - RNA, 63 nt, Human
ugcuaaauaauauuuauuacuuguuugguugcaaaaacggaauaaaugacugaguguugagau

SEQ ID NO: 41714 - RNA, 63 nt, Human
ugaacaggaggauggauacagccgcgaggcuaaaaaacggauuuccucuuccuagcuuaaaau

SEQ ID NO: 41715 - RNA, 63 nt, Human
gcugaauacaaauauaccuuauauucuuuaaggaaaacggaaaggaaagaucagcagaaauag

SEQ ID NO: 41716 - RNA, 63 nt, Human
ggaccuaaauauguuaauuccuuuucaccuuucaaaacggacagccccuugaacauuaaaaac

SEQ ID NO: 41717 - RNA, 63 nt, Human
gaugggcaugaagcaucucagacuccuuggcaaaaaacggaguccgcaggccgcagguguugu

SEQ ID NO: 41718 - RNA, 63 nt, Human
aaaagaaaagugagccaagcagaaggaggugggaaaacggacccaaaccccagugugcccugc

SEQ ID NO: 41719 - RNA, 64 nt, Human
aggugguggaaggggccaggggccugcaggccucccccuggaacugggacuggucucggucugc

SEQ ID NO: 41720 - RNA, 64 nt, Human
auggcuguguucuucauguguugauuuuauuugaccccuggaguggugggucucaucuuuccca

SEQ ID NO: 41721 - RNA, 64 nt, Human
cacccucagugcaggcaccucuguucccgcuuugccccuggaggagccacuauuccagaaggcu

SEQ ID NO: 41722 - RNA, 64 nt, Human
ggcugggggaggcacuggcgggaggccucgggcuccccuggaagggcgcugggcuggcggguca

SEQ ID NO: 41723 - RNA, 64 nt, Human
ccagaaacauaaaggauuaaaaucacacuaauaaccccuggauggucaaucugauaauaggauc

SEQ ID NO: 41724 - RNA, 64 nt, Human
auggcuggggcucuccgugguguucuggacccagccccuggagacaccauucacuuuuacugcu

SEQ ID NO: 41725 - RNA, 64 nt, Human
gccuccauggcuggucaugagagcaaaccguaguccccuggagacagcgacuccagagaaccuc

SEQ ID NO: 41726 - RNA, 64 nt, Human
cugcacucuuucuugcaagugcaucuuuuuccuuccccuggacuguccucugacccuuuggcuc

SEQ ID NO: 41727 - RNA, 64 nt, Human
ccuuugguuguaugauuuucuucuuuuuuaagaaccccuggaagcagcgccuccuucaggguug

SEQ ID NO: 41728 - RNA, 64 nt, Human
aaggggaguuggugggccuuuaggucugccccauccccuggaaaacuuaggacuuauuggguua

SEQ ID NO: 41729 - RNA, 61 nt, Human
agguguaccagauacgaugacuaagccagggccccuggaucuccucccuuacccuccucug

SEQ ID NO: 41730 - RNA, 64 nt, Human
agaucaggucccggccuggaauauauuuucuaccccccuggagcuuugauuuugcacugagcca

SEQ ID NO: 41731 - RNA, 64 nt, Human
gcccuguccggugagggggcagaaggacucagcgccccuggacccccaaaugcugcaugaacac

SEQ ID NO: 41732 - RNA, 64 nt, Human
ugggacaauggggccaagagugaagcgggcagggccccuggacugucguggcuccccucaucag

SEQ ID NO: 41733 - RNA, 64 nt, Human
aucucucuccucauggcagcgacccaccuccaguccccuggacaaucggguacaagagacuuaa

SEQ ID NO: 41734 - RNA, 64 nt, Human
cugggguccaauguucugucuaguggcagcuuuuccccuggaacaggggucccuggaguucaca

SEQ ID NO: 41735 - RNA, 64 nt, Human
ccccacagccgguucugcacuuaucaccgagucgccccuggaagcagauucccauugaguuuuc

SEQ ID NO: 41736 - RNA, 64 nt, Human
aacacuguaggaguaguaagcagauguccuccuuccccuggacaucuccuagagaggaauggac

SEQ ID NO: 41737 - RNA, 64 nt, Human
cucucaucccaaggagccagaguccucccaagauccccuggaggaggagggaucccugcugccu

SEQ ID NO: 41738 - RNA, 64 nt, Human
gugguggaggaggaggaggaggaggaaggcaaagccccuggaaaugugcuaaaguuggaaaguc

SEQ ID NO: 41739 - RNA, 64 nt, Human
agugggagcugucaucaccaacaggguuuacucuccccuggagagguuauuuaaauagcugucc

SEQ ID NO: 41740 - RNA, 64 nt, Human
agcaccaccacaaccccuugcagugugccccaguccccuggauucgcuggacugcaaaaaggag

SEQ ID NO: 41741 - RNA, 64 nt, Human
gguuugcauuuuucaugguuuuuauuuccuguucccccuggaguuuuccauuagugaguuuuug

SEQ ID NO: 41742 - RNA, 64 nt, Human
agcaggggguggggugugagcuuggagggccccuccccuggauuuccuccaacaccugcuugga

SEQ ID NO: 41743 - RNA, 64 nt, Human
gugcacaccugcaaguaggcaccggccgcggcucccccuggacggggcgggcccugccugaggg

SEQ ID NO: 41744 - RNA, 64 nt, Human
ggcucugcguuggcuucucccuggggacggggcuccccuggacagaggcggggcuacagauugg

SEQ ID NO: 41745 - RNA, 64 nt, Human
ccaguuucucacagagggaggagguggccuuuguccccuggagcagccaguuggugcuacugcu

SEQ ID NO: 41746 - RNA, 64 nt, Human
cugaacuccucaagcagcgauuggagcccaagcaccccuggagaggaagggaggguccccacug

SEQ ID NO: 41747 - RNA, 64 nt, Human
ccugccugcccacuuagccguccauggcaccagcccccuggaugggcauugggcugacaccuac

SEQ ID NO: 41748 - RNA, 64 nt, Human
gagaguuugagacagcuccguguggagagcuuagccccuggaggcagcacaaggaggaugugau

SEQ ID NO: 41749 - RNA, 64 nt, Human
acacagcugccuggcuggggaggcugugcuguuuccccuggagaccugacuggucugugguucc

SEQ ID NO: 41750 - RNA, 64 nt, Human
agaaugggguuugaaaggaaggugagggcuguggccccuggacggguacaauaacacacuguac

SEQ ID NO: 41751 - RNA, 64 nt, Human
cuuggugacaggcccagggugggaggggucggggccccuggaggggcaauggggaggugauguc

SEQ ID NO: 41752 - RNA, 64 nt, Human
uggccugcucuuacuucccccacccuggguuuggccccuggaaccuuucccuuguguguaccac

SEQ ID NO: 41753 - RNA, 64 nt, Human
aauuccaccuuggacacuggguuaauucuguuugccccuggaacacaaucacguaaguuuccuu

SEQ ID NO: 41754 - RNA, 64 nt, Human
cugcucuuggaguggacaugaccagacaccgcacccccuggaucuggcugagggcucaggacac

SEQ ID NO: 41755 - RNA, 64 nt, Human
cagcccagaagagauggaccucucccaggagcagccccuggaugcccagcaggguccccccgaa

SEQ ID NO: 41756 - RNA, 64 nt, Human
aaggguuuuuccuuagcacacgaaaaagccccuuccccuggauucauguuucuuauuuuggagg

SEQ ID NO: 41757 - RNA, 64 nt, Human
caccuuauaggcccuaggccuggccaggcauuguccccuggaaaccuguguggcuaaagucugc

SEQ ID NO: 41758 - RNA, 64 nt, Human
aaagugucugcaguaggggacccagagucccaggccccuggaguuguuuucggcaggggccuug

SEQ ID NO: 41759 - RNA, 64 nt, Human
aagaguagcugaguuacugggcccagaggcugggccccuggacauguaccugcagaauaauaaa

SEQ ID NO: 41760 - RNA, 64 nt, Human
guccaaagucccaggcccagugcaguccuugcggccccuggaaugaucaacucauuccagcuuu

SEQ ID NO: 41761 - RNA, 64 nt, Human
gcugugauauuuacuagaauugaacauucaaaaaccccuggaagagacucuuuaagaccucaaa

SEQ ID NO: 41762 - RNA, 64 nt, Human
ggguuaugaaucugccaaaggugguaugaaccaaccccuggaagccaaagcggccucuccaagg

SEQ ID NO: 41763 - RNA, 64 nt, Human
uuccuuucuuugcucaaugcagggcuucuugcacccccuggaaagcuaagagauuuuuuucaac

SEQ ID NO: 41764 - RNA, 64 nt, Human
agaaggcuacgcagggcugaggaugaagaugcagccccuggauggucccagacucucaggacau

SEQ ID NO: 41765 - RNA, 64 nt, Human
guggccuugggcacaguuuugcaaccaaccuacuccccuggaaagauggcuuccuucuccaauu

SEQ ID NO: 41766 - RNA, 64 nt, Human
caccaggagucacuucuauaccucccuaaccucaccccuggaaagccaccagauuggaggucac

SEQ ID NO: 41767 - RNA, 64 nt, Human
ccuacccaguuccaugauauuucuugcccuguucccccuggaaugugcagugggccagcugaga

SEQ ID NO: 41768 - RNA, 64 nt, Human
gucaguaggaggcuggauuggaguggugauuauuccccuggagcuaagcucaggagcccgaagg

SEQ ID NO: 41769 - RNA, 64 nt, Human
cugaaacaucacugcccucagaggcugcucccuuccccuggaggcuggcuagaaaccccaaaga

SEQ ID NO: 41770 - RNA, 64 nt, Human
gaccauccaguuugaaaauguggacuugaaggaaccccuggagcagaaggacuuacuguugcuc

SEQ ID NO: 41771 - RNA, 58 nt, Human
gcagugccagucaguucugagcgagcggccccuggacaguugcagagaaacacaggcu

SEQ ID NO: 41772 - RNA, 64 nt, Human
gcacagaagggcuguccuguguccccccaacccuccccuggacagacucugaaggcccucccgg

SEQ ID NO: 41773 - RNA, 64 nt, Human
gcugacccagugagggugccuucugcugcccaguccccuggacacauugaagagaggagcaagu

SEQ ID NO: 41774 - RNA, 64 nt, Human
gggcgucuccuguaauuacugccuugccauucugccccuggacccuucucuccggaccagggag

SEQ ID NO: 41775 - RNA, 64 nt, Human
gugaccugagaaggaaagaaagauccucugcugaccccuggagcagcucucgagaacuaccugu

SEQ ID NO: 41776 - RNA, 64 nt, Human
acacagggugaggccccccagccaggauaugccuccccuggaggagcacagcacugcauaugcu

SEQ ID NO: 41777 - RNA, 64 nt, Human
uuucacacuaaggaaaaaacuaguauucccugugccccuggaugcacuuucauuauagcagaga

SEQ ID NO: 41778 - RNA, 64 nt, Human
auacacacauacacauauucuucaggucucuaagccccuggaagcagcauugugugauauucuc

SEQ ID NO: 41779 - RNA, 64 nt, Human
ugugccugugcgagaggugcuguggucugggcagccccuggaaaagcaccuuugcugccuguca

SEQ ID NO: 41780 - RNA, 64 nt, Human
agcccccucucccguccucaugcucccucucaguccccuggauugccccaguccugugaccaug

SEQ ID NO: 41781 - RNA, 64 nt, Human
ccaagggacccugucccucgguggccuccccaggccccuggacacgacaguucuccucaggcag

SEQ ID NO: 41782 - RNA, 64 nt, Human
cgcuccaccuuugagcuguucacaccuguggcuaccccuggaaagcgcugggguuguugaugcu

SEQ ID NO: 41783 - RNA, 64 nt, Human
cagagccagaagguaggucuguucagagucugugccccuggaccuggggaguggauaucagaug

SEQ ID NO: 41784 - RNA, 64 nt, Human
cugugugaucugcuccagcagugggaccaguuggccccuggacugcccauccugcugggauggc

SEQ ID NO: 41785 - RNA, 64 nt, Human
auuaaaaugugccuuuggugggcggggucaagagccccuggaugucgaccucucccgcugugug

SEQ ID NO: 41786 - RNA, 64 nt, Human
aggugggcccaagggugccuggcagggagcacuaccccuggaccccuccugcucgcucugggga

SEQ ID NO: 41787 - RNA, 64 nt, Human
cuauagcuauagaacuugggggcuaucuccuaugccccuggacaggacaguuggcuggggacag

SEQ ID NO: 41788 - RNA, 64 nt, Human
cucccaccucucagccuuguuauuggguuucaugccccuggaccagccuuaucucagaccugcu

SEQ ID NO: 41789 - RNA, 64 nt, Human
ucuucugaacccaagcccucucgacugccccuauccccuggaccccaacauaccuacaaugcug

SEQ ID NO: 41790 - RNA, 64 nt, Human
cggcuccuggacucauugcuucacaacccaucuaccccuggaugaaguuaucuggcuucaaaua

SEQ ID NO: 41791 - RNA, 64 nt, Human
gauuuugaaacgaucugcaggucuugccagugaaccccuggacaacugaccacacccacaaggc

SEQ ID NO: 41792 - RNA, 64 nt, Human
uguugaacuggccucuuuucaggacuuuuauuucccccuggaugguuguugggagggagggaaa

SEQ ID NO: 41793 - RNA, 64 nt, Human
uauagugcuucugagcccagcagggcuuuaccugccccuggagaguuuuagccgucuuguguuu

SEQ ID NO: 41794 - RNA, 64 nt, Human
gaacugagccggagagagagaauggaauugcugaccccuggaacuggcggguauucuggucauu

SEQ ID NO: 41795 - RNA, 64 nt, Human
guuggucuuccggagaauagugcuacccucacauccccuggagcacagccuuccugaaaugccc

SEQ ID NO: 41796 - RNA, 64 nt, Human
cgccuccagagaaaaguugcucccgagguccaugccccuggaacguguuccuaucacucuggcu

SEQ ID NO: 41797 - RNA, 64 nt, Human
cagaacgugcuuccucuuucagacgguguaaaguccccuggaauuacacagcuuuagugcugag

SEQ ID NO: 41798 - RNA, 64 nt, Human
aguuuaaaaaaaaaaaugauuuucucaaggaaugccccuggaacacagcucugaagagaguuua

SEQ ID NO: 41799 - RNA, 64 nt, Human
cugacuuccccuucucccauccugaacauuuguaccccuggagaaguuccuuagcagggaggag

SEQ ID NO: 41800 - RNA, 64 nt, Human
cccaaaggaaacucauuccaaauacuucuuuuuuccccuggaguccgagaaggaaaauggaauu

SEQ ID NO: 41801 - RNA, 64 nt, Human
cugcuguccacagguggacucuggggaagccaggccccuggaucccaaguccuuuguguccgga

SEQ ID NO: 41802 - RNA, 64 nt, Human
acugaggcccagauaaugagcugagauucagcauccccuggaggagucggggucucagcagaac

SEQ ID NO: 41803 - RNA, 64 nt, Human
ugcugggauugcaggcaugagccacugcacccaaccccuggaaaacuaaauuuuuaagugcuua

SEQ ID NO: 41804 - RNA, 64 nt, Human
aggagcaacccaccccauggucgagguuccccuaccccuggauccuggacugaagccauuuccu

SEQ ID NO: 41805 - RNA, 64 nt, Human
cggcacccucacugcuggugaccagccuuguaacccccuggagaugcccauguuccuuauggua

SEQ ID NO: 41806 - RNA, 64 nt, Human
ggucaagcgggagggagauagucacuuguucuugccccuggaaaaaauucaggugaugucuuug

SEQ ID NO: 41807 - RNA, 64 nt, Human
auuguuggcaccaugggaccagaagguggugaccccccuggacccagcuuucacuaucuugugu

SEQ ID NO: 41808 - RNA, 64 nt, Human
cuuacuguauauauauaauuccuacugaagaaauccccuggaaaugcaaaaaauguggcaggau

SEQ ID NO: 41809 - RNA, 64 nt, Human
ccagcaccccaggcagucugugugugaggcauagccccuggacacacacacacagacacacaca

SEQ ID NO: 41810 - RNA, 64 nt, Human
cguggucagagggacugucagcugagcuugagcuccccuggagccagcagggcugugaugggcg

SEQ ID NO: 41811 - RNA, 64 nt, Human
ccagggguccgagggccguggccugcguggccauccccuggagagaggagccgcucagggugcg

SEQ ID NO: 41812 - RNA, 64 nt, Human
caccaugucugagcuugggggaauugccucauuuccccuggaaaagaaacaugguccauuagag

SEQ ID NO: 41813 - RNA, 64 nt, Human
uguagacugucuuaccauagacugucuuacccauccccuggauaugcucuuguuuuuucccucu

SEQ ID NO: 41814 - RNA, 64 nt, Human
gcauuaacccuuuggggcugggguggcccgccauccccuggaguaaaugccugugcaaagcccu

SEQ ID NO: 41815 - RNA, 64 nt, Human
gagcgccaccuccagaucagauggggacacacaaccccuggauauguuucauugucagauuuug

SEQ ID NO: 41816 - RNA, 64 nt, Human
agggguggaguuuuaacuguaaggugcuacaaugccccuggaucuaccagcauaaauaucuucu

SEQ ID NO: 41817 - RNA, 64 nt, Human
gcagagacugacaugcuuuuauugaccugcuaagccccuggaugauggagcgagaagggaaggg

SEQ ID NO: 41818 - RNA, 64 nt, Human
ugguggggugcuggcagccucaggagcgaucgcuccccuggagagggugauugaguguggagau

SEQ ID NO: 41819 - RNA, 64 nt, Human
ugugguacaacaugguccuuggugaagaccugcaccccuggaaccucccaccaucaucacaacu

SEQ ID NO: 41820 - RNA, 64 nt, Human
guccugcauaugcagaggacggagcaggcucagcccccuggaagaugagcucaaggggaggaca

SEQ ID NO: 41821 - RNA, 64 nt, Human
gcaggaccgagggccacagccggacaggggguagccccuggauucaggcacacgaccaccacac

SEQ ID NO: 41822 - RNA, 64 nt, Human
cgcccucguggccgcgggacuggccccggggggcccccuggaucccaggccagcgcuuugcucu

SEQ ID NO: 41823 - RNA, 64 nt, Human
gccggagcggcggggcucauggcucccaucuuggccccuggaggugagcucauucacagaagug

SEQ ID NO: 41824 - RNA, 64 nt, Human
acaggccaggaaccagagcccaucaucucagaggccccuggauguccuucgaaggaaccaggac

SEQ ID NO: 41825 - RNA, 64 nt, Human
cacagcugccucacgguugacguuguguccuccuccccuggacaaucuccucuuggaaccaaag

SEQ ID NO: 41826 - RNA, 64 nt, Human
cgaaaaaaagagcaaaaccguuuuaaauaaacucccccuggaaaaaaacccaaaacacuggcau

SEQ ID NO: 41827 - RNA, 64 nt, Human
gggauuucuucucacaggcccaauccugaaugugccccuggaccuucuggacccuugaguccaa

SEQ ID NO: 41828 - RNA, 64 nt, Human
ccaacuuccuugccacaagcuucccaggcuuucuccccuggaaaacuccagcuugagucccaga

SEQ ID NO: 41829 - RNA, 64 nt, Human
ggggggagaaggggcucccaacaugacccugaguccccuggauuuugcauucacuccugcggag

SEQ ID NO: 41830 - RNA, 64 nt, Human
cccaagacugccaccagucuacacauacagcagcccccuggacagaaucagcauuucagcucag

SEQ ID NO: 41831 - RNA, 64 nt, Human
aaugugcuguuucuaguuucuuaaauagcccacaccccuggaugcaaaaaggcaggguuauuuu

SEQ ID NO: 41832 - RNA, 64 nt, Human
gaugggugcuuccuuguacccggccaccagaaaaccccuggaacuccucuuucauagaucguga

SEQ ID NO: 41833 - RNA, 64 nt, Human
uccugcaugccggugaucccuagcugugaccucuccccuggaacugucucucaugaaccucaag

SEQ ID NO: 41834 - RNA, 64 nt, Human
uuggugcucauuugucacugaucugaagccacucccccuggagucucaacuauagaaauugugg

SEQ ID NO: 41835 - RNA, 64 nt, Human
augcaacaguuugucuuucacauuggaagggacaccccuggaugccccuaaccacuagaccugu

SEQ ID NO: 41836 - RNA, 64 nt, Human
ggcccuggggguuucagucaucuccccauuugguccccuggacugucuuuguugauucuaacuu

SEQ ID NO: 41837 - RNA, 64 nt, Human
uuaucccugugcccuuuccccaccucaggcccuaccccuggacccuccccaaccuuccuucucu

SEQ ID NO: 41838 - RNA, 64 nt, Human
ccaccacccugcucucaaaggccuccucuccagaccccuggaagggaggcuuccccaucuuuag

SEQ ID NO: 41839 - RNA, 64 nt, Human
cuguugacacaacuucccagcucugcaagugugcccccuggaucaaggcggguccccucuuguu

SEQ ID NO: 41840 - RNA, 64 nt, Human
gggaguaguugucuuuccuggcacuaacguugagccccuggaggcacugaagugcuuaguguac

SEQ ID NO: 41841 - RNA, 64 nt, Human
ggaacaacauuuacaacucauuccagaucccaggccccuggaggcugccucccaacagugggga

SEQ ID NO: 41842 - RNA, 64 nt, Human
ccccugcccaucugucacccaccugcuccuuugaccccuggacuugguauaccuccauguggag

SEQ ID NO: 41843 - RNA, 64 nt, Human
gagagcagagacagguggaccaacagacagcuggccccuggaggcagaaaggcccuucuaacuu

SEQ ID NO: 41844 - RNA, 64 nt, Human
aauauagaaaugcuuuacauauuagacuuucucuccccuggaagcacuggguugaacuugcuaa

SEQ ID NO: 41845 - RNA, 64 nt, Human
accacuaaagcuauccaguuaagugcagguaguuccccuggaggaaauaauauuuucaaacugu

SEQ ID NO: 41846 - RNA, 64 nt, Human
gcuuguaaaagcacaagugagaggcagcaucaggccccuggagggcugugguccucggacucgg

SEQ ID NO: 41847 - RNA, 64 nt, Human
gggcaggggugcuuccuccucaggcccagcugcuccccuggaggacagagggagacagggcugc

SEQ ID NO: 41848 - RNA, 64 nt, Human
cacuguagcgacugauguuaguuguuacccagauccccuggaaaagcacacuaccaguguugug

SEQ ID NO: 41849 - RNA, 64 nt, Human
cccugguuuaggaaagcagugcuuuaaccuuuugccccuggaaauuacugauucuuucugugau

SEQ ID NO: 41850 - RNA, 64 nt, Human
cgcucacaccguccuuucccgucacccuugcuauccccuggagcacugcccuccagagcugccc

SEQ ID NO: 41851 - RNA, 64 nt, Human
ucugccccagcccugagagggguggugaggcagcccccuggaccccagaaccccagacaagggg

SEQ ID NO: 41852 - RNA, 64 nt, Human
uggaauggcaccaucauucacaucagaacugcagccccuggaaaagaagagacagccauagacg

SEQ ID NO: 41853 - RNA, 64 nt, Human
cgcugggcauccucaggcuggcggccaaggccugccccuggaggcacuagaggagggcaucugu

SEQ ID NO: 41854 - RNA, 64 nt, Human
gagacaucuguugcgguuuuuuuuuuuuuuuuuuccccuggaaugcaguggcgugaucucagcu

SEQ ID NO: 41855 - RNA, 64 nt, Human
caggacucucugccucacccgcuucagcccagggccccuggagacugauccccucugaguccuc

SEQ ID NO: 41856 - RNA, 64 nt, Human
gcugccaacgcgcacgcucggguccgaggcugcuccccuggagcggcgccccugcgcccucagc

SEQ ID NO: 41857 - RNA, 64 nt, Human
acaagaguucuggguacaauuuugggaucuaguuccccuggaaaagcugcuguauuuuuaauuu

SEQ ID NO: 41858 - RNA, 64 nt, Human
ucuuucagggggguugugaggccuggccaggcacccccuggagagaaguuucuggcccuggcug

SEQ ID NO: 41859 - RNA, 64 nt, Human
cuucgugcuugggguagaucuucuucacauauucccccuggaaggagcaacuuuucugugcccu

SEQ ID NO: 41860 - RNA, 64 nt, Human
ugacuuguugaaagugcagaaauggaaugcuggcccccuggaucugcacaucugccucgcugcu

SEQ ID NO: 41861 - RNA, 64 nt, Human
uccucuacugcccagccccuccugauuucuuuggccccuggacuauggugcuguauauaaugcu

SEQ ID NO: 41862 - RNA, 64 nt, Human
guggucuccacuggggauugggccccugccagacccccuggagacuaaccccaccacacccucc

SEQ ID NO: 41863 - RNA, 64 nt, Human
cucugcagaaggagcacuuggcccuggccaggaaccccuggaacugaggccacgauccccucuc

SEQ ID NO: 41864 - RNA, 64 nt, Human
auucuugcugcaagagcagguaccccccgccgccccccuggaaagcacaagugaugagcaagaa

SEQ ID NO: 41865 - RNA, 64 nt, Human
uaaugcuuuugguuuaaucucaauuagucuuucuccccuggacuagaaauccaguauaguuugc

SEQ ID NO: 41866 - RNA, 64 nt, Human
aucuuguaucuguuuaugccucucuucuuuggggccccuggauguuuuuguggauuuuuacaga

SEQ ID NO: 41867 - RNA, 64 nt, Human
guaucacaucugcccucccugcaauugggcagcuccccuggaagaagcugauggaauucauaua

SEQ ID NO: 41868 - RNA, 64 nt, Human
aucagggucauccuacagccuccaagcgggcuuuccccuggacaaaugccacugcaacauuuau

SEQ ID NO: 41869 - RNA, 64 nt, Human
guucgggagaauggggccggggcuggccuggccuccccuggauauacucuauagugcaccaaaa

SEQ ID NO: 41870 - RNA, 64 nt, Human
ggaucgucggggaagccccucuuccugcucugcuccccuggaaacuguugcaaaacucccagcc

SEQ ID NO: 41871 - RNA, 64 nt, Human
ccccgcagccuuucccucggaccccccucgaagcccccuggacugauucccacccacgacucac

SEQ ID NO: 41872 - RNA, 64 nt, Human
cagccacacaaucagcccggcucgggagcaaacuccccuggaagaacggaguuaugaguugguc

SEQ ID NO: 41873 - RNA, 64 nt, Human
gcuggccggggcccucgccgcggccgccacgaccccccuggacgucuguaagacccuucugaac

SEQ ID NO: 41874 - RNA, 63 nt, Human
ccucugccagcaccuacugagggaaaggaaaagccccuggaaaugcgugugaccugugaagug

SEQ ID NO: 41875 - RNA, 64 nt, Human
gcuggagcagggccagagccuugggccgguggagccccuggacgguccagcaggugcuguccug

SEQ ID NO: 41876 - RNA, 64 nt, Human
ccuggcguagagcaccccuccccucccccccaccccccuggagugcugcccucuggggacaugc

SEQ ID NO: 41877 - RNA, 64 nt, Human
gcugccguugccgcguguggagccgcagccuuucccccuggacuggccuaugcccccgcgcccg

SEQ ID NO: 41878 - RNA, 64 nt, Human
gcccacuauaggcccaggcgccuuacgugcuucuccccuggaccuaugugcaucccucaccugc

SEQ ID NO: 41879 - RNA, 64 nt, Human
cacuccgcaucaccucaccaaggaucggacucugccccuggaccugggaacgacuggacuguca

SEQ ID NO: 41880 - RNA, 64 nt, Human
ucgcccaucacaggaguaccuggaccuguccaugccccuggaccaguacucccccagcuuuccc

SEQ ID NO: 41881 - RNA, 64 nt, Human
ggccaggagagagagacagggcuggcuccucucgccccuggagccgcgguguggacggcccggc

SEQ ID NO: 41882 - RNA, 64 nt, Human
ugcccuccaggccgacaggaggccaugcccaccgccccuggacaggcuucgucucagaaggcuc

SEQ ID NO: 41883 - RNA, 64 nt, Human
cagcgaguguuggguccucugcuuccugagcuguccccuggagaaggucccgaggaugcuguca

SEQ ID NO: 41884 - RNA, 64 nt, Human
agguagggagcgcccuccuucucccgccucugcgccccuggaucgcgucgcagggacucagguc

SEQ ID NO: 41885 - RNA, 64 nt, Human
ggccaacccuuccaugggugaagacaagcaagucccccuggaggcggguggcccagaaagccau

SEQ ID NO: 41886 - RNA, 64 nt, Human
uggcaacucugaucugacgccucugugcucagggccccuggaggaggggcuacugccccuuggc

SEQ ID NO: 41887 - RNA, 64 nt, Human
gcuugucccaggcuacugggcuguggucucugacccccuggaggccuccccacgccucacagaa

SEQ ID NO: 41888 - RNA, 64 nt, Human
ccuucucuccucugcugcagcuacugauaucuggccccuggaauaaaaccauaguuccuaaaau

SEQ ID NO: 41889 - RNA, 64 nt, Human
auggacccuuuuaacuuucugaagaugggaccguccccuggaggaaagucauuccugccuaauc

SEQ ID NO: 41890 - RNA, 64 nt, Human
ucuucugauggcuauuccuccaccuuauucccagccccuggaaacuuugagcugaagccagcac

SEQ ID NO: 41891 - RNA, 64 nt, Human
gugccagagaagagagaucauggguauagaccagccccuggaaaggcugcuuuggucaaggcug

SEQ ID NO: 41892 - RNA, 64 nt, Human
uugucaggugcuguuuuguuuaagcucuaacucaccccuggaauacaggggaaugaugacaacc

SEQ ID NO: 41893 - RNA, 64 nt, Human
cugagcucaugaacuugguucgcagccugccuugccccuggaggccacgccaggcgcucacccc

SEQ ID NO: 41894 - RNA, 64 nt, Human
accacaaggcgggaaaguccauggguagacccucccccuggagggaagcauuucuaguuuuugc

SEQ ID NO: 41895 - RNA, 64 nt, Human
cugggagacagaugaggagacuggcucagcaaggccccuggaggucaagcuuggccuuugccuc

SEQ ID NO: 41896 - RNA, 64 nt, Human
cagagugccugaggcuuccugcuugagaaccugcccccuggaucuuggacacuuacagauugag

SEQ ID NO: 41897 - RNA, 64 nt, Human
gcuggucccccacaccgcguccugcugagccugcccccuggauuggcuguaauuugccucgaag

SEQ ID NO: 41898 - RNA, 64 nt, Human
ggagggagccacugagcacagcaaggcaccaaagccccuggagaaaccgccagggcgaggugcg

SEQ ID NO: 41899 - RNA, 64 nt, Human
aguggagagaaguccuuggugauuguaaagagggccccuggagcucauuucugaaucgcacucu

SEQ ID NO: 41900 - RNA, 64 nt, Human
aaggaaggcugagcagcuugguucuccccucuggccccuggagagaagggagcauuccuagacc

SEQ ID NO: 41901 - RNA, 64 nt, Human
cugguaaaguagcucagugguguggggaaacguuccccuggaucauacuccagaauucugcucu

SEQ ID NO: 41902 - RNA, 64 nt, Human
aaggaggggccugaggcucucccuacucccucagccccuggaacgguguuuucugaggcaugcc

SEQ ID NO: 41903 - RNA, 64 nt, Human
ccagugagacaagcugaagauuaggcacacagauccccuggaaacccaccucucuggaaggccc

SEQ ID NO: 41904 - RNA, 64 nt, Human
aggcggagagcgccccuccaaccaggcuguuauuccccuggacuccgugacaucuguggaauuu

SEQ ID NO: 41905 - RNA, 64 nt, Human
uuccugccacacucugcuuucuuccugccauggaccccuggaggagaccuauggagggacaguu

SEQ ID NO: 41906 - RNA, 64 nt, Human
uugaggcugugcgccuuggugggcuucacgucuuccccuggauuugcuuaguacucagccagug

SEQ ID NO: 41907 - RNA, 64 nt, Human
cagcgcccucaagaccuaccuggugucggggcagccccuggaagagaucaucaccuacuaccca

SEQ ID NO: 41908 - RNA, 64 nt, Human
cauuauggggacagagagcagggggcagacagcaccccuggaguccuccuagcagaucgugggg

SEQ ID NO: 41909 - RNA, 64 nt, Human
ucggaggggaccugcccccacacccucugcucagccccuggacucagccuugccugucuuuucc

SEQ ID NO: 41910 - RNA, 64 nt, Human
uacgcagguggagccaaagcagcaggcgccuuugccccuggagucaagacccacagcccucggg

SEQ ID NO: 41911 - RNA, 64 nt, Human
uggguuuugagaaacucgcuggcaccacagugggccccuggacccggccgcgcagcugguggac

SEQ ID NO: 41912 - RNA, 64 nt, Human
aagcagguucgagccacaagggccaaccaggaggccccuggagcccagaucugucaucuggugc

SEQ ID NO: 41913 - RNA, 64 nt, Human
caauggcugcucucaaucccuugagggagaagagccccuggagggccuggcauguuuguccugc

SEQ ID NO: 41914 - RNA, 64 nt, Human
aggguugguccuguccccaccuccacccucccacccccuggaagaggaagggcccgggcaucag

SEQ ID NO: 41915 - RNA, 64 nt, Human
gccaaugucuucuagcugcuuccucaaccccuguccccuggagaccagaagcugaggcccucuc

SEQ ID NO: 41916 - RNA, 64 nt, Human
cugaccagcuguguggcccuggccgagucguagcccccuggagcccagcuuccauuucuauaaa

SEQ ID NO: 41917 - RNA, 64 nt, Human
cuuaugucucuugugacaauuguuuuccucccugccccuggagguugucuucaagcuguggacu

SEQ ID NO: 41918 - RNA, 64 nt, Human
uaaucaagaggcguguguggcgaacuuggggcagccccuggaagucuuguucuuugaccauuac

SEQ ID NO: 41919 - RNA, 64 nt, Human
augcaacaagacccccagccuacauuucucagcuccccuggagccagcugauccuguaacgcug

SEQ ID NO: 41920 - RNA, 64 nt, Human
ggagucccacccucgcuaccacucacuuccccauccccuggaauaugggagucugaccuuucua

SEQ ID NO: 41921 - RNA, 64 nt, Human
aaagaaacuccugaucauuggccaaagggacuuaccccuggagaggccaagugccuucuaggaa

SEQ ID NO: 41922 - RNA, 64 nt, Human
ggcccagggggcuuccugaggggagacagagcaaccccuggaccccagccucaaauccaggacc

SEQ ID NO: 41923 - RNA, 64 nt, Human
cauggggucucucacagacaggaccccugcaguuccccuggaagcagugcccagguggcugugg

SEQ ID NO: 41924 - RNA, 64 nt, Human
cuuuccuuugugugguaggacuuggaggagaaauccccuggacuuucacuaacccucugacaua

SEQ ID NO: 41925 - RNA, 64 nt, Human
gaacugcugagagaagaugggcagaaagcuggagccccuggaguuggcugugucuguguuugug

SEQ ID NO: 41926 - RNA, 64 nt, Human
auccuggucauguuacugcauuuguggccggccuccccuggaucaugucauucaauuccaguca

SEQ ID NO: 41927 - RNA, 64 nt, Human
cccccuugaagcaauaacuccaagcagacuccagccccuggaccccugggguggccagggcuuc

SEQ ID NO: 41928 - RNA, 64 nt, Human
aggcguguugguuuugccuucuggugcccauaguccccuggacugagucccccaggccuuccuu

SEQ ID NO: 41929 - RNA, 64 nt, Human
guucagcuccagccgacuggggcauuggugguagccccuggagacauugugcaauggggcuacg

SEQ ID NO: 41930 - RNA, 64 nt, Human
caggguuucaagaagucuuagggcuuccagggguccccuggaagcuuuagaauauuuauggguu

SEQ ID NO: 41931 - RNA, 64 nt, Human
gaaggcucccacuugagagcagccucuaccugacccccuggaccacagagagccacucugaccc

SEQ ID NO: 41932 - RNA, 64 nt, Human
cuccagcagccuuuaagaagugucccuuuggcgcccccuggaggcagagcacugagcuggaccc

SEQ ID NO: 41933 - RNA, 64 nt, Human
uuguggccacacuaaaaacaaucauagcauuuuaccccuggauuauagcacaucucauguuuua

SEQ ID NO: 41934 - RNA, 59 nt, Human
ccagcugguucgagcggugaagccgcgcuccccuggaagcgacccaggggaggccaagu

SEQ ID NO: 41935 - RNA, 64 nt, Human
uacacacaaagucugguuuuuccugcccaacuucccccuggaagguguacuuuuuguuguuuaa

SEQ ID NO: 41936 - RNA, 64 nt, Human
aaaaguuucuccuacuccagcuggcccuguauucccccuggaaggaagggaaucaugccuucua

SEQ ID NO: 41937 - RNA, 64 nt, Human
uguuuagguuugggaaggauuuuguauauuuuucccccuggagugaguaggggccauuuuuggg

SEQ ID NO: 41938 - RNA, 64 nt, Human
acuggacaggaagccuggcacccacuucugucuuccccuggaacugggcacuggcguacacugg

SEQ ID NO: 41939 - RNA, 64 nt, Human
gaguguaaaccgucccgcccugaggcuggaccggccccuggacuucuacgagcggccgaacaug

SEQ ID NO: 41940 - RNA, 64 nt, Human
ugcugggauuagaggcaugagccacugcgcccggccccuggagcaaguuauuucuuacaaagcu

SEQ ID NO: 41941 - RNA, 64 nt, Human
uguagauuuuugcucuucucaguuuacucauuguccccuggaacaaaucacugacaucuacaac

SEQ ID NO: 41942 - RNA, 64 nt, Human
gugaugcugucugucugucugagucucguggccgccccuggaccagugaugacugaugaaucuu

SEQ ID NO: 41943 - RNA, 64 nt, Human
ggacucuuccuccuggcaucaggggccaugaagcccccuggagagagauguuggagccacccau

SEQ ID NO: 41944 - RNA, 64 nt, Human
ugcacagacugguccacagggcuccugaaggaagccccuggaucuuugggguaaaaggagggug

SEQ ID NO: 41945 - RNA, 64 nt, Human
cucugaggcccagucacugcuccugggacccaguccccuggaggggagguggaaaaucagugcu

SEQ ID NO: 41946 - RNA, 64 nt, Human
ucccuucaccccaguugccaaacagaccccccacccccuggauuuuccuucucccuccaucccu

SEQ ID NO: 41947 - RNA, 64 nt, Human
acagacugaguggcaggccuccuccugagggcagccccuggagcaccaggaagcguugccgcug

SEQ ID NO: 41948 - RNA, 64 nt, Human
gggaagaggacuucgggguagaggcugggaggagccccuggacaugccuguccugaaagcggcu

SEQ ID NO: 41949 - RNA, 64 nt, Human
aagugaggaggcccaugggcagaagauagagauuccccuggaccacaccuccgugguucacuuu

SEQ ID NO: 41950 - RNA, 64 nt, Human
uuccccccuucuucaaguuauugcucccuccauuccccuggacccagggacaugcagcccuaca

SEQ ID NO: 41951 - RNA, 64 nt, Human
aggcugacaaccaggucauccaggagggcuggccccccuggaauauugugaaugacuagggagg

SEQ ID NO: 41952 - RNA, 64 nt, Human
aguggcagcgucaucacuuugcugaggugaaaugccccuggaugccaugaauaccuaggggaaa

SEQ ID NO: 41953 - RNA, 64 nt, Human
gaggaggaggcacacggagaccuggggcucggggccccuggauuccugcaucugcauaugcgua

SEQ ID NO: 41954 - RNA, 64 nt, Human
ggcggggcgggggucugccggccucugggcaaggccccuggagcaucucgcccaggcuuuuuau

SEQ ID NO: 41955 - RNA, 52 nt, Human
acauggccuccaaggaguaagaccccuggaccaccagccccagcaagagcac

SEQ ID NO: 41956 - RNA, 64 nt, Human
gugaaacucuuaaguauaucuggaaagcagucugccccuggaggugggcagaaaaaaguaaaac

SEQ ID NO: 41957 - RNA, 64 nt, Human
cuuaaguuguggucugacacacacugcugugguuccccuggauuuagugaaaugccguaugcag

SEQ ID NO: 41958 - RNA, 64 nt, Human
acaggaagaaguauggugggggcugggguagacuccccuggagccaagccuauccagcuaacaa

SEQ ID NO: 41959 - RNA, 64 nt, Human
ucugaaagagcagcacuucucagcuauuaaaggcccccuggauagacuuucucuguucuguggc

SEQ ID NO: 41960 - RNA, 64 nt, Human
agcacccuuccugcuggcgugaccgugucuaacuccccuggagugacgaccaccgccccaccac

SEQ ID NO: 41961 - RNA, 64 nt, Human
cuuugcaaucaaggccaaagaaaaugaucugcuuccccuggaaaaaaaucguguuaagcuagau

SEQ ID NO: 41962 - RNA, 64 nt, Human
acuucacggguaugguugccagcuguguuccuggccccuggacacacaguguggcauccucaug

SEQ ID NO: 41963 - RNA, 64 nt, Human
uuggcuauuugcuuaccuucccguuucuccucugccccuggaagggaaugugggggcccacuuu

SEQ ID NO: 41964 - RNA, 64 nt, Human
cuucuuuuuugcccuuggcucuugacacucuaaaccccuggaccaucugaauggagcagccaag

SEQ ID NO: 41965 - RNA, 64 nt, Human
auggagguccugcugcuggucugggaugaugaugccccuggaaaccuuccugcaauggccccuu

SEQ ID NO: 41966 - RNA, 64 nt, Human
gaauccuuuugccaaggacagguggggcaacauuccccuggaugaugcugugcaguucaaccau

SEQ ID NO: 41967 - RNA, 64 nt, Human
gcuuaucaucuuucauuacuuuuuucccauuuagccccuggaauagcuuucaugccaaguuuag

SEQ ID NO: 41968 - RNA, 64 nt, Human
ugaguguacguuuucuuccaggagacaucaggucccccuggauucaaauuaagugcaauauuuu

SEQ ID NO: 41969 - RNA, 64 nt, Human
gcuguuuuuuggcaaaucuugauugugauaagccccccuggaggauaugauucacuuuauguga

SEQ ID NO: 41970 - RNA, 64 nt, Human
uuccccucagcagccccucuccuucucgugccucccccuggagcuuccggagcaguuucugggg

SEQ ID NO: 41971 - RNA, 64 nt, Human
cccuuaccgaucugugcucuccuagcccaagagaccccuggaggggcuggaguuuuauccagcg

SEQ ID NO: 41972 - RNA, 64 nt, Human
ggccgucgcuguggggguuuuuuucucugggguuccccuggaaaggcugcaggaacuaggcaca

SEQ ID NO: 41973 - RNA, 64 nt, Human
gaggagggcagggcugcggggaggccaggccgagccccuggaaccaucccguccuguaucauau

SEQ ID NO: 41974 - RNA, 64 nt, Human
gagcuccugugucaacauccuggagaacuucuacccccuggaggggggccgggugcugcuggac

SEQ ID NO: 41975 - RNA, 64 nt, Human
uucccuaccccuguuugcucuucaggaaaauuauccccuggaaaaguggauguuauagucgcuu

SEQ ID NO: 41976 - RNA, 55 nt, Human
uuguguuucuguccucaagaucugcccccuggaggagaagacgagcgucuuaccg

SEQ ID NO: 41977 - RNA, 64 nt, Human
uaacuacaaaucuuaaugagcauucuccacccauccccuggaaggagagaaaucaaaaacccau

SEQ ID NO: 41978 - RNA, 64 nt, Human
aguuuauuucugcucuaauuaaaaugucacuuuaccccuggauaaaggcacuuucacugccugu

SEQ ID NO: 41979 - RNA, 64 nt, Human
caccccugcaugccccaguugcccaccccgccugccccuggacaugaaguggucacgcuucauc

SEQ ID NO: 41980 - RNA, 64 nt, Human
ccuucagaguagaugcccggcaggcugggguuggccccuggagggucaggggaccaucuucuua

SEQ ID NO: 41981 - RNA, 64 nt, Human
cucacucucugggacaccauagccacugcccccuccccuggaugcccaguaauguaugucuacu

SEQ ID NO: 41982 - RNA, 64 nt, Human
uuuugcacagcucuugucagaaagcccugaguucccccuggauaaagaguuaauuuuaauccuu

SEQ ID NO: 41983 - RNA, 64 nt, Human
ugggagcagugugaaggagaagaggcaagaacgaccccuggaccgaccaaagcccgcgcgcugc

SEQ ID NO: 41984 - RNA, 64 nt, Human
ggugaugcuguuuagcuuuaauagaaacccccagccccuggaggggcuggauuccuuugggagc

SEQ ID NO: 41985 - RNA, 64 nt, Human
cccucccaacaacggccgagccugcaccgacaacccccuggaggaggaguaccuagcacaguug

SEQ ID NO: 41986 - RNA, 64 nt, Human
acucagacuuagcaaaccuccagccucuccguuuccccuggacuccuccucccuuuuccuccug

SEQ ID NO: 41987 - RNA, 64 nt, Human
uuaagaagaaaugccagcuguuuaaucacaccuaccccuggaaaagagguaaaccuuuugaaca

SEQ ID NO: 41988 - RNA, 64 nt, Human
gaggaauuuaagggguccccuagucuagucucugccccuggauaguguccagccuuguauauuu

SEQ ID NO: 41989 - RNA, 64 nt, Human
aacaccugcagcucauuguggauuaagaaccucaccccuggagggguggaguuucuaccccuga

SEQ ID NO: 41990 - RNA, 64 nt, Human
ugcagacaucuauuacauggaggcaguagaaggaccccuggagccagaggguuuucuaaaugag

SEQ ID NO: 41991 - RNA, 64 nt, Human
uguccuuacagcucugcccugaccccagccccugccccuggacaccugcugacagcucccacac

SEQ ID NO: 41992 - RNA, 52 nt, Human
auagaacagccugugagugaccccccuggaguagcucccagggguucaggug

SEQ ID NO: 41993 - RNA, 64 nt, Human
uacauguaaaggucuguuguugaauuguacucugccccuggaagcagauacagauggcugccug

SEQ ID NO: 41994 - RNA, 64 nt, Human
acgcccccgccacaggauccagagcaagcaccgcccccuggacgagcgggcccugcaggucugc

SEQ ID NO: 41995 - RNA, 64 nt, Human
aaggauucuaacccuaacccagcaccacaaagccccccuggagcaucuucccggcuggcaggac

SEQ ID NO: 41996 - RNA, 64 nt, Human
uucuggcugcaccugaaggcugcgugcaccuuguccccuggacaggucuccuuuccuggcccug

SEQ ID NO: 41997 - RNA, 64 nt, Human
aucaagggaagaaggaggaaugcuggacuggaggccccuggagccagauggcaagagggugaca

SEQ ID NO: 41998 - RNA, 64 nt, Human
aacuuccuccccugguuuuuuagggagaugguauccccuggaguagagggcaagaggagagagc

SEQ ID NO: 41999 - RNA, 64 nt, Human
caagaaacagaacuguuuacuaacuuugggacauccccuggaguuuuuaaaaauaaauaaauau

SEQ ID NO: 42000 - RNA, 64 nt, Human
ugugggcucugaggacggcuucuugcggcucuggccccuggacuucuccucggugcuccuggag

SEQ ID NO: 42001 - RNA, 64 nt, Human
ccuggcucuacccugggccuccuacuccccagcaccccuggaggaggcaggggcuccccgccgc

SEQ ID NO: 42002 - RNA, 64 nt, Human
uagccgguccggccucucuccaguccauccugaaccccuggaaaacccauaaaggccgcucucc

SEQ ID NO: 42003 - RNA, 64 nt, Human
gaacuccacugggguggaugggcugccugcacagccccuggagagggggccaggcacacccuca

SEQ ID NO: 42004 - RNA, 64 nt, Human
uauuuuaucagcuuacaguuuaaugccuaaguuuccccuggaaauagcaaauaaaauuguguau

SEQ ID NO: 42005 - RNA, 64 nt, Human
cucaggauccaaaagcuagcccugcccaccccagccccuggaccugcuuaccugggugugcacc

SEQ ID NO: 42006 - RNA, 64 nt, Human
gcgugaacuaacaaaccugugaacuguaaauaggccccuggaagcacgugcuuaagcccuuuug

SEQ ID NO: 42007 - RNA, 64 nt, Human
agcuaggaucugcauuuucagguuccgagccugaccccuggaacugaccagcgcucgauuguca

SEQ ID NO: 42008 - RNA, 64 nt, Human
agggaccugccccgaggaaggccaccccccagguccccuggaugauguggcaggacacucaccu

SEQ ID NO: 42009 - RNA, 64 nt, Human
auggugaccucgggaauggcaauuuuuugggcggccccuggacgaaggucugaaucccgacucu

SEQ ID NO: 42010 - RNA, 64 nt, Human
cgcagaggccgcuggucacuucgucaucauuuugccccuggagacgucuuucuuugugccuuga

SEQ ID NO: 42011 - RNA, 64 nt, Human
gcgcucccaccucggacaccaucuugggauuccuccccuggaaguuguccuuucugauccucuc

SEQ ID NO: 42012 - RNA, 64 nt, Human
ccgacgccugcccccgucccaccucgcggcgcagccccuggagcuccugcuggggggcagggcc

SEQ ID NO: 42013 - RNA, 64 nt, Human
acaacacucauugaccugaggcccuucucuccagccccuggaugcagccucacaguccuuacca

SEQ ID NO: 42014 - RNA, 64 nt, Human
acacagggguccggcuguggagcuccccugccagccccuggagcuccaggagggccuguugguc

SEQ ID NO: 42015 - RNA, 64 nt, Human
agggcccagcccugaaggagaucuccuugccugaccccuggaccuggaaauggaggcuucaugu

SEQ ID NO: 42016 - RNA, 64 nt, Human
cuuuggcagaaggagccuccggcuggggggagcuccccuggaggugggacuggcccuugcaccu

SEQ ID NO: 42017 - RNA, 64 nt, Human
aucucaccucccccauggcacagagcccuccacaccccuggaccagggcauccgggcccuagaa

SEQ ID NO: 42018 - RNA, 64 nt, Human
uauguauaggggccgggggcuucugcccagggcuccccuggaccaggacgccagguagggcagg

SEQ ID NO: 42019 - RNA, 64 nt, Human
cugcguguggacccuggcaggggggggugccaggccccuggaaagcagggguuaccguuacgag

SEQ ID NO: 42020 - RNA, 64 nt, Human
ggccgggcagggcccugcagaagcacaacuccggccccuggacccgggccggggcgcccaccgg

SEQ ID NO: 42021 - RNA, 64 nt, Human
cauccuacucaggucucuggagcuccucucuucaccccuggaaaaacaaaugaucuguuaacaa

SEQ ID NO: 42022 - RNA, 64 nt, Human
gggcucucccuccucuccccuucgcuguccccucccccuggagggcauggugucgggggguggc

SEQ ID NO: 42023 - RNA, 64 nt, Human
caaucauguccuucaccacugugccuuagaaucgccccuggacagaguuccugggcagagggga

SEQ ID NO: 42024 - RNA, 64 nt, Human
gcagaugcucccggccacucguuuaaauaacuguccccuggagggggccgggguuugaaggcag

SEQ ID NO: 42025 - RNA, 64 nt, Human
cagcagccauaccccucuucucaaucuuccuucuccccuggaaaaccugcucacuucugacccc

SEQ ID NO: 42026 - RNA, 64 nt, Human
cagcaauaacuggaauugugacucgagggauagaccccuggaugugacucuucuuuuuaaaagg

SEQ ID NO: 42027 - RNA, 64 nt, Human
uagccucuuuccagcuacacgucgcugccacaggccccuggaaaugcuaccuacguguugccgc

SEQ ID NO: 42028 - RNA, 64 nt, Human
gacuacuuggaaugauaaaggcaaaacucaacagccccuggagcugcgcuugugguggagcugg

SEQ ID NO: 42029 - RNA, 64 nt, Human
cacagccaccgcuuaggggaagccacugcagaugccccuggaaugggcacagcacagccagggc

SEQ ID NO: 42030 - RNA, 64 nt, Human
ggggaaggggcacagugucccucagcagcuuacgccccuggagucuuggggggcccagccuggc

SEQ ID NO: 42031 - RNA, 64 nt, Human
gaggucuguuaggccugccaaacggcgaccagcuccccuggagcgagggcaggccccuucccuc

SEQ ID NO: 42032 - RNA, 64 nt, Human
cccaucccuucucccaccuccuccccucucccucccccuggagacccuggaagugguguguuca

SEQ ID NO: 42033 - RNA, 64 nt, Human
ccucuguuuguccccuuuccaguccuccaccccaccccuggagcccagccugggagcgcaaaac

SEQ ID NO: 42034 - RNA, 62 nt, Human
gaccagagugggugggcaggaccuuggccuggugccccuggaaucaguggguggcauguguu

SEQ ID NO: 42035 - RNA, 64 nt, Human
ccagaaugaagguguagccaguguuucccauaugccccuggagccccacuuauugaggccagca

SEQ ID NO: 42036 - RNA, 64 nt, Human
ccagugacuuuauggggcugagcuaguagggaagccccuggaaagaugcugcguuccgaaccug

SEQ ID NO: 42037 - RNA, 64 nt, Human
gcgacuuacgaaauaaugauguuggcaccaguucccccuggaugggcuauagccagaacauuua

SEQ ID NO: 42038 - RNA, 64 nt, Human
uuugcccuucacaauucuacuccccagauccucuccccuggacacaggagacccacagggcagg

SEQ ID NO: 42039 - RNA, 64 nt, Human
cuguagcagugagaaaaagcuccuguccucccauccccuggacugggagguagauagguaaaua

SEQ ID NO: 42040 - RNA, 64 nt, Human
gcacagcggccccugcauccccuuggcugugaggccccuggacaagcagagguggccagagcug

SEQ ID NO: 42041 - RNA, 64 nt, Human
uuccugcuccacgggaaagaggucgauggauuuaccccuggacccauaagucuguucauccugc

SEQ ID NO: 42042 - RNA, 64 nt, Human
guccuucuguuuggugcuacccuugucuacucugccccuggauggugcggggugcuuucuccac

SEQ ID NO: 42043 - RNA, 64 nt, Human
ccugaaguugucaguggcucuuucuguccuucagccccuggaaggugcuccaggauaacaaaga

SEQ ID NO: 42044 - RNA, 64 nt, Human
ccccgaccuccuucaccagggguuggggccccuuccccuggagcccgugggugcaccuguuacu

SEQ ID NO: 42045 - RNA, 64 nt, Human
agggcggauaccugaaggugacuccgaguccagcccccuggagaaggggucgggggugggggua

SEQ ID NO: 42046 - RNA, 64 nt, Human
guggggcggcuccagggcuuuccagcauacccugccccuggaugggaaaggcagggucagggcc

SEQ ID NO: 42047 - RNA, 64 nt, Human
ucccagcccuucuuugcagcugggccucucuauaccccuggaugaacagcuugcucaggcccca

SEQ ID NO: 42048 - RNA, 64 nt, Human
cuugaggucucagccccuuucccuuguagcuccuccccuggagggggaauggcagcagggguug

SEQ ID NO: 42049 - RNA, 64 nt, Human
agcagguggacagguguuugcaggggcccaacuuccccuggagcucagagguguccccacugua

SEQ ID NO: 42050 - RNA, 64 nt, Human
ggucuagcuggcuaucucuggccuuacuaacaccccccuggaggcaugccccuuuucuccagca

SEQ ID NO: 42051 - RNA, 64 nt, Human
gcugcacgcuccccuccauccccaucggcccuguccccuggagugugucagagcccaggggaga

SEQ ID NO: 42052 - RNA, 64 nt, Human
ccccucuugagugucuuggggacagcucuuuccaccccuggaagauggaaauaaaccugcgugu

SEQ ID NO: 42053 - RNA, 64 nt, Human
agccccuucacacucuugugcagggacuugggggccccuggagcucaggggucaggcugcuuug

SEQ ID NO: 42054 - RNA, 64 nt, Human
gucaccucccaccuuuggagaggaauccuucccuccccuggacaaaguugcugacaagcugcug

SEQ ID NO: 42055 - RNA, 64 nt, Human
cuccaccucucagccauaucuuucagcccccacuccccuggauccguguguguguguguccgug

SEQ ID NO: 42056 - RNA, 64 nt, Human
gcugaggggucggcaagcaucugacuugcccaauccccuggauauggugagccccgccaugcuu

SEQ ID NO: 42057 - RNA, 64 nt, Human
acccacugggccugccugccccucccucaaaaggccccuggaguuguucaggcuguugggaggu

SEQ ID NO: 42058 - RNA, 64 nt, Human
gccugaagggcuggcccccucaggcaccuuuccuccccuggacacccauggucuccaugagugc

SEQ ID NO: 42059 - RNA, 64 nt, Human
ggcacugugccacccucauuccuccagagcuugaccccuggacauuugcacugacuuuauccag

SEQ ID NO: 42060 - RNA, 64 nt, Human
acucaaggccuccagccacuuauuuccauggauuccccuggacauauucccaugguagacugug

SEQ ID NO: 42061 - RNA, 64 nt, Human
cugugaugaucacccaagccccaggcugucuuagccccuggaguucagaaguccucucuguaaa

SEQ ID NO: 42062 - RNA, 64 nt, Human
cuguuagccaaggacaaagaaguucugcaaaccuccccuggacccuugcugguguccagauguc

SEQ ID NO: 42063 - RNA, 64 nt, Human
cugccuugcccuccugggcccugggcuggcacagccccuggagccucagaaaucuguuugauug

SEQ ID NO: 42064 - RNA, 64 nt, Human
uccagccagcugcccccuuccagccccuccaggaccccuggacccacugccgcugcucucugca

SEQ ID NO: 42065 - RNA, 64 nt, Human
ggggguuguggcccccgcccccucccuauaugcaccccuggaaccagcaagucccagacaagga

SEQ ID NO: 42066 - RNA, 64 nt, Human
ccccccagccugcuucuuccccuuaagcuuugugccccuggaugcgcuaacauucacucuuguu

SEQ ID NO: 42067 - RNA, 64 nt, Human
acaacaaaugcuaauuagaugacagcaaauuaacccccuggaggcuucuccuggcagagccucc

SEQ ID NO: 42068 - RNA, 64 nt, Human
ccccgaaggaggccucuguggcggccagggucccccccuggagcugcugggaggcggcgcuggc

SEQ ID NO: 42069 - RNA, 64 nt, Human
gagcggagcagccauucuccaggccccgugguugccccuggacgugugcgucugcugcuccggg

SEQ ID NO: 42070 - RNA, 64 nt, Human
accugcugggccagucccacacauuuccacccugccccuggagcagcagcuuugauaccauggg

SEQ ID NO: 42071 - RNA, 64 nt, Human
agcccugcggagccacuccaccccucuuccccuuccccuggauuuccugacauagauggugugu

SEQ ID NO: 42072 - RNA, 64 nt, Human
uugaccaguaagaggguaaauaaagugggggcaaccccuggauaugaauguuacccccuaaguc

SEQ ID NO: 42073 - RNA, 64 nt, Human
cuggaggcuggauucgaggccggaaacgccgggaccccuggacccggccuggugggagcagcgg

SEQ ID NO: 42074 - RNA, 64 nt, Human
gggacuccagaaccgcagaagccuccccagcucaccccuggaggacggccggcucucuauagca

SEQ ID NO: 42075 - RNA, 64 nt, Human
gccacaauugucuuguccccucaccccccaacucccccuggaacaccucucccaggcaagacau

SEQ ID NO: 42076 - RNA, 64 nt, Human
gcggcauggugcccgccggccugccgggcucccaccccuggacggcagaggcaaggacggacgg

SEQ ID NO: 42077 - RNA, 64 nt, Human
gcgucaggaccacccgccuggccacgugcgcgggccccuggaccuaacgaggcaguguauaaac

SEQ ID NO: 42078 - RNA, 64 nt, Human
gaggaccucgacaggggucacccccucccucccaccccuggacugggcuggggguggccccgug

SEQ ID NO: 42079 - RNA, 64 nt, Human
gcgcccacccccagccagggccccucgccuuccuccccuggaccuggggggccaggcgggggug

SEQ ID NO: 42080 - RNA, 64 nt, Human
uugggcuaaaagcccccaggcgggcagggggugaccccuggagcuaguugcgugucccagaaug

SEQ ID NO: 42081 - RNA, 64 nt, Human
guccgucuguccucccuccagcagcacccccuggccccuggagugguggggccauggcaagaga

SEQ ID NO: 42082 - RNA, 64 nt, Human
acagguccugguggccccacgccacauguuagccccccuggagggggcgccaguuggagacggg

SEQ ID NO: 42083 - RNA, 64 nt, Human
gggaauccucuuuagagcacuuaauccuauuuauccccuggaaugugcgugcuggccaguagga

SEQ ID NO: 42084 - RNA, 64 nt, Human
uuggcugagggagaggcugagaacugggcagacaccccuggagcucagccgacaguuuugauga

SEQ ID NO: 42085 - RNA, 64 nt, Human
gcccacccccacugcuguucgaaucaagcaggaaccccuggacuaggcccugcuucagugccca

SEQ ID NO: 42086 - RNA, 64 nt, Human
gcccuagggaugggcacgggggcgcuggugagguccccuggaccauccagggugcuagggggca

SEQ ID NO: 42087 - RNA, 64 nt, Human
aaucacaagcacauagccagguaacccaccaacuccccuggaucugcagcccacacgugggagu

SEQ ID NO: 42088 - RNA, 64 nt, Human
gccgcccuggacuuggggucccuccaccugggggccccuggacacugucuacuuggagaccacu

SEQ ID NO: 42089 - RNA, 64 nt, Human
cugcccccacuguggccugcaugcgccccucacgccccuggagcgcaucgcccaugagaacacc

SEQ ID NO: 42090 - RNA, 64 nt, Human
gucuguggcuggaacugcccagccugcuccuggcccccuggaagccuccccacagcugguaauc

SEQ ID NO: 42091 - RNA, 64 nt, Human
aucucuuugcauaccccaugucuuccccaguuguccccuggaguuuggggggacaucccgccuc

SEQ ID NO: 42092 - RNA, 64 nt, Human
gcuuccugcuuggaaacugaagucgaauugggcuccccuggaagggguucauucaggucuguug

SEQ ID NO: 42093 - RNA, 64 nt, Human
agccgcugggggaccucacgucccagccaggaucccccuggaagaaaaagggcguccccacacu

SEQ ID NO: 42094 - RNA, 64 nt, Human
agccucacccacugcagggccaggcucucagucaccccuggaaaauggugccugguucacagcu

SEQ ID NO: 42095 - RNA, 64 nt, Human
gggggccacagcugcagaccuaagcccucccccaccccuggaaaggucccuccccaacccaggc

SEQ ID NO: 42096 - RNA, 64 nt, Human
gaccgcguguccuugccugaccaccuggggaacaccccuggacccaggcaucggccaggacccc

SEQ ID NO: 42097 - RNA, 64 nt, Human
cccaggacuuuguccccagagacccacugugugcccccuggagcuccuccuagagcagagucug

SEQ ID NO: 42098 - RNA, 64 nt, Human
cugauggaaggcgggauucccgcuucugaaacucccccuggagucucacucccacacaugccca

SEQ ID NO: 42099 - RNA, 64 nt, Human
caccguccccagagcaggucagcgucucgagaggccccuggacaauugaggaugcccauccccu

SEQ ID NO: 42100 - RNA, 64 nt, Human
gccuugugggucaggacgcuuggcugccuuccugccccuggacuguguccagcugguuuggagu

SEQ ID NO: 42101 - RNA, 64 nt, Human
agggcgcuugaccacuggucuagagcccugugguccccuggagccuggccacgcccuugaagcc

SEQ ID NO: 42102 - RNA, 64 nt, Human
gagaccaccaacgggacucugggcauggcuggggccccuggacggccccuuggcuggcuccugg

SEQ ID NO: 42103 - RNA, 64 nt, Human
caucuguguucuuccugucagcuccacgcccgggccccuggaccacgggguccaccucuccucu

SEQ ID NO: 42104 - RNA, 64 nt, Human
uccuccuccacuugcagcgagacggcagcacagaccccuggagguccaggggggcccgaggcag

SEQ ID NO: 42105 - RNA, 64 nt, Human
cccagccaaacucucugaacucauccagccccuuccccuggagagggacugcucagccaacacc

SEQ ID NO: 42106 - RNA, 64 nt, Human
auaucccagggguucagacuuuggcugagaacagccccuggagaacauggggugacugcuacca

SEQ ID NO: 42107 - RNA, 64 nt, Human
ccccucccgcccuccccgccccauaccuuuucuuccccuggauuuucacccuuugggcugccuu

SEQ ID NO: 42108 - RNA, 64 nt, Human
cagugacacacacugucaagcgccauuucccucaccccuggagacuuacuguuaggugccugcc

SEQ ID NO: 42109 - RNA, 64 nt, Human
cuugagcagaaaagagcacugagagcacuugggaccccuggaucagagagcaucuguguguccu

SEQ ID NO: 42110 - RNA, 64 nt, Human
caucccaucauuuuccauauccuggugccccccaccccuggaagagcccagucuguugaguuag

SEQ ID NO: 42111 - RNA, 64 nt, Human
gagcaaacccaagucuuaguugcuacaagaaaauccccuggaaguacugggggccagguucccc

SEQ ID NO: 42112 - RNA, 64 nt, Human
uggcuucauauuuucaagucacaugucucucagaccccuggauucagaacccaaggccacaaau

SEQ ID NO: 42113 - RNA, 64 nt, Human
gaauuccuuuagcugggaacagcugucauggucaccccuggauaacauuugccaccaaguauag

SEQ ID NO: 42114 - RNA, 64 nt, Human
ggcaaggccucuuggcugaaggccagggacucugccccuggaguccuggaguuaagggaugaag

SEQ ID NO: 42115 - RNA, 64 nt, Human
auuuaaagagccuucacugguucugcaucacccgccccuggacuucuuaguuguuucucuagcg

SEQ ID NO: 42116 - RNA, 64 nt, Human
uuguuggguugucagccauggacauggauuucaaccccuggagaaaacgaugucauuguucagc

SEQ ID NO: 42117 - RNA, 64 nt, Human
uaacuggcuacgccacagcuggacacacaugcagccccuggagggcagccucuuccugugccuc

SEQ ID NO: 42118 - RNA, 64 nt, Human
gucccguggacaucggaggucagaggugggcccuccccuggaccuagagagaggcacagauguu

SEQ ID NO: 42119 - RNA, 64 nt, Human
caagacugcucugguggaaaauccagccugggagccccuggaguggcaggcccuguccugggua

SEQ ID NO: 42120 - RNA, 64 nt, Human
uccuggggcccuaugguucgacugaguccacacuccccuggagccuggcuggccucugcaaaca

SEQ ID NO: 42121 - RNA, 64 nt, Human
ccaggguccaggggcuuucucucucucuccgaagccccuggaccuguuuccuugucauuugacc

SEQ ID NO: 42122 - RNA, 64 nt, Human
cucuuaugcacaccucccacccccuguauucccaccccuggacugguggccccugccuugggga

SEQ ID NO: 42123 - RNA, 64 nt, Human
ccaccacccacucccacccacuguagugcucccaccccuggacugguggcccccacccugcggg

SEQ ID NO: 42124 - RNA, 64 nt, Human
ccaccacccacucccacccccuguagugcucccaccccuggacugguggcccccacccugcggg

SEQ ID NO: 42125 - RNA, 64 nt, Human
ccaccuccuacucccaccccuuguagugcucccaccccuggacugguggcccccacccuguggg

SEQ ID NO: 42126 - RNA, 64 nt, Human
ccaccuccuacucccacccccuguagugcucccaccccuggacugguggcccccacccuggggg

SEQ ID NO: 42127 - RNA, 62 nt, Human
ccauggagguguccugcuaagcagaugcuccuccccuggaccauugcaaguccauccuucaa

SEQ ID NO: 42128 - RNA, 64 nt, Human
aaggaaaucaagacccagcuugggggaaaagccaccccuggagucaccuguguguucaguggca

SEQ ID NO: 42129 - RNA, 53 nt, Human
acacauuucggacccucugagucccccuggaggacucccuugaggcugaaccc

SEQ ID NO: 42130 - RNA, 64 nt, Human
uccccgagagccacaccagcucuggacaucaccgccccuggaacuggggccaccagcccugggc

SEQ ID NO: 42131 - RNA, 64 nt, Human
gaaggccccuucagcuucucaugugaauuaccaaccccuggauuuuccuuguggggguacaaga

SEQ ID NO: 42132 - RNA, 64 nt, Human
ccaucaagcagccugcccucaagccaaggaucauccccuggaacccaguaugcacccagagggg

SEQ ID NO: 42133 - RNA, 64 nt, Human
gggcaugucccgggaggacccugagugccagauuccccuggacgcuccugcugauucugucggc

SEQ ID NO: 42134 - RNA, 64 nt, Human
acacuuuuuaauuaguaucgacuaagacuuuuucccccuggaaucgaggcuguguguccgucau

SEQ ID NO: 42135 - RNA, 64 nt, Human
ugaguuccugaggugaugaagacagcccgauccuccccuggacucccguguaggaaccugcaca

SEQ ID NO: 42136 - RNA, 64 nt, Human
aacgggcaggccgcugaccugaggucuggagaaaccccuggagaaggguguccccaccagccca

SEQ ID NO: 42137 - RNA, 64 nt, Human
cggacacaccguccgucuccgggacgcccucgcaccccuggacaccagaccggacuguucccga

SEQ ID NO: 42138 - RNA, 64 nt, Human
uuuaagggguagaaucagccuuuagaguuacaagccccuggaaaagggagcaggucccauacaa

SEQ ID NO: 42139 - RNA, 64 nt, Human
aggcucguggccuccccucccagaagcgccucuuccccuggaagcugcacaucacgcagaagga

SEQ ID NO: 42140 - RNA, 64 nt, Human
acacuucucacccccucacacaggcccaggggagccccuggagggaaauuccuuggcaggggaa

SEQ ID NO: 42141 - RNA, 64 nt, Human
ccaggcugguguccgcaucugucccugggccccaccccuggaccugccuugguugugucaucug

SEQ ID NO: 42142 - RNA, 64 nt, Human
ccccuuccagaaggggaggccacauuugcccggcccccuggagcugggucugagccccagcuga

SEQ ID NO: 42143 - RNA, 64 nt, Human
uugcauuaauguaacugugugguuugccuuugucccccuggauagaacgugcauuuaaagaaua

SEQ ID NO: 42144 - RNA, 64 nt, Human
caugaucuucguaacggccucggcacgcuccacaccccuggagucucccgaggcccccaugugc

SEQ ID NO: 42145 - RNA, 64 nt, Human
uugugaggcgcacuguuccuggcagauauugugcccccuggagcagugggcaagacaguccuug

SEQ ID NO: 42146 - RNA, 64 nt, Human
ugcugcugcuaagggcuuccaaacauugccugcaccccuggaacugaaccagggauagacgggg

SEQ ID NO: 42147 - RNA, 64 nt, Human
gaggcaucacggaaccuaccgaugugugaugucuccccuggacaccuagcuuuaaaauuucucu

SEQ ID NO: 42148 - RNA, 64 nt, Human
acagggaguugcuggcuggccacuugacacccucccccuggagcugaugucugugacuacaggg

SEQ ID NO: 42149 - RNA, 64 nt, Human
cccgugcccuggugaaucaccuggcugagcaguuccccuggagccccuucgggagcagggcugu

SEQ ID NO: 42150 - RNA, 64 nt, Human
ugcugaacaacugccugaauacaggcuuuagguuccccuggacuccagccaaggcuguucaggu

SEQ ID NO: 42151 - RNA, 64 nt, Human
gugggagaccaacuacgacuggcaucuucucuucccccuggaaggcagcuagacaccaauggau

SEQ ID NO: 42152 - RNA, 64 nt, Human
cuuuggggcggaguggggaaggugugagucagcgccccuggacgggccgggcuaaaaaaggcug

SEQ ID NO: 42153 - RNA, 64 nt, Human
gagccuaauauagccaggagcugcugaauuugugccccuggauuggaagcaaauaaaaaaaaaa

SEQ ID NO: 42154 - RNA, 64 nt, Human
agguauuguucagaccucagcuccugggggccggccccuggagucuucccucccugguagccuc

SEQ ID NO: 42155 - RNA, 64 nt, Human
aacuaucacccucuccuacucuucuucucccugcccccuggagggcacuguguuugguugugca

SEQ ID NO: 42156 - RNA, 64 nt, Human
agggcacacugucggaguucuaucacuugcuugaccccuggacccauaaaccaguccacuguua

SEQ ID NO: 42157 - RNA, 64 nt, Human
caggcugggaacaugcuaggcaccgccugugggaccccuggauaugugggugagggacgacacc

SEQ ID NO: 42158 - RNA, 64 nt, Human
uaaggccgauggucagugagaggaagcugacuagccccuggauucuucuccagaccccccugcu

SEQ ID NO: 42159 - RNA, 64 nt, Human
aggcccaagaccuaguuacccagacagugagaagccccuggaaggcagaaaaguugggagcaug

SEQ ID NO: 42160 - RNA, 64 nt, Human
ugacugccucucgccugcucucagcaggaagggaccccuggagcaggcuggcccggggugguga

SEQ ID NO: 42161 - RNA, 64 nt, Human
cuugacauuccuugucaccagcaacaucucgagcccccuggauguccccugucccaccaacucu

SEQ ID NO: 42162 - RNA, 64 nt, Human
gugagucccugauagagaaggaggucccaucaggccccuggaacacacucaggcuucccugacu

SEQ ID NO: 42163 - RNA, 64 nt, Human
cucagugcauuuuuuaaaauaguuaagaauccaagucgagaacacuugaacacacagaagggag

SEQ ID NO: 42164 - RNA, 64 nt, Human
gugugaagcucugugucucagacggggcccucccgucgagaagcugguagucagugagugagaa

SEQ ID NO: 42165 - RNA, 64 nt, Human
uauguacauauacaaaauuucauuuucucugaaagucgagaauuccaagaacuguuacauauaa

SEQ ID NO: 42166 - RNA, 64 nt, Human
gauagacuauauuauauucaauuuuguauccccagucgagaacaucuuguaagccuucauuaag

SEQ ID NO: 42167 - RNA, 64 nt, Human
aggagucucugggccagugaauacaaaacaucaugucgagaaucauuggaagauauacagaguu

SEQ ID NO: 42168 - RNA, 64 nt, Human
ccagaauucuuuuguccuaugcaguauugcuaaagucgagaauauauuccuugccuguguuaga

SEQ ID NO: 42169 - RNA, 64 nt, Human
acccuucacaaacugaaguccauggaccacggaagucgagaauuaauguacaccuguaucaugu

SEQ ID NO: 42170 - RNA, 64 nt, Human
caaaacaaaaacaaacaaacaaacagaaagcaccgucgagaaauggcuccagcgcugacuagcg

SEQ ID NO: 42171 - RNA, 64 nt, Human
ggauugucuauuguuuguuguuccaacuucugcugucgagaaguuuaaacagaaagcaggagua

SEQ ID NO: 42172 - RNA, 64 nt, Human
ugaucucaggagaacaccugggcuagggaauguggucgagaaagggcagcccauugcccagaau

SEQ ID NO: 42173 - RNA, 64 nt, Human
acuuucuugcacacgcgcugccuugcgggagggggucgagaaagaggaacgaggagcuguaaau

SEQ ID NO: 42174 - RNA, 64 nt, Human
uuaacacauguauaaagguauccuuugguuuuaagucgagaacaggaauuucuucuagaaacuu

SEQ ID NO: 42175 - RNA, 64 nt, Human
agccugccuucuuuucucccuuuuaauccuggcugucgagaaacagccugugucuuuaaaugcu

SEQ ID NO: 42176 - RNA, 64 nt, Human
uuagagaugauaggccuaaagggaacugucuucugucgagaaguaaaggaaacuucaugaagga

SEQ ID NO: 42177 - RNA, 64 nt, Human
acgaaaagacccgcgccaucggccuccaguuugcgucgagaauuccuggaagggcccugauaug

SEQ ID NO: 42178 - RNA, 64 nt, Human
gcggcgugugacaucuccagggaggccguccgaagucgagaaucgucagcuguaaguaggagcu

SEQ ID NO: 42179 - RNA, 64 nt, Human
uuggaucaaucuugaaauacucaaccaaaagacagucgagaagccagggggagaaagaacucag

SEQ ID NO: 42180 - RNA, 64 nt, Human
gaggaaaugcucagagcuccgaggugcggcuguggucgagaaccgggugcugggccgggcgcgg

SEQ ID NO: 42181 - RNA, 64 nt, Human
uggaccaucauucgggaaaccgucuacugagaaagucgagaaggggaggcuugggucagguuca

SEQ ID NO: 42182 - RNA, 64 nt, Human
cuaauucuacucacagugcuuuuaagugaaaauggucgagaaagaggcaccaggaagccguccu

SEQ ID NO: 42183 - RNA, 64 nt, Human
cccaugauguuucggacugaccuaaaaacuaauugucgagaagccaagggugaggaggcaggaa

SEQ ID NO: 42184 - RNA, 64 nt, Human
cgacaaggcuucaaguccagagcugccugucuccgucgagaacaucaagcaggaaacagacgac

SEQ ID NO: 42185 - RNA, 64 nt, Human
aagcuacaugcaccucccccacugcugcccuccugucgagaaugacugccagggccucgccugc

SEQ ID NO: 42186 - RNA, 64 nt, Human
uuugucaggcuugucccucccugauaccaaguaugucgagaaccgauggccccacccucuggcu

SEQ ID NO: 42187 - RNA, 58 nt, Human
acucugauaccuccaacugaucucccagcaaucgcaucccggcugacccugugcccca

SEQ ID NO: 42188 - RNA, 64 nt, Human
caguggcacuacauguaaccuucaucuaguuaaccaaucgcaaagcaagggggaaguaaguaca

SEQ ID NO: 42189 - RNA, 64 nt, Human
guaguguuaggaaccuggccuuacucuccucugacaaucgcaauuuuuucuuauuuuuuauaaa

SEQ ID NO: 42190 - RNA, 64 nt, Human
uaugcaaaauggaacgcuaaugaaacacagcuuacaaucgcaaaucaaaacucacaagugcuca

SEQ ID NO: 42191 - RNA, 64 nt, Human
auguugcccuuuugaaugagaaaauuuuuucugucaaucgcagguuauuugauuaagauagguu

SEQ ID NO: 42192 - RNA, 64 nt, Human
uucuuucuaaucuuuauauaugacauuuucuagacaaucgcaccuuuggguauauuaaacagcu

SEQ ID NO: 42193 - RNA, 64 nt, Human
guccauucugcgcaguaucucaacugccguucaacaaucgcaagaggaagguggagcagguuuc

SEQ ID NO: 42194 - RNA, 64 nt, Human
uucuccccacuaagggcaaggccccaguuuugaccaaucgcaugguucuccuggcaggccugcu

SEQ ID NO: 42195 - RNA, 64 nt, Human
cuuuaaagaauauuucuguucuagggcaucguuucaaucgcaucguaucucuacuugggcacaa

SEQ ID NO: 42196 - RNA, 64 nt, Human
gccacagagacacaccauuacauacacagacacgcaaucgcagauacgcccuuccggccacaga

SEQ ID NO: 42197 - RNA, 64 nt, Human
ccucuuagggucuaaucuuauacuguuacaguggcaaucgcauuucaacgugagcgugggaggg

SEQ ID NO: 42198 - RNA, 64 nt, Human
ggacugauccacagagaggaugagaaugcagcaucaaucgcagaccugcccugccucaguugga

SEQ ID NO: 42199 - RNA, 64 nt, Human
accgucagaugcauuagcagcccacugcaugggacaaucgcaggcagauacgaggaauguaucc

SEQ ID NO: 42200 - RNA, 64 nt, Human
caauggcacuacauguaaccuucaucauguaaagcaaucgcaaagcaagggggaaguaaguaca

SEQ ID NO: 42201 - RNA, 64 nt, Human
gccuggcccacgccgccgcccccgcugagugacgcaaucgcaccacggggcugcgcuccccacu

SEQ ID NO: 42202 - RNA, 64 nt, Human
auauauacacaaauguucacggcagcacuauacacaaucgcaaagucagggaaucaaacuaaau

SEQ ID NO: 42203 - RNA, 64 nt, Human
agaugcgcugucagugugaaacggugcuugccaacaaucgcagagaagcugaagaaugguuggc

SEQ ID NO: 42204 - RNA, 64 nt, Human
ccgccugaaugacccgacuggaauccacucuaaccaaucgcacuuaacgacucgggccaccacu

SEQ ID NO: 42205 - RNA, 64 nt, Human
gccugccccugugagacccacccucccgagcggccaaucgcauuugaguccuuauuuggcacag

SEQ ID NO: 42206 - RNA, 64 nt, Human
aaugagaagucauuuuugcaagccaaaagucgaucaaucgcauucauuuuaagaaauuauaccu

SEQ ID NO: 42207 - RNA, 64 nt, Human
cuucuggguugagugagauguuggauauugcuaucaaucgcaguagucuuuccccugugugagg

SEQ ID NO: 42208 - RNA, 64 nt, Human
acuaacaucccagacuuuaaaauucaguaaaucagauguacaccgagccugcagucucgcuagg

SEQ ID NO: 42209 - RNA, 64 nt, Human
aauucuccugcugccaccgucuuugauucaccgggauguacaguuuacaguugaagagcaaaca

SEQ ID NO: 42210 - RNA, 64 nt, Human
agaaacaaaaguaggcuacagucugugccauguugauguacaguuucugaaauuguuuuacaag

SEQ ID NO: 42211 - RNA, 64 nt, Human
agcacccaggucuuaguuuucaccucuaguucuggauguacauuccauuuccauccacagugua

SEQ ID NO: 42212 - RNA, 64 nt, Human
ucagagccuagaggggcuuaaaaaguaaucauuugauguacauaccacacuccuuggcuuccuu

SEQ ID NO: 42213 - RNA, 64 nt, Human
aaagaacccaagagaauugucacacaugacacaagauguacauaauaucaugcucacugcagug

SEQ ID NO: 42214 - RNA, 64 nt, Human
cuaugaugaaaauugaagugggucaaaagaauuagauguacagugaagggaaaagaaaaaaaau

SEQ ID NO: 42215 - RNA, 64 nt, Human
auggccugugacauuauccuguucagagcuuggagauguacaagggacauaggagcaauuuaca

SEQ ID NO: 42216 - RNA, 64 nt, Human
gugcuaaugugaguccugggccuuucugccuccugauguacacccaucgccaucauagcaagag

SEQ ID NO: 42217 - RNA, 64 nt, Human
cccaaggagccagcuagaaagaagcuuuugauuagauguacaauacauugggggcagaagaucu

SEQ ID NO: 42218 - RNA, 64 nt, Human
cacucccuaauuuaugugcuauauaaauaugucagauguacauagagaucuauuuuuucuaaaa

SEQ ID NO: 42219 - RNA, 64 nt, Human
cuggcucucugguccuuguugcucuaacaguccagauguacacccagccucagggggaaggcag

SEQ ID NO: 42220 - RNA, 64 nt, Human
uuuuuagagacucuuuuaaacuuucugaagugcugauguacauacuuucucguacacacuuuug

SEQ ID NO: 42221 - RNA, 64 nt, Human
gcugccauccguucucccagucccaaggguccacgauguacaaagucauuucggccaguaggug

SEQ ID NO: 42222 - RNA, 64 nt, Human
aaugaaaauugguuuguuuuuaguauuuaguguagauguacacauuccagcaaauguauuugca

SEQ ID NO: 42223 - RNA, 64 nt, Human
ccacaaaauugcaaauaaauaagcuaugaacuuugauguacacuauaaaucuccuuaauucuau

SEQ ID NO: 42224 - RNA, 64 nt, Human
gugccuucuuagcugcuggagaauuuggggagaggauguacacagcacuggugccucagcccug

SEQ ID NO: 42225 - RNA, 64 nt, Human
cguucuagugauuuggggcaugggcuuaauagcagauguacaguguauuccugcauuauuguga

SEQ ID NO: 42226 - RNA, 64 nt, Human
gcacaaugcauaaugucuuuaaaaagcauguugugauguacacauuuuguaauuaccuuuuuug

SEQ ID NO: 42227 - RNA, 64 nt, Human
uccaaacaguguguuggugcuuuagcgauugauugauguacagaacacaaaugucuaguuucua

SEQ ID NO: 42228 - RNA, 64 nt, Human
uuuuagacacaggguagaauuagagacaauauuggauguacaauuccucaggagacuacaguag

SEQ ID NO: 42229 - RNA, 64 nt, Human
uauacuuuaauguuaaaggugcucuauuuuuuuggauguacaguaguuuuauuuccacagccac

SEQ ID NO: 42230 - RNA, 64 nt, Human
cuuuaugccauugcagucuuguacuuuuuacugugauguacagaaauagucaacagauguuucc

SEQ ID NO: 42231 - RNA, 64 nt, Human
cacuugcuuaguggauuguauuggauugugacuugauguacagcgcuaagaccuuacugggaug

SEQ ID NO: 42232 - RNA, 64 nt, Human
acuuuuuauaugguuguuuaguuucaagcaauaugauguacauuacuuuugagaaacaguauuu

SEQ ID NO: 42233 - RNA, 64 nt, Human
guucaagaguaacagguuuaacucaugaccaagugauguacauccaagugauguauucuggaaa

SEQ ID NO: 42234 - RNA, 64 nt, Human
aaccauuuaaaggcauguguuccauagccaaaaugauguacaguuaaaaagagugcguggaaac

SEQ ID NO: 42235 - RNA, 64 nt, Human
uguaugccauuguucaugccuuaagaaaugcaaagauguacaauaaaucauuuuuaaaaugugu

SEQ ID NO: 42236 - RNA, 64 nt, Human
gaaaaaaaacucagcuucuguuguuuaucaggcagauguacaggauaaugguauaaaucaaaag

SEQ ID NO: 42237 - RNA, 64 nt, Human
caccauuucaaccuuucgggagagucagagcuaggauguacaagaacugauucuaaccagaagu

SEQ ID NO: 42238 - RNA, 64 nt, Human
guucauguuugcaguuacuguuguacauugcauagauguacacacgaauuuaaaugugaugucu

SEQ ID NO: 42239 - RNA, 64 nt, Human
ugacucaaucagaugaaaugugccugaggccaacgauguacacuugcucuauagaaggguguca

SEQ ID NO: 42240 - RNA, 64 nt, Human
uuuuuccucuggacauaagacauaacaguaacacgauguacauuuacaagcggccuuauguaca

SEQ ID NO: 42241 - RNA, 64 nt, Human
aaauaugguacucauuaaaaaaaaaaaaaaaagugauguacaaccacuucggaaaacaauuugg

SEQ ID NO: 42242 - RNA, 64 nt, Human
acuaagaauuuauguagauaauguacuuuuaugagauguacaaguaagugucuuaucuguacag

SEQ ID NO: 42243 - RNA, 64 nt, Human
auacaaaaggagcccauuuuauaauauaaaccuugauguacauguugagauauuuggacaauga

SEQ ID NO: 42244 - RNA, 64 nt, Human
auaggauuugcucacauaguuccugcaaacuucagauguacaaguugcacuuguacuuuuauag

SEQ ID NO: 42245 - RNA, 64 nt, Human
uaccucuguguaaaaaauauauauacaaguguaugauguacauuuuaguucuuaacuuuuuuuu

SEQ ID NO: 42246 - RNA, 62 nt, Human
aaggaaaaaguaaaaguuaacuuuuugguuuugauguacacauauucaaaaaguacaucuuc

SEQ ID NO: 42247 - RNA, 64 nt, Human
uuucuuuguucuugguacuuauacuuugaacuaugauguacauauuuauggcuuuuggcuuuua

SEQ ID NO: 42248 - RNA, 64 nt, Human
uagaaagauaagagaaucaccccuaugcugcugagauguacauuuguaauuuaucuguugcaua

SEQ ID NO: 42249 - RNA, 64 nt, Human
gggacucagcccguggccggcagaugccauccaggauguacaaggugcagccaaggcaggccau

SEQ ID NO: 42250 - RNA, 64 nt, Human
ucuccuacccccacugccccgagugucgggcagcgauguacauauggaggugggguggacaggg

SEQ ID NO: 42251 - RNA, 64 nt, Human
agcuacuagagcucaaucuguuauuucuuuuccugauguacagggguuaaguccuauggaagaa

SEQ ID NO: 42252 - RNA, 56 nt, Human
ccuuucaaccuaauaaguaacugugagauguacagaaagguguucuuacaugaaga

SEQ ID NO: 42253 - RNA, 64 nt, Human
auacuaauggaacauuuuggcaaauguauauucagauguacacuaauauauuaucuauuaaaau

SEQ ID NO: 42254 - RNA, 64 nt, Human
auggcuuaaugacacuagcuaauaucaauagaaggauguacauuuccaaauucacaaguugugu

SEQ ID NO: 42255 - RNA, 64 nt, Human
cuucuauccuguuaacacuguaauaucuuuaaaugauguacaggcagaugaaaccaggucacug

SEQ ID NO: 42256 - RNA, 64 nt, Human
aggaaucaagagauuccuauacaugggacuuuuagauguacauuggcacuuggauuagauucca

SEQ ID NO: 42257 - RNA, 64 nt, Human
uuagggaccugccacuuuugacuguggaucaguugauguacacuuguauuauuaaagcacucaa

SEQ ID NO: 42258 - RNA, 64 nt, Human
agcagaagagccccaagcagacuaugucuuucaagauguacagaagacugacaacaggccagug

SEQ ID NO: 42259 - RNA, 64 nt, Human
ucaauuuuuuucccuugagaugaggucugugccugauguacaacggauacuccauaaauguuug

SEQ ID NO: 42260 - RNA, 64 nt, Human
ggaguggcccuuuaacucuauuuggcuaucugaggauguacaaaauucucauuuaauuuucugg

SEQ ID NO: 42261 - RNA, 64 nt, Human
cacagaccuuuccaaauguuuguauauguaaucagauguacauuuauauugaaaaacaaaugag

SEQ ID NO: 42262 - RNA, 64 nt, Human
uaucuagagcuuaaugcuacaugugagugacgaugauguacagauucuuucaguucuuuggauu

SEQ ID NO: 42263 - RNA, 64 nt, Human
ccauugggaaauggcugaugaguucacauuuagggauguacacacacagauggcagacgucucc

SEQ ID NO: 42264 - RNA, 64 nt, Human
cgaaugucauacacaugagaugguauauccuugcgauguacaguaucagaaggugguuugacag

SEQ ID NO: 42265 - RNA, 64 nt, Human
gcauccuguaacuucuguccaaaaagaacaggaugauguacaaauugcucuuccagguaaucca

SEQ ID NO: 42266 - RNA, 64 nt, Human
auaacaccagagcuugcuguuuaaaggauuauaugauguacaucaguucuauaaaugugcucag

SEQ ID NO: 42267 - RNA, 64 nt, Human
cagcaaauuuguuacuuuguuuuuuuaauaguaggauguacacauuucaguauaauaaauguuu

SEQ ID NO: 42268 - RNA, 64 nt, Human
aacaacucugggcgugccugugucugcacauguggauguacauaugucuguauauauguauaua

SEQ ID NO: 42269 - RNA, 64 nt, Human
aagcaggcuugugcuuuauaccccauuugauuucgauguacagucucaauuuuguauuuaauga

SEQ ID NO: 42270 - RNA, 64 nt, Human
uuguguugguuaugugaguguuguuuuaaucagagauguacaugauugccaaucugcauuucuu

SEQ ID NO: 42271 - RNA, 64 nt, Human
aucauuccuaaagcacaagaaaagaaugugccuugauguacauauauuacuaaguugccucucc

SEQ ID NO: 42272 - RNA, 64 nt, Human
cugcugaauaaagaccgaugaagagguuugaguagauguacaaaucaaguaaugguuugaacac

SEQ ID NO: 42273 - RNA, 64 nt, Human
uucauagaauacucagggaaagcauuuaaagggugauguacacauguauccuuucacacauuug

SEQ ID NO: 42274 - RNA, 64 nt, Human
ggauaugacuuagaaccagguggcuggucaccuggauguacagaagucuaacuggugaaggaau

SEQ ID NO: 42275 - RNA, 64 nt, Human
agaguuucaucuggggaugaaagcuauggaagaugauguacaaauguuauugauggagaaaaug

SEQ ID NO: 42276 - RNA, 64 nt, Human
ucucgaaccgcugugucuccuacguaaaaaaagagauguacaaaucaauaauaauuacacuuuu

SEQ ID NO: 42277 - RNA, 64 nt, Human
acuacauagacuaaaauauuccaugguggugaaggauguacaagcuugugaauauguaaauuuu

SEQ ID NO: 42278 - RNA, 64 nt, Human
uccuugggaaguuggggaccacauacacuguugggauguacauugauacaaccuuuaugauggc

SEQ ID NO: 42279 - RNA, 64 nt, Human
uucuuucugccugccuacuuuucugcaaaaaugagauguacagauuucgguucccugcuaugaa

SEQ ID NO: 42280 - RNA, 64 nt, Human
uuaguuggcagagaaaaugcugccuagugcuacagauguacauuaaauaccagccagcaggagg

SEQ ID NO: 42281 - RNA, 64 nt, Human
agugcuugaucacuugcaaacauauauacauguagauguacauauacauguacacauacacaua

SEQ ID NO: 42282 - RNA, 64 nt, Human
agauaaagauggucacacaaacaguuuccauaaagauguacauauucauuauacuucugaccuu

SEQ ID NO: 42283 - RNA, 64 nt, Human
aagacucggcuuuuaauguacuugucaccugagugauguacauuguacccaauagguaauuuuu

SEQ ID NO: 42284 - RNA, 64 nt, Human
aaaaauggaugacaucaaacauuuuuaacaaaaugauguacaaacuaaggacuauuuauugaua

SEQ ID NO: 42285 - RNA, 64 nt, Human
aauacaaggauaauggguuuuaucaaaacaaaaugauguacagauuuuuuuucaaguuuuuaua

SEQ ID NO: 42286 - RNA, 64 nt, Human
gggaacaggcaaauaaaguaucaguauacauggugauguacaucuguagcaaagcucuuggaga

SEQ ID NO: 42287 - RNA, 64 nt, Human
augugaaauuuaugcuauaacauuuuuacaauaagauguacaauuuauuaccuauauggaagug

SEQ ID NO: 42288 - RNA, 64 nt, Human
uuguuagcaaacuaaaauaguaacuuuuauuauggauguacagauaaauauuaauuuuauuaua

SEQ ID NO: 42289 - RNA, 64 nt, Human
cgugguauggauguuugcuuguuuauuaacuaaagauguacagcaaacugcccguuuagagucc

SEQ ID NO: 42290 - RNA, 64 nt, Human
gucagcaauuucuaacagcauuuuaaaugaguuugauguacaguaaauauugaugacaaugaca

SEQ ID NO: 42291 - RNA, 64 nt, Human
gaaaaugcugcuuuuacuuugaugugaucucauugauguacacaaccaaguuccaauaaagugc

SEQ ID NO: 42292 - RNA, 64 nt, Human
uugccuuuuguuaaugcauuguuguaaaguauuugauguacauuacagauuaaagaagaaaagc

SEQ ID NO: 42293 - RNA, 64 nt, Human
acugcaccuggccuacguauuaggcuuuauguaagauguacauaguacuccauacuccuuuccu

SEQ ID NO: 42294 - RNA, 64 nt, Human
agaccgcagugagucaaauuaguucuuugacuuugauguacauuaauguugggauauggaauga

SEQ ID NO: 42295 - RNA, 64 nt, Human
uuuuuaaauccuuacucauacacuuguugggagggauguacaaugcauauucccaaacugugga

SEQ ID NO: 42296 - RNA, 64 nt, Human
agagagauacuaagcagcaaaaucuugguguugugauguacagaaauggagaagaguauuaaac

SEQ ID NO: 42297 - RNA, 64 nt, Human
auguaaaaauggaacuuauuuuugucaaaaauaagauguacacuugucaugauuuauauauguu

SEQ ID NO: 42298 - RNA, 64 nt, Human
ccuucacaagguuucucuccuuccagaauuuucugauguacacaaauaacugacuuccacaaga

SEQ ID NO: 42299 - RNA, 64 nt, Human
ugcuaguuaaaaaauaaaaccuuugagaaucuaagauguacauuuuuaccuuuuaggcaauuuc

SEQ ID NO: 42300 - RNA, 64 nt, Human
auguguaaauuguguuauuauguauauggguaaagauguacaaauauauguccucuuuguagca

SEQ ID NO: 42301 - RNA, 64 nt, Human
cugagcgccuacuauguacuaaugcuagauguuagauguacaaagaagacaguuuucauccucu

SEQ ID NO: 42302 - RNA, 64 nt, Human
uuugaucccaaaacaagaugaauguaugcaaugggauguacauaaguuauuuuugcccaugccu

SEQ ID NO: 42303 - RNA, 64 nt, Human
auuaguccuuaugucaucauuguucaaaauuggagauguacacauacauacccuauaccaagag

SEQ ID NO: 42304 - RNA, 64 nt, Human
cuucuuugagaaguuuuuccuuucuccgcaaccagauguacauauuugaacucucuuuguacuu

SEQ ID NO: 42305 - RNA, 64 nt, Human
guuccuggggguuuucugaucacuggugcgcauugauguacauauuuuccuccagucuggggag

SEQ ID NO: 42306 - RNA, 64 nt, Human
gagaauccgaggcuaugagugggggugggggaaagauguacaggaugcuuugguuucacuccug

SEQ ID NO: 42307 - RNA, 64 nt, Human
ucucauguuaaauauuuguccuuaaaggguuugagauguacaucuuucauuucguauuucucau

SEQ ID NO: 42308 - RNA, 64 nt, Human
gacgguuaacuuguauauuccaccauucacauuugauguacauguguagggaaaguuaaaagug

SEQ ID NO: 42309 - RNA, 64 nt, Human
cuucaauuguucaucaguggguaaaacaaauucugauguacauucaggacaaaugauuagcccu

SEQ ID NO: 42310 - RNA, 64 nt, Human
uaugcagucuuuuuuaagagagcagagaguaucagauguacaauuauggaaauaagaacauuac

SEQ ID NO: 42311 - RNA, 64 nt, Human
agcuucaucaaauaagcauguugugauaaugauagauguacaauuccaacaagguuauuauuuu

SEQ ID NO: 42312 - RNA, 64 nt, Human
ugagcagauccagacaccagauccagcuaggcuagauguacaguaucuaacuugaucugaacug

SEQ ID NO: 42313 - RNA, 64 nt, Human
uccuuuuccugcacuucucuugaauuccuuuauagauguacaguuuugcuuuaaccacugaaga

SEQ ID NO: 42314 - RNA, 64 nt, Human
ccuggaagugcuaauuuugaaaaacugcucauaugauguacauguacugauuacugccuauuuu

SEQ ID NO: 42315 - RNA, 64 nt, Human
agagcaaaagcuugugccuuuguuucugguuucugauguacaagccccuggggcucuguugaac

SEQ ID NO: 42316 - RNA, 64 nt, Human
ugagaccaugccacuagcuuuuaagggcuaccaagauguacaacagaacaugauagcccauuga

SEQ ID NO: 42317 - RNA, 64 nt, Human
agcaaguaccugucaugaaggguaugaccuuaaugauguacauaaaauaaaacaaaugaagaaa

SEQ ID NO: 42318 - RNA, 64 nt, Human
cgguuccaaccacaguggugaagcagcgcuugcagauguacaacucgcagcaccggucagcaau

SEQ ID NO: 42319 - RNA, 64 nt, Human
aaaguuuuccucuuuugcauaacagaugucacuggauguacauucagaaauguucuuugaauuu

SEQ ID NO: 42320 - RNA, 64 nt, Human
gcccccuucucugauugcuuaugaaaaacaaaaugauguacauuacugugaauuuuuauaccac

SEQ ID NO: 42321 - RNA, 64 nt, Human
uggcuugcaugggugcaccaaucaucuuuagaacgauguacacugauguucaucucauaaaugu

SEQ ID NO: 42322 - RNA, 64 nt, Human
gcagaggcaggcugggacggaccagcaucuggaagauguacauaguuauuuuucucuuuguggu

SEQ ID NO: 42323 - RNA, 64 nt, Human
uucguugauuaguugcuacaggcuguaccuauaagauguacaggauaauaguuaaauguugagu

SEQ ID NO: 42324 - RNA, 64 nt, Human
uaaaacaggcuagaaucucauguuuuauaugaaagauguacaauucaguguuuaaaaauaaaaa

SEQ ID NO: 42325 - RNA, 64 nt, Human
ugaaaacauccuucucagugaaacaagccagagagauguacaaggcuacagacuguaugauucc

SEQ ID NO: 42326 - RNA, 64 nt, Human
ugcuuuaaaaaucuuuuaagucuguggaucugcugauguacagugccuuugcugcuauggauca

SEQ ID NO: 42327 - RNA, 64 nt, Human
aaacugaugacuuuuauauguacacugaccaugugauguacauuuauuaugucuuuuuuuaaag

SEQ ID NO: 42328 - RNA, 64 nt, Human
ggcccugcucagccggaagaggcucccggaccuggauguacagggcagucucucuucccggggc

SEQ ID NO: 42329 - RNA, 64 nt, Human
ccacuucaauagcugccccuuuaggaucaagaaagauguacacugucagagcauuguuaaugag

SEQ ID NO: 42330 - RNA, 64 nt, Human
gaggagggggccacagcuuagguuuggagcucuggauguacauacauaaguaggagcaguggga

SEQ ID NO: 42331 - RNA, 64 nt, Human
uuggaguugagaggguuguugguaauaaauguaugauguacacuuaaaacaucuguuguguuuc

SEQ ID NO: 42332 - RNA, 64 nt, Human
uuauuuuguuaaauauuucuauaaauauuuaagagauguacacauguguaauauaggaaggaag

SEQ ID NO: 42333 - RNA, 64 nt, Human
auucuaagacuuuugaauuuucauuuuuuaaaaagauguacaaaacaguuugaaauaaauuuua

SEQ ID NO: 42334 - RNA, 64 nt, Human
cgugccccugaaccucugugcagcccggaaggcugauguacagguguaccucaauccacauuac

SEQ ID NO: 42335 - RNA, 64 nt, Human
aggaccaguucugugcaaugaacuugagacuccugauguacacugugauauugaccgaaggcua

SEQ ID NO: 42336 - RNA, 64 nt, Human
cucuuagguggcucugggaaugggagagggguaggauguacagggguaguuuguuuuagaacca

SEQ ID NO: 42337 - RNA, 64 nt, Human
ccagccaccuucaaugccugccacccugcccgaggauguacagagccgugcccacacauuuccu

SEQ ID NO: 42338 - RNA, 64 nt, Human
aucucacuguaaauaagucucuguucuguaaauagauguacagaagccauguuauuucuuucau

SEQ ID NO: 42339 - RNA, 64 nt, Human
uugguuuuauuuuauacuugccaucagugaaaaagauguacagaacacauuucucugaucucca

SEQ ID NO: 42340 - RNA, 64 nt, Human
gcaauuuuagcaaagcugugcuauuugcuugucagauguacacaacuuccuuaaagucaaaugu

SEQ ID NO: 42341 - RNA, 64 nt, Human
uaauaguuuuuaagguaucuaacaauaauuuauagauguacauuguggaauguaaagcuuuaag

SEQ ID NO: 42342 - RNA, 64 nt, Human
gaauuauaacagugagcucaucugacuguuuuaggauguacagccuaguguuaacauucuuggu

SEQ ID NO: 42343 - RNA, 64 nt, Human
auuuaugaucucagagguuaacuuauuuaagggggauguacauauauucucugaaacuaggaug

SEQ ID NO: 42344 - RNA, 64 nt, Human
ucaguguauauccacucagauuuuguguauuuuugauguacacuguucucuaaauucugaaucu

SEQ ID NO: 42345 - RNA, 64 nt, Human
uuucauugacauacugugaucucuauuagugauggauguacaaaaaauguuuucuuacccuuga

SEQ ID NO: 42346 - RNA, 64 nt, Human
ccucucuucauuuuacucagccagguuuuguacugauguacagguguuaaauuacuucaagcau

SEQ ID NO: 42347 - RNA, 64 nt, Human
uuucauuuugcaaauauuuaauauauagaccuaugauguacagguacgacauguauagguuacc

SEQ ID NO: 42348 - RNA, 64 nt, Human
auguaacguagguguagauucccaaaugcauuuggauguacagaucgacuacagaguacuuuuu

SEQ ID NO: 42349 - RNA, 64 nt, Human
ucaauggcuuguucauccuccagauguagcuauugauguacacuucgcaacggagugucugaaa

SEQ ID NO: 42350 - RNA, 64 nt, Human
cauaaaucauguuguuguguguauauguauuuaagauguacauuuaauaauaucaaagagaaga

SEQ ID NO: 42351 - RNA, 64 nt, Human
ccaguggagcaguuuuaugaaauauguucuauaagauguacauuuuuucauuguaacauagaaa

SEQ ID NO: 42352 - RNA, 64 nt, Human
gauacacaagaagguacuuaguccacaagaucaggauguacaagauaaccccagagggcgcuca

SEQ ID NO: 42353 - RNA, 64 nt, Human
cuguuggugaaauaacaaccaaaauacugaaucugauguacauacagguuucuacaggaagaga

SEQ ID NO: 42354 - RNA, 64 nt, Human
ucugcccuggauugguuggcaaacuaaaggacuugauguacauaacuccugucccuuuucccuu

SEQ ID NO: 42355 - RNA, 64 nt, Human
agaagagagagggagauaaaagggggagacaaaagauguacagaaaugauuuccuggcuggcca

SEQ ID NO: 42356 - RNA, 64 nt, Human
guggucuuuaaccuguugucauguuuuuucccuagauguacaacacugacucaucauaaaugug

SEQ ID NO: 42357 - RNA, 64 nt, Human
cagucuguacccagaggccacccagaagcccucagauguacauacacagaugccagucagcucc

SEQ ID NO: 42358 - RNA, 64 nt, Human
gcuuggcagugggcugcaguggaaaucaacucaagauguacacgaagguuuuuuaggggggcag

SEQ ID NO: 42359 - RNA, 64 nt, Human
ugaccauagaaaaauacagucauucauuggcaaagauguacaguggugguuuagugcagugagg

SEQ ID NO: 42360 - RNA, 64 nt, Human
acucuuuugagugguaaucauaugugucuuuauagauguacauaccuccuugcacaaauggagg

SEQ ID NO: 42361 - RNA, 64 nt, Human
auucuggaaaauauuuugacuagcugcuuggcuggauguacaaagaaauaggcauuauuuuauu

SEQ ID NO: 42362 - RNA, 64 nt, Human
auuagguugaggaaagugcuuuagaaauaauaaagauguacaaauacaaggcuuuggauuuuuu

SEQ ID NO: 42363 - RNA, 64 nt, Human
caagauccagcggguguuuucuucucgguuguuagauguacaauuggauuaauguccaucguuu

SEQ ID NO: 42364 - RNA, 64 nt, Human
ggggcucccugcccgugaggcccggugcaggaccgauguacaaaacagcagcaagugccucucu

SEQ ID NO: 42365 - RNA, 64 nt, Human
caaauagagccuccgggcucccacugcccccugagauguacacccugauugccaggaaaacaga

SEQ ID NO: 42366 - RNA, 64 nt, Human
aaaaaguaccauuuuugugguuguuuggagcagggauguacaaaauaauuuuaauguauuaacu

SEQ ID NO: 42367 - RNA, 64 nt, Human
uuggucucaagugauucucuucauguugucucuugauguacauacccccaagcaaguugggggg

SEQ ID NO: 42368 - RNA, 64 nt, Human
auaggcugagacauccaauugcugcauggaaauugauguacauucaggggacggcaaaaauagc

SEQ ID NO: 42369 - RNA, 64 nt, Human
gagcuagcagccgccuacuuggugcuaaccccucgauguacauagcuuuucucagcugccugcg

SEQ ID NO: 42370 - RNA, 64 nt, Human
aauauuuguuuaauaaugggauguuuuauuuucugauguacaaagcuugauuaccauagaaaac

SEQ ID NO: 42371 - RNA, 64 nt, Human
caguauccaugaaagcacaagugacuaguccuaugauguacaaagccuguaucucugugaugau

SEQ ID NO: 42372 - RNA, 64 nt, Human
cgucuccagagcccugggcagcauuuuccagcaagauguacacaaucuuuugccuuuauuucgu

SEQ ID NO: 42373 - RNA, 64 nt, Human
ugaaaauuugauacauuuuacagaaacuaauugugauguacauaucaguggugacauauuauua

SEQ ID NO: 42374 - RNA, 64 nt, Human
ucuucuuuguauauuuggugacuguaucgucauagauguacauauugugucgguagggcuauga

SEQ ID NO: 42375 - RNA, 64 nt, Human
cgaaauacgucuuuuucagaacuguuaaaguuuugauguacaucgagcugaauucuguuuuuac

SEQ ID NO: 42376 - RNA, 64 nt, Human
gauggagggcaugggauaggacaggagaggaggugauguacacuuagagguaacuaaggcuagu

SEQ ID NO: 42377 - RNA, 64 nt, Human
auuuacaauaaggaggaggcaaggcaaaugcauagauguacaaauauauguacaacagauuuug

SEQ ID NO: 42378 - RNA, 64 nt, Human
gaugagcacacacacaccaaugcgcacacacaccgauguacacacacagaugcacacacagaug

SEQ ID NO: 42379 - RNA, 64 nt, Human
uggaaucuuaaaaaaggaguuuuuaauaagucaagauguacaauuuguaguaaauuagcagagg

SEQ ID NO: 42380 - RNA, 64 nt, Human
guuuuuuuuaaugugucaguauuuuacauugcuagauguacaaacuuuauacagaagcacaacc

SEQ ID NO: 42381 - RNA, 64 nt, Human
uaaaguaaauaggaaaaauuauuuuauuuuuauugauguacauugauagaugccauaaaucagu

SEQ ID NO: 42382 - RNA, 64 nt, Human
ugaggguuguugugcugacccugugguugucgcugauguacacacauuucauuauuugccaaug

SEQ ID NO: 42383 - RNA, 64 nt, Human
auacccaguauguauacuuauuaaucuguaugaagauguacauucuaaaauauaaucaaccagu

SEQ ID NO: 42384 - RNA, 64 nt, Human
aaagugcuauuuauagggugcccagggagccgcugauguacaauaaccuugaggucccccauac

SEQ ID NO: 42385 - RNA, 64 nt, Human
auauaauuguguaaacaaauccuguuaauagagagauguacagaaucguuuuguacuguaucuu

SEQ ID NO: 42386 - RNA, 64 nt, Human
uuuuuugguuuuuguuuuuggggugggggguguggauguacagcggauaacaaucuuucaaguc

SEQ ID NO: 42387 - RNA, 64 nt, Human
aaauaaagugaguaauugguaugacuugcaggaugauguacauguuaguuuguagcucaggaug

SEQ ID NO: 42388 - RNA, 64 nt, Human
uaaaauaaugccaaacaccaaauaugaauuuuaugauguacacuuugugcuuggcauuaaaaga

SEQ ID NO: 42389 - RNA, 64 nt, Human
uucacagaauuuuaaaauagaguuaaagggaagugauguacauuucgggggcauuaggguaggg

SEQ ID NO: 42390 - RNA, 64 nt, Human
aaaaaaaagaaaaaaaaauuucuugaaguggaaugauguacaccaaauacccacuuuauagaua

SEQ ID NO: 42391 - RNA, 64 nt, Human
uguacauauuuauugcauacuugcacaucaaaucgauguacauaguuuaacacgugguccuuuu

SEQ ID NO: 42392 - RNA, 64 nt, Human
aggcacagugccaggccccgggaguggggaccaagauguacauaagacaaagcuacugccuucu

SEQ ID NO: 42393 - RNA, 64 nt, Human
cuugguuggcuggccuuccacuuggcuacacagggauguacaaggcgaucccaucuugauaaga

SEQ ID NO: 42394 - RNA, 64 nt, Human
uuuaucauaaauuuuuagcauuuaaaaauucacugauguacauuaagccaauaaacugcuuuaa

SEQ ID NO: 42395 - RNA, 64 nt, Human
cuucaguacuauugaaggagacauugaucuucuggauguacaguugugcagguuguucacugca

SEQ ID NO: 42396 - RNA, 64 nt, Human
aaaaccaaaucaaaugggaugugucuuuugggaggauguacaagacacaaaucuuucacuaggc

SEQ ID NO: 42397 - RNA, 64 nt, Human
aguacuguggcuucagauuuaguaccuaugaacagauguacaagacauuuauuacacuuuuuac

SEQ ID NO: 42398 - RNA, 64 nt, Human
uagaaugacaaagaugaauuauuacaauaaaucugauguacacagacugaaacauacacacaua

SEQ ID NO: 42399 - RNA, 64 nt, Human
cugcucugaccguguggguggugauccuugucaggauguacaguccuugcucccaccccauccg

SEQ ID NO: 42400 - RNA, 64 nt, Human
gucuggguggaaucagaacgugcaggucucccaggauguacacucacugcgcccuuucugcugc

SEQ ID NO: 42401 - RNA, 64 nt, Human
uugccauugacuucuucccaagauucaaucccaggauguacaaggacagccccuccuccauagu

SEQ ID NO: 42402 - RNA, 64 nt, Human
gcaguuccauuucauuugugccagaaugcuuuaggauguacaguuauggauugaaaguuuacag

SEQ ID NO: 42403 - RNA, 64 nt, Human
cguuuugaaaaugcacuuugaauaaucucaaaaagauguacaaguuauaccuguaaaccacaaa

SEQ ID NO: 42404 - RNA, 64 nt, Human
uuuuauucuaaugaugguagcaccacugaucuuggauguacauuuauguauacuuugagaaaaa

SEQ ID NO: 42405 - RNA, 64 nt, Human
aagcacucuugucaaucauggaauuggaaaaaaagauguacauuuaguuaaacaagauaacacu

SEQ ID NO: 42406 - RNA, 64 nt, Human
acuuaagcccucgugcacacacacaaauuauucagauguacacccacccacauaucuuacagcc

SEQ ID NO: 42407 - RNA, 64 nt, Human
auuuaauaggcugcagugucgcuuaugaaaguacgauguacaguaacuuaauggaagugcugac

SEQ ID NO: 42408 - RNA, 64 nt, Human
agcugugggaagcguucuuggaagcauggggagugauguacauccaaccgucacuguccccaag

SEQ ID NO: 42409 - RNA, 64 nt, Human
gcauuuucugaaacuaaugaaagcacuccucccugauguacaguugggaaaauauguccauauc

SEQ ID NO: 42410 - RNA, 64 nt, Human
uguggugaucaugaauggcucauguguagaaguagauguacaucggcugagugacgguggacug

SEQ ID NO: 42411 - RNA, 64 nt, Human
gggggugggugggacaguaaauuuguauugucucgauguacaguuuaacggggauagaggggga

SEQ ID NO: 42412 - RNA, 64 nt, Human
gcaaagccuuugcucucacgcagaggaaggcuuggauguacaaugaaacugccuggaacuaaaa

SEQ ID NO: 42413 - RNA, 64 nt, Human
uuaacaaaugguuuuuauuucacaguuaucaggggauguacaucucucccuccguacacuucgc

SEQ ID NO: 42414 - RNA, 64 nt, Human
gacccgcugugccuucuaccaucguuccaccauugauguacauacucauguuuuacaucuuuuc

SEQ ID NO: 42415 - RNA, 64 nt, Human
uuguauauggcuccuuuaauauuguaaagaugcugauguacaauugucgugcauuugugugaac

SEQ ID NO: 42416 - RNA, 64 nt, Human
ccaaaagcaacuguuguuuuggcaagacgguccugauguacaagcuugauugaaauucacugcu

SEQ ID NO: 42417 - RNA, 64 nt, Human
aguucaaacagauacagcaugguccagagucccagauguacaaaaacagggauucaucacaaau

SEQ ID NO: 42418 - RNA, 64 nt, Human
ccaggaguuauucaagggugagcccuuuacuugggauguacaggcuuugagcagugcagggcug

SEQ ID NO: 42419 - RNA, 64 nt, Human
uuaaguuacucuuaaaacucuaguuaaaauacuugauguacauaaagugcuuagcaaaaugacc

SEQ ID NO: 42420 - RNA, 64 nt, Human
guuaugaaauacuuuuacauuuaaggagauaaaggauguacauaugaaugggcacauuuuacug

SEQ ID NO: 42421 - RNA, 64 nt, Human
cuugaguuaugaaacacuuuuauaaggagauaaggauguacauauguuuggacacauuguccac

SEQ ID NO: 42422 - RNA, 64 nt, Human
cgccugcgguuucuauguauuuauagcaaguucugauguacauauguaaaggacuuuuuuaaau

SEQ ID NO: 42423 - RNA, 64 nt, Human
cucccccaccugcccauggccugggacucucugcgauguacauaacuauuuaaugcagcggcag

SEQ ID NO: 42424 - RNA, 64 nt, Human
gucacugugccaauccugucaucacccuccuguggauguacaggcagugcucaauaaaugcuuc

SEQ ID NO: 42425 - RNA, 64 nt, Human
gggacccuguggccuacccuaaggugcagaugcugauguacauguuuuauguccugccuuucug

SEQ ID NO: 42426 - RNA, 64 nt, Human
aaagagugcauuuaggcgagaacccuuauaaguagauguacauagaggauuccaucugggacuc

SEQ ID NO: 42427 - RNA, 64 nt, Human
gccagaaaaaguuggugccccugaacccaagagugauguacagucuauuccauagaaucacaga

SEQ ID NO: 42428 - RNA, 64 nt, Human
ccuuagaaaaaugggaaauuuggucacagaggcagauguacagagggaagacgaugugaagaca

SEQ ID NO: 42429 - RNA, 64 nt, Human
uugcugucuaaugacggggaaagcacgaugaaaagauguacaauccugcauccuugcuuauuuc

SEQ ID NO: 42430 - RNA, 64 nt, Human
uuggagguguguucuguguuuacacaguaguuuggauguacaauuauuauuaguggcuuuuuaa

SEQ ID NO: 42431 - RNA, 64 nt, Human
uauauauauauaucuaucugguagaucacauguagauguacaguguguauauuaagcugaauuu

SEQ ID NO: 42432 - RNA, 64 nt, Human
gugaacuaacuauauuuuagccauaacuguuugugauguacacaauguuaagggauuuauaugc

SEQ ID NO: 42433 - RNA, 64 nt, Human
guaacacggaguaauauuuuaaugucauguuuuggauguacauaauauauuuauaacaaagcag

SEQ ID NO: 42434 - RNA, 64 nt, Human
cagucagcugguuucggcgugauguugaucuuuugauguacauacuccguuuuaaacucauuuc

SEQ ID NO: 42435 - RNA, 64 nt, Human
guccuccaucaauucuguauuccagacuugggaggauguacaguugcuguugugugaucaaaca

SEQ ID NO: 42436 - RNA, 64 nt, Human
gguuacugaggacuuaugcugccugaccugguuagauguacauggagguaucucccgaaucaua

SEQ ID NO: 42437 - RNA, 64 nt, Human
accuaaauuccuauguccacacuuaaccuuuaaagauguacauugagggaauaucaaaaaauag

SEQ ID NO: 42438 - RNA, 64 nt, Human
uagccuauuuaaagacacuacgugaucugauugagauguacauaguuuuuuuuuuuaccauaac

SEQ ID NO: 42439 - RNA, 64 nt, Human
cuucugccugacccugggagacauaucaguaauggauguacaaaagcaggucuguuuuaugucu

SEQ ID NO: 42440 - RNA, 64 nt, Human
ugccaagagguuaugauacggguuucuugggucugauguacagugugaauaaaugcuugcagcu

SEQ ID NO: 42441 - RNA, 64 nt, Human
guacaccaugcccauguauauacaaguacacacagauguacacacagauguacacaugcuccag

SEQ ID NO: 42442 - RNA, 64 nt, Human
cauguauauacaaguacacacagauguacacacagauguacacaugcuccagccccagcucugc

SEQ ID NO: 42443 - RNA, 64 nt, Human
uaauuaugggaauaauugcuuuuucacagucacugauguacaauuaaaaaccugauggaaccug

SEQ ID NO: 42444 - RNA, 64 nt, Human
ccccaacuggccucccugagaugaaccugcuggagauguacagccugaaggaugagaugggcaa

SEQ ID NO: 42445 - RNA, 64 nt, Human
caaaucguguaucugacaaaagguuuguguccaggauguacaaagaacucucaaaccggauagu

SEQ ID NO: 42446 - RNA, 64 nt, Human
cuccucugcagugccuuggggaauuuccucuauugauguacagucugucaugaacauguuccug

SEQ ID NO: 42447 - RNA, 64 nt, Human
aguaaggcuuaucaugacagagcgcacuauuucugauguacaguauuuuuuguuguuuuuauca

SEQ ID NO: 42448 - RNA, 64 nt, Human
cuuucagucaugagcccuacacauuugcaugaaagauguacauuauauauugugaaacgaaaaa

SEQ ID NO: 42449 - RNA, 64 nt, Human
ccuucagugaauacaaaauguugauaucauaggugauguacaauuuaguuuugaaugaguuauu

SEQ ID NO: 42450 - RNA, 64 nt, Human
ugcuagagcaucauccuuagaaaucagugccccagauguacauguguugagcguauucuugaaa

SEQ ID NO: 42451 - RNA, 64 nt, Human
gcaguacagauguguaucccaccaaacuaauguagauguacaaacacuucacugucugucucaa

SEQ ID NO: 42452 - RNA, 64 nt, Human
gacaugcacacgggaaagccuuaaaaauauccuugauguacagauuuuauuuguaauuuuaaaa

SEQ ID NO: 42453 - RNA, 64 nt, Human
aguaaggcuuaucaugacagagcguacuauuucugauguacaguauuuuuuguuguuuuuauca

SEQ ID NO: 42454 - RNA, 64 nt, Human
ggagccggcccgcagcaccugcacacacgaaguccggacccacgcagccuccaucccgcguguc

SEQ ID NO: 42455 - RNA, 64 nt, Human
aaacaaaugguacagucauaagagccaucugucacggacccacgcccagaggaacgugcagaaa

SEQ ID NO: 42456 - RNA, 64 nt, Human
aaaagacaccagagaccucagcuauggagcccuucggacccacuucucacagacucuggcacug

SEQ ID NO: 42457 - RNA, 64 nt, Human
aagacaggccugaugugguacgucccuccacccccggacccauccaagucaucugauugaagag

SEQ ID NO: 42458 - RNA, 64 nt, Human
gagccugggcugggaugacucaacuuagcaaagacggacccaggaggagugcugguucuucagu

SEQ ID NO: 42459 - RNA, 64 nt, Human
aaggucacgcagcuggugacugguuggggcagaccggacccagguuuccugacuccuggcccaa

SEQ ID NO: 42460 - RNA, 64 nt, Human
ucaggcaagccccucagcccuugcccccaucccucggacccaccaaacugcacacacagcuccu

SEQ ID NO: 42461 - RNA, 64 nt, Human
agggacaugugguuauuuggaaauugugacugagcggacccaagaauguaaauaauauucauaa

SEQ ID NO: 42462 - RNA, 64 nt, Human
cugauccccccaggugggugcuuguggacugccucggacccagccacgcugcuccccgcaaugc

SEQ ID NO: 42463 - RNA, 64 nt, Human
accgccaagccccccucaaggugggacaguaccccggacccauccacucacuccugagagggcu

SEQ ID NO: 42464 - RNA, 64 nt, Human
ugcaauagcuggguuuacagacauuuaccaccugcggacccaaaagagaaggccuaggagaguu

SEQ ID NO: 42465 - RNA, 64 nt, Human
uggagaggggcugccaguccucucugggccgcagcggacccagcuggaacacaggaaguuggag

SEQ ID NO: 42466 - RNA, 64 nt, Human
ugcguaaaacuaucaccacaacugaagugaggaacggacccaucauucccaagugcccuugugc

SEQ ID NO: 42467 - RNA, 64 nt, Human
ggcccguccucggaagagccuugagagugcagcucggacccaccggcggcccccguagcaggug

SEQ ID NO: 42468 - RNA, 64 nt, Human
cugcaguguuauuuucuuugaaauucauccuccacggacccauucauacuaaauaaaacaaugu

SEQ ID NO: 42469 - RNA, 64 nt, Human
ugaaaauaugauguuucacauaaaaccucauucucggacccaucuuugcucauggcaacaguua

SEQ ID NO: 42470 - RNA, 64 nt, Human
cuuccuucacuuucccccacacccuacaacaggucggacccacaaaagacuucaguuaucauca

SEQ ID NO: 42471 - RNA, 64 nt, Human
uacagcaccccugcccccuaauuuauacagaaaccggacccacuaauccucugggauuggccga

SEQ ID NO: 42472 - RNA, 64 nt, Human
agguaccuuggaggggccaggggcugaggaaggccggacccagguuccaggggcgcaggcagug

SEQ ID NO: 42473 - RNA, 64 nt, Human
caagagagggaguaacaugucuucucauugcccacggacccaaccucuguccaggugccccuca

SEQ ID NO: 42474 - RNA, 64 nt, Human
cucgaucucccaggcucuuucugcagucauaccgcggacccaaugggcgcccugcacacccguu

SEQ ID NO: 42475 - RNA, 64 nt, Human
gaggccugaggucaucggccugagagaagaacaccggacccaggggagauguggauuuucagca

SEQ ID NO: 42476 - RNA, 64 nt, Human
cacccaggugccccguuggaaagcagauauuucccggacccagcgcggccucaaccagggcagg

SEQ ID NO: 42477 - RNA, 64 nt, Human
aagguuagggcauagaguugucuccuucccaacacggacccagagagcagcccuucccugcuca

SEQ ID NO: 42478 - RNA, 64 nt, Human
acgcagggcguggagggggaccacugcgugaccucggacccagccacgucgccccugguccugg

SEQ ID NO: 42479 - RNA, 64 nt, Human
cugacugcugcacauggcacaggccguucccuuccggacccaggcaggcucagcucuggggagg

SEQ ID NO: 42480 - RNA, 64 nt, Human
cuuucgugaauguucuccacccaccugugccuggcggacccacucuccaguagggaggggccgg

SEQ ID NO: 42481 - RNA, 64 nt, Human
ucccaguccuguggggcuggccgggcagagaccccggacccaggcccaggccuaaccugcuaaa

SEQ ID NO: 42482 - RNA, 64 nt, Human
uugaaaagccuagucuugucucucaagagcaucucggacccagaacauucuccaguagugcauu

SEQ ID NO: 42483 - RNA, 64 nt, Human
gguuacccuccagggcagugccgugguggccaaccggacccaggccuuccaggagcaggagcag

SEQ ID NO: 42484 - RNA, 64 nt, Human
gcaugacuggagcacagccuccugccucccagcccggacccaaugcacuuucuugucuccucua

SEQ ID NO: 42485 - RNA, 64 nt, Human
caucccugaagccaucuccccucguccugcgucccggacccaucuacgcugaggacggagaccg

SEQ ID NO: 42486 - RNA, 64 nt, Human
ccuccagcagccuugagaagcaagaacaugguuccggacccagcccuagcagccuucuccccaa

SEQ ID NO: 42487 - RNA, 64 nt, Human
gagcucggccucacuucugccccgacuuguggcucggacccagggaccuucagggcccgcagac

SEQ ID NO: 42488 - RNA, 64 nt, Human
cacccaggauucucgucuuccuccugcagacaggcggacccacaggccccucagggucugccca

SEQ ID NO: 42489 - RNA, 64 nt, Human
accccgauguggaccucuacuuuccaggcuaguccggacccaccucaccccguuacagcucccc

SEQ ID NO: 42490 - RNA, 64 nt, Human
caggagcucagacucuuagagccagcuguggcuucggacccaaggccugaccuaggcugcuauc

SEQ ID NO: 42491 - RNA, 64 nt, Human
acacacgccagggcgccaagcacggccagcuccgcggacccauggacaagcccagccccgccuc

SEQ ID NO: 42492 - RNA, 64 nt, Human
aacugaaaacauaaauacugaccacuccuauguucggacccaagcaaguuagcuaaaccaaacc

SEQ ID NO: 42493 - RNA, 64 nt, Human
gcggaguacgcgaacgcacuggagaaggggcugccggacccagugcucuaccuggcggagaagu

SEQ ID NO: 42494 - RNA, 64 nt, Human
gguuggcacugcggcccucaccagguccugggcucggacccaacuccuggaccuuuccagccug

SEQ ID NO: 42495 - RNA, 64 nt, Human
gcugcacuggccccggugcuggcaucugguggagcggacccacuccccucacauuccacaggcc

SEQ ID NO: 42496 - RNA, 64 nt, Human
cuucccgaaggagcagcugcggacggagguggaucggacccaaggcuggugccuggggcuaagg

SEQ ID NO: 42497 - RNA, 64 nt, Human
ggccuggaggguauggggcacacuuccccaagggcggacccagcaggaggaagcccaggagcug

SEQ ID NO: 42498 - RNA, 64 nt, Human
guuugacagcauguucaacgagggaaccccaagacggacccacacagguccacccacgcugggg

SEQ ID NO: 42499 - RNA, 64 nt, Human
gugaccuccacgucugaugcuggggucaucaggacggacccaucauggcugucuuuuugcccca

SEQ ID NO: 42500 - RNA, 64 nt, Human
ucuugagcaucuggucuggggggaccacuuugaucggacccacccuuggaaagcucagggguag

SEQ ID NO: 42501 - RNA, 64 nt, Human
ugcagacacauacacaacccguuugcugcagagccggacccaguggcuacacccacagcggucu

SEQ ID NO: 42502 - RNA, 64 nt, Human
gacccagcucagggaggcucugcucagaguucggcggacccaccccaacccaacucccagccgc

SEQ ID NO: 42503 - RNA, 64 nt, Human
ugcagcuacccuuucuuucccuccugcggaacagcggacccagcaagagcauccacauccucac

SEQ ID NO: 42504 - RNA, 50 nt, Human
acuuccuucacuucagcugacggacccauggcagcugcucccaggugggu

SEQ ID NO: 42505 - RNA, 64 nt, Human
guucacaaaaugcaaaacucaacgaucagauucacggacccagagcuuuuccauguguuuauau

SEQ ID NO: 42506 - RNA, 64 nt, Human
gucgcugaguggccucaggcagugaccacgcucccggacccaaccuucagcuugcccaaagcaa

SEQ ID NO: 42507 - RNA, 64 nt, Human
aggggguggcccaaggggcaccggggagaggacccggacccaggacccucugagcugggaggcu

SEQ ID NO: 42508 - RNA, 64 nt, Human
uccagugggcaggccaaggccugcugggcccccgcggacccaggugcucugggucacggucccu

SEQ ID NO: 42509 - RNA, 64 nt, Human
ggcggccugcaucccagggccccuccaaucccaccggacccaggcccugggcuaggggcagagc

SEQ ID NO: 42510 - RNA, 64 nt, Human
ccgcccccgugguaggcagacgcgcggggaaauucggacccaggagcccagccccggcugugcc

SEQ ID NO: 42511 - RNA, 64 nt, Human
cagcccgccugccgugcauggcuccugucuggcucggacccaccccaacucuccccagugccug

SEQ ID NO: 42512 - RNA, 64 nt, Human
cgcugcgcccggaaggccccugcuguggagaagccggacccauccccgagguccccagcgagga

SEQ ID NO: 42513 - RNA, 64 nt, Human
ucgcguucccaaagauccacccaaauaucaaacacggacccauagacagcccugggggagccuc

SEQ ID NO: 42514 - RNA, 64 nt, Human
ggcucucuugugagcucuuggacccuccucuucacggacccaacugugccguuuguccccucuc

SEQ ID NO: 42515 - RNA, 64 nt, Human
accuuaaauaaggaagaggcccagauugugaagacggacccauauaucccuaccucccaccacc

SEQ ID NO: 42516 - RNA, 64 nt, Human
gacgcccagguugcaacaggauggaauucagggacggacccagccuggcuaagggaaccauuuc

SEQ ID NO: 42517 - RNA, 64 nt, Human
agccccaggccugguccugggugcauaggucucucggacccacucucugccuucacaguuguuc

SEQ ID NO: 42518 - RNA, 64 nt, Human
caaaaccaauccaaagccaagccgggacuggcugcggacccagccuccugugccgcgcacucac

SEQ ID NO: 42519 - RNA, 64 nt, Human
aagacucccuggggcccaacuguguugcuccacccggacccaucucucccuucuagaccugagc

SEQ ID NO: 42520 - RNA, 64 nt, Human
ugagggaggagggggccgauucugguuuaggggccggacccacugagaggccccagagccgccc

SEQ ID NO: 42521 - RNA, 64 nt, Human
gggagucuggugugucuccuacaugcaauuuccacggacccagcucuguggagggcaugacugc

SEQ ID NO: 42522 - RNA, 64 nt, Human
caggacugcgugggcgcgggagccucagcugcuucggacccaaccacacgcuguaccccauggu

SEQ ID NO: 42523 - RNA, 64 nt, Human
cccaaccugauucugaugacugcggaugcugugacggacccaaggggcaaauagggucccaggg

SEQ ID NO: 42524 - RNA, 64 nt, Human
ggggcagcaugguugugcacgugggacccuggggcggacccaggagccaaacucuugaagcacc

SEQ ID NO: 42525 - RNA, 64 nt, Human
agaaaagugagccaagcagaaggaggugggaaaacggacccaaaccccagugugcccugcccca

SEQ ID NO: 42526 - RNA, 64 nt, Human; identical to SEQ ID NO: 42454

SEQ ID NO: 42527 - RNA, 64 nt, Human; identical to SEQ ID NO: 42455

SEQ ID NO: 42528 - RNA, 64 nt, Human; identical to SEQ ID NO: 42456

SEQ ID NO: 42529 - RNA, 64 nt, Human; identical to SEQ ID NO: 42457

SEQ ID NO: 42530 - RNA, 64 nt, Human; identical to SEQ ID NO: 42458

SEQ ID NO: 42531 - RNA, 64 nt, Human; identical to SEQ ID NO: 42459

SEQ ID NO: 42532 - RNA, 64 nt, Human; identical to SEQ ID NO: 42460

SEQ ID NO: 42533 - RNA, 64 nt, Human; identical to SEQ ID NO: 42461

SEQ ID NO: 42534 - RNA, 64 nt, Human; identical to SEQ ID NO: 42462

SEQ ID NO: 42535 - RNA, 64 nt, Human; identical to SEQ ID NO: 42463

SEQ ID NO: 42536 - RNA, 64 nt, Human; identical to SEQ ID NO: 42464

SEQ ID NO: 42537 - RNA, 64 nt, Human; identical to SEQ ID NO: 42465

SEQ ID NO: 42538 - RNA, 64 nt, Human; identical to SEQ ID NO: 42466

SEQ ID NO: 42539 - RNA, 64 nt, Human; identical to SEQ ID NO: 42467

SEQ ID NO: 42540 - RNA, 64 nt, Human; identical to SEQ ID NO: 42468

SEQ ID NO: 42541 - RNA, 64 nt, Human; identical to SEQ ID NO: 42469

SEQ ID NO: 42542 - RNA, 64 nt, Human; identical to SEQ ID NO: 42470

SEQ ID NO: 42543 - RNA, 64 nt, Human; identical to SEQ ID NO: 42471

SEQ ID NO: 42544 - RNA, 64 nt, Human; identical to SEQ ID NO: 42472

SEQ ID NO: 42545 - RNA, 64 nt, Human; identical to SEQ ID NO: 42473

SEQ ID NO: 42546 - RNA, 64 nt, Human; identical to SEQ ID NO: 42474

SEQ ID NO: 42547 - RNA, 64 nt, Human; identical to SEQ ID NO: 42475

SEQ ID NO: 42548 - RNA, 64 nt, Human; identical to SEQ ID NO: 42476

SEQ ID NO: 42549 - RNA, 64 nt, Human; identical to SEQ ID NO: 42477

SEQ ID NO: 42550 - RNA, 64 nt, Human; identical to SEQ ID NO: 42478

SEQ ID NO: 42551 - RNA, 64 nt, Human; identical to SEQ ID NO: 42479

SEQ ID NO: 42552 - RNA, 64 nt, Human; identical to SEQ ID NO: 42480

SEQ ID NO: 42553 - RNA, 64 nt, Human; identical to SEQ ID NO: 42481

SEQ ID NO: 42554 - RNA, 64 nt, Human; identical to SEQ ID NO: 42482

SEQ ID NO: 42555 - RNA, 64 nt, Human; identical to SEQ ID NO: 42483

SEQ ID NO: 42556 - RNA, 64 nt, Human; identical to SEQ ID NO: 42484

SEQ ID NO: 42557 - RNA, 64 nt, Human; identical to SEQ ID NO: 42485

SEQ ID NO: 42558 - RNA, 64 nt, Human; identical to SEQ ID NO: 42486

SEQ ID NO: 42559 - RNA, 64 nt, Human; identical to SEQ ID NO: 42487

SEQ ID NO: 42560 - RNA, 64 nt, Human; identical to SEQ ID NO: 42488

SEQ ID NO: 42561 - RNA, 64 nt, Human; identical to SEQ ID NO: 42489

SEQ ID NO: 42562 - RNA, 64 nt, Human; identical to SEQ ID NO: 42490

SEQ ID NO: 42563 - RNA, 64 nt, Human; identical to SEQ ID NO: 42491

SEQ ID NO: 42564 - RNA, 64 nt, Human; identical to SEQ ID NO: 42492

SEQ ID NO: 42565 - RNA, 64 nt, Human; identical to SEQ ID NO: 42493

SEQ ID NO: 42566 - RNA, 64 nt, Human; identical to SEQ ID NO: 42494

SEQ ID NO: 42567 - RNA, 64 nt, Human; identical to SEQ ID NO: 42495

SEQ ID NO: 42568 - RNA, 64 nt, Human; identical to SEQ ID NO: 42496

SEQ ID NO: 42569 - RNA, 64 nt, Human; identical to SEQ ID NO: 42497

SEQ ID NO: 42570 - RNA, 64 nt, Human; identical to SEQ ID NO: 42498

SEQ ID NO: 42571 - RNA, 64 nt, Human; identical to SEQ ID NO: 42499

SEQ ID NO: 42572 - RNA, 64 nt, Human; identical to SEQ ID NO: 42500

SEQ ID NO: 42573 - RNA, 64 nt, Human; identical to SEQ ID NO: 42501

SEQ ID NO: 42574 - RNA, 64 nt, Human; identical to SEQ ID NO: 42502

SEQ ID NO: 42575 - RNA, 64 nt, Human; identical to SEQ ID NO: 42503

SEQ ID NO: 42576 - RNA, 50 nt, Human; identical to SEQ ID NO: 42504

SEQ ID NO: 42577 - RNA, 64 nt, Human; identical to SEQ ID NO: 42505

SEQ ID NO: 42578 - RNA, 64 nt, Human; identical to SEQ ID NO: 42506

SEQ ID NO: 42579 - RNA, 64 nt, Human; identical to SEQ ID NO: 42507

SEQ ID NO: 42580 - RNA, 64 nt, Human; identical to SEQ ID NO: 42508

SEQ ID NO: 42581 - RNA, 64 nt, Human; identical to SEQ ID NO: 42509

SEQ ID NO: 42582 - RNA, 64 nt, Human; identical to SEQ ID NO: 42510

SEQ ID NO: 42583 - RNA, 64 nt, Human; identical to SEQ ID NO: 42511

SEQ ID NO: 42584 - RNA, 64 nt, Human; identical to SEQ ID NO: 42512

SEQ ID NO: 42585 - RNA, 64 nt, Human; identical to SEQ ID NO: 42513

SEQ ID NO: 42586 - RNA, 64 nt, Human; identical to SEQ ID NO: 42514

SEQ ID NO: 42587 - RNA, 64 nt, Human; identical to SEQ ID NO: 42515

SEQ ID NO: 42588 - RNA, 64 nt, Human; identical to SEQ ID NO: 42516

SEQ ID NO: 42589 - RNA, 64 nt, Human; identical to SEQ ID NO: 42517

SEQ ID NO: 42590 - RNA, 64 nt, Human; identical to SEQ ID NO: 42518

SEQ ID NO: 42591 - RNA, 64 nt, Human; identical to SEQ ID NO: 42519

SEQ ID NO: 42592 - RNA, 64 nt, Human; identical to SEQ ID NO: 42520

SEQ ID NO: 42593 - RNA, 64 nt, Human; identical to SEQ ID NO: 42521

SEQ ID NO: 42594 - RNA, 64 nt, Human; identical to SEQ ID NO: 42522

SEQ ID NO: 42595 - RNA, 64 nt, Human; identical to SEQ ID NO: 42523

SEQ ID NO: 42596 - RNA, 64 nt, Human; identical to SEQ ID NO: 42524

SEQ ID NO: 42597 - RNA, 64 nt, Human; identical to SEQ ID NO: 42525

SEQ ID NO: 42598 - RNA, 64 nt, Human
uguauuuuuaguagagacgggguuucaccauguuggccaggauggucucgaucucuugaccucg

SEQ ID NO: 42599 - RNA, 64 nt, Human; identical to SEQ ID NO: 42454

SEQ ID NO: 42600 - RNA, 64 nt, Human; identical to SEQ ID NO: 42455

SEQ ID NO: 42601 - RNA, 64 nt, Human; identical to SEQ ID NO: 42456

SEQ ID NO: 42602 - RNA, 64 nt, Human; identical to SEQ ID NO: 42457

SEQ ID NO: 42603 - RNA, 64 nt, Human; identical to SEQ ID NO: 42458

SEQ ID NO: 42604 - RNA, 64 nt, Human; identical to SEQ ID NO: 42459

SEQ ID NO: 42605 - RNA, 64 nt, Human; identical to SEQ ID NO: 42460

SEQ ID NO: 42606 - RNA, 64 nt, Human; identical to SEQ ID NO: 42461

SEQ ID NO: 42607 - RNA, 64 nt, Human; identical to SEQ ID NO: 42462

SEQ ID NO: 42608 - RNA, 64 nt, Human; identical to SEQ ID NO: 42463

SEQ ID NO: 42609 - RNA, 64 nt, Human; identical to SEQ ID NO: 42464

SEQ ID NO: 42610 - RNA, 64 nt, Human; identical to SEQ ID NO: 42465

SEQ ID NO: 42611 - RNA, 64 nt, Human; identical to SEQ ID NO: 42466

SEQ ID NO: 42612 - RNA, 64 nt, Human; identical to SEQ ID NO: 42467

SEQ ID NO: 42613 - RNA, 64 nt, Human; identical to SEQ ID NO: 42468

SEQ ID NO: 42614 - RNA, 64 nt, Human; identical to SEQ ID NO: 42469

SEQ ID NO: 42615 - RNA, 64 nt, Human; identical to SEQ ID NO: 42470

SEQ ID NO: 42616 - RNA, 64 nt, Human; identical to SEQ ID NO: 42471

SEQ ID NO: 42617 - RNA, 64 nt, Human; identical to SEQ ID NO: 42472

SEQ ID NO: 42618 - RNA, 64 nt, Human; identical to SEQ ID NO: 42473

SEQ ID NO: 42619 - RNA, 64 nt, Human; identical to SEQ ID NO: 42474

SEQ ID NO: 42620 - RNA, 64 nt, Human; identical to SEQ ID NO: 42475

SEQ ID NO: 42621 - RNA, 64 nt, Human; identical to SEQ ID NO: 42476

SEQ ID NO: 42622 - RNA, 64 nt, Human; identical to SEQ ID NO: 42477

SEQ ID NO: 42623 - RNA, 64 nt, Human; identical to SEQ ID NO: 42478

SEQ ID NO: 42624 - RNA, 64 nt, Human; identical to SEQ ID NO: 42479

SEQ ID NO: 42625 - RNA, 64 nt, Human; identical to SEQ ID NO: 42480

SEQ ID NO: 42626 - RNA, 64 nt, Human; identical to SEQ ID NO: 42481

SEQ ID NO: 42627 - RNA, 64 nt, Human; identical to SEQ ID NO: 42482

SEQ ID NO: 42628 - RNA, 64 nt, Human; identical to SEQ ID NO: 42483

SEQ ID NO: 42629 - RNA, 64 nt, Human; identical to SEQ ID NO: 42484

SEQ ID NO: 42630 - RNA, 64 nt, Human; identical to SEQ ID NO: 42485

SEQ ID NO: 42631 - RNA, 64 nt, Human; identical to SEQ ID NO: 42486

SEQ ID NO: 42632 - RNA, 64 nt, Human; identical to SEQ ID NO: 42487

SEQ ID NO: 42633 - RNA, 64 nt, Human; identical to SEQ ID NO: 42488

SEQ ID NO: 42634 - RNA, 64 nt, Human; identical to SEQ ID NO: 42489

SEQ ID NO: 42635 - RNA, 64 nt, Human; identical to SEQ ID NO: 42490

SEQ ID NO: 42636 - RNA, 64 nt, Human; identical to SEQ ID NO: 42491

SEQ ID NO: 42637 - RNA, 64 nt, Human; identical to SEQ ID NO: 42492

SEQ ID NO: 42638 - RNA, 64 nt, Human; identical to SEQ ID NO: 42493

SEQ ID NO: 42639 - RNA, 64 nt, Human; identical to SEQ ID NO: 42494

SEQ ID NO: 42640 - RNA, 64 nt, Human; identical to SEQ ID NO: 42495

SEQ ID NO: 42641 - RNA, 64 nt, Human; identical to SEQ ID NO: 42496

SEQ ID NO: 42642 - RNA, 64 nt, Human; identical to SEQ ID NO: 42497

SEQ ID NO: 42643 - RNA, 64 nt, Human; identical to SEQ ID NO: 42498

SEQ ID NO: 42644 - RNA, 64 nt, Human; identical to SEQ ID NO: 42499

SEQ ID NO: 42645 - RNA, 64 nt, Human; identical to SEQ ID NO: 42500

SEQ ID NO: 42646 - RNA, 64 nt, Human; identical to SEQ ID NO: 42501

SEQ ID NO: 42647 - RNA, 64 nt, Human; identical to SEQ ID NO: 42502

SEQ ID NO: 42648 - RNA, 64 nt, Human; identical to SEQ ID NO: 42503

SEQ ID NO: 42649 - RNA, 50 nt, Human; identical to SEQ ID NO: 42504

SEQ ID NO: 42650 - RNA, 64 nt, Human; identical to SEQ ID NO: 42505

SEQ ID NO: 42651 - RNA, 64 nt, Human; identical to SEQ ID NO: 42506

SEQ ID NO: 42652 - RNA, 64 nt, Human; identical to SEQ ID NO: 42507

SEQ ID NO: 42653 - RNA, 64 nt, Human; identical to SEQ ID NO: 42508

SEQ ID NO: 42654 - RNA, 64 nt, Human; identical to SEQ ID NO: 42509

SEQ ID NO: 42655 - RNA, 64 nt, Human; identical to SEQ ID NO: 42510

SEQ ID NO: 42656 - RNA, 64 nt, Human; identical to SEQ ID NO: 42511

SEQ ID NO: 42657 - RNA, 64 nt, Human; identical to SEQ ID NO: 42512

SEQ ID NO: 42658 - RNA, 64 nt, Human; identical to SEQ ID NO: 42513

SEQ ID NO: 42659 - RNA, 64 nt, Human; identical to SEQ ID NO: 42514

SEQ ID NO: 42660 - RNA, 64 nt, Human; identical to SEQ ID NO: 42515

SEQ ID NO: 42661 - RNA, 64 nt, Human; identical to SEQ ID NO: 42516

SEQ ID NO: 42662 - RNA, 64 nt, Human; identical to SEQ ID NO: 42517

SEQ ID NO: 42663 - RNA, 64 nt, Human; identical to SEQ ID NO: 42518

SEQ ID NO: 42664 - RNA, 64 nt, Human; identical to SEQ ID NO: 42519

SEQ ID NO: 42665 - RNA, 64 nt, Human; identical to SEQ ID NO: 42520

SEQ ID NO: 42666 - RNA, 64 nt, Human; identical to SEQ ID NO: 42521

SEQ ID NO: 42667 - RNA, 64 nt, Human; identical to SEQ ID NO: 42522

SEQ ID NO: 42668 - RNA, 64 nt, Human; identical to SEQ ID NO: 42523

SEQ ID NO: 42669 - RNA, 64 nt, Human; identical to SEQ ID NO: 42524

SEQ ID NO: 42670 - RNA, 64 nt, Human; identical to SEQ ID NO: 42525

SEQ ID NO: 42671 - RNA, 64 nt, Human; identical to SEQ ID NO: 42454

SEQ ID NO: 42672 - RNA, 64 nt, Human; identical to SEQ ID NO: 42455

SEQ ID NO: 42673 - RNA, 64 nt, Human; identical to SEQ ID NO: 42456

SEQ ID NO: 42674 - RNA, 64 nt, Human; identical to SEQ ID NO: 42457

SEQ ID NO: 42675 - RNA, 64 nt, Human; identical to SEQ ID NO: 42458

SEQ ID NO: 42676 - RNA, 64 nt, Human; identical to SEQ ID NO: 42459

SEQ ID NO: 42677 - RNA, 64 nt, Human; identical to SEQ ID NO: 42460

SEQ ID NO: 42678 - RNA, 64 nt, Human; identical to SEQ ID NO: 42461

SEQ ID NO: 42679 - RNA, 64 nt, Human; identical to SEQ ID NO: 42462

SEQ ID NO: 42680 - RNA, 64 nt, Human; identical to SEQ ID NO: 42463

SEQ ID NO: 42681 - RNA, 64 nt, Human; identical to SEQ ID NO: 42464

SEQ ID NO: 42682 - RNA, 64 nt, Human; identical to SEQ ID NO: 42465

SEQ ID NO: 42683 - RNA, 64 nt, Human; identical to SEQ ID NO: 42466

SEQ ID NO: 42684 - RNA, 64 nt, Human; identical to SEQ ID NO: 42467

SEQ ID NO: 42685 - RNA, 64 nt, Human; identical to SEQ ID NO: 42468

SEQ ID NO: 42686 - RNA, 64 nt, Human; identical to SEQ ID NO: 42469

SEQ ID NO: 42687 - RNA, 64 nt, Human; identical to SEQ ID NO: 42470

SEQ ID NO: 42688 - RNA, 64 nt, Human; identical to SEQ ID NO: 42471

SEQ ID NO: 42689 - RNA, 64 nt, Human; identical to SEQ ID NO: 42472

SEQ ID NO: 42690 - RNA, 64 nt, Human; identical to SEQ ID NO: 42473

SEQ ID NO: 42691 - RNA, 64 nt, Human; identical to SEQ ID NO: 42474

SEQ ID NO: 42692 - RNA, 64 nt, Human; identical to SEQ ID NO: 42475

SEQ ID NO: 42693 - RNA, 64 nt, Human; identical to SEQ ID NO: 42476

SEQ ID NO: 42694 - RNA, 64 nt, Human; identical to SEQ ID NO: 42477

SEQ ID NO: 42695 - RNA, 64 nt, Human; identical to SEQ ID NO: 42478

SEQ ID NO: 42696 - RNA, 64 nt, Human; identical to SEQ ID NO: 42479

SEQ ID NO: 42697 - RNA, 64 nt, Human; identical to SEQ ID NO: 42480

SEQ ID NO: 42698 - RNA, 64 nt, Human; identical to SEQ ID NO: 42481

SEQ ID NO: 42699 - RNA, 64 nt, Human; identical to SEQ ID NO: 42482

SEQ ID NO: 42700 - RNA, 64 nt, Human; identical to SEQ ID NO: 42483

SEQ ID NO: 42701 - RNA, 64 nt, Human; identical to SEQ ID NO: 42484

SEQ ID NO: 42702 - RNA, 64 nt, Human; identical to SEQ ID NO: 42485

SEQ ID NO: 42703 - RNA, 64 nt, Human; identical to SEQ ID NO: 42486

SEQ ID NO: 42704 - RNA, 64 nt, Human; identical to SEQ ID NO: 42487

SEQ ID NO: 42705 - RNA, 64 nt, Human; identical to SEQ ID NO: 42488

SEQ ID NO: 42706 - RNA, 64 nt, Human; identical to SEQ ID NO: 42489

SEQ ID NO: 42707 - RNA, 64 nt, Human; identical to SEQ ID NO: 42490

SEQ ID NO: 42708 - RNA, 64 nt, Human; identical to SEQ ID NO: 42491

SEQ ID NO: 42709 - RNA, 64 nt, Human; identical to SEQ ID NO: 42492

SEQ ID NO: 42710 - RNA, 64 nt, Human; identical to SEQ ID NO: 42493

SEQ ID NO: 42711 - RNA, 64 nt, Human; identical to SEQ ID NO: 42494

SEQ ID NO: 42712 - RNA, 64 nt, Human; identical to SEQ ID NO: 42495

SEQ ID NO: 42713 - RNA, 64 nt, Human; identical to SEQ ID NO: 42496

SEQ ID NO: 42714 - RNA, 64 nt, Human; identical to SEQ ID NO: 42497

SEQ ID NO: 42715 - RNA, 64 nt, Human; identical to SEQ ID NO: 42498

SEQ ID NO: 42716 - RNA, 64 nt, Human; identical to SEQ ID NO: 42499

SEQ ID NO: 42717 - RNA, 64 nt, Human; identical to SEQ ID NO: 42500

SEQ ID NO: 42718 - RNA, 64 nt, Human; identical to SEQ ID NO: 42501

SEQ ID NO: 42719 - RNA, 64 nt, Human; identical to SEQ ID NO: 42502

SEQ ID NO: 42720 - RNA, 64 nt, Human; identical to SEQ ID NO: 42503

SEQ ID NO: 42721 - RNA, 50 nt, Human; identical to SEQ ID NO: 42504

SEQ ID NO: 42722 - RNA, 64 nt, Human; identical to SEQ ID NO: 42505

SEQ ID NO: 42723 - RNA, 64 nt, Human; identical to SEQ ID NO: 42506

SEQ ID NO: 42724 - RNA, 64 nt, Human; identical to SEQ ID NO: 42507

SEQ ID NO: 42725 - RNA, 64 nt, Human; identical to SEQ ID NO: 42508

SEQ ID NO: 42726 - RNA, 64 nt, Human; identical to SEQ ID NO: 42509

SEQ ID NO: 42727 - RNA, 64 nt, Human; identical to SEQ ID NO: 42510

SEQ ID NO: 42728 - RNA, 64 nt, Human; identical to SEQ ID NO: 42511

SEQ ID NO: 42729 - RNA, 64 nt, Human; identical to SEQ ID NO: 42512

SEQ ID NO: 42730 - RNA, 64 nt, Human; identical to SEQ ID NO: 42513

SEQ ID NO: 42731 - RNA, 64 nt, Human; identical to SEQ ID NO: 42514

SEQ ID NO: 42732 - RNA, 64 nt, Human; identical to SEQ ID NO: 42515

SEQ ID NO: 42733 - RNA, 64 nt, Human; identical to SEQ ID NO: 42516

SEQ ID NO: 42734 - RNA, 64 nt, Human; identical to SEQ ID NO: 42517

SEQ ID NO: 42735 - RNA, 64 nt, Human; identical to SEQ ID NO: 42518

SEQ ID NO: 42736 - RNA, 64 nt, Human; identical to SEQ ID NO: 42519

SEQ ID NO: 42737 - RNA, 64 nt, Human; identical to SEQ ID NO: 42520

SEQ ID NO: 42738 - RNA, 64 nt, Human; identical to SEQ ID NO: 42521

SEQ ID NO: 42739 - RNA, 64 nt, Human; identical to SEQ ID NO: 42522

SEQ ID NO: 42740 - RNA, 64 nt, Human; identical to SEQ ID NO: 42523

SEQ ID NO: 42741 - RNA, 64 nt, Human; identical to SEQ ID NO: 42524

SEQ ID NO: 42742 - RNA, 64 nt, Human; identical to SEQ ID NO: 42525

SEQ ID NO: 42743 - RNA, 64 nt, Human
gugcccaggagugccccacguucugagaaggggccggccggagggaggggacccggcagggaga

SEQ ID NO: 42744 - RNA, 62 nt, Human
uccguggagagcgggcuuaagaaguggcgguucggccggagguuccaucguauccaaaaggc

SEQ ID NO: 42745 - RNA, 64 nt, Human
uucagucacucugccgaaggcgcugacggcaucgcggccggaaccucugggcccggccccuccc

SEQ ID NO: 42746 - RNA, 64 nt, Human
ugucgagagggggugaagacauuucucaacuucucggccggaguuuggcugagaucgcgguauu

SEQ ID NO: 42747 - RNA, 64 nt, Human
ugucgcacguguaggaggcugccgccgagggacucggccggagagcugaggggaggggggcguu

SEQ ID NO: 42748 - RNA, 64 nt, Human
ccagauucaucauuucaaaguuacuuucuauaugcggccggaacagggugguugacaucaguuu

SEQ ID NO: 42749 - RNA, 64 nt, Human
ucacugcggcgacgacuugcucagacugucccggcggccggagugacuuucucgcacccccuug

SEQ ID NO: 42750 - RNA, 53 nt, Human
cggacacggacaugcgcugaagccggccggagcggggccugcaugggcggguc

SEQ ID NO: 42751 - RNA, 64 nt, Human
acagcugaccgccccgccgcaccacgcgggccggcggccggagcggggaagggcgcgggcgcgg

SEQ ID NO: 42752 - RNA, 64 nt, Human
ggggcguucagcuuuaaaaagccgguccuaauuacggccggacgcaguagcuuacgccuguuau

SEQ ID NO: 42753 - RNA, 64 nt, Human
ggcuucuauuucucuuaagucagcaucaauacaacggccggaguuucuguuuuugcaauaagaa

SEQ ID NO: 42754 - RNA, 64 nt, Human
aggucccuccccggcuuccuccggaggcccggcccggccggaggauguucagcaccucugccuu

SEQ ID NO: 42755 - RNA, 64 nt, Human
cuuggcgacuucaguaagcuacagcuaagcccaucggccggaaaagaaagacaauaauuuuguu

SEQ ID NO: 42756 - RNA, 64 nt, Human
cucauucaaagaauacuagaaugguagcacuacccggccggagccgcccaccgucuugggucgc

SEQ ID NO: 42757 - RNA, 64 nt, Human
cacggcggugagguccauccugaccaaggagcggcggccggagggcggguacaaggcugucugg

SEQ ID NO: 42758 - RNA, 64 nt, Human
cgcccccggcucccccgcacgcaugcauccacugcggccggaggaggccauggagcccgaguag

SEQ ID NO: 42759 - RNA, 64 nt, Human
cccugugcagcugcccgagggucuccgcccaccccggccggacuuugauccccccgaagucuuc

SEQ ID NO: 42760 - RNA, 64 nt, Human
aacuuggcagcuuuuucuguggaggacagacggccggccggaccucugagcacauaguguccug

SEQ ID NO: 42761 - RNA, 64 nt, Human
ucagugaggacgcccgcuuccugcugauugccgccggccggaccaucaaggugugggacuacgc

SEQ ID NO: 42762 - RNA, 64 nt, Human
gugagaggucacugcacuugguacuuccuagagacggccggagccaggcccaagacacagcaga

SEQ ID NO: 42763 - RNA, 64 nt, Human
cugacccuccccccaccccccgugggcuccugugcggccggagccuccccaaggagcgccgccc

SEQ ID NO: 42764 - RNA, 63 nt, Human
uuuugcagaggcugccguaguaauccaccccaacggccggaggagccgccggagcccgccugc

SEQ ID NO: 42765 - RNA, 64 nt, Human
gaggcauucccagagguggggaagagagccugcccggccggagaacaucugccuugcugcaccu

SEQ ID NO: 42766 - RNA, 64 nt, Human
agccgccucucccgcuccggaucccuccacgcagcggccggagccagacuagccccgcccacca

SEQ ID NO: 42767 - RNA, 64 nt, Human
ugggccagcacgugccccacccgugggccaggggcggccggacccgucccuccacgaccccgcc

SEQ ID NO: 42768 - RNA, 64 nt, Human
cuuugcgcucucgggucacccugcuuuggcggcccggccggagggcaggacccucaccucuccc

SEQ ID NO: 42769 - RNA, 64 nt, Human
gcgcuacuggagaagaggagcaacaccugugccgcggccggaggaguuuuguuguugguuuuag

SEQ ID NO: 42770 - RNA, 64 nt, Human
cuaaccauuuaugcuuuuguacaucaaccgugcgcggccggagggggcaggggggcgggggcga

SEQ ID NO: 42771 - RNA, 64 nt, Human
ccagaccuggcagagccugguguggggucugagacggccggagaaccucccaggcagggcucug

SEQ ID NO: 42772 - RNA, 64 nt, Human
acagcagcagccagggaugggcccuggagguucccggccggagagugccucuccccucugccau

SEQ ID NO: 42773 - RNA, 64 nt, Human
guaaaucaagauguucugcagauuauuccuuuaacggccggacuuuuggcuguuuccuaaugaa

SEQ ID NO: 42774 - RNA, 64 nt, Human
cagcaucuccacgcgcgcccgugggagguggguccggccggagaggccucccgcggacgccguc

SEQ ID NO: 42775 - RNA, 64 nt, Human
uuggccagugaaccugccagccuuccaggacaggcggccggagagcugccccugaaggacaguc

SEQ ID NO: 42776 - RNA, 64 nt, Human
ugagggccuccaccucgagccaggaaaugaggaccggccggacgaugcccugcagacugcucug

SEQ ID NO: 42777 - RNA, 64 nt, Human
gcugccuucagugccuggaugucugcggccacaccggccggacacgugguagaugcccaccucc

SEQ ID NO: 42778 - RNA, 64 nt, Human
uugagcggcuucauggcagacagcagcgagccagcggccggacucuguauuucggaccccacuc

SEQ ID NO: 42779 - RNA, 64 nt, Human
uugcaugcaucccccaauaagaagagaugagacucggccggagagaagaaaaggcccuuaacuu

SEQ ID NO: 42780 - RNA, 61 nt, Human
ucaagccuagccaccucagcugcagggaggcagaaggcaaggcaggccccacggacacacu

SEQ ID NO: 42781 - RNA, 61 nt, Human
aggcuccucuuucccccuucccgacaucagcagaaggcagcaucccugcaugccguccgua

SEQ ID NO: 42782 - RNA, 61 nt, Human
aggcucagucucaggagcauggggauaaaggagaaggcaugaaauugucuagcagagcagg

SEQ ID NO: 42783 - RNA, 61 nt, Human
gugugugcucccgccuccuggguauacagagagaaggcaggaaucaggaguuccagaagca

SEQ ID NO: 42784 - RNA, 61 nt, Human
acauggucaggucucacccugcuugaagcgcagaaggcacagccuuacugaccagcacgcc

SEQ ID NO: 42785 - RNA, 61 nt, Human
ggccaauaggauugaguuggggcuccaguagagaaggcaggguugguggugggugggggca

SEQ ID NO: 42786 - RNA, 61 nt, Human
gaucacuuuaggaucaauauuuugacacgggagaaggcagcucagaaaggauuaaggaaga

SEQ ID NO: 42787 - RNA, 61 nt, Human
ugguggcauaugccuguggucccagcuacucagaaggcaaguggugauggcgccacugcac

SEQ ID NO: 42788 - RNA, 61 nt, Human
caucacccaagugccugaugccucaggugacagaaggcaggacguuccaugccgaggcugc

SEQ ID NO: 42789 - RNA, 61 nt, Human
ugaaaucagcagagccucuggguggauguguagaaggcacuucaaaaugcauaaaccuguu

SEQ ID NO: 42790 - RNA, 61 nt, Human
uuauauucugcgugguauauuuuaaaguuuaagaaggcauguuaaacauuauuuccucuau

SEQ ID NO: 42791 - RNA, 61 nt, Human
uggcuuuggugcuguccacacagugcccaccagaaggcagagggaacuccagggcagggau

SEQ ID NO: 42792 - RNA, 61 nt, Human
gugguucaaucuaaucugauauugacauauuagaaggcaauuaggguguuuccuuaaacaa

SEQ ID NO: 42793 - RNA, 61 nt, Human
auuuguauuacccagaugacugaagcuuaagagaaggcagggaaguauacaagcagagcca

SEQ ID NO: 42794 - RNA, 61 nt, Human
gucaucaaacuccacccaccuggcuucauacagaaggcaacaggggcacaagcccaggucc

SEQ ID NO: 42795 - RNA, 61 nt, Human
cugugcuagcaacauucugaaauuccuucaaagaaggcaguccuuugggaagguguuuuuu

SEQ ID NO: 42796 - RNA, 61 nt, Human
uugcuggaccuucaauccaucgcuacaguccagaaggcaauuggccacuccuaaugugggc

SEQ ID NO: 42797 - RNA, 61 nt, Human
ccgcucccugcagaggaugcucguuuugcagagaaggcaguguuccucuauucccuucuuc

SEQ ID NO: 42798 - RNA, 61 nt, Human
aucucaucaggguagcagcagaggcaggaccagaaggcaaucaagagcuuccagaaaugcc

SEQ ID NO: 42799 - RNA, 61 nt, Human
ggcagccuugcccauucucuaagccuggcuuagaaggcacugggaauguccuguagagaga

SEQ ID NO: 42800 - RNA, 61 nt, Human
acuccugugcaaugaaggugauaacaguaaaagaaggcaggggaaacuuacguuggaugac

SEQ ID NO: 42801 - RNA, 61 nt, Human
cauuuuacagucgcacagcaagcagucucacagaaggcaggcuaguccauucacagccuga

SEQ ID NO: 42802 - RNA, 61 nt, Human
uuccuucguccugcaugucucuaacauuaauagaaggcauggcuccugcugcaaccgcugu

SEQ ID NO: 42803 - RNA, 61 nt, Human
ccuaucuugacucacugaguuauuaggaaacagaaggcaaaaagauugucaaaauaaaaac

SEQ ID NO: 42804 - RNA, 61 nt, Human
ugucauuuccugaagucacacuggcguuuccagaaggcaucuggugcuuugcucagccuuc

SEQ ID NO: 42805 - RNA, 61 nt, Human
uggggguggagggugccacagggaaagcuguagaaggcaagaagacucgagaaucccccag

SEQ ID NO: 42806 - RNA, 61 nt, Human
agcuuuggaaagugugacucuguaggaguguagaaggcagugguguaugaucuuagccucg

SEQ ID NO: 42807 - RNA, 61 nt, Human
uccucugcguuucauuugcagucgacuguacagaaggcacucaccacaauaaaccuuuccu

SEQ ID NO: 42808 - RNA, 61 nt, Human
gaacaggagggccagauagauagguccuagcagaaggcauugaggugagggaucauuuugg

SEQ ID NO: 42809 - RNA, 61 nt, Human
gaaagaacagcuggaguuucuguugaugugaagaaggcagcucuuggccucccacucccac

SEQ ID NO: 42810 - RNA, 61 nt, Human
caggauuggggacagggacagaggagguaacagaaggcaaaggccaguuuccccguuauca

SEQ ID NO: 42811 - RNA, 61 nt, Human
ucuugugagggcugggggcauccaggcacucagaaggcaaaggaaccacccuacccauuug

SEQ ID NO: 42812 - RNA, 61 nt, Human
ugaguccacucggagugcccuguguuccuggagaaggcauuccaggguugaaucuuguccc

SEQ ID NO: 42813 - RNA, 59 nt, Human
uuauuacaguuccuaauugaggacaccuaagaaggcaugguacucugacaaagguaagu

SEQ ID NO: 42814 - RNA, 61 nt, Human
aagcaucuaagcaucuguuaacauuaaaaccagaaggcaguaugugcugcagaguacauaa

SEQ ID NO: 42815 - RNA, 61 nt, Human
gcugugaacaacaacaacaaaaaauaaaucaagaaggcauagcugucugaauccccaauua

SEQ ID NO: 42816 - RNA, 61 nt, Human
cacuuuuccccauuuauguccaaucagaaaaagaaggcaucuuuguaccagaaaucucagc

SEQ ID NO: 42817 - RNA, 61 nt, Human
gguuuuccugugggggaucugagcucuccccagaaggcacuucuuguuuuauguacaggau

SEQ ID NO: 42818 - RNA, 61 nt, Human
gguuuuccuguggaaggucugagcucuccccagaaggcacuuccugucugauguccaggau

SEQ ID NO: 42819 - RNA, 61 nt, Human
ccuaaucauucccuuuucuccccacuccuccagaaggcauaacccuucucuccacaccccc

SEQ ID NO: 42820 - RNA, 61 nt, Human
uuuuauuuuuuaaaauuaaguaauuuuuuaaagaaggcacuuuuaaaauuaacacacacau

SEQ ID NO: 42821 - RNA, 61 nt, Human
agaagggagaggaaugaauugaggaagugaaagaaggcaaggagguaggaagagagggagg

SEQ ID NO: 42822 - RNA, 61 nt, Human
cagggcagagaggucugugguucucagcaucagaaggcagcgcagccccucuccucuucag

SEQ ID NO: 42823 - RNA, 61 nt, Human
auccuguaaaugauaauauguguacagacugagaaggcaggaauauaaaguaauugaaauc

SEQ ID NO: 42824 - RNA, 61 nt, Human
ugugcuagcccgaugccuccaccgggcacuuagaaggcaagaggacaggaucucucaagac

SEQ ID NO: 42825 - RNA, 61 nt, Human
augagaagacggugaaaugauguaaugacagagaaggcagacaacauguuuccgugacuca

SEQ ID NO: 42826 - RNA, 61 nt, Human
uaauaguugaaaucugccuuuuucucauucaagaaggcauacaaauaucugagagugacuu

SEQ ID NO: 42827 - RNA, 61 nt, Human
agccuugcgagaagggacguaccuaugccccagaaggcaagagaggaagacuauuuggacu

SEQ ID NO: 42828 - RNA, 61 nt, Human
gauugauagcagaacagcucuuguuggucugagaaggcaggauaagugaccacauauuuau

SEQ ID NO: 42829 - RNA, 61 nt, Human
uuuuaaaaaaacaaacagaugaaaaccucagagaaggcauguggauuauaagauuugucua

SEQ ID NO: 42830 - RNA, 61 nt, Human
ggggaggagcucaggucugcgccaggcaggaagaaggcaggcuucuggcuuccagaggugc

SEQ ID NO: 42831 - RNA, 61 nt, Human
ugugccacuuggaauugcaacccaugaguucagaaggcacacucugccaugcugagcucca

SEQ ID NO: 42832 - RNA, 61 nt, Human
caguggcuucucagagccuggggcauacagaagaaggcaggaguugauuuuuguguugggu

SEQ ID NO: 42833 - RNA, 61 nt, Human
guuuggcuuuuucccucagggaacuuggucuagaaggcacugggaagcucaucagagaaaa

SEQ ID NO: 42834 - RNA, 61 nt, Human
aauaagagaacgugccaucuguaaagcacucagaaggcagccaucccuagauguugguuuc

SEQ ID NO: 42835 - RNA, 61 nt, Human
cccuggcugggcagccuggcacaagugaagaagaaggcagugggaaaacuggguuuaucuc

SEQ ID NO: 42836 - RNA, 61 nt, Human
aagaaaugcucaaugucugaugcuaagugggagaaggcagagaacaaaggauguggcauaa

SEQ ID NO: 42837 - RNA, 61 nt, Human
cgacugucuggcccugaauuugcauggcuugagaaggcacaccguaagacuaaguaggaaa

SEQ ID NO: 42838 - RNA, 61 nt, Human
cuggggacaccucaggagcuuuacucauggcagaaggcaaagcaaaggcaggcacuucaca

SEQ ID NO: 42839 - RNA, 61 nt, Human
aaagaaaggcaacucgcaaagaugagauggaagaaggcacgugagcagaggaggcagcucc

SEQ ID NO: 42840 - RNA, 50 nt, Human
aaaaaucucaucaggaaugaagaaggcaaaaaauaucuuuuguacagaaa

SEQ ID NO: 42841 - RNA, 61 nt, Human
ccuaguucaaucuguagugaaauaagacuacagaaggcauuguuuuuuccuuuuuuauuuu

SEQ ID NO: 42842 - RNA, 61 nt, Human
caacaucucagacuuuacaaagaaaugacaaagaaggcaauugcacuuuuuaagggauauc

SEQ ID NO: 42843 - RNA, 61 nt, Human
uucacauaauuuguaugcagugugaaggagcagaaggcaucuucucacugugcugcaaauc

SEQ ID NO: 42844 - RNA, 61 nt, Human
aaagugcauauugaacacaucugugcauuugagaaggcaggcuuucauaugcugucaugag

SEQ ID NO: 42845 - RNA, 61 nt, Human
aaacccacuguuaccaguguaggaaguuacaagaaggcacauacugaaugcugaaguauac

SEQ ID NO: 42846 - RNA, 61 nt, Human
uuacaaacaugugguuaaugccauggacagaagaaggcagcagguggcagaauggggugca

SEQ ID NO: 42847 - RNA, 61 nt, Human
gccacuuaucaaagagauuuuaacaguaguaagaaggcaaagaauaaacauuugauauuca

SEQ ID NO: 42848 - RNA, 61 nt, Human
aaaauauuuuaugguugaaaaaacacuagacagaaggcacuaaaaaagaagaaugaauuaa

SEQ ID NO: 42849 - RNA, 61 nt, Human
ggcaccagauggucaagacgagggaaauaugagaaggcaaaugaugugaggauuaguaucu

SEQ ID NO: 42850 - RNA, 61 nt, Human
gcuuagggcccuuaaagaagaaaaucuccccagaaggcauccaucauguugcuuaauuguc

SEQ ID NO: 42851 - RNA, 61 nt, Human
uuggcuccuggggagauauaucugccuucuaagaaggcaggccaggucuugggcacagacc

SEQ ID NO: 42852 - RNA, 61 nt, Human
cugaguugcccaaggcccagaucagcugcccagaaggcaccagugccuaaggcucccacug

SEQ ID NO: 42853 - RNA, 61 nt, Human
aagagcccccaaccuuuucucucugccuucaagaaggcagacauuugguaugauuuagcau

SEQ ID NO: 42854 - RNA, 61 nt, Human
gaggcuugcugagaggggcuguccaguucccagaaggcauaucagucucugagggcuuccu

SEQ ID NO: 42855 - RNA, 61 nt, Human
ugcuguagaagggggacaugccacauguauuagaaggcaucugcuguaacuuccagugcaa

SEQ ID NO: 42856 - RNA, 61 nt, Human
uugguguggcucaccagggcaccagccucgcagaaggcaucuuccuccucucugugaauca

SEQ ID NO: 42857 - RNA, 61 nt, Human
ugaagcuggaaguuuaauuauauguagagugagaaggcaguuccaguuuuagcacagauuu

SEQ ID NO: 42858 - RNA, 61 nt, Human
aacuaaauguugcguggguggcaugaguugaagaaggcaaaggcuuguaaauuuacccaau

SEQ ID NO: 42859 - RNA, 61 nt, Human
guaauaucuuuuauuaugauauuugugguuuagaaggcauauugaguuauuuugcagaauc

SEQ ID NO: 42860 - RNA, 61 nt, Human
ugagggccuuugugcuuugucaucccaugccagaaggcagaaggguaagagagggcaagag

SEQ ID NO: 42861 - RNA, 61 nt, Human
uacuuugucuuuaggggaggagggcugaggaagaaggcauacauaauuacuucaguguaau

SEQ ID NO: 42862 - RNA, 61 nt, Human
uccugcaguagaaugggggcagcaccuccuaagaaggcaccucucuggguugaagggcagu

SEQ ID NO: 42863 - RNA, 61 nt, Human
agggauugugacuccuaaauccuccucuaaaagaaggcacuugccauuaauccuaauucag

SEQ ID NO: 42864 - RNA, 61 nt, Human
auuuccuucuugugauaaaaauaaaauuacgagaaggcaaugugagguuuuaguacaucau

SEQ ID NO: 42865 - RNA, 61 nt, Human
agugggaauugcagcauaucguuuaauuuuaagaaggcauuggcaucugcuuuuaauggau

SEQ ID NO: 42866 - RNA, 61 nt, Human
agaagggcuugaggccucuaugggugggggcagaaggcagagccugugucccagggggacc

SEQ ID NO: 42867 - RNA, 61 nt, Human
ggacauucaaaugguuguagccuggugggguagaaggcagagaagacuacccagccaguga

SEQ ID NO: 42868 - RNA, 61 nt, Human
gacugagggacucugaagccucugggaaaugagaaggcagccaccagcgaaugcuaggucu

SEQ ID NO: 42869 - RNA, 61 nt, Human
guguguuuaggguuggcagcaggugauuaggagaaggcauaugacaguagagaggacugga

SEQ ID NO: 42870 - RNA, 61 nt, Human
uucuaaagcugccccuugggagacuccagggagaaggcauugcuuccucccuggugugaac

SEQ ID NO: 42871 - RNA, 61 nt, Human
auggguccagugcaguggcuugccacucaaaagaaggcagcagacaaagucgucuuccuuc

SEQ ID NO: 42872 - RNA, 61 nt, Human
ucauuuccugccaccugaugguggauucagcagaaggcaagaugguuauaauucuaaaaga

SEQ ID NO: 42873 - RNA, 61 nt, Human
aaguuccugggcaaccuuuuugauuucuuccagaaggcaaaaagacauuaccaugaguaau

SEQ ID NO: 42874 - RNA, 61 nt, Human
agaagcagaguggguggugguuauguuugacagaaggcauuagguugacaacuugucauga

SEQ ID NO: 42875 - RNA, 61 nt, Human
ccagccccugguggugggggcuucucugcugagaaggcaaacugaggcagcaugcacggag

SEQ ID NO: 42876 - RNA, 61 nt, Human
ccacuucuuuuggagagcaaggggaaggucaagaaggcaguuuuaucaauauugugucagu

SEQ ID NO: 42877 - RNA, 61 nt, Human
aggguaagauaauuucccugcaaaaggacacagaaggcagucuuaagaagaugaauggaug

SEQ ID NO: 42878 - RNA, 61 nt, Human
guugacuucugccugugggucugaggaagggagaaggcagaacccauaggcagucccuggg

SEQ ID NO: 42879 - RNA, 61 nt, Human
uaacauauauauuuauuuauuucccccccauagaaggcaaaauggcuuucagcaauggcag

SEQ ID NO: 42880 - RNA, 61 nt, Human
gccuggagaaggaacaaggcuauuugaaaacagaaggcaggucaaggguagaaguuaaagg

SEQ ID NO: 42881 - RNA, 61 nt, Human
gcucuuggcaagagaagagugcuugaguuacagaaggcauaaguaguuugaagaaugcagc

SEQ ID NO: 42882 - RNA, 61 nt, Human
cugcaaccucggggagugccacuucgggagaagaaggcaacccaaaugguggccauugugc

SEQ ID NO: 42883 - RNA, 61 nt, Human
cuuauaauuauauuaguaaaaugcacaaagaagaaggcagugcuguuacuuggccacuaag

SEQ ID NO: 42884 - RNA, 61 nt, Human
uuuuuuguauguguguuuguaguauauguucagaaggcaagcaucuucauuuugcuagcuu

SEQ ID NO: 42885 - RNA, 61 nt, Human
acugccucacccugagcugggcaccaagguuagaaggcaaaagugggguagggggaugugg

SEQ ID NO: 42886 - RNA, 59 nt, Human
ucuuuucauccccuagaugaugcuggcacagaaggcauuguucccuacccucuggcgag

SEQ ID NO: 42887 - RNA, 61 nt, Human
aggaagcaggaucccacugagcaccucuugcagaaggcaaggaccaauguuugaacguguu

SEQ ID NO: 42888 - RNA, 61 nt, Human
aacuuaaauguguguuuuuaaaaaugcgcuaagaaggcaaagcagaaagaagagguauacu

SEQ ID NO: 42889 - RNA, 61 nt, Human
cugaaaggagcaaaaaagaacucaguguaagagaaggcacauacauaguuaagaauacuaa

SEQ ID NO: 42890 - RNA, 61 nt, Human
ccugugccucagggcaccgccugccgagcagagaaggcacagcagccgucagaguccauga

SEQ ID NO: 42891 - RNA, 61 nt, Human
acacacaaauacacaaucucuaggguaagccagaaggcaagaucagauuaaaaacaccaug

SEQ ID NO: 42892 - RNA, 61 nt, Human
ugccauggcugguguauauaugugcaauguuagaaggcaaaagagugaugguaggcagagg

SEQ ID NO: 42893 - RNA, 61 nt, Human
ccaaaggcccacagaggagcauauacugaaaagaaggcaguaucacagaauuuauacuaua

SEQ ID NO: 42894 - RNA, 61 nt, Human
ucagugaaagaaucugaagccgauaauacaaagaaggcaaaguaaguucucuaucuuuuug

SEQ ID NO: 42895 - RNA, 61 nt, Human
cucuguuauuguuaguuuuaagccuuaagguagaaggcacauagaaauaacaucucaucuu

SEQ ID NO: 42896 - RNA, 61 nt, Human
cucuuccugccagugguaauacgauuuuuuaagaaggcaguuugucaauuuuaaucuugug

SEQ ID NO: 42897 - RNA, 61 nt, Human
uuagagccaagacuuuaguuccagugggauaagaaggcauagaauguuuucugguucccag

SEQ ID NO: 42898 - RNA, 61 nt, Human
gaaaaucaacuagagauuauaaagucucuaaagaaggcaauaacaaaauuuaucaagauau

SEQ ID NO: 42899 - RNA, 61 nt, Human
augcucugcacaacugagaaauuagguauuuagaaggcauauagagauguugucauaacua

SEQ ID NO: 42900 - RNA, 61 nt, Human
augauuauaguguguucauuuagauaaaaguagaaggcacaggagagguagcaaaggccag

SEQ ID NO: 42901 - RNA, 61 nt, Human
ugcacaacucgcaaauauaaauugcacaugcagaaggcacagaccccguagcgcaugccaa

SEQ ID NO: 42902 - RNA, 61 nt, Human
aagcauuggcuagccuuuuuaaccuggucagagaaggcagguggucacugacauuucccaa

SEQ ID NO: 42903 - RNA, 61 nt, Human
auuucuuuacucaugacauuucgcagugcagagaaggcagaacccaagaaaaacgucaucu

SEQ ID NO: 42904 - RNA, 61 nt, Human
gcaaagccuuugucuucaagcagaaugucacagaaggcagcuacuuuauaagccccaaugg

SEQ ID NO: 42905 - RNA, 61 nt, Human
aagcgccaguaaaccaucggaucaauuggaaagaaggcaacucuucagccuuuguuaucua

SEQ ID NO: 42906 - RNA, 61 nt, Human
cauauauuuuacagauuuauuuuguuucuggagaaggcagcaaacuuuuacuucccugcag

SEQ ID NO: 42907 - RNA, 61 nt, Human
auauacaucuagcacagcugugaggacagacagaaggcaaaguuuccauguggccuugagc

SEQ ID NO: 42908 - RNA, 61 nt, Human
aacuagaggugagaaauuuaaacuauaagcaagaaggcaaaaauaguuuggauauguaaaa

SEQ ID NO: 42909 - RNA, 61 nt, Human
auuaaguaucugacaucucugcaaucuucucagaaggcaaaugacuuuggaccauaacccc

SEQ ID NO: 42910 - RNA, 61 nt, Human
agacuucucuacccaucuuaaaaacaacgaaagaaggcauggacuucuggaugcccaucca

SEQ ID NO: 42911 - RNA, 61 nt, Human
uuauaauuuuuuuuaaaauagaaauuuuguaagaaggcaauauuaaccuaaucaccaugua

SEQ ID NO: 42912 - RNA, 61 nt, Human
acuacguguuacauuuggagaggucuuguugagaaggcaaaauuuucuaaauauuuugaua

SEQ ID NO: 42913 - RNA, 61 nt, Human
aauagugaguagaaugacaugcuuacuauacagaaggcaaaaauaggacucucagguaaua

SEQ ID NO: 42914 - RNA, 61 nt, Human
caaccugggcaucuuaggaagcagucccuggagaaggcauguucccagaaaggucucugga

SEQ ID NO: 42915 - RNA, 61 nt, Human
acuucugucuauaguguacuugcucuauuuaagaaggcauaucuacauuuccaaacucauu

SEQ ID NO: 42916 - RNA, 61 nt, Human
gucagccuucagauuugggagcaaacuucagagaaggcagaggaagauacauugccuugcu

SEQ ID NO: 42917 - RNA, 61 nt, Human
caucagaacgugaauugccaaagucuucauuagaaggcagcauuuuuccucucugauacuu

SEQ ID NO: 42918 - RNA, 61 nt, Human
gauaauggaauggcuggagucugcuguugucagaaggcagggagggugaugaaggacugac

SEQ ID NO: 42919 - RNA, 61 nt, Human
cgggguaggguggugucuucaccacagcuccagaaggcacuggugggauguggagucagga

SEQ ID NO: 42920 - RNA, 61 nt, Human
ccugacguccuugucuauggucuuaaaaacaagaaggcacacauuugagaagaugagauua

SEQ ID NO: 42921 - RNA, 61 nt, Human
uccucccauacugcuuuuaaacagaugcccaagaaggcaagcaggaaugccucuugugggg

SEQ ID NO: 42922 - RNA, 61 nt, Human
ucccauguuugcuuuauuuuauuuuaaugucagaaggcaguuugcgcuaaugcuugaacuc

SEQ ID NO: 42923 - RNA, 61 nt, Human
aaagcaaaaaccucccuuuuuaauugccuguagaaggcaagauuuucuuucauuuuugucc

SEQ ID NO: 42924 - RNA, 61 nt, Human
ucacaucaccacagcucccuagggucugccgagaaggcaggcagucuuuggguucuguucu

SEQ ID NO: 42925 - RNA, 61 nt, Human
gguguucugcccagucccgucauucugggcuagaaggcaggggaccuuggcauguggcugg

SEQ ID NO: 42926 - RNA, 61 nt, Human
acggggacacaaauucuguugccugguggaaagaaggcaaaggccuucagcaaucuauauu

SEQ ID NO: 42927 - RNA, 61 nt, Human
cccauuucugggagcugcccgagaucacuggagaaggcagccagcagcagcugcacuggaa

SEQ ID NO: 42928 - RNA, 61 nt, Human
guugaagggaggggcuguguuuccaucucaaagaaggcauuugcaggguccucuucugggc

SEQ ID NO: 42929 - RNA, 61 nt, Human
gaugagguguucucuccuuguagaacaucagagaaggcacauugacuagcaaacagcacuu

SEQ ID NO: 42930 - RNA, 61 nt, Human
aagaaguaggcaugagggaucacagggccccagaaggcagggaaaggcucugaaagccagc

SEQ ID NO: 42931 - RNA, 61 nt, Human
gagacaaagcugugggagccaagaauaagacagaaggcaucagauauuugccuggcucugg

SEQ ID NO: 42932 - RNA, 61 nt, Human
gaccccagccccgaggaggaugagggcauccagaaggcauccccucucacacacagccccc

SEQ ID NO: 42933 - RNA, 61 nt, Human
gaauaugugaaaugaauuuggaaauaaugcaagaaggcagaacucaaucauuuaaauugug

SEQ ID NO: 42934 - RNA, 58 nt, Human
uucagauugggcaguuaugacauaagugagaaggcaagcaugugugagugaagauuag

SEQ ID NO: 42935 - RNA, 61 nt, Human
ggagagaaauaaaccucgcaaguuauuaaggagaaggcaugccucauugguaauuuggaag

SEQ ID NO: 42936 - RNA, 61 nt, Human
ggagguccacacuacagcuguccucucgucuagaaggcaccaccucgcuuucaugucccgu

SEQ ID NO: 42937 - RNA, 61 nt, Human
gggaauuagugcagagaagccaugucaccauagaaggcaacuccuacuuguguguggacug

SEQ ID NO: 42938 - RNA, 61 nt, Human
ucacucuuauuguacgcuuuauuauaaguuuagaaggcaguuuauucuaaauaauuuuucu

SEQ ID NO: 42939 - RNA, 61 nt, Human
ugaaaaacuccacuguacacuuauagaaugaagaaggcaaaaaacuuuuuuuuuuuuuuuu

SEQ ID NO: 42940 - RNA, 61 nt, Human
ccacccuccccaggguucaggguugcuuugcagaaggcauggaggugggaccagaugcuuc

SEQ ID NO: 42941 - RNA, 61 nt, Human
uguggcugggcuucuauccuagagauggaguagaaggcacaacugguuugauaguuacuau

SEQ ID NO: 42942 - RNA, 61 nt, Human
gcucguuccuaccuggcuggagaccgaggccagaaggcaaaaaccagaaagggaacagucc

SEQ ID NO: 42943 - RNA, 61 nt, Human
caaaacaauagcaguagggcagaaacuugaaagaaggcaggagaucauggugacaguggau

SEQ ID NO: 42944 - RNA, 61 nt, Human
aaaugauuugaaauauaggugaggauucaggagaaggcaaaagcuagaaacacuugggguu

SEQ ID NO: 42945 - RNA, 61 nt, Human
uuucaccccacgcucugcuggcuggcagaggagaaggcagucguuuccucucugaagagua

SEQ ID NO: 42946 - RNA, 61 nt, Human
aauaauucuuagaaauaggcaguucaagcaaagaaggcacacuguuaauuacaaccucuuc

SEQ ID NO: 42947 - RNA, 61 nt, Human
aaacuggcauccaggcacugggcccaugcagagaaggcaccugcagagagcagggcagccc

SEQ ID NO: 42948 - RNA, 61 nt, Human
aagugcagucacucuccuagaugcuguggggagaaggcaaguuacaaagauagaccuuccc

SEQ ID NO: 42949 - RNA, 61 nt, Human
guccucuugcugcccaugguucauaggucauagaaggcagcaaugcacugacugggccaca

SEQ ID NO: 42950 - RNA, 61 nt, Human
gugcaacagaaggguagguuagaugcuauuaagaaggcacuuaauaguacaucauguaaga

SEQ ID NO: 42951 - RNA, 61 nt, Human
uucauuaaauguuuguugaauaaaagagggaagaaggcaagccaaccuuagcuacaauccu

SEQ ID NO: 42952 - RNA, 61 nt, Human
ccaggugcauccaagacuuucccucccuuccagaaggcacugacugaagacaggauggauc

SEQ ID NO: 42953 - RNA, 61 nt, Human
aaaaaacugaaucuauauuauguuuaacuucagaaggcaucauuuauaagacaguauggca

SEQ ID NO: 42954 - RNA, 61 nt, Human
cuguuagaggcuacucagguguaccccaaacagaaggcacauggaucuggggcgacuguuc

SEQ ID NO: 42955 - RNA, 61 nt, Human
aaccacuaguuaauggauuaaaaauagagcaagaaggcaacuugaagaaacgcuucagaac

SEQ ID NO: 42956 - RNA, 61 nt, Human
aggguacauugaccuuggucaagcaucuuaaagaaggcaacccuaauugagagcugucuug

SEQ ID NO: 42957 - RNA, 61 nt, Human
agauagcacgacuacacugaggcacccucagagaaggcagggccugauuuaucuagcuguc

SEQ ID NO: 42958 - RNA, 61 nt, Human
ccgccccccuggaaagcacaagugaugagcaagaaggcauuuuccuugggagagaagggga

SEQ ID NO: 42959 - RNA, 61 nt, Human
ccagggaucuugccuggggaaaguggggugcagaaggcaugacccacgccacagcgggcuc

SEQ ID NO: 42960 - RNA, 61 nt, Human
cagcauuguguuaaauaaaaaugaaagcuuuagaaggcaugagauguuccuaucuuaaaua

SEQ ID NO: 42961 - RNA, 61 nt, Human
ggaaagaaaggauauaggaagagagggaagcagaaggcaggcauuuuucuauuuuccccac

SEQ ID NO: 42962 - RNA, 61 nt, Human
acucuuagagaagaagaaauggaaaaaugaaagaaggcaggaaggaaagaaaggauauagg

SEQ ID NO: 42963 - RNA, 61 nt, Human
uuaucaggcauaggcagccuauagggcccaaagaaggcaaaaagauaagauuuacucaagu

SEQ ID NO: 42964 - RNA, 61 nt, Human
uggccccucaugauauuugccuucugcuccuagaaggcacagacuacuuucaaccugccuc

SEQ ID NO: 42965 - RNA, 61 nt, Human
gcugaauccuugcagccucuggacagaugugagaaggcaccaccucaagaggggaggagcg

SEQ ID NO: 42966 - RNA, 61 nt, Human
guucuaguuuggaaacagauucuugagauucagaaggcauuuuggaguacacuuaucucuu

SEQ ID NO: 42967 - RNA, 61 nt, Human
aaaaaaaaaaccaggagugaaaaaggaaaguagaaggcagcugcuggccuagauguugguu

SEQ ID NO: 42968 - RNA, 61 nt, Human
uuuuuguuaauaaagaacagauuaguuuugaagaaggcaaaaauuucaguuuucugaagac

SEQ ID NO: 42969 - RNA, 60 nt, Human
uucucuuccacaguaacuagugauuccuucagaaggcaacggauaacaucgagagucucg

SEQ ID NO: 42970 - RNA, 61 nt, Human
agaaucacgaaaaggagaagucacagcaccuagaaggcagcgccuccucuucacucuccuc

SEQ ID NO: 42971 - RNA, 61 nt, Human
augaccucacugucuugaccaaagccagaauagaaggcaggauuccugaauucuaucuuaa

SEQ ID NO: 42972 - RNA, 61 nt, Human
gggcucuaguuucuaggaaugcuaaaauaucagaaggcaggagaggagauaggcuuauuau

SEQ ID NO: 42973 - RNA, 61 nt, Human
caguggagggcucaugggugggacauggaaaagaaggcagccuaggcccuggggagcccag

SEQ ID NO: 42974 - RNA, 61 nt, Human
ccauucuucaucauggaaagccacaagccucagaaggcagccagaggacaggaagagucug

SEQ ID NO: 42975 - RNA, 61 nt, Human
gagccugagagagacggcgauuuucgggcugagaaggcaguaguuuucaaaacacauaguu

SEQ ID NO: 42976 - RNA, 61 nt, Human
aaagaagcucaagaccgcacagcagcgaugcagaaggcaagaacggcagcuugaaaaauua

SEQ ID NO: 42977 - RNA, 61 nt, Human
aauccugggugugaccaauauggaauaaagaagaaggcagaaagagagcaaaugaaaaauu

SEQ ID NO: 42978 - RNA, 61 nt, Human
guuucacacaaucgaagacugcacaacuccuagaaggcagcacuaugcugcaaacccagac

SEQ ID NO: 42979 - RNA, 61 nt, Human
gaagcaagagcaaacacauucaaaagcuagcagaaggcaagaaauaacuaagauccgagca

SEQ ID NO: 42980 - RNA, 61 nt, Human
guuuggaaaauagcgaauuaaccuaagacacagaaggcagacugggugaggagaccuagca

SEQ ID NO: 42981 - RNA, 61 nt, Human
caagguuguugauggggaacuugccacuaagagaaggcagagaggucccuaguggguauau

SEQ ID NO: 42982 - RNA, 61 nt, Human
caguggggacacuccucccuccccagugagcagaaggcaccguggugguggcucugccccu

SEQ ID NO: 42983 - RNA, 61 nt, Human
gagauggccacaugaacacagacacgcagggagaaggcagccgugugaaggagucggagau

SEQ ID NO: 42984 - RNA, 61 nt, Human
cacugugaggccccagguggaaacgugcaagagaaggcagagccuuugacaguucucaaaa

SEQ ID NO: 42985 - RNA, 61 nt, Human
aagggaggaagaucagcaaauaugcuccugaagaaggcaacagauaugauggcauuuauaa

SEQ ID NO: 42986 - RNA, 61 nt, Human
augucucuucuaacaucuuagagguccauggagaaggcauauggagaacauguuuuauacu

SEQ ID NO: 42987 - RNA, 61 nt, Human
uauugaugaccugugcucugcaggggaaaccagaaggcaaaaugcuggcagcaugaaaccc

SEQ ID NO: 42988 - RNA, 61 nt, Human
uaucuuuaacagugcuugagaugcuuaacagagaaggcauccagugcuucauugaggcuaa

SEQ ID NO: 42989 - RNA, 61 nt, Human
cacagaacaaagaccaggagaggacacagugagaaggcaguuaucugcaagcaaagagaga

SEQ ID NO: 42990 - RNA, 61 nt, Human
uuauucucugauagacugagcuccuuccaccagaaggcacugccugcaggaagaagaugau

SEQ ID NO: 42991 - RNA, 61 nt, Human
gugccgucauuuguuucugcagcagcagcugagaaggcagccggcagcucugccagggugg

SEQ ID NO: 42992 - RNA, 61 nt, Human
agggggcucgggcugccuggccuggcugcacagaaggcaagugcuggggcucauggugcuc

SEQ ID NO: 42993 - RNA, 61 nt, Human
uccuuuugggacuggaggcagaaaagcggccagaaggcagcagcccuggcuccuuuccuuu

SEQ ID NO: 42994 - RNA, 61 nt, Human
gcgggcccugcagaguuacugauguucuuucagaaggcaggacugaauggcagagcuagcu

SEQ ID NO: 42995 - RNA, 61 nt, Human
cucuggaauuaaagggacucuuccauuuugaagaaggcauccagaagcuguaucagugcaa

SEQ ID NO: 42996 - RNA, 61 nt, Human
ggaugaaucucccacuccagcgcugagugggagaaggcagugauuagcacuugggugacgg

SEQ ID NO: 42997 - RNA, 61 nt, Human
agccauagcuugauugcucagagaaauaugcagaaggcaggaucaaagacacacaggaguc

SEQ ID NO: 42998 - RNA, 61 nt, Human
gcgaagguagaggauguguuccagaaacauuagaaggcaggauuaauucaguuaguuaguu

SEQ ID NO: 42999 - RNA, 61 nt, Human
aguugcuggcugagggcuucccuuggcuuccagaaggcagccuuccauccagacaagccag

SEQ ID NO: 43000 - RNA, 61 nt, Human
ucuggcuggcggcaagggaaagggacgauggagaaggcacggcugcuucuuaccugccuug

SEQ ID NO: 43001 - RNA, 61 nt, Human
gaucugaagaguaaagggcugggucugccucagaaggcaccagcaccagggcccagguauu

SEQ ID NO: 43002 - RNA, 61 nt, Human
uccccuccuaaccgcaagcguccugcuaacgagaaggcaacugaugacuaucauuaugaga

SEQ ID NO: 43003 - RNA, 61 nt, Human
ggggccaggcugggagcccaugcaguagggcagaaggcagcggaggccaggucugucccgg

SEQ ID NO: 43004 - RNA, 61 nt, Human
ugguuuauagcuggaauacugaguucaguucagaaggcaggaaagacagucacaccgacgu

SEQ ID NO: 43005 - RNA, 61 nt, Human
aauuuuuuaaauaaaccagcagguugcuaaaagaaggcauuuuaucuaaaguuauuuuaau

SEQ ID NO: 43006 - RNA, 61 nt, Human
uucuacaugagcccuacagacaggcauguguagaaggcaauuuaucaaaccuauugcacug

SEQ ID NO: 43007 - RNA, 61 nt, Human
gaguaguugcuacucuucagaauauggacaaagaaggcacagguguaaauauaguagcagg

SEQ ID NO: 43008 - RNA, 61 nt, Human
ucaucuaaugugguuuuccuuaggaagagauagaaggcacagaagaucacagcuagagaau

SEQ ID NO: 43009 - RNA, 61 nt, Human
agguaagcaucuuaaagcuguuuggugauaaagaaggcagcuuagauucugugguuggaaa

SEQ ID NO: 43010 - RNA, 61 nt, Human
accuucuagcugcacucuguacugugugccgagaaggcauuucuagacccguguuuuuaaa

SEQ ID NO: 43011 - RNA, 61 nt, Human
uuuaucagucugagaaaauauuuuuuucuaaagaaggcagucaguggaucuuaaaaugaca

SEQ ID NO: 43012 - RNA, 61 nt, Human
uggaaugcagcuaccugccaagcaaggcaauagaaggcaaaaaauggaagugaauuaagau

SEQ ID NO: 43013 - RNA, 61 nt, Human
cuugacaccagagcagcccccgcgugaaaugagaaggcaugcuuagcacugggaggaaaag

SEQ ID NO: 43014 - RNA, 61 nt, Human
ucauaaguauuucaaauuggagcuucauggcagaaggcaaacccaucaacaaaaauugucc

SEQ ID NO: 43015 - RNA, 61 nt, Human
uguacucauuccugguggcucaucucaggacagaaggcaauugcagcuaaggaacaaugga

SEQ ID NO: 43016 - RNA, 61 nt, Human
uaauuagaauguguuauuugauuucugcugcagaaggcagugugauuguaacaaaaacaau

SEQ ID NO: 43017 - RNA, 61 nt, Human
ccagaaaugcaucaccuugucaugacaaaagagaaggcaguagaguagggauaguuacaaa

SEQ ID NO: 43018 - RNA, 61 nt, Human
acuuuuguauuuuaauaucuugcaagggcaaagaaggcauuuuuaaaauucuaaaugcaca

SEQ ID NO: 43019 - RNA, 61 nt, Human
uuuaaaaccaccgacagcccuuggguuggcaagaaggcaggaguauguaugagguccaucc

SEQ ID NO: 43020 - RNA, 61 nt, Human
guguuugcaauuugaagauaucuuucuguccagaaggcaaaauuaccgaaugccauuuuua

SEQ ID NO: 43021 - RNA, 61 nt, Human
cuagagggauuaguacaaacuccucuuauacagaaggcaaaucugagguuccacagaaguc

SEQ ID NO: 43022 - RNA, 61 nt, Human
gaaaguugcaggaaguuaguuuuaguucuguagaaggcaagaguaggguagaccaaaucaa

SEQ ID NO: 43023 - RNA, 61 nt, Human
aggaggguguucaggagccagacuuuuggagagaaggcagcucccagccugcugggugacc

SEQ ID NO: 43024 - RNA, 61 nt, Human
aauccgauacugcaacguuuuccaaaaucccagaaggcaaacugugcauguucuacccuga

SEQ ID NO: 43025 - RNA, 61 nt, Human
uguacuaggccauuccagcugaaucucaaacagaaggcaguaaugagagccuacaaauggg

SEQ ID NO: 43026 - RNA, 61 nt, Human
ugcuuuuaucauuuucaagaugguuauuuguagaaggcaaggaaccaauuaugcuuguauu

SEQ ID NO: 43027 - RNA, 61 nt, Human
gcucuguuccaugccucucuccuuggcuuguagaaggcaucuugucccuaugacucuucac

SEQ ID NO: 43028 - RNA, 61 nt, Human
cccaacuggacaaugaucugucuggugcaggagaaggcaaaaguuucuacaagucuacaug

SEQ ID NO: 43029 - RNA, 61 nt, Human
uuuaagccaguuuacuuagaguauaugauaaagaaggcagaggaauagcuacauauuuggc

SEQ ID NO: 43030 - RNA, 61 nt, Human
cggaugauuggauuauucauuuaaaaugauuagaaggcaaguuucuagcuagaaauaugau

SEQ ID NO: 43031 - RNA, 61 nt, Human
uguuguggaggcaaggaaggcaacucaucccagaaggcaucuggugcuucuuguagcuuaa

SEQ ID NO: 43032 - RNA, 61 nt, Human
acacaacagugacaauuuuuuuuaaaagaauagaaggcaggagggggaauucgacauuguu

SEQ ID NO: 43033 - RNA, 61 nt, Human
gucagaggaagagacuucuucuguucucuggagaaggcaggaggaaagcaaagaccuccau

SEQ ID NO: 43034 - RNA, 61 nt, Human
cucucuuguuucccauggaaacggccucuucagaaggcagaucgggcugucucuuuccugu

SEQ ID NO: 43035 - RNA, 61 nt, Human
ggguuuggcuacuguuggccugggagcugagagaaggcacugagagggacaguaggcggag

SEQ ID NO: 43036 - RNA, 61 nt, Human
cagccccgggccuccaaccauguccaugcugagaaggcagcuuucccgcucuggguaccuu

SEQ ID NO: 43037 - RNA, 61 nt, Human
uauuuuaaaaauaaacauuuuuuaaaucgucagaaggcaacauuuaccauguuccuuucag

SEQ ID NO: 43038 - RNA, 61 nt, Human
gaaaacuggaggaaaaugggcacaaaaacucagaaggcagcuauucccagcagcuuccuag

SEQ ID NO: 43039 - RNA, 61 nt, Human
gaauaagcgaagguuucccuacaagagggaaagaaggcaaaaacggcacagcuaucuccaa

SEQ ID NO: 43040 - RNA, 61 nt, Human
cauagggaauauaacauuccaguguauacaaagaaggcaaauucuuuaaucaaauaaagcg

SEQ ID NO: 43041 - RNA, 61 nt, Human
uuaacuuaaacuaaaauuuuggguauaugaaagaaggcagcaauucagaaguaaagaagau

SEQ ID NO: 43042 - RNA, 61 nt, Human
gcccauugguuuccacgauuucaauuggcugagaaggcagagagcuagcuccucccuuucu

SEQ ID NO: 43043 - RNA, 61 nt, Human
ugucagaccaucagaccagggccaaccaaucagaaggcaacuuacuguauaaauuaugcag

SEQ ID NO: 43044 - RNA, 61 nt, Human
gaagagggagacuggggagaagggaaaagagagaaggcagggagaguagggagagaaaacc

SEQ ID NO: 43045 - RNA, 61 nt, Human
auuaacuucuccuccagaacaagugcaauucagaaggcagcucugcauucuaccuugcuug

SEQ ID NO: 43046 - RNA, 61 nt, Human
cagaggccuggaaaugcggaggacuauacagagaaggcagguuuugugaaggccaggcagg

SEQ ID NO: 43047 - RNA, 61 nt, Human
agugcaacaucucugaauccuuuuaaucuagagaaggcauuucauauuugggggcuaaggu

SEQ ID NO: 43048 - RNA, 61 nt, Human
acagcuggcuuaauuguugaaagagauauguagaaggcacaauaugggcacuuuaaaugaa

SEQ ID NO: 43049 - RNA, 61 nt, Human
acaacccagcuaugcccacaugcucaagcccagaaggcagaaucaagcuuugcuuucuaga

SEQ ID NO: 43050 - RNA, 61 nt, Human
aucugggaaugaauuugcagcaccugguagaagaaggcaccuuggaaggcacugccuuggg

SEQ ID NO: 43051 - RNA, 61 nt, Human
uucugggcuucuccccaugucguaauugaacagaaggcagcccgaauaaaccccugauguu

SEQ ID NO: 43052 - RNA, 61 nt, Human
aaaaaagacagaaauuuaagggaaaaacacaagaaggcauuuugcuucaauauauuccgug

SEQ ID NO: 43053 - RNA, 61 nt, Human
ccuucuuacaccgugaggccaagauccccucagaaggcaggagugcugcccucucccaugg

SEQ ID NO: 43054 - RNA, 61 nt, Human
cacauggcuggggaggucuugcaaucaugacagaaggcaaaugggaagcaaagucaugucu

SEQ ID NO: 43055 - RNA, 61 nt, Human
gccccuuggcccucuccugucugcccuagggagaaggcagguggacaagggcccaugaaaa

SEQ ID NO: 43056 - RNA, 61 nt, Human
ccucugacacagacugccugccuugaagcugagaaggcacagggcaaggagccaaggacca

SEQ ID NO: 43057 - RNA, 61 nt, Human
uagagacagaggaacaaaaagagcagcagugagaaggcaaagagagaggcagaagagacag

SEQ ID NO: 43058 - RNA, 61 nt, Human
aauuccauccaguucuaagugaaagaguuucagaaggcagaagauuuugaauuauuaucca

SEQ ID NO: 43059 - RNA, 61 nt, Human
ccuuggaucucuuggauaggaguuggugaauagaaggcaggcagcaucacacuggggucac

SEQ ID NO: 43060 - RNA, 61 nt, Human
uaaguuuacaguuuuuuauuaguccgggaaaagaaggcacaauaguuuucgacacuggacu

SEQ ID NO: 43061 - RNA, 61 nt, Human
uuaucuaaaucacuggaaaggcuggaggagcagaaggcagaggccaccacuggacuauugg

SEQ ID NO: 43062 - RNA, 61 nt, Human
gugguaaaagaggguugcauuucuugcagccagaaggcagagaaagugaagaccaagucca

SEQ ID NO: 43063 - RNA, 61 nt, Human
ucagaaaagguagcagcaaucccaaagcagcagaaggcagggguuaaaucaggauaaaaac

SEQ ID NO: 43064 - RNA, 61 nt, Human
gagggccucaaguccaaggcuuuaucuuuggagaaggcaaggaaggaggcggugacagacg

SEQ ID NO: 43065 - RNA, 61 nt, Human
auuaugggaggggaacauuagggaaauccagagaaggcaaaauugaaaaaaagauuuuaga

SEQ ID NO: 43066 - RNA, 54 nt, Human
acaaaggaaaaucucuuuaagaacagaaggcacaacucaaauguguaaagaagg

SEQ ID NO: 43067 - RNA, 61 nt, Human
cuugcacccauguguagucaggugccucaagagaaggcaaccuugacucuuucuauuguuu

SEQ ID NO: 43068 - RNA, 61 nt, Human
gcauguaggagaauccaagcgaggucaacagagaaggcaggaauguguggcagauuuagug

SEQ ID NO: 43069 - RNA, 61 nt, Human
gcccacucccccugccuccagcaggccaggaagaaggcacaguccaggcaagucugggagc

SEQ ID NO: 43070 - RNA, 61 nt, Human
ggaaauuagugccacccacggugagaagcagagaaggcacuugcauccuaugcagcccuga

SEQ ID NO: 43071 - RNA, 61 nt, Human
gaggcugaggcaggagaaaucgccugaacccagaaggcagagguugcagugagccaagauc

SEQ ID NO: 43072 - RNA, 61 nt, Human
aaggguacugaaaacaccauccauuugggaaagaaggcaaaguccccccaguuaugccuuc

SEQ ID NO: 43073 - RNA, 61 nt, Human
ggcagagaacugacuagaacaggguguucccagaaggcaggucccucauuguccccgaagc

SEQ ID NO: 43074 - RNA, 61 nt, Human
caacuggaagcagauggugaccaggcucuggagaaggcaaggccugaagaugggagauucc

SEQ ID NO: 43075 - RNA, 61 nt, Human
uagcuucugugagaguuaaaaaucucagguaagaaggcaaggaaggcucuguuaauuuaua

SEQ ID NO: 43076 - RNA, 61 nt, Human
cagcauuucaugaaggauaacauuuuuauacagaaggcagucaagcucaacucagagccau

SEQ ID NO: 43077 - RNA, 61 nt, Human
aaacaaaauacuugacauagucuuaaguagaagaaggcaguuagagaaaacaaaguaucua

SEQ ID NO: 43078 - RNA, 61 nt, Human
cagucuagucuggaaaacaaacaugaagcaaagaaggcacaacaccauauggaaaagcaag

SEQ ID NO: 43079 - RNA, 61 nt, Human
uucggucuccccaucaccggccgccucguggagaaggcagugccacgugggaggacaaggc

SEQ ID NO: 43080 - RNA, 61 nt, Human
gcugcgucauaaggagacuucugucuucuccagaaggcaauaccaaccugaaaguuccuuc

SEQ ID NO: 43081 - RNA, 61 nt, Human
gcaaaaagcaagggagaaaagagaaaccgggagaaggcaugagaaagaauuugagacgcac

SEQ ID NO: 43082 - RNA, 61 nt, Human
gguggauaggcauuaugguuuccacuuuggcagaaggcagacuauucacagcccuauuuac

SEQ ID NO: 43083 - RNA, 61 nt, Human
uauugaacuauuuuuauaucugcugucuuucagaaggcaaauaggaaacuauauauuugcu

SEQ ID NO: 43084 - RNA, 61 nt, Human
ccccaccugccaaauaaccuguucaaaacaaagaaggcauagaauauaaaugaauuucaaa

SEQ ID NO: 43085 - RNA, 61 nt, Human
ucugauucuuuuguaaauacagaacuuaaauagaaggcaacaggaaauuuauauaggaacu

SEQ ID NO: 43086 - RNA, 61 nt, Human
uuaccucauaagugcauauauagugugaaagagaaggcauuaaaaagaagugcaauuccuu

SEQ ID NO: 43087 - RNA, 61 nt, Human
uaaguuggaguguuuaugauuauugcuagaaagaaggcagacuucauauucucaucgccca

SEQ ID NO: 43088 - RNA, 61 nt, Human
ucccacgaugucugaaaccagagcaggaaaaagaaggcacacuucuuuuggucugaaggua

SEQ ID NO: 43089 - RNA, 61 nt, Human
caagagagggacaauguagcuuuauuuuacaagaaggcauaguuagauuucuaugaaauau

SEQ ID NO: 43090 - RNA, 61 nt, Human
cggacaaccaugagggguaguggugcuagggagaaggcaaccuucacugguuuugaacuca

SEQ ID NO: 43091 - RNA, 61 nt, Human
ggaaggguagggcagccagagaaaggagcagagaaggcacacaaacgaggaaugaggggcu

SEQ ID NO: 43092 - RNA, 61 nt, Human
uuccauuagaugagugggauuuagggaacgcagaaggcacaucccuuuggaauggaagcuu

SEQ ID NO: 43093 - RNA, 61 nt, Human
ugggccacgauaggguggagugagcuagugaagaaggcagagggagacuuggcuucugguc

SEQ ID NO: 43094 - RNA, 61 nt, Human
uuuuuaagaagaugccaauauaauuuuuguaagaaggcaguaaccuuucaucaugaucaua

SEQ ID NO: 43095 - RNA, 61 nt, Human
ugcucuuucuaaagucaaaauaugaaugcuaagaaggcauaaccuacauccuucucugauu

SEQ ID NO: 43096 - RNA, 61 nt, Human
cgcccugcagagaagagaaccaugccaggggagaaggcacccagccauccugacccagcga

SEQ ID NO: 43097 - RNA, 61 nt, Human
uuugcacacccagcauagccuccuugcaggcagaaggcaguagggccccugcacacucagu

SEQ ID NO: 43098 - RNA, 61 nt, Human
ucaggccgugugaagagcagcaaagcuuuccagaaggcauaaaaggaaacuugaauaaagg

SEQ ID NO: 43099 - RNA, 61 nt, Human
ccugauaaguagcuggggagguggauuuagcagaaggcaacuccucugggggauuugaacc

SEQ ID NO: 43100 - RNA, 61 nt, Human
ucuccauacaaugcacacaugguacaaugauagaaggcaaaauugccacugucuucuuuuu

SEQ ID NO: 43101 - RNA, 61 nt, Human
ugucugcuugccacuuccuaagaauucuuguagaaggcaguuuccucuacuugcccaagag

SEQ ID NO: 43102 - RNA, 61 nt, Human
cacuguuuuuauccuagaaaauguugcugucagaaggcaaaggaaauguuaccaguguuuu

SEQ ID NO: 43103 - RNA, 61 nt, Human
gugugccaguacucaggcagcuggagagaagagaaggcagcagcagaggcccccgcccuca

SEQ ID NO: 43104 - RNA, 61 nt, Human
ucaauaucacaggaacacacauucggcaccuagaaggcacgugggcaaaguaaucaucguu

SEQ ID NO: 43105 - RNA, 61 nt, Human
uccuuguacaucugcauuaaggugccgaugcagaaggcaaauuggaaacacgcgccagcgg

SEQ ID NO: 43106 - RNA, 61 nt, Human
cauucgguauaaggcagcuuucaauuugcuuagaaggcaacauuggaagguuagaguucau

SEQ ID NO: 43107 - RNA, 61 nt, Human
cugccaggacuccgcuucuccgugucccagcagaaggcaugcaggacccugucacuacuau

SEQ ID NO: 43108 - RNA, 61 nt, Human
cuuccuccugccuguaggugucccagaagugagaaggcagccuucgaaguccugggcauug

SEQ ID NO: 43109 - RNA, 61 nt, Human
agagggcuaggcacggagggaaggucagaggagaaggcaggcagggcccagugagagggga

SEQ ID NO: 43110 - RNA, 61 nt, Human
aaaacaaacaaaaagacuccgagcgauggagagaaggcacccuagccuggcugggauccuc

SEQ ID NO: 43111 - RNA, 61 nt, Human
cagcagcugaaggucucagagaccaguaaucagaaggcauccgacugcauuaagugugcag

SEQ ID NO: 43112 - RNA, 52 nt, Human
uucgagcugacagacugugaacagaaggcaguggaacagaagaauguuuuuc

SEQ ID NO: 43113 - RNA, 61 nt, Human
ugaacggauugcucgagaaagagaggaacucagaaggcaacaacagcagcuucguuaugaa

SEQ ID NO: 43114 - RNA, 61 nt, Human
agagggcaagaggagagagcgccuccagucuagaaggcauaagccaauaggauaauauauu

SEQ ID NO: 43115 - RNA, 61 nt, Human
ggccacguagguuuuaaagcaaggggcgugaagaaggcacagugagguauguggcuguucu

SEQ ID NO: 43116 - RNA, 61 nt, Human
uuuggcuuaaacaauuuauaaaagccuuucuagaaggcagacuuagccccagcagagccug

SEQ ID NO: 43117 - RNA, 61 nt, Human
guugcucauacaaacagaucagcaugaggacagaaggcaggagacuuuggucaguuaccug

SEQ ID NO: 43118 - RNA, 61 nt, Human
gggcccaaccgugcaugaugacagggugaagagaaggcaggucugggcacuggggcaaaga

SEQ ID NO: 43119 - RNA, 61 nt, Human
cagcaggcgccuccaggcuggggcccaaccuagaaggcaggggucaaucuaacaaaacccu

SEQ ID NO: 43120 - RNA, 61 nt, Human
ucuccaaggaggucgggauggggcuuguagcagaaggcaagcaccaggcucacagcuggaa

SEQ ID NO: 43121 - RNA, 61 nt, Human
cucagggaacugacccucaggcacaccuugcagaaggcaaggcccugcccugcccaaccuc

SEQ ID NO: 43122 - RNA, 61 nt, Human
aguugccaucuuggccaugcaagaaaagaaaagaaggcauuuacucuaugucgggggggua

SEQ ID NO: 43123 - RNA, 61 nt, Human
uguuuucuaaagaaacaggauaggaguuuagagaaggcaccaaagcuuucacuuugguuug

SEQ ID NO: 43124 - RNA, 61 nt, Human
aagugaaggaggccgccccugcccccaccugagaaggcagagcagugucugugcugccagg

SEQ ID NO: 43125 - RNA, 61 nt, Human
aauuuguucuuguauuuauugguuuugcagaagaaggcaucgucaugcacaguauuuguaa

SEQ ID NO: 43126 - RNA, 61 nt, Human
uggggucuuuugcgaaagggauugcagguucagaaggcaucuuaccauggcuggggaauug

SEQ ID NO: 43127 - RNA, 61 nt, Human
uccagucauuguaguauuguuugugacccugagaaggcaaaagaaagaaccacucauuguc

SEQ ID NO: 43128 - RNA, 61 nt, Human
uuaguacauuaauugcugucaaagaugaagaagaaggcacaucuugacacaguaccugaau

SEQ ID NO: 43129 - RNA, 61 nt, Human
accugggcuggcauuggucacaccaggccuaagaaggcagaaguugaaucaauugaacuag

SEQ ID NO: 43130 - RNA, 61 nt, Human
cuggguuuucagcauaaaugggaacugauguagaaggcaggauuuagcccuucuaggcaaa

SEQ ID NO: 43131 - RNA, 61 nt, Human
ccuucagccugagccaagcugcauugggaggagaaggcagggugagggaucugggagagca

SEQ ID NO: 43132 - RNA, 61 nt, Human
aaccaccaggacugaaagaagaaaacaguacagaaggcaaaguuuacagauguuuuuaauu

SEQ ID NO: 43133 - RNA, 61 nt, Human
cugaccguucuauuguguggaugaccacauaagaaggcaauuuuaguguauuaaucauaga

SEQ ID NO: 43134 - RNA, 61 nt, Human
ccccgccaguugcuuugucugguagcucaagagaaggcagagccccagcaccucugugccc

SEQ ID NO: 43135 - RNA, 61 nt, Human
uucaaaagucuggcccacugugcaguggagcagaaggcaggaccaugaggccuccugccau

SEQ ID NO: 43136 - RNA, 61 nt, Human
ugaaugugacguuauuuaaaaacaacaacaaagaaggcagagccaggauauaacuagaaaa

SEQ ID NO: 43137 - RNA, 61 nt, Human
ccugcuucuggcuacagccacccuggaacggagaaggcagcugacggggauugccuuccuc

SEQ ID NO: 43138 - RNA, 61 nt, Human
aguguccccaggguccagccuggcuagaguuagaaggcagaccuagccuuuggaagcaggg

SEQ ID NO: 43139 - RNA, 61 nt, Human
ucccccaaggguucugcgaagaggcaguggaagaaggcaugaggagagggucucuugagaa

SEQ ID NO: 43140 - RNA, 61 nt, Human
uuuaaaauaaaugguuaacauggcauuucuaagaaggcauuuaauccaguaucucuagugu

SEQ ID NO: 43141 - RNA, 61 nt, Human
gccugugggagaagggacagcggguaaaaagagaaggcaagcuggcaggaggguggcacuu

SEQ ID NO: 43142 - RNA, 61 nt, Human
augaauguugcaugacaacaguuggccgauuagaaggcagacuuucuacaugcaaaucugg

SEQ ID NO: 43143 - RNA, 61 nt, Human
ugucugcccugcugggagagauggagaagcuagaaggcaaagugcacaugaaggugagaga

SEQ ID NO: 43144 - RNA, 61 nt, Human
ggcuccacagcugugcauuccacagagauucagaaggcaccucuucggucaaacauggccc

SEQ ID NO: 43145 - RNA, 61 nt, Human
cucggccucccaaaguacugggauuacacgcagaaggcaccaugcccaggcuagauguguc

SEQ ID NO: 43146 - RNA, 61 nt, Human
ccgggcuuaccaggugagaagugagggaggaagaaggcagugucccuuuugcuagagcuga

SEQ ID NO: 43147 - RNA, 61 nt, Human
agagggggagguugguuccuuggggggccaaagaaggcagggaaugccuggaggguaacug

SEQ ID NO: 43148 - RNA, 61 nt, Human
uccccagcccugggcuuggcucuuggcuuccagaaggcagcaaagaggggcgcuguccugc

SEQ ID NO: 43149 - RNA, 61 nt, Human
gugcuguuaaauauauauucuauucuuuggaagaaggcagagagaggagucuuauuauuuu

SEQ ID NO: 43150 - RNA, 61 nt, Human
gaagacaaaauauuugggaaaaccuaucggaagaaggcaagccuccccaacuuaagccaug

SEQ ID NO: 43151 - RNA, 61 nt, Human
uuugcggaugagggcaugugcggcugaacugagaaggcaggccuccgucuucccagcgguu

SEQ ID NO: 43152 - RNA, 61 nt, Human
aagggcaguauuuuucugucaagacuauucaagaaggcauuauuugagauuccuguucauu

SEQ ID NO: 43153 - RNA, 50 nt, Human
aggaagaggugcucagcugaagaaggcaugggauggagcccuggcauagc

SEQ ID NO: 43154 - RNA, 61 nt, Human
uuauuuuggaggcccugguggucacaggaucagaaggcaagggauaggcaguggucaccaa

SEQ ID NO: 43155 - RNA, 61 nt, Human
cucauagguuacucccaggagugugcugagcagaaggcaagcucuugcuggaugaaacccc

SEQ ID NO: 43156 - RNA, 61 nt, Human
aagccaagaguguuuaaaugugacacuugugagaaggcauuugccaaaccaagccagcugg

SEQ ID NO: 43157 - RNA, 61 nt, Human
agaaauuauaguuacaaugaauugcauaugaagaaggcagacauuuauuuuuaauagccaa

SEQ ID NO: 43158 - RNA, 61 nt, Human
cuccggguggaagagcagcuuucugucucccagaaggcaucgcuuuucccucuugagcaga

SEQ ID NO: 43159 - RNA, 61 nt, Human
accacaagccuggcauuucagccagggcuggagaaggcagggacgccugggugagaggcaa

SEQ ID NO: 43160 - RNA, 61 nt, Human
agcucuagcuggaugggcgcagagaaccucaagaaggcaugaagccagccccugcagugcc

SEQ ID NO: 43161 - RNA, 61 nt, Human
ccuaucuuacaugagauucggaaguaaguuaagaaggcauuagucaugguuuggaagcacc

SEQ ID NO: 43162 - RNA, 61 nt, Human
auugcaagagcaaacacagucaaaaacuagcagaaggcaagaaauaacuaaaaucagcaga

SEQ ID NO: 43163 - RNA, 61 nt, Human
gugggggugggaagguaaggauggucguggaagaaggcaggauggaacucggccucauccc

SEQ ID NO: 43164 - RNA, 61 nt, Human
agguuguucacugcaggaaguccccugguuaagaaggcaagugggguuuaaacagacccac

SEQ ID NO: 43165 - RNA, 61 nt, Human
gaccccacaagccauggagacucaggaccccagaaggcauggaagcugccuccaguagaca

SEQ ID NO: 43166 - RNA, 61 nt, Human
aaaguugugauuuguccucauucuaauccauagaaggcaacauuucuaacagguuucuagg

SEQ ID NO: 43167 - RNA, 61 nt, Human
ccucuauuucccacucagggcugucccagagagaaggcagccgaacugaggauuuagacug

SEQ ID NO: 43168 - RNA, 61 nt, Human
uuuucuuucauuguuaaagggaagcuuuuuaagaaggcaauuuucauauuguuucuacagg

SEQ ID NO: 43169 - RNA, 61 nt, Human
gugugguggggcguagugguggcaggacaagagaaggcauugagcuuuuucuuucauuuuc

SEQ ID NO: 43170 - RNA, 61 nt, Human
ugguggcucaugccugcaaucccagcacuguagaaggcagaggccggcagaucacuugagc

SEQ ID NO: 43171 - RNA, 61 nt, Human
agaaagcgcugagagcucgcagguucauuaaagaaggcaaagcacugguuucucuccuuag

SEQ ID NO: 43172 - RNA, 61 nt, Human
cgggccaugcaggacaugcagcugcugugggagaaggcaguccaacagcaccagcacggcu

SEQ ID NO: 43173 - RNA, 61 nt, Human
ucacacauggcuguucuggagagggccucugagaaggcacugaaugaggcgagggacccuu

SEQ ID NO: 43174 - RNA, 61 nt, Human; identical to SEQ ID NO: 43173

SEQ ID NO: 43175 - RNA, 61 nt, Human
caacguguaugaagaugcugcauuggcccacagaaggcaaaaggugagaggauuuugaauu

SEQ ID NO: 43176 - RNA, 52 nt, Human
cuggcuaugaaaccuugugagcagaaggcaagagcggcaagaugaguuuuga

SEQ ID NO: 43177 - RNA, 61 nt, Human
cauacucaacagaaggagacucagagacuccagaaggcacaggagcugcccccaguggaca

SEQ ID NO: 43178 - RNA, 61 nt, Human
uggggagaagccugugccuccccguguggagagaaggcaaccccagauccccugagcuaac

SEQ ID NO: 43179 - RNA, 61 nt, Human
auagcugcugugcaaauugguagaccuuauaagaaggcacuuguuuguaagccagagaaga

SEQ ID NO: 43180 - RNA, 61 nt, Human
uuugaagaaggaaaaagaaauacuguuugagagaaggcaaacagacaaaaagggugauaga

SEQ ID NO: 43181 - RNA, 61 nt, Human
gacuggccauuuuucuggggguaggaugaagagaaggcacacagagauucuggaucuccug

SEQ ID NO: 43182 - RNA, 61 nt, Human
ugguuugggagagauagugagggccugucaaagaaggcagguagcagucagcaugacagcu

SEQ ID NO: 43183 - RNA, 61 nt, Human
uuaaggccacugugaggagagggguugccccagaaggcaggggaaggaccugaugagaaca

SEQ ID NO: 43184 - RNA, 61 nt, Human
caggcugcaaggagcaacagcgauggcagugagaaggcaaccaaagugcaggacaucaaaa

SEQ ID NO: 43185 - RNA, 61 nt, Human
caggguuaaaaucggccugugggguguggugagaaggcagguugugcggguguugaccgau

SEQ ID NO: 43186 - RNA, 61 nt, Human
ccugggccuaggccacaggggcagggagaagagaaggcauuaguaagaaaaaaauagaaaa

SEQ ID NO: 43187 - RNA, 61 nt, Human
uccccaugugccugcaccaggagacagacagagaaggcagcaggcggccuuuguugcucag

SEQ ID NO: 43188 - RNA, 61 nt, Human
cuaaggguuaaauuguguuguugccuucaguagaaggcauuugugggcugcagaguugaga

SEQ ID NO: 43189 - RNA, 61 nt, Human
ccuugcccuucugcaaugugugaucacagcuagaaggcacugucagagaagagaaacuggu

SEQ ID NO: 43190 - RNA, 53 nt, Human
agagagaaauuacagagugacggagaaggcagacaucaugcaacaugcucaag

SEQ ID NO: 43191 - RNA, 61 nt, Human
ugugacaauucagagcauaacucagauggcgagaaggcagcauuaucucugugcgaugcug

SEQ ID NO: 43192 - RNA, 61 nt, Human
agccuuuauuucccuggcaggcagccuugccagaaggcagagaggcaguucugaaucauuc

SEQ ID NO: 43193 - RNA, 61 nt, Human
ggagagaaggagaaggauuaggaaaaaacaaagaaggcaauaaggaacccauccuaguuga

SEQ ID NO: 43194 - RNA, 61 nt, Human
acugaaaaccagguuauauucuaaagaagaaagaaggcaggauagugcuuuugaacaagcc

SEQ ID NO: 43195 - RNA, 61 nt, Human
uugagcucaggccucucgugccuggugucagagaaggcagagcccacaguaggugcacggu

SEQ ID NO: 43196 - RNA, 61 nt, Human
uucuaugacccugacgagugcgggcugaugaagaaggcagccuuguacuucagugacuucu

SEQ ID NO: 43197 - RNA, 61 nt, Human
ccacucuaugcgaaccacaagacccuccuccagaaggcagccgcugaguucggggcucacu

SEQ ID NO: 43198 - RNA, 61 nt, Human
cacguaaacuaaguaggcagguaggaucugaagaaggcacaggugcaaguaaaauucguca

SEQ ID NO: 43199 - RNA, 61 nt, Human
uggcaaugauaaaaccagcagcaaugauaauagaaggcaaacuugcaauggucugugguaa

SEQ ID NO: 43200 - RNA, 61 nt, Human
agggguuaaugcagauggcagugcagcaaggagaaggcaggaacauuggagccugcaauaa

SEQ ID NO: 43201 - RNA, 61 nt, Human
ggaggcugaggcaggaggaucacuuaagcccagaaggcagagguuguagugagcugagauc

SEQ ID NO: 43202 - RNA, 61 nt, Human
guccaagguucugcccuuccuugaguggucuagaaggcacugcguggccccucagaugcug

SEQ ID NO: 43203 - RNA, 61 nt, Human
ggaggcugaggcaggagaauggcgugaacccagaaggcagagcuugcagugagccaagauc

SEQ ID NO: 43204 - RNA, 61 nt, Human
gcuggggcuuccugggaaaaggaaggccaugagaaggcagagaaguaggccagagcugggu

SEQ ID NO: 43205 - RNA, 61 nt, Human
auaauuaagagcuuagcaucccucuuagaguagaaggcaguacagauaacaaagaaguugu

SEQ ID NO: 43206 - RNA, 61 nt, Human
gggguuaaugcagauggcaagugcaccaaggagaaggcaggaaugcuggagccuggaauaa

SEQ ID NO: 43207 - RNA, 61 nt, Human
gggguuacucaagauggcaagugcgccaaggagaaggcagaaaugcuggggccuggaauaa

SEQ ID NO: 43208 - RNA, 61 nt, Human
gggguuaaugcagauggcaagugcaccaaggagaaggcaggaacacuggagccugcaauaa

SEQ ID NO: 43209 - RNA, 61 nt, Human
uuuuguauaugcugcauugagacuuacggcaagaaggcauuuuuuuuuuuuaaaggaaaca

SEQ ID NO: 43210 - RNA, 61 nt, Human
uuuuagggcagaauccauggagacugcuuccagaaggcaucuggcucugaguuauaaauua

SEQ ID NO: 43211 - RNA, 61 nt, Human
acuuuucccuuccuggcccaagagagcauccagaaggcaguaggaccugguuuuucaggua

SEQ ID NO: 43212 - RNA, 61 nt, Human
caacccuguuucuuuggugccugcaguuuagagaaggcagagccacugguuuugagaacca

SEQ ID NO: 43213 - RNA, 61 nt, Human
cuucugccacaaugacauccaggaagguaggagaaggcaucugagucuccuaacccaagau

SEQ ID NO: 43214 - RNA, 61 nt, Human
acaccagugcaagcagaugacaaaaaggugcagaaggcaaucuuaaaacagaaaggugcag

SEQ ID NO: 43215 - RNA, 61 nt, Human
gcacuuuggcgcguaguaagugcuuuauguaagaaggcagggcaggggggcuuuuuacagg

SEQ ID NO: 43216 - RNA, 61 nt, Human
agauugggaaggcucagaagggcagaguugaagaaggcauaccuuuaagagaagcccuuug

SEQ ID NO: 43217 - RNA, 61 nt, Human
uuaaauucuagauguugacaauuacugaaucagaaggcaugaaagaguauaauuuuaugaa

SEQ ID NO: 43218 - RNA, 61 nt, Human
guucaggaggugucaauagguugaacuugugagaaggcacugaaucugccauccacaucac

SEQ ID NO: 43219 - RNA, 61 nt, Human
gagguggaugccaggaaagggcccauguggcagaaggcaaaguacaggccaagaauugggg

SEQ ID NO: 43220 - RNA, 61 nt, Human
aaaauaauuucucuuguauuaucuccuuugaagaaggcaaggcugauaauaugacaaacau

SEQ ID NO: 43221 - RNA, 61 nt, Human
uuucauuuacaucaaaguuaucucacaaaagagaaggcaggaaacguuuugugagugccua

SEQ ID NO: 43222 - RNA, 61 nt, Human
cuuaucacucagcuuuaguuuuucuaauccaagaaggcagggcaguuaaccuuuuuggugc

SEQ ID NO: 43223 - RNA, 61 nt, Human
uaauugguuagccccagacuugggcuagagcagaaggcauaggccagggugguuauugcua

SEQ ID NO: 43224 - RNA, 61 nt, Human
ggcaaugucucaaguacuuugaccuuaggguagaaggcaaagcugccaguaaaugucucag

SEQ ID NO: 43225 - RNA, 61 nt, Human
ucucccaggggcuggcuucaggagggagcauagaaggcaggugagcaaccaguuggcuagg

SEQ ID NO: 43226 - RNA, 61 nt, Human
agacccuguccaaaaaaaaaaaaaaaaaaaaagaaggcaauggcuuugugcuuuugaagau

SEQ ID NO: 43227 - RNA, 61 nt, Human
aucuguugaaugaauccuagacacuucugugagaaggcagggauugcacaguuauguacau

SEQ ID NO: 43228 - RNA, 61 nt, Human
aaagacacugcauacguuuguauuauuaguuagaaggcaugaagacuuuuuucccugcaug

SEQ ID NO: 43229 - RNA, 61 nt, Human
aguuccacacagguuuguaaguaaguaagaaagaaggcaaauugauucaaauguuacaaaa

SEQ ID NO: 43230 - RNA, 61 nt, Human
ggaaaaacaucuagcuuaugugaagauucagagaaggcauccuguagucuagguggugaua

SEQ ID NO: 43231 - RNA, 54 nt, Human
ccauucguaugcagccuugaagggagaaggcagagaaaacacacgcuccucugc

SEQ ID NO: 43232 - RNA, 61 nt, Human
uucacauguuugucuuagguuuaccuuucacagaaggcaggguaacuugcugcaggaaacg

SEQ ID NO: 43233 - RNA, 61 nt, Human
agaaacaucagaagagaaaacgacaccuagaagaaggcaaagaaaggccagagaaagagca

SEQ ID NO: 43234 - RNA, 61 nt, Human
uuugaugagagaagucaguguucucaguaguagaaggcacagugaauggaagggaacacau

SEQ ID NO: 43235 - RNA, 61 nt, Human; identical to SEQ ID NO: 43224

SEQ ID NO: 43236 - RNA, 61 nt, Human
aucagauuuggccagaguucgccuacagauaagaaggcacugggccaggcucacaccugua

SEQ ID NO: 43237 - RNA, 61 nt, Human
uuugaaggcaaaauugcaaaucuugaaauuaagaaggcaaaaauguaaaggagucaaaacu

SEQ ID NO: 43238 - RNA, 64 nt, Human
cuaugaccaaagcuucuauuuugccaaaaaguuaaauaccgauaaaauggccuuaaguguauuc

SEQ ID NO: 43239 - RNA, 64 nt, Human
aaaacaacgcugcauauacagguaccauuuaggaaauaccgaugccuuugugggggcagaauca

SEQ ID NO: 43240 - RNA, 64 nt, Human
acugaaugccauaaucucgaucaaaccgauccagaauaccgaagguauggacaggacagaaaag

SEQ ID NO: 43241 - RNA, 64 nt, Human
augcaagcaguuuauaugggagaugauuccaggaaauaccgauaugagaauggggaaaugaaac

SEQ ID NO: 43242 - RNA, 64 nt, Human
ugccuuuucuacgagcauuuggaaggagugaucaaauaccgaaauugaacuuucuaaaaccuac

SEQ ID NO: 43243 - RNA, 64 nt, Human
uaauagugucuucuauggcauguaauggauaccuaauaccgaugaguuaaaucuugcaaguuaa

SEQ ID NO: 43244 - RNA, 64 nt, Human
uagggauuucaccccuggcuuuuaaaaaaaacgaaauaccgacaagccacaaggaccaauguag

SEQ ID NO: 43245 - RNA, 64 nt, Human
uauugaugcagaucagagaguucuuagaauacagaauaccgaugacaaugauaaguaugacaug

SEQ ID NO: 43246 - RNA, 64 nt, Human
ugaaugugauuuucauuccuugauucacccaacaaauaccgacuggcugagcaccugcugugug

SEQ ID NO: 43247 - RNA, 64 nt, Human
aaaaucaaaucauuugcauucccacagcauccugaauaccgacuaccucuucacuugcuaaagc

SEQ ID NO: 43248 - RNA, 64 nt, Human
acugccuaccgagcucccucaugccugcaauuuaaauaccgagguguguucugagagccccagg

SEQ ID NO: 43249 - RNA, 64 nt, Human
aaacugcugccaaaaagauaccaauaacacuaacaauaccgaucuugaaaaaucaucagcagug

SEQ ID NO: 43250 - RNA, 64 nt, Human
uagaugauggugugggggguuggaguuuucuucuaauaccgaggguuccuggcugugaggaaac

SEQ ID NO: 43251 - RNA, 64 nt, Human
uugguuuuaaaccuuuaaugagaaaaaaauauauaauaccgagcucaaaaacacuguguuuggu

SEQ ID NO: 43252 - RNA, 64 nt, Human
ucuccgcugggcucccagagcugcuggcguuucgaauaccgaaaagucaacccuguggaccacg

SEQ ID NO: 43253 - RNA, 64 nt, Human
ccaggucuagcccaacagucuaaacuauccagucaauaccgagugaaguggcagccagcacugu

SEQ ID NO: 43254 - RNA, 64 nt, Human
gugcguuccuuaaagacagacauugaggagagcaaauaccgacagcgccaccugaagguggagu

SEQ ID NO: 43255 - RNA, 64 nt, Human
auucugucauaggcauagagaguugcacauaaaaaauaccgaagaaaacccaaaauucaaucaa

SEQ ID NO: 43256 - RNA, 64 nt, Human
cugucaggugugacugucaguuugcuggucuuccaauaccgaagaaagggugguugugacaaua

SEQ ID NO: 43257 - RNA, 64 nt, Human
agcagggagggauugggggugggggaggccucaaaauaccgacugcguccauucucugccucca

SEQ ID NO: 43258 - RNA, 64 nt, Human
uaagaggaagaagaagaaaggggcacacacacacaauaccgacgucuauccuuuccugcuaggc

SEQ ID NO: 43259 - RNA, 64 nt, Human
gggcucucuccugggaugggggcagguguuccugaauaccgacaggccugcuggguaaaugacu

SEQ ID NO: 43260 - RNA, 64 nt, Human
cugggcuggagagcagguucgggcagccgucgggaauaccgaccauccucuucucccuucuaac

SEQ ID NO: 43261 - RNA, 64 nt, Human
uucccugucgcuugcccucauucucaccaugugaaauaccgacacccgcuuugccuuccaccau

SEQ ID NO: 43262 - RNA, 64 nt, Human
caaauucgcacagagguuuugcuuuaugcuguagaauaccgacuuucaugaugacaacuugguu

SEQ ID NO: 43263 - RNA, 64 nt, Human
acacucuggggaguaucuauucucaggugagcaaaauaccgaauacugaauggaaaucaacugu

SEQ ID NO: 43264 - RNA, 64 nt, Human
cuacaugaggauaagcauuucuggcaaagaggaaaauaccgacuggucuuaugagaagcagugg

SEQ ID NO: 43265 - RNA, 64 nt, Human
aaucuguaccaaccaacggcuggaaaugcaaaugaauaccgaauuggaaaaacagauuucuaau

SEQ ID NO: 43266 - RNA, 64 nt, Human
ggguugggggcgggguaauuauuuuauuuaaaaaaauaccgagcagcaaaaggggagaagaucc

SEQ ID NO: 43267 - RNA, 64 nt, Human
gcuuaaaccaaaucgcauggauuucuuuuucagugacguucaaguguuucucacggauggaauu

SEQ ID NO: 43268 - RNA, 64 nt, Human
auucauaaugaauuuacucuguugauauuaaaaagacguucaguccuauuacugaugaguuuac

SEQ ID NO: 43269 - RNA, 64 nt, Human
ugacccagaggcgagacgcagcuuuguccugggagacguucauauuggaaucuauuuaacugcu

SEQ ID NO: 43270 - RNA, 64 nt, Human
uuugggaggccgagccggguggaucaugaggucagacguucaacaccagccuggccaagauggu

SEQ ID NO: 43271 - RNA, 64 nt, Human
ccugaggucaagccuuuugucuuuauguguaaccgacguucagucuauucuaggaaugaaccag

SEQ ID NO: 43272 - RNA, 64 nt, Human
gucucacucacccuccacagcacucagucccaucgacguucacugaacauuggcuuucucuuuc

SEQ ID NO: 43273 - RNA, 64 nt, Human
uucagccugaccaugaagacggcggaggccaggagacguucaacgccaccggaguccuccugag

SEQ ID NO: 43274 - RNA, 64 nt, Human
ccugcugcgggucucaccauggguuuagaacaaagacguucaagaaauggccccauccucaaag

SEQ ID NO: 43275 - RNA, 64 nt, Human
aagcaauaaggaaauguauauucccacauaacuagacguucaaacaggccaggcuccagcacuu

SEQ ID NO: 43276 - RNA, 64 nt, Human
cagcauccaccaaugaacugaaaggugaauaaaggacguucaugagaaaucgacuaccagcuga

SEQ ID NO: 43277 - RNA, 64 nt, Human
uaguugucuaagaguuaaauauuacugaauuucagacguucaaauugaucaucacaaauccuuu

SEQ ID NO: 43278 - RNA, 64 nt, Human
cccauaaaauguaagaaaagcugaugaggcuggugacguucagccuuugucaauaaaccuguca

SEQ ID NO: 43279 - RNA, 64 nt, Human
gaagacugcgcuguauuuuggcguuucuaauaaugacguucauugcacagaaguccuucuggcu

SEQ ID NO: 43280 - RNA, 64 nt, Human
guucauauaugggcuugcuacuuccuguaaugaggacguucaacauggugaggggcuacaagaa

SEQ ID NO: 43281 - RNA, 64 nt, Human
ugccuguauuucuguauguccuucuauccaaacagacguucacugccacuuguaaagugaagga

SEQ ID NO: 43282 - RNA, 64 nt, Human
ucauaguucccaucauaaaauaaugacccaaggagacguucaaaauauuaaagucuauuuucua

SEQ ID NO: 43283 - RNA, 64 nt, Human
cugagagccuuuccccgcuucucuccaagaaggagacguucagcuagauuuguucccauuuccg

SEQ ID NO: 43284 - RNA, 64 nt, Human
auugcagaagaaaguuuacacgacgucaaaaagugacguucaugcuaaguguuuuuccagaaau

SEQ ID NO: 43285 - RNA, 64 nt, Human
uuacugagcucgccguggcagaugccaugcucaggacguucauguggaugguuucaugucaucg

SEQ ID NO: 43286 - RNA, 64 nt, Human
ugccuaaauuuuaaaaucuuccuacacacaucuagacguucaaguuugcaaaucaguuuuuagc

SEQ ID NO: 43287 - RNA, 64 nt, Human
uugaaccaagggauccucccuccccuucaaggcagacguucaguacaaacauuuaugcgguagg

SEQ ID NO: 43288 - RNA, 64 nt, Human
uguaguaggaacaagggagugagccuuauaagaggacguucagucucauuuauuaaaauaauaa

SEQ ID NO: 43289 - RNA, 64 nt, Human
gcgagcucuaucgcaucggccagcagcuggggaugacguucaucagugugggacaucggcagag

SEQ ID NO: 43290 - RNA, 64 nt, Human
uagagaccuaccguuuacacgcuagagccgagaggacguucaaguuucuuaaagaugcuguugg

SEQ ID NO: 43291 - RNA, 64 nt, Human
uugacuaccguuguuugcaaacccgaaaauaaaagacguucauuauguaugaaaaguaacugau

SEQ ID NO: 43292 - RNA, 64 nt, Human
cucauuaugcaagucgccuacucucugcuaccuggacguucauucuuauguauuaggagggagg

SEQ ID NO: 43293 - RNA, 64 nt, Human
agggcugccuguuuauugacaaaauggacagcaggacguucacaaacgucuauuggaugaaggu

SEQ ID NO: 43294 - RNA, 64 nt, Human
aaugguuagauuaauuugugaggcagcucuuuaagacguucagagguaagaaauacuggauuua

SEQ ID NO: 43295 - RNA, 64 nt, Human
gaggaccaacuuucaaaugagcuaacuugggugagacguucacuaaaguaccaagcacaauaca

SEQ ID NO: 43296 - RNA, 64 nt, Human
cagcuggagcuugcucccccuuguucggaagcuggacguucacuuggugacuggugccucugca

SEQ ID NO: 43297 - RNA, 64 nt, Human
cuguucugggugcagcugagaaaaugagugacuagacguucauuugugugcucauguaugugcg

SEQ ID NO: 43298 - RNA, 63 nt, Human
ccuuggagucucgagguugaaaccacagaucuggacguucacgugcacucucuuccuguacag

SEQ ID NO: 43299 - RNA, 64 nt, Human
aaaauaaugaagccuucuuccucccaggaaaggggacguucagcugagccgaguguguauacug

SEQ ID NO: 43300 - RNA, 64 nt, Human
aggagaggaagugaggagaaggaaggggaggacagacguucacacugccacguaugucuacgug

SEQ ID NO: 43301 - RNA, 64 nt, Human
ugggccugggaagauuccggggcaggggugagcggacguucacaugagugggucuauagcccgc

SEQ ID NO: 43302 - RNA, 64 nt, Human
aguggggagcauggaacuccugggcucuuguggggacguucaggguaucggggugcgaggucug

SEQ ID NO: 43303 - RNA, 64 nt, Human
gagcauacacgcguggcaaacaagcacacgaaaagacguucagccgccgauggcuugguuauaa

SEQ ID NO: 43304 - RNA, 64 nt, Human
gugcauuuguuauuuauuuuuuuuuccuuggucggacguucauaaauauguacuauuuuaauua

SEQ ID NO: 43305 - RNA, 64 nt, Human
ggcaaacgucgcucccuucauuuugggacugaggcugcagcauuggaacaaaagagcauuauuu

SEQ ID NO: 43306 - RNA, 64 nt, Human
aaucugggugucuucgggggcccgucuggaagggcugcagcaauuccccugugucuccagguaa

SEQ ID NO: 43307 - RNA, 64 nt, Human
ugugauaagccucucuucggcaucugaggagcagcugcagcaaaaucuagggguguaaguguau

SEQ ID NO: 43308 - RNA, 64 nt, Human
gccuuccuuccuggccuuagccaccuggcucugucugcagcaggggcaggcugcuuucuuaucc

SEQ ID NO: 43309 - RNA, 64 nt, Human
aggucgugggaaauaaaaggcaguucuacacagacugcagcaacgguugcaucugcauauccua

SEQ ID NO: 43310 - RNA, 64 nt, Human
cuggccaaugccuuuugccagcugcagugagauucugcagcauaggccacgauaaaggaaggag

SEQ ID NO: 43311 - RNA, 64 nt, Human
ccuaaauagguagcuuaaacuuaugucaaaaugucugcagcaguuugucaauaaaguuuagucc

SEQ ID NO: 43312 - RNA, 64 nt, Human
cagaauggagaucuccucucaucagucucaccuccugcagcaacugaacgagcagcgcaggcaa

SEQ ID NO: 43313 - RNA, 64 nt, Human
uguuccacaggacgauggaccgccggacucuuuucugcagcacacgccugugugcugugagccc

SEQ ID NO: 43314 - RNA, 64 nt, Human
cagcagccaggaccagggucguugacagcagguucugcagcauccugccuugcugcucuguccc

SEQ ID NO: 43315 - RNA, 64 nt, Human
caugacucagccugggggcuggugccggccuugccugcagcaauguagcugaggacuggucuga

SEQ ID NO: 43316 - RNA, 64 nt, Human
gaaacaagcaaaacaaaacuuuccagccauuuuacugcagcagucugugaacuaaauuuguaaa

SEQ ID NO: 43317 - RNA, 64 nt, Human
cugaaggacaaaaacaagcaaacaaaaaccccugcugcagcauuucaggugcaguaugauauuu

SEQ ID NO: 43318 - RNA, 64 nt, Human
gcuucagugacaaagacuuaaaucucucuccuaucugcagcacuggguuggagagagggcacgg

SEQ ID NO: 43319 - RNA, 64 nt, Human
caugacagcauugacugguuuacaggcccugcuccugcagcauggccccugccuuaggccuacc

SEQ ID NO: 43320 - RNA, 64 nt, Human
aggagcagcauugacugguuuacaggcccugcuccugcagcauggucccugccuuaggccuacc

SEQ ID NO: 43321 - RNA, 64 nt, Human; identical to SEQ ID NO: 43320

SEQ ID NO: 43322 - RNA, 64 nt, Human
ccuuuugaaagugucccaguaacaacgcacccagcugcagcaaggagguggggaaggagggcac

SEQ ID NO: 43323 - RNA, 64 nt, Human
gagccagaggaugucagcugccaauuguguuuuccugcagcaauuccauaaacacauccuggug

SEQ ID NO: 43324 - RNA, 64 nt, Human
uacgccucagccagcaccacugccaccagggcaacugcagcagcaucucaugcauaacccugug

SEQ ID NO: 43325 - RNA, 64 nt, Human
gguccucuuccauugcaguccugaugauccuaaccugcagcacggugguuuuacaauguuccag

SEQ ID NO: 43326 - RNA, 64 nt, Human
ccagagaugagaaaacugggucagcccucagaaacugcagcagccacgcacacagaagccugcu

SEQ ID NO: 43327 - RNA, 64 nt, Human
cuuucuggggagggguucagaaaacaucaaaacacugcagcaguuccuaaaugauucucacaag

SEQ ID NO: 43328 - RNA, 64 nt, Human
ugacuguaggcgccccugggguggguuuagcaggcugcagcaggcagaggagaguaccccccug

SEQ ID NO: 43329 - RNA, 64 nt, Human
ugcuuugugggaaaucacuaaugagaaggcuaaccugcagcaccagagaaaccuuuccaagugc

SEQ ID NO: 43330 - RNA, 64 nt, Human
uucugugggauuuucaaaaugcuaaagacucacacugcagcaaucaucccagaugauuaaauuc

SEQ ID NO: 43331 - RNA, 64 nt, Human
ccucugggaugccagcucuccccuuugugcuucccugcagcaacccauggagggcccagggugc

SEQ ID NO: 43332 - RNA, 64 nt, Human
agaaaacagcuacaaggaaugcuuaccugagugucugcagcacccuccacuucucuccuaggca

SEQ ID NO: 43333 - RNA, 64 nt, Human
gaagcaauuuacuaauuuauucuucgacuacauacugcagcagaaccagcaauacacuugauuu

SEQ ID NO: 43334 - RNA, 64 nt, Human
uguauuuacuugcauuuguuguauuuacuuucaucugcagcauuuggaguuuaaaaauaaugua

SEQ ID NO: 43335 - RNA, 64 nt, Human
gauaaaaguuggaugacguauggaagauucgaaccugcagcacugaugucucuuuaccgauggg

SEQ ID NO: 43336 - RNA, 64 nt, Human
uggcacuugucauggguuuggaagacccagccaucugcagcagaggcagccuaucccauugcaa

SEQ ID NO: 43337 - RNA, 64 nt, Human
gcucaaugcuugguguucuaguucaacuuuuauccugcagcaaguaagccuagauaacucuaca

SEQ ID NO: 43338 - RNA, 64 nt, Human
aagaccaaguauggggaaaaccaggcaccagccucugcagcaaugggucccucuagccugugga

SEQ ID NO: 43339 - RNA, 64 nt, Human
acauuguaggaaaucuucauaauuggagaaaguucugcagcauggcuuuuuacgucuguaaaua

SEQ ID NO: 43340 - RNA, 64 nt, Human
ucaggaggccugugagcgggagcucgcccugcgccugcagcagacgcagagcuugcauucucuc

SEQ ID NO: 43341 - RNA, 64 nt, Human
aucacugugcagugggaccacccucacuggccuucugcagcaggguucugggauguuuucagug

SEQ ID NO: 43342 - RNA, 64 nt, Human
guccccaggcccacgggcacagggagagggacaacugcagcaguggggaggaggcacagcuagc

SEQ ID NO: 43343 - RNA, 64 nt, Human
uuccguugucagcuucucccccuucagccuguuucugcagcagccaggguucuccccccuacac

SEQ ID NO: 43344 - RNA, 64 nt, Human
auuagacaaaucccacuggccuacagucuugcuucugcagcacccacuuugucuccucagguag

SEQ ID NO: 43345 - RNA, 64 nt, Human
cgcuccggcagcucuuccugccacugaaugcguucugcagcauguagcaugcccaccuagcucc

SEQ ID NO: 43346 - RNA, 64 nt, Human
uuccucauucaggaaaucaaaucagucuuccggucugcagcacggaaaagcacauaaucuuucu

SEQ ID NO: 43347 - RNA, 64 nt, Human
aggaaagcaaucacuucucacuuugcauaauugccugcagcaggaacaucucuucacugggcuc

SEQ ID NO: 43348 - RNA, 64 nt, Human
cacuuugucuuggugggaguggguccgcgcugcucugcagcaggggcuggggaguggacagcau

SEQ ID NO: 43349 - RNA, 64 nt, Human
aagcucaggaaacuagggugucacuuuuuuugcacugcagcauauacacuaacuagcuuauuaa

SEQ ID NO: 43350 - RNA, 64 nt, Human
cauccaaauggacuggccagcguaaaugaccccacugcagcagaaaacaaacacacgaggagca

SEQ ID NO: 43351 - RNA, 64 nt, Human
aguaaauacuacuuuagccauccaaggccaccuucugcagcaaaaggcuuuuguggagaaccuu

SEQ ID NO: 43352 - RNA, 64 nt, Human
cuaucuacaaccuaauccuacucuuugguagucucugcagcagccacagccuuagcagagcugg

SEQ ID NO: 43353 - RNA, 53 nt, Human
acuuugauguuuauuccuaguugcugcagcaauucucaccuuucuugcacauc

SEQ ID NO: 43354 - RNA, 64 nt, Human
acauuauauccauuccaguccucugcacuguacacugcagcagugugcaaacuaugggacuuag

SEQ ID NO: 43355 - RNA, 64 nt, Human
guaucccucaugcaguuggcauccaggcagcccucugcagcagcacacccugcaggcggaguuu

SEQ ID NO: 43356 - RNA, 64 nt, Human
ccuaacacggucggccgggugcuuugugucagugcugcagcacuggggagccaggcgagggggg

SEQ ID NO: 43357 - RNA, 64 nt, Human
ggagggaggcgggaggccgucacuggaguggcgucugcagcagcugcugccccagcacccgcuc

SEQ ID NO: 43358 - RNA, 64 nt, Human
accgcaccgcaccagagccagagcagcugcuugucugcagcaggacacaguuccuacauacguu

SEQ ID NO: 43359 - RNA, 64 nt, Human
auccuaaguuccuagcauaaacacuauuuauuuucugcagcaguguguuauuuuugcgcacuua

SEQ ID NO: 43360 - RNA, 64 nt, Human
uugaauucaacuggacacucuguaaaaugcugcacugcagcaaaaacaaaaccaccaccacccc

SEQ ID NO: 43361 - RNA, 64 nt, Human
ugggcaacugccuggugaaugugucuugcggcagcugcagcaaguggaggggcugaacuacugg

SEQ ID NO: 43362 - RNA, 64 nt, Human
auuccugauucccaugagaaaucagaacugcuuucugcagcaaaucagggcuucccccuaacau

SEQ ID NO: 43363 - RNA, 64 nt, Human
ccucuguuguuaguaaaauuaugaaauugaaguucugcagcaugucaggccaggauuauuaggg

SEQ ID NO: 43364 - RNA, 64 nt, Human
uguagagggaguaaaaaagugcauggauaaaugacugcagcaaaucacaaauuuugaacuuuga

SEQ ID NO: 43365 - RNA, 64 nt, Human
agagggccaccguguccauuacagcagaguccagcugcagcauccagcucacgcccucauggga

SEQ ID NO: 43366 - RNA, 64 nt, Human
auauauauauacacacacgcacacauauauguugcugcagcauaaagaaauugaaauaaaaguu

SEQ ID NO: 43367 - RNA, 64 nt, Human
gcaccugcgggggugggcauagaccgggcugggucugcagcagccccugguccugagcaggcgg

SEQ ID NO: 43368 - RNA, 64 nt, Human
aagucucucaaauuaggccagauucuaaaacaugcugcagcaagaggaccccgcucucuucagg

SEQ ID NO: 43369 - RNA, 64 nt, Human
uuaaugucugccgggggcccaggcugugcugucccugcagcacgccuccuugcagggaucugag

SEQ ID NO: 43370 - RNA, 64 nt, Human
auagucacucugggucaucagcaugucccagucacugcagcaacgccuuguguuuguuucauuu

SEQ ID NO: 43371 - RNA, 64 nt, Human
agaagauaaaaacuagucgaguauucauccgagacugcagcauggugucuguguacccgcuggu

SEQ ID NO: 43372 - RNA, 64 nt, Human
gguucucuccccugccgcugagagggccucuccccugcagcaaacguuugccugggcauugagg

SEQ ID NO: 43373 - RNA, 64 nt, Human
uuaguaaugcaaaauaacucauuuccaacuacugcugcagcauuuugguaaaaaccuguagcga

SEQ ID NO: 43374 - RNA, 64 nt, Human
ccggguagacucuccacucccccugccgcccacacugcagcagccacauccauacacacacgcu

SEQ ID NO: 43375 - RNA, 64 nt, Human
cucucugccagccgcuggugcccaccagcuggcucugcagcacauugcccugaggggccugcca

SEQ ID NO: 43376 - RNA, 64 nt, Human
cuuuguugaaggguucauagcagcccugccaucccugcagcagaaugagagagggugaacaggg

SEQ ID NO: 43377 - RNA, 64 nt, Human
gacauucaaacuucaugcuccugaaaaccauucucugcagcagaauuggcugguuucgcgccug

SEQ ID NO: 43378 - RNA, 64 nt, Human
cuucugcuguucuccuguucuucauaauccacuacugcagcagucccugaaccacuaaacuugu

SEQ ID NO: 43379 - RNA, 64 nt, Human
gagcuauacaguuuuccuaaauguauaccuguaacugcagcaguucaccuauuucaaaaauuug

SEQ ID NO: 43380 - RNA, 64 nt, Human
aaagggucuacuugagagauagugguguuuacugcugcagcauguaucacaagauaagaaauga

SEQ ID NO: 43381 - RNA, 55 nt, Human
caucuagugcugaagucugagggcucugcagcaucagacccaccucuaagagaac

SEQ ID NO: 43382 - RNA, 64 nt, Human
gucccucuuugccuuggcccucaccccacgcugccugcagcaucuuugccgcugugcucuucgc

SEQ ID NO: 43383 - RNA, 64 nt, Human
ugggcgaguagaccgccuggcucagcccacaggccugcagcaucccauagcaccccgcccuugc

SEQ ID NO: 43384 - RNA, 64 nt, Human
acugcccucccaacugccagacuuccugggggcccugcagcagccucgcgccccgcguuccggg

SEQ ID NO: 43385 - RNA, 64 nt, Human
gcaaaucaaaguggagaguucucucaggucaggucugcagcagagcucgagacagggaucugaa

SEQ ID NO: 43386 - RNA, 64 nt, Human
auuuugucugguccugaucccagacucaccccaucugcagcaagacccuuggcuggcuuccucc

SEQ ID NO: 43387 - RNA, 64 nt, Human
ucaauuccuggagaugccaacuucacagacacgucugcagcagcuggacaucacauuucauguc

SEQ ID NO: 43388 - RNA, 64 nt, Human
gcacuccccuccaggugaggggggugcugggggucugcagcagaaagaaaggggccugggcagc

SEQ ID NO: 43389 - RNA, 64 nt, Human
ggagcaggcucuggcucuguaaggagaggugcagcugcagcaguguucuaccggaaguguuuug

SEQ ID NO: 43390 - RNA, 64 nt, Human
cccuuccuuaggccucagcuuucccaucugcacccugcagcaucucuaagggccccuccagcau

SEQ ID NO: 43391 - RNA, 64 nt, Human
gcaaaccagaacucuugguggaacagaccagccacugcagcagacagaccaggaacacaaugag

SEQ ID NO: 43392 - RNA, 64 nt, Human
gaggacagucugucugaaccugccagugcugacccugcagcacuuucagcauaugcacaucaaa

SEQ ID NO: 43393 - RNA, 64 nt, Human
acccaccuggcgugcugcugccgccacuugcuuccugcagcaccuccuacccugcuccgugucc

SEQ ID NO: 43394 - RNA, 64 nt, Human
acgccucagccucucccagucucucccugcaguccugcagcagcagcccccacccccaagcuug

SEQ ID NO: 43395 - RNA, 64 nt, Human
auguaaaggcauauuguacucgaaaucugaagaccugcagcagauuuaaauuacaacucuuguu

SEQ ID NO: 43396 - RNA, 64 nt, Human
cucuucccaauccuuaugcuucccuaagugguaucugcagcaguuuguugugugcaguuugaug

SEQ ID NO: 43397 - RNA, 64 nt, Human
aauuuugugaaagaaggagcaagagaacauuccucugcagcacuucacuaccaaaugagcauua

SEQ ID NO: 43398 - RNA, 64 nt, Human
guuuagaagcgcucaucuggcuuuucgcuugcuucugcagcaacucccacgacuguuguacaag

SEQ ID NO: 43399 - RNA, 64 nt, Human
agcccaggucccuccgcggcuggagcgaagccuucugcagcaggaacucuggaccccugggccu

SEQ ID NO: 43400 - RNA, 64 nt, Human
acacaauuuaguccucauuauuuauuuguagauccugcagcaucauguuguaauuaauuuuuug

SEQ ID NO: 43401 - RNA, 64 nt, Human
ugagccagucuuugaaaaaauacaacuauggcaucugcagcacaaauauuuaaggacaucagaa

SEQ ID NO: 43402 - RNA, 64 nt, Human
ggaugguugcaagcuguagccaccugcauggccccugcagcacucaccaguugcaucuugugaa

SEQ ID NO: 43403 - RNA, 64 nt, Human
ucuggccagaaauggccuccgaacugugcagcuccugcagcaccauuuguaucauagcauaucu

SEQ ID NO: 43404 - RNA, 64 nt, Human
aauuuccucaaguuuccaugugcgguucuccuagcugcagcaauacuuugacauuuaaagagaa

SEQ ID NO: 43405 - RNA, 64 nt, Human
uuggccacuagcccaucuucaaugaccccuuaaucugcagcagcucacaggcugggggugagga

SEQ ID NO: 43406 - RNA, 64 nt, Human
ugugagcauuguguauauagcagacauggagguccugcagcaggaggugcucaauaaacacaaa

SEQ ID NO: 43407 - RNA, 64 nt, Human
gcagagggucgguggaggggucauucaccugccccugcagcaagcaaaaguugucuguggugcc

SEQ ID NO: 43408 - RNA, 64 nt, Human
cagaagugucaucucucucugagcacgcauuccccugcagcagucgaggacugagcagauugag

SEQ ID NO: 43409 - RNA, 64 nt, Human
caauuccuccagagacacugagccagucuuugaacugcagcaaucacaaaggcugacauucacu

SEQ ID NO: 43410 - RNA, 64 nt, Human
ugggccagggcugcccugagaagcugcuccaggccugcagcaggaguggugcagacagaagucu

SEQ ID NO: 43411 - RNA, 64 nt, Human
uauuagaagggcugaauaaagggaacaugcagcucugcagcaauauucugauaauguauugcag

SEQ ID NO: 43412 - RNA, 64 nt, Human
uccugcacuauaacaagauuauguuuucuuccuucugcagcagcuuucugcuucuuggguacua

SEQ ID NO: 43413 - RNA, 64 nt, Human
ggagcuguauuccuuuauacaaaucugauggcuccugcagcacuuuuuccuucugaaaauauuu

SEQ ID NO: 43414 - RNA, 64 nt, Human
uaaaccugaauguaccuacuagggcaccauaauacugcagcaagaccaaagugguaaagaaaca

SEQ ID NO: 43415 - RNA, 64 nt, Human
cuccuccccguccccgccucggcucgggguuuuacugcagcagccggaggugacagcgacgccu

SEQ ID NO: 43416 - RNA, 64 nt, Human
uuucuccgcaacagccaaguggaacgaaucgauucugcagcaccggccucgggaagccccaucc

SEQ ID NO: 43417 - RNA, 64 nt, Human
ugaagagggaauguuugacagucacagaagguuccugcagcagaugccucuuuuagccauuucu

SEQ ID NO: 43418 - RNA, 64 nt, Human
uccccgcugcugugcaacggucuccugacuggugcugcagcaccgaggggccuuuguucugggg

SEQ ID NO: 43419 - RNA, 64 nt, Human
aaaggcagucccuuuaguugggggcuguccagagcugcagcagggcuuugcacggaaggggugg

SEQ ID NO: 43420 - RNA, 64 nt, Human
cagcaccccauccaacuggcccgaaagcccagaccugcagcagaacucuccaacucucuaucag

SEQ ID NO: 43421 - RNA, 64 nt, Human
acccucccuacuccugcaccccaaauaugaacaacugcagcaggugccaccaccaccacaaaag

SEQ ID NO: 43422 - RNA, 64 nt, Human
aguguaccuuuuugcuaaaacacuuauuacccuucugcagcaaaggcauuaaaagcgcuaagca

SEQ ID NO: 43423 - RNA, 64 nt, Human
augcccuuuuaaauauaaggaucagugcuuuguucugcagcagaguuugcugauaaaugucugu

SEQ ID NO: 43424 - RNA, 64 nt, Human
uuuuuuaauuacuguaaagaaaaugaauuuuuuccugcagcaggaaacauaguuuugaguaguu

SEQ ID NO: 43425 - RNA, 64 nt, Human
ggagcaagguggaauguuucccugacgcugugaucugcagcaggcuucaaaugaaaaccgacua

SEQ ID NO: 43426 - RNA, 64 nt, Human
agaacacggcucuagauaaggaggggcagauuuucugcagcaagcacugucaagacagcggcag

SEQ ID NO: 43427 - RNA, 64 nt, Human
gcagacccccgccauccucgcagagugggagaggcugcagcaaggcuuugccucugcagacccc

SEQ ID NO: 43428 - RNA, 64 nt, Human
cuccagacuuacuuacuccuucagugacuccgagcugcagcacuccaaggcugucagggcuucu

SEQ ID NO: 43429 - RNA, 64 nt, Human
auuuuucuuggaugcgauguucagaggcuguuuccugcagcauguauuuccauggcccacacag

SEQ ID NO: 43430 - RNA, 64 nt, Human
gcagacuuuguccuuuugccaggccuaaccaugacugcagcacaaaauuaucgacucuggcgag

SEQ ID NO: 43431 - RNA, 64 nt, Human
aaaauaaaacagaggauacuacaggcugggaaagcugcagcaaagggagacuagagagagauuu

SEQ ID NO: 43432 - RNA, 64 nt, Human
uguauauuaaagagacauuugaacccuauguuuacugcagcacuauucacaauagccaagauau

SEQ ID NO: 43433 - RNA, 64 nt, Human
uguuuggacuaaacaaacaauaaacuacugaugucugcagcauuuaucuaugucccuaauuuaa

SEQ ID NO: 43434 - RNA, 64 nt, Human
aaugcccacaagcuacaaaugcuaaagacaguggcugcagcaguccaggugcacacuaagaaca

SEQ ID NO: 43435 - RNA, 64 nt, Human
auccagaugagaccaaugcacuucacaggcaagacugcagcaggagccagaaggaaaacagaua

SEQ ID NO: 43436 - RNA, 64 nt, Human
gccaauggcaucauccaauuuucuucccaaaccucugcagcaucugcuuuauugccaaagggcu

SEQ ID NO: 43437 - RNA, 64 nt, Human
ccugcuucauccacaucaggaggguccggugaggcugcagcagugguuaaggaguaacaccuuc

SEQ ID NO: 43438 - RNA, 64 nt, Human
ggugucaaacuccacuugacauuuacuguauaaucugcagcaugcuauagaaaguggggaggaa

SEQ ID NO: 43439 - RNA, 64 nt, Human
uugugagaaauuccacccacguggagacagcuuacugcagcacuguugguguucggagcucuuc

SEQ ID NO: 43440 - RNA, 64 nt, Human
augcacuaagccuuaauccuggacaccaguaccccugcagcauggcuugcucaacaacagucuu

SEQ ID NO: 43441 - RNA, 64 nt, Human
acucaggaugaacucucugagcagggaccugcuccugcagcaaccaaacuuggagugguuauug

SEQ ID NO: 43442 - RNA, 64 nt, Human
aaacaaucaaguugacucacguggguccugaggccugcagcacgucggaugcuaccccacuaug

SEQ ID NO: 43443 - RNA, 64 nt, Human
acuguccagaccgcagcugcaaaugcagcuucaacugcagcaucuagugcagcucagaaugcuu

SEQ ID NO: 43444 - RNA, 64 nt, Human
uggcaggugccuguagucccagcuacucggcaggcugcagcaggaaaauggcauaaacccggga

SEQ ID NO: 43445 - RNA, 64 nt, Human
ugcuuuuccuugcuuuguuaaccaucacgagagucugcagcacaacuuuuaacaaagcuagaac

SEQ ID NO: 43446 - RNA, 64 nt, Human
acuguguagaauuucuaugguguccuaaagggggcugcagcaggggugugacaacggugggauu

SEQ ID NO: 43447 - RNA, 64 nt, Human
cuccuuugaagcuaauggcauuuguauauacacacugcagcagagcuuguagcuggacagaguc

SEQ ID NO: 43448 - RNA, 64 nt, Human
guuuggggcagcuuuuaguaucgaugccacucaucugcagcagaagagaaagaaguccucuugg

SEQ ID NO: 43449 - RNA, 64 nt, Human
gcccccuccacaguuccugaauggugcuaaggaucugcagcaguuggcaacgagcuggggcugg

SEQ ID NO: 43450 - RNA, 64 nt, Human
ccuuuagggagcugagguucuucugcccugagcccugcagcagcggcagucacagcuuccagau

SEQ ID NO: 43451 - RNA, 64 nt, Human
ugucuggugacagccgugcggacaccacuccucucugcagcacugccucccagcgccagggucg

SEQ ID NO: 43452 - RNA, 64 nt, Human
ucuguaaccaccucauaggucucccuggugccaccugcagcauuucuagauaccgacaauaagg

SEQ ID NO: 43453 - RNA, 64 nt, Human
ggaaggauacauagugauucguauacaauuuugucugcagcauucuugaauauuuuuaacacug

SEQ ID NO: 43454 - RNA, 64 nt, Human
gggguuucaaugugcccuuaaaauugugcuggggcugcagcaaauaaauaauauugggacucau

SEQ ID NO: 43455 - RNA, 64 nt, Human
ggaucugggcaaaugaaaauguuucaggaaguuucugcagcagaugcuuuugguccagguacug

SEQ ID NO: 43456 - RNA, 64 nt, Human
uaccaaacagcuuaaauucuucaagaaagaauuccugcagcaguuauucccuuaccugaaggcu

SEQ ID NO: 43457 - RNA, 64 nt, Human
cucacgcaccggaguucugcccaugggaaguaaacugcagcaggccacuggggacagaagggcc

SEQ ID NO: 43458 - RNA, 64 nt, Human
aauaaugaagacgaauuugacuuuaugcaguguucugcagcaugccucccccacaucucauagc

SEQ ID NO: 43459 - RNA, 64 nt, Human
gccaucccuggccccaaggcuaggaucaaaguggcugcagcagaguuagcugucuagcgccuag

SEQ ID NO: 43460 - RNA, 64 nt, Human
uccaaugugaaagauuauuuaaaugcuuuuaaaucugcagcacauugauaagaugguuuccgug

SEQ ID NO: 43461 - RNA, 64 nt, Human
cuuuuaaaauaaucaggagugacagagucaacuucugcagcaccugcuucucccccacuguccc

SEQ ID NO: 43462 - RNA, 64 nt, Human
gccaucucuuucauuucugcuugaagccccuuggcugcagcaauccugucugccauagguuucu

SEQ ID NO: 43463 - RNA, 64 nt, Human
gcagcuccucagcggagccgcagacuguccugcccugcagcaugugccuaaaggcucaagggga

SEQ ID NO: 43464 - RNA, 64 nt, Human
uggaaaccugguucucuucugacaucuaagaagacugcagcaaggucagagguuuuagccuccu

SEQ ID NO: 43465 - RNA, 64 nt, Human
caggugagggggucugcgguggcuccugucuucccugcagcagggaaggagggccguguggugc

SEQ ID NO: 43466 - RNA, 64 nt, Human
gcaggcggaaacaggcucacagauugugugucggcugcagcagugauuccaacaagcagcuauu

SEQ ID NO: 43467 - RNA, 64 nt, Human
cuguacuucauagcuggagaauggggaaagaaaucugcagcaaaggggucucacucuguugcca

SEQ ID NO: 43468 - RNA, 64 nt, Human
ggcauuguggugagccugccuguuguccacguggcugcagcaagcaaacauggguuuuccuugg

SEQ ID NO: 43469 - RNA, 64 nt, Human
gcaugucuuugaggucugcuaauauggaauggaacugcagcaaaugcaaacuugaagucaugca

SEQ ID NO: 43470 - RNA, 64 nt, Human
acucgugaggccaaggcaggagaauugcuugagccugcagcagcugcaguaagccaagaucaug

SEQ ID NO: 43471 - RNA, 64 nt, Human
agcccuaccugaccuugugcgcugggaggcgcaucugcagcacuuacaggugagggauggggag

SEQ ID NO: 43472 - RNA, 64 nt, Human
gucccagggaagguggggcccugccccuaggaugcugcagcagagugagcaagggggcccaaau

SEQ ID NO: 43473 - RNA, 64 nt, Human
cuuggggaccucuggggcaaggagcugagaaguccugcagcaccaggugagacuugcuuacagu

SEQ ID NO: 43474 - RNA, 64 nt, Human
ccacuaaagcuugagguggauguuggcuucacuccugcagcacaaugcuggcccuagaaagcga

SEQ ID NO: 43475 - RNA, 64 nt, Human
ggauucuggagccgagaaggagaacaccucuguccugcagcagaaccccuccuugucggguagc

SEQ ID NO: 43476 - RNA, 64 nt, Human
uggucccagaguagcugaagggaagccaaccccccugcagcacaaauaggccccccagucccag

SEQ ID NO: 43477 - RNA, 64 nt, Human
aagugggaguggaggcaggcccuccacagaagcucugcagcaggggcugggagagcagaagggc

SEQ ID NO: 43478 - RNA, 64 nt, Human
gggccaugccaggccugucagcugcguugacugacugcagcagcuugccucaugguuuucccuu

SEQ ID NO: 43479 - RNA, 64 nt, Human
gguggcagugcccgggucccaggugccguguuuacugcagcagugggaccuccgugcccacucc

SEQ ID NO: 43480 - RNA, 64 nt, Human
aaagcucuuaaggagaauuguauuucuccagaagcugcagcaagagguacagcucaacaaagga

SEQ ID NO: 43481 - RNA, 64 nt, Human
cuaauagugcauuagucuaucucagccuaguguucugcagcacacaugggcaggcaguuuacuc

SEQ ID NO: 43482 - RNA, 64 nt, Human
ucaguuccugacauaguaaaguuugcuuucauaacugcagcaaaaaaggucaacuugccaaguc

SEQ ID NO: 43483 - RNA, 64 nt, Human
cuucugccccaagcacaccccacacuaauuucugcugcagcaucacgaucagggcaaaucagca

SEQ ID NO: 43484 - RNA, 64 nt, Human
acucugguguucuauugcugagaagcaaaccgcccugcagcaucccucagccuguaccgguuug

SEQ ID NO: 43485 - RNA, 64 nt, Human
uccuguccccuggccguccugucaucccugugugcugcagcaucaccacggccuacuucccaau

SEQ ID NO: 43486 - RNA, 64 nt, Human
gcuuauuuugaucacugucucaaauuuaaaaauucugcagcaaccuggcucugugugguguuuu

SEQ ID NO: 43487 - RNA, 64 nt, Human
ggcuguggugccgccuaguggaaaaaggaagucccugcagcaguccccgcacucuuuaagcagc

SEQ ID NO: 43488 - RNA, 64 nt, Human
cucaaaacagagggcucuauacuccuuagugugacugcagcaaacuuugguguaaaauuccacc

SEQ ID NO: 43489 - RNA, 64 nt, Human
aaugcagguguuuucucaguaucacagaccagcucugcagcaggggauuggggagcccaggagg

SEQ ID NO: 43490 - RNA, 64 nt, Human
gaaauaguaggcuccgcuauucagaugcagagcacugcagcauccagccuuucaaagcugacuc

SEQ ID NO: 43491 - RNA, 64 nt, Human
ccuauuucaaaaaaaggcugcuuucacuguacugcugcagcagucucuucagguagcuaaauua

SEQ ID NO: 43492 - RNA, 64 nt, Human
uaauuauaaucaaaauuaguuuuauugaugcuugcugcagcaagagagacugcacaccacuggg

SEQ ID NO: 43493 - RNA, 64 nt, Human
acuccagcgcagcuugaggggcugaggacggaggcugcagcaucugugucguucuacugagcac

SEQ ID NO: 43494 - RNA, 64 nt, Human
gccccucacccugcaucacugaagagcggcgccucugcagcaagcagggcuucaggaggugccc

SEQ ID NO: 43495 - RNA, 64 nt, Human
ccagacugaagugcaguggugcgaucauggaucacugcagcagcauccuccgaguucaagcuau

SEQ ID NO: 43496 - RNA, 64 nt, Human
ccaggcuggagugcaguggugccaucucggcucacugcagcacugucucggcucacugcagccu

SEQ ID NO: 43497 - RNA, 64 nt, Human
cuucaaacaaauguuggucacccacucucuccagcugcagcauguuggugccauuuucagcaau

SEQ ID NO: 43498 - RNA, 64 nt, Human
uuuuaagaagaguuuguauuauuuuuucauacggcugcagcagcagcugccaggggcuugggau

SEQ ID NO: 43499 - RNA, 64 nt, Human
ucuccccagaagcggugggaugggcccccaugaacugcagcagcaugcugagguguccauguug

SEQ ID NO: 43500 - RNA, 64 nt, Human
cagucuuuuguguuugauuuuguuugauuucccucugcagcacagcgucucuguaaagguuuuu

SEQ ID NO: 43501 - RNA, 64 nt, Human
uugcagaaucuaaguugauuguaaugauuuugagcugcagcagcuuuaacucuuacccuuuuuc

SEQ ID NO: 43502 - RNA, 64 nt, Human
ugguggcccagcuuggccagcacacacuuuccuccugcagcacccccugcugaagggguccccc

SEQ ID NO: 43503 - RNA, 64 nt, Human
agcaucuggugauaugcaauuccacacugguaaccugcagcaguuggguccuaaugauggcauu

SEQ ID NO: 43504 - RNA, 64 nt, Human
cagaauuccaccggugcaaggagaugucugaauacugcagcacucugugccgccaccucuaccu

SEQ ID NO: 43505 - RNA, 64 nt, Human
agucaaagggaucaaggagaguuggggauuugagcugcagcagagagggaugagggauuuagcc

SEQ ID NO: 43506 - RNA, 64 nt, Human
ggcagcuugucccccgaccuucaggaauggcagccugcagcaacuggaacaaggccccaccgua

SEQ ID NO: 43507 - RNA, 64 nt, Human
gcaaguuucagcaaagggcagucuugucgaaucgcugcagcagcuuucuuucaucuuuauagca

SEQ ID NO: 43508 - RNA, 64 nt, Human
aauugacucuuaguuucuuugcucagauugagaacugcagcauuuaugccagacauggacagag

SEQ ID NO: 43509 - RNA, 64 nt, Human
ccuugguuacucagagcacuguggggugucacagcugcagcauuuggagucucucucuugcuga

SEQ ID NO: 43510 - RNA, 64 nt, Human; identical to SEQ ID NO: 43496

SEQ ID NO: 43511 - RNA, 64 nt, Human
gaagcgggccuccaacgagagcacccgccagaggcugcagcagcagcugacccaggcccaagag

SEQ ID NO: 43512 - RNA, 64 nt, Human
agauguugggagagagcuggggcagagcggggagcugcagcacagcaacagugauggcgaggac

SEQ ID NO: 43513 - RNA, 64 nt, Human
cuccaagacuuuaccuauguaaguguucaaaacucugcagcauuaaacaacguguaugcaaauu

SEQ ID NO: 43514 - RNA, 64 nt, Human
cuucuauccauugcuuucugugauuagggcggcccugcagcauaucucacagcagacacagugu

SEQ ID NO: 43515 - RNA, 64 nt, Human
cccccugggagcccucgcuggaucgucucgucuccugcagcagcacuggcaggcgagggcucuc

SEQ ID NO: 43516 - RNA, 64 nt, Human
ucgacugcaggguccuggggucccuagagugguccugcagcagccccuggcaaugagcugccug

SEQ ID NO: 43517 - RNA, 64 nt, Human
cacugcaacauuuaugugugaagccaaaaucacccugcagcagagccaauacugaucaacugaa

SEQ ID NO: 43518 - RNA, 64 nt, Human
ccauggaguguagcgggcaucgcugccgccauuccugcagcaucaccauaagcagugcagggug

SEQ ID NO: 43519 - RNA, 64 nt, Human
cuccaggaagcccaccuugagccagagucaagggcugcagcacugcccgauagaacacgcccgc

SEQ ID NO: 43520 - RNA, 64 nt, Human
ucccacugccugacuuccugccacacgguuaaugcugcagcaacaccgacugcuucaucuuccc

SEQ ID NO: 43521 - RNA, 64 nt, Human
cgccccggacaagcgguuaagcgcgacccaggcacugcagcaccccuacgugcagagguggggg

SEQ ID NO: 43522 - RNA, 64 nt, Human
uaaaggaugggggcaauaaucggcccuugaggagcugcagcaguaggcaugugcucagucugca

SEQ ID NO: 43523 - RNA, 64 nt, Human
agagggaggggagagaccacagccgggugugugucugcagcaccgugggcccucaagcuuuccu

SEQ ID NO: 43524 - RNA, 64 nt, Human
aauuuuagcccaauuuucuugagucauucucucucugcagcagcagaggaagggccuguaccuc

SEQ ID NO: 43525 - RNA, 64 nt, Human
agggguugugaguaccagugguguugcuuccacccugcagcaggugggaugaggucugugugug

SEQ ID NO: 43526 - RNA, 64 nt, Human
cgggccucccucuccgccccgcuccugcuccuaccugcagcacccccagcuccgacuccagacu

SEQ ID NO: 43527 - RNA, 64 nt, Human
ugcaucccacagacuauuucccucauccuauuuacugcagcaaaucucuccuuaguugaugaga

SEQ ID NO: 43528 - RNA, 64 nt, Human
cccgcuggccgccagcugcccguccccagagccacugcagcaggagucgggcccugccucccuc

SEQ ID NO: 43529 - RNA, 64 nt, Human
gacagcccagaggggggcuacagagaggagucggcugcagcagagggcaggagccccagcuuag

SEQ ID NO: 43530 - RNA, 64 nt, Human
ggguuuguuguuuaaccuuagcgagauccuuuaacugcagcaauauucaagccagauauuugga

SEQ ID NO: 43531 - RNA, 64 nt, Human
uuccuuuuuuaucaggaggacuucagagccaggccugcagcauuuuguuugaaaacacaaucag

SEQ ID NO: 43532 - RNA, 64 nt, Human
gcaguccugguaccugagcgccuccuccgcagagcugcagcagcaguggcuggaaacccuaagc

SEQ ID NO: 43533 - RNA, 64 nt, Human
uucucuuauucuucaucagugccgucauuuguuucugcagcagcagcugagaaggcagccggca

SEQ ID NO: 43534 - RNA, 64 nt, Human
cugucaguccccagcgacucucaugacacucauucugcagcaccgccucuuggggcagugguca

SEQ ID NO: 43535 - RNA, 64 nt, Human
cccguccagucugguuuugagagcaggggcuguucugcagcaccgcagggaagggaggagagau

SEQ ID NO: 43536 - RNA, 64 nt, Human
guguguggggggguggggccuucaccuaagaccucugcagcagaccuggacagacaggccccuc

SEQ ID NO: 43537 - RNA, 64 nt, Human
gucaggggucaggugucaggcccgucggagcugccugcagcacaugcgggcucgcccauacccg

SEQ ID NO: 43538 - RNA, 64 nt, Human
aucacuauuccugguggggcuuugcugcuuuugccugcagcauccgcugguuucuccauucucc

SEQ ID NO: 43539 - RNA, 64 nt, Human
ugagacaaagucucgcacugucucccaggcuggacugcagcagcgcagucucagaucacugcaa

SEQ ID NO: 43540 - RNA, 64 nt, Human
caguaaacauuugcggaaugaaugaacacccugucugcagcaggacauggacaaauaggcucug

SEQ ID NO: 43541 - RNA, 64 nt, Human
uuccugguucauaagauggauuuggagguuauuucugcagcaaacuuggguccuguguguucaa

SEQ ID NO: 43542 - RNA, 64 nt, Human
ccuuuaaucugugaccauugggcaaaaaauuuuccugcagcaaaagucugaggcuguugggacc

SEQ ID NO: 43543 - RNA, 64 nt, Human
ucagcacuagaaagcaguuuuaggagguuccagccugcagcauagguacgaccucagaggaugg

SEQ ID NO: 43544 - RNA, 55 nt, Human
guuuggauuugaagagcuaaagagucugcagcaggauuggagacugacuugugac

SEQ ID NO: 43545 - RNA, 64 nt, Human
guggggauuuagggcacgucacugcagacacgcucugcagcauucaccgacagucugucaugca

SEQ ID NO: 43546 - RNA, 64 nt, Human
ccuacccccucuagauucccugauuuccccaggccugcagcauacaguaagaugggucccugug

SEQ ID NO: 43547 - RNA, 64 nt, Human
aaaaugacacuacacccagacggcgcccagcuggcugcagcacuuguagcaugcacaugacucu

SEQ ID NO: 43548 - RNA, 64 nt, Human
uaaucaggggucaccggaccccuugguugaugcacugcagcaugguggcuuucugaguccuguu

SEQ ID NO: 43549 - RNA, 64 nt, Human
acccuccaggcuccacuaaggagggaggggcugucugcagcagcugcacucagcaccuaggcca

SEQ ID NO: 43550 - RNA, 64 nt, Human
agccuggccacagaggagccuccuaaggcagcagcugcagcaagcgcacccucuccccacucuc

SEQ ID NO: 43551 - RNA, 64 nt, Human
uacgccucuuguucaugucagcuuauaugugacacugcagcagaaaggcucugaagguccaaag

SEQ ID NO: 43552 - RNA, 64 nt, Human
uuggggcagggagagagggaaccugcucacggcccugcagcagagcagggcgcaaacccaggac

SEQ ID NO: 43553 - RNA, 64 nt, Human
guuucccugcccugggcucaguggcacugcugagcugcagcaguccuagaguuuuccagggggu

SEQ ID NO: 43554 - RNA, 64 nt, Human
cuuccuucauccucugagggcuauuuuguacuuucugcagcaaucagcuuaauaacaacacuua

SEQ ID NO: 43555 - RNA, 64 nt, Human
ggcuuugcugcugugaaucccaccugccaccagccugcagcacaccccacagccaaguagaggc

SEQ ID NO: 43556 - RNA, 64 nt, Human
ccggcagcccaggauggccuggugcccccaccugcugcagcaggagccccaaggagugcuagcu

SEQ ID NO: 43557 - RNA, 64 nt, Human
ucccccacgugacagugccugggaauguauuauucugcagcaugaccugugaccagcacugucu

SEQ ID NO: 43558 - RNA, 64 nt, Human
aacagguguuuuguuuaauuaaaauuauacuguucugcagcauuuagacauuugucacauuuca

SEQ ID NO: 43559 - RNA, 64 nt, Human
cgccuuuucauuucaagcauaaggcaauaaauaccugcagcaacgugggagaaagaaguugcug

SEQ ID NO: 43560 - RNA, 64 nt, Human
aacgucugugcuaauuuaaacugccaaauauugacugcagcaaacaagaauuauauucagaauu

SEQ ID NO: 43561 - RNA, 64 nt, Human
gcucaugggccgggcacgugcacugacucacuggcugcagcagaacacguugagggagucuugg

SEQ ID NO: 43562 - RNA, 64 nt, Human
ccaggucacccgauucccgccaagccggaagucccugcagcaccaccuuuggcuaggagggagg

SEQ ID NO: 43563 - RNA, 64 nt, Human
ggguaacaacucguguucacucagcacuuucccucugcagcacgcuggacagcacucugccauc

SEQ ID NO: 43564 - RNA, 64 nt, Human
aauauguaucuucauacacguuuggaaauguuuccugcagcauuagguaugacuuguucugagu

SEQ ID NO: 43565 - RNA, 64 nt, Human
ccagaaccaguggcagcuacaacaggagaagcaucugcagcaucuggcggagguuucugcagag

SEQ ID NO: 43566 - RNA, 64 nt, Human
cuucagcauucccaucacggugcuccagccggcccugcagcaguacagccagacccaagaccua

SEQ ID NO: 43567 - RNA, 64 nt, Human
guuagagaucuaaaugacauuuuaucauguuuuccugcagcaggugcauagucaaauccagaaa

SEQ ID NO: 43568 - RNA, 64 nt, Human
ugcuguguuccccgugaugcagcuggaacccaagcugcagcaggagaugcaaguuucaggaugu

SEQ ID NO: 43569 - RNA, 64 nt, Human
caggccggugagggcgggcaaggggccccagccgcugcagcagcggagacagucgccagcagcu

SEQ ID NO: 43570 - RNA, 64 nt, Human
ccagagaggacggcguggcgaaagucagcguccacugcagcacaggaucagauggccgugugcu

SEQ ID NO: 43571 - RNA, 64 nt, Human
agagucaccccagcugcugggcuccucugccucucugcagcagaauguccguccucuguugauu

SEQ ID NO: 43572 - RNA, 64 nt, Human
cuuugcagacacggcacagcaaacauuuugcaaacugcagcagaaaucgaauuuaaaacaaaaa

SEQ ID NO: 43573 - RNA, 64 nt, Human
gagcuucugcacaggaugucccuggccccagguccugcagcaccuuaguccauacuaccagccc

SEQ ID NO: 43574 - RNA, 64 nt, Human
gggugagcuccgucugccacugggcaccguggaucugcagcauguucuggagcacugguaccug

SEQ ID NO: 43575 - RNA, 64 nt, Human
ggugcaccugggugcccgggccucggggcagccccugcagcacugggcagacaugcuggcccac

SEQ ID NO: 43576 - RNA, 64 nt, Human
cuuacagguuuugugagauugagagaacuaugaccugcagcaacucuggaaaccuggccugaca

SEQ ID NO: 43577 - RNA, 64 nt, Human
gauuaacuuucccugaugccgacgccccugcccccugcagcaauaagaugcucggauucacucu

SEQ ID NO: 43578 - RNA, 64 nt, Human
ugacugcuguuugacuccugcauaccaagauauucugcagcaaugucuuuaaacagugccggua

SEQ ID NO: 43579 - RNA, 64 nt, Human
ucggcucagaccgacccccacuccauccccagaccugcagcacaagugcgcgggccuguccucc

SEQ ID NO: 43580 - RNA, 64 nt, Human
uaacuguacuuuuucuagcaagagaugcuuuauucugcagcaugaacagauuuaaaauggcugg

SEQ ID NO: 43581 - RNA, 64 nt, Human
aacuucccauaggaagcaccugagagauaguaaacugcagcaaguaacuauguguaaguccuca

SEQ ID NO: 43582 - RNA, 64 nt, Human
gagauagaggcuugccccagccuguaccccagcccugcagcaggaagcccccagucccagcccu

SEQ ID NO: 43583 - RNA, 64 nt, Human
aagauucuggcccaacuccaucgcugcgggggugcugcagcagcagggcggugccccagggaca

SEQ ID NO: 43584 - RNA, 64 nt, Human
accgaggcuaggacguggccggcgcucuccagcccugcagcagaagaacuucccgugcgcgcgg

SEQ ID NO: 43585 - RNA, 57 nt, Human
ucagcacuucagaagcauaacuacagccugcagcaugucugcacgugugcaugcaua

SEQ ID NO: 43586 - RNA, 64 nt, Human
aagaagccauaacaaagcuguguacuaauaaagacugcagcaagcacuuguguuauuuaaauua

SEQ ID NO: 43587 - RNA, 64 nt, Human
auauuuacucucucuauuauacaccagugugugccugcagcagccuccacagccacgauggguu

SEQ ID NO: 43588 - RNA, 64 nt, Human
uagaaaggauguuuaggggaacaugaggcuggcucugcagcaacaaccaggcuccccugcaucc

SEQ ID NO: 43589 - RNA, 64 nt, Human
aacugcaccccacaacccacauccuccauccugacugcagcaugggguuccccggcaggggugg

SEQ ID NO: 43590 - RNA, 64 nt, Human
agccaggaguggccuucucugcaggccagcaagccugcagcagcaggugcccccacgucaggug

SEQ ID NO: 43591 - RNA, 64 nt, Human
gacuaccuucucaugcucugagguacuacugccucugcagcacaaauuucuauuucugucaaua

SEQ ID NO: 43592 - RNA, 64 nt, Human
gacucaaaaaagguauuuuuauagaauuuuuguacugcagcaugcuuaaagaggggaaaaggaa

SEQ ID NO: 43593 - RNA, 64 nt, Human
guuagcaagacugggaaggaggccacauuccugucugcagcagccgccagcgauggucuucagc

SEQ ID NO: 43594 - RNA, 64 nt, Human
cugccaaugcgggugggcuaagccgccaggaugccugcagcagauggacgcugcccauccuuga

SEQ ID NO: 43595 - RNA, 64 nt, Human
gcuuuuccaguugugacccguuuuccaaccaguucugcagcauauuagauucuagacaagcaac

SEQ ID NO: 43596 - RNA, 64 nt, Human
uccagcuccuuucccccuggguuuccuuggcuuccugcagcaaauugggcaguucucugccccu

SEQ ID NO: 43597 - RNA, 64 nt, Human
cgggcuggggagugaggccaggagugggauucagcugcagcagggcgcccccuccaaacugcag

SEQ ID NO: 43598 - RNA, 64 nt, Human
gguuuccuaggucugaaucugcgaguagaugaaccugcagcaagcagcguuuauggugcuuccu

SEQ ID NO: 43599 - RNA, 64 nt, Human
aaauaccuggacuaucaaccuuguugcuuaaucccugcagcauucaagguuaauccaucuaagu

SEQ ID NO: 43600 - RNA, 64 nt, Human
aagagcugggaauuuaugaaguuauggcaaugaacugcagcaugcugggacaauuauuugacua

SEQ ID NO: 43601 - RNA, 64 nt, Human
cacugggcccaaauauucuuuguaaagaaaaucgcugcagcaaaaacuguuacuguguuuauua

SEQ ID NO: 43602 - RNA, 64 nt, Human
gucuuuaccccugcugaccucccaccuauccgcccugcagcagaaccuuggcgguuuauaggua

SEQ ID NO: 43603 - RNA, 64 nt, Human
uguucagccaugcagggguguugguuuaugcgugcugcagcagugggcauaaugaauauaauuu

SEQ ID NO: 43604 - RNA, 64 nt, Human
ucuucacugccugaggacauuccgguuuuuacugcugcagcagcugcuaccccaguuccaucug

SEQ ID NO: 43605 - RNA, 64 nt, Human
uauuucuuaagccauagucaguguaaauacagcccugcagcagguaaaugugaguaaagagagc

SEQ ID NO: 43606 - RNA, 64 nt, Human
uuugcuuuaaaaauauugugucugugugcauagucugcagcauuuccuuuaauugacucaauaa

SEQ ID NO: 43607 - RNA, 64 nt, Human
ccuugcucaggaccucugccccuaguuagcaagacugcagcaguugcuguugcuuauucugaaa

SEQ ID NO: 43608 - RNA, 64 nt, Human
gccuugcugccagggggcagggaugcuuuccagccugcagcaacagaacacuugaccuuaaaag

SEQ ID NO: 43609 - RNA, 64 nt, Human
ggccacgcaccagcggaagcuccggcagaagcagcugcagcagcaguuccgggagcggauggag

SEQ ID NO: 43610 - RNA, 64 nt, Human
cugccgaccgaacauggcccugggacacccacagcugcagcaggugaccuccccuuccagaccc

SEQ ID NO: 43611 - RNA, 64 nt, Human
aguggguacuaucauuagucccauguuauagaaacugcagcagaguugaaaauugccuccaaau

SEQ ID NO: 43612 - RNA, 64 nt, Human
accuccuccuccuggugacagaccccaccugugacugcagcaucuucccaccagugcugcagga

SEQ ID NO: 43613 - RNA, 64 nt, Human
cauggucaggcucuugucuguggucucuagggcucugcagcagcaguggcucuucgauuaguua

SEQ ID NO: 43614 - RNA, 60 nt, Human
cucagcacaccaaugugugagcaguucagccugcagcagaggagggcacggcagcagaga

SEQ ID NO: 43615 - RNA, 64 nt, Human
ggaauagaaugcagcuggaggcuacgcauggccucugcagcacacgcagcuggagagggcuucu

SEQ ID NO: 43616 - RNA, 64 nt, Human
ggagaggaauacuaauuauccauuccuuuuggcccugcagcaugucaugcucccagaauuucag

SEQ ID NO: 43617 - RNA, 64 nt, Human
ggcggcuggaccccaggaaccccagggcacuccacugcagcaggagggacuuaagcuagacuca

SEQ ID NO: 43618 - RNA, 64 nt, Human
ucuugcauuucugcucucuuaugucacagcuggccugcagcaggucccugugagcacauaagca

SEQ ID NO: 43619 - RNA, 64 nt, Human
gagcuucaguugcaagucaaugccaaggacccaacugcagcauguucuggaagccucuccauug

SEQ ID NO: 43620 - RNA, 64 nt, Human
cuuuuauaaaauagaaaccuuuuccacaccaguucugcagcagucgcuauuagaugcucguggu

SEQ ID NO: 43621 - RNA, 64 nt, Human
cucaccccuguaagccagacaguuuguucaaaaccugcagcaaagagaagcaucagucuaacaa

SEQ ID NO: 43622 - RNA, 64 nt, Human
agaaaguggguuaucaagggugauuugaaauuuucugcagcauuaaagcuggcgcuuaauaaga

SEQ ID NO: 43623 - RNA, 64 nt, Human
cacggaggcccccagcugcccuccgagcccaggccugcagcacugaaagacgaccugccauguc

SEQ ID NO: 43624 - RNA, 64 nt, Human
ugaggaggaggaggcagagguguaccugcggaagcugcagcagguguacaagcugaacaggaag

SEQ ID NO: 43625 - RNA, 64 nt, Human
auugcuuaggugcagacaguucuaaagcaaggagcugcagcauucucaucauagauacgugcag

SEQ ID NO: 43626 - RNA, 64 nt, Human
aaaggguauguuucacuucuugacaauauaaaugcugcagcaaagaugagaggugaaguaaaac

SEQ ID NO: 43627 - RNA, 64 nt, Human
uuuaauuccucugaaaacaugaguauuuugaguucugcagcacaaugacuguaggacuaagcua

SEQ ID NO: 43628 - RNA, 64 nt, Human
ugaaaauauccuaucacgcugauuuuugaccucacugcagcaauuuucaguuauuccagauuau

SEQ ID NO: 43629 - RNA, 64 nt, Human
gccugagcagcacagggacauggacccagccacgcugcagcagcucacaccucucugcgguucc

SEQ ID NO: 43630 - RNA, 64 nt, Human
cuuccgcucccuggauauguccagucauccugcccugcagcacgcggccuugucugggugcagc

SEQ ID NO: 43631 - RNA, 64 nt, Human
uuuuggauuaaauccaacaguuuauuuguaagcccugcagcagauuucuuugauaauuuagcuu

SEQ ID NO: 43632 - RNA, 64 nt, Human
acacacccaaaaucaagggccuggaugccagcagcugcagcaagcagguuuuuccucccuguug

SEQ ID NO: 43633 - RNA, 64 nt, Human
uuauaagaucgaauuuaauuuccuuucccucauucugcagcaaucagaauacacaaucuuaacc

SEQ ID NO: 43634 - RNA, 64 nt, Human
ccuuacugucucacucguucuguuacccagggcucugcagcaccucaccugagaccuccacucc

SEQ ID NO: 43635 - RNA, 64 nt, Human
gacucucaugucacaggcgugccuugcugccccccugcagcacugugcaggacguggaccagcu

SEQ ID NO: 43636 - RNA, 64 nt, Human
uggcaaaaacugccaauaggaggacugcccgacacugcagcaagauugaggauaagauggaagg

SEQ ID NO: 43637 - RNA, 64 nt, Human
gaggggggaaggggugggagccaauacugagugccugcagcaucuacuacucugucuucacuau

SEQ ID NO: 43638 - RNA, 64 nt, Human
caggacuuuauuguuaguauuauaggcuaauaaccugcagcagaaauucauacucuauuauaau

SEQ ID NO: 43639 - RNA, 64 nt, Human
auaagaaaauuaaauucagcuucaggccuuuaaacugcagcaagauggugguguaggggugugg

SEQ ID NO: 43640 - RNA, 64 nt, Human
aacccacagccuccacccguggcuggcgugauugcugcagcaguggcgccuccuagcucaggac

SEQ ID NO: 43641 - RNA, 64 nt, Human
agcucauuuucuaugccugaggugcccggggaggcugcagcaggucagcgagugaguggagggg

SEQ ID NO: 43642 - RNA, 64 nt, Human
ugaaugucaugcucccuggggcaggaccuugagccugcagcacacacuaggccaccugcagucu

SEQ ID NO: 43643 - RNA, 64 nt, Human
uacccuuuugcauguauuugugugacagggaacucugcagcagggggugacugacacaccaaac

SEQ ID NO: 43644 - RNA, 64 nt, Human
cuaacaggcagugccaguuggacccaagagaagacugcagcagacuacacaguacuucuuguca

SEQ ID NO: 43645 - RNA, 64 nt, Human
acaauuuaaauuuuauagaugcacuaagaauucacugcagcagcagguuacauagcaaaaaugc

SEQ ID NO: 43646 - RNA, 64 nt, Human
gugcucugggcucaugaagauauugcaucaugagcugcagcaguuguacucuuuuuugaugacc

SEQ ID NO: 43647 - RNA, 64 nt, Human
cugcuucuagacuguuggcaagaguagcaagaugcugcagcacauugacuauagaaugagaugu

SEQ ID NO: 43648 - RNA, 64 nt, Human
cucaaguuugguugccaaauggaaggggccauagcugcagcaauugcugacauauuaaaugacu

SEQ ID NO: 43649 - RNA, 64 nt, Human
gcuugccucaggccaugcagcauuggcgcucuggcugcagcagcugaguugcucaaggccagug

SEQ ID NO: 43650 - RNA, 64 nt, Human
cuggagcuuuguggacaaagaugagaaggcccgucugcagcaccaggucacugaggauggagag

SEQ ID NO: 43651 - RNA, 64 nt, Human
cuuuggcaacaucagaacuugccacauguagcuacugcagcaaggcuucuguguacuugccuga

SEQ ID NO: 43652 - RNA, 64 nt, Human
uugcucgcuacuuugaugaacucuuucugagagacugcagcacaccuagagggcccuuuccugc

SEQ ID NO: 43653 - RNA, 64 nt, Human
ccugacucuaggggcacauccagucuccaucgugcugcagcagcuggacugagggcagagccug

SEQ ID NO: 43654 - RNA, 64 nt, Human
ggagccucaguucccuccugugucaaguagcuaacugcagcagcuggacugagggcagagucug

SEQ ID NO: 43655 - RNA, 64 nt, Human
gugcucugggcucaugaagauauugcaucaugagcugcagcaguuguacccuuucuugaugacc

SEQ ID NO: 43656 - RNA, 64 nt, Human
gccuaggcagugaguaaauaccucagauguccuccugcagcaagugucuauauguugugguuau

SEQ ID NO: 43657 - RNA, 64 nt, Human
uuucccuuccugucuuccucucccuucuccucugcugcagcaugauuuucuuaaucuucagaca

SEQ ID NO: 43658 - RNA, 64 nt, Human
auuuucucauuguguauguauauaucgcuuuucucugcagcacgauuucucuuuugauaaugcc

SEQ ID NO: 43659 - RNA, 64 nt, Human
ugagguggagcugaagagccaagaggcuccgagucugcagcagcagccagaccaguagcuggag

SEQ ID NO: 43660 - RNA, 64 nt, Human
ccucccuggcugcccuggcccugaggugugggggcugcagcauguugcugaggagugaggaaua

SEQ ID NO: 43661 - RNA, 64 nt, Human
ucuccuguaccucuugagccuugaacuuugaccucugcagcaauaaagcagcguuucuaugaca

SEQ ID NO: 43662 - RNA, 64 nt, Human
gugcucugggcucaugaagauauugcaucgugagcugcagcaguugcacucuuuuucagugacc

SEQ ID NO: 43663 - RNA, 64 nt, Human
cucaaaagacugagaggcaaaacuuggcuuuuagcugcagcacauagcccuguuauauuugauu

SEQ ID NO: 43664 - RNA, 64 nt, Human
gguucucuccgggccaccuucuccccaccaggcacugcagcagacggagcuguacugccgggcc

SEQ ID NO: 43665 - RNA, 64 nt, Human
auuccucugggcucacgggguguuuuccaccccccugcagcaacuaagauggugggggagaggg

SEQ ID NO: 43666 - RNA, 64 nt, Human
gcaguuauuucugcagauccagcucguggaccagcugcagcaccagagaaaagaguagcagaga

SEQ ID NO: 43667 - RNA, 64 nt, Human
ccugccgcagcggggagaccagugcugaggucuucugcagcaguacuaucagcagcugaucucu

SEQ ID NO: 43668 - RNA, 64 nt, Human
gguguccuggccagcccuggagaagcacuggugucugcagcaccccucaguuccugugccucag

SEQ ID NO: 43669 - RNA, 64 nt, Human
guccagaggacauucucaguggaaagaguuugaucugcagcacccagaagagaagccaaacucg

SEQ ID NO: 43670 - RNA, 64 nt, Human
ccccaggaagccuaggcucgguggcuggacaggacugcagcaggacagggacuggcuucucacc

SEQ ID NO: 43671 - RNA, 64 nt, Human
cacuccacccuccaccuuccauuuucccccacuacugcagcaccuccaggccuguugcuauaga

SEQ ID NO: 43672 - RNA, 64 nt, Human
guuugcaccuguccccacccuccacucagcuguccugcagcaaacacuccacccuccaccuucc

SEQ ID NO: 43673 - RNA, 64 nt, Human
aaggauuguuuuuaucaaguggguuguucugugccugcagcauagagcgcaggcuggcagagca

SEQ ID NO: 43674 - RNA, 64 nt, Human
cacaguugcucguggccacucaguggagcugggccugcagcagacucaaggcuccgagugcccu

SEQ ID NO: 43675 - RNA, 64 nt, Human
uugaagcacuauuauuuauucuuccgcugucugccugcagcaguacuacugucaacauagugua

SEQ ID NO: 43676 - RNA, 64 nt, Human
guaucuauuucuacauagucagcuacuucugaaacugcagcaguggcuuagaaaguccaauucc

SEQ ID NO: 43677 - RNA, 64 nt, Human
ggaccguaccguccgcaucugggaccuggccacccugcagcagcuauacgacuucacaucauca

SEQ ID NO: 43678 - RNA, 64 nt, Human
ggagacuugccgcuucgagggccugaaggaguuucugcagcagacggaugaccgcuuccacgag

SEQ ID NO: 43679 - RNA, 64 nt, Human
uuucccuuugaugcuuugguggccuugccccgcucugcagcacagacaggccagaugcauuugu

SEQ ID NO: 43680 - RNA, 64 nt, Human
ucagcugcuggcccaaggccaggagcgcuggguucugcagcagggcucagccucaggggcguua

SEQ ID NO: 43681 - RNA, 64 nt, Human
ggcucacacaaaacagcugacacugacuaaggaacugcagcauuugcacaggggaggggggugc

SEQ ID NO: 43682 - RNA, 64 nt, Human
caaguaccgccugucucaggaugaccgcgauggccugcagcaacucuaugguagggggagaggg

SEQ ID NO: 43683 - RNA, 64 nt, Human
gccgcgaaaccaucauugccccauccaguguccucugcagcagggccaggggacgcacaccugc

SEQ ID NO: 43684 - RNA, 64 nt, Human
cugacccaaagugaaggacauugccgggagaggccugcagcaucccuggauuucagaguucugg

SEQ ID NO: 43685 - RNA, 64 nt, Human
gugaacgaguuguuggcugcucccuccacagcuucugcagcagacugucccuguuguaacugcc

SEQ ID NO: 43686 - RNA, 64 nt, Human
ugguggggacgcgggggugcccccaauggugcagcugcagcagucaccacuagggggugaugga

SEQ ID NO: 43687 - RNA, 64 nt, Human
gcuagcauaagcugagguagaacuuaucuuuaagcugcagcaaaaucaaggagugacuuuuguc

SEQ ID NO: 43688 - RNA, 64 nt, Human
uguaaugggcagaggcucccucggggcucgggaucugcagcaucuauguggaucagcccacacc

SEQ ID NO: 43689 - RNA, 64 nt, Human
guucuguuugaaaaaaaugaggggaucuuagaugcugcagcagaacagucuccagguguuuuaa

SEQ ID NO: 43690 - RNA, 64 nt, Human
caguguggcuggccaugggccacagcugcggccacugcagcagccaugaagggcaguggguaga

SEQ ID NO: 43691 - RNA, 64 nt, Human
gcucggugagccaugugcaccuauggcccagccacugcagcacaggaggcuccgugagcccuug

SEQ ID NO: 43692 - RNA, 64 nt, Human
uuuggccacuuuaaucuagggugaccuagcaauccugcagcacagggcagagaguacugucuua

SEQ ID NO: 43693 - RNA, 64 nt, Human
augcaggcuggagcccccgaaugccccacacacacugcagcauugaccagaccauccgaaaccu

SEQ ID NO: 43694 - RNA, 64 nt, Human
gugagaagcucuuuuucgggcaccgagguauuaacugcagcagaaaaagacgagcuuuuguuau

SEQ ID NO: 43695 - RNA, 64 nt, Human
cucagacugggcacuggggccucagccugcuuuccugcagcagucgcccaagcagacagcccug

SEQ ID NO: 43696 - RNA, 64 nt, Human
auccugccagaguuuccaaauggagcccggggcucugcagcauuccaguccccuuugcagaucc

SEQ ID NO: 43697 - RNA, 64 nt, Human
ccacugugcccuggccuugggucugccgagccuccugcagcaggggacgggugcuuuggccaga

SEQ ID NO: 43698 - RNA, 64 nt, Human
cagagagagcucuccccuggcagugacaagauggcugcagcagcuccagcaaccucagaggacu

SEQ ID NO: 43699 - RNA, 64 nt, Human
ggggacgaucaggaggaagugagcagucgccugccugcagcaggcagcuucuacuccugccuca

SEQ ID NO: 43700 - RNA, 64 nt, Human
ugcaauccauggcgaaaaaacacucacuuugucucugcagcaaagaguugccccuucuuucuac

SEQ ID NO: 43701 - RNA, 64 nt, Human
auauccgagaggaagcugaugcaacaggauuugucugcagcagccucugguaccaccucugagu

SEQ ID NO: 43702 - RNA, 64 nt, Human
uuccccuuuaacucucuccuucuggugacacauccugcagcagcugagggggugcccuggcacu

SEQ ID NO: 43703 - RNA, 64 nt, Human
aucagaguuuggaacaugaugcuuugaaaguacucugcagcagcucuguuuuauggguuccuac

SEQ ID NO: 43704 - RNA, 64 nt, Human
gcaagcgcaugaguaaagagacguggggcuauuucugcagcaaguggaaccuucuggagcuggc

SEQ ID NO: 43705 - RNA, 64 nt, Human
guaccgaugcaggaggaagcaagcgugucuuccccugcagcacacagcgacuugcguugacaaa

SEQ ID NO: 43706 - RNA, 64 nt, Human
gcauagucacugucucaacuacucagcucuccugcugcagcaugaaggcagccacagacaacau

SEQ ID NO: 43707 - RNA, 64 nt, Human
cucucuacccggcccagagaccccuuccuuuccucugcagcacuuuaacccucucuucccuauu

SEQ ID NO: 43708 - RNA, 64 nt, Human
acuccaucucaaaaaaaaaaaagugucuuguucacugcagcaugcccagugccacgcacaggug

SEQ ID NO: 43709 - RNA, 64 nt, Human
ggacccaagagaccaguagucacccugcuuguuucugcagcaaugacugguccugucuuuugag

SEQ ID NO: 43710 - RNA, 64 nt, Human
aaaguauguaaagauacauagguggaugcucuuacugcagcagucaugaauacauuuuuagcca

SEQ ID NO: 43711 - RNA, 64 nt, Human
agcaggaggauugauugagccugcgaggccaaggcugcagcaggcugugauugcaccacugcac

SEQ ID NO: 43712 - RNA, 64 nt, Human
gaggacaacuccgcuuuggccaaccuagccaaggcugcagcauauagaccaggaaaucagguag

SEQ ID NO: 43713 - RNA, 64 nt, Human
uacagacccuuuuauacagugaucugucuuguuccugcagcaaaaauccucuauggacauagga

SEQ ID NO: 43714 - RNA, 64 nt, Human
uaaacugaagaccauuuuagaacuagucaguucucugcagcaaagggaacaggagccauuugaa

SEQ ID NO: 43715 - RNA, 64 nt, Human
acgccugccuccccugugcaguccugggauguggcugcagcagcgguggccucuuuucagauca

SEQ ID NO: 43716 - RNA, 64 nt, Human
guggggagcgccggauuugcucccaccacggggucugcagcaaugaagggaagugcaucuguca

SEQ ID NO: 43717 - RNA, 64 nt, Human
cucacugaagaagcagauugccaagugccagcagcugcagcaagaauacagccgcaaggaggag

SEQ ID NO: 43718 - RNA, 64 nt, Human
ugucaaaccagcaugguuaauugugagcauccuccugcagcaugccccuuaagauuuucuacaa

SEQ ID NO: 43719 - RNA, 64 nt, Human
cagccaacagcccaggagcuuuucagaauagcgucugcagcagaaccaguuuccauucagagcg

SEQ ID NO: 43720 - RNA, 64 nt, Human
augaguauuuauuuaaauaaaggagaaaagugggcugcagcagccggaauagagccucgucugg

SEQ ID NO: 43721 - RNA, 64 nt, Human
agaaauguggcagcccauuccagcacacaggcuucugcagcaaucucugaggguaaagccggug

SEQ ID NO: 43722 - RNA, 64 nt, Human
ccagcugggggccagcccacaguggccauauuggcugcagcaggaauggugcccaccucggcga

SEQ ID NO: 43723 - RNA, 64 nt, Human
cccggggacccggggccuggggucucuguggugccugcagcaggagccaggaacgcccggcagg

SEQ ID NO: 43724 - RNA, 64 nt, Human
agaggugcaccagugccgcccagguagauaagagcugcagcauugacugugcuuccguucuucc

SEQ ID NO: 43725 - RNA, 64 nt, Human
ccacaugaccaccaucccgcccuggcauggcaaccugcagcaggauuaacuugaccaugguggg

SEQ ID NO: 43726 - RNA, 64 nt, Human
caaugaaggaccagacugccuauucguaaccuuucugcagcauuagagccaucguucauggggg

SEQ ID NO: 43727 - RNA, 64 nt, Human
augucucuguauggcagcaaauguggcccauggccugcagcaaaacguccuauauguagauucc

SEQ ID NO: 43728 - RNA, 64 nt, Human
ccuuguacagagaugguggcugaugucaaucucccugcagcacagcuccaggugagucucccug

SEQ ID NO: 43729 - RNA, 64 nt, Human
ccccugccuccucuaucccccaggcucuccaacucugcagcaguggcagcagcagucaaaacaa

SEQ ID NO: 43730 - RNA, 64 nt, Human
agcuagggaacaccaguaagugcuacccaccccucugcagcaacaucuccaaacugucaaguuu

SEQ ID NO: 43731 - RNA, 64 nt, Human
caccaucccauuuuacagacaaggacgcugaggccugcagcagcagugugacuugcucaagguc

SEQ ID NO: 43732 - RNA, 64 nt, Human
auguccuuugaagagccaguauaguuucugugcccugcagcagcccaagugcuuuaaagccguu

SEQ ID NO: 43733 - RNA, 64 nt, Human
gcagacuccugagugagguguugcagcccaaaggcugcagcauugccauaccauucccauggag

SEQ ID NO: 43734 - RNA, 64 nt, Human
cugcugugcccagcaguggcugcuggggaagcagcugcagcaggagggagacggucuugccucu

SEQ ID NO: 43735 - RNA, 64 nt, Human
guuuguuuuugccuuguaaacuagcgccaaggaacugcagcaaauaaacuccaacucugcccaa

SEQ ID NO: 43736 - RNA, 64 nt, Human
ucagugccugagacuuuucuaccaagccacacagcugcagcaacugcagauacugcgggcugag

SEQ ID NO: 43737 - RNA, 64 nt, Human
cugccacaccccucacccugcuguccucccacggcugcagcagaguuugaagggcccagccgug

SEQ ID NO: 43738 - RNA, 64 nt, Human
cccacccccaaaccaccgacucucauugccgacacugcagcagaaucucuccgggugggagccc

SEQ ID NO: 43739 - RNA, 64 nt, Human
gcagccccaggguuuaaguugggcguccuagcagcugcagcagcugugccgccgcggguccacc

SEQ ID NO: 43740 - RNA, 64 nt, Human
aacugacagugcuacauuaaucauagggguuugucugcagcaaacgccucauaucccaaaaacg

SEQ ID NO: 43741 - RNA, 64 nt, Human
gaggagauuuccgaaacucuguugcuaguucauucugcagcaaauaauuauuaugucugauguu

SEQ ID NO: 43742 - RNA, 64 nt, Human
ggcuggcagcucuucccagugauguugagagcaccugcagcaaucugguccccagucgcacaac

SEQ ID NO: 43743 - RNA, 64 nt, Human
caccugcagcuggccacaccacaggcccccgugccugcagcacuacuggugccugaaacaccug

SEQ ID NO: 43744 - RNA, 64 nt, Human
gagacaccaguaugaaugcugggcucuccggacccugcagcagagaggccagagguagcuggug

SEQ ID NO: 43745 - RNA, 64 nt, Human
gaaaauaaucaugcagucauuccucaauuacugccugcagcaauuccuccauuuuuaugaaucu

SEQ ID NO: 43746 - RNA, 64 nt, Human
cgacccuggccuccccuguggccucuuugagugucugcagcagcccuggacuuccagacuucua

SEQ ID NO: 43747 - RNA, 64 nt, Human
gcacuuuucccagcuuucucuccagcaucagucccugcagcagcuggggccucuggucaggaac

SEQ ID NO: 43748 - RNA, 61 nt, Human
augugauccucaaacauugacacuggaugggcugcagcagaggcacugggggcagcggggg

SEQ ID NO: 43749 - RNA, 64 nt, Human
cauaugauuaaaacccuguguccaacagagaaaccugcagcagagauaauggugaaaguuuagg

SEQ ID NO: 43750 - RNA, 64 nt, Human
gagacaggucagggccccccacccucuccagccccugcagcaaaugacuacugcaccuggacag

SEQ ID NO: 43751 - RNA, 64 nt, Human
uccucccggcuguuacauugucaggggacagcaucugcagcaguugcugaggcuccgucagccc

SEQ ID NO: 43752 - RNA, 64 nt, Human
ccuggcccggacaucuggucccucagaguggcagcugcagcaagaggcagcugaagcccucgug

SEQ ID NO: 43753 - RNA, 64 nt, Human
uucagcaguuagaaguuucuaucccuccagcuuucugcagcagaaagacccucauugucaguuu

SEQ ID NO: 43754 - RNA, 64 nt, Human
ugaacucaagauuuggcagccccagagaugccaacugcagcaugcccaccuguauucccugucc

SEQ ID NO: 43755 - RNA, 64 nt, Human
cacagaucacaccuccauccccaaagagguagcacugcagcaacaucagggggaggacguggug

SEQ ID NO: 43756 - RNA, 64 nt, Human
cuacuucuuccaccacuacgagcugccugccauccugcagcagguccgcauccaggagaugcug

SEQ ID NO: 43757 - RNA, 64 nt, Human
ugggccucaggccaccaggcaauaaccacagggccugcagcagugccccugccagccccgaauc

SEQ ID NO: 43758 - RNA, 64 nt, Human
uuaaguggcuucuccguggaaacacagccuucugcugcagcagaggcucacccagcgugaacug

SEQ ID NO: 43759 - RNA, 64 nt, Human
gguuuuaaguccucccugcccucucuccucuccccugcagcagggcagggaccccucuccccug

SEQ ID NO: 43760 - RNA, 64 nt, Human
gcucacaggcaggcuuuuccuccaaccuguggcgcugcagcagggcaggaaggggaaacacagc

SEQ ID NO: 43761 - RNA, 64 nt, Human
uguggacgacgagaccaagcucacgcugcacggccugcagcaguacuacgucaaacucaaagac

SEQ ID NO: 43762 - RNA, 64 nt, Human
aaacuggccccaaaacuggccauaaacaaaauaucugcagcacugugacauguuugugauggcc

SEQ ID NO: 43763 - RNA, 64 nt, Human
aaaagacagggacacugccaucgauaaugucagccugcagcacugaagugugccaggcaaggac

SEQ ID NO: 43764 - RNA, 64 nt, Human
cgagcuaaaaucccagggaccggagcccuggccucugcagcagccgcagucuccggauccaaag

SEQ ID NO: 43765 - RNA, 64 nt, Human
cagagacucaggccuguuugagggcucacgaccccugcagcaaagaagcccgagacugauuccu

SEQ ID NO: 43766 - RNA, 64 nt, Human
cagcaggcccaggccagccagggcuucgucaggccugcagcacaauuugacuuccuaugcccag

SEQ ID NO: 43767 - RNA, 64 nt, Human
ugcccggcagacgacagagaugcugaaggugaugcugcagcagggcgaggccaugcgcugcccc

SEQ ID NO: 43768 - RNA, 64 nt, Human
ucuccuuuguccuuuuguucagacagaguuguaccugcagcagacaacucugaauuaaagcaug

SEQ ID NO: 43769 - RNA, 64 nt, Human
ugugaauuuggagagauacucaaaagagcuaaaacugcagcauuuuaccuuuaaaugcagugcc

SEQ ID NO: 43770 - RNA, 64 nt, Human
aaccaggugggagcguuuuguugagcaugacagccugcagcaggaauauaugugugccuauuug

SEQ ID NO: 43771 - RNA, 64 nt, Human
acucuccuuugugaugccuuaggacauguuugaacugcagcaaaaaacaaaaacaaaaaacagu

SEQ ID NO: 43772 - RNA, 64 nt, Human
uugucaaugcacacagaauacaaccucaugcucccugcagcaagaccccugaaagugauucaug

SEQ ID NO: 43773 - RNA, 64 nt, Human
uugggaauguuucacugcuacccgcauccagcgacugcagcaccagaaaacgacuaauguaacu

SEQ ID NO: 43774 - RNA, 64 nt, Human
caguggccauagugaagccugggaaugaguguuacugcagcaucugggcugccagccacaggga

SEQ ID NO: 43775 - RNA, 64 nt, Human
aagagaugggacaagcagucccuuaauauugaggcugcagcaggugcugggcuggacuggccau

SEQ ID NO: 43776 - RNA, 64 nt, Human
uucacagaaauggaccaguucuguucuccaaagacugcagcaaugauauuucagucugugaacu

SEQ ID NO: 43777 - RNA, 64 nt, Human
uacagaacaguuucucauuagaugaguguuucuccugcagcacuccaaaacccacucugcacug

SEQ ID NO: 43778 - RNA, 64 nt, Human
guuucuccugcagcacuccaaaacccacucugcacugcagcacagugaaugauaugcacucacc

SEQ ID NO: 43779 - RNA, 64 nt, Human
cucuuucaggaaggagccccuuaggaggacaggccugcagcauccuggucucgggaggcuucug

SEQ ID NO: 43780 - RNA, 64 nt, Human
gcagcugagggggcccugcauuugaccgucgagacugcagcagcgccuuuccugucugugguuu

SEQ ID NO: 43781 - RNA, 64 nt, Human
ggcugcuuggugacauggauuagcgcuacgugggcugcagcauuugggauccaggcuaccuaga

SEQ ID NO: 43782 - RNA, 64 nt, Human
ggccggggcucugcguggcuugcugggaggugggcugcagcacagaggccugugacugcguucc

SEQ ID NO: 43783 - RNA, 64 nt, Human
augcucccuggucaccccacuucccggucgccgucugcagcacuccuggagcagccugggcccu

SEQ ID NO: 43784 - RNA, 64 nt, Human
ccagcuggggcagcuccgggcucaggaagccggccugcagcaggagcagaggaaggcagacacc

SEQ ID NO: 43785 - RNA, 64 nt, Human
uagccacaaaagaggggggagacuggaggcaccccugcagcaggggcacuucccuagggcucca

SEQ ID NO: 43786 - RNA, 64 nt, Human
agggcagggcaggcagggggggcuucccgcccuccugcagcaaagggcaaccacccucggauga

SEQ ID NO: 43787 - RNA, 64 nt, Human
gcucgccccaccggcgcgcucuucgcgcccgccccugcagcacggacaauaaaccuccgccaau

SEQ ID NO: 43788 - RNA, 64 nt, Human
agccccacugcccucgcuccuaggcccugcugagcugcagcaccugcucuaggggacgagcucc

SEQ ID NO: 43789 - RNA, 64 nt, Human
uggcccccacccugugggaggucuccccaugcaccugcagcaggagaagacagagaaggcugca

SEQ ID NO: 43790 - RNA, 64 nt, Human
aggagggggccucauugugucucccgugcaugcucugcagcauugaaguaugguguguucacgu

SEQ ID NO: 43791 - RNA, 64 nt, Human
aauauaauuucccccuuggugguuuuucagacaccugcagcaagaagaaauacugacugacuag

SEQ ID NO: 43792 - RNA, 64 nt, Human
aggccacaccugugccaguggggcuucccuggugcugcagcacuuguaaaccacacacacagcc

SEQ ID NO: 43793 - RNA, 64 nt, Human
auugaaaugcccaguucagacugaauaauuccugcugcagcaaggaaaguaccuacuauaauag

SEQ ID NO: 43794 - RNA, 64 nt, Human
uccguuuuaaacucauuuccacucuaguugaguucugcagcaugcagcgguaugacccuacggg

SEQ ID NO: 43795 - RNA, 64 nt, Human
gaggauggcggugggggaggcugucuuuguaccacugcagcaucccccacuucuccacggaagc

SEQ ID NO: 43796 - RNA, 64 nt, Human
uuccugcuauucagaauaaguaggagaaugaaaacugcagcauaucagacagcaauuuaacagc

SEQ ID NO: 43797 - RNA, 64 nt, Human
uuguaaaaaugauuguaacagauaaaaaauguaucugcagcaacucugcagguuugugaaauag

SEQ ID NO: 43798 - RNA, 64 nt, Human
gaacccaaaccuauuuuuuucaaucugaauauugcugcagcaaaaccaacuccaccaaaaagcc

SEQ ID NO: 43799 - RNA, 64 nt, Human
ccgccguccuucaauuuucuucacacuaucaacacugcagcauuuugcugcuuuaucaaaaugg

SEQ ID NO: 43800 - RNA, 64 nt, Human
ucuucuuuuguauguccagucuccugcacagcaccugcagcauuguaacugcuuaauaaaugac

SEQ ID NO: 43801 - RNA, 64 nt, Human
agcacagggcagguggcugggugaggaugccgcccugcagcauguacaccgagugucugcagcu

SEQ ID NO: 43802 - RNA, 64 nt, Human
ccagaaggucaaacuccgaagacugaaacucugccugcagcaggacuggccgccccugcugugg

SEQ ID NO: 43803 - RNA, 64 nt, Human
uuugugugcaaaggaaaaucgugguugaguuucacugcagcaggcugacguugccugaugugag

SEQ ID NO: 43804 - RNA, 64 nt, Human
uuccucaguagcacuuuaaacgccgaagacagcccugcagcaagccugcacacgggcuugggug

SEQ ID NO: 43805 - RNA, 64 nt, Human
agguaacugacuguucccaccugcuccuuuucuccugcagcauggagcaaucagucaugugacc

SEQ ID NO: 43806 - RNA, 64 nt, Human
agaacgcuccuucugaagaaauggggcccuguagcugcagcacaggggaagggcccggcacccu

SEQ ID NO: 43807 - RNA, 64 nt, Human
cguggcggcugcugacugugggguguggauggggcugcagcaccaggcagagccccucagggcg

SEQ ID NO: 43808 - RNA, 64 nt, Human
aggagcaccccccagacuccccgugcccgcagcccugcagcaccccggcuuucccgggucucca

SEQ ID NO: 43809 - RNA, 64 nt, Human
agggaucagcccugcccuucagcauccucaguuccugcagcagagccuggaagacacccuaaug

SEQ ID NO: 43810 - RNA, 64 nt, Human
cacugggggcuggucacccugagagucccaucgccugcagcaccuggagacccaccucccaccc

SEQ ID NO: 43811 - RNA, 64 nt, Human
cugagcgccgccucugugcccaggucccauuucucugcagcacuggccccuuggugcacacaca

SEQ ID NO: 43812 - RNA, 64 nt, Human
cuccucucaucuggggucagucaggguucgggggcugcagcagccaagcgcaugagagguguuu

SEQ ID NO: 43813 - RNA, 64 nt, Human
cugcacagccugggauggggcuuggggcuggggccugcagcagaagugugcccagcguuucucg

SEQ ID NO: 43814 - RNA, 64 nt, Human
aagcccagucccucggagcugcagacagcagguccugcagcaacaauaccugcacggcuuugca

SEQ ID NO: 43815 - RNA, 64 nt, Human
ggauguugugcuucugaagccccacuggguguuacugcagcagggcguggcccaggccgaggga

SEQ ID NO: 43816 - RNA, 64 nt, Human
guucuucugaaagugugacaguguccagccgguucugcagcacuaggggagggggcagauggug

SEQ ID NO: 43817 - RNA, 64 nt, Human
ugagggacaaguagccugccccagccugcccuggcugcagcaagggcagggccacacucucgcc

SEQ ID NO: 43818 - RNA, 64 nt, Human
gagcuuguggaaauaccuuggcugauguugcagccugcagcaagugcuuccgucuccggaaucc

SEQ ID NO: 43819 - RNA, 64 nt, Human
cccauccaggagacauauuuccagcagcuggcaccugcagcacggagcuccggcuucccaaacc

SEQ ID NO: 43820 - RNA, 64 nt, Human
gcagccugggauggccagggucugauggcuggaccugcagcagggguuuguggagguggguagg

SEQ ID NO: 43821 - RNA, 64 nt, Human
cagugugcugcuuggcacugcacuaguuuaggaccugcagcauguagguagcguccuaguguuu

SEQ ID NO: 43822 - RNA, 64 nt, Human
ugaugagugacccuucuggagcuggccagguccucugcagcaggcaagaccaaucaaucacuga

SEQ ID NO: 43823 - RNA, 64 nt, Human
gggacauggguggaaugauggcagaauccagggucugcagcaccugcuguuguugccaaccagu

SEQ ID NO: 43824 - RNA, 64 nt, Human
gcggggaaggggcaagaaggcgggcaggccuucacugcagcacugagccucaaauccgcucugg

SEQ ID NO: 43825 - RNA, 64 nt, Human
gggcuuucugugugggugcugcaguugcuuuugucugcagcagcaggacacaucuuuccucuua

SEQ ID NO: 43826 - RNA, 64 nt, Human
gccguggcugggaagguucccugcagugccagugcugcagcagggagagcugggcagaagcagc

SEQ ID NO: 43827 - RNA, 58 nt, Human
gacacggagagucccgcuaggggcaguccugcagcagucaccugaucacuguucaguu

SEQ ID NO: 43828 - RNA, 64 nt, Human
ugugaagccuggccccacugccugccggggguuccugcagcaccccccuacuccaggcucccca

SEQ ID NO: 43829 - RNA, 64 nt, Human
aaugacggaauaagagaccuguuuuaaaaaggaacugcagcaaucuuugaaagacuuccaaaga

SEQ ID NO: 43830 - RNA, 64 nt, Human
guuugcugcugcccauucaaauuuagcaaguguacugcagcagcagggaaaacugcaggaagcu

SEQ ID NO: 43831 - RNA, 64 nt, Human
cacaaauugacacuaacucaaaaaaaaucuuaaccugcagcaggcuguuugucuuggaagcuuu

SEQ ID NO: 43832 - RNA, 64 nt, Human
cagugaucauauuagcauuuagcaaaaagcaacccugcagcaaagugaauuucuguccggcugc

SEQ ID NO: 43833 - RNA, 64 nt, Human
aauuauccauaacauuuauauagcgguguaauaacugcagcaguucugaaaugaugcuauggga

SEQ ID NO: 43834 - RNA, 64 nt, Human
ucucuggugacugaguguaaaauaugugccaagucugcagcacagugaccaaaucugacaaucg

SEQ ID NO: 43835 - RNA, 64 nt, Human
gggcccucaggaaggagggaguuggcagcgggggcugcagcaggaguaggagcagaugaggcgu

SEQ ID NO: 43836 - RNA, 64 nt, Human
cgcccacccccugcccaccucuccaggcucugcucugcagcacacccgugggugaccccucacc

SEQ ID NO: 43837 - RNA, 64 nt, Human
ucaggucagcucacugagcuggguguaggaggggcugcagcagaggccugaggaguggcaggaa

SEQ ID NO: 43838 - RNA, 64 nt, Human
ugaaaaacacugaagugcuuuucaugaagcacagcugcagcaaagccuugcaaucccaggcugg

SEQ ID NO: 43839 - RNA, 64 nt, Human
cggagggcagggcccacccugcggugucgcgcgccugcagcacgccccacguccagguggcagg

SEQ ID NO: 43840 - RNA, 64 nt, Human
aucgcaauuacuuaaauuuauuuuuuugaaacagcugcagcaagaguuggcacuuauucagaug

SEQ ID NO: 43841 - RNA, 64 nt, Human
gccgugucauuaugcaaagccucugaccaguuugcugcagcauuuacaucugcccuaaucagag

SEQ ID NO: 43842 - RNA, 64 nt, Human
aucugagacccuaaagcauuuaguccugcaauuccugcagcagagcaacuugugcaaguacuuc

SEQ ID NO: 43843 - RNA, 64 nt, Human
ucacucugcagagccaacgggcuugccaggccgacugcagcagcuccagcuuccaguugccuua

SEQ ID NO: 43844 - RNA, 64 nt, Human
accucgaaggcggaccagccugccucugugaugacugcagcagaccuccuuggguguaccaaug

SEQ ID NO: 43845 - RNA, 64 nt, Human
cugacagaccuggacuguguggcugaagggggaccugcagcacugcagaaaugccucugcgugg

SEQ ID NO: 43846 - RNA, 59 nt, Human
aggcacaggaccucuacugaggguggccacugcagcaccugccacugccgucaccucuc

SEQ ID NO: 43847 - RNA, 64 nt, Human
caucuggcggccaagugaggaaaagacacccugucugcagcacccagaacugaggaggggcacu

SEQ ID NO: 43848 - RNA, 64 nt, Human
gugccgccagugguccaaggagggagacagagggucgucccaacagggggagguagggcuuuga

SEQ ID NO: 43849 - RNA, 64 nt, Human
ggcaggggauggggugggguaccggauuucgguaucgucccagacccaagugagucacgcuucc

SEQ ID NO: 43850 - RNA, 64 nt, Human
uuaaugugcuuuuuuuguauaaagugcaaacauuucgucccaaagucuaaguacuuuagugcag

SEQ ID NO: 43851 - RNA, 64 nt, Human
gccgugcagacgaccuugguucacuuuucaggggucgucccaacucuguaucuccagccacucc

SEQ ID NO: 43852 - RNA, 64 nt, Human
cucagcuuugcgugugcccagccgugugcacagcucgucccaacuccugcggguggcaccugcc

SEQ ID NO: 43853 - RNA, 64 nt, Human
acccuggcgccaggaaggagcauguguuagcgucucgucccaccuggaauuguaauaaauacau

SEQ ID NO: 43854 - RNA, 64 nt, Human
aagaaaaucuuuuuuaguuauuuguuuguuuacuucgucccaugugcuaacuaucuuauauaua

SEQ ID NO: 43855 - RNA, 64 nt, Human
gauugcaaauggcuucagaggucaccaaguucagucgucccaaaacauggguguguuucaaaau

SEQ ID NO: 43856 - RNA, 64 nt, Human
ggggccaucagggcuaaccacuucacaccuaccaucgucccauggggauccaagaccugagaua

SEQ ID NO: 43857 - RNA, 64 nt, Human
cucucagccuggcagauguggaaacucaaauuucucgucccacuccagguuuuggcuagccaac

SEQ ID NO: 43858 - RNA, 64 nt, Human
ccaguucuuugggcugggucaaggcaaagcucagucgucccagcagcaccucagccaucuguag

SEQ ID NO: 43859 - RNA, 64 nt, Human
gcccucagauuccacaaagccucucuccccucccucgucccacccccacccaggcaggaagccc

SEQ ID NO: 43860 - RNA, 64 nt, Human
gccagcuggcaccugccucuaucccagacugcccucgucccagcucucuguccaacuguugauu

SEQ ID NO: 43861 - RNA, 64 nt, Human
aacgcugcaguuccuuuaugaagaggcuuuucugucgucccaggcuagcagagauggauagcuu

SEQ ID NO: 43862 - RNA, 64 nt, Human
ugucuccagccuggcucuaucuuccuccuugugaucgucccauccccacaucccgugcaccccc

SEQ ID NO: 43863 - RNA, 64 nt, Human
cacacaggccuccagcugggccaugucagucucaucgucccaaggcuugaaauccagcaggaug

SEQ ID NO: 43864 - RNA, 64 nt, Human
gugucuagggguucugccuggucaacguuauuugucgucccaucuuuuggcagcaaaaccaccu

SEQ ID NO: 43865 - RNA, 64 nt, Human
ccccagccaugcggccaccccuuagcacaccugcucgucccauuuagcuuacccucccaguugg

SEQ ID NO: 43866 - RNA, 64 nt, Human
gcaggcugcaggagggcacuggagcugggaggucucgucccagcccuccccaucucggggcugc

SEQ ID NO: 43867 - RNA, 64 nt, Human
gggcacccuggccacccugguccuuggauccccuucgucccaccugguccaccccagaugcuga

SEQ ID NO: 43868 - RNA, 64 nt, Human
ggugaaagcauuucuuaugguucccugagucaguucgucccacacauccucccugaggcaccug

SEQ ID NO: 43869 - RNA, 64 nt, Human
guugccuuccugaaggugaccaagcuuccaaagcucgucccacuggccucuguacauuucccug

SEQ ID NO: 43870 - RNA, 64 nt, Human
cuccgcccgccgggcucugcguccccacguccccucgucccauccccacguccccucaucccgu

SEQ ID NO: 43871 - RNA, 64 nt, Human
cuccugacuggggcuugcgacucacaggauugcaucgucccagcugcuaacuuggggccggggc

SEQ ID NO: 43872 - RNA, 64 nt, Human
cuccuggugacagguggcaccugucccacagcccucgucccauguggaacuuaccauugggauu

SEQ ID NO: 43873 - RNA, 64 nt, Human
aagugcuggacugcaggcugcagugaucccucuuucgucccacccccucuucccucagcagccc

SEQ ID NO: 43874 - RNA, 64 nt, Human
ugccagucagccgaggauguaguuguugcugccgucgucccaccaccucagggaccagagggcu

SEQ ID NO: 43875 - RNA, 64 nt, Human
uuauuuuucucuuuccuacuccuauuaaagaaccucgucccaguguuuccugcuuaagccuggu

SEQ ID NO: 43876 - RNA, 64 nt, Human
auauugaauacugacaagagaauacccauacaaaucgucccaccgcccuagaggccacagaauu

SEQ ID NO: 43877 - RNA, 64 nt, Human
uuucucuccaaccagggcagaaaggagggaggauucgucccauuacaauaaugaaauaaugaua

SEQ ID NO: 43878 - RNA, 64 nt, Human
uucuuuuacuguuauagaauagccugagguccccucgucccauccagcuaccaccacggccacc

SEQ ID NO: 43879 - RNA, 64 nt, Human
caaaaaauuagccgggugugguggugggcaccugucgucccagcuacuagggaggcugaggcag

SEQ ID NO: 43880 - RNA, 64 nt, Human
uaugagacaggcacuggcugaagacaggcaacucucgucccaaccaucauucacccugagugac

SEQ ID NO: 43881 - RNA, 64 nt, Human
aggaucuccagccucccagaagccugcugugcuuucgucccacagcuuucugcccauuguuucu

SEQ ID NO: 43882 - RNA, 64 nt, Human
ccagguucacugaggggcccuggucuccccgcagucgucccaggcugccggcuccccucgacag

SEQ ID NO: 43883 - RNA, 64 nt, Human
acaggcucuagagagagggagaaacaaguggaccucgucccaucuucacucuucacuugaguug

SEQ ID NO: 43884 - RNA, 64 nt, Human
auuccuggcuucauuuuuugcugaugguucccccucgucccaaaucucucucccaguacaccag

SEQ ID NO: 43885 - RNA, 64 nt, Human
gugccgaugcucuggcccuccccaauacgcugcuucgucccacugcaccgccuggcugagggcg

SEQ ID NO: 43886 - RNA, 64 nt, Human
gagugccgaccuuggguggcggggccugggucucucgucccacccggagggcacagacaccggc

SEQ ID NO: 43887 - RNA, 64 nt, Human
gaccauggaccucuuuuguuuguauguuguauugucgucccaacggaaggagagcuccugacuc

SEQ ID NO: 43888 - RNA, 64 nt, Human
auagcaaaggucuucuucccucgccccuucuccaucgucccaggaaucccagggggcagcacag

SEQ ID NO: 43889 - RNA, 64 nt, Human
uccguaggaaaaagucggaaugcucucgacggccucgucccagccugggacaggcccccuuucc

SEQ ID NO: 43890 - RNA, 64 nt, Human
gggcaucagggugagguccgggacucuugggucaucgucccacaguggcugaucggcugccaag

SEQ ID NO: 43891 - RNA, 64 nt, Human
agguuuuugcgaaccccagaagagaccaaaggagucgucccaggcuccucgcgccucaggugga

SEQ ID NO: 43892 - RNA, 64 nt, Human
aauuaaaaaacacguguagcuguggguaaggaagucgucccauuuuauggauguggaaacugag

SEQ ID NO: 43893 - RNA, 64 nt, Human
aauuugcuggaguguucaccuguuguuaucugugucgucccacugagugcauucaccaccuuuu

SEQ ID NO: 43894 - RNA, 64 nt, Human
gaacccgggagguggagguugcagugagccgagaucgucccacugcacuccagccugggcaaca

SEQ ID NO: 43895 - RNA, 64 nt, Human
uugugggacucaccugacucaaagaugacuaauaucgucccauuuuggaaauaaagcaacagac

SEQ ID NO: 43896 - RNA, 64 nt, Human
acuggggacuaagguugcaggccuuagccucgucucgucccagaggcauuggaucaggagaaug

SEQ ID NO: 43897 - RNA, 64 nt, Human
gaacccuggagguggagguugcagugagcugagaucgucccacugcacuccagcccgggcaaca

SEQ ID NO: 43898 - RNA, 64 nt, Human
uccuggagcagccugggcccuucagccccugugcucgucccacccuagggacucagccacuugc

SEQ ID NO: 43899 - RNA, 64 nt, Human
gggaggacagcucuggcccuucuuaggccuagccucgucccaagcuaaauguaagccaguuggg

SEQ ID NO: 43900 - RNA, 64 nt, Human
ggggagaaagggaagucaggguucuagggguuauucgucccaggaaauagaagugaaauugucu

SEQ ID NO: 43901 - RNA, 64 nt, Human
ucagguuugagucaggaggcucccuguacuggagucgucccacuauuccucaagaaaucuuaga

SEQ ID NO: 43902 - RNA, 64 nt, Human
caacaaaagggcaacucagggaaccuacagccccagccgucaggagaaggagggcucccgagug

SEQ ID NO: 43903 - RNA, 64 nt, Human
ucuggaagcucauaggguugugaggcaaacuuccagccgucagggucucagcuaagcagaaggu

SEQ ID NO: 43904 - RNA, 64 nt, Human
aaucuuauuuauccuuauauuuucuaaauugccuagccgucacaccccaagauugccuugagcc

SEQ ID NO: 43905 - RNA, 64 nt, Human
cuguggccucuuggucgcccuuucuuaccaucugagccgucagagcagugacccaucuguacuc

SEQ ID NO: 43906 - RNA, 64 nt, Human
cgcgagcuggccugacgccucaagcacgggcaccagccgucaucuccggggccaggggcugcag

SEQ ID NO: 43907 - RNA, 64 nt, Human
guaccaguggggccaggagguggcucuggcucagagccgucaguguggcugaauaaaggcucuc

SEQ ID NO: 43908 - RNA, 64 nt, Human
gaaaaucaugccgcucaguuccuggagacagaagagccgucaucagugucucacuugugauuuu

SEQ ID NO: 43909 - RNA, 64 nt, Human
agaagacuucaaaccauuuaacugguuucuuaagagccgucaaucagccugguuuuggggaugc

SEQ ID NO: 43910 - RNA, 64 nt, Human
gaacugaagcugcccuggcaagugaggaaccaggagccgucacugaguguggcugggcuacauc

SEQ ID NO: 43911 - RNA, 64 nt, Human
cauuuauggucaacacuuaaggguuuuagaaaacagccgucagccaaauguaauugaauaaagu

SEQ ID NO: 43912 - RNA, 64 nt, Human
cagggcaccgccugccgagcagagaaggcacagcagccgucagaguccaugagaggugaaacca

SEQ ID NO: 43913 - RNA, 64 nt, Human
gugugagcagcacgcaaagugucacgugggccuuagccgucacccaccagcuuccucaccaggc

SEQ ID NO: 43914 - RNA, 64 nt, Human
ccgggaggcaggcuccaggccucagcaggugcggagccgucacugcaccaagucucacuggcug

SEQ ID NO: 43915 - RNA, 64 nt, Human
cugccccacugccccucccccuguuccugccccaagccgucaaucagauuguggagcaguacac

SEQ ID NO: 43916 - RNA, 64 nt, Human
agcucugugccaagggcaaccuagguaaaacgaaagccgucaggggcagugggcggcuucccgg

SEQ ID NO: 43917 - RNA, 64 nt, Human
gggcuccagggacuggaguguaaugcucggugggagccgucagccugugaacugccaggcagcu

SEQ ID NO: 43918 - RNA, 64 nt, Human
ucugccucuguggauccacagccuggcagagccgagccgucaccugauuuuucaguguuucuac

SEQ ID NO: 43919 - RNA, 64 nt, Human
agugcugagauuacaggugugagccacccugcccagccgucaaaagagucuuaauauauauauc

SEQ ID NO: 43920 - RNA, 64 nt, Human
ccaaggaaagacacaagccccaggaagaacucagagccgucauggguagcccacgccguccuuu

SEQ ID NO: 43921 - RNA, 64 nt, Human
gcuuaucaauauuaagucuuuuaccuaaaggcccagccgucaccagacaacagaauaaucaauc

SEQ ID NO: 43922 - RNA, 64 nt, Human
gcacccagcggaaugugcuuaguauuuggucaccagccgucauccugggcuuuuccuacugugu

SEQ ID NO: 43923 - RNA, 64 nt, Human
agaggggcgagggagaggcuuuugcugugagaguagccgucacgugucucuucccagcagcgcc

SEQ ID NO: 43924 - RNA, 64 nt, Human
caggaaggcauccacgagggagcuccuggccagcagccgucauccucucggaccagccagcugg

SEQ ID NO: 43925 - RNA, 64 nt, Human
acccuccccacuagccuucugagcauuuaaacccagccgucauucucuccccacuccacgcucc

SEQ ID NO: 43926 - RNA, 64 nt, Human
uuggcauccggagacuuuccccucgacccaguggagccgucaggccggagccucagagccuuga

SEQ ID NO: 43927 - RNA, 64 nt, Human
ugugcuuucacuucccaggcuccaugugucuuggagccgucaccccgaggcucccucuuuaggu

SEQ ID NO: 43928 - RNA, 64 nt, Human
uagcacccugcccucaugggaccugcccucccucagccgucagccaucagccauggcccuccca

SEQ ID NO: 43929 - RNA, 64 nt, Human
gcagcuggugcucugugucuucgcuuccaccgacagccgucagacaucaggcuccccggccacc

SEQ ID NO: 43930 - RNA, 64 nt, Human
ccaggauguccaucagccacucgccagggcacggagccgucaguccacuguuacgggagaaugu

SEQ ID NO: 43931 - RNA, 64 nt, Human
agaaaugcacuuuuuuuuucccugaaguuuuaggagccgucacuaaaacauuagucuugugauu

SEQ ID NO: 43932 - RNA, 64 nt, Human
ccauuucugaggucuccaccauccaaggaggcacagccgucauuacuguccuccaugccuucag

SEQ ID NO: 43933 - RNA, 64 nt, Human
gcgccuccgagggacgcggcucccggggcagggcagccgucaccccugccucccgcccccuugg

SEQ ID NO: 43934 - RNA, 64 nt, Human
agucugacugcaguuuuugcuuaugauuuguaaaagccgucauggggucaauaagaaaauaggg

SEQ ID NO: 43935 - RNA, 64 nt, Human
ugccugggacucccuggcaacccagcaccggggaagccgucagcugcugugacaauaaaaccug

SEQ ID NO: 43936 - RNA, 64 nt, Human
aggcuccggcugccccagauuggcagcaaaaauaagccgucaaguaguaagaagaacuuggaug

SEQ ID NO: 43937 - RNA, 64 nt, Human
aacugcuugaacccaggagguggagguugcagugagccgucaucgcgccacuaagccaagaucg

SEQ ID NO: 43938 - RNA, 64 nt, Human
uaccuucagaacauacucuaauaaugcagccaggagccgucagccagaucccaaaugagugccu

SEQ ID NO: 43939 - RNA, 64 nt, Human
gaaugaggcagacaccaggccacucuagaagccgagccgucacaccucaggcgugugcggggcg

SEQ ID NO: 43940 - RNA, 64 nt, Human
cugggcccccagauggcgagcagcaccaccuccaagccgucaucaucauccucaggacccagga

SEQ ID NO: 43941 - RNA, 64 nt, Human
gggagaaaccguaucaauguaagcaaugugggaaagccgucagaucagccucaagacuucaaau

SEQ ID NO: 43942 - RNA, 64 nt, Human
agugggggaguucuggcuccccaaccuaaccccuagccgucaucuccacacucaccaggcccac

SEQ ID NO: 43943 - RNA, 64 nt, Human
ugugugugcugcaagugaccccgaaaacaaccacagccgucacaugguccuccugaaguugggg

SEQ ID NO: 43944 - RNA, 64 nt, Human
caagcugaccgcacagcagucuggcuugauuuucagccgucaucauuggguucuguuuugacag

SEQ ID NO: 43945 - RNA, 64 nt, Human
gccagaaauggguuuucgggacuugccccagggaagccgucaccggcccggcccaucauguuuu

SEQ ID NO: 43946 - RNA, 64 nt, Human
cuccugaggggguacaggagaggccgcugcugccagccgucauauaaaacuauuuauucauaaa

SEQ ID NO: 43947 - RNA, 64 nt, Human
accuguaaggacaggaucugcccuguaaggggccagccgucaggaaucuggccaugaaaaccuc

SEQ ID NO: 43948 - RNA, 64 nt, Human
uggggcugaucacuuaguuuuuggccucugcugcagccgucauacuguuccaaauguggcagcg

SEQ ID NO: 43949 - RNA, 64 nt, Human
gccauggucagagggggaugucaacaacagaucaagccgucaucacaacagguauuucugaagu

SEQ ID NO: 43950 - RNA, 64 nt, Human
agcccaggguugagcauccugaaggagccacugcagccgucacuguccccagagccuguggaga

SEQ ID NO: 43951 - RNA, 64 nt, Human
gggaggaaggaggcacagaccggggaaauaugacagccgucauuuccaguauucucuguguugu

SEQ ID NO: 43952 - RNA, 64 nt, Human
cuccuuugaggcaggcgaggggcugggaguggguagccgucauguugucccccgugggauccca

SEQ ID NO: 43953 - RNA, 64 nt, Human
uuuguuuggugaagggccccugcagacaucaaacagccgucauguaucauugguuugaggugaa

SEQ ID NO: 43954 - RNA, 64 nt, Human
ugggagcagaacagucccucacaccugggcccgggcaggccagcuucgugcuggaggaacuugc

SEQ ID NO: 43955 - RNA, 64 nt, Human
gagccaccaaucaaagagauucaaagagauuccugcaggccagaggcggaacacaccuuuaugg

SEQ ID NO: 43956 - RNA, 64 nt, Human
agugcccuccacagccgcagccucccucugaccugcaggccaagagcagaggcagcgaguugug

SEQ ID NO: 43957 - RNA, 64 nt, Human
cauggugugaaagucagaugcccagagggcccaggcaggccaccauauucagugcuguggccug

SEQ ID NO: 43958 - RNA, 64 nt, Human
auuccuaaccuaaccuuagagucccucccccaaugcaggccacuucuccucccuccucucuaaa

SEQ ID NO: 43959 - RNA, 64 nt, Human
gguugggugggugggaaggucucuuuaaaauggggcaggccacacccccauuccgugccucaau

SEQ ID NO: 43960 - RNA, 64 nt, Human
guugugacucuggugagagaggaguuggccuagagcaggccacugugagcucagcacagaguag

SEQ ID NO: 43961 - RNA, 64 nt, Human
uggaagagauaggaaugaguucuuaucuaguguugcaggccagcaaauacagaggugguuuaau

SEQ ID NO: 43962 - RNA, 64 nt, Human
cagggcgacaggcccggggcuacgcgaagaagucgcaggccaagauucuuuacaguuugagaaa

SEQ ID NO: 43963 - RNA, 64 nt, Human
ucugaucuaagcaaacaacucccagcugaggaaugcaggccacagcacccaaucaagacaaauu

SEQ ID NO: 43964 - RNA, 64 nt, Human
ugucugcacucacggcacacacacuuuguaucaugcaggccacacucagagcuagucaguacau

SEQ ID NO: 43965 - RNA, 64 nt, Human
gugcuucauuuuucgugcccgccccgcgccccgggcaggccagucauguguuaaguugcgcuuc

SEQ ID NO: 43966 - RNA, 64 nt, Human
ccgcagugguggagaguucuaauguugacuguuugcaggccaaaagaugauugcuuuauaauuu

SEQ ID NO: 43967 - RNA, 64 nt, Human
gcuguccuagcagugcacuggcgggucucuccaugcaggccacaacacagggucaguguucacc

SEQ ID NO: 43968 - RNA, 64 nt, Human
gaggaccccagaaucuggaccccagagucuggaagcaggccagaaaggauaaggcaaaugacug

SEQ ID NO: 43969 - RNA, 64 nt, Human
gggaaaggcccaagguauccaagccuggggaagggcaggccagccagcaccucugccuucucag

SEQ ID NO: 43970 - RNA, 64 nt, Human
cacucgaggccugcaaaccuuccugggaggacaggcaggccagauggccccuccacuggggaau

SEQ ID NO: 43971 - RNA, 64 nt, Human
guggggugggcaauuuccauuuuaaagaguguaggcaggccaggugcaguggcucaugccugua

SEQ ID NO: 43972 - RNA, 64 nt, Human
gcugauuugaggccuccuucuggggcugggcucugcaggccagguggguguggccuguguuuuc

SEQ ID NO: 43973 - RNA, 64 nt, Human
uauuuguaauaaacucuaucugcugaaagggccugcaggccauccugggaguaaagggcugccu

SEQ ID NO: 43974 - RNA, 64 nt, Human
aacccccuuagguaccugugcgaggcuguggagugcaggccagagcagggugugcguagccccc

SEQ ID NO: 43975 - RNA, 64 nt, Human
cgccgggggccgucccaaaccucgcagggcuccagcaggccaaccggcaccacggacuccuggg

SEQ ID NO: 43976 - RNA, 64 nt, Human
ccuaggaccgccggcgccuccccacggacgccaggcaggccaggccgcucuccggggccgcagc

SEQ ID NO: 43977 - RNA, 64 nt, Human
uccucccaaacuagggcccuccacucuauccagggcaggccagggacucccuggccugacacau

SEQ ID NO: 43978 - RNA, 64 nt, Human
ccaagcccagcccauggagauugaccuggauggggcaggccaccuggcucucaccucuaggucc

SEQ ID NO: 43979 - RNA, 64 nt, Human
gaaaugauuuucauuauugaaacuguucucccuagcaggccauuuucccuuuuuccugggaguu

SEQ ID NO: 43980 - RNA, 64 nt, Human
caucuaccauuuucugguucuuguguuggcuguggcaggccagcugugguuuucuuuugccaug

SEQ ID NO: 43981 - RNA, 64 nt, Human
uucuugggucuuugggguugaagggagggggaaggcaggccagaagggaauggagacauucgag

SEQ ID NO: 43982 - RNA, 64 nt, Human
acauuuagcgugaugaaauaaagcaucuacgucagcaggccauacuguguuggggcaaaggugu

SEQ ID NO: 43983 - RNA, 64 nt, Human
agccaguggaaaauggaugugacaaccccagugcgcaggccagagugagugagcccagcacggc

SEQ ID NO: 43984 - RNA, 64 nt, Human
uggcucugcagaaggugugggccuucugcuuacugcaggccaccugccaggguucucuggcauc

SEQ ID NO: 43985 - RNA, 64 nt, Human
ccccgcccugugguuggaaucgaugccacggauugcaggccaaauuucagaucguguuuccaaa

SEQ ID NO: 43986 - RNA, 64 nt, Human
gugccagcuugccuccauccuuuucacauauuaugcaggccaauugacauauaauuuguucuua

SEQ ID NO: 43987 - RNA, 64 nt, Human
ccuagaccacuuuguaugaccguuugcagucugagcaggccaggggcugacagcuaaugucagg

SEQ ID NO: 43988 - RNA, 64 nt, Human
acaaacagcacuccaggccagcucaagaagcaaagcaggccaauagaaaugcaauauuuuuaau

SEQ ID NO: 43989 - RNA, 64 nt, Human
cugccucugggugaguggcugacagagcaggucugcaggccaccagcugcuggaugucaccaag

SEQ ID NO: 43990 - RNA, 64 nt, Human
agaguucuuuaggugccuccugucuuauggcguugcaggccagguuaugccucaugcugacuug

SEQ ID NO: 43991 - RNA, 64 nt, Human
ugaaguaaaaguacaacagcuugaaguguugauagcaggccacagcccucuaacucaugugauu

SEQ ID NO: 43992 - RNA, 64 nt, Human
uuaaugguaacugaccaguguuacccugagccccgcaggccaacccauccccaguugagccuua

SEQ ID NO: 43993 - RNA, 64 nt, Human
uggacccucccuccccaaguggacacauggcugugcaggccaggaggcccacagauggacugag

SEQ ID NO: 43994 - RNA, 64 nt, Human
gcaagaagcccaugggccaggguguggccugagggcaggccagagcugaggggcugcuccugcu

SEQ ID NO: 43995 - RNA, 64 nt, Human
ggcuccuggggagauauaucugccuucuaagaaggcaggccaggucuugggcacagaccugcau

SEQ ID NO: 43996 - RNA, 64 nt, Human
guugugcgcacaucgcgguagggcguggaaaggggcaggccagagcuacccgcagaguucucag

SEQ ID NO: 43997 - RNA, 64 nt, Human
agaugccauccaggauguacaaggugcagccaaggcaggccaugcaggggccgggccugucugc

SEQ ID NO: 43998 - RNA, 64 nt, Human
ggcuugcuccuggcuugugacgcuauaagacagagcaggccacauguggccaucugcuccccau

SEQ ID NO: 43999 - RNA, 64 nt, Human
cccgugucugugggagcgggcacagguccaugcugcaggccacuacggcugcucggcaggaggg

SEQ ID NO: 44000 - RNA, 64 nt, Human
uaguccuugaaacugagccccauucugaaucccugcaggccaagucauugcucagccaggacuc

SEQ ID NO: 44001 - RNA, 64 nt, Human
agccugggcccaccugcuucugggggguuggggagcaggccagauggaggugguggugccagga

SEQ ID NO: 44002 - RNA, 64 nt, Human
cccugaaguuccaucuccgagaguggugugcagggcaggccagggcccaugcuggcugcagucu

SEQ ID NO: 44003 - RNA, 64 nt, Human
acaaauguguaauaucauauuugacuuugcuuaugcaggccauaaguuccaaaagauaauuucc

SEQ ID NO: 44004 - RNA, 64 nt, Human
ggccauaggagggcuuccugcagcugagaucuaugcaggccauccucucaacaagugccacucc

SEQ ID NO: 44005 - RNA, 64 nt, Human
agggagaauguugacuuagaagcaauagggggcagcaggccaccaagagcacaaccccagggcg

SEQ ID NO: 44006 - RNA, 53 nt, Human
aaaaagaguauuucauuuaagaugcaggccaagauucugaguuuuacuaccag

SEQ ID NO: 44007 - RNA, 64 nt, Human
gcagacuccuuguugcuuaagaguggcuuucuaggcaggccacuggcaucugaauucaucauug

SEQ ID NO: 44008 - RNA, 64 nt, Human
caguaucuuccacugccccaucuguuggccaccugcaggccagucucaacccucccccaggugg

SEQ ID NO: 44009 - RNA, 64 nt, Human
uagauguauucacuacagaauccuacauuuuucagcaggccacaguccagccaaauccuauaau

SEQ ID NO: 44010 - RNA, 64 nt, Human
caccaggggcucugaacugcagcugauguuaucagcaggccaugcauccugcugccaagggugg

SEQ ID NO: 44011 - RNA, 64 nt, Human
cugggggagcugcagauggcccuggagugggcaggcaggccagggcugcgcaucaguggacaca

SEQ ID NO: 44012 - RNA, 64 nt, Human
ccccacucauccagccccagaucugagccuugacgcaggccaaguggaaaaauacuuucccgcc

SEQ ID NO: 44013 - RNA, 64 nt, Human
cuguuuuuccuggaagaagaaaaaaaaagguuuggcaggccaucuuuuuuuguacuuaaaagua

SEQ ID NO: 44014 - RNA, 64 nt, Human
cucgccucgguugcggaccuaggaccauuucucugcaggccacuuaccuuccccugagucaggc

SEQ ID NO: 44015 - RNA, 53 nt, Human
ugcuggugugcaacacguagcgagcaggccacagccuggccucgggaaggugg

SEQ ID NO: 44016 - RNA, 64 nt, Human
cagucaacaggaugggccuggagauccgugaacugcaggccacguacccaugacguaaacggcg

SEQ ID NO: 44017 - RNA, 64 nt, Human
cuucuaacuucugugguuugagaggaugaacccugcaggccauguccacaguucugagaggcca

SEQ ID NO: 44018 - RNA, 64 nt, Human
ucucgucuccuguguguaugugugugaguggugggcaggccaguggcagggccggccccagccc

SEQ ID NO: 44019 - RNA, 64 nt, Human
agcaggaaucaggagcucgguggauuugcagguggcaggccagggauuuguaccaugggacuug

SEQ ID NO: 44020 - RNA, 64 nt, Human
ugugcuguguugucauucaaggacuuccucuccugcaggccaacugaaauaccagaaaaugaca

SEQ ID NO: 44021 - RNA, 64 nt, Human
ccagacaccccacaugucgguggauuggagaggggcaggccacugcccucuccaggaccaagcc

SEQ ID NO: 44022 - RNA, 64 nt, Human
ucagaucuguaauucucccaggagcugugauagagcaggccacacaaagucccuacgccucccu

SEQ ID NO: 44023 - RNA, 64 nt, Human
ucugguggcaggagaagagaggcccagcacagcagcaggccaggccuuccuguccaggucugca

SEQ ID NO: 44024 - RNA, 64 nt, Human
agggcugcgucgguuuguggucuagcucccaggggcaggccaggcauggcucagugcagucccu

SEQ ID NO: 44025 - RNA, 64 nt, Human
gaaugaggacucccuggagagggacacgcgagaggcaggccaggcugcaccaccccaagagcca

SEQ ID NO: 44026 - RNA, 64 nt, Human
acagcuacgaugggaugggaacaguggacccuaagcaggccaagggugcguagggacgguggua

SEQ ID NO: 44027 - RNA, 64 nt, Human
gcaaaaccugaagugucuucaugugcauucucuggcaggccacaguccugagcuuguaagaugg

SEQ ID NO: 44028 - RNA, 64 nt, Human
aaaugaaccguuuugcagcugcgcagucuaaagggcaggccagugucuggaagcagggcccacg

SEQ ID NO: 44029 - RNA, 64 nt, Human
aaacugggauauuucagcuucauuauuuccacuugcaggccagcuuaaccucugaaacacaaau

SEQ ID NO: 44030 - RNA, 64 nt, Human
cacgguggcucacaccuguaaucucagcacuuuggcaggccaaggcagguggaucaccugaggu

SEQ ID NO: 44031 - RNA, 64 nt, Human
gugucagaaccuagggcugggcucucggggccaggcaggccagcccagcccacgccgagcuggg

SEQ ID NO: 44032 - RNA, 64 nt, Human
aacgaagccaggcugagggcaagaggcccgacaggcaggccaggguccccggagaagccggauu

SEQ ID NO: 44033 - RNA, 64 nt, Human
gaacccacccguugaguuuguggguaaccagcaggcaggccaaagacuggugcuuuucauuuca

SEQ ID NO: 44034 - RNA, 64 nt, Human
acagcgccuucccuucaggaguugcgucuccucugcaggccacgauggucugcucuggagcauu

SEQ ID NO: 44035 - RNA, 64 nt, Human
uccuuugguauauagucucgcauauuauauuauagcaggccaagauaaaauuuugacagcucuu

SEQ ID NO: 44036 - RNA, 64 nt, Human
caaaccucagccuggaggcacuuuuccagugaaagcaggccaggugcgguggcucacgccugua

SEQ ID NO: 44037 - RNA, 64 nt, Human
agugcuguccaauagaaacacaacagccacaaaugcaggccacagaugcaaauauuuaacuucc

SEQ ID NO: 44038 - RNA, 64 nt, Human
caggaugauuauaggacaaguuguucauaauccagcaggccagaagacuuccagggaaacucau

SEQ ID NO: 44039 - RNA, 64 nt, Human
uagaaaguugcaaggcaaauguuuauuuaaaagagcaggccaggcgcgguggcucacgccugua

SEQ ID NO: 44040 - RNA, 64 nt, Human
cuugucaauccauggagcugguucacuguaacuagcaggccacaggaagcaaagccuuggugcc

SEQ ID NO: 44041 - RNA, 64 nt, Human
cuugaaccugucaccuggccugccacccuccugcgcaggccaugcauggcucccgaguacagua

SEQ ID NO: 44042 - RNA, 64 nt, Human
ugaugugugguguuuccugugguaaaagacugaggcaggccaggggucugccaguaacauguuc

SEQ ID NO: 44043 - RNA, 64 nt, Human
guuguuggcagaaauuaauucagaaaucaaaucugcaggccaaacaaggugcaggacccagcuu

SEQ ID NO: 44044 - RNA, 64 nt, Human
gccugaggagggaaagggggaguggccaggucaggcaggccagucgucuacacacccccuuggu

SEQ ID NO: 44045 - RNA, 64 nt, Human
ccaguguguuccugucauaguuugugucucccaggcaggccaugguaggggccucgcaggggcc

SEQ ID NO: 44046 - RNA, 64 nt, Human
cagcugugccaucgcgccucggucacccugcacagcaggccacagacucuccugucccccuuca

SEQ ID NO: 44047 - RNA, 64 nt, Human
ucuuuggucauuauguccugacaaccaacacccagcaggccacugaaauucaaaucacauuucu

SEQ ID NO: 44048 - RNA, 64 nt, Human
cauguguauacuugguggaauuguaaguggauuugcaggccagggagaaaauguccaaguaaca

SEQ ID NO: 44049 - RNA, 64 nt, Human; identical to SEQ ID NO: 44038

SEQ ID NO: 44050 - RNA, 64 nt, Human
uugcuccuaagcuucaaaucagaagcagaaacuggcaggccauggaccuuaauugucccucagg

SEQ ID NO: 44051 - RNA, 64 nt, Human
gcaccggaguucugcccaugggaaguaaacugcagcaggccacuggggacagaagggcccaugu

SEQ ID NO: 44052 - RNA, 64 nt, Human
aaauaccuugacugcuugugagaccauuagcauugcaggccaaaccguacuguauuuccuucuc

SEQ ID NO: 44053 - RNA, 64 nt, Human
guggaggaaugggcaagaaccaccucaugauucugcaggccauugcuaacgaacagcucauugc

SEQ ID NO: 44054 - RNA, 64 nt, Human
cucccuccuugggucauugaccucucagggccuggcaggccagugucuggguuuuucuuguggu

SEQ ID NO: 44055 - RNA, 64 nt, Human
ucuagucugaccccucucuccaccccugggcuaugcaggccagcccgugcagaccacccccgac

SEQ ID NO: 44056 - RNA, 64 nt, Human
guaaauaccccuggggccauggugggaugggggugcaggccagggaaacaacgggugggugggg

SEQ ID NO: 44057 - RNA, 64 nt, Human
cccaggcccaggugagacaggcaacgccaggucugcaggccaggagagaugcugcccaggccuc

SEQ ID NO: 44058 - RNA, 64 nt, Human
gaaguagaggggacgugagagaagggccaggccggcaggccaacccuccuccaauggaaauucc

SEQ ID NO: 44059 - RNA, 64 nt, Human
cuguuuauauucacguuuuccuaggugugugugugcaggccacagcagcaugcccuugguguag

SEQ ID NO: 44060 - RNA, 64 nt, Human
cccgcgcuccuuugcccugccgggccccaggauggcaggccaccugacucucaccucugugccc

SEQ ID NO: 44061 - RNA, 64 nt, Human
cuucuugucugauuuaugcccgugguuaaaaagagcaggccaguuuucgagauaaagaagauuu

SEQ ID NO: 44062 - RNA, 64 nt, Human
ucuccacucuuggcucugacugaucccugcuugugcaggccaguggaggcucuugggcuuggag

SEQ ID NO: 44063 - RNA, 64 nt, Human
acaaaacgaaugcucuaaauucugaggauuccaggcaggccauccauagagaaauaacuuuuuc

SEQ ID NO: 44064 - RNA, 64 nt, Human
aaaacacugcacaugcguccccucccaagugcuggcaggccacugugcaugcagacagcccgcc

SEQ ID NO: 44065 - RNA, 64 nt, Human
cccugggccagggcguggagagcccucagucggggcaggccaggggaggggugaagugguugcc

SEQ ID NO: 44066 - RNA, 64 nt, Human
uagucccugcuccucuuagaaucuucaccaaguggcaggccaccucugggcaggaccaccugcg

SEQ ID NO: 44067 - RNA, 64 nt, Human
agcuccucagcccacugaccucuccgugccuggugcaggccaggcccccgucuuccgccugccu

SEQ ID NO: 44068 - RNA, 64 nt, Human
gaauagaaauaauggcuuuugaaaaucgcacaaagcaggccaggcacgguggcucacgccugua

SEQ ID NO: 44069 - RNA, 64 nt, Human
acuccuagaucaagaccuauguaauggacaagcagcaggccaucaggaacucuuaauaucagca

SEQ ID NO: 44070 - RNA, 64 nt, Human
augauaaccaguuacuuacuucuuuuguuguuuugcaggccaccuagaaauacaaaaugccaau

SEQ ID NO: 44071 - RNA, 64 nt, Human
ccucaacaaccaggauuugcucgaucucagcccagcaggccaggcagacacaccccgcugugcc

SEQ ID NO: 44072 - RNA, 53 nt, Human
cugcugcgucccaggacugagacgcaggccagccccggccccuagcccucagg

SEQ ID NO: 44073 - RNA, 64 nt, Human
ugcccggaggaagcaaacucuucguauaaaaaaagcaggccaucugcuuaacccuuggcuccac

SEQ ID NO: 44074 - RNA, 64 nt, Human
cuuuucuuucaucaauccccuaucaguuagaacugcaggccaguuccaaagaguguuugcuuaa

SEQ ID NO: 44075 - RNA, 64 nt, Human
gucuacaaguagaugugcuagacaauggaaggaugcaggccaaccucuuugauuacaauugaga

SEQ ID NO: 44076 - RNA, 64 nt, Human
gagacggucucuacccauguuuaacccaaagagugcaggccagguuccuuauccuucugaugaa

SEQ ID NO: 44077 - RNA, 64 nt, Human
uugauuuccaauagcugaacuugggcagaaaacagcaggccaauguuccuaugugguuucuuug

SEQ ID NO: 44078 - RNA, 64 nt, Human
caacugcacagcaguugggcugcuuguuaaaaaugcaggccaggugcgguggcucacaccugua

SEQ ID NO: 44079 - RNA, 64 nt, Human
cacaguugcuggcuuugcuccugggcaaggaggagcaggccagagccucuuuugcuuccuuuuc

SEQ ID NO: 44080 - RNA, 64 nt, Human
gguggcugaccccaugcucagccucuaggggacggcaggccaucaggcugggggcugugcuaug

SEQ ID NO: 44081 - RNA, 64 nt, Human
gaacauugggccugaguggagaugggagacagaggcaggccagaagguucucucugcacagcug

SEQ ID NO: 44082 - RNA, 64 nt, Human
gggcugucuuaccauaacaccgucccagggcucugcaggccacugugagcgcuggcucccuggg

SEQ ID NO: 44083 - RNA, 64 nt, Human
gcauagaugaaauaacuguccugucacaugugcagcaggccauggaguguagcgggcaucgcug

SEQ ID NO: 44084 - RNA, 64 nt, Human
ugacgugugacaggucccugauccgccccagccugcaggccagaagcaguguuacacacuuccu

SEQ ID NO: 44085 - RNA, 64 nt, Human
acauauuuucuuuuguauccuggcaaauacuccugcaggccaggaaguauaauagcaaaaaguu

SEQ ID NO: 44086 - RNA, 64 nt, Human
uugauaagcuucgcgaguucuugagaguggaggagcaggccauucuggaugccauggccgagga

SEQ ID NO: 44087 - RNA, 64 nt, Human
uguccugcagugcucauucaucacuccaaaaacagcaggccaucuuuuuaugcaaaagucagcg

SEQ ID NO: 44088 - RNA, 64 nt, Human
aaaaaaguuuguuuuuucuuuauuguccuucauagcaggccaaguauugccucucugcaauaga

SEQ ID NO: 44089 - RNA, 64 nt, Human
cuuaaugaaccuuagaaagacuacauguuacuaagcaggccacuuuuaugguuguuuuucuugc

SEQ ID NO: 44090 - RNA, 64 nt, Human
caaaacugggaguucucaagugaaugcaaaaggagcaggccauaacuuuauuuguuagauacac

SEQ ID NO: 44091 - RNA, 64 nt, Human
cagccccaggggaccaugccggggugcugccugggcaggccauguuggggagacuccagcaccg

SEQ ID NO: 44092 - RNA, 64 nt, Human
gggcucuguccugcaccccucagggauggcgacagcaggccagacacagucugaugccagcugg

SEQ ID NO: 44093 - RNA, 64 nt, Human
gugccagaagagacaguagucugcauacaucgcugcaggccacagagcagcuuggguuggaaga

SEQ ID NO: 44094 - RNA, 64 nt, Human
ugagggggcugcuggcuuaacagcaggcaucugggcaggccaguccucaaagcagcuccugaag

SEQ ID NO: 44095 - RNA, 64 nt, Human
caaaagacagugaaggauucuuaucacauaaugugcaggccaugugccugugaacuugaaguuu

SEQ ID NO: 44096 - RNA, 64 nt, Human
gagcuguuagaggggcuucuccagaggcucgagagcaggccauuucccaagaagaugaagaaug

SEQ ID NO: 44097 - RNA, 64 nt, Human
aggacucaacugggacccacguggaaaagaccgagcaggccacagaggcucggucuccccgcgc

SEQ ID NO: 44098 - RNA, 64 nt, Human
cccugcccagcccccucgccgcccuugaccuccugcaggccauguguguauuacuugucuagug

SEQ ID NO: 44099 - RNA, 64 nt, Human
gguccaggugaugacugcaaagcaguguccaggagcaggccacuacugcccagagagcagagga

SEQ ID NO: 44100 - RNA, 64 nt, Human
acuuaggagaauguuccgauuuuccaugaucuaagcaggccacguuuaaaauaacaucaaggca

SEQ ID NO: 44101 - RNA, 64 nt, Human
cagcugguaaaguuggaagaauaaaguuaaccaagcaggccaggcacgguggcucacgccuaua

SEQ ID NO: 44102 - RNA, 64 nt, Human
uuccagggggcuguuuuguaaugagaugcugcuggcaggccacucagaggcucccagcuggguu

SEQ ID NO: 44103 - RNA, 64 nt, Human
uguaguggccacaaauaggccuaugauuuagcuggcaggccagguuuucucaagagcaaaauca

SEQ ID NO: 44104 - RNA, 64 nt, Human
gggugaaccucagcacucccacaccucccuuccagcaggccagugguuauggccagcacggcua

SEQ ID NO: 44105 - RNA, 64 nt, Human
cccagcucuacccugcauggcugagcugcccacagcaggccagguccagagagaccgaggaggg

SEQ ID NO: 44106 - RNA, 64 nt, Human
gagccagggcagagagagacuggacuugggaucagcaggccaggcaggucuuguccugguccug

SEQ ID NO: 44107 - RNA, 64 nt, Human
auucuaagucuaccaaaaaaaguuuuaaacucaagcaggccaaaaccaauaugcuuauaagaaa

SEQ ID NO: 44108 - RNA, 64 nt, Human
uggagguagagacggcccuuugagauggugcccagcaggccaaacccaccugccucugccagga

SEQ ID NO: 44109 - RNA, 64 nt, Human
auauucuccucugaaccacuagagggcaggccaggcaggccaggcgggcccgugcagcuugugg

SEQ ID NO: 44110 - RNA, 64 nt, Human
ccacugugaauauucuccucugaaccacuagagggcaggccaggcaggccaggcgggcccgugc

SEQ ID NO: 44111 - RNA, 64 nt, Human
ggauuaaagaaagucaggauaaaaauuuuaaaaagcaggccacugucagcaaagccuggagaag

SEQ ID NO: 44112 - RNA, 64 nt, Human
uccgccaacccagcagcuacuuugugcaguucccgcaggccaugcagcgcugccgugaccacau

SEQ ID NO: 44113 - RNA, 64 nt, Human
uucucccuggcauuguuuccacccccuggugccugcaggccacccagggaccacgggcgaggac

SEQ ID NO: 44114 - RNA, 64 nt, Human
ggucaguccucaucgcucccccuccccaccccgcgcaggccacugagacggugggacacacgcc

SEQ ID NO: 44115 - RNA, 64 nt, Human
ucuggagccacagucuggcgucugacccuucagugcaggccagccuggcagcuggaagccuccc

SEQ ID NO: 44116 - RNA, 64 nt, Human
aauggcuaacugaugaauuagaagccaucugacagcaggccacuagugacaguuucuuuugugu

SEQ ID NO: 44117 - RNA, 64 nt, Human
uaaggugcuuuucaaaagaguaacugaaauuguugcaggccaaaacagcaauaugauaucucag

SEQ ID NO: 44118 - RNA, 64 nt, Human
cacacagaaacauacauucgugccuggagacccugcaggccagaguccaaauauuuaacaauca

SEQ ID NO: 44119 - RNA, 64 nt, Human
uuccccaggaggaacgaggagagguggccacguggcaggccacagugcccuaugggcuuuucug

SEQ ID NO: 44120 - RNA, 64 nt, Human
augaccuuuugcugaaauaucaguuacugaacaggcaggccacuuugccucuaaauuaccucug

SEQ ID NO: 44121 - RNA, 64 nt, Human
gucccuuucagauauuuuaggauauucuagcaaagcaggccauuucucccaccugaaaguacau

SEQ ID NO: 44122 - RNA, 64 nt, Human
cucuaccuacuccgccuuuguccuuaagguuuuugcaggccagugccaaacacacacuaacugu

SEQ ID NO: 44123 - RNA, 64 nt, Human
cugcgugggucagaagaguugugcacgcagauuagcaggccaaggucugagccacagcagcauu

SEQ ID NO: 44124 - RNA, 64 nt, Human
ggggcagccugccgcagaugcacaggccccaggugcaggccaccaccuccgggucggcaccagg

SEQ ID NO: 44125 - RNA, 64 nt, Human
aaagacuguggucggggaaguggaaugcuucgaugcaggccagaguucaaggcucuggggcugg

SEQ ID NO: 44126 - RNA, 64 nt, Human
uauuuuacuaaguauauauuuacauuucacccaggcaggccauuuucuuuugugauuauaagaa

SEQ ID NO: 44127 - RNA, 64 nt, Human
auaaaacagacucaugacuuuuaagacaggacaagcaggccagaggcuuuuuuuuuaaucacag

SEQ ID NO: 44128 - RNA, 64 nt, Human
ggugcagguaguaucugccugcggggcuggggaggcaggccaaaggggcuccacaugagagguc

SEQ ID NO: 44129 - RNA, 64 nt, Human
ggaaggaggcccaguguugcagggaggcaggcuagcaggccacccucacucauguacucauucc

SEQ ID NO: 44130 - RNA, 64 nt, Human
gaaggccucaggauuaugguuaaccuggagaggagcaggccauggaggcaggugccaggucagu

SEQ ID NO: 44131 - RNA, 64 nt, Human
caaccaucuauauucaugagcucucaauuucauggcaggccauaguucuacuuaucugagaagc

SEQ ID NO: 44132 - RNA, 64 nt, Human
auuuuauucaucauagcucucugcuuugggcucugcaggccaccagauacacaugaggccccua

SEQ ID NO: 44133 - RNA, 64 nt, Human
gccugguucccccauguauagccauugcccucuagcaggccaggccucccagugggaaggccug

SEQ ID NO: 44134 - RNA, 64 nt, Human
gccgagaucuucuaccagcguagaguugacagaagcaggccagcgaggaggugugggacauaau

SEQ ID NO: 44135 - RNA, 64 nt, Human
uguguuugugccagagggauacacauauuaaacugcaggccaccuuccugguccagacuguacu

SEQ ID NO: 44136 - RNA, 64 nt, Human
cugcauuggguugaugacugucagcaucacugccgcaggccaugcuugacuaagguaccugguu

SEQ ID NO: 44137 - RNA, 64 nt, Human
cccuuccagaccaagcucaacgccuccaagaccagcaggccaaggccaagcccugccccagauc

SEQ ID NO: 44138 - RNA, 64 nt, Human
aacagagacacccugcggcaccagagccuucccagcaggccaggccgcugggcugggaucagug

SEQ ID NO: 44139 - RNA, 64 nt, Human
gaagccuuccggacaggcgcugcugccccgaguggcaggccagcucacacucugcugcacaaca

SEQ ID NO: 44140 - RNA, 64 nt, Human
agcugggcauuucaccugcugucacugacuuugugcaggccaaggaccuggcagggccagacgc

SEQ ID NO: 44141 - RNA, 64 nt, Human
ccccagacccaaagccaaguccaccagaguggcugcaggccaggccuggaguccccguggguca

SEQ ID NO: 44142 - RNA, 64 nt, Human
ccacgucccucaugcacaucacucaucuccugcugcaggccaaggccaaaauugggcuaguccu

SEQ ID NO: 44143 - RNA, 64 nt, Human
accccgacuuucucuaacccaguggcugugcggugcaggccacugacucccccccugcccucuc

SEQ ID NO: 44144 - RNA, 64 nt, Human
cgggggcguccuguagcuaugccagcggggcugggcaggccagccgggcauccugaccgauggg

SEQ ID NO: 44145 - RNA, 64 nt, Human
ugacucagccucccaaguagcugggauuacaggcgcaggccaccaugcccggcuaauuuuuugu

SEQ ID NO: 44146 - RNA, 64 nt, Human
uaaugcauaaauguuauauuuauauacaguuacagcaggccagaaacauacauacacugcaucc

SEQ ID NO: 44147 - RNA, 64 nt, Human
caacucagcacaggaaauaaguagaaacauuucagcaggccaccuccccucaucuuccccgccc

SEQ ID NO: 44148 - RNA, 64 nt, Human
cauugagcccagccuccagggcccgggcgcguuugcaggccaguggccacuguccgggcuguga

SEQ ID NO: 44149 - RNA, 64 nt, Human
ugagugcugggucaggguacuuggaugaaacggugcaggccaggcgggcccuaauaaaacccuc

SEQ ID NO: 44150 - RNA, 64 nt, Human
uugcaagcucccugccccagggagcucacgccaggcaggccagugggccuaagccagaaacaga

SEQ ID NO: 44151 - RNA, 64 nt, Human
gauccuggggccgaggcugcagcucagggcaacggcaggccaggucgugggucuccagccgugc

SEQ ID NO: 44152 - RNA, 64 nt, Human
uaaggcccccgggagacgcaggcaauggggccucgcaggccaggcuugcaccagcaugucuuga

SEQ ID NO: 44153 - RNA, 64 nt, Human
ccuaggcugccuccgggagcacuugagguaucccgcaggccaugaggacccacugggcagcucc

SEQ ID NO: 44154 - RNA, 64 nt, Human
ugugucacagggaaagccaggaguggccuucucugcaggccagcaagccugcagcagcaggugc

SEQ ID NO: 44155 - RNA, 64 nt, Human
ugacuccugugggcuccugagcuuacaaagcauggcaggccaagggccucgaccacaggccagc

SEQ ID NO: 44156 - RNA, 64 nt, Human
auagacauggauuuauaauggcauuuuauauuuggcaggccaucauagauuauuuacaaccuaa

SEQ ID NO: 44157 - RNA, 64 nt, Human
gccuuucccauuggucugcaugucuuuuaucauugcaggccaguggacagagggagaagggaga

SEQ ID NO: 44158 - RNA, 64 nt, Human
uccaagcagaucagcccagccuagcccagcucaggcaggccauggccgcucaagggaaagacug

SEQ ID NO: 44159 - RNA, 64 nt, Human
uguggugaauauagauggaauuaaggaaguaaaugcaggccaggggguugugaugagaggauag

SEQ ID NO: 44160 - RNA, 64 nt, Human
uaaccagcuaaccaugccuggcaucuggaagccagcaggccagaggguggcccaaaggcugaug

SEQ ID NO: 44161 - RNA, 64 nt, Human
cuguauuuaguguggcagaauaauaacaucaguggcaggccacugauuacuucaugacugccac

SEQ ID NO: 44162 - RNA, 64 nt, Human
cagacuugacuguuucuguagagcacuaucucgggcaggccauucugugccuuuucccucuguu

SEQ ID NO: 44163 - RNA, 64 nt, Human
agaagaaaugagcccucccucggcgaagccuccagcaggccacaccagcuguuucccaccugcu

SEQ ID NO: 44164 - RNA, 64 nt, Human
aagaauuaaugaccauucagaaauaaagcaaaaagcaggccacaaccuuaaccaacaccaaaga

SEQ ID NO: 44165 - RNA, 64 nt, Human
auuauugggaauuaacaucuuguaaaaacugggagcaggccagguacgguggcuaacgccugua

SEQ ID NO: 44166 - RNA, 64 nt, Human
cuuccucccuccaugcccacucccccugccuccagcaggccaggaagaaggcacaguccaggca

SEQ ID NO: 44167 - RNA, 64 nt, Human
gccugcugugcugggagguauagggguccugggggcaggccagggcaguugacagguacuugga

SEQ ID NO: 44168 - RNA, 64 nt, Human
acuuucuuuguaaaaggcugguuaguaaauuauugcaggccaccugugucuuugucauacauuc

SEQ ID NO: 44169 - RNA, 64 nt, Human
gucuacaguggaauagggggucucccuggggaaugcaggccaaguccuuuuauuuuaacaugau

SEQ ID NO: 44170 - RNA, 64 nt, Human
ugaagggugugcaggaguucgccagcaaagccaggcaggccaagacuugaguuggcaacucagc

SEQ ID NO: 44171 - RNA, 64 nt, Human
gcgcuuuggaugccgagagcgaguaucugauccagcaggccauccauggcaaccugcagaagca

SEQ ID NO: 44172 - RNA, 50 nt, Human
ugcuguugguuucuaaauaagcaggccagccgggcugugcaccuaaaugu

SEQ ID NO: 44173 - RNA, 64 nt, Human
ucaauaguuguuuuuuaaaauccaaaucagaggugcaggccaccaguuaaaugccgucuaucag

SEQ ID NO: 44174 - RNA, 64 nt, Human
ccgucucaaaaaaaaaaaaaaauuuaccuccuuugcaggccauaggacuagcccaacuaugaga

SEQ ID NO: 44175 - RNA, 64 nt, Human
aggacgugcagcagcauuggaaggcuggggccgggcaggccaggccaagccaagcagggggcca

SEQ ID NO: 44176 - RNA, 64 nt, Human
gucuguaucgccgugugcucaucacugaagaauugcaggccacucaugucagugaccagauuug

SEQ ID NO: 44177 - RNA, 64 nt, Human
cuaagcuucuggaaccacguaguuucuacacguggcaggccaagaaugggaggcugacucaaaa

SEQ ID NO: 44178 - RNA, 64 nt, Human
uagagggcuccucucagaugggcagcagcuuggagcaggccaggcagggccugggccauuggag

SEQ ID NO: 44179 - RNA, 64 nt, Human
aauuauuuagaacggggcaggcaaacuacauccugcaggccaaaucugucccaccaccuguuuu

SEQ ID NO: 44180 - RNA, 64 nt, Human
aagcuccggauggaggccagcuaagccacucggggcaggccagcaauaaaaacugucugucucc

SEQ ID NO: 44181 - RNA, 64 nt, Human
ggcucuucugucuguccugcuucuucaggugagugcaggccaaggcgggggugagauggcugag

SEQ ID NO: 44182 - RNA, 64 nt, Human
augggcuguauguccugccccaacuuggcccgcagcaggccagaccccccuacccccgcccaga

SEQ ID NO: 44183 - RNA, 64 nt, Human
uuucuguuagguucgggaacacgcuggggacagagcaggccagccagucugguggagcucagcg

SEQ ID NO: 44184 - RNA, 64 nt, Human
uguagaagaauaccucaugugcagaugcuagguggcaggccagucucauucaucugacuagcuc

SEQ ID NO: 44185 - RNA, 64 nt, Human
cugagucuacacccgugcuucaccagaagacccugcaggccaugaagagccacucagaaaaggc

SEQ ID NO: 44186 - RNA, 64 nt, Human
ugcucucgugccauuugagaggcugcugccccaggcaggccagccccuacuccucuuggcuaca

SEQ ID NO: 44187 - RNA, 64 nt, Human
ccagcagcagauguuacaaucugagugaggacaugcaggccaacuuuuacccuccugcauuugc

SEQ ID NO: 44188 - RNA, 64 nt, Human
ucucccagcagguagagcagagccggagccaggugcaggccauuggagagaaggucuccuuggc

SEQ ID NO: 44189 - RNA, 64 nt, Human
acagcucugugugugaaggugaggacucuuggaagcaggccauccuggccagacacccuagcag

SEQ ID NO: 44190 - RNA, 64 nt, Human
uccucugucacaccccauucuugccccucacugggcaggccauggccuacagcuugcagggagu

SEQ ID NO: 44191 - RNA, 64 nt, Human
gugcagaugaggugaagaucacugucaucuaaaagcaggccaccaaauuuaaaaaaaaaaaguu

SEQ ID NO: 44192 - RNA, 64 nt, Human
ggucguagguucuuaagaauuugauucaucaguggcaggccaugcauagagccacgggaggugc

SEQ ID NO: 44193 - RNA, 64 nt, Human
ugcuggggcucugcaggggcagcacagcuggggugcaggccaggcugccacuccgggaacgccu

SEQ ID NO: 44194 - RNA, 64 nt, Human
gcaggacuuggccagcagcugcccaggacacagugcaggccagagcgggcuugaccaccuggug

SEQ ID NO: 44195 - RNA, 64 nt, Human
ccaguguggccuggagcugcuacagagguguugggcaggccaugccugugccgccaucucuccc

SEQ ID NO: 44196 - RNA, 64 nt, Human
uguaaagggguagaaagugaagauuuuaggcuuugcaggccauauagccucugcugcaaaugcu

SEQ ID NO: 44197 - RNA, 64 nt, Human
uccugaagaccccucggaacacccucuccugguggcaggccacuucccucccagugccagucuc

SEQ ID NO: 44198 - RNA, 64 nt, Human
ccccaaaacauaucaguuugaauacuugaaucaugcaggccaauauuauaaugugaaaagguau

SEQ ID NO: 44199 - RNA, 64 nt, Human
acccaagagauauuuauuaaacaccaauuacguagcaggccauggcucaugggacccacccccc

SEQ ID NO: 44200 - RNA, 64 nt, Human
gcuggacucccagaccccauccagccaggggaccgcaggccauuguugaacuccucuauacucc

SEQ ID NO: 44201 - RNA, 64 nt, Human
uagaggucagagguggcuuucugaggccuggaaggcaggccaaccagcaaaauccugauaacaa

SEQ ID NO: 44202 - RNA, 64 nt, Human
acuuagaccagugucugaggugguaacagcggccgcaggccaggguuggccuagaccugggauu

SEQ ID NO: 44203 - RNA, 64 nt, Human
cucuguggcaauaugggguuggguaguguggguggcaggccauccccucuaaucuuggaaccuc

SEQ ID NO: 44204 - RNA, 64 nt, Human
agcuggcugcgggcuccagcggccgugugcuccagcaggccagagccagacacgaccucccuga

SEQ ID NO: 44205 - RNA, 64 nt, Human
uguguccugccucggcgcucucgcaaaugaagcugcaggccaagaagccccuugugagucuguu

SEQ ID NO: 44206 - RNA, 64 nt, Human
ucagcguggcagccacguggaagcagggcauguagcaggccaggccacgggcuugcagcuccuc

SEQ ID NO: 44207 - RNA, 64 nt, Human
cacugagcggguuuaggggcucgcccacaugcaugcaggccaagacagcaaaugccagccgggc

SEQ ID NO: 44208 - RNA, 64 nt, Human
accuccuuggugucguccucucccuugcccuggugcaggccaagcauuuuauacauacccucgc

SEQ ID NO: 44209 - RNA, 64 nt, Human
gugaaggugcugcaggagaugcugagcauguaccgcaggccagggcaggccccgcccgaccagg

SEQ ID NO: 44210 - RNA, 64 nt, Human
caccucucuccuuugcugaggccuccagcuucaggcaggccaaggccuucuccuccccacccgc

SEQ ID NO: 44211 - RNA, 64 nt, Human
aagugaugcacaccaccaacauucuuggcauuacgcaggccagcaacucccagcucaaugcaau

SEQ ID NO: 44212 - RNA, 64 nt, Human
ccccauccccauccucaugggucuguggcugggugcaggccaucaaaauggacaccacgagaca

SEQ ID NO: 44213 - RNA, 64 nt, Human
auuguggcugccuauggacucccgggccuugugugcaggccaggcccuuccacugauuuuuuaa

SEQ ID NO: 44214 - RNA, 64 nt, Human
ugaauauuuuauauuaaaauaugaagguuugagagcaggccauuggcuacugacuguauuuugu

SEQ ID NO: 44215 - RNA, 64 nt, Human
guuuggcuuucacgcgcuccauugccccggcguggcaggccauuccaagcccuuccgggcugga

SEQ ID NO: 44216 - RNA, 59 nt, Human
cugacagcuuucgagagugaggccugccagcaggccagggacucagcguccccugcuac

SEQ ID NO: 44217 - RNA, 64 nt, Human
ccuugcugccuucacccugaacauuuaguacccugcaggccaggccagcuuccccucacuuaac

SEQ ID NO: 44218 - RNA, 64 nt, Human
ggggagggaggcaucuuguuucuugugguucccugcaggccaguccuguccuccuuucccuguu

SEQ ID NO: 44219 - RNA, 56 nt, Human
ccuacuacccaucugggugacccggggcaggccacagaggccaggccagggcugga

SEQ ID NO: 44220 - RNA, 64 nt, Human
caagugaggggcugcccagcugcuccccugccacgcaggccacccgggcugccugccccugcug

SEQ ID NO: 44221 - RNA, 64 nt, Human
gcaaucucugaggguaaagccggugggaggcucagcaggccaggaggcccaaggacaggacuug

SEQ ID NO: 44222 - RNA, 64 nt, Human
ggagaaaugaggaugucugucccugucugccugggcaggccagauuccuccccagcagccgggu

SEQ ID NO: 44223 - RNA, 64 nt, Human
aggggaaggaaggggcuuugggaucuggaaaccagcaggccaggcagcauccacaguguuaguc

SEQ ID NO: 44224 - RNA, 64 nt, Human
guguuaaggggcacaagguccagaucacucuggagcaggccagcucugcuggacagugacccuc

SEQ ID NO: 44225 - RNA, 64 nt, Human
gcggggcagcagcacagcgugggguccuggcacugcaggccaggccaggaugcccaccccgccc

SEQ ID NO: 44226 - RNA, 64 nt, Human
ggguggcuuuuuggguccacccagccaggaugcugcaggccaagcugggugugguauuuagggc

SEQ ID NO: 44227 - RNA, 64 nt, Human
caggcucucaacaggggagagugugguguuuccugcaggccaggccagcugccuccgcgugauc

SEQ ID NO: 44228 - RNA, 64 nt, Human
aaaccccaaagucugggagcugcaccuuccgagugcaggccaugugagcccugccucuuuaagg

SEQ ID NO: 44229 - RNA, 64 nt, Human
acaccuugagcccuaguaaaggaacuaugcaaaugcaggccacucuccccaccacgucugugcc

SEQ ID NO: 44230 - RNA, 64 nt, Human
caggccuggcuuagagguagcggguggcuggugggcaggccacugcugggacagggucuauggg

SEQ ID NO: 44231 - RNA, 54 nt, Human
ccaagugccacugcaauuaaugaggcaggccaggcaagcagucaggggugccaa

SEQ ID NO: 44232 - RNA, 64 nt, Human
uaagccaaccuccucucacagccucuguaucucugcaggccauacugguuccauuguucuguau

SEQ ID NO: 44233 - RNA, 64 nt, Human
uguuauaauugccagcugucuacacaaagaauaugcaggccagaagaaaaguugcuuuucaaag

SEQ ID NO: 44234 - RNA, 64 nt, Human
gucuccacugagaggugccgucuggcccuucccugcaggccagcugccccaagcgggguagcag

SEQ ID NO: 44235 - RNA, 64 nt, Human
ccccaggacagcacacggugagggugcggggccugcaggccagucccacggcucugugcccggu

SEQ ID NO: 44236 - RNA, 55 nt, Human
ccugucgccagaucaacugagcacggcaggccaggcugagcccgcccgcccucgc

SEQ ID NO: 44237 - RNA, 64 nt, Human
auuguccacauuaaugguuggcaugauugugcuugcaggccaagaaaugaucauaccccuugcc

SEQ ID NO: 44238 - RNA, 64 nt, Human
caccucaaccuucggaguagcugggaucacagcugcaggccacgcccagcuuccuccccccgac

SEQ ID NO: 44239 - RNA, 64 nt, Human
ugcacacagcccuuccacaguuggcacugcaggugcaggccaacccuuuaaagaauaaacaagg

SEQ ID NO: 44240 - RNA, 64 nt, Human
uagccgcgugcggaggggacagagcgugagcugagcaggccacacuucaaacuacuuugcugcu

SEQ ID NO: 44241 - RNA, 64 nt, Human
gggucugcauugccauagugcccgaguuaaaacugcaggccacucugccuugcaguggccucug

SEQ ID NO: 44242 - RNA, 64 nt, Human
ccagccugggacaggcccccuuuccccucucucugcaggccaggagggccuccuuccugccacg

SEQ ID NO: 44243 - RNA, 64 nt, Human
cugcggggcgccugcccgggcgaggucggaagcugcaggccagcugggcccgggccggagcgug

SEQ ID NO: 44244 - RNA, 64 nt, Human
cacaguggcucacgccuguaaucccagcacuuuggcaggccaagguggaaggaucacuuagagc

SEQ ID NO: 44245 - RNA, 64 nt, Human
agcuuccaucucccagcccuucuugcaagcaagggcaggccauuuccuccgguccuggcuagua

SEQ ID NO: 44246 - RNA, 64 nt, Human
acugaggacaucagguccaccucuggaccccuuggcaggccacagagggcucucguguggggug

SEQ ID NO: 44247 - RNA, 64 nt, Human
aaguucacccacccccgaaaaaauaauuaaacucgcaggccaggcacgguggcucaugccugua

SEQ ID NO: 44248 - RNA, 64 nt, Human
auauuauccaggagaacuuccccaaucuagcaaggcaggccaacauucagauucaggaaauaca

SEQ ID NO: 44249 - RNA, 64 nt, Human
cgccugccgccugcucugaggcccgauccagugggcaggccaaggccugcugggcccccgcgga

SEQ ID NO: 44250 - RNA, 64 nt, Human
aggucagggcccagcgugugauguaggggccggggcaggccaggguuuguuuguggaggcgcug

SEQ ID NO: 44251 - RNA, 64 nt, Human
gggucaagccagcauccccuugguaaagacccccgcaggccaccaggcauucuggacacgcaca

SEQ ID NO: 44252 - RNA, 64 nt, Human
cacacacacacacacacacacacaaaacuucacagcaggccagcugcagugacuugucaucaag

SEQ ID NO: 44253 - RNA, 64 nt, Human
cggccccgggggccccaccgcccccuuggucagcgcaggccacggcccgagggggcgcccgcag

SEQ ID NO: 44254 - RNA, 64 nt, Human
uaaaggcggccagguuugcagugcgggaagaugagcaggccagugggaggaggggcagggcagg

SEQ ID NO: 44255 - RNA, 64 nt, Human
gggggcagucuguaaaucagucaccuguguugcugcaggccaagguagaaacgcccuccgugug

SEQ ID NO: 44256 - RNA, 64 nt, Human
aagagcagaggugaggaccugggaccccugaggggcaggccaggaggagcucgggcgcaggcca

SEQ ID NO: 44257 - RNA, 64 nt, Human
gaccccugaggggcaggccaggaggagcucgggcgcaggccaggcccccuuggugaagcagagg

SEQ ID NO: 44258 - RNA, 64 nt, Human
ccccaguuagcacccaccguccagagggcucccugcaggccaggggucccccagcgucacccug

SEQ ID NO: 44259 - RNA, 64 nt, Human
augguggccgccggcgggggccccagcccagcuugcaggccaccucuagcuuucuuccuacccc

SEQ ID NO: 44260 - RNA, 64 nt, Human
cuccuuuugguguguuggacagagaagggcuccugcaggccacagccaccuaaacgguucaguu

SEQ ID NO: 44261 - RNA, 64 nt, Human
gcucucugguggccaagcuggagcacuacgacuugcaggccacccauuccaacugaguguaguc

SEQ ID NO: 44262 - RNA, 64 nt, Human
ccccguguggcuuacaaauucuacagcauacagagcaggccacgcucaggcccggcaugcgggc

SEQ ID NO: 44263 - RNA, 64 nt, Human
cccaccccuccaccacauggggccccaaagcacugcaggccaagcagggcaaccccacacccuu

SEQ ID NO: 44264 - RNA, 64 nt, Human
cauuuauaauaauuauaugugauagagauuuuccgcaggccaaagucucacuaggcaucaaaaa

SEQ ID NO: 44265 - RNA, 64 nt, Human
aaagaaauggucuaucaacugaacaugaaauggagcaggccaagaccuuaggacauugggauuu

SEQ ID NO: 44266 - RNA, 64 nt, Human
ggaauggccgaggaggaaggggcuccgugcacuugcaggccacgucaggagagccagcggugcc

SEQ ID NO: 44267 - RNA, 64 nt, Human
aacaaugaagucguuccucuuaagacugaaacaagcaggccagaugugguggcucacgccugua

SEQ ID NO: 44268 - RNA, 64 nt, Human
gcuuaguggcacgaccucuuuccauagcauaaaugcaggccagcguuuuagccccaagugccug

SEQ ID NO: 44269 - RNA, 64 nt, Human
ccuggagaggagaaauccuggccucugcucaugcgcaggccacaaccgggcuggaagugcgguu

SEQ ID NO: 44270 - RNA, 64 nt, Human
aagcccaaggugcuagaacuagcuuaggagacaugcaggccacagggcuucuaggcagggaaag

SEQ ID NO: 44271 - RNA, 64 nt, Human
ccagguccccauccugcugccagcucucaacauagcaggccauaggacccagagaagaauccca

SEQ ID NO: 44272 - RNA, 64 nt, Human
gauccuaccaccucgccuugacccugaagucagagcaggccagccaagcaggaagcacacuguu

SEQ ID NO: 44273 - RNA, 64 nt, Human
cuggaauacaugaaauauagaucaguuauaaguagcaggccaagucaggcccuuauuuucaaga

SEQ ID NO: 44274 - RNA, 64 nt, Human
cuguuuagcccucccagauagcugccccugccacgcaggccaggagucuucacacucaggcacc

SEQ ID NO: 44275 - RNA, 64 nt, Human
gcagcagugaccagccagggcaaauggcuuagaagcaggccacuccccagccugcugccagcac

SEQ ID NO: 44276 - RNA, 64 nt, Human
aaggaccccaaaugguggucguugucccuucugugcaggccagcagggccccaucucuaguuuu

SEQ ID NO: 44277 - RNA, 64 nt, Human
cuguggcuugugcccaugcaccugccagggcccagcaggccaacccaucaucuagaguaguggc

SEQ ID NO: 44278 - RNA, 64 nt, Human
cucggcacauccugccuggcacauacacgugucugcaggccacaccgugcauguccccagaccu

SEQ ID NO: 44279 - RNA, 64 nt, Human
uggcugugugggugguguccuucgggguggccaagcaggccauccucauccacaacgagcgccg

SEQ ID NO: 44280 - RNA, 64 nt, Human
uggugccacaaagaaugccacaguggauacgccagcaggccacauggcuggccaagcaauuauu

SEQ ID NO: 44281 - RNA, 64 nt, Human
ggacaccacugcccacaccuccaucccguccugcgcaggccaacacucacugacaucgaaggcu

SEQ ID NO: 44282 - RNA, 64 nt, Human
augggcccaggucccaggggagagguuggggcuggcaggccacuggcaugugcugaguagcgca

SEQ ID NO: 44283 - RNA, 64 nt, Human
acgguuuacagacaauugcacaagcguggggugggcaggccaggacugcuuuuuuuuaaugcuc

SEQ ID NO: 44284 - RNA, 64 nt, Human
cugggucuccgccuccaggguucugcucuuccaggcaggccagcaaguggcgcugggccacacu

SEQ ID NO: 44285 - RNA, 64 nt, Human
cuucuggaagaaccccugccuggggugggacugugcaggccagagaagguggcaugggccugaa

SEQ ID NO: 44286 - RNA, 64 nt, Human
gcagcaucuggggccugggauggccacagaaggggcaggccagguggaaaggagccagggggaa

SEQ ID NO: 44287 - RNA, 64 nt, Human
ggguggggccagaaggccugauagaagggucagggcaggccagggggguggggggccgcccuca

SEQ ID NO: 44288 - RNA, 64 nt, Human
ccuuuccucuucccugccccacccccuggccgcagcaggccagcacugcagaguuugggugcug

SEQ ID NO: 44289 - RNA, 64 nt, Human
cgccagcuccucggaggccagacccaggauggcugcaggccagguuuggggggccucaacccuc

SEQ ID NO: 44290 - RNA, 61 nt, Human
ugacaggcugcugaggguaagcgccaucccugcaggccagggcacacggugcgcccgccgc

SEQ ID NO: 44291 - RNA, 64 nt, Human
cgccgccaagccagccgggcggccgacccguggggcaggccaggccagguccucccugauggac

SEQ ID NO: 44292 - RNA, 64 nt, Human
ggagcagauggcccugaagcccuucccucacugugcaggccaccgggugaggcuggacggucac

SEQ ID NO: 44293 - RNA, 64 nt, Human
ugaggccagccccuagcagcuggauguggcagaggcaggccagaggaccuaagugugauggacc

SEQ ID NO: 44294 - RNA, 64 nt, Human
gucccaccccacgccugacuccccucuggaaacugcaggccagaugguugcugccacaacuugu

SEQ ID NO: 44295 - RNA, 64 nt, Human
accccuggccagcucugaggggaggcaccuccaggcaggccaggcugccucggacuccauggcu

SEQ ID NO: 44296 - RNA, 64 nt, Human
gucacugguaccggaugcagaccccacccugucugcaggccacccccaccucccugcagcuuug

SEQ ID NO: 44297 - RNA, 64 nt, Human
ugcguuccuguaccagcgaguccacagccuuugugcaggccaugauggaggggucccacacagu

SEQ ID NO: 44298 - RNA, 64 nt, Human
aagcaucacacaauuuuacauuaagaaauacugugcaggccaugcgugguggcucaggccugua

SEQ ID NO: 44299 - RNA, 64 nt, Human
uauccucaggaagcacaucuguagugcacucccagcaggccauggacuagucacuaaccccaca

SEQ ID NO: 44300 - RNA, 64 nt, Human
uauagauuccuugguauuucuggugggguaaggggcaggccagggcuguucacgcccaugaggg

SEQ ID NO: 44301 - RNA, 64 nt, Human
auuguuuguugcacuaaaaugaggauccagggcagcaggccagagaaagcaaaggugcacucca

SEQ ID NO: 44302 - RNA, 64 nt, Human
uguaaagggccagacgggaaauauuuugggcuuugcaggccaugcggccucugucacaucuacu

SEQ ID NO: 44303 - RNA, 64 nt, Human
caugaccagugaugaggggaaauggggggagggggcaggccaaugaggucugcauggccagggg

SEQ ID NO: 44304 - RNA, 64 nt, Human
ugagaagacccccagcagggguacuggguacccggcaggccagugcccucacaguugacuugga

SEQ ID NO: 44305 - RNA, 64 nt, Human
aucauguuuauaaaauaggacgcugggagcaguugcaggccacagugaaguguguugcuucugu

SEQ ID NO: 44306 - RNA, 64 nt, Human
gcccaaugcuucuggggaauuuaauagcuaccaugcaggccacagggaauuugugaggcuucuu

SEQ ID NO: 44307 - RNA, 64 nt, Human
gaggccuggcugaccaagaagccaaaguuaacuugcaggccacaggacauagccaccugaagag

SEQ ID NO: 44308 - RNA, 64 nt, Human
aaggccuggcugaccaggaagccaacguuaacuugcaggccacgugacauaaccacccaaagag

SEQ ID NO: 44309 - RNA, 64 nt, Human
gaacuccaucagcagagaagaccuccaguauaucgcaggccagggaacugggacugcccguggu

SEQ ID NO: 44310 - RNA, 64 nt, Human
gucuuuuccauucaguaagaaagagaaagggaaugcaggccaguuacuuaaaaggucuucagau

SEQ ID NO: 44311 - RNA, 64 nt, Human
uagugucacccacaagggaggcuagggcaauggagcaggccaccagcagcagcugugcagcaug

SEQ ID NO: 44312 - RNA, 64 nt, Human
guaaacaucugaagguuuaguauauuagaaacacccaaaccaguaauaugcuaaccugaugcac

SEQ ID NO: 44313 - RNA, 64 nt, Human
agcccugccccuccaguuccuuggcaguucucccccaaaccaggucuguacagguguucuuuau

SEQ ID NO: 44314 - RNA, 64 nt, Human
uuuguaguuaaggaaaacugaggccuaaaugugaccaaaccaacauuguaauccagucccuucu

SEQ ID NO: 44315 - RNA, 64 nt, Human
ucaaacacccagcucagccacacacaacuacccuccaaaccaccacagucucugucacaccccc

SEQ ID NO: 44316 - RNA, 64 nt, Human
agggaggguuggcuucccaaaagcauaaccuugaccaaaccaaacaauaggcaccagcaaugcu

SEQ ID NO: 44317 - RNA, 64 nt, Human
gcacacgaauuaugcugcguugcucacauucaaaccaaaccaacgacuauguuuaaugaacuca

SEQ ID NO: 44318 - RNA, 64 nt, Human
uuguuaaauuguuuguaccuugcaaacuuaugaaccaaaccauauuggguuuucaaagugccuu

SEQ ID NO: 44319 - RNA, 64 nt, Human
aaaaggaacccuuuuccuccagacagauacagccccaaaccagggugcauggcuuggggagcag

SEQ ID NO: 44320 - RNA, 64 nt, Human
aacugugcuuuggaagauaagcucuguccugaguccaaaccaagcccuuccaagagagaacaaa

SEQ ID NO: 44321 - RNA, 64 nt, Human
auacuaauggagcuucaugacccacggucagcccccaaaccaaaguugucccaacagaggaggc

SEQ ID NO: 44322 - RNA, 64 nt, Human
aguaguguaguaccuaagaucauuuuccugaaagccaaaccaaacaacgaaaaacaagaacaac

SEQ ID NO: 44323 - RNA, 64 nt, Human
acaucaacaagacggcugccaaccugagaagucaccaaaccacaaaaauaaccuuacagccuuc

SEQ ID NO: 44324 - RNA, 64 nt, Human
cucucuuuugcaacauuuuacccauuucccuuccccaaaccaugugcuuauuagaugguuccac

SEQ ID NO: 44325 - RNA, 64 nt, Human
ugaggagaugguugaauuuaagcuaacaggaaagccaaaccagcacccuccuuugugcucugag

SEQ ID NO: 44326 - RNA, 64 nt, Human
uccagucuucaauaccugcagaggaggcaugaccccaaaccaccaucucuuuacuguacuaguc

SEQ ID NO: 44327 - RNA, 64 nt, Human
uauuuggacgggauuuuagguuucccucccuuccccaaaccauacaguugagaaguaauucaga

SEQ ID NO: 44328 - RNA, 64 nt, Human
ugaugaaauucaauuuaaaaaaucacguuagccuccaaaccauuuaauucaaaugaacccauca

SEQ ID NO: 44329 - RNA, 64 nt, Human
guauuuuaaagaauguaucuugccuuguguugacccaaaccaaaaacauuuuugaggggcacau

SEQ ID NO: 44330 - RNA, 64 nt, Human
guucacaauagagcucagggagccccuaacucuuccaaaccacaugggagacaguuuccuucau

SEQ ID NO: 44331 - RNA, 64 nt, Human
cuuuuuguaguaaaaugaaucuuucaaagguuucccaaaccacuccuuaugauccagugaauau

SEQ ID NO: 44332 - RNA, 64 nt, Human
cccuuuacauaagcauuauaaacuaaaaugaaaaccaaaccagacaccugacauagagucuuua

SEQ ID NO: 44333 - RNA, 64 nt, Human
uucccccaaccacccaccagaggaguucugguccccaaaccaaagaguugccugcagguuggua

SEQ ID NO: 44334 - RNA, 64 nt, Human
aaguccuucauaauuuaaccauuagcaucuuuggccaaaccaaaauaaagaaaagcaucuucuc

SEQ ID NO: 44335 - RNA, 64 nt, Human
gcacccucccuagagggcccuugucugagaaaccccaaaccaggaaaccccaccuacccaacca

SEQ ID NO: 44336 - RNA, 64 nt, Human
cuuuaagaaccuacuuccuaaucucuuccccaauccaaaccauagcugucuguccagugcucuc

SEQ ID NO: 44337 - RNA, 64 nt, Human
cacuccccgccuccccaagucagcaguccuagccccaaaccagcccagagcagggucucucuaa

SEQ ID NO: 44338 - RNA, 64 nt, Human
auggaccagcuucagccagggacaaaauccccucccaaaccacucuccacagcuuuuuaaaaau

SEQ ID NO: 44339 - RNA, 64 nt, Human
auuuuguugcagcuuuuaaauguacucugaacuuccaaaccacauucauuccagccugguagaa

SEQ ID NO: 44340 - RNA, 64 nt, Human
acguucuuggcuccagaccuggaauccacaaaagccaaaccagcucauuucaacaaaggagcuc

SEQ ID NO: 44341 - RNA, 64 nt, Human
cagcagccaccuccucugagaucccucaccuucuccaaaccagauccaaucaaaccucagcccg

SEQ ID NO: 44342 - RNA, 64 nt, Human
cccccugcaugccccaugugggaggugcugagcuccaaaccagcaucacaccaacucugacaca

SEQ ID NO: 44343 - RNA, 64 nt, Human
cuaugcgcccccccuccaucauccccaaggcugcccaaaccaccacugcugucagcaagcacau

SEQ ID NO: 44344 - RNA, 64 nt, Human
accugggcuguccacacagaaaacaaaaacccaaccaaaccaagcccuguugugcucacuggug

SEQ ID NO: 44345 - RNA, 64 nt, Human
uacaauucaagaugagauuugagugggaacacagccaaaccauaucaccuucaaagaagaaaua

SEQ ID NO: 44346 - RNA, 64 nt, Human
guacaucaaaugaaaugagaaguguguaugcugaccaaaccacaagaaacuuucuuuaaguugu

SEQ ID NO: 44347 - RNA, 64 nt, Human
gauuaaaaacacaguuuuauugcucucugcacugccaaaccaauaaauuuacagaagagaaagc

SEQ ID NO: 44348 - RNA, 64 nt, Human
aagaaucucucccaacauuuuagagucuugcuucccaaaccagaaaaagucagacucauuguug

SEQ ID NO: 44349 - RNA, 64 nt, Human
ugcauaugucgaaagagcuggcugggggccuugcccaaaccaacugaggucuuaaaguccaggg

SEQ ID NO: 44350 - RNA, 64 nt, Human
guuucagcgcaugcgccccagccuuucccaugugccaaaccagaagcuccacugcccguaggcu

SEQ ID NO: 44351 - RNA, 64 nt, Human
uggauauggguucauuuuaucccuaaacuuaguaccaaaccagcauuuaauaucuaauuauaaa

SEQ ID NO: 44352 - RNA, 64 nt, Human
ccauucagcaugagauuugggcaggaacacagacccaaaccauaccacacacauuaucauuguu

SEQ ID NO: 44353 - RNA, 64 nt, Human
gggagacaggaaacugcguuuuagccuugugcccccaaaccaagcucauccugcucagggucua

SEQ ID NO: 44354 - RNA, 64 nt, Human
uguugcuaaugcuguuccuucuuugugccuccuuccaaaccacaguuauuugcccaaacuaccu

SEQ ID NO: 44355 - RNA, 64 nt, Human
cuauacucuggcacaauuuucauuuguauaugagccaaaccacauaccuuaaugauuugggaag

SEQ ID NO: 44356 - RNA, 64 nt, Human
uucccuuuaaggcuugaaaaugccuccuguagucccaaaccagcaaagaacugguuaaaugugc

SEQ ID NO: 44357 - RNA, 60 nt, Human
agguccugcgaucgccauagccguucacagccaaaccacugacauuccuccauguccuca

SEQ ID NO: 44358 - RNA, 64 nt, Human
acccgcagaugacacgcgcucuccaccacccaacccaaaccaugagaauuugcaacaggggagg

SEQ ID NO: 44359 - RNA, 64 nt, Human
guuagggucagccauuuuuaaugaucucggaugaccaaaccagccuucggagcguucucugucc

SEQ ID NO: 44360 - RNA, 64 nt, Human
uacaauucaaguugagauuuguggggggacacaaccaaaccauaucagcauccuuucaagaaua

SEQ ID NO: 44361 - RNA, 64 nt, Human
acaauuucaaguugagauuuggguggggacauagccaaaccauaucauucuaccccuggccccu

SEQ ID NO: 44362 - RNA, 64 nt, Human
gggugugagcagggugaccccucaucugaaaggcccaaaccagggggaagcaccagccucagug

SEQ ID NO: 44363 - RNA, 64 nt, Human
uaaaaaaagagcuaagauaaagacuguggaaaugccaaaccaagcaaauuaggaaccuugcaac

SEQ ID NO: 44364 - RNA, 64 nt, Human
ucuacuugaugcgggagcaacaaacagcucagggccaaaccaaaagacaaaaauuggaguaacg

SEQ ID NO: 44365 - RNA, 64 nt, Human
uuaucacuuguaaagacaugcagauggcguggaaccaaaccaugagaaaacuccagccauccug

SEQ ID NO: 44366 - RNA, 64 nt, Human
uaggccuaaccauuaguacuuacugugcagggaaccaaaccaaggucugagaaaugcggacacc

SEQ ID NO: 44367 - RNA, 64 nt, Human
guguugccaggcaggcaccugggcuuucuggaauccaaaccacagucuuaggggcuugguaguu

SEQ ID NO: 44368 - RNA, 64 nt, Human
aguggaugcauccuaugcauguaagcauuauuucccaaaccaaagcaucauucaucuccauuua

SEQ ID NO: 44369 - RNA, 64 nt, Human
uggggaagccugucuagaugugggacucauugccccaaaccagggagaggaagagcucccacag

SEQ ID NO: 44370 - RNA, 64 nt, Human
ggggguaaacaggucucccagcauucugaguguuccaaaccaguaauccacaugccaauucaaa

SEQ ID NO: 44371 - RNA, 64 nt, Human
accagauaauucauuuuucugauuugauaacuacccaaaccaaacaaccaauacauacauggga

SEQ ID NO: 44372 - RNA, 64 nt, Human
aaaaaucaaaacaucauguagggugaccuaguuuccaaaccaauaaauaaguaguauuguaaua

SEQ ID NO: 44373 - RNA, 64 nt, Human
gaacacaacaccuugccaguaucucaggcaccuuccaaaccaaaucugacaagugaacauacuu

SEQ ID NO: 44374 - RNA, 64 nt, Human
gggagauacaagauauuuggguggagacacagagccaaaccauaucacaccuuaaggucauggu

SEQ ID NO: 44375 - RNA, 64 nt, Human
ggcagguccccagacuccaccaagccuggucagcccaaaccaccagaagcccagaauaaacugg

SEQ ID NO: 44376 - RNA, 64 nt, Human
ucucgguuuucuuacacugugaucuuaaaaguuaccaaaccaaagucauuuucaguuugaggca

SEQ ID NO: 44377 - RNA, 64 nt, Human
agaggcccuucucacugagacagcaacauuuaaaccaaaccagaggaaguauuuguggaacuca

SEQ ID NO: 44378 - RNA, 64 nt, Human
cuuucugaggccauauaagcuuauaagaaaagucccaaaccaagaauagguccuuggccacaag

SEQ ID NO: 44379 - RNA, 64 nt, Human
gaacuucccaccauaucccagaaucugcuauuccccaaaccacuucccaguuuccuuucaguaa

SEQ ID NO: 44380 - RNA, 64 nt, Human
cuacaaaaaauugccccaacuacaguuugcaaccccaaaccacauuagaagucugugcagacau

SEQ ID NO: 44381 - RNA, 64 nt, Human
aauaaucucuuggaucugccgccccccucuccucccaaaccaaaaaccauugucuuaccuccca

SEQ ID NO: 44382 - RNA, 64 nt, Human
aguauagaauuagaaaauuuauucauugguggaaccaaaccaccuuagugaguaacccuaagaa

SEQ ID NO: 44383 - RNA, 64 nt, Human
cuugacugaccaauugauuuuagagagaaaguaaccaaaccaaauauuuaucugggcaaaguca

SEQ ID NO: 44384 - RNA, 64 nt, Human
ucaaacuaagaauauuguuuauagguuuuaaaaaccaaaccaauaaaauuuuuauuuauucaau

SEQ ID NO: 44385 - RNA, 64 nt, Human
uccuagcguuuuggaagaggaaaacaggaacccaccaaaccaaccaaucaaccaaacaaagaaa

SEQ ID NO: 44386 - RNA, 64 nt, Human
gucauugaaucucuuaugccaguuuucauaaaacccaaaccacauaugaaaaaauccauuaagg

SEQ ID NO: 44387 - RNA, 64 nt, Human
acuuaauuccaaaugggaucuccauaccuguggaccaaaccaacaaguaaguuuugacagcuag

SEQ ID NO: 44388 - RNA, 64 nt, Human
cacuggcgucaucaagucaccaagcuggcaacggccaaaccaaggagguagcccagagaaaucu

SEQ ID NO: 44389 - RNA, 64 nt, Human
agaaauauauuacaguucauuccacagaaagcauccaaaccacccaaaugaccaaggcauauau

SEQ ID NO: 44390 - RNA, 64 nt, Human
ccuaguuccuuacuucuguuuuaaacuuuggguaccaaaccaaaaagaagaaaaaagaaaggaa

SEQ ID NO: 44391 - RNA, 64 nt, Human
ccaccagugggccuuggaaaaugcaucaagaaggccaaaccagcuugacccuggcucacagaca

SEQ ID NO: 44392 - RNA, 64 nt, Human
agauguauuacuuuuuauguuugguauuauucugccaaaccaaucauguuauuguuuuuaauca

SEQ ID NO: 44393 - RNA, 61 nt, Human
uagagacaagugaucaaugagaaucuguucaccaaaccaaauguggaaagaacacaaagaa

SEQ ID NO: 44394 - RNA, 64 nt, Human
gaagcuucagaaauguuuuuucuuuuccuuguggccaaaccaguuuguuaaucugauuauauuc

SEQ ID NO: 44395 - RNA, 64 nt, Human
guuuccaaugcgccgucaccaucuccaccugccaccaaaccaccagcagaguagccgccgcugc

SEQ ID NO: 44396 - RNA, 64 nt, Human
uuacuggggaaacagcucagcagauuuuuggagaccaaaccaaaggucucacuaggaaauuuau

SEQ ID NO: 44397 - RNA, 64 nt, Human
auuuaaguuggaucagcugaaguguguuuuagacccaaaccaucuggccccuucguuuugcuca

SEQ ID NO: 44398 - RNA, 64 nt, Human
aaggcccaguugccacagauuauacaaccauuacccaaaccacucugacagucuccuccaguuc

SEQ ID NO: 44399 - RNA, 64 nt, Human
aaauuuuacauuauaaagcaauguagagagaguuccaaaccaccaauuuuauaauuucccuugu

SEQ ID NO: 44400 - RNA, 64 nt, Human
ccuaguaaccacggcaacccaaccuacucuaaaaccaaaccaaaaaaauaaaauaacacauccu

SEQ ID NO: 44401 - RNA, 64 nt, Human
ccugagccagaugcacaccaucucugauggccucccaaaccaaugugccuguuucucuuccuuu

SEQ ID NO: 44402 - RNA, 64 nt, Human
gagaagagaaugccuucuagaugcaaaaucaccuccaaaccagaccacuuuucuugacuugccu

SEQ ID NO: 44403 - RNA, 64 nt, Human
uccuggucucuucaccacuguaguucucucauuuccaaaccaucagcugcuuuuaaaauaagau

SEQ ID NO: 44404 - RNA, 64 nt, Human
auauauaaagauaaauaugccugagcucccauguccaaaccauccugaagggcuguaguagaga

SEQ ID NO: 44405 - RNA, 64 nt, Human
cagaacuucuaacuugaccacacaaggcaguugcccaaaccauucugugggggaugcauccaga

SEQ ID NO: 44406 - RNA, 64 nt, Human
agacaaaagcacaggcaugcacacacacagaaccccaaaccacuaaaaacuaccuaaacacuga

SEQ ID NO: 44407 - RNA, 64 nt, Human
caguguacaguuaaacaaaggaaucucagucacaccaaaccaaccuuuuuauuuccugcucucu

SEQ ID NO: 44408 - RNA, 64 nt, Human
aagaauagggugaaaaaccucagaagggaaaacuccaaaccaguugggagacuugugcaaagga

SEQ ID NO: 44409 - RNA, 64 nt, Human
cccuggggcuccaggaccuucccuaccuccaccaccaaaccaagggauuuauagcaaaggcuaa

SEQ ID NO: 44410 - RNA, 64 nt, Human
gcacauuuuguggaccugguuccaccuuuccauuccaaaccaccuguuuccccuuccauuagca

SEQ ID NO: 44411 - RNA, 64 nt, Human
ggaagaaacuuuggaauaaggaagagaagauugaccaaaccauccaaaugccaaaaagaaaaag

SEQ ID NO: 44412 - RNA, 64 nt, Human
uacuucugaugaaaaauccgcugaggagcauaccccaaaccagacauaugcuuaggauucaugc

SEQ ID NO: 44413 - RNA, 64 nt, Human
guacuaguuuguggcagcucaaguaaaaucgaguccaaaccaacggcucuuuucagggccaccc

SEQ ID NO: 44414 - RNA, 64 nt, Human
cuacaauucaagaugagauuuggaugggacacagccaaaccauaucaauagguauuauuuuauc

SEQ ID NO: 44415 - RNA, 64 nt, Human
cauauguugucauaaaagguaaaagugaugcaugccaaaccaaacuaaaccaauuuggauuauc

SEQ ID NO: 44416 - RNA, 64 nt, Human
ugaucaugcuuccauuuuuuuuaguuuuaaaccaccaaaccaauauuuuuccuuuaaauuuuaa

SEQ ID NO: 44417 - RNA, 64 nt, Human
acuaaauaaauuaccaaaaaggaaaaaaaauccaccaaaccaugauaaacacaaaaugcagcuu

SEQ ID NO: 44418 - RNA, 64 nt, Human
uaugguuaaugacauugaagguacauuuauuguaccaaaccauuuuaugaguuuucuguuagcu

SEQ ID NO: 44419 - RNA, 64 nt, Human
guaaagcaaguccuuucaaguuucacugcacaucccaaaccauguuacaaaaagagcaacugcu

SEQ ID NO: 44420 - RNA, 64 nt, Human
cagaagagggaacuuucuggaguuuuugagaaugccaaaccacauuuuuaucacacuucuuugg

SEQ ID NO: 44421 - RNA, 64 nt, Human
cuacauaaguaauucaagaaaacaacuucaauauccaaaccaaauaaaaauauuguguugugaa

SEQ ID NO: 44422 - RNA, 64 nt, Human
cuaggaagguaaacuccaaucccggugaccgaccccaaaccagacuguuggugggcugagcucc

SEQ ID NO: 44423 - RNA, 64 nt, Human
cggggcuggagcaguucauuacucauaccucgguccaaaccaaaaagguucuuuucagagccac

SEQ ID NO: 44424 - RNA, 64 nt, Human
gcuccacacucgugccuacccagccuccugaugaccaaaccauccuguacuacccaagcaccug

SEQ ID NO: 44425 - RNA, 64 nt, Human
gaaccugcgucuuggaccauugccccucccggccccaaaccacaggggcucaggucgugugggc

SEQ ID NO: 44426 - RNA, 64 nt, Human
acagcaguccuugauggcugacagccacagaauuccaaaccaaguagugucugucagcccucuu

SEQ ID NO: 44427 - RNA, 64 nt, Human
cauugcuuuuucagccauucacaagcauucaaaaccaaaccaaacagcaguucauauaccugcc

SEQ ID NO: 44428 - RNA, 64 nt, Human
ugcggaaggauugaagucaaagaauugaaacccuccaaaccacgucaucugauuguaagcacaa

SEQ ID NO: 44429 - RNA, 64 nt, Human
acuguuaucccgguuccaagccuagaggauccuuccaaaccagcaccaacagagccaaggccuu

SEQ ID NO: 44430 - RNA, 64 nt, Human
auggaggcauugaugcaugcuauucacaauuauuccaaaccaaauuuuaauuuuugcuuuuaga

SEQ ID NO: 44431 - RNA, 64 nt, Human
gagagaaguuugaagcacaacucccuuaaggucuccaaaccagacggugacgccugcgggacca

SEQ ID NO: 44432 - RNA, 64 nt, Human
aagacccugagaccuggaugaugucuuugagccaccaaaccaagcagccuuguagccacuccuc

SEQ ID NO: 44433 - RNA, 64 nt, Human
aggcucaggaaacagcccaccacagaggcagaugccaaaccaaagacagauugcuuaaccaaca

SEQ ID NO: 44434 - RNA, 64 nt, Human
uaaaucuguauggcaccaaaaaucaaagugaaaaccaaaccaaaaacccaaacacccuauguaa

SEQ ID NO: 44435 - RNA, 64 nt, Human
uggaccauuccacuuuuuagcuccuauugaugcaccaaaccaagugccucauuucugugccaaa

SEQ ID NO: 44436 - RNA, 64 nt, Human
cacacucacaccccaccccgaagagcuguggagaccaaaccaagacuacgcuacacacagaacg

SEQ ID NO: 44437 - RNA, 64 nt, Human
cacaaacuugugagcaucagagggcugauggauuccaaaccaggacacuacccugagaucugca

SEQ ID NO: 44438 - RNA, 52 nt, Human
ugguaaccgaaaaagaauagagccaaaccaacaccccauaugucaguguaaa

SEQ ID NO: 44439 - RNA, 64 nt, Human
aaaauaaauuuuauuucuauccaaauuugaauguccaaaccauuuuuuaguuacuucuuucuaa

SEQ ID NO: 44440 - RNA, 64 nt, Human
uuaaaacuauggcuguuaaauaagcuuuuuccagccaaaccaaacuacauguaaagugaacugu

SEQ ID NO: 44441 - RNA, 64 nt, Human
aauugcuucuuuuauugguuuccaaagaaacaaaccaaaccaaccagcucuuggaugugaagau

SEQ ID NO: 44442 - RNA, 64 nt, Human
ccccucccuuucccuuaacucuacuuuuacauccccaaaccaccuuugucaucagcuuuuccuc

SEQ ID NO: 44443 - RNA, 64 nt, Human
uucugagaacaccugaaaucaauggcuauacauuccaaaccaaucuaaacgcuauuuccuuuug

SEQ ID NO: 44444 - RNA, 64 nt, Human
aucacaaaaaucaguaagcacaauaaaguggaugccaaaccaucagacacauaaauguucccgc

SEQ ID NO: 44445 - RNA, 64 nt, Human
gaccaggguuuacacacuuaggcaauaguccuuuccaaaccaugacaaaaacuacaaguuuauu

SEQ ID NO: 44446 - RNA, 64 nt, Human
agaggagagcuugaugugauuaucuucaaacccaccaaaccaacaggauaauugacaaauaaac

SEQ ID NO: 44447 - RNA, 64 nt, Human
caaaugcuaauguuuuauucaauguaaaggaagaccaaaccauguaccuuaugaagaccuuugu

SEQ ID NO: 44448 - RNA, 64 nt, Human
agacuuuuaauaucacuaauuucuucuuuagaugccaaaccacaagacucuuuggguccauuca

SEQ ID NO: 44449 - RNA, 64 nt, Human
aaucauaguaaaacgcaacaagaagaaaaccaacccaaaccagugaaguuuuuuagaaccuuua

SEQ ID NO: 44450 - RNA, 64 nt, Human
auuuucagagacuuuacuugcuucaugauuaguaccaaaccacuguacaaagaauuguuuguua

SEQ ID NO: 44451 - RNA, 64 nt, Human
uguauaguuauggucuguuuuuagaauuaauuuuccaaaccacuaugcuuaauguuaacaugau

SEQ ID NO: 44452 - RNA, 64 nt, Human
uuuaguauuuguuuucuagguggaccucugaaaaccaaaccaguaccuggggagguuagaugug

SEQ ID NO: 44453 - RNA, 64 nt, Human
ccuggcaggcucucgguggguggggugggggcccccaaaccaaaguccucugggguagggagca

SEQ ID NO: 44454 - RNA, 64 nt, Human
auagagauaaguccauuuuuuaaaaauguuuuccccaaaccauaaaacccuauacaaguuguuc

SEQ ID NO: 44455 - RNA, 64 nt, Human
uccuccacacaccgugacaaugggcaaaaucaucccaaaccaggcugccccagccccagcccag

SEQ ID NO: 44456 - RNA, 64 nt, Human
uugaaucugguuauuauuuaaaaacuagaagcccccaaaccagcagaucuuacugaagaugaug

SEQ ID NO: 44457 - RNA, 64 nt, Human
aaacuccagauaucaaggaauugggaaauccuggccaaaccaccccaagaugauuacacugaaa

SEQ ID NO: 44458 - RNA, 64 nt, Human
agugcaaugggaucgccuggaaagccuggaguccccaaaccaagguaggaggcaggcugagcag

SEQ ID NO: 44459 - RNA, 64 nt, Human
aucccaggguugagccuugugcucguggcggaccccaaaccacugcccuccuggguaccagccc

SEQ ID NO: 44460 - RNA, 64 nt, Human
ucauuuuauguuuuauauagcuuucuuagacauaccaaaccaucauucauaaaucagauaaauu

SEQ ID NO: 44461 - RNA, 64 nt, Human
gggacaccacucggcuccauggggagguuuagaaccaaaccacaaguccccucaaggacaacca

SEQ ID NO: 44462 - RNA, 64 nt, Human
uggccugaacugaguggagagagacagaccaggaccaaaccaugcagaggucaagggccacauu

SEQ ID NO: 44463 - RNA, 64 nt, Human
uguccuuagccuaggccuaguccugcgaaaacccccaaaccagauacggacagagaccaagaug

SEQ ID NO: 44464 - RNA, 64 nt, Human
aagaguauguaaaaaaaaaaaaaaaaaaaaagaaccaaaccacuggaaauaaucaaaugcaaaa

SEQ ID NO: 44465 - RNA, 64 nt, Human
augaagcaguuuuauuagcauguuacaaauauugccaaaccaagacuucucuaccauacuuuaa

SEQ ID NO: 44466 - RNA, 64 nt, Human
auuuuacaugcugaaaagcugcagagcagaggaaccaaaccagguuuauuugugcuaccaggag

SEQ ID NO: 44467 - RNA, 64 nt, Human
cuccucggcucacuuucucccuuuuuauuuuucaccaaaccauuuguagagcuacaaaagguau

SEQ ID NO: 44468 - RNA, 64 nt, Human
gauuucaguacuuuauccucauuguggaaacaagccaaaccaaaugaacucuggaaaaccuaaa

SEQ ID NO: 44469 - RNA, 64 nt, Human
ggagaggaaugaucucugcccagccccuuccuuuccaaaccaugcaauggaagagcccagaugg

SEQ ID NO: 44470 - RNA, 64 nt, Human
ugaacucauugaucgagugcugucugcuaaaucuccaaaccauucccaaaccuuuccccguagu

SEQ ID NO: 44471 - RNA, 64 nt, Human
cgaagugucagcccucaauguuggguacuuagacccaaaccaauaaauggugaguuuugaacaa

SEQ ID NO: 44472 - RNA, 64 nt, Human
aauagguauuguguaaaucuauaaauauuugaauccaaaccaaauauaauuuuuuaacuuacau

SEQ ID NO: 44473 - RNA, 64 nt, Human
uaccauuuaaguugagauuucaguggggacacagccaaaccauaucauucuaccccuggcaccu

SEQ ID NO: 44474 - RNA, 64 nt, Human
auaaauucaaguugcaauuucaguggggacauagccaaaccauaucacuggugaugccacuucu

SEQ ID NO: 44475 - RNA, 64 nt, Human
cacagagaauaagcugaacuuguaugguuuuucaccaaaccauggauagaaucaauauuuguag

SEQ ID NO: 44476 - RNA, 64 nt, Human
aacagacauuucagucacugcauucuuagguauuccaaaccaaauaugaugacaucaauagauu

SEQ ID NO: 44477 - RNA, 64 nt, Human
cagccaaauaucacaccuucugaucuuagccaucccaaaccaguaucugucccgagaggaaauu

SEQ ID NO: 44478 - RNA, 64 nt, Human
uccuacgugcuguuaugcuucucauuuuauauuuccaaaccaccugagcgaguaaugucaacuu

SEQ ID NO: 44479 - RNA, 64 nt, Human
uugcugccagguaugugaugcuguaggcuuggcuccaaaccagcugagugccugcuuuuuacuc

SEQ ID NO: 44480 - RNA, 64 nt, Human
uuuguauaaguauguauaggauugagcucuaaaaccaaaccauuauaaugauaauuuggguagc

SEQ ID NO: 44481 - RNA, 64 nt, Human
cuauuagcccuucuccauggcccugccaugcucuccaaaccacuuuuugcagcuuucucuaguu

SEQ ID NO: 44482 - RNA, 64 nt, Human
aguggccucaaagcaaccauggccuacuuaaaaaccaaaccaaaaauaaagaguuuaguugagg

SEQ ID NO: 44483 - RNA, 64 nt, Human
uccgaagcugugaccuguccuucaucguugagccccaaaccacugcucaggguccauuccucac

SEQ ID NO: 44484 - RNA, 64 nt, Human
cauuguguccggggcaccaggagccccaccaaccccaaaccaugcggagaauuagaguucagcu

SEQ ID NO: 44485 - RNA, 64 nt, Human
agcaaagucucaccccuuugucuacguugcuuccccaaaccaugagcagagggacuucgaugcc

SEQ ID NO: 44486 - RNA, 64 nt, Human
gcuuccccaaaccaugagcagagggacuucgaugccaaaccagacucggguccccuccugcuuc

SEQ ID NO: 44487 - RNA, 64 nt, Human
gugcauauauuuuuuauuuaaucugaccagccacccaaaccauggguauuuuugucuccacuuu

SEQ ID NO: 44488 - RNA, 64 nt, Human
aaaaggagcaacuugaauagauacugugaacuaaccaaaccaaaaccaaccccagagugcagau

SEQ ID NO: 44489 - RNA, 64 nt, Human
gaucugccccggagcuagggcagcaacaugaggaccaaaccaugcacauaaagcuuguaguuua

SEQ ID NO: 44490 - RNA, 64 nt, Human
ugacuggccaguuuugugcagcugacugucucagccaaaccacugaucuucccuggaggccuuc

SEQ ID NO: 44491 - RNA, 64 nt, Human
ccggaugaggccaucugagccuccagaccagaccccaaaccagcccuugagucugucacacucu

SEQ ID NO: 44492 - RNA, 54 nt, Human
aagccggugcccaccacugagaccccaaaccaccuauccccaguagauggcccu

SEQ ID NO: 44493 - RNA, 64 nt, Human
auugaagacagaucucuuuguauucucuucaagcccaaaccaauucuguuccuucaaucuaaau

SEQ ID NO: 44494 - RNA, 64 nt, Human
ucuaguugcccuuuagcaccuaaagaucugcaccccaaaccaaugucaccauaaagagggcacg

SEQ ID NO: 44495 - RNA, 64 nt, Human
gggggagggggaagcaaaggggggaggucaaaucccaaaccauuacugaggggauucucuacug

SEQ ID NO: 44496 - RNA, 64 nt, Human
gaaauuuguggccuuuuaggcgggaguuaggcgaccaaaccagugagagccccaaucccugcag

SEQ ID NO: 44497 - RNA, 64 nt, Human
cacccggucagucagagaacagagaucacacacaccaaaccagacagaggcagggcagcaugga

SEQ ID NO: 44498 - RNA, 64 nt, Human
gguggaagggaucucuggggucuggaauuuggccccaaaccagagaauguaccuuaagggggag

SEQ ID NO: 44499 - RNA, 64 nt, Human
gaguggggggcccagccccuucucuucucccccgccaaaccacagugggagcuggggcaggggg

SEQ ID NO: 44500 - RNA, 64 nt, Human
cuaauacacaggaagaagaaggcuucaaaaagucccaaaccaagacaacauguacauaaagauu

SEQ ID NO: 44501 - RNA, 64 nt, Human
gcaggcuccaccugggagccagccccaguucacaccaaaccaggcucccugaacaguccuguuc

SEQ ID NO: 44502 - RNA, 64 nt, Human
gggcaagcuggccaaaauauuggaacacacagaaccaaaccagguguguucuacaccugcauga

SEQ ID NO: 44503 - RNA, 64 nt, Human
gguuccuacucugggcucccgauucccauggcucccaaaccaugccgcaugguuugguuaauga

SEQ ID NO: 44504 - RNA, 64 nt, Human
uguugucaccccagcugaauuucuuaugacccucccaaaccaaagcucagauggggucagaaga

SEQ ID NO: 44505 - RNA, 64 nt, Human
accuccuaaugagaguaucugggugauugugaccccaaaccaucucuccaaagcauuaauaucc

SEQ ID NO: 44506 - RNA, 64 nt, Human
ugcacuuuauauguccagccucuuccucagucccccaaaccaaagcuacacagccagauuucuc

SEQ ID NO: 44507 - RNA, 64 nt, Human
ccaaagacugucagauuucuuagacuccacaggaccaaaccauagaacaauuucacugcaaaca

SEQ ID NO: 44508 - RNA, 64 nt, Human
cuuccuaucuccaagucuauguauuuucuggagaccaaaccagauaccagauaaucacaaagaa

SEQ ID NO: 44509 - RNA, 64 nt, Human
ccuaagauuuucaugaaaagccucucacuugaacccaaaccagaguacucuuacugccucuuuu

SEQ ID NO: 44510 - RNA, 64 nt, Human
gucacaacaauaaccuccauagcaccuccccuucccaaaccaaacaacccaacaaaaaaaaucc

SEQ ID NO: 44511 - RNA, 64 nt, Human
ccccuccaucuugaugauauauaaaaauuggaagccaaaccaguucuuaaaugcuacaugcaac

SEQ ID NO: 44512 - RNA, 64 nt, Human
aauguccacauacaguuuuugaaagaucuucucuccaaaccaguuaguuagagccagugacgcc

SEQ ID NO: 44513 - RNA, 64 nt, Human
ccccaaaccaaucaaggguuuguuuacgggagugccaaaccagcccucggcugcuaugaguugg

SEQ ID NO: 44514 - RNA, 64 nt, Human
gacgagcuagcccgaacugacuucagcagcuaccccaaaccaaucaaggguuuguuuacgggag

SEQ ID NO: 44515 - RNA, 64 nt, Human
gaauacaagaucccguccuccaggcagugaccucccaaaccagccugccuggucacugacugcu

SEQ ID NO: 44516 - RNA, 64 nt, Human
uguguagggaugaagacuauugaagacuccauugccaaaccauggccuuuccucaguguuguaa

SEQ ID NO: 44517 - RNA, 64 nt, Human
augauaguuaaaaauacgucauuuuaaagauuucccaaaccacaccacuaaauuuguuuuauga

SEQ ID NO: 44518 - RNA, 64 nt, Human
guuuacuaaaaguaaccaucuaaagagcuuguggccaaaccagcagaacauucuucucuucaaa

SEQ ID NO: 44519 - RNA, 64 nt, Human
gaaaggggccccaccggggucuaauggugacaguccaaaccacuccacuggccuccuggcagaa

SEQ ID NO: 44520 - RNA, 58 nt, Human
ggcucuuggaaaaugcauagagcaaaccccaaaccaguauauuuuaguauuuguuugg

SEQ ID NO: 44521 - RNA, 64 nt, Human
guguuguuuuguucgaaagauggcaaguguacaaccaaaccaauccacuugcuuacagaaagaa

SEQ ID NO: 44522 - RNA, 64 nt, Human
ccuaaggauccauggaagucaggagcauuaaaucccaaaccaaaucaacuccagauauaucagu

SEQ ID NO: 44523 - RNA, 64 nt, Human
aaucuggucuuauagcuagacaugaugaugguccccaaaccauugauguucuguuauguacugu

SEQ ID NO: 44524 - RNA, 64 nt, Human
auaaggucaagggaaaaccccgucucuauaccaaccaaaccaauucaccaacacaguugggacc

SEQ ID NO: 44525 - RNA, 64 nt, Human
guauuccacguauuccugcauuaauauugcacacccaaaccagucuaucagggaggcugaagca

SEQ ID NO: 44526 - RNA, 64 nt, Human
gccuuuuuuuaaaaaacaaaaaccacaaaaauucccaaaccauacuugcuaaaaauucugguaa

SEQ ID NO: 44527 - RNA, 64 nt, Human
aaaauucauuguguauauuacuacaaagacaaccccaaaccaauuuuuuuccugcgaaguuuaa

SEQ ID NO: 44528 - RNA, 64 nt, Human
cacccaaacuacgucaucuguuccaaugaagaaaccaaaccaccaucuuuuauaaauugccaug

SEQ ID NO: 44529 - RNA, 50 nt, Human
caccuccuuugaggucauagccaaaccaaaggguacacucauauuugugc

SEQ ID NO: 44530 - RNA, 64 nt, Human
cucgacuuggagaaauugcuauucuuccuguuguccaaaccauaaaucugaggauaaccugggc

SEQ ID NO: 44531 - RNA, 64 nt, Human
gggaaagaaccaucaaaccuuuccuccugacuuaccaaaccaggaaaacagcaggagagggugg

SEQ ID NO: 44532 - RNA, 64 nt, Human
gacucuuaagccauaggggcugguuuuccguacuccaaaccaucagguggacacaguccuagga

SEQ ID NO: 44533 - RNA, 64 nt, Human
ccccaaaagggaugaagaaaacccugugguagaaccaaaccacccaaggccagcccuuaagccu

SEQ ID NO: 44534 - RNA, 64 nt, Human
agggacgaguguucagugggccacagugaaccaaccaaaccaaccccgaaucaucgcucucgcc

SEQ ID NO: 44535 - RNA, 64 nt, Human
acuccuauguucggacccaagcaaguuagcuaaaccaaaccaacuccucugcuuugucccucag

SEQ ID NO: 44536 - RNA, 64 nt, Human
aucaccuucacgcugucccaccaugggccaggaaccaaaccagcacuggguucuacugcugugg

SEQ ID NO: 44537 - RNA, 64 nt, Human
caagguccucuugaaauguuaaugguuaauguucccaaaccagagaaugcuuugaaaauguauc

SEQ ID NO: 44538 - RNA, 64 nt, Human
agcccuggcagcccauggcaacucaaagugccuuccaaaccaaacugccccucaugagguuagg

SEQ ID NO: 44539 - RNA, 64 nt, Human
accucuagcuguucuuuuuuguacuuuucugguuccaaaccaguuuauucugugguucuauaau

SEQ ID NO: 44540 - RNA, 64 nt, Human
uauauguauaccuaagagaaugucaaaauaaacaccaaaccaaaagaagguaggagugccauuu

SEQ ID NO: 44541 - RNA, 64 nt, Human
gucaggaugacgguauuaugcuucuuggagucuuccaaaccaccuucccucaucuuucaucaau

SEQ ID NO: 44542 - RNA, 64 nt, Human
acgguaaccaucugggcccuccgacuuccuucaaccaaaccagggcuagaguccugaccugcca

SEQ ID NO: 44543 - RNA, 64 nt, Human
cacaccugagaucaacauucacauaguuuagacuccaaaccauucagucuaaaauacugaaacu

SEQ ID NO: 44544 - RNA, 64 nt, Human
uggaagggacuccucuuugggggaggguggauauccaaaccaaaaagaagaaaacagaugcccc

SEQ ID NO: 44545 - RNA, 64 nt, Human
agggugcugacuggcuucagcaaguuagaacuagccaaaccaggacccuguccaaucuuugaca

SEQ ID NO: 44546 - RNA, 64 nt, Human
gcuucuguaaaugcaggcgcaguuugucguguuuccaaaccaguugugccguccacucacuccu

SEQ ID NO: 44547 - RNA, 64 nt, Human
caagaacccaagcccacauccaaaccugccugucccaaaccacuuacuucccuguucaccucug

SEQ ID NO: 44548 - RNA, 64 nt, Human
uaaggccuuauuuaacaagcaagcaaaaugcaaaccaaaccauuauucauuuauuggcuuaagu

SEQ ID NO: 44549 - RNA, 64 nt, Human
ggaagacugccucaaacaaacaaaaaacaacaaaccaaaccaaaccaaaccaaaaaaaucucaa

SEQ ID NO: 44550 - RNA, 64 nt, Human
acugccucaaacaaacaaaaaacaacaaaccaaaccaaaccaaaccaaaaaaaucucaaagcga

SEQ ID NO: 44551 - RNA, 64 nt, Human
cucaaacaaacaaaaaacaacaaaccaaaccaaaccaaaccaaaaaaaucucaaagcgauugga

SEQ ID NO: 44552 - RNA, 64 nt, Human
aguccucucaggcaguugggaaaaugcaaagcacccaaaccacuaacacauccaacagcaccaa

SEQ ID NO: 44553 - RNA, 64 nt, Human
accaucuucucaagggcuuccaugucagcagacaccaaaccaucugaggcuuccucccuggggg

SEQ ID NO: 44554 - RNA, 64 nt, Human
auaccccacuccacaucaacauuccagggaugagccaaaccagcagggaguuagcacugaacug

SEQ ID NO: 44555 - RNA, 64 nt, Human
cucccugcccuugcccuuucccuuucccugggguccaaaccacauguguccugccucuccuggc

SEQ ID NO: 44556 - RNA, 64 nt, Human
cugcauuuccucccggagucacugguuucucggcccaaaccaugcuccccagcaguggcaaugg

SEQ ID NO: 44557 - RNA, 64 nt, Human
gaagcagguguagucccuggcauucugucuguauccaaaccagagcccagccaucccuccggua

SEQ ID NO: 44558 - RNA, 64 nt, Human
uucgucaauugcacaccggugcuguugggagugaccaaaccacaugaaccagacuuuucccguc

SEQ ID NO: 44559 - RNA, 64 nt, Human
aagcagagaccaugagaaggagaguucaggggucccaaaccaggccauccuagaccagccagcu

SEQ ID NO: 44560 - RNA, 64 nt, Human
ucugccugucccuguaucagcggcuacccaccuuccaaaccacucaggacaguacccguggcac

SEQ ID NO: 44561 - RNA, 64 nt, Human
cuuuucaugugauguggaaaccuacuucuguccuccaaaccaugaaaugugucaucuagacugc

SEQ ID NO: 44562 - RNA, 64 nt, Human
ggaauguucacccuaacuaccaauggggaccuacccaaaccaauauucauccccaauggaaugc

SEQ ID NO: 44563 - RNA, 64 nt, Human
ggcuuugguuuucauuccuuuuuguuuggcuuggccaaaccagaauucagcuuaucugaauuau

SEQ ID NO: 44564 - RNA, 64 nt, Human
acuccaaagccauaaauaaucaccauuuuugaaaccaaaccagagccugaguguugccuaauuu

SEQ ID NO: 44565 - RNA, 64 nt, Human
ucauagauaguuccauuaaguaaaaucaguaagaccaaaccacuggaaaacaugcauuuuggaa

SEQ ID NO: 44566 - RNA, 64 nt, Human
guauaauggguauacauuuuuguaaauagcauccccaaaccagccagccuucaguuauuuacaa

SEQ ID NO: 44567 - RNA, 64 nt, Human
cuccugcagcaugccccuuaagauuuucuacaacccaaaccaaguguauguauugauuucuagg

SEQ ID NO: 44568 - RNA, 64 nt, Human
ucacugccuguguaguacauaccugaccgggaguccaaaccaccuuggugcucugaaguccacu

SEQ ID NO: 44569 - RNA, 64 nt, Human
ugcccagccugggagcaccucuuugcuuuucacaccaaaccaaaacuggcgagagccccuccua

SEQ ID NO: 44570 - RNA, 64 nt, Human
gaaaaaagagcuagcccaaaaucccaaacucaaaccaaaccaaacagaaagcaguggagguggg

SEQ ID NO: 44571 - RNA, 64 nt, Human
cagggucauggucugaacuacucagauuggauuuccaaaccauccuuguauaaacugcucagaa

SEQ ID NO: 44572 - RNA, 64 nt, Human
agcucugccucuccggguuuuagucaaccuaacaccaaaccaaaauagaauguuagcuguucaa

SEQ ID NO: 44573 - RNA, 64 nt, Human
ugccucagccccacuccagaauagccaagagaacccaaaccaauaaaguuuaugcuaagucgag

SEQ ID NO: 44574 - RNA, 64 nt, Human
guuaaauaggcaagguacccagugauaacaccaaccaaaccacuccuaucugcaugauucugaa

SEQ ID NO: 44575 - RNA, 64 nt, Human
uaugcggcauuuaugaccaaucuguacuaauucuccaaaccaguauuauuucaauuauggcacu

SEQ ID NO: 44576 - RNA, 64 nt, Human
auuccccaaccucaaccuccuuucuucucugcucccaaaccaugucaggaccaccuuccucuag

SEQ ID NO: 44577 - RNA, 64 nt, Human
gucauugaauacggccucccgcagcaucccacccccaaaccaccgacucucauugccgacacug

SEQ ID NO: 44578 - RNA, 64 nt, Human
uuaacucaaguggaacuuuuaacucguuugaccuccaaaccauuuggaauucuuuccccaguau

SEQ ID NO: 44579 - RNA, 64 nt, Human
guguuuaaaugugacacuugugagaaggcauuugccaaaccaagccagcuggagcgccacagcc

SEQ ID NO: 44580 - RNA, 64 nt, Human
uuaguaucgucaauggugccacauaaaacaugucccaaaccaaaucccacccgugcugggcaga

SEQ ID NO: 44581 - RNA, 64 nt, Human
ccugcguuagcucuuuugaugagaaggaaauaaaccaaaccagccacuugcacuauggcuucca

SEQ ID NO: 44582 - RNA, 64 nt, Human
acugaaacacuucgagcuauuuagcuaaagcccaccaaaccaaaacaaaauacugauuuuuuuu

SEQ ID NO: 44583 - RNA, 64 nt, Human
aauauaauucuguuucugaccuguuuuaaaugaaccaaaccaaaucauacuuucucuucaaauu

SEQ ID NO: 44584 - RNA, 64 nt, Human
aauauaauucuguuugugaccuguuuuaaaugaaccaaaccaaaucauacuuuuucuuugaauu

SEQ ID NO: 44585 - RNA, 64 nt, Human
gccuagggacaccaaaaaagaaaaaaaaaaaaacccaaaccaaaaacgcaaaccaaagcaggca

SEQ ID NO: 44586 - RNA, 64 nt, Human
uuuuuuuuuuuuuccuccuuaagcugcugucaauccaaaccauuggcaucaucguuucuuuuga

SEQ ID NO: 44587 - RNA, 64 nt, Human
ggaugucccgcacucccuuagccauugccuuggaccaaaccacgugguuugcagcuuuucuacg

SEQ ID NO: 44588 - RNA, 64 nt, Human
agacuuuagaagauugauacugaugcacugcaucccaaaccaucaagggccuuuuccccuacaa

SEQ ID NO: 44589 - RNA, 64 nt, Human
guuccucggcggacucugcugaccuccugcagacccaaaccacagccacaucccagcuucugug

SEQ ID NO: 44590 - RNA, 64 nt, Human
ggcugccagccaggacccuggccugcagccugauccaaaccaaagacuguagaacccuggggug

SEQ ID NO: 44591 - RNA, 64 nt, Human
cugaggaagagccacaaaacaaaacacaacaaaaccaaaccacagaaucaucuuuaacccaacu

SEQ ID NO: 44592 - RNA, 64 nt, Human
cgcgcgcccgccucgcacagggccggggccuggaccaaaccacaugaacuggacugagaggggg

SEQ ID NO: 44593 - RNA, 64 nt, Human
cuauuaaaaaaaaaaaaucaacccuucuuccccaccaaaccacccaacuccucucuacucuuau

SEQ ID NO: 44594 - RNA, 64 nt, Human
agcugauuaauuacaggagguuuguucaggucccccaaaccaccgucagauuugaugauuuccu

SEQ ID NO: 44595 - RNA, 64 nt, Human
cagggaacgcuuuuguccaaggauucaccguauuccaaaccagagauguucaaauuggugagaa

SEQ ID NO: 44596 - RNA, 64 nt, Human
uccagucccacucggggauggagugggccggcggccaaaccagucacucggggaggaaugcgga

SEQ ID NO: 44597 - RNA, 64 nt, Human
ccauucucuuuggcaagaaguccccuucucgcccccaaaccagcaagggacucccccaccuggg

SEQ ID NO: 44598 - RNA, 64 nt, Human
ugcaguuggacagcugcgugcuggaguucuguccccaaaccaacugcagagaagaaagacgagc

SEQ ID NO: 44599 - RNA, 64 nt, Human
cucuaaaaaugugcuuugugaucaggagugcgcuccaaaccaaauacgcgcgcugcccuuucga

SEQ ID NO: 44600 - RNA, 64 nt, Human
augccagugccuugauauuggacuucccagccucccaaaccaugagaaauaaauguuuguugau

SEQ ID NO: 44601 - RNA, 64 nt, Human
cagccccucccuccuuggucuccuuuucgauaugccaaaccaauuuugggucgagugcauuuaa

SEQ ID NO: 44602 - RNA, 64 nt, Human
gaagucaccagaauaacuaggacucaaauucagaccaaaccaggacuagcuuuuugugccauga

SEQ ID NO: 44603 - RNA, 64 nt, Human
ccccuccaucauccuucaccuccuaucccccacuccaaaccaggacgaccugcaaggucccagc

SEQ ID NO: 44604 - RNA, 64 nt, Human
ccuaggacuugacccuuaccaaaccacagagaauccaaaccaauccaugauaaugucaguagga

SEQ ID NO: 44605 - RNA, 64 nt, Human
gguuagaaaaccuucaccuaggacuugacccuuaccaaaccacagagaauccaaaccaauccau

SEQ ID NO: 44606 - RNA, 64 nt, Human
uacugagcccaccgucagcggggcgcgcacgcccccaaaccagcuguuuacauacaggaaucag

SEQ ID NO: 44607 - RNA, 64 nt, Human
ccagccaaccuuuguggaauaagccccagcccagccaaaccaaacccagaugccugaggccugg

SEQ ID NO: 44608 - RNA, 64 nt, Human
ccccacauugccacauaccuggaggcugacguugccaaaccagccagggaaccaaccugggaag

SEQ ID NO: 44609 - RNA, 64 nt, Human
gggcugauccucaaguaccccaguuucacacauaccaaaccaagguucucuccccucuuuccuc

SEQ ID NO: 44610 - RNA, 64 nt, Human
guggauggccguggaugcgcagugccuugcauacccaaaccaggugggagcguuuuguugagca

SEQ ID NO: 44611 - RNA, 64 nt, Human
agaaacaagguuuccaggcucccaggucaguagaccaaaccaacuuccuuagauuuuuuuuuuu

SEQ ID NO: 44612 - RNA, 64 nt, Human
auauuuuauuauauauauauaucuauauuuuuguccaaaccaaccgcacaugcagauggggcuc

SEQ ID NO: 44613 - RNA, 64 nt, Human
acagccccucuucugcuguccuugaggacagacaccaaaccagagguggaggaagaacgguagg

SEQ ID NO: 44614 - RNA, 64 nt, Human
gugccucuaaagaaaccagcuuuuugcacuaaagccaaaccacaccgcuguccccuuagcccca

SEQ ID NO: 44615 - RNA, 64 nt, Human
acaugaacaaggcaauuucagugucuuacagcggccaaaccaugacgugaagaaugagauagga

SEQ ID NO: 44616 - RNA, 64 nt, Human
gcuaaguccuaaucuauggguacauuguugugucccaaaccaaaauuuuccuuauccacaaugu

SEQ ID NO: 44617 - RNA, 64 nt, Human
aauuguauuugaauuugugccucuuuguuuuuccccaaaccaaagcccucaaauuguagucucu

SEQ ID NO: 44618 - RNA, 64 nt, Human
cccugguuucuuuaagucuuaagugaugccccuuccaaaccaucauccuguccccacgcuccuc

SEQ ID NO: 44619 - RNA, 64 nt, Human
gaaaguggccaagaagcaguggccuuauugcaucccaaaccacgccucuugaccaggcugccuc

SEQ ID NO: 44620 - RNA, 64 nt, Human
aaaguucuuacuaauaguagugaaguuagaugggccaaaccaucaaacuuauuuuuauagaagu

SEQ ID NO: 44621 - RNA, 64 nt, Human
agacauugccaaccauauuggaucugcuugcuguccaaaccagcaaacuuuccugggcaaauca

SEQ ID NO: 44622 - RNA, 64 nt, Human
cuuaugucugcuagaaaguguuguaguugauugaccaaaccaguucauaaggggaauuuuuuuu

SEQ ID NO: 44623 - RNA, 64 nt, Human
gcgggccuggcuucccaucuccauggcaacccaaccaaaccaacaacacagcuggggcgggccc

SEQ ID NO: 44624 - RNA, 64 nt, Human
aauccagacucaggguuccagaaaucccccguucccaaaccaaaccaaucauggaucuucccuu

SEQ ID NO: 44625 - RNA, 64 nt, Human
agacucaggguuccagaaaucccccguucccaaaccaaaccaaucauggaucuucccuuuaagg

SEQ ID NO: 44626 - RNA, 64 nt, Human
ccugccccaccaggguccuuagggaugcucuaggccaaaccacaguuuguaccaaaaaccuugu

SEQ ID NO: 44627 - RNA, 64 nt, Human
cugccucuuuaggccaguugcauccuccauuuauccaaaccacuccucuccucccaguggagug

SEQ ID NO: 44628 - RNA, 64 nt, Human
ccagggaggggaacucagcaguucaggagccaccccaaaccauucugggacagggacaccccuu

SEQ ID NO: 44629 - RNA, 64 nt, Human
ggugggaccagaggucauaggugcccaacggcagccaaaccaaagacacuggugugcauggggc

SEQ ID NO: 44630 - RNA, 64 nt, Human
aguaucuuuaccuaccugaaaacauccaaggaagccaaaccauucaaaguaaaaugguuuuguu

SEQ ID NO: 44631 - RNA, 64 nt, Human
ugcuggggccaggacaggcgucuccuagguugugccaaaccagccuacagauguuccugccagu

SEQ ID NO: 44632 - RNA, 64 nt, Human
cagccugagcuggccuccuaugccucaucaugucccaaaccagacaccuggaugucugggugac

SEQ ID NO: 44633 - RNA, 64 nt, Human
uccgcagcuaucccgggcauccaguggcagcuccccaaaccaggccuccaagccaggugccacc

SEQ ID NO: 44634 - RNA, 64 nt, Human
ggccccccaacaggcuuucaaaugucugccuuccccaaaccaaucugugguuuuaaaagaagua

SEQ ID NO: 44635 - RNA, 64 nt, Human
ugauucuuuccccaaaucccuucuucccugguucccaaaccaaagacagccugcagcccuuucu

SEQ ID NO: 44636 - RNA, 64 nt, Human
ucaguauucuuuuggaauguaaaccgauuuaaugccaaaccaccuuaaccuuuguuucucagug

SEQ ID NO: 44637 - RNA, 64 nt, Human
uaauuuagaagauaggugagcaacuugagugaucccaaaccaaacuaacagugcugguuugucc

SEQ ID NO: 44638 - RNA, 64 nt, Human
agcaggaggcugaaggaggggagaacaaaauuguccaaaccaugcuguuuuuuucccuuaaaua

SEQ ID NO: 44639 - RNA, 64 nt, Human
cuaccacccaagggugccauggucccgggagagcccaaaccaccuguugggcauagccagagcu

SEQ ID NO: 44640 - RNA, 64 nt, Human
ccaauaauuagggaaaauugauaaauaucugucaccaaaccacaagaaauccaaaaucauuuua

SEQ ID NO: 44641 - RNA, 64 nt, Human
uucugcuuguauauuucuaaaaagaggaaggagcccaaaccauccucuccuuaccacucccauc

SEQ ID NO: 44642 - RNA, 64 nt, Human
ccuuuuauuuuuuuuuuaccuuggggugaugguuccaaaccauaaaugugauuauaguuaacac

SEQ ID NO: 44643 - RNA, 64 nt, Human
uacacuucaagaugagauuuggguggggacacagccaaaccauaacaguuugcuuuccacaggu

SEQ ID NO: 44644 - RNA, 64 nt, Human
uugcguagccagccuuaggaaaaacaaacagaacccaaaccagauggcaauguccaaucuaaaa

SEQ ID NO: 44645 - RNA, 64 nt, Human
uuuccagcugacuagaacccucuuuucuacucguccaaaccacucccgucaccugccuugucug

SEQ ID NO: 44646 - RNA, 64 nt, Human
ggaggauggggagacagcuaaccaacugcauuacccaaaccauauugcacuuuuaguucccuag

SEQ ID NO: 44647 - RNA, 64 nt, Human
aauauguaaaguauaguuuaaacccauuuccaguccaaaccaaugaaaauaguuucccaaauaa

SEQ ID NO: 44648 - RNA, 64 nt, Human
uuuuugggguuggacuaaauaugaaauccgaaagccaaaccagacucaccagaaauugcuguuu

SEQ ID NO: 44649 - RNA, 64 nt, Human
aaagggacugugcauugaguugguuccugcucccccaaaccauguuaaacguggcuaacagugu

SEQ ID NO: 44650 - RNA, 64 nt, Human
auggucauggccuuccagcccccuccaguuuuccccaaaccaauaaagaaagauacagcaaugg

SEQ ID NO: 44651 - RNA, 64 nt, Human
caguaccuggaugauucccaccaaggaggaauggccaaaccagaugggugagaacaagcccaau

SEQ ID NO: 44652 - RNA, 64 nt, Human
caauaguucaggucagacaucuaagauccccaggccaaaccaugccacacacgugucuguuccg

SEQ ID NO: 44653 - RNA, 64 nt, Human
uugcuucagaugaaaacaaaucacacaccguuucccaaaccaacagucuucacauuucuauccc

SEQ ID NO: 44654 - RNA, 64 nt, Human
ugucuggcuaguauugaaaacuagauaaacugcuccaaaccaacauggaguaaagagcauauuc

SEQ ID NO: 44655 - RNA, 64 nt, Human
auguaaaagagacaaauaaggagaaagaaaaucuccaaaccaggaauguuuuugugccacugac

SEQ ID NO: 44656 - RNA, 64 nt, Human
auauaagguuaggcuucuuggaacauuuauaaacccaaaccaauaccuguaaccucuuauguug

SEQ ID NO: 44657 - RNA, 64 nt, Human; identical to SEQ ID NO: 15710

SEQ ID NO: 44658 - RNA, 64 nt, Human; identical to SEQ ID NO: 15711

SEQ ID NO: 44659 - RNA, 64 nt, Human; identical to SEQ ID NO: 15712

SEQ ID NO: 44660 - RNA, 64 nt, Human; identical to SEQ ID NO: 15713

SEQ ID NO: 44661 - RNA, 64 nt, Human; identical to SEQ ID NO: 15714

SEQ ID NO: 44662 - RNA, 64 nt, Human; identical to SEQ ID NO: 15715

SEQ ID NO: 44663 - RNA, 64 nt, Human; identical to SEQ ID NO: 15716

SEQ ID NO: 44664 - RNA, 64 nt, Human; identical to SEQ ID NO: 15717

SEQ ID NO: 44665 - RNA, 64 nt, Human; identical to SEQ ID NO: 15718

SEQ ID NO: 44666 - RNA, 64 nt, Human; identical to SEQ ID NO: 15719

SEQ ID NO: 44667 - RNA, 64 nt, Human; identical to SEQ ID NO: 15720

SEQ ID NO: 44668 - RNA, 64 nt, Human; identical to SEQ ID NO: 15721

SEQ ID NO: 44669 - RNA, 64 nt, Human; identical to SEQ ID NO: 15722

SEQ ID NO: 44670 - RNA, 64 nt, Human; identical to SEQ ID NO: 15723

SEQ ID NO: 44671 - RNA, 64 nt, Human; identical to SEQ ID NO: 15724

SEQ ID NO: 44672 - RNA, 64 nt, Human; identical to SEQ ID NO: 15725

SEQ ID NO: 44673 - RNA, 64 nt, Human; identical to SEQ ID NO: 15726

SEQ ID NO: 44674 - RNA, 64 nt, Human; identical to SEQ ID NO: 15727

SEQ ID NO: 44675 - RNA, 64 nt, Human; identical to SEQ ID NO: 15728

SEQ ID NO: 44676 - RNA, 64 nt, Human; identical to SEQ ID NO: 15729

SEQ ID NO: 44677 - RNA, 64 nt, Human; identical to SEQ ID NO: 15730

SEQ ID NO: 44678 - RNA, 64 nt, Human; identical to SEQ ID NO: 15731

SEQ ID NO: 44679 - RNA, 64 nt, Human; identical to SEQ ID NO: 15732

SEQ ID NO: 44680 - RNA, 64 nt, Human; identical to SEQ ID NO: 15733

SEQ ID NO: 44681 - RNA, 64 nt, Human; identical to SEQ ID NO: 15734

SEQ ID NO: 44682 - RNA, 64 nt, Human; identical to SEQ ID NO: 15735

SEQ ID NO: 44683 - RNA, 64 nt, Human; identical to SEQ ID NO: 15736

SEQ ID NO: 44684 - RNA, 64 nt, Human; identical to SEQ ID NO: 15737

SEQ ID NO: 44685 - RNA, 64 nt, Human; identical to SEQ ID NO: 15738

SEQ ID NO: 44686 - RNA, 64 nt, Human; identical to SEQ ID NO: 15739

SEQ ID NO: 44687 - RNA, 63 nt, Human; identical to SEQ ID NO: 15740

SEQ ID NO: 44688 - RNA, 63 nt, Human; identical to SEQ ID NO: 15740

SEQ ID NO: 44689 - RNA, 64 nt, Human; identical to SEQ ID NO: 15742

SEQ ID NO: 44690 - RNA, 64 nt, Human; identical to SEQ ID NO: 15743

SEQ ID NO: 44691 - RNA, 64 nt, Human; identical to SEQ ID NO: 15744

SEQ ID NO: 44692 - RNA, 64 nt, Human; identical to SEQ ID NO: 15745

SEQ ID NO: 44693 - RNA, 64 nt, Human; identical to SEQ ID NO: 15710

SEQ ID NO: 44694 - RNA, 64 nt, Human; identical to SEQ ID NO: 15711

SEQ ID NO: 44695 - RNA, 64 nt, Human; identical to SEQ ID NO: 15712

SEQ ID NO: 44696 - RNA, 64 nt, Human; identical to SEQ ID NO: 15713

SEQ ID NO: 44697 - RNA, 64 nt, Human; identical to SEQ ID NO: 15714

SEQ ID NO: 44698 - RNA, 64 nt, Human; identical to SEQ ID NO: 15715

SEQ ID NO: 44699 - RNA, 64 nt, Human; identical to SEQ ID NO: 15716

SEQ ID NO: 44700 - RNA, 64 nt, Human; identical to SEQ ID NO: 15717

SEQ ID NO: 44701 - RNA, 64 nt, Human; identical to SEQ ID NO: 15718

SEQ ID NO: 44702 - RNA, 64 nt, Human; identical to SEQ ID NO: 15719

SEQ ID NO: 44703 - RNA, 64 nt, Human; identical to SEQ ID NO: 15720

SEQ ID NO: 44704 - RNA, 64 nt, Human; identical to SEQ ID NO: 15721

SEQ ID NO: 44705 - RNA, 64 nt, Human; identical to SEQ ID NO: 15722

SEQ ID NO: 44706 - RNA, 64 nt, Human; identical to SEQ ID NO: 15723

SEQ ID NO: 44707 - RNA, 64 nt, Human; identical to SEQ ID NO: 15724

SEQ ID NO: 44708 - RNA, 64 nt, Human; identical to SEQ ID NO: 15725

SEQ ID NO: 44709 - RNA, 64 nt, Human; identical to SEQ ID NO: 15726

SEQ ID NO: 44710 - RNA, 64 nt, Human; identical to SEQ ID NO: 15727

SEQ ID NO: 44711 - RNA, 64 nt, Human; identical to SEQ ID NO: 15728

SEQ ID NO: 44712 - RNA, 64 nt, Human; identical to SEQ ID NO: 15729

SEQ ID NO: 44713 - RNA, 64 nt, Human; identical to SEQ ID NO: 15730

SEQ ID NO: 44714 - RNA, 64 nt, Human; identical to SEQ ID NO: 15731

SEQ ID NO: 44715 - RNA, 64 nt, Human; identical to SEQ ID NO: 15732

SEQ ID NO: 44716 - RNA, 64 nt, Human; identical to SEQ ID NO: 15733

SEQ ID NO: 44717 - RNA, 64 nt, Human; identical to SEQ ID NO: 15734

SEQ ID NO: 44718 - RNA, 64 nt, Human; identical to SEQ ID NO: 15735

SEQ ID NO: 44719 - RNA, 64 nt, Human; identical to SEQ ID NO: 15736

SEQ ID NO: 44720 - RNA, 64 nt, Human; identical to SEQ ID NO: 15737

SEQ ID NO: 44721 - RNA, 64 nt, Human; identical to SEQ ID NO: 15738

SEQ ID NO: 44722 - RNA, 64 nt, Human; identical to SEQ ID NO: 15739

SEQ ID NO: 44723 - RNA, 63 nt, Human; identical to SEQ ID NO: 15740

SEQ ID NO: 44724 - RNA, 63 nt, Human; identical to SEQ ID NO: 15740

SEQ ID NO: 44725 - RNA, 64 nt, Human; identical to SEQ ID NO: 15742

SEQ ID NO: 44726 - RNA, 64 nt, Human; identical to SEQ ID NO: 15743

SEQ ID NO: 44727 - RNA, 64 nt, Human; identical to SEQ ID NO: 15744

SEQ ID NO: 44728 - RNA, 64 nt, Human; identical to SEQ ID NO: 15745

SEQ ID NO: 44729 - RNA, 64 nt, Human
ugccugcccucgugugacauggaauuggugucaggaccgccacguggccuucagaggaauccac

SEQ ID NO: 44730 - RNA, 64 nt, Human
uguggaguggggcaguagaaggucggaggcuugggaccgccagauggggccucuguuucggaga

SEQ ID NO: 44731 - RNA, 64 nt, Human
gaggccuggucauccuggcccgcaggucugagaagaccgccaaggugaaggcccuccugcccuc

SEQ ID NO: 44732 - RNA, 53 nt, Human
ugcugagggagccugagugaggagaccgccagccccagaagcagagggcaguc

SEQ ID NO: 44733 - RNA, 64 nt, Human
cuuggaugcccagcuguguccagagguggccugggaccgccaguugcacgccugccaccucagc

SEQ ID NO: 44734 - RNA, 64 nt, Human
ucagcuggccgagaguccaggccuugccucccccgaccgccauggagggggcagcccggcacag

SEQ ID NO: 44735 - RNA, 64 nt, Human
caucugcucaauaucacugcucuggauaggaaaugaccgccaucuccagccggccaccucaggc

SEQ ID NO: 44736 - RNA, 64 nt, Human
cgccccggggcaagggccccagcagcccuauggugaccgccacacugugccuuaaugucugccg

SEQ ID NO: 44737 - RNA, 64 nt, Human
cagcucccagccuggcaugagcuuggacagucuggaccgccacccucccugaaccagggagaca

SEQ ID NO: 44738 - RNA, 64 nt, Human
gaaaccucacccuucuggagcacggggccugggugaccgccaauacuugaccaccccgucgagc

SEQ ID NO: 44739 - RNA, 64 nt, Human
cagcggggcggaggaccggcacggcuacaucugggaccgccacuacaacaucugucuggccagg

SEQ ID NO: 44740 - RNA, 64 nt, Human
cacucugucugccagguaugagaagaacacguaagaccgccaccacacucacccucccucaagg

SEQ ID NO: 44741 - RNA, 64 nt, Human
gggcuccgccccugccgcugcugccgcugccuaugaccgccacuaguuaccgcggggaccacau

SEQ ID NO: 44742 - RNA, 64 nt, Human
ggugcccagcuggaaggacgaaagcacacuuugugaccgccauccucaccagcugcaugccugg

SEQ ID NO: 44743 - RNA, 64 nt, Human
ccugagagugcccccacccaucucaugccccagggaccgccacugcccaccgccuccagcagcc

SEQ ID NO: 44744 - RNA, 64 nt, Human
aacucccaccccugacuuacccuggaggaggggugaccgccaccugaugggauugcacgguuug

SEQ ID NO: 44745 - RNA, 64 nt, Human
cguggcugccucugucuucacucgcuguugaugugaccgccaggccuccucucguaccuuggac

SEQ ID NO: 44746 - RNA, 64 nt, Human
uuuuggagagaaggcagcucccagccugcugggugaccgccauucugcguguguuccccagcug

SEQ ID NO: 44747 - RNA, 64 nt, Human
ugccucagccucccgaguagcugggauuacaggcgaccgccaccacgccuggcuacuuuuugua

SEQ ID NO: 44748 - RNA, 64 nt, Human
uguauguggcccacaggugucgcucaagucuuccgaccgccaaggcucggacgaggagagcgug

SEQ ID NO: 44749 - RNA, 64 nt, Human
gggugacgucugcugcugcugacugaggacugcagaccgccaccacucaggggcucuggagggg

SEQ ID NO: 44750 - RNA, 64 nt, Human
ggcagaggaagauggcagugaauaucaaacaguagaccgccaucaacuucuaacagccaguaca

SEQ ID NO: 44751 - RNA, 64 nt, Human
cagacucugugaagugcaguucuucuccaccuaggaccgccagcagagcggggggaucucccug

SEQ ID NO: 44752 - RNA, 64 nt, Human
cacaccuucugggccucauuaucucccacaacuagaccgccaugccucaccaaccuaugucccu

SEQ ID NO: 44753 - RNA, 64 nt, Human
uuggggcuucaggcagcagacugaccaucucccagaccgccagugacugggggaggaccugcuc

SEQ ID NO: 44754 - RNA, 64 nt, Human
aacauauauaugcuguuuauuuacuuauuuaagagaccgccaugguagguuucucuguagcuug

SEQ ID NO: 44755 - RNA, 64 nt, Human
ggacugggccgcccagccccuugacuccagccucgaccgccaggccccaggccagagccaccca

SEQ ID NO: 44756 - RNA, 64 nt, Human
ugagcagcccuccugccaaggaggcucgguuccggaccgccaagaagcucuauggcagcaccuu

SEQ ID NO: 44757 - RNA, 64 nt, Human
gcugcaggugccaccgaggagcugucaccggccugaccgccaccccugacggccgccugcucuu

SEQ ID NO: 44758 - RNA, 64 nt, Human
ggcaggccugcugcuggaccccagaggccacugugaccgccaaggggccuuuuccacuuccacg

SEQ ID NO: 44759 - RNA, 64 nt, Human
caggcccaccuaccuucaaagcugaagccgccaggaccgccaaagaaugccuugaagauauugu

SEQ ID NO: 44760 - RNA, 64 nt, Human
ccgcccggggcugagcgcacgccccgagguccgagaccgccacgcacagggauacagggggcgc

SEQ ID NO: 44761 - RNA, 64 nt, Human
ugaggcaggccaggcaagcagucaggggugccaagaccgccauuggcucagugcagugggaaua

SEQ ID NO: 44762 - RNA, 64 nt, Human
uuccaagcccaggguuuggcuccuuaaacccgaggaccgccaccucuucccagugcuugcgacc

SEQ ID NO: 44763 - RNA, 64 nt, Human
aggcccucugacaguggggaggacgaggaugugggaccgccagccgcgggcacuggugggcccu

SEQ ID NO: 44764 - RNA, 64 nt, Human
ggaggguggagguguccugaggcugauggacagugaccgccacuggcccccaacaugaccacac

SEQ ID NO: 44765 - RNA, 64 nt, Human
uccccacucccuguccauccccaguuggggcugcgaccgccagauucucccuuaaggaauugac

SEQ ID NO: 44766 - RNA, 64 nt, Human
cccuguuggucuguugaccgcugggcucgcuggugaccgccacagccccgcuuuguaaccaggg

SEQ ID NO: 44767 - RNA, 64 nt, Human
uuauuuuuuaaguuuauuuauggcucuuuaaggugaccgccaccuugguccuagugucuauucc

SEQ ID NO: 44768 - RNA, 64 nt, Human
cgcaggccuguagggcccucgugcagcccacccugaccgccaggaugcuucugccauccagggg

SEQ ID NO: 44769 - RNA, 64 nt, Human
accuuugcagacguggcacccgagugcacacaccgaccgccacaugugcuuuucugccgggaau

SEQ ID NO: 44770 - RNA, 64 nt, Human
aguggugugcacauggcugggggacacucgguuugaccgccagcggaugggugucacaaaugca

SEQ ID NO: 44771 - RNA, 64 nt, Human
gauguccaaacugucgugcaaacccagugagacagaccgccaaauaaacggacucaguggacac

SEQ ID NO: 44772 - RNA, 64 nt, Human
cgcgugcugcgcgccggccuccugcugggcaagugaccgccagggccgggaccccucggauucc

SEQ ID NO: 44773 - RNA, 64 nt, Human
cuaggaagcuccucguuugugugagcgugggucagaccgccaaaguaggacuucaucguuuacc

SEQ ID NO: 44774 - RNA, 64 nt, Human
uggaguccuuuaucuaccagagccuuuuugguuugaccgccacgauuuagguuagucaguuuaa

SEQ ID NO: 44775 - RNA, 64 nt, Human
aaaaguggaagcuguacuugggaauuguggagaagaccgccacuccaucugauuugcauaaaug

SEQ ID NO: 44776 - RNA, 64 nt, Human
ucugggauggcuaugggagaggaggagugauggggaccgccaccuuuucugcaggaaaugugcc

SEQ ID NO: 44777 - RNA, 64 nt, Human
ggccaccacuccaccagaugggcagagcagcuaugaccgccacccagcccucccgcucaggcca

SEQ ID NO: 44778 - RNA, 64 nt, Human
ccacgguguccccgccgggaagcagccccggcuccugaaucacccucgcuccgucaggcgggac

SEQ ID NO: 44779 - RNA, 64 nt, Human
gcugggaugacaggugugagccacugcgcccagccugaaucauuucuuauaccuucugacagcc

SEQ ID NO: 44780 - RNA, 64 nt, Human
cucagauaaguugguucacaaagaauguuaaguacugaaucaugugugacugagaccagagaug

SEQ ID NO: 44781 - RNA, 64 nt, Human
caggaauccuuucugugagguggaaacagugguccugaaucauugugcucacaccuaacuugaa

SEQ ID NO: 44782 - RNA, 62 nt, Human
cgcaguguggggagauguaguccagacaaagacugaaucaggccuucccuucuucuuggugg

SEQ ID NO: 44783 - RNA, 64 nt, Human
cucugucacacccccacuaccgcugccacgcccucugaaucaugcagggaagggucugccccug

SEQ ID NO: 44784 - RNA, 64 nt, Human
ccagcuggcuuuuacccuugaccugugucccuagcugaaucacuagcucagauuuuucugaucu

SEQ ID NO: 44785 - RNA, 64 nt, Human
ucccuuacccuccucugcugggaaccuagcacaccugaaucagcuggacauacugcuggagucc

SEQ ID NO: 44786 - RNA, 64 nt, Human
uuuaacaugcaaacaaccauuguugcuaccuauccugaaucaagccuugagccuaaaucaaagc

SEQ ID NO: 44787 - RNA, 64 nt, Human
aaaaaaaaaaacucuuaagaaaacuguacuaaaucugaaucauguuuugagcuuguuugcagua

SEQ ID NO: 44788 - RNA, 64 nt, Human
ucaucuuauguggguacagaaagagguaaagagucugaaucaaaaaggaccagguuauugcugu

SEQ ID NO: 44789 - RNA, 64 nt, Human
ccaagaauuuugauugggaacagaauacaagcagcugaaucagaugaauuacuaagcaacaaag

SEQ ID NO: 44790 - RNA, 64 nt, Human
ugaccgauggacuuucugaagcuaaagaccacaccugaaucagggcugugguaaucaucuuacc

SEQ ID NO: 44791 - RNA, 64 nt, Human
uacuauaggaauccuuacuuccccaguauugaagcugaaucagugaguguguacaaugauacau

SEQ ID NO: 44792 - RNA, 64 nt, Human
ugccuauugacccugcaguuagcaugcugucacccugaaucauaaucgcuccuuugcaccucua

SEQ ID NO: 44793 - RNA, 64 nt, Human
ccugccaccuacagucaggccacaugccuggucacugaaucaugcaaaacuggccucagucccu

SEQ ID NO: 44794 - RNA, 64 nt, Human
auguauggucccuguagcgugaccuuuacuagcucugaaucagaagacagagcuauuucagagg

SEQ ID NO: 44795 - RNA, 64 nt, Human
gucguggggaaagagauggggcuguauagauuaucugaaucauuugucuaagagguacauucuu

SEQ ID NO: 44796 - RNA, 64 nt, Human
augggauaugaucauagauuuuagucuuacuaaucugaaucacauauuaaucaggacauuaaaa

SEQ ID NO: 44797 - RNA, 64 nt, Human
gcugcucuucccucccccgccauagcuaagaugccugaaucaauuacggagauacagagccuug

SEQ ID NO: 44798 - RNA, 64 nt, Human
uccauuaccuggaagguuucuguaccuugagagccugaaucagaggccgucgggaacgcccucc

SEQ ID NO: 44799 - RNA, 64 nt, Human
cgcugaccauagccagcaaaagaccuggcagguccugaaucaaaacaacagaguggcugaaagu

SEQ ID NO: 44800 - RNA, 64 nt, Human
acacacacacacacacacacacauacacacacgacugaaucagaucggauugcucuuugauagc

SEQ ID NO: 44801 - RNA, 64 nt, Human
uuucugcauaaaagucauacauaugaagcaagggcugaaucauaaucacaaggcuuaauuuuga

SEQ ID NO: 44802 - RNA, 64 nt, Human
auucacauugcagcacaugaugccagaaauagcacugaaucaagaaaauagccauugcggagcu

SEQ ID NO: 44803 - RNA, 64 nt, Human
uaacuaugaaaaucauuaugucauuccauaaugacugaaucaaggaggaaaauaugguguuugg

SEQ ID NO: 44804 - RNA, 64 nt, Human
uugguacgguuuuacacaacuccuuaccauuaaacugaaucagaaauccauuuucuggcugaau

SEQ ID NO: 44805 - RNA, 64 nt, Human
gagcaagauggagcaauggagagaagaccucuuccugaaucacuggacuccagaaaugugcaug

SEQ ID NO: 44806 - RNA, 64 nt, Human
uguguggcucuucucuagaggagcauugaccccccugaaucagcucuguccuuggcgggacagu

SEQ ID NO: 44807 - RNA, 64 nt, Human
ugacaaacaacagagccuugaccacguggagucucugaaucagccuugucuggaaccagaucua

SEQ ID NO: 44808 - RNA, 64 nt, Human
guucaugaaaccguuuggguucauuuaaauuugucugaaucauuagucuugacuugaagugaac

SEQ ID NO: 44809 - RNA, 64 nt, Human
cugaucaaacguugaguuccuuggguuggggaaccugaaucaaucagaaacugcuucuagaauu

SEQ ID NO: 44810 - RNA, 64 nt, Human
ccugcaguuuuuaauuugguagaugacaaauauucugaaucaccaauuaaaaaccuuuuuggga

SEQ ID NO: 44811 - RNA, 64 nt, Human
auuuaaucaucuaauuagacaugaacucaguuagcugaaucauuuacauuuugacuccauagcu

SEQ ID NO: 44812 - RNA, 64 nt, Human
uuuuuuuuaaagaaaugguagaaaauuugauaaucugaaucaccagcauucaaacaaauauuuc

SEQ ID NO: 44813 - RNA, 64 nt, Human
uccuguguuuuggugucuucccuuaucugcuacccugaaucaccuguccuggucuugcugugug

SEQ ID NO: 44814 - RNA, 64 nt, Human
gugccugucccugcucugccucccacccaguugccugaaucaucccagcucagaugcagccacu

SEQ ID NO: 44815 - RNA, 64 nt, Human
uugaaaauuaaccaaacuuaauacuaggagaagacugaaucauuaaugaugucucacaaauuac

SEQ ID NO: 44816 - RNA, 64 nt, Human
uuacacgacgaaguagcuuuugaauaaugucugccugaaucaccuuucuuugugugccuccuac

SEQ ID NO: 44817 - RNA, 64 nt, Human
ucacgguaugccucuuccuauccaggcaccuauucugaaucaccauguugcucugcagcuagag

SEQ ID NO: 44818 - RNA, 64 nt, Human
ugugaauuccugcccuggcgccucuucccuggggcugaaucaggcccugcugcaaaacuccagg

SEQ ID NO: 44819 - RNA, 64 nt, Human
augaucuaauacaaagaugagcucugaacaaacacugaaucauguuaauagacaguagccaagu

SEQ ID NO: 44820 - RNA, 64 nt, Human
auuucagaaaagaaagcuuuauuuuaacacucaucugaaucaacauuaaagccuuuucucucaa

SEQ ID NO: 44821 - RNA, 64 nt, Human
aaauaauaaaauuguucuaauuuggugccauuuccugaaucacaacuguauuuuuguaucucaa

SEQ ID NO: 44822 - RNA, 64 nt, Human
uugcuaaaauaucuaaacuuuuguuuuguuuuaacugaaucauuuuuuaacuuaaaaagcugga

SEQ ID NO: 44823 - RNA, 64 nt, Human
accuaugacuguacuugucaguaugagaauuuuucugaaucauauuggggaagcagugauuuua

SEQ ID NO: 44824 - RNA, 64 nt, Human
ggacuugaagaaagauuguccccaggcacaguaucugaaucacuggggauuaugauucacccuc

SEQ ID NO: 44825 - RNA, 64 nt, Human
guuucccuccugcuccccccgcccgacuuugacucugaaucagcauuugguccuauucagagga

SEQ ID NO: 44826 - RNA, 64 nt, Human
accuccuuugccacuguaccccaucaagcuuacucugaaucaaagguuuuguaaaacuuuugaa

SEQ ID NO: 44827 - RNA, 64 nt, Human
gauagccagaguaaguaagcagccacugcaagcucugaaucaguuuuuuaaaaaaaagaaaaaa

SEQ ID NO: 44828 - RNA, 64 nt, Human
uacucauccaucagacuaucuguauauauaaguacugaaucaguauuuauuaaguaaaugaugu

SEQ ID NO: 44829 - RNA, 64 nt, Human
caagauuauugcaaaaaucuuauuccaaacacaccugaaucaaaucguuacgcaacucuuuggc

SEQ ID NO: 44830 - RNA, 64 nt, Human
gaccaaugauuuccuguuaugagucaugaggaaacugaaucaccuagaaguggaauaaugugcu

SEQ ID NO: 44831 - RNA, 64 nt, Human
ugugcauaucacuugauaugugcaccaauaccuacugaaucagaaauguaaggcauuggugaug

SEQ ID NO: 44832 - RNA, 64 nt, Human
gacuuugaagcacugaaaguuacugaagugccuucugaaucaaggauuuaauuaaggccacaau

SEQ ID NO: 44833 - RNA, 64 nt, Human
ucaucaaaauuacaaauuuucugauugaacucaucugaaucaucaguuccuugauggagagaga

SEQ ID NO: 44834 - RNA, 64 nt, Human
uuuuauaugccaaucuacuuuguuuaaaaaaggucugaaucaggacuugugaaaaccuguagug

SEQ ID NO: 44835 - RNA, 64 nt, Human
uucauugacugauggugaaauggcuggagugauucugaaucaaggugauugugauuauagugac

SEQ ID NO: 44836 - RNA, 64 nt, Human
ugcuuaucaguaguaucaaugauuuacucaauaucugaaucaccuugauucagaaccauuucag

SEQ ID NO: 44837 - RNA, 64 nt, Human
ucugacaaggaagaaggugaggccacauccgauucugaaucagagguuagugaaauucacauca

SEQ ID NO: 44838 - RNA, 64 nt, Human
uuucagaagcauccagaaugccuaccaucagcuccugaaucagggauuuucagcacuaccucug

SEQ ID NO: 44839 - RNA, 64 nt, Human
caguauuuucauaaugccauguuuugauaaaguacugaaucaccacuuuauauccacaaaggca

SEQ ID NO: 44840 - RNA, 64 nt, Human
guggacuccuggaauuugaggcaucauaaugauacugaaucaagaacuuccuucugcuucuacc

SEQ ID NO: 44841 - RNA, 64 nt, Human
gugacaucuaaccaagacugugucaacaauauugcugaaucaaugguuuuguccaguuuauugg

SEQ ID NO: 44842 - RNA, 64 nt, Human
agagagauaugugugcauauauauuuuuuugcaccugaaucacccagcuuuucauaagugguau

SEQ ID NO: 44843 - RNA, 64 nt, Human
uuguuacuuuuaagaaaacucaugcucuguuucucugaaucaaaugaaguagaaguuuacaaag

SEQ ID NO: 44844 - RNA, 64 nt, Human
uuuaucuaccugguuuauggaauagaauuuauugcugaaucaugcuccaguauuugagugaugu

SEQ ID NO: 44845 - RNA, 64 nt, Human
aaccccuucuuuaggguccagaaggaauuguggacugaaucacuagccuuaggucuuucagcaa

SEQ ID NO: 44846 - RNA, 64 nt, Human
aaacauucagaacuuguugaaagaaaaauuauaucugaaucaagauucauguuuuuuauuuuua

SEQ ID NO: 44847 - RNA, 64 nt, Human
acaucagugagcaagcuguguacacuggaaaacacugaaucaauacaaugcguuugugauuauc

SEQ ID NO: 44848 - RNA, 64 nt, Human
uggggagaaagaugaaagaggucuuauuuguauucugaaucagcaauuauauucccugugauua

SEQ ID NO: 44849 - RNA, 64 nt, Human
ccggaguccuagcacagcaaaccaggagguggaacugaaucagccuggaauggcugcugagagc

SEQ ID NO: 44850 - RNA, 64 nt, Human
uugaagaccgccccccgccucuccccaagaggaacugaaucagcaugaaaaugcaguuucuuca

SEQ ID NO: 44851 - RNA, 64 nt, Human
cacgagcacaccuggagaaauucagaaccagguucugaaucaucacgauugccuuuugcaugaa

SEQ ID NO: 44852 - RNA, 64 nt, Human
accuaggauuuagggcugcaguugcugucugcuucugaaucacugggggugucuccuaagaacu

SEQ ID NO: 44853 - RNA, 64 nt, Human
gugaugugagcaauaccaucuuaaaacuuguuaccugaaucaguagaugaaucuuuuauccagu

SEQ ID NO: 44854 - RNA, 64 nt, Human
guguuucugaaauuggauggcuggcuaauagacacugaaucacccggagugcuuaucuuaaaau

SEQ ID NO: 44855 - RNA, 64 nt, Human
aaacggaaacaucaggcaugaacacuguuuaugucugaaucaacugcagaucuaauuugguucu

SEQ ID NO: 44856 - RNA, 64 nt, Human
uucguuuuguuuucuuuguuuuuucccccuucuccugaaucagcagggauggaaggaggguagg

SEQ ID NO: 44857 - RNA, 64 nt, Human
uauaggugaaugaguaaacugagacuuaagggaacugaaucacuuaaaugucaccuggcuaacu

SEQ ID NO: 44858 - RNA, 64 nt, Human
aacaggaaaguugggaagcggggguaggacuacacugaaucauuaacagugcuguaaacuacca

SEQ ID NO: 44859 - RNA, 64 nt, Human
uuuaaugagccuguaaggaccagacacuguggcgcugaaucagauuuaauaaugaguuaagaca

SEQ ID NO: 44860 - RNA, 64 nt, Human
guuuuucaaaaugcaagugagguuugauuuuuuacugaaucaaaugcaaauguuaccuguuaaa

SEQ ID NO: 44861 - RNA, 64 nt, Human
agcuaucuaagcucuggacuaccccuuugugcagcugaaucacugcaggguugaccaugccugg

SEQ ID NO: 44862 - RNA, 64 nt, Human
agugcauccaaaggugcucagagagccggcccgccugaaucauucucgauuuaacucgagaccu

SEQ ID NO: 44863 - RNA, 64 nt, Human
accaauugcacguuuggugaaaguuucuucaacucugaaucaaaagcugaaauucucagaauua

SEQ ID NO: 44864 - RNA, 64 nt, Human
cacuaaaauguaauggcaugaaaaucucuguagucugaaucacuaauauuccugaguuuuuaug

SEQ ID NO: 44865 - RNA, 64 nt, Human
gagcaauagucaguggcaccauuuccuaaaguaacugaaucaaucaauccagucagguaauuau

SEQ ID NO: 44866 - RNA, 64 nt, Human
uguacagaauuaacauauaaacuuuguuguaaaacugaaucaugucagaacugcuuaaaauuaa

SEQ ID NO: 44867 - RNA, 64 nt, Human
gagaaagagaagcuauauagagaaaaggaaaccacugaaucaaagagagagcuccuuugauuuc

SEQ ID NO: 44868 - RNA, 64 nt, Human
ucuaagcuuaagauaaaagugguucuuuacaugacugaaucaauuacaauuuaugggcuagagc

SEQ ID NO: 44869 - RNA, 63 nt, Human
cucuuuaaaauucuggcaccaaauacaacuuacccugaaucacacaccucuguagugugagug

SEQ ID NO: 44870 - RNA, 64 nt, Human
agcacuucacugcucugggcugcagcuuccagcacugaaucagaggccacacagcccaaagauu

SEQ ID NO: 44871 - RNA, 64 nt, Human
aaacaaaaguauuuaacgacccagucaaugaaaacugaaucaagaaaugaaugcuccaugaaau

SEQ ID NO: 44872 - RNA, 64 nt, Human
gagaauuuuaaucaguuugggcauauaguuuggacugaaucacaucuguaguacuuagccaaag

SEQ ID NO: 44873 - RNA, 64 nt, Human
ucagucgcaccauuugcuaauugaaaaucauauccugaaucauacugagacugaucaacuuugg

SEQ ID NO: 44874 - RNA, 64 nt, Human
uaagauuauugcauaugaauuuacccacaggacucugaaucauguuacccacuccccucacaau

SEQ ID NO: 44875 - RNA, 64 nt, Human
cugaagggggccacagccuggguggaaggcagaccugaaucacaacgggccagcucuaguaaua

SEQ ID NO: 44876 - RNA, 64 nt, Human
auaaacuguauauuaaauagauauuuuuugggugcugaaucaauuuuauuuaaauuugugauua

SEQ ID NO: 44877 - RNA, 64 nt, Human
uugaaagccaugagggaaaaaauaaaccccaguucugaaucaccuaccuucaccaucuguauau

SEQ ID NO: 44878 - RNA, 64 nt, Human
ccugccuaaauuucacaagcuaggccaaugaaggcugaaucaaagacauuucauccaccaauau

SEQ ID NO: 44879 - RNA, 64 nt, Human
cuggcgugggccaagugccugauacucccuuacacugaaucauguuaugauuuauagaaauacc

SEQ ID NO: 44880 - RNA, 64 nt, Human
uucaggagcugugaauauagcucuaggugugcuccugaaucaguucaugguagauuaugcugaa

SEQ ID NO: 44881 - RNA, 64 nt, Human
aucauucagaaauaaaagauucagcuaaaaacugcugaaucaauaauuugucuuggggcauauu

SEQ ID NO: 44882 - RNA, 64 nt, Human
gagaaaugugcuuugauguuuaaagccacuguaccugaaucaugcuguucaucuaugaaguuau

SEQ ID NO: 44883 - RNA, 64 nt, Human
uaagaagccuugacaaaguaaguauauuuuagagcugaaucaguaagauucuagagaaagcaaa

SEQ ID NO: 44884 - RNA, 64 nt, Human
ucccgccccagggcacuacauaauugcuguucugcugaaucaaaucucuuccacaugggugcau

SEQ ID NO: 44885 - RNA, 64 nt, Human
uauugaaaacacacaccacacaucacacacagaacugaaucauaccacaugcugccuaugggac

SEQ ID NO: 44886 - RNA, 64 nt, Human
aacuuauaauuuaugugcaaguguuuucagugcccugaaucaaacuauaaauguggggagaaau

SEQ ID NO: 44887 - RNA, 64 nt, Human
gcuggaacgucuucguguccaccuggguccaguccugaaucaucuuggagaaacaccuugguuu

SEQ ID NO: 44888 - RNA, 64 nt, Human
acacaauggcugaauuaucuuucuccauguggcgcugaaucacccaucugguuuggagcuagag

SEQ ID NO: 44889 - RNA, 64 nt, Human
agcaaccauaauguugauguaaguaaugcgguuacugaaucauaagaaaaugccaucucuuuuu

SEQ ID NO: 44890 - RNA, 64 nt, Human
uauuuguauauaagagcaaaugucugaauguggccugaaucaaguuuaaauauuguuggcucau

SEQ ID NO: 44891 - RNA, 64 nt, Human
auaaugcauauuugcaggccccacgcaaaaccugcugaaucagaagcucugagaguaaggccua

SEQ ID NO: 44892 - RNA, 64 nt, Human
cguuuccucagauuaaugagacccuucaacaagccugaaucagucacuuuucaacacagcgaug

SEQ ID NO: 44893 - RNA, 64 nt, Human
gaggcucucggagcuugaguggcucugccccacccugaaucaugcacccauaaaugcaguuaug

SEQ ID NO: 44894 - RNA, 64 nt, Human
ggaugaacaucugggaauccuguuaaugagaaggcugaaucacaggcaccugggccaaagggug

SEQ ID NO: 44895 - RNA, 64 nt, Human
acugcauuuccccacucugcccaccucucucaugcugaaucacauccauggugagcauuuugau

SEQ ID NO: 44896 - RNA, 64 nt, Human
acauucuuguuacucuuuucuccacagucaaaaccugaaucagaauauuucaaaagagaggaaa

SEQ ID NO: 44897 - RNA, 64 nt, Human
aguuuugaguaaacucaguaugcaugugugaaugcugaaucacaggaaugguguugaggcuacc

SEQ ID NO: 44898 - RNA, 51 nt, Human
caugcuuugcccuggaguaaccugaaucaucuaaaaaacacggucucaacc

SEQ ID NO: 44899 - RNA, 64 nt, Human
uaacaaugaaggggaaggggaagauuuccaccaacugaaucauuugugcacguguauagcucaa

SEQ ID NO: 44900 - RNA, 64 nt, Human
gaacucugacauaaauuuagugcuuuauaacgaacugaaucagguugaggauuuugaaaacugu

SEQ ID NO: 44901 - RNA, 64 nt, Human
ggacuaucacacccagcccauguggcuaaaaaagcugaaucagacaguggaugagacacacaac

SEQ ID NO: 44902 - RNA, 64 nt, Human
aaaaaaucaagacaaguaggcccaauacaaacuacugaaucaucuucuaauuucccucuaaaau

SEQ ID NO: 44903 - RNA, 64 nt, Human
uuauggcaagugucaaaaauaguaucugaagauacugaaucaucaugaaaugaacucuacuucu

SEQ ID NO: 44904 - RNA, 64 nt, Human
ugcauaucauuugugagaauuucucauuaauauccugaaucauucauuuuagcuaaggcuucau

SEQ ID NO: 44905 - RNA, 64 nt, Human
cuccccacccuccagaagggguccacguugaauucugaaucaucuugaaaauaagauuccaacc

SEQ ID NO: 44906 - RNA, 64 nt, Human
auauucacaugugaaagcaagugaucuguuguugcugaaucagagauaugagagauucuuuuuu

SEQ ID NO: 44907 - RNA, 64 nt, Human
gggugcugcuccugccguuuucuuccugccaagccugaaucaauguuucaucuccaacccucug

SEQ ID NO: 44908 - RNA, 59 nt, Human
cgggaccucuuaauuacuagaccucaguacugaaucaggaccucacucagaaagacuaa

SEQ ID NO: 44909 - RNA, 64 nt, Human
ucccccaucauccuuccuuagacugaugcuuugacugaaucaucacuagcuauggcauuaaaag

SEQ ID NO: 44910 - RNA, 64 nt, Human
uagcugcugaacaguaugaugauuuggggauuuucugaaucauuuguacuuagauacuggaguu

SEQ ID NO: 44911 - RNA, 64 nt, Human
aggcaaagccgcaaggcagaaggaggcugggucccugaaucaccgacuggaggagaguuaccua

SEQ ID NO: 44912 - RNA, 64 nt, Human
aaaucacaggaggguaaaucuuugcuggaguuaucugaaucauuggcauuuauccgauuccacu

SEQ ID NO: 44913 - RNA, 64 nt, Human
uccgagauucagacauagccaugcugguggccuucugaaucacugcauggaugucccaggaggc

SEQ ID NO: 44914 - RNA, 64 nt, Human
uuuugagugccacuguuugccaucaucuaagccacugaaucaaguguauuucaggcuuauuuca

SEQ ID NO: 44915 - RNA, 64 nt, Human
acacaaacauaagaacuggucuucuacacuuucucugaaucauuuagguuuaagauguaaguga

SEQ ID NO: 44916 - RNA, 64 nt, Human
cgagucucuuuaauaaagauacuaauucucaugacugaaucacccuccaaaggccccaccuccu

SEQ ID NO: 44917 - RNA, 64 nt, Human
auuuaaauuuggaggacaacuuaucuucacuaagcugaaucagguggagaaaguaaucuccuug

SEQ ID NO: 44918 - RNA, 64 nt, Human
ccuccuguuuauugagaacuaugcauugaacauucugaaucauucuaagccucuggagagacug

SEQ ID NO: 44919 - RNA, 64 nt, Human
uagauguucaagaacuccuucuggacuguggauacugaaucaguguacuauuggcugcagaauu

SEQ ID NO: 44920 - RNA, 64 nt, Human
acuguauuuaguagacauaacuguugaauaguuacugaaucaugauguaaagaauaugugacca

SEQ ID NO: 44921 - RNA, 64 nt, Human
cagcccguuucagaaggaccaauugacucucacacugaaucagcugcugacuggcagggcuuug

SEQ ID NO: 44922 - RNA, 64 nt, Human
ucuuguugaagggucucuucucagcuaauuaacucugaaucaugguucaagacaagccucaggc

SEQ ID NO: 44923 - RNA, 64 nt, Human
aauuuaaugaaacuuuucuuuuuccuucgaccuccugaaucaugugguucugcaaaugaauacc

SEQ ID NO: 44924 - RNA, 64 nt, Human
ccacacuucccacccccaggcaaggcugacuucucugaaucagaaaagcuauuaaaguuugugu

SEQ ID NO: 44925 - RNA, 64 nt, Human
uuagcccuaaaaugugacaagagaauugguuuggcugaaucacaacaaauaacuagcaaagcuu

SEQ ID NO: 44926 - RNA, 64 nt, Human
ugcccacagucuuuccgugugauugucuuugaaucugaaucagccagucucagaugccccaaag

SEQ ID NO: 44927 - RNA, 64 nt, Human
cucauauguaaagucacaagguucauuuaucuuucugaaucaguuaucaaagauaaauuggcaa

SEQ ID NO: 44928 - RNA, 64 nt, Human
uuguuuuuucuuuguuaaaaccaaacugguucaccugaaucaugaauugagaagaaauaauuuu

SEQ ID NO: 44929 - RNA, 64 nt, Human
cagguuaaaauuuuaauuucuacaaaauaacauucugaaucaagcacacuguauguucaguagg

SEQ ID NO: 44930 - RNA, 64 nt, Human
auauauaacaugcacaaauaaugugacauucuuacugaaucaaaucaugauucuagaacuugag

SEQ ID NO: 44931 - RNA, 64 nt, Human
aaacagagacucccagucccccucagcaucuucccugaaucacagccccagcuccuugaccccc

SEQ ID NO: 44932 - RNA, 64 nt, Human
guaucuucagacucacagagugaauucagcucuucugaaucaagacccacccagucucuuucau

SEQ ID NO: 44933 - RNA, 64 nt, Human
gaacagagggaaggagccgcgcccccaccuggagcugaaucacaugaccuagcugcaccccagc

SEQ ID NO: 44934 - RNA, 64 nt, Human
gaauccuccauggagggccugcuggcugaacaugcugaaucaucuccaacaaaacccagcccca

SEQ ID NO: 44935 - RNA, 64 nt, Human
aucucuguuuuacucuuugaaauugaucaagccacugaaucacuuugcauuucaguuuauauau

SEQ ID NO: 44936 - RNA, 64 nt, Human
ccuagucagagauugggagaaauacaagaugagccugaaucaucucauguaccugacaguaaga

SEQ ID NO: 44937 - RNA, 64 nt, Human
cuugguccuguccaaguguaucuuucacugauuucugaaucauguucuaguugcuugacccugc

SEQ ID NO: 44938 - RNA, 64 nt, Human
gauagcaggugaacucgaagcccacaauccucgucugaaucauccgaggcaaagagaaaagcca

SEQ ID NO: 44939 - RNA, 64 nt, Human
acuuuuuaauuuuuuuaacuuaaaauucaagagacugaaucacuuuucucauugauuaaaugua

SEQ ID NO: 44940 - RNA, 64 nt, Human
guauaacacauagaaacaccaagauuuucagcaucugaaucaaacuaaaauuacuugcuugacu

SEQ ID NO: 44941 - RNA, 64 nt, Human
acuaauuuaugggguggaaacagcauuaagaauacugaaucaaauggaaaaacaaaugaauaca

SEQ ID NO: 44942 - RNA, 64 nt, Human
cccuugugaugggugaggaaagguauccaccuuucugaaucagacacaagcugcaguagcuucc

SEQ ID NO: 44943 - RNA, 64 nt, Human
aguauucagguuggcugugucagaugcuaaugugcugaaucaacagucauugcagaucacgaag

SEQ ID NO: 44944 - RNA, 64 nt, Human
ucauaaauggugaugugacuuuucuucuuacaugcugaaucacugguggaaacguuaggauaag

SEQ ID NO: 44945 - RNA, 64 nt, Human
aggaaaacggcacaacacaaucuugaggugccuucugaaucaucagauuaaauuaugcuucaua

SEQ ID NO: 44946 - RNA, 63 nt, Human
uuucuauauaauaaauaacacaggagugaacauccugaaucagaucuuagcagagaugcucac

SEQ ID NO: 44947 - RNA, 64 nt, Human
uaaguuaaagacuucuuuccaguccaaggcaggccugaaucaacugucuuuaaauaaaauuuua

SEQ ID NO: 44948 - RNA, 64 nt, Human
gaauauaagagaauacuucuaaggacagaaaucucugaaucaauggcuaagacaacaguaacag

SEQ ID NO: 44949 - RNA, 64 nt, Human
ucaggacugaaguaaguucuucacacagugaccucugaaucaguuucagagaagggauggggga

SEQ ID NO: 44950 - RNA, 64 nt, Human
ugaaacauuuugccagacuuucuccaaaugaaaccugaaucaauuuuucuaaaucuagguuuca

SEQ ID NO: 44951 - RNA, 64 nt, Human
agacaugaaguuuuauaaagaucuguauaauugccugaaucaccagcacauucacugacaugau

SEQ ID NO: 44952 - RNA, 64 nt, Human
gcuguccacacugaagaacauguccuacaacagccugaaucaaaugguuagcuuaauagauaaa

SEQ ID NO: 44953 - RNA, 64 nt, Human
ggaagagggggcuuccagggagcccugcucggcccugaaucaccuucgucucuucucuaggaau

SEQ ID NO: 44954 - RNA, 64 nt, Human
augaaagugugugucugcuggggcagcugugccccugaaucaugggcacggagggccgcccgcc

SEQ ID NO: 44955 - RNA, 64 nt, Human
ccgcgcucaacugcucccguggaagauuaaagggcugaaucauggugcugaccuggcucuuugu

SEQ ID NO: 44956 - RNA, 64 nt, Human
acaaauucucuucccaagucaacugcaacugcggcugaaucaccccucacccgcuagccuugcc

SEQ ID NO: 44957 - RNA, 64 nt, Human
aaauagucauuuugcauuugauuagugcaguucucugaaucauaaagcaaguuuuaccucucug

SEQ ID NO: 44958 - RNA, 64 nt, Human
gggaguggguaaagaguuugggaagguuaucuaacugaaucacuacugaguugaaucauggcua

SEQ ID NO: 44959 - RNA, 64 nt, Human
uuacacauuuuaaaacugcuaagcuuggauuuaacugaaucauauaucuuuuaucauguuaucc

SEQ ID NO: 44960 - RNA, 64 nt, Human
ggugaaaggccuggcggggaggaaagugaaacgccugaaucaaaagcaguuuucuaauuuugac

SEQ ID NO: 44961 - RNA, 64 nt, Human
gaaaaagcuuucuucugacugugacccucuugaacugaaucagaccaacuggaaucccagaccg

SEQ ID NO: 44962 - RNA, 64 nt, Human
acaaauucucuccccaagucaacugcaauugcagcugaaucaccccucacccacuagccucgcc

SEQ ID NO: 44963 - RNA, 64 nt, Human
agugcucaauaaauguuaacuauugugauugcugcugaaucagcuacaugcugaggaaacggcc

SEQ ID NO: 44964 - RNA, 64 nt, Human
cuccucuuuggugaaagcauuucuuaugguuucucugaaucaguucaucccacacaucauccug

SEQ ID NO: 44965 - RNA, 64 nt, Human
gaaauacaaauccucaggccccaccucagaccuacugaaucagaaucucuggggguuggcacag

SEQ ID NO: 44966 - RNA, 64 nt, Human
agaggagcgaggacaacguuggcccagaugggggcugaaucauucaacugccuccaucuguggg

SEQ ID NO: 44967 - RNA, 64 nt, Human
ucuguggcauugaaaugagcaccuccauuaaagucugaaucagugcacuguugugucuaaggag

SEQ ID NO: 44968 - RNA, 64 nt, Human
auuaacuacuuguauuuuuuucacuucugggccucugaaucacauaaguaaggcaucuuuguug

SEQ ID NO: 44969 - RNA, 64 nt, Human
ccuuguuuaaggggcacuguuucuuguuuuugcacugaaucaagucuaaccccaacagccacau

SEQ ID NO: 44970 - RNA, 64 nt, Human
ucccuuggucugcccagcccucgauuagcccugccugaaucaguagauacuugaacgagucccc

SEQ ID NO: 44971 - RNA, 64 nt, Human
uucuguaagcuaauccacaaccuguuaccacuuccugaaucaguuauuauuucuucauuuuuuu

SEQ ID NO: 44972 - RNA, 64 nt, Human
auaaucaucugaaaguuauagggcacugccacugcugaaucagagcaugcccaauauuugaggu

SEQ ID NO: 44973 - RNA, 64 nt, Human
ccccguccuccaagggcagcacccccacuuucaacugaaucaagugaggaagagggcucagagc

SEQ ID NO: 44974 - RNA, 64 nt, Human
uaacaucacauggcuugaagaguaaccaucagagcugaaucauccaaguaagaacaaguaccau

SEQ ID NO: 44975 - RNA, 64 nt, Human
caguccagggcauauacuaaccugcaaacugauucugaaucaggaaggugguaaucaauaagua

SEQ ID NO: 44976 - RNA, 64 nt, Human
uauuuacaugauaaucugggagaugcauuuaugccugaaucaaagcugccuucugcucaaacaa

SEQ ID NO: 44977 - RNA, 64 nt, Human
aaaaguaaaacuucguucuuuaucagccucaugccugaaucaaauuuuuaauuauucugaaacu

SEQ ID NO: 44978 - RNA, 64 nt, Human
uuuacaauuaccccacauggaaauuuagggguuucugaaucaagcuuaauguuuacaguuucca

SEQ ID NO: 44979 - RNA, 64 nt, Human
accagguacccagagcaggguggacaggagagaccugaaucacagcagugaggaauuccucaaa

SEQ ID NO: 44980 - RNA, 64 nt, Human
cugccuaaaucuuggguuuauuagaugaaguuuacugaaucagaggaaucagacagaggaggau

SEQ ID NO: 44981 - RNA, 64 nt, Human
augagccuguuaauuguuaguugucuuccuguagcugaaucaacaaguuauuuucaacucaauu

SEQ ID NO: 44982 - RNA, 64 nt, Human
uaaagaccuucuggugggucuuuguuuucaguaacugaaucauagaacgaguucuguaucccuc

SEQ ID NO: 44983 - RNA, 64 nt, Human
uacuuuuuguuccuuuuuuaaaaacacaagagcacugaaucaaaagaauugaguuucuacuuuu

SEQ ID NO: 44984 - RNA, 64 nt, Human
uauaguauacucuugccuuccuaaauuaugacugcugaaucaucauaucuacuauauaugacug

SEQ ID NO: 44985 - RNA, 64 nt, Human
aacucuucgguuaaugggucaguucuccuuggaacugaaucaguggaaagagaaugcuucccau

SEQ ID NO: 44986 - RNA, 64 nt, Human
guaaaaaaauguauucaauaacuuaauauucucacugaaucaugagagaauguguauuuguagg

SEQ ID NO: 44987 - RNA, 64 nt, Human
uugguuaggaucauaucuucacauauggcccuuucugaaucaaagugcggcaaaguaaauauug

SEQ ID NO: 44988 - RNA, 64 nt, Human
caucuaugaaccacaaaguagcccucaucagacacugaaucagccagugccuugcucuuggacu

SEQ ID NO: 44989 - RNA, 64 nt, Human
uuuugccaugaguaugagcaaauucccucuuucccugaaucauggacauucuagauuaaaagaa

SEQ ID NO: 44990 - RNA, 64 nt, Human
uguacuugucuuuauuuaaaaugaugaaucuagucugaaucagcuguuauuccaagcuaucaug

SEQ ID NO: 44991 - RNA, 64 nt, Human
ucacuucagaagagugaauaacugauuugcacagcugaaucaggagacacaaagaugagacugu

SEQ ID NO: 44992 - RNA, 64 nt, Human
gaacagccggggccaggacugggucaccuaugagcugaaucagcaucuccuccugagucccagg

SEQ ID NO: 44993 - RNA, 64 nt, Human
auaccaugucaggauauuuuuagugucucaaggccugaaucaccugaaucugacaaagaugaaa

SEQ ID NO: 44994 - RNA, 64 nt, Human
agagcagcagcagcagguaccagcacggcccugacugaaucagcccagugucccugagcagcuu

SEQ ID NO: 44995 - RNA, 64 nt, Human
agaaauccuccuggguacuccuggccagacccuccugaaucaucugcggcuuaaacucaucucg

SEQ ID NO: 44996 - RNA, 52 nt, Human
augaagaucagcuuggauaaaucugaaucaaagaagcgcgacaauucuggac

SEQ ID NO: 44997 - RNA, 64 nt, Human
uuuugagauuuuugcugcaaucuguuugccuucccugaaucaaaauaaucuuucauucgucacc

SEQ ID NO: 44998 - RNA, 64 nt, Human
uagcauauaguuucuuugcacccacuauuuaugucugaaucauuugucacaagagagugugugc

SEQ ID NO: 44999 - RNA, 64 nt, Human
gaguuggcauuagaauuggaaguccaguuuauuucugaaucaaaaaaugagcgggcuauugugc

SEQ ID NO: 45000 - RNA, 64 nt, Human
aauuauaguaaaauuucuucuugauuggcugacacugaaucauaguuucucaccuacauauauc

SEQ ID NO: 45001 - RNA, 61 nt, Human
cuguucgucugauguuauaauauuaauauuacugaaucauugguuuugccugcaccucaca

SEQ ID NO: 45002 - RNA, 64 nt, Human
aaagguauucagcaagagguggaauggcuagacacugaaucaagagauuucaguguuacucugg

SEQ ID NO: 45003 - RNA, 64 nt, Human
uggcuuugucauaucuacuuaguccauccgacaccugaaucauuccauguaaaacagagcucua

SEQ ID NO: 45004 - RNA, 64 nt, Human
aaucuccacaaauuacuggcccaucucggacuugcugaaucaauuugauaggauuaaucuccag

SEQ ID NO: 45005 - RNA, 64 nt, Human
gaaauguacauucucaggcuccacagcaggccgccugaaucaaauccugggagguggggacaga

SEQ ID NO: 45006 - RNA, 64 nt, Human
ugggggcagaggaaaacgcuucuuucuccuccagcugaaucagcuggaucccaguguccuggcu

SEQ ID NO: 45007 - RNA, 64 nt, Human
gugccugccucggcuguggcacuuccagguucgacugaaucaagcaucugaagacuggguuuuu

SEQ ID NO: 45008 - RNA, 64 nt, Human
cacauguuaucaaccucguaacuuuuggugcuugcugaaucaguccaugaaaagcuacagcccg

SEQ ID NO: 45009 - RNA, 64 nt, Human
uugggguuggcaccucugccccgacagaauggggcugaaucagcuccaggaggaaccaggcccu

SEQ ID NO: 45010 - RNA, 64 nt, Human
agggccugcaaauggagugggggaguccuggccccugaaucaccagagccaccaagccugccag

SEQ ID NO: 45011 - RNA, 64 nt, Human
gugagaccaggucuaccuugggacuguuauuuaacugaaucaguuauuuccuugaaauuucaca

SEQ ID NO: 45012 - RNA, 64 nt, Human
aagaggaucuggagaaccucauccagcuccccuucugaaucagcugggaugacuggcuuugaga

SEQ ID NO: 45013 - RNA, 64 nt, Human
aaucaauaaaucaagggagauuauaccaguaggacugaaucagggccuucaaagcuggacugag

SEQ ID NO: 45014 - RNA, 64 nt, Human
aagacagacagacagaggcugagagaggcuguuccugaaucaaagcaauagccagcuuucgaca

SEQ ID NO: 45015 - RNA, 64 nt, Human
cgaaacugacaguauuaaggguaggauguugcuucugaaucacuguugaguucugauuguguug

SEQ ID NO: 45016 - RNA, 64 nt, Human
auguaguccuaaauugcaauuaugagggcuaccacugaaucauuuuaucuuucagccaaucaag

SEQ ID NO: 45017 - RNA, 64 nt, Human
caccccaccuuuuuccuucuccccaauuacuccccugaaucaauguacaaaucagcacccacau

SEQ ID NO: 45018 - RNA, 64 nt, Human
cugaguuugaacugcuccucccuggccugcgugacugaaucacagcuuuggucccugucuugca

SEQ ID NO: 45019 - RNA, 64 nt, Human
uauuaccugcuuugcaagguggcuuuaagaaucacugaaucacuguggccucacuugaccuagu

SEQ ID NO: 45020 - RNA, 64 nt, Human
aaggcccuuuccaaguccagguguucccaaagagcugaaucaaagacagcuuggccacuucccc

SEQ ID NO: 45021 - RNA, 64 nt, Human
agcugaagaaugguuggcuguucagacagaagagcugaaucagcagcaacuguccagcgcggag

SEQ ID NO: 45022 - RNA, 64 nt, Human
uuaaccagcauucuugauaugauccaccugugaacugaaucaugcaaggccaauuggacaaccu

SEQ ID NO: 45023 - RNA, 64 nt, Human
cuguuagguucugaugacucacaugauggggagucugaaucaaaugccaaaguagcugauguau

SEQ ID NO: 45024 - RNA, 64 nt, Human
acagucuacucugucuccaccccaaggucugguucugaaucauucaguugucaguugucuccuu

SEQ ID NO: 45025 - RNA, 64 nt, Human
gaaagggagaggaagagaagcccagcucugggaacugaaucaggaaacucaaaucgaauaggga

SEQ ID NO: 45026 - RNA, 64 nt, Human
cauuuuucuuucuucgguuucuuaaaaucuuugccugaaucagaacgcuggcuuuuauuuauuu

SEQ ID NO: 45027 - RNA, 64 nt, Human
uccuccgccucuaccaagagcuucgccagugucacugaaucaacagauccaagggaaugaacaa

SEQ ID NO: 45028 - RNA, 64 nt, Human
cucccggguggggagguggccaaggaugcuggagcugaaucagacgcugacaguucuucaggca

SEQ ID NO: 45029 - RNA, 64 nt, Human
auuuuuucagagaaaguuauucgcucgauuuuuucugaaucauaauuaaacuuuaugauaaaau

SEQ ID NO: 45030 - RNA, 64 nt, Human
gaaauacuaauuuguaagccccaccucaggccuacugaaucagaagcucuggggguugggucca

SEQ ID NO: 45031 - RNA, 64 nt, Human
agggugauaugcugauuuucauugugcacauggacugaaucacauagauucuccuccgucagua

SEQ ID NO: 45032 - RNA, 64 nt, Human
ucuccucacugcccuucuucugaguggcauuggccugaaucaaggaaagccaggccuugugggc

SEQ ID NO: 45033 - RNA, 64 nt, Human
aggucugauaugaguuuaagggauuucgcacucccugaaucagagaaguaagaccccuuccuua

SEQ ID NO: 45034 - RNA, 64 nt, Human
ugcagcuauuuugguaucuccuaucacaugcacucugaaucaggguuuuucuauaagaaaucuu

SEQ ID NO: 45035 - RNA, 64 nt, Human
gaauccuuuaagaaccugguguuccugagugguccugaaucauauaaguugguaauggaagcug

SEQ ID NO: 45036 - RNA, 64 nt, Human
acacacggacacaaucagccgagaaguuccuggucugaaucacgagaauguggagggguggggg

SEQ ID NO: 45037 - RNA, 64 nt, Human
ccugauuggucccgggccaaggucccagaccaagcugaaucacgcuuucuccaagacagcccgc

SEQ ID NO: 45038 - RNA, 64 nt, Human
uagcugagaaaacuaagucagaaagugcauuaaacugaaucacaauguaaauauuacacaucaa

SEQ ID NO: 45039 - RNA, 64 nt, Human
guuuacuuaaugaacauaaggauaaauagaaaaacugaaucaucauacauaaacauauauaaaa

SEQ ID NO: 45040 - RNA, 64 nt, Human
cucuuuuaagauguaagaugcuaauuaauaaaagcugaaucauuucauaccagcucuucauagu

SEQ ID NO: 45041 - RNA, 64 nt, Human
gaaaggccuuagggugacagguuauguacugucucugaaucaauaugaccucacuuaaaacaga

SEQ ID NO: 45042 - RNA, 64 nt, Human
ucaggugagguuccaaguugcaacugaccuugaacugaaucacucuccccacguuauuuuuuaa

SEQ ID NO: 45043 - RNA, 64 nt, Human
gcagagggcauugcgucccaaucuuuaguccuugcugaaucaguucucuaauauuuuaccucau

SEQ ID NO: 45044 - RNA, 64 nt, Human
guucccugaccuguuuuuguguuuauguuaggaucugaaucauguucuggguaaggggacgagg

SEQ ID NO: 45045 - RNA, 64 nt, Human
aaauguacacaaagagauauauaucacuguguuccugaaucaugguuuguauugcccaaaauug

SEQ ID NO: 45046 - RNA, 64 nt, Human
uacuggcacuuuuccuugcagaaagcacucagaccugaaucagagaaaaucauaugccaaagcc

SEQ ID NO: 45047 - RNA, 64 nt, Human
ucuggcaaaugaaaaaauggaaccuggucuugagcugaaucaauguguuauuguuacccccacc

SEQ ID NO: 45048 - RNA, 64 nt, Human
guguugggauuacaggcaugagacacugccuggccugaaucaaccuuuuuuaaguguaaucaga

SEQ ID NO: 45049 - RNA, 64 nt, Human
aguagggaguuuccaccuuguacguaagcaaacacugaaucaacuuuuuuuuuuuuuucggaca

SEQ ID NO: 45050 - RNA, 64 nt, Human
uugugaaaccaguguuguuagaaguguauauaaucugaaucaauaagcucugaaugguggccaa

SEQ ID NO: 45051 - RNA, 64 nt, Human
uauccuugggggcucccagggcaaggguuaaggccugaaucaugagccugcuggaagcccagcc

SEQ ID NO: 45052 - RNA, 64 nt, Human
cagcuaagccuuuuccucuacucucuuccuuguucugaaucauuucuucuucucaggccaaagu

SEQ ID NO: 45053 - RNA, 64 nt, Human
ucaacacgguguugcucuucagucauaccggaaucugaaucaaaaaaguauuuuuaaauaucca

SEQ ID NO: 45054 - RNA, 64 nt, Human
aaacuucugaaaacccaaggccagguacugcauucugaaucagaaucucgcaguguuucuguga

SEQ ID NO: 45055 - RNA, 64 nt, Human
gcauguguugugggaugggccugguaggaggugacugaaucaugggggcggacuucccccuugc

SEQ ID NO: 45056 - RNA, 64 nt, Human
ugaggccaaaugaguucccuugauucaaauaacccugaaucagaggcagagaccuccugauguc

SEQ ID NO: 45057 - RNA, 64 nt, Human
gcaggcagccuugccagaaggcagagaggcaguucugaaucauucucucauucaccagugguga

SEQ ID NO: 45058 - RNA, 64 nt, Human
guagagcagacuauguugagcuaacacagaccugcugaaucagcuucuuucugagcugccagaa

SEQ ID NO: 45059 - RNA, 64 nt, Human
ggacaccugugcacucgcuccguaccuggaccugcugaaucauagcccacauguccaggugaga

SEQ ID NO: 45060 - RNA, 64 nt, Human
ccuuauccccagacgccuagcgggcaggguugggcugaaucaaaugggagcccuccagacauaa

SEQ ID NO: 45061 - RNA, 64 nt, Human
aagagaaaaaugaaacccacaugccgccauuuuccugaaucaaauucugcaguggaauggagag

SEQ ID NO: 45062 - RNA, 64 nt, Human
uuuccuuccuuccuccuggucuguuccaaaaacucugaaucaucuacauuuuaagguauuuuac

SEQ ID NO: 45063 - RNA, 64 nt, Human
gcccacgguccccucagcagggaugcgauggucucugaaucagugugcagcuggggucccaggc

SEQ ID NO: 45064 - RNA, 64 nt, Human
ugaugaggaauguauuugcauauguuugcaaaagcugaaucauugaaaacguaccuugaaacuc

SEQ ID NO: 45065 - RNA, 64 nt, Human
uccggcagcuuggcguccacccugcacagcaucacugaaucacagagccuuugcgugaaacagc

SEQ ID NO: 45066 - RNA, 64 nt, Human
auuuauugguucuugaaguuuugcugcuauguuacugaaucauacuaaagacauuugcgcuuac

SEQ ID NO: 45067 - RNA, 64 nt, Human
caaacugacauuaaauucuagauguugacaauuacugaaucagaaggcaugaaagaguauaauu

SEQ ID NO: 45068 - RNA, 64 nt, Human
ugacuucugcaagccugcggcuggucccaaugcccugaaucaccucucucauggaagaaccaau

SEQ ID NO: 45069 - RNA, 64 nt, Human
agcaaucuguucucuugcucaaauaauaaagugacugaaucagggaggaaaagguucuuguuaa

SEQ ID NO: 45070 - RNA, 64 nt, Human
aaaugaaaauggaaacaugaugaagauauagucacugaaucaaugagaaaaauaaugaacauau

SEQ ID NO: 45071 - RNA, 64 nt, Human
ccuacccacuguacaguccacuucacaggaucagcugaaucaugaccuuuaaaaguuccgaguu

SEQ ID NO: 45072 - RNA, 63 nt, Human
uggagccguagauuccgugccugccgccgcagcgccgccgacaacgcgggugcaggggggcgc

SEQ ID NO: 45073 - RNA, 63 nt, Human
ucuguccucucagccuguggccuccacauccccgccgccgaggccuagccuccgcccucucag

SEQ ID NO: 45074 - RNA, 63 nt, Human
acuacagcgcucccggcugagcgcgccccccgagccgccgacuugccgucuccccguaaugcc

SEQ ID NO: 45075 - RNA, 63 nt, Human
ccugggaugagugccagccugagccugcauggugccgccgagcccgggguggaggagggagcc

SEQ ID NO: 45076 - RNA, 56 nt, Human; identical to SEQ ID NO: 12021

SEQ ID NO: 45077 - RNA, 63 nt, Human
guaguuaucguuaguuccucuucccgagauggggccgccgagagaccccagcgccuuugaaaa

SEQ ID NO: 45078 - RNA, 63 nt, Human
ugaugccccagagcucuaaccaaagguuuugcagccgccgaaaaacaggaaaguugggaagcg

SEQ ID NO: 45079 - RNA, 63 nt, Human
uuuaccgcccacccagcagcgcccgaggccagggccgccgaagggcagccccgcgaccacccc

SEQ ID NO: 45080 - RNA, 63 nt, Human
cucccccacuuccuuacuuuagcgggcugcaaugccgccgauaugauggcugggagcucuggc

SEQ ID NO: 45081 - RNA, 63 nt, Human
ugucacuggucaggugcuucucaccacgggaaagccgccgaccugugacucgcuugagauggg

SEQ ID NO: 45082 - RNA, 63 nt, Human
ugaaaucauguuucuuagagaaaugccucggaugccgccgacgcggugcugcugccgccgcuu

SEQ ID NO: 45083 - RNA, 52 nt, Human; identical to SEQ ID NO: 12028

SEQ ID NO: 45084 - RNA, 63 nt, Human
uucuccuguccggcccagacucuucuguguggcgccgccgaagccaccguuagcgcgagcugc

SEQ ID NO: 45085 - RNA, 51 nt, Human; identical to SEQ ID NO: 12030

SEQ ID NO: 45086 - RNA, 63 nt, Human
uaagaggagcuagagcuugccucacccgcuguagccgccgagagcccaggauguacuggcgga

SEQ ID NO: 45087 - RNA, 63 nt, Human
ucgauguacauagcuuuucucagcugccugcgcgccgccgacagucagcgcugugcgcgcgga

SEQ ID NO: 45088 - RNA, 63 nt, Human
cgacuccgugguuuccguaucgucaacccuucagccgccgacccgggaggggucuggccuaca

SEQ ID NO: 45089 - RNA, 63 nt, Human
agaaugaggguggcuuggaccccugggaaucaggccgccgagggcugagcuccagagccgcac

SEQ ID NO: 45090 - RNA, 63 nt, Human
ccccagcaccccuggaggaggcaggggcuccccgccgccgaggcugccugcccugggcccacc

SEQ ID NO: 45091 - RNA, 63 nt, Human
ccugggacgcagccacgccaggaggaggacacggccgccgagagcaaggcacaaccucgaguu

SEQ ID NO: 45092 - RNA, 63 nt, Human
aggggaaacaggccaccgccaaagccauggcccgccgccgagagcccaggccccacccgcacc

SEQ ID NO: 45093 - RNA, 63 nt, Human
aacccggccaugaccugggcgggggcgcggggcgccgccgagcccccucuucccgccuugcgc

SEQ ID NO: 45094 - RNA, 63 nt, Human
acuccccuacaucaaaugcucaagcccugaguugccgccgagaagcccacaagaucugaguga

SEQ ID NO: 45095 - RNA, 63 nt, Human
cggggccgagccuccgggccugaauacgggccagccgccgaggccgccagagcagggccgccu

SEQ ID NO: 45096 - RNA, 63 nt, Human
gggcaggagccccaucccagccgugguucuguugccgccgagcugcgacggccucagacuggg

SEQ ID NO: 45097 - RNA, 63 nt, Human
ccggaggagccgccggagcccgccugcccgcccgccgccgaaggagaggagccgccugcgcag

SEQ ID NO: 45098 - RNA, 63 nt, Human
acucccuggggcucaagcgauccucccaccucagccgccgaaguagcugggacuauaggugug

SEQ ID NO: 45099 - RNA, 63 nt, Human
gagcuuccagggcuuggguggcgucggggcagggccgccgaggcugggaggaagcccuucugc

SEQ ID NO: 45100 - RNA, 63 nt, Human
cucccggccucccucgcacacugggaggaggaagccgccgagacugcagggagccuggccccg

SEQ ID NO: 45101 - RNA, 63 nt, Human
cgauaccacgagcugcugcgggaggccaccgaggccgccgaguaccaggaggcccuggagggc

SEQ ID NO: 45102 - RNA, 63 nt, Human
acggugccucccacugcagccucugccugcucugccgccgaggcccggggaugggaugcggug

SEQ ID NO: 45103 - RNA, 63 nt, Human
cugcgcgcgcucaugcacgcggccgccccgggagccgccgaccugcccugcugcgugcccgcg

SEQ ID NO: 45104 - RNA, 63 nt, Human
uguaucgccagccguugcuuuguuacugaacgugccgccgacgaccucagaaaacccagaugg

SEQ ID NO: 45105 - RNA, 63 nt, Human
uccaggagagggagcgccccuggcugccccucggccgccgacuggacgcgcgggccuugccag

SEQ ID NO: 45106 - RNA, 63 nt, Human
uuuaugcagagacagcuguuugaauuggaccccgccgccgacuugcggauuuccaccgcggag

SEQ ID NO: 45107 - RNA, 63 nt, Human
uacuguggaguuuugagggauggcaccguccaggccgccgagagccccucugccugugucgug

SEQ ID NO: 45108 - RNA, 63 nt, Human
cgcguggcaaacaagcacacgaaaagacguucagccgccgauggcuugguuauaauuuauaac

SEQ ID NO: 45109 - RNA, 64 nt, Human
agggugggauggggaagaccaggagcagagucgagccucacagaagccagcgcgggucucugcu

SEQ ID NO: 45110 - RNA, 54 nt, Human
gcaaccgcgacuucagcugaggcagccucacagccugccaucuggugccuccug

SEQ ID NO: 45111 - RNA, 64 nt, Human
uucugauuugagcucuuccaaaaccaggauggaugccucacauagaucaugaugauucaaucca

SEQ ID NO: 45112 - RNA, 64 nt, Human
ugcucucaccagaacugagacuccuaagguagaggccucacagcccuugaguaaaauaaaagug

SEQ ID NO: 45113 - RNA, 64 nt, Human
ccgacacacgucucaggauuuuaaguccacauuggccucacacuaccagggccaaugcccaaaa

SEQ ID NO: 45114 - RNA, 64 nt, Human
gacaugagggauggcccugucucucugggacagagccucacagaugauguccauguuuugugug

SEQ ID NO: 45115 - RNA, 64 nt, Human
ucuuguggccucagcaggacaggccccgggcacugccucacagccaaggcuggacuggguuggc

SEQ ID NO: 45116 - RNA, 64 nt, Human
gggccacccugaccuacacauaccgccacugcuggccucacaagccccugguuacugguaagua

SEQ ID NO: 45117 - RNA, 64 nt, Human
aauaccccgaguggggagcaggguucuccucaaagccucacaaccauaggaucauaggaaaggg

SEQ ID NO: 45118 - RNA, 64 nt, Human
gcugugggcccuuuugccucuuccccuguucuuggccucacaucuccagcugagcugccggucu

SEQ ID NO: 45119 - RNA, 64 nt, Human
aaguaacucccacuccuaaucaagagucucuccagccucacagaugcuggccucuuggcaccug

SEQ ID NO: 45120 - RNA, 64 nt, Human
aagccaggagaagaagagggagaaacuguccagggccucacagggaggcauucauggagcugga

SEQ ID NO: 45121 - RNA, 64 nt, Human
uugccgucagccgaacuuuguuauggagggagcagccucacacaagcagaaacacuccugugga

SEQ ID NO: 45122 - RNA, 64 nt, Human
uaaggaccccucuuuucccuaucugccuaacagugccucacaaggcuugggggcuggacucccu

SEQ ID NO: 45123 - RNA, 64 nt, Human
ccuucacaggucuggagaucccagaggaaggggcgccucacacccucuucccacgacuggcccc

SEQ ID NO: 45124 - RNA, 64 nt, Human
aguagcugccacuaucuuuguuuccccaccucaggccucacacuuucccaugaaaagggugaau

SEQ ID NO: 45125 - RNA, 64 nt, Human
gagugcuuucuggucucacuuugguaccaaggaagccucacauagugguacugcauagucccac

SEQ ID NO: 45126 - RNA, 64 nt, Human
augcccaggcagccacagaaacccacucuuccccgccucacagggcuccuccgguuggccugga

SEQ ID NO: 45127 - RNA, 64 nt, Human
aucccucaccuaguccugcugcacagggcaggaggccucacagaagagauacuugcaguuccag

SEQ ID NO: 45128 - RNA, 64 nt, Human
guuccugcaaacaagaacugacccuaucaccucugccucacaguggguaaauauaucauacauc

SEQ ID NO: 45129 - RNA, 64 nt, Human
uuuaauggacucacaguuccauguggcuggggaggccucacaaucaugguggaaggugaaaggc

SEQ ID NO: 45130 - RNA, 64 nt, Human
uccuuggcaaucaaccaacguugcuaugaaauaugccucacacuguauagcucauuauaggacg

SEQ ID NO: 45131 - RNA, 64 nt, Human
caauuaacugccuugaacauagagaaaaauuaaggccucacaggaugagucuccauucucugua

SEQ ID NO: 45132 - RNA, 64 nt, Human
uguucccacaacaauggcccuuucacaagcucuugccucacaaccccugcagaaguccuucaac

SEQ ID NO: 45133 - RNA, 64 nt, Human
cgcuuggucgguucgucucccauuugccauccaggccucacacccacacucgagcccacccggc

SEQ ID NO: 45134 - RNA, 64 nt, Human
auuauucugaguaaagcucagcagggcugugcuugccucacaggaauagucaggucuucccaga

SEQ ID NO: 45135 - RNA, 64 nt, Human
aguccugcugaccuugcccucugcccacagcugugccucacagaugccccgagaagagaugacu

SEQ ID NO: 45136 - RNA, 64 nt, Human
cugacucucgugcuuauugcagaugcugugguuggccucacaagcaacgccuuaugcugaugug

SEQ ID NO: 45137 - RNA, 64 nt, Human
ucccucccagauccucugcugacuccauauggaggccucacacccagaggguagggcagcagau

SEQ ID NO: 45138 - RNA, 64 nt, Human
gagcaaggccaaugucagagacccccgggauggggccucacacuugccacccccagaaccagcu

SEQ ID NO: 45139 - RNA, 64 nt, Human
agggacuuugucauaaucacuguuacaucccagugccucacaccaugccuggcccuuaagaagu

SEQ ID NO: 45140 - RNA, 64 nt, Human
ucucuuguugaauugaagauuauucauugcuuuggccucacaaaguuuugauuucaacuaucau

SEQ ID NO: 45141 - RNA, 64 nt, Human
gcuuuuaggccaaaaaaauguaagaucguucucugccucacauagcuuacaagccagcuggaga

SEQ ID NO: 45142 - RNA, 64 nt, Human
cauccuuaugccuguaacacacaugcagugagaggccucacauauacgccucccuagaagugcc

SEQ ID NO: 45143 - RNA, 64 nt, Human
uuugucugugaguuacgggcaaccagccucuucagccucacacccauuccccugagagcaagaa

SEQ ID NO: 45144 - RNA, 64 nt, Human
gaaauccgcaagcugggugugcuuugagugugcagccucacaaacauggccuuuucucucuccc

SEQ ID NO: 45145 - RNA, 64 nt, Human
cuuuuaucuacagggaguagauucugcuaucuuggccucacagcccuuccuguugauuacaaag

SEQ ID NO: 45146 - RNA, 64 nt, Human
aggccugucagaaggcucugguaggccuuccucuggccaggagacuccagcagggaaugcccuu

SEQ ID NO: 45147 - RNA, 64 nt, Human
agacugaaaauucauugcaauuagggaacgcacagccucacaaaaagugguugugauugcaagg

SEQ ID NO: 45148 - RNA, 64 nt, Human
gucucgagacgcacaugcacgccugggcguggcagccucacagggaacacgggacagacgccgg

SEQ ID NO: 45149 - RNA, 64 nt, Human
ugucgugccugcagggacacgucggaucccgugggccucacaugccaggucaccaggucaccgu

SEQ ID NO: 45150 - RNA, 64 nt, Human
agauaaaacucuaugguacaccugcuuauguguugccucacacugugugugauuuuguuucuuu

SEQ ID NO: 45151 - RNA, 64 nt, Human
uaguaaaaaagguaggaaaucccuaaaacuuccagccucacauagcacgguucucaccugucac

SEQ ID NO: 45152 - RNA, 64 nt, Human
uccagagcagcccugaggauuccacauauccaaugccucacagucugcaagccugcucacccac

SEQ ID NO: 45153 - RNA, 64 nt, Human
cucgaggacgacuggccgaaaagccgcauucccugccucacaggccggaagucccagcccaguc

SEQ ID NO: 45154 - RNA, 64 nt, Human
aaagaugguggaagacauaggcuaaauuucuccagccucacaauggucuucacuuggucugacu

SEQ ID NO: 45155 - RNA, 64 nt, Human
ccugaguccuggagauguccccagaagcugcugugccucacagcgcugugagccagacccuccu

SEQ ID NO: 45156 - RNA, 64 nt, Human
uauauauguuaucugaugccauuuuucugaaguagccucacauguggucccccugcaguucagc

SEQ ID NO: 45157 - RNA, 64 nt, Human
uuuaacggacuuacaguuccacaugacuaaggaggccucacaaucaugguggaaggcaaagagg

SEQ ID NO: 45158 - RNA, 64 nt, Human
acugcucaagaacagauuugaggccaggugcggugccucacaucuguaaucccaacacuuuggg

SEQ ID NO: 45159 - RNA, 64 nt, Human
uacucaucuugauggcuucaugauccagcacagugccucacacaaagaacuauugggugggugg

SEQ ID NO: 45160 - RNA, 64 nt, Human
cauaugauuuucugccacauuaaacauauuguaugccucacaguuuacaggauucugaaaugua

SEQ ID NO: 45161 - RNA, 64 nt, Human
aaguagggaacauggcagagaguggugcuucccagccucacaaugugggaauuugacauaggau

SEQ ID NO: 45162 - RNA, 64 nt, Human
uaggccauucuccuucucuuccauggagaauccagccucacaaaaggauucuuucaacuucuuu

SEQ ID NO: 45163 - RNA, 64 nt, Human
ggaaaucagccugaauaaauggaaugacuugucugccucacauauucuaaggugcagagucaga

SEQ ID NO: 45164 - RNA, 64 nt, Human
ugccgcauuccugcacucagaagucugcagcggugccucacaaacuugauugugcauaaaaauc

SEQ ID NO: 45165 - RNA, 64 nt, Human
aggaagugaacaauggcggcggugugggagacaaggccaggagagcccgcguucaguauggguu

SEQ ID NO: 45166 - RNA, 64 nt, Human
aucacuguauacucuugcugagaauguggaugcagccucacagaucuuugcaacacuccaacca

SEQ ID NO: 45167 - RNA, 64 nt, Human
aagcccggcucuccuacucugcuuccaggcuggggccucacagguggggcuguuaccuuccuca

SEQ ID NO: 45168 - RNA, 64 nt, Human
ggacuggaugugccgugggcagugccuuccuccagccucacaaccuuucugcuggggcugaagu

SEQ ID NO: 45169 - RNA, 64 nt, Human
uagcaguaaauugugauucagucuuccagauuaugccucacaugcuagcaucagguaaugcuga

SEQ ID NO: 45170 - RNA, 64 nt, Human
gacagcccaaccucuggcagaccagggguuaccagccucacagcugcagcugccuucaagccug

SEQ ID NO: 45171 - RNA, 64 nt, Human
cucuacaagcuuuuguucacagcuugaaauagaugccucacaauucagacaguuuaauucagga

SEQ ID NO: 45172 - RNA, 64 nt, Human
uuuuaagucaaaagguauucugaauauaauaaaagccucacaaauuauuuguaaaauuuaguag

SEQ ID NO: 45173 - RNA, 64 nt, Human
gauucaucuucauaaucuccaguuuuuucacagugccucacagaguuaaucaugccuuuuggag

SEQ ID NO: 45174 - RNA, 64 nt, Human
agagauuccucaguaaucuccaaucucucauagugccucacaggguuggucaauggcuuuugga

SEQ ID NO: 45175 - RNA, 58 nt, Human
ccaugaccaauguguccuagaaccaccugccucacagcuggccgucacuugugggggu

SEQ ID NO: 45176 - RNA, 64 nt, Human
ugggcacacggcccuucggagccugggcagccuggccucacaggcagacucgcagacggggcag

SEQ ID NO: 45177 - RNA, 64 nt, Human
ggccaucaaccucuguauuugaaucagccuacaggccucacacacaaugugucugagagauuca

SEQ ID NO: 45178 - RNA, 64 nt, Human
ugaacuccugaccucaggugaucugccugccucggccucacaaagugcuaggauuacaggcaug

SEQ ID NO: 45179 - RNA, 64 nt, Human
uccugugccaaggguacguauauugugaaguaaagccucacaaagcuaaauaaauucucuucca

SEQ ID NO: 45180 - RNA, 64 nt, Human
ucagacacagauuggccagaaaccuuccugcugagccucacagcagugagacuggggccacuac

SEQ ID NO: 45181 - RNA, 64 nt, Human
cccagcagccuccagaaccaugcccaggucuccugccucacaucacaauaaucugggacccagg

SEQ ID NO: 45182 - RNA, 64 nt, Human
gcuccucauuugcuagucacggacagugauuccugccucacaggugaagauuaaagagacaacg

SEQ ID NO: 45183 - RNA, 64 nt, Human
ccagcgccccuccucccugagggagcauggcacagccucacacuugaaagacgguguuugguuu

SEQ ID NO: 45184 - RNA, 64 nt, Human
aggaagucuggaaaagcuuuggucccacagccuugccucacagcauguaaauaauuaaaacaau

SEQ ID NO: 45185 - RNA, 64 nt, Human
ggccagauggccuuggguuuaauccuggcucagugccucacagauugugugacuuuaggcaaac

SEQ ID NO: 45186 - RNA, 64 nt, Human
acaaacaagcaacauccucaaaacccaaccccaugccucacagagcuuccuguggcuucuccag

SEQ ID NO: 45187 - RNA, 64 nt, Human
uauuacuuuauccuggaacaugcaaaauacugaagccucacaguuguaugugaggggaaagggg

SEQ ID NO: 45188 - RNA, 64 nt, Human
ccucuucccuuccuggacaaggcccccugccuuugccucacauaaacuguacaguauuuucauu

SEQ ID NO: 45189 - RNA, 64 nt, Human
cauuucucagggaaguaagauguaaauugaagaagccucacacguaaaagaaauguauuaaugu

SEQ ID NO: 45190 - RNA, 64 nt, Human
guaaaguguuagcacacagacuguuaaaaugucugccucacagauaggagggaaaauauauaga

SEQ ID NO: 45191 - RNA, 64 nt, Human
gguuuaauggacucaguuccacauggcuggggacgccucacaaucaugguggaaggcaaggagg

SEQ ID NO: 45192 - RNA, 64 nt, Human
ccucucauccucccgccgcccgucaggccggccagccucacaucagucucuccgccccggggaa

SEQ ID NO: 45193 - RNA, 64 nt, Human
uuccuuaaauuaauauguuuguguguauauaugugccucacaccugaauugaaaauuaaagacu

SEQ ID NO: 45194 - RNA, 64 nt, Human
ugugacucuuguuacagaucauggcggugcgucagccucacaggagacauagcaggucucagaa

SEQ ID NO: 45195 - RNA, 64 nt, Human
gaguaaaccgaguguuaagugucaaggugagaaagccucacauucucucaagacaguugcucua

SEQ ID NO: 45196 - RNA, 64 nt, Human
ucaccacccucugccccaccaugauccagccucugccucacacuccuguccucugaacccaccc

SEQ ID NO: 45197 - RNA, 64 nt, Human
cuucagcuuggguacacacacagaggagaccucagccucacaccagaaauauuauuuuuuuaau

SEQ ID NO: 45198 - RNA, 60 nt, Human
aauauaaacaaagaauaugacaucuguugggccucacaaggaccagggccuucuggagga

SEQ ID NO: 45199 - RNA, 64 nt, Human
ugaacuccuggcuucaagcgauccuccugucucggccucacaaaguguugagacuacaggcaug

SEQ ID NO: 45200 - RNA, 64 nt, Human
ucuuucuugcuguuuuaauguggugcacacuauagccucacaaaccuguuauuccaguguaauc

SEQ ID NO: 45201 - RNA, 64 nt, Human
uuuuuaguuugagaagcuggaaagagagagaagggccucacagugauggguucaggacggguca

SEQ ID NO: 45202 - RNA, 64 nt, Human
aaagugauggcuuucaggacuuguuuuuuauccugccucacaguuguuaaagucuguuccaagg

SEQ ID NO: 45203 - RNA, 64 nt, Human
gucuccuacucuucauggccuuuguaccugacuuggccaggaaugaucucuguuccucucuuuc

SEQ ID NO: 45204 - RNA, 64 nt, Human
uucauuaaucuuccguuaggccaauaaaagaagggccucacaagacaaaacaggagccagaagu

SEQ ID NO: 45205 - RNA, 64 nt, Human
ucagugcuuuccuccuucacuguuucaucuaagugccucacauuuuuuucuaccuauaacacuc

SEQ ID NO: 45206 - RNA, 64 nt, Human
ucuccuccugcagugccacgugguggcauuucucgccucacaccaagaagcagcaaguggaaaa

SEQ ID NO: 45207 - RNA, 64 nt, Human
guccacacacacaucucacgccccuggucucacagccucacaccuuguccuuccaccccugccu

SEQ ID NO: 45208 - RNA, 64 nt, Human
ggaaauaguuaauuguuaaagaaaacuucuuguagccucacauuccccuugugcaaagagcucu

SEQ ID NO: 45209 - RNA, 64 nt, Human
aguuaagugagagugugaacuguguggcaagagagccucacaccucacuaggugcagagagccc

SEQ ID NO: 45210 - RNA, 64 nt, Human
gggaggagaugggacuuugaccacacacagugaugccucacacccugaaggugggggauuuugu

SEQ ID NO: 45211 - RNA, 64 nt, Human
ccaccauuagccauguggcaaccuuuacuucuaugccucacaagugccuuucagagagccccaa

SEQ ID NO: 45212 - RNA, 64 nt, Human
ugcuguaauugaacgggucgagaugccgaccucagccucacaggccaaagcaucagcaccagaa

SEQ ID NO: 45213 - RNA, 64 nt, Human
ccggcacaucuaacaucuacacuucucuagcucagccucacaggccaaagcaucagcaccagaa

SEQ ID NO: 45214 - RNA, 64 nt, Human
aagucaggcuagcugugcugguauuggaauagcagccucacacuggcgucuggacuguucugua

SEQ ID NO: 45215 - RNA, 64 nt, Human
ggaucuggagucucugaacucuuaauaggaugcagccucacauacauaaugucacccauuuuau

SEQ ID NO: 45216 - RNA, 64 nt, Human
ggacugauaacuccggaagaaugacucuccuguggccucacacugcugccugucugucugucac

SEQ ID NO: 45217 - RNA, 64 nt, Human
ggagggugagacagaacaaucccuaaagggucaugccucacacuucacaucagaauuucuggca

SEQ ID NO: 45218 - RNA, 64 nt, Human
uggcggauccaggugucugagggcuuccacgugggccucacauuccaguccuuugagguagguc

SEQ ID NO: 45219 - RNA, 64 nt, Human
aaagaaaacgaaaacaguuuaaaucucuaccacagccucacaagcaaaugcuaaggggaacaua

SEQ ID NO: 45220 - RNA, 64 nt, Human
agauggggccuggaggccuggaggaaggggccaggccucacauucguggggcucccugaauggc

SEQ ID NO: 45221 - RNA, 64 nt, Human
uauuuuauuugagguucuuguuacaauuagcuuugccucacauuuagcgguuaugaaucucauu

SEQ ID NO: 45222 - RNA, 64 nt, Human
agucugcccuccugcuccaguggccuugauuuuaggccaggaaucuucugcuccauguggcuua

SEQ ID NO: 45223 - RNA, 64 nt, Human
augauggaggugacaucaggcagaggagagugcagccucacagugacuuucucagaggugacag

SEQ ID NO: 45224 - RNA, 64 nt, Human
aaaccagugcaugcaccugguuggaagaugcucagccucacaaaagcuccaagcccuuugggag

SEQ ID NO: 45225 - RNA, 64 nt, Human
caauagcauuagaaauaagugauuaaaggccucugccucacaacauggcaaguacaguacuuug

SEQ ID NO: 45226 - RNA, 64 nt, Human
ugaugccaucgaaauuggaagguucccuggugcugccucacacuccugagauccagaccacgag

SEQ ID NO: 45227 - RNA, 64 nt, Human
cauccccugguggcuucagcaguccuuaucaccagccucacaaucccacaggcccacccccagu

SEQ ID NO: 45228 - RNA, 64 nt, Human
auguguggggaggauccaucccccacccacugcagccucacaccgaguccaccuuggacauggu

SEQ ID NO: 45229 - RNA, 64 nt, Human
gcuguggucucugacccccuggaggccuccccacgccucacagaacacagugcagacggugggc

SEQ ID NO: 45230 - RNA, 64 nt, Human
gcugugcuaagccugccacgggcguauccuugcagccucacaacagugggaggucuguauccug

SEQ ID NO: 45231 - RNA, 64 nt, Human
cagccugcccugcgguccugucaccuggaggccagccucacaugcccaaaucuccagucuccug

SEQ ID NO: 45232 - RNA, 64 nt, Human
gaaggaugaagcagcuccuguccggcccagcccugccucacagcugugcgagcucugcccuccu

SEQ ID NO: 45233 - RNA, 64 nt, Human
aguagccaggacuauggcauguaccaccgcaccugccucacauuuucuuucucacuguaaauac

SEQ ID NO: 45234 - RNA, 64 nt, Human
uuacaucagcgucuccuugggacacgccuucugagccucacaucuccuucuguucaaaggccuc

SEQ ID NO: 45235 - RNA, 64 nt, Human
uacagagcaucuagcuggugcgcuggcaccccuggccucacacagacucccgaguagcugggac

SEQ ID NO: 45236 - RNA, 64 nt, Human
uaucacugaguaacagaagagcugaguuaggcgggccucacaggucacccagccagaucucauc

SEQ ID NO: 45237 - RNA, 64 nt, Human
ggcauuuuucuuaacgagauuugcuucugucuuagccucacacagggaaaauauccauuuaucu

SEQ ID NO: 45238 - RNA, 64 nt, Human
cagcaagccuccuuugugcuauguggagcucacagccucacaugugaacacccgugucuggguu

SEQ ID NO: 45239 - RNA, 64 nt, Human
caggccuccuguccacaccagcgcccccuggggggccucacacagccccuguggcagaagcagu

SEQ ID NO: 45240 - RNA, 64 nt, Human
ucugugggugcagcucuuccagaaaguauuaggagccucacaucuacucugccaagcgccccag

SEQ ID NO: 45241 - RNA, 64 nt, Human
uacuugggaggccaaggcaggcauaucaacuugaggccaggaguuaaagagcagccuggcuaac

SEQ ID NO: 45242 - RNA, 64 nt, Human
augaugaggauagaaaauuuuuccauuuuuaugugccucacaggcuguuugggcauuaauuuug

SEQ ID NO: 45243 - RNA, 64 nt, Human
ugguggaucaagacauaaguaaaugagccuuucugccucacaucagcccuguguauaaagccau

SEQ ID NO: 45244 - RNA, 64 nt, Human
cacuucgcuucagccuccggaccauuccggagcagccucacauaccucacugucucgucugucu

SEQ ID NO: 45245 - RNA, 64 nt, Human
ucgaugcaggccagaguucaaggcucuggggcuggccucacaagaggcuucuuccacggggcuu

SEQ ID NO: 45246 - RNA, 64 nt, Human
ugccccaguucagcaaaaggaggaaaaugugccugccucacagucaucagucuuuuuaaaucuu

SEQ ID NO: 45247 - RNA, 64 nt, Human
agaugucucuagacucugucuccuuuccuacaaggccucacacagaugcuugaggcuaauggcc

SEQ ID NO: 45248 - RNA, 64 nt, Human
uuuccacacgugccuuugauuucggacagauugggccucacagccaccgauucagcugccaggg

SEQ ID NO: 45249 - RNA, 64 nt, Human
uauuuuagggguuguuugggggccuggguggucggccucacaugggaaggggauggguagugga

SEQ ID NO: 45250 - RNA, 64 nt, Human
cuuuaaaacacauacucuucuccuagcauauucugccucacaggugcuuagucuuugccuuugu

SEQ ID NO: 45251 - RNA, 64 nt, Human
ugcuccagaaaucuaugcugacugugacacaagagccucacaugagaaauuaccaguauccaac

SEQ ID NO: 45252 - RNA, 64 nt, Human
uagcacaggaguagcagcagcaggacaggcaagagccucacaagugggacucugggccucugac

SEQ ID NO: 45253 - RNA, 64 nt, Human
gaagccaggcucuuuaauguuccaagucagcugugccucacacaaggcucucuuuuuagcuacu

SEQ ID NO: 45254 - RNA, 64 nt, Human
cgugcauaggaccucaaaauacaaaauuagcagggccucacagucagcuuccucauggcuaguu

SEQ ID NO: 45255 - RNA, 64 nt, Human
agaagccuguguucuucaagagcagguguucucagccucacaugcccugccgugcuggacucag

SEQ ID NO: 45256 - RNA, 64 nt, Human
uggauuacuuuaacuuucgugaaggcauuacauugccucacauucacuaaccaccuugaauuaa

SEQ ID NO: 45257 - RNA, 64 nt, Human
acauauuuuguuucuucuagaguguacuuuuccugccucacaguuacauugguaauucuggcau

SEQ ID NO: 45258 - RNA, 64 nt, Human
uacuccuggcaacaucaggccaacguccaccccagccucacauugccagauguuggcagaaggg

SEQ ID NO: 45259 - RNA, 64 nt, Human
cccgucuuccugcauggaccacaccgggucuggggccucacagcugucaucacugaguuugccc

SEQ ID NO: 45260 - RNA, 64 nt, Human
uucccauccuaacagaaguaacccagcaagucaaggccaggaggaccaggggugcagacagaac

SEQ ID NO: 45261 - RNA, 64 nt, Human
gcuccguuguagggguuacagaacagucguucccgccucacaaccugguaaggauccaucucuu

SEQ ID NO: 45262 - RNA, 64 nt, Human
gaagaauaaaccauccaagagacggcgcugcagggccucacagucugcuuccauuuccucucag

SEQ ID NO: 45263 - RNA, 64 nt, Human
aacaaaacguaaguuucauuugggcaaaaauugagccucacaauaaacacccugaagacacaac

SEQ ID NO: 45264 - RNA, 64 nt, Human
cacagguggugagcuuaugugugggcacucuacugccucacagaagccagccaagugccaaggu

SEQ ID NO: 45265 - RNA, 64 nt, Human
cccggagggccugcucccggccccccugcacucugccucacaaaggucuauauuauauaaaucu

SEQ ID NO: 45266 - RNA, 64 nt, Human
uugagcugcugcugucacuccuccaccgagggaggccucacaaaccacaggacgcugcaacggg

SEQ ID NO: 45267 - RNA, 64 nt, Human
ccaccaagugccucccucacagccaugcccagaagccucacaccucgucaccaccaccaccccc

SEQ ID NO: 45268 - RNA, 64 nt, Human
cugaacacuccuuguucaggacaggcucaguccugccucacacuagcauuucaaguccaguauu

SEQ ID NO: 45269 - RNA, 64 nt, Human
agaucacccuaaauuuacucaucucucuagugcugccucacauugggccucagcagcuccccag

SEQ ID NO: 45270 - RNA, 64 nt, Human
cugacuucacaugaguauuucuucccagcuccuggccucacauggguggucacagggagaaaca

SEQ ID NO: 45271 - RNA, 64 nt, Human
cgcugaguuggguuugugacucuucccucucccugccucacaggauugugacuccccagccccu

SEQ ID NO: 45272 - RNA, 64 nt, Human
ggaucugagaugguuuuugcaucuuuccaggagagccucacauucuucuuccagguuguaucac

SEQ ID NO: 45273 - RNA, 64 nt, Human
caucccugcagaggaaagacaggacccggggcccgccucacaccccaguggauuuggaguugcu

SEQ ID NO: 45274 - RNA, 64 nt, Human
agcgcagcuugccggagggagggccgcugugugcgccucacaucuggcucccaguggaaacuuu

SEQ ID NO: 45275 - RNA, 64 nt, Human
ugagagacccaaggaggaaaaacagacaaaaacagccucacagaagaauaugacagcugucccu

SEQ ID NO: 45276 - RNA, 64 nt, Human
ugaggcagacggugaggguggcccaggagccauggccucacacagacccgaggcagagaacagc

SEQ ID NO: 45277 - RNA, 64 nt, Human
aaguacacagauccuuaucucuccccauccccuagccucacaaaacacaguugagagucuuuua

SEQ ID NO: 45278 - RNA, 64 nt, Human
uggcagguaugacaacucauccaguggaaacacagccucacacugcccuuccgccccccacacu

SEQ ID NO: 45279 - RNA, 64 nt, Human
cacuuggggaggccaaggcaggcggaucacaugaggccaggaauucgagaccaaccuggucagc

SEQ ID NO: 45280 - RNA, 64 nt, Human
ucuccugcacuuugaaagaccccucccacuccuggccucacauuucucugugugaucccccacu

SEQ ID NO: 45281 - RNA, 64 nt, Human
cugguguguauucucaugugguuugcacagcccagccucacagcacuauuguaaacccugcucu

SEQ ID NO: 45282 - RNA, 64 nt, Human
ccucuccagagucagggagggcugcccagcccuggccucacagccgucccagauguuaggugag

SEQ ID NO: 45283 - RNA, 64 nt, Human
auguaaaucagaaaugcagacaccccagacgagagccucacaggagggagggggccccacaggc

SEQ ID NO: 45284 - RNA, 64 nt, Human
accuguuugcauggagaaaugggcuggccccacagccucacaggagcaguuugugggcugguuu

SEQ ID NO: 45285 - RNA, 64 nt, Human
ucuuggauucuuuccaguguggugccuuuuauaugccucacauagucuccuuguucuccuacua

SEQ ID NO: 45286 - RNA, 64 nt, Human
aucuagaccucugacaucaugguguuuucuuaaugccucacauugcuggcacggggaugugccc

SEQ ID NO: 45287 - RNA, 64 nt, Human
uagucagccgugucauuauaaagcauguuguguggccucacagaaacauugaaacuguuuauac

SEQ ID NO: 45288 - RNA, 64 nt, Human
agaccccacuucaacuuccccucgaagacguugugccucacagcgaggccuacaagggauggga

SEQ ID NO: 45289 - RNA, 64 nt, Human
agcaagucggcccugacgccaggccccagugggcgccucacacucagaaccucauaccccagag

SEQ ID NO: 45290 - RNA, 64 nt, Human
gauguacgcugcgugccaugaguccauguccuaugccucacaaaugcugugguucacugcacug

SEQ ID NO: 45291 - RNA, 64 nt, Human
ucagccucccaaagugcuaggauuacaggucauggccucacaccacuguuacuugguguacaug

SEQ ID NO: 45292 - RNA, 64 nt, Human
cugauccccucgugacagaaccuuucagcauaacgccucacaucccaagucuauacccuuaccu

SEQ ID NO: 45293 - RNA, 64 nt, Human
ccucccaagcugugcgagcaugcaaggccccauggccucacacugcagacaccccuuuccagcc

SEQ ID NO: 45294 - RNA, 64 nt, Human
augagcuaacccugagcuuguccaggacuucauugccucacaggcccugagccucccgaaggag

SEQ ID NO: 45295 - RNA, 64 nt, Human
guggagggggccuucagcccucugcacccugccugccucacaccccgccuucaggagcccucuc

SEQ ID NO: 45296 - RNA, 64 nt, Human
ugaccucccgaccucaggugauccgccuaucugggccucacaaaguccugggauuauaggcaug

SEQ ID NO: 45297 - RNA, 64 nt, Human
gaaaucuuacagcuggguggcacugccaugcagggccucacacgguuugaagccuggaacauca

SEQ ID NO: 45298 - RNA, 64 nt, Human
gaaaguugugucuucugggaaagagaccuggggaggccaggaguagcugaggguccuuucugug

SEQ ID NO: 45299 - RNA, 64 nt, Human
ccuuauucuaaaaagaacuuagguagguuauggugccucacaccuguaaucccagcacuuuggg

SEQ ID NO: 45300 - RNA, 64 nt, Human
ccuucuuaaaauacauaugauugccuuuuugggugccucacagagccccagagugugagaccug

SEQ ID NO: 45301 - RNA, 64 nt, Human
ucugggauuagagccucaaggacauugugugauugccucacauuugcagguaauaucaagcagc

SEQ ID NO: 45302 - RNA, 64 nt, Human
gccggcggguccuccugagcgcggcagagggugagccucacagccccucucuggaggccuuucu

SEQ ID NO: 45303 - RNA, 64 nt, Human
uccucacuggcuuccaugcacccaccugacgguagccucacagaaguccuggcugucacucagg

SEQ ID NO: 45304 - RNA, 64 nt, Human
ggggaauuccugccaagcaccuugaaugggaggggccucacagagggcagggccaggguccagc

SEQ ID NO: 45305 - RNA, 64 nt, Human
cuaagaccaacugcguuggacaccauaagccacagccucacaggaagugggggugaggagccug

SEQ ID NO: 45306 - RNA, 64 nt, Human
caguugcgcagggacuccugggagauauucaggagccucacacuguucagacguugacuuagca

SEQ ID NO: 45307 - RNA, 64 nt, Human
gaccugaggcccuucucuccagccccuggaugcagccucacaguccuuaccagcagagcaccuu

SEQ ID NO: 45308 - RNA, 64 nt, Human
uggcaaccugagccacacaggccuccaccccugcgccucacaggggucgcuggcguuggagcgg

SEQ ID NO: 45309 - RNA, 64 nt, Human
gcuucuuaacagauggcauuuucugugacucuaggccucacaaaagagccagaguucuggaccc

SEQ ID NO: 45310 - RNA, 64 nt, Human
uccagcaggccagagccagacacgaccucccugagccucacaggcuuacaggagucaccugcuc

SEQ ID NO: 45311 - RNA, 64 nt, Human
ggcuucccuccugcaucccugccguggguugcuggccucacacuugcagcagcuggacagugau

SEQ ID NO: 45312 - RNA, 64 nt, Human
gguucccacuaggaugcagagaugaccucucgcugccucacaagcagugacaccucggguccuu

SEQ ID NO: 45313 - RNA, 64 nt, Human
agggagaaaucgguaacaguugccgaaccaggccgccucacagccaggaaauuuggaaauccua

SEQ ID NO: 45314 - RNA, 64 nt, Human
accaauggguuugccaagcccuuugcuguucgcagccucacauucccccggugccucucccaug

SEQ ID NO: 45315 - RNA, 64 nt, Human
ugcugcuauugauuuguccccgacagcaggcaaagccucacauugcccucaauuuucccccuuu

SEQ ID NO: 45316 - RNA, 64 nt, Human
cacagucgguccccgcagaggucacuguggcaaagccucacaaagcccccucuccuaguucauu

SEQ ID NO: 45317 - RNA, 64 nt, Human
aaucacuugaaccuacgaggcggagguugcagugggccaggaucgugccacugcacuuuauuua

SEQ ID NO: 45318 - RNA, 64 nt, Human
acggucaugucaguuugggggaauucucuguugugccucacagacuccccccuuucuuuccucc

SEQ ID NO: 45319 - RNA, 64 nt, Human
agauagaaaagacuuaaauggagaaccagcccaugccucacagacaguaggaucccaguaaaua

SEQ ID NO: 45320 - RNA, 64 nt, Human
ccaugcagguaccugaucggagaggagggcuacugccucacaucacugcagagugcccugagcu

SEQ ID NO: 45321 - RNA, 64 nt, Human
aaggauggcuaaaugcuccugggagucaggcgcagccucacaccagcugccuccuccacucagc

SEQ ID NO: 45322 - RNA, 64 nt, Human
auacauacaguaggugaauuuucaggacaauauugccucacaacccugcuuacauugaaaaguc

SEQ ID NO: 45323 - RNA, 64 nt, Human
gguauuuuugauaacagagcuaugacuugucugagccucacauccuuuuccuugacuucucaac

SEQ ID NO: 45324 - RNA, 64 nt, Human
gcagacccugcccaaggaugcaggccuaagccgggccucacacucacacuguaaaugucucucu

SEQ ID NO: 45325 - RNA, 64 nt, Human
uucccacucuguccaccaagugggggguagcacagccucacagcaaccgcccugaccuugggca

SEQ ID NO: 45326 - RNA, 64 nt, Human
aggagcacuggaggaggagugggcucucugugcagccucacagggcuuugccacggagccacag

SEQ ID NO: 45327 - RNA, 64 nt, Human
ugcuuugcuuuggugaacuuguccuaguaugcuugccucacaaacguuuuagccauugugaauu

SEQ ID NO: 45328 - RNA, 64 nt, Human
uuuuucuuaaagaggaaccucguauaagcuucaagccucacaaaccuucuagccucugcccuug

SEQ ID NO: 45329 - RNA, 64 nt, Human
ccaagggaagcagugaggaaagaugaggcaucgugccucacauccgcuccacauggugcaagag

SEQ ID NO: 45330 - RNA, 64 nt, Human
cacacgccccucuacugcuauguggcuucaaccagccucacagccacacgggggaagcagagag

SEQ ID NO: 45331 - RNA, 64 nt, Human
cuucuagguagccuuccaacuuaaucuaacuugagccucacaguaacccuguaaaguuaguaga

SEQ ID NO: 45332 - RNA, 64 nt, Human
gcuguggccugcagucugugaggagggcugucuugccucacacuccucacagccuacuuccccu

SEQ ID NO: 45333 - RNA, 64 nt, Human
guaggagcugcgcaaugccccucuguucuccccugccucacaguuucccucgccccugggcugg

SEQ ID NO: 45334 - RNA, 64 nt, Human
gugaaaguauaaaggcuguguucuggaauuuucugccucacagcaaauaaauaagguagugaau

SEQ ID NO: 45335 - RNA, 64 nt, Human
auccuuccuucugguggcagagccagucuucugggccucacaugccugugcgguuaagaaggag

SEQ ID NO: 45336 - RNA, 64 nt, Human
ccugugaucucuguguuuucccuuuucuuucuggggccaggaagucagggucaacucccaggcc

SEQ ID NO: 45337 - RNA, 59 nt, Human
cgcugcuccuacagguuuagcucgcuccugccucacagcccacacucccuggggcugga

SEQ ID NO: 45338 - RNA, 64 nt, Human
ccaagcagcucuccugggcccgcggcugcuccgggccucacaucugcugcuggccucggugggc

SEQ ID NO: 45339 - RNA, 64 nt, Human
uuacugagauuugagcugugcuggccagcgcauugccucacagucacgccgcagcauggaugug

SEQ ID NO: 45340 - RNA, 64 nt, Human
ccuccacgaggauuaaaggauacaagcugaccaggccucacaggugcucugcucguggccccaa

SEQ ID NO: 45341 - RNA, 64 nt, Human
uuuccccucccccuccccucugaggagccugccugccucacaacucacccucacuucacugaau

SEQ ID NO: 45342 - RNA, 64 nt, Human
aaacagaugguagggagagagagccacuggaucggccucacagacucagagcgugaaaaugaau

SEQ ID NO: 45343 - RNA, 64 nt, Human
uuuaagaugaagcaagaugucuguagcgguaauugccucacauuaaacugucgccgacugcagg

SEQ ID NO: 45344 - RNA, 63 nt, Human
cgcagccgaaggacaagugaagcagcccccugagccucacaaggaccuccuggcuggugagga

SEQ ID NO: 45345 - RNA, 64 nt, Human
ugaguguaaggaaugugggaaagccuucagaucugccucacaccuucaaauucaugaaaggaca

SEQ ID NO: 45346 - RNA, 64 nt, Human
cgcccugacccgcccucaugggcaccgggcaggcgccucacagagcacagacgugcccucggcc

SEQ ID NO: 45347 - RNA, 64 nt, Human
cgcaccuguggggagcaccacaucuccaccugcggccucacaucuccccacuccccuuuuugua

SEQ ID NO: 45348 - RNA, 64 nt, Human
ugccacaaguguuuauugagcaccugugugccaggccucacagacucccaguuggguugaagaa

SEQ ID NO: 45349 - RNA, 64 nt, Human
agggagaagacaaggccccagcccuccucugggagccucacaccugagaccagcaggacaaggc

SEQ ID NO: 45350 - RNA, 64 nt, Human
ccaccaugcgggccucagguggcagagaggcccagccucacaggccuguggccccacacaccag

SEQ ID NO: 45351 - RNA, 64 nt, Human
uuccagccuccaugucaccacguggugaauggcugccucacauugcuccaguuugugcacuaau

SEQ ID NO: 45352 - RNA, 64 nt, Human
ccagaguagcuggaaauacagugccacccagauagccucacaaaacuuugacccagccacuguu

SEQ ID NO: 45353 - RNA, 64 nt, Human
cuauuaaaaauacaggccaggggccgggcacggugccucacaccuguaaucccagcacuuaggu

SEQ ID NO: 45354 - RNA, 64 nt, Human
ccuccacaccguuccggaagagcuggcaaaaggagccucacacccccaaggaggggacggugcc

SEQ ID NO: 45355 - RNA, 64 nt, Human
aaagcaaauaagauuuaacaacccaagauuaagaggccaggaagagguuagacgcaaugugaaa

SEQ ID NO: 45356 - RNA, 64 nt, Human
ggcccuggcccuacuccagggccaaugcacccccgccucacacacgcacuccuucuccucaagg

SEQ ID NO: 45357 - RNA, 64 nt, Human
ggcuccucgcgccucagguggaauccugcccugugccucacagaagagguggggaccgcaguca

SEQ ID NO: 45358 - RNA, 64 nt, Human
ggcagacccagccacauaccacaaccacccccaagccucacacucccuugucuuuuuccagacu

SEQ ID NO: 45359 - RNA, 64 nt, Human
cccgugguguagccuccucuggccugaaaggucugccucacacaggccuucccugcagggcagc

SEQ ID NO: 45360 - RNA, 64 nt, Human
ugcaauggcacaaucuuggcucacugcaaccucugccucacagguucaagugguucuccugccu

SEQ ID NO: 45361 - RNA, 64 nt, Human
aacauggaauagucuguugaauuuugguguauuggccucacaggcacccacaaauguacacaaa

SEQ ID NO: 45362 - RNA, 64 nt, Human
uccaaaaagaugcuucaucagauccuuccugggagccucacauucaagggucugacuugugaga

SEQ ID NO: 45363 - RNA, 64 nt, Human
cagccaagugauugggagaccacacagcagagaagccucacaagaguggagacauauggacugc

SEQ ID NO: 45364 - RNA, 64 nt, Human
ucuccacagacccagccuccggcugugacccccagccucacaccugccucugguucccgccugg

SEQ ID NO: 45365 - RNA, 64 nt, Human
uaaauguacugugugugacagaggcuuuauucaggccucacagcuuugcaggcauuaaaaucua

SEQ ID NO: 45366 - RNA, 64 nt, Human
gcuuuacuccacgcaucaauaaauaauuuugaaggccucacaucuggcagccccaggccugguc

SEQ ID NO: 45367 - RNA, 64 nt, Human
uuccagccuccaagucaccaccuaguaacuggcugccucacauugcucugguuugugugguaau

SEQ ID NO: 45368 - RNA, 64 nt, Human
gcuccuuguccccucccacccgccucaugacccagccucacagacccucucaggccucugacga

SEQ ID NO: 45369 - RNA, 64 nt, Human
cagugaggaagaagacugcguggauucauggggagccucacagcagccacgcagcaggcucugg

SEQ ID NO: 45370 - RNA, 64 nt, Human
ccucacccaucaaaccagugaauuucucaaucuugccucacagugacugcagcgccaagcggca

SEQ ID NO: 45371 - RNA, 64 nt, Human
gugucgauucccuguuaacauggauaucaguucugccucacauuucccacuugagguugaggcg

SEQ ID NO: 45372 - RNA, 64 nt, Human
agguccuccccucaccccaacucuagguuuccaggccucacagccaagcugaagcuuggagaaa

SEQ ID NO: 45373 - RNA, 64 nt, Human
accaggugugauagccccagccaggucacaccuggccucacacuuugagcugagacuugaaaac

SEQ ID NO: 45374 - RNA, 64 nt, Human
ccacuguaagcuguggccucaccaggcaagcugaggccaggagggacccugcccagucugugaa

SEQ ID NO: 45375 - RNA, 64 nt, Human
gggaugacuuaugacacuugcacagcauggcucugccucacaaugaugcagucagccaccuggu

SEQ ID NO: 45376 - RNA, 64 nt, Human
gccaaccccggccccuggucaggccccugcagcugccucacaccgccccuugugcucgccucau

SEQ ID NO: 45377 - RNA, 64 nt, Human
cuacugauucaaaugcuaaucucuuccagaaacagccucacagacacacccagacaucugguag

SEQ ID NO: 45378 - RNA, 64 nt, Human
uaaaaaaugcagaauuuuaugugacugcuuuuuugccucacaauuaugcugugaauuuuacaaa

SEQ ID NO: 45379 - RNA, 64 nt, Human
cuuuaccagacuuuacuuuguacucagagaagaggccucacauggcugugucacauauaaaugu

SEQ ID NO: 45380 - RNA, 64 nt, Human
ccaagccagagaaccgaagacccggccggcccuggccucacaggcgugugcccaugcagccacc

SEQ ID NO: 45381 - RNA, 64 nt, Human
ccggcucucgcacucuguacagcccaccuucccugccucacagauaccaauagagagguuuucu

SEQ ID NO: 45382 - RNA, 64 nt, Human
aagcagaugcugcguuuuccauaaaccugauuuugccucacaugaaccaaagacucucaaaacu

SEQ ID NO: 45383 - RNA, 64 nt, Human
ugugugcgaguguguguguguggagauguuaagagccucacaaggaaacuggguuauuggaggc

SEQ ID NO: 45384 - RNA, 64 nt, Human
gagaguuccugacagucugcccuucugauagccugccucacagaguuuagacaugacuagccag

SEQ ID NO: 45385 - RNA, 64 nt, Human
cacuccaugccacccccaccagcuggaggacccagccucacaguguguccuuugugccagacca

SEQ ID NO: 45386 - RNA, 64 nt, Human
uucuccguuagauacacuuggcuaccuaguuggugccucacaggguuccugcugccuggugucu

SEQ ID NO: 45387 - RNA, 64 nt, Human
caugcuguggcuucucacagcuguggucuccccugccucacaacgacuccuuucucuugugugg

SEQ ID NO: 45388 - RNA, 51 nt, Human
gccggcagagugucgugugaggccucacagcuggccuugaguuuuuacuga

SEQ ID NO: 45389 - RNA, 64 nt, Human
cggggcccgcagaggugcccuuacugaggugacagccucacagggucugguaccagggguugug

SEQ ID NO: 45390 - RNA, 64 nt, Human
cuguuccugaaaggcagagagccucuugcccugagccucacagcuacucuucucagcucucugg

SEQ ID NO: 45391 - RNA, 64 nt, Human
cccaaaccaggccuccaagccaggugccacccucgccucacagccccggcccccugugcagggc

SEQ ID NO: 45392 - RNA, 64 nt, Human
cgugugcguuccuggcgggcacacucaggaccgugccucacagggcccacucccugccuaugcc

SEQ ID NO: 45393 - RNA, 64 nt, Human
ccagaagauuguacuuccuagagaugccagacuugccucacacccaggagcugccccugcugug

SEQ ID NO: 45394 - RNA, 64 nt, Human
cuugugccucuauuuaugcuuaauccauuugagugccucacacaaaaaacguagaguauagaaa

SEQ ID NO: 45395 - RNA, 64 nt, Human
ucucuccugaccucagggugaucagcccaccucggccucacaaagugcugggauuacaggcgug

SEQ ID NO: 45396 - RNA, 64 nt, Human
gugcugggauuauaggcgugagccacugugcccagccucacagcugcaucuuaaccuuaccuuu

SEQ ID NO: 45397 - RNA, 64 nt, Human
uugaaggcagaaucaguugaguugugagggugaagccucacauacuucucaacagacaugauaa

SEQ ID NO: 45398 - RNA, 64 nt, Human
uuuaaugggcucacaguuccacaugacugaggaggccucacaauugugguggaaggugaaaggc

SEQ ID NO: 45399 - RNA, 64 nt, Human
aaggauucaguuaaccaaacaagaaaaaggcagugccucacaaagaaauuaagaaguuguccgu

SEQ ID NO: 45400 - RNA, 64 nt, Human
aucccucuguucuccagcaaacaugggauguaaagccucacagggaaucugauaauacauacuu

SEQ ID NO: 45401 - RNA, 64 nt, Human
cccucugcuacccacuagcccucacucaguuucugccucacaaagcuguaacagaauggguugg

SEQ ID NO: 45402 - RNA, 64 nt, Human
accagaggaagaauccagauuuccuuaugcuugggccucacacuagcucucugaguauuuccuu

SEQ ID NO: 45403 - RNA, 64 nt, Human
uuguaaagucaguaauaugugaggauuuaaaugagccucacauugugacauuugugguuuuuua

SEQ ID NO: 45404 - RNA, 64 nt, Human
ccauuuaaacguuugcaaaguggcgugccccuuggccucacaggcaaagaauaacuuaaaagcu

SEQ ID NO: 45405 - RNA, 64 nt, Human
agcauugucagccugaagaucagagcugcagccagucaggcaggggagagauuuuucuuuuaag

SEQ ID NO: 45406 - RNA, 64 nt, Human
gugacuucuggcuuaugcucagaagccagucugcgucaggcacgucuccugcugcgugacaugu

SEQ ID NO: 45407 - RNA, 64 nt, Human
ucugaugcucucucucugccuccccccccauccugucaggcacaggugacgggggcagcccaug

SEQ ID NO: 45408 - RNA, 64 nt, Human
ugagaccugaccccuagucauugguuaccagugugucaggcaaucuggacuuuccagugaugcc

SEQ ID NO: 45409 - RNA, 64 nt, Human
gugcugauuuggucccugugccagggcacagggggucaggcacuguggaaagaagggacucagg

SEQ ID NO: 45410 - RNA, 64 nt, Human
gcagauggagcuacuugggggagagcucaaguuggucaggcaacagcuggggugauggccugug

SEQ ID NO: 45411 - RNA, 64 nt, Human
ugugcugauaaucucuucucuuguaccaauuuuagucaggcagaaaaugguaaacaugagggug

SEQ ID NO: 45412 - RNA, 64 nt, Human
agucacauuguaaaucuaguguaggagacuuggagucaggcagugagacugguggggcacgggg

SEQ ID NO: 45413 - RNA, 64 nt, Human
agggagaaaagaacccacaagggaagagguggaggucaggcacgguggcucacgcuuguaaucc

SEQ ID NO: 45414 - RNA, 64 nt, Human
gagugagucagcuguuugaacccaaagcugugcagucaggcacccuggcugagcuagagaagcc

SEQ ID NO: 45415 - RNA, 64 nt, Human
uauugaguuacauaaagaaaauagauuugcauuugucaggcagacguuuauacaacaccacggu

SEQ ID NO: 45416 - RNA, 64 nt, Human
ggagcccgccuggagagacagacacgugugaguggucaggcaucuucccuucacucaagcuugg

SEQ ID NO: 45417 - RNA, 64 nt, Human
ccucuuuccuuuccauucugcuuuaagcucaugugucaggcagacuuuaccagagugucagaca

SEQ ID NO: 45418 - RNA, 64 nt, Human
gaugccucuucuucaagaugcauuguuucuauuggucaggcaauugucauaauaaacuuauguc

SEQ ID NO: 45419 - RNA, 64 nt, Human
aacacugcugugcuggggcuauuuggggccugcugucaggcagaaagacguuuugaauugggcu

SEQ ID NO: 45420 - RNA, 64 nt, Human
ugaguaacagcucacacauguagcacacuuaugcgucaggcaccagcauguacaccuuaauuua

SEQ ID NO: 45421 - RNA, 64 nt, Human
aucaauuucaauaaccuuaaacaauugacccucugucaggcauaugucaggcuccacucuuaag

SEQ ID NO: 45422 - RNA, 64 nt, Human
aagagggaggugugucagugugugaggaagggaggucaggcagcuaggaccaccugcagugugg

SEQ ID NO: 45423 - RNA, 64 nt, Human
cugaaaccaauccagaaauucauguuagaacauugucaggcacuucuagguauuggacaaguga

SEQ ID NO: 45424 - RNA, 64 nt, Human
aaacucuucaccuuuaggagaccugggcaguccugucaggcagcagcgauuccgacccgccaag

SEQ ID NO: 45425 - RNA, 64 nt, Human
auagccagcauuaggugacaaucuuccagaaguggucaggcagaaggugcccuggugagagcuc

SEQ ID NO: 45426 - RNA, 64 nt, Human
aagagcugacccaucuggcccucccuugucacgugucaggcaugaagaagccacugguucuagg

SEQ ID NO: 45427 - RNA, 64 nt, Human
gucguuuguuaacaucaucaggaagaugggaaaggucaggcagaauuuuucugcccuacaaagg

SEQ ID NO: 45428 - RNA, 64 nt, Human
uuuuuccuugccccuuuccaagugguuuucaagugucaggcaguguucugagaagcagcagccu

SEQ ID NO: 45429 - RNA, 64 nt, Human
uuggaggccucagauagaccugugaccuggucuggucaggcaaugcccugcggcucuggaaagc

SEQ ID NO: 45430 - RNA, 64 nt, Human
uaaauugaaucauacaauauguaucccuuuuuuggucaggcauauuuuacucaguauaguuauu

SEQ ID NO: 45431 - RNA, 64 nt, Human
acuguggccuguuaacugguauauacauauauaugucaggcaaagugcugcuggaaguagaauu

SEQ ID NO: 45432 - RNA, 64 nt, Human
aaaaggccuucaaggaagagaaaccaggcccugcgucaggcagugugaguuugccguuuguccu

SEQ ID NO: 45433 - RNA, 64 nt, Human
aggagcugagcucccucugcccugccaguugucagucaggcagggagggaguggcuguguuggu

SEQ ID NO: 45434 - RNA, 64 nt, Human
agauaggagagagcuccauaauggcuggauaguggucaggcauucucuauucuuuucccccugu

SEQ ID NO: 45435 - RNA, 64 nt, Human
acaccugucccuggccagcaggccgccugcaagcgucaggcacacagggacagacauggcgagc

SEQ ID NO: 45436 - RNA, 64 nt, Human
auagauguugucaguuaggaaacugaagccauaggucaggcagacaucagcucagccuguggcc

SEQ ID NO: 45437 - RNA, 64 nt, Human
cguuugacaaauaguuauucaggcccuauaaugugucaggcacugacauguaaaauuuuuuuaa

SEQ ID NO: 45438 - RNA, 64 nt, Human
aaacacaaaucuucauauauacuuaauuuaauuagucaggcauccauuuugccuuuuaaacaac

SEQ ID NO: 45439 - RNA, 64 nt, Human
aguuuugccuuuucuuuugccuaaagauguuaacgucaggcaguggguuuuuccuagaggagag

SEQ ID NO: 45440 - RNA, 64 nt, Human
aggaauauccagucaaagacgcugagugggagcugucaggcaguagcagcuguguuugaguuuc

SEQ ID NO: 45441 - RNA, 64 nt, Human
acucugagaaaguuuaucaucaugauagcuguaagucaggcauuaaaaucaaauggaaauacac

SEQ ID NO: 45442 - RNA, 64 nt, Human
uauguauaccaacacugccaaaguaaaacauuaggucaggcaugguggcucaggccuguaaucc

SEQ ID NO: 45443 - RNA, 64 nt, Human
uaguaagaugaagcucaggauuuaaauaaguggggucaggcauucgaguuuuugucuuucuucu

SEQ ID NO: 45444 - RNA, 64 nt, Human
gucuguuuuugcucaaaccaucaggauggaaacagucaggcacugacuggggugcuuccaagag

SEQ ID NO: 45445 - RNA, 64 nt, Human
ugcugcuuacgugcccccagcccacugccuccaagucaggcagaccuuggugaaucuggaagca

SEQ ID NO: 45446 - RNA, 64 nt, Human
ugucugccugaggagggaaagggggaguggccaggucaggcaggccagucgucuacacaccccc

SEQ ID NO: 45447 - RNA, 64 nt, Human
aacuacaaauugucagauuucuuaaaaggacacugucaggcaaauuugaaaauauacacauuga

SEQ ID NO: 45448 - RNA, 64 nt, Human
ucguguguacuuggcugguacuuaaauucguuuugucaggcacucagagaaucucauuuuguac

SEQ ID NO: 45449 - RNA, 64 nt, Human
cacucacugugucuuugucaagugucugcuccacgucaggcacugugcuuugcaccggggagaa

SEQ ID NO: 45450 - RNA, 64 nt, Human
agcagagaggaacugagaugagcagggaugaagggucaggcagaaagcgugauagaggagagaa

SEQ ID NO: 45451 - RNA, 64 nt, Human
gcugcuuguccugcucucuucaggaggcccuggugucaggcagguuugccagugaagacuucuu

SEQ ID NO: 45452 - RNA, 64 nt, Human
gggagaccaaaugucgggguuggggugggagggcgucaggcagaggcaacugacuucauuugug

SEQ ID NO: 45453 - RNA, 64 nt, Human
ugaaucaaagguugauuuucccagagggugcugggucaggcauuucuauuaggaguuggaaagc

SEQ ID NO: 45454 - RNA, 64 nt, Human
agaugucuucagguggccuuguccaaggaugggggucaggcauuuuauaucaagggugcucuga

SEQ ID NO: 45455 - RNA, 64 nt, Human
gagcagggcaggggagggcccccucaccaggaaugucaggcaaccaucaggugauggugaggca

SEQ ID NO: 45456 - RNA, 64 nt, Human
auccuaagcucgagccccagagugaggacucggggucaggcauccgauuccccaucagcuccuu

SEQ ID NO: 45457 - RNA, 64 nt, Human
gagacagcugacuagcagcugcccagcugucaaggucaggcaagugagcaccggggacugagga

SEQ ID NO: 45458 - RNA, 64 nt, Human
gcacuuugggaggcugaggcggauggaucacgaggucaggcagucgagaccauccuggccaaca

SEQ ID NO: 45459 - RNA, 64 nt, Human
cugaugaggguacuugaagggcugauggacaggggucaggcaacuaucccaaaggggagggcac

SEQ ID NO: 45460 - RNA, 64 nt, Human
ugggggugagaggagaaggagggagggaaaaggggucaggcacacuggacaggguucucuaagc

SEQ ID NO: 45461 - RNA, 64 nt, Human
uugccaagcagaaugaugaaaugacuuuuucguugucaggcaauuuugguuaagucaaaucuua

SEQ ID NO: 45462 - RNA, 64 nt, Human
acauuggggguugcugagguaggcacaagaaaaagucaggcauaaagcacaaggcagacuguuu

SEQ ID NO: 45463 - RNA, 64 nt, Human
gacaguuugucuuggguauagggaagccuuccuugucaggcagccaacucccagcccuguucac

SEQ ID NO: 45464 - RNA, 64 nt, Human
aauuugacaaaggcauagaaucuuuuucuauccagucaggcauugccuauucuuuccaguaacu

SEQ ID NO: 45465 - RNA, 64 nt, Human
cacagagaagcuggggaggagcuuuguuuugggggucaggcagccagugagaugagggaugggc

SEQ ID NO: 45466 - RNA, 64 nt, Human
gaucuaaaacccuccauguucauuuccagacuuggucaggcacauacauaguaaauuauaauca

SEQ ID NO: 45467 - RNA, 64 nt, Human
ucuacgaaaaauagaaauauuagccgggcauggugucaggcaccuguaaucccagcuacuuggg

SEQ ID NO: 45468 - RNA, 64 nt, Human
gaucguaagucuuguuucccacagaccuggccgcgucaggcagaucaucgccuggggggccuuu

SEQ ID NO: 45469 - RNA, 64 nt, Human
cucuccacccugcaggggcccagacugccugcaggucaggcacaggggcaucuaccuagacagg

SEQ ID NO: 45470 - RNA, 64 nt, Human
acaugccaaaugcugauucugucaggcacugaaugucaggcauugagacauagggaaggaaugg

SEQ ID NO: 45471 - RNA, 64 nt, Human
ugccauauccaaggacaugccaaaugcugauucugucaggcacugaaugucaggcauugagaca

SEQ ID NO: 45472 - RNA, 64 nt, Human
gcaaagucuacauuuuaugcugaaucugcauucugucaggcacccguagaaagaccucaguaca

SEQ ID NO: 45473 - RNA, 64 nt, Human
uucuuuugguuaaauauaauuuccaaacuuuguggucaggcagcgucuaagguuacguuaccac

SEQ ID NO: 45474 - RNA, 64 nt, Human
ccgaauaggcauugcauuaaguccucuguaaggugucaggcaagccaaaaaaaaaaaaaagaug

SEQ ID NO: 45475 - RNA, 64 nt, Human
ugcacagcaagccagcggugacacaccugcaggugucaggcauggcacugggcacaacagggac

SEQ ID NO: 45476 - RNA, 53 nt, Human
agagaaaaaaaaagucuuaagccgucaggcagccucugauguggcuuuucauu

SEQ ID NO: 45477 - RNA, 64 nt, Human
ucacagugaccuuuguaugcucuguucagucugugucaggcaguaugcuuguccugaagagagg

SEQ ID NO: 45478 - RNA, 64 nt, Human
aucugcacacguguggguguuuccauaggacauugucaggcacggauggcugguccgaagcacg

SEQ ID NO: 45479 - RNA, 64 nt, Human
ggcccucacccgaagggcugccucacucuguggugucaggcacugggcuguguccugauuccuc

SEQ ID NO: 45480 - RNA, 64 nt, Human
gugaccccugaggagcgucagccaugccgaucgggucaggcaaguccaucccguccugagagcc

SEQ ID NO: 45481 - RNA, 64 nt, Human
aaagcuuagugaaacacaaaauuagaauguucaugucaggcacaaggguuuggauuuugugcaa

SEQ ID NO: 45482 - RNA, 64 nt, Human
ccuuccucacccuuggcuggcagacccacuggaggucaggcacggaccaguggcccagcccugg

SEQ ID NO: 45483 - RNA, 64 nt, Human
gcauuauuucugcccuagaguuguucacagccuagucaggcauauggauauguaaacaaugacu

SEQ ID NO: 45484 - RNA, 64 nt, Human
ucuuucccucuguuuuccuuaugcccaacacugggucaggcagagugggcgacaauaaacgcug

SEQ ID NO: 45485 - RNA, 64 nt, Human
agguuuuguaaaugaaacaguuguaauaucuaaggucaggcaccuaguaacaggguuuuguuaa

SEQ ID NO: 45486 - RNA, 64 nt, Human
ucaggcaaacagaaguuccaaccccagacuaggggucaggcagcuagcuaccuaccuugcccag

SEQ ID NO: 45487 - RNA, 64 nt, Human
ggugaacagcauaaacagcuggaccucagcaagggucaggcaaacccagucacucggaaggcag

SEQ ID NO: 45488 - RNA, 64 nt, Human
cauccgugugccggcccugcagugccugcccacggucaggcauugaaaacuaagcccaaccacu

SEQ ID NO: 45489 - RNA, 64 nt, Human
cacccuuccacauccuccuccucguugcccccuggucaggcagcuucuuuuuuuuuuuuuucaa

SEQ ID NO: 45490 - RNA, 64 nt, Human
uucugaggcccucaaccuggcaucuuaggguauggucaggcaacagggugaccagcuguccugg

SEQ ID NO: 45491 - RNA, 64 nt, Human
aggccauagaugcagggaguagaagcuuuguggugucaggcaaacggacucuguuaguaagagu

SEQ ID NO: 45492 - RNA, 64 nt, Human
acgaggacggagaacacaaacuccgcaucugugggucaggcaguuugagaggcuuuugagacag

SEQ ID NO: 45493 - RNA, 64 nt, Human
uuaucaucuaaggaaaaaagacaagggaauuccagucaggcauuauuuuccuauuacuaguguu

SEQ ID NO: 45494 - RNA, 64 nt, Human
acagaaagaauagcaaagcugcugucagaaguuugucaggcagagauguuuaugguugaggaua

SEQ ID NO: 45495 - RNA, 64 nt, Human
guguggagaaggauagccucagccacaaaacucugucaggcauugaaugacaagcaucaguagc

SEQ ID NO: 45496 - RNA, 64 nt, Human
ugucagcccguucccagaucaaccugccaguggagucaggcagugcacuccuggagccaagagg

SEQ ID NO: 45497 - RNA, 64 nt, Human
cagcuucugauuuuaaagaggcaucuagggaauugucaggcacccuacaggaaggccugccaug

SEQ ID NO: 45498 - RNA, 64 nt, Human
ugccccccgcucccagguuccccucuggugucaugucaggcauuuugcaaggaaaagccacuug

SEQ ID NO: 45499 - RNA, 64 nt, Human
ggggaaggaggagguccuccgugguacauacugggucaggcacuagcauggaggagggucacag

SEQ ID NO: 45500 - RNA, 64 nt, Human
gguuggcccuuucccaagcacuguaagugagugggucaggcaaagccccaaauggaggguuggu

SEQ ID NO: 45501 - RNA, 64 nt, Human
ccuuuaccuuuagguuuuucuuucuauacauucagucaggcacugggaucaucuguuuacaggc

SEQ ID NO: 45502 - RNA, 64 nt, Human
cagaccuagaaaugggccugucuggcauuucagagucaggcaaagcaggcagggccagggagcu

SEQ ID NO: 45503 - RNA, 64 nt, Human
guucuccaggcuucacagucuggugcuugggagagucaggcaggguuaaacugcaggagcaguu

SEQ ID NO: 45504 - RNA, 64 nt, Human
ucucaccgaagccuaauugaggcucuuggaaggagucaggcaaggauugugcuucccccauuau

SEQ ID NO: 45505 - RNA, 64 nt, Human
ugacaugaggaccguuccuaggaugggacagugggucaggcaggacaaggagaaagcagggcag

SEQ ID NO: 45506 - RNA, 64 nt, Human
gagugacucacugugucacccagaaaagagaccugucaggcagaaucgagcuuaauucaccugc

SEQ ID NO: 45507 - RNA, 64 nt, Human
uuguugagaacaagcagcaaaauuucuguauuaugucaggcaauaauccuacuaaaagguggag

SEQ ID NO: 45508 - RNA, 64 nt, Human
caaacuuuucaugaaacaagauauaccuacauaugucaggcacucugauauuuucuauucuagu

SEQ ID NO: 45509 - RNA, 64 nt, Human
uucuagccaucuuccuuugauuagcuaacaaacugucaggcagcauuauuucaugcugcuucca

SEQ ID NO: 45510 - RNA, 64 nt, Human
uacaaagcaaggagcuggugagcccagcguugacgucaggcaggcuaugcccuuccgugguuaa

SEQ ID NO: 45511 - RNA, 57 nt, Human
guaagcuggcgugugaaugagagaacagucaggcagggagcccuucuccccacagag

SEQ ID NO: 45512 - RNA, 64 nt, Human
ggaagacuucagcacaaaggaaagacuaauucuugucaggcauuuuugaaaaggcugauuaugu

SEQ ID NO: 45513 - RNA, 64 nt, Human
auagcacaggccaagguaggggaguaaaaaggaggucaggcaaaagggaggaguuuucuguccu

SEQ ID NO: 45514 - RNA, 64 nt, Human
cgcugugacuugggucucagugcuaggguauugagucaggcagcuggaggguuguggcccgagg

SEQ ID NO: 45515 - RNA, 64 nt, Human
aggcacacagcccgugccggcugaugggacgagggucaggcauccugucuguggccuucugggg

SEQ ID NO: 45516 - RNA, 64 nt, Human
uccugccucagccucccaaguagcugggauuacagucaggcaccaccacacccggcuaauuuug

SEQ ID NO: 45517 - RNA, 64 nt, Human
aaucaguuagguuccucacugcaagaaauaaaaugucaggcagugaaugaauuauauuuucaga

SEQ ID NO: 45518 - RNA, 64 nt, Human
auccagucuguguccuccugucuuucucauccaggucaggcauugacacuuuguaagaaagggg

SEQ ID NO: 45519 - RNA, 64 nt, Human
ccugagccuucuguacgugucugacacuagcacugucaggcagcuuucggcuggggcucaccca

SEQ ID NO: 45520 - RNA, 64 nt, Human
aaugugggagugaaaugguauuuagaaagcagcagucaggcacgguggcucaugccuguaaucc

SEQ ID NO: 45521 - RNA, 64 nt, Human
ccuuuguauacuuuuuuaaauacuacaaauuagugucaggcaguucccagaaagagacaagaaa

SEQ ID NO: 45522 - RNA, 64 nt, Human
cuauucacaagauaaauuccaagucuuuucaccugucaggcaugcauauuuuaauaucuguuug

SEQ ID NO: 45523 - RNA, 64 nt, Human
uuccucagagaagugaggugggaaauaugaccaggucaggcaguuggaggggcuuccccagcca

SEQ ID NO: 45524 - RNA, 64 nt, Human
gacuuuuagaugaaaaguauucuuaaaaagaaaagucaggcaccccaccuuagaccucguaugc

SEQ ID NO: 45525 - RNA, 64 nt, Human
aauuagugcucauucugagaccuaaauuuaaagggucaggcauuagaaacaaaaguguuucuuc

SEQ ID NO: 45526 - RNA, 64 nt, Human
augcgaguacacacacaccccucucucugcuuuugucaggcagugguaggacuuuggugugggu

SEQ ID NO: 45527 - RNA, 64 nt, Human
gucauggaaaugaucagauugaccuugauugacugucaggcauggcuuuguuucugguuucaau

SEQ ID NO: 45528 - RNA, 64 nt, Human
gcagggccguggggcugagccacgcucucguuuugucaggcagcuaugcaguugcucuuccuug

SEQ ID NO: 45529 - RNA, 64 nt, Human
ugggaccugacccccaauaauugguuaccagugugucaggcaaucuggacuuugcccucaaaag

SEQ ID NO: 45530 - RNA, 64 nt, Human
ggguuaugucgaggaagggaagaaagaaacagaagucaggcagaggcgugucugugcaaacugg

SEQ ID NO: 45531 - RNA, 64 nt, Human
cauuuagcacauauuuauugggcaucggugaugugucaggcacaguccuuggcacacagaauac

SEQ ID NO: 45532 - RNA, 64 nt, Human
cccacuggauucuggauacucugaggccugguuugucaggcaauaugcccuugagcaggucacc

SEQ ID NO: 45533 - RNA, 64 nt, Human
uugaacuacuggacuuucaacuggcuuuccuuaggucaggcaagcagacagcuccccacugaag

SEQ ID NO: 45534 - RNA, 64 nt, Human
ucuuugggaggccgaggcggguggaucacucaaggucaggcauuugagaccagccuggccaaca

SEQ ID NO: 45535 - RNA, 64 nt, Human
agcgccacacacugcacaucuuuuggugaucggggucaggcaaaggaggggaaacaaugaaaac

SEQ ID NO: 45536 - RNA, 64 nt, Human
uugcccaguggccuguggcgcccaaagcuggcaggucaggcaagcagccugcaccacccugcca

SEQ ID NO: 45537 - RNA, 64 nt, Human
uagaaauguuucuguuucauaucauuuggggcgagucaggcaaaaguauuugauuugacuuuau

SEQ ID NO: 45538 - RNA, 64 nt, Human
agcgagcucccccggcagcagguccccaagccaugucaggcaucuccaccacggcugggcgucu

SEQ ID NO: 45539 - RNA, 64 nt, Human
accaaugggcucaagaauaaaguaugauuuuugagucaggcacaguggcucaugucugcaaucc

SEQ ID NO: 45540 - RNA, 64 nt, Human
cagccugggccgcauucccugcaggaccucccgggucaggcagggcggcccccugcuccacaca

SEQ ID NO: 45541 - RNA, 64 nt, Human
cagccaccgccuccccuuucuuccgggcccugcugucaggcagcuuugcagaagcccagaugga

SEQ ID NO: 45542 - RNA, 64 nt, Human
cuucugagucagacgccucuggagcgagcccuaugucaggcacuccaccuggggggcccuuccc

SEQ ID NO: 45543 - RNA, 64 nt, Human
gggcaguggauggccgugaaugggugcccacagugucaggcacugggcaugagggguuccuccc

SEQ ID NO: 45544 - RNA, 64 nt, Human
ccacaaaaccaacaauuuuauuugccucuacuacgucaggcagaauucuucaauuaaguugaac

SEQ ID NO: 45545 - RNA, 64 nt, Human
guucgaggggaaaggacgauggggcaugaccucagucaggcacuggcugaacuuggagaggggg

SEQ ID NO: 45546 - RNA, 64 nt, Human
aguaacaacaagacaaccgcaacaugugggcguagucaggcaaugcugugugcgaaguaaacua

SEQ ID NO: 45547 - RNA, 64 nt, Human
agugugccuuaaugggaagcacacgggcuuuggagucaggcacaggugccagcuccagcuuuug

SEQ ID NO: 45548 - RNA, 64 nt, Human
gccaggaggggaguggcagugaggagggggccaggucaggcaccaccaucaagagagcugugug

SEQ ID NO: 45549 - RNA, 64 nt, Human
uccgugcuguucgggaauuguuuuauguacacuugucaggcagaaaagguagugaccggcccgg

SEQ ID NO: 45550 - RNA, 64 nt, Human
agagauaaagaaaaaaaaguacaaccaaaugccagucaggcacagcagaaaccuacaacucaug

SEQ ID NO: 45551 - RNA, 64 nt, Human
cgcacaccaaauuuggcaaaacagcccucagacugucaggcaagcccggguucuaccccuaaug

SEQ ID NO: 45552 - RNA, 64 nt, Human
ggcaauacaaaauauuaguaaagucacccaaagagucaggcacuggguauuguggaaauaaaac

SEQ ID NO: 45553 - RNA, 64 nt, Human
uucacuggcucuccagauuagccucucuuccucugucaggcaaagaugaggagcccguguuccc

SEQ ID NO: 45554 - RNA, 64 nt, Human
aaaagagaggugucaacagcaagggcucuuaggggucaggcaccagcauggagaccucaugaca

SEQ ID NO: 45555 - RNA, 64 nt, Human
auuaaaacaauuuuuuuuuuccucuucagaacuugucaggcauggcucagagcuugaagauuag

SEQ ID NO: 45556 - RNA, 64 nt, Human
gaauuauuuuuaauauguaaauucucucaaaagggucaggcaccuaguuauuauuuuuuaauga

SEQ ID NO: 45557 - RNA, 64 nt, Human
caguuuccagagagcaggcggggccgcccagugggucaggcacagggagccccgguccuaucuu

SEQ ID NO: 45558 - RNA, 64 nt, Human
cacgcacucccggagagcacggaaccgcacgcacgucaggcaccggcuggggaucuguggggca

SEQ ID NO: 45559 - RNA, 64 nt, Human
ugcauucagcagcuauuuaucgaguaccuacucugucaggcacugucauaggcguggggcaaag

SEQ ID NO: 45560 - RNA, 64 nt, Human
gcugaggccagaaucgugaagucacuugcucaaggucaggcagcuuaggaaggggcagaucggg

SEQ ID NO: 45561 - RNA, 64 nt, Human
cuuucaguaaauguuugcagcacauguguuacaugucaggcagugaaaccccccacagcagccu

SEQ ID NO: 45562 - RNA, 64 nt, Human
cuuugagauaauucugagccuugagaggaauguggucaggcaaccugaguccaguggaaugcag

SEQ ID NO: 45563 - RNA, 64 nt, Human
uuggggaagggaggggcugccugucucuggaggugucaggcaggcagguggcaggcagcucacc

SEQ ID NO: 45564 - RNA, 64 nt, Human
ccccugugcccuguuccccaccuaccucagcugggucaggcacagggaggggagggaucagcca

SEQ ID NO: 45565 - RNA, 64 nt, Human
agggaucacaugggggucacugcugccaucagcagucaggcagggagaacagaaaugcaaaaau

SEQ ID NO: 45566 - RNA, 64 nt, Human
augguguagacagcccucccccaaccccaggccagucaggcacaauccccccaccccccaaacg

SEQ ID NO: 45567 - RNA, 64 nt, Human
aucguguuacuccauugucagaggaggaaacggggucaggcaggaaagcaacuuaaaggagggc

SEQ ID NO: 45568 - RNA, 64 nt, Human
gacucagaugccaggaaagggacagccucccauugucaggcagaagcugcccaaagccuggaga

SEQ ID NO: 45569 - RNA, 64 nt, Human
cgcucaugggccucaguuuccuaaagugugaaaugucaggcacuucccucuaacuggcaugcaa

SEQ ID NO: 45570 - RNA, 64 nt, Human
cucacugggaggugccccgccagcccugggcagugucaggcaggacucacucaccgcugagcag

SEQ ID NO: 45571 - RNA, 64 nt, Human
ggacgacagccuuuaguuuuccugaaaucaccaggucaggcacaaggagaaaagguuccuggau

SEQ ID NO: 45572 - RNA, 64 nt, Human
ggguucccuuccccuagggcacauuacuaagggggucaggcacugcaugcucguuccagcacca

SEQ ID NO: 45573 - RNA, 64 nt, Human
acagagcagcccccacccgggagccuugaugggggucaggcagaggccagccugcacuggaguc

SEQ ID NO: 45574 - RNA, 64 nt, Human
auguugagagagacugagacaggagucuuccggagucaggcaggaaggagaagcacagcaauau

SEQ ID NO: 45575 - RNA, 64 nt, Human
aguguggguggcgcacacaccaaguagggagcuagucaggcaguuugcuuaaggaacuuuuguu

SEQ ID NO: 45576 - RNA, 64 nt, Human
auugcugggucacaggugccccucaccuuccacagucaggcagggaaguuauaggcacaaagcu

SEQ ID NO: 45577 - RNA, 64 nt, Human
cgagucccacccccucuggaggcacagcuguugcgucaggcaaggucaccugcauuuauuuauu

SEQ ID NO: 45578 - RNA, 64 nt, Human
ggucugggaacuucucugcugcaaugaaagaucugucaggcaaacauccugugucugcuuugau

SEQ ID NO: 45579 - RNA, 64 nt, Human
aggugcgucagcaauuuccugcuccucuugguuggucaggcacugaagcuccuacacaggucac

SEQ ID NO: 45580 - RNA, 64 nt, Human
cagcuguaugaaagggacgguuguggugaaguuugucaggcacaguaagcaugcugaguggcgg

SEQ ID NO: 45581 - RNA, 64 nt, Human
ccccaacucuccccugaccugugagcccagcugggucaggcagggugcaguaucaugcccugug

SEQ ID NO: 45582 - RNA, 64 nt, Human
aacaugugaauacuaccaaguuucuguccccaaagucaggcaucacuguuagucuuuugggaca

SEQ ID NO: 45583 - RNA, 64 nt, Human
uaacaccuuccauguaugucaacuuuuuaucaccgucaggcauagacucguggagauuagucau

SEQ ID NO: 45584 - RNA, 64 nt, Human
ccacucucccuuguccuccugggggcauaucucagucaggcagcggcuuccugaugauggucau

SEQ ID NO: 45585 - RNA, 64 nt, Human
agagguggaaggguacugacuggguuuguuuaaagucaggcagggcuggagugagcagccaggg

SEQ ID NO: 45586 - RNA, 64 nt, Human
cccgccugagacacgacgccugccccaggggacugucaggcacagaagcggccuccucccgugc

SEQ ID NO: 45587 - RNA, 64 nt, Human
ggguugugcccucagcagugacagcagcuuaggugucaggcaguugcugaguggcugguccaug

SEQ ID NO: 45588 - RNA, 64 nt, Human
cacaauguuauauauugacaccccagugucaucagucaggcaggagccaaacaaugaaugcccc

SEQ ID NO: 45589 - RNA, 64 nt, Human
uggcgagagccugggccagcccacagcguuccuagucaggcagccacaccuugguccucaucuu

SEQ ID NO: 45590 - RNA, 64 nt, Human
aaaaccagagacucauguuuccaggggucagucugucaggcaggaaggacccaggauuugaacc

SEQ ID NO: 45591 - RNA, 64 nt, Human
acaccgacgccgggaggccgcagaccccggacgugucaggcauccccgcaggcccggagcgaug

SEQ ID NO: 45592 - RNA, 64 nt, Human
ugaccuccauaugcuguacaugacaucaaaaugagucaggcaauugauugugaauuccuuaaag

SEQ ID NO: 45593 - RNA, 64 nt, Human
acaacuccucuuucccauagucagaguugaauuugucaggcacgccugaaaugugcucauagcc

SEQ ID NO: 45594 - RNA, 64 nt, Human
guuugccuucaucucccuccacguuugagaggcugucaggcagcagcgaaagcuuguuaggaug

SEQ ID NO: 45595 - RNA, 64 nt, Human
ggaauauauaaaguguacuaaaaacucaacugaagucaggcaugguagcucaugcuuguaaucu

SEQ ID NO: 45596 - RNA, 64 nt, Human
uuuaagcuagaccuugacaaauugguaggauuuggucaggcacuaggaguggagcaugagcucu

SEQ ID NO: 45597 - RNA, 64 nt, Human
cucccucuugauuacuuuuugacauuuuccagcugucaggcaucacugcggcuaguccggcagc

SEQ ID NO: 45598 - RNA, 64 nt, Human
cuucuugcugugagaggucucaccccgggcuaccuccugucacuacucacugcccugggguccg

SEQ ID NO: 45599 - RNA, 59 nt, Human
ccucgucauacaaugccugaucaugcugcuccugucacccuccacgauuccacagacca

SEQ ID NO: 45600 - RNA, 64 nt, Human
ggcgucugaugcucucucucugccuccccccccauccugucaggcacaggugacgggggcagcc

SEQ ID NO: 45601 - RNA, 64 nt, Human
aucaguugauucuacuucagguccuugcuuaaauuccugucacuaaauggaaauguguuugguu

SEQ ID NO: 45602 - RNA, 64 nt, Human
auuauuuuuaccuguuuuauauucacaguugguguccugucacuuuguuuuaaaauaagcuaga

SEQ ID NO: 45603 - RNA, 64 nt, Human
ggagugucaggggcccucacucucggugccuacuuccugucaggcuucugguccuuucucggua

SEQ ID NO: 45604 - RNA, 64 nt, Human
cugugauucuauuuccucccacccacuccucaaauccugucauuauuagcccuuugcuuuucug

SEQ ID NO: 45605 - RNA, 64 nt, Human
ccuuucccugcacuaacgccaaccugacugcuuuuccugucagugcuuuucucuucuuugagaa

SEQ ID NO: 45606 - RNA, 64 nt, Human
auugauucuaaggugauguucuuagcacuuuaauuccugucaaauuuuuuguucuccccuucug

SEQ ID NO: 45607 - RNA, 64 nt, Human
cuuuccccucuuugccauuccuaccuugcauuuuuccugucagugccuuagccaaggcaaggag

SEQ ID NO: 45608 - RNA, 64 nt, Human
agcccugggacccuuuccugcguaugugucuccuuccugucaccugggaauggaauggccagug

SEQ ID NO: 45609 - RNA, 64 nt, Human
ugggacuuuguuuuuuccaagaauaaacuucaacuccugucaugugucuuggcuacuuucuugg

SEQ ID NO: 45610 - RNA, 64 nt, Human
aucaauuuuuuuuuaacuguccuaucacguccucuccugucacccauuuugaagaguggcagaa

SEQ ID NO: 45611 - RNA, 64 nt, Human
caaaacuggacuuuaggaguaauuucuauugaacuccugucaauauguuuauuuccucugucua

SEQ ID NO: 45612 - RNA, 64 nt, Human
ucauaacuuuuacguuccagaauuuuguuuauuuuccugucaaugaaagcaauuuuuaaagaua

SEQ ID NO: 45613 - RNA, 64 nt, Human
acuuccuagguggugcuggguacuucuuguugcauccugucaggaggcagauaaugcuggugcc

SEQ ID NO: 45614 - RNA, 64 nt, Human
augaccggcucaaagaccucagcucugggcuguuuccugucagccuggcaggagccucaggacu

SEQ ID NO: 45615 - RNA, 64 nt, Human
uuguauacuuuccuaaaaauauucauauggggaauccugucagguguuugguuauauugacuau

SEQ ID NO: 45616 - RNA, 64 nt, Human
gaaguaagccaauaagaaccuuuuaaacaaaucguccugucacaaaaugcuuucauauggcuua

SEQ ID NO: 45617 - RNA, 64 nt, Human
caagccuuggcccggugacaccugcagcccucacuccugucaucccaggacacuugaggcccaa

SEQ ID NO: 45618 - RNA, 64 nt, Human
auggaguugugaucaucccaucuaagcugcagcuuccugucaacacuucucacaucuuaugcua

SEQ ID NO: 45619 - RNA, 64 nt, Human
uuaccguuaguaccuguguucccucaccaggccauccugucaaacgagcccauuuucuccaaag

SEQ ID NO: 45620 - RNA, 62 nt, Human
aggcauguaccauaagcuaaagaccagagccuuccugucaccccuaaccaaggcauaauuga

SEQ ID NO: 45621 - RNA, 64 nt, Human
uuguuaaaacugaaauacuggaagaagauauuuuuccugucauugaugagauauaucagaguaa

SEQ ID NO: 45622 - RNA, 64 nt, Human
gaucagcuguugccuucaagauccagauaaacuuuccugucauguguuagaacuuuauuauuau

SEQ ID NO: 45623 - RNA, 64 nt, Human
gaaacuucauaauacuuucagggaaguuaucuuuuccugucaaucuguuuaaaauaugcuauag

SEQ ID NO: 45624 - RNA, 64 nt, Human
ccugccacagccagaacgugccucaggaggcaccuccugucauuuuuguccugaugauguuucu

SEQ ID NO: 45625 - RNA, 64 nt, Human
ccaggccacaagaguggacgugaaccacaggguguccugucagaggagcccaucucccaucucc

SEQ ID NO: 45626 - RNA, 64 nt, Human
agcuccuuucugucagggugggggguucagccuguccugucaccucugaggugccugcuggcau

SEQ ID NO: 45627 - RNA, 64 nt, Human
uauuuaucccuccuuuccccacagcagcuuucuuuccugucaacuagaaaggagcaggauguaa

SEQ ID NO: 45628 - RNA, 64 nt, Human
auuaaugaaugcuuacuaugugccagguacuacauccugucauuuaaucuuaaccuagucuggg

SEQ ID NO: 45629 - RNA, 64 nt, Human
gaaguuuauuauauaaccaagguuucagguauccuccugucaccaccucuacuauucaggaggc

SEQ ID NO: 45630 - RNA, 64 nt, Human
cacauugccucucccacugcuuuggggagcacuuuccugucauuucuaacuuaccacaugcuug

SEQ ID NO: 45631 - RNA, 64 nt, Human
aacccuuccguggucugcuuucauuccgugugcuuccugucacagguaauggaaaacauaagua

SEQ ID NO: 45632 - RNA, 64 nt, Human
cugguuguauguguaggcuaagaaggaaggacccuccugucagugugcaaagcuguaaucucau

SEQ ID NO: 45633 - RNA, 64 nt, Human
ggagaaaggggaggugaaagauugaagagcagguuccugucaauguucugaguucgagcuggag

SEQ ID NO: 45634 - RNA, 64 nt, Human
ccccaucucuacaaaaauacaaauuaacugggcauccugucaugcgccugucaucccagcuacu

SEQ ID NO: 45635 - RNA, 64 nt, Human
agggcagaaagcccaaugugucauuguuuacuuguccugucacuggaucugggcuaaaguccuc

SEQ ID NO: 45636 - RNA, 64 nt, Human
gggagcaguguauguuacuuuacauagcagcgguuccugucauguguucaugucagaauauuuu

SEQ ID NO: 45637 - RNA, 64 nt, Human
ugcuaguuggucaacccugccugcauacaugggcuccugucauggggcccagagucccuugcag

SEQ ID NO: 45638 - RNA, 64 nt, Human
guccucucauuugcagucagcgccagcacuguauuccugucauugcgaguauguauccaccaac

SEQ ID NO: 45639 - RNA, 64 nt, Human
uuaugagcucagccucgcuuugagguacccaccguccugucagcuccuugaccuaugagccggg

SEQ ID NO: 45640 - RNA, 64 nt, Human
ucauaacguuuucaaggaaauucuaggcaaucauuccugucaccaaagaacuaaaauuuugguu

SEQ ID NO: 45641 - RNA, 64 nt, Human
uugaggaaaauaaaauugcuugcuucuauguaauuccugucauuccacaggaaauucacuuuuc

SEQ ID NO: 45642 - RNA, 64 nt, Human
guaagcuuugauguucugguuacuucuaguaaauuccugucaaaaucaauucagaaauucuaac

SEQ ID NO: 45643 - RNA, 64 nt, Human
cuaaauaccaguaugguggacugaauucuggacguccugucacuccaccucgaacagcuaaucc

SEQ ID NO: 45644 - RNA, 64 nt, Human
gugcaucccccagcacugauguuguuacugauucuccugucagagaucugggaggucuccacug

SEQ ID NO: 45645 - RNA, 64 nt, Human
agaguggcaggcgggaccggccccauggucuggcuccugucaccuggguccgugccagcacaau

SEQ ID NO: 45646 - RNA, 64 nt, Human
caaagggcagccccaacaugugcaccccugcauuuccugucaugccacagacuggcccuugagg

SEQ ID NO: 45647 - RNA, 64 nt, Human
cagcuaaggguuuuacaggaaguagauuaauugauccugucaccaaccauaugaaguaggcacu

SEQ ID NO: 45648 - RNA, 64 nt, Human
cccagcaugcuaccugaauggcgguuuuuauccauccugucacccugagcaucugucucaaccu

SEQ ID NO: 45649 - RNA, 64 nt, Human
cucuuauauaaguagaguccuugguacucugcccuccugucaguaguggcaggaucuauuggca

SEQ ID NO: 45650 - RNA, 64 nt, Human
auuguaucacaauguuaaugugccaagauauuguuccugucaugcagaguauaagaaugcuuug

SEQ ID NO: 45651 - RNA, 64 nt, Human
acccugagaagaacuacggagaaaucaaauaaaauccugucauauuuuuuucacccugccuuuc

SEQ ID NO: 45652 - RNA, 64 nt, Human
ccccgacagauuaaaugcguguuggggauugguuuccugucauagcugcugcugcugccaugcg

SEQ ID NO: 45653 - RNA, 64 nt, Human
aaugaaacucuucaccuuuaggagaccugggcaguccugucaggcagcagcgauuccgacccgc

SEQ ID NO: 45654 - RNA, 64 nt, Human
aacaaaauguagaaaaagcaaaagcucuuuucuguccugucagucuccugucuccuuuugcucu

SEQ ID NO: 45655 - RNA, 64 nt, Human
agaauuggagcagagccugagacguaucugcagauccugucaucagcuggcaaguccaggagac

SEQ ID NO: 45656 - RNA, 64 nt, Human
uauuuaauauuuuaauuauccuuguuuguauauguccugucacagaguguccucuugguguauu

SEQ ID NO: 45657 - RNA, 64 nt, Human
aacaggauuuucuaggaguuacacauacauuuuauccugucauaccucgagauaaaguggcaug

SEQ ID NO: 45658 - RNA, 64 nt, Human
gauguuuaaaaauaaaaaaaaaacugcuuuauccuccugucagcacccccucccaccccugcaa

SEQ ID NO: 45659 - RNA, 64 nt, Human
uuguuuuauugaggaauuugacuuaaacugggaauccugucauguuguuuaucuuuccagcuug

SEQ ID NO: 45660 - RNA, 64 nt, Human
cugcaccuguguccccaucugcccuucuuguugcuccugucaugugucaccaucuucccuccug

SEQ ID NO: 45661 - RNA, 64 nt, Human
gccccauccuccacagcuugccgcugacgcucucuccugucaccccgccccugcucucucccca

SEQ ID NO: 45662 - RNA, 64 nt, Human
cgccccccugcacacacacccacuuuaguacaguuccugucaauuggcaacauggagaggguga

SEQ ID NO: 45663 - RNA, 64 nt, Human
agggccgcagggcccaccuuggacccuggugaccuccugucacucacugaggccaucagggccc

SEQ ID NO: 45664 - RNA, 64 nt, Human
caccugagccccaggugaaggggcccggaacaccuccugucaccugagccccaggugaaggggc

SEQ ID NO: 45665 - RNA, 64 nt, Human
uuuauaaaauagcuccugcccaguggcucuugguuccugucaaauguggaccuguaguuuaaga

SEQ ID NO: 45666 - RNA, 64 nt, Human
gauugaugaaagugauuuuucugcuuuaccuuuuuccugucagaaagguuuuccucugugcuac

SEQ ID NO: 45667 - RNA, 64 nt, Human
acuuggaauggagaauacccaucuguaauacagguccugucauuucauucaucucaaauuauuu

SEQ ID NO: 45668 - RNA, 64 nt, Human
gggaucuccagaacacuggugguggacacagcuuuccugucagcacacaaaagaccuguuccuc

SEQ ID NO: 45669 - RNA, 64 nt, Human
uggagauggaauguggcccauugccuccucccucuccugucaaaaacccugaucagguagauuu

SEQ ID NO: 45670 - RNA, 64 nt, Human
ugccugugggcauggcuuucucuggggaccccauuccugucaguagcaacccuggcaguguccg

SEQ ID NO: 45671 - RNA, 64 nt, Human
guuauaaauauuuaguuuauggauugacucuguauccugucaucuuuucgccuaccugaucuuu

SEQ ID NO: 45672 - RNA, 64 nt, Human
agguugucaaaggucaucaagcaguguucauuuauccugucacauguuucuguuucuauaguaa

SEQ ID NO: 45673 - RNA, 64 nt, Human
aggcccagcccauccccucccucauccucgucuguccugucaccugccgcccagccccucuccu

SEQ ID NO: 45674 - RNA, 64 nt, Human
ggugagucaagcuuccugagcuucagaccguuuguccugucaucuguccugcccaacacuguau

SEQ ID NO: 45675 - RNA, 64 nt, Human
gcgaggccucuggaccuguguuccugugccaaaguccugucaggcuggugggcaccaggaaagg

SEQ ID NO: 45676 - RNA, 64 nt, Human
ucuugaggucacauuuucuccuugaaaagugacauccugucacuucugcucucacacuacugcc

SEQ ID NO: 45677 - RNA, 64 nt, Human
ugauguuauuaagucagccucuaaagcuuuaguuuccugucagucaaauguugacaugauaccu

SEQ ID NO: 45678 - RNA, 64 nt, Human
cucauggccaccaggaggccugcagauccagccuuccugucaacagcgacaggaaaucucuagg

SEQ ID NO: 45679 - RNA, 64 nt, Human
cacagacacagacacacaccgcagggcccgacccuccugucauucacagucccauggcacauag

SEQ ID NO: 45680 - RNA, 64 nt, Human
uaaguacuuuagugcaguaaaauguuguuucauguccugucaagaauucguauaguacgagccu

SEQ ID NO: 45681 - RNA, 64 nt, Human
gugauuccuccaggcucugccuggccugacccuguccugucagcuggguuuacauaccaguccc

SEQ ID NO: 45682 - RNA, 64 nt, Human
uuggcauuaauauucuaagagaauuaacuguauuuccugucaccuauucacuagugcaggaaau

SEQ ID NO: 45683 - RNA, 64 nt, Human
agagaucccaccugucagagccacagcuucgggguccugucaucacauccccugggaggggagg

SEQ ID NO: 45684 - RNA, 64 nt, Human
acauuacuauacuuaguguuguugacuuuucuuuuccugucaucuccucuuuacuggauuguac

SEQ ID NO: 45685 - RNA, 64 nt, Human
uuuacacucacaaagauauucucacuuagucaacuccugucaaaaugaaggugaacuggcaugg

SEQ ID NO: 45686 - RNA, 64 nt, Human
augcagagguacucccuggucagggacaaguguuuccugucagccaccgagugccugcagaaga

SEQ ID NO: 45687 - RNA, 64 nt, Human
cuagaccugaaaguguuccugaucagagaggccuuccugucacugccuugcaggaggcaaggga

SEQ ID NO: 45688 - RNA, 64 nt, Human
uggugugggaguaagcugacaguuucucugcagguccugucaacuuuagcaugcuaugucuuua

SEQ ID NO: 45689 - RNA, 64 nt, Human
cuacgacugggagcugacaugaccagcccacugauccugucagcagguccugcuccuguugcca

SEQ ID NO: 45690 - RNA, 64 nt, Human
gcugcacaucccugcccauccccagaaagacuguuccugucaggauuuguuucccucugcugug

SEQ ID NO: 45691 - RNA, 64 nt, Human
agaaccccuccacacuucagcucugcacccacuuuccugucauuuauuuauauaggacuguagu

SEQ ID NO: 45692 - RNA, 64 nt, Human
aaaagaguguauaugugaacuugacacuccaaacuccugucauggcacggaagcuaggagugcu

SEQ ID NO: 45693 - RNA, 64 nt, Human
gagaucuaaugugaaaaucaucacucaagaugccuccugucagaugacacaugacgccagauaa

SEQ ID NO: 45694 - RNA, 64 nt, Human
agcauaauauucugaauucauuccaaguuuaaaauccugucauucucuggcucuucuuuuuuca

SEQ ID NO: 45695 - RNA, 64 nt, Human
uugaaguggcuccacagcuccugucccuggaacauccugucaguuuggucauaaacccugagcc

SEQ ID NO: 45696 - RNA, 64 nt, Human
aagagaagaugauuccuucuaguccuguaaaauuuccugucauccuuagcugcuggguugauug

SEQ ID NO: 45697 - RNA, 64 nt, Human
ucccaauucugugauagaguaaugacaccaguuuuccugucaugacaagccucugugauguuac

SEQ ID NO: 45698 - RNA, 64 nt, Human
ccacguggcuccguugccucugcauugcgcccuguccugucauguguccucaccgggguaucgg

SEQ ID NO: 45699 - RNA, 64 nt, Human
gagcucaguuucuuuuucacuugggucucuggauuccugucauagggaagguauaucaggaggg

SEQ ID NO: 45700 - RNA, 64 nt, Human
uuaaauauuacauagaguauguuuacaacaaauauccugucagccaaaugguuacccauauaaa

SEQ ID NO: 45701 - RNA, 64 nt, Human
ccuuugagaagaaaucaguggauacuggauuugcuccugucaaugaaguuuuaaaggcuguacc

SEQ ID NO: 45702 - RNA, 64 nt, Human
ugaauauucuauuccaaugggcauuuauuuuuuauccugucauuaaaaaaaaaagacuguuauc

SEQ ID NO: 45703 - RNA, 64 nt, Human
ccugaaggauucugggaaucauguccaucccuuuuccugucaguguuuuugaaacccacaguuu

SEQ ID NO: 45704 - RNA, 64 nt, Human
aguaucaaguguucuaaaaugaaauaugagaagauccugucacaauucuuagaucuggugucca

SEQ ID NO: 45705 - RNA, 64 nt, Human
ugcucauaaauugguagcguauauaaagagaaguuccugucacauuauauucccacuagaauua

SEQ ID NO: 45706 - RNA, 64 nt, Human
acaauagaauacuaugcagccauaaaaacugaauuccugucauucaggacaacauggauggaau

SEQ ID NO: 45707 - RNA, 64 nt, Human
cuacuauuguagaguggucuauuucucccuucaauccugucaauguuugcuuuacguauuuugg

SEQ ID NO: 45708 - RNA, 64 nt, Human
gguuauagauaagagaguacaaaaugacucuuuuuccugucaauugaaauuuaaagaaaaguuu

SEQ ID NO: 45709 - RNA, 64 nt, Human
cuuguauuagcagguucuggcuagagagacuaucuccugucaucacgaucaauuaauguuuucu

SEQ ID NO: 45710 - RNA, 64 nt, Human
uucaaacagcaaaaaaguggggggcauauuguaguccugucauuuaaguuauguaaaaaauuua

SEQ ID NO: 45711 - RNA, 64 nt, Human
ucauuuucuuucaaaacuugaguggucucugagcuccugucauuaaaccuaucuauaucugucu

SEQ ID NO: 45712 - RNA, 64 nt, Human
uccggccagauacucuugagcucugugacccugcuccugucaccccaauuucuccaagccagag

SEQ ID NO: 45713 - RNA, 64 nt, Human
gcuuccuguucuaauaaaugcacggcuuuaccuuuccugucagaaauaaaccaaggcucuaaaa

SEQ ID NO: 45714 - RNA, 64 nt, Human
gccucccaccaaauguccccugcuccagucccacuccugucaccccacgcucugcacuggggag

SEQ ID NO: 45715 - RNA, 64 nt, Human
ccucaucuucucauccaccaccuucuccugcuucuccugucacauagggccucaugaaggucuu

SEQ ID NO: 45716 - RNA, 64 nt, Human
gccccuucuuggccccacccucuaccccauuccuuccugucagccccagucugucuuggcacug

SEQ ID NO: 45717 - RNA, 64 nt, Human
gugucuggccucauucuguaucaguccaguguguuccugucauaguuugugucucccaggcagg

SEQ ID NO: 45718 - RNA, 64 nt, Human
ucaggccaggucccugcuggaagcggcugcaucuuccugucagcccugguuuccauggugacug

SEQ ID NO: 45719 - RNA, 64 nt, Human
cacacauguguagcugcuucuggcugaguguguuuccugucaccaauggccuguuuggcuggac

SEQ ID NO: 45720 - RNA, 64 nt, Human
cacccagcaucuccuggccuggccugaccgggcuuccugucagccaggcugcccuuaucagcug

SEQ ID NO: 45721 - RNA, 64 nt, Human
ccaaaaaaagacaaaaauaaaaauuccuuuuuauuccugucaacuggauggaaacacaaauuuc

SEQ ID NO: 45722 - RNA, 64 nt, Human
uaagaauggucucaguguuaauacugagaaaaaguccugucaguucagaaaaaaugugaagucu

SEQ ID NO: 45723 - RNA, 64 nt, Human
guccuggauccagacaccgcucaucccgaucucuuccugucagaggaccggagaagugugagaa

SEQ ID NO: 45724 - RNA, 64 nt, Human
cucugaugcucuucuucugugucucuauuucucuuccugucacuuaaucuuuuccuucucuauc

SEQ ID NO: 45725 - RNA, 64 nt, Human
ucuugccuucucagggugaagaggucagcuguccuccugucaucuuccccacccuguccccagc

SEQ ID NO: 45726 - RNA, 64 nt, Human
uagugcucaggacccuucaccaucaggaauuccuuccugucaucuaaccucaguccugccuacu

SEQ ID NO: 45727 - RNA, 64 nt, Human
guggauuuuauauaggauggaacaggaagguauguccugucaguaucuuaacccuuucaacaag

SEQ ID NO: 45728 - RNA, 64 nt, Human
agggcucagaagcccucuuuucagaggcaaugauuccugucaguaugaggucccuuaguuacua

SEQ ID NO: 45729 - RNA, 64 nt, Human
cccucuggcuaaaacucaagcaaauaaagccgcuuccugucauuaagcaucucagaggaagcag

SEQ ID NO: 45730 - RNA, 64 nt, Human
gaucacccaugauucuguuucacuguuugcuuucuccugucaugguuaagagaaaugugcaauu

SEQ ID NO: 45731 - RNA, 64 nt, Human
gucuacgggugccagaucaguagggccugugauuuccugucaguguccucagcuaaugugaaca

SEQ ID NO: 45732 - RNA, 64 nt, Human
guaaaaccaagcaaaugggggaaaaguuagucaauccugucauauaauaaaaaaauuagugagu

SEQ ID NO: 45733 - RNA, 64 nt, Human
cauuuugugaaagagaacaaauuguccaguggccuccugucagaucaacaauuauuauacuccu

SEQ ID NO: 45734 - RNA, 64 nt, Human
cucucaaaauaccucggcuugacauuuggacagauccugucauuguuuaagcugagcaaaaaac

SEQ ID NO: 45735 - RNA, 64 nt, Human
gguaccuuuuuaagaucaggauuuuauuaugaauuccugucacuuucuguuuuccauuuaaauu

SEQ ID NO: 45736 - RNA, 64 nt, Human
uauauuuuuauaacuccuuucaguccucuggggcuccugucauugagggaagucguuacgccuu

SEQ ID NO: 45737 - RNA, 64 nt, Human
uccucggacucgguucuuuccuguccccuggccguccugucaucccugugugcugcagcaucac

SEQ ID NO: 45738 - RNA, 64 nt, Human
cgccaggcacaaggcaucuuguugccuugccacguccugucacagcuggguauccuuaccaugu

SEQ ID NO: 45739 - RNA, 64 nt, Human
gucuuucccucuagguccugugccucaucacugcuccugucaccaugauucuguccagccagca

SEQ ID NO: 45740 - RNA, 64 nt, Human
aggcggggcaggaaaaaggaugagguaaguuuguuccugucaauugggaacccccucaaccacu

SEQ ID NO: 45741 - RNA, 64 nt, Human
ccucagcaccuucaccuucccucccaguguagccuccugucagugggggcuggacccuucuaau

SEQ ID NO: 45742 - RNA, 64 nt, Human
cauugagaaaauuuacacagacucugaauccaguuccugucaucuucagauguugguuuauuga

SEQ ID NO: 45743 - RNA, 64 nt, Human
ugcaaaggaagcuuuuuuuguauucauuuuggacuccugucaauaaaaauagaaguuuguugac

SEQ ID NO: 45744 - RNA, 64 nt, Human
acagcacauuaaaacauaccuaauuucacaguauuccugucacgacagaauguuaguauucauc

SEQ ID NO: 45745 - RNA, 64 nt, Human
gggaaaaggagauggagaccugcuccccagcucuuccugucagccgguuuacaugggaacaggg

SEQ ID NO: 45746 - RNA, 64 nt, Human
cggccugcagagcaccuguccuaaggagggaaaauccugucacacugccucuccccauucgugu

SEQ ID NO: 45747 - RNA, 64 nt, Human
augaccucauuuauaaacacuaaauucugucaccuccugucauuuuauuuuuuauucauucaaa

SEQ ID NO: 45748 - RNA, 64 nt, Human
aguguacaugcucaacaaauccuaggcccugcauuccugucauccucauccgggggaaacacca

SEQ ID NO: 45749 - RNA, 64 nt, Human
gagcgguuuaccaucgagcuuacccgggcccggcuccugucaagcacuuuaguuagcuguuggu

SEQ ID NO: 45750 - RNA, 64 nt, Human
uaaguaauggcacuaugaggauuuuuuuuuucuuuccugucagcagcaguucugugaaugcauc

SEQ ID NO: 45751 - RNA, 64 nt, Human
auuuuuaauuuuuaauggaauguagcuuuuaaaauccugucacuggcaucaacaaaaggaauua

SEQ ID NO: 45752 - RNA, 64 nt, Human
gccacggaccaauggccugcagccgugacaacacuccugucauauuggaguccaaaacuugaau

SEQ ID NO: 45753 - RNA, 64 nt, Human
uaaugguuuaaaaacaucaggggcuuccuguaucuccugucaggaagccgaggaauaagcaggc

SEQ ID NO: 45754 - RNA, 64 nt, Human
gcccagccguguauuuauuuuucaccuaucuccuuccugucaaggcaggccgggcuccagggcu

SEQ ID NO: 45755 - RNA, 64 nt, Human
gccccaccguaaagcucugugugucccagggucuuccugucacccaggcuggaguacaguagcg

SEQ ID NO: 45756 - RNA, 64 nt, Human
ugugcagguaaccacccugcacuucagguaauguuccugucacagcugucgacuaccccacgcu

SEQ ID NO: 45757 - RNA, 64 nt, Human
uuuguuuuagaacugaaggcaauuuaaucaaaauuccugucaagaaaagcugcuuauaaaugua

SEQ ID NO: 45758 - RNA, 64 nt, Human
ccuccuuugcuuggcccuuuauugagauaaguuuuccugucaagaaagcagaaaccaucucauu

SEQ ID NO: 45759 - RNA, 64 nt, Human
ucccccauucuuaggccacacuggugucacaagcuccugucagggagcugggguuugggaaugu

SEQ ID NO: 45760 - RNA, 64 nt, Human
ugaggguauaaaguguaaccaucaguuaaaccucuccugucauuccuggcuuccuugcuucaga

SEQ ID NO: 45761 - RNA, 64 nt, Human
ugugccgggaggcagccacagggaagcucacacauccugucagugucaccuugguuugcaaaac

SEQ ID NO: 45762 - RNA, 64 nt, Human
aggaaggagucccagcaggagcacagcccugguuuccugucacucagagcugauucacaggagg

SEQ ID NO: 45763 - RNA, 64 nt, Human
gaaaagaaauuacugaacuauugucaaauggacuuccugucauuuguuggccauucacgcacac

SEQ ID NO: 45764 - RNA, 64 nt, Human
cacauuuuaucauagcagagacaucuguaugcauuccugucauuacccauuguaacagagccac

SEQ ID NO: 45765 - RNA, 64 nt, Human
ggaccugcagguguaagcauagaugaaauaacuguccugucacaugugcagcaggccauggagu

SEQ ID NO: 45766 - RNA, 64 nt, Human
uuauuuuuaauaaaauaggauuauaccacacacauccugucacuugcuuuuuugcuuaagagua

SEQ ID NO: 45767 - RNA, 64 nt, Human
aguggcagccacaggcauucaguuugugggcauuuccugucauuucggauccugcuauagggaa

SEQ ID NO: 45768 - RNA, 64 nt, Human
ugcauuacucccuaugugcguauuuucucuuucuuccugucacccugaggaagguucauugcca

SEQ ID NO: 45769 - RNA, 64 nt, Human
ggcucgggugcccaggacggucugugcccgagguuccugucaauacagguuuuauuuuaucacu

SEQ ID NO: 45770 - RNA, 64 nt, Human
uccuuuucucuguuggauuagcuuaaucaccaaguccugucaacuucugaaaugaaucucaaau

SEQ ID NO: 45771 - RNA, 64 nt, Human
gaauagaguaugguugauucccagcauucagugguccugucaagcaaccuaacaggcuaguucu

SEQ ID NO: 45772 - RNA, 64 nt, Human
ggaaaagugaaacaucucauucaguuggugaucuuccugucaugaaaguugcuugacagcucua

SEQ ID NO: 45773 - RNA, 64 nt, Human
cuuccauguucugggugauggaaacugccaaaccuccugucagugaggacucuuuccgacugcc

SEQ ID NO: 45774 - RNA, 64 nt, Human
cgcccagugacgcccaccggcucccuccgcucccuccugucaccuaccagggcagaccccacua

SEQ ID NO: 45775 - RNA, 64 nt, Human
gccccuuggagccuuggucugcagggucccuccuuccugucaugcucccuccagcccaugaccc

SEQ ID NO: 45776 - RNA, 64 nt, Human
agcagaggaggagguuguuggcagggacugcagauccugucagaccuggccaccaccuugggca

SEQ ID NO: 45777 - RNA, 64 nt, Human
ccggcucccagcuccuggccagccugcccugcgguccugucaccuggaggccagccucacaugc

SEQ ID NO: 45778 - RNA, 64 nt, Human
gccgagucccaggggccgcacggagggcacagucuccugucaggcucggagaggucaggagacc

SEQ ID NO: 45779 - RNA, 64 nt, Human
gugucucuguuggaccugucucuccucagucuauuccugucauagaugugggugucccugguag

SEQ ID NO: 45780 - RNA, 64 nt, Human
ggccccaacuguggcaucauccucucagcagucuuccugucacccgccuggcaggcagaaggag

SEQ ID NO: 45781 - RNA, 64 nt, Human
ucacauuuauucccaaaucggaaugcuuuguuuuuccugucaguuaauugccaguugccaacaa

SEQ ID NO: 45782 - RNA, 64 nt, Human
agaaacccaggccagcugggcucuaagccuggcauccugucaugcuuaguccuucagcugaaga

SEQ ID NO: 45783 - RNA, 64 nt, Human
cugcaggcugaccugaaccucaggggguagcugauccugucauucuggucaccaaacaggaggg

SEQ ID NO: 45784 - RNA, 64 nt, Human
uccccuggguucugccgucuugccucacuuccccuccugucacaugcugacguuggacuuagca

SEQ ID NO: 45785 - RNA, 64 nt, Human
uuuaagaguauuuuuuagguuuucacucaaucuuuccugucacaguaacgugaaaacugauuau

SEQ ID NO: 45786 - RNA, 64 nt, Human
cauauaucagauuuggccaacugaauggcgucuguccugucauccauauggugccuggaaauau

SEQ ID NO: 45787 - RNA, 64 nt, Human
cuguucccucauucuacccucuuuuuccugcuaauccugucauaaugaauguagcuucucaguu

SEQ ID NO: 45788 - RNA, 64 nt, Human
ccuaaugggauaucggugaucacugguccacccuuccugucagggcuuuucuggggcugcucuu

SEQ ID NO: 45789 - RNA, 64 nt, Human
gaugaguugagacccugaaucccugggcuguuguuccugucaccccuaauuaauaugugagaga

SEQ ID NO: 45790 - RNA, 64 nt, Human
ugguuuaucauuggcaagaggcaaguugacuucauccugucauuccagccuggggucugccagc

SEQ ID NO: 45791 - RNA, 64 nt, Human
ggggguuuauuagaaugcucaguguagaggacauuccugucauccaugccaacuaccuaacucg

SEQ ID NO: 45792 - RNA, 64 nt, Human
ucagggcaaagccaggucccucucauuuagccuguccugucaucaucauggccagcuggaggca

SEQ ID NO: 45793 - RNA, 64 nt, Human
ucagguagagggagcagaguggugaccugauagcuccugucaucguguuaguuuuugauucuau

SEQ ID NO: 45794 - RNA, 64 nt, Human
cccaggagaaauguuuccagacaacuccccaugauccugucacacagcauuauaaccacaaauc

SEQ ID NO: 45795 - RNA, 64 nt, Human
augcuguauuauauauaggaaaaaaugcuuaaaauccugucauuuagaacagugaaaaguaucu

SEQ ID NO: 45796 - RNA, 64 nt, Human
ucacgaccucaaacuggcuccuaaucuccagcuuuccugucauugaaagcuucggaaguuuacu

SEQ ID NO: 45797 - RNA, 64 nt, Human
gcucgugggacuccacauccuccagcccccacaauccugucaggggcucccugacaguccuggg

SEQ ID NO: 45798 - RNA, 64 nt, Human
uguuggccaugugugcuuucaguguaaccaagauuccugucaaucccaucugcagggaacucug

SEQ ID NO: 45799 - RNA, 64 nt, Human
gaacagggucccuggaucaggguuguucugggaguccugucagcuuccccaggagcucucugcu

SEQ ID NO: 45800 - RNA, 64 nt, Human
gugcacaggaagagcaccagccgcugagucaggauccugucaguuccaugagcuauuccucuuu

SEQ ID NO: 45801 - RNA, 64 nt, Human
gcuuccugacugacacaggccagccccaucuugguccugucacccuggccccaacuauuaaagu

SEQ ID NO: 45802 - RNA, 64 nt, Human
auaaauaagauccucacuuuggcagugcuuccucuccugucaauuccaggcucuuuccauaacc

SEQ ID NO: 45803 - RNA, 64 nt, Human
augggaagauacuuauuuuucugagguccuuauguccugucauauaauuaaagacucaagagaa

SEQ ID NO: 45804 - RNA, 64 nt, Human
ugugguuguaaaugguccuauuucacccccuucuuccugucacaugacccccccccauguuuua

SEQ ID NO: 45805 - RNA, 64 nt, Human
cgggccuuuggcuuugcauccuggacggggaguguccugucagggaccagauguguccugccuc

SEQ ID NO: 45806 - RNA, 64 nt, Human
cccccgcccaggcuggccagccccacagcccacguccugucagugccgccgccucgcccaccgc

SEQ ID NO: 45807 - RNA, 64 nt, Human
ugccugcucugcugugagccgccaggaacccuccuccugucaauggggguguaguauuuuugcc

SEQ ID NO: 45808 - RNA, 64 nt, Human
ucgccuggaucaccuucuuugagccuuagccaucuccugucagguaggaaugaacuugccagcc

SEQ ID NO: 45809 - RNA, 64 nt, Human
accuuccaacacuccauuauuccucucaccccacuccugucagaguugacuuuccucccauuuu

SEQ ID NO: 45810 - RNA, 64 nt, Human
ggggucaauguauuaaaccugugauugguuguuuuccugucauuuugagagacuaaaugugggg

SEQ ID NO: 45811 - RNA, 64 nt, Human
ggcucggugugaggggugcagccucccuaagaccuccugucacuggcuucagugaacacagaca

SEQ ID NO: 45812 - RNA, 64 nt, Human
uccacggcuggauaccugugugucuccauaaaaguccugucaccaaggacguuaaaggcauuuu

SEQ ID NO: 45813 - RNA, 64 nt, Human
ucggccucuacuuuguccccucaccuccacccccuccugucaccggccuugugacauucacuca

SEQ ID NO: 45814 - RNA, 64 nt, Human
acagagcgcacgugcacauaccucugcuagaaacuccugucaaggcagcgagagcugaugcacu

SEQ ID NO: 45815 - RNA, 64 nt, Human
cacuguccccccaccuguguggccacaccauauguccugucaauccagaacugccucugagcuc

SEQ ID NO: 45816 - RNA, 64 nt, Human
ccuguggugugaggugcccugcaccugcuccugcuccugucaccccuuccugcugccuccucca

SEQ ID NO: 45817 - RNA, 64 nt, Human
cauuuaucauuaaugcaagaauaaagacaauuccuccugucaguugcgugaauuuuuuuuaaga

SEQ ID NO: 45818 - RNA, 63 nt, Human
acaagcgacaaaagcaauaacugaaaaagacuguccugucagcgaugacuuuauacaucaagg

SEQ ID NO: 45819 - RNA, 64 nt, Human
gaccagaaaaaucucucucaucgaguaaacaggcuccugucacugagcuaaucugccuugguuc

SEQ ID NO: 45820 - RNA, 64 nt, Human
ugggccgagccucuaccugaagcaacucugcucuuccugucagucucaaagcacaaggagguuc

SEQ ID NO: 45821 - RNA, 64 nt, Human
ugggaggcuuuuucuuauuaaagguugggauugguccugucaugugguuuuagagauacuaaca

SEQ ID NO: 45822 - RNA, 64 nt, Human
augccaggagucacuggacauguucauccuagaauccugucacacuacagucauuucuuuuccu

SEQ ID NO: 45823 - RNA, 64 nt, Human
ggucagauugcaaugucagcaguuacugccacacuccugucagcuuaaacacaaauguuacugc

SEQ ID NO: 45824 - RNA, 64 nt, Human
gcauuauugguagguucuaaaguuuucuagacuuuccugucaauuguaaguaauugugauauau

SEQ ID NO: 45825 - RNA, 64 nt, Human
ggccuccuugccuuucucauucuuuugcccugcauccugucauuucuguucuugucccucauac

SEQ ID NO: 45826 - RNA, 64 nt, Human
cccaguuagggguuggagcccccauauaacaucuuccugucagaagacugauggaucuuuuuca

SEQ ID NO: 45827 - RNA, 63 nt, Human
cauaccacugcacuccagccugaacagagugagauccugucaaaaaagaaaagaaaaagaaag

SEQ ID NO: 45828 - RNA, 64 nt, Human
agccuggaggcuucccagguggcccagcgugguguccugucagcuuccucuuuaggaacccacc

SEQ ID NO: 45829 - RNA, 64 nt, Human
gagucccuucugcaccucuuauuuccuaaacccuuccugucagcugcuguuugcuggcucgucc

SEQ ID NO: 45830 - RNA, 64 nt, Human
guggccccagcuuccuaagcugccaccucuguguuccugucauagcaaauaugggaccaucacc

SEQ ID NO: 45831 - RNA, 64 nt, Human
gaccaagacucuucccaaguuagcuugucuccucuccugucacccuaagagccacugaguugug

SEQ ID NO: 45832 - RNA, 64 nt, Human
uuauuacauuauuuuuauuuuaguaucuugaugcuccugucaaaagggaaaugaggcuuuuaaa

SEQ ID NO: 45833 - RNA, 64 nt, Human
gguguaauuuaauuggugcaacaugcuuuauggcuccugucaaaauugguuuucacucauuuga

SEQ ID NO: 45834 - RNA, 64 nt, Human
agccauuaaagcagcucccugcuucaucauuaaguccugucaucccuaccagccaaucccaguc

SEQ ID NO: 45835 - RNA, 64 nt, Human
cacaucuugugcuucuuuguagcaggguaaaucguccugucaaagggaguugcuggaauaaugg

SEQ ID NO: 45836 - RNA, 64 nt, Human
cuggaccgacguccuaguggaccugaugugaaauuccugucaaacaaacaccacuuuucaaugg

SEQ ID NO: 45837 - RNA, 64 nt, Human
cucuguacauuucugccauguacuccagaacucauccugucaaucacucugucccauugucuac

SEQ ID NO: 45838 - RNA, 64 nt, Human
ugagacucagaccacaucugcaaccaaaucagcauccugucauuucgugaaugaaucucagacg

SEQ ID NO: 45839 - RNA, 64 nt, Human
aagccuuucugcacagagagcacagcagaauggcuccugucacugcauuccaauggcagcugua

SEQ ID NO: 45840 - RNA, 64 nt, Human
guuauuucuaugcucuuauuuaauguaauguuucuccugucauuuuugaaguugaguuuggagu

SEQ ID NO: 45841 - RNA, 64 nt, Human
ccuugccccgucaccucguccucauguccccuuguccugucaccucguccccacguccccucgu

SEQ ID NO: 45842 - RNA, 64 nt, Human
gucagugcuauaaaugccagagccaaccuggacuuccugucauuuucacaaucuuggggcugau

SEQ ID NO: 45843 - RNA, 64 nt, Human
uuguuuucaaagggacuuuuguaaaaucaaaucauccugucacaaggcaggaggagcugauaau

SEQ ID NO: 45844 - RNA, 64 nt, Human
agagggugggaaaaggcacaugaaaguggccagcuccugucaauuuauuugcuuacaagggaga

SEQ ID NO: 45845 - RNA, 64 nt, Human
uauaccucucccaagcccccauuguguguugaaauccugucaugaauccuugguagcucucuga

SEQ ID NO: 45846 - RNA, 64 nt, Human
ccugcuuucuuuauccucucucaccuccaaguaauccugucaucuugcuccaauuagagccgcu

SEQ ID NO: 45847 - RNA, 64 nt, Human
uucaaaaacauuucaugcaauauuagaauaaaguuccugucauuccucuaaaaaucugccugug

SEQ ID NO: 45848 - RNA, 64 nt, Human
guaagaaaaauggaacaaauuuuuaucuaaaaauuccugucaccacaagagggcaucagcugcu

SEQ ID NO: 45849 - RNA, 64 nt, Human
agcagcugcugcuuagggccgccggaagcugguguccugucauuuucucucaggaaagguuuuc

SEQ ID NO: 45850 - RNA, 64 nt, Human
gugugcgugaguguguggccccuguuuauuccccuccugucaagaaugaaguggauucaguuca

SEQ ID NO: 45851 - RNA, 64 nt, Human
gguuaagcaccucuccuuugcccuucacccugacuccugucacugucuccauccccaaauaaag

SEQ ID NO: 45852 - RNA, 64 nt, Human
cccagcucauucaggggagaacacgucgugggguuccugucacgacuaucacuugagauuauau

SEQ ID NO: 45853 - RNA, 64 nt, Human
cacuuugggccaggaagaacaaggaugaagagguuccugucauuucuuaugggguucacagaau

SEQ ID NO: 45854 - RNA, 64 nt, Human
gggacuguuccugucucagcaaccaagggauuguuccugucaaucaaugguuuauuggaaggug

SEQ ID NO: 45855 - RNA, 64 nt, Human
ggggcccuguagacgucgcuauuuuugguacgauuccugucaucccuauugcagagucgugucc

SEQ ID NO: 45856 - RNA, 64 nt, Human
cgcuguuaauaaauauuguuucauucuucucucuuccugucaccuucugccaagacauugaugg

SEQ ID NO: 45857 - RNA, 64 nt, Human
gguccccuaucuuucuagaaccaguauguggcauuccugucaaauggccugcccaugaagcccu

SEQ ID NO: 45858 - RNA, 64 nt, Human
acuguuacuuuuauauagaacccaaggaaugccuuccugucauauuuuagccaaaacaacuggu

SEQ ID NO: 45859 - RNA, 64 nt, Human
gcaacaugaaauggacaaaccaaucugcuuaagauccugucauaguuuuagaucauugguuauc

SEQ ID NO: 45860 - RNA, 64 nt, Human
ucagcuacaacccaaagagagaaagauugagucuuccugucaccauaggcaauaccuuuuuucu

SEQ ID NO: 45861 - RNA, 64 nt, Human
aaucucccuuuguuuuucaggccauucaccugccuccugucaguaguggccuguauuagagauc

SEQ ID NO: 45862 - RNA, 64 nt, Human
ggauguggggacucuggccucuccagacuaauguuccugucaccugcugagcuuucccaguguc

SEQ ID NO: 45863 - RNA, 64 nt, Human
gauguaucugggucuccucuggagcacucugcccuccugucacccaguagaguaaauaaacuuc

SEQ ID NO: 45864 - RNA, 64 nt, Human
acaaccccacuguacagcagaucgugcagcugucuccugucaugcaggacaccuaggagcaccc

SEQ ID NO: 45865 - RNA, 64 nt, Human
aaaacccagaauaguugguaugucagcuagucauuccugucauauucccaguagaaugauuuuc

SEQ ID NO: 45866 - RNA, 64 nt, Human
ggagugccauuuuuagaaaagacacaacuuuaauuccugucaagagaccuaggucuacugaugg

SEQ ID NO: 45867 - RNA, 64 nt, Human
ucugcuguugaaccugggcacuaccuguuacagauccugucaggcuguugaacuggagguguac

SEQ ID NO: 45868 - RNA, 64 nt, Human
gcaugugcaauaugccaagauuacccucggucauuccugucaacaaggggucaaugucauaaau

SEQ ID NO: 45869 - RNA, 64 nt, Human
acagaauaauacaauauuaaguccaaauccaaccuccugucaguggagcaguuauguuuuauac

SEQ ID NO: 45870 - RNA, 64 nt, Human
gguuauuaagacuuguguauuuucuuucuuugcuuccugucaccccaggggcuccugaguauag

SEQ ID NO: 45871 - RNA, 64 nt, Human
ggcggcugcaguuucagaggccagagccuggcccuccugucaucugcugacuucacagaaggcc

SEQ ID NO: 45872 - RNA, 64 nt, Human
uugggugcagcuuugggacagaugaguggcucuguccugucacugcccucucccugccuggggg

SEQ ID NO: 45873 - RNA, 64 nt, Human
cucugcggauaaauauuugccacgaaugaguaacuccugucaccacucugaagguccagacaga

SEQ ID NO: 45874 - RNA, 64 nt, Human
ggugaggagaagcagagagcuugucauaugcaaguccugucaagaaaacaggugggcauggugg

SEQ ID NO: 45875 - RNA, 64 nt, Human
uaccccgcuucugacugccuagggcgagugggcauccugucaucaucuccacugucccaagcag

SEQ ID NO: 45876 - RNA, 64 nt, Human
guagagccccucgugcaaugcaaugaauggacccuccugucacucugcugaacagaauuuauuu

SEQ ID NO: 45877 - RNA, 64 nt, Human
aaugugggucaccauuuuggucagaagcauacauuccugucagacaacuaguugucugacagaa

SEQ ID NO: 45878 - RNA, 64 nt, Human
guucucuggguuagguagggacucugcaguuucuuccugucaaaaucucuccuaccaagauggu

SEQ ID NO: 45879 - RNA, 64 nt, Human
ugcaucugggcccucuacugauuguuaaaggaguuccugucaccugcuccccccacccccgcau

SEQ ID NO: 45880 - RNA, 64 nt, Human
accccucguacugccgggcauuuauuauacuacuuccugucauaaccuucuaacuuguuucuug

SEQ ID NO: 45881 - RNA, 64 nt, Human
ugcacacgauccggagagccgaaggccgcgugcuuccugucacaugggcuguaaucauuuguag

SEQ ID NO: 45882 - RNA, 64 nt, Human
guccagggcaccuccccccauuagcuguaagguuuccugucaggugugacugucaguuugcugg

SEQ ID NO: 45883 - RNA, 64 nt, Human
ccucaucacuggauuugccaacuagaauucgauuuccugucauaggaagcuccuuggaagaagg

SEQ ID NO: 45884 - RNA, 64 nt, Human
accagugaauuccguguugcucuugugaggccuuuccugucaugacccagugugcuuaagaacc

SEQ ID NO: 45885 - RNA, 64 nt, Human; identical to SEQ ID NO: 45876

SEQ ID NO: 45886 - RNA, 64 nt, Human
uguggugcauguuuuuaacuucagggaagcgguauccugucacugggguaugggaugagcaugg

SEQ ID NO: 45887 - RNA, 64 nt, Human
cugcccaccugccuuuaagagacuccagggcugcuccugucaugcagcgaagguuuugucuguu

SEQ ID NO: 45888 - RNA, 64 nt, Human
ccugucauuuaucagcaaaagauugggaauuuucuccugucaacuucuuuuguauuaggcugug

SEQ ID NO: 45889 - RNA, 64 nt, Human
cacaccugagacagacauuucaacaaugauacaguccugucauuuaucagcaaaagauugggaa

SEQ ID NO: 45890 - RNA, 64 nt, Human
uugcaaaagcacuuuuguaguaacaacuauuggguccugucagaccuccacggacagcaaagug

SEQ ID NO: 45891 - RNA, 64 nt, Human
cguuuguacauacagaugaggacagaacuguauuuccugucaccucaggagaaucgccccagcc

SEQ ID NO: 45892 - RNA, 64 nt, Human
aagauugguguucguuuccaucaugucuguauacuccugucaccuagaacgugcauccuuguaa

SEQ ID NO: 45893 - RNA, 64 nt, Human
cugaggcucagaaagguugaggauaagcccacuuuccugucauuaguggcagccccagauccag

SEQ ID NO: 45894 - RNA, 64 nt, Human
ggcauauuaagaucaucccagagguucaggcaguuccugucaucucugaaaagacugggggaua

SEQ ID NO: 45895 - RNA, 64 nt, Human
ccuagacccuccccaaggaugaccacacccgaaguccugucacugagcacagucaggggcuggg

SEQ ID NO: 45896 - RNA, 64 nt, Human
uaggguuuagaagaacagcauucaaaauuccccguccugucaguguuugccuucgcaccuccuc

SEQ ID NO: 45897 - RNA, 64 nt, Human
gccccaaaauaaaaacagaaauuaugagauugccuccugucauuuugguuaacccaguccuuca

SEQ ID NO: 45898 - RNA, 64 nt, Human
acuuaggccugaaugucuugcauggagagaaaucuccugucagugugguccagcagcagggagg

SEQ ID NO: 45899 - RNA, 64 nt, Human
uuuugagauuucccuugcccuguggacgcccagcuccugucauccuuccuuagguccugcagua

SEQ ID NO: 45900 - RNA, 64 nt, Human
ugucuuaaaaaguagcagcaacuggccccacaacuccugucauuguaaguuauucugccaccac

SEQ ID NO: 45901 - RNA, 64 nt, Human
cuuccugggugaagguugauuuguaccuucugaauccugucacguguagacaugggaaacugac

SEQ ID NO: 45902 - RNA, 64 nt, Human
uccacaguugagagguuggagcaggaugagggaauccugucaccaucaauaaucacuuguggag

SEQ ID NO: 45903 - RNA, 64 nt, Human
acaggugucugccuagauccacguguggccuccguccugucacugauggaagguuugcggauga

SEQ ID NO: 45904 - RNA, 64 nt, Human
gacgugccucagaggcuuugcccgaauugcuucguccugucacccccaucaccaauuuugaggg

SEQ ID NO: 45905 - RNA, 64 nt, Human
gacucgaucagcuguucauccauuucguguuuuuuccugucaaacauuaauccagcaaauauau

SEQ ID NO: 45906 - RNA, 64 nt, Human
aacagguccucccaagggccucugccuucauuucuccugucaccuuccggggagcugggacuuc

SEQ ID NO: 45907 - RNA, 64 nt, Human
cucuugcauuuuuggguaaauggagacuuccggauccugucagggugucccccaugccuggaag

SEQ ID NO: 45908 - RNA, 64 nt, Human
uuuucugugggaugggccugggcacgcggcccucuccugucagugccggcccacccaccagcag

SEQ ID NO: 45909 - RNA, 64 nt, Human
uaaauggugucagugagguggggaaaggaagucuuccugucacauaugcagguucguuuucauu

SEQ ID NO: 45910 - RNA, 64 nt, Human
gaggcacgcacacaugcucugcaggauguggccauccugucaccagguaguuuuucccugccag

SEQ ID NO: 45911 - RNA, 64 nt, Human
ggaaccauacaucaucuaugcuuuguaguaugacuccugucacucaguacaauuauuuugagau

SEQ ID NO: 45912 - RNA, 64 nt, Human
aacaauaaugguacuaauaaaaacuccuaggguuuccugucagauuuaauucuacccaguggca

SEQ ID NO: 45913 - RNA, 64 nt, Human
gagaaaauuuguggccaaugaagucugaaauacuuccugucaucugccccuuuccagaaaaacu

SEQ ID NO: 45914 - RNA, 64 nt, Human
accucccagugcuuccacgucuccaaaagcgccuuccugucacccucgucuaucccugcgccug

SEQ ID NO: 45915 - RNA, 64 nt, Human
caggcuaggccaauugccuuuugcacuuccccguuccugucacauuuccccagccccaccuucc

SEQ ID NO: 45916 - RNA, 64 nt, Human
guaaaaggugccaggaggagcauggguguggaaguccugucagccaagaaauaaaaguuuaccu

SEQ ID NO: 45917 - RNA, 64 nt, Human
cuacgguuuuuaaguuauuacaccccgacccuccuccugucagcccccucaccugcagccuguu

SEQ ID NO: 45918 - RNA, 64 nt, Human
guguggccugguguggccugugugucggauuccuuccugucagcugugacccauuugaccugug

SEQ ID NO: 45919 - RNA, 64 nt, Human
ccccauggccagcccagccuggcucuguucucuguccugucaccccauccccacuccccuggug

SEQ ID NO: 45920 - RNA, 64 nt, Human
uuuuauuucuuuuuuauuuuuugaagagguuauguccugucagggaaccagccccgauauucac

SEQ ID NO: 45921 - RNA, 64 nt, Human
gugguuaucuccaagcucagggcaaucccuucccuccugucaacugcuccccgacuccugcaug

SEQ ID NO: 45922 - RNA, 64 nt, Human
ugaucagcaggaugcugaggaaccauguugccuuuccugucaaucacagccaccuuccuguuau

SEQ ID NO: 45923 - RNA, 64 nt, Human
ccccaacaaggggacaggacggucacugugccaauccugucaucacccuccuguggauguacag

SEQ ID NO: 45924 - RNA, 64 nt, Human
gaagaucuguagacauaauaaauguagaaaugccuccugucaccucucagaaauuauuaaacau

SEQ ID NO: 45925 - RNA, 64 nt, Human
uguguugcugagcccguccugacaucuguguucuuccugucagcuccacgcccgggccccugga

SEQ ID NO: 45926 - RNA, 64 nt, Human
gccaggcucugccuggaggaucccuccauccggcuccugucauccccuacacuuuggccaagca

SEQ ID NO: 45927 - RNA, 64 nt, Human
uuuuuuuccuauagaugucucagauguucaguuuuccugucacaaggcuuccagucuguauuag

SEQ ID NO: 45928 - RNA, 64 nt, Human
ccacaauaaaaguugagaaauguaccggcuuccauccugucaccaugacuuccucacauggucu

SEQ ID NO: 45929 - RNA, 64 nt, Human
cuugccgugaugacgcugggcacagagggucagguccugucaagaggagcuggguguccugggu

SEQ ID NO: 45930 - RNA, 64 nt, Human
uuuuauuuuuauuuuuuuugagacagaguuucgcuccugucacccaggcuggaguacaaugaug

SEQ ID NO: 45931 - RNA, 64 nt, Human
ugaacuccaacccugccuugagggaagaccacccuccugucacccggaccucaguggaagcccg

SEQ ID NO: 45932 - RNA, 64 nt, Human
gcaaccugggcuccucccugagcgcaccggcccuuccugucacccagguccacccucaguacuc

SEQ ID NO: 45933 - RNA, 64 nt, Human
uuauaccagcaaaagugcaguagugucacuuuuuuccugucaauauauagagacuucuaaauca

SEQ ID NO: 45934 - RNA, 64 nt, Human
aaauagcuucuuuaaaaccucaaaaccaugaccauccugucaaagaccuaagucuguaagcugg

SEQ ID NO: 45935 - RNA, 64 nt, Human
ucuguccaagccaucuccuucaauaucccccccuuccugucacucccggggcugucccuguacu

SEQ ID NO: 45936 - RNA, 64 nt, Human
aguuagggagucaucucccuugauuguguucuuuuccugucaauuuucauagaccuaauuugca

SEQ ID NO: 45937 - RNA, 64 nt, Human
uuucugcgcugacugugacauuggaacguggccuuccugucacccccuccgugccacgcacuga

SEQ ID NO: 45938 - RNA, 64 nt, Human
ugaucgaccugggcacucggcauuuugacacauguccugucaaaaggccagaguccccaguguc

SEQ ID NO: 45939 - RNA, 64 nt, Human
gcucugagguaaagguccaugaacccugccccacuccugucagccccucaucagccuuuucagc

SEQ ID NO: 45940 - RNA, 64 nt, Human
agccaagauuguaaccagagagcagccaggagcuuccugucaguaaccauguuuucaauaaaua

SEQ ID NO: 45941 - RNA, 64 nt, Human
auuugaaauauauaaguugugcuauaacaaaucauccugucaaguguaaccacuguccacguag

SEQ ID NO: 45942 - RNA, 64 nt, Human
cggccaccuggagccuccacaccuaagcugcgccuccugucauuucccugcugggcucucacau

SEQ ID NO: 45943 - RNA, 64 nt, Human
gcugcccuguguccaucccuagucugucaggacuuccugucacuguuuuccaaagcuguaaacc

SEQ ID NO: 45944 - RNA, 64 nt, Human
uguauaaacucuuuuuaguucuuaacccuugccuuccugucacaggguuugcuuguugcugcua

SEQ ID NO: 45945 - RNA, 64 nt, Human
gcuguuauaaaaauuauaaaaugaucucuguuuuuccugucagagauuuaaaaaacugaaaagg

SEQ ID NO: 45946 - RNA, 64 nt, Human
cuuccuggacagcguaaggccuccacaucuaaguuccugucauuaaaauggagacagcaaagcc

SEQ ID NO: 45947 - RNA, 64 nt, Human
cuaaaauagguaaccaggcgucucacagucgccguccugucaagagcgcuaaugaacguucuca

SEQ ID NO: 45948 - RNA, 64 nt, Human
auggguuuugcuuaaagaucucaacauggaaaaauccugucauggcucugaacugcacaaugca

SEQ ID NO: 45949 - RNA, 60 nt, Human
uuguuaagcaccuacugugaguagaugaucuccugucaaagacaguuaacaaauccucgg

SEQ ID NO: 45950 - RNA, 64 nt, Human
ucugaggaaccagugaauguccuauaaaugcaccuccugucaaaaccaugccugagaggucccg

SEQ ID NO: 45951 - RNA, 64 nt, Human
aggcaguggagaucugcgucuggacacccucagauccugucauugccugcccagaguccuucag

SEQ ID NO: 45952 - RNA, 64 nt, Human
gcccgcagccucaucggggccaaggacacacgccuccugucagacacuucuagguguuggcuuc

SEQ ID NO: 45953 - RNA, 64 nt, Human
gucccacagggagcggaugaugaagcagacccccuccugucaucacccucuccugguguagugu

SEQ ID NO: 45954 - RNA, 64 nt, Human
uccucagucauuucugcaaagccaaggggcagccuccugucaagguagcuagaggccugggaaa

SEQ ID NO: 45955 - RNA, 64 nt, Human
gacacacacacacacacguacaugcacacauuuuuccugucagguuaacuuauuuguagguucu

SEQ ID NO: 45956 - RNA, 64 nt, Human
gaucccacguggcucccacgugucggggugucuguccugucauccugacugucucguuauugug

SEQ ID NO: 45957 - RNA, 64 nt, Human
aaaauaaagcaucccaucucucggcguuccagcauccugucaauuucccuuuugcucuagagga

SEQ ID NO: 45958 - RNA, 64 nt, Human
guguuuuauuaagacguccacuagaaauagcuuguccugucaacuaugaaauauggugacuaga

SEQ ID NO: 45959 - RNA, 64 nt, Human
auuucuuaugccugucuuuacuuuaaucuccuaauccugucagcugaggaggauguaugucacc

SEQ ID NO: 45960 - RNA, 64 nt, Human
ccaucccgaggcagccaggguuuguuuugcgcucuccugucacaaaugcugcacuauugguucu

SEQ ID NO: 45961 - RNA, 64 nt, Human
uggccacaggcagggcgggucugugucccauguguccugucaguccccugaguauguguguggg

SEQ ID NO: 45962 - RNA, 64 nt, Human
ucagggcacagauuaucuaaaauuagccagcucuuccugucagggaucagggcagcacuaacag

SEQ ID NO: 45963 - RNA, 64 nt, Human
aggagcuuuccugugauuucuguuucacguuccuuccugucacacccuccuuuggcgucucugu

SEQ ID NO: 45964 - RNA, 64 nt, Human
ggaggccggcaaaucccgcagcugccacggucccuccugucauucucacgacuccgggagaaac

SEQ ID NO: 45965 - RNA, 64 nt, Human
aguauccuuguagcaaagcacauagagccagcuguccugucaguuccccuguuugccucugaaa

SEQ ID NO: 45966 - RNA, 64 nt, Human
aagauuacuaggguuuugccaucagcaacaucauuccugucagagcuuucagggagggcuguuc

SEQ ID NO: 45967 - RNA, 64 nt, Human
auuccuucucgacacagcacccuaggcggcuucuuccugucagucggagguggcaugcaagaug

SEQ ID NO: 45968 - RNA, 64 nt, Human
uaaaaauauaauugaacaaauuuuuuucuuuguuuccugucauugacauuuaguauaacaguuu

SEQ ID NO: 45969 - RNA, 64 nt, Human
cgcucgcauuacagggaccucaaccuaggugcaauccugucaugugagguuucagcuucagucc

SEQ ID NO: 45970 - RNA, 64 nt, Human
cuuuuucuccucucugagccuuugucuauuguguuccugucacccacccuuucaucaucuuuuu

SEQ ID NO: 45971 - RNA, 64 nt, Human
guaggaaggggcccuagaaagggccuaguuacuauccugucaguucuaacaguaguggaacagg

SEQ ID NO: 45972 - RNA, 64 nt, Human
aaaguguccauugaaaccgugauuuuuuuuuuuuuccugucauacuuuguuaggaagggugaga

SEQ ID NO: 45973 - RNA, 64 nt, Human
ugugcugaaacuaaauuucuuuaauauuuucuauuccugucagcaccuuuucuagcagcugcca

SEQ ID NO: 45974 - RNA, 64 nt, Human
aaaauauauauugauguguuugucaccucccuacuccugucauuacauuuacuuuauuaaaagc

SEQ ID NO: 45975 - RNA, 64 nt, Human
aagauggaaaauggucagaucacaccugauggcuuccugucaaaaucugcuccaucagagcuua

SEQ ID NO: 45976 - RNA, 64 nt, Human
aaguucauguugguucugaaugguucacugcagcuccugucacaagcugggauggauuuaucac

SEQ ID NO: 45977 - RNA, 64 nt, Human
auuaauugguaugaacaugagacuagaaaaguuuuccugucaauguuaaugcuacauguuacca

SEQ ID NO: 45978 - RNA, 64 nt, Human
uuuggauuauucuuucuccuuuuuuuugacagcuuccugucaagcaaucaagaaacaaacaaaa

SEQ ID NO: 45979 - RNA, 64 nt, Human
acugcaaacucugccucccagguuuaagcgauucuccugucacagcuucccaaguagcugggau

SEQ ID NO: 45980 - RNA, 64 nt, Human
ggauuggcucccaucuuuuguuacucuugggacauccugucaucugagaaugaacaaagaccaa

SEQ ID NO: 45981 - RNA, 64 nt, Human
cucccuucugugggcuccagcagaucccuuguuuuccugucaguuggaccccucaccuggccuc

SEQ ID NO: 45982 - RNA, 64 nt, Human
auaagaaaugucuuaucuguauauguaugagucuuccugucauuguauuuggcacaugaauauu

SEQ ID NO: 45983 - RNA, 64 nt, Human
cccaagccccuggccacucuaagcugggcagacggagcacgagcaccuauucaaggcacugcag

SEQ ID NO: 45984 - RNA, 64 nt, Human
gccgacuugcuaaaggucacacacgcgcccgguggagcacgagagaccucguggcagcauguga

SEQ ID NO: 45985 - RNA, 64 nt, Human
gguguccugcuacaaaaagacaucggucaguaacgagcacgauguggaaaaaugagagaaggga

SEQ ID NO: 45986 - RNA, 64 nt, Human
uuggaagaugggcccaauuucuuaagugaugagagagcacgaaauuccauaaccaguacaggcc

SEQ ID NO: 45987 - RNA, 64 nt, Human
ugagagacggcagacugagcagaauuccuuuuuugagcacgagagcauuacuagaaccauuguc

SEQ ID NO: 45988 - RNA, 64 nt, Human
agcuugggcuguggcccugcugugaucauaccuugagcacgacgaagcaaccuuguuucugagg

SEQ ID NO: 45989 - RNA, 64 nt, Human
cuguuuccccucagaacacccuguaccauccauggagcacgaggccuucagaaaagacacuuca

SEQ ID NO: 45990 - RNA, 64 nt, Human
caagcgcaucgggagcacaccagaaaccggcccugagcacgagaagagccuccgcccggcccgg

SEQ ID NO: 45991 - RNA, 64 nt, Human
agagagagagcauguauacccguauguuaucauagagcacgauucuccaguggauggauaccug

SEQ ID NO: 45992 - RNA, 64 nt, Human
cuggggugggguagcuuucgggaaagggaauaaggagcacgaugcaagggcgcuguggcccccg

SEQ ID NO: 45993 - RNA, 64 nt, Human
caggccccagagcagcccaggccaugacccugccgagcacgaguccccccgugcagccaagaac

SEQ ID NO: 45994 - RNA, 64 nt, Human
gcccugaagccuggggccagcugggacuugaagggagcacgaguccaggauggacucagugcag

SEQ ID NO: 45995 - RNA, 64 nt, Human
gaagggaaaguucacaaccugugaacagggacuugagcacgagacacuuuucaucuggagcagg

SEQ ID NO: 45996 - RNA, 64 nt, Human
cccaaagugaagcggucacuccucucaguggaaagagcacgaggauguucucagcucuggccaa

SEQ ID NO: 45997 - RNA, 64 nt, Human
ccagucuaggcagagacagaagaauguugaauaagagcacgauuagaguccugucugguuaucu

SEQ ID NO: 45998 - RNA, 62 nt, Human
auuuggcagaacaaguuugauuuuaagaacuagagcacgagucaucuccggugauccuuaaa

SEQ ID NO: 45999 - RNA, 64 nt, Human
uugaagcaggcacuugcguggauguuucucacuugagcacgauauuuaggcucucuuccaacuc

SEQ ID NO: 46000 - RNA, 64 nt, Human
aaguugccucuuuuaggaaucucuuuggaauugggagcacgaugacucugaguuugagcuauua

SEQ ID NO: 46001 - RNA, 64 nt, Human
gggccuggaggaggagcugcggaggcuucagagcgagcacgacaggugccgccccugccacagc

SEQ ID NO: 46002 - RNA, 64 nt, Human
aaggggccuccuggauucaguccccacuggcccugagcacgacagcccuucuuacccucccagg

SEQ ID NO: 46003 - RNA, 64 nt, Human
uuggaccucuccuggcugagcucugauucccugugagcacgaugcugaugcaauaguccugugu

SEQ ID NO: 46004 - RNA, 64 nt, Human
cgcaauaacuguuugguauuugaugcagaugagagagcacgagcuaaaguaaaauaucuaacag

SEQ ID NO: 46005 - RNA, 64 nt, Human
ggcccuggaggccccugaccccaccccacccacagagcacgagggccccgucagcucagucugu

SEQ ID NO: 46006 - RNA, 64 nt, Human
ccauugccgccacuaucuguguaauaaaauccgugagcacgaggugggacgugcugguguguga

SEQ ID NO: 46007 - RNA, 64 nt, Human
ucccagucccagcaggcagaaugcccaaaaccaggagcacgaaggccugucauccauggggcca

SEQ ID NO: 46008 - RNA, 64 nt, Human
gaccccuuucguuugaguccugcuguuggugucggagcacgaggggaggcacggugcggagagc

SEQ ID NO: 46009 - RNA, 64 nt, Human
ccgugagcagacacaaaacgguggcagguuuggcgagcacgaacuagaccaagcgaagggcagc

SEQ ID NO: 46010 - RNA, 64 nt, Human
guccuucccuccacagaccccuaugccuuguuccgagcacgaagaaacagcagcagggaugucu

SEQ ID NO: 46011 - RNA, 64 nt, Human
cuauauaaaaguguuuuauaaaaacccagaauaggagcacgacgcaugauugguguuugaggcg

SEQ ID NO: 46012 - RNA, 64 nt, Human
aagugugggagaccgaggacacaguggagcccacgagcacgagcuggaacccacgaggauggcc

SEQ ID NO: 46013 - RNA, 64 nt, Human
ccaccagcgggcgccuccucccagaggcuuccaggagcacgagggccuugcggcacaggacugu

SEQ ID NO: 46014 - RNA, 64 nt, Human
ccggagcccccgccgcuccacagucccuggggccgagcacgagugaguggacacugccccgccg

SEQ ID NO: 46015 - RNA, 64 nt, Human
uugaucgugccacugcacuccagccugggggacagagcacgacccugucuccaaaaauaaaaua

SEQ ID NO: 46016 - RNA, 64 nt, Human
uguucuaaagcccuuaauuguuccaguuucuuuugagcacgaaagaauucccacuggugagaaa

SEQ ID NO: 46017 - RNA, 64 nt, Human
ggcagacccuggacccagccucagauccaggcaggagcacgaggucuggccaagguggacgggg

SEQ ID NO: 46018 - RNA, 64 nt, Human
gcgggcagugaugagcccuguucuggaguggaaagagcacgauagagcaccaggcuaagaggca

SEQ ID NO: 46019 - RNA, 64 nt, Human
cucaagagaagcucauaagugugugugggugugagagcacgauggugccuguguucugugaaug

SEQ ID NO: 46020 - RNA, 64 nt, Human
acaacauaaugaugguuaaauuaaaaaaaaaaaagagcacgacaaaccuuggaaaucaagaaag

SEQ ID NO: 46021 - RNA, 64 nt, Human
gugccccuuaucucauggaaagugccaauuuacugagcacgagauaaacagguaacugacuguu

SEQ ID NO: 46022 - RNA, 64 nt, Human
uaaccuuggcccaagaccccuuugauucucuaaggagcacgaaagggggaaugccccucccagg

SEQ ID NO: 46023 - RNA, 64 nt, Human
aagauugugccacuguauuccaacuugggugacagagcacgacucugucucaaaaaaagaaaag

SEQ ID NO: 46024 - RNA, 54 nt, Human
ugagagagggggaagagugagucugagcacgaguugcagccagggccaguggga

SEQ ID NO: 46025 - RNA, 64 nt, Human
gcuaaggcuggguaagaauaguugugcagggagggagcacgagaugggcagagcugguuccuac

SEQ ID NO: 46026 - RNA, 54 nt, Human
uuagagagggggaagagugagucugagcacgaguugcagccagggccaguggga

SEQ ID NO: 46027 - RNA, 54 nt, Human; identical to SEQ ID NO: 46024

SEQ ID NO: 46028 - RNA, 64 nt, Human
uggcacagccuuggcuuccacgccugagcguggagagcacgaguuaguuguaguccggcuugcg

SEQ ID NO: 46029 - RNA, 58 nt, Human
uguccuccaccagccucugacccaccuaccaccagaggccugcagccucccacaugcc

SEQ ID NO: 46030 - RNA, 60 nt, Human
ccgaggacugugacacauagcccauucuggccaccagagcccacuuggccccaccccuca

SEQ ID NO: 46031 - RNA, 64 nt, Human
cgagugacacugggccauccaggcggcucugcucccaccagacaggagcuaggccucacuggca

SEQ ID NO: 46032 - RNA, 64 nt, Human
acccuccaguguuggcacaggcccaccccuggcuccaccagagccagaagcagagguagaauca

SEQ ID NO: 46033 - RNA, 64 nt, Human
ugcccugugguuugacucuccuuagaaccaccgcccaccagaaacauaaaggauuaaaaucaca

SEQ ID NO: 46034 - RNA, 64 nt, Human
uggccagucugcauccuugccuagaccauucuccccaccagauggacuucuccuccagggagcc

SEQ ID NO: 46035 - RNA, 64 nt, Human
gaaagugugugauuucucucccaccuccuuccccccaccagaccuuugcugggccuaaaggucu

SEQ ID NO: 46036 - RNA, 64 nt, Human
uuagucuauccuggauauguacuaacgaauauuaccaccagagaagagagcuuucuacaaaagu

SEQ ID NO: 46037 - RNA, 64 nt, Human
aagugguggugggggggacaaaagacaaaaaaauccaccagagcuuuguauuuuuguuacguac

SEQ ID NO: 46038 - RNA, 64 nt, Human
uuuucagggccuuguccagcugagagcuucauguccaccagauucugagaggugucagcagcac

SEQ ID NO: 46039 - RNA, 64 nt, Human
auggcccagcaggcaggcacuguggcccuucuguccaccagacccaccuggagcccgcuucaag

SEQ ID NO: 46040 - RNA, 64 nt, Human
cugcaucagacaccgagacacugaacuuccugagccaccagacaggaaaggguagcagaaaaca

SEQ ID NO: 46041 - RNA, 64 nt, Human
cuaaugggagacuguagagaaaaugaaaaaagauccaccagaggacaucuuggggagggggagg

SEQ ID NO: 46042 - RNA, 64 nt, Human
ucccuggccauccuccuggaauguggucugcccuccaccagagcuccugccugccaggacugga

SEQ ID NO: 46043 - RNA, 64 nt, Human
cacuuggauuuauaguauagcccuuccuccacucccaccagacuugcucauuuuucgaguuuuu

SEQ ID NO: 46044 - RNA, 64 nt, Human
acccccacuggcuuuggugcuguccacacagugcccaccagaaggcagagggaacuccagggca

SEQ ID NO: 46045 - RNA, 64 nt, Human
aauuuggugcacagacaagcccuugagaagccaaccaccagaugcuggacacccucuucccauc

SEQ ID NO: 46046 - RNA, 64 nt, Human
aaugugguccacagccaugcccuugaggagccggccaccagaugcugaauccccuaucccauuc

SEQ ID NO: 46047 - RNA, 64 nt, Human
cuccagagaccccaggaacaauaagugucuccucccaccagacacuugccuuauuucuucuucu

SEQ ID NO: 46048 - RNA, 64 nt, Human
aaaauguauuagcuacccauuauucucgcacuaaccaccagaagacuugaaaaucuuaaaaaaa

SEQ ID NO: 46049 - RNA, 64 nt, Human
uauaaagggagaggaugacuuucucaaucaagugccaccagauaaaaacaacugcagaggcugg

SEQ ID NO: 46050 - RNA, 64 nt, Human
gaaaccucuuuuguuguccuugccccacuccucuccaccagacgccuuccucucuggauacugc

SEQ ID NO: 46051 - RNA, 64 nt, Human
ugggaagcacugggaaguaaugggguguggggugccaccagaccaacacccccagacuucccca

SEQ ID NO: 46052 - RNA, 64 nt, Human
cuccuccccugccgccucccgggaagcauccuccccaccagagcugccuccccaauccauuugg

SEQ ID NO: 46053 - RNA, 64 nt, Human
ccagcaggcagcgccuguccccucacagacucuuccaccagagcaggggcugcugggggcuccc

SEQ ID NO: 46054 - RNA, 60 nt, Human
ccuucccuagaaaggccugacccuccuuacccaccagaacagggguuuugaugcccucac

SEQ ID NO: 46055 - RNA, 64 nt, Human
ggaaagcaggggaauuucccaguguccuaguuuuccaccagaggaauauguguaaguagcaaag

SEQ ID NO: 46056 - RNA, 64 nt, Human
acacauacacacacacacacacacacaccugaggccaccagaagacacuuccaucccucgggcc

SEQ ID NO: 46057 - RNA, 64 nt, Human
caagccucugaaauccagcaaggaggucugccucccaccagacccucuccaguguacuucccca

SEQ ID NO: 46058 - RNA, 64 nt, Human
gaaccuccaggcugacgaggcaagacaaagccucccaccagacuuggagauugaaguucuuaaa

SEQ ID NO: 46059 - RNA, 64 nt, Human
agaagcccugcugucugucugugcccaagcccuuccaccagaaaagcuagucuaggugugagag

SEQ ID NO: 46060 - RNA, 64 nt, Human
cagagcagaaaguaaggggcagagucauacguguggccaggaaguagccagggugaagagagac

SEQ ID NO: 46061 - RNA, 64 nt, Human
ugcagucaucuuccccuccaagggggcagaaauuccaccagaaaucaccacauauuuggaaucu

SEQ ID NO: 46062 - RNA, 64 nt, Human
caccaugcccuuccugcauccuucccccaaccacccaccagaggaguucugguccccaaaccaa

SEQ ID NO: 46063 - RNA, 64 nt, Human
uuccacaaucccagggaucuacagaacuauuucaccaccagauaugaccuaguuuuauauuucu

SEQ ID NO: 46064 - RNA, 64 nt, Human
gcuucccugccccuccuggucugugucaguauuaccaccagacugacuccaggacucacugccc

SEQ ID NO: 46065 - RNA, 64 nt, Human
ggaugcucuggggagcucauggguggaggagucuccaccagagggaggcucaggggacugguug

SEQ ID NO: 46066 - RNA, 58 nt, Human
ugcuccagggaagggugugaggaggaggccaccagauucagaauucagaauuuuagac

SEQ ID NO: 46067 - RNA, 64 nt, Human
uccuuguugguuucugguucagagugcucucccaccaccagagacaaguggguaaaaaggucag

SEQ ID NO: 46068 - RNA, 64 nt, Human
gguccccacuuuaggacaagaggcagcuugccuuccaccagacgccagccucggccuuccuucc

SEQ ID NO: 46069 - RNA, 64 nt, Human
gaguccaacucacuuccagugcccaaaagggcacccaccagaaauuccaguaaauccucauuug

SEQ ID NO: 46070 - RNA, 64 nt, Human
acuucuauaccucccuaaccucaccccuggaaagccaccagauuggaggucaccagcaugauga

SEQ ID NO: 46071 - RNA, 64 nt, Human
gaccucuuuacacacacauucccguuccuaccaaccaccagaacuggaugguggcaccccuaau

SEQ ID NO: 46072 - RNA, 64 nt, Human
acucuagccuggacaguggccaggaccgucgagaccaccagagcuaccuccccggggacagccc

SEQ ID NO: 46073 - RNA, 64 nt, Human
auacuccagauugaccuuauaaauaaaagaaugcccaccagauugaaauccuagaaauacagaa

SEQ ID NO: 46074 - RNA, 64 nt, Human
ggggggagcccucucucccuuacccucucacucuccaccagauguuuacuaaacagggcauguu

SEQ ID NO: 46075 - RNA, 64 nt, Human
aaaaaggaaaugucuguauugguuggaugaaacuccaccagagcacagcuuagcuggggcgaga

SEQ ID NO: 46076 - RNA, 64 nt, Human
uaaucaguuuacugcucuuucagggauuucuaagccaccagaaucucacaugagaugugugggu

SEQ ID NO: 46077 - RNA, 64 nt, Human
gguaggagagagccuggaucucuggccccaacccccaccagaccucaugcccuggacacugcug

SEQ ID NO: 46078 - RNA, 64 nt, Human
uaaguaguuuugagaggguggauggguuacuugcccaccagaaacagcccuagucccaacuccu

SEQ ID NO: 46079 - RNA, 64 nt, Human
cagcagggagcugccuaaacaccuccuuggauauggccaggacccacagggacacagggcaaga

SEQ ID NO: 46080 - RNA, 64 nt, Human
caacgcuccaaagucauaauugcauugacuuuccccaccagaugcugaaaauguccuugugaug

SEQ ID NO: 46081 - RNA, 64 nt, Human
ggaaaucacagcaacccauugaaaacugcccuccccaccagaacgugcuacguucuuucuucau

SEQ ID NO: 46082 - RNA, 64 nt, Human
gcaccagcaaacucuggacugguggaagaauuccccaccagaucuccuugaagcagaauuaggg

SEQ ID NO: 46083 - RNA, 64 nt, Human
aaauacaccccaucgcccagcaccccugcugauaccaccagacagagagagagagcacuugauu

SEQ ID NO: 46084 - RNA, 64 nt, Human
gguuuuuaacuggugaaacuagccuggaauaaugccaccagagacugaguggaaaucgccccuu

SEQ ID NO: 46085 - RNA, 64 nt, Human
cucuagccacagccucuaguacacuuuagcaauaccaccagacuaguuagaguuccccacucac

SEQ ID NO: 46086 - RNA, 64 nt, Human
cagcaugaagugcucuaaagacagagacccucugccaccagagaccguccucaccccuguccuc

SEQ ID NO: 46087 - RNA, 64 nt, Human
agcugaggaugggacgaugugcccagggagggacccaccagagcacaagagaagguggcuaccu

SEQ ID NO: 46088 - RNA, 64 nt, Human
cucugucagcuacagaaagccuccgugacaccguccaccagagcucuggggucucgaacauaac

SEQ ID NO: 46089 - RNA, 64 nt, Human
ugaucccuucggcgccagcagcuccaaaacuggaccaccagagaauggacaccauccaggaaga

SEQ ID NO: 46090 - RNA, 64 nt, Human
uauaaaaaguauuacuuggaaaugaggcaucagaccaccagauguuaccgcucgguugaaugug

SEQ ID NO: 46091 - RNA, 64 nt, Human
gagaauuaaugaugagguuacaugcugcuugccuccaccagauguccacaacaauaugaaguac

SEQ ID NO: 46092 - RNA, 64 nt, Human
uaccagauucgguuagaaagugucaaguccucagccaccagacuguuauacugcaccacgggag

SEQ ID NO: 46093 - RNA, 64 nt, Human
uauucuguuaaaaucaggauuuuagugcuugccaccaccagaugagaaguuaagcagccuuucu

SEQ ID NO: 46094 - RNA, 64 nt, Human
uuagauuuuuuuuaaguacauugauguugauguuccaccagaaacaccuuaaguguauacuguu

SEQ ID NO: 46095 - RNA, 64 nt, Human
cgggaugaauggagccuuaaagaguuaggaugagccaccagaauaugccugcucaaaauuaaua

SEQ ID NO: 46096 - RNA, 64 nt, Human
ugggggcuuguuuugguuugggggcagccauccuccaccagaaagggggagcuccuuccgcugc

SEQ ID NO: 46097 - RNA, 64 nt, Human
gugcaagcacacaucacuuuagaggggcugcgccccaccagauaggaaggggaggauuuucucc

SEQ ID NO: 46098 - RNA, 64 nt, Human
uuuggugguucugcccucugcccuccagcuuuacccaccagaguaagcaaucuuuucuuuuuag

SEQ ID NO: 46099 - RNA, 64 nt, Human
gguucuccuuucuuuccucaccccaaccuuuacuccaccagagaaacuuccuuuugaacucagu

SEQ ID NO: 46100 - RNA, 64 nt, Human
uuuuuuguuuauuagcuaguuccuguaagcauuuccaccagaacuugaggcaaaucguaaggaa

SEQ ID NO: 46101 - RNA, 64 nt, Human
guccccagacuccaccaagccuggucagcccaaaccaccagaagcccagaauaaacuggcagcu

SEQ ID NO: 46102 - RNA, 64 nt, Human
gaaggccacagggcacaaugagcucucccuucuaccaccagaaagucccuggucaggucucagg

SEQ ID NO: 46103 - RNA, 64 nt, Human
caggauggucucuuaacuccugcccucaagugauccaccagagaggagauccucggccucccca

SEQ ID NO: 46104 - RNA, 64 nt, Human
cccucccccuggggugugcugugucccaccuggcccaccagaggcucacgacgauggcaccuga

SEQ ID NO: 46105 - RNA, 64 nt, Human
uggccuuucugugcccacccagacuugguuugggccaccagaggcugaaguguauuuccugugc

SEQ ID NO: 46106 - RNA, 64 nt, Human
augccacugccugcaccuuucggcagaggaacccccaccagacaucacccuuugccuuagcagg

SEQ ID NO: 46107 - RNA, 64 nt, Human
ggaucugccgaauugaagaggccugauuucagcuccaccagaugcagauuuguguuuuguuuuc

SEQ ID NO: 46108 - RNA, 64 nt, Human
uccauaaaguucuagucacuucuguuggccugagccaccagauuaugauguugccagaauucac

SEQ ID NO: 46109 - RNA, 64 nt, Human
cugccuuuugaggcauucacugcccuagacaaugccaccagagauagugggggaaaugccagau

SEQ ID NO: 46110 - RNA, 64 nt, Human
ggaggaccugcccagguaugccuuccagugaugcccaccagagaauacauucucuauuaguuuu

SEQ ID NO: 46111 - RNA, 64 nt, Human
cugugagcuucgaugagccagagugauaucauaaccaccagaaaucauacucuccuuucuuagu

SEQ ID NO: 46112 - RNA, 64 nt, Human
ggccauggcuuacauguuugucucuuugagaucgccaccagaaccauuugugaacugauuugug

SEQ ID NO: 46113 - RNA, 64 nt, Human
aacauguacugguuuauguggacaagccauuauaccaccagacugcaaugccaguuuccucuac

SEQ ID NO: 46114 - RNA, 64 nt, Human
caucacaggauguuccagugucccuggucucugcccaccagaugccagcacucccaccauucgu

SEQ ID NO: 46115 - RNA, 64 nt, Human
agaugauguggauauuuauauauuacauauauaaccaccagacuccauuuuauauauuagcauu

SEQ ID NO: 46116 - RNA, 64 nt, Human
uaucaugucagugaaaaauaauuacccacaaaugccaccagaacuuacgauucuucacuucuug

SEQ ID NO: 46117 - RNA, 64 nt, Human
cugccuaaccaggcccagccaguugguggggccaggccaggaccacacaguccccagacucagc

SEQ ID NO: 46118 - RNA, 64 nt, Human
ucugccaccugugucgccuccacuggcagucacgccaccagagccacccuggcucccucuccuc

SEQ ID NO: 46119 - RNA, 64 nt, Human
uaaagcuggccaaguuugagacuacacaaauaaaccaccagaaaaaugucuguguaauaauaga

SEQ ID NO: 46120 - RNA, 64 nt, Human
uuauccacaguaaaucuucagcaacucauugucuccaccagauaguauuuuucuguaaaugaaa

SEQ ID NO: 46121 - RNA, 64 nt, Human
ccauguauaugacaggauguuuguccugggacacccaccagauuguacauacuguguuuggcug

SEQ ID NO: 46122 - RNA, 64 nt, Human
uuuuucauguguuuuugugccauaacaacuauugccaccagaauaacuuuuuuuuugcaacugu

SEQ ID NO: 46123 - RNA, 64 nt, Human
cacccugauuccggacccuguagauugggcgccaccaccagaucccccucccaggccuuccucc

SEQ ID NO: 46124 - RNA, 64 nt, Human
ccacuauuguguuuucucuaagaagcacuacaugccaccagaauugugcacugaaagauaauac

SEQ ID NO: 46125 - RNA, 64 nt, Human
ucgaaguuuggauacauuucaagugcauuucaagccaccagagugucccauugcugccaaaaau

SEQ ID NO: 46126 - RNA, 64 nt, Human
ucagcucagcaagguucucaacugccucgaguacccaccagaccaagaaggccugcggcagagc

SEQ ID NO: 46127 - RNA, 64 nt, Human
cccagaccccugaccacccccuggguccugucccccaccagagccccagcuccugucugugggg

SEQ ID NO: 46128 - RNA, 64 nt, Human
cgcacugcccuugggacuuccgaagugaaccauuccaccagaaccuuugauucugcacaagauu

SEQ ID NO: 46129 - RNA, 64 nt, Human
ggcuuuuucuuuaucacccucagucuuaauccauccaccagagucuagaaggccagacgggccc

SEQ ID NO: 46130 - RNA, 64 nt, Human
uuucauaccuagcguggagcuaugcaagaagcagccaccagagggccccaaguggcagcaacug

SEQ ID NO: 46131 - RNA, 64 nt, Human
ggcugguucccagcuggccugagcagggggccugccaccagacccacccacgcucugacgagag

SEQ ID NO: 46132 - RNA, 64 nt, Human
aauuggauguuaaggauucuuagaaaaacagcaaccaccagaauagcauauaucugaaaguagu

SEQ ID NO: 46133 - RNA, 64 nt, Human
gaggguccauccuuuuucucuaauuggucgccucccaccagacucaccugcuuuucaacuuuuu

SEQ ID NO: 46134 - RNA, 64 nt, Human
cagcugcuuaagaugggugcuuccuuguacccggccaccagaaaaccccuggaacuccucuuuc

SEQ ID NO: 46135 - RNA, 64 nt, Human
accaggaugagagaggagagaggaauccacaggaccaccagaagggagagggaaccagauaugc

SEQ ID NO: 46136 - RNA, 64 nt, Human
uguauuuuuaguagagacaggguuucaucauguuggccaggauggucucuuaacuccugcccuc

SEQ ID NO: 46137 - RNA, 64 nt, Human
cugaagagggccugacacuucacagaguggggacccaccagagccuauagaaucaauuccuugg

SEQ ID NO: 46138 - RNA, 64 nt, Human
accaggauguaagaggagagaggaauccacaggaccaccagagaggagagggaaccagauaugc

SEQ ID NO: 46139 - RNA, 64 nt, Human
ugaaauaggaagucaugcucuucccacccuccacccaccagaguggaacccgcugcaaaauccc

SEQ ID NO: 46140 - RNA, 64 nt, Human
gggcuggggagcucagcuuggucucagagucuccccaccagauacuguuuaaaaaaguagcacu

SEQ ID NO: 46141 - RNA, 64 nt, Human
aaucugacucuauuauuuaauaucuuacauaccuccaccagacuggacuugcuuuuugaauuuu

SEQ ID NO: 46142 - RNA, 64 nt, Human
auagugcaccuaugagcaguugccuaccauguguccaccagaggcuauuuaauucaugccaacu

SEQ ID NO: 46143 - RNA, 64 nt, Human
uucauuuacuagcauuuuaggauccagaagaauuccaccagauugcaugaguuagauugggaaa

SEQ ID NO: 46144 - RNA, 64 nt, Human
uagaaugcauaccuuccucccucuagacaucccuccaccagaagagacaucuauuuaaaggcac

SEQ ID NO: 46145 - RNA, 64 nt, Human
gagaagauguucaccucucuccugaaaacuauucccaccagaccguuuagccucugcuucaagc

SEQ ID NO: 46146 - RNA, 64 nt, Human
ugaguuuaguuucucuccuaaaaugaauguaugcccaccagagcagacaucuuccacguggaga

SEQ ID NO: 46147 - RNA, 64 nt, Human
aucagugguuccuggccuugccugcagaauagaaccaccagaguccuuuaaaaaguauugcugc

SEQ ID NO: 46148 - RNA, 64 nt, Human
uuuugagucaguucuaaucccaugugugucugggccaccagaccgaaaugguugcugagaaacu

SEQ ID NO: 46149 - RNA, 64 nt, Human
cugccuaaauccacucugcaggaaauaggcccaaccaccagaugagaauuaggcccuggaugag

SEQ ID NO: 46150 - RNA, 64 nt, Human
uuaagaagcaccuauagacuugaacuccuaagugccaccagaauauauaaaaagggaauuuagg

SEQ ID NO: 46151 - RNA, 64 nt, Human
aguaugcuagcacuauuguaccuugaaaggauuuccaccagacugucuugaguagugacuucuu

SEQ ID NO: 46152 - RNA, 64 nt, Human
ccuuuacaauuucauguuaaucugguuugucuguccaccagagacagaucuucugugacagccu

SEQ ID NO: 46153 - RNA, 64 nt, Human
ugugugccucugcccagaagggggccucgccguuccaccagaagcucagcuccaggcccuggag

SEQ ID NO: 46154 - RNA, 64 nt, Human
aacucgaauaaguuugacuuguguuuuaucuuaaccaccagaucauuccuucuguagcucagga

SEQ ID NO: 46155 - RNA, 64 nt, Human
aggcuccuuaaggaugaccaaaaccaaugucucaggccaggaaggcagaagagaagcccuggug

SEQ ID NO: 46156 - RNA, 64 nt, Human
uugagggacugagccagaccuucggagaguaaugccaccagauccccuaggaaagaggaggcaa

SEQ ID NO: 46157 - RNA, 64 nt, Human
aaaagacaacuaaaauacccauuuggaccaaaagccaccagauugcuuagugccugacacagaa

SEQ ID NO: 46158 - RNA, 64 nt, Human
gcugccccuguccccaccucuggagaauccacccccaccagauuccuccgcgggagguggcccu

SEQ ID NO: 46159 - RNA, 64 nt, Human
uuaaagggaauauggauaagcauaguaacaaaacccaccagaaucuaagcaguuuucacccccu

SEQ ID NO: 46160 - RNA, 64 nt, Human
acccuuggggacgagggccugggccgcggugaggccaccagaggcaggaguggcccuggggguc

SEQ ID NO: 46161 - RNA, 64 nt, Human
uccaaugucggguucacuuaaaggauuugacuuaccaccagagcauagaaaagcaugcaaggaa

SEQ ID NO: 46162 - RNA, 64 nt, Human
aaagccagcagccccagacugcccaaaaacuugcccaccagaccaagggcagugccccaaggcc

SEQ ID NO: 46163 - RNA, 64 nt, Human
uaaaacuacaugcuuccccccuuccaguagcgagccaccagaagcuuucuugucucuaugcagu

SEQ ID NO: 46164 - RNA, 64 nt, Human
ugaugcagccguccauagcaguaccccuaaaaucccaccagaauacgggucccucuaacccagu

SEQ ID NO: 46165 - RNA, 64 nt, Human
aaagggcucucucaaguucugaaaagagaaucugccaccagaucgaauuucgaccccugagcuu

SEQ ID NO: 46166 - RNA, 64 nt, Human
aaagcaaccaaaggcaacagagucuagcucauggccaccagaccaaaagcauccagcuucugug

SEQ ID NO: 46167 - RNA, 64 nt, Human
acacaaccccagacccacgccggagggcaucccuccaccagaagauuccgccaccucaagugaa

SEQ ID NO: 46168 - RNA, 64 nt, Human
cucagucccaauuggcuaggacugcaggcacacaccaccagacccagcuaauguaauuucuauc

SEQ ID NO: 46169 - RNA, 64 nt, Human
auuuugucagcaaugcuauuaucucuaauuagugccaccagacuagaccuguaucauucauggu

SEQ ID NO: 46170 - RNA, 64 nt, Human
ccuggggacagaaagucagguugaaacaggaaaaccaccagacucuaaucucagcccuuuaacg

SEQ ID NO: 46171 - RNA, 64 nt, Human
uauuuuucuacagugagaugugaucuugccaaagccaccagaccuuggcuuccaggcccuccug

SEQ ID NO: 46172 - RNA, 64 nt, Human
acagaaggcucccugcugcccggagcagguacauccaccagagcaaagggaaccacuuuuauuu

SEQ ID NO: 46173 - RNA, 64 nt, Human
ugcaauuugauuuuaugaaguauauacccuuuacccaccagagacaguacagaaucccugcccu

SEQ ID NO: 46174 - RNA, 64 nt, Human
uauuaggacauaaaauagaggcugaccuuaaaagggccaggacagaagcggcugccagcucuga

SEQ ID NO: 46175 - RNA, 64 nt, Human
uaugucugaaacgacgggacuuucacugugauuuccaccagagaaauuauagcagaguggcuga

SEQ ID NO: 46176 - RNA, 64 nt, Human
ggaaagcuggcuugauuucacaggggaguuggagccaccagauccucuugcaagauugccccaa

SEQ ID NO: 46177 - RNA, 64 nt, Human
ucucucugaucaagacaccgcagugauggagaagccaccagaggcuccuugcagccacagagca

SEQ ID NO: 46178 - RNA, 64 nt, Human
accuggacuccaaggccggccugcgcacuugcugccaccagaaacuggaggacaugauccagga

SEQ ID NO: 46179 - RNA, 64 nt, Human
ucucugaugucccagugcucaccagcccugcagcccaccagacgucaggcccugacuccucugg

SEQ ID NO: 46180 - RNA, 64 nt, Human
cugugccuuuaacaagguuguaaauauuuuaugcccaccagagauguggucauaagaucugauc

SEQ ID NO: 46181 - RNA, 64 nt, Human
uggcacccgaggcauuauuugaccggaucuacacccaccagagugaugugugaguuuguaauag

SEQ ID NO: 46182 - RNA, 64 nt, Human
cucaaauguaauucagcaaaauaauacaguacugccaccagauuuuuuauuacaucauuugaaa

SEQ ID NO: 46183 - RNA, 64 nt, Human
gauaaaaaaacagcuuuauugagguauaauucacccaccagacuuuuuuaaacaucaaauaauu

SEQ ID NO: 46184 - RNA, 64 nt, Human
gugacuugccuuugagaaaagaagggcugcaaugccaccagagaacgugaugucagacaccauc

SEQ ID NO: 46185 - RNA, 64 nt, Human
uaacccugucaucuucccaaagcucauuuaugagccaccagaggcuccuaccccaaagauuuuc

SEQ ID NO: 46186 - RNA, 64 nt, Human
uacauguaacuguuuugguuguguucuaucaaccccaccagaguucccuaaacuugcuucaguu

SEQ ID NO: 46187 - RNA, 64 nt, Human
cuccugguuuauucucugauagacugagcuccuuccaccagaaggcacugccugcaggaagaag

SEQ ID NO: 46188 - RNA, 64 nt, Human
ccuccugccacucugagcacauguccggggguugccaccagagacggcuuuguucucccagcua

SEQ ID NO: 46189 - RNA, 64 nt, Human
ggccaacuggcgaccucacgguugcacuuccauuccaccagaaugaccugaugaggaaaucuuc

SEQ ID NO: 46190 - RNA, 64 nt, Human
ccuggaggccagcucugccccaggggcugagcugccaccagagguccugggacccucacuuuag

SEQ ID NO: 46191 - RNA, 64 nt, Human
ccccugcagccgggcccagcucuucuguccuuggccaccagagacugcagcccacaacccuugg

SEQ ID NO: 46192 - RNA, 64 nt, Human
gguccuguuuucuauucuuuauuuuuccugcaacccaccagaccccaggccucaccggaggccc

SEQ ID NO: 46193 - RNA, 64 nt, Human
acaaccuugucccaaggaaucagcaggaugugugggccaggaucccccucuuugcacagcauga

SEQ ID NO: 46194 - RNA, 64 nt, Human
agcccccgggucugcaccuccagagcccacccuaccaccagacacagagcccggaccaccugga

SEQ ID NO: 46195 - RNA, 64 nt, Human
agucacucaacauaaccacaggccaauuuguuggccaccagaaaaccgcuuuuuaaaaaaacac

SEQ ID NO: 46196 - RNA, 64 nt, Human
acucucuggaagcccuggagacccucgcccaacuccaccagauagcagagggguaagagaggau

SEQ ID NO: 46197 - RNA, 64 nt, Human
gcccucucucucagcuuagcaguucgcucuccagccaccagagcagccucucugcacaugcagc

SEQ ID NO: 46198 - RNA, 64 nt, Human
ccacuagucccaugaagucucaccuuguugacuuccaccagaacaaaaccuguuaauucagcuu

SEQ ID NO: 46199 - RNA, 64 nt, Human
uuguaacuugugauuauguuuuuaacuaaauuuaccaccagauacaaacaauacuucuuacaca

SEQ ID NO: 46200 - RNA, 64 nt, Human
gccuuauucuaagacccaagguuuggaucugcuaccaccagacuccuaacauagaaaacuugaa

SEQ ID NO: 46201 - RNA, 64 nt, Human
cuaaaccuguuucuggugccucccauccccagacccaccagacaccacacagcagacaauacac

SEQ ID NO: 46202 - RNA, 64 nt, Human
aaccaggggcucugcaggucacuugggacggacgccaccagacuugucuccaaaaaucaccacc

SEQ ID NO: 46203 - RNA, 64 nt, Human
cgccaccugugaccagcagcugaugccuccuuggccaccagaccaugggccaagagccgccgug

SEQ ID NO: 46204 - RNA, 64 nt, Human
agcccccgggucugcaccuccagagcccacccuaccaccagacacagagccuggaccaccugga

SEQ ID NO: 46205 - RNA, 64 nt, Human
ccucucaauuucaggcagguguaacaguuccuuuccaccagauuuaauauuuuuauacuuccug

SEQ ID NO: 46206 - RNA, 64 nt, Human
ugagcgaguggacuuagggcugggcaggcaguagccaccagagggcagcagcgaacuaggccag

SEQ ID NO: 46207 - RNA, 64 nt, Human
ccugaaguuggggcaggugcaauuccaagcauaaccaccagauggcagagugaccgcgcauacc

SEQ ID NO: 46208 - RNA, 64 nt, Human
acagaggccuagggcuguaucucucccugggcugccaccagagaaggugcuugguguucgccug

SEQ ID NO: 46209 - RNA, 64 nt, Human
gaggagccgagcgaauagcaucuccucccaccucccaccagagacguccuguuugagcugucag

SEQ ID NO: 46210 - RNA, 64 nt, Human
ucuggcuuucuuauacagaugguguccauuugcuccaccagacaggaguuaaaaaccuuuaaag

SEQ ID NO: 46211 - RNA, 64 nt, Human
cuuauugcacugguuagcaaccccaauacagagaccaccagaucagguauagacuccugaaaga

SEQ ID NO: 46212 - RNA, 64 nt, Human
cacuuugggaggcugaggaggaaggauagcuugaggccaggaguuugagacuagacugggcaac

SEQ ID NO: 46213 - RNA, 64 nt, Human
ucccuccugccaucuacaggcuugucacaucucaccaccagaaacaggcuuccucaggcuucuc

SEQ ID NO: 46214 - RNA, 64 nt, Human
uaaggagaaacagagaggggcaaaguugcucugcccaccagaacugaagaggaggggcugccca

SEQ ID NO: 46215 - RNA, 64 nt, Human
uacccaucuuaggaucccaucagcuucccaucccccaccagacagccacaguacccucacuuuc

SEQ ID NO: 46216 - RNA, 64 nt, Human
agugagacaaauacagaaaugacccauucccugcccaccagaaacucagaggugauuggggaga

SEQ ID NO: 46217 - RNA, 64 nt, Human
auucaucauagcucucugcuuugggcucugcaggccaccagauacacaugaggccccuacuucu

SEQ ID NO: 46218 - RNA, 64 nt, Human
caugggggagugaaaccaauucucagagaacaacccaccagagacuuuuaaagagaggccaggc

SEQ ID NO: 46219 - RNA, 60 nt, Human
uuuuuccaacagacauuuaaagucugaaguccaccagaacuuggaagaaagcuguuaacu

SEQ ID NO: 46220 - RNA, 64 nt, Human
gucugccacguaaucauuuucuuagacguuugcuccaccagauuuaaccaaauguaacucccac

SEQ ID NO: 46221 - RNA, 64 nt, Human
uuucugugaaagcugcucagcaacaaacguacuuccaccagauguguccccagauccacagcag

SEQ ID NO: 46222 - RNA, 64 nt, Human
cuaagacacuaagaccccagacccaaagccaaguccaccagaguggcugcaggccaggccugga

SEQ ID NO: 46223 - RNA, 64 nt, Human
gaacacaaauagaaauuuaaugauguguucaacuccaccagaaauuaccucgagucagcauuga

SEQ ID NO: 46224 - RNA, 64 nt, Human
ggcaaugaguuagggcuccuuuuccccuucccucccaccagauugcucucccaccuuucauuuc

SEQ ID NO: 46225 - RNA, 64 nt, Human
caucuucccagggguccaccucccuuuauaaaccccaccagaaccacaucauuaaaagguuuga

SEQ ID NO: 46226 - RNA, 64 nt, Human
uucugagagcuuggugaaggugucuccaucaccaccaccagagccuccugcccagcccuggcca

SEQ ID NO: 46227 - RNA, 64 nt, Human
auaucucagggaauggugucugugcucagcccauccaccagaagagucugcucacaagccagag

SEQ ID NO: 46228 - RNA, 64 nt, Human
augagcugcagaugcuuaccuaccacggccgucuccaccagaaaaccaucgccaacuccugcga

SEQ ID NO: 46229 - RNA, 64 nt, Human
cagcuugaugguuucuccuugccccauuucugccccaccagaucuuugcuccuuucccuuugag

SEQ ID NO: 46230 - RNA, 64 nt, Human
uuaacagaaacagggguaccuuucccagggguguccaccagaagaguugaagaagaggugagaa

SEQ ID NO: 46231 - RNA, 64 nt, Human
auguauuguguuguuuguaaaguaagaaguuacuggccaggagcggcggcucaugccuguaauc

SEQ ID NO: 46232 - RNA, 64 nt, Human
acuuaacccaaaucuaguucuuugaccaccucuaccaccagaacccagcagacacucacaucuc

SEQ ID NO: 46233 - RNA, 64 nt, Human
cucccuugaugggguccagagagccucccugcagccaccagacuuggccuccagcuguucuuag

SEQ ID NO: 46234 - RNA, 64 nt, Human
augucaaauauauaauauguaauuuuuuuaaaaaccaccagauacagaaaugugcuuuaacauc

SEQ ID NO: 46235 - RNA, 64 nt, Human
cccucaggccaggauccccuuagcaggguccuucccaccagacucagggaagggaugccccauu

SEQ ID NO: 46236 - RNA, 64 nt, Human
gacaagugagguggagggccugcccccccucccuccaccagacacuccuuccaggccugagccc

SEQ ID NO: 46237 - RNA, 64 nt, Human
ucgccgucacucuccacccagccaguaccucgcgccaccagaacgcgccgcccgcgccggccuc

SEQ ID NO: 46238 - RNA, 64 nt, Human
gcagggagggcuuggggcugcaccuccuacccucccaccagaacgcaccccacugggagagcug

SEQ ID NO: 46239 - RNA, 64 nt, Human
uaaagaaacuggggaaggauuuaugaauacaccaccaccagaguggauaaugcuuagaauucuu

SEQ ID NO: 46240 - RNA, 64 nt, Human
ccaguccuccauaagcacaaauggaauugugcaaccaccagaaaaacacuacuguggcaaacug

SEQ ID NO: 46241 - RNA, 64 nt, Human
agcgugguguccugucagcuuccucuuuaggaacccaccagagggcagcaagcuccuuucacuu

SEQ ID NO: 46242 - RNA, 64 nt, Human
ggacggagacacugacugaggcgaugggagcugcccaccagagugccucugagcagcucacagu

SEQ ID NO: 46243 - RNA, 64 nt, Human
uggugacccagaacaggacuccacacagcguuugccaccagaaaccacaagcaaaaucuggauc

SEQ ID NO: 46244 - RNA, 64 nt, Human
cagccucccaaguagcuggguuuauaggugcccgccaccagacccggcuaauuuuuuaguuuua

SEQ ID NO: 46245 - RNA, 64 nt, Human
acaaggguucuaccagagaggaaaauuccacaucccaccagaagacagggguguuggcaggcau

SEQ ID NO: 46246 - RNA, 64 nt, Human
ugguccccaaagacccuucaaccuccccagucccccaccagacccacccucucccugaaucuac

SEQ ID NO: 46247 - RNA, 64 nt, Human
agaagcugcagccucacgcaccaucccccucuuuccaccagauggauguugacuuggugucugg

SEQ ID NO: 46248 - RNA, 64 nt, Human
uugacaauucugagaguuguccugcaguuggaggccaccagagguaucugagcucccugcuucc

SEQ ID NO: 46249 - RNA, 64 nt, Human
aaaugagguugucaguuuccagcaaggcugacauccaccagacugauuucuccgauguugcacu

SEQ ID NO: 46250 - RNA, 63 nt, Human
ccgugcguucagugacuaauaaaaugacccuuagggccaggaauguggggaggucccaucuuc

SEQ ID NO: 46251 - RNA, 64 nt, Human
gacucuccucggguggguccagcaggggcccugcccaccagaacacaguccgugcugugcugcg

SEQ ID NO: 46252 - RNA, 64 nt, Human
agugcuuaccugccccgagggaaguccagcagcuccaccagauagagaucuggagaugcuucuc

SEQ ID NO: 46253 - RNA, 64 nt, Human
cuccugaacucugcgugaagggccuuaaugucacccaccagaaaacuaacuccaaauaaacgcu

SEQ ID NO: 46254 - RNA, 64 nt, Human
uaauccacauaaacaaaaagcauggaaaauuuauccaccagaauuugcuguggagauacuuuuu

SEQ ID NO: 46255 - RNA, 64 nt, Human
gaaaucaauccacaguccaugaaauugugacacuccaccagauuaaguuagggcauaacauuaa

SEQ ID NO: 46256 - RNA, 64 nt, Human
agugcagcaucuuucccacauucaauaugaagcaccaccagauggcuaccaaaugauaagaaca

SEQ ID NO: 46257 - RNA, 64 nt, Human
uagcuugaacccuuuuaaugaagaccuaacuccuccaccagaaauuuaaguuuauguucuuacu

SEQ ID NO: 46258 - RNA, 64 nt, Human
augaaagaaccagaguuggaaggcacuugacuggccaccagaccaacucugcuguuacugacau

SEQ ID NO: 46259 - RNA, 64 nt, Human
uuaauccccuaaaauucucccuguagucaauguuccaccagaggagcggacagugaaauguaau

SEQ ID NO: 46260 - RNA, 64 nt, Human
ggccgaggcccuucuggggguuucuaucuuucuuccaccagacuccaagcccacucuccuccaa

SEQ ID NO: 46261 - RNA, 64 nt, Human
uugcauaucuuaaucgacauucccaguccuuucaccaccagaaccaacuccucuuucaaacaca

SEQ ID NO: 46262 - RNA, 64 nt, Human
cuuccacccuccauccagaaaggcacccuucauuccaccagaacuuuacccaggaagaacacga

SEQ ID NO: 46263 - RNA, 64 nt, Human
caaagacucaagugggaacgacugggcacugccaccaccagaaagcuguucgacgagacggucg

SEQ ID NO: 46264 - RNA, 64 nt, Human
ggagccccuguggccuggacucuaggggaugccgccaccagaaaccccucugccaaucccuacc

SEQ ID NO: 46265 - RNA, 64 nt, Human
gaugugccgcaagcacugucucaccaucccgcacccaccagacaacagccagggcuggagucca

SEQ ID NO: 46266 - RNA, 64 nt, Human
cuacauauuuuauuauagaaaaaguauuuuuucuccaccagacaaauggaaaaaaagaggaaag

SEQ ID NO: 46267 - RNA, 64 nt, Human
ggggugggggcuucaaguacagauugggcacacuccaccagaccccagcaaggucagcugcccc

SEQ ID NO: 46268 - RNA, 64 nt, Human
uaguccucuuagucacacagcgaguaggccucuuccaccagaagcuguucgugcagcuggggag

SEQ ID NO: 46269 - RNA, 64 nt, Human
uguauuuuuaguagagacgggguuucaccauguuggccaggauggucucaaucucuugaccucg

SEQ ID NO: 46270 - RNA, 64 nt, Human
gcuuacagguuugcuuaguuuggggacaccguuaccaccagaauggcugcucugacaauaugcc

SEQ ID NO: 46271 - RNA, 64 nt, Human
auacuuccuuggcccuuuuucuuuauugacuagaccaccagaggaggaugugugggauuguagg

SEQ ID NO: 46272 - RNA, 64 nt, Human
ugcuuggccacagcuuugcucuuugguccucaggccaccagaccccucacagcauggcccuugg

SEQ ID NO: 46273 - RNA, 64 nt, Human
aagagcaucugcccauuucccaccuucccuucucccaccagaagcuugccugagcuguuuggac

SEQ ID NO: 46274 - RNA, 64 nt, Human
ccacccucgcccugcuugcccugccgcaggccccccaccagaagccaucucccccgcugugugu

SEQ ID NO: 46275 - RNA, 64 nt, Human
aaauucuuggaagcaacggggagcuuccauauucccaccagagugugggaaugcuguggccaug

SEQ ID NO: 46276 - RNA, 64 nt, Human
ccaccuagagcuuuuaaccaaacaacauugcagaccaccagaguccuuggacucccccuggguc

SEQ ID NO: 46277 - RNA, 64 nt, Human
cuggugcuuaaacuucauuaccuucaugguaaauccaccagagggccgguuagaugcuggcccc

SEQ ID NO: 46278 - RNA, 64 nt, Human
cuuuuaucaaauagcauucagaguauuugaauguccaccagacaccagccccggggggcacaga

SEQ ID NO: 46279 - RNA, 64 nt, Human
gcaugagccaccagugccccggcacccuuuaacaccaccagauggguguuuucccccauccacc

SEQ ID NO: 46280 - RNA, 64 nt, Human
ugcuggcauuacaggugugagccaccgugcccggccaccagaauccuuugguauagccaagccu

SEQ ID NO: 46281 - RNA, 64 nt, Human
gugaaacauccccucaggcugaagccccccacccccaccagagacacacugggaaccgucagag

SEQ ID NO: 46282 - RNA, 64 nt, Human
gccucaggccuccauggagggagcugcuauguccccaccagauuggccccgugcggcugcuggc

SEQ ID NO: 46283 - RNA, 64 nt, Human
uggagacuggagagaucaagagagaguauggcggccaccagaaggcuguugucugccuggccuu

SEQ ID NO: 46284 - RNA, 64 nt, Human
gcuucagcccauguguguccugguguucccagccccaccagagccccgugccgggagcugacag

SEQ ID NO: 46285 - RNA, 64 nt, Human
uugugagcugacccccaggaacagcuuggcuguuccaccagagcagagggaaucauugcuggac

SEQ ID NO: 46286 - RNA, 64 nt, Human
gggaacauuucucacgugcacauuccccuaagagccaccagacugcuuccugccagccugugcu

SEQ ID NO: 46287 - RNA, 64 nt, Human
ccaucugggcagcagcaucugguugaccagauggccaccagaacccacuguucauucuuaucuu

SEQ ID NO: 46288 - RNA, 64 nt, Human
ugucccuguuguaacugcccaaggcauguuuugcccaccagaucauggcccacguggaggccca

SEQ ID NO: 46289 - RNA, 64 nt, Human
uuuuaaagaucccugaccccagcuuuagcuuucuccaccagauaaccagcuaaucccaggaauu

SEQ ID NO: 46290 - RNA, 64 nt, Human
gaugcucuuggccggcuggagcaagaccuggcucccaccagagggacgugugugugccugcaga

SEQ ID NO: 46291 - RNA, 64 nt, Human
ucugccucuaagcgcugagcauugggccccuuccccaccagaccuuuguagcuccuccagccuc

SEQ ID NO: 46292 - RNA, 64 nt, Human
auguacagagcucuguguauacacagcuucacacccaccagauuguuacuacaguggguugggu

SEQ ID NO: 46293 - RNA, 64 nt, Human
cccacucacugugggucccauucggcuguuucccccaccagaccccagggaagccggggcccac

SEQ ID NO: 46294 - RNA, 64 nt, Human
cgcacaggccucuucuccccggcacuuccgagauccaccagaucgacuugaucgugcagcugcu

SEQ ID NO: 46295 - RNA, 64 nt, Human
gguccucccagcgcugcuguugcaccugugagccccaccagacucauuuguaaauagcgcuccu

SEQ ID NO: 46296 - RNA, 64 nt, Human
agcccucggugcuggaguggacguuaauugucagccaccagacugucccggcaccuacagagaa

SEQ ID NO: 46297 - RNA, 64 nt, Human
caguagaugagucugguuaagcgaggucagacauccaccagaaucaacucagccucaggcaucc

SEQ ID NO: 46298 - RNA, 64 nt, Human
gcccuacccagaguauuucugagccaugaggggcccaccagauugguucugaauuggauucaug

SEQ ID NO: 46299 - RNA, 64 nt, Human
uggaagugguguguucacauacagugacccuuggccaccagaccacagaggauggagccuggga

SEQ ID NO: 46300 - RNA, 64 nt, Human
ccaccucaaucaccagccaagaugguugcuuuguccaccagaggucaaguucaccucucuggug

SEQ ID NO: 46301 - RNA, 64 nt, Human
aacucuugggcuucaagcaauccuccugugucagccaccagaguagcugagacuacagggguau

SEQ ID NO: 46302 - RNA, 64 nt, Human
uaccaucccuggacagugacagauuuuaagccagccaccagaauucuuuucgaguuaaccauuu

SEQ ID NO: 46303 - RNA, 64 nt, Human
acuguguuugugauugucugugugucugucucccccaccagacugugagcuccaugagggcagg

SEQ ID NO: 46304 - RNA, 64 nt, Human
auauuugcccagcaggaaaaucauguaaguuauaccaccagaaagcaaaaggagcaugguuugg

SEQ ID NO: 46305 - RNA, 64 nt, Human
ccucugccagcgccaaaacaagccaaagagccucccaccagagccgggaggaaaaggccccugc

SEQ ID NO: 46306 - RNA, 64 nt, Human
ggaggugcugaauaaauuaggccucaggccucuaccaccagagagcuggagaauggguccacgu

SEQ ID NO: 46307 - RNA, 64 nt, Human
uucggaggccaaggagggacaaacgaacccuugaggccaggaguuccagacuaacuugggcaac

SEQ ID NO: 46308 - RNA, 64 nt, Human
uuucagggccuucccucccugccugggugucgggccaccagaaggcucugccggacgccaagaa

SEQ ID NO: 46309 - RNA, 64 nt, Human
gcuggcacucucaauccuacaucaggugccaccaccaccagacucaggcccugguguaagaagc

SEQ ID NO: 46310 - RNA, 64 nt, Human
gccccuccgcugcuccuuuuuggaaugcgagcucccaccagaagaagguuccggcacgaauccc

SEQ ID NO: 46311 - RNA, 64 nt, Human
accugaguaugagaauguuguacccaucuccaggccaccagaacccugaugaccuugaauuugg

SEQ ID NO: 46312 - RNA, 64 nt, Human
aagcuccuuugugcuuugcacaaaccugaaucccccaccagagaggaugugugugaggagccag

SEQ ID NO: 46313 - RNA, 64 nt, Human
auuuucccccuuuaugaacuguacuggcuguugaccaccagacaccugaccgcaaauaucuuuu

SEQ ID NO: 46314 - RNA, 64 nt, Human
uuuaagucuauuguuuaacuguaccauccagagcccaccagaagcuauugaucauuaaaauuau

SEQ ID NO: 46315 - RNA, 64 nt, Human
agcccccacccuaaaaagguuaucccugagaacuccaccagacuugggagcccaagugcagugc

SEQ ID NO: 46316 - RNA, 64 nt, Human
ucaucagccuguguaggcagucauggcaccaaagccaccagacugacaaauguguaucggaugc

SEQ ID NO: 46317 - RNA, 64 nt, Human
ucaucggccuguguaggcagucauggcaccaaagccaccagacugacaaauguguaucagaugc

SEQ ID NO: 46318 - RNA, 64 nt, Human
agggccuggggcugggcagccugguauucaguggccaccagaagagcagggccagccccgguca

SEQ ID NO: 46319 - RNA, 64 nt, Human
cgaagggagaaguugggaagcuacguucuguuggccaccagacuugcauuucagccucugucau

SEQ ID NO: 46320 - RNA, 64 nt, Human
uccccccaccccucugcugcaggaggcguggccaccaccagaugcucccugucuggggcaggca

SEQ ID NO: 46321 - RNA, 64 nt, Human
cuggguccccuugguuuuucgugcuggaacauccccaccagagccucucugccauaacugccag

SEQ ID NO: 46322 - RNA, 64 nt, Human
uuccuggaccccccagcuggccucugaagcuggcccaccagagcugccauuugucuccagcccc

SEQ ID NO: 46323 - RNA, 64 nt, Human
gggguagcagccuugaacccacccagcugggacaccaccagaagguccagggcucuccccauga

SEQ ID NO: 46324 - RNA, 64 nt, Human
aacuggcguguagcacaaagaaaaagccccuucuccaccagauauuugcuuccuaagaauaguu

SEQ ID NO: 46325 - RNA, 64 nt, Human
cucugccugagccugcugcuagcccugccugguuccaccagacuggcgugucauuggacagaua

SEQ ID NO: 46326 - RNA, 64 nt, Human
uccucucuauuguuuaaauagauuacuguaguuuggccaggaauuuggcgucagugguaacaca

SEQ ID NO: 46327 - RNA, 64 nt, Human
uggaccaguccaugugauuucaguauauacaacuccaccagaccccuccaacccauauaacacc

SEQ ID NO: 46328 - RNA, 64 nt, Human
uuccuuccucucugcaaugaccuucaacaaccggccaccagaugucgcccuacucaccugagcg

SEQ ID NO: 46329 - RNA, 64 nt, Human
aacugacaaaccaccaaaaacugaaaccccagacccaccagaaagacaagugucuagcaaugcc

SEQ ID NO: 46330 - RNA, 64 nt, Human
ugccccaggcuaauauuagggacuggggaggggaccaccagaggggagagggaagcugcuuacu

SEQ ID NO: 46331 - RNA, 64 nt, Human
uaacaguuggucuguauuugcauguaaaagugggccaccagagaacccuuauugauuacuuaag

SEQ ID NO: 46332 - RNA, 64 nt, Human
aaccccaugggcccguucugauugaaggugaagcccaccagauuauuuuucaaagucuuagguu

SEQ ID NO: 46333 - RNA, 52 nt, Human
cuggcacggaggaguccugacaccaccagaauaaacuugccgaguuuaccuc

SEQ ID NO: 46334 - RNA, 64 nt, Human
cggccaccuggggaagccgcgccugccaaggaggccaccagagggcagugcaggcuucugccug

SEQ ID NO: 46335 - RNA, 64 nt, Human
cuuccuggaacugcccacgucugcacagaacagaccaccagacgccagggcugauugguggggg

SEQ ID NO: 46336 - RNA, 64 nt, Human
ggccuaguucaaaccuuugccucaaagccaucccccaccagacugcuuagcgucugagauccgc

SEQ ID NO: 46337 - RNA, 64 nt, Human
ucccugcccucccgucauuugcccugggucucccccaccagaaugggagccaggagucccagcc

SEQ ID NO: 46338 - RNA, 64 nt, Human
ccccuucuccacaccugaacaguuggcucaagggccaccagaagcauuucuuuauuauuauuau

SEQ ID NO: 46339 - RNA, 64 nt, Human
cagccaggaaggaaucugaauggagaaucaccaaccaccagagaaaaaagacuguggggcccuc

SEQ ID NO: 46340 - RNA, 64 nt, Human
cgccccgcccacgccgcggccaccgggcccacggccaccagaaugcaauugagaaaucguuuau

SEQ ID NO: 46341 - RNA, 64 nt, Human
cugguggcagcaccaggggacacaccugccaaacccaccagauggaggggcccucccuggucuc

SEQ ID NO: 46342 - RNA, 62 nt, Human
cccccucggacugcgggugacggcccugcccgccaccagaccccuaaaucuuggccaucgug

SEQ ID NO: 46343 - RNA, 64 nt, Human
uuacugcauagcagaccacacagaagggugugggccaccagagaauuuugguaaaaauuuggcc

SEQ ID NO: 46344 - RNA, 64 nt, Human
cacagucccccaacccuccacagagcccccagacccaccagaacuuccacagacgcccccacua

SEQ ID NO: 46345 - RNA, 64 nt, Human
aggaacuaaagaaagcugaaggugcccaccugggccaccagaaggugacacccccagaaucccu

SEQ ID NO: 46346 - RNA, 64 nt, Human
aguuggaugucaucccccgaccccacccuguuuuccaccagaguucugacacugugacucugua

SEQ ID NO: 46347 - RNA, 64 nt, Human
uggguccccaggucccugcgcagccaccagggccccaccagaccauggguuccuuauucuggac

SEQ ID NO: 46348 - RNA, 64 nt, Human
ccaggcacuggaucccagauucccaagccuucacccaccagauucuggcuccuaaaacaagugc

SEQ ID NO: 46349 - RNA, 64 nt, Human
cagccucacgaguagcuggaauuacaggcaggcgccaccagacccggcuaauuuuuuguauuuu

SEQ ID NO: 46350 - RNA, 64 nt, Human
aaggaaggauacacauggagaagacuguguggauccaccagaagauggccaucuacaagccaag

SEQ ID NO: 46351 - RNA, 64 nt, Human
guauucaccacccugggaccccccccccccccgcccaccagaccuguucugaccucaugagugu

SEQ ID NO: 46352 - RNA, 64 nt, Human
ccaagauaccagacauuugagugaaauuuuggauccaccagaccagccaccagcuaaaugccag

SEQ ID NO: 46353 - RNA, 64 nt, Human
gacugcuggaacccagccagugggagggccuggcccaccagaguccugcucccucacuccucgc

SEQ ID NO: 46354 - RNA, 64 nt, Human
ucacccugacucgggagcagacggaacguuugucccaccagaucaccucccgcguggucucggc

SEQ ID NO: 46355 - RNA, 64 nt, Human
caauaagggaauaaaagcuggcgagcgcggcaccccaccagagucugcuuccacgcugugggag

SEQ ID NO: 46356 - RNA, 64 nt, Human
ucccugaauuuuccuagaucccuccaaaugccacccaccagagucacuggugaccccagaaaau

SEQ ID NO: 46357 - RNA, 64 nt, Human
ugcccaccaggaggaucugcgcacggugcacagcccaccagagcacuacagccuuuuauugagu

SEQ ID NO: 46358 - RNA, 64 nt, Human
cugccaccaccuaaccagcgugaaagccugagucccaccagaaggaccuucccagauaccccuu

SEQ ID NO: 46359 - RNA, 64 nt, Human
ucugaccuauaaugucuuaggugcaacacggaccccaccagagcucuuggauaccccccuagau

SEQ ID NO: 46360 - RNA, 64 nt, Human
acgaguaagugaauccugauuauuuccagacccaccaccagaguggaucuuauuuucaaagcag

SEQ ID NO: 46361 - RNA, 64 nt, Human
gguuucucugccuucccuucuacccacccgccucccaccagaucccaucuggaaaucauaauaa

SEQ ID NO: 46362 - RNA, 64 nt, Human
cacauuaaaagaaagcuugacaguguuaugaaagccaccagacucagccaguguguccccaugg

SEQ ID NO: 46363 - RNA, 64 nt, Human
acagugcuggccuccuguggggccacuauagcagccaccagaagccgcgaggcccucagggaag

SEQ ID NO: 46364 - RNA, 64 nt, Human
gcagccacccggccgccaaggcaggcuugggcugggccaggacacguggggugccugggacgcu

SEQ ID NO: 46365 - RNA, 64 nt, Human
cugagguuggcucuaacaucucuggucuuuagagccaccagaucucucuggcccauacagauau

SEQ ID NO: 46366 - RNA, 55 nt, Human
uggagcacugcuggaagugaguggcccaccagagccucccucagccacgccucuc

SEQ ID NO: 46367 - RNA, 64 nt, Human
ccccacaucuagaacucccagacccuggacuuagccaccagagagcuacauuuuaaaggcuguc

SEQ ID NO: 46368 - RNA, 64 nt, Human
guaugugccacauggaaaaacaggacaccagagcccaccagacagugccggccagcagagaagc

SEQ ID NO: 46369 - RNA, 64 nt, Human
aauuuagggguuacgauuauagcaauuuaagggcccaccagaagcaggccucgaggagucaauu

SEQ ID NO: 46370 - RNA, 64 nt, Human
gcuucucccagagaggacaaaaaagcccaacuugccaccagaugcuaaaugagacuugacagcu

SEQ ID NO: 46371 - RNA, 64 nt, Human
agguggcccugcagccccccaccuucuggcccucccaccagaggcccagcuaccaaggccacau

SEQ ID NO: 46372 - RNA, 64 nt, Human
agacugagaugaaugucuuuccucucccugccucccaccagacuuccuccuggaaaacgcuuug

SEQ ID NO: 46373 - RNA, 64 nt, Human
accacccaaggggucaucaucucuggccaccacuccaccagaugggcagagcagcuaugaccgc

SEQ ID NO: 46374 - RNA, 64 nt, Human
ugcaagcuggccaggagguagguggagggcaaggccaccagaccuggcuucgcgcuguccacug

SEQ ID NO: 46375 - RNA, 64 nt, Human
gggacaagaugauggagugccacuuccgauuccgccaccagauggcacuaggugacugacggga

SEQ ID NO: 46376 - RNA, 64 nt, Human
ccagcaagacugcagccucuuccucccucagaucccaccagacccaccaggugccauaauaaag

SEQ ID NO: 46377 - RNA, 64 nt, Human
aauggauguuauggagcuucaagaaucgaguuacccaccagaacccuaaugguaaagcuaugau

SEQ ID NO: 46378 - RNA, 64 nt, Human
gcucaucccuuccuggggaccacacugcucugcuccaccagaccacacuaugaaauaggaauaa

SEQ ID NO: 46379 - RNA, 64 nt, Human
gcaccagcaaacucuggacugguggaagaauuccccaccagaucuccuugaagcagaaguaggg

SEQ ID NO: 46380 - RNA, 64 nt, Human
ucuugaucaggcuuucucaagcccuccaucggccccaccagaucuccauucuuugccaugaggg

SEQ ID NO: 46381 - RNA, 64 nt, Human
uccccggaaauaugagggaaaucucugcauugcaccaccagaggggcauaaauuugaaaguucu

SEQ ID NO: 46382 - RNA, 64 nt, Human
auguggcuaugucuuuuaggaagccacucuuagcccaccagagucugcccuuuggcccaaaauu

SEQ ID NO: 46383 - RNA, 64 nt, Human
gagcaacacaggauggucucugccaugaacuggaggccaggaaucuccucacugaaaauuacag

SEQ ID NO: 46384 - RNA, 64 nt, Human
uauaugcaauaucaggggaauaugcuaaauguuaccaccagagggcacaagcauaucacuuuua

SEQ ID NO: 46385 - RNA, 64 nt, Human
ggguuuuguuucuucugcuuguuucuguacagggccaccagacuccuggagagaucaagcaagg

SEQ ID NO: 46386 - RNA, 64 nt, Human
ggugagcaaccaguuggcuaggggagcagggggcccaccagagcuguggagaggggacccuaag

SEQ ID NO: 46387 - RNA, 64 nt, Human
uguagccaggugcaccucaggcugcacaaauaccccaccagaaugucacaaucauucauugcuc

SEQ ID NO: 46388 - RNA, 64 nt, Human
cacuugugcagugcuaagugucacaugucugcuuccaccagaggcuaggaauagugauccugcu

SEQ ID NO: 46389 - RNA, 64 nt, Human
uugggaaggaauggaagauggacaccaccggacaccaccagacacuaggaugggauggaugguu

SEQ ID NO: 46390 - RNA, 64 nt, Human
augccuacagacacuauucaacuuuggcaucuugccaccagaagacccgagggaggcucagcuc

SEQ ID NO: 46391 - RNA, 64 nt, Human
aauacccuacagauggggcauauccuaucccaucccaccagaggauugauucuccauuucacaa

SEQ ID NO: 46392 - RNA, 64 nt, Human
aguuuucuaccuacuccgaguguccuccccugccccaccagauugcugcaggggcgcggugugc

SEQ ID NO: 46393 - RNA, 64 nt, Human
uacaggcggauuagcuaucuuccaacaaugcugaccaccagacaauuacugcauuuuuccagaa

SEQ ID NO: 46394 - RNA, 64 nt, Human
acuggcuugaauuggugacauuuagucccucaagccaccagaugugacaguguugagaacuacc

SEQ ID NO: 46395 - RNA, 64 nt, Human
cccauaaaaagggagcuguggauccacuuagaucagggcggaaccaucuuucacccggccaagc

SEQ ID NO: 46396 - RNA, 58 nt, Human
gcgcgcuuggcugcuuauagacuguacuagggcggaggggauccgggccuugcgugca

SEQ ID NO: 46397 - RNA, 64 nt, Human
gauggggcacggcucugggguaggcugcucccugagggcggagcgccuccuuaggagugggguu

SEQ ID NO: 46398 - RNA, 64 nt, Human
ugaaacaggugaggucaggucacugcggacaucaagggcggacaccaccaaggggcccucugga

SEQ ID NO: 46399 - RNA, 64 nt, Human
agggagucaucgaagggcugcucggggagguggcagggcggaggaccugcuugggaagaaacuc

SEQ ID NO: 46400 - RNA, 64 nt, Human
agaacugggcccguggagcagcagugucagcaucagggcggaagccuuaaagcagcagcgggug

SEQ ID NO: 46401 - RNA, 64 nt, Human
cuuauaauaaaaccaacaauacccucagacugaaagggcggaaguuauuaucugcaucuuuauc

SEQ ID NO: 46402 - RNA, 64 nt, Human
ggaggcugagacaggagagucgcuugaaccugggagggcggagguugcagugagccaggaucgc

SEQ ID NO: 46403 - RNA, 64 nt, Human
ugaaaaaguuaguguuaaaggaagugagucagggagggcggaguuuguuguaaggcaaucaccu

SEQ ID NO: 46404 - RNA, 64 nt, Human
uuuuuucucacucguuuuuguugcuccauuguaaagggcggaggucagucuuaguggccuugag

SEQ ID NO: 46405 - RNA, 64 nt, Human
guccauccugccacccccaaccauuugcacuacaagggcggaggcaccccgaagaaugaaaagu

SEQ ID NO: 46406 - RNA, 64 nt, Human
aguaaauuuuacugucgaaaaugcaaacuuggggagggcggaaacaucacacacaagguuucca

SEQ ID NO: 46407 - RNA, 64 nt, Human
uacagauaaaguauuacauguguuugauuuuaaaagggcggacauuuuauuaaaaucaauauug

SEQ ID NO: 46408 - RNA, 64 nt, Human
acgccuguaaucccagcacuuugggaggcugagaagggcggaucacgaggucaggagauggaga

SEQ ID NO: 46409 - RNA, 64 nt, Human
aggacucccccuaccugagcagagcagaagccccagggcggagcucccagccagcaugguccgc

SEQ ID NO: 46410 - RNA, 64 nt, Human
augccuguaauccuagcacuuuggaaggcugaggagggcggaucacaaggucaggagaucaaga

SEQ ID NO: 46411 - RNA, 64 nt, Human
uauacuugaaaugcauugugcugauguucuugacagggcggagggauuucucuuuccugagcuc

SEQ ID NO: 46412 - RNA, 64 nt, Human
auagagggaaacaacacacacuggggccuaugagagggcggaaggugggaggagggagagauca

SEQ ID NO: 46413 - RNA, 64 nt, Human
ucuuauuucugccucuaguuuuguaagcuccuggagggcggauaacaucuuauacuacucuugu

SEQ ID NO: 46414 - RNA, 64 nt, Human
cuggauagggccccacaggugacagggagccugcagggcggaucuggugaucaugggagccaga

SEQ ID NO: 46415 - RNA, 64 nt, Human
agaaggacgcugccggucccugagcgguguggagagggcggaagguggacuccagcgcagcuug

SEQ ID NO: 46416 - RNA, 64 nt, Human
cuccuucgugugagcaaagcgccgcgccucccucagggcggaacggaggcaacuuuccggaguc

SEQ ID NO: 46417 - RNA, 64 nt, Human
cuccucgccccuaggacgccaagggggaaaggagagggcggaaaaggaccagcgggauccggcc

SEQ ID NO: 46418 - RNA, 64 nt, Human
guguguggaagccacgggcucaagcagccaaggcagggcggacagugugagagagcuaguguaa

SEQ ID NO: 46419 - RNA, 64 nt, Human
cugugcccaggccagcuucgagcuacaugcaucuagggcggagaggcugcacuugugagagaaa

SEQ ID NO: 46420 - RNA, 64 nt, Human
aucugaguuagguuccagcauguaaagagcugggagggcggagaauucuuagcauacauucaga

SEQ ID NO: 46421 - RNA, 64 nt, Human
ggcuugaacagggaccaccccugcagagccagccagggcggagagccauacccuggccccagcg

SEQ ID NO: 46422 - RNA, 64 nt, Human
gucuggaggguucuuguugucccucccauuagccagggcggagacugucugagcugugcaggag

SEQ ID NO: 46423 - RNA, 62 nt, Human
ucugcaacucggaacucugaacccagggcggcagggcggaaggugcuccucaggcaccuccu

SEQ ID NO: 46424 - RNA, 64 nt, Human
gagacaguuguggugaggguugccacacacagugagggcggagcaggguggcugagggcacagg

SEQ ID NO: 46425 - RNA, 64 nt, Human
aacucuccacuuccccaacccuccccaggugggcagggcggagggagccucagccuccuuagac

SEQ ID NO: 46426 - RNA, 64 nt, Human
ugugccagccugcuaaguccuguaagaauagggaagggcggaggggggugggcagugacuaggg

SEQ ID NO: 46427 - RNA, 64 nt, Human
ccuaagggaggacacucagggccuguggccaggcagggcggaggccugcugugcuguugccucu

SEQ ID NO: 46428 - RNA, 64 nt, Human
gccaggcaggcgggcgccaccgccacccgcagcgagggcggagccggccccaggugcuccccug

SEQ ID NO: 46429 - RNA, 64 nt, Human
acaacauucaagucugcauucugcacaagauaggagggcggaagagucagaggacccugugcuu

SEQ ID NO: 46430 - RNA, 64 nt, Human
uucagucaccccgagaggagaggagguaacgaggagggcggacuccaggccccggcccagagau

SEQ ID NO: 46431 - RNA, 64 nt, Human
gaaacaggcgauaauuuuucagauguggcaauucagggcggaauaaugggcauugagaucuacu

SEQ ID NO: 46432 - RNA, 64 nt, Human
aggcccccugccccuuccccacaaacugggugauagggcggacuuaccuggcccagcccugccu

SEQ ID NO: 46433 - RNA, 64 nt, Human
ugcuugggagcugguuauuggugugguccuagggagggcggaaagggaggcacugccauuugga

SEQ ID NO: 46434 - RNA, 64 nt, Human
ugagagaggaagggacagcaggagugaggugaagagggcggagagagggggcaggcucggcacc

SEQ ID NO: 46435 - RNA, 64 nt, Human
acaccuguaaucccagcacuuugggaggccgaggagggcggaucacgaggucaggagaucgaga

SEQ ID NO: 46436 - RNA, 64 nt, Human
cucuggccuggaggguauggggcacacuuccccaagggcggacccagcaggaggaagcccagga

SEQ ID NO: 46437 - RNA, 64 nt, Human
gcgccgacggugcggggcgcuggggcagggccugagggcggaccggugguggggagcuggagcc

SEQ ID NO: 46438 - RNA, 64 nt, Human
acuacuaacccagcaaaucuaagcccaaggaagaagggcggaaccagaaguagggccucgacuu

SEQ ID NO: 46439 - RNA, 62 nt, Human
cagcaacaggacuggaaugacgcgguccagggagggcggaggcccaggagaccaaagggagg

SEQ ID NO: 46440 - RNA, 60 nt, Human
uccaggcucugcuccccugagcccaggcggagggcggaaggcugcuggggugcgcaggug

SEQ ID NO: 46441 - RNA, 64 nt, Human
gucccuggccaggcugagagaauugggcagggagagggcggaagggcuggcgaucgcuuggagu

SEQ ID NO: 46442 - RNA, 64 nt, Human
uucuuucucugucccuuccuuccagccacacuccagggcggaguuggaugaggcccguccggag

SEQ ID NO: 46443 - RNA, 64 nt, Human
gaccgcgccaucccagggcuggggaggagcggggagggcggaucucccuggccagcagggaugg

SEQ ID NO: 46444 - RNA, 64 nt, Human
uccaguccccuuugcagauccauagcugcucugcagggcggaagacaccuggggcgggaaagca

SEQ ID NO: 46445 - RNA, 64 nt, Human
cacguaggugucuaacacagaggagaguaggaacagggcggauaccugaaggugacuccgaguc

SEQ ID NO: 46446 - RNA, 64 nt, Human
ucccagucggagccuuucggggaucugggggaugagggcggaaggccuagcuccuuggaaaugg

SEQ ID NO: 46447 - RNA, 64 nt, Human
aagacgcggaccgcgugacauuaaggagagcucaagggcggaccgggcccuguguagagacccu

SEQ ID NO: 46448 - RNA, 64 nt, Human
agggucagagagacggacacaaggagccggcaggagggcggagcgaggauguccuuucccggga

SEQ ID NO: 46449 - RNA, 64 nt, Human
ugcuuuccauuggcugccagcugugugacaccacagggcggagucuguggaggccccgcccacc

SEQ ID NO: 46450 - RNA, 64 nt, Human
ccucuauacuuuguucuguugucugcgccugaaaagggcggaagaguuacaauaaaguuuacaa

SEQ ID NO: 46451 - RNA, 64 nt, Human
accaggagagaguccuguagcucuggggggaaagagggcggacaggccccucccucugcccucu

SEQ ID NO: 46452 - RNA, 64 nt, Human
ugcagaccgaggccuucuccaaagaaagguggugagggcggaggggccgcuccaggccccacag

SEQ ID NO: 46453 - RNA, 64 nt, Human
uccucgccacccuaagccccgggacaccuguuggagggcggaugggaucugccuagccugggcu

SEQ ID NO: 46454 - RNA, 64 nt, Human
cccucgucaccagccaucccucuggaccaggcagagggcggaccgggugggcaggggccugagg

SEQ ID NO: 46455 - RNA, 64 nt, Human
ggaggccccgcuccgucccaucggggcugcggccagggcggagggaggaagacccucaucucag

SEQ ID NO: 46456 - RNA, 64 nt, Human
uccagcauuuucccagcacugucugagccccaugagggcggagccacuccuuguaaauucagug

SEQ ID NO: 46457 - RNA, 64 nt, Human
agcucagccucagccuucaggccugagcaagugcagggcggagcuaccagcccaggcucagaug

SEQ ID NO: 46458 - RNA, 64 nt, Human
gugguggggugauggauacacaucuaucaggcacagggcggaggugggcaccacugaguugcac

SEQ ID NO: 46459 - RNA, 64 nt, Human
cagauuauagugguugaagucugugcaguacagaagggcggagcuuauucacacagcaccuuug

SEQ ID NO: 46460 - RNA, 64 nt, Human
cuugccaccugcuccuacccggccaggauggcugagggcggagucuauuuuacgcgucgcccaa

SEQ ID NO: 46461 - RNA, 53 nt, Human
cuaaucccuuccuccuauaauccagggcggaagggggccuggcuccauccggc

SEQ ID NO: 46462 - RNA, 64 nt, Human
uggccucuggggacauaaacggggcggcugggccagggcggaaggugcuccuguuucccuccuu

SEQ ID NO: 46463 - RNA, 64 nt, Human
ggaggccgggccuugggccacaggagaccagcucagggcggaaggucaggcuccccgcccccuc

SEQ ID NO: 46464 - RNA, 64 nt, Human
agcucgagggagaaccugaaggcccaggggguccagggcggaccuggggccccgaccaccaagg

SEQ ID NO: 46465 - RNA, 64 nt, Human
acuggaacgagggcgaggaacaccuggcccacccagggcggaaaaccgcuuaaagggguuccug

SEQ ID NO: 46466 - RNA, 62 nt, Human
acccaaggcuccagugcugacucucauuggggagggcggaggugcugaccuggccugggccu

SEQ ID NO: 46467 - RNA, 64 nt, Human
uaggcuguggccugccaccuuccuuagagugaauagggcggacacuccucucuuuuccuguagc

SEQ ID NO: 46468 - RNA, 64 nt, Human
cugguuccaaaguaaagccagcuucuccucucccagggcggaaacagcauuugccuucugagag

SEQ ID NO: 46469 - RNA, 64 nt, Human
gggacuauucucaggcugaagaaggugggaggggagggcggaaccugaggagccaccugagcca

SEQ ID NO: 46470 - RNA, 64 nt, Human
acagccgcagcucuguucagcggagcagccagccagggcggaugagcagagccggcccugagga

SEQ ID NO: 46471 - RNA, 64 nt, Human
ugugcuguccuuccuaggggugcaggaaguggacagggcggaggguuugaaagaauauugagcc

SEQ ID NO: 46472 - RNA, 64 nt, Human
ggauguuggggcucugaccccaggagugggguggagggcggagccugcugggggcccugccuuc

SEQ ID NO: 46473 - RNA, 64 nt, Human
aagcagacaggaugcagcgcugacuucuuaggucagggcggaggugugcaggagcccaguuacg

SEQ ID NO: 46474 - RNA, 64 nt, Human
uaggcagauaauccaccucccuaucccccaggcaagggcggagcaugugucuugggcccacacc

SEQ ID NO: 46475 - RNA, 64 nt, Human
cauucaccagaaucucaaggagcugcuggccgucagggcggagcugcagaagcguguggagggc

SEQ ID NO: 46476 - RNA, 64 nt, Human
uuuggggcacaacaucccaccgcagucccccucacccgacaacaccuccuaccuggccccuugc

SEQ ID NO: 46477 - RNA, 64 nt, Human
ccugccccacacggacucccgggccacgccccagcccgacaaugucgaguauauuauuauuaau

SEQ ID NO: 46478 - RNA, 64 nt, Human
ucaaauaaaaaaccacaagguucgagccgccgggcccgacaaacuccgggucggcgaaacagag

SEQ ID NO: 46479 - RNA, 64 nt, Human
cgccggcgcuccaccguggcuacccauccguggucccgacaaccucccugucccuugcccgccc

SEQ ID NO: 46480 - RNA, 64 nt, Human
agagaccuugcgaccauguguagauugcguggaccccgacaaagggaaggcugcuguguagcuc

SEQ ID NO: 46481 - RNA, 64 nt, Human
gcagguuaacuggcgguaagugcuagacuguaagcccgacaagggcagggcuuuugguuuuguu

SEQ ID NO: 46482 - RNA, 64 nt, Human
uucugcuaugcaauaagaauacuuaauucuaguucccgacaagccaguugcaauauccccuaag

SEQ ID NO: 46483 - RNA, 54 nt, Human
uuucccgcucucaccuuugaggcccccgacaaagacagaaagaaggagcuaucc

SEQ ID NO: 46484 - RNA, 64 nt, Human
acuugcuggaauucaagugaaaaugggcuccucccccgacaauccuguccuuguguuugugugu

SEQ ID NO: 46485 - RNA, 64 nt, Human
caccaccgagcuggccgagcaccgcucauauccccccgacaagaaggucaaagccaaggacguc

SEQ ID NO: 46486 - RNA, 64 nt, Human
cauacacggacacaucaucggcaugggccugucgcccgacaacaggugggccucuugccagugu

SEQ ID NO: 46487 - RNA, 64 nt, Human
aagguacagcucgccugccugccccaaucccagccccgacaaucacaugcagcugacucggaca

SEQ ID NO: 46488 - RNA, 64 nt, Human
uguuagcacagugccugccacaaaaacaagugcccccgacaagauaguugcuauguuaugacac

SEQ ID NO: 46489 - RNA, 64 nt, Human
gacuccaaugcccagcuccucuccccaaaacaaucccgacaaucccuuaucccuaccccaaccc

SEQ ID NO: 46490 - RNA, 64 nt, Human
caggcgggccgcgguuccuccuuagggccuucuccccgacaaggaguccgacggggcggaugcu

SEQ ID NO: 46491 - RNA, 64 nt, Human
agaggcugcugauggauggcuacuuugcucagugcccgacaacgaagaauccagaagcuguccc

SEQ ID NO: 46492 - RNA, 64 nt, Human
ucccccugcacggaugccgacggccgggccccuccccgacaagccucccagggccccggcaccc

SEQ ID NO: 46493 - RNA, 64 nt, Human
cccguggcaggaggagggcucagggagcugagaucccgacaagcccgccagccccagccgcucc

SEQ ID NO: 46494 - RNA, 64 nt, Human
caacacccucucaacaccccccucccucaaccaccccgacaaccacuacagaaccaacauugug

SEQ ID NO: 46495 - RNA, 64 nt, Human
acacuacggggacuggggucgucuuugcccacgucccgacaacuuguucccugacccccucagg

SEQ ID NO: 46496 - RNA, 64 nt, Human
uagcuauuuagagauauuuuccauuuuaagaaaacccgacaacauuucugccagguuuguuagg

SEQ ID NO: 46497 - RNA, 64 nt, Human
gcgugugaaggaagagcaucuagacguggccucgcccgacaaggcuucaaguccagagcugccu

SEQ ID NO: 46498 - RNA, 64 nt, Human
ggggaggaccccucagcuuugcucucagcaggggcccgacaagcucagugggcaguggcaggaa

SEQ ID NO: 46499 - RNA, 64 nt, Human
cuucuaaaagccccaacacaugacgccaucugaagacccgcaacggaguggggguggcggccgc

SEQ ID NO: 46500 - RNA, 64 nt, Human
ucugguagcagcauaaagguuaggcaaucacugggacccgcaugguguuccuccaaagaauagg

SEQ ID NO: 46501 - RNA, 63 nt, Human
cuauuaguacagacguguaaauccuuccaccccgacccgcacacacacccacacugcugcccu

SEQ ID NO: 46502 - RNA, 64 nt, Human
agggaaacuaggauccagccaaggcccggggggagacccgcauguugcuuggucugcucaaguc

SEQ ID NO: 46503 - RNA, 64 nt, Human
auggagaggcaguacgcauccuuacccaggggaggacccgcagauccuguagacuaucugccag

SEQ ID NO: 46504 - RNA, 64 nt, Human
cgccccgccccugcggccccaccagguacugaaagacccgcaggcugagcggguagaacagccg

SEQ ID NO: 46505 - RNA, 64 nt, Human
ucauuugaaugucauugcuucuccggugccucccgacccgcaucgccggcccugguuucucugg

SEQ ID NO: 46506 - RNA, 64 nt, Human
aaggcauauugaguuauuuugcagaaucauaauggacccgcacaaaaucucagaaccauaucug

SEQ ID NO: 46507 - RNA, 64 nt, Human
cagcucuccccacagggccccucagcaucauggagacccgcaggcggggcuuagccaccccuca

SEQ ID NO: 46508 - RNA, 64 nt, Human
cuuugagcaguaaauugcuggcugugcugccagggacccgcagcccugguggaaaagccaguag

SEQ ID NO: 46509 - RNA, 64 nt, Human
ccccaguccaagcccuugaccucuccucuauccagacccgcacagcuguuuccuguguggaugg

SEQ ID NO: 46510 - RNA, 64 nt, Human
uuggcuuaacccuucuggaagggucugacugugugacccgcagcaaauaguucauguuggaaag

SEQ ID NO: 46511 - RNA, 64 nt, Human
caccagcucccuccugcuggcacccagagacccggacccgcagggccugccugguuccuggaag

SEQ ID NO: 46512 - RNA, 64 nt, Human
cccguacccggccugcggagggaggggacagcuggacccgcaggggaggucccuuucuuccuga

SEQ ID NO: 46513 - RNA, 64 nt, Human
agggcccuccuagagccaggugggaguggggagcgacccgcagcugcucacuccaccuugcgcg

SEQ ID NO: 46514 - RNA, 64 nt, Human
uccccacuccuugugugcacacaugcagaggugagacccgcaggcucccaggaccagcagccac

SEQ ID NO: 46515 - RNA, 64 nt, Human
caccuucacucuccaggguacaugcuuuaaaaccgacccgcaacaaguauuggaaaaauguauc

SEQ ID NO: 46516 - RNA, 64 nt, Human
uucuuguagcgccugcacaccuggguguugcagggacccgcagcucccgugcggcaccggcccu

SEQ ID NO: 46517 - RNA, 64 nt, Human
cuggaucaugucccauccaguccagugaauccacgacccgcagaccuguccccccgcaacagcu

SEQ ID NO: 46518 - RNA, 64 nt, Human
ccccaagugccuucccucaugccugggccggccugacccgcaaugggcagagggugggugggac

SEQ ID NO: 46519 - RNA, 64 nt, Human
gugugaaaccaagaaacacucuguacugugugcggacccgcagugacggccaguaaaguggacu

SEQ ID NO: 46520 - RNA, 64 nt, Human
gcgagcaggccugugaauucgcaggaucauuucagacccgcacuucggcagccaacucgaaagc

SEQ ID NO: 46521 - RNA, 64 nt, Human
cucaacacuuguccagacaccucuggccagguuggacccgcacacuuacuuucaucuauguugg

SEQ ID NO: 46522 - RNA, 64 nt, Human
uugaacuguuaagauuagacauuugaauucuguugacccgcacuuuaaagcuuuuguuugcauu

SEQ ID NO: 46523 - RNA, 64 nt, Human
cggccgagagcccuacagagaagcuggcugguaggacccgcagggaccagcugaccaggcuugu

SEQ ID NO: 46524 - RNA, 64 nt, Human
cuuguuuuacuguauugagcggcggcacccgccggacccgcauuauggcugggggcgccagccc

SEQ ID NO: 46525 - RNA, 64 nt, Human
ugcugggacccgaguaggagcuaggacuagccaggacccgcagccgccucgucaccuccaguug

SEQ ID NO: 46526 - RNA, 64 nt, Human
gccggacagaguucgcuccugugagaagaaaacugacccgcaggcuccucccagauugaaccga

SEQ ID NO: 46527 - RNA, 64 nt, Human
ggcgugucugugaagacagguaccaggauggcaggacccgcacgccucuucccacaccugucag

SEQ ID NO: 46528 - RNA, 64 nt, Human
acugcuuugucugugcugguaguuugugagaagugacccgcacgcuuccauuugaugcauuuga

SEQ ID NO: 46529 - RNA, 64 nt, Human
ccugccgcggggcucucugggccgguucccugcagacccgcaggagagcacaugugccuugcau

SEQ ID NO: 46530 - RNA, 64 nt, Human
ucagaagguggaauucuagugauaggcgaccucagacccgcauucauguucugugugccucuuc

SEQ ID NO: 46531 - RNA, 64 nt, Human
cgcggcucgcgcccaccgggguccuggcgggugggacccgcagccuccacgcggcccaggccag

SEQ ID NO: 46532 - RNA, 64 nt, Human
ugaggaagcgccgcuccaccgucugcccuccaaggacccgcauggaggcagugggcuggcagcu

SEQ ID NO: 46533 - RNA, 64 nt, Human
gacagggcugugccggccugggccagggcccacggacccgcagcucagggcgccugcccacguc

SEQ ID NO: 46534 - RNA, 64 nt, Human
ucugagcggacguuaaaaugggcccccgucccccgacccgcacccuccuuccucagggcacuua

SEQ ID NO: 46535 - RNA, 64 nt, Human
gaaccacacaccccacugggccggccacagucuggacccgcacguccuguucaaaagcagacuc

SEQ ID NO: 46536 - RNA, 64 nt, Human
ggggguccggaagggugaucaucgacccccaagggacccgcagacccuuaaaaaaaucacccac

SEQ ID NO: 46537 - RNA, 64 nt, Human
uguuaauggguuuaauggagagggcggcgaagaggacccgcaggcugcaaggagcaacagcgau

SEQ ID NO: 46538 - RNA, 64 nt, Human
aaccugucacuaauacagcugccugugacccugggacccgcaaccuuccagcugcuucccuuug

SEQ ID NO: 46539 - RNA, 64 nt, Human
ggcagguuugcagagagagacccagagugcacgugacccgcagugugaucccuggcacgcacug

SEQ ID NO: 46540 - RNA, 64 nt, Human
accggccagcaucuuccgcacaccccugcagcucgacccgcagcaggagcagcagcuguuccgg

SEQ ID NO: 46541 - RNA, 64 nt, Human
auccccacgccucggggcccccgccgccccuccggacccgcagagcuggggacauggcaugccc

SEQ ID NO: 46542 - RNA, 64 nt, Human
cccccauucccagagcagacccucuccccagaaggacccgcaggcccuuguuauugccucgcuu

SEQ ID NO: 46543 - RNA, 64 nt, Human
gcuugucacccggcuccccccaccccuucauuuggacccgcagcugcugugcugcucugugcca

SEQ ID NO: 46544 - RNA, 54 nt, Human
agccuggcgggcggagcuaagggccuccaccagcauccgagcaggaucaagggc

SEQ ID NO: 46545 - RNA, 64 nt, Human
ggcuccucugcaccccgugauucugcccacgcuccuccaccacgaggcacugaccugcgucggg

SEQ ID NO: 46546 - RNA, 64 nt, Human
ccacccuccaguguuggcacaggcccaccccuggcuccaccagagccagaagcagagguagaau

SEQ ID NO: 46547 - RNA, 64 nt, Human
cgcuaagaagucucccuuccagcuguuccauucucuccaccaccagcguaacuggcaaguuacc

SEQ ID NO: 46548 - RNA, 64 nt, Human
cuacccggguuccccucucuuuaauuuggagacacuccaccacaaacuuuucacuuuagaggua

SEQ ID NO: 46549 - RNA, 64 nt, Human
gcgaagaagaacccuguguucucaggaagacugccuccaccaccgcuacccagagaaccucugc

SEQ ID NO: 46550 - RNA, 64 nt, Human
agcugugggcccaggagccagcucaggugcuccccuccaccaugggcaggcugugcaaaaagcc

SEQ ID NO: 46551 - RNA, 64 nt, Human
gaagcgagaagacuuauaaccaccgcgucuccuccuccaccaccucaucccgcccaccugugug

SEQ ID NO: 46552 - RNA, 64 nt, Human
cucuuguuccgugccaggcauucaauccucaggucuccaccaaggaggcaggauucuucccaug

SEQ ID NO: 46553 - RNA, 64 nt, Human
ccucccuggccauccuccuggaauguggucugcccuccaccagagcuccugccugccaggacug

SEQ ID NO: 46554 - RNA, 64 nt, Human
augacucacuugucaacuaguggacuaauuaacccuccaccaaaaaaacacaaagugcuucugu

SEQ ID NO: 46555 - RNA, 64 nt, Human
agaagaguagaaaauggguucaacuccuguuucgcuccaccaacaccucugugagucucaucau

SEQ ID NO: 46556 - RNA, 64 nt, Human
aguuuggaugaugcuaguuagaucauuugcaucucuccaccauuuucuucugcacucccauuuu

SEQ ID NO: 46557 - RNA, 64 nt, Human
cuaaggaccuguguucagccacacccagugguagcuccaccaaaucaugaacagccuaauuuug

SEQ ID NO: 46558 - RNA, 64 nt, Human
ccucuucuggacccagccuggucugcacugcaaccuccaccaggaccaggauccugggccacag

SEQ ID NO: 46559 - RNA, 64 nt, Human
acgaaaccucuuuuguuguccuugccccacuccucuccaccagacgccuuccucucuggauacu

SEQ ID NO: 46560 - RNA, 64 nt, Human
uugaaacguuugcaacaugaucaagguguuaguucuccaccacacaaguuguauucuucuuuug

SEQ ID NO: 46561 - RNA, 64 nt, Human
uccacccggacacguggaacccggccuggucugucuccaccauccugacugggcuccugagcuu

SEQ ID NO: 46562 - RNA, 64 nt, Human
guuucccucugcuguggguucugggcugucaugucuccaccacuuaaggaugucuuuacacuga

SEQ ID NO: 46563 - RNA, 64 nt, Human
cucuccugugucuguccuccggaccuacccaggucuccaccaucaggacccugucuuuggguuu

SEQ ID NO: 46564 - RNA, 64 nt, Human
ggaggauucgagcaucaggcuaagacccuguguccuccaccaugcacucaccccuagcccuggu

SEQ ID NO: 46565 - RNA, 64 nt, Human
uggagaguacauuugcuuuaaugagugcaccugccuccaccagcaaggggaccccgagaacccu

SEQ ID NO: 46566 - RNA, 64 nt, Human
acaccaucacacugaaccacaggacagacccuuucuccaccacagccaaggccuggagacuggg

SEQ ID NO: 46567 - RNA, 64 nt, Human
acgcaccuuccuuggccagcuccauucuggccuccuccaccaccugccuugugaccacaucucc

SEQ ID NO: 46568 - RNA, 64 nt, Human
agaauucaugugagaaagcuaaaaugguggucuucuccaccagccccucacaggcuuggggguu

SEQ ID NO: 46569 - RNA, 64 nt, Human
aggcaguucccaaguggagggucggggcagaggccuccaccaaggccaucaauaaccaggugug

SEQ ID NO: 46570 - RNA, 64 nt, Human
uuggaugcucuggggagcucauggguggaggagucuccaccagagggaggcucaggggacuggu

SEQ ID NO: 46571 - RNA, 64 nt, Human
aguuaccugaaagcugcaguucacaggcuccucucuccaccaaauuaggauagaauaauugcug

SEQ ID NO: 46572 - RNA, 64 nt, Human
ccuuuaccuccaacccuucuguucaucgggagggcuccaccaauugagucucucccaccaugca

SEQ ID NO: 46573 - RNA, 64 nt, Human
ugaccuuugggacauugggaauacccagccaacucuccaccaucaauguaacuccauggacauu

SEQ ID NO: 46574 - RNA, 64 nt, Human
ggcaggauaagugaccacauauuuaugccacuaccuccaccagggagaguccuucuccacaggc

SEQ ID NO: 46575 - RNA, 64 nt, Human
uuacuuguccugucacuggaucugggcuaaaguccuccaccaccacucuggaccuaagaccugg

SEQ ID NO: 46576 - RNA, 64 nt, Human
gggccgaggcgcucaucagguccagccugggcuccuccaccagcuccacccugagcuuccucuu

SEQ ID NO: 46577 - RNA, 64 nt, Human
uguggcccuguguccaguggcccacaggacacgccuccaccauaugcucauccuuccugccuga

SEQ ID NO: 46578 - RNA, 64 nt, Human
acggggggagcccucucucccuuacccucucacucuccaccagauguuuacuaaacagggcaug

SEQ ID NO: 46579 - RNA, 64 nt, Human
aaaaaaaggaaaugucuguauugguuggaugaaacuccaccagagcacagcuuagcuggggcga

SEQ ID NO: 46580 - RNA, 64 nt, Human
cccucccgugcauggcugcccccccguucauuuucuccaccacagccgcuugcacguauagaua

SEQ ID NO: 46581 - RNA, 64 nt, Human
acagccucuccugcgggccagcccgcugcgaacccuccaccagcuaccggagggaggagggagg

SEQ ID NO: 46582 - RNA, 64 nt, Human
ugcauuugaaauaaguggacacaaacuauccuuucuccaccauggacucaaucugagaacaaca

SEQ ID NO: 46583 - RNA, 64 nt, Human
gagcggcaggccuugaggcugucgucgagggcuccuccaccaccggccggcucccaagccagcg

SEQ ID NO: 46584 - RNA, 64 nt, Human
uucaagcaaaaauuggaauuuccgaaaaucuguacuccaccaugagcuuuauuguuggggauau

SEQ ID NO: 46585 - RNA, 64 nt, Human
aauccucagcaguuguucuccaccccuucuccaccuccaccagcaaggagaagucaaucuacac

SEQ ID NO: 46586 - RNA, 64 nt, Human
ugagcaauuaaaagcaaaccgcgacacccuuugucuccaccacacauaguguacuuuggaagca

SEQ ID NO: 46587 - RNA, 64 nt, Human
cugaaguaauuccauaaagggcccagacagccuccuccaccauucccuucaucauucauuuaac

SEQ ID NO: 46588 - RNA, 64 nt, Human
gugaacaagccccuaggcccacagucuggcagaccuccaccagccccaggaguugauaggugau

SEQ ID NO: 46589 - RNA, 64 nt, Human
ccgugggcagugccacccgcagaugacacgcgcucuccaccacccaacccaaaccaugagaauu

SEQ ID NO: 46590 - RNA, 64 nt, Human
cuccuuccccaguuguucccuucagacucaggggcuccaccaaugccaucccaaaacaggguca

SEQ ID NO: 46591 - RNA, 64 nt, Human
ucaagcccuauuuauaaacaaauacuuuuccugccuccaccaaaccccuacagaacaucaccug

SEQ ID NO: 46592 - RNA, 64 nt, Human
gacagagagacagagcagcccugcacuguuuucccuccaccacagccauccugucccucauugg

SEQ ID NO: 46593 - RNA, 64 nt, Human
uauaauugccccagggccugauucaggacugacucuccaccauaaaacuggaagcugcuucccc

SEQ ID NO: 46594 - RNA, 64 nt, Human
ggcuaucccugaaagagggaggacuccgcugcagcuccaccaauaaacuugugucucacugcau

SEQ ID NO: 46595 - RNA, 64 nt, Human
ugaucacagcccccugcgggcaggggggcucucccuccaccaacucucaaggcuccucagccua

SEQ ID NO: 46596 - RNA, 64 nt, Human
aagagaauuaaugaugagguuacaugcugcuugccuccaccagauguccacaacaauaugaagu

SEQ ID NO: 46597 - RNA, 64 nt, Human
uaccccaccccacaugguugacucuuucccucagcuccaccagcucuucaucaugccacucauu

SEQ ID NO: 46598 - RNA, 64 nt, Human
ccaggugaagaucugagcccagaaaugacccuuccuccaccacaccccuccuuugaggacgccc

SEQ ID NO: 46599 - RNA, 64 nt, Human
ccccaacguagaccugcaggugcugccccaugaccuccaccaaagcccauauaaggagcggagu

SEQ ID NO: 46600 - RNA, 64 nt, Human
aaggucuucccauccccuuuagauucgugccucacuccaccagugaggaagaugccucugucuu

SEQ ID NO: 46601 - RNA, 64 nt, Human
aaaaggaaaggcugauguuuccauauagcuugcucuccaccaggccuaucauuuuucuuuuuag

SEQ ID NO: 46602 - RNA, 64 nt, Human
agagcugggcggcguccacaccuaagaacagcagcuccaccaaaugaagucccucucacgcagc

SEQ ID NO: 46603 - RNA, 64 nt, Human
uucccaguggccugggagaggcagugagccuucucuccaccaccauagacagguguuaaugcau

SEQ ID NO: 46604 - RNA, 64 nt, Human
ucugggggcuuguuuugguuugggggcagccauccuccaccagaaagggggagcuccuuccgcu

SEQ ID NO: 46605 - RNA, 64 nt, Human
caagcucaguuaaaucccccaccuccaacuuucccuccaccagugugcuugggaucuucaauga

SEQ ID NO: 46606 - RNA, 64 nt, Human
cggguucuccuuucuuuccucaccccaaccuuuacuccaccagagaaacuuccuuuugaacuca

SEQ ID NO: 46607 - RNA, 64 nt, Human
cuuuccucuagaagaccugagucuuccugaccgacuccaccaucacccaaucuguugauucucc

SEQ ID NO: 46608 - RNA, 64 nt, Human
ggucagaaacagaggugucccaucccauugcagccuccaccaccuguaaccccuuccuggcauu

SEQ ID NO: 46609 - RNA, 64 nt, Human
ugcgggcugugguggccgugccugagcugcagcucuccaccagcuggguggacuuugggaccug

SEQ ID NO: 46610 - RNA, 64 nt, Human
guccaguugccucccuagcuuguguguggccugccuccaccauagcagggacuagggagggagg

SEQ ID NO: 46611 - RNA, 64 nt, Human
agcugcuugugggggcaccugggaggucaaaggucuccaccacaucaaccuauuuuguuuuacc

SEQ ID NO: 46612 - RNA, 64 nt, Human
aaggccuuccaaacagcuccgucgccccuagcaacuccaccauugggcacugccaugcagagac

SEQ ID NO: 46613 - RNA, 64 nt, Human
ucucuucucuuggcucacucccuugccucucccccuccaccaccaccuugugacugaugguuug

SEQ ID NO: 46614 - RNA, 64 nt, Human
aguucauuucaucauuuucuguugcaggaagccacuccaccacagaaugcuaauaugccagugg

SEQ ID NO: 46615 - RNA, 64 nt, Human
acuuagaagaaaaugaggauucuuaagggagccacuccaccaugcuauuaagacucuggcagag

SEQ ID NO: 46616 - RNA, 64 nt, Human
cucagccucccgaguagcugggauuacaggcaugcuccaccaugcccagcuaauuuuguauuuu

SEQ ID NO: 46617 - RNA, 64 nt, Human
gccagggggccagucccugaggcagguccccagacuccaccaagccuggucagcccaaaccacc

SEQ ID NO: 46618 - RNA, 64 nt, Human
ugccuuugugccuaugcuuccacuuuccuuuucccuccaccaugaagauggguuaagagucuca

SEQ ID NO: 46619 - RNA, 64 nt, Human
uacacgcuuucugcauguauuagaaacgcacgagcuccaccaagucuacaaugaaaguuugaaa

SEQ ID NO: 46620 - RNA, 64 nt, Human
gcuggggagaggccccgccucuggugggcuuggccuccaccaccucccacgcuucugagaagag

SEQ ID NO: 46621 - RNA, 64 nt, Human
cacugucaucaaacuggccauguccuggccccgucuccaccaaccuuugugugacaaaaacaag

SEQ ID NO: 46622 - RNA, 64 nt, Human
auucuagcccucauggcugaaggcccaguccuggcuccaccacuccuccagccagagggucugg

SEQ ID NO: 46623 - RNA, 64 nt, Human
gucuauggugugacaucaccuuauucacagacaacuccaccaauuguacagguaacuaauucug

SEQ ID NO: 46624 - RNA, 64 nt, Human
uuggugggacauucuacagaaccccuuucugccccuccaccaguaccaguggugccacaugugg

SEQ ID NO: 46625 - RNA, 64 nt, Human
gaaggaggagagccccaugcuuccugucugccuccuccaccaucccugaccucaguugagcugc

SEQ ID NO: 46626 - RNA, 64 nt, Human
cguauuuuuaacagaagacagugcaacaacuggucuccaccaguauuugucacuuuauuuuuuu

SEQ ID NO: 46627 - RNA, 64 nt, Human
guggaucugccgaauugaagaggccugauuucagcuccaccagaugcagauuuguguuuuguuu

SEQ ID NO: 46628 - RNA, 64 nt, Human
uuuucaaagaugcaaaaugguguuauuuaauugucuccaccauugucacacacaggaaugccua

SEQ ID NO: 46629 - RNA, 64 nt, Human
ccuggcgggccacccugccagccagcagcuggcccuccaccaucuucacauuccaagacuggcc

SEQ ID NO: 46630 - RNA, 64 nt, Human
uuaaacuacaggcaaacauagcccacgggaauaucuccaccauuucucuauguacuuuauaugc

SEQ ID NO: 46631 - RNA, 64 nt, Human
uuagcagggugcuaacguaucucuaggcuguuuucuccaccaacuggagcacugaucaauccuu

SEQ ID NO: 46632 - RNA, 64 nt, Human
gcaaggaaauggccaguuaaguagugucuucucucuccaccaaaaagaggaagugccuccagcu

SEQ ID NO: 46633 - RNA, 64 nt, Human
acaauccagaggacgacuucaggaugcccaauggcuccaccauucccccagggagcccugagga

SEQ ID NO: 46634 - RNA, 64 nt, Human
aaguuaucuuuuaguuuauucugguuuggagucccuccaccaagauucaguagaagaaauacag

SEQ ID NO: 46635 - RNA, 64 nt, Human
uuugccuuuuaaacaacuaggauucccuacuaaccuccaccagcaaccuggacugccucagcau

SEQ ID NO: 46636 - RNA, 64 nt, Human
uuuuauccacaguaaaucuucagcaacucauugucuccaccagauaguauuuuucuguaaauga

SEQ ID NO: 46637 - RNA, 64 nt, Human
acaaucguuaguaacuguauaaaaacucaugcugcuccaccagugggccuuggaaaaugcauca

SEQ ID NO: 46638 - RNA, 64 nt, Human
cgcacuaagaugugaggaaauugugauuuguucucuccaccacaaaugaauuacacauuuauua

SEQ ID NO: 46639 - RNA, 58 nt, Human
uagugacaugugagaaauaaaauagcagcuccaccauggacuucaggcuguuaguggc

SEQ ID NO: 46640 - RNA, 64 nt, Human
ccuaucacgguacagcacgaagccaggcuccuuucuccaccaaagaagauggaaccagacugga

SEQ ID NO: 46641 - RNA, 64 nt, Human
ggcaucagacccucucccuggcccuuguuuuccucuccaccauggagccucauuuuguaggcca

SEQ ID NO: 46642 - RNA, 64 nt, Human
uccuagacucugugaucugaggguauaaagacaucuccaccaagucugagcccucaaaaugucc

SEQ ID NO: 46643 - RNA, 64 nt, Human
uccaggaagggagccauugcccagugguccauaucuccaccacauccccugcuugagcccagcg

SEQ ID NO: 46644 - RNA, 64 nt, Human
uuccucuagcaaauacuucuuucuccuugcuugccuccaccaugauauuugaauaagagauggc

SEQ ID NO: 46645 - RNA, 64 nt, Human
acggcaagcccagcaucgccucagcccagacaggcuccaccaggagaucaagcaagggcugccu

SEQ ID NO: 46646 - RNA, 64 nt, Human
accuucuaaccauucucuccacugccagccuacccuccaccacuucacaaguccugccagauua

SEQ ID NO: 46647 - RNA, 64 nt, Human
caagcuccaugugguggggacagcgcauugcgaccuccaccaccccugcagugggcugccagcu

SEQ ID NO: 46648 - RNA, 64 nt, Human
ccacaauuuagccaugucaucugguggugaccagcuccaccaagccccuuucugagcccuuccu

SEQ ID NO: 46649 - RNA, 64 nt, Human
uaugguagcuggacuuccccagggcccucuuccccuccaccacacccagguggacuugcagccc

SEQ ID NO: 46650 - RNA, 64 nt, Human
aaaagcaagggaccuucaugcccuucugauuccccuccaccaaaccccacuuccccucauaagu

SEQ ID NO: 46651 - RNA, 64 nt, Human
cugagccaaaggggucagaaauucugcccuuugccuccaccacauggcauucugguuuugguuu

SEQ ID NO: 46652 - RNA, 64 nt, Human
agcuuuuccccuggggcuccaggaccuucccuaccuccaccaccaaaccaagggauuuauagca

SEQ ID NO: 46653 - RNA, 64 nt, Human
aagagaaugauggauauucuggcucuggggcccucuccaccaccacucacaguagccuugcuga

SEQ ID NO: 46654 - RNA, 64 nt, Human
cugccccacccaccuuauccucccaccccacucccuccaccaccacagcacaccggugcuggcc

SEQ ID NO: 46655 - RNA, 64 nt, Human
auagguggaacgaggagacgggagcgagugggcucuccaccagcacaucacuaugcaucuguuc

SEQ ID NO: 46656 - RNA, 64 nt, Human
cuuuuuacugucaucacuucuauagauuuccuaacuccaccaugccuauuucugguuauauaau

SEQ ID NO: 46657 - RNA, 64 nt, Human
cccgccggcuguccacagcggacccugcugaugccuccaccaucuaugcaguuguaguuugaag

SEQ ID NO: 46658 - RNA, 64 nt, Human
aaccucuucuuccuccccugcccugcuucccuuccuccaccacccugcucucaaaggccuccuc

SEQ ID NO: 46659 - RNA, 64 nt, Human
gacuuuuucugcaauugcagucuuaagcuucacucuccaccaccuggauggcauggcgccugcc

SEQ ID NO: 46660 - RNA, 64 nt, Human
ucucugucucaccuucauccacucugcaggccugcuccaccacagcccuaauccucuggacgcu

SEQ ID NO: 46661 - RNA, 64 nt, Human
aacugcccagccccuuuucucugcucuuguuucacuccaccaucacucacucacuccccacucc

SEQ ID NO: 46662 - RNA, 64 nt, Human
cagcugcagccuccucccccugagcauucauucucuccaccaggccuccagguccugagcccuu

SEQ ID NO: 46663 - RNA, 64 nt, Human
cuaaaacugagguggggauggggagaggcuuugccuccaccauucccaccccacccuccccuua

SEQ ID NO: 46664 - RNA, 64 nt, Human
uuucaggaauuuuguaaucucauaacuuuccaagcuccaccacuuccuaaaucuuaagaacuuu

SEQ ID NO: 46665 - RNA, 62 nt, Human
aaucugacucuauuauuuaauaucuuacauaccuccaccagacuggacuugcuuuuugaauu

SEQ ID NO: 46666 - RNA, 64 nt, Human
guucacaguggaguaugguguucggcaaaaggaccuccaccaagacugaaagaaacuaauuuau

SEQ ID NO: 46667 - RNA, 64 nt, Human
uauagaaugcauaccuuccucccucuagacaucccuccaccagaagagacaucuauuuaaaggc

SEQ ID NO: 46668 - RNA, 64 nt, Human
cucagccucccaaguagcucggacuacaggcguccuccaccaugccuggcuaauauuuuguauu

SEQ ID NO: 46669 - RNA, 64 nt, Human
uaauagaaccuguaacuucauuuuggaaaugcuucuccaccaaauaagggcuuuuuccccuauu

SEQ ID NO: 46670 - RNA, 64 nt, Human
caggugggcaccccccacuuuggugcuaauagcucuccaccagguggugugagcgcgggggcug

SEQ ID NO: 46671 - RNA, 64 nt, Human
ugaguuuuucuaauuaugaagcaaaauuucuuuucuccaccaugcuuuaugugauaguauuuaa

SEQ ID NO: 46672 - RNA, 64 nt, Human
gccugcccaaggacugugcaaccuaucuguuccucuccaccaguguaucccaaguagucuggua

SEQ ID NO: 46673 - RNA, 64 nt, Human
uuagguuuucaaucaaguuauugauuccaaagaacuccaccaggaauuccugugacggccuguu

SEQ ID NO: 46674 - RNA, 64 nt, Human
accaugguaauggacagaguuaucaaggcacauucuccaccacugucacaggaaggacauguca

SEQ ID NO: 46675 - RNA, 64 nt, Human
guauuggcaacuuuggcacaccagaauuuguaaacuccaccaguccuacuuuagugagauaaaa

SEQ ID NO: 46676 - RNA, 64 nt, Human
agcucugucaccugagauccagccagagacccuccuccaccauccacagucaauggcugugcuu

SEQ ID NO: 46677 - RNA, 64 nt, Human
caccggcacugaucggggcaccgccuggcccagccuccaccagggaccccuccucaugaacucu

SEQ ID NO: 46678 - RNA, 64 nt, Human
auaaguccuuucaauuccaccagggccagagcagcuccaccacugugcacuuagccaugauggc

SEQ ID NO: 46679 - RNA, 64 nt, Human
gcaguuggcaguagcugccgaugucuguccccagcuccaccauuccucccuguggcugugccgu

SEQ ID NO: 46680 - RNA, 64 nt, Human
uuuccuuuuacuacuaccaguugcucccaugcugcuccaccaggcccuguuucggaugccaacu

SEQ ID NO: 46681 - RNA, 64 nt, Human
uuuaaaaagauuaagcaagugaaauucugcugcccuccaccauuuauuuuuacagugcuuugua

SEQ ID NO: 46682 - RNA, 64 nt, Human
ccucccgauggcugcauucccugguccuccgccucuccaccagcccccuccucauuaaagggaa

SEQ ID NO: 46683 - RNA, 64 nt, Human
uauaaaaaaagcaggccaucugcuuaacccuuggcuccaccauaaggcacugggacucggauuu

SEQ ID NO: 46684 - RNA, 64 nt, Human
cuccuuuuggcuuggccccaggaauuuccugugacuccaccagccaucaugggugccagccagg

SEQ ID NO: 46685 - RNA, 64 nt, Human
cgcuggaggaaucuugaguuucuccaaacugccgcuccaccagugccuuuggacagccgugccu

SEQ ID NO: 46686 - RNA, 64 nt, Human
uccgccuucucccuucucucacccccacccuagccuccaccauccccgcacaaagcggcucuaa

SEQ ID NO: 46687 - RNA, 64 nt, Human
gaaauggcuguggaguguggcaguuuggcaaacucuccaccacacguaaugaaacuuggauuug

SEQ ID NO: 46688 - RNA, 64 nt, Human
uccccugccacgcucgugccggccucccggcagccuccaccagcccggcuccugccucacgcug

SEQ ID NO: 46689 - RNA, 64 nt, Human
ugcagcuggaaccagcaucucugauuuaugccgucuccaccacagagccuccacuuugcaggag

SEQ ID NO: 46690 - RNA, 64 nt, Human
guagauuuggcuucucugcuucucauaggacuaucuccaccacccccaguuagcaccauuaacu

SEQ ID NO: 46691 - RNA, 64 nt, Human
gcacacaaccccagacccacgccggagggcaucccuccaccagaagauuccgccaccucaagug

SEQ ID NO: 46692 - RNA, 64 nt, Human
gagacacuccaucagguccccuuugccuuuccugcuccaccauucucaccaugcagggugggug

SEQ ID NO: 46693 - RNA, 64 nt, Human
auguguuaaauuuguaacuccucuuuggggucuucuccaccaccugucugauuuuuuugugauc

SEQ ID NO: 46694 - RNA, 64 nt, Human
gccaagcaaccucagcaguucccaucaaggccaccuccaccacaaccgaaaguaucaucucagg

SEQ ID NO: 46695 - RNA, 64 nt, Human
ugauuguacugucugauguugugaaauagccaaucuccaccaguccuguauacuguucaaagua

SEQ ID NO: 46696 - RNA, 64 nt, Human
uccucaguucccggcuguguccuugguguccuuucuccaccaccugugagcagcaagacugccg

SEQ ID NO: 46697 - RNA, 64 nt, Human
ucccucccauuauucucauuuuccuuuuaccuuucuccaccauccagagccacaaaagcaaacc

SEQ ID NO: 46698 - RNA, 64 nt, Human
cucugccacuugcgauuucaucccuaauuucuuccuccaccaugccugcagacuuuucccuggg

SEQ ID NO: 46699 - RNA, 64 nt, Human
ccaguaaucugagcagucuaacgaggcccaccuccuccaccacagaacguggcuauguuccaag

SEQ ID NO: 46700 - RNA, 64 nt, Human
gaaacaauucacuuaccagccuccucaccccauccuccaccauuuccuuaauguuccaugguau

SEQ ID NO: 46701 - RNA, 64 nt, Human
ucuccuccagcaagucuguccccaccuugucguccuccaccacacacugaaucuguagcuuccg

SEQ ID NO: 46702 - RNA, 64 nt, Human
gaacuugaguaguucauagagugcuaaggugacacuccaccaaccagagugagagggcagauag

SEQ ID NO: 46703 - RNA, 64 nt, Human
acacucucuggaagcccuggagacccucgcccaacuccaccagauagcagagggguaagagagg

SEQ ID NO: 46704 - RNA, 64 nt, Human
cccagaaccacugcagucaggaauaaacuguuuucuccaccaggcuuugacaaaagggcccaca

SEQ ID NO: 46705 - RNA, 64 nt, Human
cauucagugcagaaguccucacacacuaacagaucuccaccauugggugagccggagccugugg

SEQ ID NO: 46706 - RNA, 64 nt, Human
accacagcaucgggagcacccagagcacccccugcuccaccagcagcauggcauagccccggcc

SEQ ID NO: 46707 - RNA, 64 nt, Human
aaggccacaugugugaccucucugacuucucuuccuccaccaaggcagcuuuccuuacccugac

SEQ ID NO: 46708 - RNA, 64 nt, Human
ccaccccacagcaccaucaggcagcacccaugggcuccaccagcccagcucugucccuccccua

SEQ ID NO: 46709 - RNA, 64 nt, Human
ccgacgcccacccaaccccaagccagcccggccgcuccaccagcaucaccugccuguuaggaga

SEQ ID NO: 46710 - RNA, 64 nt, Human
acagaugccuggccugggaacccagggauuucaccuccaccagugagaccacggggccacugug

SEQ ID NO: 46711 - RNA, 64 nt, Human
agcuggcuugcuacuucccuacaucucugaagggcuccaccauuccucuagcaaccaugcucuc

SEQ ID NO: 46712 - RNA, 64 nt, Human
ugcccuuggcugccagccuacccugccugcacuccuccaccaucacaaucucacccaaacuccu

SEQ ID NO: 46713 - RNA, 64 nt, Human
gaggcggguuuccuggguccccucuccagcaagccuccaccagcaagcucggcccagagcuucc

SEQ ID NO: 46714 - RNA, 64 nt, Human
ccacuaggcuacugcugaaagggagcugaaauuccuccaccaaguugguauucaaaauauguaa

SEQ ID NO: 46715 - RNA, 64 nt, Human
gccgugagggggauucggcccagcucgucccggccuccaccaagccagccccgaagcccgccag

SEQ ID NO: 46716 - RNA, 64 nt, Human
gcaagacccaguaguuggccccugagccuuauaccuccaccacagggggugccgugagacuuca

SEQ ID NO: 46717 - RNA, 64 nt, Human
uaccuucuagaaaaucaguguucacagagacugccuccaccacaggcauccugcaaaugcagac

SEQ ID NO: 46718 - RNA, 64 nt, Human
cuuugcggugguggccugaccgucccacagcagccuccaccagggcccuggugcucaguggccc

SEQ ID NO: 46719 - RNA, 64 nt, Human
aaaaaaaagacaugggagagaugguguuuuuccucuccaccaccuggggauacgaugagaagau

SEQ ID NO: 46720 - RNA, 64 nt, Human
gggacccggcagggacaaggcgggccguggccuccuccaccaagucucucuagacaauucaggg

SEQ ID NO: 46721 - RNA, 64 nt, Human
uaucuggcuuucuuauacagaugguguccauuugcuccaccagacaggaguuaaaaaccuuuaa

SEQ ID NO: 46722 - RNA, 64 nt, Human
aguaagaguaagaccuguuguuuuggaaggucugcuccaccaucuaagagcacuguuuuuuuuu

SEQ ID NO: 46723 - RNA, 64 nt, Human
cucagccuccugaauagcugggacuaccagcacgcuccaccaugccuugcuaauuauuuuuuau

SEQ ID NO: 46724 - RNA, 64 nt, Human
aaagagaaagaaacuuaaguuuucuuucacagaacuccaccauugugggcuuugagagagcccu

SEQ ID NO: 46725 - RNA, 64 nt, Human
cugagaggccccaagaagcugagcuggcagagagcuccaccauuuggugcuaaaaaaaaaaacg

SEQ ID NO: 46726 - RNA, 64 nt, Human
uuccccucugcucaucccuccucauucagacauccuccaccauaccaguguuuagaagcaaaac

SEQ ID NO: 46727 - RNA, 64 nt, Human
ugguucuuucggagccauccuguugaucaugcagcuccaccaaaccuuagggggacgugaaauc

SEQ ID NO: 46728 - RNA, 64 nt, Human
uggucugccacguaaucauuuucuuagacguuugcuccaccagauuuaaccaaauguaacuccc

SEQ ID NO: 46729 - RNA, 64 nt, Human
agguacagguuggcaggaccaccuccgccuacuucuccaccaucccuagcaugucagcccguuc

SEQ ID NO: 46730 - RNA, 64 nt, Human
aagagugcaaagguuccucgaacucugcaccuuccuccaccaggagccugggauauggcuccau

SEQ ID NO: 46731 - RNA, 64 nt, Human
uagguucgggccagcaggaggugccggcuggagucuccaccauagacucaguggccuggccucc

SEQ ID NO: 46732 - RNA, 64 nt, Human
ugguagcccagggcgcuggcagaccaugcuccgccuccaccagggccacagaggagcggagggg

SEQ ID NO: 46733 - RNA, 64 nt, Human
cagaacacaaauagaaauuuaaugauguguucaacuccaccagaaauuaccucgagucagcauu

SEQ ID NO: 46734 - RNA, 64 nt, Human
gagaccauuuucauuuacugccaucauaaauauucuccaccauucaagaugccuguguacacgg

SEQ ID NO: 46735 - RNA, 64 nt, Human
cucgggguugaugguuuuucucucagcaugucuccuccaccacgggaccccagcccugaccaac

SEQ ID NO: 46736 - RNA, 64 nt, Human
ucccaaaaucugugaaaagauuugaaucugauaucuccaccaaagccuugauguuuucucugua

SEQ ID NO: 46737 - RNA, 64 nt, Human
uguaaucugccuguaucuauaggugggcaucucacuccaccaaaggagcccagccucucuuugu

SEQ ID NO: 46738 - RNA, 64 nt, Human
auccaccaaaaaaugcauccgauuuaaccaacaucuccaccagcgcuacggacuccucccaauu

SEQ ID NO: 46739 - RNA, 64 nt, Human
ucuccguccucgaugggagggauggcccuuccuccuccaccaccgcccgucugugugugacccc

SEQ ID NO: 46740 - RNA, 64 nt, Human
gagcaugguccauccagaguguucccugagcccccuccaccauacuggaaccccucuucagugu

SEQ ID NO: 46741 - RNA, 64 nt, Human
ggggaaaccuggcuccaaccaaccccuccccugccuccaccauauccacuaccaggcacccuuu

SEQ ID NO: 46742 - RNA, 64 nt, Human
cccaaaggcuuugcccugcugcccucccccuccucuccaccaucgucuucuuggccaugggagg

SEQ ID NO: 46743 - RNA, 61 nt, Human
ccccagcacccucacucugagcccugacguccuccaccaaccacgggcuccaggaccccuu

SEQ ID NO: 46744 - RNA, 64 nt, Human
agaugagcugcagaugcuuaccuaccacggccgucuccaccagaaaaccaucgccaacuccugc

SEQ ID NO: 46745 - RNA, 64 nt, Human
uaggccaagaacaaaggcaagcauccauuccucacuccaccacuuuucuauuucaguggguguc

SEQ ID NO: 46746 - RNA, 64 nt, Human
agaaaggauggcagccucagggcuuccuuauguccuccaccacaagagcuccuugaugaagguc

SEQ ID NO: 46747 - RNA, 64 nt, Human
agugucuugacaucacccuacccaggcggugggucuccaccacagccacuuugagucugugguc

SEQ ID NO: 46748 - RNA, 64 nt, Human
caugaccgagacccccugauccuccguggacucacuccaccagcuuccuauaacuuggacgaug

SEQ ID NO: 46749 - RNA, 64 nt, Human
ucggccaguuaacaagaagauggugugagguguucuccaccagucucuccuguuugagacuguu

SEQ ID NO: 46750 - RNA, 55 nt, Human
agguggagacagaagcauagccccucuccaccagcccuacuccugcggcugccug

SEQ ID NO: 46751 - RNA, 64 nt, Human
guaacaugaauaucuccaacaagaucaggaaccucuccaccacacugcaaacaauagccaccaa

SEQ ID NO: 46752 - RNA, 64 nt, Human
ucagugccugcuccugccugcccuggcccugaggcuccaccacuucuuccuccacccaggaccu

SEQ ID NO: 46753 - RNA, 64 nt, Human
gagacaagugagguggagggccugcccccccucccuccaccagacacuccuuccaggccugagc

SEQ ID NO: 46754 - RNA, 64 nt, Human
cuaguguucguguguuugucguagcacccagagccuccaccaaacccucuccaugucuuuaccu

SEQ ID NO: 46755 - RNA, 64 nt, Human
aggaaguuucaguauuagaugcacuuaaguuagccuccaccacccuuucccccuucucuuaguu

SEQ ID NO: 46756 - RNA, 64 nt, Human
uuuaccucagcuccuagggccuccagccccccagcuccaccacggugacuuggugaagggggac

SEQ ID NO: 46757 - RNA, 64 nt, Human
uguaaaucacgucuuauuuuccugagguuuuucacuccaccaaaucuuacaaaucauugaaaga

SEQ ID NO: 46758 - RNA, 64 nt, Human
aauuuaauucuaacugccacguucucaugaugugcuccaccaacuuuuuaguauaugagucacu

SEQ ID NO: 46759 - RNA, 64 nt, Human
uaucuaucuccuugcacacaugggcacacacaaucuccaccauccagggagguccugaagucaa

SEQ ID NO: 46760 - RNA, 64 nt, Human
ccaggauauccucccuccagauauacuugguucucuccaccagguucuuucuuuaaagcaggau

SEQ ID NO: 46761 - RNA, 64 nt, Human
aggcgcuguucucccauccucccuaccccauccucuccaccaaaucgcucccaauuuugagagc

SEQ ID NO: 46762 - RNA, 64 nt, Human
acuuggaaaugggagacgggggcagagagggacccuccaccaccucuuugggccuggcucccug

SEQ ID NO: 46763 - RNA, 64 nt, Human
ucugggacccuuuccuuccuucccuggcuuguaacuccaccaacccaucagaaggagaaggaag

SEQ ID NO: 46764 - RNA, 64 nt, Human
ccgugauguaggguaaggugccuucuuauucucacuccaccacccaaaagucaaaaggugccug

SEQ ID NO: 46765 - RNA, 64 nt, Human
ccacagacacaaucuuggacauuaaccccugaggcuccaccacccacccuuucauuuccccccc

SEQ ID NO: 46766 - RNA, 64 nt, Human
uuuuuuuuuuuuuuuaaauuugcuucaacaagcucuccaccaguugacuuucuuuggcuaauuu

SEQ ID NO: 46767 - RNA, 64 nt, Human
cagaguaacugcacgccuuugugcagcucuggagcuccaccaacucucggccugccaguucuca

SEQ ID NO: 46768 - RNA, 64 nt, Human
ggagcccucgggaccugcugcaccaggaaagccacuccaccaguagugcugguugccuccuacu

SEQ ID NO: 46769 - RNA, 64 nt, Human
agagugcuuaccugccccgagggaaguccagcagcuccaccagauagagaucuggagaugcuuc

SEQ ID NO: 46770 - RNA, 64 nt, Human
uugaaaucaauccacaguccaugaaauugugacacuccaccagauuaaguuagggcauaacauu

SEQ ID NO: 46771 - RNA, 64 nt, Human
aauagcuugaacccuuuuaaugaagaccuaacuccuccaccagaaauuuaaguuuauguucuua

SEQ ID NO: 46772 - RNA, 64 nt, Human
auacauuguuuguccugcgagaauauuuuccguccuccaccaucaacauugacacugcguagau

SEQ ID NO: 46773 - RNA, 64 nt, Human
guggcacaaccuuuuagaggugggucagccuccccuccaccacuuccuucccugucccuggauu

SEQ ID NO: 46774 - RNA, 64 nt, Human
gcugaggaauaauuaaaugagaauuucauaggagcuccaccauuccuguuacuuucauuucauu

SEQ ID NO: 46775 - RNA, 64 nt, Human
ccagaccaaaugucccaggcacacagcccaugcccuccaccauggaguacauuuucucccuggc

SEQ ID NO: 46776 - RNA, 64 nt, Human
agcacacacuuagcgcucuggagccggacgguggcuccaccacuuccgcaggccuggaaacuuc

SEQ ID NO: 46777 - RNA, 64 nt, Human
guaccauaaaccugcagagagaagucucgaaaggcuccaccagguaccaagggcagcugcuuuu

SEQ ID NO: 46778 - RNA, 64 nt, Human
gucaccucauugaggccuccccucuccugccucccuccaccacuuuuuuuuuuuuuuuuuugag

SEQ ID NO: 46779 - RNA, 64 nt, Human
aggaaucucucggaccgcggauccucagcccccgcuccaccagcccgccccagcgcgugggucu

SEQ ID NO: 46780 - RNA, 64 nt, Human
caggggguuauggccacagagggauaggcacagucuccaccacccuggagccaagggucuuuca

SEQ ID NO: 46781 - RNA, 64 nt, Human
aacuacauauuuuauuauagaaaaaguauuuuuucuccaccagacaaauggaaaaaaagaggaa

SEQ ID NO: 46782 - RNA, 64 nt, Human
ugcugcuccacgaggaagcucaggccugcacaggcuccaccaggccuuggaugcccucuaguug

SEQ ID NO: 46783 - RNA, 64 nt, Human
ggggggugggggcuucaaguacagauugggcacacuccaccagaccccagcaaggucagcugcc

SEQ ID NO: 46784 - RNA, 64 nt, Human
accuagugccuguguugcagaccauuucugaggucuccaccauccaaggaggcacagccgucau

SEQ ID NO: 46785 - RNA, 64 nt, Human
agauuugagugcaguugguacaguacuuuggugucuccaccacugucccuucuccccgcuucaa

SEQ ID NO: 46786 - RNA, 64 nt, Human
gaccugccccuuccuuguuuuuccuccuacuggucuccaccaaggcuuuguuagcccccacccu

SEQ ID NO: 46787 - RNA, 64 nt, Human
cuauuugcaaaaccucucccacccuuguguuucacuccaccaccaaccccagguaaaaaagucu

SEQ ID NO: 46788 - RNA, 64 nt, Human
uucuguucaccuucguuuacuaugccugugucuucuccaccacgcuggggucugggaggaaugg

SEQ ID NO: 46789 - RNA, 64 nt, Human
ccaauaggcaugccgccuccgggaaugagacccccuccaccaggcauuagaggugagugggagc

SEQ ID NO: 46790 - RNA, 64 nt, Human
agggucucacuguguugcccaggcuggucucaaacuccaccaaauguacuucuuauucauuuua

SEQ ID NO: 46791 - RNA, 64 nt, Human
aaccugcacacgcacuuggagggcccaggugucucuccaccagcccccaugcaguagggacugg

SEQ ID NO: 46792 - RNA, 64 nt, Human
uuauaccuuugccuuggaaguugcauggcaucaccuccaccauacuccaucaguuagagcugac

SEQ ID NO: 46793 - RNA, 64 nt, Human
ccugugucccaugacccaccccugugcuccgugccuccaccaccacuggccaccaggcuggcgc

SEQ ID NO: 46794 - RNA, 64 nt, Human
gggugggaacugggggaccugggccucaggccugcuccaccacugacucaccgaaugaccuugg

SEQ ID NO: 46795 - RNA, 64 nt, Human
cccauccacauacuccucuucugcuuuccagugacuccaccaguuugaugugggaaguguuagc

SEQ ID NO: 46796 - RNA, 64 nt, Human
cccaaaaauuucagugacuccagaagaaaugagccuccaccaccaagaaaugaacuuagagaau

SEQ ID NO: 46797 - RNA, 64 nt, Human
ccccggcagcagguccccaagccaugucaggcaucuccaccacggcugggcgucugugccaggc

SEQ ID NO: 46798 - RNA, 64 nt, Human
ccugcuaucguggaacagccuagaaaccaagggacuccaccaccaagucacuuccccugcucgu

SEQ ID NO: 46799 - RNA, 64 nt, Human
agauccaccccugcccgcaaaacauugcuccaaacuccaccaccuauccccaaaccuguaagaa

SEQ ID NO: 46800 - RNA, 64 nt, Human
cccacccccaaaggcucagccucuaaaucucagacuccaccaccucuuaauggcucaguccccu

SEQ ID NO: 46801 - RNA, 64 nt, Human
aaggcuuccucuccugcucaccccugucucucaccuccaccaaccccacucacuuuguaacuuc

SEQ ID NO: 46802 - RNA, 64 nt, Human
ggcgugggagcccugggagaccccuucccccacccuccaccaagcacaccuguuucugucucau

SEQ ID NO: 46803 - RNA, 64 nt, Human
agccugcagaacccagcugggacuuacuuccaaccuccaccagcccugcuacauaccccuguuc

SEQ ID NO: 46804 - RNA, 64 nt, Human
ggcagcccgccucucccccugcugagacuuuaaucuccaccagcccuuaaagugucggccgcuc

SEQ ID NO: 46805 - RNA, 64 nt, Human
ccuuuuaaagaucccugaccccagcuuuagcuuucuccaccagauaaccagcuaaucccaggaa

SEQ ID NO: 46806 - RNA, 64 nt, Human
aaaggccgagcuuuguuuccuguguuuguguggacuccaccaucauguugaauuuugucaacac

SEQ ID NO: 46807 - RNA, 54 nt, Human
uugagaaaauagccaacugagaagcuccaccagccacugaugccagcccuggca

SEQ ID NO: 46808 - RNA, 54 nt, Human; identical to SEQ ID NO: 46807

SEQ ID NO: 46809 - RNA, 64 nt, Human
gcacacggucucuuccccugccccaacuggcccucuccaccaccaacuucucuacuuuggguuu

SEQ ID NO: 46810 - RNA, 64 nt, Human
uccaacaaaaacagguuccuuauguuucugccuucuccaccagggucgcuccaucacccaaaca

SEQ ID NO: 46811 - RNA, 64 nt, Human
gccuccucuccucuuuggggaucaccagcucugacuccaccaacccucauccaggaaucugcca

SEQ ID NO: 46812 - RNA, 64 nt, Human
agcacugcccugugaagaaagcccuuucccagcccuccaccacuuccacccuggcgaguggagc

SEQ ID NO: 46813 - RNA, 64 nt, Human
cuugagggcuauccuccccaugcccaucucacuucuccaccaaguucacuguucaucauuuaca

SEQ ID NO: 46814 - RNA, 64 nt, Human
cagcccuucuccccaagggaggcugaggaggcuucuccaccaguggcagccccaccccgucccu

SEQ ID NO: 46815 - RNA, 64 nt, Human
uuccugaagcaucauccuggcagggaggcgccugcuccaccagcugguggguguuuguaaucgc

SEQ ID NO: 46816 - RNA, 64 nt, Human
cauuguccauccuuguuguccgugaguccuuggccuccaccaagcacguguggccauugugugc

SEQ ID NO: 46817 - RNA, 64 nt, Human
ccaccaggggaaggaaggagggcacauuaacucccuccaccagccugcugacagacacuaacuu

SEQ ID NO: 46818 - RNA, 64 nt, Human
uccuggaaagcaggccugauggcuucccacuggccuccaccaccugaccagaguguucucuuca

SEQ ID NO: 46819 - RNA, 64 nt, Human
ucuacuuauccuuuugaaauaccucacccugccacuccaccauguaugaucauuccagagaucu

SEQ ID NO: 46820 - RNA, 63 nt, Human
gagaccagccuggggaccauagcgagaccgcugucuccaccaaaaaaaaaaaaaaagaagaaa

SEQ ID NO: 46821 - RNA, 64 nt, Human
aaaaggaccucuccugagaggcaaaaccuguugccuccaccacggcuucccucuuggcucauuc

SEQ ID NO: 46822 - RNA, 64 nt, Human
uggccuggcugauuugaauaaauguuucuuuccucuccaccaucucacauuuugcuuuuaagug

SEQ ID NO: 46823 - RNA, 64 nt, Human
gagugggauugugggagggauuggcagccuucuucuccaccaccuguccagcuucuuccugguc

SEQ ID NO: 46824 - RNA, 64 nt, Human
cugaccuggggggauuggagggaaaugaccugcccuccaccaccacccaaagugugggauuaaa

SEQ ID NO: 46825 - RNA, 64 nt, Human
ucgccgugccucagcgagcagguguguguggguccuccaccacucaccucuugguuagcgggag

SEQ ID NO: 46826 - RNA, 64 nt, Human
gucuuugagucccagcucucuuacccucccuuuacuccaccagcccgacgacccaugacugagg

SEQ ID NO: 46827 - RNA, 64 nt, Human
cucagccucccgaguagcugggacuacaggugcccuccaccacgcuuggcuaauuuuuuuguau

SEQ ID NO: 46828 - RNA, 64 nt, Human
acuuucucccuuucucuaccacagcaaacacauucuccaccaugucagucuaaagagucuaaag

SEQ ID NO: 46829 - RNA, 64 nt, Human
auaagcccugccuacaccauguuccaguaaaccucuccaccaaggaacuguguucagcugccac

SEQ ID NO: 46830 - RNA, 64 nt, Human
uuucuuccuuucccauucaccuggcucaauccuccuccaccaccaggggccucaaaaggcacau

SEQ ID NO: 46831 - RNA, 64 nt, Human
ccagcccccacccuaaaaagguuaucccugagaacuccaccagacuugggagcccaagugcagu

SEQ ID NO: 46832 - RNA, 64 nt, Human
guguguugccacaggacacagucagauuuccagucuccaccaggaaccucuucagaaagugugc

SEQ ID NO: 46833 - RNA, 60 nt, Human
cuauaugcgacacaaaaugaagaccuuucccuccaccacugaugcagucccaccgaaagc

SEQ ID NO: 46834 - RNA, 64 nt, Human
uuuccuaggcccaggccuggguuuguacuuccaccuccaccacaucugccagaccuuaauaaag

SEQ ID NO: 46835 - RNA, 64 nt, Human
gcuggguuaugcaccgccauggcccacauuaacgcuccaccacaagcccagccuagucagagcc

SEQ ID NO: 46836 - RNA, 64 nt, Human
ugugcagggagacggaaccccaugugacagcccacuccaccaggguucccaaagaaccuggccc

SEQ ID NO: 46837 - RNA, 64 nt, Human
cgagaccauccuggcuaacacggugaaacccugucuccaccaaaaauacaaaaaaucugccggg

SEQ ID NO: 46838 - RNA, 64 nt, Human
acaguggccuuuggucauuuuacuucuuuuuugccuccaccaucauguuuuccaucacuuuaau

SEQ ID NO: 46839 - RNA, 64 nt, Human
gcaaccucuacugcccaucuccccugcucaacuucuccaccaagcauuugguuuauuuagaaaa

SEQ ID NO: 46840 - RNA, 64 nt, Human
auaacuggcguguagcacaaagaaaaagccccuucuccaccagauauuugcuuccuaagaauag

SEQ ID NO: 46841 - RNA, 64 nt, Human
aauggaccaguccaugugauuucaguauauacaacuccaccagaccccuccaacccauauaaca

SEQ ID NO: 46842 - RNA, 64 nt, Human
cuacgugagguuccuuggcguuguuuaaggucaacuccaccaaauacagcaaccagcuggggcu

SEQ ID NO: 46843 - RNA, 64 nt, Human
accagagcaugugaccagagcaugugcccagccccuccaccaccaggggcacugccgucauggc

SEQ ID NO: 46844 - RNA, 64 nt, Human
cucaaccuauaucucccuugaaaauacuuucaggcuccaccaaaacguagaacugaaagcaugu

SEQ ID NO: 46845 - RNA, 64 nt, Human
ccuuauccaccacgcuauuauaguuuccguuguccuccaccagcauuucccuuacucugaaguu

SEQ ID NO: 46846 - RNA, 64 nt, Human
cuugucccugccucacucugagagccuugggggucuccaccagugcagacaagggcuacagucu

SEQ ID NO: 46847 - RNA, 64 nt, Human
cuaggcccgugcccccgccugccaccggaggucacuccaccauccccaccccaccccaccccac

SEQ ID NO: 46848 - RNA, 64 nt, Human
gagcuuugccugucucuugccuuaucaguucuuccuccaccacccuacaccccccuccccccgg

SEQ ID NO: 46849 - RNA, 64 nt, Human
ucuugaacucagaacuuaaauccugcacguggcacuccaccacugacuggaccgagcuggcaua

SEQ ID NO: 46850 - RNA, 64 nt, Human
ucuuuccuuuuaucuuauuaauaaaaauguuggucuccaccacugacuacaaugauuuccccau

SEQ ID NO: 46851 - RNA, 64 nt, Human
uacugaauggcuucauuucagauuuaguugauuucuccaccaaaugcaugucauguauucucaa

SEQ ID NO: 46852 - RNA, 64 nt, Human
uucagggucuuccugaaaugcaguggugcuuacgcuccaccaagaaagcaggaaaccuguggua

SEQ ID NO: 46853 - RNA, 64 nt, Human
uugcccucugcaaauguauucaaagaagaaccuccuccaccacuuacuuuugguuggcauaauu

SEQ ID NO: 46854 - RNA, 64 nt, Human
gccucagccuccugaguagcuaggacugcaggugcuccaccacgcccggcuaauuuuuguauuu

SEQ ID NO: 46855 - RNA, 64 nt, Human
uagaucaaccuaagaauccuggcccuucuccacucuccaccaugcaggacaaacaucuucucaa

SEQ ID NO: 46856 - RNA, 64 nt, Human
ggccuuugcuuuguggccucacugcaacacaaagcuccaccaggaggcugguucacguccccua

SEQ ID NO: 46857 - RNA, 63 nt, Human
gcgggccggaaauggcgugaccaccccauccuucuccaccaaagacaguugcgcgccugcucc

SEQ ID NO: 46858 - RNA, 62 nt, Human
agcaugaguuuuacaagugacccuucccuucccuccaccacaccacucaggggcuggggcuu

SEQ ID NO: 46859 - RNA, 64 nt, Human
gccuggaagcugcgacgcccugcacugcucccgccuccaccagcgccucccacugaugucgugg

SEQ ID NO: 46860 - RNA, 64 nt, Human
gacccagaggcucccggaggccccugccggcuuccuccaccagcgccugccucggccccuccuc

SEQ ID NO: 46861 - RNA, 64 nt, Human
cuucgagagagccugauccuggggucuucugagacuccaccaggagccggagagggcagggagc

SEQ ID NO: 46862 - RNA, 64 nt, Human
aaccgccccaaccccuccagcuccaaaucugagccuccaccacauagacugaaacuccccuggc

SEQ ID NO: 46863 - RNA, 64 nt, Human
aucuauagacauuaggaagggagugagacggcuccuccaccauccucagccagugcaacccauu

SEQ ID NO: 46864 - RNA, 64 nt, Human
accccugaacuccugagcgacagaagccccaggccuccaccagccuugaacccuugcaaagggg

SEQ ID NO: 46865 - RNA, 64 nt, Human
ggagucaaagcccagacacuguaaauagaacccccuccaccaccccccgccgcccagcauccua

SEQ ID NO: 46866 - RNA, 64 nt, Human
uuuaggauuagcucagcuugcccccccuuuccaucuccaccaucuauagugagccucuccauaa

SEQ ID NO: 46867 - RNA, 64 nt, Human
cgccuggucacucugggaaccuggauuucaccggcuccaccaaauuagugccucuuagaugaug

SEQ ID NO: 46868 - RNA, 64 nt, Human
aaaucccccagcuuccaaacuugaggcccaccaucuccaccaucugguaauaaacucauguuuu

SEQ ID NO: 46869 - RNA, 64 nt, Human
gcgggugccauaaccggcgaggcugggccagccgcuccaccauuuccccgacugcauggagaca

SEQ ID NO: 46870 - RNA, 64 nt, Human
ggagggaucagccaaauugggcggccacccccgccuccaccacuuuccaccaucagcugccaaa

SEQ ID NO: 46871 - RNA, 64 nt, Human
guaacccacuugguaacaggcauccuugccaagccuccaccacuaggucaguguaagaauuaaa

SEQ ID NO: 46872 - RNA, 64 nt, Human
caggugcuggacaaguucauucacguggcacaggcuccaccagcugcagaauuucaacacgcug

SEQ ID NO: 46873 - RNA, 64 nt, Human
cagcaggguggguggguaccaugggugcccaccccuccaccacauggggccccaaagcacugca

SEQ ID NO: 46874 - RNA, 64 nt, Human
gcuaccuuggugaacucaugaccccaggccccugcuccaccaggaugucccccagguccugcca

SEQ ID NO: 46875 - RNA, 64 nt, Human
acgaccguaacaucauaauaaccacugcuaucgccuccaccaacucagagaaauaucauuucca

SEQ ID NO: 46876 - RNA, 64 nt, Human
agauugggccacacugucuggacucaaagcccagcuccaccacugagcacccgugugacucuuu

SEQ ID NO: 46877 - RNA, 64 nt, Human
aggguggggaggagaaaaucccaccuccccugaccuccaccaccuccaccaccaccaccaccac

SEQ ID NO: 46878 - RNA, 64 nt, Human
aggagaaaaucccaccuccccugaccuccaccaccuccaccaccaccaccaccaccaccaccac

SEQ ID NO: 46879 - RNA, 64 nt, Human
gagggacuugaaacugaagcaagaagguugcauucuccaccaagggaguuaaccuaccugaacu

SEQ ID NO: 46880 - RNA, 64 nt, Human
cuuuggcuuccccagcucauccuuggcccuuccgcuccaccagccuggucugaggcgugcucug

SEQ ID NO: 46881 - RNA, 64 nt, Human
cgcuggaggaaaccagcccuuuagccagcagccccuccaccacaggcacugcuguguggaacga

SEQ ID NO: 46882 - RNA, 52 nt, Human
acaaagcaagcaggcuuuagaccuccaccauccaaagcucaugcccggcagu

SEQ ID NO: 46883 - RNA, 64 nt, Human; identical to SEQ ID NO: 46664

SEQ ID NO: 46884 - RNA, 64 nt, Human
cuaaaacugagguggggauggggagagccuuugccuccaccauucccacccacccuccccuuaa

SEQ ID NO: 46885 - RNA, 64 nt, Human
aaacauaggcaguaguccuagccugguaaagacccuccaccaccccuauaaguuugauugcuau

SEQ ID NO: 46886 - RNA, 64 nt, Human
ucagaguuaaaucccuauucuccacaccucucaccuccaccaccccucccugucccagccagca

SEQ ID NO: 46887 - RNA, 64 nt, Human
agaacauaaagauucauuucucucccacccucaacuccaccaaaguaaauccuuucgauaguaa

SEQ ID NO: 46888 - RNA, 64 nt, Human
ccaaccuccuuggacugcaaacaaucuaggacaccuccaccaaaccuccucuugcacuuucccu

SEQ ID NO: 46889 - RNA, 64 nt, Human
gaccauccacucuacccucccacccccuucucugcuccaccacauccuccguccagccgccauu

SEQ ID NO: 46890 - RNA, 64 nt, Human
cugccugugaugggguggccuuccugcugccccccuccaccagugccuuuugcagagagauauu

SEQ ID NO: 46891 - RNA, 64 nt, Human
cuuugaccuaauggagcuagaaauaugucugugacuccaccaguuauucuaauaauuuguuuuc

SEQ ID NO: 46892 - RNA, 64 nt, Human
uaacgcuuucacaccaauccguacaugcugcuuccuccaccaaaaaugcccaauucaggcagac

SEQ ID NO: 46893 - RNA, 64 nt, Human
gugugguccagguccuuuccacccugagacuuggcuccaccacugauauccuccuuuggggaaa

SEQ ID NO: 46894 - RNA, 64 nt, Human
cccuuguuuaguuuuggaaccauacucacucacucuccaccagccugggaaaugaauauugggu

SEQ ID NO: 46895 - RNA, 64 nt, Human
guaugcacccagaggggacucagcuucaaagcugcuccaccaugcugggucccaggcagcuuuc

SEQ ID NO: 46896 - RNA, 64 nt, Human
gcagaaaggagaugccaauucugcuaucacagaacuccaccagcaacuccacccgaccccagca

SEQ ID NO: 46897 - RNA, 64 nt, Human
cacuuuauuuuuuagauugcugcagcaaaaccaacuccaccaaaaagccagguaacauuaacaa

SEQ ID NO: 46898 - RNA, 64 nt, Human
cucaaaagaguuucuggcugaucuguggcuuugccuccaccaucccuaaccaaccucucaucac

SEQ ID NO: 46899 - RNA, 64 nt, Human
acuuuuucuuuugcuuuuucucggcacgugguaucuccaccauuucuucugcacaaagaugucu

SEQ ID NO: 46900 - RNA, 64 nt, Human
agcaugcaucagggguccacacaggcucagcucucuccaccacccagcucuucccugaccuuca

SEQ ID NO: 46901 - RNA, 64 nt, Human
ggagcgcggcgggcgagggcccuguguggaccaccuccaccaagcucagagauuugcaccaggu

SEQ ID NO: 46902 - RNA, 64 nt, Human
cuuucugagcugccagaaguacagaaguuggagccuccaccaccuuccagaucuguuucuccuc

SEQ ID NO: 46903 - RNA, 64 nt, Human
cugggcgcaccuuuagcagguggacuccguggggcuccaccagccagaagccucuggaaggcaa

SEQ ID NO: 46904 - RNA, 64 nt, Human
uccuugcacaccugacucugucacucaagccuuucuccaccaggccccucaucugaauaccaag

SEQ ID NO: 46905 - RNA, 64 nt, Human
uaaauuucuguauauauaauuuaauaacagaagccuccaccagcaacagcauguggaagauaca

SEQ ID NO: 46906 - RNA, 64 nt, Human
ucaccacccaaggggucaucaucucuggccaccacuccaccagaugggcagagcagcuaugacc

SEQ ID NO: 46907 - RNA, 64 nt, Human
uuauuauaaauuacaauccacucauccaccugcccuccaccaggagugggcaccccauaagggu

SEQ ID NO: 46908 - RNA, 64 nt, Human
cagcucaucccuuccuggggaccacacugcucugcuccaccagaccacacuaugaaauaggaau

SEQ ID NO: 46909 - RNA, 64 nt, Human
uuuuaacugccccccaaccccacuccaacuccuucuccaccacccauucucccaauggucuuua

SEQ ID NO: 46910 - RNA, 55 nt, Human
gcauuggggcgagcaagugagggggcuccaccaaggaggggggcuugggggggcc

SEQ ID NO: 46911 - RNA, 64 nt, Human
cugcauuuuccucuuguccuggcccuucagucugcuccaccaaggggcucuugaaccccuuauu

SEQ ID NO: 46912 - RNA, 64 nt, Human
caaggccaggagugcccaccagcuugccccgcuccuccaccaucuaggcccugcuccuccuuca

SEQ ID NO: 46913 - RNA, 64 nt, Human
gccaggugugcacaggggccucccaggcuccuggcuccaccagccaaggaggugggggcaaggg

SEQ ID NO: 46914 - RNA, 64 nt, Human
gucaucuccuuggucacccucugcuccaggccuucuccaccacaggaccucagcugucccuccu

SEQ ID NO: 46915 - RNA, 64 nt, Human
cuccauugcaggugcucucggaacccuggcgucucuccaccagccagaucccccaaucccagau

SEQ ID NO: 46916 - RNA, 64 nt, Human
uagaaauccaccuuaaagccccucgccccaacuucuccaccaacgccuucugggcuuucuucag

SEQ ID NO: 46917 - RNA, 64 nt, Human
uguucaaccucaguaucugaucaggcuccucagccuccaccaucccccaggugaugucugguca

SEQ ID NO: 46918 - RNA, 64 nt, Human
uccuuuucccacccugauuccccaucuuccucaucuccaccauccacccaggaggccucuccca

SEQ ID NO: 46919 - RNA, 64 nt, Human
acgggaagagugacaguagggagggaggacagaccuccaccacacugacaucagcuccagcucc

SEQ ID NO: 46920 - RNA, 64 nt, Human
aaaugagauaugcaauaaauauuauuugaugauacuccaccagugaaaauugaugcuaagugau

SEQ ID NO: 46921 - RNA, 64 nt, Human
agacuccucaguucuugccacuuuuuuuuuuaaucuccaccagucauuuuucagaccuuuuaac

SEQ ID NO: 46922 - RNA, 64 nt, Human
uuggucaccugaucacucaacugcuucuuaacaccuccaccagggggaaggcuggcacaaggag

SEQ ID NO: 46923 - RNA, 64 nt, Human
guuugccaucacugguguugucaccucccuguuucuccaccaagggcuugggccucucggggcu

SEQ ID NO: 46924 - RNA, 64 nt, Human
agcuccucacucagcuccugccucccucuccccucuccaccaugggcugcaguauagacagaca

SEQ ID NO: 46925 - RNA, 64 nt, Human
ggggccuugagagccagugggcuuugaguuuaagcuccaccaacuucaagccaugugacuuugg

SEQ ID NO: 46926 - RNA, 64 nt, Human
cgggagcacggcuggggccuuucuugaucuccugcuccaccaaggcucuggggaaccugagagu

SEQ ID NO: 46927 - RNA, 64 nt, Human
cugggucaagcuuucaucagccccagcccccacacuccaccaaaguucucaugcacuaugcacu

SEQ ID NO: 46928 - RNA, 64 nt, Human
aggagcuguuccuuccuucacagauacuuaagaccuccaccaugucugauucgaguucucccug

SEQ ID NO: 46929 - RNA, 64 nt, Human
acugaugggcacaggaggcaccaauagcgauuauugggggcaaugcgaggucuccuccuaugcc

SEQ ID NO: 46930 - RNA, 64 nt, Human
cuccugcugacuggccgaagucuuuuuuaccuccugggggcagggcagacgccgugugucuguu

SEQ ID NO: 46931 - RNA, 64 nt, Human
ugauguugaguuuugggauuguuacugguugaagugggggcagaugccugucaccaagguguug

SEQ ID NO: 46932 - RNA, 64 nt, Human
ugggaggccaggauggcacuguuggcaccgagguugggggcagaggcccaucuggccugaacug

SEQ ID NO: 46933 - RNA, 64 nt, Human
accccagaucucuggggcccagccaggcagggugugggggcagcugugccaaucuaccucacag

SEQ ID NO: 46934 - RNA, 64 nt, Human
ugggaccaguaggugcccuuccagccugaagaucugggggcacaguauagccacaugagcccca

SEQ ID NO: 46935 - RNA, 64 nt, Human
uauauuuuuaguagagacgggguuucaccauguuggccaggauggucucgaucucuugaccuug

SEQ ID NO: 46936 - RNA, 64 nt, Human
acccuuccugaccuguccuuuucccacaggccucugggggcagguggcaaggccuggccgggcc

SEQ ID NO: 46937 - RNA, 64 nt, Human
gucccuucucucuuucuaaggacccaaauuucccugggggcauccugcuuccugaaagcuguug

SEQ ID NO: 46938 - RNA, 64 nt, Human
aucaccagguuguagaaguugacaggcagugccaugggggcaacagccaaaauagggggguaau

SEQ ID NO: 46939 - RNA, 64 nt, Human
caaccaugcucuguccaaaugcaagugaggguucugggggcaaccaggaggggggaaucacccu

SEQ ID NO: 46940 - RNA, 64 nt, Human
gggcuccaguagagaaggcaggguugguggugggugggggcagccuguaucagacaaagguaaa

SEQ ID NO: 46941 - RNA, 64 nt, Human
caguguggagagacacauaagccuuacuguccucugggggcaggagccgagccuuuuuguugcu

SEQ ID NO: 46942 - RNA, 64 nt, Human
ggaucugggaccucccuccagaauuuccuccagaugggggcagugcccagggagggguuauuug

SEQ ID NO: 46943 - RNA, 64 nt, Human
caccccaucagcagugguucuccuacuuucucagugggggcauauccucaagggagaauguugu

SEQ ID NO: 46944 - RNA, 64 nt, Human
uguaaggaacugcguuccgccccucaggcccccaugggggcagggaucggcuuggaaaucaacg

SEQ ID NO: 46945 - RNA, 64 nt, Human
uuuagcuguuuuucucauuuguugguguguggggugggggcagggguagggcgggagagcgaug

SEQ ID NO: 46946 - RNA, 64 nt, Human
cugagcugggacagguucugguaaaugccaaguaugggggcaucugggcccagggcagcugggg

SEQ ID NO: 46947 - RNA, 64 nt, Human
gacagggcauauucuuugcuuccaagauuuggguugggggcacuagggguucagagccuggcag

SEQ ID NO: 46948 - RNA, 64 nt, Human
ccuucugcugccuuugccugguccuccagguugcugggggcaccacagacaucaagauuccagu

SEQ ID NO: 46949 - RNA, 64 nt, Human
caugugggguugcugaagaugccuugaggugaaaugggggcaggaaagccacaucuugcucugc

SEQ ID NO: 46950 - RNA, 64 nt, Human
ucauugaaauuucuugguuaaguuuaauuuucucugggggcaugaucucacaaagaauacucaa

SEQ ID NO: 46951 - RNA, 64 nt, Human
cuaauggaaguggauugaauacagcagucucaacugggggcaauuuugccccccagaggacauu

SEQ ID NO: 46952 - RNA, 64 nt, Human
gaaugcaccacuccuuccccaggguuuaagagauugggggcagacagggacuuuccucugccgg

SEQ ID NO: 46953 - RNA, 64 nt, Human
ugcucaacagaacauauguugcaagacccucccaugggggcacuugaguuuuggcaaggcugac

SEQ ID NO: 46954 - RNA, 64 nt, Human
gugaggacuagggcaucaaggucgugugugugggugggggcagccuccaccuccuggauucaag

SEQ ID NO: 46955 - RNA, 64 nt, Human
uagaaagaagcuuuugauuagauguacaauacauugggggcagaagaucugggaucaauuaaga

SEQ ID NO: 46956 - RNA, 64 nt, Human
ccuccucagaucuguuugugccuuucaaaaguacugggggcagauucucaaaacucuuagauug

SEQ ID NO: 46957 - RNA, 64 nt, Human
gucucccugagccugccccagcugggcuguuggcugggggcaugggggaggcucugaagagaua

SEQ ID NO: 46958 - RNA, 64 nt, Human
uaccuccagcagaagaaaaucaggugucuggucuugggggcacugugcucacuucuagagagaa

SEQ ID NO: 46959 - RNA, 64 nt, Human
cagugugugaguggucaccuacuaaacccagcucugggggcagagcugucuuccccaucucugg

SEQ ID NO: 46960 - RNA, 64 nt, Human
ggcgggacuccucccuggggguggggcuccuaccugggggcagaacuccuaccugaaggcaggg

SEQ ID NO: 46961 - RNA, 64 nt, Human
aaguaugguggugucuagcacugaauggggaaacugggggcagcaacacuuauagccaguuaaa

SEQ ID NO: 46962 - RNA, 64 nt, Human
ugagcaagggagauccuggaguuaagacagguguugggggcagccuguauuuuacccuaggggc

SEQ ID NO: 46963 - RNA, 64 nt, Human
ggcuccccacgagucaccugcaagccccagggccugggggcagugacuggcaggugcagauggg

SEQ ID NO: 46964 - RNA, 64 nt, Human
cauuucccaugaggggccggggcagguggcugggugggggcacaggcuggaguauucuuaguuc

SEQ ID NO: 46965 - RNA, 64 nt, Human
caguucuaugcaccacuccagguagggauacccaugggggcagcugugccugugugggggaaca

SEQ ID NO: 46966 - RNA, 64 nt, Human
aaauaaacuguuauugcauuauaggccccuuuguugggggcagccuguugguccacaccuacuu

SEQ ID NO: 46967 - RNA, 64 nt, Human
agagacaagcucccguggaaaacagacaggagcaugggggcagcugucauggcuguggcgggca

SEQ ID NO: 46968 - RNA, 64 nt, Human
uucuggaauggacugaguccaucguggaaagggcugggggcaggaggagguggggaggggcacu

SEQ ID NO: 46969 - RNA, 64 nt, Human
agacaagucuguggcccagacaggaugccaagucugggggcagcagcaggguccuugagagaac

SEQ ID NO: 46970 - RNA, 64 nt, Human
ucauguugaggguuuugcuggguucucaggcuagugggggcauuaggaacagaccucucauucu

SEQ ID NO: 46971 - RNA, 64 nt, Human
gaccugccccaccccauccccgcgguugaggcugugggggcagcagaucaggagcccacugaua

SEQ ID NO: 46972 - RNA, 64 nt, Human
ggagaggcagccuagacaaccaaguggcagcaggugggggcauucuucuaggaaugaggggcau

SEQ ID NO: 46973 - RNA, 64 nt, Human
ugguucccaacccugcaugcacauucgaaucaccugggggcacaaugccuaggcuccaacccca

SEQ ID NO: 46974 - RNA, 64 nt, Human
agccuuccagcugagugaagcuaggcaaauggagugggggcaggcaucuauuccugcccccauc

SEQ ID NO: 46975 - RNA, 64 nt, Human
ugaaguggagaggccgagcagcagccggccgggaugggggcauuagaggccugagguucucuag

SEQ ID NO: 46976 - RNA, 64 nt, Human
cacugccagugucuuagcagggucuugugagggcugggggcauccaggcacucagaaggcaaag

SEQ ID NO: 46977 - RNA, 64 nt, Human
uaauucccagguguugugguagguaauugaaucaugggggcaguuucccucaugcuauucucau

SEQ ID NO: 46978 - RNA, 64 nt, Human
uacagguaccauuuaggaaauaccgaugccuuugugggggcagaaucacauggcaaaagcuuug

SEQ ID NO: 46979 - RNA, 64 nt, Human
cucccugccucucacugccauaagaauaucagccugggggcaguccagacgcagcccuuuguca

SEQ ID NO: 46980 - RNA, 64 nt, Human
gaaggggagaagaauacuuuucuucaacaaauuuugggggcaggagaucccuucaagaggcugc

SEQ ID NO: 46981 - RNA, 64 nt, Human
ugguaucuuuucaacuauuguuuuauccugucuuugggggcaaugugucaaaaguccccucagg

SEQ ID NO: 46982 - RNA, 64 nt, Human
uuccuucccuucuguaacuuggagcaggaagucaugggggcagagagggaaaggaggugguuac

SEQ ID NO: 46983 - RNA, 64 nt, Human
guggaagaggccugcucccuggcucugggucugcugggggcacaguaaaucagucuuggcaccc

SEQ ID NO: 46984 - RNA, 64 nt, Human
uggggccugggaggggcaauccucaaaugcggggugggggcagcacaggagggcggccuccuuc

SEQ ID NO: 46985 - RNA, 64 nt, Human
uguacagaaaggaaauauucagagacuuuagcauugggggcagauaucuuggccugguuauggg

SEQ ID NO: 46986 - RNA, 64 nt, Human
gugagggaaccugucuccuaccacuucggagccaugggggcaagugugaagcagccagucccug

SEQ ID NO: 46987 - RNA, 64 nt, Human
cuuucuugccagcuucguuguucccucuggcuugugggggcacggcugugcuccauguggcaag

SEQ ID NO: 46988 - RNA, 64 nt, Human
guugccccacucaucugccgccuuugcuuuugguugggggcagauuggguuggaaugcuuucca

SEQ ID NO: 46989 - RNA, 64 nt, Human
agggugcuaagaggaaggaugaagggcuucaggcugggggcaguggacagggaauugggauacc

SEQ ID NO: 46990 - RNA, 64 nt, Human
ugcguuuguaagaaauaagcucuagugauaucugugggggcaaaauuuaauuuggauuugauuu

SEQ ID NO: 46991 - RNA, 64 nt, Human
gaaaaccuucaaggagcugacugaccacguagcaugggggcaagaggcgugggauggggauugg

SEQ ID NO: 46992 - RNA, 64 nt, Human
ugcugcagcacuggggagccaggcgaggggggcuugggggcauggggccggaaagcaggcagaa

SEQ ID NO: 46993 - RNA, 64 nt, Human
ugagggcaccgagacagaggguuaaaugaaccagugggggcaggucccuccaaccaccagcacu

SEQ ID NO: 46994 - RNA, 64 nt, Human
gagccuggccggaaggaagagcccuggaggugguugggggcaaaugugcccugaguccuugggg

SEQ ID NO: 46995 - RNA, 64 nt, Human
aauaaacaucuauuugagacaauuaaaauccuucugggggcacuggaagcacaauacggugacc

SEQ ID NO: 46996 - RNA, 64 nt, Human
acugccagucccccugccccagggcucccggcuaugggggcacugaggaccagccauugagggg

SEQ ID NO: 46997 - RNA, 64 nt, Human
cugccugaccaucuguguagcuggugugggaaucugggggcauuggagggaggggguuuuauuu

SEQ ID NO: 46998 - RNA, 64 nt, Human
cagccuaucaggaaacaggcagaccagggccccgugggggcagcccagaccaguacccuuaccg

SEQ ID NO: 46999 - RNA, 64 nt, Human
auugggccccuuggccccuuccgguucugcuuccugggggcaggguuccugccuuggaccccca

SEQ ID NO: 47000 - RNA, 64 nt, Human
cagccccggggcuuggcucccccagcucugagcgugggggcauaggcaggaccccccuuguggu

SEQ ID NO: 47001 - RNA, 64 nt, Human
ucuccuacagcccccugccugauccccugcuggcugggggcagcucccaggauauccugccuuc

SEQ ID NO: 47002 - RNA, 64 nt, Human
ugaaaucagaggggagcuauccaaaaugggaguuugggggcagcuaaaguugacaugcgaauaa

SEQ ID NO: 47003 - RNA, 64 nt, Human
gggguccugcagggggaggaggacuuggagggucugggggcagcuguccugaaccgacugaccc

SEQ ID NO: 47004 - RNA, 64 nt, Human
aggggagcagcggcugggagugagcagggcagggugggggcagggugggggcacgaagugggcc

SEQ ID NO: 47005 - RNA, 64 nt, Human
ggcugggagugagcagggcagggugggggcagggugggggcacgaagugggcccugggugaccc

SEQ ID NO: 47006 - RNA, 64 nt, Human
uuuuguuuguuuguuuuaggaggaugguguauggugggggcaauaaaugagguuuuuugcauuc

SEQ ID NO: 47007 - RNA, 64 nt, Human
ucucccagcagacugguggcaugcccaguggcuuugggggcaaggauagaaaugccaucaggaa

SEQ ID NO: 47008 - RNA, 56 nt, Human
aguauuuugcguguguguaagggacaugggggcaaacugagguagcgacacaaagu

SEQ ID NO: 47009 - RNA, 64 nt, Human
gcaguccauuugucuguguggcaggcuggcuggcugggggcaucugccugucuaugugcuguug

SEQ ID NO: 47010 - RNA, 64 nt, Human
uguuggaggacaccccucgccaucucgcccuugcugggggcacgggaguggggggggugacaug

SEQ ID NO: 47011 - RNA, 64 nt, Human
aauuguauaugcucucacucugaaauuccaagguugggggcaaugaugaaacuuuguacaguau

SEQ ID NO: 47012 - RNA, 64 nt, Human
aacaggauggcacccagagccgcaggacggagacugggggcagcccucacccaacucacaacag

SEQ ID NO: 47013 - RNA, 64 nt, Human
gacuacuuuuuuuauaucaaauuuaagcuggauuugggggcauaaccuaauuugagccaacucc

SEQ ID NO: 47014 - RNA, 64 nt, Human
ugcauuuucuucugucaggaauggggaaggggagugggggcacaaucugagaaaggacaccugu

SEQ ID NO: 47015 - RNA, 64 nt, Human
uuuguaaagccuccaguguccauuccaucccugaugggggcauaguuugagacugcagagugag

SEQ ID NO: 47016 - RNA, 64 nt, Human
aaggcccuucuccacccgcaggugggccaagcucugggggcagguggagagggcgggcagggga

SEQ ID NO: 47017 - RNA, 64 nt, Human
gcuucucucuucucucaaccccuuuguaaugguuugggggcagacucuuaaguauauugugagu

SEQ ID NO: 47018 - RNA, 64 nt, Human
gcuuucuccuuuuggauugaggcuauguacuuggugggggcaggggagggaauauauuauaaua

SEQ ID NO: 47019 - RNA, 64 nt, Human
gugugcagcauuguuggcuguuccugcaguagaaugggggcagcaccuccuaagaaggcaccuc

SEQ ID NO: 47020 - RNA, 64 nt, Human
aauggggaagggggacaagggucagucugucgggugggggcagaaaucaaaucagcccaaggau

SEQ ID NO: 47021 - RNA, 64 nt, Human
acaucuuggugaaguugccccugggaagggcagcugggggcaguggcgccaguucccuuccaug

SEQ ID NO: 47022 - RNA, 64 nt, Human
cgacggugggaagaugccuuacgucugaucuugaugggggcacuggccuggagccugggcccac

SEQ ID NO: 47023 - RNA, 64 nt, Human
acccacccaggcuucaccagcccugugcgggcucugggggcagagguggcagaaauggugcugg

SEQ ID NO: 47024 - RNA, 64 nt, Human
gaccuuuagccuuuuucuuccuuugcaaaggccuugggggcacuggcugggagucagcaagcga

SEQ ID NO: 47025 - RNA, 64 nt, Human
aguuucauuccaaaguguauauuggguucagacuugggggcagaaguucagacacaccgugcuc

SEQ ID NO: 47026 - RNA, 64 nt, Human
uuuauacugccgagucugggggcuuguuuugguuugggggcagccauccuccaccagaaagggg

SEQ ID NO: 47027 - RNA, 64 nt, Human
uguuguuuaagauucggcaguuuguguggggaggugggggcaggaugggguuugguugccaaaa

SEQ ID NO: 47028 - RNA, 64 nt, Human
guugggggagguagggccuuacgcuuguccucagugggggcaguuugccuuagaugacagcugg

SEQ ID NO: 47029 - RNA, 64 nt, Human
ugaaugguugcacguuaaaaauuaaaagaaggaaugggggcagaaugccauauuuuugagggcu

SEQ ID NO: 47030 - RNA, 64 nt, Human
gcuggaagccagaagggcuugaggccucuaugggugggggcagaaggcagagccugugucccag

SEQ ID NO: 47031 - RNA, 64 nt, Human
acuguaucagccccaagcaggugguggucccugcugggggcagcaguaccaucuacaucuccuu

SEQ ID NO: 47032 - RNA, 64 nt, Human
auuccaggccacaaauuccaggccuaguucagucugggggcagggucaguccuucucccaggcc

SEQ ID NO: 47033 - RNA, 64 nt, Human
cguuuuuucuuuucuacaucuucacagguucggcugggggcagcugauaggccuaaggccauac

SEQ ID NO: 47034 - RNA, 64 nt, Human
cuugggcagacaggcugacuggcagcaccagcuuugggggcagaguccuaggaugaggcuuggg

SEQ ID NO: 47035 - RNA, 64 nt, Human
ccaucucuacuaaaauacaaaaauuauccgggcaugggggcacacaccgguaaucccagcuacu

SEQ ID NO: 47036 - RNA, 64 nt, Human
caacuuuggugcuccagggugggccagcugcuugugggggcaccugggaggucaaaggucucca

SEQ ID NO: 47037 - RNA, 64 nt, Human
ggggccaucacaggaugccagccccugccuggguugggggcacucagccacgaccagccccuuc

SEQ ID NO: 47038 - RNA, 64 nt, Human
cgccgacuuuguaccccccaaccccugaggaagaugggggcaagaagaucacgcuccccgccug

SEQ ID NO: 47039 - RNA, 64 nt, Human
ggucuccccugauccagacaagugggagagcccgugggggcaggggaccuggagcugccagcac

SEQ ID NO: 47040 - RNA, 64 nt, Human
agugcucagguauguaguaaguacuguaguccugugggggcaaauguguagauauuuuuaaaca

SEQ ID NO: 47041 - RNA, 64 nt, Human
gggccagcgggcgcagggcacaccuggccaggcuugggggcagcccaucucagguggcccugca

SEQ ID NO: 47042 - RNA, 64 nt, Human
acaguacuuaguccaaaggugcuaacgggggaacugggggcauugugacacccaagucugaugu

SEQ ID NO: 47043 - RNA, 64 nt, Human
gugaugugcuguuuauuuaucagcuugagguccaugggggcagccuugugacuggaagggugga

SEQ ID NO: 47044 - RNA, 64 nt, Human
ugaaaaucacucucgggacugccguccucgcugcugggggcauaugccccagccccuguaccac

SEQ ID NO: 47045 - RNA, 64 nt, Human
gaccucgggucaugauccucugcgugggagggcuugggggcagccugcuccccuucccucccug

SEQ ID NO: 47046 - RNA, 64 nt, Human
gagcugggaagauggcugggaagccaggccaaagugggggcaacagcuugcuucucuuucucuu

SEQ ID NO: 47047 - RNA, 64 nt, Human
auucauuggauugggggugaguguuuuguuuuucugggggcagugugagcuuugaggguuggaa

SEQ ID NO: 47048 - RNA, 64 nt, Human
aggguagagggacauccagggaucagggcaugagugggggcaaccccccggccucugcccuggc

SEQ ID NO: 47049 - RNA, 64 nt, Human
agaggaucuaggcuaacaggagagacuccaggagugggggcagaucccaaggcagccuccugcu

SEQ ID NO: 47050 - RNA, 64 nt, Human
uuauaagaacaaaaggccugggugccuacccgugugggggcacugugggaagccuuugcuaggg

SEQ ID NO: 47051 - RNA, 64 nt, Human
ucuucucuccuguaccauucuguggcuucagccaugggggcaguagcccuucauuaguguagau

SEQ ID NO: 47052 - RNA, 64 nt, Human
ugcuaccucgauuccuccuguguuggacagaggcugggggcagugccagccugauucuuccgac

SEQ ID NO: 47053 - RNA, 64 nt, Human
uaagcaacaccuuagacagggccugaacccugggugggggcacuggaugccugaaguaaguaag

SEQ ID NO: 47054 - RNA, 64 nt, Human
cugccuccaucuaugggaguucuuucucucagagugggggcaguuucuggcccaggggucugag

SEQ ID NO: 47055 - RNA, 64 nt, Human
uggucagggcucaggcuucacuuuguaaaccaggugggggcaucucacagccugacuucccuuc

SEQ ID NO: 47056 - RNA, 64 nt, Human
ccuucuuuaaauaguguuugcugaauuaagccgaugggggcaguggcguuaagugguggaaaaa

SEQ ID NO: 47057 - RNA, 64 nt, Human
uuuuccucccccauccccugcagcugccuuuuuuugggggcaggguggggguugauguugaacu

SEQ ID NO: 47058 - RNA, 64 nt, Human
cacacaaccacacacacacaaccacacacacaaaugggggcaaccacauccaguacaagcuuuu

SEQ ID NO: 47059 - RNA, 64 nt, Human
auuugcuggccuggcagggggugaaggcaggaguugggggcaggucaggaccaggacccaggga

SEQ ID NO: 47060 - RNA, 64 nt, Human
uccucgggauuggcggguccacuugccagggcucugggggcagauuuguggggaccucagccug

SEQ ID NO: 47061 - RNA, 64 nt, Human
ugcuaaguccaacucugugcaaccuacauggaggugggggcagccgaugccugguccaggcugu

SEQ ID NO: 47062 - RNA, 64 nt, Human
ugcccaggaguccccuacugcugugggcugggguugggggcacagcagccccaagccugagagg

SEQ ID NO: 47063 - RNA, 64 nt, Human
aggaaaaggcugguacaacggaggccugcgacccugggggcacaggaggcaggcauggcccugg

SEQ ID NO: 47064 - RNA, 64 nt, Human
acaguagacacccugcccgugcagagagaugucaugggggcaccugcucucccugauagaugcu

SEQ ID NO: 47065 - RNA, 64 nt, Human
uuugaagagaaggggauaggaauguauauuuggcugggggcauggagauguucguauguaugag

SEQ ID NO: 47066 - RNA, 64 nt, Human
agccccugcugacccuggcacccagggaccugccugggggcagagagcugucuuccuccuccga

SEQ ID NO: 47067 - RNA, 64 nt, Human
ggagccggcaggugcuucucacaccaggagccucugggggcaggggcuggcuccucgccgcugu

SEQ ID NO: 47068 - RNA, 64 nt, Human
uuuaggggaaguauguguggguacaugugaggacugggggcaccugaccagaaugcgcaagggc

SEQ ID NO: 47069 - RNA, 64 nt, Human
cauuauuauaauauucuuuuuuuuuucuagaaacugggggcagccucaaaaucauguuaaagag

SEQ ID NO: 47070 - RNA, 64 nt, Human
cugggaggauggaaacagugcagcccaggucccaugggggcagcuccaucccagagcauuucug

SEQ ID NO: 47071 - RNA, 64 nt, Human
ugauuuugauagauauccucucagcucucuucccugggggcagauauuucccaauacauaccac

SEQ ID NO: 47072 - RNA, 64 nt, Human
aguucuuccaagagcuucuuagaguaguauauuuugggggcagucaaggaauaaacuacagugu

SEQ ID NO: 47073 - RNA, 55 nt, Human
uucaucagcagcaagauuaagucucugggggcaugcaaaugcaaauggucaauuc

SEQ ID NO: 47074 - RNA, 64 nt, Human
aagauaaggaagggaaguguguggauguggauggugggggcauggacaaagcuugacacaucaa

SEQ ID NO: 47075 - RNA, 64 nt, Human
cugaugauggccuuaaagguggugagggagauacugggggcagagcagacuuugccagugcccc

SEQ ID NO: 47076 - RNA, 64 nt, Human
gacagguaauagcccuagccauuggugcacaggaugggggcaaugggaggggaugcuacugaug

SEQ ID NO: 47077 - RNA, 64 nt, Human
cccgccgcagaccuggcgcccccgccuuggcuccugggggcagccagcccuggcugggagagcg

SEQ ID NO: 47078 - RNA, 64 nt, Human
gggcgccaggugcugugcugggcccuugugagugugggggcacaggcugaauuagaugagcucc

SEQ ID NO: 47079 - RNA, 64 nt, Human
cccucgugccccucggccaccugcuggcagccgaugggggcacucggacaucuacaacccugca

SEQ ID NO: 47080 - RNA, 64 nt, Human
ugcaaaugaugacagcacuucugguggaugaauuugggggcacaaacagcuuuuuuccucuuuu

SEQ ID NO: 47081 - RNA, 64 nt, Human
uagaaauauuacagaauaauuuaagacacuacaaugggggcaaaugaaauaggaaaauuuuuag

SEQ ID NO: 47082 - RNA, 64 nt, Human
gaauacagcgacagaccuaucugaaaagucuguuugggggcauacuuuucauaucuuauugacu

SEQ ID NO: 47083 - RNA, 64 nt, Human
gggaagcucuuccuccugccccucccauuccuggugggggcagaggagugucugcagggaaaca

SEQ ID NO: 47084 - RNA, 64 nt, Human
cagccucccugcugggacagggaccuauggcaccugggggcagcuuagguuuggguuaaguugu

SEQ ID NO: 47085 - RNA, 64 nt, Human
accugguuugaauggagauucugauucaguggguugggggcagaguuucugcaguuccaucagg

SEQ ID NO: 47086 - RNA, 64 nt, Human
ccucuaacaacgcaguagcauguuagauugaggaugggggcaugacacuccagugucaaaauaa

SEQ ID NO: 47087 - RNA, 64 nt, Human
aaauauaauuucacucuuauuuaguauuuuuuccugggggcauuuuuacguaauuuuuuuauga

SEQ ID NO: 47088 - RNA, 64 nt, Human
ucugagaaugaaaagguguuugauggacauguugugggggcaccaaugcagaacacugcacuga

SEQ ID NO: 47089 - RNA, 64 nt, Human
ccuguguucuuggccugccccugagucuucuggcugggggcagguugccugggcaagaacugcu

SEQ ID NO: 47090 - RNA, 64 nt, Human
gcuuuuuaaauauuuuuuaaaauuauuuaaccccugggggcagagacugaggagggaggaugau

SEQ ID NO: 47091 - RNA, 64 nt, Human
guacuguacauauccggggugugugugugugggcugggggcaacccuucuguacagagcuuccu

SEQ ID NO: 47092 - RNA, 64 nt, Human
ugaggaaccacacugugcugcggaaacauagacgugggggcauaggcucccacugccaccaccg

SEQ ID NO: 47093 - RNA, 64 nt, Human
uaaacagauggcacuuugaaggggccucaccgagugggggcaucaucaaaaacuuuggaguccc

SEQ ID NO: 47094 - RNA, 64 nt, Human
uucucucaaggggaggcucaacagaacauugaccugggggcaaacuuuccucuugaaugggaac

SEQ ID NO: 47095 - RNA, 64 nt, Human
gccccucagucccaggagagcuaugaggccucacugggggcagaacuuggggagaccgaagccg

SEQ ID NO: 47096 - RNA, 64 nt, Human
aggcauuccagaaagaagaguaguuaagcagaugugggggcagggcaagaggagacagcaccuu

SEQ ID NO: 47097 - RNA, 64 nt, Human
cuggcgagcaagcucgcuuuuuaaaaaugaaauuugggggcaggggaaggggaggcgggaggga

SEQ ID NO: 47098 - RNA, 64 nt, Human
uagaaggugguggaugcuuucuagaugucgaugcugggggcagugcuuuccauaaccaccacug

SEQ ID NO: 47099 - RNA, 64 nt, Human
ugguggugaagaaaucucaaucggacaccagaggugggggcaacucugcaagcucaccugcugg

SEQ ID NO: 47100 - RNA, 64 nt, Human
cuuggugaaggcaaguucaagcaccacuugagacugggggcagcauggaguagggcagggcuac

SEQ ID NO: 47101 - RNA, 64 nt, Human
auucuuagcaaaaaaugaacagugauaaguauacugggggcaaaaucagaauggaaugcucugg

SEQ ID NO: 47102 - RNA, 64 nt, Human
uguguuuuuuugaggggaauuaaggaaaaauaagugggggcagguuuggagagcugcuuccagu

SEQ ID NO: 47103 - RNA, 64 nt, Human
uugccacuucugggugagauuaaggugcagggccugggggcaggaggacauaagguauagccau

SEQ ID NO: 47104 - RNA, 64 nt, Human
cauucacuaaggaaggaauugggaacacaaagggugggggcaggggaguuuggggcaacugguu

SEQ ID NO: 47105 - RNA, 58 nt, Human
acccgggaaaggggcugugaccguggggugggggcaaagggugaagagagugugggcu

SEQ ID NO: 47106 - RNA, 64 nt, Human
uguagggaaaugaguguucccuggaacaaggaggugggggcaguguggccccuuccccaacugg

SEQ ID NO: 47107 - RNA, 64 nt, Human
uugggaaggcugggaggccucccauccaggacacugggggcaggagugucaucuuuugggcagg

SEQ ID NO: 47108 - RNA, 64 nt, Human
gccucuguucuccagcugaaccauacccuggcugugggggcaucuguccugagcuuggcuggug

SEQ ID NO: 47109 - RNA, 64 nt, Human
cauccuaagcagccccacagcccaguguucuccuugggggcaggaaccuggggaggggcccaga

SEQ ID NO: 47110 - RNA, 60 nt, Human
cuauucaggagcaacugugaucagggaaguugggggcauuuggccugaaaggcagaaugu

SEQ ID NO: 47111 - RNA, 64 nt, Human
caauuguaaauaacauaugacuucugaguacuuuugggggcacaacuguuuucuguuugcuguu

SEQ ID NO: 47112 - RNA, 64 nt, Human
ucaagauaaacuucuguaaccuaugcauauuuuaugggggcaguauuauuacaaauggaucuga

SEQ ID NO: 47113 - RNA, 64 nt, Human
gcaaugucucauaaagacucggguaguuuuucuuugggggcauugaucucaguuuuucuguaag

SEQ ID NO: 47114 - RNA, 64 nt, Human
ucgaugaugggcagugggggguggaaugcaugugugggggcagagguuaugugggaaaucucug

SEQ ID NO: 47115 - RNA, 64 nt, Human
ggggguggcgggcggcgggcggcgggcaggcgggugggggcacaccccucguaccugucacugg

SEQ ID NO: 47116 - RNA, 64 nt, Human
cguggcugcugaacagccgcaaaccaucuucaccugggggcauugaguggcgcagagccggguu

SEQ ID NO: 47117 - RNA, 64 nt, Human
acugaauaaagugcagggcguaauagugacuggcugggggcacugggccuuuguguuuuuuuuc

SEQ ID NO: 47118 - RNA, 64 nt, Human
aaaagaagagacagccauagacgaggagccagagugggggcagacuggccauuuuuauuuugaa

SEQ ID NO: 47119 - RNA, 64 nt, Human
gaggggcugauccugccucagcuguguggccaugugggggcagcaggggccugggccauagcug

SEQ ID NO: 47120 - RNA, 64 nt, Human
caccggccccuggcagcacagcccagggccugcaugggggcaccgggcuccaugccucuggagg

SEQ ID NO: 47121 - RNA, 64 nt, Human
cagggcacccagaagagucugguguacggccucgugggggcaggggucgugcugaugcugauca

SEQ ID NO: 47122 - RNA, 64 nt, Human
ucuuaaauauauuuugucaucauaaucuuuauggugggggcagacuuugcacuuacugcagugc

SEQ ID NO: 47123 - RNA, 64 nt, Human
uguugaauugcuauguucaggauguucuagggggugggggcagggacucuuuucguaauaagca

SEQ ID NO: 47124 - RNA, 64 nt, Human
gaccugggguaagggugcgcagggaggccgggcuugggggcagccugcugcuauguccuugcug

SEQ ID NO: 47125 - RNA, 64 nt, Human
aaauauccaucuacacagcacccaaggggagggcugggggcaccggcacgggggcagcgugcag

SEQ ID NO: 47126 - RNA, 64 nt, Human
cgaggcccaccgaaggguacugaagagccucaccugggggcauuuuguggguggagggccagag

SEQ ID NO: 47127 - RNA, 64 nt, Human
uaugugguuucuuuguuguuguuuuuguuuggggugggggcaaguacaggguaauucaugagca

SEQ ID NO: 47128 - RNA, 64 nt, Human
aagggguuugaaggaaguuggaaguggggaggggugggggcaucuggucucagaaauggaccag

SEQ ID NO: 47129 - RNA, 64 nt, Human
ccacgcccugcuggaccggccuuaggggugaaggugggggcacagggcccaccccgcccgggac

SEQ ID NO: 47130 - RNA, 64 nt, Human
uuacagcggaugucaacugguuguggugauggggugggggcagaacaugaguagcaaagaaaag

SEQ ID NO: 47131 - RNA, 64 nt, Human
gagaggaaaaacuuggggaggaagaggccugcugugggggcaucggagccagccauguaagaau

SEQ ID NO: 47132 - RNA, 64 nt, Human
ggaaaagagaagggcugcucagggaaacauuggcugggggcacggaauaagcacauaguaaaaa

SEQ ID NO: 47133 - RNA, 64 nt, Human
gcaucgccaggcggccucccugcaaaccaagggcugggggcaaaggggcaugauccaggguccc

SEQ ID NO: 47134 - RNA, 64 nt, Human
cggaauggguacugucuaggaggacugggcagggugggggcaacccagaggacccauggcuagc

SEQ ID NO: 47135 - RNA, 64 nt, Human
ggagcaccuccacuucuagggaagauggacagcgugggggcacaccugggccucccggaagcug

SEQ ID NO: 47136 - RNA, 64 nt, Human
ccuggaaggaauccaagcaggaguuucaucugcaugggggcacucugcaggcccuggaacauug

SEQ ID NO: 47137 - RNA, 64 nt, Human
accacauagaaucaacauaugguagggauuacagugggggcauuucuuuauaucaccucuuaaa

SEQ ID NO: 47138 - RNA, 64 nt, Human
aacaaaacagagcaagaguuauaaccuucagaugugggggcagaauaggacccauuugggcaga

SEQ ID NO: 47139 - RNA, 64 nt, Human
gugccggaacucgcuaucccuguugucuaccugcugggggcacugaccagugagcggccgcugg

SEQ ID NO: 47140 - RNA, 64 nt, Human
guuggugagaggucgcccugccucacuggcacccugggggcacagcuggaagagaggccuggcc

SEQ ID NO: 47141 - RNA, 51 nt, Human
accagcuggggucccggugagugggggcacuucggugagggugacagggug

SEQ ID NO: 47142 - RNA, 64 nt, Human
gcaugagcccugucugccagcccaccccagggacugggggcagcaccaggucccggggagaggg

SEQ ID NO: 47143 - RNA, 64 nt, Human
gauugauacccaguuaauuuuguuugcuaaaggaugggggcaauaaucggcccuugaggagcug

SEQ ID NO: 47144 - RNA, 64 nt, Human
cccuauagcacugagcucacaugggacugggauaugggggcaucucuuccccagagaggcacuc

SEQ ID NO: 47145 - RNA, 64 nt, Human
gcggaagggacucugggcugugccugaggcuggcugggggcaggacaacacagcugcuucccca

SEQ ID NO: 47146 - RNA, 64 nt, Human
cccugugccccuuuucaugguaccaggcccgcacugggggcaauugacuuccuccaauccccac

SEQ ID NO: 47147 - RNA, 64 nt, Human
guggugccagcuucugagggccugcuuggccuccugggggcaaagccccucugcccgaagcaau

SEQ ID NO: 47148 - RNA, 64 nt, Human
aaagcuuuaucugucuugacuuuuuaaaaaaguuugggggcagauucugaauuggcuaaaagac

SEQ ID NO: 47149 - RNA, 58 nt, Human
aucaugagggagacgacugaaaaccaccugggggcaggacccacagccagugggcuaa

SEQ ID NO: 47150 - RNA, 64 nt, Human
cugguaccagaggauggugaggcgaaggccagguugggggcaguguuguggcccuggggcccag

SEQ ID NO: 47151 - RNA, 64 nt, Human
uaacaccuuauuuuaggacccuuuccguuggggaugggggcaagggugggagguuuuuagaaga

SEQ ID NO: 47152 - RNA, 64 nt, Human
auuaccauaucccuggaacuccuucucaggcuggugggggcagccuugcaagagaaacagcagc

SEQ ID NO: 47153 - RNA, 64 nt, Human
cccaggucucugccuucauuguugcuuuuucuggugggggcaaggggagcugguauggauggaa

SEQ ID NO: 47154 - RNA, 64 nt, Human
ggcugcccucuccccagccuggcguggcuggggcugggggcagccuuggcccagcuccguggcu

SEQ ID NO: 47155 - RNA, 64 nt, Human
cucugggguagggagcagggcugggcaggcauucugggggcagggugggggaggggcgagagua

SEQ ID NO: 47156 - RNA, 64 nt, Human
aucuguacgcguugaacaacuugguucaagauggugggggcauuuuuagagcggcaauaauuga

SEQ ID NO: 47157 - RNA, 64 nt, Human
ccaauggggagccccaggugaggagagaagcaucugggggcacuccaaaaggggccugugaugu

SEQ ID NO: 47158 - RNA, 64 nt, Human
acaaagcccaacagcaagggugacuccuggcaggugggggcagcaggagggcagagggcagagc

SEQ ID NO: 47159 - RNA, 64 nt, Human
gccguuccagaaccucggucaguguuucccugucugggggcagggcccagagcgagcacgcguc

SEQ ID NO: 47160 - RNA, 64 nt, Human
ugggggaaauggaaaguuuuccucaaggagcagcugggggcagaauagguaguauuuaagcaaa

SEQ ID NO: 47161 - RNA, 64 nt, Human
acaccugcaccacggccauggggaggcugcucccugggggcagagucucuggcagagguuauua

SEQ ID NO: 47162 - RNA, 64 nt, Human
gggcucuaacugcccccuacuggugucuggggguugggggcagccaggcacagccggcucacgg

SEQ ID NO: 47163 - RNA, 64 nt, Human
gcugcccccucuuccuuagcagacgaaccaguaaugggggcaaggcuggggcaucccagcccac

SEQ ID NO: 47164 - RNA, 64 nt, Human
guggagauggacccgugaccucguggaggccgugugggggcagcagccuggccugugccauggu

SEQ ID NO: 47165 - RNA, 64 nt, Human
uggagcggaauuuaccugauuucuucagggcugcugggggcaacuggccauuugccaauuuucc

SEQ ID NO: 47166 - RNA, 54 nt, Human
cggugugugagggugacuagguguugggggcagagcggggcaggaaagguaggg

SEQ ID NO: 47167 - RNA, 64 nt, Human
ggaagggcagagugcugguuucuccagguuggguugggggcacugcuguccccccuccagcuag

SEQ ID NO: 47168 - RNA, 64 nt, Human
uggcugcugggggagccgugucacuccugggccaugggggcaccuccugggcacuuagguguuu

SEQ ID NO: 47169 - RNA, 64 nt, Human
ugucuucuacugaaggacaguccgcugucuccagugggggcagcagcugucccccagccucgau

SEQ ID NO: 47170 - RNA, 64 nt, Human
uggggccacugggccagcgccuggcgauacugguugggggcaggaucauucugccccuugucca

SEQ ID NO: 47171 - RNA, 64 nt, Human
cuuuuugaaacaaaauaauguguaauuuuccauuugggggcaaacucuauucuugugagcauua

SEQ ID NO: 47172 - RNA, 64 nt, Human
uccugggguggccuguccugcaggggcccuggaaugggggcaagcagcugggugggcagaaugc

SEQ ID NO: 47173 - RNA, 64 nt, Human
cgucagaauccguuccugagcagcuccugugcccugggggcagucacagagccccccaacaccc

SEQ ID NO: 47174 - RNA, 64 nt, Human
uagcuccacauucugguguaguuuaaaaugccuuugggggcaguuugaagcaguucuucaugcc

SEQ ID NO: 47175 - RNA, 64 nt, Human
guggcugacaguuaucuuccaaccccaacuggcuugggggcaggacaagggcuaggcuugaugg

SEQ ID NO: 47176 - RNA, 64 nt, Human
uuuggccuggacagcacugauuuguggauguggaugggggcacguuguccgugauaaaaguaca

SEQ ID NO: 47177 - RNA, 64 nt, Human
aagggacagagagaggagaggaggaagauugagcugggggcaacagccaagcucaccugggcag

SEQ ID NO: 47178 - RNA, 64 nt, Human
gaucuccagagcuaccgaguucaucuguggguguugggggcaagugggggcugaaguccugugc

SEQ ID NO: 47179 - RNA, 64 nt, Human
ccagcagcagccuggcugccuugucauggccuccugggggcagaaggcgauguggaccacggga

SEQ ID NO: 47180 - RNA, 64 nt, Human
gggcggaggugggguuggucuggaagaagguccaugggggcagggaguugcgaggugggguuag

SEQ ID NO: 47181 - RNA, 64 nt, Human
agagcagccuuuuaaaagcaaauugcgccauagcugggggcagcgggggugggcgaggccugag

SEQ ID NO: 47182 - RNA, 64 nt, Human
aggagggaggcaggcauagcaucugaacccagugugggggcauucacuagaaucuucaaucaac

SEQ ID NO: 47183 - RNA, 64 nt, Human
ccauccacccgcuucagggaggaacuggacucucugggggcaggugccaagauuugccccccca

SEQ ID NO: 47184 - RNA, 64 nt, Human
uccuccucacuauucucaccaggccaugggacuuugggggcagugagagagagcuggaaagggg

SEQ ID NO: 47185 - RNA, 64 nt, Human
gacagcucacccccaccagcaugauggccccagcugggggcaguggcaggagccuuacuuuugu

SEQ ID NO: 47186 - RNA, 64 nt, Human
gggugggccugaggcaggcagccgaccugaggccugggggcaccguggaccccuaugcccgggu

SEQ ID NO: 47187 - RNA, 64 nt, Human
accacagaucccagagauaggggcccagucuccaugggggcaaggagcauagagauguuuucca

SEQ ID NO: 47188 - RNA, 64 nt, Human
cugggugggccacacucagccugacugcccuccaugggggcauucuggcacccccugcuccagg

SEQ ID NO: 47189 - RNA, 64 nt, Human
ucuuuucccgagauucaaaucuccgauucccauuugggggcaaguuuuuuucuucaccuucaau

SEQ ID NO: 47190 - RNA, 64 nt, Human
auucggggucucagcccccaggcugugagcuccuugggggcaggcccucaauaaaugugaacug

SEQ ID NO: 47191 - RNA, 64 nt, Human
gaguggguguggaauugcuuuccucgggccaccgugggggcaccucuggccucccgugaccccc

SEQ ID NO: 47192 - RNA, 64 nt, Human
ucccuucugccucugccccguuggaugcccugacugggggcaggggaagagacagggcacagcu

SEQ ID NO: 47193 - RNA, 64 nt, Human
ggcuucaagauccaucgccuuggccugaucgcugugggggcaggggccuggaguacgaggggca

SEQ ID NO: 47194 - RNA, 64 nt, Human
aacugggaugugguagagggacugaagguaccuuugggggcaacagcacccuaguuucauucuc

SEQ ID NO: 47195 - RNA, 64 nt, Human
cccuccaggcuucacccucccugccuaagcagggugggggcagagccaugacauuuuugguuua

SEQ ID NO: 47196 - RNA, 64 nt, Human
cccuucacucuaauggacuguuccagggaagggaugggggcagcagcugcuucggauccacacu

SEQ ID NO: 47197 - RNA, 64 nt, Human
gcuuccuggcccugugcuggggguggggggaagcugggggcacauguggcccuugccuucugag

SEQ ID NO: 47198 - RNA, 64 nt, Human
acugcguaggcaagaaguugaaaaacaguugauuugggggcacuuagguaccauaugccccauu

SEQ ID NO: 47199 - RNA, 64 nt, Human
ugggaugccccaucccccuccccaucaccuuuggugggggcagggccugguggcaccugugcaa

SEQ ID NO: 47200 - RNA, 64 nt, Human
uccaggacauugaguuggaagacuaugaucugggugggggcaggauaacauggcuucucuuuac

SEQ ID NO: 47201 - RNA, 64 nt, Human
aaggggaggacacuggugguucuacugacccaacugggggcaaagguuugaagacacagccucc

SEQ ID NO: 47202 - RNA, 64 nt, Human
gaaccagcaccucccaccaaccaaccacacccggugggggcacagcacagaccccagagccagg

SEQ ID NO: 47203 - RNA, 64 nt, Human
gaaccagcaccucccaccaaccagccacacccggugggggcacagcacagaccccagaggcagg

SEQ ID NO: 47204 - RNA, 64 nt, Human
gaaccagcaccucccaccaaccagccacacccagugggggcacagcacagaccccagagccagg

SEQ ID NO: 47205 - RNA, 64 nt, Human
ccaccccacccccacaccuggacgcucgcucuggugggggcacacgcagguggaggugguugug

SEQ ID NO: 47206 - RNA, 58 nt, Human
gagccgcaggggcgcucugaaaggggccugggggcaucucgggcacagacagccccac

SEQ ID NO: 47207 - RNA, 64 nt, Human
cuggcggcugcugucugagccccgggagaccaggugggggcaggacuguggcccuugugggggc

SEQ ID NO: 47208 - RNA, 64 nt, Human
ccagccaggaaccucucagagcugaagcaggcccugggggcagaagugccagaugacagucaga

SEQ ID NO: 47209 - RNA, 51 nt, Human
ucuuuaagaagaacaaguaguugggggcaaggucccaggccaacucccucc

SEQ ID NO: 47210 - RNA, 64 nt, Human
uugcaucacuccacugcacaguguuagugggaccugggggcaagucccuugacuucucugagcc

SEQ ID NO: 47211 - RNA, 64 nt, Human
caaacaaguccuaucuuuuuuuuuuuggcuggggugggggcauuggucacauaugaccaguaau

SEQ ID NO: 47212 - RNA, 64 nt, Human
gugccucucagacugagaacucuuuucuucuugcugggggcauugcuaucucuaggauguuugc

SEQ ID NO: 47213 - RNA, 64 nt, Human
uuguagggggggcauuuuugguugcccccaugcgugggggcacuacuaagaaugcuaaacuuag

SEQ ID NO: 47214 - RNA, 64 nt, Human
gaggccucuggagaagaccuggggugggggcugaugggggcaggcccacagugagagacugccu

SEQ ID NO: 47215 - RNA, 64 nt, Human
cagauggacgcugcccauccuugagccagccagcugggggcagagagguggguggcgggcaccu

SEQ ID NO: 47216 - RNA, 64 nt, Human
ugcaccugcccucugcagcccucugccagccucuugggggcaguuccggccucuccgacuuccc

SEQ ID NO: 47217 - RNA, 64 nt, Human
agauuuguucagggugccaguagugggcauggggugggggcaaggcaggacaaaacauacaagu

SEQ ID NO: 47218 - RNA, 64 nt, Human
gguugggaggccucucugggccuggaggugggggugggggcagccaaguccagccacucuucac

SEQ ID NO: 47219 - RNA, 64 nt, Human
ugcuccucugaccucccggucucccucugcaggcugggggcagaggccugaggacaaggaagag

SEQ ID NO: 47220 - RNA, 64 nt, Human
gaguguccagagcugccuccccaggagguuaaggugggggcaaaggggaagcuucaagcacuuu

SEQ ID NO: 47221 - RNA, 64 nt, Human
augaugagucagaagauucagcagcucacagcccugggggcagcucaggcuacugcuaaggccu

SEQ ID NO: 47222 - RNA, 64 nt, Human
ccccugccagccaccugcaccuguggacagugggugggggcacuacuccccacucagagcacaa

SEQ ID NO: 47223 - RNA, 64 nt, Human
cguccucacaacucuuaauugggccuagugaaaaugggggcaggugagaaguccauuuugagaa

SEQ ID NO: 47224 - RNA, 64 nt, Human
gaaacggggcaccacaggaucccugugcaagggcugggggcacgcucuggccccaggcuugugc

SEQ ID NO: 47225 - RNA, 64 nt, Human
uccuugcuuuguauuuaaggacuggggcauagcaugggggcagucccccagaccucuucauucc

SEQ ID NO: 47226 - RNA, 64 nt, Human
uuuauuuaugggauccuggaguucugguuccuacugggggcaacccuggugaccagcaccaucu

SEQ ID NO: 47227 - RNA, 64 nt, Human
uucuucacagucaaagcauuuauauuauugggggugggggcagggaauuaaguuggugggcucg

SEQ ID NO: 47228 - RNA, 64 nt, Human
aggaguugcuguuuguuugacaaagaaacccaagugggggcagagggcagaggcuggaggcagg

SEQ ID NO: 47229 - RNA, 64 nt, Human
ggauugcacugggccaucagcucaugccaggcuaugggggcagccaguuggcauugcuccccag

SEQ ID NO: 47230 - RNA, 64 nt, Human
uccgccuccuccgcuuggggggccggagagauggugggggcagcuccucuucuucugacucaga

SEQ ID NO: 47231 - RNA, 64 nt, Human
gggagagucaccgagggcccauguggcuggagguugggggcaggaucuggcccgagcucuccuc

SEQ ID NO: 47232 - RNA, 64 nt, Human
gaacuggcggguggugugugugcagcaaaggcauugggggcacgggugagaugcccacugugug

SEQ ID NO: 47233 - RNA, 64 nt, Human
agccucugugccccguccuugugccaggucaaggugggggcaggcugggcccugcauuucuggg

SEQ ID NO: 47234 - RNA, 64 nt, Human
aggucuagccgggcccauugcagggggcagcacuugggggcaucuccggcacuugggugggacc

SEQ ID NO: 47235 - RNA, 64 nt, Human
aggcugccugcugugcugggagguauagggguccugggggcaggccagggcaguugacagguac

SEQ ID NO: 47236 - RNA, 64 nt, Human
acuauaacucuagcauccccaucccauuugacacugggggcaaggguucuucuugcaugugggg

SEQ ID NO: 47237 - RNA, 64 nt, Human
gcaaaggaccagguaauuggggaggggagagaggugggggcaagggggaaaugcccccccaucu

SEQ ID NO: 47238 - RNA, 64 nt, Human
gauauuuucaaaauuacaaugcauuuauggugucugggggcaggggaacaucagaaagguuaaa

SEQ ID NO: 47239 - RNA, 64 nt, Human
accucucugugccucaguuuccucaucugcaaaaugggggcaauaugucaucuaccuaccucaa

SEQ ID NO: 47240 - RNA, 64 nt, Human
gacgauguguuuguuccagugauacugaaaguagugggggcaagaauugaguuucacaguggaa

SEQ ID NO: 47241 - RNA, 64 nt, Human
ugcaccacugugugccuggcccugugcugggcacugggggcacucccugcaggagccaucaucu

SEQ ID NO: 47242 - RNA, 64 nt, Human
aagugcacuggcccucuuugaaagggcuuuacagugggggcaccaagaccccaaagggcccagg

SEQ ID NO: 47243 - RNA, 64 nt, Human
cuugguuggaccugcccacuccaaaaacccagugugggggcaaagggcgugggaagagcagggc

SEQ ID NO: 47244 - RNA, 64 nt, Human
cagggaaugccagcaaucaggcagcacccagcugugggggcaguggggugggggagacccacau

SEQ ID NO: 47245 - RNA, 64 nt, Human
ggacgcgggcacccgucaugcuuuugcugagaguugggggcauuaaccuugagcuaauguuaaa

SEQ ID NO: 47246 - RNA, 64 nt, Human
uuuauuuuggagccaaaaaauugauucuggggggugggggcagcguagaagugguauauccaag

SEQ ID NO: 47247 - RNA, 64 nt, Human
ugaugcuaccucacaacacaaacagguaguucguugggggcaaaugaauuagccaacuguuaac

SEQ ID NO: 47248 - RNA, 64 nt, Human
cagguguauaaggaacaaugucuuauaaacagcaugggggcaaucugagaauauuccucaaaag

SEQ ID NO: 47249 - RNA, 64 nt, Human
auuuuuaaugacuccauuuaaaaauaucacagggugggggcaaggaaauuagcugagauucauc

SEQ ID NO: 47250 - RNA, 64 nt, Human
auccaauacgaguccaggggugaccgcaggauggugggggcagcgggcuucuccaccuacccca

SEQ ID NO: 47251 - RNA, 64 nt, Human
gugauuuacaccacuguaccauacugacccaggcugggggcagguguguuggagacaggcuggu

SEQ ID NO: 47252 - RNA, 64 nt, Human
uucuucucuaagaccuggaaagucagcaacccucugggggcagcaggacugggcagaucccagg

SEQ ID NO: 47253 - RNA, 64 nt, Human
aagagacuuaaugguaugauguguacauagggacugggggcaggauuggggguuucggagcuug

SEQ ID NO: 47254 - RNA, 64 nt, Human
ccuucccauugucaagaugugccacgggugccacugggggcacacugaacuuguagggagugug

SEQ ID NO: 47255 - RNA, 64 nt, Human
gccagccugcuccuucccaggaguggaggaggccugggggcagggagaggagugacugagcuuc

SEQ ID NO: 47256 - RNA, 64 nt, Human
aacuggacagaccuugguuuguuuacauguccgaugggggcaggagcucccauccugggcagcc

SEQ ID NO: 47257 - RNA, 64 nt, Human
uuuuggcuucacgccaucaggccucaagugggcaugggggcagggacgggcccaggaacuguug

SEQ ID NO: 47258 - RNA, 64 nt, Human
cccacugugccuucccggccucccgggcuucugcugggggcagaagaaaugccuccccaggucu

SEQ ID NO: 47259 - RNA, 64 nt, Human
cccuccacacaggcauccucagggcacagggcccugggggcaccuuccuccuuucguauuuguu

SEQ ID NO: 47260 - RNA, 64 nt, Human
caguuuuagaaagugaaaaaaguuaaaaaagaaaugggggcaguggguuauuagaaauaacaua

SEQ ID NO: 47261 - RNA, 64 nt, Human
auuucuuacaugcauauauugcaucguggugaagugggggcaguuccuuuugauugcugaguag

SEQ ID NO: 47262 - RNA, 64 nt, Human
ggggaagccuaggcugccucaauggaggagucgcugggggcauuuucacccacaauucuggcca

SEQ ID NO: 47263 - RNA, 64 nt, Human
ccagaacugugaauggccugcuccaggccauggcugggggcagggagugaggggacaauuucug

SEQ ID NO: 47264 - RNA, 64 nt, Human
auuuuuagauucuucugcucccuagugaccuaccugggggcaaagaaauugcaaggacuuuuuu

SEQ ID NO: 47265 - RNA, 64 nt, Human
cuaacuucugagcccaccucccaggguaggcaccugggggcaugcaggugcccaccucccaggg

SEQ ID NO: 47266 - RNA, 64 nt, Human
ggcaugcaggugcccaccucccaggguaggcaccugggggcaugcagguacccaccucuuucuc

SEQ ID NO: 47267 - RNA, 64 nt, Human
uaucugggagggaagaugggugcugggagaggguugggggcagggggcaaggaaaauugcuacc

SEQ ID NO: 47268 - RNA, 64 nt, Human
cugcuagcugagcacuuccacaagggcauaccccugggggcaggggcuggggcugagaacugca

SEQ ID NO: 47269 - RNA, 64 nt, Human
guccucaucaccugugucuuugcugcuuuuguuuugggggcauucauugcagguguggcaguau

SEQ ID NO: 47270 - RNA, 64 nt, Human
cccuggagccagaggguuuucuaaaugagauaacugggggcaaagguugggauaggcgcagcag

SEQ ID NO: 47271 - RNA, 64 nt, Human
aaugagcauucaagugauucugaugcaggugagcugggggcauacagggaggaacacugcccug

SEQ ID NO: 47272 - RNA, 64 nt, Human
ucuguccaggcuccauucagguccugcuguacucugggggcagggagaggcuagaggggcagga

SEQ ID NO: 47273 - RNA, 64 nt, Human
ugcacuuucccggggagagaaccaguaugagaagugggggcagggcacacauucaucuuuguag

SEQ ID NO: 47274 - RNA, 64 nt, Human
gaaugagaagccauccauggaaauuugaacugagugggggcagagaaagagugcagaucccuuu

SEQ ID NO: 47275 - RNA, 64 nt, Human
cucaggaaggcuucuugcuuacaggaaugaaggcugggggcauuuugcuggggggagaugaggc

SEQ ID NO: 47276 - RNA, 64 nt, Human
cuggcuggugcuguaacaaagacccaugugaugcugggggcagagacagaggagaagcuguuug

SEQ ID NO: 47277 - RNA, 64 nt, Human
gccgggccacucugcuagaguccauccgccaagcugggggcaucggcaaggccaagcugcgcag

SEQ ID NO: 47278 - RNA, 64 nt, Human
uccgagauguggcccuugcacuagcagcucuggaugggggcaggagccuggaagagcuaacucg

SEQ ID NO: 47279 - RNA, 64 nt, Human
cacccugacccuggcucaccccucuuccuaggccugggggcaggcaguuccuaccauguacccc

SEQ ID NO: 47280 - RNA, 64 nt, Human
ugccagugccccccugaggacuagggcaggcagcugggggcacuugguuccauggagccuggau

SEQ ID NO: 47281 - RNA, 64 nt, Human
caccuccacacagccgaagcacccggcaucuuggugggggcaccuuuuuaaacauuuuuuuuuu

SEQ ID NO: 47282 - RNA, 64 nt, Human
cccuagagguuuuguucguacucuuaacagggagugggggcaggaagaguccuguacuaugcag

SEQ ID NO: 47283 - RNA, 64 nt, Human
ucaagggauguaagggauauggcuugaggagggaugggggcaggaaugagggaaggucuugggu

SEQ ID NO: 47284 - RNA, 64 nt, Human
ggccuuagcucuagagugagggguggguggaaccugggggcaccucguucacccuguccccacu

SEQ ID NO: 47285 - RNA, 64 nt, Human
gcauucauccuucguaucacugcagaagcaacagugggggcacagggagggaacucuugacacu

SEQ ID NO: 47286 - RNA, 64 nt, Human
gcaaaugcuuggugguucgacuucucccucugucugggggcaggcucagcaucugcccacuggu

SEQ ID NO: 47287 - RNA, 64 nt, Human
ugccaagggcugaaggagguacccucuuggcagaugggggcaucacuugcuuccuuugggaagc

SEQ ID NO: 47288 - RNA, 64 nt, Human
gaggcuuugcuggcuguggugauggggauugaguugggggcaagggucccugccuagacuguug

SEQ ID NO: 47289 - RNA, 64 nt, Human
uucucacagacccuagguauccacagcugugacaugggggcaagcggcuuuguuucagccuaac

SEQ ID NO: 47290 - RNA, 64 nt, Human
ccaucuggaccaguagcccaucccgcaguuuucuugggggcagaggaaaacgcuucuuucuccu

SEQ ID NO: 47291 - RNA, 64 nt, Human
ucuuugcucaguggaucacacacauggaaggugaugggggcauggguggagggucccuaauucu

SEQ ID NO: 47292 - RNA, 64 nt, Human
uuuuauuuuaaugaaguguuauacaaucaagaaaugggggcaagggccugccccccacucccuc

SEQ ID NO: 47293 - RNA, 64 nt, Human
gugggagggaggaacaccggugccucggucacucugggggcaguuuagaugcugugaaauuaaa

SEQ ID NO: 47294 - RNA, 64 nt, Human
ggcagccuccuuccuguaggcgagggcccaagucugggggcagaaccugaguguggauggggcg

SEQ ID NO: 47295 - RNA, 64 nt, Human
ggcugcacaccgugaagauguggagggcguagggugggggcagugaggaauggguccguacagc

SEQ ID NO: 47296 - RNA, 64 nt, Human
ugucugcucugccucgguuuccccaucuggaaaaugggggcagggguccugaccuaccucaggu

SEQ ID NO: 47297 - RNA, 64 nt, Human
cugcuuggaugcgagcuuggccuugggccggugcugggggcacagcugucugccaggcacucuc

SEQ ID NO: 47298 - RNA, 64 nt, Human
gaccagccgcccagaucaugccgccgcagcugguugggggcaccaucuggacggggaugguucc

SEQ ID NO: 47299 - RNA, 64 nt, Human
aacucagugcugguuuguaaauggugaggggacuugggggcaucccagagugcucccuccaggc

SEQ ID NO: 47300 - RNA, 64 nt, Human
aauauuuuuggaauaaugugaaucaaccgaaaacugggggcaaggcagaggacagguuuucuca

SEQ ID NO: 47301 - RNA, 64 nt, Human
cucccuaacucccugaccugagaacccuggggccugggggcaguuugagccuccucucccuucu

SEQ ID NO: 47302 - RNA, 64 nt, Human
augcucugcccucagaccuggccaggugaugcucugggggcagcaucuccccaccgagagaagc

SEQ ID NO: 47303 - RNA, 64 nt, Human
augaucccugccugugagccacaccuccuagcucugggggcaaaggggcuuaguaaaggaaugc

SEQ ID NO: 47304 - RNA, 64 nt, Human
uuccaaucagaagucucacugguggggcugggggugggggcaggcaggaggcauggaugggaac

SEQ ID NO: 47305 - RNA, 64 nt, Human
aucgguucuucagcuccugaugggggcuguguaaugggggcagaggccagggaaaaagaugcug

SEQ ID NO: 47306 - RNA, 64 nt, Human
ggcuucuuauccugugccucucccaucuccugggugggggcaucaaagcauuucuccccuuagc

SEQ ID NO: 47307 - RNA, 64 nt, Human
ucaagguggcucuuggaaccugggaggcagcaucugggggcaguggauagaacacccggccugu

SEQ ID NO: 47308 - RNA, 64 nt, Human
cacccuccccaccucaccaacuuuggucccucucugggggcaugaaugguuaacaaacaccaga

SEQ ID NO: 47309 - RNA, 64 nt, Human
acaccagagcaguacuccaauauuggagagucgcugggggcacagggcuuugaaucaggguagu

SEQ ID NO: 47310 - RNA, 64 nt, Human
ggugcugcucuagggcagggaauuaugggagaagugggggcagcccaggcgguuucacgcccca

SEQ ID NO: 47311 - RNA, 64 nt, Human
uguaauuucaggggagcaucaguggaggaggcagugggggcagcagcagccuccugaccaaugc

SEQ ID NO: 47312 - RNA, 64 nt, Human
uucaccucccugaugccugcuuucaguugaggguugggggcaaugaugagcauaugaauuuuuu

SEQ ID NO: 47313 - RNA, 64 nt, Human
aauauguccgcagaauggacuugauagcaaacacugggggcaccuuaagauuuugcaccuguaa

SEQ ID NO: 47314 - RNA, 64 nt, Human
ugacacugcaauuggcaccgaagcccagagggucugggggcacaagacugacgccaggguauga

SEQ ID NO: 47315 - RNA, 64 nt, Human
cggagaggccggugcacagggccccgccaggggcugggggcaucccggcuuccacaaugcagcu

SEQ ID NO: 47316 - RNA, 64 nt, Human
aacuggaguuuugcugcuaaagaacucuucucucugggggcagagcuucuauuuauggcacaua

SEQ ID NO: 47317 - RNA, 64 nt, Human
acacgcaugugcagauggcaccacggccggcaccugggggcacacacaugcaggcggcgugguc

SEQ ID NO: 47318 - RNA, 64 nt, Human
agggacagacuggaauguaugucauuuggggucuugggggcagggcucccacgaggccauccuc

SEQ ID NO: 47319 - RNA, 64 nt, Human
gcuacagugaugggauuugcauuuuagggugauuugggggcagaaauaacugcugaugguagcu

SEQ ID NO: 47320 - RNA, 64 nt, Human
ccaucggccugaggggcagccugguggccagagcugggggcacacagaauaguuuuguauaaua

SEQ ID NO: 47321 - RNA, 64 nt, Human
caggagacgagagaauaugaagucuccaucuaggugggggcagucuagggaagucaacucagac

SEQ ID NO: 47322 - RNA, 64 nt, Human
cccuagugccccaucauauuaacugucaguauuuugggggcauuagguuaauagacuuaauugc

SEQ ID NO: 47323 - RNA, 64 nt, Human
gacugucagcaugaugucagaggccagaguuuggugggggcagauggcagggcgacccaaaaga

SEQ ID NO: 47324 - RNA, 64 nt, Human
ggguacaaagaaggaauagaagauuccguggccuugggggcaggagagagacacucuccaugaa

SEQ ID NO: 47325 - RNA, 64 nt, Human
ucagaaagccugaggcgugcccagagcacaagacugggggcaacuguagaugugguuucuaguc

SEQ ID NO: 47326 - RNA, 64 nt, Human
uggcuggcuaacuaggaccucucgaaagucucugugggggcaugagggagaaaaggccauuggg

SEQ ID NO: 47327 - RNA, 64 nt, Human
gaugcugaaacaggagagaaaggggauguauccaugggggcagggcaugacuuugucccauuuc

SEQ ID NO: 47328 - RNA, 64 nt, Human
ucagcagugggaccagggccucgcagcagcaaggugggggcaagcagaaugccucccaggauuu

SEQ ID NO: 47329 - RNA, 64 nt, Human
cccaaccagagauccccuuccuugcugagaggguugggggcaggaggagauuuggcagugccug

SEQ ID NO: 47330 - RNA, 64 nt, Human
augugucaccggggcaacugccugggggcggggaugggggcaggguggaagcggcuccccauuu

SEQ ID NO: 47331 - RNA, 64 nt, Human
gcagcucuuccuugccagagaugaucugacccggugggggcagcuggaaagcaacacuggcccc

SEQ ID NO: 47332 - RNA, 64 nt, Human
cuuccuccacagugguccaaggagcaguccucagugggggcaggugugggcccuaccccuaagc

SEQ ID NO: 47333 - RNA, 64 nt, Human
uccuuccaucucuuccuucagaaguuucgucuaaugggggcagucuccccuuccuggcacauug

SEQ ID NO: 47334 - RNA, 64 nt, Human
uuaacucuuuaugaccuucacucagcuguggauuugggggcacuuugugggagacuuggcuuuu

SEQ ID NO: 47335 - RNA, 64 nt, Human
gcuauaggugccuugcucuucugucggaggcugcugggggcaagagcagcugcacaaggccagg

SEQ ID NO: 47336 - RNA, 64 nt, Human
augggacauugugggaaaggcuuuggccauggucugggggcagagaacaaggggggagacacaa

SEQ ID NO: 47337 - RNA, 64 nt, Human
cccagaaaaggaaagggcuuggugguacaugaagugggggcagugggcagggugcccugggggg

SEQ ID NO: 47338 - RNA, 64 nt, Human
gauugaggguggaaggugggcugugaagacuuuuugggggcauccuggagucugugaaugaagc

SEQ ID NO: 47339 - RNA, 64 nt, Human
cugcucccuggacuucuccuggguugugcuuuuuugggggcaacauaccuuggacaaagcugag

SEQ ID NO: 47340 - RNA, 64 nt, Human
uuucugugggcacacacucuguuucagacugggcugggggcacacgugcugggugagacagugg

SEQ ID NO: 47341 - RNA, 64 nt, Human
cuacagagauguguuggagagcacgucgugaccuugggggcaaggaauccagaaagguaggaag

SEQ ID NO: 47342 - RNA, 64 nt, Human
agcagaauauugaccaguaagaggguaaauaaagugggggcaaccccuggauaugaauguuacc

SEQ ID NO: 47343 - RNA, 64 nt, Human
acuucccacauacccagaggagagcauaugccugugggggcagugcugauggcauccagaguca

SEQ ID NO: 47344 - RNA, 64 nt, Human
cccucucauuggaaguggcaaggggcuucccuccugggggcagcuacacucguccccagaggca

SEQ ID NO: 47345 - RNA, 64 nt, Human
cucugauggcucaggaggacuuguggggagaggcugggggcacccauguggugggcucugugca

SEQ ID NO: 47346 - RNA, 64 nt, Human
caacaccaaaggcgcagaagccggcuggccguggugggggcagcguaggcguagcaucccucuc

SEQ ID NO: 47347 - RNA, 64 nt, Human
cugggguaggggaggguggcagguauaagacuucugggggcaccccaagaccccagacacccaa

SEQ ID NO: 47348 - RNA, 64 nt, Human
cagagaggcagguccuaaaggagggggggucuccugggggcagaccgagggucucggaggauag

SEQ ID NO: 47349 - RNA, 64 nt, Human
cguccauggagcugagggucggaggaaccuuccuugggggcagcagcccuucccgggggccuac

SEQ ID NO: 47350 - RNA, 64 nt, Human
uucugcugccuguuuggggaggggggcggugaggugggggcagcggccccgcaccccuccuccu

SEQ ID NO: 47351 - RNA, 64 nt, Human
ugaguaugcugaaauccgggucaagugaaggagcugggggcagccugcguggcugaccccccuc

SEQ ID NO: 47352 - RNA, 64 nt, Human
aacauugacacuggaugggcugcagcagaggcacugggggcagcgggggccagggaaguccccg

SEQ ID NO: 47353 - RNA, 64 nt, Human
gacuuggaguggcgagcuggggcccgauggggcuugggggcagaguagacaucuagccucccua

SEQ ID NO: 47354 - RNA, 54 nt, Human
gccacgugcagaagaagugacggcugggggcacagugggcugggcgccccugca

SEQ ID NO: 47355 - RNA, 64 nt, Human
acgccacaccugcugugucccgagagucuccagaugggggcaucagggugagguccgggacucu

SEQ ID NO: 47356 - RNA, 64 nt, Human
gaucugcagauccugccccaagaagcugggguggugggggcaguaauuccugccccccucucug

SEQ ID NO: 47357 - RNA, 64 nt, Human
ggggcggggcuugugggaggggcggggcuaagaaugggggcagugggggaaggaaggggagagg

SEQ ID NO: 47358 - RNA, 64 nt, Human
ccuaaagccucccuucucccauacugggugaugcugggggcagagaugagucaggccuaaggcu

SEQ ID NO: 47359 - RNA, 64 nt, Human
acuuauaguacccccucaggacauggacaguaugugggggcaggaagguuaucuccucccgggu

SEQ ID NO: 47360 - RNA, 64 nt, Human
uaugggagcaaauugcccuggaccuuugccugaaugggggcaggaaaggugagguguugcuggc

SEQ ID NO: 47361 - RNA, 64 nt, Human
acuagcuuguuacagcugccucuguccccacaugugggggcaccuucuccaguaggauucggaa

SEQ ID NO: 47362 - RNA, 64 nt, Human
cuuuaucaucaccucaguuucccugaauuauauuugggggcaaagauuguccccucugcuguuc

SEQ ID NO: 47363 - RNA, 64 nt, Human
uggacagagaggaaggagguggagcagcuggggcugggggcacagccugggcauucugugggga

SEQ ID NO: 47364 - RNA, 64 nt, Human
acaucauaggagcagcucgcuggccagaaggggaugggggcaucccugugccucacucagcucc

SEQ ID NO: 47365 - RNA, 64 nt, Human
ccuggucuuucccugauguucucguggcugcuguugggggcagagauugacgcccccggucuuu

SEQ ID NO: 47366 - RNA, 64 nt, Human
uagcaagauggagggauggggcucucuccugggaugggggcagguguuccugaauaccgacagg

SEQ ID NO: 47367 - RNA, 64 nt, Human
uccucuuuccacgaugccgcugggcgacguggcgugggggcagggggacggugggggagcccuc

SEQ ID NO: 47368 - RNA, 64 nt, Human
agggacucuauggaaaacuggcagccauugggugugggggcagucuguaaaucagucaccugug

SEQ ID NO: 47369 - RNA, 64 nt, Human
aaggaugacgcuguaaacauagcccacgcuguccugggggcacugggaagccuagauaaggccg

SEQ ID NO: 47370 - RNA, 64 nt, Human
gggauuggggaggaggggaugggcagcggaggguugggggcauggucugcaggcucaucugugu

SEQ ID NO: 47371 - RNA, 64 nt, Human
gccgggacuucugguagaggcggcugggggagggugggggcagggcuggcugggggcuucuccc

SEQ ID NO: 47372 - RNA, 64 nt, Human
caaucuuugcacuuccauuuccugcccucuaauuugggggcagcaguuugugcuuuguaagcuu

SEQ ID NO: 47373 - RNA, 64 nt, Human
acugacaaacucugucugccgccagaaggaaugcugggggcagucaugucccaggucccgugcu

SEQ ID NO: 47374 - RNA, 64 nt, Human
ucagaaggaacaaggcccccagagggaggucaccugggggcagcuggugccgggucuucaccca

SEQ ID NO: 47375 - RNA, 64 nt, Human
cccaccuggugccgugggagccacccccaggugcugggggcacagccccuccccacuccggcca

SEQ ID NO: 47376 - RNA, 64 nt, Human
gccccagaggaccgagagaguggagagugcggcgugggggcacugaccaggcccaaggaggguc

SEQ ID NO: 47377 - RNA, 64 nt, Human
gggagcccucgcggcaagcagggugggggggacuugggggcaugccgggcccucacucucucgc

SEQ ID NO: 47378 - RNA, 64 nt, Human
aaugcuacugaccagggcagagcuggggagggcgugggggcaguaaagccucugcuacagccgg

SEQ ID NO: 47379 - RNA, 64 nt, Human
gccagggcuggccucaguuucuccucaacaggccugggggcagcccuuccccugccuagucccc

SEQ ID NO: 47380 - RNA, 64 nt, Human
gcccuccccacccggcauccaccugcauccccucugggggcaggagcccacccccagcaccccc

SEQ ID NO: 47381 - RNA, 64 nt, Human
ugccuucaagcaucccugcaacugccacagcaggugggggcagggcucgugggacccucuggac

SEQ ID NO: 47382 - RNA, 64 nt, Human
agacccccccucaccccaggacccuaggagggggugggggcagguagggggagauggccuugcu

SEQ ID NO: 47383 - RNA, 64 nt, Human
aagaccgggcuugggagaggggcgcagcuaagacugggggcaggauggcggaaaggaaggggcg

SEQ ID NO: 47384 - RNA, 64 nt, Human
uggggaggccuuggccugugacagcccccaggccugggggcacagauccccccagcaaggauaa

SEQ ID NO: 47385 - RNA, 64 nt, Human
cuuaccagccuugauggcagcgggaaucuggugcugggggcagccggugcagccccggggagcc

SEQ ID NO: 47386 - RNA, 64 nt, Human
auagggauucugugucuuugugucauaacuuugaugggggcagugagggagacagccccaaccc

SEQ ID NO: 47387 - RNA, 64 nt, Human
auuauccggcccagaccaaagauucccucaucccugggggcagcccugccgcugugucuccuuu

SEQ ID NO: 47388 - RNA, 64 nt, Human
agcacauguagccgcugagaccugcuguuucugcugggggcaggcuccucuucccccagccccg

SEQ ID NO: 47389 - RNA, 64 nt, Human
gaagugcugauggucuuggucccagccagggucgugggggcagccacucucuccaaagcauagu

SEQ ID NO: 47390 - RNA, 64 nt, Human
ccccacagggugacucugggggaccccuggucugugggggcauccugcagggcauuguguccug

SEQ ID NO: 47391 - RNA, 64 nt, Human
ccuuucuuugcauccacaauguggggucggagcuugggggcagguccugggagugggaagccuc

SEQ ID NO: 47392 - RNA, 64 nt, Human
ccaaaucuuccguccucccguggaucucccggggugggggcagggcgggucccacgauggcccc

SEQ ID NO: 47393 - RNA, 64 nt, Human
cacuaguuuuuagcccuuuuuguuggggguggggugggggcagaggagaggcggauacagaaac

SEQ ID NO: 47394 - RNA, 64 nt, Human
cgcuguccccaucagcaaccauguucuugcaggcugggggcaagggauucugcucauguguuug

SEQ ID NO: 47395 - RNA, 64 nt, Human
cgguuccuuuuccgcccgccacccugccuuuccuugggggcagcugucucucuguacaugagca

SEQ ID NO: 47396 - RNA, 64 nt, Human
ggacugagcacccucuggauucugaaucucaagaugggggcagggcugugcuugaaggcccugc

SEQ ID NO: 47397 - RNA, 64 nt, Human
ggaagguuuuaacauugaaagugagcggaggacuugggggcagagcagcacaaagaaacagccu

SEQ ID NO: 47398 - RNA, 64 nt, Human
cagaauaucaauguaaaauuggaaaauaaggaacugggggcauuuguuuaggccaugacuucua

SEQ ID NO: 47399 - RNA, 64 nt, Human
uccaugccaggcacugugcuugcuaauugcuuuaugggggcauucucuuauuuauuccccagcc

SEQ ID NO: 47400 - RNA, 64 nt, Human
gucauaccguguaccucaguucccucuugcucagugggggcagagccaccugacucuugcaggg

SEQ ID NO: 47401 - RNA, 64 nt, Human
uuaagccuaggccuaggcaguccacuucgggaggugggggcacuccacacuggggggcccugca

SEQ ID NO: 47402 - RNA, 64 nt, Human
caggccugaugcuccuguuuggguccagggccccugggggcagaccggugauccuuaccagugg

SEQ ID NO: 47403 - RNA, 64 nt, Human
ucuccugccggaaagcccugcaacauucuaggguugggggcagggccauccacgguuucugggc

SEQ ID NO: 47404 - RNA, 64 nt, Human
gcugcucaacaugaaacugggcacccaaaacucaugggggcacaauccuggggcaccugcagga

SEQ ID NO: 47405 - RNA, 64 nt, Human
ugucacgagcccauucucauguuuacagggguugugggggcagagggggucugugaaucugaga

SEQ ID NO: 47406 - RNA, 64 nt, Human
cccagacugggcccagggucucccauagacagccugggggcaaguuagcacuuuauucccgcag

SEQ ID NO: 47407 - RNA, 64 nt, Human
caacagacuucucgccauagucgagcucucccgcugggggcacugcggggaggcgaggccucgg

SEQ ID NO: 47408 - RNA, 64 nt, Human
ggaggaaguagcugucguggccugaagaaauucaugggggcagcccuuaaaucccuucccugug

SEQ ID NO: 47409 - RNA, 64 nt, Human
auguggggcuugguggaggggccccaggauuuguugggggcaaaggggguggcgggaccguucc

SEQ ID NO: 47410 - RNA, 64 nt, Human
gcaaugcccaggaagcaggcacauugccaaggacugggggcaucuugacuaggaagcuccucgu

SEQ ID NO: 47411 - RNA, 64 nt, Human
aaccacaccgcuguccccuuagccccaagggcccugggggcagccacccucccgccugucggcc

SEQ ID NO: 47412 - RNA, 64 nt, Human
aaccugggagacuccugaaaaucagccuaaugucugggggcagcuggcgcugaggcugugcaga

SEQ ID NO: 47413 - RNA, 64 nt, Human
cacacgccucugccccauugcucugcagccagcuugggggcaggaguccuggacucucagaucc

SEQ ID NO: 47414 - RNA, 64 nt, Human
cuaaaaggagggaauaggaggagggcagggugagugggggcaauccuagguggugggggaguca

SEQ ID NO: 47415 - RNA, 64 nt, Human
aaaggaggcuggcagguauggaaggguuuguggcugggggcaggagggcccuaccugauuggug

SEQ ID NO: 47416 - RNA, 64 nt, Human
gugccguggaaguacugugugugaauagcaguagugggggcaaaagcaaucuucucauuuggaa

SEQ ID NO: 47417 - RNA, 64 nt, Human
cuuaaagggacauuguaggagguacucaaggguuugggggcaaaacccugaauccagccagucg

SEQ ID NO: 47418 - RNA, 64 nt, Human
cccuucuggccagcuccagcccccucacccuugcugggggcauaucucucauacccaccugcug

SEQ ID NO: 47419 - RNA, 64 nt, Human
acgguccacuggccgccuuguguugcuggagacgugggggcagggaggggacagugugggccug

SEQ ID NO: 47420 - RNA, 64 nt, Human
aggacuuccugcuacaguagcuguggggagcuggugggggcauccuugaggaccuccaccuggg

SEQ ID NO: 47421 - RNA, 64 nt, Human
gcaucccuucuggugugggcaucgcuacguguuuugggggcagcguuucacggcggugcccuug

SEQ ID NO: 47422 - RNA, 64 nt, Human
uccagcgucauccuccagaaccucacaucugaacugggggcaggugcauaccuuggggagggag

SEQ ID NO: 47423 - RNA, 64 nt, Human
gcauucagcacaggugccaaaauaugcuucauuuugggggcagaucuauuuugacaguauuuga

SEQ ID NO: 47424 - RNA, 64 nt, Human
ccaucgcuguggccaguggagagccacuccccucugggggcagucgccgagagccuccuucccc

SEQ ID NO: 47425 - RNA, 64 nt, Human
ucccgcaguggggaugcagcuguuggacagguauugggggcaagguugguagggaggacagacu

SEQ ID NO: 47426 - RNA, 64 nt, Human
ccuagagguggaggucuaggugucugaagugccuugggggcacccucauuuuguuuccauucca

SEQ ID NO: 47427 - RNA, 64 nt, Human
uguauucucuggccacauucaagucccccauuggugggggcagagaaguaggaccaggccaucc

SEQ ID NO: 47428 - RNA, 64 nt, Human
cugucuuuccagcauccacucucccuuguccuccugggggcauaucucagucaggcagcggcuu

SEQ ID NO: 47429 - RNA, 64 nt, Human
cguggggccugaggaggucauaaucucuucugagugggggcaggucgauucuugcacaaggugg

SEQ ID NO: 47430 - RNA, 64 nt, Human
cccccgccgccagguggcccacaugggaccagcaugggggcagguuaucuguuggccugaagag

SEQ ID NO: 47431 - RNA, 64 nt, Human
ggcaaagcagcucugaccgaauucuaggcaggggugggggcaccugccugggcccuggguccag

SEQ ID NO: 47432 - RNA, 64 nt, Human
gugccuguggcggaaggaacugcccaguccucccugggggcagguagaccuguggggauggcuc

SEQ ID NO: 47433 - RNA, 64 nt, Human
gcaggauaagguccccugacagugaguuguguggugggggcagccucugccucaaaaauucacc

SEQ ID NO: 47434 - RNA, 64 nt, Human
cucccuggcccguccuccucccacccccucccccugggggcaaaucaggacacaacagagggca

SEQ ID NO: 47435 - RNA, 64 nt, Human
caccgguguggccugggcuggagugcacucucccugggggcagcuggggccucgcaauucuugc

SEQ ID NO: 47436 - RNA, 64 nt, Human
gagaggcagagagaggucugggaacugcaccagcugggggcaugggguggagaacacugggcag

SEQ ID NO: 47437 - RNA, 64 nt, Human
ugguagcccucuuucugugaaugggguggggcugugggggcagcugggguuggaggaugagagc

SEQ ID NO: 47438 - RNA, 64 nt, Human
gcccccgcccauugcuuuggagcacagaugacucugggggcagaggugggcucuguuuaggagg

SEQ ID NO: 47439 - RNA, 64 nt, Human
cucaaaucuaggggcgucuucuuuggacccacaaugggggcaagccuuaauaauauggaaggga

SEQ ID NO: 47440 - RNA, 64 nt, Human
uuuuguuauuccuuuugcagauugggauguguuuugggggcagggguuaguucuucaggucggc

SEQ ID NO: 47441 - RNA, 64 nt, Human
gucaaggguucugugaggagaggacccaggagugugggggcauuuggggggugaaguggccccc

SEQ ID NO: 47442 - RNA, 64 nt, Human
agucaccaggccuccccuccuggcccaggugugcugggggcaccgugccccccaccccccugcc

SEQ ID NO: 47443 - RNA, 64 nt, Human
accucguugccaagcuccuccuguccccuuguucugggggcaggcgcugugcuucugugaggug

SEQ ID NO: 47444 - RNA, 64 nt, Human
ccucccaggcuccuggcuccaccagccaaggaggugggggcaagggucagggcaaugggggaca

SEQ ID NO: 47445 - RNA, 64 nt, Human
ggcccaggacauggcugagagguggucagcaggcugggggcauggagcagagagggcuugggua

SEQ ID NO: 47446 - RNA, 64 nt, Human
caagcuuugagcaggggagugaggcagccagaagugggggcagaggaggguggcucuguuuccc

SEQ ID NO: 47447 - RNA, 64 nt, Human
cgcugcaugagacauugacaccagaaagcccucuugggggcacugcucccuaccccagggcccu

SEQ ID NO: 47448 - RNA, 64 nt, Human
cagaggcccagaagugccagccuggggagccguuugggggcagccccuucugcccaccccaucc

SEQ ID NO: 47449 - RNA, 64 nt, Human
auuggacaaaagggcccaugcugcagccacugacugggggcagagcucuggguggaagagggaa

SEQ ID NO: 47450 - RNA, 64 nt, Human
uauaucgacgcgaagugcuuaacacagccgggcuugggggcagucaggaggaagcuggccaucc

SEQ ID NO: 47451 - RNA, 64 nt, Human
cgccgcuuacucucagcggaugcagcugcucacuugggggcacuggccucuuagguuuuaacga

SEQ ID NO: 47452 - RNA, 64 nt, Human
cacagggacgacccggggcgggcugaugucuucuugggggcagaccagagagcucaaguuucag

SEQ ID NO: 47453 - RNA, 64 nt, Human
caagcuguguuuccuaaugaguuugcuacugcugugggggcauguggguggguaaaugauguaa

SEQ ID NO: 47454 - RNA, 64 nt, Human
ggcaugcugccccagcacuggagaagcagcgcugugggggcaaucugucacacucucagagucu

SEQ ID NO: 47455 - RNA, 64 nt, Human
cugaagacuucccucaccauuggaucaagcuccuugggggcauaugaucaccagggcacacagu

SEQ ID NO: 47456 - RNA, 64 nt, Human
auaucaauucucaugaguguauuauaaucucuggugggggcaagugucuggaaggccugagggg

SEQ ID NO: 47457 - RNA, 64 nt, Human
auccagaauggaauuuugcuacauggggucugggugggggcaaagagacccagucaauuacaug

SEQ ID NO: 47458 - RNA, 64 nt, Human
gcuagaccacuuuauaccuucgcaguguggucucugggggcaaaaaacuaaugaaaacaaucuc

SEQ ID NO: 47459 - RNA, 64 nt, Human
accgagccagccacugaggggagcuggcagagccugggggcacagggugcaaagccaggcacug

SEQ ID NO: 47460 - RNA, 64 nt, Human
uccuggcugacugccuuagcagugggggugggggugggggcaggggcaggggcuuuauguguuu

SEQ ID NO: 47461 - RNA, 64 nt, Human
gaacaggggccaaacuggugggaggcagagguggugggggcagggaugauaggcccuggaugug

SEQ ID NO: 47462 - RNA, 64 nt, Human
agucaaauaauuugcaaccagcuuaugagggcaaugggggcaccuaaacucuugaugaaagaac

SEQ ID NO: 47463 - RNA, 64 nt, Human
auaaccuaauucagguugcaguuuuaauauucauugggggcaguggaauugcauguguaaauua

SEQ ID NO: 47464 - RNA, 64 nt, Human
aggugcuggcugcggggauccagacagggcacauugggggcauggaagugccagggugguuuuc

SEQ ID NO: 47465 - RNA, 64 nt, Human
augcuaauuacaaguuauaaaucaaacggagagaugggggcauggagauaguuuuuacguacug

SEQ ID NO: 47466 - RNA, 64 nt, Human
cacccccaagucuguccccaggcucugcccugccugggggcaguggcuccccuccccuguugcc

SEQ ID NO: 47467 - RNA, 64 nt, Human
gcccaaguaaagugaccaugccaguggccagcacugggggcacaccugugaugggcaccccuuc

SEQ ID NO: 47468 - RNA, 64 nt, Human
ggucuccgaaaugcugucuuucuugcucccugacugggggcagacaugguggggucuccucagg

SEQ ID NO: 47469 - RNA, 64 nt, Human
aggcagaguggaacccugccuccaugccagcaucugggggcaaggaaggcuggcaucauccagu

SEQ ID NO: 47470 - RNA, 64 nt, Human
gugaaggcccugggaaugcagguucuagaaggggugggggcauggggcccaggagguugcuaga

SEQ ID NO: 47471 - RNA, 64 nt, Human
uuguugccugagaagaaaccuuggggugccagggugggggcagaagcaugggcuggguuccggu

SEQ ID NO: 47472 - RNA, 64 nt, Human
cgcugccuggggagcugaggcguuaccgcuguguugggggcagcuuggugucaggugcagcagg

SEQ ID NO: 47473 - RNA, 64 nt, Human
caggaugaacggacgcccacagaggccugcggggugggggcaucgcugccuggggagcugaggc

SEQ ID NO: 47474 - RNA, 64 nt, Human
guuuucaugguagacaguucaugcaguauaugaauugccauaauggaaauaaucugauuuuauu

SEQ ID NO: 47475 - RNA, 64 nt, Human
ucacuauccuuccaagucccggguagcagaaggguugccauagaucucaguuugaucaaaaaga

SEQ ID NO: 47476 - RNA, 64 nt, Human
cagcuaauuuuuguguuuuguuagagaugagguuuugccauauugcccaggcucgucuugaaca

SEQ ID NO: 47477 - RNA, 64 nt, Human
gagcuggcaaggccaaggacacccaacacaauuuuugccauacagccccaggcaaugggcacag

SEQ ID NO: 47478 - RNA, 64 nt, Human
guaccccuaaaaagauugccaauuuucuucaucuuugccauauggaggacugugacagacuuug

SEQ ID NO: 47479 - RNA, 64 nt, Human
cucaaagaaaaauaaacagagacaaauguuaaaauugccauacagacuguuuuucccccuguug

SEQ ID NO: 47480 - RNA, 64 nt, Human
uuuuuuguauugaguauagauuccggcucauggguugccauagagucuaggaacaaggaguaua

SEQ ID NO: 47481 - RNA, 64 nt, Human
cuuuguaaugugaacaugcuucagaguguaccuuuugccauaaccuauuuuaauuuacuuuuuc

SEQ ID NO: 47482 - RNA, 64 nt, Human
gugaccaaaauuaagcaugaaaaaaauguuuccauugccauauuugauucacuaguggaagaua

SEQ ID NO: 47483 - RNA, 64 nt, Human
acuuucuaaguuaaauuuuaaaaauuuugauuguuugccauauuggguggguuuacucuuagaa

SEQ ID NO: 47484 - RNA, 64 nt, Human
gaaagaaaagacccugagacuccagaaucugcuguugccauagccccauaugugugaauucugc

SEQ ID NO: 47485 - RNA, 64 nt, Human
uuuauugugaauguuguaacauuuuaaaaauguuuugccauagcuuuuuaggacuugguguuaa

SEQ ID NO: 47486 - RNA, 64 nt, Human
agauagauucuaagggcaaacauuuuuccaagucuugccauauuucaagcaaagaggugcccag

SEQ ID NO: 47487 - RNA, 64 nt, Human
uuaucuuugccaaaucuuuaccacugauuuaccauugccauaaaguagacugguauaugguuaa

SEQ ID NO: 47488 - RNA, 64 nt, Human
uuaauaaauuagcccauuauauuuucaucuguauuugccauaaaaaauuuauuugcauuuaugc

SEQ ID NO: 47489 - RNA, 64 nt, Human
auucacuucccuuaauuuuaucuugccuugucucuugccauauuugcuguuuuuauggauaaau

SEQ ID NO: 47490 - RNA, 64 nt, Human
ugacucuccugcuaccaauuaaauaaagcuuacuuugccauaacuguuuuguguccagauucuc

SEQ ID NO: 47491 - RNA, 64 nt, Human
cucaggcacuaaccccaggaaagaugacagcacauugccauaaaguuuugguuguuuucuaagc

SEQ ID NO: 47492 - RNA, 64 nt, Human
gacacucuguccucauucccugcccuuccuuugguugccauauggaauggccauggaaugcacg

SEQ ID NO: 47493 - RNA, 64 nt, Human
gucaggagugcaccucucuacuugggagguacaauugccauaugauuucuagcugccauggugg

SEQ ID NO: 47494 - RNA, 64 nt, Human
uuuaaagaauauuuuuucucaguuuuuucagauauugccauacugaaccucauucuaaacuggu

SEQ ID NO: 47495 - RNA, 64 nt, Human
aguggcauuuccagcuggauuccuccuguuguaguugccauaaggaaaugagaugcagaaucag

SEQ ID NO: 47496 - RNA, 64 nt, Human
caaaauuccuaaagcaaugcuacaaccauugaauuugccauauuuuguaucagugcuguuaauu

SEQ ID NO: 47497 - RNA, 64 nt, Human
gagggaggagggaggaugcgcugugggguuguuuuugccauaagcgaacuuugugccuguccua

SEQ ID NO: 47498 - RNA, 64 nt, Human
gugaaacugaguuuccuuuaacuuacaaagcuaguugccauauuucuauuuuauuuuaaaaagu

SEQ ID NO: 47499 - RNA, 64 nt, Human
gcuaaaauuacaaauuaaaauuuugggucagacuuugccauaaugauagacucaauuuagcucu

SEQ ID NO: 47500 - RNA, 64 nt, Human
augguuugucaauuuaaaauuccagaauuuauuauugccauauuuucacaugcugcuuauacaa

SEQ ID NO: 47501 - RNA, 64 nt, Human
aaacuuuuguuguaauuaaacugcuauauauuguuugccauauauuauggcccaaggaauauag

SEQ ID NO: 47502 - RNA, 64 nt, Human
uuuugcuguguuuuaaaaaugauugaaauuuaucuugccauaucucauaauuucaugcacaagu

SEQ ID NO: 47503 - RNA, 64 nt, Human
caugcccgacauacaauguuagcuauugguauuauugccauauagauaaauuauguauaaaaau

SEQ ID NO: 47504 - RNA, 64 nt, Human
augguuuagaaagcuugcccuggugccucaccccuugccauaauuacuaugucauuugcuggag

SEQ ID NO: 47505 - RNA, 64 nt, Human
ugccuauccugucccuggaucugaggccuuucccuugccauagaaaugguugcugguagcagua

SEQ ID NO: 47506 - RNA, 64 nt, Human
gguucaucuguucacuguuucuagaaaaaaaucauugccauaagaaaaaguauaaauuagcaag

SEQ ID NO: 47507 - RNA, 64 nt, Human
aacagcaggcaaaugcuuuuuaacucugacaccguugccauaaaucccugauacucaaagucua

SEQ ID NO: 47508 - RNA, 64 nt, Human
agcugaacaguguguaguauuuucccagucagcuuugccauacugacgucaaucauuugagaga

SEQ ID NO: 47509 - RNA, 64 nt, Human
cuugaauuggaaaaagaacucuguaguuugagauuugccauacagcaagaaaaaaagaaaagaa

SEQ ID NO: 47510 - RNA, 64 nt, Human
uacuaugugcaugcauacuaccuauuucuaaacuuugccauauugaggccuuuauaaacuauug

SEQ ID NO: 47511 - RNA, 64 nt, Human
cuaaugaaacaaaaaauauucaucuguugacaauuugccauagcagugcuaggauaaaccaauc

SEQ ID NO: 47512 - RNA, 64 nt, Human
aauuuauuauuuuguuugaguaagaauuuuaauauugccauauucuguaguauuuuucuuugua

SEQ ID NO: 47513 - RNA, 64 nt, Human
caagaagucuauugauauuggucauguuuauuucuugccauauuuauaacacagcaagaguauu

SEQ ID NO: 47514 - RNA, 64 nt, Human
gcugauuucuauuucuagcuaauuuggucauucuuugccauagcuuacucuauucaaauaaaca

SEQ ID NO: 47515 - RNA, 64 nt, Human
guaugaacauuaggaaacaaugagaagcuuauuuuugccauaggccauacauguuacuguaauc

SEQ ID NO: 47516 - RNA, 64 nt, Human
auaaggaaagauuuugagauggguggcauauguuuugccauaacuugacaugcuuugcaaaucu

SEQ ID NO: 47517 - RNA, 64 nt, Human
gggcaagggugagaaacuagaggcuucuccaguguugccauaucccccuagguugucuugaucc

SEQ ID NO: 47518 - RNA, 64 nt, Human
ccaugcagagacguggcuggcccagaauggccuguugccauagcaacuggaggcgauggggcag

SEQ ID NO: 47519 - RNA, 64 nt, Human
ugugggggcaaauguguagauauuuuuaaacauuuugccauaauugcacaauuuuuugcauuuu

SEQ ID NO: 47520 - RNA, 64 nt, Human
gauagcguuguuggaauucaaaaaacagacaauauugccauagaaaugugugaagaauuugcau

SEQ ID NO: 47521 - RNA, 64 nt, Human
ccgugauucaucuggaaguuauuacagggccagcuugccauauuccaggcacacguuaucaagu

SEQ ID NO: 47522 - RNA, 64 nt, Human
caauuccuaccucuucaccugacccugcccccacuugccauaaaacuuagcuaaguuuuguuuu

SEQ ID NO: 47523 - RNA, 64 nt, Human
gggccuuggagcuuacauaguuuuaaacucauuuuugccauacaucaguuauucauucugugau

SEQ ID NO: 47524 - RNA, 64 nt, Human
agcaauccuagguaggguuuaauccccaguaaaauugccauauugcacaugucuuaaugaaguu

SEQ ID NO: 47525 - RNA, 64 nt, Human
uacaaaguagccagucccauaaugaaaugcuguauugccauaguggucacacccaaguggucca

SEQ ID NO: 47526 - RNA, 64 nt, Human
ucuucuuagcaguugauaaaauauuaaaacucucuugccauagagaauacaccaucaaagaaaa

SEQ ID NO: 47527 - RNA, 64 nt, Human
cacaggaauguacacugguggcagaaacaugcauuugccauaaauaauucagaaacacuuguau

SEQ ID NO: 47528 - RNA, 64 nt, Human
auauauuuggguaaauuuacaacuguucuuuuauuugccauaaucugguuauaacacuguuugu

SEQ ID NO: 47529 - RNA, 64 nt, Human
uucccucaaaauagacuguguugcaguacacaaguugccauaauaguauaaaacaguaaaaugu

SEQ ID NO: 47530 - RNA, 64 nt, Human
aaaaaauggaaacaguagcauccauacuggaaucuugccauauuuuuuucauuuuagaauagau

SEQ ID NO: 47531 - RNA, 64 nt, Human
cucugaggggaguucauuguuucucaugcaucauuugccauauacuauuaaucaaagugcuugc

SEQ ID NO: 47532 - RNA, 64 nt, Human
aagcaaagccacccuucgggaagaaaacgucaccuugccauacauucuguuucaacagugggua

SEQ ID NO: 47533 - RNA, 64 nt, Human
uaauuuuuguacuuuuuaaaguagagacggggcuuugccauauuggccuggcugaucucaaacu

SEQ ID NO: 47534 - RNA, 64 nt, Human
ggagccaugaggaguucccaugaccucccgagacuugccauaaguguucuaguccacauauaag

SEQ ID NO: 47535 - RNA, 64 nt, Human
cuuucauaaaacaguuuuuucaguauuuugagaauugccauauuaauuuuuauaauggaaaacu

SEQ ID NO: 47536 - RNA, 64 nt, Human
ggggcaucucuuaauccugggguaaaaggagagauugccauacuuagacucacugugagucucc

SEQ ID NO: 47537 - RNA, 64 nt, Human
auuuucaaaacuaaacacauaaaaugcuuuuauuuugccauauccuacaggaaggaagacaugc

SEQ ID NO: 47538 - RNA, 64 nt, Human
uuugggguuguguugucacccaagagauuguuguuugccauacuuugucugaaaaauuccuuug

SEQ ID NO: 47539 - RNA, 64 nt, Human
cuagagaguuuauugucuaaauuucaguugugucuugccauauggagggcaccuaaucagaggg

SEQ ID NO: 47540 - RNA, 64 nt, Human
gaagcaucacauaaaaaugaugggacaauaaauuuugccauaaagucaaauuuagcuggaaauc

SEQ ID NO: 47541 - RNA, 64 nt, Human
caggaucaauguacuacggccuuuuaauucaacauugccauaaaugcuuuaaagaaaacccacc

SEQ ID NO: 47542 - RNA, 64 nt, Human
ugguugaggaggaacuguggcccuccguaaguuauugccauaguguaugcauuaaaccaagucc

SEQ ID NO: 47543 - RNA, 64 nt, Human
ccaucaaauaaucagaucaaacaccugcuccuuauugccauacccacgaacuguuaaauauaaa

SEQ ID NO: 47544 - RNA, 64 nt, Human
uacuuuaauauuuuugauaacuagaaaucuaguauugccauaaaggaaacuaagugcccaucaa

SEQ ID NO: 47545 - RNA, 64 nt, Human
ggggacgccacacaccucagggccguccgcugcauugccauagaggagcccucccuccaguggu

SEQ ID NO: 47546 - RNA, 64 nt, Human
cauaaaguacuucuguacaguauuagauucacaauugccauauauacuaguuauauuuuucuac

SEQ ID NO: 47547 - RNA, 64 nt, Human
gaaguauauauaaaaggaauuacuguaaacuacauugccauagcaauuuacauaaaaguauauu

SEQ ID NO: 47548 - RNA, 64 nt, Human
aagcuaucuagucuguggaguuuguggcaauuaauugccauaaaauaacaauguuuccaaaugc

SEQ ID NO: 47549 - RNA, 64 nt, Human
ugaaguuugaaauguuuuuagcaaaaucuaauuuuugccauaauguguccucccuguccaaauu

SEQ ID NO: 47550 - RNA, 64 nt, Human
cucucaguucuuaauugaugauaacaugauugaauugccauauaucuguauuacuugugugaau

SEQ ID NO: 47551 - RNA, 64 nt, Human
acugcaguuuaccaugggacacuguauauauuucuugccauaaugguaaaggacugauugauau

SEQ ID NO: 47552 - RNA, 64 nt, Human
uguauacuuguauuuucaggauauuuuauuuuuuuugccauacagauaaaauuuguaagguugc

SEQ ID NO: 47553 - RNA, 64 nt, Human
cugaauaacauuuagcaguauugugauugaaaaauugccauauuuugauguauaggacaaguca

SEQ ID NO: 47554 - RNA, 64 nt, Human
gcuucaugacuugaauucuacuuugauaaaaacauugccauacugcuuuuuaucuugaugaauu

SEQ ID NO: 47555 - RNA, 64 nt, Human
cguugagcccugacaacaugaguggagagugcauuugccauaccugugugcaugacacuaagau

SEQ ID NO: 47556 - RNA, 64 nt, Human
uuacugauaguugggaaaagaagauuggguuauuuugccauaucauuuagcuggaagugacauu

SEQ ID NO: 47557 - RNA, 64 nt, Human
uguuguuuucccagauugagaacucaacuguauuuugccauaaaugcuucuaagauauauccag

SEQ ID NO: 47558 - RNA, 64 nt, Human
uuucaaaaauucuguaacaaauauauuuaauguguugccauaaugucauuucaguauuuuugcu

SEQ ID NO: 47559 - RNA, 64 nt, Human
auguguguauacauuuggguuguguguauacaucuugccauauacaauauacaaacauaugccc

SEQ ID NO: 47560 - RNA, 64 nt, Human
aguuuauuuauuuauuuauuacccuaagaaugcuuugccauaaccacauuuaaugggaaaaacg

SEQ ID NO: 47561 - RNA, 64 nt, Human
uccauccaaaguucccuaugaaaaauguguuccauugccauagcugacuacaaauuaaaguuga

SEQ ID NO: 47562 - RNA, 64 nt, Human
ucuuuuucaguuuucauaauaaguauucauuuuuuugccauaaugcuuccuguaaagccaauuu

SEQ ID NO: 47563 - RNA, 64 nt, Human
auggugcauuuauuauguucaaguuauuucaggauugccauaugugcaaacaaaucaugcaaug

SEQ ID NO: 47564 - RNA, 64 nt, Human
aaucccagaauuuuguuccaccaugguuaguuauuugccauaugaauguauucuuguuucuacc

SEQ ID NO: 47565 - RNA, 64 nt, Human
aacauaucccuucauugccauaauggcugccauuuugccauagauuuccauauaacugaaaaac

SEQ ID NO: 47566 - RNA, 64 nt, Human
aauaucaucuaacagucuaaaacauaucccuucauugccauaauggcugccauuuugccauaga

SEQ ID NO: 47567 - RNA, 64 nt, Human
cuugcugauuuucugguuggaguguuuuuuuguauugccauagucccuucccccugaagcaaua

SEQ ID NO: 47568 - RNA, 64 nt, Human
caaaggauaaaagaguagcauaagcugcugaauguugccauauuaaaggagagaacuugguaac

SEQ ID NO: 47569 - RNA, 64 nt, Human
cuuacugggauccgguuuucauuuuccgguccuuuugccauacacaguuacagagaucagucaa

SEQ ID NO: 47570 - RNA, 64 nt, Human
ugacaugaugagcacaggaacaggcaugaagauauugccauacaauuuuaauuuauacaaguau

SEQ ID NO: 47571 - RNA, 64 nt, Human
aaugaaacacucaguuguucaauaauaaauauuuuugccauaaugacucagaauauugcuuugg

SEQ ID NO: 47572 - RNA, 64 nt, Human
aaaaucuaacugaagaacuaaguugauuuuuuauuugccauaaaccaagcaaaaguaaaugcaa

SEQ ID NO: 47573 - RNA, 64 nt, Human
agccagcaggaugcagccuuugccuuugccucucuugccauaguuuucuccuccuauaucacuc

SEQ ID NO: 47574 - RNA, 64 nt, Human
cuguugcagggaaccaggaggaaagggaaagauguugccauauuuccuacucuuuaggcaugga

SEQ ID NO: 47575 - RNA, 64 nt, Human
auuuuucauaaagacaaagaacagcaauguuaaauugccauaugaagagaaacacuagugaugu

SEQ ID NO: 47576 - RNA, 64 nt, Human
cucuaaauaggaaaccacaauuugucaaauauguuugccauaauuugucaauaaagcugaaaac

SEQ ID NO: 47577 - RNA, 64 nt, Human
gaggaaaaucauagguuaccauuuuauaacucuauugccauaagaaaauacacucuaaaaucuu

SEQ ID NO: 47578 - RNA, 64 nt, Human
aucuaggaaaguacuauuucaugguccaaaccuguugccauaguugguaaggcuuuccuuuaag

SEQ ID NO: 47579 - RNA, 64 nt, Human
aaaaggacucuggaagauuuucauugaggauaaauugccauaauaugaugcaaacugugcuucu

SEQ ID NO: 47580 - RNA, 64 nt, Human
gccuuccugaguguguguaugcggucuguaacuauugccauauaaauaaaaaauccuguugcac

SEQ ID NO: 47581 - RNA, 64 nt, Human
uaucuaaaaugucuccuacuuuuuuccuauuucuuugccauacauguuaucagaaauccauguc

SEQ ID NO: 47582 - RNA, 64 nt, Human
uugguaggaaagggucaguuucucacuugacagauugccauauuuuuuuuucugggagauguca

SEQ ID NO: 47583 - RNA, 64 nt, Human
aaguauucgauuucauucaugugauuaaaacaaguugccauauuucaaagccuugaacuaagac

SEQ ID NO: 47584 - RNA, 64 nt, Human
augaaaugaagaaaggcuuuauguucaaggaccuuugccauaguucagcuaauuguaguuuuau

SEQ ID NO: 47585 - RNA, 64 nt, Human
uuuuagcuccaguaacagaauggaauaagaucuauugccauaaauuguaguuaagaacuguaag

SEQ ID NO: 47586 - RNA, 64 nt, Human
cuuuucucuuguccuuagguauauguggcagccuuugccauaucagcguaugcaucuagcuacu

SEQ ID NO: 47587 - RNA, 64 nt, Human
aaaagguuuuaaaaauuguauccuagggaacaguuugccauaagucagaauuuugcaguuuagc

SEQ ID NO: 47588 - RNA, 64 nt, Human
augccauagaaacugaggccauuauuucaaccgcuugccauauuccgaggacccaguguucuua

SEQ ID NO: 47589 - RNA, 64 nt, Human
uuaaguuuaaaauguguauuuuucaaggcauuuauugccauauuaaaaucugauguaacaaggu

SEQ ID NO: 47590 - RNA, 64 nt, Human
cuauguguuucagaaauauguagaaauaaaaauguugccauaaaauaacaccuaagcauauacu

SEQ ID NO: 47591 - RNA, 64 nt, Human
cugauuuuuguuuacuuuuuagagagauggggucuugccauauuugccaggcugguuugaacuc

SEQ ID NO: 47592 - RNA, 64 nt, Human
agaaugacacaauuuuauucgccuuugguguuaguugccauagugcuguauuugaaaaucgaug

SEQ ID NO: 47593 - RNA, 64 nt, Human
uuuuuuaaaugguaaaugaccuuguauauaaauauugccauaucaugguaccuauaauggugau

SEQ ID NO: 47594 - RNA, 64 nt, Human
auugcaaacuuuagaauguauuaaaaauuuuaccuugccauagagacugaauuagucacagcuc

SEQ ID NO: 47595 - RNA, 64 nt, Human
uguguuguugugguuuuauuucugaaaguaaaacuugccauaaauuagaaaacaauuucccaaa

SEQ ID NO: 47596 - RNA, 64 nt, Human
auuucaaacuuugugguaacccuacauuuuauaguugccauaucaaagccaugggagaguuuua

SEQ ID NO: 47597 - RNA, 64 nt, Human
ggcagcagaguggaugaaggaguaagucugcccuuugccauacugaacagcuguggaccccgau

SEQ ID NO: 47598 - RNA, 64 nt, Human
gaaauuuaauguuuuuuaaacuaguuuauuugccuugccauaacacauuuuuuaacuaauaagg

SEQ ID NO: 47599 - RNA, 64 nt, Human
guauucagguaauauguuuaaagauauuuauauauugccauacaaaaacuuaacauuuaaaacu

SEQ ID NO: 47600 - RNA, 64 nt, Human
cauagucaccugacuaagaaauucugacugcuaguugccauaaauaacucaauggaaauauucc

SEQ ID NO: 47601 - RNA, 64 nt, Human
uggaauuauucccaaauggacucugaccagauuuuugccauacugggggguggcgggauggagg

SEQ ID NO: 47602 - RNA, 64 nt, Human
cuauguauuuaaauguuugaagugccuuagacucuugccauauuuucaaaauaaaauuccauua

SEQ ID NO: 47603 - RNA, 64 nt, Human
uguuuuaaaguuuaacccuugaagcagcaugucuuugccauagcagcacuucacuuaaaaggaa

SEQ ID NO: 47604 - RNA, 64 nt, Human
auuaugggacuaggaaauauuuaucuuuccaaauuugccauaacagauuuagguuucuuuccuu

SEQ ID NO: 47605 - RNA, 64 nt, Human
aaauauauuuaagcuacauuuuuguuuugaaaaauugccauaaauuuggugccacuuucuuuua

SEQ ID NO: 47606 - RNA, 64 nt, Human
agaauauaacucuguguaggucacuggaaagugauugccauagggcugggagagaagcauugca

SEQ ID NO: 47607 - RNA, 64 nt, Human
guaauaaccaugcuucuuuuuuauccuuaaacuauugccauacuucaguaagugucuuuuuuaa

SEQ ID NO: 47608 - RNA, 64 nt, Human
ugggcucaucuugaaaugauucucauugauuaauuugccauauaacacuugcacaugugacucu

SEQ ID NO: 47609 - RNA, 64 nt, Human
gaaauuauauucacauauaaaguacaucagaucuuugccauauauugaugguuauuaugcauaa

SEQ ID NO: 47610 - RNA, 64 nt, Human
cgugcucucugcuggauucuaaauuaugugaauuuugccauauuaaaucuuccucauuuauacu

SEQ ID NO: 47611 - RNA, 64 nt, Human
uaauuaacaacugcugagagaucaaagauucaacuugccauacaccucaaauucggagaaacag

SEQ ID NO: 47612 - RNA, 64 nt, Human
gauuuugauaucuuuggcuuuccgguaucuauuuuugccauacauuuugcuguuuugcaaaguu

SEQ ID NO: 47613 - RNA, 64 nt, Human
caauucaauuacuauugaaugaauuaagaauugguugccauaaaaauaaaucaguucauuuaaa

SEQ ID NO: 47614 - RNA, 64 nt, Human
acuucuggggaaacuucauggucccaaaaugucauugccauacagcuucacuagaguucuuuga

SEQ ID NO: 47615 - RNA, 64 nt, Human
gggcauuugucuagcugggcuacuuucuaacacuuugccauagcucagaccacuucucaucguu

SEQ ID NO: 47616 - RNA, 64 nt, Human
aaauuguaccuugaucaauguacuuuuuauaaacuugccauagauaucucagauuugaaaccuc

SEQ ID NO: 47617 - RNA, 64 nt, Human
cccaggcauugccaagggcuuuguuuugcacacuuugccauauuuucaccauuugauuauguag

SEQ ID NO: 47618 - RNA, 64 nt, Human
uuaguuaccucuugaaagcacaaaaauuaaaacauugccauauguugaauuuuuaaaaagcacu

SEQ ID NO: 47619 - RNA, 64 nt, Human
ggcuuauuugagguuguuggugcuguugguauuauugccauaguuguuauuuaauugcuugauu

SEQ ID NO: 47620 - RNA, 64 nt, Human
ggaugaagacuuaaucgaaauacuuaccucuaauuugccauaucagaagccuaaaaagaaugau

SEQ ID NO: 47621 - RNA, 64 nt, Human
acacuuauaacuuccuaccuuuuacuugaaugcuuugccauauucaggacagagacucucacaa

SEQ ID NO: 47622 - RNA, 64 nt, Human
cccaggggcuggggccacagccuugccauuuucguugccauacccucuugccuuacucgcggug

SEQ ID NO: 47623 - RNA, 64 nt, Human
ucaaacuuaaaaaaaaucauuuuaauaaauauuuuugccauaucauagaaguugguauaauuua

SEQ ID NO: 47624 - RNA, 64 nt, Human
gccuucucaaacagcucaagcaauauauuguauauugccauaucgucuggugaaaggguuaaau

SEQ ID NO: 47625 - RNA, 64 nt, Human
ucucccugcguugccuaggguaaagccuccagauuugccauacugagccccucuuccuagcauc

SEQ ID NO: 47626 - RNA, 64 nt, Human
uuggaugcugccaaguccaugguaguuuucaauuuugccauacuuuuguucuuccuaccggacc

SEQ ID NO: 47627 - RNA, 64 nt, Human
ugauguguucuuguguauuauaacucuuuauuuuuugccauaaaaguaaaggaugcuuacucca

SEQ ID NO: 47628 - RNA, 64 nt, Human
acuagaagacuuuguuagaaaauuacuaauaaacuugccauacguauuacagcagaagugcuuc

SEQ ID NO: 47629 - RNA, 64 nt, Human
gaacuacuguacuuaaagguuuguuuguuuguuuuugccauacuguauaauuugggugaggucu

SEQ ID NO: 47630 - RNA, 64 nt, Human
ggaugaccgaccgccuguauguuuguguaauuaauugccauaauaaacuuugaugagucacaug

SEQ ID NO: 47631 - RNA, 64 nt, Human
uggcuucugugacugccagcucuaaaucucgaucuugccauaacuuuacaggguaacuuggguc

SEQ ID NO: 47632 - RNA, 64 nt, Human
uaugcccaguugaugugauaaaauuuucauugucuugccauauaaagccuugguuaucaacagg

SEQ ID NO: 47633 - RNA, 64 nt, Human
cccacugaagagcccuuuggaccuuccuaaacccuugccauaguggaagcuguggucacuuucg

SEQ ID NO: 47634 - RNA, 64 nt, Human
ugaauaccuaagagauacuuuuuggauauuuauauugccauauucuuacuugaaugcuuugaau

SEQ ID NO: 47635 - RNA, 64 nt, Human
gcuguugacugagaaguuuguggugggaaaacguuugccauauuuucuuugcauuugaauaauu

SEQ ID NO: 47636 - RNA, 64 nt, Human
aaaacaaagcucuauguaaaguaauaaaguauaauugccauauaaauuucaaaauucaacuggc

SEQ ID NO: 47637 - RNA, 64 nt, Human
uauaagcauuuggcaaaaacaagagaaaagaaacuugccauauuuuacaagcugcaauuuuaga

SEQ ID NO: 47638 - RNA, 64 nt, Human
gaucucauugaaaauuuaaagucaucauaauuuguugccauaaauauguaagugucaauaccaa

SEQ ID NO: 47639 - RNA, 64 nt, Human
accuaauggaauauuuuugaggccuggaugaacuuugccauauggguagagguuacagagggag

SEQ ID NO: 47640 - RNA, 64 nt, Human
agccagcucccagcagcuucuccggaagcugcucuugccauaaucaacucccugggaguggaag

SEQ ID NO: 47641 - RNA, 64 nt, Human
agccuuucaggugggaaacccagauuuccucccuuugccauauuccccuaaaaugucuauaaau

SEQ ID NO: 47642 - RNA, 64 nt, Human
gucaugaagcucaugagcuccucaaauaagguauuugccauagaacuaaauauucugguggucu

SEQ ID NO: 47643 - RNA, 64 nt, Human
aaggaauaccacgaaggaauuuaugcuccagugcuugccauaauuugucugagaaggaaucugu

SEQ ID NO: 47644 - RNA, 64 nt, Human
aacgagugaagucauccuaacuuuuccccuacucuugccauagagaggaggagaagaaacuaac

SEQ ID NO: 47645 - RNA, 64 nt, Human
ggaagcugguuaaaguggaugagguuggaaagaguugccauaaugaggucccacguggcuucuu

SEQ ID NO: 47646 - RNA, 64 nt, Human
ugacagcacgcuuuacuuaguagccgguucccauuugccauacaauguagguucugcuuaaugu

SEQ ID NO: 47647 - RNA, 64 nt, Human
uuucccuacucuggaauuugaacuuucuucauguuugccauacugaacaucuuuuuucuugugg

SEQ ID NO: 47648 - RNA, 64 nt, Human
ucccauuucauaauguaaaucauauuuuuguuauuugccauauuuuauuugaagugauaaaauu

SEQ ID NO: 47649 - RNA, 64 nt, Human
aaauuggccuauuccuucaauuaauaaaauauuuuugccauaguaugugacucuacauaacaua

SEQ ID NO: 47650 - RNA, 64 nt, Human
ccuuuauuauuuguuauuuuuuauuugcauugcuuugccauaagucuucccuugcuuguaucuu

SEQ ID NO: 47651 - RNA, 64 nt, Human
cacauccuuugugcuaaugacacuuacauauuucuugccauaacuuuucucuugcagaaaaacu

SEQ ID NO: 47652 - RNA, 64 nt, Human
guggaaaaaguuuaaugauaugcauguaaugccuuugccauauuccucuccuucuuagaucaca

SEQ ID NO: 47653 - RNA, 64 nt, Human
ccuggccauuugcugccucuaauucccuuuugcuuugccauauugggcuauguauuaccuccuu

SEQ ID NO: 47654 - RNA, 64 nt, Human
ggaaaaaaacucaaaacaaaagcgagagagacuauugccauaugaacucaaaagcuaucauggu

SEQ ID NO: 47655 - RNA, 64 nt, Human
uuaguugaacuggcauccugcuuuagccugagacuugccauaagaaacugcugaguacuuggca

SEQ ID NO: 47656 - RNA, 64 nt, Human
cauuccaggacaauuuuuggucccauuuugaggauugccauaguugcaaguccuuaggaucuuc

SEQ ID NO: 47657 - RNA, 64 nt, Human
ccaugaucuccuugcacagaauugcaaaugucuuuugccauaccaagggccagacucagaaccc

SEQ ID NO: 47658 - RNA, 64 nt, Human
agggaaaagucuuuuguugcccucuccuauccucuugccauaugaauagcguuuuccaugaaau

SEQ ID NO: 47659 - RNA, 64 nt, Human
acuaguauucaacaaaccuuguauaguauauguuuugccauauuuaauauuaauagcagaggaa

SEQ ID NO: 47660 - RNA, 64 nt, Human
gugauugcaccaauacuuugugcuucuaguggcuuugccauaauucagugucaccaauaaggca

SEQ ID NO: 47661 - RNA, 64 nt, Human
uugcuaaaugauuucaucuuuaggaaaaaauuacuugccauauagagcuaaauucaucuuaaga

SEQ ID NO: 47662 - RNA, 64 nt, Human
agugcuagucucuguuuaaugguaaaaggagacuuugccauaauuuucagaugaagauguuucc

SEQ ID NO: 47663 - RNA, 64 nt, Human
uuuuugugaugaggaaaucccuaaacaaaauuaguugccauaaaauaugacaacugcuuuaugg

SEQ ID NO: 47664 - RNA, 64 nt, Human
cuucuagauucuucccagcucagaggcuuggcauuugccauaucaucaucuuuuuuuuuuucuu

SEQ ID NO: 47665 - RNA, 64 nt, Human
ugaugcgcaggucucauugguuucauucuugcaguugccauacagugccuuuccauuuauuuaa

SEQ ID NO: 47666 - RNA, 64 nt, Human
gaauuuacuugguaggaaaaaaaguaggacauuauugccauauuguaugucuuaauauuuaacu

SEQ ID NO: 47667 - RNA, 64 nt, Human
guucacuguuuaagacaagugaauucuauagugguugccauaaaaggaaguucuagguauuuau

SEQ ID NO: 47668 - RNA, 64 nt, Human
uuccuggccuagaaccauucagccuacccuguauuugccauaaacuccacaauucacaccaaaa

SEQ ID NO: 47669 - RNA, 64 nt, Human
ggauuuucuuuuuuauuaauaugcaacauagacauugccauaacagaauaauaaaccacaugug

SEQ ID NO: 47670 - RNA, 64 nt, Human
uagaaccuggguuucaacgcuagcccuuucugguuugccauaggcccugccaagauacugcagg

SEQ ID NO: 47671 - RNA, 64 nt, Human
gggcaguuggcugcugguccugucugauuauguuuugccauauugagucugaaguuugugugga

SEQ ID NO: 47672 - RNA, 64 nt, Human
cucauaaaacagguaaacaguggggugauuucauuugccauaauucacauaagacgaauuuuaa

SEQ ID NO: 47673 - RNA, 64 nt, Human
uccugugugaagaaagccucagugaaacaggucuuugccauaacuuuaugaagugcuacagaaa

SEQ ID NO: 47674 - RNA, 64 nt, Human
ccuagccuuuggaagcaggguggccuccagagccuugccauaaaaaggcugaaggcagccgggc

SEQ ID NO: 47675 - RNA, 64 nt, Human
gauauuuucuuagagaaugaccaaaucuccuuucuugccauaauuaacauuuaguaauuaugua

SEQ ID NO: 47676 - RNA, 64 nt, Human
agcuaauuuuuauauuuuuaguagagaugggguuuugccauauuggccaggcuggucucaaacu

SEQ ID NO: 47677 - RNA, 64 nt, Human
gaugcccaauauucaaagcugcuaaauguucucuuugccauaaagacuccguguaacuguguga

SEQ ID NO: 47678 - RNA, 64 nt, Human
ucccauaaaugcaguugucaaagaaaagauuugguugccauagucauaagcaaugauacaugaa

SEQ ID NO: 47679 - RNA, 64 nt, Human
ccaaauguaaauagaggucuguaaagaaaaauaauugccauagaaaguauaauuucagugcagu

SEQ ID NO: 47680 - RNA, 64 nt, Human
gugaguugggagccguuaggcugaauguuacugcuugccauaugaugugaaguacagcaauauc

SEQ ID NO: 47681 - RNA, 64 nt, Human
uaccggcuucucugcauuuggucugcugaucauguugccauaauguguauggaaaguguaacac

SEQ ID NO: 47682 - RNA, 64 nt, Human
cuauauuugucuguacuccccuaggagaaguauuuugccauauauaaaaccacuguccuguccu

SEQ ID NO: 47683 - RNA, 64 nt, Human
cuccaaaaccuccauuccccugcugccagccccuuugccauagccugauuuuggggaggaggaa

SEQ ID NO: 47684 - RNA, 64 nt, Human
cugagugagguguugcagcccaaaggcugcagcauugccauaccauucccauggaguugccaac

SEQ ID NO: 47685 - RNA, 64 nt, Human
guccuacagagacgcaucugugguucuuuuguacuugccauagauguaaccuaaaaaguuuugg

SEQ ID NO: 47686 - RNA, 64 nt, Human
acacugcuggggaauaugcuuuuuaugguugcuguugccauauuuacugaagguuuauaccuaa

SEQ ID NO: 47687 - RNA, 64 nt, Human
aguuuguuuuggagacauuuucagugcauuguuauugccauauuuauauaauaugacuauucua

SEQ ID NO: 47688 - RNA, 64 nt, Human
agcaaagaacuggcacaauugguuugggucugcauugccauagugcccgaguuaaaacugcagg

SEQ ID NO: 47689 - RNA, 64 nt, Human
caaacucaggggaacuggcuucccaguugccccuuugccauauuccaagucccccucagacuuc

SEQ ID NO: 47690 - RNA, 64 nt, Human
aucuuuccaauggaagaguccugggaucuccaacuugccauaauggauuguucugauuucugag

SEQ ID NO: 47691 - RNA, 64 nt, Human
aauauaugccugaagauaauguguggaaggauauuugccauaugcuaacugguuuuuuggccag

SEQ ID NO: 47692 - RNA, 64 nt, Human
gaaaaaaacuuuaucuuaccauuaaguaaaauguuugccauaggcuuucuggggcuuucucuuu

SEQ ID NO: 47693 - RNA, 64 nt, Human
accuucuucauagguuuuuuuuuuuuuuaugugauugccauagugggauauucccucucccaca

SEQ ID NO: 47694 - RNA, 64 nt, Human
ugugauugccauagguggaauaauccaacauaaauugccauagauagaagguaucuguaauaua

SEQ ID NO: 47695 - RNA, 64 nt, Human
cucuuaaaaaaaaaggaaagaaaacuugaugugauugccauagguggaauaauccaacauaaau

SEQ ID NO: 47696 - RNA, 64 nt, Human
ccuuguggacaacggggcccuguucaccaagcuguugccauagagacugucaacguuguccuca

SEQ ID NO: 47697 - RNA, 64 nt, Human
cuauugguggauaucguagucuccucuagauauuuugccauaauacaugccaaaauacaagucc

SEQ ID NO: 47698 - RNA, 64 nt, Human
acccccaguccuguccuaucacucuaauucggauuugccauagccuugagguuauguccuuuuc

SEQ ID NO: 47699 - RNA, 64 nt, Human
agucgcugucucuuuucugugauuucuguaaaaguugccauaaaacuuugaaauucugccugaa

SEQ ID NO: 47700 - RNA, 64 nt, Human
agcuauuagguuggugcaaaaguaauugugguuuuugccauaaccuuuaauugcagcaaaaacc

SEQ ID NO: 47701 - RNA, 64 nt, Human
auuucuaaguaguaauucuucccagcucuuugauuugccauauauaaaauaggugggucguaug

SEQ ID NO: 47702 - RNA, 64 nt, Human
ggugacugguauagucugaugagaaagauguggauugccauaauaccucaaagauacacuuguu

SEQ ID NO: 47703 - RNA, 64 nt, Human
gggaacuuuuacaguucaaauuaauuugcagaaguugccauaaauguuugcauaaugacauagc

SEQ ID NO: 47704 - RNA, 64 nt, Human
accauaaaauguccaguaagaucacuguuuagauuugccauagaguacacugccugccuuaagu

SEQ ID NO: 47705 - RNA, 64 nt, Human
aaaagagacugaaaaaaagcaauguacuguacauuugccauauaauuuauauuuaagaacuuuu

SEQ ID NO: 47706 - RNA, 64 nt, Human
ggcuucuguacauuauguaucuccaguagcaauguugccauauuauuuauuucccaaacuuagu

SEQ ID NO: 47707 - RNA, 64 nt, Human
cuucgguggcccacacaccuaagcgucaucgucauugccauagcaucaugaugcaacacaucua

SEQ ID NO: 47708 - RNA, 64 nt, Human
aaugucacacuuaaaacuguguggaauaagacuuuugccauaaaaauaaacuauggaguccuuu

SEQ ID NO: 47709 - RNA, 64 nt, Human
aguguugucaggcgaucuuguuugaagcucuauguugccauaauuaccaucaaguacacacugu

SEQ ID NO: 47710 - RNA, 64 nt, Human
aauauaaaugcccuuguacccuucacauacuauuuugccauauuugcuucugauuuuuaaauaa

SEQ ID NO: 47711 - RNA, 64 nt, Human
cuaaauuacuggccagguaggacgcgaguccacuuugccauaaggaaagcgggucaauagggcu

SEQ ID NO: 47712 - RNA, 64 nt, Human
aaacuaagguuaauguucauauaacauuuagacuuugccauaaauaucagaaccaaagaucaag

SEQ ID NO: 47713 - RNA, 64 nt, Human
uugggccagcuaccuuuggggcugacccccuccauugccauaacauccugcuccauucccucua

SEQ ID NO: 47714 - RNA, 64 nt, Human
agauuuagcuaauuagaauuaauccuggcuuucauugccauagucuguaaaagacuuugguggc

SEQ ID NO: 47715 - RNA, 64 nt, Human
gggauuggcauaggcuaguguuuagcuugucuauuugccauaucuauuuuuuuuaaauuuccau

SEQ ID NO: 47716 - RNA, 64 nt, Human
guucuagaaugugcacaagcggguuucugugcuuuugccauagcuuuauaacuggggauaaccc

SEQ ID NO: 47717 - RNA, 64 nt, Human
uuguuuuuucagcauuuaguaugagaaccuauguuugccauauuuguaguauugcuuuuacauc

SEQ ID NO: 47718 - RNA, 64 nt, Human
ggguagagaucaaaggaggcaauggcuccaagccuugccauagggcugccuccaaggacacaga

SEQ ID NO: 47719 - RNA, 64 nt, Human
ugagccuugguaaaccugucucuauuacagcauguugccauacaucuauuuaagugcauaaggu

SEQ ID NO: 47720 - RNA, 64 nt, Human
aacaacaacaacauuuuuucaacaauuucaacaaugacacaaaaauucacauggaaauggggaa

SEQ ID NO: 47721 - RNA, 64 nt, Human
auguccuccaggugacagaggguggcaaggugacugacacaaagugacuuucagggcugugguc

SEQ ID NO: 47722 - RNA, 64 nt, Human
gaagggcaggagcucacaccgcaccgggcuggccugacacaaugguagcucugaagggagggga

SEQ ID NO: 47723 - RNA, 64 nt, Human
gugagagcugggauggggccagagauuauaaguuugacacaacaucugagacacuaggaugaau

SEQ ID NO: 47724 - RNA, 64 nt, Human
acugcugaaaagaacccaagagaauugucacacaugacacaagauguacauaauaucaugcuca

SEQ ID NO: 47725 - RNA, 64 nt, Human
uguuuuauuuugguguccuauuaaaggaauaaaaugacacaacuugucccuuuuuugucccauu

SEQ ID NO: 47726 - RNA, 64 nt, Human
aagcaguuccagucagccccugccacugugagaaugacacaaccauuuccuacacaguuugcac

SEQ ID NO: 47727 - RNA, 64 nt, Human
acaaagacuuuuagcaggugaacuguuccaagacugacacaaggauguuucaaacuugccucug

SEQ ID NO: 47728 - RNA, 64 nt, Human
agcuucuugggguugcuaggacagagagcuccuuugacacaaaagacaggagcaggguccaggu

SEQ ID NO: 47729 - RNA, 64 nt, Human
gacaggggggcaguugugaggccacagagugccuugacacaaagauuacauuuuucagaccccc

SEQ ID NO: 47730 - RNA, 64 nt, Human
gaaauuauuacaagcagauuaaucccucuuuuugugacacaaguacaaucuaaaaguuauauug

SEQ ID NO: 47731 - RNA, 64 nt, Human
ggaaguuuguguucuguuuguuaaaacuggcaucugacacaaaaaaaguugaaggccuuauucu

SEQ ID NO: 47732 - RNA, 64 nt, Human
aguccuggggccuagauucugcacuuggggucucugacacaacacaccaucccaaaguagccgg

SEQ ID NO: 47733 - RNA, 64 nt, Human
guauauucccuauaggcagcuggagagaucugugugacacaagaugcuuuuguacggguuccca

SEQ ID NO: 47734 - RNA, 64 nt, Human
uguacacugcagucaagggcagggaggggaggaaugacacaaauggcagggagcugcuggggga

SEQ ID NO: 47735 - RNA, 64 nt, Human
caacuugucauugaauguaaagaaugaaaccuucugacacaaaacuugagccacuuggauguuu

SEQ ID NO: 47736 - RNA, 64 nt, Human
augggaguuuccuuuuuuuacucuuugucacugaugacacaacagaaaagaaacuguagaccuu

SEQ ID NO: 47737 - RNA, 64 nt, Human
aaaccaaagcugagcuuuuaacuuucucccucuaugacacaaaugaauugaggguaggaggagg

SEQ ID NO: 47738 - RNA, 64 nt, Human
acagcaaucaugcaguuccagagacacaugaaccugacacaaucucucuuauccuugaggccac

SEQ ID NO: 47739 - RNA, 64 nt, Human
ccccacccuacugccucagcuggacccagggcuuugacacaaacccagugcuuugcuuaugggu

SEQ ID NO: 47740 - RNA, 64 nt, Human
aaagucucacugugucacccagacuggaaugcagugacacaaucucggcucacugaaaccucug

SEQ ID NO: 47741 - RNA, 64 nt, Human
aucuauuguaaauaaaaagcauuuuaaaaaguauugacacaaagcccaucagugggcauuaaaa

SEQ ID NO: 47742 - RNA, 64 nt, Human
gcuguucauuucuaucugccauuucugucaggguugacacaauccugcaagaauaguuauucua

SEQ ID NO: 47743 - RNA, 64 nt, Human
cuuaacaugagcuccaguuuaccuaaauguucacugacacaaaggaugagauuacaccuacagu

SEQ ID NO: 47744 - RNA, 64 nt, Human
uggaagugagggaauauuucaguuuccugaaguaugacacaaauacucauauacugucuuuuag

SEQ ID NO: 47745 - RNA, 64 nt, Human
uuaaaugaagucuuuuggucagaaauuaccuuuuugacacaagccuacugaaugcuguguauau

SEQ ID NO: 47746 - RNA, 64 nt, Human
ccuguuaacuugccccuuaguaucagcuguuacuugacacaaauguguguguuauucagagguu

SEQ ID NO: 47747 - RNA, 64 nt, Human
caccauuagagguugauggggcaacugcagcccaugacacaagaucucauuguucucgauguag

SEQ ID NO: 47748 - RNA, 64 nt, Human
aguaagucaggucccuaagccccgucccaagaagugacacaaguggccaacauccacacuguag

SEQ ID NO: 47749 - RNA, 64 nt, Human
accauucucucuuuguaggcaugcuguauguaauugacacaagggaacaguauuugcauuugua

SEQ ID NO: 47750 - RNA, 64 nt, Human
gcuacauauauucauguggugauagggaucaacuugacacaacuuugaaacugcauaaaguaga

SEQ ID NO: 47751 - RNA, 64 nt, Human
gaauccaggaggcagaggcuguggugagccaagaugacacaacugcacuccagcuugggcaaca

SEQ ID NO: 47752 - RNA, 64 nt, Human
uaggguacaagaagccuguucuguccagcuucagugacacaagcugcuuuagcuaaagucccgc

SEQ ID NO: 47753 - RNA, 64 nt, Human
augagccacuuugaccacccucgggugcuaugggugacacaagagcuguccacuggguguuugc

SEQ ID NO: 47754 - RNA, 64 nt, Human
uagcaguauauguuaauuuguguguuuuuagcugugacacaacugugugauuaaaagguauacu

SEQ ID NO: 47755 - RNA, 64 nt, Human
uagcccugguuauuuugaaaguguaauuccccucugacacaauaucccucacauacaagauggu

SEQ ID NO: 47756 - RNA, 64 nt, Human
uauguuuaguugguaaaugcuucauguucauggaugacacaauguuuuugcaaaaaaacccuga

SEQ ID NO: 47757 - RNA, 64 nt, Human
uacagagagcacccaggagguacacauacuaaagugacacaaagagaaugaagcagaaguagag

SEQ ID NO: 47758 - RNA, 64 nt, Human
auacuguauuuuuaccuuuuuccuuccuuaucacugacacaaaaaguagauuaagagauggguu

SEQ ID NO: 47759 - RNA, 64 nt, Human
guuuagauacauuagcugcaauuuuuuuugcauuugacacaauauuguaauaauccaugauuuu

SEQ ID NO: 47760 - RNA, 64 nt, Human
uguuugcaaggggaaggaccauuucguaauggucugacacaaaagcaaguuugauuuuugcagc

SEQ ID NO: 47761 - RNA, 64 nt, Human
agcaaaucauucuguauauaugcucuccagccucugacacaagaugcguucuuaauacagacuu

SEQ ID NO: 47762 - RNA, 64 nt, Human
aucauagaaguauguuaaaaccacuuuaaauuguugacacaaagugguaaggaaguuuugucug

SEQ ID NO: 47763 - RNA, 64 nt, Human
ccuuguuaagauuggugcuuuugguaacuuguacugacacaacagacaugugcuaguaucugau

SEQ ID NO: 47764 - RNA, 64 nt, Human
uacguguuaucaauaauaagauuuugcaacuggaugacacaagauuuuacuugaacagugaagg

SEQ ID NO: 47765 - RNA, 64 nt, Human
cacccugaaagugauucccuggucuacuugaauuugacacaagagaaaagcaggaggaaaaggg

SEQ ID NO: 47766 - RNA, 64 nt, Human
ggggcccuaccuagagggacugacuuuuguccauugacacaaaccccuuuuaguacuguuuuga

SEQ ID NO: 47767 - RNA, 64 nt, Human
agcagaguucuuugcaagcuuauuuagcacauuuugacacaauguugcacugaaaacccaggcc

SEQ ID NO: 47768 - RNA, 64 nt, Human
ggguuuaucccuuuuaaucaguuaagauucuuguugacacaaauuguuuuacaucaacuguugu

SEQ ID NO: 47769 - RNA, 64 nt, Human
uaaaaaauaccuaaaaggaagcuuagaugggcugugacacaaaaaauucaauuacugucaucua

SEQ ID NO: 47770 - RNA, 64 nt, Human
gaaccaaaccaccuuagugaguaacccuaagaauugacacaaaucucauauuuuaggagauuau

SEQ ID NO: 47771 - RNA, 64 nt, Human
aggggcauauuuuauauuagugaagagguauuacugacacaauuucuucuauauaugaaccuau

SEQ ID NO: 47772 - RNA, 64 nt, Human
cuuaaaaccaauaggaaacuuaagcgagguuucaugacacaaccuuucaugucgugaaaggcag

SEQ ID NO: 47773 - RNA, 64 nt, Human
agaauuaaagcaaguuauuuucuuauuuguauaaugacacaaagcauugggagucagacugcuu

SEQ ID NO: 47774 - RNA, 64 nt, Human
acaauaaagggcucauaauaaauaaauauauuuuugacacaauuaaauauuacauagaguaugu

SEQ ID NO: 47775 - RNA, 64 nt, Human
cauauguuucuuucuccaucggccaaaaacauuuugacacaauguuugugaaacaccuuuggag

SEQ ID NO: 47776 - RNA, 64 nt, Human
aauaauuaacuggggauaaaagaauggcaaggggugacacaaaguagcaaacugaauacuucuc

SEQ ID NO: 47777 - RNA, 64 nt, Human
aauuuuuaccugucuuuuaauccaguccauuuucugacacaauauuaaacagaacgccaguugc

SEQ ID NO: 47778 - RNA, 64 nt, Human
acaaaguacgugaaaaucagguuucaauagaaugugacacaacgugcaaggaaaugaagcggaa

SEQ ID NO: 47779 - RNA, 64 nt, Human
auucgaggaggaggcuguuauuuugggccugaugugacacaacaguugcuacaaaaauacaaca

SEQ ID NO: 47780 - RNA, 64 nt, Human
ugcuaacauuagguuauuuauugauucaaucaguugacacaaggaggcagcuacggggagguaa

SEQ ID NO: 47781 - RNA, 64 nt, Human
aaaaucaugcuuauaagcaacaugaauuaagaacugacacaaaggacaaaaauauaaaguuauu

SEQ ID NO: 47782 - RNA, 64 nt, Human
uccucauguaacauuggugaaggauccaggaauaugacacaaagguggaauaaacauuaauuuu

SEQ ID NO: 47783 - RNA, 64 nt, Human
uucaagacaacauuauacauggcucugaaauaucugacacaauguaaacauugcaggcaccugc

SEQ ID NO: 47784 - RNA, 64 nt, Human
ugucauuacaaccuggaaaauaaaucacccuaagugacacaaauugaagcauguacaaauuaua

SEQ ID NO: 47785 - RNA, 64 nt, Human
ggcaaaccagacuuaucuugcaauaugagaaugcugacacaaugcaggaaagccaguuucccuu

SEQ ID NO: 47786 - RNA, 64 nt, Human
guagcaucccuaccacccaggacacuggugcgaaugacacaacucaaguugggaggggaacagg

SEQ ID NO: 47787 - RNA, 64 nt, Human
uuucugccaacugugaaguauccuccuggagcagugacacaaucuuggcggagcauugcuaccc

SEQ ID NO: 47788 - RNA, 64 nt, Human
cucagggagauaagaccuucuugcuggauuuuuaugacacaaucucuuuauaauuuuacaaaua

SEQ ID NO: 47789 - RNA, 64 nt, Human
ggagcuuagaguccaggaggaauacauuagauaaugacacaaucaaauauaaauugcaagaugu

SEQ ID NO: 47790 - RNA, 64 nt, Human
ugcaugugucuuagucuuagucaccuuauuauccugacacaaaaacacaugagcauacaugucu

SEQ ID NO: 47791 - RNA, 64 nt, Human
ggggucuugcucugucucccaggcuggagugcagugacacaaucucagcucacugugaccuccg

SEQ ID NO: 47792 - RNA, 64 nt, Human
cgccgcugcacgagagcgaggcugaagaacuuugugacacaauaguccaccucccugcaaaggc

SEQ ID NO: 47793 - RNA, 64 nt, Human
gacuauuagaaaaguacaggguauugggcguuccugacacaaacugaggccuccuagcaagacu

SEQ ID NO: 47794 - RNA, 64 nt, Human
ugcugcaggacuugagaagaccucaccuagaaauugacacaaguggaccuuaggccuuccucuc

SEQ ID NO: 47795 - RNA, 64 nt, Human
caugccuguucuccuuccuugcuauggaauuugcugacacaauaucuuccgccuggugcugggc

SEQ ID NO: 47796 - RNA, 64 nt, Human
ccaccucccacccacagaccuucccuuuagcuguugacacaacuucccagcucugcaagugugc

SEQ ID NO: 47797 - RNA, 64 nt, Human
uuagcuguucaaaucuguuugucucuugaaacagugacacaaagguguaauucucuaugguuug

SEQ ID NO: 47798 - RNA, 64 nt, Human
ugccuuuguuguugaaaaaguguugcacucugugugacacaauuacagcugauugcagccucaa

SEQ ID NO: 47799 - RNA, 64 nt, Human
gugugaugcauauuacaaaguggacuugucacaaugacacaaacucauuuuuuguaacugggaa

SEQ ID NO: 47800 - RNA, 64 nt, Human
ugacaaaauuuauuuuauuuuuaaacagugguuuugacacaaauuauguuauugaaaagcauua

SEQ ID NO: 47801 - RNA, 64 nt, Human
gggaauguguagccuucaggaaaaaaaugccaauugacacaaagcauuccaguagcuaugaccu

SEQ ID NO: 47802 - RNA, 64 nt, Human
aggaaggggaagugggcaaagcagacccucaaacugacacaagaccuacagagaaaacccuuug

SEQ ID NO: 47803 - RNA, 64 nt, Human
cagauucauuuuaacaaauuaagggaagauauuuugacacaagaaagcaggaacguggagaaau

SEQ ID NO: 47804 - RNA, 64 nt, Human
cugaaaagacaaggugugaaggagcaacuucaguugacacaaaauuugaaaugcucacagauca

SEQ ID NO: 47805 - RNA, 64 nt, Human
aacaacaguauuuuaagggucacuugccuccuguugacacaauuguugcuaaaucaaaagaagc

SEQ ID NO: 47806 - RNA, 64 nt, Human
cagcauuggggccauacuaagguuuguaucuagaugacacaaacgauauucugauuuugcacau

SEQ ID NO: 47807 - RNA, 64 nt, Human
guaggucacauuaaauacugacuugagcagugggugacacaacacaguguuugucuuccacagg

SEQ ID NO: 47808 - RNA, 64 nt, Human
agguugaaauuaaagaugaauaaauaaaauaaaaugacacaaggccaaaaacaaauggguuuaa

SEQ ID NO: 47809 - RNA, 64 nt, Human
uuuauuaaaucugaauuuuaaaacaugcuguuuaugacacaaugacacauuuguugcaccaauu

SEQ ID NO: 47810 - RNA, 64 nt, Human
gagccaaagaagaucaccugggccagggccuacgugacacaaggagacaugggcuagggaaggc

SEQ ID NO: 47811 - RNA, 64 nt, Human
aaaguuuacuuaauaaugguaucuuuaaaauaauugacacaauugcaaaaugaauuccuggcuu

SEQ ID NO: 47812 - RNA, 64 nt, Human
acugauccgugugugaggugggaguacugcaaccugacacaaugcucagaaacagaaucagugu

SEQ ID NO: 47813 - RNA, 64 nt, Human
gcgacaccaccaacaggcguucucagccuccggaugacacaaauaccagagcacagauucaagu

SEQ ID NO: 47814 - RNA, 64 nt, Human
uccugucuuauccuccaccgucuuucuuuuauacugacacaagaauggucuuucugaauugcac

SEQ ID NO: 47815 - RNA, 64 nt, Human
uacuucaacaguuucauaaaacgauuccccugagugacacaagaacauaaaauguuaauaucac

SEQ ID NO: 47816 - RNA, 64 nt, Human
uugcuuuaaaucucugguaguuuuuccaccccugugacacaauccuaauagacaguguccugua

SEQ ID NO: 47817 - RNA, 64 nt, Human
auaucguugaccugcaaaauucaccuuuggaacgugacacaauguuaggcauaccuccuuuuuu

SEQ ID NO: 47818 - RNA, 64 nt, Human
cugaagcaauaggcagaggaaaauagcuuuucuaugacacaagucauaagaaguccauauacug

SEQ ID NO: 47819 - RNA, 64 nt, Human
guaaauuaagaauugcuacucgaaggugccagaaugacacaaaggacagaauuccuuucccagu

SEQ ID NO: 47820 - RNA, 64 nt, Human
gugucugccucuaggaugagcucagagcgagagaugacacaaugccucacucaggccccgggcu

SEQ ID NO: 47821 - RNA, 64 nt, Human
caaaugggagagcaaaauguuggccuacagagaaugacacaauuuuauucgccuuugguguuag

SEQ ID NO: 47822 - RNA, 64 nt, Human
aauaaaaugugaagacuagaccaauugucaugcuugacacaacugcuguggcugguuggugcuu

SEQ ID NO: 47823 - RNA, 64 nt, Human
cccuccaguggccugugggugagggaagccagaaugacacaaagcaaugcaaagacaagauugc

SEQ ID NO: 47824 - RNA, 64 nt, Human
ccuugagggacucccaaacuguuuuccaauguggugacacaauuuuauaucccaucaacagggc

SEQ ID NO: 47825 - RNA, 64 nt, Human
cgggacgguuccacacagccccggccuuucgcggugacacaaugguuagggaacgguuagaacg

SEQ ID NO: 47826 - RNA, 64 nt, Human
gucuggagacguuucuucuguggaagagaagaagugacacaaaccuauacuucauaugcugcuu

SEQ ID NO: 47827 - RNA, 64 nt, Human
cccaacacauacuguuuccaaaauuauuucuauaugacacaaaguaugauaccuuuaaaaaggu

SEQ ID NO: 47828 - RNA, 58 nt, Human
aagugcacagaaaguugugacccauggcugacacaagaauccauucucacagaaacug

SEQ ID NO: 47829 - RNA, 64 nt, Human
ugaacagcuuccccuccagcccacugcuuuaggaugacacaaugaauaacaccuagucauagaa

SEQ ID NO: 47830 - RNA, 64 nt, Human
caguggcaggaggccgugcuguguuuuacuuggaugacacaaugcaguuuacuugccucuucau

SEQ ID NO: 47831 - RNA, 64 nt, Human
cuuguaaucaagccuuuauggcugcugggcugagugacacaagcacuuuaauggccuggaggga

SEQ ID NO: 47832 - RNA, 64 nt, Human
ucuguugggagcuauugagccaccugggaugagaugacacaaggcacuccuaccacugagcgcc

SEQ ID NO: 47833 - RNA, 64 nt, Human
guuccuuuauguuucguuuauucacuaaaguagcugacacaaaacacaccaaaaccuagagcgg

SEQ ID NO: 47834 - RNA, 62 nt, Human
aagacggugacuuuuuuuccaauaaaauauuuuaugacacaaucgggcucgguggagcagcu

SEQ ID NO: 47835 - RNA, 64 nt, Human
cuaacaugguacacugcaucucaagauguuuaucugacacaaguguauuauuucuggcuuuuug

SEQ ID NO: 47836 - RNA, 64 nt, Human
gcaagaugucuuagaguaggguuaagguucucagugacacaagaauucaguauuaaguacauag

SEQ ID NO: 47837 - RNA, 64 nt, Human
ugccaaacacacacuaacuguccuggccucuccgugacacaagucucuucccagccuuccucac

SEQ ID NO: 47838 - RNA, 64 nt, Human
cuuuugcuagauggaauggaaaagcaacuucauuugacacaaagcuucuaaagcagguaaauug

SEQ ID NO: 47839 - RNA, 64 nt, Human
caaaguguuuaauuguauaaaacaguguuuccagugacacaacucauccagaacugucuuaguc

SEQ ID NO: 47840 - RNA, 64 nt, Human
uuuauuuuccucugccauccuugcuaaguaguuuugacacaaugaaaauggaagcacuuuagug

SEQ ID NO: 47841 - RNA, 64 nt, Human
gccaaccucucgaacaguauucaccuaguuacccugacacaagaaguucuuguucuucaggaga

SEQ ID NO: 47842 - RNA, 64 nt, Human
cauaguauucaugacuauggauaaacuaaacacgugacacaaacacacacaaaagggaacccag

SEQ ID NO: 47843 - RNA, 64 nt, Human
acuaaccccaacgcacaggaaaagguagcuuaccugacacaagaggaauaagaauggagcagua

SEQ ID NO: 47844 - RNA, 64 nt, Human
ccaucugagaacuuuauuaugucauuuuuuuccaugacacaaaauaagaauuuucuuaauauga

SEQ ID NO: 47845 - RNA, 64 nt, Human
aacagacaaaugcuccagaaaucuaugcugacugugacacaagagccucacaugagaaauuacc

SEQ ID NO: 47846 - RNA, 64 nt, Human
agcaaggagcccgacacugauuugaucgauucugugacacaaaccccaccaauuguuaaugcaa

SEQ ID NO: 47847 - RNA, 64 nt, Human
ucuggcuccugcuaggugagaccuggccaucaaaugacacaaacaacuaaacgauggaagagag

SEQ ID NO: 47848 - RNA, 64 nt, Human
gcuuggaccuugguacuaccucagcugaggguggugacacaaccccuuccauuugucagcacuu

SEQ ID NO: 47849 - RNA, 64 nt, Human
agugaaagcugcacuuaacccuuugugauaaugaugacacaaaaugaauauuaauggaggauau

SEQ ID NO: 47850 - RNA, 64 nt, Human
auauguauacauauagauagauaauguucuccacugacacaaaagaagaaauaaauaaucuaca

SEQ ID NO: 47851 - RNA, 64 nt, Human
caaacaaucaaaaaaaaagacaguuuauuaaaaaugacacaaaugacugggcuaaaucuacugu

SEQ ID NO: 47852 - RNA, 64 nt, Human
caguccccuugaacuucugcccucuguucagggcugacacaagccccacaggcuggggggcucc

SEQ ID NO: 47853 - RNA, 64 nt, Human
cuccugcuccucuucggaguagaaauaaaggcugugacacaaggaagccaguggggugggaggg

SEQ ID NO: 47854 - RNA, 64 nt, Human
auuccauucaaucuuuggaggcuuuuaaacauuuugacacaaaauucuuaugguauguagccag

SEQ ID NO: 47855 - RNA, 64 nt, Human
cuuucuacucaaugguccccacuccaagaugaguugacacaaccccuucccccaauuuuugugg

SEQ ID NO: 47856 - RNA, 64 nt, Human
gcagaucccagcugugaagaggccacugcauggcugacacaaaacaccucuuggccauucacag

SEQ ID NO: 47857 - RNA, 64 nt, Human
uccagcuuccugucuuuacaccaaaauaaaguauugacacaagagaucucuuccugccaagguu

SEQ ID NO: 47858 - RNA, 64 nt, Human
uaccuuaggacucagucaucuccacuuaaauugaugacacaagcagcuaauaaccauuucuggg

SEQ ID NO: 47859 - RNA, 64 nt, Human
aacacaucuuggccucccaaguugcugggauuacugacacaagccaccgccccugagugcucau

SEQ ID NO: 47860 - RNA, 64 nt, Human
aauuucuuucuuuuaauuguggcauauagguuugugacacaagaagucauacuuugguggcuaa

SEQ ID NO: 47861 - RNA, 64 nt, Human
uucuacaaccguaagaugacaguuuucaauguagugacacaaaagggcaugaaaaacuaacugc

SEQ ID NO: 47862 - RNA, 64 nt, Human
aagcaaaacaauaggggaagccuggagccaaagaugacacaaggggaaggguacugaaaacacc

SEQ ID NO: 47863 - RNA, 64 nt, Human
guggagaacugggcuugcucagacgcacucgcauugacacaacguaacaccagcauugugugug

SEQ ID NO: 47864 - RNA, 64 nt, Human
cccagcugccuuuguggaagggaggagacggucaugacacaaagcuuuauccuacacagaaaca

SEQ ID NO: 47865 - RNA, 64 nt, Human
cauuugauuuucaaggaugccgucaagacgggguugacacaaugcugcacgugucuggucacac

SEQ ID NO: 47866 - RNA, 64 nt, Human
aggagugugggaaugaaggaauucuggagcuuuuugacacaaaaccuauuaccacauuuagcag

SEQ ID NO: 47867 - RNA, 64 nt, Human
uaguuuccuuuccauuucuuccuagucuggccuuugacacaaaucugguagaaagaagccugau

SEQ ID NO: 47868 - RNA, 64 nt, Human
gaccccaucaaacugagccuuugaugucacauucugacacaagaugcaagucugugcaaaaccc

SEQ ID NO: 47869 - RNA, 64 nt, Human
auaguacugugccucuuucuucucaaacaauggaugacacaaaacuaugagagugacaaaaugg

SEQ ID NO: 47870 - RNA, 64 nt, Human
aaaguacaagccaaaugauuuucauugguggaacugacacaaaaaaaguaacuuaaaaacaaga

SEQ ID NO: 47871 - RNA, 64 nt, Human
gaccucuguugggauaugguauuauuuuacauacugacacaaccuaaauuuucuuuggguagua

SEQ ID NO: 47872 - RNA, 64 nt, Human
gagcccuuaaaauaccaccuccucauguguaaauugacacaaucacuaaucugguaauuuaaac

SEQ ID NO: 47873 - RNA, 64 nt, Human
auacagagcaacaccuguugagccagggaguaggugacacaaggaaaccuucauggaucuuccc

SEQ ID NO: 47874 - RNA, 64 nt, Human
auaguuuacagcuguacuuuccagaucuucuaugugacacaaugcacuguccuuguggguuugu

SEQ ID NO: 47875 - RNA, 64 nt, Human
caaggacuggguagcagacuccucagaguccucuugacacaaaugucagauuugugucacucuu

SEQ ID NO: 47876 - RNA, 64 nt, Human
gaggaaagagucuucaacauaacccacuugucacugacacaaaggaagugcccccuccccggca

SEQ ID NO: 47877 - RNA, 64 nt, Human
caguucucugucaucguuuaacaaaaccaacaacugacacaacuccuuaagcugugguuucagu

SEQ ID NO: 47878 - RNA, 64 nt, Human
uaaaaaguaaauguauuugccuuugacaaaagacugacacaagagcaaauaagcuuuaaaaucg

SEQ ID NO: 47879 - RNA, 64 nt, Human
cucucacaucuugcacacuuuuuggguguguaaaugacacaaaaguuauuuacauauuauauau

SEQ ID NO: 47880 - RNA, 64 nt, Human
guggaggugauuuacugcugaauuaaaacucaagugacacaaguuacaaguugauaucguugaa

SEQ ID NO: 47881 - RNA, 64 nt, Human
cgaaccauccagcgcacagaagcaagugcaaaaaugacacaagcacaacucuccagacguggcu

SEQ ID NO: 47882 - RNA, 64 nt, Human
ggcaucaccuccaccauacuccaucaguuagagcugacacaaaccugccuggguuuaaggggag

SEQ ID NO: 47883 - RNA, 64 nt, Human
aauacugcauuuagaaaaauugucuuuucuuaaaugacacaagcagguuuagaguggagaauuu

SEQ ID NO: 47884 - RNA, 64 nt, Human
aaguauuuacauccucuuucaagaugagcuuauaugacacaauuauuauuugcugauacaugaa

SEQ ID NO: 47885 - RNA, 64 nt, Human
auugauuuuacggaagauguuauauggacuuuaaugacacaauguuuagagauaaaauguacau

SEQ ID NO: 47886 - RNA, 64 nt, Human
uuuguucccagguaccucaugggaagcauguggaugacacaaucccuggggcugugcauuccca

SEQ ID NO: 47887 - RNA, 64 nt, Human
cuggaaggaauggaggagucucaacauguguuucugacacaagauccgugguuuguacucaaag

SEQ ID NO: 47888 - RNA, 64 nt, Human
gaugguuuugcuacuaauuccuaucccauacauuugacacaaaagaaguguugguaauggauaa

SEQ ID NO: 47889 - RNA, 64 nt, Human
gaguuuugcucuuguugcccaggcuggagugcagugacacaaucucuacucacugcaaccucca

SEQ ID NO: 47890 - RNA, 64 nt, Human
uuuaauauguacauuuuuuguguuaacagcuuuuugacacaauuacuggguaauuucuaauaua

SEQ ID NO: 47891 - RNA, 64 nt, Human
acaucaugcacagcagccuccagcaaggcaaauuugacacaaaaggcaucgagaguacugacga

SEQ ID NO: 47892 - RNA, 64 nt, Human
uguaaacacuacaaaaugucaaaauaaugagaacugacacaacuuugccuuaaagaguacuaga

SEQ ID NO: 47893 - RNA, 64 nt, Human
guuccccagauuguuaagaguucacugaagauauugacacaauuuuaaaaaaucaguaaaggaa

SEQ ID NO: 47894 - RNA, 64 nt, Human
aaaauuacaaaacacugcugaaagaaaucagagaugacacaaauggaaaaacauuccauacuua

SEQ ID NO: 47895 - RNA, 64 nt, Human
uauauuguguguguguguggguguguguguguuuugacacaaaaacaaugcaagcaugugucau

SEQ ID NO: 47896 - RNA, 64 nt, Human
aucuccagccucaggccggcagguccuauguccuugacacaaaugcuucuugcugaaauccucc

SEQ ID NO: 47897 - RNA, 64 nt, Human
cugggcagauccucaagcagaccuacagcaaguuugacacaaacucacacaaccaugacgcacu

SEQ ID NO: 47898 - RNA, 64 nt, Human
ucagcacucccagacguagcacagaaaaacccuuugacacaaaccauguguucugauuuuuggu

SEQ ID NO: 47899 - RNA, 64 nt, Human
aaguaagugaauagaauacaauaaaacaaaacaaugacacaaaaccacaaucaucaucauaauc

SEQ ID NO: 47900 - RNA, 64 nt, Human
auugaaacagugauuaaguuugaucaagccauggugacacaaaaaugcauugaucaugaauagg

SEQ ID NO: 47901 - RNA, 64 nt, Human
aauuuaauuuaaaauuuaaauuuuaacaaagugaugacacaacaauauguacguuuaggugugg

SEQ ID NO: 47902 - RNA, 64 nt, Human
gagacccgaggggcggcggcgcgguuuuuuauggugacacaaauguauauuuugcuaacagcaa

SEQ ID NO: 47903 - RNA, 64 nt, Human
uucucuccaggaaguuuugaguuucucuccaccgugacacaauccucaaacauggaagaugaaa

SEQ ID NO: 47904 - RNA, 64 nt, Human
gcuuugaaccuccuuccacagccgcaucuucucaugacacaaagcuuuugauaaguacuuuccu

SEQ ID NO: 47905 - RNA, 64 nt, Human
ccaaguuaguaaacaaaauaucuuaacaguuugaugacacaagcuacugaugaggguuuggaau

SEQ ID NO: 47906 - RNA, 64 nt, Human
gagugauccuccuuccuucccuggcccuuggcugugacacaagauccuccugcagggcuaggcg

SEQ ID NO: 47907 - RNA, 64 nt, Human
ccucuucucuguuuuuacuggaauugcuacacucugacacaaacauuuacugcuggaucgacca

SEQ ID NO: 47908 - RNA, 64 nt, Human
auaccaaaagaguguacaaaguguugcagggcugugacacaauagggacucuauggaaaacugg

SEQ ID NO: 47909 - RNA, 64 nt, Human
ggagggguggggcccacccuggaagaguggacagugacacaagguggacacucucuacagauca

SEQ ID NO: 47910 - RNA, 64 nt, Human
ucaaucagauguugaauuucauguaucugaacauugacacaaaggagauaccuuauggugccag

SEQ ID NO: 47911 - RNA, 64 nt, Human
aggacaguguccccccgagugacuccgcagcuucugacacaacuccccugggggcugcgguagg

SEQ ID NO: 47912 - RNA, 64 nt, Human
agccuguuugguggucucuucacacggacgcgcgugacacaaugcugggugguuuucccacgaa

SEQ ID NO: 47913 - RNA, 64 nt, Human
ucagugggcugggcggagccgcagcugcaaacucugacacaaaagacgugccuuaaggaacccg

SEQ ID NO: 47914 - RNA, 64 nt, Human
ggacacugagcuugaacuucauauaucagucaugugacacaaaauaucauucuucuuuuuauuu

SEQ ID NO: 47915 - RNA, 64 nt, Human
agagaaaauucaaggaauggaagaguaaauuacaugacacaaaaaggagcaauuaaaucuaaaa

SEQ ID NO: 47916 - RNA, 64 nt, Human
ggcagaaaguagaacuuacuauucauuaaauguuugacacaauuggaauugucuuuaauuucug

SEQ ID NO: 47917 - RNA, 64 nt, Human
cgugguucugcuuccugcugcaucgucugccaucugacacaaggccugucguggccuccugguu

SEQ ID NO: 47918 - RNA, 64 nt, Human
uugagagagcguuauuuacauuauuuauuuguuuugacacaagugcuuucaguguuuuauccua

SEQ ID NO: 47919 - RNA, 64 nt, Human
ugacagguggcuguucagguggaccaaagcaccuugacacaaggacuccacacugugcucucua

SEQ ID NO: 47920 - RNA, 64 nt, Human
uuuucuuugaaacaauuaaguucaugacaauggaugacacaaguuugagguagugucuagaauu

SEQ ID NO: 47921 - RNA, 64 nt, Human
ggcaagaucacagguugaugcugcacagccccauugacacaaacccucaaagcagacgugagag

SEQ ID NO: 47922 - RNA, 64 nt, Human
ggccaguucacaggaaguacaggaguacagguuuugacacaagaacaguuggccaauacuggug

SEQ ID NO: 47923 - RNA, 64 nt, Human
uuuuuugccaacccugugucacuuagugaggaccugacacaaucccuacagggugucugucagu

SEQ ID NO: 47924 - RNA, 64 nt, Human
gaguuuugcucuugucucccaggcuggagugcagugacacaaucucggcucacugcaaccucca

SEQ ID NO: 47925 - RNA, 64 nt, Human
ugucuguaaccaauaauguagcaguucugcacuuugacacaagguguaacuagaccauuuuuaa

SEQ ID NO: 47926 - RNA, 64 nt, Human
aaauuuugauaaucuguucucuuaaaaaaguuaaugacacaauuaagauacugacaucaaauug

SEQ ID NO: 47927 - RNA, 64 nt, Human
gacgccaccccgccccaucagcacuuaagccacaugacacaaagucuguaccgcacgggaaaug

SEQ ID NO: 47928 - RNA, 64 nt, Human
ucuccugcuguucuggguaaccuugagcuauguaugacacaacucuucuaugccuggauguggu

SEQ ID NO: 47929 - RNA, 64 nt, Human
ugccgcugggcccuggggcgguggggacagauguugacacaaauuauuuauguuuucuuaguau

SEQ ID NO: 47930 - RNA, 64 nt, Human
guuuaucacuguuguggagauuuccuuuuauucuugacacaauuugaugaccuaaaguguguuu

SEQ ID NO: 47931 - RNA, 64 nt, Human
agaggggaaugaauacuucagaugcuuucaggagugacacaagaacacaaugauuuuugcuuau

SEQ ID NO: 47932 - RNA, 64 nt, Human
aaggaaauaaaugugacucacauuucuuuuacugugacacaauaaugugauccuaaaacuggcu

SEQ ID NO: 47933 - RNA, 64 nt, Human
gacuuaauugauugguauauuagugacaucaacuugacacaagauuagacaaaaaauuccuuac

SEQ ID NO: 47934 - RNA, 64 nt, Human
agggucuugcucugucacccagacuggaguacaaugacacaaucauagcucacugcagccuuua

SEQ ID NO: 47935 - RNA, 64 nt, Human
cuuuggaccaucacacacauuucagcauuugaagugacacaagcuaccugguaacugcccaugg

SEQ ID NO: 47936 - RNA, 64 nt, Human
acacuuaguguucuucuuucacacuucucaaaagugacacaagagaaauccaguucaccuacag

SEQ ID NO: 47937 - RNA, 64 nt, Human
aaaggggaaaucuauaacauuucuuuugcccaagugacacaaaaaugauuacugcauagaaauc

SEQ ID NO: 47938 - RNA, 64 nt, Human
uguuaaaaaauguuuaacaaaaaaaauguuguaaugacacaaagccuuaugaaaauauuuaugg

SEQ ID NO: 47939 - RNA, 64 nt, Human
aauauugguguggcugcaaauuucccucugaagcugacacaauuaaggaugaauuaccauaaca

SEQ ID NO: 47940 - RNA, 64 nt, Human
gaacugaaguaaacacuuuaguugcuuucagggaugacacaagcacacaaugauuuuugcuuac

SEQ ID NO: 47941 - RNA, 64 nt, Human
ggugggugcuggcugagccccuggggcagaaggaguggggcaggcggggucuuuguucucggcu

SEQ ID NO: 47942 - RNA, 64 nt, Human
caggugagggggcgccugccagggccagacccagguggggcagccugaacccugcuucccccug

SEQ ID NO: 47943 - RNA, 64 nt, Human
ccagugaggcccggagcgcuugggaggggucccaguggggcaggccccucugucuggccacccc

SEQ ID NO: 47944 - RNA, 64 nt, Human
gaggcucugccuuucccaagggcccuggcagaggguggggcacugcaccuuaccccacccaucc

SEQ ID NO: 47945 - RNA, 64 nt, Human
gagucccagugggaggcgcgagccaugauguggaguggggcaguagaaggucggaggcuuggga

SEQ ID NO: 47946 - RNA, 64 nt, Human
uccuggggaagcaggucucaauucugaauagccaguggggcacacugacuguccuccccagggg

SEQ ID NO: 47947 - RNA, 64 nt, Human
gggcugcuggagagagcggggaacucccaccacaguggggcauccggcacugaagcccuggugu

SEQ ID NO: 47948 - RNA, 63 nt, Human
ccaaccugacccccaucugaccacagggcagggguggggcaacaugcgggcugccaaugggac

SEQ ID NO: 47949 - RNA, 64 nt, Human
gggcccaucaggcaguguuaccuguuagcucccuguggggcaggagugccaggaccagccugua

SEQ ID NO: 47950 - RNA, 64 nt, Human
ugggggccauaccuguuccagcucuguucccaggguggggcagggagguggggguugggggagu

SEQ ID NO: 47951 - RNA, 64 nt, Human
aggguggggcagggagguggggguugggggaguaguggggcacggcuccuaagauccagccccc

SEQ ID NO: 47952 - RNA, 64 nt, Human
acuaggccccaggcccgcccuccuggccagcagaguggggcacuggggggcaacagcaacaguu

SEQ ID NO: 47953 - RNA, 64 nt, Human
uccgccuuuccggggcugcuggccuggcccuugaguggggcagccuccuugccuggaacucacu

SEQ ID NO: 47954 - RNA, 64 nt, Human
cagguggaggugccaggaagcucccucccucacuguggggcauuucaccauucaaacaggucga

SEQ ID NO: 47955 - RNA, 64 nt, Human
agcuuuuuugaagcauuucauaagggccaaggaaguggggcagggcuuuucugauccaaagaaa

SEQ ID NO: 47956 - RNA, 64 nt, Human
aauugaggggacccagugugcuucaguguuaagaguggggcaaugaagagugaaccccaaugaa

SEQ ID NO: 47957 - RNA, 64 nt, Human
ccaauauuccuucgaaagagugucaaggaauaggguggggcaaugugucauucugcauuggaag

SEQ ID NO: 47958 - RNA, 64 nt, Human
ccaugucggcucugccugcagugaccagugcucuguggggcagaggagcugaccagggagggag

SEQ ID NO: 47959 - RNA, 64 nt, Human
aguguaggagacuuggagucaggcagugagacugguggggcacggggggcaguggguacuugua

SEQ ID NO: 47960 - RNA, 64 nt, Human
ccuucccacuccugagucacugaauucgaggaggguggggcagggaaagggcuggccccccugc

SEQ ID NO: 47961 - RNA, 64 nt, Human
gaaauuggaaauccagcugccuaguggccaguggguggggcaagacugucaacgagauuuacag

SEQ ID NO: 47962 - RNA, 64 nt, Human
augcuucuuuaccccucacaauccuugccacaguguggggcaguggaugggugcuuaguaagua

SEQ ID NO: 47963 - RNA, 64 nt, Human
agggcccucugcuguggucugaaccccagggggaguggggcauugacuccaccccuguccugag

SEQ ID NO: 47964 - RNA, 64 nt, Human
ugggugggauguaccgcaggugcaucgcgucgagguggggcacggccgccggcaagaaacccac

SEQ ID NO: 47965 - RNA, 64 nt, Human
aggcaauggacugaaugagugcgugcugggugggguggggcacggaggcuggcggguugcuuca

SEQ ID NO: 47966 - RNA, 64 nt, Human
caagcuguccccucugucaucacucccuggauguguggggcaugguuccuucccugggaaggcu

SEQ ID NO: 47967 - RNA, 64 nt, Human
aaucaggugauuguggaaccauggggacuuggggguggggcagaggugggaacauuuguaucag

SEQ ID NO: 47968 - RNA, 64 nt, Human
gguguccaggguaaaguguaacucagacugaccuguggggcacagggggcaccagcuggccuug

SEQ ID NO: 47969 - RNA, 64 nt, Human
guaccagggucacagccuggcacaggcuacagggguggggcagaaggaaaggggacaagauaga

SEQ ID NO: 47970 - RNA, 64 nt, Human
auuuuuaaacuaagcaaagguacacguuguaacgguggggcaucugugaaaaagaugucccuuu

SEQ ID NO: 47971 - RNA, 64 nt, Human
uucuacuuggugguuugcuugcucuacguuacagguggggcauguccucauccuuuccugccau

SEQ ID NO: 47972 - RNA, 64 nt, Human
aaaguuccaugagaugcucgaggagcaccugcugguggggcacccagcacucugcugggcauca

SEQ ID NO: 47973 - RNA, 64 nt, Human
uuauauauauuaucagagaaguagccuaguggucguggggcacagaaaaaauagauaggggcag

SEQ ID NO: 47974 - RNA, 64 nt, Human
caugacucacccugaggagucuccagggauggagguggggcaugcggccacuggucggugcugc

SEQ ID NO: 47975 - RNA, 64 nt, Human
gaaaauuuuuacuccacacagguguuucaguagaguggggcaggaaaagagaucucuucgauuu

SEQ ID NO: 47976 - RNA, 64 nt, Human
cugcuugcucuuuauuuuggucccggauccugggguggggcagaaauauuuucugggcuggggu

SEQ ID NO: 47977 - RNA, 64 nt, Human
uccucugaguccgccccucccugcugccuccucaguggggcagugggcaaggggcccaggggca

SEQ ID NO: 47978 - RNA, 64 nt, Human
ugcagugcaugccaucuugaggccucauaccuagguggggcaggcuggggcugccaaccugauc

SEQ ID NO: 47979 - RNA, 64 nt, Human
aaaaucuagagauguggcuguggcuuuuugggagguggggcaugggaggaccagagacgaaggg

SEQ ID NO: 47980 - RNA, 64 nt, Human
uaagggcuaaugaugaggguugguggggcucucuguggggcaaaaaggugguauggggguuagc

SEQ ID NO: 47981 - RNA, 64 nt, Human
acaggugccauagaaguagauuucuaggaaugaaguggggcagaucuuaucuuuguggauuaca

SEQ ID NO: 47982 - RNA, 64 nt, Human
cgugguggcugauaccgaauugugacucggcuagguggggcaaggcugggcaguguccgagaga

SEQ ID NO: 47983 - RNA, 64 nt, Human
ccaauucuagcacuccaggaaacugugggagaguguggggcaggcuccguccucccugggagac

SEQ ID NO: 47984 - RNA, 64 nt, Human
cggcuuggccagaagacagggugugagugagacaguggggcacagguuggguuugccaaacgcc

SEQ ID NO: 47985 - RNA, 64 nt, Human
uggugggauuccaaugggucuuggugggugggagguggggcaugugcaaagcaagcaaggaaca

SEQ ID NO: 47986 - RNA, 64 nt, Human
ccagagggagaggcagcagggaacgugggucaggguggggcaacaguggcaucaggugcggggc

SEQ ID NO: 47987 - RNA, 64 nt, Human
ucaagggaaggacaaucccaggaaguccuaagaaguggggcagauggcagggcugaggaugggc

SEQ ID NO: 47988 - RNA, 64 nt, Human
ugaccuggaagagcuggguaccaggccacccacuguggggcaagccugaguggugaggggccac

SEQ ID NO: 47989 - RNA, 64 nt, Human
ggaggagggcaacagggaaugaagcugguugaguguggggcaggaggacuggucagucacaaga

SEQ ID NO: 47990 - RNA, 64 nt, Human
gcugcgccugacagugcaaggcaggggcacggugguggggcacggagggcagucccgggugggc

SEQ ID NO: 47991 - RNA, 64 nt, Human
gucaacagggccacaggguugcuuucugucuuugguggggcaggggaguugacagggaugaggg

SEQ ID NO: 47992 - RNA, 64 nt, Human
accugcccucaccagacugagccaaccaaccacuguggggcaugugggagucacacacgugggu

SEQ ID NO: 47993 - RNA, 64 nt, Human
cuugaagggaguagggagugggggaagcaugggaguggggcaaaguugaauuuagagaauuuuu

SEQ ID NO: 47994 - RNA, 64 nt, Human
cagggcucccagccugcaccgccucccacugccaguggggcaugauucucucaggcuucugccc

SEQ ID NO: 47995 - RNA, 64 nt, Human
acaggcggggaagcuccacuucagacagggcuugguggggcaggacauggcucccauuuugaag

SEQ ID NO: 47996 - RNA, 64 nt, Human
uuuaaaugccaacacugucuucucauguucuuccguggggcauugauuaaugagcauuuguugg

SEQ ID NO: 47997 - RNA, 64 nt, Human
cugcccucucuccuccugaacucucucaucugcaguggggcaucgucugucuugccuugucacu

SEQ ID NO: 47998 - RNA, 64 nt, Human
ggccuuggacucuuccgaagggaugugaggcacuguggggcaggacaagggccugggauuuggu

SEQ ID NO: 47999 - RNA, 64 nt, Human
uuuaaggcguguguaugacacaguaacuggcaguguggggcagcugcaauuguaucuuaaaagu

SEQ ID NO: 48000 - RNA, 64 nt, Human
agcagagagagcaacgggaaggacaaagaaagagguggggcagggagcacaccccaggacccuc

SEQ ID NO: 48001 - RNA, 64 nt, Human
agaguuucccgugagcaauaaacucagcuuuuuuguggggcacaguacuggauuugacagugau

SEQ ID NO: 48002 - RNA, 64 nt, Human
aaaacaaaaaaaaauuacccuuuuguugggggggguggggcaguggucccaauaggagacaaag

SEQ ID NO: 48003 - RNA, 64 nt, Human
cuccccaugcccuccccagccucucccagcacaaguggggcaaagccagcaugcaagcagaccc

SEQ ID NO: 48004 - RNA, 64 nt, Human
cuuggaaggccgcagugaggagcugucuggaccaguggggcaccuuggggcuagcacacgggug

SEQ ID NO: 48005 - RNA, 56 nt, Human
ugcugcggaaggaggucuaaagccagguggggcaacagcgguggcagggcaggggg

SEQ ID NO: 48006 - RNA, 64 nt, Human
ucucuacuaaaaacacaaaaauuaucugggcaugguggggcaugccuguagucccacuuacuug

SEQ ID NO: 48007 - RNA, 64 nt, Human
guucugcaggcugguggggaggccgcccaucgugguggggcaucuguccagccccauugccacu

SEQ ID NO: 48008 - RNA, 64 nt, Human
acuuucucuagcccaucauuaccugugaacugcaguggggcagucauggcaaauagaauugggc

SEQ ID NO: 48009 - RNA, 64 nt, Human
gcggagacugcagaccagugcuucacuguguggaguggggcaggcaggggcuggaccccaggga

SEQ ID NO: 48010 - RNA, 64 nt, Human
ugggcagugcugguaggguuucaaggugcuauuaguggggcaggggcagggcggcugcucacag

SEQ ID NO: 48011 - RNA, 64 nt, Human
ucuccucaccaucuaaggcagaggaugggaugugguggggcagggaucugguacagacauaggc

SEQ ID NO: 48012 - RNA, 64 nt, Human
gaaggcugcacacaggcacauuccuucuuccacaguggggcaccaaggauucuguccucauugc

SEQ ID NO: 48013 - RNA, 64 nt, Human
agaacuacacuccaaauuuaauguguuuaaauugguggggcaccagcagaaaauauucuagcuc

SEQ ID NO: 48014 - RNA, 64 nt, Human
gagguugcugagcuucucuccaaagucuaaaaugguggggcaguagggaccugugagaggccca

SEQ ID NO: 48015 - RNA, 64 nt, Human
cagcagaaagcauuauuuugaaaggugauauacaguggggcacagaaaacaaaugaaaaccuuc

SEQ ID NO: 48016 - RNA, 64 nt, Human
ugggucugugcugcuguuacuguuaaccauuuaaguggggcaaaaccuugcuaauuuucucaaa

SEQ ID NO: 48017 - RNA, 64 nt, Human
ccuuuuggagagaugagcuguaucaccugcagauguggggcaggggugccucacugugagcggg

SEQ ID NO: 48018 - RNA, 64 nt, Human
cucaggccguaggugccuggccaguuuccuguuuguggggcagcuggggccugaggaggagggg

SEQ ID NO: 48019 - RNA, 64 nt, Human
uggccuuccagaacagucugccccucaaggaaggguggggcaggcaguacccccaagcaggcug

SEQ ID NO: 48020 - RNA, 64 nt, Human
cuacaaaccaaggcugcuguucaucccacaucguguggggcaguguccauccccugcagcuacu

SEQ ID NO: 48021 - RNA, 64 nt, Human
cugugggccuagaauauggcccucaacccuuagaguggggcagugagggcuugaggagugaccc

SEQ ID NO: 48022 - RNA, 64 nt, Human
ugaugcccucgcucccccaugcccccacaucccaguggggcauaacuaggggucacgggagagc

SEQ ID NO: 48023 - RNA, 64 nt, Human
caggccaggcuaaauaugugccuuccucagggcuguggggcaggcacuagggggccuuucccuu

SEQ ID NO: 48024 - RNA, 64 nt, Human
ggcacuggaugccugaaguaaguaaguuuucucaguggggcagucucauaaaaucaccaggaca

SEQ ID NO: 48025 - RNA, 64 nt, Human
cuacaaaaaauuucugaaaaauuaccugggcauuguggggcacaccuguugucccagcuacucu

SEQ ID NO: 48026 - RNA, 64 nt, Human
uccaucauauuuuucaggacagauaguuuuuacuguggggcaaauagguuaaaauuacacuaug

SEQ ID NO: 48027 - RNA, 64 nt, Human
uuuaaguaauuauaucuucucuucuugcugguggguggggcaguuugguuuaguguuauacuuu

SEQ ID NO: 48028 - RNA, 64 nt, Human
auccugauagcuucauguuuaagagcauugacagguggggcaccucugaggggaguucauuguu

SEQ ID NO: 48029 - RNA, 64 nt, Human
agauaguggaugaagaaagaaggacgaggaagccguggggcagccucuucacauggggacaggg

SEQ ID NO: 48030 - RNA, 64 nt, Human
cagaauguaagugggcccacccggugggacccccguggggcagggagcugggcccgacauggcu

SEQ ID NO: 48031 - RNA, 64 nt, Human
aacggucccacggugcggaucucccccuucccuuguggggcacagcuggccugggccuccaauc

SEQ ID NO: 48032 - RNA, 64 nt, Human
gccgggcccgagugucugccccucggcccucaggguggggcacuuagcacccagaagggaccaa

SEQ ID NO: 48033 - RNA, 64 nt, Human
aauacuggguagaaucaaaugggaaagggguuggguggggcaauacccaugaguugauagugau

SEQ ID NO: 48034 - RNA, 64 nt, Human
gaaauguaaaagcacaugagaaugcuagcaggcuguggggcagcugagcagcuuuucuccccuc

SEQ ID NO: 48035 - RNA, 64 nt, Human
cagauuccuguuguguaauaacagaacucguggcguggggcagcagcugccucugagcccucgc

SEQ ID NO: 48036 - RNA, 64 nt, Human
uugggugcuuguuuguugcagugguugaaaguguguggggcacagaggacgugcaccucccugc

SEQ ID NO: 48037 - RNA, 64 nt, Human
uccuagugugaucagcauugggaguuggguuucaguggggcaugucuauacuuagagaaaaaaa

SEQ ID NO: 48038 - RNA, 64 nt, Human
cuguauuuggggagggaaaaccuuuuuaagcaugguggggcacucagauaggagugaauacacc

SEQ ID NO: 48039 - RNA, 64 nt, Human
uaauauaaauauauguuuuaauaccacaaacacuguggggcacuugauauuuauuaguggugua

SEQ ID NO: 48040 - RNA, 64 nt, Human
gccucagcauggcucaugcacacagcauucucccguggggcaggguucccucaugcaacaggcc

SEQ ID NO: 48041 - RNA, 64 nt, Human
uucagaaacgcccaagcccagccccuaggaggggguggggcaucccuggucaacccucaaacau

SEQ ID NO: 48042 - RNA, 64 nt, Human
ugaaggcagcagcuuggcuaauacugagcagguaguggggcaaauuccugcccucucucucugg

SEQ ID NO: 48043 - RNA, 64 nt, Human
ccccugguggccugggggccagacccgugggcagguggggcaugggcccuggccugcggggacc

SEQ ID NO: 48044 - RNA, 64 nt, Human
cucuggccuaagguaggggaggccuucucagauuguggggcacauuguguagccugacuucugc

SEQ ID NO: 48045 - RNA, 64 nt, Human
gcgugugccgggcugggcugggcggccggcggucguggggcaggguugggggucugugcucagc

SEQ ID NO: 48046 - RNA, 64 nt, Human
augagcaaguuuuccagaucaccacccaaguuguguggggcagguugagacuagaaaaugccuc

SEQ ID NO: 48047 - RNA, 64 nt, Human
aguaucuauaugagauucuucuauauuguacagaguggggcaaaacacgcccccaucugcugcc

SEQ ID NO: 48048 - RNA, 59 nt, Human
ugaccaagaaagauuccugaggcuggcaaguggggcaacguguggaggaagccccucau

SEQ ID NO: 48049 - RNA, 64 nt, Human
caaaaaaaaaaaaaaaaaaaauuagccaaguacaguggggcacaccuauagucgcagcuacuug

SEQ ID NO: 48050 - RNA, 64 nt, Human
ccccgagucuccgggacugcccucucgacugucaguggggcagccucuccgacucugcacccgc

SEQ ID NO: 48051 - RNA, 64 nt, Human
caugugaaaaugaucacugauaaauaucuucaugguggggcagguuauuggaugcagagaagau

SEQ ID NO: 48052 - RNA, 64 nt, Human
gcauggccacgccagggagucugucaccugggagguggggcagggaugguguuucggguggcgg

SEQ ID NO: 48053 - RNA, 64 nt, Human
auugugggagaagagaggagaggagggcucagcgguggggcagccuguccggggcgcugaccca

SEQ ID NO: 48054 - RNA, 64 nt, Human
ccagccugguggcuuugccagaagggagccagaaguggggcagacauggagccccucccuuggu

SEQ ID NO: 48055 - RNA, 64 nt, Human
gcuccguucacucucugccuucugccccacuacuguggggcaguggggccagagcccaccuccc

SEQ ID NO: 48056 - RNA, 64 nt, Human
uccguauuccccugggugugcacacagggcggguguggggcauuuaggccaugcugugcucuac

SEQ ID NO: 48057 - RNA, 64 nt, Human
uuaaaaucaagauagagcauuccuucuuguaucaguggggcaguguuaccauaaacacggugua

SEQ ID NO: 48058 - RNA, 64 nt, Human
gcccgucaccaagcccucucccgacccaggcuuuguggggcaggcaccugguaccaaggguaac

SEQ ID NO: 48059 - RNA, 64 nt, Human
aaggagagaauagaauggugguuaucaagggcugguggggcaguggaggauugaggagauauug

SEQ ID NO: 48060 - RNA, 64 nt, Human
ggagggagggcugccugaugcaggccggcucccaguggggcaggccucgcugcagaaugcccag

SEQ ID NO: 48061 - RNA, 64 nt, Human
gcuccaucggggcaggggguaugcagagcuugugguggggcaggaacgguggaggcagagguga

SEQ ID NO: 48062 - RNA, 64 nt, Human
aacaggcauugcacuccgguuggggguccccaggguggggcagggaucccccagaucugucugg

SEQ ID NO: 48063 - RNA, 64 nt, Human
ucaaaucguccuuuaagucuuccuuccaagugcuguggggcauaacgaugaggcgcuggccuug

SEQ ID NO: 48064 - RNA, 64 nt, Human
gucaaggcaggccgggcuccagggcuccccuugcguggggcauguaggugggggaggcgucugc

SEQ ID NO: 48065 - RNA, 64 nt, Human
cuuccucuggguucucugugcugggcaggcucucguggggcaggagaugggaggggagagacca

SEQ ID NO: 48066 - RNA, 64 nt, Human
uguuucucugucaccuccacuugcuccccgacagguggggcacagaccucuguuccugagcaga

SEQ ID NO: 48067 - RNA, 64 nt, Human
ucucuacuaaaaauacaaaaauuagcugggcaugguggggcaugccuguagucccagcuacuca

SEQ ID NO: 48068 - RNA, 64 nt, Human
uccccugccucuggguggcacugcuuuuuauaggguggggcaaaauuagcaaaaaacaaaaacc

SEQ ID NO: 48069 - RNA, 64 nt, Human
caauauuuguguuuuuauuauuuaugccacgucaguggggcaagaaaucuggagugagugaaga

SEQ ID NO: 48070 - RNA, 64 nt, Human
ucagucuugucuccagauggucguaggggagcguguggggcauaaagugcugugaacuuuucca

SEQ ID NO: 48071 - RNA, 64 nt, Human
ugugcagcacauuccagaagguuccagggagguuguggggcagcuagaggacaaaaucaugaaa

SEQ ID NO: 48072 - RNA, 64 nt, Human
cccuggagugaaggacuccucagcauggggggcaguggggcacacguuagggcugcccccauuc

SEQ ID NO: 48073 - RNA, 64 nt, Human
cgguagaacuucagggugaaggacagaguccuggguggggcagcggcugcagggcgcaccagag

SEQ ID NO: 48074 - RNA, 64 nt, Human
ugaugggugacucagagugcaggacugccuggccguggggcagagggguuugcccuucucggag

SEQ ID NO: 48075 - RNA, 64 nt, Human
gaauaugcuacuugccuccucccugcauuuccucguggggcacuauuugcgacauaggccuaca

SEQ ID NO: 48076 - RNA, 64 nt, Human
aucuaucaaaggcagaucaguaagcaaggucuuuguggggcaguugucgaccucaccaagacau

SEQ ID NO: 48077 - RNA, 64 nt, Human
uuuccacuccuuuaaaguugggaaaacuugauucguggggcaggagauuguuucuucauucuuc

SEQ ID NO: 48078 - RNA, 64 nt, Human
ugugagcagagagguccauccuacaggcacugguguggggcacaguccaugcagaggcaaagga

SEQ ID NO: 48079 - RNA, 64 nt, Human
uuauuuuaaaggcaggguuauuuccccccagggaguggggcaagcggggaaguugggaugagug

SEQ ID NO: 48080 - RNA, 64 nt, Human
gcagacggcuggccuggcucaccuucccacgccaguggggcaggggucugcuucaggaaaugga

SEQ ID NO: 48081 - RNA, 64 nt, Human
uauauauauauauauauauauauauauaguggggguggggcaagggaucagaaauucaaauaau

SEQ ID NO: 48082 - RNA, 64 nt, Human
agaccucagccgccucggggaugagaggggacucguggggcaagcaagcugcccugugcucuga

SEQ ID NO: 48083 - RNA, 64 nt, Human
uguuuccugcagggcuggcccuggcucgggcaggguggggcaucaccaccucacuggccuugcu

SEQ ID NO: 48084 - RNA, 64 nt, Human
agagagaggggcucaggaacugggagccucguggguggggcagaugcuccgcggccuggagugg

SEQ ID NO: 48085 - RNA, 64 nt, Human
uggcagugcuggagaugaccccgagccccuccccguggggcacccaggagggcccugccggaau

SEQ ID NO: 48086 - RNA, 64 nt, Human
uugccccauucacccgcuuccuugcacucugggaguggggcaggguaaggugggccuuacagac

SEQ ID NO: 48087 - RNA, 64 nt, Human
cagagccucagagaaagggggacgggguggggggguggggcagcggaaucuguccuggaugggg

SEQ ID NO: 48088 - RNA, 64 nt, Human
agccggagaccuuucuccuagugacugguagucaguggggcauuuuaggaugucagggccccag

SEQ ID NO: 48089 - RNA, 64 nt, Human
ugucccuccacuggauccccuucacacgugacccguggggcagccaguccucccagggacuaca

SEQ ID NO: 48090 - RNA, 64 nt, Human
guuaggacuccuccugggcuggaggauuuaccugguggggcacuuccagacuguuucuagcaau

SEQ ID NO: 48091 - RNA, 64 nt, Human
ugggaggcccuggagccugauagaaaucagugguguggggcacuguagagacuagccagcuccc

SEQ ID NO: 48092 - RNA, 64 nt, Human
ccaagcuaggucuggcccguuggggaucucagcaguggggcaggagggugccugauuucgggga

SEQ ID NO: 48093 - RNA, 64 nt, Human
cucagccugggagcuacugccagaggcuggcguaguggggcagcugcugaccaaaccccacaga

SEQ ID NO: 48094 - RNA, 64 nt, Human
cccuaugguaucauaucaugaauggacuuuacuaguggggcaaugacuuuccuagacaauaacc

SEQ ID NO: 48095 - RNA, 64 nt, Human
ucccaacucccaugaccucuggcuucagugguggguggggcagggcagaugaaagggcuucagu

SEQ ID NO: 48096 - RNA, 64 nt, Human
gaggaccuguauuuaagcaaauacuuagcaaaaaguggggcagagccucccaaggagaacaaau

SEQ ID NO: 48097 - RNA, 62 nt, Human
aagugcaugaaggacagugauguggggaggccguggggcagcucuuuucauggcuuguacac

SEQ ID NO: 48098 - RNA, 64 nt, Human
aaccucucacuauaccaguauaauugaguuuucaguggggcagucauuauccagguaauccaag

SEQ ID NO: 48099 - RNA, 64 nt, Human
uuguggucugcgaguucugagccaacugggguggguggggcagugcuuggcccaggaguuuggc

SEQ ID NO: 48100 - RNA, 64 nt, Human
aagcguggagaaauguaugcgccagggugcuuccguggggcaugagaauuucccgggccaucca

SEQ ID NO: 48101 - RNA, 64 nt, Human
acugucuuggccuugagaagagagcccgcucuccguggggcaccccauggaggacacaguacca

SEQ ID NO: 48102 - RNA, 64 nt, Human
ucccagcaaaaggcuccagcuggagggauggguuguggggcaaccugguuccugcuaacugcca

SEQ ID NO: 48103 - RNA, 64 nt, Human
cugcccugggcacccgguuccaggcagcacagacguggggcauccccagaaagacuccauccca

SEQ ID NO: 48104 - RNA, 64 nt, Human
uauagcuggggacuuggcuuccgcagggcaggggguggggcagggcucaaggcugcucuggugu

SEQ ID NO: 48105 - RNA, 64 nt, Human
ggacugggcucucuggccugcuggggcucaggcuguggggcaggcugggcagggggcugagcug

SEQ ID NO: 48106 - RNA, 64 nt, Human
ucccucccuuccuucaagauaacuggccccaagaguggggcaugggaagggcugguccaggggu

SEQ ID NO: 48107 - RNA, 64 nt, Human
ggaagugggggccgcuggcccaggguaggggaggguggggcaauggggagaggcaaaugcaguu

SEQ ID NO: 48108 - RNA, 64 nt, Human
cuuuuauuuauguuuucccuuuggcugugacuggguggggcagcaugcagcuucugauuuuaaa

SEQ ID NO: 48109 - RNA, 64 nt, Human
guggcuggagggccgguggggguaugggcgugugguggggcagaaagccuagacccaggugguc

SEQ ID NO: 48110 - RNA, 64 nt, Human
caccuggaauucccuggucagggagauggagucaguggggcauugcagcuuggaaucuauuuua

SEQ ID NO: 48111 - RNA, 64 nt, Human
ggcagcuuccugugugcuccaagggaugagccucguggggcagagggcccggggccgccgccug

SEQ ID NO: 48112 - RNA, 64 nt, Human
gccucaggcaggucucagccuggggguggcagggguggggcagagagaauacugacagcagagg

SEQ ID NO: 48113 - RNA, 64 nt, Human
cugcucuccugucccuugagcccuuccucuacagguggggcagagagggugguggacaccaggc

SEQ ID NO: 48114 - RNA, 64 nt, Human
ugggucaggcacuagcauggaggagggucacagaguggggcacgugaggacccauggaaccguc

SEQ ID NO: 48115 - RNA, 64 nt, Human
ggagagcaccuuaauauuauugggguugguugggguggggcaggaucucagccauaaagugcca

SEQ ID NO: 48116 - RNA, 64 nt, Human
agcugaagaguuaucaguccuuugacaaggacagguggggcagggagcaagacagguaggcugg

SEQ ID NO: 48117 - RNA, 64 nt, Human
uaggacuggaacuugguaacugcaagggccucagguggggcaggugcagagggcaagcauucca

SEQ ID NO: 48118 - RNA, 64 nt, Human
cagggucuuguuuugucacccaggcuggagugcaguggggcaaucuuggcucccugcaaccucu

SEQ ID NO: 48119 - RNA, 64 nt, Human
gaugcaaguugucccccaaggccaucacaaagcaguggggcaugagcuguguuucaggggccac

SEQ ID NO: 48120 - RNA, 64 nt, Human
acaagguuucagaguaguguaguccaaguagaggguggggcacccuuuucucgccgcaagaagc

SEQ ID NO: 48121 - RNA, 57 nt, Human
agcuuaacgaugcccauuaacugguuuguggggcacagaugccuggguugcugcugu

SEQ ID NO: 48122 - RNA, 64 nt, Human
accauuaggugaggcggucccgaguugagguagaguggggcagaggaagauggcagugaauauc

SEQ ID NO: 48123 - RNA, 64 nt, Human
agcgccugcccacuuggccucagucuccccaccuguggggcaggacggugacugcagaccuguc

SEQ ID NO: 48124 - RNA, 64 nt, Human
gugggcacugcugcucugcuagggagaagccuguguggggcacaccucuucaagggagcgugaa

SEQ ID NO: 48125 - RNA, 64 nt, Human
aaacuacuguuaggaacagcaguguucucacaguguggggcagccguccuucuaaugaagacaa

SEQ ID NO: 48126 - RNA, 64 nt, Human
auuucugaguggccaucccaaggucuagguggagguggggcaugguauuugagacauuccaaaa

SEQ ID NO: 48127 - RNA, 64 nt, Human
uagucaguuagcaucauuaguacaucuuuggaggguggggcaggaguauaugagcauccucucu

SEQ ID NO: 48128 - RNA, 54 nt, Human
accugaaaauguuaauuugaagauguggggcagggacagugacauuucuguagu

SEQ ID NO: 48129 - RNA, 64 nt, Human
gggcccgaguggcccaguggguggguggggugggguggggcaagugccccaacuccccucacca

SEQ ID NO: 48130 - RNA, 64 nt, Human
agaugggggcugaaucauucaacugccuccaucuguggggcagcugcugccuuacagcccuucc

SEQ ID NO: 48131 - RNA, 64 nt, Human
gccaaggcugggaaaugaggaggccaugcacaggguggggcagcuuucuuuggggcuucaguga

SEQ ID NO: 48132 - RNA, 64 nt, Human
ggaggaauggcuuaagaugagguaagaucuggugguggggcaucuuuccucaauuccauacuga

SEQ ID NO: 48133 - RNA, 64 nt, Human
uuccccggaguaccuauuguagauaacacuauggguggggcacuccuuucuugcacuauuccac

SEQ ID NO: 48134 - RNA, 64 nt, Human
cccacuuacuaacugccaguucuccagcacugagguggggcagauaacggggcauauuuaaggg

SEQ ID NO: 48135 - RNA, 64 nt, Human
ccccaagagaaccagauuggcagggagaagcauuguggggcaauuguuccuccuugacaaugua

SEQ ID NO: 48136 - RNA, 64 nt, Human
uaccacucugcucacauguuccccccuuggcaauguggggcaucuuguuuaggggguucuaguu

SEQ ID NO: 48137 - RNA, 64 nt, Human
uacucuagauuuuguuuugcuuuuucugacuccaguggggcaagauuuuccuuuuuuauacaca

SEQ ID NO: 48138 - RNA, 64 nt, Human
agcagaaucagcugaugaaggggugggcagcaguguggggcaggcaccccacuggcugcagcua

SEQ ID NO: 48139 - RNA, 64 nt, Human
cacagugccuuuuccucuccugcucugagccaggguggggcauucccucuagauucagguuugg

SEQ ID NO: 48140 - RNA, 64 nt, Human
ggagccucgcaacccgugccaaguccagguccugguggggcagcuccucugucucgagcgcccu

SEQ ID NO: 48141 - RNA, 64 nt, Human
gccggcccacagggccuccguccccagguccccaguggggcagcccuccccacagacgagcccc

SEQ ID NO: 48142 - RNA, 64 nt, Human
uuccucaucaccuugauggcuuuauucucaccuuguggggcauguuuguauuuauugcuucaug

SEQ ID NO: 48143 - RNA, 64 nt, Human
cacaauuuuguccuaauauauacauagaaacuuuguggggcauguuaaguuacaguuugcacaa

SEQ ID NO: 48144 - RNA, 64 nt, Human
cucaugugaccucgcaguugagaagcccauuaucguggggcauccuuuugccuacagccccugg

SEQ ID NO: 48145 - RNA, 64 nt, Human
ccaccccccaccaacccccaucuuuuaauaugcuguggggcauagaacuccggaaugaccagca

SEQ ID NO: 48146 - RNA, 64 nt, Human
aggcuugcaaagugaauccuuuugccaaggacagguggggcaacauuccccuggaugaugcugu

SEQ ID NO: 48147 - RNA, 64 nt, Human
ggauaugugugacuguggguggggacgugugcuuguggggcacagguggcggccccugcuggag

SEQ ID NO: 48148 - RNA, 64 nt, Human
agcuggcgcuaccaaccuuuuuccuauaucccgaguggggcacagacgguggaucucugcccag

SEQ ID NO: 48149 - RNA, 64 nt, Human
cacaaggccugauggggggccccugcuucucccgguggggcagaggacccggugccugccuggc

SEQ ID NO: 48150 - RNA, 64 nt, Human
uguaaacugggcacaucacuuucucuucuugcguguggggcagguguggagaagggcuuuaagg

SEQ ID NO: 48151 - RNA, 64 nt, Human
uucuccucucagcacacuuugggcugggauggcaguggggcauaauggagcccugggcgaucgc

SEQ ID NO: 48152 - RNA, 64 nt, Human
guggagggagcaagaggagagggaugucggggggguggggcacgggguaggggaaaugggguga

SEQ ID NO: 48153 - RNA, 64 nt, Human
gaccugcuuuggggaguaggggaaggcccagggaguggggcagggggcugcuuauucacucugg

SEQ ID NO: 48154 - RNA, 64 nt, Human
cugcagagcauucucuacacagcguaaaggagaaguggggcagcugcaggacauguagagaaac

SEQ ID NO: 48155 - RNA, 64 nt, Human
guauguguguuacacccucacauuagugugcuguguggggcaguucaacacaaauguaacaaug

SEQ ID NO: 48156 - RNA, 64 nt, Human
aacucuucgaaaaccugcuggugcugaguccuguguggggcaccccacacgacaccccucuucc

SEQ ID NO: 48157 - RNA, 64 nt, Human
cugcaaaauggucacucugccaucuuggugguugguggggcaggucauuuggaaauaaagaaug

SEQ ID NO: 48158 - RNA, 64 nt, Human
ggucugugcugagcuggagggccucuagggaaccguggggcaggguggccagcugcuggcuccc

SEQ ID NO: 48159 - RNA, 64 nt, Human
aacuuugagacacacuaugagagcguugcuaccuguggggcaagagcauguacaaacaugcuca

SEQ ID NO: 48160 - RNA, 64 nt, Human
guuaaucuuuugucucuugcggugcucaugauguguggggcacacggaaggcauugcuguaguc

SEQ ID NO: 48161 - RNA, 64 nt, Human
uuugaaggcgcugacacuggcagagagguaaaggguggggcauugagaauggaggcucccaggg

SEQ ID NO: 48162 - RNA, 64 nt, Human
uaaaaauaacucaccgccaaaccuguggagcaguguggggcauccugccagaggugcacaggcu

SEQ ID NO: 48163 - RNA, 64 nt, Human
ugcuggcuccagaguuugagauuugaggcaagagguggggcaggcagauugccucacuuaacuu

SEQ ID NO: 48164 - RNA, 64 nt, Human
cggugacuuuuuuauuggugggaaggggauugggguggggcaggcuggcuuaauguaauaugag

SEQ ID NO: 48165 - RNA, 64 nt, Human
agaggaauauauagcaacucagggccugggaauuguggggcaauccguucuuagggacuggaua

SEQ ID NO: 48166 - RNA, 64 nt, Human
gacaucuucugguagccgugcaggagagggcuggguggggcagaggccaggaggggaccuggug

SEQ ID NO: 48167 - RNA, 64 nt, Human
ggaugcccagcggaaggaggcaauuaaggcaaagguggggcaguacgugucccgggcugaggag

SEQ ID NO: 48168 - RNA, 64 nt, Human
ccugugugggcgccgagaccugggugucugggaaguggggcacacggggccuccgaacuaugaa

SEQ ID NO: 48169 - RNA, 64 nt, Human
cauugaauucaaaauuucuucugcaaagaaaguuguggggcauaagacaccgggaaugagggag

SEQ ID NO: 48170 - RNA, 64 nt, Human
ugagaggaacuggaaggggggugaggguggggagguggggcagggcaugguccuuggaucaaca

SEQ ID NO: 48171 - RNA, 64 nt, Human
cugcccugcagcugggccuggggacaggucggcuguggggcagcucaguacccucccugaggcu

SEQ ID NO: 48172 - RNA, 64 nt, Human
caaggcagaccuacaggcgaggccgcagcagaggguggggcagagcagccucggggucuggggg

SEQ ID NO: 48173 - RNA, 64 nt, Human
ucccgccugcaugucaccuugaugggggcugugaguggggcagugugauacccagugacuagac

SEQ ID NO: 48174 - RNA, 64 nt, Human
cggggacagcuccuucuguccuacucugugucagguggggcagcuugaggguugggcugguguc

SEQ ID NO: 48175 - RNA, 64 nt, Human
cugccuggaggcaaaggccuggacagcuugacuuguggggcaggauucucugcagcccauuccc

SEQ ID NO: 48176 - RNA, 64 nt, Human
gaggggcuggcccuuagaggaacuggggugggagguggggcaggccucacccuugggcuuugcu

SEQ ID NO: 48177 - RNA, 64 nt, Human
aaaaggcugcucucuuccaccuggcccagacccuguggggcagcggagcuucccuguggcauga

SEQ ID NO: 48178 - RNA, 64 nt, Human
agugccaugggugagccgagcagcugugagguggguggggcagggcuguagcccacgccgggug

SEQ ID NO: 48179 - RNA, 64 nt, Human
guggcugguccucacuauuccccagucucccgcuguggggcaggaacaggaagugacgggaacc

SEQ ID NO: 48180 - RNA, 64 nt, Human
gacccacgcggccucuccuccuccuugccgcuguguggggcaguccccuguccgccccaaaacc

SEQ ID NO: 48181 - RNA, 64 nt, Human
acuggcguggaccaucuggguguccucagccccuguggggcagccaaguuccugauagcacuug

SEQ ID NO: 48182 - RNA, 64 nt, Human
ccacuuuagucuccccacuauggugaggacgaggguggggcauugagaguguugauuugggaaa

SEQ ID NO: 48183 - RNA, 64 nt, Human
ucgugagagguacugggguccacggauauguguuguggggcagacagucacugugggaugucuu

SEQ ID NO: 48184 - RNA, 64 nt, Human
gugacuugauacuuggggcagcccgaugcuguguguggggcaggggaggcauccuuacuggaga

SEQ ID NO: 48185 - RNA, 64 nt, Human
gguggcuugaccccgggcccaugggcagcuugcuguggggcagugcagggaguccugcggccgc

SEQ ID NO: 48186 - RNA, 64 nt, Human
gcauugggggauuggggcaaggauggaaggagcaguggggcagcugccagagcucaggcgagcc

SEQ ID NO: 48187 - RNA, 64 nt, Human
ccaagggcagcagagcccugccgagugagaggcuguggggcagcggcucuguccugugccuuac

SEQ ID NO: 48188 - RNA, 64 nt, Human
ggauacucacgcacagcuucuucacuggugggggguggggcacacauuauuucucacuggucau

SEQ ID NO: 48189 - RNA, 64 nt, Human
uuaacccacagaauccaaggagcauggcuggcccguggggcagguggagggagcagucuucguu

SEQ ID NO: 48190 - RNA, 64 nt, Human
gcggcuuccuggcccuggggccgggggcugggguguggggcagucuggguccucucaucauccc

SEQ ID NO: 48191 - RNA, 64 nt, Human
ugaugccaggaaugccgccuaguuuauguccccgguggggcacacagcggggggcgccagguuu

SEQ ID NO: 48192 - RNA, 64 nt, Human
uucucccucugccugaccacuggguguggacgguguggggcagcccugaaaggacaggcuccug

SEQ ID NO: 48193 - RNA, 64 nt, Human
accgacacacgccccuucucaaagccagaggugaguggggcaggugcccggggcugggugagug

SEQ ID NO: 48194 - RNA, 64 nt, Human
ucuuccucacaugagguuacuguuucuuuccucuguggggcauuggauccucccacaguugccc

SEQ ID NO: 48195 - RNA, 64 nt, Human
ggggucuggccuaguggggaggggccuggccuggguggggcagggccuggccugguccaggcuu

SEQ ID NO: 48196 - RNA, 64 nt, Human
cucccauaagggcugguuccuagaggcagggguuguggggcacucccagccacggcacuguuac

SEQ ID NO: 48197 - RNA, 64 nt, Human
cuacuacauccaugacugccccaacccccuugggguggggcagaaggugaagcaucccaacuga

SEQ ID NO: 48198 - RNA, 64 nt, Human
aaaugagcacaagauguggcccugauucuaguugguggggcaagggccugguucuccugggcug

SEQ ID NO: 48199 - RNA, 64 nt, Human
uggaacucaggacucgauuuuaaggacccaggagguggggcagaagagaggacugugugccuuu

SEQ ID NO: 48200 - RNA, 64 nt, Human
gggugggggggaguucuguuccuugugccccgagguggggcagccccuucucauuuuauacaau

SEQ ID NO: 48201 - RNA, 64 nt, Human
aucuacuugaaguuacucggacaaagaccccaaaguggggcaacaacuccagagaggcuguggg

SEQ ID NO: 48202 - RNA, 64 nt, Human
gugugugugggggucaucacugccuuggggaggaguggggcagggcagagaauccccccaauuc

SEQ ID NO: 48203 - RNA, 64 nt, Human
auccuacaggaucccacaugggacggcuaccuagguggggcacggccccuacccgagaacagga

SEQ ID NO: 48204 - RNA, 64 nt, Human
ccuguggcugccugggcaccucucccaggaagugguggggcaccggucucccccacccgacugc

SEQ ID NO: 48205 - RNA, 64 nt, Human
acccucagcaaaggggcagguggggacacuccaaguggggcagcucuccguacaugcgccccac

SEQ ID NO: 48206 - RNA, 64 nt, Human
cucacuuuguucggaguggucuuugguuugggcgguggggcagaccuugggaaggggcuuagga

SEQ ID NO: 48207 - RNA, 64 nt, Human
caacacugccaaaaaucuguguaugugccauuggguggggcagccccaagccuccuggggaggc

SEQ ID NO: 48208 - RNA, 64 nt, Human
cacucagcccgcggcugugggcaccacagcucuuguggggcagcccaccuuagaaccugacuag

SEQ ID NO: 48209 - RNA, 64 nt, Human
ccugggcugcgucccacauccacccuccugccccguggggcaauuuaaccuuuuucaugaaagu

SEQ ID NO: 48210 - RNA, 64 nt, Human
gagagaggagaccaaaaugaggugguggcacaggguggggcaaggagauccucucuaaggccuc

SEQ ID NO: 48211 - RNA, 64 nt, Human
ggcgcccagaagccucgguuuggcccaccugugaguggggcagggagggguuccgguugugcag

SEQ ID NO: 48212 - RNA, 64 nt, Human
ucggaaccagaggguggagguugguguggaagagguggggcagauuaaagccaguggagccacu

SEQ ID NO: 48213 - RNA, 64 nt, Human
cuugagccggagcacaugggggaaggggugggcaguggggcaggaggggcuggccugccugagu

SEQ ID NO: 48214 - RNA, 64 nt, Human
caggaagagcaccuguugcugcaagcucagugaaguggggcacucccagaccugccaugcaguu

SEQ ID NO: 48215 - RNA, 64 nt, Human
guucuugguguuaagcuaucuuuuguaggaaauaguggggcacacuacucagagacauuauuua

SEQ ID NO: 48216 - RNA, 64 nt, Human
aacuuuacagaaugucaucaagcuuuggggcucuguggggcacaugauuuauccauaaaggaga

SEQ ID NO: 48217 - RNA, 64 nt, Human
gccugauuauuuuagcuaaauucagggagauugcguggggcaggaaagcaugcauugaaaaauu

SEQ ID NO: 48218 - RNA, 64 nt, Human
aagcggugucucuccugccccuuggacacgcucaguggggcagaggcaguaccugggcaagcug

SEQ ID NO: 48219 - RNA, 64 nt, Human
aucaguaguuacuaaucgcugaacucucaauauuguggggcauuuuccccccaguugauuaauu

SEQ ID NO: 48220 - RNA, 64 nt, Human
ugacaugcgggcugggcagcuguuagaguccaacguggggcagcacagagagggggccaccucc

SEQ ID NO: 48221 - RNA, 64 nt, Human
uucacaaaagaaaaauacauuuuuucccccagggguggggcaaggacaguggagagagugcuag

SEQ ID NO: 48222 - RNA, 64 nt, Human
cggcacucaugacggccugccugcaaaccugcugguggggcagacccgaaaauccagcgugcac

SEQ ID NO: 48223 - RNA, 64 nt, Human
ugcccgcacgcuggggucugucuugucuggagcaguggggcacaccccggaggaggcggggguc

SEQ ID NO: 48224 - RNA, 64 nt, Human
cggccgggcagcggagaccgcagaggcgggcaggguggggcaggcgaguggugucgcgggggug

SEQ ID NO: 48225 - RNA, 64 nt, Human
uucuccccugcccccaggacugggccacuucuggguggggcagugggucccagauuggcucaca

SEQ ID NO: 48226 - RNA, 64 nt, Human
uuuuagcuguaaugucuuuacucuuuauuuagggguggggcauucauuguuugggucuuuugcu

SEQ ID NO: 48227 - RNA, 64 nt, Human
aaccgcacgcacgucaggcaccggcuggggaucuguggggcagcggcgggcgcaggcucgaccc

SEQ ID NO: 48228 - RNA, 64 nt, Human
cuggagaugaucgucugagccccccgggcacuggguggggcagggcacgaguuauuuaaaacag

SEQ ID NO: 48229 - RNA, 64 nt, Human
cccugggggcacucugugaagugggggacagggaguggggcaggcagugguugguggguggugu

SEQ ID NO: 48230 - RNA, 64 nt, Human
gcacucgacagcaaauuucuugauaucaaggaaaguggggcacugagaaaggcagggacuugcc

SEQ ID NO: 48231 - RNA, 64 nt, Human
ucgaguaccuacucugucaggcacugucauaggcguggggcaaagcaggaaccaagagacgagg

SEQ ID NO: 48232 - RNA, 64 nt, Human
gaaaugaguuggccagauuguggggugcagcuggguggggcagcacaccucuggggggauaaug

SEQ ID NO: 48233 - RNA, 64 nt, Human
ggugggagggcguuggcuuguccagaauggggacguggggcagccaccccugcccagcgagagc

SEQ ID NO: 48234 - RNA, 64 nt, Human
gccagaagacugauuggagggcccuaucuugugaguggggcaucuguuggacuuuccaccuggu

SEQ ID NO: 48235 - RNA, 64 nt, Human
gacuguuagaggcaggcuuuauaguaacaagacgguggggcaaacucugauuuccgugggggaa

SEQ ID NO: 48236 - RNA, 64 nt, Human
ccugauguucaggguuggggugggacgggcagcgguggggcacacccauuccacaugcaaaggg

SEQ ID NO: 48237 - RNA, 64 nt, Human
ccaggugcucagggccccgcgucucgggggcuccguggggcagaccccugcuaauauaugcaau

SEQ ID NO: 48238 - RNA, 64 nt, Human
uguggacugccccuuccaaagaccccugggggggguggggcauuccgcccaccccuuuccccca

SEQ ID NO: 48239 - RNA, 64 nt, Human
agcaaauaggagugcuccccagaaccagaggaggguggggcacagaccauagacggaccccucg

SEQ ID NO: 48240 - RNA, 64 nt, Human
gaguggaauaaaguuaucaaggacaaugccaaggguggggcacccccaaauuugacucugggag

SEQ ID NO: 48241 - RNA, 64 nt, Human
uccccaguguggcauuuccugccaggggcgggggguggggcagcuguggggagacgggggucuu

SEQ ID NO: 48242 - RNA, 64 nt, Human
cagaaucuugcucugucaccuaggcuggagugcaguggggcaaucucggcucacugcaaccucu

SEQ ID NO: 48243 - RNA, 64 nt, Human
gaagauuagaaugcaaauggacauucucugggagguggggcauaccauagcccaaggugacauu

SEQ ID NO: 48244 - RNA, 64 nt, Human
ucauucuguuaauagucccggcaaccagauuucaguggggcaugacgugaauguguauauggug

SEQ ID NO: 48245 - RNA, 64 nt, Human
cacagcccaccagagcacuacagccuuuuauugaguggggcaagugcugggcuguggucgugcc

SEQ ID NO: 48246 - RNA, 64 nt, Human
uagggcuucugugguuguggaugggaggcuccugguggggcagaaaggcugcaacgcugauucc

SEQ ID NO: 48247 - RNA, 64 nt, Human
ugguggccugcgcagcgagcaggcgugugcguguguggggcaggcaggauguggugcaggcagg

SEQ ID NO: 48248 - RNA, 64 nt, Human
gcugaaguggugggugcauuggccuaggcugagcguggggcagggaauuaugggggcugugccc

SEQ ID NO: 48249 - RNA, 64 nt, Human
gggggcugucagccacaccuguuccugaugggcuguggggcaccggcugccuuuccccagggaa

SEQ ID NO: 48250 - RNA, 64 nt, Human
gagaauggcuugaacccaggagacagagguugugguggggcaagaucgcaccauugcacccgag

SEQ ID NO: 48251 - RNA, 64 nt, Human
ccuucugauugagcgguugccauggccggucuccguggggcaggguugggccgcauguggaagg

SEQ ID NO: 48252 - RNA, 64 nt, Human
gcuguggaccgucaacccagcccugcuucucaguguggggcaggugucucaggacgaaggcgcc

SEQ ID NO: 48253 - RNA, 64 nt, Human
cugggggggugagggagcaucaggagguccaggcguggggcagguccccaccuuccugaaccuu

SEQ ID NO: 48254 - RNA, 64 nt, Human
cuccuuccuccauagggacagcagcaccagcccuguggggcauggaguggaagcccagaagggc

SEQ ID NO: 48255 - RNA, 64 nt, Human
aaucuuggugcuuuguggcucaccacagccaucuguggggcaggcacacacaccucccgccagc

SEQ ID NO: 48256 - RNA, 64 nt, Human
cuauugacgggccuugguagccaccaguggguguguggggcaguggcuguggggguguaagaau

SEQ ID NO: 48257 - RNA, 64 nt, Human
cuuuacccaccaugaguuauugcugucgacggggguggggcaaggacccgcgcuccguagagcu

SEQ ID NO: 48258 - RNA, 64 nt, Human
ccaggagccagggagcuggugacacuugugugcuguggggcagcugggauccagguaagaccgg

SEQ ID NO: 48259 - RNA, 64 nt, Human
ccuggauuuuccuuguggggguacaagagcaggaguggggcaagaguuugaaaauaaagccgcu

SEQ ID NO: 48260 - RNA, 64 nt, Human
gaaagucuauuuaaauugauucccaucauaacugguggggcacaucuaacucaacugugaaaag

SEQ ID NO: 48261 - RNA, 64 nt, Human
ucacugguacugccuugugaguacugguuggacuguggggcauguggccgcugcaguuccagug

SEQ ID NO: 48262 - RNA, 64 nt, Human
agcccaagcccuccccuggugcagcuggcagcauguggggcagcugccuggagccagaaccggu

SEQ ID NO: 48263 - RNA, 64 nt, Human
ccuagugggggaaggcucacuaagagggcaccaaguggggcaaauaccccugguaacccauuua

SEQ ID NO: 48264 - RNA, 64 nt, Human
gucgcgaggaggggcgcaggaccauggacuggggguggggcaugguggggauuccagcaucugc

SEQ ID NO: 48265 - RNA, 64 nt, Human
ccacccuggaagcugccaaucuuccaagguggguguggggcacggugggggcgggcagcuccca

SEQ ID NO: 48266 - RNA, 64 nt, Human
uuggugguuuucaacuuccugcuggaaacuagagguggggcaccccccaccccccagccucgca

SEQ ID NO: 48267 - RNA, 64 nt, Human
ggguuccugcccagcacugugcuugcgggaggcgguggggcaugggaggaaggaggcacagacc

SEQ ID NO: 48268 - RNA, 64 nt, Human
gcucugcccucucuggcuuugacacccucagaagguggggcaggcucuuugucuuggggaccag

SEQ ID NO: 48269 - RNA, 64 nt, Human
uaccauuggguuaaggggcagauuggcgguggguguggggcagugugagguaguccuggauccc

SEQ ID NO: 48270 - RNA, 64 nt, Human
ccccaguuucuaauuugcuguaggcugugacgcuguggggcaagacuaggaguccuguugaaau

SEQ ID NO: 48271 - RNA, 64 nt, Human
uggcaguggcauguuaggcauguuagggcuugagguggggcauucacauucaucugacuguaaa

SEQ ID NO: 48272 - RNA, 64 nt, Human
ggccucagcccucacggcauuccugcugagcaccguggggcacccagggagcaggggcgucagg

SEQ ID NO: 48273 - RNA, 64 nt, Human
ugccuuacaaugcccacuggagaggcggggcgggguggggcaggauggccccacuggggcuccu

SEQ ID NO: 48274 - RNA, 64 nt, Human
gucccacugagguccaggguagcucggggcagggguggggcaguccaguguuggggacugucua

SEQ ID NO: 48275 - RNA, 64 nt, Human
gagagacuugcaccuuggccaagccacacaaucaguggggcagccagagcucagaccugagcca

SEQ ID NO: 48276 - RNA, 64 nt, Human
acauuccagaaugccccacaucauuggcacaggaguggggcagccccggaaggaaccagggauu

SEQ ID NO: 48277 - RNA, 64 nt, Human
gguguguuugcuauacgaacauaauggacgugaaguggggcagaaacccagaacucagcauuca

SEQ ID NO: 48278 - RNA, 64 nt, Human
caccccuuucuaccccagggcagggcagggcuggguggggcaagaucccccagcccgacuagac

SEQ ID NO: 48279 - RNA, 64 nt, Human
gagugccacaggaagucagacaaggaaggagaguguggggcaggugccguuuaaauggggggcg

SEQ ID NO: 48280 - RNA, 64 nt, Human
ggccggagggagggcuugggugccugggcuggguguggggcagggccuggcacagcugcagagu

SEQ ID NO: 48281 - RNA, 64 nt, Human
cuccacgccgccaagccagccgggcggccgacccguggggcaggccaggccagguccucccuga

SEQ ID NO: 48282 - RNA, 64 nt, Human
gaaaagcuaagggcuugauuccuagccccguucuguggggcacugggugauacucaguuucuug

SEQ ID NO: 48283 - RNA, 64 nt, Human
uuguucagguagucgcccuucugguuuguucucuguggggcaguuggugggggcugggggaaga

SEQ ID NO: 48284 - RNA, 64 nt, Human
uucgcggggggugggggaggucaacagggacugaguggggcagaggcccagaagugccagccug

SEQ ID NO: 48285 - RNA, 64 nt, Human
cuaggcaggugugaggagcccugcugaggucacuguggggcacgguugccacacggcugucauu

SEQ ID NO: 48286 - RNA, 64 nt, Human
auguccuauauuggcuaaauugaaaccuggaauuguggggcaaucuauuaauagcugccuuaaa

SEQ ID NO: 48287 - RNA, 64 nt, Human
ucuguauauguacugcuuucuguuuuguugcauuguggggcagaggccucucugcucuuguuua

SEQ ID NO: 48288 - RNA, 64 nt, Human
acggaucagaugucuauauugcugaaugcaagaaguggggcagcagcaguggagagaugggaca

SEQ ID NO: 48289 - RNA, 64 nt, Human
uuguaggacugucuucccaagccccauguucaugguggggcaaugguuauuugguuauuuuacu

SEQ ID NO: 48290 - RNA, 64 nt, Human
aaaggaguuugagcaggaguugcagcuagggccaguggggcagguugugggagggccugggcca

SEQ ID NO: 48291 - RNA, 55 nt, Human
cccagacaaacagcagaugaguugaguggggcagagggacagggcagccagacca

SEQ ID NO: 48292 - RNA, 64 nt, Human
ggcuguccccacgcugucccuuugccacaagucuguggggcaagaggcugcaauauuccguccu

SEQ ID NO: 48293 - RNA, 64 nt, Human
cuggguccccgggcugagcccuggauuggguaucguggggcaggucacccuggccacgaugccc

SEQ ID NO: 48294 - RNA, 64 nt, Human
uagaguucacagucuuaaaagucugcauuuucagguggggcaagguggcucaugccuuuaaucc

SEQ ID NO: 48295 - RNA, 64 nt, Human
acuacacacugcucauuugagaacugucagcugaguggggcaggcuugaguuuucauuucauau

SEQ ID NO: 48296 - RNA, 64 nt, Human
gguuucuacucugcucccuagucccaggguggggguggggcaccccagcugcccugacagaugg

SEQ ID NO: 48297 - RNA, 64 nt, Human
uuggugggugggacccugcuuguguuggccccacguggggcagugcuuccucucucgagccagu

SEQ ID NO: 48298 - RNA, 64 nt, Human
uaugcuagccauguaaucagauuuauuuaauuggguggggcagguguguauuuacuuuagaaaa

SEQ ID NO: 48299 - RNA, 64 nt, Human
guucaucaaauguacugagaauagacuagcauuuguggggcacucaauaaauuuaaauucaugg

SEQ ID NO: 48300 - RNA, 64 nt, Human
gugauaaauucuaaauuaugaacauuagaaaucuguggggcacauauuuuugcugauugguuaa

SEQ ID NO: 48301 - RNA, 64 nt, Human
uuugccuuaacuuguagguaccagcugguacccuguggggcaaccucuccaguuccccaggagg

SEQ ID NO: 48302 - RNA, 64 nt, Human
cugcgcgugcuggaggcccuccugccugggccuuguggggcaaauauuggguccccaggcugga

SEQ ID NO: 48303 - RNA, 64 nt, Human
gcgggacucugaguuaucuaaugucagacaucuaguggggcagcucucuuccucauguuauaac

SEQ ID NO: 48304 - RNA, 64 nt, Human
uguucucggcagaagggcagcuggaagggacacaguggggcaggcuuugggguugcucccuguu

SEQ ID NO: 48305 - RNA, 64 nt, Human
aucuacaggucaaauuaauuugaacaguucuugucaauccgaauuguugauucuguuuaaauga

SEQ ID NO: 48306 - RNA, 64 nt, Human
gggcucaccugggcauccaaagcggccacgcccacaauccgacagcccccaggagcagguccag

SEQ ID NO: 48307 - RNA, 64 nt, Human
uaagucaaggaaaccagaauuugacacacuccaacaauccgaaggggcauguugcuccugagca

SEQ ID NO: 48308 - RNA, 64 nt, Human
gcuuuuugccaucugugauaugccauaggugugacaauccgagcaguggagucauucagcggga

SEQ ID NO: 48309 - RNA, 64 nt, Human
gccugccucccucuccccuccgcccucacccagccaauccgaggcugcuucgcacuuugcccuc

SEQ ID NO: 48310 - RNA, 64 nt, Human
auauauauuaaaauugcaugggacagagacuuugcaauccgaaagaauagacugugaaaugagu

SEQ ID NO: 48311 - RNA, 64 nt, Human
gucaacuuuaauagaguuuugaaacaguacugugcaauccgauggaucuaauuaaaaaaaaggc

SEQ ID NO: 48312 - RNA, 64 nt, Human
aaugcuguauuucucuucuuacgccagucagaaccaauccgaaaagaauguguguugacucagg

SEQ ID NO: 48313 - RNA, 64 nt, Human
ggccgagacaggagcagcccacccagcagaaauacaauccgagcuacaaagcaugggaaaaaga

SEQ ID NO: 48314 - RNA, 64 nt, Human
gaaggggguagggcccgagcuccgcgcggccgcacaauccgagcccccgccccgcgccccgucc

SEQ ID NO: 48315 - RNA, 64 nt, Human
ggagacauuuccucccugccccagcacucugucccaauccgagaaguuccgaggcuuucccagg

SEQ ID NO: 48316 - RNA, 64 nt, Human
caucuucgcaguuuaagaaaccacguuuccuauccaauccgaagggaaggugcuguacaguuca

SEQ ID NO: 48317 - RNA, 64 nt, Human
uuuguuuacauuucuguaucccuggguugacugccaauccgaggccgucaugaagcucuguguu

SEQ ID NO: 48318 - RNA, 64 nt, Human
guuuguucuccggguguggccucagcccucagaacaauccgauucacguagggaaauguuaagg

SEQ ID NO: 48319 - RNA, 64 nt, Human
ucaaagucugggccacuggcagccuucucuugcucaauccgagguggaaaaagaucaccuccca

SEQ ID NO: 48320 - RNA, 64 nt, Human
cgcccggcugacccuuuuaauuuuuaagaguguucaauccgagaugaaucauuugaaguauuuu

SEQ ID NO: 48321 - RNA, 64 nt, Human
agagagggaaggacaccaagcaaaaaauguuccaggccaggauucggauucuugaauuacucga

SEQ ID NO: 48322 - RNA, 64 nt, Human
uuuuccaaaguuuuucuuagaaccaaccaaaaaacaauccgaguaggcccaagaauuugauaau

SEQ ID NO: 48323 - RNA, 64 nt, Human
caggucccuagccugcaacauuuaugucgcaugucaauccgaagagugaugcccacccaagaag

SEQ ID NO: 48324 - RNA, 64 nt, Human
cuacugucagcccuucgcuuacaaacugcaggcucaauccgaaggggacggccggcgggggcuc

SEQ ID NO: 48325 - RNA, 64 nt, Human
ucacuuucuuguugacuccaucaguacauggguacaauccgagggugugaauuucagcuugaaa

SEQ ID NO: 48326 - RNA, 64 nt, Human
aaggguuauuuuuacuuagcuuagcuaugucagccaauccgauugccuuaggugaaagaaacca

SEQ ID NO: 48327 - RNA, 64 nt, Human
cucugcugugggcaguugucauaaacucuucucacaauccgagcugcucuuuguccucugugaa

SEQ ID NO: 48328 - RNA, 64 nt, Human
gcgcuccuggaaaaagcaacuccaucagaacucgcaauccgagccagcucugggggcuccagcg

SEQ ID NO: 48329 - RNA, 64 nt, Human
ccucaacucuggccccaggcccuguucuguuauccaauccgaaacacggaacaugcugcaauuc

SEQ ID NO: 48330 - RNA, 64 nt, Human
gcaggguacacacguuagguauugugaagaacaucaauccgaacuuuucuucuguuguuugcac

SEQ ID NO: 48331 - RNA, 64 nt, Human
ccugggcugggaaaggggccuuucuuuuguuuugcagauagauccacccacugaggaacuugaa

SEQ ID NO: 48332 - RNA, 64 nt, Human
uuuucgaaguuaaauuuacagcuaaugauccaagcagauagaaagggaucaauguaugguggga

SEQ ID NO: 48333 - RNA, 64 nt, Human
uaaaaauagccccagaaagagccuaagcuauguucagauagaagccucgaaauuccuguaaauu

SEQ ID NO: 48334 - RNA, 64 nt, Human
cuuacuauucuguuccuacauacucuguuaggaucagauagauguuauagaaaugccuuuuguu

SEQ ID NO: 48335 - RNA, 64 nt, Human
caucuccgcaaccacagcccagagcuccagucaccagauagaaaauugauuugauuucauccaa

SEQ ID NO: 48336 - RNA, 64 nt, Human
gacauguuuauggacagugcucuagaugugaaaacagauagaacugguuugugggacaggggca

SEQ ID NO: 48337 - RNA, 64 nt, Human
uagugccaaugacaggacauuugacaugagucuccagauagaugucguggacuccagcucuacg

SEQ ID NO: 48338 - RNA, 64 nt, Human
agacuccauuuucuccagggaaacgaggcuugcccagauagacuaacaacccuuuagugcucca

SEQ ID NO: 48339 - RNA, 64 nt, Human
cccccacugucccccuacccaccgauggagcccccagauagagcuggguggccuguuucugcag

SEQ ID NO: 48340 - RNA, 64 nt, Human
cucauaauuccauuuguggagagaacaggagggccagauagauagguccuagcagaaggcauug

SEQ ID NO: 48341 - RNA, 64 nt, Human
cuuugacacucuuggaaguccauguaguucucuacagauagacuucaaagaaacguuaccuuau

SEQ ID NO: 48342 - RNA, 64 nt, Human
agcucuggauuuuaagcccagacuucaguggacccagauagaaaauauaaagucucugaucuau

SEQ ID NO: 48343 - RNA, 64 nt, Human
ugaauuugauuuaaauguuuccugaauauauauacagauagauagaugaguaucaacacuuaca

SEQ ID NO: 48344 - RNA, 64 nt, Human
cauuagucauuauuuaguuuccaggccaaccauccagauagagauucccucuuuccuuugagca

SEQ ID NO: 48345 - RNA, 64 nt, Human
ugccacaucuacucacagauuuaucuaguauucucagauagauguuacagggcuucuuauucuu

SEQ ID NO: 48346 - RNA, 64 nt, Human
gagcccugcauguggagcccucccaccccacccccagauagagggaaauaaccaaaaaacuacc

SEQ ID NO: 48347 - RNA, 64 nt, Human
ggcuuuucaugcuuccaagugucagggccuugcccagauagacagggcuggcucugcugcccca

SEQ ID NO: 48348 - RNA, 64 nt, Human
aagaugcauuuacuacaguuggcuucuaaugcuucagauagaauacaguugggucucacauaac

SEQ ID NO: 48349 - RNA, 64 nt, Human
aacucugugagguggauaccaauauucuauuuugcagauagaauuuggcccagagagguuaacu

SEQ ID NO: 48350 - RNA, 64 nt, Human
aggaagcaguggaggaaagaaugcauuacuaccacagauagaaauaggggacucauagaacucu

SEQ ID NO: 48351 - RNA, 64 nt, Human
acaggagaagucaugcagaaucuaagcaggaaugcagauagaacacaucuaggcucuuuucccc

SEQ ID NO: 48352 - RNA, 64 nt, Human
gguaguauucuaccuacuuuuaagucuaauuuuacagauagaauaauggaaauugaaaauuuaa

SEQ ID NO: 48353 - RNA, 64 nt, Human
gggcauuugguggaugauaaugagcagccccucccagauagaaugucaauauuugagcaguagg

SEQ ID NO: 48354 - RNA, 64 nt, Human
gaauugcugccgucuggccucuggccucagucuucagauagacaguaagaagaaagcagccuca

SEQ ID NO: 48355 - RNA, 64 nt, Human
aagguuaaguuauuuuuugaucguguauaccaagcagauagaauacugugcuuaguggaacccg

SEQ ID NO: 48356 - RNA, 64 nt, Human
uccuguguauaccuagauauuagucaguuggugccagauagaagacagguuguguuuuuauccu

SEQ ID NO: 48357 - RNA, 64 nt, Human
auuacacgaugagauucugauucaugaagaaaagcagauagaagugguugaaaaaaugaauucu

SEQ ID NO: 48358 - RNA, 64 nt, Human
gauguuuagaagccauauaaguggcuuuuuuuaacagauagaauuuguauuuuuauuguacuuu

SEQ ID NO: 48359 - RNA, 64 nt, Human
guaagaaggugcaauccuagauaacacagcuagccagauagaagacacuuuuuucuccaaaaug

SEQ ID NO: 48360 - RNA, 64 nt, Human
auuuugcuuuuucauagaggcagaaaguaggaaccagauagagaugaaaaggggccacugaaaa

SEQ ID NO: 48361 - RNA, 64 nt, Human
aagugaaaagauaauucaccaaacaaugauuaaucagauagaaguucuagucaagagggauauu

SEQ ID NO: 48362 - RNA, 64 nt, Human
gcuagaguaacaucuuuguauaagcaaguaaccccagauagaguugacguuucagcuuugggcu

SEQ ID NO: 48363 - RNA, 64 nt, Human
caccagaaagggggagcuccuuccgcugcggcuccagauagauggggaugccgggcuccaggcc

SEQ ID NO: 48364 - RNA, 64 nt, Human
cccugcuccaggagggaaaaacagauguuguugacagauagagugauaggcaaauucugugugg

SEQ ID NO: 48365 - RNA, 64 nt, Human
uaauaaauucuuacuuguccuucaagacccaacucagauagauagagcuuccugagugaaaccu

SEQ ID NO: 48366 - RNA, 64 nt, Human
ccuuuaccagggaagaaaagcaauuauuucauuucagauagaaauacaaaaaaaaaaaaaauac

SEQ ID NO: 48367 - RNA, 64 nt, Human
cauucacuagcuuugccugguuuugucuuuuaugcagauagaaucaaucaguauguauucuuuu

SEQ ID NO: 48368 - RNA, 64 nt, Human
aaaugauugauucucccuggacaaagcaggaaagcagauagagcagggaaaaggaagaacagag

SEQ ID NO: 48369 - RNA, 64 nt, Human
ugcauugauuagaauaccguacuuuugguugccacagauagauuuucuauuuauaaaugcccaa

SEQ ID NO: 48370 - RNA, 64 nt, Human
caggaauccaaauccugaacauuuggaaugagcccagauagaaauaucgaaugcaaagcuacug

SEQ ID NO: 48371 - RNA, 64 nt, Human
aucuguucgagaugccucuucucugucuccuuaucagauagaaauggagucaugugcugcugcu

SEQ ID NO: 48372 - RNA, 64 nt, Human
caucacagcgaaccaggucucucaaaagaaaggacagauagaccacccucaucaaugaaaggaa

SEQ ID NO: 48373 - RNA, 64 nt, Human
acagccggagcaguuggccugugcuuggaggccucagauagaccugugaccuggucuggucagg

SEQ ID NO: 48374 - RNA, 64 nt, Human
agaugaccagucaaucagggagucccgccacuuccagauagacuacgaugaggacgggaacugc

SEQ ID NO: 48375 - RNA, 64 nt, Human
uuucucugaauccucuucacuggccaaagguuggcagauagaggcaacucccaggccagugagc

SEQ ID NO: 48376 - RNA, 64 nt, Human
aaaaccacuaaccuugauuuuuguauugcaaaaucagauagaccuggaaacauaaauuuaaauc

SEQ ID NO: 48377 - RNA, 64 nt, Human
gauuaguuaugucugacauuugaagcuggaaaaccagauagauggguugacaucaguuuauucc

SEQ ID NO: 48378 - RNA, 64 nt, Human
agagcuaguuaauuuccuuaaaucuuuuuguauucagauagauaauaugaaucauuauggguug

SEQ ID NO: 48379 - RNA, 64 nt, Human
guucacauuuacuggugcauccuugauccucucacagauagaggucuuaaagguuggaucaugu

SEQ ID NO: 48380 - RNA, 64 nt, Human
uggaggcuuagaugacuucugcaggauuuauauucagauagaaaacaucaaauauuuucagggg

SEQ ID NO: 48381 - RNA, 64 nt, Human
agaacuuaucuguuaugcuccugauagccaauagcagauagaagcuugcaaucaagaggguagg

SEQ ID NO: 48382 - RNA, 64 nt, Human
gauuaguuaugucugacauuugaagcuggaaaaccagauagauaggacaacuucaguuuauucc

SEQ ID NO: 48383 - RNA, 64 nt, Human
uguaucaaugaguaacaggaaaauuuuaaaaauacagauagauauaugcucugcauguuacaua

SEQ ID NO: 48384 - RNA, 64 nt, Human
aagaccagauggagaacuuauuuccugcagcugacagauagacucagauuuugugagacugaaa

SEQ ID NO: 48385 - RNA, 64 nt, Human
uaagccacuaaaucacaguaauuuguuauagcagcagauagaaaacuaauauacucccuuuaau

SEQ ID NO: 48386 - RNA, 64 nt, Human
uugcuaacaaccacaguaauauaauaugauuuuacagauagaugcuuccccuuggcuaugacau

SEQ ID NO: 48387 - RNA, 64 nt, Human
ggaaauaagggagaaaucuugcaguuaccauguucagauagagugacugaaauuaauuguacuu

SEQ ID NO: 48388 - RNA, 64 nt, Human
auaugauguuaaaaaaauaagaagaaugcuuaaucagauagauauuccuauugugcaauguaaa

SEQ ID NO: 48389 - RNA, 64 nt, Human
uagauuuguauucagagugugagagcaagcucuacagauagaccuuauuggacuacuuuuuuuu

SEQ ID NO: 48390 - RNA, 64 nt, Human
uuaauuauugcuugucuuaaaauaaugaacacuacagauagaaaauaugauauauugcuguuau

SEQ ID NO: 48391 - RNA, 64 nt, Human
uacuagacaguucaacaagccacaucuaauggcacagauagaggauguagcuauuuuauaccuu

SEQ ID NO: 48392 - RNA, 64 nt, Human
cgguccaaacgcccaaccuucagaaagaggaagucagauagaaauagucccugagagcacacug

SEQ ID NO: 48393 - RNA, 64 nt, Human
auccagccgugccccagccuggaccccuggggcucagauagaggugcugagccccugugucaaa

SEQ ID NO: 48394 - RNA, 64 nt, Human
cagcuuuauguauuuguauggggaguugaagauucagauagagguauuaagauguguggcauuu

SEQ ID NO: 48395 - RNA, 64 nt, Human
ugaucagaggacucuaucuaaauugugaucguggcagauagagauggagucauguacucuaucu

SEQ ID NO: 48396 - RNA, 64 nt, Human
uuucaaaggcugccuacagaauauuaucacuugacagauagaguuaauaaauuaccaaucaggc

SEQ ID NO: 48397 - RNA, 64 nt, Human
cuuugggauagguugcaguaccagccacagccagcagauagaggaaaagacacacauaaacucg

SEQ ID NO: 48398 - RNA, 64 nt, Human
uggguagggccaagaugaccagugugaaaacucucagauagaaaggagccaugcauauuaaaug

SEQ ID NO: 48399 - RNA, 64 nt, Human
uggccgcucucuccucuccccuccucagagggggcagauagaaacugggacggauucaagucac

SEQ ID NO: 48400 - RNA, 64 nt, Human
aaacaagucaucauuguagaaaagcaagaaaaugcagauagagaaaaagaagaaaauaaaacug

SEQ ID NO: 48401 - RNA, 64 nt, Human
caguuuuuaaaauaguguaggauaauauaaaaagcagauagauggcgcuauguuugauuccuac

SEQ ID NO: 48402 - RNA, 64 nt, Human
aaucuuacauuuuauaccaaguucaaaacacuuucagauagaagucuuucuaugcaaagauuaa

SEQ ID NO: 48403 - RNA, 64 nt, Human
aaacuguuuaaguauuuaaacaucugagccaaagcagauagaaguuauuguauaauuguuaauc

SEQ ID NO: 48404 - RNA, 64 nt, Human
cuugggggagguguugaaauucucauuuacaggucagauagagcaguguacgucuuuucugagg

SEQ ID NO: 48405 - RNA, 64 nt, Human
uccuccccaccuuucccuaagcaaaguuuaaacgcagauagagaguucagaguugaugcuggau

SEQ ID NO: 48406 - RNA, 64 nt, Human
caaggagguuaccuuuaauaaaagaagacaaacccagauagauauguaaaccaaaauacuaugc

SEQ ID NO: 48407 - RNA, 64 nt, Human
agcaugaaauggauacuuauauggaaauucugcucagauagaaugacaguccgucaaaacagau

SEQ ID NO: 48408 - RNA, 64 nt, Human
cuuuuuucguagaaguacuauaauuauaagauuucagauagaacaugcaauuagccuuuugaaa

SEQ ID NO: 48409 - RNA, 64 nt, Human
caacaaauaaaccuucuacugagaaaauacaucacagauagaagauuaucugcuaaguccaggc

SEQ ID NO: 48410 - RNA, 64 nt, Human
auuugugccauuagucuuucuauguuucugcauccagauagagugcaguucaugagggaggggg

SEQ ID NO: 48411 - RNA, 64 nt, Human
accuuaucuuauauccagagcagauuccauuuggcagauagauggucucuagccuauuguauuc

SEQ ID NO: 48412 - RNA, 64 nt, Human
auuagugaaagagaccuguggauugaaauggcugcagauagaucccgcagucccuucugaaagg

SEQ ID NO: 48413 - RNA, 64 nt, Human
cucagccccaggaagggcaaggcaagaugguggacagauagagaauuguugcuguauuuuuuaa

SEQ ID NO: 48414 - RNA, 64 nt, Human
cccuggggugcagaggcccggcacguagagaacccagauagacgccggugguggaacuggucaa

SEQ ID NO: 48415 - RNA, 64 nt, Human
uuuauuacuugcuauagguuuagggaguguaccucagauagauuuuaaaaaaaagaauagaaag

SEQ ID NO: 48416 - RNA, 64 nt, Human
gaaauuccuucauaaaacauguaacacugaucuucagauagaaaaagcaaucuguuuauuuacc

SEQ ID NO: 48417 - RNA, 64 nt, Human
aaaaaccugguuuagugguuuaagccuuguguggcagauagaucuuaaagggcaaagcaguaua

SEQ ID NO: 48418 - RNA, 64 nt, Human
auuacaagaugagauucugacuacuaaacagaagcagauagaaguggccgaaaaaaaaaugaau

SEQ ID NO: 48419 - RNA, 64 nt, Human
gcucugcuuuugcccuuugucaucaccaacacaacagauagaauuuaaauauaaguauauggug

SEQ ID NO: 48420 - RNA, 64 nt, Human
ugggaaguguucuuccugccuuucugcuaggugucagauagauggucccagagcuaggugcugu

SEQ ID NO: 48421 - RNA, 64 nt, Human
ugggagcccuggaugugaggucugugggagucugcagauagaaagcauuacauuguuuaaagaa

SEQ ID NO: 48422 - RNA, 64 nt, Human
uuuccuacucuuuaaggaaugauuucuuuagccucagauagaaggaccuuuaugaucuggccau

SEQ ID NO: 48423 - RNA, 64 nt, Human
uuacuggauccagaacacaauuuuccccucagaacagauagacagacugaagccacugaacucu

SEQ ID NO: 48424 - RNA, 64 nt, Human
ugagaaaauaaaaaaaaauggugacaaagcuguacagauagagauaauagaagacaaagagauu

SEQ ID NO: 48425 - RNA, 64 nt, Human
guguauguuucaggggcuucacauggaggagcugcagauagauauguguuucuguguaugugua

SEQ ID NO: 48426 - RNA, 64 nt, Human
uacaauuacagaaacugauuaguuugucaguuugcagauagauuuagcacaguacucaucacuc

SEQ ID NO: 48427 - RNA, 64 nt, Human
agauuugguggugauggggggauagagguagaagcagauagaagguaauuuuaaaguuaauuua

SEQ ID NO: 48428 - RNA, 64 nt, Human
ccucgaccccgcgccgggcaccuguggcuugggacagauagaagggaugguuggggauacuucc

SEQ ID NO: 48429 - RNA, 64 nt, Human
caucuucaguuucuaugacuguggaauaaauguucagauagaaacuucacuuuuggauguacug

SEQ ID NO: 48430 - RNA, 64 nt, Human
gaggcucaaaaaaaacacaaagaucagaagccuucagauagagggugguauucugguaaagaag

SEQ ID NO: 48431 - RNA, 64 nt, Human
uuaggaaaucuaggacuuccagcuucccucaugucagauagaaaaaaagucaggaaaccagcuc

SEQ ID NO: 48432 - RNA, 64 nt, Human
acagaugggcauuuauuacuggcaguggaaacaccagauagaagaucuuaggagaggcccagaa

SEQ ID NO: 48433 - RNA, 64 nt, Human
agccauggagcccuccccuggccaugucuggggacagauagaaccuguugggggaaauauuccc

SEQ ID NO: 48434 - RNA, 64 nt, Human
cauuugucauuuacccugguggaggcuucuugcccagauagagaucugaaauuggugggaagca

SEQ ID NO: 48435 - RNA, 64 nt, Human
cagucaucucaugauacaggcgggaggggcagaacagauagauuacgacagguuugguuuuuaa

SEQ ID NO: 48436 - RNA, 64 nt, Human
agagggugaggaggguuguucagaaucuaaauuacagauagaugauuguuucuugugaauuugu

SEQ ID NO: 48437 - RNA, 64 nt, Human
uauuuuuauaagcagagaauuuuuuaugucuuaccagauagaguugcagggaagggggggccug

SEQ ID NO: 48438 - RNA, 64 nt, Human
gucugcacgugugcaugcauacacaccggguugacagauagagaaaacuggguuugaaccaaau

SEQ ID NO: 48439 - RNA, 64 nt, Human
acccacgcagaagaaacagaagaacucaugcugccagauagauagaaaaagaagcauggauccu

SEQ ID NO: 48440 - RNA, 64 nt, Human
ggcgcugugcuaucaugauggaauuucauaucuacagauagagaguuguuguguacagacuugu

SEQ ID NO: 48441 - RNA, 64 nt, Human
ugggcaguauacuaagguguggcugucuuggauucagauagaacuaaggguucccgacucugaa

SEQ ID NO: 48442 - RNA, 64 nt, Human
uuaugccugguaaguggcuuuuuguacuguaguucagauagagauauuuuggguauauuuucaa

SEQ ID NO: 48443 - RNA, 64 nt, Human
acaguguggaauaguucugaauuaugcuguucuacagauagaaaaaaaguccaaaugccuuuaa

SEQ ID NO: 48444 - RNA, 64 nt, Human
gaugagaaaguccucaagugaggggaggaggaagcagauagaugguccagcaggcuugaagcag

SEQ ID NO: 48445 - RNA, 64 nt, Human
auaugugggugggugggagggcuggggcaggggccagauagaaauuauugguuuuguuuuuuaa

SEQ ID NO: 48446 - RNA, 64 nt, Human
ccauauucaucuccaacuacacaggggaacggagcagauagagcugcgacugggaagcgucacc

SEQ ID NO: 48447 - RNA, 64 nt, Human
gacuuguacagacuuguacaaguaaagacuuauacagauagauuuuuguuuuaacuuacaaucc

SEQ ID NO: 48448 - RNA, 64 nt, Human
aacccgggagaaggaguaucaggagaccauugaccagauagagcuggaguuggccacggccaag

SEQ ID NO: 48449 - RNA, 64 nt, Human
aaagaauugaaaagcaaaucucacuaaugauacacagauagauaaagcaagucuaucaacauua

SEQ ID NO: 48450 - RNA, 64 nt, Human
uucaagucaauugccauuauuuguauugaaguaucagauagauaguaaauacugcaacuaguag

SEQ ID NO: 48451 - RNA, 64 nt, Human
gcauuucuggggcaggaacagagggugaaagggacagauagaugcagguccauucugcaccucu

SEQ ID NO: 48452 - RNA, 64 nt, Human
ccuuuuuguuccuuaccagcaugccacuuccugccagauagagggaggcuagauuugaugacau

SEQ ID NO: 48453 - RNA, 64 nt, Human
cucauuuuguuuccuaugaucauccucuagauaccagauagaggcccauuccugcauuugagau

SEQ ID NO: 48454 - RNA, 64 nt, Human
uuuuaagacuguaauguguacuggucagcuugcucagauagaucuguguuugugggggcccuuc

SEQ ID NO: 48455 - RNA, 64 nt, Human
cucuaggaaaugggggugauaauugugccuaccucagauagacagugccagaauuaagugaguc

SEQ ID NO: 48456 - RNA, 64 nt, Human
gaaagcccuggaucucuuugcaccaaaaaugguccagauagacucuuuuuaaggaucuuggcug

SEQ ID NO: 48457 - RNA, 64 nt, Human
augugauguaagccuccauacgaaagcacuguugcagauagaagaagaggugguugcugcucau

SEQ ID NO: 48458 - RNA, 64 nt, Human
ucaguuauguaggaccuuuggacccaggguccuacagauagauauggugugcccagauuuuaaa

SEQ ID NO: 48459 - RNA, 64 nt, Human
cuuaccugccccgagggaaguccagcagcuccaccagauagagaucuggagaugcuucucucac

SEQ ID NO: 48460 - RNA, 64 nt, Human
gcuuuuuuuuuuuugacuaacaagaauguaacuccagauagagaaauagugacaagugaagaac

SEQ ID NO: 48461 - RNA, 64 nt, Human
auuacaagaugagauucugauucaugaagaaaagcagauagaaguggcugaaaaugaauucuga

SEQ ID NO: 48462 - RNA, 64 nt, Human
agagcuugaugcugccuggccaaaugaggugacucagauagaaucugaucccauucagagcuug

SEQ ID NO: 48463 - RNA, 64 nt, Human; identical to SEQ ID NO: 48461

SEQ ID NO: 48464 - RNA, 64 nt, Human
uaggggccagaucuaacauuguagugucuuucaccagauagacuucuacuguuucaucaaacuc

SEQ ID NO: 48465 - RNA, 64 nt, Human
auucaggaguuuuaauguuagaauuuagauuuaacagauagaguguggcuucauuuguccaugg

SEQ ID NO: 48466 - RNA, 64 nt, Human
agagcgcgcauucuauuuccuccgcagggaaugccagauagaaaguugcgggcaacacuuuucu

SEQ ID NO: 48467 - RNA, 64 nt, Human
acacuuccaucagaagugaagauaggaagcucaucagauagaacaucagcccaugagauguuug

SEQ ID NO: 48468 - RNA, 64 nt, Human
agaaacaucuaucaagcaacacagccccuuaucccagauagaaaagugucucaaaugcauucua

SEQ ID NO: 48469 - RNA, 64 nt, Human
uuaaaauuguaagauaagaaacaguuucuuagagcagauagaaaaaugcuuauuuaaaucuuug

SEQ ID NO: 48470 - RNA, 64 nt, Human
aggcuuuuauccuagaucaccacuggauugcugacagauagaggaggugggacccugacuauca

SEQ ID NO: 48471 - RNA, 64 nt, Human
ucugagggucaaggauaccaggggucccaagucacagauagacauuccaguuuguauucuuagg

SEQ ID NO: 48472 - RNA, 64 nt, Human
gacccccugcuuccacugcuugggccugcuuucucagauagacugacugcugaggaggcucuag

SEQ ID NO: 48473 - RNA, 64 nt, Human
uuuuuuacucacguaccuguuacacuuuagcauacagauagaucauagaucacguuacaagcac

SEQ ID NO: 48474 - RNA, 64 nt, Human
agucauauguugucuuuguuguagugaaauuauacagauagaguuccauauauuguauuuguuu

SEQ ID NO: 48475 - RNA, 64 nt, Human
aaacgcucauggcgcugcuuugcuccacccgcuucagauagaucauuguuagauauuucacauu

SEQ ID NO: 48476 - RNA, 64 nt, Human
cugacgucacagucuaagaugggaaacugugguacagauagacaugaagagagcuuagcaguga

SEQ ID NO: 48477 - RNA, 64 nt, Human
uccaggaugugccugaaguauugauaggucuucucagauagagcccuccacacuguggacugga

SEQ ID NO: 48478 - RNA, 64 nt, Human
gccagccgggcacccccaaccucauggucauggacagauagacagugcugcccugcgaaguggc

SEQ ID NO: 48479 - RNA, 64 nt, Human
ucuaucagcuuuacacaugucccaccagcuguuucagauagauccuuacagcuggcagaguaaa

SEQ ID NO: 48480 - RNA, 64 nt, Human
ucccagggcaagacaacaggaucagagaacuugccagauagaaaagacuuaaauggagaaccag

SEQ ID NO: 48481 - RNA, 64 nt, Human
guaguagacaggaugcccaguuaaguuugaauuucagauagaaaauaauuuuagaauaaauaug

SEQ ID NO: 48482 - RNA, 64 nt, Human
uuaccauacuacuggacuggacucaggcuggaggcagauagacacaguauagggggaaugggcu

SEQ ID NO: 48483 - RNA, 64 nt, Human
ccuuuagggcagagacagaccacugacaaauacacagauagacaaggaauuucccaugguaaaa

SEQ ID NO: 48484 - RNA, 64 nt, Human
acuccaguuuucuccucugcuucuuugccucccucagauagaaaacagcccccacuccagucca

SEQ ID NO: 48485 - RNA, 64 nt, Human
cugugcuuucccucccugcacaugggcacuguaucagauagauuacuuuuuaaauguagauaaa

SEQ ID NO: 48486 - RNA, 64 nt, Human
guccauguaacucuuuagaacaagaggaauaggucagauagaagaagcuguguaauguauuaau

SEQ ID NO: 48487 - RNA, 64 nt, Human
cuguuuuaucuuaguuuuauacauaauuuaccaucagauagaacuuuaugguucuaguacagau

SEQ ID NO: 48488 - RNA, 64 nt, Human
aucuagaaaagccuuguugagcagccuccuuauccagauagauccaaagcucaugucucuucag

SEQ ID NO: 48489 - RNA, 64 nt, Human
uuugcaaaaugucuccuuugagacagaggcauuucagauagauacccaccaugagguguucugg

SEQ ID NO: 48490 - RNA, 64 nt, Human
aagccgccaguacuugucauauguagccuucacacagauagaccuuuuuuuuuuuuccaauucu

SEQ ID NO: 48491 - RNA, 64 nt, Human
caaaagagcaguuuuaauaacuuuaaaaguacuucagauagacgcagaaaauuggugagugguu

SEQ ID NO: 48492 - RNA, 64 nt, Human
agucuauguccaaaaggcuuaguugcuucuuaugcagauagaugugugaaaucuaagcaguaau

SEQ ID NO: 48493 - RNA, 64 nt, Human
gccggggguggcuauugugggaagucauaacccacagauagaucaaccuaagaauccuggcccu

SEQ ID NO: 48494 - RNA, 64 nt, Human
ggggauugugccuggagacaugcccauggcugcacagauagaagaaccuccagcccauucaggu

SEQ ID NO: 48495 - RNA, 64 nt, Human
gaaagaggucggggcuggacagauggggagagcgcagauagauuuaagagaguccugugaggca

SEQ ID NO: 48496 - RNA, 64 nt, Human
cccagccccacagccuugccugaccacccuccagcagauagacgccggcaccccuuccucuucc

SEQ ID NO: 48497 - RNA, 64 nt, Human
gcuuccaggccccuaugugccccuuuucagaaaacagauagaugccaucucgcccgcuccugac

SEQ ID NO: 48498 - RNA, 64 nt, Human
auguagggaaguauucuuuaauguuauuucauuucagauagaaauaauucucauuggagauaaa

SEQ ID NO: 48499 - RNA, 64 nt, Human
uaaaaggaaguauuuaaaggaugauagagaccaucagauagaagcagggaagguagauaacuuu

SEQ ID NO: 48500 - RNA, 64 nt, Human
accugacagcuagguaucuagcuagcuagaaaggcagauagacagauauauagaugauagauag

SEQ ID NO: 48501 - RNA, 64 nt, Human
auuuucuccacuucauuuuuaagaaaggaagcaacagauagauguugcucuuucaccugggugu

SEQ ID NO: 48502 - RNA, 64 nt, Human
ucuuagacuccgcucuuguucuccagguuuucaccagauagauuugggguuggcgggaccugcu

SEQ ID NO: 48503 - RNA, 64 nt, Human
aucagguacccaccaacuuuauacuuucugccuucagauagaguuucuaacauuuucuaguuug

SEQ ID NO: 48504 - RNA, 64 nt, Human
ugcuuggaauugaacuugacaagauuagcucaagcagauagagucggguccagcaguggguggc

SEQ ID NO: 48505 - RNA, 64 nt, Human
gccuuccagcggggcacccggagggcugccccagcagauagagagggccuccguucugccaccu

SEQ ID NO: 48506 - RNA, 64 nt, Human
agcugauguaaaauucuaaauuaccauuuacuuccagauagagcagaggagaaacaccucacug

SEQ ID NO: 48507 - RNA, 64 nt, Human
agauggaagccaggacaagggagcccaccgggcccagauagagacuucagaacccacuccugag

SEQ ID NO: 48508 - RNA, 64 nt, Human
uugaaaaaucccuccaagugauucuuuuacaucccagauagaaaacccuaaauuaaaggugaaa

SEQ ID NO: 48509 - RNA, 64 nt, Human
gccaaccauuucaggaucagucaaaggcagcaagcagauagacucaaggugugugaaagauguu

SEQ ID NO: 48510 - RNA, 64 nt, Human
auguaaugauuucuucuuuuccuauugaccaguacagauagauauguuguguuugcuucauuuu

SEQ ID NO: 48511 - RNA, 64 nt, Human
uaaaaggacacuaaaaacuggaguuauagauauccagauagaaacaguaguuaucuuuggguag

SEQ ID NO: 48512 - RNA, 64 nt, Human
uuugaugagugauauuucccuauaccuauguacccagauagauauaugcauagauaaaagugau

SEQ ID NO: 48513 - RNA, 64 nt, Human
uuccccguguguagguagaucuggucuuuagaggcagauagauaggucagugcaaauacucugg

SEQ ID NO: 48514 - RNA, 64 nt, Human
guagccucuaaccagcauucccagacaccugaggcagauagauggaugggcuggugggcagggg

SEQ ID NO: 48515 - RNA, 64 nt, Human
uacagcucaucauucuguagaaaugugcaguuugcagauagaacacugcacacagaaauguuuu

SEQ ID NO: 48516 - RNA, 57 nt, Human
ccaagaucugucaagaguaagaggcaacagauagaguguccuugguaauaagaaguc

SEQ ID NO: 48517 - RNA, 64 nt, Human
uauucauaacaguuuuuccaaaguucuuuccugccagauagaaauugugcacagcacagcauca

SEQ ID NO: 48518 - RNA, 64 nt, Human
cauacacauuaguccucaguuauaaagugaaucucagauagaaauuaaaagugcaguuguguua

SEQ ID NO: 48519 - RNA, 64 nt, Human
ugugucuaaaaauauugcugaaguuauucuugaucagauagaauuuaaccuaaaaugugaacuc

SEQ ID NO: 48520 - RNA, 64 nt, Human
ucucaguucucucucccugcuaccccuuucucugcagauagauagacacuggcauuaucccuuu

SEQ ID NO: 48521 - RNA, 64 nt, Human
caggacaacugaccugucuccuucacacaguccacgucaccacgaaucacacaacaaaaaggag

SEQ ID NO: 48522 - RNA, 64 nt, Human
ccacgggaagaaccaagcggugccagccacgagacgucaccaagaaaacaugcaacucaaacga

SEQ ID NO: 48523 - RNA, 64 nt, Human
uuugauuuccugagcuacuuguucgccuucugugcgucaccaaguaaucugguucaucuuucgu

SEQ ID NO: 48524 - RNA, 64 nt, Human
cgccccccaggggcccuguggggacugcuggggccgucaccaacccggacuuguacagagcaac

SEQ ID NO: 48525 - RNA, 64 nt, Human
gcaagccuuucaccaaccaaauaguugccucucucgucaccaaacuggaaccucacaccagccg

SEQ ID NO: 48526 - RNA, 64 nt, Human
cucagccuccugaguagcugggauuacaggcgcccgucaccacacccagguaauuuuuguauuu

SEQ ID NO: 48527 - RNA, 64 nt, Human
aaaaaaagucagagacagauaccuccaacccugccgucaccaccaccccuaccacauaugucca

SEQ ID NO: 48528 - RNA, 64 nt, Human
cucagccucucgaguagcugggauuacaggcaugcgucaccacucccagcuaauuuuguauuuu

SEQ ID NO: 48529 - RNA, 64 nt, Human
cuggcagccuggaagaccgugccugcccagcccucgucaccacagggacuccuuggguccuggc

SEQ ID NO: 48530 - RNA, 64 nt, Human
ccucggccacgucccugcacucucagcccccgcccgucaccaccaccggccaccugaguguccg

SEQ ID NO: 48531 - RNA, 64 nt, Human
uccauuccucauauuaaacuauuacuucucaugacgucaccauuuuuaacugacaggauuagua

SEQ ID NO: 48532 - RNA, 64 nt, Human
acaagugguuuuuccuaauuccagaggaacuggacgucaccaaacaagguugcauuuuacuuuu

SEQ ID NO: 48533 - RNA, 64 nt, Human
aacagaaugguauauuccucuggaaaaagaugaacgucaccaauggauugugcugcucucguuu

SEQ ID NO: 48534 - RNA, 64 nt, Human
aauuucagagcuuuaacaaaagauaaaaauaaaucgucaccaauuguuauugcuucucaucuuu

SEQ ID NO: 48535 - RNA, 64 nt, Human
cgcaagugagcagacaccaccgacuuccuuucugcgucaccagugucgucagcagagagaggac

SEQ ID NO: 48536 - RNA, 64 nt, Human
cucagccuccagagcaacugggacaacaggcgcccgucaccacgcccagcuaauuuuuuguauu

SEQ ID NO: 48537 - RNA, 64 nt, Human
acguucaaacaggccaggcuccagcacuucaguacgucaccagggaucuggguucuucccagcu

SEQ ID NO: 48538 - RNA, 64 nt, Human
cucccguugucaugccuuacgguuuccaaugcgccgucaccaucuccaccugccaccaaaccac

SEQ ID NO: 48539 - RNA, 64 nt, Human
uccgugugucucaugccagcagcacgucgccauccgucaccagaauuaguccucacagccuagg

SEQ ID NO: 48540 - RNA, 64 nt, Human
uacaacuccgaagaaaacccuuacuguccaagaccgucaccagcaaccauccgcagucauucaa

SEQ ID NO: 48541 - RNA, 64 nt, Human
ccggcuacuucuuguauuuuuuguagagacggaucgucaccauauuucuuaggcuggccuuuaa

SEQ ID NO: 48542 - RNA, 64 nt, Human
aaguaacagaccagacuccuuuucucuucugucccgucaccaggcucuugcuucacugcagaua

SEQ ID NO: 48543 - RNA, 64 nt, Human
gagcaggacuccaggcccaaggcucccggaauuccgucaccacgacuggccagggccacgcucc

SEQ ID NO: 48544 - RNA, 64 nt, Human
aguguaguccauuugcaauagaaauaaaaaaauccgucaccaaauuguaaccuggauguuauag

SEQ ID NO: 48545 - RNA, 64 nt, Human
cccauucugccuccauucugaccauuucaggggucgucaccaccucuccuuuggccauuccaac

SEQ ID NO: 48546 - RNA, 64 nt, Human
uuuucuuuuucucuugugccaaacugacagaaaccgucaccacacuggucuuuuucuuuaaugu

SEQ ID NO: 48547 - RNA, 64 nt, Human
acaaaugacgucuucaccaagugaucaaaauuaacgucaccagugauaagucauucagauuugu

SEQ ID NO: 48548 - RNA, 64 nt, Human
uaucaauauuaagucuuuuaccuaaaggcccagccgucaccagacaacagaauaaucaaucugc

SEQ ID NO: 48549 - RNA, 64 nt, Human
gggaaaagacaguuacucacgggagcugcaggcccgucaccaagcccucucccgacccaggcuu

SEQ ID NO: 48550 - RNA, 60 nt, Human
acuggacaaccgcuacaugaccccagcaggcgucaccauccaccuucccuucuacaagga

SEQ ID NO: 48551 - RNA, 64 nt, Human
cagcacacgugugaucaccguaggguaacuggagcgucaccaccggcggaaucgcagcuucuga

SEQ ID NO: 48552 - RNA, 64 nt, Human
cuggcuggcucuccgugucugacgaccucaccagcgucaccaaccauggcuaccgcgugcaggu

SEQ ID NO: 48553 - RNA, 64 nt, Human
agaugagcugcagccccccagagagagcucugcacgucaccaaguaaccaggccccagccucca

SEQ ID NO: 48554 - RNA, 62 nt, Human
gcgucaccgcccacuucuagccccguggaugccgucaccaccagcacacggaacuaccuccc

SEQ ID NO: 48555 - RNA, 64 nt, Human
cagccaagcccuaccucucgguuaucuuuucucccgucaccacccaguaaggucaugugcuucc

SEQ ID NO: 48556 - RNA, 64 nt, Human
cugguggucccgccgcaccucugcaucuccugggcgucaccaggaaggcucugaagucccgggc

SEQ ID NO: 48557 - RNA, 64 nt, Human
ccuccaggcugugccaggaaacccgcugccuuugcgucaccacagccuuggucacagcgugacc

SEQ ID NO: 48558 - RNA, 64 nt, Human
uacaggguggggggagugggcgguucucauuaaacgucaccauuucaugaguccuuggaacaga

SEQ ID NO: 48559 - RNA, 64 nt, Human
agcuccaggccagcacagaaauuccugaggccaacgucaccaaaguuagauugaauguuuauua

SEQ ID NO: 48560 - RNA, 64 nt, Human
acaccaguggggagcccgcaggccuauguggcagcgucaccacaggaguugugggccuaggaga

SEQ ID NO: 48561 - RNA, 64 nt, Human
cucccucacagccaugcccagaagccucacaccucgucaccaccaccaccccccaccccauccu

SEQ ID NO: 48562 - RNA, 64 nt, Human
cccuucuccacuuacuauaaugguuggaacuaaacgucaccaagguggcuucuccuuggcugag

SEQ ID NO: 48563 - RNA, 64 nt, Human
ccaugaauuaggagcauaguuuuuuccauuuaaacgucaccauuacuuaaaagaugauugauua

SEQ ID NO: 48564 - RNA, 64 nt, Human
cuagcugacugcaaaggucaaguucucuuuacuccgucaccauauccauauggaauaagggcuc

SEQ ID NO: 48565 - RNA, 64 nt, Human
uaaaauccacucuuggcaaugcaauaaaaaaaaccgucaccauaagccagugacaccugacuga

SEQ ID NO: 48566 - RNA, 64 nt, Human
agacuguuaaccaggcucugcuggccuguuuacucgucaccaccucugcaccugcugucuugag

SEQ ID NO: 48567 - RNA, 64 nt, Human
cuguaugaaaggagagagcaaagggugucugcgucgucaccaaaucguagcguuuguuaccaga

SEQ ID NO: 48568 - RNA, 64 nt, Human
guuugccuucccugaaucaaaauaaucuuucauucgucaccauuauacuaaugaacaauagauu

SEQ ID NO: 48569 - RNA, 64 nt, Human
uauggacaacaugaucugcacgcagacccugcugcgucaccagggcagugucaccgcgcuggcu

SEQ ID NO: 48570 - RNA, 64 nt, Human
uaugacuguaugccguggacaagagaugccugggcgucaccaugccacagcuacccacuuguug

SEQ ID NO: 48571 - RNA, 64 nt, Human
ugccccugcugccuccccaacccugccccugccccgucaccaucucaggccaccugcccccuuc

SEQ ID NO: 48572 - RNA, 64 nt, Human
ucuuucgcuggaaagagggacaggggcccccacccgucaccacgccccaacacuccccccgaac

SEQ ID NO: 48573 - RNA, 64 nt, Human
ucugauggggagcuccgucucaccggccacccgccgucaccauggcagaugcccuuggccggaa

SEQ ID NO: 48574 - RNA, 64 nt, Human
ccugccucccagccucucccaagaccuccccccucgucaccagccaucccucuggaccaggcag

SEQ ID NO: 48575 - RNA, 64 nt, Human
caugauggcugcugcagccccguguuggccaugucgucaccauucucucuggcauggguugggu

SEQ ID NO: 48576 - RNA, 64 nt, Human
aaccauuugaccuggcguauuguguacuagucaccgucaccaucucuccauauguaucucccug

SEQ ID NO: 48577 - RNA, 64 nt, Human
agcaggaaggaugugggacucuguccaaguucaccgucaccaucaagccacuggcuguggaagg

SEQ ID NO: 48578 - RNA, 64 nt, Human
gaaaagagucagaucccauuuccgucugcccccucgucaccaggugugauagccccagccaggu

SEQ ID NO: 48579 - RNA, 64 nt, Human
acccucccuugcugcaccaguggccauuagcucccgucaccacugcaacccagggucccagcug

SEQ ID NO: 48580 - RNA, 64 nt, Human
uuuuucucccuccuccucaaguuccuuuuugcaccgucaccacccaacaccuuccaugacacuu

SEQ ID NO: 48581 - RNA, 64 nt, Human
accaugccaagcacuuucaucauuauuuauacaucgucaccacacccccucuauucaugagaag

SEQ ID NO: 48582 - RNA, 64 nt, Human
cugccaaaacaaaaaaacaaauacaaacaaaccucgucaccacggucaggaggagguucagaca

SEQ ID NO: 48583 - RNA, 64 nt, Human
ugcuggagguggcugcagagagccacuugucccacgucaccauuucaucucauuguaggcucac

SEQ ID NO: 48584 - RNA, 64 nt, Human
uggguuguuuccugcccugccuggggcugcuucucgucaccaagcccugguccugcggcagcug

SEQ ID NO: 48585 - RNA, 64 nt, Human
ccuguguuucacgugacucagcagugcccgccgccgucaccagcuaugcauucacuccguuucc

SEQ ID NO: 48586 - RNA, 64 nt, Human
ucucugacguggugccugcuggagggaggcucgucgucaccagcugacugcugguccggcuucu

SEQ ID NO: 48587 - RNA, 64 nt, Human
augucaaaaaaaaauaauauuuucaccauccagacgucaccauuauaaauucuuaguucagggc

SEQ ID NO: 48588 - RNA, 64 nt, Human
uaggcaggagguaacaaaaauaucucugccuuugcgucaccaaagacugccuguuuuuaaaaca

SEQ ID NO: 48589 - RNA, 64 nt, Human
aaggcagaaaccaagaacugucugcaggcaaauaagcacccagcacccauccuggcugccggug

SEQ ID NO: 48590 - RNA, 64 nt, Human
aaaccaagaacugucugcaggcaaauaagcacccagcacccauccuggcugccggugccccgua

SEQ ID NO: 48591 - RNA, 64 nt, Human
ggcuccugcccccuggccacugccaagagaaugaagcacccagucucguaccauuuugagcccu

SEQ ID NO: 48592 - RNA, 64 nt, Human
ugagcagggaacucagugugacaccgccagguccagcacccaugggggcgggggagaggcucac

SEQ ID NO: 48593 - RNA, 64 nt, Human
ccuaggaucagggaccagaggauccuaucuucucagcacccagcccaccccuuccuguagcaua

SEQ ID NO: 48594 - RNA, 64 nt, Human
gacaaugcaaaaauggucuucaaagcacauaaaaagcacccagggugagaaagccccaucccgg

SEQ ID NO: 48595 - RNA, 64 nt, Human
cagugauuuuuccccccaccccccagcacaggagagcacccacagccgcagaaggggaaugugu

SEQ ID NO: 48596 - RNA, 64 nt, Human
cucauccugggcaagcugauccugcugcaccacaagcacccagaacggaagcaggcaccacuaa

SEQ ID NO: 48597 - RNA, 64 nt, Human
gguucaugggaucccgaaggagcaagcagucggcagcacccaggccacaggagacuccgcuuuu

SEQ ID NO: 48598 - RNA, 64 nt, Human
agcaaacaacucccagcugaggaaugcaggccacagcacccaaucaagacaaauuguuauuauc

SEQ ID NO: 48599 - RNA, 64 nt, Human
gugugacgacugaaaucaggaagauuuuucuaucagcacccaggucuuaguuuucaccucuagu

SEQ ID NO: 48600 - RNA, 64 nt, Human
agaucucagagccugcccaacagcagggaagccaagcacccauucaucccccugcccccaucug

SEQ ID NO: 48601 - RNA, 56 nt, Human
aguggaggaaugagcucugaagacacagcacccagccuucucgcaccagccaagcc

SEQ ID NO: 48602 - RNA, 64 nt, Human
uggccacagggcauagaaacaagaggucacauucagcacccaccaccucccucuuucgcaucag

SEQ ID NO: 48603 - RNA, 64 nt, Human
uaacaucagcauuuucauuuuguguccagggaaaagcacccagaggucaucugugugucccgag

SEQ ID NO: 48604 - RNA, 64 nt, Human
ccuacuuuuggccucaucucugccugacaaggccagcacccaaaggguuaauauuuaaccucuu

SEQ ID NO: 48605 - RNA, 64 nt, Human
aggccgaggauggaugcccugugccagugaccagagcacccagggcuggccagucacugaggga

SEQ ID NO: 48606 - RNA, 64 nt, Human
gagugcaggccagagcagggugugcguagcccccagcacccagguucuucugucagacccugug

SEQ ID NO: 48607 - RNA, 64 nt, Human
caugggggauggggaccuaccuggcuccucagccagcacccagcuuaaccccugccaucccaug

SEQ ID NO: 48608 - RNA, 64 nt, Human
ugaggacagcgaugcgggcagcuggggggcugagagcacccagaggaccgaggacaggggccgg

SEQ ID NO: 48609 - RNA, 64 nt, Human
ugcugaagaaggcuguucgugaggaggagaugcgagcacccagaacgucuuuugaggcugggcg

SEQ ID NO: 48610 - RNA, 64 nt, Human
gaugaauuaguugcugucacaaaaggagggaaguagcacccaaauuaaguugcuuaagagagga

SEQ ID NO: 48611 - RNA, 64 nt, Human
gacaaaucccacuggccuacagucuugcuucugcagcacccacuuugucuccucagguagugau

SEQ ID NO: 48612 - RNA, 64 nt, Human
uugccugccugugcuauuuuacuuguaaagcuagagcacccaagcuucugccuucuggaauaua

SEQ ID NO: 48613 - RNA, 64 nt, Human
caacuccaaacaauucugaugaaaacaaaaucacagcacccacuaccauacagacagcacaagg

SEQ ID NO: 48614 - RNA, 64 nt, Human
aggcucucccuuucucugugauuggacaguugacagcacccaaacucuggggugcaugugugug

SEQ ID NO: 48615 - RNA, 64 nt, Human
gcuacagcaucugaaaggaaugaugcagaugagaagcacccagaacaugcugagcagaacauca

SEQ ID NO: 48616 - RNA, 64 nt, Human
uugggaaccccaguccugagcuugguuucuucccagcacccagagaauccuuccucagcucucu

SEQ ID NO: 48617 - RNA, 64 nt, Human
ggaauacuacccggguuuacuggagaucccccgaagcacccauccuccacucccucuucuuuaa

SEQ ID NO: 48618 - RNA, 64 nt, Human
ucacacugugugcugccgacccggcaaguuugacagcacccaaacuggccagacuguucuguag

SEQ ID NO: 48619 - RNA, 64 nt, Human
agcuccauacucuguccccccagcuaauacccagagcacccagaucagacucuccuucaggguu

SEQ ID NO: 48620 - RNA, 64 nt, Human
gggacccucaguucuaggacugguccgcagagaaagcacccaggagcagagcgcuucggagcgg

SEQ ID NO: 48621 - RNA, 64 nt, Human
uaaaguaagcaccacaccauguuucugucuccccagcacccagcacagugcugugaaccuuggc

SEQ ID NO: 48622 - RNA, 64 nt, Human
uuugaucccuugaacagaaagucaccaccgagagagcacccaggugggugguuucacaucagug

SEQ ID NO: 48623 - RNA, 64 nt, Human
ccauacccagucuaggagcuccuucuggcucccaagcacccagagcuuuccuccgccuuuuagu

SEQ ID NO: 48624 - RNA, 64 nt, Human
gcaggcagagaaguggagugacuauuuggagaauagcacccauaucugugugcccuagggcuca

SEQ ID NO: 48625 - RNA, 64 nt, Human
ccucacauucccuucccuccaccucuccuuaccaagcacccaaaagaggauuuagaacuagcag

SEQ ID NO: 48626 - RNA, 64 nt, Human
agccagucagucugucccagaaagggcccuuuucagcacccaaagcugggcuggcugggaugcc

SEQ ID NO: 48627 - RNA, 64 nt, Human
cuguugguugguugaacugaacauaucuugucuuagcacccaggaaacagaacuuuaagauaua

SEQ ID NO: 48628 - RNA, 64 nt, Human
uaacuagugauucuucuccaaaauugagaaagacagcacccauugaagcagauaugugugugaa

SEQ ID NO: 48629 - RNA, 64 nt, Human
ugggcagcucccacugccccagagcggagcucgaagcacccagguugcccacggaaaauccaau

SEQ ID NO: 48630 - RNA, 64 nt, Human
aucgcugcuggcagcacuuuuugagcaagccgagagcacccauuuuggcuggggguucagaucg

SEQ ID NO: 48631 - RNA, 64 nt, Human
gcuguuggccggcccugcuaccugacgcgccagaagcacccagcccugcccagcaaccggcccc

SEQ ID NO: 48632 - RNA, 64 nt, Human
ggguaccaggcaggcucccuuccuggggaaaagaagcacccagaccccgcgccccgcugaucuu

SEQ ID NO: 48633 - RNA, 64 nt, Human
ucucagacguuccauacccccacaugccaauuucagcacccaacugagauccgaggagcuccug

SEQ ID NO: 48634 - RNA, 64 nt, Human
acucagauguucgacgcccccuaagguccauuccagcacccaccugaguuccgaggagcaccug

SEQ ID NO: 48635 - RNA, 64 nt, Human
uggcaucucccccccgugccuucuggguacaauaagcacccaauucucaacagccccaguggcc

SEQ ID NO: 48636 - RNA, 64 nt, Human
cugguggcauuuccagaaccucagccccgauuccagcacccaccaccgccugacccuguguaac

SEQ ID NO: 48637 - RNA, 64 nt, Human
aggcucccucgucuguguaguggagauaaagaacagcacccaucucuuaguguugccugagacu

SEQ ID NO: 48638 - RNA, 64 nt, Human
cccccaggggaggccaggcagaagccugggucacagcacccagaacugcaugguuccauuuucu

SEQ ID NO: 48639 - RNA, 64 nt, Human
aaacaccaagaacaugaggauggagagaaguaucagcacccagaagagaaaaaggaauuuaaaa

SEQ ID NO: 48640 - RNA, 64 nt, Human
uacagcagaaguuugcugucucuaggauucauauagcacccacagagcuccaaguaaccaaauu

SEQ ID NO: 48641 - RNA, 64 nt, Human
cugggcagauggauggugagcaccacugcuacagagcacccagugauuuuacugaggauuaaaa

SEQ ID NO: 48642 - RNA, 64 nt, Human
uugcuucccuuauuuauaagggaaugccuuuaaaagcacccaagucaccuguugaacacuuugc

SEQ ID NO: 48643 - RNA, 64 nt, Human
caagggaagagccuugcugugccccuguagccucagcacccagcacaggccugucagacagcag

SEQ ID NO: 48644 - RNA, 64 nt, Human
cuuuggaaagaccugugaggggaaaccuucacccagcacccaugccccacucugcugaggccag

SEQ ID NO: 48645 - RNA, 64 nt, Human
caucacauuagauuaucccucagggugacaccaaagcacccagacagauuuagaagcccaaagu

SEQ ID NO: 48646 - RNA, 64 nt, Human
cgggcaccugcucugucugggacagauacugcccagcacccacccggccaugaggaccugcucu

SEQ ID NO: 48647 - RNA, 64 nt, Human
guggcuucacccaucacugguggguugcaggaacagcacccaggacucugaggagggacagaga

SEQ ID NO: 48648 - RNA, 64 nt, Human
ccagcuucaguguuaagcucacccuguucuuugaagcacccaugucaguauuagaagaauaggc

SEQ ID NO: 48649 - RNA, 64 nt, Human
acagacuuguauagaggagaaaaaauguacagagagcacccaggagguacacauacuaaaguga

SEQ ID NO: 48650 - RNA, 64 nt, Human
guauuuauaaacuuuguaccacaagagagaguguagcacccauuuuacagugccaugcacauca

SEQ ID NO: 48651 - RNA, 64 nt, Human
acuugcucagcuuugggaugugggugggaacuggagcacccagagaaaacccauacagacagug

SEQ ID NO: 48652 - RNA, 64 nt, Human
gucacgccugcgucccaccguggggcucucuuggagcacccagggacacccagcgugcaacagc

SEQ ID NO: 48653 - RNA, 64 nt, Human
ugugugaauaugcauaaccagagugaccccccccagcacccagcaugcccggcugugccccucu

SEQ ID NO: 48654 - RNA, 64 nt, Human
auggucuucacuuggucugacuuguaccaauucuagcacccacugaaaaacaaguugaguagag

SEQ ID NO: 48655 - RNA, 64 nt, Human
ggagcagcaggguacaugggugggagguucauucagcacccaccagucagguauguucugagug

SEQ ID NO: 48656 - RNA, 64 nt, Human
cggucugggcccguugccaccgacucccaccuccagcacccaugcccgcugcaccgcugccauc

SEQ ID NO: 48657 - RNA, 64 nt, Human
uggccacucuggagaaagaaacccaaggaaagugagcacccaacuggaugccaagacacccggg

SEQ ID NO: 48658 - RNA, 64 nt, Human
cauuucaaugaaccuuaauaguguuccuuugaggagcacccaggagaauaucuggucauagauc

SEQ ID NO: 48659 - RNA, 64 nt, Human
cagacaaguaaaauugcaggugauuugauaauuaagcacccauaccauuuauaacuucugaauu

SEQ ID NO: 48660 - RNA, 64 nt, Human
ggcaaugagaccuggcagggcagaguacaagcccagcacccagugucccagccuuacugggucc

SEQ ID NO: 48661 - RNA, 64 nt, Human
uuaacucaacggagccagucucaacucugcugggagcacccacaggucucugugggggagacag

SEQ ID NO: 48662 - RNA, 64 nt, Human
gcuggggccccuaagcuccuagguuuuccuuccaagcacccagcccuccugcuccaagagggau

SEQ ID NO: 48663 - RNA, 64 nt, Human
gcuaaagaaagggagaucaauggaguugccuaccagcacccauucucuuuuaguucagcuggcu

SEQ ID NO: 48664 - RNA, 63 nt, Human
cugagggcaagacaagcuagggaggggggacucagcacccacaccuccuccaacaagcuccug

SEQ ID NO: 48665 - RNA, 64 nt, Human
uguagaauuuuugucuuaaaaagaccacauacccagcacccaugaaauaaaagauucaucugua

SEQ ID NO: 48666 - RNA, 64 nt, Human
acuaaugaguguuugcgugugguguuucuaugcgagcacccauucucaauuuuuuuuuuuuuuu

SEQ ID NO: 48667 - RNA, 61 nt, Human
agcugggggaagaaaccugacaauaugacagagcacccacugcccaagacucagccauaga

SEQ ID NO: 48668 - RNA, 64 nt, Human
gaagacuuuaucauguuccuaaaaaucuguggcaagcacccaucguauuauccaaauuuuguug

SEQ ID NO: 48669 - RNA, 64 nt, Human
uuuuaauguaagaguuacucugcaaucuaagcaaagcacccaacaaugguaaauguuuuuuaaa

SEQ ID NO: 48670 - RNA, 64 nt, Human
ggcugguguggccgccacagagaguguuaccaccagcacccagaccgaacccccaccggccaaa

SEQ ID NO: 48671 - RNA, 64 nt, Human
guuggcuguggucacaaaaguaguuaauugugucagcacccaaauaaacaucuaacagguuucu

SEQ ID NO: 48672 - RNA, 64 nt, Human
gugucugccccucggcccucaggguggggcacuuagcacccagaagggaccaaaagcagggcau

SEQ ID NO: 48673 - RNA, 64 nt, Human
cccucccagcccacaccagugcucucggccacugagcacccagacucaggcuuggguuccccag

SEQ ID NO: 48674 - RNA, 64 nt, Human
uccgaguugagacaaauuacgaccacuggaagccagcacccaaggaagaugaccggagguaggc

SEQ ID NO: 48675 - RNA, 64 nt, Human
agagauacccauacacagaagcaccuuggcauagagcacccaggcaucgaccucuuccaggaga

SEQ ID NO: 48676 - RNA, 64 nt, Human
ugugugaaucagauuugggcaucuguuuuuuccaagcacccagggaauucugaugcauuccaaa

SEQ ID NO: 48677 - RNA, 64 nt, Human
aguaguuguucugaaaugucaguucugauauggaagcacccauuaugcgcuguggccacuccaa

SEQ ID NO: 48678 - RNA, 64 nt, Human
auaaguacaaaguaaaucuugaacagguucacuaagcacccacccugugaaaaguauuauggaa

SEQ ID NO: 48679 - RNA, 64 nt, Human
gacaaggagugaagcgcccacccagcggauggacagcacccaccuggguuuacucaagggugug

SEQ ID NO: 48680 - RNA, 64 nt, Human
gcaauacucuguggaggucugguggggcugggggagcacccaggcggaucugcaagcaccucgg

SEQ ID NO: 48681 - RNA, 64 nt, Human
ggggagcacccaggcggaucugcaagcaccucggagcacccaccgcugggucugcggccuaagg

SEQ ID NO: 48682 - RNA, 64 nt, Human
cucacagccuggcuugagucaacaggaacaccauagcacccacaaauacuucuacuugaaucau

SEQ ID NO: 48683 - RNA, 64 nt, Human
cauguagccccagucagaaguucuggguggugccagcacccaguccucugccuccauuuaauuu

SEQ ID NO: 48684 - RNA, 64 nt, Human
cccagcaagcaccucccagccugccuuucggagcagcacccaggaggggaugccgcgcuccagc

SEQ ID NO: 48685 - RNA, 64 nt, Human
uuacccuaagccccuguguuuuugucugguugauagcacccaaagcccagcgucuaucaccuug

SEQ ID NO: 48686 - RNA, 64 nt, Human
ucccaugcuugacucccgagaguacuggcagugcagcacccaucauugacguaagcggcugucu

SEQ ID NO: 48687 - RNA, 64 nt, Human
ccuacccugcccugccugaagcucccccccugccagcacccagcaucuccuggccuggccugac

SEQ ID NO: 48688 - RNA, 64 nt, Human
aaggacagcuucugagugugguaauugugccucuagcacccagccuuucaaagcccaccugaaa

SEQ ID NO: 48689 - RNA, 64 nt, Human
cuagaggccaggccuuguggguuucuaucugcuaagcacccagcagguuggggccugggacuca

SEQ ID NO: 48690 - RNA, 64 nt, Human
uucuucuucuuaaagagagcugcuuaccauacauagcacccacagugucucccuucucuucuac

SEQ ID NO: 48691 - RNA, 64 nt, Human
ucuugcuucagccucccaaguagcugagacuacaagcacccaccaucacacccagcuaauuuug

SEQ ID NO: 48692 - RNA, 64 nt, Human
ggucccucuggggagaugggacacggcuccuggcagcacccaggagccccccaggcugccugcc

SEQ ID NO: 48693 - RNA, 64 nt, Human
cacaagugccuauauaaugauaaaacauauccaaagcacccaaaccugugauuccagaaaagua

SEQ ID NO: 48694 - RNA, 64 nt, Human
ugcaccccugggagaggaagccaggcaccgauagagcacccagccccaccccuguaaauggaau

SEQ ID NO: 48695 - RNA, 64 nt, Human
cugugcuuugcccacaugcccuuggugacagcugagcacccagcucugucuugguagguuuggg

SEQ ID NO: 48696 - RNA, 64 nt, Human
aagaagcuuuauuucuagcuuuuuaauuaagcaaagcacccauuucaauguguauaaauugucu

SEQ ID NO: 48697 - RNA, 64 nt, Human
auauuccaucuuuuuaacauaaaauguaaagcuuagcacccaucauuaauuuaugucucuguuu

SEQ ID NO: 48698 - RNA, 64 nt, Human
ucuuagaugcgaucugacuccugugugacuguggagcacccagggacgugguuuuagagucuac

SEQ ID NO: 48699 - RNA, 64 nt, Human
gcccaccugugcucaggaugcagcccugggauccagcacccauggaagcuucugcugggauggu

SEQ ID NO: 48700 - RNA, 64 nt, Human
gggagcucugcucugagcuugccacacugcugagagcacccacuguccugaccagagucucagu

SEQ ID NO: 48701 - RNA, 64 nt, Human
acguuccuaaacacugagggggaagacagccaauagcacccauuaaaagaaauaccuaaauaaa

SEQ ID NO: 48702 - RNA, 64 nt, Human
cgagccaggcacgggggaccacagggcugccgugagcacccacccugguucuccaggccccucu

SEQ ID NO: 48703 - RNA, 64 nt, Human
auauacugugcacugaaaaaauauccaucuacacagcacccaaggggagggcugggggcaccgg

SEQ ID NO: 48704 - RNA, 64 nt, Human
ggccgcaagcgcagggaggaugccacagccccacagcacccaggcuccauggggaagugcuccc

SEQ ID NO: 48705 - RNA, 64 nt, Human
cgcuuccuaucaaaauauucagagacucgagcacagcacccagacuucaugcgcccguggaaug

SEQ ID NO: 48706 - RNA, 64 nt, Human
cucagcuuucucccuacugccuuuucagacuuggagcacccaaggucuccaaugaaaguuuucu

SEQ ID NO: 48707 - RNA, 64 nt, Human
uucuuuuuuaucaccuuugaauuuggaaauuuugagcacccaagcucuucuguaccuauuuaaa

SEQ ID NO: 48708 - RNA, 64 nt, Human
caggaagugcucuguggcuaaaacaaguccaaaaagcacccacagagaggcaaugggugagaca

SEQ ID NO: 48709 - RNA, 64 nt, Human
gccuucuuggaggagcuugggugacagccaggugagcacccagaccccagacccucaugugcug

SEQ ID NO: 48710 - RNA, 64 nt, Human
aauuuuguguuuuucucauauaaguuuucuccagagcacccaccuucucuuccuucuuggucug

SEQ ID NO: 48711 - RNA, 64 nt, Human
cucugccucagccucccgaguagcugggauuacaagcacccaccacuacacucagcuaauuuuu

SEQ ID NO: 48712 - RNA, 64 nt, Human
cugccauccauuggacguguuugggucaccucagagcacccagcaggagaggcuccugguguag

SEQ ID NO: 48713 - RNA, 64 nt, Human
ugacugugauucacacuaucuagaacacuuuaccagcacccagggacauggacuuggguguucu

SEQ ID NO: 48714 - RNA, 64 nt, Human
gcugcggaggacaggaagcacccccucaauagccagcacccacagugagcugagcacuuacagc

SEQ ID NO: 48715 - RNA, 64 nt, Human
gagaaguguuaugacauuagugcccugauugggcagcacccacggcuacaguaucaggucaggu

SEQ ID NO: 48716 - RNA, 64 nt, Human
ugauuaguaaaauuaugucucauuuuauuuuuucagcacccauaccacaauuaauauuaggcug

SEQ ID NO: 48717 - RNA, 64 nt, Human
uccagugcacucaaguuuggccaagggacuccacagcacccagaagacugcaugccucaagguu

SEQ ID NO: 48718 - RNA, 64 nt, Human
uuccuuucucccaugauuccucuggacugcacacagcacccacaaccagccccaugcaugcugc

SEQ ID NO: 48719 - RNA, 64 nt, Human
uccguugugacgaaugugauuggaacauuuggggagcacccagagggauuucucagugggaagc

SEQ ID NO: 48720 - RNA, 64 nt, Human
ggccacuccccagugcucccgugcagggagaggaagcacccaguuugagaguguacccagccag

SEQ ID NO: 48721 - RNA, 64 nt, Human
ccuagggcuugacccugguacccagcccagccuuagcacccagcaugugaccccacuccugauc

SEQ ID NO: 48722 - RNA, 64 nt, Human
uuucaaaccacaauauccagcaaaaugucuccugagcacccagaacuccauaccaucggccggg

SEQ ID NO: 48723 - RNA, 64 nt, Human
aaaauuuguucgaaugccuuauagccuuccucacagcacccaggauugugacugacucugcauu

SEQ ID NO: 48724 - RNA, 64 nt, Human
ucaacggaauggccucuccacaccagggauccuuagcacccaaccggucugccuuuaauuuuac

SEQ ID NO: 48725 - RNA, 64 nt, Human
gggcaugagguggucaccaggauugagcuuccucagcacccaguggguaauacuugcuuccacu

SEQ ID NO: 48726 - RNA, 64 nt, Human
cuccugccucagccucccuaguagcugggacuacagcacccaccaccacacccagcuaauuuuu

SEQ ID NO: 48727 - RNA, 64 nt, Human
cugguuguauaaacggugcaaacaaugucgccacagcacccacgcgguuugcauucuuuuggaa

SEQ ID NO: 48728 - RNA, 64 nt, Human
gaugcugggggggcccagccaucccccuccccccagcacccacaauuuucaguccccuccccuc

SEQ ID NO: 48729 - RNA, 64 nt, Human
cacccuggccuucgcgcuggccgacacugucuucagcacccaggacuuccucacccucuucuau

SEQ ID NO: 48730 - RNA, 64 nt, Human
ccccccguagcaggggcaugacuguuucccaaccagcacccaaagacgggcgccauugccaagu

SEQ ID NO: 48731 - RNA, 64 nt, Human
ccugggaaggagagcuugcuuuuguugcuucagcagcacccauguaaauaccuucuugcuuuuc

SEQ ID NO: 48732 - RNA, 64 nt, Human
uucguaugcacucccuugaggauggagagcagccagcacccaccugguacugacccaggaccau

SEQ ID NO: 48733 - RNA, 64 nt, Human
cuguccucugacacagagagcugcccugccuaggagcacccaagccaggcagggggucuggcag

SEQ ID NO: 48734 - RNA, 64 nt, Human
aaacccaagggaggaguccugguccugcucccucagcacccaaaaggggcagaaccugaguuga

SEQ ID NO: 48735 - RNA, 64 nt, Human
ugugucgcuucucacuccucaaagcccccucaggagcacccaguccucagcugcucucuuaggu

SEQ ID NO: 48736 - RNA, 64 nt, Human
ccgggcagagcccaacccccuccacgggggucccagcacccacuuuucuaaucaugaaugaaca

SEQ ID NO: 48737 - RNA, 64 nt, Human
caucucguaaccagagaccagcacaugucagggaagcacccagugucggcuccccauccaaauc

SEQ ID NO: 48738 - RNA, 64 nt, Human
gagcucuccugcaggguggagggcauuguuucccagcacccaggcagugucuugcugguguguc

SEQ ID NO: 48739 - RNA, 64 nt, Human
ucucuugccucugcuugccuccuacugcacacucagcacccaggacuggaaucaccgacuacug

SEQ ID NO: 48740 - RNA, 64 nt, Human
uuuugacuuccacugacucauucugaacccccuaagcacccaggccagaggcaagaaccugggc

SEQ ID NO: 48741 - RNA, 64 nt, Human
cucggagagcagcagcaccaaccacagcaucgggagcacccagagcacccccugcuccaccagc

SEQ ID NO: 48742 - RNA, 64 nt, Human
guuacuguagucacauaguggcacaaccaggccuagcacccaaggcccucaaaugaauuccuca

SEQ ID NO: 48743 - RNA, 64 nt, Human
gcacaugagcacccaccccacagcaccaucaggcagcacccaugggcuccaccagcccagcucu

SEQ ID NO: 48744 - RNA, 64 nt, Human
caggucuccacugccaagcaggacuuggcacaugagcacccaccccacagcaccaucaggcagc

SEQ ID NO: 48745 - RNA, 64 nt, Human
cuuaaaggcagagaagcgaggcggaugcccuggaagcacccagcaucacacccaggcuugugcg

SEQ ID NO: 48746 - RNA, 64 nt, Human
gggucacugccaccugugcccaugggcaccccagagcacccacugugaccacugcaguucucuc

SEQ ID NO: 48747 - RNA, 64 nt, Human
gugguuaagcauuccuuucucuucagugcccagcagcacccaguguuggucuguguccaucagu

SEQ ID NO: 48748 - RNA, 64 nt, Human
augauucccacagccagcucuuggcuccaagaugagcacccacaggaagccgacccaggccuga

SEQ ID NO: 48749 - RNA, 64 nt, Human
ugugacuagacagggaagccuugugggugugagcagcacccauccaccguccccucccagggag

SEQ ID NO: 48750 - RNA, 64 nt, Human
cugccuuagagaugaggcucagacaaacgaccuuagcacccauagccuaugccaugagcacugg

SEQ ID NO: 48751 - RNA, 63 nt, Human
gcagcagcucccccagcuagagcagguccugccagcacccagcaacuuggcaaagcaaccagg

SEQ ID NO: 48752 - RNA, 64 nt, Human
ugggacuggucguguuugugcuuuucuccaagucagcacccaaaggucaaugcacagagacccc

SEQ ID NO: 48753 - RNA, 64 nt, Human
gucuagcuuuauuuagagggucaggaagucaaagagcacccaggaccaucuuggcaauuaauag

SEQ ID NO: 48754 - RNA, 64 nt, Human
uuaacacaaaacagauaacacuaaagacggguucagcacccaccuuucuuuagccagcugauca

SEQ ID NO: 48755 - RNA, 64 nt, Human
aggaggaagaauaaggaggaaaaccaaaaccccaagcacccauuaaacaaguccuggcaggacu

SEQ ID NO: 48756 - RNA, 64 nt, Human
ccgccaaugugagggacuucuguuuaccuuccgcagcacccagcaucaaaggacggacuucagg

SEQ ID NO: 48757 - RNA, 64 nt, Human
gccucgggacucaguggacaccaaagucaagaccagcacccaccacgggcccugccagccucug

SEQ ID NO: 48758 - RNA, 64 nt, Human
uuucuacuuggggggaaaaaaguccucauguagaagcacccacuuuugcaauguuguucuaagc

SEQ ID NO: 48759 - RNA, 64 nt, Human
gaagccugaagacucgccccacccaccacugcccagcacccaguguccucccgugccccucccc

SEQ ID NO: 48760 - RNA, 63 nt, Human
cagccauaguugagcccugauugccacagacccagcacccagcaaaucccucucuaccuccca

SEQ ID NO: 48761 - RNA, 64 nt, Human
aguuagggaggaagaggcaggcgaugagucuaguagcacccaggacggcuuguagcuaugcauc

SEQ ID NO: 48762 - RNA, 64 nt, Human
aauggaucccacuguuccucuuugccacagagaaagcacccagacgccacaggcucugucgcau

SEQ ID NO: 48763 - RNA, 64 nt, Human
acugcaucugacgugugucuucuugagacaagauagcacccaugaauuacaucaugagguaugc

SEQ ID NO: 48764 - RNA, 64 nt, Human
guuauuugcaggcagggaugggcuuguaccugacagcacccaccccuguguggcccccaggccc

SEQ ID NO: 48765 - RNA, 64 nt, Human
caggucuccaggacaagagcaguugucugccaugagcacccauccaggauggagaauaagggcu

SEQ ID NO: 48766 - RNA, 64 nt, Human
ccaccuauccccaguagauggcccugccaagaccagcacccagcaagauuauagaggaagaaau

SEQ ID NO: 48767 - RNA, 64 nt, Human
ggcagagccagggcuaggcccuggugguguguggagcacccaggcagacccaguccugguuggg

SEQ ID NO: 48768 - RNA, 64 nt, Human
caccgaugcccaccguggucuuugaacucacccaagcacccaccaggcaggcuacaagugaggc

SEQ ID NO: 48769 - RNA, 64 nt, Human
aauuuuauaaucugcagcucuauuccgagcccuuagcacccauuccgaccauaguauaaucaua

SEQ ID NO: 48770 - RNA, 64 nt, Human
uaauuaagugacagguccaagugugacauccuucagcacccagggacaagagaggggaaagaug

SEQ ID NO: 48771 - RNA, 64 nt, Human
ccaaaccaugacuuccacccuggagcuugaauccagcacccaccucaugucuguucucauaagu

SEQ ID NO: 48772 - RNA, 64 nt, Human
uuuuggcgucuuuugggucggcccaugugguuugagcacccagccaggcggucucuuuagagga

SEQ ID NO: 48773 - RNA, 64 nt, Human
uacucaauguguacuuuuggguucacagaagcacagcacccaugggaaggguccaucucagaga

SEQ ID NO: 48774 - RNA, 64 nt, Human
agacuucugucuguaucuaucucacacugcaccaagcacccacugugcaccaggcacuaagucu

SEQ ID NO: 48775 - RNA, 64 nt, Human
uggaaaguucggcuaguguucguguguuugucguagcacccagagccuccaccaaacccucucc

SEQ ID NO: 48776 - RNA, 64 nt, Human
ccccuuccuuucccagaagccacuggccccccauagcacccagugcauccuuuuuacaagugga

SEQ ID NO: 48777 - RNA, 64 nt, Human
caccuccagcacaaucccagugaaaaaggugugaagcacccaccauguucuugaacaaucaggu

SEQ ID NO: 48778 - RNA, 64 nt, Human
uuucauggccucugcuuggggugggggagucagcagcacccauuuguacauauaggucauucau

SEQ ID NO: 48779 - RNA, 64 nt, Human
ccucacuucucucugucuauaccugccccaucugagcacccauugcucaccaucagaucaaccu

SEQ ID NO: 48780 - RNA, 64 nt, Human
cccucacuucuucucucucucucuauaccaucugagcacccauugcucaccaucagaucaaccu

SEQ ID NO: 48781 - RNA, 64 nt, Human
cuuccucccuaguccggguuccauucuuuucaccagcacccaucgcccaagggguaccgagggg

SEQ ID NO: 48782 - RNA, 64 nt, Human
gagcuacacgacuggaugugcacucauuucgaagagcacccacuguuugagcgugugccucugg

SEQ ID NO: 48783 - RNA, 64 nt, Human
cccgugggacucucacccuucuugcucauucuccagcacccauuccuacuuuagucucuuugaa

SEQ ID NO: 48784 - RNA, 64 nt, Human
gagcugggagaacugcuguguaccucuugcugccagcacccaacagccuugccguggggaccuu

SEQ ID NO: 48785 - RNA, 64 nt, Human
uaagauuucuuccagggaaugccagcaaucaggcagcacccagcugugggggcagugggguggg

SEQ ID NO: 48786 - RNA, 64 nt, Human
guuuuucuuucuggcugagauuuccgugcaagacagcacccaauagacuauuuagaguugacau

SEQ ID NO: 48787 - RNA, 64 nt, Human
ccgcccccgcgacuggagacggcaucucguucacagcacccacccucuuaccugauaaguucca

SEQ ID NO: 48788 - RNA, 64 nt, Human
uggggagagggaugaaggcucggcggcccagggcagcacccaaggucugggcaaacucagcauu

SEQ ID NO: 48789 - RNA, 64 nt, Human
uagcuuuauaaggagauugucuauuuacaaaaggagcacccagugaauuggcacaagaacuaug

SEQ ID NO: 48790 - RNA, 64 nt, Human
ucaguaaagugcugaaaacuguauauuuagcaguagcacccaaaaccaagccuuuaaccccaac

SEQ ID NO: 48791 - RNA, 64 nt, Human
agcaucuaugccacaugcguugauggaaggucauagcacccacucacuuagaugcuaaagguga

SEQ ID NO: 48792 - RNA, 59 nt, Human
aagaccugcagaguguaugacacauaaccagcacccaagaaaugucuaccgaggaauua

SEQ ID NO: 48793 - RNA, 64 nt, Human
auaugcuaacauagcuauggaggaauugagggcaagcacccaggacugaugaggucuuaacaaa

SEQ ID NO: 48794 - RNA, 64 nt, Human
gugggcaccagcagcaagggcugccaugggauacagcacccaucuacaaagaccucuauuacau

SEQ ID NO: 48795 - RNA, 64 nt, Human
cccacccccuuuuuaaagcacuuacuguuuucagagcacccauaucccacccuggugagaaggc

SEQ ID NO: 48796 - RNA, 64 nt, Human
aaugaucauguuauuguguauugccguggacuucagcacccagacaagccaaaaacagagacag

SEQ ID NO: 48797 - RNA, 64 nt, Human
gugcagcugucuccugucaugcaggacaccuaggagcacccaggcuugcccagcaaacccugcg

SEQ ID NO: 48798 - RNA, 64 nt, Human
cucuaaacauccuacagagaagguuccaaagcugagcacccaucacccuaggugugcaccagac

SEQ ID NO: 48799 - RNA, 64 nt, Human
uggaugugcggacaagcaggguggacuccccaggagcacccaggcuuggguggagaagcuguug

SEQ ID NO: 48800 - RNA, 64 nt, Human
ccuaccuccuccacuagccgcaggaagggccuccagcacccacaacugcccuuccucuugaugc

SEQ ID NO: 48801 - RNA, 64 nt, Human
gugcagacuugcgcuucucugcaccuuaucccuuagcacccaaacauuuaauuucacugguggg

SEQ ID NO: 48802 - RNA, 64 nt, Human
gcaaccccacugcucuggccaaugggacugugcaagcacccaagcagaagggagacugagugcc

SEQ ID NO: 48803 - RNA, 64 nt, Human
agaggacauucucaguggaaagaguuugaucugcagcacccagaagagaagccaaacucggugu

SEQ ID NO: 48804 - RNA, 64 nt, Human
ugacagcuuuaucuccccaggagcagcaucucugagcacccaagccaggugggugguggcucuu

SEQ ID NO: 48805 - RNA, 64 nt, Human
ccuugugacaucucugaucagguuggggugccccagcacccaguaccaguuugggguuugggaa

SEQ ID NO: 48806 - RNA, 64 nt, Human
uggugcaggugguggcagcuggagggacccaugcagcacccaggucagagcagacccuccccug

SEQ ID NO: 48807 - RNA, 64 nt, Human
uccugccucagccuccuggguagcugggauuacaagcacccaaccacgcccagcuaauuuuugu

SEQ ID NO: 48808 - RNA, 50 nt, Human
uggccugguacuacaugugaagcacccaucaugccacaccgguacccucc

SEQ ID NO: 48809 - RNA, 64 nt, Human
uuuuuucccuuucuuuacaccauccucucccauaagcacccaugucuuugaauaugaauguauu

SEQ ID NO: 48810 - RNA, 64 nt, Human
cucagcccuggauuuccugcugccauccucacccagcacccacaacuagcgccugggcagggca

SEQ ID NO: 48811 - RNA, 64 nt, Human
cuuggaguccucucaggcaguugggaaaaugcaaagcacccaaaccacuaacacauccaacagc

SEQ ID NO: 48812 - RNA, 64 nt, Human
caugcacgcaccucacugccaggccauuaaaaucagcacccagcaugcuggaggugacguggcc

SEQ ID NO: 48813 - RNA, 64 nt, Human
gcuuggggagaccaguuucuggggagcuuccaagagcacccaccaagacacagcaggacaggcc

SEQ ID NO: 48814 - RNA, 64 nt, Human
agggcugaggauggggcuccuauccacccuggccagcacccagcuuagugcugggacuagccca

SEQ ID NO: 48815 - RNA, 64 nt, Human
gauuuguggggaaagcugcuggugugaccagcugagcacccagccaggagaccugcagcccugc

SEQ ID NO: 48816 - RNA, 64 nt, Human
cgucaccccacccgaugaccugcaugaagccagcagcacccagagccacuccugcugcccuaga

SEQ ID NO: 48817 - RNA, 64 nt, Human
ggccgugucuaauaaaaaguauuugaaccuugggagcacccaagcuugcucauguggcaacaug

SEQ ID NO: 48818 - RNA, 54 nt, Human
ggagcuacagacccuucugaucacagcacccaggagcuugucuccaggaaggcg

SEQ ID NO: 48819 - RNA, 64 nt, Human
acauuugggauuccccaucacuugucaugcccucagcacccagcuugugccauugggcauugau

SEQ ID NO: 48820 - RNA, 64 nt, Human
cuuggagcaaaacuccugagcuagacagcacagcagcacccauccccugccagagcccuuccgu

SEQ ID NO: 48821 - RNA, 64 nt, Human
augauucaucugcuuuaaucagugugauuaaugcagcacccauugccccgggaaccguuucugc

SEQ ID NO: 48822 - RNA, 64 nt, Human
ucuggcuccaucugaguccccugggagagagcccagcacccaagauccagcaggggacaggaca

SEQ ID NO: 48823 - RNA, 64 nt, Human
aacaagcuguggucugggguaacagccucuucccagcacccaccugccagcccugcuugccugg

SEQ ID NO: 48824 - RNA, 64 nt, Human
cagcacuucccugccucccccaggccucaggcccagcacccaguuccuccucacauggcaggug

SEQ ID NO: 48825 - RNA, 64 nt, Human
aguuguaaaguggggauuaggcacgugacaguauagcacccauuugaauuuaaauaaaagugaa

SEQ ID NO: 48826 - RNA, 64 nt, Human
caccccaugcugcugcugccugggucucugcucuagcacccagaggcaugacaggcccugcuca

SEQ ID NO: 48827 - RNA, 64 nt, Human
ugucuguggacccccccaggagcugcuaauuggcagcacccacucagccauucucuacccaucc

SEQ ID NO: 48828 - RNA, 64 nt, Human
uggaggcccaaggucggggaggggagggaaaagcagcacccacagggagcgccugcgagguuuc

SEQ ID NO: 48829 - RNA, 64 nt, Human
ccuuucaucuuccccgugcauuguagauggaaggagcacccaugccauucacaucuagacuuug

SEQ ID NO: 48830 - RNA, 64 nt, Human
gagggauuucacucuucuucccagguucuucugaagcacccacacaaaaugcacacucugcgau

SEQ ID NO: 48831 - RNA, 64 nt, Human
gcaucgcccgccccuucccccaaaugcugcuugcagcacccacccuaaagcccccuccaaauag

SEQ ID NO: 48832 - RNA, 64 nt, Human
uguccaucuuucucagacggggcucugucuggggagcacccacaggcugccuuuggggucccag

SEQ ID NO: 48833 - RNA, 64 nt, Human
accuggaagugccaccuggaagugucucuggaagagcacccaccacuguucagccuuccccugc

SEQ ID NO: 48834 - RNA, 64 nt, Human
uccccaauuacuccccugaaucaauguacaaaucagcacccacauccccuuucuugacaaauga

SEQ ID NO: 48835 - RNA, 64 nt, Human
gggaggcugcacuggagccacaggcaggggugagagcacccacugaauugacaugacccucugu

SEQ ID NO: 48836 - RNA, 64 nt, Human
uucggagcugacacugacagcuucaguuucccccagcacccaggagagccuugcugugucuguc

SEQ ID NO: 48837 - RNA, 64 nt, Human
cucggucagcugggaggggcccgccccggcacaaagcacccaugggaauaaaggccaagccgcg

SEQ ID NO: 48838 - RNA, 64 nt, Human
aucguuuguguucuuuguggaaauguccuuuagaagcacccaugaaguaguguguucagacugu

SEQ ID NO: 48839 - RNA, 64 nt, Human
uggcggucacucuccgcugaggacccagggcgucagcacccagcacugccacauguccaccaag

SEQ ID NO: 48840 - RNA, 64 nt, Human
uuacguucaggcccuguccuaaacccagccgucuagcacccagugaucccaugccuuugggaau

SEQ ID NO: 48841 - RNA, 64 nt, Human
uuugaacccuugcuugcaauaggugugcgucagaagcacccaggacuuccauuugcuuuguccc

SEQ ID NO: 48842 - RNA, 64 nt, Human
agcugaguccccuccccguaaccucugcaaggccagcacccaccaucacuaccugcaccugcug

SEQ ID NO: 48843 - RNA, 64 nt, Human
uuaaaucugccuggcguccccucccucugucuucagcacccagaggaggagagagccggcaguu

SEQ ID NO: 48844 - RNA, 64 nt, Human
cgucaguaucaggccugccagacggcacccacccagcacccagcaacuccaacuaacaagaaac

SEQ ID NO: 48845 - RNA, 64 nt, Human
gaaugguauuuuuaauauuuguacacauucuuugagcacccagguacccaagccaauaaggaaa

SEQ ID NO: 48846 - RNA, 64 nt, Human
gaugacaagcugugacuccagcugggggcgccacagcacccaccaccugccgccuucagacucu

SEQ ID NO: 48847 - RNA, 64 nt, Human
aaaugaaauaauacgaaaugaccucuccagcacgagcacccacuccuaguugccacauuggagc

SEQ ID NO: 48848 - RNA, 64 nt, Human
agauggcagaaucuaaaucaaguauuuugaaggaagcacccaucuucacuuggugcugccauca

SEQ ID NO: 48849 - RNA, 64 nt, Human
gccauggugucucgauggacggcagccaggauggagcacccaugggucucacggccaugcuuca

SEQ ID NO: 48850 - RNA, 64 nt, Human
uaacuauccuaaauauauaugcacccaauacaggagcacccagauucauaaagcaaguccugag

SEQ ID NO: 48851 - RNA, 64 nt, Human
aacaucacacacaggugggggggccugauagcccagcacccaugauacagggccuaccaaugcu

SEQ ID NO: 48852 - RNA, 64 nt, Human
uguagaacccugggguguggcuaacggccccuccagcacccauagccaggucuuccuggcccuu

SEQ ID NO: 48853 - RNA, 64 nt, Human
uaguaccuguuauuuauuaccuggaggccuguccagcacccacccuacccccauaaagcauugu

SEQ ID NO: 48854 - RNA, 64 nt, Human
gcuuugguggcacguaagcuccuugucugucuccagcacccagaaucucauuaaagcuuauuua

SEQ ID NO: 48855 - RNA, 64 nt, Human
cuugauauuagauaacuccaacuucuggcuguagagcacccagccaagagaauaagcagugcuu

SEQ ID NO: 48856 - RNA, 64 nt, Human
acugugguagccaucuucguaaauuuaaacuuugagcacccacagugggguauucuucauaagu

SEQ ID NO: 48857 - RNA, 64 nt, Human
ggagagcaagaauaaucugauuuuccugggggccagcacccaaauaagccuggcaugcaguggc

SEQ ID NO: 48858 - RNA, 64 nt, Human
guguccccucgggcccaucugugucccaugucccagcacccaggccucucuccaggucuccuuu

SEQ ID NO: 48859 - RNA, 64 nt, Human
gccacagccauagccccagcuagugaccccaguuagcacccaccguccagagggcucccugcag

SEQ ID NO: 48860 - RNA, 64 nt, Human
ccuuccugcagcgccugccgccccggggacucgcagcacccacagcaccacguccucgaauucu

SEQ ID NO: 48861 - RNA, 64 nt, Human
ucucaguccccuggcccggccagccaccguccccagcacccaagcaugcaauugccuguccccc

SEQ ID NO: 48862 - RNA, 64 nt, Human
gaaaaucggcaaagaccacccuucccuaaacccaagcacccaaugaugcaaaaaacaaaaacaa

SEQ ID NO: 48863 - RNA, 64 nt, Human
cucccaaagugcugggauuacaggugugagccacagcacccaaccuuuuuuuccccgccgcacc

SEQ ID NO: 48864 - RNA, 64 nt, Human
cagcugcacccuagcucccugcuccagggaugugagcacccacucccugugcuaguuagugccu

SEQ ID NO: 48865 - RNA, 64 nt, Human
ucccgaggaagugaaugggaccgugguuugcucuagcacccaucucuacgcgcuuucuuguccc

SEQ ID NO: 48866 - RNA, 64 nt, Human
ucucaugagcucccccaucccugcuacagaacacagcacccauggcgccugcaguggacuggcc

SEQ ID NO: 48867 - RNA, 64 nt, Human
ugagcuccacaacaucuaccagauauagcagacaagcacccauggaggcagguuucgggccuga

SEQ ID NO: 48868 - RNA, 64 nt, Human
guccccaaagcacuggggcaggggccagagcagcagcacccagugcucccuccucuacucugac

SEQ ID NO: 48869 - RNA, 64 nt, Human
gccccccaauccccacguugagcugucuagcaugagcacccacccccacagcgcccugcacccg

SEQ ID NO: 48870 - RNA, 64 nt, Human
gagccacagucagagaguagauugugcaugugugagcacccagcuacuggggacgggggcucuc

SEQ ID NO: 48871 - RNA, 64 nt, Human
uguugcgggaggggaggacuggggcuggaaguccagcacccagggaagaucuguccuccuguuc

SEQ ID NO: 48872 - RNA, 64 nt, Human
auccugucuuuccuuuccuccucucaguguccucagcacccacaaggaauuuuccuaucacugu

SEQ ID NO: 48873 - RNA, 64 nt, Human
ucgcccucccaggccacuaggcucugacucuuccagcacccauggaugugccagaggccucugg

SEQ ID NO: 48874 - RNA, 64 nt, Human
ggauccaguagcccuuuccacauacuguggcuacagcacccagcacugugcuguuguugucuga

SEQ ID NO: 48875 - RNA, 64 nt, Human
cacccgaccccagcaguggugcaggacagcugccagcacccaccuggcccuccuccuuuuccac

SEQ ID NO: 48876 - RNA, 64 nt, Human
cucagacccaccacaucgccccagaggcuuuuccagcacccaugauguuucggacugaccuaaa

SEQ ID NO: 48877 - RNA, 64 nt, Human
ccuaaguuccaacuuuguuggacuccuuaaaauaagcacccaugaaagccagccagcccuuccu

SEQ ID NO: 48878 - RNA, 64 nt, Human
uacugggggaagaaccuguaagcagggugugaggagcacccaggcuggguagggacugcaugcc

SEQ ID NO: 48879 - RNA, 64 nt, Human
gaggcgacgcaccucgaggguguccgccggccccagcacccaggggacgcgcuggaaagcaaac

SEQ ID NO: 48880 - RNA, 64 nt, Human
cugccgcggggcacugcuaugugcagggacagccagcacccagcccaucaccacucccugggcu

SEQ ID NO: 48881 - RNA, 64 nt, Human
cucccuugcccuucccccgcccccggacggucacagcacccaaaccgcaggcccugcucuggca

SEQ ID NO: 48882 - RNA, 64 nt, Human
cucaggacccguguccucagagcaccacacacugagcacccagagacagcgggccuggcagcgg

SEQ ID NO: 48883 - RNA, 64 nt, Human
ucagguuggcuuauuuuggguucaggccuggcguagcacccacaaguggcagacauaucacaag

SEQ ID NO: 48884 - RNA, 64 nt, Human
uccuucugccucccccuguaaccugugugaacccagcacccaugugaacugguccgugcacagu

SEQ ID NO: 48885 - RNA, 64 nt, Human
cgaccucugcuaggggcuggagaacagagcucagagcacccaguguagggaaacacagccagac

SEQ ID NO: 48886 - RNA, 64 nt, Human
cuuguguugaccagauguuccugagucuggagcaagcacccaggccagaauaacagagcuuucu

SEQ ID NO: 48887 - RNA, 64 nt, Human
gggucagaagugccaagucacuggccguuaacucagcacccaggccaagcccccgccucccacu

SEQ ID NO: 48888 - RNA, 64 nt, Human
gguugaggcagauggugcccagaagaaagagggcagcacccauugcacauggcaggccuggaau

SEQ ID NO: 48889 - RNA, 64 nt, Human
gcccuaacccuuggcuccaggagacacagggcccagcacccagguugcugucggcaggcugaag

SEQ ID NO: 48890 - RNA, 64 nt, Human
uucaaagacugggggaccccuuccuccugacuccagcacccaggccugggaagagcucggcccc

SEQ ID NO: 48891 - RNA, 64 nt, Human
uccagcccaggcacggaaugggagggcccugcaaagcacccaaguguguuucacucaccccuua

SEQ ID NO: 48892 - RNA, 64 nt, Human
gccaacugaccaucuaccugcccguggggccaggagcacccaagaccacagaaaagagaaagga

SEQ ID NO: 48893 - RNA, 64 nt, Human
ccuagcuagguccuccuugggcuuugaaugcaggagcacccagugccccaggccuugcacugug

SEQ ID NO: 48894 - RNA, 64 nt, Human
ggaccgggguugucugucauuuauguggcuggaaagcacccaaagugguggucaggagggucgc

SEQ ID NO: 48895 - RNA, 64 nt, Human
ggagguggaaacagagcuacgccagcaggcgccaagcacccaacuccagagauggaagccuggu

SEQ ID NO: 48896 - RNA, 64 nt, Human
cuuucuaugcuguuuguagugaaauaauagaaugagcacccauuccaaagcuuuauuaccagug

SEQ ID NO: 48897 - RNA, 64 nt, Human
gcccuuucucuuaccacuaguugcuuacaaaaauagcacccaaacacauggcacuuggaagaaa

SEQ ID NO: 48898 - RNA, 64 nt, Human
cagaacgcuacagagcccaugcucuucccagagcagcacccacaaaagcaagcauugauuuugu

SEQ ID NO: 48899 - RNA, 64 nt, Human
cgcccccaagcucggaucacaugaaggagacagcagcacccacccaugcacgcaccccgccccu

SEQ ID NO: 48900 - RNA, 64 nt, Human
caggcaugcagaagccuguaccaacacagacuacagcacccaggaggugcgaguguggcugcuc

SEQ ID NO: 48901 - RNA, 64 nt, Human
uacguaagccucuuuggcaaggguccuggugcccagcacccaggcuaaaauauccugucuggca

SEQ ID NO: 48902 - RNA, 64 nt, Human
aaccggucagcaccaaguaacaccacacacacgcagcacccaggaugaugguuucacuucaguc

SEQ ID NO: 48903 - RNA, 64 nt, Human
agcgagaauucugagauccuccagaaagucgagcagcacccaccuccaaccucgggccaguguc

SEQ ID NO: 48904 - RNA, 64 nt, Human
gugggagggagggacaagggggaggaaaggggcgagcacccacgugagagaaucugccuguggc

SEQ ID NO: 48905 - RNA, 64 nt, Human
uggcggccaagugaggaaaagacacccugucugcagcacccagaacugaggaggggcacugccc

SEQ ID NO: 48906 - RNA, 64 nt, Human
ccaaaacaagggauuaucacauauugcggaguccagcacccagguaaaauuuugucauauaccc

SEQ ID NO: 48907 - RNA, 64 nt, Human
gaaagcucacuguagcuuuuaggaauaacuuuuacacgaccauuugauagggaacuggggaaug

SEQ ID NO: 48908 - RNA, 64 nt, Human
ccgucgaggucaagaucaagauccaggucuauuucacgaccaagaagcagguaggguaaaaauu

SEQ ID NO: 48909 - RNA, 64 nt, Human
gggacgcccaugccaggcccggggaccugugccacacgaccagcugugcucccagcagaggcug

SEQ ID NO: 48910 - RNA, 64 nt, Human
cauccccacuuccagcccauguacacuaguggcccacgaccaaggggucuucauuuccaugaaa

SEQ ID NO: 48911 - RNA, 64 nt, Human
augccagccccugccuggguugggggcacucagccacgaccagccccuuccuggguauuuauuc

SEQ ID NO: 48912 - RNA, 64 nt, Human
uuaguuuuuuaugugugaagucauuaaauuauuacacgaccagaacuaaaaugcaauauacagu

SEQ ID NO: 48913 - RNA, 64 nt, Human
uaguuaagcucuguaaaugugccacgagcuccaacacgaccaucguagggugaagcccacguuu

SEQ ID NO: 48914 - RNA, 64 nt, Human
ugguauaauaaugugucucuuacuagaagucccccacgaccaaguuaaagauacuuuuccuguu

SEQ ID NO: 48915 - RNA, 64 nt, Human
gaacuucagcugacuccacggggaucuggaaauccacgaccaaucccgaucggcucuuauuagc

SEQ ID NO: 48916 - RNA, 64 nt, Human
cagccggacaggggguagccccuggauucaggcacacgaccaccacacgagcacgugccacgca

SEQ ID NO: 48917 - RNA, 64 nt, Human
uccucccgcuucagccuccugaguagcuggugcgcacgaccauacccagcuaauguuuuauuuu

SEQ ID NO: 48918 - RNA, 64 nt, Human
uggaugaaggacuagaauacagcagcuguuauaacacgaccagucaauguggaacaaacuguuu

SEQ ID NO: 48919 - RNA, 64 nt, Human
acuuuuaucauuuuuuaagauucccucguuaugccacgaccagauaagaaucaccaguggguau

SEQ ID NO: 48920 - RNA, 64 nt, Human
uuggugcuuuggcccuaauagcacuggacaacaccacgaccacauggaaacauauuuuuggaag

SEQ ID NO: 48921 - RNA, 64 nt, Human
accgaagugggcagaucaccugaggucaggaguucacgaccagccuggccaacauggugaaacc

SEQ ID NO: 48922 - RNA, 64 nt, Human
ccuccacugugaacaagcuuuugcagcuucccagcacgaccauugaaaauaucucugugucugu

SEQ ID NO: 48923 - RNA, 64 nt, Human
gaaagggugcaaacaaaaugccuacauccaggcacacgaccaagucagcgagagcuagcccugg

SEQ ID NO: 48924 - RNA, 64 nt, Human
cucuuccaccccaaacaaaagggcucaggcuacacacgaccaugauuuauguuuucaggggaug

SEQ ID NO: 48925 - RNA, 64 nt, Human
cucagcauuuccacaccaagcagcaacagcaaaucacgaccacugauagaugucuauucuuguu

SEQ ID NO: 48926 - RNA, 64 nt, Human
cacccucccccauaucuguuugcauuaggaguuccacgaccaugguggaauguuaaggugaacc

SEQ ID NO: 48927 - RNA, 64 nt, Human
acuggguaccccaccuccucucucauaugcccaacacgaccacugccucccugcccccacaccu

SEQ ID NO: 48928 - RNA, 64 nt, Human
agagcgugcauagcgacacucgggaccuguggaccacgaccacgcugucccaggcacagcugaa

SEQ ID NO: 48929 - RNA, 64 nt, Human
uccccagacccccugagcccucccagggacccuccacgaccagcucugggggaggcacaggccc

SEQ ID NO: 48930 - RNA, 64 nt, Human
auggcccucccuggcucccugucccugggcucagcacgaccacacaggacacccagccagggaa

SEQ ID NO: 48931 - RNA, 64 nt, Human
uugcccuuggcuuuuucugguaugugcugugcuccacgaccaagccgagaaaggaccuagggug

SEQ ID NO: 48932 - RNA, 64 nt, Human
cgggagagacacccccauccccacgcgggccgggcacgaccacaccgggcggaccgcuggacag

SEQ ID NO: 48933 - RNA, 64 nt, Human
acugggcuuccuaccaguuucucagaauuacacgcacgaccauccaaacauuggcuccaugcca

SEQ ID NO: 48934 - RNA, 64 nt, Human
aucucuguggccaagcuccagccaaaaaggagggcacgaccagaaaggaacucccuuugcacgg

SEQ ID NO: 48935 - RNA, 64 nt, Human
gggugcauggcagcccuucuggcgggggugagcgcacgaccaaagucacuggaagccggguuuc

SEQ ID NO: 48936 - RNA, 64 nt, Human
ccuaggcuggacuuaaccccuuccucccuguccccacgaccaacuguccccaguuacucuaacc

SEQ ID NO: 48937 - RNA, 64 nt, Human
cuuauaaagucacccagcaggucaacaaugggcccacgaccaagacccuggguguucagacccc

SEQ ID NO: 48938 - RNA, 64 nt, Human
gccuccagcuuuccugguuagcgcaacgcggcuccacgaccacacgcacuucaggguggaagcu

SEQ ID NO: 48939 - RNA, 64 nt, Human
gggcugcagagugacacuggcugggcaccugccccacgaccaaugacaaggauuuccagcugaa

SEQ ID NO: 48940 - RNA, 64 nt, Human
gccaaggcgggucgauuacuugaggucaggaguucacgaccagccuggccaacauugugaaacc

SEQ ID NO: 48941 - RNA, 64 nt, Human
gagccagguggcuucauucuggcggugagaggcccacgaccacgggagugagagcugguguggc

SEQ ID NO: 48942 - RNA, 64 nt, Human
aaccaugcccagccccucccagcacccccagccccacgaccaucguucugaauucugacgacac

SEQ ID NO: 48943 - RNA, 64 nt, Human; identical to SEQ ID NO: 48942

SEQ ID NO: 48944 - RNA, 64 nt, Human
aaccaugcccggccccucccagcacccccagccccacgaccaucguucugaauucugacgacac

SEQ ID NO: 48945 - RNA, 64 nt, Human
gaggccugauucuguuuggacuggguucucaagacacgaccagguucucaagacacgagucccc

SEQ ID NO: 48946 - RNA, 64 nt, Human
gugcagaucacuaaguaguaagauuuuaaucaaacacgaccagguccgaaaugcaggucaugag

SEQ ID NO: 48947 - RNA, 64 nt, Human
uaaaugccugcacccauaauuuucuaguaauagccacgaccaauuuauuaacagucagggccua

SEQ ID NO: 48948 - RNA, 64 nt, Human
ugcacugaacacgcgugugugcaucgcacgcggccacgaccacagacacgcaugcacacacgca

SEQ ID NO: 48949 - RNA, 64 nt, Human
aacccuuacagacaccacugccaccaccaccaaccacgaccaccaccaccaccaccacucacca

SEQ ID NO: 48950 - RNA, 54 nt, Human; identical to SEQ ID NO: 46544

SEQ ID NO: 48951 - RNA, 64 nt, Human; identical to SEQ ID NO: 46545

SEQ ID NO: 48952 - RNA, 64 nt, Human; identical to SEQ ID NO: 46546

SEQ ID NO: 48953 - RNA, 64 nt, Human; identical to SEQ ID NO: 46547

SEQ ID NO: 48954 - RNA, 64 nt, Human; identical to SEQ ID NO: 46548

SEQ ID NO: 48955 - RNA, 64 nt, Human; identical to SEQ ID NO: 46549

SEQ ID NO: 48956 - RNA, 64 nt, Human; identical to SEQ ID NO: 46550

SEQ ID NO: 48957 - RNA, 64 nt, Human; identical to SEQ ID NO: 46551

SEQ ID NO: 48958 - RNA, 64 nt, Human; identical to SEQ ID NO: 46552

SEQ ID NO: 48959 - RNA, 64 nt, Human; identical to SEQ ID NO: 46553

SEQ ID NO: 48960 - RNA, 64 nt, Human; identical to SEQ ID NO: 46554

SEQ ID NO: 48961 - RNA, 64 nt, Human; identical to SEQ ID NO: 46555

SEQ ID NO: 48962 - RNA, 64 nt, Human; identical to SEQ ID NO: 46556

SEQ ID NO: 48963 - RNA, 64 nt, Human; identical to SEQ ID NO: 46557

SEQ ID NO: 48964 - RNA, 64 nt, Human; identical to SEQ ID NO: 46558

SEQ ID NO: 48965 - RNA, 64 nt, Human; identical to SEQ ID NO: 46559

SEQ ID NO: 48966 - RNA, 64 nt, Human; identical to SEQ ID NO: 46560

SEQ ID NO: 48967 - RNA, 64 nt, Human; identical to SEQ ID NO: 46561

SEQ ID NO: 48968 - RNA, 64 nt, Human; identical to SEQ ID NO: 46562

SEQ ID NO: 48969 - RNA, 64 nt, Human; identical to SEQ ID NO: 46563

SEQ ID NO: 48970 - RNA, 64 nt, Human; identical to SEQ ID NO: 46564

SEQ ID NO: 48971 - RNA, 64 nt, Human; identical to SEQ ID NO: 46565

SEQ ID NO: 48972 - RNA, 64 nt, Human; identical to SEQ ID NO: 46566

SEQ ID NO: 48973 - RNA, 64 nt, Human; identical to SEQ ID NO: 46567

SEQ ID NO: 48974 - RNA, 64 nt, Human; identical to SEQ ID NO: 46568

SEQ ID NO: 48975 - RNA, 64 nt, Human; identical to SEQ ID NO: 46569

SEQ ID NO: 48976 - RNA, 64 nt, Human; identical to SEQ ID NO: 46570

SEQ ID NO: 48977 - RNA, 64 nt, Human; identical to SEQ ID NO: 46571

SEQ ID NO: 48978 - RNA, 64 nt, Human; identical to SEQ ID NO: 46572

SEQ ID NO: 48979 - RNA, 64 nt, Human; identical to SEQ ID NO: 46573

SEQ ID NO: 48980 - RNA, 64 nt, Human; identical to SEQ ID NO: 46574

SEQ ID NO: 48981 - RNA, 64 nt, Human; identical to SEQ ID NO: 46575

SEQ ID NO: 48982 - RNA, 64 nt, Human; identical to SEQ ID NO: 46576

SEQ ID NO: 48983 - RNA, 64 nt, Human; identical to SEQ ID NO: 46577

SEQ ID NO: 48984 - RNA, 64 nt, Human; identical to SEQ ID NO: 46578

SEQ ID NO: 48985 - RNA, 64 nt, Human; identical to SEQ ID NO: 46579

SEQ ID NO: 48986 - RNA, 64 nt, Human; identical to SEQ ID NO: 46580

SEQ ID NO: 48987 - RNA, 64 nt, Human; identical to SEQ ID NO: 46581

SEQ ID NO: 48988 - RNA, 64 nt, Human; identical to SEQ ID NO: 46582

SEQ ID NO: 48989 - RNA, 64 nt, Human; identical to SEQ ID NO: 46583

SEQ ID NO: 48990 - RNA, 64 nt, Human; identical to SEQ ID NO: 46584

SEQ ID NO: 48991 - RNA, 64 nt, Human; identical to SEQ ID NO: 46585

SEQ ID NO: 48992 - RNA, 64 nt, Human; identical to SEQ ID NO: 46586

SEQ ID NO: 48993 - RNA, 64 nt, Human; identical to SEQ ID NO: 46587

SEQ ID NO: 48994 - RNA, 64 nt, Human; identical to SEQ ID NO: 46588

SEQ ID NO: 48995 - RNA, 64 nt, Human; identical to SEQ ID NO: 46589

SEQ ID NO: 48996 - RNA, 64 nt, Human; identical to SEQ ID NO: 46590

SEQ ID NO: 48997 - RNA, 64 nt, Human; identical to SEQ ID NO: 46591

SEQ ID NO: 48998 - RNA, 64 nt, Human; identical to SEQ ID NO: 46592

SEQ ID NO: 48999 - RNA, 64 nt, Human; identical to SEQ ID NO: 46593

SEQ ID NO: 49000 - RNA, 64 nt, Human; identical to SEQ ID NO: 46594

SEQ ID NO: 49001 - RNA, 64 nt, Human; identical to SEQ ID NO: 46595

SEQ ID NO: 49002 - RNA, 64 nt, Human; identical to SEQ ID NO: 46596

SEQ ID NO: 49003 - RNA, 64 nt, Human; identical to SEQ ID NO: 46597

SEQ ID NO: 49004 - RNA, 64 nt, Human; identical to SEQ ID NO: 46598

SEQ ID NO: 49005 - RNA, 64 nt, Human; identical to SEQ ID NO: 46599

SEQ ID NO: 49006 - RNA, 64 nt, Human; identical to SEQ ID NO: 46600

SEQ ID NO: 49007 - RNA, 64 nt, Human; identical to SEQ ID NO: 46601

SEQ ID NO: 49008 - RNA, 64 nt, Human; identical to SEQ ID NO: 46602

SEQ ID NO: 49009 - RNA, 64 nt, Human; identical to SEQ ID NO: 46603

SEQ ID NO: 49010 - RNA, 64 nt, Human; identical to SEQ ID NO: 46604

SEQ ID NO: 49011 - RNA, 64 nt, Human; identical to SEQ ID NO: 46605

SEQ ID NO: 49012 - RNA, 64 nt, Human; identical to SEQ ID NO: 46606

SEQ ID NO: 49013 - RNA, 64 nt, Human; identical to SEQ ID NO: 46607

SEQ ID NO: 49014 - RNA, 64 nt, Human; identical to SEQ ID NO: 46608

SEQ ID NO: 49015 - RNA, 64 nt, Human; identical to SEQ ID NO: 46609

SEQ ID NO: 49016 - RNA, 64 nt, Human; identical to SEQ ID NO: 46610

SEQ ID NO: 49017 - RNA, 64 nt, Human; identical to SEQ ID NO: 46611

SEQ ID NO: 49018 - RNA, 64 nt, Human; identical to SEQ ID NO: 46612

SEQ ID NO: 49019 - RNA, 64 nt, Human; identical to SEQ ID NO: 46613

SEQ ID NO: 49020 - RNA, 64 nt, Human; identical to SEQ ID NO: 46614

SEQ ID NO: 49021 - RNA, 64 nt, Human; identical to SEQ ID NO: 46615

SEQ ID NO: 49022 - RNA, 64 nt, Human; identical to SEQ ID NO: 46616

SEQ ID NO: 49023 - RNA, 64 nt, Human; identical to SEQ ID NO: 46617

SEQ ID NO: 49024 - RNA, 64 nt, Human; identical to SEQ ID NO: 46618

SEQ ID NO: 49025 - RNA, 64 nt, Human; identical to SEQ ID NO: 46619

SEQ ID NO: 49026 - RNA, 64 nt, Human; identical to SEQ ID NO: 46620

SEQ ID NO: 49027 - RNA, 64 nt, Human; identical to SEQ ID NO: 46621

SEQ ID NO: 49028 - RNA, 64 nt, Human; identical to SEQ ID NO: 46622

SEQ ID NO: 49029 - RNA, 64 nt, Human; identical to SEQ ID NO: 46623

SEQ ID NO: 49030 - RNA, 64 nt, Human; identical to SEQ ID NO: 46624

SEQ ID NO: 49031 - RNA, 64 nt, Human; identical to SEQ ID NO: 46625

SEQ ID NO: 49032 - RNA, 64 nt, Human; identical to SEQ ID NO: 46626

SEQ ID NO: 49033 - RNA, 64 nt, Human; identical to SEQ ID NO: 46627

SEQ ID NO: 49034 - RNA, 64 nt, Human; identical to SEQ ID NO: 46628

SEQ ID NO: 49035 - RNA, 64 nt, Human; identical to SEQ ID NO: 46629

SEQ ID NO: 49036 - RNA, 64 nt, Human; identical to SEQ ID NO: 46630

SEQ ID NO: 49037 - RNA, 64 nt, Human; identical to SEQ ID NO: 46631

SEQ ID NO: 49038 - RNA, 64 nt, Human; identical to SEQ ID NO: 46632

SEQ ID NO: 49039 - RNA, 64 nt, Human; identical to SEQ ID NO: 46633

SEQ ID NO: 49040 - RNA, 64 nt, Human; identical to SEQ ID NO: 46634

SEQ ID NO: 49041 - RNA, 64 nt, Human; identical to SEQ ID NO: 46635

SEQ ID NO: 49042 - RNA, 64 nt, Human; identical to SEQ ID NO: 46636

SEQ ID NO: 49043 - RNA, 64 nt, Human; identical to SEQ ID NO: 46637

SEQ ID NO: 49044 - RNA, 64 nt, Human; identical to SEQ ID NO: 46638

SEQ ID NO: 49045 - RNA, 58 nt, Human; identical to SEQ ID NO: 46639

SEQ ID NO: 49046 - RNA, 64 nt, Human; identical to SEQ ID NO: 46640

SEQ ID NO: 49047 - RNA, 64 nt, Human; identical to SEQ ID NO: 46641

SEQ ID NO: 49048 - RNA, 64 nt, Human; identical to SEQ ID NO: 46642

SEQ ID NO: 49049 - RNA, 64 nt, Human; identical to SEQ ID NO: 46643

SEQ ID NO: 49050 - RNA, 64 nt, Human; identical to SEQ ID NO: 46644

SEQ ID NO: 49051 - RNA, 64 nt, Human; identical to SEQ ID NO: 46645

SEQ ID NO: 49052 - RNA, 64 nt, Human; identical to SEQ ID NO: 46646

SEQ ID NO: 49053 - RNA, 64 nt, Human; identical to SEQ ID NO: 46647

SEQ ID NO: 49054 - RNA, 64 nt, Human; identical to SEQ ID NO: 46648

SEQ ID NO: 49055 - RNA, 64 nt, Human; identical to SEQ ID NO: 46649

SEQ ID NO: 49056 - RNA, 64 nt, Human; identical to SEQ ID NO: 46650

SEQ ID NO: 49057 - RNA, 64 nt, Human; identical to SEQ ID NO: 46651

SEQ ID NO: 49058 - RNA, 64 nt, Human; identical to SEQ ID NO: 46652

SEQ ID NO: 49059 - RNA, 64 nt, Human; identical to SEQ ID NO: 46653

SEQ ID NO: 49060 - RNA, 64 nt, Human; identical to SEQ ID NO: 46654

SEQ ID NO: 49061 - RNA, 64 nt, Human; identical to SEQ ID NO: 46655

SEQ ID NO: 49062 - RNA, 64 nt, Human; identical to SEQ ID NO: 46656

SEQ ID NO: 49063 - RNA, 64 nt, Human; identical to SEQ ID NO: 46657

SEQ ID NO: 49064 - RNA, 64 nt, Human; identical to SEQ ID NO: 46658

SEQ ID NO: 49065 - RNA, 64 nt, Human; identical to SEQ ID NO: 46659

SEQ ID NO: 49066 - RNA, 64 nt, Human; identical to SEQ ID NO: 46660

SEQ ID NO: 49067 - RNA, 64 nt, Human; identical to SEQ ID NO: 46661

SEQ ID NO: 49068 - RNA, 64 nt, Human; identical to SEQ ID NO: 46662

SEQ ID NO: 49069 - RNA, 64 nt, Human; identical to SEQ ID NO: 46663

SEQ ID NO: 49070 - RNA, 64 nt, Human; identical to SEQ ID NO: 46664

SEQ ID NO: 49071 - RNA, 62 nt, Human; identical to SEQ ID NO: 46665

SEQ ID NO: 49072 - RNA, 64 nt, Human; identical to SEQ ID NO: 46666

SEQ ID NO: 49073 - RNA, 64 nt, Human; identical to SEQ ID NO: 46667

SEQ ID NO: 49074 - RNA, 64 nt, Human; identical to SEQ ID NO: 46668

SEQ ID NO: 49075 - RNA, 64 nt, Human; identical to SEQ ID NO: 46669

SEQ ID NO: 49076 - RNA, 64 nt, Human; identical to SEQ ID NO: 46670

SEQ ID NO: 49077 - RNA, 64 nt, Human; identical to SEQ ID NO: 46671

SEQ ID NO: 49078 - RNA, 64 nt, Human; identical to SEQ ID NO: 46672

SEQ ID NO: 49079 - RNA, 64 nt, Human; identical to SEQ ID NO: 46673

SEQ ID NO: 49080 - RNA, 64 nt, Human; identical to SEQ ID NO: 46674

SEQ ID NO: 49081 - RNA, 64 nt, Human; identical to SEQ ID NO: 46675

SEQ ID NO: 49082 - RNA, 64 nt, Human; identical to SEQ ID NO: 46676

SEQ ID NO: 49083 - RNA, 64 nt, Human; identical to SEQ ID NO: 46677

SEQ ID NO: 49084 - RNA, 64 nt, Human; identical to SEQ ID NO: 46678

SEQ ID NO: 49085 - RNA, 64 nt, Human; identical to SEQ ID NO: 46679

SEQ ID NO: 49086 - RNA, 64 nt, Human; identical to SEQ ID NO: 46680

SEQ ID NO: 49087 - RNA, 64 nt, Human; identical to SEQ ID NO: 46681

SEQ ID NO: 49088 - RNA, 64 nt, Human; identical to SEQ ID NO: 46682

SEQ ID NO: 49089 - RNA, 64 nt, Human; identical to SEQ ID NO: 46683

SEQ ID NO: 49090 - RNA, 64 nt, Human; identical to SEQ ID NO: 46684

SEQ ID NO: 49091 - RNA, 64 nt, Human; identical to SEQ ID NO: 46685

SEQ ID NO: 49092 - RNA, 64 nt, Human; identical to SEQ ID NO: 46686

SEQ ID NO: 49093 - RNA, 64 nt, Human; identical to SEQ ID NO: 46687

SEQ ID NO: 49094 - RNA, 64 nt, Human; identical to SEQ ID NO: 46688

SEQ ID NO: 49095 - RNA, 64 nt, Human; identical to SEQ ID NO: 46689

SEQ ID NO: 49096 - RNA, 64 nt, Human; identical to SEQ ID NO: 46690

SEQ ID NO: 49097 - RNA, 64 nt, Human; identical to SEQ ID NO: 46691

SEQ ID NO: 49098 - RNA, 64 nt, Human; identical to SEQ ID NO: 46692

SEQ ID NO: 49099 - RNA, 64 nt, Human; identical to SEQ ID NO: 46693

SEQ ID NO: 49100 - RNA, 64 nt, Human; identical to SEQ ID NO: 46694

SEQ ID NO: 49101 - RNA, 64 nt, Human; identical to SEQ ID NO: 46695

SEQ ID NO: 49102 - RNA, 64 nt, Human; identical to SEQ ID NO: 46696

SEQ ID NO: 49103 - RNA, 64 nt, Human; identical to SEQ ID NO: 46697

SEQ ID NO: 49104 - RNA, 64 nt, Human; identical to SEQ ID NO: 46698

SEQ ID NO: 49105 - RNA, 64 nt, Human; identical to SEQ ID NO: 46699

SEQ ID NO: 49106 - RNA, 64 nt, Human; identical to SEQ ID NO: 46700

SEQ ID NO: 49107 - RNA, 64 nt, Human; identical to SEQ ID NO: 46701

SEQ ID NO: 49108 - RNA, 64 nt, Human; identical to SEQ ID NO: 46702

SEQ ID NO: 49109 - RNA, 64 nt, Human; identical to SEQ ID NO: 46703

SEQ ID NO: 49110 - RNA, 64 nt, Human; identical to SEQ ID NO: 46704

SEQ ID NO: 49111 - RNA, 64 nt, Human; identical to SEQ ID NO: 46705

SEQ ID NO: 49112 - RNA, 64 nt, Human; identical to SEQ ID NO: 46706

SEQ ID NO: 49113 - RNA, 64 nt, Human; identical to SEQ ID NO: 46707

SEQ ID NO: 49114 - RNA, 64 nt, Human; identical to SEQ ID NO: 46708

SEQ ID NO: 49115 - RNA, 64 nt, Human; identical to SEQ ID NO: 46709

SEQ ID NO: 49116 - RNA, 64 nt, Human; identical to SEQ ID NO: 46710

SEQ ID NO: 49117 - RNA, 64 nt, Human; identical to SEQ ID NO: 46711

SEQ ID NO: 49118 - RNA, 64 nt, Human; identical to SEQ ID NO: 46712

SEQ ID NO: 49119 - RNA, 64 nt, Human; identical to SEQ ID NO: 46713

SEQ ID NO: 49120 - RNA, 64 nt, Human; identical to SEQ ID NO: 46714

SEQ ID NO: 49121 - RNA, 64 nt, Human; identical to SEQ ID NO: 46715

SEQ ID NO: 49122 - RNA, 64 nt, Human; identical to SEQ ID NO: 46716

SEQ ID NO: 49123 - RNA, 64 nt, Human; identical to SEQ ID NO: 46717

SEQ ID NO: 49124 - RNA, 64 nt, Human; identical to SEQ ID NO: 46718

SEQ ID NO: 49125 - RNA, 64 nt, Human; identical to SEQ ID NO: 46719

SEQ ID NO: 49126 - RNA, 64 nt, Human; identical to SEQ ID NO: 46720

SEQ ID NO: 49127 - RNA, 64 nt, Human; identical to SEQ ID NO: 46721

SEQ ID NO: 49128 - RNA, 64 nt, Human; identical to SEQ ID NO: 46722

SEQ ID NO: 49129 - RNA, 64 nt, Human; identical to SEQ ID NO: 46723

SEQ ID NO: 49130 - RNA, 64 nt, Human; identical to SEQ ID NO: 46724

SEQ ID NO: 49131 - RNA, 64 nt, Human; identical to SEQ ID NO: 46725

SEQ ID NO: 49132 - RNA, 64 nt, Human; identical to SEQ ID NO: 46726

SEQ ID NO: 49133 - RNA, 64 nt, Human; identical to SEQ ID NO: 46727

SEQ ID NO: 49134 - RNA, 64 nt, Human; identical to SEQ ID NO: 46728

SEQ ID NO: 49135 - RNA, 64 nt, Human; identical to SEQ ID NO: 46729

SEQ ID NO: 49136 - RNA, 64 nt, Human; identical to SEQ ID NO: 46730

SEQ ID NO: 49137 - RNA, 64 nt, Human; identical to SEQ ID NO: 46731

SEQ ID NO: 49138 - RNA, 64 nt, Human; identical to SEQ ID NO: 46732

SEQ ID NO: 49139 - RNA, 64 nt, Human; identical to SEQ ID NO: 46733

SEQ ID NO: 49140 - RNA, 64 nt, Human; identical to SEQ ID NO: 46734

SEQ ID NO: 49141 - RNA, 64 nt, Human; identical to SEQ ID NO: 46735

SEQ ID NO: 49142 - RNA, 64 nt, Human; identical to SEQ ID NO: 46736

SEQ ID NO: 49143 - RNA, 64 nt, Human; identical to SEQ ID NO: 46737

SEQ ID NO: 49144 - RNA, 64 nt, Human; identical to SEQ ID NO: 46738

SEQ ID NO: 49145 - RNA, 64 nt, Human; identical to SEQ ID NO: 46739

SEQ ID NO: 49146 - RNA, 64 nt, Human; identical to SEQ ID NO: 46740

SEQ ID NO: 49147 - RNA, 64 nt, Human; identical to SEQ ID NO: 46741

SEQ ID NO: 49148 - RNA, 64 nt, Human; identical to SEQ ID NO: 46742

SEQ ID NO: 49149 - RNA, 61 nt, Human; identical to SEQ ID NO: 46743

SEQ ID NO: 49150 - RNA, 64 nt, Human; identical to SEQ ID NO: 46744

SEQ ID NO: 49151 - RNA, 64 nt, Human; identical to SEQ ID NO: 46745

SEQ ID NO: 49152 - RNA, 64 nt, Human; identical to SEQ ID NO: 46746

SEQ ID NO: 49153 - RNA, 64 nt, Human; identical to SEQ ID NO: 46747

SEQ ID NO: 49154 - RNA, 64 nt, Human; identical to SEQ ID NO: 46748

SEQ ID NO: 49155 - RNA, 64 nt, Human; identical to SEQ ID NO: 46749

SEQ ID NO: 49156 - RNA, 55 nt, Human; identical to SEQ ID NO: 46750

SEQ ID NO: 49157 - RNA, 64 nt, Human; identical to SEQ ID NO: 46751

SEQ ID NO: 49158 - RNA, 64 nt, Human; identical to SEQ ID NO: 46752

SEQ ID NO: 49159 - RNA, 64 nt, Human; identical to SEQ ID NO: 46753

SEQ ID NO: 49160 - RNA, 64 nt, Human; identical to SEQ ID NO: 46754

SEQ ID NO: 49161 - RNA, 64 nt, Human; identical to SEQ ID NO: 46755

SEQ ID NO: 49162 - RNA, 64 nt, Human; identical to SEQ ID NO: 46756

SEQ ID NO: 49163 - RNA, 64 nt, Human; identical to SEQ ID NO: 46757

SEQ ID NO: 49164 - RNA, 64 nt, Human; identical to SEQ ID NO: 46758

SEQ ID NO: 49165 - RNA, 64 nt, Human; identical to SEQ ID NO: 46759

SEQ ID NO: 49166 - RNA, 64 nt, Human; identical to SEQ ID NO: 46760

SEQ ID NO: 49167 - RNA, 64 nt, Human; identical to SEQ ID NO: 46761

SEQ ID NO: 49168 - RNA, 64 nt, Human; identical to SEQ ID NO: 46762

SEQ ID NO: 49169 - RNA, 64 nt, Human; identical to SEQ ID NO: 46763

SEQ ID NO: 49170 - RNA, 64 nt, Human; identical to SEQ ID NO: 46764

SEQ ID NO: 49171 - RNA, 64 nt, Human; identical to SEQ ID NO: 46765

SEQ ID NO: 49172 - RNA, 64 nt, Human; identical to SEQ ID NO: 46766

SEQ ID NO: 49173 - RNA, 64 nt, Human; identical to SEQ ID NO: 46767

SEQ ID NO: 49174 - RNA, 64 nt, Human; identical to SEQ ID NO: 46768

SEQ ID NO: 49175 - RNA, 64 nt, Human; identical to SEQ ID NO: 46769

SEQ ID NO: 49176 - RNA, 64 nt, Human; identical to SEQ ID NO: 46770

SEQ ID NO: 49177 - RNA, 64 nt, Human; identical to SEQ ID NO: 46771

SEQ ID NO: 49178 - RNA, 64 nt, Human; identical to SEQ ID NO: 46772

SEQ ID NO: 49179 - RNA, 64 nt, Human; identical to SEQ ID NO: 46773

SEQ ID NO: 49180 - RNA, 64 nt, Human; identical to SEQ ID NO: 46774

SEQ ID NO: 49181 - RNA, 64 nt, Human; identical to SEQ ID NO: 46775

SEQ ID NO: 49182 - RNA, 64 nt, Human; identical to SEQ ID NO: 46776

SEQ ID NO: 49183 - RNA, 64 nt, Human; identical to SEQ ID NO: 46777

SEQ ID NO: 49184 - RNA, 64 nt, Human; identical to SEQ ID NO: 46778

SEQ ID NO: 49185 - RNA, 64 nt, Human; identical to SEQ ID NO: 46779

SEQ ID NO: 49186 - RNA, 64 nt, Human; identical to SEQ ID NO: 46780

SEQ ID NO: 49187 - RNA, 64 nt, Human; identical to SEQ ID NO: 46781

SEQ ID NO: 49188 - RNA, 64 nt, Human; identical to SEQ ID NO: 46782

SEQ ID NO: 49189 - RNA, 64 nt, Human; identical to SEQ ID NO: 46783

SEQ ID NO: 49190 - RNA, 64 nt, Human; identical to SEQ ID NO: 46784

SEQ ID NO: 49191 - RNA, 64 nt, Human; identical to SEQ ID NO: 46785

SEQ ID NO: 49192 - RNA, 64 nt, Human; identical to SEQ ID NO: 46786

SEQ ID NO: 49193 - RNA, 64 nt, Human; identical to SEQ ID NO: 46787

SEQ ID NO: 49194 - RNA, 64 nt, Human; identical to SEQ ID NO: 46788

SEQ ID NO: 49195 - RNA, 64 nt, Human; identical to SEQ ID NO: 46789

SEQ ID NO: 49196 - RNA, 64 nt, Human; identical to SEQ ID NO: 46790

SEQ ID NO: 49197 - RNA, 64 nt, Human; identical to SEQ ID NO: 46791

SEQ ID NO: 49198 - RNA, 64 nt, Human; identical to SEQ ID NO: 46792

SEQ ID NO: 49199 - RNA, 64 nt, Human; identical to SEQ ID NO: 46793

SEQ ID NO: 49200 - RNA, 64 nt, Human; identical to SEQ ID NO: 46794

SEQ ID NO: 49201 - RNA, 64 nt, Human; identical to SEQ ID NO: 46795

SEQ ID NO: 49202 - RNA, 64 nt, Human; identical to SEQ ID NO: 46796

SEQ ID NO: 49203 - RNA, 64 nt, Human; identical to SEQ ID NO: 46797

SEQ ID NO: 49204 - RNA, 64 nt, Human; identical to SEQ ID NO: 46798

SEQ ID NO: 49205 - RNA, 64 nt, Human; identical to SEQ ID NO: 46799

SEQ ID NO: 49206 - RNA, 64 nt, Human; identical to SEQ ID NO: 46800

SEQ ID NO: 49207 - RNA, 64 nt, Human; identical to SEQ ID NO: 46801

SEQ ID NO: 49208 - RNA, 64 nt, Human; identical to SEQ ID NO: 46802

SEQ ID NO: 49209 - RNA, 64 nt, Human; identical to SEQ ID NO: 46803

SEQ ID NO: 49210 - RNA, 64 nt, Human; identical to SEQ ID NO: 46804

SEQ ID NO: 49211 - RNA, 64 nt, Human; identical to SEQ ID NO: 46805

SEQ ID NO: 49212 - RNA, 64 nt, Human; identical to SEQ ID NO: 46806

SEQ ID NO: 49213 - RNA, 54 nt, Human; identical to SEQ ID NO: 46807

SEQ ID NO: 49214 - RNA, 54 nt, Human; identical to SEQ ID NO: 46807

SEQ ID NO: 49215 - RNA, 64 nt, Human; identical to SEQ ID NO: 46809

SEQ ID NO: 49216 - RNA, 64 nt, Human; identical to SEQ ID NO: 46810

SEQ ID NO: 49217 - RNA, 64 nt, Human; identical to SEQ ID NO: 46811

SEQ ID NO: 49218 - RNA, 64 nt, Human; identical to SEQ ID NO: 46812

SEQ ID NO: 49219 - RNA, 64 nt, Human; identical to SEQ ID NO: 46813

SEQ ID NO: 49220 - RNA, 64 nt, Human; identical to SEQ ID NO: 46814

SEQ ID NO: 49221 - RNA, 64 nt, Human; identical to SEQ ID NO: 46815

SEQ ID NO: 49222 - RNA, 64 nt, Human; identical to SEQ ID NO: 46816

SEQ ID NO: 49223 - RNA, 64 nt, Human; identical to SEQ ID NO: 46817

SEQ ID NO: 49224 - RNA, 64 nt, Human; identical to SEQ ID NO: 46818

SEQ ID NO: 49225 - RNA, 64 nt, Human; identical to SEQ ID NO: 46819

SEQ ID NO: 49226 - RNA, 63 nt, Human; identical to SEQ ID NO: 46820

SEQ ID NO: 49227 - RNA, 64 nt, Human; identical to SEQ ID NO: 46821

SEQ ID NO: 49228 - RNA, 64 nt, Human; identical to SEQ ID NO: 46822

SEQ ID NO: 49229 - RNA, 64 nt, Human; identical to SEQ ID NO: 46823

SEQ ID NO: 49230 - RNA, 64 nt, Human; identical to SEQ ID NO: 46824

SEQ ID NO: 49231 - RNA, 64 nt, Human; identical to SEQ ID NO: 46825

SEQ ID NO: 49232 - RNA, 64 nt, Human; identical to SEQ ID NO: 46826

SEQ ID NO: 49233 - RNA, 64 nt, Human; identical to SEQ ID NO: 46827

SEQ ID NO: 49234 - RNA, 64 nt, Human; identical to SEQ ID NO: 46828

SEQ ID NO: 49235 - RNA, 64 nt, Human; identical to SEQ ID NO: 46829

SEQ ID NO: 49236 - RNA, 64 nt, Human; identical to SEQ ID NO: 46830

SEQ ID NO: 49237 - RNA, 64 nt, Human; identical to SEQ ID NO: 46831

SEQ ID NO: 49238 - RNA, 64 nt, Human; identical to SEQ ID NO: 46832

SEQ ID NO: 49239 - RNA, 60 nt, Human; identical to SEQ ID NO: 46833

SEQ ID NO: 49240 - RNA, 64 nt, Human; identical to SEQ ID NO: 46834

SEQ ID NO: 49241 - RNA, 64 nt, Human; identical to SEQ ID NO: 46835

SEQ ID NO: 49242 - RNA, 64 nt, Human; identical to SEQ ID NO: 46836

SEQ ID NO: 49243 - RNA, 64 nt, Human; identical to SEQ ID NO: 46837

SEQ ID NO: 49244 - RNA, 64 nt, Human; identical to SEQ ID NO: 46838

SEQ ID NO: 49245 - RNA, 64 nt, Human; identical to SEQ ID NO: 46839

SEQ ID NO: 49246 - RNA, 64 nt, Human; identical to SEQ ID NO: 46840

SEQ ID NO: 49247 - RNA, 64 nt, Human; identical to SEQ ID NO: 46841

SEQ ID NO: 49248 - RNA, 64 nt, Human; identical to SEQ ID NO: 46842

SEQ ID NO: 49249 - RNA, 64 nt, Human; identical to SEQ ID NO: 46843

SEQ ID NO: 49250 - RNA, 64 nt, Human; identical to SEQ ID NO: 46844

SEQ ID NO: 49251 - RNA, 64 nt, Human; identical to SEQ ID NO: 46845

SEQ ID NO: 49252 - RNA, 64 nt, Human; identical to SEQ ID NO: 46846

SEQ ID NO: 49253 - RNA, 64 nt, Human; identical to SEQ ID NO: 46847

SEQ ID NO: 49254 - RNA, 64 nt, Human; identical to SEQ ID NO: 46848

SEQ ID NO: 49255 - RNA, 64 nt, Human; identical to SEQ ID NO: 46849

SEQ ID NO: 49256 - RNA, 64 nt, Human; identical to SEQ ID NO: 46850

SEQ ID NO: 49257 - RNA, 64 nt, Human; identical to SEQ ID NO: 46851

SEQ ID NO: 49258 - RNA, 64 nt, Human; identical to SEQ ID NO: 46852

SEQ ID NO: 49259 - RNA, 64 nt, Human; identical to SEQ ID NO: 46853

SEQ ID NO: 49260 - RNA, 64 nt, Human; identical to SEQ ID NO: 46854

SEQ ID NO: 49261 - RNA, 64 nt, Human; identical to SEQ ID NO: 46855

SEQ ID NO: 49262 - RNA, 64 nt, Human; identical to SEQ ID NO: 46856

SEQ ID NO: 49263 - RNA, 63 nt, Human; identical to SEQ ID NO: 46857

SEQ ID NO: 49264 - RNA, 62 nt, Human; identical to SEQ ID NO: 46858

SEQ ID NO: 49265 - RNA, 64 nt, Human; identical to SEQ ID NO: 46859

SEQ ID NO: 49266 - RNA, 64 nt, Human; identical to SEQ ID NO: 46860

SEQ ID NO: 49267 - RNA, 64 nt, Human; identical to SEQ ID NO: 46861

SEQ ID NO: 49268 - RNA, 64 nt, Human; identical to SEQ ID NO: 46862

SEQ ID NO: 49269 - RNA, 64 nt, Human; identical to SEQ ID NO: 46863

SEQ ID NO: 49270 - RNA, 64 nt, Human; identical to SEQ ID NO: 46864

SEQ ID NO: 49271 - RNA, 64 nt, Human; identical to SEQ ID NO: 46865

SEQ ID NO: 49272 - RNA, 64 nt, Human; identical to SEQ ID NO: 46866

SEQ ID NO: 49273 - RNA, 64 nt, Human; identical to SEQ ID NO: 46867

SEQ ID NO: 49274 - RNA, 64 nt, Human; identical to SEQ ID NO: 46868

SEQ ID NO: 49275 - RNA, 64 nt, Human; identical to SEQ ID NO: 46869

SEQ ID NO: 49276 - RNA, 64 nt, Human; identical to SEQ ID NO: 46870

SEQ ID NO: 49277 - RNA, 64 nt, Human; identical to SEQ ID NO: 46871

SEQ ID NO: 49278 - RNA, 64 nt, Human; identical to SEQ ID NO: 46872

SEQ ID NO: 49279 - RNA, 64 nt, Human; identical to SEQ ID NO: 46873

SEQ ID NO: 49280 - RNA, 64 nt, Human; identical to SEQ ID NO: 46874

SEQ ID NO: 49281 - RNA, 64 nt, Human; identical to SEQ ID NO: 46875

SEQ ID NO: 49282 - RNA, 64 nt, Human; identical to SEQ ID NO: 46876

SEQ ID NO: 49283 - RNA, 64 nt, Human; identical to SEQ ID NO: 46877

SEQ ID NO: 49284 - RNA, 64 nt, Human; identical to SEQ ID NO: 46878

SEQ ID NO: 49285 - RNA, 64 nt, Human; identical to SEQ ID NO: 46879

SEQ ID NO: 49286 - RNA, 64 nt, Human; identical to SEQ ID NO: 46880

SEQ ID NO: 49287 - RNA, 64 nt, Human; identical to SEQ ID NO: 46881

SEQ ID NO: 49288 - RNA, 52 nt, Human; identical to SEQ ID NO: 46882

SEQ ID NO: 49289 - RNA, 64 nt, Human; identical to SEQ ID NO: 46664

SEQ ID NO: 49290 - RNA, 64 nt, Human; identical to SEQ ID NO: 46884

SEQ ID NO: 49291 - RNA, 64 nt, Human; identical to SEQ ID NO: 46885

SEQ ID NO: 49292 - RNA, 64 nt, Human; identical to SEQ ID NO: 46886

SEQ ID NO: 49293 - RNA, 64 nt, Human; identical to SEQ ID NO: 46887

SEQ ID NO: 49294 - RNA, 64 nt, Human; identical to SEQ ID NO: 46888

SEQ ID NO: 49295 - RNA, 64 nt, Human; identical to SEQ ID NO: 46889

SEQ ID NO: 49296 - RNA, 64 nt, Human; identical to SEQ ID NO: 46890

SEQ ID NO: 49297 - RNA, 64 nt, Human; identical to SEQ ID NO: 46891

SEQ ID NO: 49298 - RNA, 64 nt, Human; identical to SEQ ID NO: 46892

SEQ ID NO: 49299 - RNA, 64 nt, Human; identical to SEQ ID NO: 46893

SEQ ID NO: 49300 - RNA, 64 nt, Human; identical to SEQ ID NO: 46894

SEQ ID NO: 49301 - RNA, 64 nt, Human; identical to SEQ ID NO: 46895

SEQ ID NO: 49302 - RNA, 64 nt, Human; identical to SEQ ID NO: 46896

SEQ ID NO: 49303 - RNA, 64 nt, Human; identical to SEQ ID NO: 46897

SEQ ID NO: 49304 - RNA, 64 nt, Human; identical to SEQ ID NO: 46898

SEQ ID NO: 49305 - RNA, 64 nt, Human; identical to SEQ ID NO: 46899

SEQ ID NO: 49306 - RNA, 64 nt, Human; identical to SEQ ID NO: 46900

SEQ ID NO: 49307 - RNA, 64 nt, Human; identical to SEQ ID NO: 46901

SEQ ID NO: 49308 - RNA, 64 nt, Human; identical to SEQ ID NO: 46902

SEQ ID NO: 49309 - RNA, 64 nt, Human; identical to SEQ ID NO: 46903

SEQ ID NO: 49310 - RNA, 64 nt, Human; identical to SEQ ID NO: 46904

SEQ ID NO: 49311 - RNA, 64 nt, Human; identical to SEQ ID NO: 46905

SEQ ID NO: 49312 - RNA, 64 nt, Human; identical to SEQ ID NO: 46906

SEQ ID NO: 49313 - RNA, 64 nt, Human; identical to SEQ ID NO: 46907

SEQ ID NO: 49314 - RNA, 64 nt, Human; identical to SEQ ID NO: 46908

SEQ ID NO: 49315 - RNA, 64 nt, Human; identical to SEQ ID NO: 46909

SEQ ID NO: 49316 - RNA, 55 nt, Human; identical to SEQ ID NO: 46910

SEQ ID NO: 49317 - RNA, 64 nt, Human; identical to SEQ ID NO: 46911

SEQ ID NO: 49318 - RNA, 64 nt, Human; identical to SEQ ID NO: 46912

SEQ ID NO: 49319 - RNA, 64 nt, Human; identical to SEQ ID NO: 46913

SEQ ID NO: 49320 - RNA, 64 nt, Human; identical to SEQ ID NO: 46914

SEQ ID NO: 49321 - RNA, 64 nt, Human; identical to SEQ ID NO: 46915

SEQ ID NO: 49322 - RNA, 64 nt, Human; identical to SEQ ID NO: 46916

SEQ ID NO: 49323 - RNA, 64 nt, Human; identical to SEQ ID NO: 46917

SEQ ID NO: 49324 - RNA, 64 nt, Human; identical to SEQ ID NO: 46918

SEQ ID NO: 49325 - RNA, 64 nt, Human; identical to SEQ ID NO: 46919

SEQ ID NO: 49326 - RNA, 64 nt, Human; identical to SEQ ID NO: 46920

SEQ ID NO: 49327 - RNA, 64 nt, Human; identical to SEQ ID NO: 46921

SEQ ID NO: 49328 - RNA, 64 nt, Human; identical to SEQ ID NO: 46922

SEQ ID NO: 49329 - RNA, 64 nt, Human; identical to SEQ ID NO: 46923

SEQ ID NO: 49330 - RNA, 64 nt, Human; identical to SEQ ID NO: 46924

SEQ ID NO: 49331 - RNA, 64 nt, Human; identical to SEQ ID NO: 46925

SEQ ID NO: 49332 - RNA, 64 nt, Human; identical to SEQ ID NO: 46926

SEQ ID NO: 49333 - RNA, 64 nt, Human; identical to SEQ ID NO: 46927

SEQ ID NO: 49334 - RNA, 64 nt, Human; identical to SEQ ID NO: 46928

SEQ ID NO: 49335 - RNA, 60 nt, Human
gaucucuuggccugguccuugcagcuguggcagcagcaggcuccccagcggcccagggug

SEQ ID NO: 49336 - RNA, 57 nt, Human
aaaaaggccaaggaacuugaagacauacagcagcaucccuuagcaaugugacauugc

SEQ ID NO: 49337 - RNA, 58 nt, Human
agacauuccagagagccugauccacauccagcagcagagcccacuuguggcugcagcu

SEQ ID NO: 49338 - RNA, 60 nt, Human
auuuugcauuuuagcacuugcacuauuacucagcagcaguaacaugguaacacuuaaaau

SEQ ID NO: 49339 - RNA, 60 nt, Human
gccucucaguucuugagggccuccccaccgcagcagcaaggaaagcucacgaaccccaaa

SEQ ID NO: 49340 - RNA, 60 nt, Human
gcacaauugagcagcuugcccagcuaggagcagcagcaacacgagacccuccagcuuugg

SEQ ID NO: 49341 - RNA, 60 nt, Human
cugacacugugacccugggucgggacagaccagcagcaaucugucuuuagaaucgcuuuc

SEQ ID NO: 49342 - RNA, 60 nt, Human
cucagguacaugagcaaucucagggauagccagcagcagcuccaggucugcgcagcagga

SEQ ID NO: 49343 - RNA, 60 nt, Human
agaagaggcagagaggucgucgucgucgcccagcagcaagggcugcaaaauaguagaacu

SEQ ID NO: 49344 - RNA, 60 nt, Human
ugucucacauggaaacagaaaacgcugggucagcagcaagcuguaguuuuuaaaaauguu

SEQ ID NO: 49345 - RNA, 60 nt, Human
ucuucagggacuguccugcccuuuagcuggcagcagcaggaggagugggauucccaauug

SEQ ID NO: 49346 - RNA, 60 nt, Human
gcuucauguccaccagauucugagaggugucagcagcacuuuuuuuuuuuauuuguuguu

SEQ ID NO: 49347 - RNA, 60 nt, Human
gaggugagaagugcucccaagcagacacaacagcagcacagaggucuggaggccacacaa

SEQ ID NO: 49348 - RNA, 60 nt, Human
ccagauuccugcaguggagaggaggucuuccagcagcagcaggucuggagggcugagaau

SEQ ID NO: 49349 - RNA, 60 nt, Human
gauuccugcaguggagaggaggucuuccagcagcagcaggucuggagggcugagaaugaa

SEQ ID NO: 49350 - RNA, 60 nt, Human
aaguccugguccucucagcccugggcccuucagcagcagcauggaggagggugcugaacc

SEQ ID NO: 49351 - RNA, 60 nt, Human
uccugguccucucagcccugggcccuucagcagcagcauggaggagggugcugaaccucg

SEQ ID NO: 49352 - RNA, 60 nt, Human
guggggcugucugguguaugguagggugcucagcagcaucccuggccucugcccacuaga

SEQ ID NO: 49353 - RNA, 60 nt, Human
cucuuuggugagacuucccuggauggagagcagcagcaggggaagaggugcucucagaga

SEQ ID NO: 49354 - RNA, 60 nt, Human
aguaaaacauaguugcuccuaacuuuuuuccagcagcagcaagugguaauaaacaugaaa

SEQ ID NO: 49355 - RNA, 60 nt, Human
aaaacauaguugcuccuaacuuuuuuccagcagcagcaagugguaauaaacaugaaaacu

SEQ ID NO: 49356 - RNA, 60 nt, Human
ccugccuauggcuccagcugugcuguggcccagcagcauggccugcaucuggaaggacac

SEQ ID NO: 49357 - RNA, 60 nt, Human
acuuuuuuuuuuuuuuuuuuuuugguuaaacagcagcacuuuuuaguucccuaaacuuua

SEQ ID NO: 49358 - RNA, 60 nt, Human
gcuacaagcaugaacgggaccagggaauggcagcagcaugcagaaucuuagcacucuuua

SEQ ID NO: 49359 - RNA, 59 nt, Human
aaucaugucugcugcucuaggcccauagucagcagcagcucugagccagguaagaugcu

SEQ ID NO: 49360 - RNA, 60 nt, Human
uuauacuucaaaguagcuuccuuuguaugccagcagcaaauugaaugcucucuuauuaag

SEQ ID NO: 49361 - RNA, 60 nt, Human
gacaagugcucuucuagaacagguuccuaccagcagcacuggugugaaugaaagagagac

SEQ ID NO: 49362 - RNA, 60 nt, Human
aacaucucaaaaauucucuuuccauccuaccagcagcaguguguaagaugggcuauuugu

SEQ ID NO: 49363 - RNA, 60 nt, Human
gcggcccaagcacagcccugacuaggaugacagcagcacaaaagaccaccuuucuccccu

SEQ ID NO: 49364 - RNA, 60 nt, Human
auagcagaguguggcugccccuccuugcuccagcagcagugggagaggcacugcucuggg

SEQ ID NO: 49365 - RNA, 60 nt, Human
gcucugggcuauaugccuauauuuauaaaccagcagcaggggaaagauuauauuuuauaa

SEQ ID NO: 49366 - RNA, 60 nt, Human
ucucuuugcagguagcagcaacaguuguagcagcagcagacgaagccauugcagaggcag

SEQ ID NO: 49367 - RNA, 60 nt, Human
cagccagcaccacugccaccagggcaacugcagcagcaucucaugcauaacccuguggcu

SEQ ID NO: 49368 - RNA, 60 nt, Human
gaagcgaaaggggucagggugcugaggcaacagcagcaagggcuggucuggacaagaaaa

SEQ ID NO: 49369 - RNA, 57 nt, Human
ucacauuagauaugauuuaaccauaagcagcagcacgauccagagauccauugccau

SEQ ID NO: 49370 - RNA, 60 nt, Human
cagagcucauacccaaagcauuacagagaacagcagcaucauugcccuccccagcugaaa

SEQ ID NO: 49371 - RNA, 60 nt, Human
ucgagcccccagacucugugcacuucagaccagcagcagcaggagggcucccgagggccu

SEQ ID NO: 49372 - RNA, 60 nt, Human
agcccccagacucugugcacuucagaccagcagcagcaggagggcucccgagggccuuau

SEQ ID NO: 49373 - RNA, 60 nt, Human
cccagcugccaccauuuucauugcuuuccccagcagcaugaugggaacccaagcugaggg

SEQ ID NO: 49374 - RNA, 60 nt, Human
accaagagcucucccgccuucucccucgagcagcagcaaggacccugacgcuguccccga

SEQ ID NO: 49375 - RNA, 60 nt, Human
caaagcaagagcagauucccuaggcaagagcagcagcacaacuaggaaaccccaaagccc

SEQ ID NO: 49376 - RNA, 60 nt, Human
cugcgggaucacuggggggcucucagggaacagcagcagugccauagccaggcucucugc

SEQ ID NO: 49377 - RNA, 60 nt, Human
gagcugucuuccuguguaccucuagaaucccagcagcagagaaccaucaaggcgggaggg

SEQ ID NO: 49378 - RNA, 60 nt, Human
ucggcaccccgggcccauacaggaccagggcagcagcauugagccacccccuuggcaggc

SEQ ID NO: 49379 - RNA, 60 nt, Human
guccuugaggccuaggacgcugcccggccucagcagcagcccugggagccuccugagggc

SEQ ID NO: 49380 - RNA, 60 nt, Human
ccagaguuagaguaggagaggacuaauucucagcagcaguggaggugaguucuuucuuuu

SEQ ID NO: 49381 - RNA, 60 nt, Human
augggggaggcggcgucccagucuguguugcagcagcauucucaucgggggugcgcacac

SEQ ID NO: 49382 - RNA, 60 nt, Human
uguccugguguucauuucaaggccaguguucagcagcagcguuuggaaagcagguucugu

SEQ ID NO: 49383 - RNA, 60 nt, Human
cagcaguacgagaugcucaagcgcuggcgccagcagcagcccgcgggccucggagccguu

SEQ ID NO: 49384 - RNA, 60 nt, Human
acuugugucugcuccuagccugugcucugccagcagcacagacaucugcuccaucagacc

SEQ ID NO: 49385 - RNA, 60 nt, Human
accuaucccaagaccucacuggucuguggacagcagcagaaauguuugcaagauaggcca

SEQ ID NO: 49386 - RNA, 60 nt, Human
uggugccaaagucuggaucuuuccacauuucagcagcaccaacaucugcugcuacucaaa

SEQ ID NO: 49387 - RNA, 60 nt, Human
aucuuugaagcauuuugggcuuaagauugccagcagcacacaucagaugcagucauuguu

SEQ ID NO: 49388 - RNA, 60 nt, Human
acucugaauuuucaggaaccgucaaaggagcagcagcaaauucacauauuuucgacuuga

SEQ ID NO: 49389 - RNA, 60 nt, Human
guggcccagacaggaugccaagucugggggcagcagcaggguccuugagagaacagggga

SEQ ID NO: 49390 - RNA, 60 nt, Human
ccugguaaacccagcugggagguuucuaggcagcagcaaaacucugugacaggguguccu

SEQ ID NO: 49391 - RNA, 60 nt, Human
gcccagcagagccugcucccacccuccucccagcagcagacacccacccucucacugacu

SEQ ID NO: 49392 - RNA, 60 nt, Human
gcccagaccccucuccugcccucugcacaccagcagcaggcaugaaccuugggucuggga

SEQ ID NO: 49393 - RNA, 60 nt, Human
ccccagggaggggccuggggaaagcugguccagcagcagggguggaggcuggggccacac

SEQ ID NO: 49394 - RNA, 60 nt, Human
gccuguccacaggcuuccuuguaagcaagucagcagcacagcuacucacgcugccaucug

SEQ ID NO: 49395 - RNA, 60 nt, Human
gauggguacaauaaaaagaacaugggcuuucagcagcagacaaaucccacuuccaccacu

SEQ ID NO: 49396 - RNA, 60 nt, Human
agcagacagcuuuacuuuguaagguuggaacagcagcacuauacaugaaauauaaaccaa

SEQ ID NO: 49397 - RNA, 60 nt, Human
ucaagagucuaauagucuuugccagucauucagcagcaaauuuucagcauuaagcuguuc

SEQ ID NO: 49398 - RNA, 60 nt, Human
ucccuuccaaacugaacuguagaagcagagcagcagcaguuaugugaugcaacacuugau

SEQ ID NO: 49399 - RNA, 60 nt, Human
gagggauagaaugacucucucucuacauaccagcagcauaccaaaugcguucucuaaguu

SEQ ID NO: 49400 - RNA, 60 nt, Human
uagcagcaacagcagcagcagcagcagcagcagcagcagagaccucuccacuuucccuua

SEQ ID NO: 49401 - RNA, 60 nt, Human
ugguagcagcaacagcagcagcagcagcagcagcagcagcagagaccucuccacuuuccc

SEQ ID NO: 49402 - RNA, 60 nt, Human
cagugguagcagcaacagcagcagcagcagcagcagcagcagcagagaccucuccacuuu

SEQ ID NO: 49403 - RNA, 60 nt, Human
uggcagugguagcagcaacagcagcagcagcagcagcagcagcagcagagaccucuccac

SEQ ID NO: 49404 - RNA, 60 nt, Human
ugguggcagugguagcagcaacagcagcagcagcagcagcagcagcagcagagaccucuc

SEQ ID NO: 49405 - RNA, 60 nt, Human
ucuugguggcagugguagcagcaacagcagcagcagcagcagcagcagcagcagagaccu

SEQ ID NO: 49406 - RNA, 60 nt, Human
ugcucuugguggcagugguagcagcaacagcagcagcagcagcagcagcagcagcagaga

SEQ ID NO: 49407 - RNA, 60 nt, Human
cccugcucuugguggcagugguagcagcaacagcagcagcagcagcagcagcagcagcag

SEQ ID NO: 49408 - RNA, 60 nt, Human
ggcucaagcagcagagguaagaggaagaggcagcagcaucccaagaaggaaagagcugga

SEQ ID NO: 49409 - RNA, 60 nt, Human
ggaagaagcaggaaaagcaagaagaaaagacagcagcaucaagaggaggaggacaucuug

SEQ ID NO: 49410 - RNA, 60 nt, Human
uuuuuaggccuaguugaaagucaagaaggacagcagcaagcauaggcucaggauuaaaga

SEQ ID NO: 49411 - RNA, 60 nt, Human
cccaucccauggggguaauaagagcaguagcagcagcaucucugaacauuucucuggauu

SEQ ID NO: 49412 - RNA, 55 nt, Human
cggaccaccucgaccagugacaggccagcagcagagggcggcggaggaaggguua

SEQ ID NO: 49413 - RNA, 60 nt, Human
cacauauagcaguagcagcagcagcagcagcagcagcaaccuuugaucaggagugagauu

SEQ ID NO: 49414 - RNA, 60 nt, Human
acacacauauagcaguagcagcagcagcagcagcagcagcaaccuuugaucaggagugag

SEQ ID NO: 49415 - RNA, 60 nt, Human
cacacacacauauagcaguagcagcagcagcagcagcagcagcaaccuuugaucaggagu

SEQ ID NO: 49416 - RNA, 60 nt, Human
auacacacacacauauagcaguagcagcagcagcagcagcagcagcaaccuuugaucagg

SEQ ID NO: 49417 - RNA, 60 nt, Human
cacauacacacacacauauagcaguagcagcagcagcagcagcagcagcaaccuuugauc

SEQ ID NO: 49418 - RNA, 60 nt, Human
acgcacauacacacacacauauagcaguagcagcagcagcagcagcagcagcaaccuuug

SEQ ID NO: 49419 - RNA, 60 nt, Human
accucccucaugccaggccccugccucucacagcagcacccuuuccucucauugucccug

SEQ ID NO: 49420 - RNA, 60 nt, Human
gccaagcucagcugugugucugagcccacucagcagcaggcaugaucagggcagggccca

SEQ ID NO: 49421 - RNA, 60 nt, Human
ccugaggacacaucuuggcacccagaggagcagcagcaacaggcuggagggagagggaag

SEQ ID NO: 49422 - RNA, 60 nt, Human
cuccuuaguggugcuugcagucacaggaagcagcagcaguaaggacaaggggccggauuc

SEQ ID NO: 49423 - RNA, 60 nt, Human
ugaaacaggugagaguuugcuucccccuuucagcagcauucuuuuuagauuuagguacug

SEQ ID NO: 49424 - RNA, 60 nt, Human
ucccuccccgcaucuccagagagagccucucagcagcaggggggugcuacccuuacagga

SEQ ID NO: 49425 - RNA, 60 nt, Human
acaugcugaaaaguaauuaucaguucugcacagcagcagaugcaggguuuuuuuuuaaag

SEQ ID NO: 49426 - RNA, 60 nt, Human
gagcuuuaacauuugaagccacuucagcagcagcagcaaaaggcgaacucaucucuaccc

SEQ ID NO: 49427 - RNA, 60 nt, Human
ccagagcuuuaacauuugaagccacuucagcagcagcagcaaaaggcgaacucaucucua

SEQ ID NO: 49428 - RNA, 60 nt, Human
gcaccagagcuuuaacauuugaagccacuucagcagcagcagcaaaaggcgaacucaucu

SEQ ID NO: 49429 - RNA, 60 nt, Human
gccucugccccuggccuuugaggcaaaggccagcagcagauaacaaccccggacaaauca

SEQ ID NO: 49430 - RNA, 60 nt, Human
aaagaaugcguccgaggacuuugggccgggcagcagcaggagcuuauauuucuucgcaac

SEQ ID NO: 49431 - RNA, 60 nt, Human
cccacugucacgcugccugguguucccccucagcagcaagcacuucucuuagggcugacg

SEQ ID NO: 49432 - RNA, 60 nt, Human
ucaugcaguuggcauccaggcagcccucugcagcagcacacccugcaggcggaguuuuca

SEQ ID NO: 49433 - RNA, 60 nt, Human
auuuccuccuccuucaccuccaaccacugucagcagcacucuggaguuuucaaaugucac

SEQ ID NO: 49434 - RNA, 60 nt, Human
cuuucucacaccugcuucccaaugagcacucagcagcauggcugagaccuggggcuugac

SEQ ID NO: 49435 - RNA, 60 nt, Human
guagaggcagccagaauucugacucccuggcagcagcagggcuuucaggcaccagugucu

SEQ ID NO: 49436 - RNA, 60 nt, Human
gcaaggagauugaguucacuauggagaagucagcagcaggaggcccaucccuuacucagu

SEQ ID NO: 49437 - RNA, 60 nt, Human
cagcggcuggucucuucccuccaccuggggcagcagcaggaggccuggggaggaggaaaa

SEQ ID NO: 49438 - RNA, 60 nt, Human
gcugucuucccuaccucaccaggcuacuggcagcagcaucccgagagcacaucaucucca

SEQ ID NO: 49439 - RNA, 60 nt, Human
acugucccacucagcucugcuggcgcaguacagcagcagcagccccagcacagcuguguu

SEQ ID NO: 49440 - RNA, 60 nt, Human
gucccacucagcucugcuggcgcaguacagcagcagcagccccagcacagcuguguuccu

SEQ ID NO: 49441 - RNA, 60 nt, Human
aagcacccagcccugcccagcaaccggccccagcagcagguccuggugcuggcggagccc

SEQ ID NO: 49442 - RNA, 60 nt, Human
cuggcgagcuggcguggagcccacaggauucagcagcauggacagucacucuugcacuau

SEQ ID NO: 49443 - RNA, 60 nt, Human
ucugugcaaacacuucgugguucuauauaucagcagcaagugugcaaaauaaaggaccug

SEQ ID NO: 49444 - RNA, 60 nt, Human
uuuauucauuugcauuagcaaauauucaugcagcagcaguugacugaaaauuuauucuua

SEQ ID NO: 49445 - RNA, 60 nt, Human
gaggacccgcagauccuguagacuaucugccagcagcaccucgggggcucuacaaggaaa

SEQ ID NO: 49446 - RNA, 60 nt, Human
acucuggcacagugaugccgggcgccaggacagcagcacucccgcugcacacagacggcc

SEQ ID NO: 49447 - RNA, 60 nt, Human
ucugggagagccgcuguucccuuccuguagcagcagcauuuaugaauggggugaaugggg

SEQ ID NO: 49448 - RNA, 60 nt, Human
accucaaaauagccguuaagacaugaaauacagcagcagguuaccaaugcgaacagguag

SEQ ID NO: 49449 - RNA, 60 nt, Human
cucccaugauaacuaaucuguuuuuaguaucagcagcauuuggcaaguuuauuuuuugga

SEQ ID NO: 49450 - RNA, 60 nt, Human
cuguggaauggaucacguagacauguaacccagcagcaguuugcuucuguuguccacuga

SEQ ID NO: 49451 - RNA, 60 nt, Human
cuuugaauacauaauucucuucaaagacuucagcagcaaaccaaaacagcagguuaaaaa

SEQ ID NO: 49452 - RNA, 60 nt, Human
aaaugagcuggucuauuaugccuuguaaaacagcagcauagggcuuuuaaaagguaguca

SEQ ID NO: 49453 - RNA, 60 nt, Human
caugccugggcuuucaccuugaagcauggucagcagcagagagagcaacgggaaggacaa

SEQ ID NO: 49454 - RNA, 60 nt, Human
uuuuagagacugcuccuauaauugaggaaucagcagcauaggcuuuaucucccuacuucc

SEQ ID NO: 49455 - RNA, 60 nt, Human
gaagcagaucauuucccaaaauucuaagagcagcagcauauguuguugcuuguauaaagc

SEQ ID NO: 49456 - RNA, 60 nt, Human
ucaaccccacauguauuccaugcucagcagcagcagcagaaauaguaggauauagaucac

SEQ ID NO: 49457 - RNA, 60 nt, Human
guuucaaccccacauguauuccaugcucagcagcagcagcagaaauaguaggauauagau

SEQ ID NO: 49458 - RNA, 60 nt, Human
ccuguuucaaccccacauguauuccaugcucagcagcagcagcagaaauaguaggauaua

SEQ ID NO: 49459 - RNA, 60 nt, Human
cucggggugucuuccccaaggcauguggcucagcagcaagaaaggcaaguugcuccugcu

SEQ ID NO: 49460 - RNA, 60 nt, Human
ccaagcuggcccauaaucagcaguggggcccagcagcacaggaggggcggacgguuagcu

SEQ ID NO: 49461 - RNA, 60 nt, Human
uaaaggcaagcaggugugaagagcagggcucagcagcaagucacauuuuucuacuauuug

SEQ ID NO: 49462 - RNA, 60 nt, Human
cugaaccuuccugcccgggagucuguaacacagcagcacaggaccgcgcuuccuuuagca

SEQ ID NO: 49463 - RNA, 60 nt, Human
cucuucuugccaguaagcagcuuuggugggcagcagcagcucaugaauggcaagcugaca

SEQ ID NO: 49464 - RNA, 60 nt, Human
ucaucauagugagcccagagagccacugcccagcagcaugcucacaccaccuacccuagu

SEQ ID NO: 49465 - RNA, 60 nt, Human
caagugccacuccaagggcgguccucggugcagcagcaucagcuucacuugugggggggu

SEQ ID NO: 49466 - RNA, 60 nt, Human
ucagcaggcagagccagaugccaugcuuggcagcagcaguaggacuauaaaccacagcug

SEQ ID NO: 49467 - RNA, 60 nt, Human
ucugauugaggucucuaagagcuggaccaucagcagcagggagcugccuaaacaccuccu

SEQ ID NO: 49468 - RNA, 60 nt, Human
aaaauauuugacaggcuuauggaaggacuacagcagcaugcauucauaacagaacaagaa

SEQ ID NO: 49469 - RNA, 60 nt, Human
ccuugcaaacaaaaaacaacaaaaaagaagcagcagcagcagccugcuguguggcaucug

SEQ ID NO: 49470 - RNA, 60 nt, Human
ugcaaacaaaaaacaacaaaaaagaagcagcagcagcagccugcuguguggcaucugaac

SEQ ID NO: 49471 - RNA, 60 nt, Human
cccaguggucaguucucaguucucagccaucagcagcauuugcucgccccgccuucuucc

SEQ ID NO: 49472 - RNA, 60 nt, Human
uauauauuuuucuucgcuguuacgaauuuacagcagcauuuguacauguaaaauuaaagg

SEQ ID NO: 49473 - RNA, 60 nt, Human
cuccuugugcccuuuggcucuugcugucuucagcagcaucucaggguagcugcccugacc

SEQ ID NO: 49474 - RNA, 60 nt, Human
gaacucauguguugccauguacagaggccacagcagcaugaaggguuguggcuucccuuu

SEQ ID NO: 49475 - RNA, 60 nt, Human
ccacauuuuacaguuuaugaugauuaauagcagcagcauguucaguuucgcuuauaugag

SEQ ID NO: 49476 - RNA, 60 nt, Human
uuaagagguuucucagaauaucuauggccacagcagcauaccaguuuccauccuaauagg

SEQ ID NO: 49477 - RNA, 60 nt, Human
agcuggcacuaaguguuuucauuguaggaucagcagcagguuaaagacugaacgguuagu

SEQ ID NO: 49478 - RNA, 60 nt, Human
agggaguccccucuuaggacaggcacugcccagcagcaagggcagcagaguugggugcua

SEQ ID NO: 49479 - RNA, 60 nt, Human
aagggacuugccuaaagccacccagcaacucagcagcagaaccaagaugggccccaggcu

SEQ ID NO: 49480 - RNA, 60 nt, Human
agccucucccagucucucccugcaguccugcagcagcagcccccacccccaagcuuggug

SEQ ID NO: 49481 - RNA, 60 nt, Human
ggagaacauaucuauccucucagacccucgcagcagcagcaacucauacuuggcuaauga

SEQ ID NO: 49482 - RNA, 60 nt, Human
gaacauaucuauccucucagacccucgcagcagcagcaacucauacuuggcuaaugauau

SEQ ID NO: 49483 - RNA, 60 nt, Human
gagguaagagcagucucuaaaaacuacccacagcagcauuggugcaggggaacuuggcca

SEQ ID NO: 49484 - RNA, 60 nt, Human
aaaauauuccagcacuugaguuguguguggcagcagcauuugaguccaugaaugcuaugg

SEQ ID NO: 49485 - RNA, 60 nt, Human
cagcccagacccugaaaggacguguggagacagcagcaguccuguggugcaguuacugcc

SEQ ID NO: 49486 - RNA, 60 nt, Human
acauugguguucuuggagcccuuuugcagucagcagcaucuauggaugcaaauccagcca

SEQ ID NO: 49487 - RNA, 60 nt, Human
acugcaggagacccugggcuggcuggguuacagcagcagggaggcccagcagcccacugg

SEQ ID NO: 49488 - RNA, 60 nt, Human
uggccaugccuauucuguugacuuuaaaagcagcagcaucaagaacuccuagccuuccca

SEQ ID NO: 49489 - RNA, 60 nt, Human
ugggauucaaaccaacagucugucaguguacagcagcaguacucuccugcacagucucaa

SEQ ID NO: 49490 - RNA, 60 nt, Human
ugaagaagcucugagggcggcaggaccagccagcagcagcccaagcuucccuccaucccc

SEQ ID NO: 49491 - RNA, 60 nt, Human
gggaguggcauggggcaggggcccaguucucagcagcagacacucuguacaguuuuuuca

SEQ ID NO: 49492 - RNA, 60 nt, Human
aagaaaauuaauaaaaaauuuauauauaggcagcagcaaaagagccauguucaaaauagu

SEQ ID NO: 49493 - RNA, 60 nt, Human
gacucuuggauuacagcauggagacuaugucagcagcaauacuuuaggauccacguggca

SEQ ID NO: 49494 - RNA, 60 nt, Human
cucguugaugaagcacauguaugaggagaccagcagcaaaacauaaccauauguguuuug

SEQ ID NO: 49495 - RNA, 60 nt, Human
cauacuacuuuucuaaaauagacaugacuucagcagcagcuuuuuuuuguuguauuuuga

SEQ ID NO: 49496 - RNA, 60 nt, Human
acauuguauauuucaaaagacaaaaagaagcagcagcaguaucuuguucucuaauucaua

SEQ ID NO: 49497 - RNA, 60 nt, Human
gcucccuguccaagugccuuggagaacucacagcagcacgccuuaaucaaagguuuuacc

SEQ ID NO: 49498 - RNA, 60 nt, Human
uuuaugggcagggcccuagaagagcgagcccagcagcacagagaagcucugauagcacag

SEQ ID NO: 49499 - RNA, 60 nt, Human
cucugguggcaggagaagagaggcccagcacagcagcaggccaggccuuccuguccaggu

SEQ ID NO: 49500 - RNA, 60 nt, Human
uuuuguaaccgcguuaaccugacaaaaccucagcagcagaagucccuauuuuucuaggag

SEQ ID NO: 49501 - RNA, 60 nt, Human
ggaagggccacaaccucuguuucugugacccagcagcaucaagccccucgcugggcaccu

SEQ ID NO: 49502 - RNA, 60 nt, Human
cuuucugccuaaggcagagcacaagacucacagcagcaccgaagcgcaucugccguccgg

SEQ ID NO: 49503 - RNA, 60 nt, Human
guggucaugauuaccugcaugcuuugagcucagcagcagucuucauaaacacauuuaaaa

SEQ ID NO: 49504 - RNA, 60 nt, Human
auagcaauuaaugcaggcuauuaucagacacagcagcaggaugaagccaaccugcaguau

SEQ ID NO: 49505 - RNA, 60 nt, Human
aauuuugucaaacccuucucuguacccauacagcagcagccuagcaacucugcuggugau

SEQ ID NO: 49506 - RNA, 60 nt, Human
cuaaugugagguuugaguccagugcgcccacagcagcaugcccuucucaccccuugcagu

SEQ ID NO: 49507 - RNA, 54 nt, Human
aauugaagaacgggaccuaggggacagcagcaccacuccagccucagagacugc

SEQ ID NO: 49508 - RNA, 60 nt, Human
uuucuguucccuugccaucacacuguugcacagcagcaauuguuuuaaagagauacauuu

SEQ ID NO: 49509 - RNA, 60 nt, Human
aacucuacagaaguugugcgcgugcuuucucagcagcauuuuuccuucaaaaucaucuuu

SEQ ID NO: 49510 - RNA, 60 nt, Human
ucucgucccucugcuccgugugucucaugccagcagcacgucgccauccgucaccagaau

SEQ ID NO: 49511 - RNA, 60 nt, Human
uaaacaaaaucguucuuguuggauuuuauucagcagcaucuaucauguagauaaauuccc

SEQ ID NO: 49512 - RNA, 60 nt, Human
uggaaacuuauuuuuucuccccaaaagaaucagcagcacaggggaacuaugucacaguuu

SEQ ID NO: 49513 - RNA, 60 nt, Human
ccuuucuccuccuccuuccucugaguugaccagcagcaggucugccgaccaccagcacca

SEQ ID NO: 49514 - RNA, 60 nt, Human
gcugggaacuguucccuuucugauuaauuucagcagcaucggaauauauuuggagcacac

SEQ ID NO: 49515 - RNA, 60 nt, Human
caagagcacccuguccccauuccaaggggccagcagcacuuuggcccaaaguauuuucuu

SEQ ID NO: 49516 - RNA, 60 nt, Human
gcaugaccaggauuccugugaaagcaggagcagcagcaagccgucccgggccugccuuuc

SEQ ID NO: 49517 - RNA, 60 nt, Human
uucauuuacauguuuucugauuuuacacuacagcagcaggauggaguaguugugucagag

SEQ ID NO: 49518 - RNA, 60 nt, Human
ucagagugggggcuccuuaagccuccaggccagcagcaucagcaucaccugggagauugu

SEQ ID NO: 49519 - RNA, 60 nt, Human
cacaccuggauacugcccauguugacgagacagcagcagggggagagggagggaaggaag

SEQ ID NO: 49520 - RNA, 60 nt, Human
ccaagaucugaggccagcagagcgagcugacagcagcaacacugucagaaggugcccuga

SEQ ID NO: 49521 - RNA, 60 nt, Human
gauuaaaugucugacacauuaaugaaugaccagcagcagcuuucagcucuuaaaaagaca

SEQ ID NO: 49522 - RNA, 60 nt, Human
augccuguagucccagcuacucaggaggcucagcagcaggacgacuugagcccaagaguu

SEQ ID NO: 49523 - RNA, 60 nt, Human
cugggguuugggaaaccacuucagagauggcagcagcaaguuuagcaucuucaaauuucu

SEQ ID NO: 49524 - RNA, 60 nt, Human
ggcacucauuuaaaguauaucuuaaaaaagcagcagcaagguaccuugccauuuuuagca

SEQ ID NO: 49525 - RNA, 60 nt, Human
ugaugauagauuucaaaaaacaaaagguggcagcagcacaauguucauggugaauuaucu

SEQ ID NO: 49526 - RNA, 60 nt, Human
gagauaaugacauacucuuuuacacuguaacagcagcauuauugccuagaacuuuaacca

SEQ ID NO: 49527 - RNA, 60 nt, Human
uguuaauauuagacaaacaguagacaaaugcagcagcaagucaauuguauuagcagaaua

SEQ ID NO: 49528 - RNA, 60 nt, Human
ucuccuccuuuacgcccauuuuccuacccacagcagcaaaugacaacgugucuguccagg

SEQ ID NO: 49529 - RNA, 59 nt, Human
gcuguguuucuacugaccaagcaggagagccagcagcacuuccagcauuugggaaugga

SEQ ID NO: 49530 - RNA, 60 nt, Human
acuugcagcccacaaggggugaggaaaggacagcagcaggaaggaggugcagugcgcaga

SEQ ID NO: 49531 - RNA, 60 nt, Human
uuaccacgccuugaccuucccaagguuacucagcagcagagagcccugggugacuucagg

SEQ ID NO: 49532 - RNA, 60 nt, Human
agcucccccaaggugcaggagggcaggauccagcagcacuggggaugccgaggcaaugcu

SEQ ID NO: 49533 - RNA, 60 nt, Human
cucccucacugaacccugcacguugaguaacagcagcauaauuccauccuaggaaagggg

SEQ ID NO: 49534 - RNA, 60 nt, Human
gagcugcccgagaucacuggagaaggcagccagcagcagcugcacuggaacagucagagc

SEQ ID NO: 49535 - RNA, 60 nt, Human
uaauuugaaaaucacuaaaccucguuuucucagcagcaauaauuuaagaggcuucaaaaa

SEQ ID NO: 49536 - RNA, 60 nt, Human
agaggcguaggggcccaggagagcccccaccagcagcacaauucugucccugucccugcc

SEQ ID NO: 49537 - RNA, 60 nt, Human
acguuuuccuaggugugugugugcaggccacagcagcaugcccuugguguagucagugcc

SEQ ID NO: 49538 - RNA, 60 nt, Human
auccuggcacgcccuacuccacugcccuggcagcagcagguguggccaauggaggggggu

SEQ ID NO: 49539 - RNA, 60 nt, Human
uauucugugagauguuuuguauuauuucaccagcagcauagaacaggaccucugcuuuug

SEQ ID NO: 49540 - RNA, 60 nt, Human
ggccacccacugacccaacugauccugcuccagcagcacaccucagccccacugacaccc

SEQ ID NO: 49541 - RNA, 60 nt, Human
ugggauccaaguccauuucuuaguuccacacagcagcaaaucgcuucaccuucuugaagc

SEQ ID NO: 49542 - RNA, 60 nt, Human
ggugaggaagccccaagccauggugacacacagcagcacugcagauagccagacacaugg

SEQ ID NO: 49543 - RNA, 60 nt, Human
ucgucaucaaccuaacaaacacaaccuucucagcagcauuucuccccugugauggaaaua

SEQ ID NO: 49544 - RNA, 60 nt, Human
ccacaucugaaacugccuccccccaaccaccagcagcagcagggcccuccucccccacca

SEQ ID NO: 49545 - RNA, 60 nt, Human
caucugaaacugccuccccccaaccaccagcagcagcagggcccuccucccccaccagcu

SEQ ID NO: 49546 - RNA, 60 nt, Human
gaucgcucugcucggggagccugggcagagcagcagcaacgugagggucgcugugguggu

SEQ ID NO: 49547 - RNA, 60 nt, Human
uucaccuagggaauguucuguucuuaguuacagcagcaaaauuugaaauaauuucaccag

SEQ ID NO: 49548 - RNA, 60 nt, Human
cagggccaaggcagcaggcggcaggaguagcagcagcaaacaaaggaaggagcugggugg

SEQ ID NO: 49549 - RNA, 60 nt, Human
gaggcgcuguaggagccuggucaucucuaccagcagcagcagcagcgagguucuagccca

SEQ ID NO: 49550 - RNA, 60 nt, Human
gcgcuguaggagccuggucaucucuaccagcagcagcagcagcgagguucuagcccagga

SEQ ID NO: 49551 - RNA, 60 nt, Human
cuguaggagccuggucaucucuaccagcagcagcagcagcgagguucuagcccaggaggg

SEQ ID NO: 49552 - RNA, 60 nt, Human
gugaccugccugcuggcauuggccagaccacagcagcaccuccuccaugcaggccuuaac

SEQ ID NO: 49553 - RNA, 60 nt, Human
cgaguggugcuguacuuguuaugagugaggcagcagcacaguguguggcauuuacauggu

SEQ ID NO: 49554 - RNA, 60 nt, Human
guaacaauuaugaagaauuauuugugcugacagcagcaguuaaacuuuguuucucuaaua

SEQ ID NO: 49555 - RNA, 60 nt, Human
auugggaaaguacagucucaaaaccagcaacagcagcaguaccuacagcccuuuuuuugg

SEQ ID NO: 49556 - RNA, 60 nt, Human
cuuauacugucugucugaggcagaagauaacagcagcaucucgaccagccucugccuuaa

SEQ ID NO: 49557 - RNA, 60 nt, Human
gggcugggucaaggcaaagcucagucgucccagcagcaccucagccaucuguagaagguu

SEQ ID NO: 49558 - RNA, 60 nt, Human
ccagggccgcccgcguccucgccagccucccagcagcaggcgcgcccuuccggccgcgag

SEQ ID NO: 49559 - RNA, 60 nt, Human
gagaucccagggugcaaaguggcauugagacagcagcaacagcucaagagauaucuccug

SEQ ID NO: 49560 - RNA, 60 nt, Human
uuauugggaugaagcuaaauccccagaaugcagcagcagcugagcauguuaaaaugggga

SEQ ID NO: 49561 - RNA, 60 nt, Human
gugcaccacugggacccagcagcagcucagcagcagcagugagagggccuugggaaagac

SEQ ID NO: 49562 - RNA, 60 nt, Human
gcugugcaccacugggacccagcagcagcucagcagcagcagugagagggccuugggaaa

SEQ ID NO: 49563 - RNA, 60 nt, Human
caacaaggaaggcugugcaccacugggacccagcagcagcucagcagcagcagugagagg

SEQ ID NO: 49564 - RNA, 60 nt, Human
gggcugagguuuuuauaccaaaccuggaagcagcagcaggugccugaacucguaacuaga

SEQ ID NO: 49565 - RNA, 60 nt, Human
ugcaaaaaacaacuagaggucaucagaagucagcagcagaaacgacaaggcacuucauga

SEQ ID NO: 49566 - RNA, 60 nt, Human
cacguccugcaauauucacugaggaaugcacagcagcacauaugugccucauguguccug

SEQ ID NO: 49567 - RNA, 60 nt, Human
ugcucacugccucugcaggugcagaggggucagcagcaggagaagcguguugaacacgug

SEQ ID NO: 49568 - RNA, 60 nt, Human
cguuacauuucaggacgauccuuuuuccuucagcagcauuucuuacuggcuguggcugga

SEQ ID NO: 49569 - RNA, 60 nt, Human
gaagugcaguggugcgaucauggaucacugcagcagcauccuccgaguucaagcuauccu

SEQ ID NO: 49570 - RNA, 60 nt, Human
ccuaccaagaccccagcccaacucaagcuacagcagcagcacuucccaagccugcugacc

SEQ ID NO: 49571 - RNA, 60 nt, Human
accaagaccccagcccaacucaagcuacagcagcagcacuucccaagccugcugaccaca

SEQ ID NO: 49572 - RNA, 60 nt, Human
agggaacagaaguggaggaaacaaaagaagcagcagcacgcacaguccugucgcugggug

SEQ ID NO: 49573 - RNA, 60 nt, Human
gcacaaggacugccgccuucucgcucccgccagcagcauagacuggacuggaccagacaa

SEQ ID NO: 49574 - RNA, 60 nt, Human
guggggccacccugugcaugguagaauguucagcagcauuccugccauccauauccauua

SEQ ID NO: 49575 - RNA, 60 nt, Human
gcaggguccccuccugugucucaucucuugcagcagcagcugcugaacuccagccaucaa

SEQ ID NO: 49576 - RNA, 60 nt, Human
aagaguuuguauuauuuuuucauacggcugcagcagcagcugccaggggcuugggauuuu

SEQ ID NO: 49577 - RNA, 60 nt, Human
cuguccuuuuucuccugcuccuuguuuucccagcagcacaugggguuccucggaggagca

SEQ ID NO: 49578 - RNA, 60 nt, Human
agaagcggugggaugggcccccaugaacugcagcagcaugcugagguguccauguugucu

SEQ ID NO: 49579 - RNA, 60 nt, Human
agguagaaauauuuuuaagcuccucugaugcagcagcaaugcaaauuaugacauagugaa

SEQ ID NO: 49580 - RNA, 60 nt, Human
agcaaucuucuauucucauuccuuuucccacagcagcauauuuuagaggcacauacaaaa

SEQ ID NO: 49581 - RNA, 60 nt, Human
cacuuucaacauuuuauuacgauuauuauucagcagcacauucugaggggggaacaauuc

SEQ ID NO: 49582 - RNA, 60 nt, Human
ucugaaaaccagaaagaagucuugucauugcagcagcaucgauuccggugauagaguuug

SEQ ID NO: 49583 - RNA, 60 nt, Human
cacuaugaggauuuuuuuuuucuuuccugucagcagcaguucugugaaugcaucuuaggu

SEQ ID NO: 49584 - RNA, 60 nt, Human
uucggaaaagugggcuaacaccaauucacucagcagcagauggacaaaaugcacaguguc

SEQ ID NO: 49585 - RNA, 60 nt, Human
cagucacugguggccuuccccaagugagcucagcagcaugugcuaauaggugccaauacu

SEQ ID NO: 49586 - RNA, 60 nt, Human
acuugaaaagcaaaccuuaaucugcaaagacagcagcaagcauuauacggucaucuugaa

SEQ ID NO: 49587 - RNA, 60 nt, Human
ccagccuguccccagccccucaaucuggugcagcagcaucuugucacugcacaacagugg

SEQ ID NO: 49588 - RNA, 60 nt, Human
ggccuuguuagacagcacuugggccuuugccagcagcaagaggugaagcgaagccacucu

SEQ ID NO: 49589 - RNA, 60 nt, Human
cucccagcgcugagagccuccccuggcugucagcagcacuguguccaggcucuugucuga

SEQ ID NO: 49590 - RNA, 60 nt, Human
ggccccaugaccguggccacagcccugcuccagcagcacuugcccauuccuuacaccccu

SEQ ID NO: 49591 - RNA, 60 nt, Human
cagugggaguuccuuccagccccaggaccacagcagcagccaggugccgaguggauugag

SEQ ID NO: 49592 - RNA, 60 nt, Human
ugcacguccugccucuccagccccacagggcagcagcaugacugacagacacgcugggac

SEQ ID NO: 49593 - RNA, 60 nt, Human
ggcucagcccuucccacccugccccaugcccagcagcacaacacggagugagacaggaug

SEQ ID NO: 49594 - RNA, 60 nt, Human
uccuccccucuuacaccuacucagaugaggcagcagcagacccaucucgcggcggggguu

SEQ ID NO: 49595 - RNA, 60 nt, Human
uggaugucccaggaggcagcucuccccacacagcagcacagccaucacaggauuccuugu

SEQ ID NO: 49596 - RNA, 60 nt, Human
ccuguucaugggguuuuugcccuggagccucagcagcaaaugccacucugggcagucuuu

SEQ ID NO: 49597 - RNA, 60 nt, Human
gccacgucacaggcccaaaggacucuucuucagcagcaucuuugcaaaugucuuucucuc

SEQ ID NO: 49598 - RNA, 60 nt, Human
cuauugucccuaucauuucagcaaguggaacagcagcaaguuuuucagugcauaugcugc

SEQ ID NO: 49599 - RNA, 57 nt, Human
cugaggagcuggccaagugacuugugccagcagcauggacugcgugccucuccgccg

SEQ ID NO: 49600 - RNA, 60 nt, Human
cccuuccuccccgagucagggcgacuuccacagcagcagaacaagugccuccuggacugu

SEQ ID NO: 49601 - RNA, 60 nt, Human
gccuccaacgagagcacccgccagaggcugcagcagcagcugacccaggcccaagagacc

SEQ ID NO: 49602 - RNA, 60 nt, Human
gaggagcucaaugccgccauuaaccugugccagcagcagcugcccgccacagggguaccc

SEQ ID NO: 49603 - RNA, 60 nt, Human
uccguaggcuucuuaaucuuccaggcauuacagcagcacaguguucuacuuuuuacauca

SEQ ID NO: 49604 - RNA, 60 nt, Human
acaccucuaguccggucugccgguggccuccagcagcaccacagagcuccagaccaacca

SEQ ID NO: 49605 - RNA, 60 nt, Human
ggauucagcagaaucauuucacguuuugaacagcagcaguuugaagggccaaagccuuga

SEQ ID NO: 49606 - RNA, 60 nt, Human
ccuuuugucucccaucaccuuuuccuucuucagcagcaccucacagucagucagacgcug

SEQ ID NO: 49607 - RNA, 60 nt, Human
ggagcccucgcuggaucgucucgucuccugcagcagcacuggcaggcgagggcucucguu

SEQ ID NO: 49608 - RNA, 60 nt, Human
uguuugcugugccacgccugaugcccagcccagcagcaugcuuuguacacugauauauug

SEQ ID NO: 49609 - RNA, 60 nt, Human
cuccuagugcugagcuuggagcagcacggacagcagcauuguuuaugggaauggagagag

SEQ ID NO: 49610 - RNA, 60 nt, Human
guugaaagucuucugucauaaucuauaaagcagcagcacucauggaaauuguagcaugcc

SEQ ID NO: 49611 - RNA, 60 nt, Human
gaaaacucaugagaaauccuuuucuuaauacagcagcacuucuauaauagaucagaauuc

SEQ ID NO: 49612 - RNA, 60 nt, Human
agcuacugcuagaagucuuaaaaaaaccaacagcagcacaggauguauuaagaauuauau

SEQ ID NO: 49613 - RNA, 60 nt, Human
uuuugucuugucuuagagaugagggggcuacagcagcaucaugcaaagagggaaagauga

SEQ ID NO: 49614 - RNA, 60 nt, Human
cacugacagccgccucuggguugaauuccgcagcagcagcaauuggguuggaaagggcuu

SEQ ID NO: 49615 - RNA, 60 nt, Human
ugacagccgccucuggguugaauuccgcagcagcagcaauuggguuggaaagggcuucuu

SEQ ID NO: 49616 - RNA, 60 nt, Human
acagcuagugcauugugcucuuuccaaguucagcagcaguucuaucaguggugccacuga

SEQ ID NO: 49617 - RNA, 60 nt, Human
ugaaguggaucagucucaagugucugguaacagcagcagugcuuagaaaauucuuuuguu

SEQ ID NO: 49618 - RNA, 60 nt, Human
gaguuacaaacaguguaugaagcauucguccagcagcaccaggcugaaaaaacagaacga

SEQ ID NO: 49619 - RNA, 60 nt, Human
uggcagcuguauuuucugcaccaccauuuccagcagcaaucggcucucagaagaaguuua

SEQ ID NO: 49620 - RNA, 60 nt, Human
gcaaagccccucugcccgaagcaauaacaacagcagcagaagcaaucccggggagcugcc

SEQ ID NO: 49621 - RNA, 60 nt, Human
agcaaacagagagccugugggaggggcugacagcagcagccggcuguuugggggaugaug

SEQ ID NO: 49622 - RNA, 60 nt, Human
cccuuccugggccugcugcccuccacggagcagcagcacccuccagcaggcagcccagca

SEQ ID NO: 49623 - RNA, 60 nt, Human
gagcaauugcagcagacccagcagcagcagcagcagcacaaacauugcugccuuuguccc

SEQ ID NO: 49624 - RNA, 60 nt, Human
caagagcaauugcagcagacccagcagcagcagcagcagcacaaacauugcugccuuugu

SEQ ID NO: 49625 - RNA, 60 nt, Human
gaccaagagcaauugcagcagacccagcagcagcagcagcagcacaaacauugcugccuu

SEQ ID NO: 49626 - RNA, 60 nt, Human
aaggaccaagagcaauugcagcagacccagcagcagcagcagcagcacaaacauugcugc

SEQ ID NO: 49627 - RNA, 60 nt, Human
cucaaggaccaagagcaauugcagcagacccagcagcagcagcagcagcacaaacauugc

SEQ ID NO: 49628 - RNA, 60 nt, Human
gcccaauuuucuugagucauucucucucugcagcagcagaggaagggccuguaccucccu

SEQ ID NO: 49629 - RNA, 60 nt, Human
aaggcucacuucugccccgggcacugcguccagcagcagaggggacagggggcaggugug

SEQ ID NO: 49630 - RNA, 60 nt, Human
aaaaagggggauugggcggaaagugagagccagcagcaaaaacuacauuuugcaacuugu

SEQ ID NO: 49631 - RNA, 60 nt, Human
gauguaaaaaguauauuuuugcagaacaggcagcagcaauaacuuguuucuguucuuaug

SEQ ID NO: 49632 - RNA, 60 nt, Human
uacuuagcaugcacaaaguguauucacgugcagcagcaacacaauguuauucguuuuguc

SEQ ID NO: 49633 - RNA, 60 nt, Human
aaagaugauuugcaaugggauguaugaauacagcagcaagaaaaaaaaaugccauaauac

SEQ ID NO: 49634 - RNA, 60 nt, Human
ugcaaaacagggcuaacggcaccugcaggacagcagcacgcuccaucccucaugcucagc

SEQ ID NO: 49635 - RNA, 60 nt, Human
ugcccugcugcaggagugacggugaugacccagcagcaacugaaagggaggugaggggcu

SEQ ID NO: 49636 - RNA, 60 nt, Human
auaaauuacccagucaugggcaguccuuuacagcagcaugagaauggacuaauacacucc

SEQ ID NO: 49637 - RNA, 60 nt, Human
ugaacaccuucgacuccugugccaaucaggcagcagcaauuucacaaaucagggccagug

SEQ ID NO: 49638 - RNA, 60 nt, Human
uuucauggguaggaaagcuuguccugaccccagcagcaaagagguggcaggucgcuaaug

SEQ ID NO: 49639 - RNA, 60 nt, Human
cucaaaccagucagggccgucaugacuacgcagcagcagcaguuuccaagacgggccaga

SEQ ID NO: 49640 - RNA, 60 nt, Human
aaaccagucagggccgucaugacuacgcagcagcagcaguuuccaagacgggccagaaac

SEQ ID NO: 49641 - RNA, 60 nt, Human
agccagucacagcuccaccuccaacuucuacagcagcaauuuuuagugggaaagaacagc

SEQ ID NO: 49642 - RNA, 60 nt, Human
ugguaccugagcgccuccuccgcagagcugcagcagcaguggcuggaaacccuaagcacu

SEQ ID NO: 49643 - RNA, 60 nt, Human
agccugguucggccuggcggccccaggaggcagcagcaaccuugggcuuccugcggggug

SEQ ID NO: 49644 - RNA, 60 nt, Human
aaccagcagaucuuacugaagaugauguuccagcagcagcgacuuagccccaggagccca

SEQ ID NO: 49645 - RNA, 60 nt, Human
aagcagacacagggauaagaacagaggaggcagcagcauugcacagccccaggcacagug

SEQ ID NO: 49646 - RNA, 60 nt, Human
gaggauguuagacuugcucccucuccaagacagcagcagccugcaccugccccgugugug

SEQ ID NO: 49647 - RNA, 60 nt, Human
auucuucaucagugccgucauuuguuucugcagcagcagcugagaaggcagccggcagcu

SEQ ID NO: 49648 - RNA, 60 nt, Human
ggguggccuucucaggacuccuggguggcacagcagcaggaccuugucaugggacugaug

SEQ ID NO: 49649 - RNA, 60 nt, Human
acccccugggcagccucaaaaccccgcuuacagcagcaacacaggagaucaucuguccau

SEQ ID NO: 49650 - RNA, 60 nt, Human
ugcuaaagaagacagacuuucccuuccucccagcagcagcagugcagagcccaccuggag

SEQ ID NO: 49651 - RNA, 60 nt, Human
uaaagaagacagacuuucccuuccucccagcagcagcagugcagagcccaccuggaggga

SEQ ID NO: 49652 - RNA, 60 nt, Human
gaaugaggaguaaaaugcucacggcaaagucagcagcacugguaagccaagacugagaaa

SEQ ID NO: 49653 - RNA, 60 nt, Human
cuggggccaccucggcugcugcagccugcccagcagcacauuccagucacugcccccgca

SEQ ID NO: 49654 - RNA, 60 nt, Human
uuuaaaugugcugcaacguuuuuaaaaaugcagcagcauaggagugaacaacagcaacac

SEQ ID NO: 49655 - RNA, 60 nt, Human
guuugguagacaaaaucaaaaggcauuuaacagcagcaguacuuggaagcuuugaaaaca

SEQ ID NO: 49656 - RNA, 60 nt, Human
ccaucuagcaggaaaagccauaucuugcaccagcagcaugaauggucccuccacacucug

SEQ ID NO: 49657 - RNA, 60 nt, Human
ucccaaguugaacacccaagacacaagcuucagcagcaucggaaauuuccagcugggcau

SEQ ID NO: 49658 - RNA, 60 nt, Human
cgcuagguuaugacgaccugacccaggggacagcagcaggagacuacuccaaagguggcu

SEQ ID NO: 49659 - RNA, 60 nt, Human
cugucugggugggacccccgcgagugcauccagcagcaguagcagggccgcgcccuuggu

SEQ ID NO: 49660 - RNA, 60 nt, Human
auuauacugccucagucugacuccucaacccagcagcaauuugaggggaugagggggaag

SEQ ID NO: 49661 - RNA, 60 nt, Human
agacaugguggccauugcccacccagguaccagcagcagaagacuaucugacuuggaaag

SEQ ID NO: 49662 - RNA, 60 nt, Human
ccugggaaggagagcuugcuuuuguugcuucagcagcacccauguaaauaccuucuugcu

SEQ ID NO: 49663 - RNA, 60 nt, Human
cgugcaaaaacuaacauugaaauuuugaaacagcagcagagugaguggauuuuauuuuuc

SEQ ID NO: 49664 - RNA, 60 nt, Human
ucuccugucccuccuaugcagggcuugcagcagcagcaguguggccaucuccauccccca

SEQ ID NO: 49665 - RNA, 60 nt, Human
guuucuccugucccuccuaugcagggcuugcagcagcagcaguguggccaucuccauccc

SEQ ID NO: 49666 - RNA, 60 nt, Human
cagcuaacaucugcuucaccucaacuaacccagcagcagcgggacggcggugcuagguca

SEQ ID NO: 49667 - RNA, 60 nt, Human
agacuacugguauucccagcugccauguggcagcagcaggagcuacuagaauauucucag

SEQ ID NO: 49668 - RNA, 60 nt, Human
aacuugaaaaacaguuuguaagccuuucaacagcagcaucaaccuacgugguggaaauag

SEQ ID NO: 49669 - RNA, 60 nt, Human
uggccaaaacacuggccaggaugcagcaagcagcagcaggggcugacagcaggcuuacug

SEQ ID NO: 49670 - RNA, 60 nt, Human
ggucaagucugcucucccucgccuaaagugcagcagcagcuccucucaagcucacucucu

SEQ ID NO: 49671 - RNA, 60 nt, Human
caggccgccucccgcaccccuaccccguggcagcagcauaccucugcauuucuggaaugu

SEQ ID NO: 49672 - RNA, 60 nt, Human
uuuaugugcaauggugucguccaugcacgacagcagcaaacauucuggggcugcuuuuua

SEQ ID NO: 49673 - RNA, 60 nt, Human
uguuuuaguuugguaaguuuuaagaaauuucagcagcaaaguuguuauucagugggcacg

SEQ ID NO: 49674 - RNA, 60 nt, Human
cgggagcacccagagcacccccugcuccaccagcagcauggcauagccccggccccccgc

SEQ ID NO: 49675 - RNA, 60 nt, Human
ggcgguggcugccccggccuccucggagagcagcagcaccaaccacagcaucgggagcac

SEQ ID NO: 49676 - RNA, 60 nt, Human
gauauugcugauggccuagcuguuacagugcagcagcagugacggaggaaacagacaugg

SEQ ID NO: 49677 - RNA, 60 nt, Human
agggucugggcuccugccucaccgcugguucagcagcacccuccccgccgggucccaccu

SEQ ID NO: 49678 - RNA, 60 nt, Human
cugcagccucagaaaccaggccucucacuccagcagcaggcagaaccgugucuguggucg

SEQ ID NO: 49679 - RNA, 60 nt, Human
ccaucagggccucccuugcccgccugagagcagcagcagucucugucaucccgucgcccc

SEQ ID NO: 49680 - RNA, 60 nt, Human
gcuagugagaccacacagggguagccccagcagcagcacccugcaagccagccuggccag

SEQ ID NO: 49681 - RNA, 60 nt, Human
agggcuagugagaccacacagggguagccccagcagcagcacccugcaagccagccuggc

SEQ ID NO: 49682 - RNA, 60 nt, Human
acagcauggguggcaggguuuggacccgcccagcagcaccacggaccccagccacucucg

SEQ ID NO: 49683 - RNA, 60 nt, Human
auuuuuuccuaguaccuuuggcugcuaaggcagcagcauguuuaauuuauaacaacacaa

SEQ ID NO: 49684 - RNA, 60 nt, Human
gugguuaagcauuccuuucucuucagugcccagcagcacccaguguuggucuguguccau

SEQ ID NO: 49685 - RNA, 60 nt, Human
gcauugagagggugcugcccgcucaaugcccagcagcagcucuggaaggcagugcucagc

SEQ ID NO: 49686 - RNA, 60 nt, Human
cuauugcucuccucuguccaccguuccaggcagcagcacucccaccuggcugcucugaug

SEQ ID NO: 49687 - RNA, 60 nt, Human
gauuuggccuuaauauauuuccauugugaccagcagcaggcuuuuuucccccaagaagau

SEQ ID NO: 49688 - RNA, 60 nt, Human
uuucuaggauuaacugagagauuaaaggaacagcagcacuuaggcucaaaaucgccccua

SEQ ID NO: 49689 - RNA, 60 nt, Human
acgcagauuagcaggccaaggucugagccacagcagcauuuuuauuucagauuuugauaa

SEQ ID NO: 49690 - RNA, 60 nt, Human
agugcgugaggucagucaacagccaaauuccagcagcaaaauacauuuucaucaauauca

SEQ ID NO: 49691 - RNA, 60 nt, Human
cuuuccuaacagugaauucacaacccugaacagcagcauuuuuggaaggcaaacuguucg

SEQ ID NO: 49692 - RNA, 60 nt, Human
aggcacacacagacacagaccagagacucccagcagcagagcccaagcacuggcuucgcc

SEQ ID NO: 49693 - RNA, 60 nt, Human
gaugagauugucaacauugccuaacagaugcagcagcagucuuuagccagagaacucucu

SEQ ID NO: 49694 - RNA, 52 nt, Human
guuccuuuaggagacguugauccagcagcacgugucauuucauuagguccug

SEQ ID NO: 49695 - RNA, 60 nt, Human
aggaagaaggaaugaccucugggcugaaaacagcagcauuuucaguaauuccuacaaaca

SEQ ID NO: 49696 - RNA, 60 nt, Human
uggaaucugaagcuuauaaaaguugaaugacagcagcauuaaacauauaugugaagaguc

SEQ ID NO: 49697 - RNA, 60 nt, Human
cgcaaccaccauguuccuuuguauaugaugcagcagcauaaauguaagcuuuuauaucau

SEQ ID NO: 49698 - RNA, 60 nt, Human
caaagcaauaauaguaguaguaguaguuagcagcagcaguaguagucaugcuaauuauau

SEQ ID NO: 49699 - RNA, 60 nt, Human
gauguaaauuugccaugacuuccuggaggacagcagcauggagaaagauccuagaaaagg

SEQ ID NO: 49700 - RNA, 60 nt, Human
ggaaccuucgcuguuugguauuugguauuucagcagcagugugcaauuuuugcuuggccc

SEQ ID NO: 49701 - RNA, 60 nt, Human
uuagauggccacccucaccacuguccaguccagcagcagccuggcugccuugucauggcc

SEQ ID NO: 49702 - RNA, 60 nt, Human
ccgggggggacucaacagcagagcucugagcagcagcaggcaacuucgagaacggaucca

SEQ ID NO: 49703 - RNA, 60 nt, Human
ucaagugugcggagacaggcggcugaaagccagcagcacgaacugcccgucagagaagug

SEQ ID NO: 49704 - RNA, 60 nt, Human
gccccacuuguccuuagccuggaccucugacagcagcaucucuaccuucuccccagcucc

SEQ ID NO: 49705 - RNA, 60 nt, Human
uuggaacuugccugccuuuccauccauggccagcagcaccugcccuaccugccccacuug

SEQ ID NO: 49706 - RNA, 60 nt, Human
gcuuacucagauacuuacacacaacaacagcagcagcagcugcuacugcaacaaccgcua

SEQ ID NO: 49707 - RNA, 60 nt, Human
ccugcuuacucagauacuuacacacaacaacagcagcagcagcugcuacugcaacaaccg

SEQ ID NO: 49708 - RNA, 60 nt, Human
uucagacugaagcagcaauucugccacuaccagcagcaaccaggacgucuguucuuugug

SEQ ID NO: 49709 - RNA, 60 nt, Human
ugaccaaaggccccugccaggugugggccacagcagcagguaugugugaaagcaacguag

SEQ ID NO: 49710 - RNA, 60 nt, Human
ugcugauggaaacaguaucuucaaaaaaaucagcagcaauugaaaugcuacaaaagacuu

SEQ ID NO: 49711 - RNA, 60 nt, Human
uacaugacagagaaaguuacacucagggagcagcagcaccuccagacuggaaaaauaugu

SEQ ID NO: 49712 - RNA, 60 nt, Human
agcaaagccugggugcccaagcagccaccgcagcagcagaguacaaccugcagagaagcu

SEQ ID NO: 49713 - RNA, 60 nt, Human
ucuuuaccagaaagguagacaaaaaagaagcagcagcagcucuuaaagugaggguuauuc

SEQ ID NO: 49714 - RNA, 60 nt, Human
cuuugucucacugaauucuuaucauggaaacagcagcagcagccgcuaggaaaucuucaa

SEQ ID NO: 49715 - RNA, 60 nt, Human
ugucucacugaauucuuaucauggaaacagcagcagcagccgcuaggaaaucuucaagug

SEQ ID NO: 49716 - RNA, 60 nt, Human
ucggcaguaaccuacuuuguuccuucgccucagcagcaaaucuugcuacuggcucuagau

SEQ ID NO: 49717 - RNA, 60 nt, Human
gaagcccugcccuccagccacagcaguccacagcagcaggguuaagacucagcacagggc

SEQ ID NO: 49718 - RNA, 60 nt, Human
cagcagcaggguuaagacucagcacagggccagcagcagcacaaccuugaccagagcuug

SEQ ID NO: 49719 - RNA, 60 nt, Human
cagcaggguuaagacucagcacagggccagcagcagcacaaccuugaccagagcuugggu

SEQ ID NO: 49720 - RNA, 60 nt, Human
cuugccuguuccccauuagcacaggaguagcagcagcaggacaggcaagagccucacaag

SEQ ID NO: 49721 - RNA, 60 nt, Human
gaugcucucuagccuggaucugaggcacaccagcagcaugacaaacucaugaaauggugg

SEQ ID NO: 49722 - RNA, 60 nt, Human
uauauucauauacacuaguauauauguacacagcagcauccugcaugccaaaguagcuuc

SEQ ID NO: 49723 - RNA, 60 nt, Human
uauaggcaugagcugccgugccuggacuaucagcagcacauguuuugcuguuacggugua

SEQ ID NO: 49724 - RNA, 60 nt, Human
uuauguccuaauuguauuuuggggaaugaacagcagcaaauacuguaaauguacaguuuu

SEQ ID NO: 49725 - RNA, 60 nt, Human
gaaaaccaccucuguuuuccuugcucuauacagcagcacauauuaucauacagacagaaa

SEQ ID NO: 49726 - RNA, 60 nt, Human
gggugauggguucguuagaaguccaaaccucagcagcacacaauauacucauguaacaag

SEQ ID NO: 49727 - RNA, 60 nt, Human
caacacuaccugugggaugccuuaguuacccagcagcagguuaccaagggcugucuggaa

SEQ ID NO: 49728 - RNA, 60 nt, Human
guauaaagaaauaugaggccccaauuggaacagcagcauggagggucccaguuggguccc

SEQ ID NO: 49729 - RNA, 60 nt, Human
uggcccaacuccaucgcugcgggggugcugcagcagcagggcggugccccagggacaaac

SEQ ID NO: 49730 - RNA, 60 nt, Human
cuucaggauacuuccaggagacagagccaccagcagcaaaacaaauauucccaugccugg

SEQ ID NO: 49731 - RNA, 60 nt, Human
acauccagucccagcguggcccuuggcgcgcagcagcaggcgaacucccagaagguggug

SEQ ID NO: 49732 - RNA, 60 nt, Human
cucggcccccuccaucgggcugaggaagcacagcagcaucuucaaacauguacaaaaucg

SEQ ID NO: 49733 - RNA, 60 nt, Human
ggccugugggggcccuggacagucacaccccagcagcagugagugggcagguuuggagga

SEQ ID NO: 49734 - RNA, 60 nt, Human
ggcaucgacaucugaccucccagcaccagccagcagcaggacugagaaagacucacccug

SEQ ID NO: 49735 - RNA, 60 nt, Human
gagacuuuauuugugguuuucacacuauuucagcagcaaaaacuuuuucaaggaaaaucu

SEQ ID NO: 49736 - RNA, 60 nt, Human
uuuguaaguggaaggauuguacugaaggcucagcagcaauagaggugagugcauguagcc

SEQ ID NO: 49737 - RNA, 60 nt, Human
uuauucuugcccuaagagacacugccuuuucagcagcagauacuggugagaugggggugg

SEQ ID NO: 49738 - RNA, 60 nt, Human
ggucguuucgcacacuagguggcauacaggcagcagcagguguucauauccuugauuuug

SEQ ID NO: 49739 - RNA, 60 nt, Human
cccagguaugggcagcucccaggccagcagcagcagcagccuacgcuaauaggaccacug

SEQ ID NO: 49740 - RNA, 60 nt, Human
ccacccagguaugggcagcucccaggccagcagcagcagcagccuacgcuaauaggacca

SEQ ID NO: 49741 - RNA, 60 nt, Human
agaccacccagguaugggcagcucccaggccagcagcagcagcagccuacgcuaauagga

SEQ ID NO: 49742 - RNA, 60 nt, Human
ccagguggcaggauuacuacuuugccucuucagcagcaucuacucuaggcauauugauca

SEQ ID NO: 49743 - RNA, 60 nt, Human
acccuccaccccagcugccaagcccugggccagcagcacccccuuguggccauccugugc

SEQ ID NO: 49744 - RNA, 60 nt, Human
gcagggggggaggugggcagaggggccuuacagcagcagaggcuggaagagaagcucugu

SEQ ID NO: 49745 - RNA, 60 nt, Human
agaacacuaacucaccagccccacugccagcagcagcaggugauuggaccaggccauucu

SEQ ID NO: 49746 - RNA, 60 nt, Human
ccuagaacacuaacucaccagccccacugccagcagcagcaggugauuggaccaggccau

SEQ ID NO: 49747 - RNA, 60 nt, Human
cgcgaagggauugccuggucuaagggcacccagcagcagagcuaggacuuccgcccuaag

SEQ ID NO: 49748 - RNA, 60 nt, Human
gucucaggagugggguugggggacagccuucagcagcagcucacacccuaccuuccccag

SEQ ID NO: 49749 - RNA, 60 nt, Human
aguggccuucucugcaggccagcaagccugcagcagcaggugcccccacgucaggugcug

SEQ ID NO: 49750 - RNA, 60 nt, Human
gaauugguauauucacagacuguagacuuucagcagcaaucucagaagcuuacaaauaga

SEQ ID NO: 49751 - RNA, 60 nt, Human
ugacccucaggucacaggcagagagagucacagcagcagacugcucugggucagugacaa

SEQ ID NO: 49752 - RNA, 60 nt, Human
ucuaccagagcagacagucacccuacuuuucagcagcaaaacugcccugaugacgcagca

SEQ ID NO: 49753 - RNA, 60 nt, Human
cgcuguucacacccgcuccggagagcaccccagcagcauccagaagcagcugcaguguug

SEQ ID NO: 49754 - RNA, 60 nt, Human
cuaccucccagguggaaguccuucaggguccagcagcaaccuguaucagaagaacauccu

SEQ ID NO: 49755 - RNA, 60 nt, Human
gacaaguuggggccagagaugauggcaguccagcagcaacucccugugcucccuucucuu

SEQ ID NO: 49756 - RNA, 60 nt, Human
acagaaucagugacccgggugcuuuguggccagcagcacagaaucaaacccgcaucccag

SEQ ID NO: 49757 - RNA, 60 nt, Human
cacagcuccuccgggauacauaugugcccucagcagcagcucccaggugaaguuaccaga

SEQ ID NO: 49758 - RNA, 60 nt, Human
uaccugaaagagaacuucucgccauggauccagcagcacgguggauggguaagcguaucc

SEQ ID NO: 49759 - RNA, 60 nt, Human
uuuaagugaaaaguaaccuuucaggcauuucagcagcauacauugacaaucuaggguaua

SEQ ID NO: 49760 - RNA, 60 nt, Human
ggaguuuaaaacguauagccuacaaaguaccagcagcaaauuagcaaagaagcagugaaa

SEQ ID NO: 49761 - RNA, 60 nt, Human
uuuaguuacuaaauuauagcuaaguuuugucagcagcauacuccggaaagucucauacuu

SEQ ID NO: 49762 - RNA, 60 nt, Human
ggaaaugagccagcccaagggcaucauccucagcagcaucgaggaagggccgaggaaugu

SEQ ID NO: 49763 - RNA, 60 nt, Human
cuucugucaauuuuuucaggaccuuaguuccagcagcagaauggaaaaauccuugaagcc

SEQ ID NO: 49764 - RNA, 60 nt, Human
ugaggcccggugcaggaccgauguacaaaacagcagcaagugccucucuucucagagggc

SEQ ID NO: 49765 - RNA, 60 nt, Human
cuagggggcgccaacguucgauuucuaccucagcagcaguuggaucuuuugaagggagaa

SEQ ID NO: 49766 - RNA, 60 nt, Human
uccuacacaggcaaaauagcaugaucugagcagcagcauccaggcugaccucaaggaagc

SEQ ID NO: 49767 - RNA, 60 nt, Human
uuucauggccucugcuuggggugggggagucagcagcacccauuuguacauauaggucau

SEQ ID NO: 49768 - RNA, 60 nt, Human
gacuuuacaucgguuccugucuucugugcacagcagcacuugccgcugugcaggcccacc

SEQ ID NO: 49769 - RNA, 60 nt, Human
ggcagcagagaccugcucugccaaguuguccagcagcagaguggcccuggccugggcauc

SEQ ID NO: 49770 - RNA, 60 nt, Human
ugugggugaguuucaaguuugugguggcaacagcagcaggacagggcacggagggagcga

SEQ ID NO: 49771 - RNA, 60 nt, Human
ucuaaaaucucagcugagaacuucagaaaacagcagcaguauuuuccuuuuccuagugcu

SEQ ID NO: 49772 - RNA, 60 nt, Human
guggcuguccccugccgccccucccuguggcagcagcaggacaggugugugcccagcacc

SEQ ID NO: 49773 - RNA, 60 nt, Human
caccagcggaagcuccggcagaagcagcugcagcagcaguuccgggagcggauggagaag

SEQ ID NO: 49774 - RNA, 60 nt, Human
agaacccaaggacuucuggguacugagaagcagcagcagaaugaggccaaaugcagagau

SEQ ID NO: 49775 - RNA, 60 nt, Human
aggcucuugucuguggucucuagggcucugcagcagcaguggcucuucgauuaguuaaaa

SEQ ID NO: 49776 - RNA, 60 nt, Human
ugggcagggucuggaugcccacuuuccaugcagcagcauuucauugcucaaaaccauccu

SEQ ID NO: 49777 - RNA, 60 nt, Human
ggugucuuacagaaaccaucacguaugucgcagcagcauuucaccccugaagucucuaaa

SEQ ID NO: 49778 - RNA, 60 nt, Human
acgugccacugccccaccaccagcugaaaacagcagcacaucgcuggcuuuuccccuugu

SEQ ID NO: 49779 - RNA, 60 nt, Human
gccucucccuccugacagugcccagacugccagcagcacccgucuguuacacaugugaaa

SEQ ID NO: 49780 - RNA, 60 nt, Human
ccugaguuuucucuggggucugcacagaggcagcagcauggacaucauggccucucaggu

SEQ ID NO: 49781 - RNA, 60 nt, Human
gcucuuucacggauuuaggcugagaaacuucagcagcaguauuggacuucucugcuguca

SEQ ID NO: 49782 - RNA, 60 nt, Human
cauuuacuucauaccccaggaccccuuccccagcagcagagacccuggagcacaggagag

SEQ ID NO: 49783 - RNA, 60 nt, Human
auuugggagggugagacacugcacagaagacagcagcaagugugcuggccucucugacau

SEQ ID NO: 49784 - RNA, 60 nt, Human
uaaaccaauuaugaaaucugguaauuugugcagcagcaauagaugauaaccaaaaaaaac

SEQ ID NO: 49785 - RNA, 60 nt, Human
uuuacagggguucagccaagcaagacugagcagcagcagggccccaugggauccauccug

SEQ ID NO: 49786 - RNA, 60 nt, Human
uagcaggaauggcaauaguaguaguaguagcagcagcaauaguagaaguagucauaauaa

SEQ ID NO: 49787 - RNA, 60 nt, Human
gaaaagggugugugagaaagccuacugaagcagcagcacugccacuacauguggacaaaa

SEQ ID NO: 49788 - RNA, 60 nt, Human
uauauuugccgaauuuggccuccucaaaagcagcagcaagucgucaagaagcacaccaau

SEQ ID NO: 49789 - RNA, 60 nt, Human
cuuauacucaccacagaauggauugggacacagcagcauaagugugcuacuuggcagcua

SEQ ID NO: 49790 - RNA, 60 nt, Human
cauguggagagagcacugugugcgcagcggcagcagcacagacguccaugaggaaaacuc

SEQ ID NO: 49791 - RNA, 60 nt, Human
gugaaaugcaucaagguccucuccgcuggccagcagcauccccaggcuucucucaggcgc

SEQ ID NO: 49792 - RNA, 60 nt, Human
uuauuuucuuucccugagguuugauuggcacagcagcaaaaguugaggccaccccacuug

SEQ ID NO: 49793 - RNA, 60 nt, Human
caccauccugacaugagaggccugggccagcagcagcauugccgcuccacaucuuugcuc

SEQ ID NO: 49794 - RNA, 60 nt, Human
cgacaccauccugacaugagaggccugggccagcagcagcauugccgcuccacaucuuug

SEQ ID NO: 49795 - RNA, 60 nt, Human
auugaagaccagcaggggcuuccuaaaaagcagcagcagcuggaauuccaaggccaaguc

SEQ ID NO: 49796 - RNA, 60 nt, Human
ccagguuccuggcagugagaggcagcuucucagcagcaggugcuccuuagccaaauaugg

SEQ ID NO: 49797 - RNA, 60 nt, Human
cagcagagaccaaauaaagagaggauuaggcagcagcacugugugugucuuccugggagc

SEQ ID NO: 49798 - RNA, 60 nt, Human
gugagcgcugggcagggcucgugguggcaucagcagcagagacgaagccuuucuguaaca

SEQ ID NO: 49799 - RNA, 60 nt, Human
guauaucccaaaauuuaaaaaaaaaaguaccagcagcaauaaaauugcacuaguuuuauc

SEQ ID NO: 49800 - RNA, 60 nt, Human
uauuaagaccaccucccuuccuaugucucucagcagcacguuggggcacacuuguucauc

SEQ ID NO: 49801 - RNA, 60 nt, Human
acaccgcaugcuuccucauccacauagugccagcagcagugccacgcaguuccuccucuc

SEQ ID NO: 49802 - RNA, 60 nt, Human
aaaaaaaagucuaccaaaggaauuugcauccagcagcagcacuuagaccugccagccacu

SEQ ID NO: 49803 - RNA, 60 nt, Human
aaaaagucuaccaaaggaauuugcauccagcagcagcacuuagaccugccagccacuguc

SEQ ID NO: 49804 - RNA, 60 nt, Human
cacagccccagaccacccgcuuggcccacgcagcagcagagccgccguuugcuggguugu

SEQ ID NO: 49805 - RNA, 60 nt, Human
cuuuggaucauagcccugggccuggcggcacagcagcacuugcguucucggggcugucga

SEQ ID NO: 49806 - RNA, 60 nt, Human
cuccacucaccacaagcugagcaggacagccagcagcaggaugggcugagcuagccucca

SEQ ID NO: 49807 - RNA, 60 nt, Human
gaggggaccaaaaaggaaaaugaggacgugcagcagcauuggaaggcuggggccgggcag

SEQ ID NO: 49808 - RNA, 60 nt, Human
aaggggcuugccugaggucacguagauaaucagcagcacauugaacgcugcacuccuggg

SEQ ID NO: 49809 - RNA, 60 nt, Human
ccauucaugcauugucagauauuuauuaaacagcagcaaagugccagccaauuuguccug

SEQ ID NO: 49810 - RNA, 60 nt, Human
uguucgcugugggaucaccuucuggcccuccagcagcaugauggcacgcugucgcccaaa

SEQ ID NO: 49811 - RNA, 60 nt, Human
gauggggccccccaggcccaggcgaaagggcagcagcauguggcccauggcaccaccccc

SEQ ID NO: 49812 - RNA, 60 nt, Human
uuuguuaaguuggagcuugcacauuuaaaccagcagcauacguuccagaagagcaucuca

SEQ ID NO: 49813 - RNA, 60 nt, Human
uauacagugcauccuugaacugucagcccacagcagcaauaugcuuauucuauccacauc

SEQ ID NO: 49814 - RNA, 60 nt, Human
uggaauccuuaaacuuggccuucucaaacucagcagcagaucuccgggauucugcuguua

SEQ ID NO: 49815 - RNA, 60 nt, Human
ucaggagguacugugaggaagagcaggcaccagcagcagaauggggaauggagagguggg

SEQ ID NO: 49816 - RNA, 60 nt, Human
agauugucugcagaaacucagacagcucaucagcagcagcagcuguauuguauuuuaccu

SEQ ID NO: 49817 - RNA, 60 nt, Human
uugucugcagaaacucagacagcucaucagcagcagcagcuguauuguauuuuaccucau

SEQ ID NO: 49818 - RNA, 60 nt, Human
gcacagguccaaggcuggucccacacuuaucagcagcaacaacugucaguucauccugca

SEQ ID NO: 49819 - RNA, 60 nt, Human
accagcacacgcaaaagaugacgcccagcacagcagcaggacacaccaugugccaggaaa

SEQ ID NO: 49820 - RNA, 60 nt, Human
ccuauacaacaauaagaggagugcgcccuucagcagcauguauacaaaaauugcaacgau

SEQ ID NO: 49821 - RNA, 60 nt, Human
aggcccuggcagcgucuggacuuguguaaacagcagcagucacguuccucggccgccaca

SEQ ID NO: 49822 - RNA, 60 nt, Human
acaguagauuucaccuuuguuucauuauuacagcagcacuguauauaccugucucuaagu

SEQ ID NO: 49823 - RNA, 60 nt, Human
ugaauccgcccagugauagccugugggcaccagcagcaagggcugccaugggauacagca

SEQ ID NO: 49824 - RNA, 60 nt, Human
guucacuguaugccucugagcagagagcagcagcagcagguaccagcacggcccugacug

SEQ ID NO: 49825 - RNA, 60 nt, Human
gauguucacuguaugccucugagcagagagcagcagcagcagguaccagcacggcccuga

SEQ ID NO: 49826 - RNA, 60 nt, Human
aguacucaggcagcuggagagaagagaaggcagcagcagaggcccccgcccucaccccag

SEQ ID NO: 49827 - RNA, 60 nt, Human
aaauuuuauagaugcacuaagaauucacugcagcagcagguuacauagcaaaaaugcaaa

SEQ ID NO: 49828 - RNA, 60 nt, Human
uguagagucacgaagcucagagauuauucccagcagcagccagcaccuggccuggcugag

SEQ ID NO: 49829 - RNA, 60 nt, Human
acucgugagugguaccaacaaacucaugagcagcagcaacaacugaauguccugguccug

SEQ ID NO: 49830 - RNA, 60 nt, Human
gcaacaacugaauguccugguccuggcuagcagcagcaccguggugaugcaggaugaguc

SEQ ID NO: 49831 - RNA, 60 nt, Human
aauaagggaauaaaaucuggccaccccagccagcagcagcaaccuguucaggucgccugc

SEQ ID NO: 49832 - RNA, 60 nt, Human
aagggaauaaaaucuggccaccccagccagcagcagcaaccuguucaggucgccugccgc

SEQ ID NO: 49833 - RNA, 60 nt, Human
acuguacacauuucuuaaaacacaugauaccagcagcaacugaaaaugaaugccgaauuu

SEQ ID NO: 49834 - RNA, 60 nt, Human
uucaagguauuauugauaaaccuuuucaaccagcagcaagaaguucaaauuuuuuucugu

SEQ ID NO: 49835 - RNA, 60 nt, Human
uuccaacuuccuggaacaaagcgacaucgccagcagcaggcuggcagggagugguugagg

SEQ ID NO: 49836 - RNA, 60 nt, Human
gcaguuguauuguguaacaaguacugcucccagcagcaauuagggagaaaacuagucuaa

SEQ ID NO: 49837 - RNA, 60 nt, Human
gcuuguaggacuguucaccaagggggauaccagcagcaagagagugcacccguuuagccc

SEQ ID NO: 49838 - RNA, 60 nt, Human
uagccuccgcagaggcugggggccuccacccagcagcagaccaaccaggaagcagcuuga

SEQ ID NO: 49839 - RNA, 60 nt, Human
ugcaccccaagcccuugccccagcccaguccagcagcagauguuacaaucugagugagga

SEQ ID NO: 49840 - RNA, 60 nt, Human
gagcugaagagccaagaggcuccgagucugcagcagcagccagaccaguagcuggagccc

SEQ ID NO: 49841 - RNA, 60 nt, Human
cccuguaggccaaggcgccaggcaggacgacagcagcagcagcgcgucuccuucaggugg

SEQ ID NO: 49842 - RNA, 60 nt, Human
uguaggccaaggcgccaggcaggacgacagcagcagcagcgcgucuccuucaggugggag

SEQ ID NO: 49843 - RNA, 60 nt, Human
guccagagcgagcagcguggagcucagugacagcagcagggagaaauccacugaaggaaa

SEQ ID NO: 49844 - RNA, 60 nt, Human
agugaguuacccagggcuccagggagcccacagcagcaucagacccauccaggggcuaca

SEQ ID NO: 49845 - RNA, 60 nt, Human
uguacauuuuccccuuuguuaaacaauuaacagcagcacacucugggaccaccagcuauu

SEQ ID NO: 49846 - RNA, 60 nt, Human
cccuaauggugcuaacccccucucacuacccagcagcaggcuggggaccuccucccccuc

SEQ ID NO: 49847 - RNA, 60 nt, Human
gcuguugcagggcaggucugagagggugcccagcagcacccggugucagggccaccuugu

SEQ ID NO: 49848 - RNA, 60 nt, Human
cuccugacccuggugauggucgccacugggcagcagcagccuuaccaguccuccaugauc

SEQ ID NO: 49849 - RNA, 60 nt, Human
gcugugggugggaggaggcagcgcccaucucagcagcaccaggacugccugggacucccu

SEQ ID NO: 49850 - RNA, 60 nt, Human
cccgugcaggcuguggccuucucuccugaccagcagcagguccucagcgcaggggacgcc

SEQ ID NO: 49851 - RNA, 60 nt, Human
ccugccccaggaacccuggccucaccaaaacagcagcagcucguuggcuccaaaaccagg

SEQ ID NO: 49852 - RNA, 60 nt, Human
gggcaccugggagacgggaggauuccagaacagcagcacugagcucccacccgcagagcc

SEQ ID NO: 49853 - RNA, 60 nt, Human
guggcaggacuggcccagggaggaggaagccagcagcacaccuggggaauggggucccgg

SEQ ID NO: 49854 - RNA, 60 nt, Human
ucuuccuguuuuguauuuaaauaaaaacaacagcagcaggcugucccugaguaguuuugc

SEQ ID NO: 49855 - RNA, 60 nt, Human
gcacagggaggauugucuguuuggcugacacagcagcagcccuucccacccagccaccuu

SEQ ID NO: 49856 - RNA, 60 nt, Human
cuggaucccgccugaaacggaccugcagagcagcagcacccuuccgguguggaggcuaug

SEQ ID NO: 49857 - RNA, 60 nt, Human
auccccauggaggaaccaggcccaucugggcagcagcaucugguugaccagauggccacc

SEQ ID NO: 49858 - RNA, 60 nt, Human
aagaggcgucgagggcgccagaaguggcggcagcagcagccgcagcagccaaagagaggc

SEQ ID NO: 49859 - RNA, 60 nt, Human
caacucggagcccgccugagcuccagugcccagcagcagcaugucagcugagccuccugc

SEQ ID NO: 49860 - RNA, 60 nt, Human
cucggagcccgccugagcuccagugcccagcagcagcaugucagcugagccuccugcccu

SEQ ID NO: 49861 - RNA, 60 nt, Human
uggcggaggagaggcccuuugccaggagcacagcagcagcucgccuaccucugagcccag

SEQ ID NO: 49862 - RNA, 60 nt, Human
ugguuuuucuaaguuauuuuguacauuuuucagcagcaaaaccaaacugggucuucagcu

SEQ ID NO: 49863 - RNA, 60 nt, Human
guucaccaucucaagggaaaauggaggcuccagcagcauauuguaccgcuaccccuuuga

SEQ ID NO: 49864 - RNA, 60 nt, Human
uaaaaucuugaaugaauugaguauucuagacagcagcauaagaaauauacaaacaguauc

SEQ ID NO: 49865 - RNA, 60 nt, Human
cgucaccccacccgaugaccugcaugaagccagcagcacccagagccacuccugcugccc

SEQ ID NO: 49866 - RNA, 60 nt, Human
uguggccaggggugcaggguggcggggggucagcagcaugucccugggcaggcccugggc

SEQ ID NO: 49867 - RNA, 60 nt, Human
gacuuugagacuugccaucagcacagcacacagcagcacccuuccccugaggccgguggg

SEQ ID NO: 49868 - RNA, 60 nt, Human
uacaaaucagagcugaguggggaggugcuucagcagcagcgggaucaauacgauuuccac

SEQ ID NO: 49869 - RNA, 60 nt, Human
cuuggagcaaaacuccugagcuagacagcacagcagcacccauccccugccagagcccuu

SEQ ID NO: 49870 - RNA, 60 nt, Human
gaacacggagauugucuuucugccacagaacagcagcagacgugucgggagguuagcugc

SEQ ID NO: 49871 - RNA, 60 nt, Human
ggcccuggguggggauaguuuacacccgggcagcagcaccacacaugaacccaaagacau

SEQ ID NO: 49872 - RNA, 60 nt, Human
uuagaaaauauaaugaaaagauuucguucccagcagcaucaagaaaaguagauuuucuag

SEQ ID NO: 49873 - RNA, 60 nt, Human
ggucccacagaggcaucagcuucagugagacagcagcagccgaugccgcccuuggcuaca

SEQ ID NO: 49874 - RNA, 60 nt, Human
ccccuaugccuuguuccgagcacgaagaaacagcagcagggaugucuaccagccaccucu

SEQ ID NO: 49875 - RNA, 60 nt, Human
acauugacgugaacuuugauguauaauaagcagcagcaacuucaugugaaaauaugguca

SEQ ID NO: 49876 - RNA, 60 nt, Human
augugggcccugggugggagcagcccacuucagcagcacugccacugccuuuggccaccu

SEQ ID NO: 49877 - RNA, 60 nt, Human
caaaagcccauccucacucagcgcuaacaucagcagcagcccaaaaggugaggccugggg

SEQ ID NO: 49878 - RNA, 60 nt, Human
ccaaguugagcacgcgccuuccccagcuugcagcagcacaccccaagcgcugcuuuucac

SEQ ID NO: 49879 - RNA, 60 nt, Human
gcagcugacggggauugccuuccucagccgcagcagcaccuggggcuccagcugcuggaa

SEQ ID NO: 49880 - RNA, 60 nt, Human
uuucccacagcagggacugugagagacaaccagcagcauccucuuuguaaucacagggca

SEQ ID NO: 49881 - RNA, 60 nt, Human
gcucucuauagaggaggauggucaucgugacagcagcagcucaaguuagcauuucaagug

SEQ ID NO: 49882 - RNA, 60 nt, Human
cugaaaggcaagauuguuccuuugccucuccagcagcaguagccagggcuuggacuuauc

SEQ ID NO: 49883 - RNA, 60 nt, Human
ggggagcaucaguggaggaggcagugggggcagcagcagccuccugaccaaugcccgcuc

SEQ ID NO: 49884 - RNA, 60 nt, Human
aaugaauugaaauggggcgcuggacaccuacagcagcacgcaugucccuccaaggcuguc

SEQ ID NO: 49885 - RNA, 60 nt, Human
ugaaaacacaccacauugaaaauccugccacagcagcagccgcagccgccaacagcagcg

SEQ ID NO: 49886 - RNA, 60 nt, Human
aaggugugucuaaaaaacaauucagaauaccagcagcauuguacagcaagggguaaauaa

SEQ ID NO: 49887 - RNA, 60 nt, Human
ucggccauuuaguaauuuaaagcgaauuuccagcagcaagcaugcuuugauaucugguuc

SEQ ID NO: 49888 - RNA, 60 nt, Human
agagggcuggcgggaacgcgagaagggcaccagcagcauuccacacccagcucuuccuca

SEQ ID NO: 49889 - RNA, 60 nt, Human
cagaaaacuccugcugauggucucagcuuccagcagcacaaaagcagaugauguacugga

SEQ ID NO: 49890 - RNA, 60 nt, Human
aaccaggucaaugccgggcaccuguucgugcagcagcacacacacccuaccuuccacgcg

SEQ ID NO: 49891 - RNA, 60 nt, Human
cauggagagaaaucuccugucagugugguccagcagcagggaggaguucugcccaaauuc

SEQ ID NO: 49892 - RNA, 60 nt, Human
uuguguuuucuuaggguggaaugugauguucagcagcaaacuugcaacagacuggccuuc

SEQ ID NO: 49893 - RNA, 60 nt, Human
aaagggccagucccccugcccagaauggagcagcagcaggacagacccccacgaggcccc

SEQ ID NO: 49894 - RNA, 60 nt, Human
aaauugugcgcucuguagauuuggauuuuacagcagcaauuacuuggcuaaauuagagua

SEQ ID NO: 49895 - RNA, 60 nt, Human
cacuugguggcgggguggggugggggugggcagcagcaucccagccuugagaugcuucac

SEQ ID NO: 49896 - RNA, 60 nt, Human
acugguagcagucaucugcauuugaggguucagcagcauauaccuucacacuagguuuca

SEQ ID NO: 49897 - RNA, 60 nt, Human
ugagugggcccugcccggggagcugcagagcagcagcaccuuucucugagaagagguccu

SEQ ID NO: 49898 - RNA, 60 nt, Human
cuuggcaaacagcugguguaaaccuacagccagcagcagucuggagccugggagccuccu

SEQ ID NO: 49899 - RNA, 60 nt, Human
cgggacgggccucauccuccuuuuuuaauccagcagcauccccuaccccaggcugucaac

SEQ ID NO: 49900 - RNA, 60 nt, Human
gggaagucaacucagacuugcaccacaguccagcagcaaggcuccuugcuuccugcuguc

SEQ ID NO: 49901 - RNA, 60 nt, Human
cacaggccccaaccugugugcugggguccccagcagcaaacacuggaaagucuguuuuuu

SEQ ID NO: 49902 - RNA, 60 nt, Human
acacgggaugacgggaagcaggaagcggggcagcagcacagcgugggguccuggcacugc

SEQ ID NO: 49903 - RNA, 60 nt, Human
gaggccgugggccauggggaggacuucacucagcagcaaagagaagagcauuggggcugg

SEQ ID NO: 49904 - RNA, 60 nt, Human
cgcuccuugaagggcccagauucuaccacacagcagcaguuacaaaaaccuuccccaggc

SEQ ID NO: 49905 - RNA, 60 nt, Human
ccacauuucacuaccuucacagaucaaacucagcagcagucaugacugucugucacuaca

SEQ ID NO: 49906 - RNA, 60 nt, Human
cacagaacuauaauauacauugccuuuucucagcagcauuugaauucaacuuauuuauuu

SEQ ID NO: 49907 - RNA, 60 nt, Human
guuaaggacagcagguagaggaaucaaagccagcagcauccuagaaaggagauggggcuu

SEQ ID NO: 49908 - RNA, 60 nt, Human
gugucuguguuucagacagaagagcugaaucagcagcaacuguccagcgcggagcagcug

SEQ ID NO: 49909 - RNA, 60 nt, Human
uaccacucauuuuucccauggaucucuucccagcagcauucagaccucagaugcaugaug

SEQ ID NO: 49910 - RNA, 60 nt, Human
cccccaggcucuccaacucugcagcaguggcagcagcagucaaaacaaacacggggggcg

SEQ ID NO: 49911 - RNA, 60 nt, Human
ugccgauggccccacccucaccagccugggcagcagcaagaacuauuuauuaaaaacuua

SEQ ID NO: 49912 - RNA, 60 nt, Human
aguccagaaaauuagggucccagaagggggcagcagcaggcugggaguuaggagggagag

SEQ ID NO: 49913 - RNA, 60 nt, Human
ccccggcucagcagugggaccagggccucgcagcagcaaggugggggcaagcagaaugcc

SEQ ID NO: 49914 - RNA, 60 nt, Human
ccauuuuacagacaaggacgcugaggccugcagcagcagugugacuugcucaagguccag

SEQ ID NO: 49915 - RNA, 60 nt, Human
cccuccccugacugcauguggaagggcacacagcagcaggcagggaggaggcggaggugg

SEQ ID NO: 49916 - RNA, 60 nt, Human
uuuauaucuuuuuacuacagugaucugugacagcagcagcuucauguuguauuuuuuuua

SEQ ID NO: 49917 - RNA, 60 nt, Human
cacaaagaaaugaacaguuguagggagacccagcagcaccuuuccuccacacaccuucau

SEQ ID NO: 49918 - RNA, 60 nt, Human
cuuccggguaaggggagucaauugauuacccagcagcacaguauuugcuuuuuauaauuc

SEQ ID NO: 49919 - RNA, 60 nt, Human
gaaccaucuacgggcauagaccccacagggcagcagcaaauguggugagcaucauuauac

SEQ ID NO: 49920 - RNA, 60 nt, Human
caccagggaggaguggaggacgagguaacucagcagcaaugucaccuuguagccuaugcg

SEQ ID NO: 49921 - RNA, 60 nt, Human
cacagucucuauggugcugaggaagagcagcagcagcaggauggugaaguaguaaacugg

SEQ ID NO: 49922 - RNA, 60 nt, Human
cagcacagucucuauggugcugaggaagagcagcagcagcaggauggugaaguaguaaac

SEQ ID NO: 49923 - RNA, 60 nt, Human
cccaagguugccccgggccagcagcccagccagcagcacagucucuauggugcugaggaa

SEQ ID NO: 49924 - RNA, 60 nt, Human
uugagcuaaguucaggcagcagcauguggccagcagcagugugcugggagcagagguugg

SEQ ID NO: 49925 - RNA, 60 nt, Human
agugauggagagccuugagcuaaguucaggcagcagcauguggccagcagcagugugcug

SEQ ID NO: 49926 - RNA, 60 nt, Human
agaaucaagcuccuguggccaccugugucccagcagcagugaguggagcugcucagggug

SEQ ID NO: 49927 - RNA, 60 nt, Human
gcugccgagaccccucgggggcugcacacccagcagcagcgcacgccuccgaagccugcg

SEQ ID NO: 49928 - RNA, 60 nt, Human
aaaauauaaaaaauuccaaauucugccuuucagcagcaucaauugcuaggaacauuucau

SEQ ID NO: 49929 - RNA, 60 nt, Human
uauuuaccuaauccuaaggauccacaguuucagcagcauccaccaaaagucacuuuucca

SEQ ID NO: 49930 - RNA, 60 nt, Human
gcgggcagggacugaagccugaccgaccuccagcagcacucggacguccccggaccagcc

SEQ ID NO: 49931 - RNA, 60 nt, Human
uaaggggaagagggaaauguacacuuuuuacagcagcaauauuuuguauauuauguuuau

SEQ ID NO: 49932 - RNA, 60 nt, Human
cuggcuggcuccugcccgugacgccuugcccagcagcaaggugcgcaacauggcugccag

SEQ ID NO: 49933 - RNA, 60 nt, Human
cagcccggucucacccaugguccagucucccagcagcagcaacauccccacgcagccccc

SEQ ID NO: 49934 - RNA, 60 nt, Human
cccggucucacccaugguccagucucccagcagcagcaacauccccacgcagccccccag

SEQ ID NO: 49935 - RNA, 59 nt, Human
ucucucuucaggaacgcugaggcccuucccagcagcagaaucuguugaguugcugccac

SEQ ID NO: 49936 - RNA, 60 nt, Human
aucuggggugggcacguggucggggacccucagcagcaggggcucugucucccuucccaa

SEQ ID NO: 49937 - RNA, 60 nt, Human
agacgggagcagguucuuggccagcguagacagcagcaaacagcagcagggaagccauuc

SEQ ID NO: 49938 - RNA, 60 nt, Human
agguucuuggccagcguagacagcagcaaacagcagcagggaagccauucucacugcauc

SEQ ID NO: 49939 - RNA, 59 nt, Human
uuaucaucguccaaguuuagcaaucccaucagcagcaguaagaggaaugucucccuccu

SEQ ID NO: 49940 - RNA, 60 nt, Human
ugauuuuaagccuuuugccgcuccggggaccagcagcaauccugggcagccaguggcucu

SEQ ID NO: 49941 - RNA, 60 nt, Human
cccaggccgccuguccgucuguccucccuccagcagcacccccuggccccuggaguggug

SEQ ID NO: 49942 - RNA, 60 nt, Human
cccaugucccagccacuucugggucccagccagcagcacggauguuacuguccugcuccu

SEQ ID NO: 49943 - RNA, 60 nt, Human
gaguuggggcggguggucgggucaagauagcagcagcaggugucagggcucaagacacca

SEQ ID NO: 49944 - RNA, 60 nt, Human
auccucaauaaaauacuggcaaaccgaauccagcagcacaucaaaaagcuuauccaccau

SEQ ID NO: 49945 - RNA, 60 nt, Human
guuucuggggguggacaguuccucgccacccagcagcacccugggacugcggccuuuccc

SEQ ID NO: 49946 - RNA, 60 nt, Human
ucucaaacauggacgcccacuguggggccccagcagcacuguggccugcaggagggcaug

SEQ ID NO: 49947 - RNA, 60 nt, Human
gggccgaugagguggacucagccaaagacucagcagcacauggggcagguguccuggcag

SEQ ID NO: 49948 - RNA, 60 nt, Human
gcccuggaccggcagcuggcgcaccaggcccagcagcagcuggaggaggaggaggaggau

SEQ ID NO: 49949 - RNA, 60 nt, Human
uguugcccuggaauguacgggacccaggggcagcagcaguccaggugccacaggcagccc

SEQ ID NO: 49950 - RNA, 60 nt, Human
ugcagagcgcuggggacuccagacuccccacagcagcagagacucgggacugaggcaucc

SEQ ID NO: 49951 - RNA, 60 nt, Human
gauugugggaggggcaagaaggaaaagaaacagcagcagguuugauauucagaaagaaau

SEQ ID NO: 49952 - RNA, 60 nt, Human
ccaaccugcccuccccaaauaugugcucaccagcagcaacaggcuaucugagucuuucca

SEQ ID NO: 49953 - RNA, 60 nt, Human
uccagacggggagcuggcgggcggggguggcagcagcagcucuagccuuggggggacaag

SEQ ID NO: 49954 - RNA, 60 nt, Human
cuggaguggguggaggccagagacacugcucagcagcacccugcagugcccaggacggcc

SEQ ID NO: 49955 - RNA, 60 nt, Human
guggcagacgagcccacggcgccguggucccagcagcaggguugucagucggagcauccu

SEQ ID NO: 49956 - RNA, 60 nt, Human
cuuucaaaaaaucaaaaccagaaguuuuaucagcagcaggaaggaugugggacucugucc

SEQ ID NO: 49957 - RNA, 60 nt, Human
gugacaguuuucaggggccgugcagggcuucagcagcaccuccugccugccagcuggcgu

SEQ ID NO: 49958 - RNA, 60 nt, Human
cccccgcagcagcagcagcagcagcagcagcagcagcaggcgguggccaggccgggccgg

SEQ ID NO: 49959 - RNA, 60 nt, Human
gggcccccgcagcagcagcagcagcagcagcagcagcagcagcagcaggcgguggccagg

SEQ ID NO: 49960 - RNA, 60 nt, Human
ucggggcccccgcagcagcagcagcagcagcagcagcagcagcagcagcaggcgguggcc

SEQ ID NO: 49961 - RNA, 60 nt, Human
ggcucggggcccccgcagcagcagcagcagcagcagcagcagcagcagcagcaggcggug

SEQ ID NO: 49962 - RNA, 60 nt, Human
ggcggcucggggcccccgcagcagcagcagcagcagcagcagcagcagcagcagcaggcg

SEQ ID NO: 49963 - RNA, 60 nt, Human
gccggcggcucggggcccccgcagcagcagcagcagcagcagcagcagcagcagcagcag

SEQ ID NO: 49964 - RNA, 60 nt, Human
aaggccggcggcucggggcccccgcagcagcagcagcagcagcagcagcagcagcagcag

SEQ ID NO: 49965 - RNA, 60 nt, Human
cguaaggccggcggcucggggcccccgcagcagcagcagcagcagcagcagcagcagcag

SEQ ID NO: 49966 - RNA, 60 nt, Human
auccguaaggccggcggcucggggcccccgcagcagcagcagcagcagcagcagcagcag

SEQ ID NO: 49967 - RNA, 60 nt, Human
ggugggcgucaccuggggacuccccacugucagcagcagccccgggacacccuaccccca

SEQ ID NO: 49968 - RNA, 60 nt, Human
gauacagucuucaucuucuucacuuacccacagcagcaacaccaggccugucacacagau

SEQ ID NO: 49969 - RNA, 60 nt, Human
auuaaagugacaugaaugugggaaguccuucagcagcaauucaaaacuuaaauacuauga

SEQ ID NO: 49970 - RNA, 60 nt, Human
acuuuuuuucaaacaguaagaauaauauaucagcagcauguaucugccaaucauauguaa

SEQ ID NO: 49971 - RNA, 60 nt, Human
ugcacugaguuguauccgagagggugggaacagcagcauccccuaauugcaguacacggu

SEQ ID NO: 49972 - RNA, 60 nt, Human
aacacuugcacagcaaagcaagagaagucacagcagcaagacacgcacagucaaccauuu

SEQ ID NO: 49973 - RNA, 56 nt, Human
uggagcuggaguauuuauagcaggaucagcagcaucuccaccugccaucucacccu

SEQ ID NO: 49974 - RNA, 60 nt, Human
guccccaaagcacuggggcaggggccagagcagcagcacccagugcucccuccucuacuc

SEQ ID NO: 49975 - RNA, 60 nt, Human
agaugugacugccaucaucuucgugguggccagcagcagcuacaacauggucauccggga

SEQ ID NO: 49976 - RNA, 60 nt, Human
cccucucacuuucaguaaaaauaaauaaaacagcagcagcaaacaaauaaaaugaaauaa

SEQ ID NO: 49977 - RNA, 60 nt, Human
ucucacuuucaguaaaaauaaauaaaacagcagcagcaaacaaauaaaaugaaauaaaag

SEQ ID NO: 49978 - RNA, 60 nt, Human
gacaguggggugccuccgugccgcuucgugcagcagcaaguucagccugagaugcuggcu

SEQ ID NO: 49979 - RNA, 60 nt, Human
uaaaacuaucagcagcggcagcagcagcagcagcagcaguuugugaucuguccuuccaac

SEQ ID NO: 49980 - RNA, 60 nt, Human
cucuaaaacuaucagcagcggcagcagcagcagcagcagcaguuugugaucuguccuucc

SEQ ID NO: 49981 - RNA, 60 nt, Human
agacucuaaaacuaucagcagcggcagcagcagcagcagcagcaguuugugaucuguccu

SEQ ID NO: 49982 - RNA, 60 nt, Human
ccuagacucuaaaacuaucagcagcggcagcagcagcagcagcagcaguuugugaucugu

SEQ ID NO: 49983 - RNA, 60 nt, Human
acaccuagacucuaaaacuaucagcagcggcagcagcagcagcagcagcaguuugugauc

SEQ ID NO: 49984 - RNA, 60 nt, Human
uaccacaccgugcccucaguggacuaaccacagcagcagccagggaugggcccuggaggu

SEQ ID NO: 49985 - RNA, 60 nt, Human
uuuauagcaagucuccuuccuccauagggacagcagcaccagcccuguggggcauggagu

SEQ ID NO: 49986 - RNA, 60 nt, Human
cucauuccagaacccaucuggccagagaagcagcagcauccugggggauggccgugcaug

SEQ ID NO: 49987 - RNA, 60 nt, Human
gacacaguguuucugcccaggugaccuguucagcagcagaacaagccagggccaugggga

SEQ ID NO: 49988 - RNA, 60 nt, Human
gucccaucugaagcuggaguacccuggggucagcagcaagagaaagaagaggagauuuuc

SEQ ID NO: 49989 - RNA, 60 nt, Human
ugcugaggcucccagccucaguuucccccacagcagcacgggccccacugugcugcucuu

SEQ ID NO: 49990 - RNA, 60 nt, Human
ccgagagacacgguggguaaaggaugugggcagcagcagggaagacaacagaaacacaag

SEQ ID NO: 49991 - RNA, 60 nt, Human
caucuuggagaugugguuuuucggguuccccagcagcaucucccgacaccaacugugccg

SEQ ID NO: 49992 - RNA, 58 nt, Human
aguccuccuccgaggccuaggccgcccccagcagcacagaccccgccgccuccuacgg

SEQ ID NO: 49993 - RNA, 60 nt, Human
ugugguuuucagugaacaagcgcugagcaccagcagcagaaaacaacaacaaaaaaacac

SEQ ID NO: 49994 - RNA, 60 nt, Human
ugaagaaaacaaagaugaugauaauguuuucagcagcaauuugcccucagagguaaguag

SEQ ID NO: 49995 - RNA, 60 nt, Human
uggguguuaacgugcaugaggaucaguuugcagcagcaaguacaaaaggagaagaggaac

SEQ ID NO: 49996 - RNA, 60 nt, Human
augugugcuccccacuguugcacucaggcacagcagcaccuccaggcugggugguuuugc

SEQ ID NO: 49997 - RNA, 60 nt, Human
aagccgccuagugcagagagguugugaaaacagcagcaaugcaauguggaaauuguagcg

SEQ ID NO: 49998 - RNA, 60 nt, Human
auaaaccacauccagccaccuccuucugaucagcagcaaagcugacguuuugaucuccau

SEQ ID NO: 49999 - RNA, 60 nt, Human
aacuucugggcccgggauuuuuucccuauucagcagcauuuuaaucacauguccuccagc

SEQ ID NO: 50000 - RNA, 60 nt, Human
uuuaaaacauuuugcuuugggaaaguaggucagcagcaccuaagaucaaggaugcguucc

SEQ ID NO: 50001 - RNA, 60 nt, Human
ugaauuauaaaugugguguuuggccugccucagcagcaccaguugacugcucgugugcca

SEQ ID NO: 50002 - RNA, 60 nt, Human
ugagggucuccccaccagugcugcaccccgcagcagcauacaggccuguguggccugcug

SEQ ID NO: 50003 - RNA, 60 nt, Human
ggaacccauggaaggagaagcgaggugaugcagcagcaggggcaagacccuggguccagu

SEQ ID NO: 50004 - RNA, 50 nt, Human
gggacuucagcuccugguagcagcagcaacuugcaggcuguaccucugcc

SEQ ID NO: 50005 - RNA, 60 nt, Human
ugugcugcaagcugacuccagccuugggcucagcagcacccggugaacagcagcaggagg

SEQ ID NO: 50006 - RNA, 60 nt, Human
accucgcagggcucagcagcacccggugaacagcagcaggaggagccgcuagagcagcug

SEQ ID NO: 50007 - RNA, 60 nt, Human
aggccuugcaccaggugggggccacagcaccagcagcaucuuugcugggcagggcccagc

SEQ ID NO: 50008 - RNA, 60 nt, Human
ccuuagggcaugaagccuuuuuccuggucccagcagcaucugcccugugaaguuuguuuu

SEQ ID NO: 50009 - RNA, 60 nt, Human
ucugcacaaugagaacuccgacagggguggcagcagcaagcacaauaccauuaaaaaggu

SEQ ID NO: 50010 - RNA, 60 nt, Human
agcuugcuuuagggcugagcccuggacucccagcagcagcacaguucagcauuguguggc

SEQ ID NO: 50011 - RNA, 60 nt, Human
uugcuuuagggcugagcccuggacucccagcagcagcacaguucagcauuguguggcugg

SEQ ID NO: 50012 - RNA, 60 nt, Human
uagggaaacuucuaguggcaaugauaaaaccagcagcaaugauaauagaaggcaaacuug

SEQ ID NO: 50013 - RNA, 60 nt, Human
cacaccuggccuccucuggcuucagcuucucagcagcaagcaccagccuuccacaacaac

SEQ ID NO: 50014 - RNA, 60 nt, Human
guacugccccucacauuuucucaccuaaaccagcagcaccuccaucuuaacagccauagg

SEQ ID NO: 50015 - RNA, 60 nt, Human
gcccccucccaaggauggucccuuugggugcagcagcagaggucaccuccugacaugcgc

SEQ ID NO: 50016 - RNA, 60 nt, Human
guuacaggguaggcaccugucaggacagaacagcagcagcgcuacagcccagagguuaua

SEQ ID NO: 50017 - RNA, 60 nt, Human
accccuacaggagaagcucugggacuggggcagcagcaaggcgcccaugccacacaccgu

SEQ ID NO: 50018 - RNA, 60 nt, Human
uccaagacugagcccagcaccaccccugggcagcagcauccuccucucuggccuugcccc

SEQ ID NO: 50019 - RNA, 60 nt, Human
gcaaucaaaggggcuguuggccagcaauggcagcagcagcggcgggcagucugcccaagu

SEQ ID NO: 50020 - RNA, 60 nt, Human
agacccaccugacaccaucacgcggaggcccagcagcaccugcacccacuuccagcugcu

SEQ ID NO: 50021 - RNA, 60 nt, Human
uuacuaacuucuccaaggagcaugucacuccagcagcacaggggacgcaaugggaggcag

SEQ ID NO: 50022 - RNA, 60 nt, Human
ugagaaaguauacaauucuuuuuccuucuacagcagcacuguucuguccucaaguacuca

SEQ ID NO: 50023 - RNA, 60 nt, Human
gaagaaaaaugaauucaaaaguagaugugucagcagcaaaguagaauuuucucacugcgu

SEQ ID NO: 50024 - RNA, 60 nt, Human
cagccccugagcccccaguccggaucuccacagcagcaaaggucaccaggcucuccgcag

SEQ ID NO: 50025 - RNA, 60 nt, Human
uccacugcugccuaaugcaaggcaguggcucagcagcaagaaugcugguucuacaucccg

SEQ ID NO: 50026 - RNA, 60 nt, Human
ccugaugacccacccgccccauccaggcuccagcagcaaagccccaggagaacaggcugg

SEQ ID NO: 50027 - RNA, 60 nt, Human
cagagcuggcaauggcagcgacagcagcaacagcagcagauccaagaagcgggucccuga

SEQ ID NO: 50028 - RNA, 60 nt, Human
ggggcuguucagagcuggcaauggcagcgacagcagcaacagcagcagauccaagaagcg

SEQ ID NO: 50029 - RNA, 60 nt, Human
cugugugggugcugcaguugcuuuugucugcagcagcaggacacaucuuuccucuuacuc

SEQ ID NO: 50030 - RNA, 60 nt, Human
cuggguagggauuggaaguacuuggcagggcagcagcaaucuugcuguguuugauauaac

SEQ ID NO: 50031 - RNA, 60 nt, Human
cccacaaccaugcccuugaggguagcagggcagcagcauaccaaagagaugugcugcagg

SEQ ID NO: 50032 - RNA, 60 nt, Human
gaccucaaggaccccaucaaguguacacagcagcagcaaaaucaagggaugacccuccuc

SEQ ID NO: 50033 - RNA, 60 nt, Human
gaggaccucaaggaccccaucaaguguacacagcagcagcaaaaucaagggaugacccuc

SEQ ID NO: 50034 - RNA, 60 nt, Human
cagagcggcgggucuauguucacguccccccagcagcaggcggaaccacccagccagggc

SEQ ID NO: 50035 - RNA, 60 nt, Human
cacuccucaccuucccugccuuggugcugccagcagcagacauagacgggugcagaagcg

SEQ ID NO: 50036 - RNA, 60 nt, Human
uuuuccaguggaauggagauuucauuuugucagcagcagugaccacagccuuaccaaagc

SEQ ID NO: 50037 - RNA, 60 nt, Human
gugccucgcgggcucagugaguuaggaagucagcagcaggggaggcagcuugcaugccug

SEQ ID NO: 50038 - RNA, 60 nt, Human
cucauuucuucacaauaggaccgucuuuggcagcagcaaaauguauuucaguauggcagu

SEQ ID NO: 50039 - RNA, 60 nt, Human
gcugcccauucaaauuuagcaaguguacugcagcagcagggaaaacugcaggaagcucug

SEQ ID NO: 50040 - RNA, 60 nt, Human
ugucuauauugcugaaugcaagaaguggggcagcagcaguggagagaugggacaauuaga

SEQ ID NO: 50041 - RNA, 60 nt, Human
uuccucaacuaguauuauuugggcucugggcagcagcagggaucuggugguaugugaggu

SEQ ID NO: 50042 - RNA, 60 nt, Human
uuuuggauugauuuuccaaaaccacagcuucagcagcaacaaucagaauguccaaaugcu

SEQ ID NO: 50043 - RNA, 60 nt, Human
caacaaaauugaacacaggacucuucugcucagcagcaucucuuuucucagauguggcca

SEQ ID NO: 50044 - RNA, 60 nt, Human
cgcccccaagcucggaucacaugaaggagacagcagcacccacccaugcacgcaccccgc

SEQ ID NO: 50045 - RNA, 60 nt, Human
aagugacugaccugugagcucuggcucagacagcagcaagccggauccaccaacaccgca

SEQ ID NO: 50046 - RNA, 60 nt, Human
ggggaggggugacagggcgagcccccaccccagcagcagcaauacccccacccuccugcc

SEQ ID NO: 50047 - RNA, 60 nt, Human
gaggggugacagggcgagcccccaccccagcagcagcaauacccccacccuccugcccug

SEQ ID NO: 50048 - RNA, 60 nt, Human
cccacccauuccaaggcggggucacgguaccagcagcacuuggggugaggccuccaaagc

SEQ ID NO: 50049 - RNA, 60 nt, Human
auauggccggacacauauguauaaacuuuucagcagcauuuuuaauaauaaaauaucaca

SEQ ID NO: 50050 - RNA, 60 nt, Human
cgccuuagaauucggaaguguuuuggaauccagcagcaucauaagauaaccaaacucguc

SEQ ID NO: 50051 - RNA, 60 nt, Human
ucaucuucagccaccacccacagaugaugccagcagcaggcgcggcugggggcccuggau

SEQ ID NO: 50052 - RNA, 60 nt, Human
uucucucuggacucuguuccuauaccacaacagcagcaggggccugaaaugugaugucca

SEQ ID NO: 50053 - RNA, 60 nt, Human
caaacugguuucauauggugagagcagccacagcagcagcuugaccugguauucuaccug

SEQ ID NO: 50054 - RNA, 60 nt, Human
uagaaggacuguuugagaaauguuagaaagcagcagcaauuauaaggcaaaauagguaau

SEQ ID NO: 50055 - RNA, 60 nt, Human
cuagcuccugacugaacacuauagacuucccagcagcauuucacccagcagccagagccg

SEQ ID NO: 50056 - RNA, 60 nt, Human
caaaauuacaguguucauugucauugaccucagcagcaaauuugacuugaauucacuuag

SEQ ID NO: 50057 - RNA, 60 nt, Human
cuugccaagggaguugggggaaagcagcagcagcagcaggagcgacuagaguuuuuccug

SEQ ID NO: 50058 - RNA, 60 nt, Human
ccccuugccaagggaguugggggaaagcagcagcagcagcaggagcgacuagaguuuuuc

SEQ ID NO: 50059 - RNA, 60 nt, Human
aagccccuugccaagggaguugggggaaagcagcagcagcagcaggagcgacuagaguuu

SEQ ID NO: 50060 - RNA, 60 nt, Human
aagggaggcuagggcaauggagcaggccaccagcagcagcugugcagcauggaacucagg

SEQ ID NO: 50061 - RNA, 60 nt, Human
gaaacaaaguacagguaguuuuugagcugacagcagcaaaggcaccauaagucaaaauau

SEQ ID NO: 50062 - RNA, 60 nt, Human
ggcucccccagacucagagggcagcaggagcagcagcagcagcagcagcagcaacaacaa

SEQ ID NO: 50063 - RNA, 60 nt, Human
ucccccagacucagagggcagcaggagcagcagcagcagcagcagcagcaacaacaacaa

SEQ ID NO: 50064 - RNA, 60 nt, Human
cccagacucagagggcagcaggagcagcagcagcagcagcagcagcaacaacaacaacua

SEQ ID NO: 50065 - RNA, 60 nt, Human
agacucagagggcagcaggagcagcagcagcagcagcagcagcaacaacaacaacuacug

SEQ ID NO: 50066 - RNA, 60 nt, Human
cucagagggcagcaggagcagcagcagcagcagcagcagcaacaacaacaacuacugugc

SEQ ID NO: 50067 - RNA, 60 nt, Human
agagggcagcaggagcagcagcagcagcagcagcagcaacaacaacaacuacugugccuu

SEQ ID NO: 50068 - RNA, 64 nt, Human
uaacguccucauccgcuagccgcgcaggcguggaggccaggaggcuggggccccugggcugcgu

SEQ ID NO: 50069 - RNA, 64 nt, Human
gagcgacaucaggcgcuuccucagugcauuucacgagccacagguggggcucauccaggccgcc

SEQ ID NO: 50070 - RNA, 64 nt, Human
cagggaccccagggggauugacucugcaguuugggagccacaaaaagcguagcggugugauuuc

SEQ ID NO: 50071 - RNA, 64 nt, Human
aucccauuuggcgacgaggacucguggcuggagagagccacacagcguguaaccugaagucauc

SEQ ID NO: 50072 - RNA, 64 nt, Human
ugcaucauuugcucuucaaauaucuaugugcuuggagccacaguuuccuaagcgcauaguuuuu

SEQ ID NO: 50073 - RNA, 64 nt, Human
uauuuugguccuuuaugcuugagguuccaaccuggagccacagugugugagaggaggaggagag

SEQ ID NO: 50074 - RNA, 64 nt, Human
ccagagcuggauuccuguaaaggaguccaggcuagagccacagagacuguuguggaggugaguu

SEQ ID NO: 50075 - RNA, 64 nt, Human
cacauuuuucuuguauuaagauugcucuucccaagagccacaaguuccugguuuuaguaaaccc

SEQ ID NO: 50076 - RNA, 64 nt, Human
agugagcugagaucacgucauugcacuccauccugagccacaagagcaaaacuccgucucaaaa

SEQ ID NO: 50077 - RNA, 64 nt, Human
ggagugagggauggaaaaggggauaaaaggccuggagccacacucuauauggcugaggaaggag

SEQ ID NO: 50078 - RNA, 64 nt, Human
uuuuuuuuucuauauccugaugaccaguaaauuagagccacacugguuaaguuugacucgucuc

SEQ ID NO: 50079 - RNA, 64 nt, Human
aguuggucaggcaacagcuggggugauggccugugagccacaggccacaucaggaacuuucccc

SEQ ID NO: 50080 - RNA, 64 nt, Human
gaccuuuguuguaagucucccaacguccuauuaggagccacagcaggugaggcauuuggugcag

SEQ ID NO: 50081 - RNA, 64 nt, Human
ugucccccagcagccuggggucugacaauaccucgagccacaaccgaccagaugccagggaccc

SEQ ID NO: 50082 - RNA, 64 nt, Human
aauacuugaaccuucucccagguaggggcaggaggagccacaugagagagggagaaggaccgcg

SEQ ID NO: 50083 - RNA, 64 nt, Human
ugugugcugcacagcagugaaccaacacuagagggagccacacaagccuccucuccccagucug

SEQ ID NO: 50084 - RNA, 64 nt, Human
aggccuucugagccgggugguccuggaauuaaaggagccacaggcccuccgggagcucagggga

SEQ ID NO: 50085 - RNA, 64 nt, Human
guaaugggauugagcauuuauggcagcaacagaggagccacaaaauguucuuuguucuuuggcu

SEQ ID NO: 50086 - RNA, 64 nt, Human
caugaauucaauaucuaaugucaaccaauggggagagccacaacuccaggagagguuccugagc

SEQ ID NO: 50087 - RNA, 64 nt, Human
ucuguuuucauuaauuuguuauuuuucaaaaaccgagccacaccuuuggaaguaaugauuuggc

SEQ ID NO: 50088 - RNA, 52 nt, Human
aacugcagcuucaguauuagcagagccacaggccgccucuguggcaucacca

SEQ ID NO: 50089 - RNA, 52 nt, Human
aggaggaguucuaugccuaguggagccacagugccucccugcagccucaaca

SEQ ID NO: 50090 - RNA, 64 nt, Human
cugaagcuagaaccagguuuggauaaagauugaagagccacaggccacucuucccucugagcca

SEQ ID NO: 50091 - RNA, 64 nt, Human
uccagaugcuuuuguagaugacugaaguauuugugagccacauauugggaguucuagauuugag

SEQ ID NO: 50092 - RNA, 64 nt, Human
auauccagagcauaauuuuccauggccauaguuugagccacagagaaagccaaugaaauagauu

SEQ ID NO: 50093 - RNA, 64 nt, Human
ccucggccucccaaagugcugggauuacaggugugagccacagcgccuggcccaguguaauauu

SEQ ID NO: 50094 - RNA, 64 nt, Human
ugugauguuguguguguugggggagcuuccacaggagccacacuggggaaaagcuguaguaucu

SEQ ID NO: 50095 - RNA, 64 nt, Human
aaaccacaucuugaugcuaaguaacauuucccaugagccacaaaacugaaugcugaaaagcuac

SEQ ID NO: 50096 - RNA, 64 nt, Human
cagacucucaggacaugcccagcucaggggcuucgagccacaggccuggccucauauggcauga

SEQ ID NO: 50097 - RNA, 64 nt, Human
gcccuggcugaggccaaugcugugaagcuccacagagccacauucugaagccguccucugccca

SEQ ID NO: 50098 - RNA, 64 nt, Human
cuucucuccggaccagggaggcgucccucccuaggagccacacauuauacuccaagucccugcc

SEQ ID NO: 50099 - RNA, 64 nt, Human
uagauuucaauugacuguuuccccuacaucuuuugagccacagucgcccaucgaauaagcaaau

SEQ ID NO: 50100 - RNA, 64 nt, Human
uuuucuguaacguuuuccugaagcuguuucuggagagccacacauuuaaauacagacagcuuuc

SEQ ID NO: 50101 - RNA, 64 nt, Human
uggguuaauacaacaacugcacuguaaggacucagagccacacagaacuucugagaggggcugu

SEQ ID NO: 50102 - RNA, 64 nt, Human
gauguggaggaagagccaccugcaagauggacacgagccacaagcugcacugugaaccugggca

SEQ ID NO: 50103 - RNA, 64 nt, Human
ggcucacuucucuucagacuuggguagaagugcagagccacagaauugcuuuccuuccccgccu

SEQ ID NO: 50104 - RNA, 64 nt, Human
cauuuaugcauagagacucguuuaugaauggguagagccacagaacguauagaguuaaccaaag

SEQ ID NO: 50105 - RNA, 64 nt, Human
gggcagcagaggccccugggcagcccagccaggggagccacagccccaaggauggucuugcucu

SEQ ID NO: 50106 - RNA, 64 nt, Human
uggcgacaguuucccuuaggggucugccuggcaggagccacagcucaggagaguugugagggau

SEQ ID NO: 50107 - RNA, 64 nt, Human
guccucgcgcuugacugcacaucaguuacuugaagagccacaccucagaucaaugcagucagaa

SEQ ID NO: 50108 - RNA, 64 nt, Human
ugcagacaccccagccccauuauuaaaucaaccugagccacauguuaucuaaaggaacugauuc

SEQ ID NO: 50109 - RNA, 64 nt, Human
gcugcuccucuacucuugggucgagaucccuuuggagccacagcgaggaacccugugguccuca

SEQ ID NO: 50110 - RNA, 64 nt, Human
aaaaauaacucagccaugacaugucuguuuccaagagccacacauguuagagaaacuugaggaa

SEQ ID NO: 50111 - RNA, 64 nt, Human
uuggggagccaggagacagcagggucugagagaggagccacagucccuaaugacacccacuccu

SEQ ID NO: 50112 - RNA, 64 nt, Human
guagcuguguuuuaauuugagaaucuugaggguagagccacaaauuucaauucuuacauuucca

SEQ ID NO: 50113 - RNA, 50 nt, Human
uagggaaagaugaguugugagagccacaacagaggcuucagaccauuuuc

SEQ ID NO: 50114 - RNA, 64 nt, Human
uaauuuuuuucucugaaaaaucaucgagacaaaagagccacagaguacaaguuuuuaugauuuu

SEQ ID NO: 50115 - RNA, 64 nt, Human
ccaacacccgccaguacugugacuuccaaagccagagccacaugugcucaucaaacuugcauua

SEQ ID NO: 50116 - RNA, 64 nt, Human
agcucccuagacucaucccaugucagcucccuaggagccacagcaccaggaagggaugcugccu

SEQ ID NO: 50117 - RNA, 64 nt, Human
cucaagcuggggggugguguguaagaagcacguggagccacaagaggcaccuccuauagucagc

SEQ ID NO: 50118 - RNA, 64 nt, Human
cuccugggcuacccacagccagggcagccugcuggagccacagggccagggccaugcagaugga

SEQ ID NO: 50119 - RNA, 64 nt, Human
agaggugaauaacaguagguggacaaaguuuagggagccacauuuaccaacuucugugaauaua

SEQ ID NO: 50120 - RNA, 64 nt, Human
aauugcaccugaaaaaccugggcaccuaagcaaugagccacagcaaaaaguaaagaacaacaac

SEQ ID NO: 50121 - RNA, 64 nt, Human
uuccuggcagguagcuuaaagagugggguauauagagccacaacacauguuuauuuugcuuggc

SEQ ID NO: 50122 - RNA, 64 nt, Human
cauuuugacauuggacauauggaauucauaguaugagccacauuuuguugugaaauuuauuuac

SEQ ID NO: 50123 - RNA, 64 nt, Human
gugucucaugaagagaagacaccaguuuuaaaaugagccacaaacaguaaagcccuaucaguau

SEQ ID NO: 50124 - RNA, 64 nt, Human
cuugccaaagccccugcagaauuaccuacuuuuggagccacaggguguuuugcacugaaacgca

SEQ ID NO: 50125 - RNA, 64 nt, Human
agccaggugccguguuggccuuggcuaggacccagagccacacugcagccuccgccgacucccu

SEQ ID NO: 50126 - RNA, 64 nt, Human
cauaguugaccacagacauguuauucuucugaaagagccacauuuugguuuuauuucuugucac

SEQ ID NO: 50127 - RNA, 64 nt, Human
agucccgcccuggcucuuuagaauggaccacugagagccacaggaccguuuuggggcugaccug

SEQ ID NO: 50128 - RNA, 64 nt, Human
uguguacaucuggugcuuuucaugugucauuugugagccacaaaugcaaaguugccauuugaau

SEQ ID NO: 50129 - RNA, 64 nt, Human
uuuuagcccauuccccaugcugggccugcucacagagccacaggaagaucauucagaaacuagg

SEQ ID NO: 50130 - RNA, 64 nt, Human
uugauugggcccuggacguugagcccagauguuggagccacaccagccuggauuucaaucccag

SEQ ID NO: 50131 - RNA, 64 nt, Human
auaacaaaauggacaugguggcuuuguuuagguagagccacaaaagaaaagacuuguaauauuu

SEQ ID NO: 50132 - RNA, 64 nt, Human
agcuacucgagaggcugagguaagagcaucccuugagccacagaggucgaggcugcagugagcu

SEQ ID NO: 50133 - RNA, 64 nt, Human
ucugcccaaacauaaagagaacucuggggagccugagccacaaaaauguuccuuuauuuuaugu

SEQ ID NO: 50134 - RNA, 64 nt, Human
ccaaaggccccucagacauguuacagcaaaucuggagccacagacagguucccuccauuggcag

SEQ ID NO: 50135 - RNA, 64 nt, Human
acuccccgagcccccagauucucaccuuugcccagagccacauucgggcuugucuuccucuucc

SEQ ID NO: 50136 - RNA, 64 nt, Human
cgaggcagcccucccaagucagacaccuccuucggagccacagagagccuggagucugcaccuc

SEQ ID NO: 50137 - RNA, 64 nt, Human
uuagaguauuauuucuucaguguuauuguuuucagagccacauuuuguugcauauuugcuagua

SEQ ID NO: 50138 - RNA, 64 nt, Human
aagugcagccucacgacagauaccaggcaauccagagccacaaaacgugauuccuccaggcucu

SEQ ID NO: 50139 - RNA, 64 nt, Human
augggacuguccccuuuagagaucccaccugucagagccacagcuucgggguccugucaucaca

SEQ ID NO: 50140 - RNA, 64 nt, Human
ccucaccccaguuccaugacauuggcugguauaggagccacagucaggaaagcacuugaggcag

SEQ ID NO: 50141 - RNA, 64 nt, Human
caaugcaguucugagcaccgugucaagcugcucugagccacagugggaugaaccagccggggcc

SEQ ID NO: 50142 - RNA, 64 nt, Human
acagcucacuucuaucagaggcccaggugccucagagccacauugaguugcuuuuucugggaug

SEQ ID NO: 50143 - RNA, 64 nt, Human
cuucuuccuaccuugauugagggugugaugccuggagccacagcagccacuuugcuaccaugac

SEQ ID NO: 50144 - RNA, 64 nt, Human
gguuuucuuuuuuuuuuuuucuuugauacauagagagccacacugaggagaagcacucugaauu

SEQ ID NO: 50145 - RNA, 64 nt, Human
ugcaaucuuuuagauucagcuuguaauaaucuuugagccacaccaaaaggaaugccaagggcuc

SEQ ID NO: 50146 - RNA, 64 nt, Human
gcaauaugacugcuaaaagaaccaacccaggacagagccacaaucuuccucuauuucauuguaa

SEQ ID NO: 50147 - RNA, 64 nt, Human
cgugcagcguccuuggcaguuggcccaggaacuggagccacagagcuggugcugccgcuggaau

SEQ ID NO: 50148 - RNA, 64 nt, Human
gaacaggauggccuggcagcagggauguuuccgugagccacaaauaccagaaacugaggcgagg

SEQ ID NO: 50149 - RNA, 64 nt, Human
gacaaagaauacuggagaagagagagggugggcagagccacaaccucauccucccagugguucc

SEQ ID NO: 50150 - RNA, 64 nt, Human
ugaagcugaugaaggcuugaaggacggaagggcugagccacaugaaggcagcacucagggccag

SEQ ID NO: 50151 - RNA, 64 nt, Human
gcugaaagucagcccacgucggagcggugaggaggagccacagcacauggggugccaccucgag

SEQ ID NO: 50152 - RNA, 64 nt, Human
uaugaaaacaccacugaacagaaauuucuccagggagccacaggcucuccuucaucgcauuuug

SEQ ID NO: 50153 - RNA, 64 nt, Human
cucagccaaauugcacccauuuaacuaucccaaagagccacagugccuacaacccaggcccuaa

SEQ ID NO: 50154 - RNA, 64 nt, Human
cacgucacacuaggguggccacccccgccauugcgagccacaugucugcacugagaaacugcau

SEQ ID NO: 50155 - RNA, 64 nt, Human
cugcggggcucagggcuccuuccauucuaaccuugagccacagugucacucuucagggcucugc

SEQ ID NO: 50156 - RNA, 64 nt, Human
cucuccaaccagauugucagcuccuugagggcaagagccacaguauauuucccuguuucuucca

SEQ ID NO: 50157 - RNA, 64 nt, Human
gggcugcucugauguuugggagucgguuuuuugugagccacaucugauauuucugauaucccca

SEQ ID NO: 50158 - RNA, 64 nt, Human
augaaacagucaaaugguuugccucauucuccaagagccacaacucaagcugaacugugaaagu

SEQ ID NO: 50159 - RNA, 64 nt, Human
ccucggccucacaaagugcuaggauuacaggcaugagccacagcacccggcccagaauaagaau

SEQ ID NO: 50160 - RNA, 64 nt, Human
acuuuaugaaaguguggucaucuugacccccaaagagccacaguagcugucaauuauugagauu

SEQ ID NO: 50161 - RNA, 64 nt, Human
ucaguagagaaagaucagaauggccuugagaauagagccacaaaaauaacuaugaaaaugccag

SEQ ID NO: 50162 - RNA, 64 nt, Human
agaaggagaagaaguaacauggaggccaggccaagagccacagggcggccucuccccaaccagc

SEQ ID NO: 50163 - RNA, 64 nt, Human
cucuaaaagaugauuucccuucuguaacucccuagagccacagguucucauuccuuuucccauu

SEQ ID NO: 50164 - RNA, 64 nt, Human
cuguccugguuccugagcucuaggcugcuaagcugagccacacaccccuccguuugcaccaguu

SEQ ID NO: 50165 - RNA, 64 nt, Human
cugcugcuucauugccagacugggccuggggcaagagccacauggcagcauuucccuuuucccc

SEQ ID NO: 50166 - RNA, 64 nt, Human
ugacuuugcuucugugcacagccccgucuuccaggagccacaacucagaagaaaagggugcuca

SEQ ID NO: 50167 - RNA, 64 nt, Human
cagggggcacguggucaggcuccaccgcacagaagagccacagucuccagacucauggcguucc

SEQ ID NO: 50168 - RNA, 64 nt, Human
cauagcacgaaucuguuaccaguaggaggaggaugagccacagaaauugcauaauuuucuaauu

SEQ ID NO: 50169 - RNA, 64 nt, Human
aagcccuccucagauuggaacccccaaaucgauggagccacauuaauaauacuuuucaugccuc

SEQ ID NO: 50170 - RNA, 64 nt, Human
gaguccaagccucguuccuccuucugccuccccggagccacaggauggauuuaggagccacugc

SEQ ID NO: 50171 - RNA, 64 nt, Human
ucaggcugucacuccuacuaccaauggccacugugagccacagaaggaagacauguacgugcug

SEQ ID NO: 50172 - RNA, 64 nt, Human
gagccaaaggugaccgcagggggccccagggcuggagccacaaggauacccucacuuugcauga

SEQ ID NO: 50173 - RNA, 64 nt, Human
cacagucugucaccacguggcuugggaacuucuggagccacagcaggcaucacggugcgacgug

SEQ ID NO: 50174 - RNA, 64 nt, Human
ucccacgacaggugaguugaaggaaugggauauggagccacauccacuuccaccccuugguauc

SEQ ID NO: 50175 - RNA, 64 nt, Human
uuggggcugcuauggggacuggcccuguaggguugagccacagacagcucuucagcccaguagc

SEQ ID NO: 50176 - RNA, 64 nt, Human
cagcacagccuugucccaggacccuugggugcaugagccacaacauggauccuggaugaauccc

SEQ ID NO: 50177 - RNA, 64 nt, Human
gggacauuuuuggcucuccuuuaguggacaccuagagccacagauucccuucuuuacuaaacaa

SEQ ID NO: 50178 - RNA, 64 nt, Human
auuuaaacugugcaagguaaaaaucaagccuuuggagccacagaaccagcucaaguacaugcca

SEQ ID NO: 50179 - RNA, 64 nt, Human
ccucggccucccaaagugcagggcuuacaggugugagccacagugcccagcuuuuuuuuuuuuu

SEQ ID NO: 50180 - RNA, 64 nt, Human
gucagaaauagcaagcaaaaagcaggacucccaggagccacaagaaaagagcacaggcugcacc

SEQ ID NO: 50181 - RNA, 64 nt, Human
gccagcugaucccucugugccaccacguggcccugagccacauccaggugcagcuggagcugga

SEQ ID NO: 50182 - RNA, 64 nt, Human
ggccuccccagccucaagguccacucaggcacaagagccacaguacccuagauagugucacaug

SEQ ID NO: 50183 - RNA, 64 nt, Human
uucugagaaccacccuuuugcuaagggagcuugggagccacauggcugcucccuucacacuggg

SEQ ID NO: 50184 - RNA, 64 nt, Human
ggacuucaagaucacacuugugggcaaucugggggagccacaacuuuucaugaagugcauugua

SEQ ID NO: 50185 - RNA, 64 nt, Human
ucccagccggauuuaaagcagucacuucagacaggagccacagggagccugugagggaguagug

SEQ ID NO: 50186 - RNA, 64 nt, Human
ccucagccucccaaagugcugggauuacaggcaugagccacagugcccggccaaguauuuuuau

SEQ ID NO: 50187 - RNA, 64 nt, Human
acauauauucaagaauuuuaauuuguaaagaauugagccacauugaacacaauugaaugagauu

SEQ ID NO: 50188 - RNA, 64 nt, Human
uguuguacuuuccagauccuuauagauacgguaagagccacauucguagaaaaacuucuggugu

SEQ ID NO: 50189 - RNA, 64 nt, Human
cugcagguuuuuugaacucacuucuggaggugcagagccacaaacgcacuuucggggccuaguu

SEQ ID NO: 50190 - RNA, 64 nt, Human
cagaauauuguugaucuuagauuaaaaaguggaagagccacaaacauuggugcccuuuucagac

SEQ ID NO: 50191 - RNA, 64 nt, Human
acuucacccaccgccuccuggcugcagcucugaagagccacagcgggaacauaucuugcaugga

SEQ ID NO: 50192 - RNA, 52 nt, Human
auaucagagaguccacgugaaagagccacacacccauuuuccucacuuuccc

SEQ ID NO: 50193 - RNA, 64 nt, Human
caccgaagcucccuagaggggcaaaagauggagugagccacaggaaguuuggggcguggugagu

SEQ ID NO: 50194 - RNA, 64 nt, Human
gcgccugggaaucuagaacaguuuagaggggaaagagccacagcaaagaaaagccgaggcaggg

SEQ ID NO: 50195 - RNA, 64 nt, Human
aaauacuaaauucuuuuaaaccuggagccuuagagagccacaggaauaucuucuguuguacagu

SEQ ID NO: 50196 - RNA, 64 nt, Human
uguacuaguuuuuagaccccaagucaaccuuucugagccacagcuucccgcugggaauaaugau

SEQ ID NO: 50197 - RNA, 64 nt, Human
ucuguaugcauuccugucauuacccauuguaacagagccacaaacuaauacuaugcaauguuuu

SEQ ID NO: 50198 - RNA, 64 nt, Human
gucugcuaucgagcccuggugcuauguggccccggagccacagcacaaucaucucaguggcgaa

SEQ ID NO: 50199 - RNA, 64 nt, Human
uucucauuuuccuuuuaccuuucuccaccauccagagccacaaaagcaaaccuucuaccuccua

SEQ ID NO: 50200 - RNA, 64 nt, Human
augaggucaaugugauucaguuguguugcugucugagccacagccaauugugugugcucuauua

SEQ ID NO: 50201 - RNA, 64 nt, Human
acugguuuccccaacaggcugcguaagggacccugagccacagugaguuggucaaaugcuccug

SEQ ID NO: 50202 - RNA, 64 nt, Human
aguagaggucuccggcuauuccagaaagaaaagugagccacaugcaggcugaugaaugccgaca

SEQ ID NO: 50203 - RNA, 64 nt, Human
ccucauccuucuaaagugcugggauuacaggugugagccacagcacucggccuaaauagguuuu

SEQ ID NO: 50204 - RNA, 64 nt, Human
ccucagccucccaaagugcugggauuacaggugggagccacaacacccggccaugaauuaacuc

SEQ ID NO: 50205 - RNA, 64 nt, Human
uugugccucaguuccagaaauuauugccaaacaggagccacagcaauuuuuggcuacuuuucug

SEQ ID NO: 50206 - RNA, 64 nt, Human
gccucaucuuuaaacuguccuuaguagcccaggggagccacacccucacucccugccucccccc

SEQ ID NO: 50207 - RNA, 64 nt, Human
cccaaagaugacauuacuaaugaugugauuucaggagccacagaagaaccuuaccagcuucccu

SEQ ID NO: 50208 - RNA, 64 nt, Human
aagagagugguccaugaccacacuuagugagaaggagccacaaguuguggcugagaguucccug

SEQ ID NO: 50209 - RNA, 64 nt, Human
aucugaagacaucuaacuuagagucugcagcccagagccacaugcaaaacaccuucaauaaaca

SEQ ID NO: 50210 - RNA, 64 nt, Human
gacggcagccccauccuucccgcagcaccagccugagccacaguggggcccauggccccagcug

SEQ ID NO: 50211 - RNA, 64 nt, Human
acaggaguccaggagguccuuuccgcucuccuaagagccacaccuggugaauacucaguaaaca

SEQ ID NO: 50212 - RNA, 64 nt, Human
gaagucuaaccaaggaacaagaaucucacuaucagagccacaaaucugggaccugucuuuccaa

SEQ ID NO: 50213 - RNA, 64 nt, Human
gcacagaauucugaucucuaccuugagccaugcugagccacaaguuggucuccuugggaggugc

SEQ ID NO: 50214 - RNA, 64 nt, Human
gccacaccaccacaugcccaaguguacacacacagagccacaccgucccucugggccugcuggc

SEQ ID NO: 50215 - RNA, 64 nt, Human
ccugugcagagccccauccacugguucuugcccugagccacauaugucugugccaugggcugag

SEQ ID NO: 50216 - RNA, 64 nt, Human
uaaaauacuccuuucugcccauuggccaugcugggagccacagcuauccagagccagcaugacc

SEQ ID NO: 50217 - RNA, 64 nt, Human
agacaccugagaaucgauggcucagucugcucuggagccacagucuggcgucugacccuucagu

SEQ ID NO: 50218 - RNA, 64 nt, Human
ccuggggugaggugcucagcaccuuccucucgaggagccacauuuuccuccuuuguguuagggg

SEQ ID NO: 50219 - RNA, 64 nt, Human
gaugaggcuugcggcuguggcccgcuggugggcugagccacaaggcccccgauggcccaggagc

SEQ ID NO: 50220 - RNA, 59 nt, Human
agcuugagccagagcgaugacgggcaggggagccacacauacucacagcccccgggcuc

SEQ ID NO: 50221 - RNA, 64 nt, Human
caucacagcgccagggcagcugugccugggacaggagccacacagucagagggggauguaagag

SEQ ID NO: 50222 - RNA, 64 nt, Human
caaacacuuuugauuugcauauccuggguguacugagccacauaauaaggugucaaaaugugcu

SEQ ID NO: 50223 - RNA, 64 nt, Human
uguucacuuuguuucaggcuggucugugccccgugagccacauggccuagggugaugccagguu

SEQ ID NO: 50224 - RNA, 64 nt, Human
ggccauggauggggaagugcccgguagccagcaugagccacacuaggaaagaggaggagggugc

SEQ ID NO: 50225 - RNA, 64 nt, Human
ggcccucacccugccugucucccgaagcagguucgagccacaagggccaaccaggaggccccug

SEQ ID NO: 50226 - RNA, 64 nt, Human
agguggugucacugucccuccuggugucaccccagagccacacaugggcaucuaugggagagug

SEQ ID NO: 50227 - RNA, 64 nt, Human
agaguugugcacgcagauuagcaggccaaggucugagccacagcagcauuuuuauuucagauuu

SEQ ID NO: 50228 - RNA, 64 nt, Human
gaaccuggggagaugucacugccagggugagguggagccacauggcagggacaaugccggcagc

SEQ ID NO: 50229 - RNA, 64 nt, Human
cgccugcuggaggaggagagagcucugcuggcaugagccacaguuucuugacuggaggccauca

SEQ ID NO: 50230 - RNA, 64 nt, Human
aguucccuaguuaccauuuaauaugagggugcaagagccacauuuacaaacaacaaacuugauc

SEQ ID NO: 50231 - RNA, 64 nt, Human
uccagggcaucuuaaguucauccagcagcuccaugagccacacagauauccuagaaaauauucc

SEQ ID NO: 50232 - RNA, 64 nt, Human
uuguuucugaauaucucaggguaggaaccauguggagccacacauucccugaccacagggaagc

SEQ ID NO: 50233 - RNA, 64 nt, Human
gccccaacgucagcccaauccaccuugcagacacgagccacacgggccacacggugacugcugc

SEQ ID NO: 50234 - RNA, 64 nt, Human
uagggcucaggacaaguggcuccccuggccaggagagccacagccaugauacagggcucuuaug

SEQ ID NO: 50235 - RNA, 64 nt, Human
gaaaugaaugcugagacccccggagcaggggucugagccacagccgugcucgcccacaaacuga

SEQ ID NO: 50236 - RNA, 64 nt, Human
uccccucaggcuuuccagucaccagggacacucggagccacagccuagagccccguguucccug

SEQ ID NO: 50237 - RNA, 64 nt, Human
agcaagucuuccuuccacccuguggccugcacuugagccacaaagugugugugugugugugcgu

SEQ ID NO: 50238 - RNA, 64 nt, Human
ugucgcggugucucuaaguacagauggguagauagagccacaugcacgguccuuaccguucuuc

SEQ ID NO: 50239 - RNA, 64 nt, Human
ggcccagccaggccaucucacguguacauaaucagagccacaauaaauucuauuucacaccccu

SEQ ID NO: 50240 - RNA, 64 nt, Human
agcugugagugaggggacaaggggcaggucccaggagccacacacucccuuccucacuuuggac

SEQ ID NO: 50241 - RNA, 64 nt, Human
aguugaguggcugagagagaagugccucaucccugagccacacagggggcgugggagcauccca

SEQ ID NO: 50242 - RNA, 64 nt, Human
cacugugaagacccagcaggaagccaggcugagugagccacagaccaccugcuucugaacucaa

SEQ ID NO: 50243 - RNA, 64 nt, Human
agcuagaggcagggcugucccacagaaauagugugagccacauaugugacuuuaaauuuucuga

SEQ ID NO: 50244 - RNA, 64 nt, Human
uucagcuccugcuuggccaguguggagaggaaaggagccacaggagcgggugcuacacccggca

SEQ ID NO: 50245 - RNA, 64 nt, Human
ggaguugugggccuaggagaggcuuuggaccugggagccacaccuaggagcaaagucucacccc

SEQ ID NO: 50246 - RNA, 64 nt, Human
agaccccuuugccaggggcuuugggggcugagcagagccacauccagagugggguaauagcuca

SEQ ID NO: 50247 - RNA, 64 nt, Human
aaauacauagguagggcuacugaggaaauuuggagagccacauucugugguuucucauuauacu

SEQ ID NO: 50248 - RNA, 64 nt, Human
gcacagcaaccauggacaugggagaaagggaugggagccacagugcccuucacucucuccugga

SEQ ID NO: 50249 - RNA, 64 nt, Human
gcccccaagaugcucucucccuucuccaaugagggagccacagaauccugagaaggugaaugug

SEQ ID NO: 50250 - RNA, 64 nt, Human
uccugcuccucugcucucagggaaacugggcugugagccacacacuucuccccccagacaggga

SEQ ID NO: 50251 - RNA, 64 nt, Human
ggaacuagaaccuuccaggaucuggagcccgggagagccacacugugggcuuaaugugaauaga

SEQ ID NO: 50252 - RNA, 64 nt, Human
caugggaggccuuucccuaagccagcugcccccagagccacaguuccccuauguggaagugggg

SEQ ID NO: 50253 - RNA, 64 nt, Human
augguggaggauugcugccagagaagucuggucagagccacagggucugccuccagccaaacgg

SEQ ID NO: 50254 - RNA, 64 nt, Human
gugaacuguggacucgcuuucccaggcaggggcugagccacauggccaucugcuccucccugcc

SEQ ID NO: 50255 - RNA, 64 nt, Human
cuuggucuaggucucuccaggccuuuccuuccuggagccacagugcuuagagacaggccacugg

SEQ ID NO: 50256 - RNA, 64 nt, Human
ggggagggaaagcgccuuuuccugcagcucuucagagccacagaccucaggguggagugagccc

SEQ ID NO: 50257 - RNA, 64 nt, Human
ucuccaucucccaaagugcugggaugacaggcgugagccacagcucccagccuaggcccuuaau

SEQ ID NO: 50258 - RNA, 64 nt, Human
agagaugcacuguccacuguaaauacuauaaugagagccacaucuguaauuuaaauguuucuag

SEQ ID NO: 50259 - RNA, 64 nt, Human
cuaggucugcaacccucugucucugacagauugggagccacaggugccuaauugggaaccaggg

SEQ ID NO: 50260 - RNA, 64 nt, Human
gaaggaacuguguaucucaaaaaccauauuuccagagccacaaacaugaggaccaaaaaggaug

SEQ ID NO: 50261 - RNA, 64 nt, Human
uuuggauguaaagauugugugucuauccaacagggagccacaguauuuaaauugaccaaccuaa

SEQ ID NO: 50262 - RNA, 64 nt, Human
gacagcucagaaaaucaaagaggccaacugcccagagccacagaaaauggaggauaauugaggc

SEQ ID NO: 50263 - RNA, 64 nt, Human
aguguggaagcugccucccaucucaacucccugagagccacaggugccuggaggagcugugcug

SEQ ID NO: 50264 - RNA, 64 nt, Human
cccugcagcucacggggcagaaccagcacaucuggagccacacagcuuggggggugucucccau

SEQ ID NO: 50265 - RNA, 64 nt, Human
gucuccugccacaauccugcugggaaccucuggagagccacaggcacccccagcuggaggccag

SEQ ID NO: 50266 - RNA, 64 nt, Human
agaugacgaugaugaccagucguacuaucuuacugagccacagugaugcaugcuuuucggggaa

SEQ ID NO: 50267 - RNA, 64 nt, Human
cuacccaccauucuuaauacuguggcuuauaccugagccacacaucucccugcccuucuggcac

SEQ ID NO: 50268 - RNA, 64 nt, Human
uuugacaaaagaugccauuaaauuucagacuguagagccacauuuacaauaccucaggcuaauu

SEQ ID NO: 50269 - RNA, 64 nt, Human
aagaaaaaaaaugccaugaaacauuugaacugaugagccacagaacuucaguugaaauuuuuuu

SEQ ID NO: 50270 - RNA, 64 nt, Human
aauuguucaauuguguaugucuuccacuaugucagagccacauucccgucacauuauaaaugaa

SEQ ID NO: 50271 - RNA, 64 nt, Human
uauauauauauauaucuuagucccugccucucaagagccacaaaugcauggguguuguauagau

SEQ ID NO: 50272 - RNA, 64 nt, Human
uuguccuguugaaaucaaguaauuaaacauuuaagagccacaaaauuguaucacuuuuauaaua

SEQ ID NO: 50273 - RNA, 64 nt, Human
auaaauaacauugagaguuuuuggucugguccuugagccacaagaaguggaggggagaccaugc

SEQ ID NO: 50274 - RNA, 64 nt, Human
gccauaaugaggucccacguggcuucuucgauaggagccacaacuuggggugggaagaacuugu

SEQ ID NO: 50275 - RNA, 64 nt, Human
aaguuugguugagguucaagugugacuccuuccagagccacagguaggggagugugaaguugag

SEQ ID NO: 50276 - RNA, 64 nt, Human
cagggcgggggggggggcggugucaggucccagcgagccacaggaacggcccugcaggagcagg

SEQ ID NO: 50277 - RNA, 64 nt, Human
uuuaagcuuaacauuucauguaguaagauuuggagagccacauacuuuacaguaaaauuaagug

SEQ ID NO: 50278 - RNA, 64 nt, Human
ucucagccucccaaagugcugggauuacagguaugagccacaacgcccagccaucauuuaucuu

SEQ ID NO: 50279 - RNA, 64 nt, Human
cucuggcccaucaggcuuucuaaauucuucaaaagagccacaacuuccccagcuucuccagcuc

SEQ ID NO: 50280 - RNA, 64 nt, Human
auuccaaaacuggcucagcacauugcauguaguugagccacauuuuuuaaaaaaagaaaaugga

SEQ ID NO: 50281 - RNA, 64 nt, Human
gcaucccauauaggccauuuuagaaggccaaggagagccacaccgaaaaaggagacaguuccug

SEQ ID NO: 50282 - RNA, 64 nt, Human
aucgguaguguuguguguaggccauucuucuggagagccacaagcaggaagagcagcgcugugu

SEQ ID NO: 50283 - RNA, 64 nt, Human
cuuaguguuuucauugcaaauuauaauugcuguagagccacacacaacuuuugaacuuuuaauu

SEQ ID NO: 50284 - RNA, 64 nt, Human
acccuggccgccuggacccagcacugugguuguugagccacaccaguggccucugggcauucgg

SEQ ID NO: 50285 - RNA, 64 nt, Human
ggauuucauguuuucacucuguucuuagucccaggagccacagguaaucgagaauguuugugaa

SEQ ID NO: 50286 - RNA, 64 nt, Human
cuugaggcacugugaaauuuaaguguaagacauugagccacaaacauggaaucucuucuuugua

SEQ ID NO: 50287 - RNA, 64 nt, Human
ggcgccagcugccuguucuuaccuccgccugcgagagccacagcaaggagcucagccagccgug

SEQ ID NO: 50288 - RNA, 64 nt, Human
ucgagcucagguucgccacauagaucccgugcaggagccacauggguccugugcaggaccccua

SEQ ID NO: 50289 - RNA, 64 nt, Human
ucaaaguggaaugaagcucuggcuuuuggaaggagagccacacuguggcgggucggcggcccuc

SEQ ID NO: 50290 - RNA, 64 nt, Human
gcacaaccuaagguggcauuacagaucuuugagcgagccacagcaacuuuucugccaagucagc

SEQ ID NO: 50291 - RNA, 64 nt, Human
aaaaugagauggaggaaggaaaaagggagaagcugagccacagcuuaacuccuacagagugaaa

SEQ ID NO: 50292 - RNA, 64 nt, Human
gcaagacucagucaucucccuuugggauuggaacgagccacaccuacccggcagaccccucuuc

SEQ ID NO: 50293 - RNA, 64 nt, Human
gaggacuaauagucauagaggaugcuuuacccaagagccacagugggggaagaggggaaguuag

SEQ ID NO: 50294 - RNA, 64 nt, Human
cucauggagaauuaaagagagaagccuccuuaaggagccacaggaugguaccuggccccaaaag

SEQ ID NO: 50295 - RNA, 64 nt, Human
ggguguccugccugccuggguccagggccugagggagccacauggaucccgagacuuguguucu

SEQ ID NO: 50296 - RNA, 64 nt, Human
gucuuugggggauuccaccacacccaaugcucuggagccacaaggagugucccuucuuccccag

SEQ ID NO: 50297 - RNA, 64 nt, Human
caggcuccaggcucccgccugacaaacaggcagggagccacagucagggacaauaaaaacuugg

SEQ ID NO: 50298 - RNA, 64 nt, Human
uaagccaggcauggagggcuccugcccuucugcugagccacagcccauugcagcacugugcugg

SEQ ID NO: 50299 - RNA, 64 nt, Human
ggcugugugcucaaagcggacaaaacucaggccagagccacagcugggagaccugcacuguccc

SEQ ID NO: 50300 - RNA, 64 nt, Human
aaacuguagccugaguguccacagggacacacgugagccacagggcuagaagcacaggcccguc

SEQ ID NO: 50301 - RNA, 64 nt, Human
uuuuuucaauagcuacuuuuuuuagcagacaccagagccacacucaaauggcuaaguagguuau

SEQ ID NO: 50302 - RNA, 64 nt, Human
cuuuuuuaauagcucgaauauuucuagaguacuugagccacauguauuucuguauuuaaagaau

SEQ ID NO: 50303 - RNA, 64 nt, Human
ccucagccucccaaagugcugggauuacaggcgugagccacagugccuggccucuucccucucc

SEQ ID NO: 50304 - RNA, 64 nt, Human
cuggguccaggggaggccuuccagggacgaagaagagccacagugagggagaucccauccccuu

SEQ ID NO: 50305 - RNA, 64 nt, Human
cugacugaaggccuggcgggugccuuggcaaccugagccacacaggccuccaccccugcgccuc

SEQ ID NO: 50306 - RNA, 64 nt, Human
gggaccucucccacccgaccccuacagagcuugagagccacagacgccuggcuucuccggccuc

SEQ ID NO: 50307 - RNA, 64 nt, Human
caagugcuuccuacaaagacgcaaggugugcucugagccacagaugggcaaacccuggugcuuu

SEQ ID NO: 50308 - RNA, 64 nt, Human
gcugaauuucacaccagauccuaccccuuucccugagccacauguuucacacaaguguagaaaa

SEQ ID NO: 50309 - RNA, 64 nt, Human
uugagugccagcucuaaacaagucccuuuaugcagagccacagcugugcaugcucagcccugcc

SEQ ID NO: 50310 - RNA, 64 nt, Human
cagaugaggacaagagggacaagguauggggugggagccacaauugaggauaccccgagacuac

SEQ ID NO: 50311 - RNA, 64 nt, Human
cggugcuugggggaggagggcagggacagggagggagccacagucagugcccgggaaccuggaa

SEQ ID NO: 50312 - RNA, 64 nt, Human
uuucaaaacaucuucuuuuuaugcauuaauaaaagagccacauuuaucuucagcaacucugauu

SEQ ID NO: 50313 - RNA, 64 nt, Human
ccuuggaggaaagcagaggaugaucccugccugugagccacaccuccuagcucugggggcaaag

SEQ ID NO: 50314 - RNA, 64 nt, Human
agcuguuugaaaguuacgcuuuucuguuguucuagagccacagcagucuaauauugaaauauaa

SEQ ID NO: 50315 - RNA, 64 nt, Human
uuuuuaguucugacauguauauauugcuucaguagagccacaauauguaucuuugcuguaaagu

SEQ ID NO: 50316 - RNA, 64 nt, Human
uucacugugguauuuauaguauuggcuucaguccgagccacaggcaauaaaaggauaucagcug

SEQ ID NO: 50317 - RNA, 64 nt, Human
uucuacuguauaaauguuuuacauuaaguguuacgagccacaaauuucauguacauuuauuaua

SEQ ID NO: 50318 - RNA, 64 nt, Human
ugggcuuagcagaguuacccucaugccccuaucugagccacaaccuucuguaauucacuucaua

SEQ ID NO: 50319 - RNA, 64 nt, Human
agcaacaaaggauuugaaacuugguguguucguggagccacaggcagacgaugucaaccuugug

SEQ ID NO: 50320 - RNA, 64 nt, Human
ggcucucugugcagccucacagggcuuugccacggagccacagagagaugcuggguccccgagg

SEQ ID NO: 50321 - RNA, 64 nt, Human
gugacaccucccccuuucacacuggauccaucuugagccacagucacuggauugacuuugcugu

SEQ ID NO: 50322 - RNA, 64 nt, Human
ucuucgggaaaccagaauauguuuggggugguaggagccacacagacucuucugagcccccuca

SEQ ID NO: 50323 - RNA, 64 nt, Human
gcggccuccccgagguuguggggaggcugcacuggagccacaggcaggggugagagcacccacu

SEQ ID NO: 50324 - RNA, 64 nt, Human
gcuaaggagccucauagccuggcgggggcuggcagagccacaccccaagugccugugcccagag

SEQ ID NO: 50325 - RNA, 64 nt, Human
aaauguuuucucauucagucuccagucauugguugagccacagccuagggguuggaggaagacu

SEQ ID NO: 50326 - RNA, 64 nt, Human
cguuguccacuuuguggggcuuuguagguagacggagccacacuacaggcaggguaugagcaga

SEQ ID NO: 50327 - RNA, 64 nt, Human
uugaagcuaauuuguacuacuggauaucugacuggagccacagauacagaaucuguauuguucu

SEQ ID NO: 50328 - RNA, 52 nt, Human
cgugggcccaggugggcugagggagccacacuggggccccccccccguggaa

SEQ ID NO: 50329 - RNA, 53 nt, Human
ugacacauauugagacuuaggaagagccacaagaccacacacacagcccuuac

SEQ ID NO: 50330 - RNA, 64 nt, Human
gccuucggagccugccacccaggcccucagaacugagccacaggcugcucuggccaggagagaa

SEQ ID NO: 50331 - RNA, 64 nt, Human
uacaaagugagggagggcaguguccagauccccagagccacacauacauacacauacacacccu

SEQ ID NO: 50332 - RNA, 64 nt, Human
aacugaaaaucuaauuauaggagcauuuguuacugagccacagauaauacaagagcguccccuc

SEQ ID NO: 50333 - RNA, 64 nt, Human
caggcugcaauuccauccaguucccacaucaacggagccacacauuuggcacuguuaucuuggu

SEQ ID NO: 50334 - RNA, 64 nt, Human
cucugccucccuaaguugcugggauuacaggugugagccacagugccuggcccauucuugaguu

SEQ ID NO: 50335 - RNA, 64 nt, Human
ugggaagggccauggacccaacugggccccagaagagccacaggaacaucauuccucucccgca

SEQ ID NO: 50336 - RNA, 64 nt, Human
cuaaagagagacugucaugggucauuccccacaagagccacauccucacaccugacagaugcac

SEQ ID NO: 50337 - RNA, 64 nt, Human
ucaaugacgaauguugaagaugcuuuuauguucugagccacaugcacuuggaggccgcugguca

SEQ ID NO: 50338 - RNA, 64 nt, Human
agcccacuguuguuggugucagggaggcuuacuggagccacaccugcaggcgcuguguucaggc

SEQ ID NO: 50339 - RNA, 64 nt, Human
uugcugcauuccccuugguucgauuccacgcaaggagccacaagugagaacuccacuguccuua

SEQ ID NO: 50340 - RNA, 64 nt, Human
aggguggagcaggcucgccgcaagucauacuagugagccacacgccacagucagcgucugcugc

SEQ ID NO: 50341 - RNA, 64 nt, Human
uugucuuucuguuucuaaaacacagaacuuacaagagccacaggagccaauuauagcaccugac

SEQ ID NO: 50342 - RNA, 64 nt, Human
uaacagcaauuccaggcucaguauugugaccgcggagccacaggggaccccacgcacauuccgu

SEQ ID NO: 50343 - RNA, 64 nt, Human
aagauacggguggggagggaagauauccagaaaggagccacagcugacgccaaaaagaaaagaa

SEQ ID NO: 50344 - RNA, 64 nt, Human
gacccuucucuugcuugucacccgcuccagguuggagccacagacacccaccgccaccccggcu

SEQ ID NO: 50345 - RNA, 64 nt, Human
guuaaaguccuuucuugcuuucaaauaugcuauggagccacaguugaggacaguaguuuccugc

SEQ ID NO: 50346 - RNA, 64 nt, Human
cuccugcaccccaaagaagccacugaggcuggccgagccacacugucuccccaggggcgucgac

SEQ ID NO: 50347 - RNA, 50 nt, Human
cgggccagaccaauggcugagagccacagcugacaaagucugcauguccg

SEQ ID NO: 50348 - RNA, 64 nt, Human
agcauuucuuuccugaguucaggugacugaggaagagccacaaaacaaaacacaacaaaaccaa

SEQ ID NO: 50349 - RNA, 64 nt, Human
gggaagcgugcagcccaaaugggcacuugcaugggagccacagaggagcgucccuggggauugu

SEQ ID NO: 50350 - RNA, 64 nt, Human
uggacacucucuacagaucacugaggauaagcuggagccacaaugcaugaggcacacacacagc

SEQ ID NO: 50351 - RNA, 64 nt, Human
gcucgaggucuaagagaaacgcugaguuccugaagagccacagacagggugggugauugaugag

SEQ ID NO: 50352 - RNA, 64 nt, Human
ucccgugugugccuggugugugggacgcuuucgggagccacauugcacucugacuugccugggg

SEQ ID NO: 50353 - RNA, 64 nt, Human
caaccucuggcucccacaaggcccgguguugaccgagccacaggccacggacaggggccggggu

SEQ ID NO: 50354 - RNA, 64 nt, Human
ccugccauggccacuagggggcgcgcggcacccggagccacagcuggcggggucuccgccgcca

SEQ ID NO: 50355 - RNA, 64 nt, Human
gccuuaaaagcugggccccaggcccugcuggccagagccacagaugccaagcucugggagcuug

SEQ ID NO: 50356 - RNA, 64 nt, Human
uugaaaaccagagaaggugaaggggggcugcacugagccacaggaacaaugauggagauuccag

SEQ ID NO: 50357 - RNA, 64 nt, Human
cucuagaacuggagagagguccagauugcgacaggagccacaccagagugugcaggcuucaugg

SEQ ID NO: 50358 - RNA, 64 nt, Human
ucuccugccucggcagggacugugaucgaggcgugagccacagugguuaucuccaagcucaggg

SEQ ID NO: 50359 - RNA, 64 nt, Human
ccucggccucccaaagugcugggauuacaggugugagccacagcacccaaccuuuuuuuccccg

SEQ ID NO: 50360 - RNA, 64 nt, Human
ccccuacccagggcuguggacccagacuggccuugagccacagucccucuuucccuccucaccc

SEQ ID NO: 50361 - RNA, 64 nt, Human
cuuacggaaaauccgacaagccuucagccacagggagccacacagagauguccaaacugucgug

SEQ ID NO: 50362 - RNA, 64 nt, Human
acagcucaguucuuacaccgucuccacuuguggagagccacaggaagagaaggaagaccagcgc

SEQ ID NO: 50363 - RNA, 64 nt, Human
ucgaccaauaugugggguuggugaccaaucaguugagccacaucaaagcuaaguaagagcaugg

SEQ ID NO: 50364 - RNA, 64 nt, Human
uccccuacaguuuuaugcucagacauggaggucagagccacaagggaaaggggagagggggaga

SEQ ID NO: 50365 - RNA, 64 nt, Human
ugaggauuugcccagaguucaguccuggcuggaggagccacagccugucugggggaaaggacaa

SEQ ID NO: 50366 - RNA, 64 nt, Human
ccagcuccagcuucgucucaccuugaguuaggcugagccacaggcauuuccugcuuauuuuagg

SEQ ID NO: 50367 - RNA, 64 nt, Human
cuauccagugaauugaugaaugugagacauugcugagccacacuguuaagucugcucauugggg

SEQ ID NO: 50368 - RNA, 64 nt, Human
ccucagccucccaaaguguugggauuacaggugugagccacagcaccuggccaaccaacacuuc

SEQ ID NO: 50369 - RNA, 64 nt, Human
acagcuuuggccagagcucccguguggcaucugggagccacagugacccagccaccuggcucag

SEQ ID NO: 50370 - RNA, 64 nt, Human
ggauucuuugagcccaggaguuugagguuacagugagccacaaucacaccaaucacugcacucc

SEQ ID NO: 50371 - RNA, 64 nt, Human
aacccuccuguccuggacgugacuucauccugaggagccacagcacaggccgugcuggcacuuu

SEQ ID NO: 50372 - RNA, 64 nt, Human
caugucuuaggugcagcugugccacgggucagcugagccacagucccagaaccaagcucucggu

SEQ ID NO: 50373 - RNA, 64 nt, Human
guugggucaccggcuggaccugcugcagccugcagagccacagucagccugcccacaugccacc

SEQ ID NO: 50374 - RNA, 64 nt, Human
aucuucugcccaugggcuccauuuggcaccugcugagccacaguuguccugcuggaugugcugu

SEQ ID NO: 50375 - RNA, 64 nt, Human
auagacacagaccugcuccccgcagccuuguugagagccacacuucugcccaugccaggagcca

SEQ ID NO: 50376 - RNA, 64 nt, Human
aggguaauaacagaauuggaaccaugccacucuugagccacaauaccugucaccagccuguugu

SEQ ID NO: 50377 - RNA, 64 nt, Human
guucuguuggagaaacgcuugguuuccggauccagagccacagaaagaaauguaggugugaagu

SEQ ID NO: 50378 - RNA, 64 nt, Human
caguacccagaacagccaguuuuacugugauucagagccacagucuaacugagcaccuuuuaaa

SEQ ID NO: 50379 - RNA, 64 nt, Human
caggagaagcuggccgggaccagccaggagcugggagccacaggaagcaaaagucagccuuuuc

SEQ ID NO: 50380 - RNA, 64 nt, Human
ccuuuagaaccacagaugauaggaccagcccaaugagccacagucagagaguagauugugcaug

SEQ ID NO: 50381 - RNA, 64 nt, Human
aguggagcuucgacccacccacuccaggaacccagagccacauuagaaguuccugagggcugga

SEQ ID NO: 50382 - RNA, 64 nt, Human
agcccucugagaagugagaccucagcaauuccgggagccacauagagacagacuuggcaaggga

SEQ ID NO: 50383 - RNA, 64 nt, Human
cauuaauccaaccaaaaauaaugaaauaaaauuugagccacaguauaccacuccuugggauaaa

SEQ ID NO: 50384 - RNA, 64 nt, Human
uauuauuuacuuuuauuuuuuugaccugaaucgggagccacacuuggcccucuuccucuccaaa

SEQ ID NO: 50385 - RNA, 64 nt, Human
ucagccucuggacucuccuaagcaccucucaggagagccacaggugccacugccuccucaaauc

SEQ ID NO: 50386 - RNA, 64 nt, Human
ccuucugaacccucugggccugcgcuaauuguaggagccacagcgcuccuagggugagaggcuu

SEQ ID NO: 50387 - RNA, 64 nt, Human
gccuccaucacgccuguuaccagaggauccccgagagccacaccagcucuggacaucaccgccc

SEQ ID NO: 50388 - RNA, 64 nt, Human
agauccucuaccacagacauuaauagcugagcaggagccacauggauugauuguauccacucac

SEQ ID NO: 50389 - RNA, 64 nt, Human
uguaaccaagcuguacccuugagaccuggaaccagagccacaggccccuuuuguggguuucucu

SEQ ID NO: 50390 - RNA, 64 nt, Human
cccgaagaggcaggccguccuguagguccuagaggagccacagcccaggggcagaugaaggggc

SEQ ID NO: 50391 - RNA, 64 nt, Human
cgcguuugccacgugcugcccgugacagcacauugagccacagcauuuguagacaggacagagg

SEQ ID NO: 50392 - RNA, 64 nt, Human
ugugcucacugcccccacgccuccugccaaggccgagccacacacccgcuccaccugcauuucc

SEQ ID NO: 50393 - RNA, 64 nt, Human
agggggagagggaaaaguaaccgggagacaaauugagccacauauuuucagacacuuguuacca

SEQ ID NO: 50394 - RNA, 64 nt, Human
aguuaugagacugggaaagaacggggcacucaaagagccacacacaucugggccugggcgacgu

SEQ ID NO: 50395 - RNA, 64 nt, Human
guaacagaacacagccaaaguaaacuguguaggggagccacauuuacauaggaaccaaaucaau

SEQ ID NO: 50396 - RNA, 64 nt, Human
guuucucguugccuaagauguuuuggcaacucuagagccacaggccuaagucauuaaaaaauuc

SEQ ID NO: 50397 - RNA, 64 nt, Human
guuaugauuugauuugaccuuggcacacacugcagagccacagggauguugcugaauuucaauc

SEQ ID NO: 50398 - RNA, 64 nt, Human
gggcagggacauccauccaccucugaguccuucugagccacagccccagugacggucuggucuu

SEQ ID NO: 50399 - RNA, 64 nt, Human
uuuauuuauguugguacauccaacaaaauaguuggagccacaaggcccuugucuuuuuaaaaaa

SEQ ID NO: 50400 - RNA, 64 nt, Human
aagggaauguuuuuuucugagauaaaauaaaaacgagccacaucguguuuuaagcuuguccaaa

SEQ ID NO: 50401 - RNA, 64 nt, Human
cuaugucuuugcuccauacugcugggggaugggagagccacaguguguuucuuuugugcacuuc

SEQ ID NO: 50402 - RNA, 64 nt, Human
ucccaacucauuagcuccugggcagcauccuccugagccacaugugcagguacuggaaaaccuc

SEQ ID NO: 50403 - RNA, 64 nt, Human
gagugguucacaggccagcuggccggggguuggggagccacacagggugaacgggcagcagccg

SEQ ID NO: 50404 - RNA, 64 nt, Human
ggggagguuucauuuaaaagugcugggagcaggugagccacaggcaacucuucucucggaaccu

SEQ ID NO: 50405 - RNA, 64 nt, Human
cuuggcacagacuguggaugccucucccccagcagagccacacagccuucgugacaacugcuuu

SEQ ID NO: 50406 - RNA, 64 nt, Human
aggccucauggcccaggagaccccaccucuggcagagccacauuaccuacccugugcauggucc

SEQ ID NO: 50407 - RNA, 64 nt, Human
aaauaaaaguucauuuccaaggggaaucaggagcgagccacacccgaaugguagaaagaucuca

SEQ ID NO: 50408 - RNA, 64 nt, Human
gucaaacccaggcacgcggccuggccugcaugcugagccacauggugcuguccggacagaugga

SEQ ID NO: 50409 - RNA, 64 nt, Human
aggcuggcggggucugcuccugggaauggggugggagccacagggacgacccggggcgggcuga

SEQ ID NO: 50410 - RNA, 64 nt, Human
acgucugcuuccaccucaagcgcacagcccugcugagccacauggccggcucugugcaguuccg

SEQ ID NO: 50411 - RNA, 64 nt, Human
gagaccccaccgagggcgggagggggacucucgggagccacagacgcccgagacccacgccggg

SEQ ID NO: 50412 - RNA, 64 nt, Human
gaacuaaaaccaguuuuauuugccccaccccuuggagccacaaauguuuagaacucuucaacuu

SEQ ID NO: 50413 - RNA, 64 nt, Human
agccucagauuccuucuaaacacagcuaucuagagagccacauccuguugacugaaaguggcau

SEQ ID NO: 50414 - RNA, 53 nt, Human
aagagcugacaauuacauaacaggagccacauuccccauugaucaacccccaa

SEQ ID NO: 50415 - RNA, 64 nt, Human
ugaucaacccccaaagccaugagggauccaaguagagccacagaaaaagaagaauuccaggaga

SEQ ID NO: 50416 - RNA, 64 nt, Human
cuaacacuagcaucagucccacucaucucaggcugagccacaucucacuuuuucgcucaagcua

SEQ ID NO: 50417 - RNA, 64 nt, Human
acuacugcaccauuuaaaaacaggcagcucauaagagccacaggucuuuauguugagucgcgca

SEQ ID NO: 50418 - RNA, 64 nt, Human
cugaagcccacagagguggaacuuaauuaccuaagagccacaauaagccacugguaucuggggg

SEQ ID NO: 50419 - RNA, 64 nt, Human
ggagagagugagcuggggaacaggaaagucuggggagccacaggagagggaccuugcacccucu

SEQ ID NO: 50420 - RNA, 64 nt, Human
ugagaguuauuucucagggucauguugcaucuuggagccacaugcugcugcccugaucucagug

SEQ ID NO: 50421 - RNA, 64 nt, Human
uugaacagaucaucagaaacuacgcccgcuccgagagccacacagauuugacuuucucuagaga

SEQ ID NO: 50422 - RNA, 64 nt, Human
aguccucccugguccaccccacccucauccucaggagccacagccauuucuuagaggguuucaa

SEQ ID NO: 50423 - RNA, 64 nt, Human
auaaaaucuaugggaacugugaauacagacaagagagccacaguagagaggcuuguuuaaugca

SEQ ID NO: 50424 - RNA, 64 nt, Human
aaacugagauuacaaaaaaccagaggccuuuugggagccacaggcugggggcuggggccaacau

SEQ ID NO: 50425 - RNA, 64 nt, Human
aguugaucaaauacaauagaccauguaagcuggggccgcucauccacuuccaguuugcuggucu

SEQ ID NO: 50426 - RNA, 64 nt, Human
uuagggcuggaagacggcaguguucagaauuccagccgcucaucugaacacagaaggugugaac

SEQ ID NO: 50427 - RNA, 64 nt, Human
gccucuguguguggaucgcccgccccagcccggggccgcucaggucugcuuggaggaugccucc

SEQ ID NO: 50428 - RNA, 64 nt, Human
accguggccccucggccuucucucugcuagaguugccgcucagaggcuucagccugacuuccag

SEQ ID NO: 50429 - RNA, 64 nt, Human
ccugugcacccuggggaggagagcucugggaacagccgcucacaauauggccaucagguaccug

SEQ ID NO: 50430 - RNA, 64 nt, Human
ccauccccagccccucucaucccuggagcacucugccgcucaagagcugguuuguuaauuauug

SEQ ID NO: 50431 - RNA, 64 nt, Human
cccccgggaccacaaagccaccgccgcuguuaccgccgcucagcgccccggcugggcggaggag

SEQ ID NO: 50432 - RNA, 64 nt, Human
gcccugggaaaaaugugcgagucuugagcgcggagccgcucaagccacagcucccaggccccug

SEQ ID NO: 50433 - RNA, 64 nt, Human
gccugggucuucugcagacucaugcagcccuauggccgcucagaccaaggcgcagagcaacuau

SEQ ID NO: 50434 - RNA, 64 nt, Human
cgcagaccccguggccugagaugugggcuucccagccgcucacgguuuuacagauacuauuuac

SEQ ID NO: 50435 - RNA, 64 nt, Human
aauaaugugaaggaagaaaagagccgcuugaaucgccgcucagcccccuuuguuucugcuuucu

SEQ ID NO: 50436 - RNA, 64 nt, Human
ggucauaacgcuuuugcagggucaaugguguugagccgcucauagcaugugaccuaccuacccc

SEQ ID NO: 50437 - RNA, 64 nt, Human
uuggggaugcuaugaaagagagaaggaaaaucaugccgcucaguuccuggagacagaagagccg

SEQ ID NO: 50438 - RNA, 64 nt, Human
cugagaggugguggcaguaauuguggccuuaucagccgcucaguuccaggcuuuugcccagguc

SEQ ID NO: 50439 - RNA, 64 nt, Human
ccguggccugcguggccauccccuggagagaggagccgcucagggugcgcgucauggagugugc

SEQ ID NO: 50440 - RNA, 64 nt, Human
ugcuccuccuacugagccggccgcagaaauugcagccgcucagcuucuacccccuccugccuuu

SEQ ID NO: 50441 - RNA, 64 nt, Human
gguugguggcuggaaaacagcccugcuucugagggccgcucaguucugcacacgaaaccaccuc

SEQ ID NO: 50442 - RNA, 64 nt, Human
gaaagaacuagaauagaagacugaagcuggguaggccgcucaguguccacuggcauuuugcuaa

SEQ ID NO: 50443 - RNA, 62 nt, Human
acaaaaacaaaaaaacccaaaggcccuuuucagggccgcucacaaagucguuuaaagagcug

SEQ ID NO: 50444 - RNA, 64 nt, Human
acaagugacacuguggacaaugaacacaugggccgccgcucauccaaaugugaguaauuguugg

SEQ ID NO: 50445 - RNA, 64 nt, Human
ccaugcucagcgccgggccugaggaccuggagccgccgcucaaaaggaggugccuccgaauuag

SEQ ID NO: 50446 - RNA, 64 nt, Human
gcggggaccacagaggcacagaguccagcacuuggccgcucaugggccuucuuucugccucaga

SEQ ID NO: 50447 - RNA, 64 nt, Human
ugacuggaggccgggcaggaagcaagucaucagagccgcucagcuccguucacucucugccuuc

SEQ ID NO: 50448 - RNA, 64 nt, Human
uggcggcccccaagcagacuagaugggaggaggcgccgcucagccccucacccugcaucacuga

SEQ ID NO: 50449 - RNA, 64 nt, Human
aaagucaaguguuucaccaauuuccguaggaagggccgcucacugcacgguggggcgaugcugg

SEQ ID NO: 50450 - RNA, 64 nt, Human
ccuccguggacagcaggggccacguggagcccgggccgcucacccgccacccagugcuggccgc

SEQ ID NO: 50451 - RNA, 64 nt, Human
gucucuccugcuucccucccuaagggaagggcuggccgcucacugcuugggcccccuugauuuc

SEQ ID NO: 50452 - RNA, 64 nt, Human
augcagggggagcucuuccuggaccaagggaggagccgcucauucacccaacaaaacugugucu

SEQ ID NO: 50453 - RNA, 64 nt, Human
ccgcuggauggagagcaaaggagaccccucccgagccgcucacaguccuguauuuggcagguuu

SEQ ID NO: 50454 - RNA, 64 nt, Human
ucaccuaccaagaggcggccgccuccuuggacaagccgcucauggaccauuagacuugagaaga

SEQ ID NO: 50455 - RNA, 64 nt, Human
uccaucugggaacuaacagcugcuaaccugaccagccgcucaggacaggacccuggggcuacac

SEQ ID NO: 50456 - RNA, 64 nt, Human
ccccaaugccuuagagagaggaggggacggcacggccgcucaccggaaggcugugugcggggac

SEQ ID NO: 50457 - RNA, 59 nt, Human
agccggccacagcaagguagagaaguugugccgcucaaucacagacaccugcacccaca

SEQ ID NO: 50458 - RNA, 64 nt, Human
aaauagcaucaugugugaucucgucuuccagcgugccgcucaguuccccgaauccgugugcaca

SEQ ID NO: 50459 - RNA, 64 nt, Human
uccgugugcacacgugugaucucgucuucagugugccgcucaguucccugaauccgugugcaca

SEQ ID NO: 50460 - RNA, 64 nt, Human
ugagccgacagccggacuccucggagcagccgccgccgcucaacgggcagcugugcgccaagca

SEQ ID NO: 50461 - RNA, 64 nt, Human
guggcuggacugauggagacgucuucagacaggagccgcucagucuucuuucccgggcgucgcc

SEQ ID NO: 50462 - RNA, 64 nt, Human
ggaacagaaggucaugaguucagggucagacgcagccgcucagcacaggagggguggaggggaa

SEQ ID NO: 50463 - RNA, 64 nt, Human
gccaugcguuccagcauuccacgguccagcuagugccgcucagcccuagacccugacuuugcag

SEQ ID NO: 50464 - RNA, 50 nt, Human
agacuugucagacacagugagccgcucaagcaaaauggaucuggcagaau

SEQ ID NO: 50465 - RNA, 64 nt, Human
uagaggccggucuuggugucccaucccugucacagccgcucacuccccgugccucugcuuccca

SEQ ID NO: 50466 - RNA, 64 nt, Human
ucagcccagccuagcccagcucaggcaggccauggccgcucaagggaaagacugccccagaaga

SEQ ID NO: 50467 - RNA, 64 nt, Human
cccaugcuccaagcagccucccccagcacuugcggccgcucagcccuccaaccaagaccuaagu

SEQ ID NO: 50468 - RNA, 64 nt, Human
gcgugcucugagcaggcgccugccagccucaccugccgcucaggccucagaggcccugccgggc

SEQ ID NO: 50469 - RNA, 64 nt, Human
gcugagagaugaggcuggacuccuguccccgcgggccgcucaccugacauguggaccugcagcu

SEQ ID NO: 50470 - RNA, 64 nt, Human
cagcguuucagcugugggcuucuaccaccacuaagccgcucaccuagaguuguuacuuuuuuga

SEQ ID NO: 50471 - RNA, 64 nt, Human
gauggguggggccugcucuggagcugagcccguggccgcucacagguguccuuagugguguugc

SEQ ID NO: 50472 - RNA, 64 nt, Human
uggcuguaaauauagaugaagcuucagcucgccugccgcucaccuugugcugugcagcccgguu

SEQ ID NO: 50473 - RNA, 56 nt, Human
uggccagugugcucaucugagaggcugccgcucaccuaccugcacaucugccacag

SEQ ID NO: 50474 - RNA, 64 nt, Human
cagcacugccccucagcaaggaugacucagcacugccgcucaacagacaugacucagggauggc

SEQ ID NO: 50475 - RNA, 64 nt, Human
cagcacugccccucagcaaggaugacucagcacugccgcucaacagggaugacucagggauggc

SEQ ID NO: 50476 - RNA, 64 nt, Human; identical to SEQ ID NO: 50474

SEQ ID NO: 50477 - RNA, 64 nt, Human
cagcacugccccucaccaaggaugacucagcacugccgcucaacagacaugacucagggauggc

SEQ ID NO: 50478 - RNA, 64 nt, Human
gagacuugcccaaggcuggauaggaggcuucuuugccgcucaggcuuuaucagucaggaaaucc

SEQ ID NO: 50479 - RNA, 64 nt, Human
aggagugcacuaccugcugucagucaccagaguggccgcucagugcccagcccgccagccucgc

SEQ ID NO: 50480 - RNA, 64 nt, Human
acaucacggcaacugaagcggcuggaaucagucagccgcucaccuaucuacucccacuuuucgg

SEQ ID NO: 50481 - RNA, 64 nt, Human
accccaagugccugugcccagagggcuucagucagccgcucacuccuccagggcacuuuuagga

SEQ ID NO: 50482 - RNA, 64 nt, Human
ggcccagggcccaggccugucuggggugggcgcugccgcucaccacucagggaggaccugggcc

SEQ ID NO: 50483 - RNA, 64 nt, Human
guuaagaagagccggguggcagcugacagaggaagccgcucaaauaccuucacaauaaauagug

SEQ ID NO: 50484 - RNA, 58 nt, Human
ggcccggagcccccuucuaggacagcuggccgcucaggcgacccucagcccggcgggg

SEQ ID NO: 50485 - RNA, 64 nt, Human
auggaccgccugugagcgggcacgccggcacccugccgcucagccgucccgacggcgccucccc

SEQ ID NO: 50486 - RNA, 64 nt, Human
agcuagaagagauuugaggucaugaccucccacugccgcucaggggcugacccuauuuaggaaa

SEQ ID NO: 50487 - RNA, 64 nt, Human
ggggcaaagauuguccccucugcuguucucuggggccgcucagcacagaagaaggaugaggggg

SEQ ID NO: 50488 - RNA, 64 nt, Human
cugggaugucaucauucaccauuuauccaggauggccgcucaccaggcaauuugcuaggcucgg

SEQ ID NO: 50489 - RNA, 64 nt, Human
uagcaguaggaacgggggccgccgcggcccugcagccgcucauggcggugaggugugugccaag

SEQ ID NO: 50490 - RNA, 64 nt, Human
ugcuccuggcaucgaguggguggagaccagagaagccgcucaacauccugcaaugcaugggaca

SEQ ID NO: 50491 - RNA, 64 nt, Human
ccagcaucacagaugaccuccagcccugcagggagccgcucaagucugggagggcaugggagca

SEQ ID NO: 50492 - RNA, 64 nt, Human
cuuuugcauguugggaaagggucuuggugucacugccgcucaugcauagaaaccaccaaaagcc

SEQ ID NO: 50493 - RNA, 64 nt, Human
gccgcgcacggugccaggauuccgccgaggggaagccgcucacauugcagucaucacagacuua

SEQ ID NO: 50494 - RNA, 64 nt, Human
ggugggggcaagggucagggcaaugggggacaaugccgcucagggugcagugagcuccccuggg

SEQ ID NO: 50495 - RNA, 64 nt, Human
agcuuggaggcaggauggguugcugagugaagucgccgcucacuuuuggauucuuauggacugu

SEQ ID NO: 50496 - RNA, 64 nt, Human
guugaagaugugauuucaagaaaugaaauucagggccgcucagcagaggaggcuuacaaacagc

SEQ ID NO: 50497 - RNA, 64 nt, Human
uuuuucuggugccacugacaccugggcugcccaugccgcucaggcuacccuuaucuccucugca

SEQ ID NO: 50498 - RNA, 64 nt, Human
cccgccuugcacugcgccugccccacgguguccccgccgggaagcagccccggcuccugaauca

SEQ ID NO: 50499 - RNA, 64 nt, Human
ggaagcguccuguuuggagagagccagagagcaccgccgggaggcgcucgcgcaaggccacggu

SEQ ID NO: 50500 - RNA, 64 nt, Human
uuccaguaucaaugcuacacaguguugucccgagcgccgggaggcguugggcagaaacccucgg

SEQ ID NO: 50501 - RNA, 64 nt, Human
ugcugcauguacauauuuucuguaaauauacaugcgccgggagcuucuugcaggaauacugcuc

SEQ ID NO: 50502 - RNA, 64 nt, Human
aaccccaccgacccagaccaagaccgcgccgagccgccgggacucagcgccuucggguggcggc

SEQ ID NO: 50503 - RNA, 64 nt, Human
gaaaaucuucucaguucuccuugcagaggacuggcgccgggacgcgaagagcaacgggcgcugc

SEQ ID NO: 50504 - RNA, 64 nt, Human
cuggauagcuacuuccaucccccggggacucccgcgccgggacgcggggugggaccaggcgcgg

SEQ ID NO: 50505 - RNA, 64 nt, Human
gcagcgcaacgcacuggugaccagacuguccccacgccgggaaccaagcaggagacgacaggcg

SEQ ID NO: 50506 - RNA, 63 nt, Human
caguggaccggcccgugugagccgcacccacagcgccgggauccuaggaccuugccggauggg

SEQ ID NO: 50507 - RNA, 64 nt, Human
acgaauuuggccgauggcagauguuuugggggaacgccgggacugagagacuccacgcaggcga

SEQ ID NO: 50508 - RNA, 64 nt, Human
cuuuuaaaggcaaaucauucccaccaucacuuaacgccgggauuauacacauucuagaaaugau

SEQ ID NO: 50509 - RNA, 64 nt, Human
ucgcccgcuccugugguuuuucugagcgugcgggcgccgggaggggaugcugaggcugauggag

SEQ ID NO: 50510 - RNA, 64 nt, Human
ccuugcagaggcgccucucaaggccccaucagcucgccgggaccucugugaagccucucuguca

SEQ ID NO: 50511 - RNA, 64 nt, Human
guuccaaguacucacaggggcucugggugcccaucgccgggaguaugguucagcugccaccggc

SEQ ID NO: 50512 - RNA, 64 nt, Human
aagccacuacuuccagaagcaucuccucauuccccgccgggagcaacaucucucuucucgagac

SEQ ID NO: 50513 - RNA, 64 nt, Human
caacugauccaccugccucagccucccaaagugccgccgggauuacaggcgugagccaccaugc

SEQ ID NO: 50514 - RNA, 64 nt, Human
cugcauggcaucagacuagccacuccugccaggccgccgggaugguucuucuccaguuagaaug

SEQ ID NO: 50515 - RNA, 64 nt, Human
gagcagugggcagguggccgccccugaggcuucacgccgggagaagccaccuucccaccccuuc

SEQ ID NO: 50516 - RNA, 57 nt, Human
accgggaagagaagaccuaggagcagacgccgggauccaggagaaugcucgaggggc

SEQ ID NO: 50517 - RNA, 64 nt, Human
aaacuguccuguugucgaagcuucuccccugggccgccgggagccccguggagcgcggccugca

SEQ ID NO: 50518 - RNA, 64 nt, Human
cuuagugaugugugugugucuccaugcacaugcacgccgggauuccucugcugccauuugaauu

SEQ ID NO: 50519 - RNA, 64 nt, Human
agauggcacugaucacugagcaggagaggagugucgccgggaggccuucagggugggggggaag

SEQ ID NO: 50520 - RNA, 64 nt, Human
accccucgggcccacccguacagaggcugguggucgccgggauaauuaaugaccaccgccaauu

SEQ ID NO: 50521 - RNA, 64 nt, Human
ccgcugcucccgccgccgccucagcgccacacaucgccgggacacccgcgccgggcagccccgc

SEQ ID NO: 50522 - RNA, 64 nt, Human
ggugacucggacugaauuccccauacuguuuccacgccgggacaccauguucuccaucaagcua

SEQ ID NO: 50523 - RNA, 64 nt, Human
gugcccagagugggcgguggccugucuagaaugccgccgggaguccgggcauggugggcacagu

SEQ ID NO: 50524 - RNA, 64 nt, Human
ugcaggccaggcugccacuccgggaacgccuuugcgccgggacuuuuuguuucugaaggcaguc

SEQ ID NO: 50525 - RNA, 64 nt, Human
aacacggggugagacagcaggaaggggcccugcacgccgggacgccaccuccgccagccgccuc

SEQ ID NO: 50526 - RNA, 64 nt, Human
aauguccuacugcccgggcagccccagcccagcccgccgggagcaaggauggugcuaggucauu

SEQ ID NO: 50527 - RNA, 64 nt, Human
ugagaaaggguccgcccgguggccuggaggcaggcgccgggagcgcaguagcacguggacuggg

SEQ ID NO: 50528 - RNA, 64 nt, Human
ugaggucgcauaacgccccauggcucaaggaagccgccgggagcugcccgcaggcccugggccg

SEQ ID NO: 50529 - RNA, 64 nt, Human
cgcggcgacuggaggcuggauucgaggccggaaacgccgggaccccuggacccggccugguggg

SEQ ID NO: 50530 - RNA, 64 nt, Human
cucuggaggggguuugcuggggaacuggcgccaucgccgggacuccagaaccgcagaagccucc

SEQ ID NO: 50531 - RNA, 64 nt, Human
cugaucuugucaaacccagccugaccgcuucugacgccgggauggccucguuacuagacuuuuc

SEQ ID NO: 50532 - RNA, 64 nt, Human
ugguguaagcacacaugcacgauuaaagaggagacgccgggacccccugcccgaucgcgcgcgg

SEQ ID NO: 50533 - RNA, 64 nt, Human
aggaccggguggaggcgguggggacccagccgcgcgccgggagcgcuccccggaaugagccgcc

SEQ ID NO: 50534 - RNA, 64 nt, Human
ccgccuccccuuccccguccccuccucccgaagacgccgggacagucggguguccgcccucagc

SEQ ID NO: 50535 - RNA, 64 nt, Human
gcgacggcggagccaccggagcgagcgcgagcggcgccgggaccgggaucgugaccgugaccgu

SEQ ID NO: 50536 - RNA, 64 nt, Human
gcaucuaacugcaggaacccagagugucccagcacgccgggaggggcaaccaggccucccagcg

SEQ ID NO: 50537 - RNA, 64 nt, Human
guccccaagaacgugacguucgugauguccugcccgccgggagucuuuccccacaccccagcca

SEQ ID NO: 50538 - RNA, 64 nt, Human
gccgguucccccggucauguggcgccuguuucgacgccgggacccccaggagaccaggucuggc

SEQ ID NO: 50539 - RNA, 64 nt, Human
ggccguccccaccuucuagcgacuucgggccucccgccgggaucugaugccgcggggugggggc

SEQ ID NO: 50540 - RNA, 64 nt, Human
cacuguaaccacaagauguuauuuauugagcuggcgccgggacuugggcggggccugcccuaca

SEQ ID NO: 50541 - RNA, 64 nt, Human
ggagucgaguugacucucggcuccacuagggaggcgccgggagguugccugcgucuccuuggag

SEQ ID NO: 50542 - RNA, 53 nt, Human
agcccgacacggaggacugaggucgccgggaccacccugagccggccccaggc

SEQ ID NO: 50543 - RNA, 64 nt, Human
uccgggcgcgcgggccuccuguucgcgacaagcccgccgggaucccgggcccugggcccggcca

SEQ ID NO: 50544 - RNA, 64 nt, Human
ugcccacacccagcuggccauauccaccccucgacgccgggaugagccggcucugccuguguca

SEQ ID NO: 50545 - RNA, 64 nt, Human
caccugcgggaggcagcgacggcccccacgcagacgccgggaacgcaggccgcuuuauuccucu

SEQ ID NO: 50546 - RNA, 64 nt, Human
cggaggucucuguaaaagcagacccaccucccagcgccgggaagcccgucuuggguccucgcug

SEQ ID NO: 50547 - RNA, 64 nt, Human
acuugaaagacacugucggaggugagcaucugggcgccgggacgcugcagugauccccgccaga

SEQ ID NO: 50548 - RNA, 64 nt, Human
uucaggugauccgcgggaggggccuccacgccagcgccgggaaggcugcuggggccuccacacc

SEQ ID NO: 50549 - RNA, 64 nt, Human
gggucgggacaggagcacguggcucagacaccgacgccgggaggccgcagaccccggacguguc

SEQ ID NO: 50550 - RNA, 64 nt, Human
ggcaccuggacgcugaugguggccaggaugcucagcuggccaggagggcagcaccugcugggga

SEQ ID NO: 50551 - RNA, 64 nt, Human
ccuguggucaugugcuccuagcugcacgguggcugcuggccacaccacggcaaguggcagcagg

SEQ ID NO: 50552 - RNA, 64 nt, Human
cacgcuaaggaguaguggcccugacuuccggucggcuggccagcugacucccuagggccuucag

SEQ ID NO: 50553 - RNA, 62 nt, Human
uuggcauccccacgaacugacccgggcuuggggcuggccaauggggagcuggauugagcaga

SEQ ID NO: 50554 - RNA, 52 nt, Human
agacacacuuuauuuccuaagggcuggccaaggcucccauagaggcgcugug

SEQ ID NO: 50555 - RNA, 55 nt, Human
ugggcacugcaucagccugaaugaggcuggccaccugccacuuugcccugcccuc

SEQ ID NO: 50556 - RNA, 64 nt, Human
uuugcuuggcuggggagccccccaggccagguuugcuggccauagauaccuuugggcugccugg

SEQ ID NO: 50557 - RNA, 64 nt, Human
agaacccggugugccgggagauggcugugguacugcuggccaaccuggcucagggggacagccu

SEQ ID NO: 50558 - RNA, 64 nt, Human
gcagcuucaacguugaguaaagggauuucugagagcuggccaaugccuuuugccagcugcagug

SEQ ID NO: 50559 - RNA, 64 nt, Human
ugcugcccugaagaccaccccagucuaccucggugcuggccaggaaaccuuucggcuaccucuc

SEQ ID NO: 50560 - RNA, 64 nt, Human
ugcagagaugacugggcuggggaagcaggugcuugcuggccauggagccucauugcaaguuguu

SEQ ID NO: 50561 - RNA, 64 nt, Human
caucccuggcgcugucucccacuggacagaggaggcuggccauggggcccaggggucaggccca

SEQ ID NO: 50562 - RNA, 64 nt, Human
uugggagaacuaaguaagaaacacaaugccaacagcuggccaguaauuaguguugugcacuuca

SEQ ID NO: 50563 - RNA, 64 nt, Human
cuccaacuugaauuccuaguaacuuucuugguaugcuggccagaaagggaaaugaggaggagag

SEQ ID NO: 50564 - RNA, 64 nt, Human
cuguccacccaccggaagcgcucuuuacuuggucgcuggccaccccaguguuuggaaaaaaauc

SEQ ID NO: 50565 - RNA, 64 nt, Human
uacaauuugaauauguguuacuuaauaaggcuaggcuggccaucaguugcuuauuucagaugug

SEQ ID NO: 50566 - RNA, 64 nt, Human
gaaguaaugugguccacagccaugcccuugaggagcuggccacuggauacugaacacccuacuc

SEQ ID NO: 50567 - RNA, 64 nt, Human
cauuucaacagagaagggaaaugacaaaggggcagcuggccagauaagcuaggaugagagcaga

SEQ ID NO: 50568 - RNA, 64 nt, Human
uggaugcccugugccagugaccagagcacccagggcuggccagucacugagggaacagcgucuc

SEQ ID NO: 50569 - RNA, 64 nt, Human
gaaucuguuuucaaucuccacugauugcccccuugcuggccagcccaggggccuuuaccauguu

SEQ ID NO: 50570 - RNA, 64 nt, Human
cgacacugccaagccaacccuggaaaaggaguucgcuggccauuggcuagaaucaggguggaga

SEQ ID NO: 50571 - RNA, 64 nt, Human
gcucagugacugucgccuuguuacugauccucuugcuggccauuguugcuucuguugucaccuc

SEQ ID NO: 50572 - RNA, 64 nt, Human
ccagccacaccaacccugugcucucuggcccccagcuggccacacuucuccaggagggacccuu

SEQ ID NO: 50573 - RNA, 64 nt, Human
acacugugauuuuuacaccgaaaagccaaaaggagcuggccauccagggccuagggagaccagc

SEQ ID NO: 50574 - RNA, 64 nt, Human
caucccaucacaucagccuaccucccuccuggcugcuggccaggaugucgccagcauuaccuuc

SEQ ID NO: 50575 - RNA, 64 nt, Human
gggucugugcuguuugucgugaaaagcuuaaugggcuggccaggcugugucaccuucuccaagc

SEQ ID NO: 50576 - RNA, 64 nt, Human
auaaagagaagauacuuucuagauaccgcucuuugcuggccagagucuguccuggugugugagg

SEQ ID NO: 50577 - RNA, 64 nt, Human
augucaucaauggcaguucucaugcugucaccaagcuggccaugcaggaguucaugguccuccc

SEQ ID NO: 50578 - RNA, 64 nt, Human
cugucacuuagcagauugcacuuaagucccuugugcuggccagauggcguggcugguugccuua

SEQ ID NO: 50579 - RNA, 64 nt, Human
cacccucacacacacagcugggcaaagccacaaggcuggccagcaaggcagguuggaugggagu

SEQ ID NO: 50580 - RNA, 64 nt, Human
auccuugagucuccucucuggauggaauccgcgagcuggccaccuggccacccucuacacggcu

SEQ ID NO: 50581 - RNA, 64 nt, Human
augagcugccaguccauucccaggccaggcugucgcuggccauccauucagucgauucagucau

SEQ ID NO: 50582 - RNA, 64 nt, Human
ccacuguuuucugagaaauguagcauccgcugcagcuggccacacugagggcccucugggaacc

SEQ ID NO: 50583 - RNA, 64 nt, Human
uagacccauggagaggaacucuucugcacucugagcuggccagccccucggggcugcagagcag

SEQ ID NO: 50584 - RNA, 64 nt, Human
gugcugggauuacaggugugagccaccgcacccggcuggccaaucuuaucagaagugagcuacc

SEQ ID NO: 50585 - RNA, 64 nt, Human
cacccaguaaacccaaaaaaagcaaauggauaaugcuggccauuuugccuuucugacauuuccu

SEQ ID NO: 50586 - RNA, 64 nt, Human
agguggucuuucauccuugacaggcugguaaugugcuggccaccuccagcuccugcaucgaguc

SEQ ID NO: 50587 - RNA, 64 nt, Human
ucuccccaaggugaaguggagggugcuguggugagcuggccacuccagagcugcagugccacug

SEQ ID NO: 50588 - RNA, 64 nt, Human
cuccccaccccucaguugacgccagcccuguaaagcuggccacagugugcagggagaaugggga

SEQ ID NO: 50589 - RNA, 64 nt, Human
gugccgcggccuugggagcaugucacuguguacagcuggccacacacagggaaggagcagcauc

SEQ ID NO: 50590 - RNA, 64 nt, Human
gaggcaaagaggagcugcuccugccuccaugguugcuggccacucccaccaacuacucuuaggg

SEQ ID NO: 50591 - RNA, 64 nt, Human
ucuuccaagccgggcauccuugcgagccccccaagcuggccacagaugccacuacuucuguagc

SEQ ID NO: 50592 - RNA, 64 nt, Human
gcuaacaagucuucuuagaguuaaaggagggggugcuggccaagagccaacacauucuuggccc

SEQ ID NO: 50593 - RNA, 64 nt, Human
guagaguccagccuagugagagcugagugaaggggcuggccaugccugagacaaaaagucaaau

SEQ ID NO: 50594 - RNA, 64 nt, Human
uuacaaggugauguaaucagcuuguuguagugaugcuggccaaauggugcucagcaggugagaa

SEQ ID NO: 50595 - RNA, 64 nt, Human
uugucgagugauuuuuagccucugaaaacucuaugcuggccacugauuccuuugagucucacaa

SEQ ID NO: 50596 - RNA, 64 nt, Human
gcucugacgacgcugcagccgcagggagggaggggcuggccagagggagaggcagcagggaacg

SEQ ID NO: 50597 - RNA, 64 nt, Human
accacaaacccacgagggcagagugcugcuugcugcuggccaggccccugcgugggcccaagcu

SEQ ID NO: 50598 - RNA, 64 nt, Human
gacaguagccaaugaggugcggggagggggccgggcuggccaaugggagcugcuuuccugaggg

SEQ ID NO: 50599 - RNA, 64 nt, Human
ugguguuaacagaagggagggcagagcuggugcggcuggccauggagaaagcugacuuggcugg

SEQ ID NO: 50600 - RNA, 64 nt, Human
accaacagcagauguugcaaacuuucauaccacugcuggccauggaagccucuuaacaacacac

SEQ ID NO: 50601 - RNA, 64 nt, Human
uuaggauggcuaguaucaaaagaaagaaaaucaggcuggccaacggggugaaacccugucucua

SEQ ID NO: 50602 - RNA, 64 nt, Human
ccauuccuaagaacacugaagggcuggaaugcuggcuggccacucucugccucaguggccuccc

SEQ ID NO: 50603 - RNA, 64 nt, Human
uuuguguauuuucagcagagacgggguuugccaugcuggccaggcuggucucgaacugcuggau

SEQ ID NO: 50604 - RNA, 64 nt, Human
cuaaaggccucuggauacugggcuccccagaacugcuggccacaggauggugggugagguuagu

SEQ ID NO: 50605 - RNA, 64 nt, Human
aggcucuggcuguggaugucuucagccucugggugcuggccagugaggucccaaaugacccagg

SEQ ID NO: 50606 - RNA, 64 nt, Human
ggacgccuggagaagggugguuuccugccacccugcuggccaaggaggcuccugggguggggau

SEQ ID NO: 50607 - RNA, 64 nt, Human
ccagaaccagcucaccuggccagaguggguuccugcuggccagggugcagccuugaugacaccu

SEQ ID NO: 50608 - RNA, 64 nt, Human
gcagauuuucagaagugucuggucaagauaacaugcuggccaaccacaauuccuagaguuaaga

SEQ ID NO: 50609 - RNA, 64 nt, Human
ucugguggccccguuucugguggucuguuggcaggcuggccaguccaggcugccguggggccgc

SEQ ID NO: 50610 - RNA, 64 nt, Human
uacagacggaccagaagccaccuuuuucucccccgcuggccaggggcuccacacagacuaacgu

SEQ ID NO: 50611 - RNA, 64 nt, Human
cugacaucacuguuuguaccaaagccaaacucuggcuggccaagagguauguuaaaaucccaca

SEQ ID NO: 50612 - RNA, 64 nt, Human
cggcuggacacacguggaaccaagccagggaugggcuggccauuguguccccgcaggagagaug

SEQ ID NO: 50613 - RNA, 64 nt, Human
gguggaggcuaagccuggacacagucagggcggggcuggccagcugugcgagaacacaagccac

SEQ ID NO: 50614 - RNA, 64 nt, Human
aucuuuguucuuuguuagucucuugaaacuggcugcuggccaagcuuuauagcccucaccauuu

SEQ ID NO: 50615 - RNA, 64 nt, Human
ggcgggucaguugaggucaggaguucaagaccaggcuggccaacaugguaaaacccugucucua

SEQ ID NO: 50616 - RNA, 64 nt, Human
cuuuacccccaugaccaacaucgcagacacaugugcuggccaccugcugagccccaaguggaac

SEQ ID NO: 50617 - RNA, 64 nt, Human
cugcauaaacuucaucuucaaccuuaaggacuuagcuggccacagugagcugaugugcccacca

SEQ ID NO: 50618 - RNA, 64 nt, Human
gcucgggaguccagugagcagagcauuggacuuggcuggccagagggucucugagggcaagaga

SEQ ID NO: 50619 - RNA, 64 nt, Human
cagccgacgcccgcuacgaagcagccugcaacaggcuggccaacaaggcggugcagcggggcuc

SEQ ID NO: 50620 - RNA, 64 nt, Human
acuuucuaugcaauguucaggauaaaugcauacugcuggccaaucagugucaucuccuggguaa

SEQ ID NO: 50621 - RNA, 64 nt, Human
cugaguagcugggauuacaggcgccugccaccacgcuggccaauuuuuguacuuuuaguagaga

SEQ ID NO: 50622 - RNA, 64 nt, Human
aaggcaaauaaacucuuuaacaggcaauuauauugcuggccaaaauaugcuauauuuguauaca

SEQ ID NO: 50623 - RNA, 64 nt, Human
uaaaccaggugucugugauuucuaauuaaucaccgcuggccauuacacagguuuuguuguuugg

SEQ ID NO: 50624 - RNA, 64 nt, Human
ggcugcgggagagcuggcuguugcuggacuacaugcuggccacugcugugaccacgacacugcu

SEQ ID NO: 50625 - RNA, 64 nt, Human
uuauacacuucucccauuuuguaucagguguguugcuggccaggagcugauggcucacugggcu

SEQ ID NO: 50626 - RNA, 64 nt, Human
accugagccagaccuuaagcucuaugguuauuuagcuggccauucagguauaaggcaggguggu

SEQ ID NO: 50627 - RNA, 64 nt, Human
gcugagaagacagagcacugacaaugagcuggcagcuggccaggaucagggcugucucaagcuu

SEQ ID NO: 50628 - RNA, 64 nt, Human
uugcucaggggccgggacagcacugggugcucaggcuggccaaggaccuucauugccuggcaag

SEQ ID NO: 50629 - RNA, 64 nt, Human
uccauucuccauucuggagaaucugcuccaaaaagcuggccacaucucugaggugucagaauua

SEQ ID NO: 50630 - RNA, 64 nt, Human
gguaaaggcaaaauagaggguaugaccugggguugcuggccagagccagggaggagccuuaaga

SEQ ID NO: 50631 - RNA, 64 nt, Human
guccaagccugggcauggguggggggccuugucugcuggccacgcaagugucacaugcgaucua

SEQ ID NO: 50632 - RNA, 64 nt, Human
gcccccucuggcugugugucaccuuggcuggcuggcuggccaggguuuugccgauuucccuccu

SEQ ID NO: 50633 - RNA, 61 nt, Human
accgugaguccaucgugugagccucggccuggcuggccaggacacacugaaaagcagccuu

SEQ ID NO: 50634 - RNA, 64 nt, Human
gcugccuggcuccuagauggcucugugggcaggugcuggccaaggacaucaucuaggcaggggg

SEQ ID NO: 50635 - RNA, 64 nt, Human
acggaggggaguagagaaguuacacagaaaugcugcuggccaaauagcaaagacaaccugggaa

SEQ ID NO: 50636 - RNA, 64 nt, Human
uuuuuuccaggacaaagccaaaggccccuuguuagcuggccaucccugccccauuuuuuccccu

SEQ ID NO: 50637 - RNA, 64 nt, Human
uagagccucgucccucccucacugaaggaccugagcuggccaggcccugagagucuggucugcg

SEQ ID NO: 50638 - RNA, 64 nt, Human
caggacauugaccaccugaccuccccuaacuagugcuggccaaggccugagaguucacagaacc

SEQ ID NO: 50639 - RNA, 64 nt, Human
agcccucucugauuccuccguguugugaugugaugcuggccacguuuccaaacggcagcuccac

SEQ ID NO: 50640 - RNA, 64 nt, Human
cugaggucucauacaaggauauuuggagugaaaugcuggccaguacuuguucucccuugcccca

SEQ ID NO: 50641 - RNA, 64 nt, Human
cuuuucuuucaauccucauuaucuuuagcccucagcuggccaguacuuauugcuaaagaaaggg

SEQ ID NO: 50642 - RNA, 52 nt, Human
aauggauggacagcaaguaggcgcuggccacccggcccugccuucccaccac

SEQ ID NO: 50643 - RNA, 64 nt, Human
uauaugaaggcagaaucagacuaucaggaaaggagcuggccagggccacagccagucaagaucu

SEQ ID NO: 50644 - RNA, 64 nt, Human
uccacagagagucccacugccucagguuccuauggcuggccacugcacagagcucuccagcucc

SEQ ID NO: 50645 - RNA, 64 nt, Human
gacccugagagacccugagaccuggggcacccuggcuggccaggucagaagcauccugacugca

SEQ ID NO: 50646 - RNA, 64 nt, Human
uuuuguauuuucaguagagacaggguuucacaaugcuggccaggcuguucucgaacuccugagc

SEQ ID NO: 50647 - RNA, 64 nt, Human
ucuuguucccacaccccaacacuuccagcauuuagcuggccacauggcggagaguuuuaauuuu

SEQ ID NO: 50648 - RNA, 64 nt, Human
ccucccucugcggggaggacccgggaccacagcugcuggccaggguagacuuggagcuguccuc

SEQ ID NO: 50649 - RNA, 64 nt, Human
ucugcaaggacaccuuugcagggauucuuguccugcuggccaccccacccacaccugucccugg

SEQ ID NO: 50650 - RNA, 64 nt, Human
caaaggugcuccccacuucccagauggugcggcggcuggccagaggcacucuucacuucccaga

SEQ ID NO: 50651 - RNA, 64 nt, Human
cugggggccggcacugcugcuuagaguggaggaggcuggccaaagagacugugggcuguuuuca

SEQ ID NO: 50652 - RNA, 64 nt, Human
ccuugcagaacuguccugagaaguuauugcuggugcuggccagccauggcuuaggacuccaaca

SEQ ID NO: 50653 - RNA, 64 nt, Human
uaaaguuccgaaucccccaugugucucuuucagagcuggccagaccggaaauaaaucauucuca

SEQ ID NO: 50654 - RNA, 64 nt, Human
gaagagaaacagcuccuccccgacuagguggaaggcuggccaggcaccaagcaugugugugcac

SEQ ID NO: 50655 - RNA, 64 nt, Human
gggguggccuccccgcacucggcagcauggccaggcuggccagggcgugggcaggugguguccu

SEQ ID NO: 50656 - RNA, 64 nt, Human
gcuuggauccccggcugccccgggcaugaguguggcuggccaugggcacugggcucgccuugca

SEQ ID NO: 50657 - RNA, 64 nt, Human
uaaacaauuuauuuguggcuuauuuuacccaugagcuggccaauacuuccuggccuagaaaaau

SEQ ID NO: 50658 - RNA, 64 nt, Human
auucuggccagagguuaaagagcaggcugacauggcuggccauuaagcuuuauaaaaucaugug

SEQ ID NO: 50659 - RNA, 64 nt, Human
cgggcagaucaugaggucaggaguuugagaccaggcuggccaacguggugaaaccccgucucua

SEQ ID NO: 50660 - RNA, 64 nt, Human
gcucauacacagaaucaggaccagcaugugcagagcuggccaccagcacaggcuuagggcaguu

SEQ ID NO: 50661 - RNA, 64 nt, Human
auuuguuuauuuuguaaaaaagaaaugaaaaucugcuggccagcuauguccucuaggaaaugac

SEQ ID NO: 50662 - RNA, 64 nt, Human
ggagccaguccaggagugagaccggccagaugaggcuggccaagccggggagcugcucucucau

SEQ ID NO: 50663 - RNA, 64 nt, Human
cuuggggagggcacucucccaugcccuuggccucgcuggccacauuggccaaugagccagggcu

SEQ ID NO: 50664 - RNA, 64 nt, Human
uuuuguauuuucaguagagacgggguuucuccaugcuggccaggcuggucucgaacuccugacc

SEQ ID NO: 50665 - RNA, 64 nt, Human
aacuuggaauuaaauauuguaagauauguauaaugcuggccauuuuaaagggguuuucucaaaa

SEQ ID NO: 50666 - RNA, 64 nt, Human
ggcagggccccugugggcacuagguguaaaaggugcuggccaaaugguucagggugaagagggc

SEQ ID NO: 50667 - RNA, 64 nt, Human
gggcaugugcccagcaauguggcuccuuggccccgcuggccaguguccugggccccugacaggc

SEQ ID NO: 50668 - RNA, 64 nt, Human
gaggguggucacaccccugagccuucagcacugugcuggccaccccggccucugaguaagacuc

SEQ ID NO: 50669 - RNA, 64 nt, Human
aauggcuccuccagagggccccucagagccaggugcuggccagaugccuugaucacagccucca

SEQ ID NO: 50670 - RNA, 64 nt, Human
agaacaguuccccacccagcgauuagggagcugggcuggccaguacagccaguggggagugggu

SEQ ID NO: 50671 - RNA, 64 nt, Human
acagagggaccaaauugcuucuaggagucaacuggcuggccagucugggucuggguuuggaucu

SEQ ID NO: 50672 - RNA, 64 nt, Human
cuggucuagcugaguucuagaacuucucucuuuagcuggccaucugaauacucccccaucacua

SEQ ID NO: 50673 - RNA, 64 nt, Human
uucugggcuagaaggcaggggaccuuggcauguggcuggccacaccaagcaggaagcacaaacu

SEQ ID NO: 50674 - RNA, 64 nt, Human
guuccgaggcuuucccaggggcagucugugucacgcuggccauuugacauaaaggagacagccc

SEQ ID NO: 50675 - RNA, 64 nt, Human
caccccacucccuccaccaccacagcacaccggugcuggccacaccagcccccuuucaccucca

SEQ ID NO: 50676 - RNA, 64 nt, Human
gagugcuuccucacaguuaccaagaauaaagaaagcuggccaccauuguucauugugguuuguu

SEQ ID NO: 50677 - RNA, 64 nt, Human
acugcccccucccucggguuggguggcccagccagcuggccagccuccacucccacucugccag

SEQ ID NO: 50678 - RNA, 64 nt, Human
ucuacugcccuccccuuccccuuuacucagcccagcuggccaccuagaagucucccugcacagc

SEQ ID NO: 50679 - RNA, 64 nt, Human
uacuaaauuugggacucuuugcugcgggaguuuggcuggccaggaacuugagugacauugaccu

SEQ ID NO: 50680 - RNA, 64 nt, Human
gccugcugcuggcuuuucagucagaggguugggggcuggccagccaagcugccuugcccuggcc

SEQ ID NO: 50681 - RNA, 64 nt, Human
ugacauccccgccacagacacggaggccccgccugcuggccagcuguggccgccauaggggagc

SEQ ID NO: 50682 - RNA, 64 nt, Human
aacacaccugcgcagcccuggcugaggucacuaggcuggccagaggcaggacaggcagucuuga

SEQ ID NO: 50683 - RNA, 64 nt, Human
gcccccacagcugagggccuggccuugggguacugcuggccagggguaggauaguauaggaagu

SEQ ID NO: 50684 - RNA, 64 nt, Human
agagcugguuccucccugggagggcaacuucagggcuggccaccccccguguuccccauccuca

SEQ ID NO: 50685 - RNA, 64 nt, Human
gggcaucucuccccugcuccagcgcaucucccgggcuggccaccuccuugaccagcauaucugu

SEQ ID NO: 50686 - RNA, 64 nt, Human
gagcaaccaggaccacccccacguucagaaaucagcuggccaagugacuccauuugacuugcaa

SEQ ID NO: 50687 - RNA, 64 nt, Human
aacauugucuuuaaugaccacaagacaaccaacagcuggccacguacuuaaaauuuugucccca

SEQ ID NO: 50688 - RNA, 64 nt, Human
cucaggcuuccugaccuaccgccaguggccccuugcuggccacccuauaggguccuccuucccu

SEQ ID NO: 50689 - RNA, 64 nt, Human
gccucugcagcaagcagggcuucaggaggugcccgcuggccacagccagguuuucccuaagaag

SEQ ID NO: 50690 - RNA, 64 nt, Human
gggacagugccacacuccuucaauaaacguggcugcuggccagaggacgugagcgugugacggg

SEQ ID NO: 50691 - RNA, 64 nt, Human
caggcacggcuggggccgcucugugcuggcgccugcuggccacugagggacagggacacgugcc

SEQ ID NO: 50692 - RNA, 64 nt, Human
auauggauuuccuuaauucaaagaucauauuuuagcuggccacaaaaccaagaacauaucuagc

SEQ ID NO: 50693 - RNA, 64 nt, Human
aggggugaaauccauacuguagacacucugacaagcuggccaaagucacuuccccaagaucugc

SEQ ID NO: 50694 - RNA, 64 nt, Human
guuuaccugcugcugcccauuuucucuggguacugcuggccagaggacuuuagccuaccccuga

SEQ ID NO: 50695 - RNA, 64 nt, Human
caggguguggugguggaguggggagcuggcuucugcuggccaggauagcuuaacccugacuuug

SEQ ID NO: 50696 - RNA, 64 nt, Human
uaaacauucuccgccuccagggugcagauucagagcuggccagaguuucagugauagccguaug

SEQ ID NO: 50697 - RNA, 64 nt, Human
aauaggaugccucucacucacaugccaguuccuggcuggccagcugcucagggcucaggcuggg

SEQ ID NO: 50698 - RNA, 64 nt, Human
gggagcccgcgggagccugugaauguugauacgagcuggccaguccugggcccagcucacuugu

SEQ ID NO: 50699 - RNA, 64 nt, Human
caagacaacaccugccuggcuucuauuaaugugugcuggccaugauauugccccaaauccgccc

SEQ ID NO: 50700 - RNA, 53 nt, Human
uggccgaggaggacuacugaggggcuggccagucagggagggcuagggggcag

SEQ ID NO: 50701 - RNA, 64 nt, Human
gucugcugccugucucuagagccuucaucgucuggcuggccaacggggacacccuccgugucuu

SEQ ID NO: 50702 - RNA, 64 nt, Human
uuuuguauuuuuaguagauacgggguuucaccaugcuggccagacugaggucucgaacugccga

SEQ ID NO: 50703 - RNA, 64 nt, Human
uccccacaagcagagcccugagggguggggaccagcuggccacauggugcugcuuuucagguua

SEQ ID NO: 50704 - RNA, 64 nt, Human
cuucccucgggcccagaugcagacggugccgaacgcuggccacuggauccacgcugaccgccca

SEQ ID NO: 50705 - RNA, 64 nt, Human
uggagccaacaugacuguccuuuaaacuccaguggcuggccaggcacgguagcucacgccugua

SEQ ID NO: 50706 - RNA, 64 nt, Human
cuguucuuuucccgccucccuaguuagcauccaggcuggccagugcugcccaugagcaagccua

SEQ ID NO: 50707 - RNA, 64 nt, Human
cccaucggcaguguuucuugagcucccaguaggggcuggccacggccaggugugggagggacuu

SEQ ID NO: 50708 - RNA, 64 nt, Human
ugacuaagccaagcuguguucauccagcuacuuagcuggccaaggagaggaguucuuuggcucu

SEQ ID NO: 50709 - RNA, 64 nt, Human
uccaagaauaggagugaugggugaagggaccuaagcuggccaauagcccucugccccagacaug

SEQ ID NO: 50710 - RNA, 64 nt, Human
gcccaugacucuagcugggcaccuuggaccuccagcuggccaauagaagagacaggagacagga

SEQ ID NO: 50711 - RNA, 64 nt, Human
cccuucugaacacucaggagaacguggcccucucgcuggccaacaucagcggccggcugucggg

SEQ ID NO: 50712 - RNA, 64 nt, Human
acauauauacacaugcacauacacagauuuuucugcuggccaggugggccaacuggguuucccu

SEQ ID NO: 50713 - RNA, 64 nt, Human
gaggaaggucucacaucugucucugggcacccaugcuggccagcaguuucccagggcucccugg

SEQ ID NO: 50714 - RNA, 64 nt, Human
auggcucagguuaauucucaaaacacaaauuguugcuggccaggcauggugacucaugccugua

SEQ ID NO: 50715 - RNA, 64 nt, Human
ccgucuaagguggggcgggcgacgcgguagacgggcuggccacgcggcucguucccccgcuccu

SEQ ID NO: 50716 - RNA, 64 nt, Human
uguauuaauugucauuuuaacugaaagaauuaccgcuggccauuguagugcugagagcaagagc

SEQ ID NO: 50717 - RNA, 64 nt, Human
guccaccugagaggccccuggggccuccccagcugcuggccagacccuggcgcugccacagucc

SEQ ID NO: 50718 - RNA, 64 nt, Human
uuuucugugaaaugugcugcuccccuuugugcaggcuggccagccaagaguucccuuccagcuc

SEQ ID NO: 50719 - RNA, 64 nt, Human
cauggugggauaagacaacaggcugacaaaccaagcuggccauuugguaccgugagaaaggaaa

SEQ ID NO: 50720 - RNA, 64 nt, Human
gcuggcagagggcaucggucagcggggcagcggggcuggccaugaggguccaccuucagcccuu

SEQ ID NO: 50721 - RNA, 64 nt, Human
aagauguuaaauggaauucguguuaugaaucugugcuggccauggacgaauaugaaugucacau

SEQ ID NO: 50722 - RNA, 64 nt, Human
ugcccauggucaggagcuauucggguggcaccucgcuggccaggcucucccgagucguggcacc

SEQ ID NO: 50723 - RNA, 64 nt, Human
ccuacucugcaaaccuugguaaaggaaccagucagcuggccagauuuccucacuaccugccaug

SEQ ID NO: 50724 - RNA, 64 nt, Human
ucagggccagugacuugcugggcuucguguucaugcuggccaugcaugucaucuaugcaagcgu

SEQ ID NO: 50725 - RNA, 64 nt, Human
gagccagcugacgcccucccugccucccagggcagcuggccagccucgggcagcgcggcccccu

SEQ ID NO: 50726 - RNA, 64 nt, Human
aauaaguaccuuuguguccuuguucauuuauaucgcuggccagcauuauaagcagguguauacu

SEQ ID NO: 50727 - RNA, 64 nt, Human
uccuguucuacccuugauggauuuucaaggucaugcuggccaauuaaggcaucaucaguccuac

SEQ ID NO: 50728 - RNA, 64 nt, Human
gagugagccaaugcucaccagccccagagucagagcuggccacaggcuggcagccuccaggggc

SEQ ID NO: 50729 - RNA, 64 nt, Human
aggcuaagccauguggcagggaccgucuugcccugcuggccacacucuggagaagcacuucuca

SEQ ID NO: 50730 - RNA, 64 nt, Human
cagaugcugaaggcagagcagcugagggaggggcgcuggccacaugucacugauggucagauuc

SEQ ID NO: 50731 - RNA, 64 nt, Human
acgggaggaaagggaggcagcgccggacggcgcagcuggccaagaggcgggcggggccagaaau

SEQ ID NO: 50732 - RNA, 64 nt, Human
cagggcuggagcagguguacccugagcaggggcagcuggccacucccaguucucaccaagucac

SEQ ID NO: 50733 - RNA, 64 nt, Human
agaaacgagggcugcuccaggagaagggccuccugcuggccagagcaaggaaggcugagcagcu

SEQ ID NO: 50734 - RNA, 64 nt, Human
uugguucacauuagguuugaacgaccaagugcaugcuggccacugggaguggaucgguggugaa

SEQ ID NO: 50735 - RNA, 64 nt, Human
gaaccucacccagcacccugccccgcuucccagggcuggccaagagagaagacuggacggcagg

SEQ ID NO: 50736 - RNA, 64 nt, Human
gccacacaacacgcagagaggacucaagacucccgcuggccauggaguggccugaaagagagca

SEQ ID NO: 50737 - RNA, 64 nt, Human
cccagagaagagcagcccugagccccuguauucugcuggccagacacacauggcacagacacag

SEQ ID NO: 50738 - RNA, 64 nt, Human
uucccaggaggcagcucccuccuggcacaugggggcuggccacaauagcccagagggucagaac

SEQ ID NO: 50739 - RNA, 64 nt, Human
uggugugucgugagugcuggauguccaagucccugcuggccacggagggcuccugccucucuuc

SEQ ID NO: 50740 - RNA, 64 nt, Human
caugauccaagcaagacugaggggucgacuucgggcuggccaucugguuaggauggcaggacgu

SEQ ID NO: 50741 - RNA, 64 nt, Human
cucguggccauugccaggagcccacccuggucacgcuggccacagcacaaagaacaacuccuca

SEQ ID NO: 50742 - RNA, 64 nt, Human
gugcagaugaggugaagaucacugucaucuaaaagcuggccacuaaauuaaaaaaaaauuaaaa

SEQ ID NO: 50743 - RNA, 64 nt, Human
cgcauggcaggagucccggccucggagccaugaggcuggccagcccucagcggggccgggcggg

SEQ ID NO: 50744 - RNA, 64 nt, Human
gcuggcagguggcaggaauggagaagcugacccugcuggccaggcaaggggccagacccccccc

SEQ ID NO: 50745 - RNA, 64 nt, Human
gugacagccaccuccagggcaccgucaggguggugcuggccacagaggcugcaugaccuccccu

SEQ ID NO: 50746 - RNA, 64 nt, Human
gagcacuguacuacugacccaacaacugugacuagcuggccacgccauucagggcugguguggc

SEQ ID NO: 50747 - RNA, 64 nt, Human
uauguacagguaauaaacauccccaagguuuguggcuggccauacacauaggcaucaguuuaac

SEQ ID NO: 50748 - RNA, 64 nt, Human
uacccuucucccaacuuuuugaugucccuguagggcuggccagucaggcccagccaaagccccc

SEQ ID NO: 50749 - RNA, 64 nt, Human
uuuuuguauuuuaguggagacgggguuucaccaugcuggccagacuggucucgaacuccugacc

SEQ ID NO: 50750 - RNA, 64 nt, Human
cccugcgcuaccagcugcagcggggagugguggugcuggccaagagcuucucucaggagagaau

SEQ ID NO: 50751 - RNA, 64 nt, Human
gagaaagggagcggcagcuagagguagccagggagcuggccaggcuccccggggccuuccuauu

SEQ ID NO: 50752 - RNA, 64 nt, Human
cuccauacagaaaacggugccaucccugaacacggcuggccacuggguauacugcugacaaccg

SEQ ID NO: 50753 - RNA, 64 nt, Human
caagugagauguucuggaaaccaggcucgccggagcuggccaagccaccgacuugcuucucaaa

SEQ ID NO: 50754 - RNA, 64 nt, Human
ucaggcuggguugggggagccccacagcuuucuggcuggccaguggcaaucuacuggccuuguc

SEQ ID NO: 50755 - RNA, 64 nt, Human
gcuugaugccagcugccauaggaagagggugcuggcuggccaugguggcacacaccuguccucc

SEQ ID NO: 50756 - RNA, 64 nt, Human
aggcucaccuggggauuugggggugggguggucagcuggccaagggaguaaaaaugaagaaaua

SEQ ID NO: 50757 - RNA, 64 nt, Human
gggcccuaugcgcacucaggggugaagggcguccgcuggccacucugcaggggccccugcagga

SEQ ID NO: 50758 - RNA, 64 nt, Human
uccauccacaccccagggugagcuggagcuccaggcuggccaggcugaaccucgcacacacgca

SEQ ID NO: 50759 - RNA, 64 nt, Human
agagcuucuauuccuuggccauugucaacggagagcuggccaagucuucacaaacccuugcaac

SEQ ID NO: 50760 - RNA, 64 nt, Human
ggggagacaaaagauguacagaaaugauuuccuggcuggccaacugguggccagugggagguga

SEQ ID NO: 50761 - RNA, 64 nt, Human
ggagucagggucccaagaucccaccuguauggucgcuggccagugauucuccuucugagccgug

SEQ ID NO: 50762 - RNA, 64 nt, Human
cccugacugggggcaggggaagagacagggcacagcuggccacagggcucagccacugagcagg

SEQ ID NO: 50763 - RNA, 64 nt, Human
uuuugggcccggggccaugcccgggcugugcaaagcuggccagggccuccuguagggcuccucu

SEQ ID NO: 50764 - RNA, 64 nt, Human
ggcgagcuccgggcucagaccaacuccaaggucagcuggccacaggcccaggccuccucugaag

SEQ ID NO: 50765 - RNA, 64 nt, Human
ccccauccuggcccaucaguguacccccgcccaggcuggccagccccacagcccacguccuguc

SEQ ID NO: 50766 - RNA, 64 nt, Human
ucuuauuucucauugagccucaggcuauacuccagcuggccaaggcuggaaaccugucucccuc

SEQ ID NO: 50767 - RNA, 64 nt, Human
gggaagacuuaugccaucccggcagcgaggcugggcuggccagccaccacugacuauaccaacu

SEQ ID NO: 50768 - RNA, 64 nt, Human
ccuaccaacgucgguaacuugagcagucccuguugcuggccagagacugccuggucgccagcgc

SEQ ID NO: 50769 - RNA, 64 nt, Human
aauguuaauauuaauguucauguuaauguccuaagcuggccauuaacaugaacuacgucacuuu

SEQ ID NO: 50770 - RNA, 64 nt, Human
gcccacagagugcccccacguggaacauucuggagcuggccaucccaaauucaaucaguccaua

SEQ ID NO: 50771 - RNA, 64 nt, Human
uggaccccugcccccacuaucuggaguuuuccaugcuggccaagaucuggacacgagcaguccc

SEQ ID NO: 50772 - RNA, 64 nt, Human
cuuggccugccacguguggggccaccucuccucagcuggccacccugcacguugugcacugacc

SEQ ID NO: 50773 - RNA, 64 nt, Human
aagcaauauugcagauugagcaggcccuccagcugcuggccacagaggcuccuguucuucugcc

SEQ ID NO: 50774 - RNA, 64 nt, Human
ccuggccggccagccagccacucuaccagugcaggcuggccagccgcucuccugccacauuaga

SEQ ID NO: 50775 - RNA, 64 nt, Human
uuuuguauuuuuaguagagacgggguuucaccaugcuggccaggcuggucucaaacaccugacc

SEQ ID NO: 50776 - RNA, 64 nt, Human
ugggcagguccucacucaggagugggggguguaggcuggccagcccccagggcuuguccaccag

SEQ ID NO: 50777 - RNA, 64 nt, Human
gcugugauucgacucuggaugcugugagcuugaugcuggccagggaagcagaggaugugagagg

SEQ ID NO: 50778 - RNA, 64 nt, Human
ccgcagcccccgccgggccccgccaggccuccccgcuggccauagcauuaagcccucgcccggc

SEQ ID NO: 50779 - RNA, 64 nt, Human
guccuccaccaaccacgggcuccaggaccccuuugcuggccauccccaggcaucucugguguca

SEQ ID NO: 50780 - RNA, 64 nt, Human
uacagcuguuggggcagaagagacgggaccagcugcuggccacauuuccugcuuuauuuuaaaa

SEQ ID NO: 50781 - RNA, 64 nt, Human
accucagggcaagggaacauggggguagaguggugcuggccagaaccaucugcuugagcuacuu

SEQ ID NO: 50782 - RNA, 64 nt, Human
acggcccugcaauguaucccuucucacagcacaugcuggccagccuggggccuggcagggaggu

SEQ ID NO: 50783 - RNA, 64 nt, Human
acccuggcagagaagagaccaagcuuguuucccugcuggccaaagucaguaggagaggaugcac

SEQ ID NO: 50784 - RNA, 64 nt, Human
cccugcucagaguuuuuaagcccucucaaccagggcuggccacccuggucuugaggguuccugg

SEQ ID NO: 50785 - RNA, 64 nt, Human
uggcugaccccucucccaccccucccugcaggcggcuggccaggugggcaggugccagccggag

SEQ ID NO: 50786 - RNA, 64 nt, Human
uaaaccucuuacugagaugcuuccugauagccaggcuggccagagaggggugcagggguuagau

SEQ ID NO: 50787 - RNA, 64 nt, Human
ccucagaucugucauguaucccuaaaaggagggagcuggccacuggcuguugggaaagccauga

SEQ ID NO: 50788 - RNA, 64 nt, Human
gguguggcagccacauccaagacuggagcagcaggcuggccacgcucgggccagagagagcuca

SEQ ID NO: 50789 - RNA, 64 nt, Human
uucuuccauuggggcggagucggggauggagggagcuggccacaacccacugcucugaugggug

SEQ ID NO: 50790 - RNA, 64 nt, Human
cuggauuauucugggggcugcaguucgacucugugcuggccagcgagcgcccagcuccugacac

SEQ ID NO: 50791 - RNA, 64 nt, Human
aggggaaccugaggcuuguucuugaagugggcaagcuggccaaaauauuggaacacacagaacc

SEQ ID NO: 50792 - RNA, 64 nt, Human
cugccaacucaaacauagccuccuuccccacccagcuggccacccuggccucagcucccucagg

SEQ ID NO: 50793 - RNA, 64 nt, Human
cgccaggcaaagcgccagcagcccugcacuccacgcuggccaagaaggccuuccacgcagaaug

SEQ ID NO: 50794 - RNA, 64 nt, Human
agaugcgagcuggguugcuucccugagggcccccgcuggccaaggccuguggacgacgcuggcg

SEQ ID NO: 50795 - RNA, 64 nt, Human
aaagccagggugugccgggccaagauacucacaggcuggccacagcugggcaaggcucuccgug

SEQ ID NO: 50796 - RNA, 64 nt, Human
cuaucccagggauccucaggccuccccuuccuuagcuggccaggagugcccuaaggguaagagg

SEQ ID NO: 50797 - RNA, 64 nt, Human
gucauggacagccccugcucaagaaaaagcaugagcuggccacacauguaauccauaaccacca

SEQ ID NO: 50798 - RNA, 64 nt, Human
guaagguccuggcaggcagacccggcauguagccgcuggccaucuugaauccuagggcaugaag

SEQ ID NO: 50799 - RNA, 64 nt, Human
guacuuccuggucucugggaugacuucagauucugcuggccaaggcaaauugaacucaguucaa

SEQ ID NO: 50800 - RNA, 64 nt, Human
ccagagcccugugaaaugcaucaagguccucuccgcuggccagcagcauccccaggcuucucuc

SEQ ID NO: 50801 - RNA, 64 nt, Human
uaaguaauaacaugaaaugaaacccagcauaggagcuggccaagagcuuuuaauuuuauugaua

SEQ ID NO: 50802 - RNA, 64 nt, Human
gggcccccuuccuccccccgugucaacuuucagugcuggccaaaaccuggccgucucuucuauu

SEQ ID NO: 50803 - RNA, 64 nt, Human
gaaccacacgaaaccucaacugggggagugaggggcuggccaggucuggaggggccucaggggu

SEQ ID NO: 50804 - RNA, 64 nt, Human
gaugcuggggcuucagcccgccgcagacuucacagcuggccacaacgagccuguagccaacggc

SEQ ID NO: 50805 - RNA, 64 nt, Human
uguuuucuuuuuaguagagacgggguuuuaccaugcuggccaggcuggccucaaacuccugacc

SEQ ID NO: 50806 - RNA, 64 nt, Human
uccaggcgccccucacccccacaccugcugcauggcuggccacaccacucagugcauggcggcc

SEQ ID NO: 50807 - RNA, 64 nt, Human
ugacauuagguccuuuguuguuuuuaaagaggcugcuggccacaggcaaaaaaaaugaccuagc

SEQ ID NO: 50808 - RNA, 64 nt, Human
uuucgugggcugagaaaggggcaggcaaaaugaagcuggccacugaaaacuguaagauggucaa

SEQ ID NO: 50809 - RNA, 64 nt, Human
gaaugagccguauacaaggaauaugacauacagugcuggccacaaccuucugaaggcccaugcc

SEQ ID NO: 50810 - RNA, 64 nt, Human
gcuggcuagaauccccuuugacuucuagccauaagcuggccacauuggacaucuuggucacugc

SEQ ID NO: 50811 - RNA, 64 nt, Human
cagacagcugccuggccggggccacuaggcugcggcuggccacugugucuccucacuucucuga

SEQ ID NO: 50812 - RNA, 64 nt, Human
ugagaacugcaaugaacaaucugacaaaugugaagcuggccaaaagucggaaaaugagaaugag

SEQ ID NO: 50813 - RNA, 64 nt, Human
gccuagggugcucaugccuuaccuaagagaagaggcuggccaagccacaguucugacgcugaca

SEQ ID NO: 50814 - RNA, 64 nt, Human
guuaauggaagaauugagacaaaaauccaguguagcuggccacuuauccagggcuuuuucuacu

SEQ ID NO: 50815 - RNA, 64 nt, Human
gaaugaggggcuucacgagaggccacagggccuggcuggccacgcugucccggccugcucacca

SEQ ID NO: 50816 - RNA, 58 nt, Human
augggccaccccccacauagagggcauagcuggccacagugcuacaccaccugccuga

SEQ ID NO: 50817 - RNA, 64 nt, Human
gagagaggaagcucugcucaggccuccagcguuggcuggccauggccacagccagauggaggag

SEQ ID NO: 50818 - RNA, 64 nt, Human
cagcagcuguggaaauaaagcuugugagcccucugcuggccacagugaggaaaguagcacaaau

SEQ ID NO: 50819 - RNA, 64 nt, Human
uucacugcuaauaauucuguaaggacacaucaaagcuggccaaaauaaugaauuuuuuuuaaaa

SEQ ID NO: 50820 - RNA, 64 nt, Human
gccaggaagcugaggccgggcuugagaggagagcgcuggccaugccaggagagaacccacgcac

SEQ ID NO: 50821 - RNA, 64 nt, Human
ccgcauucgcacugggggacaugggaggggucuagcuggccacugcuggaggcagcgcuggucg

SEQ ID NO: 50822 - RNA, 64 nt, Human
uuaugccuuuggccuggagauggcagaagugaaagcuggccaucugcaaaaagcagauaaguga

SEQ ID NO: 50823 - RNA, 64 nt, Human
ccaucugaacuagacaauggaaauaaugcugcaugcuggccauggcccauucuucaucauuugu

SEQ ID NO: 50824 - RNA, 64 nt, Human
uagcuccuauguaucagguuaagagcaagggagagcuggccagggacagcaguuugcacagcag

SEQ ID NO: 50825 - RNA, 64 nt, Human
cuauccaacauucaacaacgggucugaaugucuagcuggccauuggcuugugcuguguuaagaa

SEQ ID NO: 50826 - RNA, 64 nt, Human
cccugacuauuccgcugcugcaggaacccagcuagcuggccagguggggaggggcuggggaccg

SEQ ID NO: 50827 - RNA, 64 nt, Human
aacgcaguggugugagucugcaggcccuggacccgcuggccagagggacaccuugguggcacug

SEQ ID NO: 50828 - RNA, 64 nt, Human
ccugguggcaccagaugcaaccucacuaugguaugcuggccagcacccucuccuggggguggca

SEQ ID NO: 50829 - RNA, 64 nt, Human
cguggcccaaggcuggcaggucaaccucgcgcuugcuggccaguccacccugccugccgucugu

SEQ ID NO: 50830 - RNA, 64 nt, Human
gccagccagucugguggagcucagcgucuggcuggcuggccagccugugggucuguugggagca

SEQ ID NO: 50831 - RNA, 64 nt, Human
aggggugauucagagguggggaugggcagagagggcuggccacucugccucaggacuugaccuc

SEQ ID NO: 50832 - RNA, 64 nt, Human
ucuugaaaugcuuaucaggauaaugguagcuauagcuggccauuuagaggaauucuaggacagu

SEQ ID NO: 50833 - RNA, 64 nt, Human
uacucaagugucuaccuggagccccuggggcggugcuggccaaugcuggaaacauucacuuucc

SEQ ID NO: 50834 - RNA, 64 nt, Human
uccuaguuaaccagagccuuggaaucuacugccugcuggccaggcuuuaaaaugaaaaguguuu

SEQ ID NO: 50835 - RNA, 64 nt, Human
uuccuuugacgcaggcuucucagaaccugguggugcuggccagggaggaugcuggagcggagaa

SEQ ID NO: 50836 - RNA, 64 nt, Human
caccgcccccaccaccacccccagcuccugaggugcuggccagugcacccccacucccacccuc

SEQ ID NO: 50837 - RNA, 64 nt, Human
acagcugcauggcacauaccaaagcugcugcacagcuggccaccauggcacccugcaccaggcc

SEQ ID NO: 50838 - RNA, 64 nt, Human
uacccugaaguuaugcuuuccuucugugcucugugcuggccagaggugccucuugaaucagauu

SEQ ID NO: 50839 - RNA, 64 nt, Human
uuaguaaacaagcggaacauagauaauggacaaugcuggccacugccauucuguguucagaaag

SEQ ID NO: 50840 - RNA, 64 nt, Human
cauaauacaguugugaggaauguguuguaacuuggcuggccaaguuacauguuacaguaucuuu

SEQ ID NO: 50841 - RNA, 64 nt, Human
auucucccacuuguccuccuuggaaggagcucuugcuggccaguguuuggaggggaggaugagu

SEQ ID NO: 50842 - RNA, 64 nt, Human
uuuaguagagacgggguuucaccaugcaagcccagcuggccacguagguuuuaaagcaaggggc

SEQ ID NO: 50843 - RNA, 64 nt, Human
uccgggggcccagagcuucccagcccugagucaagcuggccaugaacgcguacacuucaguuca

SEQ ID NO: 50844 - RNA, 64 nt, Human
uguuggcccucgccauggagcagaggcggggacagcuggccaccgugucccaggaccguaccgu

SEQ ID NO: 50845 - RNA, 64 nt, Human
agcacagaucuuggggagcugccccacaagccccgcuggccaccgagggcugcagccgcugcgc

SEQ ID NO: 50846 - RNA, 64 nt, Human
agccccucagcaggagagaggcccagaggcuccagcuggccaccgugccccacaagauggcccc

SEQ ID NO: 50847 - RNA, 64 nt, Human
uccccugaaccagcccuggaccuuucugagccaggcuggccacaugggguggucucgggguuuc

SEQ ID NO: 50848 - RNA, 64 nt, Human
cccgugggagggaggcagaccccugggcuuuccugcuggccacggagacucugcuccugcaugg

SEQ ID NO: 50849 - RNA, 64 nt, Human
aaggaccaagggggcguggacccgucuuguaccagcuggccacaggcacaagggcugcagcugc

SEQ ID NO: 50850 - RNA, 64 nt, Human
ccuucugcugagccacagcccauugcagcacugugcuggccagacuucagcugccuugggaacu

SEQ ID NO: 50851 - RNA, 64 nt, Human
cccguguuuggggcugaggccugcuggacagauggcuggccaagugggagcagacccuagggag

SEQ ID NO: 50852 - RNA, 64 nt, Human
ggccugagcgcaucguccuguguugccccaagcagcuggccaacauguguagagacaggaugcu

SEQ ID NO: 50853 - RNA, 64 nt, Human
caggccagcuaaugaggcugacuggauguccagagcuggccaggccacugggcccugagccaga

SEQ ID NO: 50854 - RNA, 64 nt, Human
cccucagaccuccucaucucaugagcuucuuggggcuggccaguggcccagggccagcuuggcg

SEQ ID NO: 50855 - RNA, 64 nt, Human
aacccgccgcugcacuguaggagccccuuucugggcuggccaaggccggagccagcucccucag

SEQ ID NO: 50856 - RNA, 57 nt, Human
gcagcaucgcugaaccuugacaguguggcuggccaugggccacagcugcggccacug

SEQ ID NO: 50857 - RNA, 64 nt, Human
auuugcuaaggcagcugauccaggcaaucguucugcuggccaagaaguuaaacuauuuugagca

SEQ ID NO: 50858 - RNA, 64 nt, Human
cauggugcaugagugaucucagccuagcgaugccgcuggccagaccgugaccaugcugccagug

SEQ ID NO: 50859 - RNA, 64 nt, Human
uuuuauauuuuugguagagaugggguuucaccaugcuggccaggcuggucucgaacuccugacc

SEQ ID NO: 50860 - RNA, 64 nt, Human
uucccuccccuucccagacuuuugccccggcucugcuggccaagucguggguccuccucugucc

SEQ ID NO: 50861 - RNA, 64 nt, Human
guugguugugguuuuucuaucagggaagucaauggcuggccaguguagugugaagucccagcuu

SEQ ID NO: 50862 - RNA, 64 nt, Human
ugcccccaaggaugaggcuggacugaggcaaagggcuggccacaccaccugagcaugugugagg

SEQ ID NO: 50863 - RNA, 64 nt, Human
caggcuuucucggccccucuccucagcuugcagagcuggccagcccccuccuuagggggugggc

SEQ ID NO: 50864 - RNA, 64 nt, Human
uagccacucuuaggaaagacuauugggaguauuugcuggccagagaaugggacucuaucagcuu

SEQ ID NO: 50865 - RNA, 64 nt, Human
ggaugaacugcuuugugacuuggaaagguacgcugcuggccagcauuggagaagaagcugcuga

SEQ ID NO: 50866 - RNA, 64 nt, Human
gugugguacuggcacccaaguucagcauggcagagcuggccaacagcuugugguccccgaucug

SEQ ID NO: 50867 - RNA, 64 nt, Human
ggggcuauuucugcagcaaguggaaccuucuggagcuggccaucauccuggccagcuggagcgc

SEQ ID NO: 50868 - RNA, 64 nt, Human
cccucaucuggaagaaucccauacugauggcagggcuggccagggggaagaggguaguaucugu

SEQ ID NO: 50869 - RNA, 64 nt, Human
uaaagcuggcgcccccagccccacucuuggcugugcuggccaggugacuccuaguucuuggcca

SEQ ID NO: 50870 - RNA, 64 nt, Human
auggcauaacaugaguguacuaacuaccuucuaugcuggccaugcuacagauuuucuggaggua

SEQ ID NO: 50871 - RNA, 64 nt, Human
uuguuggggaguggguggcaggugggggugggcugcuggccaugaaucucugccucucccaggc

SEQ ID NO: 50872 - RNA, 64 nt, Human
gggcccuuccuggcuaggacuguggaggggagcugcuggccauggcugcuuuguaguuugccca

SEQ ID NO: 50873 - RNA, 64 nt, Human
aucaucuaggcuccccagcccccacugugaaggggcuggccaggggcccgagcugcccccaccc

SEQ ID NO: 50874 - RNA, 64 nt, Human
acaacagcucauggucaugcaugagagagaaguggcuggccacagccagagggaacaguaacag

SEQ ID NO: 50875 - RNA, 64 nt, Human
gggauuaugccaaggccguggggcucuguaccacgcuggccaucugucuccuguauguggguca

SEQ ID NO: 50876 - RNA, 64 nt, Human
uggugacagaacaugcagcaaggggacaucuuaggcuggccagacuucagcuguuccuuugaag

SEQ ID NO: 50877 - RNA, 64 nt, Human
ccuuuuacuuuguuguucugauuuuaggacucuggcuggccaugugcuugugguugccucuccu

SEQ ID NO: 50878 - RNA, 64 nt, Human
caauaccgacgucuauccuuuccugcuaggcagugcuggccaggcucauguguagugugcgaga

SEQ ID NO: 50879 - RNA, 64 nt, Human
cggggcagaggcagaagcccacauaugcugugacgcuggccaccuuuucucagcuucugaggcu

SEQ ID NO: 50880 - RNA, 64 nt, Human
aagucuguaaacugauucugggagaaaccaagcugcuggccauaggguguccuuggguacaucc

SEQ ID NO: 50881 - RNA, 64 nt, Human
aaggagcccauggaacacaaguuaaagagguuuugcuggccagguaugguggcucacgccugua

SEQ ID NO: 50882 - RNA, 64 nt, Human
aaguucacuugggaggauggcaguaggagccagggcuggccauggguccccuacccuuccccgu

SEQ ID NO: 50883 - RNA, 64 nt, Human
gccaccuggcacuggugacuacagacguucucaggcuggccagaagagacaucuuggguuccuu

SEQ ID NO: 50884 - RNA, 64 nt, Human
ucagagacuaucuguucaaguagaaaacccaagagcuggccaggugugguggcucaugccugua

SEQ ID NO: 50885 - RNA, 64 nt, Human
accaaaggggcagcccuggcccucccuccccucugcuggccagagggucugcaucucagcccac

SEQ ID NO: 50886 - RNA, 64 nt, Human
ucuuuucagcuuuuggugccagcuacagaguugagcuggccauguuucacaguauaucaagcau

SEQ ID NO: 50887 - RNA, 64 nt, Human
uguauaggaggcccuuauuuuugucacagagcaagcuggccaugaacgaaggagagaagacgcc

SEQ ID NO: 50888 - RNA, 64 nt, Human
gguaagggggugcagcagugagggguauaucugggcuggccaguuggaaccacggagaucuccu

SEQ ID NO: 50889 - RNA, 64 nt, Human
uuuuguauuuucaguagagacagcguuuugccaugcuggccaggcucgucucgaacuccugacc

SEQ ID NO: 50890 - RNA, 64 nt, Human
gcccaccaccucccucuaggaugcccccucaggggcuggccaggcccugcucaacaucuggaga

SEQ ID NO: 50891 - RNA, 64 nt, Human
aauaacucugugagguuacugagauuugagcugugcuggccagcgcauugccucacagucacgc

SEQ ID NO: 50892 - RNA, 64 nt, Human
ugcucuccuuuuuuucugaauguugauugccuuagcuggccaccugguguucugcauguagccu

SEQ ID NO: 50893 - RNA, 64 nt, Human
ugccaaggugcgcccucgacucccgauuucauuugcuggccaggaaaaucgaaagggaaacacc

SEQ ID NO: 50894 - RNA, 64 nt, Human
ccugcagcuggagggcaacaggcugccgggccccgcuggccacgccgcucccaucaccgcaggc

SEQ ID NO: 50895 - RNA, 64 nt, Human
uacacuucggaguccaccaccgagaucaccugcagcuggccacaccacaggcccccgugccugc

SEQ ID NO: 50896 - RNA, 64 nt, Human
gggugggcacugcugggcugaguucacccccagggcuggccagauggggccaggagggacagag

SEQ ID NO: 50897 - RNA, 64 nt, Human
ggacagaucugggagccagcagcuggaugcuguggcuggccagagacaccuccaggcuguggcc

SEQ ID NO: 50898 - RNA, 64 nt, Human
ggcguggaccaaggggcauggagcuucacuccuugcuggccagggaguuggggacucagaggga

SEQ ID NO: 50899 - RNA, 64 nt, Human
ccaggcaggagcagucgccuuucccacccacagcgcuggccacagggcucccugcagggucagg

SEQ ID NO: 50900 - RNA, 64 nt, Human
cacaggaaggacgguguuugugucugagggagcugcuggccacagugaacacccacguuuauuc

SEQ ID NO: 50901 - RNA, 64 nt, Human
gaaaggcauucuguugacagaugaacagccgaaagcuggccagacccuccuguaugccucugcc

SEQ ID NO: 50902 - RNA, 64 nt, Human
gcacuuaauccuauuuauccccuggaaugugcgugcuggccaguaggagggcuggcuuuggcag

SEQ ID NO: 50903 - RNA, 64 nt, Human
ccuucacugagcaccaagcuuaugccaggucugugcuggccacucucauauaccucuucagauc

SEQ ID NO: 50904 - RNA, 64 nt, Human
uagguuugcagaggggguaggggcagagucaggggcuggccagagggucugcucccuggacaga

SEQ ID NO: 50905 - RNA, 64 nt, Human
cgguggacagagggugacaucauaggagcagcucgcuggccagaaggggaugggggcaucccug

SEQ ID NO: 50906 - RNA, 64 nt, Human
gguggaucaccugaggucaagaguuccagaccaggcuggccagcauggugaaaccccgucugua

SEQ ID NO: 50907 - RNA, 64 nt, Human
agccucgccccauccacuccggugccuccauuuagcuggccaaucagcccaggaggggcagguu

SEQ ID NO: 50908 - RNA, 53 nt, Human
ucugggacguccacgagugaggggcuggccacccagccccacagccuugccug

SEQ ID NO: 50909 - RNA, 64 nt, Human
augucaccuuguccaucuggaggugaugucaauggcuggccaugcaggaggggugggguagcug

SEQ ID NO: 50910 - RNA, 64 nt, Human
ggagagaaacuggacauggggccuggggaggggagcuggccagaggaggaccccuuucccgugg

SEQ ID NO: 50911 - RNA, 64 nt, Human
uuuuuuauuucuauuagcaaugggguuucaccaugcuggccaggcuuguuaugaacugaccuca

SEQ ID NO: 50912 - RNA, 64 nt, Human
uacugagcaacuuguuagaagagaugaaggcgacgcuggccaaguguugagagcugccugcgag

SEQ ID NO: 50913 - RNA, 64 nt, Human
cauggccccggagccccauccugggccugcccuggcuggccaggaccccagcgguucuuggucc

SEQ ID NO: 50914 - RNA, 64 nt, Human
gcgggccccagugaggcacuuugucccgcccagcgcuggccagccccgaggagccgcugccuuc

SEQ ID NO: 50915 - RNA, 64 nt, Human
cuucugaugccuuaaaagcugggccccaggcccugcuggccagagccacagaugccaagcucug

SEQ ID NO: 50916 - RNA, 64 nt, Human
agcucgcagggugagaaccacuggaguggcuggggcuggccagaggucaccguuucuccuuccu

SEQ ID NO: 50917 - RNA, 64 nt, Human
ccuuuugaacuguacaucucacauguugggaaacgcuggccacugggaaaucauuagaaaggag

SEQ ID NO: 50918 - RNA, 64 nt, Human
augaagcccaccccacauggcccacagcuccugugcuggccagacucccagaaaauucucuauu

SEQ ID NO: 50919 - RNA, 64 nt, Human
gcucugccucugaacuucaaaguggagguggagugcuggccacgucuccaccuaacaacccucu

SEQ ID NO: 50920 - RNA, 64 nt, Human
cuccugugccccugacugagcagaagcccccacagcuggccagcagccccgccugacauggaac

SEQ ID NO: 50921 - RNA, 64 nt, Human
gggggaucaccugaggucucgaguucgagaccaggcuggccaacacggugaaacgcugucucua

SEQ ID NO: 50922 - RNA, 64 nt, Human
cccucugcuugggaucaaauuaauguuugacagagcuggccaggcgugguggcucauguaugua

SEQ ID NO: 50923 - RNA, 64 nt, Human
caugagcugauucacauucugaaggaccucucuagcuggccagugcugaggagguuggagagag

SEQ ID NO: 50924 - RNA, 64 nt, Human
cccacuucugugccacccccggucuaugucgagagcuggccaaagagccuuuccaaagaggagc

SEQ ID NO: 50925 - RNA, 64 nt, Human
cuaguccccuuuccucuaacucacugccuaggaggcuggccaagguguccaggguccucuagcc

SEQ ID NO: 50926 - RNA, 64 nt, Human
uggccgccaugagcaaccuggugccccccguggagcuggccaaccccgagaaccaguucagagu

SEQ ID NO: 50927 - RNA, 64 nt, Human
uuuccacggacccagcucuguggagggcaugacugcuggccagaagcuagugguccuggggccc

SEQ ID NO: 50928 - RNA, 64 nt, Human
cccugaccucccucaccaguggaggcuggguagugcuggccaucccaaaagggcucuguccugg

SEQ ID NO: 50929 - RNA, 64 nt, Human
gcccuuaacuccuugcccuuugagaguguccauugcuggccauggucacuaaauuugaaguucc

SEQ ID NO: 50930 - RNA, 54 nt, Human
ggccagggcaagccaacuagacaggcuggccaggacccaaccccuagaucccac

SEQ ID NO: 50931 - RNA, 64 nt, Human
cauggagaagaaccugcagauucuuccauccucagcuggccauggcccacagcucugcaucugc

SEQ ID NO: 50932 - RNA, 64 nt, Human
agcauggcccgggccuuauccagucaaagcggaugcuggccacagaaaggccacucaggauguc

SEQ ID NO: 50933 - RNA, 64 nt, Human
cagugugagcauacgaggcugaugacugcccugugcuggccaaaagauuuuuauuuuaaaugaa

SEQ ID NO: 50934 - RNA, 64 nt, Human
acugugcaucaaccaggaagaguucuauccccaagcuggccacuaucacauaugcuuacucuug

SEQ ID NO: 50935 - RNA, 64 nt, Human
uggccguggggacaucagagagugucaucacgcagcuggccagcugaguucuguuguuguuuuc

SEQ ID NO: 50936 - RNA, 64 nt, Human
gaagcucucccucccuacucccugggagccacgugcuggccauguggccagggacggcaugagc

SEQ ID NO: 50937 - RNA, 64 nt, Human
guaaucacagauaauacauggccaguaaucccaggcuggccauucauucagguuuuuuaaagga

SEQ ID NO: 50938 - RNA, 64 nt, Human
cucugccaguuccuuuauugaaagaggugugcuggcuggccacgguggcuuacaccuguaaucc

SEQ ID NO: 50939 - RNA, 64 nt, Human
gcuuugagcagagagggaaagauuaauuuacacugcuggccaccgaaggcagguguuuccuggg

SEQ ID NO: 50940 - RNA, 64 nt, Human
gaaacuugcagcucugcuccucacaccaggcccggcuggccacccacccucgcccccacuggcc

SEQ ID NO: 50941 - RNA, 64 nt, Human
ugguuccaaacaacaccaccgagaucucccucaggcuggccagguuuugcagcuggaauucucc

SEQ ID NO: 50942 - RNA, 64 nt, Human
gaaugccacaguggauacgccagcaggccacauggcuggccaagcaauuauuauuauggauccc

SEQ ID NO: 50943 - RNA, 64 nt, Human
uguugcaggcggcuuggagaaagggcagugggacgcuggccacggccaggguggugucgggagc

SEQ ID NO: 50944 - RNA, 64 nt, Human
ugaaguguugacuuuguaaaucugcccacacccagcuggccauauccaccccucgacgccggga

SEQ ID NO: 50945 - RNA, 64 nt, Human
aaugcuugugacagaugccaggagguagaugugugcuggccaauaaaggccccuaccugauucc

SEQ ID NO: 50946 - RNA, 64 nt, Human
acuccuggcugucugagugggcacuugucuggcugcuggccagcagugaagggccacuugguga

SEQ ID NO: 50947 - RNA, 64 nt, Human
gucuaucaaauaccuaaggaguccccaggagcuggcuggccaucgugauaggaucugucugucc

SEQ ID NO: 50948 - RNA, 64 nt, Human
agagcccacacugccagucgaggccuggcuggaggcuggccacaguggaaauucugccgagccu

SEQ ID NO: 50949 - RNA, 64 nt, Human
ucccugcucugcugcauggggccccauggcuuuggcuggccacugaggguaggguguggaggug

SEQ ID NO: 50950 - RNA, 64 nt, Human
cccuaggcugucccugcagccaggguguccgggggcuggccagucagagaaagggggccaugga

SEQ ID NO: 50951 - RNA, 64 nt, Human
gccugggggcuggggaggggaggcccagaggagggcuggccaugugagcaccccaugaagggac

SEQ ID NO: 50952 - RNA, 64 nt, Human
gucuuggucccaggagaugggggccacucgugaggcuggccaugcuguggcuucucacagcugu

SEQ ID NO: 50953 - RNA, 64 nt, Human
uccacccaccccacgacccgugacuacugugcaagcuggccaggagguagguggagggcaaggc

SEQ ID NO: 50954 - RNA, 64 nt, Human
accggggagaaguggggccgugguucgagggagggcuggccaggggugggacccuuaugagacu

SEQ ID NO: 50955 - RNA, 64 nt, Human
ucccagggccccaggggcggggaaggcauggcuugcuggccaggauauucagagguaggcagcc

SEQ ID NO: 50956 - RNA, 64 nt, Human
accuuugcaggaccugaugagugacccuucuggagcuggccagguccucugcagcaggcaagac

SEQ ID NO: 50957 - RNA, 64 nt, Human
ccaggauccccacccaaagccugauggcaccccggcuggccaugcuguccccucccuguggcgu

SEQ ID NO: 50958 - RNA, 64 nt, Human
aggguguuggucccagaauugggaccggggccccgcuggccagcccugggccacuucccggguc

SEQ ID NO: 50959 - RNA, 64 nt, Human
acucccuuucaggcugggccacagggaguugcuggcuggccacuugacacccucccccuggagc

SEQ ID NO: 50960 - RNA, 64 nt, Human
ggcgcagcgccuggugcgcgugcugcagaucugugcuggccacgugcccggugucucagcucug

SEQ ID NO: 50961 - RNA, 64 nt, Human
cuuggcucuccucuggcuagagugggaagagggggcuggccauggggcccucccagaaccucag

SEQ ID NO: 50962 - RNA, 64 nt, Human
agaacugagaggggaccccagacugggcccagaggcuggccagaguucaggaacgccgggcaca

SEQ ID NO: 50963 - RNA, 64 nt, Human
uaacacagccgggcuugggggcagucaggaggaagcuggccauccguggaggaggggccggucc

SEQ ID NO: 50964 - RNA, 64 nt, Human
uguuggaugaugaggaauauuaccgcauggaguugcuggccaaagaauuccaggacaagacugc

SEQ ID NO: 50965 - RNA, 64 nt, Human
gaaauuaggagugcugauaagaaugaauauagaugcuggccagcauuuucauucauuuuaagga

SEQ ID NO: 50966 - RNA, 64 nt, Human
accacaucaugcgcaaugggcuggauuauaaugagcuggccaugcacuuugaccgccuugugcg

SEQ ID NO: 50967 - RNA, 64 nt, Human
gggccacugagcagugagaggaaggcagugcagagcuggccagcccuggagguaggcugggacc

SEQ ID NO: 50968 - RNA, 64 nt, Human
gguggccagcacuaguaaaggaggaauagugcuugcuggccacaaggaaaaggaggaggugucu

SEQ ID NO: 50969 - RNA, 64 nt, Human
gcgugauuguugaccccggguacaguuuaaagaagcuggccauaagaaaaauauauauugaugu

SEQ ID NO: 50970 - RNA, 64 nt, Human
uccguggaggaagcugggguacaaggggcccagugcuggccacacagcagcgcagccgagcccc

SEQ ID NO: 50971 - RNA, 64 nt, Human
gcugaauaauuaauugauuuacagccuuguugccgcuggccagaccaccagguggcccauuacu

SEQ ID NO: 50972 - RNA, 64 nt, Human
uauuaagaaaauagaugaaaaauuaggguacacagcuggccaccaaaugcgaagucaaucugcu

SEQ ID NO: 50973 - RNA, 64 nt, Human
cugaacucuucuggagccucagcucaggauagcugcuggccacuccuguccuguggauugugca

SEQ ID NO: 50974 - RNA, 64 nt, Human
ucacauucuuugggcuggcugcccuugcaaagcagcuggccaaggcuuauuaaaugugaaccca

SEQ ID NO: 50975 - RNA, 64 nt, Human
ucacccaguaaacccaaaaaagcaaauggauaaugcuggccauuuugccuuucugacauuuccu

SEQ ID NO: 50976 - RNA, 64 nt, Human
gggcauggcccgccacagccacucaggccuccgugcuggccagccccccaaguggugaugccca

SEQ ID NO: 50977 - RNA, 64 nt, Human
gcccgggggggcgguuucccaugggaugugaaaggcuggccauuauuaagucccuguaacucaa

SEQ ID NO: 50978 - RNA, 64 nt, Human; identical to SEQ ID NO: 50550

SEQ ID NO: 50979 - RNA, 64 nt, Human; identical to SEQ ID NO: 50551

SEQ ID NO: 50980 - RNA, 64 nt, Human; identical to SEQ ID NO: 50552

SEQ ID NO: 50981 - RNA, 62 nt, Human; identical to SEQ ID NO: 50553

SEQ ID NO: 50982 - RNA, 52 nt, Human; identical to SEQ ID NO: 50554

SEQ ID NO: 50983 - RNA, 55 nt, Human; identical to SEQ ID NO: 50555

SEQ ID NO: 50984 - RNA, 64 nt, Human; identical to SEQ ID NO: 50556

SEQ ID NO: 50985 - RNA, 64 nt, Human; identical to SEQ ID NO: 50557

SEQ ID NO: 50986 - RNA, 64 nt, Human; identical to SEQ ID NO: 50558

SEQ ID NO: 50987 - RNA, 64 nt, Human; identical to SEQ ID NO: 50559

SEQ ID NO: 50988 - RNA, 64 nt, Human; identical to SEQ ID NO: 50560

SEQ ID NO: 50989 - RNA, 64 nt, Human; identical to SEQ ID NO: 50561

SEQ ID NO: 50990 - RNA, 64 nt, Human; identical to SEQ ID NO: 50562

SEQ ID NO: 50991 - RNA, 64 nt, Human; identical to SEQ ID NO: 50563

SEQ ID NO: 50992 - RNA, 64 nt, Human; identical to SEQ ID NO: 50564

SEQ ID NO: 50993 - RNA, 64 nt, Human; identical to SEQ ID NO: 50565

SEQ ID NO: 50994 - RNA, 64 nt, Human; identical to SEQ ID NO: 50566

SEQ ID NO: 50995 - RNA, 64 nt, Human; identical to SEQ ID NO: 50567

SEQ ID NO: 50996 - RNA, 64 nt, Human; identical to SEQ ID NO: 50568

SEQ ID NO: 50997 - RNA, 64 nt, Human; identical to SEQ ID NO: 50569

SEQ ID NO: 50998 - RNA, 64 nt, Human; identical to SEQ ID NO: 50570

SEQ ID NO: 50999 - RNA, 64 nt, Human; identical to SEQ ID NO: 50571

SEQ ID NO: 51000 - RNA, 64 nt, Human; identical to SEQ ID NO: 50572

SEQ ID NO: 51001 - RNA, 64 nt, Human; identical to SEQ ID NO: 50573

SEQ ID NO: 51002 - RNA, 64 nt, Human; identical to SEQ ID NO: 50574

SEQ ID NO: 51003 - RNA, 64 nt, Human; identical to SEQ ID NO: 50575

SEQ ID NO: 51004 - RNA, 64 nt, Human; identical to SEQ ID NO: 50576

SEQ ID NO: 51005 - RNA, 64 nt, Human; identical to SEQ ID NO: 50577

SEQ ID NO: 51006 - RNA, 64 nt, Human; identical to SEQ ID NO: 50578

SEQ ID NO: 51007 - RNA, 64 nt, Human; identical to SEQ ID NO: 50579

SEQ ID NO: 51008 - RNA, 64 nt, Human; identical to SEQ ID NO: 50580

SEQ ID NO: 51009 - RNA, 64 nt, Human; identical to SEQ ID NO: 50581

SEQ ID NO: 51010 - RNA, 64 nt, Human; identical to SEQ ID NO: 50582

SEQ ID NO: 51011 - RNA, 64 nt, Human; identical to SEQ ID NO: 50583

SEQ ID NO: 51012 - RNA, 64 nt, Human; identical to SEQ ID NO: 50584

SEQ ID NO: 51013 - RNA, 64 nt, Human; identical to SEQ ID NO: 50585

SEQ ID NO: 51014 - RNA, 64 nt, Human; identical to SEQ ID NO: 50586

SEQ ID NO: 51015 - RNA, 64 nt, Human; identical to SEQ ID NO: 50587

SEQ ID NO: 51016 - RNA, 64 nt, Human; identical to SEQ ID NO: 50588

SEQ ID NO: 51017 - RNA, 64 nt, Human; identical to SEQ ID NO: 50589

SEQ ID NO: 51018 - RNA, 64 nt, Human; identical to SEQ ID NO: 50590

SEQ ID NO: 51019 - RNA, 64 nt, Human; identical to SEQ ID NO: 50591

SEQ ID NO: 51020 - RNA, 64 nt, Human; identical to SEQ ID NO: 50592

SEQ ID NO: 51021 - RNA, 64 nt, Human; identical to SEQ ID NO: 50593

SEQ ID NO: 51022 - RNA, 64 nt, Human; identical to SEQ ID NO: 50594

SEQ ID NO: 51023 - RNA, 64 nt, Human; identical to SEQ ID NO: 50595

SEQ ID NO: 51024 - RNA, 64 nt, Human; identical to SEQ ID NO: 50596

SEQ ID NO: 51025 - RNA, 64 nt, Human; identical to SEQ ID NO: 50597

SEQ ID NO: 51026 - RNA, 64 nt, Human; identical to SEQ ID NO: 50598

SEQ ID NO: 51027 - RNA, 64 nt, Human; identical to SEQ ID NO: 50599

SEQ ID NO: 51028 - RNA, 64 nt, Human; identical to SEQ ID NO: 50600

SEQ ID NO: 51029 - RNA, 64 nt, Human; identical to SEQ ID NO: 50601

SEQ ID NO: 51030 - RNA, 64 nt, Human; identical to SEQ ID NO: 50602

SEQ ID NO: 51031 - RNA, 64 nt, Human; identical to SEQ ID NO: 50603

SEQ ID NO: 51032 - RNA, 64 nt, Human; identical to SEQ ID NO: 50604

SEQ ID NO: 51033 - RNA, 64 nt, Human; identical to SEQ ID NO: 50605

SEQ ID NO: 51034 - RNA, 64 nt, Human; identical to SEQ ID NO: 50606

SEQ ID NO: 51035 - RNA, 64 nt, Human; identical to SEQ ID NO: 50607

SEQ ID NO: 51036 - RNA, 64 nt, Human; identical to SEQ ID NO: 50608

SEQ ID NO: 51037 - RNA, 64 nt, Human; identical to SEQ ID NO: 50609

SEQ ID NO: 51038 - RNA, 64 nt, Human; identical to SEQ ID NO: 50610

SEQ ID NO: 51039 - RNA, 64 nt, Human; identical to SEQ ID NO: 50611

SEQ ID NO: 51040 - RNA, 64 nt, Human; identical to SEQ ID NO: 50612

SEQ ID NO: 51041 - RNA, 64 nt, Human; identical to SEQ ID NO: 50613

SEQ ID NO: 51042 - RNA, 64 nt, Human; identical to SEQ ID NO: 50614

SEQ ID NO: 51043 - RNA, 64 nt, Human; identical to SEQ ID NO: 50615

SEQ ID NO: 51044 - RNA, 64 nt, Human; identical to SEQ ID NO: 50616

SEQ ID NO: 51045 - RNA, 64 nt, Human; identical to SEQ ID NO: 50617

SEQ ID NO: 51046 - RNA, 64 nt, Human; identical to SEQ ID NO: 50618

SEQ ID NO: 51047 - RNA, 64 nt, Human; identical to SEQ ID NO: 50619

SEQ ID NO: 51048 - RNA, 64 nt, Human; identical to SEQ ID NO: 50620

SEQ ID NO: 51049 - RNA, 64 nt, Human; identical to SEQ ID NO: 50621

SEQ ID NO: 51050 - RNA, 64 nt, Human; identical to SEQ ID NO: 50622

SEQ ID NO: 51051 - RNA, 64 nt, Human; identical to SEQ ID NO: 50623

SEQ ID NO: 51052 - RNA, 64 nt, Human; identical to SEQ ID NO: 50624

SEQ ID NO: 51053 - RNA, 64 nt, Human; identical to SEQ ID NO: 50625

SEQ ID NO: 51054 - RNA, 64 nt, Human; identical to SEQ ID NO: 50626

SEQ ID NO: 51055 - RNA, 64 nt, Human; identical to SEQ ID NO: 50627

SEQ ID NO: 51056 - RNA, 64 nt, Human; identical to SEQ ID NO: 50628

SEQ ID NO: 51057 - RNA, 64 nt, Human; identical to SEQ ID NO: 50629

SEQ ID NO: 51058 - RNA, 64 nt, Human; identical to SEQ ID NO: 50630

SEQ ID NO: 51059 - RNA, 64 nt, Human; identical to SEQ ID NO: 50631

SEQ ID NO: 51060 - RNA, 64 nt, Human; identical to SEQ ID NO: 50632

SEQ ID NO: 51061 - RNA, 61 nt, Human; identical to SEQ ID NO: 50633

SEQ ID NO: 51062 - RNA, 64 nt, Human; identical to SEQ ID NO: 50634

SEQ ID NO: 51063 - RNA, 64 nt, Human; identical to SEQ ID NO: 50635

SEQ ID NO: 51064 - RNA, 64 nt, Human; identical to SEQ ID NO: 50636

SEQ ID NO: 51065 - RNA, 64 nt, Human; identical to SEQ ID NO: 50637

SEQ ID NO: 51066 - RNA, 64 nt, Human; identical to SEQ ID NO: 50638

SEQ ID NO: 51067 - RNA, 64 nt, Human; identical to SEQ ID NO: 50639

SEQ ID NO: 51068 - RNA, 64 nt, Human; identical to SEQ ID NO: 50640

SEQ ID NO: 51069 - RNA, 64 nt, Human; identical to SEQ ID NO: 50641

SEQ ID NO: 51070 - RNA, 52 nt, Human; identical to SEQ ID NO: 50642

SEQ ID NO: 51071 - RNA, 64 nt, Human; identical to SEQ ID NO: 50643

SEQ ID NO: 51072 - RNA, 64 nt, Human; identical to SEQ ID NO: 50644

SEQ ID NO: 51073 - RNA, 64 nt, Human; identical to SEQ ID NO: 50645

SEQ ID NO: 51074 - RNA, 64 nt, Human; identical to SEQ ID NO: 50646

SEQ ID NO: 51075 - RNA, 64 nt, Human; identical to SEQ ID NO: 50647

SEQ ID NO: 51076 - RNA, 64 nt, Human; identical to SEQ ID NO: 50648

SEQ ID NO: 51077 - RNA, 64 nt, Human; identical to SEQ ID NO: 50649

SEQ ID NO: 51078 - RNA, 64 nt, Human; identical to SEQ ID NO: 50650

SEQ ID NO: 51079 - RNA, 64 nt, Human; identical to SEQ ID NO: 50651

SEQ ID NO: 51080 - RNA, 64 nt, Human; identical to SEQ ID NO: 50652

SEQ ID NO: 51081 - RNA, 64 nt, Human; identical to SEQ ID NO: 50653

SEQ ID NO: 51082 - RNA, 64 nt, Human; identical to SEQ ID NO: 50654

SEQ ID NO: 51083 - RNA, 64 nt, Human; identical to SEQ ID NO: 50655

SEQ ID NO: 51084 - RNA, 64 nt, Human; identical to SEQ ID NO: 50656

SEQ ID NO: 51085 - RNA, 64 nt, Human; identical to SEQ ID NO: 50657

SEQ ID NO: 51086 - RNA, 64 nt, Human; identical to SEQ ID NO: 50658

SEQ ID NO: 51087 - RNA, 64 nt, Human; identical to SEQ ID NO: 50659

SEQ ID NO: 51088 - RNA, 64 nt, Human; identical to SEQ ID NO: 50660

SEQ ID NO: 51089 - RNA, 64 nt, Human; identical to SEQ ID NO: 50661

SEQ ID NO: 51090 - RNA, 64 nt, Human; identical to SEQ ID NO: 50662

SEQ ID NO: 51091 - RNA, 64 nt, Human; identical to SEQ ID NO: 50663

SEQ ID NO: 51092 - RNA, 64 nt, Human; identical to SEQ ID NO: 50664

SEQ ID NO: 51093 - RNA, 64 nt, Human; identical to SEQ ID NO: 50665

SEQ ID NO: 51094 - RNA, 64 nt, Human; identical to SEQ ID NO: 50666

SEQ ID NO: 51095 - RNA, 64 nt, Human; identical to SEQ ID NO: 50667

SEQ ID NO: 51096 - RNA, 64 nt, Human; identical to SEQ ID NO: 50668

SEQ ID NO: 51097 - RNA, 64 nt, Human; identical to SEQ ID NO: 50669

SEQ ID NO: 51098 - RNA, 64 nt, Human; identical to SEQ ID NO: 50670

SEQ ID NO: 51099 - RNA, 64 nt, Human; identical to SEQ ID NO: 50671

SEQ ID NO: 51100 - RNA, 64 nt, Human; identical to SEQ ID NO: 50672

SEQ ID NO: 51101 - RNA, 64 nt, Human; identical to SEQ ID NO: 50673

SEQ ID NO: 51102 - RNA, 64 nt, Human; identical to SEQ ID NO: 50674

SEQ ID NO: 51103 - RNA, 64 nt, Human; identical to SEQ ID NO: 50675

SEQ ID NO: 51104 - RNA, 64 nt, Human; identical to SEQ ID NO: 50676

SEQ ID NO: 51105 - RNA, 64 nt, Human; identical to SEQ ID NO: 50677

SEQ ID NO: 51106 - RNA, 64 nt, Human; identical to SEQ ID NO: 50678

SEQ ID NO: 51107 - RNA, 64 nt, Human; identical to SEQ ID NO: 50679

SEQ ID NO: 51108 - RNA, 64 nt, Human; identical to SEQ ID NO: 50680

SEQ ID NO: 51109 - RNA, 64 nt, Human; identical to SEQ ID NO: 50681

SEQ ID NO: 51110 - RNA, 64 nt, Human; identical to SEQ ID NO: 50682

SEQ ID NO: 51111 - RNA, 64 nt, Human; identical to SEQ ID NO: 50683

SEQ ID NO: 51112 - RNA, 64 nt, Human; identical to SEQ ID NO: 50684

SEQ ID NO: 51113 - RNA, 64 nt, Human; identical to SEQ ID NO: 50685

SEQ ID NO: 51114 - RNA, 64 nt, Human; identical to SEQ ID NO: 50686

SEQ ID NO: 51115 - RNA, 64 nt, Human; identical to SEQ ID NO: 50687

SEQ ID NO: 51116 - RNA, 64 nt, Human; identical to SEQ ID NO: 50688

SEQ ID NO: 51117 - RNA, 64 nt, Human; identical to SEQ ID NO: 50689

SEQ ID NO: 51118 - RNA, 64 nt, Human; identical to SEQ ID NO: 50690

SEQ ID NO: 51119 - RNA, 64 nt, Human; identical to SEQ ID NO: 50691

SEQ ID NO: 51120 - RNA, 64 nt, Human; identical to SEQ ID NO: 50692

SEQ ID NO: 51121 - RNA, 64 nt, Human; identical to SEQ ID NO: 50693

SEQ ID NO: 51122 - RNA, 64 nt, Human; identical to SEQ ID NO: 50694

SEQ ID NO: 51123 - RNA, 64 nt, Human; identical to SEQ ID NO: 50695

SEQ ID NO: 51124 - RNA, 64 nt, Human; identical to SEQ ID NO: 50696

SEQ ID NO: 51125 - RNA, 64 nt, Human; identical to SEQ ID NO: 50697

SEQ ID NO: 51126 - RNA, 64 nt, Human; identical to SEQ ID NO: 50698

SEQ ID NO: 51127 - RNA, 64 nt, Human; identical to SEQ ID NO: 50699

SEQ ID NO: 51128 - RNA, 53 nt, Human; identical to SEQ ID NO: 50700

SEQ ID NO: 51129 - RNA, 64 nt, Human; identical to SEQ ID NO: 50701

SEQ ID NO: 51130 - RNA, 64 nt, Human; identical to SEQ ID NO: 50702

SEQ ID NO: 51131 - RNA, 64 nt, Human; identical to SEQ ID NO: 50703

SEQ ID NO: 51132 - RNA, 64 nt, Human; identical to SEQ ID NO: 50704

SEQ ID NO: 51133 - RNA, 64 nt, Human; identical to SEQ ID NO: 50705

SEQ ID NO: 51134 - RNA, 64 nt, Human; identical to SEQ ID NO: 50706

SEQ ID NO: 51135 - RNA, 64 nt, Human; identical to SEQ ID NO: 50707

SEQ ID NO: 51136 - RNA, 64 nt, Human; identical to SEQ ID NO: 50708

SEQ ID NO: 51137 - RNA, 64 nt, Human; identical to SEQ ID NO: 50709

SEQ ID NO: 51138 - RNA, 64 nt, Human; identical to SEQ ID NO: 50710

SEQ ID NO: 51139 - RNA, 64 nt, Human; identical to SEQ ID NO: 50711

SEQ ID NO: 51140 - RNA, 64 nt, Human; identical to SEQ ID NO: 50712

SEQ ID NO: 51141 - RNA, 64 nt, Human; identical to SEQ ID NO: 50713

SEQ ID NO: 51142 - RNA, 64 nt, Human; identical to SEQ ID NO: 50714

SEQ ID NO: 51143 - RNA, 64 nt, Human; identical to SEQ ID NO: 50715

SEQ ID NO: 51144 - RNA, 64 nt, Human; identical to SEQ ID NO: 50716

SEQ ID NO: 51145 - RNA, 64 nt, Human; identical to SEQ ID NO: 50717

SEQ ID NO: 51146 - RNA, 64 nt, Human; identical to SEQ ID NO: 50718

SEQ ID NO: 51147 - RNA, 64 nt, Human; identical to SEQ ID NO: 50719

SEQ ID NO: 51148 - RNA, 64 nt, Human; identical to SEQ ID NO: 50720

SEQ ID NO: 51149 - RNA, 64 nt, Human; identical to SEQ ID NO: 50721

SEQ ID NO: 51150 - RNA, 64 nt, Human; identical to SEQ ID NO: 50722

SEQ ID NO: 51151 - RNA, 64 nt, Human; identical to SEQ ID NO: 50723

SEQ ID NO: 51152 - RNA, 64 nt, Human; identical to SEQ ID NO: 50724

SEQ ID NO: 51153 - RNA, 64 nt, Human; identical to SEQ ID NO: 50725

SEQ ID NO: 51154 - RNA, 64 nt, Human; identical to SEQ ID NO: 50726

SEQ ID NO: 51155 - RNA, 64 nt, Human; identical to SEQ ID NO: 50727

SEQ ID NO: 51156 - RNA, 64 nt, Human; identical to SEQ ID NO: 50728

SEQ ID NO: 51157 - RNA, 64 nt, Human; identical to SEQ ID NO: 50729

SEQ ID NO: 51158 - RNA, 64 nt, Human; identical to SEQ ID NO: 50730

SEQ ID NO: 51159 - RNA, 64 nt, Human; identical to SEQ ID NO: 50731

SEQ ID NO: 51160 - RNA, 64 nt, Human; identical to SEQ ID NO: 50732

SEQ ID NO: 51161 - RNA, 64 nt, Human; identical to SEQ ID NO: 50733

SEQ ID NO: 51162 - RNA, 64 nt, Human; identical to SEQ ID NO: 50734

SEQ ID NO: 51163 - RNA, 64 nt, Human; identical to SEQ ID NO: 50735

SEQ ID NO: 51164 - RNA, 64 nt, Human; identical to SEQ ID NO: 50736

SEQ ID NO: 51165 - RNA, 64 nt, Human; identical to SEQ ID NO: 50737

SEQ ID NO: 51166 - RNA, 64 nt, Human; identical to SEQ ID NO: 50738

SEQ ID NO: 51167 - RNA, 64 nt, Human; identical to SEQ ID NO: 50739

SEQ ID NO: 51168 - RNA, 64 nt, Human; identical to SEQ ID NO: 50740

SEQ ID NO: 51169 - RNA, 64 nt, Human; identical to SEQ ID NO: 50741

SEQ ID NO: 51170 - RNA, 64 nt, Human; identical to SEQ ID NO: 50742

SEQ ID NO: 51171 - RNA, 64 nt, Human; identical to SEQ ID NO: 50743

SEQ ID NO: 51172 - RNA, 64 nt, Human; identical to SEQ ID NO: 50744

SEQ ID NO: 51173 - RNA, 64 nt, Human; identical to SEQ ID NO: 50745

SEQ ID NO: 51174 - RNA, 64 nt, Human; identical to SEQ ID NO: 50746

SEQ ID NO: 51175 - RNA, 64 nt, Human; identical to SEQ ID NO: 50747

SEQ ID NO: 51176 - RNA, 64 nt, Human; identical to SEQ ID NO: 50748

SEQ ID NO: 51177 - RNA, 64 nt, Human; identical to SEQ ID NO: 50749

SEQ ID NO: 51178 - RNA, 64 nt, Human; identical to SEQ ID NO: 50750

SEQ ID NO: 51179 - RNA, 64 nt, Human; identical to SEQ ID NO: 50751

SEQ ID NO: 51180 - RNA, 64 nt, Human; identical to SEQ ID NO: 50752

SEQ ID NO: 51181 - RNA, 64 nt, Human; identical to SEQ ID NO: 50753

SEQ ID NO: 51182 - RNA, 64 nt, Human; identical to SEQ ID NO: 50754

SEQ ID NO: 51183 - RNA, 64 nt, Human; identical to SEQ ID NO: 50755

SEQ ID NO: 51184 - RNA, 64 nt, Human; identical to SEQ ID NO: 50756

SEQ ID NO: 51185 - RNA, 64 nt, Human; identical to SEQ ID NO: 50757

SEQ ID NO: 51186 - RNA, 64 nt, Human; identical to SEQ ID NO: 50758

SEQ ID NO: 51187 - RNA, 64 nt, Human; identical to SEQ ID NO: 50759

SEQ ID NO: 51188 - RNA, 64 nt, Human; identical to SEQ ID NO: 50760

SEQ ID NO: 51189 - RNA, 64 nt, Human; identical to SEQ ID NO: 50761

SEQ ID NO: 51190 - RNA, 64 nt, Human; identical to SEQ ID NO: 50762

SEQ ID NO: 51191 - RNA, 64 nt, Human; identical to SEQ ID NO: 50763

SEQ ID NO: 51192 - RNA, 64 nt, Human; identical to SEQ ID NO: 50764

SEQ ID NO: 51193 - RNA, 64 nt, Human; identical to SEQ ID NO: 50765

SEQ ID NO: 51194 - RNA, 64 nt, Human; identical to SEQ ID NO: 50766

SEQ ID NO: 51195 - RNA, 64 nt, Human; identical to SEQ ID NO: 50767

SEQ ID NO: 51196 - RNA, 64 nt, Human; identical to SEQ ID NO: 50768

SEQ ID NO: 51197 - RNA, 64 nt, Human; identical to SEQ ID NO: 50769

SEQ ID NO: 51198 - RNA, 64 nt, Human; identical to SEQ ID NO: 50770

SEQ ID NO: 51199 - RNA, 64 nt, Human; identical to SEQ ID NO: 50771

SEQ ID NO: 51200 - RNA, 64 nt, Human; identical to SEQ ID NO: 50772

SEQ ID NO: 51201 - RNA, 64 nt, Human; identical to SEQ ID NO: 50773

SEQ ID NO: 51202 - RNA, 64 nt, Human; identical to SEQ ID NO: 50774

SEQ ID NO: 51203 - RNA, 64 nt, Human; identical to SEQ ID NO: 50775

SEQ ID NO: 51204 - RNA, 64 nt, Human; identical to SEQ ID NO: 50776

SEQ ID NO: 51205 - RNA, 64 nt, Human; identical to SEQ ID NO: 50777

SEQ ID NO: 51206 - RNA, 64 nt, Human; identical to SEQ ID NO: 50778

SEQ ID NO: 51207 - RNA, 64 nt, Human; identical to SEQ ID NO: 50779

SEQ ID NO: 51208 - RNA, 64 nt, Human; identical to SEQ ID NO: 50780

SEQ ID NO: 51209 - RNA, 64 nt, Human; identical to SEQ ID NO: 50781

SEQ ID NO: 51210 - RNA, 64 nt, Human; identical to SEQ ID NO: 50782

SEQ ID NO: 51211 - RNA, 64 nt, Human; identical to SEQ ID NO: 50783

SEQ ID NO: 51212 - RNA, 64 nt, Human; identical to SEQ ID NO: 50784

SEQ ID NO: 51213 - RNA, 64 nt, Human; identical to SEQ ID NO: 50785

SEQ ID NO: 51214 - RNA, 64 nt, Human; identical to SEQ ID NO: 50786

SEQ ID NO: 51215 - RNA, 64 nt, Human; identical to SEQ ID NO: 50787

SEQ ID NO: 51216 - RNA, 64 nt, Human; identical to SEQ ID NO: 50788

SEQ ID NO: 51217 - RNA, 64 nt, Human; identical to SEQ ID NO: 50789

SEQ ID NO: 51218 - RNA, 64 nt, Human; identical to SEQ ID NO: 50790

SEQ ID NO: 51219 - RNA, 64 nt, Human; identical to SEQ ID NO: 50791

SEQ ID NO: 51220 - RNA, 64 nt, Human; identical to SEQ ID NO: 50792

SEQ ID NO: 51221 - RNA, 64 nt, Human; identical to SEQ ID NO: 50793

SEQ ID NO: 51222 - RNA, 64 nt, Human; identical to SEQ ID NO: 50794

SEQ ID NO: 51223 - RNA, 64 nt, Human; identical to SEQ ID NO: 50795

SEQ ID NO: 51224 - RNA, 64 nt, Human; identical to SEQ ID NO: 50796

SEQ ID NO: 51225 - RNA, 64 nt, Human; identical to SEQ ID NO: 50797

SEQ ID NO: 51226 - RNA, 64 nt, Human; identical to SEQ ID NO: 50798

SEQ ID NO: 51227 - RNA, 64 nt, Human; identical to SEQ ID NO: 50799

SEQ ID NO: 51228 - RNA, 64 nt, Human; identical to SEQ ID NO: 50800

SEQ ID NO: 51229 - RNA, 64 nt, Human; identical to SEQ ID NO: 50801

SEQ ID NO: 51230 - RNA, 64 nt, Human; identical to SEQ ID NO: 50802

SEQ ID NO: 51231 - RNA, 64 nt, Human; identical to SEQ ID NO: 50803

SEQ ID NO: 51232 - RNA, 64 nt, Human; identical to SEQ ID NO: 50804

SEQ ID NO: 51233 - RNA, 64 nt, Human; identical to SEQ ID NO: 50805

SEQ ID NO: 51234 - RNA, 64 nt, Human; identical to SEQ ID NO: 50806

SEQ ID NO: 51235 - RNA, 64 nt, Human; identical to SEQ ID NO: 50807

SEQ ID NO: 51236 - RNA, 64 nt, Human; identical to SEQ ID NO: 50808

SEQ ID NO: 51237 - RNA, 64 nt, Human; identical to SEQ ID NO: 50809

SEQ ID NO: 51238 - RNA, 64 nt, Human; identical to SEQ ID NO: 50810

SEQ ID NO: 51239 - RNA, 64 nt, Human; identical to SEQ ID NO: 50811

SEQ ID NO: 51240 - RNA, 64 nt, Human; identical to SEQ ID NO: 50812

SEQ ID NO: 51241 - RNA, 64 nt, Human; identical to SEQ ID NO: 50813

SEQ ID NO: 51242 - RNA, 64 nt, Human; identical to SEQ ID NO: 50814

SEQ ID NO: 51243 - RNA, 64 nt, Human; identical to SEQ ID NO: 50815

SEQ ID NO: 51244 - RNA, 58 nt, Human; identical to SEQ ID NO: 50816

SEQ ID NO: 51245 - RNA, 64 nt, Human; identical to SEQ ID NO: 50817

SEQ ID NO: 51246 - RNA, 64 nt, Human; identical to SEQ ID NO: 50818

SEQ ID NO: 51247 - RNA, 64 nt, Human; identical to SEQ ID NO: 50819

SEQ ID NO: 51248 - RNA, 64 nt, Human; identical to SEQ ID NO: 50820

SEQ ID NO: 51249 - RNA, 64 nt, Human; identical to SEQ ID NO: 50821

SEQ ID NO: 51250 - RNA, 64 nt, Human; identical to SEQ ID NO: 50822

SEQ ID NO: 51251 - RNA, 64 nt, Human; identical to SEQ ID NO: 50823

SEQ ID NO: 51252 - RNA, 64 nt, Human; identical to SEQ ID NO: 50824

SEQ ID NO: 51253 - RNA, 64 nt, Human; identical to SEQ ID NO: 50825

SEQ ID NO: 51254 - RNA, 64 nt, Human; identical to SEQ ID NO: 50826

SEQ ID NO: 51255 - RNA, 64 nt, Human; identical to SEQ ID NO: 50827

SEQ ID NO: 51256 - RNA, 64 nt, Human; identical to SEQ ID NO: 50828

SEQ ID NO: 51257 - RNA, 64 nt, Human; identical to SEQ ID NO: 50829

SEQ ID NO: 51258 - RNA, 64 nt, Human; identical to SEQ ID NO: 50830

SEQ ID NO: 51259 - RNA, 64 nt, Human; identical to SEQ ID NO: 50831

SEQ ID NO: 51260 - RNA, 64 nt, Human; identical to SEQ ID NO: 50832

SEQ ID NO: 51261 - RNA, 64 nt, Human; identical to SEQ ID NO: 50833

SEQ ID NO: 51262 - RNA, 64 nt, Human; identical to SEQ ID NO: 50834

SEQ ID NO: 51263 - RNA, 64 nt, Human; identical to SEQ ID NO: 50835

SEQ ID NO: 51264 - RNA, 64 nt, Human; identical to SEQ ID NO: 50836

SEQ ID NO: 51265 - RNA, 64 nt, Human; identical to SEQ ID NO: 50837

SEQ ID NO: 51266 - RNA, 64 nt, Human; identical to SEQ ID NO: 50838

SEQ ID NO: 51267 - RNA, 64 nt, Human; identical to SEQ ID NO: 50839

SEQ ID NO: 51268 - RNA, 64 nt, Human; identical to SEQ ID NO: 50840

SEQ ID NO: 51269 - RNA, 64 nt, Human; identical to SEQ ID NO: 50841

SEQ ID NO: 51270 - RNA, 64 nt, Human; identical to SEQ ID NO: 50842

SEQ ID NO: 51271 - RNA, 64 nt, Human; identical to SEQ ID NO: 50843

SEQ ID NO: 51272 - RNA, 64 nt, Human; identical to SEQ ID NO: 50844

SEQ ID NO: 51273 - RNA, 64 nt, Human; identical to SEQ ID NO: 50845

SEQ ID NO: 51274 - RNA, 64 nt, Human; identical to SEQ ID NO: 50846

SEQ ID NO: 51275 - RNA, 64 nt, Human; identical to SEQ ID NO: 50847

SEQ ID NO: 51276 - RNA, 64 nt, Human; identical to SEQ ID NO: 50848

SEQ ID NO: 51277 - RNA, 64 nt, Human; identical to SEQ ID NO: 50849

SEQ ID NO: 51278 - RNA, 64 nt, Human; identical to SEQ ID NO: 50850

SEQ ID NO: 51279 - RNA, 64 nt, Human; identical to SEQ ID NO: 50851

SEQ ID NO: 51280 - RNA, 64 nt, Human; identical to SEQ ID NO: 50852

SEQ ID NO: 51281 - RNA, 64 nt, Human; identical to SEQ ID NO: 50853

SEQ ID NO: 51282 - RNA, 64 nt, Human; identical to SEQ ID NO: 50854

SEQ ID NO: 51283 - RNA, 64 nt, Human; identical to SEQ ID NO: 50855

SEQ ID NO: 51284 - RNA, 57 nt, Human; identical to SEQ ID NO: 50856

SEQ ID NO: 51285 - RNA, 64 nt, Human; identical to SEQ ID NO: 50857

SEQ ID NO: 51286 - RNA, 64 nt, Human; identical to SEQ ID NO: 50858

SEQ ID NO: 51287 - RNA, 64 nt, Human; identical to SEQ ID NO: 50859

SEQ ID NO: 51288 - RNA, 64 nt, Human; identical to SEQ ID NO: 50860

SEQ ID NO: 51289 - RNA, 64 nt, Human; identical to SEQ ID NO: 50861

SEQ ID NO: 51290 - RNA, 64 nt, Human; identical to SEQ ID NO: 50862

SEQ ID NO: 51291 - RNA, 64 nt, Human; identical to SEQ ID NO: 50863

SEQ ID NO: 51292 - RNA, 64 nt, Human; identical to SEQ ID NO: 50864

SEQ ID NO: 51293 - RNA, 64 nt, Human; identical to SEQ ID NO: 50865

SEQ ID NO: 51294 - RNA, 64 nt, Human; identical to SEQ ID NO: 50866

SEQ ID NO: 51295 - RNA, 64 nt, Human; identical to SEQ ID NO: 50867

SEQ ID NO: 51296 - RNA, 64 nt, Human; identical to SEQ ID NO: 50868

SEQ ID NO: 51297 - RNA, 64 nt, Human; identical to SEQ ID NO: 50869

SEQ ID NO: 51298 - RNA, 64 nt, Human; identical to SEQ ID NO: 50870

SEQ ID NO: 51299 - RNA, 64 nt, Human; identical to SEQ ID NO: 50871

SEQ ID NO: 51300 - RNA, 64 nt, Human; identical to SEQ ID NO: 50872

SEQ ID NO: 51301 - RNA, 64 nt, Human; identical to SEQ ID NO: 50873

SEQ ID NO: 51302 - RNA, 64 nt, Human; identical to SEQ ID NO: 50874

SEQ ID NO: 51303 - RNA, 64 nt, Human; identical to SEQ ID NO: 50875

SEQ ID NO: 51304 - RNA, 64 nt, Human; identical to SEQ ID NO: 50876

SEQ ID NO: 51305 - RNA, 64 nt, Human; identical to SEQ ID NO: 50877

SEQ ID NO: 51306 - RNA, 64 nt, Human; identical to SEQ ID NO: 50878

SEQ ID NO: 51307 - RNA, 64 nt, Human; identical to SEQ ID NO: 50879

SEQ ID NO: 51308 - RNA, 64 nt, Human; identical to SEQ ID NO: 50880

SEQ ID NO: 51309 - RNA, 64 nt, Human; identical to SEQ ID NO: 50881

SEQ ID NO: 51310 - RNA, 64 nt, Human; identical to SEQ ID NO: 50882

SEQ ID NO: 51311 - RNA, 64 nt, Human; identical to SEQ ID NO: 50883

SEQ ID NO: 51312 - RNA, 64 nt, Human; identical to SEQ ID NO: 50884

SEQ ID NO: 51313 - RNA, 64 nt, Human; identical to SEQ ID NO: 50885

SEQ ID NO: 51314 - RNA, 64 nt, Human; identical to SEQ ID NO: 50886

SEQ ID NO: 51315 - RNA, 64 nt, Human; identical to SEQ ID NO: 50887

SEQ ID NO: 51316 - RNA, 64 nt, Human; identical to SEQ ID NO: 50888

SEQ ID NO: 51317 - RNA, 64 nt, Human; identical to SEQ ID NO: 50889

SEQ ID NO: 51318 - RNA, 64 nt, Human; identical to SEQ ID NO: 50890

SEQ ID NO: 51319 - RNA, 64 nt, Human; identical to SEQ ID NO: 50891

SEQ ID NO: 51320 - RNA, 64 nt, Human; identical to SEQ ID NO: 50892

SEQ ID NO: 51321 - RNA, 64 nt, Human; identical to SEQ ID NO: 50893

SEQ ID NO: 51322 - RNA, 64 nt, Human; identical to SEQ ID NO: 50894

SEQ ID NO: 51323 - RNA, 64 nt, Human; identical to SEQ ID NO: 50895

SEQ ID NO: 51324 - RNA, 64 nt, Human; identical to SEQ ID NO: 50896

SEQ ID NO: 51325 - RNA, 64 nt, Human; identical to SEQ ID NO: 50897

SEQ ID NO: 51326 - RNA, 64 nt, Human; identical to SEQ ID NO: 50898

SEQ ID NO: 51327 - RNA, 64 nt, Human; identical to SEQ ID NO: 50899

SEQ ID NO: 51328 - RNA, 64 nt, Human; identical to SEQ ID NO: 50900

SEQ ID NO: 51329 - RNA, 64 nt, Human; identical to SEQ ID NO: 50901

SEQ ID NO: 51330 - RNA, 64 nt, Human; identical to SEQ ID NO: 50902

SEQ ID NO: 51331 - RNA, 64 nt, Human; identical to SEQ ID NO: 50903

SEQ ID NO: 51332 - RNA, 64 nt, Human; identical to SEQ ID NO: 50904

SEQ ID NO: 51333 - RNA, 64 nt, Human; identical to SEQ ID NO: 50905

SEQ ID NO: 51334 - RNA, 64 nt, Human; identical to SEQ ID NO: 50906

SEQ ID NO: 51335 - RNA, 64 nt, Human; identical to SEQ ID NO: 50907

SEQ ID NO: 51336 - RNA, 53 nt, Human; identical to SEQ ID NO: 50908

SEQ ID NO: 51337 - RNA, 64 nt, Human; identical to SEQ ID NO: 50909

SEQ ID NO: 51338 - RNA, 64 nt, Human; identical to SEQ ID NO: 50910

SEQ ID NO: 51339 - RNA, 64 nt, Human; identical to SEQ ID NO: 50911

SEQ ID NO: 51340 - RNA, 64 nt, Human; identical to SEQ ID NO: 50912

SEQ ID NO: 51341 - RNA, 64 nt, Human; identical to SEQ ID NO: 50913

SEQ ID NO: 51342 - RNA, 64 nt, Human; identical to SEQ ID NO: 50914

SEQ ID NO: 51343 - RNA, 64 nt, Human; identical to SEQ ID NO: 50915

SEQ ID NO: 51344 - RNA, 64 nt, Human; identical to SEQ ID NO: 50916

SEQ ID NO: 51345 - RNA, 64 nt, Human; identical to SEQ ID NO: 50917

SEQ ID NO: 51346 - RNA, 64 nt, Human; identical to SEQ ID NO: 50918

SEQ ID NO: 51347 - RNA, 64 nt, Human; identical to SEQ ID NO: 50919

SEQ ID NO: 51348 - RNA, 64 nt, Human; identical to SEQ ID NO: 50920

SEQ ID NO: 51349 - RNA, 64 nt, Human; identical to SEQ ID NO: 50921

SEQ ID NO: 51350 - RNA, 64 nt, Human; identical to SEQ ID NO: 50922

SEQ ID NO: 51351 - RNA, 64 nt, Human; identical to SEQ ID NO: 50923

SEQ ID NO: 51352 - RNA, 64 nt, Human; identical to SEQ ID NO: 50924

SEQ ID NO: 51353 - RNA, 64 nt, Human; identical to SEQ ID NO: 50925

SEQ ID NO: 51354 - RNA, 64 nt, Human; identical to SEQ ID NO: 50926

SEQ ID NO: 51355 - RNA, 64 nt, Human; identical to SEQ ID NO: 50927

SEQ ID NO: 51356 - RNA, 64 nt, Human; identical to SEQ ID NO: 50928

SEQ ID NO: 51357 - RNA, 64 nt, Human; identical to SEQ ID NO: 50929

SEQ ID NO: 51358 - RNA, 54 nt, Human; identical to SEQ ID NO: 50930

SEQ ID NO: 51359 - RNA, 64 nt, Human; identical to SEQ ID NO: 50931

SEQ ID NO: 51360 - RNA, 64 nt, Human; identical to SEQ ID NO: 50932

SEQ ID NO: 51361 - RNA, 64 nt, Human; identical to SEQ ID NO: 50933

SEQ ID NO: 51362 - RNA, 64 nt, Human; identical to SEQ ID NO: 50934

SEQ ID NO: 51363 - RNA, 64 nt, Human; identical to SEQ ID NO: 50935

SEQ ID NO: 51364 - RNA, 64 nt, Human; identical to SEQ ID NO: 50936

SEQ ID NO: 51365 - RNA, 64 nt, Human; identical to SEQ ID NO: 50937

SEQ ID NO: 51366 - RNA, 64 nt, Human; identical to SEQ ID NO: 50938

SEQ ID NO: 51367 - RNA, 64 nt, Human; identical to SEQ ID NO: 50939

SEQ ID NO: 51368 - RNA, 64 nt, Human; identical to SEQ ID NO: 50940

SEQ ID NO: 51369 - RNA, 64 nt, Human; identical to SEQ ID NO: 50941

SEQ ID NO: 51370 - RNA, 64 nt, Human; identical to SEQ ID NO: 50942

SEQ ID NO: 51371 - RNA, 64 nt, Human; identical to SEQ ID NO: 50943

SEQ ID NO: 51372 - RNA, 64 nt, Human; identical to SEQ ID NO: 50944

SEQ ID NO: 51373 - RNA, 64 nt, Human; identical to SEQ ID NO: 50945

SEQ ID NO: 51374 - RNA, 64 nt, Human; identical to SEQ ID NO: 50946

SEQ ID NO: 51375 - RNA, 64 nt, Human; identical to SEQ ID NO: 50947

SEQ ID NO: 51376 - RNA, 64 nt, Human; identical to SEQ ID NO: 50948

SEQ ID NO: 51377 - RNA, 64 nt, Human; identical to SEQ ID NO: 50949

SEQ ID NO: 51378 - RNA, 64 nt, Human; identical to SEQ ID NO: 50950

SEQ ID NO: 51379 - RNA, 64 nt, Human; identical to SEQ ID NO: 50951

SEQ ID NO: 51380 - RNA, 64 nt, Human; identical to SEQ ID NO: 50952

SEQ ID NO: 51381 - RNA, 64 nt, Human; identical to SEQ ID NO: 50953

SEQ ID NO: 51382 - RNA, 64 nt, Human; identical to SEQ ID NO: 50954

SEQ ID NO: 51383 - RNA, 64 nt, Human; identical to SEQ ID NO: 50955

SEQ ID NO: 51384 - RNA, 64 nt, Human; identical to SEQ ID NO: 50956

SEQ ID NO: 51385 - RNA, 64 nt, Human; identical to SEQ ID NO: 50957

SEQ ID NO: 51386 - RNA, 64 nt, Human; identical to SEQ ID NO: 50958

SEQ ID NO: 51387 - RNA, 64 nt, Human; identical to SEQ ID NO: 50959

SEQ ID NO: 51388 - RNA, 64 nt, Human; identical to SEQ ID NO: 50960

SEQ ID NO: 51389 - RNA, 64 nt, Human; identical to SEQ ID NO: 50961

SEQ ID NO: 51390 - RNA, 64 nt, Human; identical to SEQ ID NO: 50962

SEQ ID NO: 51391 - RNA, 64 nt, Human; identical to SEQ ID NO: 50963

SEQ ID NO: 51392 - RNA, 64 nt, Human; identical to SEQ ID NO: 50964

SEQ ID NO: 51393 - RNA, 64 nt, Human; identical to SEQ ID NO: 50965

SEQ ID NO: 51394 - RNA, 64 nt, Human; identical to SEQ ID NO: 50966

SEQ ID NO: 51395 - RNA, 64 nt, Human; identical to SEQ ID NO: 50967

SEQ ID NO: 51396 - RNA, 64 nt, Human; identical to SEQ ID NO: 50968

SEQ ID NO: 51397 - RNA, 64 nt, Human; identical to SEQ ID NO: 50969

SEQ ID NO: 51398 - RNA, 64 nt, Human; identical to SEQ ID NO: 50970

SEQ ID NO: 51399 - RNA, 64 nt, Human; identical to SEQ ID NO: 50971

SEQ ID NO: 51400 - RNA, 64 nt, Human; identical to SEQ ID NO: 50972

SEQ ID NO: 51401 - RNA, 64 nt, Human; identical to SEQ ID NO: 50973

SEQ ID NO: 51402 - RNA, 64 nt, Human; identical to SEQ ID NO: 50974

SEQ ID NO: 51403 - RNA, 64 nt, Human; identical to SEQ ID NO: 50975

SEQ ID NO: 51404 - RNA, 64 nt, Human; identical to SEQ ID NO: 50976

SEQ ID NO: 51405 - RNA, 64 nt, Human; identical to SEQ ID NO: 50977

SEQ ID NO: 51406 - RNA, 64 nt, Human; identical to SEQ ID NO: 50550

SEQ ID NO: 51407 - RNA, 64 nt, Human; identical to SEQ ID NO: 50551

SEQ ID NO: 51408 - RNA, 64 nt, Human; identical to SEQ ID NO: 50552

SEQ ID NO: 51409 - RNA, 62 nt, Human; identical to SEQ ID NO: 50553

SEQ ID NO: 51410 - RNA, 52 nt, Human; identical to SEQ ID NO: 50554

SEQ ID NO: 51411 - RNA, 55 nt, Human; identical to SEQ ID NO: 50555

SEQ ID NO: 51412 - RNA, 64 nt, Human; identical to SEQ ID NO: 50556

SEQ ID NO: 51413 - RNA, 64 nt, Human; identical to SEQ ID NO: 50557

SEQ ID NO: 51414 - RNA, 64 nt, Human; identical to SEQ ID NO: 50558

SEQ ID NO: 51415 - RNA, 64 nt, Human; identical to SEQ ID NO: 50559

SEQ ID NO: 51416 - RNA, 64 nt, Human; identical to SEQ ID NO: 50560

SEQ ID NO: 51417 - RNA, 64 nt, Human; identical to SEQ ID NO: 50561

SEQ ID NO: 51418 - RNA, 64 nt, Human; identical to SEQ ID NO: 50562

SEQ ID NO: 51419 - RNA, 64 nt, Human; identical to SEQ ID NO: 50563

SEQ ID NO: 51420 - RNA, 64 nt, Human; identical to SEQ ID NO: 50564

SEQ ID NO: 51421 - RNA, 64 nt, Human; identical to SEQ ID NO: 50565

SEQ ID NO: 51422 - RNA, 64 nt, Human; identical to SEQ ID NO: 50566

SEQ ID NO: 51423 - RNA, 64 nt, Human; identical to SEQ ID NO: 50567

SEQ ID NO: 51424 - RNA, 64 nt, Human; identical to SEQ ID NO: 50568

SEQ ID NO: 51425 - RNA, 64 nt, Human; identical to SEQ ID NO: 50569

SEQ ID NO: 51426 - RNA, 64 nt, Human; identical to SEQ ID NO: 50570

SEQ ID NO: 51427 - RNA, 64 nt, Human; identical to SEQ ID NO: 50571

SEQ ID NO: 51428 - RNA, 64 nt, Human; identical to SEQ ID NO: 50572

SEQ ID NO: 51429 - RNA, 64 nt, Human; identical to SEQ ID NO: 50573

SEQ ID NO: 51430 - RNA, 64 nt, Human; identical to SEQ ID NO: 50574

SEQ ID NO: 51431 - RNA, 64 nt, Human; identical to SEQ ID NO: 50575

SEQ ID NO: 51432 - RNA, 64 nt, Human; identical to SEQ ID NO: 50576

SEQ ID NO: 51433 - RNA, 64 nt, Human; identical to SEQ ID NO: 50577

SEQ ID NO: 51434 - RNA, 64 nt, Human; identical to SEQ ID NO: 50578

SEQ ID NO: 51435 - RNA, 64 nt, Human; identical to SEQ ID NO: 50579

SEQ ID NO: 51436 - RNA, 64 nt, Human; identical to SEQ ID NO: 50580

SEQ ID NO: 51437 - RNA, 64 nt, Human; identical to SEQ ID NO: 50581

SEQ ID NO: 51438 - RNA, 64 nt, Human; identical to SEQ ID NO: 50582

SEQ ID NO: 51439 - RNA, 64 nt, Human; identical to SEQ ID NO: 50583

SEQ ID NO: 51440 - RNA, 64 nt, Human; identical to SEQ ID NO: 50584

SEQ ID NO: 51441 - RNA, 64 nt, Human; identical to SEQ ID NO: 50585

SEQ ID NO: 51442 - RNA, 64 nt, Human; identical to SEQ ID NO: 50586

SEQ ID NO: 51443 - RNA, 64 nt, Human; identical to SEQ ID NO: 50587

SEQ ID NO: 51444 - RNA, 64 nt, Human; identical to SEQ ID NO: 50588

SEQ ID NO: 51445 - RNA, 64 nt, Human; identical to SEQ ID NO: 50589

SEQ ID NO: 51446 - RNA, 64 nt, Human; identical to SEQ ID NO: 50590

SEQ ID NO: 51447 - RNA, 64 nt, Human; identical to SEQ ID NO: 50591

SEQ ID NO: 51448 - RNA, 64 nt, Human; identical to SEQ ID NO: 50592

SEQ ID NO: 51449 - RNA, 64 nt, Human; identical to SEQ ID NO: 50593

SEQ ID NO: 51450 - RNA, 64 nt, Human; identical to SEQ ID NO: 50594

SEQ ID NO: 51451 - RNA, 64 nt, Human; identical to SEQ ID NO: 50595

SEQ ID NO: 51452 - RNA, 64 nt, Human; identical to SEQ ID NO: 50596

SEQ ID NO: 51453 - RNA, 64 nt, Human; identical to SEQ ID NO: 50597

SEQ ID NO: 51454 - RNA, 64 nt, Human; identical to SEQ ID NO: 50598

SEQ ID NO: 51455 - RNA, 64 nt, Human; identical to SEQ ID NO: 50599

SEQ ID NO: 51456 - RNA, 64 nt, Human; identical to SEQ ID NO: 50600

SEQ ID NO: 51457 - RNA, 64 nt, Human; identical to SEQ ID NO: 50601

SEQ ID NO: 51458 - RNA, 64 nt, Human; identical to SEQ ID NO: 50602

SEQ ID NO: 51459 - RNA, 64 nt, Human; identical to SEQ ID NO: 50603

SEQ ID NO: 51460 - RNA, 64 nt, Human; identical to SEQ ID NO: 50604

SEQ ID NO: 51461 - RNA, 64 nt, Human; identical to SEQ ID NO: 50605

SEQ ID NO: 51462 - RNA, 64 nt, Human; identical to SEQ ID NO: 50606

SEQ ID NO: 51463 - RNA, 64 nt, Human; identical to SEQ ID NO: 50607

SEQ ID NO: 51464 - RNA, 64 nt, Human; identical to SEQ ID NO: 50608

SEQ ID NO: 51465 - RNA, 64 nt, Human; identical to SEQ ID NO: 50609

SEQ ID NO: 51466 - RNA, 64 nt, Human; identical to SEQ ID NO: 50610

SEQ ID NO: 51467 - RNA, 64 nt, Human; identical to SEQ ID NO: 50611

SEQ ID NO: 51468 - RNA, 64 nt, Human; identical to SEQ ID NO: 50612

SEQ ID NO: 51469 - RNA, 64 nt, Human; identical to SEQ ID NO: 50613

SEQ ID NO: 51470 - RNA, 64 nt, Human; identical to SEQ ID NO: 50614

SEQ ID NO: 51471 - RNA, 64 nt, Human; identical to SEQ ID NO: 50615

SEQ ID NO: 51472 - RNA, 64 nt, Human; identical to SEQ ID NO: 50616

SEQ ID NO: 51473 - RNA, 64 nt, Human; identical to SEQ ID NO: 50617

SEQ ID NO: 51474 - RNA, 64 nt, Human; identical to SEQ ID NO: 50618

SEQ ID NO: 51475 - RNA, 64 nt, Human; identical to SEQ ID NO: 50619

SEQ ID NO: 51476 - RNA, 64 nt, Human; identical to SEQ ID NO: 50620

SEQ ID NO: 51477 - RNA, 64 nt, Human; identical to SEQ ID NO: 50621

SEQ ID NO: 51478 - RNA, 64 nt, Human; identical to SEQ ID NO: 50622

SEQ ID NO: 51479 - RNA, 64 nt, Human; identical to SEQ ID NO: 50623

SEQ ID NO: 51480 - RNA, 64 nt, Human; identical to SEQ ID NO: 50624

SEQ ID NO: 51481 - RNA, 64 nt, Human; identical to SEQ ID NO: 50625

SEQ ID NO: 51482 - RNA, 64 nt, Human; identical to SEQ ID NO: 50626

SEQ ID NO: 51483 - RNA, 64 nt, Human; identical to SEQ ID NO: 50627

SEQ ID NO: 51484 - RNA, 64 nt, Human; identical to SEQ ID NO: 50628

SEQ ID NO: 51485 - RNA, 64 nt, Human; identical to SEQ ID NO: 50629

SEQ ID NO: 51486 - RNA, 64 nt, Human; identical to SEQ ID NO: 50630

SEQ ID NO: 51487 - RNA, 64 nt, Human; identical to SEQ ID NO: 50631

SEQ ID NO: 51488 - RNA, 64 nt, Human; identical to SEQ ID NO: 50632

SEQ ID NO: 51489 - RNA, 61 nt, Human; identical to SEQ ID NO: 50633

SEQ ID NO: 51490 - RNA, 64 nt, Human; identical to SEQ ID NO: 50634

SEQ ID NO: 51491 - RNA, 64 nt, Human; identical to SEQ ID NO: 50635

SEQ ID NO: 51492 - RNA, 64 nt, Human; identical to SEQ ID NO: 50636

SEQ ID NO: 51493 - RNA, 64 nt, Human; identical to SEQ ID NO: 50637

SEQ ID NO: 51494 - RNA, 64 nt, Human; identical to SEQ ID NO: 50638

SEQ ID NO: 51495 - RNA, 64 nt, Human; identical to SEQ ID NO: 50639

SEQ ID NO: 51496 - RNA, 64 nt, Human; identical to SEQ ID NO: 50640

SEQ ID NO: 51497 - RNA, 64 nt, Human; identical to SEQ ID NO: 50641

SEQ ID NO: 51498 - RNA, 52 nt, Human; identical to SEQ ID NO: 50642

SEQ ID NO: 51499 - RNA, 64 nt, Human; identical to SEQ ID NO: 50643

SEQ ID NO: 51500 - RNA, 64 nt, Human; identical to SEQ ID NO: 50644

SEQ ID NO: 51501 - RNA, 64 nt, Human; identical to SEQ ID NO: 50645

SEQ ID NO: 51502 - RNA, 64 nt, Human; identical to SEQ ID NO: 50646

SEQ ID NO: 51503 - RNA, 64 nt, Human; identical to SEQ ID NO: 50647

SEQ ID NO: 51504 - RNA, 64 nt, Human; identical to SEQ ID NO: 50648

SEQ ID NO: 51505 - RNA, 64 nt, Human; identical to SEQ ID NO: 50649

SEQ ID NO: 51506 - RNA, 64 nt, Human; identical to SEQ ID NO: 50650

SEQ ID NO: 51507 - RNA, 64 nt, Human; identical to SEQ ID NO: 50651

SEQ ID NO: 51508 - RNA, 64 nt, Human; identical to SEQ ID NO: 50652

SEQ ID NO: 51509 - RNA, 64 nt, Human; identical to SEQ ID NO: 50653

SEQ ID NO: 51510 - RNA, 64 nt, Human; identical to SEQ ID NO: 50654

SEQ ID NO: 51511 - RNA, 64 nt, Human; identical to SEQ ID NO: 50655

SEQ ID NO: 51512 - RNA, 64 nt, Human; identical to SEQ ID NO: 50656

SEQ ID NO: 51513 - RNA, 64 nt, Human; identical to SEQ ID NO: 50657

SEQ ID NO: 51514 - RNA, 64 nt, Human; identical to SEQ ID NO: 50658

SEQ ID NO: 51515 - RNA, 64 nt, Human; identical to SEQ ID NO: 50659

SEQ ID NO: 51516 - RNA, 64 nt, Human; identical to SEQ ID NO: 50660

SEQ ID NO: 51517 - RNA, 64 nt, Human; identical to SEQ ID NO: 50661

SEQ ID NO: 51518 - RNA, 64 nt, Human; identical to SEQ ID NO: 50662

SEQ ID NO: 51519 - RNA, 64 nt, Human; identical to SEQ ID NO: 50663

SEQ ID NO: 51520 - RNA, 64 nt, Human; identical to SEQ ID NO: 50664

SEQ ID NO: 51521 - RNA, 64 nt, Human; identical to SEQ ID NO: 50665

SEQ ID NO: 51522 - RNA, 64 nt, Human; identical to SEQ ID NO: 50666

SEQ ID NO: 51523 - RNA, 64 nt, Human; identical to SEQ ID NO: 50667

SEQ ID NO: 51524 - RNA, 64 nt, Human; identical to SEQ ID NO: 50668

SEQ ID NO: 51525 - RNA, 64 nt, Human; identical to SEQ ID NO: 50669

SEQ ID NO: 51526 - RNA, 64 nt, Human; identical to SEQ ID NO: 50670

SEQ ID NO: 51527 - RNA, 64 nt, Human; identical to SEQ ID NO: 50671

SEQ ID NO: 51528 - RNA, 64 nt, Human; identical to SEQ ID NO: 50672

SEQ ID NO: 51529 - RNA, 64 nt, Human; identical to SEQ ID NO: 50673

SEQ ID NO: 51530 - RNA, 64 nt, Human; identical to SEQ ID NO: 50674

SEQ ID NO: 51531 - RNA, 64 nt, Human; identical to SEQ ID NO: 50675

SEQ ID NO: 51532 - RNA, 64 nt, Human; identical to SEQ ID NO: 50676

SEQ ID NO: 51533 - RNA, 64 nt, Human; identical to SEQ ID NO: 50677

SEQ ID NO: 51534 - RNA, 64 nt, Human; identical to SEQ ID NO: 50678

SEQ ID NO: 51535 - RNA, 64 nt, Human; identical to SEQ ID NO: 50679

SEQ ID NO: 51536 - RNA, 64 nt, Human; identical to SEQ ID NO: 50680

SEQ ID NO: 51537 - RNA, 64 nt, Human; identical to SEQ ID NO: 50681

SEQ ID NO: 51538 - RNA, 64 nt, Human; identical to SEQ ID NO: 50682

SEQ ID NO: 51539 - RNA, 64 nt, Human; identical to SEQ ID NO: 50683

SEQ ID NO: 51540 - RNA, 64 nt, Human; identical to SEQ ID NO: 50684

SEQ ID NO: 51541 - RNA, 64 nt, Human; identical to SEQ ID NO: 50685

SEQ ID NO: 51542 - RNA, 64 nt, Human; identical to SEQ ID NO: 50686

SEQ ID NO: 51543 - RNA, 64 nt, Human; identical to SEQ ID NO: 50687

SEQ ID NO: 51544 - RNA, 64 nt, Human; identical to SEQ ID NO: 50688

SEQ ID NO: 51545 - RNA, 64 nt, Human; identical to SEQ ID NO: 50689

SEQ ID NO: 51546 - RNA, 64 nt, Human; identical to SEQ ID NO: 50690

SEQ ID NO: 51547 - RNA, 64 nt, Human; identical to SEQ ID NO: 50691

SEQ ID NO: 51548 - RNA, 64 nt, Human; identical to SEQ ID NO: 50692

SEQ ID NO: 51549 - RNA, 64 nt, Human; identical to SEQ ID NO: 50693

SEQ ID NO: 51550 - RNA, 64 nt, Human; identical to SEQ ID NO: 50694

SEQ ID NO: 51551 - RNA, 64 nt, Human; identical to SEQ ID NO: 50695

SEQ ID NO: 51552 - RNA, 64 nt, Human; identical to SEQ ID NO: 50696

SEQ ID NO: 51553 - RNA, 64 nt, Human; identical to SEQ ID NO: 50697

SEQ ID NO: 51554 - RNA, 64 nt, Human; identical to SEQ ID NO: 50698

SEQ ID NO: 51555 - RNA, 64 nt, Human; identical to SEQ ID NO: 50699

SEQ ID NO: 51556 - RNA, 53 nt, Human; identical to SEQ ID NO: 50700

SEQ ID NO: 51557 - RNA, 64 nt, Human; identical to SEQ ID NO: 50701

SEQ ID NO: 51558 - RNA, 64 nt, Human; identical to SEQ ID NO: 50702

SEQ ID NO: 51559 - RNA, 64 nt, Human; identical to SEQ ID NO: 50703

SEQ ID NO: 51560 - RNA, 64 nt, Human; identical to SEQ ID NO: 50704

SEQ ID NO: 51561 - RNA, 64 nt, Human; identical to SEQ ID NO: 50705

SEQ ID NO: 51562 - RNA, 64 nt, Human; identical to SEQ ID NO: 50706

SEQ ID NO: 51563 - RNA, 64 nt, Human; identical to SEQ ID NO: 50707

SEQ ID NO: 51564 - RNA, 64 nt, Human; identical to SEQ ID NO: 50708

SEQ ID NO: 51565 - RNA, 64 nt, Human; identical to SEQ ID NO: 50709

SEQ ID NO: 51566 - RNA, 64 nt, Human; identical to SEQ ID NO: 50710

SEQ ID NO: 51567 - RNA, 64 nt, Human; identical to SEQ ID NO: 50711

SEQ ID NO: 51568 - RNA, 64 nt, Human; identical to SEQ ID NO: 50712

SEQ ID NO: 51569 - RNA, 64 nt, Human; identical to SEQ ID NO: 50713

SEQ ID NO: 51570 - RNA, 64 nt, Human; identical to SEQ ID NO: 50714

SEQ ID NO: 51571 - RNA, 64 nt, Human; identical to SEQ ID NO: 50715

SEQ ID NO: 51572 - RNA, 64 nt, Human; identical to SEQ ID NO: 50716

SEQ ID NO: 51573 - RNA, 64 nt, Human; identical to SEQ ID NO: 50717

SEQ ID NO: 51574 - RNA, 64 nt, Human; identical to SEQ ID NO: 50718

SEQ ID NO: 51575 - RNA, 64 nt, Human; identical to SEQ ID NO: 50719

SEQ ID NO: 51576 - RNA, 64 nt, Human; identical to SEQ ID NO: 50720

SEQ ID NO: 51577 - RNA, 64 nt, Human; identical to SEQ ID NO: 50721

SEQ ID NO: 51578 - RNA, 64 nt, Human; identical to SEQ ID NO: 50722

SEQ ID NO: 51579 - RNA, 64 nt, Human; identical to SEQ ID NO: 50723

SEQ ID NO: 51580 - RNA, 64 nt, Human; identical to SEQ ID NO: 50724

SEQ ID NO: 51581 - RNA, 64 nt, Human; identical to SEQ ID NO: 50725

SEQ ID NO: 51582 - RNA, 64 nt, Human; identical to SEQ ID NO: 50726

SEQ ID NO: 51583 - RNA, 64 nt, Human; identical to SEQ ID NO: 50727

SEQ ID NO: 51584 - RNA, 64 nt, Human; identical to SEQ ID NO: 50728

SEQ ID NO: 51585 - RNA, 64 nt, Human; identical to SEQ ID NO: 50729

SEQ ID NO: 51586 - RNA, 64 nt, Human; identical to SEQ ID NO: 50730

SEQ ID NO: 51587 - RNA, 64 nt, Human; identical to SEQ ID NO: 50731

SEQ ID NO: 51588 - RNA, 64 nt, Human; identical to SEQ ID NO: 50732

SEQ ID NO: 51589 - RNA, 64 nt, Human; identical to SEQ ID NO: 50733

SEQ ID NO: 51590 - RNA, 64 nt, Human; identical to SEQ ID NO: 50734

SEQ ID NO: 51591 - RNA, 64 nt, Human; identical to SEQ ID NO: 50735

SEQ ID NO: 51592 - RNA, 64 nt, Human; identical to SEQ ID NO: 50736

SEQ ID NO: 51593 - RNA, 64 nt, Human; identical to SEQ ID NO: 50737

SEQ ID NO: 51594 - RNA, 64 nt, Human; identical to SEQ ID NO: 50738

SEQ ID NO: 51595 - RNA, 64 nt, Human; identical to SEQ ID NO: 50739

SEQ ID NO: 51596 - RNA, 64 nt, Human; identical to SEQ ID NO: 50740

SEQ ID NO: 51597 - RNA, 64 nt, Human; identical to SEQ ID NO: 50741

SEQ ID NO: 51598 - RNA, 64 nt, Human; identical to SEQ ID NO: 50742

SEQ ID NO: 51599 - RNA, 64 nt, Human; identical to SEQ ID NO: 50743

SEQ ID NO: 51600 - RNA, 64 nt, Human; identical to SEQ ID NO: 50744

SEQ ID NO: 51601 - RNA, 64 nt, Human; identical to SEQ ID NO: 50745

SEQ ID NO: 51602 - RNA, 64 nt, Human; identical to SEQ ID NO: 50746

SEQ ID NO: 51603 - RNA, 64 nt, Human; identical to SEQ ID NO: 50747

SEQ ID NO: 51604 - RNA, 64 nt, Human; identical to SEQ ID NO: 50748

SEQ ID NO: 51605 - RNA, 64 nt, Human; identical to SEQ ID NO: 50749

SEQ ID NO: 51606 - RNA, 64 nt, Human; identical to SEQ ID NO: 50750

SEQ ID NO: 51607 - RNA, 64 nt, Human; identical to SEQ ID NO: 50751

SEQ ID NO: 51608 - RNA, 64 nt, Human; identical to SEQ ID NO: 50752

SEQ ID NO: 51609 - RNA, 64 nt, Human; identical to SEQ ID NO: 50753

SEQ ID NO: 51610 - RNA, 64 nt, Human; identical to SEQ ID NO: 50754

SEQ ID NO: 51611 - RNA, 64 nt, Human; identical to SEQ ID NO: 50755

SEQ ID NO: 51612 - RNA, 64 nt, Human; identical to SEQ ID NO: 50756

SEQ ID NO: 51613 - RNA, 64 nt, Human; identical to SEQ ID NO: 50757

SEQ ID NO: 51614 - RNA, 64 nt, Human; identical to SEQ ID NO: 50758

SEQ ID NO: 51615 - RNA, 64 nt, Human; identical to SEQ ID NO: 50759

SEQ ID NO: 51616 - RNA, 64 nt, Human; identical to SEQ ID NO: 50760

SEQ ID NO: 51617 - RNA, 64 nt, Human; identical to SEQ ID NO: 50761

SEQ ID NO: 51618 - RNA, 64 nt, Human; identical to SEQ ID NO: 50762

SEQ ID NO: 51619 - RNA, 64 nt, Human; identical to SEQ ID NO: 50763

SEQ ID NO: 51620 - RNA, 64 nt, Human; identical to SEQ ID NO: 50764

SEQ ID NO: 51621 - RNA, 64 nt, Human; identical to SEQ ID NO: 50765

SEQ ID NO: 51622 - RNA, 64 nt, Human; identical to SEQ ID NO: 50766

SEQ ID NO: 51623 - RNA, 64 nt, Human; identical to SEQ ID NO: 50767

SEQ ID NO: 51624 - RNA, 64 nt, Human; identical to SEQ ID NO: 50768

SEQ ID NO: 51625 - RNA, 64 nt, Human; identical to SEQ ID NO: 50769

SEQ ID NO: 51626 - RNA, 64 nt, Human; identical to SEQ ID NO: 50770

SEQ ID NO: 51627 - RNA, 64 nt, Human; identical to SEQ ID NO: 50771

SEQ ID NO: 51628 - RNA, 64 nt, Human; identical to SEQ ID NO: 50772

SEQ ID NO: 51629 - RNA, 64 nt, Human; identical to SEQ ID NO: 50773

SEQ ID NO: 51630 - RNA, 64 nt, Human; identical to SEQ ID NO: 50774

SEQ ID NO: 51631 - RNA, 64 nt, Human; identical to SEQ ID NO: 50775

SEQ ID NO: 51632 - RNA, 64 nt, Human; identical to SEQ ID NO: 50776

SEQ ID NO: 51633 - RNA, 64 nt, Human; identical to SEQ ID NO: 50777

SEQ ID NO: 51634 - RNA, 64 nt, Human; identical to SEQ ID NO: 50778

SEQ ID NO: 51635 - RNA, 64 nt, Human; identical to SEQ ID NO: 50779

SEQ ID NO: 51636 - RNA, 64 nt, Human; identical to SEQ ID NO: 50780

SEQ ID NO: 51637 - RNA, 64 nt, Human; identical to SEQ ID NO: 50781

SEQ ID NO: 51638 - RNA, 64 nt, Human; identical to SEQ ID NO: 50782

SEQ ID NO: 51639 - RNA, 64 nt, Human; identical to SEQ ID NO: 50783

SEQ ID NO: 51640 - RNA, 64 nt, Human; identical to SEQ ID NO: 50784

SEQ ID NO: 51641 - RNA, 64 nt, Human; identical to SEQ ID NO: 50785

SEQ ID NO: 51642 - RNA, 64 nt, Human; identical to SEQ ID NO: 50786

SEQ ID NO: 51643 - RNA, 64 nt, Human; identical to SEQ ID NO: 50787

SEQ ID NO: 51644 - RNA, 64 nt, Human; identical to SEQ ID NO: 50788

SEQ ID NO: 51645 - RNA, 64 nt, Human; identical to SEQ ID NO: 50789

SEQ ID NO: 51646 - RNA, 64 nt, Human; identical to SEQ ID NO: 50790

SEQ ID NO: 51647 - RNA, 64 nt, Human; identical to SEQ ID NO: 50791

SEQ ID NO: 51648 - RNA, 64 nt, Human; identical to SEQ ID NO: 50792

SEQ ID NO: 51649 - RNA, 64 nt, Human; identical to SEQ ID NO: 50793

SEQ ID NO: 51650 - RNA, 64 nt, Human; identical to SEQ ID NO: 50794

SEQ ID NO: 51651 - RNA, 64 nt, Human; identical to SEQ ID NO: 50795

SEQ ID NO: 51652 - RNA, 64 nt, Human; identical to SEQ ID NO: 50796

SEQ ID NO: 51653 - RNA, 64 nt, Human; identical to SEQ ID NO: 50797

SEQ ID NO: 51654 - RNA, 64 nt, Human; identical to SEQ ID NO: 50798

SEQ ID NO: 51655 - RNA, 64 nt, Human; identical to SEQ ID NO: 50799

SEQ ID NO: 51656 - RNA, 64 nt, Human; identical to SEQ ID NO: 50800

SEQ ID NO: 51657 - RNA, 64 nt, Human; identical to SEQ ID NO: 50801

SEQ ID NO: 51658 - RNA, 64 nt, Human; identical to SEQ ID NO: 50802

SEQ ID NO: 51659 - RNA, 64 nt, Human; identical to SEQ ID NO: 50803

SEQ ID NO: 51660 - RNA, 64 nt, Human; identical to SEQ ID NO: 50804

SEQ ID NO: 51661 - RNA, 64 nt, Human; identical to SEQ ID NO: 50805

SEQ ID NO: 51662 - RNA, 64 nt, Human; identical to SEQ ID NO: 50806

SEQ ID NO: 51663 - RNA, 64 nt, Human; identical to SEQ ID NO: 50807

SEQ ID NO: 51664 - RNA, 64 nt, Human; identical to SEQ ID NO: 50808

SEQ ID NO: 51665 - RNA, 64 nt, Human; identical to SEQ ID NO: 50809

SEQ ID NO: 51666 - RNA, 64 nt, Human; identical to SEQ ID NO: 50810

SEQ ID NO: 51667 - RNA, 64 nt, Human; identical to SEQ ID NO: 50811

SEQ ID NO: 51668 - RNA, 64 nt, Human; identical to SEQ ID NO: 50812

SEQ ID NO: 51669 - RNA, 64 nt, Human; identical to SEQ ID NO: 50813

SEQ ID NO: 51670 - RNA, 64 nt, Human; identical to SEQ ID NO: 50814

SEQ ID NO: 51671 - RNA, 64 nt, Human; identical to SEQ ID NO: 50815

SEQ ID NO: 51672 - RNA, 58 nt, Human; identical to SEQ ID NO: 50816

SEQ ID NO: 51673 - RNA, 64 nt, Human; identical to SEQ ID NO: 50817

SEQ ID NO: 51674 - RNA, 64 nt, Human; identical to SEQ ID NO: 50818

SEQ ID NO: 51675 - RNA, 64 nt, Human; identical to SEQ ID NO: 50819

SEQ ID NO: 51676 - RNA, 64 nt, Human; identical to SEQ ID NO: 50820

SEQ ID NO: 51677 - RNA, 64 nt, Human; identical to SEQ ID NO: 50821

SEQ ID NO: 51678 - RNA, 64 nt, Human; identical to SEQ ID NO: 50822

SEQ ID NO: 51679 - RNA, 64 nt, Human; identical to SEQ ID NO: 50823

SEQ ID NO: 51680 - RNA, 64 nt, Human; identical to SEQ ID NO: 50824

SEQ ID NO: 51681 - RNA, 64 nt, Human; identical to SEQ ID NO: 50825

SEQ ID NO: 51682 - RNA, 64 nt, Human; identical to SEQ ID NO: 50826

SEQ ID NO: 51683 - RNA, 64 nt, Human; identical to SEQ ID NO: 50827

SEQ ID NO: 51684 - RNA, 64 nt, Human; identical to SEQ ID NO: 50828

SEQ ID NO: 51685 - RNA, 64 nt, Human; identical to SEQ ID NO: 50829

SEQ ID NO: 51686 - RNA, 64 nt, Human; identical to SEQ ID NO: 50830

SEQ ID NO: 51687 - RNA, 64 nt, Human; identical to SEQ ID NO: 50831

SEQ ID NO: 51688 - RNA, 64 nt, Human; identical to SEQ ID NO: 50832

SEQ ID NO: 51689 - RNA, 64 nt, Human; identical to SEQ ID NO: 50833

SEQ ID NO: 51690 - RNA, 64 nt, Human; identical to SEQ ID NO: 50834

SEQ ID NO: 51691 - RNA, 64 nt, Human; identical to SEQ ID NO: 50835

SEQ ID NO: 51692 - RNA, 64 nt, Human; identical to SEQ ID NO: 50836

SEQ ID NO: 51693 - RNA, 64 nt, Human; identical to SEQ ID NO: 50837

SEQ ID NO: 51694 - RNA, 64 nt, Human; identical to SEQ ID NO: 50838

SEQ ID NO: 51695 - RNA, 64 nt, Human; identical to SEQ ID NO: 50839

SEQ ID NO: 51696 - RNA, 64 nt, Human; identical to SEQ ID NO: 50840

SEQ ID NO: 51697 - RNA, 64 nt, Human; identical to SEQ ID NO: 50841

SEQ ID NO: 51698 - RNA, 64 nt, Human; identical to SEQ ID NO: 50842

SEQ ID NO: 51699 - RNA, 64 nt, Human; identical to SEQ ID NO: 50843

SEQ ID NO: 51700 - RNA, 64 nt, Human; identical to SEQ ID NO: 50844

SEQ ID NO: 51701 - RNA, 64 nt, Human; identical to SEQ ID NO: 50845

SEQ ID NO: 51702 - RNA, 64 nt, Human; identical to SEQ ID NO: 50846

SEQ ID NO: 51703 - RNA, 64 nt, Human; identical to SEQ ID NO: 50847

SEQ ID NO: 51704 - RNA, 64 nt, Human; identical to SEQ ID NO: 50848

SEQ ID NO: 51705 - RNA, 64 nt, Human; identical to SEQ ID NO: 50849

SEQ ID NO: 51706 - RNA, 64 nt, Human; identical to SEQ ID NO: 50850

SEQ ID NO: 51707 - RNA, 64 nt, Human; identical to SEQ ID NO: 50851

SEQ ID NO: 51708 - RNA, 64 nt, Human; identical to SEQ ID NO: 50852

SEQ ID NO: 51709 - RNA, 64 nt, Human; identical to SEQ ID NO: 50853

SEQ ID NO: 51710 - RNA, 64 nt, Human; identical to SEQ ID NO: 50854

SEQ ID NO: 51711 - RNA, 64 nt, Human; identical to SEQ ID NO: 50855

SEQ ID NO: 51712 - RNA, 57 nt, Human; identical to SEQ ID NO: 50856

SEQ ID NO: 51713 - RNA, 64 nt, Human; identical to SEQ ID NO: 50857

SEQ ID NO: 51714 - RNA, 64 nt, Human; identical to SEQ ID NO: 50858

SEQ ID NO: 51715 - RNA, 64 nt, Human; identical to SEQ ID NO: 50859

SEQ ID NO: 51716 - RNA, 64 nt, Human; identical to SEQ ID NO: 50860

SEQ ID NO: 51717 - RNA, 64 nt, Human; identical to SEQ ID NO: 50861

SEQ ID NO: 51718 - RNA, 64 nt, Human; identical to SEQ ID NO: 50862

SEQ ID NO: 51719 - RNA, 64 nt, Human; identical to SEQ ID NO: 50863

SEQ ID NO: 51720 - RNA, 64 nt, Human; identical to SEQ ID NO: 50864

SEQ ID NO: 51721 - RNA, 64 nt, Human; identical to SEQ ID NO: 50865

SEQ ID NO: 51722 - RNA, 64 nt, Human; identical to SEQ ID NO: 50866

SEQ ID NO: 51723 - RNA, 64 nt, Human; identical to SEQ ID NO: 50867

SEQ ID NO: 51724 - RNA, 64 nt, Human; identical to SEQ ID NO: 50868

SEQ ID NO: 51725 - RNA, 64 nt, Human; identical to SEQ ID NO: 50869

SEQ ID NO: 51726 - RNA, 64 nt, Human; identical to SEQ ID NO: 50870

SEQ ID NO: 51727 - RNA, 64 nt, Human; identical to SEQ ID NO: 50871

SEQ ID NO: 51728 - RNA, 64 nt, Human; identical to SEQ ID NO: 50872

SEQ ID NO: 51729 - RNA, 64 nt, Human; identical to SEQ ID NO: 50873

SEQ ID NO: 51730 - RNA, 64 nt, Human; identical to SEQ ID NO: 50874

SEQ ID NO: 51731 - RNA, 64 nt, Human; identical to SEQ ID NO: 50875

SEQ ID NO: 51732 - RNA, 64 nt, Human; identical to SEQ ID NO: 50876

SEQ ID NO: 51733 - RNA, 64 nt, Human; identical to SEQ ID NO: 50877

SEQ ID NO: 51734 - RNA, 64 nt, Human; identical to SEQ ID NO: 50878

SEQ ID NO: 51735 - RNA, 64 nt, Human; identical to SEQ ID NO: 50879

SEQ ID NO: 51736 - RNA, 64 nt, Human; identical to SEQ ID NO: 50880

SEQ ID NO: 51737 - RNA, 64 nt, Human; identical to SEQ ID NO: 50881

SEQ ID NO: 51738 - RNA, 64 nt, Human; identical to SEQ ID NO: 50882

SEQ ID NO: 51739 - RNA, 64 nt, Human; identical to SEQ ID NO: 50883

SEQ ID NO: 51740 - RNA, 64 nt, Human; identical to SEQ ID NO: 50884

SEQ ID NO: 51741 - RNA, 64 nt, Human; identical to SEQ ID NO: 50885

SEQ ID NO: 51742 - RNA, 64 nt, Human; identical to SEQ ID NO: 50886

SEQ ID NO: 51743 - RNA, 64 nt, Human; identical to SEQ ID NO: 50887

SEQ ID NO: 51744 - RNA, 64 nt, Human; identical to SEQ ID NO: 50888

SEQ ID NO: 51745 - RNA, 64 nt, Human; identical to SEQ ID NO: 50889

SEQ ID NO: 51746 - RNA, 64 nt, Human; identical to SEQ ID NO: 50890

SEQ ID NO: 51747 - RNA, 64 nt, Human; identical to SEQ ID NO: 50891

SEQ ID NO: 51748 - RNA, 64 nt, Human; identical to SEQ ID NO: 50892

SEQ ID NO: 51749 - RNA, 64 nt, Human; identical to SEQ ID NO: 50893

SEQ ID NO: 51750 - RNA, 64 nt, Human; identical to SEQ ID NO: 50894

SEQ ID NO: 51751 - RNA, 64 nt, Human; identical to SEQ ID NO: 50895

SEQ ID NO: 51752 - RNA, 64 nt, Human; identical to SEQ ID NO: 50896

SEQ ID NO: 51753 - RNA, 64 nt, Human; identical to SEQ ID NO: 50897

SEQ ID NO: 51754 - RNA, 64 nt, Human; identical to SEQ ID NO: 50898

SEQ ID NO: 51755 - RNA, 64 nt, Human; identical to SEQ ID NO: 50899

SEQ ID NO: 51756 - RNA, 64 nt, Human; identical to SEQ ID NO: 50900

SEQ ID NO: 51757 - RNA, 64 nt, Human; identical to SEQ ID NO: 50901

SEQ ID NO: 51758 - RNA, 64 nt, Human; identical to SEQ ID NO: 50902

SEQ ID NO: 51759 - RNA, 64 nt, Human; identical to SEQ ID NO: 50903

SEQ ID NO: 51760 - RNA, 64 nt, Human; identical to SEQ ID NO: 50904

SEQ ID NO: 51761 - RNA, 64 nt, Human; identical to SEQ ID NO: 50905

SEQ ID NO: 51762 - RNA, 64 nt, Human; identical to SEQ ID NO: 50906

SEQ ID NO: 51763 - RNA, 64 nt, Human; identical to SEQ ID NO: 50907

SEQ ID NO: 51764 - RNA, 53 nt, Human; identical to SEQ ID NO: 50908

SEQ ID NO: 51765 - RNA, 64 nt, Human; identical to SEQ ID NO: 50909

SEQ ID NO: 51766 - RNA, 64 nt, Human; identical to SEQ ID NO: 50910

SEQ ID NO: 51767 - RNA, 64 nt, Human; identical to SEQ ID NO: 50911

SEQ ID NO: 51768 - RNA, 64 nt, Human; identical to SEQ ID NO: 50912

SEQ ID NO: 51769 - RNA, 64 nt, Human; identical to SEQ ID NO: 50913

SEQ ID NO: 51770 - RNA, 64 nt, Human; identical to SEQ ID NO: 50914

SEQ ID NO: 51771 - RNA, 64 nt, Human; identical to SEQ ID NO: 50915

SEQ ID NO: 51772 - RNA, 64 nt, Human; identical to SEQ ID NO: 50916

SEQ ID NO: 51773 - RNA, 64 nt, Human; identical to SEQ ID NO: 50917

SEQ ID NO: 51774 - RNA, 64 nt, Human; identical to SEQ ID NO: 50918

SEQ ID NO: 51775 - RNA, 64 nt, Human; identical to SEQ ID NO: 50919

SEQ ID NO: 51776 - RNA, 64 nt, Human; identical to SEQ ID NO: 50920

SEQ ID NO: 51777 - RNA, 64 nt, Human; identical to SEQ ID NO: 50921

SEQ ID NO: 51778 - RNA, 64 nt, Human; identical to SEQ ID NO: 50922

SEQ ID NO: 51779 - RNA, 64 nt, Human; identical to SEQ ID NO: 50923

SEQ ID NO: 51780 - RNA, 64 nt, Human; identical to SEQ ID NO: 50924

SEQ ID NO: 51781 - RNA, 64 nt, Human; identical to SEQ ID NO: 50925

SEQ ID NO: 51782 - RNA, 64 nt, Human; identical to SEQ ID NO: 50926

SEQ ID NO: 51783 - RNA, 64 nt, Human; identical to SEQ ID NO: 50927

SEQ ID NO: 51784 - RNA, 64 nt, Human; identical to SEQ ID NO: 50928

SEQ ID NO: 51785 - RNA, 64 nt, Human; identical to SEQ ID NO: 50929

SEQ ID NO: 51786 - RNA, 54 nt, Human; identical to SEQ ID NO: 50930

SEQ ID NO: 51787 - RNA, 64 nt, Human; identical to SEQ ID NO: 50931

SEQ ID NO: 51788 - RNA, 64 nt, Human; identical to SEQ ID NO: 50932

SEQ ID NO: 51789 - RNA, 64 nt, Human; identical to SEQ ID NO: 50933

SEQ ID NO: 51790 - RNA, 64 nt, Human; identical to SEQ ID NO: 50934

SEQ ID NO: 51791 - RNA, 64 nt, Human; identical to SEQ ID NO: 50935

SEQ ID NO: 51792 - RNA, 64 nt, Human; identical to SEQ ID NO: 50936

SEQ ID NO: 51793 - RNA, 64 nt, Human; identical to SEQ ID NO: 50937

SEQ ID NO: 51794 - RNA, 64 nt, Human; identical to SEQ ID NO: 50938

SEQ ID NO: 51795 - RNA, 64 nt, Human; identical to SEQ ID NO: 50939

SEQ ID NO: 51796 - RNA, 64 nt, Human; identical to SEQ ID NO: 50940

SEQ ID NO: 51797 - RNA, 64 nt, Human; identical to SEQ ID NO: 50941

SEQ ID NO: 51798 - RNA, 64 nt, Human; identical to SEQ ID NO: 50942

SEQ ID NO: 51799 - RNA, 64 nt, Human; identical to SEQ ID NO: 50943

SEQ ID NO: 51800 - RNA, 64 nt, Human; identical to SEQ ID NO: 50944

SEQ ID NO: 51801 - RNA, 64 nt, Human; identical to SEQ ID NO: 50945

SEQ ID NO: 51802 - RNA, 64 nt, Human; identical to SEQ ID NO: 50946

SEQ ID NO: 51803 - RNA, 64 nt, Human; identical to SEQ ID NO: 50947

SEQ ID NO: 51804 - RNA, 64 nt, Human; identical to SEQ ID NO: 50948

SEQ ID NO: 51805 - RNA, 64 nt, Human; identical to SEQ ID NO: 50949

SEQ ID NO: 51806 - RNA, 64 nt, Human; identical to SEQ ID NO: 50950

SEQ ID NO: 51807 - RNA, 64 nt, Human; identical to SEQ ID NO: 50951

SEQ ID NO: 51808 - RNA, 64 nt, Human; identical to SEQ ID NO: 50952

SEQ ID NO: 51809 - RNA, 64 nt, Human; identical to SEQ ID NO: 50953

SEQ ID NO: 51810 - RNA, 64 nt, Human; identical to SEQ ID NO: 50954

SEQ ID NO: 51811 - RNA, 64 nt, Human; identical to SEQ ID NO: 50955

SEQ ID NO: 51812 - RNA, 64 nt, Human; identical to SEQ ID NO: 50956

SEQ ID NO: 51813 - RNA, 64 nt, Human; identical to SEQ ID NO: 50957

SEQ ID NO: 51814 - RNA, 64 nt, Human; identical to SEQ ID NO: 50958

SEQ ID NO: 51815 - RNA, 64 nt, Human; identical to SEQ ID NO: 50959

SEQ ID NO: 51816 - RNA, 64 nt, Human; identical to SEQ ID NO: 50960

SEQ ID NO: 51817 - RNA, 64 nt, Human; identical to SEQ ID NO: 50961

SEQ ID NO: 51818 - RNA, 64 nt, Human; identical to SEQ ID NO: 50962

SEQ ID NO: 51819 - RNA, 64 nt, Human; identical to SEQ ID NO: 50963

SEQ ID NO: 51820 - RNA, 64 nt, Human; identical to SEQ ID NO: 50964

SEQ ID NO: 51821 - RNA, 64 nt, Human; identical to SEQ ID NO: 50965

SEQ ID NO: 51822 - RNA, 64 nt, Human; identical to SEQ ID NO: 50966

SEQ ID NO: 51823 - RNA, 64 nt, Human; identical to SEQ ID NO: 50967

SEQ ID NO: 51824 - RNA, 64 nt, Human; identical to SEQ ID NO: 50968

SEQ ID NO: 51825 - RNA, 64 nt, Human; identical to SEQ ID NO: 50969

SEQ ID NO: 51826 - RNA, 64 nt, Human; identical to SEQ ID NO: 50970

SEQ ID NO: 51827 - RNA, 64 nt, Human; identical to SEQ ID NO: 50971

SEQ ID NO: 51828 - RNA, 64 nt, Human; identical to SEQ ID NO: 50972

SEQ ID NO: 51829 - RNA, 64 nt, Human; identical to SEQ ID NO: 50973

SEQ ID NO: 51830 - RNA, 64 nt, Human; identical to SEQ ID NO: 50974

SEQ ID NO: 51831 - RNA, 64 nt, Human; identical to SEQ ID NO: 50975

SEQ ID NO: 51832 - RNA, 64 nt, Human; identical to SEQ ID NO: 50976

SEQ ID NO: 51833 - RNA, 64 nt, Human; identical to SEQ ID NO: 50977

SEQ ID NO: 51834 - RNA, 64 nt, Human; identical to SEQ ID NO: 33511

SEQ ID NO: 51835 - RNA, 64 nt, Human; identical to SEQ ID NO: 33512

SEQ ID NO: 51836 - RNA, 64 nt, Human; identical to SEQ ID NO: 33513

SEQ ID NO: 51837 - RNA, 64 nt, Human; identical to SEQ ID NO: 33514

SEQ ID NO: 51838 - RNA, 64 nt, Human; identical to SEQ ID NO: 33515

SEQ ID NO: 51839 - RNA, 64 nt, Human; identical to SEQ ID NO: 33516

SEQ ID NO: 51840 - RNA, 64 nt, Human; identical to SEQ ID NO: 33517

SEQ ID NO: 51841 - RNA, 64 nt, Human; identical to SEQ ID NO: 33518

SEQ ID NO: 51842 - RNA, 64 nt, Human; identical to SEQ ID NO: 33519

SEQ ID NO: 51843 - RNA, 64 nt, Human; identical to SEQ ID NO: 33520

SEQ ID NO: 51844 - RNA, 64 nt, Human; identical to SEQ ID NO: 33521

SEQ ID NO: 51845 - RNA, 50 nt, Human; identical to SEQ ID NO: 33522

SEQ ID NO: 51846 - RNA, 64 nt, Human; identical to SEQ ID NO: 33523

SEQ ID NO: 51847 - RNA, 64 nt, Human
ugccaacuuucuggagaggugccaaacuugguguggccaggaaagggcaguccugagggagaag

SEQ ID NO: 51848 - RNA, 64 nt, Human; identical to SEQ ID NO: 33524

SEQ ID NO: 51849 - RNA, 64 nt, Human; identical to SEQ ID NO: 33525

SEQ ID NO: 51850 - RNA, 64 nt, Human; identical to SEQ ID NO: 33526

SEQ ID NO: 51851 - RNA, 64 nt, Human; identical to SEQ ID NO: 33527

SEQ ID NO: 51852 - RNA, 64 nt, Human; identical to SEQ ID NO: 33528

SEQ ID NO: 51853 - RNA, 64 nt, Human; identical to SEQ ID NO: 33529

SEQ ID NO: 51854 - RNA, 64 nt, Human; identical to SEQ ID NO: 33530

SEQ ID NO: 51855 - RNA, 64 nt, Human; identical to SEQ ID NO: 33531

SEQ ID NO: 51856 - RNA, 64 nt, Human; identical to SEQ ID NO: 33532

SEQ ID NO: 51857 - RNA, 64 nt, Human; identical to SEQ ID NO: 33533

SEQ ID NO: 51858 - RNA, 64 nt, Human; identical to SEQ ID NO: 33534

SEQ ID NO: 51859 - RNA, 64 nt, Human; identical to SEQ ID NO: 33535

SEQ ID NO: 51860 - RNA, 64 nt, Human; identical to SEQ ID NO: 33536

SEQ ID NO: 51861 - RNA, 64 nt, Human; identical to SEQ ID NO: 33537

SEQ ID NO: 51862 - RNA, 64 nt, Human; identical to SEQ ID NO: 33538

SEQ ID NO: 51863 - RNA, 64 nt, Human; identical to SEQ ID NO: 33539

SEQ ID NO: 51864 - RNA, 64 nt, Human; identical to SEQ ID NO: 33540

SEQ ID NO: 51865 - RNA, 64 nt, Human; identical to SEQ ID NO: 33541

SEQ ID NO: 51866 - RNA, 64 nt, Human; identical to SEQ ID NO: 33542

SEQ ID NO: 51867 - RNA, 64 nt, Human; identical to SEQ ID NO: 33543

SEQ ID NO: 51868 - RNA, 64 nt, Human; identical to SEQ ID NO: 33544

SEQ ID NO: 51869 - RNA, 64 nt, Human; identical to SEQ ID NO: 33545

SEQ ID NO: 51870 - RNA, 64 nt, Human; identical to SEQ ID NO: 33546

SEQ ID NO: 51871 - RNA, 64 nt, Human; identical to SEQ ID NO: 33547

SEQ ID NO: 51872 - RNA, 64 nt, Human; identical to SEQ ID NO: 33548

SEQ ID NO: 51873 - RNA, 64 nt, Human; identical to SEQ ID NO: 33549

SEQ ID NO: 51874 - RNA, 64 nt, Human; identical to SEQ ID NO: 33550

SEQ ID NO: 51875 - RNA, 64 nt, Human; identical to SEQ ID NO: 33551

SEQ ID NO: 51876 - RNA, 64 nt, Human; identical to SEQ ID NO: 33552

SEQ ID NO: 51877 - RNA, 64 nt, Human; identical to SEQ ID NO: 33553

SEQ ID NO: 51878 - RNA, 64 nt, Human; identical to SEQ ID NO: 33554

SEQ ID NO: 51879 - RNA, 64 nt, Human; identical to SEQ ID NO: 33555

SEQ ID NO: 51880 - RNA, 64 nt, Human; identical to SEQ ID NO: 33556

SEQ ID NO: 51881 - RNA, 64 nt, Human; identical to SEQ ID NO: 33557

SEQ ID NO: 51882 - RNA, 64 nt, Human; identical to SEQ ID NO: 33558

SEQ ID NO: 51883 - RNA, 64 nt, Human; identical to SEQ ID NO: 33559

SEQ ID NO: 51884 - RNA, 64 nt, Human; identical to SEQ ID NO: 33560

SEQ ID NO: 51885 - RNA, 64 nt, Human; identical to SEQ ID NO: 33561

SEQ ID NO: 51886 - RNA, 64 nt, Human; identical to SEQ ID NO: 33562

SEQ ID NO: 51887 - RNA, 64 nt, Human; identical to SEQ ID NO: 33563

SEQ ID NO: 51888 - RNA, 64 nt, Human; identical to SEQ ID NO: 33564

SEQ ID NO: 51889 - RNA, 64 nt, Human; identical to SEQ ID NO: 33565

SEQ ID NO: 51890 - RNA, 64 nt, Human; identical to SEQ ID NO: 33566

SEQ ID NO: 51891 - RNA, 64 nt, Human; identical to SEQ ID NO: 33567

SEQ ID NO: 51892 - RNA, 64 nt, Human; identical to SEQ ID NO: 33568

SEQ ID NO: 51893 - RNA, 64 nt, Human; identical to SEQ ID NO: 33569

SEQ ID NO: 51894 - RNA, 64 nt, Human; identical to SEQ ID NO: 33570

SEQ ID NO: 51895 - RNA, 64 nt, Human; identical to SEQ ID NO: 33571

SEQ ID NO: 51896 - RNA, 64 nt, Human; identical to SEQ ID NO: 33572

SEQ ID NO: 51897 - RNA, 64 nt, Human; identical to SEQ ID NO: 33573

SEQ ID NO: 51898 - RNA, 64 nt, Human; identical to SEQ ID NO: 33574

SEQ ID NO: 51899 - RNA, 64 nt, Human; identical to SEQ ID NO: 33575

SEQ ID NO: 51900 - RNA, 64 nt, Human; identical to SEQ ID NO: 33576

SEQ ID NO: 51901 - RNA, 64 nt, Human; identical to SEQ ID NO: 33577

SEQ ID NO: 51902 - RNA, 64 nt, Human; identical to SEQ ID NO: 33578

SEQ ID NO: 51903 - RNA, 64 nt, Human; identical to SEQ ID NO: 33579

SEQ ID NO: 51904 - RNA, 64 nt, Human; identical to SEQ ID NO: 33580

SEQ ID NO: 51905 - RNA, 64 nt, Human; identical to SEQ ID NO: 33581

SEQ ID NO: 51906 - RNA, 64 nt, Human; identical to SEQ ID NO: 33582

SEQ ID NO: 51907 - RNA, 64 nt, Human; identical to SEQ ID NO: 33583

SEQ ID NO: 51908 - RNA, 64 nt, Human; identical to SEQ ID NO: 33584

SEQ ID NO: 51909 - RNA, 64 nt, Human; identical to SEQ ID NO: 33585

SEQ ID NO: 51910 - RNA, 64 nt, Human; identical to SEQ ID NO: 33586

SEQ ID NO: 51911 - RNA, 64 nt, Human; identical to SEQ ID NO: 33587

SEQ ID NO: 51912 - RNA, 64 nt, Human; identical to SEQ ID NO: 33588

SEQ ID NO: 51913 - RNA, 64 nt, Human; identical to SEQ ID NO: 33589

SEQ ID NO: 51914 - RNA, 64 nt, Human; identical to SEQ ID NO: 33590

SEQ ID NO: 51915 - RNA, 64 nt, Human; identical to SEQ ID NO: 33591

SEQ ID NO: 51916 - RNA, 64 nt, Human; identical to SEQ ID NO: 33592

SEQ ID NO: 51917 - RNA, 64 nt, Human; identical to SEQ ID NO: 33593

SEQ ID NO: 51918 - RNA, 64 nt, Human; identical to SEQ ID NO: 33594

SEQ ID NO: 51919 - RNA, 64 nt, Human; identical to SEQ ID NO: 33595

SEQ ID NO: 51920 - RNA, 64 nt, Human; identical to SEQ ID NO: 33596

SEQ ID NO: 51921 - RNA, 64 nt, Human; identical to SEQ ID NO: 33597

SEQ ID NO: 51922 - RNA, 64 nt, Human; identical to SEQ ID NO: 33598

SEQ ID NO: 51923 - RNA, 64 nt, Human; identical to SEQ ID NO: 33599

SEQ ID NO: 51924 - RNA, 64 nt, Human; identical to SEQ ID NO: 33600

SEQ ID NO: 51925 - RNA, 64 nt, Human; identical to SEQ ID NO: 33601

SEQ ID NO: 51926 - RNA, 64 nt, Human; identical to SEQ ID NO: 33602

SEQ ID NO: 51927 - RNA, 64 nt, Human; identical to SEQ ID NO: 33603

SEQ ID NO: 51928 - RNA, 64 nt, Human; identical to SEQ ID NO: 33604

SEQ ID NO: 51929 - RNA, 64 nt, Human; identical to SEQ ID NO: 33605

SEQ ID NO: 51930 - RNA, 64 nt, Human; identical to SEQ ID NO: 33606

SEQ ID NO: 51931 - RNA, 64 nt, Human; identical to SEQ ID NO: 33607

SEQ ID NO: 51932 - RNA, 64 nt, Human; identical to SEQ ID NO: 33608

SEQ ID NO: 51933 - RNA, 64 nt, Human; identical to SEQ ID NO: 33609

SEQ ID NO: 51934 - RNA, 64 nt, Human; identical to SEQ ID NO: 33610

SEQ ID NO: 51935 - RNA, 64 nt, Human; identical to SEQ ID NO: 33611

SEQ ID NO: 51936 - RNA, 64 nt, Human; identical to SEQ ID NO: 33612

SEQ ID NO: 51937 - RNA, 64 nt, Human; identical to SEQ ID NO: 33613

SEQ ID NO: 51938 - RNA, 64 nt, Human; identical to SEQ ID NO: 33614

SEQ ID NO: 51939 - RNA, 64 nt, Human; identical to SEQ ID NO: 33615

SEQ ID NO: 51940 - RNA, 64 nt, Human; identical to SEQ ID NO: 33616

SEQ ID NO: 51941 - RNA, 64 nt, Human; identical to SEQ ID NO: 33617

SEQ ID NO: 51942 - RNA, 64 nt, Human; identical to SEQ ID NO: 33618

SEQ ID NO: 51943 - RNA, 64 nt, Human; identical to SEQ ID NO: 33619

SEQ ID NO: 51944 - RNA, 64 nt, Human; identical to SEQ ID NO: 33620

SEQ ID NO: 51945 - RNA, 64 nt, Human; identical to SEQ ID NO: 33621

SEQ ID NO: 51946 - RNA, 64 nt, Human; identical to SEQ ID NO: 33622

SEQ ID NO: 51947 - RNA, 64 nt, Human; identical to SEQ ID NO: 33623

SEQ ID NO: 51948 - RNA, 64 nt, Human; identical to SEQ ID NO: 33624

SEQ ID NO: 51949 - RNA, 64 nt, Human; identical to SEQ ID NO: 33625

SEQ ID NO: 51950 - RNA, 64 nt, Human; identical to SEQ ID NO: 33626

SEQ ID NO: 51951 - RNA, 64 nt, Human; identical to SEQ ID NO: 33627

SEQ ID NO: 51952 - RNA, 64 nt, Human; identical to SEQ ID NO: 33628

SEQ ID NO: 51953 - RNA, 64 nt, Human; identical to SEQ ID NO: 33629

SEQ ID NO: 51954 - RNA, 64 nt, Human; identical to SEQ ID NO: 33630

SEQ ID NO: 51955 - RNA, 64 nt, Human; identical to SEQ ID NO: 33631

SEQ ID NO: 51956 - RNA, 64 nt, Human; identical to SEQ ID NO: 33632

SEQ ID NO: 51957 - RNA, 64 nt, Human; identical to SEQ ID NO: 33633

SEQ ID NO: 51958 - RNA, 64 nt, Human; identical to SEQ ID NO: 33634

SEQ ID NO: 51959 - RNA, 64 nt, Human; identical to SEQ ID NO: 33635

SEQ ID NO: 51960 - RNA, 64 nt, Human; identical to SEQ ID NO: 33636

SEQ ID NO: 51961 - RNA, 64 nt, Human; identical to SEQ ID NO: 33637

SEQ ID NO: 51962 - RNA, 64 nt, Human; identical to SEQ ID NO: 33638

SEQ ID NO: 51963 - RNA, 64 nt, Human; identical to SEQ ID NO: 33639

SEQ ID NO: 51964 - RNA, 64 nt, Human; identical to SEQ ID NO: 33640

SEQ ID NO: 51965 - RNA, 64 nt, Human; identical to SEQ ID NO: 33641

SEQ ID NO: 51966 - RNA, 64 nt, Human; identical to SEQ ID NO: 33642

SEQ ID NO: 51967 - RNA, 64 nt, Human; identical to SEQ ID NO: 33643

SEQ ID NO: 51968 - RNA, 64 nt, Human; identical to SEQ ID NO: 33644

SEQ ID NO: 51969 - RNA, 64 nt, Human; identical to SEQ ID NO: 33645

SEQ ID NO: 51970 - RNA, 64 nt, Human; identical to SEQ ID NO: 33646

SEQ ID NO: 51971 - RNA, 64 nt, Human; identical to SEQ ID NO: 33647

SEQ ID NO: 51972 - RNA, 64 nt, Human; identical to SEQ ID NO: 33648

SEQ ID NO: 51973 - RNA, 64 nt, Human; identical to SEQ ID NO: 33649

SEQ ID NO: 51974 - RNA, 64 nt, Human; identical to SEQ ID NO: 33650

SEQ ID NO: 51975 - RNA, 64 nt, Human; identical to SEQ ID NO: 33651

SEQ ID NO: 51976 - RNA, 64 nt, Human; identical to SEQ ID NO: 33652

SEQ ID NO: 51977 - RNA, 64 nt, Human; identical to SEQ ID NO: 33653

SEQ ID NO: 51978 - RNA, 64 nt, Human; identical to SEQ ID NO: 33654

SEQ ID NO: 51979 - RNA, 64 nt, Human; identical to SEQ ID NO: 33655

SEQ ID NO: 51980 - RNA, 64 nt, Human; identical to SEQ ID NO: 33656

SEQ ID NO: 51981 - RNA, 64 nt, Human; identical to SEQ ID NO: 33657

SEQ ID NO: 51982 - RNA, 64 nt, Human; identical to SEQ ID NO: 33658

SEQ ID NO: 51983 - RNA, 64 nt, Human; identical to SEQ ID NO: 33659

SEQ ID NO: 51984 - RNA, 64 nt, Human; identical to SEQ ID NO: 33660

SEQ ID NO: 51985 - RNA, 64 nt, Human; identical to SEQ ID NO: 33661

SEQ ID NO: 51986 - RNA, 64 nt, Human; identical to SEQ ID NO: 33662

SEQ ID NO: 51987 - RNA, 64 nt, Human; identical to SEQ ID NO: 33663

SEQ ID NO: 51988 - RNA, 64 nt, Human; identical to SEQ ID NO: 33664

SEQ ID NO: 51989 - RNA, 64 nt, Human; identical to SEQ ID NO: 33665

SEQ ID NO: 51990 - RNA, 64 nt, Human; identical to SEQ ID NO: 33666

SEQ ID NO: 51991 - RNA, 64 nt, Human; identical to SEQ ID NO: 33667

SEQ ID NO: 51992 - RNA, 64 nt, Human; identical to SEQ ID NO: 33668

SEQ ID NO: 51993 - RNA, 53 nt, Human; identical to SEQ ID NO: 33669

SEQ ID NO: 51994 - RNA, 64 nt, Human; identical to SEQ ID NO: 33670

SEQ ID NO: 51995 - RNA, 64 nt, Human; identical to SEQ ID NO: 33671

SEQ ID NO: 51996 - RNA, 64 nt, Human; identical to SEQ ID NO: 33672

SEQ ID NO: 51997 - RNA, 64 nt, Human; identical to SEQ ID NO: 33673

SEQ ID NO: 51998 - RNA, 64 nt, Human; identical to SEQ ID NO: 33674

SEQ ID NO: 51999 - RNA, 64 nt, Human; identical to SEQ ID NO: 33675

SEQ ID NO: 52000 - RNA, 64 nt, Human; identical to SEQ ID NO: 33676

SEQ ID NO: 52001 - RNA, 64 nt, Human; identical to SEQ ID NO: 33677

SEQ ID NO: 52002 - RNA, 64 nt, Human; identical to SEQ ID NO: 33678

SEQ ID NO: 52003 - RNA, 64 nt, Human; identical to SEQ ID NO: 33679

SEQ ID NO: 52004 - RNA, 64 nt, Human; identical to SEQ ID NO: 33680

SEQ ID NO: 52005 - RNA, 64 nt, Human; identical to SEQ ID NO: 33681

SEQ ID NO: 52006 - RNA, 64 nt, Human; identical to SEQ ID NO: 33682

SEQ ID NO: 52007 - RNA, 64 nt, Human; identical to SEQ ID NO: 33683

SEQ ID NO: 52008 - RNA, 64 nt, Human; identical to SEQ ID NO: 33684

SEQ ID NO: 52009 - RNA, 64 nt, Human; identical to SEQ ID NO: 33685

SEQ ID NO: 52010 - RNA, 64 nt, Human; identical to SEQ ID NO: 33686

SEQ ID NO: 52011 - RNA, 64 nt, Human; identical to SEQ ID NO: 33687

SEQ ID NO: 52012 - RNA, 64 nt, Human; identical to SEQ ID NO: 33688

SEQ ID NO: 52013 - RNA, 64 nt, Human; identical to SEQ ID NO: 33689

SEQ ID NO: 52014 - RNA, 64 nt, Human; identical to SEQ ID NO: 33690

SEQ ID NO: 52015 - RNA, 64 nt, Human; identical to SEQ ID NO: 33691

SEQ ID NO: 52016 - RNA, 64 nt, Human; identical to SEQ ID NO: 33692

SEQ ID NO: 52017 - RNA, 64 nt, Human; identical to SEQ ID NO: 33693

SEQ ID NO: 52018 - RNA, 64 nt, Human; identical to SEQ ID NO: 33694

SEQ ID NO: 52019 - RNA, 64 nt, Human; identical to SEQ ID NO: 33695

SEQ ID NO: 52020 - RNA, 64 nt, Human; identical to SEQ ID NO: 33696

SEQ ID NO: 52021 - RNA, 64 nt, Human; identical to SEQ ID NO: 33697

SEQ ID NO: 52022 - RNA, 64 nt, Human; identical to SEQ ID NO: 33698

SEQ ID NO: 52023 - RNA, 64 nt, Human; identical to SEQ ID NO: 33699

SEQ ID NO: 52024 - RNA, 64 nt, Human; identical to SEQ ID NO: 33700

SEQ ID NO: 52025 - RNA, 64 nt, Human; identical to SEQ ID NO: 33701

SEQ ID NO: 52026 - RNA, 64 nt, Human; identical to SEQ ID NO: 33702

SEQ ID NO: 52027 - RNA, 64 nt, Human; identical to SEQ ID NO: 33703

SEQ ID NO: 52028 - RNA, 64 nt, Human; identical to SEQ ID NO: 33704

SEQ ID NO: 52029 - RNA, 64 nt, Human; identical to SEQ ID NO: 33705

SEQ ID NO: 52030 - RNA, 64 nt, Human; identical to SEQ ID NO: 33706

SEQ ID NO: 52031 - RNA, 64 nt, Human; identical to SEQ ID NO: 33707

SEQ ID NO: 52032 - RNA, 64 nt, Human; identical to SEQ ID NO: 33708

SEQ ID NO: 52033 - RNA, 64 nt, Human; identical to SEQ ID NO: 33709

SEQ ID NO: 52034 - RNA, 64 nt, Human; identical to SEQ ID NO: 33710

SEQ ID NO: 52035 - RNA, 64 nt, Human; identical to SEQ ID NO: 33711

SEQ ID NO: 52036 - RNA, 64 nt, Human; identical to SEQ ID NO: 33712

SEQ ID NO: 52037 - RNA, 64 nt, Human; identical to SEQ ID NO: 33713

SEQ ID NO: 52038 - RNA, 64 nt, Human; identical to SEQ ID NO: 33714

SEQ ID NO: 52039 - RNA, 64 nt, Human; identical to SEQ ID NO: 33715

SEQ ID NO: 52040 - RNA, 64 nt, Human; identical to SEQ ID NO: 33716

SEQ ID NO: 52041 - RNA, 64 nt, Human; identical to SEQ ID NO: 33717

SEQ ID NO: 52042 - RNA, 55 nt, Human; identical to SEQ ID NO: 33718

SEQ ID NO: 52043 - RNA, 64 nt, Human; identical to SEQ ID NO: 33719

SEQ ID NO: 52044 - RNA, 64 nt, Human; identical to SEQ ID NO: 33720

SEQ ID NO: 52045 - RNA, 64 nt, Human; identical to SEQ ID NO: 33721

SEQ ID NO: 52046 - RNA, 64 nt, Human; identical to SEQ ID NO: 33722

SEQ ID NO: 52047 - RNA, 64 nt, Human; identical to SEQ ID NO: 33723

SEQ ID NO: 52048 - RNA, 55 nt, Human; identical to SEQ ID NO: 33724

SEQ ID NO: 52049 - RNA, 64 nt, Human; identical to SEQ ID NO: 33725

SEQ ID NO: 52050 - RNA, 64 nt, Human; identical to SEQ ID NO: 33726

SEQ ID NO: 52051 - RNA, 64 nt, Human; identical to SEQ ID NO: 33727

SEQ ID NO: 52052 - RNA, 64 nt, Human; identical to SEQ ID NO: 33728

SEQ ID NO: 52053 - RNA, 64 nt, Human; identical to SEQ ID NO: 33729

SEQ ID NO: 52054 - RNA, 64 nt, Human; identical to SEQ ID NO: 33730

SEQ ID NO: 52055 - RNA, 64 nt, Human; identical to SEQ ID NO: 33731

SEQ ID NO: 52056 - RNA, 64 nt, Human; identical to SEQ ID NO: 33732

SEQ ID NO: 52057 - RNA, 64 nt, Human; identical to SEQ ID NO: 33733

SEQ ID NO: 52058 - RNA, 64 nt, Human; identical to SEQ ID NO: 33734

SEQ ID NO: 52059 - RNA, 64 nt, Human; identical to SEQ ID NO: 33735

SEQ ID NO: 52060 - RNA, 64 nt, Human; identical to SEQ ID NO: 33736

SEQ ID NO: 52061 - RNA, 64 nt, Human; identical to SEQ ID NO: 33737

SEQ ID NO: 52062 - RNA, 64 nt, Human; identical to SEQ ID NO: 33738

SEQ ID NO: 52063 - RNA, 64 nt, Human; identical to SEQ ID NO: 33739

SEQ ID NO: 52064 - RNA, 64 nt, Human; identical to SEQ ID NO: 33740

SEQ ID NO: 52065 - RNA, 64 nt, Human; identical to SEQ ID NO: 33741

SEQ ID NO: 52066 - RNA, 64 nt, Human; identical to SEQ ID NO: 33742

SEQ ID NO: 52067 - RNA, 64 nt, Human; identical to SEQ ID NO: 33743

SEQ ID NO: 52068 - RNA, 64 nt, Human; identical to SEQ ID NO: 33744

SEQ ID NO: 52069 - RNA, 64 nt, Human; identical to SEQ ID NO: 33745

SEQ ID NO: 52070 - RNA, 64 nt, Human; identical to SEQ ID NO: 33746

SEQ ID NO: 52071 - RNA, 64 nt, Human; identical to SEQ ID NO: 33747

SEQ ID NO: 52072 - RNA, 64 nt, Human; identical to SEQ ID NO: 33748

SEQ ID NO: 52073 - RNA, 64 nt, Human; identical to SEQ ID NO: 33749

SEQ ID NO: 52074 - RNA, 64 nt, Human; identical to SEQ ID NO: 33750

SEQ ID NO: 52075 - RNA, 64 nt, Human; identical to SEQ ID NO: 33751

SEQ ID NO: 52076 - RNA, 64 nt, Human; identical to SEQ ID NO: 33752

SEQ ID NO: 52077 - RNA, 64 nt, Human; identical to SEQ ID NO: 33753

SEQ ID NO: 52078 - RNA, 64 nt, Human; identical to SEQ ID NO: 33754

SEQ ID NO: 52079 - RNA, 64 nt, Human; identical to SEQ ID NO: 33755

SEQ ID NO: 52080 - RNA, 64 nt, Human; identical to SEQ ID NO: 33756

SEQ ID NO: 52081 - RNA, 64 nt, Human; identical to SEQ ID NO: 33757

SEQ ID NO: 52082 - RNA, 64 nt, Human; identical to SEQ ID NO: 33758

SEQ ID NO: 52083 - RNA, 64 nt, Human; identical to SEQ ID NO: 33759

SEQ ID NO: 52084 - RNA, 64 nt, Human; identical to SEQ ID NO: 33760

SEQ ID NO: 52085 - RNA, 64 nt, Human; identical to SEQ ID NO: 33761

SEQ ID NO: 52086 - RNA, 64 nt, Human; identical to SEQ ID NO: 33762

SEQ ID NO: 52087 - RNA, 64 nt, Human; identical to SEQ ID NO: 33763

SEQ ID NO: 52088 - RNA, 64 nt, Human; identical to SEQ ID NO: 33764

SEQ ID NO: 52089 - RNA, 64 nt, Human; identical to SEQ ID NO: 33765

SEQ ID NO: 52090 - RNA, 64 nt, Human; identical to SEQ ID NO: 33766

SEQ ID NO: 52091 - RNA, 64 nt, Human; identical to SEQ ID NO: 33767

SEQ ID NO: 52092 - RNA, 64 nt, Human; identical to SEQ ID NO: 33768

SEQ ID NO: 52093 - RNA, 64 nt, Human; identical to SEQ ID NO: 33769

SEQ ID NO: 52094 - RNA, 64 nt, Human; identical to SEQ ID NO: 33770

SEQ ID NO: 52095 - RNA, 64 nt, Human; identical to SEQ ID NO: 33771

SEQ ID NO: 52096 - RNA, 64 nt, Human; identical to SEQ ID NO: 33772

SEQ ID NO: 52097 - RNA, 64 nt, Human; identical to SEQ ID NO: 33773

SEQ ID NO: 52098 - RNA, 64 nt, Human; identical to SEQ ID NO: 33774

SEQ ID NO: 52099 - RNA, 64 nt, Human; identical to SEQ ID NO: 33775

SEQ ID NO: 52100 - RNA, 64 nt, Human; identical to SEQ ID NO: 33776

SEQ ID NO: 52101 - RNA, 64 nt, Human; identical to SEQ ID NO: 33777

SEQ ID NO: 52102 - RNA, 64 nt, Human; identical to SEQ ID NO: 33778

SEQ ID NO: 52103 - RNA, 64 nt, Human; identical to SEQ ID NO: 33779

SEQ ID NO: 52104 - RNA, 64 nt, Human; identical to SEQ ID NO: 33780

SEQ ID NO: 52105 - RNA, 64 nt, Human; identical to SEQ ID NO: 33781

SEQ ID NO: 52106 - RNA, 64 nt, Human; identical to SEQ ID NO: 33782

SEQ ID NO: 52107 - RNA, 64 nt, Human; identical to SEQ ID NO: 33783

SEQ ID NO: 52108 - RNA, 64 nt, Human; identical to SEQ ID NO: 33784

SEQ ID NO: 52109 - RNA, 64 nt, Human; identical to SEQ ID NO: 33785

SEQ ID NO: 52110 - RNA, 64 nt, Human; identical to SEQ ID NO: 33786

SEQ ID NO: 52111 - RNA, 64 nt, Human; identical to SEQ ID NO: 33787

SEQ ID NO: 52112 - RNA, 64 nt, Human; identical to SEQ ID NO: 33788

SEQ ID NO: 52113 - RNA, 64 nt, Human; identical to SEQ ID NO: 33789

SEQ ID NO: 52114 - RNA, 64 nt, Human; identical to SEQ ID NO: 33790

SEQ ID NO: 52115 - RNA, 64 nt, Human; identical to SEQ ID NO: 33791

SEQ ID NO: 52116 - RNA, 64 nt, Human; identical to SEQ ID NO: 33792

SEQ ID NO: 52117 - RNA, 64 nt, Human; identical to SEQ ID NO: 33793

SEQ ID NO: 52118 - RNA, 64 nt, Human; identical to SEQ ID NO: 33794

SEQ ID NO: 52119 - RNA, 64 nt, Human; identical to SEQ ID NO: 33795

SEQ ID NO: 52120 - RNA, 64 nt, Human; identical to SEQ ID NO: 33796

SEQ ID NO: 52121 - RNA, 64 nt, Human; identical to SEQ ID NO: 33797

SEQ ID NO: 52122 - RNA, 64 nt, Human; identical to SEQ ID NO: 33798

SEQ ID NO: 52123 - RNA, 64 nt, Human; identical to SEQ ID NO: 33799

SEQ ID NO: 52124 - RNA, 64 nt, Human; identical to SEQ ID NO: 33800

SEQ ID NO: 52125 - RNA, 64 nt, Human; identical to SEQ ID NO: 33801

SEQ ID NO: 52126 - RNA, 62 nt, Human; identical to SEQ ID NO: 33802

SEQ ID NO: 52127 - RNA, 64 nt, Human; identical to SEQ ID NO: 33803

SEQ ID NO: 52128 - RNA, 64 nt, Human; identical to SEQ ID NO: 33804

SEQ ID NO: 52129 - RNA, 64 nt, Human; identical to SEQ ID NO: 33805

SEQ ID NO: 52130 - RNA, 64 nt, Human; identical to SEQ ID NO: 33806

SEQ ID NO: 52131 - RNA, 64 nt, Human; identical to SEQ ID NO: 33807

SEQ ID NO: 52132 - RNA, 64 nt, Human; identical to SEQ ID NO: 33808

SEQ ID NO: 52133 - RNA, 64 nt, Human; identical to SEQ ID NO: 33809

SEQ ID NO: 52134 - RNA, 64 nt, Human; identical to SEQ ID NO: 33810

SEQ ID NO: 52135 - RNA, 64 nt, Human; identical to SEQ ID NO: 33811

SEQ ID NO: 52136 - RNA, 64 nt, Human; identical to SEQ ID NO: 33812

SEQ ID NO: 52137 - RNA, 64 nt, Human; identical to SEQ ID NO: 33813

SEQ ID NO: 52138 - RNA, 64 nt, Human; identical to SEQ ID NO: 33814

SEQ ID NO: 52139 - RNA, 64 nt, Human; identical to SEQ ID NO: 33815

SEQ ID NO: 52140 - RNA, 64 nt, Human; identical to SEQ ID NO: 33816

SEQ ID NO: 52141 - RNA, 64 nt, Human; identical to SEQ ID NO: 33817

SEQ ID NO: 52142 - RNA, 64 nt, Human; identical to SEQ ID NO: 33818

SEQ ID NO: 52143 - RNA, 64 nt, Human; identical to SEQ ID NO: 33819

SEQ ID NO: 52144 - RNA, 64 nt, Human; identical to SEQ ID NO: 33820

SEQ ID NO: 52145 - RNA, 64 nt, Human; identical to SEQ ID NO: 33821

SEQ ID NO: 52146 - RNA, 64 nt, Human; identical to SEQ ID NO: 33822

SEQ ID NO: 52147 - RNA, 64 nt, Human; identical to SEQ ID NO: 33823

SEQ ID NO: 52148 - RNA, 64 nt, Human; identical to SEQ ID NO: 33824

SEQ ID NO: 52149 - RNA, 64 nt, Human; identical to SEQ ID NO: 33825

SEQ ID NO: 52150 - RNA, 64 nt, Human; identical to SEQ ID NO: 33826

SEQ ID NO: 52151 - RNA, 64 nt, Human; identical to SEQ ID NO: 33827

SEQ ID NO: 52152 - RNA, 64 nt, Human; identical to SEQ ID NO: 33828

SEQ ID NO: 52153 - RNA, 64 nt, Human; identical to SEQ ID NO: 33829

SEQ ID NO: 52154 - RNA, 64 nt, Human; identical to SEQ ID NO: 33830

SEQ ID NO: 52155 - RNA, 64 nt, Human; identical to SEQ ID NO: 33831

SEQ ID NO: 52156 - RNA, 64 nt, Human; identical to SEQ ID NO: 33832

SEQ ID NO: 52157 - RNA, 64 nt, Human; identical to SEQ ID NO: 33833

SEQ ID NO: 52158 - RNA, 64 nt, Human; identical to SEQ ID NO: 33834

SEQ ID NO: 52159 - RNA, 64 nt, Human; identical to SEQ ID NO: 33835

SEQ ID NO: 52160 - RNA, 64 nt, Human; identical to SEQ ID NO: 33836

SEQ ID NO: 52161 - RNA, 64 nt, Human; identical to SEQ ID NO: 33837

SEQ ID NO: 52162 - RNA, 64 nt, Human; identical to SEQ ID NO: 33838

SEQ ID NO: 52163 - RNA, 64 nt, Human; identical to SEQ ID NO: 33839

SEQ ID NO: 52164 - RNA, 64 nt, Human; identical to SEQ ID NO: 33840

SEQ ID NO: 52165 - RNA, 64 nt, Human; identical to SEQ ID NO: 33841

SEQ ID NO: 52166 - RNA, 64 nt, Human; identical to SEQ ID NO: 33842

SEQ ID NO: 52167 - RNA, 64 nt, Human; identical to SEQ ID NO: 33843

SEQ ID NO: 52168 - RNA, 64 nt, Human; identical to SEQ ID NO: 33844

SEQ ID NO: 52169 - RNA, 64 nt, Human; identical to SEQ ID NO: 33845

SEQ ID NO: 52170 - RNA, 64 nt, Human; identical to SEQ ID NO: 33846

SEQ ID NO: 52171 - RNA, 64 nt, Human; identical to SEQ ID NO: 33847

SEQ ID NO: 52172 - RNA, 64 nt, Human; identical to SEQ ID NO: 33848

SEQ ID NO: 52173 - RNA, 64 nt, Human; identical to SEQ ID NO: 33849

SEQ ID NO: 52174 - RNA, 64 nt, Human; identical to SEQ ID NO: 33850

SEQ ID NO: 52175 - RNA, 64 nt, Human; identical to SEQ ID NO: 33851

SEQ ID NO: 52176 - RNA, 64 nt, Human; identical to SEQ ID NO: 33852

SEQ ID NO: 52177 - RNA, 64 nt, Human; identical to SEQ ID NO: 33853

SEQ ID NO: 52178 - RNA, 64 nt, Human; identical to SEQ ID NO: 33854

SEQ ID NO: 52179 - RNA, 64 nt, Human; identical to SEQ ID NO: 33855

SEQ ID NO: 52180 - RNA, 64 nt, Human; identical to SEQ ID NO: 33856

SEQ ID NO: 52181 - RNA, 64 nt, Human; identical to SEQ ID NO: 33857

SEQ ID NO: 52182 - RNA, 64 nt, Human; identical to SEQ ID NO: 33858

SEQ ID NO: 52183 - RNA, 64 nt, Human; identical to SEQ ID NO: 33859

SEQ ID NO: 52184 - RNA, 64 nt, Human; identical to SEQ ID NO: 33860

SEQ ID NO: 52185 - RNA, 64 nt, Human; identical to SEQ ID NO: 33861

SEQ ID NO: 52186 - RNA, 64 nt, Human; identical to SEQ ID NO: 33862

SEQ ID NO: 52187 - RNA, 64 nt, Human; identical to SEQ ID NO: 33863

SEQ ID NO: 52188 - RNA, 64 nt, Human; identical to SEQ ID NO: 33864

SEQ ID NO: 52189 - RNA, 64 nt, Human; identical to SEQ ID NO: 33865

SEQ ID NO: 52190 - RNA, 64 nt, Human; identical to SEQ ID NO: 33866

SEQ ID NO: 52191 - RNA, 64 nt, Human; identical to SEQ ID NO: 33867

SEQ ID NO: 52192 - RNA, 64 nt, Human; identical to SEQ ID NO: 33868

SEQ ID NO: 52193 - RNA, 64 nt, Human; identical to SEQ ID NO: 33869

SEQ ID NO: 52194 - RNA, 50 nt, Human; identical to SEQ ID NO: 33870

SEQ ID NO: 52195 - RNA, 64 nt, Human; identical to SEQ ID NO: 33871

SEQ ID NO: 52196 - RNA, 64 nt, Human; identical to SEQ ID NO: 33872

SEQ ID NO: 52197 - RNA, 64 nt, Human; identical to SEQ ID NO: 33873

SEQ ID NO: 52198 - RNA, 64 nt, Human; identical to SEQ ID NO: 33874

SEQ ID NO: 52199 - RNA, 64 nt, Human; identical to SEQ ID NO: 33875

SEQ ID NO: 52200 - RNA, 64 nt, Human; identical to SEQ ID NO: 33876

SEQ ID NO: 52201 - RNA, 64 nt, Human; identical to SEQ ID NO: 33877

SEQ ID NO: 52202 - RNA, 64 nt, Human; identical to SEQ ID NO: 33878

SEQ ID NO: 52203 - RNA, 64 nt, Human; identical to SEQ ID NO: 33879

SEQ ID NO: 52204 - RNA, 64 nt, Human; identical to SEQ ID NO: 33880

SEQ ID NO: 52205 - RNA, 64 nt, Human; identical to SEQ ID NO: 33881

SEQ ID NO: 52206 - RNA, 64 nt, Human; identical to SEQ ID NO: 33882

SEQ ID NO: 52207 - RNA, 64 nt, Human; identical to SEQ ID NO: 33883

SEQ ID NO: 52208 - RNA, 64 nt, Human; identical to SEQ ID NO: 33884

SEQ ID NO: 52209 - RNA, 64 nt, Human; identical to SEQ ID NO: 33885

SEQ ID NO: 52210 - RNA, 64 nt, Human; identical to SEQ ID NO: 33886

SEQ ID NO: 52211 - RNA, 64 nt, Human; identical to SEQ ID NO: 33887

SEQ ID NO: 52212 - RNA, 64 nt, Human; identical to SEQ ID NO: 33888

SEQ ID NO: 52213 - RNA, 64 nt, Human; identical to SEQ ID NO: 33889

SEQ ID NO: 52214 - RNA, 64 nt, Human; identical to SEQ ID NO: 33890

SEQ ID NO: 52215 - RNA, 64 nt, Human; identical to SEQ ID NO: 33891

SEQ ID NO: 52216 - RNA, 64 nt, Human; identical to SEQ ID NO: 33892

SEQ ID NO: 52217 - RNA, 64 nt, Human; identical to SEQ ID NO: 33893

SEQ ID NO: 52218 - RNA, 64 nt, Human; identical to SEQ ID NO: 33894

SEQ ID NO: 52219 - RNA, 64 nt, Human; identical to SEQ ID NO: 33895

SEQ ID NO: 52220 - RNA, 64 nt, Human; identical to SEQ ID NO: 33896

SEQ ID NO: 52221 - RNA, 64 nt, Human; identical to SEQ ID NO: 33897

SEQ ID NO: 52222 - RNA, 64 nt, Human; identical to SEQ ID NO: 33898

SEQ ID NO: 52223 - RNA, 64 nt, Human; identical to SEQ ID NO: 33899

SEQ ID NO: 52224 - RNA, 64 nt, Human; identical to SEQ ID NO: 33900

SEQ ID NO: 52225 - RNA, 64 nt, Human; identical to SEQ ID NO: 33901

SEQ ID NO: 52226 - RNA, 64 nt, Human; identical to SEQ ID NO: 33902

SEQ ID NO: 52227 - RNA, 64 nt, Human; identical to SEQ ID NO: 33903

SEQ ID NO: 52228 - RNA, 58 nt, Human; identical to SEQ ID NO: 33904

SEQ ID NO: 52229 - RNA, 64 nt, Human; identical to SEQ ID NO: 33905

SEQ ID NO: 52230 - RNA, 64 nt, Human; identical to SEQ ID NO: 33906

SEQ ID NO: 52231 - RNA, 64 nt, Human; identical to SEQ ID NO: 33907

SEQ ID NO: 52232 - RNA, 64 nt, Human; identical to SEQ ID NO: 33908

SEQ ID NO: 52233 - RNA, 58 nt, Human; identical to SEQ ID NO: 33909

SEQ ID NO: 52234 - RNA, 64 nt, Human; identical to SEQ ID NO: 33910

SEQ ID NO: 52235 - RNA, 64 nt, Human; identical to SEQ ID NO: 33911

SEQ ID NO: 52236 - RNA, 64 nt, Human; identical to SEQ ID NO: 33912

SEQ ID NO: 52237 - RNA, 64 nt, Human; identical to SEQ ID NO: 33913

SEQ ID NO: 52238 - RNA, 64 nt, Human; identical to SEQ ID NO: 33914

SEQ ID NO: 52239 - RNA, 64 nt, Human; identical to SEQ ID NO: 33915

SEQ ID NO: 52240 - RNA, 64 nt, Human; identical to SEQ ID NO: 33916

SEQ ID NO: 52241 - RNA, 64 nt, Human; identical to SEQ ID NO: 33917

SEQ ID NO: 52242 - RNA, 64 nt, Human
gucuggggucuagucucgagcaucagggucaggcucggggcagggcuggguuaggcuccggguc

SEQ ID NO: 52243 - RNA, 64 nt, Human
cauuacccccuuauuauuuugacgguuuuuuuuuucggggcaggggaccuuaccuguaagacuu

SEQ ID NO: 52244 - RNA, 64 nt, Human
ugucccucucggaaggcuggcugggcauggacguucggggcaugcuggggcaagucccugacuc

SEQ ID NO: 52245 - RNA, 64 nt, Human
ccgggaaaacaccuugguuacacucgccaacaucucggggcaguuggaccuaucuccauacccc

SEQ ID NO: 52246 - RNA, 64 nt, Human
ccagaagauugaaugagugacauaaaucuuuaguucggggcaagccagggugggcuaggguggu

SEQ ID NO: 52247 - RNA, 64 nt, Human
gggccagcagcugcaccucuccugucugugcuccucggggcaucuccugaugcuccggggcuca

SEQ ID NO: 52248 - RNA, 64 nt, Human
cugggaagaguccuuugcuuuggggcccagugacucggggcacuugaguucagggcggccuccu

SEQ ID NO: 52249 - RNA, 64 nt, Human
cuaucuggguucugcugucuccgcguaggcagcuucggggcaaggauucaacuccccaggccuc

SEQ ID NO: 52250 - RNA, 64 nt, Human
cccccguaguagcaggcaguucccaaguggagggucggggcagaggccuccaccaaggccauca

SEQ ID NO: 52251 - RNA, 64 nt, Human
uuccccaaacugaaaauaccuacugcaggaucccucggggcacacugaagcuuggcugccaacc

SEQ ID NO: 52252 - RNA, 64 nt, Human
ccucgcggugacagccgccuuuggcagcgagcgcucggggcacuucuauccccgccucucaaag

SEQ ID NO: 52253 - RNA, 64 nt, Human
ugcagccagggucugggcagggugcagccgguccucggggcacgcagcuuccuucaaguacacu

SEQ ID NO: 52254 - RNA, 64 nt, Human
ccagaagagagugcaguguuggagagugacacugucggggcagcuggggccacaagcaggagcc

SEQ ID NO: 52255 - RNA, 64 nt, Human
cucugcuagaggaaugaauuuauucaagagccauucggggcacguguguguacacaccguauac

SEQ ID NO: 52256 - RNA, 64 nt, Human
aacagaguugccaagauauuuauacccucagcacucggggcaacacaguggaaaguggggaggc

SEQ ID NO: 52257 - RNA, 64 nt, Human
cuacugacgcaggccucaggcccagggcgcgccgucggggcaagguggccuuccccgggcggua

SEQ ID NO: 52258 - RNA, 64 nt, Human
cccaagggaaucagccccaucaacaaaguucaaaucggggcagaggcugcacuugugcccccag

SEQ ID NO: 52259 - RNA, 64 nt, Human
gggagcccugggccagggcguggagagcccucagucggggcaggccaggggaggggugaagugg

SEQ ID NO: 52260 - RNA, 64 nt, Human
uguccugggugacaugggaugugacuuucgggugucggggcagcaugcccuucucccccacuuc

SEQ ID NO: 52261 - RNA, 64 nt, Human
aagagaugcuugcaaagcaauggggaacguguucucggggcagguuuccgggagcagaugccaa

SEQ ID NO: 52262 - RNA, 64 nt, Human
cugcaccccggcccucaucacccaccggcacugaucggggcaccgccuggcccagccuccacca

SEQ ID NO: 52263 - RNA, 64 nt, Human
cagcuggaaaacuaaaggaaaaauacaaguguuuucggggcauacauuuuuuuucugggugugc

SEQ ID NO: 52264 - RNA, 64 nt, Human
gccagcugcagccugguuggcagcaucugcuccaucggggcaggggguaugcagagcuuguggu

SEQ ID NO: 52265 - RNA, 64 nt, Human
ggagccucauucguaccaugccaaacgcauucacucggggcaguauuaaccguucuagaaagcc

SEQ ID NO: 52266 - RNA, 64 nt, Human
aagccgcagggacagaacugaacguccugcagcuucggggcaagugagacaaucacagcuccuc

SEQ ID NO: 52267 - RNA, 64 nt, Human
uccauggacacucaggauauaguuggccuaauaaucggggcauggguaaaacuuaugaaaauuu

SEQ ID NO: 52268 - RNA, 64 nt, Human
ggccuucccuggccuugaguagaaaagucggggaucggggcaagagaggcugaguacggauggg

SEQ ID NO: 52269 - RNA, 64 nt, Human
acugagugugccggacccugaggagaggcuggacucggggcauguguggaagcugcagugggcc

SEQ ID NO: 52270 - RNA, 64 nt, Human
ugggaggaaaccgccgcaaugggggugucuucccucggggcaggagggugggccugaggcuuuc

SEQ ID NO: 52271 - RNA, 64 nt, Human
gcuucagccaggcucgguggacacccuggcccucucggggcagagccgccaguguuucucaggg

SEQ ID NO: 52272 - RNA, 64 nt, Human
aaacagccuacagccagaacuucugagcauccucucggggcagacccuccccguccucguggag

SEQ ID NO: 52273 - RNA, 64 nt, Human
ugucaucaucagcgcccucaagaccuaccuggugucggggcagccccuggaagagaucaucacc

SEQ ID NO: 52274 - RNA, 64 nt, Human
uagcaccuguaauuggggagagggagugugccccucggggcaggagggaagggcaucuggggaa

SEQ ID NO: 52275 - RNA, 64 nt, Human
aacuuuggcaguuucaaugucugucucuguugcuucggggcauaagcugaucaccgucuaguug

SEQ ID NO: 52276 - RNA, 64 nt, Human
cucuguggagaagcagcuccaccucugggggggcucggggcagaggggcggugucuuguagcgg

SEQ ID NO: 52277 - RNA, 64 nt, Human
ccugcaggugcagcuuuucaacuucaagcgcuucucggggcaugagccccugggugagcuccgu

SEQ ID NO: 52278 - RNA, 64 nt, Human
gcccguaggcaaggugcaccugggugcccgggccucggggcagccccugcagcacugggcagac

SEQ ID NO: 52279 - RNA, 64 nt, Human
agcucacaaggcuuuggagaauugucuuccuaaaucggggcaccugcuacagaagagaauguuu

SEQ ID NO: 52280 - RNA, 64 nt, Human
cacucugcucucaggagaccuggcuaugaggcccucggggcagggauacaaaguuagugagguc

SEQ ID NO: 52281 - RNA, 64 nt, Human
aaauacuucaaccagagcagggagccugggggugucggggcaggaggcuggggauggggguggg

SEQ ID NO: 52282 - RNA, 64 nt, Human
acuggacaccaguagguagugucaagccagagauucggggcaguagauaaauguucauuuuacu

SEQ ID NO: 52283 - RNA, 64 nt, Human
uggaaccugaggaugggaucugcucagccuaucuucggggcaauugcugagcuucaggaugggc

SEQ ID NO: 52284 - RNA, 64 nt, Human
ggaagaagcuccggauggaggccagcuaagccacucggggcaggccagcaauaaaaacugucug

SEQ ID NO: 52285 - RNA, 54 nt, Human
uccggaaaaacccccuguaagcccucggggcagacccugccuuggagggagacu

SEQ ID NO: 52286 - RNA, 64 nt, Human
gcucgggcugacaggugaggggaacgggggggggucggggcaaagcuccaucuccccuuccuuu

SEQ ID NO: 52287 - RNA, 64 nt, Human
caaaaguuggcaaaaugcgggcugggcaggcagcucggggcagggagcagcagugcaggccugg

SEQ ID NO: 52288 - RNA, 64 nt, Human
cccacuggagcagaaggggagauggacgacacggucggggcaucuggccuggccagugcccuga

SEQ ID NO: 52289 - RNA, 64 nt, Human
auacgugugguuaguggcugccauacuggacagcucggggcauuuucacugucaaagaaaguuc

SEQ ID NO: 52290 - RNA, 64 nt, Human
gggagagagggacagagagagauagagcaggaggucggggcacucugagucccaguucccagug

SEQ ID NO: 52291 - RNA, 64 nt, Human
ggcggccaugauggugcugaccucugguggccgaucggggcacugcaggggccgagccauuuug

SEQ ID NO: 52292 - RNA, 64 nt, Human
ccaguuuuuuuuguuuguuuguuuuuuaagacguucggggcagggugggaguggguauggagau

SEQ ID NO: 52293 - RNA, 64 nt, Human
agcuguaaaaugagcuuccagggcuuggguggcgucggggcagggccgccgaggcugggaggaa

SEQ ID NO: 52294 - RNA, 64 nt, Human
cuguccuuuuuaaccuguguuguccuagacccugucggggcagucaggggacacuagagauuug

SEQ ID NO: 52295 - RNA, 64 nt, Human
gcacugagugaggguggggagcccaggccuggccucggggcagggcagggcggcuaggccggcc

SEQ ID NO: 52296 - RNA, 64 nt, Human
cauuucacacucacccuccacccuccccacccccucggggcagaguuugcacaaaguccccccc

SEQ ID NO: 52297 - RNA, 64 nt, Human
cucccuccucggcccguccccacuucccggggccucggggcacacagcuggggcugcccccacc

SEQ ID NO: 52298 - RNA, 64 nt, Human
ugcaugcacugggagggggcggcuggcccagcccucggggcaggagcccccucugccacacgcu

SEQ ID NO: 52299 - RNA, 64 nt, Human
caucugagagcaucuccccacucucgccaaccuaucggggcauagcccagggaugcccccaggc

SEQ ID NO: 52300 - RNA, 64 nt, Human
acccaugcccacccagcgccgccgccgcuggcucucggggcaccuggcaggaggcgggugugug

SEQ ID NO: 52301 - RNA, 64 nt, Human
ccgcagaggugcagccucgaggaaucugagggcgucggggcagcgaaccuuugcauccacggac

SEQ ID NO: 52302 - RNA, 64 nt, Human
aggcccaggggacucucuccacucuuuccugggcucggggcaucugccuggaguuaccuuccau

SEQ ID NO: 52303 - RNA, 64 nt, Human
cuugaggaccuccaccugggagaugcugggacccucggggcaggaagucccugagaagccucau

SEQ ID NO: 52304 - RNA, 64 nt, Human
ugccggggcgaugcuuccacccuggacugaguguucggggcagccugcucggcuguauguuucu

SEQ ID NO: 52305 - RNA, 64 nt, Human
guuaaagugaccagagcggauguucgauggcgccucggggcaguuugggguucugggucgguuc

SEQ ID NO: 52306 - RNA, 64 nt, Human
uuguccuuccugcccuccgauggggccaccugugucggggcagcaguguccauguuuauggaga

SEQ ID NO: 52307 - RNA, 64 nt, Human
agauguacagcuacugagcugcguuccgggagacucggggcaagaacugcagagggauguuugg

SEQ ID NO: 52308 - RNA, 64 nt, Human
gccucugccuugucccacugagguccaggguagcucggggcagggguggggcaguccaguguug

SEQ ID NO: 52309 - RNA, 64 nt, Human
acuuagggaaaauagaaaagaaccuacgugaccaucggggcagguuccccgauacccaaugacc

SEQ ID NO: 52310 - RNA, 64 nt, Human
aaaacaaaacaaaauuaacugcuuaaauguuuugucggggcaaacaaaauuaugugaauugugu

SEQ ID NO: 52311 - RNA, 64 nt, Human
uugugugaaacaauacaaagcccagaaauucuuuucggggcaugaguaaauuuuguucagggcu

SEQ ID NO: 52312 - RNA, 64 nt, Human
gcggcgccccgacugcggggccacccgccugcgcuccgccgacgcccuuggaacaaucggcugg

SEQ ID NO: 52313 - RNA, 64 nt, Human
cuggacguccugucacuccaccucgaacagcuaauccgccgaagaaaaggugaagaaaggaauu

SEQ ID NO: 52314 - RNA, 64 nt, Human
ucugaagcagcagguugcaggacaaaugcuucaguccgccgagagcaguaccguguggccaaga

SEQ ID NO: 52315 - RNA, 64 nt, Human
gccaggcuggucucaaacucuugaccucaggugauccgccgaccucggccucccaaaguccucg

SEQ ID NO: 52316 - RNA, 64 nt, Human
ggccuuggcuaggacccagagccacacugcagccuccgccgacucccuccuuccgggccugcuc

SEQ ID NO: 52317 - RNA, 64 nt, Human
gccuucugucccugguuuuugcaagugcugcauuuccgccgagaauccgcguugccuacugcug

SEQ ID NO: 52318 - RNA, 64 nt, Human
uguuagccaggauggucuugaucugaccucgugauccgccgaccucggccucccaaagugcugg

SEQ ID NO: 52319 - RNA, 64 nt, Human
aguccacgagacucuuuucugucccucacuguguuccgccgacuguccccucucgucacccauc

SEQ ID NO: 52320 - RNA, 64 nt, Human
ccaucacagaugggagaaggccaugccagccacguccgccgaggggcgccagccugaagcugcc

SEQ ID NO: 52321 - RNA, 64 nt, Human
gagaaaaacagacugugggaaggaucagaaggaauccgccgaggcagggaugggugugcccaug

SEQ ID NO: 52322 - RNA, 64 nt, Human
cugagauggccaccccgggcagggaccugugccuuccgccgaugcucagggcucccucuggcuc

SEQ ID NO: 52323 - RNA, 64 nt, Human
cucucugugcucgguugucuugggguggggcccauccgccgagguggggaccgauaggagaagc

SEQ ID NO: 52324 - RNA, 64 nt, Human
gugugagcgcacuuugcaccuccuauccccaggguccgccgagagccacgauuuuuuacagaaa

SEQ ID NO: 52325 - RNA, 64 nt, Human
gugcuggacgggaagauugacgaccugcaugacuuccgccgagggcucuccaagcugggcaccg

SEQ ID NO: 52326 - RNA, 64 nt, Human
ggaucggagugcgggccgcgcacggugccaggauuccgccgaggggaagccgcucacauugcag

SEQ ID NO: 52327 - RNA, 64 nt, Human
ggaccucuuguaacccaucggcaucuuccaggaauccgccgagugacuugaggaagaugcuaac

SEQ ID NO: 52328 - RNA, 64 nt, Human
gcgcacacagcugcucucuacagaggcugcaggcuccgccgaguccccccucaguguuauuuua

SEQ ID NO: 52329 - RNA, 64 nt, Human
gcggcgcuggaaggaguucgugcgcacgcuggggcugcgcgaggcagagaucgaagccguggag

SEQ ID NO: 52330 - RNA, 64 nt, Human
cccgccgcugcgcgcccugccgcgcuaccgccugcugcgcgaccugccgcgucugcugcgggcg

SEQ ID NO: 52331 - RNA, 64 nt, Human
gaagucccgccgcuacgugcccggcacaguggcccugcgcgacguucggcgcuaccagaacucc

SEQ ID NO: 52332 - RNA, 64 nt, Human
aggucucgggaguguagcaccaugccaaccagcccugcgcgaagacagagugagccacgcccgg

SEQ ID NO: 52333 - RNA, 64 nt, Human
ccuaugcagggaccuuguaagcggagcuggguggcugcgcgagggaccgaguacuagagcugcu

SEQ ID NO: 52334 - RNA, 64 nt, Human
agcaggaucucacggacugccgggucggcgccuccugcgcgagggagcagguucuccgcauucc

SEQ ID NO: 52335 - RNA, 64 nt, Human
ggagcgggcacagcuggagaugcagagccagcagcugcgcgaguccaaccagcagcuggaccug

SEQ ID NO: 52336 - RNA, 64 nt, Human
cauacuucgacuuaucaggauucuggcugguggccugcgcgagggugcagucuuacuuaaaaga

SEQ ID NO: 52337 - RNA, 64 nt, Human
uggcggcuacugggcccugcccagccccggaacucugcgcgauaucaauacuggcuauuuucuc

SEQ ID NO: 52338 - RNA, 64 nt, Human
aggcccagccgccgcccugcuccaggcucuaggacugcgcgaugagccccagggugcccccagg

SEQ ID NO: 52339 - RNA, 64 nt, Human
gaagauuuauggaacacuuaccacacggcugacgcugcgcgaggcuaagguucuaauacaccgc

SEQ ID NO: 52340 - RNA, 64 nt, Human
gcuucgcacugagcucucagccuccugcccucagcugcgcgaagcgcucggcccagcucacuga

SEQ ID NO: 52341 - RNA, 64 nt, Human
auuggaaugacacagaggagauuagcauggcccccugcgcgaggaagaucugcagauucaugca

SEQ ID NO: 52342 - RNA, 64 nt, Human
auuggaaugacacagaggagauuagcauggcccccugcgcgaggaagauccgcagauucaugca

SEQ ID NO: 52343 - RNA, 64 nt, Human
ccuuaaacugcaacgucccgucccuuccccacccccaucccauccccacccccagccccagccc

SEQ ID NO: 52344 - RNA, 64 nt, Human
uccggccuccugccaaggcucuuguccccauacaccaucccacaagggcgcuggggguggaagu

SEQ ID NO: 52345 - RNA, 64 nt, Human
uaagggcccuucucugcccuuucugcccuccuucccaucccacaugcugagccgccacaaagac

SEQ ID NO: 52346 - RNA, 64 nt, Human
gugucuccugggugccuucugaggacucccacccccaucccaguaucucaucuguccccucucc

SEQ ID NO: 52347 - RNA, 64 nt, Human
ugcuggccaggaaaccuuucggcuaccucucccaccaucccagacugugggcagggggaugggg

SEQ ID NO: 52348 - RNA, 64 nt, Human
cacaccaguuagguagagcugucuguucacccucccaucccagcugaucccagucacugcuugc

SEQ ID NO: 52349 - RNA, 64 nt, Human
ucuuucuaguucagcugccccacagguguguuucccaucccacugcucccccaacacaaacccc

SEQ ID NO: 52350 - RNA, 59 nt, Human
auuacacagcugacuacugaggggugcccccaucccauccaccccuucucuucauccuu

SEQ ID NO: 52351 - RNA, 55 nt, Human
ccucccaggagcuccagugacagccccaucccaggaugggugucuggggaggguc

SEQ ID NO: 52352 - RNA, 64 nt, Human
agaucaccacucuaaccucggccugacaucccucccaucccauauuuguccaaguguuccugcu

SEQ ID NO: 52353 - RNA, 63 nt, Human
ugggcucugacagugacugaggcccugcauuccccaucccacccccggcuggacugcccucuc

SEQ ID NO: 52354 - RNA, 64 nt, Human
uccugucaccugggaauggaauggccagugaacaccaucccagaagcauuuucccucugcaaaa

SEQ ID NO: 52355 - RNA, 64 nt, Human
cuauguguuagaguccccccgaccagauccuuuuccaucccacuccacuauguugucuauuuuu

SEQ ID NO: 52356 - RNA, 64 nt, Human
augauggcuccaggucagugucuggaguuucauuccaucccagggcuuggaugucaggauuaua

SEQ ID NO: 52357 - RNA, 64 nt, Human
aagaaaagucuagguuuuaaggcugugccagaacccaucccaauaaagagaccgagucugaagu

SEQ ID NO: 52358 - RNA, 64 nt, Human
ugaacagccccgguccagacagcagccuguacauccaucccaggacacagcccagccccucccc

SEQ ID NO: 52359 - RNA, 64 nt, Human
cagcaguuuuaaaggaugaacauuggauuucaugccaucccauagaaaaccuguuuuaaaauuu

SEQ ID NO: 52360 - RNA, 64 nt, Human
uuccagauagcuccagaguaugaugaccccagccccaucccaaucucuagcgaaaggguuaugc

SEQ ID NO: 52361 - RNA, 64 nt, Human
gaggcaacaguguucugagcccccaccugccugaccaucccaugagcaguccagagcuucaggg

SEQ ID NO: 52362 - RNA, 64 nt, Human
cuucugcaccaugagaccaacccagggcaagaucccaucccaucacaucagccuaccucccucc

SEQ ID NO: 52363 - RNA, 64 nt, Human
uucuucaaaaguaacggaaucagcaucugugaugccaucccaggaugugagugggucugaagau

SEQ ID NO: 52364 - RNA, 64 nt, Human
gacacuggaggucucuucugccauugugcuggucccaucccaagaauuguaggacagagaccac

SEQ ID NO: 52365 - RNA, 64 nt, Human
cuggcuccucagccagcacccagcuuaaccccugccaucccaugcugggcccuccaggccaaga

SEQ ID NO: 52366 - RNA, 64 nt, Human
accucaugccuuucccagcagccacugaacucccccaucccagggcucagccuccugauucaug

SEQ ID NO: 52367 - RNA, 64 nt, Human
ggugugacaccugcugcacucaucugauguaaaaccaucccagagcuggcgagaggauggagcu

SEQ ID NO: 52368 - RNA, 64 nt, Human
uaacuaaacgcaaaucuguagauucucuccucucccaucccagaaaacaaaacaaaauaaugcu

SEQ ID NO: 52369 - RNA, 64 nt, Human
uagauucugcacuuggggucucugacacaacacaccaucccaaaguagccggaagagcuaaaca

SEQ ID NO: 52370 - RNA, 64 nt, Human
cccuucacccaccaucuacgccauauacccaucaccaucccaugaggaaaaaaaaaaaaguaaa

SEQ ID NO: 52371 - RNA, 64 nt, Human
guacggucagcuuucaaaacaauaugccccccgcccaucccaugugugaggacauggugacucg

SEQ ID NO: 52372 - RNA, 64 nt, Human
auggcugccaaugggagcucauggugagggauacccaucccauaugccugggcagaaggaagac

SEQ ID NO: 52373 - RNA, 64 nt, Human
ucugccaucuagccagccccucuuccccaaugcuccaucccaaccaggcaccucuuccuugaug

SEQ ID NO: 52374 - RNA, 64 nt, Human
agaauggccauggaggcaaagccuucacccagacccaucccacucuccugugauccaggugguc

SEQ ID NO: 52375 - RNA, 64 nt, Human
ggaacuugaauugggaacuuuggagucuugucucccaucccagcacauugaggauguaguuggu

SEQ ID NO: 52376 - RNA, 64 nt, Human
cagaauccucucagagucauugaaggguguucacccaucccacccaaggcuuggcacacugcca

SEQ ID NO: 52377 - RNA, 64 nt, Human
gccauugcggagcugcccucuugagucuuucuguccaucccauucuauucuguacugugacuuu

SEQ ID NO: 52378 - RNA, 64 nt, Human
uccuucuccagaccccagaacuagaaaccccgggccaucccacuagcagcuuuggccuccauau

SEQ ID NO: 52379 - RNA, 64 nt, Human
guuacccuuaagcuaggauguugcucagaagugaccaucccaacuuuggugcgggcacaauaaa

SEQ ID NO: 52380 - RNA, 64 nt, Human
uugugucagaacacauguuaauccacaaaacgccccaucccagauuccaaauuaaaacaucguu

SEQ ID NO: 52381 - RNA, 64 nt, Human
uacguauugaucuaauauuguuggguuaauuuuuccaucccacccuuuucuuaaucgcuuccgu

SEQ ID NO: 52382 - RNA, 64 nt, Human
cuuccacacaauagccucuguagguuaggcugccccaucccacccuacucuguguggcugcuuu

SEQ ID NO: 52383 - RNA, 64 nt, Human
ggacaccccacacccccugccugaauggauggguccaucccaggcacugguacuugcccccuug

SEQ ID NO: 52384 - RNA, 64 nt, Human
augacucccauauccacagccuguccauccuagcccaucccaguuuauccuguaucauuugagc

SEQ ID NO: 52385 - RNA, 64 nt, Human
ccugucccugugagugggaaggucuucuggcuccccaucccaccuggcuccagagccugcccuc

SEQ ID NO: 52386 - RNA, 64 nt, Human
auuuagaauuucucauugggagaguaagguacccccaucccagaaugauaacugcacaguggca

SEQ ID NO: 52387 - RNA, 64 nt, Human
uccuauuuuccugggaaguccuuaaagccccuaaccaucccacacucuucacuuuccuuuccac

SEQ ID NO: 52388 - RNA, 64 nt, Human
augacaguuggcuccccccccacccccagcaaccccaucccagaauccuauuuuccugggaagu

SEQ ID NO: 52389 - RNA, 64 nt, Human
cuuaaacacccccauuucuugcggaagaugcuccccaucccacugacugcuugaccuuuaccuc

SEQ ID NO: 52390 - RNA, 53 nt, Human
aggacccucaagacaaaugacccccaucccauggggguaauaagagcaguagc

SEQ ID NO: 52391 - RNA, 64 nt, Human
uaaauggagaaaggacccucaagacaaaugacccccaucccauggggguaauaagagcaguagc

SEQ ID NO: 52392 - RNA, 64 nt, Human
ccuucuccuuucuaagcccuguucuccugucccuccaucccagacauugauggggacauuucuu

SEQ ID NO: 52393 - RNA, 64 nt, Human
ugggacaagaaaaccccaaaguggccugcuuuucccaucccaggagcucauuauccagucugug

SEQ ID NO: 52394 - RNA, 64 nt, Human
ccacugauugcaguuaacaucuagaguguuguuuccaucccacugcccaagcauuggcaugguc

SEQ ID NO: 52395 - RNA, 64 nt, Human
uucuccgugugaccccacaauugacauggcuccuccaucccagcgcuggaagggccagugggaa

SEQ ID NO: 52396 - RNA, 64 nt, Human
gccacuuaucuguccucuggaucagguccuuucuccaucccacuaccuccuggguccaaagccu

SEQ ID NO: 52397 - RNA, 64 nt, Human
cugguccugcugcuaguaguguuuggcuuauuuuccaucccaguucugggaggucuuuuaaguc

SEQ ID NO: 52398 - RNA, 64 nt, Human
auguaggucuuaacuuuauacuuagcaaguuacuccaucccaauuuagugcuccugugugaccu

SEQ ID NO: 52399 - RNA, 64 nt, Human
cagacuuauacaccccugagugaggauuacaugcccaucccaguguccuaggaccuuuucccaa

SEQ ID NO: 52400 - RNA, 64 nt, Human
uugcgccaggacuuggcgugggcaccgggcgcccccaucccagugucugugugcguccagcugu

SEQ ID NO: 52401 - RNA, 64 nt, Human
aggcugucaugugucucgaaaucagcagcccuccccaucccaaucccaggcagcuuguguguac

SEQ ID NO: 52402 - RNA, 64 nt, Human
aaguaaggaaaauuggagaugcuaacauccucccccaucccaacugcaccuuaaaauaugcaug

SEQ ID NO: 52403 - RNA, 64 nt, Human
acuaccagacgagcacaucagaacccuuugacagccaucccaggucuaaagccacaaguuucuu

SEQ ID NO: 52404 - RNA, 64 nt, Human
cacugagaugcugggggucacugggccuggaagaccaucccagccucugaguucucuuugagua

SEQ ID NO: 52405 - RNA, 64 nt, Human
cuaaacacagcagccauuuguaccuguuugcuucccaucccacuuggcacccacucugaccucu

SEQ ID NO: 52406 - RNA, 64 nt, Human
cauugcaauaauuauuggaagucuagauaucgagccaucccagguguugggcggggggaggguu

SEQ ID NO: 52407 - RNA, 64 nt, Human
agucuggaaagugaggagcgucucugcccggccgccaucccaucuaggaagugaggagcgccuc

SEQ ID NO: 52408 - RNA, 64 nt, Human
caucuaggaagugaggagcgccucuucccacccgccaucccaucuaggaagugaggagcuucuc

SEQ ID NO: 52409 - RNA, 64 nt, Human
ccuguccucacugcucccugaagccagccuucuuccaucccaggacaccacacccagccucagu

SEQ ID NO: 52410 - RNA, 64 nt, Human
agggaaggaaggagagggagggggaggauagagcccaucccagccggggagggggagcccucug

SEQ ID NO: 52411 - RNA, 64 nt, Human
agugggaucacagggaaggauguuggcagcgacaccaucccauacaggcucuuaccucuucucc

SEQ ID NO: 52412 - RNA, 64 nt, Human
guuguucccuucagacucaggggcuccaccaaugccaucccaaaacagggucagacacugccca

SEQ ID NO: 52413 - RNA, 64 nt, Human
gcccgggaacaccucucaccugaacccgggggucccaucccaggaagaagggccaucucaggac

SEQ ID NO: 52414 - RNA, 64 nt, Human
cacgugaugaugugguccugccugccacugugcaccaucccagguauugaauuuugaccuuuuc

SEQ ID NO: 52415 - RNA, 64 nt, Human
cccaacaucuuccauggacacaugacauugaagaccaucccaagcuaucgccacccuuggagau

SEQ ID NO: 52416 - RNA, 64 nt, Human
ugcggagcuucuccagccaccaaggcugccugccccaucccaucccuuucuaagcaggaagguc

SEQ ID NO: 52417 - RNA, 64 nt, Human
aaagagaagaggagguaggggccaagcccccaccccaucccacuccccuucccuccccagauau

SEQ ID NO: 52418 - RNA, 64 nt, Human
ugggaucugggcuuccucacuucuggagaaguggccaucccaugcccaccugugccauggagga

SEQ ID NO: 52419 - RNA, 64 nt, Human
gagaccagcuucuggcaacugccccagcuccaggccaucccauagccccuccucuucuggcugc

SEQ ID NO: 52420 - RNA, 64 nt, Human
uuuaauuuuuuucuuuuaaaauaaacagcugggaccaucccaaaagacaagccaugcauacaac

SEQ ID NO: 52421 - RNA, 64 nt, Human
cagagcagcuccuaaacaagagaauaaaaaugggccaucccagcacuuauaaggggagcacauc

SEQ ID NO: 52422 - RNA, 64 nt, Human
agcccuccguggugcacacagcacgcgccucaguccaucccauuuuagucuuuaaacccucagg

SEQ ID NO: 52423 - RNA, 64 nt, Human
gccuaggauuauaauucuuugugcacaaugcaucccaucccaaagacaguccacagcaggacuu

SEQ ID NO: 52424 - RNA, 64 nt, Human
auggaccugugggugugcccuggggaccccugacccaucccaaaacacuguggaaagaagggcc

SEQ ID NO: 52425 - RNA, 64 nt, Human
uguuugaagcaacaaagucacagcccagcuguggccaucccaagcaaauugagaauauauucac

SEQ ID NO: 52426 - RNA, 64 nt, Human
ggugggccaaaguuaggacacugcguaaaacaggccaucccaccaccucuaccugcucaugcca

SEQ ID NO: 52427 - RNA, 64 nt, Human
aauuauucagucacugccugguaccuuuaucuucccaucccacuaauguuaguguuuuuuaaug

SEQ ID NO: 52428 - RNA, 64 nt, Human
ggaaccauuuugugaugguauguuguccaucuucccaucccaguucuuccugccccccuuccuc

SEQ ID NO: 52429 - RNA, 64 nt, Human
uacaaacucggacagggucagaaacagaggugucccaucccauugcagccuccaccaccuguaa

SEQ ID NO: 52430 - RNA, 64 nt, Human
ucacugaaugcuucugacuucauagauuuccuucccaucccagcugaaauacugaggggucucc

SEQ ID NO: 52431 - RNA, 64 nt, Human
cccuggaacuccuaaaccuuugccccuggggcuuccaucccaaccagugccaaggaccuccucu

SEQ ID NO: 52432 - RNA, 64 nt, Human
gucucccauccccuacaccuucccccagccacagccaucccaccaggagcagcgccugugcaga

SEQ ID NO: 52433 - RNA, 64 nt, Human
agaaagucuaaauuccuuccaagacaguagaauuccaucccaguaccaaagccagauaggcccc

SEQ ID NO: 52434 - RNA, 64 nt, Human
ugguuuugauauggcuagugaccagcacugaccaccaucccaagcugggaagagcaauugguga

SEQ ID NO: 52435 - RNA, 64 nt, Human
ccaaggacuuccacauuuuugcacagauuaugcuccaucccauucacuucugcauuccuguaac

SEQ ID NO: 52436 - RNA, 64 nt, Human
ggaaaaacuugaggguuugggguucaaagucagcccaucccaccuggcaaaauccuccuggaag

SEQ ID NO: 52437 - RNA, 64 nt, Human
augaaaccaucaguagagacauugcuguuccugcccaucccagugccagcuacuccuuccugga

SEQ ID NO: 52438 - RNA, 64 nt, Human
ucauguacuguuugauugggugguucaucugcuuccaucccagugaaauuuaccuguagcccag

SEQ ID NO: 52439 - RNA, 64 nt, Human
cguguggaucucuaccaguacccuguugccauccccaucccacaggccugcauaggcagcagcg

SEQ ID NO: 52440 - RNA, 64 nt, Human
ucacaguccccacccuuucaaaguugacauauggccaucccauuggccagaauccacagacaca

SEQ ID NO: 52441 - RNA, 64 nt, Human
cuucugcaaccccagguauccuucauuauccaccccaucccagacucccaccccagggauugcc

SEQ ID NO: 52442 - RNA, 64 nt, Human
guaauucggagacuccaauucaccugccccucccccaucccagguuguggaggcucgaggaagc

SEQ ID NO: 52443 - RNA, 64 nt, Human
uccacuuuguuuagcauuucaagcuuuuauguauccaucccaucuaaaaacucuucaaacucca

SEQ ID NO: 52444 - RNA, 64 nt, Human
uggcacgagggcagggcuggcucucccaaugccuccaucccauccccauggugcuuuggccucc

SEQ ID NO: 52445 - RNA, 64 nt, Human
ccacucuggcuuuccgugccacucuucuuccuuuccaucccaaaagucucuugcggccccugaa

SEQ ID NO: 52446 - RNA, 64 nt, Human
uuucaguagggcuacaaaaccugauguuaaaauuccaucccaucaucuugguacuacuagaugu

SEQ ID NO: 52447 - RNA, 64 nt, Human
ccucagaggcuuaauguugccuguggagcagugcccaucccagcccguuucugcccaccaguug

SEQ ID NO: 52448 - RNA, 64 nt, Human
ggcgacugacagcucugcaggagagauugcaacaccaucccacacuguccaggccuuaacugag

SEQ ID NO: 52449 - RNA, 64 nt, Human
agaagagccaaccagaagagcucugcacagggacccaucccaugguuucuccccgaaagccgcu

SEQ ID NO: 52450 - RNA, 64 nt, Human
agaagaaagggugagaaacccuggccuaaacaauccaucccacagauccucaggcauuccuuug

SEQ ID NO: 52451 - RNA, 64 nt, Human
gaaacagugcagcccaggucccaugggggcagcuccaucccagagcauuucugauaguugaacu

SEQ ID NO: 52452 - RNA, 64 nt, Human
cuuccuaucccaucccaucccaucccaucccaucccaucccaucccgcucuuuuccuacuuuuc

SEQ ID NO: 52453 - RNA, 64 nt, Human
ccucucuuccuaucccaucccaucccaucccaucccaucccaucccaucccgcucuuuuccuac

SEQ ID NO: 52454 - RNA, 64 nt, Human
cccagccucucuuccuaucccaucccaucccaucccaucccaucccaucccaucccgcucuuuu

SEQ ID NO: 52455 - RNA, 64 nt, Human
cauuccccagccucucuuccuaucccaucccaucccaucccaucccaucccaucccaucccgcu

SEQ ID NO: 52456 - RNA, 64 nt, Human
cugcccauuccccagccucucuuccuaucccaucccaucccaucccaucccaucccaucccauc

SEQ ID NO: 52457 - RNA, 64 nt, Human
cuucucugcccauuccccagccucucuuccuaucccaucccaucccaucccaucccaucccauc

SEQ ID NO: 52458 - RNA, 64 nt, Human
auuaaaggauguggcuuuauuuuauaaaucacaaccaucccaacaguggauuuaaacaagauuu

SEQ ID NO: 52459 - RNA, 64 nt, Human
cauauccauuucuuuccucaccauccuacucuccccaucccacuccaucucacccuuagaagua

SEQ ID NO: 52460 - RNA, 64 nt, Human
uacaguauguuuuacauguauuuaaaguagcaucccaucccaacuuccuuuaauuauugcuugu

SEQ ID NO: 52461 - RNA, 64 nt, Human
ugauagcgucucugcacgugaccucugacaaagcccaucccaggagacggggugaagcuauucc

SEQ ID NO: 52462 - RNA, 64 nt, Human
guuccacuaacuaauaagugacaaaacugagcauccaucccagaucugucugacucugggucag

SEQ ID NO: 52463 - RNA, 64 nt, Human
gaacuccuccaucuuccaaaucaaucaggcccauccaucccaugccucccuccuccccacccca

SEQ ID NO: 52464 - RNA, 64 nt, Human
auguuucuaucccccaucucaguguuuucuuuauccaucccagugaugccuuauuugaaacugg

SEQ ID NO: 52465 - RNA, 64 nt, Human
gaccccuuggggagcaggcucgggcuccccagccccaucccaaacccuucagugccaaaaacaa

SEQ ID NO: 52466 - RNA, 64 nt, Human
agguggcuaaacuugcacgcacgugugugaaaagccaucccaucuucugccuccaguuggagcu

SEQ ID NO: 52467 - RNA, 64 nt, Human
ccaugggugacccugcgauauccacugucauuuuccaucccauccccaccaccugagugacaga

SEQ ID NO: 52468 - RNA, 64 nt, Human
guacuccuccagauggaaucaggaagucgagacaccaucccagguguguguaagagagagagag

SEQ ID NO: 52469 - RNA, 64 nt, Human
cuacaugcaucucuccacucaacuccaccccaucccaucccaccuugaaaaucacugcucugaa

SEQ ID NO: 52470 - RNA, 64 nt, Human
ucuaacuacaugcaucucuccacucaacuccaccccaucccaucccaccuugaaaaucacugcu

SEQ ID NO: 52471 - RNA, 64 nt, Human
cugacuuucugugaaggcaccagcuugcaauaugccaucccauuucaccuugcaugugagacag

SEQ ID NO: 52472 - RNA, 64 nt, Human
caaaacaugauuauaguggcagcugaccaaucccccaucccaaauugaccauuuagauguacca

SEQ ID NO: 52473 - RNA, 64 nt, Human
agauauagaucaauaccuguuugaucacugcucuccaucccauguaccacaacuaucuugcugc

SEQ ID NO: 52474 - RNA, 64 nt, Human
acccugaaugggcaugcagagccugugucaggccccaucccagcaggccuggguggccacuuuc

SEQ ID NO: 52475 - RNA, 64 nt, Human
gugcaucucaucuggacuauggguuguacugugaccaucccaacaccucacccucugucuacaa

SEQ ID NO: 52476 - RNA, 64 nt, Human
uguuuuguuuuguuuuauuauuuucauaucaccuccaucccauaaaguuguacugugaacugga

SEQ ID NO: 52477 - RNA, 64 nt, Human
accaggagccaggcugugccaugucccccgccccccaucccagccggcccgguccgaacgcggg

SEQ ID NO: 52478 - RNA, 64 nt, Human
gaaugagaacacaaauuggauaauccacugucucccaucccaggagguggugaguuggcuacaa

SEQ ID NO: 52479 - RNA, 64 nt, Human
ggccuuguugccuugggcguguguucagcaccucccaucccauggauacaguggagauuccaua

SEQ ID NO: 52480 - RNA, 64 nt, Human
gaggcucuucuaacacccucagucagugacacacccaucccauccaccacuucccccguguggg

SEQ ID NO: 52481 - RNA, 64 nt, Human
aaagccucuaguguaccuuccuccucuuacucauccaucccagucaacaugauguugucaauga

SEQ ID NO: 52482 - RNA, 64 nt, Human
uaacuugcauaguaggaccauaccucuuccuuucccaucccacccacauaugauagacagcccc

SEQ ID NO: 52483 - RNA, 64 nt, Human
ugagcccuagccugaggauaaaggcugagccuggccaucccagauugcaacugccucccuguua

SEQ ID NO: 52484 - RNA, 64 nt, Human
gaggcugcugaagugaguagcugagcagcuggagccaucccaagcaucagugucucagaguccu

SEQ ID NO: 52485 - RNA, 64 nt, Human
uauguacagagacugaccucacagacugaccauuccaucccacagcugcuggacauagagugau

SEQ ID NO: 52486 - RNA, 64 nt, Human
cccucagcagagggcagcacuugaaugcuuagcuccaucccauaguucucuacuucauauaaau

SEQ ID NO: 52487 - RNA, 64 nt, Human
auggggaagggucuguuccagccucucccuacucccaucccauuuccaccaacuggggaacugu

SEQ ID NO: 52488 - RNA, 64 nt, Human
ccucaaguagcaggccggcccgggccgccaccgcccaucccagaccauggagcgcgcugggaag

SEQ ID NO: 52489 - RNA, 64 nt, Human
gcaggugcggggaagggaagggcccaggccagacccaucccaaacggaugaugggaugauggga

SEQ ID NO: 52490 - RNA, 64 nt, Human
gcgcugcaguauugacuuggaauccugaccauguccaucccaaaauucaguccucaguuaacgg

SEQ ID NO: 52491 - RNA, 64 nt, Human
cucuuugggucuuucccggguacacuagauggcuccaucccaaggcaucuugucauaaaacagc

SEQ ID NO: 52492 - RNA, 64 nt, Human
gcugcuagugccaucgugguguguggcaggugggccaucccaugucccuccagggggaccccac

SEQ ID NO: 52493 - RNA, 64 nt, Human
uuccaaaaaaaauguucuccucuaaaaggaaaccccaucccauuaagcagauacucuccauucc

SEQ ID NO: 52494 - RNA, 64 nt, Human
aagcaaggagggguugcuucccucccuaccucauccaucccacacaccuuggccuucugcaagc

SEQ ID NO: 52495 - RNA, 64 nt, Human
uacaucggggccaccaaaucaccacucuucagccccaucccacucccuguuucgggccucgucu

SEQ ID NO: 52496 - RNA, 64 nt, Human
ugccuguaaacgcucuguaaauacucccuuccacccaucccagccccugggcagccgggcagaa

SEQ ID NO: 52497 - RNA, 64 nt, Human
ggcucaugcagccacaggucaccuucugugauccccaucccaaggcacugguggugacucugcu

SEQ ID NO: 52498 - RNA, 64 nt, Human
gauuuguccacauuuuauuguuuuccuuuuauuuccaucccauggauuaccuagagggaaauua

SEQ ID NO: 52499 - RNA, 64 nt, Human
agcacaacuuuaagaggacauaaugggguccuggccaucccacaaguggugguaacccuggugg

SEQ ID NO: 52500 - RNA, 64 nt, Human
cugcguaggaauaaccauaauuaucuuacuaauuccaucccagaaaagccugugaucccugagg

SEQ ID NO: 52501 - RNA, 64 nt, Human
cauugcaaaagcacuggcucauccgcccuacuucccaucccacacaaacccaauuguaaauaac

SEQ ID NO: 52502 - RNA, 64 nt, Human
caaacuccugaucucaagugaucugcccaccucaccaucccaaagugcugggauuacaggcgug

SEQ ID NO: 52503 - RNA, 64 nt, Human
gcaauucauucucucugaacacacauugcuauucccaucccacccccaaugcacagggcugcaa

SEQ ID NO: 52504 - RNA, 64 nt, Human
cucccaaucugcagugggagagcuuugcugaauuccaucccaaagucaaacaugggcaagaggu

SEQ ID NO: 52505 - RNA, 64 nt, Human
aggaauggcccgugcaucccugcuagucucaggcccaucccagagcacugagaggccacaaucg

SEQ ID NO: 52506 - RNA, 64 nt, Human
guucugaguuuucggugccguguuccuaacuacuccaucccaugaccucgccacaccuacuggg

SEQ ID NO: 52507 - RNA, 64 nt, Human
agcccaagccaggagggauuucccuuaggcaacaccaucccagggagaucugccacaauuugcg

SEQ ID NO: 52508 - RNA, 64 nt, Human
uuucgauacccaggaccaagccacagcagguccuccaucccaacagccaugcccgcauuagcuc

SEQ ID NO: 52509 - RNA, 64 nt, Human
aggagcaagacuguccaguucuccuccacaucucccaucccagaaucaggaucugggacuggca

SEQ ID NO: 52510 - RNA, 64 nt, Human
caguacuccacaaacaugggugguaacaagaguuccaucccaggaggccaaacggugcaacaga

SEQ ID NO: 52511 - RNA, 64 nt, Human
caccggugggaccaaaagggaacaggugccucagccaucccaacagugucgucagagggucccc

SEQ ID NO: 52512 - RNA, 64 nt, Human
agcccucagauggaacgaaaggcgaugugcaaggccaucccagagagacggaagcaggugcgau

SEQ ID NO: 52513 - RNA, 64 nt, Human
agaauucacuuuaugugagaucucccgagaguuuccaucccaacaugauggacuuugguuugaa

SEQ ID NO: 52514 - RNA, 64 nt, Human
gagaagagccagucagaugucugcaggcauuugcccaucccagccucucuggccagggccuuac

SEQ ID NO: 52515 - RNA, 64 nt, Human
uuacaauugcaguuuugccuaauggcaaaaccagccaucccauuggcaaaagagucaacaguau

SEQ ID NO: 52516 - RNA, 64 nt, Human
cugacuucaggguugccacagaagagggggcuuuccaucccacccuggcuuccuuccuccaccc

SEQ ID NO: 52517 - RNA, 64 nt, Human
auauguguucucaaguuuucagugucaaggaaugccaucccagaagcucauucucagaugcaca

SEQ ID NO: 52518 - RNA, 64 nt, Human
aacauuccgacguguaacucacagccgaagcacuccaucccagauuuguugucugggaacuuag

SEQ ID NO: 52519 - RNA, 64 nt, Human
uuuuuguaaauaaacaggaacugauuuucugccuccaucccacccaugagggcugcaggcacua

SEQ ID NO: 52520 - RNA, 64 nt, Human
gcaccccccuguguccagcccucuguuucucuuuccaucccauggagugcuucccagucuccag

SEQ ID NO: 52521 - RNA, 64 nt, Human
gcccaccucugcgcggacgaccccgacuuccgugccaucccagacgggccgcgaaggcggggug

SEQ ID NO: 52522 - RNA, 64 nt, Human
acuuagguacuuuucucacguggacacacugaucccaucccauauugcaucuuggaagagaugg

SEQ ID NO: 52523 - RNA, 64 nt, Human
cgggaggcagagguugcagugagccaagaucaugccaucccacucuagcuugggcaauagagca

SEQ ID NO: 52524 - RNA, 64 nt, Human
gcacuuccuugccuccguaaggccagaggaagaaccaucccaaucauuugaucuccagcuccac

SEQ ID NO: 52525 - RNA, 64 nt, Human
ccauccugccagaacaggcccucaagcccaagagccaucccaggccuguucaggccucagcuaa

SEQ ID NO: 52526 - RNA, 64 nt, Human
aagccaggaugcccugugguuguggcgccccaggccaucccaaacccaguggcagaggaagcug

SEQ ID NO: 52527 - RNA, 64 nt, Human
aaauugccucucccagggccugcugggugagucaccaucccaaagcaggaagggugcccuggag

SEQ ID NO: 52528 - RNA, 64 nt, Human
accucggacccagccacgucgccccugguccuggccaucccacgccgccugcguguggagcugg

SEQ ID NO: 52529 - RNA, 64 nt, Human
gcccacacaaagcuggacacccccaggcucuacuccaucccauuggagucucuucuuuuuuuga

SEQ ID NO: 52530 - RNA, 64 nt, Human
caugaccagcucucugccucccuuccaggaggcuccaucccacacuguucacccaggcugcgga

SEQ ID NO: 52531 - RNA, 64 nt, Human
ggcuucugaccaaaaaccaagcucuaccccauccccaucccagaccugcaggagacgagcgagc

SEQ ID NO: 52532 - RNA, 64 nt, Human
uuagaauaugaccaugagccauuucacagaaaaaccaucccaccgaagauauugucuaucaccc

SEQ ID NO: 52533 - RNA, 64 nt, Human
gugguccaaacagaacuaagcauaaaucauugugccaucccaaaccucguuccagccgccuugc

SEQ ID NO: 52534 - RNA, 64 nt, Human
uuguccgugagcuccgugcacuucaccaaagcccccaucccagcacacaggacccguguguaug

SEQ ID NO: 52535 - RNA, 64 nt, Human
caaguuucgccaugcuggaugaugaaauggauucccaucccaaagucugagauggauugcauau

SEQ ID NO: 52536 - RNA, 64 nt, Human
cagcuggacucaggggacacggccuguggccucaccaucccagagggcuucaccagugugggau

SEQ ID NO: 52537 - RNA, 64 nt, Human
uuaaaaaaauaagucgccccuccaaaacacgcccccaucccacagcgcuccgcagcuucccacc

SEQ ID NO: 52538 - RNA, 64 nt, Human
cgccuugucuguguauuucuauuuugcagcaguaccaucccacugauaucacgggcccgcucaa

SEQ ID NO: 52539 - RNA, 64 nt, Human
auuacuuuguucuugguccuucacagggccugcuccaucccaccuuccuuucugcugccugaug

SEQ ID NO: 52540 - RNA, 64 nt, Human
gucccguggaugcucuuucaaugcagcacccuugccaucccaagcccagugaccuuacucguau

SEQ ID NO: 52541 - RNA, 64 nt, Human
gggcaugguggcccauguagucuccugggccucaccaucccagaagaggagugggagccagcuc

SEQ ID NO: 52542 - RNA, 64 nt, Human
uuggugcuagagccagggccaucuggacuaugcuccaucccaagggccaagggucaggggccgg

SEQ ID NO: 52543 - RNA, 64 nt, Human
caagugaagccagcagaggagugauagcugcuccccaucccaaagugggccugggcagucaggc

SEQ ID NO: 52544 - RNA, 64 nt, Human
uuaauaagguuuuaaugugagauauuccugcaaaccaucccauuucuacugauuguaagucaga

SEQ ID NO: 52545 - RNA, 64 nt, Human
gcuuccuuucucucuccugccucuccucugcuccccaucccacuuucucaucugccuccuuuuc

SEQ ID NO: 52546 - RNA, 64 nt, Human
ugcauggccaggguggcaggaagacauccccccuccaucccagcccacuggaccagaacuggga

SEQ ID NO: 52547 - RNA, 64 nt, Human
uuccagccugggaaucaacccaguuccugagugcccaucccaccccgcgguugccucuccucgg

SEQ ID NO: 52548 - RNA, 64 nt, Human
gugucuauagcaaaguuuuucuaucaauuuucccccaucccauccccacccuggacucauuuga

SEQ ID NO: 52549 - RNA, 64 nt, Human
uugcaccuccaggguccugcguggacucuggguuccaucccaccugcuacaugcucaccagguc

SEQ ID NO: 52550 - RNA, 64 nt, Human
agucgccaugccguugcgaggccuccgggaugucccaucccaagccaucacacuccacaaaaac

SEQ ID NO: 52551 - RNA, 64 nt, Human
cacaaguauuuccugccccgagccuaugcugucgccaucccacuggcugcaggccuccugcugc

SEQ ID NO: 52552 - RNA, 64 nt, Human
ccggccguccuccuaccuggggcagcuggggcugccaucccauuucuccugccucuggaaggug

SEQ ID NO: 52553 - RNA, 64 nt, Human
gaagggaaucuacugagggcucagaccacaugccccaucccaugcuguccauccauucucacag

SEQ ID NO: 52554 - RNA, 64 nt, Human
aaaagagugguucuggaaucaauguuuuccagucccaucccagaacaucaguuguaagauaagu

SEQ ID NO: 52555 - RNA, 64 nt, Human
gaguucagcuuuuaccagccucaguguggaggcuccaucccagcacacaggccuggggcuuggc

SEQ ID NO: 52556 - RNA, 64 nt, Human
guauccuaguuuaguagugguuacauuaucaggcccaucccagauguuugugauguccugaaac

SEQ ID NO: 52557 - RNA, 64 nt, Human
cacauccuucagcagcugagaaacgaacacgaauccaucccaaccgagaugccauuaacauuca

SEQ ID NO: 52558 - RNA, 61 nt, Human
cugccuccccggugacaugagcugugcccugccaucccacuggcacguuuacacucugugu

SEQ ID NO: 52559 - RNA, 64 nt, Human
ccgucccauauccugccucagcccgccaagguagccaucccaugaacacacuguguccuggugc

SEQ ID NO: 52560 - RNA, 64 nt, Human
uucagggcugagaauugacgagaagccagcucacccaucccagaccucacagucccucagguuc

SEQ ID NO: 52561 - RNA, 64 nt, Human
acucaguccagcccaagacuacucugggcagcucccaucccagucuggggccauuugcagacuc

SEQ ID NO: 52562 - RNA, 64 nt, Human
cgcgaugccucccggccaccgccccagccucaccccaucccacgacccccgcaacccuucacau

SEQ ID NO: 52563 - RNA, 64 nt, Human
ggcggcgagggcggcgagggcgccgagguccggcccaucccaguccuguggggcuggccgggca

SEQ ID NO: 52564 - RNA, 64 nt, Human
ugcugugguucugggugauuuaucuggucccuucccaucccagagcuuuaugauucuguaauaa

SEQ ID NO: 52565 - RNA, 64 nt, Human
uuaguaauaaaaaacaaaaauuccauaucuagccccaucccacaccuguuucaaauccuugaaa

SEQ ID NO: 52566 - RNA, 64 nt, Human
gggcaugcuacuuaauaucucugugccucaguucccaucccauaaaagaguagugauagugaca

SEQ ID NO: 52567 - RNA, 64 nt, Human
guauccuaauuuaguagugguuacuucaucaggcccaucccagguguuugucguguccugaaac

SEQ ID NO: 52568 - RNA, 64 nt, Human
agugcuuuuugugucauguuuaagaaauuuuugcccaucccaaaaucauaagauauuuuucaug

SEQ ID NO: 52569 - RNA, 64 nt, Human
aggugcagccaaauaucacaccuucugaucuuagccaucccaaaccaguaucugucccgagagg

SEQ ID NO: 52570 - RNA, 64 nt, Human
ucccuggacuuaaagcccagccaggugucaugguccaucccagcucacugcauacauccaucgg

SEQ ID NO: 52571 - RNA, 64 nt, Human
aaucacugaccagccuugacacuccccuugcaaaccaucccagcacugcaccccaggcagccac

SEQ ID NO: 52572 - RNA, 64 nt, Human
gucauagcgugaucuuagccuagguaggccacauccaucccaaaggaaaauguagacaucaccu

SEQ ID NO: 52573 - RNA, 64 nt, Human
uuuuaccaccaacuuaggggacuguuuuaaagagccaucccaaggccucuccuagcaggcagaa

SEQ ID NO: 52574 - RNA, 64 nt, Human
cuuucuugcagacaagucacuacagaaacauaccccaucccacccaccccugccucugccccag

SEQ ID NO: 52575 - RNA, 64 nt, Human
acccacccccaccccuacccuaccccaccacaccccaucccagaggccuugccugggcaacccu

SEQ ID NO: 52576 - RNA, 64 nt, Human
gaaugggugaccucaaagaugcccccuguccaagccaucccacagcuggaagguaggggauggg

SEQ ID NO: 52577 - RNA, 64 nt, Human
cuuugauuucggcaagcuggaauggcccaccagcccaucccagaucuuccuuuauuaaaauaau

SEQ ID NO: 52578 - RNA, 64 nt, Human
ggcuggagcaguucuuuuucaguucucauccucuccaucccaauccaguauaucaaucaacucu

SEQ ID NO: 52579 - RNA, 64 nt, Human
ggcagcacagacguggggcauccccagaaagacuccaucccaggaccagguuccccugcgugcu

SEQ ID NO: 52580 - RNA, 64 nt, Human
aggaacuggggccuugccuugcagccacauggccccaucccaguuggggaagccaggugagcuc

SEQ ID NO: 52581 - RNA, 64 nt, Human
cugguacccguaaaaguugugggaauugugacccccaucccaaggggaugccaaaauuucucuc

SEQ ID NO: 52582 - RNA, 64 nt, Human
uuugcaggcaggaauaugcugaccuuucacccugccaucccaucccaaccccagcucacuagcc

SEQ ID NO: 52583 - RNA, 64 nt, Human
aggcaggaauaugcugaccuuucacccugccaucccaucccaaccccagcucacuagccuucau

SEQ ID NO: 52584 - RNA, 64 nt, Human
acguggccuccgugguauggaccugguggcuucuccaucccacuguggccucugugguauggac

SEQ ID NO: 52585 - RNA, 64 nt, Human
caguucccuccuuuucuugcauguaaguugucccccaucccaaaguauuccaucuacuuuucua

SEQ ID NO: 52586 - RNA, 64 nt, Human
ccagagaauggcacccaagagccugcggggaugcccaucccacacaccccacccagcuguucua

SEQ ID NO: 52587 - RNA, 64 nt, Human
cagagugcccccacguggaacauucuggagcuggccaucccaaauucaaucaguccauagagac

SEQ ID NO: 52588 - RNA, 64 nt, Human
ccugccucauggagcuguuguauagaucccagauccaucccaugauuuguuccugucugaggca

SEQ ID NO: 52589 - RNA, 64 nt, Human
auaacgucaggcccaaguguggacacacugccgcccaucccaucaggucaugaggaaggguucu

SEQ ID NO: 52590 - RNA, 64 nt, Human
ccgugcagacaagugaccugccagagcccaagugccaucccacauucggacccugcccauaccc

SEQ ID NO: 52591 - RNA, 64 nt, Human
acuggaggaccacacucaagccgacuuaugcccaccaucccaccucuggauaauuuugcauaaa

SEQ ID NO: 52592 - RNA, 64 nt, Human
auuuaccggcagugcgggaggaauuucugaguggccaucccaaggucuagguggagguggggca

SEQ ID NO: 52593 - RNA, 64 nt, Human
cucuacucaccccuagggccucaguaaacucagaccaucccaacuggggcuccuggggguacag

SEQ ID NO: 52594 - RNA, 64 nt, Human
uucaauucugccauuagagacacauccaaugcucccaucccaaagguucaaaaguuuucaaaua

SEQ ID NO: 52595 - RNA, 64 nt, Human
uugaggguggggggagggcaccggagccuugccaccaucccaggacuuugggcaagucacccgc

SEQ ID NO: 52596 - RNA, 64 nt, Human
ccugccuuccuucucuucccaagcccuccaauccccaucccaggcuugcugugucucacugucc

SEQ ID NO: 52597 - RNA, 64 nt, Human
cccaucgccucuagcggggacccuccuuuccuccccaucccaccugugugcagugcccuugccu

SEQ ID NO: 52598 - RNA, 64 nt, Human
ccccucuaggcacacgcgcacuuccaucucugccccaucccaacugcaccagcacugccucccc

SEQ ID NO: 52599 - RNA, 64 nt, Human
accagguccaguacuaacucugaagaaguuaugcccaucccaucuucaccccaagccuucuccu

SEQ ID NO: 52600 - RNA, 64 nt, Human
cauacagacacacacacucucucucucuuucuuuccaucccaccccccuuggaauuauuuaguc

SEQ ID NO: 52601 - RNA, 64 nt, Human
aaggcugagugaagagaguccagguuccggagcaccaucccacgguggccuucccccugcacgc

SEQ ID NO: 52602 - RNA, 64 nt, Human
uauggcuuucugcaacuugcuacucucucccucuccaucccaucuuugcagccucauagggugg

SEQ ID NO: 52603 - RNA, 64 nt, Human
agauguuuuuucuccuuuguccaaaggccagagaccaucccaggaagaguggugggugguuuau

SEQ ID NO: 52604 - RNA, 64 nt, Human
ggacaaaaggaguaauuauuugguauagauccacccaucccaaccuuucucuccucagucccug

SEQ ID NO: 52605 - RNA, 64 nt, Human
uggaauucugaauguguugugacagcugcuguucccaucccagcucagaagacacccuucaacc

SEQ ID NO: 52606 - RNA, 64 nt, Human
cuggagagaaaucccaagaggcagcccuuccucaccaucccauuaaagaccgggcugguuagcg

SEQ ID NO: 52607 - RNA, 64 nt, Human
uugucugccuuuuccuuuccaucccuugccccacccaucccaucuccaacccuagucuuccauu

SEQ ID NO: 52608 - RNA, 64 nt, Human
aauuccguaaaagcauugacgcagccccuacacuccaucccaaccaagaaacugcauuuccugg

SEQ ID NO: 52609 - RNA, 64 nt, Human
aggagccugcagucgccucuaaaauccuaccuaaccaucccauggucacucgggcccaugccuu

SEQ ID NO: 52610 - RNA, 64 nt, Human
ucuuucuacaagaguuuucugcccaaggccacagccaucccacucucugcuuccuugagauuca

SEQ ID NO: 52611 - RNA, 64 nt, Human
cacacacacauacauauacauguguauauauauaccaucccauauauaugugggauauauauau

SEQ ID NO: 52612 - RNA, 64 nt, Human
gucuaacccggggugccaggaacacacacauccuccaucccagcauagagaauggggacucccu

SEQ ID NO: 52613 - RNA, 64 nt, Human
aucuggcucauuugaaauuucuucucccucucaaccaucccacuaaguuauagccaagaaggga

SEQ ID NO: 52614 - RNA, 64 nt, Human
ugaccuguguuuuggcaaggugauccuuccagagccaucccaaaaagucagcacugacauggga

SEQ ID NO: 52615 - RNA, 64 nt, Human
acugcaagagaaacccccacccggcaagcccgccccaucccagacaggaagcagagucccacag

SEQ ID NO: 52616 - RNA, 64 nt, Human
aagaaucuagaccuagaaauaccauuugacccagccaucccauuacuggguagauacccaaagg

SEQ ID NO: 52617 - RNA, 64 nt, Human
ugaaguuuccuuaauuagacuaauuauuuuauccccaucccaggguauaaacaggaauuguuuu

SEQ ID NO: 52618 - RNA, 64 nt, Human
ggcucaggaagccaagaaacuggaugccaagaccccaucccagcggaacaaguggcaacagcag

SEQ ID NO: 52619 - RNA, 64 nt, Human
uagcacugucaggcagcuuucggcuggggcucacccaucccauaggaggccuauguggagcauu

SEQ ID NO: 52620 - RNA, 64 nt, Human
cauuugccaggacauguuggccagaggucugggcccaucccaggccucaaggcccuccaggccu

SEQ ID NO: 52621 - RNA, 64 nt, Human
uuauuccugcugauggcugagaagcaucugucuuccaucccacuugccugucccaaguuuuguu

SEQ ID NO: 52622 - RNA, 64 nt, Human
caagguacagccuaauggcuugccccacucaaaaccaucccagcucuucacccaggucuccucu

SEQ ID NO: 52623 - RNA, 64 nt, Human
auaggguuuccccuuuacuauaacucuagcauccccaucccauuugacacugggggcaaggguu

SEQ ID NO: 52624 - RNA, 64 nt, Human
uccuccccauguacccaaggaagauggagcucccccaucccacacgcacugcacugccauuguc

SEQ ID NO: 52625 - RNA, 64 nt, Human
ugcccccuuggguugcucugccaauguauuaauaccaucccauagcuccugccaaaucgagacc

SEQ ID NO: 52626 - RNA, 64 nt, Human
ucccauuuccucugcccuuuuccaccucccccuuccaucccaccagcugccaguggcucccaga

SEQ ID NO: 52627 - RNA, 64 nt, Human
guaccuuuggcuuuuuacuuguuuuuuuggauagccaucccaccauaggauguguacauagaua

SEQ ID NO: 52628 - RNA, 64 nt, Human
cccauccucggcgguucccaucaccacugcaguuccaucccaagucacagcugcccuagguccc

SEQ ID NO: 52629 - RNA, 64 nt, Human
cagcucagucuccccucucucccuguccugcauuccaucccagcuccucagcauggccucagug

SEQ ID NO: 52630 - RNA, 64 nt, Human
auccccuucacaguguuaacacaaaagggcaucaccaucccacgaugucugaaaccagagcagg

SEQ ID NO: 52631 - RNA, 64 nt, Human
aagucauucuugaccagccaugaaaccagaggcgccaucccauucugccggaggacagccagcg

SEQ ID NO: 52632 - RNA, 64 nt, Human
aagaacaccuuccuccuccaucccccacuucaccccaucccauaccaguuccauccagggucug

SEQ ID NO: 52633 - RNA, 64 nt, Human
cucuaccauggggcaucccaagugggguccucacccaucccagcuacugcagcucuguauuacu

SEQ ID NO: 52634 - RNA, 64 nt, Human
ucuggaucugucucuguauuccucacucccuuccccaucccaaccccuucuuucucuagauugu

SEQ ID NO: 52635 - RNA, 64 nt, Human
auuuaaagcauucauguuucuccccaccuuauccccaucccaccuuuauuauuauuauuuuucu

SEQ ID NO: 52636 - RNA, 64 nt, Human
ccugcacccacaucccauacccucuucucccuacccaucccauuccccacaggcccuacauuaa

SEQ ID NO: 52637 - RNA, 64 nt, Human
aggcccaacccuuagguuuaaaaagucagguuguccaucccauuggguucacugagugaaggca

SEQ ID NO: 52638 - RNA, 64 nt, Human
uccugggugggacagagcaggacaaugcaagauuccaucccacuacucagaauggcaugcugcu

SEQ ID NO: 52639 - RNA, 64 nt, Human
uggauuggcaggcccuguccgaggaguugggggaccaucccagcaggugaggaaccagcagagg

SEQ ID NO: 52640 - RNA, 64 nt, Human
uagcuucggguaucagaggaggcugaccuggcccccaucccaaguuacaagaacuucagugaga

SEQ ID NO: 52641 - RNA, 64 nt, Human
uuuuacuguauguuuuuacugaaugaucuauuccccaucccaaggcaagcaugaauaaaauuag

SEQ ID NO: 52642 - RNA, 64 nt, Human
ugguaguguucagcugcuucagcaguguccccaaccaucccaauagggugggggccugugggcc

SEQ ID NO: 52643 - RNA, 64 nt, Human
uugaaccacuucucagagauaucuucccaggugcccaucccaacguuacuauuauaucauaauu

SEQ ID NO: 52644 - RNA, 64 nt, Human
cugggcucucuagguggcccuggucuugccccauccaucccaccugccacuaccuugggugucc

SEQ ID NO: 52645 - RNA, 64 nt, Human
acacuggugaagucuguguacccauacugcagccccaucccauggggccccugaagacccacug

SEQ ID NO: 52646 - RNA, 64 nt, Human
gagcaccuggugaugauggagaagauccuagggcccaucccaucacacaugauccaccguacca

SEQ ID NO: 52647 - RNA, 64 nt, Human
uuaacugggcaccugagaugggaaccaauggggaccaucccagacacauggguuugucuguccc

SEQ ID NO: 52648 - RNA, 55 nt, Human
cccaggagagccgccucugaugcccccaucccacugggacauuuagcaaggaggu

SEQ ID NO: 52649 - RNA, 64 nt, Human
ccagcagagcaggcagucaggccccagcgugccuccaucccagugccccgaugaccaucugguc

SEQ ID NO: 52650 - RNA, 64 nt, Human
caaagaucauguauauaaucgaaguguauuaguaccaucccaagguuuuuuucucauuuaacau

SEQ ID NO: 52651 - RNA, 64 nt, Human
caaaacagaucugaauucugcccuuuucucucacccaucccaccccuccauuggcucccaaguc

SEQ ID NO: 52652 - RNA, 64 nt, Human
aucauuaccucauuuccagccucccaggcuccauccaucccagcaucuuuuauucugccauuuu

SEQ ID NO: 52653 - RNA, 64 nt, Human
ucacccggcccccaugcaaggugcccacauguguccaucccagcggcuggugcagggccuccau

SEQ ID NO: 52654 - RNA, 64 nt, Human
cucgccccaagacuggggauccuggccacuguucccaucccaugucccuguggguagugacugu

SEQ ID NO: 52655 - RNA, 64 nt, Human
cauucauucaccuaacuuucauuaaauagcugcaccaucccaggcccugugcggagcaucggga

SEQ ID NO: 52656 - RNA, 64 nt, Human
gaaucucagccagccuccagcaccuucccucucaccaucccacugcccccucgcucccauguuu

SEQ ID NO: 52657 - RNA, 64 nt, Human
cugaacucuccagcuucgcgugagaaguccccuuccaucccagagggugggcuucagggcgcac

SEQ ID NO: 52658 - RNA, 64 nt, Human
ucugcugcuggcugguuagagguucccuuugacgccaucccagccccaaugaacaauuauuuau

SEQ ID NO: 52659 - RNA, 64 nt, Human
aagaacuguggaccaugccagucccgucugguuuccaucccaccacuccaaggacugagacuga

SEQ ID NO: 52660 - RNA, 64 nt, Human
cuggccccaugaccccuucuccuguccccagcucccaucccaguuguggguuaagaauaggcua

SEQ ID NO: 52661 - RNA, 64 nt, Human
aagaacaugacuucugucugagcuaagcuggcacccaucccagggcuccucuggagcuaauccu

SEQ ID NO: 52662 - RNA, 64 nt, Human
gccaaguugguagcagugacccagugauucacugccaucccaggccuuaacuagcaaaacuacg

SEQ ID NO: 52663 - RNA, 64 nt, Human
ugggcccagccccccuccuuccagccuuugcuccccaucccacguuccacucgcccugccuguu

SEQ ID NO: 52664 - RNA, 64 nt, Human
acaucuucaggaagcugugcagccucugccauugccaucccagggggaucuggcauccuccuaa

SEQ ID NO: 52665 - RNA, 64 nt, Human
ccuuuaggguucccggagcuccgggaagacccgcccaucccaggacuccagaugccaggagccc

SEQ ID NO: 52666 - RNA, 64 nt, Human
cagcuguugcugaggagggggcugggaccccuucccaucccaaccuugagccccaggagauacc

SEQ ID NO: 52667 - RNA, 64 nt, Human
gagcgcgaggaucccgaugaggggauggaccgcgccaucccagggcuggggaggagcggggagg

SEQ ID NO: 52668 - RNA, 64 nt, Human
uugcauggcacagcucacuuuggcccuucuccacccaucccaaccccauugcuaacaacauggu

SEQ ID NO: 52669 - RNA, 64 nt, Human
ggggaccugcuuuggagaucagccucaccuucucccaucccagaagcggggcuuacagccagcc

SEQ ID NO: 52670 - RNA, 64 nt, Human
cacuccgguuccccgcaacccacagcucagcugcccaucccagucccucgccgucccucccagg

SEQ ID NO: 52671 - RNA, 64 nt, Human
aaacagugaccugcaggucggaggggcaggagccccaucccagccgugguucuguugccgccga

SEQ ID NO: 52672 - RNA, 64 nt, Human
cuucccuccagucuucugagggauaggggacauuccaucccaagcuucucccuuacccacaccu

SEQ ID NO: 52673 - RNA, 64 nt, Human
cucuagaggcugccugggccuguucacguguuuuccaucccacauaaauacaguauucccacuc

SEQ ID NO: 52674 - RNA, 64 nt, Human
aagaaauuagugcagauugcagauguucugucuuccaucccaaacaagccugccaugagguagg

SEQ ID NO: 52675 - RNA, 64 nt, Human
agcagcaccuggggcuccagcugcuggaauccuaccaucccaggaggcaggcacagccagggag

SEQ ID NO: 52676 - RNA, 64 nt, Human
cgucuggaaagugaggagcgccucugcccggccgccaucccaucuaggaagugaggagcgccuc

SEQ ID NO: 52677 - RNA, 64 nt, Human
caucuaggaagugaggagcgccucuucccagccgccaucccaucuaggaagugaggagcgucuc

SEQ ID NO: 52678 - RNA, 64 nt, Human
ccaaagaaaugaguuuuggggaggaacacaacucccaucccagucaguuuccuucccauggcug

SEQ ID NO: 52679 - RNA, 64 nt, Human
caucucugguuuucuugccacccucugggaguccccaucccauuuucauccugagcccaaccag

SEQ ID NO: 52680 - RNA, 62 nt, Human
gccaccuugcccagcccugagccaagcccuccccaucccauguauuuaucucuauuuaauau

SEQ ID NO: 52681 - RNA, 64 nt, Human
gacauccccuuccucagcccucccagccuacuccccaucccagcuuuuagaggaucugcuccac

SEQ ID NO: 52682 - RNA, 64 nt, Human
accuccugguggugagccagucugcauucccacgccaucccaaagcccuuucaucuuccccgug

SEQ ID NO: 52683 - RNA, 64 nt, Human
ccagguccguucggccuagugaugaugucaucguccaucccaucuuccuuugcccccaggaaag

SEQ ID NO: 52684 - RNA, 64 nt, Human
acaagagaaaccaucucugaccacccccuccuccccaucccacccuuuggaaacuccccauugu

SEQ ID NO: 52685 - RNA, 64 nt, Human
ccccuucucucuccagaaacagcugcuucuccccccaucccagggucccacccccaacccccag

SEQ ID NO: 52686 - RNA, 64 nt, Human
cuggguugccugaauuugugggagacccgugaucccaucccagagugugcgggggacggaggua

SEQ ID NO: 52687 - RNA, 64 nt, Human
uggaaaaccauuuccccuuccaguagcuugguguccaucccagagcauucaugaagucuucccg

SEQ ID NO: 52688 - RNA, 64 nt, Human
ucauuucuucuagguuuucuuggcccagcacugcccaucccaccccaugaggcucacucauugc

SEQ ID NO: 52689 - RNA, 64 nt, Human
gggccucccugcucugugauuggauaaauauuucccaucccacccaccuccccccaaaaaauag

SEQ ID NO: 52690 - RNA, 64 nt, Human
uggugaaccuuaguaccuaaaaggaaaucucaccccaucccacacccuggaggauuucaucucu

SEQ ID NO: 52691 - RNA, 64 nt, Human
caccucacuaucauacucagcuuccccugauggcccaucccagccccugaagcucuaugccaag

SEQ ID NO: 52692 - RNA, 64 nt, Human
gcaggauuggaaccacagcccaggucuccugacuccaucccauaccuuccaggccuaggccucu

SEQ ID NO: 52693 - RNA, 64 nt, Human
ccacuuccccuccuugagaagaccagaagucaacccaucccaaagacaaacugcaugaaaaggg

SEQ ID NO: 52694 - RNA, 64 nt, Human
ccuuugcucaaagcuugggguuucuuugguguuaccaucccagcucccgggaggcccuuaagcc

SEQ ID NO: 52695 - RNA, 64 nt, Human
acaggaauagaauggagggagcuccagaaacuuuccaucccaaaggcagucuccgugguugaag

SEQ ID NO: 52696 - RNA, 64 nt, Human
gauuuuuccccaccauucugugacauucuuuacaccaucccacuuucaggaagucaacuugcuu

SEQ ID NO: 52697 - RNA, 64 nt, Human
ucagcacucacuacugccuacaucaaggcuaaggccaucccaauccccggggccaagucuugau

SEQ ID NO: 52698 - RNA, 64 nt, Human
caggguggacuucauguuuccaaugagcccaucaccaucccacugacucugugagaacauucug

SEQ ID NO: 52699 - RNA, 64 nt, Human
accucauauuggacuaucaaccaugagccagucaccaucccaugauaugaaagugucauuuaua

SEQ ID NO: 52700 - RNA, 64 nt, Human
gugggcccucaguuccccucuguccucccgugggccaucccagccuccuucccccagaggagcg

SEQ ID NO: 52701 - RNA, 64 nt, Human
gcaucugccgcucggcaugcaccaguuccacacaccaucccauuuuacagacaaggacgcugag

SEQ ID NO: 52702 - RNA, 64 nt, Human
uuuaaagccguuucaagcuguauaguuugcacacccaucccaguggaggggaaaggggauaagu

SEQ ID NO: 52703 - RNA, 57 nt, Human
gcccugucugcuuccuguaaacucccuccaucccaaccuggcucccucccacccaac

SEQ ID NO: 52704 - RNA, 64 nt, Human
uuaugugaacaucaggcaaagccaugagaucaaaccaucccaagccuuucaccaaugagguaca

SEQ ID NO: 52705 - RNA, 64 nt, Human
cuucagccaaaugccccaacuuucagucuguaccccaucccaagcauagccagcucccccuccu

SEQ ID NO: 52706 - RNA, 64 nt, Human
agcgugcaguccggcaucucccgcggaugcuuuuccaucccaagugccugcggagcgccgagga

SEQ ID NO: 52707 - RNA, 50 nt, Human
cccuccacaaugagcugugaccaucccaggaggccugugcacacauccca

SEQ ID NO: 52708 - RNA, 64 nt, Human
guguugcucucauugugugacucagugcugcuguccaucccauggaaacaugggcacaaucaag

SEQ ID NO: 52709 - RNA, 64 nt, Human
agucagucucaguagccaucagccuggcagcugcccaucccauaaccaaagagcucaaugggcu

SEQ ID NO: 52710 - RNA, 64 nt, Human
uaauuucucacucuuccuucucccucuccccgucccaucccaaccacugaucugcucaggcaac

SEQ ID NO: 52711 - RNA, 64 nt, Human
caaugcacugucugucucuccuuuuaggaguaagccaucccacaaguucuauaccauauuuuua

SEQ ID NO: 52712 - RNA, 64 nt, Human
auugcaucgauguaaucagaaugaagaccgcaugccaucccaagauuauguccucacuuauaac

SEQ ID NO: 52713 - RNA, 64 nt, Human
uaucucucuuuuuuuuuucuucuccugucccuucccaucccaccccuuuagacuaccuuccagu

SEQ ID NO: 52714 - RNA, 64 nt, Human
uauuuaucucucauucuguauagaauucuugccgccaucccaggucuagccuuaggagcaaaug

SEQ ID NO: 52715 - RNA, 64 nt, Human
uggugcagacgccgggccggcugacauuuggaccccaucccagaggagaugcuggcuaccagcu

SEQ ID NO: 52716 - RNA, 64 nt, Human
ccauggagguccgugagcuggaacugggcacacgccaucccagagggcucaggaugccccagga

SEQ ID NO: 52717 - RNA, 64 nt, Human
cagccugauggcagccucagaggcuuacucuaacccaucccagaauaaauggagacuucaugug

SEQ ID NO: 52718 - RNA, 64 nt, Human
gcugugugaauacaggcuguauggacacuugcuuccaucccauuuuccugcuucuuuggguugc

SEQ ID NO: 52719 - RNA, 64 nt, Human
cgccucggucccauuuuuuauucuuuggguccuuccaucccacugggaaaacgucucagguggc

SEQ ID NO: 52720 - RNA, 64 nt, Human
ggcagcuccagaagcugcccagggcuccgggaccccaucccaugguggcaggugcagcgguggg

SEQ ID NO: 52721 - RNA, 64 nt, Human
agcugacaccagccccucagaggaccagugcgccccaucccagggaggguuccuuggggacaag

SEQ ID NO: 52722 - RNA, 64 nt, Human
ugaguuggcagaccgggccccccugaaccgcaccccaucccaccagccccggccuugcuuuguc

SEQ ID NO: 52723 - RNA, 64 nt, Human
cacuugcagcccugucuuccuaccuaucccaccuccaucccagacaggucccuccccuucucug

SEQ ID NO: 52724 - RNA, 64 nt, Human
accuguacuuuugcauccauuagccaaccuuuggccaucccaccuaucccuuacccuucccugc

SEQ ID NO: 52725 - RNA, 64 nt, Human
ugaagacuacacaggaaugcaucguucccacuccccaucccacuuggaaaacuccaagggggug

SEQ ID NO: 52726 - RNA, 64 nt, Human
cccaccccccaccccccccacacacaccaucuuuccaucccaggcuuuugaaaaacaaacagaa

SEQ ID NO: 52727 - RNA, 64 nt, Human
cuagaaguccagaacauguaugugggaccccagaccaucccagccaccccccaucuuccuggcc

SEQ ID NO: 52728 - RNA, 64 nt, Human
ccucccuuucugcuggaguccccuguguccucagccaucccaagaaggguuugcuggucccucc

SEQ ID NO: 52729 - RNA, 64 nt, Human
cccuucuagcggggccgguaccccgccucccugcccaucccaccacccggccuuucccugcgcc

SEQ ID NO: 52730 - RNA, 64 nt, Human
gcuugcacuccgguacccgacccggcgcccuggcccaucccaugccggggggccaguggaaaga

SEQ ID NO: 52731 - RNA, 64 nt, Human
gaauauuucuggaauccaccucuugaauccauuuccaucccaucauccuuguccaaugcacauu

SEQ ID NO: 52732 - RNA, 64 nt, Human
aaagccaaguaccuuuucagcuuuuuaacugcccccaucccaacccagggaggccugugucacu

SEQ ID NO: 52733 - RNA, 64 nt, Human
ugguggauguaacuacuccaccugcccuugggacccaucccaguuuucaucauugagccccaga

SEQ ID NO: 52734 - RNA, 64 nt, Human
auacuggagagaaacuauaaagaaaauucuauauccaucccaucuuuugugggguuuguuuuuu

SEQ ID NO: 52735 - RNA, 64 nt, Human
ucauccccguauuucccccucucauaacuucuccccaucccaggaggaguucucaggccugggg

SEQ ID NO: 52736 - RNA, 64 nt, Human
ggcucacgcuuaacuccagcccccacccacacccccaucccacccaaccacaggccccacuugc

SEQ ID NO: 52737 - RNA, 64 nt, Human
uugagauccugaauguuaagugacuugccugaggccaucccacuaacaggagccaggguuagga

SEQ ID NO: 52738 - RNA, 64 nt, Human
gccgaagcuggaaaccaaaccuaauaaaguuuucccaucccaccuccggguuucucuguuacug

SEQ ID NO: 52739 - RNA, 53 nt, Human
accaggacugcgccugcugagagccaucccacucccuuuccccucuucccugu

SEQ ID NO: 52740 - RNA, 64 nt, Human
aguagcccugcacaaaggguggggagucaggagaccaucccaaaggcaucucccugucuuccuc

SEQ ID NO: 52741 - RNA, 64 nt, Human
ucagcauugccuaggaacacgaagcacgaucaguccaucccagagggaccggaguuaugacaag

SEQ ID NO: 52742 - RNA, 64 nt, Human
ggggaggcaggccugcugccugcccucgaucuguccaucccacagcucagccuggaugcccacc

SEQ ID NO: 52743 - RNA, 64 nt, Human
gcuuggcgcagucgaggggggcgaugcucucugcccaucccagcugcacccuagcucccugcuc

SEQ ID NO: 52744 - RNA, 64 nt, Human
gccuggcaggugaccaccagugugcaccacucacccaucccaguguauucagguaagugaaccu

SEQ ID NO: 52745 - RNA, 64 nt, Human
gcagugaugcuggaggacacaccauggggugaagccaucccaaggcugacagcucagucuucac

SEQ ID NO: 52746 - RNA, 64 nt, Human
agguuaacugaugcugccauuugcccagccucuuccaucccagcccugucagugagcccagguc

SEQ ID NO: 52747 - RNA, 64 nt, Human
accgcauucugaucuggacaaagucgggacagcaccaucccagccccgaagccagggccaugcc

SEQ ID NO: 52748 - RNA, 64 nt, Human
cugcuuaaagaaugcccuuuaugaugcacugauuccaucccaggaacccaacagagcucaggac

SEQ ID NO: 52749 - RNA, 64 nt, Human
acagaaggaggaagacuaacacacacccccugccccaucccaucccccucucccgagcuauuuu

SEQ ID NO: 52750 - RNA, 64 nt, Human
gggucugagugccaccccccaggccacagugauaccaucccagugccaugagcccacacugccc

SEQ ID NO: 52751 - RNA, 64 nt, Human
ucuuccaguugagguguuuuaugucacgcacacuccaucccaguguacaaaaccugcuucucuu

SEQ ID NO: 52752 - RNA, 64 nt, Human
accucccucaccaguggaggcuggguagugcuggccaucccaaaagggcucuguccugggaguc

SEQ ID NO: 52753 - RNA, 64 nt, Human
uguccuacagaccgacggcacaacagacagcugcccaucccaugccaugcucuacccucugccu

SEQ ID NO: 52754 - RNA, 64 nt, Human
ccacugcagcaucccccacuucuccacggaagccccaucccaaagcugcugccuggccccuugc

SEQ ID NO: 52755 - RNA, 64 nt, Human
ggagggaggacccucggggcuaccgcgcgcccccccaucccacagaucaggagccaaggaggga

SEQ ID NO: 52756 - RNA, 64 nt, Human
caaaccaaggaaggccgaggauggaugcgcauccccaucccaagaagucgggaagaagccagga

SEQ ID NO: 52757 - RNA, 64 nt, Human
uaguuuuuauguagcaauuuguuuauaaaaauucccaucccauaaugcaugaccuuccuaaaaa

SEQ ID NO: 52758 - RNA, 64 nt, Human
ccaccucagggauucugauccaugucauuaacgaccaucccagggugugagggccugauuaaag

SEQ ID NO: 52759 - RNA, 64 nt, Human
gagggaagccaggggucccagcccgucuaccuccccaucccacccaggcccccagcuccccgcg

SEQ ID NO: 52760 - RNA, 64 nt, Human
agguuggagaccccgcucccaugccccagcugugccaucccaaauacuugggcagcagcucagc

SEQ ID NO: 52761 - RNA, 64 nt, Human
gaacucaucaagagcuccuucugcccuuguaagcccaucccagcuacuuguaaccaucucuaag

SEQ ID NO: 52762 - RNA, 64 nt, Human
cuauggcugagguggggccgggccacaccccugcccaucccagccagggugcugugcccccguc

SEQ ID NO: 52763 - RNA, 64 nt, Human
aauuuacaaauguuugcuagggucacccucucggccaucccacgagggucgccaugaucacccc

SEQ ID NO: 52764 - RNA, 64 nt, Human
acauucucacacuguggcuggagacccauuuuuuccaucccauguggaaugagaaucuugaguu

SEQ ID NO: 52765 - RNA, 64 nt, Human
uuuuugcugaaacccaaugacggcaaccucugagccaucccagagccuggggaggccaggguag

SEQ ID NO: 52766 - RNA, 64 nt, Human
acugagccugagguauuucauaucuccugcuguuccaucccagcuugaauuggugccacaagcu

SEQ ID NO: 52767 - RNA, 64 nt, Human
ggguggagggugcggcccggaguuguccaucuguccaucccaacagcaagacgaggauguggcu

SEQ ID NO: 52768 - RNA, 64 nt, Human
agaccaggaagcugugggcccuccugcuccacccccaucccacucccacccaugucugggcucc

SEQ ID NO: 52769 - RNA, 51 nt, Human
guuugaugauuccacugugagccaucccacgagccccugcauuggagucag

SEQ ID NO: 52770 - RNA, 64 nt, Human
cgugggcuuccugcccucaccccacaccucaagaccaucccacugcuugccugcuugcccccug

SEQ ID NO: 52771 - RNA, 64 nt, Human
aaccaaauaagaauaacacucaagacuauguucuccaucccaacacaucacuuaccacuugcac

SEQ ID NO: 52772 - RNA, 64 nt, Human
cuguaguuuggauuaacuccccucccgccuacccccaucccaaacugcauuuauaauuuuguga

SEQ ID NO: 52773 - RNA, 64 nt, Human
uucucagggucuccccagcccaguccccuugcucccaucccacucggugcuguuggguaggggc

SEQ ID NO: 52774 - RNA, 64 nt, Human
cgaucacauggagcaguaauggagcaaagaccagccaucccaguugagauacccuacaccaacc

SEQ ID NO: 52775 - RNA, 64 nt, Human
aauacacuggcccagauuaggaagguucugccauccaucccagccaucccaaacaacuaccaga

SEQ ID NO: 52776 - RNA, 64 nt, Human
gcccagauuaggaagguucugccauccaucccagccaucccaaacaacuaccagaauaauggau

SEQ ID NO: 52777 - RNA, 64 nt, Human
agaaguaggguccugucggcccugcugcuguccuccaucccaccccucuuacuccagccucgug

SEQ ID NO: 52778 - RNA, 64 nt, Human
cagagcuacuugggccauagcuccugcuccacagccaucccagccuuggcaucuagagcuugau

SEQ ID NO: 52779 - RNA, 64 nt, Human
cucggccugcugaugccacauaccaggcaaccucccaucccacccccgacccugcccugggcga

SEQ ID NO: 52780 - RNA, 64 nt, Human
auaggguuggaaaauuucuuuugggaaggggaagccaucccagccuuuaccacccaaugugucu

SEQ ID NO: 52781 - RNA, 64 nt, Human
gggacuuaccugacagcucuuaccaacaagaaggccaucccagauauggccucucaaccucaga

SEQ ID NO: 52782 - RNA, 64 nt, Human
uucccuccaaagaaacugauuggcccuggaaccuccaucccacucuuguuaugacuccacagug

SEQ ID NO: 52783 - RNA, 64 nt, Human
uacugcuguucccaccuugggauucugugugcugccaucccaccugcagcugcccuggaauucc

SEQ ID NO: 52784 - RNA, 64 nt, Human
gcgcugugauuuuagccuccugagauuggaguuuccaucccauguugguuugucccagucuaac

SEQ ID NO: 52785 - RNA, 64 nt, Human
cuucguguuuucugagcagaauguacgaggugugccaucccaaaaccagcugcuacccuguccu

SEQ ID NO: 52786 - RNA, 64 nt, Human
ccuggccuggccuggcccccaauggucagaagagccaucccauggccaugucacagggauagau

SEQ ID NO: 52787 - RNA, 64 nt, Human
gacuccucuucaucuuagccccccuagcagcauuccaucccagccagagcacccccaccaucag

SEQ ID NO: 52788 - RNA, 64 nt, Human
caccacccccagucaccauugucaccacacucacccaucccaccccaccccuccuauccacccc

SEQ ID NO: 52789 - RNA, 64 nt, Human
gagcuaauacccuacagauggggcauauccuaucccaucccaccagaggauugauucuccauuu

SEQ ID NO: 52790 - RNA, 64 nt, Human
gaugccagcccccaagagacucagagugccuucuccaucccaguguccacacucuccuccagcu

SEQ ID NO: 52791 - RNA, 64 nt, Human
agcacccaggaugaugguuucacuucagucuuccccaucccagguuuuauguugcugggcuucc

SEQ ID NO: 52792 - RNA, 51 nt, Human
ccucaggacagggagucugauccaucccauucacccagugacuucuuuuug

SEQ ID NO: 52793 - RNA, 64 nt, Human
ugugucaaacucuacuucagauugucuccuuaucccaucccacaaaacagaaucuguccguuuc

SEQ ID NO: 52794 - RNA, 64 nt, Human
ucagcccucccaggaaacacacagagcucugggcccaucccagcccuggccuguggccuuucuu

SEQ ID NO: 52795 - RNA, 64 nt, Human
ugcggaaaggaggcuccgugagaugggguccagcccaucccaacacaagggugcagcuugauuc

SEQ ID NO: 52796 - RNA, 59 nt, Human
acgagcccuccccauccugaguccacagggagauccacagcucacggagccuggccgcg

SEQ ID NO: 52797 - RNA, 64 nt, Human
cuucuauuaucgucuucggaaguuaccagccugugagauccaagcccccccacccaggcccccu

SEQ ID NO: 52798 - RNA, 64 nt, Human
cggcagcuucaggaggcagaaacgagaggggugggagauccacaggaccaaagggugcagugau

SEQ ID NO: 52799 - RNA, 64 nt, Human
gauuggagguuggugggauaggggucucugugaagagauccaaaaucauuucuagguacacagu

SEQ ID NO: 52800 - RNA, 64 nt, Human
cugaagccccacucuggacccaggacauuuugaugagauccaaaggaguuguaugcacaugaaa

SEQ ID NO: 52801 - RNA, 64 nt, Human
ccaggguccugcuccgaagcagucaucucugccugagauccauucuuccuuuacuucccccacc

SEQ ID NO: 52802 - RNA, 64 nt, Human
gauaugauuuaaccauaagcagcagcacgauccagagauccauugccaucagugaucucacuaa

SEQ ID NO: 52803 - RNA, 64 nt, Human
cucaccauauggguuucuuucuucuucgcuucaggagauccagagggcaccugccugcaggaug

SEQ ID NO: 52804 - RNA, 64 nt, Human
acauuacccugaugucuaaauggaccaaagaucugagauccauugugauuauaucuguaucagg

SEQ ID NO: 52805 - RNA, 64 nt, Human
uuggugggaaguaagcuggagauccaggcugcuggagauccaaugccugcugccuccagacucu

SEQ ID NO: 52806 - RNA, 64 nt, Human
uccacuguaccaagacuuggugggaaguaagcuggagauccaggcugcuggagauccaaugccu

SEQ ID NO: 52807 - RNA, 64 nt, Human
ccauuguggaagcuucuaggaggcugagaagcaggagauccaagcuccaguccuggguguuacc

SEQ ID NO: 52808 - RNA, 64 nt, Human
ccaagaauaucuccugaggaucacuccaagaaaagagauccacauaccauucucaaucccacug

SEQ ID NO: 52809 - RNA, 64 nt, Human
acuguuuugggaaacuuacauguugagaucuacagagauccaggaaaccaaagcccugcugagc

SEQ ID NO: 52810 - RNA, 64 nt, Human
cauugugucugaaaacugcaaagugaacuuaacugagauccagcaaacagguucuguuuaagaa

SEQ ID NO: 52811 - RNA, 64 nt, Human
gaagagagauggaagccagcccugccaaaggauggagauccauaauauggaugccagugaacuu

SEQ ID NO: 52812 - RNA, 64 nt, Human
aauuccaacacaagacuggcaguccaaauugaaagagauccagggaaugaugacaacaaucuca

SEQ ID NO: 52813 - RNA, 64 nt, Human
gguaaugaaacugaaacuauacuaugcccuuaaggagauccaguuuaauucaaggugaucuuuu

SEQ ID NO: 52814 - RNA, 64 nt, Human
uagcaaguguaagcagaauggagugugguuccaagagauccaucaagacaaugggaauggccug

SEQ ID NO: 52815 - RNA, 64 nt, Human
gggcaaguccucucaauggcuaaaauuaacuuuagagauccauguguucagguuuagaucauau

SEQ ID NO: 52816 - RNA, 64 nt, Human
guauuuugaauccuuaaaggugagcccucauagggagauccaaaguccugugguuaacgccuuc

SEQ ID NO: 52817 - RNA, 64 nt, Human
ggguugcacaguuggucucuuuaaugucgguguggagauccaaaguggguuguggaaagagcgu

SEQ ID NO: 52818 - RNA, 64 nt, Human
cagaaccgagugagguguacauugccguccugcagagauccaggcugcacgcggcggacugggc

SEQ ID NO: 52819 - RNA, 64 nt, Human
gccugugacgcuacagggagaggcugaguaaaccgagauccagcguucuguauggcagggguau

SEQ ID NO: 52820 - RNA, 64 nt, Human
aacugauuucuuguccaaugauccuugcguggccgagauccagcuucaacgaaccagcuagaag

SEQ ID NO: 52821 - RNA, 64 nt, Human
uauuuugugaauuauauauuucaagaacuaaacagagauccaccuuucuggaucugauuuauau

SEQ ID NO: 52822 - RNA, 64 nt, Human
ccgucagaaccacuggccagagagggagcugcuagagauccaagaaggcuggcaggagugaggc

SEQ ID NO: 52823 - RNA, 64 nt, Human
guucaagccgaugggaugaaagaagcuugucucagagauccagaucaugguccuauaauggaua

SEQ ID NO: 52824 - RNA, 64 nt, Human
uguaauucuccccacccuugagaauguacuuugugagauccacccugcccacaaaacauugcuc

SEQ ID NO: 52825 - RNA, 64 nt, Human
aaagaauacaaaugcugcagaggaauccuuaccagagauccagaaagaacaucgcaaucugcuu

SEQ ID NO: 52826 - RNA, 64 nt, Human
uccauuuuugagucuaaaucuuuuaaaauauacugagauccacaucuagugaaaugucaguguc

SEQ ID NO: 52827 - RNA, 64 nt, Human
cugugcuccaggccgaggcugggcuacccucagggagauccagagacucaugcccauggccauc

SEQ ID NO: 52828 - RNA, 64 nt, Human
ggcgguguucuccagaauucagcaccugggagccgagauccaccugauccgugacaugauggac

SEQ ID NO: 52829 - RNA, 64 nt, Human
accauugucuuaccucccaacuggaagacagcucgagauccagaagggaagauuuauuacuacc

SEQ ID NO: 52830 - RNA, 64 nt, Human
uaaaauaauuaugaucuauguuguuugcccaauugagauccaguuuuuuguuguuauuuuuaau

SEQ ID NO: 52831 - RNA, 64 nt, Human
gacagccugauacguucccgucugugcacccauggagauccaggcgugggcccgugucuguccc

SEQ ID NO: 52832 - RNA, 64 nt, Human
cugaaaggcagauuaacuuuccauucuacuuauggagauccacacaucaguauaguccugaugc

SEQ ID NO: 52833 - RNA, 64 nt, Human
auguuggccaggauggucucaaucuccuaaccuugagauccacccuccacagccucccaaacug

SEQ ID NO: 52834 - RNA, 64 nt, Human
ugggaguuguauuuucagucuucgccaggucauugagauccauccacucacaucuuaagcauuc

SEQ ID NO: 52835 - RNA, 64 nt, Human
uuggaaguauugcuaaaaucuuauaauaugaaaagagauccacuaauguagcuuaagguuauua

SEQ ID NO: 52836 - RNA, 64 nt, Human
aaaacucaguagacuccucuuugucacuucucuggagauccagcauuccuuauuuggaaaugac

SEQ ID NO: 52837 - RNA, 64 nt, Human
auugccauauuuugauguauaggacaagucaacugagauccagagaauccuggaugugaaugcu

SEQ ID NO: 52838 - RNA, 64 nt, Human
agugagcugguuuaauacucugagaaugagcagggagauccagagaaugaaucccugaccgcau

SEQ ID NO: 52839 - RNA, 64 nt, Human
uuauuuuuuacuuugcccccuccccacuuuuuuugagauccauccuuuaucaagaagucugaag

SEQ ID NO: 52840 - RNA, 64 nt, Human
cauuagcacaauauuuaaauaucuaaaaauuuaagagauccauacuuucuguagcuuuacaauu

SEQ ID NO: 52841 - RNA, 64 nt, Human
aagccugcuggggcugggugaagaaauuggcgcugagauccaggcuggauccauugcuuuuguu

SEQ ID NO: 52842 - RNA, 64 nt, Human
uggacacgguauuaggagggaaugccagauuggagagauccaaacaacacagggagacuugcuu

SEQ ID NO: 52843 - RNA, 64 nt, Human
uugucacagaaaacaucagggucuuggaacaccagagauccaccuaacugcucauccuaagaag

SEQ ID NO: 52844 - RNA, 64 nt, Human
gaccaggcuggggucgcugcguugcugugccgcagagauccacucuguccguggaguggagcug

SEQ ID NO: 52845 - RNA, 64 nt, Human
ugggucauccuugcugugggucauccuugcuguggagauccauuccccaccuuuccuguggccc

SEQ ID NO: 52846 - RNA, 64 nt, Human
aaaauguacugauuuuuuuuuaauaaacugcaucgagauccaaccgacugaauuguuaaaaaaa

SEQ ID NO: 52847 - RNA, 64 nt, Human
gaauuagaguauuuguaacuguguucuuuagccggagauccauuuuuuauauuucaaguacacu

SEQ ID NO: 52848 - RNA, 64 nt, Human
uaguuaggauacuaaaaggauauuaguuacccaagagauccaauuuguuuuucugaugaauagu

SEQ ID NO: 52849 - RNA, 64 nt, Human
agguaaacugucucuugaaguucuguggugguaugagauccagcugugugaauauaauuuuuga

SEQ ID NO: 52850 - RNA, 64 nt, Human
uuuaugucaaaauucaauugcuauuaaacaaguugagauccaguuauaaauuaaccuuguuuuu

SEQ ID NO: 52851 - RNA, 64 nt, Human
uugggaggccgaggcaggcggaucacgaggucaagagauccagaccauccuggcuaacacggug

SEQ ID NO: 52852 - RNA, 64 nt, Human
gccaccucacuuuccaccacugucagccuggaaagagauccaggucuggagcuggagagaacag

SEQ ID NO: 52853 - RNA, 64 nt, Human
uguguagauaaagcccugaguaggcaagagcagugagauccacugcuauggucuugauacaucc

SEQ ID NO: 52854 - RNA, 64 nt, Human
ccccucuuguggugcaagcccagcucugucaccugagauccagccagagacccuccuccaccau

SEQ ID NO: 52855 - RNA, 64 nt, Human
uggaugugcuuuggucaaggaauaggccaaggcagagauccaugccugcaugacucaguggguu

SEQ ID NO: 52856 - RNA, 64 nt, Human
cagacauuacacuaaauuagaguguugaguauaggagauccaaaacuaaaauuguuagguaagu

SEQ ID NO: 52857 - RNA, 64 nt, Human
uuaccaggaguauagugauguuguccugaauaaggagauccagagccagcagcggcuggagagc

SEQ ID NO: 52858 - RNA, 64 nt, Human
cccucuccuuuuccugccacaaaaggugaaaaaugagauccaauccucucaccaaaauuucaaa

SEQ ID NO: 52859 - RNA, 64 nt, Human
cuaaccugaaagcuuugccuaacaguagcuuguagagauccagugcacgccgaugcugcuaaac

SEQ ID NO: 52860 - RNA, 64 nt, Human
cuccuccuucagcacaacgucacccauugggcaagagauccagauuuguuaacaaaaaagauuu

SEQ ID NO: 52861 - RNA, 64 nt, Human
auuuuaacuaaaaucacugcauaugggaaauuaagagauccaggaccauauuugauaagaguuc

SEQ ID NO: 52862 - RNA, 64 nt, Human
cuuucccaaccaggaugguucacaaaaaagcugugagauccacaguuacaagugacacgcaugc

SEQ ID NO: 52863 - RNA, 64 nt, Human
ugucauaauagaaaacacaagcauuugaccaaaugagauccauucagcgacuaacuggcaaggc

SEQ ID NO: 52864 - RNA, 64 nt, Human
uuuguauuaaugaaaagcuuuaguuuaaaauaaggagauccagaauaaaaagaagagacugauc

SEQ ID NO: 52865 - RNA, 64 nt, Human
aauaccaguucacccaaguugcuucuagccuacugagauccaugugacauuggaggagaucuuu

SEQ ID NO: 52866 - RNA, 64 nt, Human
uuacucgauguaagggauuccuuguuguuguguugagauccagugcaguugugauuucugugga

SEQ ID NO: 52867 - RNA, 64 nt, Human
auuggaagguucccuggugcugccucacacuccugagauccagaccacgagaagugaccuucag

SEQ ID NO: 52868 - RNA, 64 nt, Human
uccagaucucaaucguguugcuucaaucaauauugagauccagcagccuucaccauccaggaga

SEQ ID NO: 52869 - RNA, 64 nt, Human
auuguaucaauucuaccuugugcuauacguaggagagauccaaaauuuggaugcuucuggagac

SEQ ID NO: 52870 - RNA, 64 nt, Human
uggaggucccuuaguagauuugguaguuccuuaagagauccacgugauaaaauaaauggaguug

SEQ ID NO: 52871 - RNA, 64 nt, Human
ucucuuuuggccaaaagaauaucugaccaucacagagauccagagaacagaaacaagagccccu

SEQ ID NO: 52872 - RNA, 64 nt, Human
gugggagccagcucagagaaggaacugaacccaggagauccauccaccuauuagcccugggccu

SEQ ID NO: 52873 - RNA, 64 nt, Human
acuaagggguuuguaguauauauuguaggcagaagagauccaucaacagauugcaagcaaggaa

SEQ ID NO: 52874 - RNA, 64 nt, Human
accauugggugagccggagccugugguuccaggggagauccagaaugcaugugucucuucccac

SEQ ID NO: 52875 - RNA, 64 nt, Human
cccgugggcgccccacagcugccccucagccgcugagauccaguguccaagcugcggccaggag

SEQ ID NO: 52876 - RNA, 64 nt, Human
ugggggacuuucucacagcuuacauagccauccagagauccacagcuacgucacugaauuguua

SEQ ID NO: 52877 - RNA, 64 nt, Human
uugaugauuucugaacugaagccuucacacaugugagauccaugcugaggagaagcaaaauggc

SEQ ID NO: 52878 - RNA, 64 nt, Human
cuucuuucucuguaacagagauaucauuuauguggagauccacaaccuuuaacagggauccaag

SEQ ID NO: 52879 - RNA, 64 nt, Human
ggagugcccacagggugcaggacuccacugaugagagauccagccaaagagcugcccccagggg

SEQ ID NO: 52880 - RNA, 64 nt, Human
uuuucucuuuucaggcuguuuaacuuaggcacaggagauccacuuuuaaacuugggaaauaagc

SEQ ID NO: 52881 - RNA, 64 nt, Human
acaugacauauacaugguggcagguccuagagaugagauccacauccuaaaaauaccaugucug

SEQ ID NO: 52882 - RNA, 64 nt, Human
ggaucagcaguaucacuaucacuugggcuaguuagagauccagauucuggauccauaccccaua

SEQ ID NO: 52883 - RNA, 64 nt, Human
agacucuugucuucuucaagagcaagggccuccggagauccaaacugugauugaaccaagugca

SEQ ID NO: 52884 - RNA, 64 nt, Human
augaggccaugccccuggcugcucuuauggagccgagauccagucagggugggggcgcuggagc

SEQ ID NO: 52885 - RNA, 64 nt, Human
auaacagcaaggaaacauuaaugcuuagaauucugagauccagcacaacucagucugugggagc

SEQ ID NO: 52886 - RNA, 64 nt, Human
uggcagccucuucucgacgucuccuuccggagcugagauccagcccagggcgaauggcgagcuu

SEQ ID NO: 52887 - RNA, 64 nt, Human
accacaaugggguaccugccgaggggguccccaagagauccaggcugucaugugauuuauggug

SEQ ID NO: 52888 - RNA, 64 nt, Human
cuuagaggcaccagugggaaagcaggacuggggagagauccaggacugagccagccucaggcca

SEQ ID NO: 52889 - RNA, 64 nt, Human
uauuugcauguacauaaugagguaucuuggggaugagauccaagucuaaacacaaaauucauuu

SEQ ID NO: 52890 - RNA, 64 nt, Human
gcaugauggcaugccgugaucagaagucaugcaugagauccauacaccacaggacacuacuaau

SEQ ID NO: 52891 - RNA, 64 nt, Human
uuuuaauuccuuucucuguucagcuguugaugcugagauccauauuuaguuuuauaagcuucuc

SEQ ID NO: 52892 - RNA, 64 nt, Human
uuaggaguccgagguggguggaucacgaggucaggagauccagcccauccuggccaacauggug

SEQ ID NO: 52893 - RNA, 64 nt, Human
uccaaccugcaaagaucuguccucagccuugccagagauccaaaagaagcccccagcuaagaac

SEQ ID NO: 52894 - RNA, 64 nt, Human
uugggaggccaaggcagguggaucacgaggucaggagauccagaccauccuggcuaacauggug

SEQ ID NO: 52895 - RNA, 64 nt, Human
agaauguggucugucagcugugaaucuguugauggagauccaacuauuucuuucaucagaaaaa

SEQ ID NO: 52896 - RNA, 64 nt, Human
auucacuagcucauaucugccggcagcaauugaagagauccaauauuugaagauuggccuucau

SEQ ID NO: 52897 - RNA, 64 nt, Human
cacucacaucuaucugcuggagaccauccccuccgagauccaggucuucgugaagaauccugau

SEQ ID NO: 52898 - RNA, 64 nt, Human
aaauguuacgcuuuggaccauuuuuccggggaaggagauccagaacuuuuuaccagauuuucaa

SEQ ID NO: 52899 - RNA, 64 nt, Human
accguagcaggguuguuuucuguuaagcaaagccgagauccagugcaauaccuggacugucacc

SEQ ID NO: 52900 - RNA, 64 nt, Human
cagguugccauugaauuuugcucuggugaaugcugagauccagcuuuuucuuacaaauaaaugg

SEQ ID NO: 52901 - RNA, 64 nt, Human
uuuauagaauucacauaauucuguauaaacuauggagauccacaguacuuuuuuguuuuugaga

SEQ ID NO: 52902 - RNA, 64 nt, Human
uauuuuuuuguuguuucaaacugaaguuuacugagagauccaucaaauugaacaaucuguugua

SEQ ID NO: 52903 - RNA, 64 nt, Human
guugcccaagcugaucucaaacuccuggcuucaagagauccacccaccucagccucccaaagcg

SEQ ID NO: 52904 - RNA, 64 nt, Human
ugaacccaaguagagaagauagaucuuggaaggagagauccauugaguccagaagccagaucag

SEQ ID NO: 52905 - RNA, 64 nt, Human
uugccgucacuauucaucaaugaagauuaacacugagauccagagaggcuggaugacuugcuca

SEQ ID NO: 52906 - RNA, 64 nt, Human
uuaguaacgguuccugaauucucuuaaauucuuugagauccaaagauggccucuucagugacaa

SEQ ID NO: 52907 - RNA, 64 nt, Human
gcgggcacagcccuuucucaggguuggacccccugagauccagcccuacuucuugcacugauaa

SEQ ID NO: 52908 - RNA, 64 nt, Human
acuaaguuggcauagcacacacuaacaguuguaggagauccaugagcaugcuggauauugaggg

SEQ ID NO: 52909 - RNA, 64 nt, Human
aagucaguagcgccacaucugguuuauaaaguaagagauccagugggacaaugcuauuuuugua

SEQ ID NO: 52910 - RNA, 64 nt, Human
uccucuccucugcaggacaugcugcccaugccaggagauccaacccaggggacuggcaacuaua

SEQ ID NO: 52911 - RNA, 64 nt, Human
gcuccacauuaaaccccagcccugucuggccagggagauccaugugcucaauguugcuggggga

SEQ ID NO: 52912 - RNA, 64 nt, Human
uacaguuccaaaugaguugauaaagauuguugaagagauccaaaaccagaauaagccacuguuu

SEQ ID NO: 52913 - RNA, 64 nt, Human
uggguggaaauccugcccuggaggaaguuguggggagauccacugggacccccaacauucugcc

SEQ ID NO: 52914 - RNA, 64 nt, Human
cuaacauuucuaacaacugcucugacauuguaaagagauccaacagaaucacuccugcugaaaa

SEQ ID NO: 52915 - RNA, 64 nt, Human
uugggaggccgaggcgggcggcucacgacgucaggagauccagaccaucuuggcuaacagggug

SEQ ID NO: 52916 - RNA, 64 nt, Human
uuuaauucuccccacccuugagaauguacuuugugagauccaccccugcccgcaaaacauugcu

SEQ ID NO: 52917 - RNA, 64 nt, Human
ggugcagcuggagcacgugcagacucggcugcgggagauccagcccugccuggcagagagccgg

SEQ ID NO: 52918 - RNA, 64 nt, Human
caaagcaguuaauuaggcagccuggagaaaaccagagauccaguacagaaaggaaaggauauuu

SEQ ID NO: 52919 - RNA, 64 nt, Human
ccauuuacaaggggaucuggaugaccugcugauggagauccagcuugccagggacuuagguuua

SEQ ID NO: 52920 - RNA, 64 nt, Human
gcuggcgcacaggccucuucuccccggcacuuccgagauccaccagaucgacuugaucgugcag

SEQ ID NO: 52921 - RNA, 64 nt, Human
gcauuuuaggacauguacaugaaacagugaaaaugagauccaccaacaucuuuuauuaaguuca

SEQ ID NO: 52922 - RNA, 64 nt, Human
gccccagcugcagcagcugaagaccgcgguggaggagauccacaaugccguaggugaggccagg

SEQ ID NO: 52923 - RNA, 64 nt, Human
auuguuuugucaauaauuugaaauuugaacuggagagauccagaaccuugggagucauuaaagc

SEQ ID NO: 52924 - RNA, 64 nt, Human
uugggaggccgaggcaggcagaucacgaggucaggagauccagaccauccuggcuaacacggug

SEQ ID NO: 52925 - RNA, 64 nt, Human
uccuuuggacccaucggggaaaaagucuaaauuggagauccaguuuuagaagugcuuucuggga

SEQ ID NO: 52926 - RNA, 64 nt, Human
aaggcaaugggaagcucaauguugcucagugggugagauccagacccacuggugcaaugucuua

SEQ ID NO: 52927 - RNA, 64 nt, Human
uggaacauccuuggaaauuggaagagcacaagaggagauccagggcaaggccauugggauauuc

SEQ ID NO: 52928 - RNA, 64 nt, Human
ccccuguccugaugccgucgcccugccucauacugagauccaacccuuuauuuucugggcaaag

SEQ ID NO: 52929 - RNA, 64 nt, Human
uuccacgugacuguguuucuaucccguguacagagagauccagagcccuacacuccacgaccug

SEQ ID NO: 52930 - RNA, 64 nt, Human
cagcaucaaaggugcugggacaucccaggguggugagauccauccacgauccagcuccggugga

SEQ ID NO: 52931 - RNA, 64 nt, Human
guuuuguucuuugcuuuacuuuucaccuugcaaagagauccaguaccuaguauuggaagaucca

SEQ ID NO: 52932 - RNA, 64 nt, Human
uggccuggcugcccacuccucaggggaggaaagagagauccaguaugcaccccucagcuuucau

SEQ ID NO: 52933 - RNA, 64 nt, Human
cugcacagacaggaaccucagcagugacagaagagagauccagggaugggucuucucugaccca

SEQ ID NO: 52934 - RNA, 64 nt, Human
ugauguccaguuguccaguuuccaauagaagugggagauccagauuuuuaaaugggauaacuuu

SEQ ID NO: 52935 - RNA, 64 nt, Human
ucugugaacgugaauuuuguucaguuguccacaggagauccacauaauuccuagcacuggugag

SEQ ID NO: 52936 - RNA, 64 nt, Human
cuguuaagccaagaccugccaggagugucucuaagagauccaggagggagccacccccaaggac

SEQ ID NO: 52937 - RNA, 64 nt, Human
ccuucccugacccccacccacauuucccuccuuagagauccaggagggauggaauguucuuuaa

SEQ ID NO: 52938 - RNA, 64 nt, Human
uugggaggccgaggugggcaaauuacgaggucaggagauccagaccauccuggcuaacacggug

SEQ ID NO: 52939 - RNA, 64 nt, Human
agguauuaggaaagugaucccagauuagauuuuugagauccaaaaaaaaugaaaaccuaggaaa

SEQ ID NO: 52940 - RNA, 64 nt, Human
gccuuucaguguaauauucaugauuuugucgugagagauccacucaauaaaaaccaggcaaaug

SEQ ID NO: 52941 - RNA, 64 nt, Human
auucauagagagcccuaguuacugcauggggaaagagauccaggaagcaugagugcuggauauu

SEQ ID NO: 52942 - RNA, 64 nt, Human
agccugucccugagccggccccucccaggggucugagauccaugaggugugucccuagggcuuc

SEQ ID NO: 52943 - RNA, 64 nt, Human
gaaguugacuggcaaaagagcagugcugaaggaggagauccagguuuaaaucuggcuuauuaac

SEQ ID NO: 52944 - RNA, 64 nt, Human
agcuuuacuggggcuggggaaggaagccggggaagagauccaaagacucuugggagggaguuac

SEQ ID NO: 52945 - RNA, 64 nt, Human
guccccugggguggggacacaaucaccccagguugagauccauggagccaggucuguuugccac

SEQ ID NO: 52946 - RNA, 64 nt, Human
ugccugggcugcuccugucccacccacccucacugagauccauguaaggggcuccucuucccac

SEQ ID NO: 52947 - RNA, 64 nt, Human
gggggcccugaguggcaaguugcuuagcuaacaggagauccauaggcagccugcaggcuaggaa

SEQ ID NO: 52948 - RNA, 64 nt, Human
agcaaucuuugcccugaauuuaggcagucacuuugagauccaucagccuaaaacaaaggauugg

SEQ ID NO: 52949 - RNA, 64 nt, Human
auauauugcauucgugcugacuuuguuaucccgagagauccaugcaaugaucucuugcugucuu

SEQ ID NO: 52950 - RNA, 64 nt, Human
cagggccagguuggccaccgugggcgaccuggaggagauccagcgugcgcacgcagaguaccug

SEQ ID NO: 52951 - RNA, 64 nt, Human
ccuagagggggaugcuuggggaaacagagaaggggagauccagggccuccccgccuuccuucuu

SEQ ID NO: 52952 - RNA, 64 nt, Human
ugaaaagggcucagaggaauggcagggauggcaagagauccagcuagagagguauucagggaug

SEQ ID NO: 52953 - RNA, 64 nt, Human
guuggccaggcugguaucaaacuccugaccucaagagauccacucgccuugcccucccaaagug

SEQ ID NO: 52954 - RNA, 64 nt, Human
cccguagaggucuuuuagaccagcugaccagaaugagauccaaucugcugaaaacgcacaaguu

SEQ ID NO: 52955 - RNA, 64 nt, Human
cuuuuacuuaaacaauuccaggaacuggccuuaggagauccaaauagggaaccaagauugcaga

SEQ ID NO: 52956 - RNA, 64 nt, Human
agccaaacugaaacucuaugcaacauuaaaagaagagauccaucauguagcuugugacacuuuu

SEQ ID NO: 52957 - RNA, 64 nt, Human
gcuguuucugguugggaagcguaaaagccagggagagauccagagaguuuucaaguuuuugcag

SEQ ID NO: 52958 - RNA, 64 nt, Human
aaaaacauucaaggguucugcccccagauuucgggagauccacguuccauguucugauugguuu

SEQ ID NO: 52959 - RNA, 64 nt, Human
agcccgccggcaggaaggaagacaccaugcuuuagagauccaucuuucuccacucaccgcagcg

SEQ ID NO: 52960 - RNA, 64 nt, Human
ggggcgcagcuuggagagccgggggcgcagcuuggagauccaggggcgcauggagaggccacgg

SEQ ID NO: 52961 - RNA, 64 nt, Human
cgccaacaucucggggcaguuggaccuaucuccauaccccgagagcauuugccugccuguccug

SEQ ID NO: 52962 - RNA, 64 nt, Human
uuuuguaaaaagauaauuuuugagacuugaaaaauaccccgaccuugagauuauuccuguuuga

SEQ ID NO: 52963 - RNA, 64 nt, Human
ggacgugggcagcaaaacgacacugcgcaucaccuaccccgagggcgccaugcagcggccugag

SEQ ID NO: 52964 - RNA, 64 nt, Human
cuucucugaaguccguuugagcagaacuaccugguaccccgaaagaaaaucuuaggcuaccaca

SEQ ID NO: 52965 - RNA, 64 nt, Human
cagaauauauucguccacccccucggcaccccauuaccccgagucccaccguguguccguugua

SEQ ID NO: 52966 - RNA, 64 nt, Human
cguccaguugguggguaacagcuggaccccuggcuaccccgagacccaggaggcgcucugcccg

SEQ ID NO: 52967 - RNA, 64 nt, Human
uggaaagagcugcuuuuagggauuauuuuuugaauaccccgaguggggagcaggguucuccuca

SEQ ID NO: 52968 - RNA, 64 nt, Human
gacuuuuguucugucccuggggugugugaauuccuaccccgaacuggaagccgggaguggcaga

SEQ ID NO: 52969 - RNA, 64 nt, Human
agacugagagcagagaccacuuauccucauugcuuaccccgagccgggguucccuccucccggc

SEQ ID NO: 52970 - RNA, 64 nt, Human
uugaauuucugguuugccugaauccaccugcaguuaccccgauccguuugcaagaaccagaucg

SEQ ID NO: 52971 - RNA, 64 nt, Human
accccaggccuggugauucugggccccuccuccauaccccgaggucugggauuccccccucugc

SEQ ID NO: 52972 - RNA, 64 nt, Human
uaggggagugaccuaacuggccuaauuaaugggauaccccgacauuuccacuguuagcaaauau

SEQ ID NO: 52973 - RNA, 64 nt, Human
ugucauuuucucuguuuuguuuuuguauguuuuuuaccccgauguaacagucucccuuaugguc

SEQ ID NO: 52974 - RNA, 64 nt, Human
uauuguuaauuccaguuucccuuuuccucauauuuaccccgaagagguguugcauauagaaucc

SEQ ID NO: 52975 - RNA, 64 nt, Human
ggggcuggccuugagaaggaacuggacccagcucuaccccgauuccagcaugugagcuucaugc

SEQ ID NO: 52976 - RNA, 58 nt, Human
agccaaggaaacaaggauaaauggcucauaccccgaaggcaguuccuagacacauggg

SEQ ID NO: 52977 - RNA, 64 nt, Human
cauuccagagaaagugauagaaucuuccccaaauuaccccgauuuaggacaaagugaauuuaua

SEQ ID NO: 52978 - RNA, 64 nt, Human
cugcgucccuaaccccuuccccagcuugguguuuuaccccgaaacaggaaggaacagggguccu

SEQ ID NO: 52979 - RNA, 64 nt, Human
gccuucuagggggagcuuucuaaguccccacauuuaccccgagucaccggaaaaaucugauuuu

SEQ ID NO: 52980 - RNA, 64 nt, Human
auguguaggaagacuuuacgguaaucauuaacucuaccccgaaaugauggacuacaaguuauaa

SEQ ID NO: 52981 - RNA, 64 nt, Human
cauucuuauuacaggagugagcaaaggaagcauuuaccccgaugguuaccuagaccacgauuau

SEQ ID NO: 52982 - RNA, 64 nt, Human
uuccuagacaauaacccgagggacuccagauacauaccccgaaggucuaggaaauacguuaagg

SEQ ID NO: 52983 - RNA, 64 nt, Human
uccugucugccuggcuucuugucuguccugcuucuaccccgaggacuccucugcagggagcgcc

SEQ ID NO: 52984 - RNA, 64 nt, Human
cugaggugcucuugacugucgccugcgcacuguguaccccgagcaacauucuaagggugugcuu

SEQ ID NO: 52985 - RNA, 64 nt, Human
cuuuucucaggugauauauccccugaaggaggucuaccccgacucaggugagcugguccuccuu

SEQ ID NO: 52986 - RNA, 64 nt, Human
ggcaacaggaggcauucuguggccagccaaaagguaccccgauggccaagcaauuccucugaac

SEQ ID NO: 52987 - RNA, 64 nt, Human
aguugaaaggaagcuuucccccgccaaggacgccuaccccgaaaccggccccgacgccccgcag

SEQ ID NO: 52988 - RNA, 64 nt, Human
gcgaagcccccacuacuaaauggccucucuccacuaccccgacuaucccugcacauaaacuccg

SEQ ID NO: 52989 - RNA, 64 nt, Human
ugggucacacagcuaaagccgaggugaccaguuguaccccgagugccaggcuugugagaugaga

SEQ ID NO: 52990 - RNA, 64 nt, Human
ggacaagguauggggugggagccacaauugaggauaccccgagacuaccaggagagcccugggc

SEQ ID NO: 52991 - RNA, 64 nt, Human
cuggcuccuccuugcuccccugcugaugguguccuaccccgaacuccaaaaauuacaccuggag

SEQ ID NO: 52992 - RNA, 64 nt, Human
cugggguggagcaggcucugugcucccaccacuguaccccgaaucccuccugcaggcucauugc

SEQ ID NO: 52993 - RNA, 64 nt, Human
cugcuuggaccaggguccugggucuucccaaccauaccccgagaucaggccccaccugccagcu

SEQ ID NO: 52994 - RNA, 64 nt, Human
cccaggaaaggcugggagaagagguggccuggaguaccccgagaucccagcagcgcacacagug

SEQ ID NO: 52995 - RNA, 64 nt, Human
guuuauaauaguaagccccugugacccucucacuuaccccgagaccucacuuuauuacaagauc

SEQ ID NO: 52996 - RNA, 64 nt, Human
agaccugcucagcccacccccacccauccucagcuaccccgagagguagccccacucuaagggg

SEQ ID NO: 52997 - RNA, 64 nt, Human
uggccacuaugccaguucugaccucgcaucccccuaccccgagcccaugcagucugggaacaug

SEQ ID NO: 52998 - RNA, 64 nt, Human
aagagagcuggguguagccagagcuacuggcaccuaccccgagcaucucucucuguaagcagcu

SEQ ID NO: 52999 - RNA, 64 nt, Human
cacaaacugucuugcaugugugugugugucugguuaccccgaccuucugugaaggugggucuuc

SEQ ID NO: 53000 - RNA, 64 nt, Human
cccagaccacgugggacagaacuccugcccacccuaccccgagggaggcgaacccgcacuucca

SEQ ID NO: 53001 - RNA, 64 nt, Human
gcaagguuuccuuucagcccugucuacugaccaauaccccgacucaccuuguguggcgcacuuc

SEQ ID NO: 53002 - RNA, 64 nt, Human
cgccucagccucccaaaguguugaugagccacuguaccccgauaccacuguauaaaaaauuuaa

SEQ ID NO: 53003 - RNA, 64 nt, Human
uggcaugcccccuccugcaaggggcucaacccccuaccccgaccccuccacguaucuuuccuag

SEQ ID NO: 53004 - RNA, 64 nt, Human
gaggacauaaguaucaugucuccuuuaacuagcauaccccgaaguggagaagggugcagcaggc

SEQ ID NO: 53005 - RNA, 64 nt, Human
cacugguaaggacucuuagcugagguucgggauauaccccgaggcgcggaaccauagauauaac

SEQ ID NO: 53006 - RNA, 64 nt, Human; identical to SEQ ID NO: 40787

SEQ ID NO: 53007 - RNA, 64 nt, Human; identical to SEQ ID NO: 40788

SEQ ID NO: 53008 - RNA, 58 nt, Human; identical to SEQ ID NO: 40789

SEQ ID NO: 53009 - RNA, 64 nt, Human; identical to SEQ ID NO: 40790

SEQ ID NO: 53010 - RNA, 64 nt, Human; identical to SEQ ID NO: 40791

SEQ ID NO: 53011 - RNA, 64 nt, Human; identical to SEQ ID NO: 40792

SEQ ID NO: 53012 - RNA, 64 nt, Human; identical to SEQ ID NO: 40793

SEQ ID NO: 53013 - RNA, 64 nt, Human; identical to SEQ ID NO: 40794

SEQ ID NO: 53014 - RNA, 64 nt, Human; identical to SEQ ID NO: 40795

SEQ ID NO: 53015 - RNA, 64 nt, Human; identical to SEQ ID NO: 40796

SEQ ID NO: 53016 - RNA, 64 nt, Human; identical to SEQ ID NO: 40797

SEQ ID NO: 53017 - RNA, 64 nt, Human; identical to SEQ ID NO: 40798

SEQ ID NO: 53018 - RNA, 64 nt, Human; identical to SEQ ID NO: 40799

SEQ ID NO: 53019 - RNA, 64 nt, Human; identical to SEQ ID NO: 40800

SEQ ID NO: 53020 - RNA, 64 nt, Human; identical to SEQ ID NO: 40801

SEQ ID NO: 53021 - RNA, 64 nt, Human; identical to SEQ ID NO: 40802

SEQ ID NO: 53022 - RNA, 64 nt, Human; identical to SEQ ID NO: 40803

SEQ ID NO: 53023 - RNA, 64 nt, Human; identical to SEQ ID NO: 40804

SEQ ID NO: 53024 - RNA, 64 nt, Human; identical to SEQ ID NO: 40805

SEQ ID NO: 53025 - RNA, 64 nt, Human; identical to SEQ ID NO: 40806

SEQ ID NO: 53026 - RNA, 64 nt, Human; identical to SEQ ID NO: 40807

SEQ ID NO: 53027 - RNA, 64 nt, Human; identical to SEQ ID NO: 40808

SEQ ID NO: 53028 - RNA, 64 nt, Human; identical to SEQ ID NO: 40809

SEQ ID NO: 53029 - RNA, 64 nt, Human; identical to SEQ ID NO: 40810

SEQ ID NO: 53030 - RNA, 64 nt, Human; identical to SEQ ID NO: 40811

SEQ ID NO: 53031 - RNA, 64 nt, Human; identical to SEQ ID NO: 40812

SEQ ID NO: 53032 - RNA, 64 nt, Human; identical to SEQ ID NO: 40813

SEQ ID NO: 53033 - RNA, 64 nt, Human; identical to SEQ ID NO: 40814

SEQ ID NO: 53034 - RNA, 64 nt, Human; identical to SEQ ID NO: 40815

SEQ ID NO: 53035 - RNA, 64 nt, Human; identical to SEQ ID NO: 40816

SEQ ID NO: 53036 - RNA, 64 nt, Human; identical to SEQ ID NO: 40817

SEQ ID NO: 53037 - RNA, 64 nt, Human; identical to SEQ ID NO: 40818

SEQ ID NO: 53038 - RNA, 64 nt, Human; identical to SEQ ID NO: 40819

SEQ ID NO: 53039 - RNA, 64 nt, Human; identical to SEQ ID NO: 40820

SEQ ID NO: 53040 - RNA, 64 nt, Human; identical to SEQ ID NO: 40821

SEQ ID NO: 53041 - RNA, 64 nt, Human; identical to SEQ ID NO: 40822

SEQ ID NO: 53042 - RNA, 62 nt, Human; identical to SEQ ID NO: 40823

SEQ ID NO: 53043 - RNA, 62 nt, Human; identical to SEQ ID NO: 40824

SEQ ID NO: 53044 - RNA, 64 nt, Human; identical to SEQ ID NO: 40825

SEQ ID NO: 53045 - RNA, 62 nt, Human; identical to SEQ ID NO: 40826

SEQ ID NO: 53046 - RNA, 62 nt, Human; identical to SEQ ID NO: 40827

SEQ ID NO: 53047 - RNA, 64 nt, Human; identical to SEQ ID NO: 40828

SEQ ID NO: 53048 - RNA, 64 nt, Human; identical to SEQ ID NO: 40829

SEQ ID NO: 53049 - RNA, 64 nt, Human; identical to SEQ ID NO: 40830

SEQ ID NO: 53050 - RNA, 64 nt, Human; identical to SEQ ID NO: 40831

SEQ ID NO: 53051 - RNA, 64 nt, Human; identical to SEQ ID NO: 40832

SEQ ID NO: 53052 - RNA, 64 nt, Human; identical to SEQ ID NO: 40833

SEQ ID NO: 53053 - RNA, 64 nt, Human; identical to SEQ ID NO: 40834

SEQ ID NO: 53054 - RNA, 64 nt, Human; identical to SEQ ID NO: 40835

SEQ ID NO: 53055 - RNA, 64 nt, Human; identical to SEQ ID NO: 40836

SEQ ID NO: 53056 - RNA, 64 nt, Human; identical to SEQ ID NO: 40837

SEQ ID NO: 53057 - RNA, 56 nt, Human; identical to SEQ ID NO: 40838

SEQ ID NO: 53058 - RNA, 64 nt, Human; identical to SEQ ID NO: 40839

SEQ ID NO: 53059 - RNA, 64 nt, Human; identical to SEQ ID NO: 40840

SEQ ID NO: 53060 - RNA, 64 nt, Human; identical to SEQ ID NO: 40841

SEQ ID NO: 53061 - RNA, 64 nt, Human; identical to SEQ ID NO: 40842

SEQ ID NO: 53062 - RNA, 64 nt, Human; identical to SEQ ID NO: 40843

SEQ ID NO: 53063 - RNA, 64 nt, Human; identical to SEQ ID NO: 40844

SEQ ID NO: 53064 - RNA, 64 nt, Human; identical to SEQ ID NO: 40845

SEQ ID NO: 53065 - RNA, 64 nt, Human; identical to SEQ ID NO: 40846

SEQ ID NO: 53066 - RNA, 64 nt, Human; identical to SEQ ID NO: 40847

SEQ ID NO: 53067 - RNA, 64 nt, Human; identical to SEQ ID NO: 40848

SEQ ID NO: 53068 - RNA, 64 nt, Human; identical to SEQ ID NO: 40849

SEQ ID NO: 53069 - RNA, 64 nt, Human; identical to SEQ ID NO: 40850

SEQ ID NO: 53070 - RNA, 64 nt, Human; identical to SEQ ID NO: 40851

SEQ ID NO: 53071 - RNA, 64 nt, Human; identical to SEQ ID NO: 40852

SEQ ID NO: 53072 - RNA, 64 nt, Human; identical to SEQ ID NO: 40853

SEQ ID NO: 53073 - RNA, 64 nt, Human; identical to SEQ ID NO: 40854

SEQ ID NO: 53074 - RNA, 64 nt, Human; identical to SEQ ID NO: 40855

SEQ ID NO: 53075 - RNA, 64 nt, Human; identical to SEQ ID NO: 40856

SEQ ID NO: 53076 - RNA, 52 nt, Human; identical to SEQ ID NO: 40857

SEQ ID NO: 53077 - RNA, 50 nt, Human; identical to SEQ ID NO: 40858

SEQ ID NO: 53078 - RNA, 60 nt, Human; identical to SEQ ID NO: 40859

SEQ ID NO: 53079 - RNA, 53 nt, Human; identical to SEQ ID NO: 40860

SEQ ID NO: 53080 - RNA, 64 nt, Human; identical to SEQ ID NO: 40861

SEQ ID NO: 53081 - RNA, 64 nt, Human; identical to SEQ ID NO: 40862

SEQ ID NO: 53082 - RNA, 64 nt, Human; identical to SEQ ID NO: 40863

SEQ ID NO: 53083 - RNA, 64 nt, Human; identical to SEQ ID NO: 40864

SEQ ID NO: 53084 - RNA, 64 nt, Human; identical to SEQ ID NO: 40865

SEQ ID NO: 53085 - RNA, 64 nt, Human; identical to SEQ ID NO: 40866

SEQ ID NO: 53086 - RNA, 64 nt, Human; identical to SEQ ID NO: 40867

SEQ ID NO: 53087 - RNA, 64 nt, Human; identical to SEQ ID NO: 40868

SEQ ID NO: 53088 - RNA, 64 nt, Human; identical to SEQ ID NO: 40869

SEQ ID NO: 53089 - RNA, 64 nt, Human; identical to SEQ ID NO: 40870

SEQ ID NO: 53090 - RNA, 64 nt, Human; identical to SEQ ID NO: 40871

SEQ ID NO: 53091 - RNA, 64 nt, Human; identical to SEQ ID NO: 40872

SEQ ID NO: 53092 - RNA, 64 nt, Human; identical to SEQ ID NO: 40873

SEQ ID NO: 53093 - RNA, 64 nt, Human; identical to SEQ ID NO: 40874

SEQ ID NO: 53094 - RNA, 64 nt, Human; identical to SEQ ID NO: 40875

SEQ ID NO: 53095 - RNA, 64 nt, Human; identical to SEQ ID NO: 40876

SEQ ID NO: 53096 - RNA, 64 nt, Human; identical to SEQ ID NO: 40877

SEQ ID NO: 53097 - RNA, 64 nt, Human; identical to SEQ ID NO: 40878

SEQ ID NO: 53098 - RNA, 64 nt, Human; identical to SEQ ID NO: 40879

SEQ ID NO: 53099 - RNA, 64 nt, Human; identical to SEQ ID NO: 40880

SEQ ID NO: 53100 - RNA, 63 nt, Human; identical to SEQ ID NO: 40881

SEQ ID NO: 53101 - RNA, 64 nt, Human; identical to SEQ ID NO: 40882

SEQ ID NO: 53102 - RNA, 64 nt, Human; identical to SEQ ID NO: 40883

SEQ ID NO: 53103 - RNA, 64 nt, Human; identical to SEQ ID NO: 40884

SEQ ID NO: 53104 - RNA, 64 nt, Human; identical to SEQ ID NO: 40885

SEQ ID NO: 53105 - RNA, 64 nt, Human; identical to SEQ ID NO: 40886

SEQ ID NO: 53106 - RNA, 64 nt, Human; identical to SEQ ID NO: 40887

SEQ ID NO: 53107 - RNA, 64 nt, Human; identical to SEQ ID NO: 40888

SEQ ID NO: 53108 - RNA, 64 nt, Human; identical to SEQ ID NO: 40889

SEQ ID NO: 53109 - RNA, 64 nt, Human; identical to SEQ ID NO: 40890

SEQ ID NO: 53110 - RNA, 64 nt, Human; identical to SEQ ID NO: 40891

SEQ ID NO: 53111 - RNA, 64 nt, Human; identical to SEQ ID NO: 40892

SEQ ID NO: 53112 - RNA, 64 nt, Human; identical to SEQ ID NO: 40893

SEQ ID NO: 53113 - RNA, 64 nt, Human; identical to SEQ ID NO: 40894

SEQ ID NO: 53114 - RNA, 64 nt, Human; identical to SEQ ID NO: 40895

SEQ ID NO: 53115 - RNA, 64 nt, Human; identical to SEQ ID NO: 40896

SEQ ID NO: 53116 - RNA, 64 nt, Human; identical to SEQ ID NO: 40897

SEQ ID NO: 53117 - RNA, 64 nt, Human; identical to SEQ ID NO: 40898

SEQ ID NO: 53118 - RNA, 64 nt, Human; identical to SEQ ID NO: 40899

SEQ ID NO: 53119 - RNA, 64 nt, Human; identical to SEQ ID NO: 40900

SEQ ID NO: 53120 - RNA, 64 nt, Human; identical to SEQ ID NO: 40901

SEQ ID NO: 53121 - RNA, 64 nt, Human; identical to SEQ ID NO: 40902

SEQ ID NO: 53122 - RNA, 64 nt, Human; identical to SEQ ID NO: 40903

SEQ ID NO: 53123 - RNA, 64 nt, Human; identical to SEQ ID NO: 40904

SEQ ID NO: 53124 - RNA, 64 nt, Human; identical to SEQ ID NO: 40905

SEQ ID NO: 53125 - RNA, 64 nt, Human; identical to SEQ ID NO: 40906

SEQ ID NO: 53126 - RNA, 64 nt, Human; identical to SEQ ID NO: 40907

SEQ ID NO: 53127 - RNA, 64 nt, Human; identical to SEQ ID NO: 40908

SEQ ID NO: 53128 - RNA, 64 nt, Human; identical to SEQ ID NO: 40909

SEQ ID NO: 53129 - RNA, 64 nt, Human; identical to SEQ ID NO: 40910

SEQ ID NO: 53130 - RNA, 64 nt, Human; identical to SEQ ID NO: 40911

SEQ ID NO: 53131 - RNA, 64 nt, Human; identical to SEQ ID NO: 40912

SEQ ID NO: 53132 - RNA, 64 nt, Human; identical to SEQ ID NO: 40913

SEQ ID NO: 53133 - RNA, 64 nt, Human; identical to SEQ ID NO: 40914

SEQ ID NO: 53134 - RNA, 64 nt, Human; identical to SEQ ID NO: 40915

SEQ ID NO: 53135 - RNA, 64 nt, Human; identical to SEQ ID NO: 40916

SEQ ID NO: 53136 - RNA, 64 nt, Human; identical to SEQ ID NO: 40917

SEQ ID NO: 53137 - RNA, 64 nt, Human; identical to SEQ ID NO: 40918

SEQ ID NO: 53138 - RNA, 64 nt, Human; identical to SEQ ID NO: 40919

SEQ ID NO: 53139 - RNA, 64 nt, Human; identical to SEQ ID NO: 40920

SEQ ID NO: 53140 - RNA, 64 nt, Human; identical to SEQ ID NO: 40921

SEQ ID NO: 53141 - RNA, 64 nt, Human; identical to SEQ ID NO: 40922

SEQ ID NO: 53142 - RNA, 64 nt, Human; identical to SEQ ID NO: 40923

SEQ ID NO: 53143 - RNA, 64 nt, Human; identical to SEQ ID NO: 40924

SEQ ID NO: 53144 - RNA, 64 nt, Human; identical to SEQ ID NO: 40925

SEQ ID NO: 53145 - RNA, 64 nt, Human; identical to SEQ ID NO: 40926

SEQ ID NO: 53146 - RNA, 64 nt, Human; identical to SEQ ID NO: 40927

SEQ ID NO: 53147 - RNA, 64 nt, Human; identical to SEQ ID NO: 40928

SEQ ID NO: 53148 - RNA, 64 nt, Human; identical to SEQ ID NO: 40929

SEQ ID NO: 53149 - RNA, 64 nt, Human; identical to SEQ ID NO: 40930

SEQ ID NO: 53150 - RNA, 64 nt, Human; identical to SEQ ID NO: 40931

SEQ ID NO: 53151 - RNA, 64 nt, Human; identical to SEQ ID NO: 40932

SEQ ID NO: 53152 - RNA, 64 nt, Human; identical to SEQ ID NO: 40933

SEQ ID NO: 53153 - RNA, 64 nt, Human; identical to SEQ ID NO: 40934

SEQ ID NO: 53154 - RNA, 64 nt, Human; identical to SEQ ID NO: 40935

SEQ ID NO: 53155 - RNA, 64 nt, Human; identical to SEQ ID NO: 40936

SEQ ID NO: 53156 - RNA, 64 nt, Human; identical to SEQ ID NO: 40937

SEQ ID NO: 53157 - RNA, 64 nt, Human; identical to SEQ ID NO: 40938

SEQ ID NO: 53158 - RNA, 64 nt, Human; identical to SEQ ID NO: 40939

SEQ ID NO: 53159 - RNA, 64 nt, Human; identical to SEQ ID NO: 40940

SEQ ID NO: 53160 - RNA, 64 nt, Human; identical to SEQ ID NO: 40941

SEQ ID NO: 53161 - RNA, 64 nt, Human; identical to SEQ ID NO: 40942

SEQ ID NO: 53162 - RNA, 64 nt, Human; identical to SEQ ID NO: 40943

SEQ ID NO: 53163 - RNA, 56 nt, Human
acgaguucgaggcccuguaacagccaggccaggaccaagggcagaggggugcucau

SEQ ID NO: 53164 - RNA, 64 nt, Human
gagauguccccuucucacucugaaaucauccauuuggggacaaauccacauuggggucuagaaa

SEQ ID NO: 53165 - RNA, 64 nt, Human
accuggagaacuucauaaagaugucucacagcccuggggacaccugcccagugggccccagccc

SEQ ID NO: 53166 - RNA, 64 nt, Human
guuuuaguaacagacuggcuccaacacugcaacauggggacauuugccaacucgaacaaaggcu

SEQ ID NO: 53167 - RNA, 64 nt, Human
agaggguccccugccucuagagucaucaucuaauuggggacaggcagaccuagauaagaaaagc

SEQ ID NO: 53168 - RNA, 64 nt, Human
cacaaaagcuggcuuuuauuccuuucccauccuauggggacaggagccuucaggacugcuggcc

SEQ ID NO: 53169 - RNA, 64 nt, Human
aaguaaggagguugguuugauucaauaguaagaauggggacagcaagggcagaaguguccucuc

SEQ ID NO: 53170 - RNA, 64 nt, Human
gcauggaucugggucaaguagaagguacuggggauggggacauuccugcccauaaaggauuugg

SEQ ID NO: 53171 - RNA, 64 nt, Human
agggcaguaagaagggcugcaaggaaggggaggauggggacaaggaaaggaucagauaccugcu

SEQ ID NO: 53172 - RNA, 64 nt, Human
cccccaaauauuaacuccagaaacuaggccugacuggggacaccugagaguaguauaguagugc

SEQ ID NO: 53173 - RNA, 64 nt, Human
uccucaagccagcugggggcccaggcugaagaccuggggacaggucgauugcuggaccagggca

SEQ ID NO: 53174 - RNA, 64 nt, Human
cucuucugaccugcacucuugccugacccuagaauggggacagggaaagugaagguuagggaaa

SEQ ID NO: 53175 - RNA, 64 nt, Human
caggacacuggaaguucuccaggauccagauccauggggacauuaauaguccaaggcauucccu

SEQ ID NO: 53176 - RNA, 64 nt, Human
gggcucgggagccaugucaugugagugggugggauggggacauuugaacauguuuaauggguau

SEQ ID NO: 53177 - RNA, 64 nt, Human
ccuccccuagaaagauuuugugcaauauauuaaauggggacagaauucuaaauggauaaaacaa

SEQ ID NO: 53178 - RNA, 64 nt, Human
gaagagaaaggcaaaguuacuguccuguaguaauuggggacaaugugaucauccuuggagagag

SEQ ID NO: 53179 - RNA, 64 nt, Human
caggguuccugugguuucccuggucccucugagauggggacagacugaagacagaggucguuug

SEQ ID NO: 53180 - RNA, 64 nt, Human
aauuaccaaaugcuucuaaauaugaaggagagguuggggacacgcacccuaugugauaccaagu

SEQ ID NO: 53181 - RNA, 64 nt, Human
cuuugcaaaaugaccuggugacauggcaagucaguggggacaggaaggaccacucccuaaguaa

SEQ ID NO: 53182 - RNA, 64 nt, Human
ucacccagccgccaccucugcccucucccaucccuggggacagaggccuugugucaccugccug

SEQ ID NO: 53183 - RNA, 64 nt, Human
gcccgaauccuuccgcugcccuccaagcgcccucuggggacagaccaaucugcgugugucugug

SEQ ID NO: 53184 - RNA, 64 nt, Human
ccacggagacccuggccaugguugugguagagccuggggacacgcuguccucccccgaguucga

SEQ ID NO: 53185 - RNA, 64 nt, Human
acauuggcuugaaggcauucguuuccuucugggguggggacaggcccucauggcaggcuuguuc

SEQ ID NO: 53186 - RNA, 64 nt, Human
gccaggcccaucucaggugccacucccugagcuuuggggacaguuggcagagaaggccucuugu

SEQ ID NO: 53187 - RNA, 64 nt, Human
aauguguguguguggcagggggccccgccagggcuggggacagagggugucaaacauucgugag

SEQ ID NO: 53188 - RNA, 64 nt, Human
ucaggguggggcccaaugugaucuaaugcccagcuggggacaauugugccucaucauuugcuca

SEQ ID NO: 53189 - RNA, 64 nt, Human
guggaaauaggggcacacacagaugauucauggauggggacauggaaaugagaauagguuaaau

SEQ ID NO: 53190 - RNA, 64 nt, Human
uuauaauuucuaguauuucucugaaagaucguuuuggggacaaaagugacuugacauguccaau

SEQ ID NO: 53191 - RNA, 64 nt, Human
aggggaagggagugcguaggcuuccagugaugguuggggacaauccugcccaaaggcagggcag

SEQ ID NO: 53192 - RNA, 64 nt, Human
gaaggaagacagaacucacacaugcucccaggauuggggacagggacagaggagguaacagaag

SEQ ID NO: 53193 - RNA, 64 nt, Human
uagggggaaagaauaguaaaugcauguaaacaaauggggacacucuguucaggagaauaauccg

SEQ ID NO: 53194 - RNA, 64 nt, Human
cagcuuuggguuucauuuuguuuagcuaaagucauggggacaacucuucaauuuagaacuuaag

SEQ ID NO: 53195 - RNA, 64 nt, Human
gaggcuggcacagccuggccggcuuuucuccaucuggggacaguccuacuccaagaacacugca

SEQ ID NO: 53196 - RNA, 64 nt, Human
uuucucucuaauucaguguuuuggaggccugacuuggggacaacguauuauugauauuauuguc

SEQ ID NO: 53197 - RNA, 64 nt, Human
auaagcauccucaaaucuuuugggauuuggcacuuggggacaugaguaguugucugggauacgu

SEQ ID NO: 53198 - RNA, 64 nt, Human
agagcaaaggacccacaggcuacagagaagaggauggggacagagugugggauggagaggacag

SEQ ID NO: 53199 - RNA, 64 nt, Human
ugcagccaucuacugcugcuguacccuaggaauauggggacauggacauggugucccaugccca

SEQ ID NO: 53200 - RNA, 64 nt, Human
ucguagaauuccuuuugaaugaauugaguggggauggggacacagucuccaaguguguaugugg

SEQ ID NO: 53201 - RNA, 64 nt, Human
cuuacucacucuuaaccccaauccgcugacuggguggggacagcacguccagccuucccaccuc

SEQ ID NO: 53202 - RNA, 64 nt, Human
gcagguacggagcugaggacugggccccaggagguggggacaggggucugaaugccgagucccu

SEQ ID NO: 53203 - RNA, 64 nt, Human
cccuguucuccugucccuccaucccagacauugauggggacauuucuuccccagugucagcugu

SEQ ID NO: 53204 - RNA, 64 nt, Human
uucaacugucuccuaccucugcucuuggaggagauggggacagggcuggagucaaaacacuugu

SEQ ID NO: 53205 - RNA, 64 nt, Human
aggaugauuuccuggggcacagugggugaggagauggggacaggugaauggaggaguuagggga

SEQ ID NO: 53206 - RNA, 64 nt, Human
agagggaaacaaaagggagagccccacaaaacuuuggggacaagggagagagagacucaucuga

SEQ ID NO: 53207 - RNA, 64 nt, Human
aaaauuugagcuuaguucugggauuaugaaaacauggggacaaaaacaauaacuuguggauguc

SEQ ID NO: 53208 - RNA, 64 nt, Human
uguggacuggagcaggggaguuuugucuggaaucuggggacaugggguuuggcuuuagcaaccu

SEQ ID NO: 53209 - RNA, 64 nt, Human
gagaaggugguucuucaagccgagaggcacgagcuggggacaguucugccucugugacugcugc

SEQ ID NO: 53210 - RNA, 64 nt, Human
ugucacauuuuaaaaaauaauaagcaagacacauuggggacacuggcagcaguugccagguuuu

SEQ ID NO: 53211 - RNA, 64 nt, Human
gcucggggcacuucuauccccgccucucaaaggguggggacagccguuuccagauuugaauuuu

SEQ ID NO: 53212 - RNA, 64 nt, Human
uuuaugugucuuguuggggaggugacuugcaugguggggacaaggcugucguggcaaccuuggg

SEQ ID NO: 53213 - RNA, 64 nt, Human
uuugccuguaagauagcuguagagauauuugggguggggacagugaguuuggauggggaaaugg

SEQ ID NO: 53214 - RNA, 64 nt, Human
cuucaacugcacucccuccucaggagccccuuccuggggacagugaggacaaugacccuacaga

SEQ ID NO: 53215 - RNA, 64 nt, Human
cggagaccaucaagccacacccccuucuuaaaacuggggacaugagccugagcagaaaggguga

SEQ ID NO: 53216 - RNA, 64 nt, Human
gccaaauuccaugucccuguauaauucuacaggauggggacacuaaugaagauacgguugcuuc

SEQ ID NO: 53217 - RNA, 64 nt, Human
caggcuguaugggaagcauggcggcaucugcuucuggggacaccucaggagcuuuacucauggc

SEQ ID NO: 53218 - RNA, 64 nt, Human
augugggaaggcagaggaucucugaggaguucccuggggacaacugagcagccucuggagaggg

SEQ ID NO: 53219 - RNA, 64 nt, Human
ggaaagaaaaaaaguugcaaucugugcccuucauuggggacauuccucuaggacugguuugggg

SEQ ID NO: 53220 - RNA, 64 nt, Human
ucuuauguuauaaaagaaagaaguuaacuauauuuggggacaaaaaaauauuucaagaguugau

SEQ ID NO: 53221 - RNA, 64 nt, Human
gcugucguucccccucccccucuccgaguccucguggggacacggcggggucuguaggaaguug

SEQ ID NO: 53222 - RNA, 64 nt, Human
ugggccagaguccuuguggcccacagcauagcacuggggacagagcgcucuaugcaggugaggc

SEQ ID NO: 53223 - RNA, 64 nt, Human
ucagaacagggagucccaggacccagggagaguguggggacaggacagccugucucuuguagcu

SEQ ID NO: 53224 - RNA, 64 nt, Human
aggagcaaacagacccugcaagguccuccaggccuggggacaggaaagccacugacccagcccg

SEQ ID NO: 53225 - RNA, 64 nt, Human
ucugcaucugcgaaugugcccuaggugcugcugcuggggacauggaugccaagcggaggccugc

SEQ ID NO: 53226 - RNA, 64 nt, Human
gacugguggcggugggaggguuugcugggacugauggggacaccggccagcuugucuggugucc

SEQ ID NO: 53227 - RNA, 64 nt, Human
uccaugcuggccccuggcccagcaggccugucuguggggacaucggugugaagggaagggacug

SEQ ID NO: 53228 - RNA, 64 nt, Human
uaccuggauguucuuuuuacgaggugacaagaguuggggacagaacucccauuacaacugacca

SEQ ID NO: 53229 - RNA, 64 nt, Human
uucugguagauacaauuucaaguugagauuuggguggggacauagccaaaccauaucauucuac

SEQ ID NO: 53230 - RNA, 64 nt, Human
gugaaggcaucgguuaagggcacaaagacagccauggggacauuuauguaaauacgucucuaau

SEQ ID NO: 53231 - RNA, 64 nt, Human
ggaauuuugcuacuuggaauuuggagauagcaucuggggacaaguggagccagguagaggaaaa

SEQ ID NO: 53232 - RNA, 64 nt, Human
gaaugcagggaccccgcauucccaugguugugcauggggacaucuaacucuggucugggaagcc

SEQ ID NO: 53233 - RNA, 64 nt, Human
cacugccacggccuuugaccaucuguaguugccauggggacagugggagcgacugagcaacagg

SEQ ID NO: 53234 - RNA, 64 nt, Human
acggaagaagcacgccaugggaaguguuuacacuuggggacaagugcuaaguauuguggagccc

SEQ ID NO: 53235 - RNA, 64 nt, Human
acccuauuaagcauuaauuucuucauuuuuuaaauggggacaaaaauaucugcuuuauuauuac

SEQ ID NO: 53236 - RNA, 64 nt, Human
cuuucuuugacagccaggccuagacagacaggccuggggacacuggccccaugaggggaggaag

SEQ ID NO: 53237 - RNA, 64 nt, Human
gcuaucuccuaugccccuggacaggacaguuggcuggggacaggagaagugcucaaucuucaug

SEQ ID NO: 53238 - RNA, 64 nt, Human
gaguucugccuaaagauggccccccagcacugguuggggacaagggccaaauuggugaccacca

SEQ ID NO: 53239 - RNA, 64 nt, Human
ccuuugacguggugcaauuuugaugagaugucucuggggacacgaggaugcccuaaugaugcug

SEQ ID NO: 53240 - RNA, 64 nt, Human
accuuaugaggcccauggcacuggggcagggagcuggggacauuuuaaucaucaauaaacgaag

SEQ ID NO: 53241 - RNA, 64 nt, Human
aggccacauggcuaaagaagguuucagaaagaaguggggacagagcagaacuuucaccuucaua

SEQ ID NO: 53242 - RNA, 64 nt, Human
cuacgcuugguccagaacaucaaacuccaaacccuggggacaaacgacaugaaauaaauguauu

SEQ ID NO: 53243 - RNA, 64 nt, Human
cuuccuggcccuugcauggaugcaguugugacucuggggacaaugcagccagaagcugagggac

SEQ ID NO: 53244 - RNA, 64 nt, Human
uauggccaauagcugggcuguccugagggguggcuggggacagaguccagcucccuuggaucag

SEQ ID NO: 53245 - RNA, 64 nt, Human
cucaguaugucucuuucaacucuaguuuuugagguggggacacaggagguccagugggacacag

SEQ ID NO: 53246 - RNA, 64 nt, Human
guccucccucuagaagcuggcaucacacucaugcuggggacaaacagaaccauuuucuuccucu

SEQ ID NO: 53247 - RNA, 64 nt, Human
caccuaaaacccaaagguggcagcuugugaagauuggggacacucauauugcccuaauuaaaaa

SEQ ID NO: 53248 - RNA, 64 nt, Human
ugucucaaaacaaacaaaaaagcguggggacuucuggggacagacaaggugccuguuauauauu

SEQ ID NO: 53249 - RNA, 64 nt, Human
agauaauccuagccauccucuccacucccacggcuggggacaauggccacuuacuaccugugca

SEQ ID NO: 53250 - RNA, 64 nt, Human
ccacaguccuugcccuuuggaacuuccaguauaguggggacaaucaguuaauaagcaaacaaac

SEQ ID NO: 53251 - RNA, 64 nt, Human
ucauuuacuuguacgagacagaaaaagauagcauuggggacaugggaugggggagggagggcaa

SEQ ID NO: 53252 - RNA, 64 nt, Human
ggccaccacuccaggccguggacuucccccaacuuggggacagccuuauucccaaaugucucua

SEQ ID NO: 53253 - RNA, 64 nt, Human
cuuucugacaguggggggucuggaauggaauugguggggacaggcagcaagcugcacuuuugag

SEQ ID NO: 53254 - RNA, 64 nt, Human
ccccccugagugggcugggcccucuguccacauguggggacagggcugguguggcugcucccag

SEQ ID NO: 53255 - RNA, 64 nt, Human
uaaaucauucuccugugaugucugugggccugcguggggacaacaggggcacaugacaucugcc

SEQ ID NO: 53256 - RNA, 64 nt, Human
uuaggaguugcuggacuggaugcauuacgaggacuggggacaggguagagggacauccagggau

SEQ ID NO: 53257 - RNA, 64 nt, Human
ccagacuacucuuucggggagcucagccgccugguggggacagaauggagaaaucuugagacag

SEQ ID NO: 53258 - RNA, 64 nt, Human
ggggugugggaguuggugagagcaggaggagagguggggacagcaagaagccacagauuggcau

SEQ ID NO: 53259 - RNA, 64 nt, Human
acacuguggagaugguuccuaucugggguccuuuuggggacauaugccucagucagucauucag

SEQ ID NO: 53260 - RNA, 64 nt, Human
ugugcccaccucaucuucguagggaccuugauuuuggggacacacauugcaacuucccacuucu

SEQ ID NO: 53261 - RNA, 64 nt, Human
aaggacgaggaagccguggggcagccucuucacauggggacaggggauggagcaugaggcaagg

SEQ ID NO: 53262 - RNA, 64 nt, Human
guaucucagcgggggguggggugacaucguucccuggggacauugggaaggugggcaggggcaa

SEQ ID NO: 53263 - RNA, 64 nt, Human
gggccucuggccuggcugaguucacagcccagucuggggacagcuggguaugaggugcuuacgg

SEQ ID NO: 53264 - RNA, 64 nt, Human
ucugguaugcuuugcagcauuucagcugcuuugguggggacacagauaaccccuucgcuuccag

SEQ ID NO: 53265 - RNA, 64 nt, Human
uacuggucagccuggcuguguggcagcggggggcuggggacaacaaaggggcggcucagucccg

SEQ ID NO: 53266 - RNA, 64 nt, Human
guggcugccuucagagcgccaccuccagaucagauggggacacacaaccccuggauauguuuca

SEQ ID NO: 53267 - RNA, 64 nt, Human
ugucaucuugacuacuuuguugauuuguugguauuggggacauuuuaaaggcugaguuauuuuu

SEQ ID NO: 53268 - RNA, 64 nt, Human
cuagagugauacucaucucaggcacaaauauauauggggacaucaaaacuucaauaaucaagau

SEQ ID NO: 53269 - RNA, 64 nt, Human
uuugagggaaagucuugcacuauugcauauauuuuggggacacagauuuucauaguuuccauuu

SEQ ID NO: 53270 - RNA, 64 nt, Human
cuaccuguuugccuccaagagacuaucaguuccuuggggacagggaccaugucuuauucaucuu

SEQ ID NO: 53271 - RNA, 64 nt, Human
aaugaguaauuuuucuacuuugaagauacacagauggggacaaaaacccuguuuuggaauucug

SEQ ID NO: 53272 - RNA, 64 nt, Human
ccuuccuccgucacagcauggucauuccaggauauggggacaaaccacuccuucccagccaggg

SEQ ID NO: 53273 - RNA, 64 nt, Human
aaacauuauugucaacuugaaauguguucuguaauggggacacuacaaaaagcuagcuuuccaa

SEQ ID NO: 53274 - RNA, 64 nt, Human
caugggaggaaggucuggcauugggaugccgcccuggggacauacgaaccgccuccuuccacca

SEQ ID NO: 53275 - RNA, 64 nt, Human
auuuuauccaagacugcuccacuuaccccagugcuggggacaaguuucuguugaaacuuuagau

SEQ ID NO: 53276 - RNA, 64 nt, Human
ccuggguacccagugcugauggggugugcccacguggggacauguccuuggcgugcuuccucag

SEQ ID NO: 53277 - RNA, 64 nt, Human
guucucaguaauguagccauuugagaaacuuacuuggggacaaagucucaauccuuauuuuaaa

SEQ ID NO: 53278 - RNA, 64 nt, Human
acccuccauuguccauggucaacagggaagggguuggggacaggucugccaaucuaucuaaaag

SEQ ID NO: 53279 - RNA, 64 nt, Human
guugucuccaacgaacagaaaacuauaaacuuacuggggacaggaugugugcuaaagggcacag

SEQ ID NO: 53280 - RNA, 64 nt, Human
uucugcccaugggaaguaaacugcagcaggccacuggggacagaagggcccauguacuuguugg

SEQ ID NO: 53281 - RNA, 64 nt, Human
aucauuucugugccaagcugcacaccgagugaccuggggacaucauggaaccaagggauccugc

SEQ ID NO: 53282 - RNA, 64 nt, Human
caaagaggugcggaggcaagcaagcuccaugugguggggacagcgcauugcgaccuccaccacc

SEQ ID NO: 53283 - RNA, 64 nt, Human
agccaagcugcucagaaguacgaggcacuguauauggggacacugccagucaccaaggccaugg

SEQ ID NO: 53284 - RNA, 64 nt, Human
auaauuacuagaaacccaauuaauuugauaagcuuggggacaacaucccaauagauaaaaauuu

SEQ ID NO: 53285 - RNA, 64 nt, Human
uccaggaguagacaugauugguggccaaguuauuuggggacaccuaaacagaucagugaccuga

SEQ ID NO: 53286 - RNA, 64 nt, Human
guauuuacucugcaccaggucccaugccaagcacuggggacacaguuauggcaaaguagacaaa

SEQ ID NO: 53287 - RNA, 64 nt, Human
ccuggcauccugggugaccgguguucuuggguauuggggacaggacagagagcucauucuauaa

SEQ ID NO: 53288 - RNA, 64 nt, Human
ccagggccuccagacgugcgggcggcacaugccuuggggacauccugccuucaggaccgugggg

SEQ ID NO: 53289 - RNA, 64 nt, Human
agcuuguggaugccacuaacucgaaaccagaugcuggggacacacauucugccuuggauuccua

SEQ ID NO: 53290 - RNA, 64 nt, Human
agacuccugaggacagcuguccucuucugcaucuuggggacaucucuuugaauuuucuguguuu

SEQ ID NO: 53291 - RNA, 53 nt, Human
acaacaccguguucagcuaacccuggggacaaagcagcgucuggcucgagugg

SEQ ID NO: 53292 - RNA, 64 nt, Human
cuuccacuguuauccuaguaaaagcaucaggggcuggggacaauuucuuuccaaagcaaaagag

SEQ ID NO: 53293 - RNA, 64 nt, Human
acuggaccaggucuacgucagcauucagguucaauggggacaccaguggcuucaaacuuccuga

SEQ ID NO: 53294 - RNA, 64 nt, Human
aauggaccagaucuaccucaguauucaaguucaguggggacaccaguggcuucaaacuuccugg

SEQ ID NO: 53295 - RNA, 64 nt, Human
uggaggagagccugguugcccagggauuuguccuuggggacaucucauccaucaaguugcacac

SEQ ID NO: 53296 - RNA, 64 nt, Human
ccaucaaguugcacacucacuggcaucuuugcuauggggacauuccaauuugcacuuucaggaa

SEQ ID NO: 53297 - RNA, 64 nt, Human
gugcaggcucccuacacaguccugcugcugccgcuggggacaagccgccaagacccaggggccc

SEQ ID NO: 53298 - RNA, 64 nt, Human
cccugcaccugcugcguccccacucccuuggugguggggacauugcucucugggcuuuugguuu

SEQ ID NO: 53299 - RNA, 64 nt, Human
gagcccucaggcuccccagaacuggcugggccccuggggacagagccaccccaugagcucgggg

SEQ ID NO: 53300 - RNA, 64 nt, Human
ccaggcccuggggagggagccucuggacggacaguggggacauuguggguuuggggcucagagu

SEQ ID NO: 53301 - RNA, 64 nt, Human
uuucuauacaguaguuuugugauuagaauucaccuggggacacacacucacacgcacagucacu

SEQ ID NO: 53302 - RNA, 64 nt, Human
uuauuuaaucaacuuuaagcauuacauucucaauuggggacaaaaauugguucuuggggugaaa

SEQ ID NO: 53303 - RNA, 64 nt, Human
auguauaugaggucaaaucaaggaaggcaauugcuggggacaagaaaaguagagguaggaaaga

SEQ ID NO: 53304 - RNA, 64 nt, Human
aaaaaaaaaaaaaguuuuuaugugcacuuaaauuuggggacaauuuuauguaucuguguuaagg

SEQ ID NO: 53305 - RNA, 64 nt, Human
aaauucucaagaugcagguucuuggggaaugggauggggacagcauuugauuuacacugauuau

SEQ ID NO: 53306 - RNA, 64 nt, Human
acaaaaaaugccgagguuuggcguagcugguagcuggggacagugucuucguuugauuacugcc

SEQ ID NO: 53307 - RNA, 64 nt, Human
ucaccaagcaugcaccaaacacugcuuuaggcacuggggacacaaaggggacagagccauccuc

SEQ ID NO: 53308 - RNA, 64 nt, Human
cugauuugaaauuuagauuuuuuaaauuauguacuggggacagguuuuugucgcuuuacauugc

SEQ ID NO: 53309 - RNA, 64 nt, Human
agccugggggcugggaggauccuggagaaguggguggggacagaccagcccuuccccauccugg

SEQ ID NO: 53310 - RNA, 64 nt, Human
gggcggaucuggugaucaugggagccagagggaguggggacagugcaggcaguauuggcaggag

SEQ ID NO: 53311 - RNA, 64 nt, Human
ggggaaccccucccauuaaagauccgggcaggacuggggacagguuggaagugugauggguggg

SEQ ID NO: 53312 - RNA, 64 nt, Human
gacgccagcccugcccaaucagagaugccaaaaauggggacaugacuucuggacagaggacaug

SEQ ID NO: 53313 - RNA, 64 nt, Human
ucaaggaguggcugggagucuuuucccuaacuuguggggacaccaccaguugucaagcuacuag

SEQ ID NO: 53314 - RNA, 64 nt, Human
agcucuccuccagcccugggcacauagcauaggcuggggacacaggauccuggccugagaauug

SEQ ID NO: 53315 - RNA, 64 nt, Human
aggagcaucacagggcuccuucuggagcauuugguggggacagcugcagagaagaggccuggaa

SEQ ID NO: 53316 - RNA, 64 nt, Human
ucucagagacccacuuuauucaguucuguacauauggggacaucgguccaagcccaacccaccu

SEQ ID NO: 53317 - RNA, 64 nt, Human
ccagcugcuauggggcuuaggccaugcucagugcuggggacaggaguuuugcccaacgcagugu

SEQ ID NO: 53318 - RNA, 64 nt, Human
ccaaggacaacucuaucuaugucguggcuaauauuggggacaagaagccaugcaaugccaguga

SEQ ID NO: 53319 - RNA, 64 nt, Human
ggcuucaugcacauugcacagaggaggagauucauggggacagcaggcacugguuaggcacagc

SEQ ID NO: 53320 - RNA, 64 nt, Human
uggcugacgaauuuguuucuacagaaauaacagcuggggacaacugcggugaugauguaaaaac

SEQ ID NO: 53321 - RNA, 64 nt, Human
ggcccacagccucguugggaggacaggguggcccuggggacaagagggaggagcccaggggcuu

SEQ ID NO: 53322 - RNA, 64 nt, Human
gguguaccugcuggaagaauucuagcaugcuacuuggggacauaauuucagugggaaauaugcc

SEQ ID NO: 53323 - RNA, 64 nt, Human
acaggcugagguugucagggcagagagcugaagguggggacagugaccgcggaccccucugugc

SEQ ID NO: 53324 - RNA, 64 nt, Human
aggacugcagcugucuaggucugcggccacaucuuggggacacacuggacuguucccaugugca

SEQ ID NO: 53325 - RNA, 64 nt, Human
uguuguuuucucagcugugaaaggaauauucugguggggacaagguuacagaguugcugagagg

SEQ ID NO: 53326 - RNA, 64 nt, Human
aaugccgacuguguggacucucuuccucagacuguggggacagauacaauuccacuccugucca

SEQ ID NO: 53327 - RNA, 64 nt, Human
auauuuaauauauuuauuauauugucccccgagguggggacagugagugaguucucuuaguccc

SEQ ID NO: 53328 - RNA, 64 nt, Human
gagacuuaaacauaaagaaauaggcacuauacaauggggacauaaaaaaagaaaaucaaagaag

SEQ ID NO: 53329 - RNA, 64 nt, Human
uauauuuaaaaguaauacacuuccuguaaacaaauggggacaaugcauccaaaaaaucuuuuua

SEQ ID NO: 53330 - RNA, 64 nt, Human
gcggggacccggacagccaggugacuaccaguccuggggacacacucaccauaaacacaucccc

SEQ ID NO: 53331 - RNA, 64 nt, Human
ucucgagagccagagcagcaguugaauguaaugcuggggacaggcaugcugccgccaguagggc

SEQ ID NO: 53332 - RNA, 64 nt, Human
gcuacagucagcuagcuggacagcccaugcugaguggggacauacacuugcaucuuuguugaaa

SEQ ID NO: 53333 - RNA, 64 nt, Human
aaaaagcugugugcucuccaagcccaguucagcuuggggacaggggcaggaggaagggguagga

SEQ ID NO: 53334 - RNA, 64 nt, Human
acugugcuuuaaauuauauuuucauauguuuuguuggggacagagcacauuaagucugaaagca

SEQ ID NO: 53335 - RNA, 64 nt, Human
accaaauauaagccucgcugucccacaugcguauuggggacaagaugaaaccugcuuccaggcu

SEQ ID NO: 53336 - RNA, 64 nt, Human
cccuggagcgccggagcggacgcccccagggagcuggggacacccccaugggacaggugagggg

SEQ ID NO: 53337 - RNA, 64 nt, Human
cucccagcugcguccacagugaccuggaucaggguggggacaaggacuggacccuccuucucca

SEQ ID NO: 53338 - RNA, 64 nt, Human
agucugagucugguccauugcuaccccaauucucuggggacauaaaaccaggcuggaaagggac

SEQ ID NO: 53339 - RNA, 64 nt, Human
ucuguuugccauguaccuggaugcgacgggccccuggggacaggcccuugccccauccauccgc

SEQ ID NO: 53340 - RNA, 64 nt, Human
gcuggggggaugcuuagcucagagcaguggcugauggggacacugagauaagaucggaggggag

SEQ ID NO: 53341 - RNA, 64 nt, Human
agugucauaggaguggagggggauaaguggggacuggggacaugugaaaugaugggcauuccag

SEQ ID NO: 53342 - RNA, 64 nt, Human
agaacggaguuaugaguuggucagcagaggaggcuggggacaggcaguuuuuggucuuuuaccu

SEQ ID NO: 53343 - RNA, 64 nt, Human
gucccagggggcugugcuagcacagaccugagaauggggacacaggucauucagagcuccaggc

SEQ ID NO: 53344 - RNA, 64 nt, Human
uaauguuuaaaaagcuuuacaccuguuuacaauuuggggacaaaaaggcaggcuucauuuuuca

SEQ ID NO: 53345 - RNA, 64 nt, Human
ggagcaaacuuaagaguaguuuauuuauauacccuggggacagaaagucagguugaaacaggaa

SEQ ID NO: 53346 - RNA, 64 nt, Human
cacuuccucccaugagacagagugauggccagcuuggggacauuugcuuuaaaugggaaagagg

SEQ ID NO: 53347 - RNA, 64 nt, Human
gagugcuauuagaacacagcuuauuacauggauauggggacaggagagauuaaagcagguucaa

SEQ ID NO: 53348 - RNA, 64 nt, Human
uuccuuuauugucuucagugcauauauuugcaguuggggacagguugaguagaggaaaagggaa

SEQ ID NO: 53349 - RNA, 64 nt, Human
uggagggcauugacaccuggcucagcuggaacaguggggacaggaggaggcaggucucaagaga

SEQ ID NO: 53350 - RNA, 64 nt, Human
ccccucccccccaccccccuggagugcugcccucuggggacaugcggagugggggucuuauccc

SEQ ID NO: 53351 - RNA, 64 nt, Human
uugcaggguucugacaaggcaggacagucaagaguggggacacuuucagcuucuacuuuugccu

SEQ ID NO: 53352 - RNA, 64 nt, Human
caaauagagggaugcuaggugucugggaucgggguggggacagguagaccaggugcucagccca

SEQ ID NO: 53353 - RNA, 64 nt, Human
gcccuucucagggcuagcugcuccucucacaggcuggggacagagguggcccugguucacuugc

SEQ ID NO: 53354 - RNA, 64 nt, Human
cauuccagcaggaggcacuuaggggagacucggauggggacauggagaacaacccaagcuccuu

SEQ ID NO: 53355 - RNA, 64 nt, Human
uaggaaacaccauuauaaaaacacuuauaguaaauggggacauucacuauaaugaucuaagaag

SEQ ID NO: 53356 - RNA, 64 nt, Human
gcguggcagagcaugucuuggaaccugucuugaguggggacaacguccccccacugcugcccua

SEQ ID NO: 53357 - RNA, 64 nt, Human
gggagguuccagcaggcgggggagccccgaccaguggggacacuccucccuccccagugagcag

SEQ ID NO: 53358 - RNA, 64 nt, Human
agcaguggcuggaaacccuaagcacugcugcccauggggacacggcccaggacagcccgggggc

SEQ ID NO: 53359 - RNA, 64 nt, Human
aguguuuacuaugugccaguuccuguaacagguguggggacacagcagugaguaaucaauacag

SEQ ID NO: 53360 - RNA, 64 nt, Human
ucuucagcuggccucacugacaccccggccucccuggggacauuguucauaaccaugacuaauc

SEQ ID NO: 53361 - RNA, 64 nt, Human
cccacaauccuauucucgggcugagaacccugcguggggacagggcucgccucaggaaugggcu

SEQ ID NO: 53362 - RNA, 64 nt, Human
cacaggaucggcccgagacccaggccaugcccacuggggacacacugugccgugcuccuucugc

SEQ ID NO: 53363 - RNA, 64 nt, Human
cccagcagguaugggacaggugccaggugugugguggggacaacagcacgugcagcccacggaa

SEQ ID NO: 53364 - RNA, 64 nt, Human
ggguugccaggacaacaagcauggcaggggcgaauggggacaucaggugacugacugcgagcca

SEQ ID NO: 53365 - RNA, 64 nt, Human
ggccuccugggucugcagugagucugggggcccauggggacagggacaggugaggggcuuccug

SEQ ID NO: 53366 - RNA, 64 nt, Human
cccaugccaggaacuaaggaugucauguagaucguggggacagagaugggugauggaacuugga

SEQ ID NO: 53367 - RNA, 64 nt, Human
cagugagcugagauugcaccacugcacuccagccuggggacagagcaagacucuugucucaaaa

SEQ ID NO: 53368 - RNA, 64 nt, Human
aguacuggcuccaccccuuggugcuggcaguguuuggggacauuaugcuggaaagagcuccuag

SEQ ID NO: 53369 - RNA, 64 nt, Human
gggaaggugucgggggcccccuaggagggagcgcuggggacauugccaugggacggaagucugc

SEQ ID NO: 53370 - RNA, 64 nt, Human
gcauggcccgaagcgugcggggccccggaugacuuggggacaccccagaauccccuggggagaa

SEQ ID NO: 53371 - RNA, 64 nt, Human
gacuucugcuaaaaagcaaucaugagugcguggcuggggacagaccucucugaagugucuccug

SEQ ID NO: 53372 - RNA, 64 nt, Human
cccucugcccugcccggccaaauacccggcauuauggggacagagagcagggggcagacagcac

SEQ ID NO: 53373 - RNA, 64 nt, Human
guagucgaacaccucucuggccccuagaccuaucuggggacaggcuggcucagccugucuccag

SEQ ID NO: 53374 - RNA, 64 nt, Human
cugaccacccagagcugggccagggacucaacaauggggacagaagucccccagugccugccag

SEQ ID NO: 53375 - RNA, 64 nt, Human
agggugaugagugcugguccugacaggaggccgcuggggacacugugcuguuuuguuucguuuc

SEQ ID NO: 53376 - RNA, 64 nt, Human
cagcacuugcauuaccgucccugcucuucccagguggggacaguggcccaagcaaggccucacu

SEQ ID NO: 53377 - RNA, 64 nt, Human
agggagauucguuacauaaauauauuuacguaucuggggacaaaggucaagccaguaaagaaua

SEQ ID NO: 53378 - RNA, 64 nt, Human
cuguuucuugcuuguaccucuggcugacuaaauuuggggacagauucagucuugccuuacacaa

SEQ ID NO: 53379 - RNA, 64 nt, Human
ugggggccauggaggaaaggccuaaaguuucacuuggggacagagagcagagcacacucgggcc

SEQ ID NO: 53380 - RNA, 64 nt, Human
ggccggucgggggggacccuccaaggccaggccuuggggacaaccuuggcuuggcccuggcagc

SEQ ID NO: 53381 - RNA, 64 nt, Human
aagcucauugaguugugugcggguggcugugcauuggggacacauaccccucaguacuguagca

SEQ ID NO: 53382 - RNA, 64 nt, Human
aggaaaaguaaauggagagguaaaagaaaggcauuggggacaaaugaaagagaugauguagauu

SEQ ID NO: 53383 - RNA, 64 nt, Human
gaccuugaugcagcguagcugguauuaacaaccguggggacaccaggccacucuuuuucuacca

SEQ ID NO: 53384 - RNA, 64 nt, Human
auucugagagauaccauuuaaguugagauuucaguggggacacagccaaaccauaucauucuac

SEQ ID NO: 53385 - RNA, 64 nt, Human
aauuccagaagauaaauucaaguugcaauuucaguggggacauagccaaaccauaucacuggug

SEQ ID NO: 53386 - RNA, 64 nt, Human
agcccaggcaccccagugcccgcugggcccagccuggggacagggaaccugccgggcucacagu

SEQ ID NO: 53387 - RNA, 64 nt, Human
gcuggaccaggagguggaggcucaggggaccccauggggacaggcagagcuggucuccucccag

SEQ ID NO: 53388 - RNA, 64 nt, Human
gaaauagcaggugcgucuucuaguuuauuccuccuggggacauuuccucaaagcaguuuugcgc

SEQ ID NO: 53389 - RNA, 64 nt, Human
cuacaauagguugggagaugcugaucccuucaaguggggacagcaaaaagacaagcaaaacuga

SEQ ID NO: 53390 - RNA, 64 nt, Human
uauugacuuacaauauucuagaaggaccuacguguggggacacaguuuuccaaacugaggaaaa

SEQ ID NO: 53391 - RNA, 64 nt, Human
uuuucacaauucaugggggccugcauggcaggaguggggacaggacaccugcuguuccuggagu

SEQ ID NO: 53392 - RNA, 64 nt, Human
cuggggguaaaacagggaaggcagugccugagcauggggacaggugagguggggcugggcagac

SEQ ID NO: 53393 - RNA, 64 nt, Human
ucucgugguggagccaugaucugggcugcucucuuggggacacuggguggugguuacacaguug

SEQ ID NO: 53394 - RNA, 64 nt, Human
cuuuuuuuaaucuucuuccuauguuuuggaauucuggggacaaucugacuggauaugacacugc

SEQ ID NO: 53395 - RNA, 64 nt, Human
cuaaagagccauggagcccuccccuggccaugucuggggacagauagaaccuguugggggaaau

SEQ ID NO: 53396 - RNA, 64 nt, Human
ccuucccugcuaugggaaaggccaagcugcuggguggggacagaagcugcaggggagagggaag

SEQ ID NO: 53397 - RNA, 64 nt, Human
aaagggagaagagggaaaacagaaaaccugaugcuggggacacagcaucagcucaagacgucac

SEQ ID NO: 53398 - RNA, 64 nt, Human
gucuacauaaagaagacaugggucugucauagaauggggacauuagacugaaaacugggacaac

SEQ ID NO: 53399 - RNA, 64 nt, Human
gccguggccuugggaucucacccucuccauguccuggggacagccucgcccucagccggacugc

SEQ ID NO: 53400 - RNA, 64 nt, Human
ccucacucaagccugagagaaguugggagggugguggggacagguaaguggcaggacccuguca

SEQ ID NO: 53401 - RNA, 64 nt, Human
ucagaugaauugucugugugucuugcaaaagaguuggggacaacuugggcaggccuaugaagug

SEQ ID NO: 53402 - RNA, 64 nt, Human
uaagaagucaugauuaacuuaugaaaaaauuauuuggggacaggagugugauaccuuccuuggu

SEQ ID NO: 53403 - RNA, 64 nt, Human
ucccgguggggcgaagcucugagucauucagcccuggggacaccccuaggcaacgauuccgaca

SEQ ID NO: 53404 - RNA, 64 nt, Human
cugggagucuuguuuuuauuuauaauaaaauuguuggggacaccucagugcuagucucuggugu

SEQ ID NO: 53405 - RNA, 64 nt, Human
aggaagagaccuuuccucugacggaccacuaagcuggggacaggaaccaaguccuuugcgugug

SEQ ID NO: 53406 - RNA, 64 nt, Human
caaugcuugacauacagcauuguguuaugcccauuggggacacagaggugaacaagacaaggaa

SEQ ID NO: 53407 - RNA, 64 nt, Human
gcccaguggaggaggggguacaguccugguuagguggggacagaggauuucugcuuaggccccu

SEQ ID NO: 53408 - RNA, 64 nt, Human
cuugcuguuauucuccaacucauccgugggcuucuggggacagccauuuggcuggggugccaaa

SEQ ID NO: 53409 - RNA, 64 nt, Human
caucacauuagggguuaggauuuaacaugaauuuuggggacauauaaacauuaagucuguagua

SEQ ID NO: 53410 - RNA, 64 nt, Human
agaagagcacagaugugugggauugggggaggaguggggacaagauuuuuuaucuccaagugaa

SEQ ID NO: 53411 - RNA, 64 nt, Human
aaaacagcaccucccaccaaccagccacucccgguggggacacagcacagaccccaaagccagg

SEQ ID NO: 53412 - RNA, 64 nt, Human
ugccgggauggguugggccugggcccggcccucguggggacauuaaagggcgcgguggcuccac

SEQ ID NO: 53413 - RNA, 64 nt, Human
aguucagguauguguguauauaguaugaaugcaguggggacacccuuugugguuacaguuugag

SEQ ID NO: 53414 - RNA, 64 nt, Human
cccuugcagcugcagcugacaacaggcaggaugguggggacagcagggggcuacugccauccag

SEQ ID NO: 53415 - RNA, 64 nt, Human
cgaugcacacaccggaaguggcgagcccaagcccuggggacagguguagggagaaaagcagccc

SEQ ID NO: 53416 - RNA, 64 nt, Human
ggguaaaaggaggguggccucaagaaacaaugucuggggacaggccuuucuggccugcuauguc

SEQ ID NO: 53417 - RNA, 64 nt, Human
cucgaaucccccuagggcucaggcacugagggccuggggacaguggagcauaugggugggagac

SEQ ID NO: 53418 - RNA, 64 nt, Human
cuuucgaguaucuaacuuuugccauugggugggguggggacagcugcucgcggaacagccccua

SEQ ID NO: 53419 - RNA, 64 nt, Human
cuuguuuuagaggaagguacugcccauugggagauggggacauugggaccucagcaaugaagaa

SEQ ID NO: 53420 - RNA, 64 nt, Human
uuuguacucguguuguguccauugugugugugcguggggacagaggccuggaaaugcggaggac

SEQ ID NO: 53421 - RNA, 64 nt, Human
ccacuauaguuuaauacucagaggggguuggguuuggggacauaaagccucugacucaaacucc

SEQ ID NO: 53422 - RNA, 64 nt, Human
uccccuagccugccguguggcacugcccacaggcuggggacaagcagcccuuguguugagucag

SEQ ID NO: 53423 - RNA, 64 nt, Human
uuguagcagagggaaaugagacaggaagaugcucuggggacacauuuuuuauguguuaucuuca

SEQ ID NO: 53424 - RNA, 64 nt, Human
gcucagcucauccucccucuggccccuucucccauggggacaucucggcccagcaccccuaucc

SEQ ID NO: 53425 - RNA, 64 nt, Human
uuccucccaaacaaugacuuccugccauguuugauggggacagcuaccacuguccucugccccc

SEQ ID NO: 53426 - RNA, 64 nt, Human
uuaccuugccuuaggcguucuaaucaugagaucuuggggacaaauugacuaugucacagguugc

SEQ ID NO: 53427 - RNA, 64 nt, Human
auuucaguauuagcuauaggugcuaccuaccucuuggggacauggcccuguuugcgcuaaccau

SEQ ID NO: 53428 - RNA, 64 nt, Human
guggguggcagggagaaaagaacaucaggguggguggggacaggccagugacgaagagagggac

SEQ ID NO: 53429 - RNA, 64 nt, Human
cauugcuuuacucugguuggaaaugccauuguuuuggggacagacuuuuaaaaugcccuugugu

SEQ ID NO: 53430 - RNA, 64 nt, Human
acacuacucgcuccucucccaacaacucccuucguggggacaaaagugacaauuguaggccagg

SEQ ID NO: 53431 - RNA, 64 nt, Human
gauuggagaggagacaaaaccaggagcagcacaguggggacaucucccgucucaacagccccag

SEQ ID NO: 53432 - RNA, 64 nt, Human
ccccucccuaccucauggggaaugucugggaagcuggggacauugcuaugcaaaugugugaauc

SEQ ID NO: 53433 - RNA, 64 nt, Human
gauguggugugcagagguggggagguggcgaggauggggacagaaagcgcacagaaucuuggac

SEQ ID NO: 53434 - RNA, 64 nt, Human
gugugcuuucaaagauguugggauuuuauuuaucuggggacaguguguaugguaagacaugccc

SEQ ID NO: 53435 - RNA, 64 nt, Human
ggagacagguagacagaccuccaggucccuaagcuggggacagagaagguucugagcuguccca

SEQ ID NO: 53436 - RNA, 64 nt, Human
uauacaaugccucccagcuagacuguaagcccuuuggggacaagggcugcuuccaguucuugga

SEQ ID NO: 53437 - RNA, 64 nt, Human
cagcggcuggcuauccucacaggcaccguagagguggggacaggggcaggggcaggggcggagc

SEQ ID NO: 53438 - RNA, 64 nt, Human
cgugggggucggggauccccuuaagaagugguaauggggacaagaugcggcccuggugcuguag

SEQ ID NO: 53439 - RNA, 64 nt, Human
cacccccacccccaaaucccucccuguucuacacuggggacagcagaauuuucuccccgucuuc

SEQ ID NO: 53440 - RNA, 64 nt, Human
cuugggagacaggaacuggcgaguucaggugggguggggacagcacagacuguuccaccguugu

SEQ ID NO: 53441 - RNA, 64 nt, Human
augggaagggaaauuuggggauuauuuauccuccuggggacaguuuggggaggauuauuuauug

SEQ ID NO: 53442 - RNA, 64 nt, Human
augcaguaaaaacuaggagaaugacuuuuacccuuggggacagccaaguuuuguugauaaaccu

SEQ ID NO: 53443 - RNA, 64 nt, Human
ugguuacccccacucaucuguccucucuuuggucuggggacaauccccuuggcugcucuuugcc

SEQ ID NO: 53444 - RNA, 64 nt, Human
ucuauaaaaaccucaccuccaucaagcgcuaugauggggacaucacugaccugggccugacgcu

SEQ ID NO: 53445 - RNA, 64 nt, Human
acaaucauuuaaauguuauuuuggaaagggguuuuggggacacagaagaauaaguaaacacauc

SEQ ID NO: 53446 - RNA, 64 nt, Human
gaagcuauuuuaaaacauuauuuugacuacuaaguggggacagaaagauccauccugaguugug

SEQ ID NO: 53447 - RNA, 64 nt, Human
gauuguuuuuacaauuuugucuuguuuuaguaauuggggacaaugggauaaaaugacauacaac

SEQ ID NO: 53448 - RNA, 64 nt, Human
ugaagcugcauucuccugccgguuucuccaguucuggggacagugguuugcucugagaccucgc

SEQ ID NO: 53449 - RNA, 64 nt, Human
uuacuuuccuccucccuguguuaacuggggcuguuggggacagugcgugauuucucagugauuu

SEQ ID NO: 53450 - RNA, 64 nt, Human
ggaaaguacguuaugauagugucccacggugccuuggggacaagagcagguggauugugcgugc

SEQ ID NO: 53451 - RNA, 64 nt, Human
cuuuuucuugggaugauuuucuagucuuaagguuuggggacauuauaaacuugaguacauuugu

SEQ ID NO: 53452 - RNA, 64 nt, Human
accugugugcagacccucagcuaggcccagaugguggggacagacggcagagaaagagcaugca

SEQ ID NO: 53453 - RNA, 64 nt, Human
uugagaacaccuaaauguuuuuauuuuugagaaguggggacagagucucacuaugucacccagg

SEQ ID NO: 53454 - RNA, 64 nt, Human
uagucuugguuuaccuguggugacaaccggguguuggggacacaugucaaaugccccucugaga

SEQ ID NO: 53455 - RNA, 64 nt, Human
cagguaaagggaggggcaagcccccaaacugcuguggggacauuuuauaaucuauaugcugcac

SEQ ID NO: 53456 - RNA, 64 nt, Human
aacucuuaugugacaguaaaguuuuuuggggggguggggacagagaaguuaagagcuuucaucc

SEQ ID NO: 53457 - RNA, 64 nt, Human
cuaggacaggcggcucuacccgagggagggcgucuggggacagugaugccaacucaaacacgug

SEQ ID NO: 53458 - RNA, 64 nt, Human
cuccucuaauuugguugagaggagguaaugaaaauggggacaggauaaaagguggcaacuaaau

SEQ ID NO: 53459 - RNA, 64 nt, Human
ucuaaaauuugaauggaaauucaagcacaaguacuggggacacaucaaagugugguguuugguu

SEQ ID NO: 53460 - RNA, 64 nt, Human
uuuccagaauuccguaucagucaccauuuuaauauggggacaaugaagacaagcacacaggagg

SEQ ID NO: 53461 - RNA, 64 nt, Human
agagaggaaaugaggugggguuggaggaaacccauggggacagauucccauucuuagccuaacg

SEQ ID NO: 53462 - RNA, 64 nt, Human
ucuagagugugggcuggcuguugugcuggaaagcuggggacagguugaugguaauaaacugcuc

SEQ ID NO: 53463 - RNA, 64 nt, Human
agcagaucuucuggguuuugauggaacuuggcaguggggacauucagcugaugcauuauauacc

SEQ ID NO: 53464 - RNA, 64 nt, Human
ugguguuaaaugcuuuguaaagcugagaucuaaauggggacaaggcagguggaggggaggccag

SEQ ID NO: 53465 - RNA, 64 nt, Human
gagggcugggagugaguagcucuguguuuagaguuggggacaaggaugacaccgaagguccagg

SEQ ID NO: 53466 - RNA, 64 nt, Human
uucaagacacuagaacauuauguucuagacacuguggggacacaguggugaacagacaggcaug

SEQ ID NO: 53467 - RNA, 64 nt, Human
gauccuuagagaaguuugugguauaaaaaggaaguggggacagauucgcagcacagagucgcug

SEQ ID NO: 53468 - RNA, 64 nt, Human
ggggaggagagagcacuuaguuucugaacuagucuggggacauccuggacuugagccuagagau

SEQ ID NO: 53469 - RNA, 64 nt, Human
ccgccucugggccucaggcugccuguccauaaaauggggacauggccagcugacggacaacuga

SEQ ID NO: 53470 - RNA, 64 nt, Human
ccgucaugacgcggcugcuucggaagcagacaucuggggacacagccucaguacccagucuuuu

SEQ ID NO: 53471 - RNA, 64 nt, Human
ugagcuggggggauguucugccucucccugggucuggggacaggcccgcuugcuggguaccugg

SEQ ID NO: 53472 - RNA, 64 nt, Human
ccuggcucccaggacacgacuuguaaugaaaguuuggggacaugugauugauugauugauugua

SEQ ID NO: 53473 - RNA, 64 nt, Human
acucuggaguuuucuguuagguucgggaacacgcuggggacagagcaggccagccagucuggug

SEQ ID NO: 53474 - RNA, 64 nt, Human
auucaagagccaaguacucagcccuggcaggggauggggacaugaugcccagagccaccccuau

SEQ ID NO: 53475 - RNA, 64 nt, Human
aaaagcagcaguaugcuuacagguuugcuuaguuuggggacaccguuaccaccagaauggcugc

SEQ ID NO: 53476 - RNA, 64 nt, Human
acaaagguauagggcugccuuccucuuauuuauuuggggacauuauuuuguuauuuagauacca

SEQ ID NO: 53477 - RNA, 64 nt, Human
aaguuugguaaacuuuagucccauuauauacuuuuggggacaguguuauaaaucagaauuuuac

SEQ ID NO: 53478 - RNA, 64 nt, Human
agugcccaggcacuccugagguagcuucuggaaauggggacaaguccccucgaaggaaaggaaa

SEQ ID NO: 53479 - RNA, 64 nt, Human
cuaaggcguggagcugccugauauuucccuccccuggggacagcaagggcuaucccuuuccaaa

SEQ ID NO: 53480 - RNA, 64 nt, Human
aaagagaagguggguuuucaucaagacuggaagguggggacagggaugagcauggagcuggccg

SEQ ID NO: 53481 - RNA, 64 nt, Human
ucauuuccuucuugaucagugaacacuaacauuuuggggacaacuuagucaauugguuuuccuu

SEQ ID NO: 53482 - RNA, 64 nt, Human
aguagucaccuaugucugugccucccuucuuuauuggggacaugugggcuggaacagcagauuu

SEQ ID NO: 53483 - RNA, 64 nt, Human
uccauguccuuagugaaguccacauuauucucuguggggacaagagcugggcaguuuugaaugg

SEQ ID NO: 53484 - RNA, 64 nt, Human
gagugaagaguggcuuagcuauuuacccgcucuuuggggacagggcaaacuaaaugcaucccuu

SEQ ID NO: 53485 - RNA, 64 nt, Human
ugaccugccaaaaguucucuugccccaugccugcuggggacagaagguuuucaugaacucuuuu

SEQ ID NO: 53486 - RNA, 64 nt, Human
uuguggcagggcucuaccaggagggagugagaucuggggacacaguggcuuccaaguuuucuaa

SEQ ID NO: 53487 - RNA, 64 nt, Human
accuuccccauggaggacacugaaaaggcuggguuggggacagggaguaucacuccauaaguga

SEQ ID NO: 53488 - RNA, 64 nt, Human
accuuuaaucugcaccuuacaacucggggacaaauggggacaggaaggaucaaguuguagagag

SEQ ID NO: 53489 - RNA, 64 nt, Human
agauccaccuccccacugccuuuucucacucagauggggacaccgagguccagaggaaaagaca

SEQ ID NO: 53490 - RNA, 64 nt, Human
ccugggauggcucaaaggagucaggacuuggaaguggggacaucaggguagcugaaggaaaucc

SEQ ID NO: 53491 - RNA, 64 nt, Human
ccuacucagggccuugcucagugcuguggcccgguggggacacaguugcucguggccacucagu

SEQ ID NO: 53492 - RNA, 64 nt, Human
aguguucuuugacaauuuuggugcucauguguuuuggggacaaaagugaaaugaaucugucauu

SEQ ID NO: 53493 - RNA, 64 nt, Human
uugaaauaaaugcuccacagacuguggcugugaguggggacagcuccucgggacaagggggcug

SEQ ID NO: 53494 - RNA, 64 nt, Human
accuggcucuggagggcugcccugcagcugggccuggggacaggucggcuguggggcagcucag

SEQ ID NO: 53495 - RNA, 64 nt, Human
gagggacuggacagaucugaggaaggccguaaaauggggacaggaggauucagcucaggaguaa

SEQ ID NO: 53496 - RNA, 64 nt, Human
augucuugaaucugcuugagcucuaagaugaaccuggggacaaagugagccagucagcaccuac

SEQ ID NO: 53497 - RNA, 64 nt, Human
ggggcugagcuggagguggggaugagagcagguguggggacagcaauacccccuugggggucac

SEQ ID NO: 53498 - RNA, 64 nt, Human
ccaaguucuagggccgucaggacacgggaggguuuggggacagaguguccuuccucuguccucu

SEQ ID NO: 53499 - RNA, 64 nt, Human
gggaccguggaggcuuccgagggggccggggugguggggacagagguggcuuuggcccuggcaa

SEQ ID NO: 53500 - RNA, 64 nt, Human
ccacagcaggccgccugaaucaaauccugggagguggggacagaaaucuguguuuuaagaagcc

SEQ ID NO: 53501 - RNA, 64 nt, Human
ggacccuugagucuggggcacccuucagcugcccuggggacaggaaggacaggagcuaagcagg

SEQ ID NO: 53502 - RNA, 64 nt, Human
caucuaccauuuccucuggauuaaaacuacggacuggggacaacaguauuaauucgauugaaug

SEQ ID NO: 53503 - RNA, 64 nt, Human
augugucccgaauccacagucguacugauucuaauggggacacagaucaugguagagaaucucu

SEQ ID NO: 53504 - RNA, 64 nt, Human
aggacgccugggcuuaccuggggggcaggaugccuggggacaguucaggacacacacacaguag

SEQ ID NO: 53505 - RNA, 64 nt, Human
ggcaacucuggacaucucugccuauuaucagugcuggggacaccccugggggucgggacgugua

SEQ ID NO: 53506 - RNA, 64 nt, Human
aacggcaguuucccuuccccaguggacgucuagguggggacaggguaucuuggcucccagcugg

SEQ ID NO: 53507 - RNA, 64 nt, Human
cugcagguuuggaaaggccccuuggauuccuggcuggggacaaugaugaccuggacccuggcca

SEQ ID NO: 53508 - RNA, 58 nt, Human
aacuguacgcagugacgugacacuggccuggggacagcugcugcucugaugaccucuu

SEQ ID NO: 53509 - RNA, 64 nt, Human
ccggacucaggcccccaccuggcucaccuugugcuggggacagguccucaguguccucaggggc

SEQ ID NO: 53510 - RNA, 63 nt, Human
cuggcacugugaagcucuaggccugcuacugccuggggacacggacuucugcugcugccaccu

SEQ ID NO: 53511 - RNA, 64 nt, Human
agccaccaaaccuugcuuuuucucaucugcaaaauggggacaauggggauaaugauccccaccu

SEQ ID NO: 53512 - RNA, 64 nt, Human
ugugacacccucagccaagggacagugccauccuuggggacaggaggaaaagcagccugucucu

SEQ ID NO: 53513 - RNA, 64 nt, Human
ccuccuccucuuccugcuccaacuucuguccaccuggggacagucugugccuguagccucauga

SEQ ID NO: 53514 - RNA, 64 nt, Human
acuuuacacaauagaauuauaacuggaaagaaguuggggacacauguauuuggugauuacauuu

SEQ ID NO: 53515 - RNA, 64 nt, Human
ggggacagcuuucuagaaaagccacaccugcaucuggggacacacuuuggaaagugggacccuc

SEQ ID NO: 53516 - RNA, 64 nt, Human
ucacuucccucaguucccaaagcugcccaguccauggggacagaaccgucacucagauccacau

SEQ ID NO: 53517 - RNA, 64 nt, Human
caccaagccugccagaggggucucauucauggcuuggggacacagggcuccuagcaagcaggaa

SEQ ID NO: 53518 - RNA, 64 nt, Human
aaaggcccuugucauugccuucgcuccauguuuuuggggacacugacaaagucauccccucuca

SEQ ID NO: 53519 - RNA, 64 nt, Human
cucucugcccccauuccuucaagaggagacccuuuggggacaaggccguuucuuuguuucugag

SEQ ID NO: 53520 - RNA, 64 nt, Human
gucagcggugcuggggaacagauggagggggcaguggggacagggcuugggcagacaccagcag

SEQ ID NO: 53521 - RNA, 64 nt, Human
ggaccaggaacccggcgacugaggugcuuccagguggggacaagccccucuuggucucagccac

SEQ ID NO: 53522 - RNA, 64 nt, Human
cagccuccggcgagggugggagacggcuuuguccuggggacacuuucccucuggaaucucaaga

SEQ ID NO: 53523 - RNA, 64 nt, Human
aauuugggucccagcuaaagagguggggugaagcuggggacagcuuuccugggugaguuuuucu

SEQ ID NO: 53524 - RNA, 64 nt, Human
cuugagcuggggggcuggggagggguagggggaauggggacaggcucuuucccccuuggggguc

SEQ ID NO: 53525 - RNA, 64 nt, Human
ucacugcugucccuccugaggucuggauuggggauggggacaaagaaauagcaagagaugagaa

SEQ ID NO: 53526 - RNA, 64 nt, Human
caaauguuuuuaagucaugaccaaacaggcuuguuggggacauaucauggggugagcuuugaag

SEQ ID NO: 53527 - RNA, 64 nt, Human
ucaggccuugcuuguuccugcauuaggggaaaguuggggacaugcugcuacaauacggcuaauc

SEQ ID NO: 53528 - RNA, 64 nt, Human
aagcacuuucgauugugccuccuguuuucucgaguggggacacuuuaacuacaguuuacaccuc

SEQ ID NO: 53529 - RNA, 64 nt, Human
agccuggaacagugaccagaucugggggccugaguggggacagaguugaucguccaccuggcca

SEQ ID NO: 53530 - RNA, 64 nt, Human
ugccugggccaacucugcauggagaggccagggcuggggacaguccgcacucugccacccuccu

SEQ ID NO: 53531 - RNA, 64 nt, Human
ccuuucguccugguuccuccgccacucuuccucuuggggacaacaggaagugucugauuccagu

SEQ ID NO: 53532 - RNA, 64 nt, Human
gagacuccuuccucaugcuggcgccgauggcugcuggggacagcgccccugagcugcaacaagg

SEQ ID NO: 53533 - RNA, 64 nt, Human
acauggggccugugcccaccccucuugagugucuuggggacagcucuuuccaccccuggaagau

SEQ ID NO: 53534 - RNA, 64 nt, Human
uggcuugaggacgaggccacucagaggcccccaguggggacagggagggggaccugucccccac

SEQ ID NO: 53535 - RNA, 64 nt, Human
uucagacgcugguaugggggcucggaccccucacuggggacagggccaguguuggagaauucug

SEQ ID NO: 53536 - RNA, 64 nt, Human
ucccagagaacuccuugaggagaacaagugcccuuggggacagccggcaggcgccccuguacgu

SEQ ID NO: 53537 - RNA, 64 nt, Human
ugcuaaguuuucugagaugagggucuagcccuguuggggacagaaaaguguguagaccuucuuc

SEQ ID NO: 53538 - RNA, 64 nt, Human
ucgccuucuagggcacccucagcaaaggggcagguggggacacuccaaguggggcagcucuccg

SEQ ID NO: 53539 - RNA, 64 nt, Human
auuccauucuacaaugaauaccuugacccuucacuggggacacagaaaugcuacaaagccaccu

SEQ ID NO: 53540 - RNA, 64 nt, Human
gaggaagagaggccuucugggacugcccaggcuauggggacaaaggccuucaccagcaagggcc

SEQ ID NO: 53541 - RNA, 64 nt, Human
uggcuuugcccaccccucacuccccagggagcucuggggacagcuuccucacaccccuguccca

SEQ ID NO: 53542 - RNA, 64 nt, Human
uagccacaugcucuugccccccaacccuuguauauggggacaguggggucagugcagcuacccu

SEQ ID NO: 53543 - RNA, 64 nt, Human
aguucauuguuuuaagggauugggggagggagccuggggacacaaaccuuuuauacaauacaaa

SEQ ID NO: 53544 - RNA, 64 nt, Human
guaccccuccagauguggggacauuccaccccaguggggacagccauuccccuaccugcuccag

SEQ ID NO: 53545 - RNA, 64 nt, Human
ccucugccuagacacugggguaccccuccagauguggggacauuccaccccaguggggacagcc

SEQ ID NO: 53546 - RNA, 64 nt, Human
aggcugaggcauaaguggcaggauuucgggaagcuggggacacggcagugaugcugcggucucu

SEQ ID NO: 53547 - RNA, 64 nt, Human
acuggagucugguggcgauuagcggacuggagucuggggacauccguggcaaagacaccagcuc

SEQ ID NO: 53548 - RNA, 64 nt, Human
acucagcuuucugggaaaagcgugccuccagccguggggacaggccauccuacugacuaccucu

SEQ ID NO: 53549 - RNA, 64 nt, Human
gcagaagggcccucccuccagccuaggucagagguggggacagagaacuccccuacagcccaga

SEQ ID NO: 53550 - RNA, 64 nt, Human
ggguauugcauggucacgagugagggcaggccccuggggacacaucugcccacagcugcacagg

SEQ ID NO: 53551 - RNA, 64 nt, Human
gacugcagugcacugcgggccuuggaguguccaguggggacacuggugugggaaggggcagcac

SEQ ID NO: 53552 - RNA, 64 nt, Human
cuauggauauaguccuucucagauuagcuggaaauggggacagaguucucauuuaucccagaua

SEQ ID NO: 53553 - RNA, 64 nt, Human
cuuccaucuggucugaccgcaaacaguguuuauuuggggacagggguugggauggggguguggg

SEQ ID NO: 53554 - RNA, 64 nt, Human
acacaugggguuaguuacuacucuccaugugcauuggggacaguuuuuauaagugggaaggacu

SEQ ID NO: 53555 - RNA, 64 nt, Human
guguguguguguguguguguguguuggaaccuccuggggacauguuauauuuugaagugauuaa

SEQ ID NO: 53556 - RNA, 64 nt, Human
cuuuuuauacugucacaaagguuuuugaaaaagcuggggacacuauuuugucuuuuaguuuuaa

SEQ ID NO: 53557 - RNA, 64 nt, Human
uagacccugaagccccuccuccuucccccacagauggggacaggaggugauggggugcucagaa

SEQ ID NO: 53558 - RNA, 64 nt, Human
uguguagacacaggcccucugcagaagcgugggguggggacacugacagccccuaucugguccc

SEQ ID NO: 53559 - RNA, 64 nt, Human
agcaguguccccagccuagcccugugagaccccauggggacacgggugccuauguauuuucacu

SEQ ID NO: 53560 - RNA, 64 nt, Human
ucagaguuaaauagaguauaugcacuuuccaaauuggggacaagggcucuaaaaaaagccccaa

SEQ ID NO: 53561 - RNA, 64 nt, Human
cccaccauguggcugggaggacuugggagggggauggggacauugggaaccugucaagaagugc

SEQ ID NO: 53562 - RNA, 64 nt, Human
cucauggugcuggugcuguuguguguagguccccuggggacacaagcaggcgccaaugguaucu

SEQ ID NO: 53563 - RNA, 64 nt, Human
uggcugccucucugcuccaccuugugacccaggguggggacaggggcuggcccagggcugcaau

SEQ ID NO: 53564 - RNA, 64 nt, Human
agaauucaagacagugacagcauuacgucaccccuggggacagaggucagccuaaggugacaca

SEQ ID NO: 53565 - RNA, 64 nt, Human
aaauuuuuuuuucucccauuuuccucccugcaucuggggacacagcugccgugaccagggaggc

SEQ ID NO: 53566 - RNA, 64 nt, Human
aggaccagugcgccccaucccagggaggguuccuuggggacaagggugguuggcagcuccaagc

SEQ ID NO: 53567 - RNA, 64 nt, Human
auucaagauggcagguaggcccuuugaggagagauggggacagggcaguggguguugggaguuu

SEQ ID NO: 53568 - RNA, 64 nt, Human
auuuuuuuucuugguuucuggauaaaccacccucuggggacaggauaauaaaacauguaauauu

SEQ ID NO: 53569 - RNA, 64 nt, Human
agaaccagcucugaguccugaggagacacaggccuggggacaggaagggaugggggucccugcu

SEQ ID NO: 53570 - RNA, 64 nt, Human
aaccagcuauaaguccugagaagacacuggugucuggggacagggagggaugggggucccugau

SEQ ID NO: 53571 - RNA, 64 nt, Human
ugagacuguacugaggagaggcugaggcuagggcuggggacagauaucuuguacucccagugac

SEQ ID NO: 53572 - RNA, 64 nt, Human
uuuccaugccaaagucccccaagaucuggauaucuggggacaagaugguggccucaggccugcc

SEQ ID NO: 53573 - RNA, 64 nt, Human
ccucgcccuaccaagagggcaccugaggagacuuuggggacagggcaggggcagggagggaaac

SEQ ID NO: 53574 - RNA, 64 nt, Human
aggcuuggucaauuccugagagcauccucugugcuggggacacagugguaaucaagacagcccc

SEQ ID NO: 53575 - RNA, 64 nt, Human
uguagccucuggguguggagcugggaucuucaacuggggacaguacaguaaagaacaucacagc

SEQ ID NO: 53576 - RNA, 64 nt, Human
cugugccccggcgaggccggagagcuggugacuuuggggacagggggugggaaggggauggaca

SEQ ID NO: 53577 - RNA, 64 nt, Human
caaugcuccagcugucgucugacucuggguucguuggggacaugagauuuuauuuuuugugagu

SEQ ID NO: 53578 - RNA, 64 nt, Human
aauggucaugcccacugggagccguggauaugcguggggacauccugggucaucucagucaugg

SEQ ID NO: 53579 - RNA, 64 nt, Human
gguggcauuuggccuugaacaaaaccaaguccacuggggacagaggcaggggcaaguggcucuc

SEQ ID NO: 53580 - RNA, 64 nt, Human
cccguuuucccaagaagaggguucgagcccuugguggggacagcuggggagauggcagugcagg

SEQ ID NO: 53581 - RNA, 64 nt, Human
uacguccuaaagccaggaagagugacaaggcagguggggacagaaggaagaagccaggagccuc

SEQ ID NO: 53582 - RNA, 64 nt, Human
auauacucugcagcuguuagaaugugcaagcacuuggggacagcaugagcuugcuguuguacac

SEQ ID NO: 53583 - RNA, 64 nt, Human
gaauaacugccuguuggguacuaugcugauuaccuggggacaaaauuaacuguacaccaaacuc

SEQ ID NO: 53584 - RNA, 64 nt, Human
guagcugcccucaucagaaaccaggcccaggcaguggggacacauccagagugcugaaagaacc

SEQ ID NO: 53585 - RNA, 64 nt, Human
gcacccacacagacacagagggaagggguugggauggggacagggugcacagcagggcggggua

SEQ ID NO: 53586 - RNA, 64 nt, Human
cucagaaagcaagccccucggugucugacguaucuggggacacuucaagguucacuguagcuga

SEQ ID NO: 53587 - RNA, 64 nt, Human
gaacucacacuggauaaacccacuccacaugugcuggggacauaggaagaccuuaagccauagc

SEQ ID NO: 53588 - RNA, 64 nt, Human
agggaggcccuuuggcugugauuucauuugcacguggggacaggauuugccaguucacccacag

SEQ ID NO: 53589 - RNA, 64 nt, Human
aagcacagauagcucagcugcgaccucuggccucuggggacauaaacggggcggcugggccagg

SEQ ID NO: 53590 - RNA, 64 nt, Human
cgugaacugcccccagggaacacugggcgaugccuggggacauugugguugucacgaugggggg

SEQ ID NO: 53591 - RNA, 64 nt, Human
cucagugcaggacaucuggccugaacaucgacuguggggacagcccucgcccugccaagcacug

SEQ ID NO: 53592 - RNA, 64 nt, Human
guggggaugcgcccaagcccccgagggagaggccuggggacaccaacaaaucuaagcccucccu

SEQ ID NO: 53593 - RNA, 64 nt, Human
agggauugggccacccuacccaggaucuccacccuggggacaguagaaggggaaagccuucauc

SEQ ID NO: 53594 - RNA, 64 nt, Human
aucugccguggucagauccauuucaaaugaaauguggggacauagaucuuuuuuuuuuuuuuuu

SEQ ID NO: 53595 - RNA, 64 nt, Human
caggucuggaggggccauggggaaguccuggguguggggacacagucggguugacccagggcug

SEQ ID NO: 53596 - RNA, 64 nt, Human
agaaccagcucugaguccugaggagacacaggccuggggacagggagggaugggagucccugcu

SEQ ID NO: 53597 - RNA, 64 nt, Human
uaggagauuccuuuccccuguagggguagagggguggggacagaaacaacuuucuccuacucuu

SEQ ID NO: 53598 - RNA, 64 nt, Human
agccuugggaggucugggaagggcuggaaaucacuggggacaggaaaccacuuccuuuugccaa

SEQ ID NO: 53599 - RNA, 64 nt, Human
agagguuuauguagggcacugugcuggguggggcuggggacacaacaaugacugaggcagccug

SEQ ID NO: 53600 - RNA, 64 nt, Human
gaaaggacagaucacuccggaguaucagggauuguggggacaggagugagacaaccccccaggu

SEQ ID NO: 53601 - RNA, 64 nt, Human
cccagcucaagccagaagcugacuuuggccgccauggggacaucaggcaaggucuggagacauu

SEQ ID NO: 53602 - RNA, 64 nt, Human
uuugacgauaguccaccggccacccaggccugucuggggacauguaggaugggcucuuacccca

SEQ ID NO: 53603 - RNA, 64 nt, Human
aaaacuaaaaaccaaggcaccuuaccagucugucuggggacaggaucccugcugcaccuucccc

SEQ ID NO: 53604 - RNA, 64 nt, Human
guggccaccuggaaagucccaggugggacucuucuggggacacuugggguccacaaucccaggu

SEQ ID NO: 53605 - RNA, 64 nt, Human
agccccgggggagauaaggucaugggagaguggguggggacacacccagagacuggcuuuggga

SEQ ID NO: 53606 - RNA, 59 nt, Human
auuccuuauacucucucugaaggcaaagauggggacaaggacuaagagucagaauguug

SEQ ID NO: 53607 - RNA, 64 nt, Human
uccaccccacaccugaguucuugccuccuccuuuuggggacacccaaaacacugcuugugagaa

SEQ ID NO: 53608 - RNA, 64 nt, Human
uguccaguccucuucuucccucugcuggaaccuuuggggacacucaaggguacaguuugacacu

SEQ ID NO: 53609 - RNA, 64 nt, Human
uucucaccacaucucuugcaugacuucaugguacuggggacaaguuuguaugccuucaccccag

SEQ ID NO: 53610 - RNA, 64 nt, Human
uagucucugaccccuccaaggaaagaccaccuucuggggacaugggcuggagggcaggaccuag

SEQ ID NO: 53611 - RNA, 64 nt, Human
ggccugaggagcugggcgggcagggagagggucuuggggacagcccuccugggaaucuacauug

SEQ ID NO: 53612 - RNA, 64 nt, Human
uuuguuuguuugcuuggguucuugcaagagcgcguggggacaguucuuccagcaggcacugguu

SEQ ID NO: 53613 - RNA, 64 nt, Human
cacaaaacagugccuucuagagccgggcugggaauggggacacgguguccaccauccccagcug

SEQ ID NO: 53614 - RNA, 64 nt, Human
aauguaagcacucuauucuccaaguugugcuuuguggggacaaucauucuuugaacauuagaga

SEQ ID NO: 53615 - RNA, 64 nt, Human
gacccugggcugaucaugugcauuccugcuucucuggggacacagugggcccacaugggccagc

SEQ ID NO: 53616 - RNA, 64 nt, Human
ccaugugccaagaggguggcgcacccccacuccauggggacagaagcuccagcauuugcccagg

SEQ ID NO: 53617 - RNA, 64 nt, Human
uuugugaucacacaccacagggagaaucugcauguggggacacuguggagcucugcccagauga

SEQ ID NO: 53618 - RNA, 64 nt, Human
accaagaugaacauaaugucaaaggacgaaaucauggggacaauuuggauuuuguuccaaaaga

SEQ ID NO: 53619 - RNA, 64 nt, Human
ccuguagagcugacaggugggucacacucagaccuggggacagaggugaaaugcacaagcugcu

SEQ ID NO: 53620 - RNA, 64 nt, Human
agcuccaggggcccuugggacagccagagcuggguggggacagugauaggcccaagguccccuc

SEQ ID NO: 53621 - RNA, 64 nt, Human
uguuuuuuuucuguuguuuuuuuuuggcuggugcuggggacaagccugugccugccaaagcucc

SEQ ID NO: 53622 - RNA, 64 nt, Human
gccgguccccacacucuugcuccuccugggcaucuggggacaggaacaccucucaggguggcca

SEQ ID NO: 53623 - RNA, 64 nt, Human
ugugggcuuuguucccagauaagaucacuccuucuggggacaagauggucacuaguagauccag

SEQ ID NO: 53624 - RNA, 64 nt, Human
ggcccugcucugggaccugccccucacguucucuuggggacacccgagccaggacacuacgcau

SEQ ID NO: 53625 - RNA, 64 nt, Human
ccgcccugcagcauguacaccgagugucugcagcuggggacacaacugcccgggacucuaacuu

SEQ ID NO: 53626 - RNA, 64 nt, Human
gucuuccuccaaccccucuauguagugccgcucuuggggacaugggucgcccaugagagcgcag

SEQ ID NO: 53627 - RNA, 64 nt, Human
cuccagccagaccuucagugguccugccuggccguggggacaucagagagugucaucacgcagc

SEQ ID NO: 53628 - RNA, 64 nt, Human
ugucagugcucggcuguaaacagcucuguguuucuggggacaccagccaucaugugccuggaaa

SEQ ID NO: 53629 - RNA, 64 nt, Human
aaaaugagguguguagaacagggucccacagguuuggggacauugagaucacuugucuuguggu

SEQ ID NO: 53630 - RNA, 64 nt, Human
gacagcaguuugagcuugcuggagaguggcaucauggggacaaaaggaaaccucugacuugcua

SEQ ID NO: 53631 - RNA, 64 nt, Human
aauguccccagaggaugccagauguccccugggguggggacacaaucaccccagguugagaucc

SEQ ID NO: 53632 - RNA, 64 nt, Human
guggaggugggcaugugggccccugggcccaggcuggggacagagcccuuguuuugugacuuag

SEQ ID NO: 53633 - RNA, 64 nt, Human
gaugugaaucugggggccaggcuggaggcagggauggggacaggguggguggcuuagacucuug

SEQ ID NO: 53634 - RNA, 64 nt, Human
cggaugaccagaggccccuugaaaaggagggguuuggggacagggacuguguccaugaaacauu

SEQ ID NO: 53635 - RNA, 64 nt, Human
agcccccaggcccucccgcaucucagguuggggauggggacauggagaggaaggggccgccuac

SEQ ID NO: 53636 - RNA, 64 nt, Human
cggggcccccgccgccccuccggacccgcagagcuggggacauggcaugcccugcacucaguca

SEQ ID NO: 53637 - RNA, 64 nt, Human
gauauguuuguauacacauuugcauauacccacauggggacauaagcuaauuuuuuuacaggac

SEQ ID NO: 53638 - RNA, 64 nt, Human
ccugacagagcacuacagcaucaaaguaaaucuuuggggacaguguagcccaucugcauccuau

SEQ ID NO: 53639 - RNA, 64 nt, Human
agggccuguucugccccagcuguuccuccuccccuggggacagccccaccuccgggucccucca

SEQ ID NO: 53640 - RNA, 64 nt, Human
cuuuucgaaaugccccucugagucaggagccugguggggacaagauggaggauguccacagagg

SEQ ID NO: 53641 - RNA, 64 nt, Human
gaguuccugagccccacaacaaggccagggaugguggggacaggccucacuagucuugaggccc

SEQ ID NO: 53642 - RNA, 64 nt, Human; identical to SEQ ID NO: 53641

SEQ ID NO: 53643 - RNA, 64 nt, Human
guuggcagcgccucgccccagccaagccugacuuuggggacacccuccugcccccccaccccac

SEQ ID NO: 53644 - RNA, 64 nt, Human
gaccuuccccucauccuaggcccaggacccauuauggggacaggagcugaagggcucccagggc

SEQ ID NO: 53645 - RNA, 64 nt, Human
caaaguagaauuuucucacugcguugggcauugguggggacaaccaaaacaggucugcagagca

SEQ ID NO: 53646 - RNA, 64 nt, Human
cugcccucccagauccuguguccauucugaagaauggggacaccucccuauuacagaugagaac

SEQ ID NO: 53647 - RNA, 64 nt, Human
cgaugaucuaaaccaaccacuuggaaaaacccaauggggacauuguaaccagaggguccuggag

SEQ ID NO: 53648 - RNA, 64 nt, Human
uucucagccugguacuuguaccuccggugucguguggggacauccccuucugcaauccucccua

SEQ ID NO: 53649 - RNA, 64 nt, Human
cucugggaguugggguaccacccccagggcaggauggggacaggaucaccugcccgggacacca

SEQ ID NO: 53650 - RNA, 64 nt, Human
ggaaggucccucugaggcagaagcucaagccccauggggacaguggcuccccagugccuggccc

SEQ ID NO: 53651 - RNA, 64 nt, Human
agcacagagccaggucaugucaugccccaaaguguggggacagagccucagggagccccgagca

SEQ ID NO: 53652 - RNA, 64 nt, Human
cccaggcugggucugccgcugggcccuggggcgguggggacagauguugacacaaauuauuuau

SEQ ID NO: 53653 - RNA, 64 nt, Human
cugugcugagcaaggcccugcagugcagccugcauggggacaccccgcacgccuccaaccucuc

SEQ ID NO: 53654 - RNA, 64 nt, Human
ugauauguuauuaucccaaugaaagaucaugcauuggggacagcagaaacaaaagcuuuuuugg

SEQ ID NO: 53655 - RNA, 64 nt, Human
aguuaauuuuagguuauguuuuauauuaggcuacuggggacauaaacggucauaacuaaugacu

SEQ ID NO: 53656 - RNA, 64 nt, Human
uggggguagcggcaugcagacccucagaccagaauggggacaucuuguggucugcugccucagg

SEQ ID NO: 53657 - RNA, 64 nt, Human
ucaguguccagugccuguuccuaaacuugcuuguuggggacacacucauaacuauuucaccuga

SEQ ID NO: 53658 - RNA, 63 nt, Human
ucuggagcaggcccagcugaaccaauggaggccuggggacaucuggcauggucaccccugcac

SEQ ID NO: 53659 - RNA, 64 nt, Human
ucccucuaagaauugcuguggguaauaccaggaguggggacauugcccacaugcauaagagcgu

SEQ ID NO: 53660 - RNA, 64 nt, Human
ccauauguaaaugguuuuuauaaauuucucaauuuggggacaagauuuuuuuguggucuaaauu

SEQ ID NO: 53661 - RNA, 64 nt, Human
ccugggucagcagccaggaggcgguccauaagaauggggacagugggcucugccagggcugccg

SEQ ID NO: 53662 - RNA, 64 nt, Human
ugggagcuacauacacuucaagaugagauuuggguggggacacagccaaaccauaacaguuugc

SEQ ID NO: 53663 - RNA, 64 nt, Human
aauguuccacaccaucgacaaccaaggggugagguggggacaggccucagcagggaauggggcg

SEQ ID NO: 53664 - RNA, 64 nt, Human
auuuggucaggcacuaggaguggagcaugagcucuggggacagacaguuauggguucugguccc

SEQ ID NO: 53665 - RNA, 64 nt, Human
ccugccaacaggccuugcggcaccuuuggaucucuggggacacagccuucgacagggacaucuu

SEQ ID NO: 53666 - RNA, 64 nt, Human
aaagaaauacauaaaggggaaaaaaguuucacaauggggacaauuagcauaacuaaacaaagau

SEQ ID NO: 53667 - RNA, 64 nt, Human
ucaauucaguuucucaaauuaucuucccuucucuuggggacaacaucugaaggguauguugcau

SEQ ID NO: 53668 - RNA, 64 nt, Human
cuggggagcuccagccaggcagcgaguccugccccgcccgcagcucccucccacaccccgccug

SEQ ID NO: 53669 - RNA, 64 nt, Human
uucugacgaauccuuugccccuucaccuuuaccccgcccgcaccccuaggcccucucagccuuc

SEQ ID NO: 53670 - RNA, 56 nt, Human
acaccgucugcuucuacugagcccagcgcccgcauggagccgccucuggagcuucc

SEQ ID NO: 53671 - RNA, 64 nt, Human
ugccagccccggaguucagccucccgagcugcggcgcccgcagcggaggagguuuucaguggcu

SEQ ID NO: 53672 - RNA, 64 nt, Human
ggccccugcccacucaccugcccgccugcccgcccgcccgcauagcacuugcagaccugccuga

SEQ ID NO: 53673 - RNA, 64 nt, Human
aaggugcuuuguaauauucuccccacccaccccacgcccgcacccccgcacccuuaagaaggua

SEQ ID NO: 53674 - RNA, 64 nt, Human
accacuagacggggcggucgggugccugcggccucgcccgcacgccuagagucucgcccgaucc

SEQ ID NO: 53675 - RNA, 64 nt, Human
cccaaaucgugacaaucaaaaaugccugcagacacgcccgcauuucuccagggcggggugggaa

SEQ ID NO: 53676 - RNA, 64 nt, Human
ucccugcggacgcccccgcuccucggcuccagagcgcccgcauucccgggagaggcgguguggg

SEQ ID NO: 53677 - RNA, 64 nt, Human
gccaaguagcuaggacuacaggcguucaccacugcgcccgcaaaguuuuuuuguuguuuuuuuu

SEQ ID NO: 53678 - RNA, 64 nt, Human
cugacaagaaagcgccuuacguuucuccgccccccgcccgcaccccccgggccgggcgccugua

SEQ ID NO: 53679 - RNA, 64 nt, Human
cuaacaauccuagacugagacgcagucaggcgcacgcccgcaagaggcggcgaggugacaaguu

SEQ ID NO: 53680 - RNA, 64 nt, Human
ucagguguuuccguaccacagcaggagcagggcccgcccgcaucccagcugugggccugccggu

SEQ ID NO: 53681 - RNA, 64 nt, Human
agaaggaguuccacuucaacaaguaccugacgcgcgcccgcaggguggagaucgcugcaucccu

SEQ ID NO: 53682 - RNA, 51 nt, Human
ugcucuggcccagccgcugagcgcccgcacccgccgcaccccgaggccgcc

SEQ ID NO: 53683 - RNA, 64 nt, Human
cgccccggccggcggcuucucccggaggccccggcgcccgcacccacccggcccggccccgaga

SEQ ID NO: 53684 - RNA, 64 nt, Human
auguucaaacagauucaggcaccacccccuccaccgcccgcaagguuagggcauagaguugucu

SEQ ID NO: 53685 - RNA, 64 nt, Human
uacucagcagggccccccgcccggcccgcgcucccgcccgcacugcccuccccccgcagcaggg

SEQ ID NO: 53686 - RNA, 64 nt, Human
ccacugcccaccgccuccagcagccaugcaugugcgcccgcagcccugccuccacagcucgcca

SEQ ID NO: 53687 - RNA, 64 nt, Human
uaggcuuuuauauggauuauguuuugcugacccacgcccgcauuuucagauuuuguaucuaaca

SEQ ID NO: 53688 - RNA, 64 nt, Human
gguguccugaccccuccgcugcccucggccccgccgcccgcagccaggcccguuauaaauguau

SEQ ID NO: 53689 - RNA, 64 nt, Human
uccugggccucggcccuucccgcaccgccgccagcgcccgcagacacccuggcaucucaagagg

SEQ ID NO: 53690 - RNA, 64 nt, Human
ucgcuucucccgugugucgccgccgugcgucgugcgcccgcaacagagccccaaccgggccuuu

SEQ ID NO: 53691 - RNA, 64 nt, Human
gacgcggaccacggcccgggagcuagaaacugaacgcccgcauaauaaagacuggaacccucgu

SEQ ID NO: 53692 - RNA, 64 nt, Human
cuuauucucucuuuguccucucuccccuccugcccgcccgcacccuggaauugccacucaguuc

SEQ ID NO: 53693 - RNA, 64 nt, Human
gacaggcggggcccagcgcucuccuggacgcccccgcccgcacagcucccggcgggugcucuga

SEQ ID NO: 53694 - RNA, 64 nt, Human
aguaggcuucagcugggacugccagggccgcggccgcccgcacguccgcgggucccggccgcgc

SEQ ID NO: 53695 - RNA, 64 nt, Human
ucugcuggucugugcuggucucagaaggccaccgcgcccgcauuccacucagccaggguccagc

SEQ ID NO: 53696 - RNA, 64 nt, Human
cagccacgcagacaggucgauuugcccaggcccgcgcccgcacgcacgcacgcacacggccccg

SEQ ID NO: 53697 - RNA, 64 nt, Human
gagcccucacccuucuugucuuccuucccggcagcgcccgcagcgggccauuuacacgucgagg

SEQ ID NO: 53698 - RNA, 64 nt, Human
ccccuuggucagcgcaggccacggcccgagggggcgcccgcaguggacaggacccgcguggguu

SEQ ID NO: 53699 - RNA, 64 nt, Human
gucagcucacguggccuuuaaaaaccuacuuccccgcccgcaggagcucagagcaucgcugggc

SEQ ID NO: 53700 - RNA, 64 nt, Human
aauauccugaaauucaugggcuuccucgggggcccgcccgcagguggugcuggguggguuccgc

SEQ ID NO: 53701 - RNA, 64 nt, Human
uaaccaccacgugccagagccgcccacccggagccgcccgcaugcagcuucaccuccccuuucc

SEQ ID NO: 53702 - RNA, 64 nt, Human
ggaggccuccagagucagcuggaccuugcugugucgcccgcaggcagcccugcagacaccggug

SEQ ID NO: 53703 - RNA, 64 nt, Human
gccagccgcagccaaguaggagggggcugggccgcgcccgcaccccgggagccuccucaggcuc

SEQ ID NO: 53704 - RNA, 64 nt, Human
gguccgggagcugauggccccucucucccggcuccgcccgcagacucuggcuccuccgacuaca

SEQ ID NO: 53705 - RNA, 64 nt, Human
cccagcgggacaucaggagcauccaggaggcucucgcccgcaacgcuggccgguacgugugggg

SEQ ID NO: 53706 - RNA, 64 nt, Human
acucgcucuccacgcgccccgggcccccuaccugcgcccgcagcgcccucgcccagccccggcu

SEQ ID NO: 53707 - RNA, 64 nt, Human
acugcgccugcgcggcaagaaugucuagccugcccgcccgcauggccagccaguggcaagcugc

SEQ ID NO: 53708 - RNA, 64 nt, Human
ggacaccagcccugcguggacguggccugugcuucgcccgcacugcgcgcauccccaaccucug

SEQ ID NO: 53709 - RNA, 64 nt, Human
gccccgacgcggcuccuggauccgcuccugccugcgcccgcagcugaccuucuccugccacuag

SEQ ID NO: 53710 - RNA, 64 nt, Human
caggagaagcauuuuaaagaaacccccacccugccgcccgcauuauaaacacaggagaauaauc

SEQ ID NO: 53711 - RNA, 64 nt, Human
ggcuuggcgaguccuugcagagcugacauagaggcgcccgcaugucacuuagucuaacgcugac

SEQ ID NO: 53712 - RNA, 64 nt, Human
ugcuggcuggcgaggaggcugcgagcguggaaucggaagcgaccgcgggcuuuuuugcccuucu

SEQ ID NO: 53713 - RNA, 64 nt, Human
ccucaggcuuccuuggcaucacagggcagagccgggaagcgaugaauuuggagacucugugggg

SEQ ID NO: 53714 - RNA, 64 nt, Human
cugaggagugaacugaaauaggacaaccgaaucaggaagcgaagccccaggagcugcagccauc

SEQ ID NO: 53715 - RNA, 64 nt, Human
auaauuuuccugucucugccucugggagggaacaggaagcgaugaagaggucuuggaacaguag

SEQ ID NO: 53716 - RNA, 64 nt, Human
guaaacagcuccucauggucaaugaacauguucaggaagcgaucaccuugaugcuugaacccaa

SEQ ID NO: 53717 - RNA, 64 nt, Human
gcuuucuccaguuuucuguuaauggcgaaagaauggaagcgaauaaaguuuuacugauuuuuga

SEQ ID NO: 53718 - RNA, 64 nt, Human
ugccucuacuugggagcgggaagaggagaugacaggaagcgacgccucuggcagggcccuugcu

SEQ ID NO: 53719 - RNA, 64 nt, Human
uuguugucuauuaucuguagguggaagaaauuuaggaagcgaaauauuacaguagugcauuggu

SEQ ID NO: 53720 - RNA, 64 nt, Human
caacaaaggcucaucaaacagguaaagucucgaaggaagcgagaacgaaaucucucauugugug

SEQ ID NO: 53721 - RNA, 64 nt, Human
guauaugaaugcuccuaauauggucaggaagcaaggaagcgaaggauauauuaugaguuuuaag

SEQ ID NO: 53722 - RNA, 64 nt, Human
auacaacuugaauguaauuaaagugcuguuuuuuggaagcgauaaacuuuaaauauacuuauua

SEQ ID NO: 53723 - RNA, 64 nt, Human
ugggauugggagaaauaaaacaugcaauuuaaguggaagcgaagaaauuuaaagaggauuuuau

SEQ ID NO: 53724 - RNA, 64 nt, Human
aguugguuguggggcuggagagagguuguggggaggaagcgaggaugcgugccugccacuaggc

SEQ ID NO: 53725 - RNA, 64 nt, Human
auucauugaaaagcaugauagcaauguggcauguggaagcgaacccccagggcauaacauagua

SEQ ID NO: 53726 - RNA, 64 nt, Human
uauaaauggguaccuguaauaauacugagcucuuggaagcgaaucaugcaugcaauuagcuccc

SEQ ID NO: 53727 - RNA, 64 nt, Human
augugaauuuguucuuacauuauggcucccgaggggaagcgauuacuuuuuuuaauuuuaaauu

SEQ ID NO: 53728 - RNA, 64 nt, Human
caucauccugaccuucaucucugggcuuguuccgggaagcgaaaagaccaagaucaaauaauag

SEQ ID NO: 53729 - RNA, 64 nt, Human
gaggcugugucucuggacagacggauagacauacggaagcgaggccuggaccaagagaggccca

SEQ ID NO: 53730 - RNA, 64 nt, Human
cagcacguggagagcuucaauugucagauaaacaggaagcgacagaugaccgcuuucuaacgcu

SEQ ID NO: 53731 - RNA, 64 nt, Human
cacugagccauguuccuaugucagguggcagcggggaagcgaggguccaauccugcccugcgcu

SEQ ID NO: 53732 - RNA, 64 nt, Human
cuugggaaaugaggggagguggaggcagggcaggggaagcgaagagucagccuuggagagagca

SEQ ID NO: 53733 - RNA, 64 nt, Human
cugauguuucuucugaggggaauggggagagagaggaagcgacugagcccuuuggaaguauaau

SEQ ID NO: 53734 - RNA, 64 nt, Human
guucuacucaggcugguggagaacucuggcuuuuggaagcgagaguaaaaagcuaaugacgagg

SEQ ID NO: 53735 - RNA, 64 nt, Human
ggagagaguuagcauguaugaauguaaggaugagggaagcgaagcaagaggaaccucucgccau

SEQ ID NO: 53736 - RNA, 64 nt, Human
acuguuccguaugaggaaacagacagcggacugaggaagcgauggccccagagaaagggccccu

SEQ ID NO: 53737 - RNA, 64 nt, Human
uaaccuaauaaaguugaugagagagaaggggagaggaagcgaacauaaagcgggucaaguguag

SEQ ID NO: 53738 - RNA, 64 nt, Human
uggugacggguguagacguugcaaacaaaucuugggaagcgaggagggccggggaggacacuuc

SEQ ID NO: 53739 - RNA, 64 nt, Human
ccagcugguucgagcggugaagccgcgcuccccuggaagcgacccaggggaggccaaguuguca

SEQ ID NO: 53740 - RNA, 64 nt, Human
uuccucaagauggacccgguaaauauaaccacaaggaagcgaaacugggugcguucacugaguu

SEQ ID NO: 53741 - RNA, 64 nt, Human
uguaaaaagcaaaaucucucuguccuaaacuaauggaagcgauucucccaugcucauguguaau

SEQ ID NO: 53742 - RNA, 64 nt, Human
uugugggucuuucuguucccaagauccugaacauggaagcgauggcagggcauagacucaggca

SEQ ID NO: 53743 - RNA, 64 nt, Human
agugaccagucacugacccugugcagaaccuccuggaagcgagcuuugcugggagaggggguag

SEQ ID NO: 53744 - RNA, 64 nt, Human
gugacggagcaggcgggcugaggagaguggaaaaggaagcgacccagaaauggcagggacacuu

SEQ ID NO: 53745 - RNA, 64 nt, Human
ccugccucuccauuauuuauuugcucugcucucaggaagcgacgugaccccugccccagcugga

SEQ ID NO: 53746 - RNA, 64 nt, Human
cacugccaacucaggcacaugcuuagcuguaaagggaagcgaggugaagucguccugcagcgua

SEQ ID NO: 53747 - RNA, 64 nt, Human
ccaaaccauugauguucuguuauguacuguaaugggaagcgauucugauuuuguuuuauauggg

SEQ ID NO: 53748 - RNA, 64 nt, Human
acagugaucugauugaaaaaaaacgacagucuggggaagcgaucacaucuggugaccaggcugc

SEQ ID NO: 53749 - RNA, 64 nt, Human
gggugaggggacgagaugggguucaugugaaggaggaagcgaugccgagguaggaaaggccagc

SEQ ID NO: 53750 - RNA, 64 nt, Human
agaaguccauauuguuccuuaucaccugccaacaggaagcgaaaggggauggagugagcccaug

SEQ ID NO: 53751 - RNA, 64 nt, Human
ggccugccccagcucucuucuggcuuucugagcaggaagcgagcagaggcuccacaggcuuacg

SEQ ID NO: 53752 - RNA, 64 nt, Human
ugaagcacgugguacucugaagcacuugaaaaugggaagcgaugacaaaucugacuuuaaaaaa

SEQ ID NO: 53753 - RNA, 64 nt, Human
cagcgcaauugucagcuaaaccuccugcaaaaguggaagcgaagccgaaaaaggcagcagcgaa

SEQ ID NO: 53754 - RNA, 64 nt, Human
gccugccuggcucugucugaacagaaggucugggggaagcgacggguggaguacaauaaaggga

SEQ ID NO: 53755 - RNA, 64 nt, Human
ugucucuuucccccgcuaugucauagguaguggaggaagcgaaggaagugaacgcugaauguga

SEQ ID NO: 53756 - RNA, 64 nt, Human
ugggggggaggcauagagggcccugggggucaugggaagcgagcacgcagcaggcgugcccagg

SEQ ID NO: 53757 - RNA, 64 nt, Human
cuccaccaggaggcugguucacguccccuaccacggaagcgaggucccagaaggccagcggugg

SEQ ID NO: 53758 - RNA, 64 nt, Human
uguaaauaccagaauuuauaguagaaauauaugaggaagcgacacuucgaauauucuacuaaau

SEQ ID NO: 53759 - RNA, 64 nt, Human
caaguuccacacacgcuauggaaugguuaugaagggaagcgagaagggggccuaggguggucug

SEQ ID NO: 53760 - RNA, 64 nt, Human
acuuuggggagagcuggagaacaggauucuaggcggaagcgauagcauaggcaaaggcccuugg

SEQ ID NO: 53761 - RNA, 64 nt, Human
gcauuggcaggaggagagcaccaggacgaggaugggaagcgaccuccagauuuaucaaaugguc

SEQ ID NO: 53762 - RNA, 64 nt, Human
cucccugcgugcucagagggucuguccagcccugggaagcgaccuuggccucaguucacagccu

SEQ ID NO: 53763 - RNA, 64 nt, Human
gcggggcagcccuggcccuaggcuuccuaacccuggaagcgagaggaugagaggaggccggccc

SEQ ID NO: 53764 - RNA, 64 nt, Human
gagagaacaaugcaccauugaaugcuggagccuuggaagcgaaucugaugguccuaggagguuc

SEQ ID NO: 53765 - RNA, 64 nt, Human
cauuccuccaaguccaagcacagccaugcugaguggaagcgaggccaccaucugaguggauugg

SEQ ID NO: 53766 - RNA, 64 nt, Human
ggccccugggggcagaccggugauccuuaccaguggaagcgagccaucgagccauuggcagaaa

SEQ ID NO: 53767 - RNA, 64 nt, Human
gacucaaggccacggcucuacuaaaagagagagaggaagcgagagagagagagaaaaaacaaaa

SEQ ID NO: 53768 - RNA, 64 nt, Human
guuuugaaagcuugauuuuguagcuuuggaagcuggaagcgaugguguuuggugccgaguccug

SEQ ID NO: 53769 - RNA, 64 nt, Human
gaauauacugguggacugaauguagguugagagaggaagcgagaaguuaaggaugccuucaaaa

SEQ ID NO: 53770 - RNA, 64 nt, Human
cgcguucuggcgacaggggagccaggggccgcggggaagcgaggacuggccugcgcugggcucg

SEQ ID NO: 53771 - RNA, 64 nt, Human
cugggcuaggugagcugccucugccccugggcaaggaagcgaggcccucugggaggagggugcu

SEQ ID NO: 53772 - RNA, 64 nt, Human
auguaugagggacacucuccaaguugauaacaauggaagcgaguuuaauauaaaacaauucccu

SEQ ID NO: 53773 - RNA, 55 nt, Human
caucuugccaugaucucugacuggaggaagcgaggaggcggccggccgcacuggg

SEQ ID NO: 53774 - RNA, 64 nt, Human
gagcagauccggaagaacuuugcucggacacacuggaagcgagccuucaaugccaccucguucc

SEQ ID NO: 53775 - RNA, 61 nt, Human
ucccugcguguggccacuccucagcauccuccccacccaccaugguucauuccgacuuuuc

SEQ ID NO: 53776 - RNA, 61 nt, Human
gccacguggccuucagaggaauccacagguccccacccaagaucccucaauuauaugggga

SEQ ID NO: 53777 - RNA, 61 nt, Human
aggcacugguuaggaaggauguucaaacggucccacccaagccugucaccucugcucaucc

SEQ ID NO: 53778 - RNA, 61 nt, Human
augccuaccaagcucgagcuggcccuugacccccacccacccccacccuugcuggcagggg

SEQ ID NO: 53779 - RNA, 61 nt, Human
uggaggccaaauguggcaaaccaaccccaggcccacccagagcgagcaaacgcugagaccu

SEQ ID NO: 53780 - RNA, 61 nt, Human
guuggugcgugauaugguuaagcuuuguguccccacccacaucucaucuugaaugguaauc

SEQ ID NO: 53781 - RNA, 61 nt, Human
gagguggguccuuauuucaagccauauucaacccacccaacaaaaccuaacauugaggugg

SEQ ID NO: 53782 - RNA, 61 nt, Human
guucugcgaggggcucaugggucugagagcccccacccacuaggcuugauugcaucccugu

SEQ ID NO: 53783 - RNA, 61 nt, Human
ugccuggaguccuugaccgcucucugugggccccacccacucuguccugggaaaugaagaa

SEQ ID NO: 53784 - RNA, 61 nt, Human
gucauuggccgacaucacaguuuuccuguuucccacccagcuaaaaaccguuguuugcuuu

SEQ ID NO: 53785 - RNA, 61 nt, Human
ugggauuucaaaacacaaaugaaaacucacacccacccacccccaagugcaugucuccauc

SEQ ID NO: 53786 - RNA, 61 nt, Human
acaggggaggacccuucuuuuggacagcccccccacccagagcccggucccuugggggccu

SEQ ID NO: 53787 - RNA, 61 nt, Human
agaaugcaccucauucuucccuggccucuuucccacccacagcccccagaggcucuagauc

SEQ ID NO: 53788 - RNA, 57 nt, Human
gguggaacauggugcccugagacagcucccacccaccauccugucccccuggggcgg

SEQ ID NO: 53789 - RNA, 61 nt, Human
aaucacaccuacucugugguaagaauaaaaucccacccaccugggacuugguaauuucucc

SEQ ID NO: 53790 - RNA, 61 nt, Human
caucugccugagccagggaaggacccccucccccacccaccucucuggcuuccaugcuccg

SEQ ID NO: 53791 - RNA, 61 nt, Human
cccuggcagaggguggggcacugcaccuuaccccacccauccaugccagcacuucugcacu

SEQ ID NO: 53792 - RNA, 61 nt, Human
ggaaguuaccagccugugagauccaagcccccccacccaggcccccuaaaaaucagggccu

SEQ ID NO: 53793 - RNA, 61 nt, Human
auuuccuccaagccacaugaggacucuggcacccacccacaaagcaagaccuguauuuaua

SEQ ID NO: 53794 - RNA, 61 nt, Human
gguuuaggucuggcaauuguccuugaaaaaucccacccauguuguaccaccuuggugaguc

SEQ ID NO: 53795 - RNA, 61 nt, Human
gccuaugcacauauggacucugcacaugaaucccacccacaugugacacauaugcaccuug

SEQ ID NO: 53796 - RNA, 61 nt, Human
uggccuccuugcugucuuuauugaagagcugcccacccagagucuugacucuagggcaggc

SEQ ID NO: 53797 - RNA, 61 nt, Human
gguuggucugccccucagucaggcccccuuacccacccaccagccccaaggcccgaccccu

SEQ ID NO: 53798 - RNA, 61 nt, Human
gccaucuauaaggauugugccaguuuacagucccacccacaaugcaugagagugccuauua

SEQ ID NO: 53799 - RNA, 61 nt, Human
cucccugugucccgcugugauucuauuuccucccacccacuccucaaauccugucauuauu

SEQ ID NO: 53800 - RNA, 61 nt, Human
uggcaaauagaaguauaucaagcaauaaucucccacccaaggcuucuguaaacugggacca

SEQ ID NO: 53801 - RNA, 61 nt, Human
ggccaacaacugucccuccuugagcaccagccccacccaagcaagcagacauuuaucuuuu

SEQ ID NO: 53802 - RNA, 61 nt, Human
uuuguuaggcugugucucccuaagcccuugccccacccagaguuucccguccccuucacug

SEQ ID NO: 53803 - RNA, 61 nt, Human
ggucccugccucuggggcuuuucugaagaaacccacccacugugaucaauagggagagaaa

SEQ ID NO: 53804 - RNA, 61 nt, Human
agagggucagauggggggaaccccacccugccccacccaucugaacacucauuacacuaaa

SEQ ID NO: 53805 - RNA, 61 nt, Human
cuagccccacucccugccuccugaaaugguucccacccagaacuaauuuauuuuuuauuaa

SEQ ID NO: 53806 - RNA, 61 nt, Human
cgcagggccgccccucccgcuugcuccccagcccacccaccccccuguacagaaugucugc

SEQ ID NO: 53807 - RNA, 61 nt, Human
aaaccccauggagcagccagcguuagaugcccccacccaccuguacucuggagagacugug

SEQ ID NO: 53808 - RNA, 61 nt, Human
uaaggcaaaauaaucuaaaaagacuaaccugcccacccacuccuuauauugcugugagauu

SEQ ID NO: 53809 - RNA, 61 nt, Human
auguacuccaggcuucuucagauagguucagcccacccacccccaugauuguaugaaguuu

SEQ ID NO: 53810 - RNA, 61 nt, Human
ucuccgcuccacccccugccaacuacucagucccacccaacuuguaaaccaauaccaaaau

SEQ ID NO: 53811 - RNA, 61 nt, Human
ugaaaaauuaauccucaguuccacgagacugcccacccacagacaaaaaaauauauauauu

SEQ ID NO: 53812 - RNA, 61 nt, Human
agguugagaagacuccugggcuucagccucucccacccagcccugccccucaccugccugc

SEQ ID NO: 53813 - RNA, 55 nt, Human
cuaucuacucucuggccuaacggagcccacccaggcacagccaccacuuugcaag

SEQ ID NO: 53814 - RNA, 61 nt, Human
ccugccacagccaaacccccacugcacccuacccacccaccccuagcccaggucagcuuuc

SEQ ID NO: 53815 - RNA, 61 nt, Human
ccauacugagccugccaaagugccugggaagcccacccagauucugaaacaggcccucugu

SEQ ID NO: 53816 - RNA, 61 nt, Human
acaaagcagauccucaauaaacauuucauuucccacccacacucgccagcucaccccauca

SEQ ID NO: 53817 - RNA, 61 nt, Human
aaauagguuuauguguacugguuugcauguacccacccaaaaugauuauuuuuguagaauc

SEQ ID NO: 53818 - RNA, 61 nt, Human
aggggcaggugggccucucuaggaucagugucccacccagaggccaguggccccuucacau

SEQ ID NO: 53819 - RNA, 61 nt, Human
aaccaucuucccacauguggguuguuggaaucccacccacucccccggacccugccccucc

SEQ ID NO: 53820 - RNA, 61 nt, Human
gcucucgcuuaacuuccuaggggcugcugagcccacccagagguuguuggaguucagcggg

SEQ ID NO: 53821 - RNA, 61 nt, Human
gcggggggccccaagcugcgccggccuccagcccacccacagcuguugcugaagucaggcc

SEQ ID NO: 53822 - RNA, 61 nt, Human
gacuaauuuucccuuacaguuccugcuuggucccacccacugaaguagcucaucguagugc

SEQ ID NO: 53823 - RNA, 61 nt, Human
cacucuucauccuggaagugggaacuggagucccacccacagugcauucagaaagcaugcu

SEQ ID NO: 53824 - RNA, 61 nt, Human
acauaaaccacgagagugacagucaucuuugcccacccaguguaaugucacugcucaaauu

SEQ ID NO: 53825 - RNA, 61 nt, Human
ugcagggaagagggcaguaccugggaaaggacccacccaucuuccugcugcuguaacugcu

SEQ ID NO: 53826 - RNA, 61 nt, Human
auccuagaggccaggcaggagcccuucuauacccacccagaaugagacauccagcagauuu

SEQ ID NO: 53827 - RNA, 61 nt, Human
gcugcccccugccuccccacccuccccauggcccacccaucugggcugucucugcagggca

SEQ ID NO: 53828 - RNA, 61 nt, Human
ccccauccccaccagcucguuuuucagcacccccacccaccuccacccagccccuggcacc

SEQ ID NO: 53829 - RNA, 61 nt, Human
agguagauugaccggcuuuagacgcccaccccccacccaccgcaagcuuugagugggacac

SEQ ID NO: 53830 - RNA, 61 nt, Human
cauugucccuucagcucagcugcucuucucccccacccacccugggaugugggugcucugg

SEQ ID NO: 53831 - RNA, 61 nt, Human
gucaggagagugagcucucagaagccagagccccacccaaggggacccuggucucuccgcc

SEQ ID NO: 53832 - RNA, 61 nt, Human
cuucauugguugucucugugagagcacuguccccacccaaccugucacaacggccagaacc

SEQ ID NO: 53833 - RNA, 61 nt, Human
cuaaccaaagagucucuggcucagcuguggucccacccaggaagggagggagcugaggccu

SEQ ID NO: 53834 - RNA, 61 nt, Human
ccuacaugccuguagccuuucucacuccauccccacccaaagugcucagaccuugucuagu

SEQ ID NO: 53835 - RNA, 61 nt, Human
agguaggcaccuuucugagcuuauucuauuccccacccacacccccaggcaggguuggaaa

SEQ ID NO: 53836 - RNA, 61 nt, Human
ugucucaugauuaguuauguuugccugucuccccacccaucagugaaaucccugagggcag

SEQ ID NO: 53837 - RNA, 61 nt, Human
acuuuaaggaccagaucaugcuccauccagccccacccaauggccuuuugugcuuguuucc

SEQ ID NO: 53838 - RNA, 61 nt, Human
ggaggagggacacuccagccccccucucuggcccacccaguccucugcccaagcccuuccu

SEQ ID NO: 53839 - RNA, 61 nt, Human
cugaggucucgccugcccccgcccgguuucccccacccacugcccuccuucccucccgugc

SEQ ID NO: 53840 - RNA, 61 nt, Human
agccugcgucaggagaagggcuccucgccaacccacccacacgcucgucucacucaauuca

SEQ ID NO: 53841 - RNA, 61 nt, Human
aaggggaagguuggaucuuggguuuggucuacccacccaagagaaaagacuguuaacugga

SEQ ID NO: 53842 - RNA, 61 nt, Human
ggccaugacccaggggagccagcgcugccaccccacccagcgcugccagggagccgccauc

SEQ ID NO: 53843 - RNA, 61 nt, Human
cucucagagucauugaaggguguucacccaucccacccaaggcuuggcacacugccagugu

SEQ ID NO: 53844 - RNA, 61 nt, Human
cauauauggauugauaugguuuggauguauccccacccaagucucaucuugaauuuuaauc

SEQ ID NO: 53845 - RNA, 61 nt, Human
cauuuagaaaaaaaaauuuuuucuaucucugcccacccacaccugugauguuguguguguu

SEQ ID NO: 53846 - RNA, 61 nt, Human
gagacaaguuaacucgugcaagagccaguuacccacccacaggucccccuacuuccugcca

SEQ ID NO: 53847 - RNA, 61 nt, Human
cagggcucugggauaguaagagaggugacaacccacccagacugcaguucccuccccaccc

SEQ ID NO: 53848 - RNA, 61 nt, Human
ccuuccagccuuucugucaucaucuccacagcccacccauccccugagcacacuaaccacc

SEQ ID NO: 53849 - RNA, 61 nt, Human
gcucuccccaggcucccuccucagccuccugcccacccagggcccuuuacucucuucuccc

SEQ ID NO: 53850 - RNA, 61 nt, Human
gagaaggaagcgcugaucuucuauuuaauuccccacccaugacccccagaaagcaggaggg

SEQ ID NO: 53851 - RNA, 61 nt, Human
cacagagauauagagauacacaugcuuuuuucccacccaaaauugugacaacauuauguga

SEQ ID NO: 53852 - RNA, 61 nt, Human
ccuugagaugaucguagacacagggaugauucccacccaaacccacguauucauucaguga

SEQ ID NO: 53853 - RNA, 61 nt, Human
cuuagacuuagcugucagugugacuuccuuucccacccacccccagaaaaacagaaagagc

SEQ ID NO: 53854 - RNA, 61 nt, Human
ucuaugaugucccccuucucugaggccuggacccacccaucuuugucccuggggccugcuc

SEQ ID NO: 53855 - RNA, 61 nt, Human
ggucuccugcugcuuagguccuuuugggacccccacccauccaggcccuuucuuugcacac

SEQ ID NO: 53856 - RNA, 61 nt, Human
ugacuuuaauuuaaaacaaaggccugugccucccacccaggaggugggagggugaauuuua

SEQ ID NO: 53857 - RNA, 61 nt, Human
ccgcaauggacaagccuccugcucacuccaccccacccaccucugcccuguccuuggcagc

SEQ ID NO: 53858 - RNA, 61 nt, Human
uggccucuccagggcugcucaggcaaggccccccacccaucugguauggaaaccugccggc

SEQ ID NO: 53859 - RNA, 61 nt, Human
cugcccccucaccuugguacugaucagcgcccccacccaggacauaccuuccccaggauag

SEQ ID NO: 53860 - RNA, 61 nt, Human
ucaccuccuccuccacucccugccucuucuccccacccauccuggcgggcgggcugcgcgg

SEQ ID NO: 53861 - RNA, 61 nt, Human
ggauggaaaugaccuccuggcaccaggcucacccacccaaggcccccugccccagcacuga

SEQ ID NO: 53862 - RNA, 61 nt, Human
cuguuucguauccuccucacaccguguauuucccacccacucagggucacagccuacuaau

SEQ ID NO: 53863 - RNA, 61 nt, Human
gaugcuguucgugccugucccugcucugccucccacccaguugccugaaucaucccagcuc

SEQ ID NO: 53864 - RNA, 61 nt, Human
cugggaaugcuggaccagggggauuacuucccccacccacacccccauuuggacaucuggg

SEQ ID NO: 53865 - RNA, 57 nt, Human
gucguggccgcccccacugagaggcaccccacccaucacauggcuggcuggcugcug

SEQ ID NO: 53866 - RNA, 61 nt, Human
guuccugggaugagccauacccuggaacuggcccacccacugugucuuccacguaagggag

SEQ ID NO: 53867 - RNA, 61 nt, Human
uauugugaaaaugggggauuuucccucugcucccacccaccuaaacacagcagccauuugu

SEQ ID NO: 53868 - RNA, 61 nt, Human
ucuaggccauccccucuucuaccuccugcaacccacccauccuauuagccucccacauuca

SEQ ID NO: 53869 - RNA, 61 nt, Human
cuugggcuucuccugagguaaugauuacccccccacccacagcugagucugugaggcccca

SEQ ID NO: 53870 - RNA, 61 nt, Human
cauagcagaacccagugcacguccuccccuucccacccaccucuggcugaaggugcucaag

SEQ ID NO: 53871 - RNA, 61 nt, Human
uaaccauaggauguugacucuagaaccuggacccacccagcgcguccuuucuuauccccga

SEQ ID NO: 53872 - RNA, 61 nt, Human
gagacuagaugcuuucacuagggaaugucuucccacccagccaucacaaauguggacaauc

SEQ ID NO: 53873 - RNA, 61 nt, Human
agacucugcccucuucccacagccucccugccccacccaucccugcaaagccauuuuucag

SEQ ID NO: 53874 - RNA, 61 nt, Human
aaauggugaggcgaggggcuugagaggaacgcccacccacgaaggcccagggcgccagacg

SEQ ID NO: 53875 - RNA, 61 nt, Human
ugaagaagagaagcuuccggcaacccugcaacccacccaaggaggcuacuggaucggggau

SEQ ID NO: 53876 - RNA, 61 nt, Human
cucccucuuccugguggccaccucccucccgcccacccacucucaccccaaacaaaaucac

SEQ ID NO: 53877 - RNA, 61 nt, Human
gccgcugccccucggggcuggaauaaaacuccccacccagagucaguccuaguggggcccu

SEQ ID NO: 53878 - RNA, 61 nt, Human
cucauguaacaucugggaggggcuucauccccccacccaggaccuagugcaugccagcagc

SEQ ID NO: 53879 - RNA, 61 nt, Human
uucaccaucugauaugguuuggcuuuguguccccacccaaauugcaucucaaauuguaauc

SEQ ID NO: 53880 - RNA, 61 nt, Human
uccugaguagcuggauuacaggcaugugccacccacccaacuaauuuuuguguuuuuaaua

SEQ ID NO: 53881 - RNA, 61 nt, Human
acgcaacucuuuggcugcucugauuggauaucccacccacaagaucguauacccauaauau

SEQ ID NO: 53882 - RNA, 61 nt, Human
gguccuaagacccagggacccagcgacuaugcccacccagaccccagagcguucccauaac

SEQ ID NO: 53883 - RNA, 61 nt, Human
agaaaggagaaaaagaugggauugccacucacccacccacacugguaagggaggagaauuu

SEQ ID NO: 53884 - RNA, 61 nt, Human
cacccuugagaaggugcuuuguaauauucuccccacccaccccacgcccgcacccccgcac

SEQ ID NO: 53885 - RNA, 61 nt, Human
ugugguguuuucguuucuuuuucaucucccccccacccacaaagagcacggagccagccuu

SEQ ID NO: 53886 - RNA, 61 nt, Human
ugggucaggaggccaaagcugauguucaggccccacccacucccuacaguccucagaccaa

SEQ ID NO: 53887 - RNA, 61 nt, Human
gcguuuuauaguccucuaaaaucuaggugcucccacccaccaaaggcauauccugcaaagg

SEQ ID NO: 53888 - RNA, 52 nt, Human
gcagccggaaucggcaaugacccccacccagggggccagcgggagcagggcc

SEQ ID NO: 53889 - RNA, 61 nt, Human
aucgcagggugcucacacacccccacacccacccacccacacacaacacugggacaauuca

SEQ ID NO: 53890 - RNA, 61 nt, Human
uuccaucgcagggugcucacacacccccacacccacccacccacacacaacacugggacaa

SEQ ID NO: 53891 - RNA, 61 nt, Human
uuguagagcugccagcgcucucccagguucacccacccaggcuucaccagcccugugcggg

SEQ ID NO: 53892 - RNA, 61 nt, Human
uucauccaccggcugcacaggcacaaacucccccacccaggacggcugugaugagguggcc

SEQ ID NO: 53893 - RNA, 61 nt, Human
uccagaggccuagggagguuuuagggcccuccccacccacacccacaggucgauuuggucu

SEQ ID NO: 53894 - RNA, 61 nt, Human
ggggggauuguagcagacgucugggcuuuuccccacccagagaauagcccccuucgauaca

SEQ ID NO: 53895 - RNA, 57 nt, Human
gcaaguccaaacgcuccugaagggcugcccacccacagccagaauccacaggauccc

SEQ ID NO: 53896 - RNA, 61 nt, Human
auaaucgcggccaccaccuguaggaccuccucccacccacgcugcccccagagcuugggcu

SEQ ID NO: 53897 - RNA, 61 nt, Human
auaccuuucaaauccccagggcagacacacccccacccagccccuauuuggaccuaaacug

SEQ ID NO: 53898 - RNA, 61 nt, Human
aaucccugcaucagguucuccuuugaggguacccacccaggacaguccccuaccacuucug

SEQ ID NO: 53899 - RNA, 61 nt, Human
caugucuacuauggcaaaaaacauuaccauccccacccauaccacagcauccccuagagag

SEQ ID NO: 53900 - RNA, 61 nt, Human
ccccaaacucacuuggcauaauucacaaccucccacccaaacaaugggccugguggacgug

SEQ ID NO: 53901 - RNA, 61 nt, Human
ggcaggggcuggaccccagggacuugccuuccccacccacucugcugccagcaggcccagg

SEQ ID NO: 53902 - RNA, 61 nt, Human
aggaggggguuggacauccugccccucaccccccacccacacugcagguagaggaggccau

SEQ ID NO: 53903 - RNA, 61 nt, Human
gccaccgucccucugcagauacacugcucuccccacccagaccugccugucucccacccuu

SEQ ID NO: 53904 - RNA, 61 nt, Human
uacugaggaugauguuauucacagccccuggcccacccacuaauacuacugcacagaguca

SEQ ID NO: 53905 - RNA, 61 nt, Human
acacccuugccuuucugggacuuggccucaccccacccauggaauaccugccucaucccaa

SEQ ID NO: 53906 - RNA, 61 nt, Human
guccuuggacagcagauccacacaccacuuccccacccacacacaguacccugggcugguu

SEQ ID NO: 53907 - RNA, 61 nt, Human
gaaaacuuacuuacuucaggcauccagugcccccacccaggguucaggcccugucuaaggu

SEQ ID NO: 53908 - RNA, 61 nt, Human
gucugcuucucccauguaccagggcaccaggcccacccaacugaaggcauggcggcggggu

SEQ ID NO: 53909 - RNA, 61 nt, Human
agccugccacgauggcugcugcuccuuguagcccacccaugagaagcaagagaccuuaaag

SEQ ID NO: 53910 - RNA, 61 nt, Human
uguccugcucacgucugugagucuguccuuucccacccacuagcccucuuucucucugugu

SEQ ID NO: 53911 - RNA, 61 nt, Human
cugggcuguugcuaauauugaggaggcuugccccacccaacaagccauaguggagagaacu

SEQ ID NO: 53912 - RNA, 61 nt, Human
cccacaucuaaugucucuuccucuguucuaucccacccaacagcucagagaugaaacuaug

SEQ ID NO: 53913 - RNA, 61 nt, Human
aggagggucucuccuccagccccugcacacucccacccaggacagcccccagcccaacuag

SEQ ID NO: 53914 - RNA, 61 nt, Human
uugcccgugauggcuccuuggggucugccugcccacccacaugagcccgcgaguauggcag

SEQ ID NO: 53915 - RNA, 61 nt, Human
ucuuagguuagcggagcuuuuuccucuuuuccccacccaucuccccaauauugcccauuau

SEQ ID NO: 53916 - RNA, 61 nt, Human
uggcaguguccuguuugagcacccugcagcccccacccaagauggccuggugagaugaugc

SEQ ID NO: 53917 - RNA, 61 nt, Human
gcgguuuucccaaaacaagcccuuccuggcucccacccagacauggaccagccaugcaccc

SEQ ID NO: 53918 - RNA, 61 nt, Human
agagcccucccaugucugcugguuucaguuccccacccaacugacugaagucuugaccuug

SEQ ID NO: 53919 - RNA, 61 nt, Human
ugaggaauaaagggaaaaacccaaguucauucccacccaaagucagaaucccucauuggcc

SEQ ID NO: 53920 - RNA, 61 nt, Human
cagccuguucugggaggagcucccucacuggcccacccacuuguguugaagcaaaaagcaa

SEQ ID NO: 53921 - RNA, 61 nt, Human
ggugcugucagcgcacagacccaugcgcauccccacccacaacccuuuacccugaugaucu

SEQ ID NO: 53922 - RNA, 61 nt, Human
ugcuccuagccaagauguuggccuuucugugcccacccagacuugguuugggccaccagag

SEQ ID NO: 53923 - RNA, 61 nt, Human
ucccaugacaaccuagacugcccagggcucccccacccaggcccccacccucuugcugcuc

SEQ ID NO: 53924 - RNA, 61 nt, Human
ucaccccaagugaaggcucgagacuuccugccccacccaguggguaggccaaguguguugc

SEQ ID NO: 53925 - RNA, 61 nt, Human
gacccugccucagcugacccggccucucugccccacccaagcccaaacuugguuucuguga

SEQ ID NO: 53926 - RNA, 61 nt, Human
ggggcccacuagcagcccccagcaucucccacccacccagcuagggcagaggggucaggau

SEQ ID NO: 53927 - RNA, 61 nt, Human
cuggggggcccacuagcagcccccagcaucucccacccacccagcuagggcagagggguca

SEQ ID NO: 53928 - RNA, 61 nt, Human
ucacucauuacugugaccuuccagcucaguccccacccaugggagccuguguugcuccucu

SEQ ID NO: 53929 - RNA, 61 nt, Human
cagaauggccacugauaggcaugccucuuuucccacccacuggaaggcucacaggcaaggu

SEQ ID NO: 53930 - RNA, 61 nt, Human
cccccaucugcccagcacggccugcacugugcccacccacuugcuccacaacguccaguug

SEQ ID NO: 53931 - RNA, 61 nt, Human
ccauguguacuucugaaaauauuuuaaccagcccacccagcagucaguacacaugccuggg

SEQ ID NO: 53932 - RNA, 61 nt, Human
auaguuaccuugccuuuuaggauguucuuaucccacccauaaugagaguugaaaggggaug

SEQ ID NO: 53933 - RNA, 61 nt, Human
uuucuguuucccccuuucccaccuccuuccccccacccaauccuuuuuuuuuucuuuuuug

SEQ ID NO: 53934 - RNA, 61 nt, Human
ggcgaggaagaguaauauuuagcauucaggacccacccacccuaugccggcuucugugcca

SEQ ID NO: 53935 - RNA, 61 nt, Human
ucccuugcagaacgagaaaguuaaaaacaagcccacccaguacucacaccaucaagucugu

SEQ ID NO: 53936 - RNA, 61 nt, Human
cagcagggcugugaugggcgagucccggagccccacccagaccugaaugcuucugagagca

SEQ ID NO: 53937 - RNA, 61 nt, Human
gcucaacaggacugcacucgucucugcccugcccacccagagccccucuuugugcccugau

SEQ ID NO: 53938 - RNA, 61 nt, Human
uccucuugaguuugauuugacaagaugccuucccacccagguaaccccgugggaacgugcc

SEQ ID NO: 53939 - RNA, 61 nt, Human
ccuuugcagggauucuuguccugcuggccaccccacccacaccugucccuggccagcaggc

SEQ ID NO: 53940 - RNA, 61 nt, Human
ugggggguugccucgaguccccccaccccuccccacccaccaccgcucccgcgggaagcca

SEQ ID NO: 53941 - RNA, 61 nt, Human
acaccuuguuaccaaauagguuguucucuuccccacccaccuuugagcuuuugcucuaaaa

SEQ ID NO: 53942 - RNA, 61 nt, Human
aagagauguuauauucuuuucucauuucuuccccacccaaaaauaagcuaccauauagcuu

SEQ ID NO: 53943 - RNA, 61 nt, Human
uuuuuuuuuuugagauggagucuugcucugucccacccagucuggagugcaauggugcgau

SEQ ID NO: 53944 - RNA, 61 nt, Human
ugguuaaaaaagauaccuuauccuauuccuccccacccacccauguuuuuaaacuaauuua

SEQ ID NO: 53945 - RNA, 61 nt, Human
uaaaaaagauaccuuauccuauuccuccccacccacccauguuuuuaaacuaauuuauaua

SEQ ID NO: 53946 - RNA, 61 nt, Human
cugggacgccccuuucucuugcuguuuaccgcccacccagcagcgcccgaggccagggccg

SEQ ID NO: 53947 - RNA, 61 nt, Human
uggaucccccucuagcuccugcucacccacgcccacccaguaguccugccugucugcacag

SEQ ID NO: 53948 - RNA, 61 nt, Human
agucucugcaggcguggcacgcacgcacgcacccacccacgcgcacuuacacgagaagaca

SEQ ID NO: 53949 - RNA, 61 nt, Human
ucauuuucccaccugccuccccuacccaccccccacccaccaccuggggcuuccucugggg

SEQ ID NO: 53950 - RNA, 61 nt, Human
auauaugauuuuuauccaugcgucaguuuuucccacccaguguagcauccuaaagauaaag

SEQ ID NO: 53951 - RNA, 61 nt, Human
aaaagugaauaaccugaggauucuauuaguccccacccaaacuuuauugauucaccuccua

SEQ ID NO: 53952 - RNA, 61 nt, Human
gugggagggaggagggccgagacaggagcagcccacccagcagaaauacaauccgagcuac

SEQ ID NO: 53953 - RNA, 61 nt, Human
uggcagaugugaacugacaaggagugaagcgcccacccagcggauggacagcacccaccug

SEQ ID NO: 53954 - RNA, 61 nt, Human
ccaccgcuguuccgcugcagccccgcccugccccacccacccagugccuugcugaagccca

SEQ ID NO: 53955 - RNA, 61 nt, Human
cgcuguuccgcugcagccccgcccugccccacccacccagugccuugcugaagcccauagc

SEQ ID NO: 53956 - RNA, 61 nt, Human
cugggcuaggagagcuggggucaaaagcugccccacccacucucccucacauggugcuagg

SEQ ID NO: 53957 - RNA, 61 nt, Human
uguguuucgccaaagcucauaagggcugugacccacccauauggccccaguuuuuucuguc

SEQ ID NO: 53958 - RNA, 61 nt, Human
ccagcgcgcaccgucgccacggaucgccgcccccacccagccgggcgccccggacccccca

SEQ ID NO: 53959 - RNA, 61 nt, Human
agaacucucugacuggggccccuggcccggccccacccagccgacauguuuucuuuggccu

SEQ ID NO: 53960 - RNA, 61 nt, Human
cacauuugccucucacaugcugcccucuccacccacccagggacaccccacggcuccuccc

SEQ ID NO: 53961 - RNA, 61 nt, Human
gccuugagggugcaggcaggcagcccuguaccccacccacauagacuauacuguacauaca

SEQ ID NO: 53962 - RNA, 61 nt, Human
accuugguauaccagcucggcagaacaguuccccacccagcgauuagggagcugggcuggc

SEQ ID NO: 53963 - RNA, 61 nt, Human
ccuuuucuuuuauuucagugcugccuucccacccacccaguccauucacccucaccucucc

SEQ ID NO: 53964 - RNA, 61 nt, Human
ggugccuuuucuuuuauuucagugcugccuucccacccacccaguccauucacccucaccu

SEQ ID NO: 53965 - RNA, 61 nt, Human
gugugaugucaaguaacauguggggaguguccccacccaaugcuuuggaaaaugcaagauc

SEQ ID NO: 53966 - RNA, 61 nt, Human
cccuccuccuggccuucugacgggcggcguucccacccacaccuucgacgcgacgccuacg

SEQ ID NO: 53967 - RNA, 61 nt, Human
ucccccgucucccggccgccccucuucccuucccacccagcugcgcccucggcucggucuc

SEQ ID NO: 53968 - RNA, 61 nt, Human
uguacaucuaaagaaugauuccguccuaacacccacccagccuguuugaacacauucuaau

SEQ ID NO: 53969 - RNA, 61 nt, Human
aagguuggagguggggaaggcuuuguauaaucccacccaccucaccaaaacgaugaaguua

SEQ ID NO: 53970 - RNA, 61 nt, Human
gugcuguccaguggaggggagggcuuucacgcccacccacccccuggcccugccagcuggu

SEQ ID NO: 53971 - RNA, 61 nt, Human
ucaccauaucugugugccgcccccagcaccccccacccaccucuggggggcccgugagcgu

SEQ ID NO: 53972 - RNA, 61 nt, Human
ucuguggccuuuggugaccucaccacucccucccacccagucccucccucugguccacugc

SEQ ID NO: 53973 - RNA, 61 nt, Human
gaggaggccgcuguagggucuggcugagcuucccacccacuuucccuggucccaauccuuu

SEQ ID NO: 53974 - RNA, 61 nt, Human
uggcccgagccuggggcucccugggcccugccccacccaccuuauccucccaccccacucc

SEQ ID NO: 53975 - RNA, 61 nt, Human
gcuggcagcaggacgacuggcuguccuccugcccacccacacugacggcaucuucccaguu

SEQ ID NO: 53976 - RNA, 61 nt, Human
agcuggccugagcagggggccugccaccagacccacccacgcucugacgagaggcuuuucc

SEQ ID NO: 53977 - RNA, 61 nt, Human
ucagagucugggucucacuggccccaagucucccacccagaacucuggccaaaaauggcuc

SEQ ID NO: 53978 - RNA, 61 nt, Human
uaccuguggccuuuuaacauucaagaguaugcccacccagccccaaagccaccggcaugug

SEQ ID NO: 53979 - RNA, 61 nt, Human
guagcugggauuacaggugugagccacugcacccacccaagacaagugauuuucauuguaa

SEQ ID NO: 53980 - RNA, 61 nt, Human
gucucaucugccugaaaaugacuguguggaucccacccaaauccaacucauccugguuugc

SEQ ID NO: 53981 - RNA, 61 nt, Human
cacuugauaaaucauggggcacagauauguucccacccaacaaaugugauaagugauugug

SEQ ID NO: 53982 - RNA, 61 nt, Human
gcccccgugauucaauuaccucccacuuggucccacccacgacacgugggaauugugggag

SEQ ID NO: 53983 - RNA, 61 nt, Human
auagaggcagugagacugcaggugggcugggcccacccagggagcugaugccccuucuccc

SEQ ID NO: 53984 - RNA, 61 nt, Human
uccuguucuuccuuccuagaagccccugucgcccacccagcugguccuguggaugggaucc

SEQ ID NO: 53985 - RNA, 50 nt, Human
gaaacaccgcagaccacuagcccacccagcaucagagaccuucucuuccu

SEQ ID NO: 53986 - RNA, 61 nt, Human
cuccuucuaccacucuuaaauuuacucccuccccacccagaacccagaugggguggagggg

SEQ ID NO: 53987 - RNA, 61 nt, Human
cccccuccccccccgccccucugcuucccuccccacccaccaccucaaggguagggaguug

SEQ ID NO: 53988 - RNA, 61 nt, Human
cauaguaggaccauaccucuuccuuucccaucccacccacauaugauagacagccccucug

SEQ ID NO: 53989 - RNA, 61 nt, Human
cuccacucccacucugccagacacccugacacccacccaggcuuugaagagcauggagggg

SEQ ID NO: 53990 - RNA, 61 nt, Human
uuccccuggccucaguucccagcuccccccgcccacccacgcauacacacaugcccuccug

SEQ ID NO: 53991 - RNA, 61 nt, Human
gcagacuccaauggggccagcacuggaggggcccacccacaugacuuuuccauugaccagc

SEQ ID NO: 53992 - RNA, 61 nt, Human
cuccuggcaggccugcugugugccaaaaacucccacccaaggucccucaggggauauuuca

SEQ ID NO: 53993 - RNA, 61 nt, Human
accuaugacccccucccccaggacaccaccucccacccacagaccuucccuuuagcuguug

SEQ ID NO: 53994 - RNA, 61 nt, Human
aggggagggcuccacaagcgugucuggcauucccacccaccauggaagacuggauacgcac

SEQ ID NO: 53995 - RNA, 61 nt, Human
cgcugggcaugugcccucacuguggacagggcccacccaccuccgguuccccugugccucc

SEQ ID NO: 53996 - RNA, 61 nt, Human
ugagaagcccccucucccugguccucuccuacccacccauguccucucagaaccccagccu

SEQ ID NO: 53997 - RNA, 61 nt, Human
gcuuagaggacagaaaaaugugaagagacgccccacccacccucagccagcccucuccagu

SEQ ID NO: 53998 - RNA, 61 nt, Human
cucacacacagccccccugaugagcucugagcccacccagcauccucuguccugagacccc

SEQ ID NO: 53999 - RNA, 61 nt, Human
acuccaccaucacucacucacuccccacucccccacccauggggaggagaccuuugaugaa

SEQ ID NO: 54000 - RNA, 61 nt, Human
ggucccggaacccucccuucgccacccuccacccacccaccucgcgguccccaggaccacu

SEQ ID NO: 54001 - RNA, 61 nt, Human
aaaauaauaacaaaucaaccccagcaccaaacccacccaggcaggaagaagccgccccucc

SEQ ID NO: 54002 - RNA, 61 nt, Human
aggucaccgggacuucucucagagucagcggcccacccaacucccucauaccgucgcaucu

SEQ ID NO: 54003 - RNA, 61 nt, Human
aauccgguaccaagugagcaagguggcaggacccacccaagccugauacgcaucugggccc

SEQ ID NO: 54004 - RNA, 61 nt, Human
uucugagcguggggccagcuccccccgcgcgcccacccacacucacuccaugcucccggaa

SEQ ID NO: 54005 - RNA, 61 nt, Human
ccccauaguacaguucuucaguggacaugaccccacccagcccccugcagcccugcugcac

SEQ ID NO: 54006 - RNA, 61 nt, Human
ccaucuguccccaucuuccuccccacaccuacccacccagugggcccugaagcagggccaa

SEQ ID NO: 54007 - RNA, 61 nt, Human
cuggagcucuguguucugagaucaugcaucucccacccaucugcccuucucccuucuacgu

SEQ ID NO: 54008 - RNA, 61 nt, Human
uucagccuccagcauguguggccacuguacccccacccacccuugggggagcaugaugggc

SEQ ID NO: 54009 - RNA, 55 nt, Human
cuggacgcuccaagcagugagacugcccacccacucccacaccuagcccagaaug

SEQ ID NO: 54010 - RNA, 61 nt, Human
agguggggaagaaggggaucucccucccgggcccacccagcugcccagccuuugcccacuc

SEQ ID NO: 54011 - RNA, 61 nt, Human
cgggcuuagcaccugcccuucucacccauggcccacccaggccuggagcugggaugcaaug

SEQ ID NO: 54012 - RNA, 61 nt, Human
ccagggacccaaugucccgaggaaucugccucccacccacugacucagggcucagacucag

SEQ ID NO: 54013 - RNA, 61 nt, Human
uuaaggauaugguuaaaaaaaaaucccaggacccacccauguuuucacuaucccuucugca

SEQ ID NO: 54014 - RNA, 61 nt, Human
cucuccacccuaacucagaccucaccuuccucccacccaccccugccuugcuuuucuuccu

SEQ ID NO: 54015 - RNA, 61 nt, Human
gaggguuuacuacaggccaggccauggacaccccacccagguacugcagugagggccuuga

SEQ ID NO: 54016 - RNA, 61 nt, Human
aaaucuguuuuucuaacugggggaaaagauucccacccaauucaaaacauugugccauguc

SEQ ID NO: 54017 - RNA, 60 nt, Human
uccagccugggcaacaggaguaaaacucccccccacccaaaaaaaaaaacaacaacaaca

SEQ ID NO: 54018 - RNA, 61 nt, Human
augcaagugacggugcugcucuuguuccacccccacccagauggucucugagugcgccguc

SEQ ID NO: 54019 - RNA, 61 nt, Human
guccagcuggaggcuggagggagacacaggccccacccagcagacugaggggcagaggcac

SEQ ID NO: 54020 - RNA, 61 nt, Human
ugugaauuggagaaauggagcucuguggcuucccacccaaaccuucucaguccagcuggag

SEQ ID NO: 54021 - RNA, 56 nt, Human
cacaggaguuugugguguaggcaccacccacccagcaguaccguccgcaccgccag

SEQ ID NO: 54022 - RNA, 61 nt, Human
gcgaccugccgggaccuugacaacaccuggccccacccacacguccugcaauauucacuga

SEQ ID NO: 54023 - RNA, 61 nt, Human
ccgcccacucucccaccccugaagcugcacucccacccaccuagcuccccccagggccccc

SEQ ID NO: 54024 - RNA, 61 nt, Human
ucugcagugcccuccucgccugugcagcccgcccacccacaggcucaccccuccugccggc

SEQ ID NO: 54025 - RNA, 61 nt, Human
uggccgccuucuuggugccaaacccccuucccccacccagagacugggcagcugugucugg

SEQ ID NO: 54026 - RNA, 61 nt, Human
ggccugguugggagcagccccuggcccauugcccacccacccaucucacuaugcaauucga

SEQ ID NO: 54027 - RNA, 61 nt, Human
ugguugggagcagccccuggcccauugcccacccacccaucucacuaugcaauucgaguuc

SEQ ID NO: 54028 - RNA, 61 nt, Human
cagcacucugcagggucacacgcaccguguccccacccaggacagcagacacccgccagag

SEQ ID NO: 54029 - RNA, 57 nt, Human
cucuggaagaaaacuccuaaagagaugcccacccauaaucagaagcaaaauucacag

SEQ ID NO: 54030 - RNA, 61 nt, Human
aggcccugugagauagagggcccagcccagccccacccacagauccccugcuccuguugug

SEQ ID NO: 54031 - RNA, 61 nt, Human
guuccaggcuguguguggggcccaagcaugccccacccaccccuccugggcccaggcagca

SEQ ID NO: 54032 - RNA, 61 nt, Human
cucacaccuuguccuuccaccccugccugcccccacccagccugcuucuuguccagcauug

SEQ ID NO: 54033 - RNA, 61 nt, Human
aucucauccaaauaacauuguucccauccuccccacccaccacaucaaaacauaacacauc

SEQ ID NO: 54034 - RNA, 61 nt, Human
acccgcgcccaggaguauggcugaggccuugcccacccaccugccugggaagugcagagug

SEQ ID NO: 54035 - RNA, 61 nt, Human
gcccgugggaccaugacuuagggaggugggacccacccacccccauccaggaaccgugacg

SEQ ID NO: 54036 - RNA, 61 nt, Human
ccuggacguguggagcuaggggccugccugccccacccaccccacagacuccggccuguaa

SEQ ID NO: 54037 - RNA, 61 nt, Human
ggcugcaggaaagcacuggucccaucgccuucccacccauucgccaacgcgggaaaggcaa

SEQ ID NO: 54038 - RNA, 61 nt, Human
uuaaugucacccucuacaucaucuuaccuagcccacccaaccuuauaaacaugauaauuga

SEQ ID NO: 54039 - RNA, 61 nt, Human
acaaagccucucuccccucccucgucccacccccacccaggcaggaagcccaggaggagug

SEQ ID NO: 54040 - RNA, 61 nt, Human
cccgggccacggggccuugggucccugcccucccacccagguuugguuccucccggggccc

SEQ ID NO: 54041 - RNA, 61 nt, Human
aauguggugugggcagcgugacauuuuaugucccacccaaaaauuggauuccuuuuggaga

SEQ ID NO: 54042 - RNA, 61 nt, Human
guggcccgccaccuccugaagcagggccuggcccacccaaggugccuggggcaggcgggca

SEQ ID NO: 54043 - RNA, 61 nt, Human
gucuuccaugaaaauaaaugcugccuggacccccacccagaccacacacugacggccggcu

SEQ ID NO: 54044 - RNA, 61 nt, Human
ggugcaugcauucccauagauuuuuacaucucccacccaacucuuccccaauuuccuuuua

SEQ ID NO: 54045 - RNA, 61 nt, Human
ggcauucucugaauuuauuuccucuccuucccccacccagcuuucuuuuuauggccccagg

SEQ ID NO: 54046 - RNA, 61 nt, Human
ggcuuggggcuacgcgccaggagagucuccccccacccaccuuuuuucuuugguugcuuuu

SEQ ID NO: 54047 - RNA, 61 nt, Human
gcauaggcacuauggacccuguuuugcuuaacccacccaacagccaauuuuagcagacauc

SEQ ID NO: 54048 - RNA, 61 nt, Human
augccucgcgguggccucuccgggcccagcucccacccagccugacggcgccucccggccc

SEQ ID NO: 54049 - RNA, 61 nt, Human
uggaucuggccagagggguguuggagcccagcccacccacauaccagucaagcucuuaggg

SEQ ID NO: 54050 - RNA, 61 nt, Human
ccaaguggggucuggggccuggagagacccucccacccagcagaccaggagauagcugggg

SEQ ID NO: 54051 - RNA, 61 nt, Human
caucuccgccuccacacugaccaagugcuggcccacccaguccaugcuccagggucaggcg

SEQ ID NO: 54052 - RNA, 61 nt, Human
cacccauauaucccuccuuuaccauaguacucccacccacuuccaucacccauccaauaaa

SEQ ID NO: 54053 - RNA, 61 nt, Human
ggagggggaugggggacuuuuguugguggcucccacccauauaucccuccuuuaccauagu

SEQ ID NO: 54054 - RNA, 61 nt, Human
ccgcgguuggccccccagaccauaccucugacccacccagccccugugguagccccagcag

SEQ ID NO: 54055 - RNA, 61 nt, Human
ucaccugauuggaggggcugguaaagcaacacccacccacuucucacacuagccuuaagag

SEQ ID NO: 54056 - RNA, 61 nt, Human
augugugucacuuugcuucagugacagcccucccacccagccuggcucugcuggcccugaa

SEQ ID NO: 54057 - RNA, 61 nt, Human
uuuguccaucuacugcuuugauuccuuggaucccacccauucuuucacuuuaagaaaaaac

SEQ ID NO: 54058 - RNA, 61 nt, Human
aaauaaacaggaacugauuuucugccuccaucccacccaugagggcugcaggcacuacaaa

SEQ ID NO: 54059 - RNA, 61 nt, Human
ggaaccgcugagcugaaguucuuggaaggcucccacccaggugccccguuggaaagcagau

SEQ ID NO: 54060 - RNA, 61 nt, Human
ggggcgcccacccggcccggcugagcccugccccacccaacuccacagggcuguuuugccu

SEQ ID NO: 54061 - RNA, 61 nt, Human
caggcagaaagagcuccaggcucuugugucgcccacccagcccucccauacucacuccuga

SEQ ID NO: 54062 - RNA, 61 nt, Human
caacaagaacugcaucuggcagcugguggcccccacccaguaccgcaucucccugcaguuu

SEQ ID NO: 54063 - RNA, 61 nt, Human
cggaccccccucgaagcccccuggacugauucccacccacgacucacaggcauuccuccca

SEQ ID NO: 54064 - RNA, 61 nt, Human
ggaagggguguggaaaaggugauccuuuacccccacccaggaaaaccugcauugugcuagc

SEQ ID NO: 54065 - RNA, 61 nt, Human
cuguuuugaagcugggcucuuuuguguagcucccacccaccuguagggcuagcucggcuua

SEQ ID NO: 54066 - RNA, 61 nt, Human
ucuggugccccucuucuccuggauucacauccccacccagggcccgcuuuuacuaaguguu

SEQ ID NO: 54067 - RNA, 61 nt, Human
uucugucuaagagaagaaagauaaggaggcucccacccaccucucccaagagcagacauua

SEQ ID NO: 54068 - RNA, 61 nt, Human
ucucccagucuccccgagucacagugccgaucccacccacccaccguagggugcacagcaa

SEQ ID NO: 54069 - RNA, 61 nt, Human
ccagucuccccgagucacagugccgaucccacccacccaccguagggugcacagcaaggca

SEQ ID NO: 54070 - RNA, 61 nt, Human
gggacgacaggccgaggauucacgcuggaagcccacccaagccggcggggcccuagcgcag

SEQ ID NO: 54071 - RNA, 61 nt, Human
auuuugcagguccaaugcaaacaucacagaccccacccaugcauaggagagacucuaacau

SEQ ID NO: 54072 - RNA, 61 nt, Human
agagugugacccucuccuguaaaguauuuaucccacccauuaauauaauuucuguauaaua

SEQ ID NO: 54073 - RNA, 61 nt, Human
uuuccuccccacuggagggcaagcccccccacccacccaggauguccuggcucacuccgca

SEQ ID NO: 54074 - RNA, 61 nt, Human
ugccuuuccuccccacuggagggcaagcccccccacccacccaggauguccuggcucacuc

SEQ ID NO: 54075 - RNA, 61 nt, Human
ccagcagugccaccgccaccacaccccagaucccacccaccuugcaguggccuuuccuugu

SEQ ID NO: 54076 - RNA, 61 nt, Human
cccugccacaaggaaaggaaagcaaaggcuucccacccaagucccccaucugcuaaaacug

SEQ ID NO: 54077 - RNA, 61 nt, Human
guguggcuuacuauuucauugugugcacccacccacccaccacacuggacuuuucuagaga

SEQ ID NO: 54078 - RNA, 61 nt, Human
uuugguguggcuuacuauuucauugugugcacccacccacccaccacacuggacuuuucua

SEQ ID NO: 54079 - RNA, 61 nt, Human
acggaggugcauuagcccaggcuggagguagcccacccaaaugcccuuucugauucuaauu

SEQ ID NO: 54080 - RNA, 61 nt, Human
cugcaucaaaugcaugcgugugcgugguggccccacccaggcaggggcuucccacagccuc

SEQ ID NO: 54081 - RNA, 61 nt, Human
ggcaacaguggcccugcagcccccagcccuccccacccagguuuucggcccagugaagagg

SEQ ID NO: 54082 - RNA, 61 nt, Human
gagucccuccuugauaagguuuggcgguguccccacccaaaucucauguugaauuguaguu

SEQ ID NO: 54083 - RNA, 61 nt, Human
ggacacuucccugagaagccccuuccacucucccacccacccucuucaaauguuuacuaua

SEQ ID NO: 54084 - RNA, 61 nt, Human
guagcaaggacaagaacuaaacaaucccagccccacccagcaacacagaacacaggaguuu

SEQ ID NO: 54085 - RNA, 61 nt, Human
guguccucagauguguggggaggauccaucccccacccacugcagccucacaccgagucca

SEQ ID NO: 54086 - RNA, 61 nt, Human
aaaagguagcugugauacaaaccccaggacacccacccacccaaagagccaaagaauaguu

SEQ ID NO: 54087 - RNA, 61 nt, Human
gguagcugugauacaaaccccaggacacccacccacccaaagagccaaagaauaguuccug

SEQ ID NO: 54088 - RNA, 61 nt, Human
acagagugaauucagcucuucugaaucaagacccacccagucucuuucauucagaccuguu

SEQ ID NO: 54089 - RNA, 61 nt, Human
ggcugagcuggcugccugaggaggggcagggcccacccaugucaccggucagugccuuuug

SEQ ID NO: 54090 - RNA, 61 nt, Human
accccuuccugucucacucuucugucuuguccccacccaugcgccuucgugccugagacca

SEQ ID NO: 54091 - RNA, 61 nt, Human
cggcgugguggaagaggggacaggucccucacccacccacaauccuauucucgggcugaga

SEQ ID NO: 54092 - RNA, 61 nt, Human
ccgacagcggccuugaagacagagcaaagcgcccacccaggucccccgacugccugucucc

SEQ ID NO: 54093 - RNA, 61 nt, Human
aggcggggcaggaaggggccaagggggcuugcccacccaccccgaccccagcccccagccu

SEQ ID NO: 54094 - RNA, 61 nt, Human
cgccaacaccuggugccuucugcagccagcgcccacccauccgugcccggacccuugggaa

SEQ ID NO: 54095 - RNA, 61 nt, Human
accuacccuccagccaugacccuucccugcucccacccaccugacuccaaauaaagagcuu

SEQ ID NO: 54096 - RNA, 61 nt, Human
agcuccacccuccccucuucuugcggcaccgcccacccacaccccgucugccccuugaccc

SEQ ID NO: 54097 - RNA, 61 nt, Human
acgacuuuauuuucuuacccaauuucccacccccacccaccuaauucgaugaaggcugcca

SEQ ID NO: 54098 - RNA, 61 nt, Human
aagggauaaagguaauagagcccuucugccccccacccaccaaauuuacacaacaaaauga

SEQ ID NO: 54099 - RNA, 61 nt, Human
uuucacaggugcucccaccccaguugaggcucccacccacagggcugucugucacaaaccc

SEQ ID NO: 54100 - RNA, 61 nt, Human
uuuacacaucaugucaaagauaacagcuguucccacccaccaguuccucuaagcacauacu

SEQ ID NO: 54101 - RNA, 61 nt, Human
cccauacuggcccccaucugaacccaccucucccacccagaucaacauccccccaaccccu

SEQ ID NO: 54102 - RNA, 61 nt, Human
cucccucaggggaggugggccaugcagcuaacccacccaccaaagacccccucacccuggc

SEQ ID NO: 54103 - RNA, 60 nt, Human
uaccuaacugaauaaaaagcuguucugucuucccacccaaguaccuguucccauguguuu

SEQ ID NO: 54104 - RNA, 61 nt, Human
uuucuggugugugcagacaugguggccauugcccacccagguaccagcagcagaagacuau

SEQ ID NO: 54105 - RNA, 61 nt, Human
gugauguccuuagucacuaagguuaaacuuucccacccagaaaaggcaacuuagauaaaau

SEQ ID NO: 54106 - RNA, 61 nt, Human
aauauucuguggugccagugcacacuaccuucccacccauacacauccauguucacuguaa

SEQ ID NO: 54107 - RNA, 61 nt, Human
gaguuuucccuggcuccaaaggccauuggcacccacccaaguauuaugggaaaccuccaga

SEQ ID NO: 54108 - RNA, 61 nt, Human
caacacuuucagcuccccaugcuccagaauacccacccaagaaaauaauaggcuuuaaaac

SEQ ID NO: 54109 - RNA, 61 nt, Human
ugccuuuggaagauuuugccccuuagccauccccacccacuuguaccagcuaagaaugcug

SEQ ID NO: 54110 - RNA, 61 nt, Human
uuuuaagggggaccucaccuccugugcacagcccacccacuuuccucugcuucccuggcac

SEQ ID NO: 54111 - RNA, 61 nt, Human
agcuucccaaucaauacuuccuggagccagccccacccaccccugagaacagaggucagac

SEQ ID NO: 54112 - RNA, 61 nt, Human
ggagaacguuugguacaaucgacauccuagccccacccagagguggcccucccaggcuggu

SEQ ID NO: 54113 - RNA, 61 nt, Human
aacuuugcuccaggcaucacugauucccucucccacccaaggagaacguuugguacaaucg

SEQ ID NO: 54114 - RNA, 61 nt, Human
cguccuuuucuaaugucuuccauuccuaccccccacccaaaaacaaaagaaauauuuguag

SEQ ID NO: 54115 - RNA, 61 nt, Human
cggccucuuccugggagccaugaccucagaccccacccacacuccagaucgagaccccugc

SEQ ID NO: 54116 - RNA, 61 nt, Human
ggcuuucacaucaucuuugagaggcucuguucccacccaggcugcacggaagacgagagcc

SEQ ID NO: 54117 - RNA, 61 nt, Human
cucucugucucaaaugaggcccaacccaucccccacccagcucccggccguccuccuaccu

SEQ ID NO: 54118 - RNA, 61 nt, Human
cauguguguucagggacugagccuggggacgcccacccacacccacugcuuccucucggcg

SEQ ID NO: 54119 - RNA, 61 nt, Human
aguagcccccacgcuggccccagccucagaccccacccagcaccuucccagacacgcagga

SEQ ID NO: 54120 - RNA, 61 nt, Human
accuacccuccagccaugacccuucccugcucccacccaccugacuccaaauaaaguccuu

SEQ ID NO: 54121 - RNA, 61 nt, Human
gcuauuguacauagaggaaaccugggcuagccccacccagagcgcagaggagggggcaccg

SEQ ID NO: 54122 - RNA, 61 nt, Human
ggggcguccaggccgcgcccuuuccccgacgcccacccaaccccaagccagcccggccgcu

SEQ ID NO: 54123 - RNA, 61 nt, Human
accccccccaacccccagcugccaucgcucucccacccagcuuggcccccugcccgcccac

SEQ ID NO: 54124 - RNA, 61 nt, Human
cuggguggggccugcuccccauccccccaagcccacccagcacucucauugcugcuguuga

SEQ ID NO: 54125 - RNA, 61 nt, Human
gcaagcauguugaauuuaaaauaugaauaaccccacccaacaauuuucaguuuauuuuuug

SEQ ID NO: 54126 - RNA, 61 nt, Human
gccuggucccaagugucccucuguacccacacccacccacucacuuguaagcuccuugaug

SEQ ID NO: 54127 - RNA, 61 nt, Human
cccgcagcuagcauccccacuccuccuccagcccacccaaccgccuugggucaagggggcu

SEQ ID NO: 54128 - RNA, 61 nt, Human
cauucccaucacuagcacuguccucuaaugccccacccaguggggaagucuccaauagguc

SEQ ID NO: 54129 - RNA, 61 nt, Human
acuugcuguagggggccuuacucccuguccccccacccacagggccccacgcaggccuggg

SEQ ID NO: 54130 - RNA, 61 nt, Human
gaguaagaaccuugccugaacauccuuccuucccacccaucgcuguguguuaguucccaac

SEQ ID NO: 54131 - RNA, 61 nt, Human
gagcacuggcaguugguggcagugagaccagcccacccaccaccacccaccacagaaaagc

SEQ ID NO: 54132 - RNA, 61 nt, Human
ugcugcaccaaccucacugcccucccucggccccacccacccucugguccuucugacccca

SEQ ID NO: 54133 - RNA, 61 nt, Human
cggggucucugugcacuugagagcugggggacccacccaccgucucccacuccaaguucau

SEQ ID NO: 54134 - RNA, 61 nt, Human
aggcucuguggcgggggucccugagagugcccccacccaucucaugccccagggaccgcca

SEQ ID NO: 54135 - RNA, 61 nt, Human
aggaaagggagccugcucucccuccccacaccccacccaaagcauacaccgcugagcucaa

SEQ ID NO: 54136 - RNA, 61 nt, Human
agccccccuaccuuaggccacccuccucaugcccacccagcaaggggcagaggccacaggc

SEQ ID NO: 54137 - RNA, 61 nt, Human
uugggcaaucugaggccaggacagauguugccccacccacuggagauggugcugagggagg

SEQ ID NO: 54138 - RNA, 61 nt, Human
cauuucuuuuguuuguuuguugcuguuuucccccacccauccaguucuccucagcaaagca

SEQ ID NO: 54139 - RNA, 61 nt, Human
gggacacuccccuucuccccacuuucaccuccccacccaaacuuuauaaaaguugaaaaaa

SEQ ID NO: 54140 - RNA, 61 nt, Human
ccagugcccugagccagggucuccagaaagccccacccaggccaggcauguggcagggguu

SEQ ID NO: 54141 - RNA, 61 nt, Human
uuccccagacgccuggcugcugaucgccuuccccacccaccaacccucagggcaaagccag

SEQ ID NO: 54142 - RNA, 61 nt, Human
ugacugcgccgccugcccuccugcccacccucccacccacccgaccagcagagcuuuuuaa

SEQ ID NO: 54143 - RNA, 61 nt, Human
ugacucucauuuucuacaaggcugcagugggcccacccaugggcuggcccauaacuguaug

SEQ ID NO: 54144 - RNA, 61 nt, Human
cuucauuuguauauaacacuuucagagccuucccacccauagguaguucuuaaaccaggug

SEQ ID NO: 54145 - RNA, 61 nt, Human
auauaccucugauaugguuuggcucuguguccccacccaaaucucaucuugaauguguacu

SEQ ID NO: 54146 - RNA, 61 nt, Human
cccaucucugcuguucccugcguggaggaagcccacccagcaagcucucuccuaccccagg

SEQ ID NO: 54147 - RNA, 61 nt, Human
gcagacaagucacuacagaaacauaccccaucccacccaccccugccucugccccagccag

SEQ ID NO: 54148 - RNA, 61 nt, Human
agaggaggaaaggcccucccucacccugcuccccacccaggcagggcagcaugggacccag

SEQ ID NO: 54149 - RNA, 61 nt, Human
ccccuaggcugacuggauuugagaacaaauacccacccauuuccaccaugguaugguaacu

SEQ ID NO: 54150 - RNA, 61 nt, Human
gggccaugggccgaggccuggcauucacguucccacccagccuggcuggcggugcccacag

SEQ ID NO: 54151 - RNA, 61 nt, Human
guccugcagcaccuuaguccauacuaccagccccacccaccuuccuuccucuucccucuuc

SEQ ID NO: 54152 - RNA, 61 nt, Human
ccucccaccuagaggagaccaugggcccugccccacccacuccaggauguuaggguccccu

SEQ ID NO: 54153 - RNA, 61 nt, Human
cugccuugggcuggggccugcggaggggaagcccacccacaaugcauggaguauuauuuuu

SEQ ID NO: 54154 - RNA, 61 nt, Human
gggguccuggccccugugaugcucccccauccccacccacuucuacauccauccacacccc

SEQ ID NO: 54155 - RNA, 61 nt, Human
cuuccacucucugaccaccgcccccgcccuccccacccagcuccgcuucuuguuacuuggg

SEQ ID NO: 54156 - RNA, 61 nt, Human
gguuauaaggcagucacuuuuucucucuacucccacccacaccugccucccucuuaccccu

SEQ ID NO: 54157 - RNA, 61 nt, Human
cgucguccaagcucuugaauauucuucuguucccacccacuucugauaaguacccugaggc

SEQ ID NO: 54158 - RNA, 61 nt, Human
cucuacccaguaguaccacuagcaccuauuccccacccagcgugucuccagauauugucaa

SEQ ID NO: 54159 - RNA, 61 nt, Human
uccgaccagaacccuucuuccuguggcacuccccacccauagaccuucagaucaucuccca

SEQ ID NO: 54160 - RNA, 61 nt, Human
agaggguauggccugaagccugaagacucgccccacccaccacugcccagcacccaguguc

SEQ ID NO: 54161 - RNA, 61 nt, Human
aggguccugcccacagcgcccuguaccugcucccacccagcccuuggugugcccacccagc

SEQ ID NO: 54162 - RNA, 61 nt, Human
cuguaccugcucccacccagcccuuggugugcccacccagccuccucuccagcaccuugcu

SEQ ID NO: 54163 - RNA, 61 nt, Human
cucaaguaccuuuucuccuggacuguguggacccacccagcuuucuuccucccuguugugu

SEQ ID NO: 54164 - RNA, 61 nt, Human
cagccaugggcucgggauggacucccugggccccacccauugccaagccaggaaggcagcu

SEQ ID NO: 54165 - RNA, 61 nt, Human
ggccuggaguacgaggggcacccugggggcucccacccagaagcagaggggcugggcuguu

SEQ ID NO: 54166 - RNA, 61 nt, Human
ugcugggcucccagguagcugaaggccucagcccacccacucccuucuucccugugugggg

SEQ ID NO: 54167 - RNA, 61 nt, Human
ucccuaggcugggcugagggcaaccuugccccccacccaagaagcccugcccuccagccac

SEQ ID NO: 54168 - RNA, 61 nt, Human
ugcugugggcucuccuccagccugcccagggcccacccagaugccucugggguuaccccug

SEQ ID NO: 54169 - RNA, 61 nt, Human
caaagccaagaagaucaagucucagcaccggcccacccaaagauucuggcccaacuccauc

SEQ ID NO: 54170 - RNA, 61 nt, Human
aaaucccugaggauagauggcacccauggcccccacccacggaaggacuugaguuguuuac

SEQ ID NO: 54171 - RNA, 61 nt, Human
aagagccugcggggaugcccaucccacacaccccacccagcuguucuaacccugcuaucca

SEQ ID NO: 54172 - RNA, 61 nt, Human
gcucuccacuguccacccuaacacauacccucccacccaccuuccagacccccuugguugg

SEQ ID NO: 54173 - RNA, 61 nt, Human
augcaccccuggagaagugaccacgcuggaacccacccacccgcugugcugaccaugggcc

SEQ ID NO: 54174 - RNA, 61 nt, Human
gagcacagaucuguuucgugcauuggaagaccccacccaagcuuggcagccgagcucgugu

SEQ ID NO: 54175 - RNA, 61 nt, Human
ggcccgcgcuccgcccccagcgagccggggacccacccaccaccccccgcaccgccgacgc

SEQ ID NO: 54176 - RNA, 61 nt, Human
ccuugcaucugaauaggccuacccucacccacccacccaguuuaauugugcuuagagccca

SEQ ID NO: 54177 - RNA, 61 nt, Human
cuggccuugcaucugaauaggccuacccucacccacccacccaguuuaauugugcuuagag

SEQ ID NO: 54178 - RNA, 61 nt, Human
cugcaagacugcuccucucgucucaaaaugacccacccagcuagagcacuguacaccccca

SEQ ID NO: 54179 - RNA, 61 nt, Human
guauguaaaucagaucuccccucucaccccucccacccauuaaccuccucccaaaaaacaa

SEQ ID NO: 54180 - RNA, 61 nt, Human
uuugcgcuugccuucucacaccccccgacuccccacccauauuuugguaccaguuucuccu

SEQ ID NO: 54181 - RNA, 61 nt, Human
acacacuccuggcccucggccccucccuagucccacccacgcucaaccuuuggcccagcca

SEQ ID NO: 54182 - RNA, 61 nt, Human
ccauccccaccuccacuucagaacauggcaccccacccaacuggccaaguguuaagugaug

SEQ ID NO: 54183 - RNA, 61 nt, Human
ucuccuggcaggggucucuucccaaccagaccccacccaggcacauuagcgaccaggcuug

SEQ ID NO: 54184 - RNA, 61 nt, Human
ggccugggugggcaggcaggaccugggcccucccacccaucagagcccacucaggaccagc

SEQ ID NO: 54185 - RNA, 61 nt, Human
cugcugagaaauccuuuuagcgccagcaagccccacccagggcccuguccugugucugcca

SEQ ID NO: 54186 - RNA, 61 nt, Human
guggcagcuccccaaggcccugccccccagccccacccacucaugacucuaaguguguugu

SEQ ID NO: 54187 - RNA, 61 nt, Human
cuccugcuucuugccuaccacuuggccagugcccacccagccccucagguggcacaucugg

SEQ ID NO: 54188 - RNA, 61 nt, Human
aacaagaguuagcagcgagguccccaugagucccacccaugaccugccgacaguguugccc

SEQ ID NO: 54189 - RNA, 61 nt, Human
caaacagacccuguggccccugcccggcucccccacccauucugcuccccuagagaccucu

SEQ ID NO: 54190 - RNA, 61 nt, Human
gcaccuguggccagagcaccucaggacccuccccacccaccaaaugccucugccuugaugg

SEQ ID NO: 54191 - RNA, 61 nt, Human
cgggccgagugcccucuccguccccucuccucccacccacgccacaggccagccuacucuu

SEQ ID NO: 54192 - RNA, 61 nt, Human
ggcucagggccauguaccagaucugucugugcccacccaggcacagccacugccucccccu

SEQ ID NO: 54193 - RNA, 61 nt, Human
aggcuagucuugaacuccugaccucaaaugacccacccaccucagccucccaaagugcuga

SEQ ID NO: 54194 - RNA, 61 nt, Human
ccugugcucuuccuagggagcuguguuguuucccacccaccacccuucccucugaacaaau

SEQ ID NO: 54195 - RNA, 61 nt, Human
ugggucccuuggccauaucaaggcagcacggcccacccaggccucccauugccgcaacccc

SEQ ID NO: 54196 - RNA, 61 nt, Human
cagcugcucucuccaagcagguggcccagaucccacccacguggacuuucucaucaggugc

SEQ ID NO: 54197 - RNA, 61 nt, Human
gaaguggcuguccccuccucuccagccccugcccacccacugguggaggugcuaacuagca

SEQ ID NO: 54198 - RNA, 61 nt, Human
gguccacagucacucuuugugccucaguuuacccacccauuaaaugggaacauuacugucu

SEQ ID NO: 54199 - RNA, 61 nt, Human
ugccugagcaaaccugaggccucccggcagacccacccacccccuggggcugcucagccuc

SEQ ID NO: 54200 - RNA, 61 nt, Human
uccagccugggcucacccuguguggcucauucccacccaggaaacugaagauaaaagauuu

SEQ ID NO: 54201 - RNA, 61 nt, Human
uauagggaccucagggagccccagcuucuuacccacccaggaaacccuugguccagagagg

SEQ ID NO: 54202 - RNA, 61 nt, Human
ccccagggaagggguugcuguagagauagcccccacccaggggauggaggucuacccugga

SEQ ID NO: 54203 - RNA, 61 nt, Human
acuccauuuguuacucucuguucuuugacugcccacccacagaaaagcaaaauaaccaacu

SEQ ID NO: 54204 - RNA, 61 nt, Human
aguugucugccuuuuccuuuccaucccuugccccacccaucccaucuccaacccuagucuu

SEQ ID NO: 54205 - RNA, 61 nt, Human
gggcagcugcgccugccugcucggcccccagcccacccagccaaaaauacagcugggcuga

SEQ ID NO: 54206 - RNA, 61 nt, Human
uguuucugugggugagagauguguugcugugcccacccaguacagcuuccuccucugaccc

SEQ ID NO: 54207 - RNA, 61 nt, Human
ucucuuccccaacccuggauaccaguagcuucccacccaguccaaaccugcaccauccauc

SEQ ID NO: 54208 - RNA, 61 nt, Human
cccucaucuguaggauuugggcugccccaggcccacccagggggcucugaauguauuuugu

SEQ ID NO: 54209 - RNA, 61 nt, Human
guccuucagaguuucagcugcauccuggugucccacccaggucgagcccccaggcuucugg

SEQ ID NO: 54210 - RNA, 61 nt, Human
ggccucugagaggagcccacgacacugcagccccacccagaugccccuuucuggauuauuc

SEQ ID NO: 54211 - RNA, 61 nt, Human
ugacucuauccucauaccaccacugcugcuucccacccagcugagaaugcccccuccuccc

SEQ ID NO: 54212 - RNA, 61 nt, Human
acgugcugccaacucaaacauagccuccuuccccacccagcuggccacccuggccucagcu

SEQ ID NO: 54213 - RNA, 61 nt, Human
cuggaugccacccagugcagccuggcaccuacccacccacccuucagcuuaagccacuccc

SEQ ID NO: 54214 - RNA, 61 nt, Human
ccuggcgcagucgcuccucgagccgcugccccccacccacccugcaccccucgcccucccc

SEQ ID NO: 54215 - RNA, 61 nt, Human
gcccaccccucucugugccggcgccaccaaccccacccacacugcugccuggugcucccgc

SEQ ID NO: 54216 - RNA, 61 nt, Human
ccagucuccaggagccucucccuccgagauacccacccagcuuugucaaucacccaagcac

SEQ ID NO: 54217 - RNA, 61 nt, Human
cugcuccuccucuugaacuugggugggaaaccccacccaaaagcccccuuuguuacuuagg

SEQ ID NO: 54218 - RNA, 61 nt, Human
ccuugguacugccucugaacacucugguuuccccacccaacugcggcuaagucucuuuuuc

SEQ ID NO: 54219 - RNA, 61 nt, Human
cugcccucuguuugcucucucaacacacuuccccacccaccguccuccauuccagcccagg

SEQ ID NO: 54220 - RNA, 61 nt, Human
caugugcuaccaacacaugauacggggaagacccacccagggagcgguuucaguggcgcaa

SEQ ID NO: 54221 - RNA, 61 nt, Human
aagugaaagccagacagcccuaacaaagcaccccacccaccccugacauaccuacugucac

SEQ ID NO: 54222 - RNA, 61 nt, Human
caaacucucuaacuuauaaguguugugaacccccacccaggcaguauccaugaaagcacaa

SEQ ID NO: 54223 - RNA, 61 nt, Human
uguauuggggauucucugccagccugugucacccacccaccuccuucauuaucagcaauag

SEQ ID NO: 54224 - RNA, 61 nt, Human
augccugcaaccuugcauccaucugggcuaccccacccaaguauacaauaaagucuuaccu

SEQ ID NO: 54225 - RNA, 61 nt, Human
uuucugcuugacaauguagcaacccaggccccccacccacgguccuccccuuuuuccucuc

SEQ ID NO: 54226 - RNA, 61 nt, Human
gcacagaccucucccacccacaagaacuccucccacccaacuuccccuuagagugcuguga

SEQ ID NO: 54227 - RNA, 61 nt, Human
aggaucggcuuccucaggggcacagaccucucccacccacaagaacuccucccacccaacu

SEQ ID NO: 54228 - RNA, 61 nt, Human
caucaaucucuuggggugauuaaucaaauuacccacccaaggcuucuagaaggagcuuccu

SEQ ID NO: 54229 - RNA, 61 nt, Human
cucugaauuuuucgaaagggauucuccuaaacccacccacuucucuugcccaggcugcuuu

SEQ ID NO: 54230 - RNA, 61 nt, Human
ggagggaaacuaagaaaugguugacagcguucccacccaucuacaauguuauuuuaggugc

SEQ ID NO: 54231 - RNA, 61 nt, Human
uccaauggauugugcaaauccccuccccaaacccacccauaccagcuagaaucacuugacu

SEQ ID NO: 54232 - RNA, 61 nt, Human
caguggccuggcuggcguggcagggccaaggcccacccacugccaucccccuucugugugu

SEQ ID NO: 54233 - RNA, 61 nt, Human
aaaggaaggagccuucugagacccuccccaacccacccagguucccaaggcccugccguac

SEQ ID NO: 54234 - RNA, 61 nt, Human
uuagaaaaauugggauuuccccccaccccgccccacccagauaaacuauaucuacacuguc

SEQ ID NO: 54235 - RNA, 61 nt, Human
uuaauggcuaaaucuuuaaaagccaaugcaacccacccaauugaaucugcauuuucuuuua

SEQ ID NO: 54236 - RNA, 61 nt, Human
aagccuuucuucuaaaaacgaaaaaagaccccccacccaaaauguuucgagucaacaaauu

SEQ ID NO: 54237 - RNA, 61 nt, Human
cggccuggaaggagaagguguccacggagcccccacccauccucggcgguucccaucacca

SEQ ID NO: 54238 - RNA, 61 nt, Human
gcuuuugcuuuugcuuuuguuuguuucuucccccacccagugcagaaaucaggaucaggga

SEQ ID NO: 54239 - RNA, 61 nt, Human
ugcuagacuccucaggagagaccccuccccucccacccacagccauagaccuacagaccug

SEQ ID NO: 54240 - RNA, 61 nt, Human
uggggggcacguggacaugccccauaggggccccacccagacuuaacaggcaagguccugg

SEQ ID NO: 54241 - RNA, 61 nt, Human
caucugcugaaaacgguaaaacuaauuagugcccacccacccuccccgccccagcaacugc

SEQ ID NO: 54242 - RNA, 61 nt, Human
gacacauauagcagcauauuuugcucuuaaccccacccaccuuuuuaaucacacuagauuu

SEQ ID NO: 54243 - RNA, 61 nt, Human
cugucucaccaguggccugcccucucgcucccccacccagcccacccauugaagucuccuu

SEQ ID NO: 54244 - RNA, 61 nt, Human
caguggccugcccucucgcucccccacccagcccacccauugaagucuccuugggccacca

SEQ ID NO: 54245 - RNA, 61 nt, Human
ccgcgcuucgaacuccaggcuuucuggaguucccacccaagcccuccuuuggagcaaagaa

SEQ ID NO: 54246 - RNA, 61 nt, Human
ggcacaggggggcauuuggcacagcaaaaagcccacccaggacuuagccucaguugacgau

SEQ ID NO: 54247 - RNA, 61 nt, Human
aucuucuggaauacauuagcucuuucaaaaacccacccaguguuuagccucaacggcagcc

SEQ ID NO: 54248 - RNA, 61 nt, Human
cugugcaggcccaggcaggcccagccucugccccacccaucaguggaguccagauggcagg

SEQ ID NO: 54249 - RNA, 61 nt, Human
aggcucccgaccccauccaccuauccaccaccccacccaccuuugcagggaauaccucguu

SEQ ID NO: 54250 - RNA, 61 nt, Human
ggagaggggcgugcugcggggcccugaugcccccacccaccucgguccagcgcggcccugc

SEQ ID NO: 54251 - RNA, 61 nt, Human
cugcgugugauuugucucugagcccccugugcccacccagggcccggcacagagucgaugc

SEQ ID NO: 54252 - RNA, 61 nt, Human
ugcucacauagccgguccccacgcccagcggcccacccaccagcagcugcuggaggucgua

SEQ ID NO: 54253 - RNA, 61 nt, Human
cguggcgcuguccgcucucccucuccugcugcccacccaccugccaguguuauuuaugcuc

SEQ ID NO: 54254 - RNA, 61 nt, Human
ccagggugucaggaaggcaggggugccgggucccacccaguggaguaacaaacugugggug

SEQ ID NO: 54255 - RNA, 61 nt, Human
gcggcgggcguaggagggugggcuggcgguacccacccagcccaagggagucacagugccu

SEQ ID NO: 54256 - RNA, 61 nt, Human
ucaggaccugcagacaguacaggcuagauaacccacccaauuuccccacuguccucugauc

SEQ ID NO: 54257 - RNA, 57 nt, Human
ggguuaugaacccaguguaagagaccacccacccagagccucagcacugucugacuu

SEQ ID NO: 54258 - RNA, 61 nt, Human
ccgugauuaguagcccguaugaucacguagacccacccaacacacuccugcacacuggccc

SEQ ID NO: 54259 - RNA, 61 nt, Human
uggaggugcccuaccugcauccugcugcacccccacccacgacacucgagugcaagaucgc

SEQ ID NO: 54260 - RNA, 61 nt, Human
cagccagcccgugaggugaccugagcaugcgcccacccacucaucugucccugaccucuaa

SEQ ID NO: 54261 - RNA, 61 nt, Human
ggcagagagggauggggucccugagccaggccccacccaucacagcauucccagguccugg

SEQ ID NO: 54262 - RNA, 51 nt, Human
ucuuccucaccuccuucuagccccacccagggcuucccuaacuccuccccu

SEQ ID NO: 54263 - RNA, 61 nt, Human
ucagggguuuggucacaaaggauggacucuucccacccagaggaugcagggaaagcacacu

SEQ ID NO: 54264 - RNA, 61 nt, Human
aaccgcugauucucagggucucugcugccgccccacccagaugggggaaagcacagguggg

SEQ ID NO: 54265 - RNA, 61 nt, Human
gagcccaggagccugccaggcugacgugcaucccacccagacgguguccucuucuugucgc

SEQ ID NO: 54266 - RNA, 61 nt, Human
acuuauacaaaccuagaugggacaccuaugacccacccaggccagaugguacagccuguug

SEQ ID NO: 54267 - RNA, 61 nt, Human
ccucugacaaguugacucuucgacccccacccccacccaagacauuuuaauaguaaauaga

SEQ ID NO: 54268 - RNA, 61 nt, Human
cccuaacaggaagguguccaguucaagagaacccacccagagacugggagugguggcucac

SEQ ID NO: 54269 - RNA, 61 nt, Human
ucagugcuucugcuugcccugccccaggcagcccacccacgcccagugcggguguggagaa

SEQ ID NO: 54270 - RNA, 61 nt, Human
cagcccagagccuggcugcccaucauguggccccacccaaucaagggaagaaggaggaaug

SEQ ID NO: 54271 - RNA, 61 nt, Human
gugguccccugcaaucacuguuuguccccuacccacccaaccugucccugccugcucccag

SEQ ID NO: 54272 - RNA, 61 nt, Human
cacucaggaaaacaggaaaggagguuccagccccacccaccugcccaccccgccccaggca

SEQ ID NO: 54273 - RNA, 61 nt, Human
aauaugaauuucugcaccguuucagacuucgcccacccaucccuccccucgucuccugcag

SEQ ID NO: 54274 - RNA, 61 nt, Human
gggcagacacaacagcguggcuuagauugugcccacccagggaaggugcugaaugggaccc

SEQ ID NO: 54275 - RNA, 61 nt, Human
ccugccagcagcccuacagcuccacacccuacccacccaucggcagccccucugcuguucc

SEQ ID NO: 54276 - RNA, 61 nt, Human
ggucgcucaaagcucagacucaggucugaaacccacccacccgcaagccuaccagccuugu

SEQ ID NO: 54277 - RNA, 61 nt, Human
ccugagcuucguagccaaagcagccugaugacccacccaccaaggaagaaagcagaauaaa

SEQ ID NO: 54278 - RNA, 61 nt, Human
cgccugcuccccacacggacuccaggcgguccccacccacagaagcagaccuucagcucag

SEQ ID NO: 54279 - RNA, 61 nt, Human
ccgggguggcccuggaggccccugaccccaccccacccacagagcacgagggccccgucag

SEQ ID NO: 54280 - RNA, 61 nt, Human
gggcagggacagggcagaggacucugagcgccccacccaugccugccuggccugguagaga

SEQ ID NO: 54281 - RNA, 61 nt, Human
cccagaggaaugccucgcacaaaaggucuuccccacccacccccagcccccuagucuaaua

SEQ ID NO: 54282 - RNA, 61 nt, Human
ugucuguuuggcugacacagcagcagcccuucccacccagccaccuuccucacagggacua

SEQ ID NO: 54283 - RNA, 61 nt, Human
cagggccgacguuccaccuggggcuucccuccccacccaccccgacuccaggcuuucccuu

SEQ ID NO: 54284 - RNA, 61 nt, Human
ugggaaagaaccacauuuuaggaauuugcuucccacccagugcccugcauuuaaucagcac

SEQ ID NO: 54285 - RNA, 61 nt, Human
gcacauuccucacugaaaaagaaaacacacacccacccacacacacacacacagaagaaaa

SEQ ID NO: 54286 - RNA, 61 nt, Human
gugggggguuccugcucugccccugcccguccccacccagucuugcccucccauccucuca

SEQ ID NO: 54287 - RNA, 61 nt, Human
ugggauuccugagugucagugacuugggauucccacccagggacucaagccagccaccccc

SEQ ID NO: 54288 - RNA, 61 nt, Human
accccgaggccuugcucucagagcgggaggccccacccacuggagagccccgccccuaagg

SEQ ID NO: 54289 - RNA, 61 nt, Human
gggaaggccaagugggaggcugggaggcugccccacccaccgacucuaccaagucucucuu

SEQ ID NO: 54290 - RNA, 61 nt, Human
cugccugggaucccucauccucauacccacccccacccaagggccuggccugagcugggau

SEQ ID NO: 54291 - RNA, 61 nt, Human
ggguuuguuuuggggggugggaguugauccucccacccagucugccccuggucucugccca

SEQ ID NO: 54292 - RNA, 61 nt, Human
acacaaagaaaauauuggggucacuggcgagcccacccacacucaccagaaucuccacugu

SEQ ID NO: 54293 - RNA, 61 nt, Human
ggcuauagcuuauacaguaucuccccuuguccccacccagucaccaaagccaccuacauga

SEQ ID NO: 54294 - RNA, 61 nt, Human
gucgggcuauugucacagagaaaagaagagacccacccacucgggcugcaaaaggugaaaa

SEQ ID NO: 54295 - RNA, 61 nt, Human
gcccaucgugcacaccugcccaucgugcacacccacccauggugcacaccuguaguccucc

SEQ ID NO: 54296 - RNA, 61 nt, Human
cuugccccaugggaaccuccaccuccuacuccccacccaccucugcgaaucugcucccaaa

SEQ ID NO: 54297 - RNA, 61 nt, Human
acaugcauaugaaaaacaucacuuacguucucccacccauagacauaaaaaagggugaccu

SEQ ID NO: 54298 - RNA, 61 nt, Human
ucucucgucugucugucugucugcccacucccccacccaccacugugcguuucugauuucc

SEQ ID NO: 54299 - RNA, 61 nt, Human
ucaacucucucggcgguagggcggugccauccccacccauagggcuggcucacauccaguc

SEQ ID NO: 54300 - RNA, 61 nt, Human
ccacugaagcucucgccccuguaacuuauaccccacccagcucaguuuugucacuuuucua

SEQ ID NO: 54301 - RNA, 61 nt, Human
augccuaaaaaagcuaaaggccaccccaccccccacccaccaccuccugccuccucuccuc

SEQ ID NO: 54302 - RNA, 61 nt, Human
uguccuuccuucaggaagauguccacucaugcccacccaugagagggcuugccguaugccc

SEQ ID NO: 54303 - RNA, 61 nt, Human
aguccguagccccgccccggcgcuggucccgcccacccagacaccgcccacuucccggccc

SEQ ID NO: 54304 - RNA, 61 nt, Human
auguggcccagccggcuggaaccucaagggccccacccaccgagauugcagcggcucuggc

SEQ ID NO: 54305 - RNA, 61 nt, Human
uagcuccucacagcugccuugcaccaagggccccacccagcucgguguucugagaccucgg

SEQ ID NO: 54306 - RNA, 61 nt, Human
acaccucccucagcaccaagaccgggacccccccacccacgugucucauuguggcugccua

SEQ ID NO: 54307 - RNA, 61 nt, Human
gggcccccacaccagaccccaacauagcuuccccacccaggcacccccucccggggcagca

SEQ ID NO: 54308 - RNA, 61 nt, Human
cugcacccuggcauucucacagagcuggcugcccacccaguggggggcuauagccucagag

SEQ ID NO: 54309 - RNA, 61 nt, Human
ccuggccugccggacacagcaccgugccaaccccacccagcuccaggcccaccggaugcug

SEQ ID NO: 54310 - RNA, 61 nt, Human
gggucagcccucuugacugucacaugcugcccccacccagccuaaaauaaagagcucacug

SEQ ID NO: 54311 - RNA, 61 nt, Human
ggcagagggagauuucaagggccuuuucuagcccacccaaaggacaaauggggagcucuag

SEQ ID NO: 54312 - RNA, 61 nt, Human
cucacuggcccagugguguucucacuccuaccccacccacccccugccuguccccaaauug

SEQ ID NO: 54313 - RNA, 61 nt, Human
uccccugagaguuauaggaagugcccacugacccacccacccaccuacaccccccgccaca

SEQ ID NO: 54314 - RNA, 61 nt, Human
cugagaguuauaggaagugcccacugacccacccacccaccuacaccccccgccacacaca

SEQ ID NO: 54315 - RNA, 61 nt, Human
gaccaugacccaggcauccuugucccccucacccacccagagcuaggggcgggaacagccc

SEQ ID NO: 54316 - RNA, 61 nt, Human
caaaucaggucaaugugugcccuccugagcucccacccaggcaucuccagugcucaugauc

SEQ ID NO: 54317 - RNA, 61 nt, Human
agccucgacccucuucugugcuggacuuccacccacccacccuuuucaaguuuagauagug

SEQ ID NO: 54318 - RNA, 61 nt, Human
cccuuuccuucucuagugccugggccugggacccacccagagcaccugugcuggaggaugc

SEQ ID NO: 54319 - RNA, 61 nt, Human
uuuaugucgcaugucaauccgaagagugaugcccacccaagaaguucaggagcugccgauu

SEQ ID NO: 54320 - RNA, 61 nt, Human
cgugcacacacacaaauuauucagauguacacccacccacauaucuuacagccagaggaac

SEQ ID NO: 54321 - RNA, 61 nt, Human
cuuaauagaauaguacaauaaaacacaaccccccacccagcauuaaaaaauaguuuuacug

SEQ ID NO: 54322 - RNA, 61 nt, Human
cugugagggcuguaccuggugcccuguggcccccacccaccuggauucccuguucuuugaa

SEQ ID NO: 54323 - RNA, 61 nt, Human
cucacccccuacacacacaugagagagagcccccacccaguuccuuggccuaggucucccc

SEQ ID NO: 54324 - RNA, 61 nt, Human
cuccccugccaagagucaaccacuaagcaaucccacccaagccuggaugcuucuagagggg

SEQ ID NO: 54325 - RNA, 61 nt, Human
caaaccaauugcauuuuaguugggcagugcucccacccacccuccagaucccuuccagcua

SEQ ID NO: 54326 - RNA, 61 nt, Human
caaucucaucugauaugcagaguauuucugccccacccaccuaccccccaaaaaaagcuga

SEQ ID NO: 54327 - RNA, 61 nt, Human
acugcaguauccauaacccccugcccacguccccacccacgggggagacggagagauauaa

SEQ ID NO: 54328 - RNA, 61 nt, Human
ccaggccuggagggcacuuccuccacagucccccacccaccuccugcggcucagccuugca

SEQ ID NO: 54329 - RNA, 59 nt, Human
uggagaacagcaagaucuagggcaccagccccacccacuggcuguuucuccguccucuc

SEQ ID NO: 54330 - RNA, 61 nt, Human
uucaaaagagcuaaccccuucccacacuccacccacccaccuacauuuccucugugaaauc

SEQ ID NO: 54331 - RNA, 61 nt, Human
gugaggaacccugaucucucagccccaaacacccacccaauuggcccaacacugucugccc

SEQ ID NO: 54332 - RNA, 61 nt, Human
gagcaaaagcagaaguggaccaccaucagcucccacccacccagcgauuuuuccuuggagg

SEQ ID NO: 54333 - RNA, 61 nt, Human
aaaagcagaaguggaccaccaucagcucccacccacccagcgauuuuuccuuggaggucag

SEQ ID NO: 54334 - RNA, 61 nt, Human
cauucuucaccuccuuggcgcugccaccugccccacccaguuucuggaaaaaguugaugcu

SEQ ID NO: 54335 - RNA, 61 nt, Human
cuugcugagccuccuugucuauccuuccucccccacccaccauuguaaaguuuaugucacc

SEQ ID NO: 54336 - RNA, 61 nt, Human
ccucugcccugccccacccccaccaccuguccccacccagugucccaggccacaggagcuu

SEQ ID NO: 54337 - RNA, 61 nt, Human
ugccaguguuugggugggugucauggguguccccacccacuccucaguguuuguggagucg

SEQ ID NO: 54338 - RNA, 61 nt, Human
cucagcgggucaggccuucagaacacugccacccacccaguuuuauaaucccgcucccucu

SEQ ID NO: 54339 - RNA, 61 nt, Human
guuuuauaaucccgcucccucuccaggcaaccccacccaccagccuaggccugcuccucca

SEQ ID NO: 54340 - RNA, 61 nt, Human
ccgccccuccucggacagccagcugcacccgcccacccagcggcgacauuguacagacucc

SEQ ID NO: 54341 - RNA, 61 nt, Human
gaaguuggggcacugggcgucugacucccuccccacccaagagaggaaggaccccucacca

SEQ ID NO: 54342 - RNA, 61 nt, Human
gcugugggagacgucuggccacaggcagugccccacccagucuuggagagagaugaauguu

SEQ ID NO: 54343 - RNA, 61 nt, Human
auaggaaacuauuuuuuaaaaaaagccauuucccacccaaggacacaguggauguguuuuc

SEQ ID NO: 54344 - RNA, 61 nt, Human
acuacccauggcaggaaccuaguacaggucucccacccagggccuuccacccucggcuccu

SEQ ID NO: 54345 - RNA, 61 nt, Human
cacacauuccagccaggcccaggccagcccccccacccacccccaggccuccuaggggaag

SEQ ID NO: 54346 - RNA, 61 nt, Human
ccccagcagcugcucugcucaccagccugaccccacccagagcaggagcuggcgggugucu

SEQ ID NO: 54347 - RNA, 61 nt, Human
gcuggucucgaacuccugaccuggugaucugcccacccaggccucccaaagugcugggauu

SEQ ID NO: 54348 - RNA, 61 nt, Human
auccagccuuagcucgcaccgacuucaauuucccacccaucuccaguaggaaauugauuuu

SEQ ID NO: 54349 - RNA, 61 nt, Human
ccugcucugugauuggauaaauauuucccaucccacccaccuccccccaaaaaauagcuca

SEQ ID NO: 54350 - RNA, 61 nt, Human
ucuccaccuguugguggggggugcuccucgacccacccagauuugaccguucagggggccu

SEQ ID NO: 54351 - RNA, 61 nt, Human
gcccugggccugcaggagaggcugagaccagcccacccagccaguggucgagcacugcccc

SEQ ID NO: 54352 - RNA, 61 nt, Human
ggcucuaucccacacccacccccaccccacccccacccagccuccagaagcuggaaccauu

SEQ ID NO: 54353 - RNA, 61 nt, Human
agcucuggggacagcuuccucacaccccugucccacccacacagcugcccuagcugacccc

SEQ ID NO: 54354 - RNA, 61 nt, Human
gcccuguccuggcccaggccucugcccucugcccacccagcgucagcccccagaaaaaagg

SEQ ID NO: 54355 - RNA, 61 nt, Human
gcugccuuccccucagccucuccccacaccacccacccagcugcugucauuccgcucacug

SEQ ID NO: 54356 - RNA, 61 nt, Human
cgcacccagcaacuccugacagaaagcuccucccacccaaaugggccaggccccagcauga

SEQ ID NO: 54357 - RNA, 61 nt, Human
acuaagccagcaccggaccagccuggcccaccccacccacuucugcacuugcgguuccggc

SEQ ID NO: 54358 - RNA, 61 nt, Human
gcuccgucaguaucaggccugccagacggcacccacccagcacccagcaacuccaacuaac

SEQ ID NO: 54359 - RNA, 61 nt, Human
gagucagguggugggaguaccagccccccagcccacccacuuggcccacucagcccauuca

SEQ ID NO: 54360 - RNA, 61 nt, Human
ccuucccugggggcgauuagcugcugagucacccacccagccuuggagcuggaugccugug

SEQ ID NO: 54361 - RNA, 61 nt, Human
ggcaggccacugcugggacagggucuaugggcccacccagugccuuuccuuggcccucacu

SEQ ID NO: 54362 - RNA, 61 nt, Human
cggcgggugcucugaggccucacuacucgagcccacccagcaucccgcgcgcccuuccuuc

SEQ ID NO: 54363 - RNA, 61 nt, Human
ucacuuccagcuugccuguuucuucucuacacccacccaaaagucacccagggacacucca

SEQ ID NO: 54364 - RNA, 61 nt, Human
guaaacucccuccaucccaaccuggcucccucccacccaaccaacuuuccccccaacccgg

SEQ ID NO: 54365 - RNA, 61 nt, Human
uauccucagaaauguauucugcacccccggccccacccaugcugagggaaggggagcaguu

SEQ ID NO: 54366 - RNA, 61 nt, Human
cagcugccccaagcgggguagcagccuugaacccacccagcugggacaccaccagaagguc

SEQ ID NO: 54367 - RNA, 61 nt, Human
ccuuaccuguccucagaaaggaagaggugaccccacccagccaccucucccuuuuauggaa

SEQ ID NO: 54368 - RNA, 61 nt, Human
ggcccgcucaccuuccucaccccuccucugacccacccauggugccagggccgaagcugac

SEQ ID NO: 54369 - RNA, 61 nt, Human
gagugccuccgaccccccuccucagcccucccccacccacaggcccagccuccucggucuc

SEQ ID NO: 54370 - RNA, 61 nt, Human
cccaccaccuggacagaggccacacugacugcccacccagcuguggcgggaggugcagagc

SEQ ID NO: 54371 - RNA, 61 nt, Human
cgaggcugcuagauguagguguuaggcaugucccacccacccgccgccucccacggcaccu

SEQ ID NO: 54372 - RNA, 61 nt, Human
agcccggcagaggacgggaggagaccagucccccacccagccguaccagaaauaaaggcuu

SEQ ID NO: 54373 - RNA, 61 nt, Human
ugggcacgcggcccucuccugucagugccggcccacccaccagcaggcccccaacccccag

SEQ ID NO: 54374 - RNA, 61 nt, Human
gcgguuagccugacucuucuuccccccagcccccacccacugcuguguugugugugcuaga

SEQ ID NO: 54375 - RNA, 61 nt, Human
caacacaucuucaaggcggcagagcugugcgcccacccagcuauugaaaaggacuuucugu

SEQ ID NO: 54376 - RNA, 61 nt, Human
caagcccauggaggaaaguuacugcugaggacccacccaauggaaggauucuucucagccu

SEQ ID NO: 54377 - RNA, 61 nt, Human
cuugagacugagccaacccccaguguguggccccacccauguuauuuuuguuuuuguuuuu

SEQ ID NO: 54378 - RNA, 61 nt, Human
ugauuccagcaaguacagagauucuaugaagcccacccagaaaaaacuugcugguccuggc

SEQ ID NO: 54379 - RNA, 61 nt, Human
aguugcuuuacguggccuguuucaacacagacccacccagagcccuccugcccuccuuccg

SEQ ID NO: 54380 - RNA, 61 nt, Human
auagcaccagggcucacgugggaaccccccucccacccaccgccacaauaaagaucgcccc

SEQ ID NO: 54381 - RNA, 61 nt, Human
acaugccccgccaaguacugcacagggaccccccacccaggggaccugcuccgugagauaa

SEQ ID NO: 54382 - RNA, 61 nt, Human
uggggcgcgaccuugugcgaggcccucggggcccacccacagcggcccagggccagacccu

SEQ ID NO: 54383 - RNA, 61 nt, Human
aaggcagaagaagaagaagaagaaauaaaaacccacccaagcaagaagacaaaagguaaag

SEQ ID NO: 54384 - RNA, 61 nt, Human
gagaggguggggcgggcugggguuggagggucccacccaccacccugcugugcuugggaac

SEQ ID NO: 54385 - RNA, 61 nt, Human
auguuugaggcuagacggggaggggccaggacccacccacugcuccugggggaugaggucc

SEQ ID NO: 54386 - RNA, 61 nt, Human
gggaagcggagaccagggugcaggcuccgcccccacccaaggccgggcccagccagaggag

SEQ ID NO: 54387 - RNA, 61 nt, Human
ccaacaccagccucaccuaggcccccaggcacccacccagcugggguguuuuugggggagu

SEQ ID NO: 54388 - RNA, 61 nt, Human
ggcagggacgaggccugguguccucgcuccacccacccacgcugcugucaccugaggggaa

SEQ ID NO: 54389 - RNA, 61 nt, Human
cuggcucaggaccccagggagaaacgcucuccccacccacgccaugcugaccagagaucuu

SEQ ID NO: 54390 - RNA, 61 nt, Human
accuaggacugaggacagagaguggggggugcccacccaccccccccgccccgggccuacc

SEQ ID NO: 54391 - RNA, 61 nt, Human
cugaugaucugucuccagccccuuccuucugcccacccacccuucuucccucugggcaacu

SEQ ID NO: 54392 - RNA, 61 nt, Human
agcugcagcccaggcaggagcagucgccuuucccacccacagcgcuggccacagggcuccc

SEQ ID NO: 54393 - RNA, 61 nt, Human
ccccaaaacugacaccuuuguuagccaccuccccacccacauacauuucugccaguguuca

SEQ ID NO: 54394 - RNA, 61 nt, Human
cuguuuucuuuuuuuccccuuucccccugcccccacccacggggccuuuuuuuggaggugg

SEQ ID NO: 54395 - RNA, 61 nt, Human
gcucucuuuguaagagaggaaagaaacuaaacccacccaagggaugaugucagggggagag

SEQ ID NO: 54396 - RNA, 61 nt, Human
uagccuuugcccugucacccccgaaucaugacccacccagugucuuucgagguggguuugu

SEQ ID NO: 54397 - RNA, 61 nt, Human
agccgugaccaccugcugugaggcccgaccacccacccagaaucugcccaguccccacuuc

SEQ ID NO: 54398 - RNA, 61 nt, Human
accugugaccucaauacaauaaaugugaucccccacccaaacuugucugugucugccucgc

SEQ ID NO: 54399 - RNA, 61 nt, Human
gacacucccaguugcagggaggguagauggccccacccagaccgagagacacagugaugac

SEQ ID NO: 54400 - RNA, 61 nt, Human
gcaccccagccccgccucugcucccccccaccccacccacccucggggcgccccccucccc

SEQ ID NO: 54401 - RNA, 61 nt, Human
aguagaaccccugggcugaggccugcagugacccacccaccuaccuuugcaucaccuaccu

SEQ ID NO: 54402 - RNA, 61 nt, Human
gcuauuuuuccuguaacaucugcugaacgggcccacccacacguuguauauucagagagag

SEQ ID NO: 54403 - RNA, 61 nt, Human
gcuguuuguguuacccucacuguccccaugucccacccacguccuacggcacucaggaagc

SEQ ID NO: 54404 - RNA, 61 nt, Human
gucccagccgccacccaaggagccccauccgcccacccacccugggacccacgcggccacu

SEQ ID NO: 54405 - RNA, 61 nt, Human
cgugguggugggcaccuguacuggggaggugcccacccagcuacuggggaggcugagucag

SEQ ID NO: 54406 - RNA, 61 nt, Human
ucccaggaggccuccuggaagcccaggacugcccacccaccacgcuggugcccaccgccug

SEQ ID NO: 54407 - RNA, 61 nt, Human
cgcgccgggagcgcuccccggaaugagccgccccacccaccccaaggcuggagccgcugca

SEQ ID NO: 54408 - RNA, 61 nt, Human
gagggcgccaccaccaccugacggcuggggacccacccagccccucuccccucucugcucc

SEQ ID NO: 54409 - RNA, 61 nt, Human
ccacaggucugagcagggagcaacucaggcccccacccaagccugcgucagcggaacuuga

SEQ ID NO: 54410 - RNA, 61 nt, Human
cucaagugacucagccugguuggagaacugccccacccaguaucuucugugccaugguucc

SEQ ID NO: 54411 - RNA, 61 nt, Human
cuccaaauaaguacgauaacauagucauagucccacccaacaugaugcaguuaucuugcau

SEQ ID NO: 54412 - RNA, 61 nt, Human
caaaagcaaguagccaaagccguugccaaaccccacccauaaaucaaugggcccuuuauuu

SEQ ID NO: 54413 - RNA, 61 nt, Human
acuucgauaagugagaccugcucagcccacccccacccauccucagcuaccccgagaggua

SEQ ID NO: 54414 - RNA, 61 nt, Human
aggaaugggggagaggacgugagggaccacccccacccacacagcugccgcagcaucucac

SEQ ID NO: 54415 - RNA, 61 nt, Human
cucgguuuaaccagggcucuguaagaccacucccacccagagacuuguguggccuggugug

SEQ ID NO: 54416 - RNA, 61 nt, Human
ucagccucaucuggagccccugaagaccagucccacccaccuuucuggccucaucugacac

SEQ ID NO: 54417 - RNA, 61 nt, Human
ggagcugcccccccaguggacaccauuggaccccacccagccuggaucuaccccaggagac

SEQ ID NO: 54418 - RNA, 61 nt, Human
cuugcccggaccaacgucuugaagcuuuucucccacccauuuuuguauaugggauaagggu

SEQ ID NO: 54419 - RNA, 61 nt, Human
ggcauuagaagggggagggguggcuggggcccccacccauucccccucccuccaaacuccc

SEQ ID NO: 54420 - RNA, 61 nt, Human
aggcagggagcugcugugaguccagcugaggcccacccagguggucccuccagcccugguu

SEQ ID NO: 54421 - RNA, 61 nt, Human
acgucggccgucgggaaagcacggggccuuucccacccacccucagccagcgccacacggc

SEQ ID NO: 54422 - RNA, 61 nt, Human
gggcacagccccuccccacuccggccacgcccccacccaccccgcguguuucugcccugug

SEQ ID NO: 54423 - RNA, 61 nt, Human
ggugucaggcaggcagguggcaggcagcucacccacccaccccaugggaucccccagcccu

SEQ ID NO: 54424 - RNA, 61 nt, Human
ccaggggaaaagagaguuaaggacacucacccccacccacgcacacacacaaggcagcguc

SEQ ID NO: 54425 - RNA, 61 nt, Human
ggauccgagggcgccccggacagaggucugccccacccacuuccuccccaccaccugugcc

SEQ ID NO: 54426 - RNA, 61 nt, Human
acugggcccugggaacuggcacccauggggccccacccaugagugaugguucuggcugauu

SEQ ID NO: 54427 - RNA, 61 nt, Human
ucucuguccuuccaccccucccuccuugcuucccacccauuccucaucccucacucccacc

SEQ ID NO: 54428 - RNA, 61 nt, Human
uacugcagucuggcucuuucuccccucccuccccacccaagccucaccuccccaccccuug

SEQ ID NO: 54429 - RNA, 61 nt, Human
agcugcagcugcuagagauggcccccaaccccccacccaccccucuccugccucggcaggg

SEQ ID NO: 54430 - RNA, 61 nt, Human
gcccgggggaagggugaaauugggguucaggcccacccagggggccgcuucccacucuugg

SEQ ID NO: 54431 - RNA, 61 nt, Human
uagaagcugaauagugacgcccucccccaagcccacccagccgcacacaggccuagaggua

SEQ ID NO: 54432 - RNA, 61 nt, Human
gcuuaacuccagcccccacccacacccccaucccacccaaccacaggccccacuugcuaag

SEQ ID NO: 54433 - RNA, 61 nt, Human
uggaaagaggggcucacgcuuaacuccagcccccacccacacccccaucccacccaaccac

SEQ ID NO: 54434 - RNA, 61 nt, Human
gggugcgaacucacagugacuguccuacccacccacccaccucuguagagucccagaaaca

SEQ ID NO: 54435 - RNA, 58 nt, Human
ugggugcgaacucacagugacuguccuacccacccacccaccucuguagagucccaga

SEQ ID NO: 54436 - RNA, 61 nt, Human
aagaggcuccauguggcuccugcuucacuuucccacccauuuagggagacaaucaagcucu

SEQ ID NO: 54437 - RNA, 53 nt, Human
gacaggcgggcaaacagugagcgcccacccagaccggcugcugcgcccccucc

SEQ ID NO: 54438 - RNA, 61 nt, Human
ucucacccaguuccucucuccuucccugacccccacccacauuucccuccuuagagaucca

SEQ ID NO: 54439 - RNA, 53 nt, Human
gccagccugcuguaagcuaagaacccacccacagcagcccucgggggugucac

SEQ ID NO: 54440 - RNA, 61 nt, Human
guuuacuggaacgagggcgaggaacaccuggcccacccagggcggaaaaccgcuuaaaggg

SEQ ID NO: 54441 - RNA, 60 nt, Human
cauucgagauugaacuguagcccgagccgccccacccacuccaucaucuccaggugcccc

SEQ ID NO: 54442 - RNA, 61 nt, Human
agaaacagucugauaugguuuggcucuguuccccacccaaaucccaucucaauuuuaaucc

SEQ ID NO: 54443 - RNA, 61 nt, Human
gcccucuggcccccuccaucucuuguccguucccacccaccccccuccucggcccgagccu

SEQ ID NO: 54444 - RNA, 52 nt, Human
augaggaggaccugcgcuaagccccacccagccccccagugcccgucuuccu

SEQ ID NO: 54445 - RNA, 61 nt, Human
agaucugcacuggguguggccccgcagugcccccacccaguccgccaaacacuccaccccc

SEQ ID NO: 54446 - RNA, 56 nt, Human
agacgaugaagaacaauuagacuggacccacccaccacagcccaucacccuccauu

SEQ ID NO: 54447 - RNA, 61 nt, Human
gguuguuuguuugauaugguuuggcuguguccccacccaaaucuuaucuagaauuguaauc

SEQ ID NO: 54448 - RNA, 61 nt, Human
ucccccacagggguuacacccaucugguugucccacccacucuucagaggcuaggccccac

SEQ ID NO: 54449 - RNA, 61 nt, Human
guuugcccucuuucccccaggaggggcucgacccacccacccucccucucagaccaaggug

SEQ ID NO: 54450 - RNA, 61 nt, Human
acgcccugccuacucuuuguuuucuuuccuccccacccauuuucccccguccuguccccuc

SEQ ID NO: 54451 - RNA, 61 nt, Human
cauccucgcucccccaccuccuugggucaugcccacccacccuuuccugccuccuccgugu

SEQ ID NO: 54452 - RNA, 61 nt, Human
ucguggccagcccugcagcuucagcaccugccccacccagagugggagucagguggagcca

SEQ ID NO: 54453 - RNA, 61 nt, Human
ccgagcccacaccaucuggcccaggcuggcccccacccaccuuccuugcgaccaccaacac

SEQ ID NO: 54454 - RNA, 61 nt, Human
uaguuaacaaacgcccaucugcucacccaugcccacccagcgccgccgccgcuggcucucg

SEQ ID NO: 54455 - RNA, 61 nt, Human
ucccuacacccugaccggccacugccgcacacccacccagagcacgccacccgccauggga

SEQ ID NO: 54456 - RNA, 54 nt, Human
cccgguggaaguccaucugacaaccccacccaggccagggucgaaucuggaaug

SEQ ID NO: 54457 - RNA, 61 nt, Human
aucucagugcaggagagacagugaggcugcacccacccaggaguguggccacgugggcaaa

SEQ ID NO: 54458 - RNA, 61 nt, Human
ggaaggggccuacacccgucuuggggcucgccccacccagggcucccuccuggagcauccc

SEQ ID NO: 54459 - RNA, 61 nt, Human
gacaagaagugaauuugccuggggcagaacacccacccaaagaguccccacuuaacaauac

SEQ ID NO: 54460 - RNA, 61 nt, Human
ggcgcuugcagugcguugcacacccucaccucccacccacugauuauuaauaaagucuuuu

SEQ ID NO: 54461 - RNA, 61 nt, Human
acccccuccgugccacgcacugaaggccacccccacccaccugggaaacuaagaacuggau

SEQ ID NO: 54462 - RNA, 61 nt, Human
ugcagaagccuccuggccuggcugugucuuccccacccagcucuccccugcgccccugucu

SEQ ID NO: 54463 - RNA, 61 nt, Human
uggccuugcuggggccccuccugccuccacgcccacccagcgucgacccuugacccacgaa

SEQ ID NO: 54464 - RNA, 61 nt, Human
ggggauggggagagccuuugccuccaccauucccacccacccuccccuuaaacccucugcc

SEQ ID NO: 54465 - RNA, 61 nt, Human
gacuucacugaggcugucauugcugccuugccccacccauaggcccuguccauacccaugu

SEQ ID NO: 54466 - RNA, 61 nt, Human
uuggaaguuucuuccccgaguggagcuucgacccacccacuccaggaacccagagccacau

SEQ ID NO: 54467 - RNA, 61 nt, Human
cccucuuuccuugcaucccuauuccuugucccccacccacucuuccccccaucaagaaaag

SEQ ID NO: 54468 - RNA, 61 nt, Human
ugccugcgucuccuuggaguggcagauuccacccacccagcucugcccaugccucuccuuc

SEQ ID NO: 54469 - RNA, 61 nt, Human
gccaggccagucacaccgaccaccacccacucccacccacuguagugcucccaccccugga

SEQ ID NO: 54470 - RNA, 61 nt, Human
guccuccagaagccucuggcuagaggccagccccacccaggagggagggggcuauagcuac

SEQ ID NO: 54471 - RNA, 61 nt, Human
aaugggcaggagagaaggccuuuauuucucgcccacccauuccuccuguaccagcaccucc

SEQ ID NO: 54472 - RNA, 61 nt, Human
ugucauuugcauaucguuugcaugcccucaucccacccauucucagggcaguaugggaagc

SEQ ID NO: 54473 - RNA, 61 nt, Human
ccccauucuacauccccaccauuaaccaggccccacccacaagguagaaacaaccccuaga

SEQ ID NO: 54474 - RNA, 60 nt, Human
auagucaagucuuccagggcaaagccagcagcccacccaggucagguagccagcagggcu

SEQ ID NO: 54475 - RNA, 61 nt, Human
guguggcugugccgggcagccauccugcauucccacccagcgcgcagucuccaccucggcc

SEQ ID NO: 54476 - RNA, 61 nt, Human
gcggggcccacaggcagggguaugagugcgucccacccaacgcagcaccagccccggccac

SEQ ID NO: 54477 - RNA, 61 nt, Human
acccuacgggggucaggagagcccugcggcccccacccaccagcucagaaccugucacuaa

SEQ ID NO: 54478 - RNA, 61 nt, Human
cccaucgccugcugagucacuugucuguccacccacccagcccaguucuaggucguucccc

SEQ ID NO: 54479 - RNA, 61 nt, Human
aggccagccaugcccacgccccuccccagcccccacccaugccagcgcagcgccagggcuc

SEQ ID NO: 54480 - RNA, 61 nt, Human
ccaccucccugccaguccuuggaccucccagcccacccagccucagcacagcucaacacag

SEQ ID NO: 54481 - RNA, 61 nt, Human
uucggucagucuucugaagaaucucaaaaagcccacccaacuuucagcugacauuuccacc

SEQ ID NO: 54482 - RNA, 61 nt, Human
auacuauagugagcccaugcagcaccucucacccacccagagauggagcugcucugccuuc

SEQ ID NO: 54483 - RNA, 61 nt, Human
ccuguguucucuuaagcagauagcacauacccccacccaguaccaaauuucagaacacaag

SEQ ID NO: 54484 - RNA, 61 nt, Human
cauggccugggucgcacccccuccccacggccccacccacagggaccucaacuucugggcc

SEQ ID NO: 54485 - RNA, 61 nt, Human
ccaccucccugccaguccuuggaccucccagcccacccagccucagcacagcucagcacag

SEQ ID NO: 54486 - RNA, 61 nt, Human
cugcggagaccaagagaaggcgugugagcaacccacccacuggaagaucaccuacugagga

SEQ ID NO: 54487 - RNA, 61 nt, Human
guaccgggggucuccugaccugucuagcauucccacccacucuucugcacuucuugcaagg

SEQ ID NO: 54488 - RNA, 61 nt, Human
ccacccagaaguggggagagacuuugggccucccacccaguggggcuuggccuggcuucug

SEQ ID NO: 54489 - RNA, 61 nt, Human
gcaccagcgaaucugccugggcugcuccugucccacccacccucacugagauccauguaag

SEQ ID NO: 54490 - RNA, 61 nt, Human
gccaggggucccagcccgucuaccuccccaucccacccaggcccccagcuccccgcggggg

SEQ ID NO: 54491 - RNA, 61 nt, Human
ccguucaucaccacucgggggcaccgggccgcccacccacucccaaaauccgucaguauuc

SEQ ID NO: 54492 - RNA, 61 nt, Human
caagcuguaggcccauguuccagucccuccacccacccaccgggcucagcuccagggcaca

SEQ ID NO: 54493 - RNA, 61 nt, Human
acuucagggccuggguauccagcgagcccuccccacccacccacgguccucaccuggagcu

SEQ ID NO: 54494 - RNA, 61 nt, Human
cagggccuggguauccagcgagcccuccccacccacccacgguccucaccuggagcugugg

SEQ ID NO: 54495 - RNA, 61 nt, Human
cuggcaccucaacugugacaaucagcaaagccccacccaggcccccaucugggaugauggg

SEQ ID NO: 54496 - RNA, 61 nt, Human
cagauccucugcaaucuaccugcaccccugacccacccaggaguuggaccgggaguuggga

SEQ ID NO: 54497 - RNA, 61 nt, Human
cagcagcuccaacccugccucuguccccuuccccacccacugccugagccuucugagcaga

SEQ ID NO: 54498 - RNA, 61 nt, Human
aaccgcagcucgcgaggcaccucuccucguccccacccacccccacauuugcacaccuucc

SEQ ID NO: 54499 - RNA, 61 nt, Human
uuuaguguggauuucagcaaaaccugaucaucccacccagaagaccuucucaucaauagau

SEQ ID NO: 54500 - RNA, 61 nt, Human
gcuccacucagcuccguccagucaaccugaacccacccaguccagcugucugugggaaugg

SEQ ID NO: 54501 - RNA, 61 nt, Human
ccuaccuccaagggggaggguccuggaagcgcccacccaggcgccgccccugugcuugcuc

SEQ ID NO: 54502 - RNA, 61 nt, Human
cggcggcagcguuuguuccagaacgccgccucccacccagaucgcgguauauagagauaug

SEQ ID NO: 54503 - RNA, 61 nt, Human
ugcagaauguucauagguucccagccccgaccccacccaaaggggccuggagcugcaggau

SEQ ID NO: 54504 - RNA, 61 nt, Human
gaccccaucugccacccccgcagcagugacccccacccagggccaggccuaagaggcuucu

SEQ ID NO: 54505 - RNA, 61 nt, Human
caaagcaacgggcuggggcagccugcagcugcccacccaaccuggucuucacaccagauug

SEQ ID NO: 54506 - RNA, 61 nt, Human
ccaccuugcggcccuggcucugagucgcucucccacccagccuggacuuggccccauggga

SEQ ID NO: 54507 - RNA, 61 nt, Human
gugggcccuccugcuccacccccaucccacucccacccaugucugggcucccaggcaggga

SEQ ID NO: 54508 - RNA, 61 nt, Human
ucccaggagccagugacaugaggugcagaggcccacccagcccccuaccuacugcccccau

SEQ ID NO: 54509 - RNA, 61 nt, Human
cuuccagggcuaggccccugccgcucccacccccacccaucugggccccggguucaagaga

SEQ ID NO: 54510 - RNA, 61 nt, Human
guugcagcuggacuucuccacccggauggcccccacccaguccugcacacuugguccaucc

SEQ ID NO: 54511 - RNA, 61 nt, Human
cccaccuagaugggucugauccuccaggauccccacccaaagccugauggcaccccggcug

SEQ ID NO: 54512 - RNA, 61 nt, Human
cgagccucagaauccaggagauacgcacagccccacccacucugagaugacaguggcugac

SEQ ID NO: 54513 - RNA, 61 nt, Human
gccagggccugcccggccuccuguuccugcccccacccaccaccugccuggagaggaacgg

SEQ ID NO: 54514 - RNA, 61 nt, Human
cagugggaucucgauggagccuccccccccccccacccaugccucccucuuccuccucuuu

SEQ ID NO: 54515 - RNA, 61 nt, Human
uggugcccagucuggcaugcagcuacccaggcccacccaucacgugugauugacauguagg

SEQ ID NO: 54516 - RNA, 61 nt, Human
gcugaucuccgccugggcccugauggccguccccacccaccugccuuccggcccggcuccc

SEQ ID NO: 54517 - RNA, 61 nt, Human
cuagcccuccucccauccacacacacaggcacccacccacaccaggucggcuuguuucuca

SEQ ID NO: 54518 - RNA, 61 nt, Human
aaucaccagaaagcaccaaagccccuggcaccccacccacuccauccuacccagggacccc

SEQ ID NO: 54519 - RNA, 61 nt, Human
cccuccucuggcccaggacgccugcugcaagcccacccagauggggccagagucugugugg

SEQ ID NO: 54520 - RNA, 61 nt, Human
ugcuccgcccugugccccccgcccaucgccccccacccaucucuggagagcccucugcacc

SEQ ID NO: 54521 - RNA, 61 nt, Human
aucaccuccugcggcagaacagcacccgugacccacccagagagcaaggccaggggucuug

SEQ ID NO: 54522 - RNA, 61 nt, Human
auacaggaaacuucucguuuccucguuuagccccacccagaucaggugaaagggcagcuuu

SEQ ID NO: 54523 - RNA, 61 nt, Human
accugucugccaggaggccacguguguccugcccacccagggggagcuguauuuuggcagc

SEQ ID NO: 54524 - RNA, 61 nt, Human
cgcuccaccccucaccucaccucgcccccgccccacccaucgcgccccggcccgucccauc

SEQ ID NO: 54525 - RNA, 61 nt, Human
uugggcuucuccugagguaaugauuuacccccccacccacagcugagucugugaggcccca

SEQ ID NO: 54526 - RNA, 61 nt, Human
ucuaggccauccccucuucuaccuccugcaacccacccauccuauuagccucccacauucu

SEQ ID NO: 54527 - RNA, 61 nt, Human
uuuguugggguccaaaagacaccaucucuaccccacccaaauaaaaaugcacucaucucug

SEQ ID NO: 54528 - RNA, 61 nt, Human
cccccuuaccccacaacgugcaacugacacucccacccagucucugcuccaccuuucagcc

SEQ ID NO: 54529 - RNA, 61 nt, Human
cugcccaaacaccccaccauuggccugucaacccacccauuggccugucugcugggugcua

SEQ ID NO: 54530 - RNA, 61 nt, Human
cugcacgaccugcucaccaccuaugccguuacccacccacagguguccuacugccagggca

SEQ ID NO: 54531 - RNA, 61 nt, Human
ggcuccaggagggacccucugguccagcugccccacccagcugcccuuaucagcuccaagu

SEQ ID NO: 54532 - RNA, 61 nt, Human
cagccccaucuguggguugcacuuacaaacccccacccaccuucagaaauaguuuuucaac

SEQ ID NO: 54533 - RNA, 61 nt, Human
uuccccuuuuggggaucaccucucuguaucccccacccacuaucccauuugcccuccuccu

SEQ ID NO: 54534 - RNA, 61 nt, Human
uagccaugggaccaaaccuagccccuuagcccccacccacuucccugggcaaaugaauggc

SEQ ID NO: 54535 - RNA, 61 nt, Human
cuuuucugggcccuagcacagguggguaacccccacccaacccagcuccugcugcuguccc

SEQ ID NO: 54536 - RNA, 61 nt, Human
ucaugauggagugaaugcccugcccugcuuccccacccaagccagucuacauugcccaaac

SEQ ID NO: 54537 - RNA, 61 nt, Human
agauuguuauaauacagcucuccgucugugucccacccaugcagacucucugaauaaccua

SEQ ID NO: 54538 - RNA, 61 nt, Human
guugaaaaaagaagcaugccuccuucucccucccacccaccucaagcaguugaacacagcc

SEQ ID NO: 54539 - RNA, 61 nt, Human
ucaccaccuguugggcauagccagagcuguucccacccagccagggcaugaaacaucaacc

SEQ ID NO: 54540 - RNA, 61 nt, Human
uuggggguaaauccugaggcuuuggugcucccccacccacccauucccgcccuuugcagca

SEQ ID NO: 54541 - RNA, 61 nt, Human
ggguaaauccugaggcuuuggugcucccccacccacccauucccgcccuuugcagcagccc

SEQ ID NO: 54542 - RNA, 61 nt, Human
uuaaaucugaauuuccacugcuuuggagagucccacccacuaagcacugugcauguaaaca

SEQ ID NO: 54543 - RNA, 61 nt, Human
ccccuguagugacccacgcguccagcagacgcccacccaccgcuagccguuguuccugugc

SEQ ID NO: 54544 - RNA, 61 nt, Human
guuguuccugugcaaaguagugugcuaugcacccacccagguggccgccucugggcccaag

SEQ ID NO: 54545 - RNA, 61 nt, Human
ccguggccggcaggccggccccugccccacccccacccacgggugucccugcccacucgug

SEQ ID NO: 54546 - RNA, 61 nt, Human
gcugguccuaggccccgccuagugccccacccccacccacagugcugcacuccuccugccc

SEQ ID NO: 54547 - RNA, 61 nt, Human
aagcucggaucacaugaaggagacagcagcacccacccaugcacgcaccccgccccugcau

SEQ ID NO: 54548 - RNA, 61 nt, Human
ugggcucccugccugccaccuccccugccagcccacccaccuuccccccaccugagauugu

SEQ ID NO: 54549 - RNA, 61 nt, Human
ccucuggcaccucacccuugccauggcugaccccacccauuccaaggcggggucacgguac

SEQ ID NO: 54550 - RNA, 61 nt, Human
ggguggccacaacugggaugccaccuggagccccacccaggagcuggccgcggcaccuuac

SEQ ID NO: 54551 - RNA, 61 nt, Human
acacuggacucccuguccccaccaccccugccccacccagggccaacaugacuaagcucuc

SEQ ID NO: 54552 - RNA, 61 nt, Human
cugagaaucuaggccaccccaaccucuguuccccacccaguucuucauuuggaggaaucac

SEQ ID NO: 54553 - RNA, 61 nt, Human
ugaucaggccucaccccuccccugggacuuucccacccaggaaaggaggaccagucaggau

SEQ ID NO: 54554 - RNA, 61 nt, Human
gaagcugcagugggagacaaagccucggucccccacccauccacacacaccuacacucaca

SEQ ID NO: 54555 - RNA, 61 nt, Human
uuaaagaugaauuuccacugcuuuggagagucccacccacuaagcacugugcauguaaaca

SEQ ID NO: 54556 - RNA, 61 nt, Human
ugcaacaggcauuacucgccauugauuggugcccacccagggcacacugucggaguucuau

SEQ ID NO: 54557 - RNA, 64 nt, Human
gccacugugagggugggugcuggcugagccccuggggcagaaggaguggggcaggcggggucuu

SEQ ID NO: 54558 - RNA, 64 nt, Human
aucuaggagaagggucucaugcggacccucacaugggcagaaaaaugguggucauuggccgaca

SEQ ID NO: 54559 - RNA, 64 nt, Human
ccccaggaggcaugaugugccgacagcgcucagugggcagaauggcaguuagauaugggacuug

SEQ ID NO: 54560 - RNA, 64 nt, Human
cagucucaacaggagccagucuucuggagccucugggcagaacccuccaucagaguggaaauca

SEQ ID NO: 54561 - RNA, 64 nt, Human
uggcugccaacucccaaucucccaggaaggcagggggcagaaucuuuuuuucacuuggccugcu

SEQ ID NO: 54562 - RNA, 64 nt, Human
cagggaaaaaaauauaguuuucuaucucuuucaagggcagaagaguuuucauuuuuauuuuugu

SEQ ID NO: 54563 - RNA, 64 nt, Human
uaugugaggggaauggacauuauuaaaagaacaggggcagaaguggcucauuuaugacccauuc

SEQ ID NO: 54564 - RNA, 64 nt, Human
gguggacuuuaagcauggugacagaugguauuuugggcagaaagcucuuagacaauggacuauc

SEQ ID NO: 54565 - RNA, 64 nt, Human
gaaguuuggugguaauauugaaagaacuagcauugggcagaaugugucuuuuuuaggcacuuua

SEQ ID NO: 54566 - RNA, 64 nt, Human
ugcugccagcugcucccaaugugccgauguccgugggcagaaugacuuuuauugagcucuuguu

SEQ ID NO: 54567 - RNA, 64 nt, Human
cucccaggaacuggaaaagcccuguccggugagggggcagaaggacucagcgccccuggacccc

SEQ ID NO: 54568 - RNA, 64 nt, Human
auucaauaguauggggacagaauggggacagcaagggcagaaguguccucuccacguaacucau

SEQ ID NO: 54569 - RNA, 64 nt, Human
auacuggcuccaucuuugagagcucuggugggcagggcagaaacaggccacagugcucaacccg

SEQ ID NO: 54570 - RNA, 64 nt, Human
aagcgugggaggcacccccauugcucuccuccaggggcagaacauggggaggggacuagauggg

SEQ ID NO: 54571 - RNA, 64 nt, Human
guauucauuuagguuugaaaauacuauuuaauaagggcagaagggcuauauaugauuuggcuau

SEQ ID NO: 54572 - RNA, 64 nt, Human
ccgaggcccagccuucccugccacuccucugagagggcagaacacacauauccaaguaggcuac

SEQ ID NO: 54573 - RNA, 64 nt, Human
aaagaagcuuuugauuagauguacaauacauugggggcagaagaucugggaucaauuaagaugg

SEQ ID NO: 54574 - RNA, 64 nt, Human
auggggaagggagguugugcggaucuugacucuagggcagaacagaucuaaccaugcauugcua

SEQ ID NO: 54575 - RNA, 64 nt, Human
gggacuccucccuggggguggggcuccuaccugggggcagaacuccuaccugaaggcagggcuc

SEQ ID NO: 54576 - RNA, 64 nt, Human
cagucagugaggaucauuuuaucacauuagacuggggcagaacucugccaggauuuaggaauau

SEQ ID NO: 54577 - RNA, 64 nt, Human
ggaaagccuuuacaaauuacucucaguucuuuaggggcagaaggcuuguuucaagagguuugac

SEQ ID NO: 54578 - RNA, 64 nt, Human
cuacacaguguugucccgagcgccgggaggcguugggcagaaacccucgggaaugcuuccgagc

SEQ ID NO: 54579 - RNA, 64 nt, Human
ccagggucacagccuggcacaggcuacagggguggggcagaaggaaaggggacaagauagaacc

SEQ ID NO: 54580 - RNA, 64 nt, Human
agaaccaggccuggaaaagaaccagaaggaggcugggcagaaccagaacaaccugcacuucugc

SEQ ID NO: 54581 - RNA, 64 nt, Human
cugaggauccccuguccccuggggcugguggauugggcagaauccugggcccccagagaccuuu

SEQ ID NO: 54582 - RNA, 64 nt, Human
cuagcagcaauuugagcuaccugaggaggaggcagggcagaaagggcgagggccugccucugac

SEQ ID NO: 54583 - RNA, 64 nt, Human
agcucauggugagggauacccaucccauaugccugggcagaaggaagacuucaucccucugggg

SEQ ID NO: 54584 - RNA, 64 nt, Human
gucagaguggucagugcugaccccuggggcucuugggcagaaagaugaggagacagagguccag

SEQ ID NO: 54585 - RNA, 64 nt, Human
aaaggaaccacccuacccauuuggccucuggagggggcagaagaaagaaauaaaccucauccua

SEQ ID NO: 54586 - RNA, 64 nt, Human
uugagcccuagggcaguucuugguagguucugcugggcagaacauauggguuaaaucucgguag

SEQ ID NO: 54587 - RNA, 64 nt, Human
gcagccuucuguacaacagaugggagggugaagggggcagaaugaaaaucgaaccaaccuuuua

SEQ ID NO: 54588 - RNA, 64 nt, Human
agguaccauuuaggaaauaccgaugccuuugugggggcagaaucacauggcaaaagcuuugaaa

SEQ ID NO: 54589 - RNA, 64 nt, Human
ccagcaugccaugcagucaucuuccccuccaagggggcagaaauuccaccagaaaucaccacau

SEQ ID NO: 54590 - RNA, 64 nt, Human
auccgccacaaaucuuaauguguugaaagaaugagggcagaaguucagaguaugcaggcucaua

SEQ ID NO: 54591 - RNA, 64 nt, Human
caugcucuuggcaauuucuuugacuuucuuuuaagggcagaagcauuuuaguuaauuguagaua

SEQ ID NO: 54592 - RNA, 64 nt, Human
gcaggggaagguuuggugugugggggugggaggugggcagaagucuuggggaggaaugggcaaa

SEQ ID NO: 54593 - RNA, 64 nt, Human
cagcugccaaguaggacaugacuaggaguguuaggggcagaaguuuugaaugcacuuaaccgga

SEQ ID NO: 54594 - RNA, 64 nt, Human
cuugcucuuuauuuuggucccggauccugggguggggcagaaauauuuucugggcugggguagg

SEQ ID NO: 54595 - RNA, 64 nt, Human
ugguccuuguuuccacuggcuuuccauccccauggggcagaaacaguggcuccugggagcagaa

SEQ ID NO: 54596 - RNA, 64 nt, Human
aaagacaagagagccaugaggagagggcugaggagggcagaagggcuaggcagggggcaaauug

SEQ ID NO: 54597 - RNA, 64 nt, Human
ucaggugagggaggcugggaagaggugggaggaggggcagaagugaaggaagaauaggaaggau

SEQ ID NO: 54598 - RNA, 64 nt, Human
auagcuugggucccuuuuccugcaaggccccauggggcagaauauaauaaauauucugagugag

SEQ ID NO: 54599 - RNA, 64 nt, Human
gauaaggaucagaacagcagagguucuuuuaaaggggcagaaaaacucugggaaauaagagaga

SEQ ID NO: 54600 - RNA, 64 nt, Human
acucaacacaccuaagccaguggcccucuaggaggggcagaagagccaaccagaggguuccugg

SEQ ID NO: 54601 - RNA, 64 nt, Human
cuggagcugaaggaauggacgagcccugggaggagggcagaaggcuacgcagggcugaggauga

SEQ ID NO: 54602 - RNA, 64 nt, Human
cgacgaccagguaccagaaaccaccaggcacacggggcagaaagccagcguccaugccccagca

SEQ ID NO: 54603 - RNA, 64 nt, Human
uaccuccuauauuuccauauugugugcaaaggaugggcagaaaagaaagugcuugaaagauuuc

SEQ ID NO: 54604 - RNA, 64 nt, Human
cuaagcacuuacauguggagauacuguaaccugagggcagaaagcccaaugugucauuguuuac

SEQ ID NO: 54605 - RNA, 64 nt, Human
aaaaauguuguuacaaagucuggagucuaggguugggcagaagaugacauuuaauuuggaaauu

SEQ ID NO: 54606 - RNA, 64 nt, Human
uuuuggcacaugaaagccugacaaguuuuuaaaagggcagaagcuuuauuuuuugaacaggaaa

SEQ ID NO: 54607 - RNA, 64 nt, Human
ucauuucauaaaaaucccucuuccuccaaagccugggcagaaaugugcugcaaagaguuauaug

SEQ ID NO: 54608 - RNA, 64 nt, Human
aucccuggcuucuccccauguuguucccggacaagggcagaagggaggcauggcaagggaccuc

SEQ ID NO: 54609 - RNA, 64 nt, Human
ccgacgccaacagacagucaaacgcugauguugcgggcagaaaacauaaaagaggugacaauug

SEQ ID NO: 54610 - RNA, 64 nt, Human
ugucagacagccucagggcaucucugagacacaggggcagaaaaugacauucaucuuuugaguc

SEQ ID NO: 54611 - RNA, 64 nt, Human
aagucuugucagaauuggccucaguguaguuaaagggcagaaggggaagauacugacuagucau

SEQ ID NO: 54612 - RNA, 64 nt, Human
cucccaugcauugagcucccaucuagcuucagcagggcagaacccuucuccagauguguguaac

SEQ ID NO: 54613 - RNA, 64 nt, Human
ucaaaaauggagugggcuggggagugcagaaguugggcagaaagggaggaggagggcaacaggg

SEQ ID NO: 54614 - RNA, 64 nt, Human
cccacuuccaccagcaccauagaagaauaauucugggcagaagucuguuuuuuuucauuuuucc

SEQ ID NO: 54615 - RNA, 64 nt, Human
cggccaguggugccaggcagcuugccacuugggagggcagaagccaggaauuccacacccuugu

SEQ ID NO: 54616 - RNA, 64 nt, Human
aauauaggcuucaagaagggcugguccuaagagggggcagaaaugaaugaccagguuaaauccc

SEQ ID NO: 54617 - RNA, 64 nt, Human
aaaacacuaucugcaaacucaggacacuuuaacagggcagaauacucuaaaaacuugauaaaau

SEQ ID NO: 54618 - RNA, 64 nt, Human
agauggcgugcacaggacacagcgugggcggccugggcagaagggcggcuggcuguccuggagc

SEQ ID NO: 54619 - RNA, 64 nt, Human
agagacugaaaauugcagacagaggggcacgucugggcagaaaaccuguuuuguuuggcucaga

SEQ ID NO: 54620 - RNA, 64 nt, Human
gucaucuacaccuagcuucaccuuauucuuuaaagggcagaaaauuugagacggugaucgccgu

SEQ ID NO: 54621 - RNA, 64 nt, Human
ggagauauuucuuugugcagauucuguaagggcugggcagaaauguguauggucaaagccaagc

SEQ ID NO: 54622 - RNA, 64 nt, Human
gaugggcuggccauuguguccccgcaggagagaugggcagaauggcccuagaguucuuuucccu

SEQ ID NO: 54623 - RNA, 64 nt, Human
aaauuuagcauaggaaaaaguuguuuaaugcucagggcagaaauuuggggaaguugaaauccuc

SEQ ID NO: 54624 - RNA, 64 nt, Human
uuccucugcuggaccugggguaggcugcaggggugggcagaagccccucuuaaauugugguugc

SEQ ID NO: 54625 - RNA, 64 nt, Human
cugggaggugagguguggugugcggcuucacccagggcagaacaaggcagaaucgcaggaaacc

SEQ ID NO: 54626 - RNA, 64 nt, Human
uucccuagcugagccacgcugcccaugcagcagagggcagaaggcuugcacuugggccaaaggg

SEQ ID NO: 54627 - RNA, 64 nt, Human
ggggaagggggacaagggucagucugucgggugggggcagaaaucaaaucagcccaaggauaua

SEQ ID NO: 54628 - RNA, 64 nt, Human
uucauuccaaaguguauauuggguucagacuugggggcagaaguucagacacaccgugcucagg

SEQ ID NO: 54629 - RNA, 64 nt, Human
augguugcacguuaaaaauuaaaagaaggaaugggggcagaaugccauauuuuugagggcugua

SEQ ID NO: 54630 - RNA, 64 nt, Human
ggaagccagaagggcuugaggccucuaugggugggggcagaaggcagagccugugucccagggg

SEQ ID NO: 54631 - RNA, 64 nt, Human
aaaacaacugcauuagaaauaaugcguguuuggggggcagaaugcagauuuuuuuaauuuacaa

SEQ ID NO: 54632 - RNA, 64 nt, Human
uagcugccauauugugaaaaacuuuaguggacaagggcagaaggaagagggaagaccuguuagg

SEQ ID NO: 54633 - RNA, 64 nt, Human
cgucucagcccuucaguuuggucugcuccgccuggggcagaaagccacaaacuccauccagauc

SEQ ID NO: 54634 - RNA, 64 nt, Human
cgguggauccucaaacaacacuggugugaccugagggcagaaagguucugcccgggaaggucac

SEQ ID NO: 54635 - RNA, 64 nt, Human
uauaagcuacuuuccucccuggagugcucuaugugggcagaacaugcucuccuugccucuccug

SEQ ID NO: 54636 - RNA, 64 nt, Human
caaaauuuacacauucauuuggaugcagugaaaagggcagaaauaccacagcagagaauaaaau

SEQ ID NO: 54637 - RNA, 64 nt, Human
gcagccuugaagacaccacaggccaaaacaugaggggcagaaaugggaucacagagucuguugc

SEQ ID NO: 54638 - RNA, 64 nt, Human
ucauugauauuauccucugaaugcaguuaaggcugggcagaaauucuacucaugugacaucugc

SEQ ID NO: 54639 - RNA, 64 nt, Human
aaguauacucucaaauguaugaagcaacuggggugggcagaagacauuuuagaaugagggcuuu

SEQ ID NO: 54640 - RNA, 64 nt, Human
aacccaaugaaaccacagagaggcagaagagaacgggcagaaguacagaacagaaauggagaag

SEQ ID NO: 54641 - RNA, 64 nt, Human
cgggcagugccucgguugucucugcggcuccuuagggcagaacagcugcauguggcacuuguga

SEQ ID NO: 54642 - RNA, 55 nt, Human
cugagagggaggucucuugaccaaugggcagaaucuucacuccaggcacauagcc

SEQ ID NO: 54643 - RNA, 64 nt, Human
uauugugugguggugucacaggauggugggggcggggcagaagucuccuguugguguucugaug

SEQ ID NO: 54644 - RNA, 64 nt, Human
cauccuaaguuaauaggaaccaaaaaauaaugaugggcagaagggggggaauagccacagggga

SEQ ID NO: 54645 - RNA, 64 nt, Human
uggagguccucaggaguggagagaaugaguaggagggcagaagcuuccauuuuuguccuuccua

SEQ ID NO: 54646 - RNA, 64 nt, Human
ucaucaagucccauggccuggugcguccucgugugggcagaauugaaaaaguauggguucgaga

SEQ ID NO: 54647 - RNA, 64 nt, Human
aucuugguuauuaaacaguaucugggacugguuugggcagaauauuaaacuuauuuuguugcca

SEQ ID NO: 54648 - RNA, 64 nt, Human
uuuggaguauucuuucuauagggguaccugugaggggcagaacacguaagccacagaacauggu

SEQ ID NO: 54649 - RNA, 64 nt, Human
cuucuaccaaaguaaaacucugugaguuguuucagggcagaauguaccagccagucagcguugu

SEQ ID NO: 54650 - RNA, 64 nt, Human
ucucacuacugaguuagggugcaggcagaggcuggggcagaauguuuacagccagugccagcac

SEQ ID NO: 54651 - RNA, 64 nt, Human
cucugaaggcagaaaagaagggagagaaccucaugggcagaauauuauaaaaagagugucauau

SEQ ID NO: 54652 - RNA, 64 nt, Human
acagauacauuggcuggggagugggaacagggaggggcagaaaaccaccaaaaggccagugccu

SEQ ID NO: 54653 - RNA, 64 nt, Human
cuuccagggggccccuggcagcagcuggggugucgggcagaaugugacuuguggccuuaccaug

SEQ ID NO: 54654 - RNA, 64 nt, Human
augaaaauaauaauuuucuacuuggaguugaagagggcagaauccgcagcucucaucauuguga

SEQ ID NO: 54655 - RNA, 64 nt, Human
ucugggaauccuggacagcuccgcgcucggggcugggcagaaggggcggcccggacgggggagc

SEQ ID NO: 54656 - RNA, 64 nt, Human
aguagcuugcauuugagaagcuuaugacuuagaugggcagaaucaacaaagaugaaaccgccug

SEQ ID NO: 54657 - RNA, 64 nt, Human
uaggaagugcccuggagggggccagcaggucacggggcagaaucucucagguugcugugggauc

SEQ ID NO: 54658 - RNA, 64 nt, Human
auuuugccaaauguaucuuuucugcuuuugaauugggcagaagauuuuagcaacuauauucuac

SEQ ID NO: 54659 - RNA, 64 nt, Human
ucaggugcuacuuaagaccagcuugggcaauucagggcagaacuccuguaucagccucauggac

SEQ ID NO: 54660 - RNA, 64 nt, Human
auucuuugguguuuggcacuuuaaggucaucguugggcagaaguuuagcauuaauaguuguucu

SEQ ID NO: 54661 - RNA, 64 nt, Human
uggauaccaaugauagaaaaugauaccuuuacaggggcagaaaaauccccacucuuccuuauug

SEQ ID NO: 54662 - RNA, 64 nt, Human
acacagacacuauaauuggaagugcugagcucuggggcagaaggaucaggugaccuucgcaaca

SEQ ID NO: 54663 - RNA, 64 nt, Human
uccacagcugacaguugaauugacacuuuuauuggggcagaauggaacaguccaagaauguaga

SEQ ID NO: 54664 - RNA, 64 nt, Human
acgcgcacuuacacgagaagacauucauggcuuugggcagaaggauugugcagauugucaacuc

SEQ ID NO: 54665 - RNA, 64 nt, Human
ccucggagccucauccgaggcagggucaggagaggggcagaacagccgcuccugucugccagcc

SEQ ID NO: 54666 - RNA, 64 nt, Human
aaccaaaaccagaaugccaugugguggaggcaaagggcagaauuucugaccccuuuggcucagc

SEQ ID NO: 54667 - RNA, 64 nt, Human
aggaggagucgaugaugugaggcaggaggcaggcgggcagaaggcccugcccgggaccucacag

SEQ ID NO: 54668 - RNA, 64 nt, Human
gcagugcucgguuguuuacaaucaguggggaaaagggcagaaccagugcccggccccacacugc

SEQ ID NO: 54669 - RNA, 64 nt, Human
caagaucugcuucuagugauugugagugccuugugggcagaauccuugucauuuccucuuuggg

SEQ ID NO: 54670 - RNA, 64 nt, Human
uuagaaaauuuuauauacuuuuuuacauguuggggggcagaagguaaagccauguuuugacuug

SEQ ID NO: 54671 - RNA, 64 nt, Human
uagugcacagaauacgugagaguugcucuggcaggggcagaauccucacaggaucgccugggag

SEQ ID NO: 54672 - RNA, 64 nt, Human
caccucgcacuucauuacauuccuguacuaacuggggcagaacucagacgggugccccagaggg

SEQ ID NO: 54673 - RNA, 64 nt, Human
gugcagcgagguccaccccguuguugucccugcagggcagaaaaacgucuaacuucaugcuguc

SEQ ID NO: 54674 - RNA, 64 nt, Human
ggaucugaaaucagacaccaauggacugguuugugggcagaaacacacacacucgcacucucgc

SEQ ID NO: 54675 - RNA, 64 nt, Human
acaaggggaaaggguugguuaggcaaucauucuagggcagaaagaaguacaggauaggaagagc

SEQ ID NO: 54676 - RNA, 64 nt, Human
uaacuuaugauaguagauuguuucuuuagaaacugggcagaagcucugcauucucacuuguacu

SEQ ID NO: 54677 - RNA, 64 nt, Human
gcccauugccuuugcuuuguucauaauuucagcagggcagaauaaaaaccaugggaggcaaaga

SEQ ID NO: 54678 - RNA, 64 nt, Human
cccucuggcuggggcagcgcagacccucuagcuggggcagaacaaggcuggugcuuccuucuag

SEQ ID NO: 54679 - RNA, 64 nt, Human
uuagagaguuggaguagcacaauugccuguuuuagggcagaaaccaugggcuauguuaaugucc

SEQ ID NO: 54680 - RNA, 64 nt, Human
uuuucuacugaaaacaauuuagaaagaagcuauugggcagaaacagauauagaucaauaccugu

SEQ ID NO: 54681 - RNA, 64 nt, Human
aucucugaguuaagcaagccuuccucaaagagaggggcagaagcaagaagagauuguuuugaag

SEQ ID NO: 54682 - RNA, 64 nt, Human
uauaguggguacaucaaguccaucugacaaaauggggcagaagagaaaggacucagugugugau

SEQ ID NO: 54683 - RNA, 64 nt, Human
cuccgggagccugaaccuccugacugaggaacaugggcagaacauguuuauugcacagaguggg

SEQ ID NO: 54684 - RNA, 64 nt, Human
gagcuaagaaugguuuauauguuuucaaaugauugggcagaaaaucaaaagaagaacaauauuu

SEQ ID NO: 54685 - RNA, 64 nt, Human
aagaaaaaaaugcugcaguuguucucucaagcuagggcagaagaggggugucaagcuccucaau

SEQ ID NO: 54686 - RNA, 64 nt, Human
gucuuacgccaccuucuggacacucccuccuugagggcagaaaggagucccaggccugucccua

SEQ ID NO: 54687 - RNA, 64 nt, Human
ccucagucccaggagagcuaugaggccucacugggggcagaacuuggggagaccgaagccggcc

SEQ ID NO: 54688 - RNA, 64 nt, Human
ucaaggcaccacacaacccagaaaggagcugauggggcagaacgaacuuuaaguaugagaaaag

SEQ ID NO: 54689 - RNA, 64 nt, Human
uuagacgcggcucuccuccggcagggcccccagagggcagaagcagcguggaggggcccucacg

SEQ ID NO: 54690 - RNA, 64 nt, Human
uuguuguggcuacuagagaacaagagggaaaguagggcagaaacuggauacaguucugaggcac

SEQ ID NO: 54691 - RNA, 64 nt, Human
agugacuuccaaccgacaguugcuagaauucacagggcagaaaagggguugaccuucuccccuu

SEQ ID NO: 54692 - RNA, 64 nt, Human
uuuuauuuuaaggcaaaacaguguuuacugugaugggcagaacagccuuuuguaucuaggaguc

SEQ ID NO: 54693 - RNA, 64 nt, Human
uuuggcccaggagaauugggggguggggggucuggggcagaaagguaagagugggaggcugagc

SEQ ID NO: 54694 - RNA, 64 nt, Human
acucccuuccacccaucccagccccugggcagccgggcagaagggaauccaggcuauggaccuc

SEQ ID NO: 54695 - RNA, 64 nt, Human
auguucccagaaccuugauggggugagaaguacagggcagaaccaagaacauaaacccuccaag

SEQ ID NO: 54696 - RNA, 64 nt, Human
ggucagugaguagaacuacaaaacaauagcaguagggcagaaacuugaaagaaggcaggagauc

SEQ ID NO: 54697 - RNA, 64 nt, Human
uuucuaggacaaagggagucauuuugguugaacugggcagaaugguuuguucuauuuucuuauu

SEQ ID NO: 54698 - RNA, 64 nt, Human
uaguacuucuccuucacccauaguaauccuccuggggcagaaacauaacaccccaaaggcacgu

SEQ ID NO: 54699 - RNA, 64 nt, Human
gugccggugggggcugggcucccgugagguccuagggcagaaggaggugcuugcagggccucuc

SEQ ID NO: 54700 - RNA, 64 nt, Human
uguaggugucugcacccagggguggggaauguuugggcagaagggagaaggaucuagaaugugu

SEQ ID NO: 54701 - RNA, 64 nt, Human
uucauuucugucuccccuaccaggcuguaaaugagggcagaaaccuuguuuguuuuauucacca

SEQ ID NO: 54702 - RNA, 64 nt, Human
ccagaaaugaggccauggcucacuguuucugggcgggcagaaggcucuguagagggagauggca

SEQ ID NO: 54703 - RNA, 64 nt, Human
agcggagcgguggagagggagaggcuggaggccugggcagaacagcgccgcccgggcagacggc

SEQ ID NO: 54704 - RNA, 64 nt, Human
guagugcacagugucucuacaggugucuucuggggggcagaaccaauuggaaggaagaaaggga

SEQ ID NO: 54705 - RNA, 64 nt, Human
gggacugaaaugcugcagcugaggcuggucuucagggcagaaaaugaguacuucuuugaaggug

SEQ ID NO: 54706 - RNA, 64 nt, Human
uugcuaaccaugcuaucugcgcagacgcuuccgagggcagaaauagucccauguauaccuuuuc

SEQ ID NO: 54707 - RNA, 64 nt, Human
ucuuaaaguggcuugauuuccaauagcugaacuugggcagaaaacagcaggccaauguuccuau

SEQ ID NO: 54708 - RNA, 64 nt, Human
cacaagguaugguauauacaauuugcagugcagugggcagaauacuucucacagcucaaagaua

SEQ ID NO: 54709 - RNA, 64 nt, Human
cagcggaugucaacugguuguggugauggggugggggcagaacaugaguagcaaagaaaaggga

SEQ ID NO: 54710 - RNA, 64 nt, Human
ugggcguaaauucccugggaucaaguaggaaaaugggcagaacugcuuaggggaaugaaauugc

SEQ ID NO: 54711 - RNA, 64 nt, Human
uggcugucccuguuggcccagccgggcacucacagggcagaagggugggucucaagugggagga

SEQ ID NO: 54712 - RNA, 64 nt, Human
uugggcaaugaggaaggaaagguuucaaauuuaggggcagaagugagagaaugagccaacccau

SEQ ID NO: 54713 - RNA, 64 nt, Human
aauguacucagaacacuuagaauugcccacaguugggcagaaucaucuaacacaaacucuauuu

SEQ ID NO: 54714 - RNA, 64 nt, Human
acgaaaugggaauuccagcacuaagccaggcaccgggcagaagcugggccuuccgccucccuug

SEQ ID NO: 54715 - RNA, 64 nt, Human
ggggagcgagaaauugcuuuuucucuuccucccugggcagaauguagcuuuucugcuucacugu

SEQ ID NO: 54716 - RNA, 64 nt, Human
ugccaaaugaauaagacaacaaagagaagcagaagggcagaagauuauuuacugacauauaucu

SEQ ID NO: 54717 - RNA, 64 nt, Human
cuccucagauuuggaguggcaaggauaaaagugagggcagaaguagcugugggaaaagaugagc

SEQ ID NO: 54718 - RNA, 64 nt, Human
ugaggggaguagagggagagggcagguggaacuggggcagaaucuagucaugcccuaaagcuag

SEQ ID NO: 54719 - RNA, 64 nt, Human
aaaucguagcuuguacagaucaagagaauauacugggcagaaugaaguauguuuguuuauuuuu

SEQ ID NO: 54720 - RNA, 64 nt, Human
ggaacuuaaaacuacuuuguugaaacaucaaccugggcagaaaaaaaaaaaaaaagacauguaa

SEQ ID NO: 54721 - RNA, 64 nt, Human
aaaacagagcaagaguuauaaccuucagaugugggggcagaauaggacccauuugggcagacac

SEQ ID NO: 54722 - RNA, 64 nt, Human
ggggugucagacaggcuacccugugccagggagggggcagaaugggccugcagcuuccugcaga

SEQ ID NO: 54723 - RNA, 64 nt, Human
aggggaaaucacauuuuuaccuuaugcuguuacugggcagaaccacguuuuauguaaacauacc

SEQ ID NO: 54724 - RNA, 64 nt, Human
cuggcucccagcaaggguaggacgggccgcaugcgggcagaaaguugggacugagcagcuggga

SEQ ID NO: 54725 - RNA, 64 nt, Human
ugcacacuagccucuccaggaaugccuccucccugggcagaaaguggccaugccacccuguuuu

SEQ ID NO: 54726 - RNA, 64 nt, Human
ucucaagcuucuccugggggauggggauugggaugggcagaaucuguuuuggaucuccggguua

SEQ ID NO: 54727 - RNA, 64 nt, Human
uagacaaaguugugacccauuuuacucuggauaagggcagaaacgguucacauuccauuauuug

SEQ ID NO: 54728 - RNA, 64 nt, Human
agguggaggugucaggcugcuggcgccucugcaagggcagaacacuaaccugaccgugggcggg

SEQ ID NO: 54729 - RNA, 64 nt, Human
ucgcagcauucccaagggucacaugcccuggcaugggcagaaacugggcuaaugauucuuugcc

SEQ ID NO: 54730 - RNA, 64 nt, Human
acacaaauguaaugcaagaauaaaaaauauuuuggggcagaaaggacuuugguuuuucaaacua

SEQ ID NO: 54731 - RNA, 64 nt, Human
gagacccucgcugugcugcugccagccccuggcugggcagaaagugcccucggcaugggcaccu

SEQ ID NO: 54732 - RNA, 64 nt, Human
gggaaauggaaaguuuuccucaaggagcagcugggggcagaauagguaguauuuaagcaaauac

SEQ ID NO: 54733 - RNA, 64 nt, Human
cacguuucccuaagaaaucauggcagagaugugagggcagaauauacacaacagaugcugaagg

SEQ ID NO: 54734 - RNA, 64 nt, Human
ggaguccugguccugcucccucagcacccaaaaggggcagaaccugaguugagacuugcauguu

SEQ ID NO: 54735 - RNA, 64 nt, Human
ccaggcccccuccccugcugcuuugcggggggcagggcagaaauggacuccuuuuggguccccg

SEQ ID NO: 54736 - RNA, 64 nt, Human
cuugugcggggccaggcugggagcccaugcaguagggcagaaggcagcggaggccaggucuguc

SEQ ID NO: 54737 - RNA, 64 nt, Human
gcaggggcccuggaaugggggcaagcagcugggugggcagaaugcagaguagacucgggggagg

SEQ ID NO: 54738 - RNA, 64 nt, Human
gucgggggagcacguccaggcguggugcauccuggggcagaacgccauggcuccuccccgcucu

SEQ ID NO: 54739 - RNA, 64 nt, Human
ccaaaucaaggaggcuacaaaagggcagccuagagggcagaacagagaaaagcuagacaaaaug

SEQ ID NO: 54740 - RNA, 64 nt, Human
guucucacaaccucagcccacucucagucaaggagggcagaaaauaaaagaugacaucacugcc

SEQ ID NO: 54741 - RNA, 64 nt, Human
gccgccugcgagccccucucugccuccagaccuugggcagaaggaggccuccuugggccugguc

SEQ ID NO: 54742 - RNA, 64 nt, Human
cuaucagauuuuaccacuaucaaauauaauucaagggcagaauuaaacgugagugugugugugu

SEQ ID NO: 54743 - RNA, 64 nt, Human
guggcauaaccuugugcacagagaacuagaaaaggggcagaaccccggccuugcaguuguggca

SEQ ID NO: 54744 - RNA, 64 nt, Human
gcagcagccuggcugccuugucauggccuccugggggcagaaggcgauguggaccacgggauuu

SEQ ID NO: 54745 - RNA, 64 nt, Human
acagcuacacagaucacagcuucagccaggagcugggcagaaggccaagaggcuguucccacca

SEQ ID NO: 54746 - RNA, 64 nt, Human
gagguggccacuucagccaagcccagagaagugugggcagaagcagugaagguucuucucugug

SEQ ID NO: 54747 - RNA, 64 nt, Human
aaggagacaaaacgguaaugaacagauagcacuggggcagaauaugcaugcauuuuguaacguc

SEQ ID NO: 54748 - RNA, 64 nt, Human
cuguuuaguuuuaaggacugaaaaugguagguuugggcagaagaaugaauuugaacuuugaugg

SEQ ID NO: 54749 - RNA, 64 nt, Human
uucccaaguaaauauaucaguguuuccuguguuugggcagaagugcaaaguaguuuuaauuucu

SEQ ID NO: 54750 - RNA, 64 nt, Human
ucacagggcugcaaaggguacagggauugcaccagggcagaacaggggaggguguucaaggaag

SEQ ID NO: 54751 - RNA, 64 nt, Human
ucuccugccaccuggcugcccacagagcucuccagggcagaagucgcggugggcucagugggug

SEQ ID NO: 54752 - RNA, 64 nt, Human
ggaauuuucagucaucucaugauacaggcgggaggggcagaacagauagauuacgacagguuug

SEQ ID NO: 54753 - RNA, 64 nt, Human
uaaauauggggauaauucaguuguugcaaaaaaagggcagaauucaguagaauaaaguccuuuu

SEQ ID NO: 54754 - RNA, 64 nt, Human
gucauauugaagaagcccagaggguugugcccaggggcagaaaucauugccuaguguucaccgg

SEQ ID NO: 54755 - RNA, 64 nt, Human
uuucugacacuucagggcccagagguccugcgaggggcagaacuggacccccaugccagugcug

SEQ ID NO: 54756 - RNA, 64 nt, Human
ucuuagcagaugggaggaacugcugagagaagaugggcagaaagcuggagccccuggaguuggc

SEQ ID NO: 54757 - RNA, 64 nt, Human
guguuugugacugauuacuggcugugucuugggugggcagaaacucgaacuugcuauguaauuu

SEQ ID NO: 54758 - RNA, 64 nt, Human
cucgucucgaggccuguggcgucuggguccguuggggcagaaccauggaggaaaagccuucgaa

SEQ ID NO: 54759 - RNA, 64 nt, Human
gcuggagggccgguggggguaugggcgugugguggggcagaaagccuagacccaggugguccug

SEQ ID NO: 54760 - RNA, 64 nt, Human
uuggggggcccucucccaggacacugccucuucugggcagaaggccccuccagggggacugcuc

SEQ ID NO: 54761 - RNA, 64 nt, Human
ccucuccucccagccaccaucguucaucugcuccgggcagaacuguguggccccugccugugcc

SEQ ID NO: 54762 - RNA, 64 nt, Human
gcaguggcucacaccuguaagcccagcugucagggggcagaagcgggaggauagcuugagccca

SEQ ID NO: 54763 - RNA, 64 nt, Human
gauaagugaagugagcaggucaacaguaggacuggggcagaagcucugccuaaaaugaagugaa

SEQ ID NO: 54764 - RNA, 64 nt, Human
agaccaaggaaaggacagaaugaggaaaggccuggggcagaagagcccaacuccuucucauagc

SEQ ID NO: 54765 - RNA, 64 nt, Human
uggagaaaauguccucauuaaaguauuaaagugugggcagaauuacaauuacaaagugccagcc

SEQ ID NO: 54766 - RNA, 64 nt, Human
ggacaauauuuagaacccaaauuuuggagugcuugggcagaaaguuguaaaguuugugcuggag

SEQ ID NO: 54767 - RNA, 64 nt, Human
ugcuccucugccuggaccaggaggagggccccuggggcagaaguuaggcacgaggcagucuggg

SEQ ID NO: 54768 - RNA, 64 nt, Human
gaacuuuucaacuccguugguggugggaggcagcgggcagaaauuuacuguuggccacugccag

SEQ ID NO: 54769 - RNA, 64 nt, Human
cuguguguuggcaccagcaucgggucuuggacuggggcagaauccccaguggaaccggaagagc

SEQ ID NO: 54770 - RNA, 64 nt, Human
caccccugcugacccaggacuuccccaaccuccagggcagaaagagcccaggcuccggggucca

SEQ ID NO: 54771 - RNA, 64 nt, Human
auggggcugucuccccugacaggcacaacuccccgggcagaaaacgugccccaccgcaucccua

SEQ ID NO: 54772 - RNA, 64 nt, Human
uaggaaacaaaaugggaucuuucugacacacuuagggcagaagugaaugccugucacggaggga

SEQ ID NO: 54773 - RNA, 64 nt, Human
gucucagggccucugcuggcagucuagaccuuuugggcagaaaggagcuucaaauggcugugau

SEQ ID NO: 54774 - RNA, 64 nt, Human
uccaggccaggccucauccuccuggacccagcaggggcagaaggaggaagggacugguccaggc

SEQ ID NO: 54775 - RNA, 64 nt, Human
aaugaauccuaccuuucgcagaaggcugaaagcagggcagaaaagaucuacauuucuuuggaca

SEQ ID NO: 54776 - RNA, 64 nt, Human
aguacugugauuacaagcgugagccacggcaccugggcagaaaaguaucuuaauuaaugaaaga

SEQ ID NO: 54777 - RNA, 64 nt, Human
cugcagcuacccuagcugaggagccuguugugaggggcagaaugagaaaggcaauaaagggaga

SEQ ID NO: 54778 - RNA, 64 nt, Human
gccaggaaccucucagagcugaagcaggcccugggggcagaagugccagaugacagucagaggc

SEQ ID NO: 54779 - RNA, 64 nt, Human
accgcguugaaggccaccuccuucuggcugggaggggcagaacuguggacagauucucaaugcc

SEQ ID NO: 54780 - RNA, 64 nt, Human
gggacagugggucaggcaggacaaggagaaagcagggcagaaugaugccuagaggaccacauca

SEQ ID NO: 54781 - RNA, 64 nt, Human
guuuuucuuugugcuaaaguggauacagcuguuggggcagaagagacgggaccagcugcuggcc

SEQ ID NO: 54782 - RNA, 64 nt, Human
aguauagauacccuacgcuguccagaaagguuuggggcagaaaggacuccuccuuuuuccaugc

SEQ ID NO: 54783 - RNA, 60 nt, Human
acaucucccugcugaagugaggaggcccaugggcagaagauagagauuccccuggaccac

SEQ ID NO: 54784 - RNA, 64 nt, Human
ugauguugggagugggaucuccugaguccuuguugggcagaauuggugaggccagggauggcag

SEQ ID NO: 54785 - RNA, 64 nt, Human
gacauuaccucuuccugcaacuaaacacgagccugggcagaaccucucagccuuccucuacgcc

SEQ ID NO: 54786 - RNA, 64 nt, Human
ccuucucugcuugaccugaagaagggccagaccugggcagaaagacuccagcaggugagcucuu

SEQ ID NO: 54787 - RNA, 64 nt, Human
gggauuugcuccuggguucccuaggcccuagugagggcagaagagaaaccauccucucccuucu

SEQ ID NO: 54788 - RNA, 64 nt, Human
aaguauaucuggaaagcagucugccccuggaggugggcagaaaaaaguaaaacuugcugcugcu

SEQ ID NO: 54789 - RNA, 64 nt, Human
ugugagcuggauuccaucuuucugcaguaacagcgggcagaaccauuucaguuagcaugugccu

SEQ ID NO: 54790 - RNA, 64 nt, Human
caaaaguguauuguuuaaaaaauaaaaagaaggugggcagaaaugugcccaguggaaggcugac

SEQ ID NO: 54791 - RNA, 64 nt, Human
uuggcuauuugaguaaccuaggauuagugagaaggggcagaaggagauacaacuccacugcaag

SEQ ID NO: 54792 - RNA, 64 nt, Human
ccuugacaauguagcaauaaauagaugcugccaagggcagaaaauggggagguuagcucagagc

SEQ ID NO: 54793 - RNA, 64 nt, Human
uaccuuaucugaaacucuugcacuuccccaaccagggcagaaaugaggugggagaaguuugacu

SEQ ID NO: 54794 - RNA, 64 nt, Human
ccuuccuguuaguagauggggguacuucuguggugggcagaagccuuacuaaaggggaagacag

SEQ ID NO: 54795 - RNA, 64 nt, Human
gacagucagccugccggccucccugcagcucacggggcagaaccagcacaucuggagccacaca

SEQ ID NO: 54796 - RNA, 64 nt, Human
gugggaagugaugcagagagcccacccgugcagagggcagaagaggacgaaaugccuuugggug

SEQ ID NO: 54797 - RNA, 64 nt, Human
uuucauucuaggcucacacuguccuugucaaggugggcagaagagcagaggucuucucugcacc

SEQ ID NO: 54798 - RNA, 64 nt, Human
ugagaaauggcuucuuugcagagcuggggaagccgggcagaagaugccgcagccuccuacucug

SEQ ID NO: 54799 - RNA, 64 nt, Human
ccugugccuguaaacccagcuacucaggagguuggggcagaauugcuugaacccagggggcaga

SEQ ID NO: 54800 - RNA, 64 nt, Human
cacugugcucggaaguuagacccacggcgugaaggggcagaaauucggguaaggaaaacuccag

SEQ ID NO: 54801 - RNA, 64 nt, Human
caguacucucuuaaagaagguggggagcugcccagggcagaacccacugguguucaugacuacc

SEQ ID NO: 54802 - RNA, 64 nt, Human
ccguccuagucccaccaauuagucaacucuuuuagggcagaagucugucuaauucaucuuugcu

SEQ ID NO: 54803 - RNA, 64 nt, Human
ucaguuuugcaagccaaaucauuauuaaaagugcgggcagaacaacuggucugguuuccacugg

SEQ ID NO: 54804 - RNA, 64 nt, Human
cagcaguguccuugggaaaggcaauauuuaugaagggcagaagaggcagccccaagaaccuaaa

SEQ ID NO: 54805 - RNA, 64 nt, Human
acugucuuugcagagcugggcacaugugcccagggggcagaaaaaauggcuucucaguuguuaa

SEQ ID NO: 54806 - RNA, 64 nt, Human
acgccccgcuguguccucccucccucccuuccuugggcagaaugaauucgaugcguauucugug

SEQ ID NO: 54807 - RNA, 64 nt, Human
ucagugcauaaaguuugaauuauuuuguucuugugggcagaagugggaaugauggaauauccuc

SEQ ID NO: 54808 - RNA, 64 nt, Human
uaaguaguggaggagcguaugguuaagcccaaaggggcagaacaagaaagccacgggauuguau

SEQ ID NO: 54809 - RNA, 64 nt, Human
cuuauacugaggugugcuucaagggagcauuauagggcagaaaacaaauuaaaaugaaauguug

SEQ ID NO: 54810 - RNA, 64 nt, Human
aaauaguaaugugaugcugaugcuguuaaccaaagggcagaauaaauaagcaaaaugccaaaag

SEQ ID NO: 54811 - RNA, 64 nt, Human
cauuggaaaugacuaguauucugccucauuuucagggcagaauauguguuugugacccaaaaug

SEQ ID NO: 54812 - RNA, 64 nt, Human
uacucacauacacacacaccuagccagcugucaagggcagaaugaaucuaugcuggauaagaaa

SEQ ID NO: 54813 - RNA, 64 nt, Human
ccaaggaaggagccugagccacuggggacuaagugggcagaagaaacccuuggcagcccugugc

SEQ ID NO: 54814 - RNA, 64 nt, Human
acuagagacccuccagcccccaaggggaggauuugggcagaaccugagguuuugccauccacaa

SEQ ID NO: 54815 - RNA, 64 nt, Human
auucggugacauucucucccaugacacccagaaggggcagaagaaccacauuuuucauuuauag

SEQ ID NO: 54816 - RNA, 64 nt, Human
acugugccuucccggccucccgggcuucugcugggggcagaagaaaugccuccccaggucuguc

SEQ ID NO: 54817 - RNA, 64 nt, Human
gaauaccgaaaagucaacccuguggaccacgacagggcagaaggaguuucuccggagaugagcc

SEQ ID NO: 54818 - RNA, 64 nt, Human
ucaggacacuucccucucuuuugggagcuucucugggcagaauugggcugggaccucucucccc

SEQ ID NO: 54819 - RNA, 64 nt, Human
uauugauggguaucucuguauguauaucaagagugggcagaaauguuuggcuggugauggcaaa

SEQ ID NO: 54820 - RNA, 64 nt, Human
aaacuggaaaacauauauauguuagcaucaaagggggcagaagcaaagaagauacagaucugca

SEQ ID NO: 54821 - RNA, 64 nt, Human
ccccucucauaguaugcccauaagucagggcauagggcagaacuaccugucauguugcuacacc

SEQ ID NO: 54822 - RNA, 64 nt, Human
agcagcucugggaggcacagagugcaggucucaggggcagaagacauggguuccaguucugguu

SEQ ID NO: 54823 - RNA, 64 nt, Human
cugugucccugcugcugccagggcuuccucuuccgggcagaaacaauaaaaccacuugugccca

SEQ ID NO: 54824 - RNA, 64 nt, Human
augaaggaaccucuuucuuacaaaacaaaaaaaagggcagaaaucaccccaaggaacgauuucu

SEQ ID NO: 54825 - RNA, 64 nt, Human
cuacugccucaacccaaggggauuuuuaugucuggggcagaaacacucaaguugauuagaaaga

SEQ ID NO: 54826 - RNA, 64 nt, Human
acucugagggggggcacccaguggggugcugagugggcagaaucucagaagguccuccugaacc

SEQ ID NO: 54827 - RNA, 64 nt, Human
cuucagaucuggggguguggugaguggcaaguaagggcagaauuuuaggagaaccagagucacc

SEQ ID NO: 54828 - RNA, 64 nt, Human
ugcccuaccuggcguccugguccaggggagcccugggcagaagcccccggccccuauacauagu

SEQ ID NO: 54829 - RNA, 64 nt, Human
cccguucugacccguguccccccaggcucugccugggcagaagacucaccuuggaggagugggc

SEQ ID NO: 54830 - RNA, 64 nt, Human
guccuugccuaaugcucugaucuguaagugaauagggcagaacaguucagccuugagguuagaa

SEQ ID NO: 54831 - RNA, 64 nt, Human
gccgaccugcaccugucugugaaguauguagggugggcagaagccacagucgccgccgccaggg

SEQ ID NO: 54832 - RNA, 64 nt, Human
gaacccccuucauggacagaucccccacagccuggggcagaagaggcgucgagggcgccagaag

SEQ ID NO: 54833 - RNA, 64 nt, Human
gggggcaggaccuggggaccugggcuggagggaagggcagaagcuuccuacuuggcugacagcc

SEQ ID NO: 54834 - RNA, 64 nt, Human
ggccccggugcggcugcagcucacccagccccaggggcagaagagacccaaccacuucuauuuu

SEQ ID NO: 54835 - RNA, 64 nt, Human
gggcaagugggcugcacuccuuucucuccaaccagggcagaaaggagggaggauucgucccauu

SEQ ID NO: 54836 - RNA, 64 nt, Human
agccuccuuccuguaggcgagggcccaagucugggggcagaaccugaguguggauggggcggcc

SEQ ID NO: 54837 - RNA, 64 nt, Human
ccucuaggcacccaccguaauacugcuaccuucagggcagaagacacugcucuuuguaacccag

SEQ ID NO: 54838 - RNA, 64 nt, Human
agcacagauuugcucagaaacucugcccaagauugggcagaaguuacuuuaaaaagacuugguu

SEQ ID NO: 54839 - RNA, 64 nt, Human
guggcccaugcagaccaggcgcacguggcucauggggcagaauugccaaggacagcucacgaca

SEQ ID NO: 54840 - RNA, 64 nt, Human
ugggcuggcgcuuggaucuggggugggaguaacagggcagaaaugauuaaaauguuugagcaca

SEQ ID NO: 54841 - RNA, 64 nt, Human
caaccuugguuagcucacccaucagggcagacuugggcagaaaucaugucuuggcauauuguuu

SEQ ID NO: 54842 - RNA, 64 nt, Human
agaguccagguuggugagcauuuagagggaagcagggcagaacucugaacgacaauacgucucu

SEQ ID NO: 54843 - RNA, 64 nt, Human
gaccguuuuaagaaguggcaugugccuugaaagggggcagaauguucagucggucguguuuuua

SEQ ID NO: 54844 - RNA, 64 nt, Human
gaagugcauugaugugagaggagcagugccaaucgggcagaaguuugcaaauaggcagaaugga

SEQ ID NO: 54845 - RNA, 64 nt, Human
aaccagccaaggaauaaaagcugaucuguauguagggcagaaguguggcaaaugcaucaggaac

SEQ ID NO: 54846 - RNA, 64 nt, Human
caauccaccaacagaaugugguuucugccauccugggcagaagcugaaggccagcuucacauuu

SEQ ID NO: 54847 - RNA, 64 nt, Human
gaggugcuggggaugacaggaaggaaggaacacugggcagaaccagagagaugggacaugguag

SEQ ID NO: 54848 - RNA, 64 nt, Human
accacucgcacacaggcgcacaaugguguuagcugggcagaaagaguggcaucucuggcuaccg

SEQ ID NO: 54849 - RNA, 64 nt, Human
acauguuuaaaaucuuggaaaucugcuugagggagggcagaauacuucauccugauucucuuuu

SEQ ID NO: 54850 - RNA, 64 nt, Human
acauguuuaaaaucuugggaaucugcuugagggagggcagaauacuucauccucauucccucuu

SEQ ID NO: 54851 - RNA, 64 nt, Human
accuguuuaaaaucuugggaaucuacuugagggagggcagaauacuucauccugauucucuuuu

SEQ ID NO: 54852 - RNA, 64 nt, Human
ccccucccugucccuucgaguccaggacaacaacgggcagaaaucgagagugugcucuccccgg

SEQ ID NO: 54853 - RNA, 64 nt, Human
cuacauccaugacugccccaacccccuugggguggggcagaaggugaagcaucccaacugacua

SEQ ID NO: 54854 - RNA, 64 nt, Human
uugcugguaaauuagaagcuacaauaauaauuaagggcagaaauuauacuuaaaaagugcagau

SEQ ID NO: 54855 - RNA, 64 nt, Human
aacuccuucuccucuuccugacccucccuccccugggcagaagaaacgcauguggaccagaaga

SEQ ID NO: 54856 - RNA, 64 nt, Human
aacucaggacucgauuuuaaggacccaggagguggggcagaagagaggacugugugccuuuaac

SEQ ID NO: 54857 - RNA, 64 nt, Human
ccccagaccuguuuguaucauccgggcuccuuccgggcagaaacaacugaaaaugcacuucaga

SEQ ID NO: 54858 - RNA, 64 nt, Human
ggcccuuuuugagccuguuuacuccuguggccuugggcagaacaguaaauacucugugcacgga

SEQ ID NO: 54859 - RNA, 64 nt, Human
aucccugugugaucccagaggaggggcaguagcugggcagaaacugcaggcacacauuugggug

SEQ ID NO: 54860 - RNA, 64 nt, Human
accacuuuggguuugaccugcacaucugcagugagggcagaauucaacaagcacaacucacugg

SEQ ID NO: 54861 - RNA, 64 nt, Human
acagugaugggauuugcauuuuagggugauuugggggcagaaauaacugcugaugguagcuggc

SEQ ID NO: 54862 - RNA, 64 nt, Human
uaggaugggaggauagggagccccucaugacugagggcagaagaaauugcuagaagucagaaca

SEQ ID NO: 54863 - RNA, 64 nt, Human
ugcucucagggcaaaaucauguuccccacccccggggcagaaccccucuuagaagccucugagu

SEQ ID NO: 54864 - RNA, 64 nt, Human
acccagagagcuagggcuggagggacagggagcagggcagaaaacacagccuguguacuccucu

SEQ ID NO: 54865 - RNA, 64 nt, Human
uuaaacucauuuuagugcauguauaugaagggcugggcagaaaaugaaaaagcaauacauuccu

SEQ ID NO: 54866 - RNA, 64 nt, Human
ggaaggagcugccuggacccguucaugggggagggggcagaaguguuuuuuauauauguguaua

SEQ ID NO: 54867 - RNA, 64 nt, Human
uagaugaccacccccucccucacaccugugggcagggcagaacagccuggcgggcuacaguuua

SEQ ID NO: 54868 - RNA, 64 nt, Human
gcagcgcccccaggauugaacguggggagccccagggcagaagcgagaaggugugggguuucuu

SEQ ID NO: 54869 - RNA, 64 nt, Human
ugccaggcacauuggacaugggggauacacuagugggcagaaauagccccgucccagagccggc

SEQ ID NO: 54870 - RNA, 64 nt, Human
gcccacugcugcuccauguguaccaagagcagcagggcagaagggcccucccuccagccuaggu

SEQ ID NO: 54871 - RNA, 64 nt, Human
uggggccggggcaggcuguggauggggcggagcagggcagaagauggacugggggagggggcag

SEQ ID NO: 54872 - RNA, 64 nt, Human
cccugagugaugagcuugaaccugugguguuucugggcagaagcuuaucuuuuuugagaguguc

SEQ ID NO: 54873 - RNA, 64 nt, Human
cggccgggucuugucacuugugcaugcuucucaggggcagaacccgcucgugccaucugucgau

SEQ ID NO: 54874 - RNA, 64 nt, Human
aguuaaauaagcaaaaggaaacccagaaggaagagggcagaaucuuuaauuaccuuuuuuucuu

SEQ ID NO: 54875 - RNA, 64 nt, Human
cccacuuuuguaaacugcucugcauauaaaccaagggcagaauguuucacccugaucuuauggg

SEQ ID NO: 54876 - RNA, 64 nt, Human
gagaacuuguaaugguguuagggaacaguuguaggggcagaaaacaacucugaaagugguagaa

SEQ ID NO: 54877 - RNA, 64 nt, Human
gguugccucuugauuaccccaagacagacacaaagggcagaaggugcggucucaacaagauacc

SEQ ID NO: 54878 - RNA, 64 nt, Human
uauggccaucgggucgucuccgaagauuuggcaggggcagaaaacucuggcaggcuuaagauuu

SEQ ID NO: 54879 - RNA, 64 nt, Human
augcuacaugguugauaacacuauuuccauuauugggcagaaucucaguguuuacuuucaauuc

SEQ ID NO: 54880 - RNA, 64 nt, Human
ucugaauauucugugacaaaaaguuaagauucuugggcagaauauuuaaauuggucagucaggu

SEQ ID NO: 54881 - RNA, 64 nt, Human
gggcccccccgccggcggcagcggcuuuggacgagggcagaaccacaacgugcaaggguuccac

SEQ ID NO: 54882 - RNA, 64 nt, Human
ucuaaacagaacccucuuacuauuuaguuuaucugggcagaaccagauuguuauguccuuuguu

SEQ ID NO: 54883 - RNA, 64 nt, Human
ggagagaccuggacagggguggugggaagagcuugggcagaaguggcugaaaaacuaaggcagu

SEQ ID NO: 54884 - RNA, 64 nt, Human
gaaggaagcaggggcugaggaacacuuagagggugggcagaagcggggguucccagucugcuug

SEQ ID NO: 54885 - RNA, 64 nt, Human
ccacauuuccauggugugagauccucuuuacucugggcagaagugagccccccccuuaaaggga

SEQ ID NO: 54886 - RNA, 64 nt, Human
cauggcccaaggccccaaguauaucaaggcacuugggcagaacaugccaaggaaucaaauguca

SEQ ID NO: 54887 - RNA, 64 nt, Human
ggcagcgguggggcacacccauuccacaugcaaagggcagaagcaaacccaguaaaauguuaac

SEQ ID NO: 54888 - RNA, 64 nt, Human
uaaaccacaaaucaucauuuuccaccgagccacugggcagaauucacacugaagcugucguccu

SEQ ID NO: 54889 - RNA, 64 nt, Human
ccccuucacgugggacccacuucccaugcuggaugggcagaagacauugcuuauuggagacaaa

SEQ ID NO: 54890 - RNA, 64 nt, Human
gggucacgugggccccgguacucaagaccagccugggcagaauggugaaaccaccuucucuaca

SEQ ID NO: 54891 - RNA, 64 nt, Human
cucauuggggaacuccagagacaacuuaggaugagggcagaaaagucuuuggggaugauucagu

SEQ ID NO: 54892 - RNA, 64 nt, Human
cuggagaauccaccagcacaagaagaggaggcaggggcagaaacccaagggggcucccccagcc

SEQ ID NO: 54893 - RNA, 64 nt, Human
ugcaaccgacagcaaacagcuuucuccggccucagggcagaaaaagggaauggcagggaguaag

SEQ ID NO: 54894 - RNA, 64 nt, Human
ccacuucacugaaagacaccauuuaucuacccaagggcagaaaguagaacuuacuauucauuaa

SEQ ID NO: 54895 - RNA, 64 nt, Human
uagcucaggaggcagaauucaguguguuaucauugggcagaacuggauccugaaaaauucaaga

SEQ ID NO: 54896 - RNA, 64 nt, Human
caggugcuagaaaguuugugcacauugagggcaugggcagaaucugcucccaaaagcauugaaa

SEQ ID NO: 54897 - RNA, 64 nt, Human
ggcuucugugguuguggaugggaggcuccugguggggcagaaaggcugcaacgcugauuccuaa

SEQ ID NO: 54898 - RNA, 64 nt, Human
ucuuuacauggggcucccuucuuguugaacaauagggcagaaucaggagucaccuuagcaggac

SEQ ID NO: 54899 - RNA, 64 nt, Human
gagucgcgggcagcguggacaucugucccagagggggcagaaucuccaauagaggacugagcac

SEQ ID NO: 54900 - RNA, 64 nt, Human
aacauguggaggcauguggagcuuuauacaaacagggcagaaccacagaagaacguuuuagaaa

SEQ ID NO: 54901 - RNA, 64 nt, Human
ccaccucuuuauagacaagaagugaauuugccuggggcagaacacccacccaaagaguccccac

SEQ ID NO: 54902 - RNA, 64 nt, Human
uccaaaaugaagcauccccgugacaaaccagagugggcagaagcaucgagagcgugacaggaaa

SEQ ID NO: 54903 - RNA, 64 nt, Human
uuuggagccaguggagccugccggcgcaucugaggggcagaaugcugcuagcacuugaaucugg

SEQ ID NO: 54904 - RNA, 64 nt, Human
auaacuaauuuuuccuugugcauuuaauaccucugggcagaauccaaauacuggguucucccgu

SEQ ID NO: 54905 - RNA, 64 nt, Human
cccuccagccagaguugccagcaggcgagugcuugggcagaagagguucgaguccagggucaca

SEQ ID NO: 54906 - RNA, 64 nt, Human
uuuuagucuuuuuaaaaaaaacauccuauacuaagggcagaacccacugccccggccucaauua

SEQ ID NO: 54907 - RNA, 64 nt, Human
ccccucccuucccaugggaguggcuuuccauuuugggcagaaugcugacuaguagacuaacaua

SEQ ID NO: 54908 - RNA, 64 nt, Human
uuuuuaacauacagaauuuuaaauaccacaacuggggcagaauuuaaagcugcaacacagcugg

SEQ ID NO: 54909 - RNA, 64 nt, Human
uaaccuauaugugauggagaucacccaaugccaagggcagaaagcaaaccuaguuaaauaggug

SEQ ID NO: 54910 - RNA, 64 nt, Human
gcuucagugacauugucaacaggaguccaauuaugggcagaaucugcucucugugaccaaaaga

SEQ ID NO: 54911 - RNA, 64 nt, Human
gacggcacccagcgcuguggcugucauucucccagggcagaacccugcguuucucucuguccac

SEQ ID NO: 54912 - RNA, 64 nt, Human
augccccaacgcgugcuagagaggcccaauccaggggcagaaaacagggggccuaaagaauguc

SEQ ID NO: 54913 - RNA, 64 nt, Human
ggcaagagagaaauuccuucuucccagccagagagggcagaagcagaccguagcccauuggccu

SEQ ID NO: 54914 - RNA, 64 nt, Human
ccagggccuggugggcgugagaggauagguggcagggcagaaacugggcagcccugacuugaua

SEQ ID NO: 54915 - RNA, 64 nt, Human
guguuugcuauacgaacauaauggacgugaaguggggcagaaacccagaacucagcauucaagg

SEQ ID NO: 54916 - RNA, 64 nt, Human
gagcagaagacacccuuguagacagacauaagaggggcagaaggcuugaccagaguucucuuga

SEQ ID NO: 54917 - RNA, 64 nt, Human
uggcagcuuccauccuacccaugaccccuacuuggggcagaaaaaacccauccuaaaggcuggg

SEQ ID NO: 54918 - RNA, 64 nt, Human
ugcagaaauaucaaugagacuugguaugggacaggggcagaaaacacuacauaggccuccaagg

SEQ ID NO: 54919 - RNA, 64 nt, Human
caagaccaaugaccccagagcagugcagccaccagggcagaaaugccgggcacaggccaggaca

SEQ ID NO: 54920 - RNA, 64 nt, Human
ccgguggcagcuccaucuuccauuccugguuuuagggcagaauccauggagacugcuuccagaa

SEQ ID NO: 54921 - RNA, 64 nt, Human
uaaggccccagaugaucccagucacuccucucuagggcagaagacuagaggccagggcagcaag

SEQ ID NO: 54922 - RNA, 64 nt, Human
ucccugcagugccagugcugcagcagggagagcugggcagaagcagcgagggggcccagcuggc

SEQ ID NO: 54923 - RNA, 64 nt, Human
uggugaagcagcugcuuugcucuacaaauaccuggggcagaaauuugauuugaaaaguauuauu

SEQ ID NO: 54924 - RNA, 64 nt, Human
ggacaagggccucuucucccauugguuuuccugugggcagaagggcugaggaagauggcccagc

SEQ ID NO: 54925 - RNA, 64 nt, Human
ggggagcuauccagagggucagugcugaaggucugggcagaagaccugcgagacccagaugacu

SEQ ID NO: 54926 - RNA, 64 nt, Human
gguaaugaggaagaaggagaaagagcugggggaagggcagaagacugguuuaggaggaaaagga

SEQ ID NO: 54927 - RNA, 64 nt, Human
agagauuuuuuaaccauggcagggugcuaguggugggcagaaugcuuuuuuuucuuucugaagg

SEQ ID NO: 54928 - RNA, 64 nt, Human
auguugcaugaauccaucgauuuguauuaauguagggcagaauagcugauagaagaaggacuga

SEQ ID NO: 54929 - RNA, 64 nt, Human
ccuaagacagauuggcuuucuaaugaguuuaagugggcagaaguguaggguucaguguguccug

SEQ ID NO: 54930 - RNA, 64 nt, Human
ggaaagauuugaacagagcaaaggcuucaagagagggcagaauguauucggcagaaaagggacu

SEQ ID NO: 54931 - RNA, 64 nt, Human
uauuauuggaaaggaccuaaaaauugguguaauggggcagaaaucugaggaauggacauuucua

SEQ ID NO: 54932 - RNA, 64 nt, Human
ugauuucaggggagauccuuguguuuaucagaaagggcagaaguaggggaagaauaauuuggua

SEQ ID NO: 54933 - RNA, 64 nt, Human
gcaggaaauguaaacguggaauguauggcaggcugggcagaauguauacugauccaggguauag

SEQ ID NO: 54934 - RNA, 64 nt, Human
gggggaggcggagaggggagaagaaggaagggaagggcagaaggaaggagggaagaaaagaaag

SEQ ID NO: 54935 - RNA, 64 nt, Human
auuccuuuugugucauguaaauuguaacucaggggggcagaagcucuggucacccacaccaaca

SEQ ID NO: 54936 - RNA, 64 nt, Human
uugccugagaagaaaccuuggggugccagggugggggcagaagcaugggcuggguuccgguuca

SEQ ID NO: 54937 - RNA, 64 nt, Human
uacaccuggcacccuggcuaccagaauuucauaugggcagaauaauauugugucaaacucuacu

SEQ ID NO: 54938 - RNA, 64 nt, Human
cucuucuccagaggaaaaguacuaggauucuuaagauggcgagaccccaagagggaucucauag

SEQ ID NO: 54939 - RNA, 64 nt, Human
acucuuuuuuuuuuuccuuucagaacauuuuccagauggcgaggucacagcagagagauguggc

SEQ ID NO: 54940 - RNA, 64 nt, Human
gccagagcauuuagggacagaacuugaaagagaagauggcgaaaagggccugagccagggcugg

SEQ ID NO: 54941 - RNA, 64 nt, Human
uugacuugaugagguuugagguacaaggggaaaagauggcgauucugucuuauaaccuccuggg

SEQ ID NO: 54942 - RNA, 64 nt, Human
uaagacacaguaaguuaacccuacauguuauaaagauggcgacuguuaacaaaggcuguaacag

SEQ ID NO: 54943 - RNA, 64 nt, Human
accgcacuccauaaccuccaucuucucccacacugauggcgagcagccccugagcacuuucugg

SEQ ID NO: 54944 - RNA, 64 nt, Human
ggagagaagaagcaauagccgaggaacuuggggggauggcgaaugguuccugcccgggcccaag

SEQ ID NO: 54945 - RNA, 64 nt, Human
gccauacugaaacaugucuuguacagccugcugagauggcgaaacccuguguguggggugcagu

SEQ ID NO: 54946 - RNA, 64 nt, Human
acaaucugaggccuccucucucaguuuuuauauagauggcgagaaccuaaguuucaguugauuu

SEQ ID NO: 54947 - RNA, 64 nt, Human
aacagucccucaggagaggcaguggaccagaagagauggcgaaacgugagcucgccggagguac

SEQ ID NO: 54948 - RNA, 64 nt, Human
agggaugacuagcucuuugagccuguccucagaggauggcgaggcagccgggcaguggaggccu

SEQ ID NO: 54949 - RNA, 64 nt, Human
uucugagaaguugaggcaaaucaguauucccaaggauggcgacaagggcagccaagcagggcuu

SEQ ID NO: 54950 - RNA, 64 nt, Human
cuuucugcggugaucagagggcgcguuuggguuugauggcgaguuucuaaaggcgaggaaaugg

SEQ ID NO: 54951 - RNA, 64 nt, Human
uuuggaaucacagaaaaugcccaaaugaggucaagauggcgagugggugcgagugagaaugagu

SEQ ID NO: 54952 - RNA, 64 nt, Human
agguaacauguucccuagcugaggaugacagagggauggcgaauaccucaugggacagcgcguc

SEQ ID NO: 54953 - RNA, 64 nt, Human
cauagcagauaccauugaauugcuguaaaaauaggauggcgaguuuguguuuuaauuuuucaua

SEQ ID NO: 54954 - RNA, 64 nt, Human
acaagucacuugacccaucuuaggcugagggugugauggcgauaauaguaucacgauaccaccc

SEQ ID NO: 54955 - RNA, 64 nt, Human
uuacacacccuaggaaacauuuccaagauccugugauggcgagacaaaugauccuuaaagaagg

SEQ ID NO: 54956 - RNA, 64 nt, Human
gagucaacuggagcaagaaggaaggaggcagacugauggcgauucccucucacccgggacucuc

SEQ ID NO: 54957 - RNA, 64 nt, Human
acccagucugcguccugggucugcuagguucgaugauggcgaacucguaucugcauccggugca

SEQ ID NO: 54958 - RNA, 64 nt, Human
caaacuguggccgaccgcagcugugccguggcacgauggcgaggaagccagccccaaggaaaca

SEQ ID NO: 54959 - RNA, 64 nt, Human
gggaggccaagguggggggaucacaaggucacuagauggcgagcauccuggccaacauggugaa

SEQ ID NO: 54960 - RNA, 64 nt, Human
gaaggagcagugaagccaagccaggaaacaccaagauggcgagccagugugguuguagagauug

SEQ ID NO: 54961 - RNA, 64 nt, Human
ggggcagagcggggagcugcagcacagcaacagugauggcgaggacuuccccguggcgcuguuu

SEQ ID NO: 54962 - RNA, 64 nt, Human
cuccuugcagccacagagcauuuuccaaguucccgauggcgaacggggcucagcaccagagacc

SEQ ID NO: 54963 - RNA, 64 nt, Human
ggugguuugaucauuucugccaugauguuuacaagauggcgaccaccaaagucaaacgacuaac

SEQ ID NO: 54964 - RNA, 64 nt, Human
ggcaucucauugugauuuugguuugcauuucccugauggcgaaugauauugagcaucuuuucau

SEQ ID NO: 54965 - RNA, 64 nt, Human
ugccccuauggggcucuguccugcaccccucagggauggcgacagcaggccagacacagucuga

SEQ ID NO: 54966 - RNA, 64 nt, Human
uagaugcuccuuuugaccuuuucaaauaaauauggauggcgagcuccuaggccucuggcuuccu

SEQ ID NO: 54967 - RNA, 64 nt, Human
guagguggaguuccugacuaaacugccacuuuaggauggcgaugcaggugucuuuuccccccag

SEQ ID NO: 54968 - RNA, 64 nt, Human
cuggucguucagcagccacgacagcaccaugugagauggcgagguggcuggacagcaccagcag

SEQ ID NO: 54969 - RNA, 64 nt, Human
augugcuggugaacacugugaccaggcuuuuguagauggcgauguguuauagacggugcucacu

SEQ ID NO: 54970 - RNA, 64 nt, Human
uggcuucugauccauaucauauuuauuuguagaagauggcgaaacaguuuagcuggugguucuu

SEQ ID NO: 54971 - RNA, 64 nt, Human
ugcgaagaauacuaaauguaguugagaaauaauugauggcgagaguuugcuagucucccucccc

SEQ ID NO: 54972 - RNA, 64 nt, Human
ugcgaaagaauuuguaguaaaccaggccucccaggauggcgagcuccaguaagaugauaaugga

SEQ ID NO: 54973 - RNA, 64 nt, Human
auaagaaaagccagucaaaacccaccaaaaccaagauggcgacaaaagugaucucugguugucc

SEQ ID NO: 54974 - RNA, 64 nt, Human
ggaacacguggccugagagcugggcaacagcagugauggcgaugcccuccaccucuuuccucca

SEQ ID NO: 54975 - RNA, 64 nt, Human
uauaguuaaauuaagggugacaguacaauaaagugauggcgauguagacgggccacauucugua

SEQ ID NO: 54976 - RNA, 63 nt, Human
ugagggaagaugagggcuaaaggugcgagcccagauggcgagccccaggggauggcccuggcu

SEQ ID NO: 54977 - RNA, 64 nt, Human
cuugaggucaggaguucgagaccagccuggccaagauggcgaaacccugugucuacuaaaaaua

SEQ ID NO: 54978 - RNA, 64 nt, Human
accaaguccgaagucaacaacaagcaaugauggcgauggcgauucuaguuaauaaaaagggggg

SEQ ID NO: 54979 - RNA, 64 nt, Human
uccgaaaccaaguccgaagucaacaacaagcaaugauggcgauggcgauucuaguuaauaaaaa

SEQ ID NO: 54980 - RNA, 64 nt, Human
uuccccagagugggauccacuucuugguuccugggauggcgauggggacucugccgcuguguag

SEQ ID NO: 54981 - RNA, 64 nt, Human
ucccugcuuucucuuucucuuucucugugucucagauggcgauuuugcugacagcugccaagaa

SEQ ID NO: 54982 - RNA, 64 nt, Human
ccagagggaggugcuguuaucucguaccuccugggauggcgaucccuacugaacgcuugugucu

SEQ ID NO: 54983 - RNA, 64 nt, Human
cucugaagcaggaaugugacucccugggcccccagauggcgagcagcaccaccuccaagccguc

SEQ ID NO: 54984 - RNA, 64 nt, Human
gucucuacuaaaaauacaaaaauuagcugggcaugauggcgagugucuguaaucccagcuacuc

SEQ ID NO: 54985 - RNA, 64 nt, Human
ucaaagccacagucuguuccuuccacagccacaagauggcgacaugagccuaagucaaguccug

SEQ ID NO: 54986 - RNA, 64 nt, Human
agaaccagugcagacucaagacuuauggaacagggauggcgaggccucucucaggagcaggggc

SEQ ID NO: 54987 - RNA, 64 nt, Human
uggcuggcaggaacugggguggcuaucaauauuggauggcgaggacagcguggcacuggcugcg

SEQ ID NO: 54988 - RNA, 64 nt, Human
aaaagaugauugugacaauucagagcauaacucagauggcgagaaggcagcauuaucucugugc

SEQ ID NO: 54989 - RNA, 64 nt, Human
ucugcuugauucugggguucaguguaggucagcugauggcgaaccaugguggugguuuggcuuc

SEQ ID NO: 54990 - RNA, 64 nt, Human
ucaucccacccgucucgugcuguugcuucccguagauggcgagcaccuugcaggcagccuucug

SEQ ID NO: 54991 - RNA, 64 nt, Human
ugcucagucacuccugcuucuacccccugucacugauggcgagccuugcccagcuugagaccug

SEQ ID NO: 54992 - RNA, 64 nt, Human
uggcuuaugcuugacaaaccaguaacaacugugggauggcgauggugggaugugucgcaagcaa

SEQ ID NO: 54993 - RNA, 64 nt, Human
uucuggaucaggagggguguuaaaacaucaaaaugauggcgacuuguauaaguagaauucuuac

SEQ ID NO: 54994 - RNA, 64 nt, Human
gaucuuucacccacagaaagagagcacugaccccgauggcgauggacuacugaagcccuaacuc

SEQ ID NO: 54995 - RNA, 64 nt, Human
aguuuuucaagugcauaacuauuuuugaccagcagauggcgauacgcuucaguauuuuaugcaa

SEQ ID NO: 54996 - RNA, 64 nt, Human
auggagaaaccaaauuggacaaaucaucaccacugauggcgaugauuacaauaaaaucaaguuu

SEQ ID NO: 54997 - RNA, 64 nt, Human
gcuucucugcccagcuuuucauugcugugacagugauggcgaaagaggguaauaaccagacaca

SEQ ID NO: 54998 - RNA, 64 nt, Human
cugcagauugccgugaacucuaucaauagucucuuuuccgcaggcaaaguggcauuuucuaaac

SEQ ID NO: 54999 - RNA, 64 nt, Human
gaaagcuagacccgcuucagggccaggaguggcguuuccgcacaggauuuccuaagacgagagg

SEQ ID NO: 55000 - RNA, 64 nt, Human
ccuccagcugccgcaauuuccaugccaggauauuuuuccgcaaaucagucgguugaaauucaga

SEQ ID NO: 55001 - RNA, 64 nt, Human
uuuugcacaucggucucugccacacgcaguagaauuuccgcagggcuguggcucggccagcagc

SEQ ID NO: 55002 - RNA, 64 nt, Human
uuuguguugggggggguguauggugcugguuacuuuuccgcaguuggcauggguugcccuacag

SEQ ID NO: 55003 - RNA, 64 nt, Human
guugaagucacuguguauguuuguuuggucaauguuuccgcaguauuuauuaaaacauacuuuu

SEQ ID NO: 55004 - RNA, 64 nt, Human
gccuguuuuuauauacccuguaagcuaagaaugguuuccgcauuuuuaaaugguugggaaaaga

SEQ ID NO: 55005 - RNA, 64 nt, Human
ggcacuggcauagcacgguagugguuuggggagguuuccgcaggucugcuccccaccccugccu

SEQ ID NO: 55006 - RNA, 64 nt, Human
uaaaccuuaauguguuugugugucuauacauugcuuuccgcauuucaagacauccagacgcuau

SEQ ID NO: 55007 - RNA, 64 nt, Human
acaggcugcuccacccggacgccguacccgcccuuuuccgcaccgugcccgucuucacacugcc

SEQ ID NO: 55008 - RNA, 64 nt, Human
caaguuuuccauauuuuuacaacucacuggugguuuuccgcauucuuuguacacccaugaaaga

SEQ ID NO: 55009 - RNA, 64 nt, Human
uuauugucccacaauauuaccuuaagauuuuucuuuuccgcacuaccugaacauuguaauacag

SEQ ID NO: 55010 - RNA, 64 nt, Human
auugcccucuuuguauucccauuuucuacaguuuuuuccgcagacuucuuucugcaaauuauuc

SEQ ID NO: 55011 - RNA, 64 nt, Human
uuaaaaaagcaaugcacauguugguuguggcuguuuuccgcaugcuaucuucauaucuaaaugc

SEQ ID NO: 55012 - RNA, 64 nt, Human
guacuugcauauggugaauuacuacuguugacaguuuccgcagaaauccuauuucaguggacca

SEQ ID NO: 55013 - RNA, 64 nt, Human
uguuccauauuuaucuuugaacauguagcaucucuuuccgcaaauaaaugcagacuuugguuuu

SEQ ID NO: 55014 - RNA, 64 nt, Human
gugucuguugagugcaacaagagcaaaaugaugcuuuccgcacauccaucccuuaggugagcuu

SEQ ID NO: 55015 - RNA, 64 nt, Human
ccuuucugcuuuguaaguuuucucuuuuugggauuuuccgcagaucagggcaacacagaaugac

SEQ ID NO: 55016 - RNA, 64 nt, Human
agggucagaugcugcugugagaggcacagagcccuuuccgcauguggaagagugggaggaagca

SEQ ID NO: 55017 - RNA, 64 nt, Human
augcgucaguuauuuagggauggucuuuuguucauuuccgcauccauuauuuaaaccaguggaa

SEQ ID NO: 55018 - RNA, 64 nt, Human
gggugugagcauucauguucucugcucaccuugguuuccgcacaccuucgcaaugugaacaggu

SEQ ID NO: 55019 - RNA, 64 nt, Human
ccccgagccccucugcagcucacccuuggcuuguuuuccgcaaacccgguaaacgcaagcccuu

SEQ ID NO: 55020 - RNA, 64 nt, Human
aguuauguuuugaggcagcaugguuugauuagcauuuccgcauccaugcaaacgagucacauau

SEQ ID NO: 55021 - RNA, 64 nt, Human
guuuacuguuguuuagaaauuugcaagggcuucuuuuccgcaaaugccaccagcagauuauaau

SEQ ID NO: 55022 - RNA, 64 nt, Human
ggacccagagagcagcccuucccugcucaaagccuuuccgcacccuccugacuguccuggaugu

SEQ ID NO: 55023 - RNA, 64 nt, Human
aucuauuuccuuaccucuagccagucacuuccuuuuuccgcaguugugauggguuuugcugagc

SEQ ID NO: 55024 - RNA, 64 nt, Human
aagugaacaccauggucaguugugagcauuuugguuuccgcaaaggauggauggugagcaucau

SEQ ID NO: 55025 - RNA, 64 nt, Human
cuucuaccaggcuuuuccuuugaugccgccuggauuuccgcaccugccugucuccucucccaga

SEQ ID NO: 55026 - RNA, 64 nt, Human
agaucaauuucagcagggccaggcaggaccuggguuuccgcacuuuuaaucaucgaugcccagg

SEQ ID NO: 55027 - RNA, 64 nt, Human
cuuuaguuggguuauucaagauggcacaaaaagguuuccgcagaggugguaugcugugcuuuug

SEQ ID NO: 55028 - RNA, 64 nt, Human
ggaacuccgcauccuugucccucugcauucccaguuuccgcaggagccuugaucaauggggaag

SEQ ID NO: 55029 - RNA, 64 nt, Human
ccccggagagaagcagcugccgaaagcugcagccuuuccgcacucugagaccaugaucuuccuc

SEQ ID NO: 55030 - RNA, 64 nt, Human
gggagccuaggaccacucagccccuaggaguauauuuccgcacuucagaauuccauaucuugcg

SEQ ID NO: 55031 - RNA, 64 nt, Human
aucucugaggaauuggguuauaggugauuuucccuuuccgcaugauaaauuuauguaauauuug

SEQ ID NO: 55032 - RNA, 64 nt, Human
auuacauuucaaaacaaacccuaauaaauccacauuuccgcauggcucauucaccuggaauaau

SEQ ID NO: 55033 - RNA, 64 nt, Human
ucacuucccuguuccauucaguaagagcuuuacuuuuccgcagaaaugaaauuuuaucuguacc

SEQ ID NO: 55034 - RNA, 64 nt, Human
caaaaguuguugcacuccugaaauucuauuaacauuuccgcagaagaugaguagggagaugcug

SEQ ID NO: 55035 - RNA, 64 nt, Human
gagucucuuguguauugauggccggacacacucguuuccgcaguggcugcuuuccuggaagacg

SEQ ID NO: 55036 - RNA, 64 nt, Human
ggaaguucaaagaugaaagcaccauguaucaggauuuccgcauuauaaaaaugaacuaaacauu

SEQ ID NO: 55037 - RNA, 64 nt, Human
uuguaaauuuuuuaaaauuucuuuuauaauaugcuuuccgcaguccuaacuaugcugcguuuua

SEQ ID NO: 55038 - RNA, 64 nt, Human
uuucuuuguguuuggaucaaaaagaaacuuuguuuuuccgcaauugaagguuguauguaaaucu

SEQ ID NO: 55039 - RNA, 64 nt, Human
auuaacacauuaucaaaguccucuuacaauuuauuuuccgcagcaugucagcuaaguagaccca

SEQ ID NO: 55040 - RNA, 64 nt, Human
caaucuccauucgacugagguacuacaaacacgauuuccgcaaccuggaguuggaggcauugca

SEQ ID NO: 55041 - RNA, 64 nt, Human
cuggaggcuacuuugcacucuuccucuucuccuuuuuccgcacuucuccaccccucccacauuu

SEQ ID NO: 55042 - RNA, 64 nt, Human
gagaggggagcccccuccaucuggcccccuucccuuuccgcacuguccgcuuugugaggcucag

SEQ ID NO: 55043 - RNA, 64 nt, Human
cucuucugguuauaaagcagacauguggccaucuuuuccgcaggguuagagugggcuccuuucu

SEQ ID NO: 55044 - RNA, 64 nt, Human
uuaagcccagcucaggaacaguucaggagcuaaauuuccgcagcaauaagaauguuuggggaua

SEQ ID NO: 55045 - RNA, 64 nt, Human
acccccaggaccugacacaucucgucuccccucuuuuccgcacugugggcacaaagacacuuuu

SEQ ID NO: 55046 - RNA, 64 nt, Human
ccugaccacagggacccagaagacccgcuucuccuuuccgcacacccggccugucacccugcuu

SEQ ID NO: 55047 - RNA, 64 nt, Human
aagagcauuuauaauaauuauaugugauagagauuuuccgcaggccaaagucucacuaggcauc

SEQ ID NO: 55048 - RNA, 64 nt, Human
uugggguaugacugggggagaguggaacaugccuuuuccgcacaauauuaauuccuuuuuguau

SEQ ID NO: 55049 - RNA, 64 nt, Human
ccaacccacugagcgccugaggccauucccuccuuuuccgcaugccuccugccuccugggcuau

SEQ ID NO: 55050 - RNA, 64 nt, Human
auuuuuguagauguagcuuaggacgugaguuauuuuuccgcagacuggccaagagccagguucu

SEQ ID NO: 55051 - RNA, 64 nt, Human
aacaaauuccuuuacccaagguuaugcuaugaccuuuccgcaguuuacuuugauuuucuauguu

SEQ ID NO: 55052 - RNA, 64 nt, Human
cgcccuguuuggcaucuaauucuuauuuuuaauuuuuccgcaccuuaucaauugcaaaaugcgu

SEQ ID NO: 55053 - RNA, 64 nt, Human
caaugguaaccccaguaauucuguaauguuguaauuuccgcauggcccugagcucccuuuuccu

SEQ ID NO: 55054 - RNA, 64 nt, Human
accaccggcaccgccucccaaacagggcugcugguuuccgcagccacugcuccaccucccccaa

SEQ ID NO: 55055 - RNA, 64 nt, Human; identical to SEQ ID NO: 54998

SEQ ID NO: 55056 - RNA, 64 nt, Human; identical to SEQ ID NO: 54999

SEQ ID NO: 55057 - RNA, 64 nt, Human; identical to SEQ ID NO: 55000

SEQ ID NO: 55058 - RNA, 64 nt, Human; identical to SEQ ID NO: 55001

SEQ ID NO: 55059 - RNA, 64 nt, Human; identical to SEQ ID NO: 55002

SEQ ID NO: 55060 - RNA, 64 nt, Human
uggagguuaaaagagccuuuuggacagaaaacugggccaggaaaaggcaucucagaccacaaau

SEQ ID NO: 55061 - RNA, 64 nt, Human; identical to SEQ ID NO: 55003

SEQ ID NO: 55062 - RNA, 64 nt, Human; identical to SEQ ID NO: 55004

SEQ ID NO: 55063 - RNA, 64 nt, Human; identical to SEQ ID NO: 55005

SEQ ID NO: 55064 - RNA, 64 nt, Human; identical to SEQ ID NO: 55006

SEQ ID NO: 55065 - RNA, 64 nt, Human; identical to SEQ ID NO: 55007

SEQ ID NO: 55066 - RNA, 64 nt, Human; identical to SEQ ID NO: 55008

SEQ ID NO: 55067 - RNA, 64 nt, Human; identical to SEQ ID NO: 55009

SEQ ID NO: 55068 - RNA, 64 nt, Human; identical to SEQ ID NO: 55010

SEQ ID NO: 55069 - RNA, 64 nt, Human; identical to SEQ ID NO: 55011

SEQ ID NO: 55070 - RNA, 64 nt, Human; identical to SEQ ID NO: 55012

SEQ ID NO: 55071 - RNA, 64 nt, Human; identical to SEQ ID NO: 55013

SEQ ID NO: 55072 - RNA, 64 nt, Human; identical to SEQ ID NO: 55014

SEQ ID NO: 55073 - RNA, 64 nt, Human; identical to SEQ ID NO: 55015

SEQ ID NO: 55074 - RNA, 64 nt, Human; identical to SEQ ID NO: 55016

SEQ ID NO: 55075 - RNA, 64 nt, Human; identical to SEQ ID NO: 55017

SEQ ID NO: 55076 - RNA, 64 nt, Human; identical to SEQ ID NO: 55018

SEQ ID NO: 55077 - RNA, 64 nt, Human; identical to SEQ ID NO: 55019

SEQ ID NO: 55078 - RNA, 64 nt, Human; identical to SEQ ID NO: 55020

SEQ ID NO: 55079 - RNA, 64 nt, Human; identical to SEQ ID NO: 55021

SEQ ID NO: 55080 - RNA, 64 nt, Human; identical to SEQ ID NO: 55022

SEQ ID NO: 55081 - RNA, 64 nt, Human; identical to SEQ ID NO: 55023

SEQ ID NO: 55082 - RNA, 64 nt, Human; identical to SEQ ID NO: 55024

SEQ ID NO: 55083 - RNA, 64 nt, Human; identical to SEQ ID NO: 55025

SEQ ID NO: 55084 - RNA, 64 nt, Human; identical to SEQ ID NO: 55026

SEQ ID NO: 55085 - RNA, 64 nt, Human; identical to SEQ ID NO: 55027

SEQ ID NO: 55086 - RNA, 64 nt, Human; identical to SEQ ID NO: 55028

SEQ ID NO: 55087 - RNA, 64 nt, Human; identical to SEQ ID NO: 55029

SEQ ID NO: 55088 - RNA, 64 nt, Human; identical to SEQ ID NO: 55030

SEQ ID NO: 55089 - RNA, 64 nt, Human; identical to SEQ ID NO: 55031

SEQ ID NO: 55090 - RNA, 64 nt, Human; identical to SEQ ID NO: 55032

SEQ ID NO: 55091 - RNA, 64 nt, Human; identical to SEQ ID NO: 55033

SEQ ID NO: 55092 - RNA, 64 nt, Human; identical to SEQ ID NO: 55034

SEQ ID NO: 55093 - RNA, 64 nt, Human; identical to SEQ ID NO: 55035

SEQ ID NO: 55094 - RNA, 64 nt, Human; identical to SEQ ID NO: 55036

SEQ ID NO: 55095 - RNA, 64 nt, Human; identical to SEQ ID NO: 55037

SEQ ID NO: 55096 - RNA, 64 nt, Human; identical to SEQ ID NO: 55038

SEQ ID NO: 55097 - RNA, 64 nt, Human; identical to SEQ ID NO: 55039

SEQ ID NO: 55098 - RNA, 64 nt, Human; identical to SEQ ID NO: 55040

SEQ ID NO: 55099 - RNA, 64 nt, Human; identical to SEQ ID NO: 55041

SEQ ID NO: 55100 - RNA, 64 nt, Human; identical to SEQ ID NO: 55042

SEQ ID NO: 55101 - RNA, 64 nt, Human; identical to SEQ ID NO: 55043

SEQ ID NO: 55102 - RNA, 64 nt, Human; identical to SEQ ID NO: 55044

SEQ ID NO: 55103 - RNA, 64 nt, Human; identical to SEQ ID NO: 55045

SEQ ID NO: 55104 - RNA, 64 nt, Human; identical to SEQ ID NO: 55046

SEQ ID NO: 55105 - RNA, 64 nt, Human; identical to SEQ ID NO: 55047

SEQ ID NO: 55106 - RNA, 64 nt, Human; identical to SEQ ID NO: 55048

SEQ ID NO: 55107 - RNA, 64 nt, Human; identical to SEQ ID NO: 55049

SEQ ID NO: 55108 - RNA, 64 nt, Human; identical to SEQ ID NO: 55050

SEQ ID NO: 55109 - RNA, 64 nt, Human; identical to SEQ ID NO: 55051

SEQ ID NO: 55110 - RNA, 64 nt, Human; identical to SEQ ID NO: 55052

SEQ ID NO: 55111 - RNA, 64 nt, Human; identical to SEQ ID NO: 55053

SEQ ID NO: 55112 - RNA, 64 nt, Human; identical to SEQ ID NO: 55054

SEQ ID NO: 55113 - RNA, 64 nt, Human
gacacucuggcugcucccugacagcaccugaagugaccuggaaucagugaagccaaagggacug

SEQ ID NO: 55114 - RNA, 64 nt, Human
ucaggugcuggaggagcugaaggcuucgccacaggaccuggaguuaucaggggucaggcgccug

SEQ ID NO: 55115 - RNA, 64 nt, Human
uccuagcugcucuggaggcuccuuugauucucuagaccuggaaaaggugucccuaggcagagcc

SEQ ID NO: 55116 - RNA, 64 nt, Human
gcucagagcuggggauuuccugccuggaacaagggaccuggagaauguuuuugcgugggaugau

SEQ ID NO: 55117 - RNA, 64 nt, Human
auaggauaucuguaaggcuggugggacaguuuuggaccuggaaucauguguaacuaacaagguu

SEQ ID NO: 55118 - RNA, 64 nt, Human
cuuaccuuucuucuaaggaauugaagcucccagugaccuggagggaggauuccuggaaaccaaa

SEQ ID NO: 55119 - RNA, 64 nt, Human
cgcaagucacucuuguggcucagauugcucuuaggaccuggagggacagaccagaaucaggguc

SEQ ID NO: 55120 - RNA, 64 nt, Human
ugaccaaaacauguucugauauguguaggacagagaccuggaugugcuuugaucguuaaugagg

SEQ ID NO: 55121 - RNA, 64 nt, Human
acucucccuuuucaguaagcgcaaagccucagaagaccuggaacaagauucugccaucucugug

SEQ ID NO: 55122 - RNA, 64 nt, Human
cucuuccuugucaugucugaagcuguggaccagagaccuggacuuuugucugcuuaagggaaau

SEQ ID NO: 55123 - RNA, 64 nt, Human
aacuguggaggagagcacauuugauuaucauauugaccuggauuuagacucaaagcacauuugu

SEQ ID NO: 55124 - RNA, 64 nt, Human
agaggccuccgaguucuucaggucuggaaaguaugaccuggaauucaaguuucucgacgacccc

SEQ ID NO: 55125 - RNA, 64 nt, Human
acuguacagagcccugcugcggcguguuaggaaugaccuggaauugucaauaaacagaugcugc

SEQ ID NO: 55126 - RNA, 64 nt, Human
uguuugugugugauccuucuccuggccccaggucgaccuggaaggcguuucugagucuuguacu

SEQ ID NO: 55127 - RNA, 64 nt, Human
aucuaugaagucucugcagggcaaggggaccagggaccuggaacccucuuggccaaggggagug

SEQ ID NO: 55128 - RNA, 64 nt, Human
cugaguggcuuccaggagagcgggaugaacccuggaccuggaguaggagacccggaugcacugg

SEQ ID NO: 55129 - RNA, 64 nt, Human
ggcccugccccucccuagauccaggcuucucccggaccuggacuagggccucggaggcuccucc

SEQ ID NO: 55130 - RNA, 64 nt, Human
ugccaccugcaagagcccugcccaggagauagaagaccuggacuccagcccaccguggccacug

SEQ ID NO: 55131 - RNA, 64 nt, Human
aaaaggccuuuaugaagaaaaacacuuaagcugagaccuggauaagugggagcuagccagauaa

SEQ ID NO: 55132 - RNA, 53 nt, Human
ugcagcagguggcacccugacgggaccuggaucugggcgggguggugcgcucc

SEQ ID NO: 55133 - RNA, 64 nt, Human
acuuuucccacuccaagcccagcccauggagauugaccuggauggggcaggccaccuggcucuc

SEQ ID NO: 55134 - RNA, 64 nt, Human
gaauugggauuugcagagaugaaaaagacugggugaccuggaucucugcuuaauacaucuacaa

SEQ ID NO: 55135 - RNA, 64 nt, Human
cccaagugaaacgguuugagagacgcagugcccugaccuggacaagcugugcacgucuccuguu

SEQ ID NO: 55136 - RNA, 64 nt, Human
aagaggggaucuuuggacuacguucuuggcuccagaccuggaauccacaaaagccaaaccagcu

SEQ ID NO: 55137 - RNA, 64 nt, Human
ugccuguuucuuguguacaugggggggccacagagaccuggaaagagaacucucccagggccca

SEQ ID NO: 55138 - RNA, 64 nt, Human
cucuccccuuacucuucaauuuauucuacuucuggaccuggacuuacccaaacugugauacuac

SEQ ID NO: 55139 - RNA, 64 nt, Human
cagccucagaacugaaggagauuguugacccagugaccuggaguugaggcucagggagagaucu

SEQ ID NO: 55140 - RNA, 64 nt, Human
acaugaaguagugcaugguuauuuuacauaguaagaccuggaauuuuaugggaaaaguaugucu

SEQ ID NO: 55141 - RNA, 64 nt, Human
gagucacugcacacacuuuguagcucaauguugugaccuggagcagaggacauuagaacaagau

SEQ ID NO: 55142 - RNA, 64 nt, Human
ggguguaucuuaauucaguuaaauauuauuaguagaccuggauuuucccccuugaccccaucag

SEQ ID NO: 55143 - RNA, 64 nt, Human
ugaacacaguggggagggcugugaaggcucaugugaccuggaucugaggucucugauagaaauc

SEQ ID NO: 55144 - RNA, 64 nt, Human
aauucuaaauagguaccaaaagaguauugauuaugaccuggagccugagcuuugggagaauaua

SEQ ID NO: 55145 - RNA, 64 nt, Human
gagcauauaauguaaagggcuuuagagugagacagaccuggauuaaaaucugccauuuaauuag

SEQ ID NO: 55146 - RNA, 64 nt, Human
ucccagccugggagccugcugucaggagcaggcagaccuggacucacagccuggcugugaugcu

SEQ ID NO: 55147 - RNA, 64 nt, Human
cccugggggucccaggauccccugcuacuccacugaccuggaagagcuggguaccaggccaccc

SEQ ID NO: 55148 - RNA, 64 nt, Human
augccugcauucauauuugcacaggaaaaauaaagaccuggauuuaaaaauaggaaugacucuu

SEQ ID NO: 55149 - RNA, 64 nt, Human
uugcgcugugggcuguggucacgugcucccagaagaccuggaauucaaaagaaauggagcuauu

SEQ ID NO: 55150 - RNA, 64 nt, Human
cauacugaacaaggggcuuuauguccucaccuaugaccuggaauaguuuaaauaugguguucaa

SEQ ID NO: 55151 - RNA, 64 nt, Human
guuucuguaacuuucucccccucuacugagaagugaccuggaagugagaaguucuuugcagauu

SEQ ID NO: 55152 - RNA, 64 nt, Human
ggaagaaagauucaauuaaguuauuaacauuugggaccuggauaauuauaucagaguaugucag

SEQ ID NO: 55153 - RNA, 64 nt, Human
ucccuucccgacccagccagcugcagggcacggggaccuggauaguuaagggcuuuuccaaaca

SEQ ID NO: 55154 - RNA, 64 nt, Human
ugccugugggcuggggagccuuggaugggguggggaccuggaaugggucucucuugccccaccu

SEQ ID NO: 55155 - RNA, 64 nt, Human
gaagacagggauugggaaguggugggugauggaggaccuggauauauuuaucaaauaaaggguu

SEQ ID NO: 55156 - RNA, 64 nt, Human
caugugugaauuuaagauaccgaagucuuaaagugaccuggacgugaaggaaaaaguaagauga

SEQ ID NO: 55157 - RNA, 64 nt, Human
gccacauagaaaaaaguugccuuucuuuuuuuaugaccuggauauauaagcaaaucagcuagga

SEQ ID NO: 55158 - RNA, 58 nt, Human
ccaacccauuugcucaguagcuaugauagaccuggacaaauaacuugacaaauugcug

SEQ ID NO: 55159 - RNA, 64 nt, Human
ccaguuucaagaugaagaacuacaugauacaguggaccuggagaccauccccuuggaaagacaa

SEQ ID NO: 55160 - RNA, 64 nt, Human
ggcuuacagaaaugacugccggucauuugaaugagaccuggaacaaaucguuucucagaaguac

SEQ ID NO: 55161 - RNA, 64 nt, Human
gaacacguucgacaaaagcaguggagaagaggaagaccuggagcaauaaaagacaaaugcaaca

SEQ ID NO: 55162 - RNA, 64 nt, Human
agcuaacugugaaugaggagaguaccugcugcaggaccuggaggucaggugugaaugcuguauu

SEQ ID NO: 55163 - RNA, 64 nt, Human
auccagacaagugggagagcccgugggggcaggggaccuggagcugccagcaccaagcgugauu

SEQ ID NO: 55164 - RNA, 64 nt, Human
ugagggugaagagauuuccucaaaagacuuaaaugaccuggauugaucagagagaauugaacug

SEQ ID NO: 55165 - RNA, 64 nt, Human
acacuuaugggccaagcccagcuuaauggcucaugaccuggaaauaaaauuuaggaccaauacc

SEQ ID NO: 55166 - RNA, 64 nt, Human
aggaagauauguguguauuucauacacacacaaggaccuggauuaaaaauccaaaaagugauuc

SEQ ID NO: 55167 - RNA, 64 nt, Human
auuucugagucacaaacagcaggauaccucacaggaccuggaguugcuggcuaccuuaccgcag

SEQ ID NO: 55168 - RNA, 64 nt, Human
cuaaaauugccugagaggcagcucuaaagcacaagaccuggaugugugacacacaguuuuggaa

SEQ ID NO: 55169 - RNA, 64 nt, Human
agucugaccacaacugagggcugguggggccggggaccuggagccccauggacacacagauggc

SEQ ID NO: 55170 - RNA, 64 nt, Human
uccugucuaugugcaggcccaggguguggugaaggaccuggagccggaacugcugcggcaccug

SEQ ID NO: 55171 - RNA, 64 nt, Human
gcacucugucucgcaauuuugaggaggcuguuccgaccuggaagcguuaaacugcugcauguca

SEQ ID NO: 55172 - RNA, 64 nt, Human
gccaguuuggcuuuuauugccugaaccuuaugcugaccuggagaggagaugggggacagugcug

SEQ ID NO: 55173 - RNA, 64 nt, Human
gaauaaggagcugaaguacuguaagaauccugaggaccuggagugcaaugagaaugugaaacac

SEQ ID NO: 55174 - RNA, 64 nt, Human
ggggucacagugauagggccacccuggaugggaagaccuggagggcagccacacagcuggacgg

SEQ ID NO: 55175 - RNA, 64 nt, Human
uggcuauuacaaagcaguacugcaguaugucuuggaccuggaaaguuggacauguguguggcuc

SEQ ID NO: 55176 - RNA, 64 nt, Human
cugggcugaccuacuaaaaccugcuccauguauggaccuggaaggccauugcugccauggcacu

SEQ ID NO: 55177 - RNA, 64 nt, Human
uucugccccauguugaggaaacaaucuguugauagaccuggaauuuagaguauaucugaaaagc

SEQ ID NO: 55178 - RNA, 64 nt, Human
gaucauuucgugaaggagcaaggcugaagaaccagaccuggacuuucuuaggcaaguaaauucu

SEQ ID NO: 55179 - RNA, 52 nt, Human
gggccuuuuuaguuggcuaacugaccuggaaagaaaaagcaauaaccucaaa

SEQ ID NO: 55180 - RNA, 64 nt, Human
uguaauggaaaggguguuggcauuggugucuggagaccuggauuugagucuuggugcuaucaau

SEQ ID NO: 55181 - RNA, 64 nt, Human
caucacggagcuacgacuuuggguacugcggacagaccuggauaggcccagcauucguucugaa

SEQ ID NO: 55182 - RNA, 64 nt, Human
acuaaccuugauuuuuguauugcaaaaucagauagaccuggaaacauaaauuuaaauccuuaga

SEQ ID NO: 55183 - RNA, 64 nt, Human
uaaguucuguauacauaauuaccaaacacuaugugaccuggaguuuguguuguuucugcucuga

SEQ ID NO: 55184 - RNA, 64 nt, Human
gugggaaaauaaguugacuuucaaaucacguuaggaccuggauugaggaggugugcaguucgcu

SEQ ID NO: 55185 - RNA, 64 nt, Human
aauguuuguuuauauaucacuauaaaauccaguugaccuggacaguauuauauguacauaucua

SEQ ID NO: 55186 - RNA, 64 nt, Human
gauaaggguucaucucacuggacgaguucaggcagaccuggaagcuguucagcucucacaugaa

SEQ ID NO: 55187 - RNA, 64 nt, Human
cuuugcuuggugaagaaacugugugagcuguccugaccuggacgaugacguggggaaacccucc

SEQ ID NO: 55188 - RNA, 64 nt, Human
ugaaaagaauccguuuuauauccagguuucagaggaccuggaauaauaaaaagcuuuggauuuu

SEQ ID NO: 55189 - RNA, 64 nt, Human
agcaaaagugaaaggccuggcuuugggguucagagaccuggaauagaaacuuggaucuaugcac

SEQ ID NO: 55190 - RNA, 64 nt, Human
aauaaucgaacaggaaaaaguugcccucaagccugaccuggaaccguuccucaccuucauccuc

SEQ ID NO: 55191 - RNA, 64 nt, Human
ggaacuccaaagucaauucaaggaaauaaggaaugaccuggaacaggccuuagaaacaauugau

SEQ ID NO: 55192 - RNA, 64 nt, Human
agagucaaggccugcucccuguaggguccaaccagaccuggaagaacaggccucuccauuugcu

SEQ ID NO: 55193 - RNA, 64 nt, Human
agguuugacccuagagcagaggugggcaaacuaugaccuggaaaccaaaucugacuuaccaccu

SEQ ID NO: 55194 - RNA, 64 nt, Human
ugccauaggauccaacuggacaacgugugggauggaccuggaaacaagcaccuccccaaacaca

SEQ ID NO: 55195 - RNA, 64 nt, Human
cugggaaaugggagcauaguacugggaaaccccagaccuggauucugaguuuuucagccuagcc

SEQ ID NO: 55196 - RNA, 64 nt, Human
ccuugcaucugagggcagacgcugcuaccggagugaccuggacguggccagaucuucucgcagg

SEQ ID NO: 55197 - RNA, 64 nt, Human
aaggaauggaacaugaaaauaguauauaauccuagaccuggaguugccaaguucugucagacuc

SEQ ID NO: 55198 - RNA, 64 nt, Human
ucgaaaaacaaugauaaauuucucagcuuguccagaccuggaacaaaauuucuggaauaagaaa

SEQ ID NO: 55199 - RNA, 64 nt, Human
ccuucagaagaggcuaaaauauccagcuuugggggaccuggaagaaaugucuccaaaggaagca

SEQ ID NO: 55200 - RNA, 64 nt, Human
ugccucuuuaacucaguuaaguuguucuguuugggaccuggaaaagaacccaaagaaaaccuga

SEQ ID NO: 55201 - RNA, 64 nt, Human
cugcuggaacucuccagccaaaugcugggagaaggaccuggagggugagucuuugcugaccucu

SEQ ID NO: 55202 - RNA, 64 nt, Human
auaagcaaaacaaagcaugucuuugaguaacaaugaccuggaaauacccaaaauuccaaguucu

SEQ ID NO: 55203 - RNA, 64 nt, Human
uuuuguaccacaacuuauuuuacuacugauauuugaccuggaaaguuaaucauggcaacaaaua

SEQ ID NO: 55204 - RNA, 64 nt, Human
caucuccucgcccaugcucagcgccgggccugaggaccuggagccgccgcucaaaaggaggugc

SEQ ID NO: 55205 - RNA, 64 nt, Human
uuaagaauuuaagacuugugcuuacaauauuuuugaccuggaguggaucuauuuacauagucau

SEQ ID NO: 55206 - RNA, 64 nt, Human
cccauggaggggacuguguuucuuuaaggaugcugaccuggaggccaccgagaggcuggggcug

SEQ ID NO: 55207 - RNA, 64 nt, Human
cacacacacacacacacacacacaggugucuacugaccuggagugacuggaauagcaccugggg

SEQ ID NO: 55208 - RNA, 64 nt, Human
ccagaucuugucagucauuuccuauguguauguugaccuggauaagaauauccaauuuugggug

SEQ ID NO: 55209 - RNA, 64 nt, Human
cugacuucuuagagaauguguggccagacccagggaccuggaguguguuuggacugcaguuugc

SEQ ID NO: 55210 - RNA, 64 nt, Human
cauguucugaugaaagaaccaagugacccaaagugaccuggacaagauucauagacugaaagcu

SEQ ID NO: 55211 - RNA, 64 nt, Human
gacuuuacagccccaugcuacaggccaucaagaugaccuggagcagagagcaugggccuugggu

SEQ ID NO: 55212 - RNA, 64 nt, Human
ccuuucuuuuaagggcauuuuuagaauuaacucagaccuggaagacuccucaguucuucaaaga

SEQ ID NO: 55213 - RNA, 64 nt, Human
guaugaccccuggccacagccuucccucugcauugaccuggaggggagaggucagccuugaccu

SEQ ID NO: 55214 - RNA, 64 nt, Human
uguccccacgcaguguaaacccaguggcuucucugaccuggagcugaugggccgugaagggggc

SEQ ID NO: 55215 - RNA, 64 nt, Human
ggcaggaagcccaggaggagugcgggcagggccugaccuggaggagugaugguugagggggagg

SEQ ID NO: 55216 - RNA, 64 nt, Human
uaccuguuuucgcaccuaccaucagggacaggaugaccuggauaacuuagguggcaagcuguga

SEQ ID NO: 55217 - RNA, 64 nt, Human
augauuaaucauaaagaaaaaucaguuuuugacugaccuggauauccaugagcugcacugauca

SEQ ID NO: 55218 - RNA, 64 nt, Human
aucaucuguuuauggacacaugaaaccuccuaaugaccuggaauuguuagaauauuugacuuuu

SEQ ID NO: 55219 - RNA, 64 nt, Human
ggaugugcgagacgucagcgccacguuccuuucagaccuggaagagaacuuugagaacaauauc

SEQ ID NO: 55220 - RNA, 64 nt, Human
ccuuacaagaauaccacauuuugaaacccagaaagaccuggaaaggagcccagcauguccaucu

SEQ ID NO: 55221 - RNA, 64 nt, Human
ucauggccugagcagaaauacugaaagacccugagaccuggaugaugucuuugagccaccaaac

SEQ ID NO: 55222 - RNA, 64 nt, Human
cuuuccuaacggugaccuucuucuugcucccagugaccuggaagcaagcccacccuccccaggg

SEQ ID NO: 55223 - RNA, 64 nt, Human
ugucccccuugaggacgaagccuccagugaccuggaccuggagcaacucauggaagauguuggg

SEQ ID NO: 55224 - RNA, 64 nt, Human
uggaagugucccccuugaggacgaagccuccagugaccuggaccuggagcaacucauggaagau

SEQ ID NO: 55225 - RNA, 64 nt, Human
gcugccaggcucagcucccagcugcguccacagugaccuggaucaggguggggacaaggacugg

SEQ ID NO: 55226 - RNA, 64 nt, Human
aaaacuuugauuaaaucuuaaugggaggcugggugaccuggauuaucuacagugagcagacuua

SEQ ID NO: 55227 - RNA, 64 nt, Human
ccauugcccaaggaagugcauccaccuggcaggugaccuggaggaguagcuuccccgaggaccc

SEQ ID NO: 55228 - RNA, 64 nt, Human
uagugaugucauuuucucccugagcuguaggguggaccuggaccccucagagaugcucgacugc

SEQ ID NO: 55229 - RNA, 64 nt, Human
cacauuaaguaaaagaauuccagcugguaaacaugaccuggacauuuguaagaauauauuuaau

SEQ ID NO: 55230 - RNA, 64 nt, Human
ggccuggucgucauguaggucaggaccuuggcuggaccuggaggcccugcccagcccugcucug

SEQ ID NO: 55231 - RNA, 64 nt, Human
auucaaggagaugaugaccuggguccagggcccagaccuggacuccaaggccggccugcgcacu

SEQ ID NO: 55232 - RNA, 64 nt, Human
gcgaagugaagcacacaguuuuagauuuuugcaggaccuggauaugaacugcacauauauacau

SEQ ID NO: 55233 - RNA, 64 nt, Human
gccauggugccaugacuguacugugcccaugcgugaccuggacuguggacccucugcugcuccg

SEQ ID NO: 55234 - RNA, 64 nt, Human
ggaugagcuggugugagugcugccgcuacaccgagaccuggagaagaccucuugccucauggau

SEQ ID NO: 55235 - RNA, 64 nt, Human
cucacagagacccaccuucaagcagcugguggaagaccuggaccgcaucguggccuugaccucc

SEQ ID NO: 55236 - RNA, 63 nt, Human
gaguuuaugagagagcauaagccaagggacguugaccuggacugaaguucgcauugaacucua

SEQ ID NO: 55237 - RNA, 64 nt, Human
gcuggacgacucacaggugcgucagaugcuguucgaccuggagucagccuacaacgccuucaac

SEQ ID NO: 55238 - RNA, 64 nt, Human
ucugcggcccccugcggcugucagagagcggugagaccuggagcgaggugugggccgccauccc

SEQ ID NO: 55239 - RNA, 64 nt, Human
acauauuaugacugccaaguauuggaaaugaaaagaccuggagucuaugcuaggaagcugagau

SEQ ID NO: 55240 - RNA, 64 nt, Human
aggacagagacuacaccuuguacuuuuugugcaugaccuggaccugcuaaggaaaaaaaaaucu

SEQ ID NO: 55241 - RNA, 64 nt, Human
gacacccuuggacagaagacuggccuaccuagcagaccuggauuuuucuuccugaucugcugcu

SEQ ID NO: 55242 - RNA, 64 nt, Human
uucaggaagcucucuuaaaauacccauugccccagaccuggaagauauaacauucaguucccac

SEQ ID NO: 55243 - RNA, 64 nt, Human
acauuucuccuuucauucccccuaaaaacagagugaccuggaaguagauguucuuugcuccuug

SEQ ID NO: 55244 - RNA, 64 nt, Human
ggggguggggccuucaccuaagaccucugcagcagaccuggacagacaggccccucccgccugu

SEQ ID NO: 55245 - RNA, 64 nt, Human
agucgcggcccugcucagccggaagaggcucccggaccuggauguacagggcagucucucuucc

SEQ ID NO: 55246 - RNA, 64 nt, Human
cccuggggcugggguggggguggcagggagcugggaccuggagagacaacuccuguaaauaaaa

SEQ ID NO: 55247 - RNA, 64 nt, Human
ggguauauuccucaggaguccacagacuggaguggaccuggaacuuagagacgggagggacccg

SEQ ID NO: 55248 - RNA, 64 nt, Human
guuuuugacaaaacaaacaggccaaaagggggcugaccuggagcagagcauggugagaggcaag

SEQ ID NO: 55249 - RNA, 64 nt, Human
gcacugcucccagcacugcgcaccaggucaggaggaccuggaguggacuagaaucggggcugcu

SEQ ID NO: 55250 - RNA, 64 nt, Human
gaaaaaggcaaagcaagguuguggccuuagguuggaccuggaauaucccuuauugccuauaaug

SEQ ID NO: 55251 - RNA, 64 nt, Human
cgggcuaggaagaucucugcagggccgccagggagaccuggacacaggccugcucucuuuuucu

SEQ ID NO: 55252 - RNA, 64 nt, Human
ccugacacagccccagaccccacaaagccuucuggaccuggaaagccuggggaaggacugacag

SEQ ID NO: 55253 - RNA, 64 nt, Human
gccaccaucuguacccugcuucccaaacucccaggaccuggagacaggauugucuggggccgag

SEQ ID NO: 55254 - RNA, 64 nt, Human
uguggguuuuauucaacuacgguugggagaaugagaccuggagucauguugaaggugcccaacc

SEQ ID NO: 55255 - RNA, 64 nt, Human
cuuuuggcugguguugaaugucuuuagcuggggugaccuggagugaccugggacgguguugugg

SEQ ID NO: 55256 - RNA, 64 nt, Human
guuucaggaaaucuauauuauaugcauucaaaaagaccuggacaaauaaagaccaaucuuaaca

SEQ ID NO: 55257 - RNA, 64 nt, Human
gagcggcuauaguguucaucccugcucuugaaaagaccuggaaaggggagcagggucccuucau

SEQ ID NO: 55258 - RNA, 64 nt, Human
uuuuggaguuccucucggguuaucucccacgccugaccuggaaccagcaagccccuuuccugcc

SEQ ID NO: 55259 - RNA, 64 nt, Human
aguuugugaagcaccuggucagcaaccugccccagaccuggagggucuuuguggacugaaggua

SEQ ID NO: 55260 - RNA, 64 nt, Human
ccacacauccccaguuguugguuuggccacucuugaccuggagccaucuuccuagugggccacc

SEQ ID NO: 55261 - RNA, 64 nt, Human
gaagagugacagcuuaauaaaugccagggaaucugaccuggaaggcagaugggagggggcuggu

SEQ ID NO: 55262 - RNA, 64 nt, Human
aggacccguugcagggugaggucaagagaguucugaccuggauggcccauagaccugacguccc

SEQ ID NO: 55263 - RNA, 64 nt, Human
cauugcauaauacagagaaaaauuaaucacaacugaccuggaucucagaugcuagaaauaguag

SEQ ID NO: 55264 - RNA, 64 nt, Human
cagaagcugugagggacccacagauuuuggaaacgaccuggacacacuauugggaaggagaugu

SEQ ID NO: 55265 - RNA, 64 nt, Human
cuacagcuacguggccgugggcaguacugggggcgaccuggaccugcuggcucagccccucccu

SEQ ID NO: 55266 - RNA, 64 nt, Human
ucccuaugacauagcaguggugagccuggaggaggaccuggaugauguccccaucccugugccc

SEQ ID NO: 55267 - RNA, 64 nt, Human
acaaccuccaucuauuuauugcuuccugagaacugaccuggaugcggcccucugcagggcccag

SEQ ID NO: 55268 - RNA, 64 nt, Human
uccuuugagucuuuggaugccaacucagcccccugaccuggaggcagccggccaaggccucuag

SEQ ID NO: 55269 - RNA, 64 nt, Human
ucucccuuccaccuuuacgacccucuccagaccagaccuggaguccucuucaagcagcaaucca

SEQ ID NO: 55270 - RNA, 64 nt, Human
aacgcuugagcauccuuggcaacagcccaggugggaccuggaugaagcuuugcacucaaguauu

SEQ ID NO: 55271 - RNA, 64 nt, Human
ccgaggcuguggaacaaucagcccaucucuuugugaccuggagcagucagagggcccucaguca

SEQ ID NO: 55272 - RNA, 64 nt, Human
caaacaucuuggugggauuugauaaaugccuugggaccuggagugcugggcuugugcacaggaa

SEQ ID NO: 55273 - RNA, 64 nt, Human
aggcagccagagcccugcugaguuccugcuuucugaccuggaggcugagcaggccggaguggau

SEQ ID NO: 55274 - RNA, 64 nt, Human
uccuuguguuuuucauagcccaagauagccaugugaccuggaacuuuuaaaaaaaaauuuuuuu

SEQ ID NO: 55275 - RNA, 64 nt, Human
gcuccccgagccccgggaccgcuguggaccucgggaccuggacgccguccuggcugcgcaggag

SEQ ID NO: 55276 - RNA, 64 nt, Human
guuuugucccauuuccuuggaggccaccgggacagaccuggacacuagggucaggcggggugcu

SEQ ID NO: 55277 - RNA, 64 nt, Human
ucaggcugauccaggagaugcucacaggccacaggaccuggaaaacacucuugguggugucuug

SEQ ID NO: 55278 - RNA, 64 nt, Human
guccacaccccagguguugcugacacuggaugacgaccuggauacugugcagcgggacaagauc

SEQ ID NO: 55279 - RNA, 64 nt, Human
cuccauccaugcucaccauagcccccuuccuugugaccuggacccuccauuguaccuggcugag

SEQ ID NO: 55280 - RNA, 64 nt, Human
acaaagaacccuugaccuggggcguaauaaagaugaccuggaccccugcccccacuaucuggag

SEQ ID NO: 55281 - RNA, 64 nt, Human
agaauuugcuuaaugacuaacacccuaagcaucagaccuggaauuuggaguugcaaagugacua

SEQ ID NO: 55282 - RNA, 64 nt, Human
ugcacaagaaaugauggcacaucacgagaauuuagaccuggauuuuaccaugaaccucacaucu

SEQ ID NO: 55283 - RNA, 64 nt, Human
ucugaggugaccgcauagacuucucagaccaagggaccuggaugacaggcaaucaaggccugag

SEQ ID NO: 55284 - RNA, 64 nt, Human
ggucccccucuucugaggcccucuccuguaucccgaccuggaagcuuugaugggucaugggcca

SEQ ID NO: 55285 - RNA, 64 nt, Human
ugaaaacaaaugaaaacaaaauuagagcaaagcugaccuggagcccucagggagcaaaacauca

SEQ ID NO: 55286 - RNA, 64 nt, Human
cucucccuaggauacacagccugcagguccccaggaccuggaugacacccgccucacuguggca

SEQ ID NO: 55287 - RNA, 64 nt, Human
gcacauucauuccaaggucauagauuuuuaaaaggaccuggauuugaagagauggcaaaugaug

SEQ ID NO: 55288 - RNA, 64 nt, Human
ggguaggcucuagagccagcacaggucacugccugaccuggacuaagaaccccacggccccacu

SEQ ID NO: 55289 - RNA, 64 nt, Human
uggguucguuucagaagugccucacuguucucgugaccuggaguuaaccggaacagcgucuuca

SEQ ID NO: 55290 - RNA, 64 nt, Human
uccuguccucccugugcaggguauccuguagggugaccuggaauucgaauucuguuucccuugu

SEQ ID NO: 55291 - RNA, 64 nt, Human
cuagguggcagcacuccgagguaucuaaaggguagaccuggaccugccaccuaugaguugugug

SEQ ID NO: 55292 - RNA, 64 nt, Human
uggcagaagcagccccaugugcuucccugcccccgaccuggaguggauaagacaagagggguau

SEQ ID NO: 55293 - RNA, 64 nt, Human
ggccccgcagcuuccucccccgaccaaaccccaagaccuggaucccaggagacaacagucucca

SEQ ID NO: 55294 - RNA, 64 nt, Human
gguuuuaguucagccuuuaagauaccuugaugaagaccuggacuauugaauggagcagaaauuc

SEQ ID NO: 55295 - RNA, 64 nt, Human
ccagauuucucuugauauaucucugugcuuuugagaccuggagaucuaauucuguuuagacauu

SEQ ID NO: 55296 - RNA, 64 nt, Human
cuuuggggcugggguagcauggaaucccucugaggaccuggauacugguacuacggggugggga

SEQ ID NO: 55297 - RNA, 64 nt, Human
ccuggagggaagcccaaggcuacuuggaccucaggaccuggaaucugagaggguggguggcaga

SEQ ID NO: 55298 - RNA, 64 nt, Human
uucaccccucagaguccuacaaguccaaccaguggaccuggaauuggccaagggcucaggagag

SEQ ID NO: 55299 - RNA, 64 nt, Human
ggcucugggaccagcggcuuguucuagggauuuggaccuggaggccaagggcaauaggagaggg

SEQ ID NO: 55300 - RNA, 64 nt, Human
uaccugaaaggaagguuucuauucguugguuguggaccuggacaaaguccaagucuguggaacu

SEQ ID NO: 55301 - RNA, 64 nt, Human
auuaccagagugacuccuugacacuucucucauggaccuggaaacuuccauaaguggugacuuu

SEQ ID NO: 55302 - RNA, 64 nt, Human
ggauuacaguguuuacagaacaaccuucagcgccgaccuggaaugguaacuuuuucccuccuca

SEQ ID NO: 55303 - RNA, 64 nt, Human
agggaucacgccuauaggugugggcacaugaaacgaccuggaacuugcuucacagcccugagga

SEQ ID NO: 55304 - RNA, 64 nt, Human
cuccuguggaaguuuaggggcaaauuuguucccugaccuggagaggguuagaaagaaccaacag

SEQ ID NO: 55305 - RNA, 64 nt, Human
gaguuguggacaccuauagaguguucuucucuaagaccuggaaagucagcaacccucugggggc

SEQ ID NO: 55306 - RNA, 64 nt, Human
cuccacacccugccuggcaaugguaugagagucggaccuggacagggccagcugcugggggagc

SEQ ID NO: 55307 - RNA, 64 nt, Human
agucugacaaaaccuucuccagagaaucaagcaagaccuggaugugaagaagguuuggguaaac

SEQ ID NO: 55308 - RNA, 64 nt, Human
aguauuauuuguugguccuuuuugugccuuucuugaccuggagggggaggcaggaggauugcug

SEQ ID NO: 55309 - RNA, 64 nt, Human
gaauacuggaaucguuagagaacccugauguguugaccuggauaaaguacaaagguggaagagg

SEQ ID NO: 55310 - RNA, 64 nt, Human
ucacggccgaugcucugcagucugacaagcuucagaccuggacagugucugugaacgagggccg

SEQ ID NO: 55311 - RNA, 64 nt, Human
gacauaaaacacuuaaguguuuucuucacuccgugaccuggagaguuuuccauuuuuuaaaaua

SEQ ID NO: 55312 - RNA, 64 nt, Human
cacccccuguuucaggucucccaucucccucagugaccuggaucugaccucacaccaucagcag

SEQ ID NO: 55313 - RNA, 64 nt, Human
ugagcccgggcugccugggcuguuggcacucacagaccuggagccccuggguggguggugggga

SEQ ID NO: 55314 - RNA, 64 nt, Human
aggauucucacgccaccauuaccucacucagugugaccuggagggggucagacagacgggagag

SEQ ID NO: 55315 - RNA, 64 nt, Human
cugugccuuguguuacuuaaucauacaguaagcugaccuggaaaugaaugaaacuauuacuccu

SEQ ID NO: 55316 - RNA, 64 nt, Human
gguggagaaucagauuuagagggagggagagucugaccuggauccugaccuguaaccagcugaa

SEQ ID NO: 55317 - RNA, 64 nt, Human
cucaagcgggaccuucuuucucugucaggcccuugaccuggaaugggggccuuugucaaacacu

SEQ ID NO: 55318 - RNA, 64 nt, Human
aaggugggucccggcaacacgcaggggaugaguggaccuggaacugacaauggcgugcugccaa

SEQ ID NO: 55319 - RNA, 64 nt, Human
aaauuaaccgagacacuuuauauggcccugcacagaccuggagcgccacacacugcacaucuuu

SEQ ID NO: 55320 - RNA, 64 nt, Human
ggaggagccuugguccaugcugagcauccuggaggaccuggagagcugggagaccaugaugagc

SEQ ID NO: 55321 - RNA, 64 nt, Human
cuccuuccaggacuuuuuugcgcaccccuggguggaccuggagcacaugcccaguggggagagu

SEQ ID NO: 55322 - RNA, 64 nt, Human
ccuggugcugucugaguauccccagagcaagagagaccuggagacaccagggguggaggguccu

SEQ ID NO: 55323 - RNA, 64 nt, Human
acccauuuugagccuuagaagagucaagccucaggaccuggaaacuuugugucuggggaagacu

SEQ ID NO: 55324 - RNA, 64 nt, Human
uuugggauuaugaacaaaccucacagacuuugaggaccuggaugguccugcauucacggcauca

SEQ ID NO: 55325 - RNA, 64 nt, Human
ccaaacucccuccucccuguuaaaugucaaccuagaccuggaccugggugggaggaaacuguag

SEQ ID NO: 55326 - RNA, 64 nt, Human
uggaagggaccugguuggacuaacggcuaaccuggaccuggaacuguagggccaggggauuguc

SEQ ID NO: 55327 - RNA, 64 nt, Human
uacacacacacacacauacucucacacaggaaacgaccuggaagaauauuuggugcuuuuauuu

SEQ ID NO: 55328 - RNA, 64 nt, Human
gccuuccacccaggggcagccccaggccaaaggggaccuggaagggaggugggccguggcccuu

SEQ ID NO: 55329 - RNA, 64 nt, Human
accccacucugucacccacaccaggaucgggugggaccuggagcuaggggguguuugcugagug

SEQ ID NO: 55330 - RNA, 64 nt, Human
guccuuggcagaggcagggaagcucuaccgcaaggaccuggagauugugcucugcagcgagccc

SEQ ID NO: 55331 - RNA, 64 nt, Human
cagcccugaaggagaucuccuugccugaccccuggaccuggaaauggaggcuucaugugcccgc

SEQ ID NO: 55332 - RNA, 64 nt, Human
gccaggagugcuaaaccuagaggccaauacugaugaccuggaaggugauccauaugauugucac

SEQ ID NO: 55333 - RNA, 64 nt, Human
aaggccccuuggauuccuggcuggggacaaugaugaccuggacccuggccagaagagcccuggc

SEQ ID NO: 55334 - RNA, 54 nt, Human
cuucuaaugcuagccggugaggcugaccuggagccagcugcuggggucccucag

SEQ ID NO: 55335 - RNA, 64 nt, Human
gugucuuacaagacgugcgggcuccggggaaaaggaccuggagucacagcgaauccccgccccg

SEQ ID NO: 55336 - RNA, 64 nt, Human
caucaguggcuuuguaugcaaauaugcuguguuggaccuggacgcuauaacuuauuguaaagac

SEQ ID NO: 55337 - RNA, 64 nt, Human
gccaaauauuuggagagauuguguggauuuaagagaccuggauuuuuauauuuuaccaguaaau

SEQ ID NO: 55338 - RNA, 64 nt, Human
uaucagugagugggucccaucgacaggguuccaggaccuggaacacuuuaacagaaggaaaugc

SEQ ID NO: 55339 - RNA, 64 nt, Human
gaggacagugaguucccagcccucccucucucuugaccuggaucagcucuuacaggaguauauc

SEQ ID NO: 55340 - RNA, 64 nt, Human
gaaugaggagccgccugagccuuccuggagccaggaccuggauuccucuggguagagggcaacg

SEQ ID NO: 55341 - RNA, 64 nt, Human
gcaggcggccuacuugggcagggcuggacgcugggaccuggagcugccgccgucucuucaaagc

SEQ ID NO: 55342 - RNA, 64 nt, Human
gcccuggaggagaaagccauucuggacaccaggggaccuggacggaggguccccacagcccgug

SEQ ID NO: 55343 - RNA, 64 nt, Human
uugacagauacuuuguauuuuucuuuugaauucagaccuggaauguaaguaagugacaaugcuu

SEQ ID NO: 55344 - RNA, 64 nt, Human
ggggcucacccuggugcugccucccgcacaaggagaccuggacacaacagacacacaucacaag

SEQ ID NO: 55345 - RNA, 64 nt, Human
cagccacaucuucuaugagccagaugcuuaugaugaccuggaccaagaagacccagaugacgac

SEQ ID NO: 55346 - RNA, 64 nt, Human
uuaugaugaccuggaccaagaagacccagaugacgaccuggauauuugacuggccagauuugau

SEQ ID NO: 55347 - RNA, 64 nt, Human
uucuaauguguacugcugguauagcugaacuacugaccuggaucuuaguccuagccuuuuugcu

SEQ ID NO: 55348 - RNA, 64 nt, Human
gaagcccaccaagaccgaaacuggagaagggcuggaccuggaccuggaccuggaccuacagcgg

SEQ ID NO: 55349 - RNA, 64 nt, Human
caccaagaccgaaacuggagaagggcuggaccuggaccuggaccuggaccuacagcggggacuu

SEQ ID NO: 55350 - RNA, 64 nt, Human
gaccgaaacuggagaagggcuggaccuggaccuggaccuggaccuacagcggggacuuaaaugc

SEQ ID NO: 55351 - RNA, 64 nt, Human
ccagcagacucuggaggccugugccuugcuagcugaccuggagaugcugccugguggggaucag

SEQ ID NO: 55352 - RNA, 64 nt, Human
cauccugguuuuagacgaggccacagcugccaucgaccuggagacugacaaccucauccaggcu

SEQ ID NO: 55353 - RNA, 64 nt, Human
gcacuccaaguaugagucggauacccuggagcaagaccuggagcggcuauuccaggagcugcgg

SEQ ID NO: 55354 - RNA, 64 nt, Human
uucauucuaauuauggcccacagacugccccggagaccuggaggacagcagugcuggcacuugg

SEQ ID NO: 55355 - RNA, 64 nt, Human
ucccagguggccugcggccacugcuaugcucaaggaccuggaaacccaugcuucgagacaacgu

SEQ ID NO: 55356 - RNA, 64 nt, Human
aucccacccccagaguggggagggucaggugccagaccuggacuaaacugcaccaaggaaacac

SEQ ID NO: 55357 - RNA, 64 nt, Human
ccugcaguggaacuccaugccccgccucccaacggaccuggacguagagggcccuugguuccgc

SEQ ID NO: 55358 - RNA, 64 nt, Human
gcuguggagucuggcuguauccauuacgucaagcgaccuggagcagcucuugacccuggcugug

SEQ ID NO: 55359 - RNA, 64 nt, Human
uuguaacaaaucaaaauuaccuuauauccuucuggaccuggaguagucuuuuaacgaacuuucu

SEQ ID NO: 55360 - RNA, 64 nt, Human
uaaccuggagaaccagcuggccgagauccgcugcgaccuggagcgacagaaccaggaguaccag

SEQ ID NO: 55361 - RNA, 64 nt, Human
gcucuucucuuccggucggaucucucuccucucugaccuggauacgcuuugguuucucaacuuc

SEQ ID NO: 55362 - RNA, 64 nt, Human
uugacaaguaggcccaucuuugggccgcagcccugaccuggaaugucuccaccucggauucuga

SEQ ID NO: 55363 - RNA, 64 nt, Human
gggcugggcagaugagauccuacuuucuccccaggaccuggaggcagguagagaugggggagca

SEQ ID NO: 55364 - RNA, 64 nt, Human
uuauugggaugcaggcaaaccucugugguccuaagaccuggagaggacaggcuaagugaagugu

SEQ ID NO: 55365 - RNA, 64 nt, Human
guuuugcguuuuuugguaaaaggagcaaagcgaggaccuggagauaaacgcuggagcaaucucc

SEQ ID NO: 55366 - RNA, 64 nt, Human
guaugcucauucuuaugcaguuaaacagaguuucgaccuggaggaguacagccucucacagucu

SEQ ID NO: 55367 - RNA, 64 nt, Human
ugguccaggggguguggcucaguggcuggugguggaccuggagaguggaggcaccggccaggca

SEQ ID NO: 55368 - RNA, 64 nt, Human
ggcaucuugagauggaagagcagccuuguguuuagaccuggauugaauugggcccuguuguuuc

SEQ ID NO: 55369 - RNA, 64 nt, Human
cccucugcccucucccugcagaauguggcaggcggaccuggaauguguuggagggaagggggag

SEQ ID NO: 55370 - RNA, 64 nt, Human
ggccauccauuuugagcaccucugccaggcugcagaccuggaggcgaagggaguguggaagagg

SEQ ID NO: 55371 - RNA, 64 nt, Human
uauauccaguaaguagaauuaucucuucaucugggaccuggaaauccugaaauaaaaaaggaua

SEQ ID NO: 55372 - RNA, 64 nt, Human
ugucagugagaaugacuccgaugagcugcucaucgaccuggagcggccccagagcaacagcagc

SEQ ID NO: 55373 - RNA, 64 nt, Human
uccacggguggagcuacccguugggcuuaugagugaccuggagugacagcugagucacccuggg

SEQ ID NO: 55374 - RNA, 64 nt, Human
ucugccccuugucaggcugugaggugcucguguagaccuggagcaugcaggcugccuccguuuu

SEQ ID NO: 55375 - RNA, 64 nt, Human
gaggggagucccggcagugagcccgaggcccugggaccuggagcccgcgcuggccucuccccag

SEQ ID NO: 55376 - RNA, 64 nt, Human
aagcaaagagcagacacacauacagccugaaacagaccuggacagacagacacagccugaaaca

SEQ ID NO: 55377 - RNA, 64 nt, Human
cagacagagagacaggcagacacagccuaaaacagaccuggacagacaggcagacguagucuga

SEQ ID NO: 55378 - RNA, 64 nt, Human
uuggccacccagcugccugccaggggagaccugggaccuggacggccaccuaggacugaggaca

SEQ ID NO: 55379 - RNA, 64 nt, Human
gagaaaugaggggagauggaccaagaaagacguggaccuggaugauguacucugggucaagaga

SEQ ID NO: 55380 - RNA, 64 nt, Human
uggacagugugugcugggggguucgggugcugcagaccuggaacucccuucugccaggauguug

SEQ ID NO: 55381 - RNA, 64 nt, Human
gcccugcuucagugcccaccugggcccccccagggaccuggaaacagugcuggggaguucugcc

SEQ ID NO: 55382 - RNA, 64 nt, Human
gcagcgccagugacacggggcacuagucaggagagaccuggacagggguggugggaagagcuug

SEQ ID NO: 55383 - RNA, 64 nt, Human
gauuucagccagaugccauagacccucagaacuugaccuggaaguccagacacugaacgcaggc

SEQ ID NO: 55384 - RNA, 64 nt, Human
cgcuuaugcguaugugcacggggccgcccgccuggaccuggagaagggaccuacggacgccugg

SEQ ID NO: 55385 - RNA, 64 nt, Human
gcaccuggccccaucaugaugcagggguuuuggggaccuggaaggaaggugaugaggcagugag

SEQ ID NO: 55386 - RNA, 64 nt, Human
aagacuggcaguucuagauuccucuauauggggagaccuggauuguugaccagggugagaagcc

SEQ ID NO: 55387 - RNA, 64 nt, Human
ggacucaggacuucagaagcaacauuucuggccugaccuggaaggugaaggugaaggugagacc

SEQ ID NO: 55388 - RNA, 64 nt, Human
ggcggagucuauuuuacgcgucgcccaaugacaggaccuggaauguacuggcugggguaggccu

SEQ ID NO: 55389 - RNA, 64 nt, Human
cccagaguuaggguuugcgacuccgccucccugggaccuggauugggucagaugccuguccuug

SEQ ID NO: 55390 - RNA, 64 nt, Human
cuccucccuccccaccccugucgcauccacgugcgaccuggaggacuggucagaaccguuacug

SEQ ID NO: 55391 - RNA, 64 nt, Human
agccacguccugccucgcgccgccccucgggccugaccuggaagcuccgucagcuccguccuug

SEQ ID NO: 55392 - RNA, 64 nt, Human
ucagugagaucucagcccugaugacacccugcgagaccuggagcguagggcccagcuagcccgc

SEQ ID NO: 55393 - RNA, 64 nt, Human
ggaggcaggggcagaggucagaaggggugucugggaccuggauggccagcagggacaggggcau

SEQ ID NO: 55394 - RNA, 64 nt, Human
gccuggagagugccugucugggaaaaggucacuggaccuggaaggguccccaggguccccugac

SEQ ID NO: 55395 - RNA, 64 nt, Human
accagaagauggccaucuacaagccaaggacagagaccuggaacagaugcuuucauuauggccu

SEQ ID NO: 55396 - RNA, 64 nt, Human
agaauaaugucgccguugucacaucagcugacaugaccuggagggguugggggugggggacagg

SEQ ID NO: 55397 - RNA, 64 nt, Human
gagagaaacagagacucagggagagggagacaaugaccuggagggugggguauggcagagacgc

SEQ ID NO: 55398 - RNA, 64 nt, Human
acuuaauaaucaaccugggguucgaaaucagugagaccuggauucaaauucugccuugaaauau

SEQ ID NO: 55399 - RNA, 64 nt, Human
cgugaagccagcuggacuuccuggguugaauggggaccuggagaacuuuucugucuuacaagag

SEQ ID NO: 55400 - RNA, 64 nt, Human
uggcuggggucggggaggguacagggggcacugggaccuggauuuguuuuucuaaauaaaguug

SEQ ID NO: 55401 - RNA, 64 nt, Human
accauguauguaucauggcggaagaguuggcccugaccuggaauaaagcaguugguguugcuua

SEQ ID NO: 55402 - RNA, 64 nt, Human
uuccuagaucucacugaacuggcccagcuaaggagaccuggacucuggguguggguuggcucac

SEQ ID NO: 55403 - RNA, 64 nt, Human
augcuaaggccccucaggcugggcucugaacgaggaccuggacucagagccagacagggcagcc

SEQ ID NO: 55404 - RNA, 64 nt, Human
gccugcccacaggcuccuguugcuccuucacacagaccuggaugccccagagcaaggucuucau

SEQ ID NO: 55405 - RNA, 64 nt, Human
ucuuaaaugagagcuggcugucuucuagagguaagaccuggaauggaguccaguugguacuuuu

SEQ ID NO: 55406 - RNA, 64 nt, Human
ggcaggagggaaccuucagccugucuggcugcuggaccuggacaccagggcucgguggacacaa

SEQ ID NO: 55407 - RNA, 64 nt, Human
cuccaagcuacuuuggcuucugccuggcucaggagaccuggauucuggucccugcugucccugc

SEQ ID NO: 55408 - RNA, 64 nt, Human
gccaggcaggguggccaaagaggacuggacucuggaccuggagccccgugguccaguucacauu

SEQ ID NO: 55409 - RNA, 64 nt, Human
aauacugugaaauaaagaauguuaaucaacuuuggaccuggagaugauuugccuuucugaacau

SEQ ID NO: 55410 - RNA, 64 nt, Human
cgggacagaauggauauuuggcugaccuuggugagaccuggagcugccuguuucuucccuaggg

SEQ ID NO: 55411 - RNA, 64 nt, Human
acaugugccgcuaacugaccgcguugccauuggcgaccuggacucugaacucagguuuauucua

SEQ ID NO: 55412 - RNA, 64 nt, Human
ggggccuggggauguaaccaagcuguacccuugagaccuggaaccagagccacaggccccuuuu

SEQ ID NO: 55413 - RNA, 64 nt, Human
aaaaaagcugaaggguacgaccaugcacauaugugaccuggaaaaugcaaauuuagaucuuuua

SEQ ID NO: 55414 - RNA, 64 nt, Human
accccuucugugccuugggaugccggagcugggggaccuggaggcccaucagccggagccacgu

SEQ ID NO: 55415 - RNA, 64 nt, Human
cucuuucaggguugacgccaugguggaccugcuggaccuggacccacugaagaggucgggcucc

SEQ ID NO: 55416 - RNA, 64 nt, Human
cucagaucuacagaacaagaaucucugcuaaguggaccuggaaucuuccaucugcaucuuaaca

SEQ ID NO: 55417 - RNA, 64 nt, Human
ugaccgcuuacaccccuucuccacagcccggcccgaccuggagggcccccggggcacugggcgg

SEQ ID NO: 55418 - RNA, 64 nt, Human
augccaucagucccuccugcuguugccucccugugaccuggaggacagugugugccaugucucc

SEQ ID NO: 55419 - RNA, 64 nt, Human
ugcgacucccgcauccccaggaccagacaccugggaccuggauacuugauaccugggcauuuaa

SEQ ID NO: 55420 - RNA, 64 nt, Human
ugaagcugaaauggaauaucugaagauagcucaggaccuggagauguacggugugaacuacuuu

SEQ ID NO: 55421 - RNA, 64 nt, Human
auugugggaggcucuugcuuacacuaaucagcgugaccuggaccugcugggcaggaucccaggg

SEQ ID NO: 55422 - RNA, 64 nt, Human
aaagaaugcaacuguuugugucucaccuaucugugaccuggaagcucccuccccacugaaccaa

SEQ ID NO: 55423 - RNA, 64 nt, Human
ccugcccaggacaggcaccagggucauggccugggaccuggacacuggccccuccacccucccu

SEQ ID NO: 55424 - RNA, 64 nt, Human
agguggaaaggagccagggggaaguggucuaagagaccuggaacugccagaggauggcggccug

SEQ ID NO: 55425 - RNA, 64 nt, Human
acuucugagcuuuucuugccauuugguugccugggaccuggaaaguguuuagauucuugauaaa

SEQ ID NO: 55426 - RNA, 61 nt, Human
auacccaccuugaugccuagugaggaagauggaccuggacagacagucagcuccacaccuu

SEQ ID NO: 55427 - RNA, 64 nt, Human
agcguugauuaugguaguuugucaagaauauauggaccuggaaacacuuucucucucuguccac

SEQ ID NO: 55428 - RNA, 64 nt, Human
ccccucacggcaacuugugccuggcgucaauaaagaccuggaaggauguugugcuucugaagcc

SEQ ID NO: 55429 - RNA, 64 nt, Human
ucaugaaugacuuuuauccgggaaucuugacggugaccuggaaggcagaugguacccccaucac

SEQ ID NO: 55430 - RNA, 64 nt, Human
ccaugggccccaccuugugacugggacaaucagggaccuggauuggacgggaucgcccaacuuc

SEQ ID NO: 55431 - RNA, 64 nt, Human
cgccguggaugugcugcagacccucgaacauguggaccuggacccucaggagcccccgagauga

SEQ ID NO: 55432 - RNA, 64 nt, Human
ccauauuucaaugccaaaugaaccacauugacaugaccuggaccauagggcuuccuauccuggg

SEQ ID NO: 55433 - RNA, 64 nt, Human
gugcgaguucagggccagguuggccaccgugggcgaccuggaggagauccagcgugcgcacgca

SEQ ID NO: 55434 - RNA, 64 nt, Human
uacucuaguugaaacucuguacagauacagaucugaccuggaaaucauauuuaaugccauugac

SEQ ID NO: 55435 - RNA, 64 nt, Human
caagagcgagugggcccagcgagcgaacccugaggaccuggaauucauccgcagcacgguccuc

SEQ ID NO: 55436 - RNA, 64 nt, Human
cacucucagaguguuuugaccaguuuaagccgcagaccuggagcuucagccaggucugacucca

SEQ ID NO: 55437 - RNA, 64 nt, Human
uucauuggaaauuaggauguaaaucugcucaggagaccuggaggagcagaggauaauuagcauc

SEQ ID NO: 55438 - RNA, 64 nt, Human
cuaauacccuuuuaccucucuguggguuugucuugaccuggaaauuugggcuaaaacuuagaaa

SEQ ID NO: 55439 - RNA, 64 nt, Human
gcugaacaugcccacuggcccccaggccacaugggaccuggaggagccuaccuggggccugccc

SEQ ID NO: 55440 - RNA, 64 nt, Human
ugcugugcuguggaguucagaaacgggguaccaugaccuggaaucuuuugcucuuguuuuugca

SEQ ID NO: 55441 - RNA, 64 nt, Human
ggcuggauccuaggccccugggaucuguacccaggaccuggagaauaccaccccacccccagcc

SEQ ID NO: 55442 - RNA, 64 nt, Human
ccacccaguuccccacaaagcaccagagguaggagaccuggauucaagugccagcucugccacu

SEQ ID NO: 55443 - RNA, 64 nt, Human
ccugaucaagaucaucagcuaccuucaaauuauugaccuggacaggguccaagucugauaguaa

SEQ ID NO: 55444 - RNA, 64 nt, Human
cuaagcuaggugaccugaaagcuuuaauuuucaugaccuggauauguggucuauuguauaucuu

SEQ ID NO: 55445 - RNA, 64 nt, Human
ccccuuuuccugcucggcccuuuaaucccugacagaccuggacuguguggcugaagggggaccu

SEQ ID NO: 55446 - RNA, 61 nt, Human
ccauuuuagccaggaaauaacuguuucuugugaccuggaacuaacgucaaagcacacaaga

SEQ ID NO: 55447 - RNA, 64 nt, Human
gagcaggggcagggugauaaauuguugauaaauuccacuggacuugagcuuggcagcugaacua

SEQ ID NO: 55448 - RNA, 52 nt, Human
ugcgaaucucucucaucugagcccacuggaggcgccgccccacccggcccac

SEQ ID NO: 55449 - RNA, 64 nt, Human
cccucaccccaucuugucacaucuggcccugaccccacuggaccaaaaggggcagcacuggugc

SEQ ID NO: 55450 - RNA, 64 nt, Human
guacuaccgcgagaggcaucccuggcgcugucucccacuggacagaggaggcuggccauggggc

SEQ ID NO: 55451 - RNA, 64 nt, Human
augucuggaggcugauuuuccuguucucuguucuccacuggaaagguuguuuacgacaaaccuc

SEQ ID NO: 55452 - RNA, 64 nt, Human
gucccccaucccuggggaggcucccaccaucucgccacuggacagaagcguccccuuugaccug

SEQ ID NO: 55453 - RNA, 64 nt, Human
auuuacaauucaguuucugugacaucuuuuuaaaccacuggaggaaaaaugagauauucucuaa

SEQ ID NO: 55454 - RNA, 64 nt, Human
ccuaccacucuuaaacggaccugcauccuggagcccacuggaaaagggaaacccucuggcugua

SEQ ID NO: 55455 - RNA, 64 nt, Human
gugaccuguuuacugucucuuuagaagaaaaacuccacuggaaaccauucaccaugugugauug

SEQ ID NO: 55456 - RNA, 64 nt, Human
aaugugguccacagccaugcccuugaggagcuggccacuggauacugaacacccuacuccauuc

SEQ ID NO: 55457 - RNA, 64 nt, Human
auuuucccaauaaauacuugccugugacauuuugccacuggaacacuaaacuucaugaauugcg

SEQ ID NO: 55458 - RNA, 64 nt, Human
cccauauuuaugugccuuuugucuauuuauaaugccacuggaagaggagggauaacuuuuucug

SEQ ID NO: 55459 - RNA, 64 nt, Human
accugguauuacagccuuugccuuucgagacuauccacuggauuaauggguuauuuucaguggg

SEQ ID NO: 55460 - RNA, 64 nt, Human
agcaaguuugugucagccacgcccuggggaggauccacuggaucaccgccgucacugccuguuc

SEQ ID NO: 55461 - RNA, 64 nt, Human
accaagcggucagaaggccugaggacccaaggccccacuggagcagucuguccuuaugccgaau

SEQ ID NO: 55462 - RNA, 64 nt, Human
cggacaccaccaaggggcccucuggaacuugagaccacuggaggcacaccugcuauaccucaug

SEQ ID NO: 55463 - RNA, 64 nt, Human
cagggcccuuccuuguuucucagaggccccucagccacuggaaccccaucuucagcccagccug

SEQ ID NO: 55464 - RNA, 64 nt, Human
ggagauagaagaccuggacuccagcccaccguggccacuggagaccucaggccaguuguuuacc

SEQ ID NO: 55465 - RNA, 64 nt, Human
cuggccacacugagggcccucugggaaccccaccccacuggagccgcuccggcagcucuuccug

SEQ ID NO: 55466 - RNA, 52 nt, Human
ucaaggucuccgccuuguaaaaccacuggacagagggccagaguggguagug

SEQ ID NO: 55467 - RNA, 64 nt, Human
acuucuggggcuccccaaggguugugguuuuaacccacuggagacuuugaguucuccuacauuc

SEQ ID NO: 55468 - RNA, 64 nt, Human
gccccacuucugaaaguaucagcuacugauccagccacuggauauuuuauauccucccuuuucc

SEQ ID NO: 55469 - RNA, 64 nt, Human
gcuguggugagcuggccacuccagagcugcagugccacuggaggagucagacuaccaugacauc

SEQ ID NO: 55470 - RNA, 64 nt, Human
guaaccugagccccccucuccuccccuuccucaaccacuggacguuuauauauuauaggcaggg

SEQ ID NO: 55471 - RNA, 64 nt, Human
cccuggaguaucacccuuccucccuccccaggcaccacuggaccaauuaccuuugaaugcugua

SEQ ID NO: 55472 - RNA, 64 nt, Human
cucccucugaagaacugggcauuugccaaaguaaccacuggagucaucuaauggcccucccccu

SEQ ID NO: 55473 - RNA, 64 nt, Human
uaccuaucaucaaauuguaguaauguauuucaccccacuggacuuaucuucagaguuuuaaaag

SEQ ID NO: 55474 - RNA, 64 nt, Human
cagagcuuuccuccgccuuuuaguuuugguuccuccacuggaauguaggcuccucacgggcgau

SEQ ID NO: 55475 - RNA, 64 nt, Human
uuugcuuuggucuaucuuugagcgcccacuagacccacuggacucaccucccccaucucuucug

SEQ ID NO: 55476 - RNA, 64 nt, Human
aauauugacauucucugugggggaaaagcaguguccacuggaccccuucugguacuggaugugu

SEQ ID NO: 55477 - RNA, 64 nt, Human
cuaauuuuugcuucucaggaaugagaaucuuuggccacuggagagcccuugcucaguuuucucu

SEQ ID NO: 55478 - RNA, 64 nt, Human
uuuaacaauuacuuuaaaggucaugugaaaacucccacuggaaauaaauccuguaaauguaaau

SEQ ID NO: 55479 - RNA, 64 nt, Human
cagaccccuuggcuuuugcuuggcagagaggaccccacuggacuggguuuugucucugcaucuc

SEQ ID NO: 55480 - RNA, 64 nt, Human
agcauagaccuauaguacaacagggguguagugaccacuggaccugaugaagcgaaucugccug

SEQ ID NO: 55481 - RNA, 64 nt, Human
uguucugugucugugcuccuccuucccucucagaccacuggaaugcaaguccuucuucccuuug

SEQ ID NO: 55482 - RNA, 64 nt, Human
cgggagguggagguugcagugagucgagaucgugccacuggacuccagccugggugacagagcg

SEQ ID NO: 55483 - RNA, 64 nt, Human
uucugagauuuggagcucaguccacgguccucccccacuggauggugcuacugcuguggaaucu

SEQ ID NO: 55484 - RNA, 64 nt, Human
aacagagcagagaaggagguucucuauguucagaccacuggagaggauagagagguaaaaggug

SEQ ID NO: 55485 - RNA, 64 nt, Human
uccagaaggguaucagauuaaacaccgaauucagccacuggacuuuuaaaaguacuuaagaugg

SEQ ID NO: 55486 - RNA, 64 nt, Human
ugagcauuugauucugacuucuguacucugguggccacuggaucuuugggauuaaagcucuguu

SEQ ID NO: 55487 - RNA, 64 nt, Human
aacaagagauggcaaagcagcaguccgaccaagcccacuggaauuauccuuuaauuuuacagau

SEQ ID NO: 55488 - RNA, 64 nt, Human
agucugcaucaagagauuuguccuccuugggggaccacuggaucauuccagauuucuugugauu

SEQ ID NO: 55489 - RNA, 64 nt, Human
augaucacaaugguaaggcacauaaauuauuuucccacuggaaaccugcccuguccaccccuuc

SEQ ID NO: 55490 - RNA, 64 nt, Human
guucuccccaucagcgaguuauuguaacuggucaccacuggacgggaaggagaacagaggagag

SEQ ID NO: 55491 - RNA, 64 nt, Human
uugcaguuugccagccauauucccaugugauuucccacuggauccaggcccccauccggcuggc

SEQ ID NO: 55492 - RNA, 64 nt, Human
ucuuaagagaacacugcacagcacucaaagucccccacuggacugcuuccuccuuagccccacu

SEQ ID NO: 55493 - RNA, 64 nt, Human
uggccuaggguugucugagccggagccggcagcuccacuggagagcagugcaggcagaguggag

SEQ ID NO: 55494 - RNA, 64 nt, Human
ucagccuuguuuucgguguguaggccccagcugcccacuggaacugccggcuaaugcuugcucu

SEQ ID NO: 55495 - RNA, 64 nt, Human
cacugagucgggagcccagaggaacggcgugaagccacuggacccucucccgggaccuccugcu

SEQ ID NO: 55496 - RNA, 64 nt, Human
aagccagccccggacucaucgugacauugagaucccacuggaggguaggggugguaauaaacuu

SEQ ID NO: 55497 - RNA, 64 nt, Human
gagacaacuugaacagucaucaacggaagucccuccacuggauuccuuuguuucuguccccucc

SEQ ID NO: 55498 - RNA, 64 nt, Human
cagagaugaacuguacacaugugauacauuuaagccacuggaaaaaccccugugcuugaaaaua

SEQ ID NO: 55499 - RNA, 64 nt, Human
gcaucagagccuggugcgccccuaggggagccucccacuggagugcccggccaggucuccaagc

SEQ ID NO: 55500 - RNA, 64 nt, Human
uuugacaccuagauuauagucuuaguaauagcauccacuggaaaaggugaaaauguuuuauucg

SEQ ID NO: 55501 - RNA, 64 nt, Human
cagaauaagugcuguuugagaugugaugcugguaccacuggaaucgaucuguacuguaauuuug

SEQ ID NO: 55502 - RNA, 64 nt, Human
agaaggcuugcacuugggccaaagggccuaagguccacuggacaguugggaaaacaccugacca

SEQ ID NO: 55503 - RNA, 64 nt, Human
agguucaagauauuauucauugcaguaugaguugccacuggauugacgcaaaguuuugaguuua

SEQ ID NO: 55504 - RNA, 61 nt, Human
ugggggagcuauggaagugacccaaggcugcccacuggagacgccucucccugcagucccc

SEQ ID NO: 55505 - RNA, 64 nt, Human
gaaugaagaugacuaauaguacuuguacuucccaccacuggaaauguuagcauaaaagaacuug

SEQ ID NO: 55506 - RNA, 64 nt, Human
ugauugacaacugaagagacacguggcuaggguuccacuggagaauugaaaaggacucuugagc

SEQ ID NO: 55507 - RNA, 64 nt, Human
ggagggccuuggcuucugcuaagugagaugggaaccacuggaggguuugaacagaggagugccu

SEQ ID NO: 55508 - RNA, 50 nt, Human
guggcuacuggucaucgugaccacuggagucaacacagacugauguaccc

SEQ ID NO: 55509 - RNA, 64 nt, Human
ggcaguaucuggguuacagccacagcaggaagaaccacuggagagacacucagaaggacuuccc

SEQ ID NO: 55510 - RNA, 64 nt, Human
ugaaggagccguguuagagcuuccgagaauagcuccacuggagagaaguggaauccuauauaga

SEQ ID NO: 55511 - RNA, 64 nt, Human
cuuaagagcuaguuguuaaaccuuuaccagcauaccacuggaccuugucuaaaauuucuuugug

SEQ ID NO: 55512 - RNA, 64 nt, Human
aggagauacaguggagacaucuggaaaguuuucuccacuggaaaacugcuacuaucuguuuuua

SEQ ID NO: 55513 - RNA, 64 nt, Human
acagcaacaccauucuaggaguuuccugagcucuccacuggaguccucuuucugucgcggguca

SEQ ID NO: 55514 - RNA, 64 nt, Human
uuuuaaaugcuguauguagaggaaaaucugcagaccacuggaauacauuuguuaaacucucauc

SEQ ID NO: 55515 - RNA, 64 nt, Human
ugacuuuaaauagcuauggguacaauauuaaaaaccacuggaacucuuguccaguuuuuaaauu

SEQ ID NO: 55516 - RNA, 64 nt, Human
ggccagguuccugacaguguugguuuuugcacauccacuggaaaggugucauuaaugacccagu

SEQ ID NO: 55517 - RNA, 64 nt, Human
ccacccugagcccuagacccauggguggcuaaauccacuggacugugaagacuauaauuuauuu

SEQ ID NO: 55518 - RNA, 64 nt, Human
aaucaaugaguuuaugcuagaauuuuucacauggccacuggaccauuguggaaguagacugguu

SEQ ID NO: 55519 - RNA, 64 nt, Human
gaauggccacugauaggcaugccucuuuucccacccacuggaaggcucacaggcaaggugagag

SEQ ID NO: 55520 - RNA, 64 nt, Human
auauuugcagugguuucacuaaagccugaucuucccacuggacugucggccugugaggaugagg

SEQ ID NO: 55521 - RNA, 64 nt, Human
aucuuuuuuuuuccuucucuacuuauuuaaauugccacuggaauaaaugugccuuuugaagcaa

SEQ ID NO: 55522 - RNA, 64 nt, Human
gggaaaaaguucacugcuacaaagggaucccaacccacuggaggcuuugaaguagggagguugg

SEQ ID NO: 55523 - RNA, 64 nt, Human
uguccuuccuaagaaggauaaauauauaaaaaagccacuggaaugaaaacuuccuauaugcuau

SEQ ID NO: 55524 - RNA, 64 nt, Human
ucacuuaagucaauuuugcauucaaugcugagaaccacuggacuagaaccuaaggguccugaaa

SEQ ID NO: 55525 - RNA, 64 nt, Human
ucuccuuuuggauacaguuauugaugaggcuuggccacuggauguuuucacuaacuacacucua

SEQ ID NO: 55526 - RNA, 64 nt, Human
ccaagcuggcaacggccaaaccaaggaguaccuuccacuggaagaaucucaaacagcgcuacuu

SEQ ID NO: 55527 - RNA, 64 nt, Human
auuggugacacauguuggugucacagcccucaucccacuggagacuggugugcggguggcagug

SEQ ID NO: 55528 - RNA, 64 nt, Human
aacaugcaaaaaauaaaaacauucuaguaacuggccacuggaaaauaaauaaaaauaaaaacua

SEQ ID NO: 55529 - RNA, 64 nt, Human
ggggggagaauuuauuguaguggcugccuaaaaaccacuggaguuuuuaaaagaagcaaggagu

SEQ ID NO: 55530 - RNA, 64 nt, Human
uuucagaauucacuggagaaggugugguugcagcccacuggagagaaguuugcuggcuugccca

SEQ ID NO: 55531 - RNA, 64 nt, Human
guuguaggugguuccgaguugagacaaauuacgaccacuggaagccagcacccaaggaagauga

SEQ ID NO: 55532 - RNA, 64 nt, Human
cugagagauucaugcugauuguuauuggguaucaccacuggagaucaccaguguguggcuuuca

SEQ ID NO: 55533 - RNA, 64 nt, Human
uaauauuuuuccacuuaaacuuuuuuuucuuacuccacuggagcucaguaaaaguaaauucaug

SEQ ID NO: 55534 - RNA, 64 nt, Human
cagcagugaaugacaccaaaggaccgcuugguagccacuggaacccuuuccagaacugcuguuu

SEQ ID NO: 55535 - RNA, 64 nt, Human
ggcuuuccuugccuacuuuagucacccagcagagccacuggagcuggcuaguccagcccagcca

SEQ ID NO: 55536 - RNA, 64 nt, Human
gguugaaguuauaaaauaaaauaaaauucauuuuccacuggaacucuaugacauucaguggagu

SEQ ID NO: 55537 - RNA, 64 nt, Human
cgggaggcggagguugcaguaagcagagauugugccacuggacuccagccugggugacagagcg

SEQ ID NO: 55538 - RNA, 64 nt, Human
gccccagcacuucagacaaagaccaccccuucacccacuggaccccaagccgcaaaagcugggg

SEQ ID NO: 55539 - RNA, 64 nt, Human
cacaggaucgccugggaggugaggugugugugacccacuggaugggagggcaaugagugugcac

SEQ ID NO: 55540 - RNA, 64 nt, Human
ucugcucuuugucagcuuucaggggagaaggaggccacuggaaaauuauuucccuaagugcagg

SEQ ID NO: 55541 - RNA, 64 nt, Human
ccuggccuugagccgugaccuccaggaagggaccccacuggaauuuuauuucucucaggugcgu

SEQ ID NO: 55542 - RNA, 64 nt, Human
gagcguguacuaccccaggacgcaugcagggcccccacuggagcguguacuaccccaggacgca

SEQ ID NO: 55543 - RNA, 64 nt, Human
cugugggagucaaagccuauuuugcugaguguucccacuggagucucugguagaauuagcaggu

SEQ ID NO: 55544 - RNA, 64 nt, Human
gggaugauuauuagucacauagagcuugggaguaccacuggaaacguauggguaggaguuuagg

SEQ ID NO: 55545 - RNA, 64 nt, Human
agggaagcuggcugggcuggcugaagaaugaagaccacuggacucuccguuaaucucuaagggg

SEQ ID NO: 55546 - RNA, 64 nt, Human
cuuagaacagaccucucugugcaauaacuuguggccacuggaaaucccugggccggcauuugua

SEQ ID NO: 55547 - RNA, 64 nt, Human
aucucuaacaccacacagaaagaggcuggaggagccacuggacaaagcuucugucucugugugu

SEQ ID NO: 55548 - RNA, 56 nt, Human
ugggcccacuucuuccuuaaaagguuccacuggagggcagaucccaaaggacagua

SEQ ID NO: 55549 - RNA, 64 nt, Human
ugaccuacaagucagaguccucucucacagucggccacuggauuucccucacuggcucucagga

SEQ ID NO: 55550 - RNA, 61 nt, Human
ggcuuuauuaugugaacuaaaacauggccucccacuggaagcaaggacuagauuccuccuc

SEQ ID NO: 55551 - RNA, 64 nt, Human
ggacucccaggcuggagagcacugccaggacccaccacuggaagcaggauggagcugacuacgg

SEQ ID NO: 55552 - RNA, 64 nt, Human
ucaggaccuggcuacguaauuauacuuaaaauauccacuggacacugugaaauacacuaacagg

SEQ ID NO: 55553 - RNA, 64 nt, Human
gcagauuuuucuuuacaguauuccauaggcagguccacuggaaaacugcagaaaaaugugagcu

SEQ ID NO: 55554 - RNA, 64 nt, Human
cacuuuuuuuauaagcaaaaacgugccguuuaaaccacuggaucuaucuaaaugccgauuugag

SEQ ID NO: 55555 - RNA, 64 nt, Human
gacacuggacauggcccauuggagcaccugggccccacuggacaacacugauuccuggagaggu

SEQ ID NO: 55556 - RNA, 64 nt, Human
auggggauuccuaggggcagaugaaggacaagccccacuggagugggguucuuugaguggggga

SEQ ID NO: 55557 - RNA, 64 nt, Human
ccauaccuggcgcaugcauauuuuuuaagaguacccacuggagucuaauauauagccuggguua

SEQ ID NO: 55558 - RNA, 64 nt, Human
cucagcccuggcugguuuuaccaucaucgugaugccacuggagcuggaguggcuggauguggag

SEQ ID NO: 55559 - RNA, 64 nt, Human
guauccuaauauuucaaugcaucaggggagcgcuccacuggauaagcauuuuauuucccgcaug

SEQ ID NO: 55560 - RNA, 64 nt, Human
ugaagaagacuugguuccugguaacauuuccuugccacuggagcucucuuaauaccgucaaacc

SEQ ID NO: 55561 - RNA, 64 nt, Human
gucccucauaccagcccuccuugccucccuccagccacuggaccccagccuuggcucuuccucu

SEQ ID NO: 55562 - RNA, 64 nt, Human
gcuguaaccccgcgccggcauagggaccuaaggcccacuggagggcgcucaucaaguagcugcu

SEQ ID NO: 55563 - RNA, 64 nt, Human
cccccaaaaaauaaaagggggcauaaacuuuauuccacuggagaagcccuggggguggcuggag

SEQ ID NO: 55564 - RNA, 64 nt, Human
acaaaacggauguaacauuucaugugaucgugcaccacuggaacaaaaccaaaaugugaccaua

SEQ ID NO: 55565 - RNA, 64 nt, Human
ugcugacaucuaugugcuaggcugccucaucacgccacuggaguccacacuugaauuugggcag

SEQ ID NO: 55566 - RNA, 64 nt, Human
cacaugaccccacagguaggcugaccccauggacccacuggagacuuugagggcagagcucggg

SEQ ID NO: 55567 - RNA, 64 nt, Human
aaaucuuuuccauuccucuuucauacauuccaacccacuggaagucuuuagagguauuuugauu

SEQ ID NO: 55568 - RNA, 64 nt, Human
gacuccccaggccaggccaccaggauggcccuucccacuggaggucacauucaggaagaugaaa

SEQ ID NO: 55569 - RNA, 64 nt, Human
ugcaaaccacuuacuaccaggccuuuuucuguguccacuggagagcuugagcucacacucaaag

SEQ ID NO: 55570 - RNA, 64 nt, Human
augucaccuccccaucauccacgccaaguggaagccacuggaccacaggaggugugauagagcc

SEQ ID NO: 55571 - RNA, 64 nt, Human
uucaaucaaauguugcuucccucuccugucuuucccacuggagccgcccaagcuuguagguggg

SEQ ID NO: 55572 - RNA, 64 nt, Human
agguugugaagggcguaacuuuuagagggaacggccacuggagguagagcuggacuaauccagu

SEQ ID NO: 55573 - RNA, 64 nt, Human
ccugcaaggguggcggguggcugaggucacaccaccacuggaguggaugggcagugccccacau

SEQ ID NO: 55574 - RNA, 64 nt, Human
cucgggcccagaugcagacggugccgaacgcuggccacuggauccacgcugaccgcccacagga

SEQ ID NO: 55575 - RNA, 64 nt, Human
cucugaaaauuccacuugcuauuuacccaagaauccacuggaggucauuacugccauuaaauaa

SEQ ID NO: 55576 - RNA, 50 nt, Human
cgauucccagacuggcuugaccacuggaugcuuugccgaaagcagcuugg

SEQ ID NO: 55577 - RNA, 64 nt, Human
ugacccuuccuaagggagggagguggauuagauaccacuggaggcccauucuguauuccuaauc

SEQ ID NO: 55578 - RNA, 64 nt, Human
uuacucuaggugccuuuuauguucagaacucuuuccacuggacugguauuugcucaaaaauaaa

SEQ ID NO: 55579 - RNA, 64 nt, Human
ccaaaccaccuuugucaucagcuuuuccucuuugccacuggaucuucauggagacaugggcaag

SEQ ID NO: 55580 - RNA, 64 nt, Human
ucuaagcacaaaaauaaaaacuuaucacuguauaccacuggaguuuucugguuaucucucguau

SEQ ID NO: 55581 - RNA, 64 nt, Human
aguuaacaugcuuucagucaaguacagauuguguccacuggaaagguaaaugauugcuuuuuua

SEQ ID NO: 55582 - RNA, 64 nt, Human
caggacgaaauaucggcguguggcuggagccuucccacuggaggcugaaaguggcuugugguau

SEQ ID NO: 55583 - RNA, 64 nt, Human
cugccugcguaaugaaguuuugauucauuuuuaaccacuggaauuuuucaaugccgucauuuuc

SEQ ID NO: 55584 - RNA, 64 nt, Human
gcuuuauuugcaguguguugagggacugguguauccacuggaauaguugguacucuuggaugug

SEQ ID NO: 55585 - RNA, 64 nt, Human
gggggugccgaggccucuggucuccucaggguggccacuggaggaugggugggggccucuguga

SEQ ID NO: 55586 - RNA, 64 nt, Human
ccuaaaccauaauuguaaccagugccuuuccuccccacuggagggcaagcccccccacccaccc

SEQ ID NO: 55587 - RNA, 64 nt, Human
cacuaaccacuauaauuauuuuuggcuuuuucagccacuggaacuuuuuuuggggggauuuaaa

SEQ ID NO: 55588 - RNA, 64 nt, Human
aagaaagauuaaagccauguugacuauuuuacagccacuggaguuaacuaacccuuccuuguau

SEQ ID NO: 55589 - RNA, 64 nt, Human
uuaagcaagcacuacugcacuuuacagaauuaccccacuggauccuggacccacagaauuccuu

SEQ ID NO: 55590 - RNA, 64 nt, Human
accugugagucuuggguugaguacccaaaugcuaccacuggagaaggaaugagagauaaagaaa

SEQ ID NO: 55591 - RNA, 64 nt, Human
guauauggacaguccagggcuuaugcccagcagcccacuggaggcauucuucaggcuccuuuaa

SEQ ID NO: 55592 - RNA, 64 nt, Human
aagaaacugauuggaaggggaaaugugcagcucuccacuggaaaggaacucuccaccccuccca

SEQ ID NO: 55593 - RNA, 64 nt, Human
acucacuccacucaaugugcacccagcuugauguccacuggacacuggcaacuuuuucuaaaau

SEQ ID NO: 55594 - RNA, 64 nt, Human
ggcuuucaaaaccaggcagggccaagccuuggccccacuggagguagagcaccuucuguggcuc

SEQ ID NO: 55595 - RNA, 64 nt, Human
auaaaauuuucuaauauucauuuggaaaaccucuccacuggagagguuucaucucugagagguu

SEQ ID NO: 55596 - RNA, 64 nt, Human
agagacuuuaagcaugcuucaagaggcaguugacccacuggaauuucuauaaggcugguacccu

SEQ ID NO: 55597 - RNA, 53 nt, Human
agaugagucccccgcuuuaggggccacuggagucgagcucagcguucacacca

SEQ ID NO: 55598 - RNA, 64 nt, Human
ugacuuugcuccuuccuuuccugagaaaauauuuccacuggauuuuuuccaccaguccccuuac

SEQ ID NO: 55599 - RNA, 64 nt, Human
aaugagccaauaaagcucacacuugggcuggcacccacuggagguggguauguuugcacuccgg

SEQ ID NO: 55600 - RNA, 64 nt, Human
auacagguaccuauguaaaagaaaaacuugagaaccacuggaauaugaaaaauauuuuaagugg

SEQ ID NO: 55601 - RNA, 64 nt, Human
uucugcagagccugagcugcugcugugguguggcccacuggagcaaacugcuggcaccuauucu

SEQ ID NO: 55602 - RNA, 64 nt, Human
acccucaccccacgagacagccccuucaggauuuccacuggaccuugcccaaauagcaccuuag

SEQ ID NO: 55603 - RNA, 64 nt, Human
uugugaaaucauacaggaagugggaaaacucuauccacuggagauaguauuuggaaugaaugga

SEQ ID NO: 55604 - RNA, 64 nt, Human
cccuucuucccuggcugccaggcucgccaggagcccacuggaaacgcccaccacgggggcuccu

SEQ ID NO: 55605 - RNA, 64 nt, Human
uccccacagccuuccucacccuuggcuggcagacccacuggaggucaggcacggaccaguggcc

SEQ ID NO: 55606 - RNA, 64 nt, Human
uaucccuggguuagaguugaaauuugccgcaauuccacuggaaggcauuucccacgaggccaga

SEQ ID NO: 55607 - RNA, 64 nt, Human
ggguggcaggaagacauccccccuccaucccagcccacuggaccagaacugggagaggaagaga

SEQ ID NO: 55608 - RNA, 64 nt, Human
uguucgcacauccugugugugcacagcugucccuccacuggauccccuucacacgugacccgug

SEQ ID NO: 55609 - RNA, 64 nt, Human
guccucccagcuccucacucaccuucaguaacccccacuggacugaccugguccacagggcacc

SEQ ID NO: 55610 - RNA, 64 nt, Human
ggagacauaauuuuucuaauuaguggaucuuuuuccacuggaaagugugauagcucauugcuaa

SEQ ID NO: 55611 - RNA, 64 nt, Human
cucuggagauggaauuaaaccaaauaaagagcuuccacuggaggcuuguauugaccuuguaacu

SEQ ID NO: 55612 - RNA, 64 nt, Human
uauguaaaaaaaaaaaaaaaaaaaaagaaccaaaccacuggaaauaaucaaaugcaaaaaggua

SEQ ID NO: 55613 - RNA, 64 nt, Human
aucccaugaacacacuguguccuggugcucucugccacuggaagggcagaguagccagggugug

SEQ ID NO: 55614 - RNA, 64 nt, Human
gccccagcaggcacugugcugggcuuaggggcuaccacuggaugauggcauugccgugacucac

SEQ ID NO: 55615 - RNA, 64 nt, Human
uauggcaaaagauuggacuaagacacuggccauaccacuggacaggguuauguuaacaccugaa

SEQ ID NO: 55616 - RNA, 64 nt, Human
uaggugggaagcaugguguccaccugccugcugaccacuggacgcugcuccaugcugaagaaaa

SEQ ID NO: 55617 - RNA, 64 nt, Human
acacuguaguuuuugagaagccugugaagaccauccacuggaacggguccuuccaggaggcagc

SEQ ID NO: 55618 - RNA, 64 nt, Human
ucuagucuggagaaaacuggaucaagauucuagcccacuggaguugcaaggaaugagaggcaaa

SEQ ID NO: 55619 - RNA, 64 nt, Human
acaccagcucccaaaggucccggaggcccuuuguccacuggagcugcacaacaaacacuaccac

SEQ ID NO: 55620 - RNA, 64 nt, Human
uuauuuuuguuaucucucuucucacaauuaugcuccacuggauaauaggaaaaacacuucuuuc

SEQ ID NO: 55621 - RNA, 64 nt, Human
uacauagggcagcucuuugugaaagugguuuauuccacuggagaaaggggauugaaaaucaguu

SEQ ID NO: 55622 - RNA, 64 nt, Human
gggcaaucugaggccaggacagauguugccccacccacuggagauggugcugagggaggugggu

SEQ ID NO: 55623 - RNA, 64 nt, Human
acaaaggggaaugguucuccagugcagcccgccgccacuggagugcccuguauggaaguccccu

SEQ ID NO: 55624 - RNA, 64 nt, Human
cccucauguucaccagggaacaggaccacaccggccacuggaggagggcaggagcaguccucac

SEQ ID NO: 55625 - RNA, 64 nt, Human
ggcucuuccagccucagugugccucucuggccgcccacuggaugagcggugagacgaacaaaag

SEQ ID NO: 55626 - RNA, 64 nt, Human
uuguuuauucaaugucuaaacacaugucaguuuuccacuggauuuuuauuuucacagguaaaua

SEQ ID NO: 55627 - RNA, 64 nt, Human
acaaucuguuguggggaaaccaccuccauguaacccacuggauacaguccccuuaauguuuuug

SEQ ID NO: 55628 - RNA, 64 nt, Human
cuuccuugggguugcaaccuggggaagccacaucccacuggauccacacccgcccccacuucuc

SEQ ID NO: 55629 - RNA, 64 nt, Human
uuggaaggagauaaggagggggccccagcaaaagccacuggacacacagcucugcuugacgagg

SEQ ID NO: 55630 - RNA, 64 nt, Human
auggaaaacugaaaaagaaaaccccucaagugagccacuggaaagaaagcaaaacaagagaaaa

SEQ ID NO: 55631 - RNA, 64 nt, Human
uugaggacucggaacccacagcgcaaucccugguccacuggaggauggacuguuccccccuuca

SEQ ID NO: 55632 - RNA, 64 nt, Human
gucuuucucuguccccagucucaagcagggugucccacuggagagaucucuuggcuucccuaac

SEQ ID NO: 55633 - RNA, 64 nt, Human
caaccaagccugcaaaucucccucuuguggaauuccacuggacccaaucuguuuuccauuucca

SEQ ID NO: 55634 - RNA, 64 nt, Human
uugcuaaaaucuauuucugcagcugagguuuuauccacuggacacauuugugugugagaacuag

SEQ ID NO: 55635 - RNA, 64 nt, Human
uccccuacucccuccacccccccuccacuguaggccacuggauggucauuugcaucuccguaaa

SEQ ID NO: 55636 - RNA, 64 nt, Human
augauggcugaagaguuuuucccagauuuacaagccacuggagaccccuuuuuucugauacaau

SEQ ID NO: 55637 - RNA, 64 nt, Human
agguuggaguuccagggcugggcccugguggaguccacuggaagucccauuauggauguugaaa

SEQ ID NO: 55638 - RNA, 64 nt, Human
cugugcaauaaugucuguguuucucucccaccugccacuggaacuggagaaugcacuuuauucu

SEQ ID NO: 55639 - RNA, 64 nt, Human
uagcccauuaugggaaucucugaugccuuugugaccacuggagaguuuaauccucuugguuuau

SEQ ID NO: 55640 - RNA, 64 nt, Human
cuucccuguccacugggcuggauucauguucaaaccacuggacuggcagggcaacgacuucuuc

SEQ ID NO: 55641 - RNA, 64 nt, Human
cagaauaugugaacugaguggacacccgaggcugccacuggaaugucuucucaggccaugagcu

SEQ ID NO: 55642 - RNA, 64 nt, Human
cugggggacuccuuccuugaacccuaauaagaccccacuggagucucucucucuccaucccucu

SEQ ID NO: 55643 - RNA, 64 nt, Human
ucaaauaugggaauuugagaaauauuucauuuguccacuggaugucacuauuuuacuaaaaggc

SEQ ID NO: 55644 - RNA, 64 nt, Human
cugucuuuaaauuuuauaugggcuuuguuaucuuccacuggaaaaguguaauagcauacaucaa

SEQ ID NO: 55645 - RNA, 64 nt, Human
aggccagcagcagcagcagccuacgcuaauaggaccacuggacucuuugccaggauggcuuuuc

SEQ ID NO: 55646 - RNA, 52 nt, Human
guucuaauuccaaaaaguaauuccacuggagcugcugggaaggaaaacgagc

SEQ ID NO: 55647 - RNA, 64 nt, Human
aguuagauuauuugcuacugugagaauauugucaccacuggaaguuacuuuaguucauuuaauu

SEQ ID NO: 55648 - RNA, 64 nt, Human
gcaugugagggguagugggauggugggguaccagccacuggaggggucauccuugcccaucggg

SEQ ID NO: 55649 - RNA, 64 nt, Human
ccucaaacuccugcccuccccaggccucuggggcccacuggaaagggcucugacccccuggccc

SEQ ID NO: 55650 - RNA, 64 nt, Human
auuggugaacuccccagggcucccgugggcucugccacuggacagaaggccuccagcuccuccg

SEQ ID NO: 55651 - RNA, 64 nt, Human
uccaggaggccuuauuuugaacugccucaggaccccacuggagagcacagcaugccuuacuacu

SEQ ID NO: 55652 - RNA, 64 nt, Human
ucaauuccuaaccuuuuuuaaaguuuccuggucuccacuggacacagagcuuuggagacggagg

SEQ ID NO: 55653 - RNA, 64 nt, Human
aacccuuggaucucuuugagucuacugauaaucuccacuggaaagguggaauugaaaugugguc

SEQ ID NO: 55654 - RNA, 64 nt, Human
caaauugagguggaggugggcgguucaguaucugccacuggacuugauuauaaacuguauuuga

SEQ ID NO: 55655 - RNA, 64 nt, Human
gugaauagaaugaauaccuuucaugccacugcagccacuggaaauacauucugugguguccuag

SEQ ID NO: 55656 - RNA, 64 nt, Human
uccacagcccgugauccccugcuucuggcuccuaccacuggacagucauuguggauagagcagc

SEQ ID NO: 55657 - RNA, 64 nt, Human
caggggauuuaggaucgcccucccauccucucacccacuggaccccguaggaguccugacccca

SEQ ID NO: 55658 - RNA, 64 nt, Human
gcggcuaaagcugggggauagaggggcugcagggccacuggaaggaacauggagcugucaucac

SEQ ID NO: 55659 - RNA, 64 nt, Human
ugguacuuuacaguuuugcaccaacucugccaagccacuggaucuuacauuaaacaucauacuc

SEQ ID NO: 55660 - RNA, 64 nt, Human
gcaaaagcaaacuacaaacaggccuugugcucaaccacuggaaaugccuccugggauaagaaug

SEQ ID NO: 55661 - RNA, 64 nt, Human
cuggaaaggcuggaggagcagaaggcagaggccaccacuggacuauugguuucaauauuagacc

SEQ ID NO: 55662 - RNA, 64 nt, Human
ccacucucaucaaagacaugucaucuugugcuagccacuggauuuugcagauuuuccuguccau

SEQ ID NO: 55663 - RNA, 64 nt, Human
gugaaccccugggccacugaagaguaacauggcuccacuggacacaaaagagggauggaaucaa

SEQ ID NO: 55664 - RNA, 64 nt, Human
cucucagcuucuugaaguuguucaacuauccuugccacuggaagaccaaacaagguuuucacug

SEQ ID NO: 55665 - RNA, 64 nt, Human
gagugaagcucagggcuugcagccaggacacugcccacuggagccugucaucugccccuuccgu

SEQ ID NO: 55666 - RNA, 64 nt, Human
aagcugcguagugcugaacauuaagcuuucugggccacuggaacaaagaacuaggaucucacag

SEQ ID NO: 55667 - RNA, 64 nt, Human
cauucccaccagcggcuccuccccaccuuucaucccacuggaaaggggccuguggcuggggaau

SEQ ID NO: 55668 - RNA, 64 nt, Human
gaucaaccucugauuuuacaucaugauguaaucaccacuggagcuucacuguuacuaaauuauu

SEQ ID NO: 55669 - RNA, 51 nt, Human
uaucgcaugaugagcuaugaaccacuggagcagcccacacuggcuugaugg

SEQ ID NO: 55670 - RNA, 64 nt, Human
ucccccauuauucuuucuguccagccccucccucccacuggagcagcuccagagccauuccuca

SEQ ID NO: 55671 - RNA, 64 nt, Human
uugcaaguuuuuggagaacccccaaacuccuucuccacuggaguuaggagggccugugguagac

SEQ ID NO: 55672 - RNA, 64 nt, Human
auuaaaagugcgggcagaacaacuggucugguuuccacuggaguaccacucugagcucuucaag

SEQ ID NO: 55673 - RNA, 64 nt, Human
aggugccagaggcgggaguuggucccccuuccucccacuggacaugguugcagcugggaguggg

SEQ ID NO: 55674 - RNA, 64 nt, Human
gaagccugguggcaauaaggaucuucccacuuugccacuggaugacuuuggaugggucacuugu

SEQ ID NO: 55675 - RNA, 64 nt, Human
cuugccgacaagggcaacucacgggugcaugaaaccacuggaacauggccgucgcugugggggu

SEQ ID NO: 55676 - RNA, 64 nt, Human
agaaggggccucccacccuuguccgaguugccucccacuggaggucaggagucuacacugcagc

SEQ ID NO: 55677 - RNA, 64 nt, Human
aaaaguugacaaaauggaaaagcaauguguuuuuccacuggauuaauuuucaccggaacaauug

SEQ ID NO: 55678 - RNA, 64 nt, Human
uuucuuuauauguuuugcauuuuaauauguugagccacuggaaauuuguaacagauuaauuugu

SEQ ID NO: 55679 - RNA, 64 nt, Human
cgauucuagcucuaauuacugucaugucauuuacccacuggaucaaaggguauguuucacuucu

SEQ ID NO: 55680 - RNA, 64 nt, Human
guauuuguuguuuagccaaaacagaaaaugauuuccacuggacaguagaaaaauauguguaaaa

SEQ ID NO: 55681 - RNA, 64 nt, Human
agcuucuccacaaggcuagaaauggggcacagagccacuggaggccucugacugaccucuacuc

SEQ ID NO: 55682 - RNA, 64 nt, Human
ugagaauuuuguccuuagcaaucucauccaauggccacuggagauguguguagggccacaagaa

SEQ ID NO: 55683 - RNA, 64 nt, Human
uggggguggagacccuuaugugcagcacucaaucccacuggaagccuaaugcugcagucagaag

SEQ ID NO: 55684 - RNA, 64 nt, Human
aacaugacugaaaagagcaccuguacuuuucaagccacuggagggagaaauggaaaacaugaaa

SEQ ID NO: 55685 - RNA, 64 nt, Human
ggucuccugcccugcagggccuuucuacccguguccacuggaggggcuguggccaucagcucug

SEQ ID NO: 55686 - RNA, 64 nt, Human
gcugcgggaccugcccagcugcccgugugccuacccacuggaggccauggacagcccugugagc

SEQ ID NO: 55687 - RNA, 64 nt, Human
cuuuucugcacaucuaguuuccuaccauagaaucccacuggaauaccacauagcuuuugcacug

SEQ ID NO: 55688 - RNA, 64 nt, Human
uuguggcaccaggcaucugauggugccaggaaagccacuggaauugucacacggcgagcacaga

SEQ ID NO: 55689 - RNA, 64 nt, Human
ggcucccuuacuugugaguaagggaucaugcucaccacuggagaagcuuacaccgggacuuuuu

SEQ ID NO: 55690 - RNA, 64 nt, Human
ucuaauucuucuuuaaucuaaaguagauagcuucccacuggaaaguaaacaaaaccaucccucc

SEQ ID NO: 55691 - RNA, 64 nt, Human
auuuuacacaugcccuagaagccaaaacugaaagccacuggauccuggucuagcugaaucuuca

SEQ ID NO: 55692 - RNA, 64 nt, Human
uaaguaaguagccuguaauggauguacuacuuugccacuggaauaccccgggucugugccaagg

SEQ ID NO: 55693 - RNA, 64 nt, Human
aaaauggguuuagaaaucuuugccaggucauggcccacuggauucuggauacucugaggccugg

SEQ ID NO: 55694 - RNA, 64 nt, Human
gcaggcucucugagggcauucuguagucccaggcccacuggaaaaaugaaucuauauuuugguu

SEQ ID NO: 55695 - RNA, 64 nt, Human
aauagaaugcaacuaucugcuuuucuuaugcugaccacuggaguccaugguggcaaguagagag

SEQ ID NO: 55696 - RNA, 64 nt, Human
cgacuuggcaagacaaaugaugagcaggaaaacaccacuggaucucacaccuucaauccaugac

SEQ ID NO: 55697 - RNA, 64 nt, Human
guguauugaacucucaggcuuuuauccuagaucaccacuggauugcugacagauagaggaggug

SEQ ID NO: 55698 - RNA, 64 nt, Human
agcuguccucccuggugcagguggccuggccagcccacuggauuggggacgggccaggcugggc

SEQ ID NO: 55699 - RNA, 64 nt, Human
ggaggccaggaaagggggagcggggcgcccagggccacuggaacagccccacuggagucaaggc

SEQ ID NO: 55700 - RNA, 64 nt, Human
ggggagcggggcgcccagggccacuggaacagccccacuggagucaaggcuccgagggaggaga

SEQ ID NO: 55701 - RNA, 64 nt, Human
uuuaccucaugauaucccagccgaggaaaaagauccacuggaaacuaggccgggaagcagcagc

SEQ ID NO: 55702 - RNA, 64 nt, Human
uaaaacauugucccugcccccgggggcucacaugccacuggaaacaacagacucuuaaacuaac

SEQ ID NO: 55703 - RNA, 64 nt, Human
gaggccgcuccuucccagacacacccccacgcccccacuggacggcauuggaggaagggacagc

SEQ ID NO: 55704 - RNA, 64 nt, Human
cccgaggccuugcucucagagcgggaggccccacccacuggagagccccgccccuaagguacua

SEQ ID NO: 55705 - RNA, 64 nt, Human
acucuacuuagcaugucccuaccgagucucuucuccacuggauggaggaaaaccaagccguggc

SEQ ID NO: 55706 - RNA, 64 nt, Human
aucgauaggaauccagaccuaggcugaggaucgcccacuggagccaguggcauggaggauuucg

SEQ ID NO: 55707 - RNA, 64 nt, Human
cccugcccaaccucuguggucacccaugcaucuuccacuggaacguuucacugcaaacacaccu

SEQ ID NO: 55708 - RNA, 64 nt, Human
cagagcgaagaggcuguagucauguccccaucccccacuggauucccuacaaggagaggccuug

SEQ ID NO: 55709 - RNA, 64 nt, Human
agagggagaaacuucugcucagaccgagcgugugccacuggaccucaguccucgccuggaggag

SEQ ID NO: 55710 - RNA, 64 nt, Human
gcuuugcgugcugcuagcuggguucaggcuucacccacuggaaagaaccaccaucugcucuaac

SEQ ID NO: 55711 - RNA, 64 nt, Human
gauguaaagaacugaguggggaaggaggaggcucccacuggauccauccguccagccaagagcu

SEQ ID NO: 55712 - RNA, 64 nt, Human
gaaggccaagugagaagcuggaggcuccaggacuccacuggacagacccaggucuuccagaccu

SEQ ID NO: 55713 - RNA, 64 nt, Human
uccagcagaagaccuuagacaaaaaaagcagaacccacuggaguagaaaaggaagcauguagca

SEQ ID NO: 55714 - RNA, 64 nt, Human
cgggcgccaggcauuguccagaccuggucggggcccacuggaagcauccagaacagcaccacca

SEQ ID NO: 55715 - RNA, 64 nt, Human
cagcuggggcaucucacuggagcuguuccaggccccacuggagagcagaggaccugauccccca

SEQ ID NO: 55716 - RNA, 64 nt, Human
agauaauguacuacugaagauguaauguagcuuuccacuggagucugggauuugcaauucugga

SEQ ID NO: 55717 - RNA, 64 nt, Human
gauaguuccauuaaguaaaaucaguaagaccaaaccacuggaaaacaugcauuuuggaaacuuu

SEQ ID NO: 55718 - RNA, 64 nt, Human
gugggggagggggauggcagagacuguaaaggcgccacuggacucuggcaaggccuuuauuacc

SEQ ID NO: 55719 - RNA, 64 nt, Human
uacuaacuuuccaaggccugccuuccccucccucccacuggagaagccgccagccccuuucucc

SEQ ID NO: 55720 - RNA, 64 nt, Human
uaaccagggcaccaagcccacagguguccccagcccacuggaucagaaagaguucaguaagacc

SEQ ID NO: 55721 - RNA, 64 nt, Human
uacuugaauacucucacaaguagggagcucacucccacuggaacagcccauuuuaucuuugaau

SEQ ID NO: 55722 - RNA, 64 nt, Human
uuuuccagauucuuccacuggcuccacauccaccccacuggaucuucagaaggcuagagggcga

SEQ ID NO: 55723 - RNA, 64 nt, Human
uggacugaguugguccuguucuggcacauaugguccacuggagacaauguaugauugaguuuuu

SEQ ID NO: 55724 - RNA, 64 nt, Human
aucuguuaccauugggaugauaaccugaggacccccacuggaaaucucccaucuuuugaaaaac

SEQ ID NO: 55725 - RNA, 64 nt, Human
gaucgucaaggcagguacccccucaacccuucuuccacuggagccccugacaccacaggugccc

SEQ ID NO: 55726 - RNA, 64 nt, Human
ggccaugugcuugugguugccucuccugcauuugccacuggauuugcacugcaucguuuggaga

SEQ ID NO: 55727 - RNA, 64 nt, Human
guggccuuugcgcuccuggcccagccuuuguuccccacuggagcagaaggggagauggacgaca

SEQ ID NO: 55728 - RNA, 64 nt, Human
ccacgugggcauggaaauggggcagauuaggggaccacuggacucagaggggagggaagggcuc

SEQ ID NO: 55729 - RNA, 64 nt, Human
agacuauuuacccuucaugaucuuuggcgauucuccacuggagcggaagggcugugugucaaaa

SEQ ID NO: 55730 - RNA, 64 nt, Human
guggaugcuguuccgagucagcguaggagaaaggccacuggaaaccagagucacacugcgcguc

SEQ ID NO: 55731 - RNA, 59 nt, Human
cacggcugaauucucggugauaaaggcgcccacuggacccucccaacgcccaaugcuuu

SEQ ID NO: 55732 - RNA, 64 nt, Human
cgggaggcggagguugcaguuagcugagauugcgccacuggacgacagagcgagacucagucuc

SEQ ID NO: 55733 - RNA, 64 nt, Human
ucugccaggaagguugaggacucccagguuucacccacuggaggcucaaccuaaggaacccugg

SEQ ID NO: 55734 - RNA, 64 nt, Human
guuccugcugucaucaacuugggcaacaaaugacccacuggaaaggcaaauccacuuaaaagau

SEQ ID NO: 55735 - RNA, 64 nt, Human
guuuuugggggugccuggagaugaacuggaugggccacuggagucucaauaaagcucugcacca

SEQ ID NO: 55736 - RNA, 64 nt, Human
caggccuaggaggccccccguguggacacagaucccacuggaagauccccucuccugcccaagc

SEQ ID NO: 55737 - RNA, 64 nt, Human
cucacaggggaagggagaggaaagaguuguucucccacuggaagggguucugccuucugaggug

SEQ ID NO: 55738 - RNA, 64 nt, Human
cagaccugucgucucucccacccccuccccaaagccacuggaaggagcacauacuaccuagaag

SEQ ID NO: 55739 - RNA, 64 nt, Human
gaaauagcuccucaaagccucaaaaccugauuggccacuggauccugcugcuuugggcugggau

SEQ ID NO: 55740 - RNA, 64 nt, Human
aacagaaaacaaagaaaagcuuguauauacuuugccacuggaaaggacaaauacauuuccaggu

SEQ ID NO: 55741 - RNA, 64 nt, Human
aagagggaaggugaccgcccagcucucccacaucccacuggaucuggcuuacaggggggucgga

SEQ ID NO: 55742 - RNA, 64 nt, Human
ccaggaggugagguugcagugagcugagauugcaccacuggacuacagccugggugacagagcg

SEQ ID NO: 55743 - RNA, 64 nt, Human
cagggacauagccagggaggggccacaucacuucccacuggaaaucucuguggucugcaagugc

SEQ ID NO: 55744 - RNA, 64 nt, Human
gcaguguuucuguccggaggaaauggaucuuaggccacuggacaagaaccugcacccaagggcc

SEQ ID NO: 55745 - RNA, 64 nt, Human
aauggauaaaaaaacagaugguagggagagagagccacuggaucggccucacagacucagagcg

SEQ ID NO: 55746 - RNA, 64 nt, Human
cugacugaacugugucuaagggucggucgguuuaccacuggacgggugcugcaucggcaaggcc

SEQ ID NO: 55747 - RNA, 64 nt, Human
caccugcaguuaaaccaucuaaagagaagaaagaccacuggagaccuagaaaacauacauuuuu

SEQ ID NO: 55748 - RNA, 64 nt, Human
cccgccacaccaagauguuggggcugccuggcgcccacuggagacagacagacagacgccuguc

SEQ ID NO: 55749 - RNA, 64 nt, Human
ugggaggcagagguugcagugagccgagauugcgccacuggacuccagccugcgugacagagag

SEQ ID NO: 55750 - RNA, 64 nt, Human
caugaaaaagccauuaauaucuauucacaucuuaccacuggagaguucauacuuaauaaaagga

SEQ ID NO: 55751 - RNA, 64 nt, Human
uaucaccaauccccuacuguuaaucagagaugucccacuggauaaaaaacauauaaauguaaga

SEQ ID NO: 55752 - RNA, 64 nt, Human
ccgaaggaaugagggucgugaccaacucaguauaccacuggaggcucugugagcaaacagcaaa

SEQ ID NO: 55753 - RNA, 64 nt, Human
ccccaucacuggaucccagauccccucacuccacccacuggauuccugcauugguuuuugguuu

SEQ ID NO: 55754 - RNA, 64 nt, Human
ucagcugcuggauucuggaugucaacaaaccucaccacuggauccugacaaccacaaugccugg

SEQ ID NO: 55755 - RNA, 64 nt, Human
gcccccuacuggauccuggaccucuacgucuuaaccacuggaucccacacaaaucagugaaugg

SEQ ID NO: 55756 - RNA, 64 nt, Human
ccguccccccaaucccucaccccccacaccucagccacuggagacugaugauccaaccacagga

SEQ ID NO: 55757 - RNA, 64 nt, Human
cguccuuauccuagccuagcucgcagggugagaaccacuggaguggcuggggcuggccagaggu

SEQ ID NO: 55758 - RNA, 64 nt, Human
agggaggggcagcuucugagguugccaaaggcccccacuggauggaaccuguuagcugcuccuc

SEQ ID NO: 55759 - RNA, 64 nt, Human
agguccucugggaagugucgcacaaaggagucgcccacuggaagguucugggcaggcgagaugc

SEQ ID NO: 55760 - RNA, 64 nt, Human
cucccaaaggccagaaguaucugaccgaccuacgccacuggaaacacacccaccgcaaccucaa

SEQ ID NO: 55761 - RNA, 64 nt, Human
uugaacacaaguuccugauaacuuuaagaucacgccacuggacugucuaugaacuugcaaacag

SEQ ID NO: 55762 - RNA, 64 nt, Human
uugaauacaaguuccugauaacuucaagaucauaccacuggacuaagaacuuucaaaauuuuaa

SEQ ID NO: 55763 - RNA, 64 nt, Human
uugaauacaaguuccugauaacuucaagaucauaccacuggacuaagaacuuucaaaauuuuga

SEQ ID NO: 55764 - RNA, 64 nt, Human
uugaauacaagcuccugauaacuucaagaucauaccacuggacuaagaacuuucaaaauuuuaa

SEQ ID NO: 55765 - RNA, 64 nt, Human; identical to SEQ ID NO: 55762

SEQ ID NO: 55766 - RNA, 64 nt, Human
uggguaccccucuucucaucacuuccuguucccaccacuggacugggcuggcccagccccuguu

SEQ ID NO: 55767 - RNA, 64 nt, Human
accugcccagccgggccugggaugggccaccacaccacuggauauuccugggagucacugcuga

SEQ ID NO: 55768 - RNA, 64 nt, Human
ggaggaggggcacggguuuaagggacuuggggagccacuggaagaauaauaaaaguguugcucu

SEQ ID NO: 55769 - RNA, 64 nt, Human
cuaagauguguccauugaggccacaaaucacccuccacuggaaucaccuaccuugccugcacua

SEQ ID NO: 55770 - RNA, 64 nt, Human
uauauuugacaacauaaaaucucucuauuuuucaccacuggaauuuagucaagcuucaggcccc

SEQ ID NO: 55771 - RNA, 64 nt, Human
gccugucuucuaggaaugaccaggcacccagcucccacuggacuccaauuuuuuuuccugccuu

SEQ ID NO: 55772 - RNA, 64 nt, Human
gcugcagaugccgagaagccagcaaacacagggcccacuggaaaaaaauaguuuuuucauuagu

SEQ ID NO: 55773 - RNA, 64 nt, Human
ggcauccagacuacacguguggauuugcagggagccacuggaguugguguuacauuuuuauacu

SEQ ID NO: 55774 - RNA, 64 nt, Human
ccucccugccacccccccugccugagcccaggacccacuggagccagccccacccuaggcagga

SEQ ID NO: 55775 - RNA, 61 nt, Human
ugcugcggguccacuucugagugacugaccuccacuggaggagacccauugcugggaggag

SEQ ID NO: 55776 - RNA, 64 nt, Human
ucaacagcaagugugaauacugcuugaauaaacaccacuggauuaauggccuguagugucgagg

SEQ ID NO: 55777 - RNA, 50 nt, Human
uuuuccuagacuccucauaaccacuggauaauuuuuuuauuuuuauuuuu

SEQ ID NO: 55778 - RNA, 64 nt, Human
aguaauauucaguguaguuaaggccagucuuaacccacuggaugaaaaucuaggacuguaugga

SEQ ID NO: 55779 - RNA, 64 nt, Human
ccaucaggacuagguuugugcaggaaggugaugcccacuggaacucuccucacaccuggcagcu

SEQ ID NO: 55780 - RNA, 64 nt, Human
gggacuucagcugaaccucugagugccaaggacaccacuggaacucacaaaggucuccuucacc

SEQ ID NO: 55781 - RNA, 64 nt, Human
auuccaugugguuccacgcccccuuccgagcugaccacuggaugcucuaugaaugcgagagccc

SEQ ID NO: 55782 - RNA, 64 nt, Human
ucgcuggcuuuggugcaagaggaagaagaauguuccacuggaagccugagcaccuaaucagcuc

SEQ ID NO: 55783 - RNA, 64 nt, Human
ggaucaaaaaauguuuuucaauguguucuuuguuccacuggaaacuuagagucaugaguuuaug

SEQ ID NO: 55784 - RNA, 64 nt, Human
ugcacgcacacugucugcccccguucccggguagccacuggacugacgacuugagugcucagua

SEQ ID NO: 55785 - RNA, 64 nt, Human
cacauuccucucauacucuuuauugugauggauaccacuggauuucuuuuuggcuguuguaagg

SEQ ID NO: 55786 - RNA, 64 nt, Human
guccuugacuugaugaauuuggucugccucugagccacuggaggaagcuguuuugagccagggu

SEQ ID NO: 55787 - RNA, 64 nt, Human
cagauacucgccaaggcagagcgcaaagugcuagccacuggaaaugcaugacuucccuccaccc

SEQ ID NO: 55788 - RNA, 64 nt, Human
gucagcgugcccuguaugcucagggcagcuguuuccacuggacauucucccuuugccucucugg

SEQ ID NO: 55789 - RNA, 64 nt, Human
gcggagaccaagagaaggcgugugagcaacccacccacuggaagaucaccuacugaggaggauc

SEQ ID NO: 55790 - RNA, 64 nt, Human
gcccgggcccuugaggcuguugcuagcgugacccccacuggaccagccccugacccagcucggg

SEQ ID NO: 55791 - RNA, 64 nt, Human
ggacuggccacugaauuaugccagggcgcacuuuccacuggaguucacuuucaauugcuucugu

SEQ ID NO: 55792 - RNA, 64 nt, Human
caucucguacagugacaaggaguuuacuauuaaaccacuggauaagaaaauugaugucuucaag

SEQ ID NO: 55793 - RNA, 64 nt, Human
acgugggggucagucgggggcaaggggcucagccccacuggacucugggcugcagaggccaccc

SEQ ID NO: 55794 - RNA, 64 nt, Human
aaccaccuguacagagugacagauuugggaugcaccacuggauuguagauugauuuuucuuucc

SEQ ID NO: 55795 - RNA, 64 nt, Human
ugaaaacaccaaugugugaaaugccuuacaaugcccacuggagaggcggggcgggguggggcag

SEQ ID NO: 55796 - RNA, 64 nt, Human
ugcugggcauggguggugacauuggcagaaauggccacuggaaaggggagcgaugagcugugga

SEQ ID NO: 55797 - RNA, 64 nt, Human
uuaugacugccaagacugcuguggccaggaggugccacuggagugugcgugguggucccugggu

SEQ ID NO: 55798 - RNA, 64 nt, Human
agccauccuugugugauuaggaggguuucaggggccacuggacuauuugcaaggugacagggac

SEQ ID NO: 55799 - RNA, 64 nt, Human
ggagccaagcacagcaggagcuuccgccuccucuccacuggagcacacaacuugaaccuggcuu

SEQ ID NO: 55800 - RNA, 64 nt, Human
gacaagcucagugggcaguggcaggaacugagugccacuggaaagcccauucccuuuauuuaga

SEQ ID NO: 55801 - RNA, 64 nt, Human
uucccuggggggacgggggacucacaugugccugccacuggagccucucaaccguccagcagaa

SEQ ID NO: 55802 - RNA, 64 nt, Human
gugaacaggaaacuccugugaccacaacaugaggccacuggagacgcauaugaguaagggcacu

SEQ ID NO: 55803 - RNA, 64 nt, Human
ggugugggccgaaccugauaccugccugggacagccacuggaaacuuuugggaacucuccucga

SEQ ID NO: 55804 - RNA, 64 nt, Human
ccugguggucugauucauacccuagccugaggcuccacuggaagaucucgcagccucaguguau

SEQ ID NO: 55805 - RNA, 64 nt, Human
ugggaaagggccccagcugaccuggcuaugggugccacuggagcuagaacagcccuccugcacc

SEQ ID NO: 55806 - RNA, 64 nt, Human
cuccucguuuucccacauguccugcaucccucccccacuggagugauuucagugaaucagacaa

SEQ ID NO: 55807 - RNA, 64 nt, Human
agagcacuggggcccauccaaguuuguucugccaccacuggauggaaaauuggaaauggacugg

SEQ ID NO: 55808 - RNA, 64 nt, Human
augcugccaggccugggaccucccacugcccccuccacuggaggggucuccucugcagcucagg

SEQ ID NO: 55809 - RNA, 64 nt, Human
cauaaauagauugcccagccccuccaguacaaucccacuggaagaaaaggcaauggcgggcuuc

SEQ ID NO: 55810 - RNA, 64 nt, Human
ucuugccaccccuucucacugcccugacccaaccccacuggaccuugaugcugcgaggaguggu

SEQ ID NO: 55811 - RNA, 64 nt, Human
aauuacauuugucuacugaaagcugccgaagcagccacuggaaagaacccuggggacccuaaug

SEQ ID NO: 55812 - RNA, 64 nt, Human
agaaccucucuggaauuugugccugaugugccuuccacuggauuuugggguucccagcacccca

SEQ ID NO: 55813 - RNA, 64 nt, Human
agggcugcauaucugagaaguggaugcccacaugccacuggaagggaaguggguguccaugggc

SEQ ID NO: 55814 - RNA, 64 nt, Human
agacauggaggggaugauaaaggaaauaggaucuccacuggacccuugauucauucugaacccu

SEQ ID NO: 55815 - RNA, 64 nt, Human
acagcaccccgagggccacaggugagggacacuaccacuggaucgugucagaaggugcugcuga

SEQ ID NO: 55816 - RNA, 64 nt, Human
guaacaagccuccuuuuaaaguaacccuacaaaaccacuggaaaguuuaugguuguauuauuuu

SEQ ID NO: 55817 - RNA, 64 nt, Human
aacugaaggcaaacagagccaaguauccuucaguccacuggaaagacaaguuccugcaucacca

SEQ ID NO: 55818 - RNA, 64 nt, Human
ucgagggaagaaaaagcucuuccaaagagaggagccacuggaaggaacagagcaauacuauacc

SEQ ID NO: 55819 - RNA, 64 nt, Human
agugggaugagccaacuccaguuucuuaaggaaaccacuggaaucugcagcccccacaugcauc

SEQ ID NO: 55820 - RNA, 64 nt, Human
agugcacauugucugccauaagaaaaccacccacaagcucaacugugacccaagcagaaucuac

SEQ ID NO: 55821 - RNA, 64 nt, Human
agguauaucuauuuuuauuuacuuuguaagaaacaagcucaaggagcuuccuuuuaaauuuugu

SEQ ID NO: 55822 - RNA, 64 nt, Human
ugcuagcuuuuccuccaggggaccacagcaggugaagcucaagagcgcauggcucugcuaauag

SEQ ID NO: 55823 - RNA, 64 nt, Human
uacagugagacccugucucaaaaaaaggaaaaaaaagcucaaaaaguucuguguugccuuucuc

SEQ ID NO: 55824 - RNA, 64 nt, Human
ugcuuguuucugauuaaugauuguuugucaauauaagcucaauuuaauuuugcaggauuuguug

SEQ ID NO: 55825 - RNA, 64 nt, Human
caguauuaaacccuuaaccacuucuaaaauaggcaagcucaauaaugucugccaacuucacauu

SEQ ID NO: 55826 - RNA, 64 nt, Human
cagcuuuucauauuaauguaugcagagucucaccaagcucaaagacacugguuggggguggagg

SEQ ID NO: 55827 - RNA, 64 nt, Human
acuuauccccacucauuggagugaacagugacgcaagcucaauagacuucauaaguguucauag

SEQ ID NO: 55828 - RNA, 64 nt, Human
ccugauggagagggcagcagcugccacguggaggaagcucaauaucagcugggaaggaacugug

SEQ ID NO: 55829 - RNA, 64 nt, Human
cuguugccuaugggaggagguggaaggauuuggcaagcucaaccacaugcuauuuaguuagcau

SEQ ID NO: 55830 - RNA, 64 nt, Human
caccuucaugauuauagcaacuaauguuugaacaaagcucaaaguaugcaaugcuucauuauuc

SEQ ID NO: 55831 - RNA, 64 nt, Human
gccaaucacccaaagaaaauaauagcuucugagaaagcucaauucacuguagcaacugugauau

SEQ ID NO: 55832 - RNA, 64 nt, Human
acucuucuucugauaggguuugauuuucuauuagaagcucaauuuuaguuuuuuuucauauuau

SEQ ID NO: 55833 - RNA, 64 nt, Human
ggaacacugaagggcaaggaggcuaaacaaaguuaagcucaacuaauuggcucaucaagaacac

SEQ ID NO: 55834 - RNA, 64 nt, Human
ggaugagaauuguuaagcuucuaaaauauuaaauaagcucaaauauauauauuugguguaaaua

SEQ ID NO: 55835 - RNA, 64 nt, Human
acaguuccuacauacguuucaguucuuucaugguaagcucaauggacuuugaauuguuuacagu

SEQ ID NO: 55836 - RNA, 64 nt, Human
auuuuaauuguauauuauucaagcaccuuuguugaagcucaaaaaaaaugaugccucuuuaaac

SEQ ID NO: 55837 - RNA, 64 nt, Human
ugacaggcagcaggguggcgacauggagagagggaagcucaauaaaucacuagguacaauccug

SEQ ID NO: 55838 - RNA, 64 nt, Human
caacugagcagccucuggagaggggccauuaauaaagcucaacaucauuggcuguggcugagug

SEQ ID NO: 55839 - RNA, 64 nt, Human
gccaucaaacuguaaaagauuaaacugcgaagucaagcucaacagauuauuuuggaaaguuuuu

SEQ ID NO: 55840 - RNA, 64 nt, Human
guuuuguuuugcauuuuuaacuccagauauccuaaagcucaauuguuuggucucugguuuucau

SEQ ID NO: 55841 - RNA, 64 nt, Human
gugaugugcuggguauagcauggaccucccagagaagcucaagcuauguggcacuguagcuuug

SEQ ID NO: 55842 - RNA, 64 nt, Human
agauggcaauuacuuugguagcugggaaagcauaaagcucaaaugaaauguaugcauucacauu

SEQ ID NO: 55843 - RNA, 64 nt, Human
uaaaaauggauacacaaggucaguugacacuaugaagcucaagcuaccaaaaagaaaguggcaa

SEQ ID NO: 55844 - RNA, 64 nt, Human
agcacaugugaggguuagacagguaggugaaugcaagcucaagguuuggaaaaaugacuuuuca

SEQ ID NO: 55845 - RNA, 64 nt, Human
ggguaaauuauguacuguugucuuucuaauaaaaaagcucaauuuuaauuuuucaucucuagac

SEQ ID NO: 55846 - RNA, 64 nt, Human
ucccgaggugaucuuugccugcucuucucuacccaagcucaagagcugcuucuguugcuaucua

SEQ ID NO: 55847 - RNA, 64 nt, Human
uguugugcucaaauaaauguuuacuuaucuuacaaagcucaaauacuggauuguaaccauguga

SEQ ID NO: 55848 - RNA, 64 nt, Human
cuugagaugguuucaggaauggcugcaaucucaaaagcucaauguacugcccaagaggcaccuu

SEQ ID NO: 55849 - RNA, 64 nt, Human
gaucaaaaucucacucacagucuuauucuagaggaagcucaagaucaaggacugcgucaaaguc

SEQ ID NO: 55850 - RNA, 64 nt, Human
cagcccucaggucagggugaggauggccucugcuaagcucaaggcgugaggaugggaaggaggg

SEQ ID NO: 55851 - RNA, 64 nt, Human
cuucagaaauggaacccccagcccagcagacaucaagcucaaggcaaugggcuacccucauuuc

SEQ ID NO: 55852 - RNA, 64 nt, Human
uuuccuuugaguaggacauuagcuuuugauuauaaagcucaacuaguauaagcaaaaauauaac

SEQ ID NO: 55853 - RNA, 64 nt, Human
aguauuuucacauaguauaguacucuggauguaaaagcucaaaaauugugauuccuugaacguu

SEQ ID NO: 55854 - RNA, 64 nt, Human
auaaaugcaaaaauggauaaaauaauuuuuguuaaagcucaaauacuguuuucuuucauucuuc

SEQ ID NO: 55855 - RNA, 64 nt, Human
agaguuguucugucuuuagauaagguuugaaccaaagcucaaaacaaucaagacccuuuucugu

SEQ ID NO: 55856 - RNA, 64 nt, Human
ggguggacauuuguauuuuguuagguugcuguuuaagcucaaguuugcugugcucucugcagcu

SEQ ID NO: 55857 - RNA, 64 nt, Human
guaagugaccaccaaauuguuauuugcacuaacaaagcucaaaacacgauaaguuuacuccucc

SEQ ID NO: 55858 - RNA, 64 nt, Human
augucagauguggucaguagggagcuccaugcccaagcucaagaacgacugcaacacuacuuua

SEQ ID NO: 55859 - RNA, 64 nt, Human
uguuuucuuuacucuugucaagguuggguacuucaagcucaaagccuaucuaccuugauccaaa

SEQ ID NO: 55860 - RNA, 64 nt, Human
cuaauguuauuuugcaaaugccauauauucaaaaaagcucaaagauaauuuucuuuacuauuau

SEQ ID NO: 55861 - RNA, 64 nt, Human
auuucuauaauggguuugggggauaauaauggugaagcucaagaacagaugucuauugaguaga

SEQ ID NO: 55862 - RNA, 64 nt, Human
aacauuccuuuccauugaucccaggucuucagcuaagcucaaccaauugucaaccagaaaaugu

SEQ ID NO: 55863 - RNA, 64 nt, Human
uuauuagcauguaccuugaaauuauuugaccaagaagcucaaagaaaagaaguacguuaaagaa

SEQ ID NO: 55864 - RNA, 64 nt, Human
caaucuaagcuguguuacuccaaaggacaugaaaaagcucaagaguaaaauuaaaauucucaaa

SEQ ID NO: 55865 - RNA, 64 nt, Human
aguaucuauagccauguacauauuacagcaugacaagcucaaauaauuaugagucagcccgaaa

SEQ ID NO: 55866 - RNA, 64 nt, Human
caccgugggggaggaaggcagcagcugaagaaaaaagcucaaaugaucuagucacuuucgauac

SEQ ID NO: 55867 - RNA, 64 nt, Human
uuuuuacccauauaaguuauuuaauauaauaaugaagcucaacacugugguaggaaaauagcca

SEQ ID NO: 55868 - RNA, 64 nt, Human
gccugcuucuuccccaggguucuguauugcagcuaagcucaaauguauauuuaacuucuaguug

SEQ ID NO: 55869 - RNA, 64 nt, Human
ucuaaaggacuaacauaaaaucugugaauuaaaaaagcucaaugcauugucuuguggaggauga

SEQ ID NO: 55870 - RNA, 64 nt, Human
uucuaguacaaaaggaauacuuagccagggccucaagcucaagauacuuauugaaaacauccuc

SEQ ID NO: 55871 - RNA, 64 nt, Human
uuucucugauaauuuaauaucuacucuccuacaaaagcucaagccugaagauacaagacuauua

SEQ ID NO: 55872 - RNA, 64 nt, Human
ugucaaacaacaugugagcauggucacaagcacaaagcucaagaugacagcucuucuaaggaaa

SEQ ID NO: 55873 - RNA, 64 nt, Human
gggagauguuaggagaaaggaaaugcuguaacuaaagcucaauuauuaucaguucuaugcuaac

SEQ ID NO: 55874 - RNA, 64 nt, Human
cauguaacaaaacccagcacauuaucugcacuauaagcucaaagaaugucacauccgcccagac

SEQ ID NO: 55875 - RNA, 64 nt, Human
acaaaacaaaacacaguccugcauacucaccaccaagcucaagaaauaaaucaucaccaauacc

SEQ ID NO: 55876 - RNA, 64 nt, Human
augcuauuccaugacguuuguaaaauguuuguaaaagcucaaacaugacgauuccauaaaauaa

SEQ ID NO: 55877 - RNA, 64 nt, Human
ccccgcacggggaggguugggaagggggugcaggaagcucaaccccucugggcaccaacccugc

SEQ ID NO: 55878 - RNA, 64 nt, Human
agugagagugaaucccuuaggacuggaacacuucaagcucaaccaacugacucaguugucauuc

SEQ ID NO: 55879 - RNA, 64 nt, Human
agauguuuuucccaccugucagaugaaaaaacugaagcucaaaaaggguugacuugaccauaca

SEQ ID NO: 55880 - RNA, 64 nt, Human
augcaguccagugagaaauuacagguuccuuuugaagcucaacuguugccaggagauggaauau

SEQ ID NO: 55881 - RNA, 64 nt, Human
gccagauccucauggcagcgaggcccucugcaagaagcucaaggaagcucagggaaaauggacg

SEQ ID NO: 55882 - RNA, 64 nt, Human
caagccugacccuguaaaauggagguggaaagacaagcucaaguguucacaaccuggaagugcu

SEQ ID NO: 55883 - RNA, 64 nt, Human
uucuuccuuuaacaaaaagcaaaggcguagguaaaagcucaaaugaauuuauucuuucgguaug

SEQ ID NO: 55884 - RNA, 64 nt, Human
ucaagacaaauugaaagaaagcaauaacucaccaaagcucaacgcugccccugccucgaccucc

SEQ ID NO: 55885 - RNA, 64 nt, Human
gguuauuauccccauuuuacagaugaggaaacugaagcucaaagaggcucaaugacuuucccaa

SEQ ID NO: 55886 - RNA, 64 nt, Human
cucucaucccuguuccccuuucuccaaagagaugaagcucaaauaaaauguauaacucuaguaa

SEQ ID NO: 55887 - RNA, 64 nt, Human
ucccuggcagcacaggaaaagaauuuuuuuuuuuaagcucaaaaucuagaagagucuauugucu

SEQ ID NO: 55888 - RNA, 64 nt, Human
uuuauaucuguagcugaauuuguuaaagucuaaaaagcucaaggacuuuaugaagaucucauua

SEQ ID NO: 55889 - RNA, 64 nt, Human
cccuccuaaucuacuauccagaccugccuucuggaagcucaauuaucacgagcacaugguggaa

SEQ ID NO: 55890 - RNA, 64 nt, Human
aagacaguucauacaguaugaugccauuuuuauaaagcucaaaaccaaauauguguggaauuca

SEQ ID NO: 55891 - RNA, 64 nt, Human
gagaguugggugaggguaaagcuuuucuauaaucaagcucaauacaccaaggaaacuggaucca

SEQ ID NO: 55892 - RNA, 64 nt, Human
cuuggcagguuugagacaguuccagaaagaacccaagcucaagacgcaggacgagcucaguugu

SEQ ID NO: 55893 - RNA, 64 nt, Human
cagugugaauuuuauuaaugcuaucaucucgaccaagcucaaagccuacuuauuagaaacaaug

SEQ ID NO: 55894 - RNA, 64 nt, Human
agggcuacuggugagauugagaucugagcaggcaaagcucaaaagagaguuuggagguuaaaaa

SEQ ID NO: 55895 - RNA, 64 nt, Human
aggccuucuguggauggagaacuaggccuucucaaagcucaaggacaaaauccagcuaacccag

SEQ ID NO: 55896 - RNA, 64 nt, Human
cuuggcuccaaaccuucugcugccucuaagauaaaagcucaacuucuuaacaguguacagugug

SEQ ID NO: 55897 - RNA, 64 nt, Human
ucacagacagacaauaagccagacaacacaaucaaagcucaauagaugauuucuugcuuuuuuc

SEQ ID NO: 55898 - RNA, 64 nt, Human
aucaaaauaugaaugacuuuggaaaauuuacaugaagcucaaguguuaggauugacuuaugaaa

SEQ ID NO: 55899 - RNA, 64 nt, Human
ggaaagcaaaugauuugggucucaacugaagaugaagcucaacucaggaagagauuuaucugua

SEQ ID NO: 55900 - RNA, 64 nt, Human
ccuaguguuguggugcuucugguaaugguaauagaagcucaacuauuuuuuuguggauuucagu

SEQ ID NO: 55901 - RNA, 64 nt, Human
cugcuuagcagaaaaugacgauuaaucuauaggaaagcucaaguaaaugcauuaucaacugcag

SEQ ID NO: 55902 - RNA, 64 nt, Human
acugauauauuggguaaauuuuguugaauaaauuaagcucaacuauuuguauuucaauaguuga

SEQ ID NO: 55903 - RNA, 64 nt, Human
uguccccgcagcugcuuguggcggauuccucaccaagcucaacggcuccaucaccagcccgggc

SEQ ID NO: 55904 - RNA, 64 nt, Human
auaaagguaacaaagggcagcucagugguuacucaagcucaaaaggguuuuuuuaagagcaagc

SEQ ID NO: 55905 - RNA, 64 nt, Human
cguaacauggaauacaagcuugaaucugggaaacaagcucaaaaaacagugaaaaaaaaaguac

SEQ ID NO: 55906 - RNA, 64 nt, Human
uccaaaaguaauguguuuaguagagagagacucuaagcucaaguucugguuuauuucauggaug

SEQ ID NO: 55907 - RNA, 64 nt, Human
aaguucucagaauuuuugaguaguugcuuacgugaagcucaagauaccuguagaaagaaauaug

SEQ ID NO: 55908 - RNA, 64 nt, Human
ccgagucaccggaaaaaucugauuuuucccccgaaagcucaaugacuuuaacgugcuuggcugg

SEQ ID NO: 55909 - RNA, 64 nt, Human
aaaaaaaauguauguggaauucugucucuugguaaagcucaaagccaggcuagccugagguggc

SEQ ID NO: 55910 - RNA, 64 nt, Human
ucagcuagaacagcaaguugaaaaacucagaaagaagcucaagaccgcacagcagcgaugcaga

SEQ ID NO: 55911 - RNA, 64 nt, Human
aauauauguaugauuuauaagcuuuuuuaaaacaaagcucaaauuguugguauuuuucuaaaau

SEQ ID NO: 55912 - RNA, 64 nt, Human
aauaucucccuuuggagcugcucagacuuacuuuaagcucaaacagaagggaaugcuauuacug

SEQ ID NO: 55913 - RNA, 64 nt, Human
acagcauggaugcaauaaauguagagcaauacauaagcucaauuugauuugagacuaguaccca

SEQ ID NO: 55914 - RNA, 64 nt, Human
ucuggagacaucagccuuugguaccuaauucucuaagcucaagaugcaucccauugccacuuua

SEQ ID NO: 55915 - RNA, 64 nt, Human
aaaaaagucgacugcuaugcucaaaaaguaaaaaaagcucaacaguuaaaaucuaauguuuguu

SEQ ID NO: 55916 - RNA, 64 nt, Human
ucuugagucacacugcuagcaaauggcagaaccaaagcucaaauaaaaauaaaauaauuuucau

SEQ ID NO: 55917 - RNA, 64 nt, Human
aaaaagauuccuuuuucuaaccuguuaaaaacuaaagcucaaguucacuaccucuuuccucaga

SEQ ID NO: 55918 - RNA, 64 nt, Human
cuugugcucuggacucagguucaaaguucagaugaagcucaauggccucuuaguuggagcuuag

SEQ ID NO: 55919 - RNA, 64 nt, Human
uaggacuuggugccuaauuuuauaaaaagucacuaagcucaagugcuuggaugaaaggacagcg

SEQ ID NO: 55920 - RNA, 64 nt, Human
cuccugucucucccugggguuucuggugguggaaaagcucaagccuuugcgaagcuaaugaccu

SEQ ID NO: 55921 - RNA, 64 nt, Human
gaggaggcaaaaaugccuggcgccccuucucuccaagcucaauucucuaagccccucagggucu

SEQ ID NO: 55922 - RNA, 64 nt, Human
ccagacauuucacaagugugaaaggagauaggagaagcucaacuugagggcguguaguaaguug

SEQ ID NO: 55923 - RNA, 64 nt, Human
gaccuguggagaccagucuuucugacacacagugaagcucaacuugccuccuggcugcuucagc

SEQ ID NO: 55924 - RNA, 64 nt, Human
cugcugaguaaggaacacgauuuucaagauucuaaagcucaauucaagugacacauuaaugaua

SEQ ID NO: 55925 - RNA, 64 nt, Human
agagaggauuagauaggguuccaacugggccuacaagcucaagccauacauaaaaggaccuugg

SEQ ID NO: 55926 - RNA, 64 nt, Human
aggaccugaaaggaucacacugcauccuaggacaaagcucaaaaguaccucugggacuacaaaa

SEQ ID NO: 55927 - RNA, 64 nt, Human
ugggaugccuucugugaggauuuuuaucgcagugaagcucaagugguacccaacugcguuguaa

SEQ ID NO: 55928 - RNA, 64 nt, Human
aggaaugugugaaaaguauacacaaagggcucugaagcucaagucagaggagugggaggucuga

SEQ ID NO: 55929 - RNA, 64 nt, Human
gcuuguuaagacaacucuuguguacgcuauguugaagcucaacaaaaaagucaugggaccacuu

SEQ ID NO: 55930 - RNA, 64 nt, Human
cuucuccacggccguccuauagacaggauuucuaaagcucaaagaauucuguguuuaaacgauc

SEQ ID NO: 55931 - RNA, 64 nt, Human
gugagcccagacgcuccuccaccccuuccagaccaagcucaacgccuccaagaccagcaggcca

SEQ ID NO: 55932 - RNA, 64 nt, Human
cucucaggcacccccuacacuucaguugagggaaaagcucaagugccuuaggcccguggaccac

SEQ ID NO: 55933 - RNA, 64 nt, Human
auggcaccauccacccugcaggcuugggaacuguaagcucaagcuuuugcucauuugucauuua

SEQ ID NO: 55934 - RNA, 64 nt, Human
cccacaaacucaggagaacauaagccugcucguaaagcucaauccuucuaucauggcaccaauc

SEQ ID NO: 55935 - RNA, 64 nt, Human
cccacuuaacagaugaggaaacugaggccuagagaagcucaacaaguugccuaaguuccaaguu

SEQ ID NO: 55936 - RNA, 64 nt, Human
gaagaaauugguauacuuugugcaaaucugccauaagcucaaggcugugacuggggaaaaagau

SEQ ID NO: 55937 - RNA, 64 nt, Human
ugcuacugaaggggacaccaaugcugcuauccgcaagcucaagagaucccagagauucuaacca

SEQ ID NO: 55938 - RNA, 64 nt, Human
cagcccagccuagcccacuugucauccauaaagcaagcucaaccuuggcgucuccucccucucu

SEQ ID NO: 55939 - RNA, 64 nt, Human
ccugucucccuccucugucaccaccagccucuccaagcucaaguacaaauacagccgggucuca

SEQ ID NO: 55940 - RNA, 64 nt, Human
gcuggagcauaguggcaagaucauagcucauugcaagcucaagugauccuccugacucagccuc

SEQ ID NO: 55941 - RNA, 64 nt, Human
uugaugaagcaccugcuggacacugagggacccaaagcucaaucagccauaaucccugcuuuca

SEQ ID NO: 55942 - RNA, 64 nt, Human
guauagccucaggccuucauuucugaaaagaaaaaagcucaaaaagcugcugaauuucucuggg

SEQ ID NO: 55943 - RNA, 64 nt, Human
aaauguagagaacagcaaaugauugaugcaguuaaagcucaauaugccuuuuuuuacuggauac

SEQ ID NO: 55944 - RNA, 64 nt, Human
ugauaaucauauagcgaaggcauauuuuucuuccaagcucaagucaggauugugacuauauauu

SEQ ID NO: 55945 - RNA, 64 nt, Human
uuuaaugucacuaauuuucaaaauuaaauaguuuaagcucaauuuaauuuugcuagauauuuaa

SEQ ID NO: 55946 - RNA, 64 nt, Human
uguuuuuccccuuccugucuaggaaaaugcuauaaagcucaaauuaguuaggaaugacuuauac

SEQ ID NO: 55947 - RNA, 64 nt, Human
acaaaagcaugauaaauaauuguuaauauggaauaagcucaaauaugucaaaauaaauguaaaa

SEQ ID NO: 55948 - RNA, 64 nt, Human
uuaaaucucauauaauguuucucaaucuuguuaaaagcucaaaauuuugggccuauuuguaaug

SEQ ID NO: 55949 - RNA, 64 nt, Human
ugguagaaagaaaaccaacuguggucauccagagaagcucaaaaacucuuguacucagguucuc

SEQ ID NO: 55950 - RNA, 64 nt, Human
cauagucuccugugggucuugaguugguuauuucaagcucaaacucugaauaugauuaaaccag

SEQ ID NO: 55951 - RNA, 64 nt, Human
gcaucaggcugcuuggacaugaaaccccgucuccaagcucaagcugggagacccuggcccaguu

SEQ ID NO: 55952 - RNA, 64 nt, Human
caugaaggauaacauuuuuauacagaaggcagucaagcucaacucagagccauggaggcaagua

SEQ ID NO: 55953 - RNA, 64 nt, Human
aaucuggugaaaacaauacccccacauauucaagaagcucaaaugaccugaaguagaauaaaca

SEQ ID NO: 55954 - RNA, 64 nt, Human
agaguauuauugcacagaucugaagaucaaaaaaaagcucaaggaaauacagaucggaagugcu

SEQ ID NO: 55955 - RNA, 64 nt, Human
cacacacucuugggcugaccuuuauuuuaucaauaagcucaauauuacuuuguuuaaaauaaga

SEQ ID NO: 55956 - RNA, 64 nt, Human
gggaggcugagacgcaaggaucacuugagcccagaagcucaaggcugcagugagccaaguucac

SEQ ID NO: 55957 - RNA, 64 nt, Human
accacagcacuuauaaugaugucacuacauauagaagcucaaaguuaagggauuugcugaagac

SEQ ID NO: 55958 - RNA, 64 nt, Human
uguguuauaugacaucauccugaagaacuucgagaagcucaagaagcccaggggagaaacaaag

SEQ ID NO: 55959 - RNA, 64 nt, Human
aaacugaagguuucauuuugggaguaggguuuuaaagcucaaucuguuaucugcuaaaauugau

SEQ ID NO: 55960 - RNA, 64 nt, Human
cuggcagaaacugcucacaugccuucaaaagugaaagcucaacucuacgcucaagcauaugacg

SEQ ID NO: 55961 - RNA, 64 nt, Human
uuaccaggggcagugccucucugcgggggaggaaaagcucaagguuagcugucuuaacccaagu

SEQ ID NO: 55962 - RNA, 64 nt, Human
aguccuggcccuugaugcccagcucagugccacaaagcucaauaggagggauguuccaguggau

SEQ ID NO: 55963 - RNA, 64 nt, Human
ggucugcuuuuauuucuauguacuccuguuugccaagcucaauaauggacaaaggauacaaaca

SEQ ID NO: 55964 - RNA, 64 nt, Human
cuuaaaguuaaugacuuaaugacuaauuugccaaaagcucaauuccuauuuugguguguuuaua

SEQ ID NO: 55965 - RNA, 64 nt, Human
ucccauuccccacaggcccuacauuaacaagguuaagcucaaccccuuucccccagcaccucag

SEQ ID NO: 55966 - RNA, 64 nt, Human
guugccaaguggguucagggugagggcaauuuguaagcucaauuucucugacagccaagacaug

SEQ ID NO: 55967 - RNA, 64 nt, Human
cugucaugcugcucagugugguucucaccccugcaagcucaaauucaguucccugaauggaguc

SEQ ID NO: 55968 - RNA, 64 nt, Human
uuggagaagucucagcuaagcucacguccugagaaagcucaaagguuuggaaggagcagaaaac

SEQ ID NO: 55969 - RNA, 64 nt, Human
gugcuaugaucucugaaaagacguuaucaccuuaaagcucaaauucuuugggaugguuuuuacu

SEQ ID NO: 55970 - RNA, 64 nt, Human
ccugaccucccuccuccagacagauggcucuggaaagcucaaccugcaggaguuccaccaccuc

SEQ ID NO: 55971 - RNA, 64 nt, Human
ucaugcauuugacaaggauggagaugguaucaucaagcucaacguucuggagguaaagcauagg

SEQ ID NO: 55972 - RNA, 64 nt, Human
agagcuggagccccugcugcccagcucagacucuaagcucaacaagcccuugagcccccagaag

SEQ ID NO: 55973 - RNA, 64 nt, Human
gagccaguaaacagaggaguacaggugaagcaccaagcucaaagcguggacaggugugccgaca

SEQ ID NO: 55974 - RNA, 64 nt, Human
aauaucaauuaaaauguuuuauuuauuuuauuaaaagcucaauauuuucuaugaauucaaaaau

SEQ ID NO: 55975 - RNA, 64 nt, Human
gccccgccgagagaacugcugucacuuucaggcaaagcucaaagguccuaggcccacaguucuu

SEQ ID NO: 55976 - RNA, 64 nt, Human
cggguuaagaaauaccuuuaaauuuagguaaauaaagcucaaggagguggggcugucaucugug

SEQ ID NO: 55977 - RNA, 64 nt, Human
auguguagaucuccguccuucauuucugucauucaagcucaacggcuauuguggugacauuuuu

SEQ ID NO: 55978 - RNA, 64 nt, Human
gaugacaagcaagacccucccuccaaagaaaauaaagcucaaaauaaaauaugauuuguguuca

SEQ ID NO: 55979 - RNA, 64 nt, Human
acaaauuugugcaaacacugcuagagucauuuugaagcucaagcauuuucacuuuguuucuuac

SEQ ID NO: 55980 - RNA, 64 nt, Human
cuaagaaagaacacgcucucuccaggcaggucugaagcucaacucucuuauugccucacuucag

SEQ ID NO: 55981 - RNA, 64 nt, Human
uugucucuaccaaaaguuaaaaaaaaaaaaaaaaaagcucaagaaccugcacgagggccuaaaa

SEQ ID NO: 55982 - RNA, 64 nt, Human
gaauuuuuaaauuauuuguuuauauauaaaagaaaagcucaauuggcugugcuguccugugcug

SEQ ID NO: 55983 - RNA, 64 nt, Human
ccuugcuagaaacauaauuuuuuuuuucucacugaagcucaauaauggaacucuuuuuuuuuuu

SEQ ID NO: 55984 - RNA, 64 nt, Human
uauauguggaaauucuuccuguuggcuaaaggggaagcucaaguggugucgucuuuugugcugu

SEQ ID NO: 55985 - RNA, 64 nt, Human
agguggccccccuuucuugaccuccuccuccuucaagcucaaacaccaccucccuuauucagga

SEQ ID NO: 55986 - RNA, 64 nt, Human
aaauuauaaauaacucuuugcaaauaggaaagugaagcucaaggguaaccagugaggcuaugaa

SEQ ID NO: 55987 - RNA, 64 nt, Human
cugucucuccacaaguagagccaaaggcaaugggaagcucaauguugcucagugggugagaucc

SEQ ID NO: 55988 - RNA, 64 nt, Human
uuuaccagguuuuccaaagacagaauagaucacaaagcucaaggaauuuaauauucuuguaaug

SEQ ID NO: 55989 - RNA, 64 nt, Human
aaacauuaaaacucggucacaacuaagugaucccaagcucaagggugaauccccaauacuuuac

SEQ ID NO: 55990 - RNA, 64 nt, Human
ggugugauuacagcucauguagccuggaccucccaagcucaagcaauccuccugccucugccuc

SEQ ID NO: 55991 - RNA, 64 nt, Human
uauuuuccuucauuaugaauagucaguauuuuaaaagcucaaaguagaagaggagucacuaagc

SEQ ID NO: 55992 - RNA, 64 nt, Human
aaguucuuagaaauauuuuuuguuugcugaaauaaagcucaaucaacacacuaccuuaaaaaaa

SEQ ID NO: 55993 - RNA, 64 nt, Human
guuucuucuggagaauuggaacauguguggccccaagcucaacagaaaccaguuguucccaauc

SEQ ID NO: 55994 - RNA, 64 nt, Human
aauugaucauaaaaccuuuaggaaauguauuugaaagcucaaaauagaaauuagguuaaaaugc

SEQ ID NO: 55995 - RNA, 64 nt, Human
guaauuagagcuugcuacguguuuauggaacugaaagcucaacaggggagcaauaaaccgagaa

SEQ ID NO: 55996 - RNA, 64 nt, Human
ugccuuucccuccagaaugcggccucagaccuagaagcucaaccccccuaugagggccacgucc

SEQ ID NO: 55997 - RNA, 64 nt, Human
aguguucggcccucagagaaggauccagaaucaaaagcucaagagugacgugaggugggcaccg

SEQ ID NO: 55998 - RNA, 64 nt, Human
uucaacccauguuuuacuuaaaauaucuuggcauaagcucaaaaaagccaggaucuuuauggaa

SEQ ID NO: 55999 - RNA, 64 nt, Human
gcauccgcgaaggcuuuuaaugggaggggcgucaaagcucaaaacuguuuuccucucuccuccc

SEQ ID NO: 56000 - RNA, 64 nt, Human
accauagcuuaaccccauccccacccucaaccccaagcucaacccauaaccucaaccacaucuu

SEQ ID NO: 56001 - RNA, 64 nt, Human
caucuucuccagcgcugggcccucccuugcccccaagcucaagaagggggcacugcccggcccg

SEQ ID NO: 56002 - RNA, 64 nt, Human
cucacauuuuucacugcucugugccuguccguauaagcucaaugaguauugauuuaggggcuuu

SEQ ID NO: 56003 - RNA, 64 nt, Human
cccuacaaacaggucccuaauacugauguggagaaagcucaagagggaaucaucuggccugagc

SEQ ID NO: 56004 - RNA, 64 nt, Human
guguaauaaacgcucuaucuaguuuaccuagcaaaagcucaaaacugcgcuaguauggacuuuu

SEQ ID NO: 56005 - RNA, 64 nt, Human
uaugacuuuuaaaguuuuauuuaaauaaauguugaagcucaaguuuaaagaagcguugcagagg

SEQ ID NO: 56006 - RNA, 64 nt, Human
ccucaauggcagccggaaggucccucugaggcagaagcucaagccccauggggacaguggcucc

SEQ ID NO: 56007 - RNA, 64 nt, Human
gguuuugaaugaauauuuugugaaucuuucuuaaaagcucaaauuuguagacuucuaaauagaa

SEQ ID NO: 56008 - RNA, 64 nt, Human
aaugcauucucuauagagccaaguccaaacuggcaagcucaaugaugcaggcaauaaaccgccu

SEQ ID NO: 56009 - RNA, 64 nt, Human
cccuggggaggaagcucaccaaaaguuuuucccaaagcucaaugcacuugagcucugaggggag

SEQ ID NO: 56010 - RNA, 64 nt, Human
uuguauaugcuaagauuuauuguuuccccuucuaaagcucaagaucauuucuuuccaguuuuug

SEQ ID NO: 56011 - RNA, 64 nt, Human
aacaucucuuuuccugguuccuuuuuuuuccucaaagcucaauuagaauagcaaaauuuauaag

SEQ ID NO: 56012 - RNA, 64 nt, Human
cgucuaccagaaggggauggacuucauuuuggagaagcucaaccauggggacugggugcauauc

SEQ ID NO: 56013 - RNA, 64 nt, Human
caaacaaacaaaaauugcucaaaaaagaggagaaaagcucaagaggaaaagcuaaggacuggua

SEQ ID NO: 56014 - RNA, 64 nt, Human
gucuuaucaaguuuucauucucugucaauaugacaagcucaaagugacagaauauguuauaggu

SEQ ID NO: 56015 - RNA, 64 nt, Human
auuguaaaacuacuacuuuguuuuaguuagaacaaagcucaaaacuacuuuaguuaacuugguc

SEQ ID NO: 56016 - RNA, 64 nt, Human
aauuggcuagcucuuugagcuagagagcuguaggaagcucaacauuucuuuguagagaacguug

SEQ ID NO: 56017 - RNA, 64 nt, Human
ucaguuccuuuucuguccuuccccuucuuaacacaagcucaaauuuucuaacuuguuuuuauuu

SEQ ID NO: 56018 - RNA, 64 nt, Human
aauuauuuuagguauuaagacugagaaauauuuaaagcucaagaagaacacagaagcacacauc

SEQ ID NO: 56019 - RNA, 64 nt, Human
aguggacaucaccuuuggcucugucaccuuguagaagcucaaguguggaaaagaaaagcuuaaa

SEQ ID NO: 56020 - RNA, 64 nt, Human
ccugcccgggucccagcacccuggaugcccgucucugucccaggcgggauggggcacagugcag

SEQ ID NO: 56021 - RNA, 64 nt, Human
ggagaggccuuccuuuacaaggccacgcgugcagcugucccauccagaccccgacuggccaaga

SEQ ID NO: 56022 - RNA, 64 nt, Human
agggcuaggcccugggaucgggaguuacacuacccugucccaagccgagggggccgguggaaug

SEQ ID NO: 56023 - RNA, 64 nt, Human
cccuucacaaacaccucucucuccccugcacuagcugucccaagcuuacauacagaggcccuuc

SEQ ID NO: 56024 - RNA, 64 nt, Human
uguaagggacgauuggaguuucuucccagagagucugucccagaaggacuguggcuugugugug

SEQ ID NO: 56025 - RNA, 64 nt, Human
ccccuucccacugugauuggcacaucgacaagggcugucccaagucaauggaaagggaaagggu

SEQ ID NO: 56026 - RNA, 64 nt, Human
agacacggucguguagaguagcagcugauuugaccugucccagauuuuaagugauauuccaaaa

SEQ ID NO: 56027 - RNA, 64 nt, Human
aaaacaguccucagaggauccaugauccccagcacugucccauccuccacaaaggcccacaggc

SEQ ID NO: 56028 - RNA, 64 nt, Human
ccucauacccacuuuugggauagggugcuggcagcugucccaagcaauggguaaugaugauggc

SEQ ID NO: 56029 - RNA, 64 nt, Human
gcuggcaggguuccucucaauccugcaaccccagcugucccaccgguggaugcagaggggaauc

SEQ ID NO: 56030 - RNA, 64 nt, Human
gagaaggcgggguauucccacucaccagcccuagcugucccauggggaaacccuggagccaucc

SEQ ID NO: 56031 - RNA, 64 nt, Human
uagcagcacauaggcucaggcuucuguaggcuuccugucccagagccaauuauggaaguaaggg

SEQ ID NO: 56032 - RNA, 64 nt, Human
caucuccggccagcaacccugucaguguuccacccugucccaggcccugugauauuuauugugg

SEQ ID NO: 56033 - RNA, 64 nt, Human
gacuuuauugggccucuucacuuccccuaaaccccugucccaugcaggcccuuugaagccucag

SEQ ID NO: 56034 - RNA, 64 nt, Human
gacuucauugucccucuucacucccccuaaaccccugucccaugcaggcccuuugaagccucag

SEQ ID NO: 56035 - RNA, 64 nt, Human; identical to SEQ ID NO: 56034

SEQ ID NO: 56036 - RNA, 64 nt, Human
gaucggcccacucugaacccccuggcucuccagccugucccagucucagcagggauguccucca

SEQ ID NO: 56037 - RNA, 64 nt, Human
ugaucagguggccuggcuguuucuuuggaucccucugucccagagccacccagaacccugacuc

SEQ ID NO: 56038 - RNA, 64 nt, Human
gagcaacccuuauggagaaacuugcaaccaggaccugucccagagugaugcuucuccugccccu

SEQ ID NO: 56039 - RNA, 64 nt, Human
ccccagcggcccaccccaugccucagcuucaugucugucccauuccuauaccauccccacccug

SEQ ID NO: 56040 - RNA, 64 nt, Human
ucccccaggugguuauggagaggguguccggucccugucccagugccgagaaggaagccuccca

SEQ ID NO: 56041 - RNA, 64 nt, Human
cuuaugucccucuucucccucuugcaugcuuuaccugucccacacccaugccaaugugccaagu

SEQ ID NO: 56042 - RNA, 64 nt, Human
aacacaguguuucaagagacccuaaaaaaccugccugucccaggacccuaugguaaugaacacc

SEQ ID NO: 56043 - RNA, 64 nt, Human
ucuugccagcucagcaguucacuuccuagagcaucugucccacugggacacaaccacuaauuug

SEQ ID NO: 56044 - RNA, 64 nt, Human
cuauuuggcuacuucccugucccucugacuccuacugucccaauuuucucccucccuguguguc

SEQ ID NO: 56045 - RNA, 64 nt, Human
gaaagaagagagguggggguggaggggaauuagucugucccagcuagagggagauaaagagggc

SEQ ID NO: 56046 - RNA, 64 nt, Human
ucuccuuuuuccuuccuugaagaaaaauucuuggcugucccaaggauucuucauguauauugca

SEQ ID NO: 56047 - RNA, 64 nt, Human
ucuguauguuuguguacacacacgugcccaucugcugucccagaggggagggguugugugugcg

SEQ ID NO: 56048 - RNA, 64 nt, Human
augaagaacauuuauuauuggguuacuacuaacccugucccaagaauaguaauaucaccucuag

SEQ ID NO: 56049 - RNA, 64 nt, Human
gcccagccccaguacacucuucucuggaccagaucugucccaguccuggaugccuccuccuacu

SEQ ID NO: 56050 - RNA, 64 nt, Human
uuccuccuccuuucuuugggaucccuggguugcccugucccaaccuccuuguuaggugcuuucc

SEQ ID NO: 56051 - RNA, 64 nt, Human
ccaguggggucucaguccaguccucacaugcccgcugucccaggggucucccugagccugcccc

SEQ ID NO: 56052 - RNA, 64 nt, Human
aaacuucugaagugcugucuuuuuacauuuuacucugucccaguuugaaacuuaaaacucuuag

SEQ ID NO: 56053 - RNA, 64 nt, Human
gccggugacucgggggaggaggcgacccugucaucugucccaccugcugcugccccuuggagca

SEQ ID NO: 56054 - RNA, 64 nt, Human
uuguccugccagcugccuuccucauccccucguccugucccagagguuaucugccuggccuggc

SEQ ID NO: 56055 - RNA, 64 nt, Human
cccuuccaaaaggcagaaauccauucaaacgugacugucccaaaugccuuaugucaaauaaagc

SEQ ID NO: 56056 - RNA, 64 nt, Human
agcugagcugccggucuuggcuuccuggucgccucugucccagagauggucccagggagccauc

SEQ ID NO: 56057 - RNA, 64 nt, Human
augcugaauaucuguucacuuuucaaucccaauucugucccaaucuuaccagaugcuacuggac

SEQ ID NO: 56058 - RNA, 64 nt, Human
acaggaggcgguggccauauuccaaaaaccacuucugucccauuucaccaggaugacuaaggca

SEQ ID NO: 56059 - RNA, 64 nt, Human
gagcgucugucuuuguauuucugcucuguucauucugucccacuuucuucauagacuccuuuuc

SEQ ID NO: 56060 - RNA, 64 nt, Human
aggggcuugucugaaaagccacucuggaccuagccugucccagaagaggagaaugcacaagugu

SEQ ID NO: 56061 - RNA, 64 nt, Human
cuuggccuccuucaugagagucuagugccauguccugucccaugaucuggacccugggacuguc

SEQ ID NO: 56062 - RNA, 64 nt, Human
aaggcaugcaugcgucacugguaguaggaggagccugucccagcuucaucuuguccugagauuu

SEQ ID NO: 56063 - RNA, 64 nt, Human
caggguuccgugacuccagugggccagugguagccugucccagacaacuccgucaccccagcuc

SEQ ID NO: 56064 - RNA, 64 nt, Human
uuugcuucuaggauauacacuuuaaaagaacucacugucccagugguggucauugauggccuuu

SEQ ID NO: 56065 - RNA, 64 nt, Human
gaaaaugcugaacaccauuguauaguuucuucaacugucccagccauguuguacauagauaugu

SEQ ID NO: 56066 - RNA, 64 nt, Human
gggaucagguuggggggcagcccccagucccuuucugucccagcucaguuuuccaaaagacacu

SEQ ID NO: 56067 - RNA, 64 nt, Human
uugagccuggggcagagcagcuccuccccaacuucugucccagccuugaaggcugaggcacuuc

SEQ ID NO: 56068 - RNA, 64 nt, Human
gcugccaaccugauccugccugggcaacccuuuccugucccaggcccuacauucagcagaaacg

SEQ ID NO: 56069 - RNA, 64 nt, Human
gcauuaacagaccucccuacagcuguaggaacuacugucccagagcugaggcaaggggauuucu

SEQ ID NO: 56070 - RNA, 64 nt, Human
guggaaaagaaaguacagaacaaacccugugucacugucccaaguugcuaagugaacagaacua

SEQ ID NO: 56071 - RNA, 64 nt, Human
aaauugaaguuucagagcuacacaaacacuuuuucugucccaaccguucccucacagcaaagca

SEQ ID NO: 56072 - RNA, 64 nt, Human
aauuguccacauacguggaaacaauccuguuacucugucccacguccaaucaugggccacaagg

SEQ ID NO: 56073 - RNA, 64 nt, Human
guacaaucucaaauucucaaccuaccaccccuuccugucccaccucuucucuuccuguaacaca

SEQ ID NO: 56074 - RNA, 64 nt, Human
cuacuuucaaagcaaagaucagcagaaaaauuggcugucccaccuguggcaaaugcuggagccu

SEQ ID NO: 56075 - RNA, 64 nt, Human
cuggcaaggcccuguugacuagcaauggccuuagcugucccacacaacucaguggccugaacac

SEQ ID NO: 56076 - RNA, 64 nt, Human
ccuaucauugggcuugucacacucuauugcucuucugucccaaagaugcagucuucucuccaau

SEQ ID NO: 56077 - RNA, 64 nt, Human
cucagacccuuccccgugcucagacagugcaccgcugucccaucuaaagaaaccugucaggaau

SEQ ID NO: 56078 - RNA, 64 nt, Human
agccuuacccuggcaucuuucuuuuaaauuauaucugucccaggugcucuccacacauaggaug

SEQ ID NO: 56079 - RNA, 64 nt, Human
gaccagggcaggaugccaccugcuacacucuugccugucccagagcccuugggagaccagcugu

SEQ ID NO: 56080 - RNA, 64 nt, Human
aucuguucagaccaagcaaugcgagcuuccucuccugucccauguuggaaguugcucugaaggg

SEQ ID NO: 56081 - RNA, 64 nt, Human
uaauccugucccucccuaagucacagcgaggugucugucccagggcuggagaugcuucccaagg

SEQ ID NO: 56082 - RNA, 64 nt, Human
guuuuagcugccaccgcuucaguaugagauauagcugucccaucuucccccauucaggguagga

SEQ ID NO: 56083 - RNA, 64 nt, Human
cauuccaccuggcagcugaaggcagccagucagucugucccagaaagggcccuuuucagcaccc

SEQ ID NO: 56084 - RNA, 64 nt, Human
ggaaagaaaagaucauugaaagucaugauaauuucugucccacugugucucauuauagaguucu

SEQ ID NO: 56085 - RNA, 64 nt, Human
cucucucucuagcuuuccacaaauccuaaaauuccugucccaagccacccaaauucucagaucu

SEQ ID NO: 56086 - RNA, 64 nt, Human
gucuuguucuguaaaggaccagagaugguaaauacugucccacucagcucugcuggcgcaguac

SEQ ID NO: 56087 - RNA, 64 nt, Human
cucgggccugcugcgcagacguccaucacguuagcugucccacaucacaagacuaugccauugg

SEQ ID NO: 56088 - RNA, 64 nt, Human
ccugccgaggcugacuuccuacuuggucuggccacugucccaggcuauguauccuuucggcaug

SEQ ID NO: 56089 - RNA, 64 nt, Human
uuguccuuuccuugaaguuuugcaguagggucuccugucccaggggguugaggaaaaaaaacac

SEQ ID NO: 56090 - RNA, 64 nt, Human
ucauguagaauaguguuugucaacugucuuuucucugucccagcacaugccguacucuuauaug

SEQ ID NO: 56091 - RNA, 64 nt, Human
gagccagguagaugcagcgguagcaucugagcuccugucccagcuccaggaaggggaguucugg

SEQ ID NO: 56092 - RNA, 64 nt, Human
ugcccacuggcacacagcuggcacuggcacacaccugucccaugcccacccugagggaucagga

SEQ ID NO: 56093 - RNA, 64 nt, Human
cuggcccccaugauucaauuaccucccccugggucugucccacaacacgugggaauucugggag

SEQ ID NO: 56094 - RNA, 64 nt, Human
uucuguuuuagguuaaaaaaaggcauuguuugagcugucccaucuccacuguuaucccuuuggg

SEQ ID NO: 56095 - RNA, 64 nt, Human
aaaacagaacuugggcuuccuggcagugaggccacugucccaucacagauuuuuaaaauaaaua

SEQ ID NO: 56096 - RNA, 64 nt, Human
cugacucucuuaaggaggcugagagcccaaacugcugucccaaacaugcacuuccuugcuuaag

SEQ ID NO: 56097 - RNA, 64 nt, Human
gaccucugaucauuaaaaccuauaaaggguugagcugucccaaguuuucugucuuucuguaaug

SEQ ID NO: 56098 - RNA, 64 nt, Human
aacacaggcuucagcacuuccuuugguguguuuccugucccagugaaguuggaaccaaauaaug

SEQ ID NO: 56099 - RNA, 64 nt, Human
uuaucacaaagaagaacgugcauucaggcagaugcugucccauucagaggaagcuacagcaguu

SEQ ID NO: 56100 - RNA, 64 nt, Human
ugcuuccugucccugaaugccuuuuugugccagacugucccaagaauccuaauuuguauuccau

SEQ ID NO: 56101 - RNA, 64 nt, Human
agaggauggauaacacaguuaucucuguaauguucugucccaguaugucuuugggucaccaguu

SEQ ID NO: 56102 - RNA, 64 nt, Human
gagagagggaagaggggcguuuucgaggaagaaccugucccaggucuucuccaaggggcccagc

SEQ ID NO: 56103 - RNA, 64 nt, Human
cucccucaauccuugucugguacuagauuugcuccugucccaccccgcaguccccugaggaggg

SEQ ID NO: 56104 - RNA, 64 nt, Human
cugcugcacugcaugcugggacugcuccuacucucugucccaccccucacccagcugugguccg

SEQ ID NO: 56105 - RNA, 64 nt, Human
accccacugguucugaggccccuacccucccaggcugucccacgugaugcugacaugagccuca

SEQ ID NO: 56106 - RNA, 64 nt, Human
uuugaucuguugucacgugucuguggggagggcccugucccauccugaauaagauacuuauguu

SEQ ID NO: 56107 - RNA, 64 nt, Human
uuaaaaauauugucuuagcaauuuucaaucaagccugucccauggagacacaagcaauagugac

SEQ ID NO: 56108 - RNA, 64 nt, Human
ugguauuccucuaauuguguucccuaggaaaugacugucccaagagccagugauuauuccaggu

SEQ ID NO: 56109 - RNA, 64 nt, Human
aauggauuucacagagccuugugucccuaaaguucugucccagucagcagucuuuauaguccaa

SEQ ID NO: 56110 - RNA, 64 nt, Human
ugccacgcccccagaaagaggaaucaggcaaguacugucccaaggcagcuggagggugagggcu

SEQ ID NO: 56111 - RNA, 64 nt, Human
cuacacacucgaaaaagagaaaccagcugcgguacugucccauuuuugucaucagcaccagugu

SEQ ID NO: 56112 - RNA, 64 nt, Human
aacuuguaugcuaggcacuuuuguccagagccugcugucccauggagaaaaaguuuuaagcacu

SEQ ID NO: 56113 - RNA, 64 nt, Human
uuuuagcagaacauccguccguccaucugcaucucugucccaugacucaggggcgcccacucug

SEQ ID NO: 56114 - RNA, 64 nt, Human
gcaaaaaauccaaguaacaccuucugaguagcugcugucccacacaauaggguaugaagcugcg

SEQ ID NO: 56115 - RNA, 64 nt, Human
ugucuggguggauggggcaggaggggcugagggccugucccagacaauaaaggugcccucagcg

SEQ ID NO: 56116 - RNA, 64 nt, Human
gaagguccguggccauucacuucaauuuugaccucugucccauagugaagaacauuuaaaguaa

SEQ ID NO: 56117 - RNA, 64 nt, Human
uguggggcuugaacauugcuccugugaugaucaucugucccaggucacacuccuucauuugacc

SEQ ID NO: 56118 - RNA, 64 nt, Human
caucugaguccucugccuaaagcauuccucagaacugucccauuugaagggcaagcaaaccugg

SEQ ID NO: 56119 - RNA, 64 nt, Human
ggggagaagaagaguccagccaccaucuuccugacugucccagguccccacucuccagggccca

SEQ ID NO: 56120 - RNA, 64 nt, Human
acuugauuucuucuagaagauaacauuuucaauacugucccacuucucaucuuaaaaauauugu

SEQ ID NO: 56121 - RNA, 64 nt, Human
guucccuuugaguccagugugggacacgguuuaacugucccagcgacauuucuccaaguggaaa

SEQ ID NO: 56122 - RNA, 64 nt, Human
agcagcuguucauggcacugaagaugucccuucacugucccaaaacuggcacuagaaguggcug

SEQ ID NO: 56123 - RNA, 64 nt, Human
cagacucuagggagaggaaauccugugggccuuucugucccaccccugucagcacugugcuacu

SEQ ID NO: 56124 - RNA, 64 nt, Human
acagggcucaggcugccggagcuccaaccaaacucugucccacuucacgcacggacuguccugg

SEQ ID NO: 56125 - RNA, 64 nt, Human
ucccugcugccacuuuuccaguccuggaacuacucugucccacucuugcucuauucaguuuaca

SEQ ID NO: 56126 - RNA, 64 nt, Human
gugccaaaugcuggggcagggggugaagaacccucugucccaccccuagccaccaguguccucc

SEQ ID NO: 56127 - RNA, 64 nt, Human
ugagagauuucuuauugaggccaagagauguuuccugucccagaggaaccauuaggagucgcuu

SEQ ID NO: 56128 - RNA, 62 nt, Human
ggaaggugaaaaugaaguagcugugagaauaccugucccagcuaucaaugagcacaacauuu

SEQ ID NO: 56129 - RNA, 64 nt, Human
uauuuguuugaaccuuauccugugaaagcauuaucugucccaaacaguauaugccuuuuaucag

SEQ ID NO: 56130 - RNA, 64 nt, Human
cuagaugcagugcugggaccuuccucuuuuggagcugucccauguacaguggacccaagcucag

SEQ ID NO: 56131 - RNA, 64 nt, Human
uucuaacaaggacuuggagacuugguggucugagcugucccaaguccuccgguucuuccucggg

SEQ ID NO: 56132 - RNA, 64 nt, Human
cuuucugugagaagggauuuccccucaacaacuucugucccauuuuucagagcuaaagugacaa

SEQ ID NO: 56133 - RNA, 64 nt, Human
ugugggccacaguaggaggggccagcaguccucccugucccaugccugcuggcucugaccguuu

SEQ ID NO: 56134 - RNA, 64 nt, Human
uauuucuacagugauucuacuucugaggagucuucugucccaggaagagauaccuucuuuacag

SEQ ID NO: 56135 - RNA, 64 nt, Human
gcaaacacuagugcacuuuguagcuuuucacccucugucccagggaaucuaggagagaugaggc

SEQ ID NO: 56136 - RNA, 64 nt, Human
uaauguuuccucccuccuuuccuguccucccuuucugucccauuaccuucagaagcucucuguu

SEQ ID NO: 56137 - RNA, 64 nt, Human
gugcagaguccuuggacaggagucgggggcuccucugucccacugcugcuucuugagugggugg

SEQ ID NO: 56138 - RNA, 64 nt, Human
acgaagggacucuguugccccacacuaacuugcccugucccaaucccagaaacccaggaccaag

SEQ ID NO: 56139 - RNA, 64 nt, Human
agacuuguacuuucaacuguccauuucucccugucugucccaugggcacucaugaaaaaacaga

SEQ ID NO: 56140 - RNA, 64 nt, Human
uagaacacacaucuuuuauuuaaauccaucugaacugucccaaaauguaauuugcaaagagcuu

SEQ ID NO: 56141 - RNA, 64 nt, Human
uuuuuuuuuuuuuuuuuugagauggagucuugcucugucccacccagucuggagugcaauggug

SEQ ID NO: 56142 - RNA, 64 nt, Human
cacaaguaaaaauggcuuuuuauuuagauucuuucugucccaggcuguugaucuuaaaacuagu

SEQ ID NO: 56143 - RNA, 64 nt, Human
ugaaaaagaaaugacaauauggaacaucccaaggcugucccauaggguuggaaguuguguagca

SEQ ID NO: 56144 - RNA, 64 nt, Human
gaaaauguuaccaguuuuuuuaucugaaguuuaacugucccauuguaaagguguaaguuauaua

SEQ ID NO: 56145 - RNA, 64 nt, Human
cggcggccggagugacuuucucgcacccccuugccugucccaccucgcugaacaccaucccgcc

SEQ ID NO: 56146 - RNA, 64 nt, Human
gagaccauggucuguagaccccuucccgauucuccugucccagcuuggaaggcauugaaaacag

SEQ ID NO: 56147 - RNA, 64 nt, Human
acuuccauaccugcugcuggacuguaccagacgucugucccaguaaagugauguccagcugaca

SEQ ID NO: 56148 - RNA, 64 nt, Human
agcaaagccauauucuaaauucacuguugaaugccugucccaguccaaauugucugucugcucu

SEQ ID NO: 56149 - RNA, 64 nt, Human
augcccaugugcccugagagcugccucucaaucccugucccaagccacagcuauggcauuaaug

SEQ ID NO: 56150 - RNA, 64 nt, Human
guuauugcagacagacguggcucugggccccucucugucccaccuugcacaaaggacccccuca

SEQ ID NO: 56151 - RNA, 64 nt, Human
uccucccggggcuucaaggggugacugcuguaggcugucccagugcgaggccgggagcgaaugg

SEQ ID NO: 56152 - RNA, 63 nt, Human
ugggcguacuggccuccuaacucacccccuucccugucccaggcccugcccugguccccccac

SEQ ID NO: 56153 - RNA, 64 nt, Human
gcggccgaccacauuugauguuugaaguuguaaucugucccaucauaaacuuaccuggagcuca

SEQ ID NO: 56154 - RNA, 64 nt, Human
agcuucugccaggcaccucagagcaccagcuccccugucccagggccuaaccacagauccugga

SEQ ID NO: 56155 - RNA, 64 nt, Human
gaacugggagugaggcucagagaaguugagggaccugucccagcaucacauggcugaugacaag

SEQ ID NO: 56156 - RNA, 64 nt, Human
ccuggggauguuguuccaaauccagacaacuggacugucccagacuugcagcaucagagucucc

SEQ ID NO: 56157 - RNA, 64 nt, Human
cuggccagcuauuguucuuccacuucguuuucugcugucccaaggccagaugaguggaaucacc

SEQ ID NO: 56158 - RNA, 50 nt, Human
aagccaagaagcuuguguagcugucccaggcgucacaacccauccuccca

SEQ ID NO: 56159 - RNA, 64 nt, Human
uguaccaaauuuaacuuggcaaacuuucuauugccugucccaugugcaucuuauuuaaaauuuc

SEQ ID NO: 56160 - RNA, 64 nt, Human
cuucacauggaaauaauaaagcucuuuauaugagcugucccaccagcaacuuauauauguaaac

SEQ ID NO: 56161 - RNA, 64 nt, Human
uauuaagggaccuugguuuucuucuagauagcagcugucccaaagaaaauauuucuucuuuguc

SEQ ID NO: 56162 - RNA, 64 nt, Human
gaauaagcaucugauuuuaugacugagccuuuuccugucccaagaggucuuuaacaauauuuuc

SEQ ID NO: 56163 - RNA, 64 nt, Human
cacuaggcacgccagccagaccaauaaaaagcgucugucccacucugcuaagccugguuuucuu

SEQ ID NO: 56164 - RNA, 64 nt, Human
gaaaccagaggccugggugauguuaaagucuauccugucccacuuccuacauucugggacuacc

SEQ ID NO: 56165 - RNA, 64 nt, Human
ugcgugcagugucuugccuugcuuucucuucuuacugucccacagcuugguuucauguuacaaa

SEQ ID NO: 56166 - RNA, 64 nt, Human
cugucaccuugaagcauccuguucuccuucugugcugucccaggaagugucuggcgggcguggg

SEQ ID NO: 56167 - RNA, 64 nt, Human
gcaagaggagacauuuccucccugccccagcacucugucccaauccgagaaguuccgaggcuuu

SEQ ID NO: 56168 - RNA, 64 nt, Human
ugcauucacuccugcggagaccuaggaacuuuuucugucccacgcgcguuuguucuugcgcacg

SEQ ID NO: 56169 - RNA, 64 nt, Human
caagaccaucaccaccuuucaucugauuccagaccugucccaacagcagggaugcuacauggga

SEQ ID NO: 56170 - RNA, 64 nt, Human
gcccaauauccugguuggggaccgugagaaauaucugucccauuuagaucucuggggccacuga

SEQ ID NO: 56171 - RNA, 64 nt, Human
ugaaggcuguacacugcacgaauggaagaggcaccugucccagaaaaagcaucauggcuaucug

SEQ ID NO: 56172 - RNA, 64 nt, Human
uucaaucucccuccaagcucuacucuggaggagucugucccacucugucaaguggaauccuucc

SEQ ID NO: 56173 - RNA, 64 nt, Human
ccugccuaggaauucccagcccaaagcuguuggucugucccaccagcuagguggggccuagauc

SEQ ID NO: 56174 - RNA, 64 nt, Human
cauucgggugggagacuucagaugggcucaguaccugucccagccacaggcuucuuguccaccu

SEQ ID NO: 56175 - RNA, 64 nt, Human
aguacccucucagcuccagguggcucugaggugccugucccacccccacccccagcucaaugga

SEQ ID NO: 56176 - RNA, 64 nt, Human
uuugucaccucucuuucuucccuauccugcccugcugucccaauccuagcuuuucuauauacca

SEQ ID NO: 56177 - RNA, 64 nt, Human
uuugugccacacgcaugggcauugcagccuugcgcugucccaggcaugcagcugccuggggccc

SEQ ID NO: 56178 - RNA, 64 nt, Human
uccccaugggcucccacugcagccucgagugccccugucccaccuggcucccccugcugguguc

SEQ ID NO: 56179 - RNA, 64 nt, Human
ugcaaccucugccuccuggauucaagcgauucuccugucccagccucccagguagcugggacua

SEQ ID NO: 56180 - RNA, 64 nt, Human
ccccuuugaccuugagcagucuccaucugcggcccugucccauggcuuaaccgccuauugguau

SEQ ID NO: 56181 - RNA, 64 nt, Human
aaaagccagaugugggggaaaaguaacaucaacacugucccauccucagcccugaacuagcuac

SEQ ID NO: 56182 - RNA, 64 nt, Human
ccccugcccagaauuccuagcugccugugucacccugucccacugaggucagaguccuacagug

SEQ ID NO: 56183 - RNA, 64 nt, Human
uuccuggagauaaccauaguugcuauuuugcugccugucccaucagucguuuaucuguuguuug

SEQ ID NO: 56184 - RNA, 64 nt, Human
auaagccccgggcggggacuuguucccggucagccugucccaggacagcccacuccagaggcac

SEQ ID NO: 56185 - RNA, 64 nt, Human
acuuccaucgcgucugucggguauuguuccuuaacugucccaucugugcagaguccauugcccc

SEQ ID NO: 56186 - RNA, 64 nt, Human
aggacgaacaggugggacuuugcgagcucugugacugucccacguccaggagacaaggaaggua

SEQ ID NO: 56187 - RNA, 64 nt, Human
gcccacucacaagcccuuggccacaacuauacuccugucccaccccaccacgauggccuggucc

SEQ ID NO: 56188 - RNA, 64 nt, Human
acccucauucucaugccuguagguuuccauugcucugucccaggacacuugcgugccagagacg

SEQ ID NO: 56189 - RNA, 64 nt, Human
uucugcucauggaagucuuaaacagaaacuguuacugucccaaaguacuuuacuauuacguucg

SEQ ID NO: 56190 - RNA, 64 nt, Human
caucugaagauugagcacuggucacccugacacgcugucccaccuacagauccucaucuugcuu

SEQ ID NO: 56191 - RNA, 64 nt, Human
ccagcaucccuugcucacaccugcaguagcggugcugucccagguggcuuacagaugaacccaa

SEQ ID NO: 56192 - RNA, 64 nt, Human
uuugccugaggugcuggguagcccauccuuuccucugucccagauucaaaugaggaguaagagc

SEQ ID NO: 56193 - RNA, 64 nt, Human
accggcuucccccauccccacagcaaaacacggccugucccaagccagugaggagcuaaagaca

SEQ ID NO: 56194 - RNA, 64 nt, Human
uuauuuuuguuuuuaaaaauauuucuuaaacaugcugucccaacauuugugaguugugucacaa

SEQ ID NO: 56195 - RNA, 64 nt, Human
agaguggccuuggccuguugucuuccccuauuuucugucccagcucauccgugucucugaagaa

SEQ ID NO: 56196 - RNA, 64 nt, Human
uuucaaauauuuacaguacuugucuucaccaacacugucccaaggugaaaugaagcaacagaga

SEQ ID NO: 56197 - RNA, 64 nt, Human
cagcccugcccuguggggugcccccgaugggaggcugucccaucucccaguccccaucucuuuu

SEQ ID NO: 56198 - RNA, 64 nt, Human
caggggaagcaaagaccucuucccucugccguuucugucccacuuaacugaccucacuggaggc

SEQ ID NO: 56199 - RNA, 64 nt, Human
aaccccgucgaggggcucucagcucagcgccagccugucccauggacacuccagugccagcaau

SEQ ID NO: 56200 - RNA, 64 nt, Human
agggaaaagguguucagggcacuucuuguccucucugucccauaaccuaccuccacccuccccc

SEQ ID NO: 56201 - RNA, 64 nt, Human
uuauuguacuguauuauaauuguugaaaacuugucugucccauuuagaaugugagcuccuugag

SEQ ID NO: 56202 - RNA, 64 nt, Human
ugggauuggugaagaaacugcauugucaauuucacugucccaaaaaagccaaauuguggcagga

SEQ ID NO: 56203 - RNA, 64 nt, Human
auuccuuuaugaugacugcuuaacuccccacugccugucccagagaggcuuuccaauguagcuc

SEQ ID NO: 56204 - RNA, 64 nt, Human
gugggcgucaacaucccaguuuuguucuaucuuucugucccaccugcacugggauguggcuucu

SEQ ID NO: 56205 - RNA, 64 nt, Human
ggaaaauaacauuaaacaccaaauauaagccucgcugucccacaugcguauuggggacaagaug

SEQ ID NO: 56206 - RNA, 64 nt, Human
uucuucccauugagguccuaggauuugcacaccacugucccacaagagcuuuccugccuaauga

SEQ ID NO: 56207 - RNA, 64 nt, Human
gaggaggaauuucugcauggggcgugaaggcacacugucccaccacaacugaaccagaagagag

SEQ ID NO: 56208 - RNA, 64 nt, Human
gaagaaccacugucuagagcaacuuuucuuggaacugucccagcuaccaagucagacaccaagg

SEQ ID NO: 56209 - RNA, 64 nt, Human
auucaaggcucagaaggaauggugcguggcuucccugucccaguuguggcaacuaaaccaaucg

SEQ ID NO: 56210 - RNA, 64 nt, Human
uuaaaaaacaaaaauuucuaauggauuuaucaaacugucccaaauccugauaaauauuaacauc

SEQ ID NO: 56211 - RNA, 64 nt, Human
gugugacucccuugccagcuccagagugggggggcugucccagggggcaagaaggggugucagg

SEQ ID NO: 56212 - RNA, 64 nt, Human
uuguauuuuucugugauugugagaacucccguuccugucccacauuguuuaacuuguauaagac

SEQ ID NO: 56213 - RNA, 64 nt, Human
caagagacccgagaacuccagauucacgacauuccugucccauguagaagcauuuccauucaac

SEQ ID NO: 56214 - RNA, 64 nt, Human
cugcuggcugggcuuccuguuuccagaugcauuccugucccagagucaccacagagacuguuug

SEQ ID NO: 56215 - RNA, 64 nt, Human
gcuaccuugccaggacaagaaccaagaacucuaacugucccaggaaucuugugaauuuucaccc

SEQ ID NO: 56216 - RNA, 64 nt, Human
agacccccaggcucgacuucaggggucaguguuccugucccaaaccccacacagaauacucugc

SEQ ID NO: 56217 - RNA, 64 nt, Human
auuguugguggcggucaccauuccuggaaagggacugucccaagccacuuaccuucccgaggag

SEQ ID NO: 56218 - RNA, 64 nt, Human
uugagccaagaggugagggugcacgucuucccuccugucccagcuccccagccuggcguagagc

SEQ ID NO: 56219 - RNA, 64 nt, Human
agaggagugcagccuucuccauaucuccauggcccugucccaggccggcccagauguguccccc

SEQ ID NO: 56220 - RNA, 64 nt, Human
gagccgcggggaagcuggcuuugaaaccucagggcugucccagccccggcaagccacaggaagg

SEQ ID NO: 56221 - RNA, 64 nt, Human
acugguaccucgggaacgcaagcugucaguggaacugucccacaagaauucacaggucucaaag

SEQ ID NO: 56222 - RNA, 64 nt, Human
caucagauuguuaagggcauuuuuauacucagaacugucccauccccagguccccaaacuuaug

SEQ ID NO: 56223 - RNA, 64 nt, Human
ugaaggcgccaacagaguagucuccauggugggccugucccagcccuggcugcgaggacagguu

SEQ ID NO: 56224 - RNA, 64 nt, Human
aagccaaacauucuuauuuuagacaaccauagaacugucccacaaaauauuucuaagcuuauuu

SEQ ID NO: 56225 - RNA, 64 nt, Human
uaaaauuuacacaguagaccauuugucauccaugcugucccacaaauaguuuuuuguuuacgau

SEQ ID NO: 56226 - RNA, 64 nt, Human
cuguguucagggaccuuuggaaauaaaaccuguucugucccaaauaaaaccagccugugauguu

SEQ ID NO: 56227 - RNA, 64 nt, Human
acagucagcuuuagcucucaagagucguauguaacugucccagacuccucugucaguuucagca

SEQ ID NO: 56228 - RNA, 64 nt, Human
uagccagaucaacucccccacccgucuucuuccucugucccagaauggaaaaugauguaugguc

SEQ ID NO: 56229 - RNA, 64 nt, Human
ugacucuggaaccauccucuguuacccgcagauccugucccaugggcucuggccccaagauguu

SEQ ID NO: 56230 - RNA, 64 nt, Human
uucugaggaaaguccuguggggagauucugaccacugucccauaggauucugauuuuaggaugu

SEQ ID NO: 56231 - RNA, 64 nt, Human
cagaccacgagaagugaccuucagggucaucaggcugucccagagagguccgcguucuccccac

SEQ ID NO: 56232 - RNA, 64 nt, Human
ugaaaaucaagaccugaggggcuggccucagucucugucccaucgcuugaauacaguacuccua

SEQ ID NO: 56233 - RNA, 64 nt, Human
cucccugugcucaguauuaauuacgcccccuuaacugucccagugaccuuguccagaccuccac

SEQ ID NO: 56234 - RNA, 64 nt, Human
ggauggaacaugcccacaacuugucacccaaagccugucccaggacucacccuccacaaagcaa

SEQ ID NO: 56235 - RNA, 64 nt, Human
aauggacgucuuuucucaaguugcuaagagugaucugucccagaaaagcggcccugcaaguuug

SEQ ID NO: 56236 - RNA, 64 nt, Human
guuucaagagaugaaccuaaaugagauaggaagccugucccauagcagccuuccucucacuacu

SEQ ID NO: 56237 - RNA, 64 nt, Human
ccucaccugcccccuggcccuugcugccuucauucugucccaaugccagcucccuggaugucug

SEQ ID NO: 56238 - RNA, 64 nt, Human
cgcagaggcccugaggccucacuuuucggaucuucugucccagauccugcucccucccugcuga

SEQ ID NO: 56239 - RNA, 64 nt, Human
ggagcaggguggcugagggcacaggugccugggucugucccacggggcagggcuuuggggcugu

SEQ ID NO: 56240 - RNA, 64 nt, Human
gugguccaaaagguccugccgccuccgcaucugacugucccaacggcaugcuggugacaccccc

SEQ ID NO: 56241 - RNA, 64 nt, Human
acgauggacuccaaaugccucaaguuauguauaccugucccagauguaaacuucauuguccuuu

SEQ ID NO: 56242 - RNA, 63 nt, Human
cuagcagaagacaaggcauguagggggagccauucugucccagggaaguuguggaggguaggg

SEQ ID NO: 56243 - RNA, 64 nt, Human
caaucacuccccacucuccugggauaaugggguccugucccaaggagcugggaacuugguguug

SEQ ID NO: 56244 - RNA, 64 nt, Human
ugcucugccgccccucuuccuggacccucaguggcugucccauggcuacauccugugggugggg

SEQ ID NO: 56245 - RNA, 64 nt, Human
aucccuggggauguggcuggagcaugagccagcucugucccaggauggucccagcggaugcugc

SEQ ID NO: 56246 - RNA, 64 nt, Human
ggggagcccccaaggugcugucugucuagacaggcugucccaccccaggguggcuaguggccau

SEQ ID NO: 56247 - RNA, 64 nt, Human
cuccaggacacccucugaguccuugacgcuggcucugucccaggaucuccacagaccucggccu

SEQ ID NO: 56248 - RNA, 64 nt, Human
uggccuucaggagccuagguuugaacagcagaugcugucccaggaagggcuagggacaucggag

SEQ ID NO: 56249 - RNA, 64 nt, Human
ccugcggcuuaggcuucaucugcuugcacauugccugucccagagccccuguggguccacaagc

SEQ ID NO: 56250 - RNA, 64 nt, Human
ccgcggcgccuccgcccaaaucaauaaacugugucugucccaggaggccgagucucuuuacugg

SEQ ID NO: 56251 - RNA, 64 nt, Human
cggaaagguggccccagcuguugacuuccagucacugucccagacggcacaagguuuucuguag

SEQ ID NO: 56252 - RNA, 64 nt, Human
ccugugcucaguuuggcagcuauagaaggaaaugcugucccauaaaaugccauuccuauuuucu

SEQ ID NO: 56253 - RNA, 64 nt, Human
gaaaggugaggcccaaaggagagaggccuucaaacugucccagguccugcgcagcucagugcgu

SEQ ID NO: 56254 - RNA, 64 nt, Human
gccagccggacugcccucgccuuccgggugugcccugucccagaagauggaauggggguguggg

SEQ ID NO: 56255 - RNA, 64 nt, Human
cucccagaacaaaugcucuuccaagccagccuaucugucccaggcugggccacugccucccuaa

SEQ ID NO: 56256 - RNA, 64 nt, Human
uucagggccugggucuccagcucuguaaccaguccugucccauuuccucagucccugggccucc

SEQ ID NO: 56257 - RNA, 64 nt, Human
gugcuggccuugcaguggguguguggggaagucacugucccacuaugggucuccacuacccagu

SEQ ID NO: 56258 - RNA, 64 nt, Human
caguagggcuccaggggccaucacugcccccgcccugucccaaggcccaggcuguugggacugg

SEQ ID NO: 56259 - RNA, 64 nt, Human
uuaacuuggaaaaaaauuuuagccuuaucuuaaucugucccaacagcaaugugacggauuuuug

SEQ ID NO: 56260 - RNA, 64 nt, Human
cagggacagggugccucgccaagcugucugaggucugucccagguggcccagguggugcaggua

SEQ ID NO: 56261 - RNA, 64 nt, Human
gugugcucaacugccaguaauuuuuuaaaaagcacugucccaguggauugauguuguuuuuaau

SEQ ID NO: 56262 - RNA, 64 nt, Human
gggguacagccccucucuuccaaccgagaaguuccugucccagaauggacccagggacaagaga

SEQ ID NO: 56263 - RNA, 64 nt, Human
cccucagagccccagcgcgccccuggcccugguucugucccagcugauggauggcuucuccaug

SEQ ID NO: 56264 - RNA, 64 nt, Human
gaauuucucccuccuuccuuuuuuuuuccugccacugucccaacucuuucccucuacgucucuc

SEQ ID NO: 56265 - RNA, 64 nt, Human
gcacagcuaaaauugcagcauuuccccagcugggcugucccaaauguuaccauuugagaugcuc

SEQ ID NO: 56266 - RNA, 64 nt, Human
uccagggcacgguggcaggaacaacuauccucgucugucccaacacugagcaggcacucgguaa

SEQ ID NO: 56267 - RNA, 64 nt, Human
ccaagaagugaccagugcugcauuucaguucuggcugucccacagcuccaggaguugugucccc

SEQ ID NO: 56268 - RNA, 64 nt, Human
aagccccccuccccauacaccccaagccugagcccugucccaucccccuccccggguuccuuca

SEQ ID NO: 56269 - RNA, 64 nt, Human
cagcuccaccucugggguucagcuucugucucugcugucccaguuuugagguuugguuucuugu

SEQ ID NO: 56270 - RNA, 64 nt, Human
uagaaacaaauaucaaggaugagaauggcacuggcugucccauaugguauccaggagccaccaa

SEQ ID NO: 56271 - RNA, 64 nt, Human
gggaggacugggggcuguuaccuaaugguccucucugucccauuauaggugcaaggcaccccau

SEQ ID NO: 56272 - RNA, 64 nt, Human
uugugcuguuccacucuuggcuccagcagacccacugucccagaaaagccugauccuguaguuu

SEQ ID NO: 56273 - RNA, 64 nt, Human
accucaggcggggaggaggagcugccgcaaggcccugucccagcagaagagggaggcuuccuga

SEQ ID NO: 56274 - RNA, 64 nt, Human
gccuccagagacugcuccagaguuggugacacagcugucccaagggccccucuguaucuagccu

SEQ ID NO: 56275 - RNA, 64 nt, Human
cggugggcgcuggggggguaggguagcacaccagcugucccaggcuuugcuccgggcgguaacu

SEQ ID NO: 56276 - RNA, 64 nt, Human
uagcgacacucgggaccuguggaccacgaccacgcugucccaggcacagcugaacaugccgcug

SEQ ID NO: 56277 - RNA, 64 nt, Human
ucaggauguucucggucacccuccugguucugcccugucccauuccaccccaccccagggggaa

SEQ ID NO: 56278 - RNA, 64 nt, Human
ccugagaagccaugucccucgugcugucucuugccugucccaccugugcccugcccuccagcuu

SEQ ID NO: 56279 - RNA, 64 nt, Human
cucucgcaggccccagcuggcugucacuguaaagcugucccacagcggucgggccugggccguu

SEQ ID NO: 56280 - RNA, 64 nt, Human
caccagccagcguagcagggucgggaaaggccaccugucccacuccuacgauacgcuacuauaa

SEQ ID NO: 56281 - RNA, 64 nt, Human
ucaggucggcccuguggcggguaggcaggaaggacugucccagacgaggggcuuccucuagagu

SEQ ID NO: 56282 - RNA, 64 nt, Human
auuuaggcuucaguuccacucccaggaacuuugccugucccacgagggaguaugggagagaggg

SEQ ID NO: 56283 - RNA, 64 nt, Human
ugguucucaccaaagccccuagcuagaggcagggcugucccacagaaauagugugagccacaua

SEQ ID NO: 56284 - RNA, 64 nt, Human
uuccuccuggaccccauccucuaccauccaagcccugucccacuuuggcccuauccucuccauu

SEQ ID NO: 56285 - RNA, 64 nt, Human
uccaagcacauggccucccaucugggagagcccacugucccacucccacaugucugggcaccug

SEQ ID NO: 56286 - RNA, 64 nt, Human
uuagagauuuuaaggacaugauaaaugaacuuuucugucccaugugaagugguagugcggugcc

SEQ ID NO: 56287 - RNA, 64 nt, Human
auagagggcaucucucccaggugacccuucuuuucugucccaggaggguggguaauucccuuug

SEQ ID NO: 56288 - RNA, 64 nt, Human
uuggacacgccgacccggcgcuccccaaggaaugcugucccaacaagauucccgugaaagagca

SEQ ID NO: 56289 - RNA, 64 nt, Human
cucaggacaacuuacugcagggccaaaaaagggacugucccagcuagaacugugagaguauaca

SEQ ID NO: 56290 - RNA, 64 nt, Human
ugggucugugccccaguguggagcaaaacauugccugucccauucugauauacuucagaauuug

SEQ ID NO: 56291 - RNA, 62 nt, Human
uagagcggagugggcguuagcugaagacaugucugucccaccuguaccugacacagaagcug

SEQ ID NO: 56292 - RNA, 64 nt, Human
uggaauucugcagugcaagagcccuucgugggagcugucccauguuuccaugguccccagucuc

SEQ ID NO: 56293 - RNA, 64 nt, Human
aucuguauuuuuaaauucugcuccugaaaaaugacugucccauucuccacucacugcauuuggg

SEQ ID NO: 56294 - RNA, 64 nt, Human
augcuaaacuuaguccccacaacaaagaaucauccugucccaugucaacauuauacccauggag

SEQ ID NO: 56295 - RNA, 64 nt, Human
gccccagcagauggggcugggucaggaaccaucucugucccaggugcucagcccucauaugcau

SEQ ID NO: 56296 - RNA, 64 nt, Human
ggaggccuuggaaccugagcugccaaugccagcccugucccaucugcagccacacuacucgcuc

SEQ ID NO: 56297 - RNA, 64 nt, Human
agagggcuacaaaggaggacaagacccucucaggcugucccaagcucccaagagcuuccagagc

SEQ ID NO: 56298 - RNA, 64 nt, Human
ugcaccacugaccuugaggagccuuuuguuccuccugucccaguuugguuuccaugggaaccug

SEQ ID NO: 56299 - RNA, 64 nt, Human
aucaguccaggaacuucccaccaccagcccuugacugucccauuaacugacauggucagauuuc

SEQ ID NO: 56300 - RNA, 64 nt, Human
uucugaaacgggaaucaguaacucuuugcauuuucugucccacaagauaugcaaaaacaaugca

SEQ ID NO: 56301 - RNA, 64 nt, Human
gucacuccuucaguagaaggcccugcucccuauccugucccacagcccugccuggauuuguauc

SEQ ID NO: 56302 - RNA, 64 nt, Human
aggucccuaagcuggggacagagaagguucugagcugucccauacucccacuuugugccaaaug

SEQ ID NO: 56303 - RNA, 64 nt, Human
uuuucuuuuaagggauaguuuguaauaguaagaacugucccauauguuaguaaauuacauaugu

SEQ ID NO: 56304 - RNA, 64 nt, Human
uccaggaacacccucccagcaggggaugggaacccugucccaugaagcccucuccucagcuuua

SEQ ID NO: 56305 - RNA, 64 nt, Human
cuggaccccagcaagugguccuagaggcccuuugcugucccauagucccugccacgaauuucug

SEQ ID NO: 56306 - RNA, 64 nt, Human
cagcaugaacacgggcuuugaacucuccuagcuccugucccagcccugccuccagggcuccugg

SEQ ID NO: 56307 - RNA, 64 nt, Human
ucuccuucucccuucccaucuccaggccuucugucugucccagauaaaggcgcuguucucccau

SEQ ID NO: 56308 - RNA, 64 nt, Human
ggagaggccugggcuccucuacuggaucuacacucugucccagguuuuuagaucccacugagcc

SEQ ID NO: 56309 - RNA, 64 nt, Human
uucucucacuuuaagugacauugaggaagguauucugucccacagguuucuguggacagcgaua

SEQ ID NO: 56310 - RNA, 64 nt, Human
gugucugcccuuccaaucaccucccugaccccugcugucccauuuuccccagcuggccgcauuc

SEQ ID NO: 56311 - RNA, 64 nt, Human
ccugagcuaagacauacugucagucucacuucugcugucccaguccuagaaauccuggguagaa

SEQ ID NO: 56312 - RNA, 64 nt, Human
cacagcauggcugagggaccccuucccaguagggcugucccaagccccacuccauggggccagg

SEQ ID NO: 56313 - RNA, 64 nt, Human
acagcugggcagguggagugggugggcaggauggcugucccagucugcccaucuucucuuggcu

SEQ ID NO: 56314 - RNA, 64 nt, Human
gcugacuaccucccagaagccccucaugccaagccugucccacuggggcuccagggccucugcc

SEQ ID NO: 56315 - RNA, 64 nt, Human
uugccuuuccucuccuggccuccagucuccccugcugucccagguagagcuggguauggaugcu

SEQ ID NO: 56316 - RNA, 64 nt, Human
auauaugcgccacauaaucaacagaaagauggggcugucccagccguaagucaggcucgaggga

SEQ ID NO: 56317 - RNA, 64 nt, Human
uggcugagaagcaucugucuuccaucccacuugccugucccaaguuuuguuccauuuuuuaaaa

SEQ ID NO: 56318 - RNA, 64 nt, Human
ggacuccuggacugcauuaggaagaccucuuucccugucccaauccccaggugcgcacgcuccu

SEQ ID NO: 56319 - RNA, 64 nt, Human
aggacuucuguuccaaaggcugggaaaaacuaagcugucccagccccucccauuucuugggcag

SEQ ID NO: 56320 - RNA, 64 nt, Human
cccuucucccugguugugcugcuuuucuaguaaucugucccauuuuucagguuauaauauuucc

SEQ ID NO: 56321 - RNA, 64 nt, Human
aacaaaagguauaugccuucaggaaugauauaaucugucccauuuucgaggcuccuuauaagga

SEQ ID NO: 56322 - RNA, 64 nt, Human
ugacccuccuuuaucuugcaaaccccugccccugcugucccagggaggacgggcuucuguagag

SEQ ID NO: 56323 - RNA, 64 nt, Human
auguugcugucgcuccuguuuuuaaccauauguucugucccauagcagucauucacacauguga

SEQ ID NO: 56324 - RNA, 64 nt, Human
agguauuggggugauuuuggucaugacagugugccugucccacuguuacacgcaugaauggggg

SEQ ID NO: 56325 - RNA, 64 nt, Human
gccauguacuccagaacucauccugucaaucacucugucccauugucuacugggaaggucccag

SEQ ID NO: 56326 - RNA, 64 nt, Human
caaggcugcuucccuggugugucuguucucuccucugucccaggugcugggagcguccucuuca

SEQ ID NO: 56327 - RNA, 64 nt, Human
caccuagucauugcuugaggggccaaauuguguucugucccaugcacgcucuauuugguguuaa

SEQ ID NO: 56328 - RNA, 64 nt, Human
cagcacgugacuccagucagugguccuggucccacugucccaguguagguuaguauuccuucac

SEQ ID NO: 56329 - RNA, 64 nt, Human
gagaagccauggcauuaucuucaggcaauuuagucugucccaaauaaaauaaauccuugcaugu

SEQ ID NO: 56330 - RNA, 64 nt, Human
aauaaauguguuugaaaugcacaccuacacaacccugucccacacuggccuguaggaccuaauc

SEQ ID NO: 56331 - RNA, 64 nt, Human
uacuccuuaaauagcagugaguaaugcauuugagcugucccaggcucugucuccucagcucauu

SEQ ID NO: 56332 - RNA, 64 nt, Human
ugguccuagucacuggccgaggauaagcccgucccugucccacauucuagccccacuaugcggg

SEQ ID NO: 56333 - RNA, 64 nt, Human
aguucagcaaagcugcuuguucucccauggauuccugucccaagcuaccucuaccaacccucuc

SEQ ID NO: 56334 - RNA, 64 nt, Human
ccaaauccaucuccaucccuuuacugucaaucuucugucccaguaguuuagccuuuguggcuua

SEQ ID NO: 56335 - RNA, 64 nt, Human
ucacccucaggaacccacccucuccacacccagccugucccacuggcuccucccagcacaggca

SEQ ID NO: 56336 - RNA, 64 nt, Human
cuguguauuucugucugggaccaggaagccgcagcugucccaucauccccagcaaauccuagaa

SEQ ID NO: 56337 - RNA, 64 nt, Human
guuucucucguuuuccuuaguuaucaguccuguccugucccacucaggucuguacuuagggcag

SEQ ID NO: 56338 - RNA, 64 nt, Human
ggauucacuuggguguugggaucaaauuuggauucugucccaggccuuacuguaaaacuagggg

SEQ ID NO: 56339 - RNA, 64 nt, Human
uucugugucugcguguccgaauccccgugugacccugucccagcauuuucccgccgacccugcg

SEQ ID NO: 56340 - RNA, 64 nt, Human
uugccauccuccccuucugguucucugcacccaccugucccacugcaguuccuuccgugcucug

SEQ ID NO: 56341 - RNA, 64 nt, Human
ccacugcaccuggcccacauuuuuuaaagagacacugucccacuccaucacccaggcuggaguc

SEQ ID NO: 56342 - RNA, 64 nt, Human
acggggcaggcaaacuacauccugcaggccaaaucugucccaccaccuguuuucauauggccug

SEQ ID NO: 56343 - RNA, 64 nt, Human
gucacagcuguuguuuucguggcauuuggcaccucugucccagauacguuugccagcaaagcug

SEQ ID NO: 56344 - RNA, 64 nt, Human
cccccuuccccuucugugucacaguucuuggugacugucccaccgggagccucccccucagaug

SEQ ID NO: 56345 - RNA, 64 nt, Human
ccccagcgccgagacuccuggugacagguggcaccugucccacagcccucgucccauguggaac

SEQ ID NO: 56346 - RNA, 64 nt, Human
cuggggcucagccaucaaggggcugguguugcuccugucccagacaaggaagccccucuuuaca

SEQ ID NO: 56347 - RNA, 64 nt, Human
agugccaacuuccccucuaacuggacagccucuucugucccaagucuccagagagaaaucaggc

SEQ ID NO: 56348 - RNA, 61 nt, Human
guauggaacgcaaacucugaguucuggaagccugucccaagugaaugaaugcuccagcgau

SEQ ID NO: 56349 - RNA, 64 nt, Human
ccuccuugugcuagagcccuccaucaccuucacgcugucccaccaugggccaggaaccaaacca

SEQ ID NO: 56350 - RNA, 64 nt, Human
gaugugaaaaguuguguuuguguguuuucuucuccugucccauauuuggguuaugaugacucaa

SEQ ID NO: 56351 - RNA, 64 nt, Human
gugggugauuuaaucaacugcaaaccaucugccccugucccaaaaugaugagccagauuagcau

SEQ ID NO: 56352 - RNA, 64 nt, Human
aaugugggcagagauuggaaugggcagcucaucucugucccacuuggcaucagcuggcgucaug

SEQ ID NO: 56353 - RNA, 64 nt, Human
accaggcaaagcaagugauugggacagagguuaucugucccagguuaucugggcauagaugcag

SEQ ID NO: 56354 - RNA, 64 nt, Human
gguugucauuuaaaaauaaaguuccuuuauauuucugucccaucaggaaaacugaaggauaugg

SEQ ID NO: 56355 - RNA, 64 nt, Human
gaguucguguucccuguuuuaaucacaugacuaccugucccaguacacgaaagggcgcugguug

SEQ ID NO: 56356 - RNA, 64 nt, Human
aaaagccacuaacauggcugucuguuucauuggacugucccauuugcugguuaaaaggauuggg

SEQ ID NO: 56357 - RNA, 64 nt, Human
gccgugauggaccccagagccccuccuccagccccugucccacccccuucccccagcccaucca

SEQ ID NO: 56358 - RNA, 64 nt, Human
guggggcccauggggucucugcaucuucagucgucugucccaaguccugcuccuuucugcccag

SEQ ID NO: 56359 - RNA, 64 nt, Human
agcccugaccccccuucggcccaugcuauuccuccugucccaaccugggagguccuagccuggg

SEQ ID NO: 56360 - RNA, 64 nt, Human
cccgggacccccuggccuggcgcuguccccugagcugucccauuaaacauggcccugucucucu

SEQ ID NO: 56361 - RNA, 64 nt, Human
gucagcaagaacccaagcccacauccaaaccugccugucccaaaccacuuacuucccuguucac

SEQ ID NO: 56362 - RNA, 64 nt, Human
ugccccuuggguguggguggccucaaaggaggcccugucccagccacccaccccccacucccag

SEQ ID NO: 56363 - RNA, 64 nt, Human
guuccggcgggacgcauccauguuaaaugacgagcugucccacaucaacgcgcggcugaacaug

SEQ ID NO: 56364 - RNA, 64 nt, Human
ccacucccuacgacacgugacucguuuuagagcucugucccagaggcguucguaugugacccac

SEQ ID NO: 56365 - RNA, 64 nt, Human
gauuuguggcccuuccccagaggaauuguggagacugucccauggaacaaacccucaggcacca

SEQ ID NO: 56366 - RNA, 64 nt, Human
cccuagugcuuccuggagcugaggcugugggcggcugucccagcaaccaugcgagggguugccc

SEQ ID NO: 56367 - RNA, 64 nt, Human
ccuagggcgagugggcauccugucaucaucuccacugucccaagcagucacuagguggcggccg

SEQ ID NO: 56368 - RNA, 64 nt, Human
ugaauuugucacccagucgcaacuuuucccuucucugucccauugcuuucuccuuuccccgacg

SEQ ID NO: 56369 - RNA, 64 nt, Human
guucucuccgucucaucggcaguauggggggcagcugucccagugucaauguuuacucaagggu

SEQ ID NO: 56370 - RNA, 64 nt, Human
cagcauuuggccauguucuuuuguuuuucuauuccugucccaaaucaaagagcaugguucucag

SEQ ID NO: 56371 - RNA, 64 nt, Human
gggauuccugcugcuccagguguccucagcucaccugucccagacugaggacaggggaguuccu

SEQ ID NO: 56372 - RNA, 64 nt, Human
ucuggguggggagugaggggucuuggaggcagggcugucccacagggcgcccgccgaccugcac

SEQ ID NO: 56373 - RNA, 64 nt, Human
gcccacacuucaggggcccagacuuacacccugacugucccaccuucuguccuuguccuggacc

SEQ ID NO: 56374 - RNA, 64 nt, Human
cuccaagaccuggugucucccacugugagcccagcugucccacaggcaguccccauggaccuag

SEQ ID NO: 56375 - RNA, 64 nt, Human
ccuugccucuaugaaccucugcugggcccagccccugucccagcucccgaccugcacuuccugc

SEQ ID NO: 56376 - RNA, 64 nt, Human
cgccgccaugcugccuaggguacuguccccacaucugucccaacccagcuggaggccuggucuc

SEQ ID NO: 56377 - RNA, 64 nt, Human
ucccuuccagcccacacucugccaccuccuggcccugucccaauucugagccaaggccuccccg

SEQ ID NO: 56378 - RNA, 64 nt, Human
ggcaucuuggguaucccacuccuucuccccauuucugucccacaggccuucagcccuuuaacgu

SEQ ID NO: 56379 - RNA, 64 nt, Human
aacuauuguguaccaccacauagcacaugcacgucugucccagacuuugacaaccugcacaaga

SEQ ID NO: 56380 - RNA, 64 nt, Human
uuaucuuauugcuuuaaacaaguuugugcuuaaucugucccaacuaaaauggagcuuauaaacu

SEQ ID NO: 56381 - RNA, 64 nt, Human
ucaaggguauuauguggacucaguccaagcucuccugucccauugugcauugucugugacaugc

SEQ ID NO: 56382 - RNA, 64 nt, Human
uuccugaaugcacucauccccucaaaguggggaccugucccaaggacuggcccagccgugggga

SEQ ID NO: 56383 - RNA, 64 nt, Human
ccagggcuauagggugugaugaagucaccccuuucugucccacuacaucugggacugacuuucc

SEQ ID NO: 56384 - RNA, 64 nt, Human
uccugcgcccugugcccgacugacuggaggaggccugucccaauucugcccgcuccauggaaaa

SEQ ID NO: 56385 - RNA, 64 nt, Human
aguuguuuacucuguuccucuccagaggggcucucugucccaguugggcagcucaccuuuggga

SEQ ID NO: 56386 - RNA, 64 nt, Human
cccuccccagcucaacccauuaaagacccaggcccugucccaucaugcauucaugucugucuuc

SEQ ID NO: 56387 - RNA, 64 nt, Human
cgcccaugccccgcugggucugcagggaacuggacugucccauggccugugagcaccggagcgc

SEQ ID NO: 56388 - RNA, 64 nt, Human
ggagccuggaagcagcagggagcagccugggucucugucccagacucgccacucucgaccagca

SEQ ID NO: 56389 - RNA, 64 nt, Human
gugaggaaagccgucucccugcuugacucgacugcugucccagaggagaguccugugcgaccug

SEQ ID NO: 56390 - RNA, 64 nt, Human
ggucucuagccccucagcccccgcugggcacucucugucccaucccucuaggacagggaagcug

SEQ ID NO: 56391 - RNA, 64 nt, Human
ugggguccuuugggguuuccagguugucaccaugcugucccauuugggaaucccauaccugccu

SEQ ID NO: 56392 - RNA, 64 nt, Human
guucccuuccucuuccugcccuugaacccccucccugucccagggcccucccagcccauugcug

SEQ ID NO: 56393 - RNA, 64 nt, Human
caucaugaacuggugacggggcccugggcuggggcugucccacacuggacccagcucucccccu

SEQ ID NO: 56394 - RNA, 64 nt, Human
auugauucauguucaucaauaccugcugagaguacugucccaggaauauccaguggauggauuc

SEQ ID NO: 56395 - RNA, 64 nt, Human
acccacuuggcuucugaauacucccggccagggccugucccaguuaugugccuucccucaagcc

SEQ ID NO: 56396 - RNA, 64 nt, Human
uuugugcuucuccuuagggucugggcccugcucccugucccaucugcaguggaccccaggcacc

SEQ ID NO: 56397 - RNA, 64 nt, Human
ccacccuuuucaaguuuagauaguguuucagcugcugucccaaaguaacaaaacaauaccuacu

SEQ ID NO: 56398 - RNA, 64 nt, Human
uaagugauggauagcagaaagggagaacugacuccugucccaaauagcuccucugccaccuguc

SEQ ID NO: 56399 - RNA, 64 nt, Human
cuuucagaagucaaugugaaaauuccuuccuaggcugucccacagucuuugcugcccuuagaug

SEQ ID NO: 56400 - RNA, 64 nt, Human
ccuccauuucccuggccugccccccacccccaaccugucccacccccgugcccccuccuuaccc

SEQ ID NO: 56401 - RNA, 64 nt, Human
aaaaauaguggccagaccagagcucuggagccaccugucccaccucaaaugggucuggggguca

SEQ ID NO: 56402 - RNA, 63 nt, Human
uggaggggugcauccagugaaccccaugucaggcugucccaugguguguucugccccucccac

SEQ ID NO: 56403 - RNA, 64 nt, Human
auaacaucaggccaguagaauuaagccucuccaccugucccaaccauaaaaagggucucccagc

SEQ ID NO: 56404 - RNA, 64 nt, Human
cuacucagaggaggacauuuggugggcuuuggagcugucccaccugcacacguuugugagcucc

SEQ ID NO: 56405 - RNA, 64 nt, Human
guagggaaauagcaguucagagagaggaagcucucugucccagcaccgagacucacuccuaagu

SEQ ID NO: 56406 - RNA, 64 nt, Human
aaaagucuagcucuuugcuuuaccauacagggaccugucccaaagaaaaaggcucuuuuuuuag

SEQ ID NO: 56407 - RNA, 64 nt, Human
uuggaaucccccaaccagagauguuaaagugagccugucccaggaaacaucuccacccaagacg

SEQ ID NO: 56408 - RNA, 64 nt, Human
gagucgauucuuaaauaaggaucagugaggcauccugucccaagcuacuguuugguggggaucu

SEQ ID NO: 56409 - RNA, 64 nt, Human
caacccugaugcgcugacauucccuuagcaccagcugucccaccuccaggguccugaccagguc

SEQ ID NO: 56410 - RNA, 64 nt, Human
gcaggcuuggaagggacuucucccgcaccccacucugucccaggacauagggcagggggccuca

SEQ ID NO: 56411 - RNA, 64 nt, Human
ucuauuuaagaaaauuuaacaaauacgaguaacccugucccaaucacugaaucucuaguuacua

SEQ ID NO: 56412 - RNA, 64 nt, Human
cccuaggcgggaggggguggcgcuucucagccggcugucccagccagccccgcagagcgcccac

SEQ ID NO: 56413 - RNA, 64 nt, Human
guugguguuuccucccuggagaagaugggggaggcugucccacucccagcucuggcagaaucaa

SEQ ID NO: 56414 - RNA, 64 nt, Human
ucaucacuugguucuguuuuaaucgacuggcccccugucccaccucuccagugagccuccuuca

SEQ ID NO: 56415 - RNA, 64 nt, Human
uguaugagagccgcucuccugcuaccucccaccacugucccagcagucccucggcacacaggca

SEQ ID NO: 56416 - RNA, 64 nt, Human
uggcugggcuccaugagaaugaguugccuccaaccugucccaacagcugacagccaggagccac

SEQ ID NO: 56417 - RNA, 64 nt, Human
uucucuaaaguucuggacaguucugccuccugcccugucccaguggaggcaguaauucuaggag

SEQ ID NO: 56418 - RNA, 64 nt, Human
ugaagacaaaaguuaaaaacagacuuuaaaaauacugucccagaaauguaauuuuaugauccca

SEQ ID NO: 56419 - RNA, 64 nt, Human
accacccgccaggggagccugugacugucaguuccugucccaggcuuugcccggccgccccagg

SEQ ID NO: 56420 - RNA, 64 nt, Human
cuggggcagcgcaguccuguuaccuguggguggccugucccaggggccucgcuucccccagggg

SEQ ID NO: 56421 - RNA, 64 nt, Human
uaggauggaccaaggugggccauaccaacucccucugucccaaaauguaaguuauuacguaugu

SEQ ID NO: 56422 - RNA, 64 nt, Human
cccagggagcucuggggacagcuuccucacaccccugucccacccacacagcugcccuagcuga

SEQ ID NO: 56423 - RNA, 64 nt, Human
uucuggaccuucaggcacccccaagcgugcagcucugucccagccuucacugugugugagaggu

SEQ ID NO: 56424 - RNA, 64 nt, Human
uccuucagugagcagaaucacuguggucagucuccugucccagcuucaguucaugaauacuccu

SEQ ID NO: 56425 - RNA, 64 nt, Human
guaucugaagugggagaagaagcagguagaccaccugucccaggcuguggugccacccucucug

SEQ ID NO: 56426 - RNA, 64 nt, Human
ucccucugcagggggugguggugucuucccagcccugucccaugugucccuccccccauuuucc

SEQ ID NO: 56427 - RNA, 64 nt, Human
gaccuggggaggccccugaaggcaaagagggaaacugucccagcuguucuguccuaggggaggg

SEQ ID NO: 56428 - RNA, 64 nt, Human
cgaauugcuaugacauuccaagcuccaauaaagacugucccagacuuuggccugugaccauuca

SEQ ID NO: 56429 - RNA, 64 nt, Human
uuucagccccagggcccggcucugugugagaagucugucccaaaauucugggacggaccaccuc

SEQ ID NO: 56430 - RNA, 64 nt, Human
guaucugucuacuuagcguggcuguuuugagggacugucccaucagugaacaaacugcauggcc

SEQ ID NO: 56431 - RNA, 64 nt, Human
acucgggaaagugguaccgacuuccccaucccugcugucccaccagggacagauccagaaacug

SEQ ID NO: 56432 - RNA, 64 nt, Human
uaugucuggcuaagagauucgccuuaaaugcucccugucccauggagagggacccagcauagga

SEQ ID NO: 56433 - RNA, 64 nt, Human
gcaguuguugacugaguuuuucauccuuacaauccugucccaugguauuuaacauaaaaaaaaa

SEQ ID NO: 56434 - RNA, 64 nt, Human
cugcacccaagggcccugaacccauuuuccuccccugucccagccuucccacuuugacagacac

SEQ ID NO: 56435 - RNA, 64 nt, Human
gaucuuaauauaaauucacuuucauuuuugauagcugucccaucuggucauuugguuggcacua

SEQ ID NO: 56436 - RNA, 64 nt, Human
ggugacuuuccggaggccuugagggaaaugcacacugucccauagccucauugggcucccagac

SEQ ID NO: 56437 - RNA, 64 nt, Human
uuaagcuguguucacucuagaagguguaaaggcccugucccaaucucugcucucucacuucucg

SEQ ID NO: 56438 - RNA, 64 nt, Human
accagccucccccaacagaacgccugugccgccacugucccaaggacuggacauucuuccaagg

SEQ ID NO: 56439 - RNA, 64 nt, Human
guacuguaguuugcacuggacgcccgggcccucccugucccaaagcccccuugggggaacugug

SEQ ID NO: 56440 - RNA, 64 nt, Human
ucccccucagacuucaugucucugcucaucagcacugucccaggauccuggagagggagaacuc

SEQ ID NO: 56441 - RNA, 64 nt, Human
gacugggaggcgacagaugggccccucuuggccucugucccagcucucugcagccagacggaaa

SEQ ID NO: 56442 - RNA, 64 nt, Human
gccgucaucauuggguucuguuuugacagcucugcugucccauagggacugcgacugggaccag

SEQ ID NO: 56443 - RNA, 64 nt, Human
aucauuguuguccuuuugugaggggcugaggcgacugucccauggaggcauccaaggcuuucug

SEQ ID NO: 56444 - RNA, 64 nt, Human
uccuucugaauguaaaacuggagcccaggagaagcugucccaggagggcuguuaacucccuaua

SEQ ID NO: 56445 - RNA, 64 nt, Human
aaaggggaaugaagccauucacuucacucaguuccugucccauuuaaccgccccgauccuugau

SEQ ID NO: 56446 - RNA, 64 nt, Human
ccuccaggugucugcagugguuguccccucaaagcugucccacacccuccuccgaggacccuuu

SEQ ID NO: 56447 - RNA, 64 nt, Human
aggggcuggggcuucucucgcacccccagcaccucugucccaaaaccucauucccuuuuuucuu

SEQ ID NO: 56448 - RNA, 64 nt, Human
ccacauuuacacgccugcaguuguuuuccggagucugucccacggcccacacgcucacuugacu

SEQ ID NO: 56449 - RNA, 64 nt, Human
cugccugcacgggggugcgggcgggcccgagccccugucccacuucgaaguggaggucugccag

SEQ ID NO: 56450 - RNA, 64 nt, Human
ccugaacccccagccugggcuuagcccugugguccugucccagugcagagggccuggagcacgg

SEQ ID NO: 56451 - RNA, 64 nt, Human
aacuuagagaagcccgcccccuccccuucuccgucugucccaagagggucugcucugagccugc

SEQ ID NO: 56452 - RNA, 64 nt, Human
cccagcccccuuccucccuggaccccacgggccccugucccaggaaccccgcccucugacuucu

SEQ ID NO: 56453 - RNA, 64 nt, Human
caaggacaccaucgcagccaaccccugagugccccugucccaccccuaccucuaguaaauuuaa

SEQ ID NO: 56454 - RNA, 64 nt, Human
ggcagccccacuucacccccaacuucaccacccccugucccauucuagauccugcaccccagca

SEQ ID NO: 56455 - RNA, 64 nt, Human
cagaaaaaguuugcugacuugugauugagaccuacugucccauugugagguggccugaagaauc

SEQ ID NO: 56456 - RNA, 64 nt, Human
ugggugacuugguaccugcucaggaccccccgcacugucccaaucccacucaggcccaccucca

SEQ ID NO: 56457 - RNA, 64 nt, Human
cgcuggugacuucguaccugcucaggagcccccacugucccagucccacucaggcccaucucug

SEQ ID NO: 56458 - RNA, 64 nt, Human
cccugcacugcuacccucuauuucccacucagggcugucccagagagaaggcagccgaacugag

SEQ ID NO: 56459 - RNA, 64 nt, Human
guguucucuggucuucucucacaaugcugcaucccugucccauuuuuagggucccugucuauca

SEQ ID NO: 56460 - RNA, 64 nt, Human
cuuugggcucgaggccagcuccuccccaugcccgcugucccagcuccuugagacuggagagcag

SEQ ID NO: 56461 - RNA, 64 nt, Human
uccccgaaucucagccaccgugucacucugugaccugucccauggauccugaaacugcaucuug

SEQ ID NO: 56462 - RNA, 64 nt, Human
ucaccacagugguccuuccugccugagcccugcacugucccagaccacacagaagucuggucac

SEQ ID NO: 56463 - RNA, 64 nt, Human
cugugaggccagcccccaccuuccucuuucccaccugucccaggaccagaaucccagggacaga

SEQ ID NO: 56464 - RNA, 64 nt, Human
uguaaugauagaauuaaauuagugucacuaaaaacugucccaaagugcugcuuccuaauaggaa

SEQ ID NO: 56465 - RNA, 64 nt, Human
ggggccaagggcgaugcaggaccccccggagcuccugucccauccacaccagcuccccaugcca

SEQ ID NO: 56466 - RNA, 64 nt, Human
gguggggcucuuccuguccacucccagccucccacugucccaccgccuccugccucucuccucu

SEQ ID NO: 56467 - RNA, 64 nt, Human
gggcuccccuucucucuaccuucucccccaacgucugucccauccauauuugucucucugucca

SEQ ID NO: 56468 - RNA, 64 nt, Human
cagaguccugcucccucacuccucgccccgcccccugucccagagucccaccugggggcucucu

SEQ ID NO: 56469 - RNA, 64 nt, Human
cucccucccugugcuuggcugggccugacccuuccugucccagggcccaggucugugugauauc

SEQ ID NO: 56470 - RNA, 64 nt, Human
cuaagccccacccagccccccagugcccgucuuccugucccaucugcucagagagagguggggc

SEQ ID NO: 56471 - RNA, 64 nt, Human
uuaggggucccaagguugccacccacgugcccagcugucccacgcugcagcgcagacggccacg

SEQ ID NO: 56472 - RNA, 64 nt, Human
uaagaugcuucauggauacaagaguuaaaacuuccugucccauuuagugaaacaaaagguuaag

SEQ ID NO: 56473 - RNA, 64 nt, Human
uggugcagcugugaagcucgggcugauucccccucugucccagaagguuggccagaggguguga

SEQ ID NO: 56474 - RNA, 64 nt, Human
ucugccauguugccccuuucucuuuuccccuuuccugucccaccauacgagcaccuccagccug

SEQ ID NO: 56475 - RNA, 64 nt, Human
aggcacacacugagggggcaguguggcucccugccugucccauccccaugccccguccgcgggg

SEQ ID NO: 56476 - RNA, 64 nt, Human
cagacagaaaacccaugcuuuacuuuguacagcccugucccagaguuaguaagccucggcuugu

SEQ ID NO: 56477 - RNA, 64 nt, Human
ugaaagaucaaaacugcauuugcaaagcccuccccugucccaggacaaagcugagacugacggg

SEQ ID NO: 56478 - RNA, 64 nt, Human
gagugugcucaggagucgcgggcagcguggacaucugucccagagggggcagaaucuccaauag

SEQ ID NO: 56479 - RNA, 64 nt, Human
aacgcuccucucgcgagcggcccgggcagggacccugucccaacaccaacaccuccucuccagc

SEQ ID NO: 56480 - RNA, 64 nt, Human
uggagcacacgcuccacgcacacacaccccagcccugucccaggggccuggcccccucagccau

SEQ ID NO: 56481 - RNA, 64 nt, Human
accccggggugaggccuccugccugccuggugcccugucccagccccagguccugugcagggca

SEQ ID NO: 56482 - RNA, 64 nt, Human
uauucuccacaccucucaccuccaccaccccucccugucccagccagcaucaucucuuugggga

SEQ ID NO: 56483 - RNA, 64 nt, Human
cccaccccauagcugaggaggagucacaguggaacugucccagcuuuaagauaucuagcagaaa

SEQ ID NO: 56484 - RNA, 64 nt, Human
augaaguauuauguagggauacgucccucccauucugucccacagccaccaccucucuccucag

SEQ ID NO: 56485 - RNA, 64 nt, Human
ucacuuccuuugcccuuccuccugccuuucucaacugucccaaggagggggccucauugugucu

SEQ ID NO: 56486 - RNA, 64 nt, Human
uccuggcccccgcccuugccccggcccggacucccugucccacgucccuagucccagacuaccc

SEQ ID NO: 56487 - RNA, 64 nt, Human
ucauguucuucuaaagugucaucuucugcccucccugucccaauagggaccacaucuuauuugu

SEQ ID NO: 56488 - RNA, 64 nt, Human
acuaaggaggccacugagggaauccuccacguggcugucccagccaccaaaacccaugcacagu

SEQ ID NO: 56489 - RNA, 64 nt, Human
agggguagcuuuucaaaaacagggcagagccuggcugucccaaccagggggagcaggggcuugg

SEQ ID NO: 56490 - RNA, 64 nt, Human
gcacugugcuguuguugucugacuguggcuaucucugucccaucacccugagccucaagaugga

SEQ ID NO: 56491 - RNA, 64 nt, Human
gcucauaagcuguagaacucugcaggcagauuuacugucccaggagcaaaugcuggaugagcaa

SEQ ID NO: 56492 - RNA, 64 nt, Human
ugggcugucuccucaccccucccugugcuggagccugucccaaaaaggugccaacugggaggcc

SEQ ID NO: 56493 - RNA, 64 nt, Human
aaugagccggagccccuugggcaggucacacaaccugucccagcgagggacaccgaguggcccu

SEQ ID NO: 56494 - RNA, 64 nt, Human
acucuuggaagagguuuugugguucccaaugugucugucccacccugauccuuuucaauauaua

SEQ ID NO: 56495 - RNA, 64 nt, Human
cagaugcguuuuaaaaaauucugguccccgcucucugucccaucaucugccucggggacuuccu

SEQ ID NO: 56496 - RNA, 64 nt, Human
ggacaagggccacugggcuggucugugucugggccugucccauggcuggggcagugagggggcc

SEQ ID NO: 56497 - RNA, 64 nt, Human
uugcgcugcaccagcgaaucugccugggcugcuccugucccacccacccucacugagauccaug

SEQ ID NO: 56498 - RNA, 64 nt, Human
ucucuggauccagaaauguugccauucuuggaaacugucccauugcuucguauuucugccaacg

SEQ ID NO: 56499 - RNA, 64 nt, Human
gggaggcccugcugggacccugaucugggccuuccugucccagggccuaugggcaacugcguug

SEQ ID NO: 56500 - RNA, 64 nt, Human
ccccaggcccuggaggcugcaacauaccucaauccugucccaggccggauccuccugaagcccu

SEQ ID NO: 56501 - RNA, 64 nt, Human
cagcaggugccccauccucugcccacagcagacucugucccauggcucuccgggcaguagagug

SEQ ID NO: 56502 - RNA, 64 nt, Human
ugaacccugaguguugcaggcccagcagacccugcugucccaagcccaccccuccucccaccau

SEQ ID NO: 56503 - RNA, 64 nt, Human
guggucagcuccccuaaaaugggcacggcccagccugucccaugaggaauaaaggccccuggcc

SEQ ID NO: 56504 - RNA, 64 nt, Human
aauaccaccaccaaccaccuucuuccucucaacucugucccacaggccugucugguauuugugg

SEQ ID NO: 56505 - RNA, 64 nt, Human
agugaaacuguuuacaauaaccucauacaaccuucugucccaucuccugguucagccuaggugu

SEQ ID NO: 56506 - RNA, 64 nt, Human
cuaggaucacuuuuuaaaaaaucaccacuuguggcugucccagagugcgguuguacauccuccc

SEQ ID NO: 56507 - RNA, 64 nt, Human
aaaacaccggucccuggggagacuugaaaggccccugucccagccuggacgccacgcacugccg

SEQ ID NO: 56508 - RNA, 64 nt, Human
ccuucgagggccucugccccaugugcccucaaagcugucccacaaucauggagcccugcgaccu

SEQ ID NO: 56509 - RNA, 64 nt, Human
gccugcuagacgcguugcccgucccugcguggugcugucccaugucacuugaacugauagaggg

SEQ ID NO: 56510 - RNA, 64 nt, Human
cugccacuguguacuguggaguugacucgguguucugucccagugcggugccuccucuugacuu

SEQ ID NO: 56511 - RNA, 64 nt, Human
ggcacgcuagagccgccuucccggugggagcccucugucccacagggagcggggagccagcuuu

SEQ ID NO: 56512 - RNA, 64 nt, Human
auuuaguuuucccacuguuaagcuggaaugaggacugucccaacaacaguagguacaguggaca

SEQ ID NO: 56513 - RNA, 64 nt, Human
cccuugguggauaguuggucagugccuggaaaaccugucccaguuuaucaggaacgcaggccug

SEQ ID NO: 56514 - RNA, 64 nt, Human
cugggguggggggaggaguggauuccuccccacccugucccaggcagcgccacuguccgcuguc

SEQ ID NO: 56515 - RNA, 64 nt, Human
ccgacccaagggagugucagccuugggcucucuucugucccagggcuuucuggaggacgcgcug

SEQ ID NO: 56516 - RNA, 64 nt, Human
augccaaagggguuccccugcggaguuccccugucugucccaggccgacccaagggagugucag

SEQ ID NO: 56517 - RNA, 64 nt, Human
uaggccaagaauuagauuuuaaaacuucaucugucugucccaguuaacuguuaaauaaggccuc

SEQ ID NO: 56518 - RNA, 64 nt, Human
cguggugaggaccgacuccaggaguccccuuucccugucccagccccaucuguggguugcacuu

SEQ ID NO: 56519 - RNA, 64 nt, Human
cuucuccccaggguucaguccucaaggggccauccugucccaccaugcagugccccuagcuuag

SEQ ID NO: 56520 - RNA, 64 nt, Human
aucuuagccagcuggagcuuaagccaaaccuguucugucccacuggccagccaucuuugcucac

SEQ ID NO: 56521 - RNA, 64 nt, Human
gguggguaacccccacccaacccagcuccugcugcugucccagucuugggcuggggccuggaaa

SEQ ID NO: 56522 - RNA, 64 nt, Human
auucacaccuuuccaucccugacucuauggguuacugucccaauugcgaaacacccauacuccu

SEQ ID NO: 56523 - RNA, 64 nt, Human
ccagacucagcagagugaggggguaaagcaguuccugucccacauggccaucuucuuucuucca

SEQ ID NO: 56524 - RNA, 64 nt, Human
cucuuuccucccagaacuauaucugacucucagucugucccauaaauuaauucagaaaccaucu

SEQ ID NO: 56525 - RNA, 64 nt, Human
aaaaaggagagaauggaaauuggaauggagucuccugucccaaucauuuucaaaaucuagccag

SEQ ID NO: 56526 - RNA, 58 nt, Human
aaguauuaaccaaacucuaauuuggagucugucccaaacaauauugagauauuugcag

SEQ ID NO: 56527 - RNA, 64 nt, Human
cagccauggccuggguggaggcaccugaagacgucugucccaaacucccccagcccugagcugg

SEQ ID NO: 56528 - RNA, 64 nt, Human
ugugacuguccugugcgggccauagggcagggcccugucccagcagaugggcuugggagggggc

SEQ ID NO: 56529 - RNA, 64 nt, Human
uagcacguaucugagagacaccugcaagcacacacugucccagcugguacccauaaugcugcug

SEQ ID NO: 56530 - RNA, 64 nt, Human
uuuuaaaaaggcaguagccuuugcagggaccugucugucccaacuguuugaacagugugcuccu

SEQ ID NO: 56531 - RNA, 64 nt, Human
auacagcccugucacauugagaucauaaucccuccugucccacuccucucuaccaaccccaccc

SEQ ID NO: 56532 - RNA, 64 nt, Human
ccaagaaucugucugaaacuuguacagcuaguuccugucccacaacuauuaagugguuuauuaa

SEQ ID NO: 56533 - RNA, 64 nt, Human
uguuauugccuaaucacuccaacccugccccuuucugucccauccuucccaagaagagagaacu

SEQ ID NO: 56534 - RNA, 64 nt, Human
caucucgggggguaauuuccggaagggcuccauacugucccaauaaggugaggccaguagcagg

SEQ ID NO: 56535 - RNA, 64 nt, Human
guggggcucgaggaacguaguguucuuugcauuucugucccauaugggugauguagagauuuac

SEQ ID NO: 56536 - RNA, 64 nt, Human
ugucuaucugaagguugcacuggccagcaugggccugucccaagcgagaggggagacacagugg

SEQ ID NO: 56537 - RNA, 64 nt, Human
gcucuggggaaccugagagugccuaguccccauccugucccagcaccggcaccgcgucaggacu

SEQ ID NO: 56538 - RNA, 64 nt, Human
ucaccagcaacaucucgagcccccuggauguccccugucccaccaacucugcacuccauggcca

SEQ ID NO: 56539 - RNA, 64 nt, Human
cccaacagaaggaaggaggagggcgcccauucgucugucccagagcuuauuggccacugggucu

SEQ ID NO: 56540 - RNA, 64 nt, Human
ugacuuuagauaaaaaugcaaaagggcagucauccugucccagcagacccuucucauuggcauu

SEQ ID NO: 56541 - RNA, 63 nt, Human
cacugagggccucgccuggcugcagccugcgccaccgcccagagacccaagcugccuccccuc

SEQ ID NO: 56542 - RNA, 63 nt, Human
gucuugcccugugguuugacucuccuuagaaccaccgcccaccagaaacauaaaggauuaaaa

SEQ ID NO: 56543 - RNA, 63 nt, Human
acccccagauucuucgcacagugucuagauccgaccgcccaacguuugccucccagccugacu

SEQ ID NO: 56544 - RNA, 63 nt, Human
uuccuuaaauuuuuagccauuucuccaugggccaccgcccagcucauguaggugagccugggc

SEQ ID NO: 56545 - RNA, 63 nt, Human
acugguggccgccucccugucccguguguuuccaccgcccaaucuggcuuguccuggcagugc

SEQ ID NO: 56546 - RNA, 63 nt, Human
aggaguagcugaggguccuuucugugcccuuaaaccgcccagaggagcccuauuccacucugg

SEQ ID NO: 56547 - RNA, 63 nt, Human
gacaccaacgccgcauaggacugcccacaugggaccgcccacauaggaccgcccacauaggac

SEQ ID NO: 56548 - RNA, 63 nt, Human
auaggacugcccacaugggaccgcccacauaggaccgcccacauaggaccgcccacaugggac

SEQ ID NO: 56549 - RNA, 63 nt, Human
augggaccgcccacauaggaccgcccacauaggaccgcccacaugggaccgcccacaugggac

SEQ ID NO: 56550 - RNA, 63 nt, Human
auaggaccgcccacauaggaccgcccacaugggaccgcccacaugggaccgcccacaugggac

SEQ ID NO: 56551 - RNA, 63 nt, Human
auaggaccgcccacaugggaccgcccacaugggaccgcccacaugggaccgcccacauagaac

SEQ ID NO: 56552 - RNA, 63 nt, Human
augggaccgcccacaugggaccgcccacaugggaccgcccacauagaaccguccuccaguggu

SEQ ID NO: 56553 - RNA, 63 nt, Human
cagccucggccaggccugcucugcucagcgcccaccgcccaccaccccuccugcuuccccgag

SEQ ID NO: 56554 - RNA, 63 nt, Human
auauuauuacaguuccacaucaaggccgagugcaccgcccaccacugccacggccuuugacca

SEQ ID NO: 56555 - RNA, 63 nt, Human
gugaugccuacugaugcuucagugccucugcacaccgcccauuccacuuccuccuuccccaca

SEQ ID NO: 56556 - RNA, 63 nt, Human
caagagcaaauccugccugcccuaucccuagccaccgcccagugcucucacuauccaccucaa

SEQ ID NO: 56557 - RNA, 63 nt, Human
gaaccccucucccuuccauaauuccccucauccaccgcccacuccaggcacucacucaaacuu

SEQ ID NO: 56558 - RNA, 63 nt, Human
acgaacggugaucugugacccgguggugugcccaccgcccagcugcccacacccggugcaggc

SEQ ID NO: 56559 - RNA, 63 nt, Human
gacgggaacuccuccuuccugcuucagggccgcaccgcccagacuggcucagcccaggccacc

SEQ ID NO: 56560 - RNA, 63 nt, Human
caucgccugggacgccccuuucucuugcuguuuaccgcccacccagcagcgcccgaggccagg

SEQ ID NO: 56561 - RNA, 63 nt, Human
auucuggcuaucgucccccuucucacugaccugaccgcccaccaccuccuucccccucaucac

SEQ ID NO: 56562 - RNA, 63 nt, Human
uggaaugggaacugagaaccgauucuuuccacaaccgcccacugagcagcaaggcugcagcca

SEQ ID NO: 56563 - RNA, 63 nt, Human
uauucacuaauaaauguaugauguauaccaacgaccgcccacgcugccuuuggcugcccgugu

SEQ ID NO: 56564 - RNA, 63 nt, Human
uaaggacauacaagagccauuguuacgagcagcaccgcccagcccuuccuugccuacugucag

SEQ ID NO: 56565 - RNA, 63 nt, Human
aggaaccacuccuguuguacaaagcucacacccaccgcccaggucuuaacuuucuggcaucca

SEQ ID NO: 56566 - RNA, 63 nt, Human
ggccucuggacuucuuggaugagcucacccugaaccgcccaggcggucugcucuugguguuca

SEQ ID NO: 56567 - RNA, 63 nt, Human
ccugccucaaguagcaggccggcccgggccgccaccgcccaucccagaccauggagcgcgcug

SEQ ID NO: 56568 - RNA, 63 nt, Human
caauuccguagccagcugcuccccagcagcggaaccgcccaggaucagauugcaugugacucu

SEQ ID NO: 56569 - RNA, 63 nt, Human
agcugcugcccaggcuccgcagagcagguguccaccgcccauccagccauuguguuuagaggg

SEQ ID NO: 56570 - RNA, 63 nt, Human
ccuggacgcuguggcuuaagaguaacagcagccaccgcccaguuccaguggccccacgaagcc

SEQ ID NO: 56571 - RNA, 63 nt, Human
uaaaaagguucuccugaauaaugagaucagccaaccgcccaugcaacugaagacacugucguc

SEQ ID NO: 56572 - RNA, 63 nt, Human
cggugccgaacgcuggccacuggauccacgcugaccgcccacaggacuucauagcugccaucc

SEQ ID NO: 56573 - RNA, 63 nt, Human
ggguuguugggggggccucuguuuccggaauucaccgcccagucgccagggggcgcccgcggg

SEQ ID NO: 56574 - RNA, 63 nt, Human
gaaacagggccggccccccaacuucagggacccaccgcccauuccccgagagcugucggaacc

SEQ ID NO: 56575 - RNA, 63 nt, Human
auuuauuuuuuuuugagacaggaucucacuuuuaccgcccaggcuggagugcagugccaugau

SEQ ID NO: 56576 - RNA, 63 nt, Human
uccgcugaccucuggccacaggaagccagguccaccgcccaccacccuuucaggccauguuuc

SEQ ID NO: 56577 - RNA, 63 nt, Human
uggccuggaauggguaauggggugaguuaacccaccgcccagcuggcaagggaaaccuucuga

SEQ ID NO: 56578 - RNA, 63 nt, Human
uucuggcuggggaaugacaacauccacgcccugaccgcccaggguagggccgcugcuggggcu

SEQ ID NO: 56579 - RNA, 63 nt, Human
agccugagcuccacccuccccucuucuugcggcaccgcccacccacaccccgucugccccuug

SEQ ID NO: 56580 - RNA, 63 nt, Human
cucugccccuccguccccagggugcaggcgcgcaccgcccaacccccaccucccgguguaugc

SEQ ID NO: 56581 - RNA, 63 nt, Human
guggacucugcuacacuuaaaccuaugugacaaaccgcccauuauuuuauuguuuauuuaauu

SEQ ID NO: 56582 - RNA, 63 nt, Human
ugcccggccccucgccccugccuggcacugcucaccgcccaaggcgacgccggcuggaccagg

SEQ ID NO: 56583 - RNA, 63 nt, Human
uccccaggaagcuccugcgcuacuacagcaagaaccgcccaaccgaggcugucaggugcuacg

SEQ ID NO: 56584 - RNA, 63 nt, Human
ccaaaaaggcagcugccuguggcuccuguaccaaccgcccagccacgcuccaucgccgcccaa

SEQ ID NO: 56585 - RNA, 63 nt, Human
uugagcccuggcuguucugugguuccucugcucaccgcccaucaggguucucuuagcaacuca

SEQ ID NO: 56586 - RNA, 63 nt, Human
auucaauauauuuuuucuaaaauccaacuucugaccgcccaguaggaagaaaaaugagacauu

SEQ ID NO: 56587 - RNA, 63 nt, Human
acccgggccuccccucgucccucuucuagugguaccgcccaggccuuaaucacccccauuccg

SEQ ID NO: 56588 - RNA, 63 nt, Human
ccccgcccaggcacggccgaccccgccccgggcaccgcccaccgagccauccugccucgccuc

SEQ ID NO: 56589 - RNA, 63 nt, Human
cccugagggcccaccagccugugcugcauacccaccgcccagcuucucccugagggcccacca

SEQ ID NO: 56590 - RNA, 63 nt, Human
cucugagggcccaccagccugugcugcauacccaccgcccagcuucucccugagggcccacca

SEQ ID NO: 56591 - RNA, 63 nt, Human
cuguccccccaccacccgccugccccgcggaagaccgcccagugagccagcccccaccuucca

SEQ ID NO: 56592 - RNA, 63 nt, Human
cccacggccccacuguccacacacugccuccccaccgcccaccucggcugcuaggccccucgc

SEQ ID NO: 56593 - RNA, 63 nt, Human
aucaaauucuaagggagaaaaaaacaauauuaaaccgcccaagcagugugcccuagcagagga

SEQ ID NO: 56594 - RNA, 63 nt, Human
gggcucuuggcaccugcguguccugugcuuaccaccgcccaaggcccccuuggaucucuugga

SEQ ID NO: 56595 - RNA, 63 nt, Human
uaugguuguucgccaccaagccaggagugcugcaccgcccaguggucccccucgggcuccagg

SEQ ID NO: 56596 - RNA, 63 nt, Human
gccgggccauaugcccagugccagcuagggcccaccgcccauccugcacacggggccgcuggg

SEQ ID NO: 56597 - RNA, 63 nt, Human
aguguuccugagaggcugggcacuuagcuggaaaccgcccaccucccucccgggugagccugg

SEQ ID NO: 56598 - RNA, 63 nt, Human
ugcucacaacugccccucaaguucaaccccgggaccgcccagccccgcaaagcaaagacccug

SEQ ID NO: 56599 - RNA, 63 nt, Human
auccugguuugcaaaagagccucccaugccaguaccgcccagccuuggaggccggaaugcuca

SEQ ID NO: 56600 - RNA, 63 nt, Human
auggagacacccuggcccccaggagcuggaggcaccgcccacuccccuggcauuccagcuuug

SEQ ID NO: 56601 - RNA, 63 nt, Human
ccguccucucggcuuccccaugugugggcugggaccgcccacggggugcagaucuccuggcgu

SEQ ID NO: 56602 - RNA, 63 nt, Human
ugucuacccacacaaauccucaggaaaccaaccaccgcccagguggcccugagggaggcauuc

SEQ ID NO: 56603 - RNA, 63 nt, Human
acccaaagaagugaaggagaaagcagcugccucaccgcccagacauugauuuguucagauguu

SEQ ID NO: 56604 - RNA, 63 nt, Human
ggagcucaaagcaagugagcucaccuaccugccaccgcccaggaccagucugcccacugccua

SEQ ID NO: 56605 - RNA, 63 nt, Human
gacucuuccugcgaggucucagagcgcuguguaaccgcccaagggguucaccuugccugcugc

SEQ ID NO: 56606 - RNA, 63 nt, Human
cccuccugccacccaugcucaugugguguccccaccgcccacuuguuugaugucacugacugu

SEQ ID NO: 56607 - RNA, 63 nt, Human
ccccgccccggcgcuggucccgcccacccagacaccgcccacuucccggcccggggccugcac

SEQ ID NO: 56608 - RNA, 63 nt, Human
cugggcuccggcagggagaggugcaggggagucaccgcccagaccuccccagccaccaaccga

SEQ ID NO: 56609 - RNA, 63 nt, Human
acaguauucccacucuuaucuuacaacucccccaccgcccacucuccaccucacuagcucccc

SEQ ID NO: 56610 - RNA, 63 nt, Human
uguccaaggauucccguacagugacugugucucaccgcccacaacccuaucgcuggagcugug

SEQ ID NO: 56611 - RNA, 63 nt, Human
gugcuaggcugagggauguuuuuccucccccuuaccgcccaugcccuugaaagaaaagucacu

SEQ ID NO: 56612 - RNA, 63 nt, Human
guccuucugauacaguugaucagaccccugcccaccgcccaggccaggccuguggucaucaau

SEQ ID NO: 56613 - RNA, 63 nt, Human
gagagggugguguccugagucaaguccugccccaccgcccagcuccccccagaggccaccucg

SEQ ID NO: 56614 - RNA, 63 nt, Human
gugugaugggccaccggggcaagagggaaggugaccgcccagcucucccacaucccacuggau

SEQ ID NO: 56615 - RNA, 63 nt, Human
cgguaggagcucucccgguaccaguguccacagaccgcccaacacagaggcuuugaggcuucu

SEQ ID NO: 56616 - RNA, 63 nt, Human
ucuccgguucucccugugcccauccaccgguugaccgcccaucugccuuuaucagagggacug

SEQ ID NO: 56617 - RNA, 63 nt, Human
cauccccugccgugggggccacagccacaccucaccgcccaguccagcugucuccagaagggg

SEQ ID NO: 56618 - RNA, 63 nt, Human
ccaguggccuuagagggagccugcccugcccccaccgcccaccaccuccuccccuucauuccu

SEQ ID NO: 56619 - RNA, 63 nt, Human
gaguccggccuggccucccccaggaccgagaucaccgcccaguaugggcuagagcaggucuuc

SEQ ID NO: 56620 - RNA, 63 nt, Human
caaaacuuugacccagccacuguuagugucgccaccgcccauaaaggagcugagcccagcagg

SEQ ID NO: 56621 - RNA, 63 nt, Human
gaggcaccaugggcguggaggggcuucccggacaccgcccacccgggacccgccucuuccacc

SEQ ID NO: 56622 - RNA, 63 nt, Human
gaaagacauuauacgugggcuuggcccagccccaccgcccacgccuggguaguagcagugccu

SEQ ID NO: 56623 - RNA, 63 nt, Human
augagaaacccaaagcugagagagguguggggaaccgcccaaggucacccagcugugaaugaa

SEQ ID NO: 56624 - RNA, 63 nt, Human
cauccagcacugaccagcccugauuccccgaccaccgcccaggguggagaaggaggcccuugc

SEQ ID NO: 56625 - RNA, 63 nt, Human
augagguucccugcaacccccgcccuccagcccaccgcccaaccuuuuacaaauggcauuuuc

SEQ ID NO: 56626 - RNA, 59 nt, Human
ccuuccaaggccacguuugaccggagcucaccgcccagagcguggacagggcuuccgug

SEQ ID NO: 56627 - RNA, 63 nt, Human
aggggcccagugcaugagggcggcuccccagggaccgcccagaucccagcuuugagagaggag

SEQ ID NO: 56628 - RNA, 63 nt, Human
gugugugugucuugcacuccagagcugaccuccaccgcccagccugggaagucauuguaggga

SEQ ID NO: 56629 - RNA, 56 nt, Human
gcgauuuccugcgguggugacgucccaccgcccagcggcuugccugccugcucgcu

SEQ ID NO: 56630 - RNA, 63 nt, Human
agccuaccucugacagcgcggggcucacuaguuaccgcccaaccuggauccggcgcguguggc

SEQ ID NO: 56631 - RNA, 63 nt, Human
agucagaugaggcccugcaccuuccccaaaggaaccgcccagugcagguauuucagaaggaga

SEQ ID NO: 56632 - RNA, 63 nt, Human
acuccugcucucuggaggacggucaguccaugucucggagaaacgggugagcugagcuuggcg

SEQ ID NO: 56633 - RNA, 63 nt, Human
ggccuugccuggagacugggcuagcucuguaggcucggagagccuggggagggugccaacccc

SEQ ID NO: 56634 - RNA, 63 nt, Human
aggaggugagaggcuggggugccccaagcuucccucggagaagugagaggcucucccuggcua

SEQ ID NO: 56635 - RNA, 63 nt, Human
ggagaugguugcugccauugcugcugccucugccucggagaagcccacugccccuguuggcug

SEQ ID NO: 56636 - RNA, 63 nt, Human
uguuuugguguauugucagccaucguccugggacucggagacuauggccucgccuccccaccc

SEQ ID NO: 56637 - RNA, 63 nt, Human
gaagccccuccacguuugaaaaugcgccuccuccucggagacagacgcaucggugccaccuag

SEQ ID NO: 56638 - RNA, 63 nt, Human
gcucugccucaacuuuccuaggaaagagcccaccucggagauagcuacgguuuucucuggugg

SEQ ID NO: 56639 - RNA, 63 nt, Human
uguuuugaagcaugggccagacccggcacugcgcucggagagccggugggccuggccuccccg

SEQ ID NO: 56640 - RNA, 63 nt, Human
augggguggggaaggcaggcaugggguguggcccucggagaaguuaggagucccccagcucaa

SEQ ID NO: 56641 - RNA, 63 nt, Human
gcuggcugaggccugggaccacuuggccuucuccucggagagccugccugccugggcgggccc

SEQ ID NO: 56642 - RNA, 63 nt, Human
ucuuuuuggguccucagagaaaaugcccauuuucucggagaauucucugcacuccucucugcu

SEQ ID NO: 56643 - RNA, 63 nt, Human
cuccuccccacccgagccuggagcacucuaacccucggagacccccuaagccccguuccuccg

SEQ ID NO: 56644 - RNA, 63 nt, Human
gcuuucaguauuaaucuccaaacaucacugcugcucggagaaaccacauccccaggcauaaca

SEQ ID NO: 56645 - RNA, 63 nt, Human
cauaccaacacgagcaggcuacugucagcuccccucggagaagagcuguucacagccagacug

SEQ ID NO: 56646 - RNA, 63 nt, Human
cuggcuguagacaacauucuuuauauugccaaccucggagauagucggguauguggcucugga

SEQ ID NO: 56647 - RNA, 63 nt, Human
aggccacccuaaccucuguguucaggugaacagcucggagaagcugcagcugcaggagugcuu

SEQ ID NO: 56648 - RNA, 63 nt, Human
gguuagagggacaggccuaaucaacugaaacuccucggagaugccaucucugucucccugggu

SEQ ID NO: 56649 - RNA, 63 nt, Human
cuuagaagcacuccucgguacucccauaauccucucggagaaaaaaaucacaaggcaacugug

SEQ ID NO: 56650 - RNA, 63 nt, Human
uggcggagaaggccugggcccucccacuggucccucggagaucugcuggggcuaugggaaucg

SEQ ID NO: 56651 - RNA, 63 nt, Human
auguuggcugaaagcaugaacuugcagaacucccucggagacgcagguugcaguggacauugg

SEQ ID NO: 56652 - RNA, 63 nt, Human
gcagccuaccugguguccccuaccccaccuguucucggagaaccaaguugcuacacaggaagu

SEQ ID NO: 56653 - RNA, 63 nt, Human
accugucccgaggggacccuguccggguccuugcucggagaguacggccugauggcucugugc

SEQ ID NO: 56654 - RNA, 63 nt, Human
uuucccuccugggagagaaggagaucagggcaacucggagagggcugcgagcauuucccuccc

SEQ ID NO: 56655 - RNA, 63 nt, Human
ucucucucucucuguguuuccuccagcccuugucucggagacgguguuuuccucccuugcccc

SEQ ID NO: 56656 - RNA, 63 nt, Human
cccccuucgaccucuaaacagaucccuccucuucucggagaccucccuuuccaagccugccug

SEQ ID NO: 56657 - RNA, 63 nt, Human
ggggccgcacggagggcacagucuccugucaggcucggagaggucaggagaccgaccccacca

SEQ ID NO: 56658 - RNA, 63 nt, Human
agagcugugugcuccauagcguguagcuuuagacucggagaugagugcuuugacccagcgagg

SEQ ID NO: 56659 - RNA, 63 nt, Human
uucucuuccacuuuccugccacuccccacuacccucggagagagguggugggaugggagagag

SEQ ID NO: 56660 - RNA, 63 nt, Human
ggagcccgugguggcgguggcugccccggccuccucggagagcagcagcaccaaccacagcau

SEQ ID NO: 56661 - RNA, 63 nt, Human
cuccacucucuggguuuccuaggaauguccagccucggagaccuucacaaagccuugggaggg

SEQ ID NO: 56662 - RNA, 63 nt, Human
aaguauuaccauuuucagaugaggacacuaaaucucggagaacuuaagucauuuaccugaugg

SEQ ID NO: 56663 - RNA, 63 nt, Human
guugcgggacagaguagccagguucugccggugcucggagaagagcgcaguguuuugcaagug

SEQ ID NO: 56664 - RNA, 63 nt, Human
uccaucccaauccaguauaucaaucaacucuaacucggagacgucuagcuggcaauguuucua

SEQ ID NO: 56665 - RNA, 63 nt, Human
gacacagcgcgguuuuuuccacgcagcacccuucucggagacccauugcgauggccgcuccgu

SEQ ID NO: 56666 - RNA, 63 nt, Human
gugccucaggaucaccaggugcaggcccccacccucggagaugcugcugcagugagugguucc

SEQ ID NO: 56667 - RNA, 63 nt, Human
agauccuuuuuuguucucugaggucauaauuuccucggagaccuguuuaacaagcaaaaauca

SEQ ID NO: 56668 - RNA, 63 nt, Human
gugcccagaccccauuccacagcucugggcuuccucggagaccccuggggauggggaucuuca

SEQ ID NO: 56669 - RNA, 63 nt, Human
gagagggucuucguugcucagucagucaaguuccucggagaucugccucugccucaccuaccc

SEQ ID NO: 56670 - RNA, 63 nt, Human
cuuguuaaaaauucagccucccaggucccuccccucggagaggcugauucacugggucuggga

SEQ ID NO: 56671 - RNA, 63 nt, Human
aggacgcugcccuggcuucaggggcugugaaugcucggagagggucaacuggaccuccccucc

SEQ ID NO: 56672 - RNA, 63 nt, Human
uuaaacugaugucuuuucugccaccuguuaccccucggagacuccguaaccaaacucuucgga

SEQ ID NO: 56673 - RNA, 63 nt, Human
cccucuuuggccauacacuccaugccuagaugccucggagagcaucauucucugccuaggcaa

SEQ ID NO: 56674 - RNA, 63 nt, Human
gggcgugguggcgggcgccuguagucccagcuacucggagaggcugaggcaggagaauggcgu

SEQ ID NO: 56675 - RNA, 63 nt, Human
gaucgccuuccugcgcuccaugcugggaaagcucucggagaagaucgaccagcuagagaagag

SEQ ID NO: 56676 - RNA, 63 nt, Human
uugugcgagcucaauucacuuuguaagaaaacucucggagaaauaaaaucaauaaaaagcaaa

SEQ ID NO: 56677 - RNA, 63 nt, Human
aucaggguauuuguuccaccuuggccaggccuccucggagaagcuugucccccgugugggagg

SEQ ID NO: 56678 - RNA, 63 nt, Human
agguuuuucaagaguugguuuugcguuuccaaccucggagaauuccaggcacuccccuucccc

SEQ ID NO: 56679 - RNA, 63 nt, Human
cugccuccagccgcccgcgccagauuuugaaaucucggagacaaaacuaguacuguaagauaa

SEQ ID NO: 56680 - RNA, 63 nt, Human
uuagucacugccucccgaaguugcuugaaagcacucggagaauugugcaggugucauuuaucu

SEQ ID NO: 56681 - RNA, 63 nt, Human
ccaauuuccccuuuuccccuggcuaccaggaaacucggagacaaucuuuucagccucagcauu

SEQ ID NO: 56682 - RNA, 63 nt, Human
uacuugaaugucggggggccugggggugggggccucggagaccgucugccuggcccugcugcc

SEQ ID NO: 56683 - RNA, 63 nt, Human
caucucuguccccuccacccucacuccauccaccucggagaccacccucccccagccagauac

SEQ ID NO: 56684 - RNA, 63 nt, Human
cgggucucccggugcccgaaccgccgcuggggccucggagacuuggaggaggacgcucuggaa

SEQ ID NO: 56685 - RNA, 63 nt, Human
acagacccaccccagcccagggcccucacccaccucggagaggcguccccaccaucggaucca

SEQ ID NO: 56686 - RNA, 63 nt, Human
cucggguucuugggaggacacucauucuccaggcucggagacgaggggagaaguuugggguuu

SEQ ID NO: 56687 - RNA, 63 nt, Human
uugucgggggagaagacuuagacccuuuugggccucggagagguggcaugauuguggaucccc

SEQ ID NO: 56688 - RNA, 63 nt, Human
ccuuggugggcuggcccuggcuagcccuugggccucggagaugaucagaggugaagaaccgcc

SEQ ID NO: 56689 - RNA, 63 nt, Human
ccacagugugcucuggcugcugggagcccaucucucggagaaacccuguccacccaaccccga

SEQ ID NO: 56690 - RNA, 63 nt, Human
gcggggccacugcucugugcugacgggcuccgucucggagauucuuguccuguuuuuuuucug

SEQ ID NO: 56691 - RNA, 63 nt, Human
cugcaagggccucggcucagucgugugcacuuccucggagagccuugggcugccacguccacc

SEQ ID NO: 56692 - RNA, 63 nt, Human
acaaaaaugcuaagugggaucaagagagcagcacucggagaggguguuugccagucugagugu

SEQ ID NO: 56693 - RNA, 63 nt, Human
gcagccucagcccaucuggcagagucccaggaacucggagacuggcacagcugcuuugucugc

SEQ ID NO: 56694 - RNA, 63 nt, Human
uuccuugucccaggauggagcugauccaguaaccucggagacgggacccugcccagagcugag

SEQ ID NO: 56695 - RNA, 63 nt, Human
gagcguguucugccugagacccccgugagggcucucggagaaaguguguguauuccuuucuua

SEQ ID NO: 56696 - RNA, 63 nt, Human
gcuggcuaugcaagaggacgcggccccggggggcucggagaagcuuuacagagugccagggca

SEQ ID NO: 56697 - RNA, 64 nt, Human
aguccucaugacauaccgcaaauaucugugggguccuguugaaaagaacaaaauaaaggagccc

SEQ ID NO: 56698 - RNA, 64 nt, Human
gcuggaagaacuugguggccugggucccuggagcccuguugaaggagcuggugacauucugaug

SEQ ID NO: 56699 - RNA, 64 nt, Human
uuuaccauuaaucacuucucaauaaacgugagauccuguugagcaucacuucuaguaccauuua

SEQ ID NO: 56700 - RNA, 64 nt, Human
agagcuaauguacaugcuuucaaaagcuaaucugccuguugaugguaacuagguacagcgacuu

SEQ ID NO: 56701 - RNA, 64 nt, Human
aaguccccagcucaccuuaggggcucagcaggucccuguugaagggaggaaggggaggagagaa

SEQ ID NO: 56702 - RNA, 64 nt, Human
agauagggaaaaggggcuccuugcuccacagggcccuguugaauuuuguucucugggagaaaau

SEQ ID NO: 56703 - RNA, 64 nt, Human
aaugaagcaacacuugagcuguucaggccaguucccuguugaagaaacaguucccuguugaaga

SEQ ID NO: 56704 - RNA, 64 nt, Human
uguucaggccaguucccuguugaagaaacaguucccuguugaagaaaguagagccugacacugc

SEQ ID NO: 56705 - RNA, 64 nt, Human
cuuuuuuguaaaacauuuucaugucuuuaaaaugccuguugaauaccuggaguuuaguaucaac

SEQ ID NO: 56706 - RNA, 64 nt, Human
ucaauaaguacuuuuuagugauguggcagaaaucccuguugauucuaaguuuuagagugucuuu

SEQ ID NO: 56707 - RNA, 64 nt, Human
uuagcuggugaagaauauagagaaggaaccaaagccuguugagucauugaggcuuuugagguuu

SEQ ID NO: 56708 - RNA, 64 nt, Human
uccagcucugcccuugcccugccaagcucccugcccuguugaugcugaacuacagccuugggac

SEQ ID NO: 56709 - RNA, 64 nt, Human
gaaugacccagagucaaggccaagucugcagggaccuguugaaagccucgagaaugucuuggcu

SEQ ID NO: 56710 - RNA, 64 nt, Human
uaagacucgcuauauggggaagggugucucaaagccuguugagcccaucaauaaaacuauugca

SEQ ID NO: 56711 - RNA, 64 nt, Human
ugaaagguggggggugagucccacuugagcgcuuccuguugaauaaagcaggcacuugaccugg

SEQ ID NO: 56712 - RNA, 64 nt, Human
cagcagcaccaacaucugcugcuacucaaaauguccuguugaagagggacagcugugaugcccu

SEQ ID NO: 56713 - RNA, 64 nt, Human
cauggcucuuagcuaaccuauucaaagaccuuuuccuguugauuaaucuauuuucauauuuaua

SEQ ID NO: 56714 - RNA, 64 nt, Human
guucccaggaugccacuuccuccacgaauagcuaccuguugaagugauauucauuguugcugua

SEQ ID NO: 56715 - RNA, 64 nt, Human
caguguuaguguuccucaaaagucggaacaauugccuguugauauauuaauaagacauuaaagu

SEQ ID NO: 56716 - RNA, 64 nt, Human
gcucgacccccacuuccuuucuugugcuucguguccuguugacgguuacauuuguguauaauua

SEQ ID NO: 56717 - RNA, 64 nt, Human
aaauguuaacccucucauuagaucuacuaguuuaccuguugauucuauuguguuuucuauguaa

SEQ ID NO: 56718 - RNA, 64 nt, Human
gaagcccagccuuucagaaagagccuggcaaggcccuguugacuagcaauggccuuagcugucc

SEQ ID NO: 56719 - RNA, 64 nt, Human
cucauuugagaucaugguagguuaagaaaauaugccuguugaugaaagcuaaaagcaaauuuau

SEQ ID NO: 56720 - RNA, 64 nt, Human
uauccaggaaaaaauggaacagugcacucuucucccuguugacccauguccaccuauugguucc

SEQ ID NO: 56721 - RNA, 64 nt, Human
cauuuauugggcaguugggaaaucagcucucuguccuguugaguguuuucagcagcugcuccua

SEQ ID NO: 56722 - RNA, 64 nt, Human
aaaccucacuugaaggcccaggucaacaucuaagccuguugagacuuagauaaucgagucuacc

SEQ ID NO: 56723 - RNA, 64 nt, Human
ugugagcacaggcauuugugucuggucuguccucccuguugauuggucuggcauuuccgguauu

SEQ ID NO: 56724 - RNA, 64 nt, Human
acauauauauuuauacacauacaauuuauguuuuccuguugaauguauuuuuaugagauuuuaa

SEQ ID NO: 56725 - RNA, 64 nt, Human
ucagcagcugccugcuuuucugugauguauguauccuguugacuuuuccagaaauuuuuuaaga

SEQ ID NO: 56726 - RNA, 64 nt, Human
gugaagcugagagagaaucuuggaaacacacauaccuguugaucaugggcccugcagaauuggc

SEQ ID NO: 56727 - RNA, 64 nt, Human
gaccuuacuugucuugcauaacugaagcuuuauaccuguugaacaacucuccauuucccuggcc

SEQ ID NO: 56728 - RNA, 64 nt, Human
aucugaacuuugcacgucugccgaaaaauccgaaccuguugacugggauuuuuaagaauccguu

SEQ ID NO: 56729 - RNA, 57 nt, Human
acggaaaauggagccauugaugcuguuccuguugaugaaaaucuuuucacuggagag

SEQ ID NO: 56730 - RNA, 64 nt, Human
ggcuugucagggggauaacuaccagaaagguauaccuguugagacugauucagaggagcaaccc

SEQ ID NO: 56731 - RNA, 64 nt, Human
ugcuccacaggaauggcuucugacaauaaucuguccuguugauuuuguuuuccuugcccaugac

SEQ ID NO: 56732 - RNA, 64 nt, Human
gguugcacuuucauuugcuuuaguucuagaaucaccuguugacuccucagacuucaccuaacuu

SEQ ID NO: 56733 - RNA, 64 nt, Human
ccuaacaaagaagucugucuaagacaguacaucuccuguugaacuugcaucuuuccacaggacu

SEQ ID NO: 56734 - RNA, 64 nt, Human
aggcaggccugagcgaauacaaguuuagcuugucccuguugaguaaguagggcaugcuacaaug

SEQ ID NO: 56735 - RNA, 64 nt, Human
cugccccguuauuacuauaccaggucguacauuuccuguugaucaauuuuuuuuggaagaugca

SEQ ID NO: 56736 - RNA, 64 nt, Human
uuauaagggaaugccuuuaaaagcacccaagucaccuguugaacacuuugcugcuuagaaauuu

SEQ ID NO: 56737 - RNA, 64 nt, Human
ucgaccucucccgcuguguggcgucccccucccaccuguugaauacauagggauggcucucuca

SEQ ID NO: 56738 - RNA, 64 nt, Human
aacauggaacucuagggauagucaccuuuuaaauccuguugaaaagccauguuuaagauuuaau

SEQ ID NO: 56739 - RNA, 64 nt, Human
ggaaaugaaagaaaggccagcaaauucgcugcaaccuguugauagcaagugaauuuuucucuaa

SEQ ID NO: 56740 - RNA, 64 nt, Human
gaguagauucugcuaucuuggccucacagcccuuccuguugauuacaaagcccguggaagaaaa

SEQ ID NO: 56741 - RNA, 64 nt, Human
uuuaaacuacugaacuguuaccuagguuaacaacccuguugaguauuugcuguuuguccaguuc

SEQ ID NO: 56742 - RNA, 64 nt, Human
ugaagcugaguaauuuucggucacagggcaggccccuguugaaauuucauuuguccugcucugg

SEQ ID NO: 56743 - RNA, 64 nt, Human
caagccagcuuacuagcacuuugagaaugagucuccuguugagcugguaggauguaagccugga

SEQ ID NO: 56744 - RNA, 64 nt, Human
cuuaaaguugccugcaggaaugaagcaugacauaccuguugagggacuaggggaguggugggga

SEQ ID NO: 56745 - RNA, 64 nt, Human
ggcaaucauaaaaaguaauaaagguucuuuuugaccuguugacaaauguauuuaagccuuugga

SEQ ID NO: 56746 - RNA, 64 nt, Human
guugacaaauguauuuaagccuuuggauuuaaagccuguugaggcuggaguuaggaggcagauu

SEQ ID NO: 56747 - RNA, 64 nt, Human
auuugccccuccauguaggagcugggccuagggaccuguugaacucucucagcugagucagggg

SEQ ID NO: 56748 - RNA, 64 nt, Human
aaauugguguggauuucauggccauaguacuuuaccuguugaacucuugugauuucacaagauu

SEQ ID NO: 56749 - RNA, 64 nt, Human
cuuuucacagugcugugaccuuuucuggaauccaccuguugagaugcuuuauagccaguguaac

SEQ ID NO: 56750 - RNA, 64 nt, Human
aaauggugugagacgaaugggcucuggacauaugccuguugauuugagaagaaaucuggcuggu

SEQ ID NO: 56751 - RNA, 64 nt, Human
accacccuaccagccccuauuugcuucagguuauccuguugagggugggugggaagagugagaa

SEQ ID NO: 56752 - RNA, 64 nt, Human
aguacuagguugccuuuuuggcaauuuuuauugaccuguugaaucuugacuauaaaaugaucug

SEQ ID NO: 56753 - RNA, 64 nt, Human
uuguucaagccugaguggcagccgcucuugcucaccuguugaggaagggcuggcucacugucca

SEQ ID NO: 56754 - RNA, 64 nt, Human
uuacguuaggcuuucuguuaauagugguuuuucuccuguugacagagccaccggauuaugacac

SEQ ID NO: 56755 - RNA, 64 nt, Human
gaaaggcuuugggccugagagguuaaggccacagccuguugacaccuguuuugguccugcgacc

SEQ ID NO: 56756 - RNA, 64 nt, Human
cacgcucuaaggccguuuuuuccuuagccagaccccuguugauagaccagauacuugagggcaa

SEQ ID NO: 56757 - RNA, 64 nt, Human
uuacagaaaauaccaccucgagaugggugcugguccuguugaucccagucucugccagaccaag

SEQ ID NO: 56758 - RNA, 64 nt, Human
auaaagaccugauagcagaauaaauugguguuucccuguugacccagcaccauuucugugggcc

SEQ ID NO: 56759 - RNA, 64 nt, Human
gcacacagguguuggugauggggcuguugagaugccuguugaagguacaucguuugcaaauguc

SEQ ID NO: 56760 - RNA, 56 nt, Human
aggucgcugucaagggcugacuccucccuguugacgaagucucuuuucuuuagagc

SEQ ID NO: 56761 - RNA, 64 nt, Human
ggcaaaucuuucugcaugaccaaagugauaaauuccuguugaccuucccacacaaucccuguac

SEQ ID NO: 56762 - RNA, 64 nt, Human
cuguugcauuuucugaccuacuauuuuuaaaauuccuguugaguuucuuuguguuuacaaggaa

SEQ ID NO: 56763 - RNA, 64 nt, Human
gugagagcucugucagugacaaacacuccuuuggccuguugaauuugcugaagaacaucaccua

SEQ ID NO: 56764 - RNA, 64 nt, Human
aguaaggccaggugcuacuauaaaaucauauauuccuguugaaguucuuuugaaguccuaucuc

SEQ ID NO: 56765 - RNA, 64 nt, Human
gaaauagauuacacaucaagugaaaaauauuccuccuguugauauugcugcuuuuggaaguucc

SEQ ID NO: 56766 - RNA, 64 nt, Human
gcauuuucauaaaaucuaggacuaucuuaaauggccuguugacuucugacuaucuguaacauca

SEQ ID NO: 56767 - RNA, 64 nt, Human
uggggaaacccuccaccuccuugcaggcuuguugccuguugaaagaaggaaaaagacacggcgc

SEQ ID NO: 56768 - RNA, 64 nt, Human
auggacacaugauggggaacaacacacacuggggccuguugagggcagggagucggcagagaga

SEQ ID NO: 56769 - RNA, 64 nt, Human
uuuucucuguggcccaaacuugugggucacaaacccuguugagauaaagcuggcuguuaucuca

SEQ ID NO: 56770 - RNA, 64 nt, Human
augaaaugauagguaaggagaagcuggauuaucuccuguugagagcaagagauucguuuugaca

SEQ ID NO: 56771 - RNA, 64 nt, Human
uugguaacuaggauccuagggagggaaauguuugccuguugaacuucuuucuguuaugagagga

SEQ ID NO: 56772 - RNA, 64 nt, Human
aaugccauuaucccagacagcaucagcagaugcaccuguugacagccugcuaggugaugguuua

SEQ ID NO: 56773 - RNA, 64 nt, Human
uagccuguaccuguuaucaauauaaaauaaucuuccuguugaaugcuucaugacuugaauucua

SEQ ID NO: 56774 - RNA, 64 nt, Human
caugaaauggaaaagagaguuccaaaaaagaagaccuguugauacugaauaugagaacauuaca

SEQ ID NO: 56775 - RNA, 64 nt, Human
agcacauguauuguaaaugucccaggaucagagaccuguugaauuugagugggugucuccucaa

SEQ ID NO: 56776 - RNA, 64 nt, Human
ccuuuuucuucuugagcgaagcuguuugaguaaaccuguugaagaguguuugugucuuuugugc

SEQ ID NO: 56777 - RNA, 64 nt, Human
aauguaccucggugaggaggcacagauuuugccuccuguugaccagccugguuucauaccgaaa

SEQ ID NO: 56778 - RNA, 62 nt, Human
gucaagaaucauggaaguaaacaucugagaaaccuguugaagauuauuucauucgucuuguu

SEQ ID NO: 56779 - RNA, 64 nt, Human
uuauuucagauaauuggagaguaaaauguuaaaaccuguugagaggaauugaugguuucugaga

SEQ ID NO: 56780 - RNA, 64 nt, Human
ucuuauuuaaaauuucccccauggaaaucacucuccuguugacuauuuccagagcucuaggugu

SEQ ID NO: 56781 - RNA, 64 nt, Human
gaaaaacgaagcugucuuagagugggaccaacuuccuguugauguucagaauggauuuaucaga

SEQ ID NO: 56782 - RNA, 64 nt, Human
uucaagguuucuuacuugacaguuccuacacaacccuguugaaaaucuacaauauaugcugcau

SEQ ID NO: 56783 - RNA, 64 nt, Human
acacaggguagcugcuguugcucuugcucucaccccuguugacaccaguaagucugugucuccc

SEQ ID NO: 56784 - RNA, 64 nt, Human
cuccuccaggaaccuccacaucuccaaaaaucucccuguugacucagugccuccucggcuuccu

SEQ ID NO: 56785 - RNA, 64 nt, Human
aagagauacuuacauggaaaccugacaaugcaaaccuguugagaagauccaggagaacaagaug

SEQ ID NO: 56786 - RNA, 64 nt, Human
cagucguggcccugggaaggggaaauaagaaggcccuguugacgggcugucuuggcucuggaau

SEQ ID NO: 56787 - RNA, 63 nt, Human
ugacuuauguuuauuacuaaauaaacuucaaacuccuguugaacauuguguauaacuuagaau

SEQ ID NO: 56788 - RNA, 64 nt, Human
aaggaucacuguaggugguuguggaguugacaccccuguugacuccuucccagcugauugucag

SEQ ID NO: 56789 - RNA, 64 nt, Human
caucucgucaacuuuuuugauauagugcauugcuccuguugaauguuuuuugacuacuuuuuau

SEQ ID NO: 56790 - RNA, 64 nt, Human
gagccaacaacaguauuuuaagggucacuugccuccuguugacacaauuguugcuaaaucaaaa

SEQ ID NO: 56791 - RNA, 64 nt, Human
aacuugcguacucagcacagcaguggagaguguuccuguugaaucuugcacauauuugaaugug

SEQ ID NO: 56792 - RNA, 64 nt, Human
guuuuuuuugguuggaauuuugaaacauuuuguaccuguugauuuuauuuaucaguuuauuuuu

SEQ ID NO: 56793 - RNA, 64 nt, Human
guggcugagccccugucuagagagggaggcaagcccuguugacacaggucuuuccuaaggcugc

SEQ ID NO: 56794 - RNA, 64 nt, Human
uuaggcccuggaugaguagcgcuauaguuacuguccuguugauuaauuucugccauuucauguc

SEQ ID NO: 56795 - RNA, 64 nt, Human
guggugagauacaaaaagguuuuagaaucacugcccuguugagagaaauuagggggaaaugauu

SEQ ID NO: 56796 - RNA, 64 nt, Human
uuccaaagaacuccaccaggaauuccugugacggccuguugauaugagcucccaguugggaacu

SEQ ID NO: 56797 - RNA, 64 nt, Human
auaauuaaaugaucuguucuucuacuucacucuuccuguugaaaaacugugugauuuuuuuuuu

SEQ ID NO: 56798 - RNA, 64 nt, Human
gucaugcacauuucagcuugcgucuaucaugauuccuguugagagggcuuucauugucugacuc

SEQ ID NO: 56799 - RNA, 64 nt, Human
aucauccugauccuauuuuaccuggccuccagggccuguugaugggcuuugcaggcaguccagc

SEQ ID NO: 56800 - RNA, 64 nt, Human
uaugccaauuuugugacuguuaccaugugaaaguccuguugaaaugaacaauugucugccccac

SEQ ID NO: 56801 - RNA, 64 nt, Human
gcugggacuuuccauuacaaauagagacuucauuccuguugagucuaguuggaauuuuuaguau

SEQ ID NO: 56802 - RNA, 64 nt, Human
uacugucaguucacagugaaccuucccuccuuuuccuguugacuuucccacacuccuguaaccc

SEQ ID NO: 56803 - RNA, 64 nt, Human
ugucguauugcuuuacagccacaacacuuggauuccuguugauuaacuucuccauucucuuaag

SEQ ID NO: 56804 - RNA, 64 nt, Human
gaauuugaaaccccccauuuuuucuuuucaccacccuguugagcaauuuucccaaaaaaagggc

SEQ ID NO: 56805 - RNA, 64 nt, Human
agaggaaaagagucggagggguagacccugcagcccuguugagaagaaagauuccagugaaguu

SEQ ID NO: 56806 - RNA, 64 nt, Human
cacauuucauagaauacagguuuucaagcaaaccccuguugaccaugcccuaauuuccuauuga

SEQ ID NO: 56807 - RNA, 64 nt, Human
caccccguuuuuugucccuccguuugaucaccucccuguugaguauggaaugucccaguuuaau

SEQ ID NO: 56808 - RNA, 64 nt, Human
aauguaaaggggacagcucaggguuguuuuggagccuguugacuuuguaucucugccugugauu

SEQ ID NO: 56809 - RNA, 64 nt, Human
uauuaagccuccaaucuuuaaaaguaucgguuugccuguugagcacacuccugcaagccaaaca

SEQ ID NO: 56810 - RNA, 64 nt, Human
uucaccuuagaaguuuagcacacgcccuucaaaaccuguugaauaauuugauuggcaaauacua

SEQ ID NO: 56811 - RNA, 64 nt, Human
cuucauucuaauguccucaacuguuaccaaauacccuguugacucccaaaccuaagauuuuagc

SEQ ID NO: 56812 - RNA, 64 nt, Human
cgucggccaaccuccccaacagcacuuagguuuuccuguugagaugggggacugagagacagga

SEQ ID NO: 56813 - RNA, 64 nt, Human
cuguucacuguggugggaaagaucacacuacaugccuguugauuggcucagucacucugugucu

SEQ ID NO: 56814 - RNA, 64 nt, Human
ccccucaccuuucccugaggaguguguuguuuucccuguugaaaaaaguuacaaaaauaaaucu

SEQ ID NO: 56815 - RNA, 50 nt, Human
ccauggccaucaaaagcuaaccuguugacuggcauccauaagugugccuc

SEQ ID NO: 56816 - RNA, 64 nt, Human
agauuuggcuucugguauguguuucugauugcuuccuguugagcacaaagugagagcugccacu

SEQ ID NO: 56817 - RNA, 64 nt, Human
ggaguccaugguguccaggcaucggggcgucacaccuguugaggagugggguggcuuugaaugc

SEQ ID NO: 56818 - RNA, 64 nt, Human
agucuugcuuaguuccuucgugcagcuucuugccccuguugacguggaaugcugugucugcuuu

SEQ ID NO: 56819 - RNA, 64 nt, Human
uuuuuuuuauccuuuucuaguucaguuaauucauccuguugaauugcaccaucgugaaagaugg

SEQ ID NO: 56820 - RNA, 64 nt, Human
uggcuuucuaaaaaucucuuuuuagauuauuucuccuguugaacauaguaaaacuauugaauuu

SEQ ID NO: 56821 - RNA, 64 nt, Human
acucccucuguaucaucucaggagguuucaggggccuguugacaugaaguuucgaaguuucaug

SEQ ID NO: 56822 - RNA, 64 nt, Human
ugcagugagccgagaucacgccacugcacuccagccuguugacaaagcaagacucugucucaaa

SEQ ID NO: 56823 - RNA, 64 nt, Human
gaauucagccuucauuuauaaucagugagauuccccuguugaagaaacuaaauuuuauauaggu

SEQ ID NO: 56824 - RNA, 64 nt, Human
acuugauuugguuaauuacccucuuuuugaaaugccuguugaugacaagaagcaauacauucca

SEQ ID NO: 56825 - RNA, 64 nt, Human
uggccuagauguugguuugggaauauuaggugauccuguugagauucuggauccagagcaauuu

SEQ ID NO: 56826 - RNA, 64 nt, Human
auagacaaugagcugcgaaaagacuccugguuccccuguugauuugugagggccaaguuugcua

SEQ ID NO: 56827 - RNA, 64 nt, Human
uugucccagucagaaauaaaauuugauaaacauuccuguugaugggaaaagcccccaguuaaua

SEQ ID NO: 56828 - RNA, 64 nt, Human
auuuuuguaaugguagcuuuuucuacaucuuacuccuguugaugcagcuaagguacauuuguaa

SEQ ID NO: 56829 - RNA, 64 nt, Human
cuucugccacugccuuuccagacucuuaccacugccuguugauuaaaucuaacucuucaacauc

SEQ ID NO: 56830 - RNA, 64 nt, Human
agaaaguauuuuaucagauguuuaaaaaucucugccuguugauucauaagggauauagacagua

SEQ ID NO: 56831 - RNA, 64 nt, Human
cauaugccuaucuuacaauuugauuaucuauucaccuguugaugaauguuugaauuuuuuccau

SEQ ID NO: 56832 - RNA, 64 nt, Human
caagaaaagagcgguacuuuacaugauuacuuuuccuguugauuguucaaauauaauuuaagaa

SEQ ID NO: 56833 - RNA, 64 nt, Human
ugacccacaggucuuuuggcgaguuugcuauuugccuguugaaauacuuguuucaacuuagaga

SEQ ID NO: 56834 - RNA, 64 nt, Human
aggguccccugcauggcugagagggugugggugcccuguugaccuacccuggaccgaguggacc

SEQ ID NO: 56835 - RNA, 64 nt, Human
cugggaacagccagcucccgagcacagccgcacuccuguugacccuggaucccacccuuugagc

SEQ ID NO: 56836 - RNA, 64 nt, Human
uauaaggguuuagcuguggcgcagugaugcauggccuguugacacuugaaaaugccagucuuuu

SEQ ID NO: 56837 - RNA, 64 nt, Human
ucuuaaccuucuauuugaccucugcgcauuuggcccuguugagcacucuucuugaagcucuccc

SEQ ID NO: 56838 - RNA, 64 nt, Human
gggcagaugccuaauuucgcacaaugcaugcccaccuguugaucuaaggggccgcgauggucag

SEQ ID NO: 56839 - RNA, 64 nt, Human
cuaaaacagagcaaacugaagaccaaauuauucuccuguugagguccguggauggcagauuuaa

SEQ ID NO: 56840 - RNA, 64 nt, Human
uuuuuuccaaauuggcuaauggaucaaaaugaaaccuguugaugugaauucaguuauugaacuu

SEQ ID NO: 56841 - RNA, 64 nt, Human
agcuagagauaaaacagaaucuucuggguaguccccuguugauuaucuucagcccaggcuuuug

SEQ ID NO: 56842 - RNA, 64 nt, Human
aguacagccacccacugacaucugaauuuauauaccuguugaguuuugagugcacccaaacacu

SEQ ID NO: 56843 - RNA, 64 nt, Human
uaaugccucagagucuucacacuguggagaagggccuguugacauccugaauguucaauaacua

SEQ ID NO: 56844 - RNA, 64 nt, Human
uuuugguaaugagugaguucucacuguauuagauccuguugaaaauugauuguuaaaaagaccu

SEQ ID NO: 56845 - RNA, 64 nt, Human
agucugaaccuauuucuuaaacacuugcaaccuaccuguugagcaucacagaaugugauaagga

SEQ ID NO: 56846 - RNA, 64 nt, Human
auugaaaccauuccaguaggaaaucaggcaguucccuguugaaaguugucuggcuuuuugcacg

SEQ ID NO: 56847 - RNA, 64 nt, Human
uuaucugguagcaaacugguucuuucggagccauccuguugaucaugcagcuccaccaaaccuu

SEQ ID NO: 56848 - RNA, 64 nt, Human
gcauuuucuuucuuuuuucucugaccaccugcagccuguugaaggacuacagguauuuucauca

SEQ ID NO: 56849 - RNA, 64 nt, Human
uucugcucuucccucccggcucugcccugcacauccuguugagccaagccccagugacccggag

SEQ ID NO: 56850 - RNA, 64 nt, Human
ugacucuugcuugauauaucaaucuuagacauuaccuguugacucccuguugucauacaugagg

SEQ ID NO: 56851 - RNA, 64 nt, Human
uuuaguuuuauauuguguuuuccacuaguauaucccuguugauuuguuugugccuuuuauuaac

SEQ ID NO: 56852 - RNA, 64 nt, Human
acuuuuuguuguuuaauguguagcuuguuugugcccuguugacauaaauguuuccuggguuugc

SEQ ID NO: 56853 - RNA, 64 nt, Human
cccauugaucaccuugugcccucuuuuggggcagccuguugaaacugaagcacagucugaccac

SEQ ID NO: 56854 - RNA, 64 nt, Human
cccaagcugggcccucuucuacucuccauuuaggccuguugauaacuccauuacccgcccauca

SEQ ID NO: 56855 - RNA, 64 nt, Human
agguugccacagugcauggacccaauuguguuugccuguugacgugccaucagugcgugaugug

SEQ ID NO: 56856 - RNA, 64 nt, Human
accgggcuuguaauagcgguucuugucuccauagccuguugaguguucccagaugugacucacc

SEQ ID NO: 56857 - RNA, 64 nt, Human
gauuccugcuaggugaugccaggaaucucaaugaccuguugauuagagggucucuggucauuuc

SEQ ID NO: 56858 - RNA, 64 nt, Human
ggccuaaagagaaguauccaugagggucaaacuuccuguugaacuuccuauguucuuucucaag

SEQ ID NO: 56859 - RNA, 64 nt, Human
cccacuuugugagagccagcccuguaugccaacaccuguugagccaggagacagaagcugugag

SEQ ID NO: 56860 - RNA, 64 nt, Human
guuuuuuuucguuguuguuuuuuacacuucuuaaccuguugaucuauuugaggucuuuuguguu

SEQ ID NO: 56861 - RNA, 64 nt, Human
auuugaggagccgucuuucuuggccugagcuaugccuguugaggcaucuggagacugagaaaga

SEQ ID NO: 56862 - RNA, 64 nt, Human
auauguuuuccugugaaauuaucuaagagaauuuccuguugagauauaaaggcccaucugauca

SEQ ID NO: 56863 - RNA, 64 nt, Human
agaguaaaauggccugugcugcucagaaugccagccuguugaagauaaacaacaaaaaugcauu

SEQ ID NO: 56864 - RNA, 64 nt, Human
caaugacaucugcuguaauuuugguugcuuuugcccuguugaucugccggagucuugaaauuca

SEQ ID NO: 56865 - RNA, 64 nt, Human
caugagaaggaagcucaguacuucccacagugucccuguugauaacuguuuuuauuaacugaau

SEQ ID NO: 56866 - RNA, 64 nt, Human
acuguuuuuaaacccaaguaaagacugcuugaaaccuguugauggaaaugacuuaugcauacuc

SEQ ID NO: 56867 - RNA, 64 nt, Human
uacuuguaaucuacaauuggcuuuuuaaaaauaaccuguugauauauaauugucaguccaaaug

SEQ ID NO: 56868 - RNA, 64 nt, Human
ugagugaugcuucccuuccuaaggcugaccaagaccuguugauccuuuuagauuaaaaauaaaa

SEQ ID NO: 56869 - RNA, 64 nt, Human
uguuggcaaccacuucuaguaagcuacugauuuuccuguugacaaaaucucuuuagucuugaag

SEQ ID NO: 56870 - RNA, 64 nt, Human
ggccaaggagcugccucuacugcucccacguguuccuguugaaaaacaaaggacuuuccacugg

SEQ ID NO: 56871 - RNA, 64 nt, Human
cucgugccaguuuggaagugacccuucuauuaggccuguugaagggcccuccuguagguuucau

SEQ ID NO: 56872 - RNA, 64 nt, Human
agagacccgcccccucacacacaaacacacauguccuguugaacucaugcacgcacacccacgu

SEQ ID NO: 56873 - RNA, 64 nt, Human
gucaucuguguguuuuuaaggccagccacuugucccuguugaggccuggcuauggaacuaaaua

SEQ ID NO: 56874 - RNA, 64 nt, Human
uauuccgggaaagagaauuauaguuuuuaugccuccuguugaauaaaugguguccugauugccu

SEQ ID NO: 56875 - RNA, 64 nt, Human
uugcccucguuaaagaggguccuguuccucucuuccuguugaugaaggagcgugaggguguuag

SEQ ID NO: 56876 - RNA, 64 nt, Human
aguuguugguuguuccucaaaacagguuguggcuccuguugaauaagaugauccauuaaaaacu

SEQ ID NO: 56877 - RNA, 64 nt, Human
cauuaacguuugcuacuuagugauuuuuguuuuuccuguugauauuuugagcaaaacaaucauu

SEQ ID NO: 56878 - RNA, 64 nt, Human
ucuccuccaaaaccagggaaucagagcagucaggccuguugacucuaagcagcagacauccuga

SEQ ID NO: 56879 - RNA, 64 nt, Human
ccugucuugaugauuuuugguuuuuuuucauuguccuguugaaaucaaguaauuaaacauuuaa

SEQ ID NO: 56880 - RNA, 64 nt, Human
auuggagccgguguaauuccucccuaagaggcaaccuguugaauuuacucucucagaguaaaug

SEQ ID NO: 56881 - RNA, 64 nt, Human
uaauguaugacgcuccacuguggauaucuaaugcccuguugagaguagccuugcucaguacuaa

SEQ ID NO: 56882 - RNA, 64 nt, Human
cauccuguguaauuggagcagggcacacuugcuuccuguugaguuaacucagagguuaagucca

SEQ ID NO: 56883 - RNA, 64 nt, Human
gcuggguucccugugggcauuugcuuaguaaaugccuguugaugguuuuugcaagagaauucag

SEQ ID NO: 56884 - RNA, 64 nt, Human
cccagacuuguguucucuugcgucccuuggacugccuguugauugauggaaagugucugcacug

SEQ ID NO: 56885 - RNA, 64 nt, Human
aaacgagccagugacugaaacacccugguggaaaccuguugacagaccuuccacuuucucuuca

SEQ ID NO: 56886 - RNA, 64 nt, Human
agguaauuguguguggggaaaagugcaguauuuaccuguugaauucagcaucuugagagcacaa

SEQ ID NO: 56887 - RNA, 64 nt, Human
gcuguguuucuguaugguauugcacuugucccggccuguugaguuugguggggauugugaccag

SEQ ID NO: 56888 - RNA, 64 nt, Human
gguaauaugucacuggaguaauuacgcuguaauaccuguugagaauucauaccaucugaugcuu

SEQ ID NO: 56889 - RNA, 64 nt, Human
auaaaucaaaguaauaaguuuaacguauauuaaaccuguugaaaugauaauuauguaaagauaa

SEQ ID NO: 56890 - RNA, 56 nt, Human
aaacuacugucauguacugaaucuuuccuguugaagaaauccauguuauagaaaag

SEQ ID NO: 56891 - RNA, 64 nt, Human
uuuuuuuagagagagguuuaaacuacugauuuuuccuguugauucaaauagacuaaugggguga

SEQ ID NO: 56892 - RNA, 64 nt, Human
gacucaagucuguauguacacuggggagaagcagccuguugaguaagaugagagagaugacagu

SEQ ID NO: 56893 - RNA, 64 nt, Human
gaugccagcagcugcagcaagcagguuuuuccucccuguugagcaagacaggugagcaagauag

SEQ ID NO: 56894 - RNA, 64 nt, Human
aaacccuagggagcagugcuuuuggguccuagaaccuguugaguuucuaaugaauauuuguaga

SEQ ID NO: 56895 - RNA, 64 nt, Human
auugaagauccagcugccuauugauuuaagcuuuccuguugaaugacaaaguaugugguuuugu

SEQ ID NO: 56896 - RNA, 64 nt, Human
ugagucuucagggcagugucuccaugaggguuuuccuguugaggggcaccacauacaauagugu

SEQ ID NO: 56897 - RNA, 64 nt, Human
uguuuugugcaugaguaguacuuguguugauacuccuguugauguuaaauuacuauauaauaua

SEQ ID NO: 56898 - RNA, 64 nt, Human
uuuuccauucgcaugaacaaugggagcacauagcccuguugaccugcccgauccagauucccag

SEQ ID NO: 56899 - RNA, 64 nt, Human
gguacaguaacacgaaugagcauacagagcaacaccuguugagccagggaguaggugacacaag

SEQ ID NO: 56900 - RNA, 64 nt, Human
cauuuauugguuaaugcucuaguuucaaaaccacccuguugaaaguuccaguuauuuauaugcc

SEQ ID NO: 56901 - RNA, 64 nt, Human
cacacaagguguuguugcaauggcaugacggugaccuguugacguaacuaagccuuacagcaag

SEQ ID NO: 56902 - RNA, 64 nt, Human
cggggucccugggcuggcagagaagguuugugucccuguugaggagccacucugccagucuuug

SEQ ID NO: 56903 - RNA, 64 nt, Human
cagaacuauugcuguucucucccuuucuucaugcccuguugaacucuccuaccagcuucucuuc

SEQ ID NO: 56904 - RNA, 64 nt, Human
gaaaauauguaaauucuauugagcaaaauucuguccuguugaaacuuaguucuaaagguuuuga

SEQ ID NO: 56905 - RNA, 64 nt, Human
agggaccguuucccauaauuugggccuaugcuauccuguugauuuuuaugucuagcuuaaaagg

SEQ ID NO: 56906 - RNA, 64 nt, Human
gacauucaaaaccuuuuucuucccgaucugaaccccuguugacuaaucuugccuggguuugugu

SEQ ID NO: 56907 - RNA, 64 nt, Human
gauucauaauaauggcaacggccuaggaucaguaccuguugaaaaaaacugguucuccaccccu

SEQ ID NO: 56908 - RNA, 64 nt, Human
ccuuguaccggauuauucuacuccugcaaugaacccuguugacaccggauuuagcucuugucgg

SEQ ID NO: 56909 - RNA, 64 nt, Human
ucuuaguuccagaaaaaucaguaaaugcacaugcccuguugauuggagaucaguagugucaucu

SEQ ID NO: 56910 - RNA, 64 nt, Human
uuugaauacuacaucagauuuagaugcacgacuaccuguugacuuguuuuauaauugcuacuga

SEQ ID NO: 56911 - RNA, 64 nt, Human
cacaagcuggauucccacuucuuaccucauggagccuguugaggaaggauugagcugaugacuu

SEQ ID NO: 56912 - RNA, 64 nt, Human
ugucguccacgggcgggggcaugguaacagugguccuguugaugucaccgaugaugcugagcgc

SEQ ID NO: 56913 - RNA, 64 nt, Human
acacagauuauguuccugcuguauuuccugcuucccuguugaauuggugaauaaaaccuugcuc

SEQ ID NO: 56914 - RNA, 64 nt, Human
auugugcccacccagggaaggugcugaaugggacccuguugauggccccaucuggauguaaauc

SEQ ID NO: 56915 - RNA, 64 nt, Human
gaauccuagggggaaauuggggauugugucuuucccuguugaaaauguuuggaugggaauaaau

SEQ ID NO: 56916 - RNA, 64 nt, Human
cacuacaguggucgcacauguuccucuuccuguuccuguugacaugucguuguuuaaauaaauc

SEQ ID NO: 56917 - RNA, 64 nt, Human
aggucaaguuguuugucaaugauuugucagagaaccuguugaaaugugaauuaagaagcuaaga

SEQ ID NO: 56918 - RNA, 64 nt, Human
gcagcaaaaucaaggagugacuuuuguccccucuccuguugacccugguuuagagccguuaacc

SEQ ID NO: 56919 - RNA, 64 nt, Human
ccuuccccagccucuucuagagccgugaugccucccuguugaagcucuggugacaccagccuuu

SEQ ID NO: 56920 - RNA, 64 nt, Human
ccagucaccaaagccaccuacaugacaguccaucccuguugaauuaauaaauuaauguauccau

SEQ ID NO: 56921 - RNA, 64 nt, Human
cuuagaagagauacaaguuguuaauaaaauugauccuguugauaguaguuuguuuuuguggugg

SEQ ID NO: 56922 - RNA, 64 nt, Human
ugacugcagccaucgguaaauaaaaguuuuugauccuguugaacccgccugagacggugcugug

SEQ ID NO: 56923 - RNA, 64 nt, Human
ucugugaaguggcuuuacgcuucaggaagccacgccuguugaauaaagcuuugguguguuugca

SEQ ID NO: 56924 - RNA, 64 nt, Human
uggcugugguuuuuuccccuuuuuaaucuaacugccuguugacauugacacucaucacgguugu

SEQ ID NO: 56925 - RNA, 64 nt, Human
cagugcuuuccaguaucuugaacucuucggggguccuguugacccauuucgugaccuaccuccg

SEQ ID NO: 56926 - RNA, 64 nt, Human
uuccgaauguaaaaggcucacuugccuuuggcuuccuguugacuucuucccgacccagaaagca

SEQ ID NO: 56927 - RNA, 64 nt, Human
uugcaaaauuuccugcacugcugucugacacuguccuguugaugcccuuucugacuguguucuc

SEQ ID NO: 56928 - RNA, 64 nt, Human
uaugggaaugcuggguagaagcuguuuuaauuccccuguugaaugugaaaaagguaguaguauu

SEQ ID NO: 56929 - RNA, 64 nt, Human
cgccacacucacugucaguauuaaggcccagcagccuguugauaagcuacccugucucaccaug

SEQ ID NO: 56930 - RNA, 64 nt, Human
acaugaacacugacuggccacuagcuggccuggcccuguugagucugcacagucccugcccagc

SEQ ID NO: 56931 - RNA, 64 nt, Human
uucuguacuaagaaaaauucuucugccuugggauccuguugaucuaugaccuuacccccaaccu

SEQ ID NO: 56932 - RNA, 64 nt, Human
acaagcuagucuagcucacugcagccaagcaaacccuguugauggcugaugggccuuuccauua

SEQ ID NO: 56933 - RNA, 64 nt, Human
cggggccccacuggcuggaggaaguggggucuggccuguugauguuuacauggcgcccugccuc

SEQ ID NO: 56934 - RNA, 64 nt, Human
acaccuuccuuuucaccuucuugguggacaguuuccuguugacagcauuuccccugugcgaaca

SEQ ID NO: 56935 - RNA, 64 nt, Human
acugaucagugaaggaaaccgugguuacugaggcccuguugaaaagugcacgucuuguccaaua

SEQ ID NO: 56936 - RNA, 64 nt, Human
auuggccaggagggaauaaugucccccaauacugccuguugagggaccagaguuggggucuuug

SEQ ID NO: 56937 - RNA, 64 nt, Human
gcugucacaguccugaguguggacuuggcaggugccuguugaaucugagcugcagguuccuuau

SEQ ID NO: 56938 - RNA, 64 nt, Human
acacacagguucaugcggccccaggggccucccuccuguugaagacugggggagagcagugggu

SEQ ID NO: 56939 - RNA, 64 nt, Human
ggagguggcucagccucgaaggacagacugcacaccuguugaccuaaacucacuggacagacuc

SEQ ID NO: 56940 - RNA, 64 nt, Human
ggauaacuaccuucacguuuugaaauaaauguuuccuguugaaaugcuuuuagauuuuagacag

SEQ ID NO: 56941 - RNA, 64 nt, Human
ggauaaccaccuucauguuuugaaauaaauguuuccuguugaaaugauuuuagauuuuagacag

SEQ ID NO: 56942 - RNA, 64 nt, Human; identical to SEQ ID NO: 56941

SEQ ID NO: 56943 - RNA, 64 nt, Human
uuuuuaucaaguagauugguaaaauuuaaccauuccuguugaggugcccauaagaaaaucauag

SEQ ID NO: 56944 - RNA, 64 nt, Human
acaucaucaacuuccaaugucuggacaacuccuuccuguugagggucgagccuguuuguuucua

SEQ ID NO: 56945 - RNA, 64 nt, Human
uagugagagaggaggccuggaccgagaugugaguccuguugaagacuuccucucuaccccccac

SEQ ID NO: 56946 - RNA, 64 nt, Human
gugugugaacugggcacagauugaagaaucugccccuguugaggugggugggccugacuguugc

SEQ ID NO: 56947 - RNA, 64 nt, Human
gggcaccuucaaacugguagcuaugcuuugauguccuguugaggccaucggacagagacuggag

SEQ ID NO: 56948 - RNA, 64 nt, Human
ggaugugauaugccccucucucucccaaucagagccuguugauauuacaacagggacagaugug

SEQ ID NO: 56949 - RNA, 64 nt, Human
cucaggaauguuuuaggcagaaaacugguuuuacccuguugauaaucagaaggagugugcuuua

SEQ ID NO: 56950 - RNA, 64 nt, Human
ucgcagguucuccucccugauggucuauaaguugccuguugaggaugugcgaccuuuaucacag

SEQ ID NO: 56951 - RNA, 64 nt, Human
cuccuggacaacuuccccaggaaccccguaccagccuguugaucaucaauaacacaggugaaaa

SEQ ID NO: 56952 - RNA, 64 nt, Human
augaaagaguuuuggaaucugcuguggguccuucccuguugaccauuugguaacuuauaaucug

SEQ ID NO: 56953 - RNA, 64 nt, Human
cucuuugggcuguguguuuuuauuuccaccuccuccuguugaccagugagucgguggcuucugg

SEQ ID NO: 56954 - RNA, 64 nt, Human
uacauggccugucgaccacguuauagcccucaggccuguugaacuugcucucuaagagagguug

SEQ ID NO: 56955 - RNA, 64 nt, Human
gacuggaaacgcagagcggcuccucacgccuaauccuguugacaagucccccgccguguuggaa

SEQ ID NO: 56956 - RNA, 64 nt, Human
ccugcccacugugcucuaaacccugcucaggauuccuguugaggagaugccucccuagcccaga

SEQ ID NO: 56957 - RNA, 64 nt, Human
uuuuaagucuucugccuucuuucuugaguuugcuccuguugacuucccacagcacagauaauug

SEQ ID NO: 56958 - RNA, 64 nt, Human
gaaaaugaagacucuccuaucuacugcuacagauccuguugaagaaagagcuuaccccuuuccc

SEQ ID NO: 56959 - RNA, 64 nt, Human
uagguauaccaugauuuguugaugaacaaauuuaccuguugaugaacauuuacguuguuaccaa

SEQ ID NO: 56960 - RNA, 64 nt, Human
ucaacucuuugaaaacaccuauugagcaguuauaccuguugagcaguuuacuuccugguuguaa

SEQ ID NO: 56961 - RNA, 64 nt, Human
agcguaggcguagcaucccucuccucucacuuagccuguugacucuuguuauuaucaugauauu

SEQ ID NO: 56962 - RNA, 64 nt, Human
cggggguuggccucucaagccucagggguucuagccuguugaauauaccccaccuggugguggc

SEQ ID NO: 56963 - RNA, 64 nt, Human
ucuggccccuuggauuuaaaaauaaaauuaauuuccuguugauagugggcaccucgguuucuuc

SEQ ID NO: 56964 - RNA, 64 nt, Human
uuaccaaauucugaagggaauaauauaauaaaagccuguugaggguccucuuccaucuugcuga

SEQ ID NO: 56965 - RNA, 64 nt, Human
ugcuccuugagguuauccacaggaacauccagaaccuguugaacaaagaaaggaaucauguggg

SEQ ID NO: 56966 - RNA, 64 nt, Human
uuuucauagccuaagggauguugcaucgcuaaacccuguugacuucucuaaucucuucuguagc

SEQ ID NO: 56967 - RNA, 64 nt, Human
uagaccuguacuaauauaugguagucacuagcaaccuguugagcacuugaaauugaguuauuga

SEQ ID NO: 56968 - RNA, 64 nt, Human
gccuggggcucuggggguccccgcugaccuggccccuguugacgucgaguucuccuuucccaag

SEQ ID NO: 56969 - RNA, 64 nt, Human
ggaucuagaagucuuggguccccgucccuacacuccuguugacucauuuggagauccuagaugg

SEQ ID NO: 56970 - RNA, 64 nt, Human
gucacugaauaagacuuuggacucucuuagggccccuguugauagagaucuggcccugagguaa

SEQ ID NO: 56971 - RNA, 64 nt, Human
uuuccucaaagauauauuuaaaccaaccucaugcccuguugauaaaccaaucaaauugguaaag

SEQ ID NO: 56972 - RNA, 64 nt, Human
guuucuagccaauuggaacauaaacauggugcugccuguugacagaugugugucuguccucagg

SEQ ID NO: 56973 - RNA, 64 nt, Human
gaggcagagacggguacaggggguaccacacuacccuguugacacagccuagauccagaguuca

SEQ ID NO: 56974 - RNA, 64 nt, Human
aaaacuggggccacauauuuucagucauuucuucccuguugaauugaagcaaaucagauuuucu

SEQ ID NO: 56975 - RNA, 64 nt, Human
uggcuaaugaagauuaagcccucuauaaagacuuccuguugaggugaauucucauacugaaaug

SEQ ID NO: 56976 - RNA, 64 nt, Human
uuguuucuuuaaaggauaugaguuagaaucacccccuguugaauuuucccuccuagauccccuu

SEQ ID NO: 56977 - RNA, 64 nt, Human
aguuugggguuuccaguaccaucuggaugcccugccuguugagccccauucuacauccccacca

SEQ ID NO: 56978 - RNA, 64 nt, Human
agggggauaaaccuaaggcccugauccaaagcagccuguugagcugguucuccagggcugcagu

SEQ ID NO: 56979 - RNA, 64 nt, Human
uuuuggaggggauugggugaggacaguggucuuuccuguugaucaugaugauaaaguaaugaug

SEQ ID NO: 56980 - RNA, 64 nt, Human
uuguaaauuucaucgugugugucuaauuuuuuuuccuguugaauggguaaaaacaaaacaaaac

SEQ ID NO: 56981 - RNA, 64 nt, Human
guaggcugugacgcuguggggcaagacuaggaguccuguugaaauuaggaauaagugugcugug

SEQ ID NO: 56982 - RNA, 64 nt, Human
gacagcgucugugugcgcaucuugagucuucacaccuguugacucacacggcuuuugcugauga

SEQ ID NO: 56983 - RNA, 64 nt, Human
guuuuggcuaagaucuccccuuugauguggguccccuguugauuauaugugcggccuuccagcu

SEQ ID NO: 56984 - RNA, 64 nt, Human
ggagaaguguguucugaugaggcauuuuacuaugccuguugaucuaugggaaaucuaggcgaaa

SEQ ID NO: 56985 - RNA, 64 nt, Human
aaggguggggagucagccaagugccucagugugcccuguugaaacuuagguuuuuccacgcaau

SEQ ID NO: 56986 - RNA, 64 nt, Human
gaguuuuguauaaaaauguaaggaagcguuguuaccuguugaauuuuguauuaugugaaucagu

SEQ ID NO: 56987 - RNA, 64 nt, Human
cuuucucucucuguccaccugguagauaaauuguccuguugagaauuuuuagaucuggacugga

SEQ ID NO: 56988 - RNA, 64 nt, Human
ugucucuccacucuggagcccugggcucuugccuccuguugaauugccccugggccugcccccg

SEQ ID NO: 56989 - RNA, 64 nt, Human
uuuuauguuaaaacuuugaagaaauugaacaugaccuguugaagaaauugaacaugaccuguug

SEQ ID NO: 56990 - RNA, 64 nt, Human
cagcugccugcucugcgccgagccucagaaggacccuguugaggguccucaguccacugcugag

SEQ ID NO: 56991 - RNA, 64 nt, Human
ucuggcacugcacugaguguggcacaggcaccguccuguugaucucacaacacaguucuaaguu

SEQ ID NO: 56992 - RNA, 64 nt, Human
uuccuucuaaacacagcuaucuagagagccacauccuguugacugaaaguggcaugcaagauaa

SEQ ID NO: 56993 - RNA, 64 nt, Human
gaagacccuugcauccagcugugaguaauuuugaccuguugacuuuuuaggaaguaggacuaaa

SEQ ID NO: 56994 - RNA, 64 nt, Human
auuacuaaaaugcacugauaucacuucuucuuccccuguugaaaagcuuucucaugaucauauu

SEQ ID NO: 56995 - RNA, 64 nt, Human
ggcuguagcucagggcgugcacugugaggcuggaccuguugacucugcagggggcauccauuua

SEQ ID NO: 56996 - RNA, 64 nt, Human
uuagcuucuggcaaaggggguacccacuucuuucccuguugacuuugcuguuucccaggcuccu

SEQ ID NO: 56997 - RNA, 64 nt, Human
uggugucauaugcaguagccaguggauaaacuaaccuguugauucaauauuauuugacuccuuu

SEQ ID NO: 56998 - RNA, 64 nt, Human
agcucuccaucagcuccugucuccagcagcuuucccuguugauguggaucacgcagugcuuucu

SEQ ID NO: 56999 - RNA, 64 nt, Human
ucuauaggaguuaaauuaggaagucacaacagcgccuguugaacaaacucaucagugugguaau

SEQ ID NO: 57000 - RNA, 64 nt, Human
ggucagcagucaacuccaggguuugggcuugauuccuguugaauaauaguuuugagcauucuuu

SEQ ID NO: 57001 - RNA, 64 nt, Human
uuuuaugugccuuuuuguuuuuguaaaaaaggaacacccggaaagacugaaagaauacauuuua

SEQ ID NO: 57002 - RNA, 64 nt, Human
guuuugcaggcugugucuuucuaucacggauuuccacccggacacguggaacccggccuggucu

SEQ ID NO: 57003 - RNA, 64 nt, Human
uugggucuuccuccaggaugccugcaugggaccccacccggagcugguguggccauuccccaag

SEQ ID NO: 57004 - RNA, 64 nt, Human
aaaaaaagcccagaaacuuucgaacaaaaccaaacacccggacgacccucuccggugagcggcg

SEQ ID NO: 57005 - RNA, 64 nt, Human
augaccuagaggcccgagcgccuggugcugagugcacccggaggggucaucgcugcccagagcc

SEQ ID NO: 57006 - RNA, 64 nt, Human
aacgaggauuaacagaaaggaauuacgauuauaucacccggacacacaucaugcuuaagauuca

SEQ ID NO: 57007 - RNA, 64 nt, Human
gacuugucaaagcuugcaacauagcuacauggugcacccggaccuguacccccuccccccaaca

SEQ ID NO: 57008 - RNA, 64 nt, Human
cagcuacgugggggccugcuucgacaggcugcuccacccggacgccguacccgcccuuuuccgc

SEQ ID NO: 57009 - RNA, 64 nt, Human
cccacccccguccaccccagagacccugcccuuccacccggaggccaaaggccaacuguacucc

SEQ ID NO: 57010 - RNA, 64 nt, Human
cugaaauuggauggcuggcuaauagacacugaaucacccggagugcuuaucuuaaaauugcaga

SEQ ID NO: 57011 - RNA, 64 nt, Human
ccaggcgagguucggccuuccucucgccccugugcacccggagaugcccacagcaccagcaccu

SEQ ID NO: 57012 - RNA, 64 nt, Human
caauggugcaauuucagcucacugcaaucucugccacccggauucaagcaauucuccugucuca

SEQ ID NO: 57013 - RNA, 64 nt, Human
acgccaugcagaucccggcugcgagagagggagacacccggaggagcaggugggaagaugaagc

SEQ ID NO: 57014 - RNA, 64 nt, Human
cauuucuaccccauccagaacauucuuggaagagcacccggagcugaagcugucccugaugaug

SEQ ID NO: 57015 - RNA, 64 nt, Human
gccccgggggccgccccgaggcccuuccggcgcgcacccggaccccggcgcccugccccguccc

SEQ ID NO: 57016 - RNA, 64 nt, Human
guucgugcaguccauagcgcuucucaaugugugucacccggaaccugggaggggagggaacacu

SEQ ID NO: 57017 - RNA, 64 nt, Human
gggccgcuaccugguggcgcugggccacgcguaccacccggaggaguuuguguguagccagugu

SEQ ID NO: 57018 - RNA, 64 nt, Human
gugccccagcagucuggcugcguccagccaccaucacccggaaggaugcccacaaggcagcuga

SEQ ID NO: 57019 - RNA, 64 nt, Human
uggcaccccuggcugugacuguggccgccacggccacccggaaugugaagggcgcuccgggcuc

SEQ ID NO: 57020 - RNA, 64 nt, Human
ugccccuggaccaguacucccccagcuuucccgacacccggagcucuacgugcuccucagggga

SEQ ID NO: 57021 - RNA, 64 nt, Human
cuuuucuacguuagugucacauguuaugugaucgcacccggacuguucauauguuaagcacaca

SEQ ID NO: 57022 - RNA, 64 nt, Human
agaaaguaggaguggcugaccaggcccugcucaucacccggauagaggacacggacccugugug

SEQ ID NO: 57023 - RNA, 64 nt, Human
gggccgcugagccccgcccggaggacgcuccccgcacccggaggccgggggucccggggucccg

SEQ ID NO: 57024 - RNA, 64 nt, Human
ccugacucccccacuccccuccuugccaggggcacacccggaccccacacggcaggccccucuc

SEQ ID NO: 57025 - RNA, 64 nt, Human
acagaauagagcgugugcuguugauaauaucucucacccggaucccuccucacuugcccugcca

SEQ ID NO: 57026 - RNA, 64 nt, Human
ccuguggaccccccccugccaccacgacugcugccacccggaguucccccauugucuuuggugc

SEQ ID NO: 57027 - RNA, 64 nt, Human
gcuccccaauccaacccaugcauggccucccagccacccggaucuccaggcccagccuggcccc

SEQ ID NO: 57028 - RNA, 64 nt, Human
ccagggccugagcucucuuccccagcauugcccccacccggaaaccccaccuuuggagaguuaa

SEQ ID NO: 57029 - RNA, 64 nt, Human
cucaagcugcagagaagcuuuucauucccacccccacccggaaccuccccuugccuaacauuuc

SEQ ID NO: 57030 - RNA, 64 nt, Human
cagcaucuccuucuacuaagagaagccacugcuccacccggagccagaccagaaacucaagaga

SEQ ID NO: 57031 - RNA, 64 nt, Human
ggggcggggaggacaaggggcgggcccgcggccucacccggagggacggcagccccggucgcgc

SEQ ID NO: 57032 - RNA, 64 nt, Human
gaggcccacuggccuuggaucaucuccucaugcacacccggaguuuuaccugcuugcuugcuuu

SEQ ID NO: 57033 - RNA, 52 nt, Human
augagccggucccccccugaggcacccggauucaccucuggaccacccugau

SEQ ID NO: 57034 - RNA, 64 nt, Human
gugcucgugcuagaacucgggggcccccugcccgcacccggacacuugaucgauccccaccgac

SEQ ID NO: 57035 - RNA, 64 nt, Human
cugcauguucauugcaaacagaagguuccuugagcacccggaaacggucacgagacccagagga

SEQ ID NO: 57036 - RNA, 64 nt, Human
gcgggagggaggggcggcugcugccuggugacggcacccggaggcccaccaggacgcgccaccg

SEQ ID NO: 57037 - RNA, 64 nt, Human
ugacagaucauaggaaguggcuggucuggagucccacccggacagguggggccucagccugggg

SEQ ID NO: 57038 - RNA, 64 nt, Human
gacaccccucccccuuccccucgcucccuuucuucacccggagcccucugcagagauuagcugu

SEQ ID NO: 57039 - RNA, 64 nt, Human
ugcacuccucgggggcguggggcgugccuugcuccacccggacucccugggcugcgucccacau

SEQ ID NO: 57040 - RNA, 64 nt, Human
cgaccuuggguggcggggccugggucucucgucccacccggagggcacagacaccggcuugcuu

SEQ ID NO: 57041 - RNA, 64 nt, Human
cugcauaacaggagcucugcaggagucugcaggucacccggagcaggacggggaggagcugagc

SEQ ID NO: 57042 - RNA, 64 nt, Human
accauggauuccgacugagggcaggaugcucucccacccggaccccuccagccaagcagcccuu

SEQ ID NO: 57043 - RNA, 64 nt, Human
uguggaugcccccgccgaggucccccgauccccgcacccggacugcugcucccugccccucccu

SEQ ID NO: 57044 - RNA, 64 nt, Human
uucugggggaggaguggggcccacagcucuccagcacccggaauaaagcccgccugccccaguc

SEQ ID NO: 57045 - RNA, 64 nt, Human
gcacacuugccugcggaaaagggcucuccccagccacccggagauggggguaagaggaagagca

SEQ ID NO: 57046 - RNA, 64 nt, Human
agcgcccccuuccguccucgggacuccucgcucccacccggaggaggcugcgccagcuuuaggc

SEQ ID NO: 57047 - RNA, 64 nt, Human
acuguguccucuuucccaccuucauagcaggaaucacccggacccgacuggcugggcuucgugc

SEQ ID NO: 57048 - RNA, 64 nt, Human
aguuuucaaucucuggaguuugugcauugggccucacccggagcagacgagggcagggcuggga

SEQ ID NO: 57049 - RNA, 61 nt, Human
aaaccugccauggccacuagggggcgcgcggcacccggagccacagcuggcggggucuccg

SEQ ID NO: 57050 - RNA, 64 nt, Human
gcagagccgguaaccaccacgugccagagccgcccacccggagccgcccgcaugcagcuucacc

SEQ ID NO: 57051 - RNA, 64 nt, Human
ccaacccugccuugagggaagaccacccuccugucacccggaccucaguggaagcccguucccc

SEQ ID NO: 57052 - RNA, 64 nt, Human
cgcuuugaccccuuuggacccauugggaccagcccacccggaccuaacccagaccaucuccccc

SEQ ID NO: 57053 - RNA, 64 nt, Human
cuccaagacucccuggggcccaacuguguugcuccacccggacccaucucucccuucuagaccu

SEQ ID NO: 57054 - RNA, 64 nt, Human
ccagucaucugugaagcuagggcgccuacccccccacccggaggaccccugcggcccccugccu

SEQ ID NO: 57055 - RNA, 64 nt, Human
ugcugcugcguuggcagaacccugggugggcaggcacccggaggaggagcagcagcugugucau

SEQ ID NO: 57056 - RNA, 64 nt, Human
gaaccugagugacagccuggcccgcggccgccuacacccggaccugcaguccaaccuccugcag

SEQ ID NO: 57057 - RNA, 64 nt, Human
ggucccggucccagucccaccaggcaacuccuuccacccggaaauucuucccuucccuuagccu

SEQ ID NO: 57058 - RNA, 64 nt, Human
gcuggcgccccguucuccuccaguugggaacaugcacccggagcuuggggugcagauccugaug

SEQ ID NO: 57059 - RNA, 64 nt, Human
cccagagauggagcugcucugccuuccagcggggcacccggagggcugccccagcagauagaga

SEQ ID NO: 57060 - RNA, 64 nt, Human
ggccauaacacaggagaccugcucccuaucugcgcacccggagguggggugaggacggugacga

SEQ ID NO: 57061 - RNA, 64 nt, Human
ggccauaacacaggagaccugcucccuaugugcacacccggagguggggugaggacggugacga

SEQ ID NO: 57062 - RNA, 64 nt, Human
auucugucucagugcccucacucccugcuccccgcacccggagccucagggaugggcucaggcu

SEQ ID NO: 57063 - RNA, 64 nt, Human
ggacacucaguguccaguugcagcuggacuucuccacccggauggcccccacccaguccugcac

SEQ ID NO: 57064 - RNA, 64 nt, Human
gaagucaccagcucgaggcguguggauugguuuccacccggaacaggcucugugauggcugaau

SEQ ID NO: 57065 - RNA, 64 nt, Human
gcccuugacccccacccacccccacccuugcuggcaggggcagggaccccagggggauugacuc

SEQ ID NO: 57066 - RNA, 64 nt, Human
aggcgcccaggggaguacauugccccgugcaaagcaggggcauuggggacugucuugagacccu

SEQ ID NO: 57067 - RNA, 64 nt, Human
gugcugccagcccuaagugccaugugggcucccccaggggcacguguggcuccugcccccuggc

SEQ ID NO: 57068 - RNA, 64 nt, Human
gauaaaggagaaggcaugaaauugucuagcagagcaggggcagggugauaaauuguugauaaau

SEQ ID NO: 57069 - RNA, 64 nt, Human
cugcagcccugggccagacaaggccagaagguuucaggggcauuugacauccccuccugguucu

SEQ ID NO: 57070 - RNA, 64 nt, Human
cuuccuggccuuagccaccuggcucugucugcagcaggggcaggcugcuuucuuauccauuucc

SEQ ID NO: 57071 - RNA, 64 nt, Human
gucccccccacaugaggccacccaggaaaaaaggcaggggcaguggcauccuugccguagcagg

SEQ ID NO: 57072 - RNA, 64 nt, Human
cuucagacccagagaaggacggugccaagggccccaggggcagcaaggccuugguggagcagcc

SEQ ID NO: 57073 - RNA, 64 nt, Human
uccuaugugaggggaauggacauuauuaaaagaacaggggcagaaguggcucauuuaugaccca

SEQ ID NO: 57074 - RNA, 64 nt, Human
acugcaauacuaauugagaaacaugaauuauuuccaggggcacacaaugcuauugaaauuacug

SEQ ID NO: 57075 - RNA, 64 nt, Human
gggauguaggcgcuggagcuccaguucccaggagcaggggcagguguuccuagauguuaguguu

SEQ ID NO: 57076 - RNA, 64 nt, Human
agcugucgccuuucugaccagcaggccuggagggcaggggcacagagcagagaggagggcacug

SEQ ID NO: 57077 - RNA, 64 nt, Human
uauauuagagcauauuacuguagugcugaaugagcaggggcauugccugcaaggagaggagacc

SEQ ID NO: 57078 - RNA, 64 nt, Human
aaacuccacccaccuggcuucauacagaaggcaacaggggcacaagcccagguccugcugccuc

SEQ ID NO: 57079 - RNA, 64 nt, Human
uauuuaaaucugcaccucucucuauuuuauuugccaggggcacgaugugacauaucugcagucc

SEQ ID NO: 57080 - RNA, 64 nt, Human
guaccacggaggcgaaggaguuggagguguuuuccaggggcaccgaugggcuuagagcucucau

SEQ ID NO: 57081 - RNA, 64 nt, Human
gaggaugggcuuccuuguccuguggccucugcuccaggggcaguguccuuucccugugcugugu

SEQ ID NO: 57082 - RNA, 64 nt, Human
ucgaagcgugggaggcacccccauugcucuccuccaggggcagaacauggggaggggacuagau

SEQ ID NO: 57083 - RNA, 64 nt, Human
uagaugugaaaacagauagaacugguuugugggacaggggcagcuugcucaggagagggaauaa

SEQ ID NO: 57084 - RNA, 64 nt, Human
gaggagaaggcuuucacagcuguucccugauauucaggggcauugcucauugcucccuucucgg

SEQ ID NO: 57085 - RNA, 64 nt, Human
augucagggucaaacuacauugagccccugaggacaggggcaucucugggcugagccuacuguc

SEQ ID NO: 57086 - RNA, 64 nt, Human
ucgcaucccggcugacccugugccccaguuggggcaggggcaggagggaggguuucucucccaa

SEQ ID NO: 57087 - RNA, 64 nt, Human
cuuacuuaaaacaauguacuguggugaugagucccaggggcacuggucagccuguggagcccug

SEQ ID NO: 57088 - RNA, 64 nt, Human
gccagacaccugcaucccuggcuccucuauuacucaggggcauucaugccuggacuuaaacaau

SEQ ID NO: 57089 - RNA, 64 nt, Human
cagaucugugccugggaucgugcauuugaggggccaggggcaggcagggcugcagagggagacg

SEQ ID NO: 57090 - RNA, 64 nt, Human
gagguggcaggaauacuucaccuuuccucucccucaggggcaggugguggaggggcgcccaggg

SEQ ID NO: 57091 - RNA, 64 nt, Human
agagaggcgccuccuggccuggcucugcagaacccaggggcacgcucugggccugggcugagga

SEQ ID NO: 57092 - RNA, 64 nt, Human
aagcuccugcguuuuuugcaaacuuggcuucccccaggggcaggcuggacuuucccugcccccu

SEQ ID NO: 57093 - RNA, 64 nt, Human
uggagugcgcucuuggucccuggucccucguccacaggggcaggccugggacccagcuacucug

SEQ ID NO: 57094 - RNA, 64 nt, Human
ugggccuaauccucagcaaauguucuaccacucgcaggggcaaagguggugagccacgggacgu

SEQ ID NO: 57095 - RNA, 64 nt, Human
guuccgagccugccugccugccgguucuauaccucaggggcauuuuuacaaaaagcccccuccc

SEQ ID NO: 57096 - RNA, 64 nt, Human
uuucugugaacaugaaguucugcgguagugccuccaggggcagaggaaaagaagaaguguuacu

SEQ ID NO: 57097 - RNA, 64 nt, Human
uuagucccaggaacaaaaaagggcauuuuggguacaggggcauauaccuguaauccuagcuauu

SEQ ID NO: 57098 - RNA, 64 nt, Human
ggcaaccccugcccaacccucauccccaucuucucaggggcaggggacuaccuuccagugucuc

SEQ ID NO: 57099 - RNA, 64 nt, Human
augucuuuuuaaaaucuaacucuugagagugcagcaggggcauggcucugcugggaguuguguu

SEQ ID NO: 57100 - RNA, 64 nt, Human
uccauuuaccaaaauuugacacgcacacauucuucaggggcaugccaauugcguaaagugaggc

SEQ ID NO: 57101 - RNA, 64 nt, Human
gagccugcggagcugcaggggcaggcgaggccuccaggggcaggguccugaggcaggaacucga

SEQ ID NO: 57102 - RNA, 63 nt, Human
agcuggagaccaaugucugagccugcggagcugcaggggcaggcgaggccuccaggggcaggg

SEQ ID NO: 57103 - RNA, 64 nt, Human
caucugccaccaacaacccuccccucaccccugccaggggcagacaggcuucucagcagaacug

SEQ ID NO: 57104 - RNA, 64 nt, Human
aggcccccagaucucucucuccuggaggcuuuagcaggggcaaggaaauaguaggggaaucucc

SEQ ID NO: 57105 - RNA, 64 nt, Human
cauucccaguuugagucuucauccuguaagcccccaggggcagucccugcuuuacugaacuuca

SEQ ID NO: 57106 - RNA, 64 nt, Human
ggacuucugggggaccaagacauccucaagaaaacaggggcauccagggcucccuggaugaaua

SEQ ID NO: 57107 - RNA, 64 nt, Human
gcagggccagugugagcuuacagcgacguaagcccaggggcaaugguuugggugacucacuuuc

SEQ ID NO: 57108 - RNA, 64 nt, Human
gccagccuuccugccucagcuccccugcugucuccaggggcaggugguaggcauggguaccugc

SEQ ID NO: 57109 - RNA, 64 nt, Human
gcugccuccucaguggggcagugggcaaggggcccaggggcagccgaagcacgggguccugaga

SEQ ID NO: 57110 - RNA, 64 nt, Human
aaaggagccuaggccaggugcaaccagggagcugcaggggcaugggaaggugggcgggcagggg

SEQ ID NO: 57111 - RNA, 64 nt, Human
uacugagaauucaacagcuccagagcagaagccacaggggcauagcuuaguccaaacugcuaau

SEQ ID NO: 57112 - RNA, 64 nt, Human
auaccccaaaguccaggcuaauuagaggauguggcaggggcaguggccuggaugcacagugccu

SEQ ID NO: 57113 - RNA, 64 nt, Human
uugggcaagguugggacaaagccaucugggcagucaggggcaaggacuguuggaggagaguuag

SEQ ID NO: 57114 - RNA, 64 nt, Human
cggugcauuuguaacacucagauuugugcccauucaggggcaauuuggcacucagauucuacuc

SEQ ID NO: 57115 - RNA, 64 nt, Human
acccugguggucugugcuucagccauuugcagggcaggggcaucauuaauucagacguaaagau

SEQ ID NO: 57116 - RNA, 64 nt, Human
cuccgagccaugugagcccccugaugccaccgagcaggggcagcuucaugaccgaugucuggcu

SEQ ID NO: 57117 - RNA, 64 nt, Human
ccuggacaucaccaguccuagcucuuacacauagcaggggcaccuuccgacaucccagaccagc

SEQ ID NO: 57118 - RNA, 64 nt, Human
cccagauagggaccacagagauucuggggccagccaggggcagucaaauuggcaccuacuggcu

SEQ ID NO: 57119 - RNA, 64 nt, Human
ccgccaccagcccgcaacucuccagccgaagcugcaggggcaggagaggcugggcuggguggca

SEQ ID NO: 57120 - RNA, 64 nt, Human
ucccuguugcuaugugucaccugggcccuacagacaggggcacacgcuuauggauguguguacc

SEQ ID NO: 57121 - RNA, 64 nt, Human
ccuugucagacagccucagggcaucucugagacacaggggcagaaaaugacauucaucuuuuga

SEQ ID NO: 57122 - RNA, 64 nt, Human
cagugucuguguuguuagaacucagaggaagaggcaggggcagcagccgacagggggcagcaug

SEQ ID NO: 57123 - RNA, 64 nt, Human
ccacuuggagggcgguggucuguuacagggugugcaggggcagagaaggaagggaccaggggac

SEQ ID NO: 57124 - RNA, 64 nt, Human
gcccagcccuggggccugugcccccagaggccuacaggggcaccaugcugcacugcccgcugaa

SEQ ID NO: 57125 - RNA, 64 nt, Human
uuuucuuagugucauuuucacgcuggugcugagacaggggcaaggcugcuguuaucaucucauu

SEQ ID NO: 57126 - RNA, 60 nt, Human
aggagugcggcugcgccugacagugcaaggcaggggcacggugguggggcacggagggca

SEQ ID NO: 57127 - RNA, 64 nt, Human
ccagaaaggacacaacccgucagagaccugggagcaggggcaaugaccguuugacuguuugugg

SEQ ID NO: 57128 - RNA, 64 nt, Human
ugcauagagcccccucuuccccgcccagcuuucccaggggcacagcucuaggcugggaggggag

SEQ ID NO: 57129 - RNA, 64 nt, Human
ggaaugagggaguuaaccaaguuuggugcaggagcaggggcagggggccacuguagugagcgug

SEQ ID NO: 57130 - RNA, 64 nt, Human
agggucucacucugucacccagguuggagugcagcaggggcaugaucagcucacugaaggauca

SEQ ID NO: 57131 - RNA, 64 nt, Human
cuggggugggacagggagggccggcggcucugagcaggggcaggcgcagaggucccagccccag

SEQ ID NO: 57132 - RNA, 64 nt, Human
cagugugcccaaaagccauguauuucagggaccucaggggcaccuccggcugccuagcccuccc

SEQ ID NO: 57133 - RNA, 64 nt, Human
gccugucucuuguagcuuccuggggugggaggcacaggggcaaagcaauaccccagggaaagug

SEQ ID NO: 57134 - RNA, 64 nt, Human
gccaacgauguacacuugcucuauagaagggugucaggggcaaguacacuucaccacagcaaua

SEQ ID NO: 57135 - RNA, 64 nt, Human
agggccgaaguaaaaaaccaucaccucccauucccaggggcaucaucauguucaacaaggcaug

SEQ ID NO: 57136 - RNA, 64 nt, Human
uccagggagcucccauguuggggcugaagacgagcaggggcaaccugccagcaucacagaauuc

SEQ ID NO: 57137 - RNA, 64 nt, Human
cuucuggcaaggguuccccucucucaugcaugaacaggggcauccaaaauaagaagcucuccau

SEQ ID NO: 57138 - RNA, 64 nt, Human
gccgauaucaacaagacuggaauguuugugauaucaggggcaagaguuaucauagaacaacaaa

SEQ ID NO: 57139 - RNA, 64 nt, Human
gggcaccaauggaggaaaaugacccuugggcuggcaggggcagugacccuuccaggguaccacu

SEQ ID NO: 57140 - RNA, 64 nt, Human
cccuggaugaaguuaucuggcuucaaauauuaugcaggggcaaacaccugcugauguggcaacu

SEQ ID NO: 57141 - RNA, 64 nt, Human
gugcugguaggguuucaaggugcuauuaguggggcaggggcagggcggcugcucacagagcacc

SEQ ID NO: 57142 - RNA, 64 nt, Human
agcugaggcccauggccacauccucauggcccaucaggggcaggaaccagacaaucucguaggu

SEQ ID NO: 57143 - RNA, 64 nt, Human
aaaaacaggcccuccccaugagagagcuacacggcaggggcagacacugugaguauaagcuacu

SEQ ID NO: 57144 - RNA, 64 nt, Human
uuagugucuucagguaaagacucagagauacuugcaggggcaagcuguaaagggcaugggaaca

SEQ ID NO: 57145 - RNA, 64 nt, Human
uguuuugagcagaggacccuccaacuuauggcaucaggggcaaaaagucacagcuuaucccagg

SEQ ID NO: 57146 - RNA, 64 nt, Human
cugggcaccugcugcaaccaugcagcuacccugccaggggcacucagcaaacagaaccacaggg

SEQ ID NO: 57147 - RNA, 64 nt, Human
gggcugcuggaacccaggaguggggauucuacaccaggggcagcuacugcgagaacuucaggcc

SEQ ID NO: 57148 - RNA, 64 nt, Human
acccccgcccuuggugcugucauaaaagggcaggcaggggcaggcugaggaguugcccuuugcc

SEQ ID NO: 57149 - RNA, 64 nt, Human
uuccauguggucugaauguuggcaccagcccgggcaggggcaucucauuugggcaguacugcug

SEQ ID NO: 57150 - RNA, 64 nt, Human
uuucagaaggagacauuuugcuguuacauucugccaggggcaaaagauacuaggcccaggaguc

SEQ ID NO: 57151 - RNA, 64 nt, Human
cuccugugaugucugugggccugcguggggacaacaggggcacaugacaucugccugggcccug

SEQ ID NO: 57152 - RNA, 64 nt, Human
uuagaguuaugcccagccaagucuucaguauauccaggggcaacagauuuucacagcucaucca

SEQ ID NO: 57153 - RNA, 64 nt, Human
cuggugggagaggguggggagguuguggccccugcaggggcagaguauccuaggguguguaucc

SEQ ID NO: 57154 - RNA, 64 nt, Human
uaacucauaaucugauuuggagguuugcccuuuacaggggcagauuuucugcucaguucaacaa

SEQ ID NO: 57155 - RNA, 64 nt, Human
aguaaacaagaaacacaagacggcuaaaacucuccaggggcagguaaagcccugcugggcucag

SEQ ID NO: 57156 - RNA, 64 nt, Human
auucucccccuacugaggccagcugagguacaggcaggggcaggcaggaccaccagcagggggc

SEQ ID NO: 57157 - RNA, 64 nt, Human
uccuaaaguuaaguuugaauccccuauuuuugcacaggggcagcagauacacacaacaaugaga

SEQ ID NO: 57158 - RNA, 64 nt, Human
uaaaugaucacuuacuggggaagaaaugagagagcaggggcaccccccuaggccagcacagccu

SEQ ID NO: 57159 - RNA, 64 nt, Human
gagccuuacuucucuuccugggcuagccugcggucaggggcaaggcuuuuggaugauaagagug

SEQ ID NO: 57160 - RNA, 64 nt, Human
cgagcagggcugcgucgguuuguggucuagcucccaggggcaggccaggcauggcucagugcag

SEQ ID NO: 57161 - RNA, 64 nt, Human
aucccauaaaacaguagaaacucaguucccuucucaggggcacacacauccaaggcaccgugga

SEQ ID NO: 57162 - RNA, 64 nt, Human
aggaugugacagaagcagagaugaccagaaagcacaggggcaggguucugacuggcguguggga

SEQ ID NO: 57163 - RNA, 64 nt, Human
cccgcugaugguggccugcugugccuggugccaacaggggcaucccggcccauaccccuccaga

SEQ ID NO: 57164 - RNA, 64 nt, Human
aagagcagcaugacauuggcaucagcugaauaaccaggggcacaugggggaacguggaugggaa

SEQ ID NO: 57165 - RNA, 64 nt, Human
ugacaucguucccuggggacauugggaaggugggcaggggcaagugaacucagcacucugcagu

SEQ ID NO: 57166 - RNA, 64 nt, Human
cgcuccacagguacgcgggagccucagguucucucaggggcagcaaaguggcccaagcugcccc

SEQ ID NO: 57167 - RNA, 64 nt, Human
aaagugguuguuaguuauagaugucuagguacuucaggggcacuucauugagaguuuugucuug

SEQ ID NO: 57168 - RNA, 64 nt, Human
uuauaacuuuaagagauuucuuaggauacaucuucaggggcagauuucauaacaacaucucaaa

SEQ ID NO: 57169 - RNA, 64 nt, Human
aaugaauacuuggaauucuaauuguuuugugugccaggggcaguaaugucccugccucuucucc

SEQ ID NO: 57170 - RNA, 64 nt, Human
auacagauggcagcuuggaucucagguacagcuccaggggcaggcagugcccagcuggaccugg

SEQ ID NO: 57171 - RNA, 64 nt, Human
cucacugcgucucaugaggccgcugccgcugcugcaggggcacccagaccuccagagcauccag

SEQ ID NO: 57172 - RNA, 58 nt, Human
gcgacaaggccggccugugacguggugccaggggcagccccaacccacccgggccagg

SEQ ID NO: 57173 - RNA, 64 nt, Human
uagcugcuccuugaacuugaggcugccuuggcagcaggggcacagcaggccucaagagccccua

SEQ ID NO: 57174 - RNA, 64 nt, Human
cacugggcucgccuugcacgcccaccaggagggccaggggcauacgcaguccugacguggacuu

SEQ ID NO: 57175 - RNA, 64 nt, Human
caauggauaccaaugauagaaaaugauaccuuuacaggggcagaaaaauccccacucuuccuua

SEQ ID NO: 57176 - RNA, 64 nt, Human
uauucugcagguguagcuucggugcucuccuguucaggggcaggcucacugcccgcuucuuuuc

SEQ ID NO: 57177 - RNA, 64 nt, Human
cccucccuccccaguguuuuugcaggugaggaaacaggggcagaguaauucaggcacauguguu

SEQ ID NO: 57178 - RNA, 64 nt, Human
agacacugucaaugagguuaugagaaaaaaacagcaggggcauuaguuucaggcaaggcagcuc

SEQ ID NO: 57179 - RNA, 64 nt, Human
auugaaaucuuuaguccuuggagcugucacauagcaggggcaaccucacacugaaacaaaggaa

SEQ ID NO: 57180 - RNA, 64 nt, Human
ggauauuuaggccaaaaggaggaagugacuuguccaggggcagacaccaaaugggaaucugauu

SEQ ID NO: 57181 - RNA, 64 nt, Human
aauggaguugucagcaugaucaucaucuucuagccaggggcauaguugccaaggccauuuaccu

SEQ ID NO: 57182 - RNA, 64 nt, Human
ugccucagcuuuuuccccacagacaccuaccucacaggggcauugagaaaaaaaaaaugaaggc

SEQ ID NO: 57183 - RNA, 64 nt, Human
ggccucuaacccucagugggcccccaggucagggcaggggcacugaguggccuggcucugagga

SEQ ID NO: 57184 - RNA, 64 nt, Human
ucuucuucuuccaucuccuuggugacacccagcccaggggcacccccuuccccagcccccaccu

SEQ ID NO: 57185 - RNA, 64 nt, Human
acguagugcacagaauacgugagaguugcucuggcaggggcagaauccucacaggaucgccugg

SEQ ID NO: 57186 - RNA, 64 nt, Human
cugagaaggagcgauaacccccagaaugcaaaaucaggggcaucauuauccggugcuugaacaa

SEQ ID NO: 57187 - RNA, 64 nt, Human
agugccagccuccccagccugugccaagcuucaacaggggcaagaggaggggccggccccuccu

SEQ ID NO: 57188 - RNA, 64 nt, Human
gugggcaccaggucugugccaagcacagggacuccaggggcagcugccauucguuccagugaug

SEQ ID NO: 57189 - RNA, 64 nt, Human
gugccaagggcaaccuagguaaaacgaaagccgucaggggcagugggcggcuucccggcugacc

SEQ ID NO: 57190 - RNA, 64 nt, Human
aucagugccucacgcaggcaaaugcacugaaacccaggggcacacgcgcgcagagugaacagug

SEQ ID NO: 57191 - RNA, 64 nt, Human
ucccugcucccugcucccggcucugaggcugccccaggggcacuguguucucaggcggggauca

SEQ ID NO: 57192 - RNA, 64 nt, Human
gggacaaagucaacuggacugcugagugagagggcaggggcaguugaagggaacaugaauugcu

SEQ ID NO: 57193 - RNA, 64 nt, Human
uaacagugguuaaguuucuuauuuucaaguucagcaggggcaaacuauacacggucguccauca

SEQ ID NO: 57194 - RNA, 64 nt, Human
ccccucccccugcucaaaggagggguuggcggugcaggggcaaccccucgaaagcggggugucu

SEQ ID NO: 57195 - RNA, 64 nt, Human
caggguccugaaacuuugugucaaacagacaaugcaggggcagggugugguuuggggggaaauu

SEQ ID NO: 57196 - RNA, 64 nt, Human
ggcuucccaguaaggcccagugaucccauuaucccaggggcaaaaccaccuguccccuuuugag

SEQ ID NO: 57197 - RNA, 64 nt, Human
cucuguccuuggcagagaccuugcugcccaggcccaggggcaggcucuuggccugccccaggcc

SEQ ID NO: 57198 - RNA, 64 nt, Human
cuccuggcccuucagucuuggugccaccugggcacaggggcaagcuuggugguugugaguccau

SEQ ID NO: 57199 - RNA, 64 nt, Human
cucugucccaauccgagaaguuccgaggcuuucccaggggcagucugugucacgcuggccauuu

SEQ ID NO: 57200 - RNA, 64 nt, Human
acucacagauaauaaagcucagagcagcucccggcaggggcacucacggcacacgccccugccc

SEQ ID NO: 57201 - RNA, 64 nt, Human
uuuaguagcaucccugcccccaccuacuagaugccaggggcacuguucuccccagccccccgcc

SEQ ID NO: 57202 - RNA, 64 nt, Human
aggcguggaggagaggagacuguuugaugugguacaggggcagucaguggagggcgagugguuu

SEQ ID NO: 57203 - RNA, 64 nt, Human
gccuguccuuccccagucaccagggugggggggacaggggcagcugagugcauucauuuugugc

SEQ ID NO: 57204 - RNA, 64 nt, Human
ccuacuuuugcacuucuccaagugcaggucacaccaggggcagacccugucgcugcguuucuga

SEQ ID NO: 57205 - RNA, 64 nt, Human
ccaugucugagcggcgcagagcccuccaggccugcaggggcaaggggcuggcuggagucucaga

SEQ ID NO: 57206 - RNA, 64 nt, Human
caaacugaccaggcugaugucaaccuaacccccucaggggcagggaacaggggagggcuccaca

SEQ ID NO: 57207 - RNA, 64 nt, Human
cuuaauuaaauucaaccucugaacugaaaugugucaggggcagcugagcaagacagcaguugua

SEQ ID NO: 57208 - RNA, 64 nt, Human
gggggccccuugagaauggugauccacccaguuacaggggcauuuagggagcagaugacugaga

SEQ ID NO: 57209 - RNA, 64 nt, Human
uguccugagaccccugauuuugaagcugaggagucaggggcauggcucuggcaggccgggaugg

SEQ ID NO: 57210 - RNA, 64 nt, Human
ccugaaaauuuagcaaaauuccgacuauggccuccaggggcaauuccuaaaagcugaauggaua

SEQ ID NO: 57211 - RNA, 64 nt, Human
acucccuccucuucagagaagcccuccuguggcucaggggcagcugcagggccagauggaguug

SEQ ID NO: 57212 - RNA, 64 nt, Human
gagccacaagaaaagagcacaggcugcaccaaagcaggggcagcagagaauaaaauaucccuuu

SEQ ID NO: 57213 - RNA, 64 nt, Human
ggggagucagaagaaccuggaggacggaggaaaccaggggcaauguuuacaagacugguggaca

SEQ ID NO: 57214 - RNA, 64 nt, Human
acaccuagcccagaaugcuguaggccacuaggcgcaggggcaucucuccccugcuccagcgcau

SEQ ID NO: 57215 - RNA, 64 nt, Human
aagcacugucuaguugaaaguucccuucuccacccaggggcagugaaggaggaggggcuuauag

SEQ ID NO: 57216 - RNA, 64 nt, Human
guaccaaagacugacccccgccagcuggggugcccaggggcagggccggcccgccagggagggg

SEQ ID NO: 57217 - RNA, 64 nt, Human
agggaacaggggccggccugggggcugggagggccaggggcaccucccucccacccuucaggcu

SEQ ID NO: 57218 - RNA, 64 nt, Human
ucugcaggccgcuugcccuccuguccccuccccgcaggggcacaguggagacgcaggggcucug

SEQ ID NO: 57219 - RNA, 64 nt, Human
cccagcccucgaggcucgaugccugugccaaggccaggggcagccagagggcagcuggauggcc

SEQ ID NO: 57220 - RNA, 64 nt, Human
agaaggggucuggcccgggcauccacguagggggcaggggcaggggcgggcggagggaggggag

SEQ ID NO: 57221 - RNA, 64 nt, Human
ggcugcucuuuccacuugcccuguguucuuuccccaggggcaugacugucgccacacgccucug

SEQ ID NO: 57222 - RNA, 64 nt, Human
uggccacugccaagcugcggggaaggguccugagcaggggcaucugggaggcucuggcugccuu

SEQ ID NO: 57223 - RNA, 64 nt, Human
ggaccccauggcagacuuggcaaggucuccacuucaggggcaaacaucuccaucaucagcaacu

SEQ ID NO: 57224 - RNA, 64 nt, Human
caggcagugcucaugcgcuggccgucgggggaggcaggggcacagccuccaugugcgcgcgcgu

SEQ ID NO: 57225 - RNA, 64 nt, Human
agaaggcaccugcagagagcagggcagcccggcgcaggggcaugcgccuagaaucccagcuacu

SEQ ID NO: 57226 - RNA, 64 nt, Human
uauaacauuggcucguuaucuucaggaacuggugcaggggcaauuaccauggcagcugcucaag

SEQ ID NO: 57227 - RNA, 55 nt, Human
acgagcugucaaagcgcuaaccagccaggggcaggccccugaugcccggaagcuc

SEQ ID NO: 57228 - RNA, 64 nt, Human
ggaaugugacaugagggccgacuggggccaggcucaggggcagaggcugggacacaaggggcug

SEQ ID NO: 57229 - RNA, 64 nt, Human
cugugugcucuccaagcccaguucagcuuggggacaggggcaggaggaagggguaggauuacua

SEQ ID NO: 57230 - RNA, 64 nt, Human
auuuccccagccacaggccaaauccuuggagucccaggggcagccacaccacugccauuaccca

SEQ ID NO: 57231 - RNA, 64 nt, Human
cuugcugcagccugcuccagccuggcccccaccccaggggcaggcggccccuccuggcuucucc

SEQ ID NO: 57232 - RNA, 64 nt, Human
cuacagaagccagacugggucccgcggacgccagcaggggcagccccagccuaggcugcgcucc

SEQ ID NO: 57233 - RNA, 64 nt, Human
acauacaagugacugaacacuuccuggggagcuacaggggcacuuaacccaccacagcacagcc

SEQ ID NO: 57234 - RNA, 64 nt, Human
auuuguggccagggccaagccugugacucaacuccaggggcaagauggggagugagcugauggc

SEQ ID NO: 57235 - RNA, 64 nt, Human
acagcaucaugcauuacgcucggaacacauucuccaggggcaucuuccuggauaccauuguccc

SEQ ID NO: 57236 - RNA, 64 nt, Human
aaggggccggcuucucuuggugccugcuggguugcaggggcaggaagcguguggacugcagcuu

SEQ ID NO: 57237 - RNA, 64 nt, Human
guggagggcacagcccuccgacccucauggcccccaggggcaggacugaguccccuccaggaag

SEQ ID NO: 57238 - RNA, 64 nt, Human
ccugcaggggcccagacugccugcaggucaggcacaggggcaucuaccuagacaggacagcagg

SEQ ID NO: 57239 - RNA, 64 nt, Human
gcggugcuacagcagauguggcuaaaugcggagccaggggcaagccaggaugcccugugguugu

SEQ ID NO: 57240 - RNA, 64 nt, Human
agggacagguggacaacggucaccuaucuguagccaggggcaguuguguggccagcugucucuc

SEQ ID NO: 57241 - RNA, 64 nt, Human
gcuguugauuucgaguuguaagagcucagcaucccaggggcaucuucuugacuguggcauuucc

SEQ ID NO: 57242 - RNA, 64 nt, Human
uuacuuucuggucaucccagguucugacuuuuaccaggggcaaaaaaaaaaaaagcaagaggga

SEQ ID NO: 57243 - RNA, 64 nt, Human
cccugaggagccaggagcccgguggccccuuccccaggggcagggcgaugaaugcuuuuugcac

SEQ ID NO: 57244 - RNA, 64 nt, Human
ugugguuucucguacuuucacaucucuguagauacaggggcaaaagucauugcugacagagccc

SEQ ID NO: 57245 - RNA, 64 nt, Human
ccuacugaaguggguuugcugcacauugacuggucaggggcagagucugggugcuguccuuugg

SEQ ID NO: 57246 - RNA, 64 nt, Human
cagccaaggcaccccugcccugggacuggcagggcaggggcaggggcagggacaguggccaggc

SEQ ID NO: 57247 - RNA, 64 nt, Human
aggcaccccugcccugggacuggcagggcaggggcaggggcagggacaguggccaggcggcccg

SEQ ID NO: 57248 - RNA, 64 nt, Human
agagcauuguuguaguggugagggcccucuguugcaggggcauggggaaaugcauauauuaauc

SEQ ID NO: 57249 - RNA, 64 nt, Human
gcuguucccagggcuggagcagguguacccugagcaggggcagcuggccacucccaguucucac

SEQ ID NO: 57250 - RNA, 64 nt, Human
gcaggccuggccuuggagaacgagaccugugugccaggggcagauggccuggaggcuccaguga

SEQ ID NO: 57251 - RNA, 64 nt, Human
uauuaagccaguauauguuaaaaagacuuagguucaggggcaucagucccuaagauguuauuua

SEQ ID NO: 57252 - RNA, 64 nt, Human
ccccaacuuucucucugaugcuccagcauuggggcaggggcaugguggcccauguagucuccug

SEQ ID NO: 57253 - RNA, 64 nt, Human
acagcggggcgugcacugccccagccccccguagcaggggcaugacuguuucccaaccagcacc

SEQ ID NO: 57254 - RNA, 64 nt, Human
ucgacgagaacgacccuucggugagagagcaccccaggggcacgcaggccguccuguccucgag

SEQ ID NO: 57255 - RNA, 64 nt, Human
agggggccuugacggcguuggcggggccugggcacaggggcagccgcagggaggcagggauggc

SEQ ID NO: 57256 - RNA, 64 nt, Human
aggaggauggacacaccccacugaaagauguaggcaggggcaggucucucaaccaggcauauuu

SEQ ID NO: 57257 - RNA, 64 nt, Human
ugcaauucaaugcaaugaaaacaaaauuccauuacaggggcagugccuuuguagccuaugucuu

SEQ ID NO: 57258 - RNA, 64 nt, Human
aaggccucgagcucuuggauguuguauuucagaucaggggcaggcaccggaguugaggcugugc

SEQ ID NO: 57259 - RNA, 64 nt, Human
agggacauuuccccucugcagcugcggacagcgucaggggcagaggggcacacaacuuucccca

SEQ ID NO: 57260 - RNA, 64 nt, Human
gagcuggaccugauagcugugcagaaagugagagcaggggcaccuuuucuacguaagacacaaa

SEQ ID NO: 57261 - RNA, 64 nt, Human
uguggaaagccccagcccagggauggucagaacucaggggcagauuccacugccccuucugcca

SEQ ID NO: 57262 - RNA, 64 nt, Human
agcucugucccaggauggucccagcggaugcugccaggggcagugaaguguuuaggugaaggac

SEQ ID NO: 57263 - RNA, 64 nt, Human
aagacuucccugacucccccacuccccuccuugccaggggcacacccggaccccacacggcagg

SEQ ID NO: 57264 - RNA, 64 nt, Human
aauccaggguagaggcccuaacaggcacagagagcaggggcaacuccuggcacacaucaugggc

SEQ ID NO: 57265 - RNA, 64 nt, Human
augaagaaaauauauauugcuagcccaaaaaucccaggggcaaaauaaaguucaacaaaagugc

SEQ ID NO: 57266 - RNA, 64 nt, Human
ccuuuaaaugcaguaaacuccaccuaaccagauucaggggcacuaugcccacugccuccucuuc

SEQ ID NO: 57267 - RNA, 64 nt, Human
uucuauccucccagucaccuuugcagacaaagaccaggggcagcucccgagggcacugugaagg

SEQ ID NO: 57268 - RNA, 64 nt, Human
agaucgcuggccccagaacccugucccccacacccaggggcacaugcacuguugaguuagcgcc

SEQ ID NO: 57269 - RNA, 64 nt, Human
cgccaacugcugaucaaugaaaugcuuguugaaucaggggcaaacggaguacagacgucucaag

SEQ ID NO: 57270 - RNA, 64 nt, Human
ggcccucagcuggcccuccccacacacaggacggcaggggcacugugaggcuuuucuuauuaaa

SEQ ID NO: 57271 - RNA, 64 nt, Human
aaagucauauugaagaagcccagaggguugugcccaggggcagaaaucauugccuaguguucac

SEQ ID NO: 57272 - RNA, 64 nt, Human
gacucaggcagagggacucagggauggggacugccaggggcaguuggcaaaaguccaaguagag

SEQ ID NO: 57273 - RNA, 64 nt, Human
ggccaguccugccccagagacacuccaaguccgccaggggcacagaccaguucugcagugacug

SEQ ID NO: 57274 - RNA, 64 nt, Human
ugcccccugccgggcagcuuuaaggacagacccccaggggcaguuuagccucaggcacaggcau

SEQ ID NO: 57275 - RNA, 64 nt, Human
ggcuggggcaggcuugggcucaauccugggcacccaggggcagcccaccccuaaccuggcuccu

SEQ ID NO: 57276 - RNA, 64 nt, Human
ccucaccuuuuguugcuaucggcagcugcuggcucaggggcaucccaccuccgggcucuggguu

SEQ ID NO: 57277 - RNA, 64 nt, Human
cccugagcccacaggaccccuacuucacagcucacaggggcaggaggcagcuccccugccucca

SEQ ID NO: 57278 - RNA, 64 nt, Human
cccuuggacuagagcggcugggcagagcucuaaacaggggcaggggcuccucugccagccugug

SEQ ID NO: 57279 - RNA, 64 nt, Human
caugggcacugcuggguggcccauccccccucaccaggggcaggcacagcacagggauccgacu

SEQ ID NO: 57280 - RNA, 64 nt, Human
ggccaaccggacccaggccuuccaggagcaggagcaggggcaggggcaggggcagggagagccc

SEQ ID NO: 57281 - RNA, 64 nt, Human
ccggacccaggccuuccaggagcaggagcaggggcaggggcaggggcagggagagcccugcauu

SEQ ID NO: 57282 - RNA, 64 nt, Human
ccaggccuuccaggagcaggagcaggggcaggggcaggggcagggagagcccugcauuuccucu

SEQ ID NO: 57283 - RNA, 64 nt, Human
gcccacacgcagacuuugaccaggaguauccagccaggggcacacaugugccugcgugggcucu

SEQ ID NO: 57284 - RNA, 64 nt, Human
augcacgugaugcauuucacugggcuguaacccgcaggggcacagguaucuuuggcaaggcuac

SEQ ID NO: 57285 - RNA, 64 nt, Human
aaggccuagacacggcacuggccucccaggagggcaggggcauugggaaugggugggugcccuc

SEQ ID NO: 57286 - RNA, 64 nt, Human
gcaagggaagaccccuccccagcccucccgucggcaggggcagcagggggcagggugcaggguc

SEQ ID NO: 57287 - RNA, 64 nt, Human
ccacgugaaggagagaugagccccccgggccggacaggggcacacgugugcaaagagacggugg

SEQ ID NO: 57288 - RNA, 64 nt, Human
agccugcaggguggugcugggacugagccagucccaggggcauguauuggccuggagguggggu

SEQ ID NO: 57289 - RNA, 64 nt, Human
aggcgcugcgggcccaggugugcugggccccucucaggggcacuggccucucugcagggccuuc

SEQ ID NO: 57290 - RNA, 64 nt, Human
ugguccaggccaggccucauccuccuggacccagcaggggcagaaggaggaagggacuggucca

SEQ ID NO: 57291 - RNA, 64 nt, Human
uguuuggucuauuguaauuacagaugggaccacucaggggcaaaggucugacucuuccugguag

SEQ ID NO: 57292 - RNA, 64 nt, Human
ccugcucagccaagaucugccuaagauuaugauucaggggcauuuuggugcuguuaaaagcaag

SEQ ID NO: 57293 - RNA, 64 nt, Human
gcccuauaaaccagaagagaaaauacugaaagcacaggggcagggacagaccagaccagaccca

SEQ ID NO: 57294 - RNA, 64 nt, Human
cucccacuuugucccgagccuccuucucccccagcaggggcacaggccuggcaccucccugccu

SEQ ID NO: 57295 - RNA, 64 nt, Human
ugcccucucggucaggguuggccagacccagucacaggggcagugucacccuggaaaauacagu

SEQ ID NO: 57296 - RNA, 64 nt, Human
gaacgccuccugagacuccagcgccuggaggaggcaggggcaggaagcggccuccaagacccuu

SEQ ID NO: 57297 - RNA, 64 nt, Human
ucccauaacuguccacggcccuggagcacgcacccaggggcagagccugcccuuacucacgcuc

SEQ ID NO: 57298 - RNA, 63 nt, Human
cuguccaaacuguuguauaaaggacuguaagaucaggggcaucauugcuauacacucuugauu

SEQ ID NO: 57299 - RNA, 64 nt, Human
gcaggcuguccaggcugggcuugguggucaggaacaggggcagcucacgguggcucuggaguac

SEQ ID NO: 57300 - RNA, 64 nt, Human
caugguaccagcccuggggcugggccccccagcucaggggcagcucauagaguccccccuccca

SEQ ID NO: 57301 - RNA, 64 nt, Human
ugccuucuccaugggguaaccacccucgccugggcaggggcagccaaggcugggaaaugaggag

SEQ ID NO: 57302 - RNA, 64 nt, Human
gcgugggaaacucuggcuuaggaaaacaugaacacaggggcaacagaggcaaacuguuguucga

SEQ ID NO: 57303 - RNA, 64 nt, Human
ugugcaggaaacggggacguggggaggggaccugcaggggcagcccccugaagugccaagagag

SEQ ID NO: 57304 - RNA, 64 nt, Human
ugaguugugcagggugaagaccgcuucccugagacaggggcaguggugcugauggaaugugggg

SEQ ID NO: 57305 - RNA, 64 nt, Human
cuggaggcucuguucugccucuuaucagccaggucaggggcacacauggcuuaagugacaaagc

SEQ ID NO: 57306 - RNA, 64 nt, Human
gggacugugccuuugggaggcagcaucagggacacaggggcaaagaacugccccaucuccuccc

SEQ ID NO: 57307 - RNA, 64 nt, Human
caaagacgcuggccuucagaccugaucagacucccaggggcagccaccacauguaugacagaga

SEQ ID NO: 57308 - RNA, 64 nt, Human
cuggcuauccucacaggcaccguagagguggggacaggggcaggggcaggggcggagccccuga

SEQ ID NO: 57309 - RNA, 64 nt, Human
auccucacaggcaccguagagguggggacaggggcaggggcaggggcggagccccugaagaagg

SEQ ID NO: 57310 - RNA, 64 nt, Human
uccacacacacaguuccaugacccagcgggcccccaggggcaucaggugcugguccuccucccu

SEQ ID NO: 57311 - RNA, 64 nt, Human
aauugagggugagggguuugggggaaaggggaagcaggggcauagucaggguggggaguguuug

SEQ ID NO: 57312 - RNA, 64 nt, Human
uucuuccacuuaggccucaauucccuuccuuuuccaggggcagccuuaguucccauggcccuga

SEQ ID NO: 57313 - RNA, 64 nt, Human
ugggggaggccaccccaaaccccagccccaacuccaggggcaccuaugagauggccaugcucaa

SEQ ID NO: 57314 - RNA, 64 nt, Human
gaaguuaaacaucugggauaugacgucuucaugccaggggcacucauuucuuagcagccucucu

SEQ ID NO: 57315 - RNA, 64 nt, Human
ucacugcagaaggccagauggcaggugccugggacaggggcaggugccccggggagggcaagua

SEQ ID NO: 57316 - RNA, 64 nt, Human
guggauuggucucuggcccagcccagucucuucucaggggcaggggguggagguuggggucacc

SEQ ID NO: 57317 - RNA, 64 nt, Human
aggucccuugacguuccgaggaugggaaaggugacaggggcauguauggaauuugcugcuucuc

SEQ ID NO: 57318 - RNA, 64 nt, Human
caaccccacuuuuuucuggaaaggagggguccugcaggggcaagcaggagcuagcagccgccua

SEQ ID NO: 57319 - RNA, 64 nt, Human
aaggggagugauggaagccuugcuuucacaucagcaggggcacaacuaaugagauuuucucuca

SEQ ID NO: 57320 - RNA, 64 nt, Human
cgauuuggacuugucugacaguagugagucacugcaggggcagccaaacauaugccccauuugg

SEQ ID NO: 57321 - RNA, 64 nt, Human
ccuucucuugcagagugugggggugguggugcugcaggggcagggcugggugggggucaccaga

SEQ ID NO: 57322 - RNA, 64 nt, Human
gugucgcaucaagauuuggcaggaucggcuuccucaggggcacagaccucucccacccacaaga

SEQ ID NO: 57323 - RNA, 64 nt, Human
guguacuguucaccaaauugugaauuugggggugcaggggcaggaguuggaaauuuuuuaaagu

SEQ ID NO: 57324 - RNA, 64 nt, Human
cacacugcccugucuccccacucaguggggaaagcaggggcagaugccacccugcccaggguug

SEQ ID NO: 57325 - RNA, 64 nt, Human
auguauuugaaggaaggucuaaccaggggguuuucaggggcauugucugaccacauucuuuuug

SEQ ID NO: 57326 - RNA, 64 nt, Human
aauaguggaacuucacacuuacaucaauucagugcaggggcauagaauaaaauauuaaauauug

SEQ ID NO: 57327 - RNA, 64 nt, Human
gcaaucauagcacuugccauuuaaaaacaugcuacaggggcacauuuucugugguuaaaaauga

SEQ ID NO: 57328 - RNA, 64 nt, Human
uccuucacaugaugggcaccugugggaaaccugccaggggcagccgauguucagaggcauccaa

SEQ ID NO: 57329 - RNA, 64 nt, Human
guuuuagugauuuuuuucauuguccauuacuugccaggggcaguuuuagcagcacuuuugauag

SEQ ID NO: 57330 - RNA, 64 nt, Human
ggacauugaggaagcuugagacauagggaugggacaggggcaaugacagccucuaacauggcca

SEQ ID NO: 57331 - RNA, 64 nt, Human
accccuuucuaguucaaugccucacgagauuugccaggggcauccaaggcaaacaaucccaauc

SEQ ID NO: 57332 - RNA, 64 nt, Human
agugaggcucccagagacgcagcugucucagugccaggggcagauugggugugaccucuccacu

SEQ ID NO: 57333 - RNA, 64 nt, Human
uuguagaaaaauggggccucuggugucucuuuaccaggggcagugccucucugcgggggaggaa

SEQ ID NO: 57334 - RNA, 64 nt, Human
gcccugccacccagaagucuggcugaggucugggcaggggcagggcaagcuugaccucucacug

SEQ ID NO: 57335 - RNA, 64 nt, Human
gagacaaggucucgcuguugcccaggcuagagcgcaggggcacaaucaccacacacugccgcuu

SEQ ID NO: 57336 - RNA, 64 nt, Human
auuuaaagauguggaccaaggccuguggguacuccaggggcaaggagagcccuggggucaguga

SEQ ID NO: 57337 - RNA, 64 nt, Human
gcagugaugaacaggaugacaagauucaugccaucaggggcaccuugucacugccgucugugca

SEQ ID NO: 57338 - RNA, 64 nt, Human
ccucgcaucuuuuuuuuuuuaagcuuuaacuuagcaggggcauggacuuuauagcacuuuuuca

SEQ ID NO: 57339 - RNA, 64 nt, Human
cguagagugaugugcacuccuggugggugaggggcaggggcaguggcagugugcaaagaauuga

SEQ ID NO: 57340 - RNA, 64 nt, Human
cccuccugaggaugcucgccagggaaacuggaaacaggggcagggcaaagacugcagagcugca

SEQ ID NO: 57341 - RNA, 64 nt, Human
uuaaccuguggccaaacucagagaugguaccagccaggggcaagcaugaccagagccagggacc

SEQ ID NO: 57342 - RNA, 64 nt, Human
guggacugaugccuucgaugggcaggaugaaggccaggggcacuggagugagggaguagauaaa

SEQ ID NO: 57343 - RNA, 64 nt, Human
auugcugcuaacagcauugccugugcucuccucucaggggcagcaugcuaacggggcgacgucc

SEQ ID NO: 57344 - RNA, 64 nt, Human
ggaugagucugcuugggccugagaguuugaucugcaggggcaggcucaucuuuucucuccccug

SEQ ID NO: 57345 - RNA, 64 nt, Human
aacagcagcucugggaggcacagagugcaggucucaggggcagaagacauggguuccaguucug

SEQ ID NO: 57346 - RNA, 64 nt, Human
aguaagcuuugcaucucuuacaagaggggagcuacaggggcagccguggccuaggcccaaacuc

SEQ ID NO: 57347 - RNA, 64 nt, Human
ucccugaggugaaccccagugcaacaccaaacuucaggggcacaagcgaggacacaucuaaggg

SEQ ID NO: 57348 - RNA, 64 nt, Human
gacauugccuagagggggagggacugucuggguucaggggcauggccuggagggcuggugggca

SEQ ID NO: 57349 - RNA, 64 nt, Human
ccucagaagcccagaccuggggaccccaccuacacaggggcauugacagacuggaguugaaagc

SEQ ID NO: 57350 - RNA, 64 nt, Human
cuguuuggcagguccuggacuggggccgggcaggcaggggcagggaggcgccccgggugggcuu

SEQ ID NO: 57351 - RNA, 64 nt, Human
gagucaccaccuugccggccacuccuccagcugccaggggcaucccacagacucugcagaggcu

SEQ ID NO: 57352 - RNA, 64 nt, Human
ccugaccugggugugccucgcugcuggggcucugcaggggcagcacagcuggggugcaggccag

SEQ ID NO: 57353 - RNA, 64 nt, Human
gaaacagaggccugggcucgguucccgggcccugcaggggcaggcccaggcagcgucagccgga

SEQ ID NO: 57354 - RNA, 64 nt, Human
gauugguggucgaagcaccaucuucacagauguucaggggcaguggggggcuccaggcacgguc

SEQ ID NO: 57355 - RNA, 64 nt, Human
ggagguggggguccaggagggggaucccucuccacaggggcagccccaagggcucggugcuauu

SEQ ID NO: 57356 - RNA, 64 nt, Human
caauuggggauccaggugucagagguaggggaaccaggggcaagcuggggcugagcuggaggug

SEQ ID NO: 57357 - RNA, 64 nt, Human
cauggccccggugcggcugcagcucacccagccccaggggcagaagagacccaaccacuucuau

SEQ ID NO: 57358 - RNA, 64 nt, Human
gagucucucugggccuuaggaagagccuuccacccaggggcagccccaggccaaaggggaccug

SEQ ID NO: 57359 - RNA, 64 nt, Human
ggccuggccagagccccuugcauauccccacugucaggggcagccaggacuguucccauccucc

SEQ ID NO: 57360 - RNA, 64 nt, Human
cauacugugugaccugccucugaaaccagggugccaggggcacugccuucucacagcuggccuu

SEQ ID NO: 57361 - RNA, 64 nt, Human
uggcuuccugggcgagccuaguagcuccugcaggcaggggcaguuuguugcguucuucgugguu

SEQ ID NO: 57362 - RNA, 64 nt, Human
ugcucaaaggucccugcguggggaggugucacaccaggggcacacccagggccaccugggugua

SEQ ID NO: 57363 - RNA, 64 nt, Human
cagaagagaugaggcuccugggacaggucagcgucaggggcagccugcugucugcucuggaggg

SEQ ID NO: 57364 - RNA, 64 nt, Human
uucgcucuaacucccucgguaggugauguaggaccaggggcacguggaacuucugggccuugcu

SEQ ID NO: 57365 - RNA, 64 nt, Human
cacagguagucggggaugucucgcuucuguggcacaggggcacacggucagaggcugaaaaggg

SEQ ID NO: 57366 - RNA, 64 nt, Human
agaauggcugcacguagguuccccagagagcaggcaggggcaucugucugucugugggcuucag

SEQ ID NO: 57367 - RNA, 64 nt, Human
cagcccuccaccacuuccacccuggcgaguggagcaggggcaggcgaaccucuuucuuugcaga

SEQ ID NO: 57368 - RNA, 64 nt, Human
cagggaaauaucagccuugggcaacugcagugaccaggggcaccggcugcccacagggaacaca

SEQ ID NO: 57369 - RNA, 64 nt, Human
aggggcucgguggcccagguggugguuccgccuccaggggcagggccuuguccugggucugugu

SEQ ID NO: 57370 - RNA, 64 nt, Human
gggcccuagauuuuuggggggucaccagccacuccaggggcagggaccauuucuucauuuucug

SEQ ID NO: 57371 - RNA, 64 nt, Human
uguuuacguuugagacacaaccagucauugguggcaggggcauagaguggucagucugaaaggg

SEQ ID NO: 57372 - RNA, 64 nt, Human
cuaagacuggucuucucagaugcccugcuuaaaucaggggcacuucaggcuccacaggcgucau

SEQ ID NO: 57373 - RNA, 64 nt, Human
cuuggacuuuuucucgccaucccuccccccagcgcaggggcacaagcugagcuuguaaaagccc

SEQ ID NO: 57374 - RNA, 64 nt, Human
gcccaccuggggucucucucccuaccucccuccucaggggcaacaacaggagaaugggguuccu

SEQ ID NO: 57375 - RNA, 64 nt, Human
acgcuccucccucugaggcuguaggacucgcagucaggggcagcugaccauggaagauugagag

SEQ ID NO: 57376 - RNA, 64 nt, Human
ggcugguggacagcagccagugugucuggacacccaggggcauugagacugcauguugucacau

SEQ ID NO: 57377 - RNA, 64 nt, Human
agagccuucuagaaugacagacugugcgaggaagcaggggcagggguuuccagcccgggcugug

SEQ ID NO: 57378 - RNA, 64 nt, Human
aggccgggagggagcagggucucccucagggcugcaggggcaggugcagggaagccccaggaug

SEQ ID NO: 57379 - RNA, 64 nt, Human
acaacuuaggggaagacgggguuuucgguggagccaggggcaaaucuuaaugggaccagugggg

SEQ ID NO: 57380 - RNA, 64 nt, Human
ggaaccacaagagagacugaggaaggccuggaggcaggggcagaggugacgacagugccccuau

SEQ ID NO: 57381 - RNA, 64 nt, Human
uaccuucaugacgggaaccuaaggacgaagccuacaggggcaagggccgcuucguauuccugga

SEQ ID NO: 57382 - RNA, 64 nt, Human
uguuuauguuugagauacaaccagucauugguggcaggggcauagaguggucagucugaaaggg

SEQ ID NO: 57383 - RNA, 64 nt, Human
gaucugcaugggaaacacccugaccuucuucugucaggggcacuuuccaggcuaugggugucug

SEQ ID NO: 57384 - RNA, 64 nt, Human
aguagaggcugaaggccacaggggaggccucagccaggggcaagugcccacagugacuccauuu

SEQ ID NO: 57385 - RNA, 64 nt, Human
cccgaucccucaaaugggcucuuggaggcacccccaggggcagcccauuucucaaaguccagaa

SEQ ID NO: 57386 - RNA, 64 nt, Human
gucugcuccucugugccaggugcugugcucugggcaggggcacugcaugggcugccugcccugg

SEQ ID NO: 57387 - RNA, 64 nt, Human
uauuuauguuugagacacaaccagucauugguggcaggggcauauaguggucagucugaaaggg

SEQ ID NO: 57388 - RNA, 64 nt, Human
cccccaccccacuaugaccuuugacccuacggcgcaggggcagccaggacccuugauucagacc

SEQ ID NO: 57389 - RNA, 64 nt, Human
guagacuugggggaggccugccccagagggagggcaggggcaucggaacuggaugagagugugg

SEQ ID NO: 57390 - RNA, 64 nt, Human
agaggaacugacucaccggcuguccuagaaugggcaggggcagagcgaaguucugggugggaug

SEQ ID NO: 57391 - RNA, 64 nt, Human
ugugaccagagcaugugcccagccccuccaccaccaggggcacugccgucauggcaggggacac

SEQ ID NO: 57392 - RNA, 64 nt, Human
gcacggccgggucuugucacuugugcaugcuucucaggggcagaacccgcucgugccaucuguc

SEQ ID NO: 57393 - RNA, 64 nt, Human
uuguacuguuucuuuaaaacagaguucuuaguaacaggggcaguuccugaauucaaauaaacca

SEQ ID NO: 57394 - RNA, 64 nt, Human
auugcuuuuuguuuuagugugucaccauaaauaucaggggcauaaaaggcuaucuauucuuaau

SEQ ID NO: 57395 - RNA, 64 nt, Human
uuaaaguuggccaagauaccaagaagguggcuugcaggggcaucuuuggcuucucauaauuuua

SEQ ID NO: 57396 - RNA, 64 nt, Human
gucuauggccaucgggucgucuccgaagauuuggcaggggcagaaaacucuggcaggcuuaaga

SEQ ID NO: 57397 - RNA, 64 nt, Human
aggcuggggcugagguccccaugggguuugggugcaggggcauggcacccuuuccugucgggaa

SEQ ID NO: 57398 - RNA, 64 nt, Human
aguuuagaccugcccagguguggagcgaggggcacaggggcauccuaaccucagaaacugaaau

SEQ ID NO: 57399 - RNA, 64 nt, Human
uagcugcuuggcggcggccagccccacagggggccaggggcauggccacaggccccccucccca

SEQ ID NO: 57400 - RNA, 64 nt, Human
acccccaccuacccacugcucccaggggucucuccaggggcagggggauuuuaggagauggggu

SEQ ID NO: 57401 - RNA, 64 nt, Human
ggucugggcuauuggcuggagccaggacaugagucaggggcaccauggaccucacgugccaggg

SEQ ID NO: 57402 - RNA, 64 nt, Human
caccacccaagagggaggguagcucuuccgccaccaggggcaagcacagguccugguggcccca

SEQ ID NO: 57403 - RNA, 64 nt, Human
cagguugucagagcuauguggagucuguggguggcaggggcagccgcuccagccuuugaagacu

SEQ ID NO: 57404 - RNA, 64 nt, Human
aggcuuggacuuccugggagcuccuccaaguacccaggggcaucagagcugccuggguguuaca

SEQ ID NO: 57405 - RNA, 64 nt, Human
guccuaauccugugugccagggcaggcagugccccaggggcaccacgccugacucuccaucacc

SEQ ID NO: 57406 - RNA, 64 nt, Human
ugcccagggucugagggggcugcccagugaguggcaggggcaggagaggggagaaccccauccu

SEQ ID NO: 57407 - RNA, 64 nt, Human
ucccucccggugcuggggggcagcugaggggcugcaggggcagucucccuccuccaagccccug

SEQ ID NO: 57408 - RNA, 64 nt, Human
aaguguggggaagagauaggaaccagcaggauggcaggggcaaagggcucaagggugaggaggc

SEQ ID NO: 57409 - RNA, 64 nt, Human
cuggaacugaauggcgcuucgggauucugaguagcaggggcagcaugcccagugggccuggggu

SEQ ID NO: 57410 - RNA, 64 nt, Human
uccggaauugaggggcacgcaggauucugagcaccaggggcagaggcggccagacaaccucagg

SEQ ID NO: 57411 - RNA, 64 nt, Human
caagagggcaccugaggagacuuuggggacagggcaggggcagggagggaaacugaggaaaucu

SEQ ID NO: 57412 - RNA, 64 nt, Human
cauuccucccaacagcucaaaauuaggccuugggcaggggcagggagagcugcugagccuaaag

SEQ ID NO: 57413 - RNA, 64 nt, Human
aaagguauuuguugguuuauguuacuuaauaguccaggggcaccuggcuucagguagguuugau

SEQ ID NO: 57414 - RNA, 64 nt, Human
agagccaacagguggggagagacagagaagugggcaggggcacccaaguugggauuucauuuca

SEQ ID NO: 57415 - RNA, 64 nt, Human
cugcccaagauuccgagagcccugcgcucuagggcaggggcagaguuuuggaaacagugcaggc

SEQ ID NO: 57416 - RNA, 64 nt, Human
ccuugaacaaaaccaaguccacuggggacagaggcaggggcaaguggcucuccccauuaccuuc

SEQ ID NO: 57417 - RNA, 64 nt, Human
ccucaaagacaguguccccuccacagcugggugccaggggcaggggauccucaguauagccggu

SEQ ID NO: 57418 - RNA, 64 nt, Human
cuuccuccauuguugcccuggaauguacgggacccaggggcagcagcaguccaggugccacagg

SEQ ID NO: 57419 - RNA, 64 nt, Human
cacacgcgugucuucgugcacuccccgugcgguacaggggcacuucguaacccagggaaagggc

SEQ ID NO: 57420 - RNA, 64 nt, Human
aagggugaaauugccacagcuggcugacacaggacaggggcaacugguuuggcaaccccacauc

SEQ ID NO: 57421 - RNA, 64 nt, Human
uguguccccuugaggguacccuggguccccucaucaggggcagaggcaugaaagagucggggcu

SEQ ID NO: 57422 - RNA, 64 nt, Human
gugucgccaccgcccauaaaggagcugagcccagcaggggcacugccuggggcccuguagccaa

SEQ ID NO: 57423 - RNA, 64 nt, Human
gauguccuuccuggggaagaagaagcaccagccacaggggcagguguccucccaggaaguacag

SEQ ID NO: 57424 - RNA, 64 nt, Human
aaggggugucugggaccuggauggccagcagggacaggggcauugucaucucaaaggcccaacc

SEQ ID NO: 57425 - RNA, 64 nt, Human
ccgaaggacacccagcaggcaccccccggggaggcaggggcagaggucagaaggggugucuggg

SEQ ID NO: 57426 - RNA, 64 nt, Human
ggaggauccaccccaaccucugcccugcccgccccaggggcaccccgacauccaggccaccccc

SEQ ID NO: 57427 - RNA, 64 nt, Human
acaggacggaugaagaaggggugggguuaagacucaggggcaccugagggucugagcccccuua

SEQ ID NO: 57428 - RNA, 64 nt, Human
uauggaacagggauggcgaggccucucucaggagcaggggcauugcugauuuugucugcccaau

SEQ ID NO: 57429 - RNA, 64 nt, Human
accuaccccgagcaucucucucuguaagcagcuucaggggcaguccguuucucugugcuucuga

SEQ ID NO: 57430 - RNA, 64 nt, Human
gcgaacucccccgaagaaggaccagugaagacgucaggggcaaggucucggggguccggaaggg

SEQ ID NO: 57431 - RNA, 64 nt, Human
accagaggacuuagggccagcccugcgugaacugcaggggcaauggaugguaaagcccuuuggc

SEQ ID NO: 57432 - RNA, 64 nt, Human
cucugggcgggcaugggggguggugggugccagccaggggcauggacagagccuuuuucuaaag

SEQ ID NO: 57433 - RNA, 64 nt, Human
aguggagcuagaccugccaggagcacuuggccugcaggggcaggucccagccgcuaaaaugggc

SEQ ID NO: 57434 - RNA, 64 nt, Human
acaugguggaaauuguguagcucugugauucuuccaggggcauguuauuuuagguucugugaac

SEQ ID NO: 57435 - RNA, 64 nt, Human
cagcuggagaauccaccagcacaagaagaggaggcaggggcagaaacccaagggggcuccccca

SEQ ID NO: 57436 - RNA, 64 nt, Human
gccccagagcgaaugagggcagagaugcccggggcaggggcaaacgcccuccgcucccucugcu

SEQ ID NO: 57437 - RNA, 64 nt, Human
cacccagggccaggagaacaggaacagaacugagcaggggcaggucuccaaggcaagcccagcu

SEQ ID NO: 57438 - RNA, 64 nt, Human
cuuguuuaccugugggaggaaacacuuuuuuugucaggggcagccugguucagagcucagaggu

SEQ ID NO: 57439 - RNA, 64 nt, Human
cuuggccucuucugcaagaggaaucucuugaaaacaggggcacacagaaauuugauuuguggcc

SEQ ID NO: 57440 - RNA, 64 nt, Human
gaggcgcucacagccucgcgaagguggagaagggcaggggcaggagagggcugcggaggagggg

SEQ ID NO: 57441 - RNA, 64 nt, Human
caaaagaggggggagacuggaggcaccccugcagcaggggcacuucccuagggcuccagagggg

SEQ ID NO: 57442 - RNA, 64 nt, Human
acucacucucagccacagggagcugcaugcaccacaggggcaaugcaccuuugcagggguaccu

SEQ ID NO: 57443 - RNA, 64 nt, Human
cacuguaccugcccuagaaccugggccuaggccacaggggcagggagaagagaaggcauuagua

SEQ ID NO: 57444 - RNA, 64 nt, Human
uggccacugacagccacuccaggaacuugaacugcaggggcagagccagugaaucaccggaccu

SEQ ID NO: 57445 - RNA, 64 nt, Human
uauccaaauaaaagccugaaagccauuggugauccaggggcaccuucucuucagcuugacuggg

SEQ ID NO: 57446 - RNA, 64 nt, Human
acacugcagugaggccaggcaccucagugcugggcaggggcaucagaaggugcuaagcccucuc

SEQ ID NO: 57447 - RNA, 64 nt, Human
uggacagccagcugcagggccugagcauggcuggcaggggcagcugcuguggcaaacuggccuu

SEQ ID NO: 57448 - RNA, 64 nt, Human
ggaauguccugggcuccuucaggagcucucuacccaggggcaaggagagcccagagagaagcgc

SEQ ID NO: 57449 - RNA, 64 nt, Human
gagaccacccagcccugaccugggaccccaggcccaggggcacauugaacaggaggacggggcu

SEQ ID NO: 57450 - RNA, 64 nt, Human
agagagggugacauccuggggcuugugacauuuccaggggcacucauggcccucucugcucugc

SEQ ID NO: 57451 - RNA, 64 nt, Human
cuucccccaaggcugaugcauucccggugcagaacaggggcacccuccaaacacugggcucuga

SEQ ID NO: 57452 - RNA, 64 nt, Human
aaagauggcgcacccggcagccccccaguguccccaggggcacacuuccccuugggaugggcac

SEQ ID NO: 57453 - RNA, 64 nt, Human
aauuugguuuuggugcucaaggguucuuuccucccaggggcagguguuucuuuccuguuugucu

SEQ ID NO: 57454 - RNA, 64 nt, Human
uugcugaccguuuugggguuccccgccggagcuacaggggcauuuucuucccuaaaaccaacag

SEQ ID NO: 57455 - RNA, 64 nt, Human
ccagagaugcuggaaucgcuaggaggguuggcuccaggggcagccaauuccuaucauucagauc

SEQ ID NO: 57456 - RNA, 64 nt, Human
aggccguccuguagguccuagaggagccacagcccaggggcagaugaaggggcugcggaagacg

SEQ ID NO: 57457 - RNA, 64 nt, Human
uccggggccauggcacugcuguucagcucaggcacaggggcacagcagagguuugggaagcggu

SEQ ID NO: 57458 - RNA, 64 nt, Human
ccccugaccucaguucugugccccaccaaaugcccaggggcaagaggccacccuggaagcugcc

SEQ ID NO: 57459 - RNA, 64 nt, Human
ccucagauccugucauugccugcccagaguccuucaggggcaccccucugccuuggugugcagu

SEQ ID NO: 57460 - RNA, 64 nt, Human
aacccauggaaggagaagcgaggugaugcagcagcaggggcaagacccuggguccaguggaggc

SEQ ID NO: 57461 - RNA, 64 nt, Human
gucaugccccaacgcgugcuagagaggcccaauccaggggcagaaaacagggggccuaaagaau

SEQ ID NO: 57462 - RNA, 64 nt, Human
guacgcagagacccccuugucguccuggacaccacaggggcaccugcaggcugggagaccaggu

SEQ ID NO: 57463 - RNA, 64 nt, Human
gauucugaaggacaggccguggaguuuuagguuucaggggcaagagcaguuuucaaaagucuuu

SEQ ID NO: 57464 - RNA, 64 nt, Human
aucgagacgggcagcacucaugggugccaaggggcaggggcagugggggcucgggcaggagcac

SEQ ID NO: 57465 - RNA, 64 nt, Human
ccgcccucccuaucuugcugcuccucuuggcacucaggggcaccuuccauggagccagaccggg

SEQ ID NO: 57466 - RNA, 64 nt, Human
gauccugcauaucuacuggagccauaugagcccucaggggcacugguguccugcagucuuacua

SEQ ID NO: 57467 - RNA, 64 nt, Human
auguagagagaaaaaugacuuuuucaaaaauauacaggggcagcugccaaauugauguauuaua

SEQ ID NO: 57468 - RNA, 64 nt, Human
acagugccccaguggugcgggccaggucuggcgccaggggcaggcagcuaggcagggagggggc

SEQ ID NO: 57469 - RNA, 64 nt, Human
auaacugcucugagcagagaugaguggugguuggcaggggcaggcaacuuugggugcugcugau

SEQ ID NO: 57470 - RNA, 64 nt, Human
gaccugcagcagggguuuguggagguggguagggcaggggcagguugcuaagucaggugcagag

SEQ ID NO: 57471 - RNA, 64 nt, Human
auuugccucuggccugguugcuagaaguuugccccaggggcaagaguugaaauuuggcuuccug

SEQ ID NO: 57472 - RNA, 64 nt, Human
uucugcagaaauaucaaugagacuugguaugggacaggggcagaaaacacuacauaggccucca

SEQ ID NO: 57473 - RNA, 64 nt, Human
gcuccccaaggcuggugggacggggucccgguggcaggggcagguaucuccuucccguuccuca

SEQ ID NO: 57474 - RNA, 64 nt, Human
gcugccggguggcacccuuuacaguuccuuugaacaggggcauugaaggccuggacugccucuc

SEQ ID NO: 57475 - RNA, 64 nt, Human
uaucuggcuuauccaucaguuucugaaccaacaucaggggcaccugccaugaugagugugaaga

SEQ ID NO: 57476 - RNA, 64 nt, Human
uuuguuccuucccuucuaggucagucaccacgaacaggggcacucggcaugcugccccagcacu

SEQ ID NO: 57477 - RNA, 64 nt, Human
aucacccauccccauccccugacucuuucaccggcaggggcacguggucaacaggacuccccaa

SEQ ID NO: 57478 - RNA, 64 nt, Human
uucaggcagggaaguacaagaccacucuuguauucaggggcaaccaaaggagagaauuacguac

SEQ ID NO: 57479 - RNA, 64 nt, Human
cacuuggcaugaagccuccacagcuccccgccugcaggggcaaagaggucgacagcaaugugug

SEQ ID NO: 57480 - RNA, 64 nt, Human
uuuggguuuauggggagcuuuuguugcacccaugcaggggcaaucagaucagcaucuucaugca

SEQ ID NO: 57481 - RNA, 64 nt, Human
cugacugccuuagcagugggggugggggugggggcaggggcaggggcuuuauguguuuuugcuu

SEQ ID NO: 57482 - RNA, 64 nt, Human
agccauuuguuguaaaugccaauaaaauauucaccaggggcaagaauguacauuuucuuuuuag

SEQ ID NO: 57483 - RNA, 64 nt, Human
uuuacagauaucacccacacacaccucgcuggggcaggggcacccagcaucagcccuggggaga

SEQ ID NO: 57484 - RNA, 64 nt, Human
ucccaggacauuuggggcaagugaguuaggggcccaggggcaauuuucccucugaauaacgugu

SEQ ID NO: 57485 - RNA, 64 nt, Human
uccaaaauacuuaaaaauaauagugucaaaaauucaggggcaguuaaggagucauggauggaac

SEQ ID NO: 57486 - RNA, 64 nt, Human
cuagucauuucaauacccaaagaaagacaagugacaggggcaauggaucucaggcucugagaua

SEQ ID NO: 57487 - RNA, 64 nt, Human
cccggugcacgccgaaauuucuguuuauuucacucaggggcacugugguugcugugguuggaau

SEQ ID NO: 57488 - RNA, 62 nt, Human
gugcucuugacaucacuguacucccucucccuccccgcaacccugccccaccuugcauccag

SEQ ID NO: 57489 - RNA, 62 nt, Human
ugcgaucaauucugcauggucacaguagagauccccgcaacucgcuuguccuugggucaccc

SEQ ID NO: 57490 - RNA, 62 nt, Human
cucucucugucacccaaguuggagugcaguggccccgcaaucucggcucacugcaaccucua

SEQ ID NO: 57491 - RNA, 62 nt, Human
ugccguuuaagcuuugcuugcaagaguggaugccccgcaaucguuccugcucucccgggccc

SEQ ID NO: 57492 - RNA, 62 nt, Human
cugcagcccccacucagccggcagccagauggccccgcaaggccuccagggauggccccuag

SEQ ID NO: 57493 - RNA, 62 nt, Human
uucaaaaaguacaucuucccccccccccccccccccgcaaaauaauucuguggcagggcaag

SEQ ID NO: 57494 - RNA, 62 nt, Human
uuguggacugccucggacccagccacgcugcuccccgcaaugcugauggggcugugcauuga

SEQ ID NO: 57495 - RNA, 62 nt, Human
ugcacucggucgggccuccacaggcauggaguccccgcaaaaaccuggccccugcaggaguc

SEQ ID NO: 57496 - RNA, 62 nt, Human
uaacugaggagcuaguguuaauccagagaaccccccgcaaugugcuuccgagauucagacug

SEQ ID NO: 57497 - RNA, 62 nt, Human
uuaagauagguucuuucuguauaugaaacgcuccccgcaaauucacuggcagcucagaauua

SEQ ID NO: 57498 - RNA, 62 nt, Human
aacccugcgaaucaaaacaacccccacacagaccccgcaauccuuuuuuaaaaaaucugcca

SEQ ID NO: 57499 - RNA, 62 nt, Human
cccugcugcgaaaguucuuggugguggaugacccccgcaaguuugcacucuuugagcgcgcu

SEQ ID NO: 57500 - RNA, 62 nt, Human
acauguuuagcaaaaaccaauucaguuccauuccccgcaaaaaaccccuaacuuuacucuga

SEQ ID NO: 57501 - RNA, 62 nt, Human
auuggaaggcagcucccgcauaccaggauaacccccgcaaaccacauagcagacccccgcca

SEQ ID NO: 57502 - RNA, 62 nt, Human
uuguucuucccccuguccccaacccacucucaccccgcaacccaucaguauuuuaguuauuu

SEQ ID NO: 57503 - RNA, 62 nt, Human
ugcaguccuugcucauauuuccuucaucuuaaccccgcaaacaagaauuaagaugaucccaa

SEQ ID NO: 57504 - RNA, 62 nt, Human
ccagaguagggguuggggggaguguggacaaaccccgcaaaucagaguggggaaggugagug

SEQ ID NO: 57505 - RNA, 62 nt, Human
cucagcugugguacugcccuguaagaaccugcccccgcaaaacucuggagucccugggacac

SEQ ID NO: 57506 - RNA, 62 nt, Human
cauuaggugauacauagauaagggcuuuuucuccccgcaaacaccccuaagaaugguucugu

SEQ ID NO: 57507 - RNA, 62 nt, Human
agaaaccagguuauuucucccugcuuauggcuccccgcaaagggacuugcagcguguccugc

SEQ ID NO: 57508 - RNA, 62 nt, Human
ugcuucccucagaggaccuuccaauccauuugccccgcaacccuggcugcuccgacagggga

SEQ ID NO: 57509 - RNA, 62 nt, Human
ucucccugucaauggccucgugucccccccuaccccgcaacacccacaucaccuccccacca

SEQ ID NO: 57510 - RNA, 62 nt, Human
agaagggaaaggcggcuguuuggcucuuucucccccgcaaggacccgcugacccgcuggaug

SEQ ID NO: 57511 - RNA, 62 nt, Human
uccagcugagccugucucugaauuguucccucccccgcaaugugggcacuuaccauguuccu

SEQ ID NO: 57512 - RNA, 62 nt, Human
augggagaagaaggaaggggguggcccgucacccccgcaagacuugcauccagguagccuaa

SEQ ID NO: 57513 - RNA, 62 nt, Human
aggcccugggacucugagcguccgugucucucccccgcaacccauccucagccggggccguc

SEQ ID NO: 57514 - RNA, 62 nt, Human
ugacuugcauguuugcuucugggacgucugugccccgcaaguguuugaguuuggccuccacc

SEQ ID NO: 57515 - RNA, 62 nt, Human
agccgggagggucgaacgcccagggcacugcgccccgcaacugacgcuccugcaaggaaaag

SEQ ID NO: 57516 - RNA, 62 nt, Human
uucuagucaauucugaaccaccaccccccgccccccgcaaaaaaguaaaagucaaaccaaac

SEQ ID NO: 57517 - RNA, 62 nt, Human
aaacucauagacacaucggcuguucacacguuccccgcaaucugagaacgaacaggaaugga

SEQ ID NO: 57518 - RNA, 62 nt, Human
ggccaaacaggcccuccucccucccagcuccaccccgcaagcaccauccccuccggcuaagc

SEQ ID NO: 57519 - RNA, 62 nt, Human
cauccuaggcaacagagcgagacucugucuccccccgcaaaaaaaaaaaagaaagaaagaaa

SEQ ID NO: 57520 - RNA, 62 nt, Human
gccaccgccccagccucaccccaucccacgacccccgcaacccuucacaucaccccccucga

SEQ ID NO: 57521 - RNA, 62 nt, Human
ccuggggacauuuccucaaagcaguuuugcgcccccgcaagggaauggucagccuaagggua

SEQ ID NO: 57522 - RNA, 62 nt, Human
gagcuggcugagucacagccaccuccccaccuccccgcaagcuggucccaucgaccagcaag

SEQ ID NO: 57523 - RNA, 62 nt, Human
guccagugaauccacgacccgcagaccuguccccccgcaacagcuuauaccauggaaugagg

SEQ ID NO: 57524 - RNA, 62 nt, Human
accaggaagcugccaucagggaucuuccccugccccgcaaagcuaggcuccagcugcaggcg

SEQ ID NO: 57525 - RNA, 62 nt, Human
gccagcccccagggcuuguccaccagucuucuccccgcaaggcccucagagcagcgccugug

SEQ ID NO: 57526 - RNA, 62 nt, Human
cuucaaagucuaccagcacaaagaccccugagccccgcaauugugaucccacaagacaugca

SEQ ID NO: 57527 - RNA, 62 nt, Human
ccuuccauucccaccacacagacucugggccuccccgcaaaauggcuccagaauuagaguaa

SEQ ID NO: 57528 - RNA, 62 nt, Human
uucugcucagucugucccccuucccccucgacccccgcaaugagugggcaccaggggacgcu

SEQ ID NO: 57529 - RNA, 62 nt, Human
ccgcccuggcuuggcagcccugcccacgcugcccccgcaaacaauggugugugcguuuuuac

SEQ ID NO: 57530 - RNA, 62 nt, Human
uuguaacuaaaaucuuccucaggacuauuaacccccgcaaaguuucuauagggaacugccua

SEQ ID NO: 57531 - RNA, 62 nt, Human
gggagaaaaacucucaucccugacccuuccccccccgcaaauguuagaccagagcuguugau

SEQ ID NO: 57532 - RNA, 62 nt, Human
uggagaccagacucugcaaguggggagaccacccccgcaagccagugacaagggagcccuga

SEQ ID NO: 57533 - RNA, 62 nt, Human
ugccccucaaguucaaccccgggaccgcccagccccgcaaagcaaagacccugacuucuccu

SEQ ID NO: 57534 - RNA, 62 nt, Human
aggaucuuuaggccugaguugugaagcgcaacccccgcaaaacgcauuugccaucacaguug

SEQ ID NO: 57535 - RNA, 62 nt, Human
acacagacacguaauaccagaccaaccucaauccccgcaaacuaaagcaaagcuaauugcaa

SEQ ID NO: 57536 - RNA, 62 nt, Human
uccagaauccugaugguaucaauggauuuaucccccgcaaagacaucaaaccugaguaucag

SEQ ID NO: 57537 - RNA, 62 nt, Human
aaguagaucaccuccucgaacccacuccgguuccccgcaacccacagcucagcugcccaucc

SEQ ID NO: 57538 - RNA, 62 nt, Human
cuccaggccgugggggcugcugaaggcucuuuccccgcaagggccagguguugacaccuuaa

SEQ ID NO: 57539 - RNA, 62 nt, Human
cuguggcuuuauccaucagcucccugggccuuccccgcaacccaccucggggaucugaggau

SEQ ID NO: 57540 - RNA, 62 nt, Human
cagagcugggugaguggggagacaccucagagccccgcaaaacccacugaccggaggcaaaa

SEQ ID NO: 57541 - RNA, 62 nt, Human
cccugcagcuucacagggacgcuuccuucccuccccgcaaccaccccaggcuccccugggag

SEQ ID NO: 57542 - RNA, 62 nt, Human
gccuggccuguaacuuauaaagugcaccucgcccccgcaagccccagccccgaggaccgucc

SEQ ID NO: 57543 - RNA, 62 nt, Human
gagacagacaugagagacaagcaucuucuuucccccgcaaguccauuuuauuuccuucuugu

SEQ ID NO: 57544 - RNA, 62 nt, Human
ugucccuuucugugugaagaucacguuccuucccccgcaaugugcccccagacgcacguggg

SEQ ID NO: 57545 - RNA, 62 nt, Human
acgcacacggccccgcacacagccccgccccaccccgcaaccagcccugucgacugccuuau

SEQ ID NO: 57546 - RNA, 62 nt, Human
ccaccccacccacccucggggcgccccccuccccccgcaagccagccugggccagccccgcu

SEQ ID NO: 57547 - RNA, 62 nt, Human
uguccccgccucuguagacaauggcucugacuccccgcaacuuccugccucugagagaccug

SEQ ID NO: 57548 - RNA, 62 nt, Human
uauaaguuauuuguugcagcauaacaaaugauccccgcaaauuuuguggcuucaaacacgaa

SEQ ID NO: 57549 - RNA, 62 nt, Human
ugaagcuccuuuccccuugcucuuggucccugccccgcaagcaaaccugcccccucugccuc

SEQ ID NO: 57550 - RNA, 62 nt, Human
uaccuccgcauuugacacgagucugcugugaaccccgcaaccuccuccccaccucccaucuc

SEQ ID NO: 57551 - RNA, 62 nt, Human
gauucugucggcaguugaaggcccgucugaggccccgcaaugcgaggguccugugucccacu

SEQ ID NO: 57552 - RNA, 62 nt, Human
gccugcugggaguggcuguuuuuaugccccagccccgcaaguuggggaguguuugugggggu

SEQ ID NO: 57553 - RNA, 62 nt, Human
uagcacacucuccgauuugggccauuuaugcaccccgcaaccugggaucucaaggagcuuua

SEQ ID NO: 57554 - RNA, 62 nt, Human
ugagcagagaccccgugcagugcauucagacaccccgcaaagcaggacucuguggaaauuga

SEQ ID NO: 57555 - RNA, 62 nt, Human
accgugagaagucaacaacuuagccaccacuuccccgcaauggaccauguaacaaauaccuc

SEQ ID NO: 57556 - RNA, 62 nt, Human
ucucugcugugguugcugcagcuccaggaaguccccgcaaugucucacguugucuuugacca

SEQ ID NO: 57557 - RNA, 62 nt, Human
ccacagagauagagcugaggaguccuguguucccccgcaaggagcaccccgggaucauuuuc

SEQ ID NO: 57558 - RNA, 62 nt, Human
uaccauccccuucccuggcugcuggaaauggaccccgcaacccuguccucugcugggccccc

SEQ ID NO: 57559 - RNA, 64 nt, Human; identical to SEQ ID NO: 21846

SEQ ID NO: 57560 - RNA, 64 nt, Human; identical to SEQ ID NO: 21847

SEQ ID NO: 57561 - RNA, 64 nt, Human; identical to SEQ ID NO: 21848

SEQ ID NO: 57562 - RNA, 64 nt, Human; identical to SEQ ID NO: 21849

SEQ ID NO: 57563 - RNA, 64 nt, Human; identical to SEQ ID NO: 21850

SEQ ID NO: 57564 - RNA, 64 nt, Human; identical to SEQ ID NO: 21851

SEQ ID NO: 57565 - RNA, 64 nt, Human; identical to SEQ ID NO: 21852

SEQ ID NO: 57566 - RNA, 64 nt, Human; identical to SEQ ID NO: 21853

SEQ ID NO: 57567 - RNA, 64 nt, Human; identical to SEQ ID NO: 21854

SEQ ID NO: 57568 - RNA, 64 nt, Human; identical to SEQ ID NO: 21855

SEQ ID NO: 57569 - RNA, 64 nt, Human; identical to SEQ ID NO: 21856

SEQ ID NO: 57570 - RNA, 64 nt, Human; identical to SEQ ID NO: 21857

SEQ ID NO: 57571 - RNA, 57 nt, Human; identical to SEQ ID NO: 21858

SEQ ID NO: 57572 - RNA, 64 nt, Human; identical to SEQ ID NO: 21859

SEQ ID NO: 57573 - RNA, 64 nt, Human; identical to SEQ ID NO: 21860

SEQ ID NO: 57574 - RNA, 64 nt, Human; identical to SEQ ID NO: 21861

SEQ ID NO: 57575 - RNA, 64 nt, Human; identical to SEQ ID NO: 21862

SEQ ID NO: 57576 - RNA, 64 nt, Human; identical to SEQ ID NO: 21863

SEQ ID NO: 57577 - RNA, 64 nt, Human; identical to SEQ ID NO: 21864

SEQ ID NO: 57578 - RNA, 64 nt, Human; identical to SEQ ID NO: 21865

SEQ ID NO: 57579 - RNA, 64 nt, Human; identical to SEQ ID NO: 21866

SEQ ID NO: 57580 - RNA, 64 nt, Human; identical to SEQ ID NO: 21867

SEQ ID NO: 57581 - RNA, 64 nt, Human
acccugugcccuccuucccaaucuucuuuuucaggcucgccaaggccuaggaccuauguuguaa

SEQ ID NO: 57582 - RNA, 64 nt, Human
gcugcgcccacacucucgccagaguccccagccggcucgccagccaugaugcugcagccgggcc

SEQ ID NO: 57583 - RNA, 64 nt, Human
gaccugcaggaucucaagcauaauggauacaagggcucgccacgggccuugccugagccaugug

SEQ ID NO: 57584 - RNA, 64 nt, Human
caccucagccuccugaguagcuaggacuacagaugcucgccaccacaccuggcuaauuuuuuuu

SEQ ID NO: 57585 - RNA, 64 nt, Human
ucucucaugcuucuugaguugcuucaugguuuaugcucgccauggaaagcuaucaguaacaguu

SEQ ID NO: 57586 - RNA, 64 nt, Human
gugaguuugacggugcaucagcaugccgcguuaggcucgccauggaaauacgcgcggggagcgg

SEQ ID NO: 57587 - RNA, 64 nt, Human
ucuuuguguagaacagaauguacacauuauagcagcucgccauuguguuugcauuuuuuaagaa

SEQ ID NO: 57588 - RNA, 64 nt, Human
cuccuuaaaugcuucuagggaccagcaauacagugcucgccacagugggcagucacacaaagcu

SEQ ID NO: 57589 - RNA, 64 nt, Human
uucuggugcauguucuuuucuggaaaauaugguagcucgccaaccgcaucugcucaucugauau

SEQ ID NO: 57590 - RNA, 64 nt, Human
ccgcggguccucacaccgcacggcaggcacagaggcucgccaggcccugauccggucugugggg

SEQ ID NO: 57591 - RNA, 64 nt, Human
ggagccacugccuaguucuucagcccuagauggugcucgccagaccuccucucaaugcucauca

SEQ ID NO: 57592 - RNA, 64 nt, Human
ugccucagccucccgaguagcugggacuacaggagcucgccaccacacccagcuaauuuuuuuu

SEQ ID NO: 57593 - RNA, 64 nt, Human
caguccccuguggaacagcucuucccugggccuagcucgccagcgcugugcuccucauggacgg

SEQ ID NO: 57594 - RNA, 64 nt, Human
uccagcgaguggcaguggagcugauucugagccagcucgccauaucuucuccuuuuccugguug

SEQ ID NO: 57595 - RNA, 64 nt, Human
auggugacaaaccauggcugcugcuuucugcccagcucgccaguccuccccaaagaguugcgca

SEQ ID NO: 57596 - RNA, 64 nt, Human
ucuuuuggggguuagaaggucagguguggagacugcucgccagucucugugagccuaggcccug

SEQ ID NO: 57597 - RNA, 64 nt, Human
uaugggccgaagacccuucuucccuggcugccaggcucgccaggagcccacuggaaacgcccac

SEQ ID NO: 57598 - RNA, 64 nt, Human
gcaggccgugugggugcccggcgugagggaucaggcucgccagggccacaggacaggugaugac

SEQ ID NO: 57599 - RNA, 64 nt, Human
cgccgcucaacgggcagcugugcgccaagcaggcgcucgccagccucggcgccuggacucgagc

SEQ ID NO: 57600 - RNA, 64 nt, Human
ggacgugggacuuuuggacccguccuuuggugcagcucgccagggaugagaggcaccucccuac

SEQ ID NO: 57601 - RNA, 64 nt, Human
ugccucagccuccugaguagcugggacuacaggcgcucgccauguauuuagcagagacgggguu

SEQ ID NO: 57602 - RNA, 64 nt, Human
aucucggcggaagaggaaaauggagcuuuuugaggcucgccaggucccuuuuguuuucaccauu

SEQ ID NO: 57603 - RNA, 64 nt, Human
gccaugcaugugcgcccgcagcccugccuccacagcucgccacacacucacgcuucgccagaga

SEQ ID NO: 57604 - RNA, 64 nt, Human
ccaucccuccuaagaaucuuaaaaaacuugaaaugcucgccaaauguccccaugggauuuuuga

SEQ ID NO: 57605 - RNA, 64 nt, Human
gauacucgccguccuccuguccucgcggugccuugcucgccaagcggucccggagcaggcuuuc

SEQ ID NO: 57606 - RNA, 64 nt, Human
ccgccugccugcagaggcgcccuuuucagcugcugcucgccagaagcccuugauuccacugguu

SEQ ID NO: 57607 - RNA, 64 nt, Human
uucacuugguccuagaauguggcaacguaguugugcucgccagaacgugggaccaaauuggccu

SEQ ID NO: 57608 - RNA, 64 nt, Human
auccccugccuggugcccacacugccucgcaagcgcucgccacccucacguggcucaccugcug

SEQ ID NO: 57609 - RNA, 64 nt, Human
ugggaggggagcuugguggcccccguggcugcaagcucgccacaacauggcucuuugugagccu

SEQ ID NO: 57610 - RNA, 64 nt, Human
aaccuccaucagucccagggccccuccugaggaugcucgccagggaaacuggaaacaggggcag

SEQ ID NO: 57611 - RNA, 58 nt, Human
agccggccugugacaccugaagccgccagcucgccacaggggccagggagcuggagau

SEQ ID NO: 57612 - RNA, 64 nt, Human
agcucuacaggugaggcccagcagagggaguagggcucgccauguuucuggugagccaauuugg

SEQ ID NO: 57613 - RNA, 64 nt, Human
ggaggggcaggcugacaucuguguuucaaguggggcucgccaugccggggguucauaggucacu

SEQ ID NO: 57614 - RNA, 64 nt, Human
ucauguaaggacaugcuuaugaaaugugagagaggcucgccacuaaguauucuaaauacuuuuc

SEQ ID NO: 57615 - RNA, 64 nt, Human
ugcagagacuggaccccgcccagcauugggcugggcucgccacaucccaugagaguagagggca

SEQ ID NO: 57616 - RNA, 64 nt, Human
ucagacguugacuuagcaacugcguuuuuucccagcucgccacagaauggaucaugaagacuga

SEQ ID NO: 57617 - RNA, 64 nt, Human
ggggcagcaaacuuuguccugguaccugggcccagcucgccagggaugugggcagagcaccagc

SEQ ID NO: 57618 - RNA, 64 nt, Human
uaaaacuagugacagcuuguggcuuuuuauuagagcucgccacgaacuaggguaaggugagugu

SEQ ID NO: 57619 - RNA, 64 nt, Human
gccgcuggccagaccgugaccaugcugccagugugcucgccaugagcugggucagggcugggga

SEQ ID NO: 57620 - RNA, 64 nt, Human
augugccuuccacaguugaaacuugagaagcagagcucgccaccuucuggaggccacugugaug

SEQ ID NO: 57621 - RNA, 64 nt, Human
guguugcaccaggcacugcugcacaacaagauacgcucgccacaguccuucuuugacaccacac

SEQ ID NO: 57622 - RNA, 64 nt, Human
cugccgucaaggggcucaggaaagcggacgcgaggcucgccaucgcaagguacagacgggaccu

SEQ ID NO: 57623 - RNA, 64 nt, Human
acugguugaggguggaaccuccaggcaggaaccggcucgccacccucugcccgguaagggcugc

SEQ ID NO: 57624 - RNA, 64 nt, Human
agggagcuucgugucugugcuggagcugcagccugcucgccaucuggaggcucaguggaguggg

SEQ ID NO: 57625 - RNA, 64 nt, Human
ccccuccuaccugccaccgcuggggaggcacagagcucgccagcgucccuggaguccccucagg

SEQ ID NO: 57626 - RNA, 64 nt, Human
uagacccccugcagcguuaggggcccauuugugggcucgccaccuucaggcuuccccagccaug

SEQ ID NO: 57627 - RNA, 64 nt, Human
ggaauacaggaaguagcccugcaccugccagugagcucgccauucacugauuggaagagugacc

SEQ ID NO: 57628 - RNA, 64 nt, Human
agacaauguaaagagagaacaucucacacacccagcucgccaugccuacucauuccugaauuuc

SEQ ID NO: 57629 - RNA, 64 nt, Human
ugcauaugagccagacggccuguguauuguuuaagcucgccaagucuguguugcugugaaauga

SEQ ID NO: 57630 - RNA, 64 nt, Human
aaaggcgcccccgccccaggcuuccgcgcccagcgcucgccacgcucagugcccguuuuaccaa

SEQ ID NO: 57631 - RNA, 64 nt, Human
ccgcuugccagaggcccucggucagcgacuggaugcucgccaucaagguccaguggaaguucuu

SEQ ID NO: 57632 - RNA, 64 nt, Human
cagcauccaggugacgugcugucccgcaguagcugcucgccacacaggcuguugaaacucagca

SEQ ID NO: 57633 - RNA, 64 nt, Human
gaucuggaagggccaaggucugagcacuggaguggcucgccaggccaaaucacccuuagaaggc

SEQ ID NO: 57634 - RNA, 64 nt, Human
aguguaacagcaugcagguugaauugccaaggaugcucgccaugccagccuuucuguuuuccuc

SEQ ID NO: 57635 - RNA, 64 nt, Human
agugaaaaaaaaaagcucuggacaccuuuaauaagcucgccacuguuuuuuguaguguagacaa

SEQ ID NO: 57636 - RNA, 50 nt, Human
ucauggaugaagaauccugagcucgccaauaagcuucuugguucuacuuc

SEQ ID NO: 57637 - RNA, 64 nt, Human
cagcccugaggauggcaucuagugugcccgugcguggccauacccugccucccucucuggcccu

SEQ ID NO: 57638 - RNA, 64 nt, Human
ggcggcuccccuguuuaucuagagccuucguuccuggccauaccccggacugcccuccugugcc

SEQ ID NO: 57639 - RNA, 64 nt, Human
ugcuuggcuggggagccccccaggccagguuugcuggccauagauaccuuugggcugccuggga

SEQ ID NO: 57640 - RNA, 64 nt, Human
gcaguaaauaauacauccuuucacucagcagagauggccauauuaaacacguuuugcuauguua

SEQ ID NO: 57641 - RNA, 64 nt, Human
aucuaagcaguggcaucugagugggcccagcacauggccauagaggcccaggcaccaccaggag

SEQ ID NO: 57642 - RNA, 64 nt, Human
uuuuuuuucuguuccaaagauucauccuaugggguggccauaaagucuagaauuagauacuaau

SEQ ID NO: 57643 - RNA, 64 nt, Human
aggauuacacaaaaaguaucacaaaggauggucuuggccauaugcuagggccccugugaaaaua

SEQ ID NO: 57644 - RNA, 64 nt, Human
ggaucauuugcuuccuacccagcucaaucugcccuggccauagggcuucccagggaaggaagaa

SEQ ID NO: 57645 - RNA, 64 nt, Human
auugagacaaccaggugcauaauugauugcccuuuggccauaaaaaugcagugucauggaucuu

SEQ ID NO: 57646 - RNA, 64 nt, Human
gguucucaaauaucaguuaaaaacuaauuuuagguggccauaaacauaaaauagaaacccugua

SEQ ID NO: 57647 - RNA, 64 nt, Human
auauauggacuaaacguagcccugugcuguaucauggccauaguauauuguaaccuuugucuaa

SEQ ID NO: 57648 - RNA, 64 nt, Human
ucucccuugucagcaggggcguaagggcuggguuuggccauacaagguuggcuacgcccucaau

SEQ ID NO: 57649 - RNA, 64 nt, Human
cagaugaccauugcuagcaagaaacaggaggcgguggccauauuccaaaaaccacuucuguccc

SEQ ID NO: 57650 - RNA, 64 nt, Human
auauucacaauuauauccagagcauaauuuuccauggccauaguuugagccacagagaaagcca

SEQ ID NO: 57651 - RNA, 64 nt, Human
uaaauuauagaauguaguuggguggauuuugggguggccauauaguaauggaaagcugcaauaa

SEQ ID NO: 57652 - RNA, 64 nt, Human
ggaugggucugauuucuuggcccucuucuugaauuggccauauacagggucccuggccagugga

SEQ ID NO: 57653 - RNA, 64 nt, Human
agugcaucuccagccuaugaaacagcugggucuuuggccauaagaaguaaagauuugaagacag

SEQ ID NO: 57654 - RNA, 64 nt, Human
cuggcaagauaaacacuuucuggaacccgagacuuggccauaaagauaaugcugcauuuuucug

SEQ ID NO: 57655 - RNA, 64 nt, Human
caaggcuugggggcuggacucccucuacucccucuggccauagccccuccuggagaugggguca

SEQ ID NO: 57656 - RNA, 64 nt, Human
uggcuuccuggaguugauggaauaaagguugggguggccauaaugguuuguugggggugaggga

SEQ ID NO: 57657 - RNA, 64 nt, Human
auauaagacaagaauauguucacaucuugguauguggccauauuuauagaaugcugaacucaau

SEQ ID NO: 57658 - RNA, 64 nt, Human
uuuugauuuugcagaaaaagccaccacgugagaauggccauaagcagauaaguagcaguucaac

SEQ ID NO: 57659 - RNA, 64 nt, Human
gcaacuuuucacugaauuugauagauuuuauguuuggccauaucuucaugcucacauuugauuu

SEQ ID NO: 57660 - RNA, 64 nt, Human
aauuguagaugcuugcuuuuuguuuuuucaaucauggccauauuaugaaaauacuaacaggaua

SEQ ID NO: 57661 - RNA, 64 nt, Human
gugugaauauuugagaggucauaagcagugguuuuggccauaccguauuauaccauauacauca

SEQ ID NO: 57662 - RNA, 64 nt, Human
acucucacagggcauggagguuuucgaaugaacuuggccauaagaauaaauucagaguugacag

SEQ ID NO: 57663 - RNA, 64 nt, Human
aggucuauauggaaaaguuaccauuaggaaaauauggccauacugcuuuuuuaccccugcacua

SEQ ID NO: 57664 - RNA, 64 nt, Human
cagauccagggccuuucaaacauccccaaagucauggccauacucaccauuagccaguuucuaa

SEQ ID NO: 57665 - RNA, 64 nt, Human
caguuuccaacaccuucauuauuaauguuaagaauggccauauaccacuucauuuacguaaaag

SEQ ID NO: 57666 - RNA, 64 nt, Human
guccauauucaggaaucugagaguguaaaaaagguggccauaagacagagagagaauaaucgug

SEQ ID NO: 57667 - RNA, 64 nt, Human
aguguccuggccgcuguccucccggggcccaugauggccauagauuugccuugugguguuggau

SEQ ID NO: 57668 - RNA, 64 nt, Human
augauggguagaagcuccuugagaaaccuagcaguggccauagagaaguagacuggguaugggg

SEQ ID NO: 57669 - RNA, 64 nt, Human
cucacagagcaccccaguuccucaccagcuacucuggccauauaucccacaccagaaggaacaa

SEQ ID NO: 57670 - RNA, 64 nt, Human
ccuaugccuaucuuucaaauugguguggauuucauggccauaguacuuuaccuguugaacucuu

SEQ ID NO: 57671 - RNA, 64 nt, Human
aagcaacacagaggaauuuauaccucaaacuaucuggccauauuuacuaccuuaucacugcauu

SEQ ID NO: 57672 - RNA, 64 nt, Human
uuucuaaaaacguugguugaaggaccuaaauaccuggccauaccauagauuugggaugauguag

SEQ ID NO: 57673 - RNA, 64 nt, Human
cauauauguaaaacauacacauguaaaauauauguggccauaaauuaggcaauaaucaucuaaa

SEQ ID NO: 57674 - RNA, 64 nt, Human
aaauucccguuuugucacuuuuucugauaaaagauggccauauuaccccuuuucggccccaugu

SEQ ID NO: 57675 - RNA, 64 nt, Human
cugcccucugcacuaagcacuuuccaggcaggccuggccauagggcaagagcaggccuuacagc

SEQ ID NO: 57676 - RNA, 64 nt, Human
ccagaguugcaguuguaacuguugccaggacacauggccauaaauaauagaaagaaagcuacaa

SEQ ID NO: 57677 - RNA, 64 nt, Human
gaacuugcuuagggagucaugccacuccccacuguggccauaguuucucuuccuguaaaauuuu

SEQ ID NO: 57678 - RNA, 64 nt, Human
gaaguguguucuguccauacaauggaauauuauuuggccauaaaaaggaaggaaauucugacgc

SEQ ID NO: 57679 - RNA, 64 nt, Human
aauuaaaauaccaugguaauauuugcaaaaggucuggccauaccagaaaaguacaguugagaua

SEQ ID NO: 57680 - RNA, 64 nt, Human
aaauauuaaauuacacaauuacacuugucuuuacuggccauacaaaaugauuuuuuuuuuuuuu

SEQ ID NO: 57681 - RNA, 64 nt, Human
guguaaaagcacaaagugcauguguacucacuucuggccauauaacauuuacacagggaaaugg

SEQ ID NO: 57682 - RNA, 64 nt, Human
guggggaaugaagagauaauaaauaaaacuagauuggccauauguuuauaauuuuuuuagauug

SEQ ID NO: 57683 - RNA, 64 nt, Human
agagcuaacagagagaucauuauuucuuaaagauuggccauaaccuguauuuugauagaauuag

SEQ ID NO: 57684 - RNA, 64 nt, Human
cucuugaaauauggaaauuuugucugaagaucaguggccauauuacuguaggcccugguucaug

SEQ ID NO: 57685 - RNA, 64 nt, Human
ugcucugccgccuucuuaucugaacuagaugaauuggccauaauuaugaauaggaauauuaaug

SEQ ID NO: 57686 - RNA, 64 nt, Human
aaacacaagagacuuaaaggacaggaggaggagauggccauaggagaggaggguuccucuuagg

SEQ ID NO: 57687 - RNA, 64 nt, Human
uguaauuuuacauuucugcauuuuuaaaacaguuuggccauaauccuagaugcacgcuucuaau

SEQ ID NO: 57688 - RNA, 64 nt, Human
aggccacugcccagguccccagugcgcccccuaguggccauagccugguuaaaguuccccagug

SEQ ID NO: 57689 - RNA, 64 nt, Human
uuggagcagcuuuuggcugcguaacugugaacuauggccauauauaauuuuuuuucauuaauuu

SEQ ID NO: 57690 - RNA, 64 nt, Human
aaccugggaacagucacaagggagugugacuucuuggccauaauaaacucacucgauaguguuu

SEQ ID NO: 57691 - RNA, 64 nt, Human
aacuugaacuacaaauuaccuccauguauauuauuggccauaguuaacuagaaaguuauaaaua

SEQ ID NO: 57692 - RNA, 64 nt, Human
uugugaaacugcuaauauuagcuugucauaauuauggccauaaacuaauuuuucuauaaaagac

SEQ ID NO: 57693 - RNA, 64 nt, Human
uguggccugcugcccgccccccccccccccacaguggccauacgggcacaggagaccuuuuaug

SEQ ID NO: 57694 - RNA, 64 nt, Human
uaucuguaaauaagguuucauuggaacacagcuguggccauauguuuguauauuguguguggcu

SEQ ID NO: 57695 - RNA, 64 nt, Human
cauauuaacaaaauugggugcauucagggugguauggccauagaccagagcaacacauugaaau

SEQ ID NO: 57696 - RNA, 64 nt, Human
ggugcccaggaacccugcuucuccucacagggccuggccauauagccagcuccaacccaaagcc
